United States Patent 7,709,616 (MICRORNAS AND USES THEREOF) - sequence listing, part 9

SEQ ID NO: 236496 - RNA, 64 nt, hsa; identical to SEQ ID NO: 236342

SEQ ID NO: 236497 - RNA, 64 nt, hsa; identical to SEQ ID NO: 236343

SEQ ID NO: 236498 - RNA, 64 nt, hsa; identical to SEQ ID NO: 236344

SEQ ID NO: 236499 - RNA, 64 nt, hsa; identical to SEQ ID NO: 236345

SEQ ID NO: 236500 - RNA, 64 nt, hsa; identical to SEQ ID NO: 236346

SEQ ID NO: 236501 - RNA, 64 nt, hsa; identical to SEQ ID NO: 236347

SEQ ID NO: 236502 - RNA, 64 nt, hsa; identical to SEQ ID NO: 236348

SEQ ID NO: 236503 - RNA, 64 nt, hsa; identical to SEQ ID NO: 236349

SEQ ID NO: 236504 - RNA, 64 nt, hsa; identical to SEQ ID NO: 236350

SEQ ID NO: 236505 - RNA, 64 nt, hsa; identical to SEQ ID NO: 236351

SEQ ID NO: 236506 - RNA, 64 nt, hsa; identical to SEQ ID NO: 236352

SEQ ID NO: 236507 - RNA, 64 nt, hsa; identical to SEQ ID NO: 236353

SEQ ID NO: 236508 - RNA, 53 nt, hsa; identical to SEQ ID NO: 236354

SEQ ID NO: 236509 - RNA, 64 nt, hsa; identical to SEQ ID NO: 236355

SEQ ID NO: 236510 - RNA, 64 nt, hsa; identical to SEQ ID NO: 236356

SEQ ID NO: 236511 - RNA, 64 nt, hsa; identical to SEQ ID NO: 236357

SEQ ID NO: 236512 - RNA, 64 nt, hsa; identical to SEQ ID NO: 236358

SEQ ID NO: 236513 - RNA, 64 nt, hsa; identical to SEQ ID NO: 236359

SEQ ID NO: 236514 - RNA, 64 nt, hsa; identical to SEQ ID NO: 236360

SEQ ID NO: 236515 - RNA, 64 nt, hsa; identical to SEQ ID NO: 236361

SEQ ID NO: 236516 - RNA, 64 nt, hsa; identical to SEQ ID NO: 236362

SEQ ID NO: 236517 - RNA, 64 nt, hsa; identical to SEQ ID NO: 236363

SEQ ID NO: 236518 - RNA, 64 nt, hsa; identical to SEQ ID NO: 236364

SEQ ID NO: 236519 - RNA, 50 nt, hsa; identical to SEQ ID NO: 236365

SEQ ID NO: 236520 - RNA, 64 nt, hsa; identical to SEQ ID NO: 236366

SEQ ID NO: 236521 - RNA, 64 nt, hsa; identical to SEQ ID NO: 236367

SEQ ID NO: 236522 - RNA, 64 nt, hsa; identical to SEQ ID NO: 236368

SEQ ID NO: 236523 - RNA, 64 nt, hsa; identical to SEQ ID NO: 236369

SEQ ID NO: 236524 - RNA, 64 nt, hsa; identical to SEQ ID NO: 236370

SEQ ID NO: 236525 - RNA, 64 nt, hsa; identical to SEQ ID NO: 236371

SEQ ID NO: 236526 - RNA, 64 nt, hsa; identical to SEQ ID NO: 236372

SEQ ID NO: 236527 - RNA, 64 nt, hsa; identical to SEQ ID NO: 236373

SEQ ID NO: 236528 - RNA, 64 nt, hsa; identical to SEQ ID NO: 236374

SEQ ID NO: 236529 - RNA, 64 nt, hsa; identical to SEQ ID NO: 236375

SEQ ID NO: 236530 - RNA, 64 nt, hsa; identical to SEQ ID NO: 236376

SEQ ID NO: 236531 - RNA, 64 nt, hsa; identical to SEQ ID NO: 236377

SEQ ID NO: 236532 - RNA, 64 nt, hsa; identical to SEQ ID NO: 236378

SEQ ID NO: 236533 - RNA, 64 nt, hsa; identical to SEQ ID NO: 236379

SEQ ID NO: 236534 - RNA, 64 nt, hsa; identical to SEQ ID NO: 236380

SEQ ID NO: 236535 - RNA, 64 nt, hsa; identical to SEQ ID NO: 236381

SEQ ID NO: 236536 - RNA, 64 nt, hsa; identical to SEQ ID NO: 74555

SEQ ID NO: 236537 - RNA, 64 nt, hsa; identical to SEQ ID NO: 74556

SEQ ID NO: 236538 - RNA, 64 nt, hsa; identical to SEQ ID NO: 74557

SEQ ID NO: 236539 - RNA, 64 nt, hsa; identical to SEQ ID NO: 74558

SEQ ID NO: 236540 - RNA, 64 nt, hsa; identical to SEQ ID NO: 74559

SEQ ID NO: 236541 - RNA, 64 nt, hsa; identical to SEQ ID NO: 74560

SEQ ID NO: 236542 - RNA, 64 nt, hsa
ggagagacagcauaccugaaaccugcaaggaaccgguuuauaaaacaacagaacagccaggaaa

SEQ ID NO: 236543 - RNA, 64 nt, hsa
gccuuuccugggaagggcaguuugcagaaccagggguuuauauugcagggaguguauuuucuga

SEQ ID NO: 236544 - RNA, 64 nt, hsa
ccacauccggugacaucaugagacaugcuucuuugguuuauaaugagauguuuacaguuaaaua

SEQ ID NO: 236545 - RNA, 64 nt, hsa
agaacaguaagaagacuuuaccauugcaugccaugguuuauaaucuaagauaggcaauagugua

SEQ ID NO: 236546 - RNA, 64 nt, hsa
ugggguugaugugaacauuuuauguuacucauuugguuuauacuuuuuuuuuuuuuuuuuuaac

SEQ ID NO: 236547 - RNA, 64 nt, hsa
uucucuuguuacauuugaagcaguugauauaauggguuuauacuuuaaaagauagacauggugc

SEQ ID NO: 236548 - RNA, 64 nt, hsa
uggaaaaaaacauuucagaagugaaggcuuuugagguuuauaaaaugguagcagucuuaguccu

SEQ ID NO: 236549 - RNA, 64 nt, hsa
cuaucuguguucagggaaugauuugcaagaaguugguuuauagacguuuacucuggaggcacaa

SEQ ID NO: 236550 - RNA, 64 nt, hsa
augcacugcccuugucuaaaguucuuauugcacugguuuauauguguauguguguuuuauugug

SEQ ID NO: 236551 - RNA, 64 nt, hsa
cccucagaacugaagagguucagagaacuuuccagguuuauacuauaccucaagaccacauaga

SEQ ID NO: 236552 - RNA, 51 nt, hsa
gcuuucucaaacggccuuaaagguuuauaguuugggaaauuauauauauua

SEQ ID NO: 236553 - RNA, 64 nt, hsa
gggugguuaauuaaaaugaaccagauaucagggugguuuauaaagccuguaaacacaccuaaga

SEQ ID NO: 236554 - RNA, 64 nt, hsa
uauaacuucgucucacaaauaguguagguaucuggguuuauauacuaaaauuaaggguggagaa

SEQ ID NO: 236555 - RNA, 64 nt, hsa
uaacuuaaugucuugucaaauacuuuuauugauugguuuauaugccauucuuguuauagaagaa

SEQ ID NO: 236556 - RNA, 64 nt, hsa
aauggagaccugaauaauucuguguaauauaaaugguuuauaacugcuuuuguaccuagcuagg

SEQ ID NO: 236557 - RNA, 64 nt, hsa
guugcuguugauugaagauguauauaauaucuccgguuuauaaaaccuauuuauaacacuuuuu

SEQ ID NO: 236558 - RNA, 64 nt, hsa
ugucuauccuucauagugcccucuacuuuuaaaggguuuauauguugaaaaacugcuguggccu

SEQ ID NO: 236559 - RNA, 64 nt, hsa
uuggcacaccuaggcuguuaacaaaucucaaagagguuuauaaaaacguauagaauacuuggaa

SEQ ID NO: 236560 - RNA, 64 nt, hsa
aaugcauugugaacuguaaaagcaaaguaucaauaaagcuuauagacuuaaaauaugcuuuggu

SEQ ID NO: 236561 - RNA, 64 nt, hsa
aguaaauauagauuauauauguauaguguuucacaaagcuuagaccuuuaccuuccagccaccc

SEQ ID NO: 236562 - RNA, 64 nt, hsa
aaauagcauugaagaaaauaccgcacaucagaggaaagcuuauuuucugcauggugucuuuuca

SEQ ID NO: 236563 - RNA, 64 nt, hsa
aguuauccaaucaccaaauccauggcuuuuucucaaagcuuagucuuguccuuggcagaacugg

SEQ ID NO: 236564 - RNA, 64 nt, hsa
acuaagugguacuagggaacuacaagaauacuguaaagcuuaagccauuguuaucacugucauu

SEQ ID NO: 236565 - RNA, 64 nt, hsa
ccgucaaaggcagaaucugucacuugaaugaaggaaagcuuaaagcccaagcagauaaaaauaa

SEQ ID NO: 236566 - RNA, 64 nt, hsa
ucuuaauuguuaauuugaagaacacauuaaccagaaagcuuaaacauuauuauuaaaauaaauu

SEQ ID NO: 236567 - RNA, 64 nt, hsa
uauguauauauuuaauaaagaguacuuguacaaaaaagcuuaucauaaauuauuucaugaaugu

SEQ ID NO: 236568 - RNA, 64 nt, hsa
guuugccugcaaguaaagaauugagagugugugcaaagcuuauuuucuuuuaucugggcaaaaa

SEQ ID NO: 236569 - RNA, 64 nt, hsa
caucugcaacaaaaagucauuuuucuggaguggaaaagcuuaaaaaaauuacugugaauuguuu

SEQ ID NO: 236570 - RNA, 64 nt, hsa
acaaaugcuuagucucagcagccuccgggggaaaaaagcuuagccuagcagucagugacuuacu

SEQ ID NO: 236571 - RNA, 64 nt, hsa
gcaagaaaggcacuucagugaauaugugacuaguaaagcuuaaauauguuuggaucuaauagag

SEQ ID NO: 236572 - RNA, 64 nt, hsa
gaacauuagccuagaaguuuuugcuuugcuaguuaaagcuuacuuugcagagcuucccaaagug

SEQ ID NO: 236573 - RNA, 64 nt, hsa
uauuuuaucacaagcaacucuucaagauguugcaaaagcuuacauuuuuccuuaaaaggaaaac

SEQ ID NO: 236574 - RNA, 64 nt, hsa
guggagaggcgagaggugagcuacuuugugagccaaagcuuaugugacaugguuggggaaacag

SEQ ID NO: 236575 - RNA, 64 nt, hsa
gacaccacacauuuaauucagcuuuguccaaaggaaagcuuaaaacccaauacagucuaguuuc

SEQ ID NO: 236576 - RNA, 64 nt, hsa
gugaaaccuuugccaucuucauguuuuauaauauaaagcuuacccaacaccaguuaagccaugg

SEQ ID NO: 236577 - RNA, 64 nt, hsa
gguauuguauuuuuuauaaauaagauuuuuauguaaagcuuagaauuugauuuacagggaccuu

SEQ ID NO: 236578 - RNA, 64 nt, hsa
accacgcuagggcuggcucaauugaaagugggcaaaagcuuacaaauacuaaaaagaagugcug

SEQ ID NO: 236579 - RNA, 64 nt, hsa
caagucacuuagguaguaccaaaauaaauaaggaaaagcuuagcuuuagaaacagugcaacacu

SEQ ID NO: 236580 - RNA, 64 nt, hsa
cuugccucuuguccugcuggaaagauagcaguguucuccugacuucgcccuacugcaugcagcc

SEQ ID NO: 236581 - RNA, 64 nt, hsa
uggaguuucaccauguuggccaggguggucucaaucuccugaccucgugauccacccaccucga

SEQ ID NO: 236582 - RNA, 64 nt, hsa
cccagaccucuuuaguuugggggauccuccucacucuccugaagugucucaaguauaccagugg

SEQ ID NO: 236583 - RNA, 64 nt, hsa
cuaagcuugagauagggggcugugguccuuccuuucuccugaggagaaaguccuugcucuggug

SEQ ID NO: 236584 - RNA, 64 nt, hsa
cgggguuucaccauguuggccaggauggucucgaucuccugaccucgugauccacccgacucgg

SEQ ID NO: 236585 - RNA, 64 nt, hsa
agcccuaaacaucauucuugagagcauugggauaucuccugaaaagguuuaugaaaaagaagaa

SEQ ID NO: 236586 - RNA, 64 nt, hsa
auuaaugacaacuggugggaaaccuagcauuuccucuccugaagaauaaauguauaaauguuau

SEQ ID NO: 236587 - RNA, 64 nt, hsa
ucuuguguagcuggucagggacuuuuuuuucuuuucuccugaacuacaugauucuaauuggaau

SEQ ID NO: 236588 - RNA, 64 nt, hsa
ucacaacaucugcucuucggguuccaccaaagagucuccugagcccugagggauggaugucucc

SEQ ID NO: 236589 - RNA, 64 nt, hsa
accaaagagucuccugagcccugagggauggaugucuccugacccuuccaccccgccucacucc

SEQ ID NO: 236590 - RNA, 64 nt, hsa
aggaucucuuguucucuccugagugucuuucuacucuccugagcgucuuucugcucuccuuauc

SEQ ID NO: 236591 - RNA, 64 nt, hsa
uccucauaauaagaaugggcaggaucucuuguucucuccugagugucuuucuacucuccugagc

SEQ ID NO: 236592 - RNA, 64 nt, hsa
cucuuuauaucugguuuucccacuugucugaagcucuccugaucuuagaaccuggagcugcaga

SEQ ID NO: 236593 - RNA, 64 nt, hsa
ugggguuucacuguguuagccaggauggucucgaucuccugaccucgugauccgcccaccuugg

SEQ ID NO: 236594 - RNA, 64 nt, hsa
uuuuucaaggauucuaauaaauaucccgcagucaucuccugagcagcuuuccucuguuucacuu

SEQ ID NO: 236595 - RNA, 64 nt, hsa
uauucaguauuauucuuguuuucugaauucugagucuccugaacaaaaggcuuacuauccaugg

SEQ ID NO: 236596 - RNA, 64 nt, hsa
cauauucagguaccaccuuugacguguggcucuuucuccugaccaucaugggaagugucugcug

SEQ ID NO: 236597 - RNA, 64 nt, hsa
auguuccugaauuucaaauaccucaugcaaaaugucuccugaaauaagggaaaaaaaaaaaacc

SEQ ID NO: 236598 - RNA, 64 nt, hsa
auaaagggcucugccccuuuaacuccucacucuuucuccugaagccuugugaagaaggugcuuu

SEQ ID NO: 236599 - RNA, 64 nt, hsa
gauuggaucaugggggugguuuccccuacgauguucuccugauagugggugaguucucacaaga

SEQ ID NO: 236600 - RNA, 64 nt, hsa
ucccaccacauggacaugccuuacacuggcguccucuccugagucccuccgcacucuccaucag

SEQ ID NO: 236601 - RNA, 64 nt, hsa
gccccugccccagcuccucucugcaacccagcccucuccugagcucuaggcugggauuacaccc

SEQ ID NO: 236602 - RNA, 64 nt, hsa
auuguucacauuucuauucuaaaaucucagguuaucuccugaacacuuuugggcagaugaaguu

SEQ ID NO: 236603 - RNA, 64 nt, hsa
ugaaguuucaccguguuggccaggauggucuugaucuccugaccgcauaauccacccaccucgg

SEQ ID NO: 236604 - RNA, 64 nt, hsa
cucagaucaccaggucaagcaccuaggccuggcuucuccugagacagaggacucagaaguggcc

SEQ ID NO: 236605 - RNA, 64 nt, hsa
acaggauuuacuggggugggcugguccagguagcucuccugaaccuccuccuuccccaagcuga

SEQ ID NO: 236606 - RNA, 64 nt, hsa
aguggccguguugucccagugcccugguucagugucuccugaguggaugacaggucuucauucu

SEQ ID NO: 236607 - RNA, 64 nt, hsa
uccuuaguucaguucuuuacuguuccucgaauaaucuccugacuaaggcaaaaaaaaaaagcuu

SEQ ID NO: 236608 - RNA, 64 nt, hsa
ccuuuuuuuuuuuuuuuuuuacuggauuucuuuuucuccugauuuucggccucagcuccuagag

SEQ ID NO: 236609 - RNA, 64 nt, hsa
cgggguuucaccauguuagacaggauggucuccaucuccugaguuugugaucugcccgccuugg

SEQ ID NO: 236610 - RNA, 64 nt, hsa
ugggguuucaccauguugaccaggauggucucaaucuccugaccuugugauccacccaccucgg

SEQ ID NO: 236611 - RNA, 64 nt, hsa
cgggguuucaccguguuagccaggauagucuugaucuccugaccucgugauccgcccuccucgg

SEQ ID NO: 236612 - RNA, 64 nt, hsa
cgggguuucaucguguuaaccaggauggucucgaucuccugaccucgugaucugcccaccucgg

SEQ ID NO: 236613 - RNA, 64 nt, hsa
caggguuucaccauguuggccaggauggucucgaucuccugaccuugucauccaccugucuugg

SEQ ID NO: 236614 - RNA, 64 nt, hsa
aaguauaugcaccagcccuugugcauuuauuguuucuccugauuuuguggauuuaaauguccaa

SEQ ID NO: 236615 - RNA, 64 nt, hsa
uauaugcugauauuguacuuuagacauacgcuugucuccugaauguccucugaauauuuauagu

SEQ ID NO: 236616 - RNA, 64 nt, hsa
uuccccucugcuggggacgguaguugcuuuucucucuccugaugcuagguuggggcccacccug

SEQ ID NO: 236617 - RNA, 64 nt, hsa
uguggccccaugcagaugaaaaggacgggcagggucuccugagcagcagguggcucgaggcggu

SEQ ID NO: 236618 - RNA, 64 nt, hsa
aaaggaauggaggcucuaauugaauuuucaagcaucuccugaggaucagaaaguaauuucuucu

SEQ ID NO: 236619 - RNA, 64 nt, hsa
guguuaagaguuagguuuaacauaaagguuauuuucuccugauauagaucacauaacagaaugc

SEQ ID NO: 236620 - RNA, 64 nt, hsa; identical to SEQ ID NO: 126132

SEQ ID NO: 236621 - RNA, 64 nt, hsa; identical to SEQ ID NO: 126133

SEQ ID NO: 236622 - RNA, 64 nt, hsa; identical to SEQ ID NO: 126134

SEQ ID NO: 236623 - RNA, 64 nt, hsa; identical to SEQ ID NO: 126135

SEQ ID NO: 236624 - RNA, 64 nt, hsa; identical to SEQ ID NO: 126136

SEQ ID NO: 236625 - RNA, 64 nt, hsa; identical to SEQ ID NO: 126137

SEQ ID NO: 236626 - RNA, 64 nt, hsa; identical to SEQ ID NO: 126138

SEQ ID NO: 236627 - RNA, 64 nt, hsa; identical to SEQ ID NO: 126139

SEQ ID NO: 236628 - RNA, 64 nt, hsa; identical to SEQ ID NO: 126140

SEQ ID NO: 236629 - RNA, 64 nt, hsa; identical to SEQ ID NO: 126141

SEQ ID NO: 236630 - RNA, 64 nt, hsa; identical to SEQ ID NO: 126142

SEQ ID NO: 236631 - RNA, 64 nt, hsa; identical to SEQ ID NO: 126143

SEQ ID NO: 236632 - RNA, 64 nt, hsa; identical to SEQ ID NO: 126144

SEQ ID NO: 236633 - RNA, 64 nt, hsa; identical to SEQ ID NO: 126145

SEQ ID NO: 236634 - RNA, 64 nt, hsa; identical to SEQ ID NO: 126146

SEQ ID NO: 236635 - RNA, 64 nt, hsa; identical to SEQ ID NO: 126147

SEQ ID NO: 236636 - RNA, 64 nt, hsa; identical to SEQ ID NO: 126148

SEQ ID NO: 236637 - RNA, 64 nt, hsa; identical to SEQ ID NO: 126149

SEQ ID NO: 236638 - RNA, 64 nt, hsa; identical to SEQ ID NO: 126150

SEQ ID NO: 236639 - RNA, 64 nt, hsa; identical to SEQ ID NO: 126151

SEQ ID NO: 236640 - RNA, 64 nt, hsa; identical to SEQ ID NO: 126152

SEQ ID NO: 236641 - RNA, 64 nt, hsa; identical to SEQ ID NO: 126153

SEQ ID NO: 236642 - RNA, 64 nt, hsa
aggagaaaauagauaagcaaugaauuuaucuccaacuuccuaaaggcuuaugacuucuaaaaag

SEQ ID NO: 236643 - RNA, 64 nt, hsa
uguaacuuuccaaguaaaggugucccuaaagaccacuuccuaucugguuuuucccaguaaauga

SEQ ID NO: 236644 - RNA, 64 nt, hsa
cacguggccaagagaaacuuccuagggggcuaagacuuccuagacugugcuaagagaugucaug

SEQ ID NO: 236645 - RNA, 64 nt, hsa
gaaugcgaaauucaccaacacguggccaagagaaacuuccuagggggcuaagacuuccuagacu

SEQ ID NO: 236646 - RNA, 64 nt, hsa
gcaucguggugggggaggagccucuggcuucccuaaacugcagccucucuggcuggucuucacu

SEQ ID NO: 236647 - RNA, 64 nt, hsa
uguggaguuugacaccuuagagaagcuaccccucaaacugcacaucuacacacaaacaaacaau

SEQ ID NO: 236648 - RNA, 64 nt, hsa
caagaccccaucucuauaaaaagaaaaaauaaagaaacugcagcgccuuagaccugagguguca

SEQ ID NO: 236649 - RNA, 64 nt, hsa
augcugagaauuuguauugaugaaccucuuuuagaaacugcagagggcugggcacggugguuua

SEQ ID NO: 236650 - RNA, 64 nt, hsa
caucuaucaccucuagaagguuccagagacagugaaacugcaagaugcucucaacaggauuaug

SEQ ID NO: 236651 - RNA, 64 nt, hsa
uguaaaaggcaggagacaugugauuaugaucaggaaacugcacaaaauuauuguuuucagcccc

SEQ ID NO: 236652 - RNA, 64 nt, hsa
uucgagcaggacuaacaacugggaaauaagcaaaaaacugcaucgauccccagccugguguugu

SEQ ID NO: 236653 - RNA, 64 nt, hsa
ucucuuugccaagggaggggagaaaggaacuuuuaaacugcaguuuuaacuuuuucuaagcugu

SEQ ID NO: 236654 - RNA, 64 nt, hsa
gaccacagcaccacuuagguguagcauggauuuuaaacugcagucaguaucagauccuguuuga

SEQ ID NO: 236655 - RNA, 62 nt, hsa
caaugauuuccuuccugccaaaaauaaacaugugaaacugcacucuuuuguggauugacuac

SEQ ID NO: 236656 - RNA, 64 nt, hsa
uuuaugaaacagccaucuuaaaaaaaaaaaaaguaaacugcaaaaguacaaaaucauuuuucaa

SEQ ID NO: 236657 - RNA, 64 nt, hsa
ccaucccagugaugccuuauuugaaacugggcuuaaacugcaaaaagaaugaaguuggauuuag

SEQ ID NO: 236658 - RNA, 64 nt, hsa
acauuucacacacauauacuuauuauucaaguugaaacugcacucuaaucaaucugagucuauu

SEQ ID NO: 236659 - RNA, 64 nt, hsa
ucuaaauuccagauuuuaaggaagauuuuucaagaaacugcaaguuuuugacuugaaggaaaga

SEQ ID NO: 236660 - RNA, 64 nt, hsa
ccaucucagcagggaagaacaaccuucucaaccaaaacugcaaucaggaaagcagcagcccacu

SEQ ID NO: 236661 - RNA, 64 nt, hsa
aaagguuuucucauugcauccauacugugagaauaaacugcagacugaaagaaacaugccugca

SEQ ID NO: 236662 - RNA, 50 nt, hsa
gcacacaacuguggaaaugaaaacugcaauacaaguuucauccagaacua

SEQ ID NO: 236663 - RNA, 64 nt, hsa
aacauccucuuccauauggauccacuggcuggacaaacugcaccaguugcugcuucaauuuaua

SEQ ID NO: 236664 - RNA, 64 nt, hsa
gcgacucucuauggaaaacgaggagcuucuguggaaacugcacaauggggaccuguguagcccc

SEQ ID NO: 236665 - RNA, 64 nt, hsa
aagccugaaagcuguguuagagaucaagaaugagaaacugcaucaacaggacaucaaguuaaug

SEQ ID NO: 236666 - RNA, 64 nt, hsa
uuuuuuaaaccccaaggaaagccuacauccuugaaaacugcacagucgucaugggugaauuugc

SEQ ID NO: 236667 - RNA, 64 nt, hsa
aaggaucugaaagaucuaaacauggugugcuuagaaacugcagauuuuagaucuaauguauacu

SEQ ID NO: 236668 - RNA, 64 nt, hsa
auucacuuaaagguaccucuguagaaauaaccuaaaacugcagaaggaucugaaagaucuaaac

SEQ ID NO: 236669 - RNA, 64 nt, hsa
guuuauuugaaagauaaugucuucucaaaaucagaaacugcagugguaauuaaauuaauagaaa

SEQ ID NO: 236670 - RNA, 64 nt, hsa
cugcagugguaauuaaauuaauagaaaagagaacaaacugcagguuuagaaaaaugguuuucau

SEQ ID NO: 236671 - RNA, 64 nt, hsa
uuuucuucggcuugaguucaccaucucuucauucaaacugcacuuuuagccagagaugcaauau

SEQ ID NO: 236672 - RNA, 64 nt, hsa
cauucauuuguuuuuucaauguuugaaauaguucaaacugcagcuaacccuagucaaaacuauu

SEQ ID NO: 236673 - RNA, 64 nt, hsa
ccacauucuuuuuguauccaaauagugcugcuagaaacugcacugaaguggcugaggauagguu

SEQ ID NO: 236674 - RNA, 64 nt, hsa
cugggcucuacauuuccuacuaguuuguguccagaaacugcaaguugacaugaauagaggacaa

SEQ ID NO: 236675 - RNA, 64 nt, hsa
gucuuguaucuaaaguggauacaagcguauguuuaaacugcaagauuuuuacuugcuagagaau

SEQ ID NO: 236676 - RNA, 64 nt, hsa
aggaaaaacagcaaaacaaaaagcaaacaaaaaaaaacugcaaaagucuaaaauacccauuggu

SEQ ID NO: 236677 - RNA, 64 nt, hsa
uguuuacaagaaggccacggugcucuuagcauucaaacugcagauacuaaacagaugcugugau

SEQ ID NO: 236678 - RNA, 64 nt, hsa
acacaaaucuuucacuaggcaccgggcacagggaaaacugcagggaacaagaguuguaguguua

SEQ ID NO: 236679 - RNA, 64 nt, hsa
uuuuaaaugccucaucuguuguacugaacaauugaaacugcaugcagccauaaaagggacaaga

SEQ ID NO: 236680 - RNA, 64 nt, hsa
auaaacaggaucuaagacuggauucccugucacuaaacugcaccacuauaccugucucucugug

SEQ ID NO: 236681 - RNA, 64 nt, hsa
ucuucccagcuggcuggggacugucuuggguuuaaaacugcaagucuccuacccugggauccca

SEQ ID NO: 236682 - RNA, 64 nt, hsa
ccgugucacucugugaccugucccauggauccugaaacugcaucuuggcccuguugccugggcu

SEQ ID NO: 236683 - RNA, 64 nt, hsa
cuaaaaauauucauguagcaaaucugagaauugaaaacugcagauaaccggccggguaugguga

SEQ ID NO: 236684 - RNA, 64 nt, hsa
aaaaaaaaaaaaaaaacagaaagaaagaaaaagaaaacugcagauaacccuauacauuaauacu

SEQ ID NO: 236685 - RNA, 64 nt, hsa
aaggaggcuucauggggcagacccugaaagaucaaaacugcauuugcaaagcccuccccugucc

SEQ ID NO: 236686 - RNA, 64 nt, hsa
uugaauccugcaagcacauuccaagacuggccugaaacugcaugagcaacaucacucgaaauaa

SEQ ID NO: 236687 - RNA, 64 nt, hsa
gaucugcaaaauaaagauaccacaauucaucuuaaaacugcagagauuuaaugugucagggaau

SEQ ID NO: 236688 - RNA, 64 nt, hsa
aaugaucuguuuuucaguuaugacauagaaaaccaaacugcaaguguagacuaugacaaaaaau

SEQ ID NO: 236689 - RNA, 64 nt, hsa
uuaaacucuuccccuccugcuuuagugccaccccaaacugcauuuauaauuuugugacugagga

SEQ ID NO: 236690 - RNA, 64 nt, hsa
auccuugaaaucacacagcuugcaaauacguacuaaacugcacaagguguguguucuauaugug

SEQ ID NO: 236691 - RNA, 64 nt, hsa
aaauaaaaauguauauagcugugagcucaaacaaaaacugcagacaaacaaaaaagagaaaagc

SEQ ID NO: 236692 - RNA, 64 nt, hsa
ccccaccugagcaaccacaaauaggcucuccaugaaacugcaaaggaacugauguguggcaucc

SEQ ID NO: 236693 - RNA, 64 nt, hsa; identical to SEQ ID NO: 236642

SEQ ID NO: 236694 - RNA, 64 nt, hsa; identical to SEQ ID NO: 236643

SEQ ID NO: 236695 - RNA, 64 nt, hsa; identical to SEQ ID NO: 236644

SEQ ID NO: 236696 - RNA, 64 nt, hsa; identical to SEQ ID NO: 236645

SEQ ID NO: 236697 - RNA, 64 nt, hsa; identical to SEQ ID NO: 236646

SEQ ID NO: 236698 - RNA, 64 nt, hsa; identical to SEQ ID NO: 236647

SEQ ID NO: 236699 - RNA, 64 nt, hsa; identical to SEQ ID NO: 236648

SEQ ID NO: 236700 - RNA, 64 nt, hsa; identical to SEQ ID NO: 236649

SEQ ID NO: 236701 - RNA, 64 nt, hsa; identical to SEQ ID NO: 236650

SEQ ID NO: 236702 - RNA, 64 nt, hsa; identical to SEQ ID NO: 236651

SEQ ID NO: 236703 - RNA, 64 nt, hsa; identical to SEQ ID NO: 236652

SEQ ID NO: 236704 - RNA, 64 nt, hsa; identical to SEQ ID NO: 236653

SEQ ID NO: 236705 - RNA, 64 nt, hsa; identical to SEQ ID NO: 236654

SEQ ID NO: 236706 - RNA, 62 nt, hsa; identical to SEQ ID NO: 236655

SEQ ID NO: 236707 - RNA, 64 nt, hsa; identical to SEQ ID NO: 236656

SEQ ID NO: 236708 - RNA, 64 nt, hsa; identical to SEQ ID NO: 236657

SEQ ID NO: 236709 - RNA, 64 nt, hsa; identical to SEQ ID NO: 236658

SEQ ID NO: 236710 - RNA, 64 nt, hsa; identical to SEQ ID NO: 236659

SEQ ID NO: 236711 - RNA, 64 nt, hsa; identical to SEQ ID NO: 236660

SEQ ID NO: 236712 - RNA, 64 nt, hsa; identical to SEQ ID NO: 236661

SEQ ID NO: 236713 - RNA, 50 nt, hsa; identical to SEQ ID NO: 236662

SEQ ID NO: 236714 - RNA, 64 nt, hsa; identical to SEQ ID NO: 236663

SEQ ID NO: 236715 - RNA, 64 nt, hsa; identical to SEQ ID NO: 236664

SEQ ID NO: 236716 - RNA, 64 nt, hsa; identical to SEQ ID NO: 236665

SEQ ID NO: 236717 - RNA, 64 nt, hsa; identical to SEQ ID NO: 236666

SEQ ID NO: 236718 - RNA, 64 nt, hsa; identical to SEQ ID NO: 236667

SEQ ID NO: 236719 - RNA, 64 nt, hsa; identical to SEQ ID NO: 236668

SEQ ID NO: 236720 - RNA, 64 nt, hsa; identical to SEQ ID NO: 236669

SEQ ID NO: 236721 - RNA, 64 nt, hsa; identical to SEQ ID NO: 236670

SEQ ID NO: 236722 - RNA, 64 nt, hsa; identical to SEQ ID NO: 236671

SEQ ID NO: 236723 - RNA, 64 nt, hsa; identical to SEQ ID NO: 236672

SEQ ID NO: 236724 - RNA, 64 nt, hsa; identical to SEQ ID NO: 236673

SEQ ID NO: 236725 - RNA, 64 nt, hsa; identical to SEQ ID NO: 236674

SEQ ID NO: 236726 - RNA, 64 nt, hsa; identical to SEQ ID NO: 236675

SEQ ID NO: 236727 - RNA, 64 nt, hsa; identical to SEQ ID NO: 236676

SEQ ID NO: 236728 - RNA, 64 nt, hsa; identical to SEQ ID NO: 236677

SEQ ID NO: 236729 - RNA, 64 nt, hsa; identical to SEQ ID NO: 236678

SEQ ID NO: 236730 - RNA, 64 nt, hsa; identical to SEQ ID NO: 236679

SEQ ID NO: 236731 - RNA, 64 nt, hsa; identical to SEQ ID NO: 236680

SEQ ID NO: 236732 - RNA, 64 nt, hsa; identical to SEQ ID NO: 236681

SEQ ID NO: 236733 - RNA, 64 nt, hsa; identical to SEQ ID NO: 236682

SEQ ID NO: 236734 - RNA, 64 nt, hsa; identical to SEQ ID NO: 236683

SEQ ID NO: 236735 - RNA, 64 nt, hsa; identical to SEQ ID NO: 236684

SEQ ID NO: 236736 - RNA, 64 nt, hsa; identical to SEQ ID NO: 236685

SEQ ID NO: 236737 - RNA, 64 nt, hsa; identical to SEQ ID NO: 236686

SEQ ID NO: 236738 - RNA, 64 nt, hsa; identical to SEQ ID NO: 236687

SEQ ID NO: 236739 - RNA, 64 nt, hsa; identical to SEQ ID NO: 236688

SEQ ID NO: 236740 - RNA, 64 nt, hsa; identical to SEQ ID NO: 236689

SEQ ID NO: 236741 - RNA, 64 nt, hsa; identical to SEQ ID NO: 236690

SEQ ID NO: 236742 - RNA, 64 nt, hsa; identical to SEQ ID NO: 236691

SEQ ID NO: 236743 - RNA, 64 nt, hsa; identical to SEQ ID NO: 236692

SEQ ID NO: 236744 - RNA, 64 nt, hsa
ucuugugcuuuauccugccccgcuccccaucgccugcccgcagcagcgacgaaacguccaucug

SEQ ID NO: 236745 - RNA, 64 nt, hsa
ggugaggggccagggcaaagggugugccucguccugcccgcacugccucucccaggaacuggaa

SEQ ID NO: 236746 - RNA, 64 nt, hsa
cccugcaguguucgcuuggcuccaugcuccucacugcccgcacacccucacucugccagggcag

SEQ ID NO: 236747 - RNA, 60 nt, hsa
ugaagauccuccacugcugacucugcugccugcccgcacagcagccugcuucccaccucc

SEQ ID NO: 236748 - RNA, 64 nt, hsa
ccugagccgggagacccaggacuggcggccgccaugcccgcaguagguucuagggggcggugcu

SEQ ID NO: 236749 - RNA, 64 nt, hsa
auggcgccuccagaccgaggacagcuguccgccaugcccgcagcuuccuggcacuaccugagcc

SEQ ID NO: 236750 - RNA, 64 nt, hsa
gaguucuccuagcuguggcuucucuagguucuaggggugcaagccucuguguguuuguuugugu

SEQ ID NO: 236751 - RNA, 64 nt, hsa
uuugugugugucugugugugcguauccacacuaggggugcaagccucugggugugugugugugu

SEQ ID NO: 236752 - RNA, 64 nt, hsa
uaguaguuacuuuguacugagagaacuugcuuuggggugcaauuaauaaacugauuuuauuugg

SEQ ID NO: 236753 - RNA, 64 nt, hsa
agaauuggucuccagcugccuuugaucaagauucgggugcaaguggagcaggagccauauaccu

SEQ ID NO: 236754 - RNA, 64 nt, hsa
acauacaugcauauagacgcaucuauuggaaaugcaguuccacaggugagcauguucuuucugg

SEQ ID NO: 236755 - RNA, 64 nt, hsa
ucauacaagcauagacuggauuaaagaaguuuuccaguuccaaaaauuaaaggaauauauccuu

SEQ ID NO: 236756 - RNA, 64 nt, hsa
cucugugcugaugcagguaguuuuaaauuuuucucaguuccagugauagaaaacccacacaaua

SEQ ID NO: 236757 - RNA, 64 nt, hsa
ggagacuggcucauaccuugccagaucccucucucaguuccagccuucuggacaaggccugggc

SEQ ID NO: 236758 - RNA, 64 nt, hsa
augccaauaugugacauuaguaugaaauuuacuacaguuccauuuaacauuccaacugguugcu

SEQ ID NO: 236759 - RNA, 64 nt, hsa
gguaauuuguaaagaaaaagguuuaauggacucacaguuccauguggcuggggaggccucacaa

SEQ ID NO: 236760 - RNA, 64 nt, hsa
gcccuccaaacuguuccagccucugccuguuacccaguuccaaagucacuuccacauuuugggu

SEQ ID NO: 236761 - RNA, 64 nt, hsa
agacugggaagaaaaagagguuuacuuggacuuacaguuccacauggcuggggaggccucagaa

SEQ ID NO: 236762 - RNA, 64 nt, hsa
ggccacacuguaggcagcagugacuaagcacuggcaguuccagaacauuuacccagguauaugu

SEQ ID NO: 236763 - RNA, 64 nt, hsa
acauuauaaguuacuguucuaagaaaaguaaauacaguuccagauggguuauugcagauuaaca

SEQ ID NO: 236764 - RNA, 57 nt, hsa
acaaugaaaaugaugaauaaccaguaccaguuccaguucaaguguuuaaaacuuuug

SEQ ID NO: 236765 - RNA, 64 nt, hsa
aaccuacugggaggguucuugccagacagaacuacaguuccauugucucguggucuuguaaugc

SEQ ID NO: 236766 - RNA, 64 nt, hsa
agucuucugucaccaugucauauugugguucuuucaguuccaugauauguuuggcucugcaugc

SEQ ID NO: 236767 - RNA, 64 nt, hsa
aagaaagccaguuguuuggcaugugaguuaaaggcaguuccaaugccugaugguucccagaucu

SEQ ID NO: 236768 - RNA, 64 nt, hsa
agaccaggaagaaaaagagguuuaauuggacuuacaguuccacaugacuggggaggccucagaa

SEQ ID NO: 236769 - RNA, 64 nt, hsa
gcccuucaaacuguuccaaccucugccuguuacccaguuccaaacuugcuuucauauuuuuggc

SEQ ID NO: 236770 - RNA, 64 nt, hsa
agauugugaagaaaaagagguuuaauuggacuuacaguuccacauggccggggaggccucagaa

SEQ ID NO: 236771 - RNA, 64 nt, hsa
cagauuuaaauccagcugaggcucccuuuguuuucaguuccauguaacaaucuggaaggaaacu

SEQ ID NO: 236772 - RNA, 64 nt, hsa
aggaagagcaccagccgcugagucaggauccugucaguuccaugagcuauuccucuuugguuug

SEQ ID NO: 236773 - RNA, 64 nt, hsa
ggguaguugaauaaaauugggcagcuaaauuuuucaguuccaugugccucccaaauaaaaaaca

SEQ ID NO: 236774 - RNA, 64 nt, hsa
gauacuuucugcacuaguaucacuuuuauuauugcaguuccauuuaaaagcauaacuggcuaag

SEQ ID NO: 236775 - RNA, 64 nt, hsa
gcagccauggcuucucauuuacaccaacagguuucaguuccaacagaaaggucgggguagguuc

SEQ ID NO: 236776 - RNA, 64 nt, hsa
ggagcuggggaaccuggucucaaggcaggcccugcaguuccacagagguggcaggucuugcccu

SEQ ID NO: 236777 - RNA, 64 nt, hsa
uuucucaaccagguacuuccucagucuggugcuccaguuccaguuccacgaaacacugugcaaa

SEQ ID NO: 236778 - RNA, 64 nt, hsa
aaccagguacuuccucagucuggugcuccaguuccaguuccacgaaacacugugcaaagccucg

SEQ ID NO: 236779 - RNA, 64 nt, hsa
cacugaccaaagcuguacuuuuaaaacacaaccccugggcuagugaugucucuacuugcucuau

SEQ ID NO: 236780 - RNA, 64 nt, hsa
aaguguaagcuaaauaaaaugcuuggaguuuugccugggcuagugagaguuggugcaaauucuu

SEQ ID NO: 236781 - RNA, 64 nt, hsa
cagcucugccccaggcuccuccuagacucugucccugggcuagggcaggggaggagggagagca

SEQ ID NO: 236782 - RNA, 64 nt, hsa
aaagaauugguaguagggggagaacagagaggagcugggcuaugggaaaugauuugaauaaugg

SEQ ID NO: 236783 - RNA, 64 nt, hsa
ugcuuugaaaacaaaacuuuucaacaugggcauacugggcuacauggaaaaugacaucacccag

SEQ ID NO: 236784 - RNA, 64 nt, hsa
gucucacuauguugcccagucuagucuugaacuccugggcuacaguuacccuccuaccucggcu

SEQ ID NO: 236785 - RNA, 64 nt, hsa
ggcuguugucugccuggccuucaaugacagugugcugggcuagccugugaccccucgggacugc

SEQ ID NO: 236786 - RNA, 64 nt, hsa
gagcucgacccaagccaggcugcacacuccuggacugggcuagccugcacugccugggaaaguc

SEQ ID NO: 236787 - RNA, 64 nt, hsa
ucucagucuaugagaaacuugcccugaggggcaccugggcuaggggcuugggacuggaagacca

SEQ ID NO: 236788 - RNA, 64 nt, hsa
gccauucccuccuuuuccgcaugccuccugccuccugggcuauuccucuccacccagaaggcug

SEQ ID NO: 236789 - RNA, 64 nt, hsa
ccugcaguuuguccugggcacagacagcuuccaccugggcuacacggagaccgggcacugccug

SEQ ID NO: 236790 - RNA, 64 nt, hsa
agaugcauggcaagaccagcaacuugaccaggaucugggcuauguguauccgccuucuauccag

SEQ ID NO: 236791 - RNA, 64 nt, hsa
ucuuguggcaagcuauaccggaaaagcggcaugucaaaaauacuuuagguucuacauagaucuc

SEQ ID NO: 236792 - RNA, 64 nt, hsa
ggucuaaaauauuuguaauguauauuaaaagguucaaaaauauuuguauaaaucuaaguuauuu

SEQ ID NO: 236793 - RNA, 64 nt, hsa
acauugacaaguuuaacauugagaagaaucuuaacaaaaauauggauaugaauucaguagauau

SEQ ID NO: 236794 - RNA, 64 nt, hsa
agaagaaaaccagcaaacuaaaacuucugggcagcaaaaauauauaaaugcuucagaugucaaa

SEQ ID NO: 236795 - RNA, 64 nt, hsa
cagccugggcuacaugacgaaacuccaucucuaucaaaaauacaaaaaauuaacuagguguggu

SEQ ID NO: 236796 - RNA, 64 nt, hsa
uuuaccuugugucuucucuuguaaaaaugaaacucaaaaauaaaauaaaugugucaaauuuuga

SEQ ID NO: 236797 - RNA, 64 nt, hsa
acuccacccugggcaacagagcaagaccccaucucaaaaauaaauaaauauauauaaaaaauaa

SEQ ID NO: 236798 - RNA, 64 nt, hsa
acuuggguaccgggggaacuuuaaaauuucaucucaaaaauaauuuuuaaaaagccugagguau

SEQ ID NO: 236799 - RNA, 64 nt, hsa
uuaaggaaacaaaaauacuuauauauacacagaacaaaaauaauguucuuuuuaugcaaauccc

SEQ ID NO: 236800 - RNA, 64 nt, hsa
guugugugugggcaacagaaacaaguuaaggaaacaaaaauacuuauauauacacagaacaaaa

SEQ ID NO: 236801 - RNA, 64 nt, hsa
auaggguaguucuggagagaugguaugcagcauacaaaaauauauuaaaaauauaaacaauguu

SEQ ID NO: 236802 - RNA, 64 nt, hsa
agucugaauuguugaaacuaaagcacuucuuuuccaaaaauacuucugcaacucaugaacaaaa

SEQ ID NO: 236803 - RNA, 64 nt, hsa
cacauauuuuguaaauuuuuaccuuguaaagucacaaaaauaguuuuuaaaggaaaaaguacag

SEQ ID NO: 236804 - RNA, 64 nt, hsa
aagcacagaaugccuguauaugauguaacuguaucaaaaauaaaaagcugucacauauuuugua

SEQ ID NO: 236805 - RNA, 64 nt, hsa
uuaaagagacaaccaagggaacacauugagacuacaaaaauaugaauaaucucaauuauauuca

SEQ ID NO: 236806 - RNA, 64 nt, hsa
guaaauggaaauacaaaggauucuuacuaacauacaaaaauaaugcacaacagaaauaucuaaa

SEQ ID NO: 236807 - RNA, 64 nt, hsa
agagcugacuguugcuuaagaaguuuucuuauggcaaaaauaauguaaauaaguuacuaugauc

SEQ ID NO: 236808 - RNA, 64 nt, hsa
ucacaauuucccuucauauggauaugauuccagucaaaaauaaaaugcacaccaaaauguauac

SEQ ID NO: 236809 - RNA, 64 nt, hsa
agaauguuuugaaaguguuuuauuaagaaucacacaaaaauaaauguauuaaaauuaaauucau

SEQ ID NO: 236810 - RNA, 64 nt, hsa
uuaaugagaauauaucaaaguacuuuauaacucacaaaaauauaaacuuauauaaugcuguuua

SEQ ID NO: 236811 - RNA, 64 nt, hsa
uuaagcauuaauuucuucauuuuuuaaauggggacaaaaauaucugcuuuauuauuaccacuua

SEQ ID NO: 236812 - RNA, 64 nt, hsa
uuuuagggucuaaguugaccucgagugagccaugcaaaaauagcuuuaaaauuauacaugagca

SEQ ID NO: 236813 - RNA, 64 nt, hsa
uauagggugguguuuuuauuucauuuauuguagacaaaaauaaugaauuuaguauacacauacc

SEQ ID NO: 236814 - RNA, 64 nt, hsa
aaaaaaaaaagauguuauacaaccaucaaaguggcaaaaauaaaaaaaaucaaguauuggcaaa

SEQ ID NO: 236815 - RNA, 64 nt, hsa
agaauaaaaaugacaacaaaguaaaaggguaucccaaaaauaaaacuauccuuuuggaaaaaaa

SEQ ID NO: 236816 - RNA, 64 nt, hsa
uggggguauauucaagguuauaugucuuagaaaacaaaaauacuuguuuggguucaguuuugga

SEQ ID NO: 236817 - RNA, 64 nt, hsa
uaagauuuucugggccuaaaggauagaucaaagucaaaaauagcaaugccucccuaucccucac

SEQ ID NO: 236818 - RNA, 64 nt, hsa
uuccuaaucagaaauuuuuaucaguuuccagucucaaaaauacaaaauaaaaacaaacguuuuu

SEQ ID NO: 236819 - RNA, 64 nt, hsa
aauucuaaaauaaaauauuggcacaaagagauuucaaaaauaucacugcauccuauagaagaua

SEQ ID NO: 236820 - RNA, 64 nt, hsa
uaauaaaauauucucuauaauugcuucuagauuacaaaaauaugacaaucuuguaaguagcaga

SEQ ID NO: 236821 - RNA, 64 nt, hsa
uaaaaagguuagaaucuaaggacaaagaaugauccaaaaauacuaaggaaaaagaacaauuuuc

SEQ ID NO: 236822 - RNA, 64 nt, hsa
cuuugcuuaauguaaucauucauauacuuugcuacaaaaauauuaauauauuucauuacugaau

SEQ ID NO: 236823 - RNA, 64 nt, hsa
cuuggcacccagaagaauucaacugcgcucacugcaaaaauacaauggccuacauuggauuugu

SEQ ID NO: 236824 - RNA, 64 nt, hsa
agauguuauauucuuuucucauuucuuccccacccaaaaauaagcuaccauauagcuuauaagu

SEQ ID NO: 236825 - RNA, 64 nt, hsa
ugggacagaccauaaaugauggaaaaugucaacacaaaaauagcugaaagccagguacaacuac

SEQ ID NO: 236826 - RNA, 64 nt, hsa
aacuacugcauuuauauauguaaguuuuguauaucaaaaauaauuggucuaaauuuccuagacu

SEQ ID NO: 236827 - RNA, 64 nt, hsa
auguuauaccaacuauucagaggaacucauacuucaaaaauauuaggaaaaucugucuuauagu

SEQ ID NO: 236828 - RNA, 64 nt, hsa
gaaaguuuuaaucaaagcaguuuaauuaagguaucaaaaauaucuuugcuuacuaucaagaagu

SEQ ID NO: 236829 - RNA, 64 nt, hsa
auaagcaacaugaauuaagaacugacacaaaggacaaaaauauaaaguuauuaauagccauuug

SEQ ID NO: 236830 - RNA, 64 nt, hsa
auggugagaauuaaaauaaaacguuaucucauugcaaaaauauuuuauuuuuaucccaucucac

SEQ ID NO: 236831 - RNA, 64 nt, hsa
uagaggugagaaauuuaaacuauaagcaagaaggcaaaaauaguuuggauauguaaaacauuua

SEQ ID NO: 236832 - RNA, 64 nt, hsa
cuauuucacaacagccugacaacauuucuauagccaaaaauagcuaaauaccucaaucagucuc

SEQ ID NO: 236833 - RNA, 64 nt, hsa
gcacuccagccugggcgacagagugagacuaucucaaaaauaaauaaauaaauaaauaaauagu

SEQ ID NO: 236834 - RNA, 64 nt, hsa
gguuucaaacccacagauuaaaccaaccacagaucaaaaauagaaaaaaaaaaaaaaagaaaaa

SEQ ID NO: 236835 - RNA, 64 nt, hsa
cugguguuuuaacuaguauugcaauaagcaaaugcaaaaauauucaauagaugcacuauucuug

SEQ ID NO: 236836 - RNA, 64 nt, hsa
agugaguagaaugacaugcuuacuauacagaaggcaaaaauaggacucucagguaauaguuuaa

SEQ ID NO: 236837 - RNA, 64 nt, hsa
uuagucuacuuguauuguuuauaagaaacccaagcaaaaauauauagcaauuguuaccuuguua

SEQ ID NO: 236838 - RNA, 64 nt, hsa
gagaaagaucagaauggccuugagaauagagccacaaaaauaacuaugaaaaugccaguaacgu

SEQ ID NO: 236839 - RNA, 64 nt, hsa
uucuguaugaacaccuggaagcaaaaucauagugcaaaaauacauuuaagguguggucaaaaau

SEQ ID NO: 236840 - RNA, 64 nt, hsa
aaaucauagugcaaaaauacauuuaagguguggucaaaaauaagucuuuaauugguaaauaaua

SEQ ID NO: 236841 - RNA, 64 nt, hsa
uuuccaaauauucuaaaaaagauacuguauaugucaaaaauauuuuuaugugaagguguuucaa

SEQ ID NO: 236842 - RNA, 64 nt, hsa
cuuaauucucauuaugaagauguuuuuagaggggcaaaaauauuuugcaagcucuggaauuguu

SEQ ID NO: 236843 - RNA, 64 nt, hsa
uaaaagcuuuagauugaaauuuaugacuagcaaacaaaaauagaauauauaaacgauauaugua

SEQ ID NO: 236844 - RNA, 64 nt, hsa
ccaacauggagaaaccccgucucuacuaaaaauacaaaaauauuagccgggcgugguggugcau

SEQ ID NO: 236845 - RNA, 64 nt, hsa
uuccacauguaacugguuauguucuguaaaguuacaaaaauagaaagguugaaucuguggcggc

SEQ ID NO: 236846 - RNA, 64 nt, hsa
cuuacaagauuacacuaaccauuuuuaaagugcacaaaaauauuauuauuagucuuaacuaaaa

SEQ ID NO: 236847 - RNA, 64 nt, hsa
caaaaugagcuuggguuuaaaaagugcuuugugccaaaaauaucauaccuaauuuuuauagugc

SEQ ID NO: 236848 - RNA, 64 nt, hsa
uucuaguuuaugguuaaaaguuuuugaagugucucaaaaauauuuuacuaacuguaacccuaaa

SEQ ID NO: 236849 - RNA, 64 nt, hsa
cuccuaugcaucauaagcauguuuguaauauuuucaaaaauaguucuacugaugcuacaggaau

SEQ ID NO: 236850 - RNA, 64 nt, hsa
ugucuugaccuucaauucaauugguuucuuuuaacaaaaauaaacacugcuaaaaguuauuguu

SEQ ID NO: 236851 - RNA, 64 nt, hsa
gaaagagaaugaaagacccugugacauuucacuucaaaaauaagcccuguagcucuuuacgguc

SEQ ID NO: 236852 - RNA, 64 nt, hsa
ggauaaagcuacuuaaugugucuccuccacugaucaaaaauauuccauauagucuuggugagga

SEQ ID NO: 236853 - RNA, 64 nt, hsa
uugguucuguauuauaaauugcaccuuaauagaccaaaaauaucuauacagcacugauuuccuu

SEQ ID NO: 236854 - RNA, 64 nt, hsa
ugagugcccgccccugauauauuaccucauuaugcaaaaauaacauaucuuucaugacuauuuu

SEQ ID NO: 236855 - RNA, 64 nt, hsa
uacaucucucuaugcuguucuacaagcaaacaaacaaaaauaggaguauaggaacugcuggcuu

SEQ ID NO: 236856 - RNA, 64 nt, hsa
auacuuuuguauuuaauagauuacuuagaaaccacaaaaauaggaauccuuaccccuucaauuc

SEQ ID NO: 236857 - RNA, 64 nt, hsa
uugauucaaagaccaaacuagaacuuuaaaaguucaaaaauaagaaaguauacauuuuugcugu

SEQ ID NO: 236858 - RNA, 64 nt, hsa
aaagguuucuuuucccuuuuuaccaugguuucuacaaaaauaaccuucaggaaaaagaaaauca

SEQ ID NO: 236859 - RNA, 64 nt, hsa
cugaagcagcucaagaccaauuuugccucuuucacaaaaauaacucugaguuugauauucaagu

SEQ ID NO: 236860 - RNA, 64 nt, hsa
cucauuuuuaaauaauucaaaaucaguagcaaugcaaaaauauucugauuacuuuagccuuaug

SEQ ID NO: 236861 - RNA, 64 nt, hsa
caauaaguuuauguuaguagagcuguuuucaacccaaaaauaagaaaaaauagcucuaaauauc

SEQ ID NO: 236862 - RNA, 64 nt, hsa
ucuaaaugcacaccuccuaagguaaauagucuuucaaaaauaucaggcgugccaacucuugcug

SEQ ID NO: 236863 - RNA, 64 nt, hsa
auuuaauacuuauuuaaaaagaagaugagagauucaaaaauaucagaaaaguuggccaugguaa

SEQ ID NO: 236864 - RNA, 64 nt, hsa
auuccagccugggcgacagagcaagacuccaucucaaaaauaaaauaaaaaaagaaagaaagaa

SEQ ID NO: 236865 - RNA, 64 nt, hsa
ccagccuggccaacauggcaaaaccccgucucuacaaaaauacaaaagaaauuagccagacaug

SEQ ID NO: 236866 - RNA, 64 nt, hsa
uuuuaauaaaacaugcugcaaccaugguauacaacaaaaauacauuucuuuggugauugaaauu

SEQ ID NO: 236867 - RNA, 64 nt, hsa
cuggcuuuuaauuuugccagcuaaggacauaaaacaaaaauaaacaaacaaaaacaaauagcca

SEQ ID NO: 236868 - RNA, 64 nt, hsa
aauucaauguaauuuauaauuuucuaugucaauacaaaaauacaucacagccuucucaaacagc

SEQ ID NO: 236869 - RNA, 64 nt, hsa
gaugucuacaauacaauaccuguauucaaaauaacaaaaauaaagccugauucuuuguuucuag

SEQ ID NO: 236870 - RNA, 64 nt, hsa
acauuauuuuaaucauauauaugacuuuccuuuucaaaaauacuuuaauguacaaguguaaaua

SEQ ID NO: 236871 - RNA, 64 nt, hsa
caaaucugcuuuucaaaguuuaucaauacccuuucaaaaauauauuuaaaaucuuugaaagaag

SEQ ID NO: 236872 - RNA, 64 nt, hsa
cagguuuuuuuuuuaauaaacacaauuuugcugccaaaaauauauaaauaaaacacgaaagaaa

SEQ ID NO: 236873 - RNA, 64 nt, hsa
cauuacuuaacacaguauaaagaugaaaagacaacaaaaauaucuucauacuuccucauccccu

SEQ ID NO: 236874 - RNA, 64 nt, hsa
uuggugcuauuucauuccugcuguaagagaaugacaaaaauauucauguauagccaauugauug

SEQ ID NO: 236875 - RNA, 64 nt, hsa
uucagcaauugacaaaauuugaagaaauauuaaacaaaaauaacaaaaaaagaaacaaccuugg

SEQ ID NO: 236876 - RNA, 64 nt, hsa
cugccacucucauccccgucccaaccaucucugucaaaaauauaccuuuuucauaugauauucu

SEQ ID NO: 236877 - RNA, 64 nt, hsa
uuggaucaccaaauuaucuuagguacuaaggccucaaaaauaagaaaaacuuuauuauuucucc

SEQ ID NO: 236878 - RNA, 64 nt, hsa
ggcauuugcuuuuuagaaauguccacugcaauggcaaaaauauuuccaguugcacuguaucucu

SEQ ID NO: 236879 - RNA, 64 nt, hsa
ugaaaucugugguauuuauuuacaaacaugucuacaaaaauagauuacagcuuauuuuauuuuu

SEQ ID NO: 236880 - RNA, 64 nt, hsa
guggcaagcugacauucugcacgcuagcacuuuacaaaaauauugugcaagaccuaccucccac

SEQ ID NO: 236881 - RNA, 64 nt, hsa
gauaggguuacauccugauaaaauaaucauaagucaaaaauauugucaguugaaaauacauuua

SEQ ID NO: 236882 - RNA, 64 nt, hsa
ccauuguuauagguaaaaucccauuacaaaaauacaaaaauauuuuuuguaacaguuauuuucc

SEQ ID NO: 236883 - RNA, 64 nt, hsa
agcuuuuaccauuguuauagguaaaaucccauuacaaaaauacaaaaauauuuuuuguaacagu

SEQ ID NO: 236884 - RNA, 64 nt, hsa
auauauuuacauuuucacucaucuaaaaaguauacaaaaauaaaaaguggaaaaagguaucuuc

SEQ ID NO: 236885 - RNA, 64 nt, hsa
agagaggggcuuuauuucaaucauagagcaacaacaaaaauaaugcuuauagcuaaacugccug

SEQ ID NO: 236886 - RNA, 64 nt, hsa
uucuuuuauauauagcaaacaauuugaaagaauacaaaaauaugugaaguucauuuaaaaaaau

SEQ ID NO: 236887 - RNA, 64 nt, hsa
agaaaagcuggugacauauuuauacguuuuugugcaaaaauaaaugaauggcaauagauuuuaa

SEQ ID NO: 236888 - RNA, 64 nt, hsa
aauagacuguaguauccuuucauuggagaauuuacaaaaauaucaucuacagcucaaaaguccc

SEQ ID NO: 236889 - RNA, 64 nt, hsa
aggucuuguugauauuauauaguaaaaauaaaaccaaaaauaaauauuauucaaguggcucuuc

SEQ ID NO: 236890 - RNA, 64 nt, hsa
acuauaugguaguuuaaguuuccuugugauuagucaaaaauaccauuuuaguaugaagcaauga

SEQ ID NO: 236891 - RNA, 64 nt, hsa
auuuuggguuuauguauaaaucauggaauuuaugcaaaaauaugaguaguacagauucuccucu

SEQ ID NO: 236892 - RNA, 64 nt, hsa
cccuucggagcuuauauuccaguaggagaaaaagcaaaaauaaaauaauuauaaauggucauau

SEQ ID NO: 236893 - RNA, 64 nt, hsa
cuaucacugagaaguuuuacuacucauugaagcacaaaaauauccgcuacacagguucacauca

SEQ ID NO: 236894 - RNA, 64 nt, hsa
uaccuaccucacuucaaauuauguuuggacuugacaaaaauaggugcaaaugauggggggcaau

SEQ ID NO: 236895 - RNA, 64 nt, hsa
cagccuggccaacaugaugaaaccccgucucuaccaaaaauagaaaaaaauauagccgggccug

SEQ ID NO: 236896 - RNA, 64 nt, hsa
cacuccagccugaugacagagcaagacucagucucaaaaauaaauaaaaauaauaaaaccucca

SEQ ID NO: 236897 - RNA, 64 nt, hsa
cauccuggccaacauggugaaacccugucuguaccaaaaauacaaaaauuaauugggcauggug

SEQ ID NO: 236898 - RNA, 64 nt, hsa
acaccuacaaccaucuaaucuuugacaaaguugacaaaaauacgcaauggggaaagaauucccc

SEQ ID NO: 236899 - RNA, 64 nt, hsa
auaggaacggaaaaagauuucaugacaaagaucccaaaaauaauuguaacgaaagcaaaaauug

SEQ ID NO: 236900 - RNA, 64 nt, hsa
uaaccaauuugagauucaugauuaauuauguacacaaaaauauuuuccuuguagaaaauaguuu

SEQ ID NO: 236901 - RNA, 64 nt, hsa
gguugguuaguugggcaaaaucauuuauuacaugcaaaaauagaaaauuauuuguuaaauucag

SEQ ID NO: 236902 - RNA, 64 nt, hsa
accagccugggcaauauagcaagaccccucacuacaaaaauaaaacaucaaaaacaaaaacaau

SEQ ID NO: 236903 - RNA, 64 nt, hsa
acuccaggcuggguaacagaaugagaccuuaucucaaaaauaaacaaacuaauaaaaagcaaaa

SEQ ID NO: 236904 - RNA, 64 nt, hsa
cagccugagcaacaugguaaaaccccaucucuaccaaaaauacaaaaauuagcugggcuuggug

SEQ ID NO: 236905 - RNA, 64 nt, hsa
acuccagccugggcaacagagcaagaccuugucucaaaaauaaacaaacuaaaauuaaaaaaag

SEQ ID NO: 236906 - RNA, 64 nt, hsa
cagccuggcuaacauggugaaauccuaucucuaccaaaaauacaaaaauuagccaggcguggug

SEQ ID NO: 236907 - RNA, 64 nt, hsa
cuccugccugggcaacaagagcaaaauuucaucucaaaaauaagauaaaauaaaauaaacaaau

SEQ ID NO: 236908 - RNA, 64 nt, hsa
cagcaugaccaacauggugaaacccugucucuaccaaaaauacaaaaauuagccaggcauaguu

SEQ ID NO: 236909 - RNA, 64 nt, hsa
uaacagaugugguuuguugcuuuaguuguugaagcaaaaauacugaguuguuauguuuauguua

SEQ ID NO: 236910 - RNA, 64 nt, hsa
cagccuggccagcauggugaaaccccaucucuaccaaaaauacaggaaauuaucugggcauagu

SEQ ID NO: 236911 - RNA, 64 nt, hsa
uuaacagcuugaguauugcauuuccuuggccaaacaaaaauagcuacaaauccacaaaaauuua

SEQ ID NO: 236912 - RNA, 64 nt, hsa
uuugaaaaaaauacauaacuaauuuaauuuuacacaaaaauauuuaugcagauuuucagaauuu

SEQ ID NO: 236913 - RNA, 64 nt, hsa
ggcuaaacuggucaguauuaauguguagcccuaccaaaaauagccaguaguaucugaaaaugaa

SEQ ID NO: 236914 - RNA, 64 nt, hsa
gagauuuaaaaaacugaaaagguauaccucaacccaaaaauaaagguuuguuuugguuuguuau

SEQ ID NO: 236915 - RNA, 64 nt, hsa
agauuuugcacaauucguguugaaccuuccaaaacaaaaauaaagaccuguccaaaaguuuuga

SEQ ID NO: 236916 - RNA, 64 nt, hsa
aaaacaaaaauaaagaccuguccaaaaguuuugacaaaaauacugauugcucccaaauaaagug

SEQ ID NO: 236917 - RNA, 64 nt, hsa
ugaggacugucccaacaacaguagguacaguggacaaaaauagcccagggugacugacugaauu

SEQ ID NO: 236918 - RNA, 64 nt, hsa
caaaaaauacaaaccauacauuauucaguagcaccaaaaauagugaaacuaguggauuauauau

SEQ ID NO: 236919 - RNA, 64 nt, hsa
uuaucuacugcacaccaacuguuuauagaauacacaaaaauaaaauguaauaacuguauucugu

SEQ ID NO: 236920 - RNA, 64 nt, hsa
caguuuagaaauuagcuccagguucuuaaacuaacaaaaauaaaaccuaagcaugccacagagc

SEQ ID NO: 236921 - RNA, 64 nt, hsa
aaauuguugaguauuacaucauuuacuugagguucaaaaauaauucauuuuaaauuaaguaguu

SEQ ID NO: 236922 - RNA, 64 nt, hsa
cacauuucaaauaauaacaauacuuuuuguuuuucaaaaauaaaaugcaauguuauauaaagcu

SEQ ID NO: 236923 - RNA, 64 nt, hsa
uagggauucuauuugaguugcguuuaucuguuggcaaaaauaucuuuuucaaggcaucagcucu

SEQ ID NO: 236924 - RNA, 64 nt, hsa
auuuacaggagaaagaggugauuauggagggaaucaaaaauacugcuuucaguuaguagcuagc

SEQ ID NO: 236925 - RNA, 64 nt, hsa
caacuugacacaagauuagacaaaaaauuccuuacaaaaauacuguguaacuauuucucaaacu

SEQ ID NO: 236926 - RNA, 64 nt, hsa
uuagaauuuuguucaaauuauagcagaauuuaggcaaaaauaaaacagacauguauuuuuguuu

SEQ ID NO: 236927 - RNA, 64 nt, hsa
acuaaaacaacuuuuuccauuuuuaauaaaacgccaaaaauaucacaacccaccaaaaauagau

SEQ ID NO: 236928 - RNA, 64 nt, hsa
uuuuuaauaaaacgccaaaaauaucacaacccaccaaaaauagaugccucucccccuccagccc

SEQ ID NO: 236929 - RNA, 64 nt, hsa
uaauaguauugacuguuuaaaaaauugagcucaucaaaaauauugucaucaaauacaggugguu

SEQ ID NO: 236930 - RNA, 64 nt, hsa
ggauuuuaauaagcuccaguauuauucaaaugaucaaaaauauaguuauaauuuuuugaauuuu

SEQ ID NO: 236931 - RNA, 64 nt, hsa
augaaauuaccugguucuaagaauuuuugaguggcaaaaauagaaaacaaucuucauuugaaaa

SEQ ID NO: 236932 - RNA, 64 nt, hsa
agugggauuugugauuuaaugacaguugaauaaucaaaaauauuuuauuaggcccccaaaauuu

SEQ ID NO: 236933 - RNA, 64 nt, hsa
ugcaguuucccuuaaauugguuauuucauguugucaaaaauaccaauguuaauaugauuaauuu

SEQ ID NO: 236934 - RNA, 64 nt, hsa
aaauauuucaaauucaugaauaagaauauuccgucaaaaauaguuugccuuaggucacgccuua

SEQ ID NO: 236935 - RNA, 64 nt, hsa; identical to SEQ ID NO: 156143

SEQ ID NO: 236936 - RNA, 64 nt, hsa; identical to SEQ ID NO: 156144

SEQ ID NO: 236937 - RNA, 64 nt, hsa; identical to SEQ ID NO: 156145

SEQ ID NO: 236938 - RNA, 64 nt, hsa; identical to SEQ ID NO: 156146

SEQ ID NO: 236939 - RNA, 64 nt, hsa; identical to SEQ ID NO: 156147

SEQ ID NO: 236940 - RNA, 64 nt, hsa; identical to SEQ ID NO: 156148

SEQ ID NO: 236941 - RNA, 64 nt, hsa; identical to SEQ ID NO: 156149

SEQ ID NO: 236942 - RNA, 64 nt, hsa; identical to SEQ ID NO: 156150

SEQ ID NO: 236943 - RNA, 64 nt, hsa; identical to SEQ ID NO: 156151

SEQ ID NO: 236944 - RNA, 64 nt, hsa; identical to SEQ ID NO: 156152

SEQ ID NO: 236945 - RNA, 64 nt, hsa; identical to SEQ ID NO: 156153

SEQ ID NO: 236946 - RNA, 64 nt, hsa; identical to SEQ ID NO: 156154

SEQ ID NO: 236947 - RNA, 64 nt, hsa; identical to SEQ ID NO: 156155

SEQ ID NO: 236948 - RNA, 64 nt, hsa; identical to SEQ ID NO: 156156

SEQ ID NO: 236949 - RNA, 64 nt, hsa; identical to SEQ ID NO: 156157

SEQ ID NO: 236950 - RNA, 64 nt, hsa; identical to SEQ ID NO: 156158

SEQ ID NO: 236951 - RNA, 64 nt, hsa; identical to SEQ ID NO: 156159

SEQ ID NO: 236952 - RNA, 64 nt, hsa; identical to SEQ ID NO: 156160

SEQ ID NO: 236953 - RNA, 64 nt, hsa; identical to SEQ ID NO: 156161

SEQ ID NO: 236954 - RNA, 64 nt, hsa; identical to SEQ ID NO: 156162

SEQ ID NO: 236955 - RNA, 64 nt, hsa; identical to SEQ ID NO: 156163

SEQ ID NO: 236956 - RNA, 64 nt, hsa; identical to SEQ ID NO: 156164

SEQ ID NO: 236957 - RNA, 64 nt, hsa; identical to SEQ ID NO: 156165

SEQ ID NO: 236958 - RNA, 64 nt, hsa; identical to SEQ ID NO: 156166

SEQ ID NO: 236959 - RNA, 64 nt, hsa; identical to SEQ ID NO: 156167

SEQ ID NO: 236960 - RNA, 64 nt, hsa; identical to SEQ ID NO: 156168

SEQ ID NO: 236961 - RNA, 64 nt, hsa; identical to SEQ ID NO: 156169

SEQ ID NO: 236962 - RNA, 64 nt, hsa; identical to SEQ ID NO: 156170

SEQ ID NO: 236963 - RNA, 64 nt, hsa; identical to SEQ ID NO: 156171

SEQ ID NO: 236964 - RNA, 64 nt, hsa; identical to SEQ ID NO: 156172

SEQ ID NO: 236965 - RNA, 64 nt, hsa; identical to SEQ ID NO: 156173

SEQ ID NO: 236966 - RNA, 64 nt, hsa; identical to SEQ ID NO: 156174

SEQ ID NO: 236967 - RNA, 64 nt, hsa; identical to SEQ ID NO: 156175

SEQ ID NO: 236968 - RNA, 64 nt, hsa; identical to SEQ ID NO: 156176

SEQ ID NO: 236969 - RNA, 64 nt, hsa; identical to SEQ ID NO: 156177

SEQ ID NO: 236970 - RNA, 64 nt, hsa; identical to SEQ ID NO: 156178

SEQ ID NO: 236971 - RNA, 64 nt, hsa; identical to SEQ ID NO: 156179

SEQ ID NO: 236972 - RNA, 64 nt, hsa; identical to SEQ ID NO: 156180

SEQ ID NO: 236973 - RNA, 64 nt, hsa; identical to SEQ ID NO: 156181

SEQ ID NO: 236974 - RNA, 64 nt, hsa; identical to SEQ ID NO: 156182

SEQ ID NO: 236975 - RNA, 64 nt, hsa; identical to SEQ ID NO: 156183

SEQ ID NO: 236976 - RNA, 64 nt, hsa; identical to SEQ ID NO: 156184

SEQ ID NO: 236977 - RNA, 64 nt, hsa; identical to SEQ ID NO: 156185

SEQ ID NO: 236978 - RNA, 64 nt, hsa; identical to SEQ ID NO: 156186

SEQ ID NO: 236979 - RNA, 64 nt, hsa; identical to SEQ ID NO: 156187

SEQ ID NO: 236980 - RNA, 64 nt, hsa; identical to SEQ ID NO: 156188

SEQ ID NO: 236981 - RNA, 64 nt, hsa; identical to SEQ ID NO: 156189

SEQ ID NO: 236982 - RNA, 64 nt, hsa; identical to SEQ ID NO: 156190

SEQ ID NO: 236983 - RNA, 64 nt, hsa; identical to SEQ ID NO: 156191

SEQ ID NO: 236984 - RNA, 64 nt, hsa; identical to SEQ ID NO: 156192

SEQ ID NO: 236985 - RNA, 64 nt, hsa; identical to SEQ ID NO: 156193

SEQ ID NO: 236986 - RNA, 64 nt, hsa; identical to SEQ ID NO: 156194

SEQ ID NO: 236987 - RNA, 64 nt, hsa; identical to SEQ ID NO: 156195

SEQ ID NO: 236988 - RNA, 64 nt, hsa; identical to SEQ ID NO: 156196

SEQ ID NO: 236989 - RNA, 64 nt, hsa; identical to SEQ ID NO: 156197

SEQ ID NO: 236990 - RNA, 64 nt, hsa; identical to SEQ ID NO: 156198

SEQ ID NO: 236991 - RNA, 64 nt, hsa; identical to SEQ ID NO: 156199

SEQ ID NO: 236992 - RNA, 64 nt, hsa; identical to SEQ ID NO: 156200

SEQ ID NO: 236993 - RNA, 64 nt, hsa; identical to SEQ ID NO: 156201

SEQ ID NO: 236994 - RNA, 64 nt, hsa; identical to SEQ ID NO: 156202

SEQ ID NO: 236995 - RNA, 64 nt, hsa; identical to SEQ ID NO: 156203

SEQ ID NO: 236996 - RNA, 64 nt, hsa; identical to SEQ ID NO: 156204

SEQ ID NO: 236997 - RNA, 64 nt, hsa; identical to SEQ ID NO: 156205

SEQ ID NO: 236998 - RNA, 64 nt, hsa; identical to SEQ ID NO: 156206

SEQ ID NO: 236999 - RNA, 64 nt, hsa; identical to SEQ ID NO: 156207

SEQ ID NO: 237000 - RNA, 64 nt, hsa; identical to SEQ ID NO: 156208

SEQ ID NO: 237001 - RNA, 64 nt, hsa; identical to SEQ ID NO: 156209

SEQ ID NO: 237002 - RNA, 53 nt, hsa; identical to SEQ ID NO: 156210

SEQ ID NO: 237003 - RNA, 64 nt, hsa; identical to SEQ ID NO: 156211

SEQ ID NO: 237004 - RNA, 64 nt, hsa; identical to SEQ ID NO: 156212

SEQ ID NO: 237005 - RNA, 64 nt, hsa; identical to SEQ ID NO: 156213

SEQ ID NO: 237006 - RNA, 64 nt, hsa; identical to SEQ ID NO: 156214

SEQ ID NO: 237007 - RNA, 64 nt, hsa; identical to SEQ ID NO: 156215

SEQ ID NO: 237008 - RNA, 64 nt, hsa; identical to SEQ ID NO: 156216

SEQ ID NO: 237009 - RNA, 64 nt, hsa; identical to SEQ ID NO: 156217

SEQ ID NO: 237010 - RNA, 64 nt, hsa; identical to SEQ ID NO: 156218

SEQ ID NO: 237011 - RNA, 64 nt, hsa; identical to SEQ ID NO: 156219

SEQ ID NO: 237012 - RNA, 64 nt, hsa; identical to SEQ ID NO: 156220

SEQ ID NO: 237013 - RNA, 64 nt, hsa; identical to SEQ ID NO: 156221

SEQ ID NO: 237014 - RNA, 64 nt, hsa; identical to SEQ ID NO: 156222

SEQ ID NO: 237015 - RNA, 64 nt, hsa; identical to SEQ ID NO: 156223

SEQ ID NO: 237016 - RNA, 64 nt, hsa; identical to SEQ ID NO: 156224

SEQ ID NO: 237017 - RNA, 64 nt, hsa; identical to SEQ ID NO: 156225

SEQ ID NO: 237018 - RNA, 64 nt, hsa; identical to SEQ ID NO: 156226

SEQ ID NO: 237019 - RNA, 64 nt, hsa; identical to SEQ ID NO: 156227

SEQ ID NO: 237020 - RNA, 64 nt, hsa; identical to SEQ ID NO: 156228

SEQ ID NO: 237021 - RNA, 64 nt, hsa; identical to SEQ ID NO: 156229

SEQ ID NO: 237022 - RNA, 64 nt, hsa; identical to SEQ ID NO: 156230

SEQ ID NO: 237023 - RNA, 64 nt, hsa; identical to SEQ ID NO: 156231

SEQ ID NO: 237024 - RNA, 64 nt, hsa; identical to SEQ ID NO: 156232

SEQ ID NO: 237025 - RNA, 64 nt, hsa; identical to SEQ ID NO: 156233

SEQ ID NO: 237026 - RNA, 64 nt, hsa; identical to SEQ ID NO: 156234

SEQ ID NO: 237027 - RNA, 64 nt, hsa; identical to SEQ ID NO: 156235

SEQ ID NO: 237028 - RNA, 64 nt, hsa; identical to SEQ ID NO: 156236

SEQ ID NO: 237029 - RNA, 64 nt, hsa; identical to SEQ ID NO: 156237

SEQ ID NO: 237030 - RNA, 64 nt, hsa; identical to SEQ ID NO: 156238

SEQ ID NO: 237031 - RNA, 64 nt, hsa; identical to SEQ ID NO: 156239

SEQ ID NO: 237032 - RNA, 64 nt, hsa; identical to SEQ ID NO: 156240

SEQ ID NO: 237033 - RNA, 64 nt, hsa; identical to SEQ ID NO: 156241

SEQ ID NO: 237034 - RNA, 64 nt, hsa; identical to SEQ ID NO: 156242

SEQ ID NO: 237035 - RNA, 64 nt, hsa; identical to SEQ ID NO: 156243

SEQ ID NO: 237036 - RNA, 64 nt, hsa; identical to SEQ ID NO: 156244

SEQ ID NO: 237037 - RNA, 64 nt, hsa; identical to SEQ ID NO: 156245

SEQ ID NO: 237038 - RNA, 64 nt, hsa; identical to SEQ ID NO: 156246

SEQ ID NO: 237039 - RNA, 64 nt, hsa; identical to SEQ ID NO: 156247

SEQ ID NO: 237040 - RNA, 64 nt, hsa; identical to SEQ ID NO: 156248

SEQ ID NO: 237041 - RNA, 64 nt, hsa; identical to SEQ ID NO: 156249

SEQ ID NO: 237042 - RNA, 64 nt, hsa; identical to SEQ ID NO: 156250

SEQ ID NO: 237043 - RNA, 64 nt, hsa; identical to SEQ ID NO: 156251

SEQ ID NO: 237044 - RNA, 64 nt, hsa; identical to SEQ ID NO: 156252

SEQ ID NO: 237045 - RNA, 64 nt, hsa; identical to SEQ ID NO: 156253

SEQ ID NO: 237046 - RNA, 64 nt, hsa; identical to SEQ ID NO: 156254

SEQ ID NO: 237047 - RNA, 64 nt, hsa; identical to SEQ ID NO: 156255

SEQ ID NO: 237048 - RNA, 64 nt, hsa; identical to SEQ ID NO: 156256

SEQ ID NO: 237049 - RNA, 64 nt, hsa; identical to SEQ ID NO: 156257

SEQ ID NO: 237050 - RNA, 64 nt, hsa; identical to SEQ ID NO: 156258

SEQ ID NO: 237051 - RNA, 64 nt, hsa; identical to SEQ ID NO: 156259

SEQ ID NO: 237052 - RNA, 64 nt, hsa; identical to SEQ ID NO: 156260

SEQ ID NO: 237053 - RNA, 64 nt, hsa; identical to SEQ ID NO: 156261

SEQ ID NO: 237054 - RNA, 64 nt, hsa; identical to SEQ ID NO: 156262

SEQ ID NO: 237055 - RNA, 64 nt, hsa; identical to SEQ ID NO: 156263

SEQ ID NO: 237056 - RNA, 64 nt, hsa; identical to SEQ ID NO: 156264

SEQ ID NO: 237057 - RNA, 64 nt, hsa; identical to SEQ ID NO: 156265

SEQ ID NO: 237058 - RNA, 64 nt, hsa; identical to SEQ ID NO: 156266

SEQ ID NO: 237059 - RNA, 64 nt, hsa; identical to SEQ ID NO: 156267

SEQ ID NO: 237060 - RNA, 64 nt, hsa; identical to SEQ ID NO: 156268

SEQ ID NO: 237061 - RNA, 64 nt, hsa; identical to SEQ ID NO: 156269

SEQ ID NO: 237062 - RNA, 64 nt, hsa; identical to SEQ ID NO: 156270

SEQ ID NO: 237063 - RNA, 64 nt, hsa; identical to SEQ ID NO: 156271

SEQ ID NO: 237064 - RNA, 64 nt, hsa; identical to SEQ ID NO: 156272

SEQ ID NO: 237065 - RNA, 64 nt, hsa; identical to SEQ ID NO: 156273

SEQ ID NO: 237066 - RNA, 64 nt, hsa; identical to SEQ ID NO: 156274

SEQ ID NO: 237067 - RNA, 64 nt, hsa; identical to SEQ ID NO: 156275

SEQ ID NO: 237068 - RNA, 64 nt, hsa; identical to SEQ ID NO: 156276

SEQ ID NO: 237069 - RNA, 64 nt, hsa; identical to SEQ ID NO: 156277

SEQ ID NO: 237070 - RNA, 64 nt, hsa; identical to SEQ ID NO: 156278

SEQ ID NO: 237071 - RNA, 64 nt, hsa; identical to SEQ ID NO: 156279

SEQ ID NO: 237072 - RNA, 64 nt, hsa; identical to SEQ ID NO: 156280

SEQ ID NO: 237073 - RNA, 64 nt, hsa; identical to SEQ ID NO: 156281

SEQ ID NO: 237074 - RNA, 64 nt, hsa; identical to SEQ ID NO: 156282

SEQ ID NO: 237075 - RNA, 64 nt, hsa; identical to SEQ ID NO: 156283

SEQ ID NO: 237076 - RNA, 64 nt, hsa; identical to SEQ ID NO: 156284

SEQ ID NO: 237077 - RNA, 64 nt, hsa; identical to SEQ ID NO: 156285

SEQ ID NO: 237078 - RNA, 64 nt, hsa; identical to SEQ ID NO: 156286

SEQ ID NO: 237079 - RNA, 64 nt, hsa; identical to SEQ ID NO: 156287

SEQ ID NO: 237080 - RNA, 64 nt, hsa; identical to SEQ ID NO: 229078

SEQ ID NO: 237081 - RNA, 64 nt, hsa; identical to SEQ ID NO: 229079

SEQ ID NO: 237082 - RNA, 64 nt, hsa
ccuggacaggcauggaccugucuccagagagaggagccugaaguucguggggcgggacagcguc

SEQ ID NO: 237083 - RNA, 64 nt, hsa
gaggaggccucuggaccugcuggucugcacugacagccugaagggucuacacccucggcucacc

SEQ ID NO: 237084 - RNA, 64 nt, hsa
uccaggcucagcagggagcugcuggagguaguagagccugaagucuugcaggacucacuggaug

SEQ ID NO: 237085 - RNA, 64 nt, hsa
uccaggcucagcagggagcugcuggcugagaaagagccugaagucuugcaggacucacuggaua

SEQ ID NO: 237086 - RNA, 55 nt, hsa
agcagggagcugcuggaugagaaagagccugaagucuugcaggacucacuggaua

SEQ ID NO: 237087 - RNA, 64 nt, hsa
cggaaagacagcuaucaggaagaggaaauacagaagccugaauaaucuauggguuagaaaagca

SEQ ID NO: 237088 - RNA, 64 nt, hsa
uugagaugcagauauagcaaaggauuaguaauauagccugaaaacaaaugggagcauagcagug

SEQ ID NO: 237089 - RNA, 64 nt, hsa
uuuaaaagcagucagauucuauaaauggcaaguaagccugaagugaggauacugcaauuuucgg

SEQ ID NO: 237090 - RNA, 64 nt, hsa
uuauuugaguaagccucuaguugacuuuucucuuagccugaauguggacguugaaacauaucac

SEQ ID NO: 237091 - RNA, 54 nt, hsa
cagaguccgaggagcuguagcccuagccugaaucuucaguuccccagucucggg

SEQ ID NO: 237092 - RNA, 64 nt, hsa
cugcuaagaugucacugggggucacuaaagcugaagccugaaggaaagccucucauugcuguag

SEQ ID NO: 237093 - RNA, 64 nt, hsa
auugcaccuggccaagaagagacaucuugacuugagccugaagacuauguacagagacugaccu

SEQ ID NO: 237094 - RNA, 64 nt, hsa
uauaucugucauuauugcccugaucacaaacaaaagccugaauguacuauguuuaaaagacaaa

SEQ ID NO: 237095 - RNA, 64 nt, hsa
gauagcgggagggaggaaguacgacuaauguuggagccugaaacuauggaaaugcugcuaaaau

SEQ ID NO: 237096 - RNA, 64 nt, hsa
guccagagucaguuucuaucccaauucucccugcagccugaagaacggauccuugucuccaaug

SEQ ID NO: 237097 - RNA, 64 nt, hsa
aaauuuccagaugucucaugcugcauagggcaggagccugaaaagcuaauuugagaagauaaua

SEQ ID NO: 237098 - RNA, 64 nt, hsa
auuccuagucagagauugggagaaauacaagaugagccugaaucaucucauguaccugacagua

SEQ ID NO: 237099 - RNA, 64 nt, hsa
uucaccuccccgguucaagcaauucuccugccucagccugaagucgugaucugcccgccucggc

SEQ ID NO: 237100 - RNA, 64 nt, hsa
uuguuguguuucugaaaagugaaauuuaaaaagcagccugaaaaauaaaaauuuauaauuugcc

SEQ ID NO: 237101 - RNA, 64 nt, hsa
uucuucucugacuuucaggugauugaguuugacaagccugaaguccuugcagagaagccagauu

SEQ ID NO: 237102 - RNA, 64 nt, hsa
gagauacagagacaacaccccccuuguucucgacagccugaacuugaacauacaaagugggcag

SEQ ID NO: 237103 - RNA, 64 nt, hsa
gagccucacauccuuuuccuugacuucucaacccagccugaaguccauugcgguuccgucacuc

SEQ ID NO: 237104 - RNA, 64 nt, hsa
uaaucacuaacuccuuccuuuuccucugcaugccagccugaaaauuccaaaucuagccucugaa

SEQ ID NO: 237105 - RNA, 64 nt, hsa
gccaggagcagaagcaaagagcagacacacauacagccugaaacagaccuggacagacagacac

SEQ ID NO: 237106 - RNA, 64 nt, hsa
auacagccugaaacagaccuggacagacagacacagccugaaacagacccggacagacagacac

SEQ ID NO: 237107 - RNA, 64 nt, hsa
acacagccugaaacagacccggacagacagacacagccugaaacagacccagacaaacagacag

SEQ ID NO: 237108 - RNA, 64 nt, hsa
ugaaacagacccagacaaacagacagacagacacagccugaaacagacccagacagacagacag

SEQ ID NO: 237109 - RNA, 64 nt, hsa
acagccugaaacagacccagacagacagacagacagccugaaacagacccagacacagccugaa

SEQ ID NO: 237110 - RNA, 64 nt, hsa
agacagacagacagccugaaacagacccagacacagccugaaacagauccggacagacagacag

SEQ ID NO: 237111 - RNA, 64 nt, hsa
agccugaaacagauccggacagacagacagaaacagccugaaacagacccagacagacagacag

SEQ ID NO: 237112 - RNA, 64 nt, hsa
agccugaaacagacccagacagacagacagacacagccugaaacagacccggacagacagacag

SEQ ID NO: 237113 - RNA, 64 nt, hsa
agccugaaacagacccggacagacagacagacacagccugaaacagacccggacagacagacag

SEQ ID NO: 237114 - RNA, 64 nt, hsa; identical to SEQ ID NO: 237113

SEQ ID NO: 237115 - RNA, 64 nt, hsa
agccugaaacagacccggacagacagacagacacagccugaaacagaccuagacagacagacac

SEQ ID NO: 237116 - RNA, 64 nt, hsa
agauugaaacagacccagacaaacagacagacacagccugaaacagacccagacacagccugaa

SEQ ID NO: 237117 - RNA, 64 nt, hsa
acagacagacacagccugaaacagacccagacacagccugaaacagacccggacagacagacag

SEQ ID NO: 237118 - RNA, 64 nt, hsa
agccugaaacagacccggacagacagacagacacagccugaaacagacccagacagacagacag

SEQ ID NO: 237119 - RNA, 64 nt, hsa
agccugaaacagacccagacagacagacagacacagccugaaacagacccagacagacagaccg

SEQ ID NO: 237120 - RNA, 64 nt, hsa
agccugaaacagacccagacagacagaccgacgcagccugaaagagacccagacagagagacag

SEQ ID NO: 237121 - RNA, 64 nt, hsa
ccuacuaauuuaaacuaagacaguuuaaaaaggaagccugaaaaagacucauacuacaaauaau

SEQ ID NO: 237122 - RNA, 64 nt, hsa
gugguccuuggccgccuccugcuccugcucugcaagccugaaacuggcuugucuggagccagga

SEQ ID NO: 237123 - RNA, 64 nt, hsa
aagcagcccccuguggcggccuuccgggucucgcagccugaagccuggauuccagcagugaaug

SEQ ID NO: 237124 - RNA, 64 nt, hsa
aagggcacauugcccauggcugggaacaugacccagccugaaagauacaggggaucauguuaaa

SEQ ID NO: 237125 - RNA, 64 nt, hsa
cuguuguuacaaaccaccaaauaauacaguugugagccugaauacaggacugaacuccuauaca

SEQ ID NO: 237126 - RNA, 64 nt, hsa
aauguaguguagcucauuauugagaauuuaggaaagccugaauccauuaauuaaggaaauaaau

SEQ ID NO: 237127 - RNA, 64 nt, hsa
acugcucuguuuuaaaaacucagaggcaauuuuuacauaucaguaauuguuuuuauaauuugug

SEQ ID NO: 237128 - RNA, 64 nt, hsa
gaaauugaaucuguccaucuguuuauaaucaagaacauaucagaaauauauaggucccagguaa

SEQ ID NO: 237129 - RNA, 64 nt, hsa
gaagaaaaaauuaagagauacauucccuaucaaaacauaucaauucaacacauuacuugcacaa

SEQ ID NO: 237130 - RNA, 64 nt, hsa
uauuuuaaaaccaugcagcuucaucaauuuuuauacauaucagaaaaguagaauuauaucuaau

SEQ ID NO: 237131 - RNA, 64 nt, hsa
gaacuguaacaccucuaaucaauucaggagaaacacauaucauuuaaagcaacauaggcuaacc

SEQ ID NO: 237132 - RNA, 64 nt, hsa
aaagcuauuuacuuugguuuucuagaaaguuguuacauaucauggcugguuaacuuuuauuucu

SEQ ID NO: 237133 - RNA, 64 nt, hsa
uuuuaaggaaaacuaccuguauuuaaaaauagaaacauaucaaaaacaagagaaaagacacgag

SEQ ID NO: 237134 - RNA, 64 nt, hsa
aaugaggaggaugcuaaaaaugucacgaauauggacauaucaucuguggacugaccuuguaaaa

SEQ ID NO: 237135 - RNA, 64 nt, hsa
agagagccgccaaacauuccuccagacguccaccucagugcacgagcuggcccagaggcucucg

SEQ ID NO: 237136 - RNA, 64 nt, hsa
gucuuggcugccgcccugcuccacgcagucugcuucagugcagugaagguaggugugaggacca

SEQ ID NO: 237137 - RNA, 64 nt, hsa
ucuuacuucccugaagcaagagacuauauggccuucagugcaaagacuucagaccaauucuuug

SEQ ID NO: 237138 - RNA, 64 nt, hsa
aaauuuuaaaacccgagaaauggggaaaaaaaaaucagugcacaagaauugggcugguuaggcc

SEQ ID NO: 237139 - RNA, 64 nt, hsa
ggagcccuaaaugucagugcagcagcccuaaaugucagugcagcaguguuaaccagucauggug

SEQ ID NO: 237140 - RNA, 64 nt, hsa
uuuuaaugauuaaaaagugcaggagcccuaaaugucagugcagcagcccuaaaugucagugcag

SEQ ID NO: 237141 - RNA, 64 nt, hsa
uacagacgguuggcauacguuauagacuguauacucagugcaaauauagcugcauuuauaccuc

SEQ ID NO: 237142 - RNA, 64 nt, hsa
uucucugguccuucccuauuuucuguucuggaugucagugcagugcacugcuacuguuuuaucc

SEQ ID NO: 237143 - RNA, 64 nt, hsa
aucugugugcguggcuaucaggaguucuaggaacucagugcaauacgggagugacccagcuacu

SEQ ID NO: 237144 - RNA, 64 nt, hsa
uccgaaagaagacacagaaccaacaaaaccgcauucagugcaccugccucagcuaccuaaugau

SEQ ID NO: 237145 - RNA, 64 nt, hsa
cccagggcacagaugcugagacagccucuccuucucagugcagggacgucaccccugccaggca

SEQ ID NO: 237146 - RNA, 64 nt, hsa
cccagggcauagaugcugagacagccucucccucucagugcagggacgucaccccugccaggca

SEQ ID NO: 237147 - RNA, 64 nt, hsa
aucccgacacguccccguucccccgaaaccuggcucagugcaauacucccauugccaugggguc

SEQ ID NO: 237148 - RNA, 64 nt, hsa
ggacccuccugcccucagcuuggguuugggggccucagugcaggacaucuggccugaacaucga

SEQ ID NO: 237149 - RNA, 64 nt, hsa
auccauuccacgcaguugcucaaagcagaaauuuucagugcaagucuugaugcugcgccguccc

SEQ ID NO: 237150 - RNA, 64 nt, hsa
ugcccaggcuggaguacaauggugcgaucucagcucagugcaaccuccgccacccggguucagg

SEQ ID NO: 237151 - RNA, 64 nt, hsa; identical to SEQ ID NO: 44795

SEQ ID NO: 237152 - RNA, 64 nt, hsa; identical to SEQ ID NO: 44796

SEQ ID NO: 237153 - RNA, 64 nt, hsa; identical to SEQ ID NO: 44797

SEQ ID NO: 237154 - RNA, 64 nt, hsa; identical to SEQ ID NO: 44798

SEQ ID NO: 237155 - RNA, 64 nt, hsa; identical to SEQ ID NO: 44799

SEQ ID NO: 237156 - RNA, 64 nt, hsa; identical to SEQ ID NO: 44800

SEQ ID NO: 237157 - RNA, 64 nt, hsa; identical to SEQ ID NO: 44801

SEQ ID NO: 237158 - RNA, 64 nt, hsa; identical to SEQ ID NO: 44802

SEQ ID NO: 237159 - RNA, 64 nt, hsa; identical to SEQ ID NO: 44803

SEQ ID NO: 237160 - RNA, 64 nt, hsa; identical to SEQ ID NO: 44804

SEQ ID NO: 237161 - RNA, 64 nt, hsa; identical to SEQ ID NO: 44805

SEQ ID NO: 237162 - RNA, 64 nt, hsa; identical to SEQ ID NO: 44806

SEQ ID NO: 237163 - RNA, 64 nt, hsa; identical to SEQ ID NO: 44807

SEQ ID NO: 237164 - RNA, 64 nt, hsa; identical to SEQ ID NO: 44808

SEQ ID NO: 237165 - RNA, 64 nt, hsa; identical to SEQ ID NO: 44809

SEQ ID NO: 237166 - RNA, 64 nt, hsa; identical to SEQ ID NO: 44810

SEQ ID NO: 237167 - RNA, 64 nt, hsa; identical to SEQ ID NO: 44811

SEQ ID NO: 237168 - RNA, 64 nt, hsa; identical to SEQ ID NO: 44812

SEQ ID NO: 237169 - RNA, 64 nt, hsa; identical to SEQ ID NO: 44813

SEQ ID NO: 237170 - RNA, 64 nt, hsa; identical to SEQ ID NO: 44814

SEQ ID NO: 237171 - RNA, 64 nt, hsa; identical to SEQ ID NO: 44815

SEQ ID NO: 237172 - RNA, 64 nt, hsa; identical to SEQ ID NO: 44816

SEQ ID NO: 237173 - RNA, 64 nt, hsa; identical to SEQ ID NO: 44817

SEQ ID NO: 237174 - RNA, 64 nt, hsa; identical to SEQ ID NO: 44818

SEQ ID NO: 237175 - RNA, 64 nt, hsa; identical to SEQ ID NO: 44819

SEQ ID NO: 237176 - RNA, 64 nt, hsa; identical to SEQ ID NO: 44820

SEQ ID NO: 237177 - RNA, 64 nt, hsa; identical to SEQ ID NO: 44821

SEQ ID NO: 237178 - RNA, 64 nt, hsa; identical to SEQ ID NO: 44822

SEQ ID NO: 237179 - RNA, 64 nt, hsa; identical to SEQ ID NO: 44823

SEQ ID NO: 237180 - RNA, 64 nt, hsa; identical to SEQ ID NO: 44824

SEQ ID NO: 237181 - RNA, 64 nt, hsa; identical to SEQ ID NO: 44825

SEQ ID NO: 237182 - RNA, 64 nt, hsa; identical to SEQ ID NO: 44826

SEQ ID NO: 237183 - RNA, 64 nt, hsa; identical to SEQ ID NO: 44827

SEQ ID NO: 237184 - RNA, 64 nt, hsa; identical to SEQ ID NO: 44828

SEQ ID NO: 237185 - RNA, 64 nt, hsa; identical to SEQ ID NO: 44829

SEQ ID NO: 237186 - RNA, 64 nt, hsa; identical to SEQ ID NO: 44830

SEQ ID NO: 237187 - RNA, 64 nt, hsa; identical to SEQ ID NO: 44831

SEQ ID NO: 237188 - RNA, 64 nt, hsa; identical to SEQ ID NO: 44832

SEQ ID NO: 237189 - RNA, 64 nt, hsa; identical to SEQ ID NO: 44833

SEQ ID NO: 237190 - RNA, 64 nt, hsa; identical to SEQ ID NO: 44834

SEQ ID NO: 237191 - RNA, 64 nt, hsa; identical to SEQ ID NO: 44835

SEQ ID NO: 237192 - RNA, 64 nt, hsa; identical to SEQ ID NO: 44836

SEQ ID NO: 237193 - RNA, 64 nt, hsa; identical to SEQ ID NO: 44837

SEQ ID NO: 237194 - RNA, 64 nt, hsa; identical to SEQ ID NO: 44838

SEQ ID NO: 237195 - RNA, 64 nt, hsa; identical to SEQ ID NO: 44839

SEQ ID NO: 237196 - RNA, 64 nt, hsa; identical to SEQ ID NO: 44840

SEQ ID NO: 237197 - RNA, 59 nt, hsa; identical to SEQ ID NO: 44841

SEQ ID NO: 237198 - RNA, 64 nt, hsa; identical to SEQ ID NO: 44842

SEQ ID NO: 237199 - RNA, 64 nt, hsa; identical to SEQ ID NO: 44843

SEQ ID NO: 237200 - RNA, 64 nt, hsa; identical to SEQ ID NO: 44844

SEQ ID NO: 237201 - RNA, 64 nt, hsa; identical to SEQ ID NO: 44845

SEQ ID NO: 237202 - RNA, 64 nt, hsa; identical to SEQ ID NO: 44846

SEQ ID NO: 237203 - RNA, 64 nt, hsa; identical to SEQ ID NO: 44847

SEQ ID NO: 237204 - RNA, 64 nt, hsa; identical to SEQ ID NO: 44848

SEQ ID NO: 237205 - RNA, 64 nt, hsa; identical to SEQ ID NO: 44849

SEQ ID NO: 237206 - RNA, 64 nt, hsa; identical to SEQ ID NO: 44850

SEQ ID NO: 237207 - RNA, 64 nt, hsa; identical to SEQ ID NO: 44851

SEQ ID NO: 237208 - RNA, 64 nt, hsa; identical to SEQ ID NO: 44852

SEQ ID NO: 237209 - RNA, 64 nt, hsa; identical to SEQ ID NO: 44853

SEQ ID NO: 237210 - RNA, 64 nt, hsa; identical to SEQ ID NO: 44854

SEQ ID NO: 237211 - RNA, 64 nt, hsa; identical to SEQ ID NO: 44855

SEQ ID NO: 237212 - RNA, 64 nt, hsa; identical to SEQ ID NO: 44856

SEQ ID NO: 237213 - RNA, 64 nt, hsa; identical to SEQ ID NO: 44857

SEQ ID NO: 237214 - RNA, 64 nt, hsa; identical to SEQ ID NO: 44858

SEQ ID NO: 237215 - RNA, 64 nt, hsa; identical to SEQ ID NO: 44859

SEQ ID NO: 237216 - RNA, 64 nt, hsa; identical to SEQ ID NO: 44860

SEQ ID NO: 237217 - RNA, 64 nt, hsa; identical to SEQ ID NO: 44861

SEQ ID NO: 237218 - RNA, 64 nt, hsa; identical to SEQ ID NO: 44862

SEQ ID NO: 237219 - RNA, 64 nt, hsa; identical to SEQ ID NO: 44863

SEQ ID NO: 237220 - RNA, 64 nt, hsa; identical to SEQ ID NO: 44864

SEQ ID NO: 237221 - RNA, 64 nt, hsa
cccacccacucuguccugggaaaugaagaagcaucuuccuuaggucugcccugcuugcaaaucc

SEQ ID NO: 237222 - RNA, 64 nt, hsa
gggagggauugacauguuucaacaaaauaaugcacuuccuuaccuaguggcccuucacacaacu

SEQ ID NO: 237223 - RNA, 64 nt, hsa
cagagugccagaguuuuagccaaagguguacuuacuuccuuauuuaucugcaaaaggauggaaa

SEQ ID NO: 237224 - RNA, 64 nt, hsa
ucaccugucuuggaaacuccuucauaaagccgcucuuccuuaggccugggcuguuuggaagucc

SEQ ID NO: 237225 - RNA, 64 nt, hsa
uugaguaccgguagcuugugaucaaaggcauauacuuccuuaugagauuucuuuacuaaagcaa

SEQ ID NO: 237226 - RNA, 64 nt, hsa
gcaauuuugauucccauguaucacaugaauuacacuuccuuaaauaaauuacaguuuauggcug

SEQ ID NO: 237227 - RNA, 64 nt, hsa
auggggacauuagacugaaaacugggacaacccccuuccuuauuuuauagagacuaggaguuaa

SEQ ID NO: 237228 - RNA, 64 nt, hsa
guguggggauggagaggauggugcauuuccagugcuuccuuaccugucaauaacaaugguggcc

SEQ ID NO: 237229 - RNA, 64 nt, hsa
aaaguagggagauuaaaaaaaaagaaagaaaaugcuuccuuaucuggaagccuuucuggauuaa

SEQ ID NO: 237230 - RNA, 64 nt, hsa
acuguuugguccagcuuuagaacugugguuuugacuuccuuaucucuugggagaagcuucuguu

SEQ ID NO: 237231 - RNA, 64 nt, hsa
uuuuauugcgcucagguuauguuccuuuuaccuccuuccuuaauaaagagaccacuugaaauaa

SEQ ID NO: 237232 - RNA, 64 nt, hsa
gaaaaaucuuuaagucuuuguccccguucucuaacuuccuuacguuuucguuuauuuagcucua

SEQ ID NO: 237233 - RNA, 64 nt, hsa
cacacaucuccuccauguuccugccacagggccccuuccuuaaguaaugacuuaucuccuucca

SEQ ID NO: 237234 - RNA, 64 nt, hsa
aacucuccuacgaaccuccuaccuguuggccagccuuccuuaaacuacccuggacaccgcugag

SEQ ID NO: 237235 - RNA, 64 nt, hsa
uuucuugcucccagcacccgccccuuccucaccucuuccuuauuccauaggcugggagagaaac

SEQ ID NO: 237236 - RNA, 64 nt, hsa
agaagggagaagagaugggggcuugaacacggggcuuccuuacagccccggaugcagauuuuag

SEQ ID NO: 237237 - RNA, 64 nt, hsa
uuuuaaauuaaugggcaccuuucaacaucauuugcuuccuuaucuacaguugauucagaaaucu

SEQ ID NO: 237238 - RNA, 64 nt, hsa
uaauuuaccaaagccagaccuucaguucaacaugcuuccuuagcuuuucauaguugucugacau

SEQ ID NO: 237239 - RNA, 64 nt, hsa
uugucuccccacucccucccucuuuguuuccuuccuuccuuauuuccuuuaguuuccuuccuua

SEQ ID NO: 237240 - RNA, 64 nt, hsa
uuuguuuccuuccuuccuuauuuccuuuaguuuccuuccuuagccguuuugaguggugggaauc

SEQ ID NO: 237241 - RNA, 64 nt, hsa
ucucaguaccuggcuggggagggggauauuuuuccuuccuuaaguaguuuuacauugccacagu

SEQ ID NO: 237242 - RNA, 64 nt, hsa
uaagucauuagggcugagggcucggcuguaggggcuuccuuaggcugagagugcccccaggcug

SEQ ID NO: 237243 - RNA, 64 nt, hsa
ugugcagaccauuacuaaggucuaugucugcaaacauuacuaaucuagguccuauuacuaaucu

SEQ ID NO: 237244 - RNA, 64 nt, hsa
ccucaaaccugucacuuuggucagaugugcagaccauuacuaaggucuaugucugcaaacauua

SEQ ID NO: 237245 - RNA, 64 nt, hsa
gguagacaugugcuuugacauagcgugagcagcacauuacuaaagcaauuacaugcauguugca

SEQ ID NO: 237246 - RNA, 64 nt, hsa
gguagaacugauucuuaaggcaggccugaaaggccauuacuaauagaaacacagccuuuccaau

SEQ ID NO: 237247 - RNA, 64 nt, hsa
auaauuuacaaacuacuauaaacaaauuuauaaacauuacuaauuucugaugaaaauaaaguug

SEQ ID NO: 237248 - RNA, 64 nt, hsa
uccugauugucucuuaaaguaagugguuuauagacauuacuauuucugauaauaauuuacaaac

SEQ ID NO: 237249 - RNA, 64 nt, hsa
caugaaaaggcaaucuuaaaguucauuauguaaaacuaauuauaaacaggacccaauuuauauu

SEQ ID NO: 237250 - RNA, 64 nt, hsa
agauauaggagacuucaugcaauuuggagauaagacuaauuauuggggguuuuccuuggauuuu

SEQ ID NO: 237251 - RNA, 64 nt, hsa
ucaauaaauggaauugacugaacuucccaacgccacuaauuauuaaaauccaucugcuuauucu

SEQ ID NO: 237252 - RNA, 64 nt, hsa
caacuguuuuaaacuagcauuaaacugucauuguacuaauuaauguacuaaauccuauguuuac

SEQ ID NO: 237253 - RNA, 64 nt, hsa
ugcucuguggccuucuuacacuucucagagggcagaguggcagccgggcacccuacagaaacuc

SEQ ID NO: 237254 - RNA, 64 nt, hsa
ggcagccgggcacccuacagaaacucagagggcagaguggcagccaggcccacaugucucucaa

SEQ ID NO: 237255 - RNA, 64 nt, hsa
cuccuugggcccgccuccccaggagguagaaaaugaguggcaggcuagagauuucacccauuuu

SEQ ID NO: 237256 - RNA, 64 nt, hsa
uguguccacaagcagaggcccccucgaugggagggaguggcaggcaggagaagguggcgcugcc

SEQ ID NO: 237257 - RNA, 64 nt, hsa
guuugauagugcuucuuguaauauuucuucaagugaguggcauguggguugugauauugaccau

SEQ ID NO: 237258 - RNA, 64 nt, hsa
auucauaauuuuaucuacccagucauguacuggagaguggcaaaagucugaggcaccugcauau

SEQ ID NO: 237259 - RNA, 64 nt, hsa
ucaaaauaugcagcaaaaaccaauacaacaaaacgaguggcacgauuuauuucaaacuaggcca

SEQ ID NO: 237260 - RNA, 64 nt, hsa
gaucugucucucugcuccaaagaaauuuuggagugaguggcaguccugcgccagccucgcggga

SEQ ID NO: 237261 - RNA, 64 nt, hsa; identical to SEQ ID NO: 105003

SEQ ID NO: 237262 - RNA, 64 nt, hsa; identical to SEQ ID NO: 105004

SEQ ID NO: 237263 - RNA, 64 nt, hsa; identical to SEQ ID NO: 105005

SEQ ID NO: 237264 - RNA, 64 nt, hsa; identical to SEQ ID NO: 105006

SEQ ID NO: 237265 - RNA, 64 nt, hsa; identical to SEQ ID NO: 105007

SEQ ID NO: 237266 - RNA, 54 nt, hsa; identical to SEQ ID NO: 100148

SEQ ID NO: 237267 - RNA, 64 nt, hsa; identical to SEQ ID NO: 105009

SEQ ID NO: 237268 - RNA, 64 nt, hsa; identical to SEQ ID NO: 105010

SEQ ID NO: 237269 - RNA, 64 nt, hsa; identical to SEQ ID NO: 105011

SEQ ID NO: 237270 - RNA, 64 nt, hsa; identical to SEQ ID NO: 105012

SEQ ID NO: 237271 - RNA, 64 nt, hsa; identical to SEQ ID NO: 105013

SEQ ID NO: 237272 - RNA, 64 nt, hsa; identical to SEQ ID NO: 105014

SEQ ID NO: 237273 - RNA, 64 nt, hsa; identical to SEQ ID NO: 105015

SEQ ID NO: 237274 - RNA, 64 nt, hsa
aguaacuuccaugaugacacugacgccuauaccugagcucuaggcugccuggagggaaggaaca

SEQ ID NO: 237275 - RNA, 64 nt, hsa
aagcuccgagccuguuuucuguaguuuauaguuagagcucuauuuuguuaugguuuuuuaaacu

SEQ ID NO: 237276 - RNA, 64 nt, hsa
gagaaccuacaugucagguucuggaguuggcccugagcucuauccaccaagccagcaccccacc

SEQ ID NO: 237277 - RNA, 64 nt, hsa
gccccagcuccucucugcaacccagcccucuccugagcucuaggcugggauuacacccgcugga

SEQ ID NO: 237278 - RNA, 64 nt, hsa; identical to SEQ ID NO: 213296

SEQ ID NO: 237279 - RNA, 64 nt, hsa; identical to SEQ ID NO: 213297

SEQ ID NO: 237280 - RNA, 64 nt, hsa; identical to SEQ ID NO: 213298

SEQ ID NO: 237281 - RNA, 64 nt, hsa; identical to SEQ ID NO: 213299

SEQ ID NO: 237282 - RNA, 64 nt, hsa; identical to SEQ ID NO: 213300

SEQ ID NO: 237283 - RNA, 64 nt, hsa; identical to SEQ ID NO: 213301

SEQ ID NO: 237284 - RNA, 64 nt, hsa; identical to SEQ ID NO: 213302

SEQ ID NO: 237285 - RNA, 64 nt, hsa; identical to SEQ ID NO: 213303

SEQ ID NO: 237286 - RNA, 64 nt, hsa; identical to SEQ ID NO: 213304

SEQ ID NO: 237287 - RNA, 64 nt, hsa; identical to SEQ ID NO: 213305

SEQ ID NO: 237288 - RNA, 64 nt, hsa; identical to SEQ ID NO: 213306

SEQ ID NO: 237289 - RNA, 64 nt, hsa; identical to SEQ ID NO: 213307

SEQ ID NO: 237290 - RNA, 64 nt, hsa; identical to SEQ ID NO: 88803

SEQ ID NO: 237291 - RNA, 64 nt, hsa; identical to SEQ ID NO: 88804

SEQ ID NO: 237292 - RNA, 64 nt, hsa; identical to SEQ ID NO: 88805

SEQ ID NO: 237293 - RNA, 64 nt, hsa; identical to SEQ ID NO: 88806

SEQ ID NO: 237294 - RNA, 64 nt, hsa; identical to SEQ ID NO: 88807

SEQ ID NO: 237295 - RNA, 64 nt, hsa; identical to SEQ ID NO: 88808

SEQ ID NO: 237296 - RNA, 64 nt, hsa; identical to SEQ ID NO: 88809

SEQ ID NO: 237297 - RNA, 64 nt, hsa; identical to SEQ ID NO: 88810

SEQ ID NO: 237298 - RNA, 64 nt, hsa; identical to SEQ ID NO: 88811

SEQ ID NO: 237299 - RNA, 52 nt, hsa; identical to SEQ ID NO: 88812

SEQ ID NO: 237300 - RNA, 64 nt, hsa; identical to SEQ ID NO: 88813

SEQ ID NO: 237301 - RNA, 64 nt, hsa; identical to SEQ ID NO: 88814

SEQ ID NO: 237302 - RNA, 64 nt, hsa; identical to SEQ ID NO: 88815

SEQ ID NO: 237303 - RNA, 54 nt, hsa; identical to SEQ ID NO: 88816

SEQ ID NO: 237304 - RNA, 64 nt, hsa; identical to SEQ ID NO: 88817

SEQ ID NO: 237305 - RNA, 64 nt, hsa; identical to SEQ ID NO: 88818

SEQ ID NO: 237306 - RNA, 64 nt, hsa; identical to SEQ ID NO: 88819

SEQ ID NO: 237307 - RNA, 64 nt, hsa; identical to SEQ ID NO: 88820

SEQ ID NO: 237308 - RNA, 64 nt, hsa; identical to SEQ ID NO: 88821

SEQ ID NO: 237309 - RNA, 64 nt, hsa; identical to SEQ ID NO: 88822

SEQ ID NO: 237310 - RNA, 64 nt, hsa; identical to SEQ ID NO: 88823

SEQ ID NO: 237311 - RNA, 64 nt, hsa; identical to SEQ ID NO: 88824

SEQ ID NO: 237312 - RNA, 64 nt, hsa; identical to SEQ ID NO: 88825

SEQ ID NO: 237313 - RNA, 64 nt, hsa; identical to SEQ ID NO: 88826

SEQ ID NO: 237314 - RNA, 64 nt, hsa; identical to SEQ ID NO: 88827

SEQ ID NO: 237315 - RNA, 64 nt, hsa; identical to SEQ ID NO: 88828

SEQ ID NO: 237316 - RNA, 64 nt, hsa; identical to SEQ ID NO: 88829

SEQ ID NO: 237317 - RNA, 64 nt, hsa; identical to SEQ ID NO: 88830

SEQ ID NO: 237318 - RNA, 64 nt, hsa; identical to SEQ ID NO: 88831

SEQ ID NO: 237319 - RNA, 64 nt, hsa; identical to SEQ ID NO: 88832

SEQ ID NO: 237320 - RNA, 64 nt, hsa; identical to SEQ ID NO: 88833

SEQ ID NO: 237321 - RNA, 64 nt, hsa; identical to SEQ ID NO: 88834

SEQ ID NO: 237322 - RNA, 64 nt, hsa; identical to SEQ ID NO: 88835

SEQ ID NO: 237323 - RNA, 64 nt, hsa; identical to SEQ ID NO: 88836

SEQ ID NO: 237324 - RNA, 64 nt, hsa; identical to SEQ ID NO: 88837

SEQ ID NO: 237325 - RNA, 64 nt, hsa; identical to SEQ ID NO: 88838

SEQ ID NO: 237326 - RNA, 64 nt, hsa; identical to SEQ ID NO: 88839

SEQ ID NO: 237327 - RNA, 64 nt, hsa; identical to SEQ ID NO: 88840

SEQ ID NO: 237328 - RNA, 64 nt, hsa; identical to SEQ ID NO: 88841

SEQ ID NO: 237329 - RNA, 62 nt, hsa; identical to SEQ ID NO: 88842

SEQ ID NO: 237330 - RNA, 64 nt, hsa; identical to SEQ ID NO: 88843

SEQ ID NO: 237331 - RNA, 64 nt, hsa; identical to SEQ ID NO: 88844

SEQ ID NO: 237332 - RNA, 64 nt, hsa; identical to SEQ ID NO: 88845

SEQ ID NO: 237333 - RNA, 64 nt, hsa; identical to SEQ ID NO: 88846

SEQ ID NO: 237334 - RNA, 64 nt, hsa; identical to SEQ ID NO: 88847

SEQ ID NO: 237335 - RNA, 64 nt, hsa; identical to SEQ ID NO: 88848

SEQ ID NO: 237336 - RNA, 64 nt, hsa; identical to SEQ ID NO: 88849

SEQ ID NO: 237337 - RNA, 64 nt, hsa; identical to SEQ ID NO: 88850

SEQ ID NO: 237338 - RNA, 64 nt, hsa; identical to SEQ ID NO: 88851

SEQ ID NO: 237339 - RNA, 64 nt, hsa; identical to SEQ ID NO: 88852

SEQ ID NO: 237340 - RNA, 64 nt, hsa; identical to SEQ ID NO: 88853

SEQ ID NO: 237341 - RNA, 64 nt, hsa; identical to SEQ ID NO: 88854

SEQ ID NO: 237342 - RNA, 64 nt, hsa
gcauguccccucaggucuccagucaguccagguugacccucaguucuggacguguguauauagc

SEQ ID NO: 237343 - RNA, 64 nt, hsa
ucugagcaggccaggggcugacagcuaaugucaggacccucagcgguggagccugcugggggga

SEQ ID NO: 237344 - RNA, 64 nt, hsa
ccaccacugcaccauuuccaggagggagaguggggacccucagccgcccccuuuuccuucccau

SEQ ID NO: 237345 - RNA, 64 nt, hsa
ucugccucaucguuccccugagcacugggggacagacccucacccccacccuggggguguggca

SEQ ID NO: 237346 - RNA, 64 nt, hsa
cgcgcggcugaacaugggcauccuaggcuccuacgacccucagcagaucuucaagugcaaaggg

SEQ ID NO: 237347 - RNA, 64 nt, hsa
aggugugggacauugaguccaaggagcaggugcggacccucacgggccacgugggcaccgugua

SEQ ID NO: 237348 - RNA, 64 nt, hsa
gaauccaucagggccaugagugucacccagaccugacccucaccaauuccagcccugacccuca

SEQ ID NO: 237349 - RNA, 64 nt, hsa
ucacccagaccugacccucaccaauuccagcccugacccucaggacgcuggaugccagcuccca

SEQ ID NO: 237350 - RNA, 64 nt, hsa
guccaccaguaucuggggugggcacguggucggggacccucagcagcaggggcucugucucccu

SEQ ID NO: 237351 - RNA, 64 nt, hsa
accgucuguacucagagcgacggaugcccccugggacccucacugccuccgucuguucaucacc

SEQ ID NO: 237352 - RNA, 64 nt, hsa
caccccugccugccaccugggcccucacagcccagacccucacugggaggugagcucagcugcc

SEQ ID NO: 237353 - RNA, 64 nt, hsa
ggaucugggaauggaaggugcucccaucggaggggacccucagagcccuggagacugccaggug

SEQ ID NO: 237354 - RNA, 64 nt, hsa
ccacccugagaaccccucugggaaaaucuauuccugccaccacugggcaaacagaagaauuuuu

SEQ ID NO: 237355 - RNA, 64 nt, hsa
acgguuuucauugacacucuucccuccucccaccugccaccaggccucaccaaagcccacugcc

SEQ ID NO: 237356 - RNA, 64 nt, hsa
cccagccucccauauagcugggauuauaggugccugccaccaugcccagcuaauuuuuguguuu

SEQ ID NO: 237357 - RNA, 64 nt, hsa
aucagccucccaaguagcugggauuauaggcaugugccaccaugcccagcaaauuuuguauuuu

SEQ ID NO: 237358 - RNA, 64 nt, hsa
auacaucuugggcaacuaguuaccaaaugaauugugccaccauaacugauuuuaauuuugcauu

SEQ ID NO: 237359 - RNA, 64 nt, hsa
aggcacugauuucuauaauagagcucuaaaaacaugccaccaguguaugaauaagggaaagauu

SEQ ID NO: 237360 - RNA, 64 nt, hsa
cucagccucccaaguagccaggacuauaggcaccugccaccaugccuggcuaauuuuuguauuu

SEQ ID NO: 237361 - RNA, 64 nt, hsa
cucagccuccugaguagcuggaacuacaugcgcgugccaccacgcacagcuaauuuuuauaauu

SEQ ID NO: 237362 - RNA, 64 nt, hsa
ccuuguugggagggagaacccucuccagaaacccugccaccauggugucuugccguacuuccca

SEQ ID NO: 237363 - RNA, 64 nt, hsa
cucccagcccguggguggcagcgugcuagcacacugccaccaucucaaagccaucccccuagcc

SEQ ID NO: 237364 - RNA, 64 nt, hsa
aguauuuuugggcuauugcauaaggagccacugcugccaccacuuuuggauuuuaugggaggcu

SEQ ID NO: 237365 - RNA, 64 nt, hsa
cucagccuccugagcagcugggacuacaggcgcaugccaccaugcccagcuaauuuuuguauuu

SEQ ID NO: 237366 - RNA, 64 nt, hsa
caaacuauacugaacauuccuguccuagcgucccugccaccaggcccaaugcaucugauccuug

SEQ ID NO: 237367 - RNA, 64 nt, hsa
acuaaagaacacuuucagaaccacuucuugauucugccaccacuugaucccauaacaggcuacc

SEQ ID NO: 237368 - RNA, 64 nt, hsa
cucagccucccaaguagcugggauuacaggugccugccaccaugccuggcuaauuuuuuuguau

SEQ ID NO: 237369 - RNA, 64 nt, hsa
cucagccuccugaguagcugggacuacaggcgccugccaccacgcccagcuaauuuuuguauuu

SEQ ID NO: 237370 - RNA, 64 nt, hsa
cccuuccuauggcggcccugagugugaguaucccugccaccaagagagcaaugggcagggaagg

SEQ ID NO: 237371 - RNA, 64 nt, hsa
uagggcuggcaccaguggaaacacauacugaagcugccaccacaauagcuugugagguuuuauc

SEQ ID NO: 237372 - RNA, 64 nt, hsa
cagccugccugguagcugagacuuaacaggcaucugccaccaugcuugacuaauuuuugugauu

SEQ ID NO: 237373 - RNA, 64 nt, hsa
cucagccucccaaguagcugggauuacaggugucugccaccaugccaggcuaauuuuuguauuu

SEQ ID NO: 237374 - RNA, 64 nt, hsa
cucagccucccaauuuacugggauuacaggcaccugccaccacgcccagcuaauuuuuguauuu

SEQ ID NO: 237375 - RNA, 64 nt, hsa
cucagccucccaaguagcugggauuacaggcaugugccaccaugcccagcuaauuuuguuuuuu

SEQ ID NO: 237376 - RNA, 64 nt, hsa
gcggaaacauagacgugggggcauaggcucccacugccaccaccgccaucgccucaccugcagc

SEQ ID NO: 237377 - RNA, 64 nt, hsa
ugcaggaccuccucuuggccacuuggccugggccugccaccaccacguccugcagaacgagccc

SEQ ID NO: 237378 - RNA, 64 nt, hsa
aaguguacucaaaauaucauaauuguacaguuuaugccaccauaauuugaggccuauagauuua

SEQ ID NO: 237379 - RNA, 64 nt, hsa
cucagccucccgaguagcuggaauuacaggcaccugccaccacgccuggcuaauuuuguauuuu

SEQ ID NO: 237380 - RNA, 64 nt, hsa
guuuagaaauuugcaagggcuucuuuuccgcaaaugccaccagcagauuauaauuuugucagca

SEQ ID NO: 237381 - RNA, 64 nt, hsa
uaauuuugucagcaaugcuauuaucucuaauuagugccaccagacuagaccuguaucauucaug

SEQ ID NO: 237382 - RNA, 64 nt, hsa
ccucaacccacaaguagcuacgacugcaagcaccugccaccauaaagggcugcauuuugccacc

SEQ ID NO: 237383 - RNA, 64 nt, hsa
cugcaagcaccugccaccauaaagggcugcauuuugccaccauaaagggcugcauuuuuuuaaa

SEQ ID NO: 237384 - RNA, 64 nt, hsa
cuuagccuccugaaaagcugggauuacagggcccugccaccaagcccagcuaauuguauuuuua

SEQ ID NO: 237385 - RNA, 64 nt, hsa
agccuguuccaggcgcuggucagugcguguucuuugccaccagccugucacuccaguggcagcu

SEQ ID NO: 237386 - RNA, 64 nt, hsa
ugacagaggccuagggcuguaucucucccugggcugccaccagagaaggugcuugguguucgcc

SEQ ID NO: 237387 - RNA, 64 nt, hsa
ggcagagaggugccaucaguucgccuccauuccuugccaccaugaccagccucucccugaacuc

SEQ ID NO: 237388 - RNA, 64 nt, hsa
uccacaaaugauguuuucaggugucauggacuguugccaccauguauucauccagaguucuuaa

SEQ ID NO: 237389 - RNA, 64 nt, hsa
cagugcucucuccacuaccccacaccagccuuggugccaccaaaagugcuccccaaaaggaagg

SEQ ID NO: 237390 - RNA, 64 nt, hsa
ggacuaaagaggacgccguccuuaaaaccugacgugccaccaaagccuuccuuuguuccucaaa

SEQ ID NO: 237391 - RNA, 64 nt, hsa
uagcauuuuuuuuucauguguggcaucuuuuucaugccaccaacaaacuuguugugugugugcg

SEQ ID NO: 237392 - RNA, 64 nt, hsa
gucagccaccagaguagcugagacuacagggguaugccaccaugcccagcuggcauuuguuaau

SEQ ID NO: 237393 - RNA, 64 nt, hsa
cucagccuccugaguagcugagaccacaggcgugugccaccacgccuagcuaauuuuuuauacc

SEQ ID NO: 237394 - RNA, 64 nt, hsa
cucagccuccugaguagcugggauuacagguguaugccaccacgccuggcuuaugaugaauauu

SEQ ID NO: 237395 - RNA, 64 nt, hsa
cugaagaaggcaugggauggagcccuggcauagcugccaccaugccuaugugcccaagagcugc

SEQ ID NO: 237396 - RNA, 64 nt, hsa
cuaagccaccugagcagcugggauuacaggugcaugccaccaugccuggcuaauuuugguauuu

SEQ ID NO: 237397 - RNA, 64 nt, hsa
gucagccuccagaguagcugggaccgcaggcacuugccaccacgccccacuaaaaauuuuuuaa

SEQ ID NO: 237398 - RNA, 64 nt, hsa
cucagccuccugaguagcugggacuauaggcgcgugccaccacaaccagcuaaauuuuuuugua

SEQ ID NO: 237399 - RNA, 64 nt, hsa
cucaggcccccuaguagcuggcauuacaggcacaugccaccacgcccaacuaauuuuuauauuu

SEQ ID NO: 237400 - RNA, 64 nt, hsa
cauccaccaaccaccugggcgagccacccuggguugccaccaucaagcuguccggcucucuggu

SEQ ID NO: 237401 - RNA, 64 nt, hsa
ccaggugcuuaacuccugucccugcaaguguuacugccaccaccagccacgccaucgccgccug

SEQ ID NO: 237402 - RNA, 64 nt, hsa
uugaguggaucaucucuuggaaaugcagaacuucugccaccacuuggcuauuugcacagucauc

SEQ ID NO: 237403 - RNA, 64 nt, hsa
guuagaaaugucugucuggaaacaggacacaucuugccaccacaaguccacaccuggccuuggc

SEQ ID NO: 237404 - RNA, 64 nt, hsa
ugguccugaaaguuaacaggagggcuggggucccugccaccaguuuucaccuagccagucuuga

SEQ ID NO: 237405 - RNA, 64 nt, hsa
cauccuggguuugcuucugaccuugucaugugugugccaccaaacacguuauuggcaccuuuuu

SEQ ID NO: 237406 - RNA, 64 nt, hsa
cggagcgaagagccaagcagaagcuccuggagauugccaccaagcccacguacccggugagccu

SEQ ID NO: 237407 - RNA, 64 nt, hsa
cucagccucccgaguagcugggacuacaggcgugugccaccaugccuggcuaauuuuuguauuu

SEQ ID NO: 237408 - RNA, 64 nt, hsa
caccucugccucccaaguaacugggacuauagcaugccaccacacccagcugauuaucauauuu

SEQ ID NO: 237409 - RNA, 64 nt, hsa
cacuucugccucccaaguaacugggacuauagcaugccaccacacccagcugauuaucauauuu

SEQ ID NO: 237410 - RNA, 64 nt, hsa; identical to SEQ ID NO: 189120

SEQ ID NO: 237411 - RNA, 64 nt, hsa; identical to SEQ ID NO: 189121

SEQ ID NO: 237412 - RNA, 64 nt, hsa; identical to SEQ ID NO: 189122

SEQ ID NO: 237413 - RNA, 64 nt, hsa; identical to SEQ ID NO: 189123

SEQ ID NO: 237414 - RNA, 64 nt, hsa; identical to SEQ ID NO: 189124

SEQ ID NO: 237415 - RNA, 64 nt, hsa; identical to SEQ ID NO: 189125

SEQ ID NO: 237416 - RNA, 64 nt, hsa; identical to SEQ ID NO: 189126

SEQ ID NO: 237417 - RNA, 64 nt, hsa; identical to SEQ ID NO: 189127

SEQ ID NO: 237418 - RNA, 64 nt, hsa; identical to SEQ ID NO: 189128

SEQ ID NO: 237419 - RNA, 64 nt, hsa; identical to SEQ ID NO: 189129

SEQ ID NO: 237420 - RNA, 64 nt, hsa; identical to SEQ ID NO: 189130

SEQ ID NO: 237421 - RNA, 64 nt, hsa; identical to SEQ ID NO: 189131

SEQ ID NO: 237422 - RNA, 64 nt, hsa; identical to SEQ ID NO: 189132

SEQ ID NO: 237423 - RNA, 64 nt, hsa; identical to SEQ ID NO: 189133

SEQ ID NO: 237424 - RNA, 64 nt, hsa; identical to SEQ ID NO: 189134

SEQ ID NO: 237425 - RNA, 64 nt, hsa; identical to SEQ ID NO: 189135

SEQ ID NO: 237426 - RNA, 64 nt, hsa; identical to SEQ ID NO: 189136

SEQ ID NO: 237427 - RNA, 64 nt, hsa; identical to SEQ ID NO: 189137

SEQ ID NO: 237428 - RNA, 64 nt, hsa; identical to SEQ ID NO: 189138

SEQ ID NO: 237429 - RNA, 64 nt, hsa; identical to SEQ ID NO: 189139

SEQ ID NO: 237430 - RNA, 64 nt, hsa; identical to SEQ ID NO: 189140

SEQ ID NO: 237431 - RNA, 64 nt, hsa; identical to SEQ ID NO: 189141

SEQ ID NO: 237432 - RNA, 64 nt, hsa; identical to SEQ ID NO: 189142

SEQ ID NO: 237433 - RNA, 64 nt, hsa; identical to SEQ ID NO: 189143

SEQ ID NO: 237434 - RNA, 64 nt, hsa; identical to SEQ ID NO: 189144

SEQ ID NO: 237435 - RNA, 64 nt, hsa; identical to SEQ ID NO: 189145

SEQ ID NO: 237436 - RNA, 64 nt, hsa; identical to SEQ ID NO: 189146

SEQ ID NO: 237437 - RNA, 64 nt, hsa; identical to SEQ ID NO: 189147

SEQ ID NO: 237438 - RNA, 64 nt, hsa; identical to SEQ ID NO: 189148

SEQ ID NO: 237439 - RNA, 64 nt, hsa; identical to SEQ ID NO: 189149

SEQ ID NO: 237440 - RNA, 64 nt, hsa; identical to SEQ ID NO: 189150

SEQ ID NO: 237441 - RNA, 64 nt, hsa; identical to SEQ ID NO: 189151

SEQ ID NO: 237442 - RNA, 64 nt, hsa; identical to SEQ ID NO: 189152

SEQ ID NO: 237443 - RNA, 64 nt, hsa; identical to SEQ ID NO: 189153

SEQ ID NO: 237444 - RNA, 64 nt, hsa; identical to SEQ ID NO: 189154

SEQ ID NO: 237445 - RNA, 64 nt, hsa; identical to SEQ ID NO: 189155

SEQ ID NO: 237446 - RNA, 64 nt, hsa; identical to SEQ ID NO: 189156

SEQ ID NO: 237447 - RNA, 64 nt, hsa; identical to SEQ ID NO: 189157

SEQ ID NO: 237448 - RNA, 64 nt, hsa; identical to SEQ ID NO: 189158

SEQ ID NO: 237449 - RNA, 64 nt, hsa; identical to SEQ ID NO: 189159

SEQ ID NO: 237450 - RNA, 64 nt, hsa; identical to SEQ ID NO: 189160

SEQ ID NO: 237451 - RNA, 64 nt, hsa; identical to SEQ ID NO: 189161

SEQ ID NO: 237452 - RNA, 64 nt, hsa; identical to SEQ ID NO: 189162

SEQ ID NO: 237453 - RNA, 64 nt, hsa; identical to SEQ ID NO: 189163

SEQ ID NO: 237454 - RNA, 64 nt, hsa; identical to SEQ ID NO: 189164

SEQ ID NO: 237455 - RNA, 64 nt, hsa; identical to SEQ ID NO: 189165

SEQ ID NO: 237456 - RNA, 64 nt, hsa; identical to SEQ ID NO: 189166

SEQ ID NO: 237457 - RNA, 64 nt, hsa; identical to SEQ ID NO: 189167

SEQ ID NO: 237458 - RNA, 64 nt, hsa; identical to SEQ ID NO: 189168

SEQ ID NO: 237459 - RNA, 64 nt, hsa; identical to SEQ ID NO: 189169

SEQ ID NO: 237460 - RNA, 64 nt, hsa; identical to SEQ ID NO: 189170

SEQ ID NO: 237461 - RNA, 64 nt, hsa; identical to SEQ ID NO: 189171

SEQ ID NO: 237462 - RNA, 64 nt, hsa; identical to SEQ ID NO: 189172

SEQ ID NO: 237463 - RNA, 64 nt, hsa; identical to SEQ ID NO: 189173

SEQ ID NO: 237464 - RNA, 64 nt, hsa; identical to SEQ ID NO: 189174

SEQ ID NO: 237465 - RNA, 64 nt, hsa; identical to SEQ ID NO: 189175

SEQ ID NO: 237466 - RNA, 64 nt, hsa; identical to SEQ ID NO: 189176

SEQ ID NO: 237467 - RNA, 64 nt, hsa; identical to SEQ ID NO: 189177

SEQ ID NO: 237468 - RNA, 64 nt, hsa; identical to SEQ ID NO: 189178

SEQ ID NO: 237469 - RNA, 64 nt, hsa; identical to SEQ ID NO: 189179

SEQ ID NO: 237470 - RNA, 64 nt, hsa; identical to SEQ ID NO: 189180

SEQ ID NO: 237471 - RNA, 64 nt, hsa; identical to SEQ ID NO: 189181

SEQ ID NO: 237472 - RNA, 64 nt, hsa; identical to SEQ ID NO: 189182

SEQ ID NO: 237473 - RNA, 64 nt, hsa; identical to SEQ ID NO: 189183

SEQ ID NO: 237474 - RNA, 64 nt, hsa; identical to SEQ ID NO: 189184

SEQ ID NO: 237475 - RNA, 64 nt, hsa; identical to SEQ ID NO: 51693

SEQ ID NO: 237476 - RNA, 64 nt, hsa; identical to SEQ ID NO: 51694

SEQ ID NO: 237477 - RNA, 64 nt, hsa; identical to SEQ ID NO: 51695

SEQ ID NO: 237478 - RNA, 64 nt, hsa; identical to SEQ ID NO: 51696

SEQ ID NO: 237479 - RNA, 64 nt, hsa; identical to SEQ ID NO: 51697

SEQ ID NO: 237480 - RNA, 64 nt, hsa; identical to SEQ ID NO: 51698

SEQ ID NO: 237481 - RNA, 64 nt, hsa; identical to SEQ ID NO: 51699

SEQ ID NO: 237482 - RNA, 64 nt, hsa; identical to SEQ ID NO: 51700

SEQ ID NO: 237483 - RNA, 64 nt, hsa; identical to SEQ ID NO: 51701

SEQ ID NO: 237484 - RNA, 64 nt, hsa; identical to SEQ ID NO: 51702

SEQ ID NO: 237485 - RNA, 64 nt, hsa; identical to SEQ ID NO: 51703

SEQ ID NO: 237486 - RNA, 64 nt, hsa; identical to SEQ ID NO: 51704

SEQ ID NO: 237487 - RNA, 64 nt, hsa; identical to SEQ ID NO: 51705

SEQ ID NO: 237488 - RNA, 64 nt, hsa; identical to SEQ ID NO: 235935

SEQ ID NO: 237489 - RNA, 64 nt, hsa; identical to SEQ ID NO: 235936

SEQ ID NO: 237490 - RNA, 64 nt, hsa; identical to SEQ ID NO: 235937

SEQ ID NO: 237491 - RNA, 64 nt, hsa; identical to SEQ ID NO: 235938

SEQ ID NO: 237492 - RNA, 64 nt, hsa; identical to SEQ ID NO: 235939

SEQ ID NO: 237493 - RNA, 64 nt, hsa; identical to SEQ ID NO: 235940

SEQ ID NO: 237494 - RNA, 64 nt, hsa; identical to SEQ ID NO: 235941

SEQ ID NO: 237495 - RNA, 64 nt, hsa; identical to SEQ ID NO: 235942

SEQ ID NO: 237496 - RNA, 64 nt, hsa; identical to SEQ ID NO: 235943

SEQ ID NO: 237497 - RNA, 64 nt, hsa; identical to SEQ ID NO: 235944

SEQ ID NO: 237498 - RNA, 64 nt, hsa; identical to SEQ ID NO: 235945

SEQ ID NO: 237499 - RNA, 64 nt, hsa; identical to SEQ ID NO: 235946

SEQ ID NO: 237500 - RNA, 64 nt, hsa; identical to SEQ ID NO: 235947

SEQ ID NO: 237501 - RNA, 64 nt, hsa; identical to SEQ ID NO: 235948

SEQ ID NO: 237502 - RNA, 64 nt, hsa; identical to SEQ ID NO: 235949

SEQ ID NO: 237503 - RNA, 64 nt, hsa; identical to SEQ ID NO: 235950

SEQ ID NO: 237504 - RNA, 64 nt, hsa; identical to SEQ ID NO: 235951

SEQ ID NO: 237505 - RNA, 64 nt, hsa; identical to SEQ ID NO: 235952

SEQ ID NO: 237506 - RNA, 64 nt, hsa; identical to SEQ ID NO: 235953

SEQ ID NO: 237507 - RNA, 64 nt, hsa; identical to SEQ ID NO: 235954

SEQ ID NO: 237508 - RNA, 64 nt, hsa; identical to SEQ ID NO: 235955

SEQ ID NO: 237509 - RNA, 64 nt, hsa; identical to SEQ ID NO: 235956

SEQ ID NO: 237510 - RNA, 64 nt, hsa; identical to SEQ ID NO: 235957

SEQ ID NO: 237511 - RNA, 64 nt, hsa; identical to SEQ ID NO: 235958

SEQ ID NO: 237512 - RNA, 64 nt, hsa; identical to SEQ ID NO: 235959

SEQ ID NO: 237513 - RNA, 64 nt, hsa; identical to SEQ ID NO: 235960

SEQ ID NO: 237514 - RNA, 64 nt, hsa; identical to SEQ ID NO: 235961

SEQ ID NO: 237515 - RNA, 64 nt, hsa; identical to SEQ ID NO: 235962

SEQ ID NO: 237516 - RNA, 64 nt, hsa; identical to SEQ ID NO: 235963

SEQ ID NO: 237517 - RNA, 64 nt, hsa; identical to SEQ ID NO: 235964

SEQ ID NO: 237518 - RNA, 64 nt, hsa; identical to SEQ ID NO: 235965

SEQ ID NO: 237519 - RNA, 64 nt, hsa; identical to SEQ ID NO: 235966

SEQ ID NO: 237520 - RNA, 64 nt, hsa; identical to SEQ ID NO: 235967

SEQ ID NO: 237521 - RNA, 64 nt, hsa; identical to SEQ ID NO: 235968

SEQ ID NO: 237522 - RNA, 64 nt, hsa; identical to SEQ ID NO: 235969

SEQ ID NO: 237523 - RNA, 64 nt, hsa; identical to SEQ ID NO: 235970

SEQ ID NO: 237524 - RNA, 64 nt, hsa; identical to SEQ ID NO: 235971

SEQ ID NO: 237525 - RNA, 64 nt, hsa; identical to SEQ ID NO: 235972

SEQ ID NO: 237526 - RNA, 64 nt, hsa; identical to SEQ ID NO: 235973

SEQ ID NO: 237527 - RNA, 64 nt, hsa; identical to SEQ ID NO: 235974

SEQ ID NO: 237528 - RNA, 58 nt, hsa; identical to SEQ ID NO: 235975

SEQ ID NO: 237529 - RNA, 64 nt, hsa; identical to SEQ ID NO: 235976

SEQ ID NO: 237530 - RNA, 64 nt, hsa; identical to SEQ ID NO: 235977

SEQ ID NO: 237531 - RNA, 64 nt, hsa; identical to SEQ ID NO: 235978

SEQ ID NO: 237532 - RNA, 64 nt, hsa; identical to SEQ ID NO: 235979

SEQ ID NO: 237533 - RNA, 64 nt, hsa; identical to SEQ ID NO: 235980

SEQ ID NO: 237534 - RNA, 64 nt, hsa; identical to SEQ ID NO: 235981

SEQ ID NO: 237535 - RNA, 64 nt, hsa; identical to SEQ ID NO: 235981

SEQ ID NO: 237536 - RNA, 64 nt, hsa; identical to SEQ ID NO: 235983

SEQ ID NO: 237537 - RNA, 64 nt, hsa; identical to SEQ ID NO: 235984

SEQ ID NO: 237538 - RNA, 64 nt, hsa; identical to SEQ ID NO: 235985

SEQ ID NO: 237539 - RNA, 64 nt, hsa; identical to SEQ ID NO: 235986

SEQ ID NO: 237540 - RNA, 64 nt, hsa; identical to SEQ ID NO: 235987

SEQ ID NO: 237541 - RNA, 64 nt, hsa; identical to SEQ ID NO: 235988

SEQ ID NO: 237542 - RNA, 64 nt, hsa; identical to SEQ ID NO: 235989

SEQ ID NO: 237543 - RNA, 64 nt, hsa; identical to SEQ ID NO: 235990

SEQ ID NO: 237544 - RNA, 64 nt, hsa; identical to SEQ ID NO: 235991

SEQ ID NO: 237545 - RNA, 64 nt, hsa; identical to SEQ ID NO: 235992

SEQ ID NO: 237546 - RNA, 64 nt, hsa
auuccuauaaaaauguaaaugcaaggucacacauauuaaugacagccuguuguauuaaugaugg

SEQ ID NO: 237547 - RNA, 64 nt, hsa
ugcaaggucacacauauuaaugacagccuguuguauuaaugauggcuccaggucagugucugga

SEQ ID NO: 237548 - RNA, 64 nt, hsa
ugaaauuuguauucauuuuccagauggcuaguuuauuaaugauuucccaaaagccauaccuuaa

SEQ ID NO: 237549 - RNA, 64 nt, hsa
cuugguucaucacauuauaagauaaauaaauuaaauuaaugaaaaugugacuuagaguaggggu

SEQ ID NO: 237550 - RNA, 64 nt, hsa
gagucuguaguuacuaaacccuaauggaauaauuauuaaugaaagauuuuugaaauauaaaaaa

SEQ ID NO: 237551 - RNA, 64 nt, hsa
gcaaagguaaucucucauuuuaaaauuggacaguauuaaugaaggggaaauauacaauuuauuu

SEQ ID NO: 237552 - RNA, 64 nt, hsa
uauaggaacacaguuuauucucucugauagagcuauuaaugacuuaguuucuguaaaagaaaug

SEQ ID NO: 237553 - RNA, 64 nt, hsa
aauacacugguuaugaaauuguauuuuuuuaaguauuaaugaaaaaagagccauaagcauucca

SEQ ID NO: 237554 - RNA, 64 nt, hsa
ugaaagcauuauuuuuuguugaauaggaaauaaaauuaaugaagacagaggcuagaaagcaucc

SEQ ID NO: 237555 - RNA, 64 nt, hsa
auuaaugaagacagaggcuagaaagcauccauuaauuaaugagacacacuuaacuacuuaucuc

SEQ ID NO: 237556 - RNA, 64 nt, hsa
uucuuaaacuucuauuuaggaaauuacauuaaguauuaaugaggggaaaggaaaugagcucuac

SEQ ID NO: 237557 - RNA, 64 nt, hsa
ucuacaagcuggaaagcagcuucuuagcugccuaauuaaugaaagaugaaaauaggaagugccc

SEQ ID NO: 237558 - RNA, 64 nt, hsa
uacugacuucugcaaaguauuagugguugaauuuauuaaugaaauuuguccugagucuggaggg

SEQ ID NO: 237559 - RNA, 64 nt, hsa
uucuguucuuccuuacaccuaaauaauacaagagauuaaugaauagugguuagaaguaguugag

SEQ ID NO: 237560 - RNA, 64 nt, hsa
ugcauugacuuaugagauaauuaaugauuaaacuauuaaugauaaaaauaaugcauuuguauug

SEQ ID NO: 237561 - RNA, 64 nt, hsa
aguaauuucacucucugcauugacuuaugagauaauuaaugauuaaacuauuaaugauaaaaau

SEQ ID NO: 237562 - RNA, 64 nt, hsa
uggucaaagccccaggaaaccuaccaaagcuagaauuaaugacaacuggugggaaaccuagcau

SEQ ID NO: 237563 - RNA, 64 nt, hsa
uauaauuuaagaaauagucuauguaaagucacaaauuaaugaaaaaaauucgcaugaaaaugac

SEQ ID NO: 237564 - RNA, 64 nt, hsa
ugaaauggcaggugggcucuguaaguuauuuuggauuaaugacauucagggucuuugcaguggg

SEQ ID NO: 237565 - RNA, 64 nt, hsa
uuuuuauguuauugaaaauauugaaagaacugauauuaaugauaaucauuuuauuuuucaucuc

SEQ ID NO: 237566 - RNA, 64 nt, hsa
uuccuccaggcuuguaauacccuucacauggaagauuaaugagggaaaucuuuauauucuguau

SEQ ID NO: 237567 - RNA, 64 nt, hsa
cugaaauuuggcaagaaggggcaaaaacgugacuauuaaugauugauaagcaccagugaagaag

SEQ ID NO: 237568 - RNA, 64 nt, hsa
uuugaaaucccaaggugcccucauaccucuugacauuaaugacuucauuuuuuagcuugaauuu

SEQ ID NO: 237569 - RNA, 64 nt, hsa
gagcauucuuacucauuaauuuagguggcuaggaauuaaugaaaaaauuuucaaguuaaaauac

SEQ ID NO: 237570 - RNA, 64 nt, hsa
auuuaacauacuaugaaaacaccaggagucaaugauuaaugaaaggugacucaucugucccuuu

SEQ ID NO: 237571 - RNA, 64 nt, hsa
ucuaugcaaaucuugaaagacgaaaucaaagcccauuaaugauucagaaucagugcuugaccuc

SEQ ID NO: 237572 - RNA, 64 nt, hsa
aucguguaaaucaucucuguagacauguguucauauuaaugaacacauuuuuucucaacauugu

SEQ ID NO: 237573 - RNA, 64 nt, hsa
ccagaaagaguguugguguguagguagauuccauauuaaugaggaacacugaacuaguuggaaa

SEQ ID NO: 237574 - RNA, 64 nt, hsa
aguagguuccaguacuaaugaagugggcuccaguauuaaugaaauagguuccagugaugaaaac

SEQ ID NO: 237575 - RNA, 64 nt, hsa
agaaaauguuuuuaaagaagccagcucaagcaauauuaaugaaguagguuccaguacuaaugaa

SEQ ID NO: 237576 - RNA, 64 nt, hsa
uuaacauacaguuuaggguccuagcgcagaguccuuguuuaaaggucauugacucaucaucugu

SEQ ID NO: 237577 - RNA, 64 nt, hsa
uuguaaauauuuugcacgucauuauuuuucuuuuuuguuuaagcaguguuuggccuggaagagu

SEQ ID NO: 237578 - RNA, 64 nt, hsa
gccuuuuguuuuuaaauuucuuuucuuccagagauuguuuaaaaauaaauauugacaaaaauaa

SEQ ID NO: 237579 - RNA, 64 nt, hsa
uaauguugcaggauuauacuuuauugcaucuuuuuuguuuaauuguauuuaagcauugugcaau

SEQ ID NO: 237580 - RNA, 64 nt, hsa
uauuguccaguugaaaacuguaugccaaaauuaguuguuuaagugaaguuuugugacagaaaaa

SEQ ID NO: 237581 - RNA, 64 nt, hsa
aauuauaguuuuauaaccagucuauuaaagguguuuguuuaaaauggauauaguuuuagauuug

SEQ ID NO: 237582 - RNA, 64 nt, hsa
cuuguuuuauagaaaaugcauggagaaaaggaauuuguuuaaauaacauuaugggauugcaacc

SEQ ID NO: 237583 - RNA, 64 nt, hsa
accauugucucacuggagacucacuugcaucaguuuguuuaacugugaguggcugcacaggcac

SEQ ID NO: 237584 - RNA, 64 nt, hsa
cuuugugugcccuaaaaacaaauccuguucauguuuguuuaaaguuuuuacuuuuugugguugu

SEQ ID NO: 237585 - RNA, 64 nt, hsa
guucauguuuguuuaaaguuuuuacuuuuugugguuguuuaaaauuuuuucaauuguuaaauau

SEQ ID NO: 237586 - RNA, 64 nt, hsa
acuuuaagccuccuuuuagagauauuuuuaaaacuuguuuaaaauuuuugugcaauucauauau

SEQ ID NO: 237587 - RNA, 64 nt, hsa
caaaaaaagaaaguuauucuuaguaaggaacuucuuguuuaauagcauuuuuguuuauuuuaaa

SEQ ID NO: 237588 - RNA, 64 nt, hsa
cuagaagaaaagauaaugaguaaaacaaauugcguuguuuaaaggauuauagugcugcauuguc

SEQ ID NO: 237589 - RNA, 64 nt, hsa
uuguauaagaaauuuucugugaaauauccuuccauuguuuaagcuuuuguuuuggucaucuuua

SEQ ID NO: 237590 - RNA, 64 nt, hsa
aaaaaauauuuccacuuagauauuuuacaugguuuuguuuaaaauuaccauuacuuguuuuuua

SEQ ID NO: 237591 - RNA, 64 nt, hsa
gagucuggaagauggaagcuagugcagaaaccucuuguuuaaaaaacaaaaaaggcaagauggg

SEQ ID NO: 237592 - RNA, 64 nt, hsa
auuuauguaaagucccucuaagacuacauacuuuuuguuuaaaacaaaauuggaauuuguuuuc

SEQ ID NO: 237593 - RNA, 64 nt, hsa
gaguagugcguuuuauuuuauaugccaaucuacuuuguuuaaaaaaggucugaaucaggacuug

SEQ ID NO: 237594 - RNA, 64 nt, hsa
caucuuuggcaaaaucuuugguucaggguacuaguuguuuaaaaguugauucauauucuuaccu

SEQ ID NO: 237595 - RNA, 64 nt, hsa
augacgugugagcagaaugccuuauuuuguaaucuuguuuaacuuguugcuacugggacuugau

SEQ ID NO: 237596 - RNA, 64 nt, hsa
uuaaugucacuuuaaauuaaaagugguuuauuacuuguuuaaugacauaacuacacaguuaguu

SEQ ID NO: 237597 - RNA, 64 nt, hsa
acuuucacuggcucuguuuguacauugagauuguuuguuuaacaaugcuuucuauguucauaua

SEQ ID NO: 237598 - RNA, 64 nt, hsa
cauuauagaugagagcgugcaugcacagucauuuuuguuuaagaguaauauuuuuaauguaaua

SEQ ID NO: 237599 - RNA, 64 nt, hsa
auuuucuacuguauccauuucaaauguuaaaauauuguuuaauauuuuugaaaucccugaguau

SEQ ID NO: 237600 - RNA, 64 nt, hsa
agcacucaaaaaugcaaaaugugauaaugggcacuuguuuaaaagaauuaguguauccagccuu

SEQ ID NO: 237601 - RNA, 64 nt, hsa
aaagaagaaaauuauucaaauuuggacauuuuaauuguuuaaaaauuguacaaaaggaaaaaau

SEQ ID NO: 237602 - RNA, 64 nt, hsa
uuagaauaaguacuggcgaaccaucucuguggucuuguuuaaaaagggcaaaaguuuuagacug

SEQ ID NO: 237603 - RNA, 64 nt, hsa
aacaaguucauacauuugaaaagaaaaaaaaauguuguuuaaaaaauguuuucuccugcugcag

SEQ ID NO: 237604 - RNA, 64 nt, hsa
agaaaaagagauauuuuuagauuguaugccacuuuuguuuaagaacugugcugugaucacugua

SEQ ID NO: 237605 - RNA, 64 nt, hsa
uuuuuaaaacacacucauaaguaaguuuggcaaguuguuuaaaaaaugucucuuuguuuuguac

SEQ ID NO: 237606 - RNA, 64 nt, hsa
uuuuuuccauuuuaguuaaguaguacuacacucauuguuuaaauguaacuugcugugucugagg

SEQ ID NO: 237607 - RNA, 64 nt, hsa
uuuuguugguugguugguugguuuuuguuugguuuuguuuaaaugggcaagaaguaaauaaugu

SEQ ID NO: 237608 - RNA, 64 nt, hsa
cuaaaauacauucagguuccaagccugaccauccuuguuuaaucuaucauacucuuccagguuu

SEQ ID NO: 237609 - RNA, 64 nt, hsa
guacauugaagaauauuuuucuuccuagauuuuguuguuuaaauuauggggccuaaccugccac

SEQ ID NO: 237610 - RNA, 64 nt, hsa
uccuuuuuucuuuaugcauggaagcaucaauaaauuguuuaaaaaccauguauaguaaauucag

SEQ ID NO: 237611 - RNA, 64 nt, hsa
auuacagguaagggcauguuaugguuauuuaucauuguuuaaugaauaguagaggugucaaggg

SEQ ID NO: 237612 - RNA, 64 nt, hsa
ucugcacaaaagacaggcuagacucuugucuagauuguuuaaaagaaacuuuucaaauugguua

SEQ ID NO: 237613 - RNA, 64 nt, hsa
uuacaauuuuuuuuuaccaauuuaaucucaaauguuguuuaacugcuuuaaauucauauacgua

SEQ ID NO: 237614 - RNA, 64 nt, hsa
aagugaucaaguacagacacaauaggggccaguuuuguuuaaggaucaaagagacaaccacuuu

SEQ ID NO: 237615 - RNA, 64 nt, hsa
aacaucucuugcaccaaauccugucuucagucuuuuguuuaacccucaaugaacuaccaauuga

SEQ ID NO: 237616 - RNA, 64 nt, hsa
augaagcguuuuacaauacauugcacuuaauccauuguuuaaauuuacaacuuaacuuuccaag

SEQ ID NO: 237617 - RNA, 64 nt, hsa
aguucuuauugaugacuuuuuaaugcagaguaaguuguuuaagaaaggccugaauauaucagaa

SEQ ID NO: 237618 - RNA, 64 nt, hsa
auguucuaaauuuggaaggacuuaaaaaaaaaacuuguuuaaauuuccaucuguuuuguaauau

SEQ ID NO: 237619 - RNA, 64 nt, hsa
acagugccuugcauaguguagucaucuauuauuauuguuuaauuagaauauuaaacccuacccu

SEQ ID NO: 237620 - RNA, 64 nt, hsa
uuaaaaaaaauguuguuucuauccccauuacaacuuguuuaauuuuaauuuucauugucaauau

SEQ ID NO: 237621 - RNA, 64 nt, hsa
gguagaucuaugugguauucuuuguguuucuuaauuguuuaacucuuaagauuauuugugaucu

SEQ ID NO: 237622 - RNA, 64 nt, hsa
uuauacuugaaggcccagaacacucauggcacauuuguuuaauauugcuuauaguuaguuuaag

SEQ ID NO: 237623 - RNA, 64 nt, hsa
ucauaugcugagaaauuuuucagaaaguccauuuuuguuuaaaauuagaacuuuucagaaugcc

SEQ ID NO: 237624 - RNA, 64 nt, hsa
uacuggcagaauggcagaguagcugcgaaacaauuuguuuaaaaacuugcuuaagacaauugca

SEQ ID NO: 237625 - RNA, 64 nt, hsa
uaggauccauuccguaccguuuuuuaagggauauuuguuuaagacuuuacguguuaauucuuua

SEQ ID NO: 237626 - RNA, 64 nt, hsa
gaacagauuuuauuaaucacggcuuuuggugaauuuguuuaagguuaauuaugguagcaaauuu

SEQ ID NO: 237627 - RNA, 64 nt, hsa
uuuauauucuguggaaaaauaaaggaaauucagauuguuuaaaugccuaaaaguuuugagauaa

SEQ ID NO: 237628 - RNA, 64 nt, hsa
auaccucggcuugacauuuggacagauccugucauuguuuaagcugagcaaaaaaccacacaaa

SEQ ID NO: 237629 - RNA, 64 nt, hsa
cugaggggucugagguuguuuuuacuuuauuguguuguuuaaauauuuuaaaaauaucuuuagc

SEQ ID NO: 237630 - RNA, 64 nt, hsa
gauauguuuaagaacauaauucuuuuguugcuguuuguuuaagaagcaccuuaguuuguuuaag

SEQ ID NO: 237631 - RNA, 64 nt, hsa
cuuuuguugcuguuuguuuaagaagcaccuuaguuuguuuaagaagcaccuuauauaguauaau

SEQ ID NO: 237632 - RNA, 64 nt, hsa
ucugcuuagaaucuaaagauguguuuagaaccucuuguuuaaaaauaauagacugcuuaucaua

SEQ ID NO: 237633 - RNA, 64 nt, hsa
gcauaagagaaucgagaaauuugauagagguaacuuguuuaauguaaaucuaauaguacuugua

SEQ ID NO: 237634 - RNA, 64 nt, hsa
uagaaaagaaaucuguucaacaaacuuguuuaauuuguuuaaaucaacauagcaugaaacacca

SEQ ID NO: 237635 - RNA, 64 nt, hsa
ucauuauauuagaaaagaaaucuguucaacaaacuuguuuaauuuguuuaaaucaacauagcau

SEQ ID NO: 237636 - RNA, 64 nt, hsa
uaaaaaaaaacacacacgaaaaacaaaaguuugcuuguuuaaaaugacaguugugauguaaaaa

SEQ ID NO: 237637 - RNA, 64 nt, hsa
uugaacuguuuaugauaccaaaaaaauuacaguuuuguuuaaaaggaaauguugauguuuucaa

SEQ ID NO: 237638 - RNA, 64 nt, hsa
caucuuacuuagugaaagagagcugcaguugaaauuguuuaaaaaguagcagguacaaugaaua

SEQ ID NO: 237639 - RNA, 64 nt, hsa
uguaacagacaugguaaauauuuguuuacagucuuuguuuaacaaaccaugcauuuaaguuuaa

SEQ ID NO: 237640 - RNA, 64 nt, hsa
uuucaaagagcuguuuugauuaaaauuuauauucuuguuuaauaagcuuauuuuuaaacaauuu

SEQ ID NO: 237641 - RNA, 64 nt, hsa
guuaucacaccaaaacuaugcaauugguacaugguuguuuaagaagaaaccguauuuuuccaug

SEQ ID NO: 237642 - RNA, 64 nt, hsa
uuccuuuguauaaauuaguguuugucuagcauguuuguuuaauccuuugaaauauuugaaacau

SEQ ID NO: 237643 - RNA, 64 nt, hsa
uaguuccagagugcaaauuacagaaggaagcuacuuguuuaaaauuccauacacguuugcaguu

SEQ ID NO: 237644 - RNA, 64 nt, hsa
gaacacaugcaaaauaauuuuuuaaauuauguuauuguuuaaauuugacuuaugggagaucagu

SEQ ID NO: 237645 - RNA, 64 nt, hsa
aaaucacaagugcaaauaaaaagucauuuaucauuuguuuaacuaaacugucaugguuuaguuu

SEQ ID NO: 237646 - RNA, 64 nt, hsa
aggaacauggcaguauguuuacaugucagaaguuuuguuuaauucuaugguauuucuaaauuga

SEQ ID NO: 237647 - RNA, 64 nt, hsa
guuuuguuuaauucuaugguauuucuaaauugacuuguuuaaauaaauucagcaaauggauagc

SEQ ID NO: 237648 - RNA, 64 nt, hsa
uggaccucuaaauauacuuuuaguuguguuuaacuuguuuaauaaauaacuuuuuaaguugauc

SEQ ID NO: 237649 - RNA, 64 nt, hsa
uuuuuauuucugaauuuuccaugugcuuuaauauuuguuuaagaauauuuuuuauaucuguuca

SEQ ID NO: 237650 - RNA, 64 nt, hsa
acaauggcaagggggguauucuuuauauguugccuuguuuaacuacaguucuuuucauuccauc

SEQ ID NO: 237651 - RNA, 64 nt, hsa
aggucucuaaaauuaaagaacaagaugugguuuuuuguuuaagacguuuuuaguuuauuuguug

SEQ ID NO: 237652 - RNA, 64 nt, hsa
acgucuugccuauaagcuaauaucauaaauaagguuguuuaagacgugcuucaaauauccauau

SEQ ID NO: 237653 - RNA, 64 nt, hsa
guaaugacugucaugaaagcagcauugaaauaauuuguuuaaagggggcacucuuuuaaacggg

SEQ ID NO: 237654 - RNA, 64 nt, hsa
guaaaacaauuguauugaugguuguuuaacuuuuuuguuuaauuuuuacaguuacauccagcug

SEQ ID NO: 237655 - RNA, 64 nt, hsa
aggggccauugauguaaaacaauuguauugaugguuguuuaacuuuuuuguuuaauuuuuacag

SEQ ID NO: 237656 - RNA, 64 nt, hsa
aacaagguaacuuuuuguuuaacaagguaacuuuuuguuuaaccuagauuuuuuuuaaaacuuu

SEQ ID NO: 237657 - RNA, 64 nt, hsa
ucuuugucucuuuuuuguuuaacaagguaacuuuuuguuuaacaagguaacuuuuuguuuaacc

SEQ ID NO: 237658 - RNA, 64 nt, hsa
caguaagaugccccugcuugucuuugucucuuuuuuguuuaacaagguaacuuuuuguuuaaca

SEQ ID NO: 237659 - RNA, 64 nt, hsa
cggugguuagauuuuuuuuuuccccaccagggucuuguuuaaaggggugagccaccgcacccag

SEQ ID NO: 237660 - RNA, 64 nt, hsa
aaaguauugugaauacaauguauguccaauuggauuguuuaaaaacuacuuauaauuaaucacu

SEQ ID NO: 237661 - RNA, 64 nt, hsa
augugagagggcagucauucuucucacugaguuuuuguuuaaaaaccaggaaauuucuacaauc

SEQ ID NO: 237662 - RNA, 64 nt, hsa
aagaguaauggucaaucuuaacauuuuguuuuaauuguuuaauaaagcugcugggcaguggugc

SEQ ID NO: 237663 - RNA, 64 nt, hsa
auuuuuuucuuuugcaagacaccuguuuaucaucuuguuuaaauguaaauguccccuuaugcuu

SEQ ID NO: 237664 - RNA, 64 nt, hsa
aauccuguggcaccaaccaguggugcucauucuauuguuuaaaaauggccuucuuggcugggcg

SEQ ID NO: 237665 - RNA, 64 nt, hsa
cugguccuauagcaucuuuacuacugauuuuuuuuuguuuaauuugaaaaugcaaagaauuguu

SEQ ID NO: 237666 - RNA, 64 nt, hsa
ggacugagacuuugaaaauaacuuuuacauacuuuuguuuaagccccuuugaaauguauaaaaa

SEQ ID NO: 237667 - RNA, 64 nt, hsa
uguuuuuaagccuucuaucuuuuuaggacacaguuuguuuaagcaauauguuuuggucuuguga

SEQ ID NO: 237668 - RNA, 64 nt, hsa
auagggcccccaaugcuauuuuuuuuuuuuaaguuuguuuaauuauuuguuaagauugucuaag

SEQ ID NO: 237669 - RNA, 64 nt, hsa
uacagacuuguacuaacacaccguaauuuggcauuuguuuaaccucauuuauaaaagcuucaaa

SEQ ID NO: 237670 - RNA, 64 nt, hsa
aaggauggcucuguacaacuucacagauggaaucuuguuuaaggcugugaaguuuuaaggaaua

SEQ ID NO: 237671 - RNA, 64 nt, hsa
aaaucaaaugagauuauuugguauguguuuugcuuuguuuaacccaaaagauuauuuuuugguu

SEQ ID NO: 237672 - RNA, 64 nt, hsa
aauugacaaauuguguacaaacacuaaaaaaaacuuguuuaaauuguauuugcaauaaacaaca

SEQ ID NO: 237673 - RNA, 64 nt, hsa
uaacuuuuaucaagccacaugcuuggcugugucauuguuuaacuuggauauuuuaugauuuuac

SEQ ID NO: 237674 - RNA, 64 nt, hsa
aucacuuuuucucuuuuauccucuaaccaaaaaauuguuuaauuuugcaucccaaauguuuuua

SEQ ID NO: 237675 - RNA, 64 nt, hsa
cuugcuaauaaccuuuuguucagaauuuaguagauuguuuaaugcaggacaucaacuacauaau

SEQ ID NO: 237676 - RNA, 64 nt, hsa
uaauacuaauagccaaauagauaacacuaaugcuuuguuuaaaaaaacgaaaaaaacaaaacaa

SEQ ID NO: 237677 - RNA, 64 nt, hsa
gaagcuucaugguguuggagccaccuuuguacaguuguuuaaaguuucccauugucacggaaaa

SEQ ID NO: 237678 - RNA, 64 nt, hsa
uuguaagauaucuauaauuuuaaauguuuauaaauuguuuaauuuauuagcaucuuaauguacc

SEQ ID NO: 237679 - RNA, 64 nt, hsa
cagugagguuaucuugcugcacucuguagcaaauuuguuuaaucuacauuauaauaaaauuucu

SEQ ID NO: 237680 - RNA, 64 nt, hsa
uguccacuuguaagaaugucaggaauuuaagaauuuguuuaaauuaggcauaucucugccauca

SEQ ID NO: 237681 - RNA, 64 nt, hsa
guuacuugugcaguguuaaaaguaauccacuuucuuguuuaauauaccagauacauagcaaaag

SEQ ID NO: 237682 - RNA, 64 nt, hsa
auuauuugcaauuaauuguucuuuuaucuuacaauuguuuaagccugugaucuuucuucuccca

SEQ ID NO: 237683 - RNA, 64 nt, hsa
uagccuauacaguaccuacauaguuuuuaaauuauuguuuaaaaaacaaaacagcuguuauaaa

SEQ ID NO: 237684 - RNA, 64 nt, hsa
gaagucugacuaugaugaauaaaucuuaaaugcuuuguuuaauuaaaaaacaaaaaucaccaau

SEQ ID NO: 237685 - RNA, 64 nt, hsa
gugguaauuuuaaaggucuugauuaggucaauaauuguuuaagcaccgucucauucauguuuuc

SEQ ID NO: 237686 - RNA, 64 nt, hsa
aacauuaaauguaaaugguuucaaauggucagcguuguuuaaauguaaucauguuauuuuauuc

SEQ ID NO: 237687 - RNA, 64 nt, hsa
ucugauccucagccccuccagucguuauuucuguuuguuuaagcugagccacggauaccgccac

SEQ ID NO: 237688 - RNA, 64 nt, hsa
cugccuuucaagcggugccuaagaaguuauuuucuuguuuaacauauauauuuauuaauuuauu

SEQ ID NO: 237689 - RNA, 64 nt, hsa
cauaguaggcacuaaauacauguuuguugguugauuguuuaagccagaguguauuacaacaauc

SEQ ID NO: 237690 - RNA, 64 nt, hsa
uacuaauaaauccauuuuucuagugauacacaaauuguuuaagguuauacacucgagcuuaaau

SEQ ID NO: 237691 - RNA, 64 nt, hsa
uggaaaguagauacauaaagacuugagaagggaauuguuuaagggaaaagaaaagaguaauaau

SEQ ID NO: 237692 - RNA, 64 nt, hsa
aaaacauuguuuaaaacagaauguuaaaacacuguuguuuaagcauguuuaaaucaagguauuc

SEQ ID NO: 237693 - RNA, 64 nt, hsa
uugcuguaagauaauaaauagguauuuuaaaacauuguuuaaaacagaauguuaaaacacuguu

SEQ ID NO: 237694 - RNA, 64 nt, hsa
guuuacuaaaugccuagugcaguuaaacauacucuuguuuaaguguguguugcuaaauuuuuua

SEQ ID NO: 237695 - RNA, 64 nt, hsa
caauuauauuaggaaaaaaguugguugacuguuuuuguuuaauugacuucuaaaauguucaaau

SEQ ID NO: 237696 - RNA, 64 nt, hsa
uagcucuuaguuaaaucuaguaaaggacagucuauuguuuaaagagaaggugcauuuguuccuc

SEQ ID NO: 237697 - RNA, 64 nt, hsa
uuaaaaguaaauauuuuugguuucuguaagaagcuuguuuaauaauguuguaagccguggcuau

SEQ ID NO: 237698 - RNA, 64 nt, hsa
auugcauauuuaauguagucuaauauauacacauuuguuuaacauguaaacaaaaguguuaaau

SEQ ID NO: 237699 - RNA, 64 nt, hsa
uuucuuaauguuuauauuuuauuuucaagguucauuguuuaaugaaauauuuuauucuugcauu

SEQ ID NO: 237700 - RNA, 64 nt, hsa
agaauuuauuguuugagggaaauacgagguuucauuguuuaaaaucaagaguguauuguuuacu

SEQ ID NO: 237701 - RNA, 64 nt, hsa
agcauuagguuuaaguugagggcuaagaacugguuuguuuaaagguuuaaauuguuggaaaaga

SEQ ID NO: 237702 - RNA, 64 nt, hsa
gcguuucugagucauuugggaccaacugcagugguuguuuaaaaugcugguuccugcacacaau

SEQ ID NO: 237703 - RNA, 64 nt, hsa
ugauacuuuuaauuuacacuuaguaaauuaaaaguuguuuaauuuacuuggcauuuuaggacau

SEQ ID NO: 237704 - RNA, 64 nt, hsa
uuaacaacuucugauaacauggaaaauucaaggauuguuuaaaggucugaugaucacacacaaa

SEQ ID NO: 237705 - RNA, 64 nt, hsa
uuggauuuuguaauuuaacuaaggcacaauggacuuguuuaaaauauuuuacuugauuguauac

SEQ ID NO: 237706 - RNA, 64 nt, hsa
cccucauccaggcaguuugauauuuggaguaaguuuguuuaaaucugagcaugcaucuuuaaac

SEQ ID NO: 237707 - RNA, 64 nt, hsa
gugaugguuguaauggugaauggcuagugucauuuuguuuaauuuuguuuugcuuuuugauggu

SEQ ID NO: 237708 - RNA, 64 nt, hsa
aggaaucuguacaauauguugaugguggcuguaguuguuuaaauggagacuuccaaucaccagc

SEQ ID NO: 237709 - RNA, 64 nt, hsa
cuguguauguuuguguguguguuuguauacagccuuguuuaauguuuugagcaauaagauaugc

SEQ ID NO: 237710 - RNA, 64 nt, hsa
aaggcugcagagagcuaugaucaucccacugcauuuguuuaaaaauaaauuuuuaaaauuugug

SEQ ID NO: 237711 - RNA, 64 nt, hsa
aacagcagaagaacuaacauaacuaacuccauuuuuguuuaaggggccuuuaccuauuccugca

SEQ ID NO: 237712 - RNA, 64 nt, hsa
uagaugguaaacauuuaaaggggaaaggggggguuuguuuaaaauaguaaaucaguaagucacu

SEQ ID NO: 237713 - RNA, 64 nt, hsa
auaaauuguauuuuaagugaugucauagacaggauuguuuaaauuuaguuaacuccauacucuu

SEQ ID NO: 237714 - RNA, 64 nt, hsa
ucaagucaagcgucuuguuguuuaaauaaacuucuuguuuaaaaugagcuguuuucuuuauucu

SEQ ID NO: 237715 - RNA, 64 nt, hsa
ccuagauaguuuucccuucaagucaagcgucuuguuguuuaaauaaacuucuuguuuaaaauga

SEQ ID NO: 237716 - RNA, 64 nt, hsa
gacaagcaauaggggguugaaguguuuaucugauuuguuuaaaauuuuguauaucaccaaauuu

SEQ ID NO: 237717 - RNA, 64 nt, hsa
gcuuuuaucugagaauuucucaguaugaaaaugauuguuuaaaauuuccccucuuuuugucagu

SEQ ID NO: 237718 - RNA, 64 nt, hsa
ggguacauaggcuaauuaaugugagucuuuuuccuuguuuaaaggagucccucuugcugaaagu

SEQ ID NO: 237719 - RNA, 64 nt, hsa
gcuucccccagcuuaaauaguugauaaggacuaauuguuuaaugaguuuauuuaucuacaguag

SEQ ID NO: 237720 - RNA, 64 nt, hsa
aguauucuuuuuugaaaauuagcaauuauaaagauuguuuaaaauaucuugauauuuucacaaa

SEQ ID NO: 237721 - RNA, 64 nt, hsa
uuguauauaugugauauaaauuaaugugugcaaauuguuuaaaaauuagauguguugcaguuuu

SEQ ID NO: 237722 - RNA, 64 nt, hsa
gugagucuuacugaccuaagaaacauuguuuaaauuguuuaaauggaucugcuugcaguuauuu

SEQ ID NO: 237723 - RNA, 64 nt, hsa
auuuuuuuugugagucuuacugaccuaagaaacauuguuuaaauuguuuaaauggaucugcuug

SEQ ID NO: 237724 - RNA, 64 nt, hsa
acuucagagauguaucucucuguucuguacauuauuguuuaauauaagaaaccuacuagcauuc

SEQ ID NO: 237725 - RNA, 64 nt, hsa
cagugaguuuucauuuugguuuuguauuuuccaguuguuuaauuuccauuggguggguucuuuu

SEQ ID NO: 237726 - RNA, 64 nt, hsa
augaaaguuaaacauuuuauaauacuuuuuuuauuuguuuaauaaacuugaauauuguuuaaaa

SEQ ID NO: 237727 - RNA, 64 nt, hsa
aauacuuuuuuuauuuguuuaauaaacuugaauauuguuuaaaaugauaauuuuccuucuucaa

SEQ ID NO: 237728 - RNA, 64 nt, hsa
aaguuuaugggaaaauucaauauuaucuuuguuuuuguuuaaauauauuuuuaagauaaaggca

SEQ ID NO: 237729 - RNA, 64 nt, hsa
gaugugauaugucagaacugaagaguaaaucuacuuguuuaaaugacuugacagugguagugcu

SEQ ID NO: 237730 - RNA, 64 nt, hsa
uugaguccucugguuuuaaguaguuuguuucuacuuguuuaaagaaucuucuggucugaccacu

SEQ ID NO: 237731 - RNA, 64 nt, hsa
aauuuuguugcauaugagccagacggccuguguauuguuuaagcucgccaagucuguguugcug

SEQ ID NO: 237732 - RNA, 64 nt, hsa
aacugauggaaauucuuuuucgccuuaguggugauuguuuaaacucucacagucuuaaaccgug

SEQ ID NO: 237733 - RNA, 64 nt, hsa
aagacucuccuuucuuuaucucuaucucagaugguuguuuaacugcgaguuuaaauguguuugu

SEQ ID NO: 237734 - RNA, 64 nt, hsa
uuauugucuugucucuugucaguagaccuucaguacacaguaugugggauaugucagucaaguu

SEQ ID NO: 237735 - RNA, 64 nt, hsa
gaugugcuguaauuugauuuacaugcauuagagcacacaguagaaaaacuuuagcuucauuagu

SEQ ID NO: 237736 - RNA, 64 nt, hsa
ugaggcugagagaguuaagugaaugucuaaggucacacaguauuaagugacagugcuagaaauc

SEQ ID NO: 237737 - RNA, 64 nt, hsa
gccuuccgcaguguaggcuuuacccucaggugcuacacaguauaguucuaggguuucccucccg

SEQ ID NO: 237738 - RNA, 64 nt, hsa
aaaaguauggagcaagaccuguagugacaaaauuacacaguagugguuaguccacugagaaugu

SEQ ID NO: 237739 - RNA, 64 nt, hsa
cagcauggcaucacuuuuuuuuauaacucauuaaacacaguaaaauuuuaaucauuuuuguuuu

SEQ ID NO: 237740 - RNA, 64 nt, hsa
acuuuucuuucaccauuacuuucugauaucuaguacacaguauuucuuuuucucacaucuuugc

SEQ ID NO: 237741 - RNA, 64 nt, hsa
uuuuugccucccucucuucucuuugccuguaugcacacaguaugcuuaugugucauuucacaag

SEQ ID NO: 237742 - RNA, 64 nt, hsa
ccucugauuagaugaaacuguuaccuuacccuaaacacaguauuucuuuuuaacuuuuuuauuu

SEQ ID NO: 237743 - RNA, 64 nt, hsa
uugugacaaagucaaauaaacccccaaggacgacacacaguauggaucacauauuguuugacau

SEQ ID NO: 237744 - RNA, 64 nt, hsa
ccucugaaauaucaauaaggcuaaauauuacuuuacacaguaagaugugaaauucacaaaaagu

SEQ ID NO: 237745 - RNA, 64 nt, hsa
gauggaugguuuuuauaguuuguugauaaaguggacacaguauugucugagcaguuauauuuua

SEQ ID NO: 237746 - RNA, 64 nt, hsa
guuuuuaauuaaaagaaugugugaaaaguacaugacacaguaguugcuugauaauaguuacuag

SEQ ID NO: 237747 - RNA, 64 nt, hsa
cuagccuucuuuuuagagucaacugccaacaaacacacaguaaucacucuguacacacugggau

SEQ ID NO: 237748 - RNA, 64 nt, hsa
caguggcagauuguacacugcuagcacugcuagcacacaguagcaaagcaaacagcuacauuau

SEQ ID NO: 237749 - RNA, 64 nt, hsa
ggcauguagccauauuuucauauagugguauacaacacaguaucauugcaaaugcaguuuacag

SEQ ID NO: 237750 - RNA, 64 nt, hsa
gauuuuuguaucugccacaguaaauuaaagcauuacacaguauuuaucaguauuuuuuaaacau

SEQ ID NO: 237751 - RNA, 64 nt, hsa
uuuauuuaaaauuucguuguccaauuuguaaguaacacaguauuaugccugaguuauaaauauu

SEQ ID NO: 237752 - RNA, 64 nt, hsa
gaaagauuuuuacuaauauauauuuuaagguugcacacaguacacaccagaagaugugaaauuc

SEQ ID NO: 237753 - RNA, 64 nt, hsa
gaacugucucaaaaacgaaagcacaccacccaagacacaguacccagucaugguuuccccaucc

SEQ ID NO: 237754 - RNA, 64 nt, hsa
cuuugaaaacuuacuuucagauuauucucaaagaacacaguagcaccuaaaucuguuuucaauu

SEQ ID NO: 237755 - RNA, 64 nt, hsa
uaaauuuguauccacacaaauucagucucugaauacacaguauucagagucucugauacacagu

SEQ ID NO: 237756 - RNA, 64 nt, hsa
agucucugaauacacaguauucagagucucugauacacaguaauugugacaauagggcuaaaug

SEQ ID NO: 237757 - RNA, 64 nt, hsa
ugcugaaaugacaugaauuguugaguuuauuuuuacacaguaaagaguggagaaagacuguggu

SEQ ID NO: 237758 - RNA, 64 nt, hsa
cccacuugagucguaagccuucuugcuuuugauaacacaguauuauuucucuuacuguagaaga

SEQ ID NO: 237759 - RNA, 64 nt, hsa
uuuacauucuugcucugcucaucuacacauauaaacacaguaagauagguucugcuuucugaua

SEQ ID NO: 237760 - RNA, 64 nt, hsa
ugaauuucuaaaacccuuggucuguguucucaacacacaguauagauaaauccaauagucugcc

SEQ ID NO: 237761 - RNA, 64 nt, hsa; identical to SEQ ID NO: 87537

SEQ ID NO: 237762 - RNA, 64 nt, hsa; identical to SEQ ID NO: 87538

SEQ ID NO: 237763 - RNA, 64 nt, hsa; identical to SEQ ID NO: 87539

SEQ ID NO: 237764 - RNA, 64 nt, hsa; identical to SEQ ID NO: 87540

SEQ ID NO: 237765 - RNA, 64 nt, hsa; identical to SEQ ID NO: 87541

SEQ ID NO: 237766 - RNA, 64 nt, hsa; identical to SEQ ID NO: 87542

SEQ ID NO: 237767 - RNA, 64 nt, hsa; identical to SEQ ID NO: 87543

SEQ ID NO: 237768 - RNA, 64 nt, hsa; identical to SEQ ID NO: 87544

SEQ ID NO: 237769 - RNA, 64 nt, hsa; identical to SEQ ID NO: 87545

SEQ ID NO: 237770 - RNA, 64 nt, hsa; identical to SEQ ID NO: 87546

SEQ ID NO: 237771 - RNA, 64 nt, hsa; identical to SEQ ID NO: 87547

SEQ ID NO: 237772 - RNA, 64 nt, hsa; identical to SEQ ID NO: 87548

SEQ ID NO: 237773 - RNA, 64 nt, hsa; identical to SEQ ID NO: 87549

SEQ ID NO: 237774 - RNA, 64 nt, hsa; identical to SEQ ID NO: 87550

SEQ ID NO: 237775 - RNA, 64 nt, hsa; identical to SEQ ID NO: 87551

SEQ ID NO: 237776 - RNA, 64 nt, hsa; identical to SEQ ID NO: 87552

SEQ ID NO: 237777 - RNA, 64 nt, hsa; identical to SEQ ID NO: 87553

SEQ ID NO: 237778 - RNA, 64 nt, hsa; identical to SEQ ID NO: 87554

SEQ ID NO: 237779 - RNA, 64 nt, hsa; identical to SEQ ID NO: 87555

SEQ ID NO: 237780 - RNA, 64 nt, hsa; identical to SEQ ID NO: 87556

SEQ ID NO: 237781 - RNA, 64 nt, hsa; identical to SEQ ID NO: 87557

SEQ ID NO: 237782 - RNA, 64 nt, hsa; identical to SEQ ID NO: 87558

SEQ ID NO: 237783 - RNA, 64 nt, hsa; identical to SEQ ID NO: 87559

SEQ ID NO: 237784 - RNA, 64 nt, hsa; identical to SEQ ID NO: 87560

SEQ ID NO: 237785 - RNA, 64 nt, hsa; identical to SEQ ID NO: 87561

SEQ ID NO: 237786 - RNA, 64 nt, hsa; identical to SEQ ID NO: 87562

SEQ ID NO: 237787 - RNA, 64 nt, hsa; identical to SEQ ID NO: 87563

SEQ ID NO: 237788 - RNA, 64 nt, hsa; identical to SEQ ID NO: 87564

SEQ ID NO: 237789 - RNA, 64 nt, hsa; identical to SEQ ID NO: 87565

SEQ ID NO: 237790 - RNA, 64 nt, hsa; identical to SEQ ID NO: 87566

SEQ ID NO: 237791 - RNA, 64 nt, hsa; identical to SEQ ID NO: 87567

SEQ ID NO: 237792 - RNA, 64 nt, hsa; identical to SEQ ID NO: 87568

SEQ ID NO: 237793 - RNA, 64 nt, hsa; identical to SEQ ID NO: 87569

SEQ ID NO: 237794 - RNA, 64 nt, hsa; identical to SEQ ID NO: 87570

SEQ ID NO: 237795 - RNA, 64 nt, hsa; identical to SEQ ID NO: 87571

SEQ ID NO: 237796 - RNA, 64 nt, hsa; identical to SEQ ID NO: 87572

SEQ ID NO: 237797 - RNA, 64 nt, hsa; identical to SEQ ID NO: 87573

SEQ ID NO: 237798 - RNA, 64 nt, hsa; identical to SEQ ID NO: 87574

SEQ ID NO: 237799 - RNA, 64 nt, hsa; identical to SEQ ID NO: 87575

SEQ ID NO: 237800 - RNA, 64 nt, hsa; identical to SEQ ID NO: 87576

SEQ ID NO: 237801 - RNA, 64 nt, hsa; identical to SEQ ID NO: 87577

SEQ ID NO: 237802 - RNA, 64 nt, hsa; identical to SEQ ID NO: 87578

SEQ ID NO: 237803 - RNA, 64 nt, hsa; identical to SEQ ID NO: 87579

SEQ ID NO: 237804 - RNA, 64 nt, hsa; identical to SEQ ID NO: 87580

SEQ ID NO: 237805 - RNA, 62 nt, hsa; identical to SEQ ID NO: 87581

SEQ ID NO: 237806 - RNA, 64 nt, hsa; identical to SEQ ID NO: 87582

SEQ ID NO: 237807 - RNA, 64 nt, hsa; identical to SEQ ID NO: 87583

SEQ ID NO: 237808 - RNA, 64 nt, hsa; identical to SEQ ID NO: 87584

SEQ ID NO: 237809 - RNA, 64 nt, hsa; identical to SEQ ID NO: 87585

SEQ ID NO: 237810 - RNA, 64 nt, hsa; identical to SEQ ID NO: 87586

SEQ ID NO: 237811 - RNA, 64 nt, hsa; identical to SEQ ID NO: 87587

SEQ ID NO: 237812 - RNA, 64 nt, hsa; identical to SEQ ID NO: 87588

SEQ ID NO: 237813 - RNA, 64 nt, hsa; identical to SEQ ID NO: 87589

SEQ ID NO: 237814 - RNA, 64 nt, hsa; identical to SEQ ID NO: 87590

SEQ ID NO: 237815 - RNA, 64 nt, hsa; identical to SEQ ID NO: 87591

SEQ ID NO: 237816 - RNA, 64 nt, hsa; identical to SEQ ID NO: 87592

SEQ ID NO: 237817 - RNA, 64 nt, hsa; identical to SEQ ID NO: 87593

SEQ ID NO: 237818 - RNA, 64 nt, hsa; identical to SEQ ID NO: 87594

SEQ ID NO: 237819 - RNA, 64 nt, hsa; identical to SEQ ID NO: 87595

SEQ ID NO: 237820 - RNA, 64 nt, hsa; identical to SEQ ID NO: 87596

SEQ ID NO: 237821 - RNA, 64 nt, hsa; identical to SEQ ID NO: 87597

SEQ ID NO: 237822 - RNA, 64 nt, hsa; identical to SEQ ID NO: 87598

SEQ ID NO: 237823 - RNA, 50 nt, hsa; identical to SEQ ID NO: 87599

SEQ ID NO: 237824 - RNA, 64 nt, hsa; identical to SEQ ID NO: 87600

SEQ ID NO: 237825 - RNA, 64 nt, hsa; identical to SEQ ID NO: 87601

SEQ ID NO: 237826 - RNA, 64 nt, hsa; identical to SEQ ID NO: 87602

SEQ ID NO: 237827 - RNA, 64 nt, hsa; identical to SEQ ID NO: 87603

SEQ ID NO: 237828 - RNA, 64 nt, hsa; identical to SEQ ID NO: 87604

SEQ ID NO: 237829 - RNA, 64 nt, hsa; identical to SEQ ID NO: 87605

SEQ ID NO: 237830 - RNA, 56 nt, hsa; identical to SEQ ID NO: 87606

SEQ ID NO: 237831 - RNA, 64 nt, hsa; identical to SEQ ID NO: 87607

SEQ ID NO: 237832 - RNA, 64 nt, hsa; identical to SEQ ID NO: 87608

SEQ ID NO: 237833 - RNA, 64 nt, hsa; identical to SEQ ID NO: 87609

SEQ ID NO: 237834 - RNA, 64 nt, hsa; identical to SEQ ID NO: 87610

SEQ ID NO: 237835 - RNA, 64 nt, hsa; identical to SEQ ID NO: 87611

SEQ ID NO: 237836 - RNA, 64 nt, hsa; identical to SEQ ID NO: 87612

SEQ ID NO: 237837 - RNA, 55 nt, hsa; identical to SEQ ID NO: 87613

SEQ ID NO: 237838 - RNA, 64 nt, hsa; identical to SEQ ID NO: 87614

SEQ ID NO: 237839 - RNA, 64 nt, hsa; identical to SEQ ID NO: 87615

SEQ ID NO: 237840 - RNA, 64 nt, hsa; identical to SEQ ID NO: 87616

SEQ ID NO: 237841 - RNA, 64 nt, hsa; identical to SEQ ID NO: 87617

SEQ ID NO: 237842 - RNA, 64 nt, hsa; identical to SEQ ID NO: 87618

SEQ ID NO: 237843 - RNA, 64 nt, hsa; identical to SEQ ID NO: 87619

SEQ ID NO: 237844 - RNA, 64 nt, hsa; identical to SEQ ID NO: 87620

SEQ ID NO: 237845 - RNA, 64 nt, hsa; identical to SEQ ID NO: 87621

SEQ ID NO: 237846 - RNA, 64 nt, hsa; identical to SEQ ID NO: 87622

SEQ ID NO: 237847 - RNA, 64 nt, hsa; identical to SEQ ID NO: 87623

SEQ ID NO: 237848 - RNA, 64 nt, hsa; identical to SEQ ID NO: 87624

SEQ ID NO: 237849 - RNA, 64 nt, hsa; identical to SEQ ID NO: 87625

SEQ ID NO: 237850 - RNA, 64 nt, hsa; identical to SEQ ID NO: 87626

SEQ ID NO: 237851 - RNA, 64 nt, hsa; identical to SEQ ID NO: 87627

SEQ ID NO: 237852 - RNA, 64 nt, hsa; identical to SEQ ID NO: 87628

SEQ ID NO: 237853 - RNA, 64 nt, hsa; identical to SEQ ID NO: 87629

SEQ ID NO: 237854 - RNA, 64 nt, hsa; identical to SEQ ID NO: 87630

SEQ ID NO: 237855 - RNA, 64 nt, hsa; identical to SEQ ID NO: 87631

SEQ ID NO: 237856 - RNA, 64 nt, hsa; identical to SEQ ID NO: 87632

SEQ ID NO: 237857 - RNA, 64 nt, hsa; identical to SEQ ID NO: 87633

SEQ ID NO: 237858 - RNA, 64 nt, hsa; identical to SEQ ID NO: 87634

SEQ ID NO: 237859 - RNA, 64 nt, hsa; identical to SEQ ID NO: 87635

SEQ ID NO: 237860 - RNA, 64 nt, hsa; identical to SEQ ID NO: 87636

SEQ ID NO: 237861 - RNA, 64 nt, hsa; identical to SEQ ID NO: 87637

SEQ ID NO: 237862 - RNA, 64 nt, hsa; identical to SEQ ID NO: 87638

SEQ ID NO: 237863 - RNA, 64 nt, hsa; identical to SEQ ID NO: 87639

SEQ ID NO: 237864 - RNA, 64 nt, hsa; identical to SEQ ID NO: 87640

SEQ ID NO: 237865 - RNA, 64 nt, hsa; identical to SEQ ID NO: 87641

SEQ ID NO: 237866 - RNA, 64 nt, hsa; identical to SEQ ID NO: 87642

SEQ ID NO: 237867 - RNA, 64 nt, hsa; identical to SEQ ID NO: 87643

SEQ ID NO: 237868 - RNA, 64 nt, hsa; identical to SEQ ID NO: 87644

SEQ ID NO: 237869 - RNA, 64 nt, hsa; identical to SEQ ID NO: 87645

SEQ ID NO: 237870 - RNA, 64 nt, hsa; identical to SEQ ID NO: 87646

SEQ ID NO: 237871 - RNA, 64 nt, hsa; identical to SEQ ID NO: 87647

SEQ ID NO: 237872 - RNA, 64 nt, hsa; identical to SEQ ID NO: 87648

SEQ ID NO: 237873 - RNA, 64 nt, hsa; identical to SEQ ID NO: 87649

SEQ ID NO: 237874 - RNA, 64 nt, hsa; identical to SEQ ID NO: 87650

SEQ ID NO: 237875 - RNA, 64 nt, hsa; identical to SEQ ID NO: 87651

SEQ ID NO: 237876 - RNA, 64 nt, hsa; identical to SEQ ID NO: 87652

SEQ ID NO: 237877 - RNA, 64 nt, hsa; identical to SEQ ID NO: 87653

SEQ ID NO: 237878 - RNA, 64 nt, hsa; identical to SEQ ID NO: 87654

SEQ ID NO: 237879 - RNA, 64 nt, hsa; identical to SEQ ID NO: 87655

SEQ ID NO: 237880 - RNA, 64 nt, hsa; identical to SEQ ID NO: 87656

SEQ ID NO: 237881 - RNA, 64 nt, hsa; identical to SEQ ID NO: 87657

SEQ ID NO: 237882 - RNA, 64 nt, hsa; identical to SEQ ID NO: 87658

SEQ ID NO: 237883 - RNA, 64 nt, hsa; identical to SEQ ID NO: 87659

SEQ ID NO: 237884 - RNA, 64 nt, hsa; identical to SEQ ID NO: 87659

SEQ ID NO: 237885 - RNA, 64 nt, hsa; identical to SEQ ID NO: 87661

SEQ ID NO: 237886 - RNA, 64 nt, hsa; identical to SEQ ID NO: 87662

SEQ ID NO: 237887 - RNA, 64 nt, hsa; identical to SEQ ID NO: 87661

SEQ ID NO: 237888 - RNA, 64 nt, hsa; identical to SEQ ID NO: 87659

SEQ ID NO: 237889 - RNA, 64 nt, hsa; identical to SEQ ID NO: 87665

SEQ ID NO: 237890 - RNA, 64 nt, hsa; identical to SEQ ID NO: 87666

SEQ ID NO: 237891 - RNA, 64 nt, hsa; identical to SEQ ID NO: 87667

SEQ ID NO: 237892 - RNA, 64 nt, hsa; identical to SEQ ID NO: 87668

SEQ ID NO: 237893 - RNA, 64 nt, hsa; identical to SEQ ID NO: 87669

SEQ ID NO: 237894 - RNA, 63 nt, hsa; identical to SEQ ID NO: 87670

SEQ ID NO: 237895 - RNA, 64 nt, hsa; identical to SEQ ID NO: 87671

SEQ ID NO: 237896 - RNA, 64 nt, hsa; identical to SEQ ID NO: 87672

SEQ ID NO: 237897 - RNA, 64 nt, hsa; identical to SEQ ID NO: 87673

SEQ ID NO: 237898 - RNA, 64 nt, hsa; identical to SEQ ID NO: 87674

SEQ ID NO: 237899 - RNA, 64 nt, hsa; identical to SEQ ID NO: 87675

SEQ ID NO: 237900 - RNA, 64 nt, hsa; identical to SEQ ID NO: 87676

SEQ ID NO: 237901 - RNA, 64 nt, hsa; identical to SEQ ID NO: 87677

SEQ ID NO: 237902 - RNA, 64 nt, hsa; identical to SEQ ID NO: 87678

SEQ ID NO: 237903 - RNA, 64 nt, hsa; identical to SEQ ID NO: 87679

SEQ ID NO: 237904 - RNA, 64 nt, hsa; identical to SEQ ID NO: 87680

SEQ ID NO: 237905 - RNA, 64 nt, hsa
aacauuacuaaucuagguccuauuacuaaucuaugucugcaaacauuaaaggaaugaaacaaug

SEQ ID NO: 237906 - RNA, 64 nt, hsa
uuggucagaugugcagaccauuacuaaggucuaugucugcaaacauuacuaaucuagguccuau

SEQ ID NO: 237907 - RNA, 63 nt, hsa
aaagcuuacccuugguuugcacauaaaacguauagucaauauggggcauuaauauucuuuugu

SEQ ID NO: 237908 - RNA, 63 nt, hsa
uguuccuguuccucgggaugaaaagccauaucuagucaauaacucugauuuugauauuuucac

SEQ ID NO: 237909 - RNA, 63 nt, hsa
aauuauuuuagaaauaguaggaaguauugcagaagucaauacacaaaugugccaggcagaggu

SEQ ID NO: 237910 - RNA, 63 nt, hsa
cuaggugauaggcaucuaauugagacaugugugagucaauagccaucgggguccuuuuuggug

SEQ ID NO: 237911 - RNA, 63 nt, hsa
cuuuguauucaguaucguaagugagguuaauaaagucaauacuuucuaccauauauuacguuu

SEQ ID NO: 237912 - RNA, 63 nt, hsa
uauuaaaaaacuucauuggccacuagugaaguuagucaauaaaagacuuguuuuucugauuuu

SEQ ID NO: 237913 - RNA, 63 nt, hsa
cagauaccagaauaaaucuacagcuagacccuuagucaauaguuaaccaaaaaauugcaauuu

SEQ ID NO: 237914 - RNA, 63 nt, hsa
auguuuaaugggggcgguuggggugggggggggagucaauaucuccuauugauuaacuuagac

SEQ ID NO: 237915 - RNA, 63 nt, hsa; identical to SEQ ID NO: 237913

SEQ ID NO: 237916 - RNA, 63 nt, hsa
gauguuuaaugggggcgguugggguugggggggagucaauaucuccuauugauuaacuuagac

SEQ ID NO: 237917 - RNA, 64 nt, hsa
aaucacuugaccccaggugguggagguugcagugagccaagauugcaccauugcacuccagccu

SEQ ID NO: 237918 - RNA, 64 nt, hsa
aaucgcuugaaccugggaggcagagguugcaguaagccaagaucgugccauugcacuccagccu

SEQ ID NO: 237919 - RNA, 64 nt, hsa
gcucuuugaccucaaggucuagaggucugcaguaagccaagaaacaaaggugggguggaugagg

SEQ ID NO: 237920 - RNA, 64 nt, hsa
uuauuccuucuuucaguucaucucacuggagcacagccaagauggacauguuuauggacagugc

SEQ ID NO: 237921 - RNA, 64 nt, hsa
gggauuacaggugcgagcuacugcucccagcaagagccaagauuuuaaccuagaucucccuaac

SEQ ID NO: 237922 - RNA, 64 nt, hsa
aacuuaucugugguuacaagcuaguaaguagcagagccaagauuuuuuuuaauauagagacagg

SEQ ID NO: 237923 - RNA, 64 nt, hsa
gauugcuugaacccaagaggucgaggcugcagugagccaagauugugccacugcacuccagccu

SEQ ID NO: 237924 - RNA, 64 nt, hsa
gagaaucuccugagccuggaagguccaggcagugagccaagauugugccaccacacuccagccu

SEQ ID NO: 237925 - RNA, 64 nt, hsa
ugcucauuguauaagccccgaggccuagaguggcagccaagagccaucugaagccaccucucug

SEQ ID NO: 237926 - RNA, 64 nt, hsa
ggcacuggguuugcucccugauuaaagugccuucagccaagaccaucucucccuccuggugaag

SEQ ID NO: 237927 - RNA, 64 nt, hsa
ggagagaaacuuccagaccagccccucauaccacagccaagaggggccuuucucaccuggagag

SEQ ID NO: 237928 - RNA, 64 nt, hsa
guagagaaacuuccagaccagccccucacaccacagccaagagaagccuuuccagccuggagag

SEQ ID NO: 237929 - RNA, 64 nt, hsa; identical to SEQ ID NO: 237927

SEQ ID NO: 237930 - RNA, 64 nt, hsa
guggaucaugaggucaggaguucaagaccagccuagccaagauggugaaaccccgucucuagua

SEQ ID NO: 237931 - RNA, 64 nt, hsa
aaucgcuuaaacccaggcggcagagguugcagugagccaagaucgcgccacugcacuccagccu

SEQ ID NO: 237932 - RNA, 64 nt, hsa
ugguuuucagguuucugcaaauuacagaagagccagccaagaucacccaggagcuugugccccc

SEQ ID NO: 237933 - RNA, 64 nt, hsa
aguugcucaaacccgggaggcggagauugcagugagccaagaucgcaccgcugcacuccagccu

SEQ ID NO: 237934 - RNA, 64 nt, hsa
aaucacuugaaccuaggaggcggagguugcagugagccaagauggcgccauugcacuccagccu

SEQ ID NO: 237935 - RNA, 64 nt, hsa
aaucgcuugaacccaggaggcggagguugcagugagccaagauggcgccauugcacuccagccu

SEQ ID NO: 237936 - RNA, 64 nt, hsa
auuuuacauggaggaagugagcacaugucaugcuagccaagaggacauuauugucauuaaagag

SEQ ID NO: 237937 - RNA, 64 nt, hsa
agaacaaugaaacauacucucccuacacuugcuuagccaagagauaccacucagguaacuuuuu

SEQ ID NO: 237938 - RNA, 64 nt, hsa
aacaccugaucuggcccaagcugggcucccuuuaagccaagagagccucuuguggaccccgccu

SEQ ID NO: 237939 - RNA, 64 nt, hsa
aauggcgugaacccgggagguggagcuugcaaugagccaagauugcgccacugcacuccagccu

SEQ ID NO: 237940 - RNA, 64 nt, hsa
cccagaggaaccagugggauugaaaaccagcagaagccaagacaggaugcacagcugaauugga

SEQ ID NO: 237941 - RNA, 64 nt, hsa
ccaguagcaacuagaucucuuuuaccucuucuuuagccaagaagcaagaucugucacccacaac

SEQ ID NO: 237942 - RNA, 64 nt, hsa
ugcuguucucugcugugugggcccuuaaagucuuagccaagagccaagacauagcccugugaca

SEQ ID NO: 237943 - RNA, 64 nt, hsa
cucugcugugugggcccuuaaagucuuagccaagagccaagacauagcccugugacaaggugaa

SEQ ID NO: 237944 - RNA, 64 nt, hsa
auaaggggaaauaguaucuuuaaaguuaaugucuagccaagaguuuaguaaacgaagaauuaaa

SEQ ID NO: 237945 - RNA, 64 nt, hsa
aguuuauaggagaacguaucaauacaguuuauaaagccaagaauugcuaugauuuaagacuaag

SEQ ID NO: 237946 - RNA, 64 nt, hsa
acaggguuucacugucccuuaagaccauccuguuagccaagauggucuugaucuccugaccucg

SEQ ID NO: 237947 - RNA, 64 nt, hsa
ucucuaguugaucucuuaaacccauaccugcuacagccaagaccugcucuuguggagguacauu

SEQ ID NO: 237948 - RNA, 64 nt, hsa
ggugagggcaauuuguaagcucaauuucucugacagccaagacauggagcaucucugcuaagaa

SEQ ID NO: 237949 - RNA, 64 nt, hsa
accuacuugaaagccugugggcaacguucuuuugagccaagacuucucugaauggcccugcugg

SEQ ID NO: 237950 - RNA, 64 nt, hsa
guugauugcugccaauguugauugcugaggccuuagccaagauuucaggcaucauuugcuccag

SEQ ID NO: 237951 - RNA, 64 nt, hsa
aaucacuugaacccgggaggcagagguugcagugagccaagaucgcaccacugcacuccagccc

SEQ ID NO: 237952 - RNA, 64 nt, hsa
ucucgguugcuuuugucuaauucuaauggcuuaaagccaagaaaaccauaguauaaaucuuuuu

SEQ ID NO: 237953 - RNA, 64 nt, hsa
aaucacuugaacccuggagguagaaguugcagugagccaagaucauacuacugcacuccagccu

SEQ ID NO: 237954 - RNA, 64 nt, hsa
uugcaggcucauagggaagaccugcugagggaccagccaagagggcugcaaaagugagggcuug

SEQ ID NO: 237955 - RNA, 64 nt, hsa
aauugcuugaaccugggagguggagguugcagugagccaagauugcgccauugcacuccagccu

SEQ ID NO: 237956 - RNA, 64 nt, hsa
aauugcuugaaccugggaggcagaggcugcagugagccaagacaaugccacuacacuccagccu

SEQ ID NO: 237957 - RNA, 64 nt, hsa
aauuguuugaaccuggaaggcggagguugcagugagccaagaucacagcacugcacugcugccu

SEQ ID NO: 237958 - RNA, 64 nt, hsa
guggcugcuggccuggaccccaggggucugguacagccaagauguucuggacaacauccagcua

SEQ ID NO: 237959 - RNA, 64 nt, hsa
cagccccagucagcucaacccaguccugcuucagagccaagacuaggccaggguggggaccccc

SEQ ID NO: 237960 - RNA, 64 nt, hsa
aauggcgugaacccaggaggcggagcuugcagugagccaagaucgcgccacugcacuccagccu

SEQ ID NO: 237961 - RNA, 64 nt, hsa
aaucgcuugagcccgagagguggagacugcaguaagccaagaucaugccauugcacuccagccu

SEQ ID NO: 237962 - RNA, 64 nt, hsa
gucccacaacgaugacucugccucuugucagcccagccaagagcccagacgaccccucuguccu

SEQ ID NO: 237963 - RNA, 64 nt, hsa
acccacagagggaggaucuuuaagaggagaaaaaagccaagagggaaagccagaguucccuguu

SEQ ID NO: 237964 - RNA, 64 nt, hsa
aaucacuugaauccgggaggcggagguugcggugagccaagaucgcgccacugcacuccagccu

SEQ ID NO: 237965 - RNA, 64 nt, hsa
gaucucuugagcccaagggguggggguugcagugagccaagaugcacugcaccccagccugggc

SEQ ID NO: 237966 - RNA, 64 nt, hsa
cacagaagcuuuaaauuuuccccuaagaguacaaagccaagagagugugguuuaucuaaauguc

SEQ ID NO: 237967 - RNA, 64 nt, hsa
aaucgcuugaaccugggagguggugguugcagugagccaagaucacaccauugcacuccagccu

SEQ ID NO: 237968 - RNA, 64 nt, hsa
uuggcuguccccuccaucuggggauggagaaugccagcccaaagcuggagccaauggugagggc

SEQ ID NO: 237969 - RNA, 64 nt, hsa
ugccggccuuggccuuggggccagacuggcugcacagcccaaccaggaggggucugccucccac

SEQ ID NO: 237970 - RNA, 64 nt, hsa
uggcucgggucagcgcagccagcccagcucccugcagcccaagucucaagccuccaaaccugcc

SEQ ID NO: 237971 - RNA, 64 nt, hsa
cauugaaaauaucucugugucuguccaccagccacagcccaaacacaucaaacuugcuaagcgg

SEQ ID NO: 237972 - RNA, 64 nt, hsa
ucaccgccuguguccuucaggggcugcuggagggcagcccaaagccaggggcccaccccgcccc

SEQ ID NO: 237973 - RNA, 64 nt, hsa
acaaaaccagcaucuguuacuggaacagagaccucagcccaagcucaggacaaggaggccuccc

SEQ ID NO: 237974 - RNA, 64 nt, hsa
uuccccaagcaggauuacuccagagggcaaaacacagcccaauaguaucacauuuccuuucugc

SEQ ID NO: 237975 - RNA, 64 nt, hsa
uugugaggcacuggggaggcaggcacacguccuccagcccaagacugccuaauuuaacagggau

SEQ ID NO: 237976 - RNA, 64 nt, hsa
auaaguuggauguuccauuacauagaggaacacaaaauuccaggguuuuuggaggaagggauua

SEQ ID NO: 237977 - RNA, 64 nt, hsa
auuuuuaauuagauucuuuccccugcugaguuggaaauuccagugcagcacugauugaccacag

SEQ ID NO: 237978 - RNA, 64 nt, hsa
uacgaucuugugaaaacacuguauuuucgacugaaaauuccacuuucuucaucuuguuuuuuag

SEQ ID NO: 237979 - RNA, 64 nt, hsa
uauuauuuuauuuuuguuuuuuuccaauuacuggaaauuccaaauuugggaacuuuugauacga

SEQ ID NO: 237980 - RNA, 64 nt, hsa
cccuuacucaugauucaucaauauuccuauauuaaaauuccaguuugauguuugucucuaguug

SEQ ID NO: 237981 - RNA, 64 nt, hsa
ggguaaguuaagcacuucuuaacauuguagcagaaaauuccaaaagaaagacuagaacaaauug

SEQ ID NO: 237982 - RNA, 64 nt, hsa
acccacuaugaccacagcaucugcauuuucuaaaaaauuccaugcagguguuuuggggagaggu

SEQ ID NO: 237983 - RNA, 64 nt, hsa
cuucucuguaugucaaacucaucccuggcacaagaaauuccagucaugugaagcaaacugcccu

SEQ ID NO: 237984 - RNA, 64 nt, hsa
gaguuuugaaaaauaauaguggcccugaaggaauaaauuccagcuuuaaaaaccaagucugagg

SEQ ID NO: 237985 - RNA, 64 nt, hsa
auucauuguguaugcuucaucaccuauauuaggcaaauuccauuuuuuucccuugugcuaaggu

SEQ ID NO: 237986 - RNA, 64 nt, hsa
uacugguuaguugucauuaaguaagauccaggucaaauuccauuugacaaaucccagggacuau

SEQ ID NO: 237987 - RNA, 64 nt, hsa
aaucacauauuuuauauucagcauaaaggagaauaaauuccagaaaacacauauucugaaaaug

SEQ ID NO: 237988 - RNA, 64 nt, hsa
uuggaauuuuccaaguaauagaaguaucuuacugaaauuccauaugagauaaucuuuauuuuug

SEQ ID NO: 237989 - RNA, 64 nt, hsa
uaguagguucaagaaacacaggagcaagcaaaacaaauuccauaaugucaucaaacauaaaguu

SEQ ID NO: 237990 - RNA, 64 nt, hsa
auuuuaaauacugaauucauaguuguuguuuuuuaaauuccaacaguaacagcugaaugguuua

SEQ ID NO: 237991 - RNA, 64 nt, hsa
augaaagauuccaacuaguugucagugcuucuugaaauuccaaacagaaagauacauuggucaa

SEQ ID NO: 237992 - RNA, 64 nt, hsa
ccuauacugaaagaucucugucacauccaacuggaaauuccaggaaccaaaaagagcaucccua

SEQ ID NO: 237993 - RNA, 64 nt, hsa
aauauaaauagcugaaaacuaauguacuguacauaaauuccagaggacucugcuuaaacaaagc

SEQ ID NO: 237994 - RNA, 64 nt, hsa
gauguuauugcuuccauuuuauuagaagagaaacaaauuccaugcuuuauggaauuuauguaga

SEQ ID NO: 237995 - RNA, 64 nt, hsa
cuauuccacccaaacaauauguuguaguuucuggaaauuccauacucagauaucagucugcuag

SEQ ID NO: 237996 - RNA, 64 nt, hsa
ggaagucaaccagaccaaugauggaauuaaauguaaauuccaagagggcuuucacaguccacag

SEQ ID NO: 237997 - RNA, 64 nt, hsa
cugauuaacagaauuuuauacaacuguaccaauaaaauuccaaauuggaauuguuuuguuacuc

SEQ ID NO: 237998 - RNA, 64 nt, hsa
aaagauaaauuauugaaugaguaguauuaccuacaaauuccagaauuuucuggguuuuaggacg

SEQ ID NO: 237999 - RNA, 64 nt, hsa
uuuuguuuggguuacaguaugcuugcucuaagucaaauuccaaggaacuaauuucuucuccugg

SEQ ID NO: 238000 - RNA, 64 nt, hsa
aauuuugaauguguuguuauuuuaccuagauguaaaauuccacauguauuaaaauguacaaaau

SEQ ID NO: 238001 - RNA, 64 nt, hsa
auaaacauuuuuauaauauauuauuuuacugcuuaaauuccaaguccugaaguagaugguugag

SEQ ID NO: 238002 - RNA, 64 nt, hsa
agggaggugaagaggcugcuucucuacagaggugaaauuccagaugagucagucucuugggaag

SEQ ID NO: 238003 - RNA, 64 nt, hsa
uuacaaacuaaauuccauguaagcuuucaucaacaaauuccaaagugccuccuacaagggcaca

SEQ ID NO: 238004 - RNA, 64 nt, hsa
guaguggcuuaucucugaucagcuguuacaaacuaaauuccauguaagcuuucaucaacaaauu

SEQ ID NO: 238005 - RNA, 64 nt, hsa
uacagugugguuugagcacuggguucuuuuagccaaauuccauacaaaaagaauuuggauguuu

SEQ ID NO: 238006 - RNA, 64 nt, hsa
uucaaguacacuuccacaccaggaaaacagacccaaauuccauaaacagaacugacguuaaaau

SEQ ID NO: 238007 - RNA, 64 nt, hsa
ggcuauuuaagguucaaaaucaagugccuagggaaaauuccaauggaugauuuucugggagcua

SEQ ID NO: 238008 - RNA, 64 nt, hsa
cuuuuuugaacuuuauucagaagcaguuaucaauaaauuccauaaaauaaugucauugguauuu

SEQ ID NO: 238009 - RNA, 64 nt, hsa
caccauuuagccuguagauuuauuuccauuuuccaaauuccagcacacagagaucccagccccu

SEQ ID NO: 238010 - RNA, 64 nt, hsa
accaagaagaaaaaggaccuuaguauuuagcauaaaauuccagcgcuggaugaaugcagaucua

SEQ ID NO: 238011 - RNA, 64 nt, hsa
ccuuuuauagaaacucugagcuguuacuuuggggaaauuccacaauguauuagcagccacaaau

SEQ ID NO: 238012 - RNA, 64 nt, hsa
uaacuguugaacaaagggaagauuugaacaguguaaauuccagaguugagaaagcauuuagcau

SEQ ID NO: 238013 - RNA, 64 nt, hsa
acaaauguggcaaguaggacuccuaucgguauacaaauuccauuucuuuuuauaagaaaaacac

SEQ ID NO: 238014 - RNA, 64 nt, hsa
acauacgaagaaaacuucucagguuacuaugcugaaauuccaaaaugucugaguuuugaauagu

SEQ ID NO: 238015 - RNA, 64 nt, hsa
ugaaauuuguaauaaaaucaacuucauauuuuaaaaauuccaacuaucugcuugcauuggugaa

SEQ ID NO: 238016 - RNA, 64 nt, hsa
gggccuaucaguggcaggauuuaaucuggggagcaaauuccagcucugaaauggaguucucaca

SEQ ID NO: 238017 - RNA, 64 nt, hsa
gugccggcagcaccggugccaucuuggcuuccacaaauuccagaaguuucuuggcugccucccg

SEQ ID NO: 238018 - RNA, 64 nt, hsa
aaguaauguaauuuuuaccuuauuuaucuguaugaaauuccaguaguuaauuugaacauuuauu

SEQ ID NO: 238019 - RNA, 64 nt, hsa
gugcucgucacuggguucaucagagcagugugugaaauuccauguguuugcugagguguaaagg

SEQ ID NO: 238020 - RNA, 64 nt, hsa
gcacuccuaccuuaauuauugcacuagagaaaauaaauuccaaauuaggaaguguuuccuagga

SEQ ID NO: 238021 - RNA, 64 nt, hsa
uaaauuccaaauuaggaaguguuuccuaggaggaaaauuccauuagagaguggcaauaggauga

SEQ ID NO: 238022 - RNA, 64 nt, hsa
agaggacagaagaauggagaugggaaaauccaccaaauuccaacccaaacccaacuuucuuucu

SEQ ID NO: 238023 - RNA, 64 nt, hsa
uaagggggacaggauacuugucacauauuugaagaaauuccauacagugaaggaaauuugaguc

SEQ ID NO: 238024 - RNA, 64 nt, hsa
ugauaaccuagugccuccauagagggguuuggaaaaauuccaguccgauuucuuugugugucag

SEQ ID NO: 238025 - RNA, 64 nt, hsa
gcagcugagcuuucagagcuggguucaaaaaaaaaaauuccagugucuguauacaggagcacuu

SEQ ID NO: 238026 - RNA, 64 nt, hsa
aaggcuaguaugagcgagaaaaggagagagcgcgugcagagacuugguggugcauaauggauau

SEQ ID NO: 238027 - RNA, 64 nt, hsa
ugucucucaauccuguggcuuuggugagagagugugcagagagcaaugauagcaaauaauguac

SEQ ID NO: 238028 - RNA, 64 nt, hsa
ggaaaucagacaguaagagaaagccaaaaagcaaugcagagaaagguguccaagcugucuucag

SEQ ID NO: 238029 - RNA, 64 nt, hsa
aauuagucaaaaaauuccaacaaguagccaggacugcagagacacuccagugcagagggagaag

SEQ ID NO: 238030 - RNA, 64 nt, hsa
aauaggaagggcauuccaggcagagggaaaccugugcagagaccaagagguguggaaggaaaag

SEQ ID NO: 238031 - RNA, 64 nt, hsa
cugucccuugaagcccagccacaaguguuggagcugcagagagaccccaaagguaguagauugu

SEQ ID NO: 238032 - RNA, 64 nt, hsa
aauaauuaccaaccccuuagcaauaagcacuccuugcagagagguuuuauucucuaaauaccau

SEQ ID NO: 238033 - RNA, 64 nt, hsa
aaaacagaagcacaaauuuuggugaauugggauuugcagagaugaaaaagacugggugaccugg

SEQ ID NO: 238034 - RNA, 64 nt, hsa
uaaaaucugcaaaugcacauuaaugcaaauuaaaugcagagagaaaugauuauuuuuuucuuua

SEQ ID NO: 238035 - RNA, 64 nt, hsa
uugugcuucaguaacuugaaguuuaaauuuaaaaugcagagagaccaaugguuaaaaugugaau

SEQ ID NO: 238036 - RNA, 64 nt, hsa
aaauucauguggaucuggggacugagugugggagugcagagaaagaaagggaaacuggcugagg

SEQ ID NO: 238037 - RNA, 64 nt, hsa
agaaccauuacaacaccuauauauccaagaagcaugcagagaagaauugguuuguuggccucaa

SEQ ID NO: 238038 - RNA, 64 nt, hsa
gcagccucaaacuggcauccaggcacugggcccaugcagagaaggcaccugcagagagcagggc

SEQ ID NO: 238039 - RNA, 64 nt, hsa
cauccaggcacugggcccaugcagagaaggcaccugcagagagcagggcagcccggcgcagggg

SEQ ID NO: 238040 - RNA, 64 nt, hsa
cccagugguuucagaaaugucuggguguuuuauuugcagagaacaagaugugucuuaugagucu

SEQ ID NO: 238041 - RNA, 64 nt, hsa
ccuagagcccaucccgcaccagcauuuuggaaccugcagagagccuuucucccagcuuugccgc

SEQ ID NO: 238042 - RNA, 64 nt, hsa
uauacugaguacccuaggccaacuuuuuuuucuuugcagagaaccuuuuuuguuuuauucuuca

SEQ ID NO: 238043 - RNA, 64 nt, hsa
uaugguccccugaaauuuugacuuaguauauaggugcagagacacccacuuagaaaguuaacug

SEQ ID NO: 238044 - RNA, 64 nt, hsa
uaaagguuaaagagggcauaaaggagcacucaauugcagagauuugaggacauuauuuuuauuu

SEQ ID NO: 238045 - RNA, 64 nt, hsa
auaaucaacaaaagauacaauucaaggguuagguugcagagagcuggcuugagaguaguuauua

SEQ ID NO: 238046 - RNA, 64 nt, hsa
uuucaguuccaacagaaaggucgggguagguucgugcagagauggggcuggcaggggggcuaug

SEQ ID NO: 238047 - RNA, 64 nt, hsa
aaagaaacgcugcugcuaauggcacccaguccacugcagagacugcacugcggucccuccccca

SEQ ID NO: 238048 - RNA, 64 nt, hsa
uuaggacucugauucacugaccaaaagucaguguugcagagauuucucuaccccguaugguauu

SEQ ID NO: 238049 - RNA, 64 nt, hsa
uugaaguuaaguggaauccuuucaaaugacgagcugcagagaacucagcaccaagggcugccua

SEQ ID NO: 238050 - RNA, 64 nt, hsa
augauuagauauacacaacaccaagugguacaucugcagagauaauucaaaauuccugcuuuug

SEQ ID NO: 238051 - RNA, 64 nt, hsa
caaagucaggucccgcccacccugccuaaggaacugcagagagguggcaaaucagcaaaaagga

SEQ ID NO: 238052 - RNA, 64 nt, hsa
caggacccaacccagccacugaagagagagucucugcagagacagggcuaccugggugguugag

SEQ ID NO: 238053 - RNA, 64 nt, hsa
ccugguugugauugcuggacccagaggcaagaucugcagagaugccugugagauauuugcuuuc

SEQ ID NO: 238054 - RNA, 64 nt, hsa
augacucagcaccgccccucaacaggcaugacucugcagagaugacucagcacugucccuuagc

SEQ ID NO: 238055 - RNA, 64 nt, hsa
augacucagcaccgccccucaacaggcaugacucugcagagaugacuuaguacugccccucagc

SEQ ID NO: 238056 - RNA, 64 nt, hsa
augacucagcaccgccccucaacaggcaugacucugcagagaugacucagcacugccccucagc

SEQ ID NO: 238057 - RNA, 64 nt, hsa
ccagaggacacacacaggggagaagccuuaugucugcagagagugugagcggggcuuuagccgg

SEQ ID NO: 238058 - RNA, 64 nt, hsa
ccaaaggacacacacaggggggaagcccuacgucugcagagagugugggagggcuuuagccgga

SEQ ID NO: 238059 - RNA, 64 nt, hsa
gaccucagcauuaucuauauaguaccuuugcucuugcagagaagccuugguacuaggcaguuag

SEQ ID NO: 238060 - RNA, 64 nt, hsa
ugguacuaggcaguuagagaugccucccugacccugcagagaugcgguggcuaaaggucccaag

SEQ ID NO: 238061 - RNA, 64 nt, hsa
uauauacauuccauagucaucaaggaauauauugugcagagagaguauccuugacugcuuaagu

SEQ ID NO: 238062 - RNA, 64 nt, hsa
ugcacuccagacggcuuucucaguuccaagauuuugcagagagaaggagcaaaccuuuucauug

SEQ ID NO: 238063 - RNA, 64 nt, hsa
cucucggcccccucgcccuggcccccagguucucugcagagaucucuccuggacccccagcggu

SEQ ID NO: 238064 - RNA, 64 nt, hsa
gaagguuuuuguuucuuuuuucggcuaaaaagaaugcagagaugugcccccacccccacccucg

SEQ ID NO: 238065 - RNA, 64 nt, hsa
agucacaccuugcaagucaucauagucuucauacugcagagaaaucuuacaaaugugaagacug

SEQ ID NO: 238066 - RNA, 64 nt, hsa
aaacaacccuugcacgucaucauagaauucauacugcagagaaacuuuacaaauaggaagaaug

SEQ ID NO: 238067 - RNA, 64 nt, hsa
auuugccuucugagagaagagacuagcaaaaagcugcagagaggauucggcccaaacucagaac

SEQ ID NO: 238068 - RNA, 64 nt, hsa
auugguauagagagcagaagaguagcuaggcagaugcagagauggagacaugagacucagugca

SEQ ID NO: 238069 - RNA, 64 nt, hsa
uuucucucuugaagaggauucuuugaaaagguccugcagagaaaucaguacagguuaucccgaa

SEQ ID NO: 238070 - RNA, 64 nt, hsa
cgccugacggcagagggugagcccccguggagucugcagagaggccuuggccaggagcggcggg

SEQ ID NO: 238071 - RNA, 64 nt, hsa
aguugcaugugaucgcaauguuugaguuauuacuugcagagauaggagcaaaaauuacaaaaac

SEQ ID NO: 238072 - RNA, 64 nt, hsa
guggucguguagagguccuucuccuuucacauggugcagagagcgaggaccucuccuccucguu

SEQ ID NO: 238073 - RNA, 64 nt, hsa
augggacaccuguaauguaacccacacagcgguuugcagagaauguuagccaugacuugggcuu

SEQ ID NO: 238074 - RNA, 64 nt, hsa
ucaacuuucuuagcucaagagagaggcugagaaaugcagagaagaauaagacauaaaauagcuc

SEQ ID NO: 238075 - RNA, 64 nt, hsa
uuuguuuagaaggcucuaucuuccacuguggcccugcagagauccccugagccaagccgaggca

SEQ ID NO: 238076 - RNA, 64 nt, hsa
ugcaaaauaaagauaccacaauucaucuuaaaacugcagagauuuaaugugucagggaauagau

SEQ ID NO: 238077 - RNA, 64 nt, hsa
guauuuuccugguucugaggaggcuugagacaggguuauggauuuccuuguucugugucuuuau

SEQ ID NO: 238078 - RNA, 64 nt, hsa
ugguaugaaccaaugugaggaggcuugagacaggguuauggauuuccagagcucuuccauguag

SEQ ID NO: 238079 - RNA, 64 nt, hsa
uaggugggaggugauaaaauuuguucccuuuauaguuauggaaguggcuuaggugaauugagua

SEQ ID NO: 238080 - RNA, 64 nt, hsa
guccucacaagccgugcugcuuaguugcucggugguuauggauaaacuuugcccagcaugauuu

SEQ ID NO: 238081 - RNA, 64 nt, hsa
aucagugccuauggguuguuaauacuauauugcuguaugguauaugcaugcugauuuaccacuu

SEQ ID NO: 238082 - RNA, 64 nt, hsa
aucagugccucuggguuguuaauacuguauugcuguaugguauauguaugcugauuuacuacuu

SEQ ID NO: 238083 - RNA, 64 nt, hsa
augaccagauaacugacuagaaagaaguaguugacagugcuauuuugugcccacugucucuccu

SEQ ID NO: 238084 - RNA, 64 nt, hsa
aagugaaugucuaaggucacacaguauuaagugacagugcuagaaaucaaacccagagcugugg

SEQ ID NO: 238085 - RNA, 64 nt, hsa
uucagcaccaacugagcaaaccccugugguccggcagugcuaccaugguaauggacagaguuau

SEQ ID NO: 238086 - RNA, 64 nt, hsa
uucagcaccaacagagccaaggccuugggagcagcagugcuaccacgguaauggacagaguuau

SEQ ID NO: 238087 - RNA, 64 nt, hsa
uguagucccuccgacuucucuagacaucuagucucagugcuagcuuauuuguauuuuuccucuu

SEQ ID NO: 238088 - RNA, 64 nt, hsa
uuggugccuaauguuccaugucugaaguuugccccagugcuacacguuggaguauaccuaugug

SEQ ID NO: 238089 - RNA, 64 nt, hsa
cacuaaugugucaucuagcauuagguauaucucccagugcuaucccuccccccucccccgaccc

SEQ ID NO: 238090 - RNA, 64 nt, hsa
ucaugugcaaacccacucagagaugcauuuggaacagugcuacugaaaggcaguagucauuuuc

SEQ ID NO: 238091 - RNA, 64 nt, hsa
uuuauucuuuuccaaaauaaaacaaagggcacagcaucuguagucagccgacaacuauuucggc

SEQ ID NO: 238092 - RNA, 64 nt, hsa
uacccaugaaaaacuggcaacauuccaagaauagcaucuguacaaaggggaaagaacauaaagg

SEQ ID NO: 238093 - RNA, 64 nt, hsa
auuuauauucaccagucacuucauaugucuugaacaucuguaucuguaaacaugaaucaccgug

SEQ ID NO: 238094 - RNA, 64 nt, hsa
uuuguaauuuuaggucagucuuguuccuuggcaacaucuguaguauuauuaaucuucugacauu

SEQ ID NO: 238095 - RNA, 64 nt, hsa
guaucaccuucacugacuccauugagucauugagcaucuguacauauccuucaccacccccagu

SEQ ID NO: 238096 - RNA, 64 nt, hsa
acagguuuucauucuuuugaacucuggugcacuccaucuguaauccaugucuauaaucuaccaa

SEQ ID NO: 238097 - RNA, 64 nt, hsa
uuuuaaacagcauugacaucaucuguaaaaccaucaucuguaaaaccaucuaugacaugaguuu

SEQ ID NO: 238098 - RNA, 64 nt, hsa
cucagucuucagugauuuuaaacagcauugacaucaucuguaaaaccaucaucuguaaaaccau

SEQ ID NO: 238099 - RNA, 64 nt, hsa
uucuuuguacaucuguacauuuuguccaaauguacaucuguacgucugucaucauugugacuuc

SEQ ID NO: 238100 - RNA, 64 nt, hsa
gaucuaucaauuuucaucuuuacauuucuuuguacaucuguacauuuuguccaaauguacaucu

SEQ ID NO: 238101 - RNA, 64 nt, hsa
aaguauuuguggacaguuaaaugcuaauuauauacaucuguaguuauucuacauuuucuugaaa

SEQ ID NO: 238102 - RNA, 64 nt, hsa
aguauuuguggacaguuaaaugcuaauuaauauacaucuguaguuauucuacauuuucuugaaa

SEQ ID NO: 238103 - RNA, 64 nt, hsa
uuucuuauaaaauccagccccgguuacauauaaucaucuguaucuuaucaugauuccuguaggu

SEQ ID NO: 238104 - RNA, 64 nt, hsa
gagaacgguaaugcgacaagauacacauugccuucaucuguacauucugugauaccaggcaaau

SEQ ID NO: 238105 - RNA, 64 nt, hsa
gaccuccagccggucacucacccucucuggaccucaucuguaagaggagccagcuggauaagau

SEQ ID NO: 238106 - RNA, 64 nt, hsa
ccuuaccauuaaucucucugggucucaguuuucucaucuguauuggagguagcagugcuagcuc

SEQ ID NO: 238107 - RNA, 64 nt, hsa
ugcaaguuacuucaccucugagccuaaguuuccacaucuguaaaaggagauaauaaacaccuac

SEQ ID NO: 238108 - RNA, 64 nt, hsa
gcaagucauuugaccuucugugccucaguuuccucaucuguaaaauggggcuaacaauauuacc

SEQ ID NO: 238109 - RNA, 64 nt, hsa; identical to SEQ ID NO: 141261

SEQ ID NO: 238110 - RNA, 64 nt, hsa; identical to SEQ ID NO: 141262

SEQ ID NO: 238111 - RNA, 64 nt, hsa; identical to SEQ ID NO: 141263

SEQ ID NO: 238112 - RNA, 64 nt, hsa; identical to SEQ ID NO: 141264

SEQ ID NO: 238113 - RNA, 64 nt, hsa; identical to SEQ ID NO: 141265

SEQ ID NO: 238114 - RNA, 64 nt, hsa; identical to SEQ ID NO: 141266

SEQ ID NO: 238115 - RNA, 64 nt, hsa; identical to SEQ ID NO: 141267

SEQ ID NO: 238116 - RNA, 64 nt, hsa; identical to SEQ ID NO: 141268

SEQ ID NO: 238117 - RNA, 64 nt, hsa; identical to SEQ ID NO: 141269

SEQ ID NO: 238118 - RNA, 64 nt, hsa; identical to SEQ ID NO: 141270

SEQ ID NO: 238119 - RNA, 64 nt, hsa; identical to SEQ ID NO: 141271

SEQ ID NO: 238120 - RNA, 64 nt, hsa; identical to SEQ ID NO: 141272

SEQ ID NO: 238121 - RNA, 64 nt, hsa; identical to SEQ ID NO: 141273

SEQ ID NO: 238122 - RNA, 64 nt, hsa; identical to SEQ ID NO: 141274

SEQ ID NO: 238123 - RNA, 64 nt, hsa; identical to SEQ ID NO: 141275

SEQ ID NO: 238124 - RNA, 64 nt, hsa; identical to SEQ ID NO: 141276

SEQ ID NO: 238125 - RNA, 64 nt, hsa; identical to SEQ ID NO: 141277

SEQ ID NO: 238126 - RNA, 64 nt, hsa; identical to SEQ ID NO: 141278

SEQ ID NO: 238127 - RNA, 64 nt, hsa; identical to SEQ ID NO: 141279

SEQ ID NO: 238128 - RNA, 56 nt, hsa; identical to SEQ ID NO: 141280

SEQ ID NO: 238129 - RNA, 64 nt, hsa; identical to SEQ ID NO: 141281

SEQ ID NO: 238130 - RNA, 64 nt, hsa; identical to SEQ ID NO: 141282

SEQ ID NO: 238131 - RNA, 64 nt, hsa; identical to SEQ ID NO: 141283

SEQ ID NO: 238132 - RNA, 64 nt, hsa; identical to SEQ ID NO: 141284

SEQ ID NO: 238133 - RNA, 64 nt, hsa; identical to SEQ ID NO: 141285

SEQ ID NO: 238134 - RNA, 64 nt, hsa; identical to SEQ ID NO: 141286

SEQ ID NO: 238135 - RNA, 64 nt, hsa; identical to SEQ ID NO: 141287

SEQ ID NO: 238136 - RNA, 64 nt, hsa; identical to SEQ ID NO: 141288

SEQ ID NO: 238137 - RNA, 64 nt, hsa; identical to SEQ ID NO: 141289

SEQ ID NO: 238138 - RNA, 64 nt, hsa; identical to SEQ ID NO: 141290

SEQ ID NO: 238139 - RNA, 64 nt, hsa; identical to SEQ ID NO: 141291

SEQ ID NO: 238140 - RNA, 64 nt, hsa; identical to SEQ ID NO: 141292

SEQ ID NO: 238141 - RNA, 64 nt, hsa; identical to SEQ ID NO: 141293

SEQ ID NO: 238142 - RNA, 64 nt, hsa; identical to SEQ ID NO: 141294

SEQ ID NO: 238143 - RNA, 64 nt, hsa; identical to SEQ ID NO: 141295

SEQ ID NO: 238144 - RNA, 64 nt, hsa; identical to SEQ ID NO: 141296

SEQ ID NO: 238145 - RNA, 64 nt, hsa; identical to SEQ ID NO: 141297

SEQ ID NO: 238146 - RNA, 64 nt, hsa; identical to SEQ ID NO: 141298

SEQ ID NO: 238147 - RNA, 64 nt, hsa; identical to SEQ ID NO: 141299

SEQ ID NO: 238148 - RNA, 50 nt, hsa; identical to SEQ ID NO: 141300

SEQ ID NO: 238149 - RNA, 64 nt, hsa; identical to SEQ ID NO: 141301

SEQ ID NO: 238150 - RNA, 64 nt, hsa; identical to SEQ ID NO: 141302

SEQ ID NO: 238151 - RNA, 64 nt, hsa; identical to SEQ ID NO: 141303

SEQ ID NO: 238152 - RNA, 64 nt, hsa; identical to SEQ ID NO: 141304

SEQ ID NO: 238153 - RNA, 64 nt, hsa; identical to SEQ ID NO: 141305

SEQ ID NO: 238154 - RNA, 64 nt, hsa; identical to SEQ ID NO: 141306

SEQ ID NO: 238155 - RNA, 64 nt, hsa; identical to SEQ ID NO: 141307

SEQ ID NO: 238156 - RNA, 64 nt, hsa; identical to SEQ ID NO: 141308

SEQ ID NO: 238157 - RNA, 64 nt, hsa; identical to SEQ ID NO: 141309

SEQ ID NO: 238158 - RNA, 64 nt, hsa; identical to SEQ ID NO: 141310

SEQ ID NO: 238159 - RNA, 64 nt, hsa; identical to SEQ ID NO: 141311

SEQ ID NO: 238160 - RNA, 64 nt, hsa; identical to SEQ ID NO: 141312

SEQ ID NO: 238161 - RNA, 64 nt, hsa; identical to SEQ ID NO: 141313

SEQ ID NO: 238162 - RNA, 64 nt, hsa; identical to SEQ ID NO: 141314

SEQ ID NO: 238163 - RNA, 64 nt, hsa; identical to SEQ ID NO: 141315

SEQ ID NO: 238164 - RNA, 64 nt, hsa; identical to SEQ ID NO: 141316

SEQ ID NO: 238165 - RNA, 64 nt, hsa; identical to SEQ ID NO: 141317

SEQ ID NO: 238166 - RNA, 64 nt, hsa; identical to SEQ ID NO: 141318

SEQ ID NO: 238167 - RNA, 64 nt, hsa; identical to SEQ ID NO: 141319

SEQ ID NO: 238168 - RNA, 64 nt, hsa; identical to SEQ ID NO: 141320

SEQ ID NO: 238169 - RNA, 64 nt, hsa
uuggcagccuugaaguuggggucagccucggcaggagucccacuccuccuggggugcugccugc

SEQ ID NO: 238170 - RNA, 64 nt, hsa
ggcagccccaaaacuggggucagccucagggcaggagucccacuccuccagggcucugcucguc

SEQ ID NO: 238171 - RNA, 64 nt, hsa
ugagucccacucuucauccuggaagugggaacuggagucccacccacagugcauucagaaagca

SEQ ID NO: 238172 - RNA, 64 nt, hsa
cauggugaccccacauugcacugguaaaccauuugagucccacucuucauccuggaagugggaa

SEQ ID NO: 238173 - RNA, 64 nt, hsa
acaggguucucugucauuuuccuguuuucuuccagagucccaauccuuugcccuaguucuuuca

SEQ ID NO: 238174 - RNA, 64 nt, hsa
accuucuggacacucccuccuugagggcagaaaggagucccaggccugucccuagggacaaggc

SEQ ID NO: 238175 - RNA, 64 nt, hsa
ucaccacccacacucuuuuuagguguaaaagauggagucccacggaggaggggcagagccagga

SEQ ID NO: 238176 - RNA, 64 nt, hsa
caagccugaaaacagaggggagggaggaaggaaggagucccagcaggagcacagcccugguuuc

SEQ ID NO: 238177 - RNA, 64 nt, hsa
ggcgggcccuaauaaaacccucugccaggucugggagucccaggccaucugcucaacgcucugu

SEQ ID NO: 238178 - RNA, 64 nt, hsa
ccgagucuacuuggcccuagaagagaaaguugaagagucccagaccuacuagcauuuugcaacu

SEQ ID NO: 238179 - RNA, 64 nt, hsa
aagacuaugcccagccccauucacuccauccugugagucccacucccagccccacucccaccau

SEQ ID NO: 238180 - RNA, 64 nt, hsa
aagacugugcccagccccacucacuccauccugugagucccacucccagccccacucccaccau

SEQ ID NO: 238181 - RNA, 64 nt, hsa
cuccugggugcauuuccgugucagaaacaguaccgagucccacccccucuggaggcacagcugu

SEQ ID NO: 238182 - RNA, 64 nt, hsa
ggggccuguucuuagcucaugcauaguccuuacagagucccaggaccggggguggagaggagcc

SEQ ID NO: 238183 - RNA, 64 nt, hsa
caaaaaauuagccgggcguuguggcgggcaccuggagucccagcuacuccggaggcugagggag

SEQ ID NO: 238184 - RNA, 64 nt, hsa
uccaucauggcuaccugcugugguuugaauguuugagucccaacaaaauucauaucaaaacaua

SEQ ID NO: 238185 - RNA, 64 nt, hsa
accaaaugauaucuaaguaguucucagcaauaauaauaaugacgauaauacuucuuuuccacau

SEQ ID NO: 238186 - RNA, 64 nt, hsa
gcuaugagguuaaugaaguaccaagcugugcuugaauaaugauauguuuucucagauuuucugu

SEQ ID NO: 238187 - RNA, 64 nt, hsa
uguuucuuaaaccuagcaccucuguguauuugaaaauaaugagacaucuuucauuggauuuugg

SEQ ID NO: 238188 - RNA, 64 nt, hsa
agucaauauccagguuuauuguguccuacuauuuaauaaugagagaaguaauggcaaggccuuu

SEQ ID NO: 238189 - RNA, 64 nt, hsa
auuugucuagcauuaucaucuuaaugacaaagggaauaaugaacuagaaaccagcaagugaaag

SEQ ID NO: 238190 - RNA, 64 nt, hsa
aagccucuucauaauaccagcucaccuuuggaggaauaaugacccaguauuugucccauuuuug

SEQ ID NO: 238191 - RNA, 64 nt, hsa
uuaggggcacccaaaguucugguuaucuaugaauaauaaugaauaauuuuggcugagaauggua

SEQ ID NO: 238192 - RNA, 64 nt, hsa
auuaaaauaaauuauuucauuugcacacaaugauaauaaugaugauaauaauaauaauaauaau

SEQ ID NO: 238193 - RNA, 64 nt, hsa
aauuaaaacaccaucucagcuuuaacuuuuaaauaauaaugauaacuaucuuuauugagcaucu

SEQ ID NO: 238194 - RNA, 64 nt, hsa
gaagaaaauauuuuguaaaagaauguuuauuugaaauaaugauaacuaucaauuguucacaaug

SEQ ID NO: 238195 - RNA, 64 nt, hsa
caaacucaccuuaaaauacagauguuaugucacuaauaaugaguaguaacccaauuuagcuuua

SEQ ID NO: 238196 - RNA, 64 nt, hsa
ugacuaauauucagauuccauuuucaauaagguaaauaaugaaagaucucacaaaggaaucauu

SEQ ID NO: 238197 - RNA, 64 nt, hsa
caguuaaaaugcuuuuuacucugguguauuauagaauaaugaacacauuuuuauauauguuaaa

SEQ ID NO: 238198 - RNA, 64 nt, hsa
caguuauugacuuuauauucaauuauuuacaucaaauaaugaaauaacugaaauguacaaaugu

SEQ ID NO: 238199 - RNA, 64 nt, hsa
ugaauauuguauguugcauuccacuucauuugaaaauaaugaaaccauguaccacuguuuacau

SEQ ID NO: 238200 - RNA, 64 nt, hsa
aaagauuaaaauggggaaauaaugagcaucugugaauaaugaggugucauuuuuugauaaucuu

SEQ ID NO: 238201 - RNA, 64 nt, hsa
uguguuguauauaauguaaagauuaaaauggggaaauaaugagcaucugugaauaaugaggugu

SEQ ID NO: 238202 - RNA, 64 nt, hsa
uuguauucuuuuaucagcugauuuugaaacauauaauaaugauuuucuuguucccuucuuuaac

SEQ ID NO: 238203 - RNA, 64 nt, hsa
cauauaauauauaugcuaaaguauaaagaguaauaauaaugacaauaaacaaaccccugugugc

SEQ ID NO: 238204 - RNA, 64 nt, hsa
auuuccugaugagucauauuacugugauuuucauaauaaugaagacaccaugaauauacuuuuu

SEQ ID NO: 238205 - RNA, 64 nt, hsa
uuguucaaacugaaggaaauuucuaauaaucccgaauaaugaacguagaaaucuaucuccauaa

SEQ ID NO: 238206 - RNA, 64 nt, hsa
agauguacuccguaucaaauaauaaugauguugaaauaaugauaguagguauguauuauggauu

SEQ ID NO: 238207 - RNA, 64 nt, hsa
gggguagguggggaagauguacuccguaucaaauaauaaugauguugaaauaaugauaguaggu

SEQ ID NO: 238208 - RNA, 64 nt, hsa
aucuaaagauuuuuuuuccugucuugggagauagaauaaugaugugccuuacaauggauugugu

SEQ ID NO: 238209 - RNA, 64 nt, hsa
agucacuuacuccaagaagucguuuccuguggccaauaaugaagaugacgcacucggaagcuug

SEQ ID NO: 238210 - RNA, 64 nt, hsa
aaacacaagcuuuccauggaauccugggaaaauuaauaaugauugugagaauuauaaauacaga

SEQ ID NO: 238211 - RNA, 64 nt, hsa
cauaucaagucaauuaguuugguuucacacuaauaauaaugacaaaaagcacaugcagaguaau

SEQ ID NO: 238212 - RNA, 64 nt, hsa
gcauauguaugugugguuacuuuuuauaaugugaaauaaugaauaaugaauuuacucaaaauaa

SEQ ID NO: 238213 - RNA, 64 nt, hsa
uaugugugguuacuuuuuauaaugugaaauaaugaauaaugaauuuacucaaaauaaaacauag

SEQ ID NO: 238214 - RNA, 64 nt, hsa
uguucacucgaacuaagaacaaugguuaaggcagaauaaugacuaaaauauguucauauauuau

SEQ ID NO: 238215 - RNA, 64 nt, hsa
uacuaccugaacuggcuuuucugagagaugaaucaauaaugaaacaugucuguuuuaaaaacua

SEQ ID NO: 238216 - RNA, 64 nt, hsa
ucauacuauuaaauuuugcccuaaaagaccucuuaauaaugauuguugccagugacugauuaau

SEQ ID NO: 238217 - RNA, 64 nt, hsa
cucuuaaagauugcugcuuuuuuuugauauugucaauaaugaaacccaauuguaaaacagucac

SEQ ID NO: 238218 - RNA, 64 nt, hsa
cagggcagaaaggagggaggauucgucccauuacaauaaugaaauaaugauauucuaauuuuuu

SEQ ID NO: 238219 - RNA, 64 nt, hsa
aaaggagggaggauucgucccauuacaauaaugaaauaaugauauucuaauuuuuuuaaauaaa

SEQ ID NO: 238220 - RNA, 64 nt, hsa
gauugaagccuuuggcugaaacuuuauacauagaaauaaugauuugcucauaacagguaucauu

SEQ ID NO: 238221 - RNA, 64 nt, hsa
uaugaaaauuaaguacagaggcugcgaucuuagaaauaaugaaggugccauuuggcugcuccuu

SEQ ID NO: 238222 - RNA, 64 nt, hsa
auuuuucuuacacacuaaauggguauuuguucaaaauaaugaaguuauggcuucacauucauug

SEQ ID NO: 238223 - RNA, 64 nt, hsa
ucacuucaguccuuuucugaagaguuugacuuagaauaaugaagguaacuagaaagugaguuaa

SEQ ID NO: 238224 - RNA, 64 nt, hsa
aaaagcauacagucuaaauaauaaacaguuguaaaauaaugaagguagaaauuauaacacuagg

SEQ ID NO: 238225 - RNA, 64 nt, hsa
ccaugugauguuuauagucuguauuacuucuccaaauaaugaacuaccugauucauugucccuu

SEQ ID NO: 238226 - RNA, 64 nt, hsa
uaaaaacacauuguuaagcuguggauuuguacucaauaaugacuuaggauaaacauuuauuuuc

SEQ ID NO: 238227 - RNA, 64 nt, hsa
uugauuaaacuguuuguaauuauuugaguagauuaauaaugaaaauacuuuggaaauaauauac

SEQ ID NO: 238228 - RNA, 64 nt, hsa
ugauaguuuguuaucauguuauacguacacuuagaauaaugauccagccaucucauucuaacag

SEQ ID NO: 238229 - RNA, 64 nt, hsa
uucugugaaucuauagaucaaucugaggagacuuaauaaugauauugauucucccaauucauga

SEQ ID NO: 238230 - RNA, 54 nt, hsa
cagcucuaaacacaaauuagguggaauaaugacucgagcaggaaagcaguagaa

SEQ ID NO: 238231 - RNA, 64 nt, hsa
ccuuggcuuuaguuuuauaucauauuuagaaaauaauaaugaaaagcauccccaaaauuucaau

SEQ ID NO: 238232 - RNA, 64 nt, hsa
gugucuaccaagaacaauugaguuuucuaaaaguaauaaugaagauuaugcaauucuaacugua

SEQ ID NO: 238233 - RNA, 64 nt, hsa
aauuauauaaaaauacuuuauugcuaaaaauacuaauaaugaucuuagccuucagggagucgua

SEQ ID NO: 238234 - RNA, 64 nt, hsa
aacaacaaaacaaaacaaaaaaaaaaccggauagaauaaugaccaaaaaauggagaaaaaguag

SEQ ID NO: 238235 - RNA, 64 nt, hsa
ucacuguauccuaguuauguuuacagcacaaauaaauaaugacugucauacauccagaggagac

SEQ ID NO: 238236 - RNA, 64 nt, hsa
cuuaauugaaacauauaauuugcuuaauuacgugaauaaugaaauguaaaauccggguccauaa

SEQ ID NO: 238237 - RNA, 64 nt, hsa
guggaaagguggcuuuuagcauucuguguuuccaaauaaugaauuugaacaccagguuggguua

SEQ ID NO: 238238 - RNA, 64 nt, hsa
ugcugcagggucacuuuuggcuggucagagaaggaauaaugauaucaccuucuucccccccucc

SEQ ID NO: 238239 - RNA, 64 nt, hsa
uaugguaaaggaauccuuucagcugccaguuuugaauaaugaauaucauauuguaucaucaaug

SEQ ID NO: 238240 - RNA, 64 nt, hsa
ccagauagaaacaguaguuaucuuuggguagaagaauaaugagugaucuuuacuuuuuuacuuu

SEQ ID NO: 238241 - RNA, 64 nt, hsa
ugauguaggucuuauuccuuuaguauggacuuaaaguacuuauucauauaccuuguaacuaaaa

SEQ ID NO: 238242 - RNA, 64 nt, hsa
ccuuauuauucauuacugcauccccaguaaugaaaguacuuagaaaauaauuauugaaugaaug

SEQ ID NO: 238243 - RNA, 64 nt, hsa
uaagaauacuuaaaaugccugggauaguucuugggacuaacaacaugaucuucuuugaguuaaa

SEQ ID NO: 238244 - RNA, 64 nt, hsa
ggaucgccugaggucaggaguucaagaccaaccugacuaacauggugaaaccccaucucuacua

SEQ ID NO: 238245 - RNA, 64 nt, hsa
cuuuuuuuguggggcuggguggggggagaagaccgacuaacagcugaaguaaugacagauuguu

SEQ ID NO: 238246 - RNA, 64 nt, hsa
cauuuucuccagggaaacgaggcuugcccagauagacuaacaacccuuuagugcuccaagaagu

SEQ ID NO: 238247 - RNA, 64 nt, hsa
caguguagucucaauuauaucugaaaguaauugugacuaacaaguaugcuuugccuuauuucca

SEQ ID NO: 238248 - RNA, 64 nt, hsa
acaaccuuggcucuguggccauucaaccugccaggacuaacauuucuggauuugugaagaaggg

SEQ ID NO: 238249 - RNA, 64 nt, hsa
ccuccucccagcagcagacacccacccucucacugacuaacaggucccugcacacagcuggccu

SEQ ID NO: 238250 - RNA, 64 nt, hsa
ugcagauggucccaguaauagauacucagcacuagacuaacauaacaggucacuacacgggugc

SEQ ID NO: 238251 - RNA, 64 nt, hsa
cuacccaugaggaauucguggaauggcuacugcugacuaacaugaugcacauaaccaaaugggg

SEQ ID NO: 238252 - RNA, 64 nt, hsa
ucuuucgggcuugcuaagcauuucuaaagcauuagacuaacagauuccugugaaguucugugca

SEQ ID NO: 238253 - RNA, 64 nt, hsa
caucucgugccagggcaggcuaccccuucauggugacuaacaguuacaugaaaguccacgcuuu

SEQ ID NO: 238254 - RNA, 64 nt, hsa
ucuauccuggauucugaacucuucaauuuggagugacuaacacaaguuguuaucuaaaccuuua

SEQ ID NO: 238255 - RNA, 64 nt, hsa
auucauggauaugagcuauucacuaguugggucagacuaacagggacucucagucccaaaaucu

SEQ ID NO: 238256 - RNA, 64 nt, hsa
auuuaauggcccuacugauauucacaucgaaggugacuaacaaugacaaaggccuuaugaacug

SEQ ID NO: 238257 - RNA, 64 nt, hsa
ccuggccucaaucuccaucuuuagggucuccacagacuaacauugaagucuuccagaaaccucg

SEQ ID NO: 238258 - RNA, 64 nt, hsa
uacuuauaaguagcagaacauaaaauguauuucugacuaacacaaaugguccuuucacaugugc

SEQ ID NO: 238259 - RNA, 64 nt, hsa
aaauauuacaaaacauccaacacuagaaagcaaugacuaacauuuaauuuguuuacaaaaaugu

SEQ ID NO: 238260 - RNA, 64 nt, hsa
auuuuuucuuuucuuuacaaaccauuuuguuauugacuaacaggccaaagagucuccaguuuac

SEQ ID NO: 238261 - RNA, 64 nt, hsa
gacuuauccaacuuauaaauaacauauuucuucagacuaacaucuuaaaacacugaccucuaug

SEQ ID NO: 238262 - RNA, 64 nt, hsa
uuuucauuuuguuucuccuucaaaaauuaaguuggacuaacauucacguaucaaacuaauauaa

SEQ ID NO: 238263 - RNA, 64 nt, hsa
ugaauguaccaaaggugaagggacauuacaauaugacuaacagcaacuccaucacuugagaagu

SEQ ID NO: 238264 - RNA, 64 nt, hsa
ggaaguuuugcaugcaggcuguguuuucgagcaggacuaacaacugggaaauaagcaaaaaacu

SEQ ID NO: 238265 - RNA, 64 nt, hsa
guaauauacuguauggaaaguuacaacuguguuagacuaacaaguaauuauaaaaggaaauuuu

SEQ ID NO: 238266 - RNA, 64 nt, hsa
gugccaaaaauauuaaaaaugccuuuuuuggaaggacuaacagaaagcaccugauuugcacuug

SEQ ID NO: 238267 - RNA, 64 nt, hsa
gguguacagagaccagaggagagagacacacuaggacuaacaauguccuaacaaaaugguacuu

SEQ ID NO: 238268 - RNA, 64 nt, hsa
guuaagaucccagguuccagcaacugaugccacugacuaacaacuagccacuugucagaggaag

SEQ ID NO: 238269 - RNA, 64 nt, hsa
gguaucgggggauauggccaguaaaguauugagagacuaacaaauggugaccuaauguuuuguc

SEQ ID NO: 238270 - RNA, 64 nt, hsa
ggaaaggucaccacacuuagggauuuuagaccuugacuaacaagcuccagguguagaaaaauuc

SEQ ID NO: 238271 - RNA, 64 nt, hsa
gcggaucacgaggucaggagauugagaccagccugacuaacauggugaaaucccgucucuacua

SEQ ID NO: 238272 - RNA, 64 nt, hsa
auauuaagucuaaauuaaguuuucuacucauuaagacuaacaucuccccacuccauccccacug

SEQ ID NO: 238273 - RNA, 64 nt, hsa
gccuuguugcuggcaucccggccaggugggcggggacuaacaaagacagcuguuuagggucuuc

SEQ ID NO: 238274 - RNA, 64 nt, hsa
cugggcucaagcaguucucccaccucagccucucgacuaacagggacuauaaucuugcagcacc

SEQ ID NO: 238275 - RNA, 64 nt, hsa
agucuauuuugucuauaggugacaaacaucuccagacuaacaugucaguuuuaucaauuauauu

SEQ ID NO: 238276 - RNA, 64 nt, hsa
agcauguugauuuggucacuaaaaagaagaaaaggacuaacaagcuucacuuuuaugaacaacu

SEQ ID NO: 238277 - RNA, 64 nt, hsa
uuaaguuuaacauauuaaauuaauuuaacauuuagacuaacauuaacauuuaaauuaauauguu

SEQ ID NO: 238278 - RNA, 64 nt, hsa
uucugaacuggaacaugggcauuggguucuaaaggacuaacauaaaaucugugaauuaaaaaag

SEQ ID NO: 238279 - RNA, 64 nt, hsa
ggaggggaccgcucccccuuucucuguggggguggacuaacacaauuaaaaugaacauccugcu

SEQ ID NO: 238280 - RNA, 64 nt, hsa
gaugcuacccccacagaggaggcaagagccccaggacuaacagcugacugaccaaagcagcccc

SEQ ID NO: 238281 - RNA, 64 nt, hsa
auuuaauggcccuacugauauucacaucuaaguugacuaacaaugacaaaggccuuaugaacug

SEQ ID NO: 238282 - RNA, 64 nt, hsa
gacuuugaaucuuugccuguuugucuaaacauuugacuaacauucuguuugaauuuggaaguau

SEQ ID NO: 238283 - RNA, 64 nt, hsa
acguuucacucaaguucuccuacugaggacucuugacuaacagcauacuggcaguuucaccuua

SEQ ID NO: 238284 - RNA, 64 nt, hsa
ucugaaauuuuaguuauuuuuuguuuuuaauaaagacuaacacaaacuuaaugauuaaaaguga

SEQ ID NO: 238285 - RNA, 64 nt, hsa
aaguauauguaagguuaaugcauuuagugaacgugacuaacaaagacuaaugugcacauuaaca

SEQ ID NO: 238286 - RNA, 64 nt, hsa
uuggauagaauauaauugauugguuuguuacuuggacuaacaaggcaguagauuugccugugug

SEQ ID NO: 238287 - RNA, 64 nt, hsa
agaugauagcaauauauuauuugguuacauaguggacuaacauuuuuaguaaucucuuuugcca

SEQ ID NO: 238288 - RNA, 64 nt, hsa
uagaauauuaagugcuacuugagguacauguucagacuaacauucuuuugcaguauagugagaa

SEQ ID NO: 238289 - RNA, 64 nt, hsa
gccagauuuauaguauuccaucuuuaauaugugggacuaacagcaguguagauuguuaccuuaa

SEQ ID NO: 238290 - RNA, 64 nt, hsa
uagaugacugaccaagggcuuaaucaaauaaaaugacuaacagcaucuaucauaaagccacaca

SEQ ID NO: 238291 - RNA, 64 nt, hsa
uguuaccucuuuuaugguuuuuaauuuuuaucaggacuaacauuuucagaaauagcaaggugug

SEQ ID NO: 238292 - RNA, 64 nt, hsa
ggcaggcaaucaccugagggcaggagaccagccugacuaacauggagaaaccccaucucuacua

SEQ ID NO: 238293 - RNA, 64 nt, hsa
uauauuuuauuaauaaaaugguucaugaaucggagacuaacaaaguuuucaugugcucagaauu

SEQ ID NO: 238294 - RNA, 64 nt, hsa
caggguacuaaaagaaacuaugauguggagaaaggacuaacaucuccuccaauaaaccccaaau

SEQ ID NO: 238295 - RNA, 64 nt, hsa
acaacuuuucuuagacuuaacacuuaugauaaaugacuaacauaguaacagaaucuuuaugaaa

SEQ ID NO: 238296 - RNA, 64 nt, hsa
ucacugaaccagacacagcauugcugacacaugagacuaacacgugcaauuauuuaaaaagauu

SEQ ID NO: 238297 - RNA, 64 nt, hsa
cauucaaauuuguauuauuuggagaugaagauuugacuaacagugagccuuauuaagaacacua

SEQ ID NO: 238298 - RNA, 64 nt, hsa
auuuccuagucuuaacuuucaggaguuuacaauugacuaacacuccaugauugauucagucaug

SEQ ID NO: 238299 - RNA, 64 nt, hsa
guagaggggcucucccccaggauuuugguguuuugacuaacaccaguuccugccaaccucuguu

SEQ ID NO: 238300 - RNA, 64 nt, hsa
ugauccaaaagaucaacagcaaucugaagacucugacuaacaugcagaaucuacccaauaccac

SEQ ID NO: 238301 - RNA, 64 nt, hsa
ggccuggacugcacucacagaggcaaguguuguagacuaacaaagauacuccaaaauacaaugg

SEQ ID NO: 238302 - RNA, 64 nt, hsa
uuaauuucuguguguuggccauacugaauuaugagacuaacagaugucuacaauacaauaccug

SEQ ID NO: 238303 - RNA, 64 nt, hsa
auuaauaaaaaggaauaacuguuccaaagacucagacuaacauacaggacaguccagcuggaug

SEQ ID NO: 238304 - RNA, 64 nt, hsa
ucuguaauugguuaucaggaagaauuugcuuaaugacuaacacccuaagcaucagaccuggaau

SEQ ID NO: 238305 - RNA, 64 nt, hsa
agguucuccagugacagaaagauccugaagcauggacuaacaugcucucuggagcuuaguacuc

SEQ ID NO: 238306 - RNA, 64 nt, hsa
auaaaguucaguuuauaaguuaggcacaguaagagacuaacaacagcucacagcaaaauagagc

SEQ ID NO: 238307 - RNA, 64 nt, hsa
uacaccuucuggguagggaaacaaccaacuaauugacuaacaccaccaacaacaaaaaacaaac

SEQ ID NO: 238308 - RNA, 64 nt, hsa
ccaggaauggagaccauccgucggcccugcuaaggacuaacacuuagccaucguuuuucacagg

SEQ ID NO: 238309 - RNA, 64 nt, hsa
gaggcacaccagguagagcaaacuuagcagcucugacuaacaggcugcaaagugcaaguucaga

SEQ ID NO: 238310 - RNA, 64 nt, hsa
gaccccagggcacaggagcuaccuguguggacaggacuaacacucagaagccugggggccuggc

SEQ ID NO: 238311 - RNA, 64 nt, hsa
ccuauccccaccuacuccugggucaggaggaaaagacuaacaggagaaugcacaguggguggag

SEQ ID NO: 238312 - RNA, 64 nt, hsa
auuuaguuaucuaucagacucaaaaucauuuaaagacuaacaaaacacaaucaugauauucuaa

SEQ ID NO: 238313 - RNA, 64 nt, hsa
uuugugauuuuuuuaauagugcuuuuuuuuuuuugacuaacaagaauguaacuccagauagaga

SEQ ID NO: 238314 - RNA, 64 nt, hsa
gauauacuuggugauaaugugaaugauguaaucagacuaacaguugaaucauugcuguuggagg

SEQ ID NO: 238315 - RNA, 64 nt, hsa
uuuaguugggaaauagauuucaggucuuuuauuagacuaacauuuuuugagaaguaaaauugac

SEQ ID NO: 238316 - RNA, 64 nt, hsa
gcagcucuccuguuguauucagguguuguuuacagacuaacaaauguguuggcaaaucccuggu

SEQ ID NO: 238317 - RNA, 64 nt, hsa
gcggaucacgaggucaggagaucgagaccaucgugacuaacacagugaaaccccgucucuaaua

SEQ ID NO: 238318 - RNA, 64 nt, hsa
cucuggacuuuauuguccuguuucuaucaaauuggacuaacaaaaauugauauaauacauucau

SEQ ID NO: 238319 - RNA, 64 nt, hsa
agacagcaguucagucaguacauaauuuguuggugacuaacaaagcucacaucugggagauuaa

SEQ ID NO: 238320 - RNA, 64 nt, hsa
aagccacagaagauaaauacaggggucaaaaccagacuaacaguuuuagaaagugaaaaaaguu

SEQ ID NO: 238321 - RNA, 64 nt, hsa
cuacauacgcaaaaacuuccuuuacagagguucggacuaacauuucacaugcacauuucaaaac

SEQ ID NO: 238322 - RNA, 64 nt, hsa
gcccuguucucaccucaugcugcuccccagaguagacuaacaggcucaguccccuguuguccuu

SEQ ID NO: 238323 - RNA, 64 nt, hsa
ucugagcacgcuaccaaaucucaaaauauccuaagacuaacaaaggcagcugugucugagccca

SEQ ID NO: 238324 - RNA, 64 nt, hsa
aaauuuugcuugcaugugcuaauaugaaauaacagacuaacauuuuaggggaaaaauaaauaca

SEQ ID NO: 238325 - RNA, 64 nt, hsa
ggaucaccugagguggggaguaugagaccacccugacuaacauggagagacccugucucuacua

SEQ ID NO: 238326 - RNA, 64 nt, hsa
auuaaaagcgcaggcagauuuaauuugcuaaauagacuaacaggaggaaaaaaacaaacagccu

SEQ ID NO: 238327 - RNA, 64 nt, hsa
ggaagacguuugcaaccgcgacaaaauaacucuugacuaacagccgcagagcagccgguccugg

SEQ ID NO: 238328 - RNA, 64 nt, hsa
auucuaaucuuaaaggaauaaagcacugaauugggacuaacauucugauagguugcacccuuaa

SEQ ID NO: 238329 - RNA, 64 nt, hsa
gaugcuguuauucaggcgaacuugcucauggguggacuaacaccugguuugguacagagacuga

SEQ ID NO: 238330 - RNA, 64 nt, hsa
ccccacccccaccaaccaggggagccacuaagcugacuaacaacuguccccucacccaccagcu

SEQ ID NO: 238331 - RNA, 64 nt, hsa
gcaaguaaacauuccucugcucaccucccaacaagacuaacagucuuuuuagaaguaaauauau

SEQ ID NO: 238332 - RNA, 64 nt, hsa
ugagcacugugcuaccuucacugcuccaaagccagacuaacagcucuccaagcccuugggguga

SEQ ID NO: 238333 - RNA, 64 nt, hsa
cuuuauuaauuaccaaauagucuuugugaccaaggacuaacauuuuuaaguuacucagcucuau

SEQ ID NO: 238334 - RNA, 64 nt, hsa
aucgugugcgaggccaggagaucaagaccauccugacuaacaaacacagugaaaccccgucucu

SEQ ID NO: 238335 - RNA, 64 nt, hsa
auguugcauaauauaugcuuauguagcuuuccaggacuaacagauaaauguguaaugaacaaag

SEQ ID NO: 238336 - RNA, 64 nt, hsa
gaacuuggugauagcaaugggaacaaaguggguagacuaacagagagcauuaagaaguuaaauc

SEQ ID NO: 238337 - RNA, 64 nt, hsa
uugggguccagcugccuucagccccccucccccagacuaacagacccuuggaggcaggggcugu

SEQ ID NO: 238338 - RNA, 64 nt, hsa
cugcccauucuccauuucugugugugucaaaggggacuaacagcagaaucuaccucccaacugc

SEQ ID NO: 238339 - RNA, 64 nt, hsa
ucugaaggcucaacuggggaaggauccacauccagacuaacauaguuguuacccaauguauuuc

SEQ ID NO: 238340 - RNA, 64 nt, hsa
ggagcagagguccgcugaggcagucuguccuugagacuaacaaagucaucugcuguuuggggaa

SEQ ID NO: 238341 - RNA, 64 nt, hsa
uucacuguuaccaggcauguaacagaaggaggaagacuaacacacacccccugccccaucccau

SEQ ID NO: 238342 - RNA, 64 nt, hsa
agggaucccuaacgugcccagcauguagauucuggacuaacagacaacauacauucaccgcugg

SEQ ID NO: 238343 - RNA, 64 nt, hsa
auccagguaagaccggauugaagcuuugaaauuagacuaacaaagcuccagacagcaagagccc

SEQ ID NO: 238344 - RNA, 64 nt, hsa
ccacguaacuuacccuauggacaaaagcaggaaugacuaacacauccuaggagggaaaguccag

SEQ ID NO: 238345 - RNA, 64 nt, hsa
uggcuuuccauuuugggcagaaugcugacuaguagacuaacauaaaagauauaaaaggcaauaa

SEQ ID NO: 238346 - RNA, 64 nt, hsa
aaugaaaugaaaugauaauuuggcuucauaucuagacuaacacaaaauuaagaaucuuccauaa

SEQ ID NO: 238347 - RNA, 64 nt, hsa
ugcuacccaccccuuccauggacugaauaagauggacuaacaggccuguguuuuuguguuuauu

SEQ ID NO: 238348 - RNA, 64 nt, hsa
ccuugccuuucuguuucagcaaaucucagucccugacuaacagccucagcacauccgacaccuc

SEQ ID NO: 238349 - RNA, 64 nt, hsa
ggaucaccugagaucaggaguucaagaccagccugacuaacaugcugaaaccccaugucuacua

SEQ ID NO: 238350 - RNA, 64 nt, hsa
gaaauugcuaccaaacucauuuaauuuggcauaagacuaacagaugaagucucucauuugcuug

SEQ ID NO: 238351 - RNA, 64 nt, hsa
accucugagccuccuuucuucuucuauaaaaugagacuaacaaucugucucuugcuuaccucaa

SEQ ID NO: 238352 - RNA, 64 nt, hsa
aaggccauggccauaucuguugucccaggccaaagacuaacaacugccuugggaaucccuuccu

SEQ ID NO: 238353 - RNA, 64 nt, hsa
aauggcuuacacuugcagacuuugcaaaucuuaagacuaacaaauccuugaaaucacacagcuu

SEQ ID NO: 238354 - RNA, 64 nt, hsa; identical to SEQ ID NO: 24683

SEQ ID NO: 238355 - RNA, 64 nt, hsa; identical to SEQ ID NO: 24684

SEQ ID NO: 238356 - RNA, 64 nt, hsa; identical to SEQ ID NO: 24685

SEQ ID NO: 238357 - RNA, 64 nt, hsa; identical to SEQ ID NO: 24686

SEQ ID NO: 238358 - RNA, 64 nt, hsa; identical to SEQ ID NO: 24687

SEQ ID NO: 238359 - RNA, 64 nt, hsa; identical to SEQ ID NO: 24688

SEQ ID NO: 238360 - RNA, 64 nt, hsa; identical to SEQ ID NO: 24689

SEQ ID NO: 238361 - RNA, 64 nt, hsa; identical to SEQ ID NO: 24690

SEQ ID NO: 238362 - RNA, 64 nt, hsa; identical to SEQ ID NO: 24691

SEQ ID NO: 238363 - RNA, 64 nt, hsa; identical to SEQ ID NO: 24692

SEQ ID NO: 238364 - RNA, 64 nt, hsa; identical to SEQ ID NO: 24693

SEQ ID NO: 238365 - RNA, 64 nt, hsa; identical to SEQ ID NO: 24694

SEQ ID NO: 238366 - RNA, 64 nt, hsa; identical to SEQ ID NO: 24695

SEQ ID NO: 238367 - RNA, 64 nt, hsa; identical to SEQ ID NO: 24696

SEQ ID NO: 238368 - RNA, 64 nt, hsa; identical to SEQ ID NO: 24697

SEQ ID NO: 238369 - RNA, 64 nt, hsa; identical to SEQ ID NO: 24698

SEQ ID NO: 238370 - RNA, 64 nt, hsa; identical to SEQ ID NO: 24699

SEQ ID NO: 238371 - RNA, 64 nt, hsa; identical to SEQ ID NO: 24700

SEQ ID NO: 238372 - RNA, 64 nt, hsa; identical to SEQ ID NO: 24701

SEQ ID NO: 238373 - RNA, 64 nt, hsa; identical to SEQ ID NO: 24702

SEQ ID NO: 238374 - RNA, 64 nt, hsa; identical to SEQ ID NO: 24703

SEQ ID NO: 238375 - RNA, 64 nt, hsa; identical to SEQ ID NO: 24704

SEQ ID NO: 238376 - RNA, 64 nt, hsa; identical to SEQ ID NO: 24705

SEQ ID NO: 238377 - RNA, 64 nt, hsa; identical to SEQ ID NO: 24706

SEQ ID NO: 238378 - RNA, 64 nt, hsa; identical to SEQ ID NO: 24707

SEQ ID NO: 238379 - RNA, 64 nt, hsa; identical to SEQ ID NO: 24708

SEQ ID NO: 238380 - RNA, 64 nt, hsa; identical to SEQ ID NO: 24709

SEQ ID NO: 238381 - RNA, 64 nt, hsa; identical to SEQ ID NO: 24710

SEQ ID NO: 238382 - RNA, 64 nt, hsa; identical to SEQ ID NO: 24711

SEQ ID NO: 238383 - RNA, 64 nt, hsa; identical to SEQ ID NO: 24712

SEQ ID NO: 238384 - RNA, 64 nt, hsa; identical to SEQ ID NO: 24713

SEQ ID NO: 238385 - RNA, 64 nt, hsa; identical to SEQ ID NO: 24714

SEQ ID NO: 238386 - RNA, 64 nt, hsa; identical to SEQ ID NO: 24715

SEQ ID NO: 238387 - RNA, 64 nt, hsa; identical to SEQ ID NO: 24716

SEQ ID NO: 238388 - RNA, 64 nt, hsa; identical to SEQ ID NO: 24717

SEQ ID NO: 238389 - RNA, 64 nt, hsa; identical to SEQ ID NO: 24718

SEQ ID NO: 238390 - RNA, 64 nt, hsa; identical to SEQ ID NO: 24719

SEQ ID NO: 238391 - RNA, 64 nt, hsa; identical to SEQ ID NO: 24720

SEQ ID NO: 238392 - RNA, 50 nt, hsa; identical to SEQ ID NO: 24721

SEQ ID NO: 238393 - RNA, 64 nt, hsa; identical to SEQ ID NO: 24722

SEQ ID NO: 238394 - RNA, 64 nt, hsa; identical to SEQ ID NO: 24723

SEQ ID NO: 238395 - RNA, 64 nt, hsa; identical to SEQ ID NO: 24724

SEQ ID NO: 238396 - RNA, 64 nt, hsa; identical to SEQ ID NO: 24725

SEQ ID NO: 238397 - RNA, 64 nt, hsa; identical to SEQ ID NO: 24726

SEQ ID NO: 238398 - RNA, 64 nt, hsa; identical to SEQ ID NO: 24727

SEQ ID NO: 238399 - RNA, 64 nt, hsa
ucugaaagaaguauggccaaaagcacuuuaaugcugcugacauuguuguuuuuauguucauuug

SEQ ID NO: 238400 - RNA, 64 nt, hsa
uuguuuuuauguucauuugcuggagcgcaagacgugcugacacagugaguuuucucugauguau

SEQ ID NO: 238401 - RNA, 64 nt, hsa
ucucuugaugacgcagcugucauuuggcugugcgugcugacaguuuugcaacaggcagagcugu

SEQ ID NO: 238402 - RNA, 64 nt, hsa
uaaauauauuuuaaauauuguuugggaggcauagugcugacauauauucagaguguuguaguuu

SEQ ID NO: 238403 - RNA, 64 nt, hsa
ccuagaccuuggaaccaguuuccugguagggaacugcugacaguuucaaugcugacaguuggag

SEQ ID NO: 238404 - RNA, 64 nt, hsa
caguuuccugguagggaacugcugacaguuucaaugcugacaguuggagccaaugccucauagu

SEQ ID NO: 238405 - RNA, 64 nt, hsa
aggccccacagggagcagagacugcuuuaaucccugcugacaucacggaaaagcaacagagccu

SEQ ID NO: 238406 - RNA, 64 nt, hsa
ugcucaauaaaacucagccaggagcauauggagaugcugacagccagguaaugggugagacugu

SEQ ID NO: 238407 - RNA, 64 nt, hsa
cagcagccauuucccuacccuguuuccuaacuuaugcugacaaguucuuccucuuccuaccgug

SEQ ID NO: 238408 - RNA, 64 nt, hsa
agagaggaccugguggggagggagggcuuuccugugcugacagcgcucccucaggagggccuug

SEQ ID NO: 238409 - RNA, 64 nt, hsa
acuuguuucuucaacuggaggaggucccugccuaugcugacauuccauuguagaaaaauggggc

SEQ ID NO: 238410 - RNA, 64 nt, hsa
uuuacuggaaucuauuggugcugcugcaugagucugcugacaaccugacugcacaaggacuggg

SEQ ID NO: 238411 - RNA, 64 nt, hsa
aucugcauaucuucagcuuacuaggugacccggaugcugacaucugcugcugcagaaaggaaga

SEQ ID NO: 238412 - RNA, 64 nt, hsa
uugcccugcugugacuccaaagaaaggagcuucuugcugacagugcccuguggagcaaggcugu

SEQ ID NO: 238413 - RNA, 64 nt, hsa
ccugcccggcugcggaaugaaccacaucuugcucugcugacagacacaggcccggcuccaggcu

SEQ ID NO: 238414 - RNA, 64 nt, hsa
aauaguucagguaacaggcagauacaggaaaagcugcugacaguguuguaugagguuugaggau

SEQ ID NO: 238415 - RNA, 64 nt, hsa
aucuacuucuuuuaaaguuagaagaaaauuaaccugcugacaggcaacauuuuuggggugcuuu

SEQ ID NO: 238416 - RNA, 64 nt, hsa
ccugggggcucacagcacagaaccuagaagcaccugcugacacucuucaacugauuuuuaaaug

SEQ ID NO: 238417 - RNA, 64 nt, hsa
auccaaugucuagaaucaggcccuuuggacauccugcugacacuugggccccuuaacaccuugg

SEQ ID NO: 238418 - RNA, 64 nt, hsa
uccugacucucagcccuacagaguagggaguugaugcugacaggaugaagauuuaggaauaaau

SEQ ID NO: 238419 - RNA, 64 nt, hsa
gcuaugaauccuuuuaaaaaaaucuuuggauaaaugcugacagauuuccaagaacuaccaagaa

SEQ ID NO: 238420 - RNA, 64 nt, hsa
gugaauuugaaaaaugauggccaguuuucagaagugcugacaaauucauauugguaugcaaaag

SEQ ID NO: 238421 - RNA, 60 nt, hsa
agagaaaaaaugguaaugugugccuuuauugaacuugaaugacagaacuugaaauuuuua

SEQ ID NO: 238422 - RNA, 60 nt, hsa
aaugugugccuuuauugaacuugaaugacagaacuugaaauuuuuaacacauccuucuug

SEQ ID NO: 238423 - RNA, 60 nt, hsa
agcuguuguuacauguaauauuuuaguucagaacuugaccugaaggaagggaagaaaagu

SEQ ID NO: 238424 - RNA, 60 nt, hsa
aggucgucagcagugugguauuaucuaugagaacuugagcgacagaguauuucuugauga

SEQ ID NO: 238425 - RNA, 60 nt, hsa
cuuugccacugauaggaaugacuuccggaggaacuugauacuaaauuugggacucuuugc

SEQ ID NO: 238426 - RNA, 60 nt, hsa
acucuuugcugcgggaguuuggcuggccaggaacuugagugacauugaccucauggcacc

SEQ ID NO: 238427 - RNA, 60 nt, hsa
aggauagagacuggaacacuagacaagccagaacuugacccugagcugaccagccgugag

SEQ ID NO: 238428 - RNA, 60 nt, hsa
gaaggcuuguugugcuuuuaguauuuuagugaacuugaaauauccugcuugaugggauuc

SEQ ID NO: 238429 - RNA, 60 nt, hsa
ugcugaaauuaugauaguuaagauuccuaagaacuugacaaugcuccccuggcuugcagg

SEQ ID NO: 238430 - RNA, 60 nt, hsa
aguugguagguggacaccacuuucauaagugaacuugagcucacuacucaauugugcagc

SEQ ID NO: 238431 - RNA, 60 nt, hsa
ugcuuuuuguauuuggagagagugacuauugaacuugaaaccuuuuauuccgggcgucuu

SEQ ID NO: 238432 - RNA, 60 nt, hsa
aaggggagguuggggggcuccuucccuucagaacuugaaguuucucccacugccuccucu

SEQ ID NO: 238433 - RNA, 60 nt, hsa
ucaaagaggacauaugauucuuuccaagaugaacuugaagauuacauaaaagugcagaaa

SEQ ID NO: 238434 - RNA, 60 nt, hsa
ucaaagaagacauaugacucuuuccaagaugaacuugaagauuacaucaaaguacagaaa

SEQ ID NO: 238435 - RNA, 64 nt, hsa
cgggaggugaggggcgccucugcccagcugccccuacugggaagugaggagccccucugccccg

SEQ ID NO: 238436 - RNA, 64 nt, hsa
cgggaggcgaggggcgccucugcccggcugccccuacugggaagugaggagccccucugcccgg

SEQ ID NO: 238437 - RNA, 64 nt, hsa
cgggagguuaggggcgccucugcccggccgccccuacugggaagugaggagccccucugcccgg

SEQ ID NO: 238438 - RNA, 64 nt, hsa
auuguaucaugguuucaguauguuauucauguauuacugggagaugcuaccaagaaaccaaccc

SEQ ID NO: 238439 - RNA, 64 nt, hsa
ugccuuuucuuauaugauuuuguuuacaaaauuuuacugggacuuuuaaaucuagcuauagagu

SEQ ID NO: 238440 - RNA, 64 nt, hsa
aaugggagcacaguacugggaaaugggagcauaguacugggaaaccccagaccuggauucugag

SEQ ID NO: 238441 - RNA, 64 nt, hsa
aaugggagcauaguacugggaaaugggagcacaguacugggaaaugggagcauaguacugggaa

SEQ ID NO: 238442 - RNA, 64 nt, hsa
ggggaguucacaguacucggaaaugggagcauaguacugggaaaugggagcacaguacugggaa

SEQ ID NO: 238443 - RNA, 64 nt, hsa
ugggagcacaguacugggaaaugggagcccacaguacugggaaaggggaguucacaguacucgg

SEQ ID NO: 238444 - RNA, 64 nt, hsa
ugggagcacacaguacugggaaaugggagcacaguacugggaaaugggagcccacaguacuggg

SEQ ID NO: 238445 - RNA, 64 nt, hsa
ugggcauacaguacugagaaaugggagcacacaguacugggaaaugggagcacaguacugggaa

SEQ ID NO: 238446 - RNA, 64 nt, hsa
aaugggaguacacuacugagaaaugggagcacaguacugggaaaugggcauacaguacugagaa

SEQ ID NO: 238447 - RNA, 64 nt, hsa
aaugggagcacaguauugggaaaugggagcacaguacugggaagugggagcacaguacugagaa

SEQ ID NO: 238448 - RNA, 64 nt, hsa
aaugggagcacaguacugggaaaugggagcacaguacugggaaaugggggcucacagcacugca

SEQ ID NO: 238449 - RNA, 64 nt, hsa
aaugggagcacaguacuaggaaaugggagcacaguacugggaaaugggagcacaguacugggaa

SEQ ID NO: 238450 - RNA, 64 nt, hsa
ggccgggcauguuggcucacaccugugagcacaguacugggaaaugggagcacaguacuaggaa

SEQ ID NO: 238451 - RNA, 64 nt, hsa
aucaggacuauaccucauuuacagucagaaagcuuacugggaugucaggaaaugauacaggguu

SEQ ID NO: 238452 - RNA, 64 nt, hsa
gaccucgugauccacccuccuccaccucccaaaguacugggauuacaggcaugagccacugcac

SEQ ID NO: 238453 - RNA, 64 nt, hsa
ccucaggcaaucugcccgccugggucuccuaaaguacugggauuacaggcgugagccaccucgc

SEQ ID NO: 238454 - RNA, 64 nt, hsa
aggccuugcggcuccucagggacucagguggcccuacugggagaggggccucaaaugcaccaug

SEQ ID NO: 238455 - RNA, 64 nt, hsa
uuaucaaaaaguacaauaauaaauccucagguaguacugggaauggaaggcuuugccaugggcc

SEQ ID NO: 238456 - RNA, 64 nt, hsa
aaggcuuugccaugggccugcugcgucagaccaguacugggaaggaggacgguuguaagcaguu

SEQ ID NO: 238457 - RNA, 64 nt, hsa
uaauuuacaaaggauaaucuuucuuuucauugacaacaccuacacccaccuguuuuccaguguu

SEQ ID NO: 238458 - RNA, 64 nt, hsa
cuaaaagccugcuucagggcugggcgcgguggcuaacaccuauaauucccagcacuuugggagg

SEQ ID NO: 238459 - RNA, 64 nt, hsa
ggauuacaggcaugagccaccacgcuuggcuaagaacaccuaaauuuuuauguuucuuggcuca

SEQ ID NO: 238460 - RNA, 64 nt, hsa
aaaucaaaucuauucagguuucuucacuguugagaacaccuaaauguuuuuauuuuugagaagu

SEQ ID NO: 238461 - RNA, 64 nt, hsa
uuugaauggcuauggcguuagguugaaauggccaggcacaaauuuagucuggucauuuuguuua

SEQ ID NO: 238462 - RNA, 64 nt, hsa
ccaugaugugaaacugacaauccuguggccacauggcacaaaacaccaaauauugguuaugaug

SEQ ID NO: 238463 - RNA, 64 nt, hsa
ucuauauauuucucucacccuauuuugagacagaggcacaaagacucagcaauuuuuuucccuc

SEQ ID NO: 238464 - RNA, 64 nt, hsa
aaugaaacuauuuucuucuucuccaugaagccagggcacaaagaauuugacaguacaagucaaa

SEQ ID NO: 238465 - RNA, 64 nt, hsa
cucacccaggcucugcucaggcugggaggcagagggcacaaaccuuauaauuuuuuaaaugaaa

SEQ ID NO: 238466 - RNA, 64 nt, hsa
caaacaaggagucccuccagccugaauaacacguggcacaaaugggcccggccuuuggcagagg

SEQ ID NO: 238467 - RNA, 64 nt, hsa
ucaugugagucugggauauucuuuagcuuaccugggcacaaacagaauuuuccauuuauuaagc

SEQ ID NO: 238468 - RNA, 64 nt, hsa
cucugccaguuacuugggcuucaacagccaagcuggcacaaaagacagcuggcggaggcugcuc

SEQ ID NO: 238469 - RNA, 59 nt, hsa
auuagaaagcaaagauuauuuucauuuauccagaugaccauuuucugccacagguaaca

SEQ ID NO: 238470 - RNA, 59 nt, hsa
cuuugcagucaguucaucccuacccuggcccagaugaucacugaucuugucauuauaga

SEQ ID NO: 238471 - RNA, 59 nt, hsa
cguaucugagaguuccagauucccagcuuccagaugauccuugcacagacaaccuaccu

SEQ ID NO: 238472 - RNA, 59 nt, hsa
ugacacaggagggcugggcuccacuucauccagaugaaggaaaggaagaccucaagaaa

SEQ ID NO: 238473 - RNA, 59 nt, hsa
gaugagaguacaccccaacagcacccucuccagaugagaguacaccccaacagcacccu

SEQ ID NO: 238474 - RNA, 59 nt, hsa; identical to SEQ ID NO: 238473

SEQ ID NO: 238475 - RNA, 59 nt, hsa
agaugggagugcccccaacagcacccucuccagaugagaguacaccccaacagcacccu

SEQ ID NO: 238476 - RNA, 64 nt, hsa
cucgaguggugcuguacuuguuaugagugaggcagcagcacaguguguggcauuuacaugguac

SEQ ID NO: 238477 - RNA, 64 nt, hsa
auuuuacucuugccugugaaccucaugcaugaaagcagcacauuaaauuguaaaaauacaaaca

SEQ ID NO: 238478 - RNA, 53 nt, hsa
uaucaaacagcaagcacugacaagcagcacauucucaagagcacacagguaag

SEQ ID NO: 238479 - RNA, 64 nt, hsa
gucuuuuguguuugauuuuguuugauuucccucugcagcacagcgucucuguaaagguuuuuau

SEQ ID NO: 238480 - RNA, 64 nt, hsa
aucuuccugcaagucaucugcucacacacaguuggcagcacauagcguuuccuucuuucagaaa

SEQ ID NO: 238481 - RNA, 64 nt, hsa
caggcucagcccuucccacccugccccaugcccagcagcacaacacggagugagacaggaugcc

SEQ ID NO: 238482 - RNA, 64 nt, hsa
ggccaggagcagcaggucaugugcacaugccguugcagcacaagcuuaugcuucccguagccgu

SEQ ID NO: 238483 - RNA, 64 nt, hsa
cauggaugucccaggaggcagcucuccccacacagcagcacagccaucacaggauuccuugugu

SEQ ID NO: 238484 - RNA, 64 nt, hsa
ggcugcaugagcugcaagugugugcucuccugacgcagcacaagcucaggacauggaggugccg

SEQ ID NO: 238485 - RNA, 64 nt, hsa
aggaugccuucuacacguuggugcgugagauccggcagcacaagcugcggaagcugaacccucc

SEQ ID NO: 238486 - RNA, 64 nt, hsa
uuucauaaaacuaaccgaaguuuuguuuacugaugcagcacaagagauguaaaaaaaaaaaaaa

SEQ ID NO: 238487 - RNA, 64 nt, hsa
cccaaacaaaccaaaauuuaaaugaucagaauuggcagcacaaagaaaacgcccucuccugacu

SEQ ID NO: 238488 - RNA, 64 nt, hsa
ugugguucccauguucucuaacagggccagcugagcagcacaggccaggaggccacaguguaag

SEQ ID NO: 238489 - RNA, 64 nt, hsa
aacgcuccuucugaagaaauggggcccuguagcugcagcacaggggaagggcccggcacccuuu

SEQ ID NO: 238490 - RNA, 61 nt, hsa
auuugagcauuugaagauucaaaguugcgaaagagcacaaaccauauuagguaaaauauug

SEQ ID NO: 238491 - RNA, 61 nt, hsa
caauguuuucuuucugguagcgcauaauaacagagcacaagcaucuuuuagauuugagcau

SEQ ID NO: 238492 - RNA, 61 nt, hsa
aauugaaggaguggcaaacuuacuuguauugagagcacacgcaauuccuacuggugaaauu

SEQ ID NO: 238493 - RNA, 56 nt, hsa
acuccuguccagcagccugacaugacagagcacagcugcccaaauacaaaguucuu

SEQ ID NO: 238494 - RNA, 61 nt, hsa
uggauuuccgcaccugccugucuccucucccagagcacaguauuugggagacuuugacuau

SEQ ID NO: 238495 - RNA, 61 nt, hsa
ugcccucuccuugaccuugagaugaaggucaagagcacagggaccaggccuugguuaggcu

SEQ ID NO: 238496 - RNA, 61 nt, hsa
ugcacaacuuugacaucuggucuugcuccauagagcacaacucaagauagaccaugagaca

SEQ ID NO: 238497 - RNA, 61 nt, hsa
auggugccgccuuccugaauuggcaguggucagagcacaccugaacccuauccugggcugg

SEQ ID NO: 238498 - RNA, 61 nt, hsa
uagggggguguccccccagagacaaagcugcagagcacauuccaugccagacgcucuggcc

SEQ ID NO: 238499 - RNA, 61 nt, hsa
ccacacacggcgcaggcugcccgccuccuggagagcacacuucagcugaaacaguaaagcc

SEQ ID NO: 238500 - RNA, 61 nt, hsa
ucagagcagggcgauugggacaucaccagccagagcacaggaagccacccugccugcuggg

SEQ ID NO: 238501 - RNA, 61 nt, hsa
gacaacuguuccugcuucuacuaaaaaaaaaagagcacaaaagaaaaacuaaauuauugaa

SEQ ID NO: 238502 - RNA, 61 nt, hsa
caauuuuuuguauuugcuuuuucucccuuuaagagcacauucuucuguaaggagaaaggca

SEQ ID NO: 238503 - RNA, 61 nt, hsa
guggucuucugaaaauggaacaccauucuucagagcacacgucuagcccucagcaagacag

SEQ ID NO: 238504 - RNA, 64 nt, hsa; identical to SEQ ID NO: 182536

SEQ ID NO: 238505 - RNA, 64 nt, hsa; identical to SEQ ID NO: 182537

SEQ ID NO: 238506 - RNA, 64 nt, hsa; identical to SEQ ID NO: 182538

SEQ ID NO: 238507 - RNA, 64 nt, hsa; identical to SEQ ID NO: 182539

SEQ ID NO: 238508 - RNA, 64 nt, hsa; identical to SEQ ID NO: 182540

SEQ ID NO: 238509 - RNA, 64 nt, hsa; identical to SEQ ID NO: 182541

SEQ ID NO: 238510 - RNA, 64 nt, hsa; identical to SEQ ID NO: 182542

SEQ ID NO: 238511 - RNA, 64 nt, hsa; identical to SEQ ID NO: 182543

SEQ ID NO: 238512 - RNA, 64 nt, hsa; identical to SEQ ID NO: 182544

SEQ ID NO: 238513 - RNA, 64 nt, hsa; identical to SEQ ID NO: 182545

SEQ ID NO: 238514 - RNA, 64 nt, hsa; identical to SEQ ID NO: 182546

SEQ ID NO: 238515 - RNA, 64 nt, hsa; identical to SEQ ID NO: 182547

SEQ ID NO: 238516 - RNA, 64 nt, hsa; identical to SEQ ID NO: 182548

SEQ ID NO: 238517 - RNA, 64 nt, hsa; identical to SEQ ID NO: 182549

SEQ ID NO: 238518 - RNA, 64 nt, hsa; identical to SEQ ID NO: 182550

SEQ ID NO: 238519 - RNA, 64 nt, hsa; identical to SEQ ID NO: 182551

SEQ ID NO: 238520 - RNA, 64 nt, hsa; identical to SEQ ID NO: 182552

SEQ ID NO: 238521 - RNA, 64 nt, hsa; identical to SEQ ID NO: 182553

SEQ ID NO: 238522 - RNA, 64 nt, hsa; identical to SEQ ID NO: 182554

SEQ ID NO: 238523 - RNA, 64 nt, hsa; identical to SEQ ID NO: 182555

SEQ ID NO: 238524 - RNA, 64 nt, hsa; identical to SEQ ID NO: 182556

SEQ ID NO: 238525 - RNA, 64 nt, hsa; identical to SEQ ID NO: 182557

SEQ ID NO: 238526 - RNA, 64 nt, hsa; identical to SEQ ID NO: 182558

SEQ ID NO: 238527 - RNA, 64 nt, hsa; identical to SEQ ID NO: 182559

SEQ ID NO: 238528 - RNA, 64 nt, hsa; identical to SEQ ID NO: 182560

SEQ ID NO: 238529 - RNA, 64 nt, hsa; identical to SEQ ID NO: 182561

SEQ ID NO: 238530 - RNA, 64 nt, hsa; identical to SEQ ID NO: 182562

SEQ ID NO: 238531 - RNA, 64 nt, hsa; identical to SEQ ID NO: 182563

SEQ ID NO: 238532 - RNA, 64 nt, hsa; identical to SEQ ID NO: 182564

SEQ ID NO: 238533 - RNA, 64 nt, hsa; identical to SEQ ID NO: 182565

SEQ ID NO: 238534 - RNA, 64 nt, hsa; identical to SEQ ID NO: 182566

SEQ ID NO: 238535 - RNA, 64 nt, hsa; identical to SEQ ID NO: 182567

SEQ ID NO: 238536 - RNA, 64 nt, hsa; identical to SEQ ID NO: 182568

SEQ ID NO: 238537 - RNA, 64 nt, hsa; identical to SEQ ID NO: 182569

SEQ ID NO: 238538 - RNA, 64 nt, hsa; identical to SEQ ID NO: 182570

SEQ ID NO: 238539 - RNA, 64 nt, hsa; identical to SEQ ID NO: 182571

SEQ ID NO: 238540 - RNA, 64 nt, hsa; identical to SEQ ID NO: 182572

SEQ ID NO: 238541 - RNA, 64 nt, hsa; identical to SEQ ID NO: 182573

SEQ ID NO: 238542 - RNA, 64 nt, hsa; identical to SEQ ID NO: 182574

SEQ ID NO: 238543 - RNA, 64 nt, hsa; identical to SEQ ID NO: 182575

SEQ ID NO: 238544 - RNA, 64 nt, hsa; identical to SEQ ID NO: 182576

SEQ ID NO: 238545 - RNA, 64 nt, hsa; identical to SEQ ID NO: 182577

SEQ ID NO: 238546 - RNA, 64 nt, hsa; identical to SEQ ID NO: 182578

SEQ ID NO: 238547 - RNA, 64 nt, hsa; identical to SEQ ID NO: 182579

SEQ ID NO: 238548 - RNA, 64 nt, hsa; identical to SEQ ID NO: 182580

SEQ ID NO: 238549 - RNA, 64 nt, hsa; identical to SEQ ID NO: 182581

SEQ ID NO: 238550 - RNA, 64 nt, hsa; identical to SEQ ID NO: 182582

SEQ ID NO: 238551 - RNA, 64 nt, hsa; identical to SEQ ID NO: 182579

SEQ ID NO: 238552 - RNA, 64 nt, hsa; identical to SEQ ID NO: 182584

SEQ ID NO: 238553 - RNA, 64 nt, hsa
gcugcaguaaaguuacgugaggccugucucucggggccuggaaguggcagccaucaguugcucu

SEQ ID NO: 238554 - RNA, 64 nt, hsa
augcagaaugcagcggagcuaggacccccuccacggccuggaccucggcugcaguaaaguuacg

SEQ ID NO: 238555 - RNA, 64 nt, hsa
uuuguuagcucaaauuuacagaugaggaaauggaggccuggagaguucaaguagcucacucuaa

SEQ ID NO: 238556 - RNA, 64 nt, hsa
ccacucuuccccgccucacagggcuccuccgguuggccuggauccaaagcgaucuccuuguuuc

SEQ ID NO: 238557 - RNA, 61 nt, hsa
agcgcaggagcuccgugugacugccccgaggggccuggagcaccugggggcgcgggcgggg

SEQ ID NO: 238558 - RNA, 64 nt, hsa
guucucacucccauuuuacagaugagaauacugaggccuggacaggugaagugaccagagagca

SEQ ID NO: 238559 - RNA, 64 nt, hsa
ggacaucucucuggcuucugaagagccugaagcuggccuggaccauuccugucccuuuguuacc

SEQ ID NO: 238560 - RNA, 64 nt, hsa
gggugacgccacccacagagauuuaaugagcgugggccuggaccuuccccagaugcugccaggc

SEQ ID NO: 238561 - RNA, 64 nt, hsa
gugagcauggaggggcagggccaucccuggcuggggccuggagcuggcccuuccucuacuuuuc

SEQ ID NO: 238562 - RNA, 64 nt, hsa
gggccugguucccaggcagcaggugggaacccugggccuggaugugaggggcggucaggaaggg

SEQ ID NO: 238563 - RNA, 64 nt, hsa
acuagcugccgagcugcacccgugcacccgcuggggccuggagucagggcccacuccaggaggg

SEQ ID NO: 238564 - RNA, 64 nt, hsa
aucuggacuucucagccuguuuggcuagaacucaggccuggagucugggucugcccccuccccg

SEQ ID NO: 238565 - RNA, 64 nt, hsa
cgcaagcgccuggguggaggcaggguagggcaggggccuggagacgacaugguguugucugugg

SEQ ID NO: 238566 - RNA, 64 nt, hsa
agccgacaccugaccuagcacacacugacacaggggccuggacaagcccgcccucucugguccu

SEQ ID NO: 238567 - RNA, 64 nt, hsa
gccuccuccagcagagacccucggaccccugcagggccuggacuuggggugaacagggcuucag

SEQ ID NO: 238568 - RNA, 64 nt, hsa
cccccaggcaggagcacccucacuccaagggcuuggccuggaaaggcaggcucaccugggacuc

SEQ ID NO: 238569 - RNA, 64 nt, hsa
agcagugccacggugacccaagaggcaggguuggggccuggacaggguuuccucugcugagacu

SEQ ID NO: 238570 - RNA, 64 nt, hsa
auaaccaaaauguguaucauucuacaaaaaaauaggccuggacuauuuaaggagugagugucac

SEQ ID NO: 238571 - RNA, 64 nt, hsa
aaguucauuuauugggcaggcaaaguccucugcaggccuggaaacccuccgagacaauuacuug

SEQ ID NO: 238572 - RNA, 64 nt, hsa
gggacagacuguugugggaacgucccacuguccuggccuggagcuaggccuugcuguuccucuu

SEQ ID NO: 238573 - RNA, 64 nt, hsa
cucacucugauucuccugugccacaggaaaagagggccuggaaagcgcagugcaugcugggugc

SEQ ID NO: 238574 - RNA, 64 nt, hsa
aaccgcugccuuuaucuugaagucagccacacugggccuggagcccugggcggaguccccgggg

SEQ ID NO: 238575 - RNA, 64 nt, hsa
gcaaccagaaagggaugaacuuggcccucuugcgggccuggacaaggucucuuccuuacccuuu

SEQ ID NO: 238576 - RNA, 64 nt, hsa
gucgacgugaguuccugggagucuccagagauggggccuggaggccuggaggaaggggccaggc

SEQ ID NO: 238577 - RNA, 64 nt, hsa
gaguuccugggagucuccagagauggggccuggaggccuggaggaaggggccaggccucacauu

SEQ ID NO: 238578 - RNA, 64 nt, hsa
guguggccagcugucucucugggaugagucaggaggccuggaggcuuggggagagguguggaga

SEQ ID NO: 238579 - RNA, 64 nt, hsa
cugcugagcugggucucuggggcuucccacuccaggccuggaucccuuccuucuauaaauaguc

SEQ ID NO: 238580 - RNA, 64 nt, hsa
uggguccccucccugguucaucccagagccuuugggccuggaguccgccuuguccuuuuucucu

SEQ ID NO: 238581 - RNA, 64 nt, hsa
uugcuuuuggcaaaagguacuucaaacaagggagggccuggacugagggggaccaggucuucuu

SEQ ID NO: 238582 - RNA, 64 nt, hsa
ggccccggagcccagccagcucugccucucucagggccuggaguccugggggagcucagccagc

SEQ ID NO: 238583 - RNA, 64 nt, hsa
ccugggggagcucagccagcucugccuuucucagggccuggaguccuggaugaauccugcaggu

SEQ ID NO: 238584 - RNA, 64 nt, hsa
gguggccuguugguuucccucagagggggcagguggccuggagagagaggggcucaggaacugg

SEQ ID NO: 238585 - RNA, 64 nt, hsa
acugggagccucguggguggggcagaugcuccgcggccuggaguggcucugccggggcauuggu

SEQ ID NO: 238586 - RNA, 64 nt, hsa
agggagccgggaaucggggccugcugcuccugcuggccuggaagacucuguggggucagcacug

SEQ ID NO: 238587 - RNA, 64 nt, hsa
ccacaagcugcaucaggcucucugggagaggaggggccuggagggccaggagucccagacucac

SEQ ID NO: 238588 - RNA, 64 nt, hsa
ucuggccuucuaggaucuguccaagacacucucaggccuggaggcagggcauagaaucaguucu

SEQ ID NO: 238589 - RNA, 64 nt, hsa
gccauccagccuuugccuuugagcccugggguaaggccuggaccucaagauuccuggaaagaag

SEQ ID NO: 238590 - RNA, 64 nt, hsa
ccuuucugcacuccgugggcccugggugcgcugaggccuggaggcgucuacacuggcuccacau

SEQ ID NO: 238591 - RNA, 64 nt, hsa
uggggucagagaucacugagcugccccucaagggggccuggaacccgggugcuggggucaugcu

SEQ ID NO: 238592 - RNA, 64 nt, hsa
agccguccucugagcagggcccaaggcagccaggggccuggaggggccagaggagggugggguc

SEQ ID NO: 238593 - RNA, 64 nt, hsa
auucuggcccccggcuccccacacagcugggacuggccuggauggcuguccugggagccccugc

SEQ ID NO: 238594 - RNA, 51 nt, hsa
aggaucuaucugaggccuagaggccuggagcuuggggugaggaagagggag

SEQ ID NO: 238595 - RNA, 64 nt, hsa
caaagaacagagugaugggaaagugacaugagaaggccuggaggcugauucugauauagacuca

SEQ ID NO: 238596 - RNA, 64 nt, hsa
ggcugagcuccuuccucugcaucauucugggcuuggccuggacagcacccgccagugagagcug

SEQ ID NO: 238597 - RNA, 64 nt, hsa
ggccuuggguccccauccucuggaaccagggggaggccuggaaggaguucacuguagacccguc

SEQ ID NO: 238598 - RNA, 64 nt, hsa
gagccagcaccacacguccauccugggacagacgggccuggacuucacggcaagaccccccucu

SEQ ID NO: 238599 - RNA, 64 nt, hsa
caccccagaacaagccgacacacagggagacgggggccuggagccagcccugagccagaggcag

SEQ ID NO: 238600 - RNA, 64 nt, hsa
gcgaggggugauggcaacgguggccuggauucguggccuggauucugcugccacgugccauagu

SEQ ID NO: 238601 - RNA, 64 nt, hsa
ucaaggcagccaggcgaggggugauggcaacgguggccuggauucguggccuggauucugcugc

SEQ ID NO: 238602 - RNA, 64 nt, hsa
ccucuaucugacucucgcugugggacagggaccgggccuggaaagggggugaagggaagugucu

SEQ ID NO: 238603 - RNA, 64 nt, hsa
agggagaugggauugggcaccucccccgugcuggggccuggauuuuuguaaauaaauuucccaa

SEQ ID NO: 238604 - RNA, 64 nt, hsa
ucuuaccugggcuucucugugugcauuugcgucuggccuggaguaagcagguccgaccccuccu

SEQ ID NO: 238605 - RNA, 64 nt, hsa
uagagggggagggacugucuggguucaggggcauggccuggagggcuggugggcagcacuguca

SEQ ID NO: 238606 - RNA, 64 nt, hsa
agcggugugaagcauccgguccuuugaacagaagggccuggaaggccccuggggcugagaaagg

SEQ ID NO: 238607 - RNA, 64 nt, hsa
aaggccccuggggcugagaaaggguccgcccgguggccuggaggcaggcgccgggagcgcagua

SEQ ID NO: 238608 - RNA, 64 nt, hsa
gugagguccuggugccuaucugccuggaggcaaaggccuggacagcuugacuuguggggcagga

SEQ ID NO: 238609 - RNA, 64 nt, hsa
gagggccaccuccacacccacccccucuggagaaggccuggaagagcugagaccuugcuuugag

SEQ ID NO: 238610 - RNA, 64 nt, hsa
ucuauacagcggaaccacaagagagacugaggaaggccuggaggcaggggcagaggugacgaca

SEQ ID NO: 238611 - RNA, 64 nt, hsa
ugcuuccuagcacauuccauucuuuguggcccagggccuggaccagaccauugugauaccugac

SEQ ID NO: 238612 - RNA, 64 nt, hsa
gagugucauguuagcugagucaccauuuggcuucggccuggaaauagugugauuagaacacuga

SEQ ID NO: 238613 - RNA, 64 nt, hsa
aaggccaggggaaacugggggggccucagggacaggccuggaaaggccacgauggcugcugaau

SEQ ID NO: 238614 - RNA, 64 nt, hsa
ccucgggagcagaagcccggccuggacaccccucggccuggacaccccucgaaggagagggcgc

SEQ ID NO: 238615 - RNA, 64 nt, hsa
gcccugccuccacccaccucgggagcagaagcccggccuggacaccccucggccuggacacccc

SEQ ID NO: 238616 - RNA, 64 nt, hsa
aauucucuuguccaaauaguggauugggcagacuggccuggaggaaaugcuagaacagagggaa

SEQ ID NO: 238617 - RNA, 64 nt, hsa
aggucugugaaauaauccaggagaacaaugaugaggccuggauuggauucgguaaaaagagggg

SEQ ID NO: 238618 - RNA, 64 nt, hsa
acuccagccuggaagacaccaugacacacagugaggccuggauggggaaagaguccugcuguug

SEQ ID NO: 238619 - RNA, 64 nt, hsa
uauuccagcuuuauucacacaaaucaugucuguuggccuggaaauuggaaaaccaguuaaacca

SEQ ID NO: 238620 - RNA, 64 nt, hsa
gccauggucguggcuguggccaugggagaggaggggccuggaguugccgaggaagucacagaaa

SEQ ID NO: 238621 - RNA, 64 nt, hsa
gccgaggaagucacagaaaaugaccaacugauggggccuggagugcaggaggggcagcuccucu

SEQ ID NO: 238622 - RNA, 64 nt, hsa
ucggccccgucuccugaggguccugcuggugaccggccuggaccuuggcccuacagcccuggag

SEQ ID NO: 238623 - RNA, 64 nt, hsa
aaccccgucugcuccucccucccgcagagacuggggccuggacuggacaugagagccccuuggu

SEQ ID NO: 238624 - RNA, 64 nt, hsa
aaggucccaguccaucuccuggaggcggacagauggccuggaaaccucuggcuaaucgggccau

SEQ ID NO: 238625 - RNA, 64 nt, hsa
ccaagagacagcgacccaaagccgaaggacagguggccuggaaagaucccgcccaggucuggga

SEQ ID NO: 238626 - RNA, 64 nt, hsa
acagagaggaaacaagcuucccacgggggaacaaggccuggaugaggauguugauggggucugu

SEQ ID NO: 238627 - RNA, 64 nt, hsa
ugaaagaaaacgccacuggccauguggaauccauggccuggaccaccccagaucccacaucccc

SEQ ID NO: 238628 - RNA, 64 nt, hsa
gcccggcacggccucaggcccccgagggacagucggccuggaccggaccucuccuuucgccccc

SEQ ID NO: 238629 - RNA, 64 nt, hsa
cccagcuccugcugcugucccagucuugggcuggggccuggaaagaggaagaggcugccugggg

SEQ ID NO: 238630 - RNA, 64 nt, hsa
gucaacaugugugaucuuugugucuccuuuuugccaagcacauucugauuuucuuguuggaaca

SEQ ID NO: 238631 - RNA, 64 nt, hsa
cuagaggggcuaagcuugacugcccuuagccaggcaagcacaguaauguguguuuuguucagca

SEQ ID NO: 238632 - RNA, 64 nt, hsa
ggugcaggcaccuggccaugcuggcugggcggcccaagcacagcccugacuaggaugacagcag

SEQ ID NO: 238633 - RNA, 64 nt, hsa
agcagucugccuccccuaugggacucccuucuaccaagcacaugagcucucuaacagggugggg

SEQ ID NO: 238634 - RNA, 64 nt, hsa
aucuugacaucuuacauuccaauacauuaucaagcaagcacaaguaugcugguaguagccucuu

SEQ ID NO: 238635 - RNA, 64 nt, hsa
ggcacaggcgaagccauuggaagcacuucaggaacaagcacacagcugugggacuugaacaugc

SEQ ID NO: 238636 - RNA, 64 nt, hsa
aaaauuuuaauuucuacaaaauaacauucugaaucaagcacacuguauguucaguagguugaac

SEQ ID NO: 238637 - RNA, 64 nt, hsa
cugcuacccacugccagaugcugcaagcgagguccaagcacaucuugucaacaugcauugccau

SEQ ID NO: 238638 - RNA, 64 nt, hsa
guugacauuggccaacggggaacgcauccggcuccaagcacacugugcccugcucuuugaggca

SEQ ID NO: 238639 - RNA, 64 nt, hsa
uggagaaugucagaucaaguuagaaagucaaauacaagcacauccugugaacggugaugugugu

SEQ ID NO: 238640 - RNA, 64 nt, hsa
ggcgguggggggugguggggggagcgggugcucacaagcacagagcugccuguugugaaugucc

SEQ ID NO: 238641 - RNA, 64 nt, hsa
uggaauaaaccuguuuuccaggugucucuucucccaagcacaagaaguccuggagucuuuggaa

SEQ ID NO: 238642 - RNA, 64 nt, hsa
ccuucugagccauuugacguagaggaaaagccugcaagcacauuuuguggaaagaggaguuggu

SEQ ID NO: 238643 - RNA, 64 nt, hsa
gugcaaguauucuuaacucuuuacgccuaaugaacaagcacaguuuuucaauggugaagaaaaa

SEQ ID NO: 238644 - RNA, 64 nt, hsa
auugagauaaauaagaugcuucuauccauuuauucaagcacauauuggucaccuacugugugcc

SEQ ID NO: 238645 - RNA, 64 nt, hsa
ccaagagggaggguagcucuuccgccaccaggggcaagcacagguccugguggccccacgccac

SEQ ID NO: 238646 - RNA, 64 nt, hsa
gugugggaaaacuuacuugucuccuuuagguuuucaagcacaugaaaguacucacacuggagau

SEQ ID NO: 238647 - RNA, 64 nt, hsa
auguggaaaaaccuacauaucuucuguagguuuucaagcacaugaaagaacucacacuggagaa

SEQ ID NO: 238648 - RNA, 64 nt, hsa
gcuggacccugcaggguggcucccuccuccccaucaagcacaagagagggcccaggaaaaaagg

SEQ ID NO: 238649 - RNA, 64 nt, hsa
gucugggguagggagacagcgacuuguccaaggucaagcacagagggagagguucaggagucag

SEQ ID NO: 238650 - RNA, 64 nt, hsa
uuccacauauccacaaacacagaacgacuuuagacaagcacauguuacaccuguguugccacaa

SEQ ID NO: 238651 - RNA, 64 nt, hsa
ccucuauuaagaucagugucuucuuuuucuacugcaagcacauguaacuagauuuagugccugc

SEQ ID NO: 238652 - RNA, 64 nt, hsa
augccugaaaucccacuacuuugggaggcugaggcuggagaauugcuugaggcuagugagcugu

SEQ ID NO: 238653 - RNA, 64 nt, hsa
caguuuauacucuuaauuuaauuuucuuucugagcuggagaacuggcuuugcacuuugguuaca

SEQ ID NO: 238654 - RNA, 64 nt, hsa
aaacaauaaagacuuuaccugucuaauggaaaaccuggagaagucgucaggaaccagacuacag

SEQ ID NO: 238655 - RNA, 64 nt, hsa
ggagaagucgucaggaaccagacuacaguggacccuggagaaccuugaagaacauuuuuccuuu

SEQ ID NO: 238656 - RNA, 64 nt, hsa
aacuagaauauccucagcagguggccuggccacucuggagaaagaaacccaaggaaagugagca

SEQ ID NO: 238657 - RNA, 64 nt, hsa
accucggcaagaucaccagcacugaggggcccagcuggagaaugauucugcuacaaaaggagac

SEQ ID NO: 238658 - RNA, 64 nt, hsa
ucagggcugggccaugugguugauuuuucuaaagcuggagaaaggaagaauugugccuugcaua

SEQ ID NO: 238659 - RNA, 64 nt, hsa
ggccaggauagccaagcccugggugagcgagaggcuggagaacacaggagcucacccagggcug

SEQ ID NO: 238660 - RNA, 64 nt, hsa
ggccacgaugaaacagauuucaacugauaaagagcuggagaacuccauguacuuuggaaucucc

SEQ ID NO: 238661 - RNA, 64 nt, hsa
gaucaagcucaucgacuuuggucuggccaggaggcuggagaaugcggggucucugaagguccuc

SEQ ID NO: 238662 - RNA, 64 nt, hsa
gauucuggucaacugguggagauuggcugacacccuggagaagccgaaaccagagagccuuuug

SEQ ID NO: 238663 - RNA, 64 nt, hsa
uguggaugggccgaccuggcugggacucgugaaucuggagaagagcuggagaauggauaguauu

SEQ ID NO: 238664 - RNA, 64 nt, hsa
cgaccuggcugggacucgugaaucuggagaagagcuggagaauggauaguauugucuguauuug

SEQ ID NO: 238665 - RNA, 64 nt, hsa
caaagcaaaagcuagagaagcaaguggagaaaugcuggagaaagcugcacccuacaggcaacca

SEQ ID NO: 238666 - RNA, 64 nt, hsa
caaggaaaggcaggaaugaggguuucagaauucacuggagaaggugugguugcagcccacugga

SEQ ID NO: 238667 - RNA, 64 nt, hsa
ccaguuaguuggaguuuuuaaaggcucuguuugccuggagaagcaaggagguuagaauguaauu

SEQ ID NO: 238668 - RNA, 64 nt, hsa
gaaauuucuggcauaagcaggggaagucuugugucuggagaauagucucauaccuugcagucug

SEQ ID NO: 238669 - RNA, 64 nt, hsa
aaagaaagcauuguuuuaauugagaggggcagggcuggagaaggagcaaguuguggggagccag

SEQ ID NO: 238670 - RNA, 64 nt, hsa
gcgccuguagucccagcagcuugggaggcugaggcuggagaauggugugaacccaggaggcgga

SEQ ID NO: 238671 - RNA, 64 nt, hsa
gacgccugaagucacagcuccuuccaagguuuuucuggagaagacagcaggagccucucaguuc

SEQ ID NO: 238672 - RNA, 64 nt, hsa
uuccauccauucuguuacacuuuguauuuucuaacuggagaaaagagugaggaacagaauguuu

SEQ ID NO: 238673 - RNA, 64 nt, hsa
agggaccuuggaggaugaaggcgaguaugugacacuggagaaaaguggaccaggcaugucuuuu

SEQ ID NO: 238674 - RNA, 64 nt, hsa
gagaaguuucuggcccuggcugaccccaaagagccuggagaagcugaugcuuugcuucaaaucc

SEQ ID NO: 238675 - RNA, 64 nt, hsa
cugcuucaugcucagcccugacuggugcuauaggcuggagaagcucacccaauaaacauuaaga

SEQ ID NO: 238676 - RNA, 64 nt, hsa
cagaugcugacaggcccugggaggcugcugugcucuggagaagcuggagcagcucauuucuugg

SEQ ID NO: 238677 - RNA, 64 nt, hsa
cugagccauuaggagacauuagugaauuggagcacuggagaauccuacaaauggccuaugucuc

SEQ ID NO: 238678 - RNA, 64 nt, hsa
uggacucugcucauuauucuuugacccagaaagacuggagaagguaugugcuuuaagugcugcu

SEQ ID NO: 238679 - RNA, 64 nt, hsa
auggacuuugaucugccauacggagguucggaaccuggagaacggcugugauaaguagguuuug

SEQ ID NO: 238680 - RNA, 64 nt, hsa
ugccugccgaggcgggacagaguguucgcucgcgcuggagaaggcucugcucagcccugagagu

SEQ ID NO: 238681 - RNA, 64 nt, hsa
gugauugaaagccauugaggagcagguguccgggcuggagaagaguccugcuuucucuggaguc

SEQ ID NO: 238682 - RNA, 64 nt, hsa
ucuuauuccuauaagcuauguguucagacugaaacuggagaaauuaugacuauuuuauuuauag

SEQ ID NO: 238683 - RNA, 64 nt, hsa
accuuaugaaugaauuguguuucucuguccugagcuggagaagggaaugagcaggcugacacgu

SEQ ID NO: 238684 - RNA, 64 nt, hsa
uguugcugaacuggcaacuuacuugggccugaaacuggagaaggggugacauuuuuuuaauuuc

SEQ ID NO: 238685 - RNA, 64 nt, hsa
aacagaaagcaucagcucugcuucgugacagucucuggagaaaucccuuaggaagacuaugaga

SEQ ID NO: 238686 - RNA, 64 nt, hsa
aacuacuuuuuggucaugaaauuguucaucgcugcuggagaaugaacgucauugcgauuuaucu

SEQ ID NO: 238687 - RNA, 64 nt, hsa
gcacagcacuccuguaacugucucagaaccacuccuggagaaagacuuccuugcaggagugacu

SEQ ID NO: 238688 - RNA, 64 nt, hsa
ugggcuccuccuugccuaaugcagggggucaccgcuggagaagaaccaccacuguccucgaugu

SEQ ID NO: 238689 - RNA, 64 nt, hsa
gggaucuuacaacuuuacuuuguucuccagaggccuggagaacacuuagggauugugaaaauag

SEQ ID NO: 238690 - RNA, 64 nt, hsa
aacaggcuacagugucccugauucuuggaaaagccuggagaagcuggggagaugcgguucacaa

SEQ ID NO: 238691 - RNA, 64 nt, hsa
gcuucccuuucuacuccagcagcaggaagauagccuggagaaggugauuaaagauacggagucc

SEQ ID NO: 238692 - RNA, 64 nt, hsa
agggaaugguucauuuacucuuaaucuuuaugcccuggagaagaccuacuugaacagggcauau

SEQ ID NO: 238693 - RNA, 64 nt, hsa
uagagcccugauuaacuucaaggacaaacacuggcuggagaaagccagacugaugggaaugaga

SEQ ID NO: 238694 - RNA, 64 nt, hsa
cugguuggagagcuagaaccuggagagcuagaaccuggagaacuagaaccuggagggcuagaac

SEQ ID NO: 238695 - RNA, 64 nt, hsa
gaaccuggagggaaugaaccuggagggcuagaaccuggagaaugagaaaaauuuacauggcaaa

SEQ ID NO: 238696 - RNA, 64 nt, hsa
cccccuaagagacacauacagagugggccccgggcuggagaaagagcugccuggaugagaaaca

SEQ ID NO: 238697 - RNA, 64 nt, hsa
cccccucuucuucugaagaucagaacauucagcucuggagaacagugguugccugggggcuuuu

SEQ ID NO: 238698 - RNA, 64 nt, hsa
caaucaucuaaaagccagccacugucagcaaagccuggagaaaugggaccagagagucugcccc

SEQ ID NO: 238699 - RNA, 64 nt, hsa
gcuacaagcagaggcugaacaccugcggaaggagcuggagaaucugacaggacagcuuuaagcc

SEQ ID NO: 238700 - RNA, 64 nt, hsa
gcuacaagcagaggcugaacaccugcggaaggagcuggagaaucuggcaggacagcuuuaagcc

SEQ ID NO: 238701 - RNA, 64 nt, hsa
ugaaaauucugauuaagccucugggcccuacagccuggagaaccuggagaauccuacacccaca

SEQ ID NO: 238702 - RNA, 64 nt, hsa
ugauuaagccucugggcccuacagccuggagaaccuggagaauccuacacccacagaacccggc

SEQ ID NO: 238703 - RNA, 64 nt, hsa
caucgaccugagggggcccaucccugcccaccuccuggagaacacguuggcucaguccuggguc

SEQ ID NO: 238704 - RNA, 64 nt, hsa
agaggaugaggucaauuuccugaugcauauugcccuggagaagaucgccuucauccccuuuggc

SEQ ID NO: 238705 - RNA, 64 nt, hsa
uaaccuggaagaauacagccuuucucagugcacacuggagaagguauucuuagagcuuucuaaa

SEQ ID NO: 238706 - RNA, 64 nt, hsa
cugaaaugcagacagcugugagugacaugggccucuggagaaugcaagucuuugccauggcacg

SEQ ID NO: 238707 - RNA, 64 nt, hsa
guucuccugcguggcaguccugauuuccaugcuucuggagaauccauuucguuaacacugaaag

SEQ ID NO: 238708 - RNA, 64 nt, hsa
cagccuuuguauggaggcccaaccgcgcucccgucuggagaagcggcuuccgggguguggcugc

SEQ ID NO: 238709 - RNA, 64 nt, hsa
agcuguacacugaagagucaucagagaguucacacuggagaaagaccuuuugaaugcagcauuu

SEQ ID NO: 238710 - RNA, 64 nt, hsa
agcuccacacucauuagucaugagagaguucauacuggagaaaagccuuaugagugcagugaau

SEQ ID NO: 238711 - RNA, 64 nt, hsa
agguccaaccucauucaccaucagcgaguucauacuggagaaaggcaugagugcgggcagugug

SEQ ID NO: 238712 - RNA, 64 nt, hsa
aaaucuagccuuauuauacaucugagaguucacacuggagaaaggccuuaugagugcagugacu

SEQ ID NO: 238713 - RNA, 64 nt, hsa
aacuccagccuuauuaaacacuugagaguucacacuggagaaaggccauaugaaugcauugauu

SEQ ID NO: 238714 - RNA, 64 nt, hsa
gucuggucauguggaggugggguuuauugggaugcuggagaagagcugccaggaaguguuuuuu

SEQ ID NO: 238715 - RNA, 64 nt, hsa
cuggcucugucaagcugggucaggggccuugaaacuggagaaguggaagucuaugguuggucug

SEQ ID NO: 238716 - RNA, 64 nt, hsa
acagaggguguuagaaaacaaagggcagagaguccuggagaagguggaguagucagaaaacuuu

SEQ ID NO: 238717 - RNA, 64 nt, hsa
cagaccuggggacagaggugaaaugcacaagcugcuggagaaggggucagagccauaucaaguu

SEQ ID NO: 238718 - RNA, 64 nt, hsa
gggcaggccgcugaccugaggucuggagaaaccccuggagaaggguguccccaccagcccauac

SEQ ID NO: 238719 - RNA, 64 nt, hsa
agccggaggaacgggcaggccgcugaccugaggucuggagaaaccccuggagaagggugucccc

SEQ ID NO: 238720 - RNA, 64 nt, hsa; identical to SEQ ID NO: 95053

SEQ ID NO: 238721 - RNA, 64 nt, hsa; identical to SEQ ID NO: 95054

SEQ ID NO: 238722 - RNA, 64 nt, hsa; identical to SEQ ID NO: 95055

SEQ ID NO: 238723 - RNA, 64 nt, hsa; identical to SEQ ID NO: 95056

SEQ ID NO: 238724 - RNA, 64 nt, hsa; identical to SEQ ID NO: 95057

SEQ ID NO: 238725 - RNA, 64 nt, hsa; identical to SEQ ID NO: 95058

SEQ ID NO: 238726 - RNA, 64 nt, hsa; identical to SEQ ID NO: 95059

SEQ ID NO: 238727 - RNA, 64 nt, hsa; identical to SEQ ID NO: 95060

SEQ ID NO: 238728 - RNA, 64 nt, hsa; identical to SEQ ID NO: 95061

SEQ ID NO: 238729 - RNA, 64 nt, hsa; identical to SEQ ID NO: 95062

SEQ ID NO: 238730 - RNA, 64 nt, hsa; identical to SEQ ID NO: 95063

SEQ ID NO: 238731 - RNA, 64 nt, hsa; identical to SEQ ID NO: 95064

SEQ ID NO: 238732 - RNA, 64 nt, hsa; identical to SEQ ID NO: 95065

SEQ ID NO: 238733 - RNA, 64 nt, hsa; identical to SEQ ID NO: 95066

SEQ ID NO: 238734 - RNA, 64 nt, hsa; identical to SEQ ID NO: 95067

SEQ ID NO: 238735 - RNA, 64 nt, hsa; identical to SEQ ID NO: 95068

SEQ ID NO: 238736 - RNA, 64 nt, hsa; identical to SEQ ID NO: 95069

SEQ ID NO: 238737 - RNA, 64 nt, hsa; identical to SEQ ID NO: 95070

SEQ ID NO: 238738 - RNA, 64 nt, hsa; identical to SEQ ID NO: 95071

SEQ ID NO: 238739 - RNA, 64 nt, hsa; identical to SEQ ID NO: 95072

SEQ ID NO: 238740 - RNA, 64 nt, hsa; identical to SEQ ID NO: 95073

SEQ ID NO: 238741 - RNA, 64 nt, hsa; identical to SEQ ID NO: 95074

SEQ ID NO: 238742 - RNA, 64 nt, hsa; identical to SEQ ID NO: 95075

SEQ ID NO: 238743 - RNA, 64 nt, hsa; identical to SEQ ID NO: 95076

SEQ ID NO: 238744 - RNA, 64 nt, hsa; identical to SEQ ID NO: 95077

SEQ ID NO: 238745 - RNA, 64 nt, hsa; identical to SEQ ID NO: 95078

SEQ ID NO: 238746 - RNA, 64 nt, hsa; identical to SEQ ID NO: 95079

SEQ ID NO: 238747 - RNA, 64 nt, hsa
auucuuccuugaggcucacaucaugugucccuaucacucuuacuacucuggucagucuccagcu

SEQ ID NO: 238748 - RNA, 64 nt, hsa
cucugcuucauuugugccucccucaccaugaccccacucuuaccauaguggcuacauuacuuca

SEQ ID NO: 238749 - RNA, 64 nt, hsa
caaucaccauucugauagaaagugcuuaaaccaccacucuuaggucugcucacucuuagaacac

SEQ ID NO: 238750 - RNA, 64 nt, hsa
agaaagugcuuaaaccaccacucuuaggucugcucacucuuagaacacacaauggaagaggaag

SEQ ID NO: 238751 - RNA, 64 nt, hsa
gaagcugcaacagacuuucucugcucaugauuugcacucuuaggguuuuguuagcccuuuugua

SEQ ID NO: 238752 - RNA, 64 nt, hsa
aggacgccaugugagcauuaggaaaaaaaauacucacucuuacuaacaauuuuuauacagaaaa

SEQ ID NO: 238753 - RNA, 64 nt, hsa
uuccauacuacuauauucuuccaaauauuuggaacacucuuagaauucccauuuaauaaaccau

SEQ ID NO: 238754 - RNA, 64 nt, hsa
acaucacuagaaaucauucuuugucucaaguucacacucuuagcauagaauauuauugacuagg

SEQ ID NO: 238755 - RNA, 64 nt, hsa; identical to SEQ ID NO: 87097

SEQ ID NO: 238756 - RNA, 64 nt, hsa; identical to SEQ ID NO: 87098

SEQ ID NO: 238757 - RNA, 64 nt, hsa; identical to SEQ ID NO: 87099

SEQ ID NO: 238758 - RNA, 64 nt, hsa; identical to SEQ ID NO: 87100

SEQ ID NO: 238759 - RNA, 64 nt, hsa; identical to SEQ ID NO: 87101

SEQ ID NO: 238760 - RNA, 64 nt, hsa; identical to SEQ ID NO: 87102

SEQ ID NO: 238761 - RNA, 64 nt, hsa; identical to SEQ ID NO: 87103

SEQ ID NO: 238762 - RNA, 64 nt, hsa; identical to SEQ ID NO: 87104

SEQ ID NO: 238763 - RNA, 64 nt, hsa; identical to SEQ ID NO: 87105

SEQ ID NO: 238764 - RNA, 64 nt, hsa; identical to SEQ ID NO: 87106

SEQ ID NO: 238765 - RNA, 64 nt, hsa; identical to SEQ ID NO: 87107

SEQ ID NO: 238766 - RNA, 64 nt, hsa; identical to SEQ ID NO: 87108

SEQ ID NO: 238767 - RNA, 64 nt, hsa; identical to SEQ ID NO: 87109

SEQ ID NO: 238768 - RNA, 64 nt, hsa; identical to SEQ ID NO: 87110

SEQ ID NO: 238769 - RNA, 64 nt, hsa; identical to SEQ ID NO: 87111

SEQ ID NO: 238770 - RNA, 64 nt, hsa; identical to SEQ ID NO: 87112

SEQ ID NO: 238771 - RNA, 64 nt, hsa; identical to SEQ ID NO: 87113

SEQ ID NO: 238772 - RNA, 64 nt, hsa; identical to SEQ ID NO: 87114

SEQ ID NO: 238773 - RNA, 64 nt, hsa; identical to SEQ ID NO: 87115

SEQ ID NO: 238774 - RNA, 64 nt, hsa; identical to SEQ ID NO: 87116

SEQ ID NO: 238775 - RNA, 64 nt, hsa; identical to SEQ ID NO: 87117

SEQ ID NO: 238776 - RNA, 64 nt, hsa; identical to SEQ ID NO: 87118

SEQ ID NO: 238777 - RNA, 64 nt, hsa; identical to SEQ ID NO: 87119

SEQ ID NO: 238778 - RNA, 64 nt, hsa; identical to SEQ ID NO: 87120

SEQ ID NO: 238779 - RNA, 64 nt, hsa; identical to SEQ ID NO: 87121

SEQ ID NO: 238780 - RNA, 64 nt, hsa; identical to SEQ ID NO: 87122

SEQ ID NO: 238781 - RNA, 64 nt, hsa; identical to SEQ ID NO: 87123

SEQ ID NO: 238782 - RNA, 64 nt, hsa; identical to SEQ ID NO: 87124

SEQ ID NO: 238783 - RNA, 64 nt, hsa; identical to SEQ ID NO: 87125

SEQ ID NO: 238784 - RNA, 64 nt, hsa; identical to SEQ ID NO: 87126

SEQ ID NO: 238785 - RNA, 64 nt, hsa; identical to SEQ ID NO: 87127

SEQ ID NO: 238786 - RNA, 64 nt, hsa; identical to SEQ ID NO: 87128

SEQ ID NO: 238787 - RNA, 64 nt, hsa; identical to SEQ ID NO: 87129

SEQ ID NO: 238788 - RNA, 64 nt, hsa; identical to SEQ ID NO: 87130

SEQ ID NO: 238789 - RNA, 64 nt, hsa; identical to SEQ ID NO: 87131

SEQ ID NO: 238790 - RNA, 64 nt, hsa; identical to SEQ ID NO: 87132

SEQ ID NO: 238791 - RNA, 64 nt, hsa; identical to SEQ ID NO: 87133

SEQ ID NO: 238792 - RNA, 64 nt, hsa; identical to SEQ ID NO: 87134

SEQ ID NO: 238793 - RNA, 64 nt, hsa; identical to SEQ ID NO: 87135

SEQ ID NO: 238794 - RNA, 64 nt, hsa; identical to SEQ ID NO: 87136

SEQ ID NO: 238795 - RNA, 64 nt, hsa
aaaugaaauuaagugauccaaagcugcugaaguauguuugaacucuccagugcccuauagcugc

SEQ ID NO: 238796 - RNA, 64 nt, hsa
acaaucugauauaaaucugaauacaggauuauucuguuugaaaacuuugcuaugugugaacugu

SEQ ID NO: 238797 - RNA, 64 nt, hsa
uccugggaccauaauaggcucagagugagucagcuguuugaacccaaagcugugcagucaggca

SEQ ID NO: 238798 - RNA, 64 nt, hsa
guaugguguuuccuuagccuaaagaaugaucuguuguuugaaaccuuuguaacuuguuuguaug

SEQ ID NO: 238799 - RNA, 64 nt, hsa
aaugcaucuuccaugaugcauuagaaguaacuaauguuugaaauuuuaaaguacuuuugguuau

SEQ ID NO: 238800 - RNA, 64 nt, hsa
auuucaacuuauauuauaagaacgaaaguaaagauguuugaauacuuaaacacugucacaagau

SEQ ID NO: 238801 - RNA, 64 nt, hsa
uauuauuaagaaugaaugauuuuugcauuuaaguuguuugaaggcauguauuuugaaaaauauc

SEQ ID NO: 238802 - RNA, 64 nt, hsa
gagagcugaggaauauguguuccuaugggaacuauguuugaauaugugcaguuuucaacauuuu

SEQ ID NO: 238803 - RNA, 64 nt, hsa
ugcuuggacuaccuauaaauggacuugcuucuuguguuugaaacacucgugugcaugagaaugu

SEQ ID NO: 238804 - RNA, 64 nt, hsa
ucgaaaguaaaaaagauggaaguguauugguuucuguuugaauuuucaaaggcuuccaaugugg

SEQ ID NO: 238805 - RNA, 64 nt, hsa
aggaaagaguagacccaaagauguuauuuucugcuguuugaauuuugucuccccacccccaacu

SEQ ID NO: 238806 - RNA, 64 nt, hsa
uuuuaauuagcgcauucucuauccaacauuuaauuguuugaaagccuccauauaguuagauugu

SEQ ID NO: 238807 - RNA, 64 nt, hsa
ccacagacagguucccuccauuggcagcccauuguguuugaaauuccaugucggguuuacuugg

SEQ ID NO: 238808 - RNA, 64 nt, hsa
ucgugaaacgagugaugccugaagaucucagugauguuugaaccuucuguguaacuuuuuauua

SEQ ID NO: 238809 - RNA, 64 nt, hsa
cacagagaauauacuuuuccucaaguaauauaccuguuugaagcuuuaagagagauguuuuugg

SEQ ID NO: 238810 - RNA, 64 nt, hsa
ucauugaagaaucaauacauauuuuguuucaaaauguuugaaacaaaagacauagaugguagac

SEQ ID NO: 238811 - RNA, 64 nt, hsa
ugucucaguguuugguuauuaugcaaacaaguaauguuugaaauauauaauagcacuggagauu

SEQ ID NO: 238812 - RNA, 64 nt, hsa
ucuguuccugcccuguugcuuccagccacugugauguuugaaauaugugauaguaccugguugu

SEQ ID NO: 238813 - RNA, 64 nt, hsa
uauaaaugugugucuauaugcuuuccuuuaaauauguuugaaaagauguuugaaacuugauuau

SEQ ID NO: 238814 - RNA, 64 nt, hsa
ucuauaugcuuuccuuuaaauauguuugaaaagauguuugaaacuugauuauacuauuuauaau

SEQ ID NO: 238815 - RNA, 64 nt, hsa
agugaaaugccacuuaguucucaauugaugacaguguuugaaucaucauaaaaaaaauaccugc

SEQ ID NO: 238816 - RNA, 64 nt, hsa
uucaaggcucugcuauagcggaaauucuuaauaauguuugaagaagggccccaugauuucauuu

SEQ ID NO: 238817 - RNA, 64 nt, hsa
uaccuuucuggguguuucuuguaaacuauacuccuguuugaauguuaaacuuuguugcuaaagu

SEQ ID NO: 238818 - RNA, 64 nt, hsa
uguuaaacuuuguugcuaaaguuuaauuuuaagauguuugaauguucaguuuauguauuugaac

SEQ ID NO: 238819 - RNA, 64 nt, hsa
cuuguugcagcaguuugaauuucccagauauuuauguuugaacauaauggcucagaauacauau

SEQ ID NO: 238820 - RNA, 64 nt, hsa
gugaacauguuuucaacccuuuaacuuuuuacgguguuugaagaccagcuacuccuuaauauuu

SEQ ID NO: 238821 - RNA, 64 nt, hsa
gaaaaugccucuuucuuccuuucuccaugaaauguguuugaaacaaauccugacuuaaggccca

SEQ ID NO: 238822 - RNA, 64 nt, hsa
uaaggcccagggacuuccuuaaaggaaaguuggguguuugaagcuacuguuuucucuuuuguuc

SEQ ID NO: 238823 - RNA, 64 nt, hsa
uuuggaaaaucaaugauuuuaaugcauagcaguauguuugaaaaauagaccauucuaaaaagcc

SEQ ID NO: 238824 - RNA, 64 nt, hsa
caaguuucaguucuauaugaaguauuugauguuuuguuugaaacaauacagcauuaaagaacca

SEQ ID NO: 238825 - RNA, 64 nt, hsa
cuucuagaacauguagacacuugagaaauguuucuguuugaagaaaauagagggagaaacagaa

SEQ ID NO: 238826 - RNA, 64 nt, hsa
caugaaggugugguaucaaacuucagguugaaacuguuugaagcauuauaaacauucauuucac

SEQ ID NO: 238827 - RNA, 64 nt, hsa
gauuacaggcgugagccacugcgcccggccgaaguguuugaaaucuuuaagcauccugguaaau

SEQ ID NO: 238828 - RNA, 64 nt, hsa
uuagauuuccagguauggaauaauuagguugaaguguuugaaaucuuuuuuuguugguuuguuu

SEQ ID NO: 238829 - RNA, 64 nt, hsa
cuggcuuguuuguucccuaccaauauucuguugcuguuugaaguagugccaggguccccuggga

SEQ ID NO: 238830 - RNA, 64 nt, hsa
aaagcuaaauauuauauauuuuauuuuucauacauguuugaagugcaaaucuguggauauucca

SEQ ID NO: 238831 - RNA, 64 nt, hsa
uuauagaauaugggaucccguguguguguguguguguuugaaugaaaaaugcuuauguauugac

SEQ ID NO: 238832 - RNA, 64 nt, hsa
guggggaaugccuucuacguacacacuguucuacuguuugaauuuuuuaauaugagcccaaauu

SEQ ID NO: 238833 - RNA, 64 nt, hsa
cgcugcauucucguguucagugaugcccucuucuuguuugaaacaaaagaaaauaaugcauugu

SEQ ID NO: 238834 - RNA, 64 nt, hsa
aaacuuguuuaccuuaaaauuaucagaaucucaguguuugaaaguacugaagcacaaacauaua

SEQ ID NO: 238835 - RNA, 64 nt, hsa
uaaguuuccauaugcagggaguaacuuuaaacaauguuugaauaauuaacugcuaagucuuaua

SEQ ID NO: 238836 - RNA, 64 nt, hsa
uguucaacgacuaagugauuuguuugucuugaacuguuugaaaagcuauggaagagguuacagu

SEQ ID NO: 238837 - RNA, 64 nt, hsa
augcacacccuucuugguuggaacugaaagcuucuguuugaagagacaugaguucuggaaggag

SEQ ID NO: 238838 - RNA, 64 nt, hsa
auaagccauaugaugacacacagugucuuucuccuguuugaaaagaaauugugucauauuggug

SEQ ID NO: 238839 - RNA, 64 nt, hsa
uuaaagugaugauauauuauuuugugaaacuuuguguuugaaaauguuuauuucuguuuauggu

SEQ ID NO: 238840 - RNA, 64 nt, hsa
aguucuagaaguucuuauuuuguuuuuguuguaauguuugaauacuauuuaauauccgguuuua

SEQ ID NO: 238841 - RNA, 64 nt, hsa
cauugacaguaaaaacaacaaaccaggauucuacuguuugaaaagaaguuucguuuuaauuuug

SEQ ID NO: 238842 - RNA, 64 nt, hsa
uugauuaacuucugguuugguuuagaaaaaguaauguuugaaauacgaagguaauuuaauguua

SEQ ID NO: 238843 - RNA, 64 nt, hsa
uuuaagaaucccuuuucauggucugaucuuaaguuguuugaaaaaagauucacgcuucugcauc

SEQ ID NO: 238844 - RNA, 64 nt, hsa
aguaccacaauuaaagauuaugcuccccuuuucuuguuugaaaacaguuauuuggugacuagaa

SEQ ID NO: 238845 - RNA, 64 nt, hsa
uggucucagacuaaguaaugcaucagaauucaucuguuugaagccugaaauaauuuaggacucu

SEQ ID NO: 238846 - RNA, 64 nt, hsa
ccugaaaaccugaaaaugccacuuucaugcaguuuguuugaaguuaaguggaauccuuucaaau

SEQ ID NO: 238847 - RNA, 64 nt, hsa
uuuugcaaggauuuguaggguuaugggcaguuguuguuugaagcauugcuaugaccuaauuccc

SEQ ID NO: 238848 - RNA, 64 nt, hsa
ucuagucuccauaacccccaaaguacugcuuauuuguuugaagaauccagccaucguagugcuu

SEQ ID NO: 238849 - RNA, 64 nt, hsa
cgcuacaaucugaugaacucugccauaauagagauguuugaauuuauuagagugguagguucug

SEQ ID NO: 238850 - RNA, 64 nt, hsa
gaguuuuacaaccgcuacauaaugaaaaguuuuuuguuugaaccaguagugaaagcauuucuca

SEQ ID NO: 238851 - RNA, 64 nt, hsa
aaacaaaggaaggugcuggucauuccauuucuuuuguuugaagcuaaagagauguguagcucac

SEQ ID NO: 238852 - RNA, 64 nt, hsa
ugauaaacacuacucaguccaccaacaacaaacguguuugaauucaccuuaccaauauuaaucc

SEQ ID NO: 238853 - RNA, 64 nt, hsa
uuuuugugagggcaaaggggaggaaaugggguucuguuugaaaaaaaugaggggaucuuagaug

SEQ ID NO: 238854 - RNA, 64 nt, hsa
cccucaugugcuucuucugaauacugaaugugacuguuugaaagcugguagaauucaucccucu

SEQ ID NO: 238855 - RNA, 64 nt, hsa
gggggaaagagauguuuuucuuaguugucuacuuuguuugaacacuuuuguugugguucaagug

SEQ ID NO: 238856 - RNA, 64 nt, hsa
gguuccauuuaggagcuuucuagaaaguugaggauguuugaagcuucccuucuguguuccaguu

SEQ ID NO: 238857 - RNA, 64 nt, hsa
auuuugacuuaaacaguguugucauuguagcaguuguuugaaguuuucagggauaacauaccug

SEQ ID NO: 238858 - RNA, 64 nt, hsa
ugagaauuggagagcaguaaaagacugaagauaauguuugaacagccacauacaccaugccuga

SEQ ID NO: 238859 - RNA, 64 nt, hsa
aaauuuuaaagugcuccuaagcccauaacuugccuguuugaacuaugguaauggguggaagagg

SEQ ID NO: 238860 - RNA, 64 nt, hsa
agggagcccugccuuuuucuacugguucccccaauguuugaaagaggcauuaggcuccugguag

SEQ ID NO: 238861 - RNA, 64 nt, hsa
auguuuggggaucgaugugcucagccaaauuuccuguuugaaauaucauguuaaauuagaauga

SEQ ID NO: 238862 - RNA, 64 nt, hsa
ucuuggagcuuuggaauauuuuauccuguauucuuguuugaauuccuccucuauuuaagauaua

SEQ ID NO: 238863 - RNA, 64 nt, hsa
gucaugagaaggcuaaauaucaguguuaauuucuuguuugaauccgugaaaucaugccuguaaa

SEQ ID NO: 238864 - RNA, 64 nt, hsa
ugcauguucgugguaucaugguaucauucaugcguguuugaauaguucuacaucuagugcuucu

SEQ ID NO: 238865 - RNA, 64 nt, hsa
cuaggggaagagaauuaacuagaauuaaauuuaauguuugaaucuaaaucauugggcaaacuuc

SEQ ID NO: 238866 - RNA, 64 nt, hsa
uccuuuucagauucccugucugcucaauuaaagauguuugaauccaaaggaagucaaggaagaa

SEQ ID NO: 238867 - RNA, 64 nt, hsa
guucaggaacauucucauuguauguggucuccgcuguuugaacagccuucuagcuaaaaaauuc

SEQ ID NO: 238868 - RNA, 64 nt, hsa
uuuuauacucugggaugcaaccgacauguucaaauguuugaaaucccacaauguuagaccaauc

SEQ ID NO: 238869 - RNA, 64 nt, hsa
uuuuaaauuauuguuuccagcuuuaucaaagacauguuugaaaaauaaaaagcauccaagugag

SEQ ID NO: 238870 - RNA, 64 nt, hsa
ucucuggcagcacugucugcacuuucuuguuuacuguuugaagggacgaguaccaagccacaag

SEQ ID NO: 238871 - RNA, 64 nt, hsa
acaucagccuccagguugacuaagggucaggucauguuugaaaccaugcuuggcuggaccggga

SEQ ID NO: 238872 - RNA, 64 nt, hsa
cuuggcaacagacucaugacaaaggauucaagauuguuugaaaaaaaaaaaaggggagcaggga

SEQ ID NO: 238873 - RNA, 64 nt, hsa
cuacauaguugaagacagcaacaucuucacugaauguuugaauagaaaccucuacuaaauuauu

SEQ ID NO: 238874 - RNA, 64 nt, hsa
cauuaauuuuucuauaaauuggaagauuuauaaauguuugaaauuguacacauugauauuuaau

SEQ ID NO: 238875 - RNA, 64 nt, hsa
auuuuucaaaagcucaguauaugaaucaucauacuguuugaaauugcuaaugacagaguaagua

SEQ ID NO: 238876 - RNA, 64 nt, hsa
uguaacuauaaauuuugugaaugcauuuuccugguguuugaaaaagaagggggggagaauucca

SEQ ID NO: 238877 - RNA, 64 nt, hsa
auacagugcuauaagcuaugcacagaaaauaaaauguuugaaauccaagaauaaugguucuuac

SEQ ID NO: 238878 - RNA, 64 nt, hsa
auauauagauccuuucauauuauuuuacuaagaauguuugaacuuugcauauuugauauaguuc

SEQ ID NO: 238879 - RNA, 64 nt, hsa
gcaaccagucaaaaccagagcgagaacccucaacugacaugaaauacuuuaaaaugcacacgua

SEQ ID NO: 238880 - RNA, 64 nt, hsa
caaugaccguuugacuguuuguggcuugggccucugacaugacuuauguguguguguguuuuug

SEQ ID NO: 238881 - RNA, 64 nt, hsa
uuuuaaauacauucuccuuuuugcccuggauuguugacaugaguggaauacuugguuucuuuuc

SEQ ID NO: 238882 - RNA, 64 nt, hsa
aaguuucuaaauugagauucgauuacuguuuggcugacaugacuuuucuggaagacaugauaca

SEQ ID NO: 238883 - RNA, 64 nt, hsa
uuucaaauuguccagaguggaaaagccuucaagaugacaugaugaauuacucaguucaucugau

SEQ ID NO: 238884 - RNA, 64 nt, hsa
gaccagugccaaucugaacauuguuaauggccugugacaugaugagcacaggaacaggcaugaa

SEQ ID NO: 238885 - RNA, 64 nt, hsa
ugccagacccaggguuagacacaaggaccugaagugacaugacggcgggacaggggaaauguga

SEQ ID NO: 238886 - RNA, 64 nt, hsa
uuggucuuaaggaaaauacuaacauugaacucacugacaugaucuuagcuucuuuaaucagacu

SEQ ID NO: 238887 - RNA, 64 nt, hsa
uaauaugcucaguuuggaccuuuuuuucaguuaaaugcuaaauauaugaaaauuacuauaccuc

SEQ ID NO: 238888 - RNA, 64 nt, hsa
gaaccuucuuaaucucuucugugggauuuucaaaaugcuaaagacucacacugcagcaaucauc

SEQ ID NO: 238889 - RNA, 64 nt, hsa
uugggacuccaggagagagguuuuugcagcauguaugcuaaauuugugaguuagcaagacccug

SEQ ID NO: 238890 - RNA, 64 nt, hsa
uacacauuguacaaaauaucgaagacacuaccauaugcuaaaggaagaaaucuagcugggauau

SEQ ID NO: 238891 - RNA, 64 nt, hsa
uauuuaacucacggcuacuguccuaauuuuagggaugcuaaaauaguuuguuuuaaaagagguu

SEQ ID NO: 238892 - RNA, 64 nt, hsa
uuccuacugacuuccaauuuagugcucccccaguaugcuaaauagaaagcccucugcaauauau

SEQ ID NO: 238893 - RNA, 64 nt, hsa
auaaaccuuuuuauuacauugugauuuagcaguuaugcuaaaauauguacuuaugcuuuaguag

SEQ ID NO: 238894 - RNA, 64 nt, hsa
aagucaacugagauccagagaauccuggaugugaaugcuaaacacuggcccuuaacucacauuc

SEQ ID NO: 238895 - RNA, 64 nt, hsa
auuaugauuauaguaaacagacuaguggguaguaaugcuaaauuaccaucacaguuaugugcca

SEQ ID NO: 238896 - RNA, 64 nt, hsa
ggaauauagauauguauauacacauauaauauauaugcuaaaguauaaagaguaauaauaauga

SEQ ID NO: 238897 - RNA, 64 nt, hsa
auuaauuugauaauuucauguaugaugugcauauaugcuaaaagaaugcagaaaaucauuuuau

SEQ ID NO: 238898 - RNA, 64 nt, hsa
aauuggguaaaguuuacucuuggacauuauuucgaugcuaaaguaaggauucuguggauguuac

SEQ ID NO: 238899 - RNA, 64 nt, hsa
gucaggguuggcuugugaaaaguuguuaaacaacaugcuaaaugugaaauguuaacccucuaaa

SEQ ID NO: 238900 - RNA, 64 nt, hsa
gccgccgccaugcccaagagaaagacugaaggggaugcuaaaggagauaaagccaaggugaagg

SEQ ID NO: 238901 - RNA, 64 nt, hsa
cuaauuuucaguaagaagugauuaaaauaaugacaugcuaaaaggcaaauuucaagggaagaaa

SEQ ID NO: 238902 - RNA, 64 nt, hsa
ugaagguuaaagauaaauuaagauuauccaccaaaugcuaaaaauacugauguguaaaucaccu

SEQ ID NO: 238903 - RNA, 64 nt, hsa
ccagagaggacaaaaaagcccaacuugccaccagaugcuaaaugagacuugacagcugcagagc

SEQ ID NO: 238904 - RNA, 64 nt, hsa
auacacuuuuguguauuagcaaugguuuuuacuaaugcuaaaacuuuuaaaguuuauuuuuuaa

SEQ ID NO: 238905 - RNA, 64 nt, hsa
cucuucugcuuccugauaagaaaagguauaugcaaugcuaaaacuguagaagcccaaucaccag

SEQ ID NO: 238906 - RNA, 64 nt, hsa
gagaaccuucuuuuucucuugacuuugacagcacaugcuaaaaaucucuuccaagaaguaugcu

SEQ ID NO: 238907 - RNA, 64 nt, hsa
ugacagcacaugcuaaaaaucucuuccaagaaguaugcuaaagcuuuucauuugguuccuguua

SEQ ID NO: 238908 - RNA, 64 nt, hsa; identical to SEQ ID NO: 73636

SEQ ID NO: 238909 - RNA, 64 nt, hsa; identical to SEQ ID NO: 73637

SEQ ID NO: 238910 - RNA, 64 nt, hsa; identical to SEQ ID NO: 73638

SEQ ID NO: 238911 - RNA, 64 nt, hsa; identical to SEQ ID NO: 73639

SEQ ID NO: 238912 - RNA, 64 nt, hsa; identical to SEQ ID NO: 73640

SEQ ID NO: 238913 - RNA, 64 nt, hsa; identical to SEQ ID NO: 73641

SEQ ID NO: 238914 - RNA, 64 nt, hsa; identical to SEQ ID NO: 73642

SEQ ID NO: 238915 - RNA, 64 nt, hsa; identical to SEQ ID NO: 73643

SEQ ID NO: 238916 - RNA, 64 nt, hsa; identical to SEQ ID NO: 73644

SEQ ID NO: 238917 - RNA, 64 nt, hsa; identical to SEQ ID NO: 73645

SEQ ID NO: 238918 - RNA, 64 nt, hsa; identical to SEQ ID NO: 73646

SEQ ID NO: 238919 - RNA, 64 nt, hsa; identical to SEQ ID NO: 73647

SEQ ID NO: 238920 - RNA, 64 nt, hsa; identical to SEQ ID NO: 73648

SEQ ID NO: 238921 - RNA, 64 nt, hsa; identical to SEQ ID NO: 73649

SEQ ID NO: 238922 - RNA, 64 nt, hsa; identical to SEQ ID NO: 73650

SEQ ID NO: 238923 - RNA, 64 nt, hsa; identical to SEQ ID NO: 73651

SEQ ID NO: 238924 - RNA, 64 nt, hsa; identical to SEQ ID NO: 73652

SEQ ID NO: 238925 - RNA, 64 nt, hsa; identical to SEQ ID NO: 73653

SEQ ID NO: 238926 - RNA, 64 nt, hsa; identical to SEQ ID NO: 73654

SEQ ID NO: 238927 - RNA, 64 nt, hsa; identical to SEQ ID NO: 73655

SEQ ID NO: 238928 - RNA, 64 nt, hsa; identical to SEQ ID NO: 73656

SEQ ID NO: 238929 - RNA, 64 nt, hsa; identical to SEQ ID NO: 73657

SEQ ID NO: 238930 - RNA, 64 nt, hsa; identical to SEQ ID NO: 73658

SEQ ID NO: 238931 - RNA, 64 nt, hsa; identical to SEQ ID NO: 73659

SEQ ID NO: 238932 - RNA, 64 nt, hsa; identical to SEQ ID NO: 73660

SEQ ID NO: 238933 - RNA, 64 nt, hsa; identical to SEQ ID NO: 73661

SEQ ID NO: 238934 - RNA, 64 nt, hsa; identical to SEQ ID NO: 73662

SEQ ID NO: 238935 - RNA, 64 nt, hsa; identical to SEQ ID NO: 73663

SEQ ID NO: 238936 - RNA, 63 nt, hsa; identical to SEQ ID NO: 73664

SEQ ID NO: 238937 - RNA, 64 nt, hsa; identical to SEQ ID NO: 73665

SEQ ID NO: 238938 - RNA, 64 nt, hsa; identical to SEQ ID NO: 73666

SEQ ID NO: 238939 - RNA, 64 nt, hsa; identical to SEQ ID NO: 73667

SEQ ID NO: 238940 - RNA, 64 nt, hsa; identical to SEQ ID NO: 73668

SEQ ID NO: 238941 - RNA, 64 nt, hsa; identical to SEQ ID NO: 73669

SEQ ID NO: 238942 - RNA, 64 nt, hsa; identical to SEQ ID NO: 73670

SEQ ID NO: 238943 - RNA, 64 nt, hsa; identical to SEQ ID NO: 73671

SEQ ID NO: 238944 - RNA, 64 nt, hsa; identical to SEQ ID NO: 73672

SEQ ID NO: 238945 - RNA, 64 nt, hsa; identical to SEQ ID NO: 73673

SEQ ID NO: 238946 - RNA, 64 nt, hsa; identical to SEQ ID NO: 73674

SEQ ID NO: 238947 - RNA, 64 nt, hsa; identical to SEQ ID NO: 73675

SEQ ID NO: 238948 - RNA, 64 nt, hsa; identical to SEQ ID NO: 73676

SEQ ID NO: 238949 - RNA, 64 nt, hsa; identical to SEQ ID NO: 73677

SEQ ID NO: 238950 - RNA, 64 nt, hsa; identical to SEQ ID NO: 73678

SEQ ID NO: 238951 - RNA, 64 nt, hsa; identical to SEQ ID NO: 73679

SEQ ID NO: 238952 - RNA, 64 nt, hsa; identical to SEQ ID NO: 73680

SEQ ID NO: 238953 - RNA, 64 nt, hsa; identical to SEQ ID NO: 73681

SEQ ID NO: 238954 - RNA, 64 nt, hsa; identical to SEQ ID NO: 73682

SEQ ID NO: 238955 - RNA, 64 nt, hsa; identical to SEQ ID NO: 73683

SEQ ID NO: 238956 - RNA, 64 nt, hsa; identical to SEQ ID NO: 73684

SEQ ID NO: 238957 - RNA, 64 nt, hsa; identical to SEQ ID NO: 73685

SEQ ID NO: 238958 - RNA, 64 nt, hsa; identical to SEQ ID NO: 73686

SEQ ID NO: 238959 - RNA, 64 nt, hsa; identical to SEQ ID NO: 73687

SEQ ID NO: 238960 - RNA, 64 nt, hsa; identical to SEQ ID NO: 73688

SEQ ID NO: 238961 - RNA, 64 nt, hsa; identical to SEQ ID NO: 73689

SEQ ID NO: 238962 - RNA, 64 nt, hsa; identical to SEQ ID NO: 73690

SEQ ID NO: 238963 - RNA, 64 nt, hsa; identical to SEQ ID NO: 73691

SEQ ID NO: 238964 - RNA, 64 nt, hsa; identical to SEQ ID NO: 73692

SEQ ID NO: 238965 - RNA, 64 nt, hsa; identical to SEQ ID NO: 73693

SEQ ID NO: 238966 - RNA, 64 nt, hsa; identical to SEQ ID NO: 73694

SEQ ID NO: 238967 - RNA, 64 nt, hsa; identical to SEQ ID NO: 73695

SEQ ID NO: 238968 - RNA, 64 nt, hsa; identical to SEQ ID NO: 73696

SEQ ID NO: 238969 - RNA, 64 nt, hsa; identical to SEQ ID NO: 73697

SEQ ID NO: 238970 - RNA, 64 nt, hsa; identical to SEQ ID NO: 73698

SEQ ID NO: 238971 - RNA, 64 nt, hsa; identical to SEQ ID NO: 73699

SEQ ID NO: 238972 - RNA, 64 nt, hsa; identical to SEQ ID NO: 73700

SEQ ID NO: 238973 - RNA, 64 nt, hsa; identical to SEQ ID NO: 73701

SEQ ID NO: 238974 - RNA, 64 nt, hsa; identical to SEQ ID NO: 73702

SEQ ID NO: 238975 - RNA, 64 nt, hsa; identical to SEQ ID NO: 73703

SEQ ID NO: 238976 - RNA, 64 nt, hsa; identical to SEQ ID NO: 73704

SEQ ID NO: 238977 - RNA, 64 nt, hsa; identical to SEQ ID NO: 73705

SEQ ID NO: 238978 - RNA, 64 nt, hsa; identical to SEQ ID NO: 73706

SEQ ID NO: 238979 - RNA, 64 nt, hsa; identical to SEQ ID NO: 73707

SEQ ID NO: 238980 - RNA, 63 nt, hsa
agaauugaagucugaaacaaacaaaagcaauucaaugucaauagacauuaagcaacauaauag

SEQ ID NO: 238981 - RNA, 63 nt, hsa
gcaguuuacaauuuuuguucuucuccuguaaagaaugucaaugguuaucaccuucaauaguuu

SEQ ID NO: 238982 - RNA, 63 nt, hsa
uuacauugcuuagauaauuuagaauuuuuaacuaaugucaaaacuacagugucaaacauucua

SEQ ID NO: 238983 - RNA, 63 nt, hsa
uuggugcuccaguguagggcuaucuuuuuaaaaaaugucaacaaagggaaaauaaacuaucag

SEQ ID NO: 238984 - RNA, 63 nt, hsa
uggaggguggguuggggagggguggauuuuuaaaaugucaagacagggaaggaugacaaaaug

SEQ ID NO: 238985 - RNA, 63 nt, hsa
ugugaucuaguccuugucuuguaauuguggauuaaugucaauguuaaucagccccucaaaggg

SEQ ID NO: 238986 - RNA, 63 nt, hsa
aaaguuugacuuuuguccaguaaauugcuaaguaaugucaauaaaucgaguauggguauuaug

SEQ ID NO: 238987 - RNA, 63 nt, hsa
uuugcccuucgccauuguuuccaaagaucaaggaaugucaauaacauuuuaaaggaccaauaa

SEQ ID NO: 238988 - RNA, 63 nt, hsa
uaagagcuuuuucacucuaaaaaucuuggcaauaaugucaacaccagaaagccuccucuggag

SEQ ID NO: 238989 - RNA, 63 nt, hsa
aauuuuauuuuuuuucuguaacugugcuuguugaaugucaaucauauuuaaagggaaugacuu

SEQ ID NO: 238990 - RNA, 63 nt, hsa
uguauaugugcgaucguaaaauuugugcaauguaaugucaaauugacuggucaaugucaaccu

SEQ ID NO: 238991 - RNA, 63 nt, hsa
aauuugugcaauguaaugucaaauugacuggucaaugucaaccuaguagucaaucuaacugca

SEQ ID NO: 238992 - RNA, 63 nt, hsa
uuuuugcuucuuaaauuugcuuuucaucauuaaaaugucaaguucaagugauaugugccuaau

SEQ ID NO: 238993 - RNA, 63 nt, hsa
gcacaauucagaauggcagaaguaauuugggaaaaugucaacaaaaaagcagccuaaaugcaa

SEQ ID NO: 238994 - RNA, 63 nt, hsa
uccagcucuaacaaaaugguuuauuuuuauuuaaaugucaauaguuguuuuuuaaaauccaaa

SEQ ID NO: 238995 - RNA, 60 nt, hsa
uuuucgagacagcacugugaauccaaccaaaaugucaaguccguuccgaaggcauuuucc

SEQ ID NO: 238996 - RNA, 63 nt, hsa
uuuaauauuccgcuaauuugauuuugaauuguaaaugucaaguauucuguuuuugggguuuuu

SEQ ID NO: 238997 - RNA, 63 nt, hsa
uuacguugaucucuuaaauuguaaacacuacaaaaugucaaaauaaugagaacugacacaacu

SEQ ID NO: 238998 - RNA, 63 nt, hsa
gaaaguaacaccuuuuccaaggacaauggcaacaaugucaaugucaacacugagucuaauuuu

SEQ ID NO: 238999 - RNA, 63 nt, hsa
aacaccuuuuccaaggacaauggcaacaaugucaaugucaacacugagucuaauuuugaccac

SEQ ID NO: 239000 - RNA, 63 nt, hsa
augguauguagaagccuaggaucacagggugauaaugucaauuggcagccaguuguguuuuuu

SEQ ID NO: 239001 - RNA, 63 nt, hsa
agcugccccccaccccucaguuaauugcagucuaaugucaagaggcacuucuuuauuaauuac

SEQ ID NO: 239002 - RNA, 63 nt, hsa
aacacaggaggacuuaauggcagcuuggcauuuaaugucaaaauccaagccguggcauuuaau

SEQ ID NO: 239003 - RNA, 63 nt, hsa
gcauuuaaugucaaaauccaagccguggcauuuaaugucaaaaugacuucagaccacuucuag

SEQ ID NO: 239004 - RNA, 63 nt, hsa
acugcaauguaauacuagcugguauguuucauaaaugucaagcuguggaccaacauauauagc

SEQ ID NO: 239005 - RNA, 63 nt, hsa
augucuagaugaguccccuguagggucagagacaaugucaaacuguguaagugaagaccuggg

SEQ ID NO: 239006 - RNA, 64 nt, hsa; identical to SEQ ID NO: 61625

SEQ ID NO: 239007 - RNA, 64 nt, hsa; identical to SEQ ID NO: 61626

SEQ ID NO: 239008 - RNA, 64 nt, hsa; identical to SEQ ID NO: 61627

SEQ ID NO: 239009 - RNA, 64 nt, hsa; identical to SEQ ID NO: 61628

SEQ ID NO: 239010 - RNA, 64 nt, hsa; identical to SEQ ID NO: 61629

SEQ ID NO: 239011 - RNA, 64 nt, hsa; identical to SEQ ID NO: 61630

SEQ ID NO: 239012 - RNA, 64 nt, hsa; identical to SEQ ID NO: 61631

SEQ ID NO: 239013 - RNA, 64 nt, hsa; identical to SEQ ID NO: 61632

SEQ ID NO: 239014 - RNA, 64 nt, hsa; identical to SEQ ID NO: 61633

SEQ ID NO: 239015 - RNA, 64 nt, hsa; identical to SEQ ID NO: 61634

SEQ ID NO: 239016 - RNA, 64 nt, hsa; identical to SEQ ID NO: 61635

SEQ ID NO: 239017 - RNA, 64 nt, hsa; identical to SEQ ID NO: 61636

SEQ ID NO: 239018 - RNA, 64 nt, hsa; identical to SEQ ID NO: 61637

SEQ ID NO: 239019 - RNA, 64 nt, hsa; identical to SEQ ID NO: 61638

SEQ ID NO: 239020 - RNA, 64 nt, hsa; identical to SEQ ID NO: 61639

SEQ ID NO: 239021 - RNA, 64 nt, hsa; identical to SEQ ID NO: 61640

SEQ ID NO: 239022 - RNA, 64 nt, hsa; identical to SEQ ID NO: 61641

SEQ ID NO: 239023 - RNA, 64 nt, hsa; identical to SEQ ID NO: 61642

SEQ ID NO: 239024 - RNA, 64 nt, hsa; identical to SEQ ID NO: 61643

SEQ ID NO: 239025 - RNA, 64 nt, hsa; identical to SEQ ID NO: 61644

SEQ ID NO: 239026 - RNA, 64 nt, hsa; identical to SEQ ID NO: 61645

SEQ ID NO: 239027 - RNA, 64 nt, hsa; identical to SEQ ID NO: 61646

SEQ ID NO: 239028 - RNA, 64 nt, hsa; identical to SEQ ID NO: 61647

SEQ ID NO: 239029 - RNA, 64 nt, hsa; identical to SEQ ID NO: 61648

SEQ ID NO: 239030 - RNA, 64 nt, hsa; identical to SEQ ID NO: 61649

SEQ ID NO: 239031 - RNA, 64 nt, hsa; identical to SEQ ID NO: 61650

SEQ ID NO: 239032 - RNA, 64 nt, hsa; identical to SEQ ID NO: 61651

SEQ ID NO: 239033 - RNA, 64 nt, hsa; identical to SEQ ID NO: 61652

SEQ ID NO: 239034 - RNA, 64 nt, hsa; identical to SEQ ID NO: 61653

SEQ ID NO: 239035 - RNA, 64 nt, hsa; identical to SEQ ID NO: 61654

SEQ ID NO: 239036 - RNA, 64 nt, hsa; identical to SEQ ID NO: 61655

SEQ ID NO: 239037 - RNA, 64 nt, hsa; identical to SEQ ID NO: 61656

SEQ ID NO: 239038 - RNA, 64 nt, hsa; identical to SEQ ID NO: 61657

SEQ ID NO: 239039 - RNA, 64 nt, hsa; identical to SEQ ID NO: 61658

SEQ ID NO: 239040 - RNA, 64 nt, hsa; identical to SEQ ID NO: 61659

SEQ ID NO: 239041 - RNA, 64 nt, hsa; identical to SEQ ID NO: 61660

SEQ ID NO: 239042 - RNA, 64 nt, hsa; identical to SEQ ID NO: 61661

SEQ ID NO: 239043 - RNA, 64 nt, hsa; identical to SEQ ID NO: 61662

SEQ ID NO: 239044 - RNA, 64 nt, hsa; identical to SEQ ID NO: 61663

SEQ ID NO: 239045 - RNA, 64 nt, hsa; identical to SEQ ID NO: 61664

SEQ ID NO: 239046 - RNA, 64 nt, hsa; identical to SEQ ID NO: 61665

SEQ ID NO: 239047 - RNA, 64 nt, hsa; identical to SEQ ID NO: 61666

SEQ ID NO: 239048 - RNA, 64 nt, hsa; identical to SEQ ID NO: 61667

SEQ ID NO: 239049 - RNA, 64 nt, hsa; identical to SEQ ID NO: 61668

SEQ ID NO: 239050 - RNA, 64 nt, hsa; identical to SEQ ID NO: 61669

SEQ ID NO: 239051 - RNA, 64 nt, hsa; identical to SEQ ID NO: 61670

SEQ ID NO: 239052 - RNA, 64 nt, hsa; identical to SEQ ID NO: 61671

SEQ ID NO: 239053 - RNA, 64 nt, hsa; identical to SEQ ID NO: 61672

SEQ ID NO: 239054 - RNA, 64 nt, hsa; identical to SEQ ID NO: 61673

SEQ ID NO: 239055 - RNA, 64 nt, hsa; identical to SEQ ID NO: 61674

SEQ ID NO: 239056 - RNA, 64 nt, hsa; identical to SEQ ID NO: 61675

SEQ ID NO: 239057 - RNA, 64 nt, hsa; identical to SEQ ID NO: 61676

SEQ ID NO: 239058 - RNA, 64 nt, hsa; identical to SEQ ID NO: 61677

SEQ ID NO: 239059 - RNA, 64 nt, hsa; identical to SEQ ID NO: 61678

SEQ ID NO: 239060 - RNA, 64 nt, hsa; identical to SEQ ID NO: 61679

SEQ ID NO: 239061 - RNA, 64 nt, hsa; identical to SEQ ID NO: 61680

SEQ ID NO: 239062 - RNA, 64 nt, hsa; identical to SEQ ID NO: 61681

SEQ ID NO: 239063 - RNA, 64 nt, hsa; identical to SEQ ID NO: 61682

SEQ ID NO: 239064 - RNA, 64 nt, hsa; identical to SEQ ID NO: 61683

SEQ ID NO: 239065 - RNA, 64 nt, hsa; identical to SEQ ID NO: 61684

SEQ ID NO: 239066 - RNA, 64 nt, hsa; identical to SEQ ID NO: 61685

SEQ ID NO: 239067 - RNA, 64 nt, hsa; identical to SEQ ID NO: 61686

SEQ ID NO: 239068 - RNA, 64 nt, hsa; identical to SEQ ID NO: 61687

SEQ ID NO: 239069 - RNA, 64 nt, hsa; identical to SEQ ID NO: 61688

SEQ ID NO: 239070 - RNA, 64 nt, hsa; identical to SEQ ID NO: 61689

SEQ ID NO: 239071 - RNA, 64 nt, hsa; identical to SEQ ID NO: 61690

SEQ ID NO: 239072 - RNA, 64 nt, hsa; identical to SEQ ID NO: 61691

SEQ ID NO: 239073 - RNA, 64 nt, hsa; identical to SEQ ID NO: 61692

SEQ ID NO: 239074 - RNA, 64 nt, hsa; identical to SEQ ID NO: 61693

SEQ ID NO: 239075 - RNA, 64 nt, hsa; identical to SEQ ID NO: 61694

SEQ ID NO: 239076 - RNA, 64 nt, hsa; identical to SEQ ID NO: 61695

SEQ ID NO: 239077 - RNA, 64 nt, hsa; identical to SEQ ID NO: 61696

SEQ ID NO: 239078 - RNA, 64 nt, hsa; identical to SEQ ID NO: 61697

SEQ ID NO: 239079 - RNA, 64 nt, hsa; identical to SEQ ID NO: 61698

SEQ ID NO: 239080 - RNA, 64 nt, hsa; identical to SEQ ID NO: 61699

SEQ ID NO: 239081 - RNA, 64 nt, hsa; identical to SEQ ID NO: 61700

SEQ ID NO: 239082 - RNA, 64 nt, hsa; identical to SEQ ID NO: 61701

SEQ ID NO: 239083 - RNA, 64 nt, hsa; identical to SEQ ID NO: 61702

SEQ ID NO: 239084 - RNA, 64 nt, hsa; identical to SEQ ID NO: 61703

SEQ ID NO: 239085 - RNA, 64 nt, hsa; identical to SEQ ID NO: 61704

SEQ ID NO: 239086 - RNA, 64 nt, hsa; identical to SEQ ID NO: 61705

SEQ ID NO: 239087 - RNA, 64 nt, hsa; identical to SEQ ID NO: 61706

SEQ ID NO: 239088 - RNA, 64 nt, hsa; identical to SEQ ID NO: 61707

SEQ ID NO: 239089 - RNA, 64 nt, hsa; identical to SEQ ID NO: 61708

SEQ ID NO: 239090 - RNA, 64 nt, hsa; identical to SEQ ID NO: 61709

SEQ ID NO: 239091 - RNA, 64 nt, hsa; identical to SEQ ID NO: 61710

SEQ ID NO: 239092 - RNA, 64 nt, hsa; identical to SEQ ID NO: 61711

SEQ ID NO: 239093 - RNA, 64 nt, hsa; identical to SEQ ID NO: 61712

SEQ ID NO: 239094 - RNA, 64 nt, hsa; identical to SEQ ID NO: 61713

SEQ ID NO: 239095 - RNA, 64 nt, hsa; identical to SEQ ID NO: 61714

SEQ ID NO: 239096 - RNA, 64 nt, hsa; identical to SEQ ID NO: 61715

SEQ ID NO: 239097 - RNA, 64 nt, hsa; identical to SEQ ID NO: 61716

SEQ ID NO: 239098 - RNA, 64 nt, hsa; identical to SEQ ID NO: 61717

SEQ ID NO: 239099 - RNA, 64 nt, hsa; identical to SEQ ID NO: 61718

SEQ ID NO: 239100 - RNA, 64 nt, hsa; identical to SEQ ID NO: 61719

SEQ ID NO: 239101 - RNA, 64 nt, hsa; identical to SEQ ID NO: 61720

SEQ ID NO: 239102 - RNA, 64 nt, hsa; identical to SEQ ID NO: 61721

SEQ ID NO: 239103 - RNA, 64 nt, hsa; identical to SEQ ID NO: 61722

SEQ ID NO: 239104 - RNA, 64 nt, hsa; identical to SEQ ID NO: 61723

SEQ ID NO: 239105 - RNA, 64 nt, hsa; identical to SEQ ID NO: 61724

SEQ ID NO: 239106 - RNA, 64 nt, hsa; identical to SEQ ID NO: 61725

SEQ ID NO: 239107 - RNA, 64 nt, hsa; identical to SEQ ID NO: 61726

SEQ ID NO: 239108 - RNA, 64 nt, hsa; identical to SEQ ID NO: 61727

SEQ ID NO: 239109 - RNA, 64 nt, hsa; identical to SEQ ID NO: 61728

SEQ ID NO: 239110 - RNA, 64 nt, hsa
uuuauaaugccacuggaagaggagggauaacuuuuucuguuauuugauuucuuuuauaacuuug

SEQ ID NO: 239111 - RNA, 64 nt, hsa
uggaaaugaacacuuaauggaauuuuuaagucuguucuguuagguagauggugaugcucuuguu

SEQ ID NO: 239112 - RNA, 64 nt, hsa
uggaccguuuagaaugcuauguaaaauguugccauucuguuagauugcuaacuauauacccauc

SEQ ID NO: 239113 - RNA, 64 nt, hsa
uccagaagccuauuucuccuuucauuguuguuauuucuguuauaauacuuuaauuguacaucug

SEQ ID NO: 239114 - RNA, 64 nt, hsa
uugcuuagcuguuuguuuugaugcuuagauuauguucuguuaaugggaauuuaacauauuuaag

SEQ ID NO: 239115 - RNA, 64 nt, hsa
cacacagcucaacgguugauaaaugauucugucauucuguuacaggucauucuuuuacuaggcu

SEQ ID NO: 239116 - RNA, 64 nt, hsa
gaagaaaaggaagaaagaaaaacuguuucaucauuucuguuaggguaggaaaugaaucauaggg

SEQ ID NO: 239117 - RNA, 64 nt, hsa
gcuacugcucuccuggcaaggauuaauuggcacauucuguuaagauaucccucaugacaguugc

SEQ ID NO: 239118 - RNA, 64 nt, hsa
ucuccacacaccccaucacccagauaauuuacaguucuguuaacagugagguugauaaaguauu

SEQ ID NO: 239119 - RNA, 64 nt, hsa
uagugugauauauaaagguguaauuaagacagaguucuguuaaucuaaucaaguuugcuguuag

SEQ ID NO: 239120 - RNA, 54 nt, hsa
ucaauaguaucucagauugaccauuucuguuacuugucauuucuacuuucagaa

SEQ ID NO: 239121 - RNA, 64 nt, hsa
uuuuucacuuguuaggaagcuuuuguuauguauuuucuguuaauaguaccuaaaauugcaacuu

SEQ ID NO: 239122 - RNA, 64 nt, hsa
acuccagcuauguaauaaaaaacuauacucuguguucuguuaaugccucugaguguccuaccuc

SEQ ID NO: 239123 - RNA, 64 nt, hsa
agggaaagauguggccuuuugugaugguuuuauuuucuguuaacacuguguccugggggggcug

SEQ ID NO: 239124 - RNA, 64 nt, hsa
ucaaaugcauugcuuuaaccuuugguuacuuuuauucuguuaaacagaauugaagaaagaguau

SEQ ID NO: 239125 - RNA, 64 nt, hsa
guuguguguguguguuaaaaggagcuaaugcuuauucuguuaauguaaacuuuugaagaucuua

SEQ ID NO: 239126 - RNA, 64 nt, hsa
uuucguauuaugaucuuguucacuuucuguaauuuucuguuaagcuccauuugccaguuuaagg

SEQ ID NO: 239127 - RNA, 64 nt, hsa
uugaaauugaaaucguauuguguggcucuguauauucuguuaaaaaauuaaaggacagaaaccu

SEQ ID NO: 239128 - RNA, 64 nt, hsa
aaauaauuuuccacuuaauaacuguaaaguuuuuuucuguuaauuuaggcauauagaauauuaa

SEQ ID NO: 239129 - RNA, 64 nt, hsa
auaaaugcauaauaugaggucaguggacgccauuuucuguuauaaucauuuuuguuaucuaauu

SEQ ID NO: 239130 - RNA, 64 nt, hsa
ugauauuggaauuauucagaugccuaaauucucauucuguuaugugaagauuuaaauauuuuau

SEQ ID NO: 239131 - RNA, 64 nt, hsa
ccuacaucuccuucuacuaauacuucuaaaaauuuucuguuaugaaaaccuauuuaauuccacu

SEQ ID NO: 239132 - RNA, 64 nt, hsa
acgugccacuguuugaaaucuggucuguuugcauuucuguuaugacagagagaugauguuugca

SEQ ID NO: 239133 - RNA, 64 nt, hsa
cauuucuguuaugacagagagaugauguuugcauuucuguuaugacagagagaugaugaaagua

SEQ ID NO: 239134 - RNA, 64 nt, hsa
gucuuuauaguuguaauaucaccauguuucccauuucuguuaauacuucuaugaaccccuaaag

SEQ ID NO: 239135 - RNA, 64 nt, hsa
uguuaaugugguagcaccuguaacuguguucuuguucuguuaaaaggauugauuugcuuuuaua

SEQ ID NO: 239136 - RNA, 64 nt, hsa
uuuaugaagucaucgugaccaauguuacaguaauuucuguuagcugauugugguaaacaauguu

SEQ ID NO: 239137 - RNA, 64 nt, hsa
auuuauaugcuuuguugacuagcugaaaugugaauucuguuaguguugacuaaagaaucuggua

SEQ ID NO: 239138 - RNA, 64 nt, hsa
gcuuuuaugugaguagcauuucccuaucuugcaguucuguuaacaugaaaauggcauuuuucca

SEQ ID NO: 239139 - RNA, 64 nt, hsa
cagaaaaaccuaagggaugacuagcuuacaaauauucuguuaagggguaguuuuauaaagaaaa

SEQ ID NO: 239140 - RNA, 64 nt, hsa
uccugcuauuuagacaaaaacaacugaucagugguucuguuaugucagcugacuuuguuaguau

SEQ ID NO: 239141 - RNA, 64 nt, hsa
aaaugaugguacuuugacuuuugaggguuuuuauuucuguuauucacaaaauacucauucucau

SEQ ID NO: 239142 - RNA, 64 nt, hsa
uacauugauauuggaauuggaauugguuguuaauuucuguuacuggcuuugcuagaauucauau

SEQ ID NO: 239143 - RNA, 64 nt, hsa
uugagucuaacauauggucccaauuuauuaauacuucuguuaaauuugaugucaggucaacauu

SEQ ID NO: 239144 - RNA, 64 nt, hsa
auaccagccuuauaagguucguauugcuauguucuucuguuauuuauuucagcauggacuguuc

SEQ ID NO: 239145 - RNA, 64 nt, hsa
aauuccuagaaaaguuuguuuuacuuuguuuuuauucuguuaaugcauucuuucuucucuuuac

SEQ ID NO: 239146 - RNA, 64 nt, hsa
uggauauuacaguauuuuuaauugaaaguccuaauucuguuaaggaaaggaguugauuaaauuu

SEQ ID NO: 239147 - RNA, 64 nt, hsa
aggagaugcucugauuguauaggugagacucuguuucuguuauuuuuaauugcuguaugaaaug

SEQ ID NO: 239148 - RNA, 64 nt, hsa
gaaaggcagggaaugugccucuucuguggccagauucuguuauuugcaauuaaagcaaguuuuu

SEQ ID NO: 239149 - RNA, 64 nt, hsa
agauaugucagcuugcuuucaaugagccuugggcuucuguuauugcuugagcauuuggaacucg

SEQ ID NO: 239150 - RNA, 64 nt, hsa
uuuuguugucacaauuuacuguauuuuuuacuuuuucuguuacaguuuugcuaauuuaucagaa

SEQ ID NO: 239151 - RNA, 64 nt, hsa
uugucuaccuagucuaggaggcacagaauucucauucuguuauccaguucauuccagcaaucau

SEQ ID NO: 239152 - RNA, 64 nt, hsa
ccucucuccccaccuucccucucccggcaacaucucugggaaucaacagcauauugacacguug

SEQ ID NO: 239153 - RNA, 64 nt, hsa
aaaccuggcaagucaccugcagcccauggugagcucugggaagugugguugaggccuugggguc

SEQ ID NO: 239154 - RNA, 64 nt, hsa
aaucggagacaaaagcaguuucucuccaacucccucugggaaggugaccuggccagagccaaga

SEQ ID NO: 239155 - RNA, 64 nt, hsa
ggacagauggacagacagccacccugagaaccccucugggaaaaucuauuccugccaccacugg

SEQ ID NO: 239156 - RNA, 64 nt, hsa
cuccuccuccucuccacguucccuugaguaaaugucugggaaagcaugaagcuugaugcaagaa

SEQ ID NO: 239157 - RNA, 64 nt, hsa
ccaugguaauacagauaaaauacauucuuuuaauucugggaaauuagaaaaaguggggugaucu

SEQ ID NO: 239158 - RNA, 64 nt, hsa
uuauauguauaaaaauaggagcaaaagaaaauacucugggaauagucauacugacaaaccaauu

SEQ ID NO: 239159 - RNA, 64 nt, hsa
uacuuuugauuucauuuacuuggcugauagaaacucugggaaacagaaccuagauauuuugugu

SEQ ID NO: 239160 - RNA, 64 nt, hsa
aaguacucuauucucugcacuaacuuacuguccuucugggaacuaugauggggcuucaagggag

SEQ ID NO: 239161 - RNA, 64 nt, hsa
uucugugugugccccucaccccugugugcuagugucugggaaguuucccugaaaggugggaggc

SEQ ID NO: 239162 - RNA, 64 nt, hsa
ccaagagugcagccucugcccggccgccaccccgucugggaagugaggagcgucucugccuggc

SEQ ID NO: 239163 - RNA, 64 nt, hsa
aagugaggagccccucugcccagcagccacccugucugggaagugaggagcgucuccgcccggc

SEQ ID NO: 239164 - RNA, 64 nt, hsa
auucugaagagggagguuuuggugucccugguccucugggaauagaagauccauuugucuuugu

SEQ ID NO: 239165 - RNA, 64 nt, hsa
ggaucaugccagaaauagggauggaagugcauccucugggaaaaagauaauggcuucugauuca

SEQ ID NO: 239166 - RNA, 64 nt, hsa
uggaugaguuaggauuuguaaugcuguugaaguuucugggaacacauaauauguagccaguuua

SEQ ID NO: 239167 - RNA, 64 nt, hsa
ccauucauucugaagauugcauggaggaugaacaucugggaauccuguuaaugagaaggcugaa

SEQ ID NO: 239168 - RNA, 64 nt, hsa
aagaggcuugacucuggucugggcccuguggcccucugggaagcuuuguaccucuuuugcagga

SEQ ID NO: 239169 - RNA, 64 nt, hsa
agcugcuuuuuggggguggaauuccccacucauuucugggaacacauucacacgcccauugcag

SEQ ID NO: 239170 - RNA, 64 nt, hsa
acauauuugaacagugaugaguuuggggcugguuucugggaagggaacguuuauuuaguaaaga

SEQ ID NO: 239171 - RNA, 64 nt, hsa
ucugcucccacugcagcucccggugcucucguguucugggaaggccugggugugugcacaagga

SEQ ID NO: 239172 - RNA, 64 nt, hsa
gcagaaggccuuucccaccuuaagcuuccggggaucugggaauuuuacccccauucucuucugu

SEQ ID NO: 239173 - RNA, 64 nt, hsa
aucuagacaguggaaaaagccauggugugugguuucugggaaccaccaacacuugcagguuuag

SEQ ID NO: 239174 - RNA, 64 nt, hsa
acccaccaccacccaccacagaaaagcacaaaccucugggaaagacaacgucucucgggggcca

SEQ ID NO: 239175 - RNA, 64 nt, hsa
ggccuggcaaguggccacgcccugugucagaccaucugggaauuaagcuccagacagacuuaca

SEQ ID NO: 239176 - RNA, 64 nt, hsa
uuccuuauccucuccaugcugagcuugacaacacucugggaaugaggaacaagacuuuuucuaa

SEQ ID NO: 239177 - RNA, 64 nt, hsa
guucaugguuuccuuugauuggcuauugaacccuucugggaaauguauuuuuguagacuuuaau

SEQ ID NO: 239178 - RNA, 64 nt, hsa
gcccaggugggcacagagaaggguggagagagaaucugggaagagaaauggagaauaagcagca

SEQ ID NO: 239179 - RNA, 64 nt, hsa
gcaaugagauguuugggaaguauuguguaguacuucugggaaagaucuccuugauacaacauug

SEQ ID NO: 239180 - RNA, 64 nt, hsa
guagaagucauggacuuuucugggaaaugacuuuucugggaaaugacaguuucuuugacauauu

SEQ ID NO: 239181 - RNA, 64 nt, hsa
aguugguagaauccauguagaagucauggacuuuucugggaaaugacuuuucugggaaaugaca

SEQ ID NO: 239182 - RNA, 64 nt, hsa
gcuaaaagcaugggaaauguaaaggcagucuuucucugggaaauggaugcuauucuauucugcu

SEQ ID NO: 239183 - RNA, 64 nt, hsa
cuccagccagcugcugcagacaaaagaucacauuucugggaagaugagaacuuguuuccagacc

SEQ ID NO: 239184 - RNA, 64 nt, hsa
ucccuccuccuguccucccccgcacccccucccuucugggaaacaagaagaguaaacaggaaac

SEQ ID NO: 239185 - RNA, 64 nt, hsa
cucagcgcuuaaaaaaacaaauuggacagcuacuucugggaaaaacaacaucauuccaaaaaga

SEQ ID NO: 239186 - RNA, 64 nt, hsa
gucuaggccucggugcuggccuggguucuagaucucugggaaccagugccugagucacagcugu

SEQ ID NO: 239187 - RNA, 64 nt, hsa
aucaguggugagugacuggccuggguucuagaccucugggaaccagcaccugagucacagcugu

SEQ ID NO: 239188 - RNA, 64 nt, hsa
ggacagaggcaucuggaugaaaaucucgacgcuuucugggaacagcuuccaauggcaugggagu

SEQ ID NO: 239189 - RNA, 64 nt, hsa
ccuggcugguaagggccaagucccaccgguugcuucugggaagggguuucuaacacuagucugu

SEQ ID NO: 239190 - RNA, 64 nt, hsa
cugccuaagaggcaaugaguguguuggcuugugaucugggaacucccaagaacagcaggcccac

SEQ ID NO: 239191 - RNA, 64 nt, hsa
augcagaucugcguggcuggugcgugcgcgcgcuucugggaaacagucccgcgugcaaaggaaa

SEQ ID NO: 239192 - RNA, 64 nt, hsa
ccccagucaagcuccuaguaugcccuguaauuuuucugggaaguccuagccccucacuuccagc

SEQ ID NO: 239193 - RNA, 64 nt, hsa
ccaaggaggccuuggaaacgauucccccagucauucugggaacauguuguaagcacugacuggg

SEQ ID NO: 239194 - RNA, 64 nt, hsa
ucccuucuacagccucagaaaccagacucguucuucugggaacccugcccacucccaggaccaa

SEQ ID NO: 239195 - RNA, 64 nt, hsa
ggccagcgguauugcugaaggaaaggggcagcucucugggaagugggcccucagagauuacucu

SEQ ID NO: 239196 - RNA, 64 nt, hsa
acugugaagauaguuuauuuuuauuccuugccaaucugggaauaugccuuuuuuguguguuugu

SEQ ID NO: 239197 - RNA, 64 nt, hsa
guaagauuaacaaauagguaacuaauugccuaagucugggaacugcuuccacugggacaaaaca

SEQ ID NO: 239198 - RNA, 64 nt, hsa
ugcucuaggggacgagcuccaagcaaagccuggcucugggaaaacuucccauucuuagucaacc

SEQ ID NO: 239199 - RNA, 64 nt, hsa
cauccaucaucugcugcacauagcagacuagaauucugggaacccugugcaauucagucugcuc

SEQ ID NO: 239200 - RNA, 64 nt, hsa
cucagcucagcuucgugccuggguuccccacuggucugggaagacuguugugcuccauagagca

SEQ ID NO: 239201 - RNA, 64 nt, hsa
cauuuguacuucuuguaagaccaucuuuaauuuuucugggaacacaccugccuuuuguguaaug

SEQ ID NO: 239202 - RNA, 64 nt, hsa
gggucuuguucucccaucuguuuauucuuugggcucugggaacaggggacuacuuuggggcuuu

SEQ ID NO: 239203 - RNA, 64 nt, hsa
ccuugagaagauucuucccauucuccauuuguuaucugggaacuuauuaaauggaaacugaaac

SEQ ID NO: 239204 - RNA, 64 nt, hsa
aaugagauuaauuccuuuccagguauuuuauaauucugggaagcaaaacccaugccucccccua

SEQ ID NO: 239205 - RNA, 64 nt, hsa
uaggugcaguggcuuguuccuguagucccagcacucugggaaccuggguugggaggauugcuua

SEQ ID NO: 239206 - RNA, 64 nt, hsa
uuccuugcuauuggagcuguuuuuccaagcaauaucugggaagagauuucucccucuagcacuu

SEQ ID NO: 239207 - RNA, 64 nt, hsa
agaggauugcuugagcccaggaguucaauaccugucugggaaacaccucaucucuacaaaauac

SEQ ID NO: 239208 - RNA, 53 nt, hsa
acgacccguuacccaccuagaggaagcgcgaugcuggaacacaucccugccuc

SEQ ID NO: 239209 - RNA, 64 nt, hsa
cccuaauccgcccacaggaagccugcaguccuggaagcgcgagggccucaaaggcccgcucuac

SEQ ID NO: 239210 - RNA, 64 nt, hsa
ggcgacuccugguguucgccccggacaagcgguuaagcgcgacccaggcacugcagcaccccua

SEQ ID NO: 239211 - RNA, 64 nt, hsa
gcugccccucggacuccucgagggguugggugcuaagcgcgagccucgccgucccugcuggagc

SEQ ID NO: 239212 - RNA, 63 nt, hsa
augaagaucagcuuggauaaaucugaaucaaagaagcgcgacaauucuggacagucaacuucc

SEQ ID NO: 239213 - RNA, 64 nt, hsa
gcugcagaugcuuagcugggccagggauugacccaagcgcgaugcagcaggcaggcucagaaga

SEQ ID NO: 239214 - RNA, 64 nt, hsa
cuggcuuccccagccugcggccgcaagcaaaaccaagcgcgagaugcagcuagcacccuucaua

SEQ ID NO: 239215 - RNA, 64 nt, hsa; identical to SEQ ID NO: 226314

SEQ ID NO: 239216 - RNA, 64 nt, hsa; identical to SEQ ID NO: 226315

SEQ ID NO: 239217 - RNA, 64 nt, hsa; identical to SEQ ID NO: 226316

SEQ ID NO: 239218 - RNA, 64 nt, hsa; identical to SEQ ID NO: 226317

SEQ ID NO: 239219 - RNA, 64 nt, hsa; identical to SEQ ID NO: 226318

SEQ ID NO: 239220 - RNA, 64 nt, hsa; identical to SEQ ID NO: 226319

SEQ ID NO: 239221 - RNA, 64 nt, hsa; identical to SEQ ID NO: 226320

SEQ ID NO: 239222 - RNA, 64 nt, hsa; identical to SEQ ID NO: 226321

SEQ ID NO: 239223 - RNA, 64 nt, hsa; identical to SEQ ID NO: 226322

SEQ ID NO: 239224 - RNA, 64 nt, hsa; identical to SEQ ID NO: 226323

SEQ ID NO: 239225 - RNA, 64 nt, hsa; identical to SEQ ID NO: 226324

SEQ ID NO: 239226 - RNA, 64 nt, hsa; identical to SEQ ID NO: 226325

SEQ ID NO: 239227 - RNA, 64 nt, hsa; identical to SEQ ID NO: 226326

SEQ ID NO: 239228 - RNA, 64 nt, hsa; identical to SEQ ID NO: 226327

SEQ ID NO: 239229 - RNA, 64 nt, hsa; identical to SEQ ID NO: 226328

SEQ ID NO: 239230 - RNA, 64 nt, hsa; identical to SEQ ID NO: 226329

SEQ ID NO: 239231 - RNA, 64 nt, hsa; identical to SEQ ID NO: 226330

SEQ ID NO: 239232 - RNA, 64 nt, hsa; identical to SEQ ID NO: 226331

SEQ ID NO: 239233 - RNA, 64 nt, hsa; identical to SEQ ID NO: 226332

SEQ ID NO: 239234 - RNA, 64 nt, hsa; identical to SEQ ID NO: 226333

SEQ ID NO: 239235 - RNA, 64 nt, hsa; identical to SEQ ID NO: 226334

SEQ ID NO: 239236 - RNA, 64 nt, hsa; identical to SEQ ID NO: 226335

SEQ ID NO: 239237 - RNA, 64 nt, hsa; identical to SEQ ID NO: 226336

SEQ ID NO: 239238 - RNA, 64 nt, hsa; identical to SEQ ID NO: 226337

SEQ ID NO: 239239 - RNA, 64 nt, hsa; identical to SEQ ID NO: 226338

SEQ ID NO: 239240 - RNA, 64 nt, hsa; identical to SEQ ID NO: 226339

SEQ ID NO: 239241 - RNA, 64 nt, hsa; identical to SEQ ID NO: 226340

SEQ ID NO: 239242 - RNA, 64 nt, hsa; identical to SEQ ID NO: 226341

SEQ ID NO: 239243 - RNA, 64 nt, hsa
uuugcuucaaauaaacuuauuugaaaaguugucucaagucaaauggauucaucaccugucaugc

SEQ ID NO: 239244 - RNA, 64 nt, hsa
cccacugugauuggcacaucgacaagggcugucccaagucaauggaaagggaaagggugggggu

SEQ ID NO: 239245 - RNA, 64 nt, hsa
aguccugaagucuggaggcuagacuuccugaaagcaagucaagaauauagagcaccuugcagga

SEQ ID NO: 239246 - RNA, 64 nt, hsa
ugaggccuacucuaaagaauucuugaaaaacuuacaagucaagccuagccugauaauccuauua

SEQ ID NO: 239247 - RNA, 64 nt, hsa
uucucaaagaaaaucuuugaaagaaucaggaggucaagucaagaacaugaaaauuuauauuuua

SEQ ID NO: 239248 - RNA, 64 nt, hsa
gggggaagcaccauaacuuuguuuagcccaaaaccaagucaagugaaaaaggaggaagagaaaa

SEQ ID NO: 239249 - RNA, 64 nt, hsa
acagacugaagacagaggucguuugauuucaaagcaagucaaccugcuuuuuucuguuuuuaca

SEQ ID NO: 239250 - RNA, 64 nt, hsa
ugaagcaaccaaagauauauccaagugcuuccuccaagucaacauguauuuccucuccccauuu

SEQ ID NO: 239251 - RNA, 64 nt, hsa
aaagugucaguucuaauggggaaauauauuccaucaagucaaagaguaauaacugcucacuagu

SEQ ID NO: 239252 - RNA, 64 nt, hsa
gcaccuaaaaucuaauuagaauucucugggucaacaagucaaggugguauugaucuguguuaau

SEQ ID NO: 239253 - RNA, 64 nt, hsa
ccuaucgggcucccugcggggcuuucucucacuacaagucaagcuugggcucucaaagcccugc

SEQ ID NO: 239254 - RNA, 64 nt, hsa
uguccucaguauccaggaacauaaaggcaagaagcaagucaacuuaccuauuaaauauuccucu

SEQ ID NO: 239255 - RNA, 64 nt, hsa
acuggggaaaagcuguaguaucuucuuuguuuagcaagucaaacuucacagcuggggaaguuga

SEQ ID NO: 239256 - RNA, 64 nt, hsa
ccaaguucuucccauccuaacagaaguaacccagcaagucaaggccaggaggaccaggggugca

SEQ ID NO: 239257 - RNA, 64 nt, hsa
ggccuaauuuuauaucuauaaauauauuaaaaagcaagucaaacuuggauguaucaagguaaaa

SEQ ID NO: 239258 - RNA, 60 nt, hsa
aggugcuagaauugguaugaaggguuaacucaagucaaauuguacuugauccugcugaaa

SEQ ID NO: 239259 - RNA, 64 nt, hsa
aaauaccuuuaaagacaugcacuuuccauauuuucaagucaauuuuaacuaaaaacuaagauaa

SEQ ID NO: 239260 - RNA, 64 nt, hsa
aguggaaggagggggaagcagcaggacacauuggcaagucaagcaggaaggagggagauggaaa

SEQ ID NO: 239261 - RNA, 64 nt, hsa
uggagauuggcaugccauugaaacuaagagcucucaagucaaggaagcugggcugggcaguauc

SEQ ID NO: 239262 - RNA, 64 nt, hsa
acaagucuguacuauccacuauguaaauggcucacaagucaauugcaaacaaacugaauguaca

SEQ ID NO: 239263 - RNA, 64 nt, hsa
auuugggggaaaaagaaugcaggagugaaauaaccaagucaaaaccauguacuaucuccuuggg

SEQ ID NO: 239264 - RNA, 64 nt, hsa
guguuuagauuuaugguuguuaaaaaugucaucucaagucaagucacuggucuguuugcauuug

SEQ ID NO: 239265 - RNA, 64 nt, hsa
uaaauauauguuuguuuguuuuuuuaaugaaaaacaagucaagcuagcauccaguuacuauaua

SEQ ID NO: 239266 - RNA, 64 nt, hsa
aaaagccuuuaaaacaaaaagccaucguagguaucaagucaacaugaaauuggaaugcaaaauu

SEQ ID NO: 239267 - RNA, 64 nt, hsa
uuccgcuuucaugggacaugagugaaaaugaaaccaagucaauaugagguaccuuuacagauuu

SEQ ID NO: 239268 - RNA, 64 nt, hsa
gaagugaaaacaaucagggcacauuaaaaugauacaagucaaauaaaucuuaaagacacaaugc

SEQ ID NO: 239269 - RNA, 64 nt, hsa
cuucuagaaguuguacagaaggacuaaagcuuaucaagucaacaaagaacuuaccuuggaggau

SEQ ID NO: 239270 - RNA, 64 nt, hsa
gugcaacaguagcauaggacccuacccucugggccaagucaaagacauucugacaucuuaguau

SEQ ID NO: 239271 - RNA, 64 nt, hsa
auuuaaaaaaaaaaaaaaaaagcaggaaagaucccaagucaaacaguguggcuuaaacauuuuu

SEQ ID NO: 239272 - RNA, 64 nt, hsa
ucuuaaauaaugacuguguuuuauuguuuugauccaagucaaguguagccucucagccuuuugg

SEQ ID NO: 239273 - RNA, 64 nt, hsa
cucacugccucaguuuggguaaaggaugagcagacaagucaacuaaagaaaaaagaaaagcaag

SEQ ID NO: 239274 - RNA, 64 nt, hsa
uucuuccuuuuuucccucuguuuauauugcacaucaagucaaaaacauguuugggaaagauggu

SEQ ID NO: 239275 - RNA, 64 nt, hsa
ggguguggagggaggaagggggucuaaggucuaucaagucaaucauuucucacuguguacauaa

SEQ ID NO: 239276 - RNA, 64 nt, hsa
guuuuaaagaagaacuguaaaugacggugcuauacaagucaaaaaauacaugccugccucguag

SEQ ID NO: 239277 - RNA, 64 nt, hsa
uuaggguucaguuuaucacuggacauucaggaggcaagucaaucuuuuuuauuuccuuauaaaa

SEQ ID NO: 239278 - RNA, 64 nt, hsa
aaaauacucaacauuauuauucauuagggaaaugcaagucaaaaucacaaugagauuccaguuu

SEQ ID NO: 239279 - RNA, 64 nt, hsa
uggugugccuuuucuuggcaggauugaucuugagcaagucaaugaaccucugcaucaauuuccu

SEQ ID NO: 239280 - RNA, 64 nt, hsa
ggacagguuuacuuagaaauccuguuucuaaaugcaagucaagcuuuauuguuaggcuugcugc

SEQ ID NO: 239281 - RNA, 64 nt, hsa
uuuaguaggaguguaaagugacauucuuaugaaacaagucaaaaaaguuuuuuucaggccaguu

SEQ ID NO: 239282 - RNA, 64 nt, hsa
cuucaaacauaggugaaaaaaacacugccauucacaagucaaggaacccagggccagcuggaag

SEQ ID NO: 239283 - RNA, 64 nt, hsa
guccagagucuaggcaauuuuuacaaccugaguucaagucaaauucugagccugggggguccuc

SEQ ID NO: 239284 - RNA, 64 nt, hsa
cuugugacaaaacaucuuucaaaacuuaccuugucaagucaaaauuuguuuuaguaccuguuua

SEQ ID NO: 239285 - RNA, 64 nt, hsa
ugauugaaaaauugccauauuuugauguauaggacaagucaacugagauccagagaauccugga

SEQ ID NO: 239286 - RNA, 64 nt, hsa
agggugagauuaaccuuuuugcuaaaguaauuuacaagucaaagacaggaagagaucagaguga

SEQ ID NO: 239287 - RNA, 64 nt, hsa
guuucugcuuucuugccuaaaucaaagacuauuucaagucaacaacacugaaaacugcuuuucg

SEQ ID NO: 239288 - RNA, 64 nt, hsa
uauuagugagaugggaggauuuacagaagaaaagcaagucaaaaauauuuccuuuuugauguaa

SEQ ID NO: 239289 - RNA, 64 nt, hsa
gaaaaauauuuaugaagcaucucaacuugaagaucaagucaaaguuauaacucaggaucugagg

SEQ ID NO: 239290 - RNA, 64 nt, hsa
guaguauuuuugaucacuucaaauacauacucuucaagucaagaaauaaauuucuuuacauaga

SEQ ID NO: 239291 - RNA, 64 nt, hsa
auagucugacuuugcuuuugaacaacagacauugcaagucaaaauuguugucaaauuuacauau

SEQ ID NO: 239292 - RNA, 64 nt, hsa
gaacaacaccagggaaugccaaaaaaacaaagggcaagucaaccaaggcauuuugagaacauga

SEQ ID NO: 239293 - RNA, 64 nt, hsa
auauaaaacauaugaauauaaagaaagaaagagacaagucaaauguaguaaaaugacaacacuu

SEQ ID NO: 239294 - RNA, 64 nt, hsa
auccuggcucacugcagccucuaauuccugggcucaagucaagugguucuccugccucagccuu

SEQ ID NO: 239295 - RNA, 64 nt, hsa
aauggcaauuaaaugugaaacccaguuucuugggcaagucaaauucuggaaucacauccaccua

SEQ ID NO: 239296 - RNA, 64 nt, hsa
agauuggcuaaauauuuuauuaggaaacaguuuucaagucaauaauuuuuuuaacauuucaugu

SEQ ID NO: 239297 - RNA, 64 nt, hsa
uuaauauuagacaaacaguagacaaaugcagcagcaagucaauuguauuagcagaauauugucc

SEQ ID NO: 239298 - RNA, 64 nt, hsa
uguauguacaugggguccuucaacugaggccuugcaagucaagcuggcugugccauguuuguag

SEQ ID NO: 239299 - RNA, 64 nt, hsa
aauaauaauaaauaaauaaauaaaaauccaaacccaagucaaaaccuuggcuccagcaugaaaa

SEQ ID NO: 239300 - RNA, 64 nt, hsa
cacagccccgacaucaacuccuucuagcauccagcaagucaaugucaccgacagugaugaggag

SEQ ID NO: 239301 - RNA, 64 nt, hsa
ccacugugccuagucacuuuaauugagauauuggcaagucaacugccaugcagagcccagggca

SEQ ID NO: 239302 - RNA, 64 nt, hsa
gagagauucuuggcauguaauauauaucacugcucaagucaagccuccuaaaaccacagaccug

SEQ ID NO: 239303 - RNA, 64 nt, hsa
uauauggcugaucaauuuucauacauugagaaaccaagucaaucaagcaggaaucauuuaaaaa

SEQ ID NO: 239304 - RNA, 64 nt, hsa
auuucuagauucuccuuuguacagagucacuucacaagucaagcuacuguuuuacaggugcucc

SEQ ID NO: 239305 - RNA, 64 nt, hsa
cauauacagcucucugcuccguguccccugggcucaagucaagcagucggugacagauuucauu

SEQ ID NO: 239306 - RNA, 64 nt, hsa
ucaagcccaauggcuugaugacuucaauaguaaccaagucaagguucucuuggcuggacaucau

SEQ ID NO: 239307 - RNA, 64 nt, hsa
ggaaaccccggaacaaugccaauguauaaaaccccaagucaagggccuaccaaggcaauuggau

SEQ ID NO: 239308 - RNA, 64 nt, hsa
cuccaaaaguguuauuuguaaguuaauuuuuuuacaagucaaacaauguuggaagugguauuua

SEQ ID NO: 239309 - RNA, 64 nt, hsa
cuugguuucagaaagaagauaaacugugauuugacaagucaagcucuuaagaaauacaaggacu

SEQ ID NO: 239310 - RNA, 64 nt, hsa
aaaacacaguaacaggaugaauauuaucugauaucaagucaaaaucaguuugaaaagaaggugu

SEQ ID NO: 239311 - RNA, 64 nt, hsa
augcaaauuucagaggcuucuuuugaagauuccccaagucaagcaggcaagaugccuagaucuu

SEQ ID NO: 239312 - RNA, 64 nt, hsa
caguuucaucagcauuacuugggaaaacguguugcaagucaaccagucacuaggauauuucuac

SEQ ID NO: 239313 - RNA, 64 nt, hsa
cuggcccaaggggagugccuccuucgucaagcuccaagucaaggucccucugugugccugugcc

SEQ ID NO: 239314 - RNA, 64 nt, hsa
uccaaaggagacauuggaccaguuaauucccauacaagucaagguaacagaacaaaagggaauc

SEQ ID NO: 239315 - RNA, 64 nt, hsa
uguguucucuaagaguuuggcuaacucccauaugcaagucaauucauuuaaugugccaagaggu

SEQ ID NO: 239316 - RNA, 64 nt, hsa
agggggcagguggggaggggaagccauggaaauacaagucaaaggggugagaugcgugcaggcc

SEQ ID NO: 239317 - RNA, 64 nt, hsa
cccugggggccuguagccaccaguucauaggugccaagucaauaaagcauugucccccgucucu

SEQ ID NO: 239318 - RNA, 64 nt, hsa
auaugaaaguauuguuuauagauaauuuaucucacaagucaaaaaugaagauuuugcagcacug

SEQ ID NO: 239319 - RNA, 64 nt, hsa
uucugacuuuuagaaacaaaauucuaaaaauuugcaagucaaguaaguguggguagcaaaaaca

SEQ ID NO: 239320 - RNA, 64 nt, hsa
ucuuugccuucuccaaacaagaagcaauagucuccaagucaauauaaauucuacagaaaauagu

SEQ ID NO: 239321 - RNA, 64 nt, hsa
uucaaaccagaugccuguacuaguuuuuagaccccaagucaaccuuucugagccacagcuuccc

SEQ ID NO: 239322 - RNA, 64 nt, hsa
cgucccacacugccccccauuugaguacaccgcacaagucaaacgcuaggaaguuugaauaaaa

SEQ ID NO: 239323 - RNA, 64 nt, hsa
gcauucuaacacuuuuauucccacagaaaaauuccaagucaaauuaucaaaucaaauacaaaaa

SEQ ID NO: 239324 - RNA, 64 nt, hsa
cugcaucccacguucuguuaauuuaguaaauaaacaagucaaagacuuguggaaaauaggaagu

SEQ ID NO: 239325 - RNA, 64 nt, hsa
agggcaguacccuccauugggcacaguccagacccaagucaaagaugccccauuccuugcgccu

SEQ ID NO: 239326 - RNA, 64 nt, hsa
gauaauuuuuccagucuuaagcucuguccaccuucaagucaauucauaaccaaguuuuugaacg

SEQ ID NO: 239327 - RNA, 64 nt, hsa
uuauguaucaguuauacagguaucccaccaaguucaagucaaaagaaauuccuaacuuuguaua

SEQ ID NO: 239328 - RNA, 64 nt, hsa
aggucuaaaagucuuuauauuauauacucuguaucaagucaaaauaucuuuggccauuuugcua

SEQ ID NO: 239329 - RNA, 64 nt, hsa
aaagauccuuaauauuguuagccauagggaaaugcaagucaaacucaaaucagaaugaaauauc

SEQ ID NO: 239330 - RNA, 64 nt, hsa
acagguuuuaugauaauagaacuaugacagucuucaagucaauuaaaauccacccaccagucuu

SEQ ID NO: 239331 - RNA, 64 nt, hsa
agggaugguuggggauacuucccaaaacuuuuuccaagucaacuugguguagccgguuccccgg

SEQ ID NO: 239332 - RNA, 64 nt, hsa
ccauuuugucauuuuuguuuaaacugauaaauuacaagucaacauugaguuuuauacuuguguu

SEQ ID NO: 239333 - RNA, 64 nt, hsa
gccugggugggagaacagguuucuaguuuuuacccaagucaagcugcacaucuauuauuuaaaa

SEQ ID NO: 239334 - RNA, 64 nt, hsa
ucugcccugcacuuugcauaucuguauagaaaaucaagucaaucccccauccucacacccacuc

SEQ ID NO: 239335 - RNA, 64 nt, hsa
cugaaugacucaggguacccuauagggggaagagcaagucaaaugagcauaguggggaaagaaa

SEQ ID NO: 239336 - RNA, 64 nt, hsa
gacgacagggaucuucaggaacuucugaccucaccaagucaaguggaccacucuccacuccacg

SEQ ID NO: 239337 - RNA, 64 nt, hsa
agacgacccaucucagaaugguggaucaaagcagcaagucaauuugccuuguaugcaacuuaug

SEQ ID NO: 239338 - RNA, 64 nt, hsa
uguaguuucuugaggccaaacacacuguauuuuacaagucaaaauauaauuuacauuaaucacu

SEQ ID NO: 239339 - RNA, 64 nt, hsa
auggauuuaacagcaccucaaagucaacaugccccaagucaaagucuucuuuacccauggaaua

SEQ ID NO: 239340 - RNA, 64 nt, hsa
aauucccuacuaucaucacaugccuccccaaccccaagucaaaaacaagaggaaugguacuaca

SEQ ID NO: 239341 - RNA, 64 nt, hsa
caaaguccagccgagucaaaggaaagagaaaagacaagucaagagagaaagugggaccaggggg

SEQ ID NO: 239342 - RNA, 64 nt, hsa
uuuuugcagauucaaaaucugcaaugguuauuuacaagucaaucuacugaauuccuuuuuuaaa

SEQ ID NO: 239343 - RNA, 64 nt, hsa
cuccugacucauuaauaauggauaccauucucaacaagucaauccaagucagcccguuaaggag

SEQ ID NO: 239344 - RNA, 64 nt, hsa
uaucagugaaagcuggacuugagcuguguaccaccaagucaaugauuaugucaugugaaaaugu

SEQ ID NO: 239345 - RNA, 64 nt, hsa
uuauaaguuauguaagaaucaucgccuuguggaacaagucaaucagugacuagcuuccuguagc

SEQ ID NO: 239346 - RNA, 64 nt, hsa
cacaaucagugugaauaaauucacuucagaaucucaagucaaggccaggcacggcggcucacgc

SEQ ID NO: 239347 - RNA, 64 nt, hsa
aagcaucugccuccaggaccauucaggcuguugacaagucaacuccucauggcuguaggacuga

SEQ ID NO: 239348 - RNA, 64 nt, hsa
ugacuucauaaaagccaucucagagccauugauacaagucaaucuuacuauauguaacuucaga

SEQ ID NO: 239349 - RNA, 64 nt, hsa
gaguaauaaauucacaugaaaaggagacaauaaucaagucaaaagaauaaaugcuuacuaauca

SEQ ID NO: 239350 - RNA, 64 nt, hsa
uuuaauuucucuugaaaauaauuuccucaaagcccaagucaauaaauguuaucagccagucuuc

SEQ ID NO: 239351 - RNA, 64 nt, hsa
uuaauguccauucccuccuaacaaauucucuucccaagucaacugcaacugcggcugaaucacc

SEQ ID NO: 239352 - RNA, 64 nt, hsa
aaagagccuauauuccucuuuuucccacaccgaucaagucaacucaguacucacgggagaaaaa

SEQ ID NO: 239353 - RNA, 64 nt, hsa
cugccaagguaccuagguuggaguccagccuaaucaagucaaauggagaaacaggcccagagag

SEQ ID NO: 239354 - RNA, 64 nt, hsa
aauguccauugucucuccuaacaaauucucuccccaagucaacugcaauugcagcugaaucacc

SEQ ID NO: 239355 - RNA, 64 nt, hsa
acaagcucagucuaaucaaacaccagaacccuaucaagucaaaagagcuggggccaggcagcug

SEQ ID NO: 239356 - RNA, 64 nt, hsa
gucguuuuuuuuaaaaaaauuuuuuaauuaaauucaagucaaauuugcagaacccuguaucucc

SEQ ID NO: 239357 - RNA, 64 nt, hsa
cuggacaagauggguaagggcuucauuccuucaacaagucaagucauacuuggccucucccuga

SEQ ID NO: 239358 - RNA, 64 nt, hsa
aaccagagggugcacaugacuugaucccuaugaccaagucaaguugguguugcccaaaucgcag

SEQ ID NO: 239359 - RNA, 64 nt, hsa
uuaaaauaaaaggggagaagaacaaacuagcugucaagucaaggacuggcuuucaccuugcccu

SEQ ID NO: 239360 - RNA, 64 nt, hsa
uuuguuuguuuguuuaauuuuuauuucuuccuaccaagucaaacuuggauacuuggauuuaguu

SEQ ID NO: 239361 - RNA, 64 nt, hsa
uccaugaagccagggcacaaagaauuugacaguacaagucaaaucccccaccccacaaaauaug

SEQ ID NO: 239362 - RNA, 64 nt, hsa
uggggcuaugcaugaaacccaacacuaaauuuugcaagucaaguaaccaaaaaagggggaggca

SEQ ID NO: 239363 - RNA, 64 nt, hsa
ucccccauucucuaaucaccauuauuaaucauaucaagucaauuaguuugguuucacacuaaua

SEQ ID NO: 239364 - RNA, 64 nt, hsa
ucacuucacacagaccuuuugccuuuuuuagcugcaagucaaggacuagguugaugaugcccau

SEQ ID NO: 239365 - RNA, 64 nt, hsa
uguuuuaguaguaagguuuucuuuuucuauuguacaagucaaugaaauaugaucacgcaacuua

SEQ ID NO: 239366 - RNA, 64 nt, hsa
uguguuuaauuuuuaaaaaguuuuuauugagauacaagucaauaccauaaagcucucacccuuc

SEQ ID NO: 239367 - RNA, 64 nt, hsa
uguagggccuguacaaauaaaugcaaaaucauuucaagucaauugccauuauuuguauugaagu

SEQ ID NO: 239368 - RNA, 64 nt, hsa
uuugagaauugugaaacagauaguuauauguauacaagucaaagaacaacuuaacuauugcugc

SEQ ID NO: 239369 - RNA, 64 nt, hsa
uuccaaagagaaaaaaaguuugccagaaguuugucaagucaaccaauguagaaagcuuugcuua

SEQ ID NO: 239370 - RNA, 64 nt, hsa
auaccuguuccacugagcuccuguugcuuaccaucaagucaacaguuaucagcacucagacaug

SEQ ID NO: 239371 - RNA, 64 nt, hsa
cgucuccucccucuccuucccugggcucccuuuccaagucaagaaaugcuuugucugucacuac

SEQ ID NO: 239372 - RNA, 63 nt, hsa
uuccuccuaccaacuccugaggagcuucaguugcaagucaaugccaaggacccaacugcagca

SEQ ID NO: 239373 - RNA, 64 nt, hsa
cuuugguucuugaauagcuuaguuucuuuaauaacaagucaaacuuuauuacaacaauaacuga

SEQ ID NO: 239374 - RNA, 64 nt, hsa
uaccucucgcucccaugcccaucacuacagaccccaagucaagaugaauaucauagccuuuacu

SEQ ID NO: 239375 - RNA, 64 nt, hsa
uaucuacuauauaugacuggaagaagugguucuucaagucaacccucuuacaagacuuagugga

SEQ ID NO: 239376 - RNA, 64 nt, hsa
aaacccaaaggggcuucacugaagagcccacuuccaagucaauaaaaagcaacuccugccuccc

SEQ ID NO: 239377 - RNA, 64 nt, hsa
aacuuacuaauagggauguuaaaaguaacaaaaccaagucaaacuugguguauuuuuauuuuaa

SEQ ID NO: 239378 - RNA, 64 nt, hsa
uuuaaaugagacuuguuuuccccucucuuugagucaagucaaauauguagauugccuuuggcaa

SEQ ID NO: 239379 - RNA, 64 nt, hsa
ggaaugauauaauuauacaaguaaugccaaaaaccaagucaaagccuaauuaaccaaagcacuc

SEQ ID NO: 239380 - RNA, 64 nt, hsa
aauagauggagacaaaggacaaggugaaauguaucaagucaaagugaaucauuuaguugacucu

SEQ ID NO: 239381 - RNA, 64 nt, hsa
ccucucccccucauaaccccaccuaacauaaggacaagucaauuugucaguagcuucuucuggc

SEQ ID NO: 239382 - RNA, 64 nt, hsa
gugugggaggacaugggguaccaccuacacccaacaagucaaugagggacuucuuuuuaauuug

SEQ ID NO: 239383 - RNA, 64 nt, hsa
aauaacgaugaaugucuuuuugguuguaauuuaacaagucaaauaaaauaaucauugcugagca

SEQ ID NO: 239384 - RNA, 64 nt, hsa
aagggaugcuagaaauucaacugaagaaaaaaagcaagucaaguacguauucagcauuaaagau

SEQ ID NO: 239385 - RNA, 64 nt, hsa
ugauaaagguagaggcacaaagaggcaaacuaagcaagucaaauucuaauguguguacuucaua

SEQ ID NO: 239386 - RNA, 64 nt, hsa
gcauugcacacuuuuuccuuucuaaacuuaaagacaagucaaaaagccauucuuagaacuagag

SEQ ID NO: 239387 - RNA, 64 nt, hsa
cuagcaguccaugacuuuuuaaggaaauguaauacaagucaaaccaggcaauacagaggagaag

SEQ ID NO: 239388 - RNA, 64 nt, hsa
cauuuaauuccuaugacuuuuguuuuguauugcccaagucaaacuacaucacuuguaucuccag

SEQ ID NO: 239389 - RNA, 64 nt, hsa
accccacucccaaugaugaggggcauuuucauugcaagucaaaggcaagacaggcuuccauaaa

SEQ ID NO: 239390 - RNA, 64 nt, hsa
uguuguuuagguuagugucacagccauuacagcacaagucaaagucgccaguugaauuuucauu

SEQ ID NO: 239391 - RNA, 64 nt, hsa
uaucuuuauuaaucacuauuguuccagcaguuuucaagucaaauuaauaaucuuauuagggaga

SEQ ID NO: 239392 - RNA, 64 nt, hsa
ccacuuuaauuuaaaaguucaugucauuuaaaaacaagucaagaaauuaaaauuguaucagagg

SEQ ID NO: 239393 - RNA, 64 nt, hsa
uguccugcggaccccagagcccccgggaagggcgcaagucaaagagcacuggaggcaccgccgg

SEQ ID NO: 239394 - RNA, 64 nt, hsa
gguccaguacccuucaaccaugcugugaucggugcaagucaagaacucuuaacuggaagaaauu

SEQ ID NO: 239395 - RNA, 64 nt, hsa
auauacacauuuguguauguggaaaugugcugggcaagucaaaacuauagaagaguugccuccu

SEQ ID NO: 239396 - RNA, 64 nt, hsa
cuuuuuuugcacuguugaaauugggcuuggcacucaagucaaagaugaacaucggaauaacaaa

SEQ ID NO: 239397 - RNA, 64 nt, hsa
gccuggauggagcuccagggcuggggaacguccgcaagucaaugcucagagaugcccggagcug

SEQ ID NO: 239398 - RNA, 64 nt, hsa
uucucacagagcuggggaguugguggcaacuuuccaagucaaggucuugcuuagaaaguccuuc

SEQ ID NO: 239399 - RNA, 64 nt, hsa
gcuugcucccugcucccacacaggcucaauaaagcaagucaaagccacagccuguccugugucu

SEQ ID NO: 239400 - RNA, 64 nt, hsa
ucaacucucuucggucguauccaccuugcacccgcaagucaagccgccccuuguagaaaaaucc

SEQ ID NO: 239401 - RNA, 64 nt, hsa
ccucuuggagaagcuguugcugagaccccccccccaagucaaucagaaccacaacagguugguc

SEQ ID NO: 239402 - RNA, 64 nt, hsa
cacugccugccagaaaacaaaaacaccaagaaaccaagucaacuuuucaccuccugaguuuauu

SEQ ID NO: 239403 - RNA, 64 nt, hsa
uaaaacaaaaaagaauccuagauaguuuucccuucaagucaagcgucuuguuguuuaaauaaac

SEQ ID NO: 239404 - RNA, 64 nt, hsa
agcaagcagguuucacugcuucauuagaagaggacaagucaaaagugaaucauuuuucacuacu

SEQ ID NO: 239405 - RNA, 64 nt, hsa
ggagaugcuugaagaacucaacaaaaucccaauccaagucaaacuuugcacauauuuauauuua

SEQ ID NO: 239406 - RNA, 64 nt, hsa
ccacccguguagcuacugaaaauggcuggguaagcaagucaaggguguuggaggaggucaagag

SEQ ID NO: 239407 - RNA, 64 nt, hsa
uuauagcaguccccacaacaucaaagaaccaccacaagucaauagauuugaguuuaauuggaaa

SEQ ID NO: 239408 - RNA, 64 nt, hsa
accaaacgagaaaauuuaaaggagcaaaaauuugcaagucaaauagaaauguacaaaucgagau

SEQ ID NO: 239409 - RNA, 64 nt, hsa
aguucauauggaaccaaaaaagagcccacauugccaagucaauccuaagccaaaugaauaaagc

SEQ ID NO: 239410 - RNA, 64 nt, hsa
uccugggaagaagaagcuccagccaguucugcugcaagucaaccagcaugcagggggccuuccu

SEQ ID NO: 239411 - RNA, 64 nt, hsa
acuaaauuucuuucucaauuaugucagacacacccaagucaaucccaacccccuuguuaccuug

SEQ ID NO: 239412 - RNA, 64 nt, hsa
cgcaauucuaaguuucuagauaaacagcgaucuccaagucaagacugaggaugaagagggagaa

SEQ ID NO: 239413 - RNA, 64 nt, hsa
auacugaggaguugaaagaacaaggaagaaguaccaagucaaccaaguucucucuugucacuga

SEQ ID NO: 239414 - RNA, 64 nt, hsa
uuauggaaguggucuuugugagaaaaucuucagccaagucaaacuucaugcagcagaaucccca

SEQ ID NO: 239415 - RNA, 64 nt, hsa
uuucuucuaacugccccucaacuaccauuaucuucaagucaacaugcauauuacauuuucaucc

SEQ ID NO: 239416 - RNA, 64 nt, hsa
cgccccccaccuuugggaucagccuccgccauuccaagucaacacucuucuugagcagaccgug

SEQ ID NO: 239417 - RNA, 64 nt, hsa
uugcauacuaugguuugacuugcuuuggaauuuucaagucaaagucccaacccuuugccucucc

SEQ ID NO: 239418 - RNA, 64 nt, hsa
aaaaacacaaugucccuaccguguaaauagaauccaagucaauugugacugcaauuccaaguua

SEQ ID NO: 239419 - RNA, 64 nt, hsa
aauuccaaauuaucaguuaaucgaaacuacauugcaagucaacauuauuuucucuucuuccuca

SEQ ID NO: 239420 - RNA, 64 nt, hsa
aauuucucccugcaagcgcucagucucaucccagcaagucaaagaccuccuggccaaguccugc

SEQ ID NO: 239421 - RNA, 64 nt, hsa
cgcgaacgcugugcguuugucagaaugaaguauacaagucaauguuuuucccccuuuuuauaua

SEQ ID NO: 239422 - RNA, 64 nt, hsa
uucuccaaggccugagggcaagacucaugaugagcaagucaaccccaaucuggaacaauguccc

SEQ ID NO: 239423 - RNA, 64 nt, hsa
gagaaccagggaagcugugauccacuggccaggacaagucaacaugggugaggguugggcaaag

SEQ ID NO: 239424 - RNA, 64 nt, hsa
uuuaaaaaaaaaaaaaaacugccuuucuuccccucaagucaacuuuugugcuccagaaaauuuu

SEQ ID NO: 239425 - RNA, 64 nt, hsa
acaauuccagcacaauuaugacaauucagagaagcaagucaaaggacugggcaccugccucuga

SEQ ID NO: 239426 - RNA, 64 nt, hsa
uaguucucacuacaauguucacauugaugauucccaagucaauaagcuugccaacauaauggac

SEQ ID NO: 239427 - RNA, 64 nt, hsa
uccaaacaauuuaaaaaugagugugaagggggaacaagucaaaauauuuuuaaaagaucuucaa

SEQ ID NO: 239428 - RNA, 64 nt, hsa
uggaggcagagggcaagggaggggugguauuaaacaagucaauucugugugguauauuguuuaa

SEQ ID NO: 239429 - RNA, 64 nt, hsa
cuccugacucauuacuaauggauaccauucucaacaagucaauccaaaucagcccguuaaggag

SEQ ID NO: 239430 - RNA, 64 nt, hsa
cugcuugugaugagagccuccacacuguacuguucaagucaauguuaauaaagcauuucaaaac

SEQ ID NO: 239431 - RNA, 64 nt, hsa
aaaucugaguggcuucucuaagcaucugcugguacaagucaauguggcaccaugagcuucaugg

SEQ ID NO: 239432 - RNA, 64 nt, hsa
aagggucagaaauaccauucacacccuucuuacccaagucaauuggaauaacuugucuucaaac

SEQ ID NO: 239433 - RNA, 64 nt, hsa
aaguaagacagauucuucacuguguuuuaaaaggcaagucaaauaccacaugauuuuacucaua

SEQ ID NO: 239434 - RNA, 64 nt, hsa
gcacguggcugcccugcccuacugugggcauagcgcccgccaugacagugaguguccuuagggg

SEQ ID NO: 239435 - RNA, 64 nt, hsa
cgccgccuguggugccuggucucccggcccuagcgcccgccaaaccuggugguccugggcggcc

SEQ ID NO: 239436 - RNA, 64 nt, hsa
uauuuaauucuuuaaaaaguaaaaacucuacauggucgcaaaaauguguuuauuucuaaugucc

SEQ ID NO: 239437 - RNA, 64 nt, hsa
aaaucagggcaauauaagacuuaauagauuaacugucgcaaauuugaucagagucacagaguag

SEQ ID NO: 239438 - RNA, 64 nt, hsa
uucaaccgcggcuucaaggcugggaggaacaugcgucgcaaacucuuuggggucuugcggcuga

SEQ ID NO: 239439 - RNA, 64 nt, hsa
uaaccaggcucgcacacacagggucugcugccacgucgcaaaccacucaguaaaggaaauuaaa

SEQ ID NO: 239440 - RNA, 64 nt, hsa
acccuugcguuuuguugggacauguggaccgugagucgcaaacacucuggagaaggcugagaug

SEQ ID NO: 239441 - RNA, 64 nt, hsa
augccuuaccuuuguaaauauuuuugcuuguguugucgcaaaggggauaaucugggaaagacac

SEQ ID NO: 239442 - RNA, 64 nt, hsa
auaauuaguuaugacagccauuuguaaugaauuugucgcaaagacguaauaaaauuaacuggug

SEQ ID NO: 239443 - RNA, 64 nt, hsa
uccucuaggucucguagccgaucccguucccguagucgcaaaucuuacagccggucaagaagca

SEQ ID NO: 239444 - RNA, 64 nt, hsa
cacugcgccaggagccgccugcgaccgcccgggcgucgcaaaccgcccgccugcucucugauuu

SEQ ID NO: 239445 - RNA, 64 nt, hsa
gaggguugaguuucucuaaggaccccucaaacaugucgcaaaaugaaccaaacuucuggcuagg

SEQ ID NO: 239446 - RNA, 64 nt, hsa
gcuggggagguaaccgugacuacugcucacaaacgucgcaaagcagaaacugaaaacugguagg

SEQ ID NO: 239447 - RNA, 64 nt, hsa
aauuguuucuaguuaggccacgcuccucuguucagucgcaaaggugaacacucaugcggcccag

SEQ ID NO: 239448 - RNA, 64 nt, hsa
uguucacuguacaaaagcuuacaguuuuccacaaggacuuuaauaacuagcugggaaaagacga

SEQ ID NO: 239449 - RNA, 64 nt, hsa
cuuuuuagacguuaucauuuugccucauguuggaggacuuuauggaauuuaagaaauacauuuu

SEQ ID NO: 239450 - RNA, 64 nt, hsa
uuuaugcaacaagcauguuugugcaaauuucaugggacuuuaaaaagaauaaguauuugagaaa

SEQ ID NO: 239451 - RNA, 64 nt, hsa
uugaacuaaucaaggaauaaauccuaauguucugggacuuuauuuucacauguuaaaugcugga

SEQ ID NO: 239452 - RNA, 64 nt, hsa
cauuuggauugauuuuuauacacauagauuuucaggacuuuaccuuuuguuuuguuuuuuuccu

SEQ ID NO: 239453 - RNA, 64 nt, hsa
ggcuugaacuuaaaucucagcucagucaccugcaggacuuuaggcaccagugauuucacccuuc

SEQ ID NO: 239454 - RNA, 64 nt, hsa
cugcagcagaaaucgaauuuaaaacaaaaaggagggacuuuaaaauaccuucuugacaaaaauc

SEQ ID NO: 239455 - RNA, 64 nt, hsa
acuuacuuucccaugaacacuugcaguugcuaagggacuuuauuuuguaacauaucaauuauaa

SEQ ID NO: 239456 - RNA, 64 nt, hsa; identical to SEQ ID NO: 160506

SEQ ID NO: 239457 - RNA, 64 nt, hsa; identical to SEQ ID NO: 160507

SEQ ID NO: 239458 - RNA, 64 nt, hsa; identical to SEQ ID NO: 160508

SEQ ID NO: 239459 - RNA, 64 nt, hsa; identical to SEQ ID NO: 160509

SEQ ID NO: 239460 - RNA, 64 nt, hsa; identical to SEQ ID NO: 160510

SEQ ID NO: 239461 - RNA, 64 nt, hsa; identical to SEQ ID NO: 160511

SEQ ID NO: 239462 - RNA, 64 nt, hsa; identical to SEQ ID NO: 160512

SEQ ID NO: 239463 - RNA, 64 nt, hsa; identical to SEQ ID NO: 160513

SEQ ID NO: 239464 - RNA, 64 nt, hsa; identical to SEQ ID NO: 160514

SEQ ID NO: 239465 - RNA, 64 nt, hsa; identical to SEQ ID NO: 160515

SEQ ID NO: 239466 - RNA, 64 nt, hsa; identical to SEQ ID NO: 160516

SEQ ID NO: 239467 - RNA, 64 nt, hsa; identical to SEQ ID NO: 160517

SEQ ID NO: 239468 - RNA, 64 nt, hsa
aaugccugcugcccccaaugacucuugguuucgucucccacauacagaagcaggguggagggga

SEQ ID NO: 239469 - RNA, 64 nt, hsa
caagugggguuggggguggggcugguccuucucccucccacaggccuguguucuuggggcugcu

SEQ ID NO: 239470 - RNA, 64 nt, hsa
gcuugauuuccccucugccuuccuucucucugcacucccacaaagccagggccaggcuccccau

SEQ ID NO: 239471 - RNA, 64 nt, hsa
ugggaaagccauuacucuugugucugcuacugcccucccacagucaccccaauauuacaagcac

SEQ ID NO: 239472 - RNA, 64 nt, hsa
cuauuauauucccacauccugagaaaggucauuucucccacacacgacaaagucacagacaucc

SEQ ID NO: 239473 - RNA, 64 nt, hsa
gggugaggacuuggucugucacggcugaugaggacucccacaaccggccaaguuaugucuuauu

SEQ ID NO: 239474 - RNA, 64 nt, hsa
uaggcagugccccaguagggacucugugugggggcucccacaccacauuucccuucugcacugc

SEQ ID NO: 239475 - RNA, 64 nt, hsa
ggcccccaugauucaauuaccuccccuugggucucucccacaacacgugggaauucugguagau

SEQ ID NO: 239476 - RNA, 64 nt, hsa
cugcuagccuugaggcgcggacccucccccauaccucccacaguaucccagcgccucaugcccc

SEQ ID NO: 239477 - RNA, 64 nt, hsa
ccucccaguauuucaucaaggacagggaauaucccucccacacacaggccagcugcucacccug

SEQ ID NO: 239478 - RNA, 64 nt, hsa
ggaaucucuucucugauccuucuuccuuaauucacucccacacccaagaagaaaugcuuuccaa

SEQ ID NO: 239479 - RNA, 64 nt, hsa
caguaugaaccuaacuccccaccccaacaucucccucccacauugucaccauuucaaagggccc

SEQ ID NO: 239480 - RNA, 64 nt, hsa
ggauuuuguuucauuuaaccucucuuugcacccucucccacaacaaauaccaagcaucaaaagc

SEQ ID NO: 239481 - RNA, 64 nt, hsa
ggaaagcuacaugauaguauuuuuaugcacucuucucccacacauacacacacgugcauguauc

SEQ ID NO: 239482 - RNA, 64 nt, hsa
cuuauaaauuauaagucuuauauaauuuauaagucucccacaaucuuccaguucuuacccagug

SEQ ID NO: 239483 - RNA, 64 nt, hsa
ccaccgucucaccccugcggaggagcgcucccgucucccacaggugccuuaccgcguucccucc

SEQ ID NO: 239484 - RNA, 64 nt, hsa
acugggagaaucucugaggcgugucuuccaggcccucccacagcuugugcccuccacagugugg

SEQ ID NO: 239485 - RNA, 64 nt, hsa
cuggucacaugaguuuacgauuccuuugaagugucucccacaggguggcaggacugggagaauc

SEQ ID NO: 239486 - RNA, 64 nt, hsa
ccccgccuccuccugccgccuccgccagcccucccucccacacugccccagcagggcuggcccg

SEQ ID NO: 239487 - RNA, 64 nt, hsa
uaagcagugagggcggcugcaggagaggaaggggcucccacagcccccacugaugccgcugcag

SEQ ID NO: 239488 - RNA, 64 nt, hsa
uggcccccaugauucaauuaccucccccgggucccucccacaacacaugggaauucugagagau

SEQ ID NO: 239489 - RNA, 64 nt, hsa
ggccccccugauucgaugaccucccccugggucccucccacaacaugugggaauuccagaagau

SEQ ID NO: 239490 - RNA, 64 nt, hsa
ccaaccccuggccuccugccacccaucugcccugcucccacaugcucaggucccagggcacaga

SEQ ID NO: 239491 - RNA, 64 nt, hsa
agggcaaagaacccgagccugccagcuuggccuccucccacagccucccucggaggcaugccau

SEQ ID NO: 239492 - RNA, 64 nt, hsa
auaugcacagacuauacagugaguugaguuggcucucccacagucuuugaggugaauuacaaaa

SEQ ID NO: 239493 - RNA, 64 nt, hsa
ucuagaguaguuuugaauggguugauuucccccacucccacaaacucugaagccagugucuagc

SEQ ID NO: 239494 - RNA, 64 nt, hsa
cauauuuuaauuuaaucucugucaauggccaucccucccacaaaaaaacguggguuaagagaac

SEQ ID NO: 239495 - RNA, 64 nt, hsa
ccaccgugugcaugugcaucaaugucccucuuuucucccacacaucucacaucauggggaggcc

SEQ ID NO: 239496 - RNA, 64 nt, hsa
guaaacacacgugcacacaucguacacaugugagcucccacacguacacacagaugcacaugga

SEQ ID NO: 239497 - RNA, 64 nt, hsa
ccacaaacgagcucccagacauguaaacacacgucucccacacgugagcucccacacguacaca

SEQ ID NO: 239498 - RNA, 64 nt, hsa
ccagacauguaaacacacgucucccacacgugagcucccacacguacacaugcacauguacgca

SEQ ID NO: 239499 - RNA, 64 nt, hsa
ccacuuuuucucuugguucucccacauucuuauucucccacaucccuacccacguuugagcugg

SEQ ID NO: 239500 - RNA, 64 nt, hsa
cuccacucucccagccccacuuuuucucuugguucucccacauucuuauucucccacaucccua

SEQ ID NO: 239501 - RNA, 64 nt, hsa
ucaagcuccuccucuuagaggaagcagcuccuuccucccacaggagccccaagggagcacucac

SEQ ID NO: 239502 - RNA, 64 nt, hsa
aauccaucccccuguuuucagggaccucugccuucucccacaccccuuacacuagugaggacuc

SEQ ID NO: 239503 - RNA, 64 nt, hsa
aaacuguaggaagggugcucucccugagaagcuucucccacagugcuuuggugcuguuaccuug

SEQ ID NO: 239504 - RNA, 64 nt, hsa
cuuccucuucuccuuuuuccgcacuucuccaccccucccacauuuacagccagaaucaacauuc

SEQ ID NO: 239505 - RNA, 64 nt, hsa
ccucucuucaagaagggcccuuugucuuucuccacucccacacaccuuucccaccaagccuuga

SEQ ID NO: 239506 - RNA, 64 nt, hsa
gggagauggcuggcagggucuuccaaguaccuuccucccacacugccaaguauacacaacuucc

SEQ ID NO: 239507 - RNA, 64 nt, hsa
gauucccgcuucugaaacucccccuggagucucacucccacacaugcccauagcuagcauucaa

SEQ ID NO: 239508 - RNA, 64 nt, hsa
aaaagucggccuggugccagagaggaccuccuuucucccacagaaucccagauccucaggaaaa

SEQ ID NO: 239509 - RNA, 64 nt, hsa
aggagagccucccacagcugucaccaugcuccaacucccacacaaacgcuucuaccccuuccag

SEQ ID NO: 239510 - RNA, 64 nt, hsa
gagaccaacgaccaaguguuccugcaaggagagccucccacagcugucaccaugcuccaacucc

SEQ ID NO: 239511 - RNA, 64 nt, hsa
gguaguugccgguggacagcauggccgugccagccucccacacugaggccaggucuacccccca

SEQ ID NO: 239512 - RNA, 64 nt, hsa
cagacuggcugggccccacccccugcguguggcccucccacaguauuuugugcaaugaagcccu

SEQ ID NO: 239513 - RNA, 64 nt, hsa
gaccucuauauccuggugccuaagaaacuucugccucccacagacaacuaagugcuuauucaaa

SEQ ID NO: 239514 - RNA, 64 nt, hsa
aacuccugaccucaagugauccgccugccucagccucccacagugcugggauuacaggcgugag

SEQ ID NO: 239515 - RNA, 64 nt, hsa
uccucugaagcagugaagucugugccuaugccgagcgcgcuaagaagucucccuuccagcuguu

SEQ ID NO: 239516 - RNA, 64 nt, hsa
ggcugagcuggggcugugugcuugcuaggugugggcgcgcuagugcucguuguagccuuuugcu

SEQ ID NO: 239517 - RNA, 64 nt, hsa
aauccgagcaguggagucauucagcgggagcacugcgcgcuauccccucacauucucuauguac

SEQ ID NO: 239518 - RNA, 64 nt, hsa
gggcagaguagacaucuagccucccuaaggguaugcgcgcuaaagcccagcucucgaucucacc

SEQ ID NO: 239519 - RNA, 64 nt, hsa
gugugugugugugcgcgcgcgcgcgcgcgcgcgcgcgcgcuagagggguguggcugguggggga

SEQ ID NO: 239520 - RNA, 64 nt, hsa
gacauccaaguuuaccaguagaaagacacaggaugcacagaaugggcaugaccuucagcucacg

SEQ ID NO: 239521 - RNA, 64 nt, hsa
aaugaaagggaggaacggaaggacaauuuccagugcacagaaucacuuggaugaaauaagacca

SEQ ID NO: 239522 - RNA, 64 nt, hsa
uuguaacacuugauggagugaaauuccacgccaggcacagaauuuuuuugacauagauaauuua

SEQ ID NO: 239523 - RNA, 64 nt, hsa
ggcagcaucagagugccuuucuagagggagccacgcacagaauguaacaggaugaaacaguuuc

SEQ ID NO: 239524 - RNA, 64 nt, hsa
ggcacagcaccccuccccggcaucugccagcucagcacagaagacaccgaaugugcaucuggag

SEQ ID NO: 239525 - RNA, 64 nt, hsa
guuugagugaacccucuuucaaagacaauaaauagcacagaauuguccgugcuucugugaggca

SEQ ID NO: 239526 - RNA, 64 nt, hsa
gcaccagugaagaaguucuaacuuuuagcaugcugcacagaaacugguauaacaugccuucagu

SEQ ID NO: 239527 - RNA, 64 nt, hsa
auuuuuuauucucagggucgcuggucauccucuggcacagaacgaacguugucuucacauguuu

SEQ ID NO: 239528 - RNA, 64 nt, hsa
ggaaaaugugauaaggccagagcuugugugcugggcacagaaaucaccugcugcauccugugcu

SEQ ID NO: 239529 - RNA, 64 nt, hsa
agccucugcccgcagguuucuaugcuguuucuuagcacagaauccagccuagccuuagccgcag

SEQ ID NO: 239530 - RNA, 51 nt, hsa
uggugggcagcgaccccugaggcacagaagaacaagagcaaagaccaugaa

SEQ ID NO: 239531 - RNA, 64 nt, hsa
ucagcugcccuggccuugcaccccucugcaugcagcacagaagggugugaccaugcccucagca

SEQ ID NO: 239532 - RNA, 64 nt, hsa
cugcacucaaaaguuuugaaagaaacuaaucacagcacagaaguaccuugauuuaauuuuuuaa

SEQ ID NO: 239533 - RNA, 64 nt, hsa
ucuaaauuugauuauauucucugaugaucccuuugcacagaacuaugcuuaucucauguuuguc

SEQ ID NO: 239534 - RNA, 64 nt, hsa
cuguacauauuuuuguaccuuuuauguaaauuuugcacagaaauuuuuggcauaaguuuauuuu

SEQ ID NO: 239535 - RNA, 64 nt, hsa
gacuuucuucucggcucccucaacccuggcucaggcacagaagguguuuugcuacguuuuuuug

SEQ ID NO: 239536 - RNA, 64 nt, hsa
uccaccgucagcaccauucagcugcaucccuugugcacagaacuguuugccagcguuggguggg

SEQ ID NO: 239537 - RNA, 64 nt, hsa
uauauguauauuuaaaaagugaauauaauuugaggcacagaagaauauucuuaaaaccuuuugu

SEQ ID NO: 239538 - RNA, 64 nt, hsa
uaugaaucuaauuaaaacagaaaugggaauuauugcacagaaaugggaaauaacuaauuuuaaa

SEQ ID NO: 239539 - RNA, 64 nt, hsa
gaugauuugggcauuacgaucaccucuuaccacagcacagaacauacauucuucaacagcauua

SEQ ID NO: 239540 - RNA, 64 nt, hsa
cagagcccuacacuccacgaccugggggcucacagcacagaaccuagaagcaccugcugacacu

SEQ ID NO: 239541 - RNA, 64 nt, hsa
uguuuauuuaauaagugggcagguugcaagcguugcacagaaauucugagauuuuacugccuuu

SEQ ID NO: 239542 - RNA, 64 nt, hsa
ggaaauggugucccugucccucccaaagcacagagcacagaaaugaggccguuuacauggcgag

SEQ ID NO: 239543 - RNA, 64 nt, hsa
guugcacaggaagaaugucacagggaaccaaaaagcacagaaaaaggaagugcuggugcauauu

SEQ ID NO: 239544 - RNA, 64 nt, hsa
ucauuagauaaguguugucuaccuagucuaggaggcacagaauucucauucuguuauccaguuc

SEQ ID NO: 239545 - RNA, 64 nt, hsa; identical to SEQ ID NO: 107849

SEQ ID NO: 239546 - RNA, 64 nt, hsa; identical to SEQ ID NO: 107850

SEQ ID NO: 239547 - RNA, 64 nt, hsa; identical to SEQ ID NO: 107851

SEQ ID NO: 239548 - RNA, 64 nt, hsa; identical to SEQ ID NO: 107852

SEQ ID NO: 239549 - RNA, 64 nt, hsa; identical to SEQ ID NO: 107853

SEQ ID NO: 239550 - RNA, 64 nt, hsa; identical to SEQ ID NO: 107854

SEQ ID NO: 239551 - RNA, 64 nt, hsa; identical to SEQ ID NO: 107855

SEQ ID NO: 239552 - RNA, 64 nt, hsa; identical to SEQ ID NO: 107856

SEQ ID NO: 239553 - RNA, 64 nt, hsa; identical to SEQ ID NO: 107857

SEQ ID NO: 239554 - RNA, 64 nt, hsa; identical to SEQ ID NO: 107858

SEQ ID NO: 239555 - RNA, 64 nt, hsa; identical to SEQ ID NO: 107859

SEQ ID NO: 239556 - RNA, 64 nt, hsa; identical to SEQ ID NO: 107860

SEQ ID NO: 239557 - RNA, 64 nt, hsa; identical to SEQ ID NO: 107861

SEQ ID NO: 239558 - RNA, 64 nt, hsa; identical to SEQ ID NO: 107862

SEQ ID NO: 239559 - RNA, 64 nt, hsa; identical to SEQ ID NO: 107863

SEQ ID NO: 239560 - RNA, 63 nt, hsa; identical to SEQ ID NO: 107864

SEQ ID NO: 239561 - RNA, 64 nt, hsa; identical to SEQ ID NO: 107865

SEQ ID NO: 239562 - RNA, 64 nt, hsa; identical to SEQ ID NO: 107866

SEQ ID NO: 239563 - RNA, 64 nt, hsa; identical to SEQ ID NO: 107867

SEQ ID NO: 239564 - RNA, 64 nt, hsa; identical to SEQ ID NO: 107868

SEQ ID NO: 239565 - RNA, 64 nt, hsa; identical to SEQ ID NO: 107869

SEQ ID NO: 239566 - RNA, 64 nt, hsa; identical to SEQ ID NO: 107870

SEQ ID NO: 239567 - RNA, 64 nt, hsa; identical to SEQ ID NO: 107871

SEQ ID NO: 239568 - RNA, 64 nt, hsa; identical to SEQ ID NO: 107872

SEQ ID NO: 239569 - RNA, 64 nt, hsa; identical to SEQ ID NO: 107873

SEQ ID NO: 239570 - RNA, 64 nt, hsa; identical to SEQ ID NO: 107874

SEQ ID NO: 239571 - RNA, 64 nt, hsa; identical to SEQ ID NO: 107875

SEQ ID NO: 239572 - RNA, 64 nt, hsa; identical to SEQ ID NO: 107876

SEQ ID NO: 239573 - RNA, 64 nt, hsa; identical to SEQ ID NO: 107877

SEQ ID NO: 239574 - RNA, 64 nt, hsa; identical to SEQ ID NO: 107878

SEQ ID NO: 239575 - RNA, 64 nt, hsa; identical to SEQ ID NO: 107879

SEQ ID NO: 239576 - RNA, 64 nt, hsa; identical to SEQ ID NO: 107880

SEQ ID NO: 239577 - RNA, 64 nt, hsa; identical to SEQ ID NO: 107881

SEQ ID NO: 239578 - RNA, 64 nt, hsa; identical to SEQ ID NO: 107882

SEQ ID NO: 239579 - RNA, 64 nt, hsa; identical to SEQ ID NO: 107883

SEQ ID NO: 239580 - RNA, 64 nt, hsa; identical to SEQ ID NO: 107884

SEQ ID NO: 239581 - RNA, 64 nt, hsa; identical to SEQ ID NO: 107885

SEQ ID NO: 239582 - RNA, 64 nt, hsa; identical to SEQ ID NO: 107886

SEQ ID NO: 239583 - RNA, 64 nt, hsa; identical to SEQ ID NO: 107887

SEQ ID NO: 239584 - RNA, 64 nt, hsa; identical to SEQ ID NO: 107888

SEQ ID NO: 239585 - RNA, 64 nt, hsa; identical to SEQ ID NO: 107889

SEQ ID NO: 239586 - RNA, 64 nt, hsa; identical to SEQ ID NO: 107890

SEQ ID NO: 239587 - RNA, 64 nt, hsa; identical to SEQ ID NO: 107891

SEQ ID NO: 239588 - RNA, 64 nt, hsa; identical to SEQ ID NO: 107892

SEQ ID NO: 239589 - RNA, 64 nt, hsa; identical to SEQ ID NO: 107893

SEQ ID NO: 239590 - RNA, 64 nt, hsa; identical to SEQ ID NO: 107894

SEQ ID NO: 239591 - RNA, 64 nt, hsa; identical to SEQ ID NO: 107895

SEQ ID NO: 239592 - RNA, 64 nt, hsa; identical to SEQ ID NO: 107896

SEQ ID NO: 239593 - RNA, 64 nt, hsa; identical to SEQ ID NO: 107897

SEQ ID NO: 239594 - RNA, 64 nt, hsa; identical to SEQ ID NO: 107898

SEQ ID NO: 239595 - RNA, 64 nt, hsa; identical to SEQ ID NO: 107899

SEQ ID NO: 239596 - RNA, 64 nt, hsa; identical to SEQ ID NO: 107900

SEQ ID NO: 239597 - RNA, 64 nt, hsa; identical to SEQ ID NO: 107901

SEQ ID NO: 239598 - RNA, 64 nt, hsa; identical to SEQ ID NO: 107902

SEQ ID NO: 239599 - RNA, 64 nt, hsa; identical to SEQ ID NO: 107903

SEQ ID NO: 239600 - RNA, 64 nt, hsa; identical to SEQ ID NO: 107904

SEQ ID NO: 239601 - RNA, 64 nt, hsa; identical to SEQ ID NO: 107905

SEQ ID NO: 239602 - RNA, 64 nt, hsa; identical to SEQ ID NO: 107906

SEQ ID NO: 239603 - RNA, 64 nt, hsa; identical to SEQ ID NO: 107907

SEQ ID NO: 239604 - RNA, 64 nt, hsa; identical to SEQ ID NO: 107908

SEQ ID NO: 239605 - RNA, 64 nt, hsa; identical to SEQ ID NO: 107909

SEQ ID NO: 239606 - RNA, 64 nt, hsa; identical to SEQ ID NO: 107910

SEQ ID NO: 239607 - RNA, 64 nt, hsa; identical to SEQ ID NO: 107911

SEQ ID NO: 239608 - RNA, 64 nt, hsa; identical to SEQ ID NO: 107912

SEQ ID NO: 239609 - RNA, 64 nt, hsa; identical to SEQ ID NO: 107913

SEQ ID NO: 239610 - RNA, 64 nt, hsa; identical to SEQ ID NO: 107914

SEQ ID NO: 239611 - RNA, 64 nt, hsa; identical to SEQ ID NO: 107915

SEQ ID NO: 239612 - RNA, 64 nt, hsa; identical to SEQ ID NO: 107916

SEQ ID NO: 239613 - RNA, 64 nt, hsa; identical to SEQ ID NO: 107917

SEQ ID NO: 239614 - RNA, 64 nt, hsa; identical to SEQ ID NO: 107918

SEQ ID NO: 239615 - RNA, 64 nt, hsa; identical to SEQ ID NO: 107919

SEQ ID NO: 239616 - RNA, 64 nt, hsa; identical to SEQ ID NO: 107920

SEQ ID NO: 239617 - RNA, 64 nt, hsa; identical to SEQ ID NO: 107921

SEQ ID NO: 239618 - RNA, 64 nt, hsa; identical to SEQ ID NO: 107922

SEQ ID NO: 239619 - RNA, 64 nt, hsa; identical to SEQ ID NO: 107923

SEQ ID NO: 239620 - RNA, 64 nt, hsa; identical to SEQ ID NO: 107924

SEQ ID NO: 239621 - RNA, 64 nt, hsa; identical to SEQ ID NO: 107925

SEQ ID NO: 239622 - RNA, 64 nt, hsa; identical to SEQ ID NO: 107926

SEQ ID NO: 239623 - RNA, 64 nt, hsa; identical to SEQ ID NO: 107927

SEQ ID NO: 239624 - RNA, 64 nt, hsa; identical to SEQ ID NO: 107928

SEQ ID NO: 239625 - RNA, 64 nt, hsa; identical to SEQ ID NO: 107929

SEQ ID NO: 239626 - RNA, 64 nt, hsa; identical to SEQ ID NO: 107930

SEQ ID NO: 239627 - RNA, 64 nt, hsa; identical to SEQ ID NO: 107931

SEQ ID NO: 239628 - RNA, 64 nt, hsa; identical to SEQ ID NO: 107932

SEQ ID NO: 239629 - RNA, 64 nt, hsa; identical to SEQ ID NO: 107933

SEQ ID NO: 239630 - RNA, 64 nt, hsa
accccuuuuugcugaugaguguugggacugacuccuggaagacagccuggccuugcccaccugc

SEQ ID NO: 239631 - RNA, 64 nt, hsa
uuuaaacaacucaagucagaaaucaguucacucccuggaagagagagaggggucuuggcacucu

SEQ ID NO: 239632 - RNA, 64 nt, hsa
uuuggucuacccacccaagagaaaagacuguuaacuggaagaaaaaauauauauauaaaauuuu

SEQ ID NO: 239633 - RNA, 64 nt, hsa
gcccaucuccccgcugucucccccugccccgagucuggaagagggcaaggacacuuccauuccu

SEQ ID NO: 239634 - RNA, 64 nt, hsa
aggcucuuacagccacaggcacugugucuacugucuggaagacauguccccauggcuguggggc

SEQ ID NO: 239635 - RNA, 64 nt, hsa
acccucauguuucuguaggauucucaccguggggcuggaagaaaagagcaucgacuugauuucu

SEQ ID NO: 239636 - RNA, 64 nt, hsa
ggagugaccacugagaugcugggggucacugggccuggaagaccaucccagccucugaguucuc

SEQ ID NO: 239637 - RNA, 64 nt, hsa
ggaguuaccacugagaugccaaagguugcugggucuggaagacuguuguggccucucaguucuc

SEQ ID NO: 239638 - RNA, 64 nt, hsa
caccgggcaagcacuggccuccccuggcuccugccuggaagaauuccgagccagcccauuucua

SEQ ID NO: 239639 - RNA, 64 nt, hsa
ccucuguaggccaguaguucucaaaguguggucucuggaagagcaguaucagcaucaucuggga

SEQ ID NO: 239640 - RNA, 64 nt, hsa
cuacauggaaagauagacagcagccaacccugaucuggaagacagggccccggcuggacacacg

SEQ ID NO: 239641 - RNA, 64 nt, hsa
gaauuuugucuuccccuaauucuucuuccuuggucuggaagaacaauuucuaugaauuuucucu

SEQ ID NO: 239642 - RNA, 64 nt, hsa
aagucugagagcaacagacccucaucaucugugccuggaagaguucacugucauugagcagcac

SEQ ID NO: 239643 - RNA, 64 nt, hsa
uuggcuaaagguugguguaaaaaucaagagaagccuggaagacaucauggaugccauggauuag

SEQ ID NO: 239644 - RNA, 64 nt, hsa
uaaaccucuaugucugaaaaaaaaaaugacacuccuggaagauggcuaggguuccccaguuuga

SEQ ID NO: 239645 - RNA, 64 nt, hsa
aaaaagguugguugauagcagcuuggagugcuaacuggaagaucaaaaucaugucucuugcuga

SEQ ID NO: 239646 - RNA, 64 nt, hsa
auccuucagacugcaucuuaaugauuacuuccuucuggaagacuccccuaauuuucacaacuag

SEQ ID NO: 239647 - RNA, 64 nt, hsa
ucucagaggacuggcauugucuggagacggcuuccuggaagaggagacuccagcagagcccuga

SEQ ID NO: 239648 - RNA, 64 nt, hsa
acaggcuaaaaguuuaguauucugggagaaguggcuggaagaagggguaauauggugaaagcaa

SEQ ID NO: 239649 - RNA, 64 nt, hsa
aagaauucuauaagcaauagcugauuaaugggcccuggaagaugaagauuauaacuguuuauuu

SEQ ID NO: 239650 - RNA, 64 nt, hsa
aaauccagaaagcauuuaagaauugaacuaggggcuggaagaagugaaagggaagcaucuaaaa

SEQ ID NO: 239651 - RNA, 64 nt, hsa
acuuaggaccauuugagcuugugggucacccacucuggaagaaauagucaugcuucuuuauuau

SEQ ID NO: 239652 - RNA, 64 nt, hsa
ccuaacucugagaaguuaacccuuaaacaguuuucuggaagagacugaauuucuggguccuugc

SEQ ID NO: 239653 - RNA, 64 nt, hsa
gcuugaccacgccggaagaguccuggagcuaaagcuggaagacacucagcucucuaagcagggg

SEQ ID NO: 239654 - RNA, 64 nt, hsa
ucucgcuucucuggccuugugagguuguggacaacuggaagauucugacucaggaauccagaac

SEQ ID NO: 239655 - RNA, 64 nt, hsa
gcuuggccaggcggcagagagagacaaucaaaaccuggaagacaaagugcguuccuuaaagaca

SEQ ID NO: 239656 - RNA, 64 nt, hsa
agugagcccaugagccccaccacuacacuccagccuggaagacaccaugacacacagugaggcc

SEQ ID NO: 239657 - RNA, 64 nt, hsa
uguacacaaacuaaugcucguguuucccaagcaccuggaagacaugccagauccaugugcagua

SEQ ID NO: 239658 - RNA, 64 nt, hsa
uguauuuugaacccauucugauagucucuuuuaacuggaagauuucaauuacuuacguuaaugu

SEQ ID NO: 239659 - RNA, 64 nt, hsa
cagcagaauuuguaaaaugagucaguuagguagucuggaagagagaauccagcguucucauugg

SEQ ID NO: 239660 - RNA, 64 nt, hsa
gcagcuccugaacugguggccagcccacgggguacuggaagacagugguucugauggguucagc

SEQ ID NO: 239661 - RNA, 64 nt, hsa
aaauauauaaaauauauaaaugcauaaaaaaauccuggaagacacagcaaaauguuaacagugg

SEQ ID NO: 239662 - RNA, 64 nt, hsa
gguggucugauucauacccuagccugaggcuccacuggaagaucucgcagccucaguguauggg

SEQ ID NO: 239663 - RNA, 64 nt, hsa
uuuguuagggaggcaugauuuuggugagaucuuucuggaagaguuuuccgccucuuugugaugc

SEQ ID NO: 239664 - RNA, 64 nt, hsa
cccugaaacacgucuaccugucugggaucaacuccuggaagaaacgccugauccgcaucaaggu

SEQ ID NO: 239665 - RNA, 64 nt, hsa
aggugagacccucucccaagaggagcagagaaaacuggaagaagauuugcugguagaagucagu

SEQ ID NO: 239666 - RNA, 64 nt, hsa
ggaagacauggauuguccggaagacauggauugucuggaagauguggauuuucuggaagcucag

SEQ ID NO: 239667 - RNA, 64 nt, hsa
cuggaagacuggauuugcuggaagacuugauuuacuggaagacuuggagcuucuuggaagacau

SEQ ID NO: 239668 - RNA, 64 nt, hsa
uggaagaccaguaauugcuggaagacuggauuugcuggaagacuugauuuacuggaagacuugg

SEQ ID NO: 239669 - RNA, 64 nt, hsa
ggaagaucuggauuugguggaagaccaguaauugcuggaagacuggauuugcuggaagacuuga

SEQ ID NO: 239670 - RNA, 64 nt, hsa
gaagacauggauuuccuggaagacguggauuuuccuggaagaucuggauuugguggaagaccag

SEQ ID NO: 239671 - RNA, 64 nt, hsa
gaagaccuugaaauuauuggaagacauggauuuccuggaagacguggauuuuccuggaagaucu

SEQ ID NO: 239672 - RNA, 64 nt, hsa
gaagacacagauuuuucuggaagacauggauuagcuggaagaucuguauuugauggaagaccuu

SEQ ID NO: 239673 - RNA, 64 nt, hsa
gaagacuuggauuugguggaagacacagauuuuucuggaagacauggauuagcuggaagaucug

SEQ ID NO: 239674 - RNA, 64 nt, hsa
gaagaucuagauuuuucuggaagaacuagauuuacuggaagacuuggauuugguggaagacaca

SEQ ID NO: 239675 - RNA, 56 nt, hsa
ugauugacuggaagaucuagauuuuucuggaagaacuagauuuacuggaagacuug

SEQ ID NO: 239676 - RNA, 64 nt, hsa
uggaaaaauagccugccucuucucuacucuagggaaaaaccagcgugugacuacucccccaggu

SEQ ID NO: 239677 - RNA, 64 nt, hsa
accacaaaacuuuucuaauacucuacccucuuagaaaaaccaccaccaucaccagacaggugcg

SEQ ID NO: 239678 - RNA, 64 nt, hsa
uaaggagcugguagccuaccuacacagcugcuacaaaaaccaaaauacagaauggcuucuguga

SEQ ID NO: 239679 - RNA, 64 nt, hsa
auuggcaugacaucugagcacagaaauuaaggcaaaaaaccaaagcaaaacaaauacauggugc

SEQ ID NO: 239680 - RNA, 64 nt, hsa
ccaggaugacuaaggcaagcucccuguggccucuaaaaaccaccugccagauuucagggacugu

SEQ ID NO: 239681 - RNA, 64 nt, hsa
gcuagcaagaaacaggaggcgguggccauauuccaaaaaccacuucugucccauuucaccagga

SEQ ID NO: 239682 - RNA, 64 nt, hsa
auguauguguaaacugacaaaaaaaaaaaaaaaaaaaaaccaguguugaaucaugcuauauuuc

SEQ ID NO: 239683 - RNA, 64 nt, hsa
uguaagaagaaaauggagacaaacagaaggagggaaaaaccaaccuacucugaaagccuucaga

SEQ ID NO: 239684 - RNA, 64 nt, hsa
ccuuucagcaaccucaaagcaaaaaaaaaaaaaaaaaaaccaguuagcugcuauauaaacacua

SEQ ID NO: 239685 - RNA, 64 nt, hsa
aacacagugaaaacccaucucaaaaaaaaaaaaaaaaaaccaaaaaaacuguccagcuguggac

SEQ ID NO: 239686 - RNA, 64 nt, hsa
gauggagaaaaaucuaggacagugucuucucggaaaaaaccagccuugaagguaaugaaacucu

SEQ ID NO: 239687 - RNA, 64 nt, hsa
ugagaaaccaccaggcuugaagugucuucucggaaaaaaccauccuuggagguaaugaaacucu

SEQ ID NO: 239688 - RNA, 64 nt, hsa
guauuuguuucuggucuuuguuaaguucuauuggaaaaaccacugucuguguuuuuuuggcagu

SEQ ID NO: 239689 - RNA, 64 nt, hsa
aaaagaaagaaagaaaaaaaaaggaaaaaaaaaaaaaaaccaauguuuugcaguuuuuuucauu

SEQ ID NO: 239690 - RNA, 64 nt, hsa
uaaacaaaguuuagguaaaugaauuaucgcagagaaaaaccacaugagaaaauuuuuguacucc

SEQ ID NO: 239691 - RNA, 64 nt, hsa
gugccaaauaagugcaaagauuuaauuuacuauuaaaaaccauaagcauauguuauaguuccag

SEQ ID NO: 239692 - RNA, 64 nt, hsa
ggcauuuaacuaagugcaccugugaucuuggccaaaaaaccauugcaacucacaguaagagacu

SEQ ID NO: 239693 - RNA, 64 nt, hsa
uauuguguacugacuccaucugccccgucaaauaaaaaaccacaagguucgagccgccgggccc

SEQ ID NO: 239694 - RNA, 64 nt, hsa
ccugggcaacagugagugagacucggucucaaacaaaaaccaaauugggaaauucuucuugagu

SEQ ID NO: 239695 - RNA, 64 nt, hsa
uugaauggaaaauuacucaguguauagaaaggaaaaaaaccagaaauuuaaaauagauacagaa

SEQ ID NO: 239696 - RNA, 64 nt, hsa
ucuccaucucuuauauauaacaauacugugacuuaaaaaccaacucaguauuggaaauuuucua

SEQ ID NO: 239697 - RNA, 64 nt, hsa
cuccuccagauaccaacugcugauguugcucuagaaaaaccaccaaacaugacuguucuuuccg

SEQ ID NO: 239698 - RNA, 64 nt, hsa
ggaguauaaguuuuccguuguuaaaaagcaaacaaaaaaccaacaaaaaauccaagugugccuu

SEQ ID NO: 239699 - RNA, 64 nt, hsa
acuuauugugguaauggucacauaacaauauauuaaaaaccauugaguuguauauuuuaagugg

SEQ ID NO: 239700 - RNA, 64 nt, hsa
uaauaguggcccugaaggaauaaauuccagcuuuaaaaaccaagucugaggaaauauuuggcuu

SEQ ID NO: 239701 - RNA, 64 nt, hsa
uuccuguauuuuaugcccauaaaauaagcuuuauaaaaaccaauuuccugauggacuauuaaau

SEQ ID NO: 239702 - RNA, 64 nt, hsa
caugagguuuuccaaaagauguuuuuagaguuguaaaaaccauauuugcagcaaagauuuacaa

SEQ ID NO: 239703 - RNA, 64 nt, hsa
uuguagauguuugucugaugcauuucauuaaaaaaaaaaccaugaauuacgaagcaccuuagua

SEQ ID NO: 239704 - RNA, 64 nt, hsa
cuuuuuauaggguggggcaaaauuagcaaaaaacaaaaaccaaugacaaccaaacugaaaccga

SEQ ID NO: 239705 - RNA, 64 nt, hsa
ucacaggaggaggggagguuggggggcgggagacaaaaaccacaccucuuuuuauauaagguuu

SEQ ID NO: 239706 - RNA, 64 nt, hsa
ccaugaaaucuuaggagucucuggaggacagauuaaaaaccagugaucuguaauuuguagcucu

SEQ ID NO: 239707 - RNA, 64 nt, hsa
uaaaucucggccccacucuucauuggcuuaaccuaaaaaccagaggugcuuuuccuugucugug

SEQ ID NO: 239708 - RNA, 64 nt, hsa
auuccuuuugcuggauaugcagaaaugauaggaaaaaaaccaauggugaaauuucaaguuucaa

SEQ ID NO: 239709 - RNA, 64 nt, hsa
uaggaaaaaaaccaauggugaaauuucaaguuucaaaaaccaaccuuucauuaccaaucccagg

SEQ ID NO: 239710 - RNA, 64 nt, hsa
auccuugaccucauuugaaauuacuuccauuuucaaaaaccaucauguuuuguagauacauuuu

SEQ ID NO: 239711 - RNA, 64 nt, hsa
caaaaaccaucauguuuuguagauacauuuugagaaaaaccaucauguuuugaggauacauuug

SEQ ID NO: 239712 - RNA, 64 nt, hsa
ucaaguuggugagaggagagcucauuguuugaagaaaaaccaaaacauuuuauggcuaguaaua

SEQ ID NO: 239713 - RNA, 64 nt, hsa
auguaauugccaagauuuuacuauuuuaacuuagaaaaaccaucguuucauaugauucacccua

SEQ ID NO: 239714 - RNA, 64 nt, hsa
agggcuccuugauucauaagcaccucccccccaaaaaaaccaaauugguaaaaauucauuuucu

SEQ ID NO: 239715 - RNA, 64 nt, hsa
gagggcagucauucuucucacugaguuuuuguuuaaaaaccaggaaauuucuacaaucauggag

SEQ ID NO: 239716 - RNA, 64 nt, hsa
caaauuaaccacuuuugacuagguaagucuuucuaaaaaccauuuaaagcuaacugggucuuag

SEQ ID NO: 239717 - RNA, 64 nt, hsa
auuuugcauaggggccauaucauucauggccaaaaaaaaccaaaaagcaaaaaacaaaaacaag

SEQ ID NO: 239718 - RNA, 64 nt, hsa
uccucacuaucggaaauucauuuugauucagaauaaaaaccaaauguauagagcuuugggugua

SEQ ID NO: 239719 - RNA, 64 nt, hsa
uuggaacuuucuguaucucuuaggaggaacaaguaaaaaccaaaugguuacauugugcugcuag

SEQ ID NO: 239720 - RNA, 64 nt, hsa
ggaaaaaaaaaaaaaggaaaaaaccaaaagcauaaaaaaccacagcaaauuucuugaugaaaau

SEQ ID NO: 239721 - RNA, 64 nt, hsa
cuaaaugaaauaaaguggaaaaaaaaaaaaaggaaaaaaccaaaagcauaaaaaaccacagcaa

SEQ ID NO: 239722 - RNA, 64 nt, hsa
guuuuuaguaaucuguacauuuuguuguaaaaagaaaaaccacucccaguccccagcccuucac

SEQ ID NO: 239723 - RNA, 64 nt, hsa
uuaacaaccuggccgcguuuagaccaaggaacaaaaaaaccacaaaggccaaacugcuggacgu

SEQ ID NO: 239724 - RNA, 64 nt, hsa
uuucuuuauuuuguguaaaaaaaccaccaaaaacaaaaaccaaauguuuauuuucuacguuucu

SEQ ID NO: 239725 - RNA, 64 nt, hsa
gaggccaugugcauaguuucuuuauuuuguguaaaaaaaccaccaaaaacaaaaaccaaauguu

SEQ ID NO: 239726 - RNA, 64 nt, hsa
gggugaucucugcuucauuagucauggguggaagaaaaaccacaccccccgcaccccuccguuc

SEQ ID NO: 239727 - RNA, 64 nt, hsa
aggcaccuccucuggccucacccaagccucuucuaaaaaccauguugaaugaauccacguucug

SEQ ID NO: 239728 - RNA, 64 nt, hsa
gccugcagaccggccacucugugacaacucuaccaaaaaccaacaagccauucaagcuuuuaca

SEQ ID NO: 239729 - RNA, 64 nt, hsa
aauguagaauaucucuuaagauuuccguuaugguaaaaaccauaugcaauaaauaccucauugu

SEQ ID NO: 239730 - RNA, 64 nt, hsa
ucccacaggccuucagcccuuuaacgucucugccaaaaaccagcacaaggagacaaagcagagc

SEQ ID NO: 239731 - RNA, 64 nt, hsa
ccagacugaccacuugcuuggagugugugcuugaaaaaaccagagcaauacuguuggguauugu

SEQ ID NO: 239732 - RNA, 64 nt, hsa
caaauaucacagacaccccucacacaaggaauauaaaaaccaccacccuccagccugggcaacg

SEQ ID NO: 239733 - RNA, 64 nt, hsa
acuuucuacaguuuugcaccacggcaagaaaaccaaaaaccaaaacaaacaaacaaaaaaaacc

SEQ ID NO: 239734 - RNA, 64 nt, hsa
aaguagcuaauccaguguaaucuuuuaccuuuuuaaaaaccaagauagaguaucuauuagaguu

SEQ ID NO: 239735 - RNA, 64 nt, hsa
acaguagaagaacuuacuucugaaaugaagggaaaaaaaccaccccaucguucccuacuccucc

SEQ ID NO: 239736 - RNA, 64 nt, hsa
guuuuaagcuuaauagccuuugcacuuuuaaaauaaaaaccaaguaugcaaaucaaagauauuu

SEQ ID NO: 239737 - RNA, 64 nt, hsa
aaggaaauuggaugggauacuguggcaaaucauaaaaaaccagauaauugaacuuugaaguuau

SEQ ID NO: 239738 - RNA, 64 nt, hsa
gagcgagacuccgucucaaaaaaaaaaaacaaaaaaaaaccaugcauggugcaucagcagccca

SEQ ID NO: 239739 - RNA, 64 nt, hsa
aggccugagcaacaaagcgagaucccaucucuacaaaaaccaaaaaguuaaaaaucagcugggu

SEQ ID NO: 239740 - RNA, 64 nt, hsa
cuuuucuguugccaugauuuuuuuuuuuucaacaaaaaaccaaagugcauuguacgcccuuugg

SEQ ID NO: 239741 - RNA, 64 nt, hsa
agcuuccuacugaauugugagcuguuacuuguugaaaaaccauaucacuuuucuguugccauga

SEQ ID NO: 239742 - RNA, 64 nt, hsa
uaggauuuuuuucuuuuuuaguaaaaaccuguauaaaaaccaaaauuauaggauuuuuuuuucu

SEQ ID NO: 239743 - RNA, 64 nt, hsa
uaggauuuuuuucuuuuuuaguaaaaaccuauauaaaaaccaaaauuauaggauuuuuucuuuu

SEQ ID NO: 239744 - RNA, 64 nt, hsa
gguaauagagccacuggugaguaaaaaccuauauaaaaaccaaaauuauaggauuuuuucuuuu

SEQ ID NO: 239745 - RNA, 64 nt, hsa
gggguagaaaaaaaacaaacaaacaaacagaaaaaaaaaccaaaaaaaaccacccugaguuucu

SEQ ID NO: 239746 - RNA, 64 nt, hsa
aaaaacaaacaaacaaacagaaaaaaaaaccaaaaaaaaccacccugaguuucucuggugacgc

SEQ ID NO: 239747 - RNA, 64 nt, hsa; identical to SEQ ID NO: 168029

SEQ ID NO: 239748 - RNA, 64 nt, hsa; identical to SEQ ID NO: 168030

SEQ ID NO: 239749 - RNA, 64 nt, hsa; identical to SEQ ID NO: 168031

SEQ ID NO: 239750 - RNA, 64 nt, hsa; identical to SEQ ID NO: 168032

SEQ ID NO: 239751 - RNA, 64 nt, hsa; identical to SEQ ID NO: 168033

SEQ ID NO: 239752 - RNA, 64 nt, hsa; identical to SEQ ID NO: 168034

SEQ ID NO: 239753 - RNA, 64 nt, hsa; identical to SEQ ID NO: 168035

SEQ ID NO: 239754 - RNA, 64 nt, hsa; identical to SEQ ID NO: 168036

SEQ ID NO: 239755 - RNA, 64 nt, hsa; identical to SEQ ID NO: 168037

SEQ ID NO: 239756 - RNA, 64 nt, hsa; identical to SEQ ID NO: 168038

SEQ ID NO: 239757 - RNA, 64 nt, hsa; identical to SEQ ID NO: 168039

SEQ ID NO: 239758 - RNA, 64 nt, hsa; identical to SEQ ID NO: 168040

SEQ ID NO: 239759 - RNA, 64 nt, hsa; identical to SEQ ID NO: 168041

SEQ ID NO: 239760 - RNA, 64 nt, hsa; identical to SEQ ID NO: 168042

SEQ ID NO: 239761 - RNA, 64 nt, hsa; identical to SEQ ID NO: 168043

SEQ ID NO: 239762 - RNA, 64 nt, hsa; identical to SEQ ID NO: 168044

SEQ ID NO: 239763 - RNA, 64 nt, hsa; identical to SEQ ID NO: 168045

SEQ ID NO: 239764 - RNA, 64 nt, hsa; identical to SEQ ID NO: 168046

SEQ ID NO: 239765 - RNA, 64 nt, hsa; identical to SEQ ID NO: 168047

SEQ ID NO: 239766 - RNA, 64 nt, hsa; identical to SEQ ID NO: 168048

SEQ ID NO: 239767 - RNA, 64 nt, hsa; identical to SEQ ID NO: 168049

SEQ ID NO: 239768 - RNA, 64 nt, hsa; identical to SEQ ID NO: 168050

SEQ ID NO: 239769 - RNA, 64 nt, hsa; identical to SEQ ID NO: 168051

SEQ ID NO: 239770 - RNA, 64 nt, hsa; identical to SEQ ID NO: 168052

SEQ ID NO: 239771 - RNA, 64 nt, hsa; identical to SEQ ID NO: 168053

SEQ ID NO: 239772 - RNA, 64 nt, hsa; identical to SEQ ID NO: 168054

SEQ ID NO: 239773 - RNA, 64 nt, hsa; identical to SEQ ID NO: 168055

SEQ ID NO: 239774 - RNA, 64 nt, hsa; identical to SEQ ID NO: 168056

SEQ ID NO: 239775 - RNA, 64 nt, hsa; identical to SEQ ID NO: 168057

SEQ ID NO: 239776 - RNA, 64 nt, hsa; identical to SEQ ID NO: 168058

SEQ ID NO: 239777 - RNA, 64 nt, hsa; identical to SEQ ID NO: 168059

SEQ ID NO: 239778 - RNA, 64 nt, hsa; identical to SEQ ID NO: 168060

SEQ ID NO: 239779 - RNA, 64 nt, hsa; identical to SEQ ID NO: 168061

SEQ ID NO: 239780 - RNA, 64 nt, hsa; identical to SEQ ID NO: 168062

SEQ ID NO: 239781 - RNA, 64 nt, hsa; identical to SEQ ID NO: 168063

SEQ ID NO: 239782 - RNA, 64 nt, hsa; identical to SEQ ID NO: 168064

SEQ ID NO: 239783 - RNA, 64 nt, hsa; identical to SEQ ID NO: 168065

SEQ ID NO: 239784 - RNA, 64 nt, hsa; identical to SEQ ID NO: 168066

SEQ ID NO: 239785 - RNA, 64 nt, hsa; identical to SEQ ID NO: 133550

SEQ ID NO: 239786 - RNA, 64 nt, hsa; identical to SEQ ID NO: 133551

SEQ ID NO: 239787 - RNA, 64 nt, hsa; identical to SEQ ID NO: 133552

SEQ ID NO: 239788 - RNA, 64 nt, hsa; identical to SEQ ID NO: 133553

SEQ ID NO: 239789 - RNA, 64 nt, hsa; identical to SEQ ID NO: 133554

SEQ ID NO: 239790 - RNA, 64 nt, hsa; identical to SEQ ID NO: 133555

SEQ ID NO: 239791 - RNA, 64 nt, hsa; identical to SEQ ID NO: 133556

SEQ ID NO: 239792 - RNA, 64 nt, hsa; identical to SEQ ID NO: 133557

SEQ ID NO: 239793 - RNA, 64 nt, hsa; identical to SEQ ID NO: 133558

SEQ ID NO: 239794 - RNA, 64 nt, hsa; identical to SEQ ID NO: 133559

SEQ ID NO: 239795 - RNA, 64 nt, hsa; identical to SEQ ID NO: 133560

SEQ ID NO: 239796 - RNA, 64 nt, hsa; identical to SEQ ID NO: 133561

SEQ ID NO: 239797 - RNA, 64 nt, hsa; identical to SEQ ID NO: 133562

SEQ ID NO: 239798 - RNA, 64 nt, hsa; identical to SEQ ID NO: 133563

SEQ ID NO: 239799 - RNA, 64 nt, hsa; identical to SEQ ID NO: 133564

SEQ ID NO: 239800 - RNA, 64 nt, hsa; identical to SEQ ID NO: 133565

SEQ ID NO: 239801 - RNA, 64 nt, hsa; identical to SEQ ID NO: 133566

SEQ ID NO: 239802 - RNA, 64 nt, hsa; identical to SEQ ID NO: 133567

SEQ ID NO: 239803 - RNA, 64 nt, hsa; identical to SEQ ID NO: 133568

SEQ ID NO: 239804 - RNA, 64 nt, hsa; identical to SEQ ID NO: 133569

SEQ ID NO: 239805 - RNA, 64 nt, hsa; identical to SEQ ID NO: 133570

SEQ ID NO: 239806 - RNA, 64 nt, hsa; identical to SEQ ID NO: 133571

SEQ ID NO: 239807 - RNA, 64 nt, hsa; identical to SEQ ID NO: 133572

SEQ ID NO: 239808 - RNA, 64 nt, hsa; identical to SEQ ID NO: 133573

SEQ ID NO: 239809 - RNA, 64 nt, hsa; identical to SEQ ID NO: 133574

SEQ ID NO: 239810 - RNA, 64 nt, hsa; identical to SEQ ID NO: 133575

SEQ ID NO: 239811 - RNA, 64 nt, hsa; identical to SEQ ID NO: 133576

SEQ ID NO: 239812 - RNA, 64 nt, hsa; identical to SEQ ID NO: 133577

SEQ ID NO: 239813 - RNA, 64 nt, hsa; identical to SEQ ID NO: 133578

SEQ ID NO: 239814 - RNA, 64 nt, hsa; identical to SEQ ID NO: 133579

SEQ ID NO: 239815 - RNA, 64 nt, hsa; identical to SEQ ID NO: 133580

SEQ ID NO: 239816 - RNA, 64 nt, hsa; identical to SEQ ID NO: 133581

SEQ ID NO: 239817 - RNA, 64 nt, hsa; identical to SEQ ID NO: 133582

SEQ ID NO: 239818 - RNA, 64 nt, hsa; identical to SEQ ID NO: 133583

SEQ ID NO: 239819 - RNA, 64 nt, hsa; identical to SEQ ID NO: 133584

SEQ ID NO: 239820 - RNA, 64 nt, hsa; identical to SEQ ID NO: 133585

SEQ ID NO: 239821 - RNA, 64 nt, hsa; identical to SEQ ID NO: 133586

SEQ ID NO: 239822 - RNA, 64 nt, hsa; identical to SEQ ID NO: 133587

SEQ ID NO: 239823 - RNA, 64 nt, hsa; identical to SEQ ID NO: 133588

SEQ ID NO: 239824 - RNA, 64 nt, hsa; identical to SEQ ID NO: 133589

SEQ ID NO: 239825 - RNA, 64 nt, hsa; identical to SEQ ID NO: 133590

SEQ ID NO: 239826 - RNA, 64 nt, hsa; identical to SEQ ID NO: 133591

SEQ ID NO: 239827 - RNA, 64 nt, hsa; identical to SEQ ID NO: 133592

SEQ ID NO: 239828 - RNA, 64 nt, hsa; identical to SEQ ID NO: 133593

SEQ ID NO: 239829 - RNA, 64 nt, hsa; identical to SEQ ID NO: 133594

SEQ ID NO: 239830 - RNA, 64 nt, hsa; identical to SEQ ID NO: 133595

SEQ ID NO: 239831 - RNA, 64 nt, hsa; identical to SEQ ID NO: 133596

SEQ ID NO: 239832 - RNA, 64 nt, hsa; identical to SEQ ID NO: 133597

SEQ ID NO: 239833 - RNA, 64 nt, hsa; identical to SEQ ID NO: 133598

SEQ ID NO: 239834 - RNA, 64 nt, hsa; identical to SEQ ID NO: 133599

SEQ ID NO: 239835 - RNA, 64 nt, hsa; identical to SEQ ID NO: 133600

SEQ ID NO: 239836 - RNA, 64 nt, hsa; identical to SEQ ID NO: 133601

SEQ ID NO: 239837 - RNA, 64 nt, hsa; identical to SEQ ID NO: 133602

SEQ ID NO: 239838 - RNA, 64 nt, hsa; identical to SEQ ID NO: 133603

SEQ ID NO: 239839 - RNA, 64 nt, hsa; identical to SEQ ID NO: 133604

SEQ ID NO: 239840 - RNA, 64 nt, hsa; identical to SEQ ID NO: 133605

SEQ ID NO: 239841 - RNA, 64 nt, hsa; identical to SEQ ID NO: 133606

SEQ ID NO: 239842 - RNA, 64 nt, hsa; identical to SEQ ID NO: 133607

SEQ ID NO: 239843 - RNA, 64 nt, hsa; identical to SEQ ID NO: 133608

SEQ ID NO: 239844 - RNA, 64 nt, hsa; identical to SEQ ID NO: 133609

SEQ ID NO: 239845 - RNA, 64 nt, hsa; identical to SEQ ID NO: 133610

SEQ ID NO: 239846 - RNA, 52 nt, hsa; identical to SEQ ID NO: 133611

SEQ ID NO: 239847 - RNA, 55 nt, hsa; identical to SEQ ID NO: 133612

SEQ ID NO: 239848 - RNA, 64 nt, hsa; identical to SEQ ID NO: 133613

SEQ ID NO: 239849 - RNA, 64 nt, hsa; identical to SEQ ID NO: 133614

SEQ ID NO: 239850 - RNA, 64 nt, hsa; identical to SEQ ID NO: 133615

SEQ ID NO: 239851 - RNA, 64 nt, hsa; identical to SEQ ID NO: 133616

SEQ ID NO: 239852 - RNA, 64 nt, hsa; identical to SEQ ID NO: 133617

SEQ ID NO: 239853 - RNA, 64 nt, hsa; identical to SEQ ID NO: 133618

SEQ ID NO: 239854 - RNA, 64 nt, hsa; identical to SEQ ID NO: 133619

SEQ ID NO: 239855 - RNA, 64 nt, hsa; identical to SEQ ID NO: 133620

SEQ ID NO: 239856 - RNA, 64 nt, hsa; identical to SEQ ID NO: 133621

SEQ ID NO: 239857 - RNA, 64 nt, hsa; identical to SEQ ID NO: 133622

SEQ ID NO: 239858 - RNA, 64 nt, hsa; identical to SEQ ID NO: 133623

SEQ ID NO: 239859 - RNA, 64 nt, hsa; identical to SEQ ID NO: 133624

SEQ ID NO: 239860 - RNA, 64 nt, hsa; identical to SEQ ID NO: 133625

SEQ ID NO: 239861 - RNA, 64 nt, hsa; identical to SEQ ID NO: 133626

SEQ ID NO: 239862 - RNA, 64 nt, hsa; identical to SEQ ID NO: 133627

SEQ ID NO: 239863 - RNA, 64 nt, hsa; identical to SEQ ID NO: 133628

SEQ ID NO: 239864 - RNA, 64 nt, hsa; identical to SEQ ID NO: 133629

SEQ ID NO: 239865 - RNA, 64 nt, hsa; identical to SEQ ID NO: 133630

SEQ ID NO: 239866 - RNA, 64 nt, hsa; identical to SEQ ID NO: 133631

SEQ ID NO: 239867 - RNA, 64 nt, hsa; identical to SEQ ID NO: 133632

SEQ ID NO: 239868 - RNA, 64 nt, hsa; identical to SEQ ID NO: 133633

SEQ ID NO: 239869 - RNA, 64 nt, hsa; identical to SEQ ID NO: 133634

SEQ ID NO: 239870 - RNA, 64 nt, hsa; identical to SEQ ID NO: 133635

SEQ ID NO: 239871 - RNA, 64 nt, hsa; identical to SEQ ID NO: 133636

SEQ ID NO: 239872 - RNA, 64 nt, hsa; identical to SEQ ID NO: 133637

SEQ ID NO: 239873 - RNA, 64 nt, hsa; identical to SEQ ID NO: 133638

SEQ ID NO: 239874 - RNA, 63 nt, hsa; identical to SEQ ID NO: 133639

SEQ ID NO: 239875 - RNA, 51 nt, hsa; identical to SEQ ID NO: 133640

SEQ ID NO: 239876 - RNA, 64 nt, hsa; identical to SEQ ID NO: 133641

SEQ ID NO: 239877 - RNA, 64 nt, hsa; identical to SEQ ID NO: 133642

SEQ ID NO: 239878 - RNA, 64 nt, hsa; identical to SEQ ID NO: 133643

SEQ ID NO: 239879 - RNA, 64 nt, hsa; identical to SEQ ID NO: 133644

SEQ ID NO: 239880 - RNA, 64 nt, hsa; identical to SEQ ID NO: 133645

SEQ ID NO: 239881 - RNA, 64 nt, hsa; identical to SEQ ID NO: 133646

SEQ ID NO: 239882 - RNA, 64 nt, hsa; identical to SEQ ID NO: 133647

SEQ ID NO: 239883 - RNA, 64 nt, hsa; identical to SEQ ID NO: 133648

SEQ ID NO: 239884 - RNA, 64 nt, hsa; identical to SEQ ID NO: 133649

SEQ ID NO: 239885 - RNA, 64 nt, hsa; identical to SEQ ID NO: 133650

SEQ ID NO: 239886 - RNA, 64 nt, hsa; identical to SEQ ID NO: 133651

SEQ ID NO: 239887 - RNA, 64 nt, hsa; identical to SEQ ID NO: 133652

SEQ ID NO: 239888 - RNA, 64 nt, hsa; identical to SEQ ID NO: 133653

SEQ ID NO: 239889 - RNA, 64 nt, hsa; identical to SEQ ID NO: 133654

SEQ ID NO: 239890 - RNA, 64 nt, hsa; identical to SEQ ID NO: 133655

SEQ ID NO: 239891 - RNA, 64 nt, hsa; identical to SEQ ID NO: 133656

SEQ ID NO: 239892 - RNA, 64 nt, hsa; identical to SEQ ID NO: 133657

SEQ ID NO: 239893 - RNA, 64 nt, hsa; identical to SEQ ID NO: 133658

SEQ ID NO: 239894 - RNA, 64 nt, hsa; identical to SEQ ID NO: 133659

SEQ ID NO: 239895 - RNA, 64 nt, hsa; identical to SEQ ID NO: 133660

SEQ ID NO: 239896 - RNA, 64 nt, hsa; identical to SEQ ID NO: 133661

SEQ ID NO: 239897 - RNA, 64 nt, hsa; identical to SEQ ID NO: 133662

SEQ ID NO: 239898 - RNA, 64 nt, hsa; identical to SEQ ID NO: 133663

SEQ ID NO: 239899 - RNA, 64 nt, hsa; identical to SEQ ID NO: 133664

SEQ ID NO: 239900 - RNA, 64 nt, hsa; identical to SEQ ID NO: 133665

SEQ ID NO: 239901 - RNA, 64 nt, hsa; identical to SEQ ID NO: 133666

SEQ ID NO: 239902 - RNA, 64 nt, hsa; identical to SEQ ID NO: 133667

SEQ ID NO: 239903 - RNA, 64 nt, hsa; identical to SEQ ID NO: 133668

SEQ ID NO: 239904 - RNA, 64 nt, hsa; identical to SEQ ID NO: 133669

SEQ ID NO: 239905 - RNA, 64 nt, hsa; identical to SEQ ID NO: 133670

SEQ ID NO: 239906 - RNA, 64 nt, hsa; identical to SEQ ID NO: 133671

SEQ ID NO: 239907 - RNA, 64 nt, hsa; identical to SEQ ID NO: 133672

SEQ ID NO: 239908 - RNA, 64 nt, hsa; identical to SEQ ID NO: 133673

SEQ ID NO: 239909 - RNA, 64 nt, hsa; identical to SEQ ID NO: 133674

SEQ ID NO: 239910 - RNA, 64 nt, hsa; identical to SEQ ID NO: 133675

SEQ ID NO: 239911 - RNA, 64 nt, hsa; identical to SEQ ID NO: 133676

SEQ ID NO: 239912 - RNA, 50 nt, hsa; identical to SEQ ID NO: 133677

SEQ ID NO: 239913 - RNA, 64 nt, hsa; identical to SEQ ID NO: 133678

SEQ ID NO: 239914 - RNA, 64 nt, hsa; identical to SEQ ID NO: 133679

SEQ ID NO: 239915 - RNA, 64 nt, hsa; identical to SEQ ID NO: 133680

SEQ ID NO: 239916 - RNA, 64 nt, hsa; identical to SEQ ID NO: 133681

SEQ ID NO: 239917 - RNA, 64 nt, hsa; identical to SEQ ID NO: 133682

SEQ ID NO: 239918 - RNA, 64 nt, hsa; identical to SEQ ID NO: 133683

SEQ ID NO: 239919 - RNA, 64 nt, hsa; identical to SEQ ID NO: 133684

SEQ ID NO: 239920 - RNA, 64 nt, hsa; identical to SEQ ID NO: 133685

SEQ ID NO: 239921 - RNA, 64 nt, hsa; identical to SEQ ID NO: 133686

SEQ ID NO: 239922 - RNA, 64 nt, hsa; identical to SEQ ID NO: 133687

SEQ ID NO: 239923 - RNA, 64 nt, hsa; identical to SEQ ID NO: 133688

SEQ ID NO: 239924 - RNA, 64 nt, hsa; identical to SEQ ID NO: 133689

SEQ ID NO: 239925 - RNA, 64 nt, hsa; identical to SEQ ID NO: 133690

SEQ ID NO: 239926 - RNA, 64 nt, hsa; identical to SEQ ID NO: 133691

SEQ ID NO: 239927 - RNA, 64 nt, hsa; identical to SEQ ID NO: 133692

SEQ ID NO: 239928 - RNA, 64 nt, hsa; identical to SEQ ID NO: 133693

SEQ ID NO: 239929 - RNA, 64 nt, hsa; identical to SEQ ID NO: 133694

SEQ ID NO: 239930 - RNA, 64 nt, hsa; identical to SEQ ID NO: 133695

SEQ ID NO: 239931 - RNA, 64 nt, hsa; identical to SEQ ID NO: 133696

SEQ ID NO: 239932 - RNA, 64 nt, hsa; identical to SEQ ID NO: 133697

SEQ ID NO: 239933 - RNA, 64 nt, hsa; identical to SEQ ID NO: 133698

SEQ ID NO: 239934 - RNA, 64 nt, hsa; identical to SEQ ID NO: 133699

SEQ ID NO: 239935 - RNA, 64 nt, hsa; identical to SEQ ID NO: 133700

SEQ ID NO: 239936 - RNA, 64 nt, hsa; identical to SEQ ID NO: 133701

SEQ ID NO: 239937 - RNA, 64 nt, hsa; identical to SEQ ID NO: 133702

SEQ ID NO: 239938 - RNA, 64 nt, hsa; identical to SEQ ID NO: 133703

SEQ ID NO: 239939 - RNA, 64 nt, hsa; identical to SEQ ID NO: 133704

SEQ ID NO: 239940 - RNA, 64 nt, hsa; identical to SEQ ID NO: 133705

SEQ ID NO: 239941 - RNA, 64 nt, hsa; identical to SEQ ID NO: 133706

SEQ ID NO: 239942 - RNA, 64 nt, hsa; identical to SEQ ID NO: 133707

SEQ ID NO: 239943 - RNA, 64 nt, hsa; identical to SEQ ID NO: 133708

SEQ ID NO: 239944 - RNA, 64 nt, hsa; identical to SEQ ID NO: 133709

SEQ ID NO: 239945 - RNA, 64 nt, hsa; identical to SEQ ID NO: 133710

SEQ ID NO: 239946 - RNA, 64 nt, hsa; identical to SEQ ID NO: 133711

SEQ ID NO: 239947 - RNA, 64 nt, hsa; identical to SEQ ID NO: 133712

SEQ ID NO: 239948 - RNA, 64 nt, hsa; identical to SEQ ID NO: 133713

SEQ ID NO: 239949 - RNA, 64 nt, hsa; identical to SEQ ID NO: 133714

SEQ ID NO: 239950 - RNA, 64 nt, hsa; identical to SEQ ID NO: 133715

SEQ ID NO: 239951 - RNA, 64 nt, hsa; identical to SEQ ID NO: 133716

SEQ ID NO: 239952 - RNA, 64 nt, hsa; identical to SEQ ID NO: 133717

SEQ ID NO: 239953 - RNA, 64 nt, hsa; identical to SEQ ID NO: 133718

SEQ ID NO: 239954 - RNA, 64 nt, hsa; identical to SEQ ID NO: 133719

SEQ ID NO: 239955 - RNA, 64 nt, hsa; identical to SEQ ID NO: 133720

SEQ ID NO: 239956 - RNA, 64 nt, hsa; identical to SEQ ID NO: 133721

SEQ ID NO: 239957 - RNA, 64 nt, hsa; identical to SEQ ID NO: 133722

SEQ ID NO: 239958 - RNA, 64 nt, hsa; identical to SEQ ID NO: 133723

SEQ ID NO: 239959 - RNA, 64 nt, hsa; identical to SEQ ID NO: 133724

SEQ ID NO: 239960 - RNA, 64 nt, hsa; identical to SEQ ID NO: 133725

SEQ ID NO: 239961 - RNA, 64 nt, hsa; identical to SEQ ID NO: 133726

SEQ ID NO: 239962 - RNA, 64 nt, hsa; identical to SEQ ID NO: 133727

SEQ ID NO: 239963 - RNA, 64 nt, hsa; identical to SEQ ID NO: 133728

SEQ ID NO: 239964 - RNA, 64 nt, hsa; identical to SEQ ID NO: 133729

SEQ ID NO: 239965 - RNA, 64 nt, hsa; identical to SEQ ID NO: 133730

SEQ ID NO: 239966 - RNA, 64 nt, hsa; identical to SEQ ID NO: 133731

SEQ ID NO: 239967 - RNA, 64 nt, hsa; identical to SEQ ID NO: 133732

SEQ ID NO: 239968 - RNA, 64 nt, hsa; identical to SEQ ID NO: 133733

SEQ ID NO: 239969 - RNA, 64 nt, hsa; identical to SEQ ID NO: 133734

SEQ ID NO: 239970 - RNA, 64 nt, hsa; identical to SEQ ID NO: 133735

SEQ ID NO: 239971 - RNA, 64 nt, hsa; identical to SEQ ID NO: 133736

SEQ ID NO: 239972 - RNA, 64 nt, hsa; identical to SEQ ID NO: 133737

SEQ ID NO: 239973 - RNA, 64 nt, hsa; identical to SEQ ID NO: 133738

SEQ ID NO: 239974 - RNA, 64 nt, hsa; identical to SEQ ID NO: 133739

SEQ ID NO: 239975 - RNA, 64 nt, hsa; identical to SEQ ID NO: 133740

SEQ ID NO: 239976 - RNA, 64 nt, hsa; identical to SEQ ID NO: 133741

SEQ ID NO: 239977 - RNA, 64 nt, hsa; identical to SEQ ID NO: 133742

SEQ ID NO: 239978 - RNA, 64 nt, hsa; identical to SEQ ID NO: 133743

SEQ ID NO: 239979 - RNA, 64 nt, hsa; identical to SEQ ID NO: 133744

SEQ ID NO: 239980 - RNA, 64 nt, hsa; identical to SEQ ID NO: 133745

SEQ ID NO: 239981 - RNA, 64 nt, hsa; identical to SEQ ID NO: 133746

SEQ ID NO: 239982 - RNA, 64 nt, hsa; identical to SEQ ID NO: 133747

SEQ ID NO: 239983 - RNA, 64 nt, hsa; identical to SEQ ID NO: 133748

SEQ ID NO: 239984 - RNA, 64 nt, hsa; identical to SEQ ID NO: 133749

SEQ ID NO: 239985 - RNA, 64 nt, hsa; identical to SEQ ID NO: 133750

SEQ ID NO: 239986 - RNA, 64 nt, hsa; identical to SEQ ID NO: 133751

SEQ ID NO: 239987 - RNA, 64 nt, hsa; identical to SEQ ID NO: 133752

SEQ ID NO: 239988 - RNA, 64 nt, hsa; identical to SEQ ID NO: 133753

SEQ ID NO: 239989 - RNA, 64 nt, hsa; identical to SEQ ID NO: 133754

SEQ ID NO: 239990 - RNA, 64 nt, hsa; identical to SEQ ID NO: 133755

SEQ ID NO: 239991 - RNA, 64 nt, hsa; identical to SEQ ID NO: 133756

SEQ ID NO: 239992 - RNA, 64 nt, hsa; identical to SEQ ID NO: 133757

SEQ ID NO: 239993 - RNA, 64 nt, hsa; identical to SEQ ID NO: 133758

SEQ ID NO: 239994 - RNA, 64 nt, hsa; identical to SEQ ID NO: 133759

SEQ ID NO: 239995 - RNA, 64 nt, hsa; identical to SEQ ID NO: 133760

SEQ ID NO: 239996 - RNA, 64 nt, hsa; identical to SEQ ID NO: 133761

SEQ ID NO: 239997 - RNA, 64 nt, hsa; identical to SEQ ID NO: 133762

SEQ ID NO: 239998 - RNA, 64 nt, hsa; identical to SEQ ID NO: 133763

SEQ ID NO: 239999 - RNA, 64 nt, hsa; identical to SEQ ID NO: 133764

SEQ ID NO: 240000 - RNA, 64 nt, hsa; identical to SEQ ID NO: 133765

SEQ ID NO: 240001 - RNA, 60 nt, hsa; identical to SEQ ID NO: 133766

SEQ ID NO: 240002 - RNA, 57 nt, hsa; identical to SEQ ID NO: 133767

SEQ ID NO: 240003 - RNA, 64 nt, hsa; identical to SEQ ID NO: 133768

SEQ ID NO: 240004 - RNA, 64 nt, hsa; identical to SEQ ID NO: 133769

SEQ ID NO: 240005 - RNA, 64 nt, hsa; identical to SEQ ID NO: 133770

SEQ ID NO: 240006 - RNA, 64 nt, hsa; identical to SEQ ID NO: 133771

SEQ ID NO: 240007 - RNA, 64 nt, hsa; identical to SEQ ID NO: 133772

SEQ ID NO: 240008 - RNA, 64 nt, hsa; identical to SEQ ID NO: 133773

SEQ ID NO: 240009 - RNA, 64 nt, hsa; identical to SEQ ID NO: 133774

SEQ ID NO: 240010 - RNA, 64 nt, hsa; identical to SEQ ID NO: 133775

SEQ ID NO: 240011 - RNA, 64 nt, hsa; identical to SEQ ID NO: 133776

SEQ ID NO: 240012 - RNA, 64 nt, hsa; identical to SEQ ID NO: 133777

SEQ ID NO: 240013 - RNA, 64 nt, hsa; identical to SEQ ID NO: 133778

SEQ ID NO: 240014 - RNA, 64 nt, hsa; identical to SEQ ID NO: 133779

SEQ ID NO: 240015 - RNA, 64 nt, hsa; identical to SEQ ID NO: 133780

SEQ ID NO: 240016 - RNA, 64 nt, hsa; identical to SEQ ID NO: 133781

SEQ ID NO: 240017 - RNA, 64 nt, hsa; identical to SEQ ID NO: 133782

SEQ ID NO: 240018 - RNA, 64 nt, hsa; identical to SEQ ID NO: 133783

SEQ ID NO: 240019 - RNA, 64 nt, hsa; identical to SEQ ID NO: 133784

SEQ ID NO: 240020 - RNA, 64 nt, hsa; identical to SEQ ID NO: 133785

SEQ ID NO: 240021 - RNA, 64 nt, hsa; identical to SEQ ID NO: 133786

SEQ ID NO: 240022 - RNA, 64 nt, hsa; identical to SEQ ID NO: 133787

SEQ ID NO: 240023 - RNA, 64 nt, hsa; identical to SEQ ID NO: 133788

SEQ ID NO: 240024 - RNA, 64 nt, hsa; identical to SEQ ID NO: 133789

SEQ ID NO: 240025 - RNA, 64 nt, hsa; identical to SEQ ID NO: 133790

SEQ ID NO: 240026 - RNA, 64 nt, hsa; identical to SEQ ID NO: 133791

SEQ ID NO: 240027 - RNA, 64 nt, hsa; identical to SEQ ID NO: 133792

SEQ ID NO: 240028 - RNA, 64 nt, hsa; identical to SEQ ID NO: 133793

SEQ ID NO: 240029 - RNA, 64 nt, hsa; identical to SEQ ID NO: 133794

SEQ ID NO: 240030 - RNA, 64 nt, hsa; identical to SEQ ID NO: 133795

SEQ ID NO: 240031 - RNA, 64 nt, hsa; identical to SEQ ID NO: 133796

SEQ ID NO: 240032 - RNA, 64 nt, hsa; identical to SEQ ID NO: 133797

SEQ ID NO: 240033 - RNA, 64 nt, hsa; identical to SEQ ID NO: 133798

SEQ ID NO: 240034 - RNA, 64 nt, hsa; identical to SEQ ID NO: 133799

SEQ ID NO: 240035 - RNA, 64 nt, hsa; identical to SEQ ID NO: 133800

SEQ ID NO: 240036 - RNA, 64 nt, hsa; identical to SEQ ID NO: 133801

SEQ ID NO: 240037 - RNA, 64 nt, hsa; identical to SEQ ID NO: 133802

SEQ ID NO: 240038 - RNA, 64 nt, hsa; identical to SEQ ID NO: 133803

SEQ ID NO: 240039 - RNA, 64 nt, hsa; identical to SEQ ID NO: 133804

SEQ ID NO: 240040 - RNA, 64 nt, hsa; identical to SEQ ID NO: 133805

SEQ ID NO: 240041 - RNA, 64 nt, hsa; identical to SEQ ID NO: 133806

SEQ ID NO: 240042 - RNA, 64 nt, hsa; identical to SEQ ID NO: 133807

SEQ ID NO: 240043 - RNA, 64 nt, hsa; identical to SEQ ID NO: 133808

SEQ ID NO: 240044 - RNA, 64 nt, hsa; identical to SEQ ID NO: 133809

SEQ ID NO: 240045 - RNA, 64 nt, hsa; identical to SEQ ID NO: 133810

SEQ ID NO: 240046 - RNA, 64 nt, hsa; identical to SEQ ID NO: 133811

SEQ ID NO: 240047 - RNA, 64 nt, hsa; identical to SEQ ID NO: 133812

SEQ ID NO: 240048 - RNA, 64 nt, hsa; identical to SEQ ID NO: 133813

SEQ ID NO: 240049 - RNA, 64 nt, hsa; identical to SEQ ID NO: 133814

SEQ ID NO: 240050 - RNA, 64 nt, hsa; identical to SEQ ID NO: 133815

SEQ ID NO: 240051 - RNA, 64 nt, hsa; identical to SEQ ID NO: 133816

SEQ ID NO: 240052 - RNA, 64 nt, hsa; identical to SEQ ID NO: 133817

SEQ ID NO: 240053 - RNA, 64 nt, hsa; identical to SEQ ID NO: 133818

SEQ ID NO: 240054 - RNA, 64 nt, hsa; identical to SEQ ID NO: 133819

SEQ ID NO: 240055 - RNA, 64 nt, hsa; identical to SEQ ID NO: 133820

SEQ ID NO: 240056 - RNA, 64 nt, hsa; identical to SEQ ID NO: 133821

SEQ ID NO: 240057 - RNA, 64 nt, hsa; identical to SEQ ID NO: 133822

SEQ ID NO: 240058 - RNA, 64 nt, hsa; identical to SEQ ID NO: 133823

SEQ ID NO: 240059 - RNA, 64 nt, hsa; identical to SEQ ID NO: 133824

SEQ ID NO: 240060 - RNA, 64 nt, hsa; identical to SEQ ID NO: 133825

SEQ ID NO: 240061 - RNA, 64 nt, hsa; identical to SEQ ID NO: 133826

SEQ ID NO: 240062 - RNA, 64 nt, hsa; identical to SEQ ID NO: 133827

SEQ ID NO: 240063 - RNA, 64 nt, hsa; identical to SEQ ID NO: 133828

SEQ ID NO: 240064 - RNA, 64 nt, hsa; identical to SEQ ID NO: 133829

SEQ ID NO: 240065 - RNA, 64 nt, hsa
gaggguggggagagcuggcaggcccagggcuuguccugcugaccccagcagacccuccuguugg

SEQ ID NO: 240066 - RNA, 64 nt, hsa
aaggaucuggccuuguggucacuggcaucugagcccugcugauggcuggggcucucgggcaugc

SEQ ID NO: 240067 - RNA, 64 nt, hsa
uguuucuggaggcagcuggucccccacaccgcguccugcugagccugcccccuggauuggcugu

SEQ ID NO: 240068 - RNA, 64 nt, hsa
uuuucggaucuucugucccagauccugcucccucccugcugagccugggguuccccuggcauug

SEQ ID NO: 240069 - RNA, 64 nt, hsa
cggagacuguggaggcaguggagacugacuucuuccugcugacagcuggaugucacacaugaag

SEQ ID NO: 240070 - RNA, 64 nt, hsa
ccugcugcuuuccugacagcuuacucuuccuccaccugcugagccugugccagacuccauugcu

SEQ ID NO: 240071 - RNA, 61 nt, hsa
uucugccggugucugagugaaggaccgcgcuccugcugaagaguuuagaaugaggcagcgg

SEQ ID NO: 240072 - RNA, 64 nt, hsa
gcuggugguaggugggaagcaugguguccaccugccugcugaccacuggacgcugcuccaugcu

SEQ ID NO: 240073 - RNA, 64 nt, hsa
cuagagauauggcagcgaaaggauguaaacagugccugcugaaugauuuccaaagagaaaaaaa

SEQ ID NO: 240074 - RNA, 64 nt, hsa
ucuucccaucacuggagcaccaggcacgaacccaccugcugagagacccaaggaggaaaaacag

SEQ ID NO: 240075 - RNA, 64 nt, hsa
cccugggguauccgggaggauggccgcaccccuuccugcugaucacccaaacguggucucccgu

SEQ ID NO: 240076 - RNA, 64 nt, hsa
gugccugggcuucuuuggcgagaugauugcuuugccugcugagguuaguuuugggaagcgcuuc

SEQ ID NO: 240077 - RNA, 64 nt, hsa
agcucaaggccaucgucuccucuuccaaucaggcccugcugaggcaggggaccucugcccgaga

SEQ ID NO: 240078 - RNA, 64 nt, hsa
gguucugaugaaaacugacugcuggcccagggccccugcugaggggcgucaggccaggcuugac

SEQ ID NO: 240079 - RNA, 64 nt, hsa
auaucuacuucuuuuaaaguuagaagaaaauuaaccugcugacaggcaacauuuuuggggugcu

SEQ ID NO: 240080 - RNA, 64 nt, hsa
gaccugggggcucacagcacagaaccuagaagcaccugcugacacucuucaacugauuuuuaaa

SEQ ID NO: 240081 - RNA, 64 nt, hsa
caugagcuaaguuguuauuucuuucauucauaucccugcugaaauauugguacuagcaacuuaa

SEQ ID NO: 240082 - RNA, 64 nt, hsa
guggggagcaaagagggcagccugacuagaugccccugcugaaucugguacuuucugcacagcc

SEQ ID NO: 240083 - RNA, 64 nt, hsa
accuagugccugaguuuggggaugggaugcucugccugcugauguggcccugacaggcagccgu

SEQ ID NO: 240084 - RNA, 64 nt, hsa
agcucccccaugcgaggauccgggucugccuccuccugcugaagacagacaugcagcagcgggc

SEQ ID NO: 240085 - RNA, 64 nt, hsa
ucaaggacgucugcuuccaccucaagcgcacagcccugcugagccacauggccggcucugugca

SEQ ID NO: 240086 - RNA, 64 nt, hsa
accuggaggcgcacuaugaggcacugcggcacuuccugcugauggaggacggcgaguucgccca

SEQ ID NO: 240087 - RNA, 64 nt, hsa; identical to SEQ ID NO: 110959

SEQ ID NO: 240088 - RNA, 64 nt, hsa; identical to SEQ ID NO: 110960

SEQ ID NO: 240089 - RNA, 64 nt, hsa; identical to SEQ ID NO: 110961

SEQ ID NO: 240090 - RNA, 64 nt, hsa; identical to SEQ ID NO: 110962

SEQ ID NO: 240091 - RNA, 64 nt, hsa; identical to SEQ ID NO: 110963

SEQ ID NO: 240092 - RNA, 64 nt, hsa; identical to SEQ ID NO: 110964

SEQ ID NO: 240093 - RNA, 64 nt, hsa; identical to SEQ ID NO: 110965

SEQ ID NO: 240094 - RNA, 64 nt, hsa; identical to SEQ ID NO: 110966

SEQ ID NO: 240095 - RNA, 64 nt, hsa; identical to SEQ ID NO: 110967

SEQ ID NO: 240096 - RNA, 64 nt, hsa; identical to SEQ ID NO: 110968

SEQ ID NO: 240097 - RNA, 64 nt, hsa; identical to SEQ ID NO: 110969

SEQ ID NO: 240098 - RNA, 64 nt, hsa; identical to SEQ ID NO: 110970

SEQ ID NO: 240099 - RNA, 64 nt, hsa; identical to SEQ ID NO: 110971

SEQ ID NO: 240100 - RNA, 64 nt, hsa; identical to SEQ ID NO: 110972

SEQ ID NO: 240101 - RNA, 64 nt, hsa; identical to SEQ ID NO: 110973

SEQ ID NO: 240102 - RNA, 64 nt, hsa; identical to SEQ ID NO: 110974

SEQ ID NO: 240103 - RNA, 64 nt, hsa; identical to SEQ ID NO: 110975

SEQ ID NO: 240104 - RNA, 64 nt, hsa; identical to SEQ ID NO: 110976

SEQ ID NO: 240105 - RNA, 64 nt, hsa; identical to SEQ ID NO: 110977

SEQ ID NO: 240106 - RNA, 64 nt, hsa; identical to SEQ ID NO: 110978

SEQ ID NO: 240107 - RNA, 64 nt, hsa; identical to SEQ ID NO: 110979

SEQ ID NO: 240108 - RNA, 64 nt, hsa; identical to SEQ ID NO: 110980

SEQ ID NO: 240109 - RNA, 64 nt, hsa; identical to SEQ ID NO: 91418

SEQ ID NO: 240110 - RNA, 64 nt, hsa; identical to SEQ ID NO: 91419

SEQ ID NO: 240111 - RNA, 56 nt, hsa; identical to SEQ ID NO: 91420

SEQ ID NO: 240112 - RNA, 64 nt, hsa; identical to SEQ ID NO: 91421

SEQ ID NO: 240113 - RNA, 64 nt, hsa; identical to SEQ ID NO: 91422

SEQ ID NO: 240114 - RNA, 64 nt, hsa; identical to SEQ ID NO: 91423

SEQ ID NO: 240115 - RNA, 64 nt, hsa; identical to SEQ ID NO: 91424

SEQ ID NO: 240116 - RNA, 64 nt, hsa; identical to SEQ ID NO: 91425

SEQ ID NO: 240117 - RNA, 64 nt, hsa; identical to SEQ ID NO: 91426

SEQ ID NO: 240118 - RNA, 64 nt, hsa; identical to SEQ ID NO: 91427

SEQ ID NO: 240119 - RNA, 64 nt, hsa; identical to SEQ ID NO: 91428

SEQ ID NO: 240120 - RNA, 64 nt, hsa; identical to SEQ ID NO: 91429

SEQ ID NO: 240121 - RNA, 64 nt, hsa; identical to SEQ ID NO: 91430

SEQ ID NO: 240122 - RNA, 64 nt, hsa; identical to SEQ ID NO: 91431

SEQ ID NO: 240123 - RNA, 64 nt, hsa; identical to SEQ ID NO: 91432

SEQ ID NO: 240124 - RNA, 64 nt, hsa; identical to SEQ ID NO: 91433

SEQ ID NO: 240125 - RNA, 64 nt, hsa; identical to SEQ ID NO: 91434

SEQ ID NO: 240126 - RNA, 64 nt, hsa; identical to SEQ ID NO: 91435

SEQ ID NO: 240127 - RNA, 64 nt, hsa; identical to SEQ ID NO: 91436

SEQ ID NO: 240128 - RNA, 64 nt, hsa; identical to SEQ ID NO: 217395

SEQ ID NO: 240129 - RNA, 64 nt, hsa; identical to SEQ ID NO: 217396

SEQ ID NO: 240130 - RNA, 64 nt, hsa; identical to SEQ ID NO: 217397

SEQ ID NO: 240131 - RNA, 64 nt, hsa; identical to SEQ ID NO: 217398

SEQ ID NO: 240132 - RNA, 64 nt, hsa; identical to SEQ ID NO: 217399

SEQ ID NO: 240133 - RNA, 64 nt, hsa; identical to SEQ ID NO: 217400

SEQ ID NO: 240134 - RNA, 64 nt, hsa; identical to SEQ ID NO: 217401

SEQ ID NO: 240135 - RNA, 64 nt, hsa; identical to SEQ ID NO: 217402

SEQ ID NO: 240136 - RNA, 64 nt, hsa; identical to SEQ ID NO: 217403

SEQ ID NO: 240137 - RNA, 64 nt, hsa; identical to SEQ ID NO: 217404

SEQ ID NO: 240138 - RNA, 64 nt, hsa; identical to SEQ ID NO: 217405

SEQ ID NO: 240139 - RNA, 64 nt, hsa; identical to SEQ ID NO: 217406

SEQ ID NO: 240140 - RNA, 64 nt, hsa; identical to SEQ ID NO: 217407

SEQ ID NO: 240141 - RNA, 64 nt, hsa; identical to SEQ ID NO: 217408

SEQ ID NO: 240142 - RNA, 64 nt, hsa; identical to SEQ ID NO: 217409

SEQ ID NO: 240143 - RNA, 64 nt, hsa; identical to SEQ ID NO: 217410

SEQ ID NO: 240144 - RNA, 64 nt, hsa; identical to SEQ ID NO: 217411

SEQ ID NO: 240145 - RNA, 64 nt, hsa; identical to SEQ ID NO: 217412

SEQ ID NO: 240146 - RNA, 64 nt, hsa; identical to SEQ ID NO: 217413

SEQ ID NO: 240147 - RNA, 64 nt, hsa; identical to SEQ ID NO: 217414

SEQ ID NO: 240148 - RNA, 64 nt, hsa; identical to SEQ ID NO: 217415

SEQ ID NO: 240149 - RNA, 64 nt, hsa; identical to SEQ ID NO: 217416

SEQ ID NO: 240150 - RNA, 64 nt, hsa; identical to SEQ ID NO: 98672

SEQ ID NO: 240151 - RNA, 64 nt, hsa; identical to SEQ ID NO: 98673

SEQ ID NO: 240152 - RNA, 64 nt, hsa; identical to SEQ ID NO: 98674

SEQ ID NO: 240153 - RNA, 64 nt, hsa; identical to SEQ ID NO: 98675

SEQ ID NO: 240154 - RNA, 64 nt, hsa; identical to SEQ ID NO: 98676

SEQ ID NO: 240155 - RNA, 64 nt, hsa; identical to SEQ ID NO: 98677

SEQ ID NO: 240156 - RNA, 64 nt, hsa; identical to SEQ ID NO: 98678

SEQ ID NO: 240157 - RNA, 64 nt, hsa; identical to SEQ ID NO: 98679

SEQ ID NO: 240158 - RNA, 64 nt, hsa; identical to SEQ ID NO: 98680

SEQ ID NO: 240159 - RNA, 64 nt, hsa; identical to SEQ ID NO: 98681

SEQ ID NO: 240160 - RNA, 64 nt, hsa; identical to SEQ ID NO: 98682

SEQ ID NO: 240161 - RNA, 64 nt, hsa; identical to SEQ ID NO: 98683

SEQ ID NO: 240162 - RNA, 64 nt, hsa; identical to SEQ ID NO: 98684

SEQ ID NO: 240163 - RNA, 64 nt, hsa; identical to SEQ ID NO: 98685

SEQ ID NO: 240164 - RNA, 64 nt, hsa; identical to SEQ ID NO: 98686

SEQ ID NO: 240165 - RNA, 64 nt, hsa; identical to SEQ ID NO: 98687

SEQ ID NO: 240166 - RNA, 64 nt, hsa; identical to SEQ ID NO: 98688

SEQ ID NO: 240167 - RNA, 64 nt, hsa; identical to SEQ ID NO: 98689

SEQ ID NO: 240168 - RNA, 64 nt, hsa; identical to SEQ ID NO: 98690

SEQ ID NO: 240169 - RNA, 64 nt, hsa; identical to SEQ ID NO: 98691

SEQ ID NO: 240170 - RNA, 64 nt, hsa; identical to SEQ ID NO: 98692

SEQ ID NO: 240171 - RNA, 64 nt, hsa; identical to SEQ ID NO: 98693

SEQ ID NO: 240172 - RNA, 64 nt, hsa; identical to SEQ ID NO: 98694

SEQ ID NO: 240173 - RNA, 64 nt, hsa; identical to SEQ ID NO: 98695

SEQ ID NO: 240174 - RNA, 64 nt, hsa; identical to SEQ ID NO: 98696

SEQ ID NO: 240175 - RNA, 60 nt, hsa; identical to SEQ ID NO: 98697

SEQ ID NO: 240176 - RNA, 64 nt, hsa; identical to SEQ ID NO: 98698

SEQ ID NO: 240177 - RNA, 64 nt, hsa; identical to SEQ ID NO: 98699

SEQ ID NO: 240178 - RNA, 64 nt, hsa; identical to SEQ ID NO: 98700

SEQ ID NO: 240179 - RNA, 64 nt, hsa; identical to SEQ ID NO: 98701

SEQ ID NO: 240180 - RNA, 64 nt, hsa; identical to SEQ ID NO: 98702

SEQ ID NO: 240181 - RNA, 64 nt, hsa; identical to SEQ ID NO: 98703

SEQ ID NO: 240182 - RNA, 64 nt, hsa; identical to SEQ ID NO: 98704

SEQ ID NO: 240183 - RNA, 64 nt, hsa; identical to SEQ ID NO: 98705

SEQ ID NO: 240184 - RNA, 64 nt, hsa; identical to SEQ ID NO: 98706

SEQ ID NO: 240185 - RNA, 64 nt, hsa; identical to SEQ ID NO: 98707

SEQ ID NO: 240186 - RNA, 64 nt, hsa; identical to SEQ ID NO: 98708

SEQ ID NO: 240187 - RNA, 64 nt, hsa; identical to SEQ ID NO: 98709

SEQ ID NO: 240188 - RNA, 64 nt, hsa; identical to SEQ ID NO: 98710

SEQ ID NO: 240189 - RNA, 64 nt, hsa; identical to SEQ ID NO: 98711

SEQ ID NO: 240190 - RNA, 64 nt, hsa; identical to SEQ ID NO: 98712

SEQ ID NO: 240191 - RNA, 64 nt, hsa; identical to SEQ ID NO: 98713

SEQ ID NO: 240192 - RNA, 64 nt, hsa; identical to SEQ ID NO: 98714

SEQ ID NO: 240193 - RNA, 64 nt, hsa; identical to SEQ ID NO: 98715

SEQ ID NO: 240194 - RNA, 64 nt, hsa; identical to SEQ ID NO: 98716

SEQ ID NO: 240195 - RNA, 64 nt, hsa; identical to SEQ ID NO: 98717

SEQ ID NO: 240196 - RNA, 64 nt, hsa; identical to SEQ ID NO: 98718

SEQ ID NO: 240197 - RNA, 64 nt, hsa; identical to SEQ ID NO: 98719

SEQ ID NO: 240198 - RNA, 64 nt, hsa; identical to SEQ ID NO: 98720

SEQ ID NO: 240199 - RNA, 64 nt, hsa; identical to SEQ ID NO: 98721

SEQ ID NO: 240200 - RNA, 64 nt, hsa; identical to SEQ ID NO: 98722

SEQ ID NO: 240201 - RNA, 64 nt, hsa; identical to SEQ ID NO: 98723

SEQ ID NO: 240202 - RNA, 64 nt, hsa; identical to SEQ ID NO: 98724

SEQ ID NO: 240203 - RNA, 64 nt, hsa; identical to SEQ ID NO: 98725

SEQ ID NO: 240204 - RNA, 64 nt, hsa; identical to SEQ ID NO: 98726

SEQ ID NO: 240205 - RNA, 64 nt, hsa; identical to SEQ ID NO: 98727

SEQ ID NO: 240206 - RNA, 64 nt, hsa; identical to SEQ ID NO: 98728

SEQ ID NO: 240207 - RNA, 64 nt, hsa; identical to SEQ ID NO: 98729

SEQ ID NO: 240208 - RNA, 64 nt, hsa; identical to SEQ ID NO: 98730

SEQ ID NO: 240209 - RNA, 64 nt, hsa; identical to SEQ ID NO: 98731

SEQ ID NO: 240210 - RNA, 64 nt, hsa; identical to SEQ ID NO: 98732

SEQ ID NO: 240211 - RNA, 64 nt, hsa; identical to SEQ ID NO: 98733

SEQ ID NO: 240212 - RNA, 64 nt, hsa; identical to SEQ ID NO: 98734

SEQ ID NO: 240213 - RNA, 64 nt, hsa; identical to SEQ ID NO: 98735

SEQ ID NO: 240214 - RNA, 64 nt, hsa; identical to SEQ ID NO: 98736

SEQ ID NO: 240215 - RNA, 64 nt, hsa; identical to SEQ ID NO: 98737

SEQ ID NO: 240216 - RNA, 64 nt, hsa; identical to SEQ ID NO: 98738

SEQ ID NO: 240217 - RNA, 64 nt, hsa; identical to SEQ ID NO: 98739

SEQ ID NO: 240218 - RNA, 64 nt, hsa; identical to SEQ ID NO: 98740

SEQ ID NO: 240219 - RNA, 64 nt, hsa; identical to SEQ ID NO: 98741

SEQ ID NO: 240220 - RNA, 64 nt, hsa; identical to SEQ ID NO: 98742

SEQ ID NO: 240221 - RNA, 64 nt, hsa; identical to SEQ ID NO: 98743

SEQ ID NO: 240222 - RNA, 64 nt, hsa; identical to SEQ ID NO: 98744

SEQ ID NO: 240223 - RNA, 64 nt, hsa; identical to SEQ ID NO: 98745

SEQ ID NO: 240224 - RNA, 64 nt, hsa; identical to SEQ ID NO: 98746

SEQ ID NO: 240225 - RNA, 64 nt, hsa; identical to SEQ ID NO: 98747

SEQ ID NO: 240226 - RNA, 64 nt, hsa; identical to SEQ ID NO: 98748

SEQ ID NO: 240227 - RNA, 64 nt, hsa; identical to SEQ ID NO: 98749

SEQ ID NO: 240228 - RNA, 64 nt, hsa; identical to SEQ ID NO: 98750

SEQ ID NO: 240229 - RNA, 64 nt, hsa; identical to SEQ ID NO: 98751

SEQ ID NO: 240230 - RNA, 64 nt, hsa; identical to SEQ ID NO: 98752

SEQ ID NO: 240231 - RNA, 64 nt, hsa; identical to SEQ ID NO: 98753

SEQ ID NO: 240232 - RNA, 64 nt, hsa; identical to SEQ ID NO: 98754

SEQ ID NO: 240233 - RNA, 64 nt, hsa; identical to SEQ ID NO: 98755

SEQ ID NO: 240234 - RNA, 64 nt, hsa; identical to SEQ ID NO: 98756

SEQ ID NO: 240235 - RNA, 64 nt, hsa; identical to SEQ ID NO: 98757

SEQ ID NO: 240236 - RNA, 64 nt, hsa; identical to SEQ ID NO: 98758

SEQ ID NO: 240237 - RNA, 64 nt, hsa; identical to SEQ ID NO: 98759

SEQ ID NO: 240238 - RNA, 64 nt, hsa; identical to SEQ ID NO: 98760

SEQ ID NO: 240239 - RNA, 64 nt, hsa; identical to SEQ ID NO: 98761

SEQ ID NO: 240240 - RNA, 64 nt, hsa; identical to SEQ ID NO: 98762

SEQ ID NO: 240241 - RNA, 64 nt, hsa; identical to SEQ ID NO: 98763

SEQ ID NO: 240242 - RNA, 64 nt, hsa; identical to SEQ ID NO: 98764

SEQ ID NO: 240243 - RNA, 64 nt, hsa; identical to SEQ ID NO: 98765

SEQ ID NO: 240244 - RNA, 64 nt, hsa; identical to SEQ ID NO: 98766

SEQ ID NO: 240245 - RNA, 64 nt, hsa; identical to SEQ ID NO: 98767

SEQ ID NO: 240246 - RNA, 64 nt, hsa; identical to SEQ ID NO: 98768

SEQ ID NO: 240247 - RNA, 64 nt, hsa; identical to SEQ ID NO: 98769

SEQ ID NO: 240248 - RNA, 64 nt, hsa; identical to SEQ ID NO: 98770

SEQ ID NO: 240249 - RNA, 64 nt, hsa; identical to SEQ ID NO: 98771

SEQ ID NO: 240250 - RNA, 64 nt, hsa; identical to SEQ ID NO: 98772

SEQ ID NO: 240251 - RNA, 64 nt, hsa; identical to SEQ ID NO: 98773

SEQ ID NO: 240252 - RNA, 64 nt, hsa; identical to SEQ ID NO: 98774

SEQ ID NO: 240253 - RNA, 64 nt, hsa; identical to SEQ ID NO: 98775

SEQ ID NO: 240254 - RNA, 64 nt, hsa; identical to SEQ ID NO: 98776

SEQ ID NO: 240255 - RNA, 64 nt, hsa; identical to SEQ ID NO: 98777

SEQ ID NO: 240256 - RNA, 64 nt, hsa; identical to SEQ ID NO: 98778

SEQ ID NO: 240257 - RNA, 64 nt, hsa; identical to SEQ ID NO: 98779

SEQ ID NO: 240258 - RNA, 64 nt, hsa; identical to SEQ ID NO: 98780

SEQ ID NO: 240259 - RNA, 64 nt, hsa; identical to SEQ ID NO: 98781

SEQ ID NO: 240260 - RNA, 64 nt, hsa; identical to SEQ ID NO: 98782

SEQ ID NO: 240261 - RNA, 64 nt, hsa; identical to SEQ ID NO: 98783

SEQ ID NO: 240262 - RNA, 64 nt, hsa; identical to SEQ ID NO: 98784

SEQ ID NO: 240263 - RNA, 64 nt, hsa; identical to SEQ ID NO: 98785

SEQ ID NO: 240264 - RNA, 64 nt, hsa
aaagguagcugaugagguuacaugguuacauguucuacaucaugcauaguagcuugaaaucuag

SEQ ID NO: 240265 - RNA, 64 nt, hsa
gaaaaaaauaucagcucccaaagggcccaugugucuacaucaucaguuacugucaugcaccaca

SEQ ID NO: 240266 - RNA, 64 nt, hsa
uuagacugcuguucugauugcauuuaucuuuuuccuacaucauuuagaauuuuauuucccugau

SEQ ID NO: 240267 - RNA, 64 nt, hsa
guaaagcacagguggauuucucuauuuuugaauacuacaucagauuuagaugcacgacuaccug

SEQ ID NO: 240268 - RNA, 64 nt, hsa
ccaagaaacaccgagugaggccauagcaacuccccuacaucaaaugcucaagcccugaguugcc

SEQ ID NO: 240269 - RNA, 64 nt, hsa
gcccgaaacaccaagugaggccauagcaauuccccuacaucaaaugcucaagcccccagcugga

SEQ ID NO: 240270 - RNA, 64 nt, hsa
gguggcuucuugaugcugcgcggucccccacucccuacaucagaaugcaucccgcauccagacu

SEQ ID NO: 240271 - RNA, 64 nt, hsa
gugcaagucuugaugcugcgccgucccccacucccuacaucagaacgcaucccucaucuggacu

SEQ ID NO: 240272 - RNA, 64 nt, hsa; identical to SEQ ID NO: 147473

SEQ ID NO: 240273 - RNA, 64 nt, hsa; identical to SEQ ID NO: 147474

SEQ ID NO: 240274 - RNA, 64 nt, hsa; identical to SEQ ID NO: 147475

SEQ ID NO: 240275 - RNA, 64 nt, hsa; identical to SEQ ID NO: 147476

SEQ ID NO: 240276 - RNA, 64 nt, hsa; identical to SEQ ID NO: 147477

SEQ ID NO: 240277 - RNA, 64 nt, hsa; identical to SEQ ID NO: 147478

SEQ ID NO: 240278 - RNA, 64 nt, hsa; identical to SEQ ID NO: 147479

SEQ ID NO: 240279 - RNA, 64 nt, hsa; identical to SEQ ID NO: 147480

SEQ ID NO: 240280 - RNA, 64 nt, hsa; identical to SEQ ID NO: 147481

SEQ ID NO: 240281 - RNA, 64 nt, hsa; identical to SEQ ID NO: 147482

SEQ ID NO: 240282 - RNA, 64 nt, hsa; identical to SEQ ID NO: 110487

SEQ ID NO: 240283 - RNA, 64 nt, hsa; identical to SEQ ID NO: 110488

SEQ ID NO: 240284 - RNA, 64 nt, hsa; identical to SEQ ID NO: 110489

SEQ ID NO: 240285 - RNA, 64 nt, hsa; identical to SEQ ID NO: 110490

SEQ ID NO: 240286 - RNA, 64 nt, hsa; identical to SEQ ID NO: 110491

SEQ ID NO: 240287 - RNA, 64 nt, hsa; identical to SEQ ID NO: 110492

SEQ ID NO: 240288 - RNA, 64 nt, hsa; identical to SEQ ID NO: 110493

SEQ ID NO: 240289 - RNA, 64 nt, hsa; identical to SEQ ID NO: 110494

SEQ ID NO: 240290 - RNA, 64 nt, hsa; identical to SEQ ID NO: 110495

SEQ ID NO: 240291 - RNA, 64 nt, hsa; identical to SEQ ID NO: 110496

SEQ ID NO: 240292 - RNA, 64 nt, hsa; identical to SEQ ID NO: 110497

SEQ ID NO: 240293 - RNA, 64 nt, hsa; identical to SEQ ID NO: 110498

SEQ ID NO: 240294 - RNA, 64 nt, hsa; identical to SEQ ID NO: 110499

SEQ ID NO: 240295 - RNA, 64 nt, hsa; identical to SEQ ID NO: 110500

SEQ ID NO: 240296 - RNA, 64 nt, hsa; identical to SEQ ID NO: 110501

SEQ ID NO: 240297 - RNA, 64 nt, hsa; identical to SEQ ID NO: 110502

SEQ ID NO: 240298 - RNA, 56 nt, hsa; identical to SEQ ID NO: 110503

SEQ ID NO: 240299 - RNA, 64 nt, hsa; identical to SEQ ID NO: 110504

SEQ ID NO: 240300 - RNA, 64 nt, hsa; identical to SEQ ID NO: 110505

SEQ ID NO: 240301 - RNA, 64 nt, hsa; identical to SEQ ID NO: 110506

SEQ ID NO: 240302 - RNA, 64 nt, hsa; identical to SEQ ID NO: 110507

SEQ ID NO: 240303 - RNA, 64 nt, hsa; identical to SEQ ID NO: 110508

SEQ ID NO: 240304 - RNA, 64 nt, hsa; identical to SEQ ID NO: 110509

SEQ ID NO: 240305 - RNA, 64 nt, hsa; identical to SEQ ID NO: 110510

SEQ ID NO: 240306 - RNA, 64 nt, hsa; identical to SEQ ID NO: 110511

SEQ ID NO: 240307 - RNA, 64 nt, hsa; identical to SEQ ID NO: 110512

SEQ ID NO: 240308 - RNA, 64 nt, hsa; identical to SEQ ID NO: 110513

SEQ ID NO: 240309 - RNA, 64 nt, hsa; identical to SEQ ID NO: 110514

SEQ ID NO: 240310 - RNA, 64 nt, hsa; identical to SEQ ID NO: 110515

SEQ ID NO: 240311 - RNA, 64 nt, hsa; identical to SEQ ID NO: 110516

SEQ ID NO: 240312 - RNA, 64 nt, hsa; identical to SEQ ID NO: 110517

SEQ ID NO: 240313 - RNA, 64 nt, hsa; identical to SEQ ID NO: 110518

SEQ ID NO: 240314 - RNA, 64 nt, hsa; identical to SEQ ID NO: 110519

SEQ ID NO: 240315 - RNA, 64 nt, hsa; identical to SEQ ID NO: 110520

SEQ ID NO: 240316 - RNA, 64 nt, hsa; identical to SEQ ID NO: 110521

SEQ ID NO: 240317 - RNA, 64 nt, hsa; identical to SEQ ID NO: 110522

SEQ ID NO: 240318 - RNA, 64 nt, hsa; identical to SEQ ID NO: 110523

SEQ ID NO: 240319 - RNA, 64 nt, hsa
ucucuguacacagccccgugaacccugaggaguggagucauacgcgaaggguguguggccaggc

SEQ ID NO: 240320 - RNA, 64 nt, hsa
ucucuguacacagccccgugaacccugaggaguggagucauacacgaagggcguguggccaucg

SEQ ID NO: 240321 - RNA, 64 nt, hsa
cagagucuccaagccccacgaacccugaggaguggagucauacgcgaaggccauauggccaucg

SEQ ID NO: 240322 - RNA, 64 nt, hsa
gagcauuuuuaacauacuccauagucuuuuccugugguguuaggucuuuauuuuuauuuuuuuc

SEQ ID NO: 240323 - RNA, 64 nt, hsa
aacuuuauaaaaagcaaugcaguaccccauagacugguguuaaauguugucuacagugcaaaau

SEQ ID NO: 240324 - RNA, 64 nt, hsa
uuucaugaagcugauccuuuugugugugugcuccugguguuaggagagaaaaaagcucuaugaa

SEQ ID NO: 240325 - RNA, 64 nt, hsa
cagauucccuugcaaucgauuucucuuuagucguugguguuagaaguaccagcacaauuugagc

SEQ ID NO: 240326 - RNA, 64 nt, hsa
cuacugcaggaauccagauucugggaaacaacccugguguuacacaacugauccgugugugagg

SEQ ID NO: 240327 - RNA, 64 nt, hsa
cuacugcaggaauccagauccuguggaaggcccuugguguuacacgauggaucccaaagucaga

SEQ ID NO: 240328 - RNA, 64 nt, hsa
cuacugcaggaauccggauuguucggcaggcccuugguguuauacaacggaucccaaagucagg

SEQ ID NO: 240329 - RNA, 64 nt, hsa
gugguaaugauaauaaaaaugguuuucucaaaacugguguuaauuuaaguuaccugggauguuu

SEQ ID NO: 240330 - RNA, 64 nt, hsa
auacaaauuuuuguaaauaucagaucagugauacugguguuaguguuguaaucagguuaaaccc

SEQ ID NO: 240331 - RNA, 64 nt, hsa
uuuccuaaaccaaguuaaaauuacauguauauuuugguguuaagguugauuuuuaagauacuuc

SEQ ID NO: 240332 - RNA, 64 nt, hsa
ugacaauaucuguuggauauuugauauaauuuaaugguguuauaaaaccuuuaagaggauucau

SEQ ID NO: 240333 - RNA, 64 nt, hsa
aaagcucaggaauccuacgcuauguagaaugucuugguguuaucaggguuaagccuguaauuau

SEQ ID NO: 240334 - RNA, 64 nt, hsa
caaguccuugaacccaggccaugugguuagacguugguguuaagguuagaccuuauguuagagu

SEQ ID NO: 240335 - RNA, 64 nt, hsa; identical to SEQ ID NO: 147132

SEQ ID NO: 240336 - RNA, 64 nt, hsa; identical to SEQ ID NO: 147133

SEQ ID NO: 240337 - RNA, 64 nt, hsa; identical to SEQ ID NO: 147134

SEQ ID NO: 240338 - RNA, 64 nt, hsa; identical to SEQ ID NO: 147135

SEQ ID NO: 240339 - RNA, 64 nt, hsa; identical to SEQ ID NO: 147136

SEQ ID NO: 240340 - RNA, 64 nt, hsa; identical to SEQ ID NO: 147137

SEQ ID NO: 240341 - RNA, 64 nt, hsa; identical to SEQ ID NO: 147138

SEQ ID NO: 240342 - RNA, 64 nt, hsa; identical to SEQ ID NO: 147139

SEQ ID NO: 240343 - RNA, 64 nt, hsa; identical to SEQ ID NO: 147140

SEQ ID NO: 240344 - RNA, 64 nt, hsa; identical to SEQ ID NO: 147141

SEQ ID NO: 240345 - RNA, 64 nt, hsa; identical to SEQ ID NO: 147142

SEQ ID NO: 240346 - RNA, 64 nt, hsa; identical to SEQ ID NO: 147143

SEQ ID NO: 240347 - RNA, 64 nt, hsa; identical to SEQ ID NO: 147144

SEQ ID NO: 240348 - RNA, 64 nt, hsa; identical to SEQ ID NO: 147145

SEQ ID NO: 240349 - RNA, 64 nt, hsa; identical to SEQ ID NO: 147146

SEQ ID NO: 240350 - RNA, 64 nt, hsa; identical to SEQ ID NO: 147147

SEQ ID NO: 240351 - RNA, 64 nt, hsa; identical to SEQ ID NO: 147148

SEQ ID NO: 240352 - RNA, 64 nt, hsa; identical to SEQ ID NO: 147149

SEQ ID NO: 240353 - RNA, 64 nt, hsa; identical to SEQ ID NO: 147150

SEQ ID NO: 240354 - RNA, 64 nt, hsa; identical to SEQ ID NO: 147151

SEQ ID NO: 240355 - RNA, 64 nt, hsa; identical to SEQ ID NO: 147152

SEQ ID NO: 240356 - RNA, 64 nt, hsa; identical to SEQ ID NO: 147153

SEQ ID NO: 240357 - RNA, 64 nt, hsa; identical to SEQ ID NO: 147154

SEQ ID NO: 240358 - RNA, 64 nt, hsa; identical to SEQ ID NO: 147155

SEQ ID NO: 240359 - RNA, 64 nt, hsa; identical to SEQ ID NO: 147156

SEQ ID NO: 240360 - RNA, 64 nt, hsa; identical to SEQ ID NO: 147157

SEQ ID NO: 240361 - RNA, 64 nt, hsa; identical to SEQ ID NO: 147158

SEQ ID NO: 240362 - RNA, 64 nt, hsa; identical to SEQ ID NO: 147159

SEQ ID NO: 240363 - RNA, 64 nt, hsa; identical to SEQ ID NO: 147160

SEQ ID NO: 240364 - RNA, 64 nt, hsa; identical to SEQ ID NO: 147161

SEQ ID NO: 240365 - RNA, 64 nt, hsa; identical to SEQ ID NO: 147162

SEQ ID NO: 240366 - RNA, 64 nt, hsa; identical to SEQ ID NO: 147163

SEQ ID NO: 240367 - RNA, 64 nt, hsa; identical to SEQ ID NO: 147164

SEQ ID NO: 240368 - RNA, 64 nt, hsa; identical to SEQ ID NO: 147165

SEQ ID NO: 240369 - RNA, 64 nt, hsa; identical to SEQ ID NO: 147166

SEQ ID NO: 240370 - RNA, 64 nt, hsa; identical to SEQ ID NO: 147167

SEQ ID NO: 240371 - RNA, 64 nt, hsa; identical to SEQ ID NO: 68831

SEQ ID NO: 240372 - RNA, 64 nt, hsa; identical to SEQ ID NO: 68832

SEQ ID NO: 240373 - RNA, 64 nt, hsa; identical to SEQ ID NO: 68833

SEQ ID NO: 240374 - RNA, 64 nt, hsa; identical to SEQ ID NO: 68834

SEQ ID NO: 240375 - RNA, 64 nt, hsa; identical to SEQ ID NO: 68835

SEQ ID NO: 240376 - RNA, 64 nt, hsa; identical to SEQ ID NO: 68836

SEQ ID NO: 240377 - RNA, 64 nt, hsa; identical to SEQ ID NO: 68837

SEQ ID NO: 240378 - RNA, 64 nt, hsa; identical to SEQ ID NO: 68838

SEQ ID NO: 240379 - RNA, 64 nt, hsa; identical to SEQ ID NO: 68839

SEQ ID NO: 240380 - RNA, 64 nt, hsa; identical to SEQ ID NO: 68840

SEQ ID NO: 240381 - RNA, 64 nt, hsa; identical to SEQ ID NO: 68841

SEQ ID NO: 240382 - RNA, 64 nt, hsa; identical to SEQ ID NO: 68842

SEQ ID NO: 240383 - RNA, 64 nt, hsa; identical to SEQ ID NO: 68843

SEQ ID NO: 240384 - RNA, 64 nt, hsa; identical to SEQ ID NO: 68844

SEQ ID NO: 240385 - RNA, 64 nt, hsa; identical to SEQ ID NO: 68845

SEQ ID NO: 240386 - RNA, 64 nt, hsa; identical to SEQ ID NO: 68846

SEQ ID NO: 240387 - RNA, 64 nt, hsa; identical to SEQ ID NO: 68847

SEQ ID NO: 240388 - RNA, 64 nt, hsa; identical to SEQ ID NO: 68848

SEQ ID NO: 240389 - RNA, 64 nt, hsa; identical to SEQ ID NO: 68849

SEQ ID NO: 240390 - RNA, 64 nt, hsa; identical to SEQ ID NO: 68850

SEQ ID NO: 240391 - RNA, 64 nt, hsa; identical to SEQ ID NO: 68851

SEQ ID NO: 240392 - RNA, 64 nt, hsa; identical to SEQ ID NO: 68852

SEQ ID NO: 240393 - RNA, 64 nt, hsa; identical to SEQ ID NO: 68853

SEQ ID NO: 240394 - RNA, 64 nt, hsa; identical to SEQ ID NO: 68854

SEQ ID NO: 240395 - RNA, 64 nt, hsa; identical to SEQ ID NO: 68855

SEQ ID NO: 240396 - RNA, 64 nt, hsa; identical to SEQ ID NO: 68856

SEQ ID NO: 240397 - RNA, 64 nt, hsa; identical to SEQ ID NO: 68857

SEQ ID NO: 240398 - RNA, 64 nt, hsa; identical to SEQ ID NO: 68858

SEQ ID NO: 240399 - RNA, 64 nt, hsa; identical to SEQ ID NO: 68859

SEQ ID NO: 240400 - RNA, 64 nt, hsa; identical to SEQ ID NO: 68860

SEQ ID NO: 240401 - RNA, 64 nt, hsa; identical to SEQ ID NO: 68861

SEQ ID NO: 240402 - RNA, 64 nt, hsa; identical to SEQ ID NO: 68862

SEQ ID NO: 240403 - RNA, 64 nt, hsa; identical to SEQ ID NO: 68863

SEQ ID NO: 240404 - RNA, 64 nt, hsa; identical to SEQ ID NO: 68864

SEQ ID NO: 240405 - RNA, 64 nt, hsa; identical to SEQ ID NO: 68865

SEQ ID NO: 240406 - RNA, 64 nt, hsa; identical to SEQ ID NO: 68866

SEQ ID NO: 240407 - RNA, 64 nt, hsa; identical to SEQ ID NO: 68867

SEQ ID NO: 240408 - RNA, 64 nt, hsa; identical to SEQ ID NO: 68868

SEQ ID NO: 240409 - RNA, 64 nt, hsa; identical to SEQ ID NO: 68869

SEQ ID NO: 240410 - RNA, 64 nt, hsa; identical to SEQ ID NO: 68870

SEQ ID NO: 240411 - RNA, 64 nt, hsa; identical to SEQ ID NO: 68871

SEQ ID NO: 240412 - RNA, 64 nt, hsa; identical to SEQ ID NO: 68872

SEQ ID NO: 240413 - RNA, 64 nt, hsa; identical to SEQ ID NO: 68873

SEQ ID NO: 240414 - RNA, 64 nt, hsa; identical to SEQ ID NO: 68874

SEQ ID NO: 240415 - RNA, 64 nt, hsa; identical to SEQ ID NO: 68875

SEQ ID NO: 240416 - RNA, 64 nt, hsa; identical to SEQ ID NO: 68876

SEQ ID NO: 240417 - RNA, 64 nt, hsa; identical to SEQ ID NO: 68877

SEQ ID NO: 240418 - RNA, 64 nt, hsa; identical to SEQ ID NO: 68877

SEQ ID NO: 240419 - RNA, 64 nt, hsa; identical to SEQ ID NO: 68879

SEQ ID NO: 240420 - RNA, 64 nt, hsa; identical to SEQ ID NO: 68880

SEQ ID NO: 240421 - RNA, 64 nt, hsa; identical to SEQ ID NO: 68881

SEQ ID NO: 240422 - RNA, 64 nt, hsa; identical to SEQ ID NO: 68882

SEQ ID NO: 240423 - RNA, 64 nt, hsa; identical to SEQ ID NO: 68883

SEQ ID NO: 240424 - RNA, 64 nt, hsa; identical to SEQ ID NO: 68884

SEQ ID NO: 240425 - RNA, 64 nt, hsa; identical to SEQ ID NO: 68885

SEQ ID NO: 240426 - RNA, 64 nt, hsa; identical to SEQ ID NO: 68886

SEQ ID NO: 240427 - RNA, 64 nt, hsa; identical to SEQ ID NO: 68887

SEQ ID NO: 240428 - RNA, 64 nt, hsa; identical to SEQ ID NO: 68888

SEQ ID NO: 240429 - RNA, 64 nt, hsa; identical to SEQ ID NO: 68889

SEQ ID NO: 240430 - RNA, 64 nt, hsa; identical to SEQ ID NO: 68890

SEQ ID NO: 240431 - RNA, 64 nt, hsa; identical to SEQ ID NO: 68891

SEQ ID NO: 240432 - RNA, 64 nt, hsa; identical to SEQ ID NO: 68892

SEQ ID NO: 240433 - RNA, 64 nt, hsa; identical to SEQ ID NO: 68893

SEQ ID NO: 240434 - RNA, 64 nt, hsa; identical to SEQ ID NO: 68894

SEQ ID NO: 240435 - RNA, 64 nt, hsa; identical to SEQ ID NO: 68895

SEQ ID NO: 240436 - RNA, 64 nt, hsa; identical to SEQ ID NO: 68896

SEQ ID NO: 240437 - RNA, 64 nt, hsa; identical to SEQ ID NO: 68897

SEQ ID NO: 240438 - RNA, 64 nt, hsa; identical to SEQ ID NO: 68898

SEQ ID NO: 240439 - RNA, 64 nt, hsa; identical to SEQ ID NO: 68899

SEQ ID NO: 240440 - RNA, 64 nt, hsa; identical to SEQ ID NO: 68900

SEQ ID NO: 240441 - RNA, 64 nt, hsa; identical to SEQ ID NO: 68901

SEQ ID NO: 240442 - RNA, 64 nt, hsa; identical to SEQ ID NO: 68902

SEQ ID NO: 240443 - RNA, 64 nt, hsa; identical to SEQ ID NO: 68903

SEQ ID NO: 240444 - RNA, 64 nt, hsa; identical to SEQ ID NO: 68904

SEQ ID NO: 240445 - RNA, 64 nt, hsa; identical to SEQ ID NO: 68905

SEQ ID NO: 240446 - RNA, 64 nt, hsa; identical to SEQ ID NO: 68906

SEQ ID NO: 240447 - RNA, 64 nt, hsa; identical to SEQ ID NO: 68907

SEQ ID NO: 240448 - RNA, 64 nt, hsa; identical to SEQ ID NO: 68908

SEQ ID NO: 240449 - RNA, 64 nt, hsa; identical to SEQ ID NO: 68909

SEQ ID NO: 240450 - RNA, 64 nt, hsa; identical to SEQ ID NO: 68910

SEQ ID NO: 240451 - RNA, 64 nt, hsa; identical to SEQ ID NO: 68911

SEQ ID NO: 240452 - RNA, 64 nt, hsa; identical to SEQ ID NO: 68912

SEQ ID NO: 240453 - RNA, 64 nt, hsa; identical to SEQ ID NO: 68913

SEQ ID NO: 240454 - RNA, 64 nt, hsa; identical to SEQ ID NO: 68914

SEQ ID NO: 240455 - RNA, 64 nt, hsa; identical to SEQ ID NO: 68915

SEQ ID NO: 240456 - RNA, 64 nt, hsa; identical to SEQ ID NO: 68916

SEQ ID NO: 240457 - RNA, 64 nt, hsa; identical to SEQ ID NO: 68917

SEQ ID NO: 240458 - RNA, 64 nt, hsa; identical to SEQ ID NO: 68918

SEQ ID NO: 240459 - RNA, 64 nt, hsa; identical to SEQ ID NO: 68919

SEQ ID NO: 240460 - RNA, 64 nt, hsa; identical to SEQ ID NO: 68920

SEQ ID NO: 240461 - RNA, 64 nt, hsa; identical to SEQ ID NO: 68921

SEQ ID NO: 240462 - RNA, 64 nt, hsa; identical to SEQ ID NO: 68922

SEQ ID NO: 240463 - RNA, 64 nt, hsa; identical to SEQ ID NO: 68923

SEQ ID NO: 240464 - RNA, 64 nt, hsa; identical to SEQ ID NO: 68924

SEQ ID NO: 240465 - RNA, 64 nt, hsa; identical to SEQ ID NO: 68925

SEQ ID NO: 240466 - RNA, 64 nt, hsa; identical to SEQ ID NO: 68926

SEQ ID NO: 240467 - RNA, 64 nt, hsa; identical to SEQ ID NO: 68927

SEQ ID NO: 240468 - RNA, 64 nt, hsa; identical to SEQ ID NO: 68928

SEQ ID NO: 240469 - RNA, 64 nt, hsa; identical to SEQ ID NO: 68929

SEQ ID NO: 240470 - RNA, 64 nt, hsa; identical to SEQ ID NO: 68930

SEQ ID NO: 240471 - RNA, 64 nt, hsa; identical to SEQ ID NO: 68931

SEQ ID NO: 240472 - RNA, 64 nt, hsa; identical to SEQ ID NO: 68932

SEQ ID NO: 240473 - RNA, 64 nt, hsa; identical to SEQ ID NO: 68933

SEQ ID NO: 240474 - RNA, 64 nt, hsa; identical to SEQ ID NO: 68934

SEQ ID NO: 240475 - RNA, 64 nt, hsa; identical to SEQ ID NO: 68935

SEQ ID NO: 240476 - RNA, 64 nt, hsa; identical to SEQ ID NO: 44795

SEQ ID NO: 240477 - RNA, 64 nt, hsa; identical to SEQ ID NO: 44796

SEQ ID NO: 240478 - RNA, 64 nt, hsa; identical to SEQ ID NO: 44797

SEQ ID NO: 240479 - RNA, 64 nt, hsa; identical to SEQ ID NO: 44798

SEQ ID NO: 240480 - RNA, 64 nt, hsa; identical to SEQ ID NO: 44799

SEQ ID NO: 240481 - RNA, 64 nt, hsa; identical to SEQ ID NO: 44800

SEQ ID NO: 240482 - RNA, 64 nt, hsa; identical to SEQ ID NO: 44801

SEQ ID NO: 240483 - RNA, 64 nt, hsa; identical to SEQ ID NO: 44802

SEQ ID NO: 240484 - RNA, 64 nt, hsa; identical to SEQ ID NO: 44803

SEQ ID NO: 240485 - RNA, 64 nt, hsa; identical to SEQ ID NO: 44804

SEQ ID NO: 240486 - RNA, 64 nt, hsa; identical to SEQ ID NO: 44805

SEQ ID NO: 240487 - RNA, 64 nt, hsa; identical to SEQ ID NO: 44806

SEQ ID NO: 240488 - RNA, 64 nt, hsa; identical to SEQ ID NO: 44807

SEQ ID NO: 240489 - RNA, 64 nt, hsa; identical to SEQ ID NO: 44808

SEQ ID NO: 240490 - RNA, 64 nt, hsa; identical to SEQ ID NO: 44809

SEQ ID NO: 240491 - RNA, 64 nt, hsa; identical to SEQ ID NO: 44810

SEQ ID NO: 240492 - RNA, 64 nt, hsa; identical to SEQ ID NO: 44811

SEQ ID NO: 240493 - RNA, 64 nt, hsa; identical to SEQ ID NO: 44812

SEQ ID NO: 240494 - RNA, 64 nt, hsa; identical to SEQ ID NO: 44813

SEQ ID NO: 240495 - RNA, 64 nt, hsa; identical to SEQ ID NO: 44814

SEQ ID NO: 240496 - RNA, 64 nt, hsa; identical to SEQ ID NO: 44815

SEQ ID NO: 240497 - RNA, 64 nt, hsa; identical to SEQ ID NO: 44816

SEQ ID NO: 240498 - RNA, 64 nt, hsa; identical to SEQ ID NO: 44817

SEQ ID NO: 240499 - RNA, 64 nt, hsa; identical to SEQ ID NO: 44818

SEQ ID NO: 240500 - RNA, 64 nt, hsa; identical to SEQ ID NO: 44819

SEQ ID NO: 240501 - RNA, 64 nt, hsa; identical to SEQ ID NO: 44820

SEQ ID NO: 240502 - RNA, 64 nt, hsa; identical to SEQ ID NO: 44821

SEQ ID NO: 240503 - RNA, 64 nt, hsa; identical to SEQ ID NO: 44822

SEQ ID NO: 240504 - RNA, 64 nt, hsa; identical to SEQ ID NO: 44823

SEQ ID NO: 240505 - RNA, 64 nt, hsa; identical to SEQ ID NO: 44824

SEQ ID NO: 240506 - RNA, 64 nt, hsa; identical to SEQ ID NO: 44825

SEQ ID NO: 240507 - RNA, 64 nt, hsa; identical to SEQ ID NO: 44826

SEQ ID NO: 240508 - RNA, 64 nt, hsa; identical to SEQ ID NO: 44827

SEQ ID NO: 240509 - RNA, 64 nt, hsa; identical to SEQ ID NO: 44828

SEQ ID NO: 240510 - RNA, 64 nt, hsa; identical to SEQ ID NO: 44829

SEQ ID NO: 240511 - RNA, 64 nt, hsa; identical to SEQ ID NO: 44830

SEQ ID NO: 240512 - RNA, 64 nt, hsa; identical to SEQ ID NO: 44831

SEQ ID NO: 240513 - RNA, 64 nt, hsa; identical to SEQ ID NO: 44832

SEQ ID NO: 240514 - RNA, 64 nt, hsa; identical to SEQ ID NO: 44833

SEQ ID NO: 240515 - RNA, 64 nt, hsa; identical to SEQ ID NO: 44834

SEQ ID NO: 240516 - RNA, 64 nt, hsa; identical to SEQ ID NO: 44835

SEQ ID NO: 240517 - RNA, 64 nt, hsa; identical to SEQ ID NO: 44836

SEQ ID NO: 240518 - RNA, 64 nt, hsa; identical to SEQ ID NO: 44837

SEQ ID NO: 240519 - RNA, 64 nt, hsa; identical to SEQ ID NO: 44838

SEQ ID NO: 240520 - RNA, 64 nt, hsa; identical to SEQ ID NO: 44839

SEQ ID NO: 240521 - RNA, 64 nt, hsa; identical to SEQ ID NO: 44840

SEQ ID NO: 240522 - RNA, 59 nt, hsa; identical to SEQ ID NO: 44841

SEQ ID NO: 240523 - RNA, 64 nt, hsa; identical to SEQ ID NO: 44842

SEQ ID NO: 240524 - RNA, 64 nt, hsa; identical to SEQ ID NO: 44843

SEQ ID NO: 240525 - RNA, 64 nt, hsa; identical to SEQ ID NO: 44844

SEQ ID NO: 240526 - RNA, 64 nt, hsa; identical to SEQ ID NO: 44845

SEQ ID NO: 240527 - RNA, 64 nt, hsa; identical to SEQ ID NO: 44846

SEQ ID NO: 240528 - RNA, 64 nt, hsa; identical to SEQ ID NO: 44847

SEQ ID NO: 240529 - RNA, 64 nt, hsa; identical to SEQ ID NO: 44848

SEQ ID NO: 240530 - RNA, 64 nt, hsa; identical to SEQ ID NO: 44849

SEQ ID NO: 240531 - RNA, 64 nt, hsa; identical to SEQ ID NO: 44850

SEQ ID NO: 240532 - RNA, 64 nt, hsa; identical to SEQ ID NO: 44851

SEQ ID NO: 240533 - RNA, 64 nt, hsa; identical to SEQ ID NO: 44852

SEQ ID NO: 240534 - RNA, 64 nt, hsa; identical to SEQ ID NO: 44853

SEQ ID NO: 240535 - RNA, 64 nt, hsa; identical to SEQ ID NO: 44854

SEQ ID NO: 240536 - RNA, 64 nt, hsa; identical to SEQ ID NO: 44855

SEQ ID NO: 240537 - RNA, 64 nt, hsa; identical to SEQ ID NO: 44856

SEQ ID NO: 240538 - RNA, 64 nt, hsa; identical to SEQ ID NO: 44857

SEQ ID NO: 240539 - RNA, 64 nt, hsa; identical to SEQ ID NO: 44858

SEQ ID NO: 240540 - RNA, 64 nt, hsa; identical to SEQ ID NO: 44859

SEQ ID NO: 240541 - RNA, 64 nt, hsa; identical to SEQ ID NO: 44860

SEQ ID NO: 240542 - RNA, 64 nt, hsa; identical to SEQ ID NO: 44861

SEQ ID NO: 240543 - RNA, 64 nt, hsa; identical to SEQ ID NO: 44862

SEQ ID NO: 240544 - RNA, 64 nt, hsa; identical to SEQ ID NO: 44863

SEQ ID NO: 240545 - RNA, 64 nt, hsa; identical to SEQ ID NO: 44864

SEQ ID NO: 240546 - RNA, 64 nt, hsa; identical to SEQ ID NO: 236262

SEQ ID NO: 240547 - RNA, 64 nt, hsa; identical to SEQ ID NO: 236263

SEQ ID NO: 240548 - RNA, 64 nt, hsa; identical to SEQ ID NO: 236264

SEQ ID NO: 240549 - RNA, 64 nt, hsa; identical to SEQ ID NO: 236265

SEQ ID NO: 240550 - RNA, 64 nt, hsa; identical to SEQ ID NO: 236266

SEQ ID NO: 240551 - RNA, 64 nt, hsa; identical to SEQ ID NO: 236267

SEQ ID NO: 240552 - RNA, 64 nt, hsa; identical to SEQ ID NO: 236268

SEQ ID NO: 240553 - RNA, 64 nt, hsa; identical to SEQ ID NO: 236269

SEQ ID NO: 240554 - RNA, 65 nt, hsa
ucucggccccgccaccugcccagcgugcccuggcucuccagaaccuucuaucccacagucaggcc

SEQ ID NO: 240555 - RNA, 65 nt, hsa
ugagaaagucuuaagcaaaauacucccaggucucacuccagaacauaaaaauggugugugaucaa

SEQ ID NO: 240556 - RNA, 65 nt, hsa
gaaaacccaguguccaucuuuccacccucccugaucuccagaaccuucgacugacccccuugucu

SEQ ID NO: 240557 - RNA, 65 nt, hsa
aggaccugcacgggacuuguggaugggccuggacucuccagaaacuacuugggcagagcaaagga

SEQ ID NO: 240558 - RNA, 65 nt, hsa
gacaacagaccaggaggggcccccaccugauggaccuccagaaaaacggaucacagccacuaugg

SEQ ID NO: 240559 - RNA, 65 nt, hsa
gauggggagggagugggccuggaucugggaccucccuccagaauuuccuccagaugggggcagug

SEQ ID NO: 240560 - RNA, 65 nt, hsa
gccuuccuggugcccaccaggcacuacggcuuccucuccagaauguggcuuugccugagcacaga

SEQ ID NO: 240561 - RNA, 65 nt, hsa
auauugaauaacuagaacacaagccacuguuucagcuccagaaaaaagaaagggcuuuaacguuu

SEQ ID NO: 240562 - RNA, 65 nt, hsa
ucacagggauuccuccuuucccccccaaauauuaacuccagaaacuaggccugacuggggacacc

SEQ ID NO: 240563 - RNA, 65 nt, hsa
acagcacacaauuucaagccauuuucagaucagaacuccagaaguguugacaagaugccuauucg

SEQ ID NO: 240564 - RNA, 65 nt, hsa
gagaggauccuucaguucuggccauuccagggacccuccagaaacacaguguuucaagagacccu

SEQ ID NO: 240565 - RNA, 65 nt, hsa
ugggguccccaucaucccagcugcucccaaauaaacuccagaagaggaaucugugggccugugag

SEQ ID NO: 240566 - RNA, 65 nt, hsa
caaaaucaccuauucacugcuuaugcagucggaagcuccagaagaacaaagagcccaauuaccag

SEQ ID NO: 240567 - RNA, 65 nt, hsa
cgacucugucguugccuugaucuugaacuuccagccuccagaacuaugagaaauaaaauucuguu

SEQ ID NO: 240568 - RNA, 65 nt, hsa
acaguugcaguauuucaaagucccuauccaggucacuccagaaaaggguauugaaacguugaaau

SEQ ID NO: 240569 - RNA, 65 nt, hsa
acugcugcauuuaggccaggucuccaauugcuuuccuccagaaaguguguucccgucuagugagg

SEQ ID NO: 240570 - RNA, 65 nt, hsa
cacccaaacuccuggccuucugugguuucccuuugcuccagaaacacagaugugucuaaagacuu

SEQ ID NO: 240571 - RNA, 65 nt, hsa
gagaaacguacacuaucauugcuaaacuaacaguccuccagaaauuuaauaagauguuuuugauu

SEQ ID NO: 240572 - RNA, 65 nt, hsa
guuuaagugaccuccuucaucacauccugcaguaucuccagaagcagcacuaggguuugaguuuc

SEQ ID NO: 240573 - RNA, 65 nt, hsa
gcccacguguauuguccgggcucagaaugggaggacuccagaagaugagagaaaccucuuuaucc

SEQ ID NO: 240574 - RNA, 65 nt, hsa
uuuuagccuuaccaccuuuuaaaaaauuuguuauucuccagaaacaguaaauaggugaguagggg

SEQ ID NO: 240575 - RNA, 65 nt, hsa
aacucagucagugauuuuuugaugcuucucuuauccuccagaauagagaccuaaggacacgugga

SEQ ID NO: 240576 - RNA, 65 nt, hsa
accccuguccccagucagagauaacauccaacuaacuccagaagcggaagaggauauauuuaaca

SEQ ID NO: 240577 - RNA, 65 nt, hsa
agggauggagcgggucuccugauucuacaccaucucuccagaacucucuggccuugguggcccca

SEQ ID NO: 240578 - RNA, 65 nt, hsa
gucuccccccggggagaggacacuggccccucgcacuccagaaaagccaugccagcugggcucgu

SEQ ID NO: 240579 - RNA, 65 nt, hsa
cccuguaacuuaucuagaaagaaaagacccugagacuccagaaucugcuguugccauagccccau

SEQ ID NO: 240580 - RNA, 65 nt, hsa
ggccuauccaguuuuccugguucccucacagguuucuccagaaaguacucccucaguaaagcauu

SEQ ID NO: 240581 - RNA, 65 nt, hsa
gagcuuuugccacugacucggccguguccugacaccuccagaacgcaggugcuggcgcccguucu

SEQ ID NO: 240582 - RNA, 65 nt, hsa
ggccugcuucacuugcagauaaguuuauuauaauucuccagaaaugugcaggaugugcauuagca

SEQ ID NO: 240583 - RNA, 65 nt, hsa
cuguugcccugagagugucccaggggauucagagucuccagaaagauauggcugggccaacucug

SEQ ID NO: 240584 - RNA, 65 nt, hsa
cugaacagugcucugccucuaacucccuccucacacuccagaauuacccuuccucaucugugccu

SEQ ID NO: 240585 - RNA, 65 nt, hsa
ucaggggaagcugcuaggggaaggacuggccguggcuccagaaugugcugccuuuuuaaguuuug

SEQ ID NO: 240586 - RNA, 65 nt, hsa
ggcgcacuuuccugaagccucuuauuaacucccaucuccagaagcaccucaacaaugucaguggc

SEQ ID NO: 240587 - RNA, 65 nt, hsa
uguuggaaucagcaggccucugugcucccucugcccuccagaacucagugacucuugaacaugga

SEQ ID NO: 240588 - RNA, 65 nt, hsa
gccuccaugagucaagcccccuccccacaccuggacuccagaauucacccucuccccugcagucu

SEQ ID NO: 240589 - RNA, 65 nt, hsa
gaggacgggggguggggaaggaaggaacaugaucccuccagaagucucccacccuggggccaacu

SEQ ID NO: 240590 - RNA, 65 nt, hsa
gaaguccuggcuucaggcaauucuccugccuuugccuccagaagcacugggaucacaggugucag

SEQ ID NO: 240591 - RNA, 65 nt, hsa
cugcauuuuccuacaccccuuuccuggacugcucucuccagaaacagcacagcucauggagggug

SEQ ID NO: 240592 - RNA, 65 nt, hsa
ugcuuuccuagauccacacuuucaaagagaaaccccuccagaacucccacccugacagcccaaca

SEQ ID NO: 240593 - RNA, 65 nt, hsa
uuaccuaacaacaucacuuuuguugaacauuccaacuccagaaugauccccaaucacccuaaucu

SEQ ID NO: 240594 - RNA, 65 nt, hsa
augucagucuuuguaauuauuuacacuuuaacuuucuccagaacucagacaugauuucaacaugg

SEQ ID NO: 240595 - RNA, 65 nt, hsa
cuguaucuuuggagaaggagaaagaaaggaaagaacuccagaaucccaucacuguucuuuaaagc

SEQ ID NO: 240596 - RNA, 65 nt, hsa
uguauuuuuuuaagcaacaucaugaauuuuaucuacuccagaagucucuacaauagaaaaaaaag

SEQ ID NO: 240597 - RNA, 65 nt, hsa
gcaauggagagaagaccucuuccugaaucacuggacuccagaaaugugcaugcagaucagcuguu

SEQ ID NO: 240598 - RNA, 65 nt, hsa
guauuaccaccagacugacuccaggacucacugcccuccagaaaacagaggugacaaaugugagg

SEQ ID NO: 240599 - RNA, 65 nt, hsa
aagagcugcuggugaacuccaucucauucucgccccuccagaagaagcaguugucccccaaauac

SEQ ID NO: 240600 - RNA, 65 nt, hsa
uccuuuucccuaaucauucccuuuucuccccacuccuccagaaggcauaacccuucucuccacac

SEQ ID NO: 240601 - RNA, 65 nt, hsa
cucuucucauaguguacacccaccugccucucuggcuccagaagcugccagagugcacugggggg

SEQ ID NO: 240602 - RNA, 63 nt, hsa
caaguucaagcaguugcuaaauaaaucuccccacuccagaagcauuacccauaggucuuaaga

SEQ ID NO: 240603 - RNA, 65 nt, hsa
ucaaaauagaagaccuugcaagaagcagagucauucuccagaaggaacuugggagaugauggugc

SEQ ID NO: 240604 - RNA, 65 nt, hsa
aaggaauuguacugugcuacaauuaucucuagaaucuccagaaagguggagggcuguucgcccuu

SEQ ID NO: 240605 - RNA, 55 nt, hsa
uccagcgagcgacaugguaaaugagcuccagaaccuauugagcuugcagggaagc

SEQ ID NO: 240606 - RNA, 65 nt, hsa
guguuaucuucauaugauaugcugaacaccaaaaucuccagaaaugcauuuuauguaguucuaaa

SEQ ID NO: 240607 - RNA, 65 nt, hsa
uuauguucucaugcccucaaucuguaaauuuuugucuccagaaaaacccucccaggcaucccaua

SEQ ID NO: 240608 - RNA, 65 nt, hsa
gucagggaggacugggcacuauuuggcaggauguacuccagaauauaaucaaagaauuuucugua

SEQ ID NO: 240609 - RNA, 65 nt, hsa
caaaaggaguacccagggccugguacccaggcccacuccagaauggccucuggacucaccuugag

SEQ ID NO: 240610 - RNA, 65 nt, hsa
cccccaaccccaucucagagcucagaggguacaagcuccagaacaguaaccaagugggaaaauaa

SEQ ID NO: 240611 - RNA, 65 nt, hsa
aaagaaguguuugauggugccagagaggggcugcucuccagaaagcuaaaauuuaauuucuuuuu

SEQ ID NO: 240612 - RNA, 65 nt, hsa
cgaggggcucaggaaaacgggaccggccaggccaccuccagaaacggccauucagcaagacaaca

SEQ ID NO: 240613 - RNA, 65 nt, hsa
gccaagucuauaauauaauuaugaucaugaauagacuccagaauccacaaagagaagagggcuug

SEQ ID NO: 240614 - RNA, 65 nt, hsa
gagccuucccuacccugacgccucccagucaucaucuccagaacucccagcggggcucccugagc

SEQ ID NO: 240615 - RNA, 65 nt, hsa
gaauauuagauuucugacuugcaaauauguuuguacuccagaagaauuagaggaaaagcagauac

SEQ ID NO: 240616 - RNA, 65 nt, hsa
gugcugggauuacaagugugagccaccacaccuggcuccagaaauuuuauuuuauuuuuuugagg

SEQ ID NO: 240617 - RNA, 65 nt, hsa
acacuauguguguuguuuccauagcucuucacuuccuccagaagccuccuuacauuaaaaagccu

SEQ ID NO: 240618 - RNA, 65 nt, hsa
auuguaguaauuucuauuugcacugugccuuucaacuccagaaacauucugaagauguacuugga

SEQ ID NO: 240619 - RNA, 65 nt, hsa
ccuuaaucuagauaauaaaagcuuuuuggggcaaccuccagaacugugaaaaauaaauuuguuau

SEQ ID NO: 240620 - RNA, 65 nt, hsa
gacgcuaaccgcccuucugcguuccauaaagguggcuccagaaagggcauccucuaccccaagcc

SEQ ID NO: 240621 - RNA, 65 nt, hsa
agcaucauacuggaaagcaaacaccuuuccuccagcuccagaauuccuugucucugaaugacucu

SEQ ID NO: 240622 - RNA, 65 nt, hsa
cugccuccucuucaacugaccagccuccaugcugccuccagaauggucuuucuaaugugugaauc

SEQ ID NO: 240623 - RNA, 65 nt, hsa
ugaaaccugacaaagagacuguaauauuguaguugcuccagaaugucaagggcagcuuacggaga

SEQ ID NO: 240624 - RNA, 65 nt, hsa
ggaguguggucagucugccugcugcugugcgguagcuccagaaccaccucguuccugguuuuguu

SEQ ID NO: 240625 - RNA, 65 nt, hsa
aguuuguaagaacaaucauaaaaggacuuguuagucuccagaacaucugcuaaaaugcaaguaua

SEQ ID NO: 240626 - RNA, 65 nt, hsa
acaugaguuuaugggaaugccuuuucccucuggcacuccagaacaaaccucuauauguugcugaa

SEQ ID NO: 240627 - RNA, 65 nt, hsa
guaaauaccauauaugauccucgaaaugauaauaucuccagaauauuguuuucacccaaauuuga

SEQ ID NO: 240628 - RNA, 65 nt, hsa
guaccuauuuuugaggaccuugaaaaucuuaaucucuccagaagggauacugcauugguucuucu

SEQ ID NO: 240629 - RNA, 65 nt, hsa
uauuugccuauauucucccuacaagaauauuuuugcuccagaaagacauguucuuuucucaaauu

SEQ ID NO: 240630 - RNA, 65 nt, hsa
accauuugguuacccucgggauggccauccacugucuccagaaagagaccacuuagagggucucu

SEQ ID NO: 240631 - RNA, 65 nt, hsa
uuuuaaaccuucaggaacaccaguuaggaaaauagcuccagaaaauauagauauauuuuauuuuu

SEQ ID NO: 240632 - RNA, 65 nt, hsa
cggauauaaaggaagaauauuuccuuuauguguuucuccagaauggugccuguuucucucugugu

SEQ ID NO: 240633 - RNA, 65 nt, hsa
acagaagccacaccauuugcaccauccacgccuugcuccagaaggccuggccgccuucucccugg

SEQ ID NO: 240634 - RNA, 65 nt, hsa
cagucagaucucaggcuugucccccugucagcugccuccagaagggaagguagccagugccugag

SEQ ID NO: 240635 - RNA, 65 nt, hsa
gaccucgccuagcacucugccuugccagagauuggcuccagaauuugugccagacuuacagaaaa

SEQ ID NO: 240636 - RNA, 65 nt, hsa
uauaauugugaaggagucagggcuaacaccuggaucuccagaaaccuagcccagcagguuaaucu

SEQ ID NO: 240637 - RNA, 65 nt, hsa
ccagcuccacucucugguuucuaauaaacagggaucuccagaacacuggugguggacacagcuuu

SEQ ID NO: 240638 - RNA, 65 nt, hsa
gcccaaugagggcgaaugacauuacagcuugaccucuccagaacacuaauauccuaaaauacaga

SEQ ID NO: 240639 - RNA, 57 nt, hsa
caggguaugaaacccagugaauaaggacuccagaaucuaaagccaguggcuugaggc

SEQ ID NO: 240640 - RNA, 65 nt, hsa
ucuucacuuucaauuauauccagcaauaaguuguucuccagaaaagaaagcuuggaaacuuaccc

SEQ ID NO: 240641 - RNA, 65 nt, hsa
ccuugcuuucaaaaggacugcuuaccauggaagugcuccagaagaaucauuugaaacaucuuuug

SEQ ID NO: 240642 - RNA, 65 nt, hsa
ggguuuuaguauauauagcccaaaaugguaacugucuccagaacagcaaccacauugaauucuug

SEQ ID NO: 240643 - RNA, 65 nt, hsa
ccauagccaucuacaauaguaacugcccacaggcucuccagaaaacuacuacaauggccaaguac

SEQ ID NO: 240644 - RNA, 65 nt, hsa
aacagagagugaacagcaccucuccauugcuacaucuccagaauauuguucgguuauguucaugu

SEQ ID NO: 240645 - RNA, 65 nt, hsa
gaggaaauaaagcccuguucuggaucccccauccccuccagaauaagagcauguucugcauguau

SEQ ID NO: 240646 - RNA, 65 nt, hsa
acauaugcagugguucuuacagaucaguuaauuaacuccagaaagcaaauguuagacuacacauu

SEQ ID NO: 240647 - RNA, 65 nt, hsa
uguucugaugggggagggcggucuucccacuuccucuccagaacuccagaaagagcagugugcuu

SEQ ID NO: 240648 - RNA, 65 nt, hsa
ugggggagggcggucuucccacuuccucuccagaacuccagaaagagcagugugcuuaugcuuca

SEQ ID NO: 240649 - RNA, 65 nt, hsa
agaaaacuucucuucugagccucuuuaacagcuuucuccagaaccagugucugaaccacccugga

SEQ ID NO: 240650 - RNA, 65 nt, hsa
auuaguaauaaggagaggguugggggugggcagggcuccagaaagucagcagugugccugggcac

SEQ ID NO: 240651 - RNA, 65 nt, hsa
auaaauguguauauuuaauguuuuauuguuagcuucuccagaaaauugaugcaaauucugguaau

SEQ ID NO: 240652 - RNA, 65 nt, hsa
aagcugcucucaggcacccccuucuucauugcucucuccagaaaggguugcuagccuuaacuuca

SEQ ID NO: 240653 - RNA, 65 nt, hsa
gguuauguuucugccuucggcgagagaacagcaagcuccagaaaguggcugcgccuucagccccg

SEQ ID NO: 240654 - RNA, 65 nt, hsa
ggagcacaguagugcgggccugggcccugcuccaccuccagaaguggcuggauguacccugccug

SEQ ID NO: 240655 - RNA, 65 nt, hsa
auccugcgacccucacuggccuggccuugugggggcuccagaaaagaggcuaggagaggccagag

SEQ ID NO: 240656 - RNA, 65 nt, hsa
uucaaggcacagcccuuguugggagggagaacccucuccagaaacccugccaccauggugucuug

SEQ ID NO: 240657 - RNA, 65 nt, hsa
cucugagcugccccuggcuuccuuuaaggaggcugcuccagaaggaaccuggguggggagggcga

SEQ ID NO: 240658 - RNA, 65 nt, hsa
acucuguaccccaaagagaguucucaugaaauauucuccagaauguauucauuaucaagaaaaug

SEQ ID NO: 240659 - RNA, 65 nt, hsa
ugauucucuugaugccaccuucagauccuuuuauucuccagaauaauucuuaacagugguucaaa

SEQ ID NO: 240660 - RNA, 65 nt, hsa
ucugagcccgucucccggacagguugaggaagcugcuccagaagcgccucggaaggggagcucuc

SEQ ID NO: 240661 - RNA, 65 nt, hsa
cagaaaauucuggaacuugaaaaaguaguaagggccuccagaauugacuuagcccuaguaauaaa

SEQ ID NO: 240662 - RNA, 65 nt, hsa
uuuuaaauuuuuuaauuaccuguuguaggguguuccuccagaagcaaagagcaaaauuuuacugu

SEQ ID NO: 240663 - RNA, 65 nt, hsa
gcaaacuucagucuggacuucuuuuugccagagaacuccagaaaccagucaggcucucagucagc

SEQ ID NO: 240664 - RNA, 65 nt, hsa
acauagcuucccuucccucccccuucacccacucccuccagaacauuuaguguagaugaaaaugu

SEQ ID NO: 240665 - RNA, 65 nt, hsa
gcagaaaaacacaaacaaaaacagacucccacugucuccagaagucguggccuuccagaacaguc

SEQ ID NO: 240666 - RNA, 65 nt, hsa
acccagugucauuugcuccuccuguuccugugccacuccagaaccucagcagaucugagccaccg

SEQ ID NO: 240667 - RNA, 65 nt, hsa
gcaucugaauguuccagcagccuaacugugcucugcuccagaaacauguguguggcuucccuacc

SEQ ID NO: 240668 - RNA, 65 nt, hsa
ugucacuuuaguuaugcuaaaguggagguuucagccuccagaagacagcagagccuucuaggguc

SEQ ID NO: 240669 - RNA, 65 nt, hsa
aguauuuacaguauugagcuuugcauuuaugauuucuccagaaauuuaccacaaaagcaaaauuu

SEQ ID NO: 240670 - RNA, 65 nt, hsa
acagcguuggucucuguuuggaaucacugugaggucuccagaaggaccuggccgccagccccuuc

SEQ ID NO: 240671 - RNA, 65 nt, hsa
ucuugucccucacugccccaguaagcuggaggcugcuccagaacucagcaguguuggaggggccu

SEQ ID NO: 240672 - RNA, 65 nt, hsa
uuauuccuacuggagcuuaguuccaaugcauuuggcuccagaaagaccccagugccuuuugacaa

SEQ ID NO: 240673 - RNA, 65 nt, hsa
uggggacccucuuccucuagcacaguaaagcuggccuccagaaacacggguaucuccgcguggug

SEQ ID NO: 240674 - RNA, 65 nt, hsa
auuauuucaccaagccaauaccagccgccauccuucuccagaauucuuguaaauaaaauaaaucc

SEQ ID NO: 240675 - RNA, 56 nt, hsa
ucccuggcaugacuccaugaauuugucuccagaacggcagcaggaaagucuuuuuu

SEQ ID NO: 240676 - RNA, 65 nt, hsa
gcagggcuuugaucauucaaaaguaacuaaaguagcuccagaaugccaaguauucguguaaauua

SEQ ID NO: 240677 - RNA, 65 nt, hsa
uuucaagcugaaaauaauaguucuacugcccgugucuccagaauguagagcccaucaauauuuuu

SEQ ID NO: 240678 - RNA, 65 nt, hsa
aguaugacaacacauacacacuugccucuccccaucuccagaagaggggagcagaguccgagcuu

SEQ ID NO: 240679 - RNA, 65 nt, hsa
cagagcacagaccccagagucuugugguucucuaacuccagaaaggacaauguccccuauucagg

SEQ ID NO: 240680 - RNA, 65 nt, hsa
aauuuauauccaaaauuuguguuuuaaauuucauacuccagaacuuucauguuuaugaguauuag

SEQ ID NO: 240681 - RNA, 65 nt, hsa
uguguuaaugucaauaugaugagauuuuagccuuucuccagaacuaaggcauuaaagaaaauagc

SEQ ID NO: 240682 - RNA, 65 nt, hsa
gcuguggucaccugaggaugugguucagguggggucuccagaaggcugcuugcccccagagagcc

SEQ ID NO: 240683 - RNA, 65 nt, hsa
augacccuuaagugccacccuucuuggaagacccccuccagaagcauacuggaagccaccucugg

SEQ ID NO: 240684 - RNA, 65 nt, hsa
auacaguaagagauaguguugaaccagcaucaagucuccagaaacauggcagagcagacaggccg

SEQ ID NO: 240685 - RNA, 65 nt, hsa
ggaacugacccuuccuucauccucaaccugcuguccuccagaaagcaccaaggaaaaagcagaga

SEQ ID NO: 240686 - RNA, 65 nt, hsa
aaaucagcuuauauuuuuuaucuugaugacuccugcuccagaaucgcuagacuaagaauuaggug

SEQ ID NO: 240687 - RNA, 65 nt, hsa
cuuacacuggaagcuuugauucacccuccacaguacuccagaaaggacuguccuauaaguuguac

SEQ ID NO: 240688 - RNA, 65 nt, hsa
uuccagauuuguuuccuuuuggccuccugcaaagucuccagaagaaaauuugccaaucuuuccua

SEQ ID NO: 240689 - RNA, 65 nt, hsa
gaagauguuuacuacaaaagcaugccaaaccuaggcuccagaaaccacguccaucagcugcauac

SEQ ID NO: 240690 - RNA, 65 nt, hsa
auacuagcauugcacauauagucugcuuucuguuccuccagaauuugaguccuguuaauguagua

SEQ ID NO: 240691 - RNA, 65 nt, hsa
uucauucuucaacagugccuugcauguaacaagcacuccagaaauguuuguugaaugaaugaaug

SEQ ID NO: 240692 - RNA, 65 nt, hsa
ucauggcuggagagcugaucagccaggcacagaaucuccagaacaaccuagagagugaaugcuaa

SEQ ID NO: 240693 - RNA, 65 nt, hsa
aaaucuccuggcaccuugaucuuggauuuuacagccuccagaacugugagaaaauaaauuucugu

SEQ ID NO: 240694 - RNA, 65 nt, hsa
uuuaaugguacuuaguauuuugaucaaacuuuagucuccagaacuaaacaagucccuaaguuucc

SEQ ID NO: 240695 - RNA, 65 nt, hsa
uacaggaaguacuggagaaaauggacguguuaugacuccagaauuucccaaagcagugcaugcug

SEQ ID NO: 240696 - RNA, 65 nt, hsa
uuaauguuaccuuuuggcuugagaaugucuuucagcuccagaauuauuguuacucauauuuuaau

SEQ ID NO: 240697 - RNA, 52 nt, hsa
gugaaggugccgagcuauaaaccuccagaauauuauuagucugcaugguuaa

SEQ ID NO: 240698 - RNA, 65 nt, hsa
uguauaguaauuuuguuguuguugggugcugguagcuccagaauuuugugaccacuauugugggu

SEQ ID NO: 240699 - RNA, 65 nt, hsa
cuccaaccucacagccucguagagcuucacagcuacuccagaaaauaggguuaugugugucauuc

SEQ ID NO: 240700 - RNA, 65 nt, hsa
cccauccaaagauguccagauguccaugugcuagucuccagaacuuguaacuguguuguuaugug

SEQ ID NO: 240701 - RNA, 65 nt, hsa
uguuauuucuaauaauacacuaucuugauuguacucuccagaaaauuuuucugucagugaaaaua

SEQ ID NO: 240702 - RNA, 65 nt, hsa
agucaaaagcuucagugaguuacaucucauucaaucuccagaagauugggauuaucgucuucuaa

SEQ ID NO: 240703 - RNA, 65 nt, hsa
acccagcucauggaauuuuuucaucuuauacugagcuccagaaaggacguaacuuagcauggauc

SEQ ID NO: 240704 - RNA, 65 nt, hsa
cuuuuauuuuccugucuucuuucuccugugguuugcuccagaauuaagguuuguuuuccauccau

SEQ ID NO: 240705 - RNA, 65 nt, hsa
uucucccuuuugacacaguuguuucagaaagagcucuccagaagccaauauugagauguaauuca

SEQ ID NO: 240706 - RNA, 65 nt, hsa
guagaagaaaaaaaaucuuucagauaagagguguucuccagaauggaggaacuacuuggcaugua

SEQ ID NO: 240707 - RNA, 65 nt, hsa
ugacuuaacuguaugugcaacagcaaugaaauuaacuccagaagccuuccaccugcgucacccag

SEQ ID NO: 240708 - RNA, 65 nt, hsa
cuucaagcugcucaucuguuaguaagugauguucacuccagaacacauucaugaugagaacuuuc

SEQ ID NO: 240709 - RNA, 65 nt, hsa
guagaagaaaaaaaaucuuucagauaagagguguucuccagaauggaagaacgacuuggcaugua

SEQ ID NO: 240710 - RNA, 65 nt, hsa
ccucacacugcugugcagccaucaccaccauucaucuccagaauuuguucucagucccaaacuga

SEQ ID NO: 240711 - RNA, 65 nt, hsa
cuucuauucauaaauguucuauacaguggacagcccuccagaaugguacuucagugccuagugua

SEQ ID NO: 240712 - RNA, 65 nt, hsa
caaaauaaggaagagggcugagcugagcuucgguucuccagaauguaagaaaacaaaaucuaaaa

SEQ ID NO: 240713 - RNA, 65 nt, hsa
gccgaccaccagcaccauccucuccucccagcagccuccagaaccaugcccaggucuccugccuc

SEQ ID NO: 240714 - RNA, 65 nt, hsa
ucugaccucaucaugguucuaguucucauacagaacuccagaauuuuuaaagaacucuauaauug

SEQ ID NO: 240715 - RNA, 65 nt, hsa
uuuuacugaaucugucuacccuucauucaugagaacuccagaaugaguguugaccacugaagcau

SEQ ID NO: 240716 - RNA, 65 nt, hsa
ucccacacuaagguaaguucagacuagauugaacacuccagaauuuuuuacuacagacuguuuuu

SEQ ID NO: 240717 - RNA, 65 nt, hsa
gcauccccauggagagacagcauugcuccccagcccuccagaaaccuugagcagauccagggauc

SEQ ID NO: 240718 - RNA, 65 nt, hsa
ggcauugccgggguaggguggugucuucaccacagcuccagaaggcacuggugggauguggaguc

SEQ ID NO: 240719 - RNA, 65 nt, hsa
aggaaagaaucaaauuucuugcccggucacuggcacuccagaagacagcgugccggaaccggcag

SEQ ID NO: 240720 - RNA, 65 nt, hsa
caacuuucauagucccaaagauaggcagagaacaucuccagaaaugugugugugugugugugugu

SEQ ID NO: 240721 - RNA, 65 nt, hsa
cagaagagccacagucuccagacucauggcguucccuccagaacuccccauuccccucugagcau

SEQ ID NO: 240722 - RNA, 65 nt, hsa
ucgaaaagccagaggguucaccuagucagacgaaacuccagaacagugcuuguggagggccugac

SEQ ID NO: 240723 - RNA, 65 nt, hsa
ccauaauuuucuucaaugaguuaauaaacagaaaucuccagaaccucugaaacacauucuugaag

SEQ ID NO: 240724 - RNA, 65 nt, hsa
cacuauauuacagaaugauguaauaccugguaauucuccagaagauagacuucagacccuuaaug

SEQ ID NO: 240725 - RNA, 65 nt, hsa
uauuaauuguaaagccaagcuuaucaguugacucucuccagaauaaauaaucaucuguguggcau

SEQ ID NO: 240726 - RNA, 65 nt, hsa
cacuguugcagcuuccucugcccuggcuggaaagacuccagaauccaguguggugcuguggaagg

SEQ ID NO: 240727 - RNA, 65 nt, hsa
cccucugugaggagcugugggaaguguggguuugucuccagaacagaagagaaugauggauauuc

SEQ ID NO: 240728 - RNA, 65 nt, hsa
uagucccugaggguggagggaagcugaggauagagcuccagaaacagcacuagggucccaggaga

SEQ ID NO: 240729 - RNA, 65 nt, hsa
ggaggggggaaagagaccagccuuggucccuaagccuccagaaacgucuucuuaauccccaccuu

SEQ ID NO: 240730 - RNA, 65 nt, hsa
gggcauauuucugugcuguggaugacauggccuuacuccagaaucccaggcccuccacugugacu

SEQ ID NO: 240731 - RNA, 65 nt, hsa
aagugcuggcaaccacuaagaauucaaacuggggccuccagaacucacuggggccuacagcuuug

SEQ ID NO: 240732 - RNA, 65 nt, hsa
cuucagccuuaaauacaaaaauaaaacugaaacugcuccagaaagcagcuuucuccaaaaauguc

SEQ ID NO: 240733 - RNA, 65 nt, hsa
gugaagcccaaaagcucuuaaggagaauuguauuucuccagaagcugcagcaagagguacagcuc

SEQ ID NO: 240734 - RNA, 65 nt, hsa
gaauuauucaauuucaugaauaacucuuguuugcacuccagaaaacaacauacauguuuaaauac

SEQ ID NO: 240735 - RNA, 65 nt, hsa
aaaucuuuuagaauuuuuuuggagguguuuguuuucuccagaauaaagguauuacuuuagaauag

SEQ ID NO: 240736 - RNA, 65 nt, hsa
uaguggcuguguagcauccucagugcaaaacccagcuccagaauuuucaccugguaacgaauuuc

SEQ ID NO: 240737 - RNA, 65 nt, hsa
cuaaaaugcagcuguuguuagacaacuguugaaaacuccagaaauacaucacccaagguggcagu

SEQ ID NO: 240738 - RNA, 65 nt, hsa
aaacccaggccuugacauuguuauucaaauggccccuccagaaaguuuaaugauuuccauuugua

SEQ ID NO: 240739 - RNA, 65 nt, hsa
gcgugaaaccuuggcacaggacugaggauccucuccuccagaaaagcccccucgaggaaauaaau

SEQ ID NO: 240740 - RNA, 65 nt, hsa
ggaggugucuacugaaaagggaaccugcuucuuuacuccagaacgcuguucuuuaaagaccaaga

SEQ ID NO: 240741 - RNA, 55 nt, hsa
accaguggagaagguacuagucaaccuccagaaagaguauggagagaaaaagagg

SEQ ID NO: 240742 - RNA, 65 nt, hsa
gucaaauacuugacucccacucuugccacuccuagcuccagaagggcucagggccuuccccacag

SEQ ID NO: 240743 - RNA, 65 nt, hsa
guuuaagaugcuaggaugaggcaggcccaguccuccuccagaaaauaagacaggccacaggaggg

SEQ ID NO: 240744 - RNA, 65 nt, hsa
ucagacucugauuagcugccuccccuucucccugccuccagaauguucugggauaacauuuggag

SEQ ID NO: 240745 - RNA, 65 nt, hsa
ggagagggggagcaaacaggaaauuccacagcugccuccagaaacauuaaccaccccucucuagu

SEQ ID NO: 240746 - RNA, 65 nt, hsa
ccgccagcuccucagccugcucccugggaggcaggcuccagaagcaccccgacggggggccuuau

SEQ ID NO: 240747 - RNA, 65 nt, hsa
cagugcuacaggaguacaucugcccugccacaugacuccagaagucucugaccccauuuguuuuu

SEQ ID NO: 240748 - RNA, 65 nt, hsa
ucuuggcuaaggugcuguuccuguuccugcaaggucuccagaaccccuuuggaaauggugaagga

SEQ ID NO: 240749 - RNA, 65 nt, hsa
cugucucaaauaauuauuucacagaggauagcaagcuccagaagguucuauuaccuuuaaaaaag

SEQ ID NO: 240750 - RNA, 65 nt, hsa
uagagcgagagcagagcaaacugcgcagcaggcaccuccagaaagguaaugguggcagaacccac

SEQ ID NO: 240751 - RNA, 65 nt, hsa
gcuuuuacuuccgguuucuucauauugaggggcaacuccagaaguggaguuuucugugagaauaa

SEQ ID NO: 240752 - RNA, 65 nt, hsa
uacuaaagcaaaauuuccagggguagggacugggacuccagaaccauuaauaaaacaaaacaaaa

SEQ ID NO: 240753 - RNA, 65 nt, hsa
gccuucuagcugaaaaacgaguauuccccaauggacuccagaagaaacuugauucaucgcugcaa

SEQ ID NO: 240754 - RNA, 65 nt, hsa
auccagggcaaggacagacuaaaagagcauaucuucuccagaaguccuagaaacaucucaucauu

SEQ ID NO: 240755 - RNA, 65 nt, hsa
ugaaugugggagaaaaucgcugcugcugagauggacuccagaagaagaaacuguuucuccaggcg

SEQ ID NO: 240756 - RNA, 65 nt, hsa
auaaguggcaaauauuuuaaaauauuugaaaaacacuccagaaucuaguacgcuuuauuuuuaga

SEQ ID NO: 240757 - RNA, 65 nt, hsa
uuccccguguggcccaccccaggcacggcucauuccuccagaauuauagaagcucagccuggccu

SEQ ID NO: 240758 - RNA, 65 nt, hsa
cagagccaccauuuuuuauaauuucuaauaaccaacuccagaacuaggagcugaucaacucuuug

SEQ ID NO: 240759 - RNA, 65 nt, hsa
gagauguuggcaccuuugaauucuacauccuguuucuccagaaugagaauuuguguacaaagaua

SEQ ID NO: 240760 - RNA, 65 nt, hsa
guauaccuuauaacacugagccacuucuccccacccuccagaagggguccacguugaauucugaa

SEQ ID NO: 240761 - RNA, 65 nt, hsa
agcauugcauugugggaaucacaaagcaaauaguacuccagaaagacaaauaucagaagcuuccu

SEQ ID NO: 240762 - RNA, 65 nt, hsa
uuuuuagacuguuagacaaaagugcucacgugcagcuccagaauauggaaacagagcaaaagaac

SEQ ID NO: 240763 - RNA, 65 nt, hsa
ccccgccuuccccaaagcagaggggcugucugugucuccagaaaggggacaucgggggggagggg

SEQ ID NO: 240764 - RNA, 65 nt, hsa
cugaguuugggcugcaagugcucacagcucuuguucuccagaaacuggagaauugcccucaggag

SEQ ID NO: 240765 - RNA, 65 nt, hsa
uauuucuacccaugcaacggaagaaaaacccauuacuccagaagaguauaucuaaguaacuaaaa

SEQ ID NO: 240766 - RNA, 65 nt, hsa
ucccuugaugaagaaguugauaugccuuuucccaacuccagaaagugacaagcucacagaccuuu

SEQ ID NO: 240767 - RNA, 65 nt, hsa
auuugugucgguuaaaaauucgaaggcuuaugggucuccagaaacucugccagccagccucagug

SEQ ID NO: 240768 - RNA, 65 nt, hsa
ccucccaaauaacuauuuucuuaucugcaguauuccuccagaagagcuaaccagggcagggcugg

SEQ ID NO: 240769 - RNA, 65 nt, hsa
ugcccuuccaacgcaucacccgccucaaacugcugcuccagaacauucugaagagaacacagccu

SEQ ID NO: 240770 - RNA, 65 nt, hsa
ugggcuaagguauaaaucaacacacugcuuccuuccuccagaaggucuuacugugaaggaaaaaa

SEQ ID NO: 240771 - RNA, 65 nt, hsa
caacuuggcuacacauagacucuagucaguuuugucuccagaaccuuaggcuuuuguauuuuuua

SEQ ID NO: 240772 - RNA, 65 nt, hsa
guccugcggugauauucuaucugcaguauuuguaccuccagaauggcagaucccucagcaggaac

SEQ ID NO: 240773 - RNA, 65 nt, hsa
ggaauaucaaguauaaugauguaguaaaaagauuucuccagaaaacacuuugagauacuuaaaga

SEQ ID NO: 240774 - RNA, 65 nt, hsa
gguaguucuguucuguggguuugugcuuccucuuucuccagaagccuucuggcugauuguuccga

SEQ ID NO: 240775 - RNA, 65 nt, hsa
ccucaaaccagcccaacccgagcuuuuggacagcucuccagaagcaugaacugcaguggagauga

SEQ ID NO: 240776 - RNA, 65 nt, hsa
aagauucaucugugaccuccaggcagcagucucugcuccagaaucucuggacggagcugcuggca

SEQ ID NO: 240777 - RNA, 65 nt, hsa
uguuucuuuucuauagagaaauguauaguuugacucuccagaauguacuauccaucuugaugaga

SEQ ID NO: 240778 - RNA, 65 nt, hsa
aggcccucaccagaacccaacccuuggacuucagccuccagaacugugagaaauacauaccugcu

SEQ ID NO: 240779 - RNA, 65 nt, hsa
uggaucaggguggggacaaggacuggacccuccuucuccagaaggccuucagcucuugccuugcc

SEQ ID NO: 240780 - RNA, 65 nt, hsa
ucaauauaaauucuacagaaaauaguguucuuuuucuccagaaaaaugcuugugagaaucauuaa

SEQ ID NO: 240781 - RNA, 65 nt, hsa
accucuccaaccaccacacuccccgccguacaguucuccagaaucccaggcgaugacaagucuga

SEQ ID NO: 240782 - RNA, 65 nt, hsa
gcucccaggggccggccuccucugccugguaaugacuccagaacaacaacugggaagaaacuuga

SEQ ID NO: 240783 - RNA, 65 nt, hsa
agaaggaagcauggcccugacuucagaauuccagacuccagaacuggaagaauaaaugucuguug

SEQ ID NO: 240784 - RNA, 65 nt, hsa
ccugcauugaauugaauaugaauuucucuaacucucuccagaaaauggauggagauaacuugucu

SEQ ID NO: 240785 - RNA, 65 nt, hsa
ugugagauucuuuagccacuuuggggagccugucucuccagaagccuuucuuaguggugcccaca

SEQ ID NO: 240786 - RNA, 65 nt, hsa
cuuaaaaugcacggcuaaacuauucagaguuaacacuccagaauuguuaaauuacaaguacuaug

SEQ ID NO: 240787 - RNA, 65 nt, hsa
acugagcgccugcagaucccgcaggcuucguuugccuccagaaccuucccgucugauuguuccuc

SEQ ID NO: 240788 - RNA, 65 nt, hsa
uaaccuuucuaaaaguuuucaucgccuugguaaagcuccagaaauggacaaugcuagugacugca

SEQ ID NO: 240789 - RNA, 65 nt, hsa
acaucggcuucucagauggcuuccucacuucaugccuccagaaagcauauugcccggugaugaaa

SEQ ID NO: 240790 - RNA, 65 nt, hsa
cccucugggccaaagcccauggguagcuuggcugccuccagaagagaugcagagagcuguggggc

SEQ ID NO: 240791 - RNA, 65 nt, hsa
ugauagggauccuggugggaggagagagggcacaucuccagaaaaaugaaaagcaauacaacuuu

SEQ ID NO: 240792 - RNA, 65 nt, hsa
cuucauccucgccucucaggcuuuagauacgaaaucuccagaauggaaggggguggggauuuucu

SEQ ID NO: 240793 - RNA, 65 nt, hsa
agucccaugggauuccccggcugugacacucuacccuccagaaccugacgacugggccaugugac

SEQ ID NO: 240794 - RNA, 65 nt, hsa
uauuuuucuugaagaggcagcucaaaugucaccuucuccagaagcugcucuccacuugcuuuagg

SEQ ID NO: 240795 - RNA, 65 nt, hsa
gauccagcaggccccagucucgcaucagcgccggccuccagaacuuagcaauuuccgccugguga

SEQ ID NO: 240796 - RNA, 65 nt, hsa
agaggagaggagggggaggucauuuaucugagucucuccagaaguuuuuaaggcuacauuuugga

SEQ ID NO: 240797 - RNA, 65 nt, hsa
aagcuuuucuuuggcgauucagugucacaaaauaacuccagaaagaagcacuuagcgugcuguuc

SEQ ID NO: 240798 - RNA, 65 nt, hsa
ucacuuuaaacuuuuauuaccacaguugcugccuccuccagaauuuuugaauuuuaauaaaaggc

SEQ ID NO: 240799 - RNA, 65 nt, hsa
aacauugcgagaguagcuauuuugaaagaauaauucuccagaaguuaacaucuaauaucuaguau

SEQ ID NO: 240800 - RNA, 65 nt, hsa
caaaaucaccagcaccuugaucuuugacuucuaaucuccagaauagugagaaauaaauuucuguu

SEQ ID NO: 240801 - RNA, 65 nt, hsa
uguucuuugccaccagccugucacuccaguggcagcuccagaaacggaggcuguugcuuuuaucc

SEQ ID NO: 240802 - RNA, 65 nt, hsa
acuacugcuucugucccugcuggcagccucugucccuccagaacggcuaaccagagcacacuguc

SEQ ID NO: 240803 - RNA, 57 nt, hsa
uuuuggaacaggagggauaaggaggugcuccagaagcacgggacuguggaccuugca

SEQ ID NO: 240804 - RNA, 65 nt, hsa
uuuaauccuugcuuugguuuggaacugccuucgggcuccagaacuuaaauugcuugguccguggc

SEQ ID NO: 240805 - RNA, 65 nt, hsa
gggugggcugggccgcuggagccuccgccugcuuccuccagaagacacgaaucaugacucacgau

SEQ ID NO: 240806 - RNA, 65 nt, hsa
cccugcuaagcaguuuauaguucuucuccauguuucuccagaauuaaucaguguuaguccucugu

SEQ ID NO: 240807 - RNA, 65 nt, hsa
cucagugguguggggaaacguuccccuggaucauacuccagaauucugcucucagcaauugcagu

SEQ ID NO: 240808 - RNA, 63 nt, hsa
uuuugucugcuuagcauugaucugguagccuugcuccagaagccuguuccucacagucaagcc

SEQ ID NO: 240809 - RNA, 65 nt, hsa
acuucuuggaccuccucccccgccccaauuccaagcuccagaaacucccaacucgucugccgucc

SEQ ID NO: 240810 - RNA, 65 nt, hsa
ccccaccgauuucagcguguccacaucacagcucccuccagaagcugcaagagcuucuuagcagu

SEQ ID NO: 240811 - RNA, 65 nt, hsa
cagcaguuuccuugcaacacuuucagcuccccaugcuccagaauacccacccaagaaaauaauag

SEQ ID NO: 240812 - RNA, 65 nt, hsa
gaugcucuaauuggcugguugguuuggauuuguaacuccagaaacauucuauagugugccagagc

SEQ ID NO: 240813 - RNA, 53 nt, hsa
uugccugccucaucucuugaacucuccagaacaacucuaugaggaagaugcca

SEQ ID NO: 240814 - RNA, 65 nt, hsa
uguaguuguucguugguuauacaaguucuuggucccuccagaaccaccccggcccccugcccguu

SEQ ID NO: 240815 - RNA, 65 nt, hsa
guagucugucuucaacuauuuuauccaaaauaaaccuccagaagaaaguaguuuucauuuacuua

SEQ ID NO: 240816 - RNA, 65 nt, hsa
aggagaccuaucgucuuggaacuugccauucuuuccuccagaacaaaauguuaacuuucuaacac

SEQ ID NO: 240817 - RNA, 65 nt, hsa
gcacagacagguuuucacauaaaugcagcccauuucuccagaacccauuugaggggugggggggu

SEQ ID NO: 240818 - RNA, 63 nt, hsa
aagaauuuauagauguuuaauuccugauuuuugcuccagaauaucuuugagaaugacaacuua

SEQ ID NO: 240819 - RNA, 65 nt, hsa
uaaggcugcuugguacugaguauacuuaaauauaacuccagaauccagggacuugguguuaaaac

SEQ ID NO: 240820 - RNA, 65 nt, hsa
uuacgccucaacauauacuugugcucuuccuuugccuccagaagaaguuuuuccuugauugugcu

SEQ ID NO: 240821 - RNA, 65 nt, hsa
gacugccuccaccacaggcauccugcaaaugcagacuccagaauccccagcaucagcgggaacca

SEQ ID NO: 240822 - RNA, 65 nt, hsa
augucugcuggcaccuugaucuuggaccucccagccuccagaacugugagaaauaaauguguuuu

SEQ ID NO: 240823 - RNA, 65 nt, hsa
ucauacaacauacuuaaugcagggcuacacugaaccuccagaaucauuuuguuugcuuugacccu

SEQ ID NO: 240824 - RNA, 65 nt, hsa
auucuuucacauggcuacugggaauauaaauuucgcuccagaaaggccguagcaguuugacgaua

SEQ ID NO: 240825 - RNA, 65 nt, hsa
ggcucuuaugagucauuuuuuucaaaagaugaaaacuccagaaacgcacaggaacgaaauaccuc

SEQ ID NO: 240826 - RNA, 65 nt, hsa
guuauugguaaucuuuucugugaauauuagguuuccuccagaaauaguccguuauuugggaaagu

SEQ ID NO: 240827 - RNA, 65 nt, hsa
ggccuggguugucucaaauccuguccacaaggcaacuccagaagaaagaagcccuuuacauuucc

SEQ ID NO: 240828 - RNA, 65 nt, hsa
caaaguugcaggcacaacaguuuaagaaugcauuccuccagaagaguaucuggucagguugaccc

SEQ ID NO: 240829 - RNA, 52 nt, hsa
gcucaucuaacuugcccugagacuccagaacuaaauccuuauguaugaaauu

SEQ ID NO: 240830 - RNA, 65 nt, hsa
auuaugaggcucugauuuccuaucccaguuuagggcuccagaaaagccauucucccaaacuaaug

SEQ ID NO: 240831 - RNA, 65 nt, hsa
cccuuucacaggcagccagugcccugagccagggucuccagaaagccccacccaggccaggcaug

SEQ ID NO: 240832 - RNA, 65 nt, hsa
uuugcauaugaugccagccucacgcauuuguauaucuccagaaauucagguaugccucaccaauu

SEQ ID NO: 240833 - RNA, 65 nt, hsa
uguucugugguuucuuaggugaccuuagagcaagacuccagaaugaaauuccuaaagcuuuuagg

SEQ ID NO: 240834 - RNA, 65 nt, hsa
uugucauuggucaauaggggaggguagauuagcugcuccagaauucaauaaaguguaauauuucu

SEQ ID NO: 240835 - RNA, 65 nt, hsa
uguguuuuucaauuguugacauuucagaggggacccuccagaagcccagccggcuucccccaagg

SEQ ID NO: 240836 - RNA, 65 nt, hsa
guggaggugguguucuauaccuaaaggaugaccugcuccagaaacagcaccagcacagcauguau

SEQ ID NO: 240837 - RNA, 65 nt, hsa
aauucacacaugacuaccuuugagcuaaugacugucuccagaaaauaacugugccccaagaagug

SEQ ID NO: 240838 - RNA, 65 nt, hsa
aaauaugccagguagacaccagcccaaguacccuccuccagaagucugugacuaccuugucacua

SEQ ID NO: 240839 - RNA, 65 nt, hsa
cacugaaaauguuuuguuagcuuuuccuucuuucucuccagaagaaacauggauagaugauagcu

SEQ ID NO: 240840 - RNA, 65 nt, hsa
gccugcucuaauuucuuuugcccauauaugaguaucuccagaaugucuacaaauaguuuuuguag

SEQ ID NO: 240841 - RNA, 65 nt, hsa
agguuugaggccaccaaaagaucaacagacaaaugcuccagaaaucuaugcugacugugacacaa

SEQ ID NO: 240842 - RNA, 65 nt, hsa
ggccaucucgggcacaggcccaccccgccccaccccuccagaacacggcucacgcuuaccucaac

SEQ ID NO: 240843 - RNA, 65 nt, hsa
uccuauaaaguuaaacauacacuuuuacuuuaggacuccagaauuccacuucuaguuauuuauuc

SEQ ID NO: 240844 - RNA, 65 nt, hsa
ugaccagaauucuucuguaauucugcccaugacuccuccagaauuuuaguagauacagggugggu

SEQ ID NO: 240845 - RNA, 65 nt, hsa
uuguuuuauccaugaggaagauuuuuaacaaaagccuccagaagauuuccccucaguuuccauug

SEQ ID NO: 240846 - RNA, 65 nt, hsa
aaaagauauggugaaggcagaacugcucacaccagcuccagaagcacguccucugacuucacugc

SEQ ID NO: 240847 - RNA, 65 nt, hsa
uggagcagcccgccuagaacccagucuaaugagaacuccagaaagcuggagcagcccaccuagag

SEQ ID NO: 240848 - RNA, 65 nt, hsa
cagcucuccucugggcccugccuucagccuccucacuccagaaacguguguuucccugaugcggg

SEQ ID NO: 240849 - RNA, 65 nt, hsa
gacuaagucacagggaucugcugcagccacagcuccuccagaaagggacagccacggccaagugg

SEQ ID NO: 240850 - RNA, 65 nt, hsa
caaaaggcagaugacggggaguuaggcauggggagcuccagaaggucaccagagagcuuucagcu

SEQ ID NO: 240851 - RNA, 65 nt, hsa
uuuuugggggcggggggguggggaauucagccacacuccagaaagccaggagucgacaguuuugg

SEQ ID NO: 240852 - RNA, 65 nt, hsa
aggacucccugacaaaagugaagaauuaacuucuccuccagaacaagugcaauucagaaggcagc

SEQ ID NO: 240853 - RNA, 65 nt, hsa
cccuucccaccugagcaugcugacccccuuccuaccuccagaauaaagaaucucaaccuggaggg

SEQ ID NO: 240854 - RNA, 65 nt, hsa
aaagccagcagcugugguacuccagacaaaaggaucuccagaaagccgccuguccuuccagcaug

SEQ ID NO: 240855 - RNA, 65 nt, hsa
auccaagcucccugccccaaauaacuucaguccugcuccagaauuuggaaauccuaguuuccucu

SEQ ID NO: 240856 - RNA, 65 nt, hsa
uacagaguuccuucucacccagacacacuagugcucuccagaaucucugcccaggaggcagggga

SEQ ID NO: 240857 - RNA, 65 nt, hsa
ccagucacugcugcaagguggccucugccuggggccuccagaagcugcuccuuuacccucuuggu

SEQ ID NO: 240858 - RNA, 65 nt, hsa
cugccggaagggagcccccugcuccucccaacaaacuccagaacagcagaaagcgggugcuguag

SEQ ID NO: 240859 - RNA, 65 nt, hsa
ggaagaccaagacaccuggggauugcgucuggggccuccagaacucugcuguggacugcaucagg

SEQ ID NO: 240860 - RNA, 65 nt, hsa
uguggccuggaguauuuauauggugcuuaaugaaucuccagaaugccagccagaagccugauugg

SEQ ID NO: 240861 - RNA, 65 nt, hsa
uuuucagaauaauuauugcauaguagaauuuauuacuccagaacagaaagaccuuacuucauuuc

SEQ ID NO: 240862 - RNA, 65 nt, hsa
ucuccucuucaucucagcauucuccaucacuuccccuccagaaaaacggauggaaggaagcccuc

SEQ ID NO: 240863 - RNA, 65 nt, hsa
ccccaaggagcuucagggcaguccuucuggcacugcuccagaauuccuccuucuuggugugucug

SEQ ID NO: 240864 - RNA, 65 nt, hsa
cccuagauacuguguuaugugcaacuguagaaacccuccagaaauuuccacugcuguucuucacu

SEQ ID NO: 240865 - RNA, 50 nt, hsa
uucaagguuguggaguguaacuccagaauuuuccuucuucagcucauuuu

SEQ ID NO: 240866 - RNA, 65 nt, hsa
ccaccacacagacucugggccuccccgcaaaauggcuccagaauuagaguaauuaugagauggug

SEQ ID NO: 240867 - RNA, 65 nt, hsa
ucaaauggcaacauggaauauuguccuccaugccccuccagaaggaccuaggagaguaggugagc

SEQ ID NO: 240868 - RNA, 65 nt, hsa
acaaggcgucgaggaauuggaaagauuugcacacccuccagaaaggagagacgcaaucuccccuc

SEQ ID NO: 240869 - RNA, 65 nt, hsa
auaaugcuuauuaugaguuuaagaagcaguucuuccuccagaaagaagggggcgauagcaugcag

SEQ ID NO: 240870 - RNA, 65 nt, hsa
agccgcagcccuggggccaguaggaagcggacccgcuccagaaguccccacgagaagaagaagaa

SEQ ID NO: 240871 - RNA, 65 nt, hsa
gggacuguguugacugacgagccgagggguggccgcuccagaagggugcccagucaggccgcacc

SEQ ID NO: 240872 - RNA, 65 nt, hsa
cccaucauucauucucaagaccucugaaggguuggcuccagaacuuagaccuuugcuuaugcaaa

SEQ ID NO: 240873 - RNA, 65 nt, hsa
ucagcagauacaugucagugcagagguucucugcccuccagaagcccucgucugggaauucgaga

SEQ ID NO: 240874 - RNA, 65 nt, hsa
accccaaucccaaauuuuguuuugguucuaacuaccuccagaauguguucaauaaaaugcuuuua

SEQ ID NO: 240875 - RNA, 65 nt, hsa
caccaccaccgacucucccaacccagacucucccacuccagaauguagaagccugucucuguacc

SEQ ID NO: 240876 - RNA, 65 nt, hsa
ccauggacagagaagaaaaugaccaggagugucaucuccagaauuauuggggucacauauguccc

SEQ ID NO: 240877 - RNA, 65 nt, hsa
agucuucccaacuucuuacaccauugcuuuccauucuccagaacucuuuuuuccuuuuuacaaac

SEQ ID NO: 240878 - RNA, 65 nt, hsa
gcaaaaggggcugggacacucugaacuccugcacucuccagaagugacuggucaugaagcucaug

SEQ ID NO: 240879 - RNA, 65 nt, hsa
uuacucucuauuauugggcauaaagguggcuucugcuccagaacucuauccacuguauuuccaca

SEQ ID NO: 240880 - RNA, 65 nt, hsa
gcacgugucucagacugcauguaccauuugcauggcuccagaaaugucuaaaugcugaaaaaaca

SEQ ID NO: 240881 - RNA, 65 nt, hsa
cucugggagacuucucuguacauuucugccauguacuccagaacucauccugucaaucacucugu

SEQ ID NO: 240882 - RNA, 65 nt, hsa
caagugccuucugugaguuuaaaugugcuggugcccuccagaaaagccucggccucagcuccguu

SEQ ID NO: 240883 - RNA, 65 nt, hsa
aagggauguaucagggaugaucagcugaugagaggcuccagaaggauuucuagaucgcuucaagc

SEQ ID NO: 240884 - RNA, 65 nt, hsa
uguuuaagcuagcuuuaccuaagccacuucucagccuccagaauacucucucugggguugugagu

SEQ ID NO: 240885 - RNA, 65 nt, hsa
gcuacaggggcacauuuucugugguuaaaaaugaucuccagaauaaguguaaacugcaguuuucc

SEQ ID NO: 240886 - RNA, 65 nt, hsa
aaaauguagcugcgucauaaggagacuucugucuucuccagaaggcaauaccaaccugaaaguuc

SEQ ID NO: 240887 - RNA, 65 nt, hsa
gaaagcugauagcuccuccauguugguaaaauccucuccagaaucuuggaacaccuggcauguga

SEQ ID NO: 240888 - RNA, 65 nt, hsa
guagcagugguuacccagacuuacagaauuauguccuccagaaaccagcaagaacacuuggaaug

SEQ ID NO: 240889 - RNA, 65 nt, hsa
agugugaucauuguugaacuucagcuccagugucucuccagaauaagacauuggcauucaaaugu

SEQ ID NO: 240890 - RNA, 65 nt, hsa
aauggagccugucucaggaaggccagcugcagguccuccagaaaaucaaagaagggaagaaacuc

SEQ ID NO: 240891 - RNA, 65 nt, hsa
caauaguuauccccaggccuggcacgucaaagaggcuccagaaauguuugcugagugagugauga

SEQ ID NO: 240892 - RNA, 65 nt, hsa
aguagcaaacuguacauuccuucuuccucccccugcuccagaaggugccgguacugaagaugcuc

SEQ ID NO: 240893 - RNA, 65 nt, hsa
agauacucucuuugccagaugaaguuacuugcuaacuccagaaauuccugcagacauccuacucg

SEQ ID NO: 240894 - RNA, 65 nt, hsa
cugcccuggcucugcacauaaguguuagccagcagcuccagaaaaaucccgauucccgggaucug

SEQ ID NO: 240895 - RNA, 65 nt, hsa
uugagaaauagagaaauauaaaaguguguucuuaacuccagaaccacucuuuuugcauaaauacc

SEQ ID NO: 240896 - RNA, 65 nt, hsa
caguuuacugaacuccagaccaugcauguaguccacuccagaaaucaugcucgcuucccuuggca

SEQ ID NO: 240897 - RNA, 63 nt, hsa
aucccaguaaaagauaugauauuuuccauagauaccuccagaauuuuuuucagcaaauggaau

SEQ ID NO: 240898 - RNA, 65 nt, hsa
agaggaacgguguuauggacugaauguucauguuccuccagaauucauaugcugaagccucuguc

SEQ ID NO: 240899 - RNA, 65 nt, hsa
gcgucugcuggcaccuugaucuugaacuucccagccuccagaacugugagaaagaaaucucuaug

SEQ ID NO: 240900 - RNA, 65 nt, hsa
cagugggaccuuguaaaaugcucccugucagagcucuccagaauaugcuuguuggagauccuuca

SEQ ID NO: 240901 - RNA, 65 nt, hsa
uaacggugagggcugacucugaacugucucucagucuccagaaaguguucaagccuguuguguuc

SEQ ID NO: 240902 - RNA, 65 nt, hsa
gaaaaggaauuagagggucagaaacacccagguuccuccagaaagcuccuuggagcccaacaacu

SEQ ID NO: 240903 - RNA, 65 nt, hsa
guagaaagaugugagauaacuuacucaagauuccccuccagaaaaauacguauguuuaaaaaccc

SEQ ID NO: 240904 - RNA, 65 nt, hsa
auguuuuaugauauggguuagggauucuccauggacuccagaaacccuaaaauacaauuuugagg

SEQ ID NO: 240905 - RNA, 65 nt, hsa
gcugcugcauuuaucccaagaaaaacagcuuuaaucuccagaagaaaaccaaaauaccaugggau

SEQ ID NO: 240906 - RNA, 65 nt, hsa
augagugacaaaucuuuaaaguauuuacaauaucacuccagaaaagaaaacaaaucaaauaaaua

SEQ ID NO: 240907 - RNA, 65 nt, hsa
ccaagcuucgaaagauaucccaaaaauuucagugacuccagaagaaaugagccuccaccaccaag

SEQ ID NO: 240908 - RNA, 65 nt, hsa
uugaccuaaucagcuuacaguuugaaaaccuagcucuccagaacaugagaugagccagccgagcc

SEQ ID NO: 240909 - RNA, 65 nt, hsa
ccuccucuacccaaagcucugucccccugcucccacuccagaagaacugcggcacgcgcuucggg

SEQ ID NO: 240910 - RNA, 65 nt, hsa
cuugaccucaucucccgagcaauggcgccugcucccuccagaauggaacucaagcugguuuuaag

SEQ ID NO: 240911 - RNA, 65 nt, hsa
uggcccucuuucucccagugauuacaucuaaggaccuccagaagcaugggaacaucugggugugc

SEQ ID NO: 240912 - RNA, 65 nt, hsa
cuccgcaccccgccccaugccccaguccuuuccuacuccagaaaugcuccccacccccccaaaga

SEQ ID NO: 240913 - RNA, 65 nt, hsa
gaaccuuccaaggugucugguugcccugccucuggcuccagaacagaaagggagccucacgcugg

SEQ ID NO: 240914 - RNA, 65 nt, hsa
cccaccaacuccuauuucccuaccaaccaaggagccuccagaaggaaaggaggaagaaauguuuu

SEQ ID NO: 240915 - RNA, 65 nt, hsa
gaccucaaccccagggauucccaggaagcagaacucuccagaagaaggguuuugaucauuccagc

SEQ ID NO: 240916 - RNA, 65 nt, hsa
cugcccugccucaacaggguccauugccuccucgccuccagaacuuggagcagggaagugggcac

SEQ ID NO: 240917 - RNA, 65 nt, hsa
cuggaaagauauagcauagugguucucagcacagucuccagaacagaagcaucuguaguaccugg

SEQ ID NO: 240918 - RNA, 65 nt, hsa
ggagacauugaccccucccuccaugugguaaaccacuccagaauggccaccaggcuucccagagu

SEQ ID NO: 240919 - RNA, 65 nt, hsa
acuuguguuacaucuauaaagagcaaaauaacacacuccagaacuuggcaguuguagcauuaguu

SEQ ID NO: 240920 - RNA, 65 nt, hsa
ggagcucauguuugugauccucuaucuggacagcucuccagaauccuguguugccccuguucugc

SEQ ID NO: 240921 - RNA, 65 nt, hsa
gagaaugugccaugcaugaagcaaaggauuccaggcuccagaaaaaaugaaugaacucaccuuga

SEQ ID NO: 240922 - RNA, 65 nt, hsa
gaagcugggcaggacaaguaggacaucccuggagccuccagaagggacuggccucugcccacacc

SEQ ID NO: 240923 - RNA, 65 nt, hsa
cagagggagugugcgaaucaagccugaccaagaggcuccagaauaaaguaugauuuguguucaau

SEQ ID NO: 240924 - RNA, 65 nt, hsa
gggaagaagacacagaagccuuugauauugccacccuccagaauccugaugguaucaauggauuu

SEQ ID NO: 240925 - RNA, 64 nt, hsa
cgcccagcguggggcccuagccggcguccccugccuccagaacgcggugcgugagguucccggc

SEQ ID NO: 240926 - RNA, 65 nt, hsa
ggaccuggcagcuuuucuugccgucccuccccugccuccagaaucacagcccuucuccccaaggg

SEQ ID NO: 240927 - RNA, 65 nt, hsa
aagugccggugacaagcugucugucaggggagaggcuccagaaccuggguucguccccagugaga

SEQ ID NO: 240928 - RNA, 65 nt, hsa
gcacacggcgucaaaaccaagcugccggccacugucuccagaacgcaaggcuccaggcccgugug

SEQ ID NO: 240929 - RNA, 65 nt, hsa
guucugcugagacugagcaccuuacagauauuuuucuccagaagauggugcuggguaauaaaauc

SEQ ID NO: 240930 - RNA, 65 nt, hsa
ccauccccuuuccuccccaccuuccccagacucagcuccagaauaccuucuucgcugcuagagaa

SEQ ID NO: 240931 - RNA, 65 nt, hsa
cuauuauucgcuccaagaaagaugcuaagucugagcuccagaagagacugugcuggguguggcuu

SEQ ID NO: 240932 - RNA, 65 nt, hsa
cgaggugccgccuuggccgggcccccacgugucuucuccagaaugugucugucuuugccuggugu

SEQ ID NO: 240933 - RNA, 65 nt, hsa
cagcgacacacacacacuuauggcaccagccuggacuccagaaaaaggguguccagguauugugu

SEQ ID NO: 240934 - RNA, 65 nt, hsa
agagcuggagcucgaucaugccugcgugacaaagccuccagaaaaauccuugaaagacaggacau

SEQ ID NO: 240935 - RNA, 65 nt, hsa
cuugcggccacagcacuagagucacccccccaggccuccagaaccuuacuggcacuguggcacug

SEQ ID NO: 240936 - RNA, 65 nt, hsa
aaugaucuguacuaucuagugucuaaaacacuauucuccagaaaaaucaaucauuuucuagcccu

SEQ ID NO: 240937 - RNA, 65 nt, hsa
ggacaaugaauguaguuaacugguuccugcucacacuccagaauuaaauucuauugaaaaaggaa

SEQ ID NO: 240938 - RNA, 65 nt, hsa
uuugcagaucacagugcuggaagcaggaacccaggcuccagaagguguugccaggggcccagaug

SEQ ID NO: 240939 - RNA, 65 nt, hsa
ucaaagaugaacaucggaauaacaaacauuguccucuccagaaaguccuuucuuucuccauacug

SEQ ID NO: 240940 - RNA, 65 nt, hsa
gucucaggauuuagaaagucuguaagccauccaugcuccagaaagcaccgaucuguuguaguugc

SEQ ID NO: 240941 - RNA, 65 nt, hsa
agcguggaggcgugugcaggcuuggaagaagaacucuccagaacauggaacuuaacccucuuuug

SEQ ID NO: 240942 - RNA, 65 nt, hsa
aacugaggccagagggaggagagaauugcucauggcuccagaacugguggcaaguuucucuggac

SEQ ID NO: 240943 - RNA, 65 nt, hsa
cuucuggauacagccuuuuggguaaacacugggaacuccagaaguuguggggagaguggggaauc

SEQ ID NO: 240944 - RNA, 65 nt, hsa
cucccccuucaccccuccuugcccgccuacccucccuccagaauagccccucacccuucuucccc

SEQ ID NO: 240945 - RNA, 65 nt, hsa
gaggguaacuggggggccaccaugaccccuucucucuccagaaacagcugcuucuccccccaucc

SEQ ID NO: 240946 - RNA, 65 nt, hsa
ugccuucuucauccuuccuuacgaucaaucacagucuccagaagaucagcucaauugcugugcag

SEQ ID NO: 240947 - RNA, 65 nt, hsa
cagcaagggggaccgaugcugugcagcucacaccacuccagaaccugacaaggcaccagcaggac

SEQ ID NO: 240948 - RNA, 65 nt, hsa
cccuccuggucgugccccgucucuuuugguccuggcuccagaaaacccgcgccccacauaccugc

SEQ ID NO: 240949 - RNA, 65 nt, hsa
aguguggacacuuuugacagcuuggcagauuuuaacuccagaagcacuuuaugaaaugguacacu

SEQ ID NO: 240950 - RNA, 65 nt, hsa
gcuuguuccaaguuugucaaugagguuuauggagccuccagaacagaugccaucuuccugaaugu

SEQ ID NO: 240951 - RNA, 65 nt, hsa
cauguuccugccccacaggaauagaauggagggagcuccagaaacuuuccaucccaaaggcaguc

SEQ ID NO: 240952 - RNA, 65 nt, hsa
cugcaaaccucacaggguccccacacaacagugcccuccagaagcagccccucggaggcagagga

SEQ ID NO: 240953 - RNA, 65 nt, hsa
gaacucaugguuuuaaauauagaccaucaucgaaacuccagaaauuuauccacuguggaugauga

SEQ ID NO: 240954 - RNA, 65 nt, hsa
aucccacacccacccccaccccacccccacccagccuccagaagcuggaaccauuucucccgcag

SEQ ID NO: 240955 - RNA, 65 nt, hsa
gaaaagcagcucuccccucagagugcaagccccugcuccagaagauagcuucaccccaaucccag

SEQ ID NO: 240956 - RNA, 65 nt, hsa
gggagauggggaggagauauggagugagucaccugcuccagaagaugccagcuucucucuccagg

SEQ ID NO: 240957 - RNA, 65 nt, hsa
auucugcccuucacuuagcaccugccucagccccacuccagaauagccaagagaacccaaaccaa

SEQ ID NO: 240958 - RNA, 65 nt, hsa
cuugagcccauugaaacugaucuugagcuccuggccuccagaauugcaggagaauaaauuugugu

SEQ ID NO: 240959 - RNA, 65 nt, hsa
ggaggugucuacugaaaagggaaccugcuucuuuacuccagaacucuguucuuuaaagaccaaga

SEQ ID NO: 240960 - RNA, 65 nt, hsa
aggaaggaaaaugaagagagccaguauuuccccuucuccagaagcagguacucagcuuucuggga

SEQ ID NO: 240961 - RNA, 65 nt, hsa
ggaaucccccgcugcagggacacccacgcccuucucuccagaagccgggcaggcagaauccggcc

SEQ ID NO: 240962 - RNA, 65 nt, hsa
ucgagggagaggaggggguuggggaggacccaccucuccagaauggcgacuguccccauccgccu

SEQ ID NO: 240963 - RNA, 65 nt, hsa
ggcaucuaaguuagagcuggcaccagaacugagaccuccagaaaucuauuccaguauuuuuucca

SEQ ID NO: 240964 - RNA, 65 nt, hsa
uucuguccugcuuugccuuuugucacuagaauguucuccagaaaccccaguuucugucaucuuaa

SEQ ID NO: 240965 - RNA, 65 nt, hsa
ucauucucagaaaauccaaccauaucuuagaguaucuccagaaacuggcuuagaggagcuccaaa

SEQ ID NO: 240966 - RNA, 57 nt, hsa
uccagcguugcacgccauaaccauuuucuccagaagcguggaggaaagauuaugaaa

SEQ ID NO: 240967 - RNA, 65 nt, hsa
uggugauacuccaacaccguccaguuguggcagcucuccagaaguaauagcagcugacaacuuuc

SEQ ID NO: 240968 - RNA, 65 nt, hsa
cagcaagggcucagcugggaucugcgcccggccugcuccagaacgcagcccacucgccaccggug

SEQ ID NO: 240969 - RNA, 65 nt, hsa
ggggguuugcuggggaacuggcgccaucgccgggacuccagaaccgcagaagccuccccagcuca

SEQ ID NO: 240970 - RNA, 65 nt, hsa
ugcccugcccucuccucacaggucuguugcagggacuccagaaaccauucugggagccguggaug

SEQ ID NO: 240971 - RNA, 65 nt, hsa
cugguucaugaugcauaaagcgcuaggcccuagaacuccagaaacagcacagcuggggcggggac

SEQ ID NO: 240972 - RNA, 65 nt, hsa
ggccacagccacaccucaccgcccaguccagcugucuccagaaggggacaggcaguccgcggucu

SEQ ID NO: 240973 - RNA, 65 nt, hsa
cuuuggccaccaguucuucggccagcaccucugcccuccagaaccugcagccuggaggggugagg

SEQ ID NO: 240974 - RNA, 65 nt, hsa
cccagcccggagcccagcccccugccccggcccugcuccagaacccagcccagaucggaggacaa

SEQ ID NO: 240975 - RNA, 65 nt, hsa
ucuagaacccaauccaauuuggagccccagcccaacuccagaacccaacccuucucuagaaucca

SEQ ID NO: 240976 - RNA, 65 nt, hsa
cccggcugggucugcguccuuuccugugccuuucccuccagaaugcggccucagaccuagaagcu

SEQ ID NO: 240977 - RNA, 64 nt, hsa
cugucccagcuagcaccugagagcugggccuccucuccagaaucauguggaggggccagaggcc

SEQ ID NO: 240978 - RNA, 65 nt, hsa
uaauuuucucggaggugauaggcuuccacacaggucuccagaagcccugcauugaauauccaucc

SEQ ID NO: 240979 - RNA, 65 nt, hsa
acuguuccagcaucuucccuggauggcuggaggaacuccagaaaauauccaucuucuuuuugugg

SEQ ID NO: 240980 - RNA, 65 nt, hsa
agccagcuccacugcccaggcccccaagagggcagcuccagaagcugcccagggcuccgggaccc

SEQ ID NO: 240981 - RNA, 65 nt, hsa
cucccuuaggggcugaggaagcugcccucgaaacccuccagaagacaucuguccugcagaggccc

SEQ ID NO: 240982 - RNA, 65 nt, hsa
uauccuuauccaaaucaauaaagagagaauccucccuccagaaggguuucuaaaaacagcccuca

SEQ ID NO: 240983 - RNA, 65 nt, hsa
agucuaggacagauuuuacguggagaguugaacuacuccagaaacuaaagaguaauguuucuaga

SEQ ID NO: 240984 - RNA, 65 nt, hsa
cugugagaccuccuggaacacuggcaucucugagccuccagaagggguucugggccuaguugucc

SEQ ID NO: 240985 - RNA, 65 nt, hsa
ggccccgccuggcacucagccuugccagagauuggcuccagaauuuuugccaggcuuacagaaca

SEQ ID NO: 240986 - RNA, 65 nt, hsa
gagagagggucucucuccuagcugcuacccaggaccuccagaaggagcccuuggaccucugggag

SEQ ID NO: 240987 - RNA, 65 nt, hsa
cauacuaagugcuuaguaaauguuagauaaguauucuccagaauugauguaaauuauuuuuaaac

SEQ ID NO: 240988 - RNA, 65 nt, hsa
auguuauauaaauuccacauuuuuaugcaacuaaucuccagaacauuuuuccucuuaccaagaag

SEQ ID NO: 240989 - RNA, 65 nt, hsa
cuggaguggcacaggugacccaggcguccuuucagcuccagaauguugcaagucuaggagagugu

SEQ ID NO: 240990 - RNA, 65 nt, hsa
cacgcugggcuucacggcugccaggagccucuccccuccagaagacuugccugcuagggaccucg

SEQ ID NO: 240991 - RNA, 65 nt, hsa
cuagagugaggcucuguccaauacauggcucugcccuccagaacuucaggcucucagugacccuu

SEQ ID NO: 240992 - RNA, 65 nt, hsa
caacccugucuccaccuugauauugcacuuccaggcuccagaacugugaggcaauaaauuucucu

SEQ ID NO: 240993 - RNA, 65 nt, hsa
cuauggucacagggccguccuguuccuccccgggacuccagaauuucucuccucaaaggaaagaa

SEQ ID NO: 240994 - RNA, 65 nt, hsa
gaucucgggcugccagcgaugggcaggcgagaccccuccagaaucugcaggcgccucugguucuc

SEQ ID NO: 240995 - RNA, 65 nt, hsa
uagcggacgggggucccgagguggaaaccauugcccuccagaacaaccgugagaaccaggcauuc

SEQ ID NO: 240996 - RNA, 65 nt, hsa
uaaacuucuaggcucaagcaucuaccugccucagccuccagaagugcugggauuacaaaugugag

SEQ ID NO: 240997 - RNA, 65 nt, hsa
uuagucaaacucucauuuaggugacagccuggugacuccagaauggagccagucaugcuaaaugc

SEQ ID NO: 240998 - RNA, 65 nt, hsa
gggccgggugucuuuagggaucaguuuuuccaagacuccagaaggugccagguucuccccuugag

SEQ ID NO: 240999 - RNA, 65 nt, hsa
gaagguaacugagagcagaugguccuccauuucaacuccagaaguggggcucugggagggauguu

SEQ ID NO: 241000 - RNA, 65 nt, hsa
cacuccagaauccacaaagccgugccuuucucuggcuccagaauaugcauaaucagcgcccugga

SEQ ID NO: 241001 - RNA, 65 nt, hsa
ccacccccuccagcuccaguuuccaaguuccugcacuccagaauccacaaagccgugccuuucuc

SEQ ID NO: 241002 - RNA, 65 nt, hsa
gcacaggaaaccaggcagaggaggcacagggugcucuccagaacgagaagccagcuccuggaguu

SEQ ID NO: 241003 - RNA, 65 nt, hsa
gggagaauuagagaauuuauuugugucagaaaauacuccagaacaaccaccccauauuaugauua

SEQ ID NO: 241004 - RNA, 65 nt, hsa
ccagaucucauacucaacagaaggagacucagagacuccagaaggcacaggagcugcccccagug

SEQ ID NO: 241005 - RNA, 65 nt, hsa
uuccucaacacuugagggcccagaaagucugaucucuccagaaugaucagcccagaggaaugcug

SEQ ID NO: 241006 - RNA, 64 nt, hsa
uuguaaauuaggaggcucaacaauaaaacauuaugcuccagaaauuaugugagaugugcuauau

SEQ ID NO: 241007 - RNA, 65 nt, hsa
aaaucuguaagcaccuugaucuuggacuucucagccuccagaauugugagaaauaaauuucuguu

SEQ ID NO: 241008 - RNA, 65 nt, hsa
cggagacaagcauggugcugcugcuucugcugcuucuccagaaaaucccugggacaccuuuguuc

SEQ ID NO: 241009 - RNA, 65 nt, hsa
cucuuugcaggcguccaauccuagaaaccaauggucuccagaacucucacacaaguguuuuucug

SEQ ID NO: 241010 - RNA, 65 nt, hsa
acugacuggcauccugcuuuccagugccugccagccuccagaagagccaggugccugacuaguac

SEQ ID NO: 241011 - RNA, 65 nt, hsa
gcguuguuaguuuugaagaguggaggagcuaggggcuccagaaagaaucuuacacauguguugaa

SEQ ID NO: 241012 - RNA, 65 nt, hsa
aucuuaucccuugaauuuucaauauuguggaaucacuccagaagauccuuucaugugaaguuuuu

SEQ ID NO: 241013 - RNA, 65 nt, hsa
uggcccaacauacgcacugggcauuggguaagggacuccagaagcagcagcuagaaagagaaaaa

SEQ ID NO: 241014 - RNA, 65 nt, hsa
ccuucuggccccaacccuugacucaacggggacaacuccagaaggucauuccagauccagagauc

SEQ ID NO: 241015 - RNA, 65 nt, hsa
cuccugugugccccuggcuuucugggucugugccucuccagaaucuugucuuacccuccggugug

SEQ ID NO: 241016 - RNA, 65 nt, hsa
uugguggggggaccccaaagccauucugggaagggcuccagaagaagguccagccuaggcccccu

SEQ ID NO: 241017 - RNA, 65 nt, hsa
gcacaagucuugcuaaaugugauacuguugacauccuccagaauggccagaagugcaauuaaccu

SEQ ID NO: 241018 - RNA, 65 nt, hsa
gcaccuacugauguuuugauguugaacuucccagccuccagaacucugggaaaauaaaguccucu

SEQ ID NO: 241019 - RNA, 65 nt, hsa
gacuggcuagaguccucacucccaguccaaauguccuccagaagccucuggcuagaggccagccc

SEQ ID NO: 241020 - RNA, 65 nt, hsa
uuuggaaacauuuaauuuauaccccucuccucugucuccagaagcuucuagcucuggggucuggc

SEQ ID NO: 241021 - RNA, 65 nt, hsa
caucuccuggauucaaacaauucuccugccucagccuccagaauagcugggauuacaggcguaca

SEQ ID NO: 241022 - RNA, 65 nt, hsa
ggauaccaugggaaggagccaucuccacucuccuucuccagaacccccuugaagggccuuuggga

SEQ ID NO: 241023 - RNA, 65 nt, hsa
gcaaguguucaguaaauauuugcugcuugaaucugcuccagaauuaacaagaaagccaucucuuc

SEQ ID NO: 241024 - RNA, 65 nt, hsa
ccaucuccuaccccacauccugucuuagccgcagucuccagaacccaugaugaacugugaucugc

SEQ ID NO: 241025 - RNA, 63 nt, hsa
cacgagggaagggacucugagcauugucaccuccuccagaaagccuccucugauugcacacug

SEQ ID NO: 241026 - RNA, 65 nt, hsa
uuucuauaacagaagugacauguguacugauuuuucuccagaaauauggaugcuguuguauucag

SEQ ID NO: 241027 - RNA, 65 nt, hsa
uuccuaggccuuuucaugcuucauuucuuccacuucuccagaaaauggaagcuaugaagcaacau

SEQ ID NO: 241028 - RNA, 65 nt, hsa
ucuuccuccacacaggucgccgugagucaagcugccuccagaaccucagagcuucccuggugggc

SEQ ID NO: 241029 - RNA, 65 nt, hsa
gcugaccgggcuguucuguagacucaggaccguggcuccagaacuccugugccaggcgggaggga

SEQ ID NO: 241030 - RNA, 65 nt, hsa
gguccggccggagaggccucccgcggacgccgucucuccagaacuccgcuuccaagagggagccu

SEQ ID NO: 241031 - RNA, 65 nt, hsa
ugcuauccugggagaucuaccugaaggagaacuaccuccagaaccgacaguuccagcaaaagcag

SEQ ID NO: 241032 - RNA, 65 nt, hsa
ggcgcaucccacucuaugcgaaccacaagacccuccuccagaaggcagccgcugaguucggggcu

SEQ ID NO: 241033 - RNA, 65 nt, hsa
gggggugcagggggcugugggcauccagcgucauccuccagaaccucacaucugaacugggggca

SEQ ID NO: 241034 - RNA, 65 nt, hsa
cuagauugcuuugugaagcucuugguagagacacgcuccagaagggauaacaaaaucaaauagua

SEQ ID NO: 241035 - RNA, 65 nt, hsa
ggaagcacagcccugcuugaauucaaacuuuuggccuccagaacugugagucaguaccuguuguu

SEQ ID NO: 241036 - RNA, 65 nt, hsa
guagacaggcuggauuccaguguugggacagccaucuccagaaaccugacuuaagagaguaagau

SEQ ID NO: 241037 - RNA, 65 nt, hsa
augcugguucccggaaugaaucagcugcugacugucuccagaagggcuggaaaggaugcugccag

SEQ ID NO: 241038 - RNA, 65 nt, hsa
auguggaaacaaagcaggaccagcaggcacagcaccuccagaacagugccccggaugaccagagg

SEQ ID NO: 241039 - RNA, 65 nt, hsa
gucugccuucuggcugacaauccuggaaaucuguucuccagaauccaggccaaaaaguucacagu

SEQ ID NO: 241040 - RNA, 65 nt, hsa
auccauagggagcuggcuggggguuuccgugggagcuccagaacuuuccccagcugagugaagag

SEQ ID NO: 241041 - RNA, 65 nt, hsa
caauaggacaauuugcugaggucugagaggacucccuccagaaaaucccugaucucuuaaaauuu

SEQ ID NO: 241042 - RNA, 65 nt, hsa
aagcugcagccuacugaggaggcagaggccaccuccuccagaaagcccucggccugggccgccgc

SEQ ID NO: 241043 - RNA, 65 nt, hsa
aaacugccuuucuuccccucaagucaacuuuugugcuccagaaaauuuucuauucuguaagucug

SEQ ID NO: 241044 - RNA, 65 nt, hsa
ggaagauccugcggcuggggccgucugccuacacgcuccagaagggccagcgcagagcugggaug

SEQ ID NO: 241045 - RNA, 65 nt, hsa
ucccgugacugcugccucaucgauaccccauuuagcuccagaaagcaaagaaaacucgaguaaca

SEQ ID NO: 241046 - RNA, 65 nt, hsa
aucaccgaggcucccgugacuuugaacucccuacucuccagaauccaggggcuauagcgaugggg

SEQ ID NO: 241047 - RNA, 65 nt, hsa
ggucuccucugcagcucagggacuggcacacuggccuccagaagggcagcuccacagggcagggc

SEQ ID NO: 241048 - RNA, 65 nt, hsa
cugugccucccauuuccccucaccuguacccacaccuccagaaugcccugcccugcgaguguguc

SEQ ID NO: 241049 - RNA, 65 nt, hsa
guuaaacuggcuuacuauagacuucguaaaaauggcuccagaagaguaacaaacugaaaucuuug

SEQ ID NO: 241050 - RNA, 65 nt, hsa
auucugucuggggacgaaggguuggacgggaugaccuccagaagucccuucaauuucuaguaccu

SEQ ID NO: 241051 - RNA, 65 nt, hsa
ccuuagccuccagguccagacuacuacucuauguucuccagaagggugcuaagucaccuacugaa

SEQ ID NO: 241052 - RNA, 65 nt, hsa
cugccuaugaggcaucuggccccugguagccagcucuccagaauuacuuguagguaauuccucuc

SEQ ID NO: 241053 - RNA, 60 nt, hsa
ggguauaccauauguauuagucccccagugcuccagaacagcgggagcacugugcugugc

SEQ ID NO: 241054 - RNA, 65 nt, hsa
ggcaaggccagagacuucaagucuaucugaaaagucuccagaagucuaaccccagauaaauagcc

SEQ ID NO: 241055 - RNA, 65 nt, hsa
ggcuauuuuccaacugaagucagggacauugccagcuccagaaaacauccauaacauaguaaaga

SEQ ID NO: 241056 - RNA, 65 nt, hsa
cuauaaagaaucauuagaaauuaugaguggaaauucuccagaaagauaguauuauagagucuuuu

SEQ ID NO: 241057 - RNA, 65 nt, hsa
agguuuuuuuaaaaaagaggacuugcaucagcugccuccagaacaauuuuaagaaaauaacaaag

SEQ ID NO: 241058 - RNA, 65 nt, hsa
agcugcucuccuguauuauccuccacaauaaaauucuccagaaaauaagucccagugucugcugu

SEQ ID NO: 241059 - RNA, 65 nt, hsa
aggagaaggguaguuugaggugugacaccaguuugcuccagaaaguuuaaggggucuguuucuca

SEQ ID NO: 241060 - RNA, 65 nt, hsa
guucaguccuagcaagaagcgagaauucugagauccuccagaaagucgagcagcacccaccucca

SEQ ID NO: 241061 - RNA, 65 nt, hsa
aggaagggaaggggggucagaagagagggugaguccuccagaacucuuccuccaaggacagaagg

SEQ ID NO: 241062 - RNA, 65 nt, hsa
gaaaaaggucaagauuucuaucacuuccccgucuucuccagaacuugugucuccagaggaguacg

SEQ ID NO: 241063 - RNA, 66 nt, hsa
uucucggccccgccaccugcccagcgugcccuggcucuccagaaccuucuaucccacagucaggcc

SEQ ID NO: 241064 - RNA, 66 nt, hsa
augagaaagucuuaagcaaaauacucccaggucucacuccagaacauaaaaauggugugugaucaa

SEQ ID NO: 241065 - RNA, 66 nt, hsa
ggaaaacccaguguccaucuuuccacccucccugaucuccagaaccuucgacugacccccuugucu

SEQ ID NO: 241066 - RNA, 66 nt, hsa
uaggaccugcacgggacuuguggaugggccuggacucuccagaaacuacuugggcagagcaaagga

SEQ ID NO: 241067 - RNA, 66 nt, hsa
ggacaacagaccaggaggggcccccaccugauggaccuccagaaaaacggaucacagccacuaugg

SEQ ID NO: 241068 - RNA, 66 nt, hsa
ggauggggagggagugggccuggaucugggaccucccuccagaauuuccuccagaugggggcagug

SEQ ID NO: 241069 - RNA, 66 nt, hsa
ggccuuccuggugcccaccaggcacuacggcuuccucuccagaauguggcuuugccugagcacaga

SEQ ID NO: 241070 - RNA, 66 nt, hsa
aauauugaauaacuagaacacaagccacuguuucagcuccagaaaaaagaaagggcuuuaacguuu

SEQ ID NO: 241071 - RNA, 66 nt, hsa
gucacagggauuccuccuuucccccccaaauauuaacuccagaaacuaggccugacuggggacacc

SEQ ID NO: 241072 - RNA, 66 nt, hsa
cacagcacacaauuucaagccauuuucagaucagaacuccagaaguguugacaagaugccuauucg

SEQ ID NO: 241073 - RNA, 66 nt, hsa
ggagaggauccuucaguucuggccauuccagggacccuccagaaacacaguguuucaagagacccu

SEQ ID NO: 241074 - RNA, 66 nt, hsa
gugggguccccaucaucccagcugcucccaaauaaacuccagaagaggaaucugugggccugugag

SEQ ID NO: 241075 - RNA, 66 nt, hsa
acaaaaucaccuauucacugcuuaugcagucggaagcuccagaagaacaaagagcccaauuaccag

SEQ ID NO: 241076 - RNA, 66 nt, hsa
ccgacucugucguugccuugaucuugaacuuccagccuccagaacuaugagaaauaaaauucuguu

SEQ ID NO: 241077 - RNA, 66 nt, hsa
uacaguugcaguauuucaaagucccuauccaggucacuccagaaaaggguauugaaacguugaaau

SEQ ID NO: 241078 - RNA, 66 nt, hsa
gacugcugcauuuaggccaggucuccaauugcuuuccuccagaaaguguguucccgucuagugagg

SEQ ID NO: 241079 - RNA, 66 nt, hsa
acacccaaacuccuggccuucugugguuucccuuugcuccagaaacacagaugugucuaaagacuu

SEQ ID NO: 241080 - RNA, 66 nt, hsa
ugagaaacguacacuaucauugcuaaacuaacaguccuccagaaauuuaauaagauguuuuugauu

SEQ ID NO: 241081 - RNA, 66 nt, hsa
uguuuaagugaccuccuucaucacauccugcaguaucuccagaagcagcacuaggguuugaguuuc

SEQ ID NO: 241082 - RNA, 66 nt, hsa
ggcccacguguauuguccgggcucagaaugggaggacuccagaagaugagagaaaccucuuuaucc

SEQ ID NO: 241083 - RNA, 66 nt, hsa
cuuuuagccuuaccaccuuuuaaaaaauuuguuauucuccagaaacaguaaauaggugaguagggg

SEQ ID NO: 241084 - RNA, 66 nt, hsa
caacucagucagugauuuuuugaugcuucucuuauccuccagaauagagaccuaaggacacgugga

SEQ ID NO: 241085 - RNA, 66 nt, hsa
aaccccuguccccagucagagauaacauccaacuaacuccagaagcggaagaggauauauuuaaca

SEQ ID NO: 241086 - RNA, 66 nt, hsa
gagggauggagcgggucuccugauucuacaccaucucuccagaacucucuggccuugguggcccca

SEQ ID NO: 241087 - RNA, 66 nt, hsa
agucuccccccggggagaggacacuggccccucgcacuccagaaaagccaugccagcugggcucgu

SEQ ID NO: 241088 - RNA, 66 nt, hsa
gcccuguaacuuaucuagaaagaaaagacccugagacuccagaaucugcuguugccauagccccau

SEQ ID NO: 241089 - RNA, 66 nt, hsa
uggccuauccaguuuuccugguucccucacagguuucuccagaaaguacucccucaguaaagcauu

SEQ ID NO: 241090 - RNA, 66 nt, hsa
ggagcuuuugccacugacucggccguguccugacaccuccagaacgcaggugcuggcgcccguucu

SEQ ID NO: 241091 - RNA, 66 nt, hsa
aggccugcuucacuugcagauaaguuuauuauaauucuccagaaaugugcaggaugugcauuagca

SEQ ID NO: 241092 - RNA, 66 nt, hsa
ucuguugcccugagagugucccaggggauucagagucuccagaaagauauggcugggccaacucug

SEQ ID NO: 241093 - RNA, 66 nt, hsa
gcugaacagugcucugccucuaacucccuccucacacuccagaauuacccuuccucaucugugccu

SEQ ID NO: 241094 - RNA, 66 nt, hsa
cucaggggaagcugcuaggggaaggacuggccguggcuccagaaugugcugccuuuuuaaguuuug

SEQ ID NO: 241095 - RNA, 66 nt, hsa
uggcgcacuuuccugaagccucuuauuaacucccaucuccagaagcaccucaacaaugucaguggc

SEQ ID NO: 241096 - RNA, 66 nt, hsa
cuguuggaaucagcaggccucugugcucccucugcccuccagaacucagugacucuugaacaugga

SEQ ID NO: 241097 - RNA, 66 nt, hsa
agccuccaugagucaagcccccuccccacaccuggacuccagaauucacccucuccccugcagucu

SEQ ID NO: 241098 - RNA, 66 nt, hsa
ugaggacgggggguggggaaggaaggaacaugaucccuccagaagucucccacccuggggccaacu

SEQ ID NO: 241099 - RNA, 66 nt, hsa
ugaaguccuggcuucaggcaauucuccugccuuugccuccagaagcacugggaucacaggugucag

SEQ ID NO: 241100 - RNA, 66 nt, hsa
acugcauuuuccuacaccccuuuccuggacugcucucuccagaaacagcacagcucauggagggug

SEQ ID NO: 241101 - RNA, 66 nt, hsa
cugcuuuccuagauccacacuuucaaagagaaaccccuccagaacucccacccugacagcccaaca

SEQ ID NO: 241102 - RNA, 66 nt, hsa
uuuaccuaacaacaucacuuuuguugaacauuccaacuccagaaugauccccaaucacccuaaucu

SEQ ID NO: 241103 - RNA, 66 nt, hsa
caugucagucuuuguaauuauuuacacuuuaacuuucuccagaacucagacaugauuucaacaugg

SEQ ID NO: 241104 - RNA, 66 nt, hsa
ucuguaucuuuggagaaggagaaagaaaggaaagaacuccagaaucccaucacuguucuuuaaagc

SEQ ID NO: 241105 - RNA, 66 nt, hsa
auguauuuuuuuaagcaacaucaugaauuuuaucuacuccagaagucucuacaauagaaaaaaaag

SEQ ID NO: 241106 - RNA, 66 nt, hsa
agcaauggagagaagaccucuuccugaaucacuggacuccagaaaugugcaugcagaucagcuguu

SEQ ID NO: 241107 - RNA, 66 nt, hsa
aguauuaccaccagacugacuccaggacucacugcccuccagaaaacagaggugacaaaugugagg

SEQ ID NO: 241108 - RNA, 66 nt, hsa
aaagagcugcuggugaacuccaucucauucucgccccuccagaagaagcaguugucccccaaauac

SEQ ID NO: 241109 - RNA, 66 nt, hsa
uuccuuuucccuaaucauucccuuuucuccccacuccuccagaaggcauaacccuucucuccacac

SEQ ID NO: 241110 - RNA, 66 nt, hsa
gcucuucucauaguguacacccaccugccucucuggcuccagaagcugccagagugcacugggggg

SEQ ID NO: 241111 - RNA, 63 nt, hsa; identical to SEQ ID NO: 240602

SEQ ID NO: 241112 - RNA, 66 nt, hsa
aucaaaauagaagaccuugcaagaagcagagucauucuccagaaggaacuugggagaugauggugc

SEQ ID NO: 241113 - RNA, 66 nt, hsa
caaggaauuguacugugcuacaauuaucucuagaaucuccagaaagguggagggcuguucgcccuu

SEQ ID NO: 241114 - RNA, 55 nt, hsa; identical to SEQ ID NO: 240605

SEQ ID NO: 241115 - RNA, 66 nt, hsa
aguguuaucuucauaugauaugcugaacaccaaaaucuccagaaaugcauuuuauguaguucuaaa

SEQ ID NO: 241116 - RNA, 66 nt, hsa
uuuauguucucaugcccucaaucuguaaauuuuugucuccagaaaaacccucccaggcaucccaua

SEQ ID NO: 241117 - RNA, 66 nt, hsa
ggucagggaggacugggcacuauuuggcaggauguacuccagaauauaaucaaagaauuuucugua

SEQ ID NO: 241118 - RNA, 66 nt, hsa
ccaaaaggaguacccagggccugguacccaggcccacuccagaauggccucuggacucaccuugag

SEQ ID NO: 241119 - RNA, 66 nt, hsa
ccccccaaccccaucucagagcucagaggguacaagcuccagaacaguaaccaagugggaaaauaa

SEQ ID NO: 241120 - RNA, 66 nt, hsa
caaagaaguguuugauggugccagagaggggcugcucuccagaaagcuaaaauuuaauuucuuuuu

SEQ ID NO: 241121 - RNA, 66 nt, hsa
ccgaggggcucaggaaaacgggaccggccaggccaccuccagaaacggccauucagcaagacaaca

SEQ ID NO: 241122 - RNA, 66 nt, hsa
agccaagucuauaauauaauuaugaucaugaauagacuccagaauccacaaagagaagagggcuug

SEQ ID NO: 241123 - RNA, 66 nt, hsa
agagccuucccuacccugacgccucccagucaucaucuccagaacucccagcggggcucccugagc

SEQ ID NO: 241124 - RNA, 66 nt, hsa
agaauauuagauuucugacuugcaaauauguuuguacuccagaagaauuagaggaaaagcagauac

SEQ ID NO: 241125 - RNA, 66 nt, hsa
agugcugggauuacaagugugagccaccacaccuggcuccagaaauuuuauuuuauuuuuuugagg

SEQ ID NO: 241126 - RNA, 66 nt, hsa
cacacuauguguguuguuuccauagcucuucacuuccuccagaagccuccuuacauuaaaaagccu

SEQ ID NO: 241127 - RNA, 66 nt, hsa
gauuguaguaauuucuauuugcacugugccuuucaacuccagaaacauucugaagauguacuugga

SEQ ID NO: 241128 - RNA, 66 nt, hsa
accuuaaucuagauaauaaaagcuuuuuggggcaaccuccagaacugugaaaaauaaauuuguuau

SEQ ID NO: 241129 - RNA, 66 nt, hsa
agacgcuaaccgcccuucugcguuccauaaagguggcuccagaaagggcauccucuaccccaagcc

SEQ ID NO: 241130 - RNA, 66 nt, hsa
gagcaucauacuggaaagcaaacaccuuuccuccagcuccagaauuccuugucucugaaugacucu

SEQ ID NO: 241131 - RNA, 66 nt, hsa
ucugccuccucuucaacugaccagccuccaugcugccuccagaauggucuuucuaaugugugaauc

SEQ ID NO: 241132 - RNA, 66 nt, hsa
augaaaccugacaaagagacuguaauauuguaguugcuccagaaugucaagggcagcuuacggaga

SEQ ID NO: 241133 - RNA, 66 nt, hsa
gggaguguggucagucugccugcugcugugcgguagcuccagaaccaccucguuccugguuuuguu

SEQ ID NO: 241134 - RNA, 66 nt, hsa
gaguuuguaagaacaaucauaaaaggacuuguuagucuccagaacaucugcuaaaaugcaaguaua

SEQ ID NO: 241135 - RNA, 66 nt, hsa
aacaugaguuuaugggaaugccuuuucccucuggcacuccagaacaaaccucuauauguugcugaa

SEQ ID NO: 241136 - RNA, 66 nt, hsa
gguaaauaccauauaugauccucgaaaugauaauaucuccagaauauuguuuucacccaaauuuga

SEQ ID NO: 241137 - RNA, 66 nt, hsa
uguaccuauuuuugaggaccuugaaaaucuuaaucucuccagaagggauacugcauugguucuucu

SEQ ID NO: 241138 - RNA, 66 nt, hsa
auauuugccuauauucucccuacaagaauauuuuugcuccagaaagacauguucuuuucucaaauu

SEQ ID NO: 241139 - RNA, 66 nt, hsa
gaccauuugguuacccucgggauggccauccacugucuccagaaagagaccacuuagagggucucu

SEQ ID NO: 241140 - RNA, 66 nt, hsa
guuuuaaaccuucaggaacaccaguuaggaaaauagcuccagaaaauauagauauauuuuauuuuu

SEQ ID NO: 241141 - RNA, 66 nt, hsa
acggauauaaaggaagaauauuuccuuuauguguuucuccagaauggugccuguuucucucugugu

SEQ ID NO: 241142 - RNA, 66 nt, hsa
cacagaagccacaccauuugcaccauccacgccuugcuccagaaggccuggccgccuucucccugg

SEQ ID NO: 241143 - RNA, 66 nt, hsa
ccagucagaucucaggcuugucccccugucagcugccuccagaagggaagguagccagugccugag

SEQ ID NO: 241144 - RNA, 66 nt, hsa
agaccucgccuagcacucugccuugccagagauuggcuccagaauuugugccagacuuacagaaaa

SEQ ID NO: 241145 - RNA, 66 nt, hsa
auauaauugugaaggagucagggcuaacaccuggaucuccagaaaccuagcccagcagguuaaucu

SEQ ID NO: 241146 - RNA, 66 nt, hsa
gccagcuccacucucugguuucuaauaaacagggaucuccagaacacuggugguggacacagcuuu

SEQ ID NO: 241147 - RNA, 66 nt, hsa
agcccaaugagggcgaaugacauuacagcuugaccucuccagaacacuaauauccuaaaauacaga

SEQ ID NO: 241148 - RNA, 57 nt, hsa; identical to SEQ ID NO: 240639

SEQ ID NO: 241149 - RNA, 66 nt, hsa
aucuucacuuucaauuauauccagcaauaaguuguucuccagaaaagaaagcuuggaaacuuaccc

SEQ ID NO: 241150 - RNA, 66 nt, hsa
accuugcuuucaaaaggacugcuuaccauggaagugcuccagaagaaucauuugaaacaucuuuug

SEQ ID NO: 241151 - RNA, 66 nt, hsa
uggguuuuaguauauauagcccaaaaugguaacugucuccagaacagcaaccacauugaauucuug

SEQ ID NO: 241152 - RNA, 66 nt, hsa
uccauagccaucuacaauaguaacugcccacaggcucuccagaaaacuacuacaauggccaaguac

SEQ ID NO: 241153 - RNA, 66 nt, hsa
aaacagagagugaacagcaccucuccauugcuacaucuccagaauauuguucgguuauguucaugu

SEQ ID NO: 241154 - RNA, 66 nt, hsa
ggaggaaauaaagcccuguucuggaucccccauccccuccagaauaagagcauguucugcauguau

SEQ ID NO: 241155 - RNA, 66 nt, hsa
gacauaugcagugguucuuacagaucaguuaauuaacuccagaaagcaaauguuagacuacacauu

SEQ ID NO: 241156 - RNA, 66 nt, hsa
cuguucugaugggggagggcggucuucccacuuccucuccagaacuccagaaagagcagugugcuu

SEQ ID NO: 241157 - RNA, 66 nt, hsa
augggggagggcggucuucccacuuccucuccagaacuccagaaagagcagugugcuuaugcuuca

SEQ ID NO: 241158 - RNA, 66 nt, hsa
cagaaaacuucucuucugagccucuuuaacagcuuucuccagaaccagugucugaaccacccugga

SEQ ID NO: 241159 - RNA, 66 nt, hsa
cauuaguaauaaggagaggguugggggugggcagggcuccagaaagucagcagugugccugggcac

SEQ ID NO: 241160 - RNA, 66 nt, hsa
aauaaauguguauauuuaauguuuuauuguuagcuucuccagaaaauugaugcaaauucugguaau

SEQ ID NO: 241161 - RNA, 66 nt, hsa
gaagcugcucucaggcacccccuucuucauugcucucuccagaaaggguugcuagccuuaacuuca

SEQ ID NO: 241162 - RNA, 66 nt, hsa
ugguuauguuucugccuucggcgagagaacagcaagcuccagaaaguggcugcgccuucagccccg

SEQ ID NO: 241163 - RNA, 66 nt, hsa
gggagcacaguagugcgggccugggcccugcuccaccuccagaaguggcuggauguacccugccug

SEQ ID NO: 241164 - RNA, 66 nt, hsa
cauccugcgacccucacuggccuggccuugugggggcuccagaaaagaggcuaggagaggccagag

SEQ ID NO: 241165 - RNA, 66 nt, hsa
cuucaaggcacagcccuuguugggagggagaacccucuccagaaacccugccaccauggugucuug

SEQ ID NO: 241166 - RNA, 66 nt, hsa
acucugagcugccccuggcuuccuuuaaggaggcugcuccagaaggaaccuggguggggagggcga

SEQ ID NO: 241167 - RNA, 66 nt, hsa
cacucuguaccccaaagagaguucucaugaaauauucuccagaauguauucauuaucaagaaaaug

SEQ ID NO: 241168 - RNA, 66 nt, hsa
gugauucucuugaugccaccuucagauccuuuuauucuccagaauaauucuuaacagugguucaaa

SEQ ID NO: 241169 - RNA, 66 nt, hsa
uucugagcccgucucccggacagguugaggaagcugcuccagaagcgccucggaaggggagcucuc

SEQ ID NO: 241170 - RNA, 66 nt, hsa
ucagaaaauucuggaacuugaaaaaguaguaagggccuccagaauugacuuagcccuaguaauaaa

SEQ ID NO: 241171 - RNA, 66 nt, hsa
uuuuuaaauuuuuuaauuaccuguuguaggguguuccuccagaagcaaagagcaaaauuuuacugu

SEQ ID NO: 241172 - RNA, 66 nt, hsa
ugcaaacuucagucuggacuucuuuuugccagagaacuccagaaaccagucaggcucucagucagc

SEQ ID NO: 241173 - RNA, 66 nt, hsa
gacauagcuucccuucccucccccuucacccacucccuccagaacauuuaguguagaugaaaaugu

SEQ ID NO: 241174 - RNA, 66 nt, hsa
ugcagaaaaacacaaacaaaaacagacucccacugucuccagaagucguggccuuccagaacaguc

SEQ ID NO: 241175 - RNA, 66 nt, hsa
gacccagugucauuugcuccuccuguuccugugccacuccagaaccucagcagaucugagccaccg

SEQ ID NO: 241176 - RNA, 66 nt, hsa
ggcaucugaauguuccagcagccuaacugugcucugcuccagaaacauguguguggcuucccuacc

SEQ ID NO: 241177 - RNA, 66 nt, hsa
cugucacuuuaguuaugcuaaaguggagguuucagccuccagaagacagcagagccuucuaggguc

SEQ ID NO: 241178 - RNA, 66 nt, hsa
caguauuuacaguauugagcuuugcauuuaugauuucuccagaaauuuaccacaaaagcaaaauuu

SEQ ID NO: 241179 - RNA, 66 nt, hsa
cacagcguuggucucuguuuggaaucacugugaggucuccagaaggaccuggccgccagccccuuc

SEQ ID NO: 241180 - RNA, 66 nt, hsa
cucuugucccucacugccccaguaagcuggaggcugcuccagaacucagcaguguuggaggggccu

SEQ ID NO: 241181 - RNA, 66 nt, hsa
uuuauuccuacuggagcuuaguuccaaugcauuuggcuccagaaagaccccagugccuuuugacaa

SEQ ID NO: 241182 - RNA, 66 nt, hsa
guggggacccucuuccucuagcacaguaaagcuggccuccagaaacacggguaucuccgcguggug

SEQ ID NO: 241183 - RNA, 66 nt, hsa
cauuauuucaccaagccaauaccagccgccauccuucuccagaauucuuguaaauaaaauaaaucc

SEQ ID NO: 241184 - RNA, 56 nt, hsa; identical to SEQ ID NO: 240675

SEQ ID NO: 241185 - RNA, 66 nt, hsa
ggcagggcuuugaucauucaaaaguaacuaaaguagcuccagaaugccaaguauucguguaaauua

SEQ ID NO: 241186 - RNA, 66 nt, hsa
auuucaagcugaaaauaauaguucuacugcccgugucuccagaauguagagcccaucaauauuuuu

SEQ ID NO: 241187 - RNA, 66 nt, hsa
aaguaugacaacacauacacacuugccucuccccaucuccagaagaggggagcagaguccgagcuu

SEQ ID NO: 241188 - RNA, 66 nt, hsa
ccagagcacagaccccagagucuugugguucucuaacuccagaaaggacaauguccccuauucagg

SEQ ID NO: 241189 - RNA, 66 nt, hsa
uaauuuauauccaaaauuuguguuuuaaauuucauacuccagaacuuucauguuuaugaguauuag

SEQ ID NO: 241190 - RNA, 66 nt, hsa
auguguuaaugucaauaugaugagauuuuagccuuucuccagaacuaaggcauuaaagaaaauagc

SEQ ID NO: 241191 - RNA, 66 nt, hsa
cgcuguggucaccugaggaugugguucagguggggucuccagaaggcugcuugcccccagagagcc

SEQ ID NO: 241192 - RNA, 66 nt, hsa
caugacccuuaagugccacccuucuuggaagacccccuccagaagcauacuggaagccaccucugg

SEQ ID NO: 241193 - RNA, 66 nt, hsa
aauacaguaagagauaguguugaaccagcaucaagucuccagaaacauggcagagcagacaggccg

SEQ ID NO: 241194 - RNA, 66 nt, hsa
uggaacugacccuuccuucauccucaaccugcuguccuccagaaagcaccaaggaaaaagcagaga

SEQ ID NO: 241195 - RNA, 66 nt, hsa
caaaucagcuuauauuuuuuaucuugaugacuccugcuccagaaucgcuagacuaagaauuaggug

SEQ ID NO: 241196 - RNA, 66 nt, hsa
acuuacacuggaagcuuugauucacccuccacaguacuccagaaaggacuguccuauaaguuguac

SEQ ID NO: 241197 - RNA, 66 nt, hsa
auuccagauuuguuuccuuuuggccuccugcaaagucuccagaagaaaauuugccaaucuuuccua

SEQ ID NO: 241198 - RNA, 66 nt, hsa
cgaagauguuuacuacaaaagcaugccaaaccuaggcuccagaaaccacguccaucagcugcauac

SEQ ID NO: 241199 - RNA, 66 nt, hsa
gauacuagcauugcacauauagucugcuuucuguuccuccagaauuugaguccuguuaauguagua

SEQ ID NO: 241200 - RNA, 66 nt, hsa
uuucauucuucaacagugccuugcauguaacaagcacuccagaaauguuuguugaaugaaugaaug

SEQ ID NO: 241201 - RNA, 66 nt, hsa
cucauggcuggagagcugaucagccaggcacagaaucuccagaacaaccuagagagugaaugcuaa

SEQ ID NO: 241202 - RNA, 66 nt, hsa
caaaucuccuggcaccuugaucuuggauuuuacagccuccagaacugugagaaaauaaauuucugu

SEQ ID NO: 241203 - RNA, 66 nt, hsa
uuuuaaugguacuuaguauuuugaucaaacuuuagucuccagaacuaaacaagucccuaaguuucc

SEQ ID NO: 241204 - RNA, 66 nt, hsa
uuacaggaaguacuggagaaaauggacguguuaugacuccagaauuucccaaagcagugcaugcug

SEQ ID NO: 241205 - RNA, 66 nt, hsa
uuuaauguuaccuuuuggcuugagaaugucuuucagcuccagaauuauuguuacucauauuuuaau

SEQ ID NO: 241206 - RNA, 52 nt, hsa; identical to SEQ ID NO: 240697

SEQ ID NO: 241207 - RNA, 66 nt, hsa
uuguauaguaauuuuguuguuguugggugcugguagcuccagaauuuugugaccacuauugugggu

SEQ ID NO: 241208 - RNA, 66 nt, hsa
ccuccaaccucacagccucguagagcuucacagcuacuccagaaaauaggguuaugugugucauuc

SEQ ID NO: 241209 - RNA, 66 nt, hsa
gcccauccaaagauguccagauguccaugugcuagucuccagaacuuguaacuguguuguuaugug

SEQ ID NO: 241210 - RNA, 66 nt, hsa
auguuauuucuaauaauacacuaucuugauuguacucuccagaaaauuuuucugucagugaaaaua

SEQ ID NO: 241211 - RNA, 66 nt, hsa
gagucaaaagcuucagugaguuacaucucauucaaucuccagaagauugggauuaucgucuucuaa

SEQ ID NO: 241212 - RNA, 66 nt, hsa
gacccagcucauggaauuuuuucaucuuauacugagcuccagaaaggacguaacuuagcauggauc

SEQ ID NO: 241213 - RNA, 66 nt, hsa
ucuuuuauuuuccugucuucuuucuccugugguuugcuccagaauuaagguuuguuuuccauccau

SEQ ID NO: 241214 - RNA, 66 nt, hsa
auucucccuuuugacacaguuguuucagaaagagcucuccagaagccaauauugagauguaauuca

SEQ ID NO: 241215 - RNA, 66 nt, hsa
aguagaagaaaaaaaaucuuucagauaagagguguucuccagaauggaggaacuacuuggcaugua

SEQ ID NO: 241216 - RNA, 66 nt, hsa
cugacuuaacuguaugugcaacagcaaugaaauuaacuccagaagccuuccaccugcgucacccag

SEQ ID NO: 241217 - RNA, 66 nt, hsa
acuucaagcugcucaucuguuaguaagugauguucacuccagaacacauucaugaugagaacuuuc

SEQ ID NO: 241218 - RNA, 66 nt, hsa
aguagaagaaaaaaaaucuuucagauaagagguguucuccagaauggaagaacgacuuggcaugua

SEQ ID NO: 241219 - RNA, 66 nt, hsa
cccucacacugcugugcagccaucaccaccauucaucuccagaauuuguucucagucccaaacuga

SEQ ID NO: 241220 - RNA, 66 nt, hsa
ccuucuauucauaaauguucuauacaguggacagcccuccagaaugguacuucagugccuagugua

SEQ ID NO: 241221 - RNA, 66 nt, hsa
gcaaaauaaggaagagggcugagcugagcuucgguucuccagaauguaagaaaacaaaaucuaaaa

SEQ ID NO: 241222 - RNA, 66 nt, hsa
ugccgaccaccagcaccauccucuccucccagcagccuccagaaccaugcccaggucuccugccuc

SEQ ID NO: 241223 - RNA, 66 nt, hsa
cucugaccucaucaugguucuaguucucauacagaacuccagaauuuuuaaagaacucuauaauug

SEQ ID NO: 241224 - RNA, 66 nt, hsa
auuuuacugaaucugucuacccuucauucaugagaacuccagaaugaguguugaccacugaagcau

SEQ ID NO: 241225 - RNA, 66 nt, hsa
uucccacacuaagguaaguucagacuagauugaacacuccagaauuuuuuacuacagacuguuuuu

SEQ ID NO: 241226 - RNA, 66 nt, hsa
ugcauccccauggagagacagcauugcuccccagcccuccagaaaccuugagcagauccagggauc

SEQ ID NO: 241227 - RNA, 66 nt, hsa
gggcauugccgggguaggguggugucuucaccacagcuccagaaggcacuggugggauguggaguc

SEQ ID NO: 241228 - RNA, 66 nt, hsa
aaggaaagaaucaaauuucuugcccggucacuggcacuccagaagacagcgugccggaaccggcag

SEQ ID NO: 241229 - RNA, 66 nt, hsa
gcaacuuucauagucccaaagauaggcagagaacaucuccagaaaugugugugugugugugugugu

SEQ ID NO: 241230 - RNA, 66 nt, hsa
acagaagagccacagucuccagacucauggcguucccuccagaacuccccauuccccucugagcau

SEQ ID NO: 241231 - RNA, 66 nt, hsa
cucgaaaagccagaggguucaccuagucagacgaaacuccagaacagugcuuguggagggccugac

SEQ ID NO: 241232 - RNA, 66 nt, hsa
cccauaauuuucuucaaugaguuaauaaacagaaaucuccagaaccucugaaacacauucuugaag

SEQ ID NO: 241233 - RNA, 66 nt, hsa
acacuauauuacagaaugauguaauaccugguaauucuccagaagauagacuucagacccuuaaug

SEQ ID NO: 241234 - RNA, 66 nt, hsa
guauuaauuguaaagccaagcuuaucaguugacucucuccagaauaaauaaucaucuguguggcau

SEQ ID NO: 241235 - RNA, 66 nt, hsa
gcacuguugcagcuuccucugcccuggcuggaaagacuccagaauccaguguggugcuguggaagg

SEQ ID NO: 241236 - RNA, 66 nt, hsa
ccccucugugaggagcugugggaaguguggguuugucuccagaacagaagagaaugauggauauuc

SEQ ID NO: 241237 - RNA, 66 nt, hsa
cuagucccugaggguggagggaagcugaggauagagcuccagaaacagcacuagggucccaggaga

SEQ ID NO: 241238 - RNA, 66 nt, hsa
gggaggggggaaagagaccagccuuggucccuaagccuccagaaacgucuucuuaauccccaccuu

SEQ ID NO: 241239 - RNA, 66 nt, hsa
ggggcauauuucugugcuguggaugacauggccuuacuccagaaucccaggcccuccacugugacu

SEQ ID NO: 241240 - RNA, 66 nt, hsa
gaagugcuggcaaccacuaagaauucaaacuggggccuccagaacucacuggggccuacagcuuug

SEQ ID NO: 241241 - RNA, 66 nt, hsa
ccuucagccuuaaauacaaaaauaaaacugaaacugcuccagaaagcagcuuucuccaaaaauguc

SEQ ID NO: 241242 - RNA, 66 nt, hsa
ggugaagcccaaaagcucuuaaggagaauuguauuucuccagaagcugcagcaagagguacagcuc

SEQ ID NO: 241243 - RNA, 66 nt, hsa
agaauuauucaauuucaugaauaacucuuguuugcacuccagaaaacaacauacauguuuaaauac

SEQ ID NO: 241244 - RNA, 66 nt, hsa
aaaaucuuuuagaauuuuuuuggagguguuuguuuucuccagaauaaagguauuacuuuagaauag

SEQ ID NO: 241245 - RNA, 66 nt, hsa
cuaguggcuguguagcauccucagugcaaaacccagcuccagaauuuucaccugguaacgaauuuc

SEQ ID NO: 241246 - RNA, 66 nt, hsa
acuaaaaugcagcuguuguuagacaacuguugaaaacuccagaaauacaucacccaagguggcagu

SEQ ID NO: 241247 - RNA, 66 nt, hsa
aaaacccaggccuugacauuguuauucaaauggccccuccagaaaguuuaaugauuuccauuugua

SEQ ID NO: 241248 - RNA, 66 nt, hsa
agcgugaaaccuuggcacaggacugaggauccucuccuccagaaaagcccccucgaggaaauaaau

SEQ ID NO: 241249 - RNA, 66 nt, hsa
gggaggugucuacugaaaagggaaccugcuucuuuacuccagaacgcuguucuuuaaagaccaaga

SEQ ID NO: 241250 - RNA, 55 nt, hsa; identical to SEQ ID NO: 240741

SEQ ID NO: 241251 - RNA, 66 nt, hsa
ggucaaauacuugacucccacucuugccacuccuagcuccagaagggcucagggccuuccccacag

SEQ ID NO: 241252 - RNA, 66 nt, hsa
gguuuaagaugcuaggaugaggcaggcccaguccuccuccagaaaauaagacaggccacaggaggg

SEQ ID NO: 241253 - RNA, 66 nt, hsa
cucagacucugauuagcugccuccccuucucccugccuccagaauguucugggauaacauuuggag

SEQ ID NO: 241254 - RNA, 66 nt, hsa
aggagagggggagcaaacaggaaauuccacagcugccuccagaaacauuaaccaccccucucuagu

SEQ ID NO: 241255 - RNA, 66 nt, hsa
cccgccagcuccucagccugcucccugggaggcaggcuccagaagcaccccgacggggggccuuau

SEQ ID NO: 241256 - RNA, 66 nt, hsa
ucagugcuacaggaguacaucugcccugccacaugacuccagaagucucugaccccauuuguuuuu

SEQ ID NO: 241257 - RNA, 66 nt, hsa
cucuuggcuaaggugcuguuccuguuccugcaaggucuccagaaccccuuuggaaauggugaagga

SEQ ID NO: 241258 - RNA, 66 nt, hsa
ucugucucaaauaauuauuucacagaggauagcaagcuccagaagguucuauuaccuuuaaaaaag

SEQ ID NO: 241259 - RNA, 66 nt, hsa
uuagagcgagagcagagcaaacugcgcagcaggcaccuccagaaagguaaugguggcagaacccac

SEQ ID NO: 241260 - RNA, 66 nt, hsa
ggcuuuuacuuccgguuucuucauauugaggggcaacuccagaaguggaguuuucugugagaauaa

SEQ ID NO: 241261 - RNA, 66 nt, hsa
uuacuaaagcaaaauuuccagggguagggacugggacuccagaaccauuaauaaaacaaaacaaaa

SEQ ID NO: 241262 - RNA, 66 nt, hsa
agccuucuagcugaaaaacgaguauuccccaauggacuccagaagaaacuugauucaucgcugcaa

SEQ ID NO: 241263 - RNA, 66 nt, hsa
cauccagggcaaggacagacuaaaagagcauaucuucuccagaaguccuagaaacaucucaucauu

SEQ ID NO: 241264 - RNA, 66 nt, hsa
augaaugugggagaaaaucgcugcugcugagauggacuccagaagaagaaacuguuucuccaggcg

SEQ ID NO: 241265 - RNA, 66 nt, hsa
cauaaguggcaaauauuuuaaaauauuugaaaaacacuccagaaucuaguacgcuuuauuuuuaga

SEQ ID NO: 241266 - RNA, 66 nt, hsa
cuuccccguguggcccaccccaggcacggcucauuccuccagaauuauagaagcucagccuggccu

SEQ ID NO: 241267 - RNA, 66 nt, hsa
gcagagccaccauuuuuuauaauuucuaauaaccaacuccagaacuaggagcugaucaacucuuug

SEQ ID NO: 241268 - RNA, 66 nt, hsa
ggagauguuggcaccuuugaauucuacauccuguuucuccagaaugagaauuuguguacaaagaua

SEQ ID NO: 241269 - RNA, 66 nt, hsa
aguauaccuuauaacacugagccacuucuccccacccuccagaagggguccacguugaauucugaa

SEQ ID NO: 241270 - RNA, 66 nt, hsa
aagcauugcauugugggaaucacaaagcaaauaguacuccagaaagacaaauaucagaagcuuccu

SEQ ID NO: 241271 - RNA, 66 nt, hsa
guuuuuagacuguuagacaaaagugcucacgugcagcuccagaauauggaaacagagcaaaagaac

SEQ ID NO: 241272 - RNA, 66 nt, hsa
gccccgccuuccccaaagcagaggggcugucugugucuccagaaaggggacaucgggggggagggg

SEQ ID NO: 241273 - RNA, 66 nt, hsa
ucugaguuugggcugcaagugcucacagcucuuguucuccagaaacuggagaauugcccucaggag

SEQ ID NO: 241274 - RNA, 66 nt, hsa
auauuucuacccaugcaacggaagaaaaacccauuacuccagaagaguauaucuaaguaacuaaaa

SEQ ID NO: 241275 - RNA, 66 nt, hsa
uucccuugaugaagaaguugauaugccuuuucccaacuccagaaagugacaagcucacagaccuuu

SEQ ID NO: 241276 - RNA, 66 nt, hsa
cauuugugucgguuaaaaauucgaaggcuuaugggucuccagaaacucugccagccagccucagug

SEQ ID NO: 241277 - RNA, 66 nt, hsa
gccucccaaauaacuauuuucuuaucugcaguauuccuccagaagagcuaaccagggcagggcugg

SEQ ID NO: 241278 - RNA, 66 nt, hsa
cugcccuuccaacgcaucacccgccucaaacugcugcuccagaacauucugaagagaacacagccu

SEQ ID NO: 241279 - RNA, 66 nt, hsa
uugggcuaagguauaaaucaacacacugcuuccuuccuccagaaggucuuacugugaaggaaaaaa

SEQ ID NO: 241280 - RNA, 66 nt, hsa
acaacuuggcuacacauagacucuagucaguuuugucuccagaaccuuaggcuuuuguauuuuuua

SEQ ID NO: 241281 - RNA, 66 nt, hsa
aguccugcggugauauucuaucugcaguauuuguaccuccagaauggcagaucccucagcaggaac

SEQ ID NO: 241282 - RNA, 66 nt, hsa
uggaauaucaaguauaaugauguaguaaaaagauuucuccagaaaacacuuugagauacuuaaaga

SEQ ID NO: 241283 - RNA, 66 nt, hsa
ggguaguucuguucuguggguuugugcuuccucuuucuccagaagccuucuggcugauuguuccga

SEQ ID NO: 241284 - RNA, 66 nt, hsa
gccucaaaccagcccaacccgagcuuuuggacagcucuccagaagcaugaacugcaguggagauga

SEQ ID NO: 241285 - RNA, 66 nt, hsa
caagauucaucugugaccuccaggcagcagucucugcuccagaaucucuggacggagcugcuggca

SEQ ID NO: 241286 - RNA, 66 nt, hsa
auguuucuuuucuauagagaaauguauaguuugacucuccagaauguacuauccaucuugaugaga

SEQ ID NO: 241287 - RNA, 66 nt, hsa
aaggcccucaccagaacccaacccuuggacuucagccuccagaacugugagaaauacauaccugcu

SEQ ID NO: 241288 - RNA, 66 nt, hsa
cuggaucaggguggggacaaggacuggacccuccuucuccagaaggccuucagcucuugccuugcc

SEQ ID NO: 241289 - RNA, 66 nt, hsa
gucaauauaaauucuacagaaaauaguguucuuuuucuccagaaaaaugcuugugagaaucauuaa

SEQ ID NO: 241290 - RNA, 66 nt, hsa
gaccucuccaaccaccacacuccccgccguacaguucuccagaaucccaggcgaugacaagucuga

SEQ ID NO: 241291 - RNA, 66 nt, hsa
ggcucccaggggccggccuccucugccugguaaugacuccagaacaacaacugggaagaaacuuga

SEQ ID NO: 241292 - RNA, 66 nt, hsa
uagaaggaagcauggcccugacuucagaauuccagacuccagaacuggaagaauaaaugucuguug

SEQ ID NO: 241293 - RNA, 66 nt, hsa
uccugcauugaauugaauaugaauuucucuaacucucuccagaaaauggauggagauaacuugucu

SEQ ID NO: 241294 - RNA, 66 nt, hsa
augugagauucuuuagccacuuuggggagccugucucuccagaagccuuucuuaguggugcccaca

SEQ ID NO: 241295 - RNA, 66 nt, hsa
ccuuaaaaugcacggcuaaacuauucagaguuaacacuccagaauuguuaaauuacaaguacuaug

SEQ ID NO: 241296 - RNA, 66 nt, hsa
cacugagcgccugcagaucccgcaggcuucguuugccuccagaaccuucccgucugauuguuccuc

SEQ ID NO: 241297 - RNA, 66 nt, hsa
uuaaccuuucuaaaaguuuucaucgccuugguaaagcuccagaaauggacaaugcuagugacugca

SEQ ID NO: 241298 - RNA, 66 nt, hsa
aacaucggcuucucagauggcuuccucacuucaugccuccagaaagcauauugcccggugaugaaa

SEQ ID NO: 241299 - RNA, 66 nt, hsa
ccccucugggccaaagcccauggguagcuuggcugccuccagaagagaugcagagagcuguggggc

SEQ ID NO: 241300 - RNA, 66 nt, hsa
gugauagggauccuggugggaggagagagggcacaucuccagaaaaaugaaaagcaauacaacuuu

SEQ ID NO: 241301 - RNA, 66 nt, hsa
acuucauccucgccucucaggcuuuagauacgaaaucuccagaauggaaggggguggggauuuucu

SEQ ID NO: 241302 - RNA, 66 nt, hsa
gagucccaugggauuccccggcugugacacucuacccuccagaaccugacgacugggccaugugac

SEQ ID NO: 241303 - RNA, 66 nt, hsa
uuauuuuucuugaagaggcagcucaaaugucaccuucuccagaagcugcucuccacuugcuuuagg

SEQ ID NO: 241304 - RNA, 66 nt, hsa
agauccagcaggccccagucucgcaucagcgccggccuccagaacuuagcaauuuccgccugguga

SEQ ID NO: 241305 - RNA, 66 nt, hsa
gagaggagaggagggggaggucauuuaucugagucucuccagaaguuuuuaaggcuacauuuugga

SEQ ID NO: 241306 - RNA, 66 nt, hsa
gaagcuuuucuuuggcgauucagugucacaaaauaacuccagaaagaagcacuuagcgugcuguuc

SEQ ID NO: 241307 - RNA, 66 nt, hsa
uucacuuuaaacuuuuauuaccacaguugcugccuccuccagaauuuuugaauuuuaauaaaaggc

SEQ ID NO: 241308 - RNA, 66 nt, hsa
caacauugcgagaguagcuauuuugaaagaauaauucuccagaaguuaacaucuaauaucuaguau

SEQ ID NO: 241309 - RNA, 66 nt, hsa
acaaaaucaccagcaccuugaucuuugacuucuaaucuccagaauagugagaaauaaauuucuguu

SEQ ID NO: 241310 - RNA, 66 nt, hsa
guguucuuugccaccagccugucacuccaguggcagcuccagaaacggaggcuguugcuuuuaucc

SEQ ID NO: 241311 - RNA, 66 nt, hsa
cacuacugcuucugucccugcuggcagccucugucccuccagaacggcuaaccagagcacacuguc

SEQ ID NO: 241312 - RNA, 57 nt, hsa; identical to SEQ ID NO: 240803

SEQ ID NO: 241313 - RNA, 66 nt, hsa
uuuuaauccuugcuuugguuuggaacugccuucgggcuccagaacuuaaauugcuugguccguggc

SEQ ID NO: 241314 - RNA, 66 nt, hsa
ggggugggcugggccgcuggagccuccgccugcuuccuccagaagacacgaaucaugacucacgau

SEQ ID NO: 241315 - RNA, 66 nt, hsa
ucccugcuaagcaguuuauaguucuucuccauguuucuccagaauuaaucaguguuaguccucugu

SEQ ID NO: 241316 - RNA, 66 nt, hsa
gcucagugguguggggaaacguuccccuggaucauacuccagaauucugcucucagcaauugcagu

SEQ ID NO: 241317 - RNA, 63 nt, hsa; identical to SEQ ID NO: 240808

SEQ ID NO: 241318 - RNA, 66 nt, hsa
gacuucuuggaccuccucccccgccccaauuccaagcuccagaaacucccaacucgucugccgucc

SEQ ID NO: 241319 - RNA, 66 nt, hsa
uccccaccgauuucagcguguccacaucacagcucccuccagaagcugcaagagcuucuuagcagu

SEQ ID NO: 241320 - RNA, 66 nt, hsa
acagcaguuuccuugcaacacuuucagcuccccaugcuccagaauacccacccaagaaaauaauag

SEQ ID NO: 241321 - RNA, 66 nt, hsa
ggaugcucuaauuggcugguugguuuggauuuguaacuccagaaacauucuauagugugccagagc

SEQ ID NO: 241322 - RNA, 53 nt, hsa; identical to SEQ ID NO: 240813

SEQ ID NO: 241323 - RNA, 66 nt, hsa
auguaguuguucguugguuauacaaguucuuggucccuccagaaccaccccggcccccugcccguu

SEQ ID NO: 241324 - RNA, 66 nt, hsa
uguagucugucuucaacuauuuuauccaaaauaaaccuccagaagaaaguaguuuucauuuacuua

SEQ ID NO: 241325 - RNA, 66 nt, hsa
uaggagaccuaucgucuuggaacuugccauucuuuccuccagaacaaaauguuaacuuucuaacac

SEQ ID NO: 241326 - RNA, 66 nt, hsa
cgcacagacagguuuucacauaaaugcagcccauuucuccagaacccauuugaggggugggggggu

SEQ ID NO: 241327 - RNA, 63 nt, hsa; identical to SEQ ID NO: 240818

SEQ ID NO: 241328 - RNA, 66 nt, hsa
uuaaggcugcuugguacugaguauacuuaaauauaacuccagaauccagggacuugguguuaaaac

SEQ ID NO: 241329 - RNA, 66 nt, hsa
auuacgccucaacauauacuugugcucuuccuuugccuccagaagaaguuuuuccuugauugugcu

SEQ ID NO: 241330 - RNA, 66 nt, hsa
agacugccuccaccacaggcauccugcaaaugcagacuccagaauccccagcaucagcgggaacca

SEQ ID NO: 241331 - RNA, 66 nt, hsa
caugucugcuggcaccuugaucuuggaccucccagccuccagaacugugagaaauaaauguguuuu

SEQ ID NO: 241332 - RNA, 66 nt, hsa
gucauacaacauacuuaaugcagggcuacacugaaccuccagaaucauuuuguuugcuuugacccu

SEQ ID NO: 241333 - RNA, 66 nt, hsa
cauucuuucacauggcuacugggaauauaaauuucgcuccagaaaggccguagcaguuugacgaua

SEQ ID NO: 241334 - RNA, 66 nt, hsa
gggcucuuaugagucauuuuuuucaaaagaugaaaacuccagaaacgcacaggaacgaaauaccuc

SEQ ID NO: 241335 - RNA, 66 nt, hsa
uguuauugguaaucuuuucugugaauauuagguuuccuccagaaauaguccguuauuugggaaagu

SEQ ID NO: 241336 - RNA, 66 nt, hsa
uggccuggguugucucaaauccuguccacaaggcaacuccagaagaaagaagcccuuuacauuucc

SEQ ID NO: 241337 - RNA, 66 nt, hsa
acaaaguugcaggcacaacaguuuaagaaugcauuccuccagaagaguaucuggucagguugaccc

SEQ ID NO: 241338 - RNA, 52 nt, hsa; identical to SEQ ID NO: 240829

SEQ ID NO: 241339 - RNA, 66 nt, hsa
cauuaugaggcucugauuuccuaucccaguuuagggcuccagaaaagccauucucccaaacuaaug

SEQ ID NO: 241340 - RNA, 66 nt, hsa
ccccuuucacaggcagccagugcccugagccagggucuccagaaagccccacccaggccaggcaug

SEQ ID NO: 241341 - RNA, 66 nt, hsa
auuugcauaugaugccagccucacgcauuuguauaucuccagaaauucagguaugccucaccaauu

SEQ ID NO: 241342 - RNA, 66 nt, hsa
guguucugugguuucuuaggugaccuuagagcaagacuccagaaugaaauuccuaaagcuuuuagg

SEQ ID NO: 241343 - RNA, 66 nt, hsa
cuugucauuggucaauaggggaggguagauuagcugcuccagaauucaauaaaguguaauauuucu

SEQ ID NO: 241344 - RNA, 66 nt, hsa
uuguguuuuucaauuguugacauuucagaggggacccuccagaagcccagccggcuucccccaagg

SEQ ID NO: 241345 - RNA, 66 nt, hsa
gguggaggugguguucuauaccuaaaggaugaccugcuccagaaacagcaccagcacagcauguau

SEQ ID NO: 241346 - RNA, 66 nt, hsa
caauucacacaugacuaccuuugagcuaaugacugucuccagaaaauaacugugccccaagaagug

SEQ ID NO: 241347 - RNA, 66 nt, hsa
uaaauaugccagguagacaccagcccaaguacccuccuccagaagucugugacuaccuugucacua

SEQ ID NO: 241348 - RNA, 66 nt, hsa
acacugaaaauguuuuguuagcuuuuccuucuuucucuccagaagaaacauggauagaugauagcu

SEQ ID NO: 241349 - RNA, 66 nt, hsa
ugccugcucuaauuucuuuugcccauauaugaguaucuccagaaugucuacaaauaguuuuuguag

SEQ ID NO: 241350 - RNA, 66 nt, hsa
gagguuugaggccaccaaaagaucaacagacaaaugcuccagaaaucuaugcugacugugacacaa

SEQ ID NO: 241351 - RNA, 66 nt, hsa
aggccaucucgggcacaggcccaccccgccccaccccuccagaacacggcucacgcuuaccucaac

SEQ ID NO: 241352 - RNA, 66 nt, hsa
uuccuauaaaguuaaacauacacuuuuacuuuaggacuccagaauuccacuucuaguuauuuauuc

SEQ ID NO: 241353 - RNA, 66 nt, hsa
augaccagaauucuucuguaauucugcccaugacuccuccagaauuuuaguagauacagggugggu

SEQ ID NO: 241354 - RNA, 66 nt, hsa
uuuguuuuauccaugaggaagauuuuuaacaaaagccuccagaagauuuccccucaguuuccauug

SEQ ID NO: 241355 - RNA, 66 nt, hsa
aaaaagauauggugaaggcagaacugcucacaccagcuccagaagcacguccucugacuucacugc

SEQ ID NO: 241356 - RNA, 66 nt, hsa
cuggagcagcccgccuagaacccagucuaaugagaacuccagaaagcuggagcagcccaccuagag

SEQ ID NO: 241357 - RNA, 66 nt, hsa
ucagcucuccucugggcccugccuucagccuccucacuccagaaacguguguuucccugaugcggg

SEQ ID NO: 241358 - RNA, 66 nt, hsa
ggacuaagucacagggaucugcugcagccacagcuccuccagaaagggacagccacggccaagugg

SEQ ID NO: 241359 - RNA, 66 nt, hsa
ccaaaaggcagaugacggggaguuaggcauggggagcuccagaaggucaccagagagcuuucagcu

SEQ ID NO: 241360 - RNA, 66 nt, hsa
uuuuuugggggcggggggguggggaauucagccacacuccagaaagccaggagucgacaguuuugg

SEQ ID NO: 241361 - RNA, 66 nt, hsa
gaggacucccugacaaaagugaagaauuaacuucuccuccagaacaagugcaauucagaaggcagc

SEQ ID NO: 241362 - RNA, 66 nt, hsa
acccuucccaccugagcaugcugacccccuuccuaccuccagaauaaagaaucucaaccuggaggg

SEQ ID NO: 241363 - RNA, 66 nt, hsa
gaaagccagcagcugugguacuccagacaaaaggaucuccagaaagccgccuguccuuccagcaug

SEQ ID NO: 241364 - RNA, 66 nt, hsa
aauccaagcucccugccccaaauaacuucaguccugcuccagaauuuggaaauccuaguuuccucu

SEQ ID NO: 241365 - RNA, 66 nt, hsa
cuacagaguuccuucucacccagacacacuagugcucuccagaaucucugcccaggaggcagggga

SEQ ID NO: 241366 - RNA, 66 nt, hsa
gccagucacugcugcaagguggccucugccuggggccuccagaagcugcuccuuuacccucuuggu

SEQ ID NO: 241367 - RNA, 66 nt, hsa
ccugccggaagggagcccccugcuccucccaacaaacuccagaacagcagaaagcgggugcuguag

SEQ ID NO: 241368 - RNA, 66 nt, hsa
uggaagaccaagacaccuggggauugcgucuggggccuccagaacucugcuguggacugcaucagg

SEQ ID NO: 241369 - RNA, 66 nt, hsa
guguggccuggaguauuuauauggugcuuaaugaaucuccagaaugccagccagaagccugauugg

SEQ ID NO: 241370 - RNA, 66 nt, hsa
auuuucagaauaauuauugcauaguagaauuuauuacuccagaacagaaagaccuuacuucauuuc

SEQ ID NO: 241371 - RNA, 66 nt, hsa
cucuccucuucaucucagcauucuccaucacuuccccuccagaaaaacggauggaaggaagcccuc

SEQ ID NO: 241372 - RNA, 66 nt, hsa
uccccaaggagcuucagggcaguccuucuggcacugcuccagaauuccuccuucuuggugugucug

SEQ ID NO: 241373 - RNA, 66 nt, hsa
acccuagauacuguguuaugugcaacuguagaaacccuccagaaauuuccacugcuguucuucacu

SEQ ID NO: 241374 - RNA, 50 nt, hsa; identical to SEQ ID NO: 240865

SEQ ID NO: 241375 - RNA, 66 nt, hsa
cccaccacacagacucugggccuccccgcaaaauggcuccagaauuagaguaauuaugagauggug

SEQ ID NO: 241376 - RNA, 66 nt, hsa
aucaaauggcaacauggaauauuguccuccaugccccuccagaaggaccuaggagaguaggugagc

SEQ ID NO: 241377 - RNA, 66 nt, hsa
aacaaggcgucgaggaauuggaaagauuugcacacccuccagaaaggagagacgcaaucuccccuc

SEQ ID NO: 241378 - RNA, 66 nt, hsa
uauaaugcuuauuaugaguuuaagaagcaguucuuccuccagaaagaagggggcgauagcaugcag

SEQ ID NO: 241379 - RNA, 66 nt, hsa
gagccgcagcccuggggccaguaggaagcggacccgcuccagaaguccccacgagaagaagaagaa

SEQ ID NO: 241380 - RNA, 66 nt, hsa
agggacuguguugacugacgagccgagggguggccgcuccagaagggugcccagucaggccgcacc

SEQ ID NO: 241381 - RNA, 66 nt, hsa
acccaucauucauucucaagaccucugaaggguuggcuccagaacuuagaccuuugcuuaugcaaa

SEQ ID NO: 241382 - RNA, 66 nt, hsa
aucagcagauacaugucagugcagagguucucugcccuccagaagcccucgucugggaauucgaga

SEQ ID NO: 241383 - RNA, 66 nt, hsa
caccccaaucccaaauuuuguuuugguucuaacuaccuccagaauguguucaauaaaaugcuuuua

SEQ ID NO: 241384 - RNA, 66 nt, hsa
ccaccaccaccgacucucccaacccagacucucccacuccagaauguagaagccugucucuguacc

SEQ ID NO: 241385 - RNA, 66 nt, hsa
cccauggacagagaagaaaaugaccaggagugucaucuccagaauuauuggggucacauauguccc

SEQ ID NO: 241386 - RNA, 66 nt, hsa
cagucuucccaacuucuuacaccauugcuuuccauucuccagaacucuuuuuuccuuuuuacaaac

SEQ ID NO: 241387 - RNA, 66 nt, hsa
agcaaaaggggcugggacacucugaacuccugcacucuccagaagugacuggucaugaagcucaug

SEQ ID NO: 241388 - RNA, 66 nt, hsa
uuuacucucuauuauugggcauaaagguggcuucugcuccagaacucuauccacuguauuuccaca

SEQ ID NO: 241389 - RNA, 66 nt, hsa
agcacgugucucagacugcauguaccauuugcauggcuccagaaaugucuaaaugcugaaaaaaca

SEQ ID NO: 241390 - RNA, 66 nt, hsa
ucucugggagacuucucuguacauuucugccauguacuccagaacucauccugucaaucacucugu

SEQ ID NO: 241391 - RNA, 66 nt, hsa
ucaagugccuucugugaguuuaaaugugcuggugcccuccagaaaagccucggccucagcuccguu

SEQ ID NO: 241392 - RNA, 66 nt, hsa
caagggauguaucagggaugaucagcugaugagaggcuccagaaggauuucuagaucgcuucaagc

SEQ ID NO: 241393 - RNA, 66 nt, hsa
auguuuaagcuagcuuuaccuaagccacuucucagccuccagaauacucucucugggguugugagu

SEQ ID NO: 241394 - RNA, 66 nt, hsa
ugcuacaggggcacauuuucugugguuaaaaaugaucuccagaauaaguguaaacugcaguuuucc

SEQ ID NO: 241395 - RNA, 66 nt, hsa
uaaaauguagcugcgucauaaggagacuucugucuucuccagaaggcaauaccaaccugaaaguuc

SEQ ID NO: 241396 - RNA, 66 nt, hsa
agaaagcugauagcuccuccauguugguaaaauccucuccagaaucuuggaacaccuggcauguga

SEQ ID NO: 241397 - RNA, 66 nt, hsa
uguagcagugguuacccagacuuacagaauuauguccuccagaaaccagcaagaacacuuggaaug

SEQ ID NO: 241398 - RNA, 66 nt, hsa
aagugugaucauuguugaacuucagcuccagugucucuccagaauaagacauuggcauucaaaugu

SEQ ID NO: 241399 - RNA, 66 nt, hsa
gaauggagccugucucaggaaggccagcugcagguccuccagaaaaucaaagaagggaagaaacuc

SEQ ID NO: 241400 - RNA, 66 nt, hsa
ucaauaguuauccccaggccuggcacgucaaagaggcuccagaaauguuugcugagugagugauga

SEQ ID NO: 241401 - RNA, 66 nt, hsa
aaguagcaaacuguacauuccuucuuccucccccugcuccagaaggugccgguacugaagaugcuc

SEQ ID NO: 241402 - RNA, 66 nt, hsa
cagauacucucuuugccagaugaaguuacuugcuaacuccagaaauuccugcagacauccuacucg

SEQ ID NO: 241403 - RNA, 66 nt, hsa
ucugcccuggcucugcacauaaguguuagccagcagcuccagaaaaaucccgauucccgggaucug

SEQ ID NO: 241404 - RNA, 66 nt, hsa
uuugagaaauagagaaauauaaaaguguguucuuaacuccagaaccacucuuuuugcauaaauacc

SEQ ID NO: 241405 - RNA, 66 nt, hsa
ccaguuuacugaacuccagaccaugcauguaguccacuccagaaaucaugcucgcuucccuuggca

SEQ ID NO: 241406 - RNA, 64 nt, hsa
uaucccaguaaaagauaugauauuuuccauagauaccuccagaauuuuuuucagcaaauggaau

SEQ ID NO: 241407 - RNA, 66 nt, hsa
aagaggaacgguguuauggacugaauguucauguuccuccagaauucauaugcugaagccucuguc

SEQ ID NO: 241408 - RNA, 66 nt, hsa
ugcgucugcuggcaccuugaucuugaacuucccagccuccagaacugugagaaagaaaucucuaug

SEQ ID NO: 241409 - RNA, 66 nt, hsa
ccagugggaccuuguaaaaugcucccugucagagcucuccagaauaugcuuguuggagauccuuca

SEQ ID NO: 241410 - RNA, 66 nt, hsa
cuaacggugagggcugacucugaacugucucucagucuccagaaaguguucaagccuguuguguuc

SEQ ID NO: 241411 - RNA, 66 nt, hsa
ugaaaaggaauuagagggucagaaacacccagguuccuccagaaagcuccuuggagcccaacaacu

SEQ ID NO: 241412 - RNA, 66 nt, hsa
uguagaaagaugugagauaacuuacucaagauuccccuccagaaaaauacguauguuuaaaaaccc

SEQ ID NO: 241413 - RNA, 66 nt, hsa
uauguuuuaugauauggguuagggauucuccauggacuccagaaacccuaaaauacaauuuugagg

SEQ ID NO: 241414 - RNA, 66 nt, hsa
ugcugcugcauuuaucccaagaaaaacagcuuuaaucuccagaagaaaaccaaaauaccaugggau

SEQ ID NO: 241415 - RNA, 66 nt, hsa
aaugagugacaaaucuuuaaaguauuuacaauaucacuccagaaaagaaaacaaaucaaauaaaua

SEQ ID NO: 241416 - RNA, 66 nt, hsa
uccaagcuucgaaagauaucccaaaaauuucagugacuccagaagaaaugagccuccaccaccaag

SEQ ID NO: 241417 - RNA, 66 nt, hsa
cuugaccuaaucagcuuacaguuugaaaaccuagcucuccagaacaugagaugagccagccgagcc

SEQ ID NO: 241418 - RNA, 66 nt, hsa
cccuccucuacccaaagcucugucccccugcucccacuccagaagaacugcggcacgcgcuucggg

SEQ ID NO: 241419 - RNA, 66 nt, hsa
acuugaccucaucucccgagcaauggcgccugcucccuccagaauggaacucaagcugguuuuaag

SEQ ID NO: 241420 - RNA, 66 nt, hsa
cuggcccucuuucucccagugauuacaucuaaggaccuccagaagcaugggaacaucugggugugc

SEQ ID NO: 241421 - RNA, 66 nt, hsa
ccuccgcaccccgccccaugccccaguccuuuccuacuccagaaaugcuccccacccccccaaaga

SEQ ID NO: 241422 - RNA, 66 nt, hsa
ggaaccuuccaaggugucugguugcccugccucuggcuccagaacagaaagggagccucacgcugg

SEQ ID NO: 241423 - RNA, 66 nt, hsa
ucccaccaacuccuauuucccuaccaaccaaggagccuccagaaggaaaggaggaagaaauguuuu

SEQ ID NO: 241424 - RNA, 66 nt, hsa
ggaccucaaccccagggauucccaggaagcagaacucuccagaagaaggguuuugaucauuccagc

SEQ ID NO: 241425 - RNA, 66 nt, hsa
acugcccugccucaacaggguccauugccuccucgccuccagaacuuggagcagggaagugggcac

SEQ ID NO: 241426 - RNA, 66 nt, hsa
ccuggaaagauauagcauagugguucucagcacagucuccagaacagaagcaucuguaguaccugg

SEQ ID NO: 241427 - RNA, 66 nt, hsa
cggagacauugaccccucccuccaugugguaaaccacuccagaauggccaccaggcuucccagagu

SEQ ID NO: 241428 - RNA, 66 nt, hsa
aacuuguguuacaucuauaaagagcaaaauaacacacuccagaacuuggcaguuguagcauuaguu

SEQ ID NO: 241429 - RNA, 66 nt, hsa
uggagcucauguuugugauccucuaucuggacagcucuccagaauccuguguugccccuguucugc

SEQ ID NO: 241430 - RNA, 66 nt, hsa
ugagaaugugccaugcaugaagcaaaggauuccaggcuccagaaaaaaugaaugaacucaccuuga

SEQ ID NO: 241431 - RNA, 66 nt, hsa
agaagcugggcaggacaaguaggacaucccuggagccuccagaagggacuggccucugcccacacc

SEQ ID NO: 241432 - RNA, 66 nt, hsa
gcagagggagugugcgaaucaagccugaccaagaggcuccagaauaaaguaugauuuguguucaau

SEQ ID NO: 241433 - RNA, 66 nt, hsa
ggggaagaagacacagaagccuuugauauugccacccuccagaauccugaugguaucaauggauuu

SEQ ID NO: 241434 - RNA, 64 nt, hsa; identical to SEQ ID NO: 240925

SEQ ID NO: 241435 - RNA, 66 nt, hsa
aggaccuggcagcuuuucuugccgucccuccccugccuccagaaucacagcccuucuccccaaggg

SEQ ID NO: 241436 - RNA, 66 nt, hsa
uaagugccggugacaagcugucugucaggggagaggcuccagaaccuggguucguccccagugaga

SEQ ID NO: 241437 - RNA, 66 nt, hsa
cgcacacggcgucaaaaccaagcugccggccacugucuccagaacgcaaggcuccaggcccgugug

SEQ ID NO: 241438 - RNA, 66 nt, hsa
uguucugcugagacugagcaccuuacagauauuuuucuccagaagauggugcuggguaauaaaauc

SEQ ID NO: 241439 - RNA, 66 nt, hsa
cccauccccuuuccuccccaccuuccccagacucagcuccagaauaccuucuucgcugcuagagaa

SEQ ID NO: 241440 - RNA, 66 nt, hsa
ccuauuauucgcuccaagaaagaugcuaagucugagcuccagaagagacugugcuggguguggcuu

SEQ ID NO: 241441 - RNA, 66 nt, hsa
gcgaggugccgccuuggccgggcccccacgugucuucuccagaaugugucugucuuugccuggugu

SEQ ID NO: 241442 - RNA, 66 nt, hsa
ucagcgacacacacacacuuauggcaccagccuggacuccagaaaaaggguguccagguauugugu

SEQ ID NO: 241443 - RNA, 66 nt, hsa
cagagcuggagcucgaucaugccugcgugacaaagccuccagaaaaauccuugaaagacaggacau

SEQ ID NO: 241444 - RNA, 66 nt, hsa
acuugcggccacagcacuagagucacccccccaggccuccagaaccuuacuggcacuguggcacug

SEQ ID NO: 241445 - RNA, 66 nt, hsa
aaaugaucuguacuaucuagugucuaaaacacuauucuccagaaaaaucaaucauuuucuagcccu

SEQ ID NO: 241446 - RNA, 66 nt, hsa
uggacaaugaauguaguuaacugguuccugcucacacuccagaauuaaauucuauugaaaaaggaa

SEQ ID NO: 241447 - RNA, 66 nt, hsa
cuuugcagaucacagugcuggaagcaggaacccaggcuccagaagguguugccaggggcccagaug

SEQ ID NO: 241448 - RNA, 66 nt, hsa
gucaaagaugaacaucggaauaacaaacauuguccucuccagaaaguccuuucuuucuccauacug

SEQ ID NO: 241449 - RNA, 66 nt, hsa
agucucaggauuuagaaagucuguaagccauccaugcuccagaaagcaccgaucuguuguaguugc

SEQ ID NO: 241450 - RNA, 66 nt, hsa
gagcguggaggcgugugcaggcuuggaagaagaacucuccagaacauggaacuuaacccucuuuug

SEQ ID NO: 241451 - RNA, 66 nt, hsa
aaacugaggccagagggaggagagaauugcucauggcuccagaacugguggcaaguuucucuggac

SEQ ID NO: 241452 - RNA, 66 nt, hsa
gcuucuggauacagccuuuuggguaaacacugggaacuccagaaguuguggggagaguggggaauc

SEQ ID NO: 241453 - RNA, 66 nt, hsa
gcucccccuucaccccuccuugcccgccuacccucccuccagaauagccccucacccuucuucccc

SEQ ID NO: 241454 - RNA, 66 nt, hsa
ggaggguaacuggggggccaccaugaccccuucucucuccagaaacagcugcuucuccccccaucc

SEQ ID NO: 241455 - RNA, 66 nt, hsa
gugccuucuucauccuuccuuacgaucaaucacagucuccagaagaucagcucaauugcugugcag

SEQ ID NO: 241456 - RNA, 66 nt, hsa
gcagcaagggggaccgaugcugugcagcucacaccacuccagaaccugacaaggcaccagcaggac

SEQ ID NO: 241457 - RNA, 66 nt, hsa
ucccuccuggucgugccccgucucuuuugguccuggcuccagaaaacccgcgccccacauaccugc

SEQ ID NO: 241458 - RNA, 66 nt, hsa
aaguguggacacuuuugacagcuuggcagauuuuaacuccagaagcacuuuaugaaaugguacacu

SEQ ID NO: 241459 - RNA, 66 nt, hsa
ggcuuguuccaaguuugucaaugagguuuauggagccuccagaacagaugccaucuuccugaaugu

SEQ ID NO: 241460 - RNA, 66 nt, hsa
gcauguuccugccccacaggaauagaauggagggagcuccagaaacuuuccaucccaaaggcaguc

SEQ ID NO: 241461 - RNA, 66 nt, hsa
ccugcaaaccucacaggguccccacacaacagugcccuccagaagcagccccucggaggcagagga

SEQ ID NO: 241462 - RNA, 66 nt, hsa
agaacucaugguuuuaaauauagaccaucaucgaaacuccagaaauuuauccacuguggaugauga

SEQ ID NO: 241463 - RNA, 66 nt, hsa
uaucccacacccacccccaccccacccccacccagccuccagaagcuggaaccauuucucccgcag

SEQ ID NO: 241464 - RNA, 66 nt, hsa
ggaaaagcagcucuccccucagagugcaagccccugcuccagaagauagcuucaccccaaucccag

SEQ ID NO: 241465 - RNA, 66 nt, hsa
ggggagauggggaggagauauggagugagucaccugcuccagaagaugccagcuucucucuccagg

SEQ ID NO: 241466 - RNA, 66 nt, hsa
gauucugcccuucacuuagcaccugccucagccccacuccagaauagccaagagaacccaaaccaa

SEQ ID NO: 241467 - RNA, 66 nt, hsa
acuugagcccauugaaacugaucuugagcuccuggccuccagaauugcaggagaauaaauuugugu

SEQ ID NO: 241468 - RNA, 66 nt, hsa
gggaggugucuacugaaaagggaaccugcuucuuuacuccagaacucuguucuuuaaagaccaaga

SEQ ID NO: 241469 - RNA, 66 nt, hsa
uaggaaggaaaaugaagagagccaguauuuccccuucuccagaagcagguacucagcuuucuggga

SEQ ID NO: 241470 - RNA, 66 nt, hsa
cggaaucccccgcugcagggacacccacgcccuucucuccagaagccgggcaggcagaauccggcc

SEQ ID NO: 241471 - RNA, 66 nt, hsa
gucgagggagaggaggggguuggggaggacccaccucuccagaauggcgacuguccccauccgccu

SEQ ID NO: 241472 - RNA, 66 nt, hsa
aggcaucuaaguuagagcuggcaccagaacugagaccuccagaaaucuauuccaguauuuuuucca

SEQ ID NO: 241473 - RNA, 66 nt, hsa
uuucuguccugcuuugccuuuugucacuagaauguucuccagaaaccccaguuucugucaucuuaa

SEQ ID NO: 241474 - RNA, 66 nt, hsa
uucauucucagaaaauccaaccauaucuuagaguaucuccagaaacuggcuuagaggagcuccaaa

SEQ ID NO: 241475 - RNA, 57 nt, hsa; identical to SEQ ID NO: 240966

SEQ ID NO: 241476 - RNA, 66 nt, hsa
cuggugauacuccaacaccguccaguuguggcagcucuccagaaguaauagcagcugacaacuuuc

SEQ ID NO: 241477 - RNA, 66 nt, hsa
ucagcaagggcucagcugggaucugcgcccggccugcuccagaacgcagcccacucgccaccggug

SEQ ID NO: 241478 - RNA, 66 nt, hsa
aggggguuugcuggggaacuggcgccaucgccgggacuccagaaccgcagaagccuccccagcuca

SEQ ID NO: 241479 - RNA, 66 nt, hsa
cugcccugcccucuccucacaggucuguugcagggacuccagaaaccauucugggagccguggaug

SEQ ID NO: 241480 - RNA, 66 nt, hsa
ucugguucaugaugcauaaagcgcuaggcccuagaacuccagaaacagcacagcuggggcggggac

SEQ ID NO: 241481 - RNA, 66 nt, hsa
gggccacagccacaccucaccgcccaguccagcugucuccagaaggggacaggcaguccgcggucu

SEQ ID NO: 241482 - RNA, 66 nt, hsa
acuuuggccaccaguucuucggccagcaccucugcccuccagaaccugcagccuggaggggugagg

SEQ ID NO: 241483 - RNA, 66 nt, hsa
ccccagcccggagcccagcccccugccccggcccugcuccagaacccagcccagaucggaggacaa

SEQ ID NO: 241484 - RNA, 66 nt, hsa
cucuagaacccaauccaauuuggagccccagcccaacuccagaacccaacccuucucuagaaucca

SEQ ID NO: 241485 - RNA, 66 nt, hsa
ccccggcugggucugcguccuuuccugugccuuucccuccagaaugcggccucagaccuagaagcu

SEQ ID NO: 241486 - RNA, 64 nt, hsa; identical to SEQ ID NO: 240977

SEQ ID NO: 241487 - RNA, 66 nt, hsa
uuaauuuucucggaggugauaggcuuccacacaggucuccagaagcccugcauugaauauccaucc

SEQ ID NO: 241488 - RNA, 66 nt, hsa
uacuguuccagcaucuucccuggauggcuggaggaacuccagaaaauauccaucuucuuuuugugg

SEQ ID NO: 241489 - RNA, 66 nt, hsa
aagccagcuccacugcccaggcccccaagagggcagcuccagaagcugcccagggcuccgggaccc

SEQ ID NO: 241490 - RNA, 66 nt, hsa
ccucccuuaggggcugaggaagcugcccucgaaacccuccagaagacaucuguccugcagaggccc

SEQ ID NO: 241491 - RNA, 66 nt, hsa
auauccuuauccaaaucaauaaagagagaauccucccuccagaaggguuucuaaaaacagcccuca

SEQ ID NO: 241492 - RNA, 66 nt, hsa
gagucuaggacagauuuuacguggagaguugaacuacuccagaaacuaaagaguaauguuucuaga

SEQ ID NO: 241493 - RNA, 66 nt, hsa
gcugugagaccuccuggaacacuggcaucucugagccuccagaagggguucugggccuaguugucc

SEQ ID NO: 241494 - RNA, 66 nt, hsa
aggccccgccuggcacucagccuugccagagauuggcuccagaauuuuugccaggcuuacagaaca

SEQ ID NO: 241495 - RNA, 66 nt, hsa
ggagagagggucucucuccuagcugcuacccaggaccuccagaaggagcccuuggaccucugggag

SEQ ID NO: 241496 - RNA, 66 nt, hsa
ucauacuaagugcuuaguaaauguuagauaaguauucuccagaauugauguaaauuauuuuuaaac

SEQ ID NO: 241497 - RNA, 66 nt, hsa
aauguuauauaaauuccacauuuuuaugcaacuaaucuccagaacauuuuuccucuuaccaagaag

SEQ ID NO: 241498 - RNA, 66 nt, hsa
gcuggaguggcacaggugacccaggcguccuuucagcuccagaauguugcaagucuaggagagugu

SEQ ID NO: 241499 - RNA, 66 nt, hsa
acacgcugggcuucacggcugccaggagccucuccccuccagaagacuugccugcuagggaccucg

SEQ ID NO: 241500 - RNA, 66 nt, hsa
ccuagagugaggcucuguccaauacauggcucugcccuccagaacuucaggcucucagugacccuu

SEQ ID NO: 241501 - RNA, 66 nt, hsa
ccaacccugucuccaccuugauauugcacuuccaggcuccagaacugugaggcaauaaauuucucu

SEQ ID NO: 241502 - RNA, 66 nt, hsa
acuauggucacagggccguccuguuccuccccgggacuccagaauuucucuccucaaaggaaagaa

SEQ ID NO: 241503 - RNA, 66 nt, hsa
ggaucucgggcugccagcgaugggcaggcgagaccccuccagaaucugcaggcgccucugguucuc

SEQ ID NO: 241504 - RNA, 66 nt, hsa
auagcggacgggggucccgagguggaaaccauugcccuccagaacaaccgugagaaccaggcauuc

SEQ ID NO: 241505 - RNA, 66 nt, hsa
uuaaacuucuaggcucaagcaucuaccugccucagccuccagaagugcugggauuacaaaugugag

SEQ ID NO: 241506 - RNA, 66 nt, hsa
uuuagucaaacucucauuuaggugacagccuggugacuccagaauggagccagucaugcuaaaugc

SEQ ID NO: 241507 - RNA, 66 nt, hsa
agggccgggugucuuuagggaucaguuuuuccaagacuccagaaggugccagguucuccccuugag

SEQ ID NO: 241508 - RNA, 66 nt, hsa
ugaagguaacugagagcagaugguccuccauuucaacuccagaaguggggcucugggagggauguu

SEQ ID NO: 241509 - RNA, 66 nt, hsa
gcacuccagaauccacaaagccgugccuuucucuggcuccagaauaugcauaaucagcgcccugga

SEQ ID NO: 241510 - RNA, 66 nt, hsa
uccacccccuccagcuccaguuuccaaguuccugcacuccagaauccacaaagccgugccuuucuc

SEQ ID NO: 241511 - RNA, 66 nt, hsa
agcacaggaaaccaggcagaggaggcacagggugcucuccagaacgagaagccagcuccuggaguu

SEQ ID NO: 241512 - RNA, 66 nt, hsa
ugggagaauuagagaauuuauuugugucagaaaauacuccagaacaaccaccccauauuaugauua

SEQ ID NO: 241513 - RNA, 66 nt, hsa
cccagaucucauacucaacagaaggagacucagagacuccagaaggcacaggagcugcccccagug

SEQ ID NO: 241514 - RNA, 66 nt, hsa
uuuccucaacacuugagggcccagaaagucugaucucuccagaaugaucagcccagaggaaugcug

SEQ ID NO: 241515 - RNA, 65 nt, hsa
guuguaaauuaggaggcucaacaauaaaacauuaugcuccagaaauuaugugagaugugcuauau

SEQ ID NO: 241516 - RNA, 66 nt, hsa
caaaucuguaagcaccuugaucuuggacuucucagccuccagaauugugagaaauaaauuucuguu

SEQ ID NO: 241517 - RNA, 66 nt, hsa
ucggagacaagcauggugcugcugcuucugcugcuucuccagaaaaucccugggacaccuuuguuc

SEQ ID NO: 241518 - RNA, 66 nt, hsa
gcucuuugcaggcguccaauccuagaaaccaauggucuccagaacucucacacaaguguuuuucug

SEQ ID NO: 241519 - RNA, 66 nt, hsa
cacugacuggcauccugcuuuccagugccugccagccuccagaagagccaggugccugacuaguac

SEQ ID NO: 241520 - RNA, 66 nt, hsa
ugcguuguuaguuuugaagaguggaggagcuaggggcuccagaaagaaucuuacacauguguugaa

SEQ ID NO: 241521 - RNA, 66 nt, hsa
caucuuaucccuugaauuuucaauauuguggaaucacuccagaagauccuuucaugugaaguuuuu

SEQ ID NO: 241522 - RNA, 66 nt, hsa
cuggcccaacauacgcacugggcauuggguaagggacuccagaagcagcagcuagaaagagaaaaa

SEQ ID NO: 241523 - RNA, 66 nt, hsa
accuucuggccccaacccuugacucaacggggacaacuccagaaggucauuccagauccagagauc

SEQ ID NO: 241524 - RNA, 66 nt, hsa
gcuccugugugccccuggcuuucugggucugugccucuccagaaucuugucuuacccuccggugug

SEQ ID NO: 241525 - RNA, 66 nt, hsa
uuugguggggggaccccaaagccauucugggaagggcuccagaagaagguccagccuaggcccccu

SEQ ID NO: 241526 - RNA, 66 nt, hsa
agcacaagucuugcuaaaugugauacuguugacauccuccagaauggccagaagugcaauuaaccu

SEQ ID NO: 241527 - RNA, 66 nt, hsa
ugcaccuacugauguuuugauguugaacuucccagccuccagaacucugggaaaauaaaguccucu

SEQ ID NO: 241528 - RNA, 66 nt, hsa
ggacuggcuagaguccucacucccaguccaaauguccuccagaagccucuggcuagaggccagccc

SEQ ID NO: 241529 - RNA, 66 nt, hsa
guuuggaaacauuuaauuuauaccccucuccucugucuccagaagcuucuagcucuggggucuggc

SEQ ID NO: 241530 - RNA, 66 nt, hsa
ccaucuccuggauucaaacaauucuccugccucagccuccagaauagcugggauuacaggcguaca

SEQ ID NO: 241531 - RNA, 66 nt, hsa
aggauaccaugggaaggagccaucuccacucuccuucuccagaacccccuugaagggccuuuggga

SEQ ID NO: 241532 - RNA, 66 nt, hsa
agcaaguguucaguaaauauuugcugcuugaaucugcuccagaauuaacaagaaagccaucucuuc

SEQ ID NO: 241533 - RNA, 66 nt, hsa
cccaucuccuaccccacauccugucuuagccgcagucuccagaacccaugaugaacugugaucugc

SEQ ID NO: 241534 - RNA, 63 nt, hsa; identical to SEQ ID NO: 241025

SEQ ID NO: 241535 - RNA, 66 nt, hsa
auuucuauaacagaagugacauguguacugauuuuucuccagaaauauggaugcuguuguauucag

SEQ ID NO: 241536 - RNA, 66 nt, hsa
auuccuaggccuuuucaugcuucauuucuuccacuucuccagaaaauggaagcuaugaagcaacau

SEQ ID NO: 241537 - RNA, 66 nt, hsa
cucuuccuccacacaggucgccgugagucaagcugccuccagaaccucagagcuucccuggugggc

SEQ ID NO: 241538 - RNA, 66 nt, hsa
ggcugaccgggcuguucuguagacucaggaccguggcuccagaacuccugugccaggcgggaggga

SEQ ID NO: 241539 - RNA, 66 nt, hsa
ggguccggccggagaggccucccgcggacgccgucucuccagaacuccgcuuccaagagggagccu

SEQ ID NO: 241540 - RNA, 66 nt, hsa
cugcuauccugggagaucuaccugaaggagaacuaccuccagaaccgacaguuccagcaaaagcag

SEQ ID NO: 241541 - RNA, 66 nt, hsa
aggcgcaucccacucuaugcgaaccacaagacccuccuccagaaggcagccgcugaguucggggcu

SEQ ID NO: 241542 - RNA, 66 nt, hsa
ggggggugcagggggcugugggcauccagcgucauccuccagaaccucacaucugaacugggggca

SEQ ID NO: 241543 - RNA, 66 nt, hsa
acuagauugcuuugugaagcucuugguagagacacgcuccagaagggauaacaaaaucaaauagua

SEQ ID NO: 241544 - RNA, 66 nt, hsa
aggaagcacagcccugcuugaauucaaacuuuuggccuccagaacugugagucaguaccuguuguu

SEQ ID NO: 241545 - RNA, 66 nt, hsa
uguagacaggcuggauuccaguguugggacagccaucuccagaaaccugacuuaagagaguaagau

SEQ ID NO: 241546 - RNA, 66 nt, hsa
caugcugguucccggaaugaaucagcugcugacugucuccagaagggcuggaaaggaugcugccag

SEQ ID NO: 241547 - RNA, 66 nt, hsa
gauguggaaacaaagcaggaccagcaggcacagcaccuccagaacagugccccggaugaccagagg

SEQ ID NO: 241548 - RNA, 66 nt, hsa
ugucugccuucuggcugacaauccuggaaaucuguucuccagaauccaggccaaaaaguucacagu

SEQ ID NO: 241549 - RNA, 66 nt, hsa
cauccauagggagcuggcuggggguuuccgugggagcuccagaacuuuccccagcugagugaagag

SEQ ID NO: 241550 - RNA, 66 nt, hsa
ccaauaggacaauuugcugaggucugagaggacucccuccagaaaaucccugaucucuuaaaauuu

SEQ ID NO: 241551 - RNA, 66 nt, hsa
caagcugcagccuacugaggaggcagaggccaccuccuccagaaagcccucggccugggccgccgc

SEQ ID NO: 241552 - RNA, 66 nt, hsa
aaaacugccuuucuuccccucaagucaacuuuugugcuccagaaaauuuucuauucuguaagucug

SEQ ID NO: 241553 - RNA, 66 nt, hsa
gggaagauccugcggcuggggccgucugccuacacgcuccagaagggccagcgcagagcugggaug

SEQ ID NO: 241554 - RNA, 66 nt, hsa
cucccgugacugcugccucaucgauaccccauuuagcuccagaaagcaaagaaaacucgaguaaca

SEQ ID NO: 241555 - RNA, 66 nt, hsa
gaucaccgaggcucccgugacuuugaacucccuacucuccagaauccaggggcuauagcgaugggg

SEQ ID NO: 241556 - RNA, 66 nt, hsa
gggucuccucugcagcucagggacuggcacacuggccuccagaagggcagcuccacagggcagggc

SEQ ID NO: 241557 - RNA, 66 nt, hsa
gcugugccucccauuuccccucaccuguacccacaccuccagaaugcccugcccugcgaguguguc

SEQ ID NO: 241558 - RNA, 66 nt, hsa
uguuaaacuggcuuacuauagacuucguaaaaauggcuccagaagaguaacaaacugaaaucuuug

SEQ ID NO: 241559 - RNA, 66 nt, hsa
aauucugucuggggacgaaggguuggacgggaugaccuccagaagucccuucaauuucuaguaccu

SEQ ID NO: 241560 - RNA, 66 nt, hsa
gccuuagccuccagguccagacuacuacucuauguucuccagaagggugcuaagucaccuacugaa

SEQ ID NO: 241561 - RNA, 66 nt, hsa
ucugccuaugaggcaucuggccccugguagccagcucuccagaauuacuuguagguaauuccucuc

SEQ ID NO: 241562 - RNA, 60 nt, hsa; identical to SEQ ID NO: 241053

SEQ ID NO: 241563 - RNA, 66 nt, hsa
aggcaaggccagagacuucaagucuaucugaaaagucuccagaagucuaaccccagauaaauagcc

SEQ ID NO: 241564 - RNA, 66 nt, hsa
aggcuauuuuccaacugaagucagggacauugccagcuccagaaaacauccauaacauaguaaaga

SEQ ID NO: 241565 - RNA, 66 nt, hsa
ucuauaaagaaucauuagaaauuaugaguggaaauucuccagaaagauaguauuauagagucuuuu

SEQ ID NO: 241566 - RNA, 66 nt, hsa
aagguuuuuuuaaaaaagaggacuugcaucagcugccuccagaacaauuuuaagaaaauaacaaag

SEQ ID NO: 241567 - RNA, 66 nt, hsa
gagcugcucuccuguauuauccuccacaauaaaauucuccagaaaauaagucccagugucugcugu

SEQ ID NO: 241568 - RNA, 66 nt, hsa
aaggagaaggguaguuugaggugugacaccaguuugcuccagaaaguuuaaggggucuguuucuca

SEQ ID NO: 241569 - RNA, 66 nt, hsa
gguucaguccuagcaagaagcgagaauucugagauccuccagaaagucgagcagcacccaccucca

SEQ ID NO: 241570 - RNA, 66 nt, hsa
caggaagggaaggggggucagaagagagggugaguccuccagaacucuuccuccaaggacagaagg

SEQ ID NO: 241571 - RNA, 66 nt, hsa
agaaaaaggucaagauuucuaucacuuccccgucuucuccagaacuugugucuccagaggaguacg

SEQ ID NO: 241572 - RNA, 67 nt, hsa
cuucucggccccgccaccugcccagcgugcccuggcucuccagaaccuucuaucccacagucaggcc

SEQ ID NO: 241573 - RNA, 67 nt, hsa
aaugagaaagucuuaagcaaaauacucccaggucucacuccagaacauaaaaauggugugugaucaa

SEQ ID NO: 241574 - RNA, 67 nt, hsa
uggaaaacccaguguccaucuuuccacccucccugaucuccagaaccuucgacugacccccuugucu

SEQ ID NO: 241575 - RNA, 67 nt, hsa
cuaggaccugcacgggacuuguggaugggccuggacucuccagaaacuacuugggcagagcaaagga

SEQ ID NO: 241576 - RNA, 67 nt, hsa
gggacaacagaccaggaggggcccccaccugauggaccuccagaaaaacggaucacagccacuaugg

SEQ ID NO: 241577 - RNA, 67 nt, hsa
gggauggggagggagugggccuggaucugggaccucccuccagaauuuccuccagaugggggcagug

SEQ ID NO: 241578 - RNA, 67 nt, hsa
aggccuuccuggugcccaccaggcacuacggcuuccucuccagaauguggcuuugccugagcacaga

SEQ ID NO: 241579 - RNA, 67 nt, hsa
aaauauugaauaacuagaacacaagccacuguuucagcuccagaaaaaagaaagggcuuuaacguuu

SEQ ID NO: 241580 - RNA, 67 nt, hsa
ggucacagggauuccuccuuucccccccaaauauuaacuccagaaacuaggccugacuggggacacc

SEQ ID NO: 241581 - RNA, 67 nt, hsa
acacagcacacaauuucaagccauuuucagaucagaacuccagaaguguugacaagaugccuauucg

SEQ ID NO: 241582 - RNA, 67 nt, hsa
uggagaggauccuucaguucuggccauuccagggacccuccagaaacacaguguuucaagagacccu

SEQ ID NO: 241583 - RNA, 67 nt, hsa
ugugggguccccaucaucccagcugcucccaaauaaacuccagaagaggaaucugugggccugugag

SEQ ID NO: 241584 - RNA, 67 nt, hsa
aacaaaaucaccuauucacugcuuaugcagucggaagcuccagaagaacaaagagcccaauuaccag

SEQ ID NO: 241585 - RNA, 67 nt, hsa
accgacucugucguugccuugaucuugaacuuccagccuccagaacuaugagaaauaaaauucuguu

SEQ ID NO: 241586 - RNA, 67 nt, hsa
uuacaguugcaguauuucaaagucccuauccaggucacuccagaaaaggguauugaaacguugaaau

SEQ ID NO: 241587 - RNA, 67 nt, hsa
ugacugcugcauuuaggccaggucuccaauugcuuuccuccagaaaguguguucccgucuagugagg

SEQ ID NO: 241588 - RNA, 67 nt, hsa
cacacccaaacuccuggccuucugugguuucccuuugcuccagaaacacagaugugucuaaagacuu

SEQ ID NO: 241589 - RNA, 67 nt, hsa
cugagaaacguacacuaucauugcuaaacuaacaguccuccagaaauuuaauaagauguuuuugauu

SEQ ID NO: 241590 - RNA, 67 nt, hsa
auguuuaagugaccuccuucaucacauccugcaguaucuccagaagcagcacuaggguuugaguuuc

SEQ ID NO: 241591 - RNA, 67 nt, hsa
cggcccacguguauuguccgggcucagaaugggaggacuccagaagaugagagaaaccucuuuaucc

SEQ ID NO: 241592 - RNA, 67 nt, hsa
ucuuuuagccuuaccaccuuuuaaaaaauuuguuauucuccagaaacaguaaauaggugaguagggg

SEQ ID NO: 241593 - RNA, 67 nt, hsa
ucaacucagucagugauuuuuugaugcuucucuuauccuccagaauagagaccuaaggacacgugga

SEQ ID NO: 241594 - RNA, 67 nt, hsa
aaaccccuguccccagucagagauaacauccaacuaacuccagaagcggaagaggauauauuuaaca

SEQ ID NO: 241595 - RNA, 67 nt, hsa
ugagggauggagcgggucuccugauucuacaccaucucuccagaacucucuggccuugguggcccca

SEQ ID NO: 241596 - RNA, 67 nt, hsa
gagucuccccccggggagaggacacuggccccucgcacuccagaaaagccaugccagcugggcucgu

SEQ ID NO: 241597 - RNA, 67 nt, hsa
ugcccuguaacuuaucuagaaagaaaagacccugagacuccagaaucugcuguugccauagccccau

SEQ ID NO: 241598 - RNA, 67 nt, hsa
uuggccuauccaguuuuccugguucccucacagguuucuccagaaaguacucccucaguaaagcauu

SEQ ID NO: 241599 - RNA, 67 nt, hsa
aggagcuuuugccacugacucggccguguccugacaccuccagaacgcaggugcuggcgcccguucu

SEQ ID NO: 241600 - RNA, 67 nt, hsa
gaggccugcuucacuugcagauaaguuuauuauaauucuccagaaaugugcaggaugugcauuagca

SEQ ID NO: 241601 - RNA, 67 nt, hsa
uucuguugcccugagagugucccaggggauucagagucuccagaaagauauggcugggccaacucug

SEQ ID NO: 241602 - RNA, 67 nt, hsa
ggcugaacagugcucugccucuaacucccuccucacacuccagaauuacccuuccucaucugugccu

SEQ ID NO: 241603 - RNA, 67 nt, hsa
ccucaggggaagcugcuaggggaaggacuggccguggcuccagaaugugcugccuuuuuaaguuuug

SEQ ID NO: 241604 - RNA, 67 nt, hsa
cuggcgcacuuuccugaagccucuuauuaacucccaucuccagaagcaccucaacaaugucaguggc

SEQ ID NO: 241605 - RNA, 67 nt, hsa
acuguuggaaucagcaggccucugugcucccucugcccuccagaacucagugacucuugaacaugga

SEQ ID NO: 241606 - RNA, 67 nt, hsa
gagccuccaugagucaagcccccuccccacaccuggacuccagaauucacccucuccccugcagucu

SEQ ID NO: 241607 - RNA, 67 nt, hsa
uugaggacgggggguggggaaggaaggaacaugaucccuccagaagucucccacccuggggccaacu

SEQ ID NO: 241608 - RNA, 67 nt, hsa
uugaaguccuggcuucaggcaauucuccugccuuugccuccagaagcacugggaucacaggugucag

SEQ ID NO: 241609 - RNA, 67 nt, hsa
cacugcauuuuccuacaccccuuuccuggacugcucucuccagaaacagcacagcucauggagggug

SEQ ID NO: 241610 - RNA, 67 nt, hsa
gcugcuuuccuagauccacacuuucaaagagaaaccccuccagaacucccacccugacagcccaaca

SEQ ID NO: 241611 - RNA, 67 nt, hsa
uuuuaccuaacaacaucacuuuuguugaacauuccaacuccagaaugauccccaaucacccuaaucu

SEQ ID NO: 241612 - RNA, 67 nt, hsa
gcaugucagucuuuguaauuauuuacacuuuaacuuucuccagaacucagacaugauuucaacaugg

SEQ ID NO: 241613 - RNA, 67 nt, hsa
aucuguaucuuuggagaaggagaaagaaaggaaagaacuccagaaucccaucacuguucuuuaaagc

SEQ ID NO: 241614 - RNA, 67 nt, hsa
uauguauuuuuuuaagcaacaucaugaauuuuaucuacuccagaagucucuacaauagaaaaaaaag

SEQ ID NO: 241615 - RNA, 67 nt, hsa
gagcaauggagagaagaccucuuccugaaucacuggacuccagaaaugugcaugcagaucagcuguu

SEQ ID NO: 241616 - RNA, 67 nt, hsa
caguauuaccaccagacugacuccaggacucacugcccuccagaaaacagaggugacaaaugugagg

SEQ ID NO: 241617 - RNA, 67 nt, hsa
uaaagagcugcuggugaacuccaucucauucucgccccuccagaagaagcaguugucccccaaauac

SEQ ID NO: 241618 - RNA, 67 nt, hsa
guuccuuuucccuaaucauucccuuuucuccccacuccuccagaaggcauaacccuucucuccacac

SEQ ID NO: 241619 - RNA, 67 nt, hsa
ugcucuucucauaguguacacccaccugccucucuggcuccagaagcugccagagugcacugggggg

SEQ ID NO: 241620 - RNA, 63 nt, hsa; identical to SEQ ID NO: 240602

SEQ ID NO: 241621 - RNA, 67 nt, hsa
caucaaaauagaagaccuugcaagaagcagagucauucuccagaaggaacuugggagaugauggugc

SEQ ID NO: 241622 - RNA, 67 nt, hsa
ucaaggaauuguacugugcuacaauuaucucuagaaucuccagaaagguggagggcuguucgcccuu

SEQ ID NO: 241623 - RNA, 55 nt, hsa; identical to SEQ ID NO: 240605

SEQ ID NO: 241624 - RNA, 67 nt, hsa
caguguuaucuucauaugauaugcugaacaccaaaaucuccagaaaugcauuuuauguaguucuaaa

SEQ ID NO: 241625 - RNA, 67 nt, hsa
guuuauguucucaugcccucaaucuguaaauuuuugucuccagaaaaacccucccaggcaucccaua

SEQ ID NO: 241626 - RNA, 67 nt, hsa
aggucagggaggacugggcacuauuuggcaggauguacuccagaauauaaucaaagaauuuucugua

SEQ ID NO: 241627 - RNA, 67 nt, hsa
accaaaaggaguacccagggccugguacccaggcccacuccagaauggccucuggacucaccuugag

SEQ ID NO: 241628 - RNA, 67 nt, hsa
uccccccaaccccaucucagagcucagaggguacaagcuccagaacaguaaccaagugggaaaauaa

SEQ ID NO: 241629 - RNA, 67 nt, hsa
acaaagaaguguuugauggugccagagaggggcugcucuccagaaagcuaaaauuuaauuucuuuuu

SEQ ID NO: 241630 - RNA, 67 nt, hsa
accgaggggcucaggaaaacgggaccggccaggccaccuccagaaacggccauucagcaagacaaca

SEQ ID NO: 241631 - RNA, 67 nt, hsa
uagccaagucuauaauauaauuaugaucaugaauagacuccagaauccacaaagagaagagggcuug

SEQ ID NO: 241632 - RNA, 67 nt, hsa
cagagccuucccuacccugacgccucccagucaucaucuccagaacucccagcggggcucccugagc

SEQ ID NO: 241633 - RNA, 67 nt, hsa
gagaauauuagauuucugacuugcaaauauguuuguacuccagaagaauuagaggaaaagcagauac

SEQ ID NO: 241634 - RNA, 67 nt, hsa
aagugcugggauuacaagugugagccaccacaccuggcuccagaaauuuuauuuuauuuuuuugagg

SEQ ID NO: 241635 - RNA, 67 nt, hsa
ccacacuauguguguuguuuccauagcucuucacuuccuccagaagccuccuuacauuaaaaagccu

SEQ ID NO: 241636 - RNA, 67 nt, hsa
ugauuguaguaauuucuauuugcacugugccuuucaacuccagaaacauucugaagauguacuugga

SEQ ID NO: 241637 - RNA, 67 nt, hsa
aaccuuaaucuagauaauaaaagcuuuuuggggcaaccuccagaacugugaaaaauaaauuuguuau

SEQ ID NO: 241638 - RNA, 67 nt, hsa
gagacgcuaaccgcccuucugcguuccauaaagguggcuccagaaagggcauccucuaccccaagcc

SEQ ID NO: 241639 - RNA, 67 nt, hsa
ugagcaucauacuggaaagcaaacaccuuuccuccagcuccagaauuccuugucucugaaugacucu

SEQ ID NO: 241640 - RNA, 67 nt, hsa
cucugccuccucuucaacugaccagccuccaugcugccuccagaauggucuuucuaaugugugaauc

SEQ ID NO: 241641 - RNA, 67 nt, hsa
aaugaaaccugacaaagagacuguaauauuguaguugcuccagaaugucaagggcagcuuacggaga

SEQ ID NO: 241642 - RNA, 67 nt, hsa
cgggaguguggucagucugccugcugcugugcgguagcuccagaaccaccucguuccugguuuuguu

SEQ ID NO: 241643 - RNA, 67 nt, hsa
ugaguuuguaagaacaaucauaaaaggacuuguuagucuccagaacaucugcuaaaaugcaaguaua

SEQ ID NO: 241644 - RNA, 67 nt, hsa
gaacaugaguuuaugggaaugccuuuucccucuggcacuccagaacaaaccucuauauguugcugaa

SEQ ID NO: 241645 - RNA, 67 nt, hsa
ugguaaauaccauauaugauccucgaaaugauaauaucuccagaauauuguuuucacccaaauuuga

SEQ ID NO: 241646 - RNA, 67 nt, hsa
cuguaccuauuuuugaggaccuugaaaaucuuaaucucuccagaagggauacugcauugguucuucu

SEQ ID NO: 241647 - RNA, 67 nt, hsa
uauauuugccuauauucucccuacaagaauauuuuugcuccagaaagacauguucuuuucucaaauu

SEQ ID NO: 241648 - RNA, 67 nt, hsa
ggaccauuugguuacccucgggauggccauccacugucuccagaaagagaccacuuagagggucucu

SEQ ID NO: 241649 - RNA, 67 nt, hsa
gguuuuaaaccuucaggaacaccaguuaggaaaauagcuccagaaaauauagauauauuuuauuuuu

SEQ ID NO: 241650 - RNA, 67 nt, hsa
gacggauauaaaggaagaauauuuccuuuauguguuucuccagaauggugccuguuucucucugugu

SEQ ID NO: 241651 - RNA, 67 nt, hsa
acacagaagccacaccauuugcaccauccacgccuugcuccagaaggccuggccgccuucucccugg

SEQ ID NO: 241652 - RNA, 67 nt, hsa
cccagucagaucucaggcuugucccccugucagcugccuccagaagggaagguagccagugccugag

SEQ ID NO: 241653 - RNA, 67 nt, hsa
uagaccucgccuagcacucugccuugccagagauuggcuccagaauuugugccagacuuacagaaaa

SEQ ID NO: 241654 - RNA, 67 nt, hsa
aauauaauugugaaggagucagggcuaacaccuggaucuccagaaaccuagcccagcagguuaaucu

SEQ ID NO: 241655 - RNA, 67 nt, hsa
ugccagcuccacucucugguuucuaauaaacagggaucuccagaacacuggugguggacacagcuuu

SEQ ID NO: 241656 - RNA, 67 nt, hsa
uagcccaaugagggcgaaugacauuacagcuugaccucuccagaacacuaauauccuaaaauacaga

SEQ ID NO: 241657 - RNA, 57 nt, hsa; identical to SEQ ID NO: 240639

SEQ ID NO: 241658 - RNA, 67 nt, hsa
aaucuucacuuucaauuauauccagcaauaaguuguucuccagaaaagaaagcuuggaaacuuaccc

SEQ ID NO: 241659 - RNA, 67 nt, hsa
uaccuugcuuucaaaaggacugcuuaccauggaagugcuccagaagaaucauuugaaacaucuuuug

SEQ ID NO: 241660 - RNA, 67 nt, hsa
guggguuuuaguauauauagcccaaaaugguaacugucuccagaacagcaaccacauugaauucuug

SEQ ID NO: 241661 - RNA, 67 nt, hsa
auccauagccaucuacaauaguaacugcccacaggcucuccagaaaacuacuacaauggccaaguac

SEQ ID NO: 241662 - RNA, 67 nt, hsa
uaaacagagagugaacagcaccucuccauugcuacaucuccagaauauuguucgguuauguucaugu

SEQ ID NO: 241663 - RNA, 67 nt, hsa
gggaggaaauaaagcccuguucuggaucccccauccccuccagaauaagagcauguucugcauguau

SEQ ID NO: 241664 - RNA, 67 nt, hsa
agacauaugcagugguucuuacagaucaguuaauuaacuccagaaagcaaauguuagacuacacauu

SEQ ID NO: 241665 - RNA, 67 nt, hsa
ccuguucugaugggggagggcggucuucccacuuccucuccagaacuccagaaagagcagugugcuu

SEQ ID NO: 241666 - RNA, 67 nt, hsa
gaugggggagggcggucuucccacuuccucuccagaacuccagaaagagcagugugcuuaugcuuca

SEQ ID NO: 241667 - RNA, 67 nt, hsa
ucagaaaacuucucuucugagccucuuuaacagcuuucuccagaaccagugucugaaccacccugga

SEQ ID NO: 241668 - RNA, 67 nt, hsa
ucauuaguaauaaggagaggguugggggugggcagggcuccagaaagucagcagugugccugggcac

SEQ ID NO: 241669 - RNA, 67 nt, hsa
aaauaaauguguauauuuaauguuuuauuguuagcuucuccagaaaauugaugcaaauucugguaau

SEQ ID NO: 241670 - RNA, 67 nt, hsa
ugaagcugcucucaggcacccccuucuucauugcucucuccagaaaggguugcuagccuuaacuuca

SEQ ID NO: 241671 - RNA, 67 nt, hsa
augguuauguuucugccuucggcgagagaacagcaagcuccagaaaguggcugcgccuucagccccg

SEQ ID NO: 241672 - RNA, 67 nt, hsa
ggggagcacaguagugcgggccugggcccugcuccaccuccagaaguggcuggauguacccugccug

SEQ ID NO: 241673 - RNA, 67 nt, hsa
ccauccugcgacccucacuggccuggccuugugggggcuccagaaaagaggcuaggagaggccagag

SEQ ID NO: 241674 - RNA, 67 nt, hsa
ccuucaaggcacagcccuuguugggagggagaacccucuccagaaacccugccaccauggugucuug

SEQ ID NO: 241675 - RNA, 67 nt, hsa
gacucugagcugccccuggcuuccuuuaaggaggcugcuccagaaggaaccuggguggggagggcga

SEQ ID NO: 241676 - RNA, 67 nt, hsa
ccacucuguaccccaaagagaguucucaugaaauauucuccagaauguauucauuaucaagaaaaug

SEQ ID NO: 241677 - RNA, 67 nt, hsa
ggugauucucuugaugccaccuucagauccuuuuauucuccagaauaauucuuaacagugguucaaa

SEQ ID NO: 241678 - RNA, 67 nt, hsa
cuucugagcccgucucccggacagguugaggaagcugcuccagaagcgccucggaaggggagcucuc

SEQ ID NO: 241679 - RNA, 67 nt, hsa
gucagaaaauucuggaacuugaaaaaguaguaagggccuccagaauugacuuagcccuaguaauaaa

SEQ ID NO: 241680 - RNA, 67 nt, hsa
auuuuuaaauuuuuuaauuaccuguuguaggguguuccuccagaagcaaagagcaaaauuuuacugu

SEQ ID NO: 241681 - RNA, 67 nt, hsa
cugcaaacuucagucuggacuucuuuuugccagagaacuccagaaaccagucaggcucucagucagc

SEQ ID NO: 241682 - RNA, 67 nt, hsa
ugacauagcuucccuucccucccccuucacccacucccuccagaacauuuaguguagaugaaaaugu

SEQ ID NO: 241683 - RNA, 67 nt, hsa
cugcagaaaaacacaaacaaaaacagacucccacugucuccagaagucguggccuuccagaacaguc

SEQ ID NO: 241684 - RNA, 67 nt, hsa
agacccagugucauuugcuccuccuguuccugugccacuccagaaccucagcagaucugagccaccg

SEQ ID NO: 241685 - RNA, 67 nt, hsa
uggcaucugaauguuccagcagccuaacugugcucugcuccagaaacauguguguggcuucccuacc

SEQ ID NO: 241686 - RNA, 67 nt, hsa
acugucacuuuaguuaugcuaaaguggagguuucagccuccagaagacagcagagccuucuaggguc

SEQ ID NO: 241687 - RNA, 67 nt, hsa
acaguauuuacaguauugagcuuugcauuuaugauuucuccagaaauuuaccacaaaagcaaaauuu

SEQ ID NO: 241688 - RNA, 67 nt, hsa
acacagcguuggucucuguuuggaaucacugugaggucuccagaaggaccuggccgccagccccuuc

SEQ ID NO: 241689 - RNA, 67 nt, hsa
gcucuugucccucacugccccaguaagcuggaggcugcuccagaacucagcaguguuggaggggccu

SEQ ID NO: 241690 - RNA, 67 nt, hsa
guuuauuccuacuggagcuuaguuccaaugcauuuggcuccagaaagaccccagugccuuuugacaa

SEQ ID NO: 241691 - RNA, 67 nt, hsa
uguggggacccucuuccucuagcacaguaaagcuggccuccagaaacacggguaucuccgcguggug

SEQ ID NO: 241692 - RNA, 67 nt, hsa
ucauuauuucaccaagccaauaccagccgccauccuucuccagaauucuuguaaauaaaauaaaucc

SEQ ID NO: 241693 - RNA, 56 nt, hsa; identical to SEQ ID NO: 240675

SEQ ID NO: 241694 - RNA, 67 nt, hsa
gggcagggcuuugaucauucaaaaguaacuaaaguagcuccagaaugccaaguauucguguaaauua

SEQ ID NO: 241695 - RNA, 67 nt, hsa
uauuucaagcugaaaauaauaguucuacugcccgugucuccagaauguagagcccaucaauauuuuu

SEQ ID NO: 241696 - RNA, 67 nt, hsa
uaaguaugacaacacauacacacuugccucuccccaucuccagaagaggggagcagaguccgagcuu

SEQ ID NO: 241697 - RNA, 67 nt, hsa
gccagagcacagaccccagagucuugugguucucuaacuccagaaaggacaauguccccuauucagg

SEQ ID NO: 241698 - RNA, 67 nt, hsa
auaauuuauauccaaaauuuguguuuuaaauuucauacuccagaacuuucauguuuaugaguauuag

SEQ ID NO: 241699 - RNA, 67 nt, hsa
aauguguuaaugucaauaugaugagauuuuagccuuucuccagaacuaaggcauuaaagaaaauagc

SEQ ID NO: 241700 - RNA, 67 nt, hsa
gcgcuguggucaccugaggaugugguucagguggggucuccagaaggcugcuugcccccagagagcc

SEQ ID NO: 241701 - RNA, 67 nt, hsa
ucaugacccuuaagugccacccuucuuggaagacccccuccagaagcauacuggaagccaccucugg

SEQ ID NO: 241702 - RNA, 67 nt, hsa
caauacaguaagagauaguguugaaccagcaucaagucuccagaaacauggcagagcagacaggccg

SEQ ID NO: 241703 - RNA, 67 nt, hsa
cuggaacugacccuuccuucauccucaaccugcuguccuccagaaagcaccaaggaaaaagcagaga

SEQ ID NO: 241704 - RNA, 67 nt, hsa
acaaaucagcuuauauuuuuuaucuugaugacuccugcuccagaaucgcuagacuaagaauuaggug

SEQ ID NO: 241705 - RNA, 67 nt, hsa
aacuuacacuggaagcuuugauucacccuccacaguacuccagaaaggacuguccuauaaguuguac

SEQ ID NO: 241706 - RNA, 67 nt, hsa
aauuccagauuuguuuccuuuuggccuccugcaaagucuccagaagaaaauuugccaaucuuuccua

SEQ ID NO: 241707 - RNA, 67 nt, hsa
ccgaagauguuuacuacaaaagcaugccaaaccuaggcuccagaaaccacguccaucagcugcauac

SEQ ID NO: 241708 - RNA, 67 nt, hsa
agauacuagcauugcacauauagucugcuuucuguuccuccagaauuugaguccuguuaauguagua

SEQ ID NO: 241709 - RNA, 67 nt, hsa
cuuucauucuucaacagugccuugcauguaacaagcacuccagaaauguuuguugaaugaaugaaug

SEQ ID NO: 241710 - RNA, 67 nt, hsa
ucucauggcuggagagcugaucagccaggcacagaaucuccagaacaaccuagagagugaaugcuaa

SEQ ID NO: 241711 - RNA, 67 nt, hsa
ccaaaucuccuggcaccuugaucuuggauuuuacagccuccagaacugugagaaaauaaauuucugu

SEQ ID NO: 241712 - RNA, 67 nt, hsa
uuuuuaaugguacuuaguauuuugaucaaacuuuagucuccagaacuaaacaagucccuaaguuucc

SEQ ID NO: 241713 - RNA, 67 nt, hsa
auuacaggaaguacuggagaaaauggacguguuaugacuccagaauuucccaaagcagugcaugcug

SEQ ID NO: 241714 - RNA, 67 nt, hsa
guuuaauguuaccuuuuggcuugagaaugucuuucagcuccagaauuauuguuacucauauuuuaau

SEQ ID NO: 241715 - RNA, 52 nt, hsa; identical to SEQ ID NO: 240697

SEQ ID NO: 241716 - RNA, 67 nt, hsa
cuuguauaguaauuuuguuguuguugggugcugguagcuccagaauuuugugaccacuauugugggu

SEQ ID NO: 241717 - RNA, 67 nt, hsa
gccuccaaccucacagccucguagagcuucacagcuacuccagaaaauaggguuaugugugucauuc

SEQ ID NO: 241718 - RNA, 67 nt, hsa
ggcccauccaaagauguccagauguccaugugcuagucuccagaacuuguaacuguguuguuaugug

SEQ ID NO: 241719 - RNA, 67 nt, hsa
aauguuauuucuaauaauacacuaucuugauuguacucuccagaaaauuuuucugucagugaaaaua

SEQ ID NO: 241720 - RNA, 67 nt, hsa
cgagucaaaagcuucagugaguuacaucucauucaaucuccagaagauugggauuaucgucuucuaa

SEQ ID NO: 241721 - RNA, 67 nt, hsa
ugacccagcucauggaauuuuuucaucuuauacugagcuccagaaaggacguaacuuagcauggauc

SEQ ID NO: 241722 - RNA, 67 nt, hsa
aucuuuuauuuuccugucuucuuucuccugugguuugcuccagaauuaagguuuguuuuccauccau

SEQ ID NO: 241723 - RNA, 67 nt, hsa
cauucucccuuuugacacaguuguuucagaaagagcucuccagaagccaauauugagauguaauuca

SEQ ID NO: 241724 - RNA, 67 nt, hsa
uaguagaagaaaaaaaaucuuucagauaagagguguucuccagaauggaggaacuacuuggcaugua

SEQ ID NO: 241725 - RNA, 67 nt, hsa
ccugacuuaacuguaugugcaacagcaaugaaauuaacuccagaagccuuccaccugcgucacccag

SEQ ID NO: 241726 - RNA, 67 nt, hsa
aacuucaagcugcucaucuguuaguaagugauguucacuccagaacacauucaugaugagaacuuuc

SEQ ID NO: 241727 - RNA, 67 nt, hsa
uaguagaagaaaaaaaaucuuucagauaagagguguucuccagaauggaagaacgacuuggcaugua

SEQ ID NO: 241728 - RNA, 67 nt, hsa
gcccucacacugcugugcagccaucaccaccauucaucuccagaauuuguucucagucccaaacuga

SEQ ID NO: 241729 - RNA, 67 nt, hsa
accuucuauucauaaauguucuauacaguggacagcccuccagaaugguacuucagugccuagugua

SEQ ID NO: 241730 - RNA, 67 nt, hsa
agcaaaauaaggaagagggcugagcugagcuucgguucuccagaauguaagaaaacaaaaucuaaaa

SEQ ID NO: 241731 - RNA, 67 nt, hsa
cugccgaccaccagcaccauccucuccucccagcagccuccagaaccaugcccaggucuccugccuc

SEQ ID NO: 241732 - RNA, 67 nt, hsa
ccucugaccucaucaugguucuaguucucauacagaacuccagaauuuuuaaagaacucuauaauug

SEQ ID NO: 241733 - RNA, 67 nt, hsa
aauuuuacugaaucugucuacccuucauucaugagaacuccagaaugaguguugaccacugaagcau

SEQ ID NO: 241734 - RNA, 67 nt, hsa
uuucccacacuaagguaaguucagacuagauugaacacuccagaauuuuuuacuacagacuguuuuu

SEQ ID NO: 241735 - RNA, 67 nt, hsa
augcauccccauggagagacagcauugcuccccagcccuccagaaaccuugagcagauccagggauc

SEQ ID NO: 241736 - RNA, 67 nt, hsa
ugggcauugccgggguaggguggugucuucaccacagcuccagaaggcacuggugggauguggaguc

SEQ ID NO: 241737 - RNA, 67 nt, hsa
aaaggaaagaaucaaauuucuugcccggucacuggcacuccagaagacagcgugccggaaccggcag

SEQ ID NO: 241738 - RNA, 67 nt, hsa
ugcaacuuucauagucccaaagauaggcagagaacaucuccagaaaugugugugugugugugugugu

SEQ ID NO: 241739 - RNA, 67 nt, hsa
cacagaagagccacagucuccagacucauggcguucccuccagaacuccccauuccccucugagcau

SEQ ID NO: 241740 - RNA, 67 nt, hsa
ccucgaaaagccagaggguucaccuagucagacgaaacuccagaacagugcuuguggagggccugac

SEQ ID NO: 241741 - RNA, 67 nt, hsa
acccauaauuuucuucaaugaguuaauaaacagaaaucuccagaaccucugaaacacauucuugaag

SEQ ID NO: 241742 - RNA, 67 nt, hsa
cacacuauauuacagaaugauguaauaccugguaauucuccagaagauagacuucagacccuuaaug

SEQ ID NO: 241743 - RNA, 67 nt, hsa
uguauuaauuguaaagccaagcuuaucaguugacucucuccagaauaaauaaucaucuguguggcau

SEQ ID NO: 241744 - RNA, 67 nt, hsa
ggcacuguugcagcuuccucugcccuggcuggaaagacuccagaauccaguguggugcuguggaagg

SEQ ID NO: 241745 - RNA, 67 nt, hsa
accccucugugaggagcugugggaaguguggguuugucuccagaacagaagagaaugauggauauuc

SEQ ID NO: 241746 - RNA, 67 nt, hsa
ccuagucccugaggguggagggaagcugaggauagagcuccagaaacagcacuagggucccaggaga

SEQ ID NO: 241747 - RNA, 67 nt, hsa
ugggaggggggaaagagaccagccuuggucccuaagccuccagaaacgucuucuuaauccccaccuu

SEQ ID NO: 241748 - RNA, 67 nt, hsa
uggggcauauuucugugcuguggaugacauggccuuacuccagaaucccaggcccuccacugugacu

SEQ ID NO: 241749 - RNA, 67 nt, hsa
ugaagugcuggcaaccacuaagaauucaaacuggggccuccagaacucacuggggccuacagcuuug

SEQ ID NO: 241750 - RNA, 67 nt, hsa
uccuucagccuuaaauacaaaaauaaaacugaaacugcuccagaaagcagcuuucuccaaaaauguc

SEQ ID NO: 241751 - RNA, 67 nt, hsa
aggugaagcccaaaagcucuuaaggagaauuguauuucuccagaagcugcagcaagagguacagcuc

SEQ ID NO: 241752 - RNA, 67 nt, hsa
aagaauuauucaauuucaugaauaacucuuguuugcacuccagaaaacaacauacauguuuaaauac

SEQ ID NO: 241753 - RNA, 67 nt, hsa
caaaaucuuuuagaauuuuuuuggagguguuuguuuucuccagaauaaagguauuacuuuagaauag

SEQ ID NO: 241754 - RNA, 67 nt, hsa
gcuaguggcuguguagcauccucagugcaaaacccagcuccagaauuuucaccugguaacgaauuuc

SEQ ID NO: 241755 - RNA, 67 nt, hsa
uacuaaaaugcagcuguuguuagacaacuguugaaaacuccagaaauacaucacccaagguggcagu

SEQ ID NO: 241756 - RNA, 67 nt, hsa
aaaaacccaggccuugacauuguuauucaaauggccccuccagaaaguuuaaugauuuccauuugua

SEQ ID NO: 241757 - RNA, 67 nt, hsa
cagcgugaaaccuuggcacaggacugaggauccucuccuccagaaaagcccccucgaggaaauaaau

SEQ ID NO: 241758 - RNA, 67 nt, hsa
cgggaggugucuacugaaaagggaaccugcuucuuuacuccagaacgcuguucuuuaaagaccaaga

SEQ ID NO: 241759 - RNA, 55 nt, hsa; identical to SEQ ID NO: 240741

SEQ ID NO: 241760 - RNA, 67 nt, hsa
uggucaaauacuugacucccacucuugccacuccuagcuccagaagggcucagggccuuccccacag

SEQ ID NO: 241761 - RNA, 67 nt, hsa
ggguuuaagaugcuaggaugaggcaggcccaguccuccuccagaaaauaagacaggccacaggaggg

SEQ ID NO: 241762 - RNA, 67 nt, hsa
ucucagacucugauuagcugccuccccuucucccugccuccagaauguucugggauaacauuuggag

SEQ ID NO: 241763 - RNA, 67 nt, hsa
caggagagggggagcaaacaggaaauuccacagcugccuccagaaacauuaaccaccccucucuagu

SEQ ID NO: 241764 - RNA, 67 nt, hsa
ucccgccagcuccucagccugcucccugggaggcaggcuccagaagcaccccgacggggggccuuau

SEQ ID NO: 241765 - RNA, 67 nt, hsa
aucagugcuacaggaguacaucugcccugccacaugacuccagaagucucugaccccauuuguuuuu

SEQ ID NO: 241766 - RNA, 67 nt, hsa
ccucuuggcuaaggugcuguuccuguuccugcaaggucuccagaaccccuuuggaaauggugaagga

SEQ ID NO: 241767 - RNA, 67 nt, hsa
cucugucucaaauaauuauuucacagaggauagcaagcuccagaagguucuauuaccuuuaaaaaag

SEQ ID NO: 241768 - RNA, 67 nt, hsa
cuuagagcgagagcagagcaaacugcgcagcaggcaccuccagaaagguaaugguggcagaacccac

SEQ ID NO: 241769 - RNA, 67 nt, hsa
aggcuuuuacuuccgguuucuucauauugaggggcaacuccagaaguggaguuuucugugagaauaa

SEQ ID NO: 241770 - RNA, 67 nt, hsa
auuacuaaagcaaaauuuccagggguagggacugggacuccagaaccauuaauaaaacaaaacaaaa

SEQ ID NO: 241771 - RNA, 67 nt, hsa
uagccuucuagcugaaaaacgaguauuccccaauggacuccagaagaaacuugauucaucgcugcaa

SEQ ID NO: 241772 - RNA, 67 nt, hsa
ccauccagggcaaggacagacuaaaagagcauaucuucuccagaaguccuagaaacaucucaucauu

SEQ ID NO: 241773 - RNA, 67 nt, hsa
aaugaaugugggagaaaaucgcugcugcugagauggacuccagaagaagaaacuguuucuccaggcg

SEQ ID NO: 241774 - RNA, 67 nt, hsa
ccauaaguggcaaauauuuuaaaauauuugaaaaacacuccagaaucuaguacgcuuuauuuuuaga

SEQ ID NO: 241775 - RNA, 67 nt, hsa
ucuuccccguguggcccaccccaggcacggcucauuccuccagaauuauagaagcucagccuggccu

SEQ ID NO: 241776 - RNA, 67 nt, hsa
agcagagccaccauuuuuuauaauuucuaauaaccaacuccagaacuaggagcugaucaacucuuug

SEQ ID NO: 241777 - RNA, 67 nt, hsa
gggagauguuggcaccuuugaauucuacauccuguuucuccagaaugagaauuuguguacaaagaua

SEQ ID NO: 241778 - RNA, 67 nt, hsa
caguauaccuuauaacacugagccacuucuccccacccuccagaagggguccacguugaauucugaa

SEQ ID NO: 241779 - RNA, 67 nt, hsa
gaagcauugcauugugggaaucacaaagcaaauaguacuccagaaagacaaauaucagaagcuuccu

SEQ ID NO: 241780 - RNA, 67 nt, hsa
uguuuuuagacuguuagacaaaagugcucacgugcagcuccagaauauggaaacagagcaaaagaac

SEQ ID NO: 241781 - RNA, 67 nt, hsa
agccccgccuuccccaaagcagaggggcugucugugucuccagaaaggggacaucgggggggagggg

SEQ ID NO: 241782 - RNA, 67 nt, hsa
cucugaguuugggcugcaagugcucacagcucuuguucuccagaaacuggagaauugcccucaggag

SEQ ID NO: 241783 - RNA, 67 nt, hsa
gauauuucuacccaugcaacggaagaaaaacccauuacuccagaagaguauaucuaaguaacuaaaa

SEQ ID NO: 241784 - RNA, 67 nt, hsa
guucccuugaugaagaaguugauaugccuuuucccaacuccagaaagugacaagcucacagaccuuu

SEQ ID NO: 241785 - RNA, 67 nt, hsa
gcauuugugucgguuaaaaauucgaaggcuuaugggucuccagaaacucugccagccagccucagug

SEQ ID NO: 241786 - RNA, 67 nt, hsa
agccucccaaauaacuauuuucuuaucugcaguauuccuccagaagagcuaaccagggcagggcugg

SEQ ID NO: 241787 - RNA, 67 nt, hsa
ucugcccuuccaacgcaucacccgccucaaacugcugcuccagaacauucugaagagaacacagccu

SEQ ID NO: 241788 - RNA, 67 nt, hsa
cuugggcuaagguauaaaucaacacacugcuuccuuccuccagaaggucuuacugugaaggaaaaaa

SEQ ID NO: 241789 - RNA, 67 nt, hsa
cacaacuuggcuacacauagacucuagucaguuuugucuccagaaccuuaggcuuuuguauuuuuua

SEQ ID NO: 241790 - RNA, 67 nt, hsa
uaguccugcggugauauucuaucugcaguauuuguaccuccagaauggcagaucccucagcaggaac

SEQ ID NO: 241791 - RNA, 67 nt, hsa
auggaauaucaaguauaaugauguaguaaaaagauuucuccagaaaacacuuugagauacuuaaaga

SEQ ID NO: 241792 - RNA, 67 nt, hsa
gggguaguucuguucuguggguuugugcuuccucuuucuccagaagccuucuggcugauuguuccga

SEQ ID NO: 241793 - RNA, 67 nt, hsa
ggccucaaaccagcccaacccgagcuuuuggacagcucuccagaagcaugaacugcaguggagauga

SEQ ID NO: 241794 - RNA, 67 nt, hsa
ccaagauucaucugugaccuccaggcagcagucucugcuccagaaucucuggacggagcugcuggca

SEQ ID NO: 241795 - RNA, 67 nt, hsa
cauguuucuuuucuauagagaaauguauaguuugacucuccagaauguacuauccaucuugaugaga

SEQ ID NO: 241796 - RNA, 67 nt, hsa
gaaggcccucaccagaacccaacccuuggacuucagccuccagaacugugagaaauacauaccugcu

SEQ ID NO: 241797 - RNA, 67 nt, hsa
ccuggaucaggguggggacaaggacuggacccuccuucuccagaaggccuucagcucuugccuugcc

SEQ ID NO: 241798 - RNA, 67 nt, hsa
agucaauauaaauucuacagaaaauaguguucuuuuucuccagaaaaaugcuugugagaaucauuaa

SEQ ID NO: 241799 - RNA, 67 nt, hsa
cgaccucuccaaccaccacacuccccgccguacaguucuccagaaucccaggcgaugacaagucuga

SEQ ID NO: 241800 - RNA, 67 nt, hsa
gggcucccaggggccggccuccucugccugguaaugacuccagaacaacaacugggaagaaacuuga

SEQ ID NO: 241801 - RNA, 67 nt, hsa
uuagaaggaagcauggcccugacuucagaauuccagacuccagaacuggaagaauaaaugucuguug

SEQ ID NO: 241802 - RNA, 67 nt, hsa
auccugcauugaauugaauaugaauuucucuaacucucuccagaaaauggauggagauaacuugucu

SEQ ID NO: 241803 - RNA, 67 nt, hsa
aaugugagauucuuuagccacuuuggggagccugucucuccagaagccuuucuuaguggugcccaca

SEQ ID NO: 241804 - RNA, 67 nt, hsa
accuuaaaaugcacggcuaaacuauucagaguuaacacuccagaauuguuaaauuacaaguacuaug

SEQ ID NO: 241805 - RNA, 67 nt, hsa
gcacugagcgccugcagaucccgcaggcuucguuugccuccagaaccuucccgucugauuguuccuc

SEQ ID NO: 241806 - RNA, 67 nt, hsa
auuaaccuuucuaaaaguuuucaucgccuugguaaagcuccagaaauggacaaugcuagugacugca

SEQ ID NO: 241807 - RNA, 67 nt, hsa
caacaucggcuucucagauggcuuccucacuucaugccuccagaaagcauauugcccggugaugaaa

SEQ ID NO: 241808 - RNA, 67 nt, hsa
gccccucugggccaaagcccauggguagcuuggcugccuccagaagagaugcagagagcuguggggc

SEQ ID NO: 241809 - RNA, 67 nt, hsa
agugauagggauccuggugggaggagagagggcacaucuccagaaaaaugaaaagcaauacaacuuu

SEQ ID NO: 241810 - RNA, 67 nt, hsa
uacuucauccucgccucucaggcuuuagauacgaaaucuccagaauggaaggggguggggauuuucu

SEQ ID NO: 241811 - RNA, 67 nt, hsa
ugagucccaugggauuccccggcugugacacucuacccuccagaaccugacgacugggccaugugac

SEQ ID NO: 241812 - RNA, 67 nt, hsa
guuauuuuucuugaagaggcagcucaaaugucaccuucuccagaagcugcucuccacuugcuuuagg

SEQ ID NO: 241813 - RNA, 67 nt, hsa
cagauccagcaggccccagucucgcaucagcgccggccuccagaacuuagcaauuuccgccugguga

SEQ ID NO: 241814 - RNA, 67 nt, hsa
ggagaggagaggagggggaggucauuuaucugagucucuccagaaguuuuuaaggcuacauuuugga

SEQ ID NO: 241815 - RNA, 67 nt, hsa
ggaagcuuuucuuuggcgauucagugucacaaaauaacuccagaaagaagcacuuagcgugcuguuc

SEQ ID NO: 241816 - RNA, 67 nt, hsa
auucacuuuaaacuuuuauuaccacaguugcugccuccuccagaauuuuugaauuuuaauaaaaggc

SEQ ID NO: 241817 - RNA, 67 nt, hsa
ccaacauugcgagaguagcuauuuugaaagaauaauucuccagaaguuaacaucuaauaucuaguau

SEQ ID NO: 241818 - RNA, 67 nt, hsa
aacaaaaucaccagcaccuugaucuuugacuucuaaucuccagaauagugagaaauaaauuucuguu

SEQ ID NO: 241819 - RNA, 67 nt, hsa
cguguucuuugccaccagccugucacuccaguggcagcuccagaaacggaggcuguugcuuuuaucc

SEQ ID NO: 241820 - RNA, 67 nt, hsa
ccacuacugcuucugucccugcuggcagccucugucccuccagaacggcuaaccagagcacacuguc

SEQ ID NO: 241821 - RNA, 57 nt, hsa; identical to SEQ ID NO: 240803

SEQ ID NO: 241822 - RNA, 67 nt, hsa
guuuuaauccuugcuuugguuuggaacugccuucgggcuccagaacuuaaauugcuugguccguggc

SEQ ID NO: 241823 - RNA, 67 nt, hsa
cggggugggcugggccgcuggagccuccgccugcuuccuccagaagacacgaaucaugacucacgau

SEQ ID NO: 241824 - RNA, 67 nt, hsa
cucccugcuaagcaguuuauaguucuucuccauguuucuccagaauuaaucaguguuaguccucugu

SEQ ID NO: 241825 - RNA, 67 nt, hsa
agcucagugguguggggaaacguuccccuggaucauacuccagaauucugcucucagcaauugcagu

SEQ ID NO: 241826 - RNA, 63 nt, hsa; identical to SEQ ID NO: 240808

SEQ ID NO: 241827 - RNA, 67 nt, hsa
ugacuucuuggaccuccucccccgccccaauuccaagcuccagaaacucccaacucgucugccgucc

SEQ ID NO: 241828 - RNA, 67 nt, hsa
cuccccaccgauuucagcguguccacaucacagcucccuccagaagcugcaagagcuucuuagcagu

SEQ ID NO: 241829 - RNA, 67 nt, hsa
cacagcaguuuccuugcaacacuuucagcuccccaugcuccagaauacccacccaagaaaauaauag

SEQ ID NO: 241830 - RNA, 67 nt, hsa
gggaugcucuaauuggcugguugguuuggauuuguaacuccagaaacauucuauagugugccagagc

SEQ ID NO: 241831 - RNA, 53 nt, hsa; identical to SEQ ID NO: 240813

SEQ ID NO: 241832 - RNA, 67 nt, hsa
uauguaguuguucguugguuauacaaguucuuggucccuccagaaccaccccggcccccugcccguu

SEQ ID NO: 241833 - RNA, 67 nt, hsa
uuguagucugucuucaacuauuuuauccaaaauaaaccuccagaagaaaguaguuuucauuuacuua

SEQ ID NO: 241834 - RNA, 67 nt, hsa
auaggagaccuaucgucuuggaacuugccauucuuuccuccagaacaaaauguuaacuuucuaacac

SEQ ID NO: 241835 - RNA, 67 nt, hsa
acgcacagacagguuuucacauaaaugcagcccauuucuccagaacccauuugaggggugggggggu

SEQ ID NO: 241836 - RNA, 63 nt, hsa; identical to SEQ ID NO: 240818

SEQ ID NO: 241837 - RNA, 67 nt, hsa
cuuaaggcugcuugguacugaguauacuuaaauauaacuccagaauccagggacuugguguuaaaac

SEQ ID NO: 241838 - RNA, 67 nt, hsa
cauuacgccucaacauauacuugugcucuuccuuugccuccagaagaaguuuuuccuugauugugcu

SEQ ID NO: 241839 - RNA, 67 nt, hsa
gagacugccuccaccacaggcauccugcaaaugcagacuccagaauccccagcaucagcgggaacca

SEQ ID NO: 241840 - RNA, 67 nt, hsa
ccaugucugcuggcaccuugaucuuggaccucccagccuccagaacugugagaaauaaauguguuuu

SEQ ID NO: 241841 - RNA, 67 nt, hsa
agucauacaacauacuuaaugcagggcuacacugaaccuccagaaucauuuuguuugcuuugacccu

SEQ ID NO: 241842 - RNA, 67 nt, hsa
acauucuuucacauggcuacugggaauauaaauuucgcuccagaaaggccguagcaguuugacgaua

SEQ ID NO: 241843 - RNA, 67 nt, hsa
agggcucuuaugagucauuuuuuucaaaagaugaaaacuccagaaacgcacaggaacgaaauaccuc

SEQ ID NO: 241844 - RNA, 67 nt, hsa
uuguuauugguaaucuuuucugugaauauuagguuuccuccagaaauaguccguuauuugggaaagu

SEQ ID NO: 241845 - RNA, 67 nt, hsa
cuggccuggguugucucaaauccuguccacaaggcaacuccagaagaaagaagcccuuuacauuucc

SEQ ID NO: 241846 - RNA, 67 nt, hsa
aacaaaguugcaggcacaacaguuuaagaaugcauuccuccagaagaguaucuggucagguugaccc

SEQ ID NO: 241847 - RNA, 52 nt, hsa; identical to SEQ ID NO: 240829

SEQ ID NO: 241848 - RNA, 67 nt, hsa
acauuaugaggcucugauuuccuaucccaguuuagggcuccagaaaagccauucucccaaacuaaug

SEQ ID NO: 241849 - RNA, 67 nt, hsa
cccccuuucacaggcagccagugcccugagccagggucuccagaaagccccacccaggccaggcaug

SEQ ID NO: 241850 - RNA, 67 nt, hsa
cauuugcauaugaugccagccucacgcauuuguauaucuccagaaauucagguaugccucaccaauu

SEQ ID NO: 241851 - RNA, 67 nt, hsa
uguguucugugguuucuuaggugaccuuagagcaagacuccagaaugaaauuccuaaagcuuuuagg

SEQ ID NO: 241852 - RNA, 67 nt, hsa
ucuugucauuggucaauaggggaggguagauuagcugcuccagaauucaauaaaguguaauauuucu

SEQ ID NO: 241853 - RNA, 67 nt, hsa
guuguguuuuucaauuguugacauuucagaggggacccuccagaagcccagccggcuucccccaagg

SEQ ID NO: 241854 - RNA, 67 nt, hsa
ggguggaggugguguucuauaccuaaaggaugaccugcuccagaaacagcaccagcacagcauguau

SEQ ID NO: 241855 - RNA, 67 nt, hsa
ucaauucacacaugacuaccuuugagcuaaugacugucuccagaaaauaacugugccccaagaagug

SEQ ID NO: 241856 - RNA, 67 nt, hsa
cuaaauaugccagguagacaccagcccaaguacccuccuccagaagucugugacuaccuugucacua

SEQ ID NO: 241857 - RNA, 67 nt, hsa
aacacugaaaauguuuuguuagcuuuuccuucuuucucuccagaagaaacauggauagaugauagcu

SEQ ID NO: 241858 - RNA, 67 nt, hsa
augccugcucuaauuucuuuugcccauauaugaguaucuccagaaugucuacaaauaguuuuuguag

SEQ ID NO: 241859 - RNA, 67 nt, hsa
ugagguuugaggccaccaaaagaucaacagacaaaugcuccagaaaucuaugcugacugugacacaa

SEQ ID NO: 241860 - RNA, 67 nt, hsa
gaggccaucucgggcacaggcccaccccgccccaccccuccagaacacggcucacgcuuaccucaac

SEQ ID NO: 241861 - RNA, 67 nt, hsa
uuuccuauaaaguuaaacauacacuuuuacuuuaggacuccagaauuccacuucuaguuauuuauuc

SEQ ID NO: 241862 - RNA, 67 nt, hsa
uaugaccagaauucuucuguaauucugcccaugacuccuccagaauuuuaguagauacagggugggu

SEQ ID NO: 241863 - RNA, 67 nt, hsa
auuuguuuuauccaugaggaagauuuuuaacaaaagccuccagaagauuuccccucaguuuccauug

SEQ ID NO: 241864 - RNA, 67 nt, hsa
gaaaaagauauggugaaggcagaacugcucacaccagcuccagaagcacguccucugacuucacugc

SEQ ID NO: 241865 - RNA, 67 nt, hsa
gcuggagcagcccgccuagaacccagucuaaugagaacuccagaaagcuggagcagcccaccuagag

SEQ ID NO: 241866 - RNA, 67 nt, hsa
cucagcucuccucugggcccugccuucagccuccucacuccagaaacguguguuucccugaugcggg

SEQ ID NO: 241867 - RNA, 67 nt, hsa
gggacuaagucacagggaucugcugcagccacagcuccuccagaaagggacagccacggccaagugg

SEQ ID NO: 241868 - RNA, 67 nt, hsa
cccaaaaggcagaugacggggaguuaggcauggggagcuccagaaggucaccagagagcuuucagcu

SEQ ID NO: 241869 - RNA, 67 nt, hsa
cuuuuuugggggcggggggguggggaauucagccacacuccagaaagccaggagucgacaguuuugg

SEQ ID NO: 241870 - RNA, 67 nt, hsa
agaggacucccugacaaaagugaagaauuaacuucuccuccagaacaagugcaauucagaaggcagc

SEQ ID NO: 241871 - RNA, 67 nt, hsa
gacccuucccaccugagcaugcugacccccuuccuaccuccagaauaaagaaucucaaccuggaggg

SEQ ID NO: 241872 - RNA, 67 nt, hsa
ggaaagccagcagcugugguacuccagacaaaaggaucuccagaaagccgccuguccuuccagcaug

SEQ ID NO: 241873 - RNA, 67 nt, hsa
gaauccaagcucccugccccaaauaacuucaguccugcuccagaauuuggaaauccuaguuuccucu

SEQ ID NO: 241874 - RNA, 67 nt, hsa
gcuacagaguuccuucucacccagacacacuagugcucuccagaaucucugcccaggaggcagggga

SEQ ID NO: 241875 - RNA, 67 nt, hsa
cgccagucacugcugcaagguggccucugccuggggccuccagaagcugcuccuuuacccucuuggu

SEQ ID NO: 241876 - RNA, 67 nt, hsa
cccugccggaagggagcccccugcuccucccaacaaacuccagaacagcagaaagcgggugcuguag

SEQ ID NO: 241877 - RNA, 67 nt, hsa
guggaagaccaagacaccuggggauugcgucuggggccuccagaacucugcuguggacugcaucagg

SEQ ID NO: 241878 - RNA, 67 nt, hsa
aguguggccuggaguauuuauauggugcuuaaugaaucuccagaaugccagccagaagccugauugg

SEQ ID NO: 241879 - RNA, 67 nt, hsa
cauuuucagaauaauuauugcauaguagaauuuauuacuccagaacagaaagaccuuacuucauuuc

SEQ ID NO: 241880 - RNA, 67 nt, hsa
acucuccucuucaucucagcauucuccaucacuuccccuccagaaaaacggauggaaggaagcccuc

SEQ ID NO: 241881 - RNA, 67 nt, hsa
uuccccaaggagcuucagggcaguccuucuggcacugcuccagaauuccuccuucuuggugugucug

SEQ ID NO: 241882 - RNA, 67 nt, hsa
uacccuagauacuguguuaugugcaacuguagaaacccuccagaaauuuccacugcuguucuucacu

SEQ ID NO: 241883 - RNA, 50 nt, hsa; identical to SEQ ID NO: 240865

SEQ ID NO: 241884 - RNA, 67 nt, hsa
ucccaccacacagacucugggccuccccgcaaaauggcuccagaauuagaguaauuaugagauggug

SEQ ID NO: 241885 - RNA, 67 nt, hsa
caucaaauggcaacauggaauauuguccuccaugccccuccagaaggaccuaggagaguaggugagc

SEQ ID NO: 241886 - RNA, 67 nt, hsa
aaacaaggcgucgaggaauuggaaagauuugcacacccuccagaaaggagagacgcaaucuccccuc

SEQ ID NO: 241887 - RNA, 67 nt, hsa
guauaaugcuuauuaugaguuuaagaagcaguucuuccuccagaaagaagggggcgauagcaugcag

SEQ ID NO: 241888 - RNA, 67 nt, hsa
ugagccgcagcccuggggccaguaggaagcggacccgcuccagaaguccccacgagaagaagaagaa

SEQ ID NO: 241889 - RNA, 67 nt, hsa
gagggacuguguugacugacgagccgagggguggccgcuccagaagggugcccagucaggccgcacc

SEQ ID NO: 241890 - RNA, 67 nt, hsa
uacccaucauucauucucaagaccucugaaggguuggcuccagaacuuagaccuuugcuuaugcaaa

SEQ ID NO: 241891 - RNA, 67 nt, hsa
gaucagcagauacaugucagugcagagguucucugcccuccagaagcccucgucugggaauucgaga

SEQ ID NO: 241892 - RNA, 67 nt, hsa
ccaccccaaucccaaauuuuguuuugguucuaacuaccuccagaauguguucaauaaaaugcuuuua

SEQ ID NO: 241893 - RNA, 67 nt, hsa
cccaccaccaccgacucucccaacccagacucucccacuccagaauguagaagccugucucuguacc

SEQ ID NO: 241894 - RNA, 67 nt, hsa
ucccauggacagagaagaaaaugaccaggagugucaucuccagaauuauuggggucacauauguccc

SEQ ID NO: 241895 - RNA, 67 nt, hsa
ucagucuucccaacuucuuacaccauugcuuuccauucuccagaacucuuuuuuccuuuuuacaaac

SEQ ID NO: 241896 - RNA, 67 nt, hsa
gagcaaaaggggcugggacacucugaacuccugcacucuccagaagugacuggucaugaagcucaug

SEQ ID NO: 241897 - RNA, 67 nt, hsa
auuuacucucuauuauugggcauaaagguggcuucugcuccagaacucuauccacuguauuuccaca

SEQ ID NO: 241898 - RNA, 67 nt, hsa
aagcacgugucucagacugcauguaccauuugcauggcuccagaaaugucuaaaugcugaaaaaaca

SEQ ID NO: 241899 - RNA, 67 nt, hsa
uucucugggagacuucucuguacauuucugccauguacuccagaacucauccugucaaucacucugu

SEQ ID NO: 241900 - RNA, 67 nt, hsa
cucaagugccuucugugaguuuaaaugugcuggugcccuccagaaaagccucggccucagcuccguu

SEQ ID NO: 241901 - RNA, 67 nt, hsa
ccaagggauguaucagggaugaucagcugaugagaggcuccagaaggauuucuagaucgcuucaagc

SEQ ID NO: 241902 - RNA, 67 nt, hsa
gauguuuaagcuagcuuuaccuaagccacuucucagccuccagaauacucucucugggguugugagu

SEQ ID NO: 241903 - RNA, 67 nt, hsa
augcuacaggggcacauuuucugugguuaaaaaugaucuccagaauaaguguaaacugcaguuuucc

SEQ ID NO: 241904 - RNA, 67 nt, hsa
guaaaauguagcugcgucauaaggagacuucugucuucuccagaaggcaauaccaaccugaaaguuc

SEQ ID NO: 241905 - RNA, 67 nt, hsa
aagaaagcugauagcuccuccauguugguaaaauccucuccagaaucuuggaacaccuggcauguga

SEQ ID NO: 241906 - RNA, 67 nt, hsa
uuguagcagugguuacccagacuuacagaauuauguccuccagaaaccagcaagaacacuuggaaug

SEQ ID NO: 241907 - RNA, 67 nt, hsa
uaagugugaucauuguugaacuucagcuccagugucucuccagaauaagacauuggcauucaaaugu

SEQ ID NO: 241908 - RNA, 67 nt, hsa
ggaauggagccugucucaggaaggccagcugcagguccuccagaaaaucaaagaagggaagaaacuc

SEQ ID NO: 241909 - RNA, 67 nt, hsa
uucaauaguuauccccaggccuggcacgucaaagaggcuccagaaauguuugcugagugagugauga

SEQ ID NO: 241910 - RNA, 67 nt, hsa
gaaguagcaaacuguacauuccuucuuccucccccugcuccagaaggugccgguacugaagaugcuc

SEQ ID NO: 241911 - RNA, 67 nt, hsa
ucagauacucucuuugccagaugaaguuacuugcuaacuccagaaauuccugcagacauccuacucg

SEQ ID NO: 241912 - RNA, 67 nt, hsa
uucugcccuggcucugcacauaaguguuagccagcagcuccagaaaaaucccgauucccgggaucug

SEQ ID NO: 241913 - RNA, 67 nt, hsa
cuuugagaaauagagaaauauaaaaguguguucuuaacuccagaaccacucuuuuugcauaaauacc

SEQ ID NO: 241914 - RNA, 67 nt, hsa
uccaguuuacugaacuccagaccaugcauguaguccacuccagaaaucaugcucgcuucccuuggca

SEQ ID NO: 241915 - RNA, 65 nt, hsa
cuaucccaguaaaagauaugauauuuuccauagauaccuccagaauuuuuuucagcaaauggaau

SEQ ID NO: 241916 - RNA, 67 nt, hsa
caagaggaacgguguuauggacugaauguucauguuccuccagaauucauaugcugaagccucuguc

SEQ ID NO: 241917 - RNA, 67 nt, hsa
cugcgucugcuggcaccuugaucuugaacuucccagccuccagaacugugagaaagaaaucucuaug

SEQ ID NO: 241918 - RNA, 67 nt, hsa
uccagugggaccuuguaaaaugcucccugucagagcucuccagaauaugcuuguuggagauccuuca

SEQ ID NO: 241919 - RNA, 67 nt, hsa
gcuaacggugagggcugacucugaacugucucucagucuccagaaaguguucaagccuguuguguuc

SEQ ID NO: 241920 - RNA, 67 nt, hsa
uugaaaaggaauuagagggucagaaacacccagguuccuccagaaagcuccuuggagcccaacaacu

SEQ ID NO: 241921 - RNA, 67 nt, hsa
auguagaaagaugugagauaacuuacucaagauuccccuccagaaaaauacguauguuuaaaaaccc

SEQ ID NO: 241922 - RNA, 67 nt, hsa
uuauguuuuaugauauggguuagggauucuccauggacuccagaaacccuaaaauacaauuuugagg

SEQ ID NO: 241923 - RNA, 67 nt, hsa
uugcugcugcauuuaucccaagaaaaacagcuuuaaucuccagaagaaaaccaaaauaccaugggau

SEQ ID NO: 241924 - RNA, 67 nt, hsa
gaaugagugacaaaucuuuaaaguauuuacaauaucacuccagaaaagaaaacaaaucaaauaaaua

SEQ ID NO: 241925 - RNA, 67 nt, hsa
auccaagcuucgaaagauaucccaaaaauuucagugacuccagaagaaaugagccuccaccaccaag

SEQ ID NO: 241926 - RNA, 67 nt, hsa
ucuugaccuaaucagcuuacaguuugaaaaccuagcucuccagaacaugagaugagccagccgagcc

SEQ ID NO: 241927 - RNA, 67 nt, hsa
acccuccucuacccaaagcucugucccccugcucccacuccagaagaacugcggcacgcgcuucggg

SEQ ID NO: 241928 - RNA, 67 nt, hsa
cacuugaccucaucucccgagcaauggcgccugcucccuccagaauggaacucaagcugguuuuaag

SEQ ID NO: 241929 - RNA, 67 nt, hsa
ucuggcccucuuucucccagugauuacaucuaaggaccuccagaagcaugggaacaucugggugugc

SEQ ID NO: 241930 - RNA, 67 nt, hsa
cccuccgcaccccgccccaugccccaguccuuuccuacuccagaaaugcuccccacccccccaaaga

SEQ ID NO: 241931 - RNA, 67 nt, hsa
gggaaccuuccaaggugucugguugcccugccucuggcuccagaacagaaagggagccucacgcugg

SEQ ID NO: 241932 - RNA, 67 nt, hsa
uucccaccaacuccuauuucccuaccaaccaaggagccuccagaaggaaaggaggaagaaauguuuu

SEQ ID NO: 241933 - RNA, 67 nt, hsa
aggaccucaaccccagggauucccaggaagcagaacucuccagaagaaggguuuugaucauuccagc

SEQ ID NO: 241934 - RNA, 67 nt, hsa
cacugcccugccucaacaggguccauugccuccucgccuccagaacuuggagcagggaagugggcac

SEQ ID NO: 241935 - RNA, 67 nt, hsa
cccuggaaagauauagcauagugguucucagcacagucuccagaacagaagcaucuguaguaccugg

SEQ ID NO: 241936 - RNA, 67 nt, hsa
acggagacauugaccccucccuccaugugguaaaccacuccagaauggccaccaggcuucccagagu

SEQ ID NO: 241937 - RNA, 67 nt, hsa
uaacuuguguuacaucuauaaagagcaaaauaacacacuccagaacuuggcaguuguagcauuaguu

SEQ ID NO: 241938 - RNA, 67 nt, hsa
guggagcucauguuugugauccucuaucuggacagcucuccagaauccuguguugccccuguucugc

SEQ ID NO: 241939 - RNA, 67 nt, hsa
augagaaugugccaugcaugaagcaaaggauuccaggcuccagaaaaaaugaaugaacucaccuuga

SEQ ID NO: 241940 - RNA, 67 nt, hsa
gagaagcugggcaggacaaguaggacaucccuggagccuccagaagggacuggccucugcccacacc

SEQ ID NO: 241941 - RNA, 67 nt, hsa
ugcagagggagugugcgaaucaagccugaccaagaggcuccagaauaaaguaugauuuguguucaau

SEQ ID NO: 241942 - RNA, 67 nt, hsa
uggggaagaagacacagaagccuuugauauugccacccuccagaauccugaugguaucaauggauuu

SEQ ID NO: 241943 - RNA, 64 nt, hsa; identical to SEQ ID NO: 240925

SEQ ID NO: 241944 - RNA, 67 nt, hsa
uaggaccuggcagcuuuucuugccgucccuccccugccuccagaaucacagcccuucuccccaaggg

SEQ ID NO: 241945 - RNA, 67 nt, hsa
auaagugccggugacaagcugucugucaggggagaggcuccagaaccuggguucguccccagugaga

SEQ ID NO: 241946 - RNA, 67 nt, hsa
acgcacacggcgucaaaaccaagcugccggccacugucuccagaacgcaaggcuccaggcccgugug

SEQ ID NO: 241947 - RNA, 67 nt, hsa
guguucugcugagacugagcaccuuacagauauuuuucuccagaagauggugcuggguaauaaaauc

SEQ ID NO: 241948 - RNA, 67 nt, hsa
ccccauccccuuuccuccccaccuuccccagacucagcuccagaauaccuucuucgcugcuagagaa

SEQ ID NO: 241949 - RNA, 67 nt, hsa
uccuauuauucgcuccaagaaagaugcuaagucugagcuccagaagagacugugcuggguguggcuu

SEQ ID NO: 241950 - RNA, 67 nt, hsa
ggcgaggugccgccuuggccgggcccccacgugucuucuccagaaugugucugucuuugccuggugu

SEQ ID NO: 241951 - RNA, 67 nt, hsa
aucagcgacacacacacacuuauggcaccagccuggacuccagaaaaaggguguccagguauugugu

SEQ ID NO: 241952 - RNA, 67 nt, hsa
gcagagcuggagcucgaucaugccugcgugacaaagccuccagaaaaauccuugaaagacaggacau

SEQ ID NO: 241953 - RNA, 67 nt, hsa
gacuugcggccacagcacuagagucacccccccaggccuccagaaccuuacuggcacuguggcacug

SEQ ID NO: 241954 - RNA, 67 nt, hsa
uaaaugaucuguacuaucuagugucuaaaacacuauucuccagaaaaaucaaucauuuucuagcccu

SEQ ID NO: 241955 - RNA, 67 nt, hsa
uuggacaaugaauguaguuaacugguuccugcucacacuccagaauuaaauucuauugaaaaaggaa

SEQ ID NO: 241956 - RNA, 67 nt, hsa
gcuuugcagaucacagugcuggaagcaggaacccaggcuccagaagguguugccaggggcccagaug

SEQ ID NO: 241957 - RNA, 67 nt, hsa
agucaaagaugaacaucggaauaacaaacauuguccucuccagaaaguccuuucuuucuccauacug

SEQ ID NO: 241958 - RNA, 67 nt, hsa
cagucucaggauuuagaaagucuguaagccauccaugcuccagaaagcaccgaucuguuguaguugc

SEQ ID NO: 241959 - RNA, 67 nt, hsa
agagcguggaggcgugugcaggcuuggaagaagaacucuccagaacauggaacuuaacccucuuuug

SEQ ID NO: 241960 - RNA, 67 nt, hsa
gaaacugaggccagagggaggagagaauugcucauggcuccagaacugguggcaaguuucucuggac

SEQ ID NO: 241961 - RNA, 67 nt, hsa
agcuucuggauacagccuuuuggguaaacacugggaacuccagaaguuguggggagaguggggaauc

SEQ ID NO: 241962 - RNA, 67 nt, hsa
agcucccccuucaccccuccuugcccgccuacccucccuccagaauagccccucacccuucuucccc

SEQ ID NO: 241963 - RNA, 67 nt, hsa
uggaggguaacuggggggccaccaugaccccuucucucuccagaaacagcugcuucuccccccaucc

SEQ ID NO: 241964 - RNA, 67 nt, hsa
agugccuucuucauccuuccuuacgaucaaucacagucuccagaagaucagcucaauugcugugcag

SEQ ID NO: 241965 - RNA, 67 nt, hsa
agcagcaagggggaccgaugcugugcagcucacaccacuccagaaccugacaaggcaccagcaggac

SEQ ID NO: 241966 - RNA, 67 nt, hsa
gucccuccuggucgugccccgucucuuuugguccuggcuccagaaaacccgcgccccacauaccugc

SEQ ID NO: 241967 - RNA, 67 nt, hsa
aaaguguggacacuuuugacagcuuggcagauuuuaacuccagaagcacuuuaugaaaugguacacu

SEQ ID NO: 241968 - RNA, 67 nt, hsa
aggcuuguuccaaguuugucaaugagguuuauggagccuccagaacagaugccaucuuccugaaugu

SEQ ID NO: 241969 - RNA, 67 nt, hsa
ggcauguuccugccccacaggaauagaauggagggagcuccagaaacuuuccaucccaaaggcaguc

SEQ ID NO: 241970 - RNA, 67 nt, hsa
uccugcaaaccucacaggguccccacacaacagugcccuccagaagcagccccucggaggcagagga

SEQ ID NO: 241971 - RNA, 67 nt, hsa
aagaacucaugguuuuaaauauagaccaucaucgaaacuccagaaauuuauccacuguggaugauga

SEQ ID NO: 241972 - RNA, 67 nt, hsa
cuaucccacacccacccccaccccacccccacccagccuccagaagcuggaaccauuucucccgcag

SEQ ID NO: 241973 - RNA, 67 nt, hsa
gggaaaagcagcucuccccucagagugcaagccccugcuccagaagauagcuucaccccaaucccag

SEQ ID NO: 241974 - RNA, 67 nt, hsa
aggggagauggggaggagauauggagugagucaccugcuccagaagaugccagcuucucucuccagg

SEQ ID NO: 241975 - RNA, 67 nt, hsa
ggauucugcccuucacuuagcaccugccucagccccacuccagaauagccaagagaacccaaaccaa

SEQ ID NO: 241976 - RNA, 67 nt, hsa
gacuugagcccauugaaacugaucuugagcuccuggccuccagaauugcaggagaauaaauuugugu

SEQ ID NO: 241977 - RNA, 67 nt, hsa
cgggaggugucuacugaaaagggaaccugcuucuuuacuccagaacucuguucuuuaaagaccaaga

SEQ ID NO: 241978 - RNA, 67 nt, hsa
auaggaaggaaaaugaagagagccaguauuuccccuucuccagaagcagguacucagcuuucuggga

SEQ ID NO: 241979 - RNA, 67 nt, hsa
gcggaaucccccgcugcagggacacccacgcccuucucuccagaagccgggcaggcagaauccggcc

SEQ ID NO: 241980 - RNA, 67 nt, hsa
ugucgagggagaggaggggguuggggaggacccaccucuccagaauggcgacuguccccauccgccu

SEQ ID NO: 241981 - RNA, 67 nt, hsa
aaggcaucuaaguuagagcuggcaccagaacugagaccuccagaaaucuauuccaguauuuuuucca

SEQ ID NO: 241982 - RNA, 67 nt, hsa
uuuucuguccugcuuugccuuuugucacuagaauguucuccagaaaccccaguuucugucaucuuaa

SEQ ID NO: 241983 - RNA, 67 nt, hsa
uuucauucucagaaaauccaaccauaucuuagaguaucuccagaaacuggcuuagaggagcuccaaa

SEQ ID NO: 241984 - RNA, 57 nt, hsa; identical to SEQ ID NO: 240966

SEQ ID NO: 241985 - RNA, 67 nt, hsa
acuggugauacuccaacaccguccaguuguggcagcucuccagaaguaauagcagcugacaacuuuc

SEQ ID NO: 241986 - RNA, 67 nt, hsa
cucagcaagggcucagcugggaucugcgcccggccugcuccagaacgcagcccacucgccaccggug

SEQ ID NO: 241987 - RNA, 67 nt, hsa
gaggggguuugcuggggaacuggcgccaucgccgggacuccagaaccgcagaagccuccccagcuca

SEQ ID NO: 241988 - RNA, 67 nt, hsa
ccugcccugcccucuccucacaggucuguugcagggacuccagaaaccauucugggagccguggaug

SEQ ID NO: 241989 - RNA, 67 nt, hsa
uucugguucaugaugcauaaagcgcuaggcccuagaacuccagaaacagcacagcuggggcggggac

SEQ ID NO: 241990 - RNA, 67 nt, hsa
ggggccacagccacaccucaccgcccaguccagcugucuccagaaggggacaggcaguccgcggucu

SEQ ID NO: 241991 - RNA, 67 nt, hsa
cacuuuggccaccaguucuucggccagcaccucugcccuccagaaccugcagccuggaggggugagg

SEQ ID NO: 241992 - RNA, 67 nt, hsa
gccccagcccggagcccagcccccugccccggcccugcuccagaacccagcccagaucggaggacaa

SEQ ID NO: 241993 - RNA, 67 nt, hsa
ucucuagaacccaauccaauuuggagccccagcccaacuccagaacccaacccuucucuagaaucca

SEQ ID NO: 241994 - RNA, 67 nt, hsa
accccggcugggucugcguccuuuccugugccuuucccuccagaaugcggccucagaccuagaagcu

SEQ ID NO: 241995 - RNA, 64 nt, hsa; identical to SEQ ID NO: 240977

SEQ ID NO: 241996 - RNA, 67 nt, hsa
uuuaauuuucucggaggugauaggcuuccacacaggucuccagaagcccugcauugaauauccaucc

SEQ ID NO: 241997 - RNA, 67 nt, hsa
guacuguuccagcaucuucccuggauggcuggaggaacuccagaaaauauccaucuucuuuuugugg

SEQ ID NO: 241998 - RNA, 67 nt, hsa
caagccagcuccacugcccaggcccccaagagggcagcuccagaagcugcccagggcuccgggaccc

SEQ ID NO: 241999 - RNA, 67 nt, hsa
uccucccuuaggggcugaggaagcugcccucgaaacccuccagaagacaucuguccugcagaggccc

SEQ ID NO: 242000 - RNA, 67 nt, hsa
aauauccuuauccaaaucaauaaagagagaauccucccuccagaaggguuucuaaaaacagcccuca

SEQ ID NO: 242001 - RNA, 67 nt, hsa
ugagucuaggacagauuuuacguggagaguugaacuacuccagaaacuaaagaguaauguuucuaga

SEQ ID NO: 242002 - RNA, 67 nt, hsa
ugcugugagaccuccuggaacacuggcaucucugagccuccagaagggguucugggccuaguugucc

SEQ ID NO: 242003 - RNA, 67 nt, hsa
uaggccccgccuggcacucagccuugccagagauuggcuccagaauuuuugccaggcuuacagaaca

SEQ ID NO: 242004 - RNA, 67 nt, hsa
gggagagagggucucucuccuagcugcuacccaggaccuccagaaggagcccuuggaccucugggag

SEQ ID NO: 242005 - RNA, 67 nt, hsa
cucauacuaagugcuuaguaaauguuagauaaguauucuccagaauugauguaaauuauuuuuaaac

SEQ ID NO: 242006 - RNA, 67 nt, hsa
uaauguuauauaaauuccacauuuuuaugcaacuaaucuccagaacauuuuuccucuuaccaagaag

SEQ ID NO: 242007 - RNA, 67 nt, hsa
agcuggaguggcacaggugacccaggcguccuuucagcuccagaauguugcaagucuaggagagugu

SEQ ID NO: 242008 - RNA, 67 nt, hsa
cacacgcugggcuucacggcugccaggagccucuccccuccagaagacuugccugcuagggaccucg

SEQ ID NO: 242009 - RNA, 67 nt, hsa
uccuagagugaggcucuguccaauacauggcucugcccuccagaacuucaggcucucagugacccuu

SEQ ID NO: 242010 - RNA, 67 nt, hsa
accaacccugucuccaccuugauauugcacuuccaggcuccagaacugugaggcaauaaauuucucu

SEQ ID NO: 242011 - RNA, 67 nt, hsa
gacuauggucacagggccguccuguuccuccccgggacuccagaauuucucuccucaaaggaaagaa

SEQ ID NO: 242012 - RNA, 67 nt, hsa
aggaucucgggcugccagcgaugggcaggcgagaccccuccagaaucugcaggcgccucugguucuc

SEQ ID NO: 242013 - RNA, 67 nt, hsa
cauagcggacgggggucccgagguggaaaccauugcccuccagaacaaccgugagaaccaggcauuc

SEQ ID NO: 242014 - RNA, 67 nt, hsa
cuuaaacuucuaggcucaagcaucuaccugccucagccuccagaagugcugggauuacaaaugugag

SEQ ID NO: 242015 - RNA, 67 nt, hsa
guuuagucaaacucucauuuaggugacagccuggugacuccagaauggagccagucaugcuaaaugc

SEQ ID NO: 242016 - RNA, 67 nt, hsa
cagggccgggugucuuuagggaucaguuuuuccaagacuccagaaggugccagguucuccccuugag

SEQ ID NO: 242017 - RNA, 67 nt, hsa
uugaagguaacugagagcagaugguccuccauuucaacuccagaaguggggcucugggagggauguu

SEQ ID NO: 242018 - RNA, 67 nt, hsa
ugcacuccagaauccacaaagccgugccuuucucuggcuccagaauaugcauaaucagcgcccugga

SEQ ID NO: 242019 - RNA, 67 nt, hsa
cuccacccccuccagcuccaguuuccaaguuccugcacuccagaauccacaaagccgugccuuucuc

SEQ ID NO: 242020 - RNA, 67 nt, hsa
aagcacaggaaaccaggcagaggaggcacagggugcucuccagaacgagaagccagcuccuggaguu

SEQ ID NO: 242021 - RNA, 67 nt, hsa
gugggagaauuagagaauuuauuugugucagaaaauacuccagaacaaccaccccauauuaugauua

SEQ ID NO: 242022 - RNA, 67 nt, hsa
acccagaucucauacucaacagaaggagacucagagacuccagaaggcacaggagcugcccccagug

SEQ ID NO: 242023 - RNA, 67 nt, hsa
auuuccucaacacuugagggcccagaaagucugaucucuccagaaugaucagcccagaggaaugcug

SEQ ID NO: 242024 - RNA, 66 nt, hsa
uguuguaaauuaggaggcucaacaauaaaacauuaugcuccagaaauuaugugagaugugcuauau

SEQ ID NO: 242025 - RNA, 67 nt, hsa
acaaaucuguaagcaccuugaucuuggacuucucagccuccagaauugugagaaauaaauuucuguu

SEQ ID NO: 242026 - RNA, 67 nt, hsa
aucggagacaagcauggugcugcugcuucugcugcuucuccagaaaaucccugggacaccuuuguuc

SEQ ID NO: 242027 - RNA, 67 nt, hsa
agcucuuugcaggcguccaauccuagaaaccaauggucuccagaacucucacacaaguguuuuucug

SEQ ID NO: 242028 - RNA, 67 nt, hsa
acacugacuggcauccugcuuuccagugccugccagccuccagaagagccaggugccugacuaguac

SEQ ID NO: 242029 - RNA, 67 nt, hsa
cugcguuguuaguuuugaagaguggaggagcuaggggcuccagaaagaaucuuacacauguguugaa

SEQ ID NO: 242030 - RNA, 67 nt, hsa
acaucuuaucccuugaauuuucaauauuguggaaucacuccagaagauccuuucaugugaaguuuuu

SEQ ID NO: 242031 - RNA, 67 nt, hsa
ucuggcccaacauacgcacugggcauuggguaagggacuccagaagcagcagcuagaaagagaaaaa

SEQ ID NO: 242032 - RNA, 67 nt, hsa
uaccuucuggccccaacccuugacucaacggggacaacuccagaaggucauuccagauccagagauc

SEQ ID NO: 242033 - RNA, 67 nt, hsa
ggcuccugugugccccuggcuuucugggucugugccucuccagaaucuugucuuacccuccggugug

SEQ ID NO: 242034 - RNA, 67 nt, hsa
cuuugguggggggaccccaaagccauucugggaagggcuccagaagaagguccagccuaggcccccu

SEQ ID NO: 242035 - RNA, 67 nt, hsa
cagcacaagucuugcuaaaugugauacuguugacauccuccagaauggccagaagugcaauuaaccu

SEQ ID NO: 242036 - RNA, 67 nt, hsa
cugcaccuacugauguuuugauguugaacuucccagccuccagaacucugggaaaauaaaguccucu

SEQ ID NO: 242037 - RNA, 67 nt, hsa
uggacuggcuagaguccucacucccaguccaaauguccuccagaagccucuggcuagaggccagccc

SEQ ID NO: 242038 - RNA, 67 nt, hsa
uguuuggaaacauuuaauuuauaccccucuccucugucuccagaagcuucuagcucuggggucuggc

SEQ ID NO: 242039 - RNA, 67 nt, hsa
uccaucuccuggauucaaacaauucuccugccucagccuccagaauagcugggauuacaggcguaca

SEQ ID NO: 242040 - RNA, 67 nt, hsa
caggauaccaugggaaggagccaucuccacucuccuucuccagaacccccuugaagggccuuuggga

SEQ ID NO: 242041 - RNA, 67 nt, hsa
uagcaaguguucaguaaauauuugcugcuugaaucugcuccagaauuaacaagaaagccaucucuuc

SEQ ID NO: 242042 - RNA, 67 nt, hsa
ccccaucuccuaccccacauccugucuuagccgcagucuccagaacccaugaugaacugugaucugc

SEQ ID NO: 242043 - RNA, 63 nt, hsa; identical to SEQ ID NO: 241025

SEQ ID NO: 242044 - RNA, 67 nt, hsa
gauuucuauaacagaagugacauguguacugauuuuucuccagaaauauggaugcuguuguauucag

SEQ ID NO: 242045 - RNA, 67 nt, hsa
gauuccuaggccuuuucaugcuucauuucuuccacuucuccagaaaauggaagcuaugaagcaacau

SEQ ID NO: 242046 - RNA, 67 nt, hsa
ccucuuccuccacacaggucgccgugagucaagcugccuccagaaccucagagcuucccuggugggc

SEQ ID NO: 242047 - RNA, 67 nt, hsa
aggcugaccgggcuguucuguagacucaggaccguggcuccagaacuccugugccaggcgggaggga

SEQ ID NO: 242048 - RNA, 67 nt, hsa
uggguccggccggagaggccucccgcggacgccgucucuccagaacuccgcuuccaagagggagccu

SEQ ID NO: 242049 - RNA, 67 nt, hsa
ccugcuauccugggagaucuaccugaaggagaacuaccuccagaaccgacaguuccagcaaaagcag

SEQ ID NO: 242050 - RNA, 67 nt, hsa
caggcgcaucccacucuaugcgaaccacaagacccuccuccagaaggcagccgcugaguucggggcu

SEQ ID NO: 242051 - RNA, 67 nt, hsa
uggggggugcagggggcugugggcauccagcgucauccuccagaaccucacaucugaacugggggca

SEQ ID NO: 242052 - RNA, 67 nt, hsa
gacuagauugcuuugugaagcucuugguagagacacgcuccagaagggauaacaaaaucaaauagua

SEQ ID NO: 242053 - RNA, 67 nt, hsa
gaggaagcacagcccugcuugaauucaaacuuuuggccuccagaacugugagucaguaccuguuguu

SEQ ID NO: 242054 - RNA, 67 nt, hsa
cuguagacaggcuggauuccaguguugggacagccaucuccagaaaccugacuuaagagaguaagau

SEQ ID NO: 242055 - RNA, 67 nt, hsa
ccaugcugguucccggaaugaaucagcugcugacugucuccagaagggcuggaaaggaugcugccag

SEQ ID NO: 242056 - RNA, 67 nt, hsa
ugauguggaaacaaagcaggaccagcaggcacagcaccuccagaacagugccccggaugaccagagg

SEQ ID NO: 242057 - RNA, 67 nt, hsa
cugucugccuucuggcugacaauccuggaaaucuguucuccagaauccaggccaaaaaguucacagu

SEQ ID NO: 242058 - RNA, 67 nt, hsa
ccauccauagggagcuggcuggggguuuccgugggagcuccagaacuuuccccagcugagugaagag

SEQ ID NO: 242059 - RNA, 67 nt, hsa
accaauaggacaauuugcugaggucugagaggacucccuccagaaaaucccugaucucuuaaaauuu

SEQ ID NO: 242060 - RNA, 67 nt, hsa
ccaagcugcagccuacugaggaggcagaggccaccuccuccagaaagcccucggccugggccgccgc

SEQ ID NO: 242061 - RNA, 67 nt, hsa
aaaaacugccuuucuuccccucaagucaacuuuugugcuccagaaaauuuucuauucuguaagucug

SEQ ID NO: 242062 - RNA, 67 nt, hsa
cgggaagauccugcggcuggggccgucugccuacacgcuccagaagggccagcgcagagcugggaug

SEQ ID NO: 242063 - RNA, 67 nt, hsa
ucucccgugacugcugccucaucgauaccccauuuagcuccagaaagcaaagaaaacucgaguaaca

SEQ ID NO: 242064 - RNA, 67 nt, hsa
ugaucaccgaggcucccgugacuuugaacucccuacucuccagaauccaggggcuauagcgaugggg

SEQ ID NO: 242065 - RNA, 67 nt, hsa
ggggucuccucugcagcucagggacuggcacacuggccuccagaagggcagcuccacagggcagggc

SEQ ID NO: 242066 - RNA, 67 nt, hsa
ggcugugccucccauuuccccucaccuguacccacaccuccagaaugcccugcccugcgaguguguc

SEQ ID NO: 242067 - RNA, 67 nt, hsa
auguuaaacuggcuuacuauagacuucguaaaaauggcuccagaagaguaacaaacugaaaucuuug

SEQ ID NO: 242068 - RNA, 67 nt, hsa
aaauucugucuggggacgaaggguuggacgggaugaccuccagaagucccuucaauuucuaguaccu

SEQ ID NO: 242069 - RNA, 67 nt, hsa
ggccuuagccuccagguccagacuacuacucuauguucuccagaagggugcuaagucaccuacugaa

SEQ ID NO: 242070 - RNA, 67 nt, hsa
uucugccuaugaggcaucuggccccugguagccagcucuccagaauuacuuguagguaauuccucuc

SEQ ID NO: 242071 - RNA, 60 nt, hsa; identical to SEQ ID NO: 241053

SEQ ID NO: 242072 - RNA, 67 nt, hsa
caggcaaggccagagacuucaagucuaucugaaaagucuccagaagucuaaccccagauaaauagcc

SEQ ID NO: 242073 - RNA, 67 nt, hsa
aaggcuauuuuccaacugaagucagggacauugccagcuccagaaaacauccauaacauaguaaaga

SEQ ID NO: 242074 - RNA, 67 nt, hsa
uucuauaaagaaucauuagaaauuaugaguggaaauucuccagaaagauaguauuauagagucuuuu

SEQ ID NO: 242075 - RNA, 67 nt, hsa
gaagguuuuuuuaaaaaagaggacuugcaucagcugccuccagaacaauuuuaagaaaauaacaaag

SEQ ID NO: 242076 - RNA, 67 nt, hsa
ggagcugcucuccuguauuauccuccacaauaaaauucuccagaaaauaagucccagugucugcugu

SEQ ID NO: 242077 - RNA, 67 nt, hsa
aaaggagaaggguaguuugaggugugacaccaguuugcuccagaaaguuuaaggggucuguuucuca

SEQ ID NO: 242078 - RNA, 67 nt, hsa
ugguucaguccuagcaagaagcgagaauucugagauccuccagaaagucgagcagcacccaccucca

SEQ ID NO: 242079 - RNA, 67 nt, hsa
ccaggaagggaaggggggucagaagagagggugaguccuccagaacucuuccuccaaggacagaagg

SEQ ID NO: 242080 - RNA, 67 nt, hsa
aagaaaaaggucaagauuucuaucacuuccccgucuucuccagaacuugugucuccagaggaguacg

SEQ ID NO: 242081 - RNA, 65 nt, hsa
ugguuuccuuuucuccucucucugcaucugcgcuuuccagauaagcccaaagacagcaacuucuc

SEQ ID NO: 242082 - RNA, 65 nt, hsa
gggugggcaccaggucaacccuucuccuccugcuguccagauacagggaagacucaggaugaggg

SEQ ID NO: 242083 - RNA, 65 nt, hsa
uuuuuaaaaaaccaaguagugucuuccuaccuaucuccagauacaugucaaaaaaagaaaggugu

SEQ ID NO: 242084 - RNA, 65 nt, hsa
ggcauaccuuuuuagcuucuguuuguggaguugucuccagauaagaggagaugugccuucccaau

SEQ ID NO: 242085 - RNA, 65 nt, hsa
agguagugccaaugacaggacauuugacaugagucuccagauagaugucguggacuccagcucua

SEQ ID NO: 242086 - RNA, 65 nt, hsa
gcuaaaguuuguuuuuccagggcugcugauccuuuuccagauagcuccagaguaugaugacccca

SEQ ID NO: 242087 - RNA, 65 nt, hsa
ggccuucuugucuucaaccuggccuguccagcccuuccagauauggccaaacccauggccuggau

SEQ ID NO: 242088 - RNA, 65 nt, hsa
cagaugauaugccaauuucagguggaaaauugcauuccagauaccggguucagauuugaaauugu

SEQ ID NO: 242089 - RNA, 65 nt, hsa
ggcaugcaacagacauuggauaaauguuaguuggauccagauauacacagaaagauaucugcuuc

SEQ ID NO: 242090 - RNA, 65 nt, hsa
uagccacuauucacagcuucucauuuguguagcuuuccagauauuuucgauuccacuguaagucc

SEQ ID NO: 242091 - RNA, 65 nt, hsa
ucugugaggcuucaguggccucagaaaccagaggguccagauagggggccugcuugggcccucug

SEQ ID NO: 242092 - RNA, 65 nt, hsa
uauuuauuuagcaacugcuaugugccuuucguuguuccagauaugcagagacaaugauaaauaaa

SEQ ID NO: 242093 - RNA, 65 nt, hsa
uggcauuagucauuauuuaguuuccaggccaaccauccagauagagauucccucuuuccuuugag

SEQ ID NO: 242094 - RNA, 65 nt, hsa
gaaagugagcgaggcaggcaggcaugaucccauuuuccagauaaggaaacaagccuagauaugcu

SEQ ID NO: 242095 - RNA, 65 nt, hsa
gaaaugugcaugcagaucagcuguugccuucaagauccagauaaacuuuccugucauguguuaga

SEQ ID NO: 242096 - RNA, 65 nt, hsa
uagaguacuuugguuugaaaacaacacuuagagccuccagauaacuuuuaagacuuauuuagcuu

SEQ ID NO: 242097 - RNA, 65 nt, hsa
gacaagaagccuaacagcaacuucuacauuaaguuuccagauaaggcuucugagaacuauaaaua

SEQ ID NO: 242098 - RNA, 65 nt, hsa
aagauuagcuauuauuuguaggacugaaauaauaauccagauaauugguuuuugccuauacuuca

SEQ ID NO: 242099 - RNA, 65 nt, hsa
uuuguuuaccucuuuucaucucaaagugggaaagcuccagauaacaugguacuuaggagugagug

SEQ ID NO: 242100 - RNA, 65 nt, hsa
uaaaaacuauaaaaacccauccccuaucuacuuaauccagauagccuggauuuaacaaaaccaau

SEQ ID NO: 242101 - RNA, 65 nt, hsa
agaccugggguuaaguguggguugugcauccccaauccagauaauaaagacuuuguaaaacauga

SEQ ID NO: 242102 - RNA, 65 nt, hsa
agauugcacuagcuugucucuaaaauugcugugacuccagauacuuugcacugaagagaaucuag

SEQ ID NO: 242103 - RNA, 65 nt, hsa
guucauuugacagagucaguauuuuuugccaaauauccagauaaccaguuuucacaucugagaca

SEQ ID NO: 242104 - RNA, 65 nt, hsa
uguguagagauauagcagcugaagcaggacuucauuccagauagcugugugcauuuaugucaugc

SEQ ID NO: 242105 - RNA, 65 nt, hsa
ccuacgggggcagcacacuuagauauuccuggacauccagauagcucacaugugcugaccacacu

SEQ ID NO: 242106 - RNA, 65 nt, hsa
gacuuugagccaagggaaagaaugaguacuaucuuuccagauaucuuaaggguaaaagcuuauuc

SEQ ID NO: 242107 - RNA, 65 nt, hsa
uauacagaugcuucucaacuuaugauggguuuagguccagauaagcccacugugaguugaaaaua

SEQ ID NO: 242108 - RNA, 65 nt, hsa
uggaaaacauacuacuauaauuuauuauuauaucuuccagauaauguuauucauuuagaacaaau

SEQ ID NO: 242109 - RNA, 65 nt, hsa
agcagauuaaccccaggcagaccgauaaaaagaccuccagauaggcagacagacagauggaccac

SEQ ID NO: 242110 - RNA, 65 nt, hsa
ggaagggccugcccaguugcacucaggugacauccuccagauaguguagcugaggaggcaccuac

SEQ ID NO: 242111 - RNA, 65 nt, hsa
cuuuuggaaaaaaauagagcuuuucugcauccuacuccagauacacugaaucggaaucccuaggg

SEQ ID NO: 242112 - RNA, 65 nt, hsa
guacuuuaguuggcuuccgaguuccagacuauauguccagauauuaauugacugucuuguaagcc

SEQ ID NO: 242113 - RNA, 65 nt, hsa
uuuuguuuuguuuuguuuuguuuugcauuuuuaacuccagauauccuaaagcucaauuguuuggu

SEQ ID NO: 242114 - RNA, 65 nt, hsa
acuuagcaguaaauuauagcucaugugcauuauuuuccagauaacuuagcuuaugaguagcuuau

SEQ ID NO: 242115 - RNA, 65 nt, hsa
aaguuugagcaccugauuauauuuaguuuugcuuuuccagauauuacauucuauaguuaccaaaa

SEQ ID NO: 242116 - RNA, 65 nt, hsa
caaucuaguugguuuuauucgacaugaaggaaauuuccagauaacaacacuaacaaacucucccu

SEQ ID NO: 242117 - RNA, 65 nt, hsa
aggcacugucagagaaucuggaguugaaugauuauuccagauacuguauaaccugcauaacuuuu

SEQ ID NO: 242118 - RNA, 65 nt, hsa
ggggucugcuccuguggcggugcaguggcaaaggauccagauagccuagggugagggugacagag

SEQ ID NO: 242119 - RNA, 65 nt, hsa
uguggugaaacaaaauaucuuuaaaaguuaaaacauccagauauauaagcuauuuuuuccuaagg

SEQ ID NO: 242120 - RNA, 65 nt, hsa
ucagccacucaucuuaauccuuaacaagacagcacuccagauaggcagccacgaccccaaaggug

SEQ ID NO: 242121 - RNA, 65 nt, hsa
auucucugaagaguggguuucacaagugaaaaacauccagauacacccaaaguaucaggacgaga

SEQ ID NO: 242122 - RNA, 65 nt, hsa
cuccaccagaaagggggagcuccuuccgcugcggcuccagauagauggggaugccgggcuccagg

SEQ ID NO: 242123 - RNA, 65 nt, hsa
gauaauaugcaaaugaacauuuuccuuuaugucucuccagauaauguuuauugucugagguaaau

SEQ ID NO: 242124 - RNA, 65 nt, hsa
ccaugucagauaggacaacacugcuggguuuuacauccagauaguaauaaacaccauuucaucau

SEQ ID NO: 242125 - RNA, 65 nt, hsa
cuucccccugaguaugcaugugccuguucagagucuccagauaccuuuuuuauaaaaagaagucu

SEQ ID NO: 242126 - RNA, 65 nt, hsa
gacccaauagagagggcaagcugagcaucuguauuuccagauaaaaguuguuauugauguauaaa

SEQ ID NO: 242127 - RNA, 65 nt, hsa
cgaugacagucauccuaaugauaauaaaaccugcauccagauaaucacggagcucugugguugcu

SEQ ID NO: 242128 - RNA, 65 nt, hsa
auuuguagaagugggcccucaugacugagguagcuuccagauaggccagaguagaguguagagug

SEQ ID NO: 242129 - RNA, 65 nt, hsa
uauagaauugucucucaacucugcuuuucuccaguuccagauaacguccuuaagaccaucuguuc

SEQ ID NO: 242130 - RNA, 65 nt, hsa
uuuacaguauaucuuaagauaauauuuaaaauaguuccagauaaaaacaauauauguaaauuaua

SEQ ID NO: 242131 - RNA, 65 nt, hsa
uaacccuucacuuacuagaccagaaaagaacuuauuccagauaagcuuugaauaucaauucuuac

SEQ ID NO: 242132 - RNA, 65 nt, hsa
aagaagcauuugggaaagaaaaagaaauaaauguauccagauaggaaaagaagaaguaaaacuau

SEQ ID NO: 242133 - RNA, 65 nt, hsa
uuuuuaaacaaugugaucucaaauuuaaagacugcuccagauagccugcauuugcaauggaauaa

SEQ ID NO: 242134 - RNA, 65 nt, hsa
caaagaugaccagucaaucagggagucccgccacuuccagauagacuacgaugaggacgggaacu

SEQ ID NO: 242135 - RNA, 65 nt, hsa
uuuuucacuguccucccaccauucauuacuccuccuccagauaccaacugcugauguugcucuag

SEQ ID NO: 242136 - RNA, 65 nt, hsa
cuucggaaacccccaaggugucgaggaggaucagauccagauaagagaagaugauuccuucuagu

SEQ ID NO: 242137 - RNA, 65 nt, hsa
gcguguuccuggugaagcaguuucacaucagucucuccagauagcacuacgauguauuccgcuuc

SEQ ID NO: 242138 - RNA, 65 nt, hsa
gugaucuugcugaagacuacaggcagccaaaugguuccagauacuucagcuuuguguaucuucgu

SEQ ID NO: 242139 - RNA, 65 nt, hsa
cacauuaagcuauaguagaaggaauuggacacuucuccagauauuuggcuucaaaggaguaccuu

SEQ ID NO: 242140 - RNA, 65 nt, hsa
uauuuguuauucauuuugcaaauucagaaaguugguccagauauaugucacagaacuuuucacuu

SEQ ID NO: 242141 - RNA, 65 nt, hsa
ucauucauaauuuuguuuucaccugguuuaaagaauccagauauuuuacugcaaaaguucagaug

SEQ ID NO: 242142 - RNA, 62 nt, hsa
cauguccaaaaggaaaauaagacucuaggggcuccagauaauaagguaaauuuaagagguaa

SEQ ID NO: 242143 - RNA, 65 nt, hsa
uugugcaagaacuuugaaggucaaauuaggcaaauuccagauaguaaaacaaucccuaagccuua

SEQ ID NO: 242144 - RNA, 65 nt, hsa
aauaauauagucauuagccaccuaaacauuuuaauuccagauauuauuuaauuccauauaauaac

SEQ ID NO: 242145 - RNA, 65 nt, hsa
ucuuacaguuuccuaggaaacgcuuuuuauugcuauccagauauauggauaaacuuucuuaacaa

SEQ ID NO: 242146 - RNA, 65 nt, hsa
gguuuauaguacagccuagagaaugaaacucaccguccagauaaccaugcaugcacccagauuuu

SEQ ID NO: 242147 - RNA, 65 nt, hsa
uuuucagugggcaauuuuguaauauauucagacuauccagauacagagaugacuaaggucauuga

SEQ ID NO: 242148 - RNA, 65 nt, hsa
ccuagcagauugcuucccagggcucccugaguguguccagauaccaagugaggaaugagguguga

SEQ ID NO: 242149 - RNA, 65 nt, hsa
acauggaucucaaugccaauccuccauucuuccucuccagauauuuuugggagugacaaacauuc

SEQ ID NO: 242150 - RNA, 65 nt, hsa
cugacucggugugcggccacuucggcacugcuuaauccagauauucuuguuaacuaagcauugug

SEQ ID NO: 242151 - RNA, 65 nt, hsa
aaaugcucgucauacaguaaacucuggaugauucuuccagauaauguccuugcuuuacaaaccaa

SEQ ID NO: 242152 - RNA, 65 nt, hsa
uacuucaaacagaacugcagucagcaugaauccaguccagauauuucacauuuugaaaggucaaa

SEQ ID NO: 242153 - RNA, 65 nt, hsa
ucuuuauuauuuacuuugcauuuuguuucacucuuuccagauaagcagaguugcucuucaccagu

SEQ ID NO: 242154 - RNA, 65 nt, hsa
uaugcauugccaguauaauaaacugugaguauucuuccagauaucuaauuguaagcugaugcuga

SEQ ID NO: 242155 - RNA, 65 nt, hsa
ggucaugcggaacacucuguuauuuaagauggcuauccagauaauccugaacacuguguauuuau

SEQ ID NO: 242156 - RNA, 65 nt, hsa
acaccaaagacggaagccaaauagguagccaaaaauccagauauuugagaagcaggaaauuuaua

SEQ ID NO: 242157 - RNA, 65 nt, hsa
aagaauuuuacuuaggaaaaguauugaaguucaaauccagauaguauuacauuugaaauuguuau

SEQ ID NO: 242158 - RNA, 65 nt, hsa
caugcaguguacauuucagauaauuuccuucagucuccagauaggaguguauccaaacaucuaau

SEQ ID NO: 242159 - RNA, 65 nt, hsa
gucuggaucagauccgcgcuauuccccaacccaccuccagauaaugugagaaaauagccauguca

SEQ ID NO: 242160 - RNA, 65 nt, hsa
gaaagaauuguauuucuuuaaucuaguaugguuacuccagauaagugggugaacuuauuguucuu

SEQ ID NO: 242161 - RNA, 65 nt, hsa
ugaaguaguuuguauaacuucuuaaaaguugugauuccagauaaccagcuguaacacagcugaga

SEQ ID NO: 242162 - RNA, 65 nt, hsa
augucuccaaauacgccuucuuugcugugugggcuuccagauaucaacaaaauacucccucucug

SEQ ID NO: 242163 - RNA, 65 nt, hsa
uagauuugugcacccauuggcaaaacaggaaaguuuccagauagguauuguaucauugagaaugc

SEQ ID NO: 242164 - RNA, 65 nt, hsa
ucucucucucuuuauuuucaguuuuuuugcuguuauccagauaauuaauaaaaaccaaccacgca

SEQ ID NO: 242165 - RNA, 65 nt, hsa
ugauuuuuauucaagaaagcuuuaaaaguuuuauauccagauauacaaccacaauaaagcaaaau

SEQ ID NO: 242166 - RNA, 65 nt, hsa
ggcaaauagccacugguaaagggaggaaaugaauuuccagauacuuauuaccaaguagguaaggu

SEQ ID NO: 242167 - RNA, 65 nt, hsa
ccggccacuacccagcccaucucugccugugcuuauccagauaagaagaccaaaaucccgcuggg

SEQ ID NO: 242168 - RNA, 65 nt, hsa
uuuucuuggauuugugucaguuggaugauauccccuccagauaguaucaauaaaauguuaaaauu

SEQ ID NO: 242169 - RNA, 60 nt, hsa
agagccacggaaaaucauaguaugauucaauccagauauggguuaaauuccucauuuuac

SEQ ID NO: 242170 - RNA, 65 nt, hsa
uggaaauagaucucauuuuuagguuuucucuucguuccagauaccaaauaaaugggacagagaau

SEQ ID NO: 242171 - RNA, 65 nt, hsa
ucaaauauaggcugaaaucucuuaccaaagugcguuccagauaaaaaugagacuuagaagacaga

SEQ ID NO: 242172 - RNA, 65 nt, hsa
gcccauaagacaagugauuauuaugauucccauacuccagauacaaaccauaucccagccauugc

SEQ ID NO: 242173 - RNA, 65 nt, hsa
aacuuuuuaaaaauuaauugauuuuccuuugggguuccagauaauauuuucuacagauuuugaaa

SEQ ID NO: 242174 - RNA, 65 nt, hsa
uuucuuucaucaucuucauugaacucuugggaaucuccagauaaucagauuauuucauuugguaa

SEQ ID NO: 242175 - RNA, 65 nt, hsa
uacugcccucuuacauaauguauuuauaaaguuuuuccagauaaacuaaucaaauaaauuagaau

SEQ ID NO: 242176 - RNA, 65 nt, hsa
aacaaaaaaagcauuguaacuuaugaaccuuuacauccagauagguuaccaguaacggaacagua

SEQ ID NO: 242177 - RNA, 65 nt, hsa
cucauguugaguuugugcuguggugucaccagaauuccagauaaacacacagccuuucccauacc

SEQ ID NO: 242178 - RNA, 65 nt, hsa
gaugccagguuuauagcaauuugcaacuuuaauuuuccagauaaucuggagguuagcauuugaua

SEQ ID NO: 242179 - RNA, 65 nt, hsa
uuugguuuaauuuucuaugugcuuuuaggugugaauccagauaugcggucuuaauuccuuuggaa

SEQ ID NO: 242180 - RNA, 65 nt, hsa
uguacuuaguuguugaaagggugaugaaacugauauccagauacuugagauccugguaauugguc

SEQ ID NO: 242181 - RNA, 65 nt, hsa
caugucugaaauucuauugcuuggagagaauccccuccagauaagagauuuugagugaaaaacau

SEQ ID NO: 242182 - RNA, 65 nt, hsa
guaauuugugccauuagucuuucuauguuucugcauccagauagagugcaguucaugagggaggg

SEQ ID NO: 242183 - RNA, 65 nt, hsa
ugagaauauagauagucguacaacaacccaggggauccagauacaugagaccagggcagcguuca

SEQ ID NO: 242184 - RNA, 65 nt, hsa
cucauguauaaugugccccaaaugcagcuucauuuuccagauaccuugacgcagaauaaauuuuu

SEQ ID NO: 242185 - RNA, 65 nt, hsa
gcuacuuuggcagcagaacugaaaaaggcuuuuuuuccagauauaugauuucucaucgacagggu

SEQ ID NO: 242186 - RNA, 65 nt, hsa
cccccuugauccccaaagaagcugcgccccaccuuuccagauacccacaaagcccccagacagaa

SEQ ID NO: 242187 - RNA, 65 nt, hsa
aucuagguaauuggcagauucuaaauaauauaauuuccagauaguaauuuuaagaguacucaucg

SEQ ID NO: 242188 - RNA, 65 nt, hsa
augucuuaaauauaaagcugugauuauaucaaaaauccagauaaaucaucaaauauaucagauua

SEQ ID NO: 242189 - RNA, 65 nt, hsa
aggacauaugagaaaacugaccaucaguauauuuguccagauaauugguggaucaaaaaugccac

SEQ ID NO: 242190 - RNA, 65 nt, hsa
uuuucuuuuccugggaauggaauaacuaucucacuuccagauauccacauaaaugcuccuugugg

SEQ ID NO: 242191 - RNA, 65 nt, hsa
ugguaacuaaaauuuucuuuuuggaaauuaauaaauccagauacauauuaauguugauaugagua

SEQ ID NO: 242192 - RNA, 65 nt, hsa
ucauaagggauauagacaguacuuuaacuuguguuuccagauaaggcagauuuuggucaucuuuc

SEQ ID NO: 242193 - RNA, 65 nt, hsa
cuccaggugagggugaggacugggccuauauagaauccagauaccauugucaacuucccuuauuc

SEQ ID NO: 242194 - RNA, 65 nt, hsa
ugacagaguuaugaauaugaauauuguggagucuguccagauaccggguggaagacugguuuuga

SEQ ID NO: 242195 - RNA, 65 nt, hsa
uaaauguuuauaacauaguuuaauuuuauauuuauuccagauaguauuuaauuuagugcuuuuua

SEQ ID NO: 242196 - RNA, 65 nt, hsa
gcuuucacucguggugaauauuucagaccuaaagauccagauaguaucucuguucauaugugaau

SEQ ID NO: 242197 - RNA, 65 nt, hsa
agccuccgcaggaugccggacaauggugaagaaacuccagauaucaaggaauugggaaauccugg

SEQ ID NO: 242198 - RNA, 65 nt, hsa
guuggaaggaaugaagaagcuuuuuuaguaauagguccagauaugagugcuaaaaauaaagauga

SEQ ID NO: 242199 - RNA, 65 nt, hsa
ugguauuuauuuuucuccaucucccaccuccuucauccagauaacuuauacauucccaagaaagu

SEQ ID NO: 242200 - RNA, 65 nt, hsa
aggaaaaagagaauuuuucuuuucaucuuacaaauuccagauaucuacaaaagaugugaaagcac

SEQ ID NO: 242201 - RNA, 65 nt, hsa
guaacagugcuuuugguuccuugaguucuccugucuccagauaccaaaugaccuugacuuuucug

SEQ ID NO: 242202 - RNA, 65 nt, hsa
ugggguggcaccccagcauuccuggcuuucugggguccagauaggcuggcaagagcuguuuuugc

SEQ ID NO: 242203 - RNA, 65 nt, hsa
ugauuucagauggauacuaacaguuugaggggagguccagauauuuccaaggcauaaauucuugc

SEQ ID NO: 242204 - RNA, 65 nt, hsa
caaccuuucuguagccuaaaacgaauggucuuugcuccagauaacucucuuuccuugagcuguug

SEQ ID NO: 242205 - RNA, 65 nt, hsa
gggcaaugacuuuccuagacaauaacccgagggacuccagauacauaccccgaaggucuaggaaa

SEQ ID NO: 242206 - RNA, 65 nt, hsa
aaaaccaauuguaccgacaucacguagacaaaaacuccagauaaauccauugauuggguauuuuc

SEQ ID NO: 242207 - RNA, 65 nt, hsa
uaaggaagcuaaaacaccaauguggaauuccuguuuccagauaacauguauauucuucuauagag

SEQ ID NO: 242208 - RNA, 65 nt, hsa
aaacaaaaaaacgaaagcaucuucacaaugaagcuuccagauagcaccguuuugcuaaaagauac

SEQ ID NO: 242209 - RNA, 65 nt, hsa
acucaggaugccaaguggcccucagauuacacuucuccagauagcugaaugagucugcuuucacu

SEQ ID NO: 242210 - RNA, 65 nt, hsa
aguaccacuagcaccuauuccccacccagcgugucuccagauauugucaaauaucccaucgggug

SEQ ID NO: 242211 - RNA, 65 nt, hsa
uaaugcagucagcuaagagccaacaaaaccccauauccagauaguuagcugugagccagcacuca

SEQ ID NO: 242212 - RNA, 65 nt, hsa
cauucuuacuuuguuagcauacgcugaccuuaguguccagauaugucacuauuacucauuuuucu

SEQ ID NO: 242213 - RNA, 65 nt, hsa
uuuauuuuaaccaguuauuuuuauuauugagucuguccagauaaguuauuuauaaugggcauuac

SEQ ID NO: 242214 - RNA, 65 nt, hsa
gcuagaggacuucuggcagggaaguggggaaguguuccagauagcagggcaugaaaacuuagaga

SEQ ID NO: 242215 - RNA, 65 nt, hsa
ccguaggaggggcagagauugugcugauaggucaguccagauagguggguucuagcaauuucccc

SEQ ID NO: 242216 - RNA, 65 nt, hsa
augaugaaucauaagucuucaguggccuagcaauauccagauaagaaaggaccaacuuggguucc

SEQ ID NO: 242217 - RNA, 65 nt, hsa
aagaggauugagcuuugugucaccugccugcgcucuccagauaugaccccugcacccacccccca

SEQ ID NO: 242218 - RNA, 50 nt, hsa
gcaccccccgugaggacuaauccagauacaucccaccagccucuccaagg

SEQ ID NO: 242219 - RNA, 65 nt, hsa
uuccuuugcuaaauucaggcugcaggcuccuuccauccagauaacuccauccugucgaguaggcu

SEQ ID NO: 242220 - RNA, 65 nt, hsa
ugaacaaacauauaaaauguaaacaaucccuacaauccagauaaaacagagaagacugugauucu

SEQ ID NO: 242221 - RNA, 65 nt, hsa
uaaaagaaaguccaaagagcuccuauauagacuacuccagauaacuucgcuucuuugauacuugu

SEQ ID NO: 242222 - RNA, 65 nt, hsa
acagcuugaagagguagcuagguguuuaaaguuccuccagauacuuuuaccugagugaugcuucc

SEQ ID NO: 242223 - RNA, 65 nt, hsa
cuucuacuguguagaauacuuugacuuaauuuucuuccagauacagggggauaccugccuguuuu

SEQ ID NO: 242224 - RNA, 65 nt, hsa
ccaacauuuucuuuucuguuaagguuguuuuaguuuccagauagggcuaauuacaaaauguuaag

SEQ ID NO: 242225 - RNA, 65 nt, hsa
uauaagcaaaagagauugguaaagugccacaguauuccagauaacuuuucaguugcggccuuucu

SEQ ID NO: 242226 - RNA, 65 nt, hsa
gauauaccugauauauuccaccaggauauccucccuccagauauacuugguucucuccaccaggu

SEQ ID NO: 242227 - RNA, 65 nt, hsa
ggacaucuagguuccaauucauucacauucuugguuccagauaaaaucaacuguuuauaucaauu

SEQ ID NO: 242228 - RNA, 65 nt, hsa
uuguuucgccacauguagaguuuguucagcuauuuuccagauaucuccccacaaaaggaggcaaa

SEQ ID NO: 242229 - RNA, 65 nt, hsa
guucugaugauaagcauuuggagugcauuuauuccuccagauaauaaauguguguucagaacuuu

SEQ ID NO: 242230 - RNA, 65 nt, hsa
gacagaagaguguuuucaugucuauaaucaagaauuccagauacauuccuuuuacugaaccuuga

SEQ ID NO: 242231 - RNA, 65 nt, hsa
ucugaaagcccuggaucucuuugcaccaaaaaugguccagauagacucuuuuuaaggaucuuggc

SEQ ID NO: 242232 - RNA, 65 nt, hsa
aacuuacuuucugcaauguuuucuuagaaauuguguccagauagcuuucacuaauuuuaaauuaa

SEQ ID NO: 242233 - RNA, 65 nt, hsa
gaagucaggagcauuaaaucccaaaccaaaucaacuccagauauaucagugucaaaagcccaaga

SEQ ID NO: 242234 - RNA, 65 nt, hsa
cagaucuugugguauaaaaaauaaccuuguaguucuccagauacuaagcuuguauaugauuaugg

SEQ ID NO: 242235 - RNA, 65 nt, hsa
agugcuuuuuuuuuuuugacuaacaagaauguaacuccagauagagaaauagugacaagugaaga

SEQ ID NO: 242236 - RNA, 65 nt, hsa
uuucagaauuacuuuuuaauuguuuuaaaaagcacuccagauaauuuauagaguaacauaggccu

SEQ ID NO: 242237 - RNA, 65 nt, hsa
ugcaaauuuguacaaacauuuaaaugguucuaauuuccagauaaaugauuuuugauguuauuguu

SEQ ID NO: 242238 - RNA, 65 nt, hsa
ggcuuuucuugagcccauuuuaaacaacccuuguuuccagauaaguguauuuuaaaugugaccuu

SEQ ID NO: 242239 - RNA, 65 nt, hsa
aaguuuacuuuuuccucuucugguuuuggaaaauuuccagauaagacaugucaccauuaauucuc

SEQ ID NO: 242240 - RNA, 65 nt, hsa
uguaagcuuuggaaacacaauuuaugcaacagauguccagauaugauucuauuuauggaaaaaag

SEQ ID NO: 242241 - RNA, 65 nt, hsa
aauucauaagagucagugcauuuuaucauugcacauccagauacuguuuuaggugagcugagcua

SEQ ID NO: 242242 - RNA, 65 nt, hsa
uccugcauucuguacauaaaguuuuaaguggcagguccagauauguaaaaucauuucucucuauu

SEQ ID NO: 242243 - RNA, 65 nt, hsa
ccaaccacugauuacuuuucaggaauuuaauuauuuccagauaaauuucuuuauuuuauauugua

SEQ ID NO: 242244 - RNA, 65 nt, hsa
cuugaagguccucugccuccagcuguggcccugcauccagauaccugccucguccgaggcagaca

SEQ ID NO: 242245 - RNA, 65 nt, hsa
uaugauguggauccuacguauuuuuuaaaaaacucuccagauaauuuugaugucacgagucacua

SEQ ID NO: 242246 - RNA, 65 nt, hsa
gauuugguuuuuucauuguuuccuuggccccuguauccagauauuggacuuacugcuauacuugu

SEQ ID NO: 242247 - RNA, 65 nt, hsa
cacuuaaaaacugcagagaaaacugaaaguuauguuccagauaacuuuccguuguuuaccaaauu

SEQ ID NO: 242248 - RNA, 65 nt, hsa
aaaauuagccaggcaugguggugcaugccuguaacuccagauacuugggaugcugaggcaggaga

SEQ ID NO: 242249 - RNA, 65 nt, hsa
caaggcauucaaguguacagugaaaagucucccuuuccagauauucaagucaccuccuuaaaggu

SEQ ID NO: 242250 - RNA, 65 nt, hsa
aaugaaggcucuggcccuaaccccucagcacugucuccagauaggaacaugcacaaagcaguuaa

SEQ ID NO: 242251 - RNA, 65 nt, hsa
cucaccaggcacuggcagggaggguaagggcuggcuccagauaccccucccccacagauuccuag

SEQ ID NO: 242252 - RNA, 65 nt, hsa
acacuuuuauaaaaaucagauuuuucaguggucucuccagauauuaacaagaauuguuguguaac

SEQ ID NO: 242253 - RNA, 65 nt, hsa
uaaauuuauuuuuuucauuucugucaugaaaucauuccagauaccucuuuucuucuuuccaaaug

SEQ ID NO: 242254 - RNA, 65 nt, hsa
accugaggagcucuguccugcucccuguggagggcuccagauagcucagaaaugaccagccaaug

SEQ ID NO: 242255 - RNA, 65 nt, hsa
ccugaaggagcugggaaguaaguucuuccccagccuccagauaagagccccgccggccaaucccu

SEQ ID NO: 242256 - RNA, 65 nt, hsa
ccuaggucugugcuguaaauccuaagauuaaacauuccagauaguaccuccuugucuuaaguucu

SEQ ID NO: 242257 - RNA, 65 nt, hsa
ccaccugggaccaaauaagaauugaauugugcuuguccagauaugaacaaauauguagugaguau

SEQ ID NO: 242258 - RNA, 65 nt, hsa
gaccagggcuggcccugauccaccuaccugcuaacuccagauauuauuuuuaaguuggagaccua

SEQ ID NO: 242259 - RNA, 65 nt, hsa
uuugaaaaggaaauaaacuuugaugaauuagauaauccagauacaucauuguaaacucuuacucu

SEQ ID NO: 242260 - RNA, 65 nt, hsa
aguuguugcuuaauuuauuguuuuuuaauaacuaauccagauaaaaaguuguggggcuucagggu

SEQ ID NO: 242261 - RNA, 65 nt, hsa
ccaccugggaccaaauaagaauucaauugugcuuguccagauaugaacaaauauguagugaguau

SEQ ID NO: 242262 - RNA, 65 nt, hsa
aucaguccagguucagaaacuugugguaggccaguuccagauaguuucauuucaccuguaaacug

SEQ ID NO: 242263 - RNA, 65 nt, hsa
guaugugucuucuucuccagauagugaaaaagguguccagauaaacccaccuaagugaaauggcc

SEQ ID NO: 242264 - RNA, 65 nt, hsa
acagcagcccugaacaaccaguaugugucuucuucuccagauagugaaaaagguguccagauaaa

SEQ ID NO: 242265 - RNA, 65 nt, hsa; identical to SEQ ID NO: 242261

SEQ ID NO: 242266 - RNA, 65 nt, hsa
agucccaaagcggccgaugggagucucccuccgacuccagauaugaacagggcccaggccuggag

SEQ ID NO: 242267 - RNA, 65 nt, hsa
uggacgcauugugggcuuuagggacagaugaguuuuccagauagugucagcuuauuugaagauua

SEQ ID NO: 242268 - RNA, 65 nt, hsa
aaaguuuugcuggauccuaaaguauugaggauuuuuccagauaaauuuguacucaaggaaagaac

SEQ ID NO: 242269 - RNA, 65 nt, hsa
ucaaucuagaaaagccuuguugagcagccuccuuauccagauagauccaaagcucaugucucuuc

SEQ ID NO: 242270 - RNA, 65 nt, hsa
aacacuaauagauauucaauaacggaguaaacuguuccagauaaagcaagaauaguugcaagaag

SEQ ID NO: 242271 - RNA, 65 nt, hsa
cgguggaccccguggcguuaggcaaaugcccaaccuccagauaccuccgauguggagaggguguu

SEQ ID NO: 242272 - RNA, 65 nt, hsa
ggaccugggccggcccaugggagccugggguucuguccagauaggaccagggggucucacuuugg

SEQ ID NO: 242273 - RNA, 65 nt, hsa
gacagaugcauacaugcauguaaccaccaccccauuccagauauagaauguuucuaucucucugg

SEQ ID NO: 242274 - RNA, 65 nt, hsa
uucuuuuguggauucgucauuucccaugcccugguuccagauacauuuugaaaaccuuccaucuu

SEQ ID NO: 242275 - RNA, 65 nt, hsa
gggauuucuaagaccgacuguaugagcucgccucuuccagauagcuggcagagggcagggcaagg

SEQ ID NO: 242276 - RNA, 65 nt, hsa
ugaauccaguggagcugggccaaguacgacaggaguccagauaaagguguaggggcugcacggcc

SEQ ID NO: 242277 - RNA, 65 nt, hsa
ccaagaagagugaaugugucccauccaaaggugcauccagauaugucuguguuacuauggcuuca

SEQ ID NO: 242278 - RNA, 65 nt, hsa
ggaaagcaggauuugagagaacauacaccuugccuuccagauaugugguuuuugugauucaccca

SEQ ID NO: 242279 - RNA, 65 nt, hsa
aaaucacuugucucuguuccucagaguuguaggucuccagauauguccccagugcuccacauuaa

SEQ ID NO: 242280 - RNA, 65 nt, hsa
aaaaugugggaaaacauacauuacucuugcagguuuccagauacaugaaagaacccacacuggag

SEQ ID NO: 242281 - RNA, 65 nt, hsa
ccaagcaguguagcucagagcacuugugucugcauuccagauaacauucaggaccugugugaaaa

SEQ ID NO: 242282 - RNA, 65 nt, hsa
cuauuuauuuccuuaaacuucugaaaguuaaaaaguccagauaggagugaggaagcuguacauga

SEQ ID NO: 242283 - RNA, 65 nt, hsa
aaaaaacucaugagaagaguaaucuguuauguuuuuccagauauuuaccauuucuguugcucuuc

SEQ ID NO: 242284 - RNA, 65 nt, hsa
gcagggcccuuauggacaggaugggguucuggaaauccagauaacuaaggugaagaaucuuuuua

SEQ ID NO: 242285 - RNA, 65 nt, hsa
cccagugaauccucaauuuucugucucguugucuguccagauaauugauucuaagacauguuagg

SEQ ID NO: 242286 - RNA, 65 nt, hsa
aagaucaagaauacugcccauuacugucacaauuuuccagauauuauauaaugaacucguaaugu

SEQ ID NO: 242287 - RNA, 65 nt, hsa
gccaccaggacucaccucccucuucauuuaggaucuccagauacuggauagccagcauccucuca

SEQ ID NO: 242288 - RNA, 65 nt, hsa
aaaaucccucgcaguuguggacauuucuguuccuguccagauaccauuucuccuaguauuucuuu

SEQ ID NO: 242289 - RNA, 65 nt, hsa
ugcaggaccauuuuaaaccugugugcuaaaaauuuuccagauacuugcuuuaaagcuacuuuugu

SEQ ID NO: 242290 - RNA, 65 nt, hsa
ccaccgagggacuagcuuggccuuugcgcuuugauuccagauaguaagaugaguggaaguguuua

SEQ ID NO: 242291 - RNA, 65 nt, hsa
uggguaacaacagaagaaaaccuucaguuggauccuccagauagccacugccuuuuccucaaggg

SEQ ID NO: 242292 - RNA, 65 nt, hsa
cacagcugauguaaaauucuaaauuaccauuuacuuccagauagagcagaggagaaacaccucac

SEQ ID NO: 242293 - RNA, 65 nt, hsa
ugcccagaggcaacccuugccagucuguuuaucccuccagauacagucucugauaguaaacuuuu

SEQ ID NO: 242294 - RNA, 65 nt, hsa
cagagcucaaaacaaggcgagcuugaguucugcacuccagauaugugccaaaacuaguaaaacuu

SEQ ID NO: 242295 - RNA, 65 nt, hsa
gugguaccagaggccagaauggugggaaagacagauccagauaaugcugggaaguguggcuacac

SEQ ID NO: 242296 - RNA, 65 nt, hsa
uguagcuguauauaaagcgcauguagagcuacagauccagauacacacacuuguguauauaugua

SEQ ID NO: 242297 - RNA, 65 nt, hsa
augaacaaguaaccacaucucaggcggcagugaaguccagauaguuuugcagauuguuuugcuac

SEQ ID NO: 242298 - RNA, 65 nt, hsa
gaauccaccuuuuagguaugagaaauguguucagguccagauaugguuucuccuauaauuuuucc

SEQ ID NO: 242299 - RNA, 65 nt, hsa
ucaagguagaaauacugauauguaucaucaccuuuuccagauacaaacuugccuuauuuucuagu

SEQ ID NO: 242300 - RNA, 65 nt, hsa
cuugcuuagguagagaaggagcacuaaauagcuacuccagauauaaaagcuguacauuuguggga

SEQ ID NO: 242301 - RNA, 65 nt, hsa
guuuaaaaggacacuaaaaacuggaguuauagauauccagauagaaacaguaguuaucuuugggu

SEQ ID NO: 242302 - RNA, 65 nt, hsa
cuaagacacggcagcaagacaucccugcauauuguuccagauaaaaaugaaagcugcucacaccc

SEQ ID NO: 242303 - RNA, 65 nt, hsa
gcacccucccccaaguugagacaaccaaaaaugucuccagauauugccagcuaccccuugaggga

SEQ ID NO: 242304 - RNA, 65 nt, hsa
guugccauugcugcuaaagguuaccgauuucaaaguccagauaccaagcauguggauauguuuag

SEQ ID NO: 242305 - RNA, 65 nt, hsa
guaggaauuagccaguugaggaaguagaaggaauuuccagauauuggaaacaguaugcaugaaga

SEQ ID NO: 242306 - RNA, 65 nt, hsa
ccacgggaauacuacugccauguaaucuguauaguuccagauaauuugucaugaacauugacaga

SEQ ID NO: 242307 - RNA, 65 nt, hsa
ucugcuauacuugacuugccuucagaauauuacauuccagauaauaugacuguucaucuuuuucu

SEQ ID NO: 242308 - RNA, 60 nt, hsa; identical to SEQ ID NO: 37632

SEQ ID NO: 242309 - RNA, 60 nt, hsa; identical to SEQ ID NO: 37633

SEQ ID NO: 242310 - RNA, 60 nt, hsa; identical to SEQ ID NO: 37634

SEQ ID NO: 242311 - RNA, 60 nt, hsa; identical to SEQ ID NO: 37635

SEQ ID NO: 242312 - RNA, 60 nt, hsa; identical to SEQ ID NO: 37636

SEQ ID NO: 242313 - RNA, 60 nt, hsa; identical to SEQ ID NO: 37637

SEQ ID NO: 242314 - RNA, 60 nt, hsa; identical to SEQ ID NO: 37638

SEQ ID NO: 242315 - RNA, 60 nt, hsa; identical to SEQ ID NO: 37639

SEQ ID NO: 242316 - RNA, 60 nt, hsa; identical to SEQ ID NO: 37640

SEQ ID NO: 242317 - RNA, 60 nt, hsa; identical to SEQ ID NO: 37641

SEQ ID NO: 242318 - RNA, 60 nt, hsa; identical to SEQ ID NO: 37642

SEQ ID NO: 242319 - RNA, 60 nt, hsa; identical to SEQ ID NO: 37643

SEQ ID NO: 242320 - RNA, 60 nt, hsa; identical to SEQ ID NO: 37644

SEQ ID NO: 242321 - RNA, 60 nt, hsa; identical to SEQ ID NO: 37645

SEQ ID NO: 242322 - RNA, 60 nt, hsa; identical to SEQ ID NO: 37646

SEQ ID NO: 242323 - RNA, 60 nt, hsa; identical to SEQ ID NO: 37647

SEQ ID NO: 242324 - RNA, 60 nt, hsa; identical to SEQ ID NO: 37648

SEQ ID NO: 242325 - RNA, 60 nt, hsa; identical to SEQ ID NO: 37649

SEQ ID NO: 242326 - RNA, 60 nt, hsa; identical to SEQ ID NO: 37650

SEQ ID NO: 242327 - RNA, 60 nt, hsa; identical to SEQ ID NO: 37651

SEQ ID NO: 242328 - RNA, 60 nt, hsa; identical to SEQ ID NO: 37652

SEQ ID NO: 242329 - RNA, 60 nt, hsa; identical to SEQ ID NO: 37653

SEQ ID NO: 242330 - RNA, 60 nt, hsa; identical to SEQ ID NO: 37654

SEQ ID NO: 242331 - RNA, 60 nt, hsa; identical to SEQ ID NO: 37655

SEQ ID NO: 242332 - RNA, 60 nt, hsa; identical to SEQ ID NO: 37656

SEQ ID NO: 242333 - RNA, 60 nt, hsa; identical to SEQ ID NO: 37657

SEQ ID NO: 242334 - RNA, 60 nt, hsa; identical to SEQ ID NO: 37658

SEQ ID NO: 242335 - RNA, 60 nt, hsa; identical to SEQ ID NO: 37659

SEQ ID NO: 242336 - RNA, 60 nt, hsa; identical to SEQ ID NO: 37660

SEQ ID NO: 242337 - RNA, 60 nt, hsa; identical to SEQ ID NO: 37661

SEQ ID NO: 242338 - RNA, 60 nt, hsa; identical to SEQ ID NO: 37662

SEQ ID NO: 242339 - RNA, 60 nt, hsa; identical to SEQ ID NO: 37663

SEQ ID NO: 242340 - RNA, 60 nt, hsa; identical to SEQ ID NO: 37664

SEQ ID NO: 242341 - RNA, 60 nt, hsa; identical to SEQ ID NO: 37665

SEQ ID NO: 242342 - RNA, 60 nt, hsa; identical to SEQ ID NO: 37666

SEQ ID NO: 242343 - RNA, 60 nt, hsa; identical to SEQ ID NO: 37667

SEQ ID NO: 242344 - RNA, 60 nt, hsa; identical to SEQ ID NO: 37668

SEQ ID NO: 242345 - RNA, 60 nt, hsa; identical to SEQ ID NO: 37669

SEQ ID NO: 242346 - RNA, 60 nt, hsa; identical to SEQ ID NO: 37670

SEQ ID NO: 242347 - RNA, 60 nt, hsa; identical to SEQ ID NO: 37671

SEQ ID NO: 242348 - RNA, 60 nt, hsa; identical to SEQ ID NO: 37672

SEQ ID NO: 242349 - RNA, 50 nt, hsa; identical to SEQ ID NO: 37673

SEQ ID NO: 242350 - RNA, 60 nt, hsa; identical to SEQ ID NO: 37674

SEQ ID NO: 242351 - RNA, 60 nt, hsa; identical to SEQ ID NO: 37675

SEQ ID NO: 242352 - RNA, 60 nt, hsa; identical to SEQ ID NO: 37676

SEQ ID NO: 242353 - RNA, 60 nt, hsa; identical to SEQ ID NO: 37677

SEQ ID NO: 242354 - RNA, 60 nt, hsa; identical to SEQ ID NO: 37678

SEQ ID NO: 242355 - RNA, 60 nt, hsa; identical to SEQ ID NO: 37679

SEQ ID NO: 242356 - RNA, 60 nt, hsa; identical to SEQ ID NO: 37680

SEQ ID NO: 242357 - RNA, 60 nt, hsa; identical to SEQ ID NO: 37681

SEQ ID NO: 242358 - RNA, 60 nt, hsa; identical to SEQ ID NO: 37682

SEQ ID NO: 242359 - RNA, 60 nt, hsa; identical to SEQ ID NO: 37683

SEQ ID NO: 242360 - RNA, 60 nt, hsa; identical to SEQ ID NO: 37684

SEQ ID NO: 242361 - RNA, 60 nt, hsa; identical to SEQ ID NO: 37685

SEQ ID NO: 242362 - RNA, 60 nt, hsa; identical to SEQ ID NO: 37686

SEQ ID NO: 242363 - RNA, 60 nt, hsa; identical to SEQ ID NO: 37687

SEQ ID NO: 242364 - RNA, 60 nt, hsa; identical to SEQ ID NO: 37688

SEQ ID NO: 242365 - RNA, 60 nt, hsa; identical to SEQ ID NO: 37689

SEQ ID NO: 242366 - RNA, 60 nt, hsa; identical to SEQ ID NO: 37690

SEQ ID NO: 242367 - RNA, 60 nt, hsa; identical to SEQ ID NO: 37691

SEQ ID NO: 242368 - RNA, 60 nt, hsa; identical to SEQ ID NO: 37692

SEQ ID NO: 242369 - RNA, 60 nt, hsa; identical to SEQ ID NO: 37693

SEQ ID NO: 242370 - RNA, 60 nt, hsa; identical to SEQ ID NO: 37694

SEQ ID NO: 242371 - RNA, 60 nt, hsa; identical to SEQ ID NO: 37695

SEQ ID NO: 242372 - RNA, 60 nt, hsa; identical to SEQ ID NO: 37696

SEQ ID NO: 242373 - RNA, 60 nt, hsa; identical to SEQ ID NO: 37697

SEQ ID NO: 242374 - RNA, 60 nt, hsa; identical to SEQ ID NO: 37698

SEQ ID NO: 242375 - RNA, 60 nt, hsa; identical to SEQ ID NO: 37699

SEQ ID NO: 242376 - RNA, 60 nt, hsa; identical to SEQ ID NO: 37700

SEQ ID NO: 242377 - RNA, 60 nt, hsa; identical to SEQ ID NO: 37701

SEQ ID NO: 242378 - RNA, 60 nt, hsa; identical to SEQ ID NO: 37702

SEQ ID NO: 242379 - RNA, 60 nt, hsa; identical to SEQ ID NO: 37703

SEQ ID NO: 242380 - RNA, 60 nt, hsa; identical to SEQ ID NO: 37704

SEQ ID NO: 242381 - RNA, 60 nt, hsa; identical to SEQ ID NO: 37705

SEQ ID NO: 242382 - RNA, 60 nt, hsa; identical to SEQ ID NO: 37706

SEQ ID NO: 242383 - RNA, 60 nt, hsa; identical to SEQ ID NO: 37707

SEQ ID NO: 242384 - RNA, 60 nt, hsa; identical to SEQ ID NO: 37708

SEQ ID NO: 242385 - RNA, 60 nt, hsa; identical to SEQ ID NO: 37709

SEQ ID NO: 242386 - RNA, 60 nt, hsa; identical to SEQ ID NO: 37710

SEQ ID NO: 242387 - RNA, 60 nt, hsa; identical to SEQ ID NO: 37711

SEQ ID NO: 242388 - RNA, 60 nt, hsa; identical to SEQ ID NO: 37712

SEQ ID NO: 242389 - RNA, 60 nt, hsa; identical to SEQ ID NO: 37713

SEQ ID NO: 242390 - RNA, 60 nt, hsa; identical to SEQ ID NO: 37714

SEQ ID NO: 242391 - RNA, 60 nt, hsa; identical to SEQ ID NO: 37715

SEQ ID NO: 242392 - RNA, 60 nt, hsa; identical to SEQ ID NO: 37716

SEQ ID NO: 242393 - RNA, 60 nt, hsa; identical to SEQ ID NO: 37717

SEQ ID NO: 242394 - RNA, 60 nt, hsa; identical to SEQ ID NO: 37718

SEQ ID NO: 242395 - RNA, 60 nt, hsa; identical to SEQ ID NO: 37719

SEQ ID NO: 242396 - RNA, 60 nt, hsa; identical to SEQ ID NO: 37720

SEQ ID NO: 242397 - RNA, 60 nt, hsa; identical to SEQ ID NO: 37721

SEQ ID NO: 242398 - RNA, 60 nt, hsa; identical to SEQ ID NO: 37722

SEQ ID NO: 242399 - RNA, 60 nt, hsa; identical to SEQ ID NO: 37723

SEQ ID NO: 242400 - RNA, 60 nt, hsa; identical to SEQ ID NO: 37724

SEQ ID NO: 242401 - RNA, 60 nt, hsa; identical to SEQ ID NO: 37725

SEQ ID NO: 242402 - RNA, 60 nt, hsa; identical to SEQ ID NO: 37726

SEQ ID NO: 242403 - RNA, 60 nt, hsa; identical to SEQ ID NO: 37727

SEQ ID NO: 242404 - RNA, 60 nt, hsa; identical to SEQ ID NO: 37728

SEQ ID NO: 242405 - RNA, 60 nt, hsa; identical to SEQ ID NO: 37729

SEQ ID NO: 242406 - RNA, 60 nt, hsa; identical to SEQ ID NO: 37730

SEQ ID NO: 242407 - RNA, 60 nt, hsa; identical to SEQ ID NO: 37731

SEQ ID NO: 242408 - RNA, 60 nt, hsa; identical to SEQ ID NO: 37732

SEQ ID NO: 242409 - RNA, 60 nt, hsa; identical to SEQ ID NO: 37733

SEQ ID NO: 242410 - RNA, 60 nt, hsa; identical to SEQ ID NO: 37734

SEQ ID NO: 242411 - RNA, 60 nt, hsa; identical to SEQ ID NO: 37735

SEQ ID NO: 242412 - RNA, 60 nt, hsa; identical to SEQ ID NO: 37736

SEQ ID NO: 242413 - RNA, 60 nt, hsa; identical to SEQ ID NO: 37737

SEQ ID NO: 242414 - RNA, 60 nt, hsa; identical to SEQ ID NO: 37738

SEQ ID NO: 242415 - RNA, 60 nt, hsa; identical to SEQ ID NO: 37739

SEQ ID NO: 242416 - RNA, 60 nt, hsa; identical to SEQ ID NO: 37740

SEQ ID NO: 242417 - RNA, 60 nt, hsa; identical to SEQ ID NO: 37741

SEQ ID NO: 242418 - RNA, 60 nt, hsa; identical to SEQ ID NO: 37742

SEQ ID NO: 242419 - RNA, 60 nt, hsa; identical to SEQ ID NO: 37743

SEQ ID NO: 242420 - RNA, 60 nt, hsa; identical to SEQ ID NO: 37744

SEQ ID NO: 242421 - RNA, 60 nt, hsa; identical to SEQ ID NO: 37745

SEQ ID NO: 242422 - RNA, 60 nt, hsa; identical to SEQ ID NO: 37746

SEQ ID NO: 242423 - RNA, 60 nt, hsa; identical to SEQ ID NO: 37747

SEQ ID NO: 242424 - RNA, 60 nt, hsa; identical to SEQ ID NO: 37748

SEQ ID NO: 242425 - RNA, 60 nt, hsa; identical to SEQ ID NO: 37749

SEQ ID NO: 242426 - RNA, 60 nt, hsa; identical to SEQ ID NO: 37750

SEQ ID NO: 242427 - RNA, 60 nt, hsa; identical to SEQ ID NO: 37751

SEQ ID NO: 242428 - RNA, 60 nt, hsa; identical to SEQ ID NO: 37752

SEQ ID NO: 242429 - RNA, 51 nt, hsa; identical to SEQ ID NO: 37753

SEQ ID NO: 242430 - RNA, 60 nt, hsa; identical to SEQ ID NO: 37754

SEQ ID NO: 242431 - RNA, 60 nt, hsa; identical to SEQ ID NO: 37755

SEQ ID NO: 242432 - RNA, 60 nt, hsa; identical to SEQ ID NO: 37756

SEQ ID NO: 242433 - RNA, 60 nt, hsa; identical to SEQ ID NO: 37757

SEQ ID NO: 242434 - RNA, 60 nt, hsa; identical to SEQ ID NO: 37758

SEQ ID NO: 242435 - RNA, 60 nt, hsa; identical to SEQ ID NO: 37759

SEQ ID NO: 242436 - RNA, 60 nt, hsa; identical to SEQ ID NO: 37760

SEQ ID NO: 242437 - RNA, 60 nt, hsa; identical to SEQ ID NO: 37761

SEQ ID NO: 242438 - RNA, 60 nt, hsa; identical to SEQ ID NO: 37762

SEQ ID NO: 242439 - RNA, 60 nt, hsa; identical to SEQ ID NO: 37763

SEQ ID NO: 242440 - RNA, 60 nt, hsa; identical to SEQ ID NO: 37764

SEQ ID NO: 242441 - RNA, 60 nt, hsa; identical to SEQ ID NO: 37765

SEQ ID NO: 242442 - RNA, 54 nt, hsa; identical to SEQ ID NO: 37766

SEQ ID NO: 242443 - RNA, 60 nt, hsa; identical to SEQ ID NO: 37767

SEQ ID NO: 242444 - RNA, 60 nt, hsa; identical to SEQ ID NO: 37768

SEQ ID NO: 242445 - RNA, 60 nt, hsa; identical to SEQ ID NO: 37769

SEQ ID NO: 242446 - RNA, 60 nt, hsa; identical to SEQ ID NO: 37770

SEQ ID NO: 242447 - RNA, 60 nt, hsa; identical to SEQ ID NO: 37771

SEQ ID NO: 242448 - RNA, 60 nt, hsa; identical to SEQ ID NO: 37772

SEQ ID NO: 242449 - RNA, 60 nt, hsa; identical to SEQ ID NO: 37773

SEQ ID NO: 242450 - RNA, 60 nt, hsa; identical to SEQ ID NO: 37774

SEQ ID NO: 242451 - RNA, 60 nt, hsa; identical to SEQ ID NO: 37775

SEQ ID NO: 242452 - RNA, 60 nt, hsa; identical to SEQ ID NO: 37776

SEQ ID NO: 242453 - RNA, 60 nt, hsa; identical to SEQ ID NO: 37777

SEQ ID NO: 242454 - RNA, 60 nt, hsa; identical to SEQ ID NO: 37778

SEQ ID NO: 242455 - RNA, 60 nt, hsa; identical to SEQ ID NO: 37779

SEQ ID NO: 242456 - RNA, 60 nt, hsa; identical to SEQ ID NO: 37780

SEQ ID NO: 242457 - RNA, 60 nt, hsa; identical to SEQ ID NO: 37781

SEQ ID NO: 242458 - RNA, 60 nt, hsa; identical to SEQ ID NO: 37782

SEQ ID NO: 242459 - RNA, 60 nt, hsa; identical to SEQ ID NO: 37783

SEQ ID NO: 242460 - RNA, 60 nt, hsa; identical to SEQ ID NO: 37784

SEQ ID NO: 242461 - RNA, 60 nt, hsa; identical to SEQ ID NO: 37785

SEQ ID NO: 242462 - RNA, 60 nt, hsa; identical to SEQ ID NO: 37786

SEQ ID NO: 242463 - RNA, 60 nt, hsa; identical to SEQ ID NO: 37787

SEQ ID NO: 242464 - RNA, 60 nt, hsa; identical to SEQ ID NO: 37788

SEQ ID NO: 242465 - RNA, 60 nt, hsa; identical to SEQ ID NO: 37789

SEQ ID NO: 242466 - RNA, 60 nt, hsa; identical to SEQ ID NO: 37790

SEQ ID NO: 242467 - RNA, 60 nt, hsa; identical to SEQ ID NO: 37791

SEQ ID NO: 242468 - RNA, 60 nt, hsa; identical to SEQ ID NO: 37792

SEQ ID NO: 242469 - RNA, 60 nt, hsa; identical to SEQ ID NO: 37793

SEQ ID NO: 242470 - RNA, 60 nt, hsa; identical to SEQ ID NO: 37794

SEQ ID NO: 242471 - RNA, 60 nt, hsa; identical to SEQ ID NO: 37795

SEQ ID NO: 242472 - RNA, 60 nt, hsa; identical to SEQ ID NO: 37796

SEQ ID NO: 242473 - RNA, 60 nt, hsa; identical to SEQ ID NO: 37797

SEQ ID NO: 242474 - RNA, 60 nt, hsa; identical to SEQ ID NO: 37798

SEQ ID NO: 242475 - RNA, 60 nt, hsa; identical to SEQ ID NO: 37799

SEQ ID NO: 242476 - RNA, 60 nt, hsa; identical to SEQ ID NO: 37800

SEQ ID NO: 242477 - RNA, 60 nt, hsa; identical to SEQ ID NO: 37801

SEQ ID NO: 242478 - RNA, 60 nt, hsa; identical to SEQ ID NO: 37802

SEQ ID NO: 242479 - RNA, 60 nt, hsa; identical to SEQ ID NO: 37803

SEQ ID NO: 242480 - RNA, 60 nt, hsa; identical to SEQ ID NO: 37804

SEQ ID NO: 242481 - RNA, 60 nt, hsa; identical to SEQ ID NO: 37805

SEQ ID NO: 242482 - RNA, 60 nt, hsa; identical to SEQ ID NO: 37806

SEQ ID NO: 242483 - RNA, 60 nt, hsa; identical to SEQ ID NO: 37807

SEQ ID NO: 242484 - RNA, 60 nt, hsa; identical to SEQ ID NO: 37808

SEQ ID NO: 242485 - RNA, 60 nt, hsa; identical to SEQ ID NO: 37809

SEQ ID NO: 242486 - RNA, 60 nt, hsa; identical to SEQ ID NO: 37810

SEQ ID NO: 242487 - RNA, 60 nt, hsa; identical to SEQ ID NO: 37811

SEQ ID NO: 242488 - RNA, 60 nt, hsa; identical to SEQ ID NO: 37812

SEQ ID NO: 242489 - RNA, 60 nt, hsa; identical to SEQ ID NO: 37813

SEQ ID NO: 242490 - RNA, 60 nt, hsa; identical to SEQ ID NO: 37814

SEQ ID NO: 242491 - RNA, 60 nt, hsa; identical to SEQ ID NO: 37815

SEQ ID NO: 242492 - RNA, 60 nt, hsa; identical to SEQ ID NO: 37816

SEQ ID NO: 242493 - RNA, 60 nt, hsa; identical to SEQ ID NO: 37817

SEQ ID NO: 242494 - RNA, 60 nt, hsa; identical to SEQ ID NO: 37818

SEQ ID NO: 242495 - RNA, 60 nt, hsa; identical to SEQ ID NO: 37819

SEQ ID NO: 242496 - RNA, 60 nt, hsa; identical to SEQ ID NO: 37820

SEQ ID NO: 242497 - RNA, 60 nt, hsa; identical to SEQ ID NO: 37821

SEQ ID NO: 242498 - RNA, 60 nt, hsa; identical to SEQ ID NO: 37822

SEQ ID NO: 242499 - RNA, 60 nt, hsa; identical to SEQ ID NO: 37823

SEQ ID NO: 242500 - RNA, 60 nt, hsa; identical to SEQ ID NO: 37824

SEQ ID NO: 242501 - RNA, 60 nt, hsa; identical to SEQ ID NO: 37825

SEQ ID NO: 242502 - RNA, 60 nt, hsa; identical to SEQ ID NO: 37826

SEQ ID NO: 242503 - RNA, 60 nt, hsa; identical to SEQ ID NO: 37827

SEQ ID NO: 242504 - RNA, 60 nt, hsa; identical to SEQ ID NO: 37828

SEQ ID NO: 242505 - RNA, 60 nt, hsa; identical to SEQ ID NO: 37829

SEQ ID NO: 242506 - RNA, 60 nt, hsa; identical to SEQ ID NO: 37830

SEQ ID NO: 242507 - RNA, 60 nt, hsa; identical to SEQ ID NO: 37831

SEQ ID NO: 242508 - RNA, 60 nt, hsa; identical to SEQ ID NO: 37832

SEQ ID NO: 242509 - RNA, 60 nt, hsa; identical to SEQ ID NO: 37833

SEQ ID NO: 242510 - RNA, 60 nt, hsa; identical to SEQ ID NO: 37834

SEQ ID NO: 242511 - RNA, 60 nt, hsa; identical to SEQ ID NO: 37835

SEQ ID NO: 242512 - RNA, 60 nt, hsa; identical to SEQ ID NO: 37836

SEQ ID NO: 242513 - RNA, 60 nt, hsa; identical to SEQ ID NO: 37837

SEQ ID NO: 242514 - RNA, 60 nt, hsa; identical to SEQ ID NO: 37838

SEQ ID NO: 242515 - RNA, 60 nt, hsa; identical to SEQ ID NO: 37839

SEQ ID NO: 242516 - RNA, 60 nt, hsa; identical to SEQ ID NO: 37840

SEQ ID NO: 242517 - RNA, 60 nt, hsa; identical to SEQ ID NO: 37841

SEQ ID NO: 242518 - RNA, 60 nt, hsa; identical to SEQ ID NO: 37842

SEQ ID NO: 242519 - RNA, 60 nt, hsa; identical to SEQ ID NO: 37843

SEQ ID NO: 242520 - RNA, 60 nt, hsa; identical to SEQ ID NO: 37844

SEQ ID NO: 242521 - RNA, 60 nt, hsa; identical to SEQ ID NO: 37845

SEQ ID NO: 242522 - RNA, 60 nt, hsa; identical to SEQ ID NO: 37846

SEQ ID NO: 242523 - RNA, 60 nt, hsa; identical to SEQ ID NO: 37847

SEQ ID NO: 242524 - RNA, 60 nt, hsa; identical to SEQ ID NO: 37848

SEQ ID NO: 242525 - RNA, 60 nt, hsa; identical to SEQ ID NO: 37849

SEQ ID NO: 242526 - RNA, 60 nt, hsa; identical to SEQ ID NO: 37850

SEQ ID NO: 242527 - RNA, 60 nt, hsa; identical to SEQ ID NO: 37851

SEQ ID NO: 242528 - RNA, 60 nt, hsa; identical to SEQ ID NO: 37852

SEQ ID NO: 242529 - RNA, 60 nt, hsa; identical to SEQ ID NO: 37853

SEQ ID NO: 242530 - RNA, 60 nt, hsa; identical to SEQ ID NO: 37854

SEQ ID NO: 242531 - RNA, 60 nt, hsa; identical to SEQ ID NO: 37855

SEQ ID NO: 242532 - RNA, 60 nt, hsa; identical to SEQ ID NO: 37856

SEQ ID NO: 242533 - RNA, 60 nt, hsa; identical to SEQ ID NO: 37857

SEQ ID NO: 242534 - RNA, 60 nt, hsa; identical to SEQ ID NO: 37858

SEQ ID NO: 242535 - RNA, 60 nt, hsa; identical to SEQ ID NO: 37859

SEQ ID NO: 242536 - RNA, 60 nt, hsa; identical to SEQ ID NO: 37860

SEQ ID NO: 242537 - RNA, 60 nt, hsa; identical to SEQ ID NO: 37861

SEQ ID NO: 242538 - RNA, 60 nt, hsa; identical to SEQ ID NO: 37862

SEQ ID NO: 242539 - RNA, 60 nt, hsa; identical to SEQ ID NO: 37863

SEQ ID NO: 242540 - RNA, 60 nt, hsa; identical to SEQ ID NO: 37864

SEQ ID NO: 242541 - RNA, 60 nt, hsa; identical to SEQ ID NO: 37865

SEQ ID NO: 242542 - RNA, 60 nt, hsa; identical to SEQ ID NO: 37866

SEQ ID NO: 242543 - RNA, 60 nt, hsa; identical to SEQ ID NO: 37867

SEQ ID NO: 242544 - RNA, 60 nt, hsa; identical to SEQ ID NO: 37868

SEQ ID NO: 242545 - RNA, 60 nt, hsa; identical to SEQ ID NO: 37869

SEQ ID NO: 242546 - RNA, 60 nt, hsa; identical to SEQ ID NO: 37870

SEQ ID NO: 242547 - RNA, 60 nt, hsa; identical to SEQ ID NO: 37871

SEQ ID NO: 242548 - RNA, 60 nt, hsa; identical to SEQ ID NO: 37872

SEQ ID NO: 242549 - RNA, 60 nt, hsa; identical to SEQ ID NO: 37873

SEQ ID NO: 242550 - RNA, 60 nt, hsa; identical to SEQ ID NO: 37874

SEQ ID NO: 242551 - RNA, 60 nt, hsa; identical to SEQ ID NO: 37875

SEQ ID NO: 242552 - RNA, 60 nt, hsa; identical to SEQ ID NO: 37876

SEQ ID NO: 242553 - RNA, 60 nt, hsa; identical to SEQ ID NO: 37877

SEQ ID NO: 242554 - RNA, 60 nt, hsa; identical to SEQ ID NO: 37878

SEQ ID NO: 242555 - RNA, 60 nt, hsa; identical to SEQ ID NO: 37879

SEQ ID NO: 242556 - RNA, 60 nt, hsa; identical to SEQ ID NO: 37880

SEQ ID NO: 242557 - RNA, 60 nt, hsa; identical to SEQ ID NO: 37881

SEQ ID NO: 242558 - RNA, 60 nt, hsa; identical to SEQ ID NO: 37882

SEQ ID NO: 242559 - RNA, 60 nt, hsa; identical to SEQ ID NO: 37883

SEQ ID NO: 242560 - RNA, 60 nt, hsa; identical to SEQ ID NO: 37884

SEQ ID NO: 242561 - RNA, 60 nt, hsa; identical to SEQ ID NO: 37885

SEQ ID NO: 242562 - RNA, 60 nt, hsa; identical to SEQ ID NO: 37886

SEQ ID NO: 242563 - RNA, 60 nt, hsa; identical to SEQ ID NO: 37887

SEQ ID NO: 242564 - RNA, 60 nt, hsa; identical to SEQ ID NO: 37888

SEQ ID NO: 242565 - RNA, 60 nt, hsa; identical to SEQ ID NO: 37889

SEQ ID NO: 242566 - RNA, 60 nt, hsa; identical to SEQ ID NO: 37890

SEQ ID NO: 242567 - RNA, 60 nt, hsa; identical to SEQ ID NO: 37891

SEQ ID NO: 242568 - RNA, 60 nt, hsa; identical to SEQ ID NO: 37892

SEQ ID NO: 242569 - RNA, 60 nt, hsa; identical to SEQ ID NO: 37893

SEQ ID NO: 242570 - RNA, 60 nt, hsa; identical to SEQ ID NO: 37894

SEQ ID NO: 242571 - RNA, 60 nt, hsa; identical to SEQ ID NO: 37895

SEQ ID NO: 242572 - RNA, 60 nt, hsa; identical to SEQ ID NO: 37896

SEQ ID NO: 242573 - RNA, 60 nt, hsa; identical to SEQ ID NO: 37897

SEQ ID NO: 242574 - RNA, 60 nt, hsa; identical to SEQ ID NO: 37898

SEQ ID NO: 242575 - RNA, 60 nt, hsa; identical to SEQ ID NO: 37899

SEQ ID NO: 242576 - RNA, 60 nt, hsa; identical to SEQ ID NO: 37900

SEQ ID NO: 242577 - RNA, 60 nt, hsa; identical to SEQ ID NO: 37901

SEQ ID NO: 242578 - RNA, 60 nt, hsa; identical to SEQ ID NO: 37902

SEQ ID NO: 242579 - RNA, 60 nt, hsa; identical to SEQ ID NO: 37903

SEQ ID NO: 242580 - RNA, 60 nt, hsa; identical to SEQ ID NO: 37904

SEQ ID NO: 242581 - RNA, 60 nt, hsa; identical to SEQ ID NO: 37905

SEQ ID NO: 242582 - RNA, 60 nt, hsa; identical to SEQ ID NO: 37906

SEQ ID NO: 242583 - RNA, 60 nt, hsa; identical to SEQ ID NO: 37907

SEQ ID NO: 242584 - RNA, 60 nt, hsa; identical to SEQ ID NO: 37908

SEQ ID NO: 242585 - RNA, 60 nt, hsa; identical to SEQ ID NO: 37909

SEQ ID NO: 242586 - RNA, 60 nt, hsa; identical to SEQ ID NO: 37910

SEQ ID NO: 242587 - RNA, 60 nt, hsa; identical to SEQ ID NO: 37911

SEQ ID NO: 242588 - RNA, 60 nt, hsa; identical to SEQ ID NO: 37912

SEQ ID NO: 242589 - RNA, 60 nt, hsa; identical to SEQ ID NO: 37913

SEQ ID NO: 242590 - RNA, 60 nt, hsa; identical to SEQ ID NO: 37914

SEQ ID NO: 242591 - RNA, 60 nt, hsa; identical to SEQ ID NO: 37915

SEQ ID NO: 242592 - RNA, 60 nt, hsa; identical to SEQ ID NO: 37916

SEQ ID NO: 242593 - RNA, 60 nt, hsa; identical to SEQ ID NO: 37917

SEQ ID NO: 242594 - RNA, 60 nt, hsa; identical to SEQ ID NO: 37918

SEQ ID NO: 242595 - RNA, 60 nt, hsa; identical to SEQ ID NO: 37919

SEQ ID NO: 242596 - RNA, 60 nt, hsa; identical to SEQ ID NO: 37920

SEQ ID NO: 242597 - RNA, 60 nt, hsa; identical to SEQ ID NO: 37921

SEQ ID NO: 242598 - RNA, 60 nt, hsa; identical to SEQ ID NO: 37922

SEQ ID NO: 242599 - RNA, 60 nt, hsa; identical to SEQ ID NO: 37923

SEQ ID NO: 242600 - RNA, 60 nt, hsa; identical to SEQ ID NO: 37924

SEQ ID NO: 242601 - RNA, 60 nt, hsa; identical to SEQ ID NO: 37925

SEQ ID NO: 242602 - RNA, 60 nt, hsa; identical to SEQ ID NO: 37926

SEQ ID NO: 242603 - RNA, 60 nt, hsa; identical to SEQ ID NO: 37927

SEQ ID NO: 242604 - RNA, 60 nt, hsa; identical to SEQ ID NO: 37928

SEQ ID NO: 242605 - RNA, 60 nt, hsa; identical to SEQ ID NO: 37929

SEQ ID NO: 242606 - RNA, 60 nt, hsa; identical to SEQ ID NO: 37930

SEQ ID NO: 242607 - RNA, 60 nt, hsa; identical to SEQ ID NO: 37931

SEQ ID NO: 242608 - RNA, 60 nt, hsa; identical to SEQ ID NO: 37932

SEQ ID NO: 242609 - RNA, 60 nt, hsa; identical to SEQ ID NO: 37933

SEQ ID NO: 242610 - RNA, 60 nt, hsa; identical to SEQ ID NO: 37934

SEQ ID NO: 242611 - RNA, 60 nt, hsa; identical to SEQ ID NO: 37935

SEQ ID NO: 242612 - RNA, 60 nt, hsa; identical to SEQ ID NO: 37936

SEQ ID NO: 242613 - RNA, 60 nt, hsa; identical to SEQ ID NO: 37937

SEQ ID NO: 242614 - RNA, 60 nt, hsa; identical to SEQ ID NO: 37938

SEQ ID NO: 242615 - RNA, 60 nt, hsa; identical to SEQ ID NO: 37939

SEQ ID NO: 242616 - RNA, 60 nt, hsa; identical to SEQ ID NO: 37940

SEQ ID NO: 242617 - RNA, 60 nt, hsa; identical to SEQ ID NO: 37941

SEQ ID NO: 242618 - RNA, 60 nt, hsa; identical to SEQ ID NO: 37942

SEQ ID NO: 242619 - RNA, 60 nt, hsa; identical to SEQ ID NO: 37943

SEQ ID NO: 242620 - RNA, 60 nt, hsa; identical to SEQ ID NO: 37944

SEQ ID NO: 242621 - RNA, 60 nt, hsa; identical to SEQ ID NO: 37945

SEQ ID NO: 242622 - RNA, 60 nt, hsa; identical to SEQ ID NO: 37946

SEQ ID NO: 242623 - RNA, 60 nt, hsa; identical to SEQ ID NO: 37947

SEQ ID NO: 242624 - RNA, 60 nt, hsa; identical to SEQ ID NO: 37948

SEQ ID NO: 242625 - RNA, 60 nt, hsa; identical to SEQ ID NO: 37949

SEQ ID NO: 242626 - RNA, 60 nt, hsa; identical to SEQ ID NO: 37950

SEQ ID NO: 242627 - RNA, 60 nt, hsa; identical to SEQ ID NO: 37951

SEQ ID NO: 242628 - RNA, 60 nt, hsa; identical to SEQ ID NO: 37952

SEQ ID NO: 242629 - RNA, 60 nt, hsa; identical to SEQ ID NO: 37953

SEQ ID NO: 242630 - RNA, 60 nt, hsa; identical to SEQ ID NO: 37954

SEQ ID NO: 242631 - RNA, 60 nt, hsa; identical to SEQ ID NO: 37955

SEQ ID NO: 242632 - RNA, 60 nt, hsa; identical to SEQ ID NO: 37956

SEQ ID NO: 242633 - RNA, 60 nt, hsa; identical to SEQ ID NO: 37957

SEQ ID NO: 242634 - RNA, 60 nt, hsa; identical to SEQ ID NO: 37958

SEQ ID NO: 242635 - RNA, 60 nt, hsa; identical to SEQ ID NO: 37959

SEQ ID NO: 242636 - RNA, 60 nt, hsa; identical to SEQ ID NO: 37960

SEQ ID NO: 242637 - RNA, 54 nt, hsa; identical to SEQ ID NO: 37961

SEQ ID NO: 242638 - RNA, 60 nt, hsa; identical to SEQ ID NO: 37962

SEQ ID NO: 242639 - RNA, 60 nt, hsa; identical to SEQ ID NO: 37963

SEQ ID NO: 242640 - RNA, 60 nt, hsa; identical to SEQ ID NO: 37964

SEQ ID NO: 242641 - RNA, 60 nt, hsa; identical to SEQ ID NO: 37965

SEQ ID NO: 242642 - RNA, 60 nt, hsa; identical to SEQ ID NO: 37966

SEQ ID NO: 242643 - RNA, 60 nt, hsa; identical to SEQ ID NO: 37967

SEQ ID NO: 242644 - RNA, 60 nt, hsa; identical to SEQ ID NO: 37968

SEQ ID NO: 242645 - RNA, 60 nt, hsa; identical to SEQ ID NO: 37969

SEQ ID NO: 242646 - RNA, 60 nt, hsa; identical to SEQ ID NO: 37970

SEQ ID NO: 242647 - RNA, 60 nt, hsa; identical to SEQ ID NO: 37971

SEQ ID NO: 242648 - RNA, 60 nt, hsa; identical to SEQ ID NO: 37972

SEQ ID NO: 242649 - RNA, 60 nt, hsa; identical to SEQ ID NO: 37973

SEQ ID NO: 242650 - RNA, 60 nt, hsa; identical to SEQ ID NO: 37974

SEQ ID NO: 242651 - RNA, 60 nt, hsa; identical to SEQ ID NO: 37975

SEQ ID NO: 242652 - RNA, 60 nt, hsa; identical to SEQ ID NO: 37976

SEQ ID NO: 242653 - RNA, 60 nt, hsa; identical to SEQ ID NO: 37977

SEQ ID NO: 242654 - RNA, 60 nt, hsa; identical to SEQ ID NO: 37978

SEQ ID NO: 242655 - RNA, 60 nt, hsa; identical to SEQ ID NO: 37979

SEQ ID NO: 242656 - RNA, 60 nt, hsa; identical to SEQ ID NO: 37980

SEQ ID NO: 242657 - RNA, 60 nt, hsa; identical to SEQ ID NO: 37981

SEQ ID NO: 242658 - RNA, 60 nt, hsa; identical to SEQ ID NO: 37982

SEQ ID NO: 242659 - RNA, 60 nt, hsa; identical to SEQ ID NO: 37983

SEQ ID NO: 242660 - RNA, 60 nt, hsa; identical to SEQ ID NO: 37984

SEQ ID NO: 242661 - RNA, 60 nt, hsa; identical to SEQ ID NO: 37985

SEQ ID NO: 242662 - RNA, 60 nt, hsa; identical to SEQ ID NO: 37986

SEQ ID NO: 242663 - RNA, 60 nt, hsa; identical to SEQ ID NO: 37987

SEQ ID NO: 242664 - RNA, 60 nt, hsa; identical to SEQ ID NO: 37988

SEQ ID NO: 242665 - RNA, 60 nt, hsa; identical to SEQ ID NO: 37989

SEQ ID NO: 242666 - RNA, 60 nt, hsa; identical to SEQ ID NO: 37990

SEQ ID NO: 242667 - RNA, 60 nt, hsa; identical to SEQ ID NO: 37991

SEQ ID NO: 242668 - RNA, 60 nt, hsa; identical to SEQ ID NO: 37992

SEQ ID NO: 242669 - RNA, 60 nt, hsa; identical to SEQ ID NO: 37993

SEQ ID NO: 242670 - RNA, 60 nt, hsa; identical to SEQ ID NO: 37994

SEQ ID NO: 242671 - RNA, 52 nt, hsa; identical to SEQ ID NO: 37995

SEQ ID NO: 242672 - RNA, 60 nt, hsa; identical to SEQ ID NO: 37996

SEQ ID NO: 242673 - RNA, 60 nt, hsa; identical to SEQ ID NO: 37997

SEQ ID NO: 242674 - RNA, 60 nt, hsa; identical to SEQ ID NO: 37998

SEQ ID NO: 242675 - RNA, 60 nt, hsa; identical to SEQ ID NO: 37999

SEQ ID NO: 242676 - RNA, 60 nt, hsa; identical to SEQ ID NO: 38000

SEQ ID NO: 242677 - RNA, 60 nt, hsa; identical to SEQ ID NO: 38001

SEQ ID NO: 242678 - RNA, 60 nt, hsa; identical to SEQ ID NO: 38002

SEQ ID NO: 242679 - RNA, 60 nt, hsa; identical to SEQ ID NO: 38003

SEQ ID NO: 242680 - RNA, 60 nt, hsa; identical to SEQ ID NO: 38004

SEQ ID NO: 242681 - RNA, 60 nt, hsa; identical to SEQ ID NO: 38005

SEQ ID NO: 242682 - RNA, 60 nt, hsa; identical to SEQ ID NO: 38006

SEQ ID NO: 242683 - RNA, 60 nt, hsa; identical to SEQ ID NO: 38007

SEQ ID NO: 242684 - RNA, 60 nt, hsa; identical to SEQ ID NO: 38008

SEQ ID NO: 242685 - RNA, 60 nt, hsa; identical to SEQ ID NO: 38009

SEQ ID NO: 242686 - RNA, 60 nt, hsa; identical to SEQ ID NO: 38010

SEQ ID NO: 242687 - RNA, 60 nt, hsa; identical to SEQ ID NO: 38011

SEQ ID NO: 242688 - RNA, 60 nt, hsa; identical to SEQ ID NO: 38012

SEQ ID NO: 242689 - RNA, 60 nt, hsa; identical to SEQ ID NO: 38013

SEQ ID NO: 242690 - RNA, 60 nt, hsa; identical to SEQ ID NO: 38014

SEQ ID NO: 242691 - RNA, 60 nt, hsa; identical to SEQ ID NO: 38015

SEQ ID NO: 242692 - RNA, 60 nt, hsa; identical to SEQ ID NO: 38016

SEQ ID NO: 242693 - RNA, 60 nt, hsa; identical to SEQ ID NO: 38017

SEQ ID NO: 242694 - RNA, 60 nt, hsa; identical to SEQ ID NO: 38018

SEQ ID NO: 242695 - RNA, 60 nt, hsa; identical to SEQ ID NO: 38019

SEQ ID NO: 242696 - RNA, 60 nt, hsa; identical to SEQ ID NO: 38020

SEQ ID NO: 242697 - RNA, 60 nt, hsa; identical to SEQ ID NO: 38021

SEQ ID NO: 242698 - RNA, 60 nt, hsa; identical to SEQ ID NO: 38022

SEQ ID NO: 242699 - RNA, 60 nt, hsa; identical to SEQ ID NO: 38023

SEQ ID NO: 242700 - RNA, 60 nt, hsa; identical to SEQ ID NO: 38024

SEQ ID NO: 242701 - RNA, 60 nt, hsa; identical to SEQ ID NO: 38025

SEQ ID NO: 242702 - RNA, 60 nt, hsa; identical to SEQ ID NO: 38026

SEQ ID NO: 242703 - RNA, 60 nt, hsa; identical to SEQ ID NO: 38027

SEQ ID NO: 242704 - RNA, 60 nt, hsa; identical to SEQ ID NO: 38028

SEQ ID NO: 242705 - RNA, 60 nt, hsa; identical to SEQ ID NO: 38029

SEQ ID NO: 242706 - RNA, 60 nt, hsa; identical to SEQ ID NO: 38030

SEQ ID NO: 242707 - RNA, 60 nt, hsa; identical to SEQ ID NO: 38031

SEQ ID NO: 242708 - RNA, 60 nt, hsa; identical to SEQ ID NO: 38032

SEQ ID NO: 242709 - RNA, 60 nt, hsa; identical to SEQ ID NO: 38033

SEQ ID NO: 242710 - RNA, 60 nt, hsa; identical to SEQ ID NO: 38034

SEQ ID NO: 242711 - RNA, 60 nt, hsa; identical to SEQ ID NO: 38035

SEQ ID NO: 242712 - RNA, 60 nt, hsa; identical to SEQ ID NO: 38036

SEQ ID NO: 242713 - RNA, 60 nt, hsa; identical to SEQ ID NO: 38037

SEQ ID NO: 242714 - RNA, 60 nt, hsa; identical to SEQ ID NO: 38038

SEQ ID NO: 242715 - RNA, 60 nt, hsa; identical to SEQ ID NO: 38039

SEQ ID NO: 242716 - RNA, 60 nt, hsa; identical to SEQ ID NO: 38040

SEQ ID NO: 242717 - RNA, 60 nt, hsa; identical to SEQ ID NO: 38041

SEQ ID NO: 242718 - RNA, 60 nt, hsa; identical to SEQ ID NO: 38042

SEQ ID NO: 242719 - RNA, 60 nt, hsa; identical to SEQ ID NO: 38043

SEQ ID NO: 242720 - RNA, 60 nt, hsa; identical to SEQ ID NO: 38044

SEQ ID NO: 242721 - RNA, 60 nt, hsa; identical to SEQ ID NO: 38045

SEQ ID NO: 242722 - RNA, 60 nt, hsa; identical to SEQ ID NO: 38046

SEQ ID NO: 242723 - RNA, 60 nt, hsa; identical to SEQ ID NO: 38047

SEQ ID NO: 242724 - RNA, 60 nt, hsa; identical to SEQ ID NO: 38048

SEQ ID NO: 242725 - RNA, 60 nt, hsa; identical to SEQ ID NO: 38049

SEQ ID NO: 242726 - RNA, 60 nt, hsa; identical to SEQ ID NO: 38050

SEQ ID NO: 242727 - RNA, 60 nt, hsa; identical to SEQ ID NO: 38051

SEQ ID NO: 242728 - RNA, 60 nt, hsa; identical to SEQ ID NO: 38052

SEQ ID NO: 242729 - RNA, 60 nt, hsa; identical to SEQ ID NO: 38053

SEQ ID NO: 242730 - RNA, 60 nt, hsa; identical to SEQ ID NO: 38054

SEQ ID NO: 242731 - RNA, 60 nt, hsa; identical to SEQ ID NO: 38055

SEQ ID NO: 242732 - RNA, 60 nt, hsa; identical to SEQ ID NO: 38056

SEQ ID NO: 242733 - RNA, 60 nt, hsa; identical to SEQ ID NO: 38057

SEQ ID NO: 242734 - RNA, 60 nt, hsa; identical to SEQ ID NO: 38058

SEQ ID NO: 242735 - RNA, 60 nt, hsa; identical to SEQ ID NO: 38059

SEQ ID NO: 242736 - RNA, 60 nt, hsa; identical to SEQ ID NO: 38060

SEQ ID NO: 242737 - RNA, 60 nt, hsa; identical to SEQ ID NO: 38061

SEQ ID NO: 242738 - RNA, 60 nt, hsa; identical to SEQ ID NO: 38062

SEQ ID NO: 242739 - RNA, 60 nt, hsa; identical to SEQ ID NO: 38063

SEQ ID NO: 242740 - RNA, 60 nt, hsa; identical to SEQ ID NO: 38064

SEQ ID NO: 242741 - RNA, 60 nt, hsa; identical to SEQ ID NO: 38065

SEQ ID NO: 242742 - RNA, 60 nt, hsa; identical to SEQ ID NO: 38066

SEQ ID NO: 242743 - RNA, 60 nt, hsa; identical to SEQ ID NO: 38067

SEQ ID NO: 242744 - RNA, 60 nt, hsa; identical to SEQ ID NO: 38068

SEQ ID NO: 242745 - RNA, 60 nt, hsa; identical to SEQ ID NO: 38069

SEQ ID NO: 242746 - RNA, 60 nt, hsa; identical to SEQ ID NO: 38070

SEQ ID NO: 242747 - RNA, 60 nt, hsa; identical to SEQ ID NO: 38071

SEQ ID NO: 242748 - RNA, 60 nt, hsa; identical to SEQ ID NO: 38072

SEQ ID NO: 242749 - RNA, 60 nt, hsa; identical to SEQ ID NO: 38073

SEQ ID NO: 242750 - RNA, 60 nt, hsa; identical to SEQ ID NO: 38074

SEQ ID NO: 242751 - RNA, 60 nt, hsa; identical to SEQ ID NO: 38075

SEQ ID NO: 242752 - RNA, 60 nt, hsa; identical to SEQ ID NO: 38076

SEQ ID NO: 242753 - RNA, 60 nt, hsa; identical to SEQ ID NO: 38077

SEQ ID NO: 242754 - RNA, 60 nt, hsa; identical to SEQ ID NO: 38078

SEQ ID NO: 242755 - RNA, 60 nt, hsa; identical to SEQ ID NO: 38079

SEQ ID NO: 242756 - RNA, 60 nt, hsa; identical to SEQ ID NO: 38080

SEQ ID NO: 242757 - RNA, 60 nt, hsa; identical to SEQ ID NO: 38081

SEQ ID NO: 242758 - RNA, 60 nt, hsa; identical to SEQ ID NO: 38082

SEQ ID NO: 242759 - RNA, 60 nt, hsa; identical to SEQ ID NO: 38083

SEQ ID NO: 242760 - RNA, 60 nt, hsa; identical to SEQ ID NO: 38084

SEQ ID NO: 242761 - RNA, 60 nt, hsa; identical to SEQ ID NO: 38085

SEQ ID NO: 242762 - RNA, 60 nt, hsa; identical to SEQ ID NO: 38086

SEQ ID NO: 242763 - RNA, 60 nt, hsa; identical to SEQ ID NO: 38087

SEQ ID NO: 242764 - RNA, 60 nt, hsa; identical to SEQ ID NO: 38088

SEQ ID NO: 242765 - RNA, 60 nt, hsa; identical to SEQ ID NO: 38089

SEQ ID NO: 242766 - RNA, 60 nt, hsa; identical to SEQ ID NO: 38090

SEQ ID NO: 242767 - RNA, 60 nt, hsa; identical to SEQ ID NO: 38091

SEQ ID NO: 242768 - RNA, 60 nt, hsa; identical to SEQ ID NO: 38092

SEQ ID NO: 242769 - RNA, 60 nt, hsa; identical to SEQ ID NO: 38093

SEQ ID NO: 242770 - RNA, 60 nt, hsa; identical to SEQ ID NO: 38094

SEQ ID NO: 242771 - RNA, 60 nt, hsa; identical to SEQ ID NO: 38095

SEQ ID NO: 242772 - RNA, 60 nt, hsa; identical to SEQ ID NO: 38096

SEQ ID NO: 242773 - RNA, 60 nt, hsa; identical to SEQ ID NO: 38097

SEQ ID NO: 242774 - RNA, 60 nt, hsa; identical to SEQ ID NO: 38098

SEQ ID NO: 242775 - RNA, 60 nt, hsa; identical to SEQ ID NO: 38099

SEQ ID NO: 242776 - RNA, 60 nt, hsa; identical to SEQ ID NO: 38100

SEQ ID NO: 242777 - RNA, 60 nt, hsa; identical to SEQ ID NO: 38101

SEQ ID NO: 242778 - RNA, 60 nt, hsa; identical to SEQ ID NO: 38102

SEQ ID NO: 242779 - RNA, 60 nt, hsa; identical to SEQ ID NO: 38103

SEQ ID NO: 242780 - RNA, 60 nt, hsa; identical to SEQ ID NO: 38104

SEQ ID NO: 242781 - RNA, 60 nt, hsa; identical to SEQ ID NO: 38105

SEQ ID NO: 242782 - RNA, 60 nt, hsa; identical to SEQ ID NO: 38106

SEQ ID NO: 242783 - RNA, 60 nt, hsa; identical to SEQ ID NO: 38107

SEQ ID NO: 242784 - RNA, 60 nt, hsa; identical to SEQ ID NO: 38108

SEQ ID NO: 242785 - RNA, 60 nt, hsa; identical to SEQ ID NO: 38109

SEQ ID NO: 242786 - RNA, 60 nt, hsa; identical to SEQ ID NO: 38110

SEQ ID NO: 242787 - RNA, 60 nt, hsa; identical to SEQ ID NO: 38111

SEQ ID NO: 242788 - RNA, 60 nt, hsa; identical to SEQ ID NO: 38112

SEQ ID NO: 242789 - RNA, 60 nt, hsa; identical to SEQ ID NO: 38113

SEQ ID NO: 242790 - RNA, 60 nt, hsa; identical to SEQ ID NO: 38114

SEQ ID NO: 242791 - RNA, 60 nt, hsa; identical to SEQ ID NO: 38115

SEQ ID NO: 242792 - RNA, 60 nt, hsa; identical to SEQ ID NO: 38116

SEQ ID NO: 242793 - RNA, 60 nt, hsa; identical to SEQ ID NO: 38117

SEQ ID NO: 242794 - RNA, 60 nt, hsa; identical to SEQ ID NO: 38118

SEQ ID NO: 242795 - RNA, 60 nt, hsa; identical to SEQ ID NO: 38119

SEQ ID NO: 242796 - RNA, 60 nt, hsa; identical to SEQ ID NO: 38120

SEQ ID NO: 242797 - RNA, 60 nt, hsa; identical to SEQ ID NO: 38121

SEQ ID NO: 242798 - RNA, 60 nt, hsa; identical to SEQ ID NO: 38122

SEQ ID NO: 242799 - RNA, 60 nt, hsa; identical to SEQ ID NO: 38123

SEQ ID NO: 242800 - RNA, 60 nt, hsa; identical to SEQ ID NO: 38124

SEQ ID NO: 242801 - RNA, 60 nt, hsa; identical to SEQ ID NO: 38125

SEQ ID NO: 242802 - RNA, 60 nt, hsa; identical to SEQ ID NO: 38126

SEQ ID NO: 242803 - RNA, 60 nt, hsa; identical to SEQ ID NO: 38127

SEQ ID NO: 242804 - RNA, 60 nt, hsa; identical to SEQ ID NO: 38128

SEQ ID NO: 242805 - RNA, 60 nt, hsa; identical to SEQ ID NO: 38129

SEQ ID NO: 242806 - RNA, 60 nt, hsa; identical to SEQ ID NO: 38130

SEQ ID NO: 242807 - RNA, 60 nt, hsa; identical to SEQ ID NO: 38131

SEQ ID NO: 242808 - RNA, 60 nt, hsa; identical to SEQ ID NO: 38132

SEQ ID NO: 242809 - RNA, 60 nt, hsa; identical to SEQ ID NO: 38133

SEQ ID NO: 242810 - RNA, 60 nt, hsa; identical to SEQ ID NO: 38134

SEQ ID NO: 242811 - RNA, 60 nt, hsa; identical to SEQ ID NO: 38135

SEQ ID NO: 242812 - RNA, 60 nt, hsa; identical to SEQ ID NO: 38136

SEQ ID NO: 242813 - RNA, 60 nt, hsa; identical to SEQ ID NO: 38137

SEQ ID NO: 242814 - RNA, 60 nt, hsa; identical to SEQ ID NO: 38138

SEQ ID NO: 242815 - RNA, 60 nt, hsa; identical to SEQ ID NO: 38139

SEQ ID NO: 242816 - RNA, 64 nt, hsa
aauugugaaacuugucaccacacaauaaaaagcagucuuagagagugcuugcuacucaccugcu

SEQ ID NO: 242817 - RNA, 64 nt, hsa
ggaaauugagaaaagggcccaaggaggagauggugucuuagaugccacaggagaagagguaaag

SEQ ID NO: 242818 - RNA, 61 nt, hsa
gugaaucuucuuugacagacuuuguauuuuccacuucuaacugggccucucuuuucucagg

SEQ ID NO: 242819 - RNA, 61 nt, hsa
uugcccauuucuaucacuguggaagcuaaaacacuucuacuagggccaaaaagagaaaaga

SEQ ID NO: 242820 - RNA, 61 nt, hsa
ugaagccuucguuuucaagacuuuuaaaaagcacuucuacuugguuuuuugaucaguguag

SEQ ID NO: 242821 - RNA, 61 nt, hsa
cgguucauuuaaccuggugacuggcucuuaucacuucuaguuuacaggugagggaaccaag

SEQ ID NO: 242822 - RNA, 61 nt, hsa
uguguuuuauuuugaaaauauuuaaauauugcacuucuauaaauaguaugauaaaugcaca

SEQ ID NO: 242823 - RNA, 61 nt, hsa
uaaauggugacucuaguagauuugacucaagcacuucuagaaucaugcacugaauucaaaa

SEQ ID NO: 242824 - RNA, 61 nt, hsa
gucuuuucucaucaguagaaucuauuuuggucacuucuagucaaugaaaaauguaaacuuu

SEQ ID NO: 242825 - RNA, 61 nt, hsa
uugaaugaaaaaugcuuauguauugacagaacacuucuagaaugauacccaaacuccugga

SEQ ID NO: 242826 - RNA, 64 nt, hsa; identical to SEQ ID NO: 91262

SEQ ID NO: 242827 - RNA, 64 nt, hsa; identical to SEQ ID NO: 91263

SEQ ID NO: 242828 - RNA, 64 nt, hsa; identical to SEQ ID NO: 91264

SEQ ID NO: 242829 - RNA, 64 nt, hsa; identical to SEQ ID NO: 91265

SEQ ID NO: 242830 - RNA, 64 nt, hsa; identical to SEQ ID NO: 91266

SEQ ID NO: 242831 - RNA, 64 nt, hsa; identical to SEQ ID NO: 91267

SEQ ID NO: 242832 - RNA, 64 nt, hsa; identical to SEQ ID NO: 91268

SEQ ID NO: 242833 - RNA, 64 nt, hsa; identical to SEQ ID NO: 91269

SEQ ID NO: 242834 - RNA, 64 nt, hsa; identical to SEQ ID NO: 91270

SEQ ID NO: 242835 - RNA, 64 nt, hsa; identical to SEQ ID NO: 91271

SEQ ID NO: 242836 - RNA, 64 nt, hsa; identical to SEQ ID NO: 91272

SEQ ID NO: 242837 - RNA, 64 nt, hsa; identical to SEQ ID NO: 91273

SEQ ID NO: 242838 - RNA, 64 nt, hsa; identical to SEQ ID NO: 91274

SEQ ID NO: 242839 - RNA, 64 nt, hsa; identical to SEQ ID NO: 91275

SEQ ID NO: 242840 - RNA, 64 nt, hsa; identical to SEQ ID NO: 91276

SEQ ID NO: 242841 - RNA, 64 nt, hsa; identical to SEQ ID NO: 91277

SEQ ID NO: 242842 - RNA, 64 nt, hsa; identical to SEQ ID NO: 91278

SEQ ID NO: 242843 - RNA, 64 nt, hsa; identical to SEQ ID NO: 91279

SEQ ID NO: 242844 - RNA, 64 nt, hsa; identical to SEQ ID NO: 91280

SEQ ID NO: 242845 - RNA, 64 nt, hsa; identical to SEQ ID NO: 91281

SEQ ID NO: 242846 - RNA, 64 nt, hsa; identical to SEQ ID NO: 91282

SEQ ID NO: 242847 - RNA, 64 nt, hsa; identical to SEQ ID NO: 91283

SEQ ID NO: 242848 - RNA, 64 nt, hsa; identical to SEQ ID NO: 91284

SEQ ID NO: 242849 - RNA, 64 nt, hsa; identical to SEQ ID NO: 91285

SEQ ID NO: 242850 - RNA, 64 nt, hsa; identical to SEQ ID NO: 91286

SEQ ID NO: 242851 - RNA, 64 nt, hsa; identical to SEQ ID NO: 91287

SEQ ID NO: 242852 - RNA, 64 nt, hsa; identical to SEQ ID NO: 91288

SEQ ID NO: 242853 - RNA, 64 nt, hsa; identical to SEQ ID NO: 91289

SEQ ID NO: 242854 - RNA, 64 nt, hsa; identical to SEQ ID NO: 91290

SEQ ID NO: 242855 - RNA, 64 nt, hsa; identical to SEQ ID NO: 91291

SEQ ID NO: 242856 - RNA, 64 nt, hsa; identical to SEQ ID NO: 91292

SEQ ID NO: 242857 - RNA, 64 nt, hsa; identical to SEQ ID NO: 91293

SEQ ID NO: 242858 - RNA, 64 nt, hsa; identical to SEQ ID NO: 91294

SEQ ID NO: 242859 - RNA, 64 nt, hsa; identical to SEQ ID NO: 91295

SEQ ID NO: 242860 - RNA, 64 nt, hsa; identical to SEQ ID NO: 91296

SEQ ID NO: 242861 - RNA, 64 nt, hsa; identical to SEQ ID NO: 91297

SEQ ID NO: 242862 - RNA, 64 nt, hsa; identical to SEQ ID NO: 91298

SEQ ID NO: 242863 - RNA, 64 nt, hsa; identical to SEQ ID NO: 91299

SEQ ID NO: 242864 - RNA, 64 nt, hsa; identical to SEQ ID NO: 91300

SEQ ID NO: 242865 - RNA, 64 nt, hsa; identical to SEQ ID NO: 91301

SEQ ID NO: 242866 - RNA, 64 nt, hsa; identical to SEQ ID NO: 91302

SEQ ID NO: 242867 - RNA, 64 nt, hsa; identical to SEQ ID NO: 91303

SEQ ID NO: 242868 - RNA, 64 nt, hsa; identical to SEQ ID NO: 91304

SEQ ID NO: 242869 - RNA, 64 nt, hsa; identical to SEQ ID NO: 91305

SEQ ID NO: 242870 - RNA, 64 nt, hsa; identical to SEQ ID NO: 91306

SEQ ID NO: 242871 - RNA, 64 nt, hsa; identical to SEQ ID NO: 91307

SEQ ID NO: 242872 - RNA, 64 nt, hsa; identical to SEQ ID NO: 91308

SEQ ID NO: 242873 - RNA, 64 nt, hsa; identical to SEQ ID NO: 91309

SEQ ID NO: 242874 - RNA, 64 nt, hsa; identical to SEQ ID NO: 91310

SEQ ID NO: 242875 - RNA, 64 nt, hsa; identical to SEQ ID NO: 91311

SEQ ID NO: 242876 - RNA, 64 nt, hsa; identical to SEQ ID NO: 91312

SEQ ID NO: 242877 - RNA, 64 nt, hsa; identical to SEQ ID NO: 91313

SEQ ID NO: 242878 - RNA, 64 nt, hsa; identical to SEQ ID NO: 91314

SEQ ID NO: 242879 - RNA, 64 nt, hsa; identical to SEQ ID NO: 91315

SEQ ID NO: 242880 - RNA, 64 nt, hsa; identical to SEQ ID NO: 91316

SEQ ID NO: 242881 - RNA, 64 nt, hsa; identical to SEQ ID NO: 91317

SEQ ID NO: 242882 - RNA, 64 nt, hsa; identical to SEQ ID NO: 91318

SEQ ID NO: 242883 - RNA, 64 nt, hsa; identical to SEQ ID NO: 91319

SEQ ID NO: 242884 - RNA, 64 nt, hsa; identical to SEQ ID NO: 91320

SEQ ID NO: 242885 - RNA, 64 nt, hsa; identical to SEQ ID NO: 91321

SEQ ID NO: 242886 - RNA, 64 nt, hsa; identical to SEQ ID NO: 91322

SEQ ID NO: 242887 - RNA, 64 nt, hsa; identical to SEQ ID NO: 91323

SEQ ID NO: 242888 - RNA, 64 nt, hsa; identical to SEQ ID NO: 91324

SEQ ID NO: 242889 - RNA, 64 nt, hsa; identical to SEQ ID NO: 91325

SEQ ID NO: 242890 - RNA, 64 nt, hsa; identical to SEQ ID NO: 91326

SEQ ID NO: 242891 - RNA, 64 nt, hsa; identical to SEQ ID NO: 91327

SEQ ID NO: 242892 - RNA, 64 nt, hsa; identical to SEQ ID NO: 91328

SEQ ID NO: 242893 - RNA, 64 nt, hsa; identical to SEQ ID NO: 91329

SEQ ID NO: 242894 - RNA, 64 nt, hsa; identical to SEQ ID NO: 91330

SEQ ID NO: 242895 - RNA, 64 nt, hsa; identical to SEQ ID NO: 91331

SEQ ID NO: 242896 - RNA, 64 nt, hsa; identical to SEQ ID NO: 91332

SEQ ID NO: 242897 - RNA, 64 nt, hsa; identical to SEQ ID NO: 91333

SEQ ID NO: 242898 - RNA, 64 nt, hsa; identical to SEQ ID NO: 91334

SEQ ID NO: 242899 - RNA, 64 nt, hsa; identical to SEQ ID NO: 91335

SEQ ID NO: 242900 - RNA, 64 nt, hsa; identical to SEQ ID NO: 91336

SEQ ID NO: 242901 - RNA, 64 nt, hsa; identical to SEQ ID NO: 91337

SEQ ID NO: 242902 - RNA, 64 nt, hsa; identical to SEQ ID NO: 91338

SEQ ID NO: 242903 - RNA, 64 nt, hsa; identical to SEQ ID NO: 91339

SEQ ID NO: 242904 - RNA, 64 nt, hsa; identical to SEQ ID NO: 91340

SEQ ID NO: 242905 - RNA, 64 nt, hsa; identical to SEQ ID NO: 91341

SEQ ID NO: 242906 - RNA, 64 nt, hsa; identical to SEQ ID NO: 91342

SEQ ID NO: 242907 - RNA, 64 nt, hsa; identical to SEQ ID NO: 91343

SEQ ID NO: 242908 - RNA, 64 nt, hsa; identical to SEQ ID NO: 91344

SEQ ID NO: 242909 - RNA, 64 nt, hsa; identical to SEQ ID NO: 91345

SEQ ID NO: 242910 - RNA, 64 nt, hsa; identical to SEQ ID NO: 91346

SEQ ID NO: 242911 - RNA, 64 nt, hsa; identical to SEQ ID NO: 91347

SEQ ID NO: 242912 - RNA, 64 nt, hsa; identical to SEQ ID NO: 91348

SEQ ID NO: 242913 - RNA, 64 nt, hsa; identical to SEQ ID NO: 91349

SEQ ID NO: 242914 - RNA, 64 nt, hsa; identical to SEQ ID NO: 91350

SEQ ID NO: 242915 - RNA, 64 nt, hsa; identical to SEQ ID NO: 91351

SEQ ID NO: 242916 - RNA, 64 nt, hsa; identical to SEQ ID NO: 91352

SEQ ID NO: 242917 - RNA, 64 nt, hsa; identical to SEQ ID NO: 91353

SEQ ID NO: 242918 - RNA, 54 nt, hsa; identical to SEQ ID NO: 91354

SEQ ID NO: 242919 - RNA, 64 nt, hsa; identical to SEQ ID NO: 91355

SEQ ID NO: 242920 - RNA, 64 nt, hsa; identical to SEQ ID NO: 91356

SEQ ID NO: 242921 - RNA, 64 nt, hsa; identical to SEQ ID NO: 91357

SEQ ID NO: 242922 - RNA, 64 nt, hsa; identical to SEQ ID NO: 91358

SEQ ID NO: 242923 - RNA, 64 nt, hsa; identical to SEQ ID NO: 91359

SEQ ID NO: 242924 - RNA, 64 nt, hsa; identical to SEQ ID NO: 91360

SEQ ID NO: 242925 - RNA, 64 nt, hsa; identical to SEQ ID NO: 91361

SEQ ID NO: 242926 - RNA, 64 nt, hsa; identical to SEQ ID NO: 91362

SEQ ID NO: 242927 - RNA, 64 nt, hsa; identical to SEQ ID NO: 91363

SEQ ID NO: 242928 - RNA, 64 nt, hsa; identical to SEQ ID NO: 91364

SEQ ID NO: 242929 - RNA, 64 nt, hsa; identical to SEQ ID NO: 91365

SEQ ID NO: 242930 - RNA, 64 nt, hsa; identical to SEQ ID NO: 91366

SEQ ID NO: 242931 - RNA, 64 nt, hsa; identical to SEQ ID NO: 91367

SEQ ID NO: 242932 - RNA, 64 nt, hsa; identical to SEQ ID NO: 91368

SEQ ID NO: 242933 - RNA, 64 nt, hsa; identical to SEQ ID NO: 91369

SEQ ID NO: 242934 - RNA, 64 nt, hsa; identical to SEQ ID NO: 91370

SEQ ID NO: 242935 - RNA, 64 nt, hsa; identical to SEQ ID NO: 91371

SEQ ID NO: 242936 - RNA, 64 nt, hsa; identical to SEQ ID NO: 91372

SEQ ID NO: 242937 - RNA, 64 nt, hsa; identical to SEQ ID NO: 91373

SEQ ID NO: 242938 - RNA, 64 nt, hsa; identical to SEQ ID NO: 91374

SEQ ID NO: 242939 - RNA, 64 nt, hsa; identical to SEQ ID NO: 91375

SEQ ID NO: 242940 - RNA, 64 nt, hsa; identical to SEQ ID NO: 91376

SEQ ID NO: 242941 - RNA, 64 nt, hsa; identical to SEQ ID NO: 91377

SEQ ID NO: 242942 - RNA, 64 nt, hsa; identical to SEQ ID NO: 91378

SEQ ID NO: 242943 - RNA, 64 nt, hsa; identical to SEQ ID NO: 91379

SEQ ID NO: 242944 - RNA, 64 nt, hsa; identical to SEQ ID NO: 91380

SEQ ID NO: 242945 - RNA, 64 nt, hsa
ggggccgaccccuuuccccaggcacagccccaggcuggcaaagggagggcccugggcugggugc

SEQ ID NO: 242946 - RNA, 64 nt, hsa
auccacaugcguguugugugcucugcggugccuccuggcaaaggguccuggcucgggucagaag

SEQ ID NO: 242947 - RNA, 64 nt, hsa
gaauagcugggacuacaggcacaugccaccaggacuggcaaacuguuuuauuuuuagguagagg

SEQ ID NO: 242948 - RNA, 64 nt, hsa
uauaaccuaagaaauaccaauguggacauagggccuggcaaagauuucaugaagaagacacuaa

SEQ ID NO: 242949 - RNA, 64 nt, hsa
uaaucaaauaguuaacaucaggaaguuaauuuggcuggcaaaauucuagggaaacuuggccaga

SEQ ID NO: 242950 - RNA, 64 nt, hsa
aguuuuguggugcuguagguaacguguggcacugcuggcaaaugaaggucaugagaugaguucc

SEQ ID NO: 242951 - RNA, 64 nt, hsa
agcaaagaaggccagcaacauuggcacaugccaccuggcaaaggacccuugaguaagugaaggu

SEQ ID NO: 242952 - RNA, 64 nt, hsa
ccuucccauuucuucccacuuucaucuaccuuuucuggcaaaaaggagccuuuugcucucugug

SEQ ID NO: 242953 - RNA, 64 nt, hsa
acuguugguccaauuuucacacacgugagaaucccuggcaaagggagcagaacugaaccggcuu

SEQ ID NO: 242954 - RNA, 64 nt, hsa
ggccccaguggcuguucuggaagaaacagaucuccuggcaaaggccccagcaucucccucacug

SEQ ID NO: 242955 - RNA, 64 nt, hsa
acaguuguacagguuguacacugcaggagagugccuggcaaaaagaucaaauggggcugggacu

SEQ ID NO: 242956 - RNA, 64 nt, hsa
gaguagcugggaccauaggcucacaacaccacaccuggcaaauuugauuuuuuuuuuuuuucca

SEQ ID NO: 242957 - RNA, 64 nt, hsa; identical to SEQ ID NO: 178992

SEQ ID NO: 242958 - RNA, 64 nt, hsa; identical to SEQ ID NO: 178993

SEQ ID NO: 242959 - RNA, 64 nt, hsa; identical to SEQ ID NO: 178994

SEQ ID NO: 242960 - RNA, 64 nt, hsa; identical to SEQ ID NO: 178995

SEQ ID NO: 242961 - RNA, 64 nt, hsa; identical to SEQ ID NO: 178996

SEQ ID NO: 242962 - RNA, 64 nt, hsa; identical to SEQ ID NO: 178997

SEQ ID NO: 242963 - RNA, 64 nt, hsa; identical to SEQ ID NO: 178998

SEQ ID NO: 242964 - RNA, 64 nt, hsa; identical to SEQ ID NO: 178999

SEQ ID NO: 242965 - RNA, 64 nt, hsa; identical to SEQ ID NO: 179000

SEQ ID NO: 242966 - RNA, 64 nt, hsa; identical to SEQ ID NO: 179001

SEQ ID NO: 242967 - RNA, 64 nt, hsa; identical to SEQ ID NO: 179002

SEQ ID NO: 242968 - RNA, 64 nt, hsa; identical to SEQ ID NO: 179003

SEQ ID NO: 242969 - RNA, 64 nt, hsa; identical to SEQ ID NO: 179004

SEQ ID NO: 242970 - RNA, 64 nt, hsa; identical to SEQ ID NO: 179005

SEQ ID NO: 242971 - RNA, 64 nt, hsa; identical to SEQ ID NO: 179006

SEQ ID NO: 242972 - RNA, 64 nt, hsa; identical to SEQ ID NO: 179007

SEQ ID NO: 242973 - RNA, 64 nt, hsa; identical to SEQ ID NO: 179008

SEQ ID NO: 242974 - RNA, 64 nt, hsa
cucauaguaaauacaagcauacucuuguaagaaaaacacugaauacuuugaaccacaaauaagu

SEQ ID NO: 242975 - RNA, 64 nt, hsa
auuaaacauuggcaaaaggaaauggaauaguauaaacacugaucaauagaguaaaauaucugcu

SEQ ID NO: 242976 - RNA, 64 nt, hsa
aaauuaauuuuaauuguguaucaagugaaaaagaaacacugagguuuuaagcugcuguauauag

SEQ ID NO: 242977 - RNA, 64 nt, hsa
uuugaaacaccccguguuguccaguauaccuuauaacacugagccacuucuccccacccuccag

SEQ ID NO: 242978 - RNA, 64 nt, hsa
gaucuucugucuaguacuugucuuauagguaaccaacacugaaaacuuuguagugaugacuacc

SEQ ID NO: 242979 - RNA, 64 nt, hsa
cacaaauaaaucauuugguuucacuuugcaguggaacacugagucacucuuuucuuaacacgug

SEQ ID NO: 242980 - RNA, 64 nt, hsa
ucccuuaacaagaguuuuauaccaauuauuagucaacacugauaaaaggcuuuuuuagggcuuu

SEQ ID NO: 242981 - RNA, 64 nt, hsa
gcuauuguuguacaugagaaauucagcauuaaagaacacugaagcgguaaggucacuguggaag

SEQ ID NO: 242982 - RNA, 64 nt, hsa
auguuccagcguuuucuacucugaauaguucuaaaacacugagcauuuucucauuuguugcauu

SEQ ID NO: 242983 - RNA, 64 nt, hsa
guguuauaaaucagaauuuuacgacaguuugcagaacacugauuugaaagcuuccuaugcaaaa

SEQ ID NO: 242984 - RNA, 64 nt, hsa
uaauuagcaacaagguggcaauuauuuucagaaaaacacugacugugucauuuaaaaagaaaua

SEQ ID NO: 242985 - RNA, 64 nt, hsa
gugcauucggcugcaaauaacagaaaacccagcaaacacugaagggcuggauaagaacccugag

SEQ ID NO: 242986 - RNA, 64 nt, hsa; identical to SEQ ID NO: 108616

SEQ ID NO: 242987 - RNA, 64 nt, hsa; identical to SEQ ID NO: 108617

SEQ ID NO: 242988 - RNA, 64 nt, hsa; identical to SEQ ID NO: 108618

SEQ ID NO: 242989 - RNA, 64 nt, hsa; identical to SEQ ID NO: 108619

SEQ ID NO: 242990 - RNA, 64 nt, hsa; identical to SEQ ID NO: 108620

SEQ ID NO: 242991 - RNA, 64 nt, hsa; identical to SEQ ID NO: 108621

SEQ ID NO: 242992 - RNA, 64 nt, hsa; identical to SEQ ID NO: 108622

SEQ ID NO: 242993 - RNA, 64 nt, hsa; identical to SEQ ID NO: 108623

SEQ ID NO: 242994 - RNA, 61 nt, hsa; identical to SEQ ID NO: 108624

SEQ ID NO: 242995 - RNA, 64 nt, hsa; identical to SEQ ID NO: 108625

SEQ ID NO: 242996 - RNA, 64 nt, hsa; identical to SEQ ID NO: 108626

SEQ ID NO: 242997 - RNA, 64 nt, hsa; identical to SEQ ID NO: 108627

SEQ ID NO: 242998 - RNA, 64 nt, hsa; identical to SEQ ID NO: 108628

SEQ ID NO: 242999 - RNA, 64 nt, hsa; identical to SEQ ID NO: 108629

SEQ ID NO: 243000 - RNA, 64 nt, hsa; identical to SEQ ID NO: 108630

SEQ ID NO: 243001 - RNA, 64 nt, hsa; identical to SEQ ID NO: 108631

SEQ ID NO: 243002 - RNA, 64 nt, hsa; identical to SEQ ID NO: 108632

SEQ ID NO: 243003 - RNA, 64 nt, hsa; identical to SEQ ID NO: 108633

SEQ ID NO: 243004 - RNA, 64 nt, hsa; identical to SEQ ID NO: 108634

SEQ ID NO: 243005 - RNA, 64 nt, hsa; identical to SEQ ID NO: 108635

SEQ ID NO: 243006 - RNA, 64 nt, hsa; identical to SEQ ID NO: 108636

SEQ ID NO: 243007 - RNA, 64 nt, hsa; identical to SEQ ID NO: 108637

SEQ ID NO: 243008 - RNA, 64 nt, hsa; identical to SEQ ID NO: 108638

SEQ ID NO: 243009 - RNA, 64 nt, hsa; identical to SEQ ID NO: 108639

SEQ ID NO: 243010 - RNA, 64 nt, hsa; identical to SEQ ID NO: 108640

SEQ ID NO: 243011 - RNA, 64 nt, hsa; identical to SEQ ID NO: 108641

SEQ ID NO: 243012 - RNA, 64 nt, hsa; identical to SEQ ID NO: 108642

SEQ ID NO: 243013 - RNA, 64 nt, hsa; identical to SEQ ID NO: 108643

SEQ ID NO: 243014 - RNA, 64 nt, hsa; identical to SEQ ID NO: 108644

SEQ ID NO: 243015 - RNA, 64 nt, hsa; identical to SEQ ID NO: 108645

SEQ ID NO: 243016 - RNA, 64 nt, hsa; identical to SEQ ID NO: 108646

SEQ ID NO: 243017 - RNA, 64 nt, hsa; identical to SEQ ID NO: 108647

SEQ ID NO: 243018 - RNA, 64 nt, hsa; identical to SEQ ID NO: 108648

SEQ ID NO: 243019 - RNA, 64 nt, hsa; identical to SEQ ID NO: 108649

SEQ ID NO: 243020 - RNA, 64 nt, hsa; identical to SEQ ID NO: 108650

SEQ ID NO: 243021 - RNA, 64 nt, hsa; identical to SEQ ID NO: 108651

SEQ ID NO: 243022 - RNA, 64 nt, hsa; identical to SEQ ID NO: 108652

SEQ ID NO: 243023 - RNA, 64 nt, hsa; identical to SEQ ID NO: 108653

SEQ ID NO: 243024 - RNA, 64 nt, hsa; identical to SEQ ID NO: 108654

SEQ ID NO: 243025 - RNA, 64 nt, hsa; identical to SEQ ID NO: 108655

SEQ ID NO: 243026 - RNA, 64 nt, hsa; identical to SEQ ID NO: 108656

SEQ ID NO: 243027 - RNA, 64 nt, hsa; identical to SEQ ID NO: 108657

SEQ ID NO: 243028 - RNA, 64 nt, hsa; identical to SEQ ID NO: 108658

SEQ ID NO: 243029 - RNA, 64 nt, hsa; identical to SEQ ID NO: 108659

SEQ ID NO: 243030 - RNA, 64 nt, hsa; identical to SEQ ID NO: 108660

SEQ ID NO: 243031 - RNA, 64 nt, hsa; identical to SEQ ID NO: 108661

SEQ ID NO: 243032 - RNA, 64 nt, hsa; identical to SEQ ID NO: 108662

SEQ ID NO: 243033 - RNA, 64 nt, hsa; identical to SEQ ID NO: 108663

SEQ ID NO: 243034 - RNA, 64 nt, hsa; identical to SEQ ID NO: 108664

SEQ ID NO: 243035 - RNA, 64 nt, hsa; identical to SEQ ID NO: 108665

SEQ ID NO: 243036 - RNA, 64 nt, hsa; identical to SEQ ID NO: 108666

SEQ ID NO: 243037 - RNA, 64 nt, hsa; identical to SEQ ID NO: 108667

SEQ ID NO: 243038 - RNA, 64 nt, hsa; identical to SEQ ID NO: 108668

SEQ ID NO: 243039 - RNA, 64 nt, hsa; identical to SEQ ID NO: 108669

SEQ ID NO: 243040 - RNA, 64 nt, hsa; identical to SEQ ID NO: 108670

SEQ ID NO: 243041 - RNA, 64 nt, hsa; identical to SEQ ID NO: 108671

SEQ ID NO: 243042 - RNA, 64 nt, hsa; identical to SEQ ID NO: 108672

SEQ ID NO: 243043 - RNA, 64 nt, hsa; identical to SEQ ID NO: 108673

SEQ ID NO: 243044 - RNA, 64 nt, hsa; identical to SEQ ID NO: 108674

SEQ ID NO: 243045 - RNA, 64 nt, hsa; identical to SEQ ID NO: 108675

SEQ ID NO: 243046 - RNA, 64 nt, hsa; identical to SEQ ID NO: 108676

SEQ ID NO: 243047 - RNA, 64 nt, hsa; identical to SEQ ID NO: 108677

SEQ ID NO: 243048 - RNA, 64 nt, hsa; identical to SEQ ID NO: 108678

SEQ ID NO: 243049 - RNA, 64 nt, hsa; identical to SEQ ID NO: 108679

SEQ ID NO: 243050 - RNA, 64 nt, hsa; identical to SEQ ID NO: 108680

SEQ ID NO: 243051 - RNA, 64 nt, hsa; identical to SEQ ID NO: 108681

SEQ ID NO: 243052 - RNA, 64 nt, hsa; identical to SEQ ID NO: 108682

SEQ ID NO: 243053 - RNA, 64 nt, hsa; identical to SEQ ID NO: 108683

SEQ ID NO: 243054 - RNA, 64 nt, hsa; identical to SEQ ID NO: 108684

SEQ ID NO: 243055 - RNA, 64 nt, hsa; identical to SEQ ID NO: 108685

SEQ ID NO: 243056 - RNA, 64 nt, hsa; identical to SEQ ID NO: 108686

SEQ ID NO: 243057 - RNA, 64 nt, hsa; identical to SEQ ID NO: 108687

SEQ ID NO: 243058 - RNA, 64 nt, hsa; identical to SEQ ID NO: 108688

SEQ ID NO: 243059 - RNA, 64 nt, hsa; identical to SEQ ID NO: 108689

SEQ ID NO: 243060 - RNA, 64 nt, hsa; identical to SEQ ID NO: 108690

SEQ ID NO: 243061 - RNA, 64 nt, hsa; identical to SEQ ID NO: 108691

SEQ ID NO: 243062 - RNA, 64 nt, hsa; identical to SEQ ID NO: 108692

SEQ ID NO: 243063 - RNA, 64 nt, hsa; identical to SEQ ID NO: 108693

SEQ ID NO: 243064 - RNA, 64 nt, hsa; identical to SEQ ID NO: 108694

SEQ ID NO: 243065 - RNA, 64 nt, hsa; identical to SEQ ID NO: 108695

SEQ ID NO: 243066 - RNA, 64 nt, hsa; identical to SEQ ID NO: 108696

SEQ ID NO: 243067 - RNA, 64 nt, hsa; identical to SEQ ID NO: 108697

SEQ ID NO: 243068 - RNA, 64 nt, hsa; identical to SEQ ID NO: 108698

SEQ ID NO: 243069 - RNA, 64 nt, hsa; identical to SEQ ID NO: 108699

SEQ ID NO: 243070 - RNA, 64 nt, hsa; identical to SEQ ID NO: 108700

SEQ ID NO: 243071 - RNA, 64 nt, hsa; identical to SEQ ID NO: 108701

SEQ ID NO: 243072 - RNA, 64 nt, hsa; identical to SEQ ID NO: 108702

SEQ ID NO: 243073 - RNA, 64 nt, hsa; identical to SEQ ID NO: 108703

SEQ ID NO: 243074 - RNA, 64 nt, hsa; identical to SEQ ID NO: 108704

SEQ ID NO: 243075 - RNA, 64 nt, hsa; identical to SEQ ID NO: 108705

SEQ ID NO: 243076 - RNA, 64 nt, hsa; identical to SEQ ID NO: 108706

SEQ ID NO: 243077 - RNA, 64 nt, hsa; identical to SEQ ID NO: 108707

SEQ ID NO: 243078 - RNA, 64 nt, hsa; identical to SEQ ID NO: 108708

SEQ ID NO: 243079 - RNA, 64 nt, hsa; identical to SEQ ID NO: 108709

SEQ ID NO: 243080 - RNA, 64 nt, hsa; identical to SEQ ID NO: 108710

SEQ ID NO: 243081 - RNA, 64 nt, hsa; identical to SEQ ID NO: 108711

SEQ ID NO: 243082 - RNA, 64 nt, hsa; identical to SEQ ID NO: 108712

SEQ ID NO: 243083 - RNA, 64 nt, hsa; identical to SEQ ID NO: 108713

SEQ ID NO: 243084 - RNA, 64 nt, hsa; identical to SEQ ID NO: 108714

SEQ ID NO: 243085 - RNA, 64 nt, hsa; identical to SEQ ID NO: 108715

SEQ ID NO: 243086 - RNA, 64 nt, hsa; identical to SEQ ID NO: 108716

SEQ ID NO: 243087 - RNA, 64 nt, hsa; identical to SEQ ID NO: 108717

SEQ ID NO: 243088 - RNA, 64 nt, hsa; identical to SEQ ID NO: 108718

SEQ ID NO: 243089 - RNA, 64 nt, hsa; identical to SEQ ID NO: 108719

SEQ ID NO: 243090 - RNA, 64 nt, hsa; identical to SEQ ID NO: 108720

SEQ ID NO: 243091 - RNA, 64 nt, hsa; identical to SEQ ID NO: 108721

SEQ ID NO: 243092 - RNA, 64 nt, hsa; identical to SEQ ID NO: 108722

SEQ ID NO: 243093 - RNA, 64 nt, hsa; identical to SEQ ID NO: 108723

SEQ ID NO: 243094 - RNA, 64 nt, hsa; identical to SEQ ID NO: 108724

SEQ ID NO: 243095 - RNA, 64 nt, hsa; identical to SEQ ID NO: 108725

SEQ ID NO: 243096 - RNA, 64 nt, hsa; identical to SEQ ID NO: 108726

SEQ ID NO: 243097 - RNA, 64 nt, hsa; identical to SEQ ID NO: 108727

SEQ ID NO: 243098 - RNA, 64 nt, hsa; identical to SEQ ID NO: 108728

SEQ ID NO: 243099 - RNA, 64 nt, hsa; identical to SEQ ID NO: 108729

SEQ ID NO: 243100 - RNA, 64 nt, hsa; identical to SEQ ID NO: 108730

SEQ ID NO: 243101 - RNA, 64 nt, hsa; identical to SEQ ID NO: 108731

SEQ ID NO: 243102 - RNA, 64 nt, hsa; identical to SEQ ID NO: 108732

SEQ ID NO: 243103 - RNA, 64 nt, hsa; identical to SEQ ID NO: 108733

SEQ ID NO: 243104 - RNA, 64 nt, hsa; identical to SEQ ID NO: 108734

SEQ ID NO: 243105 - RNA, 64 nt, hsa; identical to SEQ ID NO: 108735

SEQ ID NO: 243106 - RNA, 64 nt, hsa; identical to SEQ ID NO: 108736

SEQ ID NO: 243107 - RNA, 64 nt, hsa; identical to SEQ ID NO: 108737

SEQ ID NO: 243108 - RNA, 64 nt, hsa; identical to SEQ ID NO: 108738

SEQ ID NO: 243109 - RNA, 64 nt, hsa; identical to SEQ ID NO: 108739

SEQ ID NO: 243110 - RNA, 64 nt, hsa; identical to SEQ ID NO: 108740

SEQ ID NO: 243111 - RNA, 64 nt, hsa; identical to SEQ ID NO: 108741

SEQ ID NO: 243112 - RNA, 64 nt, hsa; identical to SEQ ID NO: 108742

SEQ ID NO: 243113 - RNA, 64 nt, hsa; identical to SEQ ID NO: 108743

SEQ ID NO: 243114 - RNA, 64 nt, hsa; identical to SEQ ID NO: 108744

SEQ ID NO: 243115 - RNA, 64 nt, hsa; identical to SEQ ID NO: 108745

SEQ ID NO: 243116 - RNA, 64 nt, hsa; identical to SEQ ID NO: 108746

SEQ ID NO: 243117 - RNA, 64 nt, hsa; identical to SEQ ID NO: 108747

SEQ ID NO: 243118 - RNA, 64 nt, hsa; identical to SEQ ID NO: 108748

SEQ ID NO: 243119 - RNA, 64 nt, hsa; identical to SEQ ID NO: 108749

SEQ ID NO: 243120 - RNA, 64 nt, hsa; identical to SEQ ID NO: 108750

SEQ ID NO: 243121 - RNA, 64 nt, hsa; identical to SEQ ID NO: 108751

SEQ ID NO: 243122 - RNA, 64 nt, hsa; identical to SEQ ID NO: 108752

SEQ ID NO: 243123 - RNA, 64 nt, hsa; identical to SEQ ID NO: 108753

SEQ ID NO: 243124 - RNA, 64 nt, hsa; identical to SEQ ID NO: 108754

SEQ ID NO: 243125 - RNA, 64 nt, hsa; identical to SEQ ID NO: 108755

SEQ ID NO: 243126 - RNA, 64 nt, hsa; identical to SEQ ID NO: 108756

SEQ ID NO: 243127 - RNA, 64 nt, hsa; identical to SEQ ID NO: 108757

SEQ ID NO: 243128 - RNA, 64 nt, hsa; identical to SEQ ID NO: 108758

SEQ ID NO: 243129 - RNA, 64 nt, hsa; identical to SEQ ID NO: 108759

SEQ ID NO: 243130 - RNA, 64 nt, hsa; identical to SEQ ID NO: 108760

SEQ ID NO: 243131 - RNA, 64 nt, hsa; identical to SEQ ID NO: 108761

SEQ ID NO: 243132 - RNA, 64 nt, hsa; identical to SEQ ID NO: 108762

SEQ ID NO: 243133 - RNA, 64 nt, hsa; identical to SEQ ID NO: 108763

SEQ ID NO: 243134 - RNA, 64 nt, hsa; identical to SEQ ID NO: 108764

SEQ ID NO: 243135 - RNA, 64 nt, hsa; identical to SEQ ID NO: 108765

SEQ ID NO: 243136 - RNA, 64 nt, hsa
cuaccaccaaucccgaucggcucuuauuagcuccccgcuccacaagacaccugugacauccucc

SEQ ID NO: 243137 - RNA, 64 nt, hsa
ccaccaccaaucccgaucggcucuuauuagcuccccgcuccacaagacaccugugaucuggaaa

SEQ ID NO: 243138 - RNA, 64 nt, hsa
ccacgaccaaucccgaucggcucuuauuagcuccccgcuccacaagacaccugugcuuuggaaa

SEQ ID NO: 243139 - RNA, 64 nt, hsa
cuaaugcuccacucggcgccccacuccaucggccccgcuccaucggcacuaaugccccacucgg

SEQ ID NO: 243140 - RNA, 64 nt, hsa
gucacuaacguccggcuccaucggcacuaccaccccgcuccaucaucacuauguccagcuccgu

SEQ ID NO: 243141 - RNA, 64 nt, hsa
ggcacuggugccccauuccaucggcacuaacgccccgcuccaccggcaccagugccucgcucca

SEQ ID NO: 243142 - RNA, 64 nt, hsa; identical to SEQ ID NO: 161048

SEQ ID NO: 243143 - RNA, 64 nt, hsa; identical to SEQ ID NO: 161049

SEQ ID NO: 243144 - RNA, 64 nt, hsa; identical to SEQ ID NO: 161050

SEQ ID NO: 243145 - RNA, 64 nt, hsa; identical to SEQ ID NO: 161051

SEQ ID NO: 243146 - RNA, 64 nt, hsa; identical to SEQ ID NO: 161052

SEQ ID NO: 243147 - RNA, 64 nt, hsa; identical to SEQ ID NO: 161053

SEQ ID NO: 243148 - RNA, 64 nt, hsa; identical to SEQ ID NO: 161054

SEQ ID NO: 243149 - RNA, 64 nt, hsa; identical to SEQ ID NO: 161055

SEQ ID NO: 243150 - RNA, 64 nt, hsa; identical to SEQ ID NO: 161056

SEQ ID NO: 243151 - RNA, 64 nt, hsa; identical to SEQ ID NO: 161057

SEQ ID NO: 243152 - RNA, 64 nt, hsa; identical to SEQ ID NO: 161058

SEQ ID NO: 243153 - RNA, 64 nt, hsa; identical to SEQ ID NO: 161059

SEQ ID NO: 243154 - RNA, 64 nt, hsa; identical to SEQ ID NO: 161060

SEQ ID NO: 243155 - RNA, 64 nt, hsa; identical to SEQ ID NO: 161061

SEQ ID NO: 243156 - RNA, 64 nt, hsa; identical to SEQ ID NO: 161062

SEQ ID NO: 243157 - RNA, 64 nt, hsa; identical to SEQ ID NO: 161063

SEQ ID NO: 243158 - RNA, 64 nt, hsa; identical to SEQ ID NO: 161064

SEQ ID NO: 243159 - RNA, 64 nt, hsa; identical to SEQ ID NO: 161065

SEQ ID NO: 243160 - RNA, 64 nt, hsa; identical to SEQ ID NO: 161066

SEQ ID NO: 243161 - RNA, 64 nt, hsa; identical to SEQ ID NO: 161067

SEQ ID NO: 243162 - RNA, 64 nt, hsa; identical to SEQ ID NO: 161068

SEQ ID NO: 243163 - RNA, 64 nt, hsa; identical to SEQ ID NO: 161069

SEQ ID NO: 243164 - RNA, 64 nt, hsa; identical to SEQ ID NO: 161070

SEQ ID NO: 243165 - RNA, 64 nt, hsa; identical to SEQ ID NO: 161071

SEQ ID NO: 243166 - RNA, 64 nt, hsa; identical to SEQ ID NO: 161072

SEQ ID NO: 243167 - RNA, 64 nt, hsa; identical to SEQ ID NO: 161073

SEQ ID NO: 243168 - RNA, 64 nt, hsa; identical to SEQ ID NO: 161074

SEQ ID NO: 243169 - RNA, 64 nt, hsa; identical to SEQ ID NO: 161075

SEQ ID NO: 243170 - RNA, 64 nt, hsa; identical to SEQ ID NO: 161076

SEQ ID NO: 243171 - RNA, 62 nt, hsa; identical to SEQ ID NO: 161077

SEQ ID NO: 243172 - RNA, 64 nt, hsa; identical to SEQ ID NO: 161078

SEQ ID NO: 243173 - RNA, 64 nt, hsa; identical to SEQ ID NO: 161079

SEQ ID NO: 243174 - RNA, 64 nt, hsa; identical to SEQ ID NO: 161080

SEQ ID NO: 243175 - RNA, 64 nt, hsa; identical to SEQ ID NO: 161081

SEQ ID NO: 243176 - RNA, 64 nt, hsa; identical to SEQ ID NO: 161082

SEQ ID NO: 243177 - RNA, 64 nt, hsa; identical to SEQ ID NO: 161083

SEQ ID NO: 243178 - RNA, 64 nt, hsa; identical to SEQ ID NO: 161084

SEQ ID NO: 243179 - RNA, 64 nt, hsa; identical to SEQ ID NO: 161085

SEQ ID NO: 243180 - RNA, 64 nt, hsa; identical to SEQ ID NO: 161086

SEQ ID NO: 243181 - RNA, 64 nt, hsa; identical to SEQ ID NO: 161087

SEQ ID NO: 243182 - RNA, 64 nt, hsa; identical to SEQ ID NO: 161088

SEQ ID NO: 243183 - RNA, 64 nt, hsa; identical to SEQ ID NO: 161089

SEQ ID NO: 243184 - RNA, 64 nt, hsa; identical to SEQ ID NO: 161090

SEQ ID NO: 243185 - RNA, 64 nt, hsa; identical to SEQ ID NO: 161091

SEQ ID NO: 243186 - RNA, 64 nt, hsa; identical to SEQ ID NO: 161092

SEQ ID NO: 243187 - RNA, 64 nt, hsa; identical to SEQ ID NO: 161093

SEQ ID NO: 243188 - RNA, 64 nt, hsa; identical to SEQ ID NO: 161094

SEQ ID NO: 243189 - RNA, 64 nt, hsa; identical to SEQ ID NO: 161095

SEQ ID NO: 243190 - RNA, 64 nt, hsa; identical to SEQ ID NO: 161096

SEQ ID NO: 243191 - RNA, 63 nt, hsa
uuuguuuguagauuuaauguugaacaguacuuuuccauaaaguucuagucacuucuguuggcc

SEQ ID NO: 243192 - RNA, 63 nt, hsa
augauaaaaauacauaaauuugacauucccucuuccauaaaccuuuguuuguagauuuaaugu

SEQ ID NO: 243193 - RNA, 63 nt, hsa
uuagucagaaaaaauaauuuuucauuucaguuuuccauaaacuguuacacaaaauauaaaccu

SEQ ID NO: 243194 - RNA, 63 nt, hsa
agucucaaaccuugaugaaaaacacaaaauuuuuccauaaacuuaucagaagacucacuuuuc

SEQ ID NO: 243195 - RNA, 63 nt, hsa
augaauaaggauucagggguuuuuaaucuacuuuccauaaauuaccaauaucacugauucagg

SEQ ID NO: 243196 - RNA, 63 nt, hsa
ucaaaguuacauucauuuuaauuuugguacauauccauaaauucuccauaaaaguaggaccaa

SEQ ID NO: 243197 - RNA, 63 nt, hsa
uucauuuuaauuuugguacauauccauaaauucuccauaaaaguaggaccaacuuacauuacc

SEQ ID NO: 243198 - RNA, 63 nt, hsa
uucauccgugacacaugaguaccuacugaggacuccauaaacagaacgggauacagagauaaa

SEQ ID NO: 243199 - RNA, 63 nt, hsa
accacauguucugucugagccucaguuuuccuauccauaaaaugaagguagccaggccugccu

SEQ ID NO: 243200 - RNA, 64 nt, hsa; identical to SEQ ID NO: 63016

SEQ ID NO: 243201 - RNA, 64 nt, hsa; identical to SEQ ID NO: 63017

SEQ ID NO: 243202 - RNA, 64 nt, hsa; identical to SEQ ID NO: 63018

SEQ ID NO: 243203 - RNA, 64 nt, hsa; identical to SEQ ID NO: 63019

SEQ ID NO: 243204 - RNA, 64 nt, hsa; identical to SEQ ID NO: 63020

SEQ ID NO: 243205 - RNA, 64 nt, hsa; identical to SEQ ID NO: 63021

SEQ ID NO: 243206 - RNA, 64 nt, hsa; identical to SEQ ID NO: 63022

SEQ ID NO: 243207 - RNA, 64 nt, hsa; identical to SEQ ID NO: 63023

SEQ ID NO: 243208 - RNA, 64 nt, hsa; identical to SEQ ID NO: 63024

SEQ ID NO: 243209 - RNA, 64 nt, hsa; identical to SEQ ID NO: 63025

SEQ ID NO: 243210 - RNA, 56 nt, hsa; identical to SEQ ID NO: 63026

SEQ ID NO: 243211 - RNA, 64 nt, hsa; identical to SEQ ID NO: 63027

SEQ ID NO: 243212 - RNA, 64 nt, hsa; identical to SEQ ID NO: 63028

SEQ ID NO: 243213 - RNA, 64 nt, hsa; identical to SEQ ID NO: 63029

SEQ ID NO: 243214 - RNA, 64 nt, hsa; identical to SEQ ID NO: 63030

SEQ ID NO: 243215 - RNA, 64 nt, hsa; identical to SEQ ID NO: 63031

SEQ ID NO: 243216 - RNA, 64 nt, hsa; identical to SEQ ID NO: 63032

SEQ ID NO: 243217 - RNA, 64 nt, hsa; identical to SEQ ID NO: 63033

SEQ ID NO: 243218 - RNA, 64 nt, hsa; identical to SEQ ID NO: 63034

SEQ ID NO: 243219 - RNA, 64 nt, hsa; identical to SEQ ID NO: 63035

SEQ ID NO: 243220 - RNA, 64 nt, hsa; identical to SEQ ID NO: 63036

SEQ ID NO: 243221 - RNA, 64 nt, hsa; identical to SEQ ID NO: 63037

SEQ ID NO: 243222 - RNA, 64 nt, hsa; identical to SEQ ID NO: 63038

SEQ ID NO: 243223 - RNA, 64 nt, hsa; identical to SEQ ID NO: 63039

SEQ ID NO: 243224 - RNA, 64 nt, hsa; identical to SEQ ID NO: 63040

SEQ ID NO: 243225 - RNA, 64 nt, hsa; identical to SEQ ID NO: 63041

SEQ ID NO: 243226 - RNA, 64 nt, hsa; identical to SEQ ID NO: 63042

SEQ ID NO: 243227 - RNA, 64 nt, hsa; identical to SEQ ID NO: 63043

SEQ ID NO: 243228 - RNA, 64 nt, hsa; identical to SEQ ID NO: 63044

SEQ ID NO: 243229 - RNA, 64 nt, hsa; identical to SEQ ID NO: 63045

SEQ ID NO: 243230 - RNA, 64 nt, hsa; identical to SEQ ID NO: 63046

SEQ ID NO: 243231 - RNA, 64 nt, hsa; identical to SEQ ID NO: 63047

SEQ ID NO: 243232 - RNA, 64 nt, hsa; identical to SEQ ID NO: 63048

SEQ ID NO: 243233 - RNA, 64 nt, hsa; identical to SEQ ID NO: 63049

SEQ ID NO: 243234 - RNA, 64 nt, hsa; identical to SEQ ID NO: 63050

SEQ ID NO: 243235 - RNA, 64 nt, hsa; identical to SEQ ID NO: 63051

SEQ ID NO: 243236 - RNA, 64 nt, hsa; identical to SEQ ID NO: 63052

SEQ ID NO: 243237 - RNA, 64 nt, hsa; identical to SEQ ID NO: 63053

SEQ ID NO: 243238 - RNA, 64 nt, hsa; identical to SEQ ID NO: 63054

SEQ ID NO: 243239 - RNA, 64 nt, hsa; identical to SEQ ID NO: 63055

SEQ ID NO: 243240 - RNA, 64 nt, hsa; identical to SEQ ID NO: 63056

SEQ ID NO: 243241 - RNA, 64 nt, hsa; identical to SEQ ID NO: 63057

SEQ ID NO: 243242 - RNA, 64 nt, hsa; identical to SEQ ID NO: 63058

SEQ ID NO: 243243 - RNA, 64 nt, hsa; identical to SEQ ID NO: 63059

SEQ ID NO: 243244 - RNA, 64 nt, hsa; identical to SEQ ID NO: 63060

SEQ ID NO: 243245 - RNA, 64 nt, hsa; identical to SEQ ID NO: 63061

SEQ ID NO: 243246 - RNA, 64 nt, hsa; identical to SEQ ID NO: 63062

SEQ ID NO: 243247 - RNA, 64 nt, hsa; identical to SEQ ID NO: 63063

SEQ ID NO: 243248 - RNA, 64 nt, hsa; identical to SEQ ID NO: 63064

SEQ ID NO: 243249 - RNA, 64 nt, hsa; identical to SEQ ID NO: 63065

SEQ ID NO: 243250 - RNA, 64 nt, hsa; identical to SEQ ID NO: 63066

SEQ ID NO: 243251 - RNA, 64 nt, hsa; identical to SEQ ID NO: 63067

SEQ ID NO: 243252 - RNA, 64 nt, hsa; identical to SEQ ID NO: 63068

SEQ ID NO: 243253 - RNA, 64 nt, hsa; identical to SEQ ID NO: 63069

SEQ ID NO: 243254 - RNA, 64 nt, hsa; identical to SEQ ID NO: 63070

SEQ ID NO: 243255 - RNA, 64 nt, hsa; identical to SEQ ID NO: 63071

SEQ ID NO: 243256 - RNA, 64 nt, hsa
guccccacccacagaagcagaccuucagcucaggccccggcauugccaucagcagccucagcgu

SEQ ID NO: 243257 - RNA, 64 nt, hsa
gcuggaggacgcagcguccagggccagcgagcucccccggcagcagguccccaagccaugucag

SEQ ID NO: 243258 - RNA, 64 nt, hsa
agcuuaucccaggccagaggcugcaugccacuguccccggcagcgccaaccccugcuuggcugu

SEQ ID NO: 243259 - RNA, 64 nt, hsa
gcagacccggccucggucagcugggaggggcccgccccggcacaaagcacccaugggaauaaag

SEQ ID NO: 243260 - RNA, 64 nt, hsa
cccccaccaggacugggccuccccggcagcaagaccccggcacuccccgccaggcccagggugg

SEQ ID NO: 243261 - RNA, 64 nt, hsa
ccagcccugagccucccccaccaggacugggccuccccggcagcaagaccccggcacuccccgc

SEQ ID NO: 243262 - RNA, 64 nt, hsa
ugagaaaacauuuauaaacaaaagaaacauuuauaaacuaaagaaaaacuaaaagaaugacaga

SEQ ID NO: 243263 - RNA, 64 nt, hsa
uuauaaacaaaagaaacauuuauaaacuaaagaaaaacuaaaagaaugacagaacaaucaucuu

SEQ ID NO: 243264 - RNA, 64 nt, hsa
aacuaugacuaagaaauuaaagaagaaaaccagcaaacuaaaacuucugggcagcaaaaauaua

SEQ ID NO: 243265 - RNA, 64 nt, hsa
aauaguuuuaacuagcuuaguuuucugguuuccaaaacuaaaauagauuaaauccuacaaauuu

SEQ ID NO: 243266 - RNA, 64 nt, hsa
agccguuagacacacaggaaaaauccagaaggguaaacuaaacuaaagcuacaauuaauauggg

SEQ ID NO: 243267 - RNA, 64 nt, hsa
uuagacacacaggaaaaauccagaaggguaaacuaaacuaaagcuacaauuaauaugggaauuu

SEQ ID NO: 243268 - RNA, 64 nt, hsa
uuuuaaaguaaaaauuaugauguuacuuguggagaaacuaaaaauguuguacaacugaccgaaa

SEQ ID NO: 243269 - RNA, 64 nt, hsa
auuggaauauacuaggcagcuggaaaaguauuugaaacuaaauugacauuaaaauuaagauuug

SEQ ID NO: 243270 - RNA, 64 nt, hsa
caaaguggguugcaaucauuccuaacacaggcugaaacuaaacaaucuugcuccuagaguuuau

SEQ ID NO: 243271 - RNA, 64 nt, hsa
aaauaugugaaaguucauuguggucauggugagaaaacuaaaacuacaugaguuucauguuaga

SEQ ID NO: 243272 - RNA, 64 nt, hsa
uuagaaaaugacaaguagagaauacuacauugagaaacuaaacccucuucuugggguccugaua

SEQ ID NO: 243273 - RNA, 64 nt, hsa
acauuuauguugacccacuuauguucagugcugaaaacuaaaaugaacaugcuauucugucagc

SEQ ID NO: 243274 - RNA, 64 nt, hsa
aaaaccaauguuuugcaguuuuuuucauugccaaaaacuaaauggugcuuuauauuuagauugg

SEQ ID NO: 243275 - RNA, 64 nt, hsa
auugaacacaaucucauugaggagcauuuuuuaaaaacuaaaaaaaaaaaaacuuugccagcca

SEQ ID NO: 243276 - RNA, 64 nt, hsa
ucuuagagggacugaaagguuuaaggaggcgaucaaacuaaaaugucuuaauggcugugugaca

SEQ ID NO: 243277 - RNA, 64 nt, hsa
ucauaccaggacaauagggucauuccauaugauaaaacuaaaggacuaaauuuguuuuauaaug

SEQ ID NO: 243278 - RNA, 64 nt, hsa
uggaugagcauaaaccuagucuuaguuuaaaggcaaacuaaaguugaggggaaauaauuaauca

SEQ ID NO: 243279 - RNA, 64 nt, hsa
ugauguguucauuccaguuauucacuuacagaugaaacuaaaacaaauaaaggcaagcuauuau

SEQ ID NO: 243280 - RNA, 64 nt, hsa
uugcaggcaugagccacugcacccaaccccuggaaaacuaaauuuuuaagugcuuauuuuuaua

SEQ ID NO: 243281 - RNA, 64 nt, hsa
auauaauugcgaauaucagaaaacucauacuggaaaacuaaauuuuuuuuuucucuugagacgg

SEQ ID NO: 243282 - RNA, 64 nt, hsa
aauaaguaagaacuauuuuuaaaauauucaaacaaaacuaaaacaaaaauccagugucacaugg

SEQ ID NO: 243283 - RNA, 64 nt, hsa
aguagucuuacuuguuuuuuaaaaugcugguauuaaacuaaauggacuccuuucacuaacugcu

SEQ ID NO: 243284 - RNA, 64 nt, hsa
uaugucaauuauaccucaauaaaucuguaauaaaaaacuaaauuaaaccuugcauuaaaauaau

SEQ ID NO: 243285 - RNA, 64 nt, hsa
acauggcauacgguuacugacuuaugagcuaccaaaacuaaauucuuucucugcuauuaacugg

SEQ ID NO: 243286 - RNA, 64 nt, hsa
uguuagaauauuuuuaaguaggcuuuacugagagaaacuaaauauuggcauacguuaucagcaa

SEQ ID NO: 243287 - RNA, 64 nt, hsa
auaguggaaaaauaaaaaaauaaguaaacagaaaaaacuaaaguuguauuuucccacaaauaua

SEQ ID NO: 243288 - RNA, 64 nt, hsa
ucuaauaggaaaacaugauacuuucaaugugccaaaacuaaaccuuaguauacaacuaaaaauc

SEQ ID NO: 243289 - RNA, 64 nt, hsa
agguacuaugaauguaauucauaauuuaaaaggaaaacuaaaaacuauuuugauuugggaaaau

SEQ ID NO: 243290 - RNA, 64 nt, hsa
uuauauucagcuacucuugucauuucucguugaaaaacuaaaaucugacuagguuaguuuacuc

SEQ ID NO: 243291 - RNA, 64 nt, hsa
aagaauaauuuuaacagacauguauacuccauagaaacuaaacuaaaauaguuuaaaaauauuc

SEQ ID NO: 243292 - RNA, 64 nt, hsa
uaauuuuaacagacauguauacuccauagaaacuaaacuaaaauaguuuaaaaauauucccuuu

SEQ ID NO: 243293 - RNA, 64 nt, hsa
ggagugauugugguucuuggaaaagcagaaggaaaaacuaaaaaguguaucuuguauuuucccu

SEQ ID NO: 243294 - RNA, 64 nt, hsa
auuaucugauccaguccucacauuuuuaaauauaaaacuaaagagagaaugcuucuuacaggaa

SEQ ID NO: 243295 - RNA, 64 nt, hsa
gaacuuauuagaaacgauuccggauggcauuggaaaacuaaagaaacugucaaucuugaaggug

SEQ ID NO: 243296 - RNA, 64 nt, hsa
guuauuuuaacagacccugccuaaaagcauuggaaaacuaaagaaguugagcaacuugaaugca

SEQ ID NO: 243297 - RNA, 64 nt, hsa
cauaauggugaauguucaaucuguguaagaaaacaaacuaaauguaguugucacacuaaaauuu

SEQ ID NO: 243298 - RNA, 64 nt, hsa
uggccuuuuuaaguauugcagucuaaaacuucaaaaacuaaaaucauugucaaaauuaauauga

SEQ ID NO: 243299 - RNA, 64 nt, hsa
aguaguuaaugaugauaacaaugguguaacuuguaaacuaaauauuugguaacugaagcaauag

SEQ ID NO: 243300 - RNA, 64 nt, hsa
gaaaaauuggagacuuauaaucaugguaaauauaaaacuaaauauguuuuaauauuucugaauu

SEQ ID NO: 243301 - RNA, 64 nt, hsa
uauucaaauaagauuauuuacaaacuuauucuugaaacuaaauauaguaaagaggguuuuuaaa

SEQ ID NO: 243302 - RNA, 64 nt, hsa
aaaauaaaugauuuaaaaucaaaucaaaaagaaaaaacuaaacauuuaaacaaaaaugggauaa

SEQ ID NO: 243303 - RNA, 64 nt, hsa
uaaaugcaauuuauuauuucagaaauuucccaugaaacuaaaaauagaaaauaagauauacaag

SEQ ID NO: 243304 - RNA, 64 nt, hsa
aaaacaaggaaauguaccucuuucuucagaauuaaaacuaaaaucuuaaauaaaacagaaaacu

SEQ ID NO: 243305 - RNA, 64 nt, hsa
aagaaaacagaaaccugguuauaaccugacgcuaaaacuaaaaacaaggaaauguaccucuuuc

SEQ ID NO: 243306 - RNA, 64 nt, hsa
cuuguuauuucuuuguaaaaugucuuagauaauaaaacuaaaucauaaaguagauauugguuua

SEQ ID NO: 243307 - RNA, 64 nt, hsa
aaaaaacacuuuucuaaggacugaagauuggcaaaaacuaaaauaaauuaaaacugcuuacacc

SEQ ID NO: 243308 - RNA, 64 nt, hsa
ggaaucuuuccuaaugacaaccugauauuaagggaaacuaaagaaaauguuauuguggauccca

SEQ ID NO: 243309 - RNA, 64 nt, hsa
ugauggcucgugggauguccuacuaucacugaacaaacuaaaggugcacugcuuugggauuuaa

SEQ ID NO: 243310 - RNA, 64 nt, hsa
uuauugcauauuuucauaaucagucaaaauaauaaaacuaaaaacaaaaaguaaaaauuaguuc

SEQ ID NO: 243311 - RNA, 64 nt, hsa
gaaucagagaauacuuggccaagcucguauuuguaaacuaaaaccccuuguuauuuguaucuuc

SEQ ID NO: 243312 - RNA, 64 nt, hsa
guaccuauuuuagguauuuugagguauuuaccauaaacuaaauuuagaaauuuuuuagauucac

SEQ ID NO: 243313 - RNA, 64 nt, hsa
auuauuucaucaaucauuuguugacaaaaaagaaaaacuaaaaaauaaauuuaaaaugugaccc

SEQ ID NO: 243314 - RNA, 64 nt, hsa
aaaucagcccucgaguuauucaaugauaacugacaaacuaaauuauuucccuagaaaggaagau

SEQ ID NO: 243315 - RNA, 64 nt, hsa
aucccuagaugauguaugcuugcaguccuauauaaaacuaaauuugcuaucuguguagaaaaua

SEQ ID NO: 243316 - RNA, 64 nt, hsa
uuguucuaugucuuuguuggcugguguauuuuauaaacuaaagcugccuauguuucuuuuuaaa

SEQ ID NO: 243317 - RNA, 64 nt, hsa
auauucugucuggguuuuuaaugucuguggaaaaaaacuaaacaagucucugucucaguuaaga

SEQ ID NO: 243318 - RNA, 64 nt, hsa
cuuucugcaaccuguacuuacagauucuuccuguaaacuaaauaaaaaaaaaaugauagugcau

SEQ ID NO: 243319 - RNA, 64 nt, hsa
uacugggccaacuugagaggaaaaaauggaaaagaaacuaaaauguugggugaauucuaccaaa

SEQ ID NO: 243320 - RNA, 64 nt, hsa
aauugccaagaauauguuaacaauuaaaaguuccaaacuaaagccaauagcaccaagucuucau

SEQ ID NO: 243321 - RNA, 64 nt, hsa
caucucgguggccugccuggcugauucuuccuuaaaacuaaaaucucuggaaaauggauuugcu

SEQ ID NO: 243322 - RNA, 64 nt, hsa
guuuucucuuucaguuaguugacucaaagggggaaaacuaaagaaugcaaaacuuuugcuauuc

SEQ ID NO: 243323 - RNA, 64 nt, hsa
aaauaaaagugaaccauauuuaucugguuauauaaaacuaaaaauggggguguuuauauaaaac

SEQ ID NO: 243324 - RNA, 64 nt, hsa
guuauauaaaacuaaaaauggggguguuuauauaaaacuaaaaacuaagaaugauguaaccuuu

SEQ ID NO: 243325 - RNA, 64 nt, hsa
caaaacaaaucauuuuaacaagaugacuacuagaaaacuaaaagccucaaaaaugcuaaaagaa

SEQ ID NO: 243326 - RNA, 64 nt, hsa
cuaaaucagagugcugaguauagaaaauaaucuaaaacuaaaauugguaaaauauuuguauaua

SEQ ID NO: 243327 - RNA, 64 nt, hsa
cugguacauggaggcuauuuuaauccuucuaacuaaacuaaaauagauuaaaggaauuaaacua

SEQ ID NO: 243328 - RNA, 64 nt, hsa
ccuucuaacuaaacuaaaauagauuaaaggaauuaaacuaaaauacaaguaaagcuagacaaag

SEQ ID NO: 243329 - RNA, 64 nt, hsa
uauagaugcuaugguucagauuguuuuuaauagaaaacuaaaggggcaggggaagugaaaggaa

SEQ ID NO: 243330 - RNA, 64 nt, hsa
ggauugaaaugauuuguuucucuuccuaggaugaaaacuaaaucaauuaauuauucaauuaggu

SEQ ID NO: 243331 - RNA, 64 nt, hsa
ccuagaaaacguuuucccagagcugccuauucagaaacuaaagcccucacugucauuauucuuu

SEQ ID NO: 243332 - RNA, 64 nt, hsa
acucuggauguuugguauuuuuuuacauuaaaacaaacuaaagcaaaauuuagaagaaagaacu

SEQ ID NO: 243333 - RNA, 64 nt, hsa
acuucuuggcugguccagggacugcagaaaccaaagcugcuauuguugaggaauaauucagugg

SEQ ID NO: 243334 - RNA, 64 nt, hsa
guugcccuuuuguccuugcucccuggcuagggaaagcugcuaguggucagccuguuuugccuuu

SEQ ID NO: 243335 - RNA, 64 nt, hsa
uacagucaguacacagcugacuuauguagauuuaagcugcuaauaugcuacuuaaccaucuauu

SEQ ID NO: 243336 - RNA, 64 nt, hsa
ccucaaagcaaaaaaaaaaaaaaaaaaaccaguuagcugcuauauaaacacuauaccaagcacu

SEQ ID NO: 243337 - RNA, 64 nt, hsa
auguccuccuugguggacguuucuguuuacucagagcugcuagagaccauccugcccauccgag

SEQ ID NO: 243338 - RNA, 64 nt, hsa
cacaaguggcauuauuuauguugugcugcuguccagcugcuaagaucccuucaucugcacaagc

SEQ ID NO: 243339 - RNA, 64 nt, hsa
acagaguuaauggcaaccaauaaugguggccuguagcugcuaagagcuucacgcagguuuggcc

SEQ ID NO: 243340 - RNA, 64 nt, hsa
uguuguucgguugugugacuaauuguggauuuuaagcugcuauuauuguauuucaguggcaaug

SEQ ID NO: 243341 - RNA, 64 nt, hsa
uguuugugucucugagauugacuucaagauaauaagcugcuaauuguaaacaaaacaguuaccc

SEQ ID NO: 243342 - RNA, 64 nt, hsa
ugaauuuuuuccauuugaggaauuuuaugaauaaagcugcuauaagcaugaaauuacaagucuu

SEQ ID NO: 243343 - RNA, 64 nt, hsa
gagucgucuggcaucucccacacaagacccaaguagcugcuaccuucuuuggccccuugcugga

SEQ ID NO: 243344 - RNA, 64 nt, hsa
aggauuugacucgggccuuagaacuuugcauagcagcugcuacuagcucuuugagauaauacau

SEQ ID NO: 243345 - RNA, 64 nt, hsa; identical to SEQ ID NO: 206360

SEQ ID NO: 243346 - RNA, 64 nt, hsa; identical to SEQ ID NO: 206361

SEQ ID NO: 243347 - RNA, 64 nt, hsa; identical to SEQ ID NO: 206362

SEQ ID NO: 243348 - RNA, 64 nt, hsa; identical to SEQ ID NO: 206363

SEQ ID NO: 243349 - RNA, 64 nt, hsa; identical to SEQ ID NO: 206364

SEQ ID NO: 243350 - RNA, 64 nt, hsa; identical to SEQ ID NO: 206365

SEQ ID NO: 243351 - RNA, 64 nt, hsa; identical to SEQ ID NO: 206366

SEQ ID NO: 243352 - RNA, 64 nt, hsa; identical to SEQ ID NO: 206367

SEQ ID NO: 243353 - RNA, 64 nt, hsa; identical to SEQ ID NO: 206368

SEQ ID NO: 243354 - RNA, 64 nt, hsa; identical to SEQ ID NO: 206369

SEQ ID NO: 243355 - RNA, 64 nt, hsa; identical to SEQ ID NO: 206370

SEQ ID NO: 243356 - RNA, 64 nt, hsa; identical to SEQ ID NO: 206371

SEQ ID NO: 243357 - RNA, 64 nt, hsa; identical to SEQ ID NO: 206372

SEQ ID NO: 243358 - RNA, 62 nt, hsa
ugugugguuguagcaaggacucagccucauguagcacgaauaggggugugguucauggcgug

SEQ ID NO: 243359 - RNA, 62 nt, hsa
gcucgccccuaucgcuccagccaaggcgaagaagcacgaacgaaugucgagagggggugaag

SEQ ID NO: 243360 - RNA, 62 nt, hsa
ucugaagaacauaguguccaggaaagugguuuagcacgaagaggccccuuauuaccauguau

SEQ ID NO: 243361 - RNA, 62 nt, hsa
ugcccuuguuggaagccccaggguggacacucagcacgaaggucucucccuuaacugcugcc

SEQ ID NO: 243362 - RNA, 62 nt, hsa
ugcuaaugcacugaugagucuaguuucauuauagcacgaagcuaugagaauaacuucaguca

SEQ ID NO: 243363 - RNA, 62 nt, hsa
acucuaaauaaacaagguguugccacauuuguagcacgaaggaucucuaacccgggucugcg

SEQ ID NO: 243364 - RNA, 62 nt, hsa
gcugcuaugcacacuggaguccaccauaccaaagcacgaaccagacuguuucuuggggucag

SEQ ID NO: 243365 - RNA, 62 nt, hsa
cuucuugaagccgagccucaagaugaaggcaaagcacgaaauguuauuuuuuaauuauuauu

SEQ ID NO: 243366 - RNA, 62 nt, hsa
gaagaugggcccaauuucuuaagugaugagagagcacgaaauuccauaaccaguacaggccu

SEQ ID NO: 243367 - RNA, 62 nt, hsa
auuuuaaaaaucaguguaccuaggcagugcacagcacgaaauaaguggcccuugcagcuucc

SEQ ID NO: 243368 - RNA, 62 nt, hsa
uagaagugaaugacaauaaagucugucagccaagcacgaaccaagacuggcacuauuuuucu

SEQ ID NO: 243369 - RNA, 62 nt, hsa
augauuugcuuuuuaugccuguucugaauggcagcacgaagcaggccuguuacuuguauguc

SEQ ID NO: 243370 - RNA, 62 nt, hsa
cagaauuguguaugccuugccuaucacgguacagcacgaagccaggcuccuuucuccaccaa

SEQ ID NO: 243371 - RNA, 62 nt, hsa
acgaagcaacaaauaugucaagaacaggacauagcacgaaucuguuaccaguaggaggagga

SEQ ID NO: 243372 - RNA, 62 nt, hsa
augauaacuugacuguauuuuagcacuguuaaagcacgaauugguaacaguuguuucauaaa

SEQ ID NO: 243373 - RNA, 62 nt, hsa
acaagaaagcuguggcucaacacaugagaagaagcacgaagcaguuaggcuguacaucagac

SEQ ID NO: 243374 - RNA, 62 nt, hsa
uuuaugguauuugguacaacuggcugauacuaagcacgaauagauauugauguuauggagug

SEQ ID NO: 243375 - RNA, 62 nt, hsa
ucucuguugcugcugcugaacucagcuguuguagcacgaaagcagccagguaauuacuagau

SEQ ID NO: 243376 - RNA, 62 nt, hsa
gaguggguuuguggagucgccacugcgggaccagcacgaaagcugcuugucugcuuuggcgg

SEQ ID NO: 243377 - RNA, 62 nt, hsa
ucccuagcugcaggaagccccuauuuuuuccaagcacgaagccaccagucucccccagggag

SEQ ID NO: 243378 - RNA, 62 nt, hsa
aagugugcggagacaggcggcugaaagccagcagcacgaacugcccgucagagaagugcaca

SEQ ID NO: 243379 - RNA, 62 nt, hsa
acuuuucagcagcaaaacugcccugaugacgcagcacgaagggccuggcaggcuguuagcag

SEQ ID NO: 243380 - RNA, 62 nt, hsa
uccugcaugaacagcuucaccugggggggcccagcacgaagucacaucccagccccagaguc

SEQ ID NO: 243381 - RNA, 62 nt, hsa
acgaaaaaaaagguagaucuugaauguguuguagcacgaauaaauugcuguacuucauuaag

SEQ ID NO: 243382 - RNA, 62 nt, hsa
ugucauauuucacucucaaaacauaggcugaaagcacgaauuacucaaaaaguaagcaaacc

SEQ ID NO: 243383 - RNA, 62 nt, hsa
uuucuuuuguaauuuguaacuuuuauccacuuagcacgaaugauucuauuaaagaaaaucau

SEQ ID NO: 243384 - RNA, 62 nt, hsa
gcagcccagcagugaucagcaguagccaccuuagcacgaacauaggguuaacccuuucaggc

SEQ ID NO: 243385 - RNA, 62 nt, hsa
gggaguuauucuccccuagagaucgacuuggcagcacgaaggauucuuuucucuuucaugcu

SEQ ID NO: 243386 - RNA, 62 nt, hsa
gccaaaacugcagucacugaaugaccaagagcagcacgaaggacuuggaaccuauccuugua

SEQ ID NO: 243387 - RNA, 62 nt, hsa
aaaagacauguagaauuuguugucuucugcuaagcacgaaaaguuaagauaucugcuuacau

SEQ ID NO: 243388 - RNA, 62 nt, hsa
ccacgaacguagaguuugacugccuaagggacagcacgaaugacucacauguuucagacagg

SEQ ID NO: 243389 - RNA, 62 nt, hsa
cagucccagcaggcagaaugcccaaaaccaggagcacgaaggccugucauccauggggccau

SEQ ID NO: 243390 - RNA, 62 nt, hsa
ugagcagacacaaaacgguggcagguuuggcgagcacgaacuagaccaagcgaagggcagcc

SEQ ID NO: 243391 - RNA, 62 nt, hsa
cuucccuccacagaccccuaugccuuguuccgagcacgaagaaacagcagcagggaugucua

SEQ ID NO: 243392 - RNA, 62 nt, hsa
gaugcuggugguuaaggguagcaaaucucuaaagcacgaagcccucacaaaucuuugccauu

SEQ ID NO: 243393 - RNA, 62 nt, hsa
ucacauuuuccccuacacuuugucauuaaaacagcacgaaaacucacaugauuugguucuug

SEQ ID NO: 243394 - RNA, 62 nt, hsa
ucuaaagcccuuaauuguuccaguuucuuuugagcacgaaagaauucccacuggugagaaac

SEQ ID NO: 243395 - RNA, 62 nt, hsa
ggggaaaggacaagucagggaccacuugcugaagcacgaagagcccuuguggcaauguuaac

SEQ ID NO: 243396 - RNA, 62 nt, hsa
acugaaaguuucaguuuuuauuuuuuucagaaagcacgaaaaauuauuuauaauagucugga

SEQ ID NO: 243397 - RNA, 62 nt, hsa
guuaggcugcaucccacucaaaauacaggaaaagcacgaaucaugauucugcuuucuguuag

SEQ ID NO: 243398 - RNA, 62 nt, hsa
uuucuuuucucucuuuguuguuuaagguauuaagcacgaauuauuacaugagacuggcagau

SEQ ID NO: 243399 - RNA, 62 nt, hsa
guagcugcucgccacacaggcuguugaaacucagcacgaaugcuugagccugccccagcccc

SEQ ID NO: 243400 - RNA, 62 nt, hsa
ccuuggcccaagaccccuuugauucucuaaggagcacgaaagggggaaugccccucccagga

SEQ ID NO: 243401 - RNA, 62 nt, hsa
uucacaguauuauguguaaagucauuguuuaaagcacgaauguucccucugggguacuuguu

SEQ ID NO: 243402 - RNA, 64 nt, hsa
aaaacaggagcagguaacgaaccguaaaaaaaggagcagguaaugaaucguaaccaaaacuaca

SEQ ID NO: 243403 - RNA, 64 nt, hsa
ggagauacugacuguaccugagggccaaaacaggagcagguaacgaaccguaaaaaaaggagca

SEQ ID NO: 243404 - RNA, 64 nt, hsa
uaauuuuuuuauuuguacugaaaaacuaaucauaacuguuaauucucagccaucuuugaagcuu

SEQ ID NO: 243405 - RNA, 64 nt, hsa
gguuuuggugguuaacuuuuacacaguucugaguacuguuaauaucuggaaaguaucuugagau

SEQ ID NO: 243406 - RNA, 64 nt, hsa
caguaaguuaacccuacauguuauaaagauggcgacuguuaacaaaggcuguaacagauuaagu

SEQ ID NO: 243407 - RNA, 64 nt, hsa
uuuacaguaggaaacgccaguaaacaacuuuuauacuguuaaaaggcuuuuuuccccuuccuaa

SEQ ID NO: 243408 - RNA, 64 nt, hsa
uauccaaucugaaguauugcacaucugaacugggacuguuaacacugaugccaauacagugugg

SEQ ID NO: 243409 - RNA, 64 nt, hsa
auaaagggaaccgagauuuaauuuggagaucaucacuguuaaaacgauaccagacauuugucac

SEQ ID NO: 243410 - RNA, 64 nt, hsa
ucugccauuuucuuuugcaauuguaguuuuauguacuguuaaagaauuguauugaauucuuuuu

SEQ ID NO: 243411 - RNA, 64 nt, hsa
cucaaugcauugucaguagaauacauuauuagaaacuguuaaggucuuucccgggacauuuuuu

SEQ ID NO: 243412 - RNA, 64 nt, hsa
aguuucauuuucuuuugcaauuuuaguuuuauguacuguuaaagaauuguacugaauucuuuuu

SEQ ID NO: 243413 - RNA, 64 nt, hsa
aaacucucaacaaucccuucuuucagagagaacuacuguuaacauuuuaacagacaacuucauu

SEQ ID NO: 243414 - RNA, 64 nt, hsa
uuuuuaagggcuguguuauauuaaguucucccuuacuguuaaaaccuaauuaaauaugcuuuag

SEQ ID NO: 243415 - RNA, 64 nt, hsa
caguuuaagaaaaccuuaugaggcaucacuagccacuguuaauaucuauuuguauucuuauacc

SEQ ID NO: 243416 - RNA, 64 nt, hsa
ugcuagccagguaaagauuacacaguucuucuggacuguuaaauugugcaugguuuuggacccc

SEQ ID NO: 243417 - RNA, 64 nt, hsa
uguuuuaagacuuccacacaccaaggcuacaaugacuguuaaccuggaggaagucucugguaug

SEQ ID NO: 243418 - RNA, 64 nt, hsa
auaaauuaagcauaaaauauguaaccaggaaaagacuguuaacauuacauuuaugcaaauuaaa

SEQ ID NO: 243419 - RNA, 64 nt, hsa
gacagcuggcuuuguggguggcuuuuuucauacuacuguuaacuuuuuuaaaaaagaagcaaug

SEQ ID NO: 243420 - RNA, 64 nt, hsa
guuagcuuuucacuuaugaaucaugggaguguuaacuguuaacucuugccguaucaggagacug

SEQ ID NO: 243421 - RNA, 64 nt, hsa
uaaaaauucgucuaucgaauuagggcugaaaauuacuguuaaagaguguugcaguaugucuggu

SEQ ID NO: 243422 - RNA, 64 nt, hsa
aaaugucuuucacagacuuaagggacuauguacuacuguuaauaucucuaagaacaaaacacau

SEQ ID NO: 243423 - RNA, 64 nt, hsa
aauccuuuugcugcuuaucugauguugguuugauacuguuaacacaccaaaaagaauauggaau

SEQ ID NO: 243424 - RNA, 64 nt, hsa
uguagagccacauuuacaauaccucaggcuaauuacuguuaauuuugggguugaacuuuuuuuu

SEQ ID NO: 243425 - RNA, 64 nt, hsa
uguagcucuuggaguacagcuaugaaaauuaacaacuguuaaaggaaauaccuuuuuuuuuuuu

SEQ ID NO: 243426 - RNA, 64 nt, hsa
cucuuuuauuuuacuguuuucuuuuuagaaacccacuguuaaaauuuaaaaaggugcuuuaaaa

SEQ ID NO: 243427 - RNA, 64 nt, hsa
cauuuuggcccuuacgaaauacgucuuuuucagaacuguuaaaguuuugauguacaucgagcug

SEQ ID NO: 243428 - RNA, 64 nt, hsa
ugaaaauuaaauauuacugaagauuucgacuuccacuguuaaauguacaagauacaugaaauau

SEQ ID NO: 243429 - RNA, 64 nt, hsa
accaguuuaccaauacaugaguaacugaaguguaacuguuaaaugcuuguauacuaguuuuucu

SEQ ID NO: 243430 - RNA, 64 nt, hsa
ucuaaagguguaguuuccacuguaacuguugaguacuguuaaguacuguuaaucuuuuacauau

SEQ ID NO: 243431 - RNA, 64 nt, hsa
uaguuuccacuguaacuguugaguacuguuaaguacuguuaaucuuuuacauauuugcacuugg

SEQ ID NO: 243432 - RNA, 64 nt, hsa
uucauuuuauuugcagaguacacuuguaugguagacuguuaaagacaauuuuaugacuauuuau

SEQ ID NO: 243433 - RNA, 64 nt, hsa
gacuuucuugaauugcuuucguaaaggucugaacacuguuaaggagaaagcugaguaucaacuu

SEQ ID NO: 243434 - RNA, 64 nt, hsa
gugucacgggucagcgugcgcugcugagcccuguacuguuaacagugcaaagcuagugaguagc

SEQ ID NO: 243435 - RNA, 64 nt, hsa
ucagcugcugucccaaaguaacaaaacaauaccuacuguuaaguaggaagucaaucugugugcu

SEQ ID NO: 243436 - RNA, 64 nt, hsa
gaaacuuuuacucuucaggagcuuggcaucauggacuguuaauguaugugauuuucccccuauu

SEQ ID NO: 243437 - RNA, 64 nt, hsa
ccaugcagagcugugaaucuagaggcucugagccacuguuaacgcacaauguucacagacaucu

SEQ ID NO: 243438 - RNA, 64 nt, hsa
uaaauaccugauuucuugucaucgagauucuuguacuguuaaaugaauauugccuuuuacugcu

SEQ ID NO: 243439 - RNA, 64 nt, hsa
acuugguuccaugaaaaguaugcuuuguguuuuaacuguuaaaauaauuuaaaaauuaauuauu

SEQ ID NO: 243440 - RNA, 64 nt, hsa
ugagugugguggugugaccuucaggcugcacagaggcaaggacccagauguggcagcaugggcg

SEQ ID NO: 243441 - RNA, 64 nt, hsa
ccuuccuucacuaaagcucccuuuuuuuucuguuggcaaggacagguuacagaauaggaagagu

SEQ ID NO: 243442 - RNA, 64 nt, hsa
cagcugacaggcaccucuccaggccccguagaugggcaaggacuugauaaccaggguuuuaggc

SEQ ID NO: 243443 - RNA, 64 nt, hsa
cccgagccuguguccuccccaccucgcccacccuggcaaggacagcugcggccaaggacgaaag

SEQ ID NO: 243444 - RNA, 64 nt, hsa
aggcaaggagacuuucucucaucuuuccaagcaaggcaaggagacuuuuuaucauuaggaaaca

SEQ ID NO: 243445 - RNA, 64 nt, hsa
agaggaggaucucaucucucaucuguccaaacaaggcaaggagacuuucucucaucuuuccaag

SEQ ID NO: 243446 - RNA, 64 nt, hsa
cuaugaggcugcugacaaguggguggcugcugugggcaaggaccggcccuucauggggggccag

SEQ ID NO: 243447 - RNA, 64 nt, hsa
cuacuacccagccaugaaggcugugaacgagcagggcaaggaggugaccgaguucggcaauaag

SEQ ID NO: 243448 - RNA, 64 nt, hsa
guuauagcuauaccuucaggucuuuuguuacuuaggcaaggaaaaccacaugucugaccugguu

SEQ ID NO: 243449 - RNA, 64 nt, hsa
caaaaauaagccaggcgugguggcgggaggcugaggcaaggagaaucacuugaauacaagaggc

SEQ ID NO: 243450 - RNA, 64 nt, hsa
aggacagaggcggugggacagccuggccacagagggcaaggacugugccggagucccuggggga

SEQ ID NO: 243451 - RNA, 64 nt, hsa
gggcacuguccgccagggcugggcaggcucagguggcaaggacggagcuguccccuagugaggg

SEQ ID NO: 243452 - RNA, 64 nt, hsa
gguucuuggaauuggcaggccuguccaacuugguggcaaggacagagggccuggaccagcaggu

SEQ ID NO: 243453 - RNA, 64 nt, hsa
acuacucauagcagcuccugaggcagguaaauggggcaaggacucacgccaaauaccacacgcg

SEQ ID NO: 243454 - RNA, 64 nt, hsa
ugauccugugaaguaaggaugugggggaagaccuggcaaggacacagaugaaacacaaacaaua

SEQ ID NO: 243455 - RNA, 64 nt, hsa
ucaauucaacacucccuucccaugacccaggcugggcaaggaggccacgugauguggagggcac

SEQ ID NO: 243456 - RNA, 64 nt, hsa
ccccuuccccaugaacccugcccugcucugcccaggcaaggaacagaagugaggaugagaccca

SEQ ID NO: 243457 - RNA, 64 nt, hsa
gaggagaugugaucaggccccaccccuguaaucaggcaaggaggaggagucagaugaggcccug

SEQ ID NO: 243458 - RNA, 64 nt, hsa
ucaacccacaaguagcuacgacugcaagcaccugccaccauaaagggcugcauuuugccaccau

SEQ ID NO: 243459 - RNA, 64 nt, hsa
gcaagcaccugccaccauaaagggcugcauuuugccaccauaaagggcugcauuuuuuuaaaaa

SEQ ID NO: 243460 - RNA, 64 nt, hsa
caagcagcugggacuacaccaccacagguaugcaccaccauaccuggcugauuuuuaaaauuuu

SEQ ID NO: 243461 - RNA, 64 nt, hsa
ugagugaggcgugugugugugucuuuccuaggacccaccauacccuguguauguaugcauguuu

SEQ ID NO: 243462 - RNA, 64 nt, hsa
acucggggagccuucucuguuucuggggccucccccaccauagcucugauucccaccccacaua

SEQ ID NO: 243463 - RNA, 64 nt, hsa; identical to SEQ ID NO: 156945

SEQ ID NO: 243464 - RNA, 64 nt, hsa; identical to SEQ ID NO: 156946

SEQ ID NO: 243465 - RNA, 64 nt, hsa; identical to SEQ ID NO: 156947

SEQ ID NO: 243466 - RNA, 64 nt, hsa; identical to SEQ ID NO: 156948

SEQ ID NO: 243467 - RNA, 64 nt, hsa; identical to SEQ ID NO: 156949

SEQ ID NO: 243468 - RNA, 64 nt, hsa; identical to SEQ ID NO: 156950

SEQ ID NO: 243469 - RNA, 64 nt, hsa; identical to SEQ ID NO: 156951

SEQ ID NO: 243470 - RNA, 64 nt, hsa; identical to SEQ ID NO: 156952

SEQ ID NO: 243471 - RNA, 64 nt, hsa; identical to SEQ ID NO: 156953

SEQ ID NO: 243472 - RNA, 64 nt, hsa; identical to SEQ ID NO: 156954

SEQ ID NO: 243473 - RNA, 64 nt, hsa; identical to SEQ ID NO: 156955

SEQ ID NO: 243474 - RNA, 64 nt, hsa; identical to SEQ ID NO: 156956

SEQ ID NO: 243475 - RNA, 64 nt, hsa; identical to SEQ ID NO: 156957

SEQ ID NO: 243476 - RNA, 64 nt, hsa; identical to SEQ ID NO: 156958

SEQ ID NO: 243477 - RNA, 64 nt, hsa; identical to SEQ ID NO: 156959

SEQ ID NO: 243478 - RNA, 64 nt, hsa; identical to SEQ ID NO: 156960

SEQ ID NO: 243479 - RNA, 64 nt, hsa; identical to SEQ ID NO: 156961

SEQ ID NO: 243480 - RNA, 64 nt, hsa; identical to SEQ ID NO: 156962

SEQ ID NO: 243481 - RNA, 64 nt, hsa; identical to SEQ ID NO: 156963

SEQ ID NO: 243482 - RNA, 64 nt, hsa; identical to SEQ ID NO: 156964

SEQ ID NO: 243483 - RNA, 64 nt, hsa; identical to SEQ ID NO: 156965

SEQ ID NO: 243484 - RNA, 64 nt, hsa; identical to SEQ ID NO: 156966

SEQ ID NO: 243485 - RNA, 64 nt, hsa; identical to SEQ ID NO: 156967

SEQ ID NO: 243486 - RNA, 64 nt, hsa; identical to SEQ ID NO: 156968

SEQ ID NO: 243487 - RNA, 64 nt, hsa; identical to SEQ ID NO: 156969

SEQ ID NO: 243488 - RNA, 64 nt, hsa; identical to SEQ ID NO: 156970

SEQ ID NO: 243489 - RNA, 64 nt, hsa; identical to SEQ ID NO: 156971

SEQ ID NO: 243490 - RNA, 64 nt, hsa; identical to SEQ ID NO: 156972

SEQ ID NO: 243491 - RNA, 64 nt, hsa; identical to SEQ ID NO: 156973

SEQ ID NO: 243492 - RNA, 64 nt, hsa; identical to SEQ ID NO: 156974

SEQ ID NO: 243493 - RNA, 64 nt, hsa; identical to SEQ ID NO: 156975

SEQ ID NO: 243494 - RNA, 64 nt, hsa; identical to SEQ ID NO: 156976

SEQ ID NO: 243495 - RNA, 64 nt, hsa; identical to SEQ ID NO: 156977

SEQ ID NO: 243496 - RNA, 64 nt, hsa; identical to SEQ ID NO: 156978

SEQ ID NO: 243497 - RNA, 64 nt, hsa; identical to SEQ ID NO: 156979

SEQ ID NO: 243498 - RNA, 64 nt, hsa; identical to SEQ ID NO: 156980

SEQ ID NO: 243499 - RNA, 64 nt, hsa; identical to SEQ ID NO: 156981

SEQ ID NO: 243500 - RNA, 64 nt, hsa; identical to SEQ ID NO: 156982

SEQ ID NO: 243501 - RNA, 64 nt, hsa; identical to SEQ ID NO: 156983

SEQ ID NO: 243502 - RNA, 64 nt, hsa; identical to SEQ ID NO: 156984

SEQ ID NO: 243503 - RNA, 64 nt, hsa; identical to SEQ ID NO: 156985

SEQ ID NO: 243504 - RNA, 64 nt, hsa; identical to SEQ ID NO: 156986

SEQ ID NO: 243505 - RNA, 64 nt, hsa; identical to SEQ ID NO: 156987

SEQ ID NO: 243506 - RNA, 64 nt, hsa; identical to SEQ ID NO: 156988

SEQ ID NO: 243507 - RNA, 64 nt, hsa; identical to SEQ ID NO: 156989

SEQ ID NO: 243508 - RNA, 64 nt, hsa; identical to SEQ ID NO: 156990

SEQ ID NO: 243509 - RNA, 64 nt, hsa
auugauaugaagccugacugauuuuuuuuuuccuuacagugagacauuuaagcacacauuuuau

SEQ ID NO: 243510 - RNA, 64 nt, hsa
guuauggucgauuucuauucuugaaagaaucaacuacagugaauccuuugcauuugaagccuua

SEQ ID NO: 243511 - RNA, 64 nt, hsa
guuauaauucuguuuauaauuuccuuucagcauuuacagugaaaagugagaauuuuaaaauuua

SEQ ID NO: 243512 - RNA, 64 nt, hsa
ccaucuuucuuuaucaucuggugugggcgcacucuacagugacuucagucugcucagaacgaau

SEQ ID NO: 243513 - RNA, 64 nt, hsa
aaauucggaaagugaucagagcacuuauucaaaauacagugauagaaguucagaaagcucacca

SEQ ID NO: 243514 - RNA, 64 nt, hsa
gucuccaucaucuagaucucauucacgaaauaaauacagugaucauucacaguguaguagauca

SEQ ID NO: 243515 - RNA, 64 nt, hsa
aauccagugaagaggaccuuucagguaaacaugauacagugacuguuucaucagaucuugauca

SEQ ID NO: 243516 - RNA, 64 nt, hsa
aacauuuuacagauuuuaugguacuaaugaaauuuacagugauagaacaaaagaggauuaguag

SEQ ID NO: 243517 - RNA, 64 nt, hsa
agaggacauaccacugccaugucagggguuugcuuacagugaugccaugaagacaguccaguag

SEQ ID NO: 243518 - RNA, 64 nt, hsa
caggcaugauuacaguaucucauuuuauccggauuacagugaccucaucugauguuagagauuu

SEQ ID NO: 243519 - RNA, 64 nt, hsa
aaugaugggucagaauuucuaccacguuucuggauacagugaaauagcuaaccucuguuucaag

SEQ ID NO: 243520 - RNA, 64 nt, hsa
uucuggaguagauugguauauucuguuaaagacuuacagugauccauuuugcuuacacuguugc

SEQ ID NO: 243521 - RNA, 64 nt, hsa
uguuaagggauuuuaaauugugcauuuuuaacccuacagugaaauaacuuaagauaucccugug

SEQ ID NO: 243522 - RNA, 64 nt, hsa
agcauucuucuuagaguugccuuuucaucccaauuacagugagucugauuuccauccuguauuu

SEQ ID NO: 243523 - RNA, 51 nt, hsa
uuggcacauuucuuuucugacuacagugauguaaguagauagcaaaauacu

SEQ ID NO: 243524 - RNA, 64 nt, hsa
uuuuugacuaaauaauccccaccucccuugaucauacagugaggcuacagugacugaggggaga

SEQ ID NO: 243525 - RNA, 64 nt, hsa
auaauccccaccucccuugaucauacagugaggcuacagugacugaggggagaauccccuccug

SEQ ID NO: 243526 - RNA, 64 nt, hsa
uggucucccaggugccagacccaaaagcuuuuccuacagugauacccuuuauuuuuacuucccc

SEQ ID NO: 243527 - RNA, 64 nt, hsa
gcaggaggcuugcuugaggcaaggaguucaaggcuacagugagcuaugauugugccacuguacu

SEQ ID NO: 243528 - RNA, 64 nt, hsa
gcagaagaaucauuugaacccaggaggcagagguuacagugagccgagaucgugcuacugcauu

SEQ ID NO: 243529 - RNA, 64 nt, hsa
uucuucucucuaaacagcaaagccaaagcacucugcacaccaaaucaccuguucagagguuuau

SEQ ID NO: 243530 - RNA, 64 nt, hsa
ggcagagguugcagugagcugagaucuugccacugcacaccagccugggcaacacagcaagacu

SEQ ID NO: 243531 - RNA, 64 nt, hsa
uaaccccaaagccaucaugggagacauccagauggcacaccagaacuuaaugcuggaucccaug

SEQ ID NO: 243532 - RNA, 64 nt, hsa
gcgcaacccugcugacuguuucaguuaauaugcugcacaccacacacuuguuuagugaaccaaa

SEQ ID NO: 243533 - RNA, 64 nt, hsa
guuggauuuucuaugacagcacaggggacagguggcacaccaugagaggucugcccaggguggg

SEQ ID NO: 243534 - RNA, 64 nt, hsa
uaagaaaaagguaagaacugucucaaaaacgaaagcacaccacccaagacacaguacccaguca

SEQ ID NO: 243535 - RNA, 64 nt, hsa
ucauuugucaccauuuuuaaaacucuguaugcuagcacaccaaacucuugucuauauuuaccuu

SEQ ID NO: 243536 - RNA, 64 nt, hsa
uccaugaacgccucuaguagcaaaccauucuuuugcacaccacaauguuucccucagugcccuu

SEQ ID NO: 243537 - RNA, 64 nt, hsa
cucugcaguaaaaacaaaggacaacccagccaagcagaggaagaagcugccgaaggggacagac

SEQ ID NO: 243538 - RNA, 64 nt, hsa
acguuuuuuuuaaucugugccaaaaauguguuuucagaggaaaucuuauuuucauauucagacu

SEQ ID NO: 243539 - RNA, 64 nt, hsa
uaucucaucagccaucuuguccugugcauccuaacagaggaaggauccaugauucugcuuuggu

SEQ ID NO: 243540 - RNA, 64 nt, hsa
augauucugcuuugguccaauugcuuccucucugcagaggaacaacccuaaaaccagaccacuc

SEQ ID NO: 243541 - RNA, 64 nt, hsa
ggcggguagacaagggaugccugggcugacugggcagaggaaccucuagcucugacugucacuc

SEQ ID NO: 243542 - RNA, 64 nt, hsa
cccccucaccccacccggggcucacucagccuggcagaggaagaaggaaggcagacaucuccgc

SEQ ID NO: 243543 - RNA, 64 nt, hsa
uuugcaggcuggugggcuuucaaauugguacuuccagaggaaagccaagcugcuucuguuguga

SEQ ID NO: 243544 - RNA, 64 nt, hsa
cagccaagagccugaggcugaagggaaaaguacacagaggaagauauuuuacaaaccaggucag

SEQ ID NO: 243545 - RNA, 64 nt, hsa
cuuccaccuuucuguucaaggcuguuugucuacccagaggaaggaggcacugcugaauggcuau

SEQ ID NO: 243546 - RNA, 64 nt, hsa
gaauguuugacucccuuaaucucuuccccagcuacagaggaaucuuuucucugccuggucucag

SEQ ID NO: 243547 - RNA, 64 nt, hsa
acaauuagaagaucugacugauguuaagaguggccagaggaaagugagaggcguccauuuccag

SEQ ID NO: 243548 - RNA, 64 nt, hsa
ccugaaaaggcagaaaaggaagaggggcugcagacagaggaagaaaguuuauggauuuaaaaua

SEQ ID NO: 243549 - RNA, 64 nt, hsa
gggacuuuguuaaaauucacuugaauuucaagcucagaggaaacuuugucucaugcccugacau

SEQ ID NO: 243550 - RNA, 64 nt, hsa
auuucauuccuacucuucaggagacacugcugaacagaggaaugauucuguuccuugugugcuu

SEQ ID NO: 243551 - RNA, 64 nt, hsa
uuggcuuuggguuguauaaggaggaucaaaacaacagaggaaaugcugacuuucuagcuuugca

SEQ ID NO: 243552 - RNA, 64 nt, hsa
gugguggucaacgggagggaggaggagcagacggcagaggaaauccucagcaaaggccugagcc

SEQ ID NO: 243553 - RNA, 64 nt, hsa
ccacaaaagaaaagacuuguaauauuuuuauauacagaggaaaucuguaacagguauuuuguuu

SEQ ID NO: 243554 - RNA, 64 nt, hsa
aacagguauuuuguuucuuuuaaagcaagcaacacagaggaauuuauaccucaaacuaucuggc

SEQ ID NO: 243555 - RNA, 64 nt, hsa
agcaaauaaagccgcuuccugucauuaagcaucucagaggaagcagcccucccucgauggccuc

SEQ ID NO: 243556 - RNA, 64 nt, hsa
cagccuuccugcugccaccaucucugcuucuccccagaggaacuuagggauuucaccccuggcu

SEQ ID NO: 243557 - RNA, 64 nt, hsa
uuugaucacaggagcaaucacaggaaaauguauccagaggaauugauugucagccaccucccuc

SEQ ID NO: 243558 - RNA, 64 nt, hsa
ccuuagcaugugacuccugaagggaaggcaaaggcagaggaauuuggcugcuucuacggccaug

SEQ ID NO: 243559 - RNA, 64 nt, hsa
ggucagaggaagccagcagggaagaucugggggacagaggaaggccuccugagggaggggcagg

SEQ ID NO: 243560 - RNA, 64 nt, hsa
ggagcuuggagaacucacugugggcuaggguggucagaggaagccagcagggaagaucuggggg

SEQ ID NO: 243561 - RNA, 64 nt, hsa
gggaggaaagagcuuccagggggcgaacgcagcacagaggaagaggccugcuccacuugucugg

SEQ ID NO: 243562 - RNA, 64 nt, hsa
ugcuccacuugucugggaaccugggcaggaggcacagaggaagccaaggccuggagcugcaggu

SEQ ID NO: 243563 - RNA, 64 nt, hsa
gaugagacuguguaaaugagagaaagacuugauucagaggaaaaaaauguguucucucuggacu

SEQ ID NO: 243564 - RNA, 64 nt, hsa
gaauugacagauaagaagcaaaugguuucuuguacagaggaauuuuguuuuaauguagaaaguu

SEQ ID NO: 243565 - RNA, 64 nt, hsa
agagugaacuucuuaugggaggcugcagcuggaucagaggaaaaauccagugugacagagugca

SEQ ID NO: 243566 - RNA, 64 nt, hsa
uagacaguaacuucuaaggucacguuuacuauuucagaggaaauaucuugccaggauaccuacc

SEQ ID NO: 243567 - RNA, 64 nt, hsa
ucacaaaggcuuaaaggaagugaaaauagccagccagaggaaaugucucaagaaccagaaauaa

SEQ ID NO: 243568 - RNA, 64 nt, hsa
gauuuuucaacagaacaagacuuaaagcugacaucagaggaagagucacaaaggcuuaaaggaa

SEQ ID NO: 243569 - RNA, 64 nt, hsa
gacuaguguggccucacugccccaggcuuccuuucagaggaaggccuguccugcuggaacugga

SEQ ID NO: 243570 - RNA, 64 nt, hsa
gccuuacaaaaaaaaaaaaauuguuuagugaauacagaggaaaggaaaaacaaguauuaaaggc

SEQ ID NO: 243571 - RNA, 64 nt, hsa
uaagguggaauuugcaggucagcccaggaauuggcagaggaaguaggugucugauaacccuuug

SEQ ID NO: 243572 - RNA, 64 nt, hsa
aaaauaaacagcucuggagucuuguuccugacuccagaggaacgagagcauuccaggaaagaga

SEQ ID NO: 243573 - RNA, 64 nt, hsa
ggacaucucacggcugcggcgcaagcuggaaaagcagaggaagguggaggucuacgcagaugcc

SEQ ID NO: 243574 - RNA, 64 nt, hsa
cuucgagugcgugcggggccgcuaugaggcccgccagaggaagugccccaagugcaacgcggcc

SEQ ID NO: 243575 - RNA, 64 nt, hsa
cuuccuggggccacagggccuauggcagucagaccagaggaagcgguccgggggcugggggcug

SEQ ID NO: 243576 - RNA, 64 nt, hsa
ccugagggccgggaagccgaagaguccacaggcccagaggaagcagaagcccccgaguccuuuc

SEQ ID NO: 243577 - RNA, 64 nt, hsa
gggguccagcacaggcuguaucugcagagggucccagaggaacgcuggagccaagagaagcccu

SEQ ID NO: 243578 - RNA, 64 nt, hsa
ucaaucccuguccugguuguccaagucgggaucucagaggaaauugcagugauuccacgguuag

SEQ ID NO: 243579 - RNA, 64 nt, hsa
ggaacaguucuagggagugagacauuuuugggagcagaggaaaacucugcugauguucgguccu

SEQ ID NO: 243580 - RNA, 64 nt, hsa
uugagaaauccuccuugguaucaugaaacuggagcagaggaauugcaauuuagcaggagguccu

SEQ ID NO: 243581 - RNA, 64 nt, hsa
ugggcuuuuuaccaccacugugcaggagaacagacagaggaaaugugucucccuccaaggcccc

SEQ ID NO: 243582 - RNA, 64 nt, hsa
auccugcccggaaugccagugcuccgagcucagacagaggaagcccugcagaaaguuccaucag

SEQ ID NO: 243583 - RNA, 64 nt, hsa
auaugaggaaaaauaucuugagcuaagaaaguagcagaggaaauuucacaugcaaagccacagu

SEQ ID NO: 243584 - RNA, 64 nt, hsa
gugagcaguuuauguaacuggaaugaaaagggcucagaggaauggcagggauggcaagagaucc

SEQ ID NO: 243585 - RNA, 64 nt, hsa
ccugaaaugaagucaguagaaauggcaugggauaagagcagagcucacacuuuuacaguugcag

SEQ ID NO: 243586 - RNA, 64 nt, hsa
aacuuaacuuuaauuuccuguguaguuuacacccagagcagauacucauaaaguauaaaguaaa

SEQ ID NO: 243587 - RNA, 64 nt, hsa
ucguugguuuuuuggagucuugguugugacuccaagagcagagugaggaagacccccaagcaua

SEQ ID NO: 243588 - RNA, 64 nt, hsa
uuuguuggcuuuuagaguguuggucaugacuccaagagcagagcagggaagagcccaagcauag

SEQ ID NO: 243589 - RNA, 64 nt, hsa
agggaugagaaggauggcggggcuagggaagcagagagcagagcacacacuggcucaagcagca

SEQ ID NO: 243590 - RNA, 64 nt, hsa
aggaaacuuuuaggugguggaaccagggaagcagagagcagagcaugcagugauggaagaagca

SEQ ID NO: 243591 - RNA, 64 nt, hsa
uugucuaggucugaaaucaagggcuugggaaucuagagcagagcuccuggccagcguuugaagc

SEQ ID NO: 243592 - RNA, 64 nt, hsa
ugcuagacuaccccucuucaucagccugcuggaaagagcagacagcguaacagcagccuaugcc

SEQ ID NO: 243593 - RNA, 64 nt, hsa
ugaaacagucucacauacccaacugcucaucaacagagcagagcugauggcaugagugagggcu

SEQ ID NO: 243594 - RNA, 64 nt, hsa
uggaacccuaggaacaaggagccuuuguuccaacagagcagagaaggagguucucuauguucag

SEQ ID NO: 243595 - RNA, 64 nt, hsa
guagauuuaaaaacaagugccguacguuaagagaagagcagaucaugcuauugugacauuugca

SEQ ID NO: 243596 - RNA, 64 nt, hsa
ccaucuucaguuugaaugacucccaggaaggccuagagcagacccuuuagaaaucagcccaagg

SEQ ID NO: 243597 - RNA, 64 nt, hsa
ggcaauggugauaauggauuaauuccucaaaggaagagcagaacaccugaaaaucagcaauuuc

SEQ ID NO: 243598 - RNA, 64 nt, hsa
ggcaauggugaugauggauuaauuccuccaaggaagagcagaacaccugaaagccagcaauuuc

SEQ ID NO: 243599 - RNA, 64 nt, hsa
agucguucuuaagccaucaccaguggguguacucagagcagaggggccaggacuucugccagcc

SEQ ID NO: 243600 - RNA, 64 nt, hsa
cucuguccaggacagcagguaaaaaggaauccccagagcagacgcaaugguaggagccugcaca

SEQ ID NO: 243601 - RNA, 64 nt, hsa
cugggcggcauccacagccagagaggcagaggcaagagcagagccaggcugugcccgagggacc

SEQ ID NO: 243602 - RNA, 64 nt, hsa
cagagcagacugauagguccgugggacccauguuagagcagaaaauuugggcucagcacauuuu

SEQ ID NO: 243603 - RNA, 64 nt, hsa
agacccugcucaggacccagcaggucagcaccccagagcagacugauagguccgugggacccau

SEQ ID NO: 243604 - RNA, 64 nt, hsa
uguugaaccagcaucaagucuccagaaacauggcagagcagacaggccguuaaguuucacagac

SEQ ID NO: 243605 - RNA, 64 nt, hsa
ugagccgagauugcaccacugcacuccagccuggagagcagagcaagacucugucucaaaaaaa

SEQ ID NO: 243606 - RNA, 64 nt, hsa
gccaaucagucaaugauaaucugaacaaauuuuaagagcagauuuuagauuaauaauguuuuau

SEQ ID NO: 243607 - RNA, 64 nt, hsa
uucaggcaagugcaagugguucaggggccagcgcagagcagagugcugaguaaagaugucagaa

SEQ ID NO: 243608 - RNA, 64 nt, hsa
caacccacaaugaucaggucaaucaaaaucccuaagagcagaacuccuaccccaaaagaagccu

SEQ ID NO: 243609 - RNA, 64 nt, hsa
acuauagaccaaaguuugcuuaagguuugacccuagagcagaggugggcaaacuaugaccugga

SEQ ID NO: 243610 - RNA, 64 nt, hsa
uggcccugucgacuauugccacccugcuucuccaagagcagaccaggccaccucauccguaagg

SEQ ID NO: 243611 - RNA, 57 nt, hsa
ugugggugggugagguaugaagggcccagagcagagcccugggccaaggaacacccc

SEQ ID NO: 243612 - RNA, 64 nt, hsa
caggguucucaggcaggcaguucugcuucagcuuagagcagaacccauaaaauacucaaguacu

SEQ ID NO: 243613 - RNA, 64 nt, hsa
uuauuuugaaaguuggaaggagaagggagggaagagagcagaagggaagaagguguaagucaag

SEQ ID NO: 243614 - RNA, 64 nt, hsa
gaugcugaugaacaucgaacauaucuacuucauuagagcagaggcuauuuuucugcauucuugu

SEQ ID NO: 243615 - RNA, 64 nt, hsa
auaauucugagcaggaaauuuauaagaaauugaaagagcagaagaauuacagcccugucacaug

SEQ ID NO: 243616 - RNA, 64 nt, hsa
gcugguuucugggaagggaacguuuauuuaguaaagagcagaacacccuugcguuuuguuggga

SEQ ID NO: 243617 - RNA, 64 nt, hsa
gugagcaggcggagacuccaagcugggcugagccagagcagaaggcgagggauucccagccgga

SEQ ID NO: 243618 - RNA, 64 nt, hsa
ccucccaggggagaguagaagucgcacacgcagcagagcagaccugaugucccggugcuuccug

SEQ ID NO: 243619 - RNA, 64 nt, hsa
aggggccagcggccaccaagcucaugggacacccagagcagaagcuagggcagagccaaugcug

SEQ ID NO: 243620 - RNA, 64 nt, hsa
gguagagacaucuucaaggcaugaaauagcuuaaagagcagaguagaaacggaagaggcuuugc

SEQ ID NO: 243621 - RNA, 64 nt, hsa
ugcacugucgguguuaagagaaauuacucucacaagagcagaggccugaagauucuuucuucug

SEQ ID NO: 243622 - RNA, 64 nt, hsa
gagcaccacucacuucugcagggagcaaggguccagagcagauauggaccccucugcacaggcc

SEQ ID NO: 243623 - RNA, 64 nt, hsa
cucucuguagggcuuccccaccucucggugggacagagcagaggaaggcaggggauuuaggauc

SEQ ID NO: 243624 - RNA, 64 nt, hsa
ugcugccaagggcagaaaauggggagguuagcucagagcagaguagucucuagagaaaggaaga

SEQ ID NO: 243625 - RNA, 64 nt, hsa
ggacuaugcucugaggcuauacucugugcccaugagagcagagacuggaagggcaagaccaggu

SEQ ID NO: 243626 - RNA, 64 nt, hsa
cgaugcaggggaugguguggucaagcccucgucuagagcagacccagcccagaccucugacaca

SEQ ID NO: 243627 - RNA, 64 nt, hsa
ggagucuaaccugcgucauuucagcucuugcuucagagcagauuucgauuuuuuuuggaagagg

SEQ ID NO: 243628 - RNA, 64 nt, hsa
ggaggggacugugggacugaggagcacagagcagagagcagacucugugcggugacuccgaagc

SEQ ID NO: 243629 - RNA, 64 nt, hsa
gugacuuggaggggacugugggacugaggagcacagagcagagagcagacucugugcggugacu

SEQ ID NO: 243630 - RNA, 64 nt, hsa
aggagagguugcuggagcugcaggagaggcugcuagagcagaagcggaaggccgcuuccuuucu

SEQ ID NO: 243631 - RNA, 64 nt, hsa
aggagaggcuacuggagcugcaggagagccugcuagagcagaagcggaaggccgcuuccuuucu

SEQ ID NO: 243632 - RNA, 64 nt, hsa
gaacgcugcauagaccauggaggccuuugcgcagagagcagagaggaugacuugcggccaccaa

SEQ ID NO: 243633 - RNA, 64 nt, hsa
uccucuguaacaucugaggugaccaagaggcagaagagcagagcagucgggggccguguccugg

SEQ ID NO: 243634 - RNA, 59 nt, hsa
uucguguucauuccccuugaggaggaagcagagcagagugcgagauccugacccaagag

SEQ ID NO: 243635 - RNA, 64 nt, hsa
gacccaagagcaccauaacauagcuccgaaagggagagcagagauggcagcugaaacucacucu

SEQ ID NO: 243636 - RNA, 64 nt, hsa
uuuugacauauuucaguuuccaccucacguuuuuagagcagaaccacacugucucccuggaggg

SEQ ID NO: 243637 - RNA, 64 nt, hsa
ugcaugggacuaguucaucugccacagggauuuuagagcagacaucuaaccucauucaggaaaa

SEQ ID NO: 243638 - RNA, 64 nt, hsa
uccuuacuucucuaccugccucaagaaggggcucagagcagagacuugugaauuccuuaguaac

SEQ ID NO: 243639 - RNA, 64 nt, hsa
auggacacacacccaagccacaagaaaucccaagagagcagaagcgaauuuuuaaaagauuuau

SEQ ID NO: 243640 - RNA, 64 nt, hsa
cucaggcugccccucuccuuccccggcucgcaggagagcagagcagagaacuguggggaacgcu

SEQ ID NO: 243641 - RNA, 64 nt, hsa
gcugccccucuccuuccccggcucgcaggagagcagagcagagaacuguggggaacgcugugcu

SEQ ID NO: 243642 - RNA, 64 nt, hsa
ucugaauuccccguuuuguuccauauugguauagagagcagaagaguagcuaggcagaugcaga

SEQ ID NO: 243643 - RNA, 64 nt, hsa
cuucucucaaaauggauccgauaaauauuugaauagagcagauuguagaaugucgugcugucac

SEQ ID NO: 243644 - RNA, 64 nt, hsa
gacuagugagucuguaccauaaguauuaaucaccuccacucauauuaaagugaucauuaagaau

SEQ ID NO: 243645 - RNA, 64 nt, hsa
uggaagggguaucagagaccauguaguucaacuuuccacucaaaguaagauuuaugaauuauuu

SEQ ID NO: 243646 - RNA, 64 nt, hsa
aaauuggauuauuaggaauacaucuugacccuuuuccacucaauagaccagggaaagggguuac

SEQ ID NO: 243647 - RNA, 64 nt, hsa
uucccuuccccaaaccaugugcuuauuagaugguuccacucaggaagcaaggaagcuaaaacuc

SEQ ID NO: 243648 - RNA, 64 nt, hsa
ucuaagggacauuaucuuccuucagguuuuuaccuccacucauccuuagagcccacugacugcu

SEQ ID NO: 243649 - RNA, 64 nt, hsa
caagcuagagccgcaggcacccucucacucaauuuccacucagaacccuauaaacaccaguggg

SEQ ID NO: 243650 - RNA, 64 nt, hsa
agagcaagacuccauuucaaaaaaaaaaaaaaaauccacucauauaaaaggugagcucagcuca

SEQ ID NO: 243651 - RNA, 64 nt, hsa
aacccagagucaggaagagauuuaacacuaaaauuccacucaugccgggcgugguggcacgcgc

SEQ ID NO: 243652 - RNA, 64 nt, hsa
gucgacauguucagugccugguggggcugcggaguccacucauccuugccuccucucccugggu

SEQ ID NO: 243653 - RNA, 64 nt, hsa
ugggggagccgcccggugcccguguguccguuccuccacucaucuguuucuccgguucucccug

SEQ ID NO: 243654 - RNA, 64 nt, hsa
agcuaccaccugucaccagagccuacugcugcucuccacucaacuggccucugcugccaggcca

SEQ ID NO: 243655 - RNA, 64 nt, hsa
auguacacgcuaaggaaaaacuagcacccuucuguccacucagcaauaagagggaucucuuccc

SEQ ID NO: 243656 - RNA, 64 nt, hsa
gccgcugcccuggugggcauggcacugagaugcauccacucagcaggagugacagaggcagaag

SEQ ID NO: 243657 - RNA, 64 nt, hsa
guguuucugccauauauuuuauuauaaauuacaauccacucauccaccugcccuccaccaggag

SEQ ID NO: 243658 - RNA, 64 nt, hsa; identical to SEQ ID NO: 43914

SEQ ID NO: 243659 - RNA, 64 nt, hsa; identical to SEQ ID NO: 43915

SEQ ID NO: 243660 - RNA, 64 nt, hsa; identical to SEQ ID NO: 43916

SEQ ID NO: 243661 - RNA, 64 nt, hsa; identical to SEQ ID NO: 43917

SEQ ID NO: 243662 - RNA, 64 nt, hsa; identical to SEQ ID NO: 43918

SEQ ID NO: 243663 - RNA, 64 nt, hsa; identical to SEQ ID NO: 43919

SEQ ID NO: 243664 - RNA, 64 nt, hsa; identical to SEQ ID NO: 43920

SEQ ID NO: 243665 - RNA, 64 nt, hsa; identical to SEQ ID NO: 43921

SEQ ID NO: 243666 - RNA, 64 nt, hsa; identical to SEQ ID NO: 43922

SEQ ID NO: 243667 - RNA, 64 nt, hsa; identical to SEQ ID NO: 43923

SEQ ID NO: 243668 - RNA, 64 nt, hsa; identical to SEQ ID NO: 43924

SEQ ID NO: 243669 - RNA, 64 nt, hsa; identical to SEQ ID NO: 43925

SEQ ID NO: 243670 - RNA, 64 nt, hsa; identical to SEQ ID NO: 43926

SEQ ID NO: 243671 - RNA, 64 nt, hsa; identical to SEQ ID NO: 43927

SEQ ID NO: 243672 - RNA, 64 nt, hsa; identical to SEQ ID NO: 43928

SEQ ID NO: 243673 - RNA, 64 nt, hsa; identical to SEQ ID NO: 43929

SEQ ID NO: 243674 - RNA, 64 nt, hsa; identical to SEQ ID NO: 43930

SEQ ID NO: 243675 - RNA, 64 nt, hsa; identical to SEQ ID NO: 43931

SEQ ID NO: 243676 - RNA, 64 nt, hsa; identical to SEQ ID NO: 43932

SEQ ID NO: 243677 - RNA, 64 nt, hsa; identical to SEQ ID NO: 43933

SEQ ID NO: 243678 - RNA, 64 nt, hsa; identical to SEQ ID NO: 43934

SEQ ID NO: 243679 - RNA, 64 nt, hsa; identical to SEQ ID NO: 43935

SEQ ID NO: 243680 - RNA, 64 nt, hsa; identical to SEQ ID NO: 43936

SEQ ID NO: 243681 - RNA, 64 nt, hsa; identical to SEQ ID NO: 43937

SEQ ID NO: 243682 - RNA, 64 nt, hsa; identical to SEQ ID NO: 43938

SEQ ID NO: 243683 - RNA, 64 nt, hsa; identical to SEQ ID NO: 43939

SEQ ID NO: 243684 - RNA, 64 nt, hsa; identical to SEQ ID NO: 43940

SEQ ID NO: 243685 - RNA, 64 nt, hsa; identical to SEQ ID NO: 43941

SEQ ID NO: 243686 - RNA, 64 nt, hsa; identical to SEQ ID NO: 43942

SEQ ID NO: 243687 - RNA, 64 nt, hsa; identical to SEQ ID NO: 43943

SEQ ID NO: 243688 - RNA, 64 nt, hsa; identical to SEQ ID NO: 43944

SEQ ID NO: 243689 - RNA, 64 nt, hsa; identical to SEQ ID NO: 43945

SEQ ID NO: 243690 - RNA, 64 nt, hsa; identical to SEQ ID NO: 43946

SEQ ID NO: 243691 - RNA, 64 nt, hsa; identical to SEQ ID NO: 43947

SEQ ID NO: 243692 - RNA, 64 nt, hsa; identical to SEQ ID NO: 43948

SEQ ID NO: 243693 - RNA, 64 nt, hsa; identical to SEQ ID NO: 189763

SEQ ID NO: 243694 - RNA, 64 nt, hsa; identical to SEQ ID NO: 189764

SEQ ID NO: 243695 - RNA, 64 nt, hsa; identical to SEQ ID NO: 189765

SEQ ID NO: 243696 - RNA, 64 nt, hsa; identical to SEQ ID NO: 189766

SEQ ID NO: 243697 - RNA, 64 nt, hsa; identical to SEQ ID NO: 189767

SEQ ID NO: 243698 - RNA, 64 nt, hsa; identical to SEQ ID NO: 189768

SEQ ID NO: 243699 - RNA, 64 nt, hsa; identical to SEQ ID NO: 189769

SEQ ID NO: 243700 - RNA, 64 nt, hsa; identical to SEQ ID NO: 189770

SEQ ID NO: 243701 - RNA, 64 nt, hsa; identical to SEQ ID NO: 189771

SEQ ID NO: 243702 - RNA, 64 nt, hsa; identical to SEQ ID NO: 189772

SEQ ID NO: 243703 - RNA, 64 nt, hsa; identical to SEQ ID NO: 189773

SEQ ID NO: 243704 - RNA, 64 nt, hsa; identical to SEQ ID NO: 189774

SEQ ID NO: 243705 - RNA, 64 nt, hsa; identical to SEQ ID NO: 189775

SEQ ID NO: 243706 - RNA, 64 nt, hsa; identical to SEQ ID NO: 189776

SEQ ID NO: 243707 - RNA, 64 nt, hsa; identical to SEQ ID NO: 189777

SEQ ID NO: 243708 - RNA, 64 nt, hsa; identical to SEQ ID NO: 189778

SEQ ID NO: 243709 - RNA, 64 nt, hsa; identical to SEQ ID NO: 189779

SEQ ID NO: 243710 - RNA, 64 nt, hsa; identical to SEQ ID NO: 189780

SEQ ID NO: 243711 - RNA, 64 nt, hsa; identical to SEQ ID NO: 189781

SEQ ID NO: 243712 - RNA, 64 nt, hsa; identical to SEQ ID NO: 189782

SEQ ID NO: 243713 - RNA, 64 nt, hsa; identical to SEQ ID NO: 189783

SEQ ID NO: 243714 - RNA, 64 nt, hsa
guguuuucccguagccaccaaccgcuaaaaugcacgccaucaucgagcgcacggccagcuucgu

SEQ ID NO: 243715 - RNA, 64 nt, hsa
gacucuucuccugcagugcacuugcccccguggccgccaucauccccccgccccccgacgucca

SEQ ID NO: 243716 - RNA, 64 nt, hsa; identical to SEQ ID NO: 100251

SEQ ID NO: 243717 - RNA, 64 nt, hsa; identical to SEQ ID NO: 100252

SEQ ID NO: 243718 - RNA, 64 nt, hsa; identical to SEQ ID NO: 100253

SEQ ID NO: 243719 - RNA, 64 nt, hsa; identical to SEQ ID NO: 100254

SEQ ID NO: 243720 - RNA, 64 nt, hsa; identical to SEQ ID NO: 100255

SEQ ID NO: 243721 - RNA, 64 nt, hsa; identical to SEQ ID NO: 100256

SEQ ID NO: 243722 - RNA, 64 nt, hsa; identical to SEQ ID NO: 100257

SEQ ID NO: 243723 - RNA, 64 nt, hsa; identical to SEQ ID NO: 100258

SEQ ID NO: 243724 - RNA, 64 nt, hsa; identical to SEQ ID NO: 100259

SEQ ID NO: 243725 - RNA, 64 nt, hsa; identical to SEQ ID NO: 100260

SEQ ID NO: 243726 - RNA, 64 nt, hsa; identical to SEQ ID NO: 100261

SEQ ID NO: 243727 - RNA, 64 nt, hsa; identical to SEQ ID NO: 100262

SEQ ID NO: 243728 - RNA, 64 nt, hsa; identical to SEQ ID NO: 100263

SEQ ID NO: 243729 - RNA, 64 nt, hsa; identical to SEQ ID NO: 100264

SEQ ID NO: 243730 - RNA, 64 nt, hsa; identical to SEQ ID NO: 100265

SEQ ID NO: 243731 - RNA, 64 nt, hsa; identical to SEQ ID NO: 100266

SEQ ID NO: 243732 - RNA, 64 nt, hsa; identical to SEQ ID NO: 100267

SEQ ID NO: 243733 - RNA, 64 nt, hsa; identical to SEQ ID NO: 100268

SEQ ID NO: 243734 - RNA, 64 nt, hsa; identical to SEQ ID NO: 100269

SEQ ID NO: 243735 - RNA, 64 nt, hsa; identical to SEQ ID NO: 100270

SEQ ID NO: 243736 - RNA, 64 nt, hsa; identical to SEQ ID NO: 100271

SEQ ID NO: 243737 - RNA, 64 nt, hsa; identical to SEQ ID NO: 100272

SEQ ID NO: 243738 - RNA, 64 nt, hsa; identical to SEQ ID NO: 100273

SEQ ID NO: 243739 - RNA, 64 nt, hsa; identical to SEQ ID NO: 100274

SEQ ID NO: 243740 - RNA, 64 nt, hsa; identical to SEQ ID NO: 100275

SEQ ID NO: 243741 - RNA, 64 nt, hsa; identical to SEQ ID NO: 100276

SEQ ID NO: 243742 - RNA, 64 nt, hsa; identical to SEQ ID NO: 100277

SEQ ID NO: 243743 - RNA, 64 nt, hsa; identical to SEQ ID NO: 100278

SEQ ID NO: 243744 - RNA, 64 nt, hsa; identical to SEQ ID NO: 100279

SEQ ID NO: 243745 - RNA, 64 nt, hsa; identical to SEQ ID NO: 100280

SEQ ID NO: 243746 - RNA, 64 nt, hsa; identical to SEQ ID NO: 100281

SEQ ID NO: 243747 - RNA, 64 nt, hsa; identical to SEQ ID NO: 100282

SEQ ID NO: 243748 - RNA, 64 nt, hsa; identical to SEQ ID NO: 100283

SEQ ID NO: 243749 - RNA, 64 nt, hsa; identical to SEQ ID NO: 100284

SEQ ID NO: 243750 - RNA, 64 nt, hsa; identical to SEQ ID NO: 100285

SEQ ID NO: 243751 - RNA, 64 nt, hsa; identical to SEQ ID NO: 100286

SEQ ID NO: 243752 - RNA, 64 nt, hsa; identical to SEQ ID NO: 100287

SEQ ID NO: 243753 - RNA, 64 nt, hsa; identical to SEQ ID NO: 100288

SEQ ID NO: 243754 - RNA, 64 nt, hsa; identical to SEQ ID NO: 100289

SEQ ID NO: 243755 - RNA, 64 nt, hsa; identical to SEQ ID NO: 100290

SEQ ID NO: 243756 - RNA, 64 nt, hsa; identical to SEQ ID NO: 100291

SEQ ID NO: 243757 - RNA, 64 nt, hsa; identical to SEQ ID NO: 100292

SEQ ID NO: 243758 - RNA, 64 nt, hsa; identical to SEQ ID NO: 100293

SEQ ID NO: 243759 - RNA, 64 nt, hsa; identical to SEQ ID NO: 100294

SEQ ID NO: 243760 - RNA, 64 nt, hsa; identical to SEQ ID NO: 100295

SEQ ID NO: 243761 - RNA, 64 nt, hsa; identical to SEQ ID NO: 100296

SEQ ID NO: 243762 - RNA, 64 nt, hsa; identical to SEQ ID NO: 100297

SEQ ID NO: 243763 - RNA, 64 nt, hsa; identical to SEQ ID NO: 100298

SEQ ID NO: 243764 - RNA, 64 nt, hsa; identical to SEQ ID NO: 100299

SEQ ID NO: 243765 - RNA, 64 nt, hsa; identical to SEQ ID NO: 100300

SEQ ID NO: 243766 - RNA, 64 nt, hsa; identical to SEQ ID NO: 100301

SEQ ID NO: 243767 - RNA, 64 nt, hsa; identical to SEQ ID NO: 100302

SEQ ID NO: 243768 - RNA, 64 nt, hsa; identical to SEQ ID NO: 100303

SEQ ID NO: 243769 - RNA, 64 nt, hsa
uuaccucaaguugcuuggcagcacaacuaucuuugcaaaaaaaaguaaagaaaaaguaaaugau

SEQ ID NO: 243770 - RNA, 64 nt, hsa
ugaauaaucaaagugauuuuucagaauuaugugugcaaaaaauuaaugugcauucauauauucu

SEQ ID NO: 243771 - RNA, 64 nt, hsa
guugaugagcuuaaaaaaauaaaaauagaaaauugcaaaaaaaaaaaaaaaaaaaaaucucaga

SEQ ID NO: 243772 - RNA, 64 nt, hsa
uuuagaaaaaaacaacaaagcaaaaccuaucuuggcaaaaaaaggaagugagucagagcccauu

SEQ ID NO: 243773 - RNA, 64 nt, hsa
cucauuugaaguuggcaaaaacaaauacaaacaagcaaaaaaccucaaauuuuuuucagcagug

SEQ ID NO: 243774 - RNA, 64 nt, hsa
uaaugggcugcugucauuuuaugcuaaguaaggggcaaaaaaaaaaauuacauuaugcccuuga

SEQ ID NO: 243775 - RNA, 64 nt, hsa
guguuuucgagcaggacuaacaacugggaaauaagcaaaaaacugcaucgauccccagccuggu

SEQ ID NO: 243776 - RNA, 64 nt, hsa
guguuauaacaccaucuggagucuuccuguaguggcaaaaaagaacaguguugaaauuggaaag

SEQ ID NO: 243777 - RNA, 64 nt, hsa
auauguaugcuauuuguuguauuuaugcuuaagagcaaaaaaguuuugaugggauuuuaaauuc

SEQ ID NO: 243778 - RNA, 64 nt, hsa
gccuggcuuguuuugucucuuugcaacugauuuugcaaaaaaaaauuguagcuuuaaaauaaca

SEQ ID NO: 243779 - RNA, 64 nt, hsa
caugauaaacacgcaaaaaaaaccuagaaauuaagcaaaaaauagcacaauaauuuaacugaaa

SEQ ID NO: 243780 - RNA, 64 nt, hsa
cugcccacuuuaccuacggagacaugauaaacacgcaaaaaaaaccuagaaauuaagcaaaaaa

SEQ ID NO: 243781 - RNA, 64 nt, hsa
agacauuuuagcauguuaaauagcacuuuuaauagcaaaaaaaggcacaucaacugcgaaguua

SEQ ID NO: 243782 - RNA, 64 nt, hsa
auuccaaguuuucuaguccauaccacagugccuugcaaaaaacaccacaugaauaaagcaauaa

SEQ ID NO: 243783 - RNA, 64 nt, hsa
augauauguacuauagugauucuguuuuugaggugcaaaaaacauacauauauaccaguuggua

SEQ ID NO: 243784 - RNA, 64 nt, hsa
aggagaugcuuauagaugauaguuguacauaugugcaaaaaaaaauccacuugcaaugguaaga

SEQ ID NO: 243785 - RNA, 64 nt, hsa
aaugauauuuuaggaauaacggacuuuuaaagaagcaaaaaaaaagacugaauuuccuugcuua

SEQ ID NO: 243786 - RNA, 64 nt, hsa
ucauguuuaauuuguauuuguaaaaaaacaaaaagcaaaaaaauucccaaaacccagauaacaa

SEQ ID NO: 243787 - RNA, 64 nt, hsa
agcccaaagauuacauguugguguucaaaguguagcaaaaaaugauguauauuuauaaaucuau

SEQ ID NO: 243788 - RNA, 64 nt, hsa
gccaagccauguaaaagaucuacuuuuucuaagggcaaaaaaaaaaaaaaaaaaaaaagaacac

SEQ ID NO: 243789 - RNA, 64 nt, hsa
auuaccuggucauuuugugaucacaagagucuaugcaaaaaaaaaaauuucuuuaccccagauu

SEQ ID NO: 243790 - RNA, 64 nt, hsa
uacuacagaucuggauggcuauucagauaacauggcaaaaaaugauagcagaagaucauuaaaa

SEQ ID NO: 243791 - RNA, 64 nt, hsa
acauuuggacagauccugucauuguuuaagcugagcaaaaaaccacacaaaaguuguguaagag

SEQ ID NO: 243792 - RNA, 64 nt, hsa
uccugacauaguaaaguuugcuuucauaacugcagcaaaaaaggucaacuugccaagucacugc

SEQ ID NO: 243793 - RNA, 64 nt, hsa
aguaauagacaucaccagcaaugaauuuugaaaagcaaaaaauacuauuaaccuauauaaccau

SEQ ID NO: 243794 - RNA, 64 nt, hsa
accagccuggacaacauagugaaacacugucucugcaaaaaauacaaaaauuagcuggguaugg

SEQ ID NO: 243795 - RNA, 64 nt, hsa
gacuuggauauaugguugaagaaucaaaacaaaagcaaaaaaaaaaagcaaaaaaagaaaagag

SEQ ID NO: 243796 - RNA, 64 nt, hsa
gguugaagaaucaaaacaaaagcaaaaaaaaaaagcaaaaaaagaaaagagaaaaaaagaaaaa

SEQ ID NO: 243797 - RNA, 64 nt, hsa
uucauuauuuaucuauguuuauuaaugggccaaugcaaaaaaucauuuuuucaaagaaaaauuu

SEQ ID NO: 243798 - RNA, 64 nt, hsa
caauucucaugcuaaaaauacaacaaaagacaaagcaaaaaauaaaccuuugcuuuuuuuuuuu

SEQ ID NO: 243799 - RNA, 64 nt, hsa
cuagucaauucugaaccaccaccccccgccccccgcaaaaaaguaaaagucaaaccaaacuucc

SEQ ID NO: 243800 - RNA, 64 nt, hsa
gaaagagguuucuuugauguuuuaacuuuugcuggcaaaaaaaaauucacgcuuggugugaaua

SEQ ID NO: 243801 - RNA, 64 nt, hsa
ugaaaugugaacugaacaggagaaaaaaagaaaagcaaaaaacuccuguaacccuugagauuaa

SEQ ID NO: 243802 - RNA, 64 nt, hsa
uuucaggcuaaugauuaccucuuauucucuacaugcaaaaaauuaaauauuuuguguucaaaua

SEQ ID NO: 243803 - RNA, 64 nt, hsa
gagauggaacuucaggucuuaagugcaaaucaaagcaaaaaacaaacaaaacuuacauggaaaa

SEQ ID NO: 243804 - RNA, 64 nt, hsa
uccuaggcaacagagcgagacucugucuccccccgcaaaaaaaaaaaagaaagaaagaaagaga

SEQ ID NO: 243805 - RNA, 64 nt, hsa
guacacauaacauggguuauuuaguuuaacucuggcaaaaaaaaaaaaaaaaauuuuguauguu

SEQ ID NO: 243806 - RNA, 64 nt, hsa
uaacucaaaguguuucuuaagggugaguuggcaugcaaaaaauuacauugauuacaguguguuu

SEQ ID NO: 243807 - RNA, 64 nt, hsa
accuacaaaaauaaacugaacuugcaauauuuuugcaaaaaaaucugucguuaaaacugaggau

SEQ ID NO: 243808 - RNA, 64 nt, hsa
uucacagcuaugacaaaaccgaaaaagcaaaacugcaaaaaaguacuaagauguacgggucuug

SEQ ID NO: 243809 - RNA, 64 nt, hsa
aaacuuuucauguagcguaucacauaacuuuuuugcaaaaaauauaaaaagaaauaaacuucaa

SEQ ID NO: 243810 - RNA, 64 nt, hsa
ugaaugaaaauauguggacugucauuuuguugcagcaaaaaaguguuaauaaaaugcucuauuu

SEQ ID NO: 243811 - RNA, 64 nt, hsa
cgauguaagugucgauguuuuuuuaaaaaaaaaugcaaaaaaauucuuauggcggaguuuuuug

SEQ ID NO: 243812 - RNA, 64 nt, hsa
caauuaauuugcuucuguuuuuaggucugggagggcaaaaaagaggugggugggaugaaacaug

SEQ ID NO: 243813 - RNA, 64 nt, hsa
uugcaaaaaaugauaugaguuucucccugccaaggcaaaaaauauauauauauaccuauauuua

SEQ ID NO: 243814 - RNA, 64 nt, hsa
auguuuuuauuuuauuuugcuuauuuuuaugauugcaaaaaaugauaugaguuucucccugcca

SEQ ID NO: 243815 - RNA, 64 nt, hsa
aauucuuuugaauuguuacaucaugcuggaaccugcaaaaaauacuuuuucuaaugaggagaga

SEQ ID NO: 243816 - RNA, 64 nt, hsa
aguuaauagauuuuuucagacuugucaagccugugcaaaaaaauuaaaauggaugccuugaaua

SEQ ID NO: 243817 - RNA, 64 nt, hsa
uuuucaaaauagaaaaguuauuagugguuuaucagcaaaaaaguccaauuuuaauuuaguaaau

SEQ ID NO: 243818 - RNA, 64 nt, hsa
accccagcuauugucuguuguguucagcugagaugcaaaaaagaaauuaagcaaaaaagaaaaa

SEQ ID NO: 243819 - RNA, 64 nt, hsa
guuguguucagcugagaugcaaaaaagaaauuaagcaaaaaagaaaaagaugaagacuuuucau

SEQ ID NO: 243820 - RNA, 64 nt, hsa
uaaauucuauugaaaaaggaaaaucagcaauucagcaaaaaauaaauaaaaaauaaaaauguaa

SEQ ID NO: 243821 - RNA, 64 nt, hsa
ugugaccgaccccuuggccaaaaaaaaacaaaaagcaaaaaacaaaaaccuacccuguucuggu

SEQ ID NO: 243822 - RNA, 64 nt, hsa
ucuaugacagagcaaugcuuuuaaugaauuuaaggcaaaaaagguggagagggagaugugugag

SEQ ID NO: 243823 - RNA, 64 nt, hsa
aauaaacguggauuuuaaaaaaucaaucaauggugcaaaaaaaaacuuaaagcaaaauaguauu

SEQ ID NO: 243824 - RNA, 64 nt, hsa
ucaaggaaccagggaugaaaucaguuuggauucugcaaaaaaggguaauggcaaaguuugccaa

SEQ ID NO: 243825 - RNA, 64 nt, hsa
cuuguauuuuacagaugcaaacagcuauaauuuugcaaaaaaggaaaauaacucuccugaacau

SEQ ID NO: 243826 - RNA, 55 nt, hsa; identical to SEQ ID NO: 113265

SEQ ID NO: 243827 - RNA, 64 nt, hsa; identical to SEQ ID NO: 113266

SEQ ID NO: 243828 - RNA, 64 nt, hsa; identical to SEQ ID NO: 113267

SEQ ID NO: 243829 - RNA, 64 nt, hsa; identical to SEQ ID NO: 113268

SEQ ID NO: 243830 - RNA, 64 nt, hsa; identical to SEQ ID NO: 113269

SEQ ID NO: 243831 - RNA, 64 nt, hsa; identical to SEQ ID NO: 113270

SEQ ID NO: 243832 - RNA, 64 nt, hsa; identical to SEQ ID NO: 113271

SEQ ID NO: 243833 - RNA, 64 nt, hsa; identical to SEQ ID NO: 113272

SEQ ID NO: 243834 - RNA, 64 nt, hsa; identical to SEQ ID NO: 113273

SEQ ID NO: 243835 - RNA, 64 nt, hsa; identical to SEQ ID NO: 113274

SEQ ID NO: 243836 - RNA, 64 nt, hsa; identical to SEQ ID NO: 113275

SEQ ID NO: 243837 - RNA, 64 nt, hsa; identical to SEQ ID NO: 113276

SEQ ID NO: 243838 - RNA, 64 nt, hsa; identical to SEQ ID NO: 113277

SEQ ID NO: 243839 - RNA, 64 nt, hsa; identical to SEQ ID NO: 113278

SEQ ID NO: 243840 - RNA, 64 nt, hsa
uucuauauaaacuguaguaucuucaugaagacccaaggcucaaauuuacuguccuuaaaaacaa

SEQ ID NO: 243841 - RNA, 64 nt, hsa
aauuucuuuuaucacuaucucaacugaggaagaaaaggcucaccacaaguggugugaaggcuuu

SEQ ID NO: 243842 - RNA, 64 nt, hsa
ucuuuugcccaggauggaguacaguggcauggucaaggcucacugcagcuucaaucuucugggc

SEQ ID NO: 243843 - RNA, 64 nt, hsa
ucaucucuuuuaaauagaauccucuuccaccaucaaggcucaacauuuuguaagcauccaaaaa

SEQ ID NO: 243844 - RNA, 64 nt, hsa
guuaccuguacgcuguauuaaaauagaaccaggaaaggcucaggauuucagacauuucaucagc

SEQ ID NO: 243845 - RNA, 64 nt, hsa
uagaugagaguucuuuggggcuuauuuucuggguaaggcucaucuuuaaaaacuggcuucagag

SEQ ID NO: 243846 - RNA, 64 nt, hsa
caucaaagauuuucaguuaaaguagcauuauguaaaggcucaaaacauuacccuaacaaaguaa

SEQ ID NO: 243847 - RNA, 64 nt, hsa
ucccucugacucuagugcacugaugaucucugauaaggcucagcugcuuuauaguucucuggcu

SEQ ID NO: 243848 - RNA, 64 nt, hsa
ggcuccuugcagcagggcugggccugcgagacccaaggcucacugcagcgcgcuccugaccccu

SEQ ID NO: 243849 - RNA, 64 nt, hsa
aggccaguguugugggcuuccugcugggacugagaaggcucacgaagggcauccgcaauguugg

SEQ ID NO: 243850 - RNA, 64 nt, hsa
aauaacacuucguaagcaacgaguucaccuaaguaaggcucagauccuaguuuuaaaaaccauu

SEQ ID NO: 243851 - RNA, 64 nt, hsa
gagccuggagcauuguguguggugaaguaaaauaaaggcucaaaacgugacggcaacccggcaa

SEQ ID NO: 243852 - RNA, 64 nt, hsa
gaaugcugcuuucugcuuaguauuuuuuugauucaaggcucagaaggaauggugcguggcuucc

SEQ ID NO: 243853 - RNA, 64 nt, hsa
uuggagcaaucagaacuucaggugugacucuagcaaggcucaucuuucugcccggcuacaucag

SEQ ID NO: 243854 - RNA, 64 nt, hsa
ucaccccuguucagaugaauuuccagaaagagcuaaggcucauaagguucccuuuuaaguauua

SEQ ID NO: 243855 - RNA, 64 nt, hsa
aagcuagaggaaguaugugauauacacauggacuaaggcucaggugacacuauggcuagauuaa

SEQ ID NO: 243856 - RNA, 64 nt, hsa
gaggugggaacuggaggagugggcugcaagacugagccuaaaugucuccccggccuugacuuuu

SEQ ID NO: 243857 - RNA, 64 nt, hsa
ugaggguauacccaaagcugaugcagagcccauuagccuaaaagcaacugcaggacaagccucc

SEQ ID NO: 243858 - RNA, 64 nt, hsa
uguccagcuuccaaagccuagacaaccuuucuguagccuaaaacgaauggucuuugcuccagau

SEQ ID NO: 243859 - RNA, 64 nt, hsa
uuuuuugaggagaagggggucucuguuaacaucuagccuaaaguauacaacugccuggggggca

SEQ ID NO: 243860 - RNA, 64 nt, hsa
gcauuuaguuacaaccugaaggaauaaaaugauuuguggaaaugcuuaaaauagaccuaacuga

SEQ ID NO: 243861 - RNA, 64 nt, hsa
acagucucaucuugccgcgccuggcuuaccuaucuguggaaagcuaggcuucccaggcugggcu

SEQ ID NO: 243862 - RNA, 64 nt, hsa
cauggagguucuucccaagcuggcagaggccauuuguggaaaguggagagcuacgugguggccg

SEQ ID NO: 243863 - RNA, 64 nt, hsa
ugagccccuugcccaccugaagcccuggggaugauguggaaauaggggcacacacagaugauuc

SEQ ID NO: 243864 - RNA, 64 nt, hsa
gauggaguuaaacuugaugccagugggcagugcauguggaaaguaucagaguaaggcucucccc

SEQ ID NO: 243865 - RNA, 64 nt, hsa
cugugguugcaaaacccacggaaagccucauuuguguggaaagucagaggaaaaaugauccagu

SEQ ID NO: 243866 - RNA, 64 nt, hsa
aaauuuuuuuuuccaguaaugagcuuaagaaauuuguggaaaauaacucaccuggcaucuuaca

SEQ ID NO: 243867 - RNA, 64 nt, hsa
gugguggcuuugaugguucucaugccaucaguuguguggaaauguaugauccaacuagaaauga

SEQ ID NO: 243868 - RNA, 64 nt, hsa
ucauuuaaaauaaucugauuucagacaaaugcuguguggaaacaucuauccuauagaucauccu

SEQ ID NO: 243869 - RNA, 64 nt, hsa
gaaaacguagccuucauuuuaugauuuuuucauauguggaaaucuauuacauguaauacaaaac

SEQ ID NO: 243870 - RNA, 64 nt, hsa
guugguacuauguggaaaauauuagaaacuucuauguggaaaauauuagaaacuacagaguuug

SEQ ID NO: 243871 - RNA, 64 nt, hsa
cuuucauaucuuggauuugcagcuguugguacuauguggaaaauauuagaaacuucuaugugga

SEQ ID NO: 243872 - RNA, 64 nt, hsa
aaguaacuuauuucugcacuguuuuguugaacuuuguggaaacauucuuucgaguuuguuuuug

SEQ ID NO: 243873 - RNA, 64 nt, hsa
ccguuacuuaaaaagaagucugaaauguucguuuuguggaaaagaaacuaguuaaauuuacuau

SEQ ID NO: 243874 - RNA, 64 nt, hsa
ucaaucugaagauacaugucuuucuccagggacauguggaaaaaaaaaagauguuauacaacca

SEQ ID NO: 243875 - RNA, 64 nt, hsa
uaacaagaaacuacugaauucucuguuugucuguuguggaaauaaaaccuucuggggaugaauc

SEQ ID NO: 243876 - RNA, 64 nt, hsa
gaaaaaucugaauuccuguccugaccuucugugauguggaaacccuaggcucugagacacacuc

SEQ ID NO: 243877 - RNA, 64 nt, hsa
ugcauauaguuacaguaguguauaaauuaaauauuguggaaaaacagucuuguauuuuucugua

SEQ ID NO: 243878 - RNA, 64 nt, hsa
auacuuuguggaaaguguuaaauaaaguagguacuguggaaaauucauggggaggucagugugc

SEQ ID NO: 243879 - RNA, 64 nt, hsa
cauucuacaaaaagccuagaaggacaggauacuuuguggaaaguguuaaauaaaguagguacug

SEQ ID NO: 243880 - RNA, 64 nt, hsa
augauuuuuuacaacaccagauaugcaggugaauuguggaaaaugucauguagcugacacucaa

SEQ ID NO: 243881 - RNA, 64 nt, hsa
ugugccuuagaagcgugacaguucagcucucugcuguggaaaguaacacagggcaauagaaaca

SEQ ID NO: 243882 - RNA, 64 nt, hsa
uugcuugguaguguuuuaugacucugcugcaguuuguggaaaugcuggacuuggcucagugcua

SEQ ID NO: 243883 - RNA, 64 nt, hsa
guggcuguuuuaauuuuuaaauugagaaguaauauguggaaaauuaaaauauauucaaauguau

SEQ ID NO: 243884 - RNA, 64 nt, hsa
cuaggauucagcuaaauuucugagcuuuaugaucuguggaaauuuggaaugaaaugcaauucau

SEQ ID NO: 243885 - RNA, 64 nt, hsa
ugaagcucauauuguaucuuuuuaaaaaccauguuguggaaaaaagccagagugacaagugaca

SEQ ID NO: 243886 - RNA, 64 nt, hsa
ugguugaaauaucuugguauccaggauaaggguauguggaaaaacaggcuuuaggcaaguggaa

SEQ ID NO: 243887 - RNA, 64 nt, hsa
agaggagacuggccccacuucuaugggucugagcuguggaaaagggagagcagagaggaacuga

SEQ ID NO: 243888 - RNA, 64 nt, hsa
uuguuagcacacaggacacuuccuuguugucuuuuguggaaagggcaaguaccacuaauagggu

SEQ ID NO: 243889 - RNA, 64 nt, hsa
cuacccaaagucauaaauauauucuuuacugccuuguggaaauuuuauaguuuugccuuucaca

SEQ ID NO: 243890 - RNA, 51 nt, hsa
accuuaacccaccuaaguaaauguggaaacauccgauauaaaucucauagu

SEQ ID NO: 243891 - RNA, 64 nt, hsa
cucuacaaauucccucuugguguaaaauucaagauguggaaauucuaacuuuuuugaaauuuaa

SEQ ID NO: 243892 - RNA, 64 nt, hsa
gggacucuuggaaucaggagacaaagcuaccacauguggaaagguacuauguguccaugucauu

SEQ ID NO: 243893 - RNA, 64 nt, hsa
aauuccaugacuuguggaauuuggcauucagcaauguggaaauucuaaagcucccugagaacag

SEQ ID NO: 243894 - RNA, 64 nt, hsa
uagacagaagaagucagagaagugaagagagauguguggaaauuccaugacuuguggaauuugg

SEQ ID NO: 243895 - RNA, 64 nt, hsa
ucauuucagagaaaagcccuauacguguagugaauguggaaaagacuucagauugaauucacau

SEQ ID NO: 243896 - RNA, 64 nt, hsa
ucacacaggagagaaagcacaugaauguaaugaauguggaaaagcuuucagucaaaccucaugc

SEQ ID NO: 243897 - RNA, 64 nt, hsa
aaaaaugucaaugucauagaagacaaagaaagguuguggaaauguuucagauuaaaugauagua

SEQ ID NO: 243898 - RNA, 64 nt, hsa
caaauaugaaaugagggaaggcaagaaagaaccauguggaaauggaauagaauugguauaaauu

SEQ ID NO: 243899 - RNA, 64 nt, hsa
ucauauaagacagaaacccuauggguguaaugaauguggaaaaucauucugugugaagucaaga

SEQ ID NO: 243900 - RNA, 64 nt, hsa
guugaguugcaggauaucuagcaauuuaagaaaauguggaaaaaauauuuuuauugagaaauag

SEQ ID NO: 243901 - RNA, 64 nt, hsa
gucuuagguuggcauucaggucacaugaaagguguguggaaaguggccagcauucugccugcag

SEQ ID NO: 243902 - RNA, 63 nt, hsa
agggcauggcauauuguuggugcauaauaaauauuguggaaauaauuucugugugagaagcug

SEQ ID NO: 243903 - RNA, 64 nt, hsa
uauuguuuguaaaacaugguucacauaacuagcuuguggaaaccagcagguaaaaugaauucuu

SEQ ID NO: 243904 - RNA, 64 nt, hsa
aauuauccaguuucuucuguguuucuacuugaauuguggaaaagcucuauuauccaauuaacuu

SEQ ID NO: 243905 - RNA, 64 nt, hsa
aaagaugauaaaaaauaauuuuaaugguucuuaauguggaaauucacaacauacucaacuuuug

SEQ ID NO: 243906 - RNA, 64 nt, hsa
gccaaguauuauuuugcuacuuaccguguuauucuguggaaagaaaaaccuguaaaguguuuaa

SEQ ID NO: 243907 - RNA, 64 nt, hsa
gagaaagcucgaggugaaguuuuaaaaaaaaaguuguggaaaggaaaguuccaaagaggugguu

SEQ ID NO: 243908 - RNA, 64 nt, hsa
aauaacaucuugaguuauuuuuaauucagggggauguggaaagguuugcaauugucaaguguuu

SEQ ID NO: 243909 - RNA, 64 nt, hsa
uuuuuucuuuuaaugaagaaacaccaaagaaagcuguggaaaggaccugccccacaugaaaagg

SEQ ID NO: 243910 - RNA, 64 nt, hsa
auauaccaagugacugugugugggguuugacaacuguggaaaggcgagcagaaaacuccggcgg

SEQ ID NO: 243911 - RNA, 64 nt, hsa
cacacacacacacaaacaauccaguguuuugucauguggaaaaucaaaacaaguuagaaagcau

SEQ ID NO: 243912 - RNA, 64 nt, hsa
gagguucuguuauuaaagaaacaaugugaaauaauguggaaauuaauacugauaaagacuauca

SEQ ID NO: 243913 - RNA, 64 nt, hsa
gcauggccuauuaaguuggcuggagaguguuuuauguggaaauauuuucaagauaauguuccuu

SEQ ID NO: 243914 - RNA, 64 nt, hsa
aauaaggaaugauuugaauguaauuuugugaauguguggaaaauauaaagcagggauuuagccu

SEQ ID NO: 243915 - RNA, 64 nt, hsa
aaaacugugccuggacccucccucuuggugggucuguggaaacauaagcgguuuuuuuaauggg

SEQ ID NO: 243916 - RNA, 64 nt, hsa
uccuaggaaacgguucaugugucacuuuucaggauguggaaacacugagccauacacccuccau

SEQ ID NO: 243917 - RNA, 64 nt, hsa
uuuccuguguguguggccuuugcaucauuuaucuuguggaaaagaagauucaggcccugagagg

SEQ ID NO: 243918 - RNA, 64 nt, hsa
gccacaggaaacaaacuuuauguguguguguauguguggaaaaugguguucauuuuuuuugggg

SEQ ID NO: 243919 - RNA, 64 nt, hsa
aguaaagucacccaaagagucaggcacuggguauuguggaaauaaaacuauauaaacuuagaau

SEQ ID NO: 243920 - RNA, 64 nt, hsa
auucguuuuuguucuaagaugcauggaacuaaaauguggaaagaaaagaaugcgaaaagauccu

SEQ ID NO: 243921 - RNA, 64 nt, hsa
uacauaauggagagaaacccaauagugugguaaguguggaaaagccuuuagaucauaugaaucc

SEQ ID NO: 243922 - RNA, 64 nt, hsa
ccugcaaacuccuacaggagaaaaguuguaugaauguggaaacuuuagaaauugaaggaauuuu

SEQ ID NO: 243923 - RNA, 64 nt, hsa
ucauacagcugagaaacccuaugaauguaaggaauguggaaaagccuucagcaggaaagaaaau

SEQ ID NO: 243924 - RNA, 64 nt, hsa
ucauacgggugagaaacccuaugcauguacaguauguggaaaagccuuuagucagaaaucaaac

SEQ ID NO: 243925 - RNA, 64 nt, hsa
uuauacuggagagacuucacaauuauaauaaauguguggaaaagucuucaaaaaaauuucacac

SEQ ID NO: 243926 - RNA, 64 nt, hsa
cacugcuggugggaauguaaauuaauucagccauuguggaaagcacugcagcgauuucucaaag

SEQ ID NO: 243927 - RNA, 64 nt, hsa
ucacacaggagaaaggccuuaugaaugcguugaguguggaaaaucauuucgccgaagcucuuca

SEQ ID NO: 243928 - RNA, 64 nt, hsa
ucacacuggagaaaggccauaugaaugcauugauuguggaaaaucauuucgccacaguucuucg

SEQ ID NO: 243929 - RNA, 64 nt, hsa
uuuuuugauguuggggguucucuugguuuugucauguggaaagugaugcgugggcguucccuga

SEQ ID NO: 243930 - RNA, 64 nt, hsa
ggagaaauggaaacauaucacucaagggggaugcuguggaaaccuggcuuauucuucuaaagcc

SEQ ID NO: 243931 - RNA, 64 nt, hsa
ucauacuggagagaaacccuaugaauguaaagaauguggaaaacccuucaguuuccuuacaggc

SEQ ID NO: 243932 - RNA, 64 nt, hsa
ucacacuggagauaaacccuuugaguguaaaaaauguggaaaagcauuuagauacuacuacuca

SEQ ID NO: 243933 - RNA, 64 nt, hsa
ucacacuguacagaaacgcuaugaauguaaacaauguggaaaaaccuacauaucuucuguaggu

SEQ ID NO: 243934 - RNA, 64 nt, hsa
ucacacuggagauaaacccuuuaaguguaaagaauguggaaaagcauuccgauaccaccaaucu

SEQ ID NO: 243935 - RNA, 64 nt, hsa
uccuucuggaggaaagcuuugggaaagcaguguauguggaaaagucuugagccaucauucaucc

SEQ ID NO: 243936 - RNA, 64 nt, hsa
uauuaaauuccuuuaaauguugauaucugccauuuguggaaacaacguaaauucuacuuaagug

SEQ ID NO: 243937 - RNA, 64 nt, hsa
uugagagugguucaguugucuuuaauguuugucauguggaaauggaaguagccucuuuuuguuc

SEQ ID NO: 243938 - RNA, 64 nt, hsa
uuguacuuuauuacgaguaaaguguaaugaguacuguggaaaccaaauuugaauacugcaaauu

SEQ ID NO: 243939 - RNA, 64 nt, hsa
uggggcagaguguugccaauuuucugauuuuuuguguggaaaaaaaucuccaaauuguaguuuu

SEQ ID NO: 243940 - RNA, 64 nt, hsa
guggagagcucauggccugucuaaauuguugccauguggaaauggggcagaguguugccaauuu

SEQ ID NO: 243941 - RNA, 64 nt, hsa
uggaaggaaauugaucagaucuguaauucacaacuguggaaaccuacacaaauggggcugaugc

SEQ ID NO: 243942 - RNA, 64 nt, hsa
uggacaguguucucaaagcaacuuucugaagccguguggaaaacugacucugugugggucccgu

SEQ ID NO: 243943 - RNA, 64 nt, hsa
auacaauuuauagaaauaguaucggguguucugauguggaaaaaagaaaugcaagguaauuuug

SEQ ID NO: 243944 - RNA, 64 nt, hsa
aagaugauguagauguugcccuacuaccuaccauuguggaaaaggugauucuuccuaaacuaac

SEQ ID NO: 243945 - RNA, 64 nt, hsa
ugaugauguguuaggauugcuacugaugcugucauguggaaacuauuuaaaggcacuauuauaa

SEQ ID NO: 243946 - RNA, 64 nt, hsa
aaugcaaguaagacuuucugaaaacacuugaugauguggaaaugcugcaggauuaaauaacuug

SEQ ID NO: 243947 - RNA, 64 nt, hsa
cacuuuugcagcucuuuggaauccugaacccauguguggaaaagccugaacugugcuguuggaa

SEQ ID NO: 243948 - RNA, 64 nt, hsa
aggggaaaccugcugcuacaucaugagauagcccuguggaaagguccacaugagugaacuuuga

SEQ ID NO: 243949 - RNA, 64 nt, hsa
gcuuccacucuugcuccucuacaauucauucugcacgcagaagucagaaucaaaaucaaaguuc

SEQ ID NO: 243950 - RNA, 59 nt, hsa
uagagaagcaucaggugugagaauggaaaacgcagaagagacguacaacuucugaaaga

SEQ ID NO: 243951 - RNA, 64 nt, hsa
gcauuuuuuuuucugaggugggaguaugucacucacagcaaacuuggaaagaaggcuaugacuc

SEQ ID NO: 243952 - RNA, 64 nt, hsa
uccucuauuucuguuucaacucucgucuaauccaacagcaaauccccuugaugcuaccuuugaa

SEQ ID NO: 243953 - RNA, 53 nt, hsa
ucucucguuuucuuuuaggacauacagcaaaugcugcucaucagcgucaaaau

SEQ ID NO: 243954 - RNA, 64 nt, hsa
caaaugggaucuaauuaaacuaaagagcuucugcacagcaaaagaaacuaccaucagagugaac

SEQ ID NO: 243955 - RNA, 64 nt, hsa
ucuuugcacccucaaugcaugauugguauucucaacagcaaaggggugaaaaaucuagagacag

SEQ ID NO: 243956 - RNA, 64 nt, hsa
agaccaagaacaaugaguauuagaaaaaaaggagacagcaaaggugguuugagguagucaccug

SEQ ID NO: 243957 - RNA, 64 nt, hsa
gggcaacagaggccaaagaaacgaagcaagacaaacagcaaacaggcauuuuggucaggucauu

SEQ ID NO: 243958 - RNA, 64 nt, hsa
aaaauacuuuucaggccuuuuuaaaaaauucauuacagcaaacagcuggggaaggacaugcagu

SEQ ID NO: 243959 - RNA, 64 nt, hsa
acaccauccuagcgaggcaccagcacaccuaaucacagcaaagcccagauccccccaucaguug

SEQ ID NO: 243960 - RNA, 64 nt, hsa
uuuuucauuaccuguagcuuugggcagauuugcaacagcaaauuaauguguaaaauuggauuau

SEQ ID NO: 243961 - RNA, 64 nt, hsa
guuuuaaacugugagccguccaagucagaagaagacagcaaaaaaagcaacuuuuccaacauac

SEQ ID NO: 243962 - RNA, 64 nt, hsa
uuuuucauuuuuuauuuugaaaaauugcaaaucuacagcaaaaguaaaacaguagagugaacac

SEQ ID NO: 243963 - RNA, 64 nt, hsa
cucaaaguaucuuuuagacuuuuaaggacaauuuacagcaaaugaaauuuaugaugcugugaca

SEQ ID NO: 243964 - RNA, 64 nt, hsa
cuagguucuuccugacugcuuucuccaacuguucacagcaaaugcuuggauuuuaugcaguagg

SEQ ID NO: 243965 - RNA, 64 nt, hsa
ggaucaauuucuuuuucauagggguggaacuugcacagcaaaaacaaacaaacgcaagaagaga

SEQ ID NO: 243966 - RNA, 64 nt, hsa
accaggaaggaauggaaaaaaaauucuuuucucuacagcaaauuaaugugaggaagcuccucca

SEQ ID NO: 243967 - RNA, 64 nt, hsa
accauuugaugugagaaacaauucuuuuuaauuuacagcaaaauauugaauaaccauugacaaa

SEQ ID NO: 243968 - RNA, 64 nt, hsa
auuguaugaucguaacauuauuuauuaccacaaaacagcaaaaucuucaaugucuaagaaaacu

SEQ ID NO: 243969 - RNA, 64 nt, hsa
ccaagcugcacuauugggaauggauuguggcugaacagcaaaucaaaacaccagaaauauuuuu

SEQ ID NO: 243970 - RNA, 64 nt, hsa
uugaugccucugcaagauacugugaggagaauugacagcaaaaguucaccaccuacucuuauuu

SEQ ID NO: 243971 - RNA, 64 nt, hsa
ugacuuuucuucauauuuugcaaagagaaauuucacagcaaaaauucauguuuugucagcuuuc

SEQ ID NO: 243972 - RNA, 64 nt, hsa
auucacagaaccguggucacauuuccccaucaaaauccccaaggcgggucccaaguucucuccu

SEQ ID NO: 243973 - RNA, 64 nt, hsa
acaaaaaauaaaucaagaaggcauagcugucugaauccccaauuauugaggcacacuccuuggc

SEQ ID NO: 243974 - RNA, 64 nt, hsa
cuacuuugcagcucgcccaaagagauacaaccuaauccccaaccuacuuuuaguuuuuuuguuu

SEQ ID NO: 243975 - RNA, 64 nt, hsa
gcacccccucccuuucccuuaacucuacuuuuacauccccaaaccaccuuugucaucagcuuuu

SEQ ID NO: 243976 - RNA, 64 nt, hsa
gagcauuggcugaagcccaguuccuuucccauccauccccaacuccaauaaucccccacuccuc

SEQ ID NO: 243977 - RNA, 64 nt, hsa
ucucugggccuuggcuugggaccagguacgaaggauccccaagcccuucaggccugagaucaga

SEQ ID NO: 243978 - RNA, 64 nt, hsa
aggacacuaagaggaggcaggaggagcaacucaaauccccaagaacacaagaagacccauccug

SEQ ID NO: 243979 - RNA, 64 nt, hsa
ugccuaugaacagaccaucccccacuccuuggguauccccaaccccagacccccaucacuugau

SEQ ID NO: 243980 - RNA, 64 nt, hsa
auccuccaccccacaucccaccacauccaccuccauccccaacccauccucauccccaacuaca

SEQ ID NO: 243981 - RNA, 64 nt, hsa
ccaccacauccaccuccauccccaacccauccucauccccaacuacagccccaaacccagcccc

SEQ ID NO: 243982 - RNA, 64 nt, hsa
agccccaaacccagccccagacuaauccacagccauccccaacucauccucauccccaacugca

SEQ ID NO: 243983 - RNA, 64 nt, hsa
cagacuaauccacagccauccccaacucauccucauccccaacugcagccccaaacccaaccca

SEQ ID NO: 243984 - RNA, 64 nt, hsa
uccccaacugcagccccaaacccaacccagggccauccccaaacccauccccaagccaaacuca

SEQ ID NO: 243985 - RNA, 64 nt, hsa
gccccaaacccaacccagggccauccccaaacccauccccaagccaaacucaacaccauccccu

SEQ ID NO: 243986 - RNA, 64 nt, hsa
cccuaaucaccucuccugccccuagcucagccucauccccaacuccaugccugucuccaauccc

SEQ ID NO: 243987 - RNA, 64 nt, hsa
ccaccgucccgaagccaacuucacccauguccccauccccaaucuuguccccauuccugacucc

SEQ ID NO: 243988 - RNA, 64 nt, hsa
gaugcaaaaaacaaaaacaaaaaaaaaccaccaaauccccaaauucauuccagaucuauuuuuc

SEQ ID NO: 243989 - RNA, 64 nt, hsa
agauccaguguccuagugaaacgcuggauccuagauccccaaccccagauccccaugccucgag

SEQ ID NO: 243990 - RNA, 64 nt, hsa
guauaaaccucaguaaaaauagugaagacaugcaucauggaaugagaaaaugagaaaggaauga

SEQ ID NO: 243991 - RNA, 64 nt, hsa
aggcauguuaauucaauauaaaugaccuuugauuucauggaauauuaaaguugguuuaaagucc

SEQ ID NO: 243992 - RNA, 64 nt, hsa
uauggaagaguuacuucuacggaauaguuuuugcucauggaacucaaacagaugaagcaccacu

SEQ ID NO: 243993 - RNA, 64 nt, hsa
ccuuccugcucuaacguccagugcuuccuugagaucauggaauucuggagaguuucuguggaua

SEQ ID NO: 243994 - RNA, 64 nt, hsa
ugguggcuguuccucccugucaccugccuccucaucauggaagggggugggcuaugaaagccgg

SEQ ID NO: 243995 - RNA, 64 nt, hsa
aaugccagcuaacuucuuugauuagaagguaaugucauggaauagaaugcugucaccagaaaau

SEQ ID NO: 243996 - RNA, 64 nt, hsa
aguguguccauucuggcagugguuuugaguuacuucauggaacuuggacauacaccaccagguc

SEQ ID NO: 243997 - RNA, 64 nt, hsa
gagagcagcauaaauguugacaugggacauuugcucauggaauuggagcucgugggacagucac

SEQ ID NO: 243998 - RNA, 64 nt, hsa
ugcucauggaauuggagcucgugggacagucaccucauggaauuggagcucguggaacaguuac

SEQ ID NO: 243999 - RNA, 64 nt, hsa
aagucuucugucauaaucuauaaagcagcagcacucauggaaauuguagcaugccaguaauuuu

SEQ ID NO: 244000 - RNA, 64 nt, hsa
gcuuuguaauuuaaauuggagcuuuuagcuuguuucauggaacuauacaacuuguggguaacuc

SEQ ID NO: 244001 - RNA, 64 nt, hsa
gaaaaguauuuuaaccuaccuguagagauccucgucauggaaaggugccaaacuguuuugaaug

SEQ ID NO: 244002 - RNA, 64 nt, hsa
uuggagugccauguauaaguugggcuauuagaguucauggaacauagaacaaccaugaaugagu

SEQ ID NO: 244003 - RNA, 64 nt, hsa
agguugggugcucacagaacccuuuuccugacucucauggaagaugguggaaggaaaauagacu

SEQ ID NO: 244004 - RNA, 64 nt, hsa
uuccuucauggaaagguguuggcgcugauguagcucauggaaggaucagacugggaaccacaga

SEQ ID NO: 244005 - RNA, 64 nt, hsa
gugaggcuaaacugcgaccccaacaucacuuccuucauggaaagguguuggcgcugauguagcu

SEQ ID NO: 244006 - RNA, 64 nt, hsa
cucacauugaacuaaaauccacugucucauaaguucauggaaugaaauggcuuucugccuccau

SEQ ID NO: 244007 - RNA, 64 nt, hsa
agaugcuucaaaaauuguccuguuagaauuuccaucauggaaggugguauggaagaagguaugg

SEQ ID NO: 244008 - RNA, 64 nt, hsa
cuauaagugcccaguacauguuuaaaagaagagcucauggaaccucuggaaaggacagggaagu

SEQ ID NO: 244009 - RNA, 64 nt, hsa
uccucuggagcugccuucucaucaggugcacucuucauggaaagcaacucuugccccuccuccu

SEQ ID NO: 244010 - RNA, 64 nt, hsa
uagguuuaugccuucuguggccagagucuuggacucauggaaauagaaugaauagaggggcauu

SEQ ID NO: 244011 - RNA, 64 nt, hsa
cugaauuaaaagcccacuguggagaugcugugguucauggaaucucuuccaguguaauucagaa

SEQ ID NO: 244012 - RNA, 64 nt, hsa; identical to SEQ ID NO: 209384

SEQ ID NO: 244013 - RNA, 64 nt, hsa; identical to SEQ ID NO: 209385

SEQ ID NO: 244014 - RNA, 64 nt, hsa; identical to SEQ ID NO: 209386

SEQ ID NO: 244015 - RNA, 64 nt, hsa; identical to SEQ ID NO: 209387

SEQ ID NO: 244016 - RNA, 64 nt, hsa; identical to SEQ ID NO: 209388

SEQ ID NO: 244017 - RNA, 64 nt, hsa; identical to SEQ ID NO: 209389

SEQ ID NO: 244018 - RNA, 64 nt, hsa; identical to SEQ ID NO: 209390

SEQ ID NO: 244019 - RNA, 64 nt, hsa; identical to SEQ ID NO: 209391

SEQ ID NO: 244020 - RNA, 64 nt, hsa; identical to SEQ ID NO: 209392

SEQ ID NO: 244021 - RNA, 64 nt, hsa; identical to SEQ ID NO: 209393

SEQ ID NO: 244022 - RNA, 64 nt, hsa; identical to SEQ ID NO: 209394

SEQ ID NO: 244023 - RNA, 64 nt, hsa; identical to SEQ ID NO: 209395

SEQ ID NO: 244024 - RNA, 61 nt, hsa; identical to SEQ ID NO: 209396

SEQ ID NO: 244025 - RNA, 64 nt, hsa; identical to SEQ ID NO: 209397

SEQ ID NO: 244026 - RNA, 64 nt, hsa; identical to SEQ ID NO: 209398

SEQ ID NO: 244027 - RNA, 64 nt, hsa; identical to SEQ ID NO: 209399

SEQ ID NO: 244028 - RNA, 64 nt, hsa; identical to SEQ ID NO: 209400

SEQ ID NO: 244029 - RNA, 64 nt, hsa; identical to SEQ ID NO: 209401

SEQ ID NO: 244030 - RNA, 64 nt, hsa; identical to SEQ ID NO: 209402

SEQ ID NO: 244031 - RNA, 64 nt, hsa; identical to SEQ ID NO: 209403

SEQ ID NO: 244032 - RNA, 64 nt, hsa; identical to SEQ ID NO: 209404

SEQ ID NO: 244033 - RNA, 64 nt, hsa; identical to SEQ ID NO: 209405

SEQ ID NO: 244034 - RNA, 64 nt, hsa; identical to SEQ ID NO: 209406

SEQ ID NO: 244035 - RNA, 64 nt, hsa; identical to SEQ ID NO: 209407

SEQ ID NO: 244036 - RNA, 64 nt, hsa
uuccucucucuaccagucuauuuccacugaacaaaaccuacacacauaccuucaugugguucag

SEQ ID NO: 244037 - RNA, 64 nt, hsa
agcuggcugagacacugaagaagucacugaacaaaaccuacacacguaccuucaugugauucac

SEQ ID NO: 244038 - RNA, 64 nt, hsa
uggcccaauuuccuaacaagccggaugcuugagaaaccuacauuuggacaaugagaggcugcuc

SEQ ID NO: 244039 - RNA, 64 nt, hsa
uuccuuggcuccugcuuucuuuuuagacuauaucaaccuacaacuuuagucgggaagagggaca

SEQ ID NO: 244040 - RNA, 64 nt, hsa
aggaauaggauaaugauauauaggaucaugauauuccuucuauccaugugccaaauggguguaa

SEQ ID NO: 244041 - RNA, 64 nt, hsa
uggcaaugaagucaguagauaggaaaccaguuauuccuucuaccuuuaaaaauuuugagaacuu

SEQ ID NO: 244042 - RNA, 64 nt, hsa
gagucauuuaucccaaacuggguuuuuucucucauccuucuaccucccuccuuugaaugagggu

SEQ ID NO: 244043 - RNA, 64 nt, hsa
uggguugucugaagucagaaacauauuuacaaaguccuucuacccacuaucaaaaaugaacuga

SEQ ID NO: 244044 - RNA, 64 nt, hsa
uaaaucguaaaaaauguacauuugcccuuucucuuccuucuaaacaugugucucucccacaggu

SEQ ID NO: 244045 - RNA, 64 nt, hsa
aacaacacuuagacuggggucuaacguugacaaauccuucuagaauuugccucuuugggacuga

SEQ ID NO: 244046 - RNA, 64 nt, hsa
guuccuuccuccacugcgcuuacuccucugacccuccuucuauuuucccuacccugcaacuucu

SEQ ID NO: 244047 - RNA, 64 nt, hsa
cugugaaauuuacaaaucaaaaucuuaaucauuauccuucuaagaggauacaaauuuagugcuc

SEQ ID NO: 244048 - RNA, 64 nt, hsa
ugguuuuccccaccccacacauucucaaccauaguccuucuaacaauaccaauagcuaggaccc

SEQ ID NO: 244049 - RNA, 64 nt, hsa
uucacguuaacauauagacacuguuggaagcaguuccuucuaaaaggguagcccuggacuuaau

SEQ ID NO: 244050 - RNA, 64 nt, hsa
uucugcaggaggagcagguguuucugucuucuguuccuucuagggccaccuguccccuuaaaca

SEQ ID NO: 244051 - RNA, 64 nt, hsa
uuuuuuguuccccgugaaaagcaacauggacauuuccuucuaguccuuccaaggaggggagaga

SEQ ID NO: 244052 - RNA, 64 nt, hsa
cuucaaaauuuuuagugcucccuacaaauacgaauccuucuaucccacuaaccaaaauaccucc

SEQ ID NO: 244053 - RNA, 64 nt, hsa
cauucuucaaucagauaguggaaauagaacuugcuccuucuauuaauacuuauuauauuucugg

SEQ ID NO: 244054 - RNA, 64 nt, hsa
aagaacuugacucggcacuguuucucguguaauauccuucuaaugcuuagcaacaacaacaaaa

SEQ ID NO: 244055 - RNA, 64 nt, hsa
gcucuccucucuaaccucacugggcuauaaauguuccuucuaacucuguaaugaaaguucagug

SEQ ID NO: 244056 - RNA, 64 nt, hsa
ccucaaccuggggaacuguauuuuuaaaugaagagcuauuuauauauauuauuuuuuuuuaaga

SEQ ID NO: 244057 - RNA, 64 nt, hsa
ggauuucuaaacugcucaauuuugacucaaaggugcuauuuaccaaacacucucccuacccauu

SEQ ID NO: 244058 - RNA, 64 nt, hsa
uguuuaccagagcaucuucuuaucuuuccacagagcuauuuacauccuggacuauauaacuuaa

SEQ ID NO: 244059 - RNA, 64 nt, hsa
cagcauuauggcuaaaauauaugucuaacccagugcuauuuaggugaaaaugcuaauugauaaa

SEQ ID NO: 244060 - RNA, 64 nt, hsa
auuugaggacucucuuagaaugagugauucaccugcuauuuaaaugaauuauuuagauuuuuga

SEQ ID NO: 244061 - RNA, 64 nt, hsa
aaaacuuagcaaacuuuugaaucuuucuuuuauugcuauuuacacauacauacacacauacaaa

SEQ ID NO: 244062 - RNA, 64 nt, hsa
ggcaguuuaaugugguaccaaacugaaaauaggagcuauuuauagauggagcagcacuuagugc

SEQ ID NO: 244063 - RNA, 64 nt, hsa
cagcagguuagaccggcuuuugaccauauucaucgcuauuuaaaaccuguggcaaaaugaacgc

SEQ ID NO: 244064 - RNA, 64 nt, hsa
uucagaugcuucugggagacacccaaagggugaagcuauuuaucuguaguaaacuauuuaucug

SEQ ID NO: 244065 - RNA, 64 nt, hsa
cuuaaacacaccagugucuguucuugaugcaguugcuauuuaggaugaguuaagugccugggga

SEQ ID NO: 244066 - RNA, 64 nt, hsa
guaauuggugccaauaaacuacuuuuuuuguagugcuauuuaauuuugauuaaauuuagguagc

SEQ ID NO: 244067 - RNA, 64 nt, hsa
cuugaggugugccuuguauaacugaauuuauggugcuauuuaaacaauuuuuuucuaacgugaa

SEQ ID NO: 244068 - RNA, 64 nt, hsa
cauuuuaaauuaaguaguuuuaaucagcuuaaaagcuauuuaacccauuuuaauaagcuugcag

SEQ ID NO: 244069 - RNA, 64 nt, hsa
uuggcaaguaacucuacuaacagauguugguauagcuauuuaaagacuacuucguaaguaguau

SEQ ID NO: 244070 - RNA, 64 nt, hsa; identical to SEQ ID NO: 137832

SEQ ID NO: 244071 - RNA, 64 nt, hsa; identical to SEQ ID NO: 137833

SEQ ID NO: 244072 - RNA, 64 nt, hsa; identical to SEQ ID NO: 137834

SEQ ID NO: 244073 - RNA, 64 nt, hsa; identical to SEQ ID NO: 137835

SEQ ID NO: 244074 - RNA, 64 nt, hsa; identical to SEQ ID NO: 137836

SEQ ID NO: 244075 - RNA, 64 nt, hsa; identical to SEQ ID NO: 137837

SEQ ID NO: 244076 - RNA, 64 nt, hsa; identical to SEQ ID NO: 137838

SEQ ID NO: 244077 - RNA, 64 nt, hsa; identical to SEQ ID NO: 137839

SEQ ID NO: 244078 - RNA, 64 nt, hsa; identical to SEQ ID NO: 137840

SEQ ID NO: 244079 - RNA, 64 nt, hsa; identical to SEQ ID NO: 137841

SEQ ID NO: 244080 - RNA, 64 nt, hsa; identical to SEQ ID NO: 137842

SEQ ID NO: 244081 - RNA, 64 nt, hsa; identical to SEQ ID NO: 137843

SEQ ID NO: 244082 - RNA, 64 nt, hsa; identical to SEQ ID NO: 137844

SEQ ID NO: 244083 - RNA, 64 nt, hsa; identical to SEQ ID NO: 137845

SEQ ID NO: 244084 - RNA, 64 nt, hsa; identical to SEQ ID NO: 137846

SEQ ID NO: 244085 - RNA, 64 nt, hsa; identical to SEQ ID NO: 137847

SEQ ID NO: 244086 - RNA, 64 nt, hsa; identical to SEQ ID NO: 137848

SEQ ID NO: 244087 - RNA, 64 nt, hsa; identical to SEQ ID NO: 137849

SEQ ID NO: 244088 - RNA, 64 nt, hsa; identical to SEQ ID NO: 137850

SEQ ID NO: 244089 - RNA, 64 nt, hsa; identical to SEQ ID NO: 137851

SEQ ID NO: 244090 - RNA, 64 nt, hsa; identical to SEQ ID NO: 137852

SEQ ID NO: 244091 - RNA, 64 nt, hsa; identical to SEQ ID NO: 137853

SEQ ID NO: 244092 - RNA, 64 nt, hsa; identical to SEQ ID NO: 137854

SEQ ID NO: 244093 - RNA, 64 nt, hsa; identical to SEQ ID NO: 137855

SEQ ID NO: 244094 - RNA, 64 nt, hsa; identical to SEQ ID NO: 137856

SEQ ID NO: 244095 - RNA, 64 nt, hsa; identical to SEQ ID NO: 137857

SEQ ID NO: 244096 - RNA, 64 nt, hsa; identical to SEQ ID NO: 137858

SEQ ID NO: 244097 - RNA, 64 nt, hsa; identical to SEQ ID NO: 137859

SEQ ID NO: 244098 - RNA, 64 nt, hsa; identical to SEQ ID NO: 137860

SEQ ID NO: 244099 - RNA, 64 nt, hsa; identical to SEQ ID NO: 137861

SEQ ID NO: 244100 - RNA, 64 nt, hsa; identical to SEQ ID NO: 137862

SEQ ID NO: 244101 - RNA, 64 nt, hsa; identical to SEQ ID NO: 137863

SEQ ID NO: 244102 - RNA, 64 nt, hsa; identical to SEQ ID NO: 137864

SEQ ID NO: 244103 - RNA, 64 nt, hsa; identical to SEQ ID NO: 137865

SEQ ID NO: 244104 - RNA, 64 nt, hsa; identical to SEQ ID NO: 137866

SEQ ID NO: 244105 - RNA, 64 nt, hsa; identical to SEQ ID NO: 137867

SEQ ID NO: 244106 - RNA, 64 nt, hsa; identical to SEQ ID NO: 137868

SEQ ID NO: 244107 - RNA, 64 nt, hsa; identical to SEQ ID NO: 137869

SEQ ID NO: 244108 - RNA, 64 nt, hsa; identical to SEQ ID NO: 137870

SEQ ID NO: 244109 - RNA, 64 nt, hsa; identical to SEQ ID NO: 137871

SEQ ID NO: 244110 - RNA, 64 nt, hsa; identical to SEQ ID NO: 137872

SEQ ID NO: 244111 - RNA, 64 nt, hsa; identical to SEQ ID NO: 137873

SEQ ID NO: 244112 - RNA, 64 nt, hsa; identical to SEQ ID NO: 137874

SEQ ID NO: 244113 - RNA, 64 nt, hsa; identical to SEQ ID NO: 137875

SEQ ID NO: 244114 - RNA, 64 nt, hsa; identical to SEQ ID NO: 137876

SEQ ID NO: 244115 - RNA, 64 nt, hsa; identical to SEQ ID NO: 137877

SEQ ID NO: 244116 - RNA, 64 nt, hsa; identical to SEQ ID NO: 137878

SEQ ID NO: 244117 - RNA, 64 nt, hsa; identical to SEQ ID NO: 137879

SEQ ID NO: 244118 - RNA, 64 nt, hsa; identical to SEQ ID NO: 137880

SEQ ID NO: 244119 - RNA, 64 nt, hsa; identical to SEQ ID NO: 137881

SEQ ID NO: 244120 - RNA, 64 nt, hsa; identical to SEQ ID NO: 137882

SEQ ID NO: 244121 - RNA, 64 nt, hsa; identical to SEQ ID NO: 137883

SEQ ID NO: 244122 - RNA, 64 nt, hsa; identical to SEQ ID NO: 137884

SEQ ID NO: 244123 - RNA, 64 nt, hsa; identical to SEQ ID NO: 137885

SEQ ID NO: 244124 - RNA, 64 nt, hsa; identical to SEQ ID NO: 137886

SEQ ID NO: 244125 - RNA, 64 nt, hsa; identical to SEQ ID NO: 137887

SEQ ID NO: 244126 - RNA, 64 nt, hsa; identical to SEQ ID NO: 137888

SEQ ID NO: 244127 - RNA, 64 nt, hsa; identical to SEQ ID NO: 137889

SEQ ID NO: 244128 - RNA, 64 nt, hsa; identical to SEQ ID NO: 137890

SEQ ID NO: 244129 - RNA, 64 nt, hsa; identical to SEQ ID NO: 137891

SEQ ID NO: 244130 - RNA, 64 nt, hsa; identical to SEQ ID NO: 137892

SEQ ID NO: 244131 - RNA, 64 nt, hsa; identical to SEQ ID NO: 137893

SEQ ID NO: 244132 - RNA, 64 nt, hsa; identical to SEQ ID NO: 137894

SEQ ID NO: 244133 - RNA, 64 nt, hsa; identical to SEQ ID NO: 137895

SEQ ID NO: 244134 - RNA, 64 nt, hsa; identical to SEQ ID NO: 137896

SEQ ID NO: 244135 - RNA, 64 nt, hsa
gaaagcuauuuccaucuaguaucagggugagagcauccuugaucuggcugccuguuagagaaau

SEQ ID NO: 244136 - RNA, 64 nt, hsa
ugucucuugagaagagagaggcaugugugccggcauccuugauggguucaaagagaaagguugg

SEQ ID NO: 244137 - RNA, 64 nt, hsa
gagggcuugaguucaucgaugaacuucaguaacuauccuugacuuaguauugguggaaaccauu

SEQ ID NO: 244138 - RNA, 64 nt, hsa
gcacagugagacuccaccucaaaaaaaaaaaaaaauccuugaacuaaugacucaaauuuucaaa

SEQ ID NO: 244139 - RNA, 64 nt, hsa
ggguucauaaauugaggccagagacucauuguauauccuugaucaauuuucuaauuaaaggaaa

SEQ ID NO: 244140 - RNA, 64 nt, hsa
guaacaagagucuauuugccuugaaaaaacaauuauccuugaacuuccuccagcuaugcaggga

SEQ ID NO: 244141 - RNA, 64 nt, hsa
aaugaagauauuuuaccaugaagagauugcacuuauccuugagaacagucuaaauauaaaugaa

SEQ ID NO: 244142 - RNA, 64 nt, hsa
aaugaagauauuuuaccaugaagagauugcacuuauccuugagaacagucuaaugauacuuuuu

SEQ ID NO: 244143 - RNA, 64 nt, hsa
auccccaagugacauguggcuucagaaguagagucugaaagagcagugggaugggagcugguga

SEQ ID NO: 244144 - RNA, 64 nt, hsa
cacugaauauccccuuggcagcagagaaaacccacugaaagaucguagaguggcacaugcuuac

SEQ ID NO: 244145 - RNA, 64 nt, hsa
caucuagugcauuuaaaaauaaucgacucuaaaacugaaagaaaccuuaucacauuuuccccag

SEQ ID NO: 244146 - RNA, 64 nt, hsa
gagagaugaauuuauaaaguaggaaaaaaagaaucugaaagauacaaagugauuauaaaagaau

SEQ ID NO: 244147 - RNA, 64 nt, hsa
cugaugaguagauaaguggagcucaugguauuuccugaaagaugcuaaucuauuugccaaacuu

SEQ ID NO: 244148 - RNA, 64 nt, hsa
cgaaaaggauaugcaguaugcuuaaugguagcaacugaaagaagacauccugagcagugccagc

SEQ ID NO: 244149 - RNA, 64 nt, hsa
uuugccgauggaauaacagauuugccggcaaucacugaaagagugcaaauaucggguccuugug

SEQ ID NO: 244150 - RNA, 64 nt, hsa
cccuauccauacuauaguuucucuaaaacuuuaucugaaagagucauuuuaaaauaacuauuaa

SEQ ID NO: 244151 - RNA, 64 nt, hsa
ugaauucuuguaagcggaauguaaaacggaaauacugaaagacuuuugccuaaaguggcauuau

SEQ ID NO: 244152 - RNA, 64 nt, hsa; identical to SEQ ID NO: 244151

SEQ ID NO: 244153 - RNA, 64 nt, hsa; identical to SEQ ID NO: 244150

SEQ ID NO: 244154 - RNA, 64 nt, hsa
uuugccgauggaauaacagauuugccggcaaucacugaaagagugcaaacaucggguccuugug

SEQ ID NO: 244155 - RNA, 64 nt, hsa
ugaguucuuguuaacagaauguguaacggaaauacugaaagacuuuugcuuaaaguggcauuau

SEQ ID NO: 244156 - RNA, 64 nt, hsa
uuugccaauggaauaacagauuugccggcauucacugaaagagggcagauauuggguccuugua

SEQ ID NO: 244157 - RNA, 64 nt, hsa
uaauuaccauuaaauucacacaugaaagauuaaucugaaagaucagagaccauguuauuccuga

SEQ ID NO: 244158 - RNA, 64 nt, hsa
aggucacauauuucaaacacaacuagauggggcucugaaagauuuguaucucugugcuugaacu

SEQ ID NO: 244159 - RNA, 64 nt, hsa
acagcccgccagcugauuggaugucuaggaaugacugaaagaaaccaaaacagccuguccacug

SEQ ID NO: 244160 - RNA, 64 nt, hsa
gugucccuuauagucccuucccccacagcucuugcugaaagaguuugccuuguuuuguuuuguu

SEQ ID NO: 244161 - RNA, 64 nt, hsa
aaauugaugagucagguugcagcccucaugugaacugaaagaaguugcucgcuucuguguugac

SEQ ID NO: 244162 - RNA, 64 nt, hsa
ccugcuggaagucaguacaaugcgucaaaaguugcugaaagaugcugugccuaugggguucuag

SEQ ID NO: 244163 - RNA, 64 nt, hsa
uggacagggaaggccucugacauuuauccaagaccugaaagaugggcaaaagacgggaagcaag

SEQ ID NO: 244164 - RNA, 64 nt, hsa
cuccgcggcaggaggagccggugcucuggaagaccugaaagaagcccagguggccacagggcua

SEQ ID NO: 244165 - RNA, 64 nt, hsa
cuagaggaaaacuuugaggaacauucaaugucaccugaaagagaaaugggaaaugagaacauuc

SEQ ID NO: 244166 - RNA, 64 nt, hsa
gaucucauguuaaguggagaaaggguuuugcaaacugaaagaucuguagagaguagcaguauuu

SEQ ID NO: 244167 - RNA, 64 nt, hsa
aaguucccuaggaggggguugguugggggauguacugaaagagaugaagcaaacccacacccua

SEQ ID NO: 244168 - RNA, 64 nt, hsa
uuguuguuuuuaaaaaauucauuuugcagaaagccugaaagaaaaaaaauaccccuaaauaaaa

SEQ ID NO: 244169 - RNA, 64 nt, hsa
aguguaagggcucacacauuuacuguacucagaucugaaagacaauguugcuucuugauuuuuu

SEQ ID NO: 244170 - RNA, 64 nt, hsa
agaacuucuacaaaacuucuauaccacacagaagcugaaagagacucuggggcacuaaauucag

SEQ ID NO: 244171 - RNA, 64 nt, hsa
guggcuguugccccuuuuugauauggagggaacacugaaagacaguuuccuucuggaguuccaa

SEQ ID NO: 244172 - RNA, 58 nt, hsa
gccccaagaagaagcugugaccugcccacuggcacacagcuggcacuggcacacaccu

SEQ ID NO: 244173 - RNA, 64 nt, hsa
aagcugugaccugcccacuggcacacagcuggcacuggcacacaccugucccaugcccacccug

SEQ ID NO: 244174 - RNA, 64 nt, hsa
gcccucccugcacagggcaaagccagucugggcucuggcacacagaguucauguuugcgcccuc

SEQ ID NO: 244175 - RNA, 64 nt, hsa
uccgccucccuuggauggggucaagaggccaggccuggcacauuuuggaguguccuggcuacca

SEQ ID NO: 244176 - RNA, 64 nt, hsa
uuuuauuauugaguuguaagaguccuuuuauagccuggcacaagucccuuuaacugguauauga

SEQ ID NO: 244177 - RNA, 64 nt, hsa
gaagaugaagcagcucacagaggagacggaggugcuggcacaugagaucgagcggcugcagaug

SEQ ID NO: 244178 - RNA, 64 nt, hsa
cacacacacucacgcaugagcaaacguguacagacuggcacaugccuccacaugcgaacaccca

SEQ ID NO: 244179 - RNA, 64 nt, hsa
augcgaacacccacuuacacacacgccacucacacuggcacacaugcugucuacccgugcacag

SEQ ID NO: 244180 - RNA, 64 nt, hsa
ucccugguaccaguaggcaccuggcugagccuggcuggcacagaaaccucuacuaaaaagaagg

SEQ ID NO: 244181 - RNA, 64 nt, hsa
agaguugcugggagcugaaaaaucacauccuggccuggcacaucagaaaggaaugggggccucu

SEQ ID NO: 244182 - RNA, 64 nt, hsa
agcucugggggaggcacaggcccucauccacccucuggcacaacucugaggccaccaaccucgu

SEQ ID NO: 244183 - RNA, 64 nt, hsa
gauggagggagagguugugcugaccaccaccacacuggcacaggcgggagccuucuacgcagag

SEQ ID NO: 244184 - RNA, 64 nt, hsa
cucacugaagagagaaagcagaagguucuagauccuggcacagacugcaucccauguucccaug

SEQ ID NO: 244185 - RNA, 64 nt, hsa
cuggcccagaggcuccugaagaugcugggcgguccuggcacagggaggagcagcucuguaaauc

SEQ ID NO: 244186 - RNA, 64 nt, hsa
auugccccucugccuugcccuccugggcccugggcuggcacagccccuggagccucagaaaucu

SEQ ID NO: 244187 - RNA, 64 nt, hsa
agaaguuucgucuaaugggggcagucuccccuuccuggcacauugccccucugccuugcccucc

SEQ ID NO: 244188 - RNA, 64 nt, hsa
cacguugaucugaacuuuaaaucaaucagugcugcuggcacaaugaaagguggaacugcacuuc

SEQ ID NO: 244189 - RNA, 64 nt, hsa
auuguugagaugucuuaggacaucuaaggcaaaacuggcacauuuguucugcagacuauugcag

SEQ ID NO: 244190 - RNA, 64 nt, hsa
ggagggccccuguacuaccuccugggccaagaaacuggcacagccccacacugucagugccaag

SEQ ID NO: 244191 - RNA, 64 nt, hsa
agccacuucuuaccaggcaacgggcacagccacccuggcacacccucugccuggccgugcugaa

SEQ ID NO: 244192 - RNA, 64 nt, hsa
ugugguggggggugcggaggagguacccccaccccuggcacagccgccuggaaugcaggacugu

SEQ ID NO: 244193 - RNA, 64 nt, hsa
uaccugcuugcggcuuucaguggagggcaggggucuggcacaggugcgauggcaccccaugcuc

SEQ ID NO: 244194 - RNA, 64 nt, hsa
cagccuuagagcucuuguguucagaagaaucuuccuggcacaauguuggagcagcaggccucug

SEQ ID NO: 244195 - RNA, 64 nt, hsa
gucucugccaguuacuugggcuucaacagccaagcuggcacaaaagacagcuggcggaggcugc

SEQ ID NO: 244196 - RNA, 64 nt, hsa
acacugaacuugaacuuccauugugauaugaaaacagcuauagacaaucauaaaugaaugauca

SEQ ID NO: 244197 - RNA, 64 nt, hsa
acagcaacucaauucuaccacugugguaugaaaacagcuauagacaaucauaaaugaaugauca

SEQ ID NO: 244198 - RNA, 64 nt, hsa
auugaauucugccucuuuuugaaaaaaauguauucacauacaaaucuucacauggacacauguu

SEQ ID NO: 244199 - RNA, 64 nt, hsa
uaaggucccgaagguggaacaugcuucauggucacacauacaggcacaaaaacagcauuaugug

SEQ ID NO: 244200 - RNA, 64 nt, hsa
uacagacagaccuaccuauacauacgugcacacacacauacauauucauacacaauucauacac

SEQ ID NO: 244201 - RNA, 64 nt, hsa
guguggcagccaugaaaaguuacacauacacacccacauacagacagaccuaccuauacauacg

SEQ ID NO: 244202 - RNA, 64 nt, hsa
ggagaugcuaguguguggcagccaugaaaaguuacacauacacacccacauacagacagaccua

SEQ ID NO: 244203 - RNA, 64 nt, hsa
auuuugacugcauacaaacuaugucucugacaugcacauacacugcuuuauaaugaaaaugagg

SEQ ID NO: 244204 - RNA, 64 nt, hsa
guguuaccccucuacacguccacaccacucaccacacauacauacacaugcacacacacacaca

SEQ ID NO: 244205 - RNA, 64 nt, hsa
uguguauguauacacacauauacauauauauauacacauacauacacauacauacauacauaca

SEQ ID NO: 244206 - RNA, 64 nt, hsa
uacacacauauacauauauauauacacauacauacacauacauacauacauacauauauaucug

SEQ ID NO: 244207 - RNA, 64 nt, hsa
aaaaaacggauagaacaggauuuucuaggaguuacacauacauuuuauccugucauaccucgag

SEQ ID NO: 244208 - RNA, 64 nt, hsa
aaaugagcucaaguacaugaauguuaguuguuaucacauacagcaaauuccuuuuuuuuucuuu

SEQ ID NO: 244209 - RNA, 64 nt, hsa
auguucuucuaaaacauauacauauauacauacacacauacacauauucuucaggucucuaagc

SEQ ID NO: 244210 - RNA, 64 nt, hsa
uaugcacacacgcauacacacaugcacgcacacacacauacacacaugcacgcacgcacgcaug

SEQ ID NO: 244211 - RNA, 64 nt, hsa
uuauaaucuuuucucccugaaauacucacauucccacauacauucacuauuuucacacacacac

SEQ ID NO: 244212 - RNA, 64 nt, hsa
uaauauaaacuuauuuacuuuccuuuuuaugaagcacauacaaaagaagacagggaaugcaauc

SEQ ID NO: 244213 - RNA, 64 nt, hsa
aagccuccugccccaaagcuugugggcacaugggcacauacagacucacauacagacacacaca

SEQ ID NO: 244214 - RNA, 64 nt, hsa
ccaaagcuugugggcacaugggcacauacagacucacauacagacacacacauauauguacaga

SEQ ID NO: 244215 - RNA, 64 nt, hsa
uuuuuaaagguauucauggugacucaggaauacacacauacacacacacacacacacacacaca

SEQ ID NO: 244216 - RNA, 64 nt, hsa
cacauacacacacacacacacacacacacacacacacauacacacauauaauuugaaagaggug

SEQ ID NO: 244217 - RNA, 64 nt, hsa
aaucaacagaaucacucacacauacaaguacacucacauacauaaacuaauuauuucucuggau

SEQ ID NO: 244218 - RNA, 64 nt, hsa
uugccucuaaugcagaaaucaacagaaucacucacacauacaaguacacucacauacauaaacu

SEQ ID NO: 244219 - RNA, 64 nt, hsa
agaauccauaauggacuagaauauaaauuacaaacacauacacacaucuucacuuaaaguuguu

SEQ ID NO: 244220 - RNA, 64 nt, hsa
uauaaaauguuugccauguauacaccuguaugugcacauacacacauuacacacacacacagaa

SEQ ID NO: 244221 - RNA, 64 nt, hsa
cauauauauauauauauacauauauauacauacacacauacauauaauuuuuuuuuuuuuugag

SEQ ID NO: 244222 - RNA, 64 nt, hsa
cauauauacacacacacacacacacacacacacacacauacauacauacauauauauauauaua

SEQ ID NO: 244223 - RNA, 64 nt, hsa
gcaaacuuuugaaucuuucuuuuauugcuauuuacacauacauacacacauacaaaaccuuuaa

SEQ ID NO: 244224 - RNA, 64 nt, hsa
aucuuucuuuuauugcuauuuacacauacauacacacauacaaaaccuuuaaauuuugggaucu

SEQ ID NO: 244225 - RNA, 64 nt, hsa
agugacugugccauaggaaagcagccccuccucacacauacaugugcacaugcacacacaugca

SEQ ID NO: 244226 - RNA, 64 nt, hsa
ugcacaugcacacacaugcaugcacacacaugcacacauacacgcacaugcacacauacacaug

SEQ ID NO: 244227 - RNA, 64 nt, hsa
caugcacacacaugcacacauacacgcacaugcacacauacacaugcaugcacacauacacagg

SEQ ID NO: 244228 - RNA, 64 nt, hsa
cauacacgcacaugcacacauacacaugcaugcacacauacacaggcauacaugcaugcacaca

SEQ ID NO: 244229 - RNA, 64 nt, hsa
caugcacacacacaugcacgcacacacacaugcacacauacacgugcacacauacacaggcaca

SEQ ID NO: 244230 - RNA, 64 nt, hsa
ugcacgcacacacacaugcacacauacacgugcacacauacacaggcacacaugcaugcacaca

SEQ ID NO: 244231 - RNA, 64 nt, hsa
cacgugcacacauacacaggcacacaugcaugcacacauacacaugcacacacacaugcacaca

SEQ ID NO: 244232 - RNA, 64 nt, hsa
cauauccaugcacacaaacacauauauacacaugcacauacacagauuuuucugcuggccaggu

SEQ ID NO: 244233 - RNA, 64 nt, hsa
ugcagaacuguuuuuuuuuuuuuuuuaucuuaaacacauacacaccuccaguuuuugcucuuuu

SEQ ID NO: 244234 - RNA, 64 nt, hsa
aaacccuccauguucauuuccagacuuggucaggcacauacauaguaaauuauaaucaaucaug

SEQ ID NO: 244235 - RNA, 64 nt, hsa
cacacauacacaccccugaacacacacacagacacacauacacccaugaugugagcaaacacac

SEQ ID NO: 244236 - RNA, 64 nt, hsa
cacccugaaaacacacacagacacacaacacacacacauacacaccccugaacacacacacaga

SEQ ID NO: 244237 - RNA, 64 nt, hsa
cguucucuuuccccagcgcaaccgaaauaaaugacacauacaaaugugauuuuuuuccuccuuu

SEQ ID NO: 244238 - RNA, 64 nt, hsa
ugcagauuuuguacaaaaaaaaaaaagacacacacacauacaugauaaugauucccagcccagg

SEQ ID NO: 244239 - RNA, 64 nt, hsa
auccugcaccaccucacuguuccccaugcgcacacacauacacacaccccaaaacacauacauu

SEQ ID NO: 244240 - RNA, 64 nt, hsa
uccccaugcgcacacacauacacacaccccaaaacacauacauugaaagugccucaucugaaua

SEQ ID NO: 244241 - RNA, 64 nt, hsa
aaaccaauaccuggugaaucuauggacagucauacacauacaucaggggaaaauguguguguac

SEQ ID NO: 244242 - RNA, 64 nt, hsa
aacuuuuaauguacaucacacacacacucacacucacauacacacacacacacacacucugacu

SEQ ID NO: 244243 - RNA, 64 nt, hsa
aggauuacaggcgugagacagacacacauacacacacauacacacacacagagucuuuauugca

SEQ ID NO: 244244 - RNA, 64 nt, hsa
aaugagugcuaggauuacaggcgugagacagacacacauacacacacauacacacacacagagu

SEQ ID NO: 244245 - RNA, 64 nt, hsa
ugaauucccagcuccccauccccauaaaugcauacacauacaugcacacacacacguuauccca

SEQ ID NO: 244246 - RNA, 64 nt, hsa
ccuugcagauguagcccuugcccaucuucacagacacauacacccaucuuggcacccugauuau

SEQ ID NO: 244247 - RNA, 64 nt, hsa
gguggccagcuuggaggauggacauuucuggauacacauacacauacaaaacagaaaacauuuu

SEQ ID NO: 244248 - RNA, 64 nt, hsa
cagcuuggaggauggacauuucuggauacacauacacauacaaaacagaaaacauuuuuuaaaa

SEQ ID NO: 244249 - RNA, 64 nt, hsa
gcaguguccagauccccagagccacacauacauacacauacacacccuuacccccauccacucu

SEQ ID NO: 244250 - RNA, 64 nt, hsa
gugagggagggcaguguccagauccccagagccacacauacauacacauacacacccuuacccc

SEQ ID NO: 244251 - RNA, 64 nt, hsa
cccucuccuucuccaucucacccucccucucucacacauacacacacaaacacauacacacaac

SEQ ID NO: 244252 - RNA, 64 nt, hsa
cucacccucccucucucacacauacacacacaaacacauacacacaacacuaagugccuagacu

SEQ ID NO: 244253 - RNA, 64 nt, hsa
uauauauauauauacacacacacacacacacauacacauacaauccauauacauauggaguaug

SEQ ID NO: 244254 - RNA, 64 nt, hsa
ugcaaauauauauauauauacacacacacacacacacauacacauacaauccauauacauaugg

SEQ ID NO: 244255 - RNA, 64 nt, hsa
cacaugcacacacguguagcucacacacaguauacacauacacaagugcacagaccacacacag

SEQ ID NO: 244256 - RNA, 64 nt, hsa
caucccuacgugcccacuggcacacacacgugcucacauacauguccgcauacaggcguacaca

SEQ ID NO: 244257 - RNA, 64 nt, hsa
cagacacuuguuaccauauuuuaaaaucuggcuucacauacacagagucuuugcuaugcaccau

SEQ ID NO: 244258 - RNA, 64 nt, hsa
aacacacaggcacauacacucauauacauagacacacauacacaccucaaucuagaaagaacuu

SEQ ID NO: 244259 - RNA, 64 nt, hsa
ccauccugcacacaucucccugaaaacacacaggcacauacacucauauacauagacacacaua

SEQ ID NO: 244260 - RNA, 64 nt, hsa
ugagaaauuuuauaaauguguauuucuguguauucacauacauauauauauacacacauauaua

SEQ ID NO: 244261 - RNA, 64 nt, hsa
uacauauauauauacacacauauauauguacauacacauacauacauauuaccauacugaaggg

SEQ ID NO: 244262 - RNA, 64 nt, hsa
aaauucugcccacacacacacaaacacauacacacacauacacacacacagacacacacacacg

SEQ ID NO: 244263 - RNA, 64 nt, hsa
aaauuaaaagaaauucugcccacacacacacaaacacauacacacacauacacacacacagaca

SEQ ID NO: 244264 - RNA, 63 nt, hsa
uaaaacuaaugcuaauaagggauuuagaguugaauggcaaaauguuuauuacuuggcaauacc

SEQ ID NO: 244265 - RNA, 63 nt, hsa
uugagagcugacuguugcuuaagaaguuuucuuauggcaaaaauaauguaaauaaguuacuau

SEQ ID NO: 244266 - RNA, 63 nt, hsa
gaugucuugaaacccgugcauuuaauuuuagaaauggcaaauuuguaagcgugucauuuaagu

SEQ ID NO: 244267 - RNA, 63 nt, hsa
cacuuugcgcauuguguaaguuggguaacaaaaauggcaaaagaaaugcagauuucccaguua

SEQ ID NO: 244268 - RNA, 63 nt, hsa
agugguuaaagagguaaucacagucugagcaacauggcaaaacccugugucuacaaaaaauaa

SEQ ID NO: 244269 - RNA, 63 nt, hsa
aucaaaagcugguucuuugaaaagaucuacaaaauggcaaacauuuagcuagauugaccaccc

SEQ ID NO: 244270 - RNA, 63 nt, hsa
ucuuucagaauaggauucugugauaauauuuaaauggcaaaaacaaaacauaauuuugugcaa

SEQ ID NO: 244271 - RNA, 63 nt, hsa
ccuauaauuuuagacauucuuuaucuuuuuaguauggcaaacugccaucauuuacuuuuaaac

SEQ ID NO: 244272 - RNA, 63 nt, hsa
auucuaaaccccuuuuccauagacacaagaaagauggcaaauuuaugcuauuccuggaaaaau

SEQ ID NO: 244273 - RNA, 63 nt, hsa
guauaacacauucugcuaaggcccagggauacaauggcaaacaagauagauguaguuccuucc

SEQ ID NO: 244274 - RNA, 63 nt, hsa
ugaggccaggaguucaagaccagccuggccaacauggcaaaaucccaucucuacuaaaaauac

SEQ ID NO: 244275 - RNA, 63 nt, hsa
acuaaucgugguuuuugccauuuuuaauuuuuaauggcaaaagccacuauuacuuuugcacca

SEQ ID NO: 244276 - RNA, 63 nt, hsa
ggaugugguuuacaguaagguggaugguaccuuauggcaaaaaucucucagaaauuuaugugu

SEQ ID NO: 244277 - RNA, 63 nt, hsa
gacuuagacucccacauaguaauaauaauaauaauggcaaacuuaacaccccacugucaacau

SEQ ID NO: 244278 - RNA, 63 nt, hsa
aaagagcuguguuuugguucaaagacaagggaaauggcaaacaaaagacuguaggagagccaa

SEQ ID NO: 244279 - RNA, 63 nt, hsa
aucuuucucaaaggaagcuuaggacccgugggaauggcaaaacaguaaggauggggaccuucu

SEQ ID NO: 244280 - RNA, 63 nt, hsa
cagacuugaaucuguagacauuucuuuauugauauggcaaauugcuugcagauauuuuuaaau

SEQ ID NO: 244281 - RNA, 63 nt, hsa
ccuagaggguagaaaguuuucccaauucuacacauggcaaaauggagacccagagucacuugc

SEQ ID NO: 244282 - RNA, 63 nt, hsa
acaaacucaacacuaccaucagggguuuucuuuauggcaaagccaaaauagcuccuacaauuu

SEQ ID NO: 244283 - RNA, 63 nt, hsa
aguaaaacuauguauaauaguauauagccaugcauggcaaauauuuuaauauuucuguuuuca

SEQ ID NO: 244284 - RNA, 63 nt, hsa
uucacaggcuuucacagcaaggguaccuauuucauggcaaaauaggcaguuuuaaaagaauaa

SEQ ID NO: 244285 - RNA, 63 nt, hsa
ugagcccaggaguuugagaccagccugggcaacauggcaaaaccccaucucuacaaaaaauac

SEQ ID NO: 244286 - RNA, 63 nt, hsa
ugugucuguugugccuugcccggcgccucacggauggcaaagcucuccucacccaugggacug

SEQ ID NO: 244287 - RNA, 63 nt, hsa
cuaaaaccagugggaaaacugucugauuucuggauggcaaaggcuuucuaaacucaaaaguga

SEQ ID NO: 244288 - RNA, 63 nt, hsa
caugcuuuuguaucuugucauaguuauccacaaauggcaaaacuggacuugauucuacuggua

SEQ ID NO: 244289 - RNA, 63 nt, hsa
gugugagcgguuugcuguuagccagggcuauuuauggcaaacacaugcuuuuguaucuuguca

SEQ ID NO: 244290 - RNA, 55 nt, hsa
gagaaaaauuacaaauaugaaaauuauggcaaagcuuuaaucaauuuacaagucu

SEQ ID NO: 244291 - RNA, 63 nt, hsa
auacuggugagaaauucuaaaaaugugaagacuauggcaaagucuuuaaaugguugucacacu

SEQ ID NO: 244292 - RNA, 63 nt, hsa
auacuguacaaaaaccccacaagugugaaaaacauggcaaagccuuuaagaagcccucaauuc

SEQ ID NO: 244293 - RNA, 63 nt, hsa
auacuggagaaaacgccuacaugugugaacaauauggcaaaacuuaaugcucacacuuuauug

SEQ ID NO: 244294 - RNA, 63 nt, hsa
ugagcccaggaguuugaaaccagccuggguaacauggcaaaauccugucuuuacaaaaaauac

SEQ ID NO: 244295 - RNA, 63 nt, hsa
ugaagucagaaguuugagaccagccuggcaaacauggcaaaacugucucuauuaaaaauacag

SEQ ID NO: 244296 - RNA, 63 nt, hsa
cuggccuuccccagccugcaaggagccuguagcauggcaaaucugccugcuguaugcuauuuu

SEQ ID NO: 244297 - RNA, 63 nt, hsa
aaggaaacucaggcaaagggauccauaugugcaauggcaaagaaaugugaaaaggcauuggga

SEQ ID NO: 244298 - RNA, 63 nt, hsa
ggaacgcaaagggccgaggagcaucugguuuucauggcaaagcucuacuccagagcuccuuua

SEQ ID NO: 244299 - RNA, 63 nt, hsa
cugcuaauuaagugcaauaaauuuuucuagaaaauggcaaagaugacuuccagguggauauug

SEQ ID NO: 244300 - RNA, 63 nt, hsa
gccaccuucgugguuguaaaagacaaacaaaacauggcaaauuucauuaacacaaaauuucau

SEQ ID NO: 244301 - RNA, 63 nt, hsa
uucucauauccaucgugauaggaaggccuaagaauggcaaaucgcuuugagauauaauauuga

SEQ ID NO: 244302 - RNA, 64 nt, hsa; identical to SEQ ID NO: 47378

SEQ ID NO: 244303 - RNA, 64 nt, hsa; identical to SEQ ID NO: 47379

SEQ ID NO: 244304 - RNA, 64 nt, hsa; identical to SEQ ID NO: 47380

SEQ ID NO: 244305 - RNA, 64 nt, hsa; identical to SEQ ID NO: 47381

SEQ ID NO: 244306 - RNA, 64 nt, hsa; identical to SEQ ID NO: 47382

SEQ ID NO: 244307 - RNA, 64 nt, hsa; identical to SEQ ID NO: 47383

SEQ ID NO: 244308 - RNA, 64 nt, hsa; identical to SEQ ID NO: 47384

SEQ ID NO: 244309 - RNA, 64 nt, hsa; identical to SEQ ID NO: 47385

SEQ ID NO: 244310 - RNA, 64 nt, hsa; identical to SEQ ID NO: 47386

SEQ ID NO: 244311 - RNA, 64 nt, hsa; identical to SEQ ID NO: 47387

SEQ ID NO: 244312 - RNA, 64 nt, hsa; identical to SEQ ID NO: 47388

SEQ ID NO: 244313 - RNA, 64 nt, hsa; identical to SEQ ID NO: 47389

SEQ ID NO: 244314 - RNA, 64 nt, hsa; identical to SEQ ID NO: 47390

SEQ ID NO: 244315 - RNA, 64 nt, hsa; identical to SEQ ID NO: 47391

SEQ ID NO: 244316 - RNA, 64 nt, hsa; identical to SEQ ID NO: 47392

SEQ ID NO: 244317 - RNA, 64 nt, hsa; identical to SEQ ID NO: 47393

SEQ ID NO: 244318 - RNA, 64 nt, hsa; identical to SEQ ID NO: 47394

SEQ ID NO: 244319 - RNA, 64 nt, hsa; identical to SEQ ID NO: 47395

SEQ ID NO: 244320 - RNA, 64 nt, hsa; identical to SEQ ID NO: 47396

SEQ ID NO: 244321 - RNA, 64 nt, hsa; identical to SEQ ID NO: 47397

SEQ ID NO: 244322 - RNA, 64 nt, hsa; identical to SEQ ID NO: 47398

SEQ ID NO: 244323 - RNA, 64 nt, hsa; identical to SEQ ID NO: 47399

SEQ ID NO: 244324 - RNA, 64 nt, hsa; identical to SEQ ID NO: 47400

SEQ ID NO: 244325 - RNA, 64 nt, hsa; identical to SEQ ID NO: 47401

SEQ ID NO: 244326 - RNA, 64 nt, hsa; identical to SEQ ID NO: 47402

SEQ ID NO: 244327 - RNA, 64 nt, hsa; identical to SEQ ID NO: 47403

SEQ ID NO: 244328 - RNA, 64 nt, hsa; identical to SEQ ID NO: 47404

SEQ ID NO: 244329 - RNA, 64 nt, hsa; identical to SEQ ID NO: 47405

SEQ ID NO: 244330 - RNA, 64 nt, hsa; identical to SEQ ID NO: 47406

SEQ ID NO: 244331 - RNA, 64 nt, hsa; identical to SEQ ID NO: 47407

SEQ ID NO: 244332 - RNA, 64 nt, hsa; identical to SEQ ID NO: 47408

SEQ ID NO: 244333 - RNA, 64 nt, hsa; identical to SEQ ID NO: 47409

SEQ ID NO: 244334 - RNA, 64 nt, hsa; identical to SEQ ID NO: 47410

SEQ ID NO: 244335 - RNA, 64 nt, hsa; identical to SEQ ID NO: 47411

SEQ ID NO: 244336 - RNA, 64 nt, hsa; identical to SEQ ID NO: 47412

SEQ ID NO: 244337 - RNA, 64 nt, hsa; identical to SEQ ID NO: 47413

SEQ ID NO: 244338 - RNA, 64 nt, hsa; identical to SEQ ID NO: 47414

SEQ ID NO: 244339 - RNA, 64 nt, hsa; identical to SEQ ID NO: 47415

SEQ ID NO: 244340 - RNA, 64 nt, hsa; identical to SEQ ID NO: 47416

SEQ ID NO: 244341 - RNA, 64 nt, hsa; identical to SEQ ID NO: 47417

SEQ ID NO: 244342 - RNA, 64 nt, hsa; identical to SEQ ID NO: 47418

SEQ ID NO: 244343 - RNA, 64 nt, hsa; identical to SEQ ID NO: 47419

SEQ ID NO: 244344 - RNA, 64 nt, hsa; identical to SEQ ID NO: 47420

SEQ ID NO: 244345 - RNA, 64 nt, hsa; identical to SEQ ID NO: 47421

SEQ ID NO: 244346 - RNA, 64 nt, hsa; identical to SEQ ID NO: 47422

SEQ ID NO: 244347 - RNA, 64 nt, hsa; identical to SEQ ID NO: 47423

SEQ ID NO: 244348 - RNA, 64 nt, hsa; identical to SEQ ID NO: 47424

SEQ ID NO: 244349 - RNA, 64 nt, hsa; identical to SEQ ID NO: 47425

SEQ ID NO: 244350 - RNA, 64 nt, hsa; identical to SEQ ID NO: 47426

SEQ ID NO: 244351 - RNA, 64 nt, hsa; identical to SEQ ID NO: 47427

SEQ ID NO: 244352 - RNA, 64 nt, hsa; identical to SEQ ID NO: 47428

SEQ ID NO: 244353 - RNA, 64 nt, hsa; identical to SEQ ID NO: 47429

SEQ ID NO: 244354 - RNA, 64 nt, hsa; identical to SEQ ID NO: 47430

SEQ ID NO: 244355 - RNA, 64 nt, hsa; identical to SEQ ID NO: 47431

SEQ ID NO: 244356 - RNA, 64 nt, hsa; identical to SEQ ID NO: 47432

SEQ ID NO: 244357 - RNA, 64 nt, hsa; identical to SEQ ID NO: 47433

SEQ ID NO: 244358 - RNA, 64 nt, hsa; identical to SEQ ID NO: 47434

SEQ ID NO: 244359 - RNA, 64 nt, hsa; identical to SEQ ID NO: 47435

SEQ ID NO: 244360 - RNA, 64 nt, hsa; identical to SEQ ID NO: 47436

SEQ ID NO: 244361 - RNA, 64 nt, hsa; identical to SEQ ID NO: 47437

SEQ ID NO: 244362 - RNA, 64 nt, hsa; identical to SEQ ID NO: 47438

SEQ ID NO: 244363 - RNA, 64 nt, hsa; identical to SEQ ID NO: 47439

SEQ ID NO: 244364 - RNA, 64 nt, hsa; identical to SEQ ID NO: 47440

SEQ ID NO: 244365 - RNA, 64 nt, hsa; identical to SEQ ID NO: 47441

SEQ ID NO: 244366 - RNA, 64 nt, hsa; identical to SEQ ID NO: 47442

SEQ ID NO: 244367 - RNA, 64 nt, hsa; identical to SEQ ID NO: 47443

SEQ ID NO: 244368 - RNA, 64 nt, hsa; identical to SEQ ID NO: 47444

SEQ ID NO: 244369 - RNA, 64 nt, hsa; identical to SEQ ID NO: 47445

SEQ ID NO: 244370 - RNA, 63 nt, hsa; identical to SEQ ID NO: 47446

SEQ ID NO: 244371 - RNA, 64 nt, hsa; identical to SEQ ID NO: 47447

SEQ ID NO: 244372 - RNA, 64 nt, hsa; identical to SEQ ID NO: 47448

SEQ ID NO: 244373 - RNA, 64 nt, hsa; identical to SEQ ID NO: 47449

SEQ ID NO: 244374 - RNA, 64 nt, hsa; identical to SEQ ID NO: 47450

SEQ ID NO: 244375 - RNA, 64 nt, hsa; identical to SEQ ID NO: 47451

SEQ ID NO: 244376 - RNA, 64 nt, hsa; identical to SEQ ID NO: 47452

SEQ ID NO: 244377 - RNA, 64 nt, hsa; identical to SEQ ID NO: 47453

SEQ ID NO: 244378 - RNA, 64 nt, hsa; identical to SEQ ID NO: 47454

SEQ ID NO: 244379 - RNA, 64 nt, hsa; identical to SEQ ID NO: 47455

SEQ ID NO: 244380 - RNA, 64 nt, hsa; identical to SEQ ID NO: 47456

SEQ ID NO: 244381 - RNA, 64 nt, hsa; identical to SEQ ID NO: 47457

SEQ ID NO: 244382 - RNA, 64 nt, hsa; identical to SEQ ID NO: 47458

SEQ ID NO: 244383 - RNA, 64 nt, hsa; identical to SEQ ID NO: 47459

SEQ ID NO: 244384 - RNA, 64 nt, hsa; identical to SEQ ID NO: 47460

SEQ ID NO: 244385 - RNA, 64 nt, hsa; identical to SEQ ID NO: 47461

SEQ ID NO: 244386 - RNA, 64 nt, hsa; identical to SEQ ID NO: 47462

SEQ ID NO: 244387 - RNA, 64 nt, hsa; identical to SEQ ID NO: 47463

SEQ ID NO: 244388 - RNA, 64 nt, hsa; identical to SEQ ID NO: 47464

SEQ ID NO: 244389 - RNA, 64 nt, hsa; identical to SEQ ID NO: 47465

SEQ ID NO: 244390 - RNA, 64 nt, hsa; identical to SEQ ID NO: 47466

SEQ ID NO: 244391 - RNA, 64 nt, hsa; identical to SEQ ID NO: 47467

SEQ ID NO: 244392 - RNA, 64 nt, hsa; identical to SEQ ID NO: 47468

SEQ ID NO: 244393 - RNA, 64 nt, hsa; identical to SEQ ID NO: 47469

SEQ ID NO: 244394 - RNA, 64 nt, hsa; identical to SEQ ID NO: 47470

SEQ ID NO: 244395 - RNA, 64 nt, hsa; identical to SEQ ID NO: 47471

SEQ ID NO: 244396 - RNA, 64 nt, hsa; identical to SEQ ID NO: 47472

SEQ ID NO: 244397 - RNA, 64 nt, hsa; identical to SEQ ID NO: 47473

SEQ ID NO: 244398 - RNA, 64 nt, hsa; identical to SEQ ID NO: 47474

SEQ ID NO: 244399 - RNA, 64 nt, hsa; identical to SEQ ID NO: 47475

SEQ ID NO: 244400 - RNA, 64 nt, hsa; identical to SEQ ID NO: 47476

SEQ ID NO: 244401 - RNA, 64 nt, hsa; identical to SEQ ID NO: 47477

SEQ ID NO: 244402 - RNA, 64 nt, hsa; identical to SEQ ID NO: 47478

SEQ ID NO: 244403 - RNA, 64 nt, hsa; identical to SEQ ID NO: 47479

SEQ ID NO: 244404 - RNA, 64 nt, hsa; identical to SEQ ID NO: 47480

SEQ ID NO: 244405 - RNA, 64 nt, hsa; identical to SEQ ID NO: 47481

SEQ ID NO: 244406 - RNA, 64 nt, hsa; identical to SEQ ID NO: 47482

SEQ ID NO: 244407 - RNA, 64 nt, hsa; identical to SEQ ID NO: 47483

SEQ ID NO: 244408 - RNA, 64 nt, hsa; identical to SEQ ID NO: 47484

SEQ ID NO: 244409 - RNA, 64 nt, hsa; identical to SEQ ID NO: 47485

SEQ ID NO: 244410 - RNA, 64 nt, hsa; identical to SEQ ID NO: 47486

SEQ ID NO: 244411 - RNA, 64 nt, hsa; identical to SEQ ID NO: 47487

SEQ ID NO: 244412 - RNA, 64 nt, hsa; identical to SEQ ID NO: 47488

SEQ ID NO: 244413 - RNA, 64 nt, hsa; identical to SEQ ID NO: 47489

SEQ ID NO: 244414 - RNA, 64 nt, hsa; identical to SEQ ID NO: 47490

SEQ ID NO: 244415 - RNA, 64 nt, hsa; identical to SEQ ID NO: 47491

SEQ ID NO: 244416 - RNA, 64 nt, hsa; identical to SEQ ID NO: 47492

SEQ ID NO: 244417 - RNA, 64 nt, hsa; identical to SEQ ID NO: 47493

SEQ ID NO: 244418 - RNA, 64 nt, hsa; identical to SEQ ID NO: 47494

SEQ ID NO: 244419 - RNA, 64 nt, hsa; identical to SEQ ID NO: 47495

SEQ ID NO: 244420 - RNA, 64 nt, hsa; identical to SEQ ID NO: 47496

SEQ ID NO: 244421 - RNA, 64 nt, hsa; identical to SEQ ID NO: 47497

SEQ ID NO: 244422 - RNA, 64 nt, hsa; identical to SEQ ID NO: 47498

SEQ ID NO: 244423 - RNA, 64 nt, hsa; identical to SEQ ID NO: 47499

SEQ ID NO: 244424 - RNA, 64 nt, hsa; identical to SEQ ID NO: 47500

SEQ ID NO: 244425 - RNA, 64 nt, hsa; identical to SEQ ID NO: 47501

SEQ ID NO: 244426 - RNA, 64 nt, hsa; identical to SEQ ID NO: 47502

SEQ ID NO: 244427 - RNA, 64 nt, hsa; identical to SEQ ID NO: 47503

SEQ ID NO: 244428 - RNA, 64 nt, hsa; identical to SEQ ID NO: 47504

SEQ ID NO: 244429 - RNA, 64 nt, hsa; identical to SEQ ID NO: 47505

SEQ ID NO: 244430 - RNA, 64 nt, hsa; identical to SEQ ID NO: 47506

SEQ ID NO: 244431 - RNA, 64 nt, hsa; identical to SEQ ID NO: 47507

SEQ ID NO: 244432 - RNA, 64 nt, hsa; identical to SEQ ID NO: 47508

SEQ ID NO: 244433 - RNA, 64 nt, hsa; identical to SEQ ID NO: 47509

SEQ ID NO: 244434 - RNA, 64 nt, hsa; identical to SEQ ID NO: 47510

SEQ ID NO: 244435 - RNA, 64 nt, hsa; identical to SEQ ID NO: 47511

SEQ ID NO: 244436 - RNA, 64 nt, hsa; identical to SEQ ID NO: 47512

SEQ ID NO: 244437 - RNA, 64 nt, hsa; identical to SEQ ID NO: 47513

SEQ ID NO: 244438 - RNA, 64 nt, hsa; identical to SEQ ID NO: 47514

SEQ ID NO: 244439 - RNA, 64 nt, hsa; identical to SEQ ID NO: 47515

SEQ ID NO: 244440 - RNA, 64 nt, hsa; identical to SEQ ID NO: 47516

SEQ ID NO: 244441 - RNA, 64 nt, hsa; identical to SEQ ID NO: 47517

SEQ ID NO: 244442 - RNA, 64 nt, hsa; identical to SEQ ID NO: 47518

SEQ ID NO: 244443 - RNA, 64 nt, hsa; identical to SEQ ID NO: 47519

SEQ ID NO: 244444 - RNA, 64 nt, hsa; identical to SEQ ID NO: 47520

SEQ ID NO: 244445 - RNA, 64 nt, hsa; identical to SEQ ID NO: 47521

SEQ ID NO: 244446 - RNA, 64 nt, hsa; identical to SEQ ID NO: 47522

SEQ ID NO: 244447 - RNA, 64 nt, hsa; identical to SEQ ID NO: 47523

SEQ ID NO: 244448 - RNA, 64 nt, hsa; identical to SEQ ID NO: 47524

SEQ ID NO: 244449 - RNA, 64 nt, hsa; identical to SEQ ID NO: 47525

SEQ ID NO: 244450 - RNA, 64 nt, hsa; identical to SEQ ID NO: 47526

SEQ ID NO: 244451 - RNA, 64 nt, hsa; identical to SEQ ID NO: 47527

SEQ ID NO: 244452 - RNA, 64 nt, hsa; identical to SEQ ID NO: 47528

SEQ ID NO: 244453 - RNA, 64 nt, hsa; identical to SEQ ID NO: 47529

SEQ ID NO: 244454 - RNA, 64 nt, hsa; identical to SEQ ID NO: 47530

SEQ ID NO: 244455 - RNA, 64 nt, hsa; identical to SEQ ID NO: 47531

SEQ ID NO: 244456 - RNA, 64 nt, hsa; identical to SEQ ID NO: 47532

SEQ ID NO: 244457 - RNA, 64 nt, hsa; identical to SEQ ID NO: 47533

SEQ ID NO: 244458 - RNA, 64 nt, hsa; identical to SEQ ID NO: 47534

SEQ ID NO: 244459 - RNA, 64 nt, hsa; identical to SEQ ID NO: 47535

SEQ ID NO: 244460 - RNA, 64 nt, hsa; identical to SEQ ID NO: 47536

SEQ ID NO: 244461 - RNA, 64 nt, hsa; identical to SEQ ID NO: 47537

SEQ ID NO: 244462 - RNA, 64 nt, hsa; identical to SEQ ID NO: 47538

SEQ ID NO: 244463 - RNA, 64 nt, hsa; identical to SEQ ID NO: 47539

SEQ ID NO: 244464 - RNA, 64 nt, hsa; identical to SEQ ID NO: 47540

SEQ ID NO: 244465 - RNA, 64 nt, hsa; identical to SEQ ID NO: 47541

SEQ ID NO: 244466 - RNA, 64 nt, hsa; identical to SEQ ID NO: 47542

SEQ ID NO: 244467 - RNA, 64 nt, hsa; identical to SEQ ID NO: 47543

SEQ ID NO: 244468 - RNA, 64 nt, hsa; identical to SEQ ID NO: 47544

SEQ ID NO: 244469 - RNA, 64 nt, hsa; identical to SEQ ID NO: 47545

SEQ ID NO: 244470 - RNA, 64 nt, hsa; identical to SEQ ID NO: 47546

SEQ ID NO: 244471 - RNA, 64 nt, hsa; identical to SEQ ID NO: 47547

SEQ ID NO: 244472 - RNA, 64 nt, hsa; identical to SEQ ID NO: 47548

SEQ ID NO: 244473 - RNA, 64 nt, hsa; identical to SEQ ID NO: 47549

SEQ ID NO: 244474 - RNA, 64 nt, hsa; identical to SEQ ID NO: 47550

SEQ ID NO: 244475 - RNA, 64 nt, hsa; identical to SEQ ID NO: 47551

SEQ ID NO: 244476 - RNA, 64 nt, hsa; identical to SEQ ID NO: 47552

SEQ ID NO: 244477 - RNA, 64 nt, hsa; identical to SEQ ID NO: 47553

SEQ ID NO: 244478 - RNA, 64 nt, hsa; identical to SEQ ID NO: 47554

SEQ ID NO: 244479 - RNA, 64 nt, hsa; identical to SEQ ID NO: 47555

SEQ ID NO: 244480 - RNA, 64 nt, hsa; identical to SEQ ID NO: 47556

SEQ ID NO: 244481 - RNA, 64 nt, hsa; identical to SEQ ID NO: 47557

SEQ ID NO: 244482 - RNA, 64 nt, hsa; identical to SEQ ID NO: 47558

SEQ ID NO: 244483 - RNA, 64 nt, hsa; identical to SEQ ID NO: 47559

SEQ ID NO: 244484 - RNA, 64 nt, hsa; identical to SEQ ID NO: 47560

SEQ ID NO: 244485 - RNA, 64 nt, hsa; identical to SEQ ID NO: 47561

SEQ ID NO: 244486 - RNA, 64 nt, hsa; identical to SEQ ID NO: 47562

SEQ ID NO: 244487 - RNA, 64 nt, hsa; identical to SEQ ID NO: 47563

SEQ ID NO: 244488 - RNA, 64 nt, hsa; identical to SEQ ID NO: 47564

SEQ ID NO: 244489 - RNA, 64 nt, hsa; identical to SEQ ID NO: 47565

SEQ ID NO: 244490 - RNA, 64 nt, hsa; identical to SEQ ID NO: 47566

SEQ ID NO: 244491 - RNA, 64 nt, hsa; identical to SEQ ID NO: 47567

SEQ ID NO: 244492 - RNA, 64 nt, hsa; identical to SEQ ID NO: 47568

SEQ ID NO: 244493 - RNA, 64 nt, hsa; identical to SEQ ID NO: 47569

SEQ ID NO: 244494 - RNA, 64 nt, hsa; identical to SEQ ID NO: 47570

SEQ ID NO: 244495 - RNA, 64 nt, hsa; identical to SEQ ID NO: 47571

SEQ ID NO: 244496 - RNA, 64 nt, hsa; identical to SEQ ID NO: 47572

SEQ ID NO: 244497 - RNA, 64 nt, hsa; identical to SEQ ID NO: 47573

SEQ ID NO: 244498 - RNA, 64 nt, hsa; identical to SEQ ID NO: 47574

SEQ ID NO: 244499 - RNA, 64 nt, hsa; identical to SEQ ID NO: 47575

SEQ ID NO: 244500 - RNA, 64 nt, hsa; identical to SEQ ID NO: 47576

SEQ ID NO: 244501 - RNA, 64 nt, hsa; identical to SEQ ID NO: 47577

SEQ ID NO: 244502 - RNA, 64 nt, hsa; identical to SEQ ID NO: 47578

SEQ ID NO: 244503 - RNA, 64 nt, hsa; identical to SEQ ID NO: 47579

SEQ ID NO: 244504 - RNA, 64 nt, hsa; identical to SEQ ID NO: 47580

SEQ ID NO: 244505 - RNA, 64 nt, hsa; identical to SEQ ID NO: 47581

SEQ ID NO: 244506 - RNA, 64 nt, hsa; identical to SEQ ID NO: 47582

SEQ ID NO: 244507 - RNA, 64 nt, hsa; identical to SEQ ID NO: 47583

SEQ ID NO: 244508 - RNA, 64 nt, hsa; identical to SEQ ID NO: 47584

SEQ ID NO: 244509 - RNA, 64 nt, hsa; identical to SEQ ID NO: 47585

SEQ ID NO: 244510 - RNA, 64 nt, hsa; identical to SEQ ID NO: 47586

SEQ ID NO: 244511 - RNA, 64 nt, hsa; identical to SEQ ID NO: 47587

SEQ ID NO: 244512 - RNA, 64 nt, hsa; identical to SEQ ID NO: 47588

SEQ ID NO: 244513 - RNA, 64 nt, hsa; identical to SEQ ID NO: 47589

SEQ ID NO: 244514 - RNA, 64 nt, hsa; identical to SEQ ID NO: 47590

SEQ ID NO: 244515 - RNA, 64 nt, hsa; identical to SEQ ID NO: 47591

SEQ ID NO: 244516 - RNA, 64 nt, hsa; identical to SEQ ID NO: 47592

SEQ ID NO: 244517 - RNA, 64 nt, hsa; identical to SEQ ID NO: 47593

SEQ ID NO: 244518 - RNA, 64 nt, hsa; identical to SEQ ID NO: 47594

SEQ ID NO: 244519 - RNA, 64 nt, hsa; identical to SEQ ID NO: 47595

SEQ ID NO: 244520 - RNA, 64 nt, hsa; identical to SEQ ID NO: 47596

SEQ ID NO: 244521 - RNA, 64 nt, hsa; identical to SEQ ID NO: 47597

SEQ ID NO: 244522 - RNA, 64 nt, hsa; identical to SEQ ID NO: 47598

SEQ ID NO: 244523 - RNA, 64 nt, hsa; identical to SEQ ID NO: 47599

SEQ ID NO: 244524 - RNA, 64 nt, hsa; identical to SEQ ID NO: 47600

SEQ ID NO: 244525 - RNA, 64 nt, hsa; identical to SEQ ID NO: 47601

SEQ ID NO: 244526 - RNA, 64 nt, hsa; identical to SEQ ID NO: 47602

SEQ ID NO: 244527 - RNA, 53 nt, hsa
gcccuguuugcuuuuuauaaaccaaacucuaucugaaaucccaacaaaaaaaa

SEQ ID NO: 244528 - RNA, 64 nt, hsa
acgcauguuauggugcuaauguacuuucacuuuuaaacucuagaucagaauuguugacuugcau

SEQ ID NO: 244529 - RNA, 64 nt, hsa
uuguauuagcuuaaugucuacauaucuuuggccaaaacucuauugucauauuagaaacauguua

SEQ ID NO: 244530 - RNA, 64 nt, hsa
uuguuuacaaagaguuuaguuuuuaagacauccaaaacucuaugcuagagcaaaaaucaaauag

SEQ ID NO: 244531 - RNA, 64 nt, hsa
acaucaucaggacugcauugcucaggcauuuucuaaacucuaaauuuacgagcuguacaaaaaa

SEQ ID NO: 244532 - RNA, 64 nt, hsa
guuuccuguauaauauaugaauguuucugagaagaaacucuaaauaguugaaaggcuaaccugc

SEQ ID NO: 244533 - RNA, 64 nt, hsa
uaaaugcuuucuagugaaaaauuauaaucuacuuaaacucuaaucagaaaaaaaauucucaaaa

SEQ ID NO: 244534 - RNA, 64 nt, hsa
aauaaucaugcuuuuuuccuaugguuacagcauuaaacucuauuuuaaguuguuuuugaacuuu

SEQ ID NO: 244535 - RNA, 64 nt, hsa
ccuuucgauaucuaaaaggacucacaguggagaaaaacucuaugaguguaagcaaugugggaaa

SEQ ID NO: 244536 - RNA, 64 nt, hsa
acuucaaaugcauggaagcacucacacuuggcagaaacucuaugaauguaagcaguaugggaaa

SEQ ID NO: 244537 - RNA, 64 nt, hsa
aucucaaaaaaaauaaaaaaaaagaaaaagaaauaaacucuaugaauguaaaccauguggugaa

SEQ ID NO: 244538 - RNA, 64 nt, hsa
uaccugagaaaauuaaacaaaucacauuggaaauaaacucuauggcuugggcacgguggcucau

SEQ ID NO: 244539 - RNA, 64 nt, hsa
gcaaagucaugaaagaacucacacuggagagaagaaacucuaugaaugcaagcagugugggaaa

SEQ ID NO: 244540 - RNA, 64 nt, hsa
cacuguuuugcaucaagcuggaguacuggauggaaaacucuacaauaacauuuugugcauaauu

SEQ ID NO: 244541 - RNA, 64 nt, hsa
cccuuacucaaaaucagauaauuaacaaugaaggaaacucuaaacuccccuuauggucuaccag

SEQ ID NO: 244542 - RNA, 64 nt, hsa
accaggugugagaggugugguagcagauugcaaugcucugcaccucuuccuugcaagugagcaa

SEQ ID NO: 244543 - RNA, 64 nt, hsa
gucaugcuguagagccaggauuccuagacccagggcucugcacucucaaggcuggccccaugug

SEQ ID NO: 244544 - RNA, 64 nt, hsa
uccagugcccuggguucuucccggucauccuggggcucugcacagagcagcagagcuagagcca

SEQ ID NO: 244545 - RNA, 64 nt, hsa
accggcaacuacagcagccgggugaagcucuggagcucugcauccuguggccuggcugcgggau

SEQ ID NO: 244546 - RNA, 64 nt, hsa
uuauucaucuccuggaauuuccaugugaaucacagcucugcaccuggauggaguuuucuuuugu

SEQ ID NO: 244547 - RNA, 64 nt, hsa
aagacacuugagaaagaauccucuaaaaaucccggcucugcacauuauucaucuccuggaauuu

SEQ ID NO: 244548 - RNA, 64 nt, hsa
uaaggccuuggccccauccucucacagccuaggugcucugcaggcaugcugacuguccugauug

SEQ ID NO: 244549 - RNA, 64 nt, hsa
auuccaggcccaugaggggaaagaggaucuuccagcucugcaaaaacaagaacaaacaacauca

SEQ ID NO: 244550 - RNA, 64 nt, hsa
uggacagggucucugcugacugccaggggcgggggcucugcauagccaggaugacggcuuucau

SEQ ID NO: 244551 - RNA, 64 nt, hsa
uugcccccaacuuggcucggcaugugaauucuuagcucugcaagguguuuaugccuuugcgggu

SEQ ID NO: 244552 - RNA, 64 nt, hsa
acucuuccucucagagaauguugcucuggaggcugcucugcaugaaaacccuaaugguuucuug

SEQ ID NO: 244553 - RNA, 64 nt, hsa
guuuagaaaggauguuuaggggaacaugaggcuggcucugcagcaacaaccaggcuccccugca

SEQ ID NO: 244554 - RNA, 64 nt, hsa
cuccccucagcagucugagugcaaccccguuggugcucugcaggagcugguggugcagaaaggc

SEQ ID NO: 244555 - RNA, 64 nt, hsa
gaacuguccacccagccggccacugugugucauggcucugcaaccaccagggaggcagcccgug

SEQ ID NO: 244556 - RNA, 64 nt, hsa
gcagcuggcucgggagccggcuuacaggagggcagcucugcaguugggaggggcaccguccgga

SEQ ID NO: 244557 - RNA, 64 nt, hsa
caauuacuugaccugcagccccagcccacccucggcucugcagccgguucuccgggcccugguc

SEQ ID NO: 244558 - RNA, 64 nt, hsa
aaauggcugagauuuggugaucuccccacagcuggcucugcaaguuaccucuuucuccuugggc

SEQ ID NO: 244559 - RNA, 64 nt, hsa
auuuguuuaugcaguacggccugacauugcuuuugcucugcaacagcagagucgagucauugca

SEQ ID NO: 244560 - RNA, 64 nt, hsa
ugcgaauagagaggaagcuggaaaaguuccuggggcucugcagccaggaaggggaaccagggca

SEQ ID NO: 244561 - RNA, 64 nt, hsa
gcagcauuccaguccccuuugcagauccauagcugcucugcagggcggaagacaccuggggcgg

SEQ ID NO: 244562 - RNA, 64 nt, hsa
uucauccugccagaguuuccaaauggagcccggggcucugcagcauuccaguccccuuugcaga

SEQ ID NO: 244563 - RNA, 64 nt, hsa
augggcaucuuggcucucccugccagaaaaaugugcucugcaguguccucccaacugaaaacaa

SEQ ID NO: 244564 - RNA, 64 nt, hsa
aguguaucguuacaguaagacaugauaauggccggcucugcaaauuuaucauauaguuuuuuuc

SEQ ID NO: 244565 - RNA, 64 nt, hsa
gcuggucuucaucacgucuaugagcucugcaaucgcucugcagucgccucaacuccuggucucc

SEQ ID NO: 244566 - RNA, 64 nt, hsa
ugcagugcccagcuggucuucaucacgucuaugagcucugcaaucgcucugcagucgccucaac

SEQ ID NO: 244567 - RNA, 64 nt, hsa
aauucuccaucaaauauacagcauaaguaaaacugcucugcacuguuuaauccauuuccaaggg

SEQ ID NO: 244568 - RNA, 64 nt, hsa
caugggcauugcaagugccaccgugcggggccuggcucugcacacccaggaaaagucugcagac

SEQ ID NO: 244569 - RNA, 64 nt, hsa
auccccuuagaauuucaucuuucucgaugagcaggcucugcacccacucuuuuuuugccccccg

SEQ ID NO: 244570 - RNA, 64 nt, hsa
aggaaaaagaagcuugaauuuuaagacugaggcugcucugcagauucuaguuuggcuuucagag

SEQ ID NO: 244571 - RNA, 59 nt, hsa
uggcuacagcauggggugcccuauaggcacaagcccagcugaagaacagaauggagggc

SEQ ID NO: 244572 - RNA, 59 nt, hsa
ugacugcagaagaccaagaaccuguuccccaagcccagagauguccaccugggcuggac

SEQ ID NO: 244573 - RNA, 59 nt, hsa
ggggaggaugacaagccgcugcccaccuccaagcccaggaaacaguacaagauggcuaa

SEQ ID NO: 244574 - RNA, 59 nt, hsa
gguggcuccagaaagggcauccucuaccccaagcccaaagccugcugggugucccccau

SEQ ID NO: 244575 - RNA, 59 nt, hsa
ugccccuuucaggccuacagccacauccccaagcccaccaggugucaggauagucacag

SEQ ID NO: 244576 - RNA, 59 nt, hsa
cucagcugacccggccucucugccccacccaagcccaaacuugguuucugugagaauag

SEQ ID NO: 244577 - RNA, 59 nt, hsa
ccuccccgcaagcuggucccaucgaccagcaagcccagccccagggcgcuuagggagaa

SEQ ID NO: 244578 - RNA, 59 nt, hsa
guaaccagggcacaucacccaccucaagacaagcccacgcccuugucagcuuaggggga

SEQ ID NO: 244579 - RNA, 59 nt, hsa
cuaaagacaccuuccuuuccacuggcugucaagcccacagggcaccagugccacccagg

SEQ ID NO: 244580 - RNA, 59 nt, hsa
aggccuugccuucugagagcccccguggccaagcccaggucacagaucuucccccgacc

SEQ ID NO: 244581 - RNA, 59 nt, hsa
cucagugcagggacgucaccccugccaggcaagcccagggcacagaugccaggauggcu

SEQ ID NO: 244582 - RNA, 59 nt, hsa
ucucagugcgaggcuucaccccugccaggcaagcccagggcauagaugcugagacagcc

SEQ ID NO: 244583 - RNA, 59 nt, hsa
cucagugcagggacgucaccccugccaggcaagcccagggcacagaggccgggacggcc

SEQ ID NO: 244584 - RNA, 59 nt, hsa
ucucagugugaggcuucacccaugcuaggcaagcccagggcacagaugccgggauggcc

SEQ ID NO: 244585 - RNA, 59 nt, hsa
cucagugcgggaacgucaccccugccaggcaagcccagggcacagaugcugcgauggcc

SEQ ID NO: 244586 - RNA, 59 nt, hsa
gccaagcagaagcuccuggagauugccaccaagcccacguacccggugagccugggggc

SEQ ID NO: 244587 - RNA, 59 nt, hsa
gcagcaagcacaauaccauuaaaaagccucaagcccaaggcagaagaccuaucugcauu

SEQ ID NO: 244588 - RNA, 59 nt, hsa
cugagggagagggggccgggagggguugucaagcccacccgggaaacugagcccuggag

SEQ ID NO: 244589 - RNA, 59 nt, hsa
gcagguagaccuguggggauggcucgguccaagcccaacacugcccgcuccagagagcc

SEQ ID NO: 244590 - RNA, 59 nt, hsa
gacagaggcagacuggagugaugcggccacaagcccagggacaccuggagcccccagga

SEQ ID NO: 244591 - RNA, 59 nt, hsa
cagaggcagagacugaagugaugcugccccaagcccagggaugccuggaguccccagga

SEQ ID NO: 244592 - RNA, 64 nt, hsa
agucucccaaagagccauuucaacagagaagggaaaugacaaaggggcagcuggccagauaagc

SEQ ID NO: 244593 - RNA, 64 nt, hsa
ggcagagauaaucgugucuuaaaaguuguuuuuaaaugacaauaaaacaagccagaaugucuuu

SEQ ID NO: 244594 - RNA, 64 nt, hsa
gcuuguugaacgguccacuuucuuugaugaguggaaugacaagcaaugucugaugccuuuuugu

SEQ ID NO: 244595 - RNA, 64 nt, hsa
accauuuauggaugacaacaauuuuuuuuuuguaaaugacaagaaauucuuaugcagccuuuua

SEQ ID NO: 244596 - RNA, 64 nt, hsa
cauauacuaagauguucacuguggcauugucuguaaugacaaauaaguggaaaccguguaaaua

SEQ ID NO: 244597 - RNA, 64 nt, hsa
aauucuacaacuuuuccuaaggcacccacaaauaaaugacaagugagacaaaaagcacuaguau

SEQ ID NO: 244598 - RNA, 64 nt, hsa
aaugaauuaugaauaccgcagggcagccuucuuaaaugacaaauguaaaaaaaaaaaaaaaaaa

SEQ ID NO: 244599 - RNA, 64 nt, hsa
aaagaauccauuugaagacaauguugcaauguugaaugacaaaaauaaacaguucaagugaagc

SEQ ID NO: 244600 - RNA, 64 nt, hsa
uaaauauauugauagaccugucauuguauugauuaaugacaaaacccuuuagauaauuaucuuc

SEQ ID NO: 244601 - RNA, 64 nt, hsa
gaggaaaguugauuugaagugaggauuagaagugaaugacaauaaagucugucagccaagcacg

SEQ ID NO: 244602 - RNA, 64 nt, hsa
aggaccaaaaacagaaauacagucuuccugaaugaaugacaaucagaauuccacugcccaaagg

SEQ ID NO: 244603 - RNA, 64 nt, hsa
aaaaaccuagaacaaguuuaacugugacuacugaaaugacaagaauucuacaguaggaaacuga

SEQ ID NO: 244604 - RNA, 64 nt, hsa
auuuguaagaaacauuuaaauuuucauugaaauaaaugacaagucauacugccacuuaaaaaaa

SEQ ID NO: 244605 - RNA, 64 nt, hsa
ccuccuugguuuaccuccaucauuaaaaaacaacaaugacaacgacaacaaaaaacaaaacuaa

SEQ ID NO: 244606 - RNA, 64 nt, hsa
uauuguauguguguuguaaucuaaaaaaaaaaagaaugacaaacagcuucuuuaagacaagucu

SEQ ID NO: 244607 - RNA, 64 nt, hsa
aguuuucuuugaaaguauuggaaaacuaaaauuaaaugacaaggacuuugaauuagaauuuugc

SEQ ID NO: 244608 - RNA, 64 nt, hsa
uagggcucaaacuacucucuauugguuccaggauaaugacaaauugaaccauauguaaguaauc

SEQ ID NO: 244609 - RNA, 64 nt, hsa
uuccauugagaggaauguuuacagcaguuucaaaaaugacaaagucaguuuggagacagaaaaa

SEQ ID NO: 244610 - RNA, 64 nt, hsa
uuagauuuuaaauguauuauugaccugagaccuuaaugacaaaucacugcuauuagacaauuga

SEQ ID NO: 244611 - RNA, 64 nt, hsa
auaaacuuuuucagaaagaauugaguagagcaaaaaugacaaagauguguagcuguguucaauu

SEQ ID NO: 244612 - RNA, 64 nt, hsa
gcuuaccguuuugucuauaagauacacaaguauaaaugacaaguacaaauaacaaugaauguuu

SEQ ID NO: 244613 - RNA, 64 nt, hsa
gaaugucucuugacuaauugacaaaguguaaugaaaugacaagcugguugaagcugguaaucaa

SEQ ID NO: 244614 - RNA, 64 nt, hsa
gaccaaaagacccaccacuguauuuugaccaaauaaugacaacuucuuuagaaauuugaauggc

SEQ ID NO: 244615 - RNA, 64 nt, hsa
cccgaugacuauucaaaucagcaucuagaggcugaaugacaaugccaaacacuccaccucugau

SEQ ID NO: 244616 - RNA, 64 nt, hsa
aguguauuguucugcaguguugaaacagaauggaaaugacaagaaauaucugcaguuauccagg

SEQ ID NO: 244617 - RNA, 54 nt, hsa
accacucccuuaaagacugaggaaaaugacaaaguauucucggcugcaaaaauc

SEQ ID NO: 244618 - RNA, 64 nt, hsa
uugccuaaagauaucugggaccucuacuggcuuuaaugacaaauaauguuauguugagguuaug

SEQ ID NO: 244619 - RNA, 64 nt, hsa
aauggaaaauugugguuaauucugaauuucauguaaugacaacauauucuuucauaaaacuaug

SEQ ID NO: 244620 - RNA, 64 nt, hsa
aauuaauguuuuacuuaauuuauauugaacugucaaugacaaauaaaaauucuuuuugauuauu

SEQ ID NO: 244621 - RNA, 64 nt, hsa
gagugugcuauucuaaaagauuuugauuuccuggaaugacaauuauauuuuaacuuuggugggg

SEQ ID NO: 244622 - RNA, 64 nt, hsa
gaagcauuugacucguuguacuucagagaccauaaaugacaagguuuugacauuuuugaagaga

SEQ ID NO: 244623 - RNA, 64 nt, hsa
uaucugagccuucaguuagucauuuggucaaaccaaugacaaaaccgccuuccacaaaaguuga

SEQ ID NO: 244624 - RNA, 64 nt, hsa
caccaaaauaauaaaaggcagcuaauggaaaggagagacaaaagcaugguuaauauauauacuu

SEQ ID NO: 244625 - RNA, 64 nt, hsa
uaauucagugcuauccaguuauaaauggaaucuugagacaaaaccuuaacaaagaaauaacagu

SEQ ID NO: 244626 - RNA, 64 nt, hsa
agcauguauauaagagcacguuguaaacuugaaagagacaaaggcacaaauguggcuguugauu

SEQ ID NO: 244627 - RNA, 64 nt, hsa
ccuagacuaggacuccagugcccuccucucccaagagacaaaggccauugcauugaaggaggug

SEQ ID NO: 244628 - RNA, 64 nt, hsa
gugagacucuuuaaaaaaagaaauuaaaagaguugagacaaacguuuccuacauucuuuuccau

SEQ ID NO: 244629 - RNA, 64 nt, hsa
cagcaccguuccgacagggaccagugaaagaaaagagacaaaguuagaacgugcuggggagcgg

SEQ ID NO: 244630 - RNA, 64 nt, hsa
ggaucaccugagguuaggaguucgagaccagccuggccaacaugguaaaaccccaucucuacua

SEQ ID NO: 244631 - RNA, 64 nt, hsa
ucugccaauuuuuuaaaaaaguaaguaccacucaggccaacaagccaacgacaaagccaaacuc

SEQ ID NO: 244632 - RNA, 64 nt, hsa
agaucaccugaggucaggaguucgagaccacccuggccaacauggugaaaccccaucucuacag

SEQ ID NO: 244633 - RNA, 64 nt, hsa
ggaucaccugagguuagaaguuugagaccagccuggccaacauggugaaaccuggccucuacua

SEQ ID NO: 244634 - RNA, 64 nt, hsa
acggaucacgaggucaggagaucaagaccauccuggccaacauggugaaaccccaucucuacug

SEQ ID NO: 244635 - RNA, 64 nt, hsa
ggaucucuugaggucgggaguuugagaccagccuggccaacauggugaaacccugucuuuacua

SEQ ID NO: 244636 - RNA, 64 nt, hsa
ggaccacaugaggucaggaguuugagaucagccuggccaacauggugaaaccccaucucuacua

SEQ ID NO: 244637 - RNA, 64 nt, hsa
gcggaucaugaggucaagagaucaagaucauccuggccaacauggugaaacccugucucuacua

SEQ ID NO: 244638 - RNA, 64 nt, hsa
agaucacuugaggucagaaguuugagaccagccaggccaacauggugaaacuucaucucuacua

SEQ ID NO: 244639 - RNA, 64 nt, hsa
guggaucacaaggucaagagaucgagaccauccuggccaacauggugaaacccugucucuauua

SEQ ID NO: 244640 - RNA, 64 nt, hsa
uaggaugcuacuugcugcaaacaagcccuacuuuggccaacauccugcuuauuucucaaaaaag

SEQ ID NO: 244641 - RNA, 64 nt, hsa
gaucaccugaggucaggaguuuugagaccagccuggccaacaugguaaaaucccgucucuacua

SEQ ID NO: 244642 - RNA, 64 nt, hsa
ggaugacuugaggccaggaguuggagaccagccuggccaacauggugaaacccugucucuacua

SEQ ID NO: 244643 - RNA, 64 nt, hsa
uuggcuuucccacagaggcaggaguccuaccucgggccaacacucuuucuccuugguggaaacu

SEQ ID NO: 244644 - RNA, 64 nt, hsa
gcggaucacaagguccagagaucgagaccauccuggccaacauggugaaaccccgucucuacua

SEQ ID NO: 244645 - RNA, 64 nt, hsa
ggaucacuugaggccaggaguucaagaccagccuggccaacauggcaaaaucccaucucuacua

SEQ ID NO: 244646 - RNA, 64 nt, hsa
gcacuuugggaggccaggaguucgagaccagccuggccaacauggugaaacccggucucuacua

SEQ ID NO: 244647 - RNA, 64 nt, hsa
ggaucaccugaggucaggaguuugagaccagccuggccaacauggcaaaaccccgucucuacaa

SEQ ID NO: 244648 - RNA, 64 nt, hsa
ggaucacuugaggucaggagcucgagaccagccuggccaacacggugaaaccccaucucuacua

SEQ ID NO: 244649 - RNA, 64 nt, hsa
ggaucacuugaggucaggagcucaagaccagccuggccaacauggugaaaccccaucucuacua

SEQ ID NO: 244650 - RNA, 64 nt, hsa
ggaucacucaaggucaggcauuugagaccagccuggccaacauagugaaaccccgucucuauua

SEQ ID NO: 244651 - RNA, 64 nt, hsa
agaucaccugaggcuaggaguugcagaccagccuggccaacauggcaaaaccccgucucuacua

SEQ ID NO: 244652 - RNA, 64 nt, hsa
ggaucagcugaggucaggaguuggagaccagcguggccaacauggugaaaccccgucucuacua

SEQ ID NO: 244653 - RNA, 64 nt, hsa
gcggaucacgaggucaggagaucgagaccauccuggccaacacggugaaaccucgucuccacua

SEQ ID NO: 244654 - RNA, 64 nt, hsa
cgaucacuugaggucaggaguucaagaccagccuggccaacauggugaaaccccaucucuacua

SEQ ID NO: 244655 - RNA, 64 nt, hsa
ggaucacuugaggccaggaguucaagaccagccuggccaacaugaugagaccuccgucucuacu

SEQ ID NO: 244656 - RNA, 64 nt, hsa
agcaccgcagcgggagccagcagggggcagcagaggccaacagggagcucgcaggccgggcccc

SEQ ID NO: 244657 - RNA, 64 nt, hsa
gcggaucacaaggucaggaguucgagaccagccuggccaacacggugaaaccccgacucuacua

SEQ ID NO: 244658 - RNA, 64 nt, hsa
agguggguggaucacuggaguuugagaccacccuggccaacauggugaaaccccaucucuacua

SEQ ID NO: 244659 - RNA, 64 nt, hsa
gcggaucacgaggucaggaguucgagaccagccuggccaacauagugaaaccccaucucuacua

SEQ ID NO: 244660 - RNA, 64 nt, hsa
agaucacuugaggucaggaguucaagaccagccuggccaacauggugaaaccccaucucuacua

SEQ ID NO: 244661 - RNA, 64 nt, hsa
gaucacuugagguuaggaguuugagaacuggccuggccaacauagcaaaaccucaucucuacua

SEQ ID NO: 244662 - RNA, 64 nt, hsa
gcagaucacgaggucaggaguucgagaccauccuggccaacauggugaaaccccgucucuacua

SEQ ID NO: 244663 - RNA, 64 nt, hsa
ggauugcuugaggccaggaguuagagaccagccuggccaacaaggcaaaaccccgucucuacua

SEQ ID NO: 244664 - RNA, 63 nt, hsa
aaacugucugucuaauggucacagagcacuguagcacuuaacagauugccauggacaccaguu

SEQ ID NO: 244665 - RNA, 63 nt, hsa
uucuuuagugggggaggguaagaaaagcaguuugcacuuaaaaagaaaaaaaaaaaacgggug

SEQ ID NO: 244666 - RNA, 63 nt, hsa
auaaucaguauaauaauuugccuuguguggucagcacuuaacuguuuacaaagcccuuucacg

SEQ ID NO: 244667 - RNA, 63 nt, hsa
caccuguggccccuaaacccagagugacugagagcacuuaacauucagcuugucucaucccca

SEQ ID NO: 244668 - RNA, 63 nt, hsa
uuuuucuuuccucccuuaccccaaauucauugagcacuuaaaggagcagagaugcagccagug

SEQ ID NO: 244669 - RNA, 63 nt, hsa
ugacuaggaguguuaggggcagaaguuuugaaugcacuuaaccggaggagggcgcaggguggg

SEQ ID NO: 244670 - RNA, 63 nt, hsa
guuuuaaauuaauuuuuuagcagauagcaguuagcacuuaaucuguaaauugaauaauuuauc

SEQ ID NO: 244671 - RNA, 63 nt, hsa
aaucaauuaguaauggcggaaacugucgcugaagcacuuaagaaauaaagguacuuuacagca

SEQ ID NO: 244672 - RNA, 63 nt, hsa
uauuuaaaaauuguuucuugacaagcugacuuggcacuuaagugcacuuuuuuaugaagaaaa

SEQ ID NO: 244673 - RNA, 63 nt, hsa
ugcaggugacagcaggacuugcuaaagcacuuugcacuuaauggcuguugagggccacuuuuu

SEQ ID NO: 244674 - RNA, 63 nt, hsa
auaugcaaucacucguuuaugcugucuagucaugcacuuaaagcaauuuucaaauguacucaa

SEQ ID NO: 244675 - RNA, 63 nt, hsa
gcgugcaguucauuucuaguucuugauagaacugcacuuaauuuucaguaguagucuugacuu

SEQ ID NO: 244676 - RNA, 63 nt, hsa
uuucuuaauuauuauaaaaauauuaagacaauagcacuuaaauuccucaacaguguuuucaga

SEQ ID NO: 244677 - RNA, 63 nt, hsa
uuuuucauuuuaaaaaguccauaccuuauauaugcacuuaauuuguuggggcuuuacauacuu

SEQ ID NO: 244678 - RNA, 63 nt, hsa
gcaagugacaaucagaggugacuaucuauauuugcacuuaaaaucaaaguaguucaacaugca

SEQ ID NO: 244679 - RNA, 63 nt, hsa
uugacuccccuuauucccucuccaagaguaguugcacuuaacuuuuuuuuuuuuuuuuuagug

SEQ ID NO: 244680 - RNA, 63 nt, hsa
gcagguaguguuuaguuaucuacugcauuaugagcacuuaaaguacugcuagcuguagaacuc

SEQ ID NO: 244681 - RNA, 63 nt, hsa
acuuucuauuuuuagccuauauuuggaaagaaagcacuuaacauuuuaggaauucuuuuuaaa

SEQ ID NO: 244682 - RNA, 63 nt, hsa
uuuuguuuuuuuucaucuuaauauguaccaguggcacuuaaccaaaagauacagugauauagc

SEQ ID NO: 244683 - RNA, 63 nt, hsa
gguuucaguacaaaugcugcugucuauuucugugcacuuaacaauggaacccaaacagaagag

SEQ ID NO: 244684 - RNA, 64 nt, hsa
ggcaaagucaaugaguacaacuugcauaugucaucccauauaacuaagacauaugcauuuaugg

SEQ ID NO: 244685 - RNA, 64 nt, hsa
aaauauuucaaccuuucauauuuuuaagaaaacacccauauauauugaaaugcaaacuuaaaca

SEQ ID NO: 244686 - RNA, 64 nt, hsa
agauauaacaugcucaugauaaaaaagaauugaaauaguugaaaaggguguucagugaaaagua

SEQ ID NO: 244687 - RNA, 64 nt, hsa
gguuaaugcuuuguuagauagcuucauccagucaauaguugaaaaguuuucacauaauccagua

SEQ ID NO: 244688 - RNA, 64 nt, hsa
caugucuuaaugaauguuguugaaagcaauguaaauaguugaaaauauaaauuuauauuacagu

SEQ ID NO: 244689 - RNA, 64 nt, hsa
gucuuuuugcaaguaugaaucacuuaaccugcugauaguugaagaacacuuuaggaguuuugua

SEQ ID NO: 244690 - RNA, 64 nt, hsa
ugucuuacauuuuccaaaagcaggcuuuaauugcauaguugagucuaggaaaaaauaauguuaa

SEQ ID NO: 244691 - RNA, 64 nt, hsa
gacuuuucauuuagccccaggugacuuacuaaaaauaguugaaaauuauucaccuaagaauaga

SEQ ID NO: 244692 - RNA, 64 nt, hsa
cacauauuuguagcuagaauauccuauacugguuauaguugauauguaacaguuggugauuuua

SEQ ID NO: 244693 - RNA, 64 nt, hsa
uuuuaaaaaauaacauauucuugcuuucacaaauauaguugaacaagauuucccuaaaaauucc

SEQ ID NO: 244694 - RNA, 64 nt, hsa
acgucgcuuccugggauuccagcacgaugccuccauaguugaaagacuacacaaaaagccacaa

SEQ ID NO: 244695 - RNA, 64 nt, hsa
guuuccagcuaguccuagaguucuauauuucuacauaguugaauuauuuuaucaugcuguugcu

SEQ ID NO: 244696 - RNA, 64 nt, hsa
aagccucggccucccugagcucugaccccagccucacccgaaaggccagccuggggcucuccgg

SEQ ID NO: 244697 - RNA, 64 nt, hsa
cuaaaugaaauaacuuucuucucuuccccuuccccacccgaauucuuuucugaaguugcuggca

SEQ ID NO: 244698 - RNA, 64 nt, hsa
ggguccucugggauuaguuaugcagauauuaaaucacccgaagacacuaacuuacagaagacac

SEQ ID NO: 244699 - RNA, 64 nt, hsa
aaggacaauguuaucugggauucaccgugcccagcacccgaagugccaaauuccaggaggacaa

SEQ ID NO: 244700 - RNA, 64 nt, hsa
agccgagucacacccgguggcucugguaugaauucacccgaagcgcuucugcaccaacucaccu

SEQ ID NO: 244701 - RNA, 64 nt, hsa
cuggcccucugggcccaacgcaggaggcccucagcacccgaacacaucuuccuccuccccaccc

SEQ ID NO: 244702 - RNA, 64 nt, hsa
auuuauacauaaaccuaaaagcauuugaacaugacacccgaacacauacauauauguucacuua

SEQ ID NO: 244703 - RNA, 64 nt, hsa
guauccagaccuugaaagucgcuccgccuccccccacccgaagccaauauaggggaaaaaacuc

SEQ ID NO: 244704 - RNA, 64 nt, hsa
gcugaugauuuagagugcuguccgguggagaucccacccgaacgucuuaucuaaucaugaaacu

SEQ ID NO: 244705 - RNA, 64 nt, hsa
uuguauacccacgcuucagcuacuaucuaaucaucacccgaagauuuaagauacaccaaauuuc

SEQ ID NO: 244706 - RNA, 64 nt, hsa
gaguggauagcuguuuucaccuaaaggaaaagcccacccgaaucuuguagaaauauucaaacua

SEQ ID NO: 244707 - RNA, 64 nt, hsa
aaauuaaaggaaagggaaagaaauagaucuggugcacccgaacauuaggagaaaaugaaaaaua

SEQ ID NO: 244708 - RNA, 64 nt, hsa
uccuuuuuacuugugugguuauguguggggcuggcacccgaaaugugugacauucagcuucuaa

SEQ ID NO: 244709 - RNA, 64 nt, hsa
uuuacaagaaaaugaaaagcguccucuuaauuggcacccgaauguugcuguggcucagucacau

SEQ ID NO: 244710 - RNA, 64 nt, hsa
cgggcccagccccaggcugcagcccauucgcaggcacccgaaagaacuuccccaguaugguggu

SEQ ID NO: 244711 - RNA, 64 nt, hsa
auuauuagaccccggggcagucaggugcuccggacacccgaaggcaauaaaacaggagccgugg

SEQ ID NO: 244712 - RNA, 64 nt, hsa
agugguggcugccaucccucggggcccaggcccucacccgaagggcugccucacucuguggugu

SEQ ID NO: 244713 - RNA, 64 nt, hsa
gaaggagccgugaggagaggagugaggcaacaggcacccgaagucccucguccuucccucugug

SEQ ID NO: 244714 - RNA, 64 nt, hsa
agaggugccagcaauugcugaagguggcgaugaacacccgaaggugggagggaggacugguacc

SEQ ID NO: 244715 - RNA, 64 nt, hsa
ucagugccccugggagggaagggcaucccugaggcacccgaauggucccucagggugcagggag

SEQ ID NO: 244716 - RNA, 64 nt, hsa
ggccucugcugccgggccacguuaguccgcagcucacccgaacagaggacaacccugaggugug

SEQ ID NO: 244717 - RNA, 64 nt, hsa
acacccccgugcucugcaccagccucucccuccacacccgaagcaggcguccaucuguguccuc

SEQ ID NO: 244718 - RNA, 64 nt, hsa
gcgccccugcugucuuccccaccgcagucaccaccacccgaaaugccacguggucacugugcac

SEQ ID NO: 244719 - RNA, 64 nt, hsa
agcugccuggccagcccacccuccugcaaccucucacccgaacaccagugaucaggacuggagc

SEQ ID NO: 244720 - RNA, 64 nt, hsa
ggcagcuccuggacagccucuuggcuccagcccccacccgaaaguggacacuggcuccgcccug

SEQ ID NO: 244721 - RNA, 64 nt, hsa
ucuagcauuguuugcaagagugaaagaguggaaacacccgaaguguccaucaguaagggacagg

SEQ ID NO: 244722 - RNA, 64 nt, hsa
aauucaccguguguacugagugcaguuuuuuucacacccgaaagucuuuacuggcuuucauagc

SEQ ID NO: 244723 - RNA, 64 nt, hsa
ucgcucccauguuuccacccggcacccugauccucacccgaaucuccuuuuuuuuuuucuuuug

SEQ ID NO: 244724 - RNA, 64 nt, hsa
gccuggccgccagggagcgccacuggcuucccgccacccgaagggagcucuggacccucagagc

SEQ ID NO: 244725 - RNA, 64 nt, hsa
cgaugguugagggauugucacgggaggaacaugacacccgaagggacucuaggugcccucggag

SEQ ID NO: 244726 - RNA, 64 nt, hsa
cuacuggauugccuuaaauucuucucuuacaccccacccgaaaguauucagcuggcauuuagag

SEQ ID NO: 244727 - RNA, 64 nt, hsa
uggccaugcccuagacccuccccaaggaugaccacacccgaaguccugucacugagcacaguca

SEQ ID NO: 244728 - RNA, 64 nt, hsa
gggucucagccccugccuuccccagucucugggucacccgaauuuucccaccccugcuucuccc

SEQ ID NO: 244729 - RNA, 64 nt, hsa
ucuagugcuccauccaccccucucuccacagacgcacccgaauuucuguccguucccaaagauc

SEQ ID NO: 244730 - RNA, 64 nt, hsa
cugacuauagcaaccagcuggacccggccucuggcacccgaaacuuccacccccgacggcuccu

SEQ ID NO: 244731 - RNA, 64 nt, hsa
guccaucagaaacaggagcugacaaccugcugggcacccgaagaccaagcccccugccagcuca

SEQ ID NO: 244732 - RNA, 64 nt, hsa
ccggggccucggggcacacagcuggggcugcccccacccgaaagacccuccacgcucguccucu

SEQ ID NO: 244733 - RNA, 64 nt, hsa
cccaggggucccugcuggaucagagaaauagaagcacccgaagacgguuaguggcaauuccuug

SEQ ID NO: 244734 - RNA, 64 nt, hsa
uuuguguggcccauggauuugaaagaagcugcugcacccgaaacugccagugugcggugacaac

SEQ ID NO: 244735 - RNA, 64 nt, hsa
ucugaaagucuagugagagcugugaucuuugccccacccgaauaaugcauauggacaccacacc

SEQ ID NO: 244736 - RNA, 64 nt, hsa
aaguucauuuccaaggggaaucaggagcgagccacacccgaaugguagaaagaucucaggguua

SEQ ID NO: 244737 - RNA, 64 nt, hsa
uucuuuauauagauaguauuuuauauuuuauucucacccgaaguauucacacaaucuuuuuaaa

SEQ ID NO: 244738 - RNA, 59 nt, hsa
auuuuugggcccuagaaaugcucaaagggugcuccuaggauuaucagagccuaucuuuc

SEQ ID NO: 244739 - RNA, 59 nt, hsa
cucccuagaucuuuagcuucuacucccacugcuccuaccacuccagcaacgccagauaa

SEQ ID NO: 244740 - RNA, 59 nt, hsa
ccagaucguucugccacuugcacugugcuugcuccuaagcaaaagggaaaaggagcgcg

SEQ ID NO: 244741 - RNA, 59 nt, hsa
ggauguuauucuuccuucccaacucacugugcuccuaaaggcagcaaccauucaucuuu

SEQ ID NO: 244742 - RNA, 59 nt, hsa
aaggaaguacauuuuuaaauuuuucaaacugcuccuagcuuuugauuaggagaauauuu

SEQ ID NO: 244743 - RNA, 59 nt, hsa
aaggagcuuuggcuccugauauuuuaucaugcuccuauauuuuuuuaauccuuggagca

SEQ ID NO: 244744 - RNA, 59 nt, hsa
uauuacaaauauuuugcuaguuuuugacuugcuccuaauguugaauuuugaugaacaaa

SEQ ID NO: 244745 - RNA, 59 nt, hsa
caguuuuccuaagugauuguaugaauuuaugcuccuaccggcaauguguggcaguccua

SEQ ID NO: 244746 - RNA, 59 nt, hsa
ccuggguucuggacgugagugguggguccugcuccuaucucuccaaaccccauacccuu

SEQ ID NO: 244747 - RNA, 59 nt, hsa
cugacuuucuagccauuaauaaagagaacugcuccuagcaccucagccucuaaccauca

SEQ ID NO: 244748 - RNA, 64 nt, hsa
uggaccuaauugggcauugggcuuuagugagaccacagaccaggcccgucucuccuguaggcuu

SEQ ID NO: 244749 - RNA, 64 nt, hsa
aucccacuuacucuuuuuuuuuuuuucagagaccacagaccacagugauuuuucuuuucccuug

SEQ ID NO: 244750 - RNA, 64 nt, hsa
aguacacuaggugcaaaccagaacucuugguggaacagaccagccacugcagcagacagaccag

SEQ ID NO: 244751 - RNA, 64 nt, hsa
aacucuugguggaacagaccagccacugcagcagacagaccaggaacacaaugagacugacauu

SEQ ID NO: 244752 - RNA, 64 nt, hsa
uacaggauuacuugagaguuaucagggcugccuaacagaccaggagaucuggggguugcaccag

SEQ ID NO: 244753 - RNA, 64 nt, hsa
agaaccggagguagagcaaugaucagaugggugcacagaccagugccaaucugaacauuguuaa

SEQ ID NO: 244754 - RNA, 64 nt, hsa
uagccacuuaauggagacacaauggagagguaagacagaccacaaacuaguucuuauaguguac

SEQ ID NO: 244755 - RNA, 64 nt, hsa
acaauuucaaagagaacccacauuugugagauuuacagaccaaggugugguggaggagguagaa

SEQ ID NO: 244756 - RNA, 64 nt, hsa
auucauuaaaaaaaauguauugugguuuaugcgaacagaccaaccuggcauuacaguuggccuc

SEQ ID NO: 244757 - RNA, 64 nt, hsa
uuauguuuuauuacuuuccaauuaccuguaacugacagaccaaauuaauuggcuuuguguccua

SEQ ID NO: 244758 - RNA, 64 nt, hsa
augcucuuccuggaacugcccacgucugcacagaacagaccaccagacgccagggcugauuggu

SEQ ID NO: 244759 - RNA, 64 nt, hsa
ucugcccaugcuagggggugggggagcucccaggacagaccagccuuguuucucauguaaugca

SEQ ID NO: 244760 - RNA, 64 nt, hsa
uguccucugacgucccuuucccaacugucaccaaacagaccaucuucccaggccuggggaccgg

SEQ ID NO: 244761 - RNA, 64 nt, hsa
gaagacuggccacgccuccugagaccacuuggaaacagaccaacugcccccguggucgccuggu

SEQ ID NO: 244762 - RNA, 64 nt, hsa
gugcauaggccacacagcacaugcacacaggugcacagaccacacagcacacacaagugcacag

SEQ ID NO: 244763 - RNA, 64 nt, hsa
guagcucacacacaguauacacauacacaagugcacagaccacacacagcacuaacacaugcac

SEQ ID NO: 244764 - RNA, 64 nt, hsa
acaggcguacacaugcacgcuugcacacaugcacacagaccacauagcacacaugugcacugac

SEQ ID NO: 244765 - RNA, 57 nt, hsa
caucagugaaaucccugagggcaggggcugucucauucaucuguggauauggagcgg

SEQ ID NO: 244766 - RNA, 57 nt, hsa
cacaugccugggucggcauuucucucgcugucucaugauuaguuauguuugccuguc

SEQ ID NO: 244767 - RNA, 57 nt, hsa
cuccagccuggacaacagagcaagacucugucucaaaaaaaaaauaaaaaauaaaaa

SEQ ID NO: 244768 - RNA, 57 nt, hsa
cacuccagcuugagcaacacagugauacugucucaauaaauaaauaaauagaagaaa

SEQ ID NO: 244769 - RNA, 57 nt, hsa
cuccagccugggugacagagugagacccugucucaaaagcaaaacaaacagcaauaa

SEQ ID NO: 244770 - RNA, 57 nt, hsa
cuccagccugggugacagagccagacucugucucaaaaaaaaaaaaaaagaaaagaa

SEQ ID NO: 244771 - RNA, 57 nt, hsa
cuucuguauaguaaccauuuucuuaggcugucucacuugugugaaucuucugacaca

SEQ ID NO: 244772 - RNA, 57 nt, hsa
cuccagccugggugacagagcgagacucugucucaaaaaaacaaaacaaaaaaacac

SEQ ID NO: 244773 - RNA, 57 nt, hsa
aaacaugggguuggaguggaggaggagcugucucagcaagaggagaccuggggcugu

SEQ ID NO: 244774 - RNA, 57 nt, hsa
ccacuagccccacuuaaacuacuacuacugucucagagaacaguguuuccuaaugua

SEQ ID NO: 244775 - RNA, 57 nt, hsa
ucauaaaguagaaaaauucaaaggaagcugucucaauuugagaauaccagcugggca

SEQ ID NO: 244776 - RNA, 57 nt, hsa
acuccagccugaugacagaccgagacacugucucaaaaaaauaaaaaaauucagauu

SEQ ID NO: 244777 - RNA, 57 nt, hsa
uuccagccuggaugacagagcaaaacccugucucaaaaaaaugcagacuggccaggc

SEQ ID NO: 244778 - RNA, 57 nt, hsa
ggucuuuacuuacuugucuguaucuuucugucucacucgaaaggcacagucucaaug

SEQ ID NO: 244779 - RNA, 57 nt, hsa
cucuagccugggcaaccaagagugaaacugucucaaaaaacaacuuuuaucaauguc

SEQ ID NO: 244780 - RNA, 57 nt, hsa
cucuagucugggugacagagcgagacucugucucaaaaaaaaaaaaauaaagccggg

SEQ ID NO: 244781 - RNA, 57 nt, hsa
gcuccagccugagcaacaagagcgaaacugucucaaaaaaaagaagaaaauaaauaa

SEQ ID NO: 244782 - RNA, 57 nt, hsa
aaucugccugugcugcucuuucauacccugucucaguaacuauuuggccaugugcuc

SEQ ID NO: 244783 - RNA, 57 nt, hsa
ugcuccggacucuucuaggaaauuccucugucucauuuguccucaucuccuucuugc

SEQ ID NO: 244784 - RNA, 57 nt, hsa
cuccagccggggugacagagcgaaccucugucucaaaaaaaaaaaaagaaaaaagaa

SEQ ID NO: 244785 - RNA, 57 nt, hsa
cuccagcuugggcaacagaguaagacucugucucaaaaaaaaaaaaacaaaaacaaa

SEQ ID NO: 244786 - RNA, 57 nt, hsa
uccagccugggcaacaaaagcgaaacucugucucaaaaaagaaaaaaaagaaaaaaa

SEQ ID NO: 244787 - RNA, 57 nt, hsa
uccagccugggcaacaagagcgaaacucugucucaaaaaaaaaaaaaagaggugggu

SEQ ID NO: 244788 - RNA, 57 nt, hsa
cucugcccuucacagguagauaccacucugucucaguuuaccgaccugaauguuuac

SEQ ID NO: 244789 - RNA, 57 nt, hsa
ugucuaaacccugugucccugagggaucugucucacuggcaucuuguugagggccuu

SEQ ID NO: 244790 - RNA, 57 nt, hsa
cuccagucugggcaacagagugagacccugucucaauaauaauaauaauaauaauga

SEQ ID NO: 244791 - RNA, 57 nt, hsa
gauacagaugacagugacgaaugccuucugucucaugauugacagggaaaaggaagg

SEQ ID NO: 244792 - RNA, 57 nt, hsa
guuguuugguuuugguuuucacugucucugucucaucuaguaccuaccuuaguuuau

SEQ ID NO: 244793 - RNA, 57 nt, hsa
cuccaaccuaggugacagagcaagacccugucucaaaaaaaaaaaaacaaauuaacc

SEQ ID NO: 244794 - RNA, 57 nt, hsa
ucaagcuugggcaacgagagcaaaacucugucucaaaaaaaaaauuagccagaugug

SEQ ID NO: 244795 - RNA, 57 nt, hsa
cuccagccuaggugacagagugagacccugucucaaaaauaaauaauaaauaaauaa

SEQ ID NO: 244796 - RNA, 57 nt, hsa
gagagggugggagauucuccuccaguccugucucaucuccugggagaggcagacgag

SEQ ID NO: 244797 - RNA, 57 nt, hsa
ccucugccauguccagagggcacaaaacugucucaaugagaggggagacagaggcag

SEQ ID NO: 244798 - RNA, 57 nt, hsa
cuccagccugggcaacagagcaaaacucugucucaaaaaaaaaaaaaaaaaggcaaa

SEQ ID NO: 244799 - RNA, 57 nt, hsa
acagggccacauuugcaugagacauggcugucucacaggucacagagccauuacaac

SEQ ID NO: 244800 - RNA, 57 nt, hsa
gucugcccuuuggcccaaaauuuaugucugucucauguguaaaagacauucauccca

SEQ ID NO: 244801 - RNA, 57 nt, hsa
ggcauaggauaacaguuacagacauuucugucucaaaaaggagagaauggaaauugg

SEQ ID NO: 244802 - RNA, 57 nt, hsa
cagcaucuucucuguguaccaccucugcugucucagaugcccccagcaaauaaacac

SEQ ID NO: 244803 - RNA, 57 nt, hsa
ccacucaccgaccugagucaguguccucugucucacagggccccucucccuucuguu

SEQ ID NO: 244804 - RNA, 64 nt, hsa; identical to SEQ ID NO: 163552

SEQ ID NO: 244805 - RNA, 64 nt, hsa; identical to SEQ ID NO: 163553

SEQ ID NO: 244806 - RNA, 64 nt, hsa; identical to SEQ ID NO: 163554

SEQ ID NO: 244807 - RNA, 64 nt, hsa; identical to SEQ ID NO: 163555

SEQ ID NO: 244808 - RNA, 64 nt, hsa; identical to SEQ ID NO: 163556

SEQ ID NO: 244809 - RNA, 64 nt, hsa; identical to SEQ ID NO: 163557

SEQ ID NO: 244810 - RNA, 64 nt, hsa; identical to SEQ ID NO: 163558

SEQ ID NO: 244811 - RNA, 64 nt, hsa; identical to SEQ ID NO: 163559

SEQ ID NO: 244812 - RNA, 64 nt, hsa; identical to SEQ ID NO: 163560

SEQ ID NO: 244813 - RNA, 64 nt, hsa; identical to SEQ ID NO: 163561

SEQ ID NO: 244814 - RNA, 64 nt, hsa; identical to SEQ ID NO: 163562

SEQ ID NO: 244815 - RNA, 64 nt, hsa; identical to SEQ ID NO: 163563

SEQ ID NO: 244816 - RNA, 64 nt, hsa; identical to SEQ ID NO: 163564

SEQ ID NO: 244817 - RNA, 64 nt, hsa; identical to SEQ ID NO: 163565

SEQ ID NO: 244818 - RNA, 64 nt, hsa; identical to SEQ ID NO: 163566

SEQ ID NO: 244819 - RNA, 64 nt, hsa; identical to SEQ ID NO: 163567

SEQ ID NO: 244820 - RNA, 64 nt, hsa; identical to SEQ ID NO: 163568

SEQ ID NO: 244821 - RNA, 64 nt, hsa; identical to SEQ ID NO: 163569

SEQ ID NO: 244822 - RNA, 64 nt, hsa; identical to SEQ ID NO: 163570

SEQ ID NO: 244823 - RNA, 64 nt, hsa; identical to SEQ ID NO: 163571

SEQ ID NO: 244824 - RNA, 64 nt, hsa; identical to SEQ ID NO: 163572

SEQ ID NO: 244825 - RNA, 64 nt, hsa; identical to SEQ ID NO: 163573

SEQ ID NO: 244826 - RNA, 64 nt, hsa; identical to SEQ ID NO: 163574

SEQ ID NO: 244827 - RNA, 64 nt, hsa; identical to SEQ ID NO: 163575

SEQ ID NO: 244828 - RNA, 64 nt, hsa; identical to SEQ ID NO: 163576

SEQ ID NO: 244829 - RNA, 64 nt, hsa; identical to SEQ ID NO: 163577

SEQ ID NO: 244830 - RNA, 64 nt, hsa; identical to SEQ ID NO: 113285

SEQ ID NO: 244831 - RNA, 64 nt, hsa; identical to SEQ ID NO: 113286

SEQ ID NO: 244832 - RNA, 64 nt, hsa; identical to SEQ ID NO: 113287

SEQ ID NO: 244833 - RNA, 64 nt, hsa; identical to SEQ ID NO: 113288

SEQ ID NO: 244834 - RNA, 64 nt, hsa; identical to SEQ ID NO: 113289

SEQ ID NO: 244835 - RNA, 64 nt, hsa; identical to SEQ ID NO: 113290

SEQ ID NO: 244836 - RNA, 64 nt, hsa; identical to SEQ ID NO: 113291

SEQ ID NO: 244837 - RNA, 64 nt, hsa; identical to SEQ ID NO: 113292

SEQ ID NO: 244838 - RNA, 64 nt, hsa; identical to SEQ ID NO: 113293

SEQ ID NO: 244839 - RNA, 64 nt, hsa; identical to SEQ ID NO: 113294

SEQ ID NO: 244840 - RNA, 64 nt, hsa; identical to SEQ ID NO: 113295

SEQ ID NO: 244841 - RNA, 64 nt, hsa; identical to SEQ ID NO: 113296

SEQ ID NO: 244842 - RNA, 64 nt, hsa; identical to SEQ ID NO: 113297

SEQ ID NO: 244843 - RNA, 64 nt, hsa; identical to SEQ ID NO: 113298

SEQ ID NO: 244844 - RNA, 64 nt, hsa; identical to SEQ ID NO: 113299

SEQ ID NO: 244845 - RNA, 64 nt, hsa; identical to SEQ ID NO: 113300

SEQ ID NO: 244846 - RNA, 64 nt, hsa; identical to SEQ ID NO: 113301

SEQ ID NO: 244847 - RNA, 64 nt, hsa; identical to SEQ ID NO: 113302

SEQ ID NO: 244848 - RNA, 64 nt, hsa; identical to SEQ ID NO: 113303

SEQ ID NO: 244849 - RNA, 64 nt, hsa; identical to SEQ ID NO: 113304

SEQ ID NO: 244850 - RNA, 64 nt, hsa; identical to SEQ ID NO: 113305

SEQ ID NO: 244851 - RNA, 64 nt, hsa; identical to SEQ ID NO: 113306

SEQ ID NO: 244852 - RNA, 64 nt, hsa; identical to SEQ ID NO: 113307

SEQ ID NO: 244853 - RNA, 64 nt, hsa; identical to SEQ ID NO: 113308

SEQ ID NO: 244854 - RNA, 64 nt, hsa; identical to SEQ ID NO: 113309

SEQ ID NO: 244855 - RNA, 64 nt, hsa; identical to SEQ ID NO: 113310

SEQ ID NO: 244856 - RNA, 64 nt, hsa; identical to SEQ ID NO: 113311

SEQ ID NO: 244857 - RNA, 64 nt, hsa; identical to SEQ ID NO: 113312

SEQ ID NO: 244858 - RNA, 64 nt, hsa; identical to SEQ ID NO: 113313

SEQ ID NO: 244859 - RNA, 64 nt, hsa; identical to SEQ ID NO: 113314

SEQ ID NO: 244860 - RNA, 64 nt, hsa; identical to SEQ ID NO: 113315

SEQ ID NO: 244861 - RNA, 64 nt, hsa; identical to SEQ ID NO: 113316

SEQ ID NO: 244862 - RNA, 64 nt, hsa; identical to SEQ ID NO: 113317

SEQ ID NO: 244863 - RNA, 64 nt, hsa; identical to SEQ ID NO: 113318

SEQ ID NO: 244864 - RNA, 64 nt, hsa; identical to SEQ ID NO: 113319

SEQ ID NO: 244865 - RNA, 64 nt, hsa; identical to SEQ ID NO: 113320

SEQ ID NO: 244866 - RNA, 64 nt, hsa; identical to SEQ ID NO: 113321

SEQ ID NO: 244867 - RNA, 64 nt, hsa; identical to SEQ ID NO: 113322

SEQ ID NO: 244868 - RNA, 64 nt, hsa; identical to SEQ ID NO: 113323

SEQ ID NO: 244869 - RNA, 64 nt, hsa; identical to SEQ ID NO: 113324

SEQ ID NO: 244870 - RNA, 64 nt, hsa; identical to SEQ ID NO: 89734

SEQ ID NO: 244871 - RNA, 64 nt, hsa; identical to SEQ ID NO: 89735

SEQ ID NO: 244872 - RNA, 64 nt, hsa
caauccgguaacauaagauugaaauuuuuuuacuuugucuuaauuuguuucuaauuuuuuuuuu

SEQ ID NO: 244873 - RNA, 64 nt, hsa
cagaugugaauacuucacaaagcuguaaagaccauugucuuaaauacuacaacaacuuaacacc

SEQ ID NO: 244874 - RNA, 64 nt, hsa
auacacucugauccccucagucugaaucuucucauugucuuauaggauucaagaaauggaagga

SEQ ID NO: 244875 - RNA, 64 nt, hsa
aauaugacacuuagagaaaaaggaagguuuauucuugucuuaugucuugaccuguuucugagug

SEQ ID NO: 244876 - RNA, 64 nt, hsa
aaauuagcaguauuugaaagcucaguuuaugucauugucuuaacuucagauacaaauaacugaa

SEQ ID NO: 244877 - RNA, 64 nt, hsa
aucagaggcagcuuaaagaugcuuucaguuaguuuugucuuacuuucagauuucucuacauaaa

SEQ ID NO: 244878 - RNA, 64 nt, hsa
gccaacccaacugacuucugcuagguagaggcauuugucuuagagagagagagagcgcgggaga

SEQ ID NO: 244879 - RNA, 64 nt, hsa
agguucucagcaaguguacaguauuuaccuuccuuugucuuacauuggcuuuuuaaauuuucca

SEQ ID NO: 244880 - RNA, 64 nt, hsa
uugaauuauagcaucuucaccuagaagaucucaauugucuuagucacagaguagguuuaucugg

SEQ ID NO: 244881 - RNA, 64 nt, hsa
cuuagcuugcuuccugucuccuugauaucuacacuugucuuagaucacaugcccugcuucagcu

SEQ ID NO: 244882 - RNA, 64 nt, hsa
ucauuugcacuuugacagagcagaggcagaguauuugucuuauauuucucagauuauaauauua

SEQ ID NO: 244883 - RNA, 64 nt, hsa
cuucuuugucagcaaugugauuucacuuauuuuauugucuuauuuuaaacccugucuccaugac

SEQ ID NO: 244884 - RNA, 64 nt, hsa
uagcuuaggucugagagucaaacaauguuaaggauugucuuaaaguuccuuagccagcaaaaca

SEQ ID NO: 244885 - RNA, 64 nt, hsa
caacaaaagucugugggcugccaguuuauuacuuuugucuuaaaacaugaucauuguucucuca

SEQ ID NO: 244886 - RNA, 64 nt, hsa
cacaacuaguggcugcccaauugcugcugaccaguugucuuagaaauggucaauuggauucaac

SEQ ID NO: 244887 - RNA, 64 nt, hsa
guuugugaccugaauuuacaggaaguguuucaacuugucuuaugcaucuuaucuggcauguccu

SEQ ID NO: 244888 - RNA, 64 nt, hsa
auauuucuguguaacuugaucuucugucuaguacuugucuuauagguaaccaacacugaaaacu

SEQ ID NO: 244889 - RNA, 64 nt, hsa
uuggguaguaccugcuaggacaauuucuuggcaauugucuuacuacuagggaucaguaagauuu

SEQ ID NO: 244890 - RNA, 64 nt, hsa
cauaacuauugaaugcuuucuauguggagagugcuugucuuaauuuucuguugcuauaauagaa

SEQ ID NO: 244891 - RNA, 64 nt, hsa
uucaaccaaagcacucuaaaauuuagaguauaaauugucuuauauuucaaauuagaaaaguuca

SEQ ID NO: 244892 - RNA, 64 nt, hsa
aagucuuguuuacuacuguuuaggguuugaaaacuugucuuagaaugcgaaucuguguuaagaa

SEQ ID NO: 244893 - RNA, 64 nt, hsa
uuccuuuuggaauauggcuguaagaagcagcauuuugucuuauuaacacauguauaaagguauc

SEQ ID NO: 244894 - RNA, 64 nt, hsa
gggaagaugcgguaaugaaaccgguuagucaauuuugucuuaauauuguugacaauucuguaaa

SEQ ID NO: 244895 - RNA, 64 nt, hsa
cagaaacugcugccuggcuuuuuuucuuccgagcuugucuuaucucaaaccccuuccagucaag

SEQ ID NO: 244896 - RNA, 64 nt, hsa
guuaaccauuucuuaguuucuguaaauucaugacuugucuuacugaacuacagccugguuugua

SEQ ID NO: 244897 - RNA, 64 nt, hsa
uuaccucuuaggggaaguuaugcccccucaacuauugucuuauuauaaugaaucuuuccuuuuu

SEQ ID NO: 244898 - RNA, 64 nt, hsa
cuaaguauaugugagaaaucagaauuggcauaauuugucuuaguugauauucaaggcuuuaaaa

SEQ ID NO: 244899 - RNA, 64 nt, hsa
accaugugugcuaauauacuuuuuuuguuauagauugucuuaaugguaggucaaguaauaaaaa

SEQ ID NO: 244900 - RNA, 64 nt, hsa
caaagcuagauuguaaauaggcauucaagaaguauugucuuaaauuuacgaugaauuucuugug

SEQ ID NO: 244901 - RNA, 64 nt, hsa
uguuguucugaaaaucaacaaccuuagaaggauuuugucuuagaaaauuuccuuggcuuuaguu

SEQ ID NO: 244902 - RNA, 64 nt, hsa
acagaagagcccuagcaauuguugggauguguaauugucuuauucacuguaggacaccagagag

SEQ ID NO: 244903 - RNA, 64 nt, hsa
uaguaugagaucggaaaauaguucuuaguccuguuugucuuaauuuuuauugguuuccaagguc

SEQ ID NO: 244904 - RNA, 64 nt, hsa
ggguuuugauagucauguuaucucaguaagugucuugucuuagaaauauguguguauaggcugg

SEQ ID NO: 244905 - RNA, 64 nt, hsa
aacaugagauuuuaacacaacaaugaaauuugccuugucuuauuccacuaguuuauuccuuuaa

SEQ ID NO: 244906 - RNA, 64 nt, hsa
cuuuuuguugguagggagaaaaaacgcuauugcuuugucuuacagagcgaaugucugccaacua

SEQ ID NO: 244907 - RNA, 64 nt, hsa
acaaaaauuagccgggugugguggcgcgcgccuguugucuuagcuacucaggaggcugaggcag

SEQ ID NO: 244908 - RNA, 64 nt, hsa
ggaacaaacuuguacauuuuauuucacuuguguuuugucuuaaacccuacugcuggaaacaauu

SEQ ID NO: 244909 - RNA, 64 nt, hsa
cagucguagagucucaccaucuccaaggauuggucuugagaacacuguucagugacggccaugc

SEQ ID NO: 244910 - RNA, 64 nt, hsa
gucgcucuuccugcggguucuuggcgagacacagcuugagaacagaagggcgucgggggaaccu

SEQ ID NO: 244911 - RNA, 64 nt, hsa
uucuggggagcuuugaccuuggagcuuuguacagcuugagaaaacauuagaacaaauuuuauua

SEQ ID NO: 244912 - RNA, 64 nt, hsa
cuuauaaaaacaauauauaagucucauaugcugucuugagaauccaagagaaucacaugcagcu

SEQ ID NO: 244913 - RNA, 64 nt, hsa
aauucacuugaugcucuuuuuauuuuacaagagacuugagaaaugucgguuguuccuaauggca

SEQ ID NO: 244914 - RNA, 64 nt, hsa
agagugagacccugucuccaaagagaaagagaaacuugagaaggcuugugcccaaagcuugaag

SEQ ID NO: 244915 - RNA, 64 nt, hsa
aaguucuaaaaaaaaguaaaaaauacauagaauacuugagaauuuagcagggacagggaaaaau

SEQ ID NO: 244916 - RNA, 64 nt, hsa
ccuguuccucuauuccaaguauaaguuucaccaccuugagaaauaauuuuuuuaaaaaaucuuc

SEQ ID NO: 244917 - RNA, 64 nt, hsa
aaucagcauuuuggaucuaggucuucauggaauccuugagaagagaggccuuuacaauuaccca

SEQ ID NO: 244918 - RNA, 64 nt, hsa
agagaaauaaucguaagagaacagugacggacaacuugagaaaagcagucaaguuccaaggaac

SEQ ID NO: 244919 - RNA, 64 nt, hsa
uaaaaccuaaaugacuuuugacauacaaacucuucuugagaauguuuguuguaaaugguuucaa

SEQ ID NO: 244920 - RNA, 64 nt, hsa
gcucuaucauauucugaaacaagaauuagaaugacuugagaacgggcaaauaacaaagcaaacc

SEQ ID NO: 244921 - RNA, 64 nt, hsa
gugguucugcuguuacguuugaagucugacaauccuugagaaucuuugcaugcagaggagguaa

SEQ ID NO: 244922 - RNA, 64 nt, hsa
auuaaaucccaaauccuauuuaaagaccugacagcuugagaaggucacuacugcauuuauagga

SEQ ID NO: 244923 - RNA, 64 nt, hsa
uuaguguauucaucaaaucuucagugccaguuuccuugagaagcagcuuucaugcuuauuccuu

SEQ ID NO: 244924 - RNA, 64 nt, hsa
aaacacauucauagagauuucuuggcgaaaauaucuugagaauagaauguaacgauauaacauu

SEQ ID NO: 244925 - RNA, 64 nt, hsa
gaagauauuuuaccaugaagagauugcacuuauccuugagaacagucuaaauauaaaugaagau

SEQ ID NO: 244926 - RNA, 64 nt, hsa
gaagauauuuuaccaugaagagauugcacuuauccuugagaacagucuaaugauacuuuuuuua

SEQ ID NO: 244927 - RNA, 64 nt, hsa
cuaggccccagcugaccgcaugggugugagccagcuugagaacacuaacuacucaauaaaagcg

SEQ ID NO: 244928 - RNA, 64 nt, hsa
gggagacuggcauugacgagaacucagguggaggcuugagaaggccgaaagggccccugaccug

SEQ ID NO: 244929 - RNA, 64 nt, hsa
aaaagcacugauaaacagaauacuuuuaaaacaccuugagaaaaaaagauaauacauacacaug

SEQ ID NO: 244930 - RNA, 64 nt, hsa
uggaagauuucaagaaaggacaacucacuguacacuugagaauaauaccuacagagguucauac

SEQ ID NO: 244931 - RNA, 64 nt, hsa
uuaagaaaaaguauugacuggagggguugaauuccuugagaauuuauuuuauagucuaaaucac

SEQ ID NO: 244932 - RNA, 64 nt, hsa
auuucccuucucaaaucugcucaacuccaagagucuugagaaacugcuaaaauuuugccucugu

SEQ ID NO: 244933 - RNA, 64 nt, hsa
uaacacugauguuuguguuaaauuugcagcagagcuugagaaaaguacauuguucuggaauuuc

SEQ ID NO: 244934 - RNA, 64 nt, hsa
uagaucuuaccaaucucagcauacuuuuauuucucuugagaaccuucacccuuucacuuaaagg

SEQ ID NO: 244935 - RNA, 64 nt, hsa
gauggagauaauuuauuuuuaccuucacugugaccuugagaagauucuucccauucuccauuug

SEQ ID NO: 244936 - RNA, 64 nt, hsa
gaggugguaucuucacguagaacauugguauucgcuugagaaaaaaagaauaguugaaccuauu

SEQ ID NO: 244937 - RNA, 64 nt, hsa
cuccucacacacagacucauauuacugguaggaacuugagaacuuuauuuccaaguuguucaaa

SEQ ID NO: 244938 - RNA, 64 nt, hsa
guaggcaucacugccucagcuguuaaggagaccugugucaaaacuuacauccacauuccuacac

SEQ ID NO: 244939 - RNA, 64 nt, hsa
gcugcgaagcauggaccccaguguuguugugggugugucaaauccccuuucauccucaagagcu

SEQ ID NO: 244940 - RNA, 64 nt, hsa
ggagagccuucagacugcaacgcuggccugauacgugucaaaggagagagggauagaggaggau

SEQ ID NO: 244941 - RNA, 64 nt, hsa
caugaugcuggugacucaaacgugccuacucauggugucaaauuggcauaauccucuugggaag

SEQ ID NO: 244942 - RNA, 64 nt, hsa
ggccugcucagaggaguaggagcugaaagauggugccuuccacccucuugggcugugugcccau

SEQ ID NO: 244943 - RNA, 64 nt, hsa
ccaugggcccagccccugcccugggaaccaggcagccuuccagaccucaggggcugaggcagac

SEQ ID NO: 244944 - RNA, 64 nt, hsa
ggcugccacuggggcaccgaacuaagccagcucagccuuccaagcugcuuagccuuugucaacc

SEQ ID NO: 244945 - RNA, 64 nt, hsa
ccuuucucccuccacaggaaacagauuuuucagggccuuccaugccugccacuuuguccgucuc

SEQ ID NO: 244946 - RNA, 64 nt, hsa
ggagaggcugugguggcugucucugucccucacugccuuccaggagcaauuugcacauguaaca

SEQ ID NO: 244947 - RNA, 64 nt, hsa
uguccccacuaaaacaaaacaaaaaacuuuuaaugccuuccacauuaauuagauuuucuugcag

SEQ ID NO: 244948 - RNA, 64 nt, hsa
cugggaacccuguggucugcacuacaugugaauggccuuccacuucagucuuaggcagauuuga

SEQ ID NO: 244949 - RNA, 64 nt, hsa
uuaccuauccuugaggucauccauauucuuacaggccuuccagucaauaauggaagagcucacu

SEQ ID NO: 244950 - RNA, 64 nt, hsa
ucuuacggagcuucuccucagaagugguaccaucgccuuccaaagucagcacucuacacucuug

SEQ ID NO: 244951 - RNA, 64 nt, hsa
gucacuuuacauccucagguauuguaaccacugggccuuccaacuuugcuggcaagcucuggua

SEQ ID NO: 244952 - RNA, 64 nt, hsa
ugcaauggcgugaucgcugcucaccgcaaccuccgccuuccagguucaagcgauucuccugacu

SEQ ID NO: 244953 - RNA, 64 nt, hsa
cugaguacaguggugcaaucucacugcaaccuccgccuuccaguugcaagugauucuccugccu

SEQ ID NO: 244954 - RNA, 64 nt, hsa
acacaagccauucuaaauacuuagccaguuuccagccuuccagaugaucuuugcccucuggguc

SEQ ID NO: 244955 - RNA, 64 nt, hsa
caaacucgugugcccaagcaauccaccugccucagccuuccaaaagugcugggauuacaggcgu

SEQ ID NO: 244956 - RNA, 64 nt, hsa
gugagccauaauaugaugggcagcagguggcgcugccuuccacccauggugauggaugguuugg

SEQ ID NO: 244957 - RNA, 64 nt, hsa
uaaacuggguaccucacugcacagcuucuagguagccuuccaacuuaaucuaacuugagccuca

SEQ ID NO: 244958 - RNA, 64 nt, hsa
ccccaccacgucugugcccugcacuguccccacagccuuccacacccugugcauaggcagcccu

SEQ ID NO: 244959 - RNA, 64 nt, hsa
cgaacuccugaccucaggugauccacccgccucggccuuccaaagugcugggauuacaggcgug

SEQ ID NO: 244960 - RNA, 64 nt, hsa
gauacaguuuugaguaaaaagacauuuuuuaaaagccuuccaguuuuguggauuaaaccuuuuu

SEQ ID NO: 244961 - RNA, 64 nt, hsa
gaauauguggcuaucaccuugagcacugacaguggccuuccaggcuaguugccuuccaaacgca

SEQ ID NO: 244962 - RNA, 64 nt, hsa
ccuugagcacugacaguggccuuccaggcuaguugccuuccaaacgcagguagccgaccugcag

SEQ ID NO: 244963 - RNA, 64 nt, hsa
ugaauugcagcccccuccaguuugcuuuccuuuggccuuccagaccccaggaaguuggccuucc

SEQ ID NO: 244964 - RNA, 64 nt, hsa
auugggccacgaggaacaaacagcagaugcccuugccuuccaguccaagaaacugcuucuugaa

SEQ ID NO: 244965 - RNA, 64 nt, hsa
gcaccucucacccacccagagauggagcugcucugccuuccagcggggcacccggagggcugcc

SEQ ID NO: 244966 - RNA, 64 nt, hsa
cacucuuguggcucuauccuccuccugcccuuccgccuuccacuccucccuugcacccauccug

SEQ ID NO: 244967 - RNA, 64 nt, hsa
cucuucccaucgucuuguguacacugcuccuguggccuuccacagcagaaaccagggcaaaagg

SEQ ID NO: 244968 - RNA, 64 nt, hsa
cuuauuccagggccuuuucccacuaaguaguauugccuuccauuaggcuccugagaguuauuuc

SEQ ID NO: 244969 - RNA, 62 nt, hsa
cccucuggcucaggaggguugggucccugggaggccggcagccaggccacagaauccacacg

SEQ ID NO: 244970 - RNA, 62 nt, hsa
auccacacguggaccauugugggucccugggaggccggcagccaggccacggaauccacacg

SEQ ID NO: 244971 - RNA, 64 nt, hsa
uuacuuucuuuggaguaaauucuggugugacuaaaauuuucaggguugauggguuaccuuaaaa

SEQ ID NO: 244972 - RNA, 64 nt, hsa
augcuuagauugcaguuuguuuugcauuugcuauaauuuucaaaauuauuuuugaagcaagaca

SEQ ID NO: 244973 - RNA, 64 nt, hsa
ucaaaaaagaaacaggaguaccuaucccuaucugaauuuucaaguuccccauuggaugaccaga

SEQ ID NO: 244974 - RNA, 64 nt, hsa
auagaauuccaaagaaucagaauaguuucaaaauaauuuucagugauaaaagaguguuguaauu

SEQ ID NO: 244975 - RNA, 64 nt, hsa
gagucuaauagucuuugccagucauucagcagcaaauuuucagcauuaagcuguuccuguucag

SEQ ID NO: 244976 - RNA, 64 nt, hsa
aagaacguuuuuuccucagugcauuugugcuagaaauuuucaagagucuaauagucuuugccag

SEQ ID NO: 244977 - RNA, 64 nt, hsa
uguguauauauauauauacauacacauauacauaaauuuucagcuauuucuguuccccugaacu

SEQ ID NO: 244978 - RNA, 64 nt, hsa
auguucuuuuuaugcaaauccccugugaaaauaaaauuuucaauguuuuuuuggucuuaacgcu

SEQ ID NO: 244979 - RNA, 64 nt, hsa
aaguacauuuauguuuuauucaguaagagaauagaauuuucauuuguuuuucuuuaaauccuuu

SEQ ID NO: 244980 - RNA, 64 nt, hsa
aaguaaggaugugagaauuugcauuuuaaugggaaauuuucaacccuuaaucugaaaacagaag

SEQ ID NO: 244981 - RNA, 64 nt, hsa
aacauuugcagccauuacagaguuacaguuguaaaauuuucagcuguuuuuuuuuuuuuuuuuu

SEQ ID NO: 244982 - RNA, 64 nt, hsa
aauucucaugcuuuuagguguacuuccuuuuuagaauuuucaguuuucugcuauuuuuaccgua

SEQ ID NO: 244983 - RNA, 64 nt, hsa
ucaagacaccaaauuccaaacuucuaaauguuggaauuuucaaaaauuguguuuagauuuuaug

SEQ ID NO: 244984 - RNA, 64 nt, hsa
cacggaucaauagacuguacuuauuuuccaauaaaauuuucaaacuuuguacuguuauccugag

SEQ ID NO: 244985 - RNA, 61 nt, hsa
acugccacaaaucagauuaauuugggauuuaaauuuucaccuguuaagguggaaaauggac

SEQ ID NO: 244986 - RNA, 64 nt, hsa
guuccaacaccugccuccacuucuccccucaagaaauuuucaacgccaggaaucaugaagagac

SEQ ID NO: 244987 - RNA, 64 nt, hsa
aaagguacauuuaaaauauguuaaauuggcuugaaauuuucagagaauuuugucuuccccuaau

SEQ ID NO: 244988 - RNA, 64 nt, hsa
ccuucaaauacauaguggauagcucaucccuaggaauuuucauuaaaauuuggaaacagaguaa

SEQ ID NO: 244989 - RNA, 64 nt, hsa
cugccuaaacaauauugaaguauccauagggcacaauuuucagacauuuuaguaucuguauaua

SEQ ID NO: 244990 - RNA, 64 nt, hsa
cuaaaaauaaauuuuaguuugcuaaaaauuuacaaauuuucauuuugcaguuccagagcugcuu

SEQ ID NO: 244991 - RNA, 64 nt, hsa
ucugacuagccacaaguauguuacccagauguagaauuuucaucacuaaacaguaaguucauua

SEQ ID NO: 244992 - RNA, 64 nt, hsa
gaaaaauaaaacgcaguucaaauuucaugguuuuaauuuucaacucagaagcacucaaaaaugc

SEQ ID NO: 244993 - RNA, 64 nt, hsa
aaagaaugauccaaaaauacuaaggaaaaagaacaauuuucaauuuucagaaaugaauuaucug

SEQ ID NO: 244994 - RNA, 64 nt, hsa
gauccaaaaauacuaaggaaaaagaacaauuuucaauuuucagaaaugaauuaucuguacauau

SEQ ID NO: 244995 - RNA, 64 nt, hsa
auuuccaucaguugacauagauauuauucacuaaaauuuucagcagacucaaaauagagaggag

SEQ ID NO: 244996 - RNA, 64 nt, hsa
auuccagaaauauuuguuuuuuuaagagaaaguaaauuuucacauuagauuucuauucaaagua

SEQ ID NO: 244997 - RNA, 64 nt, hsa
uuuuuacggaguuuacaguacagaaauaggcuuuaauuuucaagugaauuuuuugccaaacuua

SEQ ID NO: 244998 - RNA, 64 nt, hsa
uuuauuccaaaacuaguggguuuucucuacuggaaauuuucaauaaaccugucauuauugcuua

SEQ ID NO: 244999 - RNA, 64 nt, hsa
acucguuuaugcugucuagucaugcacuuaaagcaauuuucaaauguacucaaagucucuaggc

SEQ ID NO: 245000 - RNA, 64 nt, hsa
caguucauuucuaguucuugauagaacugcacuuaauuuucaguaguagucuugacuuuuuaag

SEQ ID NO: 245001 - RNA, 64 nt, hsa
aagguuccagaggugacauucgaaucagcaaugaaauuuucauaguuaaauuugguauucgugg

SEQ ID NO: 245002 - RNA, 64 nt, hsa
auauaccugccuaaguuguacaauuucagaaugcaauuuucauuauaaugaguuccagugacuc

SEQ ID NO: 245003 - RNA, 64 nt, hsa
gucgcuuuuauucggauugacgaaaaucaaccauaauuuucaagggaucuucauggguugugac

SEQ ID NO: 245004 - RNA, 64 nt, hsa
gaaguuuucauuuuuucuaaauccuccccuacaaaauuuucagauuggaaauuacucuuguauu

SEQ ID NO: 245005 - RNA, 64 nt, hsa
aaaugcauaagcaagacugagcagcauuauaauuaauuuucaggguuuugaggcugaacauaau

SEQ ID NO: 245006 - RNA, 64 nt, hsa
uauuuuuaaaauuuaaaguauaauuaguuuuuauaauuuucaucagauuuuuguuauauuuuuu

SEQ ID NO: 245007 - RNA, 64 nt, hsa
aaaaaaaaaaaaaaauccuugaacuaaugacucaaauuuucaaaugaaacaaaauaagcagugg

SEQ ID NO: 245008 - RNA, 64 nt, hsa
aggcgugagccaccacucccggcugucaucaucaaauuuucaagugaagauagucuguugaaga

SEQ ID NO: 245009 - RNA, 64 nt, hsa
aauaaguuuuuaggagguuuguaaaagaagaaucaauuuucagcagaaaacaugucaacuuuaa

SEQ ID NO: 245010 - RNA, 64 nt, hsa
uccuuauuuaaacauaagugcugugacuuaggugaauuuucaauuuaagguagaaaauaaguuu

SEQ ID NO: 245011 - RNA, 64 nt, hsa
auaugaaugugacaugcaccaauuguccuauuauaauuuucagauaaguguaacuaagcacuug

SEQ ID NO: 245012 - RNA, 64 nt, hsa
uagaauagucuauuccuugugaaaauauaaauuuaauuuucaggaauccaguauauuccaaaca

SEQ ID NO: 245013 - RNA, 64 nt, hsa
uuuuuaaaaaauaaugcauguuucuuuaauaauuaauuuucaucuucuauaagaugccauguga

SEQ ID NO: 245014 - RNA, 64 nt, hsa
uuugcauagaaaaucaaauucagggaccacaaagaauuuucagugggaaugucuagucugaggg

SEQ ID NO: 245015 - RNA, 64 nt, hsa
uuccuagaauccccuucuccaaacgauuagucuaaauuuucagagagaaauagauaaaacacgc

SEQ ID NO: 245016 - RNA, 64 nt, hsa
aaaacccauaaaggagugauuuagaacagucauuaauuuucaacucaaugaaauaugugaagcc

SEQ ID NO: 245017 - RNA, 64 nt, hsa
cacuuugccaaaaccuauuuaaaacagugaauuaaauuuucacuagguuugaaugaucauguuu

SEQ ID NO: 245018 - RNA, 64 nt, hsa
uauaugauuaucagguuguuagaugauaacucaaaauuuucaguaggcaaauagguaaugugga

SEQ ID NO: 245019 - RNA, 64 nt, hsa
gcgaugucagacacucuugaguugucaaaacguuaauuuucaguuuuaaauaaucaguuuaucu

SEQ ID NO: 245020 - RNA, 64 nt, hsa
agcuguugucaaacaaucagucaugagcuuuguuaauuuucaauguuuucccagccuauaaaaa

SEQ ID NO: 245021 - RNA, 64 nt, hsa
ucuugcuuuguccuuucuauacugccauucuaaaaauuuucagcuguuggcuguuuuuuuuguu

SEQ ID NO: 245022 - RNA, 64 nt, hsa
uaccagaccauuuuaaucaacuuuauugagauucaauuuucauauaguaaaacgccuauuuaag

SEQ ID NO: 245023 - RNA, 64 nt, hsa
cuucagggcaccaguguuaaaauuuuggagucuuaauuuucauguguacaccucuuugccuguu

SEQ ID NO: 245024 - RNA, 64 nt, hsa
caaaucccauuuucaaauuacuuuuagaucuuaaaauuuucauuuuugucuaauaacaguggcu

SEQ ID NO: 245025 - RNA, 64 nt, hsa
aacaguauaaaaauuucugcuuuuguauaauacaaauuuucauuaagccaguauaaaauagaaa

SEQ ID NO: 245026 - RNA, 64 nt, hsa
uuuaugaaaagaaacuuuguaaaaguaugauguaaauuuucagugcaauguaaacaaaauaaaa

SEQ ID NO: 245027 - RNA, 64 nt, hsa
gagucuucaaauuuagcauuauuuugacacuuuuaauuuucauuuaacaauggauuagaaaaau

SEQ ID NO: 245028 - RNA, 64 nt, hsa
uuugguuuuuguuccucagagagaguuugaaagaaauuuucagauguucuguucccuauagagg

SEQ ID NO: 245029 - RNA, 64 nt, hsa
uccaaauucucaucacauguauuauuugauacuaaauuuucaauuauuacuucaaaauaagagu

SEQ ID NO: 245030 - RNA, 64 nt, hsa
acauaagugcuuuuacaagcaccaaaguugaaugaauuuucaacaaaauguaauuaaagucuau

SEQ ID NO: 245031 - RNA, 64 nt, hsa
auuuugucguuaagcauacuuucaguuuacucagaauuuucaauuugcuauaaagauguaucaa

SEQ ID NO: 245032 - RNA, 64 nt, hsa
gaaauguuaaaauuuuuuucacaauaauuuuuucaauuuucacuauuacuguuguaauuauuga

SEQ ID NO: 245033 - RNA, 64 nt, hsa
ucuaauuuaugguaaauuucagauguuuauuuaaaauuuucacuuuuaaacaguaaccaaaucu

SEQ ID NO: 245034 - RNA, 64 nt, hsa
aauccuucaaaaauaaguuaaaauguuuuuguaaaauuuucaaaugucagucaaguuuugcauu

SEQ ID NO: 245035 - RNA, 64 nt, hsa
gagguacaccuuaugaaucgcaucaauagagggaaauuuucagcuacaaucuuugcucucucug

SEQ ID NO: 245036 - RNA, 64 nt, hsa
aaacugaauuuucuuuuaagcuaacaaagaucauaauuuucaaugauuagccguguaacuccug

SEQ ID NO: 245037 - RNA, 64 nt, hsa
acacacauugaaagcuucugaucaacgguccugaaauuuucaucuugaaugucuuuguauuaaa

SEQ ID NO: 245038 - RNA, 64 nt, hsa
ucuguaauaccaagaagagggagcugaaaaggaaaauuuucagauuaauaaagaagacgccaau

SEQ ID NO: 245039 - RNA, 64 nt, hsa
cacauguaaucaugucugcugcuguugcuacccaaauuuucauuucuccacauuuuggguacuu

SEQ ID NO: 245040 - RNA, 64 nt, hsa
cuccaugucaaaaaaaaaagaaugugggaacucaaauuuucauuuuuaauguaauccccaagau

SEQ ID NO: 245041 - RNA, 64 nt, hsa
cucauuaauuuagguggcuaggaauuaaugaaaaaauuuucaaguuaaaauacagguuauaaca

SEQ ID NO: 245042 - RNA, 64 nt, hsa
agguaugguuaaguagugagaaaaaucacuuauuaauuuucaagaacuuugagacuaauuugua

SEQ ID NO: 245043 - RNA, 64 nt, hsa
cuuguuauugauaggaucauguuguuaaauuguaaauuuucaaaauuaauugauguuuuaaaaa

SEQ ID NO: 245044 - RNA, 64 nt, hsa
guucuugucuuguuaccauuuaaaauugacauuuaauuuucaaaucacuguuggugccuaauca

SEQ ID NO: 245045 - RNA, 64 nt, hsa
aucugaauguuuuuauguugacuguucuugacuaaauuuucaagaguuucagaagcaacaggac

SEQ ID NO: 245046 - RNA, 64 nt, hsa
uaagaauaguagauguggccuuugaauucuguuuaauuuucacuuuuggcaaugacucaaaguc

SEQ ID NO: 245047 - RNA, 64 nt, hsa
gucuguaauaauagacuguaacuuccaaauaaauaauuuucauuuugcacugaggauauucaga

SEQ ID NO: 245048 - RNA, 64 nt, hsa
ucccuguggcggcaucaggaguggcuguacauugaauuuucaagugcugguuggcugucgccag

SEQ ID NO: 245049 - RNA, 64 nt, hsa
ucuucuaagcugagggcacuugagcaacugacuuaauuuucaagcacuugauuaacacaacacu

SEQ ID NO: 245050 - RNA, 64 nt, hsa
aaaauggaaaagcaauguguuuuuccacuggauuaauuuucaccggaacaauugcgaauucucu

SEQ ID NO: 245051 - RNA, 64 nt, hsa
caguuuaaugcaaguaagucagguuucacaagaaaauuuucaaguuuugaagggaauuugaggu

SEQ ID NO: 245052 - RNA, 64 nt, hsa
gauuuguuuaggaauuauuugauuuuauaaugguaauuuucaugaugauaauguuuuugguuau

SEQ ID NO: 245053 - RNA, 64 nt, hsa
aacauuuuugcuuauucauugaauauuuuucuguaauuuucagcacuuauguauacacuuuuuc

SEQ ID NO: 245054 - RNA, 64 nt, hsa
cugggacuauaggcacgugccaccacacccggcuaauuuucauauuuuuaguagagaugggguu

SEQ ID NO: 245055 - RNA, 64 nt, hsa
guuuuguccuguaggacauggagaacuucugaagaauuuucaaggcgggugggauaagauuaua

SEQ ID NO: 245056 - RNA, 64 nt, hsa
gucuuucauguguggaguuacucuucucaugcccaauuuucauuugaguuuaguggcuuaacca

SEQ ID NO: 245057 - RNA, 64 nt, hsa
agugaacacucagguuggcaagaaaacauacuugaauuuucauucaucuucucagcagcugaag

SEQ ID NO: 245058 - RNA, 64 nt, hsa
aaaaagucuguguuuuuguguuuuuuuaaauaaaaauuuucaaaaaguuaaaaaaaaagacaua

SEQ ID NO: 245059 - RNA, 64 nt, hsa
caccuguaaacuguaucacuuugacugauauuguaauuuucaaauguauaauauguuuacagau

SEQ ID NO: 245060 - RNA, 64 nt, hsa
guagacaacugcuuaaugguugggguuuuuucacaauuuucaacauuagugauuuuuuuuucug

SEQ ID NO: 245061 - RNA, 64 nt, hsa
cucugcguuugauauucaaacaucauaugccggaaauuuucacaguuuuuagugaacuuaagga

SEQ ID NO: 245062 - RNA, 64 nt, hsa
uaaaaauugagguauaauuuucacaaaauucuccaauuuucagugucaaauucagugaauuuug

SEQ ID NO: 245063 - RNA, 64 nt, hsa
uuauuauguauugacuuuuuaaaaauugagguauaauuuucacaaaauucuccaauuuucagug

SEQ ID NO: 245064 - RNA, 64 nt, hsa
uaccugaaacuuguuuaacauguauuagaccuagaauuuucauuuucuuucucacauaguugcu

SEQ ID NO: 245065 - RNA, 64 nt, hsa
cuuuuuaacuuuauacucaguugcauuaucauaaaauuuucauauaugccuagauaauggggaa

SEQ ID NO: 245066 - RNA, 64 nt, hsa
uacaaaugugaaaaauguggcaaagcuuuuaaccaauuuucaaaccuuacuaaacauaagauaa

SEQ ID NO: 245067 - RNA, 64 nt, hsa
gcugucuugcaaauguaauaaauuugggaaaacaaauuuucaaaaacuacagcuuagaaaacac

SEQ ID NO: 245068 - RNA, 64 nt, hsa
aacaagcugcauaucagcugaugaaugcaugagaaauuuucaaggcuuucacaguggucuuaag

SEQ ID NO: 245069 - RNA, 64 nt, hsa
caauaaauauuuauucaguguuaaugucguccagaauuuucaucagaaauggauagcuuuaaca

SEQ ID NO: 245070 - RNA, 64 nt, hsa
aaaugacauggaaagcaaaacuuucuuuuuuaaaaauuuucauuuauuuaauggaaacuugccc

SEQ ID NO: 245071 - RNA, 64 nt, hsa
auguuucuauauuauuuagaauauuuguuguugcaauuuucacauaagaaaauuuaacaguugu

SEQ ID NO: 245072 - RNA, 64 nt, hsa
uaauagucacaguuuuccagggagggaaugauauaauuuucaugacaaugucaugugaugauag

SEQ ID NO: 245073 - RNA, 64 nt, hsa
agaauaaugggaagugacucuagucuuuguaagcaauuuucauucucauuaggaaguuaaaugu

SEQ ID NO: 245074 - RNA, 64 nt, hsa
acuguacguucuacacucuguccuacucccacagaauuuucaagcccuuaagaguuuaguuaaa

SEQ ID NO: 245075 - RNA, 64 nt, hsa
gguuuacuauguuuaaauaaguuaauacuuuaaaaauuuucagguuuuuuuaguauggugaaua

SEQ ID NO: 245076 - RNA, 64 nt, hsa
acagaaaucucucacccaguucagguguauagggaauuuucauuuucauuauuucaaggaauag

SEQ ID NO: 245077 - RNA, 64 nt, hsa
caaaacguauuuaucuggccauugcacuucggauaauuuucauuuuuaauuccucuugguguca

SEQ ID NO: 245078 - RNA, 64 nt, hsa
gaaacuuaacauuaugagccuuuucugcucaaaaaauuuucaaagauuaaaacuauuauacaua

SEQ ID NO: 245079 - RNA, 64 nt, hsa
cuaggauuacaggugccugccaccacacccggcuaauuuucauauuuuucaguagagacggggu

SEQ ID NO: 245080 - RNA, 64 nt, hsa
aauuuuuuauuuuuugguauuggccauaagcaacaauuuucagauuugcacaaaaagauaccuu

SEQ ID NO: 245081 - RNA, 64 nt, hsa
ugccucugauguauuuugugaguuuguuucuuugaauuuucauuuuacaguuacuuuuccuugc

SEQ ID NO: 245082 - RNA, 64 nt, hsa
uuuguguaucccacagauucaaucuucaggugagaauuuucauugucaaaacccacugguuaga

SEQ ID NO: 245083 - RNA, 64 nt, hsa
uaaaaauguguuuuguugaguuuccaaauggaugaauuuucauuuggacauuacaucacuaaau

SEQ ID NO: 245084 - RNA, 64 nt, hsa
uguuuucauuuaaaguuuuauccaauauucuaggaauuuucagcaauacugauauucacuuuau

SEQ ID NO: 245085 - RNA, 64 nt, hsa
ucauguuauuuaaaguuuuauccaguauucuaggaauuuucagcaauacuaauauucucauuuu

SEQ ID NO: 245086 - RNA, 64 nt, hsa
aucccaguaccuaguuauaucuaaccuaucaaaggcaagauaucauuuauuggacuucuugaaa

SEQ ID NO: 245087 - RNA, 64 nt, hsa
uaaauuuggggauccuagagugaucuuaaauauggcaagauacagcucauuuagaauaaaaucu

SEQ ID NO: 245088 - RNA, 64 nt, hsa
uuagcaaauuggaaauaauauauucauuuguauggcaagauaaaugcagucaucuuaauacuag

SEQ ID NO: 245089 - RNA, 64 nt, hsa
uagauuugagcauuugaagauucaaaguugcgaaagagcacaaaccauauuagguaaaauauug

SEQ ID NO: 245090 - RNA, 64 nt, hsa
aaacaauguuuucuuucugguagcgcauaauaacagagcacaagcaucuuuuagauuugagcau

SEQ ID NO: 245091 - RNA, 64 nt, hsa
aacaauugaaggaguggcaaacuuacuuguauugagagcacacgcaauuccuacuggugaaauu

SEQ ID NO: 245092 - RNA, 56 nt, hsa; identical to SEQ ID NO: 238493

SEQ ID NO: 245093 - RNA, 64 nt, hsa
gccuggauuuccgcaccugccugucuccucucccagagcacaguauuugggagacuuugacuau

SEQ ID NO: 245094 - RNA, 64 nt, hsa
aagugcccucuccuugaccuugagaugaaggucaagagcacagggaccaggccuugguuaggcu

SEQ ID NO: 245095 - RNA, 64 nt, hsa
ccgugcacaacuuugacaucuggucuugcuccauagagcacaacucaagauagaccaugagaca

SEQ ID NO: 245096 - RNA, 64 nt, hsa
gccauggugccgccuuccugaauuggcaguggucagagcacaccugaacccuauccugggcugg

SEQ ID NO: 245097 - RNA, 64 nt, hsa
ucauagggggguguccccccagagacaaagcugcagagcacauuccaugccagacgcucuggcc

SEQ ID NO: 245098 - RNA, 64 nt, hsa
ugcccacacacggcgcaggcugcccgccuccuggagagcacacuucagcugaaacaguaaagcc

SEQ ID NO: 245099 - RNA, 64 nt, hsa
uucucagagcagggcgauugggacaucaccagccagagcacaggaagccacccugccugcuggg

SEQ ID NO: 245100 - RNA, 64 nt, hsa
auugacaacuguuccugcuucuacuaaaaaaaaaagagcacaaaagaaaaacuaaauuauugaa

SEQ ID NO: 245101 - RNA, 64 nt, hsa
ugacaauuuuuuguauuugcuuuuucucccuuuaagagcacauucuucuguaaggagaaaggca

SEQ ID NO: 245102 - RNA, 64 nt, hsa
cauguggucuucugaaaauggaacaccauucuucagagcacacgucuagcccucagcaagacag

SEQ ID NO: 245103 - RNA, 64 nt, hsa; identical to SEQ ID NO: 227857

SEQ ID NO: 245104 - RNA, 64 nt, hsa; identical to SEQ ID NO: 227858

SEQ ID NO: 245105 - RNA, 57 nt, hsa; identical to SEQ ID NO: 227859

SEQ ID NO: 245106 - RNA, 64 nt, hsa; identical to SEQ ID NO: 227860

SEQ ID NO: 245107 - RNA, 64 nt, hsa; identical to SEQ ID NO: 227861

SEQ ID NO: 245108 - RNA, 64 nt, hsa; identical to SEQ ID NO: 227862

SEQ ID NO: 245109 - RNA, 64 nt, hsa; identical to SEQ ID NO: 227863

SEQ ID NO: 245110 - RNA, 64 nt, hsa; identical to SEQ ID NO: 227864

SEQ ID NO: 245111 - RNA, 64 nt, hsa; identical to SEQ ID NO: 227865

SEQ ID NO: 245112 - RNA, 64 nt, hsa; identical to SEQ ID NO: 227866

SEQ ID NO: 245113 - RNA, 64 nt, hsa; identical to SEQ ID NO: 227867

SEQ ID NO: 245114 - RNA, 64 nt, hsa; identical to SEQ ID NO: 227868

SEQ ID NO: 245115 - RNA, 64 nt, hsa; identical to SEQ ID NO: 227869

SEQ ID NO: 245116 - RNA, 64 nt, hsa; identical to SEQ ID NO: 227870

SEQ ID NO: 245117 - RNA, 64 nt, hsa; identical to SEQ ID NO: 227871

SEQ ID NO: 245118 - RNA, 64 nt, hsa
uauuacucacaugggugcaaucuuuagccccagggaggucaauaaugucuuuuaaagccagaag

SEQ ID NO: 245119 - RNA, 64 nt, hsa
cccagcuacuugggaggcugaggugggagccugggaggucaaggcugcagugagccaugaucau

SEQ ID NO: 245120 - RNA, 64 nt, hsa
gccgcuggaagauuguauuccagaugcuagcuuagaggucaaguacagucuccucaugagacau

SEQ ID NO: 245121 - RNA, 64 nt, hsa
aaaugcccguauuaggaggauuacuugagcccaggaggucaaagcugaggugagccaugauuac

SEQ ID NO: 245122 - RNA, 64 nt, hsa
cagcagaauaacaaaaacuuugcucaggacauuugaggucaaauugaagacggaaaccggaaac

SEQ ID NO: 245123 - RNA, 64 nt, hsa
uucuugagcacugauauaaauuacggucuucuuugaggucaaaauucagccaucaugguaggca

SEQ ID NO: 245124 - RNA, 64 nt, hsa
caagggaccugaagugaagcuccccaaggcuccugaggucaagcuuccaaaagugcccgaggca

SEQ ID NO: 245125 - RNA, 64 nt, hsa
gaugcccucccuuggcaucggagugucagggcccgaggucaaggugcccaagggaccugaagug

SEQ ID NO: 245126 - RNA, 64 nt, hsa; identical to SEQ ID NO: 239110

SEQ ID NO: 245127 - RNA, 64 nt, hsa; identical to SEQ ID NO: 239111

SEQ ID NO: 245128 - RNA, 64 nt, hsa; identical to SEQ ID NO: 239112

SEQ ID NO: 245129 - RNA, 64 nt, hsa; identical to SEQ ID NO: 239113

SEQ ID NO: 245130 - RNA, 64 nt, hsa; identical to SEQ ID NO: 239114

SEQ ID NO: 245131 - RNA, 64 nt, hsa; identical to SEQ ID NO: 239115

SEQ ID NO: 245132 - RNA, 64 nt, hsa; identical to SEQ ID NO: 239116

SEQ ID NO: 245133 - RNA, 64 nt, hsa; identical to SEQ ID NO: 239117

SEQ ID NO: 245134 - RNA, 64 nt, hsa; identical to SEQ ID NO: 239118

SEQ ID NO: 245135 - RNA, 64 nt, hsa; identical to SEQ ID NO: 239119

SEQ ID NO: 245136 - RNA, 54 nt, hsa; identical to SEQ ID NO: 239120

SEQ ID NO: 245137 - RNA, 64 nt, hsa; identical to SEQ ID NO: 239121

SEQ ID NO: 245138 - RNA, 64 nt, hsa; identical to SEQ ID NO: 239122

SEQ ID NO: 245139 - RNA, 64 nt, hsa; identical to SEQ ID NO: 239123

SEQ ID NO: 245140 - RNA, 64 nt, hsa; identical to SEQ ID NO: 239124

SEQ ID NO: 245141 - RNA, 64 nt, hsa; identical to SEQ ID NO: 239125

SEQ ID NO: 245142 - RNA, 64 nt, hsa; identical to SEQ ID NO: 239126

SEQ ID NO: 245143 - RNA, 64 nt, hsa; identical to SEQ ID NO: 239127

SEQ ID NO: 245144 - RNA, 64 nt, hsa; identical to SEQ ID NO: 239128

SEQ ID NO: 245145 - RNA, 64 nt, hsa; identical to SEQ ID NO: 239129

SEQ ID NO: 245146 - RNA, 64 nt, hsa; identical to SEQ ID NO: 239130

SEQ ID NO: 245147 - RNA, 64 nt, hsa; identical to SEQ ID NO: 239131

SEQ ID NO: 245148 - RNA, 64 nt, hsa; identical to SEQ ID NO: 239132

SEQ ID NO: 245149 - RNA, 64 nt, hsa; identical to SEQ ID NO: 239133

SEQ ID NO: 245150 - RNA, 64 nt, hsa; identical to SEQ ID NO: 239134

SEQ ID NO: 245151 - RNA, 64 nt, hsa; identical to SEQ ID NO: 239135

SEQ ID NO: 245152 - RNA, 64 nt, hsa; identical to SEQ ID NO: 239136

SEQ ID NO: 245153 - RNA, 64 nt, hsa; identical to SEQ ID NO: 239137

SEQ ID NO: 245154 - RNA, 64 nt, hsa; identical to SEQ ID NO: 239138

SEQ ID NO: 245155 - RNA, 64 nt, hsa; identical to SEQ ID NO: 239139

SEQ ID NO: 245156 - RNA, 64 nt, hsa; identical to SEQ ID NO: 239140

SEQ ID NO: 245157 - RNA, 64 nt, hsa; identical to SEQ ID NO: 239141

SEQ ID NO: 245158 - RNA, 64 nt, hsa; identical to SEQ ID NO: 239142

SEQ ID NO: 245159 - RNA, 64 nt, hsa; identical to SEQ ID NO: 239143

SEQ ID NO: 245160 - RNA, 64 nt, hsa; identical to SEQ ID NO: 239144

SEQ ID NO: 245161 - RNA, 64 nt, hsa; identical to SEQ ID NO: 239145

SEQ ID NO: 245162 - RNA, 64 nt, hsa; identical to SEQ ID NO: 239146

SEQ ID NO: 245163 - RNA, 64 nt, hsa; identical to SEQ ID NO: 239147

SEQ ID NO: 245164 - RNA, 64 nt, hsa; identical to SEQ ID NO: 239148

SEQ ID NO: 245165 - RNA, 64 nt, hsa; identical to SEQ ID NO: 239149

SEQ ID NO: 245166 - RNA, 64 nt, hsa; identical to SEQ ID NO: 239150

SEQ ID NO: 245167 - RNA, 64 nt, hsa; identical to SEQ ID NO: 239151

SEQ ID NO: 245168 - RNA, 64 nt, hsa
gucuuugacuaggaaccggacucuuaauuuccucaggacagacuagcuggcacauuaucccuac

SEQ ID NO: 245169 - RNA, 64 nt, hsa
uuuacuauuuaugauguauuuaaguguuuuauuaaggacagaguucuguuaggggugggaggga

SEQ ID NO: 245170 - RNA, 64 nt, hsa
agaaccuauaggaaacuacuuggagcaaacucaaaggacagauuagggaucgagauugggucag

SEQ ID NO: 245171 - RNA, 64 nt, hsa
gccuauaucgcaaauuuucuaagccacguccuauaggacagaggagacuggccccacuucuaug

SEQ ID NO: 245172 - RNA, 64 nt, hsa
uaaaagugucuguagguacguuuuauauuauauaaggacagaccaaaaaucaaccuaucaaagc

SEQ ID NO: 245173 - RNA, 55 nt, hsa
cauuacagcuaauuucuugagauagaggacagagaagaugacucguucccauaga

SEQ ID NO: 245174 - RNA, 64 nt, hsa
aaaaggacggaguggggggacagagacucagaugaggacagagugguuuccaauguguucaaua

SEQ ID NO: 245175 - RNA, 64 nt, hsa
aggagcagaaaugcaaggggcugcaugaccuaccaggacagaacuuuccccaauuacaggguga

SEQ ID NO: 245176 - RNA, 64 nt, hsa
gauuuacuauaggugaagauagcccucauauucaaggacagaagcucuggcaggaguaaauuag

SEQ ID NO: 245177 - RNA, 64 nt, hsa
agcaugcuugugcagaaagaagccauagccagaaaggacagaaucucucccccacucccuugcc

SEQ ID NO: 245178 - RNA, 64 nt, hsa
ugccccaggcucucgcugcccuguggacaggaugaggacagagggcacaugaacagcuugccag

SEQ ID NO: 245179 - RNA, 64 nt, hsa
ucauuuggagcucuugggucagagaaaaugagaaaggacagagccagcggcuccaacuccuuuc

SEQ ID NO: 245180 - RNA, 64 nt, hsa
agaauugcuacucgaaggugccagaaugacacaaaggacagaauuccuuucccaguuguuaccc

SEQ ID NO: 245181 - RNA, 64 nt, hsa
aagaugaagugacuuccucaaaaucacaugguucaggacagaaacaagauuaaaaccuggaucc

SEQ ID NO: 245182 - RNA, 64 nt, hsa
ugucugacgcggccaccucuuucuggaggggcugaggacagaugugccugcuuguggagaccag

SEQ ID NO: 245183 - RNA, 64 nt, hsa
cagugacucagaaugaacuggcuucggacagaacaggacagauggaugucgcacacgccgagac

SEQ ID NO: 245184 - RNA, 64 nt, hsa
guguauugagcuuauuguugaaagggauuuuugaaggacagaacaauuacuccaugaugaaucu

SEQ ID NO: 245185 - RNA, 64 nt, hsa
uagagacgagcaguggaggaaacagccucccaaaaggacagagaacuaaaaaauugcugcugga

SEQ ID NO: 245186 - RNA, 64 nt, hsa
augguauguuccgugauauuaacaacucuaacccaggacagaccacaagccacacucagaggcc

SEQ ID NO: 245187 - RNA, 64 nt, hsa
cugccugggcgcugcguguagcaucuuggccuacaggacagauuuuaggugacaccugguuaug

SEQ ID NO: 245188 - RNA, 64 nt, hsa
aaggagugaguuaggacagaugcagcaagauauuaggacagauuucgcccauuauucaggcugc

SEQ ID NO: 245189 - RNA, 62 nt, hsa
ccucugcugaggcccuguaaaaggagugaguuaggacagaugcagcaagauauuaggacaga

SEQ ID NO: 245190 - RNA, 64 nt, hsa
ggugggaagagaggacaucuguccagucucaaucaggacagaccaccgugcgacacccaggagg

SEQ ID NO: 245191 - RNA, 64 nt, hsa
guucaccuuaaguaacacacaaaucgggaacaggaggacagaaccguuggcauuaucaggauuc

SEQ ID NO: 245192 - RNA, 64 nt, hsa
uugcugcuuccucggcccagggagaaagcaugucaggacagagcuguuggauuggcuuugauag

SEQ ID NO: 245193 - RNA, 64 nt, hsa
cucuuagcaucuccucuaguauuuuccauguaucaggacagaggugucuuauguagggaggggg

SEQ ID NO: 245194 - RNA, 64 nt, hsa
ucaguuauuauuucuucauuuuuuuuucuaccagaggacagauuaauagauuuaacccuucaca

SEQ ID NO: 245195 - RNA, 64 nt, hsa
ugucugggaaaaagugcacgugaagaaacaaagaaggacagaggccauuccgaaaucaagaaac

SEQ ID NO: 245196 - RNA, 64 nt, hsa
gagaacagaaggccgaauccaaguuucaugugguaggacagagaacggcaaucuacaaaacuac

SEQ ID NO: 245197 - RNA, 64 nt, hsa
cuuuagugaaggcugaauccaaguuucauguaguaggacagagaacagaaggccgaauccaagu

SEQ ID NO: 245198 - RNA, 64 nt, hsa
ggagguggcccuaucccuaggcaguggugcuaggaggacagaaggcuauaugggcguggcagag

SEQ ID NO: 245199 - RNA, 64 nt, hsa
ccccgccuugugagccaggaagcagcgucucaucaggacagaagguaggaugaagacauggggu

SEQ ID NO: 245200 - RNA, 64 nt, hsa
aaaacuuggguaacacuuccaaauaugggaggaaaggacagauguguuuacaagggaggauuuu

SEQ ID NO: 245201 - RNA, 64 nt, hsa
ucuacauuuaucaauaaaauguaaauuaucugaaaggacagaauauaagauuuaaccauguuug

SEQ ID NO: 245202 - RNA, 64 nt, hsa
uguuaggcucacaguuacaguuuauuacaguaaaaggacagagauuaagaucagcaaagggagg

SEQ ID NO: 245203 - RNA, 64 nt, hsa
caaagcuugagcugcucugcaagagaaaauaagcaggacagaggauuugcucuggacagagaug

SEQ ID NO: 245204 - RNA, 64 nt, hsa
aucugaacuugguuuucccgucagaagaaucagcaggacagaucguagugccuuauuccauugu

SEQ ID NO: 245205 - RNA, 64 nt, hsa
ccaccaccagggcacucacucgcagcuauagcccaggacagaaaaacugugcuuuggacaggug

SEQ ID NO: 245206 - RNA, 64 nt, hsa
cuagggaacgaggcagccuauuggagaugcggacaggacagacacguugagaagcugcagggag

SEQ ID NO: 245207 - RNA, 64 nt, hsa
gaagggaugggguauccccauggaugcugggaugaggacagaggaagaccugauggggucuccu

SEQ ID NO: 245208 - RNA, 64 nt, hsa
ccugcacacaaacuggggcuauagagauucuccaaggacagauggcaguggagcuagaccugag

SEQ ID NO: 245209 - RNA, 64 nt, hsa
ccuugcucacaaaguuacaggguaggcaccugucaggacagaacagcagcagcgcuacagccca

SEQ ID NO: 245210 - RNA, 64 nt, hsa
gaauuauuuauucaugggagauaauuuauuuuaaaggacagaauuaccaagcguuacaaaauca

SEQ ID NO: 245211 - RNA, 64 nt, hsa
gcacaggaaagagaaaaagaaaucuguugaagaaaggacagaagaggaaaugcuuugggaugag

SEQ ID NO: 245212 - RNA, 64 nt, hsa; identical to SEQ ID NO: 92348

SEQ ID NO: 245213 - RNA, 64 nt, hsa; identical to SEQ ID NO: 92349

SEQ ID NO: 245214 - RNA, 64 nt, hsa; identical to SEQ ID NO: 92350

SEQ ID NO: 245215 - RNA, 64 nt, hsa; identical to SEQ ID NO: 92351

SEQ ID NO: 245216 - RNA, 64 nt, hsa; identical to SEQ ID NO: 92352

SEQ ID NO: 245217 - RNA, 64 nt, hsa; identical to SEQ ID NO: 92353

SEQ ID NO: 245218 - RNA, 64 nt, hsa; identical to SEQ ID NO: 92354

SEQ ID NO: 245219 - RNA, 64 nt, hsa; identical to SEQ ID NO: 92355

SEQ ID NO: 245220 - RNA, 64 nt, hsa; identical to SEQ ID NO: 92356

SEQ ID NO: 245221 - RNA, 64 nt, hsa; identical to SEQ ID NO: 92357

SEQ ID NO: 245222 - RNA, 64 nt, hsa; identical to SEQ ID NO: 92358

SEQ ID NO: 245223 - RNA, 64 nt, hsa; identical to SEQ ID NO: 92359

SEQ ID NO: 245224 - RNA, 64 nt, hsa; identical to SEQ ID NO: 92360

SEQ ID NO: 245225 - RNA, 64 nt, hsa; identical to SEQ ID NO: 92361

SEQ ID NO: 245226 - RNA, 64 nt, hsa; identical to SEQ ID NO: 92362

SEQ ID NO: 245227 - RNA, 64 nt, hsa; identical to SEQ ID NO: 92363

SEQ ID NO: 245228 - RNA, 64 nt, hsa; identical to SEQ ID NO: 92364

SEQ ID NO: 245229 - RNA, 64 nt, hsa; identical to SEQ ID NO: 92365

SEQ ID NO: 245230 - RNA, 64 nt, hsa; identical to SEQ ID NO: 92366

SEQ ID NO: 245231 - RNA, 64 nt, hsa; identical to SEQ ID NO: 92367

SEQ ID NO: 245232 - RNA, 64 nt, hsa; identical to SEQ ID NO: 92368

SEQ ID NO: 245233 - RNA, 64 nt, hsa; identical to SEQ ID NO: 92369

SEQ ID NO: 245234 - RNA, 64 nt, hsa; identical to SEQ ID NO: 92370

SEQ ID NO: 245235 - RNA, 64 nt, hsa; identical to SEQ ID NO: 92371

SEQ ID NO: 245236 - RNA, 64 nt, hsa; identical to SEQ ID NO: 92372

SEQ ID NO: 245237 - RNA, 64 nt, hsa; identical to SEQ ID NO: 92373

SEQ ID NO: 245238 - RNA, 64 nt, hsa; identical to SEQ ID NO: 92374

SEQ ID NO: 245239 - RNA, 64 nt, hsa; identical to SEQ ID NO: 92375

SEQ ID NO: 245240 - RNA, 64 nt, hsa; identical to SEQ ID NO: 92376

SEQ ID NO: 245241 - RNA, 64 nt, hsa; identical to SEQ ID NO: 92377

SEQ ID NO: 245242 - RNA, 64 nt, hsa; identical to SEQ ID NO: 92378

SEQ ID NO: 245243 - RNA, 64 nt, hsa; identical to SEQ ID NO: 92379

SEQ ID NO: 245244 - RNA, 64 nt, hsa; identical to SEQ ID NO: 92354

SEQ ID NO: 245245 - RNA, 64 nt, hsa; identical to SEQ ID NO: 92355

SEQ ID NO: 245246 - RNA, 64 nt, hsa; identical to SEQ ID NO: 92355

SEQ ID NO: 245247 - RNA, 64 nt, hsa; identical to SEQ ID NO: 92354

SEQ ID NO: 245248 - RNA, 64 nt, hsa; identical to SEQ ID NO: 92384

SEQ ID NO: 245249 - RNA, 64 nt, hsa; identical to SEQ ID NO: 92385

SEQ ID NO: 245250 - RNA, 64 nt, hsa; identical to SEQ ID NO: 92386

SEQ ID NO: 245251 - RNA, 64 nt, hsa; identical to SEQ ID NO: 92387

SEQ ID NO: 245252 - RNA, 64 nt, hsa; identical to SEQ ID NO: 92388

SEQ ID NO: 245253 - RNA, 64 nt, hsa; identical to SEQ ID NO: 92389

SEQ ID NO: 245254 - RNA, 64 nt, hsa; identical to SEQ ID NO: 92390

SEQ ID NO: 245255 - RNA, 64 nt, hsa; identical to SEQ ID NO: 92391

SEQ ID NO: 245256 - RNA, 64 nt, hsa; identical to SEQ ID NO: 92392

SEQ ID NO: 245257 - RNA, 64 nt, hsa; identical to SEQ ID NO: 92393

SEQ ID NO: 245258 - RNA, 64 nt, hsa; identical to SEQ ID NO: 92394

SEQ ID NO: 245259 - RNA, 64 nt, hsa; identical to SEQ ID NO: 92395

SEQ ID NO: 245260 - RNA, 64 nt, hsa; identical to SEQ ID NO: 92396

SEQ ID NO: 245261 - RNA, 64 nt, hsa; identical to SEQ ID NO: 92397

SEQ ID NO: 245262 - RNA, 64 nt, hsa; identical to SEQ ID NO: 92398

SEQ ID NO: 245263 - RNA, 64 nt, hsa; identical to SEQ ID NO: 92399

SEQ ID NO: 245264 - RNA, 64 nt, hsa; identical to SEQ ID NO: 92400

SEQ ID NO: 245265 - RNA, 64 nt, hsa; identical to SEQ ID NO: 92401

SEQ ID NO: 245266 - RNA, 64 nt, hsa; identical to SEQ ID NO: 92402

SEQ ID NO: 245267 - RNA, 64 nt, hsa; identical to SEQ ID NO: 92403

SEQ ID NO: 245268 - RNA, 64 nt, hsa; identical to SEQ ID NO: 92404

SEQ ID NO: 245269 - RNA, 64 nt, hsa; identical to SEQ ID NO: 92405

SEQ ID NO: 245270 - RNA, 64 nt, hsa; identical to SEQ ID NO: 92406

SEQ ID NO: 245271 - RNA, 64 nt, hsa; identical to SEQ ID NO: 92407

SEQ ID NO: 245272 - RNA, 64 nt, hsa; identical to SEQ ID NO: 92408

SEQ ID NO: 245273 - RNA, 64 nt, hsa; identical to SEQ ID NO: 92409

SEQ ID NO: 245274 - RNA, 64 nt, hsa; identical to SEQ ID NO: 92410

SEQ ID NO: 245275 - RNA, 64 nt, hsa; identical to SEQ ID NO: 92411

SEQ ID NO: 245276 - RNA, 64 nt, hsa; identical to SEQ ID NO: 92412

SEQ ID NO: 245277 - RNA, 64 nt, hsa; identical to SEQ ID NO: 92413

SEQ ID NO: 245278 - RNA, 64 nt, hsa; identical to SEQ ID NO: 92414

SEQ ID NO: 245279 - RNA, 64 nt, hsa; identical to SEQ ID NO: 92415

SEQ ID NO: 245280 - RNA, 64 nt, hsa; identical to SEQ ID NO: 92416

SEQ ID NO: 245281 - RNA, 64 nt, hsa; identical to SEQ ID NO: 92417

SEQ ID NO: 245282 - RNA, 64 nt, hsa; identical to SEQ ID NO: 92418

SEQ ID NO: 245283 - RNA, 64 nt, hsa; identical to SEQ ID NO: 92419

SEQ ID NO: 245284 - RNA, 64 nt, hsa; identical to SEQ ID NO: 92420

SEQ ID NO: 245285 - RNA, 64 nt, hsa; identical to SEQ ID NO: 92421

SEQ ID NO: 245286 - RNA, 64 nt, hsa; identical to SEQ ID NO: 92422

SEQ ID NO: 245287 - RNA, 64 nt, hsa; identical to SEQ ID NO: 92423

SEQ ID NO: 245288 - RNA, 64 nt, hsa; identical to SEQ ID NO: 92424

SEQ ID NO: 245289 - RNA, 64 nt, hsa; identical to SEQ ID NO: 92425

SEQ ID NO: 245290 - RNA, 64 nt, hsa; identical to SEQ ID NO: 92426

SEQ ID NO: 245291 - RNA, 64 nt, hsa
aaggucucuuucaggucccaggggacgugaucuaaguuaggagugggaacaugggaguggcugc

SEQ ID NO: 245292 - RNA, 64 nt, hsa
uuuaaucuaaacuuuuuuuaaaaaaaaucauaauaguuaggauaguuuccuauagcaaagggcu

SEQ ID NO: 245293 - RNA, 64 nt, hsa
ucaggagagcagcaguuaaacccguggauuuuguaguuaggaaccuggguucaaacccucuucc

SEQ ID NO: 245294 - RNA, 64 nt, hsa
ucaguugguuccaaaugaaaccagggagcaggggaguuaggaaucgaacaccagucaugccuac

SEQ ID NO: 245295 - RNA, 64 nt, hsa
caggcccugaucugcgcuguggcugucccuggacgugcugcagcccuccugucccuucccccca

SEQ ID NO: 245296 - RNA, 64 nt, hsa
cccgcuggggcggccggggcgggagagaaagguggugcugcagugguggcccuggggggccauu

SEQ ID NO: 245297 - RNA, 64 nt, hsa
ugagccugaggccuuccagaaagcaggagcagcugugcugcaccccaugugggugaccaggucc

SEQ ID NO: 245298 - RNA, 64 nt, hsa
uaugcccguguaaaguaugugaaucgcaaggccugugcugcaugcgacagcguccgggguggug

SEQ ID NO: 245299 - RNA, 64 nt, hsa
guuaguuacauauguauacaugugccaugcuggugugcugcacccauuaacucgucauuuauca

SEQ ID NO: 245300 - RNA, 64 nt, hsa
uuggguugguuccaagucuuugcuauugugaauagugcugcaauaaacauacgugugcaugugu

SEQ ID NO: 245301 - RNA, 64 nt, hsa
gagccugcaggcuuuggaaguggcccugucacccgugcugcacgggauucacagccccagcccc

SEQ ID NO: 245302 - RNA, 64 nt, hsa
cuucccgaguugucugccucuccucaaaugcugugugcugcaauuguccaggcgaugacaaugg

SEQ ID NO: 245303 - RNA, 64 nt, hsa
agauguggggagucuggaaacacccggcccacgcgugcugcagauguggggagcccggaaacac

SEQ ID NO: 245304 - RNA, 64 nt, hsa
agauguggggagccuggaaacacccggcccacgcgugcugcagauguggggagucuggaaacac

SEQ ID NO: 245305 - RNA, 64 nt, hsa
agauguggggagccuggaaacacccggcccacgcgugcugcagauguggggagccuggaaacac

SEQ ID NO: 245306 - RNA, 64 nt, hsa
ugacguggggagccuggaaacacccggcccacgcgugcugcagauguggggagccuggaaacac

SEQ ID NO: 245307 - RNA, 64 nt, hsa
gccuggggggugugauuugugugcgugcuugcaugugcugcagguguaagagagugggagcagg

SEQ ID NO: 245308 - RNA, 64 nt, hsa
accagagacucugaaacuauagaauaaagccucugugcugcacaacaaaggggcaggcucugcu

SEQ ID NO: 245309 - RNA, 64 nt, hsa
accgcccagcuucucccugagggcccaccagccugugcugcauacccaccgcccagcuucuccc

SEQ ID NO: 245310 - RNA, 64 nt, hsa
agccccugcccugccucugagggcccaccagccugugcugcauacccaccgcccagcuucuccc

SEQ ID NO: 245311 - RNA, 64 nt, hsa
aucaggccagagugucucaaacuggacaagaaaugugcugcauugccgaguucuuauuuucacc

SEQ ID NO: 245312 - RNA, 64 nt, hsa
ccuaggcccucuccuguugcucugucauccuaaugugcugcauccaccucauggaccaagaugg

SEQ ID NO: 245313 - RNA, 64 nt, hsa
uggggucugccccucccuucucaccucuggagcugugcugcacugcuucagcccagagggcccu

SEQ ID NO: 245314 - RNA, 64 nt, hsa
ucucucaggcaugccccauucacagcugaagugggugcugcaacgucuugaacaaggcagaagu

SEQ ID NO: 245315 - RNA, 64 nt, hsa
uguuuccuccugggaugcgugcaaggcagaccuggugcugcaaaggaaagggccugaggccuca

SEQ ID NO: 245316 - RNA, 64 nt, hsa
cccugugugugggguggugagggucuccccaccagugcugcaccccgcagcagcauacaggccu

SEQ ID NO: 245317 - RNA, 64 nt, hsa
aguccucagggagggagugaccucgacccuggcugugcugcaagcugacuccagccuugguacu

SEQ ID NO: 245318 - RNA, 64 nt, hsa
cagaccugccccaagggugaugcagaggccacaggugcugcacgcuccagcgcccacucuagac

SEQ ID NO: 245319 - RNA, 64 nt, hsa
cccgccguggcugggaagguucccugcagugccagugcugcagcagggagagcugggcagaagc

SEQ ID NO: 245320 - RNA, 64 nt, hsa
cuuuagggccaccauggcgcagcgccuggugcgcgugcugcagaucugugcuggccacgugccc

SEQ ID NO: 245321 - RNA, 64 nt, hsa
gaggauggaaggauggagaaaaacagacugugggaaggaucagaaggaauccgccgaggcaggg

SEQ ID NO: 245322 - RNA, 64 nt, hsa
uacagaggagacugacagaggaauuccagaauguaaggaucaucaaaccugaagccagcaggaa

SEQ ID NO: 245323 - RNA, 64 nt, hsa
aguugucuggaagccuggguggcgucaugagcugaaggaucaugcuuuccuguccuggcuccau

SEQ ID NO: 245324 - RNA, 64 nt, hsa
gguuccucuuucuuucagcucagugcccaugggcaaggaucaugauuuccauuccguguuacaa

SEQ ID NO: 245325 - RNA, 64 nt, hsa
auguacuaaaagccacaguauguggcaacugcaaaaggaucaggaauuuaggguaugaucucgg

SEQ ID NO: 245326 - RNA, 64 nt, hsa
ccaccgcucuggagaggacaguguggcaugcuccaaggaucaucuuacuuaacucgcagccugu

SEQ ID NO: 245327 - RNA, 64 nt, hsa
auauauagggugguccccagucucuguuaugguugcgcauaaauuaauaauuuuauaaguauuu

SEQ ID NO: 245328 - RNA, 64 nt, hsa
guccaccucuucuccccugcccaccagcugcucagcgcauaagaccuucccgacaggcucugcg

SEQ ID NO: 245329 - RNA, 64 nt, hsa
ccaccacaagacuaaguaaagaccgaguugaaaagcgcauaaaaacaaaggcucuuuucagagc

SEQ ID NO: 245330 - RNA, 64 nt, hsa
ucaaauuggauaaaacaauguuuucuuucugguagcgcauaauaacagagcacaagcaucuuuu

SEQ ID NO: 245331 - RNA, 64 nt, hsa
ugggguuaaguugggcagcccauuuaguuuacacgcgcauaagacuaauuuacaaaaucacucu

SEQ ID NO: 245332 - RNA, 64 nt, hsa
aaguggaauuucaggaaggcuugugugaaccguugcgcauaaauaaacccuuucuaccgggcug

SEQ ID NO: 245333 - RNA, 64 nt, hsa
cugccccuuauacauaggaauaugcugcauaauugcgcauaacuuccaucucccuuacuggcuu

SEQ ID NO: 245334 - RNA, 64 nt, hsa
gucucaauacuuagaaaauuauuguuugucuguugcgcauaauaaugacauaaucugcuuagca

SEQ ID NO: 245335 - RNA, 64 nt, hsa
gcugaucuagcuagggcuuugucuuuucaucuuugcgcauaacuuaccuguuaccaguauaggu

SEQ ID NO: 245336 - RNA, 64 nt, hsa
gacuggaagggguuuuuguauaacuaaaaccucagcgcauaaaggagauuuaaaaggagcacau

SEQ ID NO: 245337 - RNA, 64 nt, hsa
gaaacagaaacagccuguagagagcaucgacaaggcgcauaauggagaguugguaucucaaccc

SEQ ID NO: 245338 - RNA, 64 nt, hsa
ggaacauuuuugcagcuuguuucuggaguuguuugcgcauaaaggaaugguggacuuucacaaa

SEQ ID NO: 245339 - RNA, 64 nt, hsa
gaaguccuggaguauuguuugggucucggaaugggcgcauaaccugcgcugaccaguuuagggg

SEQ ID NO: 245340 - RNA, 64 nt, hsa
aguggggacacuuuaacuacaguuuacaccucgggcgcauaaaguuuuucuucucuuucucucu

SEQ ID NO: 245341 - RNA, 64 nt, hsa
uccggacucguagccagccuguuuagccagcccugcgcauaaauacacucugcguuauuggcug

SEQ ID NO: 245342 - RNA, 64 nt, hsa
gaccaguggggauuuguaagacuuagaugagauagcgcauaauaaggggaagacuuuaaaguau

SEQ ID NO: 245343 - RNA, 64 nt, hsa
gaauauuuaaaugaaacauauuuuuuuaaaaccugcgcauaagauaaaagcagcccgugugcau

SEQ ID NO: 245344 - RNA, 64 nt, hsa
uuucauagguuauguuguguucauuuaguagguggcgcauaaucugugguuuucucucuuuuug

SEQ ID NO: 245345 - RNA, 64 nt, hsa
cccagccccugcuacuggcuggacccucugcccugggcaggaggucaggggauucuguuuuggu

SEQ ID NO: 245346 - RNA, 64 nt, hsa
uguggagagacacauaagccuuacuguccucugggggcaggagccgagccuuuuuguugcuccg

SEQ ID NO: 245347 - RNA, 64 nt, hsa
cccaucaggcaguguuaccuguuagcucccuguggggcaggagugccaggaccagccuguaccu

SEQ ID NO: 245348 - RNA, 64 nt, hsa
cagccuguaccuugcuguggggcuacaggauggugggcaggaucucaagccagcccccuccagc

SEQ ID NO: 245349 - RNA, 64 nt, hsa
ccaagacccauucugcacagucccuccaggguuugggcaggagauggccaaucaugcgcccacc

SEQ ID NO: 245350 - RNA, 64 nt, hsa
augggauuugggaaaggugaagcugugacuggaggggcaggagaugguccaaguguccauccag

SEQ ID NO: 245351 - RNA, 64 nt, hsa
ucuaggacaucuguccaggaggcugggcggaggugggcaggaugugagagguggggaguacugg

SEQ ID NO: 245352 - RNA, 64 nt, hsa
acccucgagcgggguuccccucauuguacagauggggcaggacccagcacgcugcuggcagaga

SEQ ID NO: 245353 - RNA, 64 nt, hsa
agcacugggaaagaagggagagccggggaggauagggcaggagucuggccaggagcccaagguc

SEQ ID NO: 245354 - RNA, 64 nt, hsa
cccaucugcacagcggcagcaaggauuaccccaagggcaggaaaaaagucuuuggaaauagauu

SEQ ID NO: 245355 - RNA, 64 nt, hsa
ccgagagccccgccuccagcagccguuccccagggggcaggaaguaggcuccccugagcacagu

SEQ ID NO: 245356 - RNA, 64 nt, hsa
ccuggugcuccucucugcuugguaggaaugaccagggcaggaugccaccugcuacacucuugcc

SEQ ID NO: 245357 - RNA, 64 nt, hsa
gcacuuucaaucccucaccuaguccugcugcacagggcaggaggccucacagaagagauacuug

SEQ ID NO: 245358 - RNA, 64 nt, hsa
uguuuaagauucggcaguuuguguggggaggugggggcaggaugggguuugguugccaaaagag

SEQ ID NO: 245359 - RNA, 64 nt, hsa
caccaggaagaugaacugugagggcuccuauaaggggcaggaagagcaaagcuguccuaggcca

SEQ ID NO: 245360 - RNA, 64 nt, hsa
caaaaccuggaacuuucaugccaaaccuggggcagggcaggaaacagaggaaauggcugcaaca

SEQ ID NO: 245361 - RNA, 64 nt, hsa
cuguucuggcuguuauguaaaggagugcagggaggggcaggaaaggagacaaggaggccaguau

SEQ ID NO: 245362 - RNA, 64 nt, hsa
aggaaggggcauccacugcgggugacuggaggccgggcaggaagcaagucaucagagccgcuca

SEQ ID NO: 245363 - RNA, 64 nt, hsa
acaaugcaaagacaugcuggcuggcgggacaggugggcaggacugacccugaggaggccuugcc

SEQ ID NO: 245364 - RNA, 64 nt, hsa
agcuaggucuggcccguuggggaucucagcaguggggcaggagggugccugauuucggggaguc

SEQ ID NO: 245365 - RNA, 64 nt, hsa
gaggcauaggcuaggacaggcccacguggaggcugggcaggaagggccugcugaggucacacag

SEQ ID NO: 245366 - RNA, 64 nt, hsa
cugugcccaggacgguucugagacugaacacugagggcaggagcaagggaggaagccaggggcg

SEQ ID NO: 245367 - RNA, 64 nt, hsa
caccuguaauuggggagagggagugugccccucggggcaggagggaagggcaucuggggaaggg

SEQ ID NO: 245368 - RNA, 64 nt, hsa
ccccucggggcaggagggaagggcaucuggggaagggcaggagggaagagcuguccaugcagcc

SEQ ID NO: 245369 - RNA, 64 nt, hsa
uggugaaagaaaaggugcauuucaagaacuuggggggcaggaggaaagcacaauguuucuuagc

SEQ ID NO: 245370 - RNA, 64 nt, hsa
agaacuaagaacauauugagcuggagcuucuugagggcaggagaguauuggaaaaggaauccag

SEQ ID NO: 245371 - RNA, 64 nt, hsa
agccucaaauccaggacccugccaggcacaggcagggcaggaccagcccacgcugacuacaggg

SEQ ID NO: 245372 - RNA, 64 nt, hsa
cuggcucccucacucucaggaaaugcugacccaugggcaggagacuguggagacugcuccugag

SEQ ID NO: 245373 - RNA, 64 nt, hsa
ggccucuuugacaagguaggagcugugcuuggaggggcaggaaaagaacugagcaugucgcagg

SEQ ID NO: 245374 - RNA, 64 nt, hsa
caacuggaaugauucuagaaccaaaauaaaguuggggcaggaagagggggcuuccagggagccc

SEQ ID NO: 245375 - RNA, 64 nt, hsa
cagccaggcccugcagggcuggucagggugucuggggcaggaggaggccaacucacugaacuag

SEQ ID NO: 245376 - RNA, 64 nt, hsa
gucacauggggaaccuccccucaucgggccucuggggcaggaagcuugucacuggaagaucuua

SEQ ID NO: 245377 - RNA, 64 nt, hsa
cgggaggccuucagggugggggggaaggggacaugggcaggaagcaccgagggaguugggcccu

SEQ ID NO: 245378 - RNA, 64 nt, hsa
cagaaguuucucagcuccuuugacagacauucaagggcaggagggagccccaaagcauaaccag

SEQ ID NO: 245379 - RNA, 64 nt, hsa
ccaacaccuguuucucuuuuccucaagggguuuggggcaggagccugggcacuuacuccccguu

SEQ ID NO: 245380 - RNA, 64 nt, hsa
gguggaggccccugggccugaggcugccagcagcgggcaggagcugcucuucauccacuuggag

SEQ ID NO: 245381 - RNA, 64 nt, hsa
agagucaccgagggcccauguggcuggagguugggggcaggaucuggcccgagcucuccucaga

SEQ ID NO: 245382 - RNA, 64 nt, hsa
aauggcccucccgggucaugacagagcucuuuuggggcaggaggugagggcagggggccccgcu

SEQ ID NO: 245383 - RNA, 64 nt, hsa
ggguaggggacacagcugggcagguggagugggugggcaggauggcugucccagucugcccauc

SEQ ID NO: 245384 - RNA, 64 nt, hsa
uggggcugaggcccaaaggcagaacagccagagggggcaggaggggaccaaaaaggaaaaugag

SEQ ID NO: 245385 - RNA, 64 nt, hsa
cacgcugucccggccugcucaccaucucagugaggggcaggagcuggggcucgcuuaggcuggg

SEQ ID NO: 245386 - RNA, 51 nt, hsa
ccaccagcuggucccucugaugggcaggacccagcuucccacuugccacuc

SEQ ID NO: 245387 - RNA, 64 nt, hsa
ccugcuguacucugggggcagggagaggcuagaggggcaggacagacagcguuguccaaucagg

SEQ ID NO: 245388 - RNA, 64 nt, hsa
aacagaggcaucuccgcacccaagacugugcaacgggcaggaacguggucacagagcugcuucc

SEQ ID NO: 245389 - RNA, 64 nt, hsa
cuaugcaucagcugugcccucuguggacuguaacgggcaggacaguuggguguggccugggcuc

SEQ ID NO: 245390 - RNA, 64 nt, hsa
uagagguuuuguucguacucuuaacagggagugggggcaggaagaguccuguacuaugcagguu

SEQ ID NO: 245391 - RNA, 64 nt, hsa
uagacacauccuccuaccguccccaaugcccccugggcaggaggcaguggagaaccaagcccca

SEQ ID NO: 245392 - RNA, 64 nt, hsa
cguucucucuugcccagggugggccugguccugagggcaggacaggggguuuggagaugugggc

SEQ ID NO: 245393 - RNA, 57 nt, hsa
ucuucaccaggauccgguaaaccugccgggcaggaccgugccacaccagcuguccag

SEQ ID NO: 245394 - RNA, 64 nt, hsa
gagaggcaaagggcacagccaugcaaaggcccuggggcaggacggcaccugguaugcgggagga

SEQ ID NO: 245395 - RNA, 64 nt, hsa
caaggccgggcccagccagaggaggggcagggcagggcaggagguuucuggauguuuguugggu

SEQ ID NO: 245396 - RNA, 64 nt, hsa
ggagccccagggucuucccuaccucaggcaggaagggcaggaaggagagccugcugcauggggu

SEQ ID NO: 245397 - RNA, 64 nt, hsa
ggaggcuggcagguauggaaggguuuguggcugggggcaggagggcccuaccugauuggugcaa

SEQ ID NO: 245398 - RNA, 64 nt, hsa
agugcuugccugaggucccacuguguuagugggugggcaggacuggaacucgguucuccaacag

SEQ ID NO: 245399 - RNA, 64 nt, hsa
ucuuucuuugaagccuaauggccccccaaaagaugggcaggacaagcuguagcccaucugagag

SEQ ID NO: 245400 - RNA, 64 nt, hsa
uccuaucagaggcgauuuuccuucaccaggggaugggcaggaaagaggcaggggccccagaagc

SEQ ID NO: 245401 - RNA, 64 nt, hsa
gcgccaggcuccucggagcccaacagucccaagggggcaggagacggggugguccagugcugag

SEQ ID NO: 245402 - RNA, 64 nt, hsa
ccccaggggaccagccaggccuggaaugcccccugggcaggacccugggcaggaccagaggccc

SEQ ID NO: 245403 - RNA, 64 nt, hsa
agccaggccuggaaugcccccugggcaggacccugggcaggaccagaggcccacauggaugcca

SEQ ID NO: 245404 - RNA, 64 nt, hsa
gguuuugaccaaaagugaguggggcgggaggaaggggcaggaggaaggguugagguuacuuggg

SEQ ID NO: 245405 - RNA, 64 nt, hsa
gagaguugcucugggaguugggguaccacccccagggcaggauggggacaggaucaccugcccg

SEQ ID NO: 245406 - RNA, 64 nt, hsa
acagucucaauuuuguauuuaaugauuuuuguguauccaguaugcacguuaacagcgugucaac

SEQ ID NO: 245407 - RNA, 64 nt, hsa
ucugcaacugaauacuugaaguaggaaguaggaaauccaguagggaaaauaggguccuugaaac

SEQ ID NO: 245408 - RNA, 64 nt, hsa
uuuuccuaauuaauguagcuuucggaugacauaaauccaguaucucugcuuaugacauaaaucc

SEQ ID NO: 245409 - RNA, 64 nt, hsa
ugacauaaauccaguaucucugcuuaugacauaaauccaguaccucugcuuuucuuuugcugug

SEQ ID NO: 245410 - RNA, 64 nt, hsa
aucggugaugcgcucaccuucugcugggaaguuaauccaguacauuguagaagauggaggucau

SEQ ID NO: 245411 - RNA, 64 nt, hsa
ucuuucuuuuugaaggcagcugaggaaguuggauauccaguaaugaucaaggccucagagggag

SEQ ID NO: 245412 - RNA, 64 nt, hsa
gcacagcucugcguugcucccgugcugccugcgccagccccaggcugcugaggagcagaggcca

SEQ ID NO: 245413 - RNA, 64 nt, hsa
cgucccuuccccacccccaucccauccccacccccagccccagcccaguccuccuaggagcagg

SEQ ID NO: 245414 - RNA, 64 nt, hsa
ccgcagccucgcagcuccguggggcccuccgccccagccccagccagccaggcccugguggaaa

SEQ ID NO: 245415 - RNA, 64 nt, hsa
ugcaccccaucccgacccugucuccgccaccucgcagccccauuaaagcgcucucaucugggcu

SEQ ID NO: 245416 - RNA, 64 nt, hsa
cuucuguccaccuggccuccucucgccuggccgccagccccagccccagccccagccccaggcc

SEQ ID NO: 245417 - RNA, 64 nt, hsa
uccaccuggccuccucucgccuggccgccagccccagccccagccccagccccaggcccagcug

SEQ ID NO: 245418 - RNA, 64 nt, hsa
uggccuccucucgccuggccgccagccccagccccagccccagccccaggcccagcugccuuug

SEQ ID NO: 245419 - RNA, 64 nt, hsa
ccucucgccuggccgccagccccagccccagccccagccccaggcccagcugccuuuggcuuug

SEQ ID NO: 245420 - RNA, 64 nt, hsa
gggcccggcccuggacccgucaggugccuguccccagccccaaccccacucaugccccgucguc

SEQ ID NO: 245421 - RNA, 64 nt, hsa
cagggaagcaggaaccccaccgugugcccccugccagccccagagggaguggcgagcccagcug

SEQ ID NO: 245422 - RNA, 64 nt, hsa
cccccucucccuccugcaauaauucggggagucucagccccauccaggugccgcggccagcucu

SEQ ID NO: 245423 - RNA, 64 nt, hsa
gucaacccuccuucccgacccccucccccuagcccagccccagucacugucagggucgggccag

SEQ ID NO: 245424 - RNA, 64 nt, hsa
gggggcaagcuuuggugcgcccccugcugaggagcagccccaggaggggaccagaggggaugcu

SEQ ID NO: 245425 - RNA, 50 nt, hsa
ccucccaggagcuccagugacagccccaucccaggaugggugucugggga

SEQ ID NO: 245426 - RNA, 64 nt, hsa
gggagagggccaacaacugucccuccuugagcaccagccccacccaagcaagcagacauuuauc

SEQ ID NO: 245427 - RNA, 64 nt, hsa
aaaggcagguggggucaccugaugagcuaagauccagccccagaauccuggaggagcaggaggu

SEQ ID NO: 245428 - RNA, 64 nt, hsa
acaguccccugauccccuaccucugccugcccuccagccccaucaccagcuucuugcucaggga

SEQ ID NO: 245429 - RNA, 64 nt, hsa
gcgggggccaugggggugaugaaugacccuccaacagccccacauggguuguuucuguuucuuu

SEQ ID NO: 245430 - RNA, 64 nt, hsa
cuucgccaguuucuugguugggacacuccucuggcagccccagcaccaccacaaccccuugcag

SEQ ID NO: 245431 - RNA, 64 nt, hsa
ugccacccacccccuaccauugagccaccaugcccagccccaaagccucuuaauugcucuaaca

SEQ ID NO: 245432 - RNA, 64 nt, hsa
gagugcugggauuacacacgugagucaccaugcccagccccaaagccauuucuugaagaauuuc

SEQ ID NO: 245433 - RNA, 64 nt, hsa
ugcugccugcagucagcucggccuccccgaccugcagccccagacucugcucucccagcacuga

SEQ ID NO: 245434 - RNA, 64 nt, hsa
agugcucaucccagcguaugcugccucuuuagggcagccccaagggccagccagccuguacucu

SEQ ID NO: 245435 - RNA, 64 nt, hsa
gagagaaacaaaaugggucagauagcuuuggccacagccccaggcagccuuuggggccuaugac

SEQ ID NO: 245436 - RNA, 64 nt, hsa
uggcggguugcuucagccagugcagugagaacagcagccccacggccccaugggaggcggcgcu

SEQ ID NO: 245437 - RNA, 64 nt, hsa
agaagacacuuuauucguuuauauugugagaaaacagccccaucaggcuuguguuaaggcaaug

SEQ ID NO: 245438 - RNA, 64 nt, hsa
uucugagguaaauaauuucugccaggaaacuucccagccccaccagcagccccccuaaaaaaau

SEQ ID NO: 245439 - RNA, 64 nt, hsa
agccauuuugcaccaaggacuugguaggcagaggcagccccacuguaaagaagggucagauuaa

SEQ ID NO: 245440 - RNA, 64 nt, hsa
ucugcauacuuuaaggaccagaucaugcuccauccagccccacccaauggccuuuugugcuugu

SEQ ID NO: 245441 - RNA, 53 nt, hsa
ccccuuggggacccugguaaccccagccccaagccaggaggacgacugugucu

SEQ ID NO: 245442 - RNA, 64 nt, hsa
caccaccucccucccagccccagcgccucagccccagccccagcuccagcccugaggacagcuc

SEQ ID NO: 245443 - RNA, 64 nt, hsa
ucuuaucaccaccucccucccagccccagcgccucagccccagccccagcuccagcccugagga

SEQ ID NO: 245444 - RNA, 64 nt, hsa
cuuucugcagugguucuuaucaccaccucccucccagccccagcgccucagccccagccccagc

SEQ ID NO: 245445 - RNA, 64 nt, hsa
ucucccuugacccaccccagugagugccaaagggcagccccaacaugugcaccccugcauuucc

SEQ ID NO: 245446 - RNA, 64 nt, hsa
uugagggcagccugcuguacuggccaugcugggccagccccaccuggagcucaguaaaaacugc

SEQ ID NO: 245447 - RNA, 64 nt, hsa
ugugcuccccaccacccccauggcagucccuccgcagccccagucccuggccacgcccaaggga

SEQ ID NO: 245448 - RNA, 64 nt, hsa
cagaggccccugggcagcccagccaggggagccacagccccaaggauggucuugcucugggaau

SEQ ID NO: 245449 - RNA, 64 nt, hsa
acaggggugggugauuuagggacagccagggucccagccccaaugucagcaggauagggagagc

SEQ ID NO: 245450 - RNA, 64 nt, hsa
gcaggccuggcccagcucccaguucccccugcaccagccccaccccuagagucccuucuauagg

SEQ ID NO: 245451 - RNA, 64 nt, hsa
uggggcagggaagcuucaugcccacggguucugccagccccagcacagacccaaacuggggcug

SEQ ID NO: 245452 - RNA, 64 nt, hsa
ggaggguguggggaugccuugccaaccagaagcccagccccaaggaugaagcaagacauguggg

SEQ ID NO: 245453 - RNA, 64 nt, hsa
caccugccaguuuccccagccucagccccagccccagccccagugggcaagaccaaaguguggc

SEQ ID NO: 245454 - RNA, 64 nt, hsa
uccuaccaccugccaguuuccccagccucagccccagccccagccccagugggcaagaccaaag

SEQ ID NO: 245455 - RNA, 64 nt, hsa
ucucccuccuaccaccugccaguuuccccagccucagccccagccccagccccagugggcaaga

SEQ ID NO: 245456 - RNA, 64 nt, hsa
ggcccugcccucaccccacugccaggccgaggcucagccccagacucucagcaucugcugcccu

SEQ ID NO: 245457 - RNA, 64 nt, hsa
cucagaguguggugcuagaaacuggcccccagcccagccccaguacugccaccuuuacaccuac

SEQ ID NO: 245458 - RNA, 64 nt, hsa
cuggccaagggaggugccaacacugggcuugccacagccccaggagaggaauuuggggccuagg

SEQ ID NO: 245459 - RNA, 64 nt, hsa
augagggggugcccuccggccaccuguacuguaucagccccaagcagguggugaguugggguau

SEQ ID NO: 245460 - RNA, 64 nt, hsa
ugccucaccagcccugaggcuccgccccagcccucagccccaggccccagcuggagaaaaaaca

SEQ ID NO: 245461 - RNA, 64 nt, hsa
gucacccugagaccugguagcccuagcugccuugcagccccaaaccccaggacccuaucagccc

SEQ ID NO: 245462 - RNA, 64 nt, hsa
cccggcugcacuggccucuaggacucacagcagccagccccagcuaggaacgggcaggacuugg

SEQ ID NO: 245463 - RNA, 64 nt, hsa
cugccucccugugcaguccagcccugccuugcugcagccccagcccagauggcacucagcgcuc

SEQ ID NO: 245464 - RNA, 64 nt, hsa
cagagagggccuuuccuggcugaucagagcuuaccagccccaccccaccaugguagccuuaggg

SEQ ID NO: 245465 - RNA, 64 nt, hsa
gcauauauauauauguggcucuagccucaggcuccagccccagugggguacuguacaguuaacu

SEQ ID NO: 245466 - RNA, 64 nt, hsa
uggacauuaagggacagcuaacuguggccagacucagccccauguccuuggccaggcccaagga

SEQ ID NO: 245467 - RNA, 64 nt, hsa
cucuugauauaccucgagcuuccccugugcuccccagccccaggaccacuggccccuuggccug

SEQ ID NO: 245468 - RNA, 64 nt, hsa
acacacacagauggcagacgucuccccacucauccagccccagaucugagccuugacgcaggcc

SEQ ID NO: 245469 - RNA, 64 nt, hsa
ucaacagacgaccagaggagugcuggagcuccagcagccccaaccacagcauucccuaacaugg

SEQ ID NO: 245470 - RNA, 64 nt, hsa
gcccagcagugccucuggagcccaggccccaacacagccccauggccucugccagauggcuuug

SEQ ID NO: 245471 - RNA, 64 nt, hsa
cuuccaucgugcccugaggccugacacggcagaucagccccauagugcucaggaggcagcaucu

SEQ ID NO: 245472 - RNA, 64 nt, hsa
gcccaagucuuccaggcaauaccuggcucaggcccagccccaauccauccccuuacuuucugcc

SEQ ID NO: 245473 - RNA, 64 nt, hsa
ugugcggagcuccccugcugguuggggcucagcgcagccccagggaggugcuuccugcaccuca

SEQ ID NO: 245474 - RNA, 64 nt, hsa
cccacugaggccccuacugaggccagccccgagccagccccagacccagccccgguggcugaag

SEQ ID NO: 245475 - RNA, 64 nt, hsa
cguguagccccgggcugacccagugugugcucagcagccccaccccacccugccccuuguccuc

SEQ ID NO: 245476 - RNA, 64 nt, hsa
gagaccuuuucugccuggagagaaacuuucagaccagccccacacaccacagccaggagaggcc

SEQ ID NO: 245477 - RNA, 64 nt, hsa
cagggccaggggagagagaagaggaucagcagugcagccccaggaugccucgcagguacccugc

SEQ ID NO: 245478 - RNA, 64 nt, hsa
gggacaagauaaacggagcugguggcgggagggacagccccagagcagacccuuccuauggcgg

SEQ ID NO: 245479 - RNA, 64 nt, hsa
uaagugcugugacuucagcuaaugaucuuuucuucagccccacccccuccccacuagcucgauc

SEQ ID NO: 245480 - RNA, 64 nt, hsa
ucccucuguauucccagagugggaucggggcuuucagccccacccugaugccugcccuccagga

SEQ ID NO: 245481 - RNA, 64 nt, hsa
gccuuguggcuagaguacagugggguagacccuccagccccaauagcccuaguacccagcuggc

SEQ ID NO: 245482 - RNA, 64 nt, hsa
ggauguggcccagagaaggaggcugggggaucaccagccccaaggucccgaagggcaggucaga

SEQ ID NO: 245483 - RNA, 64 nt, hsa
uguguugggagcagaggaguccuacuccuugccucagccccacacgguuccuuagcugccgugu

SEQ ID NO: 245484 - RNA, 64 nt, hsa
ucuuggccccacccucuaccccauuccuuccugucagccccagucugucuuggcacuggccagg

SEQ ID NO: 245485 - RNA, 64 nt, hsa
uggguuuacagaaugaggcccuggcuccccaccacagccccagcugccucagagcaggcacagc

SEQ ID NO: 245486 - RNA, 64 nt, hsa
gcugccucagagcaggcacagcacaaggcaggcccagccccaugggccgucacaaaggcuugau

SEQ ID NO: 245487 - RNA, 64 nt, hsa
cugugaggcccuucuucagguuggggugugaggacagccccaucuucaucugcccugcacucac

SEQ ID NO: 245488 - RNA, 64 nt, hsa
uuccagcugccucuuucacacccacuacagaccucagccccaguuuucuccuccucacuaggcu

SEQ ID NO: 245489 - RNA, 64 nt, hsa
aaggggaccugggagaugauggcucauuuccacccagccccaggauuuccagagcgcacaucca

SEQ ID NO: 245490 - RNA, 64 nt, hsa
ugcaggcccucagcccgggcugugccagcccucccagccccaggcccaucugagggaccaagac

SEQ ID NO: 245491 - RNA, 64 nt, hsa
gugccagcggcuucccagcaccugggaggggcugcagccccagcuggacuccagccugucccuc

SEQ ID NO: 245492 - RNA, 64 nt, hsa
uccccugccuaguggggugguaguggcuaccucucagccccaauagucccugcuccucuuagaa

SEQ ID NO: 245493 - RNA, 64 nt, hsa
uuaguggcggcugaucuguagagguaugaaaauacagccccaaagggggaauuugucaugggga

SEQ ID NO: 245494 - RNA, 64 nt, hsa
ucacagaugucaccacagcccugcccuucaugcccagccccaugggacacccgguggucuuucc

SEQ ID NO: 245495 - RNA, 64 nt, hsa
gggcuugcccuggggcacugagacaguuguuuggcagccccagcccagccaggggcucauccuu

SEQ ID NO: 245496 - RNA, 64 nt, hsa
gagccuucucugaaagcaucuuugccucccugaacagccccacccuuguagagcaaaacucuuc

SEQ ID NO: 245497 - RNA, 64 nt, hsa
gggugaggggacagacucugcucucacuggcuggcagccccaggagccuguucccuugccucuc

SEQ ID NO: 245498 - RNA, 64 nt, hsa
agagcgggccucuucccucaguuuuucggugggacagccccagggcccuaacgggggugcggca

SEQ ID NO: 245499 - RNA, 64 nt, hsa
gagagcaguggccgcaagcgcagggaggaugccacagccccacagcacccaggcuccaugggga

SEQ ID NO: 245500 - RNA, 64 nt, hsa
cuaacccggccccuucccccaggagucacugugccagccccaccacauccuggaagaggagggg

SEQ ID NO: 245501 - RNA, 64 nt, hsa
ucccugcuccacccgaccccaccugcggugccuucagccccaaccaaagacacuagugcacccc

SEQ ID NO: 245502 - RNA, 64 nt, hsa
gcacagcuggggaagaucuugcugaccuuguccccagccccaccuggcccuuucuccagcaagc

SEQ ID NO: 245503 - RNA, 64 nt, hsa
augcacagcuuccugagucaccccucugucuaaccagccccagcacaaauggaacucccgaggg

SEQ ID NO: 245504 - RNA, 64 nt, hsa
gcugcucauuuacauuagugugugugcauucguucagccccaugguggugaauucuguuucuuu

SEQ ID NO: 245505 - RNA, 64 nt, hsa
cauuccccuuugcuaaagcaucucacucccagggcagccccagcacccuggcauugcgggaggu

SEQ ID NO: 245506 - RNA, 64 nt, hsa
cagggauaagaacagaggaggcagcagcauugcacagccccaggcacaguggcaguuaggaugg

SEQ ID NO: 245507 - RNA, 64 nt, hsa
aaagaggcuuacgaaaaacuuugccucugaugcucagccccacccccaaauagcacacaagcuu

SEQ ID NO: 245508 - RNA, 64 nt, hsa
cucaguugugaucaggcaggcugugcucucaggacagccccauuuuagggaugaggagacuuca

SEQ ID NO: 245509 - RNA, 64 nt, hsa
cuggcugggaguuagggagcccuggguuggaauccagccccaccucuuuuaugccacagguuug

SEQ ID NO: 245510 - RNA, 64 nt, hsa
gccgcugaccgacugaccucuccucacggaggcccagccccaaagccccagggcuggcccguuu

SEQ ID NO: 245511 - RNA, 64 nt, hsa
uuccuccaccaaggcagcuuuccuuacccugacacagccccagaccccacaaagccuucuggac

SEQ ID NO: 245512 - RNA, 64 nt, hsa
aacagccugcccucccugccggagccggcucugccagccccagauugggaagucuccccgcugg

SEQ ID NO: 245513 - RNA, 64 nt, hsa
ccucuccccagaccacagggggccucucugccuccagccccaccuuccccgggagaagcuuucc

SEQ ID NO: 245514 - RNA, 64 nt, hsa
gccuccaauaucacccugugagccucgcacagcucagccccaacacagaggugagaccaggaau

SEQ ID NO: 245515 - RNA, 64 nt, hsa
ucaaugcccagcagcagcucuggaaggcagugcucagccccaucaccacugucccguggaugcc

SEQ ID NO: 245516 - RNA, 64 nt, hsa
aaguggcccugucacccgugcugcacgggauucacagccccagccccauggccccucuccacac

SEQ ID NO: 245517 - RNA, 64 nt, hsa
cccugucacccgugcugcacgggauucacagccccagccccauggccccucuccacaccucaaa

SEQ ID NO: 245518 - RNA, 64 nt, hsa
cugcaggaaugccaagcaccuggccagagcagcccagccccaauaugcuuaggaggagacagag

SEQ ID NO: 245519 - RNA, 64 nt, hsa
cuuggaagaguuaaaugcuguucagugaagauuucagccccaggccuuugcugcaagugacccu

SEQ ID NO: 245520 - RNA, 64 nt, hsa
cuccccgcaagcuggucccaucgaccagcaagcccagccccagggcgcuuagggagaaaugacc

SEQ ID NO: 245521 - RNA, 64 nt, hsa
aaaaaucagcuuuaaggagcuggcagaaagcccccagccccacagcccugagagaugguguugc

SEQ ID NO: 245522 - RNA, 64 nt, hsa
acuauaauggggcuggaggggcccccacaucucucagccccacuaaugcagaaucccacuaccc

SEQ ID NO: 245523 - RNA, 64 nt, hsa
gccccagguccugcagcaccuuaguccauacuaccagccccacccaccuuccuuccucuucccu

SEQ ID NO: 245524 - RNA, 64 nt, hsa
gccaaagaaaggagaggcaggugcuccuguaccccagccccacucagcacugacaguccccagc

SEQ ID NO: 245525 - RNA, 64 nt, hsa
ccagcugccaaacagcagccugccgggcagggagcagccccaggccagagaggccucccggucc

SEQ ID NO: 245526 - RNA, 64 nt, hsa
ccugcugccacagcccucccccggccccagauagcagccccagggaggaugcugccuccaagag

SEQ ID NO: 245527 - RNA, 64 nt, hsa
gaguuuccuaugguuuacaaagagggccccagcccagccccaccacagaucccagagauagggg

SEQ ID NO: 245528 - RNA, 64 nt, hsa
gcaccucuacuggcaucagucuuugguuaccccccagccccaguaggaggagagcaggcagagc

SEQ ID NO: 245529 - RNA, 64 nt, hsa
augguggcuuucccuaccugacacagccauggcccagccccaaggccaggcugucuacccuaug

SEQ ID NO: 245530 - RNA, 64 nt, hsa
ugggcggccucugggcuugggcaccagcucaugccagccccagagggucaggguuggaggccug

SEQ ID NO: 245531 - RNA, 64 nt, hsa
aguccauggugucaugccaagacaguaucagacacagccccagaagggggcauuaugggcccug

SEQ ID NO: 245532 - RNA, 64 nt, hsa
ucccugaccacaaggccaacugggcgcccguccccagccccacgcacgaccccaagcccgcgga

SEQ ID NO: 245533 - RNA, 64 nt, hsa
gcucaagugcugcuguggcaaagcuccggagccccagccccaaggcuuugacaaccaggcguuc

SEQ ID NO: 245534 - RNA, 64 nt, hsa
acucgggcaaccucaccguggccaggaguguccccagccccaugaccuuccuucugcuggugaa

SEQ ID NO: 245535 - RNA, 64 nt, hsa
gcccaagcccuggggacagguguagggagaaaagcagccccaggccucagacucgcuucccauc

SEQ ID NO: 245536 - RNA, 64 nt, hsa
ccugggagcccccucccugcaaccagccugaguucagccccacggacaaagggacacacagccc

SEQ ID NO: 245537 - RNA, 64 nt, hsa
ucuccgcccuccuuuguguaucaagugucgcucacagccccauucacuggggagccuuucggau

SEQ ID NO: 245538 - RNA, 64 nt, hsa
gagcccguacuguggggauccucacugaccagcccagccccauccgcaagccaggcugggccug

SEQ ID NO: 245539 - RNA, 64 nt, hsa
gccuccagggagggcuggacggcgagcugggagccagccccaggcuccagggccacggcggagu

SEQ ID NO: 245540 - RNA, 64 nt, hsa
ucugaaaggggccugggggcaucucgggcacagacagccccaccuggggcgcucagccuggccc

SEQ ID NO: 245541 - RNA, 64 nt, hsa
agcaccgucccugcccagccccacuucuccaucgcagccccaccuuggcugcugagccaggagc

SEQ ID NO: 245542 - RNA, 64 nt, hsa
ugaccccagugcugcucuaagcaccgucccugcccagccccacuucuccaucgcagccccaccu

SEQ ID NO: 245543 - RNA, 64 nt, hsa
ggagauaguggaagagucaggacagguuggucuccagccccacuucccaaauaugccucagccc

SEQ ID NO: 245544 - RNA, 64 nt, hsa
gguuggucuccagccccacuucccaaauaugccucagccccacuagcuggcaccaacuuaauuc

SEQ ID NO: 245545 - RNA, 64 nt, hsa
cuugggaagggagacgaggugugcuguuccuucccagccccaucccuccccacccuuccuacuc

SEQ ID NO: 245546 - RNA, 64 nt, hsa
cugggggaggaggcaaucgcuguagcugccaggccagccccaucuggaaggagucccugcucug

SEQ ID NO: 245547 - RNA, 64 nt, hsa
gccuggcauccaggcagggacacccucacaccaccagccccagggagcuucccugcuauaaaca

SEQ ID NO: 245548 - RNA, 64 nt, hsa
aucugagcucccugcuuccuauuucauaauccuccagccccagcagguccacuccugguuccug

SEQ ID NO: 245549 - RNA, 64 nt, hsa
uucaccugggggggcccagcacgaagucacaucccagccccagagucacuguccagcccccacc

SEQ ID NO: 245550 - RNA, 64 nt, hsa
cacccccuguuugagguucugagaaggucaagggcagccccagcagcuggauucucaggcuggg

SEQ ID NO: 245551 - RNA, 64 nt, hsa
gcauacuccaaacuuucgcagccaucuucccgcucagccccagacacccagcaaucaagccaga

SEQ ID NO: 245552 - RNA, 64 nt, hsa
cucacugcagccaaaggugcaauuacuugaccugcagccccagcccacccucggcucugcagcc

SEQ ID NO: 245553 - RNA, 64 nt, hsa
uagaaccuuuuguaaaaguugguggcagcagaggcagccccaggccgggcugcaucucucugug

SEQ ID NO: 245554 - RNA, 64 nt, hsa
ucacgagggcagugcaagggagaaccugccagcccagccccaccacagggagagugcgucagca

SEQ ID NO: 245555 - RNA, 64 nt, hsa
gccagagcccccucccucaccuucccuccaccgccagccccagaguuagauuuuaugcuugggc

SEQ ID NO: 245556 - RNA, 64 nt, hsa
cgaacgccuggaacgcucuccguccgccucccugcagccccaucuccuugggcgccaggguccc

SEQ ID NO: 245557 - RNA, 64 nt, hsa
cucuccaggcgugcucaugcccacaacccgcggccagccccacguggugcugcucagccuucuc

SEQ ID NO: 245558 - RNA, 64 nt, hsa
cagaccuuggggucuucuggccagagcuugucaccagccccauggccucuccaggcgugcucau

SEQ ID NO: 245559 - RNA, 64 nt, hsa
cuuucacacuggugaagucuguguacccauacugcagccccaucccauggggccccugaagacc

SEQ ID NO: 245560 - RNA, 64 nt, hsa
ggaaggaggaagggagacugggcccacugauuuccagccccaccaugugugcuguuuucagaug

SEQ ID NO: 245561 - RNA, 64 nt, hsa
aacaagaagaggcuggggaggguuuuccccacgacagccccacggcacagcagaucaugcggcu

SEQ ID NO: 245562 - RNA, 64 nt, hsa
gccuuggcccagaaggagccagaggcagcagccucagccccagggacugggggcgauucugugu

SEQ ID NO: 245563 - RNA, 64 nt, hsa
acagccacggccaggccagagggagugacagaggcagccccauucugccugcccaggccccugc

SEQ ID NO: 245564 - RNA, 64 nt, hsa
ggcagugggagcugccuguucagcuccagcucaccagccccagugcccacaggaucagucugau

SEQ ID NO: 245565 - RNA, 64 nt, hsa
ccagggacagaggggguggccucccaacucaccccagccccaaaacucuccucugcugcuggcu

SEQ ID NO: 245566 - RNA, 64 nt, hsa
gcuggcugguuagagguucccuuugacgccaucccagccccaaugaacaauuauuuauuaaaug

SEQ ID NO: 245567 - RNA, 64 nt, hsa
cagucaccccggccaccugcggugcuaucucccccagccccauccucuguacagagcccacgcc

SEQ ID NO: 245568 - RNA, 64 nt, hsa
ggccccacucacuccauccugugagccccacucccagccccacucacaccaaccugugagcccc

SEQ ID NO: 245569 - RNA, 64 nt, hsa
agccccacucccaccauccugugagccccacucccagccccacucccaccauccugugagcccc

SEQ ID NO: 245570 - RNA, 64 nt, hsa
agccccacucccaccauccugugagccccacuuccagccccacucccaccauccugugagcccc

SEQ ID NO: 245571 - RNA, 64 nt, hsa
agccccauucacuccauccugugagucccacucccagccccacucccaccauccugugagcccc

SEQ ID NO: 245572 - RNA, 64 nt, hsa
cggccccacucacuccaucuuguaagacuaugcccagccccauucacuccauccugugaguccc

SEQ ID NO: 245573 - RNA, 64 nt, hsa
agccccacucacuccauccugugagucccacucccagccccacucccaccauccugugagccca

SEQ ID NO: 245574 - RNA, 64 nt, hsa
cggccccacucccaccaucuuguaagacugugcccagccccacucacuccauccugugaguccc

SEQ ID NO: 245575 - RNA, 64 nt, hsa
cauuuugaacccugcucuauccccugcccucuuccagccccaccccucccuggucuugaaagaa

SEQ ID NO: 245576 - RNA, 64 nt, hsa
auugugugaaccaaagcgucaggggcuuggggcacagccccagucagcucaacccaguccugcu

SEQ ID NO: 245577 - RNA, 64 nt, hsa
agcgaaaacugccaggaugaaugaggaaaaaacccagccccacaaacgagacacacgcuggcgg

SEQ ID NO: 245578 - RNA, 64 nt, hsa
ggcccuggagaccuccaggcuuuccugcccugggcagccccaccucacagccagagucaaugcc

SEQ ID NO: 245579 - RNA, 50 nt, hsa
cccuucuccaggaagaguaacagccccaggagguauugaaggacaggaga

SEQ ID NO: 245580 - RNA, 64 nt, hsa
gcaggacuaagguggcuuucccacuccuggcccacagccccagagagccugucugugcauccug

SEQ ID NO: 245581 - RNA, 64 nt, hsa
guugaggauaagcccacuuuccugucauuaguggcagccccagauccagaccuaggccuccugg

SEQ ID NO: 245582 - RNA, 64 nt, hsa
gggccagguguugacaccuuaaagcuggcgcccccagccccacucuuggcugugcuggccaggu

SEQ ID NO: 245583 - RNA, 64 nt, hsa
uucugucucucugagggaaucagaguccagcauccagccccagcuggaacagcugaagucacaa

SEQ ID NO: 245584 - RNA, 64 nt, hsa
gaacaggaaagggucacguggucccauguugcaacagccccaacaucacgcaugucauucacug

SEQ ID NO: 245585 - RNA, 64 nt, hsa
acacacaagcucucagccacaggcagcuucuccacagccccagcuucgcacaggcuccuggagg

SEQ ID NO: 245586 - RNA, 64 nt, hsa
gggcaccuucgcgucucagccucagggagccccacagccccaagcucgcugaggcaacgugaga

SEQ ID NO: 245587 - RNA, 64 nt, hsa
gucuuuugugccaccuuguacaaagccggcugcccagccccagccucaccaccgcaucccaccu

SEQ ID NO: 245588 - RNA, 64 nt, hsa
uggcccugggagaaucgcuccugcagccccagcccagccccacuccucugcugaccugcugacc

SEQ ID NO: 245589 - RNA, 64 nt, hsa
acuggcucuccuggcccugggagaaucgcuccugcagccccagcccagccccacuccucugcug

SEQ ID NO: 245590 - RNA, 64 nt, hsa
aaagccaaccaugcccagccccucccagcacccccagccccacgaccaucguucugaauucuga

SEQ ID NO: 245591 - RNA, 64 nt, hsa
agacugaagccccagugugcgcagcucgagccaccagccccagccuggaaggaccagguucuuu

SEQ ID NO: 245592 - RNA, 64 nt, hsa
uguacacacaguguuucauugcuccgcgucuucccagccccagaaaccggcuaaaggacccugc

SEQ ID NO: 245593 - RNA, 64 nt, hsa
agggcccaggaccagaaucgcugccuccucuccccagccccaccuuguacacacaguguuucau

SEQ ID NO: 245594 - RNA, 64 nt, hsa
gcuccaaggcuugccccagaggccacauggccaccagccccagcugccaucagauucaagccca

SEQ ID NO: 245595 - RNA, 64 nt, hsa
gaugucccuccccucaugagcgugcaacagggagcagccccagccagccccaccgccgccgucu

SEQ ID NO: 245596 - RNA, 64 nt, hsa
cccucaugagcgugcaacagggagcagccccagccagccccaccgccgccgucugcguggaugg

SEQ ID NO: 245597 - RNA, 64 nt, hsa
aguuucuuguuuuggugccugaccgaaccaacgacagccccaaucuucccgucuuuaugagaga

SEQ ID NO: 245598 - RNA, 64 nt, hsa
uuccuucuccuuugaggggggagagagaacagugcagccccauuuccgguccugcuaccucacc

SEQ ID NO: 245599 - RNA, 64 nt, hsa
gacugagacgcaugagugccuucuggggugagagcagccccaggguuuaaguugggcguccuag

SEQ ID NO: 245600 - RNA, 64 nt, hsa
cuaaugagggcuuugcagggauuguuuucauucucagccccagcugugggagugcggguggggg

SEQ ID NO: 245601 - RNA, 64 nt, hsa
gaggguuggguggauggagcucagaaggaaaccccagccccaccacggaugacaccaucccucc

SEQ ID NO: 245602 - RNA, 64 nt, hsa
accuccauccccaacccauccucauccccaacuacagccccaaacccagccccagacuaaucca

SEQ ID NO: 245603 - RNA, 64 nt, hsa
aacccauccucauccccaacuacagccccaaacccagccccagacuaauccacagccaucccca

SEQ ID NO: 245604 - RNA, 64 nt, hsa
acagccauccccaacucauccucauccccaacugcagccccaaacccaacccagggccaucccc

SEQ ID NO: 245605 - RNA, 64 nt, hsa
agcccuggccacauccccauccucccccaaccuccagccccaacacccaucaucccccugagcu

SEQ ID NO: 245606 - RNA, 64 nt, hsa
ggugggugguggcuuauaacuguaagggagauggcagccccaggguacagccagcaggcauuga

SEQ ID NO: 245607 - RNA, 64 nt, hsa
aaccaggagagggcuggagggagggagauggucucagccccacagaguuuggaguccucagugu

SEQ ID NO: 245608 - RNA, 64 nt, hsa
caggcccagggugggguggaugggcccaaaggcccagccccacacuccuuucccguccacuugu

SEQ ID NO: 245609 - RNA, 64 nt, hsa
agagagagaaggggcccaagagagacagcacaggcagccccacggacgacgcgagggccccacg

SEQ ID NO: 245610 - RNA, 64 nt, hsa
accugcagggcugaaguucacucaucgaccgacucagccccaaccgggagccaggcagaaaaac

SEQ ID NO: 245611 - RNA, 64 nt, hsa
aaaugucaggcacuucccucuaacuggcaugcaacagccccaccugccugagagcccugaggug

SEQ ID NO: 245612 - RNA, 64 nt, hsa
ucccccagccucugccacccuccaccuccucggucagccccagccccagguugauaaaucuauu

SEQ ID NO: 245613 - RNA, 64 nt, hsa
agccucugccacccuccaccuccucggucagccccagccccagguugauaaaucuauugauuga

SEQ ID NO: 245614 - RNA, 64 nt, hsa
aauucccuccugagugccccacuucuggccacaucagccccacaggacuuugaugaagaccauu

SEQ ID NO: 245615 - RNA, 64 nt, hsa
ugugacuaacuaugcaauaauccacccccaggugcagccccagggccugcggaggcgguggcag

SEQ ID NO: 245616 - RNA, 64 nt, hsa
gacccacugccccaucucccucuccccaccaagacagccccagaaggagcagccagcugggaug

SEQ ID NO: 245617 - RNA, 64 nt, hsa
gguguuggaagggcagcggguaagguucccaagccagccccaacacccuucccacuuggcaccc

SEQ ID NO: 245618 - RNA, 64 nt, hsa
ugcucauccacaggguuuucucacugcuaugaaccagccccacagccccaggccccugucaccu

SEQ ID NO: 245619 - RNA, 64 nt, hsa
cacaggguuuucucacugcuaugaaccagccccacagccccaggccccugucaccuggcuaugc

SEQ ID NO: 245620 - RNA, 64 nt, hsa
uggagggccgggugguggcucugaggaugguccccagccccacccuguccccacccuggccugu

SEQ ID NO: 245621 - RNA, 64 nt, hsa
ccccuguacuaccuccugggccaagaaacuggcacagccccacacugucagugccaagaggcug

SEQ ID NO: 245622 - RNA, 64 nt, hsa
ugaccacgugggggucagucgggggcaaggggcucagccccacuggacucugggcugcagaggc

SEQ ID NO: 245623 - RNA, 64 nt, hsa
gcuugaagugaaggaacagaggcagggggugggccagccccagggccaggguccccuuggugaa

SEQ ID NO: 245624 - RNA, 64 nt, hsa
uguagcgguuugaauguugguuccaugccuggcccagccccaccucagucuccaggacauuccu

SEQ ID NO: 245625 - RNA, 64 nt, hsa
ggggacagagccucagggagccccgagcaugguccagccccauuugagugcucuccggggaugc

SEQ ID NO: 245626 - RNA, 64 nt, hsa
ugggcacccccauugguucgugugagcagcugcccagccccaggccugcccucggccuggucca

SEQ ID NO: 245627 - RNA, 64 nt, hsa
gaggaccgacuccaggaguccccuuucccugucccagccccaucuguggguugcacuuacaaac

SEQ ID NO: 245628 - RNA, 64 nt, hsa
ccuauuaaggagguccaaggggugagucccaacccagccccagaauauauuuguuuuugcaccu

SEQ ID NO: 245629 - RNA, 64 nt, hsa
agcucaccucugguagccauagcagccccugcuucagccccaccgcaccccuccagggggccug

SEQ ID NO: 245630 - RNA, 64 nt, hsa
ugagucuguuguguggaugugcgugugugguccccagccccagacuggauuggaaaagugcaug

SEQ ID NO: 245631 - RNA, 64 nt, hsa
agccuugaaccuaggaccaagagccaccuacauccagccccaaaacuggggcuucaggccagag

SEQ ID NO: 245632 - RNA, 64 nt, hsa
aaacaggacaucugugaccgcccuacccccacgccagccccaaacuaagauaucccucacaccc

SEQ ID NO: 245633 - RNA, 64 nt, hsa
cccgaagcaugaacagugcaccugggacagggagcagccccaaauugucaccugcuucucugcc

SEQ ID NO: 245634 - RNA, 64 nt, hsa
cucugccugcccuuuguccuccugcugccaguaccagccccacccuguuuugagcccugaggag

SEQ ID NO: 245635 - RNA, 64 nt, hsa
ucccacccgugguggcucaagucuggccccacaccagccccaauccaaaacuggcaaggacgcu

SEQ ID NO: 245636 - RNA, 64 nt, hsa
ugucugucuucuucuacacggcaugugccugcaccagccccaacaccugagcugguuuagcgca

SEQ ID NO: 245637 - RNA, 64 nt, hsa
cacaccuguccauacccgaggguggauauucaaccagccccaccgccuacccgacucgguuucu

SEQ ID NO: 245638 - RNA, 64 nt, hsa; identical to SEQ ID NO: 51593

SEQ ID NO: 245639 - RNA, 64 nt, hsa; identical to SEQ ID NO: 51594

SEQ ID NO: 245640 - RNA, 64 nt, hsa; identical to SEQ ID NO: 166002

SEQ ID NO: 245641 - RNA, 64 nt, hsa; identical to SEQ ID NO: 166003

SEQ ID NO: 245642 - RNA, 64 nt, hsa; identical to SEQ ID NO: 166004

SEQ ID NO: 245643 - RNA, 64 nt, hsa; identical to SEQ ID NO: 166005

SEQ ID NO: 245644 - RNA, 64 nt, hsa; identical to SEQ ID NO: 166006

SEQ ID NO: 245645 - RNA, 64 nt, hsa; identical to SEQ ID NO: 166007

SEQ ID NO: 245646 - RNA, 64 nt, hsa; identical to SEQ ID NO: 166008

SEQ ID NO: 245647 - RNA, 64 nt, hsa; identical to SEQ ID NO: 166009

SEQ ID NO: 245648 - RNA, 64 nt, hsa; identical to SEQ ID NO: 166010

SEQ ID NO: 245649 - RNA, 60 nt, hsa; identical to SEQ ID NO: 166011

SEQ ID NO: 245650 - RNA, 64 nt, hsa; identical to SEQ ID NO: 166012

SEQ ID NO: 245651 - RNA, 63 nt, hsa; identical to SEQ ID NO: 91030

SEQ ID NO: 245652 - RNA, 63 nt, hsa; identical to SEQ ID NO: 91031

SEQ ID NO: 245653 - RNA, 63 nt, hsa; identical to SEQ ID NO: 91032

SEQ ID NO: 245654 - RNA, 63 nt, hsa; identical to SEQ ID NO: 91033

SEQ ID NO: 245655 - RNA, 63 nt, hsa; identical to SEQ ID NO: 91034

SEQ ID NO: 245656 - RNA, 63 nt, hsa; identical to SEQ ID NO: 91035

SEQ ID NO: 245657 - RNA, 63 nt, hsa; identical to SEQ ID NO: 91036

SEQ ID NO: 245658 - RNA, 63 nt, hsa; identical to SEQ ID NO: 91037

SEQ ID NO: 245659 - RNA, 63 nt, hsa; identical to SEQ ID NO: 91038

SEQ ID NO: 245660 - RNA, 63 nt, hsa; identical to SEQ ID NO: 91039

SEQ ID NO: 245661 - RNA, 63 nt, hsa; identical to SEQ ID NO: 91040

SEQ ID NO: 245662 - RNA, 63 nt, hsa; identical to SEQ ID NO: 91041

SEQ ID NO: 245663 - RNA, 63 nt, hsa; identical to SEQ ID NO: 91042

SEQ ID NO: 245664 - RNA, 63 nt, hsa; identical to SEQ ID NO: 91043

SEQ ID NO: 245665 - RNA, 63 nt, hsa; identical to SEQ ID NO: 91044

SEQ ID NO: 245666 - RNA, 63 nt, hsa; identical to SEQ ID NO: 91045

SEQ ID NO: 245667 - RNA, 63 nt, hsa; identical to SEQ ID NO: 91046

SEQ ID NO: 245668 - RNA, 63 nt, hsa; identical to SEQ ID NO: 91047

SEQ ID NO: 245669 - RNA, 63 nt, hsa; identical to SEQ ID NO: 91048

SEQ ID NO: 245670 - RNA, 63 nt, hsa; identical to SEQ ID NO: 91049

SEQ ID NO: 245671 - RNA, 63 nt, hsa; identical to SEQ ID NO: 91050

SEQ ID NO: 245672 - RNA, 63 nt, hsa; identical to SEQ ID NO: 91051

SEQ ID NO: 245673 - RNA, 63 nt, hsa; identical to SEQ ID NO: 91052

SEQ ID NO: 245674 - RNA, 63 nt, hsa; identical to SEQ ID NO: 91053

SEQ ID NO: 245675 - RNA, 63 nt, hsa; identical to SEQ ID NO: 91054

SEQ ID NO: 245676 - RNA, 63 nt, hsa; identical to SEQ ID NO: 91055

SEQ ID NO: 245677 - RNA, 63 nt, hsa; identical to SEQ ID NO: 91056

SEQ ID NO: 245678 - RNA, 63 nt, hsa; identical to SEQ ID NO: 91057

SEQ ID NO: 245679 - RNA, 63 nt, hsa; identical to SEQ ID NO: 91058

SEQ ID NO: 245680 - RNA, 63 nt, hsa; identical to SEQ ID NO: 91059

SEQ ID NO: 245681 - RNA, 63 nt, hsa; identical to SEQ ID NO: 91060

SEQ ID NO: 245682 - RNA, 63 nt, hsa; identical to SEQ ID NO: 91061

SEQ ID NO: 245683 - RNA, 63 nt, hsa; identical to SEQ ID NO: 91062

SEQ ID NO: 245684 - RNA, 63 nt, hsa; identical to SEQ ID NO: 91063

SEQ ID NO: 245685 - RNA, 63 nt, hsa; identical to SEQ ID NO: 91064

SEQ ID NO: 245686 - RNA, 63 nt, hsa; identical to SEQ ID NO: 91065

SEQ ID NO: 245687 - RNA, 63 nt, hsa; identical to SEQ ID NO: 91066

SEQ ID NO: 245688 - RNA, 63 nt, hsa; identical to SEQ ID NO: 91067

SEQ ID NO: 245689 - RNA, 63 nt, hsa; identical to SEQ ID NO: 91068

SEQ ID NO: 245690 - RNA, 63 nt, hsa; identical to SEQ ID NO: 91069

SEQ ID NO: 245691 - RNA, 63 nt, hsa; identical to SEQ ID NO: 91070

SEQ ID NO: 245692 - RNA, 63 nt, hsa; identical to SEQ ID NO: 91071

SEQ ID NO: 245693 - RNA, 63 nt, hsa; identical to SEQ ID NO: 91072

SEQ ID NO: 245694 - RNA, 63 nt, hsa; identical to SEQ ID NO: 91073

SEQ ID NO: 245695 - RNA, 63 nt, hsa; identical to SEQ ID NO: 91074

SEQ ID NO: 245696 - RNA, 63 nt, hsa; identical to SEQ ID NO: 91075

SEQ ID NO: 245697 - RNA, 63 nt, hsa; identical to SEQ ID NO: 91076

SEQ ID NO: 245698 - RNA, 63 nt, hsa; identical to SEQ ID NO: 91077

SEQ ID NO: 245699 - RNA, 63 nt, hsa; identical to SEQ ID NO: 91078

SEQ ID NO: 245700 - RNA, 63 nt, hsa; identical to SEQ ID NO: 91079

SEQ ID NO: 245701 - RNA, 63 nt, hsa; identical to SEQ ID NO: 91080

SEQ ID NO: 245702 - RNA, 63 nt, hsa; identical to SEQ ID NO: 91081

SEQ ID NO: 245703 - RNA, 63 nt, hsa; identical to SEQ ID NO: 91082

SEQ ID NO: 245704 - RNA, 63 nt, hsa; identical to SEQ ID NO: 91083

SEQ ID NO: 245705 - RNA, 63 nt, hsa; identical to SEQ ID NO: 91084

SEQ ID NO: 245706 - RNA, 63 nt, hsa; identical to SEQ ID NO: 91085

SEQ ID NO: 245707 - RNA, 63 nt, hsa; identical to SEQ ID NO: 91086

SEQ ID NO: 245708 - RNA, 63 nt, hsa; identical to SEQ ID NO: 91087

SEQ ID NO: 245709 - RNA, 63 nt, hsa; identical to SEQ ID NO: 91088

SEQ ID NO: 245710 - RNA, 63 nt, hsa; identical to SEQ ID NO: 91089

SEQ ID NO: 245711 - RNA, 63 nt, hsa; identical to SEQ ID NO: 91090

SEQ ID NO: 245712 - RNA, 63 nt, hsa; identical to SEQ ID NO: 91091

SEQ ID NO: 245713 - RNA, 63 nt, hsa; identical to SEQ ID NO: 91092

SEQ ID NO: 245714 - RNA, 63 nt, hsa; identical to SEQ ID NO: 91093

SEQ ID NO: 245715 - RNA, 63 nt, hsa; identical to SEQ ID NO: 91094

SEQ ID NO: 245716 - RNA, 63 nt, hsa; identical to SEQ ID NO: 91095

SEQ ID NO: 245717 - RNA, 63 nt, hsa; identical to SEQ ID NO: 91096

SEQ ID NO: 245718 - RNA, 63 nt, hsa; identical to SEQ ID NO: 91097

SEQ ID NO: 245719 - RNA, 63 nt, hsa; identical to SEQ ID NO: 91098

SEQ ID NO: 245720 - RNA, 63 nt, hsa; identical to SEQ ID NO: 91099

SEQ ID NO: 245721 - RNA, 63 nt, hsa; identical to SEQ ID NO: 91100

SEQ ID NO: 245722 - RNA, 63 nt, hsa; identical to SEQ ID NO: 91101

SEQ ID NO: 245723 - RNA, 63 nt, hsa; identical to SEQ ID NO: 91102

SEQ ID NO: 245724 - RNA, 63 nt, hsa; identical to SEQ ID NO: 91103

SEQ ID NO: 245725 - RNA, 63 nt, hsa; identical to SEQ ID NO: 91104

SEQ ID NO: 245726 - RNA, 63 nt, hsa; identical to SEQ ID NO: 91105

SEQ ID NO: 245727 - RNA, 63 nt, hsa; identical to SEQ ID NO: 91106

SEQ ID NO: 245728 - RNA, 63 nt, hsa; identical to SEQ ID NO: 91107

SEQ ID NO: 245729 - RNA, 63 nt, hsa; identical to SEQ ID NO: 91108

SEQ ID NO: 245730 - RNA, 63 nt, hsa; identical to SEQ ID NO: 91109

SEQ ID NO: 245731 - RNA, 63 nt, hsa; identical to SEQ ID NO: 91110

SEQ ID NO: 245732 - RNA, 63 nt, hsa; identical to SEQ ID NO: 91111

SEQ ID NO: 245733 - RNA, 63 nt, hsa; identical to SEQ ID NO: 91112

SEQ ID NO: 245734 - RNA, 63 nt, hsa; identical to SEQ ID NO: 91113

SEQ ID NO: 245735 - RNA, 63 nt, hsa; identical to SEQ ID NO: 91114

SEQ ID NO: 245736 - RNA, 63 nt, hsa; identical to SEQ ID NO: 91115

SEQ ID NO: 245737 - RNA, 63 nt, hsa; identical to SEQ ID NO: 91116

SEQ ID NO: 245738 - RNA, 63 nt, hsa; identical to SEQ ID NO: 91117

SEQ ID NO: 245739 - RNA, 63 nt, hsa; identical to SEQ ID NO: 91118

SEQ ID NO: 245740 - RNA, 63 nt, hsa; identical to SEQ ID NO: 91119

SEQ ID NO: 245741 - RNA, 63 nt, hsa; identical to SEQ ID NO: 91120

SEQ ID NO: 245742 - RNA, 63 nt, hsa; identical to SEQ ID NO: 91121

SEQ ID NO: 245743 - RNA, 63 nt, hsa; identical to SEQ ID NO: 91122

SEQ ID NO: 245744 - RNA, 63 nt, hsa; identical to SEQ ID NO: 91123

SEQ ID NO: 245745 - RNA, 63 nt, hsa; identical to SEQ ID NO: 91124

SEQ ID NO: 245746 - RNA, 63 nt, hsa; identical to SEQ ID NO: 91125

SEQ ID NO: 245747 - RNA, 63 nt, hsa; identical to SEQ ID NO: 91126

SEQ ID NO: 245748 - RNA, 63 nt, hsa; identical to SEQ ID NO: 91127

SEQ ID NO: 245749 - RNA, 63 nt, hsa; identical to SEQ ID NO: 91128

SEQ ID NO: 245750 - RNA, 63 nt, hsa; identical to SEQ ID NO: 91129

SEQ ID NO: 245751 - RNA, 63 nt, hsa; identical to SEQ ID NO: 91130

SEQ ID NO: 245752 - RNA, 63 nt, hsa; identical to SEQ ID NO: 91131

SEQ ID NO: 245753 - RNA, 63 nt, hsa; identical to SEQ ID NO: 91132

SEQ ID NO: 245754 - RNA, 63 nt, hsa; identical to SEQ ID NO: 91133

SEQ ID NO: 245755 - RNA, 63 nt, hsa; identical to SEQ ID NO: 91134

SEQ ID NO: 245756 - RNA, 64 nt, hsa
ucauagcucugggaauggaaugcgccccucguggagagccuauaaacggaugcauggaaggcgc

SEQ ID NO: 245757 - RNA, 64 nt, hsa
agaaugagccaacagcacuugcuucccccuguagagagccuaugaauggacgugcagucaggga

SEQ ID NO: 245758 - RNA, 64 nt, hsa
agcuacuucucuacccuugacauccagcuucgcgagagccuagagccagaugccuaugcguugu

SEQ ID NO: 245759 - RNA, 64 nt, hsa
gcuacaaugccuuuuacgccaagaauaaauguccagagccuaacugcagggugaaaaagucccu

SEQ ID NO: 245760 - RNA, 64 nt, hsa
cucccaggauuccaauuuuaauuggagagcuaaguaaguaaaguuuuauaacuguuagguuucu

SEQ ID NO: 245761 - RNA, 64 nt, hsa
ccuuauacuuucuauuuuaaguauaucuguuucuuaaguaaacaacuuagauauuuuccacacc

SEQ ID NO: 245762 - RNA, 64 nt, hsa
auaaauuugacagauagcuauuuacauagccuucuaaguaaaggcaaugaauucuccauuuccu

SEQ ID NO: 245763 - RNA, 64 nt, hsa
aaaauacagaaacaguuuauguauaggauagcuauaaguaaauacugaaacacauuaugccucu

SEQ ID NO: 245764 - RNA, 64 nt, hsa
gggugacaaaaugagacauugucucuaaaauacauaaguaaauuuaaaaaaaaaagaauaauaa

SEQ ID NO: 245765 - RNA, 64 nt, hsa
auugaaaaacuaguaagcaaauaaaugauaaacauaaguaaauuuaaacuguuguuuguauaaa

SEQ ID NO: 245766 - RNA, 64 nt, hsa
augguaggaaaacagacuuugcucuguacagaaguaaguaaaaguaggaauaguuuccauggau

SEQ ID NO: 245767 - RNA, 64 nt, hsa
gauuuuaaguuaaagaauauggaauauaguaaaauaaguaaauuucuuuuggaauauuuuuagu

SEQ ID NO: 245768 - RNA, 64 nt, hsa
uaugugucaucuaacagaaaugacuccuuugaaauaaguaaaucuuuggcuuuuuguucuguug

SEQ ID NO: 245769 - RNA, 64 nt, hsa
gcacauugccaagaauuacugucaagagaaaugauaaguaaaagucauuuaugaaaauaaagau

SEQ ID NO: 245770 - RNA, 64 nt, hsa
auugagagauuuuucuuaguaaauagauuauuguuaaguaaauaguuauuaaaaauauaucuca

SEQ ID NO: 245771 - RNA, 64 nt, hsa
gcuuuacaaauaaacauacacaugcucaguuuuuuaaguaaaccuguaaaauacccaggaaggc

SEQ ID NO: 245772 - RNA, 64 nt, hsa
uuuuguucaauguaaauugaagaaaaucuguaaguaaguaaaccuuaagugugaaacuaaacau

SEQ ID NO: 245773 - RNA, 64 nt, hsa
ugauacauaccuaaguaaacauaacauuaauaccuaaguaaacauaacauuacuuggaggguug

SEQ ID NO: 245774 - RNA, 64 nt, hsa
ucugcuuuggaaauuauugccucugauacauaccuaaguaaacauaacauuaauaccuaaguaa

SEQ ID NO: 245775 - RNA, 64 nt, hsa
agcggagagaacacagaguggaaucagcccccuguaaguaaaaggguagagaaagagaugugug

SEQ ID NO: 245776 - RNA, 64 nt, hsa
uuggcaaguguagaggcugccucugugugugguuuaaguaaacuggaaaugagacauugacgug

SEQ ID NO: 245777 - RNA, 64 nt, hsa
ucugcucuauuuagauuuauuuuaaaaguuuauuuaaguaaauauuuuuauaaaaaccagaaaa

SEQ ID NO: 245778 - RNA, 64 nt, hsa
guuaaaggucugaagcagcuguuuagauucacuguaaguaaacuuugguaacucuaauggggau

SEQ ID NO: 245779 - RNA, 64 nt, hsa
auuuuuaauuuuuauguuauguuuugcuuuguuuuaaguaaacaaaaauuuuucuuucuuuacu

SEQ ID NO: 245780 - RNA, 64 nt, hsa
gucgacggugaauguucuggugguuguugccuguuaaguaaacuuuaguguguaaguugaguuu

SEQ ID NO: 245781 - RNA, 64 nt, hsa
uagacagucaaucagauaagaaguauacuuugauuaaguaaaaaaaaucccuauucuuggaaaa

SEQ ID NO: 245782 - RNA, 64 nt, hsa
ggauaauuuauagacaguuaaauuuauagacaguuaaguaaaaauggauaauuuauagacagau

SEQ ID NO: 245783 - RNA, 64 nt, hsa
uaucaguguuuuagaaacaugaguccggacuguguaaguaaaaguacaaacauuauuuccacca

SEQ ID NO: 245784 - RNA, 64 nt, hsa
uuuuaagcaaggauguucaaaaucuuacauauaauaaguaaaaaguaagacugaaugucuacgu

SEQ ID NO: 245785 - RNA, 64 nt, hsa
ugcucuaaaaaaugaaguguauuaaguaaauaaauaaguaaauaaccaaccaacccugaggaac

SEQ ID NO: 245786 - RNA, 64 nt, hsa
uaacccuaaagcugcucuaaaaaaugaaguguauuaaguaaauaaauaaguaaauaaccaacca

SEQ ID NO: 245787 - RNA, 64 nt, hsa
uauuugacuuuucauaaguaguggaagguuucacuaaguaaaacucucaguuucuugguaucug

SEQ ID NO: 245788 - RNA, 64 nt, hsa
uauuugacuuuucauaaguaguggaagguuucacuaaguaaagaucugaguuucuugguaucug

SEQ ID NO: 245789 - RNA, 64 nt, hsa
uauuuauaacugaagaguauaacacuuaucuucuuaaguaaaugcucucauaacuuguauacau

SEQ ID NO: 245790 - RNA, 64 nt, hsa
ccuuguauuuaaaaggguuucaugaauggaaaccuaaguaaaacuaagcucauuagugacagac

SEQ ID NO: 245791 - RNA, 64 nt, hsa
guuuauuaugagcauuuugcagaaagguguggaguaaguaaaguguuggaugcacugaacaauu

SEQ ID NO: 245792 - RNA, 64 nt, hsa
auaaguagaacacugaagauuugaauuugauauuuaaguaaaaugggacugggugcaguggcuc

SEQ ID NO: 245793 - RNA, 64 nt, hsa
uagagguuaaaaaggaggagcuagauucauauccuaaguaaagagaaaugccuagugucuauuu

SEQ ID NO: 245794 - RNA, 64 nt, hsa
acuuuaucaauguauaauuaacaauuaucuuguuuaaguaaauuuagaauacauuuaaguauug

SEQ ID NO: 245795 - RNA, 64 nt, hsa
uugguagauauucaggaaauguucacugaauaaauaaguaaauacauuauugaaaagcaaaucu

SEQ ID NO: 245796 - RNA, 64 nt, hsa
acuaugauuccaauuacuacuuuguuauuguaccuaaguaaauuuucuuuaagucagaagccca

SEQ ID NO: 245797 - RNA, 64 nt, hsa
ugguaauuuuuaccaaaacugaagcugguaauuuuaaguaaagcaacuaaauuuacccuuuacu

SEQ ID NO: 245798 - RNA, 64 nt, hsa
aggcuuuugcaggaauuuaacuuaaauaauuauuuaaguaaauucauaagagucagugcauuuu

SEQ ID NO: 245799 - RNA, 64 nt, hsa
agauaaauugacaagacuaaucaguauuuuauuauaaguaaaagauuuuucuucuuuccuuaaa

SEQ ID NO: 245800 - RNA, 64 nt, hsa
uuuguucuaacaggacaguagaacacuugcaagguaaguaaaaccaaauguauuagcauuauuc

SEQ ID NO: 245801 - RNA, 64 nt, hsa
auaacacauuuauguucucguuuuucuacagauauaaguaaauuuauauauaaaaauaccaaaa

SEQ ID NO: 245802 - RNA, 64 nt, hsa
ggaacucuacauuuuguaucuuuuaaagcuccuauaaguaaaauaacuauuggcuuuauuaaaa

SEQ ID NO: 245803 - RNA, 64 nt, hsa
uaguuauuuuucuuuucacuuuuuauaguugacauaaguaaauuuauuuauugagucaauuugu

SEQ ID NO: 245804 - RNA, 64 nt, hsa
uauucugcauuaugagaaaacuuaauuucauuuauaaguaaauuaaaauuaguauauuuuacua

SEQ ID NO: 245805 - RNA, 64 nt, hsa
ucauuuuaaaugcucaaagaguugcccuauauaugcauguuauccauuauaaaugcacucagca

SEQ ID NO: 245806 - RNA, 64 nt, hsa
cauauguuccacuuauugcuuuguuagucaaaaugcauguuauguagaaaauggucaauggcaa

SEQ ID NO: 245807 - RNA, 64 nt, hsa
uguguaugaacugugauaacuguugcccuugugggcauguuauauagggcuggcucuaggaaga

SEQ ID NO: 245808 - RNA, 64 nt, hsa
uacauuugucacauucagcuuugagccacuguaagcauguuacuauuaaaugguugguuauuuu

SEQ ID NO: 245809 - RNA, 64 nt, hsa
ggauaauuggggacuucugcucaacauggcaguggcauguuaggcauguuagggcuugaggugg

SEQ ID NO: 245810 - RNA, 64 nt, hsa
gggacuucugcucaacauggcaguggcauguuaggcauguuagggcuugagguggggcauucac

SEQ ID NO: 245811 - RNA, 64 nt, hsa
aaaauuuuuaugucuuaaucuaacucuauaguaggcauguuauguuguucuuauuacccugauu

SEQ ID NO: 245812 - RNA, 64 nt, hsa
uucucacaacaaaccuauuguagaggugaguaaggcauguuacuacagaggaaaguuugagagu

SEQ ID NO: 245813 - RNA, 64 nt, hsa; identical to SEQ ID NO: 143712

SEQ ID NO: 245814 - RNA, 64 nt, hsa; identical to SEQ ID NO: 143713

SEQ ID NO: 245815 - RNA, 64 nt, hsa; identical to SEQ ID NO: 143714

SEQ ID NO: 245816 - RNA, 64 nt, hsa; identical to SEQ ID NO: 143715

SEQ ID NO: 245817 - RNA, 64 nt, hsa; identical to SEQ ID NO: 143716

SEQ ID NO: 245818 - RNA, 64 nt, hsa; identical to SEQ ID NO: 143717

SEQ ID NO: 245819 - RNA, 64 nt, hsa; identical to SEQ ID NO: 143718

SEQ ID NO: 245820 - RNA, 64 nt, hsa; identical to SEQ ID NO: 143719

SEQ ID NO: 245821 - RNA, 64 nt, hsa; identical to SEQ ID NO: 143720

SEQ ID NO: 245822 - RNA, 64 nt, hsa; identical to SEQ ID NO: 143721

SEQ ID NO: 245823 - RNA, 64 nt, hsa; identical to SEQ ID NO: 143722

SEQ ID NO: 245824 - RNA, 64 nt, hsa; identical to SEQ ID NO: 143723

SEQ ID NO: 245825 - RNA, 64 nt, hsa; identical to SEQ ID NO: 143724

SEQ ID NO: 245826 - RNA, 64 nt, hsa; identical to SEQ ID NO: 143725

SEQ ID NO: 245827 - RNA, 64 nt, hsa; identical to SEQ ID NO: 143726

SEQ ID NO: 245828 - RNA, 64 nt, hsa; identical to SEQ ID NO: 143727

SEQ ID NO: 245829 - RNA, 64 nt, hsa; identical to SEQ ID NO: 143728

SEQ ID NO: 245830 - RNA, 64 nt, hsa; identical to SEQ ID NO: 143729

SEQ ID NO: 245831 - RNA, 64 nt, hsa; identical to SEQ ID NO: 143730

SEQ ID NO: 245832 - RNA, 64 nt, hsa; identical to SEQ ID NO: 143731

SEQ ID NO: 245833 - RNA, 64 nt, hsa; identical to SEQ ID NO: 143732

SEQ ID NO: 245834 - RNA, 64 nt, hsa; identical to SEQ ID NO: 143733

SEQ ID NO: 245835 - RNA, 64 nt, hsa; identical to SEQ ID NO: 143734

SEQ ID NO: 245836 - RNA, 64 nt, hsa; identical to SEQ ID NO: 143735

SEQ ID NO: 245837 - RNA, 64 nt, hsa; identical to SEQ ID NO: 143736

SEQ ID NO: 245838 - RNA, 64 nt, hsa; identical to SEQ ID NO: 143737

SEQ ID NO: 245839 - RNA, 64 nt, hsa; identical to SEQ ID NO: 143738

SEQ ID NO: 245840 - RNA, 64 nt, hsa; identical to SEQ ID NO: 143739

SEQ ID NO: 245841 - RNA, 64 nt, hsa; identical to SEQ ID NO: 143740

SEQ ID NO: 245842 - RNA, 64 nt, hsa; identical to SEQ ID NO: 143741

SEQ ID NO: 245843 - RNA, 64 nt, hsa; identical to SEQ ID NO: 143742

SEQ ID NO: 245844 - RNA, 64 nt, hsa; identical to SEQ ID NO: 143743

SEQ ID NO: 245845 - RNA, 64 nt, hsa; identical to SEQ ID NO: 143744

SEQ ID NO: 245846 - RNA, 64 nt, hsa; identical to SEQ ID NO: 143745

SEQ ID NO: 245847 - RNA, 64 nt, hsa; identical to SEQ ID NO: 143746

SEQ ID NO: 245848 - RNA, 64 nt, hsa; identical to SEQ ID NO: 143747

SEQ ID NO: 245849 - RNA, 64 nt, hsa; identical to SEQ ID NO: 143748

SEQ ID NO: 245850 - RNA, 64 nt, hsa; identical to SEQ ID NO: 143749

SEQ ID NO: 245851 - RNA, 64 nt, hsa; identical to SEQ ID NO: 143750

SEQ ID NO: 245852 - RNA, 64 nt, hsa; identical to SEQ ID NO: 143751

SEQ ID NO: 245853 - RNA, 64 nt, hsa; identical to SEQ ID NO: 143752

SEQ ID NO: 245854 - RNA, 64 nt, hsa; identical to SEQ ID NO: 143753

SEQ ID NO: 245855 - RNA, 64 nt, hsa; identical to SEQ ID NO: 143754

SEQ ID NO: 245856 - RNA, 64 nt, hsa; identical to SEQ ID NO: 143755

SEQ ID NO: 245857 - RNA, 64 nt, hsa; identical to SEQ ID NO: 143756

SEQ ID NO: 245858 - RNA, 64 nt, hsa; identical to SEQ ID NO: 143757

SEQ ID NO: 245859 - RNA, 64 nt, hsa; identical to SEQ ID NO: 143758

SEQ ID NO: 245860 - RNA, 64 nt, hsa; identical to SEQ ID NO: 143759

SEQ ID NO: 245861 - RNA, 64 nt, hsa; identical to SEQ ID NO: 143760

SEQ ID NO: 245862 - RNA, 64 nt, hsa; identical to SEQ ID NO: 143761

SEQ ID NO: 245863 - RNA, 64 nt, hsa; identical to SEQ ID NO: 143762

SEQ ID NO: 245864 - RNA, 64 nt, hsa; identical to SEQ ID NO: 143763

SEQ ID NO: 245865 - RNA, 64 nt, hsa; identical to SEQ ID NO: 143764

SEQ ID NO: 245866 - RNA, 64 nt, hsa; identical to SEQ ID NO: 143765

SEQ ID NO: 245867 - RNA, 64 nt, hsa; identical to SEQ ID NO: 143766

SEQ ID NO: 245868 - RNA, 64 nt, hsa; identical to SEQ ID NO: 143767

SEQ ID NO: 245869 - RNA, 64 nt, hsa; identical to SEQ ID NO: 143768

SEQ ID NO: 245870 - RNA, 64 nt, hsa; identical to SEQ ID NO: 143769

SEQ ID NO: 245871 - RNA, 64 nt, hsa; identical to SEQ ID NO: 143770

SEQ ID NO: 245872 - RNA, 64 nt, hsa; identical to SEQ ID NO: 143771

SEQ ID NO: 245873 - RNA, 64 nt, hsa; identical to SEQ ID NO: 143772

SEQ ID NO: 245874 - RNA, 64 nt, hsa; identical to SEQ ID NO: 143773

SEQ ID NO: 245875 - RNA, 64 nt, hsa; identical to SEQ ID NO: 143774

SEQ ID NO: 245876 - RNA, 64 nt, hsa; identical to SEQ ID NO: 143775

SEQ ID NO: 245877 - RNA, 64 nt, hsa; identical to SEQ ID NO: 143776

SEQ ID NO: 245878 - RNA, 64 nt, hsa; identical to SEQ ID NO: 143777

SEQ ID NO: 245879 - RNA, 64 nt, hsa; identical to SEQ ID NO: 143778

SEQ ID NO: 245880 - RNA, 64 nt, hsa; identical to SEQ ID NO: 143779

SEQ ID NO: 245881 - RNA, 64 nt, hsa; identical to SEQ ID NO: 143780

SEQ ID NO: 245882 - RNA, 64 nt, hsa; identical to SEQ ID NO: 143781

SEQ ID NO: 245883 - RNA, 64 nt, hsa; identical to SEQ ID NO: 143782

SEQ ID NO: 245884 - RNA, 64 nt, hsa; identical to SEQ ID NO: 143783

SEQ ID NO: 245885 - RNA, 64 nt, hsa; identical to SEQ ID NO: 143784

SEQ ID NO: 245886 - RNA, 64 nt, hsa; identical to SEQ ID NO: 143785

SEQ ID NO: 245887 - RNA, 64 nt, hsa; identical to SEQ ID NO: 143786

SEQ ID NO: 245888 - RNA, 64 nt, hsa; identical to SEQ ID NO: 143787

SEQ ID NO: 245889 - RNA, 64 nt, hsa; identical to SEQ ID NO: 143788

SEQ ID NO: 245890 - RNA, 64 nt, hsa; identical to SEQ ID NO: 143789

SEQ ID NO: 245891 - RNA, 57 nt, hsa; identical to SEQ ID NO: 143790

SEQ ID NO: 245892 - RNA, 64 nt, hsa; identical to SEQ ID NO: 143791

SEQ ID NO: 245893 - RNA, 64 nt, hsa; identical to SEQ ID NO: 143792

SEQ ID NO: 245894 - RNA, 64 nt, hsa; identical to SEQ ID NO: 143793

SEQ ID NO: 245895 - RNA, 64 nt, hsa; identical to SEQ ID NO: 143794

SEQ ID NO: 245896 - RNA, 64 nt, hsa; identical to SEQ ID NO: 143795

SEQ ID NO: 245897 - RNA, 64 nt, hsa; identical to SEQ ID NO: 143796

SEQ ID NO: 245898 - RNA, 64 nt, hsa; identical to SEQ ID NO: 143797

SEQ ID NO: 245899 - RNA, 64 nt, hsa; identical to SEQ ID NO: 143798

SEQ ID NO: 245900 - RNA, 64 nt, hsa; identical to SEQ ID NO: 143799

SEQ ID NO: 245901 - RNA, 64 nt, hsa; identical to SEQ ID NO: 143800

SEQ ID NO: 245902 - RNA, 64 nt, hsa; identical to SEQ ID NO: 143801

SEQ ID NO: 245903 - RNA, 64 nt, hsa; identical to SEQ ID NO: 143802

SEQ ID NO: 245904 - RNA, 64 nt, hsa; identical to SEQ ID NO: 143803

SEQ ID NO: 245905 - RNA, 64 nt, hsa; identical to SEQ ID NO: 143804

SEQ ID NO: 245906 - RNA, 64 nt, hsa; identical to SEQ ID NO: 143805

SEQ ID NO: 245907 - RNA, 64 nt, hsa; identical to SEQ ID NO: 143806

SEQ ID NO: 245908 - RNA, 64 nt, hsa; identical to SEQ ID NO: 143807

SEQ ID NO: 245909 - RNA, 64 nt, hsa; identical to SEQ ID NO: 143808

SEQ ID NO: 245910 - RNA, 64 nt, hsa; identical to SEQ ID NO: 143809

SEQ ID NO: 245911 - RNA, 64 nt, hsa; identical to SEQ ID NO: 143810

SEQ ID NO: 245912 - RNA, 64 nt, hsa; identical to SEQ ID NO: 143811

SEQ ID NO: 245913 - RNA, 64 nt, hsa; identical to SEQ ID NO: 143812

SEQ ID NO: 245914 - RNA, 64 nt, hsa
aguuuauaugucgccuuuuucuguucaaauuugcauggccuauuaaguuggcuggagaguguuu

SEQ ID NO: 245915 - RNA, 64 nt, hsa
gaaaaucuaaugucuggauuaucuuccuuuucucauggccuaagaaauaaggaucaauaaggaa

SEQ ID NO: 245916 - RNA, 64 nt, hsa
aaauagaaaauugcaaaaaaaaaaaaaaaaaaaaaucucagacuguuuuaagaaaguuuaaaaa

SEQ ID NO: 245917 - RNA, 64 nt, hsa
ccuucucucaaacuuguauuucuccuggaaauguaucucagaaaugaccuccucucccaaccac

SEQ ID NO: 245918 - RNA, 64 nt, hsa
uuguuauuggguuucaugccccuggaccagccuuaucucagaccugcuuaccugcaugaugccu

SEQ ID NO: 245919 - RNA, 64 nt, hsa
gacaucaaguggaagaacuuguuugcuugaaaguaucucagacccaaggcaccucaggucucuu

SEQ ID NO: 245920 - RNA, 64 nt, hsa
ugugaauuuuaaaugaccugcaucaagucuucugaucucagauaacucaguacagauagcaauu

SEQ ID NO: 245921 - RNA, 64 nt, hsa
aaaauuuuucugacacccuuuaaugugguugcagaucucagaugaaaccaagcuuaauuauacu

SEQ ID NO: 245922 - RNA, 64 nt, hsa
agaauugacugggacuaauaucacaggaucaaucaucucagaaucuuacuugaugcauuauuua

SEQ ID NO: 245923 - RNA, 64 nt, hsa
cuuucuacgccauucaggaaggcagcacaaauuuaucucagaaagguuccuguguauugcaagg

SEQ ID NO: 245924 - RNA, 64 nt, hsa
aauaauccuagggcagacuaaauucagacgacccaucucagaaugguggaucaaagcagcaagu

SEQ ID NO: 245925 - RNA, 64 nt, hsa
gaggacuaaagggcaaaauucuagagagugguaaaucucagaaagcacaagcauaaaaugcagc

SEQ ID NO: 245926 - RNA, 64 nt, hsa
ucagccagcuccggggcucucaucuuccacucggaucucagauugguucguuguggaugcucug

SEQ ID NO: 245927 - RNA, 64 nt, hsa
aacuuuuaaaguuugaguuuaggaguaagaacauaucucagaccaccuuagucagcuuugcuga

SEQ ID NO: 245928 - RNA, 64 nt, hsa
ggucaacaccagagaucucagaucagaaucagagaucucagaggggaauaaguucauccucaug

SEQ ID NO: 245929 - RNA, 64 nt, hsa
auccugucuggaauacaccaggucaacaccagagaucucagaucagaaucagagaucucagagg

SEQ ID NO: 245930 - RNA, 64 nt, hsa
gcaaggcucagagagcaaaaguggauguugcagaaucucagagcuggauacuugcaggaagcug

SEQ ID NO: 245931 - RNA, 64 nt, hsa
cacugcauuccugaccgaggucagaaccagaucaaucucagaaucucaccuguguaggucuguu

SEQ ID NO: 245932 - RNA, 64 nt, hsa
aaacaaugaccugauucugucuuuaaaaaaaaaaaucucagaauucuuuuuuuguuuguguuuu

SEQ ID NO: 245933 - RNA, 64 nt, hsa
gauuacaggcgugagccaccuugccuggccaaaaaucucagaauucuuuaagacuguuuuaauu

SEQ ID NO: 245934 - RNA, 64 nt, hsa
aaaagaagccugggcacuguggcucacuccuguaaucucagaacuuugggaggcugaggcaggu

SEQ ID NO: 245935 - RNA, 64 nt, hsa
uuguaaauacuuuuuaaaaaacacuaaguuccuuaucucagaugcuguucuacuggagaaguuc

SEQ ID NO: 245936 - RNA, 64 nt, hsa
cuaccucuaugaggacagcaauguauggcacgacaucucagacuuccucgucuauaacaagagc

SEQ ID NO: 245937 - RNA, 64 nt, hsa; identical to SEQ ID NO: 81841

SEQ ID NO: 245938 - RNA, 64 nt, hsa; identical to SEQ ID NO: 81842

SEQ ID NO: 245939 - RNA, 64 nt, hsa; identical to SEQ ID NO: 81843

SEQ ID NO: 245940 - RNA, 64 nt, hsa; identical to SEQ ID NO: 81844

SEQ ID NO: 245941 - RNA, 64 nt, hsa; identical to SEQ ID NO: 81845

SEQ ID NO: 245942 - RNA, 64 nt, hsa; identical to SEQ ID NO: 81846

SEQ ID NO: 245943 - RNA, 64 nt, hsa; identical to SEQ ID NO: 81847

SEQ ID NO: 245944 - RNA, 64 nt, hsa; identical to SEQ ID NO: 81848

SEQ ID NO: 245945 - RNA, 64 nt, hsa; identical to SEQ ID NO: 81849

SEQ ID NO: 245946 - RNA, 64 nt, hsa; identical to SEQ ID NO: 81850

SEQ ID NO: 245947 - RNA, 64 nt, hsa; identical to SEQ ID NO: 81851

SEQ ID NO: 245948 - RNA, 61 nt, hsa; identical to SEQ ID NO: 81852

SEQ ID NO: 245949 - RNA, 64 nt, hsa; identical to SEQ ID NO: 81853

SEQ ID NO: 245950 - RNA, 51 nt, hsa; identical to SEQ ID NO: 81854

SEQ ID NO: 245951 - RNA, 64 nt, hsa; identical to SEQ ID NO: 81855

SEQ ID NO: 245952 - RNA, 64 nt, hsa; identical to SEQ ID NO: 81856

SEQ ID NO: 245953 - RNA, 64 nt, hsa; identical to SEQ ID NO: 81857

SEQ ID NO: 245954 - RNA, 64 nt, hsa; identical to SEQ ID NO: 81858

SEQ ID NO: 245955 - RNA, 64 nt, hsa; identical to SEQ ID NO: 81859

SEQ ID NO: 245956 - RNA, 64 nt, hsa; identical to SEQ ID NO: 81860

SEQ ID NO: 245957 - RNA, 64 nt, hsa; identical to SEQ ID NO: 81861

SEQ ID NO: 245958 - RNA, 64 nt, hsa; identical to SEQ ID NO: 81862

SEQ ID NO: 245959 - RNA, 64 nt, hsa; identical to SEQ ID NO: 81863

SEQ ID NO: 245960 - RNA, 64 nt, hsa; identical to SEQ ID NO: 81864

SEQ ID NO: 245961 - RNA, 64 nt, hsa; identical to SEQ ID NO: 81865

SEQ ID NO: 245962 - RNA, 64 nt, hsa; identical to SEQ ID NO: 81866

SEQ ID NO: 245963 - RNA, 64 nt, hsa; identical to SEQ ID NO: 81867

SEQ ID NO: 245964 - RNA, 64 nt, hsa; identical to SEQ ID NO: 81868

SEQ ID NO: 245965 - RNA, 64 nt, hsa; identical to SEQ ID NO: 81869

SEQ ID NO: 245966 - RNA, 64 nt, hsa; identical to SEQ ID NO: 81870

SEQ ID NO: 245967 - RNA, 64 nt, hsa; identical to SEQ ID NO: 81871

SEQ ID NO: 245968 - RNA, 64 nt, hsa; identical to SEQ ID NO: 81872

SEQ ID NO: 245969 - RNA, 64 nt, hsa; identical to SEQ ID NO: 81873

SEQ ID NO: 245970 - RNA, 64 nt, hsa; identical to SEQ ID NO: 81874

SEQ ID NO: 245971 - RNA, 64 nt, hsa; identical to SEQ ID NO: 81875

SEQ ID NO: 245972 - RNA, 64 nt, hsa; identical to SEQ ID NO: 81876

SEQ ID NO: 245973 - RNA, 64 nt, hsa; identical to SEQ ID NO: 81877

SEQ ID NO: 245974 - RNA, 64 nt, hsa; identical to SEQ ID NO: 81878

SEQ ID NO: 245975 - RNA, 64 nt, hsa; identical to SEQ ID NO: 81879

SEQ ID NO: 245976 - RNA, 64 nt, hsa; identical to SEQ ID NO: 81880

SEQ ID NO: 245977 - RNA, 64 nt, hsa; identical to SEQ ID NO: 81881

SEQ ID NO: 245978 - RNA, 64 nt, hsa; identical to SEQ ID NO: 81882

SEQ ID NO: 245979 - RNA, 64 nt, hsa; identical to SEQ ID NO: 81883

SEQ ID NO: 245980 - RNA, 64 nt, hsa; identical to SEQ ID NO: 81884

SEQ ID NO: 245981 - RNA, 64 nt, hsa; identical to SEQ ID NO: 81885

SEQ ID NO: 245982 - RNA, 64 nt, hsa; identical to SEQ ID NO: 81886

SEQ ID NO: 245983 - RNA, 64 nt, hsa; identical to SEQ ID NO: 81887

SEQ ID NO: 245984 - RNA, 64 nt, hsa; identical to SEQ ID NO: 81888

SEQ ID NO: 245985 - RNA, 64 nt, hsa; identical to SEQ ID NO: 81889

SEQ ID NO: 245986 - RNA, 64 nt, hsa; identical to SEQ ID NO: 81890

SEQ ID NO: 245987 - RNA, 64 nt, hsa; identical to SEQ ID NO: 81891

SEQ ID NO: 245988 - RNA, 64 nt, hsa; identical to SEQ ID NO: 81892

SEQ ID NO: 245989 - RNA, 64 nt, hsa; identical to SEQ ID NO: 81893

SEQ ID NO: 245990 - RNA, 64 nt, hsa; identical to SEQ ID NO: 81894

SEQ ID NO: 245991 - RNA, 64 nt, hsa; identical to SEQ ID NO: 81895

SEQ ID NO: 245992 - RNA, 64 nt, hsa; identical to SEQ ID NO: 81896

SEQ ID NO: 245993 - RNA, 64 nt, hsa; identical to SEQ ID NO: 81897

SEQ ID NO: 245994 - RNA, 64 nt, hsa; identical to SEQ ID NO: 81898

SEQ ID NO: 245995 - RNA, 64 nt, hsa; identical to SEQ ID NO: 81899

SEQ ID NO: 245996 - RNA, 64 nt, hsa; identical to SEQ ID NO: 81900

SEQ ID NO: 245997 - RNA, 64 nt, hsa; identical to SEQ ID NO: 81901

SEQ ID NO: 245998 - RNA, 64 nt, hsa; identical to SEQ ID NO: 81902

SEQ ID NO: 245999 - RNA, 64 nt, hsa; identical to SEQ ID NO: 81903

SEQ ID NO: 246000 - RNA, 64 nt, hsa; identical to SEQ ID NO: 81904

SEQ ID NO: 246001 - RNA, 64 nt, hsa; identical to SEQ ID NO: 81905

SEQ ID NO: 246002 - RNA, 64 nt, hsa; identical to SEQ ID NO: 81906

SEQ ID NO: 246003 - RNA, 64 nt, hsa; identical to SEQ ID NO: 81907

SEQ ID NO: 246004 - RNA, 64 nt, hsa; identical to SEQ ID NO: 81908

SEQ ID NO: 246005 - RNA, 64 nt, hsa; identical to SEQ ID NO: 81909

SEQ ID NO: 246006 - RNA, 64 nt, hsa; identical to SEQ ID NO: 81910

SEQ ID NO: 246007 - RNA, 64 nt, hsa; identical to SEQ ID NO: 81911

SEQ ID NO: 246008 - RNA, 64 nt, hsa; identical to SEQ ID NO: 81912

SEQ ID NO: 246009 - RNA, 64 nt, hsa; identical to SEQ ID NO: 81913

SEQ ID NO: 246010 - RNA, 64 nt, hsa; identical to SEQ ID NO: 81914

SEQ ID NO: 246011 - RNA, 64 nt, hsa; identical to SEQ ID NO: 81915

SEQ ID NO: 246012 - RNA, 64 nt, hsa; identical to SEQ ID NO: 81916

SEQ ID NO: 246013 - RNA, 64 nt, hsa; identical to SEQ ID NO: 81917

SEQ ID NO: 246014 - RNA, 64 nt, hsa; identical to SEQ ID NO: 81918

SEQ ID NO: 246015 - RNA, 64 nt, hsa; identical to SEQ ID NO: 81919

SEQ ID NO: 246016 - RNA, 64 nt, hsa; identical to SEQ ID NO: 81920

SEQ ID NO: 246017 - RNA, 64 nt, hsa; identical to SEQ ID NO: 81921

SEQ ID NO: 246018 - RNA, 64 nt, hsa; identical to SEQ ID NO: 81922

SEQ ID NO: 246019 - RNA, 64 nt, hsa; identical to SEQ ID NO: 81923

SEQ ID NO: 246020 - RNA, 64 nt, hsa; identical to SEQ ID NO: 81924

SEQ ID NO: 246021 - RNA, 64 nt, hsa; identical to SEQ ID NO: 81925

SEQ ID NO: 246022 - RNA, 64 nt, hsa; identical to SEQ ID NO: 81926

SEQ ID NO: 246023 - RNA, 64 nt, hsa; identical to SEQ ID NO: 81927

SEQ ID NO: 246024 - RNA, 64 nt, hsa; identical to SEQ ID NO: 81928

SEQ ID NO: 246025 - RNA, 64 nt, hsa; identical to SEQ ID NO: 81929

SEQ ID NO: 246026 - RNA, 64 nt, hsa; identical to SEQ ID NO: 81930

SEQ ID NO: 246027 - RNA, 64 nt, hsa; identical to SEQ ID NO: 81931

SEQ ID NO: 246028 - RNA, 64 nt, hsa; identical to SEQ ID NO: 81932

SEQ ID NO: 246029 - RNA, 64 nt, hsa; identical to SEQ ID NO: 81933

SEQ ID NO: 246030 - RNA, 64 nt, hsa; identical to SEQ ID NO: 81934

SEQ ID NO: 246031 - RNA, 64 nt, hsa; identical to SEQ ID NO: 81935

SEQ ID NO: 246032 - RNA, 64 nt, hsa; identical to SEQ ID NO: 81936

SEQ ID NO: 246033 - RNA, 64 nt, hsa; identical to SEQ ID NO: 81937

SEQ ID NO: 246034 - RNA, 64 nt, hsa; identical to SEQ ID NO: 81938

SEQ ID NO: 246035 - RNA, 64 nt, hsa; identical to SEQ ID NO: 81939

SEQ ID NO: 246036 - RNA, 64 nt, hsa; identical to SEQ ID NO: 81940

SEQ ID NO: 246037 - RNA, 64 nt, hsa; identical to SEQ ID NO: 81941

SEQ ID NO: 246038 - RNA, 64 nt, hsa; identical to SEQ ID NO: 81942

SEQ ID NO: 246039 - RNA, 64 nt, hsa; identical to SEQ ID NO: 81943

SEQ ID NO: 246040 - RNA, 64 nt, hsa; identical to SEQ ID NO: 81944

SEQ ID NO: 246041 - RNA, 64 nt, hsa
aggggcuuguuuauuaucuugcucugugccucauagggaauaaacacaaugaaguccaggguug

SEQ ID NO: 246042 - RNA, 64 nt, hsa
uacacaguagauugcagcccuucugaugagaaauagggaauacucccaguccaggcccagcaaa

SEQ ID NO: 246043 - RNA, 64 nt, hsa
ugaauguuguugggugguagaaaaugauagaacaagggaauaaccgcgaaugcucugugcagcu

SEQ ID NO: 246044 - RNA, 64 nt, hsa
auuuuucccagcaaaauaaaucauauggcgagucagggaauaaaaagucaaaagaaacaaauag

SEQ ID NO: 246045 - RNA, 64 nt, hsa
guuuauucauuuucugcaauauacuauauguaauagggaauaccuugcuaaaauaaaacuuagg

SEQ ID NO: 246046 - RNA, 64 nt, hsa
accagagaauuggguugucaugucuguuuaaugaagggaauagguuuuguaaucuaucauuuua

SEQ ID NO: 246047 - RNA, 64 nt, hsa
auagguguucucaggagguagggaucuggcugagagggaauaaucugagcaaagguaugaaaca

SEQ ID NO: 246048 - RNA, 64 nt, hsa
aagaugggucccugugccaggccucaauacugccagggaauaaaaccagagggagaggacccuc

SEQ ID NO: 246049 - RNA, 64 nt, hsa
uauguccuugaagcuggcaggggauucccaguccagggaauaucccuacaugauuuuugucauu

SEQ ID NO: 246050 - RNA, 64 nt, hsa
gaggucaaacaugggccuucggcauuggguuucuagggaauauggcucaguagggccugccccu

SEQ ID NO: 246051 - RNA, 64 nt, hsa
auaucuucuauucaaaaucuuuuuuuuauuuuuaagggaauaaaaauuuuaaaaauuaagagau

SEQ ID NO: 246052 - RNA, 64 nt, hsa
uaguguucuccaucucuagugaagacagaaccagagggaauaaggaucuuuuuuuuaaagacag

SEQ ID NO: 246053 - RNA, 64 nt, hsa
uucucgugaagggcaaauguaacaccauaacaguagggaauaaacugugucccaccuguuuacu

SEQ ID NO: 246054 - RNA, 64 nt, hsa
aauuccauuuuaugaaaaggcaucuucaugguccagggaauauguaucuuguaaaauguaccug

SEQ ID NO: 246055 - RNA, 64 nt, hsa
augucuuaaaaggcauuuuugacuaucaccuccaagggaauagcuugagaaacccaaaguacua

SEQ ID NO: 246056 - RNA, 64 nt, hsa
cagcuggagaaagcacucaccucaggcuuacaaaagggaauaguuucaggagcuauguaagcug

SEQ ID NO: 246057 - RNA, 64 nt, hsa
aaacaaaacuuucugcuaacaaaauacauacaguaucugccaguauauucuguaaaaccuucua

SEQ ID NO: 246058 - RNA, 64 nt, hsa
gaagcaaggagucuaaggcccuagcgauuugggcaucugccacauugguucauauucagaaagu

SEQ ID NO: 246059 - RNA, 64 nt, hsa
guuauccugaaacuuucuaugcucaguggaaaguaucugccagccacagcaugaggccugugaa

SEQ ID NO: 246060 - RNA, 64 nt, hsa
guugggcuuugggaagauguuauuuaugaccaauaucugccaguaacgcuguuuaucucacuug

SEQ ID NO: 246061 - RNA, 64 nt, hsa
acaucucaaauacaaccacaggaaaaauggcccaaucugccaguuuaggcuuaccagcauauaa

SEQ ID NO: 246062 - RNA, 64 nt, hsa
cugucugccauuggucuccucugccucugacuacaucugccaccaacaacccuccccucacccc

SEQ ID NO: 246063 - RNA, 64 nt, hsa
uauuauauuuaaaaaaaacuauguucagaacuucaucugccacugguuauuuuuuucuaaggag

SEQ ID NO: 246064 - RNA, 64 nt, hsa
ucacaugccacaaccacggucacaccucacugucaucugccaggacguuuguugaacaaaacug

SEQ ID NO: 246065 - RNA, 64 nt, hsa
uucaggaaaaaucccuugugauuggauguuuacuaucugccaggaaacugguacucaagauguu

SEQ ID NO: 246066 - RNA, 64 nt, hsa
gaaaauuuguuuuuucuugaucuuagcuggaaaaaucugccaacuuuacacaguauuuacuugg

SEQ ID NO: 246067 - RNA, 64 nt, hsa
cagacugaaaggccagguuguagucccagcucuuaucugccaucuuggacaaagcuuuucccau

SEQ ID NO: 246068 - RNA, 64 nt, hsa
agcaaccccccauuucuguuugggaauucauaugaucugccagagccucuccagggguggaaua

SEQ ID NO: 246069 - RNA, 64 nt, hsa
ccacgcaaguuggggagaaaacccccaaggaugaaucugccaauguaagucagggacucuucuu

SEQ ID NO: 246070 - RNA, 64 nt, hsa
uuuagcuucuugaaaaugggccccugcagaauaaaucugccaguuuuuauaaaugcuaagaucu

SEQ ID NO: 246071 - RNA, 64 nt, hsa
uuguuggccaaaauccuuuaaagacauacgaaacaucugccaacuuuuuagcgaacuuaacagg

SEQ ID NO: 246072 - RNA, 64 nt, hsa
gucgggaggccucgguagccaggcagaacaggauaucugccaaagggugucugauguggggugg

SEQ ID NO: 246073 - RNA, 64 nt, hsa
aauaggacagcaggaaccuaaaauaucugccaucaucugccauaggaaagauacccagagaccc

SEQ ID NO: 246074 - RNA, 64 nt, hsa
gcuucaagguaauaggacagcaggaaccuaaaauaucugccaucaucugccauaggaaagauac

SEQ ID NO: 246075 - RNA, 64 nt, hsa; identical to SEQ ID NO: 81713

SEQ ID NO: 246076 - RNA, 64 nt, hsa; identical to SEQ ID NO: 81714

SEQ ID NO: 246077 - RNA, 64 nt, hsa; identical to SEQ ID NO: 81715

SEQ ID NO: 246078 - RNA, 64 nt, hsa; identical to SEQ ID NO: 81716

SEQ ID NO: 246079 - RNA, 64 nt, hsa; identical to SEQ ID NO: 81717

SEQ ID NO: 246080 - RNA, 64 nt, hsa; identical to SEQ ID NO: 81718

SEQ ID NO: 246081 - RNA, 64 nt, hsa; identical to SEQ ID NO: 52505

SEQ ID NO: 246082 - RNA, 64 nt, hsa; identical to SEQ ID NO: 52506

SEQ ID NO: 246083 - RNA, 64 nt, hsa; identical to SEQ ID NO: 52507

SEQ ID NO: 246084 - RNA, 64 nt, hsa; identical to SEQ ID NO: 52508

SEQ ID NO: 246085 - RNA, 64 nt, hsa; identical to SEQ ID NO: 52509

SEQ ID NO: 246086 - RNA, 64 nt, hsa; identical to SEQ ID NO: 52510

SEQ ID NO: 246087 - RNA, 64 nt, hsa; identical to SEQ ID NO: 52511

SEQ ID NO: 246088 - RNA, 64 nt, hsa; identical to SEQ ID NO: 52512

SEQ ID NO: 246089 - RNA, 64 nt, hsa; identical to SEQ ID NO: 52513

SEQ ID NO: 246090 - RNA, 64 nt, hsa; identical to SEQ ID NO: 52514

SEQ ID NO: 246091 - RNA, 64 nt, hsa; identical to SEQ ID NO: 52515

SEQ ID NO: 246092 - RNA, 64 nt, hsa; identical to SEQ ID NO: 52516

SEQ ID NO: 246093 - RNA, 64 nt, hsa; identical to SEQ ID NO: 52517

SEQ ID NO: 246094 - RNA, 64 nt, hsa; identical to SEQ ID NO: 52518

SEQ ID NO: 246095 - RNA, 64 nt, hsa; identical to SEQ ID NO: 52519

SEQ ID NO: 246096 - RNA, 64 nt, hsa; identical to SEQ ID NO: 52520

SEQ ID NO: 246097 - RNA, 64 nt, hsa; identical to SEQ ID NO: 52521

SEQ ID NO: 246098 - RNA, 64 nt, hsa; identical to SEQ ID NO: 52522

SEQ ID NO: 246099 - RNA, 64 nt, hsa; identical to SEQ ID NO: 52523

SEQ ID NO: 246100 - RNA, 64 nt, hsa; identical to SEQ ID NO: 52524

SEQ ID NO: 246101 - RNA, 64 nt, hsa; identical to SEQ ID NO: 52525

SEQ ID NO: 246102 - RNA, 64 nt, hsa; identical to SEQ ID NO: 52526

SEQ ID NO: 246103 - RNA, 64 nt, hsa; identical to SEQ ID NO: 52527

SEQ ID NO: 246104 - RNA, 64 nt, hsa; identical to SEQ ID NO: 52528

SEQ ID NO: 246105 - RNA, 64 nt, hsa; identical to SEQ ID NO: 52529

SEQ ID NO: 246106 - RNA, 64 nt, hsa; identical to SEQ ID NO: 52530

SEQ ID NO: 246107 - RNA, 64 nt, hsa; identical to SEQ ID NO: 52531

SEQ ID NO: 246108 - RNA, 64 nt, hsa; identical to SEQ ID NO: 52532

SEQ ID NO: 246109 - RNA, 64 nt, hsa; identical to SEQ ID NO: 52533

SEQ ID NO: 246110 - RNA, 64 nt, hsa; identical to SEQ ID NO: 52534

SEQ ID NO: 246111 - RNA, 64 nt, hsa; identical to SEQ ID NO: 52535

SEQ ID NO: 246112 - RNA, 64 nt, hsa; identical to SEQ ID NO: 52536

SEQ ID NO: 246113 - RNA, 64 nt, hsa; identical to SEQ ID NO: 52537

SEQ ID NO: 246114 - RNA, 64 nt, hsa; identical to SEQ ID NO: 52538

SEQ ID NO: 246115 - RNA, 64 nt, hsa; identical to SEQ ID NO: 52539

SEQ ID NO: 246116 - RNA, 64 nt, hsa; identical to SEQ ID NO: 52540

SEQ ID NO: 246117 - RNA, 64 nt, hsa; identical to SEQ ID NO: 52541

SEQ ID NO: 246118 - RNA, 64 nt, hsa; identical to SEQ ID NO: 52542

SEQ ID NO: 246119 - RNA, 64 nt, hsa; identical to SEQ ID NO: 52543

SEQ ID NO: 246120 - RNA, 64 nt, hsa; identical to SEQ ID NO: 52544

SEQ ID NO: 246121 - RNA, 64 nt, hsa; identical to SEQ ID NO: 52545

SEQ ID NO: 246122 - RNA, 64 nt, hsa; identical to SEQ ID NO: 52546

SEQ ID NO: 246123 - RNA, 64 nt, hsa; identical to SEQ ID NO: 52547

SEQ ID NO: 246124 - RNA, 64 nt, hsa; identical to SEQ ID NO: 52548

SEQ ID NO: 246125 - RNA, 64 nt, hsa; identical to SEQ ID NO: 52549

SEQ ID NO: 246126 - RNA, 64 nt, hsa; identical to SEQ ID NO: 52550

SEQ ID NO: 246127 - RNA, 64 nt, hsa; identical to SEQ ID NO: 52551

SEQ ID NO: 246128 - RNA, 64 nt, hsa; identical to SEQ ID NO: 52552

SEQ ID NO: 246129 - RNA, 64 nt, hsa; identical to SEQ ID NO: 52553

SEQ ID NO: 246130 - RNA, 64 nt, hsa; identical to SEQ ID NO: 52554

SEQ ID NO: 246131 - RNA, 64 nt, hsa; identical to SEQ ID NO: 52555

SEQ ID NO: 246132 - RNA, 64 nt, hsa; identical to SEQ ID NO: 52556

SEQ ID NO: 246133 - RNA, 64 nt, hsa; identical to SEQ ID NO: 52557

SEQ ID NO: 246134 - RNA, 64 nt, hsa; identical to SEQ ID NO: 52558

SEQ ID NO: 246135 - RNA, 64 nt, hsa; identical to SEQ ID NO: 52559

SEQ ID NO: 246136 - RNA, 64 nt, hsa; identical to SEQ ID NO: 52560

SEQ ID NO: 246137 - RNA, 64 nt, hsa; identical to SEQ ID NO: 52561

SEQ ID NO: 246138 - RNA, 64 nt, hsa; identical to SEQ ID NO: 52562

SEQ ID NO: 246139 - RNA, 64 nt, hsa; identical to SEQ ID NO: 52563

SEQ ID NO: 246140 - RNA, 64 nt, hsa; identical to SEQ ID NO: 52564

SEQ ID NO: 246141 - RNA, 64 nt, hsa; identical to SEQ ID NO: 52565

SEQ ID NO: 246142 - RNA, 64 nt, hsa; identical to SEQ ID NO: 52566

SEQ ID NO: 246143 - RNA, 64 nt, hsa; identical to SEQ ID NO: 52567

SEQ ID NO: 246144 - RNA, 64 nt, hsa; identical to SEQ ID NO: 52568

SEQ ID NO: 246145 - RNA, 64 nt, hsa; identical to SEQ ID NO: 52569

SEQ ID NO: 246146 - RNA, 64 nt, hsa; identical to SEQ ID NO: 52570

SEQ ID NO: 246147 - RNA, 64 nt, hsa; identical to SEQ ID NO: 52571

SEQ ID NO: 246148 - RNA, 64 nt, hsa; identical to SEQ ID NO: 52572

SEQ ID NO: 246149 - RNA, 64 nt, hsa; identical to SEQ ID NO: 52573

SEQ ID NO: 246150 - RNA, 64 nt, hsa; identical to SEQ ID NO: 52574

SEQ ID NO: 246151 - RNA, 64 nt, hsa; identical to SEQ ID NO: 52575

SEQ ID NO: 246152 - RNA, 64 nt, hsa; identical to SEQ ID NO: 52576

SEQ ID NO: 246153 - RNA, 64 nt, hsa; identical to SEQ ID NO: 52577

SEQ ID NO: 246154 - RNA, 64 nt, hsa; identical to SEQ ID NO: 52578

SEQ ID NO: 246155 - RNA, 64 nt, hsa; identical to SEQ ID NO: 52579

SEQ ID NO: 246156 - RNA, 64 nt, hsa; identical to SEQ ID NO: 52580

SEQ ID NO: 246157 - RNA, 64 nt, hsa; identical to SEQ ID NO: 52581

SEQ ID NO: 246158 - RNA, 64 nt, hsa; identical to SEQ ID NO: 52582

SEQ ID NO: 246159 - RNA, 64 nt, hsa; identical to SEQ ID NO: 52583

SEQ ID NO: 246160 - RNA, 64 nt, hsa; identical to SEQ ID NO: 52584

SEQ ID NO: 246161 - RNA, 64 nt, hsa; identical to SEQ ID NO: 52585

SEQ ID NO: 246162 - RNA, 64 nt, hsa; identical to SEQ ID NO: 52586

SEQ ID NO: 246163 - RNA, 64 nt, hsa; identical to SEQ ID NO: 52587

SEQ ID NO: 246164 - RNA, 64 nt, hsa; identical to SEQ ID NO: 52588

SEQ ID NO: 246165 - RNA, 64 nt, hsa; identical to SEQ ID NO: 52589

SEQ ID NO: 246166 - RNA, 64 nt, hsa; identical to SEQ ID NO: 52590

SEQ ID NO: 246167 - RNA, 64 nt, hsa; identical to SEQ ID NO: 52591

SEQ ID NO: 246168 - RNA, 64 nt, hsa; identical to SEQ ID NO: 52592

SEQ ID NO: 246169 - RNA, 64 nt, hsa; identical to SEQ ID NO: 52593

SEQ ID NO: 246170 - RNA, 64 nt, hsa; identical to SEQ ID NO: 52594

SEQ ID NO: 246171 - RNA, 64 nt, hsa; identical to SEQ ID NO: 52595

SEQ ID NO: 246172 - RNA, 64 nt, hsa; identical to SEQ ID NO: 52596

SEQ ID NO: 246173 - RNA, 64 nt, hsa; identical to SEQ ID NO: 52597

SEQ ID NO: 246174 - RNA, 64 nt, hsa; identical to SEQ ID NO: 52598

SEQ ID NO: 246175 - RNA, 64 nt, hsa; identical to SEQ ID NO: 52599

SEQ ID NO: 246176 - RNA, 64 nt, hsa; identical to SEQ ID NO: 52600

SEQ ID NO: 246177 - RNA, 64 nt, hsa; identical to SEQ ID NO: 52601

SEQ ID NO: 246178 - RNA, 64 nt, hsa; identical to SEQ ID NO: 52602

SEQ ID NO: 246179 - RNA, 64 nt, hsa; identical to SEQ ID NO: 52603

SEQ ID NO: 246180 - RNA, 64 nt, hsa; identical to SEQ ID NO: 52604

SEQ ID NO: 246181 - RNA, 64 nt, hsa; identical to SEQ ID NO: 52605

SEQ ID NO: 246182 - RNA, 64 nt, hsa; identical to SEQ ID NO: 52606

SEQ ID NO: 246183 - RNA, 64 nt, hsa; identical to SEQ ID NO: 52607

SEQ ID NO: 246184 - RNA, 64 nt, hsa; identical to SEQ ID NO: 52608

SEQ ID NO: 246185 - RNA, 64 nt, hsa; identical to SEQ ID NO: 52609

SEQ ID NO: 246186 - RNA, 64 nt, hsa; identical to SEQ ID NO: 52610

SEQ ID NO: 246187 - RNA, 64 nt, hsa; identical to SEQ ID NO: 52611

SEQ ID NO: 246188 - RNA, 64 nt, hsa; identical to SEQ ID NO: 52612

SEQ ID NO: 246189 - RNA, 64 nt, hsa; identical to SEQ ID NO: 52613

SEQ ID NO: 246190 - RNA, 64 nt, hsa; identical to SEQ ID NO: 52614

SEQ ID NO: 246191 - RNA, 64 nt, hsa; identical to SEQ ID NO: 52615

SEQ ID NO: 246192 - RNA, 64 nt, hsa; identical to SEQ ID NO: 52616

SEQ ID NO: 246193 - RNA, 64 nt, hsa; identical to SEQ ID NO: 52617

SEQ ID NO: 246194 - RNA, 64 nt, hsa; identical to SEQ ID NO: 52618

SEQ ID NO: 246195 - RNA, 64 nt, hsa; identical to SEQ ID NO: 52619

SEQ ID NO: 246196 - RNA, 64 nt, hsa; identical to SEQ ID NO: 52620

SEQ ID NO: 246197 - RNA, 64 nt, hsa; identical to SEQ ID NO: 52621

SEQ ID NO: 246198 - RNA, 64 nt, hsa; identical to SEQ ID NO: 52622

SEQ ID NO: 246199 - RNA, 64 nt, hsa; identical to SEQ ID NO: 52623

SEQ ID NO: 246200 - RNA, 64 nt, hsa; identical to SEQ ID NO: 52624

SEQ ID NO: 246201 - RNA, 64 nt, hsa; identical to SEQ ID NO: 52625

SEQ ID NO: 246202 - RNA, 64 nt, hsa; identical to SEQ ID NO: 52626

SEQ ID NO: 246203 - RNA, 64 nt, hsa; identical to SEQ ID NO: 52627

SEQ ID NO: 246204 - RNA, 64 nt, hsa; identical to SEQ ID NO: 52628

SEQ ID NO: 246205 - RNA, 64 nt, hsa; identical to SEQ ID NO: 52629

SEQ ID NO: 246206 - RNA, 64 nt, hsa; identical to SEQ ID NO: 52630

SEQ ID NO: 246207 - RNA, 64 nt, hsa; identical to SEQ ID NO: 52631

SEQ ID NO: 246208 - RNA, 64 nt, hsa; identical to SEQ ID NO: 52632

SEQ ID NO: 246209 - RNA, 64 nt, hsa; identical to SEQ ID NO: 52633

SEQ ID NO: 246210 - RNA, 64 nt, hsa; identical to SEQ ID NO: 52634

SEQ ID NO: 246211 - RNA, 64 nt, hsa; identical to SEQ ID NO: 52635

SEQ ID NO: 246212 - RNA, 64 nt, hsa; identical to SEQ ID NO: 52636

SEQ ID NO: 246213 - RNA, 64 nt, hsa; identical to SEQ ID NO: 52637

SEQ ID NO: 246214 - RNA, 64 nt, hsa; identical to SEQ ID NO: 52638

SEQ ID NO: 246215 - RNA, 64 nt, hsa; identical to SEQ ID NO: 52639

SEQ ID NO: 246216 - RNA, 64 nt, hsa; identical to SEQ ID NO: 52640

SEQ ID NO: 246217 - RNA, 64 nt, hsa
cacgcagccagggcuucacacccuucaggcugcacccgggcaggccucagaacggugaggggcc

SEQ ID NO: 246218 - RNA, 64 nt, hsa
caaaagugcuucauuuuucgugcccgccccgcgccccgggcaggccagucauguguuaaguugc

SEQ ID NO: 246219 - RNA, 64 nt, hsa
uccaggcugcacgcggcggacugggcaggccgggcccgggcacuggugggugacagucauacuu

SEQ ID NO: 246220 - RNA, 64 nt, hsa
gugacagucauacuucguggagcccagcgagcaucccgggcaagcacuaccaggcugugggucu

SEQ ID NO: 246221 - RNA, 64 nt, hsa
ccagcuuagaacagcccuuggugagguggucaugcccgggcaaaggcccugcuuccuggaaagg

SEQ ID NO: 246222 - RNA, 64 nt, hsa
uccacauuggccucugcagcugggugaccagagccccgggcacggccccagcuccguggggcuc

SEQ ID NO: 246223 - RNA, 64 nt, hsa
cacacccgcucugucuucccacugucccccccaucccgggcagggcccagugggauugaggggg

SEQ ID NO: 246224 - RNA, 64 nt, hsa
ccgaccuucggucccuccgcccucccagccccgccccgggcaggggggcggcgggugggcccgc

SEQ ID NO: 246225 - RNA, 64 nt, hsa
uucugguuuaggcacacgucacgggugcgggagacccgggcacgggagacccgggccgccuuca

SEQ ID NO: 246226 - RNA, 64 nt, hsa
gcacccagcacagccugcccagcccagcccugcccccgggcacugcacagccugucugggggcc

SEQ ID NO: 246227 - RNA, 60 nt, hsa
cgcugguguccacagugugaggacgcugaccccgggcagccgcugcucugaagagcuucc

SEQ ID NO: 246228 - RNA, 64 nt, hsa
gaggaagccggccgcuccugugagggaggccgggcccgggcaccugagggcuucucccucugga

SEQ ID NO: 246229 - RNA, 64 nt, hsa
cagggcaggcgcauccagcaugucaguguccugccccgggcagcucucccucccgggcacgcuc

SEQ ID NO: 246230 - RNA, 64 nt, hsa
gcaugucaguguccugccccgggcagcucucccucccgggcacgcucccucuggccugguggau

SEQ ID NO: 246231 - RNA, 64 nt, hsa
acugacucccccaucagcucaaacauuaaggguacccgggcacaaccguaccccugcccccagc

SEQ ID NO: 246232 - RNA, 64 nt, hsa
cagccccugccaggccaagcccagccacugcccucccgggcagaucugggcccaggcaccucug

SEQ ID NO: 246233 - RNA, 64 nt, hsa
ccagcuuggagugccacauggccgcugcccacgucccgggcacugucaugcccagcuuggagug

SEQ ID NO: 246234 - RNA, 64 nt, hsa
ccagcuuggagugccacguggccgcugcccacgucccgggcacugucaugcccagcuuggagug

SEQ ID NO: 246235 - RNA, 64 nt, hsa
accagauggagaggauguucaacaccacucggaucccgggcaaggacacagguaacugagcccc

SEQ ID NO: 246236 - RNA, 64 nt, hsa
uccaauagguguggccccuaccagaccccgcagacccgggcacuucucagcauggccaucuucu

SEQ ID NO: 246237 - RNA, 64 nt, hsa; identical to SEQ ID NO: 172497

SEQ ID NO: 246238 - RNA, 64 nt, hsa; identical to SEQ ID NO: 172498

SEQ ID NO: 246239 - RNA, 64 nt, hsa
cccaucuggagagaagcuuccagaccagcccuucacacaccacagccaggaggggccuuuccca

SEQ ID NO: 246240 - RNA, 64 nt, hsa
cuuucccgccuggaaacuuccggacaagccucucacacaccacagccaggagaggccuuuccca

SEQ ID NO: 246241 - RNA, 64 nt, hsa
uuucugccuggagagaaacuuucagaccagccccacacaccacagccaggagaggccguuccug

SEQ ID NO: 246242 - RNA, 64 nt, hsa
uauaauauauacacacagauacaaguguacacacacacaccacacaccacacacaccccacugg

SEQ ID NO: 246243 - RNA, 64 nt, hsa
uauacacacagauacaaguguacacacacacaccacacaccacacacaccccacuggcagucuu

SEQ ID NO: 246244 - RNA, 64 nt, hsa
acacaaucacacgcagccccuccccgccacagagacacaccauuacauacacagacacacacag

SEQ ID NO: 246245 - RNA, 64 nt, hsa
acgcaaucgcagauacgcccuuccggccacagaaacacaccauuacacacacauacacagaaag

SEQ ID NO: 246246 - RNA, 64 nt, hsa
acaaaaucacacacacacccuccccgccacagagacacaccauuacauacacagacacgcaauc

SEQ ID NO: 246247 - RNA, 64 nt, hsa
caucucaccacaccacagcacaccucaccacacaacacaccacaccccacaccgcacugcaccg

SEQ ID NO: 246248 - RNA, 64 nt, hsa
acacgcaaaagaugacgcccagcacagcagcaggacacaccaugugccaggaaaugaccucagc

SEQ ID NO: 246249 - RNA, 64 nt, hsa
uccuugaggauagacagauauacacaccacacacacacaccacauacaccacacacacacguuc

SEQ ID NO: 246250 - RNA, 64 nt, hsa
ugagaucaggcaguccuugaggauagacagauauacacaccacacacacacaccacauacacca

SEQ ID NO: 246251 - RNA, 64 nt, hsa
acuccaagucucugugagcagugacuugaaccaaacacaccaggaauaauccauucuuuggggc

SEQ ID NO: 246252 - RNA, 64 nt, hsa
gcuucuggggcuggcaaaaaccuucucugaacccacacaccaaguucguaguugguaggugccc

SEQ ID NO: 246253 - RNA, 64 nt, hsa
ccuaggucagcgugcagagcagugaugcuggaggacacaccauggggugaagccaucccaaggc

SEQ ID NO: 246254 - RNA, 64 nt, hsa
uccauguggcuuuaugugaggggacugaaugcagacacaccauagcccccuucuacuacuuucc

SEQ ID NO: 246255 - RNA, 64 nt, hsa
guuuaauuuccgauuuuuuccucugcauuuacacacacaccacacacgcacacacacacaccaa

SEQ ID NO: 246256 - RNA, 64 nt, hsa
ucugcauuuacacacacaccacacacgcacacacacacaccaaguaccaguauaagcaucuccc

SEQ ID NO: 246257 - RNA, 64 nt, hsa
gaguguuuaauuucagacuucuuccucugcauuuacacaccacacaacacacacacacacacac

SEQ ID NO: 246258 - RNA, 64 nt, hsa
auuuacacaccacacaacacacacacacacacacacacaccaaguaccauuauaagcaucuccc

SEQ ID NO: 246259 - RNA, 64 nt, hsa; identical to SEQ ID NO: 246256

SEQ ID NO: 246260 - RNA, 64 nt, hsa; identical to SEQ ID NO: 246255

SEQ ID NO: 246261 - RNA, 64 nt, hsa
acaaacacacacacacagacacacacacacacagacacaccaaguaccaguauaagcaucuccc

SEQ ID NO: 246262 - RNA, 64 nt, hsa
gaguguuuaauuuccgauuuuccccucugcauuuacacaccagacacacaaacacacacacaca

SEQ ID NO: 246263 - RNA, 64 nt, hsa
aauaaugaauauuguugaguucaaaauauucucauauacccagauuuacagagaugacacagua

SEQ ID NO: 246264 - RNA, 64 nt, hsa
uuaaugauaaucauuuuauuuuucaucucucugauauacccaauguguggcaaucagccccuac

SEQ ID NO: 246265 - RNA, 64 nt, hsa
uuaggaauuauuuuguuguuacguuuuggugaguuauacccauuuuauuuauuuagaaaaauag

SEQ ID NO: 246266 - RNA, 64 nt, hsa
ccucaucaaaccaaaggcacagauuuguguacaauauacccauugaauguauauccugagaaaa

SEQ ID NO: 246267 - RNA, 64 nt, hsa
uccaucucuaaguaaaaaaauacaacaguagaaauauacccaugauaauauacccaauauaccc

SEQ ID NO: 246268 - RNA, 64 nt, hsa
aaaaaauacaacaguagaaauauacccaugauaauauacccaauauacccuuguuaaagaagca

SEQ ID NO: 246269 - RNA, 64 nt, hsa
uggcggguagacaagggaugccugggcugacugggcagaggaaccucuagcucugacugucacu

SEQ ID NO: 246270 - RNA, 64 nt, hsa
acccccucaccccacccggggcucacucagccuggcagaggaagaaggaaggcagacaucuccg

SEQ ID NO: 246271 - RNA, 64 nt, hsa
ucagggcugggcagguccuggggaggcugagacugcagaggagccaccugggcugggagaaggu

SEQ ID NO: 246272 - RNA, 64 nt, hsa
gcgccccugggguggguuuagcaggcugcagcaggcagaggagaguaccccccugagagcaugu

SEQ ID NO: 246273 - RNA, 64 nt, hsa
ccucugagguuccaacucagucauucuuuguccagcagaggagaaucagaaaugagcccuucag

SEQ ID NO: 246274 - RNA, 64 nt, hsa
ggugguggucaacgggagggaggaggagcagacggcagaggaaauccucagcaaaggccugagc

SEQ ID NO: 246275 - RNA, 64 nt, hsa
acacugaggagcucugaacccagcccacagggaagcagaggaaggugagcccccgccgcccccc

SEQ ID NO: 246276 - RNA, 64 nt, hsa
ugucaggggagccgcguucccucccagggcuggagcagaggaccacaaggcagcagaaagcgcg

SEQ ID NO: 246277 - RNA, 51 nt, hsa
ucccucuccucaccaucuaaggcagaggaugggaugugguggggcagggau

SEQ ID NO: 246278 - RNA, 64 nt, hsa
acucagugggccuuggggccuagcccagcucugagcagaggacuguggcauucacuguccuuga

SEQ ID NO: 246279 - RNA, 64 nt, hsa
gcggugcugucugcugggaggucagcuggucaaggcagaggaggagaggaggaaaggauggggg

SEQ ID NO: 246280 - RNA, 56 nt, hsa
gggagguggaggccacguagaagggggcagaggagggguggucaggaugggcuggg

SEQ ID NO: 246281 - RNA, 64 nt, hsa
gugccuuggcaggagccaggacaaggcccuccuggcagaggagcaccuaggcagggcccagccc

SEQ ID NO: 246282 - RNA, 64 nt, hsa
cugucugcauggccacugggcauguguguugggagcagaggaguccuacuccuugccucagccc

SEQ ID NO: 246283 - RNA, 64 nt, hsa
ccaugguggcaugggucagcagagcauggagcaggcagaggaagccuaucuguggggcugggua

SEQ ID NO: 246284 - RNA, 64 nt, hsa
ccagggcccuaugccaaccugccuuuguuacaaggcagaggaagcuuuguauuuauuggcuuca

SEQ ID NO: 246285 - RNA, 64 nt, hsa
uugccagcuagaggccgccacgcaagugaagccagcagaggagugauagcugcuccccauccca

SEQ ID NO: 246286 - RNA, 64 nt, hsa
ggggggcaccccccccauggaugcccuucagauagcagaggacacccuccaaacacugguuccc

SEQ ID NO: 246287 - RNA, 64 nt, hsa
ccugguucaggaccucuaccccagcgagagcacagcagaggacgacauucaggucucagggcag

SEQ ID NO: 246288 - RNA, 64 nt, hsa
uccagggcuugggccgugacuuaggcagaggagugcagaggagggucuggcaggggcugcucag

SEQ ID NO: 246289 - RNA, 64 nt, hsa
cuccuacguguccagggcuugggccgugacuuaggcagaggagugcagaggagggucuggcagg

SEQ ID NO: 246290 - RNA, 64 nt, hsa
ugaagaucacuuugucuuggaaaugacuagagaggcagaggagaaggguuuccagaguugcuag

SEQ ID NO: 246291 - RNA, 64 nt, hsa
cccaccccagccaggugucccuccuaugcacagagcagaggagggagaagcucuggggagccag

SEQ ID NO: 246292 - RNA, 64 nt, hsa
aaugggggcucauugugagggaggugcagaggcagcagaggauuggcauaaaacugaaaaggag

SEQ ID NO: 246293 - RNA, 64 nt, hsa
auaagguggaauuugcaggucagcccaggaauuggcagaggaaguaggugucugauaacccuuu

SEQ ID NO: 246294 - RNA, 64 nt, hsa
gggaacaguucuagggagugagacauuuuugggagcagaggaaaacucugcugauguucggucc

SEQ ID NO: 246295 - RNA, 64 nt, hsa
cuugagaaauccuccuugguaucaugaaacuggagcagaggaauugcaauuuagcaggaggucc

SEQ ID NO: 246296 - RNA, 64 nt, hsa
ccauccaugaccagaggauuauuuuccugccuuggcagaggaggaggagucaagggagcagggc

SEQ ID NO: 246297 - RNA, 64 nt, hsa
uuugagcaggggagugaggcagccagaagugggggcagaggaggguggcucuguuuccccaagg

SEQ ID NO: 246298 - RNA, 64 nt, hsa
gacuccaaccgggguagccgcgaggaaggcgcuggcagaggacagaaauguccagucaccuccg

SEQ ID NO: 246299 - RNA, 64 nt, hsa
cacaucuacucaacuauccgaauauguccauuucgcagaggaggaaagugaggcccagggagug

SEQ ID NO: 246300 - RNA, 64 nt, hsa
aacauuccugcaaacagguuuuucucagcuucaggcagaggagacaacauggaagaagauuccc

SEQ ID NO: 246301 - RNA, 64 nt, hsa
aauaugaggaaaaauaucuugagcuaagaaaguagcagaggaaauuucacaugcaaagccacag

SEQ ID NO: 246302 - RNA, 64 nt, hsa; identical to SEQ ID NO: 196485

SEQ ID NO: 246303 - RNA, 64 nt, hsa; identical to SEQ ID NO: 196486

SEQ ID NO: 246304 - RNA, 64 nt, hsa; identical to SEQ ID NO: 196487

SEQ ID NO: 246305 - RNA, 64 nt, hsa; identical to SEQ ID NO: 196488

SEQ ID NO: 246306 - RNA, 64 nt, hsa; identical to SEQ ID NO: 196489

SEQ ID NO: 246307 - RNA, 64 nt, hsa; identical to SEQ ID NO: 196490

SEQ ID NO: 246308 - RNA, 64 nt, hsa; identical to SEQ ID NO: 196491

SEQ ID NO: 246309 - RNA, 64 nt, hsa; identical to SEQ ID NO: 196492

SEQ ID NO: 246310 - RNA, 64 nt, hsa; identical to SEQ ID NO: 196493

SEQ ID NO: 246311 - RNA, 64 nt, hsa; identical to SEQ ID NO: 196494

SEQ ID NO: 246312 - RNA, 64 nt, hsa; identical to SEQ ID NO: 196495

SEQ ID NO: 246313 - RNA, 64 nt, hsa; identical to SEQ ID NO: 196496

SEQ ID NO: 246314 - RNA, 64 nt, hsa; identical to SEQ ID NO: 196497

SEQ ID NO: 246315 - RNA, 64 nt, hsa; identical to SEQ ID NO: 196498

SEQ ID NO: 246316 - RNA, 64 nt, hsa; identical to SEQ ID NO: 196499

SEQ ID NO: 246317 - RNA, 64 nt, hsa; identical to SEQ ID NO: 196500

SEQ ID NO: 246318 - RNA, 64 nt, hsa; identical to SEQ ID NO: 196501

SEQ ID NO: 246319 - RNA, 64 nt, hsa; identical to SEQ ID NO: 196502

SEQ ID NO: 246320 - RNA, 64 nt, hsa; identical to SEQ ID NO: 196503

SEQ ID NO: 246321 - RNA, 64 nt, hsa; identical to SEQ ID NO: 196504

SEQ ID NO: 246322 - RNA, 64 nt, hsa; identical to SEQ ID NO: 196505

SEQ ID NO: 246323 - RNA, 64 nt, hsa; identical to SEQ ID NO: 196506

SEQ ID NO: 246324 - RNA, 64 nt, hsa; identical to SEQ ID NO: 196507

SEQ ID NO: 246325 - RNA, 64 nt, hsa; identical to SEQ ID NO: 196508

SEQ ID NO: 246326 - RNA, 64 nt, hsa; identical to SEQ ID NO: 196509

SEQ ID NO: 246327 - RNA, 64 nt, hsa; identical to SEQ ID NO: 196510

SEQ ID NO: 246328 - RNA, 64 nt, hsa; identical to SEQ ID NO: 196511

SEQ ID NO: 246329 - RNA, 64 nt, hsa; identical to SEQ ID NO: 196512

SEQ ID NO: 246330 - RNA, 64 nt, hsa; identical to SEQ ID NO: 196513

SEQ ID NO: 246331 - RNA, 64 nt, hsa; identical to SEQ ID NO: 196514

SEQ ID NO: 246332 - RNA, 64 nt, hsa; identical to SEQ ID NO: 196515

SEQ ID NO: 246333 - RNA, 64 nt, hsa; identical to SEQ ID NO: 196516

SEQ ID NO: 246334 - RNA, 64 nt, hsa; identical to SEQ ID NO: 196517

SEQ ID NO: 246335 - RNA, 64 nt, hsa; identical to SEQ ID NO: 196518

SEQ ID NO: 246336 - RNA, 64 nt, hsa; identical to SEQ ID NO: 196519

SEQ ID NO: 246337 - RNA, 64 nt, hsa; identical to SEQ ID NO: 196520

SEQ ID NO: 246338 - RNA, 64 nt, hsa; identical to SEQ ID NO: 196521

SEQ ID NO: 246339 - RNA, 64 nt, hsa; identical to SEQ ID NO: 196522

SEQ ID NO: 246340 - RNA, 64 nt, hsa; identical to SEQ ID NO: 196523

SEQ ID NO: 246341 - RNA, 64 nt, hsa; identical to SEQ ID NO: 196524

SEQ ID NO: 246342 - RNA, 64 nt, hsa; identical to SEQ ID NO: 196525

SEQ ID NO: 246343 - RNA, 64 nt, hsa; identical to SEQ ID NO: 196526

SEQ ID NO: 246344 - RNA, 64 nt, hsa; identical to SEQ ID NO: 196527

SEQ ID NO: 246345 - RNA, 64 nt, hsa; identical to SEQ ID NO: 196528

SEQ ID NO: 246346 - RNA, 64 nt, hsa; identical to SEQ ID NO: 196529

SEQ ID NO: 246347 - RNA, 64 nt, hsa; identical to SEQ ID NO: 196530

SEQ ID NO: 246348 - RNA, 64 nt, hsa; identical to SEQ ID NO: 196531

SEQ ID NO: 246349 - RNA, 64 nt, hsa; identical to SEQ ID NO: 196532

SEQ ID NO: 246350 - RNA, 64 nt, hsa; identical to SEQ ID NO: 196533

SEQ ID NO: 246351 - RNA, 64 nt, hsa; identical to SEQ ID NO: 196534

SEQ ID NO: 246352 - RNA, 64 nt, hsa; identical to SEQ ID NO: 196535

SEQ ID NO: 246353 - RNA, 64 nt, hsa; identical to SEQ ID NO: 196536

SEQ ID NO: 246354 - RNA, 64 nt, hsa; identical to SEQ ID NO: 196537

SEQ ID NO: 246355 - RNA, 64 nt, hsa; identical to SEQ ID NO: 196538

SEQ ID NO: 246356 - RNA, 64 nt, hsa; identical to SEQ ID NO: 196539

SEQ ID NO: 246357 - RNA, 64 nt, hsa; identical to SEQ ID NO: 196540

SEQ ID NO: 246358 - RNA, 64 nt, hsa; identical to SEQ ID NO: 196541

SEQ ID NO: 246359 - RNA, 64 nt, hsa; identical to SEQ ID NO: 196542

SEQ ID NO: 246360 - RNA, 64 nt, hsa; identical to SEQ ID NO: 196543

SEQ ID NO: 246361 - RNA, 64 nt, hsa; identical to SEQ ID NO: 196544

SEQ ID NO: 246362 - RNA, 64 nt, hsa; identical to SEQ ID NO: 196545

SEQ ID NO: 246363 - RNA, 64 nt, hsa; identical to SEQ ID NO: 196546

SEQ ID NO: 246364 - RNA, 64 nt, hsa; identical to SEQ ID NO: 196547

SEQ ID NO: 246365 - RNA, 64 nt, hsa; identical to SEQ ID NO: 196548

SEQ ID NO: 246366 - RNA, 64 nt, hsa; identical to SEQ ID NO: 196549

SEQ ID NO: 246367 - RNA, 64 nt, hsa; identical to SEQ ID NO: 196550

SEQ ID NO: 246368 - RNA, 64 nt, hsa; identical to SEQ ID NO: 196551

SEQ ID NO: 246369 - RNA, 64 nt, hsa; identical to SEQ ID NO: 196551

SEQ ID NO: 246370 - RNA, 64 nt, hsa; identical to SEQ ID NO: 196553

SEQ ID NO: 246371 - RNA, 64 nt, hsa; identical to SEQ ID NO: 196554

SEQ ID NO: 246372 - RNA, 64 nt, hsa; identical to SEQ ID NO: 196555

SEQ ID NO: 246373 - RNA, 64 nt, hsa; identical to SEQ ID NO: 196556

SEQ ID NO: 246374 - RNA, 64 nt, hsa; identical to SEQ ID NO: 196557

SEQ ID NO: 246375 - RNA, 64 nt, hsa; identical to SEQ ID NO: 196558

SEQ ID NO: 246376 - RNA, 64 nt, hsa; identical to SEQ ID NO: 196559

SEQ ID NO: 246377 - RNA, 64 nt, hsa; identical to SEQ ID NO: 196560

SEQ ID NO: 246378 - RNA, 64 nt, hsa; identical to SEQ ID NO: 196561

SEQ ID NO: 246379 - RNA, 64 nt, hsa; identical to SEQ ID NO: 196562

SEQ ID NO: 246380 - RNA, 64 nt, hsa; identical to SEQ ID NO: 196563

SEQ ID NO: 246381 - RNA, 64 nt, hsa; identical to SEQ ID NO: 196564

SEQ ID NO: 246382 - RNA, 64 nt, hsa; identical to SEQ ID NO: 196565

SEQ ID NO: 246383 - RNA, 64 nt, hsa; identical to SEQ ID NO: 196566

SEQ ID NO: 246384 - RNA, 64 nt, hsa; identical to SEQ ID NO: 196567

SEQ ID NO: 246385 - RNA, 64 nt, hsa; identical to SEQ ID NO: 196568

SEQ ID NO: 246386 - RNA, 64 nt, hsa; identical to SEQ ID NO: 196569

SEQ ID NO: 246387 - RNA, 64 nt, hsa; identical to SEQ ID NO: 196570

SEQ ID NO: 246388 - RNA, 64 nt, hsa; identical to SEQ ID NO: 196571

SEQ ID NO: 246389 - RNA, 64 nt, hsa; identical to SEQ ID NO: 196572

SEQ ID NO: 246390 - RNA, 60 nt, hsa
gucuauaauugcagauguuauuguaugaauguaccauaauauauuugagcagucccugcu

SEQ ID NO: 246391 - RNA, 60 nt, hsa
uucugaaguccaaaaaauuaucauuacaguguaccauauuaagccaugugaauaaguagu

SEQ ID NO: 246392 - RNA, 60 nt, hsa
ucuugaauuauuuugcagacuagugagucuguaccauaaguauuaaucaccuccacucau

SEQ ID NO: 246393 - RNA, 60 nt, hsa
cucugucuucaacucuuugacccuccauguguaccauagaggggggaaaggugguauuuu

SEQ ID NO: 246394 - RNA, 60 nt, hsa
guuaaauuugcaaugagaagcaaauuuacaguaccauaacuaauaaagcaggguacagau

SEQ ID NO: 246395 - RNA, 60 nt, hsa
guaccuuauguauuaaauagaaaucggaauguaccauaauaaauccaaacucucaauuac

SEQ ID NO: 246396 - RNA, 60 nt, hsa
cuuuccuaccccuuuagccuucuguaccuaguaccauauuccaguuuuaaagaacuggca

SEQ ID NO: 246397 - RNA, 60 nt, hsa
acuaaauggaacccaaauauuaauguuaugguaccauauacugauguaaaaaucaugcug

SEQ ID NO: 246398 - RNA, 60 nt, hsa
aaagcaaucaauuguauauuuuugugauguguaccauacugugugcuccagcaaaugucc

SEQ ID NO: 246399 - RNA, 60 nt, hsa
aauuucucuauccugcucugaggcuaauugguaccauauuuucccuuugugucuugugac

SEQ ID NO: 246400 - RNA, 60 nt, hsa
uuccuugguaucugaaaaaaauaccaaauaguaccauacaugaguuauuucuaaguuuga

SEQ ID NO: 246401 - RNA, 60 nt, hsa
cugugaauuuugaaguuaaacuaaauuuugguaccauaccaacuggaauuuaggcuuuaa

SEQ ID NO: 246402 - RNA, 60 nt, hsa
gcuuuuuuccccuuccuaaauguuuuaauuguaccauaguguuuugcucacugaagaagc

SEQ ID NO: 246403 - RNA, 60 nt, hsa
ggguauaaaacagccugaaaguguaugcauguaccauaacaucuagacuuaauauauugu

SEQ ID NO: 246404 - RNA, 60 nt, hsa; identical to SEQ ID NO: 246401

SEQ ID NO: 246405 - RNA, 60 nt, hsa
uggaauuuauaauucaguauguuuuacacuguaccauauagcaaaacuuuuaaacuacag

SEQ ID NO: 246406 - RNA, 60 nt, hsa
agugacgcaaaucugcaugaacagcuaauuguaccauaguguucauugauacaaucauag

SEQ ID NO: 246407 - RNA, 60 nt, hsa
cauaaagccacaacuccuacaugauguuauguaccauaugaucuguuuuguaucuuaaau

SEQ ID NO: 246408 - RNA, 60 nt, hsa
gaggccuaagaauuuccuaagccaugucuuguaccauagugccacauugaugacuuguuu

SEQ ID NO: 246409 - RNA, 58 nt, hsa
aacuugaauaccaacucuucagagaagcagguaccauaucuuacuucucuucccauua

SEQ ID NO: 246410 - RNA, 60 nt, hsa
augauaccagaugaaaagaaggagaaguguguaccauauguuuugagcagaggacccucc

SEQ ID NO: 246411 - RNA, 60 nt, hsa
cacuagauguuaucaaucaaacacuaaaauguaccauacaaaucccuuaagccucucaaa

SEQ ID NO: 246412 - RNA, 60 nt, hsa
ucaaacaauguagcauaaagugguauugaaguaccauauuuaaguugaacugcucugcau

SEQ ID NO: 246413 - RNA, 60 nt, hsa
ccuuagucuuggucaucagaaccucacuugguaccauauagaucaaaagcuuuguaacca

SEQ ID NO: 246414 - RNA, 60 nt, hsa
gugugaugacuuuuuuuuaaaugagguucaguaccauaauguuuauuuacuggaagauaa

SEQ ID NO: 246415 - RNA, 60 nt, hsa
auguauuauuaaauguuagauaaauggguaguaccauacuacaaauauuuaaaugcaaaa

SEQ ID NO: 246416 - RNA, 60 nt, hsa
accugaacaccagaauuagaauuaaacauuguaccauacaauuucauuaucuuaucagaa

SEQ ID NO: 246417 - RNA, 60 nt, hsa
gagacugagaaugacucaagggacgucauaguaccauaguuuuaaggaccaaggugugcc

SEQ ID NO: 246418 - RNA, 60 nt, hsa
uuucaaaaaagaaaauguguuuuuuguuugguaccauagugugaaaugcugggaacaaug

SEQ ID NO: 246419 - RNA, 60 nt, hsa
auaugcuauuuauuaaguauuuuauuaggaguaccauaauucugguagcuaaauauauau

SEQ ID NO: 246420 - RNA, 60 nt, hsa
uguggcucaccugaaggcuuugcaaaauuuguaccauaaccguuuauuuaacauauauuu

SEQ ID NO: 246421 - RNA, 60 nt, hsa
cucagguauaaagccaauuaagguacaauuguaccauaaagggaacaaucuguuucugau

SEQ ID NO: 246422 - RNA, 60 nt, hsa
aguccaaauugucugucugcucuuauuuuuguaccauauugcucuuaaaaaucuugguuu

SEQ ID NO: 246423 - RNA, 60 nt, hsa
uuuggucauuauaagugacuuuuaguaaaaguaccauaaaccuuauguuaugccacagaa

SEQ ID NO: 246424 - RNA, 60 nt, hsa
ccuagacuagacaugcgaaaguuugccuuuguaccauauaaagggggagggaaauagcua

SEQ ID NO: 246425 - RNA, 60 nt, hsa
aagucuacuuuugaagaggaaaacaggaacguaccauauauuuugcuaaggguaaaauau

SEQ ID NO: 246426 - RNA, 60 nt, hsa
agagagggaaagaauguugcaccugcucuaguaccauaggucaagaggcuucuggaucac

SEQ ID NO: 246427 - RNA, 60 nt, hsa
uugcuaauaccaacuauuucaauaaguguuguaccauauguagcauuaaauauaaaauac

SEQ ID NO: 246428 - RNA, 60 nt, hsa
ggagagaaaagcuggaccuuuucccuugcuguaccauauucagcauuugauuuccauggg

SEQ ID NO: 246429 - RNA, 60 nt, hsa
uuccuucuuuauaaugcuaaaucuauaugaguaccauauuuuuauaagucaguggucuga

SEQ ID NO: 246430 - RNA, 60 nt, hsa
aauacccagcacaauacuuguauauuuuuaguaccauacagaaguaaaaucccaggaacu

SEQ ID NO: 246431 - RNA, 60 nt, hsa
aaauucaaaauacuuuuuaaggauggcacaguaccauauaacuggaguaauaaaacauga

SEQ ID NO: 246432 - RNA, 60 nt, hsa
cccauuccaguguuacuuucugugaaugcaguaccauauucucauuuucaaugacauuuc

SEQ ID NO: 246433 - RNA, 60 nt, hsa
cuaguuuuggcugacaggaagcucaguucaguaccauaacuacagaaccugucaucugua

SEQ ID NO: 246434 - RNA, 60 nt, hsa
augccaagcguaugauacuauagauauaguguaccauacugccuuucuuugcauggcuug

SEQ ID NO: 246435 - RNA, 60 nt, hsa
uuguacugaaauaaaguagaaaauuguuacguaccauauuuguaacuaucaacuuuuaaa

SEQ ID NO: 246436 - RNA, 60 nt, hsa
gggagugacgaugaugugaguauuuagaauguaccauauuuuuuguaaauuauuuauguu

SEQ ID NO: 246437 - RNA, 60 nt, hsa
auuuauuuauuguaauaccucacagacguuguaccauauccaugcacauuuaguugccug

SEQ ID NO: 246438 - RNA, 60 nt, hsa
uuuaaaucuugaccuuaagauugauuucaaguaccauacuguaguacagauaaguggcuc

SEQ ID NO: 246439 - RNA, 60 nt, hsa
guauuguaagugaaauguaauuauuucuguguaccauauggaguaacuaaggucauuguu

SEQ ID NO: 246440 - RNA, 60 nt, hsa
cacgacaguggcaccaccugauuucaugauguaccauaugcaguaacccauguuugaggu

SEQ ID NO: 246441 - RNA, 60 nt, hsa
uauaaacaucacacuuuaauuuggagcauaguaccauagaaauuugggguucuaaauaua

SEQ ID NO: 246442 - RNA, 60 nt, hsa
uccucccccuaugcauugguuuuuuucccuguaccauacaauucuacuguaacuacccau

SEQ ID NO: 246443 - RNA, 60 nt, hsa
cugacaaucugucuuaaaauuggugcauauguaccauauucaaagugauuauugauauag

SEQ ID NO: 246444 - RNA, 60 nt, hsa
ccccacuuccagugacugcucuuauuuuguguaccauaagccaacaaccgcugacuccag

SEQ ID NO: 246445 - RNA, 60 nt, hsa
gaaggaacuuuaaaagcaacaagcaauuauguaccauauauacacuguagcaaauauuuu

SEQ ID NO: 246446 - RNA, 60 nt, hsa
uaguuaaauggaauguugguaugguacagaguaccauauugcuaagaaaacugucuuaua

SEQ ID NO: 246447 - RNA, 60 nt, hsa
cugucguaccaucuagaacuauacuguccaguaccauagccucuagccguauguagcuau

SEQ ID NO: 246448 - RNA, 60 nt, hsa
agacuuuuggaagaggauauauauagcauaguaccauaccacuuauaaaguggaaacucu

SEQ ID NO: 246449 - RNA, 60 nt, hsa
ucgaaccucuacauugugaaguugcacuauguaccauacucuaaaaugaaauaagaacuc

SEQ ID NO: 246450 - RNA, 60 nt, hsa
caaaaaaaauuuaaaaaaauacaguauucuguaccauagcgcugcucuuaugccauuugu

SEQ ID NO: 246451 - RNA, 60 nt, hsa
uuguuuuguuuuguucugaagagaagagugguaccauauguugcaggaagucaaacugga

SEQ ID NO: 246452 - RNA, 60 nt, hsa
cugagucacaacauguuuuagagcauccaaguaccauauaauccaacuaucaugguaagg

SEQ ID NO: 246453 - RNA, 60 nt, hsa
accuuuuagaaaaagauucuuguugcaaaaguaccauaggcaguguguguguaaggucau

SEQ ID NO: 246454 - RNA, 60 nt, hsa
uuucaauuguagaaacaacugguauguacaguaccauaauuuaauuacauuuuacuuuaa

SEQ ID NO: 246455 - RNA, 60 nt, hsa
aauuguagcuaacaauccuaauuauaucuaguaccauacugaguuauugguaugacccug

SEQ ID NO: 246456 - RNA, 60 nt, hsa
guauuugagaugaacucugaguaugaagcuguaccauaaugcaggacgucaguuuuggug

SEQ ID NO: 246457 - RNA, 60 nt, hsa
gagaagaaaaaaagcuucuuuccauaucaaguaccauaugaguucauuuaaacugcaccu

SEQ ID NO: 246458 - RNA, 60 nt, hsa
uguuuaaucgccaaaaacacacuggccaguguaccauaauauguuaccagaagaguuauu

SEQ ID NO: 246459 - RNA, 60 nt, hsa
acauguaaaauuaaaaaaacuauuagaacuguaccauaauuauguugaagguagaaguga

SEQ ID NO: 246460 - RNA, 60 nt, hsa
uugaaaaacaguugauuugggggcacuuagguaccauaugccccauucccaaagggcaca

SEQ ID NO: 246461 - RNA, 60 nt, hsa
cuauaacuugccaaaguagaagaaauaguaguaccauaugccaaagugauagagaugaau

SEQ ID NO: 246462 - RNA, 60 nt, hsa
uguuuucucuuuucuaaaagacaaauuaugguaccauaagcugccaaagauccccuccug

SEQ ID NO: 246463 - RNA, 60 nt, hsa
ugacucuuuacugcucugccugaagcccuaguaccauaauucaagauugcauuuucuuaa

SEQ ID NO: 246464 - RNA, 60 nt, hsa
uugucguccuguccuuccuaucuccccaaaguaccauagccaguuuccagaugggccaca

SEQ ID NO: 246465 - RNA, 60 nt, hsa
gcuacauaaaacauuucaggauuuaaauuaguaccauaucaauuuucugugaugauguau

SEQ ID NO: 246466 - RNA, 60 nt, hsa
auuuuccuuuaauuucucuggaguaauacuguaccauacuggucuuugcuuuuaguaaua

SEQ ID NO: 246467 - RNA, 60 nt, hsa
gcuugccccaucuauuuaugucuccgcuuuguaccauaaccgaacccacggaaagacgcu

SEQ ID NO: 246468 - RNA, 60 nt, hsa
cuauuuauucccuaauguaccugaacacuaguaccauagaacugaaccaccaucuguauc

SEQ ID NO: 246469 - RNA, 60 nt, hsa
gggacauuucauauuuauaaugugcugaagguaccauauuuuaaauguuauuuaaugcag

SEQ ID NO: 246470 - RNA, 60 nt, hsa
ugacuugcgaaaaagcuuuugcccuguuguguaccauaacauuuaaaagaauggaaaaug

SEQ ID NO: 246471 - RNA, 60 nt, hsa
gaagccggcucuucaaagacaauggaaacuguaccauacacauuggaaggcucccuaaca

SEQ ID NO: 246472 - RNA, 60 nt, hsa
accccuuccuuuuuggugauuuacaccacuguaccauacugacccaggcugggggcaggu

SEQ ID NO: 246473 - RNA, 60 nt, hsa
agcaaagacaaaauaauguuaaacaauucuguaccauaacauuuucuguaaugauacuga

SEQ ID NO: 246474 - RNA, 60 nt, hsa
uagaccaagucagaaagaucucucucgagcguaccauaaaccugcagagagaagucucga

SEQ ID NO: 246475 - RNA, 60 nt, hsa
caaauugauugucuuuccccccucccuccaguaccauaaucuuagagacaaaccuuaaaa

SEQ ID NO: 246476 - RNA, 60 nt, hsa
uguaucuccuuuuguauuuuuuugaauuuuguaccauauguaucaccuauucaaaaaaaa

SEQ ID NO: 246477 - RNA, 60 nt, hsa
aaaucaucuauuccuugggaaagguauuuuguaccauaugggacugaaaucauuucucug

SEQ ID NO: 246478 - RNA, 60 nt, hsa
uuucauaauugagacagaacuguuuguuauguaccauaaugcuaaauaaaacuguggcac

SEQ ID NO: 246479 - RNA, 60 nt, hsa
ugugcuagcauaacugcucuagcuucuuguguaccauaguacuguggcuucagauuuagu

SEQ ID NO: 246480 - RNA, 60 nt, hsa
cagaaugccugccuuuccugguuauuuuuuguaccauauuguaaauuauauuauuuauuc

SEQ ID NO: 246481 - RNA, 60 nt, hsa
uaccgcugcauaguauuccauugugugaguguaccauaauguauuuaaccagucuucuuu

SEQ ID NO: 246482 - RNA, 60 nt, hsa
aaauugguuggagaauuuagguuuuuauuaguaccauaguaccauuuauacaaauuagaa

SEQ ID NO: 246483 - RNA, 60 nt, hsa
auacuguaaauuuacauacguugucuagaaguaccauaggguuuaaaaaccugggcuggc

SEQ ID NO: 246484 - RNA, 60 nt, hsa
uacauugugagcucugguuauuuuucucuuguaccauagaaaaauguauaaaaauuauca

SEQ ID NO: 246485 - RNA, 60 nt, hsa
uucucauauuuaauuaucauguaguuuaauguaccauaugugaaacauucuggccauagc

SEQ ID NO: 246486 - RNA, 60 nt, hsa
uguccugccucuggccuguguccuggguguguaccauaccugcugggccagucccacaca

SEQ ID NO: 246487 - RNA, 60 nt, hsa
ucaucaauacauccaccaaaaauauauaauguaccauauauauuaauagucaacaaauac

SEQ ID NO: 246488 - RNA, 60 nt, hsa
aaaaaaaaauaccauaagaagaaucagaauguaccauaagaaaucagaugcaaagcacgu

SEQ ID NO: 246489 - RNA, 60 nt, hsa
auacauaaccuugaauaaugaggaucaacuguaccauauuuaauaaagcacaaaacccac

SEQ ID NO: 246490 - RNA, 60 nt, hsa
uuaauguauauuauucagaaacauuguauuguaccauaaaacuuguauuaucaaacuguu

SEQ ID NO: 246491 - RNA, 60 nt, hsa
agucucuguuccugcuguauuauacaaacuguaccauaguccugggaaaaggguggacuc

SEQ ID NO: 246492 - RNA, 60 nt, hsa
cucugagugccuucuucccaaaagccagcaguaccauaccugcugucagcaaguguguaa

SEQ ID NO: 246493 - RNA, 60 nt, hsa
uuuuaaaucacaagucuaauaauuauuaaaguaccauacggaauaacugucuacuguuua

SEQ ID NO: 246494 - RNA, 60 nt, hsa
auuguuucuccgugugucuuuaaccacccaguaccauacuuuuuucuugaucuggaucua

SEQ ID NO: 246495 - RNA, 60 nt, hsa
gcuuauucugagacagacauuccuggcaauguaccauacaaaaaauaagccaacucugac

SEQ ID NO: 246496 - RNA, 60 nt, hsa
ggagggaaggaggaugaguccugggaggaaguaccauagcauuguacuugccucuuuagc

SEQ ID NO: 246497 - RNA, 60 nt, hsa
uccccagcaccuccagguuggcccacacagguaccauaagcugccucggcucccuguggc

SEQ ID NO: 246498 - RNA, 60 nt, hsa
gucaacugaauucacacacacacaaauauaguaccauagaaaaaguuuguuuucucgaaa

SEQ ID NO: 246499 - RNA, 60 nt, hsa
aauuaguaauaaaacccagcauguacaaaaguaccauagaacagaacugcuaaauacugu

SEQ ID NO: 246500 - RNA, 60 nt, hsa
agugucacucuguaguuacuguggucacuuguaccauauagagguguaacacuugucaag

SEQ ID NO: 246501 - RNA, 60 nt, hsa
auuaggguuaguauuaaacuuuguuuagauguaccauaauuaacuuggcuaguugauugu

SEQ ID NO: 246502 - RNA, 60 nt, hsa
ucaccuuuuuauuauugacauuaaguaaugguaccauauauuuuuuaaaauacauauuga

SEQ ID NO: 246503 - RNA, 60 nt, hsa
uguuucuuuguugccaguguuaccuuugcuguaccauagacuuaaaauuccucuauuguu

SEQ ID NO: 246504 - RNA, 60 nt, hsa
caaauauccucuugggcccaaaugaacauuguaccauagucuucuggaaagcaaacaugc

SEQ ID NO: 246505 - RNA, 60 nt, hsa
ccucccaucccccaggcugguaccaguucuguaccauaugagaaaguugccuucagaagg

SEQ ID NO: 246506 - RNA, 60 nt, hsa
cagucagugggcaagaggaaagauaaguaaguaccauacacaccuaaaagaugagagaau

SEQ ID NO: 246507 - RNA, 60 nt, hsa
cagugaguuucugcugucuuuuucaaguauguaccauaggacuuaaaggugauuuggaug

SEQ ID NO: 246508 - RNA, 64 nt, hsa
cuugcacagaauugcaaaugucuuuugccauaccaagggccagacucagaacccuuggagucau

SEQ ID NO: 246509 - RNA, 64 nt, hsa
aacuuauuguucuuuucuauucuuucaguugaauaagggccaguugguaugcagcccauguaua

SEQ ID NO: 246510 - RNA, 64 nt, hsa
aggccgugggggcugcugaaggcucuuuccccgcaagggccagguguugacaccuuaaagcugg

SEQ ID NO: 246511 - RNA, 64 nt, hsa
cugagucagccagauccucccccuacuucuccccaagggccaagaacugcucagggacauuaaa

SEQ ID NO: 246512 - RNA, 64 nt, hsa
caccaagagccaauggaguagaccccuggcugguaagggccaagucccaccgguugcuucuggg

SEQ ID NO: 246513 - RNA, 64 nt, hsa
cucacagacuggagacaaugcagaugccagagcaaagggccaggaagggucaaaacauuuuauu

SEQ ID NO: 246514 - RNA, 64 nt, hsa
gcauguggucaguuuccauuuucuauuaccuggaaagggccauaaggaagcaggcagggcuuag

SEQ ID NO: 246515 - RNA, 64 nt, hsa
ggucccaguucuguguagcuugcccugccccaugaagggccaccagccaagggcccuggccacg

SEQ ID NO: 246516 - RNA, 64 nt, hsa
ggccagaggguccaggcaucccaaguccagcgugaagggccacagccccucuuggcugccaagc

SEQ ID NO: 246517 - RNA, 64 nt, hsa
ccauucagggagaaaccucuccuucccgugugagaagggccagaggguccaggcaucccaaguc

SEQ ID NO: 246518 - RNA, 64 nt, hsa
uguuacugcagcaucugggcugccagccacagggaagggccaagccccauguagccccagucau

SEQ ID NO: 246519 - RNA, 64 nt, hsa
cuguguccugaggugcauuuccuguuguacacacaagggccaggcuccauucucccucccuuuc

SEQ ID NO: 246520 - RNA, 64 nt, hsa
cuguuagccagugguggaggagcaaggcuucaggaagggccagccacaugccaucuucccugcg

SEQ ID NO: 246521 - RNA, 64 nt, hsa
caucggucucugaggugacacucuggagugguugaagggccacaaggugcaggguuaauacucu

SEQ ID NO: 246522 - RNA, 64 nt, hsa
ccugcggcuggggccgucugccuacacgcuccagaagggccagcgcagagcugggauggccacu

SEQ ID NO: 246523 - RNA, 64 nt, hsa
auggcugggcggcuggugagcaguccaggugcccaagggccagcuugcugcugcccaaagcaga

SEQ ID NO: 246524 - RNA, 64 nt, hsa
caguauagacagacagauggacccuggcuguacgaagggccagggccacuggggcuugggggcg

SEQ ID NO: 246525 - RNA, 64 nt, hsa
cacccagcaucagcccuggggagagaggcucccaaagggccaccaugagcccaagauauccuuc

SEQ ID NO: 246526 - RNA, 64 nt, hsa
aguaagcuaguguuucacauuuccaaaaucagccuucuggcagacuuggaaguacucuugagaa

SEQ ID NO: 246527 - RNA, 64 nt, hsa
cauuuaccaacuucugugaauauacccaagaagauucuggcaaaacauagauucaaauuacagu

SEQ ID NO: 246528 - RNA, 64 nt, hsa
uggaguggguguuguucaaguaucugugguuugguucuggcauuuuguucccaccauccccuuc

SEQ ID NO: 246529 - RNA, 64 nt, hsa
uacagcuauuacugaauuauagaaacugguuuauuucuggcagaaagcugcagugccaccugag

SEQ ID NO: 246530 - RNA, 64 nt, hsa
aagaucuuuguuuuuuguuuucauuaaagagccauucuggcacuuuaaugauaaaaucccauug

SEQ ID NO: 246531 - RNA, 64 nt, hsa
cugcugggaauauccgugccaggaaaagaaaaauuucuggcaaauauuuugucacugcuguaaa

SEQ ID NO: 246532 - RNA, 64 nt, hsa
ucucucugugacuggugauuuuguggguugaaacuucuggcaaaagggggcagcccuugggagc

SEQ ID NO: 246533 - RNA, 64 nt, hsa
uuuacuaaauaauggccugaaauugcaagagcauuucuggcauguuguuguaauuauuccauua

SEQ ID NO: 246534 - RNA, 64 nt, hsa
aucuggggacaaaggucaagccaguaaagaauacuucuggcagcacuuugggaggccaaggcgg

SEQ ID NO: 246535 - RNA, 64 nt, hsa
gacucugucucaaaaaaaaaaaaaaaaaaaauacuucuggcagagucuuuuaucuuccuauuaa

SEQ ID NO: 246536 - RNA, 64 nt, hsa
cuaucuuucauucuccacuccuaaucccucuccuuucuggcauccuggccucucgugguccuca

SEQ ID NO: 246537 - RNA, 64 nt, hsa
agccaagcugaccuuggacccuguccagcacagcuucuggcacaggaugcuuggugaauguacc

SEQ ID NO: 246538 - RNA, 59 nt, hsa
gcggcggcucccagcucugagggggcccauucuggcagcggcgccugcggccugaccac

SEQ ID NO: 246539 - RNA, 64 nt, hsa
uuaaaccucucugccucuggaggagggugggguauucuggcaggaugaaucgcaggauggcgcg

SEQ ID NO: 246540 - RNA, 64 nt, hsa
gaaauuguguuuuccccauuuauggugcucuguauucuggcauuaugcagcagccucccagaag

SEQ ID NO: 246541 - RNA, 64 nt, hsa
gcugcccuuggcccugcaagcacaucaugacccuuucuggcagccucuuggugcucuggguagu

SEQ ID NO: 246542 - RNA, 64 nt, hsa; identical to SEQ ID NO: 111305

SEQ ID NO: 246543 - RNA, 64 nt, hsa; identical to SEQ ID NO: 111306

SEQ ID NO: 246544 - RNA, 64 nt, hsa; identical to SEQ ID NO: 111307

SEQ ID NO: 246545 - RNA, 64 nt, hsa; identical to SEQ ID NO: 111308

SEQ ID NO: 246546 - RNA, 64 nt, hsa; identical to SEQ ID NO: 111309

SEQ ID NO: 246547 - RNA, 64 nt, hsa; identical to SEQ ID NO: 111310

SEQ ID NO: 246548 - RNA, 64 nt, hsa; identical to SEQ ID NO: 111311

SEQ ID NO: 246549 - RNA, 64 nt, hsa; identical to SEQ ID NO: 111312

SEQ ID NO: 246550 - RNA, 64 nt, hsa; identical to SEQ ID NO: 111313

SEQ ID NO: 246551 - RNA, 64 nt, hsa; identical to SEQ ID NO: 111314

SEQ ID NO: 246552 - RNA, 64 nt, hsa; identical to SEQ ID NO: 111315

SEQ ID NO: 246553 - RNA, 64 nt, hsa; identical to SEQ ID NO: 111316

SEQ ID NO: 246554 - RNA, 64 nt, hsa; identical to SEQ ID NO: 111317

SEQ ID NO: 246555 - RNA, 64 nt, hsa; identical to SEQ ID NO: 111318

SEQ ID NO: 246556 - RNA, 64 nt, hsa; identical to SEQ ID NO: 111319

SEQ ID NO: 246557 - RNA, 64 nt, hsa; identical to SEQ ID NO: 111320

SEQ ID NO: 246558 - RNA, 64 nt, hsa; identical to SEQ ID NO: 111321

SEQ ID NO: 246559 - RNA, 64 nt, hsa; identical to SEQ ID NO: 111322

SEQ ID NO: 246560 - RNA, 64 nt, hsa; identical to SEQ ID NO: 111323

SEQ ID NO: 246561 - RNA, 64 nt, hsa; identical to SEQ ID NO: 111324

SEQ ID NO: 246562 - RNA, 64 nt, hsa; identical to SEQ ID NO: 111325

SEQ ID NO: 246563 - RNA, 64 nt, hsa; identical to SEQ ID NO: 111326

SEQ ID NO: 246564 - RNA, 64 nt, hsa; identical to SEQ ID NO: 111327

SEQ ID NO: 246565 - RNA, 64 nt, hsa; identical to SEQ ID NO: 111328

SEQ ID NO: 246566 - RNA, 64 nt, hsa; identical to SEQ ID NO: 111329

SEQ ID NO: 246567 - RNA, 64 nt, hsa; identical to SEQ ID NO: 111330

SEQ ID NO: 246568 - RNA, 64 nt, hsa; identical to SEQ ID NO: 111331

SEQ ID NO: 246569 - RNA, 64 nt, hsa; identical to SEQ ID NO: 111332

SEQ ID NO: 246570 - RNA, 64 nt, hsa; identical to SEQ ID NO: 111333

SEQ ID NO: 246571 - RNA, 64 nt, hsa; identical to SEQ ID NO: 111334

SEQ ID NO: 246572 - RNA, 57 nt, hsa; identical to SEQ ID NO: 111335

SEQ ID NO: 246573 - RNA, 64 nt, hsa; identical to SEQ ID NO: 111336

SEQ ID NO: 246574 - RNA, 64 nt, hsa; identical to SEQ ID NO: 111337

SEQ ID NO: 246575 - RNA, 64 nt, hsa; identical to SEQ ID NO: 111338

SEQ ID NO: 246576 - RNA, 64 nt, hsa; identical to SEQ ID NO: 111339

SEQ ID NO: 246577 - RNA, 64 nt, hsa; identical to SEQ ID NO: 111340

SEQ ID NO: 246578 - RNA, 64 nt, hsa; identical to SEQ ID NO: 111341

SEQ ID NO: 246579 - RNA, 64 nt, hsa; identical to SEQ ID NO: 111342

SEQ ID NO: 246580 - RNA, 64 nt, hsa; identical to SEQ ID NO: 111343

SEQ ID NO: 246581 - RNA, 64 nt, hsa; identical to SEQ ID NO: 111344

SEQ ID NO: 246582 - RNA, 64 nt, hsa; identical to SEQ ID NO: 111345

SEQ ID NO: 246583 - RNA, 64 nt, hsa; identical to SEQ ID NO: 111346

SEQ ID NO: 246584 - RNA, 57 nt, hsa; identical to SEQ ID NO: 111347

SEQ ID NO: 246585 - RNA, 64 nt, hsa; identical to SEQ ID NO: 111348

SEQ ID NO: 246586 - RNA, 64 nt, hsa; identical to SEQ ID NO: 111349

SEQ ID NO: 246587 - RNA, 64 nt, hsa; identical to SEQ ID NO: 111350

SEQ ID NO: 246588 - RNA, 64 nt, hsa
gccacccuggucuguucuccaacucuuuuaaauggugcccaacuuuucuaagugagcuuagcaa

SEQ ID NO: 246589 - RNA, 64 nt, hsa
aaaucccaggccuggcuuccagcaccauccagcugugcccaagaagccacccuggucuguucuc

SEQ ID NO: 246590 - RNA, 64 nt, hsa
acuuggggcagcugaagcucacggugacucagcagugcccaacugaccaaucucccgcagcucu

SEQ ID NO: 246591 - RNA, 64 nt, hsa
ccagaggauucaggauaggacaaaggcccuggcugugcccaaaagggucuaccucagguggggu

SEQ ID NO: 246592 - RNA, 64 nt, hsa
auguacuuguauugauuauguaguucaguaagaugugcccaagucauuucagaaagaaagaccc

SEQ ID NO: 246593 - RNA, 64 nt, hsa
caguucuagagcaaucuacagcuguuuaugugaggugcccaacacccauucaucucaagugcuu

SEQ ID NO: 246594 - RNA, 64 nt, hsa; identical to SEQ ID NO: 161498

SEQ ID NO: 246595 - RNA, 64 nt, hsa; identical to SEQ ID NO: 161499

SEQ ID NO: 246596 - RNA, 64 nt, hsa; identical to SEQ ID NO: 161500

SEQ ID NO: 246597 - RNA, 64 nt, hsa; identical to SEQ ID NO: 161501

SEQ ID NO: 246598 - RNA, 64 nt, hsa; identical to SEQ ID NO: 161502

SEQ ID NO: 246599 - RNA, 64 nt, hsa; identical to SEQ ID NO: 161503

SEQ ID NO: 246600 - RNA, 64 nt, hsa; identical to SEQ ID NO: 161504

SEQ ID NO: 246601 - RNA, 64 nt, hsa; identical to SEQ ID NO: 161505

SEQ ID NO: 246602 - RNA, 64 nt, hsa; identical to SEQ ID NO: 161506

SEQ ID NO: 246603 - RNA, 64 nt, hsa; identical to SEQ ID NO: 161507

SEQ ID NO: 246604 - RNA, 64 nt, hsa; identical to SEQ ID NO: 161508

SEQ ID NO: 246605 - RNA, 64 nt, hsa; identical to SEQ ID NO: 161509

SEQ ID NO: 246606 - RNA, 64 nt, hsa; identical to SEQ ID NO: 161510

SEQ ID NO: 246607 - RNA, 64 nt, hsa; identical to SEQ ID NO: 161511

SEQ ID NO: 246608 - RNA, 64 nt, hsa; identical to SEQ ID NO: 161512

SEQ ID NO: 246609 - RNA, 64 nt, hsa; identical to SEQ ID NO: 161513

SEQ ID NO: 246610 - RNA, 64 nt, hsa; identical to SEQ ID NO: 161514

SEQ ID NO: 246611 - RNA, 64 nt, hsa; identical to SEQ ID NO: 161515

SEQ ID NO: 246612 - RNA, 64 nt, hsa; identical to SEQ ID NO: 161516

SEQ ID NO: 246613 - RNA, 64 nt, hsa; identical to SEQ ID NO: 161517

SEQ ID NO: 246614 - RNA, 64 nt, hsa; identical to SEQ ID NO: 161518

SEQ ID NO: 246615 - RNA, 64 nt, hsa; identical to SEQ ID NO: 161519

SEQ ID NO: 246616 - RNA, 64 nt, hsa; identical to SEQ ID NO: 161520

SEQ ID NO: 246617 - RNA, 64 nt, hsa; identical to SEQ ID NO: 161521

SEQ ID NO: 246618 - RNA, 64 nt, hsa; identical to SEQ ID NO: 161522

SEQ ID NO: 246619 - RNA, 64 nt, hsa; identical to SEQ ID NO: 161523

SEQ ID NO: 246620 - RNA, 64 nt, hsa; identical to SEQ ID NO: 161524

SEQ ID NO: 246621 - RNA, 64 nt, hsa; identical to SEQ ID NO: 161525

SEQ ID NO: 246622 - RNA, 64 nt, hsa; identical to SEQ ID NO: 161526

SEQ ID NO: 246623 - RNA, 64 nt, hsa; identical to SEQ ID NO: 161527

SEQ ID NO: 246624 - RNA, 64 nt, hsa; identical to SEQ ID NO: 161528

SEQ ID NO: 246625 - RNA, 64 nt, hsa; identical to SEQ ID NO: 161529

SEQ ID NO: 246626 - RNA, 64 nt, hsa; identical to SEQ ID NO: 161530

SEQ ID NO: 246627 - RNA, 64 nt, hsa; identical to SEQ ID NO: 161531

SEQ ID NO: 246628 - RNA, 64 nt, hsa; identical to SEQ ID NO: 161532

SEQ ID NO: 246629 - RNA, 64 nt, hsa; identical to SEQ ID NO: 161533

SEQ ID NO: 246630 - RNA, 59 nt, hsa
auggaaaggggauaucagauugguuucccccgguggagccuuagguuagugcccagugc

SEQ ID NO: 246631 - RNA, 59 nt, hsa
gugcuuugcuuaugggugcucgcugggguccgguggagacugaccacccugcuugagcc

SEQ ID NO: 246632 - RNA, 64 nt, hsa; identical to SEQ ID NO: 196000

SEQ ID NO: 246633 - RNA, 64 nt, hsa; identical to SEQ ID NO: 196001

SEQ ID NO: 246634 - RNA, 64 nt, hsa; identical to SEQ ID NO: 196002

SEQ ID NO: 246635 - RNA, 64 nt, hsa; identical to SEQ ID NO: 196003

SEQ ID NO: 246636 - RNA, 64 nt, hsa; identical to SEQ ID NO: 196004

SEQ ID NO: 246637 - RNA, 64 nt, hsa; identical to SEQ ID NO: 196005

SEQ ID NO: 246638 - RNA, 64 nt, hsa; identical to SEQ ID NO: 196006

SEQ ID NO: 246639 - RNA, 64 nt, hsa; identical to SEQ ID NO: 196007

SEQ ID NO: 246640 - RNA, 64 nt, hsa; identical to SEQ ID NO: 196008

SEQ ID NO: 246641 - RNA, 64 nt, hsa; identical to SEQ ID NO: 196009

SEQ ID NO: 246642 - RNA, 64 nt, hsa; identical to SEQ ID NO: 196010

SEQ ID NO: 246643 - RNA, 64 nt, hsa; identical to SEQ ID NO: 196011

SEQ ID NO: 246644 - RNA, 64 nt, hsa; identical to SEQ ID NO: 196012

SEQ ID NO: 246645 - RNA, 64 nt, hsa; identical to SEQ ID NO: 196013

SEQ ID NO: 246646 - RNA, 64 nt, hsa; identical to SEQ ID NO: 196014

SEQ ID NO: 246647 - RNA, 64 nt, hsa; identical to SEQ ID NO: 196015

SEQ ID NO: 246648 - RNA, 64 nt, hsa; identical to SEQ ID NO: 196016

SEQ ID NO: 246649 - RNA, 64 nt, hsa; identical to SEQ ID NO: 196017

SEQ ID NO: 246650 - RNA, 64 nt, hsa; identical to SEQ ID NO: 196018

SEQ ID NO: 246651 - RNA, 64 nt, hsa; identical to SEQ ID NO: 196019

SEQ ID NO: 246652 - RNA, 64 nt, hsa; identical to SEQ ID NO: 196020

SEQ ID NO: 246653 - RNA, 64 nt, hsa; identical to SEQ ID NO: 196021

SEQ ID NO: 246654 - RNA, 64 nt, hsa; identical to SEQ ID NO: 196022

SEQ ID NO: 246655 - RNA, 64 nt, hsa; identical to SEQ ID NO: 196023

SEQ ID NO: 246656 - RNA, 64 nt, hsa; identical to SEQ ID NO: 196024

SEQ ID NO: 246657 - RNA, 64 nt, hsa; identical to SEQ ID NO: 196025

SEQ ID NO: 246658 - RNA, 64 nt, hsa; identical to SEQ ID NO: 196026

SEQ ID NO: 246659 - RNA, 64 nt, hsa; identical to SEQ ID NO: 196027

SEQ ID NO: 246660 - RNA, 64 nt, hsa; identical to SEQ ID NO: 196028

SEQ ID NO: 246661 - RNA, 64 nt, hsa; identical to SEQ ID NO: 196029

SEQ ID NO: 246662 - RNA, 64 nt, hsa; identical to SEQ ID NO: 196030

SEQ ID NO: 246663 - RNA, 64 nt, hsa; identical to SEQ ID NO: 196031

SEQ ID NO: 246664 - RNA, 64 nt, hsa
uccggaggcgggcgugagacaagcccagcccgcacgcgcucaucuuucuucguuuuuugaucag

SEQ ID NO: 246665 - RNA, 64 nt, hsa
cuggcaccugugcuaguuacguagccgcugcucacgcgcucacuccugaccacaugcacguucc

SEQ ID NO: 246666 - RNA, 64 nt, hsa
ucucccuuccuuugagggaagcucagcuuucuuacgcgcucaucguuggacgggcugccaugca

SEQ ID NO: 246667 - RNA, 64 nt, hsa
aggcggguccgggucgcaggaccaucccggccggcgcgcucaucccacccgcccaccgcagggu

SEQ ID NO: 246668 - RNA, 64 nt, hsa
ugaggcgggcgggucccgagcccaggagggaacccgcgcucaggcggacggcgccgacucuuuu

SEQ ID NO: 246669 - RNA, 64 nt, hsa
cuacaacaaugucuuccacaacucaaacucccaccgcgcucacacaaccgguccacuccugccu

SEQ ID NO: 246670 - RNA, 64 nt, hsa
gguaaagaaaaguugccgaagaugagacugcccacgcgcucagacaugauaugcggcuaugccu

SEQ ID NO: 246671 - RNA, 64 nt, hsa
uagcacuuugcgaggccgagguggguggauugcccgcgcucaggaggucaagaccagccugggc

SEQ ID NO: 246672 - RNA, 64 nt, hsa
cgcacucgcagcugcuggacuugggccccaucgacgcgcucaacuucuucugugagcagcugcg

SEQ ID NO: 246673 - RNA, 64 nt, hsa
ggggugugcgcugccccggcaccugcuugcccuccgcgcucaucuggggccgcagcaugccuau

SEQ ID NO: 246674 - RNA, 64 nt, hsa
gaaucaugggcacggagggccgcccgccacgccccgcgcucaacugcucccguggaagauuaaa

SEQ ID NO: 246675 - RNA, 64 nt, hsa
cagccucagccccggaagccgagcgagcggccggcgcgcucaucgccggggagcccgccaggug

SEQ ID NO: 246676 - RNA, 64 nt, hsa
acucuuaugcccccaaccugcccuaccaccaccacgcgcucagccugauguguuuacaugguac

SEQ ID NO: 246677 - RNA, 64 nt, hsa
cgagaggcgaagcccacuuuuguauaccggccggcgcgcucacuuuccuccgcguugcuuccgg

SEQ ID NO: 246678 - RNA, 57 nt, hsa
agcuggaggacauggcuuaggucaaggcgcgcucagaugccggagccccaagacucu

SEQ ID NO: 246679 - RNA, 64 nt, hsa
gggauuugaaccggucugucuucacugagguccucgcgcucagaaaaggaccuugugagacgga

SEQ ID NO: 246680 - RNA, 64 nt, hsa
gcgugccgcucugcccgcuccgccuaggcuccuccgcgcucaccacucaguacggcgccgccuu

SEQ ID NO: 246681 - RNA, 64 nt, hsa
gcacgggugguccccguuccaccccaagagaacucgcgcucaguaaacgggaacaugcccccug

SEQ ID NO: 246682 - RNA, 64 nt, hsa
gguggccaggggggauuuccgaaucuccaucaggcgcgcucauaguuguccccauugucuaccc

SEQ ID NO: 246683 - RNA, 64 nt, hsa
aauacuuggcccgccggcuucccgcugcccccaucgcgcucacgcaauaaccggcccggccccc

SEQ ID NO: 246684 - RNA, 64 nt, hsa
acgccaacuugacccucaccagcauuaucaggagcgcgcucagcaaguugguaguuuccucccc

SEQ ID NO: 246685 - RNA, 64 nt, hsa
ggccucggcucuuuacuccauucacagccaugcacgcgcucaagccaccagggugcgagaugcc

SEQ ID NO: 246686 - RNA, 64 nt, hsa
gggggccgccggcgcucaaccacgcugugcugcgcgcgcucaugcacgcggccgccccgggagc

SEQ ID NO: 246687 - RNA, 64 nt, hsa; identical to SEQ ID NO: 153638

SEQ ID NO: 246688 - RNA, 64 nt, hsa; identical to SEQ ID NO: 153639

SEQ ID NO: 246689 - RNA, 64 nt, hsa; identical to SEQ ID NO: 153640

SEQ ID NO: 246690 - RNA, 64 nt, hsa; identical to SEQ ID NO: 153641

SEQ ID NO: 246691 - RNA, 64 nt, hsa; identical to SEQ ID NO: 153642

SEQ ID NO: 246692 - RNA, 64 nt, hsa; identical to SEQ ID NO: 153643

SEQ ID NO: 246693 - RNA, 64 nt, hsa; identical to SEQ ID NO: 153644

SEQ ID NO: 246694 - RNA, 64 nt, hsa; identical to SEQ ID NO: 153645

SEQ ID NO: 246695 - RNA, 64 nt, hsa; identical to SEQ ID NO: 153646

SEQ ID NO: 246696 - RNA, 64 nt, hsa; identical to SEQ ID NO: 153647

SEQ ID NO: 246697 - RNA, 64 nt, hsa; identical to SEQ ID NO: 153648

SEQ ID NO: 246698 - RNA, 64 nt, hsa; identical to SEQ ID NO: 153649

SEQ ID NO: 246699 - RNA, 64 nt, hsa; identical to SEQ ID NO: 153650

SEQ ID NO: 246700 - RNA, 64 nt, hsa; identical to SEQ ID NO: 153651

SEQ ID NO: 246701 - RNA, 64 nt, hsa; identical to SEQ ID NO: 153652

SEQ ID NO: 246702 - RNA, 64 nt, hsa; identical to SEQ ID NO: 153653

SEQ ID NO: 246703 - RNA, 64 nt, hsa; identical to SEQ ID NO: 153654

SEQ ID NO: 246704 - RNA, 64 nt, hsa; identical to SEQ ID NO: 153655

SEQ ID NO: 246705 - RNA, 64 nt, hsa; identical to SEQ ID NO: 153656

SEQ ID NO: 246706 - RNA, 64 nt, hsa; identical to SEQ ID NO: 153657

SEQ ID NO: 246707 - RNA, 64 nt, hsa; identical to SEQ ID NO: 153658

SEQ ID NO: 246708 - RNA, 64 nt, hsa; identical to SEQ ID NO: 153659

SEQ ID NO: 246709 - RNA, 64 nt, hsa; identical to SEQ ID NO: 153660

SEQ ID NO: 246710 - RNA, 64 nt, hsa; identical to SEQ ID NO: 153661

SEQ ID NO: 246711 - RNA, 64 nt, hsa; identical to SEQ ID NO: 153662

SEQ ID NO: 246712 - RNA, 64 nt, hsa; identical to SEQ ID NO: 153663

SEQ ID NO: 246713 - RNA, 64 nt, hsa; identical to SEQ ID NO: 153664

SEQ ID NO: 246714 - RNA, 64 nt, hsa; identical to SEQ ID NO: 153665

SEQ ID NO: 246715 - RNA, 64 nt, hsa; identical to SEQ ID NO: 153666

SEQ ID NO: 246716 - RNA, 64 nt, hsa; identical to SEQ ID NO: 153667

SEQ ID NO: 246717 - RNA, 64 nt, hsa; identical to SEQ ID NO: 153668

SEQ ID NO: 246718 - RNA, 64 nt, hsa; identical to SEQ ID NO: 153669

SEQ ID NO: 246719 - RNA, 64 nt, hsa; identical to SEQ ID NO: 153670

SEQ ID NO: 246720 - RNA, 64 nt, hsa; identical to SEQ ID NO: 153671

SEQ ID NO: 246721 - RNA, 64 nt, hsa; identical to SEQ ID NO: 153672

SEQ ID NO: 246722 - RNA, 64 nt, hsa; identical to SEQ ID NO: 153673

SEQ ID NO: 246723 - RNA, 64 nt, hsa
agaagagaucauuucuggaggcuucagcaauggaauuuagcauuauaagagagauuggacaaac

SEQ ID NO: 246724 - RNA, 64 nt, hsa
ugacagggaucaguggcauuuguuuccuagcaguauuuagcaccuuuuugccaccuuggugaac

SEQ ID NO: 246725 - RNA, 64 nt, hsa
cacaccuucugaauagaaauauuguucauuacucauuuagcagauaauuugggaccuaugucua

SEQ ID NO: 246726 - RNA, 64 nt, hsa
auaaaaugccucagagcuacaauuuuaaaaaaugauuuagcacaagcuaaaucucaaagccuug

SEQ ID NO: 246727 - RNA, 64 nt, hsa
agcaaucuuuaauaaaccuuuuuauuacauugugauuuagcaguuaugcuaaaauauguacuua

SEQ ID NO: 246728 - RNA, 64 nt, hsa
gaacaguggguaagaaacuuuaugccugaauaacauuuagcaguauugugauugaaaaauugcc

SEQ ID NO: 246729 - RNA, 64 nt, hsa
uuccuauaaacuaaaauaacauuacaguuuccgaauuuagcaugggacauagucaguguuugaa

SEQ ID NO: 246730 - RNA, 64 nt, hsa
cugcagaaugcaaaauaaaacuugcagugaaugaauuuagcauuuuaugagagugcuguuggaa

SEQ ID NO: 246731 - RNA, 64 nt, hsa
ggcaagauuuucugaugcuuuugauuuucucucaauuuagcauuugcuuuugguuuuuuucucu

SEQ ID NO: 246732 - RNA, 64 nt, hsa
cucaauuuagcauuugcuuuugguuuuuuucucuauuuagcauucuguuaaggcacaaaaacua

SEQ ID NO: 246733 - RNA, 64 nt, hsa
ggcugaugucucuuucuuggaauaugugaaauaaauuuagcaguuuaacuaaauacaaauauau

SEQ ID NO: 246734 - RNA, 64 nt, hsa
uacaguaacaugaauaaagccaaaccugcuuuucauuuagcagcaaauuaaaguaaccaguccu

SEQ ID NO: 246735 - RNA, 64 nt, hsa
cauuaggggaaccauuguugucuucacuuaauccauuuagcacuauuuaaaauaagcacaccaa

SEQ ID NO: 246736 - RNA, 64 nt, hsa
uaggugacuugagaguggaaccuccuauaucauuauuuagcaccguuugugacaguaaccauuu

SEQ ID NO: 246737 - RNA, 64 nt, hsa
aauuuccuggggcuauugugaguacuguguauguauuuagcaaauauuuaagaccuaguaagug

SEQ ID NO: 246738 - RNA, 64 nt, hsa
gaacaugaaaaagaaaacaacuuugagaguagucauuuagcaguagaugugcauuauuaugaga

SEQ ID NO: 246739 - RNA, 64 nt, hsa
uaaaucagaguuuacaaugcacaggggaucauuuauuuagcauucccuugcuagaagcccgugu

SEQ ID NO: 246740 - RNA, 64 nt, hsa
cacugauuccaacucuuugccagcuaaucuuaacauuuagcagaaagcucuagcaacaugaucu

SEQ ID NO: 246741 - RNA, 64 nt, hsa
agacaucuuaugaaaacuguauucauggaauuugauuuagcaugcucaguugccaguucccauu

SEQ ID NO: 246742 - RNA, 64 nt, hsa
ugaauagugacacucgguaaggauuuucagugccauuuagcaaaacgucuuuagucuaugcaac

SEQ ID NO: 246743 - RNA, 64 nt, hsa
uaugaacagaaaguacuguguagcccaggaguuuauuuagcaagauaaauagugguaauuucuu

SEQ ID NO: 246744 - RNA, 64 nt, hsa
aucuguucaguuuaccaagguucagaaauacguaauuuagcaggaaacuauaaauaccagugcu

SEQ ID NO: 246745 - RNA, 64 nt, hsa
uucuuaauuaugguaccucugucuauaggacuuaauuuagcaguccauuuuugaguaaaacuug

SEQ ID NO: 246746 - RNA, 64 nt, hsa
ccgaaaugaaaauggcugaagaaacacagcaugcauuuagcaugaguucugcacauacagaugg

SEQ ID NO: 246747 - RNA, 64 nt, hsa
gucuaaggaugugauuuaaauuuacuuaggauggauuuagcauugagguuauuaagacaaaguu

SEQ ID NO: 246748 - RNA, 64 nt, hsa
ggaauugauauauaccuuauuaaagcuugaaaacauuuagcauuugaauaguaaguuucaucac

SEQ ID NO: 246749 - RNA, 64 nt, hsa
ucuucagacauuccuaacuugacuagugguuaacauuuagcaccuugguugucuuucaauauau

SEQ ID NO: 246750 - RNA, 64 nt, hsa
uuuguagcagaguauuuaguauacuuagaaguugauuuagcaauuaggcuuuaaugaccuuaca

SEQ ID NO: 246751 - RNA, 64 nt, hsa
caccucuugaaagucaaaggugaugauuaauuucauuuagcagggaaguggaauaauaucuuuu

SEQ ID NO: 246752 - RNA, 64 nt, hsa; identical to SEQ ID NO: 166002

SEQ ID NO: 246753 - RNA, 64 nt, hsa; identical to SEQ ID NO: 166003

SEQ ID NO: 246754 - RNA, 64 nt, hsa; identical to SEQ ID NO: 166004

SEQ ID NO: 246755 - RNA, 64 nt, hsa; identical to SEQ ID NO: 166005

SEQ ID NO: 246756 - RNA, 64 nt, hsa; identical to SEQ ID NO: 166006

SEQ ID NO: 246757 - RNA, 64 nt, hsa; identical to SEQ ID NO: 166007

SEQ ID NO: 246758 - RNA, 64 nt, hsa; identical to SEQ ID NO: 166008

SEQ ID NO: 246759 - RNA, 64 nt, hsa; identical to SEQ ID NO: 166009

SEQ ID NO: 246760 - RNA, 64 nt, hsa; identical to SEQ ID NO: 166010

SEQ ID NO: 246761 - RNA, 60 nt, hsa; identical to SEQ ID NO: 166011

SEQ ID NO: 246762 - RNA, 64 nt, hsa; identical to SEQ ID NO: 166012

SEQ ID NO: 246763 - RNA, 64 nt, hsa; identical to SEQ ID NO: 116857

SEQ ID NO: 246764 - RNA, 64 nt, hsa; identical to SEQ ID NO: 116858

SEQ ID NO: 246765 - RNA, 64 nt, hsa; identical to SEQ ID NO: 116859

SEQ ID NO: 246766 - RNA, 64 nt, hsa; identical to SEQ ID NO: 116860

SEQ ID NO: 246767 - RNA, 64 nt, hsa; identical to SEQ ID NO: 116861

SEQ ID NO: 246768 - RNA, 64 nt, hsa; identical to SEQ ID NO: 116862

SEQ ID NO: 246769 - RNA, 64 nt, hsa; identical to SEQ ID NO: 116863

SEQ ID NO: 246770 - RNA, 64 nt, hsa; identical to SEQ ID NO: 116864

SEQ ID NO: 246771 - RNA, 64 nt, hsa; identical to SEQ ID NO: 116865

SEQ ID NO: 246772 - RNA, 64 nt, hsa; identical to SEQ ID NO: 116866

SEQ ID NO: 246773 - RNA, 64 nt, hsa; identical to SEQ ID NO: 116867

SEQ ID NO: 246774 - RNA, 64 nt, hsa; identical to SEQ ID NO: 116868

SEQ ID NO: 246775 - RNA, 64 nt, hsa; identical to SEQ ID NO: 116869

SEQ ID NO: 246776 - RNA, 64 nt, hsa; identical to SEQ ID NO: 116870

SEQ ID NO: 246777 - RNA, 64 nt, hsa; identical to SEQ ID NO: 116871

SEQ ID NO: 246778 - RNA, 64 nt, hsa; identical to SEQ ID NO: 116872

SEQ ID NO: 246779 - RNA, 64 nt, hsa; identical to SEQ ID NO: 116873

SEQ ID NO: 246780 - RNA, 64 nt, hsa; identical to SEQ ID NO: 116874

SEQ ID NO: 246781 - RNA, 64 nt, hsa; identical to SEQ ID NO: 116875

SEQ ID NO: 246782 - RNA, 64 nt, hsa; identical to SEQ ID NO: 116876

SEQ ID NO: 246783 - RNA, 64 nt, hsa; identical to SEQ ID NO: 116877

SEQ ID NO: 246784 - RNA, 64 nt, hsa; identical to SEQ ID NO: 116878

SEQ ID NO: 246785 - RNA, 64 nt, hsa; identical to SEQ ID NO: 116879

SEQ ID NO: 246786 - RNA, 64 nt, hsa; identical to SEQ ID NO: 116880

SEQ ID NO: 246787 - RNA, 64 nt, hsa; identical to SEQ ID NO: 116881

SEQ ID NO: 246788 - RNA, 64 nt, hsa; identical to SEQ ID NO: 116882

SEQ ID NO: 246789 - RNA, 64 nt, hsa; identical to SEQ ID NO: 116883

SEQ ID NO: 246790 - RNA, 64 nt, hsa; identical to SEQ ID NO: 116884

SEQ ID NO: 246791 - RNA, 64 nt, hsa; identical to SEQ ID NO: 116885

SEQ ID NO: 246792 - RNA, 64 nt, hsa; identical to SEQ ID NO: 116886

SEQ ID NO: 246793 - RNA, 64 nt, hsa; identical to SEQ ID NO: 116887

SEQ ID NO: 246794 - RNA, 64 nt, hsa; identical to SEQ ID NO: 116888

SEQ ID NO: 246795 - RNA, 64 nt, hsa; identical to SEQ ID NO: 116889

SEQ ID NO: 246796 - RNA, 64 nt, hsa; identical to SEQ ID NO: 116890

SEQ ID NO: 246797 - RNA, 64 nt, hsa; identical to SEQ ID NO: 116891

SEQ ID NO: 246798 - RNA, 64 nt, hsa; identical to SEQ ID NO: 116892

SEQ ID NO: 246799 - RNA, 64 nt, hsa; identical to SEQ ID NO: 116893

SEQ ID NO: 246800 - RNA, 64 nt, hsa; identical to SEQ ID NO: 116894

SEQ ID NO: 246801 - RNA, 64 nt, hsa; identical to SEQ ID NO: 116895

SEQ ID NO: 246802 - RNA, 64 nt, hsa; identical to SEQ ID NO: 116896

SEQ ID NO: 246803 - RNA, 64 nt, hsa; identical to SEQ ID NO: 116897

SEQ ID NO: 246804 - RNA, 64 nt, hsa; identical to SEQ ID NO: 116898

SEQ ID NO: 246805 - RNA, 64 nt, hsa; identical to SEQ ID NO: 116899

SEQ ID NO: 246806 - RNA, 64 nt, hsa; identical to SEQ ID NO: 116900

SEQ ID NO: 246807 - RNA, 64 nt, hsa; identical to SEQ ID NO: 116901

SEQ ID NO: 246808 - RNA, 64 nt, hsa; identical to SEQ ID NO: 116902

SEQ ID NO: 246809 - RNA, 64 nt, hsa; identical to SEQ ID NO: 116903

SEQ ID NO: 246810 - RNA, 64 nt, hsa; identical to SEQ ID NO: 116904

SEQ ID NO: 246811 - RNA, 64 nt, hsa; identical to SEQ ID NO: 116905

SEQ ID NO: 246812 - RNA, 64 nt, hsa; identical to SEQ ID NO: 116906

SEQ ID NO: 246813 - RNA, 64 nt, hsa; identical to SEQ ID NO: 116907

SEQ ID NO: 246814 - RNA, 64 nt, hsa; identical to SEQ ID NO: 116908

SEQ ID NO: 246815 - RNA, 64 nt, hsa; identical to SEQ ID NO: 116909

SEQ ID NO: 246816 - RNA, 64 nt, hsa; identical to SEQ ID NO: 116910

SEQ ID NO: 246817 - RNA, 64 nt, hsa; identical to SEQ ID NO: 116911

SEQ ID NO: 246818 - RNA, 64 nt, hsa; identical to SEQ ID NO: 116912

SEQ ID NO: 246819 - RNA, 64 nt, hsa; identical to SEQ ID NO: 116913

SEQ ID NO: 246820 - RNA, 64 nt, hsa; identical to SEQ ID NO: 116914

SEQ ID NO: 246821 - RNA, 64 nt, hsa; identical to SEQ ID NO: 116915

SEQ ID NO: 246822 - RNA, 64 nt, hsa; identical to SEQ ID NO: 116916

SEQ ID NO: 246823 - RNA, 64 nt, hsa
ggggcugcccacagccuuuucaggggcucgcuuggcgggugacggggccgcagccaggccuucu

SEQ ID NO: 246824 - RNA, 64 nt, hsa
cuuuccccacagcucucacgucucccuucucccugcgggugacaaagaagcccaaggaccaccu

SEQ ID NO: 246825 - RNA, 64 nt, hsa
guccucauguuggugaaguguugggggauggagggcgggugagcagucgggggacaaaaagucu

SEQ ID NO: 246826 - RNA, 64 nt, hsa
cgcgccgccccccacgcaccaccggggcggccucgcgggugacuccgggcuccguggcuguccc

SEQ ID NO: 246827 - RNA, 64 nt, hsa
gugaagggcccaugugugcucaccucugggaaaagcgggugagcaggaggcaugagguacaaug

SEQ ID NO: 246828 - RNA, 64 nt, hsa
cacgccuguaaucccagcacuuugggaggcugaggcgggugaaaucaccugaggucaugaguuc

SEQ ID NO: 246829 - RNA, 64 nt, hsa
guaguucucauccuccgcaugcccucagccacaagcgggugacugacuguucccugaugauuug

SEQ ID NO: 246830 - RNA, 50 nt, hsa
auccaggggccauagacuaagcgggugaugccccagcggauguuggccac

SEQ ID NO: 246831 - RNA, 64 nt, hsa
uguaggguucugggucccuggcaagucuaggugggcgggugacagggaaagcaugggcauuuuu

SEQ ID NO: 246832 - RNA, 64 nt, hsa
uuccuccacaagguccccccaccgcucagugucagcgggugacguguguucuuuugaguccuug

SEQ ID NO: 246833 - RNA, 64 nt, hsa
ugcagugagccaaggucauaccagugcacuccaggcgggugacagagcaagacugcgucucaag

SEQ ID NO: 246834 - RNA, 64 nt, hsa
cuucuauuuauugugggaaggaaaacaggguggggcgggugagugaaaagguggaaaucccugg

SEQ ID NO: 246835 - RNA, 64 nt, hsa
cgccaggagggagagagaggcaccccucugggaugcgggugagggaagguuggcugaaguuccu

SEQ ID NO: 246836 - RNA, 64 nt, hsa
cccucggagaucugcuggggcuaugggaaucggggcgggugauggagguggacaagaguggggc

SEQ ID NO: 246837 - RNA, 64 nt, hsa
ucggggucagugucccacccuucacuucccgagggcgggugaguggagagcagagccaggagcu

SEQ ID NO: 246838 - RNA, 64 nt, hsa
caaugagauacguuacagaaccuauguucagguugcgggugagcugcccucuccaaauccagcc

SEQ ID NO: 246839 - RNA, 64 nt, hsa
cgcuccauccuacucccacuaacuacaccucagggcgggugagguuccgacacugaucccagag

SEQ ID NO: 246840 - RNA, 64 nt, hsa
ggcucccuguuaccagaaagccaaauuuuauaaugcgggugaaagaaaaauauagauuaaaauu

SEQ ID NO: 246841 - RNA, 64 nt, hsa
acgccucaccagccccccgcgcgcccacccuccggcgggugacagcuccgggaucagcaacccu

SEQ ID NO: 246842 - RNA, 64 nt, hsa
cugaggugagcaaaagcaggaaggggcauccacugcgggugacuggaggccgggcaggaagcaa

SEQ ID NO: 246843 - RNA, 64 nt, hsa
auaguuaugagauuaagacuggagugccaucaccgcgggugaugauuuagcuuuugcugugugu

SEQ ID NO: 246844 - RNA, 64 nt, hsa
acugucuaguuuaaauuauggcuguuaaggccgggcgggugacucaggcagguaaucccagaac

SEQ ID NO: 246845 - RNA, 64 nt, hsa
ucuccuuugggaucguccugugcgagaucaucgggcgggugaacgcagacccugacuaccugcc

SEQ ID NO: 246846 - RNA, 64 nt, hsa
ccggguccugagcccgaacucccagagcucacccgcgggugaccgggggccagcccaggagggc

SEQ ID NO: 246847 - RNA, 64 nt, hsa
cugcacagcccugauuuacagagggaagggaagcgcgggugaggugguggccccugguggagcu

SEQ ID NO: 246848 - RNA, 64 nt, hsa
caaguuacggugguacugccacucugcagguggagcgggugacucugggggaccauuaagaccu

SEQ ID NO: 246849 - RNA, 64 nt, hsa
ggcagagggagaauccaaggguugagagccaguggcgggugauggccagccccuggggcccagc

SEQ ID NO: 246850 - RNA, 64 nt, hsa
cacgccuguaaucccagcacuuugggaggcugaggcgggugaaucacuugauugaggucaggag

SEQ ID NO: 246851 - RNA, 64 nt, hsa
uuacuaagaagagcugccaucauggcccagggaggcgggugaaagcuccgucuucugaauucau

SEQ ID NO: 246852 - RNA, 64 nt, hsa
gaguugcgcaucagcaccuggggaucuggacccugcgggugaagggauggggagggacgucccu

SEQ ID NO: 246853 - RNA, 64 nt, hsa
ugagugauucucagccaaguccagacagugcucggcgggugaggaagggucugccccgagcuuu

SEQ ID NO: 246854 - RNA, 64 nt, hsa
caaccuggcauucugcuuacuggccagaaagcuggcgggugacauuuguaacauuuccucuuug

SEQ ID NO: 246855 - RNA, 64 nt, hsa
ucugcuuacccauuagcgagcagaggggguuucugcgggugacccccagcauauuucuagguua

SEQ ID NO: 246856 - RNA, 64 nt, hsa
guggagucuucgcuucagagccauucggccaggugcgggugauguucccaucuccugcuugugg

SEQ ID NO: 246857 - RNA, 64 nt, hsa
ggguaguggaugggguuucuguuguaucuugugggcgggugauuuugcuuuuguuuuuguuuca

SEQ ID NO: 246858 - RNA, 64 nt, hsa
cgguccccugguggcaggaggggcucccccuguugcgggugaggcggcugcucucauauuuuca

SEQ ID NO: 246859 - RNA, 64 nt, hsa
ucugagagggggauucuggggcaaguaguuucuugcgggugaguguucucagagaaacuuacca

SEQ ID NO: 246860 - RNA, 64 nt, hsa
agggguaugcuccaugcuuugagucaccaaugaagcgggugagggaagaugagagggggaggug

SEQ ID NO: 246861 - RNA, 64 nt, hsa
cuaaaacgggggaagugagaggaaagaggcgggggcgggugaggagacuggccccaggccccag

SEQ ID NO: 246862 - RNA, 64 nt, hsa
aacccccacaacccccuccacaaagagaccaggggcgggugaugagaccugggguuuagaaccc

SEQ ID NO: 246863 - RNA, 64 nt, hsa
acuaauaguuuguugaucugauaagcaagagugggcgggugagaaaaaccgaauuggguuuagu

SEQ ID NO: 246864 - RNA, 64 nt, hsa
gaaggugaauauaaucaaugccaauguaaugccagcgggugagauggccgauggagguuucaaa

SEQ ID NO: 246865 - RNA, 64 nt, hsa
gguuagaggcagauggcacaggggcguguggcgggcgggugaggcugcuuugcacaccuguguu

SEQ ID NO: 246866 - RNA, 64 nt, hsa
cguggcuucugagcggccaccgaugcugcucucugcgggugacagggagaggcugcguaacugg

SEQ ID NO: 246867 - RNA, 64 nt, hsa
guggagaagggcuuuaaggaggccaauuugcugcgcgggugaccugugaaaggucacagucauu

SEQ ID NO: 246868 - RNA, 64 nt, hsa
ccacacgugaagcucgcgguccucccagggagcugcgggugauguucguugcacugcuagacac

SEQ ID NO: 246869 - RNA, 64 nt, hsa
cacaagaagggucacugccacaacagcacagucagcgggugaauuacaggugccugcugccugc

SEQ ID NO: 246870 - RNA, 64 nt, hsa
agagggcacgggcgaucccgacgggggcauuccugcgggugagagccguccccaccgcggcggc

SEQ ID NO: 246871 - RNA, 64 nt, hsa
ggagagagccgcuggaaugguguggacccaucccgcgggugaccggugccuguucuccccugac

SEQ ID NO: 246872 - RNA, 64 nt, hsa
cuuacuguggaaaacuccugccagaacucuucaagcgggugaaaaaccucaugacaguauugag

SEQ ID NO: 246873 - RNA, 64 nt, hsa
ggcucucccagauggccaccauccucaaucuggagcgggugaccgagauccucgauuacugggg

SEQ ID NO: 246874 - RNA, 64 nt, hsa
aggcugagcugagaaagggccuccgcuuagagcugcgggugaggacguccuuuucuaagcaaca

SEQ ID NO: 246875 - RNA, 64 nt, hsa
cgaggcugcuucuguuuauaugugcagggcccgggcgggugaagggucagagagacggacacaa

SEQ ID NO: 246876 - RNA, 64 nt, hsa
uggcccccugcuggcaggcugaacacccugcggagcgggugagaucggcuuucgcugcacccag

SEQ ID NO: 246877 - RNA, 52 nt, hsa
gcccagggggucgguucugagagcgggugacccagauggccauggcuauugu

SEQ ID NO: 246878 - RNA, 64 nt, hsa
uuccuuguccuuggggugcuuuuccugaaucuuugcgggugaagggaguguugcucccagucca

SEQ ID NO: 246879 - RNA, 64 nt, hsa
agauuguucuguaaggaauguuauguaugggugagcgggugacacauccauuggguauguaugc

SEQ ID NO: 246880 - RNA, 64 nt, hsa
agcgaguggccucgaaggcuacgggacgaggguggcgggugaccaagugcaggcgcgacggguc

SEQ ID NO: 246881 - RNA, 64 nt, hsa
cuugggcuuucucuggaggggaagguggaugcuggcgggugacuugcagugggcgccuggcagu

SEQ ID NO: 246882 - RNA, 64 nt, hsa
ucaacccaagcucuggggauggguggggaggggggcgggugacgcccaccuucgggcaguccug

SEQ ID NO: 246883 - RNA, 64 nt, hsa
uggcggcgguggcgacauggcggagcccuccgaggcgggugacgcgcccccugaugaugggccu

SEQ ID NO: 246884 - RNA, 64 nt, hsa
uccucccucaggagauuggggguugggggaggcagcgggugauggcucugaagcugaacccagg

SEQ ID NO: 246885 - RNA, 64 nt, hsa
gccucacagacccucucaggccucugacgagugagcgggugaagugccacugggucaccgcagg

SEQ ID NO: 246886 - RNA, 64 nt, hsa
aggcagggcuucggggacgcggggcgcuucucgggcgggugaucccuaacagggcggcuuccca

SEQ ID NO: 246887 - RNA, 64 nt, hsa
aagcugggaggucaggugggguggaugauauaaugcgggugagaguaaugaggcuuggggcugg

SEQ ID NO: 246888 - RNA, 64 nt, hsa
aguggacggucaugaaggagcggggguguggcaggcgggugacguccaggagagggagcgcccc

SEQ ID NO: 246889 - RNA, 64 nt, hsa
gaaggggaaccccggggugcccacaggccgcccugcgggugaacaaagcagccacgaggugcaa

SEQ ID NO: 246890 - RNA, 64 nt, hsa
cuucauauuuuaagugcauugaggauagaugcaggcgggugagcugcccuccgucagguggacc

SEQ ID NO: 246891 - RNA, 64 nt, hsa
gugucacuaaagaaagugagggccacugucuccggcgggugaggcugcagcccaguuucacaug

SEQ ID NO: 246892 - RNA, 64 nt, hsa
gcccagggugaugguggccagcucagggcuuccugcgggugacugucgcccagaccaggugcca

SEQ ID NO: 246893 - RNA, 64 nt, hsa
gccagacccucgcggagauggugcagaaggcggagcgggugagcggccgugcguccagcccggg

SEQ ID NO: 246894 - RNA, 64 nt, hsa
aaccuccaaugggugggggacagugagcuucggccuggccgaggugggugggugggcucucaga

SEQ ID NO: 246895 - RNA, 64 nt, hsa
ccgaucucuauuaaaggacucccucuuggugggccuggccgagucccuccuuugugcucccagg

SEQ ID NO: 246896 - RNA, 64 nt, hsa
gucuacacuggccgagucucugggucugucuacacuggccgagucuccgacugucugugcuuuc

SEQ ID NO: 246897 - RNA, 64 nt, hsa
cgucgccgggcugcccagccuggcucugucuacacuggccgagucucugggucugucuacacug

SEQ ID NO: 246898 - RNA, 57 nt, hsa
acgagugggaggucaucugaaggagcccuggccgagucacgcggaggggcccggcgu

SEQ ID NO: 246899 - RNA, 64 nt, hsa
ugagucagugcaauaaacuagacuuuuuccaaaccuggccgaguguggugccugagcugugaga

SEQ ID NO: 246900 - RNA, 54 nt, hsa
ccgagcugaccccacucugagagccuggccgagcuggcagcauggagcccucgg

SEQ ID NO: 246901 - RNA, 64 nt, hsa
ugggcagcuagagugucucagcccggugcugggccuggccgaggggcggaggcacagcugcuuc

SEQ ID NO: 246902 - RNA, 64 nt, hsa; identical to SEQ ID NO: 246823

SEQ ID NO: 246903 - RNA, 64 nt, hsa; identical to SEQ ID NO: 246824

SEQ ID NO: 246904 - RNA, 64 nt, hsa; identical to SEQ ID NO: 246825

SEQ ID NO: 246905 - RNA, 64 nt, hsa; identical to SEQ ID NO: 246826

SEQ ID NO: 246906 - RNA, 64 nt, hsa; identical to SEQ ID NO: 246827

SEQ ID NO: 246907 - RNA, 64 nt, hsa; identical to SEQ ID NO: 246828

SEQ ID NO: 246908 - RNA, 64 nt, hsa; identical to SEQ ID NO: 246829

SEQ ID NO: 246909 - RNA, 50 nt, hsa; identical to SEQ ID NO: 246830

SEQ ID NO: 246910 - RNA, 64 nt, hsa; identical to SEQ ID NO: 246831

SEQ ID NO: 246911 - RNA, 64 nt, hsa; identical to SEQ ID NO: 246832

SEQ ID NO: 246912 - RNA, 64 nt, hsa; identical to SEQ ID NO: 246833

SEQ ID NO: 246913 - RNA, 64 nt, hsa; identical to SEQ ID NO: 246834

SEQ ID NO: 246914 - RNA, 64 nt, hsa; identical to SEQ ID NO: 246835

SEQ ID NO: 246915 - RNA, 64 nt, hsa; identical to SEQ ID NO: 246836

SEQ ID NO: 246916 - RNA, 64 nt, hsa; identical to SEQ ID NO: 246837

SEQ ID NO: 246917 - RNA, 64 nt, hsa; identical to SEQ ID NO: 246838

SEQ ID NO: 246918 - RNA, 64 nt, hsa; identical to SEQ ID NO: 246839

SEQ ID NO: 246919 - RNA, 64 nt, hsa; identical to SEQ ID NO: 246840

SEQ ID NO: 246920 - RNA, 64 nt, hsa; identical to SEQ ID NO: 246841

SEQ ID NO: 246921 - RNA, 64 nt, hsa; identical to SEQ ID NO: 246842

SEQ ID NO: 246922 - RNA, 64 nt, hsa; identical to SEQ ID NO: 246843

SEQ ID NO: 246923 - RNA, 64 nt, hsa; identical to SEQ ID NO: 246844

SEQ ID NO: 246924 - RNA, 64 nt, hsa; identical to SEQ ID NO: 246845

SEQ ID NO: 246925 - RNA, 64 nt, hsa; identical to SEQ ID NO: 246846

SEQ ID NO: 246926 - RNA, 64 nt, hsa; identical to SEQ ID NO: 246847

SEQ ID NO: 246927 - RNA, 64 nt, hsa; identical to SEQ ID NO: 246848

SEQ ID NO: 246928 - RNA, 64 nt, hsa; identical to SEQ ID NO: 246849

SEQ ID NO: 246929 - RNA, 64 nt, hsa; identical to SEQ ID NO: 246850

SEQ ID NO: 246930 - RNA, 64 nt, hsa; identical to SEQ ID NO: 246851

SEQ ID NO: 246931 - RNA, 64 nt, hsa; identical to SEQ ID NO: 246852

SEQ ID NO: 246932 - RNA, 64 nt, hsa; identical to SEQ ID NO: 246853

SEQ ID NO: 246933 - RNA, 64 nt, hsa; identical to SEQ ID NO: 246854

SEQ ID NO: 246934 - RNA, 64 nt, hsa; identical to SEQ ID NO: 246855

SEQ ID NO: 246935 - RNA, 64 nt, hsa; identical to SEQ ID NO: 246856

SEQ ID NO: 246936 - RNA, 64 nt, hsa; identical to SEQ ID NO: 246857

SEQ ID NO: 246937 - RNA, 64 nt, hsa; identical to SEQ ID NO: 246858

SEQ ID NO: 246938 - RNA, 64 nt, hsa; identical to SEQ ID NO: 246859

SEQ ID NO: 246939 - RNA, 64 nt, hsa; identical to SEQ ID NO: 246860

SEQ ID NO: 246940 - RNA, 64 nt, hsa; identical to SEQ ID NO: 246861

SEQ ID NO: 246941 - RNA, 64 nt, hsa; identical to SEQ ID NO: 246862

SEQ ID NO: 246942 - RNA, 64 nt, hsa; identical to SEQ ID NO: 246863

SEQ ID NO: 246943 - RNA, 64 nt, hsa; identical to SEQ ID NO: 246864

SEQ ID NO: 246944 - RNA, 64 nt, hsa; identical to SEQ ID NO: 246865

SEQ ID NO: 246945 - RNA, 64 nt, hsa; identical to SEQ ID NO: 246866

SEQ ID NO: 246946 - RNA, 64 nt, hsa; identical to SEQ ID NO: 246867

SEQ ID NO: 246947 - RNA, 64 nt, hsa; identical to SEQ ID NO: 246868

SEQ ID NO: 246948 - RNA, 64 nt, hsa; identical to SEQ ID NO: 246869

SEQ ID NO: 246949 - RNA, 64 nt, hsa; identical to SEQ ID NO: 246870

SEQ ID NO: 246950 - RNA, 64 nt, hsa; identical to SEQ ID NO: 246871

SEQ ID NO: 246951 - RNA, 64 nt, hsa; identical to SEQ ID NO: 246872

SEQ ID NO: 246952 - RNA, 64 nt, hsa; identical to SEQ ID NO: 246873

SEQ ID NO: 246953 - RNA, 64 nt, hsa; identical to SEQ ID NO: 246874

SEQ ID NO: 246954 - RNA, 64 nt, hsa; identical to SEQ ID NO: 246875

SEQ ID NO: 246955 - RNA, 64 nt, hsa; identical to SEQ ID NO: 246876

SEQ ID NO: 246956 - RNA, 52 nt, hsa; identical to SEQ ID NO: 246877

SEQ ID NO: 246957 - RNA, 64 nt, hsa; identical to SEQ ID NO: 246878

SEQ ID NO: 246958 - RNA, 64 nt, hsa; identical to SEQ ID NO: 246879

SEQ ID NO: 246959 - RNA, 64 nt, hsa; identical to SEQ ID NO: 246880

SEQ ID NO: 246960 - RNA, 64 nt, hsa; identical to SEQ ID NO: 246881

SEQ ID NO: 246961 - RNA, 64 nt, hsa; identical to SEQ ID NO: 246882

SEQ ID NO: 246962 - RNA, 64 nt, hsa; identical to SEQ ID NO: 246883

SEQ ID NO: 246963 - RNA, 64 nt, hsa; identical to SEQ ID NO: 246884

SEQ ID NO: 246964 - RNA, 64 nt, hsa; identical to SEQ ID NO: 246885

SEQ ID NO: 246965 - RNA, 64 nt, hsa; identical to SEQ ID NO: 246886

SEQ ID NO: 246966 - RNA, 64 nt, hsa; identical to SEQ ID NO: 246887

SEQ ID NO: 246967 - RNA, 64 nt, hsa; identical to SEQ ID NO: 246888

SEQ ID NO: 246968 - RNA, 64 nt, hsa; identical to SEQ ID NO: 246889

SEQ ID NO: 246969 - RNA, 64 nt, hsa; identical to SEQ ID NO: 246890

SEQ ID NO: 246970 - RNA, 64 nt, hsa; identical to SEQ ID NO: 246891

SEQ ID NO: 246971 - RNA, 64 nt, hsa; identical to SEQ ID NO: 246892

SEQ ID NO: 246972 - RNA, 64 nt, hsa; identical to SEQ ID NO: 246893

SEQ ID NO: 246973 - RNA, 64 nt, hsa; identical to SEQ ID NO: 246894

SEQ ID NO: 246974 - RNA, 64 nt, hsa; identical to SEQ ID NO: 246895

SEQ ID NO: 246975 - RNA, 64 nt, hsa; identical to SEQ ID NO: 246896

SEQ ID NO: 246976 - RNA, 64 nt, hsa; identical to SEQ ID NO: 246897

SEQ ID NO: 246977 - RNA, 57 nt, hsa; identical to SEQ ID NO: 246898

SEQ ID NO: 246978 - RNA, 64 nt, hsa; identical to SEQ ID NO: 246899

SEQ ID NO: 246979 - RNA, 54 nt, hsa; identical to SEQ ID NO: 246900

SEQ ID NO: 246980 - RNA, 64 nt, hsa; identical to SEQ ID NO: 246901

SEQ ID NO: 246981 - RNA, 64 nt, hsa
gagugcucuuaaauguugaaccuggguguugcuuccgggccagucugcguggcuccaugaaaag

SEQ ID NO: 246982 - RNA, 64 nt, hsa
gcaugcucccugcggcccugcccucccgcccagcccgggccaccucgugggggacaagucucgc

SEQ ID NO: 246983 - RNA, 52 nt, hsa
cccggaucacgacgcucugagcccgggccacgcaggggcucugagcccgggc

SEQ ID NO: 246984 - RNA, 64 nt, hsa
cgcucugagcccgggccacgcaggggcucugagcccgggccacgcaggggcccugagccaaaag

SEQ ID NO: 246985 - RNA, 64 nt, hsa
ccuuaggaauaaucacuucaacuccugauuggucccgggccaagcugaauagcccuuaugaauc

SEQ ID NO: 246986 - RNA, 64 nt, hsa
ccuuaugaaucaucacuucgguuccugauuggucccgggccaaggucccagaccaagcugaauc

SEQ ID NO: 246987 - RNA, 64 nt, hsa
uuaaugcuuauuaaucucucacaagcaucuuugucuugcaaauccuaagggaaaagcaaguccc

SEQ ID NO: 246988 - RNA, 64 nt, hsa
aguuuucuuugacaaaaauguguacuguguaagccuugcaaacaaaaaacaacaaaaaagaagc

SEQ ID NO: 246989 - RNA, 64 nt, hsa
ccacacuuguggggacuuaggcaugacacagguucuugcaaagaaacuagaggcuggcuucacu

SEQ ID NO: 246990 - RNA, 64 nt, hsa
acuuugcucugauuaacuaguauucaaucaccaacuugcaaacagaauucauaacacuuggcac

SEQ ID NO: 246991 - RNA, 64 nt, hsa
ccuugggguuggccguuccucuaaucuggacuugcuugcaaaggugccaggcugucuucugucc

SEQ ID NO: 246992 - RNA, 64 nt, hsa
ccccuucuaccaggcugcaaauguggcucuagcacuugcaaauuguuuuuucuuccgaauaguu

SEQ ID NO: 246993 - RNA, 64 nt, hsa
ugccccagaguugcuguggacagaccuguaaggacuugcaaaacaaaagaaagugagggguuuu

SEQ ID NO: 246994 - RNA, 64 nt, hsa
guuuucaaucuaaaaagaaguauuggcaguuucacuugcaaaauuacacagcuggucccuguga

SEQ ID NO: 246995 - RNA, 64 nt, hsa
cuucuauucugaucugcaaauagcuuaaaugucucuugcaaaacaaaguaagauaccaccagua

SEQ ID NO: 246996 - RNA, 64 nt, hsa
ccugcuugacagacucacucggccucacuucauccuugcaaagagaauccuguacuucauccuu

SEQ ID NO: 246997 - RNA, 64 nt, hsa
cuucauccuugcaaagagaauccuguacuucauccuugcaaagagaauccuguacuucacucag

SEQ ID NO: 246998 - RNA, 64 nt, hsa
uuguaacaguuauuucaggauauuuuguuucuuuaaucugcacacuuucuagauagauuuuauu

SEQ ID NO: 246999 - RNA, 64 nt, hsa
augagcucagagaagcuccgugggccuguuucccaaucugcaaagugugaagggauuagauggg

SEQ ID NO: 247000 - RNA, 64 nt, hsa
caccuguggccucugagaccgccccauuuacaggaaucugcacugggucucagugaaugaacgu

SEQ ID NO: 247001 - RNA, 64 nt, hsa
uuugauucauuccugagaauggcuuaguccugagaaucugcaaagucucugaagagaacucucu

SEQ ID NO: 247002 - RNA, 64 nt, hsa
aauguuuuugucucaagaacaagaauaaaauugaaaucugcauucaugccaauucagcauaaaa

SEQ ID NO: 247003 - RNA, 64 nt, hsa
auaauguaugaugagguuaacacugaaauauuaaaaucugcaaaugcacauuaaugcaaauuaa

SEQ ID NO: 247004 - RNA, 64 nt, hsa
uccuaucuacaugagcccucuuagagaccucagaaaucugcagaaaguucccugugucugucua

SEQ ID NO: 247005 - RNA, 64 nt, hsa
uaaagucuguuggcugugacgucauuauaccuaaaaucugcaucauaccugcaagccaacaguu

SEQ ID NO: 247006 - RNA, 64 nt, hsa
gaaauaaucagcagaaacggaauggaaugccaagaaucugcauugagaauaacuaaacauuguu

SEQ ID NO: 247007 - RNA, 64 nt, hsa
caaccguaucauuauuuguuugaggaaaaaaagaaaucugcauuuuaauucauguuggucaaag

SEQ ID NO: 247008 - RNA, 64 nt, hsa
cccucugauuuccuucugcuaugacaaaaccuuuaaucugcaccuuacaacucggggacaaaug

SEQ ID NO: 247009 - RNA, 64 nt, hsa
cacuugcgacaccucaagguguucucuguagcucaaucugcaaacaugccaggccucagggauc

SEQ ID NO: 247010 - RNA, 64 nt, hsa
aggaucucuguuuuuccuggggcaaacagaaagaaaucugcaugaguugcuuuuguacccuuua

SEQ ID NO: 247011 - RNA, 64 nt, hsa
caacaucauaaccagcuuuuacauccauuuuagaaaucugcacaaauuaagagagcugauuaga

SEQ ID NO: 247012 - RNA, 64 nt, hsa
ucuuacuacuauaacaacucuaaaccugguuuaaaugaaacaucuaauuuugcuguaaggcuua

SEQ ID NO: 247013 - RNA, 64 nt, hsa
ggaagaauguucaaguugaauccuaaugccgugaaugaaacacagucuguguagggaaugagca

SEQ ID NO: 247014 - RNA, 64 nt, hsa
uugcaauuacugguuggggggugcauuuuaaaagaugaaacaugcagcuucccuacauuacaca

SEQ ID NO: 247015 - RNA, 64 nt, hsa
cucagaaauccuucaaacaugauuaauuaugaagaugaaacacuagagucauauaagaaauaaa

SEQ ID NO: 247016 - RNA, 64 nt, hsa
gagaaaauccccaacuaugcaugccaagggguuaaugaaacaaauagcuguugacguuugcuca

SEQ ID NO: 247017 - RNA, 64 nt, hsa
gcauaugcacagucaaggucacuuaaagggucuuaugaaacaauuugagccagagagcaucuuu

SEQ ID NO: 247018 - RNA, 64 nt, hsa
auuccugucuaugcauuuugugagguacaaacugaugaaacagugagugauagagaauuucugc

SEQ ID NO: 247019 - RNA, 64 nt, hsa
uguuuaaccauuaagaaaugcuguauucuuaaauaugaaacaguuaaucuaaagucuuauuauu

SEQ ID NO: 247020 - RNA, 64 nt, hsa
ggcaagauuuucagaaaaaugaguaaaauaauuaaugaaacauauuuagagcacuuaauggucu

SEQ ID NO: 247021 - RNA, 64 nt, hsa
ugcugcuuuuagggacaauuaaaacugggaaacuaugaaacauggaacauuuuauccuaccuga

SEQ ID NO: 247022 - RNA, 64 nt, hsa
aucugcuaauuuuuucccucuuccuucucaauaaaugaaacaaacacugggcagcugcagguuu

SEQ ID NO: 247023 - RNA, 64 nt, hsa
agugaguaaccucgauauuaaaaucauccuugacaugaaacagggugaagagaagcuguccgug

SEQ ID NO: 247024 - RNA, 64 nt, hsa
aaauguucauuuauacugguugcauuuuaagaucaugaaacaauuccaguuacauuguaaaaag

SEQ ID NO: 247025 - RNA, 64 nt, hsa
aacaaguuagaggcauaagcuuaagagcauuuccaugaaacaacacaugcagcauuccaggaac

SEQ ID NO: 247026 - RNA, 64 nt, hsa
augaugagagagaagguaaguggcuuugccagcaaugaaacagcugacauaaugguaaccaguc

SEQ ID NO: 247027 - RNA, 64 nt, hsa
aaaaaauccuugaacuaaugacucaaauuuucaaaugaaacaaaauaagcaguggaucuugcau

SEQ ID NO: 247028 - RNA, 64 nt, hsa
gggaaagggcauggcugugucuuuugcacccaauaugaaacaucuucucccaacacugcuuuaa

SEQ ID NO: 247029 - RNA, 64 nt, hsa
uuuuuuuggcccugggcccaacaguuuguacuucaugaaacauauuguacauuuuacauaguuu

SEQ ID NO: 247030 - RNA, 64 nt, hsa
uuauauuuguacaaucgaguauuuuagaaauuacaugaaacaugaaacaguuuuugcaauuuuu

SEQ ID NO: 247031 - RNA, 64 nt, hsa
uguacaaucgaguauuuuagaaauuacaugaaacaugaaacaguuuuugcaauuuuuuuuaaac

SEQ ID NO: 247032 - RNA, 64 nt, hsa
acuuaauuuggaaauuuuauuguccuauugcaaaaugaaacaaaauuaaaaguggccucgagua

SEQ ID NO: 247033 - RNA, 64 nt, hsa
cccacugucuguggcccauugucauuguuuccucaugaaacauugcagaguuugaauccucagu

SEQ ID NO: 247034 - RNA, 64 nt, hsa
aggugagcugguagaggggagacauuagaaaaaaaugaaacaacaaaacaauuacuaaugaggu

SEQ ID NO: 247035 - RNA, 64 nt, hsa
gcguggaaaucucagauucuucacuggugagacaaugaaacaacagagacagugaaaguuuuaa

SEQ ID NO: 247036 - RNA, 64 nt, hsa
auauccucuuuuuauugcuuugucuauguuucauaugaaacauuucagaaauuauuuugauaag

SEQ ID NO: 247037 - RNA, 64 nt, hsa
ugugugugugugcauuaaaguuguaaacgguaacaugaaacaaaugaaaguucuugcuauaaug

SEQ ID NO: 247038 - RNA, 64 nt, hsa
gaucuggcugagagggaauaaucugagcaaagguaugaaacagccuaaugcauuagagaaaaaa

SEQ ID NO: 247039 - RNA, 64 nt, hsa
ucauaagacagaacauuuggcaggaauuguccuuaugaaacaagaaaaagaaaaugaaaaguau

SEQ ID NO: 247040 - RNA, 64 nt, hsa
caauagaauaaugagaauugaauuuuuaaguucuaugaaacagccagcauugacauuuuauuuu

SEQ ID NO: 247041 - RNA, 64 nt, hsa
guugguuuuucuuaauacauucucagagggagaaaugaaacauuacuauaauuguggggggaac

SEQ ID NO: 247042 - RNA, 64 nt, hsa
uuugaggaacaccucucaucauaacuacauuuaaaugaaacaacuguauuaauauuuuaaauau

SEQ ID NO: 247043 - RNA, 64 nt, hsa
agauuauuguuaauuguauucacccuaauaaucuaugaaacacuaggucuuacuucuucuaucu

SEQ ID NO: 247044 - RNA, 64 nt, hsa
agucacucuucuaauugaauauuuuuauauuuuuaugaaacaaaagagcauuucuucagguuuc

SEQ ID NO: 247045 - RNA, 64 nt, hsa
cauauuuuaaggaaggagcuaaaaauggaaauucaugaaacauaaaugguaucaagaacuuuau

SEQ ID NO: 247046 - RNA, 64 nt, hsa
cauauuuaaaaauaucucaagguuucuguucauuaugaaacaucaauauguuuucuaccauuug

SEQ ID NO: 247047 - RNA, 64 nt, hsa
guauauuuaacuuauaaaguuaauaaauaguuaaaugaaacaaaguuuauaggugaccuuuagu

SEQ ID NO: 247048 - RNA, 64 nt, hsa
uccucaucaucccuuugagaauaaaagucuagaaaugaaacacaauccugacaaguuuggaaaa

SEQ ID NO: 247049 - RNA, 64 nt, hsa
cucugguagcuggggaaugauuuguaaugaguacaugaaacacguuaaauguccuucagccucc

SEQ ID NO: 247050 - RNA, 64 nt, hsa
gcuggggucauuuaugaaaaauacaguuugucacaugaaacauuugcaaaauuguuuuugguug

SEQ ID NO: 247051 - RNA, 64 nt, hsa
uaaggaugugggggaagaccuggcaaggacacagaugaaacacaaacaauaguaauucucaggc

SEQ ID NO: 247052 - RNA, 64 nt, hsa
ugguaauaugucauuucuauaaauguuucuauauaugaaacauaaaguggcagggagauacaau

SEQ ID NO: 247053 - RNA, 64 nt, hsa
gugacguccuggugacuugggggaaaaauuagugaugaaacagccaccaccauauugccauuag

SEQ ID NO: 247054 - RNA, 64 nt, hsa
caauuauggaaauaguacuaaaggcuugccgcacaugaaacauuauuuuaauugguuuaaaguc

SEQ ID NO: 247055 - RNA, 64 nt, hsa
acucuuaaguuuuguuuagcaauguguuucugguaugaaacaaacuacugugucacuguccagg

SEQ ID NO: 247056 - RNA, 64 nt, hsa
augugagcagagacgcauaacauccaauucugagaugaaacagucuaaaauaggaguaaagcau

SEQ ID NO: 247057 - RNA, 64 nt, hsa
uauaauugacauauugaaaaaguauaugaacauaaugaaacaccucauuuauuugauaauucac

SEQ ID NO: 247058 - RNA, 64 nt, hsa
uccucuuccucucccauuucuuuuuuaagacaggaugaaacagguucagagaggggaagugauu

SEQ ID NO: 247059 - RNA, 64 nt, hsa
uaaucgguacaguuauucuuaaagauaauuaaaaaugaaacaaagugagugcucgucacugggu

SEQ ID NO: 247060 - RNA, 64 nt, hsa
auguaguuaguuugauacuccuuagaauaaaaaaaugaaacaguaacaacuuuuauguaaaaaa

SEQ ID NO: 247061 - RNA, 64 nt, hsa
uauuguuuuuuaaggaucuccucucacagugguaaugaaacauuaacuguaacagaaauuuaca

SEQ ID NO: 247062 - RNA, 64 nt, hsa
agccuuaugucugcagagagugugagcggggcuuuagccggaagucaguccuccucauucacca

SEQ ID NO: 247063 - RNA, 64 nt, hsa
aagcccuacgucugcagagagugugggagggcuuuagccggaagucagaccuccucagucacca

SEQ ID NO: 247064 - RNA, 64 nt, hsa
ggaaaggcauguguuucuugcuggugacucauugccuucacaccacuggguuugccagaaacag

SEQ ID NO: 247065 - RNA, 64 nt, hsa
aggagguagcaggagaggaccagguccccaagucccuucacaggguccccacccccacuggcuu

SEQ ID NO: 247066 - RNA, 64 nt, hsa
uaguucaauuuauugcaauuuaauuacaauacuaccuucacaacauuuucauguguuuuaaaua

SEQ ID NO: 247067 - RNA, 64 nt, hsa
cacugugaaugaacuuuguauuauuuuuuuaaaaccuucacauuacguguagauauuauugcaa

SEQ ID NO: 247068 - RNA, 64 nt, hsa
auuuaaugaggauacacuguucauuuuuaaaauuccuucacacuguaauuuaauguguuuuaua

SEQ ID NO: 247069 - RNA, 64 nt, hsa
uuuuuuccucaaauuuuaccuacugaggcucaagccuucacagugagcugauggucucuacagg

SEQ ID NO: 247070 - RNA, 64 nt, hsa
ccuuucccaucuggagagaagcuuccagaccagcccuucacacaccacagccaggaggggccuu

SEQ ID NO: 247071 - RNA, 64 nt, hsa
ccguuccugccuggagagaagcuuccagaccagcccuucacaccacagccaggagaggccuuuc

SEQ ID NO: 247072 - RNA, 64 nt, hsa
ggccuucacaccuucacaggugcgaaaggaaaggccuucacacccucacagaggcaucaugcaa

SEQ ID NO: 247073 - RNA, 64 nt, hsa
uagaaucauuaauggcccaagauaggccuucacaccuucacaggugcgaaaggaaaggccuuca

SEQ ID NO: 247074 - RNA, 64 nt, hsa
gaaaaauauagaaucauuaauggcccaagauaggccuucacaccuucacaggugcgaaaggaaa

SEQ ID NO: 247075 - RNA, 64 nt, hsa
guaacucagaugaugccuccaacccuguggcugcccuucacacuuacaggccuaaccccagcag

SEQ ID NO: 247076 - RNA, 64 nt, hsa
cucugccucucucagccgcaucacccuguugcuuccuucacagcaugucucaccaucugcaacc

SEQ ID NO: 247077 - RNA, 64 nt, hsa
cauaugcacaagcccaccaaccccuucacaccccccuucacaggggucguaugaguaaggggau

SEQ ID NO: 247078 - RNA, 64 nt, hsa
uucacauucccucauaugcacaagcccaccaaccccuucacaccccccuucacaggggucguau

SEQ ID NO: 247079 - RNA, 64 nt, hsa
gagaaggguuuuucuuuuuugaccuuucuucucucaacaggaaccugccugaggacacccuucu

SEQ ID NO: 247080 - RNA, 64 nt, hsa
gcauuuuucuuuugguacccaugugagacaugaacaacaggagggagggaaagagcccaggugg

SEQ ID NO: 247081 - RNA, 64 nt, hsa
uaaauguuuauuaaaaguuagaagaaaugaguaccaacaggaaggaauggaagagaggagaggg

SEQ ID NO: 247082 - RNA, 64 nt, hsa
ggaagugagacaaaggagaagaaauuacucccugcaacaggaggaauagaaaugaagcagugag

SEQ ID NO: 247083 - RNA, 64 nt, hsa
auugucucccauccuagucuguccuggucccuggcaacaggaaccugggcagcuuauccugccc

SEQ ID NO: 247084 - RNA, 64 nt, hsa
uguggaccccagccgagcgcggcaagcgcuguuccaacaggagauggcccgccuugcccgagaa

SEQ ID NO: 247085 - RNA, 64 nt, hsa
gagcuacuagaaaagcugaguggagucuccuuuccaacaggaugaugcauuugcucaauucuca

SEQ ID NO: 247086 - RNA, 64 nt, hsa
caccuggaggacaugcaccaaggcuugccagagccaacaggaagugagcccagagcauggcaca

SEQ ID NO: 247087 - RNA, 55 nt, hsa
augaacaagagggaaaguaguccuccaacaggaugaagcagauuaacagaagagu

SEQ ID NO: 247088 - RNA, 64 nt, hsa
auuuagaacuuuguguguucuuaaagugugcuuccaacaggaaggucagugauaaauuuucaaa

SEQ ID NO: 247089 - RNA, 64 nt, hsa
auggguacucugaacucauuaacauugacaucugcaacaggaggcaacagggaaaaaaucucau

SEQ ID NO: 247090 - RNA, 64 nt, hsa
uuaaauugagguggacauuauuuccccaauuucacaacaggauucacauuguuaauuuauaaau

SEQ ID NO: 247091 - RNA, 64 nt, hsa
guguuuaccuggugcucucaacaggacuuaacaucaacaggacuuaacacaggccucuuguucc

SEQ ID NO: 247092 - RNA, 64 nt, hsa
agagaaggggugcagaguguuuaccuggugcucucaacaggacuuaacaucaacaggacuuaac

SEQ ID NO: 247093 - RNA, 64 nt, hsa
ccucgccaagugggaaugccuacuccagucuugccaacaggacuccaggguucgguaggugggg

SEQ ID NO: 247094 - RNA, 64 nt, hsa
caguaaggcuccaucaggacugggucagugauggcaacaggauggccaaggauggcucuagaac

SEQ ID NO: 247095 - RNA, 64 nt, hsa; identical to SEQ ID NO: 51559

SEQ ID NO: 247096 - RNA, 64 nt, hsa; identical to SEQ ID NO: 51560

SEQ ID NO: 247097 - RNA, 64 nt, hsa; identical to SEQ ID NO: 51561

SEQ ID NO: 247098 - RNA, 64 nt, hsa; identical to SEQ ID NO: 51562

SEQ ID NO: 247099 - RNA, 64 nt, hsa; identical to SEQ ID NO: 51563

SEQ ID NO: 247100 - RNA, 64 nt, hsa; identical to SEQ ID NO: 51564

SEQ ID NO: 247101 - RNA, 64 nt, hsa; identical to SEQ ID NO: 51565

SEQ ID NO: 247102 - RNA, 64 nt, hsa; identical to SEQ ID NO: 51566

SEQ ID NO: 247103 - RNA, 64 nt, hsa; identical to SEQ ID NO: 51567

SEQ ID NO: 247104 - RNA, 64 nt, hsa; identical to SEQ ID NO: 51568

SEQ ID NO: 247105 - RNA, 64 nt, hsa; identical to SEQ ID NO: 51569

SEQ ID NO: 247106 - RNA, 64 nt, hsa; identical to SEQ ID NO: 51570

SEQ ID NO: 247107 - RNA, 64 nt, hsa; identical to SEQ ID NO: 51571

SEQ ID NO: 247108 - RNA, 64 nt, hsa; identical to SEQ ID NO: 51572

SEQ ID NO: 247109 - RNA, 64 nt, hsa; identical to SEQ ID NO: 51573

SEQ ID NO: 247110 - RNA, 64 nt, hsa; identical to SEQ ID NO: 51574

SEQ ID NO: 247111 - RNA, 64 nt, hsa; identical to SEQ ID NO: 51575

SEQ ID NO: 247112 - RNA, 64 nt, hsa; identical to SEQ ID NO: 51576

SEQ ID NO: 247113 - RNA, 64 nt, hsa; identical to SEQ ID NO: 51577

SEQ ID NO: 247114 - RNA, 64 nt, hsa; identical to SEQ ID NO: 51578

SEQ ID NO: 247115 - RNA, 64 nt, hsa; identical to SEQ ID NO: 92469

SEQ ID NO: 247116 - RNA, 64 nt, hsa; identical to SEQ ID NO: 92470

SEQ ID NO: 247117 - RNA, 64 nt, hsa; identical to SEQ ID NO: 92471

SEQ ID NO: 247118 - RNA, 64 nt, hsa; identical to SEQ ID NO: 92472

SEQ ID NO: 247119 - RNA, 64 nt, hsa; identical to SEQ ID NO: 92473

SEQ ID NO: 247120 - RNA, 64 nt, hsa; identical to SEQ ID NO: 92474

SEQ ID NO: 247121 - RNA, 63 nt, hsa; identical to SEQ ID NO: 92475

SEQ ID NO: 247122 - RNA, 64 nt, hsa; identical to SEQ ID NO: 92476

SEQ ID NO: 247123 - RNA, 64 nt, hsa; identical to SEQ ID NO: 92477

SEQ ID NO: 247124 - RNA, 64 nt, hsa; identical to SEQ ID NO: 92478

SEQ ID NO: 247125 - RNA, 64 nt, hsa; identical to SEQ ID NO: 92479

SEQ ID NO: 247126 - RNA, 64 nt, hsa; identical to SEQ ID NO: 92480

SEQ ID NO: 247127 - RNA, 64 nt, hsa; identical to SEQ ID NO: 92481

SEQ ID NO: 247128 - RNA, 64 nt, hsa; identical to SEQ ID NO: 92482

SEQ ID NO: 247129 - RNA, 64 nt, hsa; identical to SEQ ID NO: 92483

SEQ ID NO: 247130 - RNA, 64 nt, hsa; identical to SEQ ID NO: 92484

SEQ ID NO: 247131 - RNA, 64 nt, hsa; identical to SEQ ID NO: 92485

SEQ ID NO: 247132 - RNA, 64 nt, hsa; identical to SEQ ID NO: 92486

SEQ ID NO: 247133 - RNA, 64 nt, hsa; identical to SEQ ID NO: 92487

SEQ ID NO: 247134 - RNA, 64 nt, hsa; identical to SEQ ID NO: 92488

SEQ ID NO: 247135 - RNA, 64 nt, hsa; identical to SEQ ID NO: 92489

SEQ ID NO: 247136 - RNA, 64 nt, hsa; identical to SEQ ID NO: 92490

SEQ ID NO: 247137 - RNA, 64 nt, hsa; identical to SEQ ID NO: 92491

SEQ ID NO: 247138 - RNA, 64 nt, hsa; identical to SEQ ID NO: 92492

SEQ ID NO: 247139 - RNA, 64 nt, hsa; identical to SEQ ID NO: 92493

SEQ ID NO: 247140 - RNA, 64 nt, hsa; identical to SEQ ID NO: 92494

SEQ ID NO: 247141 - RNA, 64 nt, hsa; identical to SEQ ID NO: 92495

SEQ ID NO: 247142 - RNA, 64 nt, hsa; identical to SEQ ID NO: 92496

SEQ ID NO: 247143 - RNA, 64 nt, hsa; identical to SEQ ID NO: 92497

SEQ ID NO: 247144 - RNA, 64 nt, hsa; identical to SEQ ID NO: 92498

SEQ ID NO: 247145 - RNA, 64 nt, hsa; identical to SEQ ID NO: 92499

SEQ ID NO: 247146 - RNA, 64 nt, hsa; identical to SEQ ID NO: 92500

SEQ ID NO: 247147 - RNA, 64 nt, hsa; identical to SEQ ID NO: 92501

SEQ ID NO: 247148 - RNA, 64 nt, hsa; identical to SEQ ID NO: 92502

SEQ ID NO: 247149 - RNA, 64 nt, hsa; identical to SEQ ID NO: 92503

SEQ ID NO: 247150 - RNA, 64 nt, hsa; identical to SEQ ID NO: 92504

SEQ ID NO: 247151 - RNA, 64 nt, hsa; identical to SEQ ID NO: 92505

SEQ ID NO: 247152 - RNA, 64 nt, hsa; identical to SEQ ID NO: 92506

SEQ ID NO: 247153 - RNA, 64 nt, hsa; identical to SEQ ID NO: 92507

SEQ ID NO: 247154 - RNA, 64 nt, hsa; identical to SEQ ID NO: 92508

SEQ ID NO: 247155 - RNA, 64 nt, hsa; identical to SEQ ID NO: 92509

SEQ ID NO: 247156 - RNA, 64 nt, hsa; identical to SEQ ID NO: 92510

SEQ ID NO: 247157 - RNA, 64 nt, hsa; identical to SEQ ID NO: 92511

SEQ ID NO: 247158 - RNA, 64 nt, hsa; identical to SEQ ID NO: 92512

SEQ ID NO: 247159 - RNA, 64 nt, hsa; identical to SEQ ID NO: 92513

SEQ ID NO: 247160 - RNA, 64 nt, hsa; identical to SEQ ID NO: 92514

SEQ ID NO: 247161 - RNA, 64 nt, hsa; identical to SEQ ID NO: 92515

SEQ ID NO: 247162 - RNA, 64 nt, hsa; identical to SEQ ID NO: 92516

SEQ ID NO: 247163 - RNA, 64 nt, hsa; identical to SEQ ID NO: 92517

SEQ ID NO: 247164 - RNA, 64 nt, hsa; identical to SEQ ID NO: 92518

SEQ ID NO: 247165 - RNA, 63 nt, hsa
gaauuuguaaacaaaacaaaauuggacugucuggaaagcuaaaguucugaaauauggaaugua

SEQ ID NO: 247166 - RNA, 63 nt, hsa
aucaugguagguuaagaaaauaugccuguugaugaaagcuaaaagcaaauuuaugaaacuaaa

SEQ ID NO: 247167 - RNA, 63 nt, hsa
uuaaaaacaagacaucuccagguaggaaaaaaugaaagcuauuucaugcaaacauuaucuaau

SEQ ID NO: 247168 - RNA, 63 nt, hsa
uggcagugauuggucuguuuguggagaauguaugaaagcuauuaauauucuagaauagauuaa

SEQ ID NO: 247169 - RNA, 63 nt, hsa
uaaaugaaucgcaaguuaacuuggaaaucaguagaaagcuaaagugauccuaaauaugacagu

SEQ ID NO: 247170 - RNA, 63 nt, hsa
auaaccaguaaggaaauauuaagagcuauuuuagaaagcuaaaugaaucgcaaguuaacuugg

SEQ ID NO: 247171 - RNA, 63 nt, hsa
cgucaguggggcaagaaaucuggagugagugaagaaagcuaaguugugaacaagaguguuuuu

SEQ ID NO: 247172 - RNA, 63 nt, hsa
aaaauuggaagagacuucaaagacugucaaguggaaagcuaucauuuccuaaauuaaggaacu

SEQ ID NO: 247173 - RNA, 63 nt, hsa
uucagccuucaaacuacuacugaucaacuaaaggaaagcuaauaagguauuucuuuuaaacaa

SEQ ID NO: 247174 - RNA, 63 nt, hsa
guauuccgucugcacaggcaaccaaggccaguagaaagcuauggcugcaaaacccuggggugg

SEQ ID NO: 247175 - RNA, 64 nt, hsa
cccggagguaagguucagaaagucccccuggggacuccuccaucuucggcagcucuggcucaaa

SEQ ID NO: 247176 - RNA, 64 nt, hsa
ggggauucaagguaaauaggcuuuacaggcuccccuccuccaaacacacacagaaugggcuggu

SEQ ID NO: 247177 - RNA, 64 nt, hsa
cguggcagguuuacgucaauagucccucucucugcuccuccauucgcaagugucuuccugggcc

SEQ ID NO: 247178 - RNA, 64 nt, hsa
caccccugccacucuguggucggugcccugcuuccuccuccacuccuggccgccuucuccagcg

SEQ ID NO: 247179 - RNA, 64 nt, hsa
cuugaguucagggcggccuccuuguguuccugugcuccuccacuugccacggaugggccacgga

SEQ ID NO: 247180 - RNA, 64 nt, hsa
gccccaccugcucaagucuaaguccgaggccagccuccuccagcugcuggcaggggcuggcacc

SEQ ID NO: 247181 - RNA, 64 nt, hsa
guccagacaguccuguuuguggagugcaaucagccuccuccagcugccagagcgccucagcaca

SEQ ID NO: 247182 - RNA, 64 nt, hsa
cagggagccuagcgccuggcugugugugcggccgcuccuccaggccuggccgugcccgcucagg

SEQ ID NO: 247183 - RNA, 64 nt, hsa
ugacuuaacaacuccaggagcccugucagcugcccuccuccaccuaaaccccuucgacucuucu

SEQ ID NO: 247184 - RNA, 64 nt, hsa
ccucauggcugaaggcccaguccuggcuccaccacuccuccagccagagggucuggaccaucca

SEQ ID NO: 247185 - RNA, 64 nt, hsa
cagcagaggaccgguugcagcuuacccagaaccacuccuccaggagagcuggauguuuugcgug

SEQ ID NO: 247186 - RNA, 64 nt, hsa
cggugccaggggaccccccggagauccugaccagcuccuccagucaugcucuugucccucacug

SEQ ID NO: 247187 - RNA, 64 nt, hsa
cacacccccuugguacccauucccauuucacaaacuccuccaaaccccaaaccccaaacggaaa

SEQ ID NO: 247188 - RNA, 64 nt, hsa
cccaaaccccaaacggaaaucucugggacaauggcuccuccagagggccccucagagccaggug

SEQ ID NO: 247189 - RNA, 64 nt, hsa
gaggggagaguaugaggagggugacuggcagcuucuccuccagacuccuagccccgaggugcug

SEQ ID NO: 247190 - RNA, 64 nt, hsa
aagcaugucuggccgccucugagcuccucccacccuccuccaggaaccuccacaucuccaaaaa

SEQ ID NO: 247191 - RNA, 64 nt, hsa
ccaggccuccacccccacccccguuugcugggggcuccuccagccgcccccaugggaagaggcc

SEQ ID NO: 247192 - RNA, 64 nt, hsa
gucuguugguggccaagaccuucucucuccaccccuccuccauccacccugaggacccuggggc

SEQ ID NO: 247193 - RNA, 64 nt, hsa
cuguuucaacuugacccucccacccccugcuacucuccuccacacaccccuccguuccgcuagc

SEQ ID NO: 247194 - RNA, 64 nt, hsa
cacccggccugcugcuugcugucgccacucaugucuccuccacaugcgguccacacaucaguaa

SEQ ID NO: 247195 - RNA, 64 nt, hsa
uuucccaugaguggaaaauguggcuuguccaacucuccuccagguugcauuucaguuucuuucc

SEQ ID NO: 247196 - RNA, 64 nt, hsa
uugguauccagggcucauguucacuugaugaaaacuccuccaaaagguacaguccucauugugg

SEQ ID NO: 247197 - RNA, 64 nt, hsa
uagaggcugccuacauuccuuggcucuuggcccccuccuccaucuucagagcuagcagguucag

SEQ ID NO: 247198 - RNA, 64 nt, hsa
cugccuuccuggccucuugauucuuggcuugccucuccuccaauuccaaacuuagugaaauggc

SEQ ID NO: 247199 - RNA, 64 nt, hsa
cauguuggggagacuccagcaccguggggcugcccuccuccaugcgccugggagcacaaaggcc

SEQ ID NO: 247200 - RNA, 64 nt, hsa
uggaaaacagccagcuuuggcgcuguuggggagacuccuccagaccaggaaccccagaaggaga

SEQ ID NO: 247201 - RNA, 64 nt, hsa
uucagaucaccucugcgccacaucucauccaugccuccuccaugcacuccaguccacacucccc

SEQ ID NO: 247202 - RNA, 61 nt, hsa
acuacuacacccgcagcuagcauccccacuccuccuccagcccacccaaccgccuuggguc

SEQ ID NO: 247203 - RNA, 64 nt, hsa
caagcccacuggccagcucuggcucagggcccaccuccuccagcgaguaccccagccacuccuc

SEQ ID NO: 247204 - RNA, 64 nt, hsa
agaauguucucacaccauuucacuuccucuuccucuccuccagcauucuccucugagcagccuu

SEQ ID NO: 247205 - RNA, 64 nt, hsa
ugucuuaagaaccagcccacaacagccucucuuucuccuccacauacugcagccucccuccaug

SEQ ID NO: 247206 - RNA, 64 nt, hsa
gccgacaagugauggccuccugggagagccccgccuccuccaccccugccucuccuccaccccu

SEQ ID NO: 247207 - RNA, 64 nt, hsa
uccugggagagccccgccuccuccaccccugccucuccuccaccccugccuccccuccaccccu

SEQ ID NO: 247208 - RNA, 64 nt, hsa
cuccuccaccccugccuccccuccaccccugccucuccuccacccgcccaggagagccccaccu

SEQ ID NO: 247209 - RNA, 64 nt, hsa
cugccucuccuccacccgcccaggagagccccaccuccuccaccccugccucuccuccaccccu

SEQ ID NO: 247210 - RNA, 64 nt, hsa
gcccaggagagccccaccuccuccaccccugccucuccuccaccccugccuccccuccaccugc

SEQ ID NO: 247211 - RNA, 64 nt, hsa
aauugcaaaugccaggcaucuguccacuuuagcccuccuccaaugcuaagaaagagggauggug

SEQ ID NO: 247212 - RNA, 64 nt, hsa
cucccugguucuucuuacagggaggauccuuuuucuccuccaaccuuggcguauaauaauuuuc

SEQ ID NO: 247213 - RNA, 64 nt, hsa
auggccagguucuugugguguccagugcgcgucucuccuccaucacacucucccggcuugcgca

SEQ ID NO: 247214 - RNA, 64 nt, hsa
acugggccaagccccaaccugccucccagccaggcuccuccaggccucugguuuagcggagccc

SEQ ID NO: 247215 - RNA, 64 nt, hsa
aguuacucagcccugggccccaccaccuaggccacuccuccaaaggaagucuaggagcugggag

SEQ ID NO: 247216 - RNA, 64 nt, hsa
uaggacagccuguggcggugccuggguggggcugcuccuccagggccacgugccaggcccgggg

SEQ ID NO: 247217 - RNA, 64 nt, hsa
caccauacagaucuguuuauucuguuucacccuacuccuccagugagccccauauuuugggaaa

SEQ ID NO: 247218 - RNA, 64 nt, hsa
ugcugucaaggaagaaagguaagaaagcugauagcuccuccauguugguaaaauccucuccaga

SEQ ID NO: 247219 - RNA, 64 nt, hsa
aagcugccguagaaagccaugcgcuacugcuuaccuccuccacucccccugccugcccccagca

SEQ ID NO: 247220 - RNA, 64 nt, hsa
gagucacaucuuagcacuuccgcucucaggccuccuccuccaucacagaugucuggaugcuuuu

SEQ ID NO: 247221 - RNA, 64 nt, hsa
uaggauuaaagugcuucugcccuuccacgaacuccuccuccauuuccuuuuugggauuugucac

SEQ ID NO: 247222 - RNA, 64 nt, hsa
uugauguaugacaugucacccuucccaacuuggucuccuccaacaugcugucuucauguggagc

SEQ ID NO: 247223 - RNA, 64 nt, hsa
cugagggagggggaagaagagagggugggagauucuccuccaguccugucucaucuccugggag

SEQ ID NO: 247224 - RNA, 64 nt, hsa
uucagauuccugggaacagacaccagugcuccagcuccuccaaaguucuggcuuagcagcugca

SEQ ID NO: 247225 - RNA, 64 nt, hsa
gucuggggugaggaauguggggagcuugggcauccuccuccagccuccuccagcccccaggcag

SEQ ID NO: 247226 - RNA, 64 nt, hsa
aggaauguggggagcuugggcauccuccuccagccuccuccagcccccaggcagugccuuaccu

SEQ ID NO: 247227 - RNA, 64 nt, hsa
gccucgggccugggauuugaggagggcccuagaccuccuccacucuccauccccuuucccuucc

SEQ ID NO: 247228 - RNA, 64 nt, hsa
agcccuuccuuccacccuggcaccaaaauaauuucuccuccauccguaccuugccuagccucuc

SEQ ID NO: 247229 - RNA, 64 nt, hsa
aaaaauuacacgucgucagccacucagcccuucucuccuccagcccggggacccccgcgggccc

SEQ ID NO: 247230 - RNA, 64 nt, hsa
uuguuugggucuuuugcuguuggaaugggaacuccuccuccauuugagcaacuugggaacaauu

SEQ ID NO: 247231 - RNA, 64 nt, hsa
agcccuccccagauccccuuggggagccucugcccuccuccagcccggauggcucuccuccauu

SEQ ID NO: 247232 - RNA, 64 nt, hsa
ggggagccucugcccuccuccagcccggauggcucuccuccauuuugguuuguuuccucuuguu

SEQ ID NO: 247233 - RNA, 64 nt, hsa
uggccucuuccucuccuccuucccucccaucguccuccuccaccugcgccucccuugucugaac

SEQ ID NO: 247234 - RNA, 64 nt, hsa
cucuucucucuccugcggcccagccucccucucccuccuccauuccucucucccugcccuuuuc

SEQ ID NO: 247235 - RNA, 64 nt, hsa
ggucgauuccucgggacccacagucucaccacgucuccuccagaggacggcagaggguacaggu

SEQ ID NO: 247236 - RNA, 64 nt, hsa
ccucgcccugcacauuccccaccuccacauuccccuccuccaagaucucagcuccuuaacauau

SEQ ID NO: 247237 - RNA, 64 nt, hsa
ggguggggaagguuguugucagcaccgcccccggcuccuccagguccugcuggcuccucggggg

SEQ ID NO: 247238 - RNA, 64 nt, hsa
uuuucuguagguuuaguguggcuggcgccccguucuccuccaguugggaacaugcacccggagc

SEQ ID NO: 247239 - RNA, 64 nt, hsa
uggagcccaucccgauggaagccgccuccuccgccuccuccacgagagaaggacagucguggca

SEQ ID NO: 247240 - RNA, 64 nt, hsa
gagcaagaagcagcauggucuccacagaaagugccuccuccacuuacgaagaacuggccagggc

SEQ ID NO: 247241 - RNA, 64 nt, hsa
uuguggacucaggcacuggggccugucaccaaggcuccuccaacaugcgggaggaggcuuagca

SEQ ID NO: 247242 - RNA, 64 nt, hsa
caagauguggcuccugccacacccacagggcagccuccuccaaaucccuccuggaggggccuac

SEQ ID NO: 247243 - RNA, 64 nt, hsa
cuuuuaaaaaauuuaaaaacaaacagccacaccccuccuccaguccuucuccucaguucuugug

SEQ ID NO: 247244 - RNA, 64 nt, hsa
ccagucuggggucgccugggccccugcugacccccuccuccagagcagccagcccagcccggga

SEQ ID NO: 247245 - RNA, 64 nt, hsa
ggccacaccggccggacacgugguagaugcccaccuccuccaugccucggcgcucgaucuccuc

SEQ ID NO: 247246 - RNA, 64 nt, hsa
agaugcccaccuccuccaugccucggcgcucgaucuccuccacgcacuggcgcacgauguaggg

SEQ ID NO: 247247 - RNA, 64 nt, hsa
ucaccaucucccagacccucuucccuuugcccuucuccuccaauacauaaaggacacagacaag

SEQ ID NO: 247248 - RNA, 64 nt, hsa
aauugggggaaauagaaggaacuaguaacugagacuccuccagccuccucccuauuggaauccc

SEQ ID NO: 247249 - RNA, 64 nt, hsa
ccgggaggagaagguggugggcuaguccuguguccuccuccacuucccaugccucuauguuacc

SEQ ID NO: 247250 - RNA, 64 nt, hsa
gugaccaucugguacauugaggggaccuguuugccuccuccacucuauaagcagucaucuuggg

SEQ ID NO: 247251 - RNA, 64 nt, hsa
uugggggacccccgccaaagacugagcccccugucuccuccaucauuugguuuccucuuggcuu

SEQ ID NO: 247252 - RNA, 64 nt, hsa
ucuuggcuuuggggauacuucuaaauuuugggagcuccuccaucuccaauggcugggauuugug

SEQ ID NO: 247253 - RNA, 64 nt, hsa
ccacauaaaagugcucuccugccugggcagcaacaaccaagaacaaagccccgggacuguuuuc

SEQ ID NO: 247254 - RNA, 64 nt, hsa
guauuaaaaagcugcguugguaaguuuuucauggaaccaagauuugacaaaggcaucucuuauc

SEQ ID NO: 247255 - RNA, 64 nt, hsa
gaauguucacauugcuuuaccaguuuggcacuggaaccaagagcacaugucguggcuggcuaca

SEQ ID NO: 247256 - RNA, 64 nt, hsa
aagugauuuagauaucuaucuaucuagauuucugaaccaagauauauuuauaguucacuuuugg

SEQ ID NO: 247257 - RNA, 64 nt, hsa
aucccuggcucagaggauagcgguuuccaucauaaaccaagaugaugaguucagccuuuauccc

SEQ ID NO: 247258 - RNA, 64 nt, hsa
uucccugggucagaggauagcgguuuccaucauaaaccaagaugaugaguucagccuuuauccc

SEQ ID NO: 247259 - RNA, 64 nt, hsa
uggucagccugucugacauccagguugugcuauuaaccaagaaggaaacagauacuuggaggcu

SEQ ID NO: 247260 - RNA, 64 nt, hsa
aauugcuugaacccgggagguggagguugcagugaaccaagaucgcggcgcugcacucuagccu

SEQ ID NO: 247261 - RNA, 64 nt, hsa
caucauucagaaaacuuuauaaucgucauuguucaaccaagauuuugaauguaauaagaugaau

SEQ ID NO: 247262 - RNA, 64 nt, hsa
auggaggggucuggggaccaugguauaaagaggaaaccaagaaaaagaagccaagcaaaaauca

SEQ ID NO: 247263 - RNA, 64 nt, hsa
cacagguuuucuugucuugacaagaugcuugaaaaaccaagaggauaugaaaaucugucucugg

SEQ ID NO: 247264 - RNA, 64 nt, hsa
auuuacuucuuauaaauugaagucuuaaaugugaaaccaagaaauguaaucaagcaguaaaaac

SEQ ID NO: 247265 - RNA, 64 nt, hsa
cugacaggagggagaagaaaaaacaaaacacuugaaccaagaaacucaaauguaauccuacgau

SEQ ID NO: 247266 - RNA, 64 nt, hsa
ucccccaaauaaacauugcuuuauuucuaauaauaaccaagacuuuucaagcuucuagaucuca

SEQ ID NO: 247267 - RNA, 64 nt, hsa
ccaugugcaagaaaaugagggcuugagucgccugaaccaagagcaggaagagguugcuggagca

SEQ ID NO: 247268 - RNA, 58 nt, hsa; identical to SEQ ID NO: 199452

SEQ ID NO: 247269 - RNA, 64 nt, hsa
augagaaagcucaugggcaagaaacucuaugaauaaccaagauggagccgggugcaguugccaa

SEQ ID NO: 247270 - RNA, 64 nt, hsa
cuugugagagauugagacacucuaaauaaauaauaaccaagaugggaaauuucccugccagacc

SEQ ID NO: 247271 - RNA, 64 nt, hsa
gcugccuuuccccagggaauccucuccagaucuuaaccaagagccccuugcaaacuucuucgac

SEQ ID NO: 247272 - RNA, 64 nt, hsa
gagauauuuccuccaggaaucguguuucaauuguaaccaagaaauuuccauuugugcuucauga

SEQ ID NO: 247273 - RNA, 55 nt, hsa; identical to SEQ ID NO: 199457

SEQ ID NO: 247274 - RNA, 64 nt, hsa
acuauagguuuaaaccaagacaaaugaagacugaaaccaagaauauuguucuuaugcuggaaau

SEQ ID NO: 247275 - RNA, 64 nt, hsa; identical to SEQ ID NO: 49704

SEQ ID NO: 247276 - RNA, 64 nt, hsa; identical to SEQ ID NO: 49705

SEQ ID NO: 247277 - RNA, 64 nt, hsa; identical to SEQ ID NO: 49706

SEQ ID NO: 247278 - RNA, 64 nt, hsa; identical to SEQ ID NO: 49707

SEQ ID NO: 247279 - RNA, 64 nt, hsa; identical to SEQ ID NO: 49708

SEQ ID NO: 247280 - RNA, 64 nt, hsa; identical to SEQ ID NO: 49709

SEQ ID NO: 247281 - RNA, 64 nt, hsa; identical to SEQ ID NO: 49710

SEQ ID NO: 247282 - RNA, 64 nt, hsa; identical to SEQ ID NO: 49711

SEQ ID NO: 247283 - RNA, 64 nt, hsa; identical to SEQ ID NO: 49712

SEQ ID NO: 247284 - RNA, 64 nt, hsa; identical to SEQ ID NO: 49713

SEQ ID NO: 247285 - RNA, 64 nt, hsa; identical to SEQ ID NO: 49714

SEQ ID NO: 247286 - RNA, 64 nt, hsa; identical to SEQ ID NO: 49715

SEQ ID NO: 247287 - RNA, 64 nt, hsa; identical to SEQ ID NO: 49716

SEQ ID NO: 247288 - RNA, 64 nt, hsa; identical to SEQ ID NO: 49717

SEQ ID NO: 247289 - RNA, 64 nt, hsa; identical to SEQ ID NO: 49718

SEQ ID NO: 247290 - RNA, 64 nt, hsa; identical to SEQ ID NO: 49719

SEQ ID NO: 247291 - RNA, 64 nt, hsa; identical to SEQ ID NO: 49720

SEQ ID NO: 247292 - RNA, 64 nt, hsa; identical to SEQ ID NO: 49721

SEQ ID NO: 247293 - RNA, 64 nt, hsa; identical to SEQ ID NO: 49722

SEQ ID NO: 247294 - RNA, 64 nt, hsa; identical to SEQ ID NO: 49723

SEQ ID NO: 247295 - RNA, 64 nt, hsa; identical to SEQ ID NO: 49724

SEQ ID NO: 247296 - RNA, 64 nt, hsa; identical to SEQ ID NO: 49725

SEQ ID NO: 247297 - RNA, 64 nt, hsa; identical to SEQ ID NO: 49726

SEQ ID NO: 247298 - RNA, 64 nt, hsa; identical to SEQ ID NO: 49727

SEQ ID NO: 247299 - RNA, 64 nt, hsa; identical to SEQ ID NO: 49728

SEQ ID NO: 247300 - RNA, 64 nt, hsa; identical to SEQ ID NO: 49729

SEQ ID NO: 247301 - RNA, 64 nt, hsa; identical to SEQ ID NO: 49730

SEQ ID NO: 247302 - RNA, 64 nt, hsa; identical to SEQ ID NO: 49731

SEQ ID NO: 247303 - RNA, 64 nt, hsa; identical to SEQ ID NO: 49732

SEQ ID NO: 247304 - RNA, 64 nt, hsa; identical to SEQ ID NO: 49733

SEQ ID NO: 247305 - RNA, 64 nt, hsa; identical to SEQ ID NO: 49734

SEQ ID NO: 247306 - RNA, 64 nt, hsa; identical to SEQ ID NO: 49735

SEQ ID NO: 247307 - RNA, 64 nt, hsa; identical to SEQ ID NO: 49736

SEQ ID NO: 247308 - RNA, 64 nt, hsa; identical to SEQ ID NO: 49737

SEQ ID NO: 247309 - RNA, 64 nt, hsa; identical to SEQ ID NO: 49738

SEQ ID NO: 247310 - RNA, 64 nt, hsa; identical to SEQ ID NO: 49739

SEQ ID NO: 247311 - RNA, 64 nt, hsa; identical to SEQ ID NO: 49740

SEQ ID NO: 247312 - RNA, 64 nt, hsa; identical to SEQ ID NO: 49741

SEQ ID NO: 247313 - RNA, 64 nt, hsa; identical to SEQ ID NO: 49742

SEQ ID NO: 247314 - RNA, 64 nt, hsa; identical to SEQ ID NO: 49743

SEQ ID NO: 247315 - RNA, 64 nt, hsa; identical to SEQ ID NO: 49744

SEQ ID NO: 247316 - RNA, 64 nt, hsa; identical to SEQ ID NO: 49745

SEQ ID NO: 247317 - RNA, 64 nt, hsa; identical to SEQ ID NO: 49746

SEQ ID NO: 247318 - RNA, 64 nt, hsa; identical to SEQ ID NO: 49747

SEQ ID NO: 247319 - RNA, 64 nt, hsa; identical to SEQ ID NO: 49748

SEQ ID NO: 247320 - RNA, 64 nt, hsa; identical to SEQ ID NO: 49749

SEQ ID NO: 247321 - RNA, 64 nt, hsa; identical to SEQ ID NO: 49750

SEQ ID NO: 247322 - RNA, 64 nt, hsa; identical to SEQ ID NO: 49751

SEQ ID NO: 247323 - RNA, 64 nt, hsa; identical to SEQ ID NO: 49752

SEQ ID NO: 247324 - RNA, 64 nt, hsa; identical to SEQ ID NO: 49753

SEQ ID NO: 247325 - RNA, 64 nt, hsa; identical to SEQ ID NO: 49754

SEQ ID NO: 247326 - RNA, 64 nt, hsa; identical to SEQ ID NO: 49755

SEQ ID NO: 247327 - RNA, 64 nt, hsa; identical to SEQ ID NO: 49756

SEQ ID NO: 247328 - RNA, 64 nt, hsa; identical to SEQ ID NO: 49757

SEQ ID NO: 247329 - RNA, 64 nt, hsa; identical to SEQ ID NO: 49758

SEQ ID NO: 247330 - RNA, 64 nt, hsa; identical to SEQ ID NO: 49759

SEQ ID NO: 247331 - RNA, 64 nt, hsa; identical to SEQ ID NO: 49760

SEQ ID NO: 247332 - RNA, 64 nt, hsa; identical to SEQ ID NO: 49761

SEQ ID NO: 247333 - RNA, 64 nt, hsa; identical to SEQ ID NO: 49762

SEQ ID NO: 247334 - RNA, 64 nt, hsa; identical to SEQ ID NO: 49763

SEQ ID NO: 247335 - RNA, 64 nt, hsa; identical to SEQ ID NO: 49764

SEQ ID NO: 247336 - RNA, 64 nt, hsa; identical to SEQ ID NO: 49765

SEQ ID NO: 247337 - RNA, 64 nt, hsa; identical to SEQ ID NO: 49766

SEQ ID NO: 247338 - RNA, 64 nt, hsa; identical to SEQ ID NO: 49767

SEQ ID NO: 247339 - RNA, 64 nt, hsa; identical to SEQ ID NO: 49768

SEQ ID NO: 247340 - RNA, 64 nt, hsa; identical to SEQ ID NO: 49769

SEQ ID NO: 247341 - RNA, 64 nt, hsa; identical to SEQ ID NO: 49770

SEQ ID NO: 247342 - RNA, 64 nt, hsa; identical to SEQ ID NO: 49771

SEQ ID NO: 247343 - RNA, 64 nt, hsa; identical to SEQ ID NO: 49772

SEQ ID NO: 247344 - RNA, 64 nt, hsa; identical to SEQ ID NO: 49773

SEQ ID NO: 247345 - RNA, 64 nt, hsa; identical to SEQ ID NO: 49774

SEQ ID NO: 247346 - RNA, 64 nt, hsa; identical to SEQ ID NO: 49775

SEQ ID NO: 247347 - RNA, 64 nt, hsa; identical to SEQ ID NO: 49776

SEQ ID NO: 247348 - RNA, 64 nt, hsa; identical to SEQ ID NO: 49777

SEQ ID NO: 247349 - RNA, 64 nt, hsa; identical to SEQ ID NO: 49778

SEQ ID NO: 247350 - RNA, 64 nt, hsa; identical to SEQ ID NO: 49779

SEQ ID NO: 247351 - RNA, 64 nt, hsa; identical to SEQ ID NO: 49780

SEQ ID NO: 247352 - RNA, 64 nt, hsa; identical to SEQ ID NO: 49781

SEQ ID NO: 247353 - RNA, 64 nt, hsa; identical to SEQ ID NO: 49782

SEQ ID NO: 247354 - RNA, 64 nt, hsa; identical to SEQ ID NO: 49783

SEQ ID NO: 247355 - RNA, 64 nt, hsa; identical to SEQ ID NO: 49784

SEQ ID NO: 247356 - RNA, 64 nt, hsa; identical to SEQ ID NO: 49785

SEQ ID NO: 247357 - RNA, 64 nt, hsa; identical to SEQ ID NO: 49786

SEQ ID NO: 247358 - RNA, 64 nt, hsa; identical to SEQ ID NO: 49787

SEQ ID NO: 247359 - RNA, 64 nt, hsa; identical to SEQ ID NO: 49788

SEQ ID NO: 247360 - RNA, 64 nt, hsa; identical to SEQ ID NO: 49789

SEQ ID NO: 247361 - RNA, 64 nt, hsa; identical to SEQ ID NO: 49790

SEQ ID NO: 247362 - RNA, 64 nt, hsa; identical to SEQ ID NO: 49791

SEQ ID NO: 247363 - RNA, 64 nt, hsa; identical to SEQ ID NO: 49792

SEQ ID NO: 247364 - RNA, 64 nt, hsa; identical to SEQ ID NO: 49793

SEQ ID NO: 247365 - RNA, 64 nt, hsa; identical to SEQ ID NO: 49794

SEQ ID NO: 247366 - RNA, 64 nt, hsa; identical to SEQ ID NO: 49795

SEQ ID NO: 247367 - RNA, 64 nt, hsa; identical to SEQ ID NO: 49796

SEQ ID NO: 247368 - RNA, 64 nt, hsa; identical to SEQ ID NO: 49797

SEQ ID NO: 247369 - RNA, 64 nt, hsa; identical to SEQ ID NO: 49798

SEQ ID NO: 247370 - RNA, 64 nt, hsa; identical to SEQ ID NO: 49799

SEQ ID NO: 247371 - RNA, 64 nt, hsa; identical to SEQ ID NO: 49800

SEQ ID NO: 247372 - RNA, 64 nt, hsa; identical to SEQ ID NO: 49801

SEQ ID NO: 247373 - RNA, 64 nt, hsa; identical to SEQ ID NO: 49802

SEQ ID NO: 247374 - RNA, 64 nt, hsa; identical to SEQ ID NO: 49803

SEQ ID NO: 247375 - RNA, 64 nt, hsa; identical to SEQ ID NO: 49804

SEQ ID NO: 247376 - RNA, 64 nt, hsa; identical to SEQ ID NO: 49805

SEQ ID NO: 247377 - RNA, 64 nt, hsa; identical to SEQ ID NO: 49806

SEQ ID NO: 247378 - RNA, 64 nt, hsa; identical to SEQ ID NO: 49807

SEQ ID NO: 247379 - RNA, 64 nt, hsa; identical to SEQ ID NO: 49808

SEQ ID NO: 247380 - RNA, 64 nt, hsa; identical to SEQ ID NO: 49809

SEQ ID NO: 247381 - RNA, 64 nt, hsa; identical to SEQ ID NO: 49810

SEQ ID NO: 247382 - RNA, 64 nt, hsa; identical to SEQ ID NO: 49811

SEQ ID NO: 247383 - RNA, 64 nt, hsa; identical to SEQ ID NO: 49812

SEQ ID NO: 247384 - RNA, 64 nt, hsa; identical to SEQ ID NO: 49813

SEQ ID NO: 247385 - RNA, 64 nt, hsa; identical to SEQ ID NO: 49814

SEQ ID NO: 247386 - RNA, 64 nt, hsa; identical to SEQ ID NO: 49815

SEQ ID NO: 247387 - RNA, 64 nt, hsa; identical to SEQ ID NO: 49816

SEQ ID NO: 247388 - RNA, 64 nt, hsa; identical to SEQ ID NO: 49817

SEQ ID NO: 247389 - RNA, 64 nt, hsa; identical to SEQ ID NO: 49818

SEQ ID NO: 247390 - RNA, 64 nt, hsa; identical to SEQ ID NO: 49819

SEQ ID NO: 247391 - RNA, 64 nt, hsa; identical to SEQ ID NO: 49820

SEQ ID NO: 247392 - RNA, 64 nt, hsa; identical to SEQ ID NO: 49821

SEQ ID NO: 247393 - RNA, 64 nt, hsa; identical to SEQ ID NO: 49822

SEQ ID NO: 247394 - RNA, 64 nt, hsa; identical to SEQ ID NO: 49823

SEQ ID NO: 247395 - RNA, 64 nt, hsa; identical to SEQ ID NO: 49824

SEQ ID NO: 247396 - RNA, 64 nt, hsa; identical to SEQ ID NO: 49825

SEQ ID NO: 247397 - RNA, 64 nt, hsa; identical to SEQ ID NO: 49826

SEQ ID NO: 247398 - RNA, 64 nt, hsa; identical to SEQ ID NO: 49827

SEQ ID NO: 247399 - RNA, 64 nt, hsa; identical to SEQ ID NO: 49828

SEQ ID NO: 247400 - RNA, 64 nt, hsa; identical to SEQ ID NO: 49829

SEQ ID NO: 247401 - RNA, 64 nt, hsa; identical to SEQ ID NO: 49830

SEQ ID NO: 247402 - RNA, 64 nt, hsa; identical to SEQ ID NO: 49831

SEQ ID NO: 247403 - RNA, 64 nt, hsa; identical to SEQ ID NO: 49832

SEQ ID NO: 247404 - RNA, 64 nt, hsa; identical to SEQ ID NO: 49833

SEQ ID NO: 247405 - RNA, 64 nt, hsa; identical to SEQ ID NO: 49834

SEQ ID NO: 247406 - RNA, 64 nt, hsa; identical to SEQ ID NO: 49835

SEQ ID NO: 247407 - RNA, 64 nt, hsa; identical to SEQ ID NO: 49836

SEQ ID NO: 247408 - RNA, 64 nt, hsa; identical to SEQ ID NO: 49837

SEQ ID NO: 247409 - RNA, 64 nt, hsa; identical to SEQ ID NO: 49838

SEQ ID NO: 247410 - RNA, 64 nt, hsa; identical to SEQ ID NO: 49839

SEQ ID NO: 247411 - RNA, 64 nt, hsa; identical to SEQ ID NO: 49840

SEQ ID NO: 247412 - RNA, 64 nt, hsa; identical to SEQ ID NO: 49841

SEQ ID NO: 247413 - RNA, 64 nt, hsa; identical to SEQ ID NO: 49842

SEQ ID NO: 247414 - RNA, 64 nt, hsa; identical to SEQ ID NO: 49843

SEQ ID NO: 247415 - RNA, 64 nt, hsa; identical to SEQ ID NO: 49844

SEQ ID NO: 247416 - RNA, 64 nt, hsa; identical to SEQ ID NO: 49845

SEQ ID NO: 247417 - RNA, 64 nt, hsa; identical to SEQ ID NO: 49846

SEQ ID NO: 247418 - RNA, 64 nt, hsa; identical to SEQ ID NO: 49847

SEQ ID NO: 247419 - RNA, 64 nt, hsa; identical to SEQ ID NO: 49848

SEQ ID NO: 247420 - RNA, 64 nt, hsa; identical to SEQ ID NO: 49849

SEQ ID NO: 247421 - RNA, 64 nt, hsa; identical to SEQ ID NO: 49850

SEQ ID NO: 247422 - RNA, 64 nt, hsa; identical to SEQ ID NO: 49851

SEQ ID NO: 247423 - RNA, 64 nt, hsa; identical to SEQ ID NO: 49852

SEQ ID NO: 247424 - RNA, 64 nt, hsa; identical to SEQ ID NO: 49853

SEQ ID NO: 247425 - RNA, 64 nt, hsa; identical to SEQ ID NO: 49854

SEQ ID NO: 247426 - RNA, 64 nt, hsa; identical to SEQ ID NO: 49855

SEQ ID NO: 247427 - RNA, 64 nt, hsa; identical to SEQ ID NO: 49856

SEQ ID NO: 247428 - RNA, 64 nt, hsa; identical to SEQ ID NO: 49857

SEQ ID NO: 247429 - RNA, 64 nt, hsa; identical to SEQ ID NO: 49858

SEQ ID NO: 247430 - RNA, 64 nt, hsa; identical to SEQ ID NO: 49859

SEQ ID NO: 247431 - RNA, 64 nt, hsa; identical to SEQ ID NO: 49860

SEQ ID NO: 247432 - RNA, 64 nt, hsa; identical to SEQ ID NO: 49861

SEQ ID NO: 247433 - RNA, 64 nt, hsa; identical to SEQ ID NO: 49862

SEQ ID NO: 247434 - RNA, 64 nt, hsa; identical to SEQ ID NO: 49863

SEQ ID NO: 247435 - RNA, 64 nt, hsa; identical to SEQ ID NO: 49864

SEQ ID NO: 247436 - RNA, 64 nt, hsa; identical to SEQ ID NO: 49865

SEQ ID NO: 247437 - RNA, 64 nt, hsa; identical to SEQ ID NO: 49866

SEQ ID NO: 247438 - RNA, 64 nt, hsa; identical to SEQ ID NO: 49867

SEQ ID NO: 247439 - RNA, 64 nt, hsa; identical to SEQ ID NO: 49868

SEQ ID NO: 247440 - RNA, 64 nt, hsa; identical to SEQ ID NO: 49869

SEQ ID NO: 247441 - RNA, 64 nt, hsa; identical to SEQ ID NO: 49870

SEQ ID NO: 247442 - RNA, 64 nt, hsa; identical to SEQ ID NO: 49871

SEQ ID NO: 247443 - RNA, 64 nt, hsa; identical to SEQ ID NO: 49872

SEQ ID NO: 247444 - RNA, 64 nt, hsa; identical to SEQ ID NO: 49873

SEQ ID NO: 247445 - RNA, 64 nt, hsa; identical to SEQ ID NO: 49874

SEQ ID NO: 247446 - RNA, 64 nt, hsa; identical to SEQ ID NO: 49875

SEQ ID NO: 247447 - RNA, 64 nt, hsa; identical to SEQ ID NO: 49876

SEQ ID NO: 247448 - RNA, 64 nt, hsa; identical to SEQ ID NO: 49877

SEQ ID NO: 247449 - RNA, 64 nt, hsa; identical to SEQ ID NO: 49878

SEQ ID NO: 247450 - RNA, 64 nt, hsa; identical to SEQ ID NO: 49879

SEQ ID NO: 247451 - RNA, 64 nt, hsa; identical to SEQ ID NO: 49880

SEQ ID NO: 247452 - RNA, 64 nt, hsa; identical to SEQ ID NO: 49881

SEQ ID NO: 247453 - RNA, 64 nt, hsa; identical to SEQ ID NO: 49882

SEQ ID NO: 247454 - RNA, 64 nt, hsa; identical to SEQ ID NO: 49883

SEQ ID NO: 247455 - RNA, 64 nt, hsa; identical to SEQ ID NO: 49884

SEQ ID NO: 247456 - RNA, 64 nt, hsa; identical to SEQ ID NO: 49885

SEQ ID NO: 247457 - RNA, 64 nt, hsa; identical to SEQ ID NO: 49886

SEQ ID NO: 247458 - RNA, 64 nt, hsa; identical to SEQ ID NO: 49887

SEQ ID NO: 247459 - RNA, 64 nt, hsa; identical to SEQ ID NO: 49888

SEQ ID NO: 247460 - RNA, 64 nt, hsa; identical to SEQ ID NO: 49889

SEQ ID NO: 247461 - RNA, 64 nt, hsa; identical to SEQ ID NO: 49890

SEQ ID NO: 247462 - RNA, 64 nt, hsa; identical to SEQ ID NO: 49891

SEQ ID NO: 247463 - RNA, 64 nt, hsa; identical to SEQ ID NO: 49892

SEQ ID NO: 247464 - RNA, 64 nt, hsa; identical to SEQ ID NO: 49893

SEQ ID NO: 247465 - RNA, 64 nt, hsa
uuugugcagacauaccauuuucaguucugcugucacuuggaaguucaggcucagcaugaauuuu

SEQ ID NO: 247466 - RNA, 64 nt, hsa
caagcagcucacuacgauaucaaguuacacuaagacuuggaacacuaacauucuguaagagguu

SEQ ID NO: 247467 - RNA, 64 nt, hsa
ggacaaguuuaacuuuauuuuuaauguguuaauuacuuggaauaaaugcauuaaucucauguuu

SEQ ID NO: 247468 - RNA, 64 nt, hsa
gggaaaaacaccagaaagcuugcugaaauggaaaacuuggaagaauuguucaucucuuaggcuu

SEQ ID NO: 247469 - RNA, 64 nt, hsa
accauaguuauuuacuugaaagaugggucuccgcacuuggaaagguuucaagacuugauacugc

SEQ ID NO: 247470 - RNA, 64 nt, hsa
ugguucaagagacacugcuuggguuccuuuuucaacuuggaaaaagaaagaaacacucaacaau

SEQ ID NO: 247471 - RNA, 64 nt, hsa
aaaguuaucuugguacaacaccguguguauauacacuuggaagcuuaaaaagguguuuugucug

SEQ ID NO: 247472 - RNA, 64 nt, hsa
uauugcucauaacuuaccaagaggcuaauacuaaacuuggaaaauuguuuaaguauguuuuauc

SEQ ID NO: 247473 - RNA, 64 nt, hsa
uuucauuugggggcuauguguuucaauaacauucacuuggaaucagcugaaagcuguaauaugu

SEQ ID NO: 247474 - RNA, 64 nt, hsa
acucagaacugaaggcaauuauuucuuuugguggacuuggaaucuccguuugucuacacugucc

SEQ ID NO: 247475 - RNA, 64 nt, hsa
gguguaccugaaagugagggggagaauggaaccaacuuggaaaacacucugcaggauauuaucc

SEQ ID NO: 247476 - RNA, 64 nt, hsa
caggauuaagaaacucacucaaaaccgcucaacuacuuggaaacugaacaaccugcuccugaau

SEQ ID NO: 247477 - RNA, 64 nt, hsa
cggccugucacccugcuuucccugccucuacuugacuuggaauuggcugaagacuacacaggaa

SEQ ID NO: 247478 - RNA, 64 nt, hsa
uacacaggaaugcaucguucccacuccccaucccacuuggaaaacuccaaggggguguggcuuc

SEQ ID NO: 247479 - RNA, 64 nt, hsa
auggcgagugauugcuuuccuucagagaacagacacuuggaauuucuccuuuuaguguuuauau

SEQ ID NO: 247480 - RNA, 64 nt, hsa
ggaugcuuuuaaaguuuuauauuuauguccccaaacuuggaaacaagaacucuacuuuagccua

SEQ ID NO: 247481 - RNA, 64 nt, hsa
agugguuauucagggucugagcagcaguaaaagucacccuaaaucaaggggcuuuucagaaggu

SEQ ID NO: 247482 - RNA, 64 nt, hsa
ccuuuuuaaagccauggaacaaaaccugauacaucacccuaacagagcauuaaguuguaacuga

SEQ ID NO: 247483 - RNA, 64 nt, hsa
guuugacuuguauaacaucacugucaaacuuugucacccuaacuucguauuuuuugauacgcac

SEQ ID NO: 247484 - RNA, 64 nt, hsa
agcucugucugcucaaugccauugugcagagaagcacccuaaugcauaagcuuuuuaaugcugu

SEQ ID NO: 247485 - RNA, 64 nt, hsa
aguucucccugaguugauugauaggcuuaauggucacccuaaaaacacccacauaugcuuuucg

SEQ ID NO: 247486 - RNA, 64 nt, hsa
augcauucaucauaauaauuccagacauuuucaucacccuaaaaggaaacccugaaacccauua

SEQ ID NO: 247487 - RNA, 64 nt, hsa
cuaauauugcaggaggggccucucuuccaagccccacccuaaggguuagcccuuggccaaaucu

SEQ ID NO: 247488 - RNA, 64 nt, hsa
gacucuucccaaguuagcuugucuccucuccugucacccuaagagccacugaguuguguaggga

SEQ ID NO: 247489 - RNA, 64 nt, hsa
agaucucgguuugccaaaauucauuucuaauuaaccuuacuaauuauacuacuuuguuaggauu

SEQ ID NO: 247490 - RNA, 64 nt, hsa
uuaauagggaauauaucucuauuugagaauagacccuuacuaggaagaacguuuuuuccucagu

SEQ ID NO: 247491 - RNA, 64 nt, hsa
aagaauguggcaaaggccuuuacugcuccuauucccuuacuaaagaauguggcaaagcuuuuca

SEQ ID NO: 247492 - RNA, 64 nt, hsa
aagaauguggcaaagauuucuauugauucucauaccuuacuaaauauaagauaauucauauugg

SEQ ID NO: 247493 - RNA, 64 nt, hsa
aagaauguggcaaaggcuuuaauuaguucucaucccuuacuaaacauaagagaauucauaccau

SEQ ID NO: 247494 - RNA, 64 nt, hsa
aggaaugucucaaagcuuuuuacugauucuuauaccuuacuaaacauaaaauaauucauaaagg

SEQ ID NO: 247495 - RNA, 64 nt, hsa
aaaaauguggcaaaccuuuuaaccaauccucaacccuuacuacacauuagauaauucaugcugg

SEQ ID NO: 247496 - RNA, 64 nt, hsa
aaaaauguggcaaagcuuuuaaccaauuuucaaaccuuacuaaacauaagauaacucauacugg

SEQ ID NO: 247497 - RNA, 64 nt, hsa
aagaauguggcaagccuuuuagcuguuccucaauccuuacuaaacauucauguaauucauacug

SEQ ID NO: 247498 - RNA, 64 nt, hsa
aagaaugugauaaagacuucaacuguuccucacaccuuacuacucauaaaagaauucauacugg

SEQ ID NO: 247499 - RNA, 64 nt, hsa; identical to SEQ ID NO: 48305

SEQ ID NO: 247500 - RNA, 64 nt, hsa; identical to SEQ ID NO: 48306

SEQ ID NO: 247501 - RNA, 64 nt, hsa; identical to SEQ ID NO: 48307

SEQ ID NO: 247502 - RNA, 64 nt, hsa; identical to SEQ ID NO: 48308

SEQ ID NO: 247503 - RNA, 64 nt, hsa; identical to SEQ ID NO: 48309

SEQ ID NO: 247504 - RNA, 64 nt, hsa; identical to SEQ ID NO: 48310

SEQ ID NO: 247505 - RNA, 64 nt, hsa; identical to SEQ ID NO: 48311

SEQ ID NO: 247506 - RNA, 64 nt, hsa; identical to SEQ ID NO: 48312

SEQ ID NO: 247507 - RNA, 64 nt, hsa; identical to SEQ ID NO: 48313

SEQ ID NO: 247508 - RNA, 64 nt, hsa; identical to SEQ ID NO: 48314

SEQ ID NO: 247509 - RNA, 64 nt, hsa; identical to SEQ ID NO: 48315

SEQ ID NO: 247510 - RNA, 64 nt, hsa; identical to SEQ ID NO: 48316

SEQ ID NO: 247511 - RNA, 64 nt, hsa; identical to SEQ ID NO: 48317

SEQ ID NO: 247512 - RNA, 64 nt, hsa; identical to SEQ ID NO: 48318

SEQ ID NO: 247513 - RNA, 64 nt, hsa; identical to SEQ ID NO: 48319

SEQ ID NO: 247514 - RNA, 64 nt, hsa; identical to SEQ ID NO: 48320

SEQ ID NO: 247515 - RNA, 64 nt, hsa; identical to SEQ ID NO: 48321

SEQ ID NO: 247516 - RNA, 64 nt, hsa; identical to SEQ ID NO: 48322

SEQ ID NO: 247517 - RNA, 64 nt, hsa; identical to SEQ ID NO: 48323

SEQ ID NO: 247518 - RNA, 64 nt, hsa; identical to SEQ ID NO: 48324

SEQ ID NO: 247519 - RNA, 64 nt, hsa; identical to SEQ ID NO: 48325

SEQ ID NO: 247520 - RNA, 64 nt, hsa; identical to SEQ ID NO: 48326

SEQ ID NO: 247521 - RNA, 64 nt, hsa; identical to SEQ ID NO: 48327

SEQ ID NO: 247522 - RNA, 64 nt, hsa; identical to SEQ ID NO: 48328

SEQ ID NO: 247523 - RNA, 64 nt, hsa; identical to SEQ ID NO: 48329

SEQ ID NO: 247524 - RNA, 51 nt, hsa; identical to SEQ ID NO: 48330

SEQ ID NO: 247525 - RNA, 64 nt, hsa; identical to SEQ ID NO: 48331

SEQ ID NO: 247526 - RNA, 64 nt, hsa; identical to SEQ ID NO: 48332

SEQ ID NO: 247527 - RNA, 64 nt, hsa; identical to SEQ ID NO: 48333

SEQ ID NO: 247528 - RNA, 64 nt, hsa; identical to SEQ ID NO: 48334

SEQ ID NO: 247529 - RNA, 64 nt, hsa; identical to SEQ ID NO: 48335

SEQ ID NO: 247530 - RNA, 64 nt, hsa; identical to SEQ ID NO: 48336

SEQ ID NO: 247531 - RNA, 64 nt, hsa; identical to SEQ ID NO: 48337

SEQ ID NO: 247532 - RNA, 64 nt, hsa; identical to SEQ ID NO: 48338

SEQ ID NO: 247533 - RNA, 64 nt, hsa; identical to SEQ ID NO: 48339

SEQ ID NO: 247534 - RNA, 64 nt, hsa; identical to SEQ ID NO: 48340

SEQ ID NO: 247535 - RNA, 64 nt, hsa; identical to SEQ ID NO: 48341

SEQ ID NO: 247536 - RNA, 64 nt, hsa; identical to SEQ ID NO: 48342

SEQ ID NO: 247537 - RNA, 64 nt, hsa; identical to SEQ ID NO: 48343

SEQ ID NO: 247538 - RNA, 64 nt, hsa; identical to SEQ ID NO: 48344

SEQ ID NO: 247539 - RNA, 64 nt, hsa; identical to SEQ ID NO: 48345

SEQ ID NO: 247540 - RNA, 64 nt, hsa; identical to SEQ ID NO: 48346

SEQ ID NO: 247541 - RNA, 64 nt, hsa; identical to SEQ ID NO: 48347

SEQ ID NO: 247542 - RNA, 64 nt, hsa; identical to SEQ ID NO: 48348

SEQ ID NO: 247543 - RNA, 64 nt, hsa; identical to SEQ ID NO: 48349

SEQ ID NO: 247544 - RNA, 64 nt, hsa; identical to SEQ ID NO: 71557

SEQ ID NO: 247545 - RNA, 64 nt, hsa; identical to SEQ ID NO: 71558

SEQ ID NO: 247546 - RNA, 64 nt, hsa; identical to SEQ ID NO: 71559

SEQ ID NO: 247547 - RNA, 64 nt, hsa; identical to SEQ ID NO: 71560

SEQ ID NO: 247548 - RNA, 64 nt, hsa; identical to SEQ ID NO: 71561

SEQ ID NO: 247549 - RNA, 64 nt, hsa; identical to SEQ ID NO: 71562

SEQ ID NO: 247550 - RNA, 64 nt, hsa; identical to SEQ ID NO: 71563

SEQ ID NO: 247551 - RNA, 64 nt, hsa; identical to SEQ ID NO: 71564

SEQ ID NO: 247552 - RNA, 64 nt, hsa; identical to SEQ ID NO: 71565

SEQ ID NO: 247553 - RNA, 64 nt, hsa; identical to SEQ ID NO: 71566

SEQ ID NO: 247554 - RNA, 64 nt, hsa; identical to SEQ ID NO: 71567

SEQ ID NO: 247555 - RNA, 64 nt, hsa; identical to SEQ ID NO: 71568

SEQ ID NO: 247556 - RNA, 64 nt, hsa; identical to SEQ ID NO: 71569

SEQ ID NO: 247557 - RNA, 64 nt, hsa; identical to SEQ ID NO: 71570

SEQ ID NO: 247558 - RNA, 64 nt, hsa; identical to SEQ ID NO: 71571

SEQ ID NO: 247559 - RNA, 64 nt, hsa; identical to SEQ ID NO: 71572

SEQ ID NO: 247560 - RNA, 64 nt, hsa; identical to SEQ ID NO: 71573

SEQ ID NO: 247561 - RNA, 64 nt, hsa; identical to SEQ ID NO: 71574

SEQ ID NO: 247562 - RNA, 64 nt, hsa; identical to SEQ ID NO: 71575

SEQ ID NO: 247563 - RNA, 64 nt, hsa; identical to SEQ ID NO: 71576

SEQ ID NO: 247564 - RNA, 64 nt, hsa; identical to SEQ ID NO: 71577

SEQ ID NO: 247565 - RNA, 64 nt, hsa; identical to SEQ ID NO: 71578

SEQ ID NO: 247566 - RNA, 64 nt, hsa; identical to SEQ ID NO: 71579

SEQ ID NO: 247567 - RNA, 64 nt, hsa; identical to SEQ ID NO: 71580

SEQ ID NO: 247568 - RNA, 64 nt, hsa; identical to SEQ ID NO: 71581

SEQ ID NO: 247569 - RNA, 64 nt, hsa; identical to SEQ ID NO: 71582

SEQ ID NO: 247570 - RNA, 64 nt, hsa; identical to SEQ ID NO: 71583

SEQ ID NO: 247571 - RNA, 64 nt, hsa; identical to SEQ ID NO: 71579

SEQ ID NO: 247572 - RNA, 64 nt, hsa; identical to SEQ ID NO: 71585

SEQ ID NO: 247573 - RNA, 64 nt, hsa; identical to SEQ ID NO: 71581

SEQ ID NO: 247574 - RNA, 64 nt, hsa
uauuuaacagcugagcaaaaacauugagucgcucucaaaggacacgaggcccuuggcagggaau

SEQ ID NO: 247575 - RNA, 64 nt, hsa
uaacaagguaugcugccucuguaaauucauguauucaaaggaaaagacaccuugccuauaauua

SEQ ID NO: 247576 - RNA, 64 nt, hsa
auguaacauggaaaacaguaacuaaagauuaaauucaaaggacuuucagaaguuaagguuaagu

SEQ ID NO: 247577 - RNA, 64 nt, hsa
aaacuuagagaagaccaagggacaguauuuuuuaucaaaggaauacuauuuuuucacacuacgu

SEQ ID NO: 247578 - RNA, 64 nt, hsa
uauacaaauuuguuacaugucagugagaccuuuuucaaaggaacauauucaauuuggcuuuuug

SEQ ID NO: 247579 - RNA, 64 nt, hsa
gaguucugauaaaauauuuuuguauuuuguaauaucaaaggaauuucuauaucguaggacucag

SEQ ID NO: 247580 - RNA, 64 nt, hsa
caguuucccgccacuggguccaaggagccuuuguucaaaggaagaagugggccacggaagaacg

SEQ ID NO: 247581 - RNA, 64 nt, hsa
agcaggccucaagagccccuaauugucucaggguucaaaggaagacacugaccuuucccauccc

SEQ ID NO: 247582 - RNA, 64 nt, hsa
aaaggacugugauauaauccauuuauaucacaacucaaaggacugugauauaauccauuuauau

SEQ ID NO: 247583 - RNA, 64 nt, hsa
gacagcauaccauuaaauacauuuacaucacagcucaaaggacugugauauaauccauuuauau

SEQ ID NO: 247584 - RNA, 64 nt, hsa
cuuccuguucucuccagcccagcauacaggaggaucaaaggaggugacggagcaucguggcacg

SEQ ID NO: 247585 - RNA, 64 nt, hsa
cccagcuugccucccucccuggcuucucugacccucaaaggagaugccacgcaggacagacugg

SEQ ID NO: 247586 - RNA, 64 nt, hsa
cuuccucuugguucccagcugugacacguuuugaucaaaggagaaacaauaaagggauaaacca

SEQ ID NO: 247587 - RNA, 64 nt, hsa
gggaccaccccuuaccccggacaggaugaauggaucaaaggagugagguugcuaaagaacaucc

SEQ ID NO: 247588 - RNA, 64 nt, hsa
aauaacugccuguuuuccuaaaucaaacccauccucaaaggaugaagacucaccaccauccagg

SEQ ID NO: 247589 - RNA, 64 nt, hsa
gaagaaacucuaaauaguugaaaggcuaaccugcucaaaggauaccaaauaaugguuuaacugg

SEQ ID NO: 247590 - RNA, 64 nt, hsa
ggaauguacguaaaacaaaauagggcuuggcuggucaaaggagacaagcaggauggauggaugg

SEQ ID NO: 247591 - RNA, 64 nt, hsa
ccuguuccuccccgggacuccagaauuucucuccucaaaggaaagaaaacagggcaugcgcuug

SEQ ID NO: 247592 - RNA, 64 nt, hsa
uggggguaaggggaugacaugcccaggugucagcucaaaggaucucugcaucaucuugaggugg

SEQ ID NO: 247593 - RNA, 64 nt, hsa
ggaaagaaaaaaaaagccuuaguggccugguuguucaaaggauaagaauagcuuuauccugcac

SEQ ID NO: 247594 - RNA, 64 nt, hsa
uaaguuaaaugugggugucaaccaguggaaaagaucaaaggaccuuuugcagccuagcuugcca

SEQ ID NO: 247595 - RNA, 64 nt, hsa
aacuaccuaauuuucaagcauggaucuccauauuucaaaggaaaguuuuaaaaauguuuuuaaa

SEQ ID NO: 247596 - RNA, 64 nt, hsa
acuuaaaacgugugcauucuuacugaaaauguuuucaaaggaagguaucagcugugggcuaauu

SEQ ID NO: 247597 - RNA, 64 nt, hsa
gggaagcagcaggaaaugugcauguggguagagaucaaaggaggcaauggcuccaagccuugcc

SEQ ID NO: 247598 - RNA, 64 nt, hsa
gggcacaugacaucugccugggcccugaccaauaaacccucagacccaggacccaggacccugc

SEQ ID NO: 247599 - RNA, 64 nt, hsa
cggcacuggagcaagcuggggcgggggguggguaaacccucacugccagcaggccccaaguggc

SEQ ID NO: 247600 - RNA, 64 nt, hsa
agcuccucacuuuuuagcccuucugcaagagaaaaacccucauggguccacauggugagaaguu

SEQ ID NO: 247601 - RNA, 64 nt, hsa
cccuggaaaggaguugagggacaucagaugcuggaacccucacugaaaguccagaaugucuaag

SEQ ID NO: 247602 - RNA, 64 nt, hsa
ucuaagagcugagagacagccggcagggaaucggaacccucagacccacagccgcaaggcacug

SEQ ID NO: 247603 - RNA, 64 nt, hsa
cuccucuuuggggaucaccagcucugacuccaccaacccucauccaggaaucugccaugagucc

SEQ ID NO: 247604 - RNA, 64 nt, hsa
gggacauuaccaccaaccccacagaaauacgaaaaacccucaaagauuacuauaaacaccugua

SEQ ID NO: 247605 - RNA, 64 nt, hsa
uuuuuaauaaaauucaacaucccuucauuuuaaaaacccucaacaaauuacacauugagggaac

SEQ ID NO: 247606 - RNA, 64 nt, hsa
ccacucuccauucugugugaugaccacuuauuacaacccucagaauaggggacaguggugugcc

SEQ ID NO: 247607 - RNA, 64 nt, hsa
uucucauucgaaucuaccacaguuggucauauccaacccucauucaguauuucuaucaagaaag

SEQ ID NO: 247608 - RNA, 64 nt, hsa
guaaaaaaaucuuccuugucccugggcucuggccaacccucagaaacccucacaauaaaccaga

SEQ ID NO: 247609 - RNA, 64 nt, hsa
cuuccuugucccugggcucuggccaacccucagaaacccucacaauaaaccagaccagaaggau

SEQ ID NO: 247610 - RNA, 64 nt, hsa
cccaaacuuggaaacaagaacucuacuuuagccuaacccucauguccuuuuuugaauugagaaa

SEQ ID NO: 247611 - RNA, 64 nt, hsa
ugccuugugggcuacucagugcagaaccugcuguaacccucaguucaaaaaauggacuggcaau

SEQ ID NO: 247612 - RNA, 64 nt, hsa
uccucaccuugcugcuccccugcccuaaguccccaacccucaacuugaaaccccauucccuuaa

SEQ ID NO: 247613 - RNA, 64 nt, hsa
aucacuccaucccucuccuaccccucccucccccaacccucaauguauaaauugcuucuugaug

SEQ ID NO: 247614 - RNA, 64 nt, hsa; identical to SEQ ID NO: 24583

SEQ ID NO: 247615 - RNA, 64 nt, hsa; identical to SEQ ID NO: 24584

SEQ ID NO: 247616 - RNA, 64 nt, hsa; identical to SEQ ID NO: 24585

SEQ ID NO: 247617 - RNA, 64 nt, hsa; identical to SEQ ID NO: 24586

SEQ ID NO: 247618 - RNA, 64 nt, hsa; identical to SEQ ID NO: 24587

SEQ ID NO: 247619 - RNA, 64 nt, hsa; identical to SEQ ID NO: 24588

SEQ ID NO: 247620 - RNA, 63 nt, hsa
ggcagcaggcggugggaugcuuguagcuccucacagcaggauuccugcccacuguuuuuucuc

SEQ ID NO: 247621 - RNA, 63 nt, hsa
ggacacaauaugcccuuccgguucuauucaaaccagcaggaucugucggugcuuagagauggc

SEQ ID NO: 247622 - RNA, 63 nt, hsa
gcucacccauucauucacccaacuuccuucauucagcaggagguccuauuacccucuccagcu

SEQ ID NO: 247623 - RNA, 63 nt, hsa
cucugcugcauccaacaugggagcagagacuggcagcaggaggggggaacauggugagaagug

SEQ ID NO: 247624 - RNA, 63 nt, hsa
agacagucgugccauucacaaagucagaaaauacagcaggaagagacagcuuuuagaggggca

SEQ ID NO: 247625 - RNA, 63 nt, hsa
aaagugauggaaugacuucugcaacuguagucccagcaggaacugugaagaccagcugcccug

SEQ ID NO: 247626 - RNA, 63 nt, hsa
acugagguuggguaggugugggguuccagaggacagcaggacacucucgcauacuuugccaaa

SEQ ID NO: 247627 - RNA, 63 nt, hsa
agcccccagacucugugcacuucagaccagcagcagcaggagggcucccgagggccuuaugag

SEQ ID NO: 247628 - RNA, 63 nt, hsa
gggcgcugccuggggccugggucaagggccagucagcaggaggcugccggaacaacagcggcu

SEQ ID NO: 247629 - RNA, 63 nt, hsa
ggguucuuggagagucggccagacggcggggggcagcaggaacuuugccucauaccccaccaa

SEQ ID NO: 247630 - RNA, 63 nt, hsa
ucacaugugugugcacacucaugaguuuugucucagcaggauagaauaagcaaauccaugaac

SEQ ID NO: 247631 - RNA, 63 nt, hsa
uagaaagauaauauuucuccaauugggacuccccagcaggaauacuuagggauaaggaagaau

SEQ ID NO: 247632 - RNA, 63 nt, hsa
gaccugggggcccuugggugccagagugagacacagcaggacccuuccccaaauacuaggcuc

SEQ ID NO: 247633 - RNA, 63 nt, hsa
aauacuaggcucagagcaaccuccagccuucuccagcaggaucugcucccuguguccuuggac

SEQ ID NO: 247634 - RNA, 63 nt, hsa
caucccuuuuuuuccccaaggcacuuuaaaaaucagcaggacaacccugaggcaaacuggaag

SEQ ID NO: 247635 - RNA, 63 nt, hsa
agaaacaugauuuguucauuucugagucacaaacagcaggauaccucacagguaagccauacc

SEQ ID NO: 247636 - RNA, 63 nt, hsa
ccucagccucugcaaggcacucagggugggggacagcaggaucaagacaacccguuggagccc

SEQ ID NO: 247637 - RNA, 63 nt, hsa
guacugcagcuuccuccacagccggcuguggagcagcaggaccuggcccuucugccugggcag

SEQ ID NO: 247638 - RNA, 63 nt, hsa
ggauguagagaggcguuagugggcagguggccacagcaggacugaggacaggcccccauuauc

SEQ ID NO: 247639 - RNA, 63 nt, hsa
cccagccaggaccaccucguccucguggcggggcagcaggagcgguagaaagggguccgaugu

SEQ ID NO: 247640 - RNA, 63 nt, hsa
cccaucugcuggcaucaguaccugguguugggacagcaggauaggguucuaaaggugguuuuc

SEQ ID NO: 247641 - RNA, 63 nt, hsa
ggcccccaggaaucccuuccucccauguccuggcagcaggaccccaggcuacauauggaaggu

SEQ ID NO: 247642 - RNA, 63 nt, hsa
caugugcuggucucuguguguuuguguguuccucagcaggaaugagugucuuuguguaucacc

SEQ ID NO: 247643 - RNA, 63 nt, hsa
agaaauguugaaaagcuccuuggguucuccugacagcaggaaccacuggccuggcaccaccug

SEQ ID NO: 247644 - RNA, 63 nt, hsa
ucuuuugucauguauaacugagacacacaaacacagcaggagaaaucuaaaccguugugccuu

SEQ ID NO: 247645 - RNA, 63 nt, hsa
cuaguaugauuaguauagcuuucuccagcauggcagcaggaaguaacuacagggccucuuuua

SEQ ID NO: 247646 - RNA, 63 nt, hsa
cuccgaagagaguucuggaugucuggcucaaagcagcaggacugugggaaagagccuaacauc

SEQ ID NO: 247647 - RNA, 63 nt, hsa
cauguucccaaggccccacuuucaagaaucagacagcaggaagccauagaugcuggcuggguu

SEQ ID NO: 247648 - RNA, 63 nt, hsa
uugcuaacaaagcacuuuuggacaaugcuaucccagcaggaaaaaaaaggauaauauaacugu

SEQ ID NO: 247649 - RNA, 63 nt, hsa
gaguauuugaucccuagauaagaacaugcaaaucagcaggaacuggucauacaggguaagcac

SEQ ID NO: 247650 - RNA, 63 nt, hsa
ggguggccuucucaggacuccuggguggcacagcagcaggaccuugucaugggacugaugcug

SEQ ID NO: 247651 - RNA, 63 nt, hsa
ccaacagcaagggugacuccuggcaggugggggcagcaggagggcagagggcagagcucuggc

SEQ ID NO: 247652 - RNA, 63 nt, hsa
ugggcacaggagcucccagcuuuuguccacggccagcaggaugggcugucguguauauagcug

SEQ ID NO: 247653 - RNA, 63 nt, hsa
agccggcgccggacccgguaggggcagucugggcagcaggaaggaagggcgcagcguccccuc

SEQ ID NO: 247654 - RNA, 63 nt, hsa
ucucggaaaugagaaagcuggaauccugguccccagcaggagagccuaguccucccccagccc

SEQ ID NO: 247655 - RNA, 63 nt, hsa
ugcagcugccagauccacucacucugcugccuccagcaggacccaaggccacuuucaacucuu

SEQ ID NO: 247656 - RNA, 63 nt, hsa
agggaugagagaaaggaggugguauggaagacucagcaggaacaagguaggcuucaaagagcc

SEQ ID NO: 247657 - RNA, 63 nt, hsa
agugagggccccugcugggcccagccaccaggacagcaggaaccagggccuacuccucuuaug

SEQ ID NO: 247658 - RNA, 63 nt, hsa
ugucugcuccuacuccucacaucuggaggauuccagcaggagggguuuuggaggggaccugcu

SEQ ID NO: 247659 - RNA, 63 nt, hsa
uccaaauccagccauagauggcugcugggugugcagcaggagaaggaggauggucagccuugg

SEQ ID NO: 247660 - RNA, 63 nt, hsa
gcacugucuauauugcacugagagaggaagggacagcaggagugaggugaagagggcggagag

SEQ ID NO: 247661 - RNA, 63 nt, hsa
gaagccaguagagagaccaggagccaccucaaucagcaggacagccucacugccccucuugca

SEQ ID NO: 247662 - RNA, 63 nt, hsa
ucuggggagcuuccaagagcacccaccaagacacagcaggacaggccaggggagggcaucugg

SEQ ID NO: 247663 - RNA, 63 nt, hsa
cagaccacuugacucucuguaaaauggaccaaucagcaggauguggguggggcgagacaagag

SEQ ID NO: 247664 - RNA, 63 nt, hsa
ugugcccagcaguggcugcuggggaagcagcugcagcaggagggagacggucuugccucucag

SEQ ID NO: 247665 - RNA, 63 nt, hsa
cuuaggcugcgugggacaagggcuguguugucacagcaggaauagguuuuccucuguuggccu

SEQ ID NO: 247666 - RNA, 63 nt, hsa
cacagucucuauggugcugaggaagagcagcagcagcaggauggugaaguaguaaacuggggg

SEQ ID NO: 247667 - RNA, 63 nt, hsa
cucauuccuuaccccccagccccugcccaccuucagcaggaugaggcccuggguugccgugcu

SEQ ID NO: 247668 - RNA, 63 nt, hsa
cucccaggaggggugguagccguucccaccucgcagcaggacccccagugcagaggcucacag

SEQ ID NO: 247669 - RNA, 63 nt, hsa
uggguugagggggucugaccaggaggccaccuacagcaggaagugaggcugccauguuuccuu

SEQ ID NO: 247670 - RNA, 63 nt, hsa
cugguuggcguccacaagcaauaccucucguuccagcaggaccaagggagccagccuccagug

SEQ ID NO: 247671 - RNA, 63 nt, hsa
uuuuucgagcuauagggcaucagguggugggaacagcaggaaaaggcauuccagucugcccca

SEQ ID NO: 247672 - RNA, 63 nt, hsa
aauugugaagcccacagaugcgcacgcaaugaccagcaggaaccggaagcccugggucacccc

SEQ ID NO: 247673 - RNA, 63 nt, hsa
uugcucccuccccucucuuagagacugugccuucagcaggacucuuaauaucugcugcaacuu

SEQ ID NO: 247674 - RNA, 63 nt, hsa
cggcccaugcagaggugguagaaaggcuggacucagcaggaacaccaaaucccggaccaggca

SEQ ID NO: 247675 - RNA, 63 nt, hsa
accucgcagggcucagcagcacccggugaacagcagcaggaggagccgcuagagcagcugcuc

SEQ ID NO: 247676 - RNA, 63 nt, hsa
acgcuuucagcuugaggggagcucccacugccucagcaggagcaauucugcaucccuaauucu

SEQ ID NO: 247677 - RNA, 63 nt, hsa
cuaagaauuauuaaguuugacuuggaaguggagcagcaggacuuuguaguuguaugcuugauu

SEQ ID NO: 247678 - RNA, 63 nt, hsa
uuaaugcugcuuuugagcuucaagguaauaggacagcaggaaccuaaaauaucugccaucauc

SEQ ID NO: 247679 - RNA, 63 nt, hsa
ucagugacaccaucuuggaauaccuuugggaagcagcaggaaaugugcauguggguagagauc

SEQ ID NO: 247680 - RNA, 64 nt, hsa
ccaaauccagaggaagcaaggaggagggaggugggguagggaggaguguaggaugccuuguuuc

SEQ ID NO: 247681 - RNA, 64 nt, hsa
aacuguguaccugauuuguucucugaccuggcuagguagggagggggugguuaucgccccaaga

SEQ ID NO: 247682 - RNA, 64 nt, hsa
ccaugggggcagcugugccugugugggggaacaggguagggaaaucuccauaccuucucaauuu

SEQ ID NO: 247683 - RNA, 64 nt, hsa
cuggguucaaauuccaguucuaugcaccacuccagguagggauacccaugggggcagcugugcc

SEQ ID NO: 247684 - RNA, 64 nt, hsa
guuggauaccuguauucuugacaguuagaauauugguagggacuuuguuaaaauucacuugaau

SEQ ID NO: 247685 - RNA, 64 nt, hsa
agaggcagggcugagguggucuacgaauguggcagguagggaaggggagaugucugucucuuga

SEQ ID NO: 247686 - RNA, 64 nt, hsa
ucagucuauuccugucauagaugugggugucccugguagggaagugccuguguggucuguuuac

SEQ ID NO: 247687 - RNA, 64 nt, hsa
cugaguggcucuauggaugugguuguuuggaugugguagggagugcuuagcagaaugugugugu

SEQ ID NO: 247688 - RNA, 64 nt, hsa
ugagcuuuaaaaagaugaauagguguucucaggagguagggaucuggcugagagggaauaaucu

SEQ ID NO: 247689 - RNA, 64 nt, hsa
uugccagaaacuuaccauuaacuugcacuacuaggguagggaggacuuagggauguuuccugug

SEQ ID NO: 247690 - RNA, 64 nt, hsa
cuagguggauuuucucuucaugacaagaguauuugguagggaaagcagguuuaaaauaaaaaga

SEQ ID NO: 247691 - RNA, 64 nt, hsa
uugaagaagugggggcuggagcgggguugggggugguagggauagggcaugaucaaaggggcca

SEQ ID NO: 247692 - RNA, 64 nt, hsa
guggugcccagaauaaaauauaccucaugccuaggguagggacauccuuuccagcucaaacgug

SEQ ID NO: 247693 - RNA, 64 nt, hsa
cuaggguagggacauccuuuccagcucaaacguggguagggaugugggagaauaagaauguggg

SEQ ID NO: 247694 - RNA, 64 nt, hsa
cauagcagcagaggacugguguaagggagggagggguagggacagaagcuagacccaaucuccu

SEQ ID NO: 247695 - RNA, 64 nt, hsa
ggaagcaagugugggaugggucuuugccuuucuggguagggagcugucuaauccaagucccagg

SEQ ID NO: 247696 - RNA, 64 nt, hsa
uccaccuagagcaccaggaaacagcuuguacccugguagggaaaugguguugcugaaaggggag

SEQ ID NO: 247697 - RNA, 64 nt, hsa
aaaaguugagauuuagcucauggauauauuuuuugguagggaaacauuagggucuccuuuucuu

SEQ ID NO: 247698 - RNA, 64 nt, hsa; identical to SEQ ID NO: 189847

SEQ ID NO: 247699 - RNA, 64 nt, hsa; identical to SEQ ID NO: 189848

SEQ ID NO: 247700 - RNA, 64 nt, hsa; identical to SEQ ID NO: 189849

SEQ ID NO: 247701 - RNA, 64 nt, hsa; identical to SEQ ID NO: 189850

SEQ ID NO: 247702 - RNA, 64 nt, hsa; identical to SEQ ID NO: 189851

SEQ ID NO: 247703 - RNA, 64 nt, hsa; identical to SEQ ID NO: 189852

SEQ ID NO: 247704 - RNA, 64 nt, hsa; identical to SEQ ID NO: 189853

SEQ ID NO: 247705 - RNA, 64 nt, hsa; identical to SEQ ID NO: 189854

SEQ ID NO: 247706 - RNA, 64 nt, hsa; identical to SEQ ID NO: 189855

SEQ ID NO: 247707 - RNA, 64 nt, hsa; identical to SEQ ID NO: 189856

SEQ ID NO: 247708 - RNA, 64 nt, hsa; identical to SEQ ID NO: 189857

SEQ ID NO: 247709 - RNA, 64 nt, hsa; identical to SEQ ID NO: 189858

SEQ ID NO: 247710 - RNA, 64 nt, hsa; identical to SEQ ID NO: 189859

SEQ ID NO: 247711 - RNA, 64 nt, hsa; identical to SEQ ID NO: 189860

SEQ ID NO: 247712 - RNA, 64 nt, hsa; identical to SEQ ID NO: 189861

SEQ ID NO: 247713 - RNA, 64 nt, hsa; identical to SEQ ID NO: 189862

SEQ ID NO: 247714 - RNA, 64 nt, hsa; identical to SEQ ID NO: 189863

SEQ ID NO: 247715 - RNA, 64 nt, hsa; identical to SEQ ID NO: 189864

SEQ ID NO: 247716 - RNA, 64 nt, hsa; identical to SEQ ID NO: 189865

SEQ ID NO: 247717 - RNA, 64 nt, hsa; identical to SEQ ID NO: 189866

SEQ ID NO: 247718 - RNA, 64 nt, hsa; identical to SEQ ID NO: 189867

SEQ ID NO: 247719 - RNA, 64 nt, hsa; identical to SEQ ID NO: 189868

SEQ ID NO: 247720 - RNA, 64 nt, hsa
ccucauagcucagaucuccuuucaaaguaguggcuuucuggaugguaauuccaucuuaaggugu

SEQ ID NO: 247721 - RNA, 64 nt, hsa
ucuguucucuaauagaagccuuucuuuuccauuguuucuggauauuuguauuauccaaaugugc

SEQ ID NO: 247722 - RNA, 64 nt, hsa
uucuuuaagagcuaacaagagaagagaguccaguuuucuggaaauaugucuuuaaguauuuuag

SEQ ID NO: 247723 - RNA, 64 nt, hsa
uaaaacaucacaaaaaaaauugcaguacauaaaauuucuggacuauguuaguuacuugaucugg

SEQ ID NO: 247724 - RNA, 64 nt, hsa
uucacugcuguuaacaguaaugugucccuuucauuuucuggaucaagccuucucagcggugggu

SEQ ID NO: 247725 - RNA, 64 nt, hsa
caaacaguuccucuuauuuugucuuuugcaccaguuucuggaggcccuugucauuucaaaaagg

SEQ ID NO: 247726 - RNA, 64 nt, hsa
gggcacaucuggaugccuucccccaguauguccuuuucuggauuaaaaugagugaaauuuaaac

SEQ ID NO: 247727 - RNA, 64 nt, hsa
aaacauuaccuaaauaggcuggcaagauaaacacuuucuggaacccgagacuuggccauaaaga

SEQ ID NO: 247728 - RNA, 64 nt, hsa
guaaccuucuccuuuacuauguugaauguauuuuuuucuggacaagcuuacaucuuccucagcc

SEQ ID NO: 247729 - RNA, 64 nt, hsa
acauuuucaauagaggauacaacaucacagaaucuuucuggaugauucuguguuaucaaggaau

SEQ ID NO: 247730 - RNA, 64 nt, hsa
uuaguaacucaguaagaacaugccugcgacucccuuucuggauggaaccugggcuguggcucuc

SEQ ID NO: 247731 - RNA, 64 nt, hsa
uggugcugugauggugucuacuguuagaauagcuuuucuggagguggguggcaacuccacgcgg

SEQ ID NO: 247732 - RNA, 64 nt, hsa
ccccuacuaaacucuuaagccuccccuuccagucuuucuggacagcuauuaagcacuugcagcc

SEQ ID NO: 247733 - RNA, 64 nt, hsa
auccgcuguuugagcccaacacuuuaauuuauucuuucuggacacuggagucacuaacuggcgu

SEQ ID NO: 247734 - RNA, 64 nt, hsa
accaugccuaggacucaccccauuuauccaggucuuucuggaucuguuuaaucaauaagcccua

SEQ ID NO: 247735 - RNA, 64 nt, hsa
auuccugucccaagccacccaaauucucagaucuuuucuggaacaaggcagaauauaaaauaaa

SEQ ID NO: 247736 - RNA, 64 nt, hsa
aagagaaauuugagaggaaaaguggaagaaguguuuucuggagcagaagauuccacuucuuugg

SEQ ID NO: 247737 - RNA, 64 nt, hsa
cuaauauucuucacauuaaacuauggacucuaauuuucuggauaaaauauccugccuuauggaa

SEQ ID NO: 247738 - RNA, 64 nt, hsa
uuugguuuccaggaauuuuuuucaaauggggcuguuucuggaaaaaugaaaaauucuauuggac

SEQ ID NO: 247739 - RNA, 64 nt, hsa
agaaguaauacuuuauucucuaauguuaauagcuuuucuggaucucuuaguagggggaaaguag

SEQ ID NO: 247740 - RNA, 64 nt, hsa
guuuguauaagaauaacaaucugcuagucugucauuucuggagugauacuuuuuuuuuugagac

SEQ ID NO: 247741 - RNA, 64 nt, hsa
uaaaucuuuggcagaggcaggaguaaggaagccauuucuggaguccuugcuacuaauuuggaaa

SEQ ID NO: 247742 - RNA, 64 nt, hsa
uuuaaguagaaccuaggguuucuaauugacuugauuucuggaaaugaaaacccgcgcuuuuauu

SEQ ID NO: 247743 - RNA, 64 nt, hsa
cugauuuuuguugauaacacaaaaaacacuauguuuucuggagagcuguguaagcugucuuguu

SEQ ID NO: 247744 - RNA, 64 nt, hsa
cagaacuagaauacuuuuuaaggaauuaaaaguguuucuggaagucaaaaaugggaaagcaaaa

SEQ ID NO: 247745 - RNA, 64 nt, hsa
ugaaauuguacaugcaaauugguacauaugcauuuuucuggagagagccugugaaacugaacag

SEQ ID NO: 247746 - RNA, 64 nt, hsa
gccaacgggauggccuuggguacaucacucagccuuucuggacccaauuuuuccccagugaaag

SEQ ID NO: 247747 - RNA, 64 nt, hsa
aauuuuuccccagugaaagccaaguuggacugaauuucuggaguucucaucagugcacauucca

SEQ ID NO: 247748 - RNA, 64 nt, hsa
ugaggggcuuuguuugggccacugccagcagcuguuucuggaaauggcuguaggugguguugag

SEQ ID NO: 247749 - RNA, 64 nt, hsa
gaggcuggcaaggaguucguggcugcaaaagaaguuucuggagcaagagagagcucgcucuugg

SEQ ID NO: 247750 - RNA, 64 nt, hsa
aagaauuccucucugcccagaugguagguugauauuucuggacucuagccaagaaaaagcuaau

SEQ ID NO: 247751 - RNA, 64 nt, hsa
gaaaggaagaagccugagauuugauccuugacaauuucuggaaagcacuggucagucacacugu

SEQ ID NO: 247752 - RNA, 64 nt, hsa
aaucuuauaucuuaucuaugcuauuuaggacuacuuucuggagcuuggcagauuuuccucugac

SEQ ID NO: 247753 - RNA, 64 nt, hsa
gaauuauugggucuuucauaaauaacaugagugguuucuggagacauuuaagauugucagcaaa

SEQ ID NO: 247754 - RNA, 64 nt, hsa
uacauauuuuucuaaguuuccccccuaguuucacuuucuggaaagugaacaguuuuuuaaaucc

SEQ ID NO: 247755 - RNA, 64 nt, hsa
augauaaggguauucaauaauugggugcccuaaauuucuggaugagaaaauuuucaauucuggc

SEQ ID NO: 247756 - RNA, 64 nt, hsa
acaaaauguuuagauucuguagguguuaaaagccuuucuggaaguauugcauucugccguguuu

SEQ ID NO: 247757 - RNA, 64 nt, hsa
uauacaauauagaguaugcacauuugggacugcauuucuggaaacauacugcaauaggcucucu

SEQ ID NO: 247758 - RNA, 64 nt, hsa
acaguaagauguguggguuuuucuguauuuuucuuuucuggaacagugggaauuaaggcuacug

SEQ ID NO: 247759 - RNA, 64 nt, hsa
caccccuaccccguggcagcagcauaccucugcauuucuggaaugugugugcaucaaugauguu

SEQ ID NO: 247760 - RNA, 64 nt, hsa
ccucuuuagggggccagacaagaaaggccuacgguuucuggagcaaaccugucccccaccugug

SEQ ID NO: 247761 - RNA, 64 nt, hsa
ugacucaacauguuacugaccagcaacuugucuuuuucuggacugaagccugcaggaguuaaaa

SEQ ID NO: 247762 - RNA, 64 nt, hsa
aacuguguggacugugaugccacacagaguggucuuucuggagagguuauaggucacuccuggg

SEQ ID NO: 247763 - RNA, 64 nt, hsa
uucaaucuacucaugauguguuaugcauaaaacauuucuggaacauggauuuguguucaccuua

SEQ ID NO: 247764 - RNA, 64 nt, hsa
uaaauccuauuuucuauggaagacugguaccugguuucuggaagaggggucugugacuuggagc

SEQ ID NO: 247765 - RNA, 64 nt, hsa
guagcaagaaguuucugugagcccaaaauguuauuuucuggagcucuuguuugugggguaucuu

SEQ ID NO: 247766 - RNA, 64 nt, hsa
auuacuuuuuuuccguugcggguuuuuuuuuuuuuuucuggaguagggugggggcgggguggga

SEQ ID NO: 247767 - RNA, 64 nt, hsa
auaaaggauuauuugcucaggggaaccauggggcuuucuggaguuguggugaggccaccaggcu

SEQ ID NO: 247768 - RNA, 64 nt, hsa
gaagcuugucacuggaagaucuuaagguauauauuuucuggacacucaaacacaucauaaugga

SEQ ID NO: 247769 - RNA, 64 nt, hsa
cacccaggaaacccuugguccagagaggacaggcuuucuggaggaaucaggcccugggacagcc

SEQ ID NO: 247770 - RNA, 64 nt, hsa
cuguagauuuauucugcccacaacuuggggguccuuucuggaucucggcuucuccagcuguaaa

SEQ ID NO: 247771 - RNA, 64 nt, hsa
uuuccugagaggcaggucuuccguccucagagccuuucuggaacaaggagaaugccugugcagg

SEQ ID NO: 247772 - RNA, 64 nt, hsa
ccuagcugauuguuguggucaaugaaauacccaguuucuggagggccaggugggaaaugcuuuc

SEQ ID NO: 247773 - RNA, 64 nt, hsa
guuucaaacauuucuggacaaaucuuauuuuguauuucuggaagaauguaguaaucuucuagac

SEQ ID NO: 247774 - RNA, 64 nt, hsa
ccauuacaacuuuugugaggauguguuucaaacauuucuggacaaaucuuauuuuguauuucug

SEQ ID NO: 247775 - RNA, 64 nt, hsa
uaggucauuaaguagcacacagucugaaugcccuuuucuggaguggccaguuccuaucagacug

SEQ ID NO: 247776 - RNA, 64 nt, hsa
cuccccagguccugggaguggcuaccgcagguaguuucuggagagcacguuuucuucauugaua

SEQ ID NO: 247777 - RNA, 64 nt, hsa
cugaccaccccccugacccccgccauuacuuucuuuucuggagugccaugcuggcgaggauccg

SEQ ID NO: 247778 - RNA, 64 nt, hsa
cucaccugcuugccaagguacgucuggguaguaguuucuggaaaugacugcagacugugccaaa

SEQ ID NO: 247779 - RNA, 64 nt, hsa
cccaagaggcucuucagagaucauggaugcucucuuucuggaagcuguggccugauggagcagc

SEQ ID NO: 247780 - RNA, 64 nt, hsa
agcaauaucccaaguucuugugacugagggagauuuucuggaagggccacaggagguugcggag

SEQ ID NO: 247781 - RNA, 64 nt, hsa
aagagccuuaaccuuuuguacuggaaggaaauauuuucuggacuuaaguaguugccuaaauuua

SEQ ID NO: 247782 - RNA, 64 nt, hsa
uguauucaaagcuuacuagacgaacaaucuuucauuucuggauauauuguagcuaacccaacac

SEQ ID NO: 247783 - RNA, 64 nt, hsa
ucugcaggugggcugcugagggucugggaucuguuuucuggaagugugcagguauaaacacacc

SEQ ID NO: 247784 - RNA, 64 nt, hsa
uccagagcaagcauucaccaaguccccuucuguguuucuggagugauucuagagggagacuugu

SEQ ID NO: 247785 - RNA, 64 nt, hsa
auucuaguugggagaguuggagagaagggggacguuucuggaacugucugaauauucuagaacu

SEQ ID NO: 247786 - RNA, 64 nt, hsa
ucacaagaucuguuagaaauggaauuuuucucuuuuucuggagauaguuuucacuuuuaguugg

SEQ ID NO: 247787 - RNA, 64 nt, hsa
gggucuguaggcaucacauugugaggaagggagcuuucuggaaguacuugcuucauguauggau

SEQ ID NO: 247788 - RNA, 64 nt, hsa
augagagaauacuguaauaauaucaaaagcacuuuuucuggaaacacauuuauggcuuuuauaa

SEQ ID NO: 247789 - RNA, 64 nt, hsa
uuauauugucauagugguuuuuauuccugcuuuguuucuggaaaggaaauccugaauuacuuaa

SEQ ID NO: 247790 - RNA, 64 nt, hsa
agcaagccuacucugacuucugacuuguuuuuguuuucuggauuuuuagcuguagguauucagc

SEQ ID NO: 247791 - RNA, 64 nt, hsa
gggggguauacauuagacauaucagagcaguguauuucuggaucauuuuuuaaaugaccucuuc

SEQ ID NO: 247792 - RNA, 64 nt, hsa
uccggaagacauggauugucuggaagauguggauuuucuggaagcucaggauuaucuggaagac

SEQ ID NO: 247793 - RNA, 64 nt, hsa
cuggaagacuuggauuugguggaagacacagauuuuucuggaagacauggauuagcuggaagau

SEQ ID NO: 247794 - RNA, 53 nt, hsa
ugauugacuggaagaucuagauuuuucuggaagaacuagauuuacuggaagac

SEQ ID NO: 247795 - RNA, 64 nt, hsa
cagccuccugaguagcugggauuacaggcguccgcuaccacaacuggcuaauuuuuacauuuuu

SEQ ID NO: 247796 - RNA, 64 nt, hsa
ggaagagaaaagguaccugaggaugcagaaguaccuaccacaugggaaccguuuguccacacuc

SEQ ID NO: 247797 - RNA, 64 nt, hsa; identical to SEQ ID NO: 60375

SEQ ID NO: 247798 - RNA, 64 nt, hsa; identical to SEQ ID NO: 60376

SEQ ID NO: 247799 - RNA, 64 nt, hsa; identical to SEQ ID NO: 60377

SEQ ID NO: 247800 - RNA, 64 nt, hsa; identical to SEQ ID NO: 60378

SEQ ID NO: 247801 - RNA, 64 nt, hsa; identical to SEQ ID NO: 60379

SEQ ID NO: 247802 - RNA, 64 nt, hsa; identical to SEQ ID NO: 60380

SEQ ID NO: 247803 - RNA, 64 nt, hsa; identical to SEQ ID NO: 60381

SEQ ID NO: 247804 - RNA, 64 nt, hsa; identical to SEQ ID NO: 60382

SEQ ID NO: 247805 - RNA, 64 nt, hsa; identical to SEQ ID NO: 60383

SEQ ID NO: 247806 - RNA, 64 nt, hsa; identical to SEQ ID NO: 60384

SEQ ID NO: 247807 - RNA, 64 nt, hsa; identical to SEQ ID NO: 60385

SEQ ID NO: 247808 - RNA, 64 nt, hsa; identical to SEQ ID NO: 60386

SEQ ID NO: 247809 - RNA, 64 nt, hsa; identical to SEQ ID NO: 60387

SEQ ID NO: 247810 - RNA, 64 nt, hsa; identical to SEQ ID NO: 60388

SEQ ID NO: 247811 - RNA, 64 nt, hsa; identical to SEQ ID NO: 60389

SEQ ID NO: 247812 - RNA, 64 nt, hsa; identical to SEQ ID NO: 60390

SEQ ID NO: 247813 - RNA, 64 nt, hsa; identical to SEQ ID NO: 60391

SEQ ID NO: 247814 - RNA, 64 nt, hsa; identical to SEQ ID NO: 60392

SEQ ID NO: 247815 - RNA, 64 nt, hsa; identical to SEQ ID NO: 60393

SEQ ID NO: 247816 - RNA, 64 nt, hsa; identical to SEQ ID NO: 60394

SEQ ID NO: 247817 - RNA, 64 nt, hsa; identical to SEQ ID NO: 60395

SEQ ID NO: 247818 - RNA, 64 nt, hsa; identical to SEQ ID NO: 60396

SEQ ID NO: 247819 - RNA, 64 nt, hsa; identical to SEQ ID NO: 60397

SEQ ID NO: 247820 - RNA, 63 nt, hsa
ugagaccagccuggccaaauggugaaaccccaucucuacgaaaaauacaaaauuuagccgggc

SEQ ID NO: 247821 - RNA, 63 nt, hsa
ucgccagccaugaugcugcagccgggcccgcagcucuacgacgugauggacgcggucccagcg

SEQ ID NO: 247822 - RNA, 63 nt, hsa
auaaguagcauugcugaaacacacaaccgaauucucuacgauggccauuugcucauugucuuu

SEQ ID NO: 247823 - RNA, 63 nt, hsa
acuugcccugacgaguaugaagacccagcaguccucuacgaggccauccaguccuucgagaag

SEQ ID NO: 247824 - RNA, 63 nt, hsa
ccacggguucccacgcugcugugacugcccugccucuacgacaaaagccaacgggucuucagu

SEQ ID NO: 247825 - RNA, 63 nt, hsa
cugguagagaggacgaauguuccacaccauggucucuacgaaaaagaaauaguuagucaccuu

SEQ ID NO: 247826 - RNA, 63 nt, hsa
acauuaaguauuaaugaggggaaaggaaaugagcucuacgaggauuucacccugcaugggaga

SEQ ID NO: 247827 - RNA, 63 nt, hsa
guagagcaaaacuauagguuuugguuccacaaucucuacgacuaaucaccuacucaaugccug

SEQ ID NO: 247828 - RNA, 63 nt, hsa
cucguuucccuuuuccucuagaagcagaaccagcucuacgagagugagacugggaacuugaug

SEQ ID NO: 247829 - RNA, 63 nt, hsa
uguuuccuaacgccauuggaggccuucaucccucucuacgauaagguugcagaaaugggaaga

SEQ ID NO: 247830 - RNA, 62 nt, hsa
aguguugccugcagaaauaaaaugcagaacguacucuacgauagaucacaguuuuuuauucu

SEQ ID NO: 247831 - RNA, 63 nt, hsa
cgagaccacccuggccaacaugcgaaaccccaucucuacgaaaaauagaaauauuagccgggc

SEQ ID NO: 247832 - RNA, 63 nt, hsa
uaaaauggaacaaauaauaucuccuuaagauugcucuacgaauuaauugacacauuaugugug

SEQ ID NO: 247833 - RNA, 63 nt, hsa
gugcacuguuguaaagcugaaaaaccguuaagccucuacgauuuuuaaguaaguuggggacca

SEQ ID NO: 247834 - RNA, 63 nt, hsa
aguuugcagccgaguagggacuccuccccuguccucuacgaaggaaaagauugcuauugucgu

SEQ ID NO: 247835 - RNA, 63 nt, hsa
uucgaaaccggggcccagguugcaccugggauucucuacgaaauucaguaggagagaagaucc

SEQ ID NO: 247836 - RNA, 63 nt, hsa
uuaagccuuauccagcagccauaauuugaauaacucuacgagaccagagagacuguaguuccc

SEQ ID NO: 247837 - RNA, 63 nt, hsa
caaauguguaccuggaccccucgaaacagaggacucuacgaaaugacaagcugccccugcccu

SEQ ID NO: 247838 - RNA, 63 nt, hsa
guuugagaccagccugacauggugaaaccccaucucuacgaaaaauacaaaaauuagcugggc

SEQ ID NO: 247839 - RNA, 63 nt, hsa
ucuuugggcggcaggugcgguccccacggccggcucuacgaggaagaguucuggcucuuuugu

SEQ ID NO: 247840 - RNA, 63 nt, hsa
ccugcucacucugggguuggggguccagcugcccucuacgaucaggugcaggggcugcccagg

SEQ ID NO: 247841 - RNA, 63 nt, hsa
guuuauuuuguuucugucuaugucacaguguuccucuacgacccgaccucucuauguaagcac

SEQ ID NO: 247842 - RNA, 63 nt, hsa
auuugguguuggagguggguuucucaccuggggcucuacgagauguugcuggggcuccaccuu

SEQ ID NO: 247843 - RNA, 63 nt, hsa
gugauaacuguaugggcuaucaauauccauucacucuacgaguugugcagaaagaugggaacu

SEQ ID NO: 247844 - RNA, 63 nt, hsa
cuugaccaaagcugcuguguggcagcucggccucucuacgaccccaucuugguggcugcacac

SEQ ID NO: 247845 - RNA, 63 nt, hsa
ggaagggagggucagggaagaaacccacucuugcucuacgaggagcaagugccugcccccucc

SEQ ID NO: 247846 - RNA, 63 nt, hsa
uucaaccagguguugaaggcacgacagccacugcucuacgaaaaggcagaguacguuuuuccc

SEQ ID NO: 247847 - RNA, 63 nt, hsa
gagaucaaccugggcaagagagugagacccugacucuacgaaaauuaaaaguuagcccggugu

SEQ ID NO: 247848 - RNA, 63 nt, hsa
cacucuguuaauaagaaacccuaagccaagacccucuacgaacauucuuugggccuccuggac

SEQ ID NO: 247849 - RNA, 63 nt, hsa
cugugacuuuuuuugcugagcagccugggaucgcucuacgaauuacacaggaagcgggauucg

SEQ ID NO: 247850 - RNA, 63 nt, hsa
augaggucugcugccaggugugaacaagcaugucucuacgaaugaacgaaacauuggggaucu

SEQ ID NO: 247851 - RNA, 63 nt, hsa
gccaacugaggcauauuuccuagaucauuuugccucuacgauguuuuuucuugguccaccuuu

SEQ ID NO: 247852 - RNA, 63 nt, hsa
uucagagaagagaacccucaccucugaucuggccucuacgagagguccucaucuccaucuggc

SEQ ID NO: 247853 - RNA, 64 nt, hsa; identical to SEQ ID NO: 125388

SEQ ID NO: 247854 - RNA, 64 nt, hsa; identical to SEQ ID NO: 125389

SEQ ID NO: 247855 - RNA, 64 nt, hsa; identical to SEQ ID NO: 125390

SEQ ID NO: 247856 - RNA, 64 nt, hsa; identical to SEQ ID NO: 125391

SEQ ID NO: 247857 - RNA, 64 nt, hsa; identical to SEQ ID NO: 125392

SEQ ID NO: 247858 - RNA, 64 nt, hsa; identical to SEQ ID NO: 125393

SEQ ID NO: 247859 - RNA, 64 nt, hsa; identical to SEQ ID NO: 125394

SEQ ID NO: 247860 - RNA, 64 nt, hsa; identical to SEQ ID NO: 125395

SEQ ID NO: 247861 - RNA, 64 nt, hsa; identical to SEQ ID NO: 125396

SEQ ID NO: 247862 - RNA, 64 nt, hsa; identical to SEQ ID NO: 125397

SEQ ID NO: 247863 - RNA, 64 nt, hsa; identical to SEQ ID NO: 125398

SEQ ID NO: 247864 - RNA, 64 nt, hsa; identical to SEQ ID NO: 125399

SEQ ID NO: 247865 - RNA, 64 nt, hsa; identical to SEQ ID NO: 125400

SEQ ID NO: 247866 - RNA, 64 nt, hsa; identical to SEQ ID NO: 125401

SEQ ID NO: 247867 - RNA, 62 nt, hsa
gcugcguccugcacccuccugggcccaccuccgauucacagagguuucagggggacccaaau

SEQ ID NO: 247868 - RNA, 62 nt, hsa
ugccuccaaacauuuuucuguacucauacuuagauucacaaugguuguguaucucuauaaug

SEQ ID NO: 247869 - RNA, 62 nt, hsa
aauucagcauguuggucagagacacggucacugauucacacccagucccugccacagaccgu

SEQ ID NO: 247870 - RNA, 62 nt, hsa
cgucucagacacgcacagugggccugcugcaugauucacacccagucccugccacagaccgu

SEQ ID NO: 247871 - RNA, 62 nt, hsa; identical to SEQ ID NO: 247870

SEQ ID NO: 247872 - RNA, 62 nt, hsa
auuggggcaauuaccuuuugauccucaauacugauucacaauugaguuaaauuagacaacug

SEQ ID NO: 247873 - RNA, 62 nt, hsa
ggguggguaguguaaauacacaagaaaaggaugauucacaucccaugugggauggagcagaa

SEQ ID NO: 247874 - RNA, 62 nt, hsa
cagagaaccaucccuauuuuguauugaagagggauucacaucugcaucuuaacugcucuuua

SEQ ID NO: 247875 - RNA, 62 nt, hsa
gccuguuuugucuuuuguuguuguucaaacgggauucacagaguauuugaaaaauguauaua

SEQ ID NO: 247876 - RNA, 62 nt, hsa
uaguuaagauucacaaucuuuagaaagaaugagauucacaauaauuaacucuuccucucuuc

SEQ ID NO: 247877 - RNA, 62 nt, hsa
uuauuuuccgucaggugccaggucuuaguuaagauucacaaucuuuagaaagaaugagauuc

SEQ ID NO: 247878 - RNA, 64 nt, hsa
ucaauagaagcagaguauucguuuuacucaauugguccccuacugaugggcauuuguugccauu

SEQ ID NO: 247879 - RNA, 64 nt, hsa
ccuaugucaaaaaagaaauaaaaagaaaguaaaaguccccuagugauagccacuauucacagcu

SEQ ID NO: 247880 - RNA, 64 nt, hsa
ccucuuccucuccucuguggcuuuuccuguuauuguccccuaaugauaggauauucccugcugc

SEQ ID NO: 247881 - RNA, 64 nt, hsa
uugggauuuccuucucccuuucccugcccacccuguccccuacaauuugugcuucugaguugag

SEQ ID NO: 247882 - RNA, 64 nt, hsa
auggaaagaauaaaagcauguacuucacagcuagcauguucacagauuugaaagaaguuucauu

SEQ ID NO: 247883 - RNA, 64 nt, hsa
guauaaauacauaacuuccuaaccagguguagggcauguucaugaauaucaaaucuuuugaugc

SEQ ID NO: 247884 - RNA, 64 nt, hsa
aaaaaccaucaccucccauucccaggggcaucaucauguucaacaaggcauggaggcagggcca

SEQ ID NO: 247885 - RNA, 64 nt, hsa
uuauguauaauggacagaggaaacugacauuugucauguucacuuaccugcugauggaauccag

SEQ ID NO: 247886 - RNA, 64 nt, hsa
gagccugccuuuccuaucuucacaccugccaccucauguucacaccuaucuuucucaccuuuuu

SEQ ID NO: 247887 - RNA, 64 nt, hsa
acaucuguuuucacaccuucaucccugucuuccucauguucacacuugucuuccccauguucau

SEQ ID NO: 247888 - RNA, 64 nt, hsa
ucccugucuuccucauguucacacuugucuuccccauguucauagcugccuuucuuaccauuuu

SEQ ID NO: 247889 - RNA, 64 nt, hsa
cgccugaagcuuaaccaagagugagaggauaugucauguucacacucaaugcaauucguagugg

SEQ ID NO: 247890 - RNA, 64 nt, hsa
ccacauuuucaauccuccuucacugucuuccuaccauguucagcccagacuccugccacaugga

SEQ ID NO: 247891 - RNA, 64 nt, hsa
ugagacacaggcaucaacacucucaaaugauucacauguucagccaaaguugagaaccaucgag

SEQ ID NO: 247892 - RNA, 64 nt, hsa
agcuaccguuaaaugaggacaaaucaccuuaaaacauguucauuugauucauaacaaggaaaau

SEQ ID NO: 247893 - RNA, 64 nt, hsa
auaaaucacuuaucaaaaugugaacuguuuuccucauguucaguuauguuaaaguaguaugaua

SEQ ID NO: 247894 - RNA, 64 nt, hsa
uuugggugaggaaauuguucucuuaaagaucagccauguucaggaaaugaucucuguuugaacc

SEQ ID NO: 247895 - RNA, 64 nt, hsa
uuuacuucauuuuccuuuaauaacuuaaucucuucauguucaguuuuuacuucacucuuuauuc

SEQ ID NO: 247896 - RNA, 64 nt, hsa
agaugagaugucugacuugcuuucacuuauuaaacauguucaccaugggaugaugucuguaaca

SEQ ID NO: 247897 - RNA, 64 nt, hsa
cauguguacacacgcuuuucccguaugcuuucuucauguucagucacaugugcucucgggugcc

SEQ ID NO: 247898 - RNA, 64 nt, hsa
uccugggccugggcuuuagucugggcuacgguuccauguucaccaagauuugguggguccacac

SEQ ID NO: 247899 - RNA, 64 nt, hsa
uucuguuuaaauuuguacuguggcuuauguuacacauguucauguucaccucucauucaccugu

SEQ ID NO: 247900 - RNA, 64 nt, hsa
uuaaauuuguacuguggcuuauguuacacauguucauguucaccucucauucaccuguuuuaua

SEQ ID NO: 247901 - RNA, 64 nt, hsa
cagcucugagauuagcaaaagccagggacagcuacauguucagguuuuuuuuuuuuuuuuuuuu

SEQ ID NO: 247902 - RNA, 64 nt, hsa
ucuuuucagauucacguucucuaacaaagagucucauguucaagaucaauaugucuaauaagug

SEQ ID NO: 247903 - RNA, 64 nt, hsa
uuuuaccguccccagccccccucccacauggucacauguucacuugcuuuuccuuccaucuguu

SEQ ID NO: 247904 - RNA, 64 nt, hsa
auuuaacagaaugauugauuuuucuuucaaucagcauguucaccaaaaauagaaaaguucuucu

SEQ ID NO: 247905 - RNA, 64 nt, hsa
ucauauaucugcugaaauuccccaucuuuucaugcauguucauguuuuccccuuuacccuuugu

SEQ ID NO: 247906 - RNA, 64 nt, hsa
uagugaauagaaugaggcagagguaaugggaugucauguucaagauugguuacaaaaagacugu

SEQ ID NO: 247907 - RNA, 64 nt, hsa
aggcagguuagcuagcccacccugugcuaguuuucauguucacacugacccuauuugaauuaau

SEQ ID NO: 247908 - RNA, 64 nt, hsa
aagauagaaagcauucaggaugucccaguuaucacauguucacacuuggguuuagggguguuuu

SEQ ID NO: 247909 - RNA, 64 nt, hsa
acgcaccucccagaggaccggugggaauuguucauagugccaaaguccuacuacugcguuuuca

SEQ ID NO: 247910 - RNA, 64 nt, hsa
uguuuuauuaauuuggggaaagggguguuagcauuagugccaugauaucuacuggauuuuaagu

SEQ ID NO: 247911 - RNA, 64 nt, hsa
aaaauaagaucgaugguaucuuguaaaaugaggguagugccacuucuuaguauuuuugaaagcu

SEQ ID NO: 247912 - RNA, 64 nt, hsa
uccucuucauuuguucuuuaugagaaaacccggguagugccagcaccuggauacaguauuuaca

SEQ ID NO: 247913 - RNA, 64 nt, hsa; identical to SEQ ID NO: 99488

SEQ ID NO: 247914 - RNA, 64 nt, hsa; identical to SEQ ID NO: 99489

SEQ ID NO: 247915 - RNA, 64 nt, hsa; identical to SEQ ID NO: 99490

SEQ ID NO: 247916 - RNA, 64 nt, hsa; identical to SEQ ID NO: 99491

SEQ ID NO: 247917 - RNA, 64 nt, hsa; identical to SEQ ID NO: 99492

SEQ ID NO: 247918 - RNA, 64 nt, hsa; identical to SEQ ID NO: 99493

SEQ ID NO: 247919 - RNA, 64 nt, hsa; identical to SEQ ID NO: 99494

SEQ ID NO: 247920 - RNA, 64 nt, hsa; identical to SEQ ID NO: 99495

SEQ ID NO: 247921 - RNA, 64 nt, hsa
aguagaaaaaucuguugccugauauacauaacaccaaucagaccguguggauuuuucucugaau

SEQ ID NO: 247922 - RNA, 64 nt, hsa
uagcaaucugccacaacugccagaugaaaagcaacaaucagaguagaaaaaucuguugccugau

SEQ ID NO: 247923 - RNA, 64 nt, hsa
uggccaaggggugggccugugaaucaauccugggcaaucagacacccucuccuuaaaaacuggc

SEQ ID NO: 247924 - RNA, 64 nt, hsa
aauggccuggagggacuuuuaaucagugaagaugcaaucagacaaguguuuuggaaagagcacc

SEQ ID NO: 247925 - RNA, 64 nt, hsa
caaucagaccuucucccugaacuuaagauagccacaaucagaaaaaggacaaggacaugagaca

SEQ ID NO: 247926 - RNA, 64 nt, hsa
aguuucugggguuaagcacuaaggacacaagaaucaaucagaccuucucccugaacuuaagaua

SEQ ID NO: 247927 - RNA, 64 nt, hsa
ucuagcggcuaaguaccuccuacacauuucccaucaaucagaaaauagacagguacacuaaagg

SEQ ID NO: 247928 - RNA, 64 nt, hsa
gaucgaauuuaauuuccuuucccucauucugcagcaaucagaauacacaaucuuaaccacucgg

SEQ ID NO: 247929 - RNA, 61 nt, hsa
ccacuaagaaggccugucuacacugcaggggaaccucaagaacuuuucauugcacuucuaa

SEQ ID NO: 247930 - RNA, 61 nt, hsa
auaucacugacucuugaaaucacuaacagugaaccucaaauuugguuaugauguuaacaga

SEQ ID NO: 247931 - RNA, 61 nt, hsa
caaaaggaagagccuuuuaaaaacauuugccaaccucaagaauaaauacugaaagucuuga

SEQ ID NO: 247932 - RNA, 61 nt, hsa
uuuuuuaacgucagccagauauuuagaaaauaaccucaaaaguguuuauauggucagugag

SEQ ID NO: 247933 - RNA, 61 nt, hsa
ccacuggaaaguaaacaaaaccaucccucccaaccucaaagcuaggccacacucuauuuca

SEQ ID NO: 247934 - RNA, 61 nt, hsa
ugaaauacacuaagagcagccacaaaacuguaaccucaaggaaaccauaaagcuuggagug

SEQ ID NO: 247935 - RNA, 61 nt, hsa
aguacacagucugauaaggacuuaacguccuaaccucaauuguauuaaauagcauugggga

SEQ ID NO: 247936 - RNA, 64 nt, hsa
gguccucagcccauuucagacugcagaugccgcccacucccaccccacuccuaggcugccuugg

SEQ ID NO: 247937 - RNA, 64 nt, hsa
ucacuaaggggguucccgaggcccagggccaaggcacucccaccgccuaccuuagcacaggguc

SEQ ID NO: 247938 - RNA, 64 nt, hsa
uuucaggcuccugccugccccaggcccccugccccacucccaucucuucuucccugccaccccu

SEQ ID NO: 247939 - RNA, 64 nt, hsa
ucuggagcugcaggcaggagguggcacuggcucccacucccaccccugcccaggcuggcaucua

SEQ ID NO: 247940 - RNA, 64 nt, hsa
ucgucgggggcugggagauguuccuggaggaggacacucccaucagaacuuggcagccuugaag

SEQ ID NO: 247941 - RNA, 64 nt, hsa
ugcccgcugggggccugaagacauuccuggaggacacucccaucagaaccuggcagccccaaaa

SEQ ID NO: 247942 - RNA, 64 nt, hsa
uuuugguugaacagagggacagaagaauaaguaacacucccaaacacagacauacuuuuguaga

SEQ ID NO: 247943 - RNA, 64 nt, hsa
uuuucuuuuguuccccugucccuccuccaccccacacucccaccucuuucuaggacuucacuuu

SEQ ID NO: 247944 - RNA, 64 nt, hsa
cuucccccagagaaguggcuuggagggaacuucccacucccauugccugcuuuccccauuccag

SEQ ID NO: 247945 - RNA, 64 nt, hsa
ucuuggguuggaugcuaugggaauuacaacccaucacucccaaugccucccuuuccuggaggag

SEQ ID NO: 247946 - RNA, 64 nt, hsa
gcauuucuucuugaauccauugcagauugacuuccacucccacuccuucacuaaaagggcucuu

SEQ ID NO: 247947 - RNA, 64 nt, hsa
uuccuaugugauuuggccuuucgaugucaaucaucacucccagccauugauuuuggugacccac

SEQ ID NO: 247948 - RNA, 64 nt, hsa
gcguccugccccuucaccuugacccggguucccccacucccauucccuggccucugccauaauu

SEQ ID NO: 247949 - RNA, 64 nt, hsa
acguggguuaagcucuuccugccccguucagcuucacucccacccuuucagcguccugccccuu

SEQ ID NO: 247950 - RNA, 64 nt, hsa
uuuuauuuuguuuucucguucucccuccccaccccacucccagccuuaucuauccccccucacu

SEQ ID NO: 247951 - RNA, 64 nt, hsa
ccuuaucuauccccccucacuguccccuuuucuccacucccagccccauuuccuuuuuuucugg

SEQ ID NO: 247952 - RNA, 64 nt, hsa
aaucauuccaaggccaaacugcaacugagccacccacucccaaacaggaaacccuggugaaggu

SEQ ID NO: 247953 - RNA, 64 nt, hsa
aaaagucugggcugccuuccuuaauauugcaucucacucccacccuuaaaaccacagauugcaa

SEQ ID NO: 247954 - RNA, 64 nt, hsa
accaaaaauaacuuuaggaaccaccauauuauaucacucccaauagcacugaccuggugaucaa

SEQ ID NO: 247955 - RNA, 64 nt, hsa
ucccucaaaucaguccuuauccucuuucuaucuucacucccaucaucaucuauuuucacacuau

SEQ ID NO: 247956 - RNA, 64 nt, hsa
cucccaacuauucuugcuuuucccagacagcucccacucccaugucucugcucauuuagucccg

SEQ ID NO: 247957 - RNA, 64 nt, hsa
gcauccugacaucuguucauuuaggcuucaguuccacucccaggaacuuugccugucccacgag

SEQ ID NO: 247958 - RNA, 64 nt, hsa
ccgcaagagggacagagcccgggagagacucgcucacucccauguuggguuugagacagacacc

SEQ ID NO: 247959 - RNA, 64 nt, hsa
cacaaguagccucugggaucugccaacacacguccacucccaagccacuagcccacuccccagu

SEQ ID NO: 247960 - RNA, 64 nt, hsa
gcaggaaggagcaguccccugcuaucccugcagccacucccagcacacccgcacacagccagca

SEQ ID NO: 247961 - RNA, 64 nt, hsa
guccaugucccaggccccacuccagugcugcccacacucccagcugcuggaggagaggggagau

SEQ ID NO: 247962 - RNA, 64 nt, hsa
cacucacaccauccuaugagcccacgcccggccccacucccaccauccugugaaccccacucca

SEQ ID NO: 247963 - RNA, 64 nt, hsa
cacucacucuauccugugagaccacgccuggccccacucccaccauccugugagccccacuccu

SEQ ID NO: 247964 - RNA, 64 nt, hsa
acucccggccccacucacuccauccugugagccccacucccagccccacucacaccaaccugug

SEQ ID NO: 247965 - RNA, 64 nt, hsa
acucccaccauccugugagccccacucccagccccacucccaccauccugugagccccacuccc

SEQ ID NO: 247966 - RNA, 64 nt, hsa
acuuccagccccacucccaccauccugugagccccacucccagccccacucccaccauccugug

SEQ ID NO: 247967 - RNA, 64 nt, hsa
acucccaccauccugugagccccacuuccagccccacucccaccauccugugagccccacuccc

SEQ ID NO: 247968 - RNA, 64 nt, hsa
auucacuccauccugugagucccacucccagccccacucccaccauccugugagccccacuucc

SEQ ID NO: 247969 - RNA, 64 nt, hsa
augcccagccccauucacuccauccugugagucccacucccagccccacucccaccauccugug

SEQ ID NO: 247970 - RNA, 64 nt, hsa
acucacuccauccugugagucccacucccagccccacucccaccauccugugagcccaugcccg

SEQ ID NO: 247971 - RNA, 64 nt, hsa
gugcccagccccacucacuccauccugugagucccacucccagccccacucccaccauccugug

SEQ ID NO: 247972 - RNA, 64 nt, hsa
cucucacaccauccugugagaccacgcccggccccacucccaccaucuuguaagacugugccca

SEQ ID NO: 247973 - RNA, 64 nt, hsa
cucccugcuccacgucugcgccgccgccggaguccacucccagugcuugcaagauuccaaguuc

SEQ ID NO: 247974 - RNA, 64 nt, hsa
ccacaccgagggcgaccccgucacagccucaagucacucccaagcccccuccuugucugugcau

SEQ ID NO: 247975 - RNA, 64 nt, hsa
accaugcacgcucccagcgugcuguguccuucgccacucccacgcgcccguuccucuuccgucg

SEQ ID NO: 247976 - RNA, 64 nt, hsa
gggggccgggcugagggugggggugcgagguggucacucccaucgugccccuggccgucccucc

SEQ ID NO: 247977 - RNA, 64 nt, hsa
ccuacugucuucaguccauggggaucucaucacccacucccagccccagcuccagcugcccuca

SEQ ID NO: 247978 - RNA, 64 nt, hsa
cuggccauucacacacacacacacccccacaccccacucccacacacaguuccuacugucuuca

SEQ ID NO: 247979 - RNA, 60 nt, hsa
auuaacacuuuugcugagggagaaaaagaaaacauacauuaugaagccuuuccaaaauua

SEQ ID NO: 247980 - RNA, 60 nt, hsa
aaaucuuacuaugaaaucaagagguuuaagaacauacacugggcagauguugauuccgug

SEQ ID NO: 247981 - RNA, 60 nt, hsa
cacccaugauucuaugcacuguauuguuggaacauacauugugaaaacacugcccugccu

SEQ ID NO: 247982 - RNA, 60 nt, hsa
aaccugugacuguugaauaacaugugcccgaacauacacacacacauauguacacacaca

SEQ ID NO: 247983 - RNA, 60 nt, hsa
gcaaguuuaaauauuugagcuuuacaaauaaacauacacaugcucaguuuuuuaaguaaa

SEQ ID NO: 247984 - RNA, 60 nt, hsa
aaggcuuauguguauuuuccauauauguaaaacauacacauguaaaauauauguggccau

SEQ ID NO: 247985 - RNA, 60 nt, hsa
aaugcacgcacacgcacagagacaugccagaacauacaaggacaugcugccugaacauac

SEQ ID NO: 247986 - RNA, 60 nt, hsa
augccagaacauacaaggacaugcugccugaacauacacacgcacacccaugcgcagaug

SEQ ID NO: 247987 - RNA, 60 nt, hsa
uucuuguuuagaacuguugauuuugaacacaacauacacugucaaacuuuacaucaggga

SEQ ID NO: 247988 - RNA, 60 nt, hsa
uguggaucaucuccuaggaaaauagaacaaaacauacauauucacauuacacaguuccag

SEQ ID NO: 247989 - RNA, 60 nt, hsa
auccagaagaugccaauguacuggcagauuaacauacaaccuauguuuugaacaaaaaca

SEQ ID NO: 247990 - RNA, 60 nt, hsa
acuccccuccaaacaaacaauuaaaaaaaaaacauacagacacucaaauuccacaagcua

SEQ ID NO: 247991 - RNA, 60 nt, hsa
cauauauauaauauauuuuuuguaacuaugaacauacacaguuuuccagaaauagauuuu

SEQ ID NO: 247992 - RNA, 60 nt, hsa
aaagggagagagaauuucuuuauauacacaaacauacaugaauaugcauaucuauaugca

SEQ ID NO: 247993 - RNA, 60 nt, hsa
gagaagcauggggaaaauauuugcacucuaaacauacagagauagagguggggcuugugg

SEQ ID NO: 247994 - RNA, 60 nt, hsa
uagaauugucacucagcauaaugagcauuuaacauacaaaggcaauguacuguuuugugu

SEQ ID NO: 247995 - RNA, 60 nt, hsa
gccagagauacucuaggcauguaaagcacaaacauacauauaaaaucugcgggcuucaaa

SEQ ID NO: 247996 - RNA, 60 nt, hsa
uauauuuauauacaguuacagcaggccagaaacauacauacacugcauccuguaaggucu

SEQ ID NO: 247997 - RNA, 60 nt, hsa
acuucucucuuuuaaaucagauaccuuugaaacauacaagagacaugagauuccaguugu

SEQ ID NO: 247998 - RNA, 60 nt, hsa
acacucgugugaccccacaggguuguguccaacauacacggaaguggcuauggaauggug

SEQ ID NO: 247999 - RNA, 60 nt, hsa
auuuuuuucuuuuuucuccuauuugguguuaacauacacccaagcccacccggcccgucg

SEQ ID NO: 248000 - RNA, 60 nt, hsa
aggauucagcacuacagcauaccccucuacaacauacagcccugucacauugagaucaua

SEQ ID NO: 248001 - RNA, 60 nt, hsa
gaacaaaguacacuugauaaaaacauuuucaacauacauugagccuaaacagcaguuaag

SEQ ID NO: 248002 - RNA, 64 nt, hsa; identical to SEQ ID NO: 244942

SEQ ID NO: 248003 - RNA, 64 nt, hsa; identical to SEQ ID NO: 244943

SEQ ID NO: 248004 - RNA, 64 nt, hsa; identical to SEQ ID NO: 244944

SEQ ID NO: 248005 - RNA, 64 nt, hsa; identical to SEQ ID NO: 244945

SEQ ID NO: 248006 - RNA, 64 nt, hsa; identical to SEQ ID NO: 244946

SEQ ID NO: 248007 - RNA, 64 nt, hsa; identical to SEQ ID NO: 244947

SEQ ID NO: 248008 - RNA, 64 nt, hsa; identical to SEQ ID NO: 244948

SEQ ID NO: 248009 - RNA, 64 nt, hsa; identical to SEQ ID NO: 244949

SEQ ID NO: 248010 - RNA, 64 nt, hsa; identical to SEQ ID NO: 244950

SEQ ID NO: 248011 - RNA, 64 nt, hsa; identical to SEQ ID NO: 244951

SEQ ID NO: 248012 - RNA, 64 nt, hsa; identical to SEQ ID NO: 244952

SEQ ID NO: 248013 - RNA, 64 nt, hsa; identical to SEQ ID NO: 244953

SEQ ID NO: 248014 - RNA, 64 nt, hsa; identical to SEQ ID NO: 244954

SEQ ID NO: 248015 - RNA, 64 nt, hsa; identical to SEQ ID NO: 244955

SEQ ID NO: 248016 - RNA, 64 nt, hsa; identical to SEQ ID NO: 244956

SEQ ID NO: 248017 - RNA, 64 nt, hsa; identical to SEQ ID NO: 244957

SEQ ID NO: 248018 - RNA, 64 nt, hsa; identical to SEQ ID NO: 244958

SEQ ID NO: 248019 - RNA, 64 nt, hsa; identical to SEQ ID NO: 244959

SEQ ID NO: 248020 - RNA, 64 nt, hsa; identical to SEQ ID NO: 244960

SEQ ID NO: 248021 - RNA, 64 nt, hsa; identical to SEQ ID NO: 244961

SEQ ID NO: 248022 - RNA, 64 nt, hsa; identical to SEQ ID NO: 244962

SEQ ID NO: 248023 - RNA, 64 nt, hsa; identical to SEQ ID NO: 244963

SEQ ID NO: 248024 - RNA, 64 nt, hsa; identical to SEQ ID NO: 244964

SEQ ID NO: 248025 - RNA, 64 nt, hsa; identical to SEQ ID NO: 244965

SEQ ID NO: 248026 - RNA, 64 nt, hsa; identical to SEQ ID NO: 244966

SEQ ID NO: 248027 - RNA, 64 nt, hsa; identical to SEQ ID NO: 244967

SEQ ID NO: 248028 - RNA, 64 nt, hsa; identical to SEQ ID NO: 244968

SEQ ID NO: 248029 - RNA, 64 nt, hsa
uuaauauuugauuaaauaaugcagucagcuaagagccaacaaaaccccauauccagauaguuag

SEQ ID NO: 248030 - RNA, 64 nt, hsa
caaggaugucaacuugacauccuucccuuagcaugccaacaagccauuagacugauucuuccac

SEQ ID NO: 248031 - RNA, 64 nt, hsa
agcugcuuguaagucacagguuuuccagaugucugccaacaagaaaugacucauacugugauga

SEQ ID NO: 248032 - RNA, 64 nt, hsa
gcacauauuacucuuuuuagcaaccuagcaugaugccaacaagacuauucuugaaagagcaaag

SEQ ID NO: 248033 - RNA, 64 nt, hsa
ccuuuuuguaggagguaggauauuuuauauucugccgcaggauagaacccacgcaaggauuuuc

SEQ ID NO: 248034 - RNA, 64 nt, hsa
uucuccggaaggcucuggccccaagcuggccggcccgcaggagccccauucucagagaaugugu

SEQ ID NO: 248035 - RNA, 64 nt, hsa
cuuauuuauuaauagauuaaguucugaggcagcuccgcaggacugugugugaauguguauguau

SEQ ID NO: 248036 - RNA, 64 nt, hsa
cucagucagaggcccccgucccuccuuuugccuuccgcaggacugaagaccugaaggggcuggc

SEQ ID NO: 248037 - RNA, 64 nt, hsa
ggggcaguauugggggacugugcuagcuuuacccccgcaggacauacacaggagccuuugaucu

SEQ ID NO: 248038 - RNA, 64 nt, hsa
cgggugggaaugaccccuaggcaaggggaugagaccgcaggaggaaauggcggggaggaggcau

SEQ ID NO: 248039 - RNA, 64 nt, hsa
gaaccaagccagggaugggcuggccauuguguccccgcaggagagaugggcagaauggcccuag

SEQ ID NO: 248040 - RNA, 64 nt, hsa
gacugagcucaaaggaacaggauggcacccagagccgcaggacggagacugggggcagcccuca

SEQ ID NO: 248041 - RNA, 64 nt, hsa
cugaauguuuccaauagacuaaauacuguuuaggccgcaggagaguuuggaauccggaauaaau

SEQ ID NO: 248042 - RNA, 64 nt, hsa
uugacuccuguggcuucuggaccccuccucugccccgcaggaggaaguuccacggcagguggug

SEQ ID NO: 248043 - RNA, 64 nt, hsa
ucaguagccagcaucugccuccccuucacucccaccgcaggauuugggcucuuggaauccuggg

SEQ ID NO: 248044 - RNA, 64 nt, hsa
cugugagcaggccccaugcccagcacgccagccaccgcaggauaccucagucauaccaguugua

SEQ ID NO: 248045 - RNA, 64 nt, hsa
gacuaggacuugccacacacugccaauucauaauccgcaggaucuguagaagacauuuugggaa

SEQ ID NO: 248046 - RNA, 64 nt, hsa
acuauuccauuagccuguggucugcaggguaggcccgcaggaaaugaggaauggccgagcugga

SEQ ID NO: 248047 - RNA, 64 nt, hsa
gagugucccuggccccuuccugccaugggcaggcccgcaggaagagccgguagggguggaaagg

SEQ ID NO: 248048 - RNA, 64 nt, hsa
uccauguagaauaaaugaagaaagggaggcccagccgcaggaaggcagaauaaauccuugggag

SEQ ID NO: 248049 - RNA, 64 nt, hsa
gcuaaggggucaggccagauggggcaggaaggcuccgcaggaccggaccccuagaccacccugc

SEQ ID NO: 248050 - RNA, 64 nt, hsa
acccuuaucugcggccggugaagaagcccaagauccgcaggaagaagugaguuggaggcugggg

SEQ ID NO: 248051 - RNA, 64 nt, hsa
cuuuucacguuuucuuuacacacacguugacgggccgcaggagggaggcggggaggaggaacgg

SEQ ID NO: 248052 - RNA, 64 nt, hsa
uggccgucaccucagacaucacuccagggagcacccgcaggagcugggcccccucacgccugcc

SEQ ID NO: 248053 - RNA, 64 nt, hsa
gacgcaguucucggacgccgaggggcuggcgcucccgcaggacggccucuauuaccucuacugu

SEQ ID NO: 248054 - RNA, 64 nt, hsa
guccacagacacacucacgcccgccaccugcuccccgcaggaugugucugugugugggaauugg

SEQ ID NO: 248055 - RNA, 64 nt, hsa
cuaagccugcaguaggaucucagccacaagggccccgcaggauggagcugggucaaggaccagg

SEQ ID NO: 248056 - RNA, 64 nt, hsa
ucaccgagaggcaggucaagaucugguuccagaaccgcaggaugaaaaugaagaaaaucaacaa

SEQ ID NO: 248057 - RNA, 64 nt, hsa
agggaugccauguagccccagcuggaagugacuuccgcaggaauugagagggaauagcucaccc

SEQ ID NO: 248058 - RNA, 64 nt, hsa
gccuguccucuccguggaggacccugggcccucaccgcaggaagcaguuuggguuuugaaaggu

SEQ ID NO: 248059 - RNA, 64 nt, hsa
auugcugcugaccuuacgccuguauauuaagccuccgcaggaugccggacaauggugaagaaac

SEQ ID NO: 248060 - RNA, 64 nt, hsa
gcagccccacucacagcugcugcaccaccaccuuccgcaggaugcacaggugaguacagugaug

SEQ ID NO: 248061 - RNA, 64 nt, hsa
ugaugccguuggggcggaggcugcccuugcagcgccgcaggaacucggccaggugcugaucggu

SEQ ID NO: 248062 - RNA, 64 nt, hsa
ccaggcagcccacagugcugcacguagccaugggccgcaggagugcauacaacccugcauccag

SEQ ID NO: 248063 - RNA, 64 nt, hsa
acucgcagccccaucggacgcucucccgggaccgccgcaggaccaguuuccauagacugcggac

SEQ ID NO: 248064 - RNA, 64 nt, hsa
cacacauacaacacagaucauuucccaguuagauccgcaggaaguagguugguggggguggaug

SEQ ID NO: 248065 - RNA, 64 nt, hsa
ccuuugaaacugugaagccucgccccgcggccugccgcaggauauguuuugguaaauguagacu

SEQ ID NO: 248066 - RNA, 64 nt, hsa
uguuccgugcaugcaguggaauaguaccagccuuccgcaggaaggaaauucugacauaugcggu

SEQ ID NO: 248067 - RNA, 64 nt, hsa
acuccgcauccuugucccucugcauucccaguuuccgcaggagccuugaucaauggggaagccu

SEQ ID NO: 248068 - RNA, 64 nt, hsa
ugccuggaggccauuugugccugccucugugcugccgcaggagggcaggccgcaagugggguug

SEQ ID NO: 248069 - RNA, 64 nt, hsa
uuggucagaaucaauccuuuggugaaaguaagaaccgcaggaguugaguuuugguuugguccug

SEQ ID NO: 248070 - RNA, 64 nt, hsa
gaugggaaaucugccuaugucauaccgugacagcccgcaggaucaggugacuucuagcagagac

SEQ ID NO: 248071 - RNA, 64 nt, hsa
gcccugcccccgugaggaugucacucagauggaaccgcaggaagcugcuccgugcuuguuugcu

SEQ ID NO: 248072 - RNA, 64 nt, hsa
aggggugcugugagaaggcugugcccauguggggccgcaggaauccccuguauguucagggcug

SEQ ID NO: 248073 - RNA, 64 nt, hsa
uucucauauagcccucagucacugagggagucccccgcaggauuggagaggcacauucccuugg

SEQ ID NO: 248074 - RNA, 53 nt, hsa
aauccuacacccugguguagggcccgcaggaagagcagccacgccuggaccgc

SEQ ID NO: 248075 - RNA, 64 nt, hsa
ggccuggcuuccugguaaggaguuucagccgccuccgcaggaacccccaaagugcagauuccgg

SEQ ID NO: 248076 - RNA, 64 nt, hsa
guaccuagucagaugguagacgagcugucugcugccgcaggagcaccucuauacaggacuuaga

SEQ ID NO: 248077 - RNA, 64 nt, hsa
ugcauggcugagagccaggcuuccuuccuggucuccgcaggaggcuguggcagcuguggcaucc

SEQ ID NO: 248078 - RNA, 64 nt, hsa
ggcucagcucgguacccggggcccagggcaagcuccgcaggacuuccccggagggcugcggcgu

SEQ ID NO: 248079 - RNA, 64 nt, hsa
augcaaccacagugcauguugcagauaccggcggccgcaggaggggcagcauccaguagaggac

SEQ ID NO: 248080 - RNA, 64 nt, hsa
aagacccuccugaggagugaagagugacaugccaccgcaggauccuuugcucugcacgaguuac

SEQ ID NO: 248081 - RNA, 64 nt, hsa
ggcagaugagugggagacugguugcaaggugugaccgcaggaauccuggaggaauagagaguaa

SEQ ID NO: 248082 - RNA, 64 nt, hsa
ggcagaugagugggagacugguugcaaggugugaccgcaggaauccuggaggaacagagaguaa

SEQ ID NO: 248083 - RNA, 64 nt, hsa
ccuuuaguuuccugacaccuguguccugagugagccgcaggaguucuuagcuccucagcgagca

SEQ ID NO: 248084 - RNA, 64 nt, hsa
caguggccaggauccaauacgaguccaggggugaccgcaggauggugggggcagcgggcuucuc

SEQ ID NO: 248085 - RNA, 64 nt, hsa
uguguucacagaccucagcagggcaucgcauggaccgcaggagggcagauucggaccacuaggc

SEQ ID NO: 248086 - RNA, 64 nt, hsa
ugccggaggacagccagcggcugcuuuguggacaccgcaggaaguuccucgggacacggcugcu

SEQ ID NO: 248087 - RNA, 64 nt, hsa
aaugacgaagcugcucagcaacuccaccugcccgccgcaggaaggagcaguccccugcuauccc

SEQ ID NO: 248088 - RNA, 64 nt, hsa
gcuccugccgccucuucccuaccuccuccacuagccgcaggaagggccuccagcacccacaacu

SEQ ID NO: 248089 - RNA, 64 nt, hsa
ucccaggccaagcacacacaggcugcgcccaguuccgcaggagccgucccacagcguggcucuc

SEQ ID NO: 248090 - RNA, 64 nt, hsa
ucggggucugcaccccaggcacagcggugucaccccgcaggaccgcgggccugccccaaccccc

SEQ ID NO: 248091 - RNA, 64 nt, hsa
ccggagggacggcagccccggucgcgcgcuggccccgcaggaccuuccuuuuccaggaagagcc

SEQ ID NO: 248092 - RNA, 64 nt, hsa
guggggguggggguggggguggggguggaagcagccgcaggagcaagggccccucccacauaca

SEQ ID NO: 248093 - RNA, 64 nt, hsa
aaauggccacugaguaggccccagaggucgcacuccgcaggaggacugaggccaugugccauuc

SEQ ID NO: 248094 - RNA, 64 nt, hsa
accuaggaaaucucggugcacuaggaagugaaucccgcaggacagcugcacucagggauacgcc

SEQ ID NO: 248095 - RNA, 64 nt, hsa
ggcagcagccagggacccccagaacaagaagaccccgcaggaucccuccugagcucggggggcu

SEQ ID NO: 248096 - RNA, 63 nt, hsa
uuguauuguugccggcaugacaccgcgggacggccgcaggacgcaggcgagggccgcacggcu

SEQ ID NO: 248097 - RNA, 64 nt, hsa
ccaaccugucccacccccgugcccccuccuuaccccgcaggacgggccuacaggggggucuccc

SEQ ID NO: 248098 - RNA, 64 nt, hsa
gaggacgcagagugcaggcuguggccucggcaucccgcaggaggucccuagaacaugccguuuc

SEQ ID NO: 248099 - RNA, 64 nt, hsa
ccuccaugaccugcgcucucagcugaccaucaucccgcaggaccccauccuguucucggggacc

SEQ ID NO: 248100 - RNA, 64 nt, hsa
ggccgccuggcagaaucuagcaccguccgaauccccgcaggacccauggagcuaugaccacacc

SEQ ID NO: 248101 - RNA, 64 nt, hsa
ccgccugauuucgcucgggcuucgggugacuucgccgcaggaccuacccagcucgcucacuucg

SEQ ID NO: 248102 - RNA, 64 nt, hsa
aggcagguaggcugcagccaggagcucccuggcaccgcaggaccucgugguacucuugccuuag

SEQ ID NO: 248103 - RNA, 64 nt, hsa
uugcacaggguggggcgcgcaguaggaaccucccccgcaggagcuggcgcccucucgcuccugc

SEQ ID NO: 248104 - RNA, 64 nt, hsa
ccucccaggccccuuguggacuuagacucaaaacccgcaggagaaacagguccgacucaguaug

SEQ ID NO: 248105 - RNA, 64 nt, hsa
gugcaggccaugugagcccugccucuuuaaggagccgcaggacaugaaagaugaccuugugaca

SEQ ID NO: 248106 - RNA, 64 nt, hsa
gccgcggggcucucugggccgguucccugcagacccgcaggagagcacaugugccuugcaugaa

SEQ ID NO: 248107 - RNA, 64 nt, hsa
cuccuggucugugaagagccgguggugcccgugcccgcaggaacugggcugggccucgugcgcc

SEQ ID NO: 248108 - RNA, 64 nt, hsa
cauuauucaagagaccaccugacaugcaucuccuccgcaggaauacauucguccucucuuagag

SEQ ID NO: 248109 - RNA, 64 nt, hsa
aaaggaaugcagugcucaaaaccuacccaaauucccgcaggauucuaccaaacccuuccccagg

SEQ ID NO: 248110 - RNA, 64 nt, hsa
gggccagcagccgcgaaccuugaagcuggggugaccgcaggagacccuguaaggccugugagcg

SEQ ID NO: 248111 - RNA, 64 nt, hsa
ggacgggagcuccacugugaaucggcggcacgcgccgcaggaggcugggacugguccaguuugu

SEQ ID NO: 248112 - RNA, 64 nt, hsa
agacgcaacguuuccaacucucgggacgccaaggccgcaggacuggagggccaggccccgccac

SEQ ID NO: 248113 - RNA, 64 nt, hsa
gccgcuguggucuggcccccucccuguccaggccccgcaggaggcagaugcagucccaggcauc

SEQ ID NO: 248114 - RNA, 64 nt, hsa
aagcacaaccagcucgcccucccccuacccggggccgcaggacgcugagacgguuugggggugg

SEQ ID NO: 248115 - RNA, 64 nt, hsa
agcucacguggccuuuaaaaaccuacuuccccgcccgcaggagcucagagcaucgcugggccug

SEQ ID NO: 248116 - RNA, 64 nt, hsa
aucagaagcccugggguuccuggccccccgugagccgcaggaggaugcguugccugcagugcag

SEQ ID NO: 248117 - RNA, 64 nt, hsa
caaagccaaagccgaaugagaacggugucucugcccgcaggacgccugcccccagcccccgcag

SEQ ID NO: 248118 - RNA, 64 nt, hsa
aacccagaugccugaggccuggcuggggcugcccccgcaggacacuguggccaugccacggagg

SEQ ID NO: 248119 - RNA, 64 nt, hsa
ccgaguaggggugggggugggauggcaggaggagccgcaggaggaaggagguugugcagggucu

SEQ ID NO: 248120 - RNA, 64 nt, hsa
gguaagugaguucacaccuagaacacuguccugaccgcaggacgcgugccuuggacuugguauu

SEQ ID NO: 248121 - RNA, 64 nt, hsa
ugagccagauccauggcaauggucuccccacagaccgcaggacugagccuggagagagaaguug

SEQ ID NO: 248122 - RNA, 64 nt, hsa
ugcuugucuggccaugaucuggagagcaucaggcccgcaggacugcacaacucugccaggggug

SEQ ID NO: 248123 - RNA, 64 nt, hsa
gugucccccaccccaucagcugggaaagcccaggccgcaggagugggaugcccguuggacuuug

SEQ ID NO: 248124 - RNA, 64 nt, hsa
ggccauccguggaggaggggccgguccuggacucccgcaggacuccucugaggcagggccugaa

SEQ ID NO: 248125 - RNA, 64 nt, hsa
guuagaguguacucugaaaccaacucgucucuggccgcaggagucuauauguuuucguaaucuu

SEQ ID NO: 248126 - RNA, 64 nt, hsa
aguggcugaguuacuugcugcccugugcuccuccccgcaggacauggcucccccuccaccugcu

SEQ ID NO: 248127 - RNA, 64 nt, hsa
uuuuuguuuugcccucuggguguuuucuuuggucccgcaggaggguggguggagcagguggacu

SEQ ID NO: 248128 - RNA, 64 nt, hsa
agauucuuucaguucuuuggauucuaaauacaugccacaucaaaccuuugaguagauccauuuc

SEQ ID NO: 248129 - RNA, 64 nt, hsa
uguauuuucaugaaaauaccauuuaguaagaauaccacaucaaauaagaaauaaugcuacaauu

SEQ ID NO: 248130 - RNA, 64 nt, hsa
uacaauaguguggaaagccacaucacaaaaaaagccacaucacaaaaaaaagccagugccuauu

SEQ ID NO: 248131 - RNA, 64 nt, hsa
augggauucuggacuucuacaauaguguggaaagccacaucacaaaaaaagccacaucacaaaa

SEQ ID NO: 248132 - RNA, 64 nt, hsa
cuuuucacuguguuuaauuugggaaaauccagauccacaucauuguagagucugaggguuagaa

SEQ ID NO: 248133 - RNA, 64 nt, hsa
cauuuacugagugucugucagggaucauucacauccacaucauccucccggccccuccccgugu

SEQ ID NO: 248134 - RNA, 64 nt, hsa
aaaauucauugucucuagagauugucagcuugguccacaucaccagaaaucuaacucccugaaa

SEQ ID NO: 248135 - RNA, 64 nt, hsa
agugauugauccuuaccuuguauaucaucuucgaccacaucagaaagaaggaaucauauuccuu

SEQ ID NO: 248136 - RNA, 64 nt, hsa
gaaaucugccuagaggauauauguaaggaagauuccacaucaugaguacuugccuuuuaacuuu

SEQ ID NO: 248137 - RNA, 64 nt, hsa
cuucugucaaauuauaugguuauuuuuuauauuaccacaucagcauuauauuaaaaguguuuuu

SEQ ID NO: 248138 - RNA, 64 nt, hsa
uccaggaauggugcuuuaugugagauaccccacuccacaucaacauuccagggaugagccaaac

SEQ ID NO: 248139 - RNA, 64 nt, hsa
aacucaaggguuuuccagguguagcuaacaguugccacaucacacagaccucgaguuucuggua

SEQ ID NO: 248140 - RNA, 64 nt, hsa
gggcgccauccagguuuaacccugcaagcuguuuccacaucagaacucccuucaaacacaaaga

SEQ ID NO: 248141 - RNA, 64 nt, hsa
aauauuuccauucaaaaugugguucacagacccgccacaucagcaccauccgagagcuuauuag

SEQ ID NO: 248142 - RNA, 64 nt, hsa
gcccaggucuggacuuuuuuggccaucagauggacgaucugaacauaggguggcuggcagaggg

SEQ ID NO: 248143 - RNA, 64 nt, hsa
ugaccucagaggcagaggaacaccaccagcucuucgaucugauugaaagcaugcuagaguauga

SEQ ID NO: 248144 - RNA, 64 nt, hsa
auuagaccuauguguuugcacccaucuuuguuggcgaucugagugcaguguggcaagugcacac

SEQ ID NO: 248145 - RNA, 64 nt, hsa
uuucuaugauauaauuuguaaauguaaauuauuccgaucugacauaucugcauuauaauaauag

SEQ ID NO: 248146 - RNA, 64 nt, hsa
gcaaaaaaaaaaaucugauuaacaaaugaaaaagcgaucugaacagacauuucccaaaggaaga

SEQ ID NO: 248147 - RNA, 64 nt, hsa
ugcuguuuagcuugacuguuuuccucaagaacaucgaucugaaggauucauaaggagcuuaucu

SEQ ID NO: 248148 - RNA, 64 nt, hsa
ucuaauauacuaagccuuacagcuaucuuagaugcgaucugacuccugugugacuguggagcac

SEQ ID NO: 248149 - RNA, 64 nt, hsa
cuccccagccaaucuguacaucccucagaggcagcgaucugaugaauugguuuuugaaucccag

SEQ ID NO: 248150 - RNA, 64 nt, hsa
auucaugguguaagaacaguuuugcaguauaacacgaucugauaaucauucaguuauuaaauug

SEQ ID NO: 248151 - RNA, 64 nt, hsa
ccucagcgacaguguagcgucauguuagaggagacgaucugacccaccaguuuguacaucacgu

SEQ ID NO: 248152 - RNA, 64 nt, hsa
acgcuccaagaguauuauuaacgcugcuguaccucgaucugaaucugccggggccccagcccac

SEQ ID NO: 248153 - RNA, 64 nt, hsa
gcagcagagacugaggcauagccagcuucaaaagcgaucugacaugaaagucauuaacaaagcc

SEQ ID NO: 248154 - RNA, 64 nt, hsa
ugugguguucucacaccuuaacgaaaaucucgugcgaucugauuccagaagauucuugugagaa

SEQ ID NO: 248155 - RNA, 64 nt, hsa
ugaugagcguaacgacccuucugaccuggucucacgaucugaaauaauaaaaggcugugucaug

SEQ ID NO: 248156 - RNA, 64 nt, hsa
aaaccugucuugacauucaaaaccuuuuucuucccgaucugaaccccuguugacuaaucuugcc

SEQ ID NO: 248157 - RNA, 64 nt, hsa
cccacugucuccccauccuuccaccuacuuguggcgaucugaguacucuacucuugcucaagaa

SEQ ID NO: 248158 - RNA, 64 nt, hsa
cccgggagccuccucaggcucccucuauuaaagccgaucugacuccgcccagccagaugucccg

SEQ ID NO: 248159 - RNA, 64 nt, hsa
gauccauuuuuagggaagggauuuuggcucaaaacgaucugaccaccucugcccuguccaccag

SEQ ID NO: 248160 - RNA, 64 nt, hsa
ucacauucucaagcaaaaauucaacugcauuaaccgaucugagaguuuuccuuuaaccuggacu

SEQ ID NO: 248161 - RNA, 64 nt, hsa
ugacuuuguguacaucugugaugauaauuaucagcgaucugagguacucagcauggaaaucaac

SEQ ID NO: 248162 - RNA, 64 nt, hsa
aggguaacaguaucugaaauuucacaguccuauccgaucugaaaacacacauacacaaaugcac

SEQ ID NO: 248163 - RNA, 64 nt, hsa
cugguuguauguguaggcuaagaaggaaggacccuccugucagugugcaaagcuguaaucucau

SEQ ID NO: 248164 - RNA, 64 nt, hsa
ggagaaaggggaggugaaagauugaagagcagguuccugucaauguucugaguucgagcuggag

SEQ ID NO: 248165 - RNA, 64 nt, hsa
acccugagaagaacuacggagaaaucaaauaaaauccugucauauuuuuuucacccugccuuuc

SEQ ID NO: 248166 - RNA, 64 nt, hsa
ccccgacagauuaaaugcguguuggggauugguuuccugucauagcugcugcugcugccaugcg

SEQ ID NO: 248167 - RNA, 64 nt, hsa
augcagagguacucccuggucagggacaaguguuuccugucagccaccgagugccugcagaaga

SEQ ID NO: 248168 - RNA, 64 nt, hsa
cuagaccugaaaguguuccugaucagagaggccuuccugucacugccuugcaggaggcaaggga

SEQ ID NO: 248169 - RNA, 64 nt, hsa
cccucuggcuaaaacucaagcaaauaaagccgcuuccugucauuaagcaucucagaggaagcag

SEQ ID NO: 248170 - RNA, 64 nt, hsa
gaucacccaugauucuguuucacuguuugcuuucuccugucaugguuaagagaaaugugcaauu

SEQ ID NO: 248171 - RNA, 64 nt, hsa
uccacggcuggauaccugugugucuccauaaaaguccugucaccaaggacguuaaaggcauuuu

SEQ ID NO: 248172 - RNA, 64 nt, hsa
ucggccucuacuuuguccccucaccuccacccccuccugucaccggccuugugacauucacuca

SEQ ID NO: 248173 - RNA, 64 nt, hsa
gguguaauuuaauuggugcaacaugcuuuauggcuccugucaaaauugguuuucacucauuuga

SEQ ID NO: 248174 - RNA, 64 nt, hsa
agccauuaaagcagcucccugcuucaucauuaaguccugucaucccuaccagccaaucccaguc

SEQ ID NO: 248175 - RNA, 64 nt, hsa
ugcacacgauccggagagccgaaggccgcgugcuuccugucacaugggcuguaaucauuuguag

SEQ ID NO: 248176 - RNA, 64 nt, hsa
guccagggcaccuccccccauuagcuguaagguuuccugucaggugugacugucaguuugcugg

SEQ ID NO: 248177 - RNA, 64 nt, hsa
ccugucauuuaucagcaaaagauugggaauuuucuccugucaacuucuuuuguauuaggcugug

SEQ ID NO: 248178 - RNA, 64 nt, hsa
cacaccugagacagacauuucaacaaugauacaguccugucauuuaucagcaaaagauugggaa

SEQ ID NO: 248179 - RNA, 64 nt, hsa
uccucagucauuucugcaaagccaaggggcagccuccugucaagguagcuagaggccugggaaa

SEQ ID NO: 248180 - RNA, 64 nt, hsa
gacacacacacacacacguacaugcacacauuuuuccugucagguuaacuuauuuguagguucu

SEQ ID NO: 248181 - RNA, 64 nt, hsa
cuuuuucuccucucugagccuuugucuauuguguuccugucacccacccuuucaucaucuuuuu

SEQ ID NO: 248182 - RNA, 64 nt, hsa
guaggaaggggcccuagaaagggccuaguuacuauccugucaguucuaacaguaguggaacagg

SEQ ID NO: 248183 - RNA, 64 nt, hsa
aaaggcaauaaugauagaaauuauuucuuagguacagcaauaguugauaggaugugaggguguu

SEQ ID NO: 248184 - RNA, 64 nt, hsa
cuguacccccggacaguuaaaucagaaccucagacagcaauaugccuugagaugccuugaacca

SEQ ID NO: 248185 - RNA, 64 nt, hsa
aaaccuuggaaauacgacagggugugguagaauucagcaauaugagaaaaccagccccuaaaau

SEQ ID NO: 248186 - RNA, 64 nt, hsa
cauacuguuaaugucaaauaucaaaaauguuuuccagcaauaucaaguuauggcaauggcaaaa

SEQ ID NO: 248187 - RNA, 64 nt, hsa
uccccuccccuccagggugcccccggcuuucucccagcaauagggucgacgagaccuagaaccg

SEQ ID NO: 248188 - RNA, 64 nt, hsa
cggguggaggggccggagggcgggccccuccucacagcaauagggggaggggggcccgguccca

SEQ ID NO: 248189 - RNA, 64 nt, hsa
gggcggcggggccucccccagccaggucggcucucagcaauacggccccccagggaagucuucg

SEQ ID NO: 248190 - RNA, 64 nt, hsa
guuauuuauucaagagaaggaaaaacaaugaucacagcaauacuuguaugcauguucauugcaa

SEQ ID NO: 248191 - RNA, 64 nt, hsa
gugguauccauuacacaauagacuacuuacuacucagcaauaaaaaugaaguaacuuucaauaa

SEQ ID NO: 248192 - RNA, 64 nt, hsa
ucucaccuucuuuaccucaggagccaggagcagacagcaauacuucguccacaccugggaucgc

SEQ ID NO: 248193 - RNA, 64 nt, hsa
cugcaggggccacgaguuugcagaugcuguacuucagcaauaaccuugccuuugcuaagacccc

SEQ ID NO: 248194 - RNA, 64 nt, hsa
cauuuaaaguuuuauccaauauucuaggaauuuucagcaauacugauauucacuuuauuuuuuu

SEQ ID NO: 248195 - RNA, 64 nt, hsa
uauuuaaaguuuuauccaguauucuaggaauuuucagcaauacuaauauucucauuuuuaaaca

SEQ ID NO: 248196 - RNA, 61 nt, hsa
ccaucugaagcuguagccaccagggaugcagcuagcugaggaguuugggguguuggguugg

SEQ ID NO: 248197 - RNA, 61 nt, hsa
cugggguggaacuagguccugagggcacagccuagcugagugcaaagaaauauaggaugcu

SEQ ID NO: 248198 - RNA, 61 nt, hsa
uuuauuuuacuugagaccuuacaucuuuguucuagcugacaguaaaucucuggguuucugu

SEQ ID NO: 248199 - RNA, 61 nt, hsa
agagacacucacaggcuaugaggguacaccccuagcugaauguucuguguuguuuccuuag

SEQ ID NO: 248200 - RNA, 61 nt, hsa
cuaccagcagacucuggaggccugugccuugcuagcugaccuggagaugcugccugguggg

SEQ ID NO: 248201 - RNA, 61 nt, hsa
cuuccugccccagacagacuucaucauugugcuagcugauggacaggugucugagaugggc

SEQ ID NO: 248202 - RNA, 61 nt, hsa
ugcggagaacccaggugggauccugaaggcacuagcugacagacgggccccucaauccugu

SEQ ID NO: 248203 - RNA, 61 nt, hsa
ggagagacaauagcuuugaggagcucacaaucuagcugaggagacaagacacauccaaugc

SEQ ID NO: 248204 - RNA, 64 nt, hsa
uguuaagagacauacccucuaaaaaagaacuuuagcaugguauugaaggaauuagaaaugaauu

SEQ ID NO: 248205 - RNA, 64 nt, hsa
auacauuaaaagaaguaaccaacugaacgacaaagcaugguauuugaauuuuaaauuaaagcaa

SEQ ID NO: 248206 - RNA, 64 nt, hsa
gaggaaaccaaggcucagaggggcaaagucaccugcaugguagcacauagugauaggguagcga

SEQ ID NO: 248207 - RNA, 64 nt, hsa
aaagaugugcuccugucucugcacuggcgcauuggcaugguagaugccacaauguaugugcacg

SEQ ID NO: 248208 - RNA, 64 nt, hsa
uguuaggcagaauauuuuggauuuggaggcauuugcaugguagucuuugaacaguaaaaugaug

SEQ ID NO: 248209 - RNA, 64 nt, hsa
aacauguccaucuuuuuagugauaauaaaagaaagcaugguauuaaacuaucauagaaguagac

SEQ ID NO: 248210 - RNA, 62 nt, hsa
gauagggggaggguuggaaaauuuauuuuuaugaaacagagggaagacuuuauuguuguuau

SEQ ID NO: 248211 - RNA, 62 nt, hsa
cucaauggccuagaagcugccuguacuuuggggaaacagauggagcucuugggcccagccag

SEQ ID NO: 248212 - RNA, 62 nt, hsa
ugacauauaugaaagguuuaucuaagaagaaagaaacagagauaauauauauauagaaagau

SEQ ID NO: 248213 - RNA, 62 nt, hsa
aaaaacaagaaccacaaaaacuugaaaaaucugaaacagagaacagaaggccaagagccagc

SEQ ID NO: 248214 - RNA, 62 nt, hsa
uaauggaucagacuuugccagauuugguuagggaaacagaaauuuagaauggugcauuauuu

SEQ ID NO: 248215 - RNA, 62 nt, hsa
agaguaaauagcccuucagcaugcucauucaugaaacagaagaggcuguacaagugaagaca

SEQ ID NO: 248216 - RNA, 62 nt, hsa
cuuuaauugaaauacucugaauuccccucauggaaacagagagcauugagagcacuuucuuu

SEQ ID NO: 248217 - RNA, 62 nt, hsa
caaguggccgugcuaccuuuuuagagaauaaagaaacagacuuuugaguuuauaugcaaugc

SEQ ID NO: 248218 - RNA, 62 nt, hsa
guuuuaauuuggguauagguuaaauggaagaagaaacagaacuucauggccaaaguagaccu

SEQ ID NO: 248219 - RNA, 62 nt, hsa
augccacacuuugcaccuuaaugaaauacuuugaaacagaaguuauucacuguguuuuugau

SEQ ID NO: 248220 - RNA, 62 nt, hsa
ccaaaaaaugguagacaugaaaggcaggugaggaaacagaaaaggucucuuugcagauauau

SEQ ID NO: 248221 - RNA, 62 nt, hsa
ggagaugaaauaaacaaggcaaaauagagguggaaacagaaggaagucauuugcugagucug

SEQ ID NO: 248222 - RNA, 62 nt, hsa
aucacgucgccuuccuauguaugacgaaacaagaaacagagauuuccaauugcucuuuuguc

SEQ ID NO: 248223 - RNA, 62 nt, hsa
ucccucacucaaccugcugagguguggauggggaaacagaggcaaaacugaggcaccugaug

SEQ ID NO: 248224 - RNA, 62 nt, hsa
uggcuaugcauuaccuaaaaccaguccaaaaugaaacagaccaacacacacacaaaagcaaa

SEQ ID NO: 248225 - RNA, 62 nt, hsa
cgcauggcuguucugcugcaacugugcuccacgaaacagaagaaaagguaagguguuguguc

SEQ ID NO: 248226 - RNA, 62 nt, hsa
cugccauugccgagaguccuguuauugagguagaaacagaaaagaaagacguucuugauuuu

SEQ ID NO: 248227 - RNA, 62 nt, hsa
cugaugauuuggguucuuuuccauaguccaaagaaacagaucagcucuucagguaucauguu

SEQ ID NO: 248228 - RNA, 55 nt, hsa
gcaaggagcagaagacauagacguugaaacagaaacagaaggaugaaggacaguu

SEQ ID NO: 248229 - RNA, 61 nt, hsa
gcaaggagcagaagacauagacguugaaacagaaacagaaggaugaaggacaguuuuuucc

SEQ ID NO: 248230 - RNA, 62 nt, hsa
ugcaugugauggugccugagaccccugccuuagaaacagaauuccuaaggggauugacucuc

SEQ ID NO: 248231 - RNA, 62 nt, hsa
aaguagugccacugcagugucuuuuuaaacuggaaacagaauuggaaaacugccugacuuau

SEQ ID NO: 248232 - RNA, 62 nt, hsa
gcagaagcaaagagcagacacacauacagccugaaacagaccuggacagacagacacagccu

SEQ ID NO: 248233 - RNA, 62 nt, hsa
cugaaacagaccuggacagacagacacagccugaaacagacccggacagacagacacagccu

SEQ ID NO: 248234 - RNA, 62 nt, hsa
cugaaacagacccggacagacagacacagccugaaacagacccagacaaacagacagacaga

SEQ ID NO: 248235 - RNA, 62 nt, hsa
gacccagacaaacagacagacagacacagccugaaacagacccagacagacagacagacagc

SEQ ID NO: 248236 - RNA, 62 nt, hsa
gaaacagacccagacagacagacagacagccugaaacagacccagacacagccugaaacaga

SEQ ID NO: 248237 - RNA, 62 nt, hsa
cagacagccugaaacagacccagacacagccugaaacagauccggacagacagacagaaaca

SEQ ID NO: 248238 - RNA, 62 nt, hsa
aacagauccggacagacagacagaaacagccugaaacagacccagacagacagacagacaca

SEQ ID NO: 248239 - RNA, 62 nt, hsa
aacagacccagacagacagacagacacagccugaaacagacccggacagacagacagacaca

SEQ ID NO: 248240 - RNA, 62 nt, hsa
aacagacccggacagacagacagacacagccugaaacagacccggacagacagacagacaca

SEQ ID NO: 248241 - RNA, 62 nt, hsa; identical to SEQ ID NO: 248240

SEQ ID NO: 248242 - RNA, 62 nt, hsa
aacagacccggacagacagacagacacagccugaaacagaccuagacagacagacacagauu

SEQ ID NO: 248243 - RNA, 62 nt, hsa
cugaaacagaccuagacagacagacacagauugaaacagacccagacaaacagacagacaca

SEQ ID NO: 248244 - RNA, 62 nt, hsa
aacagacccagacaaacagacagacacagccugaaacagacccagacacagccugaaacaga

SEQ ID NO: 248245 - RNA, 62 nt, hsa
gacacagccugaaacagacccagacacagccugaaacagacccggacagacagacagacaca

SEQ ID NO: 248246 - RNA, 62 nt, hsa
aacagacccggacagacagacagacacagccugaaacagacccagacagacagacagacaca

SEQ ID NO: 248247 - RNA, 62 nt, hsa
aacagacccagacagacagacagacacagccugaaacagacccagacagacagaccgacgca

SEQ ID NO: 248248 - RNA, 62 nt, hsa
aacagaccuggacagacaggcagacguagucugaaacagaccugaacagacagacagacgca

SEQ ID NO: 248249 - RNA, 62 nt, hsa
ccugcuuuagagacacaggaugauucagaccggaaacagaccucguggguguaagaggaagc

SEQ ID NO: 248250 - RNA, 62 nt, hsa
gaauacgggauugcacuuacucuuucaucacggaaacagaccccccgagagaagccccaacg

SEQ ID NO: 248251 - RNA, 62 nt, hsa
uuucagccaugggguugaguuggccauuaaaagaaacagagacuucucucugccauggcccu

SEQ ID NO: 248252 - RNA, 62 nt, hsa
cgacaucuugaauugcugguagaguaugugaggaaacagauacaguaccuggacuccaugaa

SEQ ID NO: 248253 - RNA, 62 nt, hsa
auauuaauuuuauuaagcaaggguucgccagagaaacagaaccaauaggauauauaagccca

SEQ ID NO: 248254 - RNA, 62 nt, hsa
acaguauuauuacauucaguauuacaauggcagaaacagacagaaaggguggaguaauuugu

SEQ ID NO: 248255 - RNA, 62 nt, hsa
aguauuuguaucuucaguucauuccacuuuaggaaacagagcugccaauugaaacagaagaa

SEQ ID NO: 248256 - RNA, 62 nt, hsa
ucauuccacuuuaggaaacagagcugccaauugaaacagaagaagaaaaaaaaaaaaagcag

SEQ ID NO: 248257 - RNA, 62 nt, hsa
uuuuauuucaccuuuaguuuugggaaaagcgagaaacagaugaucuauaggaugugaguggg

SEQ ID NO: 248258 - RNA, 62 nt, hsa
aaaaaaaaagauguuaaaacagugaaauuacagaaacagaacauagccacccuguuucauca

SEQ ID NO: 248259 - RNA, 64 nt, hsa
uuggggggacccagcaaggacucagagagucagacagugccacuuggccacuugggguaaagcc

SEQ ID NO: 248260 - RNA, 64 nt, hsa
ucagacagugccacuuggccacuugggguaaagccagugccagcaauaacaguuuaucaugcuc

SEQ ID NO: 248261 - RNA, 64 nt, hsa
cccacagccuugggcccuagguaccccagcugaucagugccaggagagaccagagccucuggag

SEQ ID NO: 248262 - RNA, 64 nt, hsa
cacacccccuccucugagcucugaauaugggacccagugccaggagcuggaagacaagguguuu

SEQ ID NO: 248263 - RNA, 64 nt, hsa
aaaccuuucccaagccuuccuggcccacaguggccagugccauaggcagugcuguggacaguag

SEQ ID NO: 248264 - RNA, 64 nt, hsa
uccagcaauacaugugcagggguugcugcuuucccagugccaggagaacccccgcuccgaguca

SEQ ID NO: 248265 - RNA, 64 nt, hsa
caucuggcauguguuucuuggauaggggccagugcagugccauccuacagguggcuggagcagc

SEQ ID NO: 248266 - RNA, 64 nt, hsa
ggcacccaguccagaaggagcaauggcaccugggcagugccagggcuuaaagcccgcugcuccu

SEQ ID NO: 248267 - RNA, 64 nt, hsa
cuggggcaguuuuaguucuuuauauuuagugggucagugccaagugcuaccacuucccaauaaa

SEQ ID NO: 248268 - RNA, 64 nt, hsa
ggucucugaggcucuuuguggcaucagccuugcccagugccacacaguaucuccuggcguucua

SEQ ID NO: 248269 - RNA, 64 nt, hsa
uuuguuaggaaaacccaugggccgccgccacacucagugccauggggaagcgggcgucuccccc

SEQ ID NO: 248270 - RNA, 64 nt, hsa
ccccagggucuaacgguuaaggggacccacauaccagugccaagggggaugucaaguggugaug

SEQ ID NO: 248271 - RNA, 64 nt, hsa
cagugauuccuuggugacagguugagggcagcuccagugccagcaauaggguggcacagaagcu

SEQ ID NO: 248272 - RNA, 64 nt, hsa
uguggagcuggacuacggcggcaguauggaauuccagugccaggccagugaccucauucccgag

SEQ ID NO: 248273 - RNA, 64 nt, hsa
cuucaccaccguauucucagucacuuccacuaaacagugccaguguuuuaagguucugucacac

SEQ ID NO: 248274 - RNA, 64 nt, hsa
agguuuguggcaggccuguguugagcaagacuaucagugccauuuuuuuucaacagcaugugcu

SEQ ID NO: 248275 - RNA, 64 nt, hsa
aggccuggccauagggcaagagcaggccuuacagcagugccacggugacccaagaggcaggguu

SEQ ID NO: 248276 - RNA, 64 nt, hsa
uuugccacucagguugcaaaauuagcuaauccuucagugccagcacucagaagucuggcaggug

SEQ ID NO: 248277 - RNA, 64 nt, hsa
uaauuucucaggauauuuuugcacugcugagaagcagugccauuaccaauuaauucuugccagg

SEQ ID NO: 248278 - RNA, 64 nt, hsa
agcuacuagaaugcagcuaaggaaagugaaauuucagugccaauuaauuaaaagauacacuguc

SEQ ID NO: 248279 - RNA, 64 nt, hsa
accggugcuggccacaccagcccccuuucaccuccagugccacaauaaaccuguacccagcugu

SEQ ID NO: 248280 - RNA, 64 nt, hsa
gggcagcaacaacggcaagacucccgugugucaccagugccacaaggucauccgguggguggcc

SEQ ID NO: 248281 - RNA, 64 nt, hsa
cauauaauacuaaucuaaacaguacuagaaauuacagugccaagagccaccaggaggcccagcc

SEQ ID NO: 248282 - RNA, 64 nt, hsa
ggagguagagcaaugaucagaugggugcacagaccagugccaaucugaacauuguuaauggccu

SEQ ID NO: 248283 - RNA, 64 nt, hsa
auguuggugccauuuucagcaauuacggcuuugacagugccaccucuuugaugccaaaucagca

SEQ ID NO: 248284 - RNA, 64 nt, hsa
gccccucaccacauacccuuugccuuuuagaacucagugccauccugggugcccagggcagagc

SEQ ID NO: 248285 - RNA, 64 nt, hsa
gccuagcccuguggcuuccaccagucuccuccugcagugccacgugguggcauuucucgccuca

SEQ ID NO: 248286 - RNA, 64 nt, hsa
uuuaaagcauucuuucuagguuauuuuggggggacagugccaaguccaucuuugcccagucaau

SEQ ID NO: 248287 - RNA, 64 nt, hsa
gcauguuuaucauauauccuuaaguggacacauacagugccauguugaugugccucucaguuuu

SEQ ID NO: 248288 - RNA, 64 nt, hsa
ggagggccuguccacacccuggauccccguaccacagugccagccaugcccuuccccugggcua

SEQ ID NO: 248289 - RNA, 64 nt, hsa
caggugccaaagagcaggccggccagggcuggggcagugccagacucugaucugaggaccccgu

SEQ ID NO: 248290 - RNA, 64 nt, hsa
caaaacagccacaauaaucagagauggagcaaaccagugccauccagucuuuaugcaaaugaaa

SEQ ID NO: 248291 - RNA, 54 nt, hsa
ugggccucccaauagacuaacaggcagugccaguuggacccaagagaagacugc

SEQ ID NO: 248292 - RNA, 64 nt, hsa
uguugauguuuccugcccaaaggacacauuugggcagugccacccacuccuugggccccuagga

SEQ ID NO: 248293 - RNA, 64 nt, hsa
cuccccugacaaucuggaagguuccuuuugcccucagugccagccaauccgggcaggacccucg

SEQ ID NO: 248294 - RNA, 64 nt, hsa
gauuuccauuucagccaguggguagcugauaagccagugccagcauccagcaugagcagauguc

SEQ ID NO: 248295 - RNA, 64 nt, hsa
cagcguuacugcucuccuucccuucaugauaagccagugccagcauccagcgugagcagacguc

SEQ ID NO: 248296 - RNA, 64 nt, hsa
ccuccuggcugcaggcacccccagccagaacacgcagugccagccgugccccccaggcaccuuc

SEQ ID NO: 248297 - RNA, 64 nt, hsa
aggcaccuucucagccagcagcuccagcucagagcagugccagccccaccgcaacugcacggcc

SEQ ID NO: 248298 - RNA, 64 nt, hsa
uaugccccaccugcccugcuuccuggcuccuuaucagugccaugagggcagaggugcuaccugg

SEQ ID NO: 248299 - RNA, 64 nt, hsa
ggaggcuagaacagagaagcccuuacuccugguucagugccacgcagggcagaggagagcagcu

SEQ ID NO: 248300 - RNA, 64 nt, hsa; identical to SEQ ID NO: 175237

SEQ ID NO: 248301 - RNA, 64 nt, hsa; identical to SEQ ID NO: 175238

SEQ ID NO: 248302 - RNA, 64 nt, hsa; identical to SEQ ID NO: 175239

SEQ ID NO: 248303 - RNA, 64 nt, hsa; identical to SEQ ID NO: 175240

SEQ ID NO: 248304 - RNA, 64 nt, hsa; identical to SEQ ID NO: 175241

SEQ ID NO: 248305 - RNA, 64 nt, hsa; identical to SEQ ID NO: 175242

SEQ ID NO: 248306 - RNA, 64 nt, hsa; identical to SEQ ID NO: 175243

SEQ ID NO: 248307 - RNA, 64 nt, hsa; identical to SEQ ID NO: 175244

SEQ ID NO: 248308 - RNA, 64 nt, hsa; identical to SEQ ID NO: 175245

SEQ ID NO: 248309 - RNA, 64 nt, hsa; identical to SEQ ID NO: 175246

SEQ ID NO: 248310 - RNA, 64 nt, hsa; identical to SEQ ID NO: 175247

SEQ ID NO: 248311 - RNA, 64 nt, hsa; identical to SEQ ID NO: 175248

SEQ ID NO: 248312 - RNA, 64 nt, hsa; identical to SEQ ID NO: 175249

SEQ ID NO: 248313 - RNA, 64 nt, hsa; identical to SEQ ID NO: 175250

SEQ ID NO: 248314 - RNA, 64 nt, hsa; identical to SEQ ID NO: 175251

SEQ ID NO: 248315 - RNA, 64 nt, hsa; identical to SEQ ID NO: 175252

SEQ ID NO: 248316 - RNA, 64 nt, hsa; identical to SEQ ID NO: 175253

SEQ ID NO: 248317 - RNA, 64 nt, hsa; identical to SEQ ID NO: 175254

SEQ ID NO: 248318 - RNA, 64 nt, hsa; identical to SEQ ID NO: 175255

SEQ ID NO: 248319 - RNA, 64 nt, hsa; identical to SEQ ID NO: 175256

SEQ ID NO: 248320 - RNA, 64 nt, hsa; identical to SEQ ID NO: 175257

SEQ ID NO: 248321 - RNA, 64 nt, hsa; identical to SEQ ID NO: 175258

SEQ ID NO: 248322 - RNA, 64 nt, hsa; identical to SEQ ID NO: 175259

SEQ ID NO: 248323 - RNA, 64 nt, hsa; identical to SEQ ID NO: 175260

SEQ ID NO: 248324 - RNA, 64 nt, hsa; identical to SEQ ID NO: 175261

SEQ ID NO: 248325 - RNA, 64 nt, hsa; identical to SEQ ID NO: 175262

SEQ ID NO: 248326 - RNA, 64 nt, hsa; identical to SEQ ID NO: 175263

SEQ ID NO: 248327 - RNA, 64 nt, hsa; identical to SEQ ID NO: 175264

SEQ ID NO: 248328 - RNA, 64 nt, hsa; identical to SEQ ID NO: 175265

SEQ ID NO: 248329 - RNA, 64 nt, hsa; identical to SEQ ID NO: 175266

SEQ ID NO: 248330 - RNA, 64 nt, hsa; identical to SEQ ID NO: 175267

SEQ ID NO: 248331 - RNA, 64 nt, hsa; identical to SEQ ID NO: 175268

SEQ ID NO: 248332 - RNA, 64 nt, hsa; identical to SEQ ID NO: 175269

SEQ ID NO: 248333 - RNA, 64 nt, hsa; identical to SEQ ID NO: 175270

SEQ ID NO: 248334 - RNA, 64 nt, hsa; identical to SEQ ID NO: 175271

SEQ ID NO: 248335 - RNA, 64 nt, hsa; identical to SEQ ID NO: 175272

SEQ ID NO: 248336 - RNA, 64 nt, hsa; identical to SEQ ID NO: 175273

SEQ ID NO: 248337 - RNA, 64 nt, hsa; identical to SEQ ID NO: 175274

SEQ ID NO: 248338 - RNA, 64 nt, hsa; identical to SEQ ID NO: 175275

SEQ ID NO: 248339 - RNA, 64 nt, hsa; identical to SEQ ID NO: 175276

SEQ ID NO: 248340 - RNA, 64 nt, hsa; identical to SEQ ID NO: 175277

SEQ ID NO: 248341 - RNA, 64 nt, hsa; identical to SEQ ID NO: 175278

SEQ ID NO: 248342 - RNA, 64 nt, hsa; identical to SEQ ID NO: 130466

SEQ ID NO: 248343 - RNA, 64 nt, hsa; identical to SEQ ID NO: 130467

SEQ ID NO: 248344 - RNA, 64 nt, hsa; identical to SEQ ID NO: 130468

SEQ ID NO: 248345 - RNA, 64 nt, hsa; identical to SEQ ID NO: 130469

SEQ ID NO: 248346 - RNA, 64 nt, hsa; identical to SEQ ID NO: 130470

SEQ ID NO: 248347 - RNA, 64 nt, hsa; identical to SEQ ID NO: 130471

SEQ ID NO: 248348 - RNA, 64 nt, hsa; identical to SEQ ID NO: 130472

SEQ ID NO: 248349 - RNA, 64 nt, hsa; identical to SEQ ID NO: 130473

SEQ ID NO: 248350 - RNA, 64 nt, hsa; identical to SEQ ID NO: 130474

SEQ ID NO: 248351 - RNA, 64 nt, hsa; identical to SEQ ID NO: 130475

SEQ ID NO: 248352 - RNA, 64 nt, hsa; identical to SEQ ID NO: 130476

SEQ ID NO: 248353 - RNA, 64 nt, hsa; identical to SEQ ID NO: 130477

SEQ ID NO: 248354 - RNA, 64 nt, hsa; identical to SEQ ID NO: 130478

SEQ ID NO: 248355 - RNA, 64 nt, hsa; identical to SEQ ID NO: 130479

SEQ ID NO: 248356 - RNA, 64 nt, hsa; identical to SEQ ID NO: 130480

SEQ ID NO: 248357 - RNA, 64 nt, hsa; identical to SEQ ID NO: 130481

SEQ ID NO: 248358 - RNA, 64 nt, hsa; identical to SEQ ID NO: 130482

SEQ ID NO: 248359 - RNA, 64 nt, hsa; identical to SEQ ID NO: 130483

SEQ ID NO: 248360 - RNA, 64 nt, hsa; identical to SEQ ID NO: 130484

SEQ ID NO: 248361 - RNA, 64 nt, hsa; identical to SEQ ID NO: 130485

SEQ ID NO: 248362 - RNA, 64 nt, hsa; identical to SEQ ID NO: 130486

SEQ ID NO: 248363 - RNA, 64 nt, hsa; identical to SEQ ID NO: 130487

SEQ ID NO: 248364 - RNA, 64 nt, hsa; identical to SEQ ID NO: 130488

SEQ ID NO: 248365 - RNA, 64 nt, hsa; identical to SEQ ID NO: 130489

SEQ ID NO: 248366 - RNA, 64 nt, hsa; identical to SEQ ID NO: 130490

SEQ ID NO: 248367 - RNA, 64 nt, hsa; identical to SEQ ID NO: 130491

SEQ ID NO: 248368 - RNA, 64 nt, hsa
uaacaaauucuuaggucaauaugugaaugcuuuuagaagcuaagcuguggcucaacucauccgg

SEQ ID NO: 248369 - RNA, 64 nt, hsa
uucaaaaauugauuguggugccucaggugaaaugagaagcuaucaguaacagcuacucucaucg

SEQ ID NO: 248370 - RNA, 64 nt, hsa
auaauaaaguaaaaauaaaaauaaaaaaguaaucagaagcuaaaguaaaguuccuuuccuggug

SEQ ID NO: 248371 - RNA, 64 nt, hsa
ucaguaucuauuccaagauacugaggucauaaucagaagcuaagcugggugcaguggcucaugc

SEQ ID NO: 248372 - RNA, 64 nt, hsa
cuacagccuggacuuaccaccacuaaacugcgagagaagcuaaacguguuuauuuucccuuaaa

SEQ ID NO: 248373 - RNA, 64 nt, hsa
gcccgcugcaguuucuugggacauaggagcgcaaagaagcuacagccuggacuuaccaccacua

SEQ ID NO: 248374 - RNA, 64 nt, hsa
ucuaacucagaaugggauuaaaaauuuuagaagcagaagcuaauauauaaaugaaguuugggau

SEQ ID NO: 248375 - RNA, 64 nt, hsa
ggauaauagagaaguccauuuaaaaauuauuuuuagaagcuaaagaaaguaauuaugcuuccug

SEQ ID NO: 248376 - RNA, 64 nt, hsa
aaaaaaaaaaaaaaaaaagagagagugugugauuagaagcuaaauaggaaaguuuugagcuuca

SEQ ID NO: 248377 - RNA, 64 nt, hsa
agacuccguuuccaaaaaaauaagagagaauagaagaagcuacugcaugauguuaguuaccaag

SEQ ID NO: 248378 - RNA, 64 nt, hsa; identical to SEQ ID NO: 167088

SEQ ID NO: 248379 - RNA, 64 nt, hsa; identical to SEQ ID NO: 167089

SEQ ID NO: 248380 - RNA, 64 nt, hsa; identical to SEQ ID NO: 167090

SEQ ID NO: 248381 - RNA, 64 nt, hsa; identical to SEQ ID NO: 167091

SEQ ID NO: 248382 - RNA, 64 nt, hsa; identical to SEQ ID NO: 167092

SEQ ID NO: 248383 - RNA, 64 nt, hsa; identical to SEQ ID NO: 167093

SEQ ID NO: 248384 - RNA, 64 nt, hsa; identical to SEQ ID NO: 167094

SEQ ID NO: 248385 - RNA, 64 nt, hsa; identical to SEQ ID NO: 167095

SEQ ID NO: 248386 - RNA, 64 nt, hsa; identical to SEQ ID NO: 167096

SEQ ID NO: 248387 - RNA, 64 nt, hsa; identical to SEQ ID NO: 167097

SEQ ID NO: 248388 - RNA, 64 nt, hsa; identical to SEQ ID NO: 167098

SEQ ID NO: 248389 - RNA, 64 nt, hsa; identical to SEQ ID NO: 167099

SEQ ID NO: 248390 - RNA, 64 nt, hsa; identical to SEQ ID NO: 167100

SEQ ID NO: 248391 - RNA, 64 nt, hsa; identical to SEQ ID NO: 167101

SEQ ID NO: 248392 - RNA, 64 nt, hsa; identical to SEQ ID NO: 167102

SEQ ID NO: 248393 - RNA, 64 nt, hsa; identical to SEQ ID NO: 167103

SEQ ID NO: 248394 - RNA, 64 nt, hsa; identical to SEQ ID NO: 167104

SEQ ID NO: 248395 - RNA, 64 nt, hsa; identical to SEQ ID NO: 167105

SEQ ID NO: 248396 - RNA, 64 nt, hsa; identical to SEQ ID NO: 167106

SEQ ID NO: 248397 - RNA, 64 nt, hsa; identical to SEQ ID NO: 167107

SEQ ID NO: 248398 - RNA, 64 nt, hsa; identical to SEQ ID NO: 167108

SEQ ID NO: 248399 - RNA, 64 nt, hsa; identical to SEQ ID NO: 167109

SEQ ID NO: 248400 - RNA, 64 nt, hsa; identical to SEQ ID NO: 167110

SEQ ID NO: 248401 - RNA, 64 nt, hsa; identical to SEQ ID NO: 167111

SEQ ID NO: 248402 - RNA, 64 nt, hsa; identical to SEQ ID NO: 167112

SEQ ID NO: 248403 - RNA, 64 nt, hsa; identical to SEQ ID NO: 167113

SEQ ID NO: 248404 - RNA, 64 nt, hsa; identical to SEQ ID NO: 167114

SEQ ID NO: 248405 - RNA, 64 nt, hsa; identical to SEQ ID NO: 167115

SEQ ID NO: 248406 - RNA, 64 nt, hsa; identical to SEQ ID NO: 167116

SEQ ID NO: 248407 - RNA, 64 nt, hsa; identical to SEQ ID NO: 167117

SEQ ID NO: 248408 - RNA, 64 nt, hsa; identical to SEQ ID NO: 167118

SEQ ID NO: 248409 - RNA, 64 nt, hsa; identical to SEQ ID NO: 167119

SEQ ID NO: 248410 - RNA, 64 nt, hsa; identical to SEQ ID NO: 167120

SEQ ID NO: 248411 - RNA, 64 nt, hsa; identical to SEQ ID NO: 167121

SEQ ID NO: 248412 - RNA, 64 nt, hsa; identical to SEQ ID NO: 167122

SEQ ID NO: 248413 - RNA, 64 nt, hsa; identical to SEQ ID NO: 167123

SEQ ID NO: 248414 - RNA, 64 nt, hsa; identical to SEQ ID NO: 167124

SEQ ID NO: 248415 - RNA, 64 nt, hsa; identical to SEQ ID NO: 167125

SEQ ID NO: 248416 - RNA, 64 nt, hsa; identical to SEQ ID NO: 167126

SEQ ID NO: 248417 - RNA, 64 nt, hsa; identical to SEQ ID NO: 167127

SEQ ID NO: 248418 - RNA, 64 nt, hsa; identical to SEQ ID NO: 167128

SEQ ID NO: 248419 - RNA, 64 nt, hsa; identical to SEQ ID NO: 167129

SEQ ID NO: 248420 - RNA, 64 nt, hsa; identical to SEQ ID NO: 167130

SEQ ID NO: 248421 - RNA, 64 nt, hsa; identical to SEQ ID NO: 167131

SEQ ID NO: 248422 - RNA, 64 nt, hsa; identical to SEQ ID NO: 167132

SEQ ID NO: 248423 - RNA, 64 nt, hsa; identical to SEQ ID NO: 167133

SEQ ID NO: 248424 - RNA, 64 nt, hsa; identical to SEQ ID NO: 167134

SEQ ID NO: 248425 - RNA, 64 nt, hsa; identical to SEQ ID NO: 167135

SEQ ID NO: 248426 - RNA, 64 nt, hsa; identical to SEQ ID NO: 167136

SEQ ID NO: 248427 - RNA, 64 nt, hsa; identical to SEQ ID NO: 167137

SEQ ID NO: 248428 - RNA, 64 nt, hsa; identical to SEQ ID NO: 167138

SEQ ID NO: 248429 - RNA, 64 nt, hsa; identical to SEQ ID NO: 167139

SEQ ID NO: 248430 - RNA, 64 nt, hsa; identical to SEQ ID NO: 167140

SEQ ID NO: 248431 - RNA, 64 nt, hsa; identical to SEQ ID NO: 167141

SEQ ID NO: 248432 - RNA, 64 nt, hsa; identical to SEQ ID NO: 167142

SEQ ID NO: 248433 - RNA, 64 nt, hsa; identical to SEQ ID NO: 167143

SEQ ID NO: 248434 - RNA, 64 nt, hsa; identical to SEQ ID NO: 167144

SEQ ID NO: 248435 - RNA, 64 nt, hsa; identical to SEQ ID NO: 167145

SEQ ID NO: 248436 - RNA, 64 nt, hsa; identical to SEQ ID NO: 167146

SEQ ID NO: 248437 - RNA, 64 nt, hsa; identical to SEQ ID NO: 167147

SEQ ID NO: 248438 - RNA, 64 nt, hsa; identical to SEQ ID NO: 167148

SEQ ID NO: 248439 - RNA, 64 nt, hsa; identical to SEQ ID NO: 167149

SEQ ID NO: 248440 - RNA, 64 nt, hsa; identical to SEQ ID NO: 167150

SEQ ID NO: 248441 - RNA, 64 nt, hsa; identical to SEQ ID NO: 167151

SEQ ID NO: 248442 - RNA, 64 nt, hsa; identical to SEQ ID NO: 167152

SEQ ID NO: 248443 - RNA, 64 nt, hsa; identical to SEQ ID NO: 167153

SEQ ID NO: 248444 - RNA, 64 nt, hsa; identical to SEQ ID NO: 167154

SEQ ID NO: 248445 - RNA, 64 nt, hsa; identical to SEQ ID NO: 167155

SEQ ID NO: 248446 - RNA, 64 nt, hsa; identical to SEQ ID NO: 167156

SEQ ID NO: 248447 - RNA, 64 nt, hsa; identical to SEQ ID NO: 167157

SEQ ID NO: 248448 - RNA, 64 nt, hsa; identical to SEQ ID NO: 167158

SEQ ID NO: 248449 - RNA, 64 nt, hsa; identical to SEQ ID NO: 167159

SEQ ID NO: 248450 - RNA, 64 nt, hsa; identical to SEQ ID NO: 167160

SEQ ID NO: 248451 - RNA, 64 nt, hsa; identical to SEQ ID NO: 167161

SEQ ID NO: 248452 - RNA, 64 nt, hsa; identical to SEQ ID NO: 167162

SEQ ID NO: 248453 - RNA, 64 nt, hsa; identical to SEQ ID NO: 167163

SEQ ID NO: 248454 - RNA, 64 nt, hsa; identical to SEQ ID NO: 167164

SEQ ID NO: 248455 - RNA, 64 nt, hsa; identical to SEQ ID NO: 167165

SEQ ID NO: 248456 - RNA, 64 nt, hsa; identical to SEQ ID NO: 167166

SEQ ID NO: 248457 - RNA, 64 nt, hsa; identical to SEQ ID NO: 167167

SEQ ID NO: 248458 - RNA, 64 nt, hsa; identical to SEQ ID NO: 167168

SEQ ID NO: 248459 - RNA, 64 nt, hsa; identical to SEQ ID NO: 159137

SEQ ID NO: 248460 - RNA, 64 nt, hsa; identical to SEQ ID NO: 159138

SEQ ID NO: 248461 - RNA, 64 nt, hsa; identical to SEQ ID NO: 159139

SEQ ID NO: 248462 - RNA, 64 nt, hsa; identical to SEQ ID NO: 159140

SEQ ID NO: 248463 - RNA, 64 nt, hsa; identical to SEQ ID NO: 159141

SEQ ID NO: 248464 - RNA, 64 nt, hsa; identical to SEQ ID NO: 159142

SEQ ID NO: 248465 - RNA, 64 nt, hsa; identical to SEQ ID NO: 159143

SEQ ID NO: 248466 - RNA, 64 nt, hsa; identical to SEQ ID NO: 159144

SEQ ID NO: 248467 - RNA, 64 nt, hsa; identical to SEQ ID NO: 159145

SEQ ID NO: 248468 - RNA, 64 nt, hsa; identical to SEQ ID NO: 159146

SEQ ID NO: 248469 - RNA, 64 nt, hsa; identical to SEQ ID NO: 159147

SEQ ID NO: 248470 - RNA, 64 nt, hsa; identical to SEQ ID NO: 159148

SEQ ID NO: 248471 - RNA, 64 nt, hsa; identical to SEQ ID NO: 159149

SEQ ID NO: 248472 - RNA, 64 nt, hsa; identical to SEQ ID NO: 159150

SEQ ID NO: 248473 - RNA, 64 nt, hsa; identical to SEQ ID NO: 159151

SEQ ID NO: 248474 - RNA, 64 nt, hsa; identical to SEQ ID NO: 159152

SEQ ID NO: 248475 - RNA, 64 nt, hsa; identical to SEQ ID NO: 159153

SEQ ID NO: 248476 - RNA, 64 nt, hsa; identical to SEQ ID NO: 159154

SEQ ID NO: 248477 - RNA, 64 nt, hsa; identical to SEQ ID NO: 159155

SEQ ID NO: 248478 - RNA, 64 nt, hsa; identical to SEQ ID NO: 159156

SEQ ID NO: 248479 - RNA, 64 nt, hsa; identical to SEQ ID NO: 159157

SEQ ID NO: 248480 - RNA, 64 nt, hsa; identical to SEQ ID NO: 159158

SEQ ID NO: 248481 - RNA, 64 nt, hsa; identical to SEQ ID NO: 159159

SEQ ID NO: 248482 - RNA, 64 nt, hsa; identical to SEQ ID NO: 159160

SEQ ID NO: 248483 - RNA, 64 nt, hsa; identical to SEQ ID NO: 159161

SEQ ID NO: 248484 - RNA, 64 nt, hsa; identical to SEQ ID NO: 159162

SEQ ID NO: 248485 - RNA, 60 nt, hsa
ucucauaucagagucaucauuuuucuuccuguggaauaaaaugccuuguggacuucccaa

SEQ ID NO: 248486 - RNA, 60 nt, hsa
uaaucuuauuuuguuugggaguaacaaaucguggaauauuuuuaaggaaaacuguuguau

SEQ ID NO: 248487 - RNA, 60 nt, hsa
uguaauauaggauccuggaaaugagaccugguggaauauuauuuucaacuguagucuuuc

SEQ ID NO: 248488 - RNA, 60 nt, hsa
cuucucuugccaccucaggggcuuggauauguggaauagugaacuggggccaugucaguu

SEQ ID NO: 248489 - RNA, 60 nt, hsa
aaaaacugcugacuguuuucucuugagaggguggaauauccaauauucgcugugucagca

SEQ ID NO: 248490 - RNA, 60 nt, hsa
aucuagauuuaaauauauuugucaaugaauguggaauagaaaaucuaaacaugacaauaa

SEQ ID NO: 248491 - RNA, 60 nt, hsa
guuauacuuuuaaugguaguauguuuuuagguggaauaaauuaauaugugauugguuuca

SEQ ID NO: 248492 - RNA, 60 nt, hsa
ucccacgcuacccccugccuugggagguguguggaauaaauuauuuuuguuaaggcaagc

SEQ ID NO: 248493 - RNA, 60 nt, hsa
auaauuuuuuuaacuuuuuaaggaacagauguggaauacacuggcccauauuucaaccuu

SEQ ID NO: 248494 - RNA, 60 nt, hsa
cugugcugggguuugaacuaaaagccauauguggaauauugacauguguaagaagcacuu

SEQ ID NO: 248495 - RNA, 60 nt, hsa
uauuuuauuucugauguuuuauuugcacuuguggaauauguuaccauuaaucagaaacau

SEQ ID NO: 248496 - RNA, 60 nt, hsa
gggcagguccaaggccugcaccuucaagaaguggaauaaauguggccuuugcuucuguuu

SEQ ID NO: 248497 - RNA, 60 nt, hsa
aauugaaccaaugacuacuuaggauggguuguggaauaaguuuugauguggaauugcaca

SEQ ID NO: 248498 - RNA, 60 nt, hsa
caaucuaaaagcagugccacacccuccaaaguggaauagaaagaaguucaugaguaaggg

SEQ ID NO: 248499 - RNA, 60 nt, hsa
aucuucgaaacugggcagagaaaaaauaaaguggaauauuaaguaaaaguugggcacuaa

SEQ ID NO: 248500 - RNA, 60 nt, hsa
uaggacaugcuguggaugaagauaaagaugguggaauagguuuuaucacaucucuuauuu

SEQ ID NO: 248501 - RNA, 60 nt, hsa
uggguuuuuucucccccuucaccaggguggguggaauaaguugauuuggccaauguguaa

SEQ ID NO: 248502 - RNA, 60 nt, hsa
uaaacuuugauuugucaaauuuuaugcuguguggaauacuaacuauauguauuuuaacuu

SEQ ID NO: 248503 - RNA, 60 nt, hsa
gguaacauuaccuuccccagccacagguauguggaauacggugaggaaaaaaaaaauuaa

SEQ ID NO: 248504 - RNA, 60 nt, hsa
ccuugggggaugguuugggccgaauggggaguggaauauuugacauuuuuccuguuuuaa

SEQ ID NO: 248505 - RNA, 60 nt, hsa
ugguuuguagacuuccuuuauaauauuucaguggaauagaugucucaaaaauccuuaugc

SEQ ID NO: 248506 - RNA, 60 nt, hsa
aaauuuuuugaaaauagagcaauacuuuuuguggaauacuagcuaacuaauucugucauu

SEQ ID NO: 248507 - RNA, 60 nt, hsa
auuuauagucaaguguuuacacuuuuuccuguggaauaauuaugucuaacuuuuuacgug

SEQ ID NO: 248508 - RNA, 60 nt, hsa
cauuugugcuacuuuguuagaaaauacugaguggaauaacuuguuagaaugaggguuaaa

SEQ ID NO: 248509 - RNA, 60 nt, hsa
ggugucuuacucccuggaagccugaaauggguggaauagcgguaaggcuugaguaaaacu

SEQ ID NO: 248510 - RNA, 60 nt, hsa
gagcagcuugcuuuagccugcucccacucuguggaauauacuuuugcuucaauaaaucug

SEQ ID NO: 248511 - RNA, 60 nt, hsa
caaauaagaccauaaagggaaaggauucauguggaauauaaagauggcugacuuugcucu

SEQ ID NO: 248512 - RNA, 60 nt, hsa
cucccaguugucccgauuguaacucaaaggguggaauaucaaggucguuuuuuucauucc

SEQ ID NO: 248513 - RNA, 60 nt, hsa
uagcuuguaucaaauguuacaguuuauauuguggaauaaauccuucguccuaacauaaca

SEQ ID NO: 248514 - RNA, 60 nt, hsa
uuauuuucagguuuuguauuuucuuuucuuguggaauauuuuaauuaauauagcauggca

SEQ ID NO: 248515 - RNA, 60 nt, hsa
gaugaccggaaacuagaaagccccuauaauguggaauaugcauauguggggugaaaccgu

SEQ ID NO: 248516 - RNA, 60 nt, hsa
guuccauuuaacauuccaacugguugcuguguggaauauggcauaauuguaauaaauuau

SEQ ID NO: 248517 - RNA, 60 nt, hsa
agcauuuaccuuuauuuaaaugaugguaagguggaauauugaauaaaauuagguuuugug

SEQ ID NO: 248518 - RNA, 60 nt, hsa
augauuuugcuagaaauagaaggcccagugguggaauauuagagggaaggaaacugacaa

SEQ ID NO: 248519 - RNA, 60 nt, hsa
augggaaggggaaggggagucuuacuauauguggaauaaacuugcucaguguugccacag

SEQ ID NO: 248520 - RNA, 60 nt, hsa
uuuaaaauuccuucugauuaaaaaaauauaguggaauacaauugucugccguuuccccuu

SEQ ID NO: 248521 - RNA, 60 nt, hsa
ucugaaagucauucacugaauuuuacacauguggaauaaacagugucuuuucuaaggcaa

SEQ ID NO: 248522 - RNA, 60 nt, hsa
gaugguagcugcacagcuugcaucaaugguguggaauaacccaagucagcaacaauuuau

SEQ ID NO: 248523 - RNA, 60 nt, hsa
uaugauuuggcuagaaagauucuuaaauauguggaauaugauuauucuuagcuggaauau

SEQ ID NO: 248524 - RNA, 60 nt, hsa
augucgauauuugcauaggagucauuuucaguggaauaacauuuuuaaugugugguuuua

SEQ ID NO: 248525 - RNA, 60 nt, hsa
ccaugccccuugggugccuggggcagagggguggaauacguuggggugccccacgauagc

SEQ ID NO: 248526 - RNA, 60 nt, hsa
uauagcuuuaaauuuugauuuauuuugacuguggaauaaauacaugaaugaaaaauuuua

SEQ ID NO: 248527 - RNA, 60 nt, hsa
auaucuuuuuccuaucuaucugaggcacugguggaauaaaaaaccuguauauuuuacuuu

SEQ ID NO: 248528 - RNA, 60 nt, hsa
uuucaaauuaguuaccaaaucauaaacagaguggaauaaauauaaaugagauucuaacua

SEQ ID NO: 248529 - RNA, 60 nt, hsa
uuuccuacuuuuccacuacuaaaaaacaguguggaauagacauuauuggcaaaauugcuc

SEQ ID NO: 248530 - RNA, 60 nt, hsa
ugagucaugaggaaacugaaucaccuagaaguggaauaaugugcucagggucaccauagc

SEQ ID NO: 248531 - RNA, 60 nt, hsa
agcgaucauacucaagaauaguacagauguguggaauacgccaauaccuuuaacuacaga

SEQ ID NO: 248532 - RNA, 60 nt, hsa
accauuucuuucagaaguaauucucagccuguggaauaauagcaggugaagacuucauag

SEQ ID NO: 248533 - RNA, 60 nt, hsa
cuaaauuaaaguauaaucauuuguauccauguggaauaaaauugugacaauuuccuacgc

SEQ ID NO: 248534 - RNA, 60 nt, hsa
cuguucacuuauaacuugccaguuucauugguggaauaaguccccuuacucaugauucau

SEQ ID NO: 248535 - RNA, 60 nt, hsa
aauugauugaguacgguuuacuaaagucauguggaauaaagccauuggaaacaaauggaa

SEQ ID NO: 248536 - RNA, 60 nt, hsa
uagauuaaggaaauaggaaacugaaacucuguggaauauaaacuuuuuaaaaauaauuuc

SEQ ID NO: 248537 - RNA, 60 nt, hsa
uguuuucauagagcccuauucucucagacgguggaauauuuggaaaaauuuuaaaacaau

SEQ ID NO: 248538 - RNA, 60 nt, hsa
ugagaaaaagaaaggauauagauuccuugaguggaauagugggcuagauuaauauaccga

SEQ ID NO: 248539 - RNA, 60 nt, hsa
auaccuuaagcuguuaacuaacuguaaggcguggaauaggaguugcucaguggauugguu

SEQ ID NO: 248540 - RNA, 60 nt, hsa
augauggccuaugguuuuaaaaauaguauuguggaauauauuuuuggguaauaagaaugg

SEQ ID NO: 248541 - RNA, 60 nt, hsa
gguuuguugaaucaaacaaaaggaaauguuguggaauauuuuuccaaguaguuuugguuc

SEQ ID NO: 248542 - RNA, 60 nt, hsa
guaauaagggggcuccaggacucccucuaaguggaauagccucccuguaacuccagcucu

SEQ ID NO: 248543 - RNA, 60 nt, hsa
ugcgugguuuugauacuuugauggauuccaguggaauaaauucaggcugcugaaacaaga

SEQ ID NO: 248544 - RNA, 60 nt, hsa
aucaaaaggcugccucuauuacaauccucaguggaauagauggcuaucuuucuuggcuaa

SEQ ID NO: 248545 - RNA, 60 nt, hsa
cuuuuuccauggggcuauaguagagaguuaguggaauauagacaggacucugaaaacaca

SEQ ID NO: 248546 - RNA, 60 nt, hsa
uguaauagggaauaggaaaccuuguuggcuguggaauauccgaugcuuugaaucaugcac

SEQ ID NO: 248547 - RNA, 60 nt, hsa
ugugguugggaaaaauaaaaauacagugguguggaauacuccaaaaccuagaaaugcugu

SEQ ID NO: 248548 - RNA, 60 nt, hsa
cucgcuuuaaugguaguaaacacuuaaccaguggaauagucugacugcugguacugaugg

SEQ ID NO: 248549 - RNA, 60 nt, hsa
aaguuuucauuugugccacaaaaaucugucguggaauauauuuuauuuucauuaauucag

SEQ ID NO: 248550 - RNA, 60 nt, hsa
acacaucuggaaaaccuccggcucucugugguggaauacccuucuaauaaaaggguaacc

SEQ ID NO: 248551 - RNA, 60 nt, hsa
caaaaccaagaccuuucugcagggaugauaguggaauaauaaugugggauuagcccgcua

SEQ ID NO: 248552 - RNA, 60 nt, hsa
uuguggcauggcagcaaaugccaacauuuuguggaauagcagcaaaucuacaagagaccc

SEQ ID NO: 248553 - RNA, 60 nt, hsa
gcuguaggcagacccccugaaacuauugcuguggaauaaaagaugaaaugcuccugauua

SEQ ID NO: 248554 - RNA, 60 nt, hsa
ggcacagaaaaguauuagguguuuuucuuaguggaauauuagaaaugaucauauucauua

SEQ ID NO: 248555 - RNA, 60 nt, hsa
cucuuggaugucauuugaucggaauaugcaguggaauaggugacucacugaaaugccuuu

SEQ ID NO: 248556 - RNA, 60 nt, hsa
guuuccucaugaaaucuaaguaauuuuguuguggaauagugucacuguuacauuuccccc

SEQ ID NO: 248557 - RNA, 60 nt, hsa
uuuaauuuauuauugaaauuguacauauuuguggaauaauguaaaauguugaauaaaaau

SEQ ID NO: 248558 - RNA, 60 nt, hsa
ucuuuuagcccauuuuucuagacugucucuguggaauauauuugugugugugauauaugc

SEQ ID NO: 248559 - RNA, 60 nt, hsa
ugaacaaaacaaaaaaacaaggcugccacaguggaauauuaucuuacaagaauaagaacu

SEQ ID NO: 248560 - RNA, 60 nt, hsa
ucuccuuuuugcccuggauuguugacaugaguggaauacuugguuucuuuucuuacuuau

SEQ ID NO: 248561 - RNA, 60 nt, hsa
gagcauauguacacagacaagggggauguuguggaauauggcaauagcauuguucuucuc

SEQ ID NO: 248562 - RNA, 60 nt, hsa
uggugaaggauccaggaauaugacacaaagguggaauaaacauuaauuuugugcauucuu

SEQ ID NO: 248563 - RNA, 60 nt, hsa
ccaccuccucccccagccuaucucaaacugguggaauauauggagagaucuugaaagagg

SEQ ID NO: 248564 - RNA, 60 nt, hsa
cauaugaaaauacaacuuaaauaauaaacaguggaauauaaggaaagcaauaaaugaaug

SEQ ID NO: 248565 - RNA, 60 nt, hsa
gcuucucagauaguuuugauguguuguacaguggaauaucuuagauacuuuuuggaaagu

SEQ ID NO: 248566 - RNA, 60 nt, hsa
ggccacuccaauaggugcugaguguacagaguggaauaagacagagaccugcccucaaga

SEQ ID NO: 248567 - RNA, 60 nt, hsa
auagucuugcuuauuuuguugcgaaggccaguggaauauaaaaaucaauggcauuaauga

SEQ ID NO: 248568 - RNA, 60 nt, hsa
cacaagauuuagcaaaaagauaaagcuuggguggaauaucauuuuaaaauguucauguuc

SEQ ID NO: 248569 - RNA, 60 nt, hsa
uucagauauauucuaaguauuuuaccagcuguggaauaaguuguguuuguccaucacugu

SEQ ID NO: 248570 - RNA, 60 nt, hsa
aaauaauaaaauucaagaagcauauucuauguggaauagauccuguuuuuccaucugugu

SEQ ID NO: 248571 - RNA, 60 nt, hsa
uuuguaaccuggcacaguuucccucauccuguggaauaagaaaaugggauagaucuggaa

SEQ ID NO: 248572 - RNA, 60 nt, hsa
cuuucccucuuucccugggauugacucugaguggaauaccuuggcacauccacuaggauc

SEQ ID NO: 248573 - RNA, 60 nt, hsa
ugcccuucuccgguuguguguacaguauguguggaauaaaaaagggaaacuguuuucaca

SEQ ID NO: 248574 - RNA, 60 nt, hsa
agucaaguacuccccgggccuucugagcugguggaauauuuuauuucagacugaaaacag

SEQ ID NO: 248575 - RNA, 60 nt, hsa
uuuauaagaaaaccaguauuugaacaaauuguggaauauaaauacaacuauuuuuaagua

SEQ ID NO: 248576 - RNA, 60 nt, hsa
aaauugcuuuguuuuguuuaaucagauacuguggaauaaaagcaccuuuugcuuuucuca

SEQ ID NO: 248577 - RNA, 60 nt, hsa
aauacagaggauaaagaaguuaauggcaugguggaauaaccaaaauguguaucauucuac

SEQ ID NO: 248578 - RNA, 60 nt, hsa
gcuuggaaguuuuacagcaauaauguugcaguggaauauuauuuguaguuaaggucaucc

SEQ ID NO: 248579 - RNA, 60 nt, hsa
uuagguggauuuuuggcugucauuucaaaaguggaauaaauuuauuaauuuaguaguacu

SEQ ID NO: 248580 - RNA, 60 nt, hsa
uauuaguggcuguauaguuuucuaucaaauguggaauaaacucaauuuauuucucccuuu

SEQ ID NO: 248581 - RNA, 60 nt, hsa
uuuugacucuaauacuguauaugcauuuaaguggaauauuuggugccauuuacaacauua

SEQ ID NO: 248582 - RNA, 60 nt, hsa
ccagucccaggaagugucaauguuuguugaguggaauauugaaaauguaggcagcaacug

SEQ ID NO: 248583 - RNA, 60 nt, hsa
cauuuggaccaauagcccacagcugagaauguggaauaccuaaggauagcaccgcuuuug

SEQ ID NO: 248584 - RNA, 60 nt, hsa
ucuaacacacugagggaaagauuaaaaucuguggaauaaaggaggagauuuuauuuacag

SEQ ID NO: 248585 - RNA, 60 nt, hsa
ugaucaucuccucaccccaucucccaccuuguggaauaaauacauguuagcacuucccag

SEQ ID NO: 248586 - RNA, 60 nt, hsa
cuagaauuuucuuggugcaaaguguaucauguggaauauccucauauuuuuaccauauuu

SEQ ID NO: 248587 - RNA, 60 nt, hsa
caugaaggaaggacuuaaccaggcuaccaaguggaauauaauuuaucugcuauuuuuaau

SEQ ID NO: 248588 - RNA, 60 nt, hsa
aaccugguaagauuucaggagguaaagaagguggaauaauugacggggagauagcgccug

SEQ ID NO: 248589 - RNA, 60 nt, hsa
uggcuuaaaugauuuuuucuaacuaauaaaguggaauauauauuucuacugugugucaug

SEQ ID NO: 248590 - RNA, 60 nt, hsa
aaaaacaguugcauagaguauagcucuguaguggaauaugucuucuguauaacuaggcug

SEQ ID NO: 248591 - RNA, 60 nt, hsa
uccugaaaauaacauucccuuaaacaugcuguggaauaaaauggauugugaugauuuggg

SEQ ID NO: 248592 - RNA, 60 nt, hsa
gaugguacauggaaacugugggacacagauguggaauacaagaagaagcaggaccccuac

SEQ ID NO: 248593 - RNA, 60 nt, hsa
uugagaaggaggcaggauaccuggagauuuguggaauacaguacgaguuccacaaaauuu

SEQ ID NO: 248594 - RNA, 60 nt, hsa
augcagagauauucaggguuuggauuagcaguggaauaaagagaugggcauuguuucccc

SEQ ID NO: 248595 - RNA, 60 nt, hsa
auaugcuguggcuuugagaaguuaacuuuuguggaauaugaaaccaaaggaagaauuucc

SEQ ID NO: 248596 - RNA, 60 nt, hsa
uugugauuauuugacuggaaugcuucuuaaguggaauaacuauacuccguuauccacccg

SEQ ID NO: 248597 - RNA, 60 nt, hsa
uguggcuguggauuuuuuuaacugcuaguaguggaauacuggaaaagcuucauuucugaa

SEQ ID NO: 248598 - RNA, 60 nt, hsa
ggcagucgaaccauggugaacuccaccuccguggaauaaauggagauucagcgugggugu

SEQ ID NO: 248599 - RNA, 60 nt, hsa
cuuaaaaccagagaaucuuaaggucuaacuguggaauauaaauagcugaaaacuaaugua

SEQ ID NO: 248600 - RNA, 60 nt, hsa
uugcuugugcuuuauuuuucuuagucauuuguggaauauagugauauauuguguuaauuu

SEQ ID NO: 248601 - RNA, 60 nt, hsa
uucaaugaagaaaaguauuuuugucugacaguggaauauaucuggagaccacaaguacca

SEQ ID NO: 248602 - RNA, 60 nt, hsa
gaauaucuaagucauagaaauagaagacagguggaauaaguauauguucagaguuuuuag

SEQ ID NO: 248603 - RNA, 60 nt, hsa
agacugaaugcuugugagggaauuaggaugguggaauauugguguuaccagugaaggggg

SEQ ID NO: 248604 - RNA, 60 nt, hsa
uuccuuucuuuaauuuuguaauucuuuacuguggaauagcucagaaugucaguucuguuu

SEQ ID NO: 248605 - RNA, 60 nt, hsa
guuaagaacacguguauuaaauucauguaaguggaauaaaaguuuuaugaauggacuuuu

SEQ ID NO: 248606 - RNA, 60 nt, hsa
uggauaccacauauuaaaccauguauaucuguggaauacucaauguguacaccuuugacu

SEQ ID NO: 248607 - RNA, 60 nt, hsa
auuguaagaaccccauuuagcuucuugaaaguggaauaauuuuuauaauagacuauagug

SEQ ID NO: 248608 - RNA, 60 nt, hsa
gguagagacuuuaggaaauguuuuggggugguggaauacucuauauauugacaagaguuu

SEQ ID NO: 248609 - RNA, 60 nt, hsa
uauuccagcuuccugauaacacugcuuacuguggaauauucauuugacaucugucucuuu

SEQ ID NO: 248610 - RNA, 60 nt, hsa
uaggcauagucaauuucagaauaacuaagaguggaauauaugcauauggugaaauuauaa

SEQ ID NO: 248611 - RNA, 60 nt, hsa
gccgguugcuggcaucuuaauguucuguagguggaauauuuccaauaaacacaaggugcc

SEQ ID NO: 248612 - RNA, 60 nt, hsa
auuuucaugaguccugcuucuagcuccauuguggaauacagaaaauuaaauauaccuguu

SEQ ID NO: 248613 - RNA, 60 nt, hsa
guuuaucuguguguagugagugcuucauguguggaauauucauuuucuuacugcaguggg

SEQ ID NO: 248614 - RNA, 60 nt, hsa
aucugagggacaaggggggcggucuccgaaguggaauaaaauaggccgggcguggugacu

SEQ ID NO: 248615 - RNA, 60 nt, hsa
uaacaguaagccagguucaccagaggaaauguggaauaccuaaguauaaagcagcaaaga

SEQ ID NO: 248616 - RNA, 60 nt, hsa
aggucuuuuccaucuucaguuucuaugacuguggaauaaauguucagauagaaacuucac

SEQ ID NO: 248617 - RNA, 60 nt, hsa
guugaauuuccuucagcuuuaagaggaagaguggaauaaauauucuaagugauuuaaugc

SEQ ID NO: 248618 - RNA, 60 nt, hsa
gauugauauacgugauuuaaucugcaauagguggaauaaccaggggaacugguuaugaau

SEQ ID NO: 248619 - RNA, 60 nt, hsa
aauuuugaggcuauacagccacugugcccuguggaauaaagccauauauauaaauguuuu

SEQ ID NO: 248620 - RNA, 60 nt, hsa
uaucuuaccagacugugccuaaagaauuuuguggaauacacuuuguuugcuucaugugca

SEQ ID NO: 248621 - RNA, 60 nt, hsa
guuuuuacccauggcauggguggaauuagaguggaauaaggauguuaacuugguucucag

SEQ ID NO: 248622 - RNA, 60 nt, hsa
aggagggacagaaaaguaaccucuucuuaaguggaauauucuaauaagcuaccuuuugua

SEQ ID NO: 248623 - RNA, 60 nt, hsa
uggaugcaggaauuguguuccgugcaugcaguggaauaguaccagccuuccgcaggaagg

SEQ ID NO: 248624 - RNA, 60 nt, hsa
uauuuucauaugaaacugauaaauauauauguggaauauucuuuuuaaaaacaauuuuau

SEQ ID NO: 248625 - RNA, 60 nt, hsa
ucggacguugauucuuacugaagacaaccuguggaauagaagcuggauuccaucagauuu

SEQ ID NO: 248626 - RNA, 60 nt, hsa
uuuuggagacuggcugagaugaaaggaaauguggaauaaaaggagguuuuccugaugugg

SEQ ID NO: 248627 - RNA, 60 nt, hsa
uugauggggcucugauuugcucuugcucaaguggaauaaaaccccauggucuucuugaca

SEQ ID NO: 248628 - RNA, 60 nt, hsa
acauuauauuuauagaauauaaauuugucaguggaauaaaauuuccccuuuuuuucauaa

SEQ ID NO: 248629 - RNA, 60 nt, hsa
aaaaauuucauccagccauaugccuguggaguggaauauucuguuuaguagaaaaauccu

SEQ ID NO: 248630 - RNA, 60 nt, hsa
aguuccccuggaagcagugcccagguggcuguggaauaggaacgcuauguccguguacug

SEQ ID NO: 248631 - RNA, 60 nt, hsa
aagggcauacaucucaguggcaugagcauuguggaauauccuuuccuaggcacauucguc

SEQ ID NO: 248632 - RNA, 60 nt, hsa
caguguaacccaagcauuuguggacaaugaguggaauacuaaaguuaaaaagucaaacuu

SEQ ID NO: 248633 - RNA, 60 nt, hsa
aauauuugcuuuuacugguguacaguaugaguggaauauaaacuguacacauaauuauca

SEQ ID NO: 248634 - RNA, 60 nt, hsa
ugagcuuucaggaaguugcugagaaaugggguggaauagggaacuguaauggccacugaa

SEQ ID NO: 248635 - RNA, 60 nt, hsa
uuguagagaaacccaacaaaucucauaaauguggaauaacauuuguucaaaaaugauagc

SEQ ID NO: 248636 - RNA, 60 nt, hsa
guaugguacaucuaccuaaaggacuauuauguggaauaauacauacuaaugaaguauuac

SEQ ID NO: 248637 - RNA, 60 nt, hsa
accugccuuucauaaucaccagggaauaaaguggaauaauguugauaacagugcuuggca

SEQ ID NO: 248638 - RNA, 60 nt, hsa
cgcuaauggaagaaguuuagaaucuuucagguggaauaaagucacaugaaaacaaaacac

SEQ ID NO: 248639 - RNA, 60 nt, hsa
aaacuuuugugauuuaauaauacuauuucuguggaauaauuauaaaaguaugaccuuuuu

SEQ ID NO: 248640 - RNA, 60 nt, hsa
ucuaagguuggaacucugaaguuggagaagguggaauaaaguuacaccuggaguuuguug

SEQ ID NO: 248641 - RNA, 60 nt, hsa
gcaugaggaaaauuuuuccagaacaacaguguggaauaguucugaauuaugcuguucuac

SEQ ID NO: 248642 - RNA, 60 nt, hsa
aaacauucugugaaugaaguagacucuucgguggaauauauuaauauauuacuguauauc

SEQ ID NO: 248643 - RNA, 60 nt, hsa
aaaacauuuuccugcuugucuuagaagaaaguggaauaauuccacugauugugauaaugg

SEQ ID NO: 248644 - RNA, 60 nt, hsa
ucucuuuaguauaauugaccuacuuugguaguggaauagugaauacuuacuauaauuuga

SEQ ID NO: 248645 - RNA, 60 nt, hsa
aagcugggucuuguuauuccuuggguguugguggaauaagcaguggaauuugaacaagga

SEQ ID NO: 248646 - RNA, 60 nt, hsa
ccuccacugccaagacagccugaguuuggaguggaauaagguggaagacaaaugucucug

SEQ ID NO: 248647 - RNA, 60 nt, hsa
gagaguuaaccugcuggcugugagucccuuguggaauauaaggggguagugggaaaagug

SEQ ID NO: 248648 - RNA, 60 nt, hsa
cuaucuaucuauauauauauuugauaguuuguggaauaauaucccccaguauuuuccaua

SEQ ID NO: 248649 - RNA, 60 nt, hsa
acacuggugcuaacuggcccaggcacuggaguggaauagaaugcagcuggaggcuacgca

SEQ ID NO: 248650 - RNA, 60 nt, hsa
cucccuguuuucaugucuuccuuacacuugguggaauaagaaacuuuuugaaguagagga

SEQ ID NO: 248651 - RNA, 60 nt, hsa
cccuaggaacaaguuagcacugaauuuuggguggaauaauuaguuucugaaggcuugcca

SEQ ID NO: 248652 - RNA, 60 nt, hsa
cuggucuccucagccuccucaucugggggaguggaauaguauccuccagguuuuucaauu

SEQ ID NO: 248653 - RNA, 60 nt, hsa
uuagauaaaaagauuaucuaccuuuuggggguggaauaucuuauuuuguuuuugaauuug

SEQ ID NO: 248654 - RNA, 60 nt, hsa
cucugccuguuuuccagacauacagguucuguggaauaagauacuggacuccucuuccca

SEQ ID NO: 248655 - RNA, 60 nt, hsa
ucaaaaaauucgugaggagagcugucuacaguggaauagggggucucccuggggaaugca

SEQ ID NO: 248656 - RNA, 60 nt, hsa
auguaauuauuugauaacucuuguaaauagguggaauaugaaugcuuggaaaauuaaacu

SEQ ID NO: 248657 - RNA, 60 nt, hsa
agcauuccuuuaauuuuuuaauucuuuacuguggaauagcucaaaauguccauucuguuu

SEQ ID NO: 248658 - RNA, 60 nt, hsa
guuuucaaagaucccgugaaauugaugccaguggaauacagugaguccuccucuuccucc

SEQ ID NO: 248659 - RNA, 60 nt, hsa
gucaguagccuuaugcaccuaauucaaaagguggaauauaguucugucagggcuuuuacg

SEQ ID NO: 248660 - RNA, 60 nt, hsa
cccagcaccuaguaugcucaguaaauguuuguggaauaagugcauaaaauguucuuaacc

SEQ ID NO: 248661 - RNA, 60 nt, hsa
agaguaagauauuccuugaaagcccauuaaguggaauagacuuucugaaaauaagaguuc

SEQ ID NO: 248662 - RNA, 60 nt, hsa
uucucugaaccuacaaaauaguuauacauaguggaauaaagaagguaaaccaucuguuau

SEQ ID NO: 248663 - RNA, 59 nt, hsa
uggauauuucuaauauuugauauuucaugguggaauaacacagagaaauguuuuaacug

SEQ ID NO: 248664 - RNA, 60 nt, hsa
uagugccaguucuuaugcuaagcagguuacguggaauauaucacuuaacucaaaaagccc

SEQ ID NO: 248665 - RNA, 60 nt, hsa
cugagggaaaucagaaaugauuuaaccccgguggaauacauuaauucuuaaagcggcucu

SEQ ID NO: 248666 - RNA, 60 nt, hsa
aaaacaacuaaauauucacuaauggugccaguggaauaaaucagagaacauccccugcua

SEQ ID NO: 248667 - RNA, 60 nt, hsa
agcugcuuuugcagaaaucacaauuuuccuguggaauaaagaugguccaaaaauagucaa

SEQ ID NO: 248668 - RNA, 60 nt, hsa
gaaaaagggcuugcagagaguggaaaguuaguggaauauucaugaaacuucauugcaggg

SEQ ID NO: 248669 - RNA, 60 nt, hsa
ucagucaccagacugggugcccuccgauggguggaauaagucugcuucaugccaaggcug

SEQ ID NO: 248670 - RNA, 60 nt, hsa
uaaugcuaauauuuccaucaaaauuugccuguggaauauauacaguucuuaauuuuaaac

SEQ ID NO: 248671 - RNA, 60 nt, hsa
uuuuuuccaccauuaaggcuuuaagaacauguggaauaaguuuuuuagcugcuaaugaca

SEQ ID NO: 248672 - RNA, 60 nt, hsa
ucagagauggcuuuggggcaagugcuaccuguggaauaaaccuguuuuccaggugucucu

SEQ ID NO: 248673 - RNA, 60 nt, hsa
acccaaacuagcugggaguucagaaccaugguggaauaaagaaaugugcaucuggucucu

SEQ ID NO: 248674 - RNA, 60 nt, hsa
uguaugugagggcauguuguccauaucccuguggaauacagaccguguaacuggacagcu

SEQ ID NO: 248675 - RNA, 60 nt, hsa
ucccugcuugcauugggucugggagagagaguggaauauuugguagggaccuugacagaa

SEQ ID NO: 248676 - RNA, 60 nt, hsa
gguucuacugcugugggguaaacuaacucaguggaauagggcugguuacuuugggcuguc

SEQ ID NO: 248677 - RNA, 60 nt, hsa
cuaaauacuccaucuguuuaguacuguauuguggaauauuugaguucuauuuccauacuu

SEQ ID NO: 248678 - RNA, 60 nt, hsa
ugcuuacccuggagaugcuacagagacacaguggaauagaccuugacacuaacacucuaa

SEQ ID NO: 248679 - RNA, 60 nt, hsa
augccuuuuuaagcuguuucauauugaaagguggaauauuguaaaaauuuugucaaagau

SEQ ID NO: 248680 - RNA, 60 nt, hsa
uuucaggaaguacuaguaguuaucccaaaaguggaauaagcauguauuccuaaguguuuc

SEQ ID NO: 248681 - RNA, 60 nt, hsa
uugcagguagcaguagugugugcugcuauuguggaauauacguguguagaguuuuugauu

SEQ ID NO: 248682 - RNA, 60 nt, hsa
uuuaaaaguaccaaacauaacccagaguauguggaauaugggcaacauauauauagccuu

SEQ ID NO: 248683 - RNA, 60 nt, hsa
ggguugcggggggagggauggcggguggggguggaauaaaauacuauuuuuacugccacu

SEQ ID NO: 248684 - RNA, 50 nt, hsa
agggagaagaugaugacuaaguggaauaaccuauuuugaaaaauuccuau

SEQ ID NO: 248685 - RNA, 60 nt, hsa
aaauuacauuuagauuaagaacaggcagggguggaauauaucaggaauuuauaauaaaau

SEQ ID NO: 248686 - RNA, 60 nt, hsa
ccagccuaaagcagggaucagucuuuucuuguggaauaaauccuuggaucgggaacccug

SEQ ID NO: 248687 - RNA, 60 nt, hsa
aguguucucugucugccuggcaaaggugcuguggaauaggcuuggcaugccacccuguuu

SEQ ID NO: 248688 - RNA, 60 nt, hsa
ucuugcuuuuccacaaagauauuauuuaaaguggaauauuuuuguaacugggauaccaau

SEQ ID NO: 248689 - RNA, 60 nt, hsa
ugaacuaaagacaucccccaugucccaaagguggaauacaaccagaggucucaucucuga

SEQ ID NO: 248690 - RNA, 60 nt, hsa
aucaauaaaucugaauuccgaacauguuguguggaauacucuuaaguguguuugagagua

SEQ ID NO: 248691 - RNA, 60 nt, hsa
gcccugucccuagcaccaccucuccuguguguggaauagaggccccucgugcuaccaaca

SEQ ID NO: 248692 - RNA, 60 nt, hsa
ugaacccagguugaugacagaccaguccuuguggaauaagauucccuuuaaaaacucuuu

SEQ ID NO: 248693 - RNA, 60 nt, hsa
uucauaugaucugccagagccucuccagggguggaauacauguccuggacuaagccaaug

SEQ ID NO: 248694 - RNA, 60 nt, hsa
uucucccugccuugauugagcuugagugauguggaauaaauuguccgucucuucuuucuc

SEQ ID NO: 248695 - RNA, 60 nt, hsa
agaacgggccaugaugacaauggcgguuuuguggaauagaaaaggcggaaagguggggaa

SEQ ID NO: 248696 - RNA, 60 nt, hsa
ccuuucuggccccagccuagguggaggcaaguggaauaucuuauauugggcgauuugggg

SEQ ID NO: 248697 - RNA, 60 nt, hsa
aaaaugguggguuaugugagugcugggacuguggaauaccuguacagccaggauggcagc

SEQ ID NO: 248698 - RNA, 60 nt, hsa
ccauucucauggcccuuuggucacugccggguggaauagcacuggcuucagcaggcgugu

SEQ ID NO: 248699 - RNA, 60 nt, hsa
gggaggcccuggccuccagugccuucccccguggaauaaacgguguguccugagaaacca

SEQ ID NO: 248700 - RNA, 60 nt, hsa
ccugccugugugggagggugguuacuguggguggaauaguggaggccuucaacugauuag

SEQ ID NO: 248701 - RNA, 60 nt, hsa
ccuaaacuggugaugcucaagcauuauacuguggaauacugccuuuugacaaaaauacuc

SEQ ID NO: 248702 - RNA, 60 nt, hsa
agaacaccaauauacccccuuuauuuuacuguggaauaugugcuggaaaaauugcaacaa

SEQ ID NO: 248703 - RNA, 60 nt, hsa
aacuauuuaauugugugucuauauuuuggaguggaauaauuucuucauuaaaaaauguuu

SEQ ID NO: 248704 - RNA, 60 nt, hsa
ugaaaaccugacaaaaaaaaaguuccagguguggaauauggggguuaucuguacauccug

SEQ ID NO: 248705 - RNA, 60 nt, hsa
ucagaagguuggggggauaccagagaggugguggaauaggaccgcccccuccuuacuugu

SEQ ID NO: 248706 - RNA, 50 nt, hsa
cagcucuaaacacaaauuagguggaauaaugacucgagcaggaaagcagu

SEQ ID NO: 248707 - RNA, 60 nt, hsa
gugcaggccuugggccacagggaggcgccuguggaauagggggaguucaugcaccccuuu

SEQ ID NO: 248708 - RNA, 60 nt, hsa
guaccauucugucuuuacuccguggcaucuguggaauaacccugcuaauguaacacguga

SEQ ID NO: 248709 - RNA, 60 nt, hsa
auguuuccuucauucccaaagaauauuuuuguggaauauaagauucagaguuggcaguug

SEQ ID NO: 248710 - RNA, 60 nt, hsa
gacagaauuacugaggaauugaguguaagaguggaauaaaguuaucaaggacaaugccaa

SEQ ID NO: 248711 - RNA, 60 nt, hsa
ggcaauugggguaauugauguaaauuuauaguggaauaugaccugagaccacaauuuguu

SEQ ID NO: 248712 - RNA, 60 nt, hsa
aggaaagaaaacuugaugugauugccauagguggaauaauccaacauaaauugccauaga

SEQ ID NO: 248713 - RNA, 60 nt, hsa
ugcuaauguugcaaacccaugauaauguauguggaauauccugccauugggguuuuacau

SEQ ID NO: 248714 - RNA, 60 nt, hsa
ggggccuguuuagagucagccugccacacuguggaauaggauuguugcaaggaguaagua

SEQ ID NO: 248715 - RNA, 60 nt, hsa
aaaauuggauauaacaaauuuuuaucaauuguggaauagaugaauaagugugaucauuuc

SEQ ID NO: 248716 - RNA, 60 nt, hsa
aauauauacauauauuccacauguguguauguggaauauauuccacauguguauauauuc

SEQ ID NO: 248717 - RNA, 60 nt, hsa
uauauauacauauauuccacauguguguauguggaauauauuccacauguguguaugugg

SEQ ID NO: 248718 - RNA, 60 nt, hsa
uuggucagggccucagaccagccaaccuuuguggaauaagccccagcccagccaaaccaa

SEQ ID NO: 248719 - RNA, 60 nt, hsa
acauucuugcucaaguugaugaaucaugggguggaauaaaggcugaguuuaguuuuucac

SEQ ID NO: 248720 - RNA, 60 nt, hsa
ucacuguguaguggauggaguuuacuguuuguggaauaaaaacggcuguuuccgugguuc

SEQ ID NO: 248721 - RNA, 60 nt, hsa
aggaacuuuugacuggagagaaucacagauguggaauauuugucauaaauaaauaaugaa

SEQ ID NO: 248722 - RNA, 60 nt, hsa
ucaggggauucccugaaaaauuaccugcagguggaauauuucauggacaaauuuuuuuuu

SEQ ID NO: 248723 - RNA, 60 nt, hsa
guuucuacaagacuuuauauuuuaagcuaaguggaauaauacaacguaacuaaaacaugg

SEQ ID NO: 248724 - RNA, 60 nt, hsa
ucucaggggacuugauuguucucuuagcugguggaauauguuggcuuauguguuugaacu

SEQ ID NO: 248725 - RNA, 60 nt, hsa
uuugauuucuaaugucacacuuaaaacuguguggaauaagacuuuugccauaaaaauaaa

SEQ ID NO: 248726 - RNA, 60 nt, hsa
caaugucugcagugugaaggcagguucauuguggaauaguuuaacagucaggaaggcuaa

SEQ ID NO: 248727 - RNA, 60 nt, hsa
aauacuuuuuggggucagauaaugugucagguggaauaucccugcuaggagauauaggau

SEQ ID NO: 248728 - RNA, 60 nt, hsa
cuugugugccccgucccaaggguauuacugguggaauaauauccgccccccaccccaguu

SEQ ID NO: 248729 - RNA, 60 nt, hsa
uaauugagguuuuugguuuuuuauugauuaguggaauacugucgaaguauuccuucuuuu

SEQ ID NO: 248730 - RNA, 60 nt, hsa
cggcuuuccauggagauagagaaagaaaaaguggaauacauggaaaagagcaagcaucug

SEQ ID NO: 248731 - RNA, 60 nt, hsa
ugccagggauggggccaccacugucacacuguggaauacaagacagugaacucugucugc

SEQ ID NO: 248732 - RNA, 60 nt, hsa
ugccugggguggccauggggauggaaggggguggaauaaaaccugucaaccuggcucaug

SEQ ID NO: 248733 - RNA, 60 nt, hsa
gggaccugcagagggggcugucgggacagcguggaauaaacauuauuucaaggacacaua

SEQ ID NO: 248734 - RNA, 60 nt, hsa
aguagggacuucugaaaugggggaggcaguguggaauacuguggaugucugugcagagcc

SEQ ID NO: 248735 - RNA, 60 nt, hsa
uauuuuacuuguguaaaaauaucggacgacguggaauaaagagcucuuuucuuaagcugu

SEQ ID NO: 248736 - RNA, 60 nt, hsa
ggccuggucuggaagucgacaauguuacaaguggaauaagccuuacgggugaagcucaga

SEQ ID NO: 248737 - RNA, 60 nt, hsa
gaggauuaucugccccauuuuuaaaacgagguggaauacccaaggucauguagccaguga

SEQ ID NO: 248738 - RNA, 60 nt, hsa
gguuuguuuuuccaaaguaacagaugacauguggaauaaaguaauagaguaacaaguggc

SEQ ID NO: 248739 - RNA, 60 nt, hsa
gcaucuguucaaaguuguagggcuuauaaaguggaauauaagaaugaacuaaguauguuu

SEQ ID NO: 248740 - RNA, 60 nt, hsa
aauugucuuagcuuaaaaaaagaagaaacuguggaauacuacaguaaauauuguuuucaa

SEQ ID NO: 248741 - RNA, 60 nt, hsa
gaaacugugaaggaacucugcaguuaaauaguggaauaaaguaaaggauuguuaauguuu

SEQ ID NO: 248742 - RNA, 60 nt, hsa
aaaagacuuauuaugugggguucaaauugaguggaauaaaguauagauuaaaaguauaca

SEQ ID NO: 248743 - RNA, 60 nt, hsa
uuauugucacuacaauugcuucaggcacagguggaauagaagaaaucgugaugaaauaau

SEQ ID NO: 248744 - RNA, 60 nt, hsa
cauuuaucuauaaauuuugugauuauaguaguggaauacauagaaaaaaauaugcuuuca

SEQ ID NO: 248745 - RNA, 60 nt, hsa
aggugaugauuaauuucauuuagcagggaaguggaauaauaucuuuugaaauaacuaagu

SEQ ID NO: 248746 - RNA, 60 nt, hsa
cauuuugugaauugggacauaguuacagcaguggaauaaguauucauuuagaaaugugaa

SEQ ID NO: 248747 - RNA, 60 nt, hsa
cauuuugugaguugucacauaauaacagcaguggaauauguauuugccuauauugugaac

SEQ ID NO: 248748 - RNA, 60 nt, hsa
ucuauuuugugaauugggauaauaacagcaguggaauaaguacuuagaaaugugaaaaau

SEQ ID NO: 248749 - RNA, 63 nt, hsa
ggcucuccggcaggcagcccgagaccugcacagaugaaggagcagagguucugaccgagaggc

SEQ ID NO: 248750 - RNA, 63 nt, hsa
ccuauuuuuuauggauuuuucagcucauuucagaugaaggaacuaagucauugugaacugucu

SEQ ID NO: 248751 - RNA, 63 nt, hsa
caucaccacacuccccccagccuucaccuggccaugaaggaccuuuugaccaacucccuguca

SEQ ID NO: 248752 - RNA, 63 nt, hsa
aucucucucaaauguauuauuuuggugacaaaaaugaaggagcuuuguaaauuuuuuuuaaaa

SEQ ID NO: 248753 - RNA, 63 nt, hsa
uuuucuuaucaaguuucucaaccuuuauuuuuaaugaaggaggugcugaguuuuguaucuuuu

SEQ ID NO: 248754 - RNA, 63 nt, hsa
agagauuuuuauauuuauacaaaagauuacuaaaugaaggauugcuaaauguuuuugguucaa

SEQ ID NO: 248755 - RNA, 63 nt, hsa
guggagcucagccccgagcuguccccguguugcaugaaggagcagcauugacugguuuacagg

SEQ ID NO: 248756 - RNA, 63 nt, hsa; identical to SEQ ID NO: 248755

SEQ ID NO: 248757 - RNA, 63 nt, hsa
gcuucuccaggaggccaagcagaggcuccccucaugaaggaagccauugcacugugaacacug

SEQ ID NO: 248758 - RNA, 63 nt, hsa
cuuugugguauguuuugcuuuccuaauagggacaugaaggaaacccagcaauuugcuguuaug

SEQ ID NO: 248759 - RNA, 63 nt, hsa
aaaagcauuuuacagggaaaaauaccucuccucaugaaggacuugaaaaguuuacaaccugcu

SEQ ID NO: 248760 - RNA, 63 nt, hsa
gaacaaucaugaaauggaagaaggaggaagagcaugaaggaucuuauaagaaaugcaagagga

SEQ ID NO: 248761 - RNA, 63 nt, hsa
cagaaccuccucagucucaguacucuuguuucuaugaaggaaaaguuuggcuacuaacaguag

SEQ ID NO: 248762 - RNA, 63 nt, hsa
agaacauucucaauuaagugauaaguccaaaugaugaaggaaauguuuuaauucacaaaugga

SEQ ID NO: 248763 - RNA, 63 nt, hsa
cugggccccucacuguggggauugaucauucucaugaaggaaucacaguuauauggcaacugc

SEQ ID NO: 248764 - RNA, 63 nt, hsa
ucgcuaaaggaaaauacaguaagugcuugaaagaugaaggaccaaaaggccaaaaaacaguga

SEQ ID NO: 248765 - RNA, 63 nt, hsa
uuuuguaucgggaauuucucagagcugaguaaaaugaaggaaaagcauguuauguguuuuuaa

SEQ ID NO: 248766 - RNA, 63 nt, hsa
caaaggacuuaaaauuaccaaaugcuucuaaauaugaaggagagguuggggacacgcacccua

SEQ ID NO: 248767 - RNA, 63 nt, hsa
aacuugagaagacauuuauaauacaaauaacugaugaaggauucauaaucacaaauauagaga

SEQ ID NO: 248768 - RNA, 63 nt, hsa
aagaagccucggcuccugcacggcacccugaucaugaaggacagcgugagugccaggacgguc

SEQ ID NO: 248769 - RNA, 63 nt, hsa
auguggugacucaugugaaguggugucauaggaaugaaggacugugggcgcuggguucaaauu

SEQ ID NO: 248770 - RNA, 63 nt, hsa
ugcacaguucucucuucuccuuguccuagucagaugaaggaggcugcacuacaaacccaaauu

SEQ ID NO: 248771 - RNA, 63 nt, hsa
auuccccacccacacccccaggcaggguuggaaaugaaggacuuuuuuaaccuuuguuuuguu

SEQ ID NO: 248772 - RNA, 63 nt, hsa
gagaccauaaaggcuucaaaacuagaagugcgcaugaaggaugcuucaugcccuguuccccac

SEQ ID NO: 248773 - RNA, 63 nt, hsa
cuccuagccacagcugccaugauaaguccuuccaugaaggacugaggagggagaguggggguc

SEQ ID NO: 248774 - RNA, 63 nt, hsa
gcugacuuggauaauucauuauuaccagcaguuaugaaggaaauauugcuaaaaugaucuggg

SEQ ID NO: 248775 - RNA, 63 nt, hsa
ucuaucauagacaccauaggggaaaguuuggggaugaaggagagcuuaaagguguuucaauua

SEQ ID NO: 248776 - RNA, 63 nt, hsa
acucucuguccccagauccucuuucuagcaugaaugaaggaugccaagaaugagaaaaagcaa

SEQ ID NO: 248777 - RNA, 63 nt, hsa
gguccugguuucaacauggaagugagauagcugaugaaggauuucaagucuggaaaugggaaa

SEQ ID NO: 248778 - RNA, 63 nt, hsa
uaagguacgcuugcuugucuuuaaaucuucaauaugaaggacuauuaauuccaagauuaaaag

SEQ ID NO: 248779 - RNA, 63 nt, hsa
aacuauauucccaucccucuauuuuaaucuguuaugaaggaagguaaauaaaaaugcuaaaua

SEQ ID NO: 248780 - RNA, 63 nt, hsa
auuagaugaauagagaauauuaauuuugcagaaaugaaggaaaaucucuucgugcuaguacag

SEQ ID NO: 248781 - RNA, 63 nt, hsa
cuuaugucuuugguaaugaaacaauaacacucaaugaaggauguauuaaaauuuuugacuuaa

SEQ ID NO: 248782 - RNA, 63 nt, hsa
cagaaacauucagguuugaagccagcccugauaaugaaggaugaacuagugugauuucuaauc

SEQ ID NO: 248783 - RNA, 63 nt, hsa
uuuugugcuggcuuugaacaauuacgaacaauaaugaaggacaaaugaauccugaaggaagau

SEQ ID NO: 248784 - RNA, 63 nt, hsa
cuugaaagcgaugaagaaugucucuagaagagaaugaaggauugaagaauucaccauuagagg

SEQ ID NO: 248785 - RNA, 63 nt, hsa
auaaaagaaaccuuuguuguuuguugaaagaaaaugaaggaacagggggaaaaaaggugcaaa

SEQ ID NO: 248786 - RNA, 63 nt, hsa
gaguagagaaagagauaaaaauaaaaguaucucaugaaggaaagagauuuugccucucuuuua

SEQ ID NO: 248787 - RNA, 63 nt, hsa
uucaaauguuuaaauaaugucuauccauguaucaugaaggacaguaugcuucaaauugucuuu

SEQ ID NO: 248788 - RNA, 63 nt, hsa
uuacaaaaauaguagaacaagcaacauaaaacaaugaaggaaaaccucacuugaaggcccagg

SEQ ID NO: 248789 - RNA, 63 nt, hsa
acuggaacuagugagcuguguccauggugugucaugaaggauguaccccagagaguaacauga

SEQ ID NO: 248790 - RNA, 63 nt, hsa
ugggagugcaaaaaaaacaaagccaaaaaauauaugaaggauagcuguucuucuguguucucu

SEQ ID NO: 248791 - RNA, 59 nt, hsa
ugaucagccagccuaacugaagaugauguaugaaggaguuggaguuguugaaaccaagg

SEQ ID NO: 248792 - RNA, 63 nt, hsa
uacuugcucuuggccuugagaucguguaacaaaaugaaggagggcucucuucuuucuuccuca

SEQ ID NO: 248793 - RNA, 63 nt, hsa
guaagucuuugcauuuaagacauccaaucaauaaugaaggaaauuuuuuucugaauguagguu

SEQ ID NO: 248794 - RNA, 63 nt, hsa
gacauuuuugauaaauuauguuuguacuaguugaugaaggaguuuuuuuuaaccuguuuauau

SEQ ID NO: 248795 - RNA, 63 nt, hsa
uauaaauuguugagaaauuuuugugauuagaauaugaaggaaaaagcuuuguugguaaaagug

SEQ ID NO: 248796 - RNA, 63 nt, hsa
ccuuuauaauuuagaaagagacugcguugagacaugaaggaucagaaggaauuuccuauuuuc

SEQ ID NO: 248797 - RNA, 63 nt, hsa
ggaaaaaucauucaaguggcaugccaagucccuaugaaggaagggcugcuaucaaaccuaccu

SEQ ID NO: 248798 - RNA, 63 nt, hsa
aaggcccuggggauuccacuccaguaaaguagaaugaaggauacaaaugauaaaaauuacacu

SEQ ID NO: 248799 - RNA, 63 nt, hsa
cucaggaccccguggaauugcaucuucugcaggaugaaggagucuccgggaagccaacagugu

SEQ ID NO: 248800 - RNA, 63 nt, hsa
uauuaugagucaaucuaguugguuuuauucgacaugaaggaaauuuccagauaacaacacuaa

SEQ ID NO: 248801 - RNA, 63 nt, hsa
ugcaacaugggagagaaguucuuauuguuggccaugaaggaaaaucacccagaaugcuucugc

SEQ ID NO: 248802 - RNA, 63 nt, hsa
uguaaugcacauggcaaagcaaagacguuugugaugaaggaacugcucaucuaagcaaaagau

SEQ ID NO: 248803 - RNA, 63 nt, hsa
guuauugaguuguacuguaccuuauuuggaaggaugaaggaaugaaucuuuuuuuccuaaauc

SEQ ID NO: 248804 - RNA, 63 nt, hsa
ccagcccuguccucauccuagggccacuaggggaugaaggacccaucucaagucagcucccua

SEQ ID NO: 248805 - RNA, 63 nt, hsa
uccccuuuacaagaaaaucgaaaacacagaagaaugaaggacaugccaguccccgaucgcugc

SEQ ID NO: 248806 - RNA, 63 nt, hsa
aauagggcaaguuuauguuucaugcgagaaaacaugaaggaggguuuugguuuuggucugcag

SEQ ID NO: 248807 - RNA, 63 nt, hsa
guucuaagcgggagaugacucccuacugggaugaugaaggauggcauccuagugaagaagcag

SEQ ID NO: 248808 - RNA, 63 nt, hsa; identical to SEQ ID NO: 248795

SEQ ID NO: 248809 - RNA, 63 nt, hsa
agcaucccgucaaaggcagaaucugucacuugaaugaaggaaagcuuaaagcccaagcagaua

SEQ ID NO: 248810 - RNA, 63 nt, hsa
uuuuuuaacauguguuaaacagagaaaggguccaugaaggaaaguguaugaguugcauuugua

SEQ ID NO: 248811 - RNA, 63 nt, hsa
uuuuaauuugaggggaaaagaaauguuuuacagaugaaggaauguuuuauaguaauuuaauuu

SEQ ID NO: 248812 - RNA, 63 nt, hsa
caaauuagcaaucauuuuauauaaagaaaaucaaugaaggauuucuuauuuucuuggaauuuu

SEQ ID NO: 248813 - RNA, 63 nt, hsa
gcaaguaccaggaugaaaagaacuaugaaauaaaugaaggaagcuacaaguguguguguauau

SEQ ID NO: 248814 - RNA, 63 nt, hsa
agcaguuaacugaccuuuuauacaaguuagcacaugaaggauagauaugcacugaaacaugug

SEQ ID NO: 248815 - RNA, 59 nt, hsa
augucucuuccaaccucugaaaaccaucgaugaaggaauaucucuucucagaaggaaag

SEQ ID NO: 248816 - RNA, 63 nt, hsa
agucauuaaaaacaguugccagugauaaucugcaugaaggaaaaagaacccugcaaauggcua

SEQ ID NO: 248817 - RNA, 63 nt, hsa
cggaacgucagccagcucccagccacauggcgcaugaaggagagcccagucucccuccaggaa

SEQ ID NO: 248818 - RNA, 63 nt, hsa
gugggugugaaagguuuccaaaaaaaguucagcaugaaggaugccauauauguuguugccaac

SEQ ID NO: 248819 - RNA, 63 nt, hsa
auggggcuaggaugagagagaaugccacagaguaugaaggaagagugauagauccagaugaga

SEQ ID NO: 248820 - RNA, 63 nt, hsa
uugggugagaugcaacuaacagccccuuccuggaugaaggagucaaagaauaaagcuugccua

SEQ ID NO: 248821 - RNA, 63 nt, hsa
guagaggggcagguagaguuccuggagggaaggaugaaggagccuuggcuacuguacucugag

SEQ ID NO: 248822 - RNA, 63 nt, hsa
aaugcucucagugucugccccaaguaccaccucaugaaggaugccacugcuuucugugcagaa

SEQ ID NO: 248823 - RNA, 63 nt, hsa
aauuucuaacaaucaucaguuaggaauauuaacaugaaggauaaaccaacuuauuuguauacc

SEQ ID NO: 248824 - RNA, 63 nt, hsa
uuuuauuggucaugagaacaaauggaugugaucaugaaggaaucagauucccuauguaaagca

SEQ ID NO: 248825 - RNA, 63 nt, hsa
gaagauuaggaugacuaaauuaauggggaaaugaugaaggaguuugaaucucuucuuugugaa

SEQ ID NO: 248826 - RNA, 63 nt, hsa
uuaaauacauggaaggaaguccgggagaaccauaugaaggagcaggaggagaggaagaaacuu

SEQ ID NO: 248827 - RNA, 63 nt, hsa
caauaccaugauuccuuccauuuucaacaguagaugaaggaaaugauacugaaugagucacag

SEQ ID NO: 248828 - RNA, 63 nt, hsa
ccaugguuuuccugaaauccucaauucaucaauaugaaggaaaugaaccacauagacuuuaug

SEQ ID NO: 248829 - RNA, 63 nt, hsa
gccaacauuagcguuggucuucucuugucaggaaugaaggaugcuugcacacaugcacccccu

SEQ ID NO: 248830 - RNA, 63 nt, hsa
agaugauucuuccggguccugagcaccugcuucaugaaggaagauagguagcccagagaagaa

SEQ ID NO: 248831 - RNA, 63 nt, hsa
caggugcuuugaagaggaagccauuauggauggaugaaggauaguaaugcaauaccuccaccu

SEQ ID NO: 248832 - RNA, 63 nt, hsa
uacugaaaauugauauuauuuuccuuuucuuauaugaaggaccuuauuuggcauauaaaauuu

SEQ ID NO: 248833 - RNA, 63 nt, hsa
agagguggggacagcaagaagccacagauuggcaugaaggauccugaccugacuauccaugcc

SEQ ID NO: 248834 - RNA, 63 nt, hsa
uccuucacuuugagcaguguucuaauuggauaaaugaaggagaguaguuuuauucugaaggua

SEQ ID NO: 248835 - RNA, 63 nt, hsa
cuggauuugguugaccuuuguggaacacaaauaaugaaggagcagaacauugacaagcuaaga

SEQ ID NO: 248836 - RNA, 63 nt, hsa
auuucuguuaucuagagguuagcagaaaaugaaaugaaggaauuucccuaagcaguugggaag

SEQ ID NO: 248837 - RNA, 63 nt, hsa
uaauaguugagaauugcuuuuuugaaaauuuucaugaaggaauuuugguaaugacuuugcuug

SEQ ID NO: 248838 - RNA, 63 nt, hsa
ggacacauuuaacaaguaacauuucuagggaaaaugaaggaaguaccacaaacuggcuagaaa

SEQ ID NO: 248839 - RNA, 63 nt, hsa
gacucagugccaugcagaagccuuuuuuuuaagaugaaggaaauauuuuauguaaagagcaac

SEQ ID NO: 248840 - RNA, 63 nt, hsa
acuugggaugagugaaaaauuacaucauuggacaugaaggaguuucaacauccagcuucaucu

SEQ ID NO: 248841 - RNA, 63 nt, hsa
uuucccuuucuuuaaaagaaacuuaacuguucuaugaaggagauugagggagaagagacaaac

SEQ ID NO: 248842 - RNA, 63 nt, hsa
uuaaaauuuccagaauuuuaagcaaaaagcauuaugaaggaaggcuugguuuaauaaagacug

SEQ ID NO: 248843 - RNA, 63 nt, hsa
uaacuucuaauggccaucuguaaaccauaaguaaugaaggacuccacugugccccacuuucug

SEQ ID NO: 248844 - RNA, 63 nt, hsa
uauuuaugaacugugauaaagcaucaaaucuugaugaaggauuguagauuuuugcuuuuucuu

SEQ ID NO: 248845 - RNA, 63 nt, hsa
aacaauucuucauuuaccuaguauuaugaaagaaugaaggaguucaaacaaauguguuuccca

SEQ ID NO: 248846 - RNA, 63 nt, hsa
ggggaaacacaccuaggugcuggugaugggcuuaugaaggaagcuaagcacggcugcucacug

SEQ ID NO: 248847 - RNA, 63 nt, hsa
gaugaaucugaacaucucuccaucuagagcccaaugaaggaagcuucaaaugagaacaugaug

SEQ ID NO: 248848 - RNA, 63 nt, hsa
uauauguauagugaacauauugcuuaguaacaaaugaaggacaagcauacuacauaauauaau

SEQ ID NO: 248849 - RNA, 63 nt, hsa
ggaaucagggguuuggaaggaguagggaggagaaugaaggaaaaugcaaccagcaugauuaua

SEQ ID NO: 248850 - RNA, 63 nt, hsa
caugguuguuaacauuguguaauaugucucuauaugaaggaacuaaacuauuucacugaaaaa

SEQ ID NO: 248851 - RNA, 63 nt, hsa
auaaaaucagaaacuucaagcucucuaaauaaaaugaaggacuauaucuagugguauuucaca

SEQ ID NO: 248852 - RNA, 63 nt, hsa
agggcaguauuaaccaccaugcuggaaggggaaaugaaggacaaaaaugcacagggagucugu

SEQ ID NO: 248853 - RNA, 63 nt, hsa
uugcugugcuguacauuacuguauguauaaauuaugaaggaccugaaauaagguauaaggauc

SEQ ID NO: 248854 - RNA, 63 nt, hsa
aaaugucuuuagguugaaggaauuaccuaugucaugaaggaccugucugugguuuuucaaugg

SEQ ID NO: 248855 - RNA, 63 nt, hsa
guuuuauaaaccaaaacaaaauuuccaaaaacaaugaaggaaaccaaaauaaauauuucugca

SEQ ID NO: 248856 - RNA, 63 nt, hsa
caguguagucauucauuucuagcuguacauaggaugaaggagagaucagauacaugaacaugu

SEQ ID NO: 248857 - RNA, 63 nt, hsa
guggccuuccccgggcgguaaagaggugaaaggaugaaggagggcuggggggggccccauuua

SEQ ID NO: 248858 - RNA, 63 nt, hsa
auuuuaaugaaggcucuuuucagauguaaccuuaugaaggaaauaucugcuuuguguauaugc

SEQ ID NO: 248859 - RNA, 63 nt, hsa
cuauuuuuuuaaaaucacuaacauuauauugcaaugaaggaaauaaaaaagucucuauuuaaa

SEQ ID NO: 248860 - RNA, 63 nt, hsa
augauuuauuugaagauggagcacugcugauuuaugaaggaaaaaagaagaauuuucuaaaga

SEQ ID NO: 248861 - RNA, 63 nt, hsa
ggagucugcuguugucagaaggcagggagggugaugaaggacugacccacauggacugggaug

SEQ ID NO: 248862 - RNA, 63 nt, hsa
cugcuggggugugagggcagagggaggguugccaugaaggaacuugggauuuucaauggaaua

SEQ ID NO: 248863 - RNA, 63 nt, hsa
cauuuuucaaggagaagagccugcaaauggccaaugaaggagguaaauaaacuaagauauucc

SEQ ID NO: 248864 - RNA, 63 nt, hsa
aucugcugcaccuuguaaaugcucuaacuggacaugaaggaaaggggcgagggaggggggugg

SEQ ID NO: 248865 - RNA, 63 nt, hsa
aaguucugucagacuccaucucccccagguucaaugaaggauaauaaucuaaaucauuagggc

SEQ ID NO: 248866 - RNA, 63 nt, hsa
uaauuucuauucaauauugcuagauauauuaacaugaaggaauggggaagcuuauuucaauca

SEQ ID NO: 248867 - RNA, 63 nt, hsa
uagggaagcuguuggagaaaauacuccagcaaaaugaaggaguacacaaaccagagaaugaca

SEQ ID NO: 248868 - RNA, 63 nt, hsa
augugugcagaggugguguggaugugagcgugcaugaaggaaaaaaagcugcuacuccuagua

SEQ ID NO: 248869 - RNA, 63 nt, hsa
auuuugaugccaagaaaguauuugguaggccuaaugaaggaguucacuguaagacucauuccc

SEQ ID NO: 248870 - RNA, 63 nt, hsa
ccuggcccugccagcugguaguccaucagcacaaugaaggagacuuggagaagaggaagaaua

SEQ ID NO: 248871 - RNA, 63 nt, hsa
gacgcuucuagggggcucuggcugcccguguuaaugaaggacagcgcuuccgcgagcacccug

SEQ ID NO: 248872 - RNA, 63 nt, hsa
ugguuaaaaggguucuuuguucccauccagccgaugaaggagcaaacgucuggcuaugugaag

SEQ ID NO: 248873 - RNA, 63 nt, hsa
ggacagccaugugggacccccuggugauucagcaugaaggaaaugaagcuggagaggaaggua

SEQ ID NO: 248874 - RNA, 63 nt, hsa
agugacuuggacuguaaaugaaacauugcauccaugaaggacagcaccaagcaccuuuuugaa

SEQ ID NO: 248875 - RNA, 63 nt, hsa
accagacugaccacaagaacugucaucucaucaaugaaggaguaacugaucaaugaagccagc

SEQ ID NO: 248876 - RNA, 63 nt, hsa
auaguucuggccagaccccguuccccuuccucuaugaaggaauaaguuggaccaagggaaguc

SEQ ID NO: 248877 - RNA, 63 nt, hsa
gcaugacaacucguguguaugagaaggagggauaugaaggaagauggcuugcagaguaagucg

SEQ ID NO: 248878 - RNA, 63 nt, hsa
aaggagggagcuacucucaggcugcaaguaaguaugaaggaggcugaucccugagauccuugg

SEQ ID NO: 248879 - RNA, 63 nt, hsa
uguguagcuggggauggggauuccuaggggcagaugaaggacaagccccacuggagugggguu

SEQ ID NO: 248880 - RNA, 63 nt, hsa
uucucuccuuuccucauccuaagugccuggcagaugaaggaguuuucaggagcuuuugacacu

SEQ ID NO: 248881 - RNA, 63 nt, hsa
guuuuacuuccuuguuaacauauaaaguuauaaaugaaggacaaggaggagauggaaaaugug

SEQ ID NO: 248882 - RNA, 63 nt, hsa
acuuaauguguguccucaucuuuuuacaaauaaaugaaggauuauaaaugaugucagcauuuu

SEQ ID NO: 248883 - RNA, 63 nt, hsa
guagaccuguuuggggucuacuauuguuuuagaaugaaggaauuguauuauuguguguauaua

SEQ ID NO: 248884 - RNA, 63 nt, hsa
acuuucuuugucaaucuauggacaugcccauauaugaaggagaugggugggucaaaaagggau

SEQ ID NO: 248885 - RNA, 63 nt, hsa
ucaugugaauuuccaaguuuuaauucguucuccaugaaggauuuucauuucagugaaagucgc

SEQ ID NO: 248886 - RNA, 63 nt, hsa
caugccugauauuucagcccauugacuugcuggaugaaggacuagaauacagcagcuguuaua

SEQ ID NO: 248887 - RNA, 63 nt, hsa
cuuuaaagagcgaaaugagugugucauuuccacaugaaggagaggcaaggaaaagccccacaa

SEQ ID NO: 248888 - RNA, 63 nt, hsa
cacgucuagcagacuuuacaauaaaaugucaauaugaaggacuguaauuccuagcaguuuauu

SEQ ID NO: 248889 - RNA, 63 nt, hsa
ucuacuguuuuaagcuuuaguuuccuuuauggaaugaaggauuuggaguagauuauuucaaag

SEQ ID NO: 248890 - RNA, 63 nt, hsa
aucaaucaaaauguuuguaacuuaaaauuuuuaaugaaggauaaugaauauuuguagagucuc

SEQ ID NO: 248891 - RNA, 63 nt, hsa
acaaccagaaacuuuuacuugugauacucuaccaugaaggaugcgguaauggcaggaauagca

SEQ ID NO: 248892 - RNA, 63 nt, hsa
uuuugaguaaauuuaugcagcagaaacuauacaaugaaggaagaauucuauggaaauuacaaa

SEQ ID NO: 248893 - RNA, 63 nt, hsa
ccucagauugcugaaucccaucaggcuguuauuaugaaggaauuugauugcuuugcugcacag

SEQ ID NO: 248894 - RNA, 63 nt, hsa
cauucuagcccagagacugucgcuacuaaaagaaugaaggaaauaauaaagugauagacaggg

SEQ ID NO: 248895 - RNA, 63 nt, hsa
ucgaaaugagcucaaauugauuuuuuaauuucuaugaaggauccaucuuuguauauuuacaug

SEQ ID NO: 248896 - RNA, 63 nt, hsa
gagacugcuucucccaaacauaacgcguuagccaugaaggagucggagcccuggguccgaaug

SEQ ID NO: 248897 - RNA, 63 nt, hsa
ucuggugacuuugacacugaagcggaagagccaaugaaggacugcaguauuugugugcccgau

SEQ ID NO: 248898 - RNA, 63 nt, hsa
guccaagaaagaaagcuucuugauugagguagcaugaaggaugaggcuucagcccccauuguc

SEQ ID NO: 248899 - RNA, 63 nt, hsa
gugacacaccgugagacaggugaggugauggugaugaaggagcugauccgguucgacgaggag

SEQ ID NO: 248900 - RNA, 63 nt, hsa
uaauuagauuauguauagggguaacuggaagccaugaaggaaggacuuaaccaggcuaccaag

SEQ ID NO: 248901 - RNA, 63 nt, hsa
aaaaguugacucuacccccuaauuugguaggagaugaaggagaaaaggauggcauugaauuau

SEQ ID NO: 248902 - RNA, 63 nt, hsa
gcauaaccauucauuagggaguacuuuacaagcaugaaggauauuaggguaaguggcuaauua

SEQ ID NO: 248903 - RNA, 63 nt, hsa
aagcacuggaauguuuugugagauuauuuuuauaugaaggaauagccugaacucaaacagaug

SEQ ID NO: 248904 - RNA, 63 nt, hsa
uuugauugacaauauauccaguccaauauaaguaugaaggauucucucuccugagauuguagc

SEQ ID NO: 248905 - RNA, 63 nt, hsa
aacuggcuguacaauaucuaaaaagaaagugacaugaaggaagcaaucuacaacuuccuuccg

SEQ ID NO: 248906 - RNA, 63 nt, hsa
aguugccaaacguugcaggaccgcacggagaagaugaaggagaucguaggguggaugccccug

SEQ ID NO: 248907 - RNA, 63 nt, hsa
gcagcugcucaagcaguucaggcuacagcucagaugaaggagggacgaagaacaucaaguuua

SEQ ID NO: 248908 - RNA, 63 nt, hsa
aagaugugcucucagaauggccgggcccaagagaugaaggaaaggagugaaagggaaguagga

SEQ ID NO: 248909 - RNA, 63 nt, hsa
auuuuuguauuuuucucugguugggaguaugauaugaaggaucaagauccucaacucacacau

SEQ ID NO: 248910 - RNA, 63 nt, hsa
cuuuggcaaaaagugaacacaauucaaauacgaaugaaggaagagcccucagauggaacgaaa

SEQ ID NO: 248911 - RNA, 63 nt, hsa
uuauucaaugauguauauacucccacagcucgcaugaaggaacagccucuauugauacuuggu

SEQ ID NO: 248912 - RNA, 63 nt, hsa
ugcaggacggaauauagaggagcacuauuauggaugaaggacgugucucaggagcuugaucca

SEQ ID NO: 248913 - RNA, 63 nt, hsa
gcucauuaaaauauuccucugaugugaaauuaaaugaaggauauuaauguaaauuagaugcaa

SEQ ID NO: 248914 - RNA, 63 nt, hsa
ccuccccagccauccucccgccuugggggcuccaugaaggaugcaggcuuccaggccuggcuu

SEQ ID NO: 248915 - RNA, 63 nt, hsa
aaaguaaauuaaaaacaaaaccugaugaaacagaugaaggaagauguggaaaaaauccuuagc

SEQ ID NO: 248916 - RNA, 63 nt, hsa
caaagagugcaggccagguuccuuauccuucugaugaaggaugagagagcucauuuagaaguc

SEQ ID NO: 248917 - RNA, 63 nt, hsa
aguuuaagaaaaaaaaauauuccuccccacugcaugaaggacuuggaugucauccaaacuuua

SEQ ID NO: 248918 - RNA, 63 nt, hsa
gucaugagaguggggagacaggcagcaaagcuuaugaaggagguacagaauauucuuugcguu

SEQ ID NO: 248919 - RNA, 63 nt, hsa
agggcugcaccucccacgguggucaccaugccaaugaaggaaguucagucuugucuuugauau

SEQ ID NO: 248920 - RNA, 63 nt, hsa
cugaggagacaaccagaucaggagagcaaggucaugaaggaggggaccucuccacacaggugu

SEQ ID NO: 248921 - RNA, 63 nt, hsa
uuguuuucuucucuuuuugucucaagauuguauaugaaggaggcuuuucuucucagcuaacag

SEQ ID NO: 248922 - RNA, 63 nt, hsa
uggaagcaggucugaggucagaagaaguagagaaugaaggaaaaggugaaugcuaugaaauug

SEQ ID NO: 248923 - RNA, 63 nt, hsa
cagucaaggaaaggccacuuaaggaucugcucuaugaaggagaagaaagaggaaaaagaagua

SEQ ID NO: 248924 - RNA, 63 nt, hsa
caugcacaagcuaaacauaauuugaaugggucuaugaaggaaaaauaaugcuuagacuuuggu

SEQ ID NO: 248925 - RNA, 63 nt, hsa
aaaauuuugaguuaaguugcauuucuuugggcuaugaaggaguccucuuaaguuugauagaaa

SEQ ID NO: 248926 - RNA, 63 nt, hsa
guuguagcacgaaagcagccagguaauuacuagaugaaggaaugcagguggcuguguuucaau

SEQ ID NO: 248927 - RNA, 63 nt, hsa
acauggcccugcguugcaaagcugagaaguaauaugaaggagcguuuuguaaguuugaaucuc

SEQ ID NO: 248928 - RNA, 63 nt, hsa
aggcuucugaagguugcugucugucaugagugcaugaaggaggccaagaguuuaugcuauggg

SEQ ID NO: 248929 - RNA, 63 nt, hsa
cagagaugauggaugagcagcuggauuuucgugaugaaggacggaagcagcagcgggccggca

SEQ ID NO: 248930 - RNA, 63 nt, hsa
cuggcacaugagaucgagcggcugcagauggagaugaaggaggacgacguuucuuuucucaug

SEQ ID NO: 248931 - RNA, 63 nt, hsa
cuggccccaccccgccacuucccucgggcccuuaugaaggacugaggcuccagggugagaagg

SEQ ID NO: 248932 - RNA, 63 nt, hsa
accccgauuggugagggcucugcauaugccuguaugaaggagauacaggugugugugcacaug

SEQ ID NO: 248933 - RNA, 63 nt, hsa
caguguguucaccucaucaaggcagcagaguggaugaaggaguaagucugcccuuugccauac

SEQ ID NO: 248934 - RNA, 63 nt, hsa
gugcucugaaaugccacuugguagcucuggacaaugaaggacaauugacucaagggugccugg

SEQ ID NO: 248935 - RNA, 63 nt, hsa
uuugugaugguguucuggguccauacaccagcaaugaaggagauagauuuguguacuuguguu

SEQ ID NO: 248936 - RNA, 63 nt, hsa
uauucucauuuucucugaguuggaaacaaaaacaugaaggacuccaacuagaagacagauauu

SEQ ID NO: 248937 - RNA, 63 nt, hsa
ucugcuguugauuccacugaaaccucuguucucaugaaggagaggauuuggcucgcugugguu

SEQ ID NO: 248938 - RNA, 63 nt, hsa
cauacucagauaucagucugcuagaacuuuaaaaugaaggacaaauccuguuaaagaaauauu

SEQ ID NO: 248939 - RNA, 63 nt, hsa
cuugugcccccagaugggccaaagaaagagccuaugaaggagaagcagaagcagacggcuggc

SEQ ID NO: 248940 - RNA, 63 nt, hsa
acuugaagaauacauauacuuauauucggggauaugaaggauucaaugaaugaucucuagaaa

SEQ ID NO: 248941 - RNA, 63 nt, hsa
ugcaggcggaacugagaccagccucucugggcgaugaaggacaauggugguagggccacuuag

SEQ ID NO: 248942 - RNA, 63 nt, hsa
accucuuugggccucaguuuccccaucuguaaaaugaaggaguuggaccaaugcccccucccc

SEQ ID NO: 248943 - RNA, 63 nt, hsa
ucuccauauaauugauuauuaggauauauucccaugaaggauucuuuuuuuaaaaaaauguga

SEQ ID NO: 248944 - RNA, 63 nt, hsa
gaugggcuuaaguuugggcuagaguuugacuuuaugaaggaggucauugaaaaagagaacagu

SEQ ID NO: 248945 - RNA, 63 nt, hsa
ggcccucagcucccugacccccuguccuaggucaugaaggacacucugcagggugaagcacca

SEQ ID NO: 248946 - RNA, 63 nt, hsa
aaugacuuuauugcaucuggguagcuguaaggcaugaaggaugccaagaaguuuaaggaauau

SEQ ID NO: 248947 - RNA, 63 nt, hsa
guuagaaguagaugacuucaauuaaacaaauuuaugaaggacauuauucugauucauaaaagu

SEQ ID NO: 248948 - RNA, 63 nt, hsa
cacucuauaaaaucauggcaauaauagaagauuaugaaggauuucuauggaggacauaaaugc

SEQ ID NO: 248949 - RNA, 63 nt, hsa
auauuaagguucuccuugcccugaagcuucaggaugaaggacaggaagcugaaggagaaaagu

SEQ ID NO: 248950 - RNA, 63 nt, hsa
uaucucaucuauggacuugccaaacagucuuuuaugaaggaaaguuacaguauuaauuuuuga

SEQ ID NO: 248951 - RNA, 63 nt, hsa
acagccucaguagucugcccaguguccacauuaaugaaggauccauguuuguagugagagaaa

SEQ ID NO: 248952 - RNA, 63 nt, hsa
uagaaaguuugcugaaagcaaagggcuaagcuuaugaaggaaugccuccuuuguuacacacuc

SEQ ID NO: 248953 - RNA, 63 nt, hsa
ggguaacugggguugagggccaaaauauuuggaaugaaggacuuuggcccuauuuaaggcaga

SEQ ID NO: 248954 - RNA, 63 nt, hsa
gcggggagcccaaggacauaacaaauuaaaagcaugaaggagagaaaaaugggggucguggcu

SEQ ID NO: 248955 - RNA, 63 nt, hsa
accuugaacaagucagcaucucugccuuucaaaaugaaggaacauuguucucuauccuccccu

SEQ ID NO: 248956 - RNA, 63 nt, hsa
caguguuaccagagcccaguaagaacugcugucaugaaggaggggccaccuuguaagagacau

SEQ ID NO: 248957 - RNA, 63 nt, hsa
gaagucaugaaguuuuuuugcauuuuuauuuaaaugaaggaauuccaaauaacucaccuacag

SEQ ID NO: 248958 - RNA, 63 nt, hsa
gucauccuggugcuuguacuucuccuacaugucaugaaggaccuuggauuuacugagaacuca

SEQ ID NO: 248959 - RNA, 63 nt, hsa
uaguucagagaauugucuuaggacaacaggcuaaugaaggauuuggggucuggguuuuuagcc

SEQ ID NO: 248960 - RNA, 63 nt, hsa
aguuaagugugaggcacucccggagcaaagucuaugaaggaucuucugcaagaggcugccucc

SEQ ID NO: 248961 - RNA, 63 nt, hsa
uguucagugcuauucucccagcuagguuuauccaugaaggacugagugaccuuuguuguauuu

SEQ ID NO: 248962 - RNA, 63 nt, hsa
aaaagaagaagaaaagagaagaaggagaaggagaugaaggaggaggaggaggagaaggagaag

SEQ ID NO: 248963 - RNA, 63 nt, hsa
cuugguuaauagaaucuacuaucuggaagauaaaugaaggauuuuaauaaaauuuucaauaga

SEQ ID NO: 248964 - RNA, 63 nt, hsa
ccauuuaauaguuauaacgucguuacuuguacuaugaaggaaaauacucagugucagcuugag

SEQ ID NO: 248965 - RNA, 63 nt, hsa
cucccgggucuccagccuccgaccccucgccccaugaaggagcuggcagguggaaauaaacaa

SEQ ID NO: 248966 - RNA, 63 nt, hsa
aaaaaaaccuccugggacuguugcaaggaugaaaugaaggauugagggauugagggauugcug

SEQ ID NO: 248967 - RNA, 63 nt, hsa
ccgcugggggugggggcggguguccguccggaaaugaaggaauagcccgaggaccgggcuggg

SEQ ID NO: 248968 - RNA, 63 nt, hsa
ggaggauauuccucggaaaaacagacuuugggaaugaaggagggacucaggaucauuguuauc

SEQ ID NO: 248969 - RNA, 63 nt, hsa
uuaaaugaagaaauuagugaaaaaauugaccuaaugaaggaaacauuugugcuuuccuauauu

SEQ ID NO: 248970 - RNA, 63 nt, hsa
agcggggagccaggaaagaagaguuggagugagaugaaggaaggacuaugacaaauaaaaaag

SEQ ID NO: 248971 - RNA, 63 nt, hsa
uuuuggcuuucuuuuuucccacagcaacugccaaugaaggaugaauccccuuuuuaaaaaguu

SEQ ID NO: 248972 - RNA, 63 nt, hsa
ugaagugagacccuuggggagaacgggcuguggaugaaggaguggacugcagccuuggccuag

SEQ ID NO: 248973 - RNA, 63 nt, hsa
ugaccugugaccagguccaauguggggagaaauaugaaggagguagcagcccuggguucuccu

SEQ ID NO: 248974 - RNA, 63 nt, hsa
guuaauauauaagaaaucuggggauaauuaagaaugaaggacuuuucuaucauuuccauuuua

SEQ ID NO: 248975 - RNA, 63 nt, hsa
uuggcuuuuugaaaaacaagcauuucaaaaaugaugaaggaagugaaaguauccuggaucaac

SEQ ID NO: 248976 - RNA, 63 nt, hsa
ggcugggacauggggguguggguaaagacagggaugaaggauagaggcugagagaagaaggaa

SEQ ID NO: 248977 - RNA, 63 nt, hsa
cgauggaugcgagugcggcggucuucagaauguaugaaggaugaccccaucacucucuuuguu

SEQ ID NO: 248978 - RNA, 63 nt, hsa
caaaagaagacaaaagccccccaggauguagaaaugaaggaccuugaagaugagagcuaaacc

SEQ ID NO: 248979 - RNA, 63 nt, hsa
caaagaucagagcaggugagcauccacuuugacaugaaggacaagaagacgcauggcucaugg

SEQ ID NO: 248980 - RNA, 63 nt, hsa
ucucaggguuuaaaacugugaggaaggagaaguaugaaggaagguagaaaaugcugguggguc

SEQ ID NO: 248981 - RNA, 63 nt, hsa
caggacagcugcuguggggugcagaggcagaagaugaaggacaaaaggaagggaaaacugaug

SEQ ID NO: 248982 - RNA, 63 nt, hsa
cuuacgaauguacaacacaaacuguaugaagccaugaaggaaacagaggggccaaaggguggg

SEQ ID NO: 248983 - RNA, 63 nt, hsa
auuagaaugcuacaaguaacucagugaaggcccaugaaggaaauugggacuaguuuauaggag

SEQ ID NO: 248984 - RNA, 63 nt, hsa
gccagaacuugaagucuuuugucccaguuugggaugaaggaaaggaggaagaggcgguggcug

SEQ ID NO: 248985 - RNA, 63 nt, hsa
ugccaccucccucucucugaggcaggccuguggaugaaggaggagggucagggcuggccuucc

SEQ ID NO: 248986 - RNA, 63 nt, hsa
ugcuagaugucaucucuggauugcacauggaugaugaaggaacucagcauugaaaguuggggg

SEQ ID NO: 248987 - RNA, 63 nt, hsa
uguuaacaucuuugaucaguggguguaucuguaaugaaggagguucaagaggcugugcuuucc

SEQ ID NO: 248988 - RNA, 63 nt, hsa
guuuggacauacauaaggagagaagguacagugaugaaggagaccauaauucuguaguguuga

SEQ ID NO: 248989 - RNA, 63 nt, hsa
auauagcacuuuuauguucauauuuuuuuuuuaaugaaggaaacguucaauaagugagucaug

SEQ ID NO: 248990 - RNA, 63 nt, hsa
cagucaacuguggcaccuguaaccucccggaacaugaaggacuaugcucugaggcuauacucu

SEQ ID NO: 248991 - RNA, 63 nt, hsa
uuccucagcuucuucacaggcacuccuggagauaugaaggauuacucuccauaucccuuccuc

SEQ ID NO: 248992 - RNA, 63 nt, hsa
aacagaacagaaagguguggugcuggaacaucgaugaaggagcccuacuuacugagcuuaguu

SEQ ID NO: 248993 - RNA, 63 nt, hsa
uucccuggccccgccggauguauaaauguaaaaaugaaggaauuacauuuuauaugugagcga

SEQ ID NO: 248994 - RNA, 63 nt, hsa
cacccuugcuguucuucucaaucucuugcucuaaugaaggaacuguguaucucaaaaaccaua

SEQ ID NO: 248995 - RNA, 63 nt, hsa
aauuauacuuaagaucuucaauuucuucaaaaaaugaaggaucaaaauuuuccaguucuuuuu

SEQ ID NO: 248996 - RNA, 63 nt, hsa
gccauugucauccauuucccaguuagggcaacaaugaaggaggacccagccaagcuagaagga

SEQ ID NO: 248997 - RNA, 63 nt, hsa
aagcccugggccacugccauuggguuagucaagaugaaggaggaggacuggcugccuccauuu

SEQ ID NO: 248998 - RNA, 63 nt, hsa
ucucugaaagcuguccuuucagaugagggagaaaugaaggauuucacacuucagaauauuuua

SEQ ID NO: 248999 - RNA, 63 nt, hsa
guuaaagaggguccuguuccucucuuccuguugaugaaggagcgugaggguguuagcagugug

SEQ ID NO: 249000 - RNA, 63 nt, hsa
cacauuuuuaucuagaugaaaauuuggaaugaaaugaaggaauagaaauccaauaaaagaguu

SEQ ID NO: 249001 - RNA, 63 nt, hsa
uuccuaagaugcaucucgcauaggcugccuaugaugaaggaccgugcaccuccacuccaacag

SEQ ID NO: 249002 - RNA, 63 nt, hsa
cuaugucagagccacauucccgucacauuauaaaugaaggaguggauucuuaaauaagaccua

SEQ ID NO: 249003 - RNA, 63 nt, hsa
augauuuuaauccagaacuuccucauaaaaugcaugaaggacuuugaucgugaauuuuuuuag

SEQ ID NO: 249004 - RNA, 63 nt, hsa
aaaaguucugccauguuaaguggccagcauuucaugaaggauaacauuuuuauacagaaggca

SEQ ID NO: 249005 - RNA, 63 nt, hsa
gacagcuguugaucuuguugcagaacugcacugaugaaggagagcgggaagcuauccagaagu

SEQ ID NO: 249006 - RNA, 63 nt, hsa
auaauucuggauuuucuuaucacaaaaaagaaaaugaaggaccucaaagcaccugaacaguuu

SEQ ID NO: 249007 - RNA, 63 nt, hsa
gacccagugauaaaaacuuccuuuuagggaucaaugaaggagagaaggucuuggaaucaccuu

SEQ ID NO: 249008 - RNA, 63 nt, hsa
gauuuuaaaaguuuuacauguaggagugugggaaugaaggaauucuggagcuuuuugacacaa

SEQ ID NO: 249009 - RNA, 63 nt, hsa
accccaguggugggacccuggaccaggccauggaugaaggacaaagaccagggcaggucacgg

SEQ ID NO: 249010 - RNA, 63 nt, hsa
caccuaaaaaagaguguguugauggcaguuccaaugaaggacaacuaauuuauaacuuguucu

SEQ ID NO: 249011 - RNA, 63 nt, hsa
gugugucagauggucuuuauauauuuuuucuguaugaaggaauagccuugccuacugaagaua

SEQ ID NO: 249012 - RNA, 62 nt, hsa
ccagaaaauccaauccuuaaaucaacugcuugaugaaggaggcaaaacaaaggcagcaggag

SEQ ID NO: 249013 - RNA, 63 nt, hsa
aauuggugacccaacccuaggaaguagggagaaaugaaggaagggcauaggaaaauuuuccca

SEQ ID NO: 249014 - RNA, 63 nt, hsa
cccccuuuccacugggcccuuccaacacaaugaaugaaggaaauaucauuuauuuaagcagcc

SEQ ID NO: 249015 - RNA, 63 nt, hsa
aagagagacuaucgaucggccagguguauaauuaugaaggagaaaacuguucaagaacaaaau

SEQ ID NO: 249016 - RNA, 63 nt, hsa
caagugaguggagaguguuuuuaauguuuuugaaugaaggaaaugagguuuuguuucaccugu

SEQ ID NO: 249017 - RNA, 63 nt, hsa
aaccaugcacuccacaaaggggagcauuuggaaaugaaggacuagcuccuauguaucagguua

SEQ ID NO: 249018 - RNA, 63 nt, hsa
augcggcugggguaugaaaacacugagaaggagaugaaggaguguguguagcaugggggugug

SEQ ID NO: 249019 - RNA, 63 nt, hsa
uaaccucuuucuucucaugugccagauguuaagaugaaggaggaauacaacacauacucaagc

SEQ ID NO: 249020 - RNA, 63 nt, hsa
accgugucagcaugguugccuggcuaccugcucaugaaggacuugauuaauagcaaauuggca

SEQ ID NO: 249021 - RNA, 63 nt, hsa
auuuuccauuuuuguuuaaucaaauacuugcuuaugaaggauuucagaaauuuguaauaaaug

SEQ ID NO: 249022 - RNA, 63 nt, hsa
cacagcugugaggcgaugcuguuccaucugcacaugaaggacccccauacagccugucuccca

SEQ ID NO: 249023 - RNA, 63 nt, hsa
gagguaacuaguucaguuuguugggauggaagcaugaaggaaagggcuagagaaguaugaaau

SEQ ID NO: 249024 - RNA, 63 nt, hsa
gauacauugagauagaauuaaggaaaaacuuuaaugaaggaauguacccauguacauauguga

SEQ ID NO: 249025 - RNA, 63 nt, hsa
aauuuuguuuugcuugcuguuuuaacuugacagaugaaggacuuuaguugaacuucauauugu

SEQ ID NO: 249026 - RNA, 63 nt, hsa
gucugggucuauucccacacuuacugaguacagaugaaggaaagugguagcaauuuaaucaua

SEQ ID NO: 249027 - RNA, 63 nt, hsa
aagaucacaugaggguaguauuuaauauauuagaugaaggacaacuuuggacauaacacugac

SEQ ID NO: 249028 - RNA, 63 nt, hsa
aaguaauugaucguuugcugccagcccagaaggaugaaggaaagaagcaccucacagcuccuu

SEQ ID NO: 249029 - RNA, 63 nt, hsa
gcugggggcaucggcaaggccaagcugcgcagcaugaaggagcgaaagcuggagaagaagcag

SEQ ID NO: 249030 - RNA, 63 nt, hsa
gaaauauuuauuaagggaaaacuaaguuacugaaugaaggaaccucuuucuuacaaaacaaaa

SEQ ID NO: 249031 - RNA, 63 nt, hsa
ugacacaggagggcugggcuccacuucauccagaugaaggaaaggaagaccucaagaaaaauu

SEQ ID NO: 249032 - RNA, 63 nt, hsa
ugacauacuaaaaaaaauaaaaccuaguauuguaugaaggauagcuauucuuuacagcauuua

SEQ ID NO: 249033 - RNA, 63 nt, hsa
uacagaaggaaagagaucuugccuuuugaaaagaugaaggaacaaagguugagagaacauuua

SEQ ID NO: 249034 - RNA, 63 nt, hsa
cugcaugccuggcgagcuggggcccagggcagcaugaaggagagcccugcguucugugcuucu

SEQ ID NO: 249035 - RNA, 63 nt, hsa
uuccagaagagacuagagaccuuaggccaggagaugaaggaguucaguagcaaagucacaccu

SEQ ID NO: 249036 - RNA, 63 nt, hsa
uucuacaguugauauauuuguaacugguacaagaugaaggacagcagcuuuccaucccuaguu

SEQ ID NO: 249037 - RNA, 63 nt, hsa
uucaggggcaguggggggcuccaggcacggucaaugaaggaaacagugccuguccacccaccc

SEQ ID NO: 249038 - RNA, 63 nt, hsa
ggggaucucagcgcagagaaguugagaggacccaugaaggaagcaaggacacggggcaggcac

SEQ ID NO: 249039 - RNA, 63 nt, hsa
auagagccccuccccagggccccacccugccauaugaaggaccccacccccgacaccacaagg

SEQ ID NO: 249040 - RNA, 63 nt, hsa
uggacauaaagucaaagaaugauggcagguaggaugaaggagagauacuuaggaaauccuaaa

SEQ ID NO: 249041 - RNA, 63 nt, hsa
guuuuuaagggcuuuauuauagaagaaguauuaaugaaggacuuuccuuccucccucccuuuc

SEQ ID NO: 249042 - RNA, 63 nt, hsa
uuuccauauguuuuauauaaauauauauauaauaugaaggacuacccuccuuuuuuuuuuuug

SEQ ID NO: 249043 - RNA, 63 nt, hsa
aacugucuucugucgagaaguaaaggaaacuucaugaaggauguagaagcuuagcugccucag

SEQ ID NO: 249044 - RNA, 63 nt, hsa
uugucuggugguggggggcaggggacagaggccaugaaggagcaaguuuuguauuugugaccu

SEQ ID NO: 249045 - RNA, 63 nt, hsa
gcuggcuggcucagcuaaguggcacgaugacgcaugaaggagauuauguugugcucuuuauug

SEQ ID NO: 249046 - RNA, 63 nt, hsa
acuaaucguuaauaacuauuguauuaaauugucaugaaggaacuuguuuaauaaauggacgug

SEQ ID NO: 249047 - RNA, 63 nt, hsa
uggaguuaaaaagagcuuuuguugagauuuggcaugaaggauauggugcucuauuuguaauag

SEQ ID NO: 249048 - RNA, 63 nt, hsa
agcaccgagaaccaucugugagcugccgcugugaugaaggagccugcucugaggaacagacag

SEQ ID NO: 249049 - RNA, 63 nt, hsa
acagcuucuauuggacauauuuucuuuuuaggaaugaaggaaaauucucccauuuuugagcca

SEQ ID NO: 249050 - RNA, 63 nt, hsa
uaccuaaggaaaaagacaguuuuucuagguaccaugaaggaagauugacccuguugguaugcc

SEQ ID NO: 249051 - RNA, 63 nt, hsa
cuucuccugcugauagcagucagcuugaggaggaugaaggaaggcagccucagacaggaauua

SEQ ID NO: 249052 - RNA, 63 nt, hsa
uucacugcgucauuguaacaugaagggauaaaaaugaaggagaaggaggguuugggaugggug

SEQ ID NO: 249053 - RNA, 63 nt, hsa
caccccugcccccugguucaccagagggagcggaugaaggauggcagcaucucacaugcccca

SEQ ID NO: 249054 - RNA, 63 nt, hsa
agucagacuggggugcaggaccuguccaccucaaugaaggagagaggagcauggggugucccg

SEQ ID NO: 249055 - RNA, 63 nt, hsa
aaaacuguauugaaaaaauauuguuuaaugcaaaugaaggaaugcaauaaagaguaaauauac

SEQ ID NO: 249056 - RNA, 63 nt, hsa
agguuggaggacaccgacuaauuugggaaacggaugaaggacugagaaggcccccgcucccuc

SEQ ID NO: 249057 - RNA, 63 nt, hsa
agcuggagaaaagaagacaagaaagucuugggcaugaaggagcuuuuugcaucuagugggugg

SEQ ID NO: 249058 - RNA, 63 nt, hsa
aggagcaugguuuggugguuaagguuuagugggaugaaggaccugucuuggugggccgggccc

SEQ ID NO: 249059 - RNA, 63 nt, hsa
aaaagccccgggaucuguuugguagcaggagaaaugaaggaagaugaaaaagcaggcagggaa

SEQ ID NO: 249060 - RNA, 63 nt, hsa
gguugggaaaugucccucaaaauccugggcacuaugaaggaacccccugcccccucaccuuuu

SEQ ID NO: 249061 - RNA, 63 nt, hsa
aauuauuucccccaagguagugaaguaauuggaaugaaggaggcugaaaguauugucuaaagu

SEQ ID NO: 249062 - RNA, 63 nt, hsa
aaacaggcaacguguucuuguaaccuuuauuucaugaaggacuucuuuuuguuucuaacuaua

SEQ ID NO: 249063 - RNA, 63 nt, hsa
aacucuuuuauuaaacuuggaacaaccauuuaaaugaaggauuuugugagauagaauucaauu

SEQ ID NO: 249064 - RNA, 63 nt, hsa
ggggacggggugaguggaaacuuaguuugaguaaugaaggaaucuucacagaagcaaaucaga

SEQ ID NO: 249065 - RNA, 63 nt, hsa
agugacaaguggguccaggacuauaucaaggacaugaaggagaacugagugacccagaagggg

SEQ ID NO: 249066 - RNA, 63 nt, hsa
uuugagguaguuguccguuugagucaugggcaaaugaaggacuuuggucauuuuggacacuua

SEQ ID NO: 249067 - RNA, 63 nt, hsa
ugauuuucucuuuucaacuucuugaacuuggacaugaaggaugugggcccagaaucauguggc

SEQ ID NO: 249068 - RNA, 63 nt, hsa
cagcagugccugcccguguccccaugucccggcaugaaggacacugcuagagaguuaccaugc

SEQ ID NO: 249069 - RNA, 63 nt, hsa
agccccgcuucuucccacuccacuuguugucccaugaaggaagaagugggguuccuccugacc

SEQ ID NO: 249070 - RNA, 63 nt, hsa
uauuaacccuuucagacccagucuguuggagccaugaaggaagagggaaagagggcugccauu

SEQ ID NO: 249071 - RNA, 63 nt, hsa
cugcacuuugcugcgaaaagcaaagggccuucuaugaaggacaaaacuugcagaauugggugu

SEQ ID NO: 249072 - RNA, 63 nt, hsa
uagugaauuaauuauucauuccauuccacuaucaugaaggacucugaauagacuuggccaacu

SEQ ID NO: 249073 - RNA, 63 nt, hsa
augcaggagaugcuacacaaaauacaaaaacagaugaaggagaacuauuaacuggcuuucagc

SEQ ID NO: 249074 - RNA, 63 nt, hsa
aaugauuacaguuuucauuuuuaaaaauuuaggaugaaggaaacaaggaaauauagggaaaag

SEQ ID NO: 249075 - RNA, 63 nt, hsa
agcugguaaacugaagagcacaacuauauucuuaugaaggaauuuguaccuuugggguauuau

SEQ ID NO: 249076 - RNA, 63 nt, hsa
agaagacauagacguugaaacagaaacagaaggaugaaggacaguuuuuuccuucuuaguuau

SEQ ID NO: 249077 - RNA, 63 nt, hsa
aacacauucuuauuaauucuucaccuguuauguaugaaggaaucauuccagugcuagaaaauu

SEQ ID NO: 249078 - RNA, 63 nt, hsa
gauacugaugacagugugggugacagcaugguaaugaaggacagugaggcuccugcuuauuua

SEQ ID NO: 249079 - RNA, 63 nt, hsa
agcaugcccaagacuauguccugacauauaacuaugaaggaagaggaucgguggcugggucug

SEQ ID NO: 249080 - RNA, 63 nt, hsa
acaucacuaaacaaagguuaacccuugugugaaaugaaggaacugucaauaauugacagccaa

SEQ ID NO: 249081 - RNA, 63 nt, hsa
aguuacacuaacccuuaauuaucuuacuugucuaugaaggagauaaacaggguacuguacugg

SEQ ID NO: 249082 - RNA, 63 nt, hsa
cugagggcgauuucggaaauguuuucagcagaaaugaaggauaagcaucgcacauguccagca

SEQ ID NO: 249083 - RNA, 63 nt, hsa
aaaacccagugcccugguuuuuccccacccgagaugaaggauacgcuguauuuuuugccuaau

SEQ ID NO: 249084 - RNA, 63 nt, hsa
cuuuuuuaacuguuaaaccaaaggaaagcacaaaugaaggaaauccuguguaaagcauugaga

SEQ ID NO: 249085 - RNA, 63 nt, hsa
gaugagggugcaugaguguauguuugcauucacaugaaggaauugcuuuucacaccagaaauu

SEQ ID NO: 249086 - RNA, 63 nt, hsa
agacacauaauugucagauucaccaaaguugaaaugaaggaaaaaauguuaagggcagccaga

SEQ ID NO: 249087 - RNA, 63 nt, hsa
aacaccagcuuaccuuggaguaugaaucuacccaugaaggaugagagauguuuugaaaaacua

SEQ ID NO: 249088 - RNA, 63 nt, hsa
gagaaaugugucaucaggagaacaucauaacccaugaaggauaaaagccccaaauggugguaa

SEQ ID NO: 249089 - RNA, 63 nt, hsa
auuagcugaggauuauuucuauccaauuuccugaugaaggacauugccuuuugagauuaaaua

SEQ ID NO: 249090 - RNA, 63 nt, hsa
guuggauugcagagacauuuucuggagugauccaugaaggaccauuaaccugugauaccuuuc

SEQ ID NO: 249091 - RNA, 63 nt, hsa
uccuugcaaagagaauccuguacuucacucagaaugaaggaacaaguaucucaggaugaaauc

SEQ ID NO: 249092 - RNA, 63 nt, hsa
uguguguuucaagaaauucaccaugucagcaauaugaaggauguuauggaaggcgugcuaggc

SEQ ID NO: 249093 - RNA, 63 nt, hsa
cucauaguguaaacucacauuugauguguuuuuaugaaggaaaguaaccaagaaaccucuagg

SEQ ID NO: 249094 - RNA, 63 nt, hsa
uuuuagacaaaaccuuuaaaguauaguaaagguaugaaggacuucugagcaucagauaaucca

SEQ ID NO: 249095 - RNA, 63 nt, hsa
cccaggauaaaggacauccggauagguguguuuaugaaggauggggccuggaaaggcaacuuu

SEQ ID NO: 249096 - RNA, 63 nt, hsa
uauauugggugugaguucagguugccucucacaaugaaggaaguuggucuuugucugcaggug

SEQ ID NO: 249097 - RNA, 63 nt, hsa
agagaagugugcaauagucuggaauaaauauaaaugaaggaggggccaugucuguccauuuga

SEQ ID NO: 249098 - RNA, 63 nt, hsa
uagaagacuuuuaggaaaauaucagagaauuuaaugaaggaaagaagccuuggcaaaaugaug

SEQ ID NO: 249099 - RNA, 63 nt, hsa
uauaauuauggacacugcaucaguauacauaacaugaaggaauaaaaaggauacagaauugua

SEQ ID NO: 249100 - RNA, 63 nt, hsa
auuuagcccuuacucaaaaucagauaauuaacaaugaaggaaacucuaaacuccccuuauggu

SEQ ID NO: 249101 - RNA, 63 nt, hsa
uuuacuagaaaauaucaucuuagaagaaaccccaugaaggaaaagaauagggaaaagcuuuca

SEQ ID NO: 249102 - RNA, 63 nt, hsa
aacacccgucugggaaggccccaaggucagcuuaugaaggaccccacuugcaccccaccccag

SEQ ID NO: 249103 - RNA, 63 nt, hsa
agcaagcaacuugcaggcuccauggaacuuuuaaugaaggacagugucuucuuugaagaaaau

SEQ ID NO: 249104 - RNA, 63 nt, hsa
ugugcuugaauuuaguagcuuacagcauuauuuaugaaggaaaaaauacauaaauaugaagua

SEQ ID NO: 249105 - RNA, 63 nt, hsa
ugagcccagguaagaccucucugaagagcugucaugaaggagggagggagcacauuccuggca

SEQ ID NO: 249106 - RNA, 63 nt, hsa
aauucuaugagcaugccaaggcucugugggaggaugaaggagugcgugccugcuacgaacgcu

SEQ ID NO: 249107 - RNA, 63 nt, hsa
uugauacccaccaaaagaauguaucucgaaagaaugaaggaagaagaaaaaaggauccuugau

SEQ ID NO: 249108 - RNA, 63 nt, hsa
gugacaaggacgcccgaagcacaguggacggucaugaaggagcggggguguggcaggcgggug

SEQ ID NO: 249109 - RNA, 63 nt, hsa
uaagcucgccaagucuguguugcugugaaaugaaugaaggagaggcuccuguucaucuugugg

SEQ ID NO: 249110 - RNA, 63 nt, hsa
auugacauuauuuucucauuugcuuuguaugguaugaaggauuuguaaagcuuugcucaaagu

SEQ ID NO: 249111 - RNA, 63 nt, hsa
cuacacagcaagagaacagaaauacugugucucaugaaggaucacagaguucagggggaaaau

SEQ ID NO: 249112 - RNA, 63 nt, hsa
guguucauguuuuauacauguaagucuguuggcaugaaggaccauuuucuacauaauaugaca

SEQ ID NO: 249113 - RNA, 63 nt, hsa
ucaaggaaaccuugacuuauaccuagcugucauaugaaggaaaugcaaagaaacauauauuuu

SEQ ID NO: 249114 - RNA, 63 nt, hsa
aaauagauucuuaaaguggcuuucaacuucaagaugaaggagcuuaauaaugguuacucauuu

SEQ ID NO: 249115 - RNA, 63 nt, hsa
ugccccuccaguucugguucaccuguaccuucuaugaaggagaauucgucaugucauucaaca

SEQ ID NO: 249116 - RNA, 63 nt, hsa
augaauucuggucacauuccauuucucuccaacaugaaggaucaaaaaauguuuuucaaugug

SEQ ID NO: 249117 - RNA, 63 nt, hsa
cuggggcccaagaucaucauugugaagcggaugaugaaggacgucuucuucuuccucuuccug

SEQ ID NO: 249118 - RNA, 63 nt, hsa
uauucucuaguauauagcuacaccuuuaauaaaaugaaggaaugucuucaaucauauuuuagu

SEQ ID NO: 249119 - RNA, 63 nt, hsa
accaugucugaccugcaaaaaugcuggagaaaaaugaaggaaaaaauuauguuuuucaguuua

SEQ ID NO: 249120 - RNA, 63 nt, hsa
gagacuaaugcugugcuucaaaaggugucucauaugaaggaugaaaaagaggcccugauaaac

SEQ ID NO: 249121 - RNA, 63 nt, hsa
ccaagauaaauugcaugcggcauggccccagccaugaaggaacuuaaccgcuagugccgagga

SEQ ID NO: 249122 - RNA, 63 nt, hsa
gaaucuucgaaauauguacacagagaaaaucacaugaaggagaccugggguccccacuuguga

SEQ ID NO: 249123 - RNA, 63 nt, hsa
accccggacgccgagacugagaagcuuaucaggaugaaggaugaggaaguauguggggcggcg

SEQ ID NO: 249124 - RNA, 63 nt, hsa
aacuaggcccugccucugucaccucauugguccaugaaggagcagccaggggugguggaagga

SEQ ID NO: 249125 - RNA, 63 nt, hsa
accuucagagacagucuacgccuuaacaagcacaugaaggaaacuauuuugaauguucucuuu

SEQ ID NO: 249126 - RNA, 63 nt, hsa
gugguguucugguaaaauuguuagaauagcuguaugaaggaaaccagugggaggaaaugaagu

SEQ ID NO: 249127 - RNA, 63 nt, hsa
gauggcuggaucuggggcagccaccuugcuaccaugaaggaaaggccaagacaaucauccaca

SEQ ID NO: 249128 - RNA, 63 nt, hsa
ugacaagcucagagagcaugaacugaugcuggcaugaaggauuccaggaagaucauggagacc

SEQ ID NO: 249129 - RNA, 63 nt, hsa
aaugugagauugaacugaacaaacccucaucucaugaaggacgggguguguguguggcguuga

SEQ ID NO: 249130 - RNA, 63 nt, hsa
cugucuuuguaacuacucaaggccaacugucacaugaaggaaugaauaaagaguuuuuacuga

SEQ ID NO: 249131 - RNA, 63 nt, hsa
ccaguuauuuaaccuguaaaaugucaauagcaaaugaaggaugaaguauaucucuagaugcaa

SEQ ID NO: 249132 - RNA, 63 nt, hsa
guggcggaggaacuccugccacgccacugugucaugaaggaaagugaaagggaacgaggaagu

SEQ ID NO: 249133 - RNA, 63 nt, hsa
agaggguuugcauuuuggauuaauucaugcaaaaugaaggaggaagccuggucuaagaagaua

SEQ ID NO: 249134 - RNA, 63 nt, hsa
uguccaugaggagaaaaaaagcaugugucaugcaugaaggaaacugaacuugagguggccucc

SEQ ID NO: 249135 - RNA, 63 nt, hsa
guuguaauauuuuuacaggauauuccuagguaaaugaaggagccuucaguuguaaauuucaau

SEQ ID NO: 249136 - RNA, 63 nt, hsa
auacuccccuaucuuguccuagcccaggccuccaugaaggagaaccugguggcauugccccag

SEQ ID NO: 249137 - RNA, 63 nt, hsa
gcacugugcauguaaacagguuccuuugcucagaugaaggaaguaggggguggggcuuuccuu

SEQ ID NO: 249138 - RNA, 63 nt, hsa
ccggccccugccccgcccccaagcucggaucacaugaaggagacagcagcacccacccaugca

SEQ ID NO: 249139 - RNA, 63 nt, hsa
uucuuuuaagccucugaaauaauugaaggcaagaugaaggaacuaucugaagaaaucacuaca

SEQ ID NO: 249140 - RNA, 63 nt, hsa
ucaguauucuuuuucaacauguagggcaagaggaugaaggaaggggcuauccugggaccuccc

SEQ ID NO: 249141 - RNA, 63 nt, hsa
ccgcuagagcuggaaggcaggaugaggagagguaugaaggagccugagccaugaagugggaag

SEQ ID NO: 249142 - RNA, 63 nt, hsa
cuuuuaaaaucauguaucuugauuguugauuuaaugaaggauuuccuuuuaaugcugcuuuug

SEQ ID NO: 249143 - RNA, 63 nt, hsa; identical to SEQ ID NO: 249137

SEQ ID NO: 249144 - RNA, 63 nt, hsa
ugcagcacugcagaaaugccucugcguggugccaugaaggaaagaaaccuuggccuggucucg

SEQ ID NO: 249145 - RNA, 63 nt, hsa
uauugucccuggcuuccuuacuaugguguaaucaugaaggagugaaacaucauagaaacuguc

SEQ ID NO: 249146 - RNA, 63 nt, hsa
caauauuaaaucugcuggaguuucauguacaagaugaaggagaggcaacauccaaaauaguua

SEQ ID NO: 249147 - RNA, 64 nt, hsa; identical to SEQ ID NO: 80199

SEQ ID NO: 249148 - RNA, 64 nt, hsa; identical to SEQ ID NO: 80200

SEQ ID NO: 249149 - RNA, 64 nt, hsa; identical to SEQ ID NO: 80201

SEQ ID NO: 249150 - RNA, 64 nt, hsa; identical to SEQ ID NO: 80202

SEQ ID NO: 249151 - RNA, 64 nt, hsa; identical to SEQ ID NO: 80203

SEQ ID NO: 249152 - RNA, 64 nt, hsa; identical to SEQ ID NO: 80204

SEQ ID NO: 249153 - RNA, 64 nt, hsa; identical to SEQ ID NO: 80205

SEQ ID NO: 249154 - RNA, 64 nt, hsa; identical to SEQ ID NO: 80206

SEQ ID NO: 249155 - RNA, 64 nt, hsa; identical to SEQ ID NO: 80207

SEQ ID NO: 249156 - RNA, 64 nt, hsa; identical to SEQ ID NO: 80208

SEQ ID NO: 249157 - RNA, 64 nt, hsa; identical to SEQ ID NO: 80209

SEQ ID NO: 249158 - RNA, 64 nt, hsa; identical to SEQ ID NO: 80210

SEQ ID NO: 249159 - RNA, 64 nt, hsa; identical to SEQ ID NO: 80211

SEQ ID NO: 249160 - RNA, 64 nt, hsa; identical to SEQ ID NO: 80212

SEQ ID NO: 249161 - RNA, 64 nt, hsa; identical to SEQ ID NO: 80213

SEQ ID NO: 249162 - RNA, 64 nt, hsa; identical to SEQ ID NO: 80214

SEQ ID NO: 249163 - RNA, 64 nt, hsa; identical to SEQ ID NO: 80215

SEQ ID NO: 249164 - RNA, 64 nt, hsa; identical to SEQ ID NO: 80216

SEQ ID NO: 249165 - RNA, 64 nt, hsa; identical to SEQ ID NO: 80217

SEQ ID NO: 249166 - RNA, 64 nt, hsa; identical to SEQ ID NO: 80218

SEQ ID NO: 249167 - RNA, 64 nt, hsa; identical to SEQ ID NO: 80219

SEQ ID NO: 249168 - RNA, 64 nt, hsa; identical to SEQ ID NO: 80220

SEQ ID NO: 249169 - RNA, 64 nt, hsa; identical to SEQ ID NO: 80221

SEQ ID NO: 249170 - RNA, 64 nt, hsa; identical to SEQ ID NO: 80222

SEQ ID NO: 249171 - RNA, 64 nt, hsa; identical to SEQ ID NO: 80223

SEQ ID NO: 249172 - RNA, 64 nt, hsa; identical to SEQ ID NO: 80224

SEQ ID NO: 249173 - RNA, 64 nt, hsa; identical to SEQ ID NO: 80225

SEQ ID NO: 249174 - RNA, 64 nt, hsa; identical to SEQ ID NO: 80226

SEQ ID NO: 249175 - RNA, 64 nt, hsa; identical to SEQ ID NO: 80227

SEQ ID NO: 249176 - RNA, 64 nt, hsa; identical to SEQ ID NO: 80228

SEQ ID NO: 249177 - RNA, 64 nt, hsa; identical to SEQ ID NO: 80229

SEQ ID NO: 249178 - RNA, 64 nt, hsa; identical to SEQ ID NO: 80230

SEQ ID NO: 249179 - RNA, 64 nt, hsa; identical to SEQ ID NO: 80231

SEQ ID NO: 249180 - RNA, 52 nt, hsa; identical to SEQ ID NO: 80232

SEQ ID NO: 249181 - RNA, 64 nt, hsa; identical to SEQ ID NO: 80233

SEQ ID NO: 249182 - RNA, 64 nt, hsa; identical to SEQ ID NO: 80234

SEQ ID NO: 249183 - RNA, 64 nt, hsa; identical to SEQ ID NO: 80235

SEQ ID NO: 249184 - RNA, 64 nt, hsa; identical to SEQ ID NO: 80236

SEQ ID NO: 249185 - RNA, 64 nt, hsa; identical to SEQ ID NO: 80237

SEQ ID NO: 249186 - RNA, 64 nt, hsa; identical to SEQ ID NO: 80238

SEQ ID NO: 249187 - RNA, 64 nt, hsa; identical to SEQ ID NO: 80239

SEQ ID NO: 249188 - RNA, 64 nt, hsa; identical to SEQ ID NO: 80240

SEQ ID NO: 249189 - RNA, 64 nt, hsa; identical to SEQ ID NO: 80241

SEQ ID NO: 249190 - RNA, 64 nt, hsa; identical to SEQ ID NO: 80242

SEQ ID NO: 249191 - RNA, 64 nt, hsa; identical to SEQ ID NO: 80243

SEQ ID NO: 249192 - RNA, 64 nt, hsa; identical to SEQ ID NO: 80244

SEQ ID NO: 249193 - RNA, 64 nt, hsa; identical to SEQ ID NO: 80245

SEQ ID NO: 249194 - RNA, 64 nt, hsa; identical to SEQ ID NO: 80246

SEQ ID NO: 249195 - RNA, 64 nt, hsa; identical to SEQ ID NO: 80247

SEQ ID NO: 249196 - RNA, 64 nt, hsa; identical to SEQ ID NO: 80248

SEQ ID NO: 249197 - RNA, 64 nt, hsa; identical to SEQ ID NO: 80249

SEQ ID NO: 249198 - RNA, 64 nt, hsa; identical to SEQ ID NO: 80250

SEQ ID NO: 249199 - RNA, 64 nt, hsa; identical to SEQ ID NO: 80251

SEQ ID NO: 249200 - RNA, 64 nt, hsa; identical to SEQ ID NO: 80252

SEQ ID NO: 249201 - RNA, 64 nt, hsa; identical to SEQ ID NO: 80253

SEQ ID NO: 249202 - RNA, 64 nt, hsa; identical to SEQ ID NO: 80254

SEQ ID NO: 249203 - RNA, 64 nt, hsa; identical to SEQ ID NO: 80255

SEQ ID NO: 249204 - RNA, 64 nt, hsa; identical to SEQ ID NO: 80256

SEQ ID NO: 249205 - RNA, 64 nt, hsa; identical to SEQ ID NO: 80257

SEQ ID NO: 249206 - RNA, 64 nt, hsa; identical to SEQ ID NO: 80258

SEQ ID NO: 249207 - RNA, 64 nt, hsa; identical to SEQ ID NO: 80259

SEQ ID NO: 249208 - RNA, 64 nt, hsa; identical to SEQ ID NO: 80260

SEQ ID NO: 249209 - RNA, 64 nt, hsa; identical to SEQ ID NO: 80261

SEQ ID NO: 249210 - RNA, 64 nt, hsa; identical to SEQ ID NO: 80262

SEQ ID NO: 249211 - RNA, 64 nt, hsa; identical to SEQ ID NO: 80263

SEQ ID NO: 249212 - RNA, 64 nt, hsa; identical to SEQ ID NO: 80264

SEQ ID NO: 249213 - RNA, 64 nt, hsa; identical to SEQ ID NO: 80265

SEQ ID NO: 249214 - RNA, 64 nt, hsa; identical to SEQ ID NO: 80266

SEQ ID NO: 249215 - RNA, 64 nt, hsa; identical to SEQ ID NO: 80267

SEQ ID NO: 249216 - RNA, 64 nt, hsa; identical to SEQ ID NO: 80268

SEQ ID NO: 249217 - RNA, 64 nt, hsa; identical to SEQ ID NO: 80269

SEQ ID NO: 249218 - RNA, 64 nt, hsa; identical to SEQ ID NO: 80270

SEQ ID NO: 249219 - RNA, 64 nt, hsa; identical to SEQ ID NO: 80271

SEQ ID NO: 249220 - RNA, 64 nt, hsa; identical to SEQ ID NO: 80272

SEQ ID NO: 249221 - RNA, 64 nt, hsa; identical to SEQ ID NO: 80273

SEQ ID NO: 249222 - RNA, 64 nt, hsa; identical to SEQ ID NO: 80274

SEQ ID NO: 249223 - RNA, 64 nt, hsa; identical to SEQ ID NO: 80275

SEQ ID NO: 249224 - RNA, 64 nt, hsa; identical to SEQ ID NO: 80276

SEQ ID NO: 249225 - RNA, 64 nt, hsa; identical to SEQ ID NO: 80277

SEQ ID NO: 249226 - RNA, 64 nt, hsa; identical to SEQ ID NO: 80278

SEQ ID NO: 249227 - RNA, 64 nt, hsa; identical to SEQ ID NO: 80279

SEQ ID NO: 249228 - RNA, 64 nt, hsa; identical to SEQ ID NO: 80280

SEQ ID NO: 249229 - RNA, 64 nt, hsa; identical to SEQ ID NO: 80281

SEQ ID NO: 249230 - RNA, 64 nt, hsa; identical to SEQ ID NO: 80282

SEQ ID NO: 249231 - RNA, 64 nt, hsa; identical to SEQ ID NO: 80283

SEQ ID NO: 249232 - RNA, 64 nt, hsa; identical to SEQ ID NO: 80284

SEQ ID NO: 249233 - RNA, 64 nt, hsa; identical to SEQ ID NO: 80285

SEQ ID NO: 249234 - RNA, 64 nt, hsa; identical to SEQ ID NO: 80286

SEQ ID NO: 249235 - RNA, 64 nt, hsa; identical to SEQ ID NO: 80287

SEQ ID NO: 249236 - RNA, 64 nt, hsa; identical to SEQ ID NO: 80288

SEQ ID NO: 249237 - RNA, 64 nt, hsa; identical to SEQ ID NO: 80289

SEQ ID NO: 249238 - RNA, 64 nt, hsa; identical to SEQ ID NO: 80290

SEQ ID NO: 249239 - RNA, 64 nt, hsa; identical to SEQ ID NO: 80291

SEQ ID NO: 249240 - RNA, 64 nt, hsa; identical to SEQ ID NO: 80292

SEQ ID NO: 249241 - RNA, 64 nt, hsa; identical to SEQ ID NO: 80293

SEQ ID NO: 249242 - RNA, 64 nt, hsa; identical to SEQ ID NO: 80294

SEQ ID NO: 249243 - RNA, 64 nt, hsa; identical to SEQ ID NO: 80295

SEQ ID NO: 249244 - RNA, 64 nt, hsa; identical to SEQ ID NO: 80296

SEQ ID NO: 249245 - RNA, 64 nt, hsa; identical to SEQ ID NO: 80297

SEQ ID NO: 249246 - RNA, 64 nt, hsa; identical to SEQ ID NO: 80298

SEQ ID NO: 249247 - RNA, 64 nt, hsa; identical to SEQ ID NO: 80299

SEQ ID NO: 249248 - RNA, 64 nt, hsa; identical to SEQ ID NO: 80300

SEQ ID NO: 249249 - RNA, 64 nt, hsa; identical to SEQ ID NO: 80301

SEQ ID NO: 249250 - RNA, 64 nt, hsa; identical to SEQ ID NO: 80302

SEQ ID NO: 249251 - RNA, 64 nt, hsa; identical to SEQ ID NO: 80303

SEQ ID NO: 249252 - RNA, 64 nt, hsa; identical to SEQ ID NO: 80304

SEQ ID NO: 249253 - RNA, 64 nt, hsa; identical to SEQ ID NO: 80305

SEQ ID NO: 249254 - RNA, 64 nt, hsa; identical to SEQ ID NO: 80306

SEQ ID NO: 249255 - RNA, 64 nt, hsa; identical to SEQ ID NO: 80307

SEQ ID NO: 249256 - RNA, 64 nt, hsa; identical to SEQ ID NO: 80308

SEQ ID NO: 249257 - RNA, 64 nt, hsa; identical to SEQ ID NO: 80309

SEQ ID NO: 249258 - RNA, 64 nt, hsa; identical to SEQ ID NO: 80310

SEQ ID NO: 249259 - RNA, 64 nt, hsa; identical to SEQ ID NO: 80311

SEQ ID NO: 249260 - RNA, 64 nt, hsa; identical to SEQ ID NO: 80312

SEQ ID NO: 249261 - RNA, 64 nt, hsa; identical to SEQ ID NO: 80313

SEQ ID NO: 249262 - RNA, 64 nt, hsa; identical to SEQ ID NO: 80314

SEQ ID NO: 249263 - RNA, 64 nt, hsa; identical to SEQ ID NO: 80315

SEQ ID NO: 249264 - RNA, 64 nt, hsa; identical to SEQ ID NO: 80316

SEQ ID NO: 249265 - RNA, 64 nt, hsa; identical to SEQ ID NO: 80317

SEQ ID NO: 249266 - RNA, 64 nt, hsa; identical to SEQ ID NO: 80318

SEQ ID NO: 249267 - RNA, 64 nt, hsa; identical to SEQ ID NO: 80319

SEQ ID NO: 249268 - RNA, 64 nt, hsa; identical to SEQ ID NO: 80320

SEQ ID NO: 249269 - RNA, 64 nt, hsa; identical to SEQ ID NO: 80321

SEQ ID NO: 249270 - RNA, 64 nt, hsa; identical to SEQ ID NO: 80322

SEQ ID NO: 249271 - RNA, 64 nt, hsa; identical to SEQ ID NO: 80323

SEQ ID NO: 249272 - RNA, 64 nt, hsa; identical to SEQ ID NO: 80324

SEQ ID NO: 249273 - RNA, 51 nt, hsa; identical to SEQ ID NO: 80325

SEQ ID NO: 249274 - RNA, 64 nt, hsa; identical to SEQ ID NO: 80326

SEQ ID NO: 249275 - RNA, 64 nt, hsa; identical to SEQ ID NO: 80327

SEQ ID NO: 249276 - RNA, 64 nt, hsa; identical to SEQ ID NO: 80328

SEQ ID NO: 249277 - RNA, 64 nt, hsa; identical to SEQ ID NO: 80329

SEQ ID NO: 249278 - RNA, 64 nt, hsa; identical to SEQ ID NO: 80330

SEQ ID NO: 249279 - RNA, 62 nt, hsa; identical to SEQ ID NO: 80331

SEQ ID NO: 249280 - RNA, 64 nt, hsa; identical to SEQ ID NO: 80332

SEQ ID NO: 249281 - RNA, 64 nt, hsa; identical to SEQ ID NO: 80333

SEQ ID NO: 249282 - RNA, 64 nt, hsa; identical to SEQ ID NO: 80334

SEQ ID NO: 249283 - RNA, 54 nt, hsa; identical to SEQ ID NO: 80335

SEQ ID NO: 249284 - RNA, 64 nt, hsa; identical to SEQ ID NO: 80336

SEQ ID NO: 249285 - RNA, 64 nt, hsa; identical to SEQ ID NO: 80337

SEQ ID NO: 249286 - RNA, 64 nt, hsa; identical to SEQ ID NO: 80338

SEQ ID NO: 249287 - RNA, 64 nt, hsa; identical to SEQ ID NO: 80339

SEQ ID NO: 249288 - RNA, 64 nt, hsa; identical to SEQ ID NO: 80340

SEQ ID NO: 249289 - RNA, 64 nt, hsa; identical to SEQ ID NO: 80341

SEQ ID NO: 249290 - RNA, 64 nt, hsa; identical to SEQ ID NO: 80342

SEQ ID NO: 249291 - RNA, 64 nt, hsa; identical to SEQ ID NO: 80343

SEQ ID NO: 249292 - RNA, 64 nt, hsa; identical to SEQ ID NO: 80344

SEQ ID NO: 249293 - RNA, 64 nt, hsa; identical to SEQ ID NO: 80345

SEQ ID NO: 249294 - RNA, 64 nt, hsa; identical to SEQ ID NO: 80346

SEQ ID NO: 249295 - RNA, 64 nt, hsa; identical to SEQ ID NO: 80347

SEQ ID NO: 249296 - RNA, 64 nt, hsa; identical to SEQ ID NO: 80348

SEQ ID NO: 249297 - RNA, 64 nt, hsa; identical to SEQ ID NO: 80349

SEQ ID NO: 249298 - RNA, 64 nt, hsa; identical to SEQ ID NO: 80350

SEQ ID NO: 249299 - RNA, 64 nt, hsa; identical to SEQ ID NO: 80351

SEQ ID NO: 249300 - RNA, 59 nt, hsa; identical to SEQ ID NO: 80352

SEQ ID NO: 249301 - RNA, 64 nt, hsa; identical to SEQ ID NO: 80353

SEQ ID NO: 249302 - RNA, 64 nt, hsa; identical to SEQ ID NO: 80354

SEQ ID NO: 249303 - RNA, 64 nt, hsa; identical to SEQ ID NO: 80355

SEQ ID NO: 249304 - RNA, 64 nt, hsa; identical to SEQ ID NO: 80356

SEQ ID NO: 249305 - RNA, 64 nt, hsa; identical to SEQ ID NO: 80357

SEQ ID NO: 249306 - RNA, 64 nt, hsa; identical to SEQ ID NO: 80358

SEQ ID NO: 249307 - RNA, 64 nt, hsa; identical to SEQ ID NO: 80359

SEQ ID NO: 249308 - RNA, 64 nt, hsa; identical to SEQ ID NO: 80360

SEQ ID NO: 249309 - RNA, 64 nt, hsa; identical to SEQ ID NO: 80361

SEQ ID NO: 249310 - RNA, 64 nt, hsa; identical to SEQ ID NO: 80362

SEQ ID NO: 249311 - RNA, 64 nt, hsa; identical to SEQ ID NO: 80363

SEQ ID NO: 249312 - RNA, 64 nt, hsa; identical to SEQ ID NO: 80364

SEQ ID NO: 249313 - RNA, 64 nt, hsa; identical to SEQ ID NO: 80365

SEQ ID NO: 249314 - RNA, 64 nt, hsa; identical to SEQ ID NO: 80366

SEQ ID NO: 249315 - RNA, 64 nt, hsa; identical to SEQ ID NO: 80367

SEQ ID NO: 249316 - RNA, 64 nt, hsa; identical to SEQ ID NO: 80368

SEQ ID NO: 249317 - RNA, 64 nt, hsa; identical to SEQ ID NO: 80369

SEQ ID NO: 249318 - RNA, 64 nt, hsa; identical to SEQ ID NO: 80370

SEQ ID NO: 249319 - RNA, 64 nt, hsa; identical to SEQ ID NO: 80371

SEQ ID NO: 249320 - RNA, 64 nt, hsa; identical to SEQ ID NO: 80372

SEQ ID NO: 249321 - RNA, 64 nt, hsa; identical to SEQ ID NO: 80373

SEQ ID NO: 249322 - RNA, 64 nt, hsa; identical to SEQ ID NO: 80374

SEQ ID NO: 249323 - RNA, 64 nt, hsa; identical to SEQ ID NO: 80375

SEQ ID NO: 249324 - RNA, 64 nt, hsa; identical to SEQ ID NO: 80376

SEQ ID NO: 249325 - RNA, 64 nt, hsa; identical to SEQ ID NO: 80377

SEQ ID NO: 249326 - RNA, 64 nt, hsa; identical to SEQ ID NO: 80378

SEQ ID NO: 249327 - RNA, 64 nt, hsa; identical to SEQ ID NO: 80379

SEQ ID NO: 249328 - RNA, 64 nt, hsa; identical to SEQ ID NO: 80380

SEQ ID NO: 249329 - RNA, 64 nt, hsa; identical to SEQ ID NO: 80381

SEQ ID NO: 249330 - RNA, 64 nt, hsa; identical to SEQ ID NO: 80382

SEQ ID NO: 249331 - RNA, 64 nt, hsa; identical to SEQ ID NO: 80383

SEQ ID NO: 249332 - RNA, 64 nt, hsa; identical to SEQ ID NO: 80384

SEQ ID NO: 249333 - RNA, 64 nt, hsa; identical to SEQ ID NO: 80385

SEQ ID NO: 249334 - RNA, 64 nt, hsa; identical to SEQ ID NO: 80386

SEQ ID NO: 249335 - RNA, 64 nt, hsa; identical to SEQ ID NO: 80387

SEQ ID NO: 249336 - RNA, 64 nt, hsa; identical to SEQ ID NO: 80388

SEQ ID NO: 249337 - RNA, 64 nt, hsa; identical to SEQ ID NO: 80389

SEQ ID NO: 249338 - RNA, 64 nt, hsa; identical to SEQ ID NO: 80390

SEQ ID NO: 249339 - RNA, 64 nt, hsa; identical to SEQ ID NO: 80391

SEQ ID NO: 249340 - RNA, 53 nt, hsa; identical to SEQ ID NO: 80392

SEQ ID NO: 249341 - RNA, 64 nt, hsa; identical to SEQ ID NO: 80393

SEQ ID NO: 249342 - RNA, 64 nt, hsa; identical to SEQ ID NO: 80394

SEQ ID NO: 249343 - RNA, 64 nt, hsa; identical to SEQ ID NO: 80395

SEQ ID NO: 249344 - RNA, 64 nt, hsa; identical to SEQ ID NO: 80396

SEQ ID NO: 249345 - RNA, 64 nt, hsa; identical to SEQ ID NO: 80397

SEQ ID NO: 249346 - RNA, 64 nt, hsa; identical to SEQ ID NO: 80398

SEQ ID NO: 249347 - RNA, 64 nt, hsa; identical to SEQ ID NO: 80399

SEQ ID NO: 249348 - RNA, 64 nt, hsa; identical to SEQ ID NO: 80400

SEQ ID NO: 249349 - RNA, 64 nt, hsa; identical to SEQ ID NO: 80401

SEQ ID NO: 249350 - RNA, 64 nt, hsa; identical to SEQ ID NO: 80402

SEQ ID NO: 249351 - RNA, 64 nt, hsa; identical to SEQ ID NO: 80403

SEQ ID NO: 249352 - RNA, 64 nt, hsa; identical to SEQ ID NO: 80404

SEQ ID NO: 249353 - RNA, 64 nt, hsa; identical to SEQ ID NO: 80405

SEQ ID NO: 249354 - RNA, 64 nt, hsa; identical to SEQ ID NO: 80406

SEQ ID NO: 249355 - RNA, 64 nt, hsa; identical to SEQ ID NO: 80407

SEQ ID NO: 249356 - RNA, 64 nt, hsa; identical to SEQ ID NO: 80408

SEQ ID NO: 249357 - RNA, 64 nt, hsa; identical to SEQ ID NO: 80409

SEQ ID NO: 249358 - RNA, 64 nt, hsa; identical to SEQ ID NO: 80410

SEQ ID NO: 249359 - RNA, 64 nt, hsa; identical to SEQ ID NO: 80411

SEQ ID NO: 249360 - RNA, 64 nt, hsa; identical to SEQ ID NO: 80412

SEQ ID NO: 249361 - RNA, 64 nt, hsa; identical to SEQ ID NO: 80413

SEQ ID NO: 249362 - RNA, 64 nt, hsa; identical to SEQ ID NO: 80414

SEQ ID NO: 249363 - RNA, 64 nt, hsa; identical to SEQ ID NO: 80415

SEQ ID NO: 249364 - RNA, 64 nt, hsa; identical to SEQ ID NO: 80416

SEQ ID NO: 249365 - RNA, 64 nt, hsa; identical to SEQ ID NO: 80417

SEQ ID NO: 249366 - RNA, 64 nt, hsa; identical to SEQ ID NO: 80418

SEQ ID NO: 249367 - RNA, 58 nt, hsa
aguguacaauucaguggugugaguauauucauaagauuuauacuuggugucuauucau

SEQ ID NO: 249368 - RNA, 58 nt, hsa
auucauaagauuuauacuuggugucuauucauaagacuuauauccagcauauucauaa

SEQ ID NO: 249369 - RNA, 58 nt, hsa
ugguuuguaauuauuugaugcaauuuuaucauaagaguaacucagauucauuucaaaa

SEQ ID NO: 249370 - RNA, 58 nt, hsa
cuauuuauuagaagaguuggauaaauuuucauaagauauucaauaucuccuucagauu

SEQ ID NO: 249371 - RNA, 64 nt, hsa
acgcaugaaggcaaaagcaggucagaagcgaauacucugccauuaucucaaaaaucuuuuuuuu

SEQ ID NO: 249372 - RNA, 64 nt, hsa
gggauuacaggcaugagccaccgcgcccggcccacucugccauugucuaagccaccucugaaag

SEQ ID NO: 249373 - RNA, 64 nt, hsa
gcaaaagggucuggcugucccuugcuguuuucaucucugccaagccuauugugccucuggcugc

SEQ ID NO: 249374 - RNA, 64 nt, hsa
ccuccuccugcccuccccuucacucccucccuggcucugccagucgguucccacggagccauuu

SEQ ID NO: 249375 - RNA, 64 nt, hsa
gaucugagaauguccuucuugguuugucagucaucucugccaaaaguggugauggugguguccg

SEQ ID NO: 249376 - RNA, 64 nt, hsa
agguguuugcucucuccuuguggggagguggauccucugccagcaggugucuguccccggccca

SEQ ID NO: 249377 - RNA, 64 nt, hsa
cuucaagccuccccacuccaccgugccgaaggagcucugccagugggccugggcaggcagccac

SEQ ID NO: 249378 - RNA, 64 nt, hsa
gucuugucuuuuguuccacucuugacucucccggcucugccacuguuuucugagaaauguagca

SEQ ID NO: 249379 - RNA, 64 nt, hsa
uaacugccuuuaggucccaacccugugccugucccucugccacaguggcuuccuuccauccuau

SEQ ID NO: 249380 - RNA, 64 nt, hsa
auacauguaaaauaccaagaaauaaugucugcgccucugccaccucucucucaucucuuauuuc

SEQ ID NO: 249381 - RNA, 64 nt, hsa
gucccugugggugaaacagaacaaucgcugcccucucugccagcaggacugggugguccaaaga

SEQ ID NO: 249382 - RNA, 64 nt, hsa
uuuuuuuuuuuuuuuuugugggggugaagucuugcucugccacccaggcuggagugcaguggca

SEQ ID NO: 249383 - RNA, 64 nt, hsa
aaaaucucuuuaccuccuuggccauuuucauguucucugccaauuacuauaggcagucuucauu

SEQ ID NO: 249384 - RNA, 64 nt, hsa
aggaaguauaagucauugacaguuuccugaguggcucugccaauccauaccacccuugguacug

SEQ ID NO: 249385 - RNA, 64 nt, hsa
gcacaugccgcgggcggccaggcaacgugcgugucucugccauguggcagaagugcucuuugug

SEQ ID NO: 249386 - RNA, 64 nt, hsa
ggggagcugaaagggagccccuccucugagcagccucugccaggccuguaugaggcuuuuccca

SEQ ID NO: 249387 - RNA, 64 nt, hsa
uugagccugggccacuccucccuggccuucuuaccucugccaagagccuccagaugugccugca

SEQ ID NO: 249388 - RNA, 64 nt, hsa
cuccaggaucuccucucaccugcccccauuaaagcucugccacucaugcaggcauguguggacc

SEQ ID NO: 249389 - RNA, 64 nt, hsa
guggauaaauuggaauuuuuuauguugucucucucucugccaauuucaauacgaaucaucuucc

SEQ ID NO: 249390 - RNA, 64 nt, hsa
cacaccucgacacccaaccccugaaccccacacacucugccaugcacacaggaggagagcugga

SEQ ID NO: 249391 - RNA, 63 nt, hsa
auuuggugaaaacauccuagaugucaucacaaacucugccaaauuuguggaacuaugaaaugu

SEQ ID NO: 249392 - RNA, 64 nt, hsa
aaugaaagcuuaaaugucccugcgaacccacaaucucugccagcagaacugguuuuguucugaa

SEQ ID NO: 249393 - RNA, 64 nt, hsa
gcgugcugguacacugugccauggggguaagccgcucugccacacuuguccuggccuuccucau

SEQ ID NO: 249394 - RNA, 64 nt, hsa
cuuccagagcugguccuuacucccugccauggggcucugccacuuugccacccuggcacugauc

SEQ ID NO: 249395 - RNA, 64 nt, hsa
ccgcucuggacacaacccuuuuauagauuaauuucucugccaauuaacuugucauuuucaguac

SEQ ID NO: 249396 - RNA, 64 nt, hsa
aacuguuucacucaugguauggaaaaccccaggacucugccacucuaggcacacaugaauuaua

SEQ ID NO: 249397 - RNA, 64 nt, hsa
aguuccauuuuagacaaugaagcugcuuaguaaucucugccaagccaucucuuaauauuaaagc

SEQ ID NO: 249398 - RNA, 64 nt, hsa
cuucaccaacaaaacuuggccucuuuugguuccacucugccacccugccauuggaacuuggauu

SEQ ID NO: 249399 - RNA, 64 nt, hsa
aacuuggggacuagaccaccuuauguugagggaacucugccaccugcgugcaacccacagcuaa

SEQ ID NO: 249400 - RNA, 64 nt, hsa
cugaccacucacgauaaagcagauuuuucucugccucugccacaagguuucagaguaguguagu

SEQ ID NO: 249401 - RNA, 64 nt, hsa
aaacggugcaggccaggcgggcccuaauaaaacccucugccaggucugggagucccaggccauc

SEQ ID NO: 249402 - RNA, 64 nt, hsa
gggagggguggcugcuuggaaauaggcccaggggcucugccagccucggccucucccuccugag

SEQ ID NO: 249403 - RNA, 64 nt, hsa
gcuaggggacaucagagguucuuugagggacugccucugccacacucugacgcaaaaccacuuu

SEQ ID NO: 249404 - RNA, 64 nt, hsa
uggcuccaugcuccucacugcccgcacacccucacucugccagggcagugcuagugagcugggc

SEQ ID NO: 249405 - RNA, 64 nt, hsa
uuuguuuuuguccaucaaggcacaugagugugaccucugccauggggaaacacacacagagaua

SEQ ID NO: 249406 - RNA, 64 nt, hsa
ugcuucucuccucaucaucauucccaacaacauccucugccacacacaacaaaacguaaguuuc

SEQ ID NO: 249407 - RNA, 64 nt, hsa
gccuuagagcaucucugccuccaacccagcaguucucugccaaagcuuguggaggagggagagc

SEQ ID NO: 249408 - RNA, 64 nt, hsa
auggagcaggucuuugggaagcucccacacccaccucugccacucuuaacacuaagugagaguu

SEQ ID NO: 249409 - RNA, 64 nt, hsa
gcaggucgcggaucuccccaguugcuaaucccggcucugccacucaauccuaucccuaguuccc

SEQ ID NO: 249410 - RNA, 64 nt, hsa
ccuuggugucacaagucuuggauuucaaucccaacucugccacugaguugcugguugacugagg

SEQ ID NO: 249411 - RNA, 64 nt, hsa
ugugcacugauucacacucccugcaaaauggucacucugccaucuuggugguugguggggcagg

SEQ ID NO: 249412 - RNA, 64 nt, hsa
uaaaaucaccacguguaagaggcagccaagucagcucugccaacugcuaggggaguugggaaag

SEQ ID NO: 249413 - RNA, 64 nt, hsa
gcaugugcagcaucucgucgugcugcugugccugcucugccaacuccuccaucaguguguucug

SEQ ID NO: 249414 - RNA, 64 nt, hsa
caccuccaggacucagugaucccuggggggcaggcucugccagcccucggccacacguggcucc

SEQ ID NO: 249415 - RNA, 64 nt, hsa
gcccaggcugccguccccuagagucccagguuggcucugccaguccuguccuuuaccaaagaug

SEQ ID NO: 249416 - RNA, 64 nt, hsa
ugcauggagaggccagggcuggggacaguccgcacucugccacccuccugccccuuccacccac

SEQ ID NO: 249417 - RNA, 64 nt, hsa
aaaagugauguccccuuucccugccaccuccagccucugccagcaaugagcugucccccuccca

SEQ ID NO: 249418 - RNA, 64 nt, hsa
guggggaaauaaacugacuuuggacugcuucagucucugccaucuuccaugacugcauuuguuc

SEQ ID NO: 249419 - RNA, 64 nt, hsa
ucucccuggcaaggcucuuccuuuucagggauaucucugccaaccccuccccuguccucggguu

SEQ ID NO: 249420 - RNA, 64 nt, hsa
cagucccagcucugccucugacucgcugugugcccucugccaagucaugcccauucucuaguuc

SEQ ID NO: 249421 - RNA, 64 nt, hsa
gguaguguuggggccgggacgggcuuggcucccucucugccauacugagccugagguauuucau

SEQ ID NO: 249422 - RNA, 64 nt, hsa
aucuggagagcaucaggcccgcaggacugcacaacucugccaggggugagguucuuggccucag

SEQ ID NO: 249423 - RNA, 64 nt, hsa
acaggguugcuaucccccuuccuuuccucccucccucugccauccuucauccuuuuauccuccc

SEQ ID NO: 249424 - RNA, 59 nt, hsa
uugaaaggcucuuagucuaaaccuguggccucugccacgugcucccugccagcuucccc

SEQ ID NO: 249425 - RNA, 64 nt, hsa
uggcagcaggcggugggaugcuuguagcuccucacagcaggauuccugcccacuguuuuuucuc

SEQ ID NO: 249426 - RNA, 64 nt, hsa
uggacacaauaugcccuuccgguucuauucaaaccagcaggaucugucggugcuuagagauggc

SEQ ID NO: 249427 - RNA, 64 nt, hsa
agcucacccauucauucacccaacuuccuucauucagcaggagguccuauuacccucuccagcu

SEQ ID NO: 249428 - RNA, 64 nt, hsa
ucucugcugcauccaacaugggagcagagacuggcagcaggaggggggaacauggugagaagug

SEQ ID NO: 249429 - RNA, 64 nt, hsa
uagacagucgugccauucacaaagucagaaaauacagcaggaagagacagcuuuuagaggggca

SEQ ID NO: 249430 - RNA, 64 nt, hsa
aaaagugauggaaugacuucugcaacuguagucccagcaggaacugugaagaccagcugcccug

SEQ ID NO: 249431 - RNA, 64 nt, hsa
gacugagguuggguaggugugggguuccagaggacagcaggacacucucgcauacuuugccaaa

SEQ ID NO: 249432 - RNA, 64 nt, hsa
gagcccccagacucugugcacuucagaccagcagcagcaggagggcucccgagggccuuaugag

SEQ ID NO: 249433 - RNA, 64 nt, hsa
cgggcgcugccuggggccugggucaagggccagucagcaggaggcugccggaacaacagcggcu

SEQ ID NO: 249434 - RNA, 64 nt, hsa
gggguucuuggagagucggccagacggcggggggcagcaggaacuuugccucauaccccaccaa

SEQ ID NO: 249435 - RNA, 64 nt, hsa
uucacaugugugugcacacucaugaguuuugucucagcaggauagaauaagcaaauccaugaac

SEQ ID NO: 249436 - RNA, 64 nt, hsa
guagaaagauaauauuucuccaauugggacuccccagcaggaauacuuagggauaaggaagaau

SEQ ID NO: 249437 - RNA, 64 nt, hsa
agaccugggggcccuugggugccagagugagacacagcaggacccuuccccaaauacuaggcuc

SEQ ID NO: 249438 - RNA, 64 nt, hsa
aaauacuaggcucagagcaaccuccagccuucuccagcaggaucugcucccuguguccuuggac

SEQ ID NO: 249439 - RNA, 64 nt, hsa
aguuagggaaaugaugcuagagcacuuuaaaaaucagcaggacaacccugaggcaaacuggaag

SEQ ID NO: 249440 - RNA, 64 nt, hsa
cagaaacaugauuuguucauuucugagucacaaacagcaggauaccucacagguaagccauacc

SEQ ID NO: 249441 - RNA, 64 nt, hsa
uccucagccucugcaaggcacucagggugggggacagcaggaucaagacaacccguuggagccc

SEQ ID NO: 249442 - RNA, 64 nt, hsa
gguacugcagcuuccuccacagccggcuguggagcagcaggaccuggcccuucugccugggcag

SEQ ID NO: 249443 - RNA, 64 nt, hsa
gggauguagagaggcguuagugggcagguggccacagcaggacugaggacaggcccccauuauc

SEQ ID NO: 249444 - RNA, 64 nt, hsa
ccccagccaggaccaccucguccucguggcggggcagcaggagcgguagaaagggguccgaugu

SEQ ID NO: 249445 - RNA, 64 nt, hsa
gcccaucugcuggcaucaguaccugguguugggacagcaggauaggguucuaaaggugguuuuc

SEQ ID NO: 249446 - RNA, 64 nt, hsa
aggcccccaggaaucccuuccucccauguccuggcagcaggaccccaggcuacauauggaaggu

SEQ ID NO: 249447 - RNA, 64 nt, hsa
gcaugugcuggucucuguguguuuguguguuccucagcaggaaugagugucuuuguguaucacc

SEQ ID NO: 249448 - RNA, 64 nt, hsa
aagaaauguugaaaagcuccuuggguucuccugacagcaggaaccacuggccuggcaccaccug

SEQ ID NO: 249449 - RNA, 64 nt, hsa
uucuuuugucauguauaacugagacacacaaacacagcaggagaaaucuaaaccguugugccuu

SEQ ID NO: 249450 - RNA, 64 nt, hsa
ucuaguaugauuaguauagcuuucuccagcauggcagcaggaaguaacuacagggccucuuuua

SEQ ID NO: 249451 - RNA, 64 nt, hsa
ccuccgaagagaguucuggaugucuggcucaaagcagcaggacugugggaaagagccuaacauc

SEQ ID NO: 249452 - RNA, 64 nt, hsa
acauguucccaaggccccacuuucaagaaucagacagcaggaagccauagaugcuggcuggguu

SEQ ID NO: 249453 - RNA, 64 nt, hsa
auugcuaacaaagcacuuuuggacaaugcuaucccagcaggaaaaaaaaggauaauauaacugu

SEQ ID NO: 249454 - RNA, 64 nt, hsa
ugaguauuugaucccuagauaagaacaugcaaaucagcaggaacuggucauacaggguaagcac

SEQ ID NO: 249455 - RNA, 64 nt, hsa
gggguggccuucucaggacuccuggguggcacagcagcaggaccuugucaugggacugaugcug

SEQ ID NO: 249456 - RNA, 64 nt, hsa
cccaacagcaagggugacuccuggcaggugggggcagcaggagggcagagggcagagcucuggc

SEQ ID NO: 249457 - RNA, 64 nt, hsa
cugggcacaggagcucccagcuuuuguccacggccagcaggaugggcugucguguauauagcug

SEQ ID NO: 249458 - RNA, 64 nt, hsa
cagccggcgccggacccgguaggggcagucugggcagcaggaaggaagggcgcagcguccccuc

SEQ ID NO: 249459 - RNA, 64 nt, hsa
uucucggaaaugagaaagcuggaauccugguccccagcaggagagccuaguccucccccagccc

SEQ ID NO: 249460 - RNA, 64 nt, hsa
augcagcugccagauccacucacucugcugccuccagcaggacccaaggccacuuucaacucuu

SEQ ID NO: 249461 - RNA, 64 nt, hsa
aagggaugagagaaaggaggugguauggaagacucagcaggaacaagguaggcuucaaagagcc

SEQ ID NO: 249462 - RNA, 64 nt, hsa
gagugagggccccugcugggcccagccaccaggacagcaggaaccagggccuacuccucuuaug

SEQ ID NO: 249463 - RNA, 64 nt, hsa
cugucugcuccuacuccucacaucuggaggauuccagcaggagggguuuuggaggggaccugcu

SEQ ID NO: 249464 - RNA, 64 nt, hsa
cuccaaauccagccauagauggcugcugggugugcagcaggagaaggaggauggucagccuugg

SEQ ID NO: 249465 - RNA, 64 nt, hsa
ugcacugucuauauugcacugagagaggaagggacagcaggagugaggugaagagggcggagag

SEQ ID NO: 249466 - RNA, 64 nt, hsa
agaagccaguagagagaccaggagccaccucaaucagcaggacagccucacugccccucuugca

SEQ ID NO: 249467 - RNA, 64 nt, hsa
uucuggggagcuuccaagagcacccaccaagacacagcaggacaggccaggggagggcaucugg

SEQ ID NO: 249468 - RNA, 64 nt, hsa
acagaccacuugacucucuguaaaauggaccaaucagcaggauguggguggggcgagacaagag

SEQ ID NO: 249469 - RNA, 64 nt, hsa
cugugcccagcaguggcugcuggggaagcagcugcagcaggagggagacggucuugccucucag

SEQ ID NO: 249470 - RNA, 64 nt, hsa
acuuaggcugcgugggacaagggcuguguugucacagcaggaauagguuuuccucuguuggccu

SEQ ID NO: 249471 - RNA, 64 nt, hsa
gcacagucucuauggugcugaggaagagcagcagcagcaggauggugaaguaguaaacuggggg

SEQ ID NO: 249472 - RNA, 64 nt, hsa
ccucauuccuuaccccccagccccugcccaccuucagcaggaugaggcccuggguugccgugcu

SEQ ID NO: 249473 - RNA, 64 nt, hsa
ccucccaggaggggugguagccguucccaccucgcagcaggacccccagugcagaggcucacag

SEQ ID NO: 249474 - RNA, 64 nt, hsa
guggguugagggggucugaccaggaggccaccuacagcaggaagugaggcugccauguuuccuu

SEQ ID NO: 249475 - RNA, 64 nt, hsa
ccugguuggcguccacaagcaauaccucucguuccagcaggaccaagggagccagccuccagug

SEQ ID NO: 249476 - RNA, 64 nt, hsa
guuuuucgagcuauagggcaucagguggugggaacagcaggaaaaggcauuccagucugcccca

SEQ ID NO: 249477 - RNA, 64 nt, hsa
gaauugugaagcccacagaugcgcacgcaaugaccagcaggaaccggaagcccugggucacccc

SEQ ID NO: 249478 - RNA, 64 nt, hsa
uuugcucccuccccucucuuagagacugugccuucagcaggacucuuaauaucugcugcaacuu

SEQ ID NO: 249479 - RNA, 64 nt, hsa
acggcccaugcagaggugguagaaaggcuggacucagcaggaacaccaaaucccggaccaggca

SEQ ID NO: 249480 - RNA, 64 nt, hsa
uaccucgcagggcucagcagcacccggugaacagcagcaggaggagccgcuagagcagcugcuc

SEQ ID NO: 249481 - RNA, 64 nt, hsa
cacgcuuucagcuugaggggagcucccacugccucagcaggagcaauucugcaucccuaauucu

SEQ ID NO: 249482 - RNA, 64 nt, hsa
ccuaagaauuauuaaguuugacuuggaaguggagcagcaggacuuuguaguuguaugcuugauu

SEQ ID NO: 249483 - RNA, 64 nt, hsa
uuuaaugcugcuuuugagcuucaagguaauaggacagcaggaaccuaaaauaucugccaucauc

SEQ ID NO: 249484 - RNA, 64 nt, hsa
gucagugacaccaucuuggaauaccuuugggaagcagcaggaaaugugcauguggguagagauc

SEQ ID NO: 249485 - RNA, 64 nt, hsa
gcugcccaugcagcagagggcagaaggcuugcacuugggccaaagggccuaagguccacuggac

SEQ ID NO: 249486 - RNA, 64 nt, hsa
aauccugaccacucuugaacccagaaggaggacuuugggccaauuucggaggagagaagaaagu

SEQ ID NO: 249487 - RNA, 64 nt, hsa
guagugugaacccuagaaauuagaaaaucaagcuuugggccaggugcgguggcucaugccugua

SEQ ID NO: 249488 - RNA, 64 nt, hsa
caucugauaaggguauuuguaaaaggcagaauguuugggccaugaagaaguaggggcugaagag

SEQ ID NO: 249489 - RNA, 64 nt, hsa
gaaaguggggaggccauagacccaaacaaguucuuugggccaggcauggccuaguaaguacacc

SEQ ID NO: 249490 - RNA, 64 nt, hsa
gaaaggaccaaucacuguccgauuguaagcuauguugggccaauuccaaaauauuauacgaugg

SEQ ID NO: 249491 - RNA, 64 nt, hsa
gaagacuagaggugauucugcccagcaucccauauugggccagccaugagccagcuucccguga

SEQ ID NO: 249492 - RNA, 64 nt, hsa
ucucaccaggaaaguacacgggccugaggcaggauugggccacagacagccucucauugguccg

SEQ ID NO: 249493 - RNA, 64 nt, hsa
ccccugccaccugucuuuccucuaaaggucaguuuugggccaguucuugcaacuaaagagcaga

SEQ ID NO: 249494 - RNA, 64 nt, hsa
uuaaagaauaacagaguucuagagcuggggguucuugggccaugcuccguguguggauaaggaa

SEQ ID NO: 249495 - RNA, 64 nt, hsa
ugugcucuugaguuuuuuauucauucaagaaaccuugggccaccgcuuuguacauagcaccgug

SEQ ID NO: 249496 - RNA, 64 nt, hsa
ggcaggacuucucgcugcccuuccaagcccggcuuugggccaggaaaggcuuccccagguggcu

SEQ ID NO: 249497 - RNA, 64 nt, hsa
gugguucagccccuucuccaaccccuucauaagcuugggccacugccugggacccagcagacac

SEQ ID NO: 249498 - RNA, 64 nt, hsa
agaccuccugggugggaaagacucaaaggggugcuugggccacucaggaccccucuggcugugu

SEQ ID NO: 249499 - RNA, 64 nt, hsa
gggcuguggucagccaagaauagaggucauauaguugggccauggggcaauuguuggcagccau

SEQ ID NO: 249500 - RNA, 64 nt, hsa
aagcuggcccaguuguccaugacaaaagaggcuuuugggccaaaaugugagggugguggguggg

SEQ ID NO: 249501 - RNA, 64 nt, hsa
uuuccuugcauuaaaggagaucuuccccuaaccuuugggccaauuuacuggccacuaauuucgu

SEQ ID NO: 249502 - RNA, 64 nt, hsa
auuaauuuacauuaaaguguuuauguuaagaagauugggccaggugggguggcucaugccugua

SEQ ID NO: 249503 - RNA, 64 nt, hsa
uuucaaacaaucgaagguaaaacaacauauuguguugggccaccuguacugaacgcugaaucgu

SEQ ID NO: 249504 - RNA, 64 nt, hsa
ccauccguagagcgggaaccuuccugagguguccuugggccacccccaaguguugggccaucug

SEQ ID NO: 249505 - RNA, 64 nt, hsa
ccuuccugagguguccuugggccacccccaaguguugggccaucugccaagagacagcgaccca

SEQ ID NO: 249506 - RNA, 64 nt, hsa; identical to SEQ ID NO: 97332

SEQ ID NO: 249507 - RNA, 64 nt, hsa; identical to SEQ ID NO: 97333

SEQ ID NO: 249508 - RNA, 64 nt, hsa; identical to SEQ ID NO: 97334

SEQ ID NO: 249509 - RNA, 64 nt, hsa; identical to SEQ ID NO: 97335

SEQ ID NO: 249510 - RNA, 64 nt, hsa; identical to SEQ ID NO: 97336

SEQ ID NO: 249511 - RNA, 64 nt, hsa; identical to SEQ ID NO: 97337

SEQ ID NO: 249512 - RNA, 64 nt, hsa; identical to SEQ ID NO: 97338

SEQ ID NO: 249513 - RNA, 64 nt, hsa; identical to SEQ ID NO: 97339

SEQ ID NO: 249514 - RNA, 64 nt, hsa; identical to SEQ ID NO: 97340

SEQ ID NO: 249515 - RNA, 64 nt, hsa; identical to SEQ ID NO: 97341

SEQ ID NO: 249516 - RNA, 64 nt, hsa; identical to SEQ ID NO: 97342

SEQ ID NO: 249517 - RNA, 64 nt, hsa; identical to SEQ ID NO: 97343

SEQ ID NO: 249518 - RNA, 64 nt, hsa; identical to SEQ ID NO: 97344

SEQ ID NO: 249519 - RNA, 64 nt, hsa; identical to SEQ ID NO: 97345

SEQ ID NO: 249520 - RNA, 64 nt, hsa; identical to SEQ ID NO: 97346

SEQ ID NO: 249521 - RNA, 64 nt, hsa; identical to SEQ ID NO: 97347

SEQ ID NO: 249522 - RNA, 64 nt, hsa; identical to SEQ ID NO: 97348

SEQ ID NO: 249523 - RNA, 64 nt, hsa; identical to SEQ ID NO: 97349

SEQ ID NO: 249524 - RNA, 64 nt, hsa; identical to SEQ ID NO: 97350

SEQ ID NO: 249525 - RNA, 64 nt, hsa; identical to SEQ ID NO: 97351

SEQ ID NO: 249526 - RNA, 64 nt, hsa; identical to SEQ ID NO: 97352

SEQ ID NO: 249527 - RNA, 64 nt, hsa; identical to SEQ ID NO: 97353

SEQ ID NO: 249528 - RNA, 64 nt, hsa; identical to SEQ ID NO: 97354

SEQ ID NO: 249529 - RNA, 64 nt, hsa; identical to SEQ ID NO: 97355

SEQ ID NO: 249530 - RNA, 64 nt, hsa; identical to SEQ ID NO: 97356

SEQ ID NO: 249531 - RNA, 64 nt, hsa; identical to SEQ ID NO: 97357

SEQ ID NO: 249532 - RNA, 64 nt, hsa; identical to SEQ ID NO: 97358

SEQ ID NO: 249533 - RNA, 64 nt, hsa; identical to SEQ ID NO: 97359

SEQ ID NO: 249534 - RNA, 64 nt, hsa; identical to SEQ ID NO: 97360

SEQ ID NO: 249535 - RNA, 64 nt, hsa; identical to SEQ ID NO: 97361

SEQ ID NO: 249536 - RNA, 64 nt, hsa; identical to SEQ ID NO: 97362

SEQ ID NO: 249537 - RNA, 64 nt, hsa; identical to SEQ ID NO: 97363

SEQ ID NO: 249538 - RNA, 64 nt, hsa; identical to SEQ ID NO: 97364

SEQ ID NO: 249539 - RNA, 64 nt, hsa; identical to SEQ ID NO: 97365

SEQ ID NO: 249540 - RNA, 64 nt, hsa; identical to SEQ ID NO: 97366

SEQ ID NO: 249541 - RNA, 64 nt, hsa; identical to SEQ ID NO: 97367

SEQ ID NO: 249542 - RNA, 64 nt, hsa; identical to SEQ ID NO: 97368

SEQ ID NO: 249543 - RNA, 64 nt, hsa; identical to SEQ ID NO: 97369

SEQ ID NO: 249544 - RNA, 64 nt, hsa; identical to SEQ ID NO: 97370

SEQ ID NO: 249545 - RNA, 64 nt, hsa; identical to SEQ ID NO: 97371

SEQ ID NO: 249546 - RNA, 64 nt, hsa; identical to SEQ ID NO: 97372

SEQ ID NO: 249547 - RNA, 64 nt, hsa; identical to SEQ ID NO: 97373

SEQ ID NO: 249548 - RNA, 64 nt, hsa; identical to SEQ ID NO: 97374

SEQ ID NO: 249549 - RNA, 64 nt, hsa; identical to SEQ ID NO: 97375

SEQ ID NO: 249550 - RNA, 64 nt, hsa; identical to SEQ ID NO: 97376

SEQ ID NO: 249551 - RNA, 64 nt, hsa; identical to SEQ ID NO: 97377

SEQ ID NO: 249552 - RNA, 64 nt, hsa; identical to SEQ ID NO: 97378

SEQ ID NO: 249553 - RNA, 64 nt, hsa; identical to SEQ ID NO: 97379

SEQ ID NO: 249554 - RNA, 64 nt, hsa; identical to SEQ ID NO: 97380

SEQ ID NO: 249555 - RNA, 64 nt, hsa; identical to SEQ ID NO: 97381

SEQ ID NO: 249556 - RNA, 64 nt, hsa; identical to SEQ ID NO: 97382

SEQ ID NO: 249557 - RNA, 64 nt, hsa; identical to SEQ ID NO: 97383

SEQ ID NO: 249558 - RNA, 64 nt, hsa; identical to SEQ ID NO: 97384

SEQ ID NO: 249559 - RNA, 64 nt, hsa; identical to SEQ ID NO: 97385

SEQ ID NO: 249560 - RNA, 64 nt, hsa; identical to SEQ ID NO: 97386

SEQ ID NO: 249561 - RNA, 64 nt, hsa; identical to SEQ ID NO: 97387

SEQ ID NO: 249562 - RNA, 64 nt, hsa; identical to SEQ ID NO: 97388

SEQ ID NO: 249563 - RNA, 64 nt, hsa; identical to SEQ ID NO: 97389

SEQ ID NO: 249564 - RNA, 64 nt, hsa; identical to SEQ ID NO: 97390

SEQ ID NO: 249565 - RNA, 64 nt, hsa; identical to SEQ ID NO: 97391

SEQ ID NO: 249566 - RNA, 64 nt, hsa; identical to SEQ ID NO: 97392

SEQ ID NO: 249567 - RNA, 64 nt, hsa; identical to SEQ ID NO: 97393

SEQ ID NO: 249568 - RNA, 64 nt, hsa; identical to SEQ ID NO: 97394

SEQ ID NO: 249569 - RNA, 64 nt, hsa
gccaucugcagccaggugugugccacacggcagccuucccgaaacauaguauggauuuuaaaaa

SEQ ID NO: 249570 - RNA, 64 nt, hsa
aaagaacucaacauggcaaagcaaaugguaaaagcuucccgacuguucuacuuuggguccgcgc

SEQ ID NO: 249571 - RNA, 64 nt, hsa
ccuuugccugcuguugcuggaagagcuggcucauacccccaaaggacacuuucagcgacagcua

SEQ ID NO: 249572 - RNA, 64 nt, hsa
cuguugugcccuuuaagagacauguuuccaccccacccccaaccuugucccaagugcccuggac

SEQ ID NO: 249573 - RNA, 64 nt, hsa
ucuugguugugacuccaagagcagagugaggaagacccccaagcauagacucggguacugugau

SEQ ID NO: 249574 - RNA, 64 nt, hsa
aacacaggcucucacaagaucagaacccccacucacccccaagaucuuaucuagcaagccugua

SEQ ID NO: 249575 - RNA, 64 nt, hsa
ugcccaaaauuuccccuacccccaacuuuccccuacccccaacuuuccccaccagcuccacaac

SEQ ID NO: 249576 - RNA, 64 nt, hsa
ugggcugaugaaggcacugcccaaaauuuccccuacccccaacuuuccccuacccccaacuuuc

SEQ ID NO: 249577 - RNA, 64 nt, hsa
acuuucaccuuuuauuuuuuauuccuuccuuucuacccccaaccagucgagcaaaugagcaauu

SEQ ID NO: 249578 - RNA, 64 nt, hsa
augaggaaggccaauuccuuacaaugauggcagaacccccaagcgaaugcccuauugaggagaa

SEQ ID NO: 249579 - RNA, 64 nt, hsa
aaauguuggaacucugugcaggugcugccuugagacccccaagcuuccaccugucccucuccua

SEQ ID NO: 249580 - RNA, 64 nt, hsa
ucagaacaccccgcucuggcaguaggugucccccacccccaaagaccugccugugugcuccgga

SEQ ID NO: 249581 - RNA, 64 nt, hsa
guuuuugucuuucuucucagguguauuucuugguacccccaagauaucaggccagaaagagaug

SEQ ID NO: 249582 - RNA, 64 nt, hsa
gaacuccugaccucaagugaucugcccacuucagacccccaaagugcugggauuccagguguga

SEQ ID NO: 249583 - RNA, 64 nt, hsa
cugccccagccaguccagagccuaccacagcaauacccccaacacucacuccacucaaugugca

SEQ ID NO: 249584 - RNA, 64 nt, hsa
uuuuuccccacaccucugaacucagggccuagccacccccaaacuuccaaaucccacuuuugug

SEQ ID NO: 249585 - RNA, 64 nt, hsa
uuacuugauuuaucuucucaggacucauuguuccacccccaaccaauuugaaugccuacaauaa

SEQ ID NO: 249586 - RNA, 64 nt, hsa
uagaggugagcucagaaaccuacuguuaaccaacacccccaagugacugacacagguggucuaa

SEQ ID NO: 249587 - RNA, 64 nt, hsa
uuuugccuuggugcucaucuuaauggccuaaugcacccccaaacauggaaauaucaccaaaaaa

SEQ ID NO: 249588 - RNA, 64 nt, hsa
aucaucaucuggauuuaggaauugcucuugucauacccccaaguuucuaagauuuaagauucuc

SEQ ID NO: 249589 - RNA, 64 nt, hsa
cccugccugcuggcuacuuccuggcuuaccuucuacccccaaggauccucaccacccaaagggu

SEQ ID NO: 249590 - RNA, 64 nt, hsa
ggcacccuccugggagcaggccuuccucccucccacccccaauguccuguugguaggagguggg

SEQ ID NO: 249591 - RNA, 64 nt, hsa
caccccaggacgagccaucagggacagaccccccacccccaaggcugcagccacaccauguuuc

SEQ ID NO: 249592 - RNA, 64 nt, hsa
aguccugaaacaggcuccccucaccaggacagucacccccaaacuugacccccaacauuucaau

SEQ ID NO: 249593 - RNA, 64 nt, hsa
gcuccccucaccaggacagucacccccaaacuugacccccaacauuucaaugcacagaagggac

SEQ ID NO: 249594 - RNA, 64 nt, hsa
ugaaacaugcacacugcaaauaucaaaaggagacacccccaaaucccacucuaaauuccaaagc

SEQ ID NO: 249595 - RNA, 64 nt, hsa
agcaugcauugcucuuaaccgcagaauggcaauaacccccaaaaggucaaaugggcacaccaca

SEQ ID NO: 249596 - RNA, 64 nt, hsa
uuuccggagaagauuucagagcugaggcuuugguacccccaaacccccaauauuuuuggacugg

SEQ ID NO: 249597 - RNA, 64 nt, hsa
gaagauuucagagcugaggcuuugguacccccaaacccccaauauuuuuggacuggcagacuca

SEQ ID NO: 249598 - RNA, 64 nt, hsa
ccaggagugucucuaagagauccaggagggagccacccccaaggacccugccagccacagaccu

SEQ ID NO: 249599 - RNA, 64 nt, hsa
accaggagggcagacccagccacauaccacaaccacccccaagccucacacucccuugucuuuu

SEQ ID NO: 249600 - RNA, 64 nt, hsa
gccccuagaagaccccaaugccguaacuccuaggacccccaaaucauggaaucccaaaucccca

SEQ ID NO: 249601 - RNA, 64 nt, hsa
ccccuuaaguccucuugaaauaaacauaggucacacccccaaagcaaaagaguaacagacauuc

SEQ ID NO: 249602 - RNA, 64 nt, hsa
ugaggccccauuauuaacagauacucccauaauaacccccaaauacagaccccaugucacccag

SEQ ID NO: 249603 - RNA, 64 nt, hsa
caaccuguauggcgggucuguacuuauuuuguuuacccccaauuuaaaacguuuuuuuuuauug

SEQ ID NO: 249604 - RNA, 64 nt, hsa
acucccccaucuugcugacagcauggcagucccuacccccaauuuuucccaggccaggcacuga

SEQ ID NO: 249605 - RNA, 64 nt, hsa
cgcuuggcgcuccuccuccguccuaucccaacucacccccaaacccccaucccuuccccaccuc

SEQ ID NO: 249606 - RNA, 64 nt, hsa
ggacccccggcccggcccggaacuuuucuccccaacccccaaacccacgacucacuuccacacc

SEQ ID NO: 249607 - RNA, 64 nt, hsa; identical to SEQ ID NO: 218520

SEQ ID NO: 249608 - RNA, 64 nt, hsa; identical to SEQ ID NO: 218521

SEQ ID NO: 249609 - RNA, 64 nt, hsa; identical to SEQ ID NO: 218522

SEQ ID NO: 249610 - RNA, 64 nt, hsa; identical to SEQ ID NO: 218523

SEQ ID NO: 249611 - RNA, 64 nt, hsa; identical to SEQ ID NO: 218524

SEQ ID NO: 249612 - RNA, 64 nt, hsa; identical to SEQ ID NO: 218525

SEQ ID NO: 249613 - RNA, 64 nt, hsa; identical to SEQ ID NO: 218526

SEQ ID NO: 249614 - RNA, 64 nt, hsa; identical to SEQ ID NO: 218527

SEQ ID NO: 249615 - RNA, 64 nt, hsa; identical to SEQ ID NO: 218528

SEQ ID NO: 249616 - RNA, 64 nt, hsa; identical to SEQ ID NO: 218529

SEQ ID NO: 249617 - RNA, 64 nt, hsa; identical to SEQ ID NO: 218530

SEQ ID NO: 249618 - RNA, 64 nt, hsa; identical to SEQ ID NO: 218531

SEQ ID NO: 249619 - RNA, 64 nt, hsa; identical to SEQ ID NO: 218532

SEQ ID NO: 249620 - RNA, 64 nt, hsa; identical to SEQ ID NO: 218533

SEQ ID NO: 249621 - RNA, 64 nt, hsa; identical to SEQ ID NO: 218534

SEQ ID NO: 249622 - RNA, 64 nt, hsa; identical to SEQ ID NO: 218535

SEQ ID NO: 249623 - RNA, 64 nt, hsa; identical to SEQ ID NO: 218536

SEQ ID NO: 249624 - RNA, 64 nt, hsa; identical to SEQ ID NO: 218537

SEQ ID NO: 249625 - RNA, 64 nt, hsa; identical to SEQ ID NO: 218538

SEQ ID NO: 249626 - RNA, 61 nt, hsa; identical to SEQ ID NO: 218539

SEQ ID NO: 249627 - RNA, 64 nt, hsa; identical to SEQ ID NO: 218540

SEQ ID NO: 249628 - RNA, 64 nt, hsa; identical to SEQ ID NO: 218541

SEQ ID NO: 249629 - RNA, 64 nt, hsa; identical to SEQ ID NO: 218542

SEQ ID NO: 249630 - RNA, 64 nt, hsa; identical to SEQ ID NO: 218543

SEQ ID NO: 249631 - RNA, 64 nt, hsa; identical to SEQ ID NO: 218544

SEQ ID NO: 249632 - RNA, 64 nt, hsa; identical to SEQ ID NO: 218545

SEQ ID NO: 249633 - RNA, 64 nt, hsa; identical to SEQ ID NO: 218546

SEQ ID NO: 249634 - RNA, 64 nt, hsa; identical to SEQ ID NO: 218547

SEQ ID NO: 249635 - RNA, 64 nt, hsa; identical to SEQ ID NO: 218548

SEQ ID NO: 249636 - RNA, 64 nt, hsa; identical to SEQ ID NO: 218549

SEQ ID NO: 249637 - RNA, 64 nt, hsa; identical to SEQ ID NO: 218550

SEQ ID NO: 249638 - RNA, 64 nt, hsa; identical to SEQ ID NO: 218551

SEQ ID NO: 249639 - RNA, 64 nt, hsa; identical to SEQ ID NO: 218552

SEQ ID NO: 249640 - RNA, 64 nt, hsa; identical to SEQ ID NO: 218553

SEQ ID NO: 249641 - RNA, 63 nt, hsa; identical to SEQ ID NO: 218554

SEQ ID NO: 249642 - RNA, 64 nt, hsa; identical to SEQ ID NO: 218555

SEQ ID NO: 249643 - RNA, 64 nt, hsa; identical to SEQ ID NO: 218556

SEQ ID NO: 249644 - RNA, 64 nt, hsa; identical to SEQ ID NO: 218557

SEQ ID NO: 249645 - RNA, 64 nt, hsa; identical to SEQ ID NO: 218558

SEQ ID NO: 249646 - RNA, 64 nt, hsa; identical to SEQ ID NO: 218559

SEQ ID NO: 249647 - RNA, 64 nt, hsa; identical to SEQ ID NO: 218560

SEQ ID NO: 249648 - RNA, 64 nt, hsa; identical to SEQ ID NO: 218561

SEQ ID NO: 249649 - RNA, 64 nt, hsa; identical to SEQ ID NO: 218562

SEQ ID NO: 249650 - RNA, 64 nt, hsa; identical to SEQ ID NO: 218563

SEQ ID NO: 249651 - RNA, 64 nt, hsa; identical to SEQ ID NO: 218564

SEQ ID NO: 249652 - RNA, 64 nt, hsa; identical to SEQ ID NO: 218565

SEQ ID NO: 249653 - RNA, 64 nt, hsa; identical to SEQ ID NO: 218566

SEQ ID NO: 249654 - RNA, 64 nt, hsa; identical to SEQ ID NO: 218567

SEQ ID NO: 249655 - RNA, 64 nt, hsa; identical to SEQ ID NO: 218568

SEQ ID NO: 249656 - RNA, 64 nt, hsa; identical to SEQ ID NO: 218569

SEQ ID NO: 249657 - RNA, 64 nt, hsa; identical to SEQ ID NO: 218570

SEQ ID NO: 249658 - RNA, 64 nt, hsa; identical to SEQ ID NO: 218571

SEQ ID NO: 249659 - RNA, 64 nt, hsa; identical to SEQ ID NO: 218572

SEQ ID NO: 249660 - RNA, 64 nt, hsa; identical to SEQ ID NO: 218573

SEQ ID NO: 249661 - RNA, 64 nt, hsa; identical to SEQ ID NO: 218574

SEQ ID NO: 249662 - RNA, 64 nt, hsa; identical to SEQ ID NO: 218575

SEQ ID NO: 249663 - RNA, 64 nt, hsa; identical to SEQ ID NO: 218576

SEQ ID NO: 249664 - RNA, 64 nt, hsa; identical to SEQ ID NO: 218577

SEQ ID NO: 249665 - RNA, 64 nt, hsa; identical to SEQ ID NO: 218578

SEQ ID NO: 249666 - RNA, 64 nt, hsa; identical to SEQ ID NO: 218579

SEQ ID NO: 249667 - RNA, 64 nt, hsa; identical to SEQ ID NO: 218580

SEQ ID NO: 249668 - RNA, 64 nt, hsa; identical to SEQ ID NO: 218581

SEQ ID NO: 249669 - RNA, 64 nt, hsa; identical to SEQ ID NO: 218582

SEQ ID NO: 249670 - RNA, 64 nt, hsa; identical to SEQ ID NO: 218583

SEQ ID NO: 249671 - RNA, 64 nt, hsa; identical to SEQ ID NO: 218584

SEQ ID NO: 249672 - RNA, 64 nt, hsa; identical to SEQ ID NO: 218585

SEQ ID NO: 249673 - RNA, 64 nt, hsa; identical to SEQ ID NO: 218586

SEQ ID NO: 249674 - RNA, 64 nt, hsa; identical to SEQ ID NO: 218587

SEQ ID NO: 249675 - RNA, 64 nt, hsa; identical to SEQ ID NO: 218588

SEQ ID NO: 249676 - RNA, 64 nt, hsa; identical to SEQ ID NO: 218589

SEQ ID NO: 249677 - RNA, 64 nt, hsa; identical to SEQ ID NO: 218590

SEQ ID NO: 249678 - RNA, 64 nt, hsa; identical to SEQ ID NO: 218591

SEQ ID NO: 249679 - RNA, 64 nt, hsa; identical to SEQ ID NO: 218592

SEQ ID NO: 249680 - RNA, 64 nt, hsa; identical to SEQ ID NO: 218593

SEQ ID NO: 249681 - RNA, 64 nt, hsa; identical to SEQ ID NO: 218594

SEQ ID NO: 249682 - RNA, 64 nt, hsa; identical to SEQ ID NO: 218595

SEQ ID NO: 249683 - RNA, 64 nt, hsa; identical to SEQ ID NO: 218596

SEQ ID NO: 249684 - RNA, 64 nt, hsa; identical to SEQ ID NO: 218597

SEQ ID NO: 249685 - RNA, 64 nt, hsa; identical to SEQ ID NO: 218598

SEQ ID NO: 249686 - RNA, 64 nt, hsa; identical to SEQ ID NO: 218599

SEQ ID NO: 249687 - RNA, 64 nt, hsa; identical to SEQ ID NO: 218600

SEQ ID NO: 249688 - RNA, 64 nt, hsa; identical to SEQ ID NO: 218601

SEQ ID NO: 249689 - RNA, 64 nt, hsa; identical to SEQ ID NO: 218602

SEQ ID NO: 249690 - RNA, 64 nt, hsa; identical to SEQ ID NO: 218603

SEQ ID NO: 249691 - RNA, 64 nt, hsa; identical to SEQ ID NO: 218604

SEQ ID NO: 249692 - RNA, 64 nt, hsa; identical to SEQ ID NO: 218605

SEQ ID NO: 249693 - RNA, 64 nt, hsa; identical to SEQ ID NO: 218606

SEQ ID NO: 249694 - RNA, 64 nt, hsa; identical to SEQ ID NO: 218607

SEQ ID NO: 249695 - RNA, 64 nt, hsa; identical to SEQ ID NO: 218608

SEQ ID NO: 249696 - RNA, 64 nt, hsa; identical to SEQ ID NO: 218609

SEQ ID NO: 249697 - RNA, 64 nt, hsa; identical to SEQ ID NO: 218610

SEQ ID NO: 249698 - RNA, 64 nt, hsa; identical to SEQ ID NO: 218611

SEQ ID NO: 249699 - RNA, 64 nt, hsa; identical to SEQ ID NO: 218612

SEQ ID NO: 249700 - RNA, 62 nt, hsa; identical to SEQ ID NO: 218613

SEQ ID NO: 249701 - RNA, 64 nt, hsa; identical to SEQ ID NO: 218614

SEQ ID NO: 249702 - RNA, 64 nt, hsa; identical to SEQ ID NO: 218615

SEQ ID NO: 249703 - RNA, 64 nt, hsa; identical to SEQ ID NO: 218616

SEQ ID NO: 249704 - RNA, 64 nt, hsa; identical to SEQ ID NO: 218617

SEQ ID NO: 249705 - RNA, 64 nt, hsa; identical to SEQ ID NO: 218618

SEQ ID NO: 249706 - RNA, 64 nt, hsa; identical to SEQ ID NO: 218619

SEQ ID NO: 249707 - RNA, 64 nt, hsa; identical to SEQ ID NO: 218620

SEQ ID NO: 249708 - RNA, 64 nt, hsa; identical to SEQ ID NO: 218621

SEQ ID NO: 249709 - RNA, 64 nt, hsa; identical to SEQ ID NO: 218622

SEQ ID NO: 249710 - RNA, 64 nt, hsa; identical to SEQ ID NO: 218623

SEQ ID NO: 249711 - RNA, 64 nt, hsa; identical to SEQ ID NO: 218624

SEQ ID NO: 249712 - RNA, 64 nt, hsa; identical to SEQ ID NO: 218625

SEQ ID NO: 249713 - RNA, 64 nt, hsa; identical to SEQ ID NO: 218626

SEQ ID NO: 249714 - RNA, 64 nt, hsa; identical to SEQ ID NO: 218627

SEQ ID NO: 249715 - RNA, 64 nt, hsa; identical to SEQ ID NO: 218628

SEQ ID NO: 249716 - RNA, 64 nt, hsa; identical to SEQ ID NO: 218629

SEQ ID NO: 249717 - RNA, 64 nt, hsa; identical to SEQ ID NO: 218630

SEQ ID NO: 249718 - RNA, 64 nt, hsa; identical to SEQ ID NO: 218631

SEQ ID NO: 249719 - RNA, 64 nt, hsa; identical to SEQ ID NO: 218632

SEQ ID NO: 249720 - RNA, 64 nt, hsa; identical to SEQ ID NO: 218633

SEQ ID NO: 249721 - RNA, 64 nt, hsa; identical to SEQ ID NO: 218634

SEQ ID NO: 249722 - RNA, 64 nt, hsa; identical to SEQ ID NO: 218635

SEQ ID NO: 249723 - RNA, 64 nt, hsa; identical to SEQ ID NO: 218636

SEQ ID NO: 249724 - RNA, 64 nt, hsa; identical to SEQ ID NO: 218637

SEQ ID NO: 249725 - RNA, 64 nt, hsa; identical to SEQ ID NO: 218638

SEQ ID NO: 249726 - RNA, 64 nt, hsa; identical to SEQ ID NO: 218639

SEQ ID NO: 249727 - RNA, 64 nt, hsa; identical to SEQ ID NO: 218640

SEQ ID NO: 249728 - RNA, 64 nt, hsa; identical to SEQ ID NO: 218641

SEQ ID NO: 249729 - RNA, 64 nt, hsa; identical to SEQ ID NO: 218642

SEQ ID NO: 249730 - RNA, 64 nt, hsa; identical to SEQ ID NO: 218643

SEQ ID NO: 249731 - RNA, 64 nt, hsa; identical to SEQ ID NO: 218644

SEQ ID NO: 249732 - RNA, 64 nt, hsa; identical to SEQ ID NO: 218645

SEQ ID NO: 249733 - RNA, 64 nt, hsa; identical to SEQ ID NO: 218646

SEQ ID NO: 249734 - RNA, 64 nt, hsa; identical to SEQ ID NO: 218647

SEQ ID NO: 249735 - RNA, 64 nt, hsa; identical to SEQ ID NO: 218648

SEQ ID NO: 249736 - RNA, 64 nt, hsa; identical to SEQ ID NO: 218649

SEQ ID NO: 249737 - RNA, 64 nt, hsa; identical to SEQ ID NO: 218650

SEQ ID NO: 249738 - RNA, 64 nt, hsa; identical to SEQ ID NO: 218651

SEQ ID NO: 249739 - RNA, 64 nt, hsa; identical to SEQ ID NO: 218652

SEQ ID NO: 249740 - RNA, 64 nt, hsa; identical to SEQ ID NO: 218653

SEQ ID NO: 249741 - RNA, 64 nt, hsa; identical to SEQ ID NO: 218654

SEQ ID NO: 249742 - RNA, 64 nt, hsa; identical to SEQ ID NO: 218655

SEQ ID NO: 249743 - RNA, 64 nt, hsa; identical to SEQ ID NO: 218656

SEQ ID NO: 249744 - RNA, 64 nt, hsa; identical to SEQ ID NO: 218657

SEQ ID NO: 249745 - RNA, 64 nt, hsa; identical to SEQ ID NO: 218658

SEQ ID NO: 249746 - RNA, 64 nt, hsa; identical to SEQ ID NO: 218659

SEQ ID NO: 249747 - RNA, 64 nt, hsa; identical to SEQ ID NO: 218660

SEQ ID NO: 249748 - RNA, 64 nt, hsa; identical to SEQ ID NO: 218661

SEQ ID NO: 249749 - RNA, 61 nt, hsa; identical to SEQ ID NO: 218662

SEQ ID NO: 249750 - RNA, 64 nt, hsa; identical to SEQ ID NO: 218663

SEQ ID NO: 249751 - RNA, 64 nt, hsa; identical to SEQ ID NO: 218664

SEQ ID NO: 249752 - RNA, 64 nt, hsa; identical to SEQ ID NO: 218665

SEQ ID NO: 249753 - RNA, 64 nt, hsa; identical to SEQ ID NO: 218666

SEQ ID NO: 249754 - RNA, 64 nt, hsa; identical to SEQ ID NO: 218667

SEQ ID NO: 249755 - RNA, 64 nt, hsa; identical to SEQ ID NO: 218668

SEQ ID NO: 249756 - RNA, 64 nt, hsa; identical to SEQ ID NO: 218669

SEQ ID NO: 249757 - RNA, 64 nt, hsa; identical to SEQ ID NO: 218670

SEQ ID NO: 249758 - RNA, 64 nt, hsa; identical to SEQ ID NO: 218671

SEQ ID NO: 249759 - RNA, 64 nt, hsa; identical to SEQ ID NO: 218672

SEQ ID NO: 249760 - RNA, 64 nt, hsa; identical to SEQ ID NO: 218673

SEQ ID NO: 249761 - RNA, 64 nt, hsa; identical to SEQ ID NO: 218674

SEQ ID NO: 249762 - RNA, 64 nt, hsa; identical to SEQ ID NO: 218675

SEQ ID NO: 249763 - RNA, 64 nt, hsa; identical to SEQ ID NO: 218676

SEQ ID NO: 249764 - RNA, 64 nt, hsa; identical to SEQ ID NO: 218677

SEQ ID NO: 249765 - RNA, 64 nt, hsa; identical to SEQ ID NO: 218678

SEQ ID NO: 249766 - RNA, 64 nt, hsa; identical to SEQ ID NO: 218679

SEQ ID NO: 249767 - RNA, 64 nt, hsa; identical to SEQ ID NO: 218680

SEQ ID NO: 249768 - RNA, 64 nt, hsa; identical to SEQ ID NO: 218681

SEQ ID NO: 249769 - RNA, 64 nt, hsa; identical to SEQ ID NO: 218682

SEQ ID NO: 249770 - RNA, 64 nt, hsa; identical to SEQ ID NO: 218683

SEQ ID NO: 249771 - RNA, 64 nt, hsa; identical to SEQ ID NO: 218684

SEQ ID NO: 249772 - RNA, 64 nt, hsa; identical to SEQ ID NO: 218685

SEQ ID NO: 249773 - RNA, 59 nt, hsa; identical to SEQ ID NO: 218686

SEQ ID NO: 249774 - RNA, 64 nt, hsa; identical to SEQ ID NO: 218687

SEQ ID NO: 249775 - RNA, 64 nt, hsa; identical to SEQ ID NO: 218688

SEQ ID NO: 249776 - RNA, 64 nt, hsa; identical to SEQ ID NO: 218689

SEQ ID NO: 249777 - RNA, 64 nt, hsa; identical to SEQ ID NO: 218690

SEQ ID NO: 249778 - RNA, 64 nt, hsa; identical to SEQ ID NO: 218691

SEQ ID NO: 249779 - RNA, 64 nt, hsa; identical to SEQ ID NO: 218692

SEQ ID NO: 249780 - RNA, 64 nt, hsa; identical to SEQ ID NO: 218693

SEQ ID NO: 249781 - RNA, 64 nt, hsa; identical to SEQ ID NO: 218694

SEQ ID NO: 249782 - RNA, 64 nt, hsa; identical to SEQ ID NO: 218695

SEQ ID NO: 249783 - RNA, 64 nt, hsa; identical to SEQ ID NO: 218696

SEQ ID NO: 249784 - RNA, 64 nt, hsa; identical to SEQ ID NO: 218697

SEQ ID NO: 249785 - RNA, 64 nt, hsa; identical to SEQ ID NO: 218698

SEQ ID NO: 249786 - RNA, 64 nt, hsa; identical to SEQ ID NO: 218699

SEQ ID NO: 249787 - RNA, 64 nt, hsa; identical to SEQ ID NO: 218700

SEQ ID NO: 249788 - RNA, 64 nt, hsa; identical to SEQ ID NO: 218701

SEQ ID NO: 249789 - RNA, 64 nt, hsa; identical to SEQ ID NO: 218702

SEQ ID NO: 249790 - RNA, 64 nt, hsa; identical to SEQ ID NO: 218703

SEQ ID NO: 249791 - RNA, 64 nt, hsa; identical to SEQ ID NO: 218704

SEQ ID NO: 249792 - RNA, 64 nt, hsa; identical to SEQ ID NO: 218705

SEQ ID NO: 249793 - RNA, 64 nt, hsa; identical to SEQ ID NO: 218706

SEQ ID NO: 249794 - RNA, 64 nt, hsa; identical to SEQ ID NO: 218707

SEQ ID NO: 249795 - RNA, 64 nt, hsa; identical to SEQ ID NO: 218708

SEQ ID NO: 249796 - RNA, 64 nt, hsa; identical to SEQ ID NO: 218709

SEQ ID NO: 249797 - RNA, 64 nt, hsa; identical to SEQ ID NO: 218710

SEQ ID NO: 249798 - RNA, 64 nt, hsa; identical to SEQ ID NO: 218711

SEQ ID NO: 249799 - RNA, 64 nt, hsa; identical to SEQ ID NO: 218712

SEQ ID NO: 249800 - RNA, 64 nt, hsa; identical to SEQ ID NO: 218713

SEQ ID NO: 249801 - RNA, 64 nt, hsa; identical to SEQ ID NO: 218714

SEQ ID NO: 249802 - RNA, 64 nt, hsa; identical to SEQ ID NO: 218715

SEQ ID NO: 249803 - RNA, 64 nt, hsa; identical to SEQ ID NO: 218716

SEQ ID NO: 249804 - RNA, 64 nt, hsa; identical to SEQ ID NO: 218717

SEQ ID NO: 249805 - RNA, 64 nt, hsa; identical to SEQ ID NO: 218718

SEQ ID NO: 249806 - RNA, 64 nt, hsa; identical to SEQ ID NO: 218719

SEQ ID NO: 249807 - RNA, 64 nt, hsa; identical to SEQ ID NO: 218720

SEQ ID NO: 249808 - RNA, 64 nt, hsa; identical to SEQ ID NO: 218721

SEQ ID NO: 249809 - RNA, 64 nt, hsa; identical to SEQ ID NO: 218722

SEQ ID NO: 249810 - RNA, 64 nt, hsa; identical to SEQ ID NO: 218723

SEQ ID NO: 249811 - RNA, 64 nt, hsa; identical to SEQ ID NO: 218724

SEQ ID NO: 249812 - RNA, 64 nt, hsa; identical to SEQ ID NO: 218725

SEQ ID NO: 249813 - RNA, 64 nt, hsa; identical to SEQ ID NO: 218726

SEQ ID NO: 249814 - RNA, 64 nt, hsa; identical to SEQ ID NO: 218727

SEQ ID NO: 249815 - RNA, 64 nt, hsa; identical to SEQ ID NO: 218728

SEQ ID NO: 249816 - RNA, 64 nt, hsa; identical to SEQ ID NO: 218729

SEQ ID NO: 249817 - RNA, 64 nt, hsa; identical to SEQ ID NO: 218730

SEQ ID NO: 249818 - RNA, 64 nt, hsa; identical to SEQ ID NO: 218731

SEQ ID NO: 249819 - RNA, 64 nt, hsa; identical to SEQ ID NO: 218732

SEQ ID NO: 249820 - RNA, 64 nt, hsa; identical to SEQ ID NO: 218733

SEQ ID NO: 249821 - RNA, 64 nt, hsa; identical to SEQ ID NO: 218734

SEQ ID NO: 249822 - RNA, 64 nt, hsa; identical to SEQ ID NO: 218735

SEQ ID NO: 249823 - RNA, 64 nt, hsa; identical to SEQ ID NO: 218736

SEQ ID NO: 249824 - RNA, 64 nt, hsa; identical to SEQ ID NO: 218737

SEQ ID NO: 249825 - RNA, 64 nt, hsa; identical to SEQ ID NO: 218738

SEQ ID NO: 249826 - RNA, 64 nt, hsa; identical to SEQ ID NO: 218739

SEQ ID NO: 249827 - RNA, 64 nt, hsa; identical to SEQ ID NO: 218740

SEQ ID NO: 249828 - RNA, 64 nt, hsa; identical to SEQ ID NO: 218741

SEQ ID NO: 249829 - RNA, 64 nt, hsa; identical to SEQ ID NO: 218742

SEQ ID NO: 249830 - RNA, 64 nt, hsa; identical to SEQ ID NO: 218743

SEQ ID NO: 249831 - RNA, 64 nt, hsa; identical to SEQ ID NO: 218744

SEQ ID NO: 249832 - RNA, 64 nt, hsa; identical to SEQ ID NO: 218745

SEQ ID NO: 249833 - RNA, 64 nt, hsa; identical to SEQ ID NO: 218746

SEQ ID NO: 249834 - RNA, 64 nt, hsa; identical to SEQ ID NO: 218747

SEQ ID NO: 249835 - RNA, 64 nt, hsa; identical to SEQ ID NO: 218748

SEQ ID NO: 249836 - RNA, 64 nt, hsa; identical to SEQ ID NO: 218749

SEQ ID NO: 249837 - RNA, 64 nt, hsa; identical to SEQ ID NO: 218750

SEQ ID NO: 249838 - RNA, 64 nt, hsa; identical to SEQ ID NO: 218751

SEQ ID NO: 249839 - RNA, 64 nt, hsa; identical to SEQ ID NO: 218752

SEQ ID NO: 249840 - RNA, 64 nt, hsa; identical to SEQ ID NO: 218753

SEQ ID NO: 249841 - RNA, 64 nt, hsa; identical to SEQ ID NO: 218754

SEQ ID NO: 249842 - RNA, 64 nt, hsa; identical to SEQ ID NO: 218755

SEQ ID NO: 249843 - RNA, 64 nt, hsa; identical to SEQ ID NO: 218756

SEQ ID NO: 249844 - RNA, 64 nt, hsa; identical to SEQ ID NO: 218757

SEQ ID NO: 249845 - RNA, 64 nt, hsa; identical to SEQ ID NO: 218758

SEQ ID NO: 249846 - RNA, 64 nt, hsa; identical to SEQ ID NO: 218759

SEQ ID NO: 249847 - RNA, 64 nt, hsa; identical to SEQ ID NO: 218760

SEQ ID NO: 249848 - RNA, 64 nt, hsa; identical to SEQ ID NO: 218761

SEQ ID NO: 249849 - RNA, 64 nt, hsa; identical to SEQ ID NO: 218762

SEQ ID NO: 249850 - RNA, 64 nt, hsa; identical to SEQ ID NO: 218763

SEQ ID NO: 249851 - RNA, 64 nt, hsa; identical to SEQ ID NO: 218764

SEQ ID NO: 249852 - RNA, 64 nt, hsa; identical to SEQ ID NO: 218765

SEQ ID NO: 249853 - RNA, 64 nt, hsa; identical to SEQ ID NO: 218766

SEQ ID NO: 249854 - RNA, 64 nt, hsa; identical to SEQ ID NO: 218767

SEQ ID NO: 249855 - RNA, 64 nt, hsa; identical to SEQ ID NO: 218768

SEQ ID NO: 249856 - RNA, 64 nt, hsa; identical to SEQ ID NO: 218769

SEQ ID NO: 249857 - RNA, 64 nt, hsa; identical to SEQ ID NO: 218770

SEQ ID NO: 249858 - RNA, 64 nt, hsa; identical to SEQ ID NO: 218771

SEQ ID NO: 249859 - RNA, 64 nt, hsa; identical to SEQ ID NO: 218772

SEQ ID NO: 249860 - RNA, 64 nt, hsa; identical to SEQ ID NO: 218773

SEQ ID NO: 249861 - RNA, 64 nt, hsa; identical to SEQ ID NO: 218774

SEQ ID NO: 249862 - RNA, 64 nt, hsa; identical to SEQ ID NO: 218775

SEQ ID NO: 249863 - RNA, 64 nt, hsa; identical to SEQ ID NO: 218776

SEQ ID NO: 249864 - RNA, 64 nt, hsa; identical to SEQ ID NO: 218777

SEQ ID NO: 249865 - RNA, 64 nt, hsa; identical to SEQ ID NO: 218778

SEQ ID NO: 249866 - RNA, 64 nt, hsa; identical to SEQ ID NO: 218779

SEQ ID NO: 249867 - RNA, 64 nt, hsa; identical to SEQ ID NO: 218780

SEQ ID NO: 249868 - RNA, 64 nt, hsa; identical to SEQ ID NO: 218781

SEQ ID NO: 249869 - RNA, 64 nt, hsa; identical to SEQ ID NO: 218782

SEQ ID NO: 249870 - RNA, 64 nt, hsa; identical to SEQ ID NO: 218783

SEQ ID NO: 249871 - RNA, 64 nt, hsa; identical to SEQ ID NO: 218784

SEQ ID NO: 249872 - RNA, 64 nt, hsa; identical to SEQ ID NO: 218785

SEQ ID NO: 249873 - RNA, 64 nt, hsa; identical to SEQ ID NO: 218786

SEQ ID NO: 249874 - RNA, 64 nt, hsa; identical to SEQ ID NO: 218787

SEQ ID NO: 249875 - RNA, 64 nt, hsa; identical to SEQ ID NO: 218788

SEQ ID NO: 249876 - RNA, 64 nt, hsa; identical to SEQ ID NO: 218789

SEQ ID NO: 249877 - RNA, 64 nt, hsa; identical to SEQ ID NO: 218790

SEQ ID NO: 249878 - RNA, 64 nt, hsa; identical to SEQ ID NO: 218791

SEQ ID NO: 249879 - RNA, 64 nt, hsa; identical to SEQ ID NO: 218792

SEQ ID NO: 249880 - RNA, 64 nt, hsa; identical to SEQ ID NO: 218793

SEQ ID NO: 249881 - RNA, 64 nt, hsa; identical to SEQ ID NO: 218794

SEQ ID NO: 249882 - RNA, 64 nt, hsa; identical to SEQ ID NO: 218795

SEQ ID NO: 249883 - RNA, 64 nt, hsa; identical to SEQ ID NO: 218796

SEQ ID NO: 249884 - RNA, 64 nt, hsa; identical to SEQ ID NO: 218797

SEQ ID NO: 249885 - RNA, 64 nt, hsa; identical to SEQ ID NO: 218798

SEQ ID NO: 249886 - RNA, 64 nt, hsa; identical to SEQ ID NO: 218799

SEQ ID NO: 249887 - RNA, 64 nt, hsa; identical to SEQ ID NO: 218800

SEQ ID NO: 249888 - RNA, 64 nt, hsa; identical to SEQ ID NO: 218801

SEQ ID NO: 249889 - RNA, 64 nt, hsa; identical to SEQ ID NO: 218802

SEQ ID NO: 249890 - RNA, 64 nt, hsa; identical to SEQ ID NO: 218803

SEQ ID NO: 249891 - RNA, 64 nt, hsa; identical to SEQ ID NO: 218804

SEQ ID NO: 249892 - RNA, 64 nt, hsa; identical to SEQ ID NO: 218805

SEQ ID NO: 249893 - RNA, 64 nt, hsa; identical to SEQ ID NO: 218806

SEQ ID NO: 249894 - RNA, 64 nt, hsa; identical to SEQ ID NO: 218807

SEQ ID NO: 249895 - RNA, 64 nt, hsa; identical to SEQ ID NO: 218808

SEQ ID NO: 249896 - RNA, 59 nt, hsa; identical to SEQ ID NO: 218809

SEQ ID NO: 249897 - RNA, 64 nt, hsa; identical to SEQ ID NO: 218810

SEQ ID NO: 249898 - RNA, 64 nt, hsa; identical to SEQ ID NO: 218811

SEQ ID NO: 249899 - RNA, 63 nt, hsa
agagaagauuaucaaacaaaugaaacaaguaaaggaagaaagaagguaucuggaaagaaauag

SEQ ID NO: 249900 - RNA, 63 nt, hsa
gcaaauuaaaacgauaucaugccuacaaugguuggaagaaaaaauacuuggaaacaaagaaag

SEQ ID NO: 249901 - RNA, 63 nt, hsa
guuucuuggccacugaauuagccaaaacacuuaggaagaaaucacuuaaauaccucuggcuua

SEQ ID NO: 249902 - RNA, 63 nt, hsa
guuggaauguaugcuaauugaacaugcaauuggggaagaaaaaauguagaaugauuuuugcua

SEQ ID NO: 249903 - RNA, 63 nt, hsa
ggccuugcucuuguggagcuuagagguugguggggaagaaaauaggcaugcaccaaggaauug

SEQ ID NO: 249904 - RNA, 63 nt, hsa
aauagccugcucaguagagggucaugcagacaaggaagaaaacuuaggggcugcucugacggu

SEQ ID NO: 249905 - RNA, 63 nt, hsa
ugggagccaagcuugaggacugcuggugaccugggaagaaaccuucuucccauccuguucagc

SEQ ID NO: 249906 - RNA, 63 nt, hsa
aggggaagaagaucaaagaagaaaagaagaaggggaagaaaagaaggggaagaagaucaaaac

SEQ ID NO: 249907 - RNA, 63 nt, hsa
aauuuauugcagaaauugaaaagaaggggaaggggaagaaaagaaggggaagaagaucaaaga

SEQ ID NO: 249908 - RNA, 63 nt, hsa
guucccaaguggugaggugagauuguggcuggaggaagaaaaaggauggcaugaaagaaugac

SEQ ID NO: 249909 - RNA, 63 nt, hsa
gauuggaggccauggccuauguacaaacauacuggaagaaaaccagcuuguuuuuaaaacuua

SEQ ID NO: 249910 - RNA, 63 nt, hsa
ugcuguguggagaagguucugagaugcagugagggaagaaaggauccugcuggggauuccauu

SEQ ID NO: 249911 - RNA, 63 nt, hsa
ugggcgugggcuucuucacauaagccuggggaaggaagaaaaaacggcuuucauuaccaaaua

SEQ ID NO: 249912 - RNA, 63 nt, hsa
gaaagcucuccuaauacuuacuuaaauagccauggaagaaaauuaugcuugucccuucugacu

SEQ ID NO: 249913 - RNA, 63 nt, hsa
uuuuguguguuuaaaaaaauugaagaaaauucaggaagaaacguguuaauaaacauuguacug

SEQ ID NO: 249914 - RNA, 63 nt, hsa
uucacgcugcugauaaagacauacccgagacugggaagaaaaagugguuuaauuggacuuaaa

SEQ ID NO: 249915 - RNA, 63 nt, hsa
uuaaugcugcugauaaagacguacccgagacugggaagaaaaagagguuuacuuggacuuaca

SEQ ID NO: 249916 - RNA, 63 nt, hsa
aaggugguauaccuuccaaauccugguucagauggaagaaauagcaggagagaggacccauua

SEQ ID NO: 249917 - RNA, 63 nt, hsa
ggagagaggacccauuagcuggcagacccagggggaagaaaggagggcugugaggagauaccu

SEQ ID NO: 249918 - RNA, 63 nt, hsa
ccauucucagugggcugcaguugcccaaccacaggaagaaagggaaggagguagagggaagaa

SEQ ID NO: 249919 - RNA, 63 nt, hsa
cccaaccacaggaagaaagggaaggagguagagggaagaaacagaagcaguguuccauuuucu

SEQ ID NO: 249920 - RNA, 63 nt, hsa
cuuuugguggggugggggugggcuaaagccauaggaagaaaaaugugauguauguguccagua

SEQ ID NO: 249921 - RNA, 63 nt, hsa
gacuacaaauguuuagcuguuacucauuucuagggaagaaauucuaaaucccuccuucacuuu

SEQ ID NO: 249922 - RNA, 63 nt, hsa
gacaguugcccuuucaaagcaggaggaagaaaaggaagaaagaaaaacuguuucaucauuucu

SEQ ID NO: 249923 - RNA, 63 nt, hsa
aucccucaugacaguugcccuuucaaagcaggaggaagaaaaggaagaaagaaaaacuguuuc

SEQ ID NO: 249924 - RNA, 63 nt, hsa
cuuccuuguuggcugauccauagagcauuacuuggaagaaaauuucacuauuugcauugaugu

SEQ ID NO: 249925 - RNA, 63 nt, hsa
aaacuaaguauuucuucauuguaccuuaguccaggaagaaauuaauggaauauggugugcuaa

SEQ ID NO: 249926 - RNA, 63 nt, hsa
caaauauauuagucuagggccacuuaauuuagaggaagaaaaaaaaucaacccauccauagaa

SEQ ID NO: 249927 - RNA, 63 nt, hsa
gaacucacugauggagaugugaaauggcaguaaggaagaaaacagaauaacugaacaaauaua

SEQ ID NO: 249928 - RNA, 63 nt, hsa
gcugcccaagagaaaagaguguauguuuggaguggaagaaaaucgguuuugaaucucaugaac

SEQ ID NO: 249929 - RNA, 63 nt, hsa
aagcuuagcuuccucaacuacuguuuuucagaaggaagaaagaaucaaauggaagaagaauca

SEQ ID NO: 249930 - RNA, 63 nt, hsa
ggaaagggaaggaagaaaggaaggagggagaagggaagaaagaaacaaugucuaacccaaccc

SEQ ID NO: 249931 - RNA, 63 nt, hsa
aggaaagaagagagggagagagaggaaagggaaggaagaaaggaaggagggagaagggaagaa

SEQ ID NO: 249932 - RNA, 63 nt, hsa
gcggaggaggcuggugacaggccaaaggccaguggaagaaacacccuuucaucucagagucca

SEQ ID NO: 249933 - RNA, 63 nt, hsa
auuucugcuuccuuuuauuuuuauaggaauagaggaagaaaugucagaugcgugcccagcucu

SEQ ID NO: 249934 - RNA, 63 nt, hsa
uguugggaaaggauaagugcuaccguugagaagggaagaaaggcugagucuagguggagaaaa

SEQ ID NO: 249935 - RNA, 63 nt, hsa
agacaggaaacagggaguucauuuggccacacuggaagaaaggcaagaaagaggaagacaagu

SEQ ID NO: 249936 - RNA, 63 nt, hsa
ucuuaaauaacuccauucauacaaauugggaugggaagaaaauccuuuccucuugggaaagua

SEQ ID NO: 249937 - RNA, 63 nt, hsa
aagaccacaagucugcaggaaacucuggaaucaggaagaaaagcuauguucauacucuaaauc

SEQ ID NO: 249938 - RNA, 63 nt, hsa
cccuuuguuuacucagauuucucuuagccauaaggaagaaaaagaacucuugcaugaaaauag

SEQ ID NO: 249939 - RNA, 63 nt, hsa
aaaagaacucuugcaugaaaauagcaugaugcaggaagaaauugccaugcuaagaauagaacu

SEQ ID NO: 249940 - RNA, 63 nt, hsa
caucuugagaagcaggcggguugggugggaggaggaagaaagggaagaauuagguuugaauug

SEQ ID NO: 249941 - RNA, 63 nt, hsa
gccacugagaagcaggcggguugggugggaggaggaagaaagggaagaauuagguuugaauug

SEQ ID NO: 249942 - RNA, 63 nt, hsa
caucauuuuaucgagagaaccuucugcuucugaggaagaaaaggaguuaggagaaagaagagc

SEQ ID NO: 249943 - RNA, 63 nt, hsa
uaauugucacaccuggaagcuuggugaauaauuggaagaaagaauuucaaaaauggcuaggaa

SEQ ID NO: 249944 - RNA, 63 nt, hsa
gacugaaaagaaauucuccauuaugaggaauugggaagaaaucugguauccaagcuuaaauuu

SEQ ID NO: 249945 - RNA, 63 nt, hsa
uguuucaugaauccauuuggcacagagacacaaggaagaaaacacuaguaaccaucuuuccac

SEQ ID NO: 249946 - RNA, 63 nt, hsa
aucucuacuuuccuauacugccaaagaaugugaggaagaaaugggacucuuugguuauuuauu

SEQ ID NO: 249947 - RNA, 63 nt, hsa
uaggcaagaaggacagcaguaaaugaagaccauggaagaaaagaaggaaugccaaagaucgag

SEQ ID NO: 249948 - RNA, 63 nt, hsa
ccaaagacccagagucucagagccagguuaaguggaagaaacuuugagagguuucuuaaucaa

SEQ ID NO: 249949 - RNA, 63 nt, hsa
uuucauggugauggugcaagggagagaugauuaggaagaaaaugucuuacacggcuguaauug

SEQ ID NO: 249950 - RNA, 63 nt, hsa
aggaugugucacuaaugcuccaccucacccuuuggaagaaaggaaagcuguuuccuccuggug

SEQ ID NO: 249951 - RNA, 63 nt, hsa
uacgcagcugccgaacucugacucuaguucugcggaagaaaaggaugcgguauuugcuuuugc

SEQ ID NO: 249952 - RNA, 63 nt, hsa
gggcacuugcauccauugccuuuuccaggaaagggaagaaaacacucaguugauaaaccuuag

SEQ ID NO: 249953 - RNA, 63 nt, hsa
uauacagucuauaaaaauuguuauuaugggauuggaagaaacacguggucaugaauagaaaaa

SEQ ID NO: 249954 - RNA, 63 nt, hsa
cauuuuagaaacggacagcuuauaaaaauaaagggaagaaaggaggcagcauggagagaggcc

SEQ ID NO: 249955 - RNA, 63 nt, hsa
ugguggcaguuguuuguuuuaaacugaccacuuggaagaaacaccuugguuaucugugguuuu

SEQ ID NO: 249956 - RNA, 63 nt, hsa
gaugaugauauucagacgaagcauugauguuauggaagaaagaaagaaacaaacaaaauauau

SEQ ID NO: 249957 - RNA, 63 nt, hsa
agaaguuuuuccuugauugugcuauguuucaguggaagaaauucuuugaaguagaugugagug

SEQ ID NO: 249958 - RNA, 63 nt, hsa
gacaaaucaacuuugaagacacaaaaguuaauuggaagaaauaaaaacugugaacgaagaaua

SEQ ID NO: 249959 - RNA, 63 nt, hsa
uucacgcugcugauaaagacauaccugagaccaggaagaaaaagagguuuaauuggacuuaca

SEQ ID NO: 249960 - RNA, 63 nt, hsa
uacaauugacauaggaauuacauuaaaauauuaggaagaaacaaggacaaauuuagaccuuga

SEQ ID NO: 249961 - RNA, 63 nt, hsa
uuuaucucaaguaauuuggugucauuuacaaaaggaagaaauuccugccaucagaagggacag

SEQ ID NO: 249962 - RNA, 63 nt, hsa
auaaguuuuuacugccaguauugagaaauucguggaagaaaugucagcaggaaguaaaaauuc

SEQ ID NO: 249963 - RNA, 63 nt, hsa
accuguuacccauuaggggugauaacauuaaugggaagaaaugauggcaacuuugaaugcuag

SEQ ID NO: 249964 - RNA, 63 nt, hsa
caucucugggauuugaaauauccagacuuguagggaagaaaacaaugacuugacgaccuuaaa

SEQ ID NO: 249965 - RNA, 63 nt, hsa
uucagaggaggcauaagcuauggagguuggaaaggaagaaagagaagagcugaaguaaaugua

SEQ ID NO: 249966 - RNA, 63 nt, hsa
ccuguccuuccccaacuccccagcuccaagaguggaagaaauccccaagaucaucugggucuc

SEQ ID NO: 249967 - RNA, 63 nt, hsa
ucugcucucuucucuccccucugucccucuucaggaagaaagagcucauucugucucacaagc

SEQ ID NO: 249968 - RNA, 63 nt, hsa
cccagcagugccugguucugagcaaacucccagggaagaaaacggcccugucuccauggccag

SEQ ID NO: 249969 - RNA, 63 nt, hsa
uccaagcaccggggcgaaaaaccacaaaggaaaggaagaaaauuuauauauauauaauauaaa

SEQ ID NO: 249970 - RNA, 63 nt, hsa
cucugcuuugucaugccauuaagcucacaauaaggaagaaauaacagauaaguccauuggugg

SEQ ID NO: 249971 - RNA, 63 nt, hsa
cugauagcucauauuauaaauuucuaaauccuaggaagaaacgcuuggagugcuucugaauau

SEQ ID NO: 249972 - RNA, 63 nt, hsa
aaauuuggaugucaacugagaaaggagugagaaggaagaaacaaugcgcaaaggaaagcaguc

SEQ ID NO: 249973 - RNA, 63 nt, hsa
ucaggucuuuacugaauguuagaagaggccuuuggaagaaaauuauguaaaguuuaaucuaua

SEQ ID NO: 249974 - RNA, 63 nt, hsa
auuaaaaauugagucuuaaauuuaaaugggaagggaagaaaacaccaaauaagaaaaaaauuu

SEQ ID NO: 249975 - RNA, 63 nt, hsa
aacgacgaagugcugagaagguuauggguaccaggaagaaacaaacagaagucuuaagauuag

SEQ ID NO: 249976 - RNA, 63 nt, hsa
cuuugggaauaguucauagggaagggacaacauggaagaaacagcgauuuaaauuguauugaa

SEQ ID NO: 249977 - RNA, 63 nt, hsa
aguuccuaaaacuaaaacuccauucuagucuugggaagaaaaguuucuacucagaacugggga

SEQ ID NO: 249978 - RNA, 63 nt, hsa
caaaaugguugacauaauuaaugagaagaauuuggaagaaauugguauuuuaauacugucugu

SEQ ID NO: 249979 - RNA, 63 nt, hsa
gacauagcaagacccugucuuaaaagaaaaaugggaagaaagacaagguaacaugaagaaaga

SEQ ID NO: 249980 - RNA, 63 nt, hsa
aggugggaggacuaacuuccagggugccaagaaggaagaaaagccccagguucucuuuucuua

SEQ ID NO: 249981 - RNA, 63 nt, hsa
gcccccacccuccugccaagcugccucugggaaggaagaaacaggagcuaggcagaagccuug

SEQ ID NO: 249982 - RNA, 63 nt, hsa
agcuuuauucaaauuuugacaaucagagcacugggaagaaauaaauuccacaacugccuuuag

SEQ ID NO: 249983 - RNA, 63 nt, hsa
uggucucgcugucgguuaacuguaaaguuagggggaagaaagaaaaaaaauuaaaaggguaga

SEQ ID NO: 249984 - RNA, 63 nt, hsa
uguauaugcaguauugagcacuguaggcaagagggaagaaagagaaggagccaucuccaucuu

SEQ ID NO: 249985 - RNA, 63 nt, hsa
acccacucuccucugccucaguaaguaucuggaggaagaaaacaggugaaagaagaaguaaaa

SEQ ID NO: 249986 - RNA, 63 nt, hsa
ggaagauguucaauagaacaugcaagaauuucuggaagaaaggcuguggaagggccaauggag

SEQ ID NO: 249987 - RNA, 63 nt, hsa
aaagcccuaugugaaaagaucccaagauggagaggaagaaacgcuaauucagcauguguucau

SEQ ID NO: 249988 - RNA, 63 nt, hsa
ugguggucccucuucccacgugcagcccuguugggaagaaaggaagaaaacaggucccuccag

SEQ ID NO: 249989 - RNA, 63 nt, hsa
ccucuucccacgugcagcccuguugggaagaaaggaagaaaacaggucccuccaggggugcug

SEQ ID NO: 249990 - RNA, 63 nt, hsa
gccuuauugaaaaacuaaagcaaauucuuuauaggaagaaaauaugggaauuugauuacacau

SEQ ID NO: 249991 - RNA, 63 nt, hsa
acaggacuucuguuuacaauggaaaucugaaauggaagaaacaucuuuaaccuugugugucug

SEQ ID NO: 249992 - RNA, 63 nt, hsa
cacaccauaacuagguaacaguuugauaacuagggaagaaagcagaacaguuaagcagccgcc

SEQ ID NO: 249993 - RNA, 63 nt, hsa
aaaaucuguagagcagggcaaguaacauggaagggaagaaaaggugaaaaauuagaaauguuc

SEQ ID NO: 249994 - RNA, 63 nt, hsa
ggccccaccaagaggguggaucacaccucagugggaagaaaaauaaaauuuccuucagguuuu

SEQ ID NO: 249995 - RNA, 63 nt, hsa
gcaugcuuugauaucugguucagacuaucaucaggaagaaaaaaaaaucccacaguaccugaa

SEQ ID NO: 249996 - RNA, 63 nt, hsa
aaauagcuuaagaagaagugaaacauggaucuuggaagaaauuuugaaaucuucaauuugauc

SEQ ID NO: 249997 - RNA, 63 nt, hsa
uuuaaaucugagcaugcaucuuuaaacagcucaggaagaaauagcuuaagaagaagugaaaca

SEQ ID NO: 249998 - RNA, 63 nt, hsa
gguuucagaugaugaagaaagaggaacgggcuuggaagaaaauaaucaagaagagcaaagcau

SEQ ID NO: 249999 - RNA, 63 nt, hsa
aaguccaaaagucacuuuugaaugugaacaaaaggaagaaaaucaaggaaagaaugagucuaa

SEQ ID NO: 250000 - RNA, 63 nt, hsa
aguuaaccacagucgggaaacaagcauagaaauggaagaaagugaacuugaugcucaguauuu

SEQ ID NO: 250001 - RNA, 63 nt, hsa
uucuccaccaagcauuugguuuauuuagaaaaaggaagaaaaacaaaaaacaaaaaacuaaag

SEQ ID NO: 250002 - RNA, 63 nt, hsa
aggacuggaggccgccaggcaggcguggccgagggaagaaaaagcuucuggauguccagccag

SEQ ID NO: 250003 - RNA, 63 nt, hsa
gucccuaucuuccagcagguuagaggccuuuagggaagaaaagccugugugcagggaaagaga

SEQ ID NO: 250004 - RNA, 63 nt, hsa
uacgaggauuucuggaagcuucuguaacuguagggaagaaagcuguaggggagcaugguuuuu

SEQ ID NO: 250005 - RNA, 63 nt, hsa
uuucucacugcuaacguugguguuucuggcgugggaagaaaugcacaggcgugcauggcaugc

SEQ ID NO: 250006 - RNA, 63 nt, hsa
cauuguaagaguucugucaugcagucugaaaagggaagaaacaggauggcuuucuguagccac

SEQ ID NO: 250007 - RNA, 63 nt, hsa
aaaucauugaacugagggggaaaaauguaacuaggaagaaaaacccaauuuaagaaauuacau

SEQ ID NO: 250008 - RNA, 63 nt, hsa
gucauuucugcugaaaaaacagaugauccugguggaagaaaagguugaaggcagcugcccucg

SEQ ID NO: 250009 - RNA, 63 nt, hsa
aaaguuuccauggaagcuguucagaaaaaucaaggaagaaaaaagcaaguuguucaauuuuaa

SEQ ID NO: 250010 - RNA, 63 nt, hsa
uaaugggaaaguucauguugcugaaagcuguuuggaagaaacagguggccugggaguagauau

SEQ ID NO: 250011 - RNA, 63 nt, hsa
aaaaaucaucucacaugcauuuuauaguuuuggggaagaaaauaucauggggaggucuaccuu

SEQ ID NO: 250012 - RNA, 63 nt, hsa
uucaagaauuucugaggacaggagcucacaucuggaagaaacaggaagauuggaaucugccug

SEQ ID NO: 250013 - RNA, 63 nt, hsa
uaaauaaauaauuuaaauuuuauugguguuauuggaagaaaaaugcuauuaaugggcuaauaa

SEQ ID NO: 250014 - RNA, 63 nt, hsa
uguccauaugucuuuaccuaccuaaguaaaacaggaagaaaaucaguaacauuauccuuaggu

SEQ ID NO: 250015 - RNA, 64 nt, hsa
aguaauaugcuaaccugaugcacugcugaaagaaaaugugaauuuuucguaauaauugcauuuu

SEQ ID NO: 250016 - RNA, 64 nt, hsa
ucauuccugcaaagcuugcuuuggggaguuggauaaugugaaaauuuuaaguaccuaggggaga

SEQ ID NO: 250017 - RNA, 64 nt, hsa
acaaguuuauguaguacuuaauguacaugauaugaaugugaagcauaaaauuaaauaaaauuuu

SEQ ID NO: 250018 - RNA, 64 nt, hsa
uaaagggaacauaauuuguuuaggcucccacauaaaugugaaucuggccaacaacuuugguuca

SEQ ID NO: 250019 - RNA, 64 nt, hsa
uucuguuauuauacuuaaucuucuaaacuaaacuaaugugaacaguagggaagcaagggcccaa

SEQ ID NO: 250020 - RNA, 64 nt, hsa
uagcuguauuccuaaacaaauuguuuccuaaacaaaugugaaaaugugaacagugcugaaaggu

SEQ ID NO: 250021 - RNA, 64 nt, hsa
uuccuaaacaaauuguuuccuaaacaaaugugaaaaugugaacagugcugaaagguuuugugaa

SEQ ID NO: 250022 - RNA, 64 nt, hsa
gaauuauaauuaguuccucauuagcauuuugcuaaaugugaaugaugauccuaggcauuugcug

SEQ ID NO: 250023 - RNA, 64 nt, hsa
cuggguaacuagggaagauaauauuaaggaagacaaugugaaaagaaaaaugagccuggcaaga

SEQ ID NO: 250024 - RNA, 64 nt, hsa
acuaguuuaaaaaauuauaaaugaaucuaaucaaaaugugaauaguagucaaaaggauaauuua

SEQ ID NO: 250025 - RNA, 64 nt, hsa
aguugaauugaaugucuauaaggucuaaagguagaaugugaauauugccacagaguucauugcu

SEQ ID NO: 250026 - RNA, 64 nt, hsa
uuagaaacauagacucccaaguuuuaaacaccuaaaugugaauaacccauauauacaacaaagu

SEQ ID NO: 250027 - RNA, 64 nt, hsa
uugagauauaaaaguaggaaacagguauaauuuuaaugugaaaauuaagucuucacuuucugug

SEQ ID NO: 250028 - RNA, 64 nt, hsa
ggugaaaaguccaucuugcugauuugaugauugaaaugugaaagugaaguggaaggaaugaaug

SEQ ID NO: 250029 - RNA, 64 nt, hsa
auguaggucaaaucaaauuaaagaugauuuuuuuaaugugaauaaaguuauguucugauaguuu

SEQ ID NO: 250030 - RNA, 64 nt, hsa
cuaguucucuuaucuuugaucguauauuucucauaaugugaaauaugaugagauucacuuaggg

SEQ ID NO: 250031 - RNA, 64 nt, hsa
uccagccauuuuuuuaguuaguaaaaauccuauuaaugugaaccagccaggaauaacaguguua

SEQ ID NO: 250032 - RNA, 64 nt, hsa
aaacuaauagaucaccuuagaaaauuaugcaauuaaugugaaaauaauugauguuugcaaugug

SEQ ID NO: 250033 - RNA, 64 nt, hsa
auuguuacaugauuuuuuaaaaaaaggaaaagaaaaugugaaacacaauuuaguccucauuauu

SEQ ID NO: 250034 - RNA, 64 nt, hsa
gaaauugcuuuagcuucuggucagcacugauuaaaaugugaauagugaaguggcuauccuaaac

SEQ ID NO: 250035 - RNA, 64 nt, hsa
aauaagccugccgccaaaauaaaucacuuaucaaaaugugaacuguuuuccucauguucaguua

SEQ ID NO: 250036 - RNA, 64 nt, hsa
ugcuaauuuaugagaaaauguaauaauugcaaugaaugugaauuauacagacaggcaaacauuu

SEQ ID NO: 250037 - RNA, 64 nt, hsa
gcacuuguacccgaucauaauaaaaauggauaauaaugugaaggaagaaaagagccgcuugaau

SEQ ID NO: 250038 - RNA, 64 nt, hsa
caugagaaaauuuauacuguagagaaacccuggaaaugugaagaacguggcaaaguucuuuacc

SEQ ID NO: 250039 - RNA, 64 nt, hsa
cauaagagaauucauaccggagagaaacuguacaaaugugaagaauauggcaaagccugugaau

SEQ ID NO: 250040 - RNA, 64 nt, hsa
caagauaauucauucuggggaaaaaaaugcuacaaaugugaaaaacguggcagagccuucagac

SEQ ID NO: 250041 - RNA, 64 nt, hsa
auaaugagaacucauacuggaggaaagucuuacaaaugugaagaauguggcagucuuuaaaucu

SEQ ID NO: 250042 - RNA, 64 nt, hsa
auauuguaagacuuuugagaauauacuugauuaaaaugugaaagaagggauuguuaacuuauug

SEQ ID NO: 250043 - RNA, 64 nt, hsa
guauauaauguuaauuuauugacuaguuugaaauaaugugaaguguuuuuuauaucagauuaau

SEQ ID NO: 250044 - RNA, 64 nt, hsa
uuuucacuuuuggcgacuagaaacaauuccaguaaaugugaaucucgacaaaucgaggacugaa

SEQ ID NO: 250045 - RNA, 64 nt, hsa
cgaacgagcgaacaacugagcccaagccggugagaaugugaaacaguuucucaaaggaaagaau

SEQ ID NO: 250046 - RNA, 64 nt, hsa
acaguucucucacaccaagggccccauaguuauaaaugugaaauuauauuccaggucaaaauuu

SEQ ID NO: 250047 - RNA, 64 nt, hsa
uuuaaauuuaaaaugcagagagaccaaugguuaaaaugugaauaguauuguaacuauuuuaagg

SEQ ID NO: 250048 - RNA, 64 nt, hsa
agggaugaaaauaaugggaguauaauacccauuuaaugugaaaaacauaagagucuuaaaagaa

SEQ ID NO: 250049 - RNA, 64 nt, hsa
gaguacgcucuaugcauaguaugacuucuauuuuaaugugaagaauuuuuugucucucuccuga

SEQ ID NO: 250050 - RNA, 64 nt, hsa
ugacaccacuaaagaaacgaucagacagaucuggaaugugaagcguuauagaagauaacuggcc

SEQ ID NO: 250051 - RNA, 64 nt, hsa
cuucuugauuaaaaguuauguaauaaccaaaugcaaugugaaauauuuuacuggacucuauuuu

SEQ ID NO: 250052 - RNA, 64 nt, hsa; identical to SEQ ID NO: 250050

SEQ ID NO: 250053 - RNA, 64 nt, hsa; identical to SEQ ID NO: 250051

SEQ ID NO: 250054 - RNA, 64 nt, hsa
ccuaggaaagauuuacacaauagauaaucaucuuaaugugaaagauauuugaaguauuaauuuu

SEQ ID NO: 250055 - RNA, 64 nt, hsa
guacauacucauucccaaagcaauccaaaaacaaaaugugaaccauuuggguuucaaauguuaa

SEQ ID NO: 250056 - RNA, 64 nt, hsa
aacuuuggucauucugcuguguucauuaggugccaaugugaagucuggauuuuaauuggcaugu

SEQ ID NO: 250057 - RNA, 64 nt, hsa
uauuucagucuaggaaagauuuuccuucucuuggaaugugaagaucugucgauucaucuccaau

SEQ ID NO: 250058 - RNA, 64 nt, hsa
uuggugaauaaguuauaaauucccacagaagaaaaaugugaaagacugggugcuagacaagaag

SEQ ID NO: 250059 - RNA, 64 nt, hsa
accuuuucuuuagucccaaccacuaguuuuaacaaaugugaauuauugaaaugugaagggacaa

SEQ ID NO: 250060 - RNA, 64 nt, hsa
ccaaccacuaguuuuaacaaaugugaauuauugaaaugugaagggacaaaaagaaucauacauu

SEQ ID NO: 250061 - RNA, 64 nt, hsa
uguugaaugacugacccaaaaugugaaugaagcuaaugugaaugugagugaagcucccuucagg

SEQ ID NO: 250062 - RNA, 64 nt, hsa
cauuugacacacaguuguugaaugacugacccaaaaugugaaugaagcuaaugugaaugugagu

SEQ ID NO: 250063 - RNA, 64 nt, hsa
aucuguauuaucaauuucucauagacacugugcuaaugugaauuuuaaaugaccugcaucaagu

SEQ ID NO: 250064 - RNA, 64 nt, hsa
uuucauuuucuguauuauauaugaaaaguaaauuaaugugaaaccuggcccagcuugcuggaaa

SEQ ID NO: 250065 - RNA, 64 nt, hsa
cacauaggaaaauucauacuggagagaaacuacaaaugugaagaauguguuaaagccuuuaaca

SEQ ID NO: 250066 - RNA, 64 nt, hsa
aguugagaaaauucguacuggagagaauccuacaaaugugaaaaauguggcaaauccuuuaacu

SEQ ID NO: 250067 - RNA, 64 nt, hsa
gauaagaaaauucauacuggaaagaaacccuacaaaugugaagucuguggcaaagcuuuuaacu

SEQ ID NO: 250068 - RNA, 64 nt, hsa
auaagacaguuuauacuuugagagaaacccugcaaaugugaauaauguggcaauacuuuaaacc

SEQ ID NO: 250069 - RNA, 64 nt, hsa
ucuaacauaaaucauacuggugaaaaauccuagaaaugugaaaaauaucacaaagccuuuaaau

SEQ ID NO: 250070 - RNA, 64 nt, hsa
cauaagaaaauuuacacuagagagaaagccuacaaaugugaagaauguggcaaagccuuuaacc

SEQ ID NO: 250071 - RNA, 64 nt, hsa
cauaagauaauucauagcggagagaaaccccacaaaugugaagaauguggcagagcuuuuaacc

SEQ ID NO: 250072 - RNA, 64 nt, hsa
cauaagauaauucacaguggagaaaaacccuacaaaugugaagaauguggcaaagcuuuuaacc

SEQ ID NO: 250073 - RNA, 64 nt, hsa
cauaagaaaauucauaguaaagagaaacccuacaaaugugaacaguguggcaaggucuuuaaga

SEQ ID NO: 250074 - RNA, 64 nt, hsa
cacaagaagauucauacuagagagaaacccuacaaaugugaagaauguggcauaucuuuuaacc

SEQ ID NO: 250075 - RNA, 64 nt, hsa
cauaagaugauucacacuugaaugaaacccuacaaaugugaacgauguggcaguuguuuuaacu

SEQ ID NO: 250076 - RNA, 64 nt, hsa
cauaagaaaauucaaacuggagagaaacucuacaaaugugaagaauguggcaaagcuuuuaacc

SEQ ID NO: 250077 - RNA, 64 nt, hsa
acaccuaaaauucaugcaggagagaaacaccacaaaugugaaaaauuugguaaauucuuuaaca

SEQ ID NO: 250078 - RNA, 64 nt, hsa
auccauacuagagagaagcccuacaaauguaaagaaugugaaaagucuuucagucagagcucaa

SEQ ID NO: 250079 - RNA, 64 nt, hsa
cauaaaagaauacacacuagagaaaaaccuuacaaaugugaagcaucugauaaauccugugaag

SEQ ID NO: 250080 - RNA, 64 nt, hsa
auucacaugggaauaaaauuccauugcugcaaugaaugugaaaaagccaucagucaaagaaacu

SEQ ID NO: 250081 - RNA, 64 nt, hsa
cacuguuugagaaugaugcuacucugaucuaaugaaugugaacauguagauguuuuguguguau

SEQ ID NO: 250082 - RNA, 64 nt, hsa
uacacacuuguauauacauucuugagaacacugcaaugugaaaaucacguuugcuauuuauaaa

SEQ ID NO: 250083 - RNA, 64 nt, hsa
uagaaaacacugacuuuguuuuuauaaguuauuaaaugugaaauugaucugcaucagcuuauuu

SEQ ID NO: 250084 - RNA, 64 nt, hsa
ugaaaacauuuguaaggcugcaacauaauauuaaaaugugaauaaauaaauguucugauaaaau

SEQ ID NO: 250085 - RNA, 64 nt, hsa
acuuuaaugaaagguggaaaauaauuuaacuuacaaugugaaaauacaaugugaaauguacaau

SEQ ID NO: 250086 - RNA, 64 nt, hsa
guggaaaauaauuuaacuuacaaugugaaaauacaaugugaaauguacaauaaaucauauuuau

SEQ ID NO: 250087 - RNA, 64 nt, hsa
guauaugccacuaauaaaaugaaucuaaacauugaaugugaauggcccucagaaaaucaucuag

SEQ ID NO: 250088 - RNA, 64 nt, hsa
ugucauauacuauugauccuuuggcacuuaaauaaaugugaaauccuccaggaauuuuccugug

SEQ ID NO: 250089 - RNA, 64 nt, hsa
ugaaaauguguuuacuucagaacggcacuacauaaaugugaaaaguuguugaucuugaaauauc

SEQ ID NO: 250090 - RNA, 64 nt, hsa
guugacuuuaaugaaucuuugguguggaaugaaaaaugugaacuucuuacucauagugugguuu

SEQ ID NO: 250091 - RNA, 64 nt, hsa
aacggaaaauuuacaagcaaccuagagguccagcaaugugaaaagaaucaaguaauucugcuua

SEQ ID NO: 250092 - RNA, 64 nt, hsa
ugaauuuacugguauacuaagugauuuaaauuugaaugugaaauacugauaggcuuuuaagcuu

SEQ ID NO: 250093 - RNA, 64 nt, hsa
uaauuugccagacagagaucagaauugaaccgucaaugugaaauaaagaguucuccuuguacuu

SEQ ID NO: 250094 - RNA, 64 nt, hsa
uuauguaaacaucauaaauaguaaauaaugauucaaugugaauuuuaaaaugcaaauauugcua

SEQ ID NO: 250095 - RNA, 64 nt, hsa
agcgagccacggcagcccccuguaucuggauuguaaugugaaucuuuaggguaauuccuccagu

SEQ ID NO: 250096 - RNA, 64 nt, hsa
cccaaacaggauuaacugugaagacuaauuuauaaaugugaaccuaagaaaacuccaccucuga

SEQ ID NO: 250097 - RNA, 64 nt, hsa
cugcauuaagaaaauaaaauuucuauauaccaaaaaugugaaguuauaccaaauaaaguuucua

SEQ ID NO: 250098 - RNA, 64 nt, hsa
auuuacugcauaugaggcuuucuguuaauuuuuuaaugugaauaauuuauauauugcacauucu

SEQ ID NO: 250099 - RNA, 64 nt, hsa
cugggaacaaaccucacuugagcugugccuagacaaugugaauuccuguguugcuaacagaagu

SEQ ID NO: 250100 - RNA, 64 nt, hsa
aacauuucuggaacauggauuuguguucaccuuaaaugugaaaauaaauccuauuuucuaugga

SEQ ID NO: 250101 - RNA, 64 nt, hsa
aauaugauuuuuaagagauuuauguucuacuuaaaaugugaauuguacuucugagcugccuuaa

SEQ ID NO: 250102 - RNA, 64 nt, hsa
agcugugcacuugccuuguugcugaaguuccaauaaugugaaaaccaaaguagagguuuuuuuc

SEQ ID NO: 250103 - RNA, 64 nt, hsa
caacguuacaaucauuuuuaggguuauuguaaucaaugugaauaucauguuuuuucaaaucugu

SEQ ID NO: 250104 - RNA, 64 nt, hsa
ugaaacucucaagggaaggugaugcaggggagaaaaugugaauuaaauuacauagauggguguu

SEQ ID NO: 250105 - RNA, 64 nt, hsa
aucauuaacaguuuguccuuaggaugcaaaugaaaaugugaauacauaccuuguuguacuguug

SEQ ID NO: 250106 - RNA, 64 nt, hsa
uuuaaucauaagccuuaauaagauuuuucuaagaaaugugaaauagaacaauuuucaucuaauu

SEQ ID NO: 250107 - RNA, 64 nt, hsa
ggagcuaguuuacaggcuuacugugauuuaagcaaaugugaaaagugaaaccuuaauuuuauca

SEQ ID NO: 250108 - RNA, 64 nt, hsa
aggguuuccugaaacuggguuaauucuuuauagaaaugugaacacugaauuuauuuuaaaaaau

SEQ ID NO: 250109 - RNA, 64 nt, hsa
accuggugucuccugcccacccuggucccagguaaaugugaauggagacagguaugagaggcug

SEQ ID NO: 250110 - RNA, 64 nt, hsa
uggugauaacugccucguuuaaauggucacaagaaaugugaagagagagcuagggcagacaugc

SEQ ID NO: 250111 - RNA, 64 nt, hsa
uauauuauuuggcuagaaauugcuguuuuuaauaaaugugaauuuuuuaaaaauaaagauuuuu

SEQ ID NO: 250112 - RNA, 64 nt, hsa
aauuucuguuagcugauugugguaaacaauguuuaaugugaaaagaaauuaaaacuuucuucau

SEQ ID NO: 250113 - RNA, 64 nt, hsa
uguuaaauauuuauaugcuuuguugacuagcugaaaugugaauucuguuaguguugacuaaaga

SEQ ID NO: 250114 - RNA, 64 nt, hsa
uucauuuuuugaagcuuucuacauauagugucugaaugugaagucuuacucaacuugcuuuuuu

SEQ ID NO: 250115 - RNA, 64 nt, hsa
gaaaagaauaaguauucuugcaucuggccuuagaaaugugaaguuauauucucaaguuuauuuu

SEQ ID NO: 250116 - RNA, 64 nt, hsa
guuuuuuuggguaacaaucccgcagcugacaaaaaaugugaaauuuccacaaaauauccaacuu

SEQ ID NO: 250117 - RNA, 64 nt, hsa
uuagccagaaagcaaaaaaacaauaguaaugauaaaugugaacauuuuugcuuauucauugaau

SEQ ID NO: 250118 - RNA, 64 nt, hsa
agaauaagagcuuuuuuguuucuuggguuuuuaaaaugugaaucugcaaugaucauaaaaauua

SEQ ID NO: 250119 - RNA, 64 nt, hsa
uaaaaugugaaucugcaaugaucauaaaaauuaaaaugugaaugucaacaauaaaaagcaagac

SEQ ID NO: 250120 - RNA, 64 nt, hsa
auguagacugccauuauguguggucuucccauuaaaugugaacauuuuaauauguaugcauuca

SEQ ID NO: 250121 - RNA, 64 nt, hsa
uccacuccugcuuuccuaaggaugaaacagugauaaugugaacucaaaugagguuuccugggua

SEQ ID NO: 250122 - RNA, 64 nt, hsa
acauguugcagaagaccagaucauuuuuauacagaaugugaaauacugauacaguuauucuuuu

SEQ ID NO: 250123 - RNA, 64 nt, hsa
uaaacccuguuugcaccucgauuuguuugcugaaaaugugaaauaguaaaaaugaaauaacugg

SEQ ID NO: 250124 - RNA, 64 nt, hsa
cuauuuauuugacaaaaaauccaguuaauauauuaaugugaaauaaacccuguuugcaccucga

SEQ ID NO: 250125 - RNA, 64 nt, hsa
cauaagauaauuaaugcuggagagaaacccuacaaaugugaagaauguggcaaagauuucuauu

SEQ ID NO: 250126 - RNA, 64 nt, hsa
cauaaaauaauucauaaaggagauaaauuauacaaaugugaagaauguggcaaagcuuuuaaca

SEQ ID NO: 250127 - RNA, 64 nt, hsa
cauaagauaauuuauacuggagagaagcccuacaaaugugaaaaauguggcaaaccuuuuaacc

SEQ ID NO: 250128 - RNA, 64 nt, hsa
cauuagauaauucaugcuggagagaaacccuacaaaugugaaaaauguggcaaagcuuuuaacc

SEQ ID NO: 250129 - RNA, 64 nt, hsa
cauaagauaacucauacuggagaaaaaucuuacaaaugugaagaauguggcaaagccuuuaucc

SEQ ID NO: 250130 - RNA, 64 nt, hsa
aacaaaauaauucauacaggagagaaacccuacaaaugugaagaaugugacaaagccuuuaacc

SEQ ID NO: 250131 - RNA, 64 nt, hsa
cuaaacauaauucauaauggagaaaaacccuacaaaugugaagaaugugucaaagcuuuuaacu

SEQ ID NO: 250132 - RNA, 64 nt, hsa
aacauaagggaauucauaauagagaaacccuacaaaugugaagaacguggccuggcuuuuaaca

SEQ ID NO: 250133 - RNA, 64 nt, hsa
uuuaaagaaaaucauucugcugaaaaauccuagaaaugugaagaaugugaaaaagccuuuaaau

SEQ ID NO: 250134 - RNA, 64 nt, hsa
aaucauucugcugaaaaauccuagaaaugugaagaaugugaaaaagccuuuaaaugauugucac

SEQ ID NO: 250135 - RNA, 64 nt, hsa
uauaaaagaaaucauaugaaugagaaauccuagaaaugugaagaaugugacaaagccuuuaaau

SEQ ID NO: 250136 - RNA, 64 nt, hsa
cauaagggaauuuauacaggagggaaacccuacaaaugugaagaauguggcaagccuuuuagcu

SEQ ID NO: 250137 - RNA, 64 nt, hsa
auaaaagaauucauacuggaggaaaagcccuacaaaugugaaaaacguggcaaagcuuuucauu

SEQ ID NO: 250138 - RNA, 51 nt, hsa
auacuggagagaaucccuaaaaaugugaagaaugugguaaauccuucagcu

SEQ ID NO: 250139 - RNA, 64 nt, hsa
guguauccuguuagcuccauucucagggcguuugaaugugaauuaggaccagcgcaaugaaugc

SEQ ID NO: 250140 - RNA, 64 nt, hsa
uuguauucucaguaguuccgauauguacccucgaaaugugaauguuaucuuaugagacucuguu

SEQ ID NO: 250141 - RNA, 64 nt, hsa
aggauggggccuggaaaggcaacuuuuccugauuaaugugaaaaauaauuccuauggacacucc

SEQ ID NO: 250142 - RNA, 64 nt, hsa
ggaaaauauuuccugacuugaguguuccuuuuuaaaugugaauuuuuauuucuuuuuaauuauu

SEQ ID NO: 250143 - RNA, 64 nt, hsa
aaaaaauggaaaaaaacauaaaaagcagaauuuuaaugugaagacauuuuuugcuauaaucauu

SEQ ID NO: 250144 - RNA, 64 nt, hsa
uucguguccuccuuauuuaaaaagguauacuuacaaugugaaguaacuuaugaauaaaaggaaa

SEQ ID NO: 250145 - RNA, 64 nt, hsa
uauucuugagaaaaagauaaaggguuauaauuugaaugugaacugauccagaaauaagugcugu

SEQ ID NO: 250146 - RNA, 64 nt, hsa
caaauaagaugguguguauguaagaaauuuguaaaaugugaagagcuaucuacacuaaguucgu

SEQ ID NO: 250147 - RNA, 64 nt, hsa
aggggggacuaugagaucaaaauauuuuuauuauaaugugaagacauugucuuuucacucuauc

SEQ ID NO: 250148 - RNA, 64 nt, hsa
uucagaaaugacuuggccucauuuuggauuucauaaugugaaguauucaugauuuugaacuggu

SEQ ID NO: 250149 - RNA, 64 nt, hsa
uaccauggcaguaauggggcaaacaauaaaaugcaaugugaaaugauuugaugauuugggaaau

SEQ ID NO: 250150 - RNA, 64 nt, hsa
guuuuuuacaucuacguuguugcuuucuaaaaugaaugugaaugccaucuuuuaugacugcaac

SEQ ID NO: 250151 - RNA, 64 nt, hsa
gguuuagccuucuaauuaguucacuugaaacauaaaugugaaaugucuucauucaauguuaaac

SEQ ID NO: 250152 - RNA, 64 nt, hsa; identical to SEQ ID NO: 216924

SEQ ID NO: 250153 - RNA, 64 nt, hsa; identical to SEQ ID NO: 216925

SEQ ID NO: 250154 - RNA, 64 nt, hsa; identical to SEQ ID NO: 22092

SEQ ID NO: 250155 - RNA, 64 nt, hsa; identical to SEQ ID NO: 22093

SEQ ID NO: 250156 - RNA, 64 nt, hsa; identical to SEQ ID NO: 22094

SEQ ID NO: 250157 - RNA, 64 nt, hsa; identical to SEQ ID NO: 22095

SEQ ID NO: 250158 - RNA, 64 nt, hsa; identical to SEQ ID NO: 22096

SEQ ID NO: 250159 - RNA, 64 nt, hsa; identical to SEQ ID NO: 22097

SEQ ID NO: 250160 - RNA, 64 nt, hsa; identical to SEQ ID NO: 22098

SEQ ID NO: 250161 - RNA, 64 nt, hsa; identical to SEQ ID NO: 22099

SEQ ID NO: 250162 - RNA, 64 nt, hsa; identical to SEQ ID NO: 22100

SEQ ID NO: 250163 - RNA, 64 nt, hsa; identical to SEQ ID NO: 22101

SEQ ID NO: 250164 - RNA, 64 nt, hsa; identical to SEQ ID NO: 22102

SEQ ID NO: 250165 - RNA, 64 nt, hsa; identical to SEQ ID NO: 22103

SEQ ID NO: 250166 - RNA, 64 nt, hsa; identical to SEQ ID NO: 22104

SEQ ID NO: 250167 - RNA, 64 nt, hsa; identical to SEQ ID NO: 22105

SEQ ID NO: 250168 - RNA, 64 nt, hsa; identical to SEQ ID NO: 22106

SEQ ID NO: 250169 - RNA, 64 nt, hsa; identical to SEQ ID NO: 22107

SEQ ID NO: 250170 - RNA, 64 nt, hsa; identical to SEQ ID NO: 22108

SEQ ID NO: 250171 - RNA, 64 nt, hsa; identical to SEQ ID NO: 22109

SEQ ID NO: 250172 - RNA, 64 nt, hsa; identical to SEQ ID NO: 22110

SEQ ID NO: 250173 - RNA, 64 nt, hsa; identical to SEQ ID NO: 22111

SEQ ID NO: 250174 - RNA, 64 nt, hsa; identical to SEQ ID NO: 22112

SEQ ID NO: 250175 - RNA, 64 nt, hsa; identical to SEQ ID NO: 22113

SEQ ID NO: 250176 - RNA, 64 nt, hsa; identical to SEQ ID NO: 132737

SEQ ID NO: 250177 - RNA, 64 nt, hsa; identical to SEQ ID NO: 132738

SEQ ID NO: 250178 - RNA, 64 nt, hsa; identical to SEQ ID NO: 132739

SEQ ID NO: 250179 - RNA, 64 nt, hsa; identical to SEQ ID NO: 132740

SEQ ID NO: 250180 - RNA, 64 nt, hsa; identical to SEQ ID NO: 132741

SEQ ID NO: 250181 - RNA, 64 nt, hsa; identical to SEQ ID NO: 132742

SEQ ID NO: 250182 - RNA, 64 nt, hsa; identical to SEQ ID NO: 132743

SEQ ID NO: 250183 - RNA, 64 nt, hsa; identical to SEQ ID NO: 132744

SEQ ID NO: 250184 - RNA, 64 nt, hsa; identical to SEQ ID NO: 132745

SEQ ID NO: 250185 - RNA, 64 nt, hsa; identical to SEQ ID NO: 132746

SEQ ID NO: 250186 - RNA, 64 nt, hsa; identical to SEQ ID NO: 132747

SEQ ID NO: 250187 - RNA, 64 nt, hsa; identical to SEQ ID NO: 132748

SEQ ID NO: 250188 - RNA, 64 nt, hsa; identical to SEQ ID NO: 132749

SEQ ID NO: 250189 - RNA, 64 nt, hsa; identical to SEQ ID NO: 132750

SEQ ID NO: 250190 - RNA, 64 nt, hsa; identical to SEQ ID NO: 132751

SEQ ID NO: 250191 - RNA, 64 nt, hsa; identical to SEQ ID NO: 132752

SEQ ID NO: 250192 - RNA, 64 nt, hsa; identical to SEQ ID NO: 132753

SEQ ID NO: 250193 - RNA, 64 nt, hsa; identical to SEQ ID NO: 132754

SEQ ID NO: 250194 - RNA, 64 nt, hsa; identical to SEQ ID NO: 132755

SEQ ID NO: 250195 - RNA, 64 nt, hsa; identical to SEQ ID NO: 132756

SEQ ID NO: 250196 - RNA, 64 nt, hsa; identical to SEQ ID NO: 132757

SEQ ID NO: 250197 - RNA, 64 nt, hsa; identical to SEQ ID NO: 132758

SEQ ID NO: 250198 - RNA, 64 nt, hsa; identical to SEQ ID NO: 132759

SEQ ID NO: 250199 - RNA, 64 nt, hsa; identical to SEQ ID NO: 132760

SEQ ID NO: 250200 - RNA, 64 nt, hsa; identical to SEQ ID NO: 132761

SEQ ID NO: 250201 - RNA, 64 nt, hsa; identical to SEQ ID NO: 132762

SEQ ID NO: 250202 - RNA, 65 nt, hsa
guugugugucgugugggaguggggcgauuuuuuaugugccaaauacccccgucccccccaugaau

SEQ ID NO: 250203 - RNA, 65 nt, hsa
ccuuaaguguauuccugacaguuaaauucagaaacgugccaaauggaacucaaggugccccuuca

SEQ ID NO: 250204 - RNA, 65 nt, hsa
aaaucaaaucccccgacauacguuuuuuuuaaucugugccaaaaauguguuuucagaggaaaucu

SEQ ID NO: 250205 - RNA, 65 nt, hsa
aauuuugccaauugcuggaccaauggcaaacauuagugccaaauguauaauacuauauguuagca

SEQ ID NO: 250206 - RNA, 65 nt, hsa
uagaauuuauguaaacuaguaaccaguugaucucugugccaaauacauuauaucaggauuacaca

SEQ ID NO: 250207 - RNA, 65 nt, hsa
uacauaaauauugauauauucuuuuucuacucaaagugccaaaggcuacaguuuuuaaugacuua

SEQ ID NO: 250208 - RNA, 65 nt, hsa
guauuaacagugcaugcuuuuacuuuguaaauguggugccaaaucccuguuugccaucguuuuua

SEQ ID NO: 250209 - RNA, 65 nt, hsa
ccucuuccuucuaagcaaaaggaaauaaacauccugugccaaagguauuggucauuuagaauguc

SEQ ID NO: 250210 - RNA, 65 nt, hsa
ugcuaugguguugaaaacugcaguguccguuaugagugccaaaaaucugucuugaaggcagcuac

SEQ ID NO: 250211 - RNA, 65 nt, hsa
cuauucaaucuuagggugucuauccacgucuggcugugccaaauggucuggcagcugguuuuggc

SEQ ID NO: 250212 - RNA, 65 nt, hsa
ucucugggacccuggaauccuagguacccacaugugugccaaagccuaccccaccuggcaggugu

SEQ ID NO: 250213 - RNA, 65 nt, hsa
caugucucacuuggaaagcuaguacuuuuaaaugggugccaaaggucaacuguaaugagauaauu

SEQ ID NO: 250214 - RNA, 59 nt, hsa
gagagauggugcuggaguaaauaucauuagugccaaagggauucuucuccaaaacuuua

SEQ ID NO: 250215 - RNA, 65 nt, hsa
guccuuugcggugagcuauguuuacaugacacagugugccaaagugacuuacugcgguugcguua

SEQ ID NO: 250216 - RNA, 65 nt, hsa
cuugccucaaugccaguaacgcgucuuccugaguggugccaaacaaaaagguucucagguguugc

SEQ ID NO: 250217 - RNA, 65 nt, hsa
uguuggagcccuggauucuggugcuauagcuccuggugccaaagucuggaucuuuccacauuuca

SEQ ID NO: 250218 - RNA, 61 nt, hsa
ucaaauauuuggagagcuaacaccaucaaaggugccaaaaucuacauugagacugcuuuga

SEQ ID NO: 250219 - RNA, 65 nt, hsa
uaaauugucacuucuauucuuuacagaaccuuguagugccaaaaacuuuuuaaaagguaaaaaaa

SEQ ID NO: 250220 - RNA, 65 nt, hsa
gggcagccacggaguggggaggccccagaugcgcugugccaaagccagguccgaggccaaaguuc

SEQ ID NO: 250221 - RNA, 65 nt, hsa
uuuugaggcauaggguagcuuacguaguggaggaugugccaaauauucucuucaaaugccaccuu

SEQ ID NO: 250222 - RNA, 65 nt, hsa
uaagguauuucuaaauaaacacauuauguaaggaagugccaaaauaguuaucaaugugagacucu

SEQ ID NO: 250223 - RNA, 65 nt, hsa
agcuaaauggucuuagaagcauagaaaaucccuaugugccaaaaguagugaaacacaaacaaagg

SEQ ID NO: 250224 - RNA, 65 nt, hsa
ccucauuccagccaauguaugguuauccacucugugugccaaaaccaaucaugccuuucacggcc

SEQ ID NO: 250225 - RNA, 65 nt, hsa
aaugaaaaauauaauguugauaauauauauuaagugugccaaaucaguuugacuacucucuguuu

SEQ ID NO: 250226 - RNA, 65 nt, hsa
ucaguuuuguguguuuuuuuuuuuuuuuauuugaagugccaaauuaacuuuagucagaaugugag

SEQ ID NO: 250227 - RNA, 55 nt, hsa
uucuuuccacagcuuuguaagccuugugccaaaagaaacuuuuaaaacagcuaca

SEQ ID NO: 250228 - RNA, 65 nt, hsa
ugucuuuuugagagcucaucauucauuuauagauggugccaaagcuaaccuuacauuucuuagaa

SEQ ID NO: 250229 - RNA, 65 nt, hsa
gccucuccaguccugcuuacuccucuauuuuuaaagugccaaacaaauccccuuccucuuucuca

SEQ ID NO: 250230 - RNA, 65 nt, hsa
ucaugucaacuuuccagaugauuuguaacuucucugugccaaaccuuuuauaaacauaaauuuuu

SEQ ID NO: 250231 - RNA, 65 nt, hsa
gaaccuagauauuuuguguucaauuguuagaaaaggugccaaacagauuaugaaauuugugccua

SEQ ID NO: 250232 - RNA, 65 nt, hsa
auguuaucugggauucaccgugcccagcacccgaagugccaaauuccaggaggacaagagccuua

SEQ ID NO: 250233 - RNA, 65 nt, hsa
aaguuuauuuucuuuuuucguuuuauaaauucagugugccaaaugaaacuuuuuuccuaaguaac

SEQ ID NO: 250234 - RNA, 65 nt, hsa
ccauucauuaguguuauuucauuguaaacguuauugugccaaauguacuguauucaaaaggaugu

SEQ ID NO: 250235 - RNA, 65 nt, hsa
cuugguguuugcucucccuugacccaccccagugagugccaaagggcagccccaacaugugcacc

SEQ ID NO: 250236 - RNA, 65 nt, hsa
ucauguuucagcgcaugcgccccagccuuucccaugugccaaaccagaagcuccacugcccguag

SEQ ID NO: 250237 - RNA, 65 nt, hsa
agaaugcaauuugaaaacuacaggcuuaggacucugugccaaaaaucucuauuuuaaaugaaaau

SEQ ID NO: 250238 - RNA, 65 nt, hsa
uuccccauuuuucagaagcgacauuucauauauaggugccaaaagugaaucggggugcggagagu

SEQ ID NO: 250239 - RNA, 65 nt, hsa
guauggaguuauuuauuugcuacauaauagauacugugccaaauaauuacuuuuuauuuauuuua

SEQ ID NO: 250240 - RNA, 65 nt, hsa
gcacagggccccgcugggccuccucaccaacggcagugccaaaaucagcccccacaucaaggugg

SEQ ID NO: 250241 - RNA, 65 nt, hsa
uaaagauaggucagaaguauuuuaaagggcuuaaugugccaaaaagaaaaaaagcuagagacccu

SEQ ID NO: 250242 - RNA, 65 nt, hsa
cacccagccagcccuucaggugccuucuacucccagugccaaagccagaccacugggguuuccug

SEQ ID NO: 250243 - RNA, 65 nt, hsa
uuaaagcaaguguuuuguacauuucuuuucaaaaagugccaaauuugucaguauugcauguaaau

SEQ ID NO: 250244 - RNA, 65 nt, hsa
ugauugugucaaugugaaaguuaaauaaaauuuaugugccaaaccugacaugagcugcgguucug

SEQ ID NO: 250245 - RNA, 65 nt, hsa
ccaaggagccaacgagggcucuggagcugugaguggugccaaaagacugccaagaaucaaggcuu

SEQ ID NO: 250246 - RNA, 65 nt, hsa
ugcaccuccaagauaacaaagaagaagcaauggucgugccaaagagguccacaaccaggugugca

SEQ ID NO: 250247 - RNA, 65 nt, hsa
agaaugacuuuucagacuuaccaaauguauugauagugccaaaaaaaaaaucucagaaaucuuaa

SEQ ID NO: 250248 - RNA, 65 nt, hsa
auaauuauggugggugauuauuuuuuauacuguaugugccaaagcuuuacuacuguggaaagaca

SEQ ID NO: 250249 - RNA, 65 nt, hsa
uagaagccccauucaauaucacuacucuuuaacgagugccaaaucuuuucccacuuuugcucuuc

SEQ ID NO: 250250 - RNA, 65 nt, hsa
guaauuagaauuguuggcaugaugacauuucauuugugccaaaaauauuaaaaaugccuuuuuug

SEQ ID NO: 250251 - RNA, 65 nt, hsa
uguacuccaggcgaggccucuggaccuguguuccugugccaaaguccugucaggcuggugggcac

SEQ ID NO: 250252 - RNA, 65 nt, hsa
cuguguggcaucugaacuuuuauaaagguuuccuugugccaaauaagugcaaagauuuaauuuac

SEQ ID NO: 250253 - RNA, 65 nt, hsa
augauauauaggaucaugauauuccuucuauccaugugccaaauggguguaauguuuauuuacug

SEQ ID NO: 250254 - RNA, 65 nt, hsa
gccuugaugauuuaauauggauuuguuacagccaagugccaaaugcucucucaaauugucagcaa

SEQ ID NO: 250255 - RNA, 65 nt, hsa
ccagggccuccuugcccagcccaguccaggcugcugugccaaaucccaaccagccacgccucagc

SEQ ID NO: 250256 - RNA, 65 nt, hsa
guuuuguuuuucagcguuaauguaaaggggcagcagugccaaaauauaaucagagauaaagcuua

SEQ ID NO: 250257 - RNA, 65 nt, hsa
uauuguuguuguuuuuuaaccgaguuuucccaucagugccaaaacucaacucaaucugaaaguag

SEQ ID NO: 250258 - RNA, 65 nt, hsa
ccaagagacaggcccagagccuaaaggcaaggacagugccaaaagguucugugagcccaucgggg

SEQ ID NO: 250259 - RNA, 65 nt, hsa
ggauauuaguguucagcagcuuauuauuuaaaggggugccaaauauagcauccuucuguuguuua

SEQ ID NO: 250260 - RNA, 65 nt, hsa
gcaacccugauagaguaaauaaauuuuaugggcgggugccaaauacugcugugaaucuauuugua

SEQ ID NO: 250261 - RNA, 65 nt, hsa
gaugcauccuguuuugugcaauucucuaaaagaaggugccaaagcuuuuugauugcugcagguaa

SEQ ID NO: 250262 - RNA, 65 nt, hsa
ugcauuuucaccugagguuucccugcaucccugcagugccaaagccccaccuucagggaccaccu

SEQ ID NO: 250263 - RNA, 65 nt, hsa
aguaauucuguauuucuacuaagauaaucugcuuugugccaaaacaguaauuuccaaacuucugu

SEQ ID NO: 250264 - RNA, 65 nt, hsa
cugguccucccauuucuaaagcugaaugucaaacagugccaaaugcuggggcagggggugaagaa

SEQ ID NO: 250265 - RNA, 65 nt, hsa
cccagugggaugggacagggaggccacacgcacuggugccaaaaccaggccucugcugccgcccu

SEQ ID NO: 250266 - RNA, 65 nt, hsa
aagccaggucuucucucuucauuccucuuaggagagugccaaacucagggacccagcacugggcu

SEQ ID NO: 250267 - RNA, 65 nt, hsa
guccgaccaagagcgaaggaauguuuguuuguacugugccaaacuguuccucagauccaauuguu

SEQ ID NO: 250268 - RNA, 65 nt, hsa
agccacaucuuaccuguaaagucuuacuugugauugugccaaacaaaaaaugugccagaaagaaa

SEQ ID NO: 250269 - RNA, 65 nt, hsa
agguuguaaugcacaggcaacugugagaaacuguugugccaaaaauagaauuccuucuaguuuuu

SEQ ID NO: 250270 - RNA, 65 nt, hsa
ccucaaaacaagcccuucccaacauaagcgcuuuugugccaaacccauaggucugaaacugagac

SEQ ID NO: 250271 - RNA, 65 nt, hsa
ugccuaaaaauauugcagugacuuuuuaggcaggagugccaaaggacacuaugaacuuuuugaac

SEQ ID NO: 250272 - RNA, 65 nt, hsa
uaaagguuaaacuugaaaagaaauucuuaaucacggugccaaaauucauuuucuaacaccaugug

SEQ ID NO: 250273 - RNA, 65 nt, hsa
ccuuggaagagagcauuugugguacaauaugcuaugugccaaaugagugauaagauuuaagcuua

SEQ ID NO: 250274 - RNA, 55 nt, hsa
agagccguucaaaagacuaaacagugugccaaacaccagcuaaaccaagagagaa

SEQ ID NO: 250275 - RNA, 65 nt, hsa
gcuacccaucugccagaucaccaaucuagaucuuugugccaaacaaaaugagaucucauuaaaag

SEQ ID NO: 250276 - RNA, 65 nt, hsa
uaagcuguggaaaaugacucaagagcaauaaaucagugccaaagcuucccugcgcaucugaauag

SEQ ID NO: 250277 - RNA, 65 nt, hsa
uuuauacagaaacucuuccugugugagcuguuaaggugccaaauuggcugucauuuguauucaug

SEQ ID NO: 250278 - RNA, 65 nt, hsa
ucagaaaucuaauaggaaaacaugauacuuucaaugugccaaaacuaaaccuuaguauacaacua

SEQ ID NO: 250279 - RNA, 65 nt, hsa
gauuuaaucuaaucuaauaauugugccccgcaguugugccaaagugcauagucugaguaaaaucu

SEQ ID NO: 250280 - RNA, 65 nt, hsa
uaaaaucauaccuacccugaaaaaugcuuaaaguagugccaaaaaucuugaaaucucucucucuc

SEQ ID NO: 250281 - RNA, 65 nt, hsa
cuuacaauacagaacaacuguuaagauggaaaacagugccaaaccuccacagcucauuucuuugu

SEQ ID NO: 250282 - RNA, 65 nt, hsa
uuuuugacugaaaguacuaaaagucagcuuuacuagugccaaaccuuuaaauuuucaaaagaaaa

SEQ ID NO: 250283 - RNA, 65 nt, hsa
ggaaaucucauuuucuuucuguaauucauucaguggugccaaagcuggggguucccuacaauggc

SEQ ID NO: 250284 - RNA, 65 nt, hsa
caauauuuaguauuaacuauauaugauuuagcacugugccaaacacauuuucaagaguacauuuu

SEQ ID NO: 250285 - RNA, 65 nt, hsa
caagaaauauuaacauuggugacaucaguauaaaagugccaaaccugcccucuuuuaaauaaaaa

SEQ ID NO: 250286 - RNA, 65 nt, hsa
ggccuuaccagcccuagccucuagcacuucucuaagugccaaaaacagugucauuguguguguuc

SEQ ID NO: 250287 - RNA, 65 nt, hsa
ugccuaagaugcgccuccacugucaccuguaccaagugccaaaacagcagaggggccaguuagag

SEQ ID NO: 250288 - RNA, 65 nt, hsa
ggcucgggcuccccagccccaucccaaacccuucagugccaaaaacaacaacaaaaugaaacgca

SEQ ID NO: 250289 - RNA, 65 nt, hsa
uaaauagagaauauacuuccacugaugcccuuacugugccaaaacaaaaaucuuaagaaaagcaa

SEQ ID NO: 250290 - RNA, 65 nt, hsa
gcgcugggucuggggccucuguaugcccuaggccugugccaaaguggccagagauugggcugccu

SEQ ID NO: 250291 - RNA, 65 nt, hsa
gaacguccguccucaggagcacagccucacggacagugccaaacccugugggucuccaggggcuu

SEQ ID NO: 250292 - RNA, 65 nt, hsa
ccauaauugcuuugccaaaauaccagagccuucaagugccaaacagaguauguccgaugguaucu

SEQ ID NO: 250293 - RNA, 65 nt, hsa
aauucuugcaacaugcauucuugauuaccuacugugugccaaacaagauuuuguagaauauugca

SEQ ID NO: 250294 - RNA, 65 nt, hsa
uuaagaaacagcauucuucuucagugaaauuuugggugccaaacaccuacccagaauguccaggg

SEQ ID NO: 250295 - RNA, 65 nt, hsa
ggguggagaggaggcaggggccgagggggugcuuggugccaaacugaaauucaguuucuugugug

SEQ ID NO: 250296 - RNA, 65 nt, hsa
gugcucucacaaaccccugacucccgcacuuuccagugccaaaguacaaacgcugcuuggauaag

SEQ ID NO: 250297 - RNA, 65 nt, hsa
uucagugauuucuugcuauugaccgaugcuucacugugccaaaagagaaaaaaaauguuggguuu

SEQ ID NO: 250298 - RNA, 65 nt, hsa
gagucauuuuccccagacacuacauuuggauacaggugccaaagaacauuauuaaggaauuauuu

SEQ ID NO: 250299 - RNA, 65 nt, hsa
gaccaaucgcaugguucuccuggcaggccugcugugugccaaaaacucccacccaaggucccuca

SEQ ID NO: 250300 - RNA, 65 nt, hsa
cuuucucuuucccauauuccuuuucuuuuucucuugugccaaacugacagaaaccgucaccacac

SEQ ID NO: 250301 - RNA, 65 nt, hsa
acuuagucagucaacacuuauugagcaccuacuaagugccaaacacucuccuggacucuggcaaa

SEQ ID NO: 250302 - RNA, 65 nt, hsa
uaccucuaggcauguuucaucccaacaaucagacugugccaaagcaggggacuuuguccuuugug

SEQ ID NO: 250303 - RNA, 65 nt, hsa
aucuuaucaauacauaagaaauuuaggaagauuaggugccaaaauacccagcacaauacuuguau

SEQ ID NO: 250304 - RNA, 65 nt, hsa
uggacagugugacuaucuuaugucaggaccuucaugugccaaacgucagugguguuuucauaugg

SEQ ID NO: 250305 - RNA, 65 nt, hsa
aguaacaagguuugggacaaugucuaaggguuaaagugccaaagccauuucuguacuaacuguuc

SEQ ID NO: 250306 - RNA, 65 nt, hsa
ggaugcugcccaagaccggcugcgugauccagccugugccaaaacccgcggagaaggcugccaug

SEQ ID NO: 250307 - RNA, 65 nt, hsa
guaugaugauaauuguauaauaauuauacaugaaagugccaaaacccuacaauuaaacacuguau

SEQ ID NO: 250308 - RNA, 65 nt, hsa
auaacugaguaaugcauaugaaauggaacuuuugggugccaaaugggacuuuuagauuaaaaaaa

SEQ ID NO: 250309 - RNA, 65 nt, hsa
acaaaggccuuucuuuagaucugugcagccuuugcgugccaaacuugugaaauuccuuuuaccuu

SEQ ID NO: 250310 - RNA, 65 nt, hsa
gucugccacuugcucccugccaacuuucuggagaggugccaaacuugguguggccaggaaagggc

SEQ ID NO: 250311 - RNA, 65 nt, hsa
uuuugcaaaaugagcuuggguuuaaaaagugcuuugugccaaaaauaucauaccuaauuuuuaua

SEQ ID NO: 250312 - RNA, 65 nt, hsa
guaauuuuaauuuagugaacagaauugagaagaacgugccaaaugagaaucaauuagguggauuu

SEQ ID NO: 250313 - RNA, 65 nt, hsa
cgcucacccgccacccagugcuggccgccuucuuggugccaaacccccuucccccacccagagac

SEQ ID NO: 250314 - RNA, 65 nt, hsa
agucucacaguuugcuugucuauuuauuuuauuuagugccaaauguauuccauuuuaaaaguaag

SEQ ID NO: 250315 - RNA, 65 nt, hsa
uuuguauucacuuucuuuaaaaaauccaaguaaaagugccaaaacuacacuucuguaaaucucuu

SEQ ID NO: 250316 - RNA, 65 nt, hsa
caauggagacuuucugaugcaucguuuucuuugcugugccaaagcaggucagaagagggagagga

SEQ ID NO: 250317 - RNA, 65 nt, hsa
uagcuauggcauuaaaaggccucucuucucaucuggugccaaagguuccguugcagcuuuuuaca

SEQ ID NO: 250318 - RNA, 65 nt, hsa
cugaagggcagggguuggcaacuuuucaacauggagugccaaacugcuaacccgucuucuagugu

SEQ ID NO: 250319 - RNA, 65 nt, hsa
cuuuccucuaguaaccaccacauggcucagcaucugugccaaacauaggcgcuccuagucugguc

SEQ ID NO: 250320 - RNA, 65 nt, hsa
ccacucccacugccaggauuuuguauugccaucgggugccaaauaaaugcucauauuuauuacug

SEQ ID NO: 250321 - RNA, 65 nt, hsa
gaaaccaaacgguggauaaaguauuaaguaacuaagugccaaauaaaugcuggaaaucuugaccu

SEQ ID NO: 250322 - RNA, 50 nt, hsa
agcucaguuugccagcauaagugccaaagaccaucaccagcaucuguccu

SEQ ID NO: 250323 - RNA, 65 nt, hsa
auaauuugacaagcuuaaaaauggccuucaugugagugccaaauuuuguuuucuucauuuaaaua

SEQ ID NO: 250324 - RNA, 65 nt, hsa
uccuauugaugcaccaaaccaagugccucauuucugugccaaauguuugccuuggucguugugga

SEQ ID NO: 250325 - RNA, 65 nt, hsa
cagccagcuuuucagagggaaaagaaguuagaacagugccaaagaaccugggccuaucagcgugu

SEQ ID NO: 250326 - RNA, 65 nt, hsa
aaaaauacaaaaaaaaagcaccaugaauuuguacugugccaaaaugauaguggcaauaauauuuu

SEQ ID NO: 250327 - RNA, 65 nt, hsa
uggaggugggacaagcaggcuuguuuccaccaauagugccaaaaagauauugccuaaugugcacc

SEQ ID NO: 250328 - RNA, 65 nt, hsa
uggaaugagcucuguuagggacaguugucugguuugugccaaaccuucgaggggcgaguagggag

SEQ ID NO: 250329 - RNA, 65 nt, hsa
agaguucaugcccaaguccccagguuggaauggcugugccaaaauccauucaaaggguuuucuuu

SEQ ID NO: 250330 - RNA, 65 nt, hsa
caauaugcuggggaaaggggagggagggaaugaaagugccaaagaaaacauguuuuuaagaacuc

SEQ ID NO: 250331 - RNA, 65 nt, hsa
guuuuuauuuuguaguccuuucaguuauuuuuaaugugccaaaaauuuguacauguucaauuaaa

SEQ ID NO: 250332 - RNA, 65 nt, hsa
guacagaguacaucaacuauuuucagcccaaaaaggugccaaaugcauauaaaucuugauaaaca

SEQ ID NO: 250333 - RNA, 65 nt, hsa
uuuugucacugcuguaaagcaaaauauuugugaaagugccaaaauaaagucugucaugccaaaag

SEQ ID NO: 250334 - RNA, 65 nt, hsa
acaugccugggauugggaaagauaggacuaaaguugugccaaacuauaucaauaaauuccauguu

SEQ ID NO: 250335 - RNA, 65 nt, hsa
uuuaaccuaccuguagagauccucgucauggaaaggugccaaacuguuuugaauggaaggacaag

SEQ ID NO: 250336 - RNA, 65 nt, hsa
cgcaccucccagaggaccggugggaauuguucauagugccaaaguccuacuacugcguuuucaau

SEQ ID NO: 250337 - RNA, 65 nt, hsa
uuuaauagauguaaugaucauauggugcgucaccugugccaaauauucuucaaugaaauuauaua

SEQ ID NO: 250338 - RNA, 65 nt, hsa
uuuauugccuuuugagauucuccaacuugacaaaugugccaaagaucaacagacagaaaauauca

SEQ ID NO: 250339 - RNA, 65 nt, hsa
auaacuguuuauuuaccuaauuaaaaggaaaggcagugccaaauaugagaggauaaacaauauua

SEQ ID NO: 250340 - RNA, 65 nt, hsa
ggauccaauacccaaaagaaauggaacuuaauguugugccaaaguuaaacuacugcaguuggugg

SEQ ID NO: 250341 - RNA, 65 nt, hsa
uuuuaaucuuaguuucccuuuugauuuuucugaaggugccaaauuccauuuaacuuuuuuacaag

SEQ ID NO: 250342 - RNA, 65 nt, hsa
ugaaucacagccccagcuccuugacccccaucuaggugccaaauguucaucugcaaccgcuaugc

SEQ ID NO: 250343 - RNA, 65 nt, hsa
ccauucagauccggcuuggacaggcaccugagauggugccaaagugcagcugacucuucccacga

SEQ ID NO: 250344 - RNA, 65 nt, hsa
uuauaaugcaucuaaaccaccuguccccaguuaaugugccaaaaugucaauuuuuaacuuaucuc

SEQ ID NO: 250345 - RNA, 65 nt, hsa
aaaccugugcuuucauguuuaagaaaugagaaauugugccaaagauagcagaagaguagauaagu

SEQ ID NO: 250346 - RNA, 65 nt, hsa
gcucagggacuuagcaaaaugagaagaugugaccugugccaaaacuauuuugagaauuuuaaaug

SEQ ID NO: 250347 - RNA, 65 nt, hsa
aauuaauuaguaugguauaaucuuuaauaaauuucgugccaaaaugcaugguuuuccacuuagca

SEQ ID NO: 250348 - RNA, 65 nt, hsa
ccugaagugacccauucuaugaauuguuaauuaaggugccaaaaaaaauuaauaauaaagcuugg

SEQ ID NO: 250349 - RNA, 65 nt, hsa
acaagggaggcaguggcuaguggggugaacagcuggugccaaauagccccagacugggcccaggc

SEQ ID NO: 250350 - RNA, 65 nt, hsa
ugucuuccauggcauauuuacucuuacuuuacuucgugccaaaucaaaugaaacaagccgucuua

SEQ ID NO: 250351 - RNA, 65 nt, hsa
uuauuucuacugauuuuauuuuggauacuaaggaugugccaaaugauucggauacuaagaugcau

SEQ ID NO: 250352 - RNA, 65 nt, hsa
gagaggaggaaagcaggcauuugauuuugguaauugugccaaagcuauguaagagaauaaaugcc

SEQ ID NO: 250353 - RNA, 65 nt, hsa
agcucaaacccuguaaguuacagucacaauuuucugugccaaagcagcuacaauaauagagagga

SEQ ID NO: 250354 - RNA, 65 nt, hsa
cuggcuccaaacucccgaaaggaacuauuuuacaggugccaaaaaggggacaguguugauaauaa

SEQ ID NO: 250355 - RNA, 65 nt, hsa
acacacagauaauaggaacaaaauguaguucccaugugccaaacaaaauaaaugaaaucucugca

SEQ ID NO: 250356 - RNA, 65 nt, hsa
uuccaaauuggaauuguuuuguuacucugguuguugugccaaauugugguacacuuagaaaauuc

SEQ ID NO: 250357 - RNA, 65 nt, hsa
gauucuguaccaaaaaggaguacuauaaaaugagggugccaaauauauugagucuuuuaugggau

SEQ ID NO: 250358 - RNA, 65 nt, hsa
gugacuauggcuuuucauucuucaauucaugacgagugccaaacuugauuuucucuaggcacagc

SEQ ID NO: 250359 - RNA, 65 nt, hsa
augcccuguggucacugcgguugccgccccuaauugugccaaaggcugacccggcccgggcugcg

SEQ ID NO: 250360 - RNA, 65 nt, hsa
gcacagcagagacagacuggugguugaaccuggaggugccaaaaaagccagcugcgggcccagga

SEQ ID NO: 250361 - RNA, 65 nt, hsa
ucauaaauucuguaguaaaguaucaucuuggcagugugccaaaggugaaaaugaugcuuucucua

SEQ ID NO: 250362 - RNA, 65 nt, hsa
guccaaaugacccuuuucaggaugucucaaagcuugugccaaaggucacuuuucuuuccugccuu

SEQ ID NO: 250363 - RNA, 65 nt, hsa
uuuuuucuuuuaaagaaaaaaagugaaaauauauagugccaaauuccaaagguacuuccuuccua

SEQ ID NO: 250364 - RNA, 65 nt, hsa
gcuaaaugcaaacacuguguauuuauuaguuaggugugccaaacuaccguucccaaauugguguu

SEQ ID NO: 250365 - RNA, 65 nt, hsa
ccugcaucugucuguccuuccuuccauugcucccagugccaaacuugggccgcugcaccgcggcg

SEQ ID NO: 250366 - RNA, 65 nt, hsa
uuaaguaucgaagcuuaauaaauuauuguguccuggugccaaagggggccagccagaacugaggu

SEQ ID NO: 250367 - RNA, 65 nt, hsa
cccauuacagucuccaccuccccgucuuccucugggugccaaaugaugggaagaugagcuucauc

SEQ ID NO: 250368 - RNA, 65 nt, hsa
cugccaguguucgcccuagaguuauuacaaagccagugccaaaacccagccaugggcucuuugca

SEQ ID NO: 250369 - RNA, 65 nt, hsa
ucaaacauguaauaaacuuuggauaauuaaauaaugugccaaauuuaaguuguaccacaauauuc

SEQ ID NO: 250370 - RNA, 65 nt, hsa
gaguucuuaagcgcuccccuggcaaacaaauugaagugccaaacagcacucgcugcaggguauuu

SEQ ID NO: 250371 - RNA, 65 nt, hsa
uacuccgccuuuguccuuaagguuuuugcaggccagugccaaacacacacuaacuguccuggccu

SEQ ID NO: 250372 - RNA, 65 nt, hsa
caaaaaagaaaaaaaguaccccauguucagccccugugccaaauuugccuagguuuuccagcuga

SEQ ID NO: 250373 - RNA, 65 nt, hsa
agagucugagucuugcccaaacauucuuucuuuuugugccaaaugacuugcauuugcaaagagcu

SEQ ID NO: 250374 - RNA, 65 nt, hsa
uuuuucgggguuucugcaugcaguggcagucuuaagugccaaaauucauuauaaccccaaaauaa

SEQ ID NO: 250375 - RNA, 65 nt, hsa
accuuguaagagacaucauuacuaccagaacuguggugccaaauugcuggugucucucuuuggag

SEQ ID NO: 250376 - RNA, 65 nt, hsa
caaguguucuuuaaauaggaggcacccuucccauugugccaaaaucaucuuuucauuuauuuuga

SEQ ID NO: 250377 - RNA, 65 nt, hsa
gaaugccgcugcaggcaaguuccagguggacacaggugccaaauucuaccguggaaugucccugg

SEQ ID NO: 250378 - RNA, 65 nt, hsa
gaauaaaaaggcaaauuacuugugaucauucugaagugccaaaggagcccccccauuccugggcc

SEQ ID NO: 250379 - RNA, 65 nt, hsa
gucaggccugucagucucaugacaguuuguugguugugccaaacacuuuauuugggaaaggaaag

SEQ ID NO: 250380 - RNA, 65 nt, hsa
acuggaaugaccuccuucagauaucgugccucuuagugccaaacccacagugagaccaaaagugu

SEQ ID NO: 250381 - RNA, 65 nt, hsa
uguagacccuuucaugccagcaguggucauauugagugccaaagagaagagcuuacuggguaguu

SEQ ID NO: 250382 - RNA, 65 nt, hsa
uaaaaccagaauacacuaagaaguuucuaguuugugugccaaaacagaagcuucuccaagcauga

SEQ ID NO: 250383 - RNA, 65 nt, hsa
uacauauguaaaauauuguuacuagaguuagauaugugccaaaguccauuuaucccaaauccugu

SEQ ID NO: 250384 - RNA, 65 nt, hsa
auccgugggcuucuggggacagccauuuggcuggggugccaaacaccagaaggggagauaauagu

SEQ ID NO: 250385 - RNA, 65 nt, hsa
uaccuggagguuugacucuaauuuuugcacugauggugccaaagggcccugagucaaaaggauag

SEQ ID NO: 250386 - RNA, 65 nt, hsa
uaggggaaaacaagaggccaaauauaguaauggaggugccaaauaauuaugugcacuuugcacua

SEQ ID NO: 250387 - RNA, 65 nt, hsa
uuguuugggaaggagacaugccgggaugugucaucgugccaaauaccacauuuccuguuggcaca

SEQ ID NO: 250388 - RNA, 65 nt, hsa
uuccaauuuuccauuuguagaguuaaacuuugaaugugccaaacuuuuucguaacuuuugaaucu

SEQ ID NO: 250389 - RNA, 65 nt, hsa
gucagccuggauauucaugaaagcugaaagaaggggugccaaaaugccuagcuccuggauuuaga

SEQ ID NO: 250390 - RNA, 65 nt, hsa
ugauugaucucgggguccaucugugauauuucuuugugccaaaaagaaaaaaaaagaguggauca

SEQ ID NO: 250391 - RNA, 65 nt, hsa
gauccuccaugcaggaucuaggagagugacugggugugccaaaauaugcccaggguccugcccuc

SEQ ID NO: 250392 - RNA, 65 nt, hsa
agguugauuguaaacccacaguaucuagcagcguugugccaaauugcccuuguguuucucuccac

SEQ ID NO: 250393 - RNA, 65 nt, hsa
agcugcucccucccccagcgucaaauuguuaucaggugccaaacacugcuagaaaggagggccua

SEQ ID NO: 250394 - RNA, 65 nt, hsa
agagaagguucugagcugucccauacucccacuuugugccaaaugacuuugcaccugcaaauggu

SEQ ID NO: 250395 - RNA, 65 nt, hsa
uucugcuauguuuguucuucacuaugauuuacugugugccaaaggaguuuugacaggguacagag

SEQ ID NO: 250396 - RNA, 65 nt, hsa
uuuaugugcggucuccaauuuaggacuuuuccauagugccaaagccauacauauucaguagaaca

SEQ ID NO: 250397 - RNA, 62 nt, hsa
ugcaccaggauggugguuagcaacaguggcccgugccaaagcacuuaccaaagugaugauga

SEQ ID NO: 250398 - RNA, 65 nt, hsa
gcugggugaucuugaacaugcugcuuagcuucucugugccaaacuuacugauauccucaucugua

SEQ ID NO: 250399 - RNA, 65 nt, hsa
ccucugcaacuacaaauagcagagugagccaggcggugccaaagcaagggcuaguugagacauug

SEQ ID NO: 250400 - RNA, 65 nt, hsa
uuauucuggaauuuaagcuauucuuugucacuugggugccaaacaugagagcccagaaaacuguc

SEQ ID NO: 250401 - RNA, 65 nt, hsa
uuaucuauugcacaccacacuacaucuuugagcaagugccaaauuuguacugaaguguugaccaa

SEQ ID NO: 250402 - RNA, 65 nt, hsa
uguggaaaaauugucuuccacaaaacuggucccuggugccaaaaauguuggggaccacugcucua

SEQ ID NO: 250403 - RNA, 65 nt, hsa
aaagguaucuucugaauguucaagagcauccuauagugccaaauaauaaagcaccauuuuuuucu

SEQ ID NO: 250404 - RNA, 65 nt, hsa
ggugcucugggaguccugugcuuccugauccaauggugccaaacccuucaucuccccaagaagcg

SEQ ID NO: 250405 - RNA, 65 nt, hsa
gugugguagcaaaaggagggagaggaguccuuuuugugccaaaucccuaagugccguucgggggc

SEQ ID NO: 250406 - RNA, 65 nt, hsa
ggaugucaggucaggagcuggaaguucaccugcaggugccaaagagcaggccggccagggcuggg

SEQ ID NO: 250407 - RNA, 65 nt, hsa
ccagcuuuggccauauuucaggagaauguuuccaugugccaaaucuuagucccaugaucuguccc

SEQ ID NO: 250408 - RNA, 65 nt, hsa
agaaacuggggauuuagaagcuuauucagggcugagugccaaaagcuugggggaggagggacagg

SEQ ID NO: 250409 - RNA, 65 nt, hsa
gcuaccccaaaccaaucaaggguuuguuuacgggagugccaaaccagcccucggcugcuaugagu

SEQ ID NO: 250410 - RNA, 65 nt, hsa
cucauggggcaggaaauggggggaucacuuuccaagugccaaagagcccagagggacucuaagaa

SEQ ID NO: 250411 - RNA, 65 nt, hsa
agaagaccucagacaggaaacuggaauuuuuuaaagugccaaaacauauagaaauguuugaaugc

SEQ ID NO: 250412 - RNA, 65 nt, hsa
ccagaggcccuugaaaauguaauugugauuuaccugugccaaaggugcuuuaaaugucacauuug

SEQ ID NO: 250413 - RNA, 65 nt, hsa
aagaauaugucagaagagugcucgguuagcccacggugccaaaacuccaaacaaguuccccggug

SEQ ID NO: 250414 - RNA, 65 nt, hsa
gguucuucauucacguauuaauugcacaucaguaugugccaaaucuacuagacauuggagaaaca

SEQ ID NO: 250415 - RNA, 65 nt, hsa
ugcaggacgggccaggcugggagugccgccuuccugugccaaauucaguggggacucagugccca

SEQ ID NO: 250416 - RNA, 65 nt, hsa
aaaugucauccuugaucuugccuaauguaguuuaugugccaaacuuuccaggguuuuguagucac

SEQ ID NO: 250417 - RNA, 65 nt, hsa
gcuagugccaguauuaaaacauugucauuacgagagugccaaaugacaucuucccuccacccugc

SEQ ID NO: 250418 - RNA, 65 nt, hsa
aacuucauguaacuauagacuggaaaaaaugagccgugccaaagucucccuucuguuucuucagc

SEQ ID NO: 250419 - RNA, 65 nt, hsa
cuaagcacagccucccggguauguaacugaacuuggugccaaaguacuuguguacuaauuucuau

SEQ ID NO: 250420 - RNA, 65 nt, hsa
aaggacugugccauuggaaauuucauuacaaugaagugccaaacucacuacaccauauaauugca

SEQ ID NO: 250421 - RNA, 65 nt, hsa
ugaggaccaucaggagcuucauauuucaauaaccagugccaaauucugaaugccagaugggauga

SEQ ID NO: 250422 - RNA, 65 nt, hsa
aacuccugguaaauacuguguauucaaguaaucaugugccaaagccagggcagagcuucuaguuc

SEQ ID NO: 250423 - RNA, 65 nt, hsa
uguucuuucucauguaucucguguuuaugugcacagugccaaaagaagacugacuggguggaggc

SEQ ID NO: 250424 - RNA, 65 nt, hsa
guuaaauuuguaugaaccuuagaaaaguuauuaaagugccaaagaauguuucccuuuccuaaggc

SEQ ID NO: 250425 - RNA, 65 nt, hsa
uuuauggcuccccucacugauggacaaggaggucugugccaaagaagaauccaauaagcacauau

SEQ ID NO: 250426 - RNA, 65 nt, hsa
acuaaaaaauuuggcuuaaaccaguguucagucuggugccaaacuucgaauggaauacaaauuca

SEQ ID NO: 250427 - RNA, 65 nt, hsa
ggcagaggaagagaggucgacuguggggucauuuggugccaaacauggaggugggcaggcucacc

SEQ ID NO: 250428 - RNA, 65 nt, hsa
ccugccccugccuccugcauccagcccccaacauggugccaaagcuuccagaagccaaaaagcuu

SEQ ID NO: 250429 - RNA, 65 nt, hsa
gugauaaucauuggcaugccaccugaggucaaggagugccaaauaggacuuuccacucaugcuca

SEQ ID NO: 250430 - RNA, 65 nt, hsa
caaacaacauaaaagacaaugucccuucuucaaaagugccaaaaggaauguaaaaugcaaaaauu

SEQ ID NO: 250431 - RNA, 65 nt, hsa
uuuccuuacauugucuugacaagauuaaaaugucugugccaaaauuuuguauuuuauuuggagac

SEQ ID NO: 250432 - RNA, 65 nt, hsa
aguagaugccuuuuuuuuuccggcuuaagccuuaagugccaaaucacaagagaaaaagcaguaac

SEQ ID NO: 250433 - RNA, 59 nt, hsa
aacauaaagcugcuggaugaaaugguccagugccaaaaugagcuuaaaaucuuuguuuc

SEQ ID NO: 250434 - RNA, 65 nt, hsa
aaugaucuuguguaagguuuugguuauggagucuugugccaaaccuacuaggccauuagcccuuc

SEQ ID NO: 250435 - RNA, 65 nt, hsa
gagaguccuucaccguauaugaaagccagggggcagugccaaacacgcggcaccaggagauggag

SEQ ID NO: 250436 - RNA, 65 nt, hsa
uguuaaugcuauaugacaaaaugcucugauuccuagugccaaagguucaauucaguguauauaac

SEQ ID NO: 250437 - RNA, 65 nt, hsa
uugagcgccugcauuccugggggcuggaggguggggugccaaaggcccugagcaaaagccagagc

SEQ ID NO: 250438 - RNA, 65 nt, hsa
auggcagcugcugaacuugaacccagagccuucaggugccaaagccauacucaggcccccaccga

SEQ ID NO: 250439 - RNA, 65 nt, hsa
auaauaugggaugcaauaaccaacaaagcugcuaagugccaaacuguuauuuuacuauauauaaa

SEQ ID NO: 250440 - RNA, 65 nt, hsa
caucuccucugccugugucugcgacccccauccaugugccaaagugucccuugggucacacagcu

SEQ ID NO: 250441 - RNA, 65 nt, hsa
cuuuauagccaguagagguggagggacccuggcaugugccaaagaagaggcccucugggugauga

SEQ ID NO: 250442 - RNA, 65 nt, hsa
cccagccugucugggauaucauguuucaaguggcugugccaaagucaaugagagugaagcugcag

SEQ ID NO: 250443 - RNA, 65 nt, hsa
uuugcugggguucagcgccucuccuggggcuggaagugccaaagccuggggcaaagcuguguuuc

SEQ ID NO: 250444 - RNA, 65 nt, hsa
agccuuuuccccaggccucagagcauugcucauccgugccaaacuggguagguggauuugagcgg

SEQ ID NO: 250445 - RNA, 65 nt, hsa
agaguccucaucugcuggcauuuugugggguguuagugccaaacuugaauaggggcuggggugcu

SEQ ID NO: 250446 - RNA, 65 nt, hsa
gaaacaugaacaugcucaaauaacucgaggcucacgugccaaagugugugugugugugugugugu

SEQ ID NO: 250447 - RNA, 65 nt, hsa
uagagagguccggugugcacagccggccucccagugugccaaaaugaacugcucucagcugaugg

SEQ ID NO: 250448 - RNA, 65 nt, hsa
ucccaccuggcucuguggcgagccauuugucccaagugccaaagaagcagaccauuggggcuccc

SEQ ID NO: 250449 - RNA, 65 nt, hsa
uuguauuguggcagucugaacgcccccagaaaauugugccaaagaguuuagaaaaauaaauauac

SEQ ID NO: 250450 - RNA, 65 nt, hsa
ggaugcucuaguugguucuguguccauuuuccucugugccaaagacagacagacagaggcugaga

SEQ ID NO: 250451 - RNA, 65 nt, hsa
ccuucucucuuuacucccacuuuuuacguuugcaggugccaaaguaauguccacuuuucccuuuc

SEQ ID NO: 250452 - RNA, 65 nt, hsa
cuaagaaggucgaccucaucaucugggagaucgaggugccaaagcacuuagucggucggcuaauu

SEQ ID NO: 250453 - RNA, 65 nt, hsa
cacuccaaaaaagcaaaacagacccuaauuuuuuugugccaaaaacuguggacaugcuggcucag

SEQ ID NO: 250454 - RNA, 65 nt, hsa
ggcucacaaauuccgauuagaccuuuauccagcuagugccaaauaauugaucagaugcugaauug

SEQ ID NO: 250455 - RNA, 65 nt, hsa
ggaguuggggagaacugucaagaagagugaagagagugccaaagcggagaucuguucaccugggg

SEQ ID NO: 250456 - RNA, 65 nt, hsa
gucuggguaguaguuucuggaaaugacugcagacugugccaaaugucuuuugagcuucugaccug

SEQ ID NO: 250457 - RNA, 65 nt, hsa
gcguaccagacugcaagaccccccaguaccucaccgugccaaauaggaagagguggccuuggugu

SEQ ID NO: 250458 - RNA, 65 nt, hsa
cgggagagcuuuucuuuaacgauaucaacucuguggugccaaaaggagacgcggccucccgccag

SEQ ID NO: 250459 - RNA, 65 nt, hsa
agaggauuggugcagucccagcugaagcccacugugugccaaaggaagaagcucccagggcugcu

SEQ ID NO: 250460 - RNA, 65 nt, hsa
gggaucaugcuagucacuuccugcccccaggcaccgugccaaagacuggaugcccccuacuccuc

SEQ ID NO: 250461 - RNA, 65 nt, hsa
aguuucuaucauccaaaguaugggcuacagaaaccgugccaaaagacuucuacagagugaacccg

SEQ ID NO: 250462 - RNA, 65 nt, hsa
gcccacccagugccuuuccuuggcccucacugccagugccaaaccgccccucagcagggcagggc

SEQ ID NO: 250463 - RNA, 65 nt, hsa
accuucucuacuccuccaguaaguuggcaguuuuggugccaaaccccaaaucuccaaagagacau

SEQ ID NO: 250464 - RNA, 65 nt, hsa
auuuaauuauuacuaaaauuguauuuacaauaguggugccaaaucaaaugguaauuuaaauaaaa

SEQ ID NO: 250465 - RNA, 65 nt, hsa
uuagguuuucuaaggacauuguuuuaaucuguaucgugccaaaguuguaucacuguuaaacuucu

SEQ ID NO: 250466 - RNA, 65 nt, hsa
uuguaagugacagguguuaaaggcccaggugugcugugccaaagagcucagcagaggcucacgug

SEQ ID NO: 250467 - RNA, 65 nt, hsa
ucuaauauugaguucaacugugaaauccaucagaugugccaaauggagaagacagaaagcaacaa

SEQ ID NO: 250468 - RNA, 65 nt, hsa
ucccugccacgcgugugugugcgugugccacgugagugccaaaguccccugccccccaagccagc

SEQ ID NO: 250469 - RNA, 65 nt, hsa
cccccguggcucccggucuccugugggccugcugugugccaaaccugagcuaccugcacccgagc

SEQ ID NO: 250470 - RNA, 65 nt, hsa
acaagcaaucauguuugcguccccguccgucacaugugccaaaucccuggcaggcagauggcucc

SEQ ID NO: 250471 - RNA, 55 nt, hsa
gagaaaucuuacaaguaugaauaaugugccaaagccuaagaaaacccucaauucu

SEQ ID NO: 250472 - RNA, 51 nt, hsa
aaucuuacaaguaugaauaaugugccaaagccuaagaaaacccucaauucu

SEQ ID NO: 250473 - RNA, 65 nt, hsa
agaaaacuucaggcugguacuccugacgaauauaggugccaaaauccucagcaaaauacuaguaa

SEQ ID NO: 250474 - RNA, 65 nt, hsa
uuaugauuucuaauuuucuaaugugccuuggauaugugccaaaugauggaaaagaaacaguaaac

SEQ ID NO: 250475 - RNA, 65 nt, hsa
gauagacuaugaaugcuauuucuagaaaaagucuagugccaaauuugucuuauuaaauaaaaaca

SEQ ID NO: 250476 - RNA, 65 nt, hsa
ugugauggugcuuuuagcgcuaaauugugccucgugugccaaagaaacauagacaacuguagagg

SEQ ID NO: 250477 - RNA, 65 nt, hsa
caccacauuauuauauuuccacaucaguuucuugugugccaaauaagacccaugcuuugcaucuu

SEQ ID NO: 250478 - RNA, 65 nt, hsa
ccagggugaacacacagccagcuuaucccucuuaagugccaaaacuuuuuuuuaaaccauuuuuu

SEQ ID NO: 250479 - RNA, 65 nt, hsa
aucuuguaccuuuucagagaaagggagguaucccugugccaaaggcuccaggccucuccccugca

SEQ ID NO: 250480 - RNA, 65 nt, hsa
cagccaucccugccuuucuguugggaaaaacuguugugccaaacucuuguguggaacacagcugg

SEQ ID NO: 250481 - RNA, 65 nt, hsa
uuguuagaacaauagaaaaauagagcaguguaugugugccaaaacucaucauuacucaaaggaga

SEQ ID NO: 250482 - RNA, 65 nt, hsa
cauccuuuuuucagcccaacauuuagcuuuauggagugccaaagggaaaauauauccauaucccu

SEQ ID NO: 250483 - RNA, 65 nt, hsa
uuugugccaggagugggugggacacagagacccccgugccaaauccugggcauccccagcccccu

SEQ ID NO: 250484 - RNA, 65 nt, hsa
uuuuuauucucaaauguuuguuuugaguaaccguagugccaaaauuucaguucaguaauggggug

SEQ ID NO: 250485 - RNA, 65 nt, hsa
caguguauguagaagcaugaagucuuaaggacaaagugccaaagaaaguggucuuaagaaaugua

SEQ ID NO: 250486 - RNA, 65 nt, hsa
gcacuugcuggucuuuguagcagcauucagcacaggugccaaaauaugcuucauuuugggggcag

SEQ ID NO: 250487 - RNA, 65 nt, hsa
ccggccccgagggccaaggggguccccgcccgccagugccaaagcgcccggucggaggcggaagg

SEQ ID NO: 250488 - RNA, 65 nt, hsa
aaacaaggcgagcuugaguucugcacuccagauaugugccaaaacuaguaaaacuuaacggacuu

SEQ ID NO: 250489 - RNA, 65 nt, hsa
cgguuuuucauuuucucaacuuuuaauagcaaaaagugccaaaguccucagagaccuaacagccu

SEQ ID NO: 250490 - RNA, 65 nt, hsa
uccugcuaccuuugucucacgauuccagugcaguagugccaaaaggccccuucccacgucccucg

SEQ ID NO: 250491 - RNA, 65 nt, hsa
cggcugcuggggccaggacaggcgucuccuagguugugccaaaccagccuacagauguuccugcc

SEQ ID NO: 250492 - RNA, 65 nt, hsa
cccaggagcucagggccugucagaccuggugacaagugccaaaggccacaggcaugagggaggcg

SEQ ID NO: 250493 - RNA, 65 nt, hsa
cugugauggcugaauggaaagaaacguaaaaagcugugccaaaaaaaaagcaaaaugcugugaua

SEQ ID NO: 250494 - RNA, 65 nt, hsa
aguggugauuguuuaaacucucacagucuuaaaccgugccaaaguccuguuaugucuugaacuuu

SEQ ID NO: 250495 - RNA, 65 nt, hsa
agccucugagucccguggggccccggcucccaccggugccaaacccagccccugcggccgucacc

SEQ ID NO: 250496 - RNA, 65 nt, hsa
ccagccaggagugcggacaccauguucccagcucagugccaaagaggggucaccagggggagcug

SEQ ID NO: 250497 - RNA, 65 nt, hsa
auuugguaaaaggccuacagcuuuguacuuacauugugccaaaggcugaggaaauguuuucuuuc

SEQ ID NO: 250498 - RNA, 65 nt, hsa
gauguggccgggcugcagagccgggccacaccucagugccaaagaccccaugggagugggaggga

SEQ ID NO: 250499 - RNA, 65 nt, hsa
agacucaaauuuucugccccagccaaaauaaucuugugccaaaagauuaaagguuugccucaaaa

SEQ ID NO: 250500 - RNA, 65 nt, hsa
uguuaaugcuaugugacaaaacgcccugauuccuagugccaaagguucaacuuaauguauauacc

SEQ ID NO: 250501 - RNA, 65 nt, hsa
ucugagguccacaucauggcaguucauuuacucuugugccaaauggcaacaccacgucuaaagca

SEQ ID NO: 250502 - RNA, 65 nt, hsa
uuucaaaggguauauauaaaagguaaaaaacuagugugccaaaugguauaggaacaacuguacuu

SEQ ID NO: 250503 - RNA, 65 nt, hsa
ggcuuuauauuaaauucuuuuaguauuauagguuggugccaaaauauuuucaguuguacuguaga

SEQ ID NO: 250504 - RNA, 65 nt, hsa
uccuuuugcaaagaaagaaaaaaaaccaucaaguugugccaaauuauucuccuauguuuggcugc

SEQ ID NO: 250505 - RNA, 65 nt, hsa
ggacacccagaaacgccacaucccccaauccaucagugccaaacuagccaacggccccagcuucu

SEQ ID NO: 250506 - RNA, 65 nt, hsa
auuuuuuuuacugauuuuuuauucuccagcuuucagugccaaagaggccaugcugaguuagguag

SEQ ID NO: 250507 - RNA, 65 nt, hsa
aucaggaugcucauaacuuuguaugucugacccaagugccaaaggcagacgugcuuuauagcuaa

SEQ ID NO: 250508 - RNA, 65 nt, hsa
uaugauguagagcuauuaagggaguauuuucacuugugccaaagaggguaagcguuuauuagccu

SEQ ID NO: 250509 - RNA, 64 nt, hsa; identical to SEQ ID NO: 226314

SEQ ID NO: 250510 - RNA, 64 nt, hsa; identical to SEQ ID NO: 226315

SEQ ID NO: 250511 - RNA, 64 nt, hsa; identical to SEQ ID NO: 226316

SEQ ID NO: 250512 - RNA, 64 nt, hsa; identical to SEQ ID NO: 226317

SEQ ID NO: 250513 - RNA, 64 nt, hsa; identical to SEQ ID NO: 226318

SEQ ID NO: 250514 - RNA, 64 nt, hsa; identical to SEQ ID NO: 226319

SEQ ID NO: 250515 - RNA, 64 nt, hsa; identical to SEQ ID NO: 226320

SEQ ID NO: 250516 - RNA, 64 nt, hsa; identical to SEQ ID NO: 226321

SEQ ID NO: 250517 - RNA, 64 nt, hsa; identical to SEQ ID NO: 226322

SEQ ID NO: 250518 - RNA, 64 nt, hsa; identical to SEQ ID NO: 226323

SEQ ID NO: 250519 - RNA, 64 nt, hsa; identical to SEQ ID NO: 226324

SEQ ID NO: 250520 - RNA, 64 nt, hsa; identical to SEQ ID NO: 226325

SEQ ID NO: 250521 - RNA, 64 nt, hsa; identical to SEQ ID NO: 226326

SEQ ID NO: 250522 - RNA, 64 nt, hsa; identical to SEQ ID NO: 226327

SEQ ID NO: 250523 - RNA, 64 nt, hsa; identical to SEQ ID NO: 226328

SEQ ID NO: 250524 - RNA, 64 nt, hsa; identical to SEQ ID NO: 226329

SEQ ID NO: 250525 - RNA, 64 nt, hsa; identical to SEQ ID NO: 226330

SEQ ID NO: 250526 - RNA, 64 nt, hsa; identical to SEQ ID NO: 226331

SEQ ID NO: 250527 - RNA, 64 nt, hsa; identical to SEQ ID NO: 226332

SEQ ID NO: 250528 - RNA, 64 nt, hsa; identical to SEQ ID NO: 226333

SEQ ID NO: 250529 - RNA, 64 nt, hsa; identical to SEQ ID NO: 226334

SEQ ID NO: 250530 - RNA, 64 nt, hsa; identical to SEQ ID NO: 226335

SEQ ID NO: 250531 - RNA, 64 nt, hsa; identical to SEQ ID NO: 226336

SEQ ID NO: 250532 - RNA, 64 nt, hsa; identical to SEQ ID NO: 226337

SEQ ID NO: 250533 - RNA, 64 nt, hsa; identical to SEQ ID NO: 226338

SEQ ID NO: 250534 - RNA, 64 nt, hsa; identical to SEQ ID NO: 226339

SEQ ID NO: 250535 - RNA, 64 nt, hsa; identical to SEQ ID NO: 226340

SEQ ID NO: 250536 - RNA, 64 nt, hsa; identical to SEQ ID NO: 226341

SEQ ID NO: 250537 - RNA, 64 nt, hsa
uugcagauggagaauaggaagggcauuccaggcagagggaaaccugugcagagaccaagaggug

SEQ ID NO: 250538 - RNA, 64 nt, hsa
acuccugggccugccccagcuccuugcccagggagagggaaagaguuaacggugugggccacuc

SEQ ID NO: 250539 - RNA, 64 nt, hsa
aaguggggcugcacucgguccagaggccagcuaggagggaaaccgcagcuuccuggggcuugug

SEQ ID NO: 250540 - RNA, 64 nt, hsa
accuggccugacccagucggagccugacaugguggagggaaagggagacaaguggggcugcacu

SEQ ID NO: 250541 - RNA, 64 nt, hsa
guuugaggugggggccucucuggaagcacauuuggagggaaagacaagagagccaugaggagag

SEQ ID NO: 250542 - RNA, 64 nt, hsa
ugcauguggagcccucccaccccacccccagauagagggaaauaaccaaaaaacuaccaaacaa

SEQ ID NO: 250543 - RNA, 64 nt, hsa
uaucugaugacggggaaacaaaauuauucucugagagggaaaggacauuugagggaaacaucaa

SEQ ID NO: 250544 - RNA, 64 nt, hsa
aacaaaauuauucucugagagggaaaggacauuugagggaaacaucaaauuuccccauaaauaa

SEQ ID NO: 250545 - RNA, 64 nt, hsa
cuauauguugcugaaacacacaggccauuucauugagggaaaacauaauaucuugaagaauauu

SEQ ID NO: 250546 - RNA, 64 nt, hsa
aaacuguuuuucaaaacgccauguccuaggggccgagggaaaugcuguuggugagaaucgaccu

SEQ ID NO: 250547 - RNA, 64 nt, hsa
cauugugugauauucucagaggcaggggaaaauagagggaaaaauagagacuauugguauguuc

SEQ ID NO: 250548 - RNA, 64 nt, hsa
cuggucaccacuggacgggaaggagaacagaggagagggaaagagaagcccaaccucugugauc

SEQ ID NO: 250549 - RNA, 64 nt, hsa
uaaaagucuguaauuucaguuuuugugucggggagagggaaaaacuauuugucuguaguugcuu

SEQ ID NO: 250550 - RNA, 64 nt, hsa
uauucuucuguaaugagaauagacuggaacaugugagggaaaaauauuuaaaaaaagauggcag

SEQ ID NO: 250551 - RNA, 64 nt, hsa
cuaaauguucagaaaauuauuuuaaaagaugaaagagggaaauaggccauggacgguggcucac

SEQ ID NO: 250552 - RNA, 64 nt, hsa
uaauaaagaugaaaagagaagguacccuaaggcugagggaaagaauccuaacaaggaaaggcag

SEQ ID NO: 250553 - RNA, 64 nt, hsa
gaaaguauggaaguuuuccauucacuggggaaaggagggaaaagugcauuuauuuuuauacaga

SEQ ID NO: 250554 - RNA, 64 nt, hsa
uuuguuuguuuguuuauuugguuggcuuuuuggagagggaaauuuggaaacgggacauacacaa

SEQ ID NO: 250555 - RNA, 64 nt, hsa
aauauucacuuuggugcuacuacccccauuaccugagggaaacuggccagguccuugaucaugg

SEQ ID NO: 250556 - RNA, 64 nt, hsa
ggucagucaacuuucagaaauucagggagcuggagagggaaaucuuuuuuuuucccccugagug

SEQ ID NO: 250557 - RNA, 64 nt, hsa
guuucuaaaauuauuucagagaugugugcuccuggagggaaaaagaaauacagccucaacagau

SEQ ID NO: 250558 - RNA, 64 nt, hsa
acuccaggcaacgacccaagcacuuauuuuuuaagagggaaaggacuuuggucauguuuacauu

SEQ ID NO: 250559 - RNA, 64 nt, hsa
uuaaucgguggcauauacugcacauacugaaauagagggaaaucacugaauguaaagagguuuc

SEQ ID NO: 250560 - RNA, 64 nt, hsa
uagagaugagggggcuacagcagcaucaugcaaagagggaaagaugaagggauagaagaagaga

SEQ ID NO: 250561 - RNA, 64 nt, hsa
ggggaacaaaacaauuaacguaagagcuacaaaggagggaaaaggaaccaagaaguagaaggag

SEQ ID NO: 250562 - RNA, 64 nt, hsa
gcagccuucccaguaacuucuaccugccagcccagagggaaauauggauuuucacaccuugccu

SEQ ID NO: 250563 - RNA, 64 nt, hsa
ccuaccugggcucuggggaggcugugggccuggagagggaaaaggagggagggggugucugcac

SEQ ID NO: 250564 - RNA, 64 nt, hsa
uuuuggaaccaacauucaaauucugccucaucuggagggaaaccaaaauugggagggggaagag

SEQ ID NO: 250565 - RNA, 64 nt, hsa
ccugggggacggggguggggggugguaguggugggagggaaaccaugucuugcuaaaccuguuu

SEQ ID NO: 250566 - RNA, 64 nt, hsa
aaaaaaaguuguuugcuuaaaaaaaauuucaugugagggaaaaaaaaaaaaccuauuccagaau

SEQ ID NO: 250567 - RNA, 64 nt, hsa
uucuucaguuuuaacgaguaauuggauaaacccugagggaaaacggagguagauucagcaccua

SEQ ID NO: 250568 - RNA, 64 nt, hsa
aagguguucaauaaaaauucaaauaauuuguacugagggaaacaguuauacuacaaaucauguu

SEQ ID NO: 250569 - RNA, 64 nt, hsa
acacaagagguacaccuuaugaaucgcaucaauagagggaaauuuucagcuacaaucuuugcuc

SEQ ID NO: 250570 - RNA, 64 nt, hsa
gacugagcuggggagggaggcaggugggugguaagagggaaacucuggagagccugcacccagg

SEQ ID NO: 250571 - RNA, 64 nt, hsa
aaaaaggauuccaagugauggaacuccagggguggagggaaauuggcaguuccuggcaucucuu

SEQ ID NO: 250572 - RNA, 64 nt, hsa
cuucuggauguuccuacagagggaaagaccuacagagggaaagacccucgggccgcuccccugc

SEQ ID NO: 250573 - RNA, 64 nt, hsa
ugcuugcuuccagaaucuucuggauguuccuacagagggaaagaccuacagagggaaagacccu

SEQ ID NO: 250574 - RNA, 64 nt, hsa
agcuuaugcuucuuuagauggaauaaugggaaaggagggaaaugggaaauggauggaaauggga

SEQ ID NO: 250575 - RNA, 64 nt, hsa
ggagggaaaugggaaauggauggaaaugggaaaggagggaaaauaauagcccagugagagcuga

SEQ ID NO: 250576 - RNA, 64 nt, hsa
aguugggaagauauauugauuaugcuguucuguugagggaaaggucauguauuuagaaauuuaa

SEQ ID NO: 250577 - RNA, 64 nt, hsa
ggauugauucagcucaccuuccaugauugcuuuugagggaaaagcuacaguggccacauuucag

SEQ ID NO: 250578 - RNA, 64 nt, hsa
uuucuacuuuguaauugugagacauuuucuuggggagggaaaauuggaaugguucccuuuuuua

SEQ ID NO: 250579 - RNA, 64 nt, hsa
ucauugauuuuuguguuuaaaaaaaaauaggaaagagggaaacugcagcuuucauuacagauuc

SEQ ID NO: 250580 - RNA, 64 nt, hsa
gagggagagagagacagaggggaagagaggcagagagggaaagaggcagagaaggaaagagaca

SEQ ID NO: 250581 - RNA, 62 nt, hsa
aggggggcccaggugcauaaaugggggucagggagggaaaggaggagggagagagauggaga

SEQ ID NO: 250582 - RNA, 64 nt, hsa
ucuucuucuccuuccucuacauuuuaaagggggagagggaaaaguaaccgggagacaaauugag

SEQ ID NO: 250583 - RNA, 64 nt, hsa
cccucacccaauaugacuggaguccuuaucggaagagggaaauucagacacagaugcauaggga

SEQ ID NO: 250584 - RNA, 64 nt, hsa
ccuugcugcuuucacagggugggaaacgaaauucgagggaaauuccccggaaauaugagggaaa

SEQ ID NO: 250585 - RNA, 64 nt, hsa
gaaacgaaauucgagggaaauuccccggaaauaugagggaaaucucugcauugcaccaccagag

SEQ ID NO: 250586 - RNA, 64 nt, hsa
guucccauccucuucuuuuagcaguaaaauagcugagggaaaagggagggaaaaggaaguuaug

SEQ ID NO: 250587 - RNA, 64 nt, hsa
cuucuuuuagcaguaaaauagcugagggaaaagggagggaaaaggaaguuaugggaauaccugu

SEQ ID NO: 250588 - RNA, 64 nt, hsa; identical to SEQ ID NO: 91867

SEQ ID NO: 250589 - RNA, 64 nt, hsa; identical to SEQ ID NO: 91868

SEQ ID NO: 250590 - RNA, 64 nt, hsa; identical to SEQ ID NO: 91869

SEQ ID NO: 250591 - RNA, 64 nt, hsa; identical to SEQ ID NO: 91870

SEQ ID NO: 250592 - RNA, 64 nt, hsa; identical to SEQ ID NO: 91871

SEQ ID NO: 250593 - RNA, 64 nt, hsa; identical to SEQ ID NO: 91872

SEQ ID NO: 250594 - RNA, 64 nt, hsa; identical to SEQ ID NO: 91873

SEQ ID NO: 250595 - RNA, 64 nt, hsa; identical to SEQ ID NO: 91874

SEQ ID NO: 250596 - RNA, 64 nt, hsa; identical to SEQ ID NO: 91875

SEQ ID NO: 250597 - RNA, 64 nt, hsa; identical to SEQ ID NO: 91876

SEQ ID NO: 250598 - RNA, 64 nt, hsa; identical to SEQ ID NO: 91877

SEQ ID NO: 250599 - RNA, 64 nt, hsa; identical to SEQ ID NO: 91878

SEQ ID NO: 250600 - RNA, 63 nt, hsa
aauacagugugacguguacugucaucaagggguaugcuccaugcuuugagucaccaaugaagc

SEQ ID NO: 250601 - RNA, 63 nt, hsa
cagaaguggggagcacuuuaaugcaacccagguaugcuccaugcauauccagcugggccagcc

SEQ ID NO: 250602 - RNA, 63 nt, hsa
gcuacccuccagacaagggcaagaguuagccagaugcuccaggcagugggaagccaauggagg

SEQ ID NO: 250603 - RNA, 63 nt, hsa
caucggcacuggcgcccugcuccaucggcacuaaugcuccacucggcgccccacuccaucggc

SEQ ID NO: 250604 - RNA, 63 nt, hsa
ugccccacucggcgccccacuccaucagcacuaaugcuccacuccauuggcacuaacgcccca

SEQ ID NO: 250605 - RNA, 64 nt, hsa
gcagaaagugcccauuguucaggauucuaauagcuacaucuacuuaauaucuucauuucuaaau

SEQ ID NO: 250606 - RNA, 64 nt, hsa
cauauuuuucaaaauagguuuuuauuguugaauguacaucuaccccagccccucaaaagaaaaa

SEQ ID NO: 250607 - RNA, 64 nt, hsa
cagcuaacgauuacucauugauccaaaacuuaaauacaucuauaauuuccuggggcuauuguga

SEQ ID NO: 250608 - RNA, 64 nt, hsa
ccaagaaccauaguuacugaaaagggaguccugauacaucuaauauugguagcauguaacagug

SEQ ID NO: 250609 - RNA, 64 nt, hsa
uuagguccuuuaaaaaaacauauuaaucauugacuacaucuaugauaaaagugcuuauuuuggu

SEQ ID NO: 250610 - RNA, 64 nt, hsa
auuaagacaauguuuuuaauuuaauuugccucauuacaucuaauaguucccauuugauggcaug

SEQ ID NO: 250611 - RNA, 64 nt, hsa
ggaagaaaauaacauucuuggguugagggaaggaaugccauacacuacugucucuucagaucug

SEQ ID NO: 250612 - RNA, 64 nt, hsa
caagcagaucuuguaucaaggcagaggugaugccaugccauacuuuuaggaagucugagaugau

SEQ ID NO: 250613 - RNA, 64 nt, hsa
uccccaaaguguauuuuucucuaagucgagggcuaugccauaauacaaauggaaauguuaccuu

SEQ ID NO: 250614 - RNA, 64 nt, hsa
caaggaacaaauuuccuuaggauuauaguauuacaugccauaaaauacuaugcuuuauuggucc

SEQ ID NO: 250615 - RNA, 64 nt, hsa
caucagugcucaauugcauuuucuuccuuucgcagccagucagucuuucaaacuauugacagua

SEQ ID NO: 250616 - RNA, 64 nt, hsa
cguagccuagagcagugucacaagcuucaguaaggccagucagcuggaagucagucuaccguau

SEQ ID NO: 250617 - RNA, 64 nt, hsa
cuucacuucuucccaauauacaguaaguacgugagccagucauccauacacuaaggccuaguug

SEQ ID NO: 250618 - RNA, 64 nt, hsa
uuuuuaauagaaaugaacuuuugauuaguauggugccagucacagggcuauuuuccugaauauu

SEQ ID NO: 250619 - RNA, 64 nt, hsa
caguauuugcagaauacauucaagguuucaaagcgccagucauuugcuccguuuucaaauccag

SEQ ID NO: 250620 - RNA, 64 nt, hsa
gugaagagauaaagaaaaaaaaguacaaccaaaugccagucaggcacagcagaaaccuacaacu

SEQ ID NO: 250621 - RNA, 64 nt, hsa
cagcccacagaggggagggagcauggggccaggugccagucaucugugaagcuagggcgccuac

SEQ ID NO: 250622 - RNA, 64 nt, hsa
ccuggcccccucagccaucucagggugaggagcugccagucauguccagauggaaugacuccca

SEQ ID NO: 250623 - RNA, 64 nt, hsa
guagaucccaggacucggcaguggaugggaugcagccagucauggguuagggucagcagagacu

SEQ ID NO: 250624 - RNA, 64 nt, hsa
guuagacuuacccuccucccucuuuccaccagcugccagucaagggcagugggaucucgaugga

SEQ ID NO: 250625 - RNA, 64 nt, hsa
guaaacaugcgaacacugcucacacgcgaguuuucacaguuauuucuauccacgccuaugaauc

SEQ ID NO: 250626 - RNA, 64 nt, hsa
uaaaaugugaagaaagugugaauuuuaguuuugucacaguuaacugugucaaagagaauuaaaa

SEQ ID NO: 250627 - RNA, 64 nt, hsa
uauuucagaaauacagauaaaugauucaaaaagucacaguuaaggagaaucauguuucuuugau

SEQ ID NO: 250628 - RNA, 64 nt, hsa
uugaucucacauuuuuauaccuguuuaaauugcucacaguuauuacauacacaucagccaucaa

SEQ ID NO: 250629 - RNA, 64 nt, hsa; identical to SEQ ID NO: 124377

SEQ ID NO: 250630 - RNA, 64 nt, hsa; identical to SEQ ID NO: 124378

SEQ ID NO: 250631 - RNA, 64 nt, hsa; identical to SEQ ID NO: 124379

SEQ ID NO: 250632 - RNA, 64 nt, hsa; identical to SEQ ID NO: 124380

SEQ ID NO: 250633 - RNA, 64 nt, hsa; identical to SEQ ID NO: 124381

SEQ ID NO: 250634 - RNA, 64 nt, hsa; identical to SEQ ID NO: 124382

SEQ ID NO: 250635 - RNA, 64 nt, hsa; identical to SEQ ID NO: 124383

SEQ ID NO: 250636 - RNA, 64 nt, hsa; identical to SEQ ID NO: 124384

SEQ ID NO: 250637 - RNA, 64 nt, hsa
auaauuucacuugcuuugaaaguugauuuaauugacugacuaaaugaaaaugccuacccacuca

SEQ ID NO: 250638 - RNA, 64 nt, hsa
uuaaaauuugcuagugguuugaaaauaauaauguacugacuacauguaugcuguuauugucagu

SEQ ID NO: 250639 - RNA, 64 nt, hsa; identical to SEQ ID NO: 182371

SEQ ID NO: 250640 - RNA, 64 nt, hsa; identical to SEQ ID NO: 182372

SEQ ID NO: 250641 - RNA, 64 nt, hsa; identical to SEQ ID NO: 182373

SEQ ID NO: 250642 - RNA, 64 nt, hsa; identical to SEQ ID NO: 182374

SEQ ID NO: 250643 - RNA, 64 nt, hsa; identical to SEQ ID NO: 182375

SEQ ID NO: 250644 - RNA, 64 nt, hsa; identical to SEQ ID NO: 182376

SEQ ID NO: 250645 - RNA, 64 nt, hsa; identical to SEQ ID NO: 182377

SEQ ID NO: 250646 - RNA, 64 nt, hsa; identical to SEQ ID NO: 182378

SEQ ID NO: 250647 - RNA, 64 nt, hsa; identical to SEQ ID NO: 182379

SEQ ID NO: 250648 - RNA, 64 nt, hsa; identical to SEQ ID NO: 182380

SEQ ID NO: 250649 - RNA, 64 nt, hsa; identical to SEQ ID NO: 182381

SEQ ID NO: 250650 - RNA, 64 nt, hsa; identical to SEQ ID NO: 182382

SEQ ID NO: 250651 - RNA, 64 nt, hsa; identical to SEQ ID NO: 182383

SEQ ID NO: 250652 - RNA, 64 nt, hsa; identical to SEQ ID NO: 182384

SEQ ID NO: 250653 - RNA, 64 nt, hsa; identical to SEQ ID NO: 182385

SEQ ID NO: 250654 - RNA, 64 nt, hsa; identical to SEQ ID NO: 182386

SEQ ID NO: 250655 - RNA, 64 nt, hsa; identical to SEQ ID NO: 182387

SEQ ID NO: 250656 - RNA, 64 nt, hsa; identical to SEQ ID NO: 182388

SEQ ID NO: 250657 - RNA, 64 nt, hsa; identical to SEQ ID NO: 182389

SEQ ID NO: 250658 - RNA, 64 nt, hsa; identical to SEQ ID NO: 182390

SEQ ID NO: 250659 - RNA, 64 nt, hsa; identical to SEQ ID NO: 182391

SEQ ID NO: 250660 - RNA, 64 nt, hsa; identical to SEQ ID NO: 182392

SEQ ID NO: 250661 - RNA, 64 nt, hsa; identical to SEQ ID NO: 182393

SEQ ID NO: 250662 - RNA, 64 nt, hsa; identical to SEQ ID NO: 182394

SEQ ID NO: 250663 - RNA, 64 nt, hsa; identical to SEQ ID NO: 182395

SEQ ID NO: 250664 - RNA, 64 nt, hsa; identical to SEQ ID NO: 182396

SEQ ID NO: 250665 - RNA, 64 nt, hsa; identical to SEQ ID NO: 182397

SEQ ID NO: 250666 - RNA, 64 nt, hsa; identical to SEQ ID NO: 182398

SEQ ID NO: 250667 - RNA, 64 nt, hsa; identical to SEQ ID NO: 182399

SEQ ID NO: 250668 - RNA, 64 nt, hsa; identical to SEQ ID NO: 182400

SEQ ID NO: 250669 - RNA, 64 nt, hsa; identical to SEQ ID NO: 182401

SEQ ID NO: 250670 - RNA, 64 nt, hsa; identical to SEQ ID NO: 182402

SEQ ID NO: 250671 - RNA, 64 nt, hsa; identical to SEQ ID NO: 182403

SEQ ID NO: 250672 - RNA, 64 nt, hsa; identical to SEQ ID NO: 182404

SEQ ID NO: 250673 - RNA, 64 nt, hsa; identical to SEQ ID NO: 182405

SEQ ID NO: 250674 - RNA, 64 nt, hsa; identical to SEQ ID NO: 182406

SEQ ID NO: 250675 - RNA, 64 nt, hsa; identical to SEQ ID NO: 182407

SEQ ID NO: 250676 - RNA, 64 nt, hsa; identical to SEQ ID NO: 182408

SEQ ID NO: 250677 - RNA, 64 nt, hsa; identical to SEQ ID NO: 182409

SEQ ID NO: 250678 - RNA, 64 nt, hsa; identical to SEQ ID NO: 182410

SEQ ID NO: 250679 - RNA, 64 nt, hsa; identical to SEQ ID NO: 182411

SEQ ID NO: 250680 - RNA, 64 nt, hsa; identical to SEQ ID NO: 182412

SEQ ID NO: 250681 - RNA, 64 nt, hsa; identical to SEQ ID NO: 182413

SEQ ID NO: 250682 - RNA, 64 nt, hsa; identical to SEQ ID NO: 182414

SEQ ID NO: 250683 - RNA, 64 nt, hsa; identical to SEQ ID NO: 182415

SEQ ID NO: 250684 - RNA, 64 nt, hsa; identical to SEQ ID NO: 182416

SEQ ID NO: 250685 - RNA, 64 nt, hsa; identical to SEQ ID NO: 182417

SEQ ID NO: 250686 - RNA, 64 nt, hsa; identical to SEQ ID NO: 182418

SEQ ID NO: 250687 - RNA, 64 nt, hsa; identical to SEQ ID NO: 182419

SEQ ID NO: 250688 - RNA, 64 nt, hsa; identical to SEQ ID NO: 182420

SEQ ID NO: 250689 - RNA, 64 nt, hsa; identical to SEQ ID NO: 182421

SEQ ID NO: 250690 - RNA, 64 nt, hsa; identical to SEQ ID NO: 182422

SEQ ID NO: 250691 - RNA, 64 nt, hsa; identical to SEQ ID NO: 182423

SEQ ID NO: 250692 - RNA, 64 nt, hsa; identical to SEQ ID NO: 182424

SEQ ID NO: 250693 - RNA, 64 nt, hsa; identical to SEQ ID NO: 182425

SEQ ID NO: 250694 - RNA, 64 nt, hsa; identical to SEQ ID NO: 182426

SEQ ID NO: 250695 - RNA, 64 nt, hsa; identical to SEQ ID NO: 182427

SEQ ID NO: 250696 - RNA, 64 nt, hsa; identical to SEQ ID NO: 182428

SEQ ID NO: 250697 - RNA, 64 nt, hsa; identical to SEQ ID NO: 182429

SEQ ID NO: 250698 - RNA, 64 nt, hsa
aaccaacucagcuguaacauaugcaauucuguggugggaagaggcuguguguccaaggauggug

SEQ ID NO: 250699 - RNA, 64 nt, hsa
ggcuggcagggaagacaaaucugcuacaaguccaugggaagacccuacaaugaaauguucauug

SEQ ID NO: 250700 - RNA, 64 nt, hsa
gcucuaggcugccuggagggaaggaacaggcccaugggaagaaggggguuuuaaaaacaugucu

SEQ ID NO: 250701 - RNA, 64 nt, hsa
acacccguggacuuguguauauggucauaggcuuugggaagacaggacguaaaggaaaaugaga

SEQ ID NO: 250702 - RNA, 64 nt, hsa
uaaagugagacuuggguggugggaagaaggaaggugggaagaaggaauuagacacucugccugc

SEQ ID NO: 250703 - RNA, 64 nt, hsa
uuuucuuuuaauaaguaaagugagacuuggguggugggaagaaggaaggugggaagaaggaauu

SEQ ID NO: 250704 - RNA, 64 nt, hsa
aaaaguuuaggaaaucauaauguggcagagguggugggaagaagaaaguugagcuuuuuccccu

SEQ ID NO: 250705 - RNA, 64 nt, hsa
agucauuggggggaaaauguagccacauuuuuuaugggaagacuuuguguuaaaagugaacauu

SEQ ID NO: 250706 - RNA, 64 nt, hsa
guuuucacgcugcugauaaagacauacccgagacugggaagaaaaagugguuuaauuggacuua

SEQ ID NO: 250707 - RNA, 64 nt, hsa
guauuaaugcugcugauaaagacguacccgagacugggaagaaaaagagguuuacuuggacuua

SEQ ID NO: 250708 - RNA, 64 nt, hsa
auacuguguuauaauauuuucucuuucuguuuacugggaagauucagcuguacagauuuucuuu

SEQ ID NO: 250709 - RNA, 64 nt, hsa
ggccuagaauuuacacuggguugacuaguuaugaugggaagagaaguacuuuuuuuuaguaugc

SEQ ID NO: 250710 - RNA, 64 nt, hsa
gauaacuacccaaaccaaacaaccaauacauacaugggaagagaggcccugugugcucagugcc

SEQ ID NO: 250711 - RNA, 64 nt, hsa
aaagguuauauuuuaagcuauuugagauugcuuuugggaagaucacuagauuuauggaggaauu

SEQ ID NO: 250712 - RNA, 64 nt, hsa
uccuggaaagcccccagcagcugccccagggacaugggaagaccacgggaccucuuucacuacc

SEQ ID NO: 250713 - RNA, 64 nt, hsa
ccuggcugacagguggggagaccgaaucccucccugggaagauucuuggaguuacugagguggu

SEQ ID NO: 250714 - RNA, 61 nt, hsa
gcccucagagugcucuguaggagcuguagacugggaagagaggccaggcgugguggcucac

SEQ ID NO: 250715 - RNA, 64 nt, hsa
agcuagacccugucucaaaaaaaaaaaaaaagacugggaagagagcuagagggacuaggagaua

SEQ ID NO: 250716 - RNA, 64 nt, hsa
guauauaaaaucauuaaccacacauugugggugaugggaagacgauuucagcugacagaguuaa

SEQ ID NO: 250717 - RNA, 64 nt, hsa
aaagcaugcaaggaagaccagaugggcuuagcauugggaagacagagggcaaggaggugauaga

SEQ ID NO: 250718 - RNA, 64 nt, hsa
acagaaaaaauaacugauuagacccaagauuucaugggaagaaguuaaaagaaacugccuugaa

SEQ ID NO: 250719 - RNA, 64 nt, hsa
ucuaugccuuggugccgcaguggcccaucuuuuaugggaagacagagugaugcaccuucccgcu

SEQ ID NO: 250720 - RNA, 64 nt, hsa
cuuuuaaaaauguuuuuuauuuucaccuuagauaugggaagaguuuuuuuuuuuuuuuuuuuuu

SEQ ID NO: 250721 - RNA, 64 nt, hsa
gcagaaaagaaggaaagagggcacccuuuucaguugggaagaaaggagagggguggcgccaugg

SEQ ID NO: 250722 - RNA, 64 nt, hsa
uuaaagucuuacgacuuuccccauuuuagucuaaugggaagauacagaugugcaagucugcuuu

SEQ ID NO: 250723 - RNA, 64 nt, hsa
cuaagaugugagcagagugccauaguagggguucugggaagagguauuucugauuugugggccu

SEQ ID NO: 250724 - RNA, 64 nt, hsa
uuucguuucugugaucucccggcacguuuggagcugggaagaccacacugguggcagaauccua

SEQ ID NO: 250725 - RNA, 64 nt, hsa
aaaccuccacgugacuguuuggugcaucuugaccugggaagacgccucaugggaacgaacuugg

SEQ ID NO: 250726 - RNA, 64 nt, hsa
ggcguggagagaagagccguugcuguuuguuuuuugggaagagcuuuuaaagaaugcauguuuu

SEQ ID NO: 250727 - RNA, 64 nt, hsa
ugauugcuguauauuaaaauugaacaucagaggaugggaagagggcucuguaagccagaaccuu

SEQ ID NO: 250728 - RNA, 64 nt, hsa
ggaaaaggaaagagucucagaguggaacaaagagugggaagaggugaucuguaauguuacaaau

SEQ ID NO: 250729 - RNA, 64 nt, hsa
ggauggagagaauaggaaucuucacuagaagccgugggaagaauuggaaguuacaugcuguaua

SEQ ID NO: 250730 - RNA, 64 nt, hsa
cuuuugguagagaaggagcagaaagauguguuuuugggaagaagaagaccucuaggaggagcua

SEQ ID NO: 250731 - RNA, 64 nt, hsa
uaucuuugcugcagagaucaaggguuaagaucuaugggaagauacuuauuuuucugagguccuu

SEQ ID NO: 250732 - RNA, 64 nt, hsa
augcuccccgggagcagaggccacuaauggagagugggaagagccuggaaagauguggccucag

SEQ ID NO: 250733 - RNA, 64 nt, hsa
ugagaacuugcgauacuagccugcacccacuggcugggaagaucucuuccugcucccacgcccc

SEQ ID NO: 250734 - RNA, 64 nt, hsa
ugugucauguacccacuuuuuggccagacuacacugggaagaagguaguccucuaaagcaaaau

SEQ ID NO: 250735 - RNA, 64 nt, hsa
cuugaacuagauugcaugcuuccuccuuugcucuugggaagaccagcuuugcagugacagcuug

SEQ ID NO: 250736 - RNA, 64 nt, hsa
uaagccaucucagauucugucuaaagggguuuuuugggaagacguuuucuuuaucgcccugaga

SEQ ID NO: 250737 - RNA, 64 nt, hsa
ggcugagguuagagagauuggccagcaaaaacugugggaagaugaacuuugucauuaugauuuc

SEQ ID NO: 250738 - RNA, 64 nt, hsa
aacuuaccugcuaggaaugcuagauugaaugggaugggaagagccuucccucauuauugucauu

SEQ ID NO: 250739 - RNA, 64 nt, hsa
cccuggccugggcaucacaagccagugaugcuccugggaagaccagguggcaggucgcaguugg

SEQ ID NO: 250740 - RNA, 64 nt, hsa
acucuuugaaagcuuuguuuugugguaguccuuuugggaagaauccaguauuauccacaauuau

SEQ ID NO: 250741 - RNA, 64 nt, hsa
ccacaaaugcagguguccugagcaccacacccagugggaagagugugggggaggcgcacagugu

SEQ ID NO: 250742 - RNA, 64 nt, hsa
agaaaccguaaggugcuuccuuuaagugaaaagaugggaagaaaacagucauaugcugaaucuu

SEQ ID NO: 250743 - RNA, 64 nt, hsa
ucuugugccuuaaauaaaacacaccucucugcugugggaagacugugcaauggcacagccgcag

SEQ ID NO: 250744 - RNA, 64 nt, hsa
uuacuggcguguagauggaauugcuuuuuuaauaugggaagauacauuuauuuuuuuccaugug

SEQ ID NO: 250745 - RNA, 64 nt, hsa
guuccuagguuggacucauacccgaggguggcagugggaagauucgggucucguuucucucugu

SEQ ID NO: 250746 - RNA, 64 nt, hsa
acacaggagucuguucugagguggcaauagcacaugggaagaugaacuuucccuguuuguuuac

SEQ ID NO: 250747 - RNA, 64 nt, hsa
uccauuuaaaacuaauuuauaaacuauguacuccugggaagauuugaaaucuuuuagaaguuug

SEQ ID NO: 250748 - RNA, 64 nt, hsa
agaugaaugagccccagcaguccaaggugugaugugggaagacaccgcagagcucacucaccgg

SEQ ID NO: 250749 - RNA, 64 nt, hsa
aacuugagaccauuuacggggagaaacuugauucugggaagauagcagaguacaaaccagcugc

SEQ ID NO: 250750 - RNA, 64 nt, hsa
cccaggucccucugagcagcccugguaacaagggugggaagaagggacagcuguucuccggccc

SEQ ID NO: 250751 - RNA, 64 nt, hsa
ccaaagaggccacaaagaagaaaaagaaacaguuugggaagaaaaguaagugcugcaccggugc

SEQ ID NO: 250752 - RNA, 64 nt, hsa
ucaauuguagaauuuggaaucuggaauacagaauugggaagaagaacagagaugacaaaagacc

SEQ ID NO: 250753 - RNA, 64 nt, hsa
caaaagguaguauguccaguggcuagagguggggugggaagagaggaggccaggccaggcccuc

SEQ ID NO: 250754 - RNA, 64 nt, hsa
uaugcaaagagaaaggaaaggaugaggugauguauugacucaagguucauucuugcugcaauug

SEQ ID NO: 250755 - RNA, 64 nt, hsa
ccacaugaaggguacacauuagguaagcugggcguugacucaugcgcagucucagucacccgug

SEQ ID NO: 250756 - RNA, 64 nt, hsa
uuucagcaaaacuuauaccuguauauguuuuuauuugacucaaaaauuagauauuuuaccauau

SEQ ID NO: 250757 - RNA, 64 nt, hsa
auucucaagauuuuucuaaauacagccuuuaaauuugacucaaauggaaauugugcacuuuccu

SEQ ID NO: 250758 - RNA, 64 nt, hsa
agcaccuccucaccugccaaucuuugcaauuugcuugacucaccucagacuuuucauucacaac

SEQ ID NO: 250759 - RNA, 64 nt, hsa
cuucauccaaaucgccucaccuacagcagggaaguugacucauccaagcauuuugccauguuuu

SEQ ID NO: 250760 - RNA, 64 nt, hsa
uggaagcuaccagagcucuauccccauccaggucuugacucauggcagcuguuucucaugaagc

SEQ ID NO: 250761 - RNA, 64 nt, hsa
gaguccagagcuugugcuccucuugauuccugguuugacucaguuccaggccugaucuugccug

SEQ ID NO: 250762 - RNA, 64 nt, hsa
caaccguagcaauguggucaucacgaagucuucauugacucacuggcuuggauuuuaggguuag

SEQ ID NO: 250763 - RNA, 64 nt, hsa
uguccuuccgucucacuuuacuagagugcccaaguugacucauccuuacucacucauucccuca

SEQ ID NO: 250764 - RNA, 64 nt, hsa
ucuuagcuguacagaaacagauggugggucagauuugacucacugcccauaguuuccagaccau

SEQ ID NO: 250765 - RNA, 64 nt, hsa
uuaggggaaaaugaaguggcucuugcagcuagaguugacucagaagccgaaauuccuagaaauc

SEQ ID NO: 250766 - RNA, 64 nt, hsa
uugacauaccaaugaucagaaauuuuagugaaacuugacucaacuauacacaaaguucucaucc

SEQ ID NO: 250767 - RNA, 64 nt, hsa
cuuaucugguuaauaauccgaaauguuaccgggguugacucacggaauuaaauuuuuccucuau

SEQ ID NO: 250768 - RNA, 64 nt, hsa
caaacuccagucuguugcaguaacaaacuccagucuguugcaguaacaaacucuagaauauuga

SEQ ID NO: 250769 - RNA, 64 nt, hsa
ucuuucccugucguuugcaguaacaaacuccagucuguugcaguaacaaacuccagucuguugc

SEQ ID NO: 250770 - RNA, 64 nt, hsa
uaaauauuggggucuucugucuaaacuggggucacuguugcauggaacauuguucuuaauaguu

SEQ ID NO: 250771 - RNA, 64 nt, hsa
uauuuguguauggaaaacacuugauauuuuaucccuguugcaucuggcugcacagagccucucc

SEQ ID NO: 250772 - RNA, 64 nt, hsa
ccugggcuuggacuggcuagaaucuuucucuggacuguugcauguacagugccuccauccugga

SEQ ID NO: 250773 - RNA, 64 nt, hsa
ggcucgaaucagagccgugcccaagauaucccugcuguugcaucguuugaagcugacguccugu

SEQ ID NO: 250774 - RNA, 64 nt, hsa
uuggaucuuaccaaugcggcuauaggaaaacagccuguugcaugguaagagugauaccaucuug

SEQ ID NO: 250775 - RNA, 64 nt, hsa
uuuuuagaauuuuuuguagggacagggccucacucuguugcacaagcuggucuugaacuccugg

SEQ ID NO: 250776 - RNA, 64 nt, hsa
uucauauuauaggcagaacacaauggcuaaauaucuguugcauguacuuuaaaguuuauuauaa

SEQ ID NO: 250777 - RNA, 64 nt, hsa
caaauucaaauguuuaugccagcaaauuuuuguacuguugcauaguuaaaaaugcugggagucu

SEQ ID NO: 250778 - RNA, 64 nt, hsa; identical to SEQ ID NO: 247079

SEQ ID NO: 250779 - RNA, 64 nt, hsa; identical to SEQ ID NO: 247080

SEQ ID NO: 250780 - RNA, 64 nt, hsa; identical to SEQ ID NO: 247081

SEQ ID NO: 250781 - RNA, 64 nt, hsa; identical to SEQ ID NO: 247082

SEQ ID NO: 250782 - RNA, 64 nt, hsa; identical to SEQ ID NO: 247083

SEQ ID NO: 250783 - RNA, 64 nt, hsa; identical to SEQ ID NO: 247084

SEQ ID NO: 250784 - RNA, 64 nt, hsa; identical to SEQ ID NO: 247085

SEQ ID NO: 250785 - RNA, 64 nt, hsa; identical to SEQ ID NO: 247086

SEQ ID NO: 250786 - RNA, 55 nt, hsa; identical to SEQ ID NO: 247087

SEQ ID NO: 250787 - RNA, 64 nt, hsa; identical to SEQ ID NO: 247088

SEQ ID NO: 250788 - RNA, 64 nt, hsa; identical to SEQ ID NO: 247089

SEQ ID NO: 250789 - RNA, 64 nt, hsa; identical to SEQ ID NO: 247090

SEQ ID NO: 250790 - RNA, 64 nt, hsa; identical to SEQ ID NO: 247091

SEQ ID NO: 250791 - RNA, 64 nt, hsa; identical to SEQ ID NO: 247092

SEQ ID NO: 250792 - RNA, 64 nt, hsa; identical to SEQ ID NO: 247093

SEQ ID NO: 250793 - RNA, 64 nt, hsa; identical to SEQ ID NO: 247094

SEQ ID NO: 250794 - RNA, 64 nt, hsa
uucuaggacauuggguguuucaagguucuguucagaucccuaugggggcccagcuggcuccacg

SEQ ID NO: 250795 - RNA, 64 nt, hsa
uuucuacuuuacugucucccuagagauccuagaggaucccuacuguuuucuguuuuauguguuu

SEQ ID NO: 250796 - RNA, 64 nt, hsa
uagugcccagcuguagaaucuaccuuagguagaugaucccuagacauacguugguuuugagggc

SEQ ID NO: 250797 - RNA, 64 nt, hsa
uuugaccaaauucucagugauaaauaugugugcagaucccuagaagagaaaacgcugacuuucu

SEQ ID NO: 250798 - RNA, 64 nt, hsa
acgugagaaugcugaauguguaaaguugcagagggaucccuaauuugaagacuuugacacagaa

SEQ ID NO: 250799 - RNA, 64 nt, hsa
ucuuuaacaucuucuuuccuaugcccucucuguggaucccuacugcugguuucugccuucucca

SEQ ID NO: 250800 - RNA, 64 nt, hsa
uauugcuauugcugcuaauuccaugagcugugaagaucccuaaccaacucagcuguaacauaug

SEQ ID NO: 250801 - RNA, 64 nt, hsa
gacuggugggucugucuaccuguuucuucuacaagaucccuauuugacuguaaaaguagcuaau

SEQ ID NO: 250802 - RNA, 64 nt, hsa
ggagaagggcaggagaguaccugggaaucauuacgaucccuagcagcucauccugcccuuugaa

SEQ ID NO: 250803 - RNA, 64 nt, hsa
aagaucuuuguucuauaacuguaaguggagaagagaucccuaauaugccuccugaaaugcagcu

SEQ ID NO: 250804 - RNA, 64 nt, hsa
agguauaacucaaaauccaaagggauagggccaggaucccuauuccuaccccaucuauucucug

SEQ ID NO: 250805 - RNA, 64 nt, hsa
cauaauuuuugucuauucauuuaaaaauuuguuggaucccuagacuaaguugaaauguauuucu

SEQ ID NO: 250806 - RNA, 64 nt, hsa
gagcuaugauccacaaaaacaacuuauuauugaagaucccuauuauguaaguacaguucacguu

SEQ ID NO: 250807 - RNA, 64 nt, hsa
uauguuuuguugcagcugauuccaguuuauaauagaucccuaguaaaaagcuuugauucaacac

SEQ ID NO: 250808 - RNA, 64 nt, hsa
ugagcucggucgcacacucacuucucuuccuugggaucccuaagaccguggaggagagagaggc

SEQ ID NO: 250809 - RNA, 64 nt, hsa
uauugguuuguauuuaauuguuugaaauaaaagugaucccuauauugaaucucaugccuguuaa

SEQ ID NO: 250810 - RNA, 64 nt, hsa
ugccccccauuucuguaacccuccuagcccccuugaucccuaaagaaaacaaacaaacaaacaa

SEQ ID NO: 250811 - RNA, 64 nt, hsa
uggaaaagacagaaaacuaaaaaggaagaaaaaagaucccuauuagauacacuucuuaaauaca

SEQ ID NO: 250812 - RNA, 64 nt, hsa
gaagauucccaacaagaauuuggauggaaaaccugaucccuagcaagaagucugcucuguauca

SEQ ID NO: 250813 - RNA, 64 nt, hsa
auuguauugcuaugcccucccauaaaaacacauugaucccuagcaagauuauugcauuccagau

SEQ ID NO: 250814 - RNA, 64 nt, hsa
auuaagacucuggcagaguuauggguaggauauggaucccuacaugaauaaguccuguaaauac

SEQ ID NO: 250815 - RNA, 64 nt, hsa
cagaaaccuaacaccauguaccagcaguggagcugaucccuacguccgugucuacuuguugcca

SEQ ID NO: 250816 - RNA, 64 nt, hsa
auauggcagagauggggggugguggguggggugggaucccuaacguaauauucuuuaugaaagc

SEQ ID NO: 250817 - RNA, 64 nt, hsa
uaaaaacuuuauuggguuuuuauuguuguuguuugaucccuaacccuacaaagagccuuccuau

SEQ ID NO: 250818 - RNA, 64 nt, hsa
agggagauaguggaaaacuguucuuauaucuucagaucccuagcagaaaugacuguuuauuuca

SEQ ID NO: 250819 - RNA, 64 nt, hsa
gucuaagguaguaacuuuccauagggccuccuuagaucccuaagauggcuuuuucuccuuggua

SEQ ID NO: 250820 - RNA, 64 nt, hsa
gggaccauggagcaguggcacccuauggggcuaugaucccuaggccugggccugggccugccua

SEQ ID NO: 250821 - RNA, 64 nt, hsa
cuuagcaauuuuccagucaccauguccuacuauagaucccuagaacauauuccuccaauguaac

SEQ ID NO: 250822 - RNA, 64 nt, hsa
gagaaccauauuuauuuauaaugaagacaucuaagaucccuaugaugaaugcaggaacucucuu

SEQ ID NO: 250823 - RNA, 64 nt, hsa
ccucccacuguuuuugcuaaaguuacaggaacacgaucccuaguuuucauugauaguaacgcug

SEQ ID NO: 250824 - RNA, 64 nt, hsa
auaagaaaauguaaagguuuuugucuaugaauaugaucccuaauguguuucuuuugacaccuua

SEQ ID NO: 250825 - RNA, 64 nt, hsa
agcaaagaaagaaguagcuuggaacuuuugagaugaucccuaacauacuguacuacuugcuuuu

SEQ ID NO: 250826 - RNA, 64 nt, hsa
uacaaaugaccuugcucuuggauuugcugagcaugaucccuauucugaugucagagauuagguu

SEQ ID NO: 250827 - RNA, 64 nt, hsa
ccccauuuagguuucugaguuccugcaugccggugaucccuagcugugaccucuccccuggaac

SEQ ID NO: 250828 - RNA, 64 nt, hsa
gcccugcccagcaccaccaccuccuaugcuccuggaucccuaggcucuguuccaugagccuguu

SEQ ID NO: 250829 - RNA, 64 nt, hsa
auuugacucaaauauauacuugaccaagcaccaugaucccuaggggcaugagaaaagcacauaa

SEQ ID NO: 250830 - RNA, 64 nt, hsa
aggccaucugaugauagauucccagagcuggauggaucccuagggacuaccuaaucugacuuuc

SEQ ID NO: 250831 - RNA, 64 nt, hsa
gcaaagaaugucuacugcucuuguccuuggcugugaucccuauacauagugugaauuuauaucc

SEQ ID NO: 250832 - RNA, 64 nt, hsa
ugguacuuacagguaccucucuuagggacucugugaucccuaaaauaucagaagaaaaugucug

SEQ ID NO: 250833 - RNA, 64 nt, hsa
uugcugguguggauagaaaccaggcaggacaguagaucccuaugguuggaucucagcuggaagu

SEQ ID NO: 250834 - RNA, 64 nt, hsa
guggagaugaggauggguaacaguauuggggccagaucccuaagccccccagcuguaaauaggc

SEQ ID NO: 250835 - RNA, 64 nt, hsa
ucauucagaagcgccauaagucaguugaguauuugaucccuagauaagaacaugcaaaucagca

SEQ ID NO: 250836 - RNA, 64 nt, hsa
ccccucaaaccugugucuggggugugggcucacagaucccuaucagccugguucgugggagggc

SEQ ID NO: 250837 - RNA, 64 nt, hsa
ccgccgcccuccaccccugccuuucagcguuguggaucccuagagguggcccccugcccgaucc

SEQ ID NO: 250838 - RNA, 64 nt, hsa
cauuauucuauaauucaggaccacaguggaguaugaucccuaacuccugauuuggaugcaucug

SEQ ID NO: 250839 - RNA, 64 nt, hsa
ggcccugaaacugauguccuagcaauaaccucuugaucccuacucaccgaguguugagcccaag

SEQ ID NO: 250840 - RNA, 58 nt, hsa
agaagaagaaggagugguaacagucacagaucccuaccugccuggcuaagacccgugg

SEQ ID NO: 250841 - RNA, 64 nt, hsa
ggacaccgggugaccccuuagggcacccaggcaagaucccuaagaggcacccaaugcccaggcc

SEQ ID NO: 250842 - RNA, 64 nt, hsa
gggaaacauucccauccauuguuccuggaaaggugaucccuaccacgggaucccaaacuuggau

SEQ ID NO: 250843 - RNA, 64 nt, hsa
gcauuaaagaauccuuguuggaugguagaaaucagaucccuaaccagugggagguacuuuuugg

SEQ ID NO: 250844 - RNA, 64 nt, hsa
uuuguuucuaugauguugugcaucaaaugauugagaucccuaaacuuuuguguuggaugguuuu

SEQ ID NO: 250845 - RNA, 64 nt, hsa
ccacagccacacaaccagagggugcacaugacuugaucccuaugaccaagucaaguugguguug

SEQ ID NO: 250846 - RNA, 64 nt, hsa
uaauguucuuacacuguguuuuuugacuucuuaugaucccuaauucugagacuuacucaucugg

SEQ ID NO: 250847 - RNA, 64 nt, hsa
aggugucuuuugagagcauucaguaggacauggugaucccuauuucagccucuaagaugacugg

SEQ ID NO: 250848 - RNA, 64 nt, hsa
ggcccugguugaaucuggcaauucuuuuugccaagaucccuagcagaagauuuagccauguccu

SEQ ID NO: 250849 - RNA, 64 nt, hsa
gcuuuauccaacaaaauguaaggagccaauaagggaucccuauuugucucuuuuggugucuauu

SEQ ID NO: 250850 - RNA, 64 nt, hsa
uacagguaggcuaguauuauuuuucuaguuaguagaucccuagacauggaaucagggcagccaa

SEQ ID NO: 250851 - RNA, 64 nt, hsa
cuaaacaguugaugggguaucucuugauuagggggaucccuaauauccccagccccagccagaa

SEQ ID NO: 250852 - RNA, 64 nt, hsa
ucaguuccauuucagguuaccugggguauaccuugaucccuagagugacuggcagaguaagaga

SEQ ID NO: 250853 - RNA, 64 nt, hsa
uuuuagucauuaaaaaaaaucuagucaccaggaggaucccuaugacucaaaauaacuuguuugu

SEQ ID NO: 250854 - RNA, 64 nt, hsa
gguuaguguacuaguccaucauagccuagaaaaugaucccuaucugcagaucaagauuuucuca

SEQ ID NO: 250855 - RNA, 64 nt, hsa
auacuuaagcaugaagugacuuuuauaaugacucgaucccuagacauuuguuacagauaguuuu

SEQ ID NO: 250856 - RNA, 64 nt, hsa
gccuaaaaccacacucagaaacgaggaccuagaagaucccuaaaacagaauaagaacaaaugug

SEQ ID NO: 250857 - RNA, 64 nt, hsa
uugcagcgaucccagagcguugauaacgugaucugaucccuaaguugagaccugucuuccugua

SEQ ID NO: 250858 - RNA, 64 nt, hsa
acacauacguaugcaaauauuauaguauaauagugaucccuauggagaauuaaaggugagaaag

SEQ ID NO: 250859 - RNA, 64 nt, hsa
aauaaaaagaggaaaggcuggaagcugcagacaggaucccuagcuuguuuucugucagucauuc

SEQ ID NO: 250860 - RNA, 64 nt, hsa
ccaguggggggagaaucuucaggugagugacucugaucccuacucaugacacggaggugacucg

SEQ ID NO: 250861 - RNA, 63 nt, hsa
cuuuguguaauauuuauaugauaaaagacauuaggaucccuacaacacaaaugucuuguguuu

SEQ ID NO: 250862 - RNA, 64 nt, hsa
cugaggaugggccugcccugucugggguaugcgugaucccuagauacauguucccacagaggug

SEQ ID NO: 250863 - RNA, 64 nt, hsa
uguaggccaaauuucauuucagccacuucugcaggaucccuacugccaaccuggaauggagacu

SEQ ID NO: 250864 - RNA, 64 nt, hsa
ucccaggauccucucuuugggagcgaagccagaggaucccuacagcacucaagcuucauggugg

SEQ ID NO: 250865 - RNA, 64 nt, hsa
aguggcuugguuccccaucuccucgccagcugcugaucccuacacgggcaggacagaugggcag

SEQ ID NO: 250866 - RNA, 64 nt, hsa
gguagaaaaguuuuuuugguuuuaucucuuuugcgaucccuaaauugccaccuuucuauuguuu

SEQ ID NO: 250867 - RNA, 64 nt, hsa
gguuacauugguuuauagcaucccaagaacuguagaucccuaggccccugagagcuggacagag

SEQ ID NO: 250868 - RNA, 64 nt, hsa
cccuuuguccuccccauagagcuggggugggguggaucccuauaccuggggcaggcagccccaa

SEQ ID NO: 250869 - RNA, 64 nt, hsa
ggaggugcuguuaucucguaccuccugggauggcgaucccuacugaacgcuugugucucagggu

SEQ ID NO: 250870 - RNA, 64 nt, hsa
uuuguaugucuguguauguauaggggaaagaagggaucccuaacuguucccuuaucuguuuucu

SEQ ID NO: 250871 - RNA, 64 nt, hsa
acugguccaguccauugaagacccuauuuugggugaucccuaucuugcagaaugucuguaggaa

SEQ ID NO: 250872 - RNA, 64 nt, hsa
ccaaaacauuugacuccagugagggcucaaguuagaucccuauagaaagaggacacuucaucuu

SEQ ID NO: 250873 - RNA, 64 nt, hsa
cucuugcuugugccuuccacaccuucucggugcagaucccuaugggggagcugccucacguucu

SEQ ID NO: 250874 - RNA, 64 nt, hsa
guauuucauuaauguuaaaaauuuucagcguauagaucccuaugcauuuuuguuagaauuugca

SEQ ID NO: 250875 - RNA, 64 nt, hsa
ccucagccacuggagacugaugauccaaccacaggaucccuacucuuuggccacgagaucccag

SEQ ID NO: 250876 - RNA, 64 nt, hsa
caggugaguaacuucaaaugagguuguuggguucgaucccuaaucugacaucacuggugucccu

SEQ ID NO: 250877 - RNA, 64 nt, hsa
aguauuacacagccauaaaaaggaaugaagcagugaucccuacuacacuguggaugaaccuuga

SEQ ID NO: 250878 - RNA, 64 nt, hsa
acacuguacacuguuccuuuucacccaccaccccgaucccuaggugaggagaagcggcuugaag

SEQ ID NO: 250879 - RNA, 64 nt, hsa
ggcuucggggacgcggggcgcuucucgggcgggugaucccuaacagggcggcuucccagggcug

SEQ ID NO: 250880 - RNA, 64 nt, hsa
aacaaggcaagccaaaggcgccccuccccagagggaucccuaacgugcccagcauguagauucu

SEQ ID NO: 250881 - RNA, 64 nt, hsa
uccuguugaucaugaugauaaaguaaugauggcugaucccuauuugugacuuccuucagcaaau

SEQ ID NO: 250882 - RNA, 64 nt, hsa
guguauguuuuuaaagcuaaaaacauuacuuuuagaucccuagaaugaaaauuuuuuucucauc

SEQ ID NO: 250883 - RNA, 64 nt, hsa
uacccuagaaaacagcugcaaaugccagaaagaugaucccuaaaaauguugagggacuucuguu

SEQ ID NO: 250884 - RNA, 64 nt, hsa
cacuaagauuccugugccuuuuaaggcagagggagaucccuauggcguuagucuucccaggccu

SEQ ID NO: 250885 - RNA, 64 nt, hsa
gggaugaggaaauaguucauagcuucgugcaggugaucccuauucugcguguauguguuugcac

SEQ ID NO: 250886 - RNA, 64 nt, hsa
guucuggcugaagggcuaucucuggcaccucugagaucccuagguccugcccuccugguccgug

SEQ ID NO: 250887 - RNA, 64 nt, hsa
aaaaggaaguuaugggaauaccuguggugguugugaucccuaggucuugggagcucuuggaggu

SEQ ID NO: 250888 - RNA, 64 nt, hsa
aacuuaccccggccagccagcccucucacccgaggaucccuacccccuggccccacaauaaaca

SEQ ID NO: 250889 - RNA, 64 nt, hsa
caguagcaguauuuuugcccucccgcccugucuggaucccuaagcugucccucucccaaucucu

SEQ ID NO: 250890 - RNA, 64 nt, hsa
ccucagaguagcaucuucacaguaacgcacggacgaucccuaaacugccuuguaaacaaaaaug

SEQ ID NO: 250891 - RNA, 64 nt, hsa; identical to SEQ ID NO: 128751

SEQ ID NO: 250892 - RNA, 64 nt, hsa; identical to SEQ ID NO: 128752

SEQ ID NO: 250893 - RNA, 64 nt, hsa; identical to SEQ ID NO: 128753

SEQ ID NO: 250894 - RNA, 64 nt, hsa; identical to SEQ ID NO: 128754

SEQ ID NO: 250895 - RNA, 64 nt, hsa; identical to SEQ ID NO: 128755

SEQ ID NO: 250896 - RNA, 64 nt, hsa; identical to SEQ ID NO: 128756

SEQ ID NO: 250897 - RNA, 64 nt, hsa; identical to SEQ ID NO: 128757

SEQ ID NO: 250898 - RNA, 64 nt, hsa; identical to SEQ ID NO: 128758

SEQ ID NO: 250899 - RNA, 64 nt, hsa; identical to SEQ ID NO: 128759

SEQ ID NO: 250900 - RNA, 64 nt, hsa; identical to SEQ ID NO: 128760

SEQ ID NO: 250901 - RNA, 64 nt, hsa; identical to SEQ ID NO: 128761

SEQ ID NO: 250902 - RNA, 64 nt, hsa; identical to SEQ ID NO: 128762

SEQ ID NO: 250903 - RNA, 64 nt, hsa; identical to SEQ ID NO: 128763

SEQ ID NO: 250904 - RNA, 64 nt, hsa; identical to SEQ ID NO: 128764

SEQ ID NO: 250905 - RNA, 64 nt, hsa; identical to SEQ ID NO: 128765

SEQ ID NO: 250906 - RNA, 64 nt, hsa; identical to SEQ ID NO: 128766

SEQ ID NO: 250907 - RNA, 64 nt, hsa; identical to SEQ ID NO: 128767

SEQ ID NO: 250908 - RNA, 64 nt, hsa; identical to SEQ ID NO: 128768

SEQ ID NO: 250909 - RNA, 64 nt, hsa; identical to SEQ ID NO: 128769

SEQ ID NO: 250910 - RNA, 64 nt, hsa; identical to SEQ ID NO: 128770

SEQ ID NO: 250911 - RNA, 64 nt, hsa; identical to SEQ ID NO: 128771

SEQ ID NO: 250912 - RNA, 64 nt, hsa; identical to SEQ ID NO: 128772

SEQ ID NO: 250913 - RNA, 64 nt, hsa; identical to SEQ ID NO: 128773

SEQ ID NO: 250914 - RNA, 64 nt, hsa; identical to SEQ ID NO: 128774

SEQ ID NO: 250915 - RNA, 64 nt, hsa; identical to SEQ ID NO: 128775

SEQ ID NO: 250916 - RNA, 64 nt, hsa; identical to SEQ ID NO: 128776

SEQ ID NO: 250917 - RNA, 64 nt, hsa; identical to SEQ ID NO: 128777

SEQ ID NO: 250918 - RNA, 64 nt, hsa; identical to SEQ ID NO: 128778

SEQ ID NO: 250919 - RNA, 64 nt, hsa; identical to SEQ ID NO: 128779

SEQ ID NO: 250920 - RNA, 64 nt, hsa; identical to SEQ ID NO: 128780

SEQ ID NO: 250921 - RNA, 64 nt, hsa; identical to SEQ ID NO: 128781

SEQ ID NO: 250922 - RNA, 64 nt, hsa; identical to SEQ ID NO: 128782

SEQ ID NO: 250923 - RNA, 64 nt, hsa; identical to SEQ ID NO: 128783

SEQ ID NO: 250924 - RNA, 64 nt, hsa; identical to SEQ ID NO: 128784

SEQ ID NO: 250925 - RNA, 64 nt, hsa; identical to SEQ ID NO: 128785

SEQ ID NO: 250926 - RNA, 64 nt, hsa; identical to SEQ ID NO: 128786

SEQ ID NO: 250927 - RNA, 64 nt, hsa; identical to SEQ ID NO: 128787

SEQ ID NO: 250928 - RNA, 64 nt, hsa; identical to SEQ ID NO: 128788

SEQ ID NO: 250929 - RNA, 64 nt, hsa; identical to SEQ ID NO: 128789

SEQ ID NO: 250930 - RNA, 64 nt, hsa
gguuugggggcuguggggaaggagaguccccugaaggucugacacgucugccuacccauucgug

SEQ ID NO: 250931 - RNA, 64 nt, hsa
uuucagaagagaugggcuuguuuucuugccaaugaggucugaaauggagguccuucugcuggau

SEQ ID NO: 250932 - RNA, 64 nt, hsa
gaaggccuugcccuaagcuaccugaggguuuaggaggucugaacacacacaguggagagguuaa

SEQ ID NO: 250933 - RNA, 64 nt, hsa
uugcccuuauuccuccaccccacuucuuuuagcaaggucugaaaguuucaaagggagaccuaua

SEQ ID NO: 250934 - RNA, 64 nt, hsa
agcuccagcucaggucugagacccgugcugagaaaggucugagcaccgaccgugcccucugccc

SEQ ID NO: 250935 - RNA, 64 nt, hsa
gggugcugccucuuccuccaguuagcuccagcucaggucugagacccgugcugagaaaggucug

SEQ ID NO: 250936 - RNA, 64 nt, hsa
agucagacauuggaauuggaagaacuauaaagugugauucgaucgucaagacaucacuuggauu

SEQ ID NO: 250937 - RNA, 64 nt, hsa
auagucaggagaagguaacauuggaguccugguuugauucgaaggaugaagacgaagaagcaag

SEQ ID NO: 250938 - RNA, 64 nt, hsa
caaaaauaacugcaaggaggggcaagagaaaggaugauucgaggcaccuuggcccuucaagguc

SEQ ID NO: 250939 - RNA, 64 nt, hsa
gauguguuuguuaugaagaaaaucuggaugccugugauucgagaauugaaccugaaacccaaag

SEQ ID NO: 250940 - RNA, 64 nt, hsa
uauuuauuaucaugacaauguuggaauuaaauuuugauucgaauaugucugccugggggugggg

SEQ ID NO: 250941 - RNA, 64 nt, hsa
ugcuacugguuaaaggaccaccauuuaauuaacaugauucgaaagccuuccucggguucaaagc

SEQ ID NO: 250942 - RNA, 64 nt, hsa
uauauccuaugauacaacucuaaguguuaucacuugauucgaaagggucagaagaccaguuuuu

SEQ ID NO: 250943 - RNA, 64 nt, hsa
agguacaaugcaugcaucacagacuguauuugauugauucgagucuucaaauauuguuuaaugg

SEQ ID NO: 250944 - RNA, 64 nt, hsa
uuaagucagaacagcagacucagcucugacauucugauucgaaugacacuguucaggaaucgga

SEQ ID NO: 250945 - RNA, 64 nt, hsa
cuuccccagcucagagccccgccccaccccguccugauucgagguccuccuggccugagcgcag

SEQ ID NO: 250946 - RNA, 64 nt, hsa
aucaugagaauagcacaggaaagacuggccccccugauucgaugaccucccccugggucccucc

SEQ ID NO: 250947 - RNA, 64 nt, hsa
ccggguugguggccauggagggucuugucugcugugauucgacucuggaugcugugagcuugau

SEQ ID NO: 250948 - RNA, 64 nt, hsa
gaauccggaauacauagggccucucccacagcccugauucgacugcaccaauucuugauuuggg

SEQ ID NO: 250949 - RNA, 64 nt, hsa
aagcgugaaugaggaacagaagaagcagagcagaugauucgagcagcauuuguuucuccccaca

SEQ ID NO: 250950 - RNA, 64 nt, hsa
acacauagcaaaauucaugugacggaugauaaauugauucgaaaagcuggucccccaggaucua

SEQ ID NO: 250951 - RNA, 64 nt, hsa
cugcugauuguggggcugggagguggagggccccugauucgaaggccauuuggugaguguuuug

SEQ ID NO: 250952 - RNA, 64 nt, hsa
ucucaguaaggaguguuugaguugaagagucaucugauucgaggccacucauguucuuuguaac

SEQ ID NO: 250953 - RNA, 64 nt, hsa
guacaguugggaaaauauguccauaucuaaccagugauucgagcuauauuuaaguauucaagaa

SEQ ID NO: 250954 - RNA, 64 nt, hsa
ccuccucuuccuccuucucuacaaaagcuccgguugauucgagggaaguggugaaaauuuuuuu

SEQ ID NO: 250955 - RNA, 64 nt, hsa
uuucuugucuccagguacaccgugcuccggcuaaugauucgacagaggcuggaggagauagccg

SEQ ID NO: 250956 - RNA, 64 nt, hsa
gucugugguuuaagcuuugugaaagaaugugcuuugauucgaagggucuuaaagaauuuuuuua

SEQ ID NO: 250957 - RNA, 64 nt, hsa
gauaugggacauuucuauaaucuauauucuaauuugauucgauuauugagucguaaguauuaau

SEQ ID NO: 250958 - RNA, 64 nt, hsa
ucuaaucaauaaaauauauuuuugacuaaauuauugauucgauaugaaaaaucaacuaagauua

SEQ ID NO: 250959 - RNA, 64 nt, hsa
auuaauuucccuaaagugaauggucauugucuaaugauucgaugcgcuacagucuacaguguua

SEQ ID NO: 250960 - RNA, 64 nt, hsa
uuccuucacagauacuuaagaccuccaccaugucugauucgaguucucccugggaggguuuaga

SEQ ID NO: 250961 - RNA, 64 nt, hsa
uauguuaucuuccauucuauuuuuaucugcuuuuugcugcuaguuucaaacugccaguauuuuu

SEQ ID NO: 250962 - RNA, 64 nt, hsa
agaccauucgcgauuuagaaguuguggagggaagugcugcuagauuugacugcaagauugaagg

SEQ ID NO: 250963 - RNA, 64 nt, hsa
auaugagaauguuuugcguaggggcaacacagucugcugcuauauagugggggaagcgugcacu

SEQ ID NO: 250964 - RNA, 64 nt, hsa
uuuaaacauuuuuaaucacaagcuguauuagcuuugcugcuauauagguguuauguguaaaugc

SEQ ID NO: 250965 - RNA, 64 nt, hsa
uuaauuuuguaaaugccaaaugaaaaacguuuuuugcugcuauggucuuagccuguagacaugc

SEQ ID NO: 250966 - RNA, 64 nt, hsa
cguuuuuugcugcuauggucuuagccuguagacaugcugcuaguaucagaggggcaguagagcu

SEQ ID NO: 250967 - RNA, 64 nt, hsa
ccuuugggauuucaggugucccaugaucuugaugugcugcuaggcuggagcacacacuggccau

SEQ ID NO: 250968 - RNA, 64 nt, hsa
aacaguauuuaacuugaaauucaucaugggagucugcugcuauaccaggcacaagauaaaacuc

SEQ ID NO: 250969 - RNA, 64 nt, hsa
ugugucucguaaaggucaucucacggaauccaauugcugcuaccucaccauguugcugugcccu

SEQ ID NO: 250970 - RNA, 64 nt, hsa
ccccacucacuuugugugcucuuaaccuucugagugcugcuagcccagaccuguggacgaggca

SEQ ID NO: 250971 - RNA, 64 nt, hsa
aggacggucuacucagcacaacugacugcuucagugcugcuaucagaagaugucuucuaucuuu

SEQ ID NO: 250972 - RNA, 64 nt, hsa
caauagccauaauuuuaccagccuuucugucauaugcugcuauuacaaaguggaagcuguugaa

SEQ ID NO: 250973 - RNA, 64 nt, hsa
uuuauuuccaaauuguuaaagagccagccauugaugcugcuacaugaguuccaugcucaagagc

SEQ ID NO: 250974 - RNA, 64 nt, hsa
cugucuugcagacagagacccuuggcuaccacugugcugcuaauaggauaaguacucuguugcc

SEQ ID NO: 250975 - RNA, 64 nt, hsa
aaacuaacacucccccuccuccaccccagccugcugcugcuacugcugcccgcugcugcucugu

SEQ ID NO: 250976 - RNA, 64 nt, hsa
aagaagagagggcugggcggggaggagcugcuacugcugcuaccgaggcugugggccucauccu

SEQ ID NO: 250977 - RNA, 64 nt, hsa
ucuuguucuucuuaaaugugacaugaaauaauugugcugcuacauuauacuggaaauuaacagg

SEQ ID NO: 250978 - RNA, 64 nt, hsa
uggauuagggugggaucuuugaaaagcugacauuugcugcuaucauuccaacacuaaauucuua

SEQ ID NO: 250979 - RNA, 64 nt, hsa
gaugacgccccagaaaugcugcuuccauaucagcugcugcuagcgccagcgcagacucucaggg

SEQ ID NO: 250980 - RNA, 64 nt, hsa
aagaugacacguggugauugugaagaugguaauuugcugcuaauagaguccucaaaggguuaag

SEQ ID NO: 250981 - RNA, 64 nt, hsa
uuuaagucuuauuuuuacuguuuauauauuugaaugcugcuacaacagaugaucuucaucccug

SEQ ID NO: 250982 - RNA, 64 nt, hsa
ugugcauuaauauuuucaauuuguuuaaccacuuugcugcuaagauuuugccgucccauuccca

SEQ ID NO: 250983 - RNA, 64 nt, hsa
ccagccaccuccagacaccagugcgugcucccgaugcugcuauggaaggugcuacuugaccuaa

SEQ ID NO: 250984 - RNA, 64 nt, hsa
aguguacaaugccuuugaugaacuguuuuguaagugcugcuauaucuauccauuuuuuaauaaa

SEQ ID NO: 250985 - RNA, 64 nt, hsa
uuacaacaagcccuacaauuagagauugcugaacugcugcuaaagugauuuuuuuuuuauuuga

SEQ ID NO: 250986 - RNA, 64 nt, hsa
ccuaacauuuuguucccauuaccagaagcaaagcugcugcuaacccaacaucuggcacauagga

SEQ ID NO: 250987 - RNA, 61 nt, hsa
aggccaaaaauggugagcgaucauuuauuucaugauucaaccugauacauuuacauagugc

SEQ ID NO: 250988 - RNA, 61 nt, hsa
gggguggugcuagaagacagacaucuguggaaugauucacauccucucaaguuaggaggau

SEQ ID NO: 250989 - RNA, 61 nt, hsa
guaaccaacuuggaaagcuguauuuguucccaugauucagcaaacaaugaguaccuacugu

SEQ ID NO: 250990 - RNA, 61 nt, hsa
augaacauuuugauacaaauuucaucauuuaaugauucaccaauuucuugcauuaauuuga

SEQ ID NO: 250991 - RNA, 61 nt, hsa
uuuuuuuccuaaccuuuugcuauuauaaauaaugauucauuuuauaaccuuuuauauaggu

SEQ ID NO: 250992 - RNA, 61 nt, hsa
uaaguaaagcacagucccuaggacauaguaaaugauucauauauccgaacuacuguuauaa

SEQ ID NO: 250993 - RNA, 61 nt, hsa
aaaccaggauggaugccucacauagaucaugaugauucaauccaaaggcacuuugcagugc

SEQ ID NO: 250994 - RNA, 61 nt, hsa
guuccuuauacucuauuauauaguguuauucaugauucagcugaucuuaacaaaauucgua

SEQ ID NO: 250995 - RNA, 61 nt, hsa
guagcugagaauucaaaaacauccuugcagaaugauucaaaagacaaaagccaggcucaac

SEQ ID NO: 250996 - RNA, 61 nt, hsa
uguuauaucugcauaugagugauaugugaucaugauucauuuugcagauuuacauuuugcu

SEQ ID NO: 250997 - RNA, 61 nt, hsa
acuugggcugcuggugccuugagucccacagaugauucauuaggaaaagccagauauacca

SEQ ID NO: 250998 - RNA, 61 nt, hsa
cuuacuucuacagguuccuugagcaccaaagaugauucauaacucuguauaggugacagcu

SEQ ID NO: 250999 - RNA, 61 nt, hsa
accaagcccugguagggaagagguaagggggaugauucaccuccauauuuccuaagcaggu

SEQ ID NO: 251000 - RNA, 61 nt, hsa
ucaucugaagagagacuuaagaugaaagcaaaugauucagcucccuuauacccccauuaaa

SEQ ID NO: 251001 - RNA, 61 nt, hsa
auguuauucuagaauguuuucuuuccagaugaugauucagaagcuaauuuuaaaaaacggu

SEQ ID NO: 251002 - RNA, 61 nt, hsa
ugaggcuaaguuuuggacuaccaaggaccagaugauucacauguaggaaacagccagaagc

SEQ ID NO: 251003 - RNA, 61 nt, hsa
ugguaauccugaaucucuuuuaaacuauuauaugauucauaaugguucucaggaauuaaua

SEQ ID NO: 251004 - RNA, 61 nt, hsa
gcuuaucgugucugggguucaccggaaauaaaugauucacuggaacaauucuacugucaaa

SEQ ID NO: 251005 - RNA, 61 nt, hsa
auaagaaauaaaaauugggcaauaaaauaaaaugauucaguguuucuuuucuauauuguca

SEQ ID NO: 251006 - RNA, 61 nt, hsa
ugacugucaguuguaucuguugcuuuucucaaugauucagggauacaaaugggcuucucuc

SEQ ID NO: 251007 - RNA, 61 nt, hsa
gacuuauuucugcucuggaauaaaguugcagaugauucaaaccgaucuuggcuuucagucu

SEQ ID NO: 251008 - RNA, 61 nt, hsa
cggacuaagcuguaauuaugauggcugagaaaugauucauuugaagauacaauuuuauuug

SEQ ID NO: 251009 - RNA, 61 nt, hsa
ggggaugauguggaaauaggggcacacacagaugauucauggauggggacauggaaaugag

SEQ ID NO: 251010 - RNA, 61 nt, hsa
uuaagugucuguguagacaaccaaagaauaaaugauucaugguuuuuuuuacuugguuugu

SEQ ID NO: 251011 - RNA, 61 nt, hsa
auguaugauuugugccacugaucuuaaaccuaugauucaguaacuucuuaccauauaaaaa

SEQ ID NO: 251012 - RNA, 61 nt, hsa
cucuauaccaagauaugcuaggaguaggaugaugauucaaagugguaacccaaauucauaa

SEQ ID NO: 251013 - RNA, 61 nt, hsa
uccuaacuuucuguuauuuuagaauguuaacaugauucacauuauacuuucucuuaguuaa

SEQ ID NO: 251014 - RNA, 61 nt, hsa
cugcagggcuggaggaacagguucuuagaagaugauucaccuuggaggaagcuggggaaag

SEQ ID NO: 251015 - RNA, 61 nt, hsa
uuuucuaaucuuuaguagauuugauuaaauaaugauucacagaauuuaguaacagaaucaa

SEQ ID NO: 251016 - RNA, 61 nt, hsa
ccaugacccagccacagucaauaccagaaagaugauucagagucugaaguggugccccagg

SEQ ID NO: 251017 - RNA, 61 nt, hsa
cacucagaugaccugaguuguggagagauguaugauucaaacauagaugacuggauuccug

SEQ ID NO: 251018 - RNA, 61 nt, hsa
accaugagaacaguaugggggaaacaacuccaugauucaguuaucucccaccagguuccuc

SEQ ID NO: 251019 - RNA, 61 nt, hsa
cuaucaauagaguaaccucauucucugccugaugauucaaaggcaugggaagaccaaaacc

SEQ ID NO: 251020 - RNA, 61 nt, hsa
ugauaccuuuguugaaagaauugugaauagcaugauucauuucuagcagaggcugaguuua

SEQ ID NO: 251021 - RNA, 61 nt, hsa
uuuaaagagauugugucuguuuaaaaucaguaugauucagagaaggaccaaauuauaugaa

SEQ ID NO: 251022 - RNA, 61 nt, hsa
ugcaggcugucacaugacucauugaguaguaaugauucagaagaaaaagaaaaaggagacu

SEQ ID NO: 251023 - RNA, 61 nt, hsa
uaaaacugacauaaaauuuuaugauaauaacaugauucaagaaaugugauguagauuuuug

SEQ ID NO: 251024 - RNA, 61 nt, hsa
uuggcuucuggucuugauguauuugauaagaaugauucauuuucugauauggcuuccuaau

SEQ ID NO: 251025 - RNA, 61 nt, hsa
agguugaauaugguaggucuuugaaaauaugaugauucaauuuucucaauuuucuuugcuu

SEQ ID NO: 251026 - RNA, 61 nt, hsa
gucauagaggaaaagcacagauuauaccuggaugauucaggagcacauucugauuccaggu

SEQ ID NO: 251027 - RNA, 61 nt, hsa
ugaauguauuguucuguuuguguuauuucagaugauucaaauaucaaaaggaagauucuuc

SEQ ID NO: 251028 - RNA, 61 nt, hsa
gacauauugcuacaaagauuuuuuuuccuaaaugauucaguaauugaaugauuauuuaaua

SEQ ID NO: 251029 - RNA, 61 nt, hsa
uauauuguaaugauguuagauaauacucaacaugauucaguaugacaaacuuuuuugagca

SEQ ID NO: 251030 - RNA, 61 nt, hsa
uauugacgguacagaugguccccaacuuguaaugauucaauuuaggguuuuucaacuuuac

SEQ ID NO: 251031 - RNA, 61 nt, hsa
uacaaaauccagcuaugaauauagagggcuuaugauucagauuguuaucuaucaacuauaa

SEQ ID NO: 251032 - RNA, 61 nt, hsa
guaacaccuaacugagccucacucacauuaaaugauucacuugaaauauauacagaaauug

SEQ ID NO: 251033 - RNA, 61 nt, hsa
cucuuauauguaccauugguugauaauuauaaugauucauuuggacuugaagaaagauugu

SEQ ID NO: 251034 - RNA, 61 nt, hsa
cccaggcacaguaucugaaucacuggggauuaugauucacccucuuuggagaacaugcucu

SEQ ID NO: 251035 - RNA, 61 nt, hsa
cacgagaauagcacgggaaagacuggcccccaugauucaauuaccucccccugggucuguc

SEQ ID NO: 251036 - RNA, 61 nt, hsa
cacaagaauagcaugggaaagacuggcccccaugauucaauuaccuccccuugggucucuc

SEQ ID NO: 251037 - RNA, 61 nt, hsa
uaggcagggaaaacugaacaaaaaggcagaaaugauucaggggaaaaucgggccuagaauu

SEQ ID NO: 251038 - RNA, 61 nt, hsa
aucauuuucugcccccccaaaaucuguugaaaugauucacugaugcaaaacauucacccgu

SEQ ID NO: 251039 - RNA, 61 nt, hsa
uugaaaauauuguuacaaaggcacugcuaaaaugauucacagggagaguggccaguuggaa

SEQ ID NO: 251040 - RNA, 61 nt, hsa
gguauuaauaagaggucuggcagguauucccaugauucacagaguuacauuugcauuuaau

SEQ ID NO: 251041 - RNA, 61 nt, hsa
aguuuacaugaauuuuacaacaaacuagugcaugauucaccaagcaguacuacagaacaaa

SEQ ID NO: 251042 - RNA, 61 nt, hsa
aguuucauugguggaauaaguccccuuacucaugauucaucaauauuccuauauuaaaauu

SEQ ID NO: 251043 - RNA, 61 nt, hsa
uggaaggaaagcugggacaagcagggaacgcaugauucagggaugcugucacucggcagcc

SEQ ID NO: 251044 - RNA, 61 nt, hsa
ucuucccccacccccauuugcugguucagcuaugauucaggcuucuucagcccucccaaau

SEQ ID NO: 251045 - RNA, 61 nt, hsa
aacucauggguacccagacucuaaauauuucaugauucacaacuaggaccucauaucuucc

SEQ ID NO: 251046 - RNA, 61 nt, hsa
caaccuaaguaaaaacauuccccuccuauguaugauucauuugaucauauaaaacaucaug

SEQ ID NO: 251047 - RNA, 61 nt, hsa
ugauugacccugauuuuaauugugaaauuauaugauucauauauuuuaugaaucagaauaa

SEQ ID NO: 251048 - RNA, 61 nt, hsa
aacccuaaauauguuuacauaccauuaagauaugauucauguaacaauguuaaauuaauua

SEQ ID NO: 251049 - RNA, 57 nt, hsa
ggcaugcuaaaaauaauugagguuuucaugauucagcaccugcuuuuguuucuguga

SEQ ID NO: 251050 - RNA, 61 nt, hsa
uagaaguuaugaguggguuuaacaauuuuagaugauucagcuuuuguuccauuacuguuga

SEQ ID NO: 251051 - RNA, 61 nt, hsa
aggagugagacacaggcaucaacacucucaaaugauucacauguucagccaaaguugagaa

SEQ ID NO: 251052 - RNA, 61 nt, hsa
uugguguuguuauggcaaguuuuugguaaugaugauucaaucauuuugggaaauucuugca

SEQ ID NO: 251053 - RNA, 61 nt, hsa
ugagagaaaucacaaaguauuagaguuuaccaugauucagagaaguucuucaggccuguag

SEQ ID NO: 251054 - RNA, 61 nt, hsa
aacuccaguucaugcuggaucuuaaccaaaaaugauucaauacuguuaucacuaaaacagc

SEQ ID NO: 251055 - RNA, 61 nt, hsa
ugauuacaguauuuuaugcagacuauuaggaaugauucagugcauuuaacugaacacagag

SEQ ID NO: 251056 - RNA, 61 nt, hsa
uuguccucacaggcaugccacguggccugagaugauucagaacaaaucaugcuaacuuuga

SEQ ID NO: 251057 - RNA, 61 nt, hsa
cuaggccugcuggcucugguuuucuaugcagaugauucauuggauugggggugaguguuuu

SEQ ID NO: 251058 - RNA, 61 nt, hsa
aauacacuuguguuuaagcaccauggccuugaugauucacuguuggggagaagaaacaaga

SEQ ID NO: 251059 - RNA, 61 nt, hsa
uuggaucauuuguuuuuaaaacuacuuagguaugauucacauacaaaaagcugcacauauu

SEQ ID NO: 251060 - RNA, 61 nt, hsa
uuggugauaaguggaaaaaagagaaaaaccaaugauucauaacaauguaugugaaagugua

SEQ ID NO: 251061 - RNA, 61 nt, hsa
ucauauggccccucuuaaccaugcugguguuaugauucaguauuaacucucaauuagcaug

SEQ ID NO: 251062 - RNA, 61 nt, hsa
uaucguguauauagcuuuaguauucgguuacaugauucacagaccccugaauuccaaaaua

SEQ ID NO: 251063 - RNA, 61 nt, hsa
aggguaugaacuagucaaaauaugaaccauuaugauucaaguuagauuuuccucuggagag

SEQ ID NO: 251064 - RNA, 61 nt, hsa
uuacuuucuacaaacucuccguaguauauucaugauucaguguagaauguauagacuuuau

SEQ ID NO: 251065 - RNA, 61 nt, hsa
uaacuuguuaagcaauauuuuuaagggccaaaugauucaaaacaucacagguauuuaugug

SEQ ID NO: 251066 - RNA, 61 nt, hsa
aauagccaugacaagaguuugcauuuucuugaugauucaucuccaugagugcacaaucccu

SEQ ID NO: 251067 - RNA, 61 nt, hsa
guuacuagcaucaggagcuuacuguuuuauuaugauucaucuucaguaauuuuuagaagca

SEQ ID NO: 251068 - RNA, 61 nt, hsa
acagaguuuaaauaauuucaguaauucuuagaugauucagcuucaucauuaagaauaucuu

SEQ ID NO: 251069 - RNA, 61 nt, hsa
acaccuaagagaaaaagaucgaauuuuucagaugauucagaaauuuucauucagguauuug

SEQ ID NO: 251070 - RNA, 61 nt, hsa
aaaguaauguauaucuguaauauauaaucaaaugauucauuuuucuguuagacuaggcaaa

SEQ ID NO: 251071 - RNA, 61 nt, hsa
guuguauuaguaaauuauuagaauccaauuaaugauucaauuaacauauaucuuauccaau

SEQ ID NO: 251072 - RNA, 61 nt, hsa
auguuauuauaauuuugaauuuuuaaguucuaugauucauguuuuaaagauggaauaauuu

SEQ ID NO: 251073 - RNA, 61 nt, hsa
uucacaauuucaaugcuucuuuuagucagaaaugauucaggguuauuugaggggaaaaaac

SEQ ID NO: 251074 - RNA, 61 nt, hsa
aguguacauuacuuuuuaacuuauaugugaaaugauucauguaccucacaaaaucaugcaa

SEQ ID NO: 251075 - RNA, 61 nt, hsa
cuuggauuuugaggggcacucuaccuugguuaugauucaguagaggaaaaagaccaccuuu

SEQ ID NO: 251076 - RNA, 61 nt, hsa
aaauaucguuagggugaagcauuauggucuaaugauucaaauguuuuaaaguuuaaugccu

SEQ ID NO: 251077 - RNA, 61 nt, hsa
ucaaacgaaaaaucaguccuguguugucagcaugauucauguauuuauauagauuugauua

SEQ ID NO: 251078 - RNA, 61 nt, hsa
uggauuuggucacaagguuuaaggugacccaaugauucagcuauuuaaaaaaaaaagagga

SEQ ID NO: 251079 - RNA, 61 nt, hsa
uugaaucaguuuuuaaaauauuuagucuaagaugauucaaaguaguuuuauuuuaauacag

SEQ ID NO: 251080 - RNA, 61 nt, hsa
uguguguuuuucuuuauacugcaaauuaauaaugauucacuuuauaguuugggagacagaa

SEQ ID NO: 251081 - RNA, 61 nt, hsa
accaccaccaaccacugcgaccacaagaaggaugauucaacagguuuuccugaagaauuga

SEQ ID NO: 251082 - RNA, 61 nt, hsa
aaaucuuuuuggucaggaggauuauauucucaugauucagcauguguauagaaagacuuuc

SEQ ID NO: 251083 - RNA, 61 nt, hsa
ucaaguguuuuacuaucucacugcuguuuuuaugauucaggcuuauaacaaauauuguauc

SEQ ID NO: 251084 - RNA, 61 nt, hsa
ugcaguuuggcaucugcaguacaccaagcacaugauucaugucugagccaggucugcuuau

SEQ ID NO: 251085 - RNA, 61 nt, hsa
ucucuccuuuguugagccuuuugagggguucaugauucauuaccacaguuuuaagaguuuc

SEQ ID NO: 251086 - RNA, 61 nt, hsa
aaucaucaaagaaugcaauuuccauauccuaaugauucaaucucccuuacccugaccaauc

SEQ ID NO: 251087 - RNA, 61 nt, hsa
uaauuucuuuucuaauaaaaaaaaccuauagaugauucagugauuuuuguccaauucauuu

SEQ ID NO: 251088 - RNA, 61 nt, hsa
gagcaaguaauagauuuucuuggcaaaucuaaugauucagcccacaggacuguugaaacua

SEQ ID NO: 251089 - RNA, 61 nt, hsa
uuguuccaaguauuaucugauagaauacaagaugauucaaaauuauauagauauuuaaagc

SEQ ID NO: 251090 - RNA, 61 nt, hsa
guguaagcuaguauucuguguguucguagaaaugauucaauaccugcagcuggugaauuag

SEQ ID NO: 251091 - RNA, 61 nt, hsa
cccccaaauuuaauaaagacagaggguucucaugauucacauugguugugcuauugcugau

SEQ ID NO: 251092 - RNA, 61 nt, hsa
gaacacaguaacugauagguaaaaagacugcaugauucacuuuuacacuuauauuucauug

SEQ ID NO: 251093 - RNA, 61 nt, hsa
auugcugaaauggcuguuggcaguucuuauuaugauucagagaagagcaaauagaccuuaa

SEQ ID NO: 251094 - RNA, 61 nt, hsa
gaagaggacuccuuaaauuugggggacuuacaugauucauuuuaacaucugagaaaagcuu

SEQ ID NO: 251095 - RNA, 61 nt, hsa
uauuguuuuaaaaauuguaaaaauuauugugaugauucauuuagcauaaagagagguggac

SEQ ID NO: 251096 - RNA, 51 nt, hsa
agagccacggaaaaucauaguaugauucaauccagauauggguuaaauucc

SEQ ID NO: 251097 - RNA, 61 nt, hsa
auaguauauacauaucaacauaacuauguugaugauucauaucaaauucucaaugcagguc

SEQ ID NO: 251098 - RNA, 61 nt, hsa
aucagaaaucagcucaguggucuuccccgccaugauucacauuugaugaguuuuuaaaaau

SEQ ID NO: 251099 - RNA, 61 nt, hsa
uuaagaaauuacuaguuguauuauuuauccuaugauucauucauucaauaagcuuuuacug

SEQ ID NO: 251100 - RNA, 61 nt, hsa
ucauaauuuuuaaagguuggaaucuuuuauaaugauucauaagacacuuagauuaagauuu

SEQ ID NO: 251101 - RNA, 61 nt, hsa
uugagcaggccuaucucuuucagauaguuuuaugauucacacagguuugaggaugcugggg

SEQ ID NO: 251102 - RNA, 61 nt, hsa
cuucugauguuaccacgauagaauguuacugaugauucagggcuauuucugaagucuguau

SEQ ID NO: 251103 - RNA, 61 nt, hsa
cgcaugugaaaaccucaacuauuuaaucaucaugauucauauuuugagugaauacaucagg

SEQ ID NO: 251104 - RNA, 61 nt, hsa
guuuuggaagggccuucaguaucuuuagcacaugauucaccaauaucuuguuaguaauauu

SEQ ID NO: 251105 - RNA, 61 nt, hsa
ugcuagugugaaacuugcucuacucucugaaaugauucaaauacacuaauuuuccauacuu

SEQ ID NO: 251106 - RNA, 61 nt, hsa
agggagaauuguggaugguuauuuauagcucaugauucauccaaggacugaguuauucucc

SEQ ID NO: 251107 - RNA, 61 nt, hsa
guugccugccuguggcugguaagguaaugucaugauucauccucucuucagugagacugag

SEQ ID NO: 251108 - RNA, 61 nt, hsa
ggcaaagcugaaauuuuuauacauucaacucaugauucacauguggcaucagucccaucag

SEQ ID NO: 251109 - RNA, 61 nt, hsa
uaaaaucuauucucucccccuuucucccuggaugauucaggaagcugacauuguuuccuca

SEQ ID NO: 251110 - RNA, 61 nt, hsa
uaaccaguucucacaacuugcuauacauaagaugauucacacuugaaugaaacccuacaaa

SEQ ID NO: 251111 - RNA, 61 nt, hsa
aauuauauagcuuuuuguuuuguuugaauaaaugauucauuccuguuugcuuuucuggugc

SEQ ID NO: 251112 - RNA, 61 nt, hsa
uucacauuggaaacaagucagucauucagauaugauucaaaugucuauaaaccgaacugau

SEQ ID NO: 251113 - RNA, 61 nt, hsa
uacuguuaagguauuacuuuuuuucaugcugaugauucauaucuaaauuacauuauuaugu

SEQ ID NO: 251114 - RNA, 61 nt, hsa
uaaccauuucucaacccuuacuaaacauaagaugauucauacuggagagaaguuacacaaa

SEQ ID NO: 251115 - RNA, 61 nt, hsa
uuaauaugauuauuaaucagaauaucagaauaugauucacuauuuaaacuaugauaaauua

SEQ ID NO: 251116 - RNA, 61 nt, hsa
ccagucaagagcuccucugcuccucgcuugaaugauucagggucagggagguggcucagag

SEQ ID NO: 251117 - RNA, 61 nt, hsa
uauuucucugaauucagugaagaaauaauucaugauucaacugcaucuccaaacauuacuc

SEQ ID NO: 251118 - RNA, 61 nt, hsa
uauaugacuuuaagagcccacauuagguuuuaugauucauuugccagguuuuuaaauguuu

SEQ ID NO: 251119 - RNA, 61 nt, hsa
aagugcaguauuuuucuacaucaugucaagaaugauucaauguaaauauuuuucauuuuau

SEQ ID NO: 251120 - RNA, 61 nt, hsa
cucuucaauccaucuuaccacacaauauuucaugauucaaauucuucaaagucuuauacgc

SEQ ID NO: 251121 - RNA, 61 nt, hsa
ggaagauagaaacuagguuuugaaagauuacaugauucaagcgagggauuuuaaaguaaag

SEQ ID NO: 251122 - RNA, 61 nt, hsa
auaauaugugauguaacauguagaugauaauaugauucaguagucaacuugagggaaauuu

SEQ ID NO: 251123 - RNA, 61 nt, hsa
uucauuuuaaagguuauuugcucccgauuauaugauucaaguguuauaaguuuuagcuuga

SEQ ID NO: 251124 - RNA, 61 nt, hsa
gcgcagaauaauauuaagaauugcuaugcuuaugauucaggcuggacagccuggacauuuu

SEQ ID NO: 251125 - RNA, 61 nt, hsa
agaaaauauucuaacauuugauaauuuugaaaugauucaucuuucagaaauaaaaguauga

SEQ ID NO: 251126 - RNA, 61 nt, hsa
cuuuggacaaaugcauuuaguggugguagaaaugauucaccagguccaauguuguucacca

SEQ ID NO: 251127 - RNA, 61 nt, hsa
auguguauuuucuuauucugguauaccacaaaugauucaugcaaaugaauuuuuggugauu

SEQ ID NO: 251128 - RNA, 61 nt, hsa
uucaauuuaaaaagagugaggaagaagcagaaugauucauuuugcugcgugugaaaucaug

SEQ ID NO: 251129 - RNA, 61 nt, hsa
auucuuguuuauucaaaugacugcaauaacaaugauucauucauuaauguuaaggcuaaua

SEQ ID NO: 251130 - RNA, 61 nt, hsa
uuaaauuugugaacucguaauuacuguuuuaaugauucaguuucuucagagugguaauugu

SEQ ID NO: 251131 - RNA, 61 nt, hsa
auuguuauguaaacaucauaaauaguaaauaaugauucaaugugaauuuuaaaaugcaaau

SEQ ID NO: 251132 - RNA, 61 nt, hsa
caaagaugagauuauuggggcuguucauauuaugauucagaaucauuuucuauugugguau

SEQ ID NO: 251133 - RNA, 61 nt, hsa
cuaccuacauuuacauguagguagauaugaaaugauucaauauccaugucuccuuuuacuc

SEQ ID NO: 251134 - RNA, 61 nt, hsa
gcuggagcagcugauaguggaaaacagaauaaugauucaaagagucuucugucaccauguc

SEQ ID NO: 251135 - RNA, 61 nt, hsa
gguuugcagcccuaaugaaauuaugucuaggaugauucagucuauuucccauuuacuagca

SEQ ID NO: 251136 - RNA, 61 nt, hsa
cugcuuacucguaaugaucuaguggggaaacaugauucauucacuuaaaauacugauuaag

SEQ ID NO: 251137 - RNA, 61 nt, hsa
aauugaaguaguguggagcauuaacuuguggaugauucagaguuaaaagauaaaaagacgc

SEQ ID NO: 251138 - RNA, 61 nt, hsa
cuugaccacaacuacuguuuuuuugaaauacaugauucaugguuuacaugugucaagguga

SEQ ID NO: 251139 - RNA, 61 nt, hsa
acagucuuuauuuuucuucuuaaaaauuuauaugauucaaaaccauuucuucagguuaaau

SEQ ID NO: 251140 - RNA, 61 nt, hsa
aauguuucccaugaucgcucauucuucuuuuaugauucauacguuauuccuuauaaaguaa

SEQ ID NO: 251141 - RNA, 61 nt, hsa
uacauugucuaaaaauccuuacaagguuaagaugauucaauaucaagaagauucagaaaau

SEQ ID NO: 251142 - RNA, 61 nt, hsa
gccagugccacaguuugaagauucucauuaaaugauucauuucauuucaccuugacgauuc

SEQ ID NO: 251143 - RNA, 61 nt, hsa
uucauuucuguugauuuuuuuuauugcauuuaugauucaguggcugggaauugagaauuua

SEQ ID NO: 251144 - RNA, 61 nt, hsa
uauaggcuguucuagccacagugguagauuuaugauucacauccgaaagugugccuuaguu

SEQ ID NO: 251145 - RNA, 61 nt, hsa
cacauggcuugcacucagugacaccaaauccaugauucaauguugaucuugagcaaguauu

SEQ ID NO: 251146 - RNA, 61 nt, hsa
cuauuuuaacuuagaaaaaccaucguuucauaugauucacccuaauagauaccuccauuau

SEQ ID NO: 251147 - RNA, 61 nt, hsa
cugaccuucagcucacgcuucacagugaucgaugauucaggugcagaggaaguacaaacua

SEQ ID NO: 251148 - RNA, 61 nt, hsa
cacgagaauagcacaggaaagacuggcccccaugauucaauuaccucccccgggucccucc

SEQ ID NO: 251149 - RNA, 61 nt, hsa
cugaacgugcuccucucuccuucucuguacaaugauucagcaucucggcggaagaggaaaa

SEQ ID NO: 251150 - RNA, 61 nt, hsa
acucuuguuaaccuuagagcuagaccugggaaugauucaacuucaagccuuaaccuggaau

SEQ ID NO: 251151 - RNA, 61 nt, hsa
uucgucacaaaauucaacauagaauuacccuaugauucagcgauuccaccucuggcuauag

SEQ ID NO: 251152 - RNA, 61 nt, hsa
gggggaagugggguauaauauuuaacgaaucaugauucagauuguaccauuacauguuuca

SEQ ID NO: 251153 - RNA, 61 nt, hsa
ccucgcuggacucucagucucugagcagugaaugauucaguguuaaaugugaugaauacug

SEQ ID NO: 251154 - RNA, 61 nt, hsa
cagguggagccauggugcucugugguggcgcaugauucacugagcaaacagcacuuuacag

SEQ ID NO: 251155 - RNA, 61 nt, hsa
uauagaaucuaagcuggucuuaaagucauaaaugauucauugggucauuagugagaaacgg

SEQ ID NO: 251156 - RNA, 61 nt, hsa
agaugaucuuuuacucuuagguuuugagcuaaugauucaaaacgggggaauauaaaagguu

SEQ ID NO: 251157 - RNA, 61 nt, hsa
caaaaugcugacuacuguagaaaaaaaggucaugauucaugauugaaagcagaacaaugga

SEQ ID NO: 251158 - RNA, 61 nt, hsa
agcugaugauuguaccagucuuaaauuauucaugauucaauaaaauugaugcuuauuuauu

SEQ ID NO: 251159 - RNA, 61 nt, hsa
acaauuucuuuuuuaaaaaagacuauuuuauaugauucacaugcuaaagccaggauugugu

SEQ ID NO: 251160 - RNA, 61 nt, hsa
acuucuucaugguauuaugaagacuauauagaugauucaaccaagccugcaaaucucccuc

SEQ ID NO: 251161 - RNA, 61 nt, hsa
aggauugccauuagugacuuggaccaguuagaugauucacuuuuugccccuagggaugaga

SEQ ID NO: 251162 - RNA, 61 nt, hsa
aauuucauguaauuuacccuuugcaauaaaaaugauucauuaaauauauaacuaaauguga

SEQ ID NO: 251163 - RNA, 61 nt, hsa
uguccuccagauaccacugagcucacugcccaugauucagagcuuucaaggauaggcuuua

SEQ ID NO: 251164 - RNA, 61 nt, hsa
auuguuggauuuaaagaggcaacuuuuguuuaugauucaaauaugggaauuugagaaauau

SEQ ID NO: 251165 - RNA, 61 nt, hsa
caaccuuggucucaaauagcugcuuuuguauaugauucacgagcuuuuuuagaguuuauau

SEQ ID NO: 251166 - RNA, 61 nt, hsa
uauccugcucagccaagaucugccuaagauuaugauucaggggcauuuuggugcuguuaaa

SEQ ID NO: 251167 - RNA, 61 nt, hsa
auaaguuugaaaugaaauggucuagagggaaaugauucaaauuuuuucauaauucaaacaa

SEQ ID NO: 251168 - RNA, 61 nt, hsa
accaaagagacccugaagaauauuugaugugaugauucacuuuucaguucucaaauuaaaa

SEQ ID NO: 251169 - RNA, 61 nt, hsa
uuuuaaaggagacuaacuccaggaguaggaaaugauucaucauccuccaaagcaagaggcu

SEQ ID NO: 251170 - RNA, 61 nt, hsa
gcauaaauauuuuugacagcagaauagaagaaugauucaugagaaccugaaccagaugaac

SEQ ID NO: 251171 - RNA, 61 nt, hsa
uacuggacaaaaucaauaacuacaaaaggcaaugauucacgcuuuuguuuucauaauaccu

SEQ ID NO: 251172 - RNA, 61 nt, hsa
aaaauuuaaaagauuaaaugaaugagaagaaaugauucauaaauuuugaacuaacaguaau

SEQ ID NO: 251173 - RNA, 61 nt, hsa
gggcggggcagugaggggugggagaaggugaaugauucauuauuccaccccgagguuugcu

SEQ ID NO: 251174 - RNA, 61 nt, hsa
acauccuucccucacucccaugauuggagaaaugauucauugggugaugaguguugggguu

SEQ ID NO: 251175 - RNA, 61 nt, hsa
ggaagugaauaagaagaugacagugauucaaaugauucaaaugccaugacauuggaagaag

SEQ ID NO: 251176 - RNA, 61 nt, hsa
ggaagugaauaagaagaugagagugauucaaaugauucaaauuccaugacauuggaaaaag

SEQ ID NO: 251177 - RNA, 61 nt, hsa
uauucacugcaacaaagcaacaauguuguccaugauucaaaaucuaagcaguuucgauuuu

SEQ ID NO: 251178 - RNA, 61 nt, hsa
uuugaaauauuaaggucuugccaagcuucugaugauucacaccuguacuacugauuauuaa

SEQ ID NO: 251179 - RNA, 61 nt, hsa
uuuuuuuugaaagaguucuccucauaggaggaugauucagcaucagaagaagaaggaaccc

SEQ ID NO: 251180 - RNA, 61 nt, hsa
caauaagcaauauguggugauaaugaaaagaaugauucagucuugacggugaauggaagac

SEQ ID NO: 251181 - RNA, 61 nt, hsa
aucuguucuugcuacccaugacuuuauauggaugauucagaaauuggaacagaauguuuua

SEQ ID NO: 251182 - RNA, 61 nt, hsa
aucuugauugugauaagccccccuggaggauaugauucacuuuaugugauucaucuuauuc

SEQ ID NO: 251183 - RNA, 61 nt, hsa
ucugugaguccuauaaaaagcaaggauaugcaugauucagggaaugaagaaucacaggcuu

SEQ ID NO: 251184 - RNA, 61 nt, hsa
uucaaccaaaugauugguucaaaaggaaagaaugauucaaagcagaggaauuuauuaugca

SEQ ID NO: 251185 - RNA, 61 nt, hsa
uauuagagaccagauauuuuucuaccuguucaugauucacaucucuucuugcauguaccua

SEQ ID NO: 251186 - RNA, 61 nt, hsa
uuuauucagaacgaggaagagaacacaaggaaugauucaagauccaccuugagaggaauga

SEQ ID NO: 251187 - RNA, 61 nt, hsa
ucugaauggaucugaccccugucagaugaaaaugauucacagcucuggcaguucccaaguc

SEQ ID NO: 251188 - RNA, 61 nt, hsa
agaaacugcugaaaaagcugggugcagugaaaugauucaugugcuuccggacaacugccaa

SEQ ID NO: 251189 - RNA, 61 nt, hsa
aaugcaaguaguuuccucgcgugaccucaccaugauucacauacgugccacuguuugaaau

SEQ ID NO: 251190 - RNA, 61 nt, hsa
cuuagccaugauuucguuaguagaccuauuuaugauucaauugcaauuuucagauaggaug

SEQ ID NO: 251191 - RNA, 61 nt, hsa
aaaucuugaaagacgaaaucaaagcccauuaaugauucagaaucagugcuugaccuccugu

SEQ ID NO: 251192 - RNA, 61 nt, hsa
auggaucauucugaugacagauuuauacaaaaugauucaaaccaguaacuuaguaaaauug

SEQ ID NO: 251193 - RNA, 61 nt, hsa
uacacacuauauaaguuguucuuucaguuuuaugauucaacuacuguuuuuccuucagcug

SEQ ID NO: 251194 - RNA, 61 nt, hsa
ccgucucagacacgcacagugggccugcugcaugauucacacccagucccugccacagacc

SEQ ID NO: 251195 - RNA, 61 nt, hsa; identical to SEQ ID NO: 251194

SEQ ID NO: 251196 - RNA, 61 nt, hsa
cuccugacugcccggcacagaugcuccagggaugauucaagccauuccaaaguucaacuug

SEQ ID NO: 251197 - RNA, 61 nt, hsa
uuuauaacauuguaaaugauaugucuuuaaaaugauucacuuuuauuguauaauuaugaag

SEQ ID NO: 251198 - RNA, 61 nt, hsa
cuaucaguaucaauaaccauuggaaggagaaaugauucaugugugaaaaaauucucagauc

SEQ ID NO: 251199 - RNA, 61 nt, hsa
gaaaauccuaaacauggaagaugauuuaaaaaugauucacccuggaauacaugcuuccagu

SEQ ID NO: 251200 - RNA, 61 nt, hsa
uuguggacuuaauuacaaccacugcacuguaaugauucaaugcuguauuaugauauugcug

SEQ ID NO: 251201 - RNA, 61 nt, hsa
agcauauaaauuaaaauauuuaaaauuagauaugauucacacuauauucuguuucauaugc

SEQ ID NO: 251202 - RNA, 61 nt, hsa
guucccugaaacacgaaacuuguuauugugaaugauucauguuauauuuaaugcauuaaac

SEQ ID NO: 251203 - RNA, 61 nt, hsa
ugcauuucuauuuauaucaaaaggugcuaaaaugauucaauuugcauuuucugauccugua

SEQ ID NO: 251204 - RNA, 61 nt, hsa
aauaauaagaugcaacauuuguugaggccuuaugauucagcagcuuggucacuugauuaga

SEQ ID NO: 251205 - RNA, 61 nt, hsa
guaaauauggcuuuaauuacaaacaugaggaaugauucacugaagaugaaaagauaggacg

SEQ ID NO: 251206 - RNA, 61 nt, hsa
ugcuauagcccaaagcacguaguauuugcugaugauucagcaugagcugcaucuaccuacu

SEQ ID NO: 251207 - RNA, 61 nt, hsa
acugagggaauuccugucuucuuuaggaguaaugauucauagaucuagauagguggaaaua

SEQ ID NO: 251208 - RNA, 61 nt, hsa
cgcaaaauguuucaaguacuguaacugugucaugauucacccccaaacagugacauuuauu

SEQ ID NO: 251209 - RNA, 61 nt, hsa
agccaacuucaaauaccgugaccaaauuuacaugauucauauucauuaugcauuacuuggu

SEQ ID NO: 251210 - RNA, 61 nt, hsa
uggguggguaguguaaauacacaagaaaaggaugauucacaucccaugugggauggagcag

SEQ ID NO: 251211 - RNA, 61 nt, hsa
ugaaacuuaacgugaucaucaccacugacagaugauucacagagacuguuugaaucuuguc

SEQ ID NO: 251212 - RNA, 61 nt, hsa
cauuuauaacuucuguuuuuuuauugagaaaaugauucacgaauuccaaaucagauugcca

SEQ ID NO: 251213 - RNA, 61 nt, hsa
aucccaccacaagcacauacuaauuuuauuuaugauucaaaugugacucgugccugcccau

SEQ ID NO: 251214 - RNA, 61 nt, hsa
ccacggaugggugacaggggaugguuuugggaugauucaagugcauuacauuuauugugca

SEQ ID NO: 251215 - RNA, 61 nt, hsa
gcuaaauccucaaaaccuaguaaggggacuaaugauucauuaaaguaaauugaugguuuug

SEQ ID NO: 251216 - RNA, 61 nt, hsa
accgccccucagcaaggaugacucagcagggaugauucagcagagauaacucggggaugac

SEQ ID NO: 251217 - RNA, 61 nt, hsa
agccucugauccaucccucaagccacaguuaaugauucagaugucaguagaugaccaaaga

SEQ ID NO: 251218 - RNA, 61 nt, hsa
uuggggcaugggaggggggcugggggaccccaugauucagccacggacuccaaugcccagc

SEQ ID NO: 251219 - RNA, 61 nt, hsa
auuacggaugaguucuggaaaagacccagcuaugauucauaaaaacacuucuggaugaauc

SEQ ID NO: 251220 - RNA, 61 nt, hsa
cccucaucugcucagcagcuauuugaaugagaugauucagaaggggaggggagacagguaa

SEQ ID NO: 251221 - RNA, 61 nt, hsa
cuauuuuaaauauuuuuaguauguacuguguaugauucauuaccauuuugaggggauuuau

SEQ ID NO: 251222 - RNA, 61 nt, hsa
gaagugauacacuaaucacggggaacccagaaugauucaacauuuuccccccacuccuccc

SEQ ID NO: 251223 - RNA, 61 nt, hsa
ucuucucuucauacucucuaccuuccuuaccaugauucagccacacuggccuuucuguucc

SEQ ID NO: 251224 - RNA, 61 nt, hsa
ccuucgggagggcggggggagguugauuuucaugauucaugagcuggguacugacugagau

SEQ ID NO: 251225 - RNA, 61 nt, hsa
ucuuuaacacacacuaggcucuuuguguauuaugauucagugcuauuuguaacuguguccc

SEQ ID NO: 251226 - RNA, 61 nt, hsa
uugguguuugucuguguuuguuuuucaagaaaugauucaaauugcugcuuggauuuugaaa

SEQ ID NO: 251227 - RNA, 61 nt, hsa
auaugaauaugcaguaugggacuuugaaauaaugauucauaauaaaauacuaaacgugugu

SEQ ID NO: 251228 - RNA, 61 nt, hsa
uuuaggaagcaaaaguaagaagcagcauuuuaugauucauaauuucaguuuacuagacuga

SEQ ID NO: 251229 - RNA, 61 nt, hsa
uuauauuuuacuuuuuuauugcugguuuaagaugauucagauuauccuuguacuuugagga

SEQ ID NO: 251230 - RNA, 61 nt, hsa
ccagugagcgcgccugcuuuagagacacaggaugauucagaccggaaacagaccucguggg

SEQ ID NO: 251231 - RNA, 61 nt, hsa
acuucaugauccugggccugagaacacaggaaugauucauagcccaccccccaccuccaug

SEQ ID NO: 251232 - RNA, 61 nt, hsa
gauuuccuguagcugugaauuguuaaaauguaugauucaggauaaaacguaaacacgugcu

SEQ ID NO: 251233 - RNA, 61 nt, hsa
uaguuuuacauuuuauaaaguaaagauguaaaugauucagguuuaaagcucuauuugacuu

SEQ ID NO: 251234 - RNA, 61 nt, hsa
agugauucaacuuuaaaacaaauuucucgugaugauucauuucaaaauccugagugagucu

SEQ ID NO: 251235 - RNA, 61 nt, hsa
uuagccuggauggucucgauuuucugaucuuaugauucacccaccucuaccucccgaagug

SEQ ID NO: 251236 - RNA, 61 nt, hsa
aaauguaagguuugugacaaggcuuucgggaaugauucacacguggcaccccauacuagaa

SEQ ID NO: 251237 - RNA, 61 nt, hsa
acuuaggaugagggcagaaaagucuuuggggaugauucagucuguaccagacaugacaaca

SEQ ID NO: 251238 - RNA, 61 nt, hsa
uugaguaugugccacgugcuugugaaaugcuaugauucacauguaacauuuaaacauuaau

SEQ ID NO: 251239 - RNA, 61 nt, hsa
ugaggaaaucucuuccaauuucugcuucugaaugauucaauguugggagcaauagaaauaa

SEQ ID NO: 251240 - RNA, 61 nt, hsa
aauacauuuuuuugguucuauauaaugcuucaugauucauuuagggaccuagaaauauugu

SEQ ID NO: 251241 - RNA, 61 nt, hsa
aucugccccacucgccuuugccccgucaucgaugauucaggcagagccagauucguuaggu

SEQ ID NO: 251242 - RNA, 61 nt, hsa
caggagacaguucaagaaagcuucaaacugcaugauucaugccaauuagcaauugacuguc

SEQ ID NO: 251243 - RNA, 61 nt, hsa
auugaaaacuuuggagaacucauuucaaguuaugauucagugcauuuucaacauugauuuu

SEQ ID NO: 251244 - RNA, 61 nt, hsa
gaaauuauaccuuuuuaguacuugcugaagaaugauucaggguaaaucacauacuuuguuu

SEQ ID NO: 251245 - RNA, 61 nt, hsa
uauacucauacauuuuuaauaugguuuaucaaugauucauguuucccucaaauagugaugg

SEQ ID NO: 251246 - RNA, 61 nt, hsa
uugcuuccccgugcaugauuuacucuuagagaugauucagaggucacuucauuuuuauuaa

SEQ ID NO: 251247 - RNA, 61 nt, hsa
cauuggggugaaguguucuugacaguuuaauaugauucacuuuucuccaaagacauguaaa

SEQ ID NO: 251248 - RNA, 61 nt, hsa
ugagccuaggaggucaaggcugcagugagccaugauucacagcacugcacugcagccuggg

SEQ ID NO: 251249 - RNA, 61 nt, hsa
agagggaugguuucugagggguucugaaaguaugauucaaugugcaacauacagguagguc

SEQ ID NO: 251250 - RNA, 61 nt, hsa
ucaccccucccagucuacccauccagccuucaugauucauuccugugucaagguuagucgc

SEQ ID NO: 251251 - RNA, 61 nt, hsa
agucccccaucccuuccucccuuacccagcuaugauucaguugucucugcccucccucuua

SEQ ID NO: 251252 - RNA, 61 nt, hsa
uguaaaauuuaaauaauuacuuuuuuauaauaugauucacuuaugccacagauucaacauu

SEQ ID NO: 251253 - RNA, 61 nt, hsa
cccacagaugauuccuuuauauagauguauaaugauucaaacugcugccuuugccuccagu

SEQ ID NO: 251254 - RNA, 61 nt, hsa
aaugcuuuuugauguugauuuugaccuguucaugauucagaagaaaaacaaacuuuuuugg

SEQ ID NO: 251255 - RNA, 61 nt, hsa
caugagaauagcaugggaaagaccugccuccaugauucaguuaccucccacugggucccuc

SEQ ID NO: 251256 - RNA, 61 nt, hsa
ucuugauuggagcuuuugugaugcagcuaccaugauucaaaaaaauuaaaaauuaaaaaaa

SEQ ID NO: 251257 - RNA, 61 nt, hsa
aagcauuugagcgaaagucauguuuggugacaugauucauacagaccucuugagcuccugg

SEQ ID NO: 251258 - RNA, 61 nt, hsa
ugugcuuggaauguguugaugugcacagcuaaugauucaaugcgagacaagauuggcgucu

SEQ ID NO: 251259 - RNA, 61 nt, hsa
uaauugugugauauuucagaaauacagauaaaugauucaaaaagucacaguuaaggagaau

SEQ ID NO: 251260 - RNA, 61 nt, hsa
ccugcuggguuggggagggugggacagcuggaugauucaucugugggugccaggcugugug

SEQ ID NO: 251261 - RNA, 62 nt, hsa
uaggccaaaaauggugagcgaucauuuauuucaugauucaaccugauacauuuacauagugc

SEQ ID NO: 251262 - RNA, 62 nt, hsa
agggguggugcuagaagacagacaucuguggaaugauucacauccucucaaguuaggaggau

SEQ ID NO: 251263 - RNA, 62 nt, hsa
aguaaccaacuuggaaagcuguauuuguucccaugauucagcaaacaaugaguaccuacugu

SEQ ID NO: 251264 - RNA, 62 nt, hsa
caugaacauuuugauacaaauuucaucauuuaaugauucaccaauuucuugcauuaauuuga

SEQ ID NO: 251265 - RNA, 62 nt, hsa
auuuuuuuccuaaccuuuugcuauuauaaauaaugauucauuuuauaaccuuuuauauaggu

SEQ ID NO: 251266 - RNA, 62 nt, hsa
cuaaguaaagcacagucccuaggacauaguaaaugauucauauauccgaacuacuguuauaa

SEQ ID NO: 251267 - RNA, 62 nt, hsa
aaaaccaggauggaugccucacauagaucaugaugauucaauccaaaggcacuuugcagugc

SEQ ID NO: 251268 - RNA, 62 nt, hsa
uguuccuuauacucuauuauauaguguuauucaugauucagcugaucuuaacaaaauucgua

SEQ ID NO: 251269 - RNA, 62 nt, hsa
aguagcugagaauucaaaaacauccuugcagaaugauucaaaagacaaaagccaggcucaac

SEQ ID NO: 251270 - RNA, 62 nt, hsa
auguuauaucugcauaugagugauaugugaucaugauucauuuugcagauuuacauuuugcu

SEQ ID NO: 251271 - RNA, 62 nt, hsa
gacuugggcugcuggugccuugagucccacagaugauucauuaggaaaagccagauauacca

SEQ ID NO: 251272 - RNA, 62 nt, hsa
ucuuacuucuacagguuccuugagcaccaaagaugauucauaacucuguauaggugacagcu

SEQ ID NO: 251273 - RNA, 62 nt, hsa
aaccaagcccugguagggaagagguaagggggaugauucaccuccauauuuccuaagcaggu

SEQ ID NO: 251274 - RNA, 62 nt, hsa
uucaucugaagagagacuuaagaugaaagcaaaugauucagcucccuuauacccccauuaaa

SEQ ID NO: 251275 - RNA, 62 nt, hsa
gauguuauucuagaauguuuucuuuccagaugaugauucagaagcuaauuuuaaaaaacggu

SEQ ID NO: 251276 - RNA, 62 nt, hsa
uugaggcuaaguuuuggacuaccaaggaccagaugauucacauguaggaaacagccagaagc

SEQ ID NO: 251277 - RNA, 62 nt, hsa
gugguaauccugaaucucuuuuaaacuauuauaugauucauaaugguucucaggaauuaaua

SEQ ID NO: 251278 - RNA, 62 nt, hsa
ugcuuaucgugucugggguucaccggaaauaaaugauucacuggaacaauucuacugucaaa

SEQ ID NO: 251279 - RNA, 62 nt, hsa
uauaagaaauaaaaauugggcaauaaaauaaaaugauucaguguuucuuuucuauauuguca

SEQ ID NO: 251280 - RNA, 62 nt, hsa
gugacugucaguuguaucuguugcuuuucucaaugauucagggauacaaaugggcuucucuc

SEQ ID NO: 251281 - RNA, 62 nt, hsa
ugacuuauuucugcucuggaauaaaguugcagaugauucaaaccgaucuuggcuuucagucu

SEQ ID NO: 251282 - RNA, 62 nt, hsa
acggacuaagcuguaauuaugauggcugagaaaugauucauuugaagauacaauuuuauuug

SEQ ID NO: 251283 - RNA, 62 nt, hsa
uggggaugauguggaaauaggggcacacacagaugauucauggauggggacauggaaaugag

SEQ ID NO: 251284 - RNA, 62 nt, hsa
cuuaagugucuguguagacaaccaaagaauaaaugauucaugguuuuuuuuacuugguuugu

SEQ ID NO: 251285 - RNA, 62 nt, hsa
cauguaugauuugugccacugaucuuaaaccuaugauucaguaacuucuuaccauauaaaaa

SEQ ID NO: 251286 - RNA, 62 nt, hsa
ucucuauaccaagauaugcuaggaguaggaugaugauucaaagugguaacccaaauucauaa

SEQ ID NO: 251287 - RNA, 62 nt, hsa
guccuaacuuucuguuauuuuagaauguuaacaugauucacauuauacuuucucuuaguuaa

SEQ ID NO: 251288 - RNA, 62 nt, hsa
ccugcagggcuggaggaacagguucuuagaagaugauucaccuuggaggaagcuggggaaag

SEQ ID NO: 251289 - RNA, 62 nt, hsa
uuuuucuaaucuuuaguagauuugauuaaauaaugauucacagaauuuaguaacagaaucaa

SEQ ID NO: 251290 - RNA, 62 nt, hsa
accaugacccagccacagucaauaccagaaagaugauucagagucugaaguggugccccagg

SEQ ID NO: 251291 - RNA, 62 nt, hsa
ccacucagaugaccugaguuguggagagauguaugauucaaacauagaugacuggauuccug

SEQ ID NO: 251292 - RNA, 62 nt, hsa
uaccaugagaacaguaugggggaaacaacuccaugauucaguuaucucccaccagguuccuc

SEQ ID NO: 251293 - RNA, 62 nt, hsa
ucuaucaauagaguaaccucauucucugccugaugauucaaaggcaugggaagaccaaaacc

SEQ ID NO: 251294 - RNA, 62 nt, hsa
augauaccuuuguugaaagaauugugaauagcaugauucauuucuagcagaggcugaguuua

SEQ ID NO: 251295 - RNA, 62 nt, hsa
guuuaaagagauugugucuguuuaaaaucaguaugauucagagaaggaccaaauuauaugaa

SEQ ID NO: 251296 - RNA, 62 nt, hsa
cugcaggcugucacaugacucauugaguaguaaugauucagaagaaaaagaaaaaggagacu

SEQ ID NO: 251297 - RNA, 62 nt, hsa
uuaaaacugacauaaaauuuuaugauaauaacaugauucaagaaaugugauguagauuuuug

SEQ ID NO: 251298 - RNA, 62 nt, hsa
cuuggcuucuggucuugauguauuugauaagaaugauucauuuucugauauggcuuccuaau

SEQ ID NO: 251299 - RNA, 62 nt, hsa
uagguugaauaugguaggucuuugaaaauaugaugauucaauuuucucaauuuucuuugcuu

SEQ ID NO: 251300 - RNA, 62 nt, hsa
ugucauagaggaaaagcacagauuauaccuggaugauucaggagcacauucugauuccaggu

SEQ ID NO: 251301 - RNA, 62 nt, hsa
uugaauguauuguucuguuuguguuauuucagaugauucaaauaucaaaaggaagauucuuc

SEQ ID NO: 251302 - RNA, 62 nt, hsa
ugacauauugcuacaaagauuuuuuuuccuaaaugauucaguaauugaaugauuauuuaaua

SEQ ID NO: 251303 - RNA, 62 nt, hsa
uuauauuguaaugauguuagauaauacucaacaugauucaguaugacaaacuuuuuugagca

SEQ ID NO: 251304 - RNA, 62 nt, hsa
auauugacgguacagaugguccccaacuuguaaugauucaauuuaggguuuuucaacuuuac

SEQ ID NO: 251305 - RNA, 62 nt, hsa
guacaaaauccagcuaugaauauagagggcuuaugauucagauuguuaucuaucaacuauaa

SEQ ID NO: 251306 - RNA, 62 nt, hsa
gguaacaccuaacugagccucacucacauuaaaugauucacuugaaauauauacagaaauug

SEQ ID NO: 251307 - RNA, 62 nt, hsa
acucuuauauguaccauugguugauaauuauaaugauucauuuggacuugaagaaagauugu

SEQ ID NO: 251308 - RNA, 62 nt, hsa
ccccaggcacaguaucugaaucacuggggauuaugauucacccucuuuggagaacaugcucu

SEQ ID NO: 251309 - RNA, 62 nt, hsa
ucacgagaauagcacgggaaagacuggcccccaugauucaauuaccucccccugggucuguc

SEQ ID NO: 251310 - RNA, 62 nt, hsa
ucacaagaauagcaugggaaagacuggcccccaugauucaauuaccuccccuugggucucuc

SEQ ID NO: 251311 - RNA, 62 nt, hsa
cuaggcagggaaaacugaacaaaaaggcagaaaugauucaggggaaaaucgggccuagaauu

SEQ ID NO: 251312 - RNA, 62 nt, hsa
caucauuuucugcccccccaaaaucuguugaaaugauucacugaugcaaaacauucacccgu

SEQ ID NO: 251313 - RNA, 62 nt, hsa
uuugaaaauauuguuacaaaggcacugcuaaaaugauucacagggagaguggccaguuggaa

SEQ ID NO: 251314 - RNA, 62 nt, hsa
agguauuaauaagaggucuggcagguauucccaugauucacagaguuacauuugcauuuaau

SEQ ID NO: 251315 - RNA, 62 nt, hsa
aaguuuacaugaauuuuacaacaaacuagugcaugauucaccaagcaguacuacagaacaaa

SEQ ID NO: 251316 - RNA, 62 nt, hsa
caguuucauugguggaauaaguccccuuacucaugauucaucaauauuccuauauuaaaauu

SEQ ID NO: 251317 - RNA, 62 nt, hsa
auggaaggaaagcugggacaagcagggaacgcaugauucagggaugcugucacucggcagcc

SEQ ID NO: 251318 - RNA, 62 nt, hsa
aucuucccccacccccauuugcugguucagcuaugauucaggcuucuucagcccucccaaau

SEQ ID NO: 251319 - RNA, 62 nt, hsa
uaacucauggguacccagacucuaaauauuucaugauucacaacuaggaccucauaucuucc

SEQ ID NO: 251320 - RNA, 62 nt, hsa
gcaaccuaaguaaaaacauuccccuccuauguaugauucauuugaucauauaaaacaucaug

SEQ ID NO: 251321 - RNA, 62 nt, hsa
augauugacccugauuuuaauugugaaauuauaugauucauauauuuuaugaaucagaauaa

SEQ ID NO: 251322 - RNA, 62 nt, hsa
aaacccuaaauauguuuacauaccauuaagauaugauucauguaacaauguuaaauuaauua

SEQ ID NO: 251323 - RNA, 57 nt, hsa; identical to SEQ ID NO: 251049

SEQ ID NO: 251324 - RNA, 62 nt, hsa
auagaaguuaugaguggguuuaacaauuuuagaugauucagcuuuuguuccauuacuguuga

SEQ ID NO: 251325 - RNA, 62 nt, hsa
gaggagugagacacaggcaucaacacucucaaaugauucacauguucagccaaaguugagaa

SEQ ID NO: 251326 - RNA, 62 nt, hsa
cuugguguuguuauggcaaguuuuugguaaugaugauucaaucauuuugggaaauucuugca

SEQ ID NO: 251327 - RNA, 62 nt, hsa
gugagagaaaucacaaaguauuagaguuuaccaugauucagagaaguucuucaggccuguag

SEQ ID NO: 251328 - RNA, 62 nt, hsa
aaacuccaguucaugcuggaucuuaaccaaaaaugauucaauacuguuaucacuaaaacagc

SEQ ID NO: 251329 - RNA, 62 nt, hsa
uugauuacaguauuuuaugcagacuauuaggaaugauucagugcauuuaacugaacacagag

SEQ ID NO: 251330 - RNA, 62 nt, hsa
uuuguccucacaggcaugccacguggccugagaugauucagaacaaaucaugcuaacuuuga

SEQ ID NO: 251331 - RNA, 62 nt, hsa
ccuaggccugcuggcucugguuuucuaugcagaugauucauuggauugggggugaguguuuu

SEQ ID NO: 251332 - RNA, 62 nt, hsa
gaauacacuuguguuuaagcaccauggccuugaugauucacuguuggggagaagaaacaaga

SEQ ID NO: 251333 - RNA, 62 nt, hsa
guuggaucauuuguuuuuaaaacuacuuagguaugauucacauacaaaaagcugcacauauu

SEQ ID NO: 251334 - RNA, 62 nt, hsa
auuggugauaaguggaaaaaagagaaaaaccaaugauucauaacaauguaugugaaagugua

SEQ ID NO: 251335 - RNA, 62 nt, hsa
uucauauggccccucuuaaccaugcugguguuaugauucaguauuaacucucaauuagcaug

SEQ ID NO: 251336 - RNA, 62 nt, hsa
auaucguguauauagcuuuaguauucgguuacaugauucacagaccccugaauuccaaaaua

SEQ ID NO: 251337 - RNA, 62 nt, hsa
uaggguaugaacuagucaaaauaugaaccauuaugauucaaguuagauuuuccucuggagag

SEQ ID NO: 251338 - RNA, 62 nt, hsa
uuuacuuucuacaaacucuccguaguauauucaugauucaguguagaauguauagacuuuau

SEQ ID NO: 251339 - RNA, 62 nt, hsa
uuaacuuguuaagcaauauuuuuaagggccaaaugauucaaaacaucacagguauuuaugug

SEQ ID NO: 251340 - RNA, 62 nt, hsa
gaauagccaugacaagaguuugcauuuucuugaugauucaucuccaugagugcacaaucccu

SEQ ID NO: 251341 - RNA, 62 nt, hsa
uguuacuagcaucaggagcuuacuguuuuauuaugauucaucuucaguaauuuuuagaagca

SEQ ID NO: 251342 - RNA, 62 nt, hsa
uacagaguuuaaauaauuucaguaauucuuagaugauucagcuucaucauuaagaauaucuu

SEQ ID NO: 251343 - RNA, 62 nt, hsa
cacaccuaagagaaaaagaucgaauuuuucagaugauucagaaauuuucauucagguauuug

SEQ ID NO: 251344 - RNA, 62 nt, hsa
aaaaguaauguauaucuguaauauauaaucaaaugauucauuuuucuguuagacuaggcaaa

SEQ ID NO: 251345 - RNA, 62 nt, hsa
uguuguauuaguaaauuauuagaauccaauuaaugauucaauuaacauauaucuuauccaau

SEQ ID NO: 251346 - RNA, 62 nt, hsa
uauguuauuauaauuuugaauuuuuaaguucuaugauucauguuuuaaagauggaauaauuu

SEQ ID NO: 251347 - RNA, 62 nt, hsa
cuucacaauuucaaugcuucuuuuagucagaaaugauucaggguuauuugaggggaaaaaac

SEQ ID NO: 251348 - RNA, 62 nt, hsa
aaguguacauuacuuuuuaacuuauaugugaaaugauucauguaccucacaaaaucaugcaa

SEQ ID NO: 251349 - RNA, 62 nt, hsa
acuuggauuuugaggggcacucuaccuugguuaugauucaguagaggaaaaagaccaccuuu

SEQ ID NO: 251350 - RNA, 62 nt, hsa
uaaauaucguuagggugaagcauuauggucuaaugauucaaauguuuuaaaguuuaaugccu

SEQ ID NO: 251351 - RNA, 62 nt, hsa
aucaaacgaaaaaucaguccuguguugucagcaugauucauguauuuauauagauuugauua

SEQ ID NO: 251352 - RNA, 62 nt, hsa
guggauuuggucacaagguuuaaggugacccaaugauucagcuauuuaaaaaaaaaagagga

SEQ ID NO: 251353 - RNA, 62 nt, hsa
cuugaaucaguuuuuaaaauauuuagucuaagaugauucaaaguaguuuuauuuuaauacag

SEQ ID NO: 251354 - RNA, 62 nt, hsa
uuguguguuuuucuuuauacugcaaauuaauaaugauucacuuuauaguuugggagacagaa

SEQ ID NO: 251355 - RNA, 62 nt, hsa
aaccaccaccaaccacugcgaccacaagaaggaugauucaacagguuuuccugaagaauuga

SEQ ID NO: 251356 - RNA, 62 nt, hsa
uaaaucuuuuuggucaggaggauuauauucucaugauucagcauguguauagaaagacuuuc

SEQ ID NO: 251357 - RNA, 62 nt, hsa
gucaaguguuuuacuaucucacugcuguuuuuaugauucaggcuuauaacaaauauuguauc

SEQ ID NO: 251358 - RNA, 62 nt, hsa
augcaguuuggcaucugcaguacaccaagcacaugauucaugucugagccaggucugcuuau

SEQ ID NO: 251359 - RNA, 62 nt, hsa
uucucuccuuuguugagccuuuugagggguucaugauucauuaccacaguuuuaagaguuuc

SEQ ID NO: 251360 - RNA, 62 nt, hsa
aaaucaucaaagaaugcaauuuccauauccuaaugauucaaucucccuuacccugaccaauc

SEQ ID NO: 251361 - RNA, 62 nt, hsa
uuaauuucuuuucuaauaaaaaaaaccuauagaugauucagugauuuuuguccaauucauuu

SEQ ID NO: 251362 - RNA, 62 nt, hsa
ugagcaaguaauagauuuucuuggcaaaucuaaugauucagcccacaggacuguugaaacua

SEQ ID NO: 251363 - RNA, 62 nt, hsa
uuuguuccaaguauuaucugauagaauacaagaugauucaaaauuauauagauauuuaaagc

SEQ ID NO: 251364 - RNA, 62 nt, hsa
aguguaagcuaguauucuguguguucguagaaaugauucaauaccugcagcuggugaauuag

SEQ ID NO: 251365 - RNA, 62 nt, hsa
ucccccaaauuuaauaaagacagaggguucucaugauucacauugguugugcuauugcugau

SEQ ID NO: 251366 - RNA, 62 nt, hsa
ugaacacaguaacugauagguaaaaagacugcaugauucacuuuuacacuuauauuucauug

SEQ ID NO: 251367 - RNA, 62 nt, hsa
uauugcugaaauggcuguuggcaguucuuauuaugauucagagaagagcaaauagaccuuaa

SEQ ID NO: 251368 - RNA, 62 nt, hsa
ggaagaggacuccuuaaauuugggggacuuacaugauucauuuuaacaucugagaaaagcuu

SEQ ID NO: 251369 - RNA, 62 nt, hsa
guauuguuuuaaaaauuguaaaaauuauugugaugauucauuuagcauaaagagagguggac

SEQ ID NO: 251370 - RNA, 51 nt, hsa; identical to SEQ ID NO: 251096

SEQ ID NO: 251371 - RNA, 62 nt, hsa
cauaguauauacauaucaacauaacuauguugaugauucauaucaaauucucaaugcagguc

SEQ ID NO: 251372 - RNA, 62 nt, hsa
uaucagaaaucagcucaguggucuuccccgccaugauucacauuugaugaguuuuuaaaaau

SEQ ID NO: 251373 - RNA, 62 nt, hsa
cuuaagaaauuacuaguuguauuauuuauccuaugauucauucauucaauaagcuuuuacug

SEQ ID NO: 251374 - RNA, 62 nt, hsa
uucauaauuuuuaaagguuggaaucuuuuauaaugauucauaagacacuuagauuaagauuu

SEQ ID NO: 251375 - RNA, 62 nt, hsa
auugagcaggccuaucucuuucagauaguuuuaugauucacacagguuugaggaugcugggg

SEQ ID NO: 251376 - RNA, 62 nt, hsa
ccuucugauguuaccacgauagaauguuacugaugauucagggcuauuucugaagucuguau

SEQ ID NO: 251377 - RNA, 62 nt, hsa
ucgcaugugaaaaccucaacuauuuaaucaucaugauucauauuuugagugaauacaucagg

SEQ ID NO: 251378 - RNA, 62 nt, hsa
aguuuuggaagggccuucaguaucuuuagcacaugauucaccaauaucuuguuaguaauauu

SEQ ID NO: 251379 - RNA, 62 nt, hsa
cugcuagugugaaacuugcucuacucucugaaaugauucaaauacacuaauuuuccauacuu

SEQ ID NO: 251380 - RNA, 62 nt, hsa
aagggagaauuguggaugguuauuuauagcucaugauucauccaaggacugaguuauucucc

SEQ ID NO: 251381 - RNA, 62 nt, hsa
aguugccugccuguggcugguaagguaaugucaugauucauccucucuucagugagacugag

SEQ ID NO: 251382 - RNA, 62 nt, hsa
uggcaaagcugaaauuuuuauacauucaacucaugauucacauguggcaucagucccaucag

SEQ ID NO: 251383 - RNA, 62 nt, hsa
uuaaaaucuauucucucccccuuucucccuggaugauucaggaagcugacauuguuuccuca

SEQ ID NO: 251384 - RNA, 62 nt, hsa
uuaaccaguucucacaacuugcuauacauaagaugauucacacuugaaugaaacccuacaaa

SEQ ID NO: 251385 - RNA, 62 nt, hsa
aaauuauauagcuuuuuguuuuguuugaauaaaugauucauuccuguuugcuuuucuggugc

SEQ ID NO: 251386 - RNA, 62 nt, hsa
uuucacauuggaaacaagucagucauucagauaugauucaaaugucuauaaaccgaacugau

SEQ ID NO: 251387 - RNA, 62 nt, hsa
guacuguuaagguauuacuuuuuuucaugcugaugauucauaucuaaauuacauuauuaugu

SEQ ID NO: 251388 - RNA, 62 nt, hsa
cuaaccauuucucaacccuuacuaaacauaagaugauucauacuggagagaaguuacacaaa

SEQ ID NO: 251389 - RNA, 62 nt, hsa
auuaauaugauuauuaaucagaauaucagaauaugauucacuauuuaaacuaugauaaauua

SEQ ID NO: 251390 - RNA, 62 nt, hsa
cccagucaagagcuccucugcuccucgcuugaaugauucagggucagggagguggcucagag

SEQ ID NO: 251391 - RNA, 62 nt, hsa
guauuucucugaauucagugaagaaauaauucaugauucaacugcaucuccaaacauuacuc

SEQ ID NO: 251392 - RNA, 62 nt, hsa
uuauaugacuuuaagagcccacauuagguuuuaugauucauuugccagguuuuuaaauguuu

SEQ ID NO: 251393 - RNA, 62 nt, hsa
aaagugcaguauuuuucuacaucaugucaagaaugauucaauguaaauauuuuucauuuuau

SEQ ID NO: 251394 - RNA, 62 nt, hsa
ccucuucaauccaucuuaccacacaauauuucaugauucaaauucuucaaagucuuauacgc

SEQ ID NO: 251395 - RNA, 62 nt, hsa
aggaagauagaaacuagguuuugaaagauuacaugauucaagcgagggauuuuaaaguaaag

SEQ ID NO: 251396 - RNA, 62 nt, hsa
uauaauaugugauguaacauguagaugauaauaugauucaguagucaacuugagggaaauuu

SEQ ID NO: 251397 - RNA, 62 nt, hsa
uuucauuuuaaagguuauuugcucccgauuauaugauucaaguguuauaaguuuuagcuuga

SEQ ID NO: 251398 - RNA, 62 nt, hsa
ugcgcagaauaauauuaagaauugcuaugcuuaugauucaggcuggacagccuggacauuuu

SEQ ID NO: 251399 - RNA, 62 nt, hsa
aagaaaauauucuaacauuugauaauuuugaaaugauucaucuuucagaaauaaaaguauga

SEQ ID NO: 251400 - RNA, 62 nt, hsa
ccuuuggacaaaugcauuuaguggugguagaaaugauucaccagguccaauguuguucacca

SEQ ID NO: 251401 - RNA, 62 nt, hsa
cauguguauuuucuuauucugguauaccacaaaugauucaugcaaaugaauuuuuggugauu

SEQ ID NO: 251402 - RNA, 62 nt, hsa
uuucaauuuaaaaagagugaggaagaagcagaaugauucauuuugcugcgugugaaaucaug

SEQ ID NO: 251403 - RNA, 62 nt, hsa
uauucuuguuuauucaaaugacugcaauaacaaugauucauucauuaauguuaaggcuaaua

SEQ ID NO: 251404 - RNA, 62 nt, hsa
uuuaaauuugugaacucguaauuacuguuuuaaugauucaguuucuucagagugguaauugu

SEQ ID NO: 251405 - RNA, 62 nt, hsa
aauuguuauguaaacaucauaaauaguaaauaaugauucaaugugaauuuuaaaaugcaaau

SEQ ID NO: 251406 - RNA, 62 nt, hsa
acaaagaugagauuauuggggcuguucauauuaugauucagaaucauuuucuauugugguau

SEQ ID NO: 251407 - RNA, 62 nt, hsa
ucuaccuacauuuacauguagguagauaugaaaugauucaauauccaugucuccuuuuacuc

SEQ ID NO: 251408 - RNA, 62 nt, hsa
agcuggagcagcugauaguggaaaacagaauaaugauucaaagagucuucugucaccauguc

SEQ ID NO: 251409 - RNA, 62 nt, hsa
ugguuugcagcccuaaugaaauuaugucuaggaugauucagucuauuucccauuuacuagca

SEQ ID NO: 251410 - RNA, 62 nt, hsa
acugcuuacucguaaugaucuaguggggaaacaugauucauucacuuaaaauacugauuaag

SEQ ID NO: 251411 - RNA, 62 nt, hsa
uaauugaaguaguguggagcauuaacuuguggaugauucagaguuaaaagauaaaaagacgc

SEQ ID NO: 251412 - RNA, 62 nt, hsa
acuugaccacaacuacuguuuuuuugaaauacaugauucaugguuuacaugugucaagguga

SEQ ID NO: 251413 - RNA, 62 nt, hsa
gacagucuuuauuuuucuucuuaaaaauuuauaugauucaaaaccauuucuucagguuaaau

SEQ ID NO: 251414 - RNA, 62 nt, hsa
aaauguuucccaugaucgcucauucuucuuuuaugauucauacguuauuccuuauaaaguaa

SEQ ID NO: 251415 - RNA, 62 nt, hsa
uuacauugucuaaaaauccuuacaagguuaagaugauucaauaucaagaagauucagaaaau

SEQ ID NO: 251416 - RNA, 62 nt, hsa
agccagugccacaguuugaagauucucauuaaaugauucauuucauuucaccuugacgauuc

SEQ ID NO: 251417 - RNA, 62 nt, hsa
cuucauuucuguugauuuuuuuuauugcauuuaugauucaguggcugggaauugagaauuua

SEQ ID NO: 251418 - RNA, 62 nt, hsa
auauaggcuguucuagccacagugguagauuuaugauucacauccgaaagugugccuuaguu

SEQ ID NO: 251419 - RNA, 62 nt, hsa
ucacauggcuugcacucagugacaccaaauccaugauucaauguugaucuugagcaaguauu

SEQ ID NO: 251420 - RNA, 62 nt, hsa
acuauuuuaacuuagaaaaaccaucguuucauaugauucacccuaauagauaccuccauuau

SEQ ID NO: 251421 - RNA, 62 nt, hsa
ucugaccuucagcucacgcuucacagugaucgaugauucaggugcagaggaaguacaaacua

SEQ ID NO: 251422 - RNA, 62 nt, hsa
ucacgagaauagcacaggaaagacuggcccccaugauucaauuaccucccccgggucccucc

SEQ ID NO: 251423 - RNA, 62 nt, hsa
gcugaacgugcuccucucuccuucucuguacaaugauucagcaucucggcggaagaggaaaa

SEQ ID NO: 251424 - RNA, 62 nt, hsa
uacucuuguuaaccuuagagcuagaccugggaaugauucaacuucaagccuuaaccuggaau

SEQ ID NO: 251425 - RNA, 62 nt, hsa
guucgucacaaaauucaacauagaauuacccuaugauucagcgauuccaccucuggcuauag

SEQ ID NO: 251426 - RNA, 62 nt, hsa
ugggggaagugggguauaauauuuaacgaaucaugauucagauuguaccauuacauguuuca

SEQ ID NO: 251427 - RNA, 62 nt, hsa
accucgcuggacucucagucucugagcagugaaugauucaguguuaaaugugaugaauacug

SEQ ID NO: 251428 - RNA, 62 nt, hsa
gcagguggagccauggugcucugugguggcgcaugauucacugagcaaacagcacuuuacag

SEQ ID NO: 251429 - RNA, 62 nt, hsa
uuauagaaucuaagcuggucuuaaagucauaaaugauucauugggucauuagugagaaacgg

SEQ ID NO: 251430 - RNA, 62 nt, hsa
cagaugaucuuuuacucuuagguuuugagcuaaugauucaaaacgggggaauauaaaagguu

SEQ ID NO: 251431 - RNA, 62 nt, hsa
acaaaaugcugacuacuguagaaaaaaaggucaugauucaugauugaaagcagaacaaugga

SEQ ID NO: 251432 - RNA, 62 nt, hsa
aagcugaugauuguaccagucuuaaauuauucaugauucaauaaaauugaugcuuauuuauu

SEQ ID NO: 251433 - RNA, 62 nt, hsa
aacaauuucuuuuuuaaaaaagacuauuuuauaugauucacaugcuaaagccaggauugugu

SEQ ID NO: 251434 - RNA, 62 nt, hsa
uacuucuucaugguauuaugaagacuauauagaugauucaaccaagccugcaaaucucccuc

SEQ ID NO: 251435 - RNA, 62 nt, hsa
aaggauugccauuagugacuuggaccaguuagaugauucacuuuuugccccuagggaugaga

SEQ ID NO: 251436 - RNA, 62 nt, hsa
caauuucauguaauuuacccuuugcaauaaaaaugauucauuaaauauauaacuaaauguga

SEQ ID NO: 251437 - RNA, 61 nt, hsa; identical to SEQ ID NO: 251163

SEQ ID NO: 251438 - RNA, 62 nt, hsa
aauuguuggauuuaaagaggcaacuuuuguuuaugauucaaauaugggaauuugagaaauau

SEQ ID NO: 251439 - RNA, 62 nt, hsa
ucaaccuuggucucaaauagcugcuuuuguauaugauucacgagcuuuuuuagaguuuauau

SEQ ID NO: 251440 - RNA, 62 nt, hsa
guauccugcucagccaagaucugccuaagauuaugauucaggggcauuuuggugcuguuaaa

SEQ ID NO: 251441 - RNA, 62 nt, hsa
uauaaguuugaaaugaaauggucuagagggaaaugauucaaauuuuuucauaauucaaacaa

SEQ ID NO: 251442 - RNA, 62 nt, hsa
aaccaaagagacccugaagaauauuugaugugaugauucacuuuucaguucucaaauuaaaa

SEQ ID NO: 251443 - RNA, 62 nt, hsa
guuuuaaaggagacuaacuccaggaguaggaaaugauucaucauccuccaaagcaagaggcu

SEQ ID NO: 251444 - RNA, 62 nt, hsa
ggcauaaauauuuuugacagcagaauagaagaaugauucaugagaaccugaaccagaugaac

SEQ ID NO: 251445 - RNA, 62 nt, hsa
uuacuggacaaaaucaauaacuacaaaaggcaaugauucacgcuuuuguuuucauaauaccu

SEQ ID NO: 251446 - RNA, 62 nt, hsa
gaaaauuuaaaagauuaaaugaaugagaagaaaugauucauaaauuuugaacuaacaguaau

SEQ ID NO: 251447 - RNA, 62 nt, hsa
ggggcggggcagugaggggugggagaaggugaaugauucauuauuccaccccgagguuugcu

SEQ ID NO: 251448 - RNA, 62 nt, hsa
uacauccuucccucacucccaugauuggagaaaugauucauugggugaugaguguugggguu

SEQ ID NO: 251449 - RNA, 62 nt, hsa
aggaagugaauaagaagaugacagugauucaaaugauucaaaugccaugacauuggaagaag

SEQ ID NO: 251450 - RNA, 62 nt, hsa
aggaagugaauaagaagaugagagugauucaaaugauucaaauuccaugacauuggaaaaag

SEQ ID NO: 251451 - RNA, 62 nt, hsa
uuauucacugcaacaaagcaacaauguuguccaugauucaaaaucuaagcaguuucgauuuu

SEQ ID NO: 251452 - RNA, 62 nt, hsa
uuuugaaauauuaaggucuugccaagcuucugaugauucacaccuguacuacugauuauuaa

SEQ ID NO: 251453 - RNA, 62 nt, hsa
uuuuuuuuugaaagaguucuccucauaggaggaugauucagcaucagaagaagaaggaaccc

SEQ ID NO: 251454 - RNA, 62 nt, hsa
acaauaagcaauauguggugauaaugaaaagaaugauucagucuugacggugaauggaagac

SEQ ID NO: 251455 - RNA, 62 nt, hsa
uaucuguucuugcuacccaugacuuuauauggaugauucagaaauuggaacagaauguuuua

SEQ ID NO: 251456 - RNA, 62 nt, hsa
aaucuugauugugauaagccccccuggaggauaugauucacuuuaugugauucaucuuauuc

SEQ ID NO: 251457 - RNA, 62 nt, hsa
uucugugaguccuauaaaaagcaaggauaugcaugauucagggaaugaagaaucacaggcuu

SEQ ID NO: 251458 - RNA, 62 nt, hsa
uuucaaccaaaugauugguucaaaaggaaagaaugauucaaagcagaggaauuuauuaugca

SEQ ID NO: 251459 - RNA, 62 nt, hsa
guauuagagaccagauauuuuucuaccuguucaugauucacaucucuucuugcauguaccua

SEQ ID NO: 251460 - RNA, 62 nt, hsa
uuuuauucagaacgaggaagagaacacaaggaaugauucaagauccaccuugagaggaauga

SEQ ID NO: 251461 - RNA, 62 nt, hsa
gucugaauggaucugaccccugucagaugaaaaugauucacagcucuggcaguucccaaguc

SEQ ID NO: 251462 - RNA, 62 nt, hsa
aagaaacugcugaaaaagcugggugcagugaaaugauucaugugcuuccggacaacugccaa

SEQ ID NO: 251463 - RNA, 62 nt, hsa
aaaugcaaguaguuuccucgcgugaccucaccaugauucacauacgugccacuguuugaaau

SEQ ID NO: 251464 - RNA, 62 nt, hsa
ccuuagccaugauuucguuaguagaccuauuuaugauucaauugcaauuuucagauaggaug

SEQ ID NO: 251465 - RNA, 62 nt, hsa
caaaucuugaaagacgaaaucaaagcccauuaaugauucagaaucagugcuugaccuccugu

SEQ ID NO: 251466 - RNA, 62 nt, hsa
uauggaucauucugaugacagauuuauacaaaaugauucaaaccaguaacuuaguaaaauug

SEQ ID NO: 251467 - RNA, 62 nt, hsa
uuacacacuauauaaguuguucuuucaguuuuaugauucaacuacuguuuuuccuucagcug

SEQ ID NO: 251468 - RNA, 62 nt, hsa
accgucucagacacgcacagugggccugcugcaugauucacacccagucccugccacagacc

SEQ ID NO: 251469 - RNA, 62 nt, hsa; identical to SEQ ID NO: 251468

SEQ ID NO: 251470 - RNA, 62 nt, hsa
acuccugacugcccggcacagaugcuccagggaugauucaagccauuccaaaguucaacuug

SEQ ID NO: 251471 - RNA, 62 nt, hsa
auuuauaacauuguaaaugauaugucuuuaaaaugauucacuuuuauuguauaauuaugaag

SEQ ID NO: 251472 - RNA, 62 nt, hsa
ucuaucaguaucaauaaccauuggaaggagaaaugauucaugugugaaaaaauucucagauc

SEQ ID NO: 251473 - RNA, 62 nt, hsa
ggaaaauccuaaacauggaagaugauuuaaaaaugauucacccuggaauacaugcuuccagu

SEQ ID NO: 251474 - RNA, 62 nt, hsa
auuguggacuuaauuacaaccacugcacuguaaugauucaaugcuguauuaugauauugcug

SEQ ID NO: 251475 - RNA, 62 nt, hsa
aagcauauaaauuaaaauauuuaaaauuagauaugauucacacuauauucuguuucauaugc

SEQ ID NO: 251476 - RNA, 62 nt, hsa
aguucccugaaacacgaaacuuguuauugugaaugauucauguuauauuuaaugcauuaaac

SEQ ID NO: 251477 - RNA, 62 nt, hsa
gugcauuucuauuuauaucaaaaggugcuaaaaugauucaauuugcauuuucugauccugua

SEQ ID NO: 251478 - RNA, 62 nt, hsa
aaauaauaagaugcaacauuuguugaggccuuaugauucagcagcuuggucacuugauuaga

SEQ ID NO: 251479 - RNA, 62 nt, hsa
gguaaauauggcuuuaauuacaaacaugaggaaugauucacugaagaugaaaagauaggacg

SEQ ID NO: 251480 - RNA, 62 nt, hsa
cugcuauagcccaaagcacguaguauuugcugaugauucagcaugagcugcaucuaccuacu

SEQ ID NO: 251481 - RNA, 62 nt, hsa
aacugagggaauuccugucuucuuuaggaguaaugauucauagaucuagauagguggaaaua

SEQ ID NO: 251482 - RNA, 62 nt, hsa
ucgcaaaauguuucaaguacuguaacugugucaugauucacccccaaacagugacauuuauu

SEQ ID NO: 251483 - RNA, 62 nt, hsa
aagccaacuucaaauaccgugaccaaauuuacaugauucauauucauuaugcauuacuuggu

SEQ ID NO: 251484 - RNA, 62 nt, hsa
auggguggguaguguaaauacacaagaaaaggaugauucacaucccaugugggauggagcag

SEQ ID NO: 251485 - RNA, 62 nt, hsa
cugaaacuuaacgugaucaucaccacugacagaugauucacagagacuguuugaaucuuguc

SEQ ID NO: 251486 - RNA, 62 nt, hsa
ccauuuauaacuucuguuuuuuuauugagaaaaugauucacgaauuccaaaucagauugcca

SEQ ID NO: 251487 - RNA, 62 nt, hsa
aaucccaccacaagcacauacuaauuuuauuuaugauucaaaugugacucgugccugcccau

SEQ ID NO: 251488 - RNA, 62 nt, hsa
uccacggaugggugacaggggaugguuuugggaugauucaagugcauuacauuuauugugca

SEQ ID NO: 251489 - RNA, 62 nt, hsa
agcuaaauccucaaaaccuaguaaggggacuaaugauucauuaaaguaaauugaugguuuug

SEQ ID NO: 251490 - RNA, 62 nt, hsa
caccgccccucagcaaggaugacucagcagggaugauucagcagagauaacucggggaugac

SEQ ID NO: 251491 - RNA, 62 nt, hsa
cagccucugauccaucccucaagccacaguuaaugauucagaugucaguagaugaccaaaga

SEQ ID NO: 251492 - RNA, 62 nt, hsa
auuggggcaugggaggggggcugggggaccccaugauucagccacggacuccaaugcccagc

SEQ ID NO: 251493 - RNA, 62 nt, hsa
uauuacggaugaguucuggaaaagacccagcuaugauucauaaaaacacuucuggaugaauc

SEQ ID NO: 251494 - RNA, 62 nt, hsa
ccccucaucugcucagcagcuauuugaaugagaugauucagaaggggaggggagacagguaa

SEQ ID NO: 251495 - RNA, 62 nt, hsa
ucuauuuuaaauauuuuuaguauguacuguguaugauucauuaccauuuugaggggauuuau

SEQ ID NO: 251496 - RNA, 62 nt, hsa
ugaagugauacacuaaucacggggaacccagaaugauucaacauuuuccccccacuccuccc

SEQ ID NO: 251497 - RNA, 62 nt, hsa
cucuucucuucauacucucuaccuuccuuaccaugauucagccacacuggccuuucuguucc

SEQ ID NO: 251498 - RNA, 62 nt, hsa
gccuucgggagggcggggggagguugauuuucaugauucaugagcuggguacugacugagau

SEQ ID NO: 251499 - RNA, 62 nt, hsa
uucuuuaacacacacuaggcucuuuguguauuaugauucagugcuauuuguaacuguguccc

SEQ ID NO: 251500 - RNA, 62 nt, hsa
uuugguguuugucuguguuuguuuuucaagaaaugauucaaauugcugcuuggauuuugaaa

SEQ ID NO: 251501 - RNA, 62 nt, hsa
uauaugaauaugcaguaugggacuuugaaauaaugauucauaauaaaauacuaaacgugugu

SEQ ID NO: 251502 - RNA, 62 nt, hsa
auuuaggaagcaaaaguaagaagcagcauuuuaugauucauaauuucaguuuacuagacuga

SEQ ID NO: 251503 - RNA, 62 nt, hsa
uuuauauuuuacuuuuuuauugcugguuuaagaugauucagauuauccuuguacuuugagga

SEQ ID NO: 251504 - RNA, 62 nt, hsa
uccagugagcgcgccugcuuuagagacacaggaugauucagaccggaaacagaccucguggg

SEQ ID NO: 251505 - RNA, 62 nt, hsa
gacuucaugauccugggccugagaacacaggaaugauucauagcccaccccccaccuccaug

SEQ ID NO: 251506 - RNA, 62 nt, hsa
agauuuccuguagcugugaauuguuaaaauguaugauucaggauaaaacguaaacacgugcu

SEQ ID NO: 251507 - RNA, 62 nt, hsa
guaguuuuacauuuuauaaaguaaagauguaaaugauucagguuuaaagcucuauuugacuu

SEQ ID NO: 251508 - RNA, 62 nt, hsa
cagugauucaacuuuaaaacaaauuucucgugaugauucauuucaaaauccugagugagucu

SEQ ID NO: 251509 - RNA, 62 nt, hsa
guuagccuggauggucucgauuuucugaucuuaugauucacccaccucuaccucccgaagug

SEQ ID NO: 251510 - RNA, 62 nt, hsa
gaaauguaagguuugugacaaggcuuucgggaaugauucacacguggcaccccauacuagaa

SEQ ID NO: 251511 - RNA, 62 nt, hsa
aacuuaggaugagggcagaaaagucuuuggggaugauucagucuguaccagacaugacaaca

SEQ ID NO: 251512 - RNA, 62 nt, hsa
cuugaguaugugccacgugcuugugaaaugcuaugauucacauguaacauuuaaacauuaau

SEQ ID NO: 251513 - RNA, 62 nt, hsa
gugaggaaaucucuuccaauuucugcuucugaaugauucaauguugggagcaauagaaauaa

SEQ ID NO: 251514 - RNA, 62 nt, hsa
aaauacauuuuuuugguucuauauaaugcuucaugauucauuuagggaccuagaaauauugu

SEQ ID NO: 251515 - RNA, 62 nt, hsa
caucugccccacucgccuuugccccgucaucgaugauucaggcagagccagauucguuaggu

SEQ ID NO: 251516 - RNA, 62 nt, hsa
ccaggagacaguucaagaaagcuucaaacugcaugauucaugccaauuagcaauugacuguc

SEQ ID NO: 251517 - RNA, 62 nt, hsa
aauugaaaacuuuggagaacucauuucaaguuaugauucagugcauuuucaacauugauuuu

SEQ ID NO: 251518 - RNA, 62 nt, hsa
agaaauuauaccuuuuuaguacuugcugaagaaugauucaggguaaaucacauacuuuguuu

SEQ ID NO: 251519 - RNA, 62 nt, hsa
cuauacucauacauuuuuaauaugguuuaucaaugauucauguuucccucaaauagugaugg

SEQ ID NO: 251520 - RNA, 62 nt, hsa
uuugcuuccccgugcaugauuuacucuuagagaugauucagaggucacuucauuuuuauuaa

SEQ ID NO: 251521 - RNA, 62 nt, hsa
ucauuggggugaaguguucuugacaguuuaauaugauucacuuuucuccaaagacauguaaa

SEQ ID NO: 251522 - RNA, 62 nt, hsa
uugagccuaggaggucaaggcugcagugagccaugauucacagcacugcacugcagccuggg

SEQ ID NO: 251523 - RNA, 62 nt, hsa
gagagggaugguuucugagggguucugaaaguaugauucaaugugcaacauacagguagguc

SEQ ID NO: 251524 - RNA, 62 nt, hsa
uucaccccucccagucuacccauccagccuucaugauucauuccugugucaagguuagucgc

SEQ ID NO: 251525 - RNA, 62 nt, hsa
uagucccccaucccuuccucccuuacccagcuaugauucaguugucucugcccucccucuua

SEQ ID NO: 251526 - RNA, 62 nt, hsa
auguaaaauuuaaauaauuacuuuuuuauaauaugauucacuuaugccacagauucaacauu

SEQ ID NO: 251527 - RNA, 62 nt, hsa
gcccacagaugauuccuuuauauagauguauaaugauucaaacugcugccuuugccuccagu

SEQ ID NO: 251528 - RNA, 62 nt, hsa
gaaugcuuuuugauguugauuuugaccuguucaugauucagaagaaaaacaaacuuuuuugg

SEQ ID NO: 251529 - RNA, 62 nt, hsa
ucaugagaauagcaugggaaagaccugccuccaugauucaguuaccucccacugggucccuc

SEQ ID NO: 251530 - RNA, 62 nt, hsa
cucuugauuggagcuuuugugaugcagcuaccaugauucaaaaaaauuaaaaauuaaaaaaa

SEQ ID NO: 251531 - RNA, 62 nt, hsa
aaagcauuugagcgaaagucauguuuggugacaugauucauacagaccucuugagcuccugg

SEQ ID NO: 251532 - RNA, 62 nt, hsa
uugugcuuggaauguguugaugugcacagcuaaugauucaaugcgagacaagauuggcgucu

SEQ ID NO: 251533 - RNA, 62 nt, hsa
auaauugugugauauuucagaaauacagauaaaugauucaaaaagucacaguuaaggagaau

SEQ ID NO: 251534 - RNA, 62 nt, hsa
cccugcuggguuggggagggugggacagcuggaugauucaucugugggugccaggcugugug

SEQ ID NO: 251535 - RNA, 63 nt, hsa
cuaggccaaaaauggugagcgaucauuuauuucaugauucaaccugauacauuuacauagugc

SEQ ID NO: 251536 - RNA, 63 nt, hsa
gagggguggugcuagaagacagacaucuguggaaugauucacauccucucaaguuaggaggau

SEQ ID NO: 251537 - RNA, 63 nt, hsa
caguaaccaacuuggaaagcuguauuuguucccaugauucagcaaacaaugaguaccuacugu

SEQ ID NO: 251538 - RNA, 63 nt, hsa
ucaugaacauuuugauacaaauuucaucauuuaaugauucaccaauuucuugcauuaauuuga

SEQ ID NO: 251539 - RNA, 63 nt, hsa
cauuuuuuuccuaaccuuuugcuauuauaaauaaugauucauuuuauaaccuuuuauauaggu

SEQ ID NO: 251540 - RNA, 63 nt, hsa
ucuaaguaaagcacagucccuaggacauaguaaaugauucauauauccgaacuacuguuauaa

SEQ ID NO: 251541 - RNA, 63 nt, hsa
caaaaccaggauggaugccucacauagaucaugaugauucaauccaaaggcacuuugcagugc

SEQ ID NO: 251542 - RNA, 63 nt, hsa
guguuccuuauacucuauuauauaguguuauucaugauucagcugaucuuaacaaaauucgua

SEQ ID NO: 251543 - RNA, 63 nt, hsa
gaguagcugagaauucaaaaacauccuugcagaaugauucaaaagacaaaagccaggcucaac

SEQ ID NO: 251544 - RNA, 63 nt, hsa
uauguuauaucugcauaugagugauaugugaucaugauucauuuugcagauuuacauuuugcu

SEQ ID NO: 251545 - RNA, 63 nt, hsa
ugacuugggcugcuggugccuugagucccacagaugauucauuaggaaaagccagauauacca

SEQ ID NO: 251546 - RNA, 63 nt, hsa
cucuuacuucuacagguuccuugagcaccaaagaugauucauaacucuguauaggugacagcu

SEQ ID NO: 251547 - RNA, 63 nt, hsa
gaaccaagcccugguagggaagagguaagggggaugauucaccuccauauuuccuaagcaggu

SEQ ID NO: 251548 - RNA, 63 nt, hsa
auucaucugaagagagacuuaagaugaaagcaaaugauucagcucccuuauacccccauuaaa

SEQ ID NO: 251549 - RNA, 63 nt, hsa
ugauguuauucuagaauguuuucuuuccagaugaugauucagaagcuaauuuuaaaaaacggu

SEQ ID NO: 251550 - RNA, 63 nt, hsa
cuugaggcuaaguuuuggacuaccaaggaccagaugauucacauguaggaaacagccagaagc

SEQ ID NO: 251551 - RNA, 63 nt, hsa
agugguaauccugaaucucuuuuaaacuauuauaugauucauaaugguucucaggaauuaaua

SEQ ID NO: 251552 - RNA, 63 nt, hsa
cugcuuaucgugucugggguucaccggaaauaaaugauucacuggaacaauucuacugucaaa

SEQ ID NO: 251553 - RNA, 63 nt, hsa
auauaagaaauaaaaauugggcaauaaaauaaaaugauucaguguuucuuuucuauauuguca

SEQ ID NO: 251554 - RNA, 63 nt, hsa
ugugacugucaguuguaucuguugcuuuucucaaugauucagggauacaaaugggcuucucuc

SEQ ID NO: 251555 - RNA, 63 nt, hsa
augacuuauuucugcucuggaauaaaguugcagaugauucaaaccgaucuuggcuuucagucu

SEQ ID NO: 251556 - RNA, 63 nt, hsa
uacggacuaagcuguaauuaugauggcugagaaaugauucauuugaagauacaauuuuauuug

SEQ ID NO: 251557 - RNA, 63 nt, hsa
cuggggaugauguggaaauaggggcacacacagaugauucauggauggggacauggaaaugag

SEQ ID NO: 251558 - RNA, 63 nt, hsa
acuuaagugucuguguagacaaccaaagaauaaaugauucaugguuuuuuuuacuugguuugu

SEQ ID NO: 251559 - RNA, 63 nt, hsa
acauguaugauuugugccacugaucuuaaaccuaugauucaguaacuucuuaccauauaaaaa

SEQ ID NO: 251560 - RNA, 63 nt, hsa
uucucuauaccaagauaugcuaggaguaggaugaugauucaaagugguaacccaaauucauaa

SEQ ID NO: 251561 - RNA, 63 nt, hsa
gguccuaacuuucuguuauuuuagaauguuaacaugauucacauuauacuuucucuuaguuaa

SEQ ID NO: 251562 - RNA, 63 nt, hsa
uccugcagggcuggaggaacagguucuuagaagaugauucaccuuggaggaagcuggggaaag

SEQ ID NO: 251563 - RNA, 63 nt, hsa
uuuuuucuaaucuuuaguagauuugauuaaauaaugauucacagaauuuaguaacagaaucaa

SEQ ID NO: 251564 - RNA, 63 nt, hsa
gaccaugacccagccacagucaauaccagaaagaugauucagagucugaaguggugccccagg

SEQ ID NO: 251565 - RNA, 63 nt, hsa
gccacucagaugaccugaguuguggagagauguaugauucaaacauagaugacuggauuccug

SEQ ID NO: 251566 - RNA, 63 nt, hsa
cuaccaugagaacaguaugggggaaacaacuccaugauucaguuaucucccaccagguuccuc

SEQ ID NO: 251567 - RNA, 63 nt, hsa
cucuaucaauagaguaaccucauucucugccugaugauucaaaggcaugggaagaccaaaacc

SEQ ID NO: 251568 - RNA, 63 nt, hsa
gaugauaccuuuguugaaagaauugugaauagcaugauucauuucuagcagaggcugaguuua

SEQ ID NO: 251569 - RNA, 63 nt, hsa
gguuuaaagagauugugucuguuuaaaaucaguaugauucagagaaggaccaaauuauaugaa

SEQ ID NO: 251570 - RNA, 63 nt, hsa
ccugcaggcugucacaugacucauugaguaguaaugauucagaagaaaaagaaaaaggagacu

SEQ ID NO: 251571 - RNA, 63 nt, hsa
auuaaaacugacauaaaauuuuaugauaauaacaugauucaagaaaugugauguagauuuuug

SEQ ID NO: 251572 - RNA, 63 nt, hsa
acuuggcuucuggucuugauguauuugauaagaaugauucauuuucugauauggcuuccuaau

SEQ ID NO: 251573 - RNA, 63 nt, hsa
auagguugaauaugguaggucuuugaaaauaugaugauucaauuuucucaauuuucuuugcuu

SEQ ID NO: 251574 - RNA, 63 nt, hsa
uugucauagaggaaaagcacagauuauaccuggaugauucaggagcacauucugauuccaggu

SEQ ID NO: 251575 - RNA, 63 nt, hsa
uuugaauguauuguucuguuuguguuauuucagaugauucaaauaucaaaaggaagauucuuc

SEQ ID NO: 251576 - RNA, 63 nt, hsa
gugacauauugcuacaaagauuuuuuuuccuaaaugauucaguaauugaaugauuauuuaaua

SEQ ID NO: 251577 - RNA, 63 nt, hsa
auuauauuguaaugauguuagauaauacucaacaugauucaguaugacaaacuuuuuugagca

SEQ ID NO: 251578 - RNA, 63 nt, hsa
uauauugacgguacagaugguccccaacuuguaaugauucaauuuaggguuuuucaacuuuac

SEQ ID NO: 251579 - RNA, 63 nt, hsa
cguacaaaauccagcuaugaauauagagggcuuaugauucagauuguuaucuaucaacuauaa

SEQ ID NO: 251580 - RNA, 63 nt, hsa
ugguaacaccuaacugagccucacucacauuaaaugauucacuugaaauauauacagaaauug

SEQ ID NO: 251581 - RNA, 63 nt, hsa
uacucuuauauguaccauugguugauaauuauaaugauucauuuggacuugaagaaagauugu

SEQ ID NO: 251582 - RNA, 63 nt, hsa
uccccaggcacaguaucugaaucacuggggauuaugauucacccucuuuggagaacaugcucu

SEQ ID NO: 251583 - RNA, 63 nt, hsa
gucacgagaauagcacgggaaagacuggcccccaugauucaauuaccucccccugggucuguc

SEQ ID NO: 251584 - RNA, 63 nt, hsa
aucacaagaauagcaugggaaagacuggcccccaugauucaauuaccuccccuugggucucuc

SEQ ID NO: 251585 - RNA, 63 nt, hsa
ucuaggcagggaaaacugaacaaaaaggcagaaaugauucaggggaaaaucgggccuagaauu

SEQ ID NO: 251586 - RNA, 63 nt, hsa
ucaucauuuucugcccccccaaaaucuguugaaaugauucacugaugcaaaacauucacccgu

SEQ ID NO: 251587 - RNA, 63 nt, hsa
cuuugaaaauauuguuacaaaggcacugcuaaaaugauucacagggagaguggccaguuggaa

SEQ ID NO: 251588 - RNA, 63 nt, hsa
aagguauuaauaagaggucuggcagguauucccaugauucacagaguuacauuugcauuuaau

SEQ ID NO: 251589 - RNA, 63 nt, hsa
aaaguuuacaugaauuuuacaacaaacuagugcaugauucaccaagcaguacuacagaacaaa

SEQ ID NO: 251590 - RNA, 63 nt, hsa
ccaguuucauugguggaauaaguccccuuacucaugauucaucaauauuccuauauuaaaauu

SEQ ID NO: 251591 - RNA, 63 nt, hsa
gauggaaggaaagcugggacaagcagggaacgcaugauucagggaugcugucacucggcagcc

SEQ ID NO: 251592 - RNA, 63 nt, hsa
caucuucccccacccccauuugcugguucagcuaugauucaggcuucuucagcccucccaaau

SEQ ID NO: 251593 - RNA, 63 nt, hsa
cuaacucauggguacccagacucuaaauauuucaugauucacaacuaggaccucauaucuucc

SEQ ID NO: 251594 - RNA, 63 nt, hsa
agcaaccuaaguaaaaacauuccccuccuauguaugauucauuugaucauauaaaacaucaug

SEQ ID NO: 251595 - RNA, 63 nt, hsa
uaugauugacccugauuuuaauugugaaauuauaugauucauauauuuuaugaaucagaauaa

SEQ ID NO: 251596 - RNA, 63 nt, hsa
gaaacccuaaauauguuuacauaccauuaagauaugauucauguaacaauguuaaauuaauua

SEQ ID NO: 251597 - RNA, 57 nt, hsa; identical to SEQ ID NO: 251049

SEQ ID NO: 251598 - RNA, 63 nt, hsa
aauagaaguuaugaguggguuuaacaauuuuagaugauucagcuuuuguuccauuacuguuga

SEQ ID NO: 251599 - RNA, 63 nt, hsa
ugaggagugagacacaggcaucaacacucucaaaugauucacauguucagccaaaguugagaa

SEQ ID NO: 251600 - RNA, 63 nt, hsa
ucuugguguuguuauggcaaguuuuugguaaugaugauucaaucauuuugggaaauucuugca

SEQ ID NO: 251601 - RNA, 63 nt, hsa
ugugagagaaaucacaaaguauuagaguuuaccaugauucagagaaguucuucaggccuguag

SEQ ID NO: 251602 - RNA, 63 nt, hsa
aaaacuccaguucaugcuggaucuuaaccaaaaaugauucaauacuguuaucacuaaaacagc

SEQ ID NO: 251603 - RNA, 63 nt, hsa
cuugauuacaguauuuuaugcagacuauuaggaaugauucagugcauuuaacugaacacagag

SEQ ID NO: 251604 - RNA, 63 nt, hsa
guuuguccucacaggcaugccacguggccugagaugauucagaacaaaucaugcuaacuuuga

SEQ ID NO: 251605 - RNA, 63 nt, hsa
cccuaggccugcuggcucugguuuucuaugcagaugauucauuggauugggggugaguguuuu

SEQ ID NO: 251606 - RNA, 63 nt, hsa
ggaauacacuuguguuuaagcaccauggccuugaugauucacuguuggggagaagaaacaaga

SEQ ID NO: 251607 - RNA, 63 nt, hsa
gguuggaucauuuguuuuuaaaacuacuuagguaugauucacauacaaaaagcugcacauauu

SEQ ID NO: 251608 - RNA, 63 nt, hsa
aauuggugauaaguggaaaaaagagaaaaaccaaugauucauaacaauguaugugaaagugua

SEQ ID NO: 251609 - RNA, 63 nt, hsa
auucauauggccccucuuaaccaugcugguguuaugauucaguauuaacucucaauuagcaug

SEQ ID NO: 251610 - RNA, 63 nt, hsa
uauaucguguauauagcuuuaguauucgguuacaugauucacagaccccugaauuccaaaaua

SEQ ID NO: 251611 - RNA, 63 nt, hsa
auaggguaugaacuagucaaaauaugaaccauuaugauucaaguuagauuuuccucuggagag

SEQ ID NO: 251612 - RNA, 63 nt, hsa
guuuacuuucuacaaacucuccguaguauauucaugauucaguguagaauguauagacuuuau

SEQ ID NO: 251613 - RNA, 63 nt, hsa
uuuaacuuguuaagcaauauuuuuaagggccaaaugauucaaaacaucacagguauuuaugug

SEQ ID NO: 251614 - RNA, 63 nt, hsa
ugaauagccaugacaagaguuugcauuuucuugaugauucaucuccaugagugcacaaucccu

SEQ ID NO: 251615 - RNA, 63 nt, hsa
auguuacuagcaucaggagcuuacuguuuuauuaugauucaucuucaguaauuuuuagaagca

SEQ ID NO: 251616 - RNA, 63 nt, hsa
auacagaguuuaaauaauuucaguaauucuuagaugauucagcuucaucauuaagaauaucuu

SEQ ID NO: 251617 - RNA, 63 nt, hsa
acacaccuaagagaaaaagaucgaauuuuucagaugauucagaaauuuucauucagguauuug

SEQ ID NO: 251618 - RNA, 63 nt, hsa
aaaaaguaauguauaucuguaauauauaaucaaaugauucauuuuucuguuagacuaggcaaa

SEQ ID NO: 251619 - RNA, 63 nt, hsa
auguuguauuaguaaauuauuagaauccaauuaaugauucaauuaacauauaucuuauccaau

SEQ ID NO: 251620 - RNA, 63 nt, hsa
auauguuauuauaauuuugaauuuuuaaguucuaugauucauguuuuaaagauggaauaauuu

SEQ ID NO: 251621 - RNA, 63 nt, hsa
ccuucacaauuucaaugcuucuuuuagucagaaaugauucaggguuauuugaggggaaaaaac

SEQ ID NO: 251622 - RNA, 63 nt, hsa
aaaguguacauuacuuuuuaacuuauaugugaaaugauucauguaccucacaaaaucaugcaa

SEQ ID NO: 251623 - RNA, 63 nt, hsa
uacuuggauuuugaggggcacucuaccuugguuaugauucaguagaggaaaaagaccaccuuu

SEQ ID NO: 251624 - RNA, 63 nt, hsa
auaaauaucguuagggugaagcauuauggucuaaugauucaaauguuuuaaaguuuaaugccu

SEQ ID NO: 251625 - RNA, 63 nt, hsa
aaucaaacgaaaaaucaguccuguguugucagcaugauucauguauuuauauagauuugauua

SEQ ID NO: 251626 - RNA, 63 nt, hsa
uguggauuuggucacaagguuuaaggugacccaaugauucagcuauuuaaaaaaaaaagagga

SEQ ID NO: 251627 - RNA, 63 nt, hsa
acuugaaucaguuuuuaaaauauuuagucuaagaugauucaaaguaguuuuauuuuaauacag

SEQ ID NO: 251628 - RNA, 63 nt, hsa
uuuguguguuuuucuuuauacugcaaauuaauaaugauucacuuuauaguuugggagacagaa

SEQ ID NO: 251629 - RNA, 63 nt, hsa
caaccaccaccaaccacugcgaccacaagaaggaugauucaacagguuuuccugaagaauuga

SEQ ID NO: 251630 - RNA, 63 nt, hsa
guaaaucuuuuuggucaggaggauuauauucucaugauucagcauguguauagaaagacuuuc

SEQ ID NO: 251631 - RNA, 63 nt, hsa
ugucaaguguuuuacuaucucacugcuguuuuuaugauucaggcuuauaacaaauauuguauc

SEQ ID NO: 251632 - RNA, 63 nt, hsa
gaugcaguuuggcaucugcaguacaccaagcacaugauucaugucugagccaggucugcuuau

SEQ ID NO: 251633 - RNA, 63 nt, hsa
cuucucuccuuuguugagccuuuugagggguucaugauucauuaccacaguuuuaagaguuuc

SEQ ID NO: 251634 - RNA, 63 nt, hsa
uaaaucaucaaagaaugcaauuuccauauccuaaugauucaaucucccuuacccugaccaauc

SEQ ID NO: 251635 - RNA, 63 nt, hsa
cuuaauuucuuuucuaauaaaaaaaaccuauagaugauucagugauuuuuguccaauucauuu

SEQ ID NO: 251636 - RNA, 63 nt, hsa
gugagcaaguaauagauuuucuuggcaaaucuaaugauucagcccacaggacuguugaaacua

SEQ ID NO: 251637 - RNA, 63 nt, hsa
uuuuguuccaaguauuaucugauagaauacaagaugauucaaaauuauauagauauuuaaagc

SEQ ID NO: 251638 - RNA, 63 nt, hsa
uaguguaagcuaguauucuguguguucguagaaaugauucaauaccugcagcuggugaauuag

SEQ ID NO: 251639 - RNA, 63 nt, hsa
uucccccaaauuuaauaaagacagaggguucucaugauucacauugguugugcuauugcugau

SEQ ID NO: 251640 - RNA, 63 nt, hsa
augaacacaguaacugauagguaaaaagacugcaugauucacuuuuacacuuauauuucauug

SEQ ID NO: 251641 - RNA, 63 nt, hsa
uuauugcugaaauggcuguuggcaguucuuauuaugauucagagaagagcaaauagaccuuaa

SEQ ID NO: 251642 - RNA, 63 nt, hsa
uggaagaggacuccuuaaauuugggggacuuacaugauucauuuuaacaucugagaaaagcuu

SEQ ID NO: 251643 - RNA, 63 nt, hsa
uguauuguuuuaaaaauuguaaaaauuauugugaugauucauuuagcauaaagagagguggac

SEQ ID NO: 251644 - RNA, 51 nt, hsa; identical to SEQ ID NO: 251096

SEQ ID NO: 251645 - RNA, 63 nt, hsa
acauaguauauacauaucaacauaacuauguugaugauucauaucaaauucucaaugcagguc

SEQ ID NO: 251646 - RNA, 63 nt, hsa
uuaucagaaaucagcucaguggucuuccccgccaugauucacauuugaugaguuuuuaaaaau

SEQ ID NO: 251647 - RNA, 63 nt, hsa
ucuuaagaaauuacuaguuguauuauuuauccuaugauucauucauucaauaagcuuuuacug

SEQ ID NO: 251648 - RNA, 63 nt, hsa
uuucauaauuuuuaaagguuggaaucuuuuauaaugauucauaagacacuuagauuaagauuu

SEQ ID NO: 251649 - RNA, 63 nt, hsa
uauugagcaggccuaucucuuucagauaguuuuaugauucacacagguuugaggaugcugggg

SEQ ID NO: 251650 - RNA, 63 nt, hsa
uccuucugauguuaccacgauagaauguuacugaugauucagggcuauuucugaagucuguau

SEQ ID NO: 251651 - RNA, 63 nt, hsa
gucgcaugugaaaaccucaacuauuuaaucaucaugauucauauuuugagugaauacaucagg

SEQ ID NO: 251652 - RNA, 63 nt, hsa
caguuuuggaagggccuucaguaucuuuagcacaugauucaccaauaucuuguuaguaauauu

SEQ ID NO: 251653 - RNA, 63 nt, hsa
ucugcuagugugaaacuugcucuacucucugaaaugauucaaauacacuaauuuuccauacuu

SEQ ID NO: 251654 - RNA, 63 nt, hsa
gaagggagaauuguggaugguuauuuauagcucaugauucauccaaggacugaguuauucucc

SEQ ID NO: 251655 - RNA, 63 nt, hsa
uaguugccugccuguggcugguaagguaaugucaugauucauccucucuucagugagacugag

SEQ ID NO: 251656 - RNA, 63 nt, hsa
guggcaaagcugaaauuuuuauacauucaacucaugauucacauguggcaucagucccaucag

SEQ ID NO: 251657 - RNA, 63 nt, hsa
uuuaaaaucuauucucucccccuuucucccuggaugauucaggaagcugacauuguuuccuca

SEQ ID NO: 251658 - RNA, 63 nt, hsa
uuuaaccaguucucacaacuugcuauacauaagaugauucacacuugaaugaaacccuacaaa

SEQ ID NO: 251659 - RNA, 63 nt, hsa
aaaauuauauagcuuuuuguuuuguuugaauaaaugauucauuccuguuugcuuuucuggugc

SEQ ID NO: 251660 - RNA, 63 nt, hsa
uuuucacauuggaaacaagucagucauucagauaugauucaaaugucuauaaaccgaacugau

SEQ ID NO: 251661 - RNA, 63 nt, hsa
uguacuguuaagguauuacuuuuuuucaugcugaugauucauaucuaaauuacauuauuaugu

SEQ ID NO: 251662 - RNA, 63 nt, hsa
ucuaaccauuucucaacccuuacuaaacauaagaugauucauacuggagagaaguuacacaaa

SEQ ID NO: 251663 - RNA, 63 nt, hsa
aauuaauaugauuauuaaucagaauaucagaauaugauucacuauuuaaacuaugauaaauua

SEQ ID NO: 251664 - RNA, 63 nt, hsa
ccccagucaagagcuccucugcuccucgcuugaaugauucagggucagggagguggcucagag

SEQ ID NO: 251665 - RNA, 63 nt, hsa
uguauuucucugaauucagugaagaaauaauucaugauucaacugcaucuccaaacauuacuc

SEQ ID NO: 251666 - RNA, 63 nt, hsa
auuauaugacuuuaagagcccacauuagguuuuaugauucauuugccagguuuuuaaauguuu

SEQ ID NO: 251667 - RNA, 63 nt, hsa
gaaagugcaguauuuuucuacaucaugucaagaaugauucaauguaaauauuuuucauuuuau

SEQ ID NO: 251668 - RNA, 63 nt, hsa
gccucuucaauccaucuuaccacacaauauuucaugauucaaauucuucaaagucuuauacgc

SEQ ID NO: 251669 - RNA, 63 nt, hsa
uaggaagauagaaacuagguuuugaaagauuacaugauucaagcgagggauuuuaaaguaaag

SEQ ID NO: 251670 - RNA, 63 nt, hsa
auauaauaugugauguaacauguagaugauaauaugauucaguagucaacuugagggaaauuu

SEQ ID NO: 251671 - RNA, 63 nt, hsa
cuuucauuuuaaagguuauuugcucccgauuauaugauucaaguguuauaaguuuuagcuuga

SEQ ID NO: 251672 - RNA, 63 nt, hsa
cugcgcagaauaauauuaagaauugcuaugcuuaugauucaggcuggacagccuggacauuuu

SEQ ID NO: 251673 - RNA, 63 nt, hsa
uaagaaaauauucuaacauuugauaauuuugaaaugauucaucuuucagaaauaaaaguauga

SEQ ID NO: 251674 - RNA, 63 nt, hsa
cccuuuggacaaaugcauuuaguggugguagaaaugauucaccagguccaauguuguucacca

SEQ ID NO: 251675 - RNA, 63 nt, hsa
ucauguguauuuucuuauucugguauaccacaaaugauucaugcaaaugaauuuuuggugauu

SEQ ID NO: 251676 - RNA, 63 nt, hsa
cuuucaauuuaaaaagagugaggaagaagcagaaugauucauuuugcugcgugugaaaucaug

SEQ ID NO: 251677 - RNA, 63 nt, hsa
uuauucuuguuuauucaaaugacugcaauaacaaugauucauucauuaauguuaaggcuaaua

SEQ ID NO: 251678 - RNA, 63 nt, hsa
uuuuaaauuugugaacucguaauuacuguuuuaaugauucaguuucuucagagugguaauugu

SEQ ID NO: 251679 - RNA, 63 nt, hsa
gaauuguuauguaaacaucauaaauaguaaauaaugauucaaugugaauuuuaaaaugcaaau

SEQ ID NO: 251680 - RNA, 63 nt, hsa
gacaaagaugagauuauuggggcuguucauauuaugauucagaaucauuuucuauugugguau

SEQ ID NO: 251681 - RNA, 63 nt, hsa
aucuaccuacauuuacauguagguagauaugaaaugauucaauauccaugucuccuuuuacuc

SEQ ID NO: 251682 - RNA, 63 nt, hsa
gagcuggagcagcugauaguggaaaacagaauaaugauucaaagagucuucugucaccauguc

SEQ ID NO: 251683 - RNA, 63 nt, hsa
gugguuugcagcccuaaugaaauuaugucuaggaugauucagucuauuucccauuuacuagca

SEQ ID NO: 251684 - RNA, 63 nt, hsa
uacugcuuacucguaaugaucuaguggggaaacaugauucauucacuuaaaauacugauuaag

SEQ ID NO: 251685 - RNA, 63 nt, hsa
auaauugaaguaguguggagcauuaacuuguggaugauucagaguuaaaagauaaaaagacgc

SEQ ID NO: 251686 - RNA, 63 nt, hsa
aacuugaccacaacuacuguuuuuuugaaauacaugauucaugguuuacaugugucaagguga

SEQ ID NO: 251687 - RNA, 63 nt, hsa
ggacagucuuuauuuuucuucuuaaaaauuuauaugauucaaaaccauuucuucagguuaaau

SEQ ID NO: 251688 - RNA, 63 nt, hsa
uaaauguuucccaugaucgcucauucuucuuuuaugauucauacguuauuccuuauaaaguaa

SEQ ID NO: 251689 - RNA, 63 nt, hsa
cuuacauugucuaaaaauccuuacaagguuaagaugauucaauaucaagaagauucagaaaau

SEQ ID NO: 251690 - RNA, 63 nt, hsa
cagccagugccacaguuugaagauucucauuaaaugauucauuucauuucaccuugacgauuc

SEQ ID NO: 251691 - RNA, 63 nt, hsa
ucuucauuucuguugauuuuuuuuauugcauuuaugauucaguggcugggaauugagaauuua

SEQ ID NO: 251692 - RNA, 63 nt, hsa
cauauaggcuguucuagccacagugguagauuuaugauucacauccgaaagugugccuuaguu

SEQ ID NO: 251693 - RNA, 63 nt, hsa
cucacauggcuugcacucagugacaccaaauccaugauucaauguugaucuugagcaaguauu

SEQ ID NO: 251694 - RNA, 63 nt, hsa
uacuauuuuaacuuagaaaaaccaucguuucauaugauucacccuaauagauaccuccauuau

SEQ ID NO: 251695 - RNA, 63 nt, hsa
uucugaccuucagcucacgcuucacagugaucgaugauucaggugcagaggaaguacaaacua

SEQ ID NO: 251696 - RNA, 63 nt, hsa
aucacgagaauagcacaggaaagacuggcccccaugauucaauuaccucccccgggucccucc

SEQ ID NO: 251697 - RNA, 63 nt, hsa
ugcugaacgugcuccucucuccuucucuguacaaugauucagcaucucggcggaagaggaaaa

SEQ ID NO: 251698 - RNA, 63 nt, hsa
guacucuuguuaaccuuagagcuagaccugggaaugauucaacuucaagccuuaaccuggaau

SEQ ID NO: 251699 - RNA, 63 nt, hsa
gguucgucacaaaauucaacauagaauuacccuaugauucagcgauuccaccucuggcuauag

SEQ ID NO: 251700 - RNA, 63 nt, hsa
cugggggaagugggguauaauauuuaacgaaucaugauucagauuguaccauuacauguuuca

SEQ ID NO: 251701 - RNA, 63 nt, hsa
aaccucgcuggacucucagucucugagcagugaaugauucaguguuaaaugugaugaauacug

SEQ ID NO: 251702 - RNA, 63 nt, hsa
agcagguggagccauggugcucugugguggcgcaugauucacugagcaaacagcacuuuacag

SEQ ID NO: 251703 - RNA, 63 nt, hsa
cuuauagaaucuaagcuggucuuaaagucauaaaugauucauugggucauuagugagaaacgg

SEQ ID NO: 251704 - RNA, 63 nt, hsa
ccagaugaucuuuuacucuuagguuuugagcuaaugauucaaaacgggggaauauaaaagguu

SEQ ID NO: 251705 - RNA, 63 nt, hsa
gacaaaaugcugacuacuguagaaaaaaaggucaugauucaugauugaaagcagaacaaugga

SEQ ID NO: 251706 - RNA, 63 nt, hsa
aaagcugaugauuguaccagucuuaaauuauucaugauucaauaaaauugaugcuuauuuauu

SEQ ID NO: 251707 - RNA, 63 nt, hsa
aaacaauuucuuuuuuaaaaaagacuauuuuauaugauucacaugcuaaagccaggauugugu

SEQ ID NO: 251708 - RNA, 63 nt, hsa
uuacuucuucaugguauuaugaagacuauauagaugauucaaccaagccugcaaaucucccuc

SEQ ID NO: 251709 - RNA, 63 nt, hsa
gaaggauugccauuagugacuuggaccaguuagaugauucacuuuuugccccuagggaugaga

SEQ ID NO: 251710 - RNA, 63 nt, hsa
ucaauuucauguaauuuacccuuugcaauaaaaaugauucauuaaauauauaacuaaauguga

SEQ ID NO: 251711 - RNA, 61 nt, hsa; identical to SEQ ID NO: 251163

SEQ ID NO: 251712 - RNA, 63 nt, hsa
aaauuguuggauuuaaagaggcaacuuuuguuuaugauucaaauaugggaauuugagaaauau

SEQ ID NO: 251713 - RNA, 63 nt, hsa
uucaaccuuggucucaaauagcugcuuuuguauaugauucacgagcuuuuuuagaguuuauau

SEQ ID NO: 251714 - RNA, 63 nt, hsa
aguauccugcucagccaagaucugccuaagauuaugauucaggggcauuuuggugcuguuaaa

SEQ ID NO: 251715 - RNA, 63 nt, hsa
guauaaguuugaaaugaaauggucuagagggaaaugauucaaauuuuuucauaauucaaacaa

SEQ ID NO: 251716 - RNA, 63 nt, hsa
aaaccaaagagacccugaagaauauuugaugugaugauucacuuuucaguucucaaauuaaaa

SEQ ID NO: 251717 - RNA, 63 nt, hsa
uguuuuaaaggagacuaacuccaggaguaggaaaugauucaucauccuccaaagcaagaggcu

SEQ ID NO: 251718 - RNA, 63 nt, hsa
aggcauaaauauuuuugacagcagaauagaagaaugauucaugagaaccugaaccagaugaac

SEQ ID NO: 251719 - RNA, 63 nt, hsa
uuuacuggacaaaaucaauaacuacaaaaggcaaugauucacgcuuuuguuuucauaauaccu

SEQ ID NO: 251720 - RNA, 63 nt, hsa
ugaaaauuuaaaagauuaaaugaaugagaagaaaugauucauaaauuuugaacuaacaguaau

SEQ ID NO: 251721 - RNA, 63 nt, hsa
uggggcggggcagugaggggugggagaaggugaaugauucauuauuccaccccgagguuugcu

SEQ ID NO: 251722 - RNA, 63 nt, hsa
cuacauccuucccucacucccaugauuggagaaaugauucauugggugaugaguguugggguu

SEQ ID NO: 251723 - RNA, 63 nt, hsa
caggaagugaauaagaagaugacagugauucaaaugauucaaaugccaugacauuggaagaag

SEQ ID NO: 251724 - RNA, 63 nt, hsa
caggaagugaauaagaagaugagagugauucaaaugauucaaauuccaugacauuggaaaaag

SEQ ID NO: 251725 - RNA, 63 nt, hsa
guuauucacugcaacaaagcaacaauguuguccaugauucaaaaucuaagcaguuucgauuuu

SEQ ID NO: 251726 - RNA, 63 nt, hsa
auuuugaaauauuaaggucuugccaagcuucugaugauucacaccuguacuacugauuauuaa

SEQ ID NO: 251727 - RNA, 63 nt, hsa
auuuuuuuuugaaagaguucuccucauaggaggaugauucagcaucagaagaagaaggaaccc

SEQ ID NO: 251728 - RNA, 63 nt, hsa
cacaauaagcaauauguggugauaaugaaaagaaugauucagucuugacggugaauggaagac

SEQ ID NO: 251729 - RNA, 63 nt, hsa
uuaucuguucuugcuacccaugacuuuauauggaugauucagaaauuggaacagaauguuuua

SEQ ID NO: 251730 - RNA, 63 nt, hsa
aaaucuugauugugauaagccccccuggaggauaugauucacuuuaugugauucaucuuauuc

SEQ ID NO: 251731 - RNA, 63 nt, hsa
uuucugugaguccuauaaaaagcaaggauaugcaugauucagggaaugaagaaucacaggcuu

SEQ ID NO: 251732 - RNA, 63 nt, hsa
cuuucaaccaaaugauugguucaaaaggaaagaaugauucaaagcagaggaauuuauuaugca

SEQ ID NO: 251733 - RNA, 63 nt, hsa
cguauuagagaccagauauuuuucuaccuguucaugauucacaucucuucuugcauguaccua

SEQ ID NO: 251734 - RNA, 63 nt, hsa
uuuuuauucagaacgaggaagagaacacaaggaaugauucaagauccaccuugagaggaauga

SEQ ID NO: 251735 - RNA, 63 nt, hsa
ggucugaauggaucugaccccugucagaugaaaaugauucacagcucuggcaguucccaaguc

SEQ ID NO: 251736 - RNA, 63 nt, hsa
caagaaacugcugaaaaagcugggugcagugaaaugauucaugugcuuccggacaacugccaa

SEQ ID NO: 251737 - RNA, 63 nt, hsa
aaaaugcaaguaguuuccucgcgugaccucaccaugauucacauacgugccacuguuugaaau

SEQ ID NO: 251738 - RNA, 63 nt, hsa
gccuuagccaugauuucguuaguagaccuauuuaugauucaauugcaauuuucagauaggaug

SEQ ID NO: 251739 - RNA, 63 nt, hsa
gcaaaucuugaaagacgaaaucaaagcccauuaaugauucagaaucagugcuugaccuccugu

SEQ ID NO: 251740 - RNA, 63 nt, hsa
guauggaucauucugaugacagauuuauacaaaaugauucaaaccaguaacuuaguaaaauug

SEQ ID NO: 251741 - RNA, 63 nt, hsa
cuuacacacuauauaaguuguucuuucaguuuuaugauucaacuacuguuuuuccuucagcug

SEQ ID NO: 251742 - RNA, 63 nt, hsa
gaccgucucagacacgcacagugggccugcugcaugauucacacccagucccugccacagacc

SEQ ID NO: 251743 - RNA, 63 nt, hsa; identical to SEQ ID NO: 251742

SEQ ID NO: 251744 - RNA, 63 nt, hsa
cacuccugacugcccggcacagaugcuccagggaugauucaagccauuccaaaguucaacuug

SEQ ID NO: 251745 - RNA, 63 nt, hsa
uauuuauaacauuguaaaugauaugucuuuaaaaugauucacuuuuauuguauaauuaugaag

SEQ ID NO: 251746 - RNA, 63 nt, hsa
uucuaucaguaucaauaaccauuggaaggagaaaugauucaugugugaaaaaauucucagauc

SEQ ID NO: 251747 - RNA, 63 nt, hsa
uggaaaauccuaaacauggaagaugauuuaaaaaugauucacccuggaauacaugcuuccagu

SEQ ID NO: 251748 - RNA, 63 nt, hsa
uauuguggacuuaauuacaaccacugcacuguaaugauucaaugcuguauuaugauauugcug

SEQ ID NO: 251749 - RNA, 63 nt, hsa
aaagcauauaaauuaaaauauuuaaaauuagauaugauucacacuauauucuguuucauaugc

SEQ ID NO: 251750 - RNA, 63 nt, hsa
aaguucccugaaacacgaaacuuguuauugugaaugauucauguuauauuuaaugcauuaaac

SEQ ID NO: 251751 - RNA, 63 nt, hsa
agugcauuucuauuuauaucaaaaggugcuaaaaugauucaauuugcauuuucugauccugua

SEQ ID NO: 251752 - RNA, 63 nt, hsa
gaaauaauaagaugcaacauuuguugaggccuuaugauucagcagcuuggucacuugauuaga

SEQ ID NO: 251753 - RNA, 63 nt, hsa
ugguaaauauggcuuuaauuacaaacaugaggaaugauucacugaagaugaaaagauaggacg

SEQ ID NO: 251754 - RNA, 63 nt, hsa
ccugcuauagcccaaagcacguaguauuugcugaugauucagcaugagcugcaucuaccuacu

SEQ ID NO: 251755 - RNA, 63 nt, hsa
aaacugagggaauuccugucuucuuuaggaguaaugauucauagaucuagauagguggaaaua

SEQ ID NO: 251756 - RNA, 63 nt, hsa
uucgcaaaauguuucaaguacuguaacugugucaugauucacccccaaacagugacauuuauu

SEQ ID NO: 251757 - RNA, 63 nt, hsa
aaagccaacuucaaauaccgugaccaaauuuacaugauucauauucauuaugcauuacuuggu

SEQ ID NO: 251758 - RNA, 63 nt, hsa
aauggguggguaguguaaauacacaagaaaaggaugauucacaucccaugugggauggagcag

SEQ ID NO: 251759 - RNA, 63 nt, hsa
ucugaaacuuaacgugaucaucaccacugacagaugauucacagagacuguuugaaucuuguc

SEQ ID NO: 251760 - RNA, 63 nt, hsa
accauuuauaacuucuguuuuuuuauugagaaaaugauucacgaauuccaaaucagauugcca

SEQ ID NO: 251761 - RNA, 63 nt, hsa
uaaucccaccacaagcacauacuaauuuuauuuaugauucaaaugugacucgugccugcccau

SEQ ID NO: 251762 - RNA, 63 nt, hsa
uuccacggaugggugacaggggaugguuuugggaugauucaagugcauuacauuuauugugca

SEQ ID NO: 251763 - RNA, 63 nt, hsa
aagcuaaauccucaaaaccuaguaaggggacuaaugauucauuaaaguaaauugaugguuuug

SEQ ID NO: 251764 - RNA, 63 nt, hsa
gcaccgccccucagcaaggaugacucagcagggaugauucagcagagauaacucggggaugac

SEQ ID NO: 251765 - RNA, 63 nt, hsa
ucagccucugauccaucccucaagccacaguuaaugauucagaugucaguagaugaccaaaga

SEQ ID NO: 251766 - RNA, 63 nt, hsa
aauuggggcaugggaggggggcugggggaccccaugauucagccacggacuccaaugcccagc

SEQ ID NO: 251767 - RNA, 63 nt, hsa
cuauuacggaugaguucuggaaaagacccagcuaugauucauaaaaacacuucuggaugaauc

SEQ ID NO: 251768 - RNA, 63 nt, hsa
gccccucaucugcucagcagcuauuugaaugagaugauucagaaggggaggggagacagguaa

SEQ ID NO: 251769 - RNA, 63 nt, hsa
cucuauuuuaaauauuuuuaguauguacuguguaugauucauuaccauuuugaggggauuuau

SEQ ID NO: 251770 - RNA, 63 nt, hsa
cugaagugauacacuaaucacggggaacccagaaugauucaacauuuuccccccacuccuccc

SEQ ID NO: 251771 - RNA, 63 nt, hsa
ccucuucucuucauacucucuaccuuccuuaccaugauucagccacacuggccuuucuguucc

SEQ ID NO: 251772 - RNA, 63 nt, hsa
ggccuucgggagggcggggggagguugauuuucaugauucaugagcuggguacugacugagau

SEQ ID NO: 251773 - RNA, 63 nt, hsa
uuucuuuaacacacacuaggcucuuuguguauuaugauucagugcuauuuguaacuguguccc

SEQ ID NO: 251774 - RNA, 63 nt, hsa
guuugguguuugucuguguuuguuuuucaagaaaugauucaaauugcugcuuggauuuugaaa

SEQ ID NO: 251775 - RNA, 63 nt, hsa
uuauaugaauaugcaguaugggacuuugaaauaaugauucauaauaaaauacuaaacgugugu

SEQ ID NO: 251776 - RNA, 63 nt, hsa
gauuuaggaagcaaaaguaagaagcagcauuuuaugauucauaauuucaguuuacuagacuga

SEQ ID NO: 251777 - RNA, 63 nt, hsa
auuuauauuuuacuuuuuuauugcugguuuaagaugauucagauuauccuuguacuuugagga

SEQ ID NO: 251778 - RNA, 63 nt, hsa
cuccagugagcgcgccugcuuuagagacacaggaugauucagaccggaaacagaccucguggg

SEQ ID NO: 251779 - RNA, 63 nt, hsa
ugacuucaugauccugggccugagaacacaggaaugauucauagcccaccccccaccuccaug

SEQ ID NO: 251780 - RNA, 63 nt, hsa
uagauuuccuguagcugugaauuguuaaaauguaugauucaggauaaaacguaaacacgugcu

SEQ ID NO: 251781 - RNA, 63 nt, hsa
aguaguuuuacauuuuauaaaguaaagauguaaaugauucagguuuaaagcucuauuugacuu

SEQ ID NO: 251782 - RNA, 63 nt, hsa
ucagugauucaacuuuaaaacaaauuucucgugaugauucauuucaaaauccugagugagucu

SEQ ID NO: 251783 - RNA, 63 nt, hsa
uguuagccuggauggucucgauuuucugaucuuaugauucacccaccucuaccucccgaagug

SEQ ID NO: 251784 - RNA, 63 nt, hsa
agaaauguaagguuugugacaaggcuuucgggaaugauucacacguggcaccccauacuagaa

SEQ ID NO: 251785 - RNA, 63 nt, hsa
caacuuaggaugagggcagaaaagucuuuggggaugauucagucuguaccagacaugacaaca

SEQ ID NO: 251786 - RNA, 63 nt, hsa
ccuugaguaugugccacgugcuugugaaaugcuaugauucacauguaacauuuaaacauuaau

SEQ ID NO: 251787 - RNA, 63 nt, hsa
agugaggaaaucucuuccaauuucugcuucugaaugauucaauguugggagcaauagaaauaa

SEQ ID NO: 251788 - RNA, 63 nt, hsa
aaaauacauuuuuuugguucuauauaaugcuucaugauucauuuagggaccuagaaauauugu

SEQ ID NO: 251789 - RNA, 63 nt, hsa
ccaucugccccacucgccuuugccccgucaucgaugauucaggcagagccagauucguuaggu

SEQ ID NO: 251790 - RNA, 63 nt, hsa
cccaggagacaguucaagaaagcuucaaacugcaugauucaugccaauuagcaauugacuguc

SEQ ID NO: 251791 - RNA, 63 nt, hsa
aaauugaaaacuuuggagaacucauuucaaguuaugauucagugcauuuucaacauugauuuu

SEQ ID NO: 251792 - RNA, 63 nt, hsa
aagaaauuauaccuuuuuaguacuugcugaagaaugauucaggguaaaucacauacuuuguuu

SEQ ID NO: 251793 - RNA, 63 nt, hsa
acuauacucauacauuuuuaauaugguuuaucaaugauucauguuucccucaaauagugaugg

SEQ ID NO: 251794 - RNA, 63 nt, hsa
uuuugcuuccccgugcaugauuuacucuuagagaugauucagaggucacuucauuuuuauuaa

SEQ ID NO: 251795 - RNA, 63 nt, hsa
aucauuggggugaaguguucuugacaguuuaauaugauucacuuuucuccaaagacauguaaa

SEQ ID NO: 251796 - RNA, 63 nt, hsa
uuugagccuaggaggucaaggcugcagugagccaugauucacagcacugcacugcagccuggg

SEQ ID NO: 251797 - RNA, 63 nt, hsa
agagagggaugguuucugagggguucugaaaguaugauucaaugugcaacauacagguagguc

SEQ ID NO: 251798 - RNA, 63 nt, hsa
uuucaccccucccagucuacccauccagccuucaugauucauuccugugucaagguuagucgc

SEQ ID NO: 251799 - RNA, 63 nt, hsa
guagucccccaucccuuccucccuuacccagcuaugauucaguugucucugcccucccucuua

SEQ ID NO: 251800 - RNA, 63 nt, hsa
uauguaaaauuuaaauaauuacuuuuuuauaauaugauucacuuaugccacagauucaacauu

SEQ ID NO: 251801 - RNA, 63 nt, hsa
agcccacagaugauuccuuuauauagauguauaaugauucaaacugcugccuuugccuccagu

SEQ ID NO: 251802 - RNA, 63 nt, hsa
agaaugcuuuuugauguugauuuugaccuguucaugauucagaagaaaaacaaacuuuuuugg

SEQ ID NO: 251803 - RNA, 63 nt, hsa
aucaugagaauagcaugggaaagaccugccuccaugauucaguuaccucccacugggucccuc

SEQ ID NO: 251804 - RNA, 63 nt, hsa
ccucuugauuggagcuuuugugaugcagcuaccaugauucaaaaaaauuaaaaauuaaaaaaa

SEQ ID NO: 251805 - RNA, 63 nt, hsa
gaaagcauuugagcgaaagucauguuuggugacaugauucauacagaccucuugagcuccugg

SEQ ID NO: 251806 - RNA, 63 nt, hsa
uuugugcuuggaauguguugaugugcacagcuaaugauucaaugcgagacaagauuggcgucu

SEQ ID NO: 251807 - RNA, 63 nt, hsa
uauaauugugugauauuucagaaauacagauaaaugauucaaaaagucacaguuaaggagaau

SEQ ID NO: 251808 - RNA, 63 nt, hsa
ccccugcuggguuggggagggugggacagcuggaugauucaucugugggugccaggcugugug

SEQ ID NO: 251809 - RNA, 64 nt, hsa; identical to SEQ ID NO: 39289

SEQ ID NO: 251810 - RNA, 64 nt, hsa; identical to SEQ ID NO: 39290

SEQ ID NO: 251811 - RNA, 64 nt, hsa; identical to SEQ ID NO: 39291

SEQ ID NO: 251812 - RNA, 64 nt, hsa; identical to SEQ ID NO: 39292

SEQ ID NO: 251813 - RNA, 64 nt, hsa; identical to SEQ ID NO: 39293

SEQ ID NO: 251814 - RNA, 64 nt, hsa; identical to SEQ ID NO: 39294

SEQ ID NO: 251815 - RNA, 64 nt, hsa; identical to SEQ ID NO: 39295

SEQ ID NO: 251816 - RNA, 64 nt, hsa; identical to SEQ ID NO: 39296

SEQ ID NO: 251817 - RNA, 64 nt, hsa; identical to SEQ ID NO: 39297

SEQ ID NO: 251818 - RNA, 64 nt, hsa; identical to SEQ ID NO: 39298

SEQ ID NO: 251819 - RNA, 64 nt, hsa; identical to SEQ ID NO: 39299

SEQ ID NO: 251820 - RNA, 64 nt, hsa; identical to SEQ ID NO: 39300

SEQ ID NO: 251821 - RNA, 64 nt, hsa; identical to SEQ ID NO: 39301

SEQ ID NO: 251822 - RNA, 64 nt, hsa; identical to SEQ ID NO: 39302

SEQ ID NO: 251823 - RNA, 64 nt, hsa; identical to SEQ ID NO: 39303

SEQ ID NO: 251824 - RNA, 64 nt, hsa; identical to SEQ ID NO: 39304

SEQ ID NO: 251825 - RNA, 64 nt, hsa; identical to SEQ ID NO: 39305

SEQ ID NO: 251826 - RNA, 64 nt, hsa; identical to SEQ ID NO: 39306

SEQ ID NO: 251827 - RNA, 64 nt, hsa; identical to SEQ ID NO: 39307

SEQ ID NO: 251828 - RNA, 64 nt, hsa; identical to SEQ ID NO: 39308

SEQ ID NO: 251829 - RNA, 64 nt, hsa; identical to SEQ ID NO: 39309

SEQ ID NO: 251830 - RNA, 64 nt, hsa; identical to SEQ ID NO: 39310

SEQ ID NO: 251831 - RNA, 64 nt, hsa; identical to SEQ ID NO: 39311

SEQ ID NO: 251832 - RNA, 64 nt, hsa; identical to SEQ ID NO: 39312

SEQ ID NO: 251833 - RNA, 64 nt, hsa; identical to SEQ ID NO: 39313

SEQ ID NO: 251834 - RNA, 64 nt, hsa; identical to SEQ ID NO: 39314

SEQ ID NO: 251835 - RNA, 64 nt, hsa; identical to SEQ ID NO: 39315

SEQ ID NO: 251836 - RNA, 64 nt, hsa; identical to SEQ ID NO: 39316

SEQ ID NO: 251837 - RNA, 64 nt, hsa; identical to SEQ ID NO: 39317

SEQ ID NO: 251838 - RNA, 64 nt, hsa; identical to SEQ ID NO: 39318

SEQ ID NO: 251839 - RNA, 64 nt, hsa; identical to SEQ ID NO: 39319

SEQ ID NO: 251840 - RNA, 64 nt, hsa; identical to SEQ ID NO: 39320

SEQ ID NO: 251841 - RNA, 64 nt, hsa; identical to SEQ ID NO: 39321

SEQ ID NO: 251842 - RNA, 64 nt, hsa; identical to SEQ ID NO: 39322

SEQ ID NO: 251843 - RNA, 64 nt, hsa; identical to SEQ ID NO: 39323

SEQ ID NO: 251844 - RNA, 64 nt, hsa; identical to SEQ ID NO: 39324

SEQ ID NO: 251845 - RNA, 64 nt, hsa; identical to SEQ ID NO: 39325

SEQ ID NO: 251846 - RNA, 64 nt, hsa; identical to SEQ ID NO: 39326

SEQ ID NO: 251847 - RNA, 64 nt, hsa; identical to SEQ ID NO: 39327

SEQ ID NO: 251848 - RNA, 64 nt, hsa; identical to SEQ ID NO: 39328

SEQ ID NO: 251849 - RNA, 64 nt, hsa; identical to SEQ ID NO: 39329

SEQ ID NO: 251850 - RNA, 64 nt, hsa; identical to SEQ ID NO: 39330

SEQ ID NO: 251851 - RNA, 64 nt, hsa; identical to SEQ ID NO: 39331

SEQ ID NO: 251852 - RNA, 64 nt, hsa; identical to SEQ ID NO: 39332

SEQ ID NO: 251853 - RNA, 61 nt, hsa; identical to SEQ ID NO: 39333

SEQ ID NO: 251854 - RNA, 64 nt, hsa; identical to SEQ ID NO: 39334

SEQ ID NO: 251855 - RNA, 64 nt, hsa; identical to SEQ ID NO: 39335

SEQ ID NO: 251856 - RNA, 64 nt, hsa; identical to SEQ ID NO: 39336

SEQ ID NO: 251857 - RNA, 64 nt, hsa; identical to SEQ ID NO: 39337

SEQ ID NO: 251858 - RNA, 64 nt, hsa; identical to SEQ ID NO: 39338

SEQ ID NO: 251859 - RNA, 64 nt, hsa; identical to SEQ ID NO: 39339

SEQ ID NO: 251860 - RNA, 64 nt, hsa; identical to SEQ ID NO: 39340

SEQ ID NO: 251861 - RNA, 64 nt, hsa; identical to SEQ ID NO: 39341

SEQ ID NO: 251862 - RNA, 64 nt, hsa; identical to SEQ ID NO: 39342

SEQ ID NO: 251863 - RNA, 64 nt, hsa; identical to SEQ ID NO: 39343

SEQ ID NO: 251864 - RNA, 64 nt, hsa; identical to SEQ ID NO: 39344

SEQ ID NO: 251865 - RNA, 64 nt, hsa; identical to SEQ ID NO: 39345

SEQ ID NO: 251866 - RNA, 64 nt, hsa; identical to SEQ ID NO: 39346

SEQ ID NO: 251867 - RNA, 64 nt, hsa
agcuauccuccaaccucagccugccaaguagcugucaccauagcuguucaucaccaugccuagc

SEQ ID NO: 251868 - RNA, 64 nt, hsa
ugaauuauauccuuuauuaagcaucaucuccauuucaccauauccuaacugaaauccuauauau

SEQ ID NO: 251869 - RNA, 64 nt, hsa
ggcuaauuuuuguauuuuuaguagagacaggguuucaccauauuggucaggcuggucuugaacu

SEQ ID NO: 251870 - RNA, 64 nt, hsa; identical to SEQ ID NO: 251869

SEQ ID NO: 251871 - RNA, 64 nt, hsa
ucgcugaaccaaaacguacugcagccgagcccccuccguccauccucugccccucccccuggcu

SEQ ID NO: 251872 - RNA, 64 nt, hsa
cucaacacccuuccuuguccuggaguauggacuguccguccaaaagugagccuaugcuauaagu

SEQ ID NO: 251873 - RNA, 64 nt, hsa
agaugccuuccccguccguccguccguccguccauccguccacuugcccuccuggcaggugggu

SEQ ID NO: 251874 - RNA, 64 nt, hsa
ucaaauccagaugccuuccccguccguccguccguccguccauccguccacuugcccuccuggc

SEQ ID NO: 251875 - RNA, 64 nt, hsa
gagacucugagcggccuccguccaggagccuggcuccguccaggagccugugccuccucacccc

SEQ ID NO: 251876 - RNA, 56 nt, hsa
ggacgccgcagagacucugagcggccuccguccaggagccuggcuccguccaggag

SEQ ID NO: 251877 - RNA, 64 nt, hsa
ucuguuugucugaacaaagugcuagacuuucuggagugauaaucuggugacaaauauucucucu

SEQ ID NO: 251878 - RNA, 64 nt, hsa
agaacuuuggaggcaaaucuuucugcaugaccaaagugauaaauuccuguugaccuucccacac

SEQ ID NO: 251879 - RNA, 64 nt, hsa
aauaaauaugaguguccuuuauuugccuaguagaagugauaaauuguguuauauaugauaauuu

SEQ ID NO: 251880 - RNA, 64 nt, hsa
aauguaccuagcaagcugguucuugcuuauauauagugauaaacuuuguagcugccucuuuaac

SEQ ID NO: 251881 - RNA, 64 nt, hsa; identical to SEQ ID NO: 249425

SEQ ID NO: 251882 - RNA, 64 nt, hsa; identical to SEQ ID NO: 249426

SEQ ID NO: 251883 - RNA, 64 nt, hsa; identical to SEQ ID NO: 249427

SEQ ID NO: 251884 - RNA, 64 nt, hsa; identical to SEQ ID NO: 249428

SEQ ID NO: 251885 - RNA, 64 nt, hsa; identical to SEQ ID NO: 249429

SEQ ID NO: 251886 - RNA, 64 nt, hsa; identical to SEQ ID NO: 249430

SEQ ID NO: 251887 - RNA, 64 nt, hsa; identical to SEQ ID NO: 249431

SEQ ID NO: 251888 - RNA, 64 nt, hsa; identical to SEQ ID NO: 249432

SEQ ID NO: 251889 - RNA, 64 nt, hsa; identical to SEQ ID NO: 249433

SEQ ID NO: 251890 - RNA, 64 nt, hsa; identical to SEQ ID NO: 249434

SEQ ID NO: 251891 - RNA, 64 nt, hsa; identical to SEQ ID NO: 249435

SEQ ID NO: 251892 - RNA, 64 nt, hsa; identical to SEQ ID NO: 249436

SEQ ID NO: 251893 - RNA, 64 nt, hsa; identical to SEQ ID NO: 249437

SEQ ID NO: 251894 - RNA, 64 nt, hsa; identical to SEQ ID NO: 249438

SEQ ID NO: 251895 - RNA, 64 nt, hsa; identical to SEQ ID NO: 249439

SEQ ID NO: 251896 - RNA, 64 nt, hsa; identical to SEQ ID NO: 249440

SEQ ID NO: 251897 - RNA, 64 nt, hsa; identical to SEQ ID NO: 249441

SEQ ID NO: 251898 - RNA, 64 nt, hsa; identical to SEQ ID NO: 249442

SEQ ID NO: 251899 - RNA, 64 nt, hsa; identical to SEQ ID NO: 249443

SEQ ID NO: 251900 - RNA, 64 nt, hsa; identical to SEQ ID NO: 249444

SEQ ID NO: 251901 - RNA, 64 nt, hsa; identical to SEQ ID NO: 249445

SEQ ID NO: 251902 - RNA, 64 nt, hsa; identical to SEQ ID NO: 249446

SEQ ID NO: 251903 - RNA, 64 nt, hsa; identical to SEQ ID NO: 249447

SEQ ID NO: 251904 - RNA, 64 nt, hsa; identical to SEQ ID NO: 249448

SEQ ID NO: 251905 - RNA, 64 nt, hsa; identical to SEQ ID NO: 249449

SEQ ID NO: 251906 - RNA, 64 nt, hsa; identical to SEQ ID NO: 249450

SEQ ID NO: 251907 - RNA, 64 nt, hsa; identical to SEQ ID NO: 249451

SEQ ID NO: 251908 - RNA, 64 nt, hsa; identical to SEQ ID NO: 249452

SEQ ID NO: 251909 - RNA, 64 nt, hsa; identical to SEQ ID NO: 249453

SEQ ID NO: 251910 - RNA, 64 nt, hsa; identical to SEQ ID NO: 249454

SEQ ID NO: 251911 - RNA, 64 nt, hsa; identical to SEQ ID NO: 249455

SEQ ID NO: 251912 - RNA, 64 nt, hsa; identical to SEQ ID NO: 249456

SEQ ID NO: 251913 - RNA, 64 nt, hsa; identical to SEQ ID NO: 249457

SEQ ID NO: 251914 - RNA, 64 nt, hsa; identical to SEQ ID NO: 249458

SEQ ID NO: 251915 - RNA, 64 nt, hsa; identical to SEQ ID NO: 249459

SEQ ID NO: 251916 - RNA, 64 nt, hsa; identical to SEQ ID NO: 249460

SEQ ID NO: 251917 - RNA, 64 nt, hsa; identical to SEQ ID NO: 249461

SEQ ID NO: 251918 - RNA, 64 nt, hsa; identical to SEQ ID NO: 249462

SEQ ID NO: 251919 - RNA, 64 nt, hsa; identical to SEQ ID NO: 249463

SEQ ID NO: 251920 - RNA, 64 nt, hsa; identical to SEQ ID NO: 249464

SEQ ID NO: 251921 - RNA, 64 nt, hsa; identical to SEQ ID NO: 249465

SEQ ID NO: 251922 - RNA, 64 nt, hsa; identical to SEQ ID NO: 249466

SEQ ID NO: 251923 - RNA, 64 nt, hsa; identical to SEQ ID NO: 249467

SEQ ID NO: 251924 - RNA, 64 nt, hsa; identical to SEQ ID NO: 249468

SEQ ID NO: 251925 - RNA, 64 nt, hsa; identical to SEQ ID NO: 249469

SEQ ID NO: 251926 - RNA, 64 nt, hsa; identical to SEQ ID NO: 249470

SEQ ID NO: 251927 - RNA, 64 nt, hsa; identical to SEQ ID NO: 249471

SEQ ID NO: 251928 - RNA, 64 nt, hsa; identical to SEQ ID NO: 249472

SEQ ID NO: 251929 - RNA, 64 nt, hsa; identical to SEQ ID NO: 249473

SEQ ID NO: 251930 - RNA, 64 nt, hsa; identical to SEQ ID NO: 249474

SEQ ID NO: 251931 - RNA, 64 nt, hsa; identical to SEQ ID NO: 249475

SEQ ID NO: 251932 - RNA, 64 nt, hsa; identical to SEQ ID NO: 249476

SEQ ID NO: 251933 - RNA, 64 nt, hsa; identical to SEQ ID NO: 249477

SEQ ID NO: 251934 - RNA, 64 nt, hsa; identical to SEQ ID NO: 249478

SEQ ID NO: 251935 - RNA, 64 nt, hsa; identical to SEQ ID NO: 249479

SEQ ID NO: 251936 - RNA, 64 nt, hsa; identical to SEQ ID NO: 249480

SEQ ID NO: 251937 - RNA, 64 nt, hsa; identical to SEQ ID NO: 249481

SEQ ID NO: 251938 - RNA, 64 nt, hsa; identical to SEQ ID NO: 249482

SEQ ID NO: 251939 - RNA, 64 nt, hsa; identical to SEQ ID NO: 249483

SEQ ID NO: 251940 - RNA, 64 nt, hsa; identical to SEQ ID NO: 249484

SEQ ID NO: 251941 - RNA, 64 nt, hsa
uugucuuagucaguuugagcugcuauaauaaagcaccauagacuugguggcuuauaaacaacag

SEQ ID NO: 251942 - RNA, 64 nt, hsa
uguguuucuuuguugccaguguuaccuuugcuguaccauagacuuaaaauuccucuauuguuau

SEQ ID NO: 251943 - RNA, 64 nt, hsa
uucaaagcaagucaaccugcuuuuuucuguuuuuacaguggaaucuaggaggccacuuagucgu

SEQ ID NO: 251944 - RNA, 64 nt, hsa
ugagaaauggggcauuuuaaucuaagugguuauaacaguggauucugacggggaagguguagcu

SEQ ID NO: 251945 - RNA, 64 nt, hsa
uccuauaggcagacguggggaggguggaggggugacaguggaggaaaauccauggauauccacg

SEQ ID NO: 251946 - RNA, 64 nt, hsa
gucccuugcugacauggcuuugcuuuguguaaauacaguggaucucaaucuucggggugugaug

SEQ ID NO: 251947 - RNA, 64 nt, hsa
uuuugguuuuguauauuuuguacauuaauaauaaacaguggaaagagaagcagcuuauuuaacc

SEQ ID NO: 251948 - RNA, 64 nt, hsa
uccuucacuuuggcaucaguuguuuucuaugaaaacaguggauugguuggguuuugugcagggu

SEQ ID NO: 251949 - RNA, 64 nt, hsa
uaaaauaaauaccaaagauaaugcauauuuuugcacaguggagcuuacacuuaaaagaaaacaa

SEQ ID NO: 251950 - RNA, 64 nt, hsa
agaguauucagugauauguaaauuaaaugaagauacaguggagaaugggggugaccacaaaaga

SEQ ID NO: 251951 - RNA, 64 nt, hsa
uuuguacugaaggcaagaacuggacagucagagaacaguggagggggcaagugacugaagagca

SEQ ID NO: 251952 - RNA, 64 nt, hsa
acaaccuguguggaaguauauacaguugagagucacaguggagguucugagacuggauucaguc

SEQ ID NO: 251953 - RNA, 64 nt, hsa
ugggugccuggcucuaggcuauguccugagacauacaguggacagggucucuacccuccucaca

SEQ ID NO: 251954 - RNA, 64 nt, hsa
gagagucuuaccugaauggcaaucgcccagauuaacaguggagacaguaaugcaaugcaggaag

SEQ ID NO: 251955 - RNA, 64 nt, hsa
aggaauaaaguucagugugcugaucauucacaauacaguggauagcuugauaucuucuguuuuc

SEQ ID NO: 251956 - RNA, 64 nt, hsa
uuccucugacuugccaaagaaaaagaagggaaccacaguggauaugcuagcauuuuagcugugc

SEQ ID NO: 251957 - RNA, 63 nt, hsa
uuucccaaacaauacaaaaagcaaauuacacacccucaccacuguucuuaucucuauagugau

SEQ ID NO: 251958 - RNA, 63 nt, hsa
ucagggcugcaaaugucaagacauaacccuguuccucaccaucaugauaccagauacagguga

SEQ ID NO: 251959 - RNA, 63 nt, hsa
cguugaaguccucaccaguacuacaccacuuuuccucaccaacccccauccuauucuugguaa

SEQ ID NO: 251960 - RNA, 63 nt, hsa
uccuacagagucuaggcuggccgucguugaaguccucaccaguacuacaccacuuuuccucac

SEQ ID NO: 251961 - RNA, 63 nt, hsa
caaggugccaggccugccccaguaccuccagagccucaccagacuagccauugcugcagugug

SEQ ID NO: 251962 - RNA, 63 nt, hsa
cucucucuccauuaucgaacgacugacuguaaaccucaccacacaggguggugcccuggcccc

SEQ ID NO: 251963 - RNA, 63 nt, hsa
uagcaucucugcuccccagaaaauuguaagcauccucaccagccuguggauacauucuuuauu

SEQ ID NO: 251964 - RNA, 63 nt, hsa
gucuccccaaggcuggggugcugagccugccuuccucaccaccuagccauagucucaaaccug

SEQ ID NO: 251965 - RNA, 63 nt, hsa
uacgaucagcgugacagaguagaagcuggagugccucaccacacggcccggaaacagcgggaa

SEQ ID NO: 251966 - RNA, 63 nt, hsa
cacacaacacaccucaccucacaccacagcacaccucaccacaccacaccgcacugcaccaua

SEQ ID NO: 251967 - RNA, 63 nt, hsa
acaccucaccacaccacaccgcacugcaccauaccucaccacaucucaccacaccacagcaca

SEQ ID NO: 251968 - RNA, 63 nt, hsa
auaccucaccacaucucaccacaccacagcacaccucaccacacaacacaccacaccccacac

SEQ ID NO: 251969 - RNA, 63 nt, hsa
uccaaagugguugucugagacagaguuggaaacccucaccaacuggccucuucaccuuccaca

SEQ ID NO: 251970 - RNA, 63 nt, hsa
ucagggaccagagggcuagguuggcacugcggcccucaccagguccugggcucggacccaacu

SEQ ID NO: 251971 - RNA, 63 nt, hsa
uucauugcugucaccuccugagucacuggggucccucaccagcaccucccugacaccugggcu

SEQ ID NO: 251972 - RNA, 63 nt, hsa
cauccaucucaguguggaggacagugacgggacccucaccauccucuugcguuuuggccccca

SEQ ID NO: 251973 - RNA, 63 nt, hsa
ccugaccauugcccuagccagguucccaggaggccucaccauacucccuuucagggccagggc

SEQ ID NO: 251974 - RNA, 63 nt, hsa
cagaaucauguggccagcccacccccuguuggcccucaccagccuuggagucuguucuaggga

SEQ ID NO: 251975 - RNA, 63 nt, hsa
gucuccuucugggggucagggacgcagcuccacccucaccacuagcccacccugcccgugggc

SEQ ID NO: 251976 - RNA, 63 nt, hsa
uggcgggcagaugguggaaggcagcuuaggagaccucaccaaagagaagauggaccggcucuu

SEQ ID NO: 251977 - RNA, 64 nt, hsa; identical to SEQ ID NO: 86383

SEQ ID NO: 251978 - RNA, 64 nt, hsa; identical to SEQ ID NO: 86384

SEQ ID NO: 251979 - RNA, 64 nt, hsa; identical to SEQ ID NO: 86385

SEQ ID NO: 251980 - RNA, 64 nt, hsa; identical to SEQ ID NO: 86386

SEQ ID NO: 251981 - RNA, 64 nt, hsa; identical to SEQ ID NO: 86387

SEQ ID NO: 251982 - RNA, 64 nt, hsa; identical to SEQ ID NO: 86388

SEQ ID NO: 251983 - RNA, 64 nt, hsa; identical to SEQ ID NO: 86389

SEQ ID NO: 251984 - RNA, 64 nt, hsa; identical to SEQ ID NO: 86390

SEQ ID NO: 251985 - RNA, 64 nt, hsa; identical to SEQ ID NO: 86391

SEQ ID NO: 251986 - RNA, 64 nt, hsa; identical to SEQ ID NO: 86392

SEQ ID NO: 251987 - RNA, 64 nt, hsa; identical to SEQ ID NO: 86393

SEQ ID NO: 251988 - RNA, 64 nt, hsa; identical to SEQ ID NO: 86394

SEQ ID NO: 251989 - RNA, 61 nt, hsa; identical to SEQ ID NO: 86395

SEQ ID NO: 251990 - RNA, 64 nt, hsa; identical to SEQ ID NO: 86396

SEQ ID NO: 251991 - RNA, 64 nt, hsa; identical to SEQ ID NO: 86397

SEQ ID NO: 251992 - RNA, 64 nt, hsa; identical to SEQ ID NO: 86398

SEQ ID NO: 251993 - RNA, 64 nt, hsa; identical to SEQ ID NO: 86399

SEQ ID NO: 251994 - RNA, 64 nt, hsa; identical to SEQ ID NO: 86400

SEQ ID NO: 251995 - RNA, 64 nt, hsa; identical to SEQ ID NO: 86401

SEQ ID NO: 251996 - RNA, 64 nt, hsa; identical to SEQ ID NO: 86402

SEQ ID NO: 251997 - RNA, 64 nt, hsa; identical to SEQ ID NO: 86403

SEQ ID NO: 251998 - RNA, 64 nt, hsa; identical to SEQ ID NO: 86404

SEQ ID NO: 251999 - RNA, 64 nt, hsa; identical to SEQ ID NO: 86405

SEQ ID NO: 252000 - RNA, 64 nt, hsa; identical to SEQ ID NO: 86406

SEQ ID NO: 252001 - RNA, 64 nt, hsa; identical to SEQ ID NO: 86407

SEQ ID NO: 252002 - RNA, 64 nt, hsa; identical to SEQ ID NO: 86408

SEQ ID NO: 252003 - RNA, 64 nt, hsa; identical to SEQ ID NO: 86409

SEQ ID NO: 252004 - RNA, 64 nt, hsa; identical to SEQ ID NO: 86410

SEQ ID NO: 252005 - RNA, 64 nt, hsa; identical to SEQ ID NO: 86411

SEQ ID NO: 252006 - RNA, 64 nt, hsa; identical to SEQ ID NO: 86412

SEQ ID NO: 252007 - RNA, 64 nt, hsa; identical to SEQ ID NO: 86413

SEQ ID NO: 252008 - RNA, 64 nt, hsa; identical to SEQ ID NO: 86414

SEQ ID NO: 252009 - RNA, 64 nt, hsa; identical to SEQ ID NO: 86415

SEQ ID NO: 252010 - RNA, 64 nt, hsa; identical to SEQ ID NO: 86416

SEQ ID NO: 252011 - RNA, 64 nt, hsa; identical to SEQ ID NO: 86417

SEQ ID NO: 252012 - RNA, 64 nt, hsa; identical to SEQ ID NO: 86418

SEQ ID NO: 252013 - RNA, 64 nt, hsa; identical to SEQ ID NO: 86419

SEQ ID NO: 252014 - RNA, 64 nt, hsa; identical to SEQ ID NO: 86420

SEQ ID NO: 252015 - RNA, 64 nt, hsa; identical to SEQ ID NO: 86421

SEQ ID NO: 252016 - RNA, 64 nt, hsa; identical to SEQ ID NO: 86422

SEQ ID NO: 252017 - RNA, 64 nt, hsa; identical to SEQ ID NO: 86423

SEQ ID NO: 252018 - RNA, 64 nt, hsa; identical to SEQ ID NO: 86424

SEQ ID NO: 252019 - RNA, 64 nt, hsa; identical to SEQ ID NO: 86425

SEQ ID NO: 252020 - RNA, 64 nt, hsa; identical to SEQ ID NO: 86426

SEQ ID NO: 252021 - RNA, 64 nt, hsa; identical to SEQ ID NO: 86427

SEQ ID NO: 252022 - RNA, 64 nt, hsa; identical to SEQ ID NO: 86428

SEQ ID NO: 252023 - RNA, 64 nt, hsa; identical to SEQ ID NO: 86429

SEQ ID NO: 252024 - RNA, 64 nt, hsa; identical to SEQ ID NO: 86430

SEQ ID NO: 252025 - RNA, 64 nt, hsa; identical to SEQ ID NO: 86431

SEQ ID NO: 252026 - RNA, 64 nt, hsa; identical to SEQ ID NO: 86432

SEQ ID NO: 252027 - RNA, 64 nt, hsa; identical to SEQ ID NO: 86433

SEQ ID NO: 252028 - RNA, 64 nt, hsa; identical to SEQ ID NO: 86434

SEQ ID NO: 252029 - RNA, 64 nt, hsa; identical to SEQ ID NO: 86435

SEQ ID NO: 252030 - RNA, 64 nt, hsa; identical to SEQ ID NO: 86436

SEQ ID NO: 252031 - RNA, 64 nt, hsa; identical to SEQ ID NO: 86437

SEQ ID NO: 252032 - RNA, 64 nt, hsa; identical to SEQ ID NO: 86438

SEQ ID NO: 252033 - RNA, 64 nt, hsa; identical to SEQ ID NO: 86439

SEQ ID NO: 252034 - RNA, 64 nt, hsa; identical to SEQ ID NO: 86440

SEQ ID NO: 252035 - RNA, 64 nt, hsa; identical to SEQ ID NO: 86441

SEQ ID NO: 252036 - RNA, 64 nt, hsa; identical to SEQ ID NO: 86442

SEQ ID NO: 252037 - RNA, 64 nt, hsa; identical to SEQ ID NO: 86443

SEQ ID NO: 252038 - RNA, 64 nt, hsa; identical to SEQ ID NO: 86444

SEQ ID NO: 252039 - RNA, 64 nt, hsa; identical to SEQ ID NO: 86445

SEQ ID NO: 252040 - RNA, 60 nt, hsa; identical to SEQ ID NO: 86446

SEQ ID NO: 252041 - RNA, 64 nt, hsa; identical to SEQ ID NO: 86447

SEQ ID NO: 252042 - RNA, 64 nt, hsa; identical to SEQ ID NO: 86448

SEQ ID NO: 252043 - RNA, 64 nt, hsa; identical to SEQ ID NO: 86449

SEQ ID NO: 252044 - RNA, 64 nt, hsa; identical to SEQ ID NO: 86450

SEQ ID NO: 252045 - RNA, 64 nt, hsa; identical to SEQ ID NO: 86451

SEQ ID NO: 252046 - RNA, 64 nt, hsa; identical to SEQ ID NO: 86452

SEQ ID NO: 252047 - RNA, 64 nt, hsa; identical to SEQ ID NO: 86453

SEQ ID NO: 252048 - RNA, 64 nt, hsa; identical to SEQ ID NO: 86454

SEQ ID NO: 252049 - RNA, 64 nt, hsa; identical to SEQ ID NO: 86455

SEQ ID NO: 252050 - RNA, 64 nt, hsa; identical to SEQ ID NO: 86456

SEQ ID NO: 252051 - RNA, 64 nt, hsa; identical to SEQ ID NO: 86457

SEQ ID NO: 252052 - RNA, 64 nt, hsa; identical to SEQ ID NO: 86458

SEQ ID NO: 252053 - RNA, 64 nt, hsa; identical to SEQ ID NO: 86459

SEQ ID NO: 252054 - RNA, 64 nt, hsa; identical to SEQ ID NO: 86460

SEQ ID NO: 252055 - RNA, 64 nt, hsa; identical to SEQ ID NO: 86461

SEQ ID NO: 252056 - RNA, 55 nt, hsa; identical to SEQ ID NO: 86462

SEQ ID NO: 252057 - RNA, 64 nt, hsa; identical to SEQ ID NO: 86463

SEQ ID NO: 252058 - RNA, 64 nt, hsa; identical to SEQ ID NO: 86464

SEQ ID NO: 252059 - RNA, 64 nt, hsa; identical to SEQ ID NO: 86465

SEQ ID NO: 252060 - RNA, 64 nt, hsa; identical to SEQ ID NO: 86466

SEQ ID NO: 252061 - RNA, 64 nt, hsa; identical to SEQ ID NO: 86467

SEQ ID NO: 252062 - RNA, 64 nt, hsa; identical to SEQ ID NO: 86468

SEQ ID NO: 252063 - RNA, 64 nt, hsa; identical to SEQ ID NO: 86469

SEQ ID NO: 252064 - RNA, 64 nt, hsa; identical to SEQ ID NO: 86470

SEQ ID NO: 252065 - RNA, 64 nt, hsa; identical to SEQ ID NO: 86471

SEQ ID NO: 252066 - RNA, 64 nt, hsa; identical to SEQ ID NO: 86472

SEQ ID NO: 252067 - RNA, 64 nt, hsa; identical to SEQ ID NO: 86473

SEQ ID NO: 252068 - RNA, 64 nt, hsa; identical to SEQ ID NO: 86474

SEQ ID NO: 252069 - RNA, 64 nt, hsa; identical to SEQ ID NO: 86475

SEQ ID NO: 252070 - RNA, 64 nt, hsa; identical to SEQ ID NO: 86476

SEQ ID NO: 252071 - RNA, 64 nt, hsa; identical to SEQ ID NO: 86477

SEQ ID NO: 252072 - RNA, 64 nt, hsa; identical to SEQ ID NO: 86478

SEQ ID NO: 252073 - RNA, 64 nt, hsa; identical to SEQ ID NO: 86479

SEQ ID NO: 252074 - RNA, 64 nt, hsa; identical to SEQ ID NO: 86480

SEQ ID NO: 252075 - RNA, 64 nt, hsa; identical to SEQ ID NO: 86481

SEQ ID NO: 252076 - RNA, 64 nt, hsa; identical to SEQ ID NO: 86482

SEQ ID NO: 252077 - RNA, 64 nt, hsa; identical to SEQ ID NO: 86483

SEQ ID NO: 252078 - RNA, 64 nt, hsa; identical to SEQ ID NO: 86484

SEQ ID NO: 252079 - RNA, 64 nt, hsa; identical to SEQ ID NO: 86485

SEQ ID NO: 252080 - RNA, 64 nt, hsa; identical to SEQ ID NO: 86486

SEQ ID NO: 252081 - RNA, 64 nt, hsa; identical to SEQ ID NO: 86487

SEQ ID NO: 252082 - RNA, 64 nt, hsa; identical to SEQ ID NO: 86488

SEQ ID NO: 252083 - RNA, 64 nt, hsa; identical to SEQ ID NO: 86489

SEQ ID NO: 252084 - RNA, 64 nt, hsa; identical to SEQ ID NO: 86490

SEQ ID NO: 252085 - RNA, 64 nt, hsa; identical to SEQ ID NO: 86491

SEQ ID NO: 252086 - RNA, 64 nt, hsa; identical to SEQ ID NO: 86492

SEQ ID NO: 252087 - RNA, 64 nt, hsa; identical to SEQ ID NO: 86493

SEQ ID NO: 252088 - RNA, 51 nt, hsa; identical to SEQ ID NO: 86494

SEQ ID NO: 252089 - RNA, 64 nt, hsa; identical to SEQ ID NO: 86495

SEQ ID NO: 252090 - RNA, 64 nt, hsa; identical to SEQ ID NO: 86496

SEQ ID NO: 252091 - RNA, 64 nt, hsa; identical to SEQ ID NO: 86497

SEQ ID NO: 252092 - RNA, 64 nt, hsa; identical to SEQ ID NO: 86498

SEQ ID NO: 252093 - RNA, 64 nt, hsa; identical to SEQ ID NO: 86499

SEQ ID NO: 252094 - RNA, 64 nt, hsa; identical to SEQ ID NO: 86500

SEQ ID NO: 252095 - RNA, 64 nt, hsa; identical to SEQ ID NO: 86501

SEQ ID NO: 252096 - RNA, 64 nt, hsa; identical to SEQ ID NO: 86502

SEQ ID NO: 252097 - RNA, 64 nt, hsa; identical to SEQ ID NO: 86503

SEQ ID NO: 252098 - RNA, 64 nt, hsa; identical to SEQ ID NO: 86504

SEQ ID NO: 252099 - RNA, 64 nt, hsa; identical to SEQ ID NO: 86505

SEQ ID NO: 252100 - RNA, 64 nt, hsa; identical to SEQ ID NO: 86506

SEQ ID NO: 252101 - RNA, 64 nt, hsa; identical to SEQ ID NO: 86507

SEQ ID NO: 252102 - RNA, 64 nt, hsa; identical to SEQ ID NO: 86508

SEQ ID NO: 252103 - RNA, 64 nt, hsa; identical to SEQ ID NO: 86509

SEQ ID NO: 252104 - RNA, 64 nt, hsa; identical to SEQ ID NO: 86510

SEQ ID NO: 252105 - RNA, 64 nt, hsa; identical to SEQ ID NO: 86511

SEQ ID NO: 252106 - RNA, 64 nt, hsa; identical to SEQ ID NO: 86512

SEQ ID NO: 252107 - RNA, 64 nt, hsa; identical to SEQ ID NO: 86513

SEQ ID NO: 252108 - RNA, 64 nt, hsa; identical to SEQ ID NO: 86514

SEQ ID NO: 252109 - RNA, 64 nt, hsa; identical to SEQ ID NO: 86515

SEQ ID NO: 252110 - RNA, 64 nt, hsa; identical to SEQ ID NO: 86516

SEQ ID NO: 252111 - RNA, 64 nt, hsa; identical to SEQ ID NO: 86517

SEQ ID NO: 252112 - RNA, 64 nt, hsa; identical to SEQ ID NO: 86518

SEQ ID NO: 252113 - RNA, 64 nt, hsa; identical to SEQ ID NO: 86519

SEQ ID NO: 252114 - RNA, 64 nt, hsa; identical to SEQ ID NO: 86520

SEQ ID NO: 252115 - RNA, 64 nt, hsa; identical to SEQ ID NO: 86521

SEQ ID NO: 252116 - RNA, 64 nt, hsa; identical to SEQ ID NO: 86522

SEQ ID NO: 252117 - RNA, 64 nt, hsa; identical to SEQ ID NO: 86523

SEQ ID NO: 252118 - RNA, 64 nt, hsa; identical to SEQ ID NO: 86524

SEQ ID NO: 252119 - RNA, 64 nt, hsa; identical to SEQ ID NO: 86525

SEQ ID NO: 252120 - RNA, 64 nt, hsa; identical to SEQ ID NO: 64804

SEQ ID NO: 252121 - RNA, 64 nt, hsa; identical to SEQ ID NO: 64805

SEQ ID NO: 252122 - RNA, 64 nt, hsa; identical to SEQ ID NO: 64806

SEQ ID NO: 252123 - RNA, 64 nt, hsa; identical to SEQ ID NO: 64807

SEQ ID NO: 252124 - RNA, 64 nt, hsa; identical to SEQ ID NO: 64808

SEQ ID NO: 252125 - RNA, 64 nt, hsa; identical to SEQ ID NO: 64809

SEQ ID NO: 252126 - RNA, 64 nt, hsa; identical to SEQ ID NO: 64810

SEQ ID NO: 252127 - RNA, 64 nt, hsa; identical to SEQ ID NO: 64811

SEQ ID NO: 252128 - RNA, 64 nt, hsa; identical to SEQ ID NO: 64812

SEQ ID NO: 252129 - RNA, 64 nt, hsa; identical to SEQ ID NO: 64813

SEQ ID NO: 252130 - RNA, 64 nt, hsa; identical to SEQ ID NO: 64814

SEQ ID NO: 252131 - RNA, 64 nt, hsa; identical to SEQ ID NO: 64815

SEQ ID NO: 252132 - RNA, 64 nt, hsa; identical to SEQ ID NO: 64816

SEQ ID NO: 252133 - RNA, 64 nt, hsa; identical to SEQ ID NO: 64817

SEQ ID NO: 252134 - RNA, 64 nt, hsa; identical to SEQ ID NO: 64818

SEQ ID NO: 252135 - RNA, 64 nt, hsa; identical to SEQ ID NO: 64819

SEQ ID NO: 252136 - RNA, 62 nt, hsa
cccugacuccuggugcccucucccuuuguccccccagagagacauaugcccccagagagagc

SEQ ID NO: 252137 - RNA, 62 nt, hsa
ucucccuuuguccccccagagagacauaugcccccagagagagcaaaucgaagcgugggagg

SEQ ID NO: 252138 - RNA, 62 nt, hsa
aaucauguuaacucuuccuuaucagccuguggcccagagacacaaugggguccuucuguagg

SEQ ID NO: 252139 - RNA, 62 nt, hsa
cugcacaaaacuuuugggaauuccucuuugcacccagagacucagaggggaagagggugcua

SEQ ID NO: 252140 - RNA, 62 nt, hsa
cccuagacccugccagaaaagggggcucuucccccagagaaguggcuuggagggaacuuccc

SEQ ID NO: 252141 - RNA, 62 nt, hsa
gaggagccugcugcauucuccugcugagggaucccagagagggcaggugcccaccccacagg

SEQ ID NO: 252142 - RNA, 62 nt, hsa
ccucagguuguucucugauucuuccucccaaccccagagacugcagauuugugccaugcggc

SEQ ID NO: 252143 - RNA, 62 nt, hsa
cucuauccuaaggaagaccaagcaggccuggacccagagacgucccccaucgugggacacga

SEQ ID NO: 252144 - RNA, 62 nt, hsa
uccaggcuggccuuuggccgacugucugcucacccagagaccuuggacuccggacuauccau

SEQ ID NO: 252145 - RNA, 62 nt, hsa
ugcaggaguuucuccugggcagcuggucacuccccagagaagcugggccuucauggacacau

SEQ ID NO: 252146 - RNA, 62 nt, hsa
ccccggggcugccguuuugcugggcagugguucccagagagucagagcuggcaccccucagu

SEQ ID NO: 252147 - RNA, 62 nt, hsa
uguucccgcugcacggcccaccggcggccagccccagagaccagaacugauccagagcugga

SEQ ID NO: 252148 - RNA, 62 nt, hsa
cccggaggggucuggaggcauaagucuagaugcccagagagcauccaggcacugaacugcuc

SEQ ID NO: 252149 - RNA, 62 nt, hsa
cagaggacaggugacaaccaccucgaagagcucccagagauuguagaaagaguccaguguaa

SEQ ID NO: 252150 - RNA, 62 nt, hsa
aggugagaggaaggcaaaggccagggaggggacccagagaggccuggcacacaaggcccaag

SEQ ID NO: 252151 - RNA, 62 nt, hsa
aacucaggaaaagcaggaacccuuuccaaaagcccagagaugcccugggcucagaucuguaa

SEQ ID NO: 252152 - RNA, 62 nt, hsa
ucuaaccaaucaaauaguuucuuugucuugcucccagagacaccuuguaaguguccccucug

SEQ ID NO: 252153 - RNA, 62 nt, hsa
acagggaagagacauaccccugggcuuggauucccagagaggaaaccuuggggccccagaug

SEQ ID NO: 252154 - RNA, 62 nt, hsa
accugggcuaagaguuuggcauugcaggagcucccagagagacugccuucccuacacuagaa

SEQ ID NO: 252155 - RNA, 62 nt, hsa
acuuuaaaugccugccaaggagcagccucaagcccagagaagacugaggcuacggggaacuu

SEQ ID NO: 252156 - RNA, 62 nt, hsa
gguccaacccugcaaugaagcagccacuucagcccagagagauuauaagaacugauguggcc

SEQ ID NO: 252157 - RNA, 62 nt, hsa
agcguuugccagagguggccacuucagccaagcccagagaagugugggcagaagcagugaag

SEQ ID NO: 252158 - RNA, 62 nt, hsa
cucccaguuggccagaaucugaggggagagcccccagagagcccccuuccccaucagaagac

SEQ ID NO: 252159 - RNA, 62 nt, hsa
cccuagggucucuucuugcuugacucaaucuacccagagaugccccuuagcacaccuagagg

SEQ ID NO: 252160 - RNA, 62 nt, hsa
uaaagcuaggcagaugagcccagaagaauggucccagagaaagcagacuggcuccaauagau

SEQ ID NO: 252161 - RNA, 62 nt, hsa
ugccuacuguuccccaccucagaagcuuccugcccagagagccagcagccuugggauacuaa

SEQ ID NO: 252162 - RNA, 62 nt, hsa
accaaggagcuggggcccaaggccaguccugccccagagacacuccaaguccgccaggggca

SEQ ID NO: 252163 - RNA, 62 nt, hsa
aaagagggccccagcccagccccaccacagaucccagagauaggggcccagucuccaugggg

SEQ ID NO: 252164 - RNA, 62 nt, hsa
gcacccggggcugcaaacgucuccgugcagcccccagagagaggcccaugggcucagaccag

SEQ ID NO: 252165 - RNA, 62 nt, hsa
uucuacccaaaugucaggaccaggauuuucuacccagagaccaagguguucuucccaaagac

SEQ ID NO: 252166 - RNA, 62 nt, hsa
uucuacccauaugucaggaccaggauuuucuacccagagaccaagguuaucuuccuaaagac

SEQ ID NO: 252167 - RNA, 62 nt, hsa
uucuacccauaugucaggaccgggauuuucuacccagagaccugcauguucucuccaacgac

SEQ ID NO: 252168 - RNA, 62 nt, hsa
cugcuauccagccgcaaauccauacccccugccccagagaagccucagucccucccuccugg

SEQ ID NO: 252169 - RNA, 62 nt, hsa
uucccaggacccugggucaccuuccugggcagcccagagagacccugccaacuuuccagacu

SEQ ID NO: 252170 - RNA, 62 nt, hsa
ucuccacccaucucuacaucugggcacagcaacccagagauggccaaaagcauucaagccug

SEQ ID NO: 252171 - RNA, 62 nt, hsa
gauggccuucuuugucaucuucacucuccacccccagagaggagucagagccauaacucaau

SEQ ID NO: 252172 - RNA, 62 nt, hsa
gugccccaaaaugcaagauuuuccacaagauucccagagacaggaaaauccucuggcuggcu

SEQ ID NO: 252173 - RNA, 62 nt, hsa
uccuugcaccugcauccguaguucccugaaaacccagagaggaaucagacuucacacugcaa

SEQ ID NO: 252174 - RNA, 62 nt, hsa
ggcagagggcagaggcuggaggcagggccuugcccagagaugccuccaccgcugccuaagug

SEQ ID NO: 252175 - RNA, 62 nt, hsa
gggcccuggcuauuugggaccuaagccuaggccccagagaucagcccgaacacccgcauccc

SEQ ID NO: 252176 - RNA, 62 nt, hsa
acccucuuggcuuucccgugcucuuugggcuccccagagaccugacaguauuagggagugaa

SEQ ID NO: 252177 - RNA, 62 nt, hsa
ucagccuggccagacacaggcccucccuguuccccagagaaaggggagcccacuguccuggg

SEQ ID NO: 252178 - RNA, 62 nt, hsa
gcugacggccagggagaagcuccucuccccagcccagagacauacuugaagggccagagcca

SEQ ID NO: 252179 - RNA, 62 nt, hsa
cccgacguagcugccccccuggggggccacagcccagagaaccagccuaggaacacucggga

SEQ ID NO: 252180 - RNA, 62 nt, hsa
gcuccaguguggggugaggcagugagguuaggcccagagagcuggaguuggcucagaugaaa

SEQ ID NO: 252181 - RNA, 62 nt, hsa
gagcagcagcaggacagacccccacgaggccccccagagaggaggaagaucccacggaggaa

SEQ ID NO: 252182 - RNA, 62 nt, hsa
ugccugagggacaacagacaucagaacaaacccccagagagaaacagucaaaaucagggccc

SEQ ID NO: 252183 - RNA, 62 nt, hsa
accuaccuugcuuugggagcugccugcaccaccccagagaaggccccaccuucuucaucccu

SEQ ID NO: 252184 - RNA, 62 nt, hsa
caucgagcuagcucccugcacggccgcacccucccagagaacuccuugaggagaacaagugc

SEQ ID NO: 252185 - RNA, 62 nt, hsa
cugaccccugccagggcacagauaggcaggaccccagagagggcaggcagccacgcccugca

SEQ ID NO: 252186 - RNA, 62 nt, hsa
aagacccucagauguggccagagcaccggccucccagagaaagcccaggaaguccccguggu

SEQ ID NO: 252187 - RNA, 62 nt, hsa
gggccgcuccaggccccacagagcaggagacccccagagaaagccggggcuggcaggaggcg

SEQ ID NO: 252188 - RNA, 62 nt, hsa
ccucaacugacagcugaggaaaggcaauuaggcccagagaggcagagacacucgcuuaagau

SEQ ID NO: 252189 - RNA, 62 nt, hsa
gucugugaaaugaaagucccugacaugaagcucccagagauaaaacuccccaaggugccuga

SEQ ID NO: 252190 - RNA, 62 nt, hsa
gugcaccucccggaagugcagcucccgaaagucccagagaugaaacucccuaaaaugccuga

SEQ ID NO: 252191 - RNA, 62 nt, hsa
gugcaccucccagaagugcagcuuccaaaagucccagagaugaagcucccugagaugaaacu

SEQ ID NO: 252192 - RNA, 62 nt, hsa
gcugccagcucucaacauagcaggccauaggacccagagaagaaucccagcguugcucaaag

SEQ ID NO: 252193 - RNA, 62 nt, hsa
agaauucuuuggcgggaaggguaugauggguucccagagacaagaagcccaaccuucuggcc

SEQ ID NO: 252194 - RNA, 62 nt, hsa
gggagagaacacgcugugaaaacacagaagcucccagagaagccuucucagcuuuuaucucu

SEQ ID NO: 252195 - RNA, 62 nt, hsa
agaaaggcuggaguuauuauucaacucaaucucccagagaacucagaggcuacaguuucuac

SEQ ID NO: 252196 - RNA, 62 nt, hsa
ccccugcucagucagccccacucccugggcuucccagagagugacagcugcucaggcccuaa

SEQ ID NO: 252197 - RNA, 62 nt, hsa
caccuaugccacagugccuaagggcuaggccacccagagacugugcccggagcuggccgugu

SEQ ID NO: 252198 - RNA, 62 nt, hsa
ugggaaaaugaacguccaggacacaccuguaucccagagagcaaagugaugaggagacugag

SEQ ID NO: 252199 - RNA, 62 nt, hsa
accuccugcggcagaacagcacccgugacccacccagagagcaaggccaggggucuuggugc

SEQ ID NO: 252200 - RNA, 62 nt, hsa
gaacugaaauccuugagaguuccggggagaaacccagagaugccugauuucauuccucgaug

SEQ ID NO: 252201 - RNA, 62 nt, hsa
auuccacccuguuacuuauguagaaacugaggcccagagagggaagaugaccugccccaagu

SEQ ID NO: 252202 - RNA, 64 nt, hsa; identical to SEQ ID NO: 159617

SEQ ID NO: 252203 - RNA, 64 nt, hsa; identical to SEQ ID NO: 159618

SEQ ID NO: 252204 - RNA, 64 nt, hsa; identical to SEQ ID NO: 159619

SEQ ID NO: 252205 - RNA, 64 nt, hsa; identical to SEQ ID NO: 159620

SEQ ID NO: 252206 - RNA, 64 nt, hsa; identical to SEQ ID NO: 159621

SEQ ID NO: 252207 - RNA, 64 nt, hsa; identical to SEQ ID NO: 159622

SEQ ID NO: 252208 - RNA, 64 nt, hsa; identical to SEQ ID NO: 159623

SEQ ID NO: 252209 - RNA, 64 nt, hsa; identical to SEQ ID NO: 159624

SEQ ID NO: 252210 - RNA, 64 nt, hsa; identical to SEQ ID NO: 159625

SEQ ID NO: 252211 - RNA, 64 nt, hsa; identical to SEQ ID NO: 159626

SEQ ID NO: 252212 - RNA, 64 nt, hsa; identical to SEQ ID NO: 159627

SEQ ID NO: 252213 - RNA, 64 nt, hsa; identical to SEQ ID NO: 159628

SEQ ID NO: 252214 - RNA, 64 nt, hsa; identical to SEQ ID NO: 159629

SEQ ID NO: 252215 - RNA, 64 nt, hsa; identical to SEQ ID NO: 159630

SEQ ID NO: 252216 - RNA, 64 nt, hsa; identical to SEQ ID NO: 159631

SEQ ID NO: 252217 - RNA, 64 nt, hsa; identical to SEQ ID NO: 159632

SEQ ID NO: 252218 - RNA, 64 nt, hsa; identical to SEQ ID NO: 159633

SEQ ID NO: 252219 - RNA, 64 nt, hsa; identical to SEQ ID NO: 159634

SEQ ID NO: 252220 - RNA, 64 nt, hsa; identical to SEQ ID NO: 159635

SEQ ID NO: 252221 - RNA, 64 nt, hsa; identical to SEQ ID NO: 159636

SEQ ID NO: 252222 - RNA, 64 nt, hsa; identical to SEQ ID NO: 159637

SEQ ID NO: 252223 - RNA, 64 nt, hsa; identical to SEQ ID NO: 159638

SEQ ID NO: 252224 - RNA, 64 nt, hsa; identical to SEQ ID NO: 159639

SEQ ID NO: 252225 - RNA, 64 nt, hsa; identical to SEQ ID NO: 159640

SEQ ID NO: 252226 - RNA, 64 nt, hsa; identical to SEQ ID NO: 159641

SEQ ID NO: 252227 - RNA, 64 nt, hsa; identical to SEQ ID NO: 159642

SEQ ID NO: 252228 - RNA, 64 nt, hsa; identical to SEQ ID NO: 159643

SEQ ID NO: 252229 - RNA, 64 nt, hsa; identical to SEQ ID NO: 159644

SEQ ID NO: 252230 - RNA, 64 nt, hsa; identical to SEQ ID NO: 159645

SEQ ID NO: 252231 - RNA, 64 nt, hsa; identical to SEQ ID NO: 159646

SEQ ID NO: 252232 - RNA, 64 nt, hsa; identical to SEQ ID NO: 159647

SEQ ID NO: 252233 - RNA, 64 nt, hsa; identical to SEQ ID NO: 159648

SEQ ID NO: 252234 - RNA, 64 nt, hsa; identical to SEQ ID NO: 159649

SEQ ID NO: 252235 - RNA, 64 nt, hsa; identical to SEQ ID NO: 159650

SEQ ID NO: 252236 - RNA, 64 nt, hsa; identical to SEQ ID NO: 159651

SEQ ID NO: 252237 - RNA, 64 nt, hsa; identical to SEQ ID NO: 159652

SEQ ID NO: 252238 - RNA, 64 nt, hsa; identical to SEQ ID NO: 159653

SEQ ID NO: 252239 - RNA, 64 nt, hsa; identical to SEQ ID NO: 159654

SEQ ID NO: 252240 - RNA, 64 nt, hsa; identical to SEQ ID NO: 159655

SEQ ID NO: 252241 - RNA, 64 nt, hsa; identical to SEQ ID NO: 159656

SEQ ID NO: 252242 - RNA, 64 nt, hsa; identical to SEQ ID NO: 159657

SEQ ID NO: 252243 - RNA, 64 nt, hsa; identical to SEQ ID NO: 159658

SEQ ID NO: 252244 - RNA, 63 nt, hsa
accucuugcacuguugucuuguuucacugaucuuagcuuuaaacacaagagaagucuuuaaaa

SEQ ID NO: 252245 - RNA, 63 nt, hsa
cccaucucuaaaaaaugaaaaaaagaagagagguagcuuuaaagugguuuuucucaugauauu

SEQ ID NO: 252246 - RNA, 63 nt, hsa
gucuaaguugaccucgagugagccaugcaaaaauagcuuuaaaauuauacaugagcagcucaa

SEQ ID NO: 252247 - RNA, 63 nt, hsa
agcauugcaauauggaauuuugcacauuuuuguuagcuuuacauuauuugcugauaccaacuu

SEQ ID NO: 252248 - RNA, 63 nt, hsa
guuaugucacuaauaaugaguaguaacccaauuuagcuuuacaaagauuuuuucuauuacuuu

SEQ ID NO: 252249 - RNA, 63 nt, hsa
cguggcuaaaaccccacaauaacuuuacauuccuagcuuuacagucuugcugugaauucucug

SEQ ID NO: 252250 - RNA, 63 nt, hsa
guugaacaaacugaauauaugggcuauagcaaguagcuuuacaguacagaucuuacaauuaag

SEQ ID NO: 252251 - RNA, 63 nt, hsa
uaucuggaccauuaagaaaacggauuuuguaacuagcuuuaaacuaggccaagcaacuaguuu

SEQ ID NO: 252252 - RNA, 63 nt, hsa
gaaaaauucagagaguuaggaaggaaaaaccaauagcuuuaaaaccugugugccauuuuaaga

SEQ ID NO: 252253 - RNA, 63 nt, hsa
aguuucuguuaaucauguauuaaaacugauuuuuagcuuuacaaauaugucaguuugcaguua

SEQ ID NO: 252254 - RNA, 63 nt, hsa
ugcaaaguagcaauuuccauagucacaguuagguagcuuuagggcaauauugccaugguuuua

SEQ ID NO: 252255 - RNA, 63 nt, hsa
gaguucuaccauagcaaggccuaauguuagcuuuagcuuuagaaaauaacaguuugugaacuu

SEQ ID NO: 252256 - RNA, 63 nt, hsa
agugaagaguucuaccauagcaaggccuaauguuagcuuuagcuuuagaaaauaacaguuugu

SEQ ID NO: 252257 - RNA, 63 nt, hsa
gaaaacacguaacuuguuuaaaaguuuuucugguagcuuuagcuuuaugcuaaaaaaaauaau

SEQ ID NO: 252258 - RNA, 63 nt, hsa
acguaacuuguuuaaaaguuuuucugguagcuuuagcuuuaugcuaaaaaaaauaaugacauu

SEQ ID NO: 252259 - RNA, 63 nt, hsa
aaaaaaagagacugguuagugaugcaguuaguauagcuuuauacucucuccacuuuauagcuc

SEQ ID NO: 252260 - RNA, 63 nt, hsa
uuuugacaaucaaagaaaagacuuuuguugaaauagcuuuacuguuucucaaguguuuuggag

SEQ ID NO: 252261 - RNA, 63 nt, hsa
gggaaauaagggaauaaggccaaggaagauguauagcuuuagcuuuagccuggcaaccuggag

SEQ ID NO: 252262 - RNA, 63 nt, hsa
uaagggaauaaggccaaggaagauguauagcuuuagcuuuagccuggcaaccuggagaaucca

SEQ ID NO: 252263 - RNA, 63 nt, hsa
aaaauaucuuuuucaaggcaucagcucugaaccuagcuuuauuuaaacugaauuuccaguaua

SEQ ID NO: 252264 - RNA, 63 nt, hsa
agggaaucaaaaauacugcuuucaguuaguagcuagcuuuaagucaggaguuaguaaugagaa

SEQ ID NO: 252265 - RNA, 65 nt, hsa
ucaucugaccacugggcaccuuagugccaaccugaaccaaagagaccuccuuguuucagcugggc

SEQ ID NO: 252266 - RNA, 65 nt, hsa
uugugggaacaagagaugacuuugaggauaaaaggaccaaagaaaaagcuuuacuuagaugauug

SEQ ID NO: 252267 - RNA, 65 nt, hsa
gaguuccugauuccaagucaccugugcuuucugggaccaaagaaugggcaccugcuggaguccgg

SEQ ID NO: 252268 - RNA, 65 nt, hsa
aguaauuuuaaggggccaaagcuuucccugaagcaaccaaagauauauccaagugcuuccuccaa

SEQ ID NO: 252269 - RNA, 65 nt, hsa
aaaguccuauaauguggaagaaacaaacaguugcuaccaaagauucuucaaauaaacauacaaau

SEQ ID NO: 252270 - RNA, 65 nt, hsa
aaauuggccugaauauucucuuggggaaagagggcaccaaagaaaaggguaagugcaucugaggg

SEQ ID NO: 252271 - RNA, 65 nt, hsa
gcaucagagccagaaaugcccucccuagguccaggaccaaagauaaaacaaacacgaggaacaug

SEQ ID NO: 252272 - RNA, 65 nt, hsa
ggugcuaccauauggagccuaaggauaaagccaauaccaaagaaaacagugacuaaacagagaga

SEQ ID NO: 252273 - RNA, 65 nt, hsa
gaguuuugccuuaauuuuuuaaguacugcaccaaaaccaaagagcugaccugacuucuguggaac

SEQ ID NO: 252274 - RNA, 65 nt, hsa
ccucaacauaacuaugaaaucauagcucuguuuucaccaaagaacagaccaauuaacauacuuau

SEQ ID NO: 252275 - RNA, 65 nt, hsa
uuuuuuguaugcuuaaauaaaaauaaaaauucauaaccaaagagaaucccacauuagcuuguuag

SEQ ID NO: 252276 - RNA, 65 nt, hsa
gggugcaguccagacagcuugacugcuuuuaaaugaccaaagaugaccugugguaagcaaccugg

SEQ ID NO: 252277 - RNA, 65 nt, hsa
aauccagauauuugagaagcaggaaauuuauagcaaccaaagaaauagggcaagagaggcaggug

SEQ ID NO: 252278 - RNA, 65 nt, hsa
ucagagagaccugcuaaaaccagacagauauaaacaccaaagacggaagccaaauagguagccaa

SEQ ID NO: 252279 - RNA, 65 nt, hsa
guaauagacaacuccagauugacauugacugcuuaaccaaagaaauugaucuuuuucaagcccga

SEQ ID NO: 252280 - RNA, 65 nt, hsa
uucuuucuuacagaucaaagguccaucaucaaaacaccaaagacucaagacacagaagaugauga

SEQ ID NO: 252281 - RNA, 65 nt, hsa
uggcugccucccuuccucagcccauuagguuaaacaccaaagaaagacugguguguacugaauag

SEQ ID NO: 252282 - RNA, 65 nt, hsa
uuuauuuggaaccuucuaagaggaaaucaaccaggaccaaagagccuuaaaggacacacagcaau

SEQ ID NO: 252283 - RNA, 65 nt, hsa
aaucagcucaggacugccauuggacuauggagugcaccaaagagaaugcccuucuccuuauugua

SEQ ID NO: 252284 - RNA, 65 nt, hsa
ccugccccagcuggggaaaucaaaagggccaaagaaccaaagaagaaaguccacccuugguuccu

SEQ ID NO: 252285 - RNA, 65 nt, hsa
acaagaaauauuaauaccacauggggagaaccccaaccaaagaaaucugaaauauauaguaaaug

SEQ ID NO: 252286 - RNA, 65 nt, hsa
aauaaagcaaaaagcaggccacaaccuuaaccaacaccaaagaaacauccaagcaauaaagugga

SEQ ID NO: 252287 - RNA, 65 nt, hsa
acaccuuuccagaaaaaagucaauuguucagguacaccaaagaggaagaagagcuguggaggcca

SEQ ID NO: 252288 - RNA, 65 nt, hsa
accuggcacacuggggucugcacaaggcuuugucaaccaaagacagcuucccccuuuugauugcc

SEQ ID NO: 252289 - RNA, 65 nt, hsa
aucucaaauuuuaaguuaaacuaccuaaaauaaauaccaaagauaaugcauauuuuugcacagug

SEQ ID NO: 252290 - RNA, 65 nt, hsa
ugcuauuaugauguuuugcaaaggaaaauaaucaaaccaaagaguauucagugauauguaaauua

SEQ ID NO: 252291 - RNA, 65 nt, hsa
uaauguucauuuaucaaaaaucugguuugggaaauaccaaagaggcuuugauugaauucccuuuu

SEQ ID NO: 252292 - RNA, 65 nt, hsa
acguguuucguaagcccaggcaccaaugggaauggaccaaagaguuucagggaaacuccaguaua

SEQ ID NO: 252293 - RNA, 65 nt, hsa
gggaccagaggucauaggugcccaacggcagccaaaccaaagacacuggugugcauggggcagca

SEQ ID NO: 252294 - RNA, 65 nt, hsa
gcgggcagaugguggaaggcagcuuaggagaccucaccaaagagaagauggaccggcucuugcuc

SEQ ID NO: 252295 - RNA, 65 nt, hsa
ggaaauggagaguagugagcaaaacaucagauuucaccaaagaaccaaagugacuccacaauugg

SEQ ID NO: 252296 - RNA, 65 nt, hsa
caggggaaacugcacuuagacugacagaauugaacaccaaagaauuugcuggcuuccaaauuggg

SEQ ID NO: 252297 - RNA, 65 nt, hsa
aagcgcuuuaugcccaugaugucauuucaggcucaaccaaagaggaucaaacaggaauuccaucu

SEQ ID NO: 252298 - RNA, 65 nt, hsa
cuuucagcugagaacagauuugacucacagacauuaccaaagaggagcuugugaauccaggaaaa

SEQ ID NO: 252299 - RNA, 60 nt, hsa
uccaagccuguggcuggagcugguguguguuuaucuaauaaagucccacaggugccucac

SEQ ID NO: 252300 - RNA, 60 nt, hsa
auaauaugguuguugaaaaugugaucaccuuuaucuaaagugggagaagauacauacaca

SEQ ID NO: 252301 - RNA, 60 nt, hsa
ucauccagaaguuccucaagggccaggacuuuaucuaauaccucugugugcuccuccuug

SEQ ID NO: 252302 - RNA, 60 nt, hsa
gggguuuaauauuacccuuuccuauguguuuuaucuaauuauuuugguuguuaauauggu

SEQ ID NO: 252303 - RNA, 60 nt, hsa
gaagccgaaaucugcauaaggaagcccacuuuaucuaaaugauauuagccaggauccuug

SEQ ID NO: 252304 - RNA, 60 nt, hsa
gguccaugcacaucccugacaccucacaccuuaucuaagucugaagcuggggagaaaggg

SEQ ID NO: 252305 - RNA, 60 nt, hsa
aaaguuucucugguuaccccucuucccuuguuaucuaagcuuuccucaguugucaucucu

SEQ ID NO: 252306 - RNA, 60 nt, hsa
gaggcagcuuucaucacacccuuuuaacauuuaucuaaaagaauuuaaauucuuuuucaa

SEQ ID NO: 252307 - RNA, 60 nt, hsa
cagccaguccacagguuugcauccuggacuuuaucuaaauagugccaagacacaucacua

SEQ ID NO: 252308 - RNA, 60 nt, hsa
cugcuggugaaccaauaccauaagcauguauuaucuaagcacuugaucaagaaauauaca

SEQ ID NO: 252309 - RNA, 60 nt, hsa
aauaugguuggcauuaaauuuagcauuucauuaucuaacaaaauuaauauaaauuccagg

SEQ ID NO: 252310 - RNA, 60 nt, hsa
uuaaacauccugaaucgggaacaaaggguuuuaucuaauaaagugucucuuccauucacg

SEQ ID NO: 252311 - RNA, 60 nt, hsa
uaucugcuuuugguuauaauguguuuuuaauuaucuaaaguaugaagcauuuucuggggu

SEQ ID NO: 252312 - RNA, 60 nt, hsa
auugucaugacauuuccaacacugugugaauuaucuaaaugcgucuaccauuuugcacua

SEQ ID NO: 252313 - RNA, 60 nt, hsa
uuauuucauaaaauaagaauuuguucuguguuaucuaaagauguaucaguauauugucac

SEQ ID NO: 252314 - RNA, 60 nt, hsa
agaacuuauaguaaggaaacucacuugauuuuaucuaaccucaaacuuuccaaguuuaau

SEQ ID NO: 252315 - RNA, 60 nt, hsa
aaggggaagugaggagaauuucuuucaagauuaucuaaacauuagaaacaugacauuuaa

SEQ ID NO: 252316 - RNA, 60 nt, hsa
gaaguuuuaugucccugacucuggcuaaaauuaucuaauuuccagaugcuuuuguagaug

SEQ ID NO: 252317 - RNA, 60 nt, hsa
uucagggucaaaucauguacauuacagauauuaucuaaauucuucuagaauuuauuuuuc

SEQ ID NO: 252318 - RNA, 60 nt, hsa
agcuaagacuuuuuuuccuguggcuuuuauuuaucuaagaggucuuugcauauagaugaa

SEQ ID NO: 252319 - RNA, 60 nt, hsa
auacaggaucuuucagaucaugugcaauuuuuaucuaaccaaucagaaauacuaguuuaa

SEQ ID NO: 252320 - RNA, 60 nt, hsa
aaaauaaccaauacuccacugcucauauuuuuaucuaauucagauggaucuuccuuacaa

SEQ ID NO: 252321 - RNA, 60 nt, hsa
cuuggccuggcccagcccaagaucccagcguuaucuaacuccuggaggguggacucuguc

SEQ ID NO: 252322 - RNA, 60 nt, hsa
uauuauacggcuacauuuacacauuuacacuuaucuaauaaaucagauuucacagucuca

SEQ ID NO: 252323 - RNA, 60 nt, hsa
ggaaauuaggauaugacauauaugaaagguuuaucuaagaagaaagaaacagagauaaua

SEQ ID NO: 252324 - RNA, 60 nt, hsa
ucuucaauuuggagugacuaacacaaguuguuaucuaaaccuuuaaaccuaucuuccagg

SEQ ID NO: 252325 - RNA, 60 nt, hsa
cagauuggauagcaaggcugcuguucuggauuaucuaaugcuccacuucuucuugugaug

SEQ ID NO: 252326 - RNA, 60 nt, hsa
acuccauggacauugcugcucuuggugguguuaucuaauuuuugugauagggaaacaaau

SEQ ID NO: 252327 - RNA, 60 nt, hsa
aaccagguauggaagccuacgugcucacaguuaucuaaugagguuauuucaaaguuugca

SEQ ID NO: 252328 - RNA, 60 nt, hsa
uugggauaauuuuucuauauuagguacaauuuaucuaaacugaauugagaaaaaauuaca

SEQ ID NO: 252329 - RNA, 60 nt, hsa
caucuuuuuuuaaaaaccgaauuucaucauuuaucuaaagagaaaauaugcagaauaacu

SEQ ID NO: 252330 - RNA, 60 nt, hsa
cuuaacacccuuuugugaagaucacagcauuuaucuaagaaacugugaggcuuucugguu

SEQ ID NO: 252331 - RNA, 60 nt, hsa
auuuauauauguauugauuggcaaccagauuuaucuaaguagaacugaauuggcuaggaa

SEQ ID NO: 252332 - RNA, 60 nt, hsa
caguaacuugugaauguuaaguaucaucucuuaucuaaauauuaaaagauaagucaaaca

SEQ ID NO: 252333 - RNA, 60 nt, hsa
ucacaaugucaguauuucaguguaguuaauuuaucuaaauuaaagccuuuaguaucagug

SEQ ID NO: 252334 - RNA, 60 nt, hsa
cuuauuuuguauaauuuuuaugcucuuugauuaucuaauaaggccaguauuucaaaagcu

SEQ ID NO: 252335 - RNA, 60 nt, hsa
ccccauuauuaaaucaaccugagccacauguuaucuaaaggaacugauucacaacuuucu

SEQ ID NO: 252336 - RNA, 60 nt, hsa
gucuaguguacaucuagcuaaaagugugguuuaucuaaaccguuuuaauaagcaagauga

SEQ ID NO: 252337 - RNA, 60 nt, hsa
uucacuugcacaucauggaggguuuagugcuuaucuaauuugugccucacuggacuuguc

SEQ ID NO: 252338 - RNA, 60 nt, hsa
aaguuuagaaauauccuaaucuauuuuuauuuaucuaaaaguaaguguuuuccggcugau

SEQ ID NO: 252339 - RNA, 60 nt, hsa
acaguaugcccauuuguuuuuauggcuuucuuaucuaaacugcacugaugaacuagauua

SEQ ID NO: 252340 - RNA, 60 nt, hsa
uccugcuucugauaugcaguuuuccuuaaauuaucuaaaaucugcuagggaauaucaaua

SEQ ID NO: 252341 - RNA, 60 nt, hsa
uaccuuccaagugaauaugauuauugaggauuaucuaauuauuaucuacguuucucucua

SEQ ID NO: 252342 - RNA, 60 nt, hsa
auuauugugacaacucuagaccugccugcuuuaucuaauguaaucaugcucaaugucuac

SEQ ID NO: 252343 - RNA, 60 nt, hsa
aaaagaaguaugucaguuauaauaaccugguuaucuaaccuguuccauuccauggaacca

SEQ ID NO: 252344 - RNA, 60 nt, hsa
aaccagcacuagcuuguuccaagcuggaauuuaucuaaucuauuuuuguguuuaaaaaag

SEQ ID NO: 252345 - RNA, 60 nt, hsa
auucaggggcuagagugauuuuuuuccagauuaucuaaaguuggaugcccacacuaugaa

SEQ ID NO: 252346 - RNA, 60 nt, hsa
uggcuagcaaucugccuguaucucucacuauuaucuaaaagaaaccuuccaaugcuucug

SEQ ID NO: 252347 - RNA, 60 nt, hsa
auguuaaaaggcauuuauaauuauuuuuaauuaucuaaguuuuaauacaagaacgauuuc

SEQ ID NO: 252348 - RNA, 60 nt, hsa
uuguccuuguuaagaauuucuugaagugauuuaucuaaaauaaagguuggcaaacuuuuu

SEQ ID NO: 252349 - RNA, 60 nt, hsa
gcauuuauuguuuaggaguauaauuuuauuuuaucuaaaauaauagucuauuuuuucuuu

SEQ ID NO: 252350 - RNA, 60 nt, hsa
aaugaaaagggacuuaaaaaguaaacaugauuaucuaaauuacuuaaaauuuuuuaaucu

SEQ ID NO: 252351 - RNA, 60 nt, hsa
uuuucaauaugcaaguuaggcuuaauuuuuuuaucuaaugaucaucaugaaaugaauaag

SEQ ID NO: 252352 - RNA, 60 nt, hsa
ugcuuguaaacagaugugauagagauaaaguuaucuaacaaauugguuauauucuaagau

SEQ ID NO: 252353 - RNA, 60 nt, hsa
caauauauaguuagcuuuauugaagucuucuuaucuaaacccagcaaaacagauucaaag

SEQ ID NO: 252354 - RNA, 60 nt, hsa
auucaagcaaaagaauuauuaacucuguguuuaucuaaaauguugaauccauucugguuu

SEQ ID NO: 252355 - RNA, 60 nt, hsa
uuguuuuuaguaguuucccaacuuuaagacuuaucuaauuuaacugagaaagaaagccuu

SEQ ID NO: 252356 - RNA, 60 nt, hsa
ucuuuuuaauuuuaguaauuuuuacaaagguuaucuaaugucuuuuauuucuuguuuucu

SEQ ID NO: 252357 - RNA, 60 nt, hsa
gggagugaugaaucaucaccgguuguccccuuaucuaacuccauaaaagugggaauuuca

SEQ ID NO: 252358 - RNA, 60 nt, hsa
uuacaggauuuuggcucgauaccucaagauuuaucuaacagugcaguuucauuuagauaa

SEQ ID NO: 252359 - RNA, 60 nt, hsa
aucuccagaagaggggagcagaguccgagcuuaucuaaauaugaauguggccacaaagcu

SEQ ID NO: 252360 - RNA, 60 nt, hsa
gauuuacaauuuauguauucccuaauccaauuaucuaaaucuuccuuuucuuucagaaau

SEQ ID NO: 252361 - RNA, 60 nt, hsa
agagcuaagacaaacaaaacaaaacacagcuuaucuaaucuaaugagaaacucagaaaaa

SEQ ID NO: 252362 - RNA, 60 nt, hsa
auaaaugugaauaugcuuuuacauuugggcuuaucuaauuugcaauaagagagccucucu

SEQ ID NO: 252363 - RNA, 60 nt, hsa
gggaaacugagggcagagagguuaacagauuuaucuaagguccccagcagaauugacagu

SEQ ID NO: 252364 - RNA, 60 nt, hsa
uucguguucuguguauaccaaaugauucuguuaucuaaagaagcuuuuugcugggaaaac

SEQ ID NO: 252365 - RNA, 60 nt, hsa
caccuggcucucucucuguccugccucccauuaucuaacacauuuuuuacauguacauuu

SEQ ID NO: 252366 - RNA, 60 nt, hsa
ugauuugaucuuuuuucaguuucacauaccuuaucuaagguuucccaggauuuaaacaga

SEQ ID NO: 252367 - RNA, 60 nt, hsa
uauaauuuuaaaaaaucccuuguaggauuauuaucuaaauuuauaugucuaacuucuacu

SEQ ID NO: 252368 - RNA, 60 nt, hsa
uuuuggucuuggcuuguucucauaagucauuuaucuaaguuuguguuucugugugugugu

SEQ ID NO: 252369 - RNA, 60 nt, hsa
gguccccaucugucaaaugagaagauuggauuaucuaaucuuuuagauccuuaacaacuc

SEQ ID NO: 252370 - RNA, 60 nt, hsa
ugcuggugcuaaauaacagucuuuauuauauuaucuaauuuugacuaaagaaauacuuuu

SEQ ID NO: 252371 - RNA, 60 nt, hsa
auucauuugugaguuuggauauagagcacauuaucuaaaccauuuuguaguuccaaaaac

SEQ ID NO: 252372 - RNA, 60 nt, hsa
ggaaaaaaugaaagcuauuucaugcaaacauuaucuaauuuagcuuaaaagugaaagugg

SEQ ID NO: 252373 - RNA, 60 nt, hsa
caagcuugugaauauguaaauuuuaaacuauuaucuaacuaaguguacugaauugucguu

SEQ ID NO: 252374 - RNA, 60 nt, hsa
gcuuucuauuacuuuuuaggcuuuaguauauuaucuaaaguuuggcuuuugauguggaug

SEQ ID NO: 252375 - RNA, 60 nt, hsa
gcuguccgguggagaucccacccgaacgucuuaucuaaucaugaaacucccuaguuccuu

SEQ ID NO: 252376 - RNA, 60 nt, hsa
auacugcuuagcauuuugcauguuuuacuuuuaucuaaaguuuuguuuuguuuuauuauu

SEQ ID NO: 252377 - RNA, 60 nt, hsa
uuuucauuucugguuuuuacuauacaaugguuaucuaacauacuaaguugguacccuacc

SEQ ID NO: 252378 - RNA, 60 nt, hsa
uauuuuguacugagaucauacacuauuucauuaucuaaguguauuaauuguuugguugcu

SEQ ID NO: 252379 - RNA, 60 nt, hsa
uauuuuguauucaauguguaaauacuuuuauuaucuaauacuaucuuacgucuaauuagu

SEQ ID NO: 252380 - RNA, 60 nt, hsa
ggaguauuuauugucaguuuuguucacuuguuaucuaauacaaaauuauaaagccuucag

SEQ ID NO: 252381 - RNA, 60 nt, hsa
aggauucauaaggagcuuaucugaacagauuuaucuaagaaaaaaaaaaaacgacauaaa

SEQ ID NO: 252382 - RNA, 60 nt, hsa
gugaaaguauucuaagccaaguuuuaaauauuaucuaacagacaagagugguauauacaa

SEQ ID NO: 252383 - RNA, 60 nt, hsa
cuuuuccugcggcaucagaugaauuguuaauuaucuaauuucugaaaugugcagcuccca

SEQ ID NO: 252384 - RNA, 60 nt, hsa
auagacuaauauggguaauuacccuuugguuuaucuaaaguguguucaugaugacugagg

SEQ ID NO: 252385 - RNA, 60 nt, hsa
gcaaugccuuuauuuaaaaaaauugucuacuuaucuaaauauucauaccacaauuucaaa

SEQ ID NO: 252386 - RNA, 60 nt, hsa
guaagugauaugagaaaucuuuaaccagccuuaucuaaaaauaaaaagagaagccauugu

SEQ ID NO: 252387 - RNA, 60 nt, hsa
cccugccaauguuuaacuuuuaaaagcaucuuaucuaaaagaaaggcuauccaguagagc

SEQ ID NO: 252388 - RNA, 60 nt, hsa
ugagguugauaaaguauuacugauaaaaaauuaucuaaggaaaaaaacagaaaauuauuu

SEQ ID NO: 252389 - RNA, 60 nt, hsa
uauuugcuguuaaauucugugaaguuucaguuaucuaaaauaaauauacacaaauaugaa

SEQ ID NO: 252390 - RNA, 60 nt, hsa
uucaagaccuauuggggguuuuguuuuauuuuaucuaauuuuuuuuuuuuuuugguauac

SEQ ID NO: 252391 - RNA, 60 nt, hsa
guguguacauaguuaccuuuaacucagugguuaucuaauagcucuaaacucauuaaaaaa

SEQ ID NO: 252392 - RNA, 60 nt, hsa
ucaauuaugaaagugaaaugcaaaugucuguuaucuaacuacaaauugucagauuucuua

SEQ ID NO: 252393 - RNA, 60 nt, hsa
uuuugaaauuguagugcaaaauggucaguauuaucuaaaugaaugagccaaaaugacuuu

SEQ ID NO: 252394 - RNA, 60 nt, hsa
aauuuccccaagccccauuuuuucuugucuuuaucuaauaaacucaauauuaagauguua

SEQ ID NO: 252395 - RNA, 60 nt, hsa
ccugaacugcuagcccucccuuuugucuguuuaucuaauucucagguaugaggcuuuagu

SEQ ID NO: 252396 - RNA, 60 nt, hsa
ugaagaaucuguacuuuguauguauagaauuuaucuaauaaaucauucauagaucauuuu

SEQ ID NO: 252397 - RNA, 60 nt, hsa
augugguccauuuuauuuucuaauauugguuuaucuaauguuuucugcguggugcugucu

SEQ ID NO: 252398 - RNA, 60 nt, hsa
aggcaugagcccuugaauuucaggcaccuuuuaucuaaugagaguuuuuacagcucauca

SEQ ID NO: 252399 - RNA, 60 nt, hsa
uguagcguaauuaaccucucacaaagaugcuuaucuaaccuccccagcagucauggguuu

SEQ ID NO: 252400 - RNA, 60 nt, hsa
ccacucagcuaccuaauuccucaaugaccuuuaucuaaaaucuccauggaagcaauaaau

SEQ ID NO: 252401 - RNA, 60 nt, hsa
agagcugucauuguccuuuauucaacuaguuuaucuaaauuugugauugcuuaggguuuu

SEQ ID NO: 252402 - RNA, 60 nt, hsa
cacuuauuucagguaauagcuuggggauauuuaucuaaagguacccccaacaaaucuucu

SEQ ID NO: 252403 - RNA, 60 nt, hsa
aguguguccaguagugcaggaaaugaugucuuaucuaaugauuugcuucucuagaggaga

SEQ ID NO: 252404 - RNA, 60 nt, hsa
uuauuugccuuaauauaagcuuuuaagcaguuaucuaacuaguguccacaacccuguaac

SEQ ID NO: 252405 - RNA, 60 nt, hsa
cacguggaauuguacuuguauaugauuaccuuaucuaaaaugaauaagaggugauggacc

SEQ ID NO: 252406 - RNA, 60 nt, hsa
ccauuugugagcugugggacuuuaggcaaguuaucuaaaugcugcuaugcuauagucucc

SEQ ID NO: 252407 - RNA, 60 nt, hsa
auauuucccagcagugacaaucuacacccuuuaucuaaauaaauauugagaugugcuuuu

SEQ ID NO: 252408 - RNA, 60 nt, hsa
aauucauuucuguauuauauucucaacucguuaucuaaagcaucagaacauguguuuuca

SEQ ID NO: 252409 - RNA, 60 nt, hsa
gcaagucucugaaagcagaacuauccaguguuaucuaaaaauuaaucugagcacaucaag

SEQ ID NO: 252410 - RNA, 60 nt, hsa
guguguguguauauauauauauauguacaguuaucuaaguuaauuuaaaguuguuugugc

SEQ ID NO: 252411 - RNA, 60 nt, hsa
aaacugcuccugguauuauauauuugcuaguuaucuaauguuuuaaaagaaaauauaccu

SEQ ID NO: 252412 - RNA, 60 nt, hsa
aauaaaaagcucuauaaggaggaaaggccuuuaucuaauucuuaucuacagacacuuacu

SEQ ID NO: 252413 - RNA, 60 nt, hsa
uuguagccuaaguacguaaacaaauuaauguuaucuaaguuuuucauauuucauggacaa

SEQ ID NO: 252414 - RNA, 60 nt, hsa
agcaugauuuuuauauaacuaguuucaguuuuaucuaauaacuuacuuuuuaaaucaaua

SEQ ID NO: 252415 - RNA, 60 nt, hsa
accccugagagaugcucaccaagcuucuauuuaucuaauuuaaaacuugaaaguaaagcc

SEQ ID NO: 252416 - RNA, 60 nt, hsa
ccucacccaucuaaguugauaucuaaaauuuuaucuaaguugguaucuaaaauuuuucau

SEQ ID NO: 252417 - RNA, 60 nt, hsa
agguggagaaccugacagaggacuaagaaguuaucuaauguaaaagaccucaggcaccac

SEQ ID NO: 252418 - RNA, 60 nt, hsa
gaaacaugccagaaggaaucuucucaucuuuuaucuaacuauauguacagcucuccccuc

SEQ ID NO: 252419 - RNA, 60 nt, hsa
uguguaaucaugagaguauaagaaucuggauuaucuaacauuguuagcccuguguaugua

SEQ ID NO: 252420 - RNA, 60 nt, hsa
aaucacucuguucauuccuccagguauucguuaucuaauagggcaauuaauuccuucagc

SEQ ID NO: 252421 - RNA, 60 nt, hsa
agcaauaaagucuccuugguacugaaaucauuaucuaaaauaaaggaaauguuaucaaaa

SEQ ID NO: 252422 - RNA, 60 nt, hsa
gauuuguaaaccaagaaauuaauccuguguuuaucuaacuucauaauagcaauuauugcc

SEQ ID NO: 252423 - RNA, 60 nt, hsa
ggaguuaaaguuuuauauuuuccugcucaguuaucuaaugucuuagaucaguggucccca

SEQ ID NO: 252424 - RNA, 60 nt, hsa
aacguuaauuuucaguuuuaaauaaucaguuuaucuaagaaaagggaauuuuaacuuuuc

SEQ ID NO: 252425 - RNA, 60 nt, hsa
ugauuuuguauguuagacuuuuuacauuguuuaucuaauauuauuuaugacaguaauuuu

SEQ ID NO: 252426 - RNA, 60 nt, hsa
uguaauucuaggagacacguguugaucuaguuaucuaacauuguuguuauaagaaaauga

SEQ ID NO: 252427 - RNA, 60 nt, hsa
ccaacauuuguuuagcuugcuuggcuuuaauuaucuaaagccaaugaaagacuucuuugu

SEQ ID NO: 252428 - RNA, 60 nt, hsa
aaauagccccaaacugcaauuccauaugacuuaucuaacaucuuggggggaaagaauauu

SEQ ID NO: 252429 - RNA, 60 nt, hsa
ggacgccauuuucuguuauaaucauuuuuguuaucuaauuuggggaaacuauucaucugu

SEQ ID NO: 252430 - RNA, 60 nt, hsa
auggcuagcuauugggcaccaguuuuucuguuaucuaaaauuucacacaacuucauuguu

SEQ ID NO: 252431 - RNA, 60 nt, hsa
uuuaugguuccaagugcaaaacagguguucuuaucuaaaacgucaauuagaaaauuaucu

SEQ ID NO: 252432 - RNA, 60 nt, hsa
uuuauauuuuuaucauuccuuuuucuucauuuaucuaaccccaaagcccugauaugccac

SEQ ID NO: 252433 - RNA, 60 nt, hsa
caugauccgugcuuaaugaucaaguguuacuuaucuaauaauccucuagaaagaacccug

SEQ ID NO: 252434 - RNA, 60 nt, hsa
uuaaucugaaggaugauacuguaacuugauuuaucuaauuagcuuuuaauuaucuacagc

SEQ ID NO: 252435 - RNA, 60 nt, hsa
ugguguguauucaaauaauacuugaccagcuuaucuaaaauguacauaauuuugagguag

SEQ ID NO: 252436 - RNA, 60 nt, hsa
cuaaaccuugugauucugcuuauaagucauuuaucuaaucuauaugauaugcagccgcug

SEQ ID NO: 252437 - RNA, 60 nt, hsa
auaaaaugauuacuuuaaaaauaauaaaauuuaucuaauuuaaaguugauauuauuuuug

SEQ ID NO: 252438 - RNA, 60 nt, hsa
agacucucccagcauguuucuaccaaagcuuuaucuaagcuucucagaacacucuccuaa

SEQ ID NO: 252439 - RNA, 60 nt, hsa
uuugaugaucguagagaaagacuugguaauuuaucuaaguaucuuuaauaaaucuuucag

SEQ ID NO: 252440 - RNA, 60 nt, hsa
gaggauugaaaaauguauaucacucaauuuuuaucuaagaaggauagguuauaaagggag

SEQ ID NO: 252441 - RNA, 60 nt, hsa
aaaucuagcuuuuuuguacagacuuagaaauuaucuaaagauuucaucuuuuuaccucau

SEQ ID NO: 252442 - RNA, 60 nt, hsa
uuuuaguucuaacauugaguuuggacaauuuuaucuaauuguaauucucuagggugccag

SEQ ID NO: 252443 - RNA, 60 nt, hsa
agaagauggucacuuuaaccuuguaaauauuuaucuaaaaugauauuuacaaaacuguaa

SEQ ID NO: 252444 - RNA, 60 nt, hsa
aaaaacaaaggcaaacuuuguacuauccaguuaucuaaggaacaauaaaaacauuaggag

SEQ ID NO: 252445 - RNA, 60 nt, hsa
gcagguguuuaaaaagaaagaaaaguuguuuuaucuaauacuguaaguaguugucauauu

SEQ ID NO: 252446 - RNA, 60 nt, hsa
ucugguaaugucuucaguaaaauauuuucuuuaucuaaauauuaacauucuaagucuacc

SEQ ID NO: 252447 - RNA, 60 nt, hsa
aauucuacucucagaggugcaaaaagauacuuaucuaacuggacacuuuuacuguuuucu

SEQ ID NO: 252448 - RNA, 60 nt, hsa
uucccucaaaauuuucauggacaugcaaucuuaucuaaaagccugcuucagggcugggcg

SEQ ID NO: 252449 - RNA, 60 nt, hsa
ccucuugccuuuuuuuuuuuaaauuuuaaauuaucuaaauuuauuguuuguugugguguc

SEQ ID NO: 252450 - RNA, 60 nt, hsa
guuuccuguggccguuugaacuuugagcauuuaucuaaauuaaauuggcccaggguuggc

SEQ ID NO: 252451 - RNA, 60 nt, hsa
auuugcauggaaauuaaguaggcuguuuauuuaucuaaaggaaucaaguccacucuucug

SEQ ID NO: 252452 - RNA, 60 nt, hsa
uaaaccagcagguugcuaaaagaaggcauuuuaucuaaaguuauuuuaauaggugguaua

SEQ ID NO: 252453 - RNA, 60 nt, hsa
cauuuaaaagguauaaaucaaaauaacaaauuaucuaaaaaaaaucuauccuguacaugu

SEQ ID NO: 252454 - RNA, 60 nt, hsa
guaguuagaugaugugacaaccucuaauauuuaucuaauaaauauguauucagaugaaac

SEQ ID NO: 252455 - RNA, 60 nt, hsa
uuaucacccucauugauauuaucauuggaauuaucuaaggugagccccaguuuccagggc

SEQ ID NO: 252456 - RNA, 60 nt, hsa
guaugccaaauuuuauaugaauuuuucagauuaucuaagcuuccagguuuuauaauuaga

SEQ ID NO: 252457 - RNA, 60 nt, hsa
ugaguuuacaauacugcaaacuguguuauuuuaucuaauccauugcuuaaugaguguguu

SEQ ID NO: 252458 - RNA, 60 nt, hsa
cauccuauuuagagggugguuuuuuuuaauuuaucuaauggcuacgauauagccagauuc

SEQ ID NO: 252459 - RNA, 60 nt, hsa
acugagaacugucacucuaaccucuccagcuuaucuaacaugucauaaacauaauaaauc

SEQ ID NO: 252460 - RNA, 52 nt, hsa
aaacauguuuaauguuguaauauuaucuaacuggucuaaacuucaaauauca

SEQ ID NO: 252461 - RNA, 60 nt, hsa
guugcauugacugucacauaaugcucauacuuaucuaauguugaguuauuaauauguuau

SEQ ID NO: 252462 - RNA, 60 nt, hsa
aacugcaguccuggagcaaucacagaugaguuaucuaagaauacagcuuucugaccuuca

SEQ ID NO: 252463 - RNA, 60 nt, hsa
auaagcuaccuuuuguaagugccauguuuauuaucuaaucauuccaaguuuugcauugau

SEQ ID NO: 252464 - RNA, 60 nt, hsa
aacauuuugguaguauacuucagagugauguuaucuaaguuuaaguaguuuaaguauguu

SEQ ID NO: 252465 - RNA, 60 nt, hsa
guguuaacauucuugguaucuuuuugugccuuaucuaaaacauuucucgaucacugguuu

SEQ ID NO: 252466 - RNA, 60 nt, hsa
aacuuucuccauggccuaugauccaaauuguuaucuaaagaugauucuagguguugcugg

SEQ ID NO: 252467 - RNA, 60 nt, hsa
gacacaugguaauggugaugcugugccuuguuaucuaagaacaugauuguauaauuuguu

SEQ ID NO: 252468 - RNA, 60 nt, hsa
aguggucccucaaggucuucgaauagauguuuaucuaaccugacaguugcaguuuucacc

SEQ ID NO: 252469 - RNA, 60 nt, hsa
aauuuuuuaaaaaauaauacuguguuguguuuaucuaaauacguaaacucaagcuaccaa

SEQ ID NO: 252470 - RNA, 60 nt, hsa
gguaguacagauaaccccucauaaagaugcuuaucuaaccuccccaguguucagguguuu

SEQ ID NO: 252471 - RNA, 60 nt, hsa
ucacuuauuaccuguaugaacaugggcaaauuaucuaaucucucugaucuauuuuuccuc

SEQ ID NO: 252472 - RNA, 60 nt, hsa
ggaugggaguggguaaagaguuugggaagguuaucuaacugaaucacuacugaguugaau

SEQ ID NO: 252473 - RNA, 60 nt, hsa
uuuuauaauuugaugucucaaauguagagauuaucuaaaaaucguaacuugaauaccuug

SEQ ID NO: 252474 - RNA, 60 nt, hsa
guaagacaaggucacugugcugauugauuuuuaucuaaaaaaauucauuuuuauaucgaa

SEQ ID NO: 252475 - RNA, 60 nt, hsa
ugcuuggaccucgugcuuuaagugccuacauuaucuaacugugcucaagagguucucgac

SEQ ID NO: 252476 - RNA, 60 nt, hsa
uaagcagcccaacacaaaacgaguguggauuuaucuaaauggaggcagaccugaagaugg

SEQ ID NO: 252477 - RNA, 60 nt, hsa
auauaaaauuuuuguaauggauaaucuuauuuaucuaaacuaaagcuuccuguuuauaca

SEQ ID NO: 252478 - RNA, 60 nt, hsa
aauggauccaggguauaccucuaauaaccuuuaucuaaauagaauacauuuaaccuguca

SEQ ID NO: 252479 - RNA, 60 nt, hsa
ugugaacaacgugaugacaacaagcaacauuuaucuaaugaacuacagcuaucuuaauuu

SEQ ID NO: 252480 - RNA, 60 nt, hsa
augauaacugggaaauguuuuucuuccucuuuaucuaacuauauuacacuuauccaucag

SEQ ID NO: 252481 - RNA, 60 nt, hsa
gauuagaugacguauuuauugguggccuucuuaucuaagcacaugaguaguuggcucuga

SEQ ID NO: 252482 - RNA, 60 nt, hsa
caucaaucuauaauauauuagacugaugcuuuaucuaaaaugcuuugaguuuguauaaua

SEQ ID NO: 252483 - RNA, 60 nt, hsa
auguacauaugcccccauccauguuaauuauuaucuaauuccauuaggguucacgucuuu

SEQ ID NO: 252484 - RNA, 60 nt, hsa
guaaccuauuuuuguucugguuugguucgguuaucuaauggaaagguaacuggcaaugca

SEQ ID NO: 252485 - RNA, 60 nt, hsa
agcccuacaaggauauguuuuccugugaaauuaucuaagagguagguuuagacaucugcu

SEQ ID NO: 252486 - RNA, 60 nt, hsa
ccuuauguguaucugcaacacccugaaaaauuaucuaauaaaaaggcacaaagaaaaagc

SEQ ID NO: 252487 - RNA, 60 nt, hsa
uaguugaauuucuuuaaaaaguuuucuauuuuaucuaaaaucuuuccauuauaucuaaau

SEQ ID NO: 252488 - RNA, 60 nt, hsa
ugcuuuaaaaagucccacugucagauuauauuaucuaacaauugaauauuguaaauauac

SEQ ID NO: 252489 - RNA, 60 nt, hsa
uuuuuaaauauuuguugaguacuuacguguuuaucuaacaguucacuuccauuuuucuag

SEQ ID NO: 252490 - RNA, 60 nt, hsa
uuuuuucaucuguuguacauaguuguauuuuuaucuaaugccauuuuagaauuuucuaag

SEQ ID NO: 252491 - RNA, 60 nt, hsa
gcuucuugcuuuaaguccucacccuuuacauuaucuaauucuucaguuuugaugcugaua

SEQ ID NO: 252492 - RNA, 60 nt, hsa
agggguggguaggcacccuccuuccuguuuuuaucuaauaaaaugcuaaccugcccugag

SEQ ID NO: 252493 - RNA, 60 nt, hsa
gccuuugacccugcuuauuugucucacugguuaucuaaugaggaacaaacacuaaccuaa

SEQ ID NO: 252494 - RNA, 60 nt, hsa
uuuaaagaauggccaauuagcugagaagaauuaucuaaucaauuagugaugucugccaug

SEQ ID NO: 252495 - RNA, 60 nt, hsa
cacucuaggaaucuuaggcagaaagggauuuuaucuaaaucacuggaaaggcuggaggag

SEQ ID NO: 252496 - RNA, 60 nt, hsa
ucugggagaggauuuuuuucugagcgauuauuaucuaaaguguguuguugcuuuaggcuc

SEQ ID NO: 252497 - RNA, 60 nt, hsa
aaaacuaccuguuguaaccuaaaaccaguuuuaucuaacagcuauuaaaacaaccuacug

SEQ ID NO: 252498 - RNA, 60 nt, hsa
aguuucuguuugaagugaggauuuucugaauuaucuaauaucaucuagguuuucuuuaaa

SEQ ID NO: 252499 - RNA, 60 nt, hsa
gcugugaguuaaaauuguauccuuugugguuuaucuaaggaaagucaaaucuugacagaa

SEQ ID NO: 252500 - RNA, 60 nt, hsa
uggggaaaaagggcuauugcuaagugagcuuuaucuaauauccuccuaagaguuuuacua

SEQ ID NO: 252501 - RNA, 60 nt, hsa
uuuuauuuaauaguaguauuuccuucccuuuuaucuaauuuuuuauaugcugcuaaauau

SEQ ID NO: 252502 - RNA, 60 nt, hsa
auagugugaagcacucauuucuaaaccuuauuaucuaagguaauauaugcaccuuucaga

SEQ ID NO: 252503 - RNA, 60 nt, hsa
ucuuacccauucucuauuuauucccuuauuuuaucuaacaccauuucaaaacaaaacugu

SEQ ID NO: 252504 - RNA, 60 nt, hsa
gacuuuauauuaugcauaaauauuuauauuuuaucuaaauaacugcgcuguaacaaacuu

SEQ ID NO: 252505 - RNA, 60 nt, hsa
aagaugauaccugaagcugucaccucuugauuaucuaaacuaagcgcucauucuauuuua

SEQ ID NO: 252506 - RNA, 60 nt, hsa
aacauauagaaauguuugaaugcaugggucuuaucuaacuuaucucuucuggacccaugu

SEQ ID NO: 252507 - RNA, 60 nt, hsa
aaaguacuguucuccuucaguggcauguaguuaucuaaucaagacaccucauucaaacaa

SEQ ID NO: 252508 - RNA, 60 nt, hsa
gauguuaagguacaacuguguuuuucucgauuaucuaaaaaccauaguacuuaaauugaa

SEQ ID NO: 252509 - RNA, 60 nt, hsa
uugauuggugaaaugcaggguauguggaaguuaucuaauuaaccucaguuguauaugaau

SEQ ID NO: 252510 - RNA, 60 nt, hsa
aaaauguauacauuucggaacaacuccauuuuaucuaaaaaaguucuugugauugccagu

SEQ ID NO: 252511 - RNA, 60 nt, hsa
auggcagugacaaagugcuagcauuuauuguuaucuaauaaagaccuuggagcauaugug

SEQ ID NO: 252512 - RNA, 60 nt, hsa
gcauguaauacacagugagacacaguaauuuuaucuaaauuacagugcaguuuaguuaau

SEQ ID NO: 252513 - RNA, 60 nt, hsa
uuccccagcaauuaagauuucgagcagaauuuaucuaaauguguuucaaggaaacacaau

SEQ ID NO: 252514 - RNA, 60 nt, hsa
uccuucugauuuaaguacagcuggaaaguauuaucuaauuaaguucaugauagugcuuuu

SEQ ID NO: 252515 - RNA, 60 nt, hsa
gaagaucccucugccaaaaauauagcucacuuaucuaaaggugagagcugcauagaucca

SEQ ID NO: 252516 - RNA, 60 nt, hsa
aaaaugcuggcuauagaugucuuuucccauuuaucuaaauauggacugcucaggaaacga

SEQ ID NO: 252517 - RNA, 60 nt, hsa
gagggaggaaaacucaacuguuucucuuuguuaucuaaauguuucagaauucaaucguga

SEQ ID NO: 252518 - RNA, 60 nt, hsa
uacaggcuugucuuucuaagugacauauucuuaucuaauucucagaucagguuuugaaag

SEQ ID NO: 252519 - RNA, 60 nt, hsa
uucagugaacuuucaaaaccauaaacaccauuaucuaacuucaugaaccagaaugaauca

SEQ ID NO: 252520 - RNA, 60 nt, hsa
gggaauguuguuuucugacuaggcugaucauuaucuaaagaaucuaauucuguugauuuu

SEQ ID NO: 252521 - RNA, 60 nt, hsa
ggaguaagguaagaaaaauggaacaaauuuuuaucuaaaaauuccugucaccacaagagg

SEQ ID NO: 252522 - RNA, 60 nt, hsa
ugcuagaacucuaccuguguuucauuaguauuaucuaauguacuuuuacauauuuguaaa

SEQ ID NO: 252523 - RNA, 60 nt, hsa
ucuaaaaagucaaaacguuaacaauaguuuuuaucuaauaaaagcacugcaagaaaauag

SEQ ID NO: 252524 - RNA, 60 nt, hsa
auaauacauuccgaggggcucaguucugccuuaucuaaaucaccagagaccaaacaagga

SEQ ID NO: 252525 - RNA, 60 nt, hsa
aauuaaacauucauaaucaugauuuaaguguuaucuaaauuuaccuuauuaguguuacca

SEQ ID NO: 252526 - RNA, 60 nt, hsa
auugauuauauuuuaaagauaaccaggauauuaucuaauggugaauuguagaauuuugau

SEQ ID NO: 252527 - RNA, 60 nt, hsa
uacaagugugguaaaugccauguuuguacuuuaucuaacaucuucucuuucaguagucuu

SEQ ID NO: 252528 - RNA, 60 nt, hsa
acuaauguguguggaaagagguguuccucauuaucuaauauuucaauguguuaagaguuu

SEQ ID NO: 252529 - RNA, 60 nt, hsa
cuccugacuguaacauauucuguaugaacuuuaucuaaagaaaaauaaaucuguucuggg

SEQ ID NO: 252530 - RNA, 60 nt, hsa
gaggcauagguacuguuguaccaaggucacuuaucuaacaaaauaacccuucauguauuu

SEQ ID NO: 252531 - RNA, 60 nt, hsa
aaauuuauuugacaagucugcagacaauccuuaucuaaccagcuauuuucuuaauugcua

SEQ ID NO: 252532 - RNA, 60 nt, hsa
gggaacauugguuugugaaggaaaaacagauuaucuaaagccaucucuauguuucuguuc

SEQ ID NO: 252533 - RNA, 60 nt, hsa
cugaacuaaggcuaccaaauacauucccuguuaucuaaauuauaacauacaauuauuuua

SEQ ID NO: 252534 - RNA, 60 nt, hsa
uuaaaaguuaauugauauuauacuuugguuuuaucuaaaaaguaaauguauuugccuuug

SEQ ID NO: 252535 - RNA, 60 nt, hsa
accacccacaaagaaacaaagcaaauuucauuaucuaaugaguugcuggaaaaucauauu

SEQ ID NO: 252536 - RNA, 60 nt, hsa
uuuguaaugauugauuaaaugcaagauaguuuaucuaacuucgugcggaaucagcuucua

SEQ ID NO: 252537 - RNA, 60 nt, hsa
uuuauauguucaccaaugggaggucaauauuuaucuaauuuaaaagguaugcuaaccacu

SEQ ID NO: 252538 - RNA, 60 nt, hsa
agcaaggcaaaaauguaugccacaucucaguuaucuaaacuagauuagauccaagccaag

SEQ ID NO: 252539 - RNA, 60 nt, hsa
uuaacaauucacaaggcacuuucacacccauuaucuaauuuaauccucauaaugacuaug

SEQ ID NO: 252540 - RNA, 60 nt, hsa
guuguccaagagcacacugaaaguugaauguuaucuaaugcauuccucuaccuuucagaa

SEQ ID NO: 252541 - RNA, 60 nt, hsa
guagaauuugaauaugacccaagcugaguauuaucuaaacagguugguggaaugaaugcg

SEQ ID NO: 252542 - RNA, 60 nt, hsa
guccagcuuugcuggaaaagacguuuuuaauuaucuaauuuauuuuucaaaaauuuuuug

SEQ ID NO: 252543 - RNA, 60 nt, hsa
guuaccauuuugggguacccacugcucugguuaucuaauauguaacaagccaccccaaau

SEQ ID NO: 252544 - RNA, 60 nt, hsa
aaacuuaugaccucuuccuuuaggagggaguuaucuaaaagaaaugucuauuaaggugau

SEQ ID NO: 252545 - RNA, 60 nt, hsa
uaaaaaacacuauuuuacuuaaacuguuucuuaucuaaauucuugcagagugucaauguu

SEQ ID NO: 252546 - RNA, 60 nt, hsa
agucaauauucauuucaguagaagauaaucuuaucuaauuuuugagaccagaauaagccu

SEQ ID NO: 252547 - RNA, 60 nt, hsa
cuuccugcgguuuauucuauguuuuauauauuaucuaaauauauguauaugcugugucau

SEQ ID NO: 252548 - RNA, 60 nt, hsa
uaguacaguuucauauuugaguuugcagaauuaucuaauagucuuuuuuuggcuaauauu

SEQ ID NO: 252549 - RNA, 60 nt, hsa
gguauucagggaaccugucuuaaauugugcuuaucuaaaucuuggaacuuugagcuaggg

SEQ ID NO: 252550 - RNA, 60 nt, hsa
cuacuuuuagaguugaaacagaguaauaacuuaucuaacccucuuuuccuacaaaggaga

SEQ ID NO: 252551 - RNA, 60 nt, hsa
caccacucuuauacaggaaaacuguccaaauuaucuaaagauccuccugagaagcuuaaa

SEQ ID NO: 252552 - RNA, 60 nt, hsa
caucaggugcagugucaguuucaaaucaaauuaucuaagaaaacaagaaaacaaaggcag

SEQ ID NO: 252553 - RNA, 60 nt, hsa
aggucaugacaaggaaaaaaaacaccacauuuaucuaagaagugauuuuggcugcaggac

SEQ ID NO: 252554 - RNA, 60 nt, hsa
uauuagcuuuguccuaccaacuucuggaauuuaucuaauuauuguuuuucaaaguuucuu

SEQ ID NO: 252555 - RNA, 60 nt, hsa
cucagguguacagguuauucuggguuaauuuuaucuaaugaagcccauuccuuuuuguac

SEQ ID NO: 252556 - RNA, 60 nt, hsa
gcuuaaacccauauuguaaaacagguagaauuaucuaauuuauaaaaagguguuuugaug

SEQ ID NO: 252557 - RNA, 51 nt, hsa
aaaucauaagugaagaguaauuuaucuaacugcugaaaggugaccaaagaa

SEQ ID NO: 252558 - RNA, 60 nt, hsa
auaauugcaaauagguaggaguggccuaaauuaucuaauguaauaaagucagacaaaaug

SEQ ID NO: 252559 - RNA, 60 nt, hsa
uugguauuuaaucccaaaguguuguucugauuaucuaaaauuugacaugguagaccuugc

SEQ ID NO: 252560 - RNA, 60 nt, hsa
auauggagcuauuccauuuuaaacaaauauuuaucuaaauaaaucuuaaauaaauuuuca

SEQ ID NO: 252561 - RNA, 60 nt, hsa
gagaaaugagugaaugugggugaucugcuuuuaucuaaaugcaaauaaggauguguucuc

SEQ ID NO: 252562 - RNA, 60 nt, hsa
ccaccauucuguagccacccauccuuugccuuaucuaacaaacauuuuuccaggaaggug

SEQ ID NO: 252563 - RNA, 60 nt, hsa
aaaugcuacaauaguuuuuuaucuauaaaauuaucuaaagaaucauugucuuucagagac

SEQ ID NO: 252564 - RNA, 60 nt, hsa
gaaauuuccugcuguauccagaagccaguuuuaucuaacggcuacugaaacacccacugu

SEQ ID NO: 252565 - RNA, 60 nt, hsa
ggcaaaaauaauacauggaauuguaugauuuuaucuaaaguaaaauucuagacugcuuuc

SEQ ID NO: 252566 - RNA, 60 nt, hsa
uugugaauucucugaauacugucaacacucuuaucuaaguuugccuuuaugaugcagugg

SEQ ID NO: 252567 - RNA, 60 nt, hsa
cuccuucaggggagccucaguuuugcccauuuaucuaauugaaucaguuuuuuacccaau

SEQ ID NO: 252568 - RNA, 60 nt, hsa
caaucccccgauuuuguaggauaaucucccuuaucuaaagucaacugauuauggacuuua

SEQ ID NO: 252569 - RNA, 60 nt, hsa
cugaauuggagguuuauuuuuuaauauauauuaucuaagaagagaucugugugugugaug

SEQ ID NO: 252570 - RNA, 60 nt, hsa
uucuuugggacaaaacagaaguccauggaguuaucuaagcucuuguaagugaguuaauuu

SEQ ID NO: 252571 - RNA, 60 nt, hsa
guguucuaaagccuuucauuuuuacaguucuuaucuaagacaugaaagaacacguacugg

SEQ ID NO: 252572 - RNA, 60 nt, hsa
uuugaauagcgucuuuuuauuuaacaauccuuaucuaacaucaccaaauucacauugcag

SEQ ID NO: 252573 - RNA, 60 nt, hsa
ugucaguuuauagacugaacaauacuguuuuuaucuaaugugacccugcaauuuacauga

SEQ ID NO: 252574 - RNA, 60 nt, hsa
gaaaccaucaucagagucacaauaaugaauuuaucuaaucuaucaccuuuguauucaccu

SEQ ID NO: 252575 - RNA, 60 nt, hsa
gguaucuauguugguacgacuccuggccuuuuaucuaaaggacuuuggcuuuuguaaauc

SEQ ID NO: 252576 - RNA, 60 nt, hsa
cuauagaaaucuuggucagggcuggauagauuaucuaagucaagcuugagaaugaaugua

SEQ ID NO: 252577 - RNA, 60 nt, hsa
ugugugaaaucuaguuuuuaucaccauacuuuaucuaauuauuauucucuguauauaacu

SEQ ID NO: 252578 - RNA, 60 nt, hsa
uaaaaugauaauuaaaaugcuguaaccaacuuaucuaauaaaauuggcaaccagccacua

SEQ ID NO: 252579 - RNA, 60 nt, hsa
agaguaacuguaauuggauguuuauuguuuuuaucuaaaguaagguguauguguuugaga

SEQ ID NO: 252580 - RNA, 60 nt, hsa
ugauuagacacuucagugucagggcacagauuaucuaaaauuagccagcucuuccuguca

SEQ ID NO: 252581 - RNA, 60 nt, hsa
caggguuaacucuuuauuuuuguaguuuuauuaucuaaggcacagccauucuguucucac

SEQ ID NO: 252582 - RNA, 60 nt, hsa
cucguucaacagugugagcauuugucucuguuaucuaaugauguucucugacccagcaga

SEQ ID NO: 252583 - RNA, 60 nt, hsa
gcuugguuauaauuuauaacuuacuuauuuuuaucuaauaauuguagauucaguguauuu

SEQ ID NO: 252584 - RNA, 60 nt, hsa
auagaauuaauuuaaagccuuaaacaaaauuuaucuaaagaaauaacuucuauuacuguc

SEQ ID NO: 252585 - RNA, 60 nt, hsa
uuuacuuuuuauucaucuuuguguuuuuauuuaucuaaaauggguauugauuuuuaggac

SEQ ID NO: 252586 - RNA, 60 nt, hsa
caugucaaucgauaaacccuacuuuccaaauuaucuaaaagauuaccauuuggggcccuu

SEQ ID NO: 252587 - RNA, 60 nt, hsa
agauuaccauuuggggcccuuguuuucaaguuaucuaacugaaauauuauuaauuuuuuu

SEQ ID NO: 252588 - RNA, 60 nt, hsa
cauauaccuauauauguuuguaucuaugacuuaucuaaucugccuaucaaucuaucuagu

SEQ ID NO: 252589 - RNA, 60 nt, hsa
guuucuaaaacaacuugaaguauaguuuuguuaucuaagcaauuuuuguuuuaaguaagu

SEQ ID NO: 252590 - RNA, 60 nt, hsa
uagccuggaaaacuuuuguguauucucagcuuaucuaaaccuaaugaaauuccuuuuaua

SEQ ID NO: 252591 - RNA, 60 nt, hsa
uuaaauuaggguugguauuucauuuuuuucuuaucuaaaucuuaguuuccuggaauaaua

SEQ ID NO: 252592 - RNA, 60 nt, hsa
ccuaagaguacaaagccaagagagugugguuuaucuaaauguccugaaauccacuuguca

SEQ ID NO: 252593 - RNA, 60 nt, hsa
aagacaagcugaaacaacacaaaacuguuuuuaucuaagauauuugacuuaaaaauaucg

SEQ ID NO: 252594 - RNA, 60 nt, hsa
uauucuucaaaauauguaagcuguugucaauuaucuaaagcauguuaguuuggugcuaca

SEQ ID NO: 252595 - RNA, 60 nt, hsa
ggagacuuguuggagaggcgggacucugaguuaucuaaugucagacaucuaguggggcag

SEQ ID NO: 252596 - RNA, 60 nt, hsa
gcuucugccugaaaugugcuuagagcucaguuaucuaaggauucucugacacuagugcau

SEQ ID NO: 252597 - RNA, 64 nt, hsa; identical to SEQ ID NO: 190131

SEQ ID NO: 252598 - RNA, 64 nt, hsa; identical to SEQ ID NO: 190132

SEQ ID NO: 252599 - RNA, 64 nt, hsa; identical to SEQ ID NO: 190133

SEQ ID NO: 252600 - RNA, 64 nt, hsa; identical to SEQ ID NO: 190134

SEQ ID NO: 252601 - RNA, 64 nt, hsa; identical to SEQ ID NO: 190135

SEQ ID NO: 252602 - RNA, 64 nt, hsa; identical to SEQ ID NO: 190136

SEQ ID NO: 252603 - RNA, 64 nt, hsa; identical to SEQ ID NO: 190137

SEQ ID NO: 252604 - RNA, 64 nt, hsa; identical to SEQ ID NO: 190138

SEQ ID NO: 252605 - RNA, 64 nt, hsa; identical to SEQ ID NO: 190139

SEQ ID NO: 252606 - RNA, 64 nt, hsa; identical to SEQ ID NO: 190140

SEQ ID NO: 252607 - RNA, 64 nt, hsa; identical to SEQ ID NO: 190141

SEQ ID NO: 252608 - RNA, 64 nt, hsa; identical to SEQ ID NO: 190142

SEQ ID NO: 252609 - RNA, 64 nt, hsa; identical to SEQ ID NO: 190143

SEQ ID NO: 252610 - RNA, 64 nt, hsa; identical to SEQ ID NO: 190144

SEQ ID NO: 252611 - RNA, 64 nt, hsa; identical to SEQ ID NO: 190145

SEQ ID NO: 252612 - RNA, 64 nt, hsa; identical to SEQ ID NO: 190146

SEQ ID NO: 252613 - RNA, 64 nt, hsa; identical to SEQ ID NO: 190147

SEQ ID NO: 252614 - RNA, 64 nt, hsa; identical to SEQ ID NO: 190148

SEQ ID NO: 252615 - RNA, 64 nt, hsa; identical to SEQ ID NO: 190149

SEQ ID NO: 252616 - RNA, 64 nt, hsa; identical to SEQ ID NO: 190150

SEQ ID NO: 252617 - RNA, 64 nt, hsa; identical to SEQ ID NO: 190151

SEQ ID NO: 252618 - RNA, 64 nt, hsa; identical to SEQ ID NO: 190152

SEQ ID NO: 252619 - RNA, 64 nt, hsa; identical to SEQ ID NO: 190153

SEQ ID NO: 252620 - RNA, 64 nt, hsa; identical to SEQ ID NO: 190154

SEQ ID NO: 252621 - RNA, 64 nt, hsa; identical to SEQ ID NO: 190155

SEQ ID NO: 252622 - RNA, 64 nt, hsa; identical to SEQ ID NO: 190156

SEQ ID NO: 252623 - RNA, 64 nt, hsa; identical to SEQ ID NO: 190157

SEQ ID NO: 252624 - RNA, 64 nt, hsa; identical to SEQ ID NO: 190158

SEQ ID NO: 252625 - RNA, 64 nt, hsa; identical to SEQ ID NO: 190159

SEQ ID NO: 252626 - RNA, 64 nt, hsa; identical to SEQ ID NO: 190160

SEQ ID NO: 252627 - RNA, 64 nt, hsa; identical to SEQ ID NO: 190161

SEQ ID NO: 252628 - RNA, 64 nt, hsa; identical to SEQ ID NO: 190162

SEQ ID NO: 252629 - RNA, 64 nt, hsa; identical to SEQ ID NO: 190163

SEQ ID NO: 252630 - RNA, 64 nt, hsa; identical to SEQ ID NO: 190164

SEQ ID NO: 252631 - RNA, 64 nt, hsa; identical to SEQ ID NO: 190165

SEQ ID NO: 252632 - RNA, 64 nt, hsa; identical to SEQ ID NO: 190166

SEQ ID NO: 252633 - RNA, 64 nt, hsa; identical to SEQ ID NO: 190167

SEQ ID NO: 252634 - RNA, 64 nt, hsa; identical to SEQ ID NO: 190168

SEQ ID NO: 252635 - RNA, 64 nt, hsa; identical to SEQ ID NO: 190169

SEQ ID NO: 252636 - RNA, 64 nt, hsa; identical to SEQ ID NO: 190170

SEQ ID NO: 252637 - RNA, 64 nt, hsa; identical to SEQ ID NO: 190171

SEQ ID NO: 252638 - RNA, 64 nt, hsa; identical to SEQ ID NO: 190172

SEQ ID NO: 252639 - RNA, 64 nt, hsa; identical to SEQ ID NO: 190173

SEQ ID NO: 252640 - RNA, 64 nt, hsa; identical to SEQ ID NO: 190174

SEQ ID NO: 252641 - RNA, 64 nt, hsa; identical to SEQ ID NO: 190175

SEQ ID NO: 252642 - RNA, 64 nt, hsa; identical to SEQ ID NO: 190176

SEQ ID NO: 252643 - RNA, 64 nt, hsa; identical to SEQ ID NO: 190177

SEQ ID NO: 252644 - RNA, 64 nt, hsa; identical to SEQ ID NO: 190178

SEQ ID NO: 252645 - RNA, 64 nt, hsa; identical to SEQ ID NO: 190179

SEQ ID NO: 252646 - RNA, 64 nt, hsa; identical to SEQ ID NO: 190180

SEQ ID NO: 252647 - RNA, 64 nt, hsa; identical to SEQ ID NO: 190181

SEQ ID NO: 252648 - RNA, 64 nt, hsa; identical to SEQ ID NO: 190182

SEQ ID NO: 252649 - RNA, 64 nt, hsa; identical to SEQ ID NO: 190183

SEQ ID NO: 252650 - RNA, 64 nt, hsa; identical to SEQ ID NO: 190184

SEQ ID NO: 252651 - RNA, 64 nt, hsa; identical to SEQ ID NO: 190185

SEQ ID NO: 252652 - RNA, 64 nt, hsa; identical to SEQ ID NO: 190186

SEQ ID NO: 252653 - RNA, 64 nt, hsa; identical to SEQ ID NO: 190187

SEQ ID NO: 252654 - RNA, 64 nt, hsa; identical to SEQ ID NO: 190188

SEQ ID NO: 252655 - RNA, 64 nt, hsa; identical to SEQ ID NO: 190189

SEQ ID NO: 252656 - RNA, 64 nt, hsa; identical to SEQ ID NO: 190190

SEQ ID NO: 252657 - RNA, 64 nt, hsa; identical to SEQ ID NO: 190191

SEQ ID NO: 252658 - RNA, 64 nt, hsa; identical to SEQ ID NO: 190192

SEQ ID NO: 252659 - RNA, 64 nt, hsa; identical to SEQ ID NO: 190193

SEQ ID NO: 252660 - RNA, 64 nt, hsa; identical to SEQ ID NO: 190194

SEQ ID NO: 252661 - RNA, 64 nt, hsa; identical to SEQ ID NO: 190195

SEQ ID NO: 252662 - RNA, 64 nt, hsa; identical to SEQ ID NO: 190196

SEQ ID NO: 252663 - RNA, 64 nt, hsa; identical to SEQ ID NO: 190197

SEQ ID NO: 252664 - RNA, 64 nt, hsa; identical to SEQ ID NO: 190198

SEQ ID NO: 252665 - RNA, 64 nt, hsa; identical to SEQ ID NO: 190199

SEQ ID NO: 252666 - RNA, 64 nt, hsa; identical to SEQ ID NO: 190200

SEQ ID NO: 252667 - RNA, 64 nt, hsa; identical to SEQ ID NO: 190201

SEQ ID NO: 252668 - RNA, 64 nt, hsa; identical to SEQ ID NO: 190202

SEQ ID NO: 252669 - RNA, 64 nt, hsa; identical to SEQ ID NO: 190203

SEQ ID NO: 252670 - RNA, 64 nt, hsa; identical to SEQ ID NO: 190204

SEQ ID NO: 252671 - RNA, 64 nt, hsa; identical to SEQ ID NO: 190205

SEQ ID NO: 252672 - RNA, 64 nt, hsa; identical to SEQ ID NO: 190206

SEQ ID NO: 252673 - RNA, 64 nt, hsa; identical to SEQ ID NO: 190207

SEQ ID NO: 252674 - RNA, 64 nt, hsa; identical to SEQ ID NO: 190208

SEQ ID NO: 252675 - RNA, 64 nt, hsa; identical to SEQ ID NO: 190209

SEQ ID NO: 252676 - RNA, 64 nt, hsa; identical to SEQ ID NO: 190210

SEQ ID NO: 252677 - RNA, 64 nt, hsa; identical to SEQ ID NO: 190211

SEQ ID NO: 252678 - RNA, 64 nt, hsa; identical to SEQ ID NO: 190212

SEQ ID NO: 252679 - RNA, 64 nt, hsa; identical to SEQ ID NO: 190213

SEQ ID NO: 252680 - RNA, 64 nt, hsa; identical to SEQ ID NO: 190214

SEQ ID NO: 252681 - RNA, 64 nt, hsa; identical to SEQ ID NO: 190215

SEQ ID NO: 252682 - RNA, 64 nt, hsa; identical to SEQ ID NO: 190216

SEQ ID NO: 252683 - RNA, 64 nt, hsa; identical to SEQ ID NO: 190217

SEQ ID NO: 252684 - RNA, 64 nt, hsa; identical to SEQ ID NO: 190218

SEQ ID NO: 252685 - RNA, 64 nt, hsa; identical to SEQ ID NO: 190219

SEQ ID NO: 252686 - RNA, 64 nt, hsa; identical to SEQ ID NO: 190220

SEQ ID NO: 252687 - RNA, 64 nt, hsa; identical to SEQ ID NO: 190221

SEQ ID NO: 252688 - RNA, 64 nt, hsa; identical to SEQ ID NO: 190222

SEQ ID NO: 252689 - RNA, 64 nt, hsa; identical to SEQ ID NO: 190223

SEQ ID NO: 252690 - RNA, 64 nt, hsa; identical to SEQ ID NO: 190224

SEQ ID NO: 252691 - RNA, 64 nt, hsa; identical to SEQ ID NO: 190225

SEQ ID NO: 252692 - RNA, 64 nt, hsa; identical to SEQ ID NO: 190226

SEQ ID NO: 252693 - RNA, 64 nt, hsa; identical to SEQ ID NO: 190227

SEQ ID NO: 252694 - RNA, 64 nt, hsa; identical to SEQ ID NO: 190228

SEQ ID NO: 252695 - RNA, 64 nt, hsa; identical to SEQ ID NO: 190229

SEQ ID NO: 252696 - RNA, 64 nt, hsa; identical to SEQ ID NO: 190230

SEQ ID NO: 252697 - RNA, 64 nt, hsa; identical to SEQ ID NO: 190231

SEQ ID NO: 252698 - RNA, 64 nt, hsa; identical to SEQ ID NO: 190232

SEQ ID NO: 252699 - RNA, 64 nt, hsa; identical to SEQ ID NO: 190233

SEQ ID NO: 252700 - RNA, 54 nt, hsa; identical to SEQ ID NO: 190234

SEQ ID NO: 252701 - RNA, 64 nt, hsa; identical to SEQ ID NO: 190235

SEQ ID NO: 252702 - RNA, 64 nt, hsa; identical to SEQ ID NO: 190236

SEQ ID NO: 252703 - RNA, 64 nt, hsa; identical to SEQ ID NO: 190237

SEQ ID NO: 252704 - RNA, 64 nt, hsa; identical to SEQ ID NO: 190238

SEQ ID NO: 252705 - RNA, 64 nt, hsa; identical to SEQ ID NO: 190239

SEQ ID NO: 252706 - RNA, 64 nt, hsa; identical to SEQ ID NO: 190240

SEQ ID NO: 252707 - RNA, 64 nt, hsa; identical to SEQ ID NO: 190241

SEQ ID NO: 252708 - RNA, 64 nt, hsa; identical to SEQ ID NO: 190242

SEQ ID NO: 252709 - RNA, 64 nt, hsa; identical to SEQ ID NO: 190243

SEQ ID NO: 252710 - RNA, 64 nt, hsa; identical to SEQ ID NO: 190244

SEQ ID NO: 252711 - RNA, 64 nt, hsa; identical to SEQ ID NO: 190245

SEQ ID NO: 252712 - RNA, 64 nt, hsa; identical to SEQ ID NO: 190246

SEQ ID NO: 252713 - RNA, 64 nt, hsa; identical to SEQ ID NO: 190247

SEQ ID NO: 252714 - RNA, 64 nt, hsa; identical to SEQ ID NO: 190248

SEQ ID NO: 252715 - RNA, 64 nt, hsa; identical to SEQ ID NO: 190249

SEQ ID NO: 252716 - RNA, 64 nt, hsa; identical to SEQ ID NO: 190250

SEQ ID NO: 252717 - RNA, 64 nt, hsa; identical to SEQ ID NO: 190251

SEQ ID NO: 252718 - RNA, 64 nt, hsa; identical to SEQ ID NO: 190252

SEQ ID NO: 252719 - RNA, 64 nt, hsa; identical to SEQ ID NO: 190253

SEQ ID NO: 252720 - RNA, 64 nt, hsa; identical to SEQ ID NO: 190254

SEQ ID NO: 252721 - RNA, 64 nt, hsa; identical to SEQ ID NO: 190255

SEQ ID NO: 252722 - RNA, 64 nt, hsa; identical to SEQ ID NO: 190256

SEQ ID NO: 252723 - RNA, 64 nt, hsa; identical to SEQ ID NO: 190257

SEQ ID NO: 252724 - RNA, 64 nt, hsa; identical to SEQ ID NO: 190258

SEQ ID NO: 252725 - RNA, 64 nt, hsa; identical to SEQ ID NO: 190259

SEQ ID NO: 252726 - RNA, 64 nt, hsa; identical to SEQ ID NO: 190260

SEQ ID NO: 252727 - RNA, 64 nt, hsa; identical to SEQ ID NO: 190261

SEQ ID NO: 252728 - RNA, 64 nt, hsa; identical to SEQ ID NO: 190262

SEQ ID NO: 252729 - RNA, 64 nt, hsa; identical to SEQ ID NO: 190263

SEQ ID NO: 252730 - RNA, 64 nt, hsa; identical to SEQ ID NO: 190264

SEQ ID NO: 252731 - RNA, 64 nt, hsa; identical to SEQ ID NO: 190265

SEQ ID NO: 252732 - RNA, 64 nt, hsa; identical to SEQ ID NO: 190266

SEQ ID NO: 252733 - RNA, 64 nt, hsa; identical to SEQ ID NO: 190267

SEQ ID NO: 252734 - RNA, 64 nt, hsa; identical to SEQ ID NO: 190268

SEQ ID NO: 252735 - RNA, 64 nt, hsa; identical to SEQ ID NO: 190269

SEQ ID NO: 252736 - RNA, 64 nt, hsa; identical to SEQ ID NO: 190270

SEQ ID NO: 252737 - RNA, 61 nt, hsa; identical to SEQ ID NO: 190271

SEQ ID NO: 252738 - RNA, 64 nt, hsa; identical to SEQ ID NO: 190272

SEQ ID NO: 252739 - RNA, 64 nt, hsa; identical to SEQ ID NO: 190273

SEQ ID NO: 252740 - RNA, 63 nt, hsa; identical to SEQ ID NO: 190274

SEQ ID NO: 252741 - RNA, 64 nt, hsa; identical to SEQ ID NO: 190275

SEQ ID NO: 252742 - RNA, 64 nt, hsa; identical to SEQ ID NO: 190276

SEQ ID NO: 252743 - RNA, 64 nt, hsa; identical to SEQ ID NO: 190277

SEQ ID NO: 252744 - RNA, 64 nt, hsa; identical to SEQ ID NO: 190278

SEQ ID NO: 252745 - RNA, 64 nt, hsa; identical to SEQ ID NO: 190279

SEQ ID NO: 252746 - RNA, 64 nt, hsa; identical to SEQ ID NO: 190280

SEQ ID NO: 252747 - RNA, 64 nt, hsa; identical to SEQ ID NO: 190281

SEQ ID NO: 252748 - RNA, 64 nt, hsa; identical to SEQ ID NO: 190282

SEQ ID NO: 252749 - RNA, 64 nt, hsa; identical to SEQ ID NO: 190283

SEQ ID NO: 252750 - RNA, 64 nt, hsa; identical to SEQ ID NO: 190284

SEQ ID NO: 252751 - RNA, 64 nt, hsa; identical to SEQ ID NO: 190285

SEQ ID NO: 252752 - RNA, 64 nt, hsa; identical to SEQ ID NO: 190286

SEQ ID NO: 252753 - RNA, 64 nt, hsa; identical to SEQ ID NO: 190287

SEQ ID NO: 252754 - RNA, 64 nt, hsa; identical to SEQ ID NO: 190288

SEQ ID NO: 252755 - RNA, 64 nt, hsa; identical to SEQ ID NO: 190289

SEQ ID NO: 252756 - RNA, 64 nt, hsa; identical to SEQ ID NO: 190290

SEQ ID NO: 252757 - RNA, 64 nt, hsa; identical to SEQ ID NO: 190291

SEQ ID NO: 252758 - RNA, 64 nt, hsa; identical to SEQ ID NO: 190292

SEQ ID NO: 252759 - RNA, 64 nt, hsa; identical to SEQ ID NO: 190293

SEQ ID NO: 252760 - RNA, 64 nt, hsa; identical to SEQ ID NO: 190294

SEQ ID NO: 252761 - RNA, 64 nt, hsa; identical to SEQ ID NO: 190295

SEQ ID NO: 252762 - RNA, 64 nt, hsa; identical to SEQ ID NO: 190296

SEQ ID NO: 252763 - RNA, 64 nt, hsa; identical to SEQ ID NO: 190297

SEQ ID NO: 252764 - RNA, 64 nt, hsa; identical to SEQ ID NO: 190298

SEQ ID NO: 252765 - RNA, 64 nt, hsa; identical to SEQ ID NO: 190299

SEQ ID NO: 252766 - RNA, 64 nt, hsa; identical to SEQ ID NO: 190300

SEQ ID NO: 252767 - RNA, 64 nt, hsa; identical to SEQ ID NO: 190301

SEQ ID NO: 252768 - RNA, 64 nt, hsa; identical to SEQ ID NO: 190302

SEQ ID NO: 252769 - RNA, 64 nt, hsa; identical to SEQ ID NO: 190303

SEQ ID NO: 252770 - RNA, 64 nt, hsa; identical to SEQ ID NO: 190304

SEQ ID NO: 252771 - RNA, 64 nt, hsa; identical to SEQ ID NO: 190305

SEQ ID NO: 252772 - RNA, 64 nt, hsa; identical to SEQ ID NO: 190306

SEQ ID NO: 252773 - RNA, 64 nt, hsa; identical to SEQ ID NO: 190307

SEQ ID NO: 252774 - RNA, 64 nt, hsa; identical to SEQ ID NO: 190308

SEQ ID NO: 252775 - RNA, 64 nt, hsa; identical to SEQ ID NO: 190309

SEQ ID NO: 252776 - RNA, 64 nt, hsa; identical to SEQ ID NO: 190310

SEQ ID NO: 252777 - RNA, 64 nt, hsa; identical to SEQ ID NO: 190311

SEQ ID NO: 252778 - RNA, 64 nt, hsa; identical to SEQ ID NO: 190312

SEQ ID NO: 252779 - RNA, 64 nt, hsa; identical to SEQ ID NO: 190313

SEQ ID NO: 252780 - RNA, 64 nt, hsa; identical to SEQ ID NO: 190314

SEQ ID NO: 252781 - RNA, 64 nt, hsa; identical to SEQ ID NO: 190315

SEQ ID NO: 252782 - RNA, 64 nt, hsa; identical to SEQ ID NO: 190316

SEQ ID NO: 252783 - RNA, 64 nt, hsa; identical to SEQ ID NO: 190317

SEQ ID NO: 252784 - RNA, 64 nt, hsa; identical to SEQ ID NO: 190318

SEQ ID NO: 252785 - RNA, 64 nt, hsa; identical to SEQ ID NO: 190319

SEQ ID NO: 252786 - RNA, 64 nt, hsa; identical to SEQ ID NO: 190320

SEQ ID NO: 252787 - RNA, 64 nt, hsa; identical to SEQ ID NO: 190321

SEQ ID NO: 252788 - RNA, 64 nt, hsa; identical to SEQ ID NO: 190322

SEQ ID NO: 252789 - RNA, 64 nt, hsa; identical to SEQ ID NO: 190323

SEQ ID NO: 252790 - RNA, 64 nt, hsa; identical to SEQ ID NO: 190324

SEQ ID NO: 252791 - RNA, 64 nt, hsa; identical to SEQ ID NO: 190325

SEQ ID NO: 252792 - RNA, 64 nt, hsa; identical to SEQ ID NO: 190326

SEQ ID NO: 252793 - RNA, 64 nt, hsa; identical to SEQ ID NO: 190327

SEQ ID NO: 252794 - RNA, 64 nt, hsa; identical to SEQ ID NO: 190328

SEQ ID NO: 252795 - RNA, 64 nt, hsa; identical to SEQ ID NO: 190329

SEQ ID NO: 252796 - RNA, 64 nt, hsa; identical to SEQ ID NO: 190330

SEQ ID NO: 252797 - RNA, 64 nt, hsa; identical to SEQ ID NO: 190331

SEQ ID NO: 252798 - RNA, 64 nt, hsa; identical to SEQ ID NO: 190332

SEQ ID NO: 252799 - RNA, 64 nt, hsa; identical to SEQ ID NO: 190333

SEQ ID NO: 252800 - RNA, 64 nt, hsa; identical to SEQ ID NO: 190334

SEQ ID NO: 252801 - RNA, 64 nt, hsa; identical to SEQ ID NO: 190335

SEQ ID NO: 252802 - RNA, 64 nt, hsa; identical to SEQ ID NO: 190336

SEQ ID NO: 252803 - RNA, 64 nt, hsa; identical to SEQ ID NO: 190337

SEQ ID NO: 252804 - RNA, 64 nt, hsa; identical to SEQ ID NO: 190338

SEQ ID NO: 252805 - RNA, 64 nt, hsa; identical to SEQ ID NO: 190339

SEQ ID NO: 252806 - RNA, 61 nt, hsa; identical to SEQ ID NO: 190340

SEQ ID NO: 252807 - RNA, 64 nt, hsa; identical to SEQ ID NO: 190341

SEQ ID NO: 252808 - RNA, 64 nt, hsa; identical to SEQ ID NO: 190342

SEQ ID NO: 252809 - RNA, 64 nt, hsa; identical to SEQ ID NO: 190343

SEQ ID NO: 252810 - RNA, 64 nt, hsa; identical to SEQ ID NO: 190344

SEQ ID NO: 252811 - RNA, 64 nt, hsa; identical to SEQ ID NO: 190345

SEQ ID NO: 252812 - RNA, 64 nt, hsa; identical to SEQ ID NO: 190346

SEQ ID NO: 252813 - RNA, 64 nt, hsa; identical to SEQ ID NO: 190347

SEQ ID NO: 252814 - RNA, 64 nt, hsa; identical to SEQ ID NO: 190348

SEQ ID NO: 252815 - RNA, 64 nt, hsa; identical to SEQ ID NO: 190349

SEQ ID NO: 252816 - RNA, 64 nt, hsa; identical to SEQ ID NO: 190350

SEQ ID NO: 252817 - RNA, 64 nt, hsa; identical to SEQ ID NO: 190351

SEQ ID NO: 252818 - RNA, 64 nt, hsa; identical to SEQ ID NO: 190352

SEQ ID NO: 252819 - RNA, 64 nt, hsa; identical to SEQ ID NO: 190353

SEQ ID NO: 252820 - RNA, 64 nt, hsa; identical to SEQ ID NO: 190354

SEQ ID NO: 252821 - RNA, 64 nt, hsa; identical to SEQ ID NO: 190355

SEQ ID NO: 252822 - RNA, 64 nt, hsa; identical to SEQ ID NO: 190356

SEQ ID NO: 252823 - RNA, 64 nt, hsa; identical to SEQ ID NO: 190357

SEQ ID NO: 252824 - RNA, 64 nt, hsa; identical to SEQ ID NO: 190358

SEQ ID NO: 252825 - RNA, 64 nt, hsa; identical to SEQ ID NO: 190359

SEQ ID NO: 252826 - RNA, 64 nt, hsa; identical to SEQ ID NO: 190360

SEQ ID NO: 252827 - RNA, 64 nt, hsa; identical to SEQ ID NO: 190361

SEQ ID NO: 252828 - RNA, 64 nt, hsa; identical to SEQ ID NO: 190362

SEQ ID NO: 252829 - RNA, 64 nt, hsa; identical to SEQ ID NO: 190363

SEQ ID NO: 252830 - RNA, 64 nt, hsa; identical to SEQ ID NO: 190364

SEQ ID NO: 252831 - RNA, 64 nt, hsa; identical to SEQ ID NO: 190365

SEQ ID NO: 252832 - RNA, 64 nt, hsa; identical to SEQ ID NO: 190366

SEQ ID NO: 252833 - RNA, 63 nt, hsa; identical to SEQ ID NO: 190367

SEQ ID NO: 252834 - RNA, 64 nt, hsa; identical to SEQ ID NO: 190368

SEQ ID NO: 252835 - RNA, 64 nt, hsa; identical to SEQ ID NO: 190369

SEQ ID NO: 252836 - RNA, 64 nt, hsa; identical to SEQ ID NO: 190370

SEQ ID NO: 252837 - RNA, 64 nt, hsa; identical to SEQ ID NO: 190371

SEQ ID NO: 252838 - RNA, 64 nt, hsa; identical to SEQ ID NO: 190372

SEQ ID NO: 252839 - RNA, 64 nt, hsa; identical to SEQ ID NO: 190373

SEQ ID NO: 252840 - RNA, 64 nt, hsa; identical to SEQ ID NO: 190374

SEQ ID NO: 252841 - RNA, 64 nt, hsa; identical to SEQ ID NO: 190375

SEQ ID NO: 252842 - RNA, 64 nt, hsa; identical to SEQ ID NO: 190376

SEQ ID NO: 252843 - RNA, 58 nt, hsa; identical to SEQ ID NO: 190377

SEQ ID NO: 252844 - RNA, 64 nt, hsa; identical to SEQ ID NO: 190378

SEQ ID NO: 252845 - RNA, 64 nt, hsa; identical to SEQ ID NO: 190379

SEQ ID NO: 252846 - RNA, 64 nt, hsa; identical to SEQ ID NO: 190380

SEQ ID NO: 252847 - RNA, 64 nt, hsa; identical to SEQ ID NO: 190381

SEQ ID NO: 252848 - RNA, 64 nt, hsa; identical to SEQ ID NO: 190382

SEQ ID NO: 252849 - RNA, 64 nt, hsa; identical to SEQ ID NO: 190383

SEQ ID NO: 252850 - RNA, 64 nt, hsa; identical to SEQ ID NO: 190384

SEQ ID NO: 252851 - RNA, 64 nt, hsa; identical to SEQ ID NO: 190385

SEQ ID NO: 252852 - RNA, 64 nt, hsa; identical to SEQ ID NO: 190386

SEQ ID NO: 252853 - RNA, 64 nt, hsa; identical to SEQ ID NO: 190387

SEQ ID NO: 252854 - RNA, 64 nt, hsa; identical to SEQ ID NO: 190388

SEQ ID NO: 252855 - RNA, 64 nt, hsa; identical to SEQ ID NO: 190389

SEQ ID NO: 252856 - RNA, 64 nt, hsa; identical to SEQ ID NO: 190390

SEQ ID NO: 252857 - RNA, 64 nt, hsa; identical to SEQ ID NO: 190391

SEQ ID NO: 252858 - RNA, 64 nt, hsa; identical to SEQ ID NO: 190392

SEQ ID NO: 252859 - RNA, 64 nt, hsa; identical to SEQ ID NO: 190393

SEQ ID NO: 252860 - RNA, 64 nt, hsa; identical to SEQ ID NO: 190394

SEQ ID NO: 252861 - RNA, 64 nt, hsa; identical to SEQ ID NO: 190395

SEQ ID NO: 252862 - RNA, 64 nt, hsa; identical to SEQ ID NO: 190396

SEQ ID NO: 252863 - RNA, 64 nt, hsa; identical to SEQ ID NO: 190397

SEQ ID NO: 252864 - RNA, 64 nt, hsa; identical to SEQ ID NO: 190398

SEQ ID NO: 252865 - RNA, 64 nt, hsa; identical to SEQ ID NO: 190399

SEQ ID NO: 252866 - RNA, 67 nt, hsa; identical to SEQ ID NO: 190400

SEQ ID NO: 252867 - RNA, 67 nt, hsa; identical to SEQ ID NO: 190401

SEQ ID NO: 252868 - RNA, 67 nt, hsa; identical to SEQ ID NO: 190402

SEQ ID NO: 252869 - RNA, 67 nt, hsa; identical to SEQ ID NO: 190403

SEQ ID NO: 252870 - RNA, 67 nt, hsa; identical to SEQ ID NO: 190404

SEQ ID NO: 252871 - RNA, 67 nt, hsa; identical to SEQ ID NO: 190405

SEQ ID NO: 252872 - RNA, 67 nt, hsa; identical to SEQ ID NO: 190406

SEQ ID NO: 252873 - RNA, 67 nt, hsa; identical to SEQ ID NO: 190407

SEQ ID NO: 252874 - RNA, 67 nt, hsa; identical to SEQ ID NO: 190408

SEQ ID NO: 252875 - RNA, 67 nt, hsa; identical to SEQ ID NO: 190409

SEQ ID NO: 252876 - RNA, 67 nt, hsa; identical to SEQ ID NO: 190410

SEQ ID NO: 252877 - RNA, 67 nt, hsa; identical to SEQ ID NO: 190411

SEQ ID NO: 252878 - RNA, 67 nt, hsa; identical to SEQ ID NO: 190412

SEQ ID NO: 252879 - RNA, 67 nt, hsa; identical to SEQ ID NO: 190413

SEQ ID NO: 252880 - RNA, 67 nt, hsa; identical to SEQ ID NO: 190414

SEQ ID NO: 252881 - RNA, 67 nt, hsa; identical to SEQ ID NO: 190415

SEQ ID NO: 252882 - RNA, 67 nt, hsa; identical to SEQ ID NO: 190416

SEQ ID NO: 252883 - RNA, 67 nt, hsa; identical to SEQ ID NO: 190417

SEQ ID NO: 252884 - RNA, 67 nt, hsa; identical to SEQ ID NO: 190418

SEQ ID NO: 252885 - RNA, 67 nt, hsa; identical to SEQ ID NO: 190419

SEQ ID NO: 252886 - RNA, 67 nt, hsa; identical to SEQ ID NO: 190420

SEQ ID NO: 252887 - RNA, 67 nt, hsa; identical to SEQ ID NO: 190421

SEQ ID NO: 252888 - RNA, 67 nt, hsa; identical to SEQ ID NO: 190422

SEQ ID NO: 252889 - RNA, 67 nt, hsa; identical to SEQ ID NO: 190423

SEQ ID NO: 252890 - RNA, 67 nt, hsa; identical to SEQ ID NO: 190424

SEQ ID NO: 252891 - RNA, 67 nt, hsa; identical to SEQ ID NO: 190425

SEQ ID NO: 252892 - RNA, 67 nt, hsa; identical to SEQ ID NO: 190426

SEQ ID NO: 252893 - RNA, 67 nt, hsa; identical to SEQ ID NO: 190427

SEQ ID NO: 252894 - RNA, 67 nt, hsa; identical to SEQ ID NO: 190428

SEQ ID NO: 252895 - RNA, 67 nt, hsa; identical to SEQ ID NO: 190429

SEQ ID NO: 252896 - RNA, 67 nt, hsa; identical to SEQ ID NO: 190430

SEQ ID NO: 252897 - RNA, 67 nt, hsa; identical to SEQ ID NO: 190431

SEQ ID NO: 252898 - RNA, 67 nt, hsa; identical to SEQ ID NO: 190432

SEQ ID NO: 252899 - RNA, 67 nt, hsa; identical to SEQ ID NO: 190433

SEQ ID NO: 252900 - RNA, 67 nt, hsa; identical to SEQ ID NO: 190434

SEQ ID NO: 252901 - RNA, 67 nt, hsa; identical to SEQ ID NO: 190435

SEQ ID NO: 252902 - RNA, 67 nt, hsa; identical to SEQ ID NO: 190436

SEQ ID NO: 252903 - RNA, 67 nt, hsa; identical to SEQ ID NO: 190437

SEQ ID NO: 252904 - RNA, 67 nt, hsa; identical to SEQ ID NO: 190438

SEQ ID NO: 252905 - RNA, 67 nt, hsa; identical to SEQ ID NO: 190439

SEQ ID NO: 252906 - RNA, 67 nt, hsa; identical to SEQ ID NO: 190440

SEQ ID NO: 252907 - RNA, 67 nt, hsa; identical to SEQ ID NO: 190441

SEQ ID NO: 252908 - RNA, 67 nt, hsa; identical to SEQ ID NO: 190442

SEQ ID NO: 252909 - RNA, 67 nt, hsa; identical to SEQ ID NO: 190443

SEQ ID NO: 252910 - RNA, 67 nt, hsa; identical to SEQ ID NO: 190444

SEQ ID NO: 252911 - RNA, 67 nt, hsa; identical to SEQ ID NO: 190445

SEQ ID NO: 252912 - RNA, 67 nt, hsa; identical to SEQ ID NO: 190446

SEQ ID NO: 252913 - RNA, 67 nt, hsa; identical to SEQ ID NO: 190447

SEQ ID NO: 252914 - RNA, 67 nt, hsa; identical to SEQ ID NO: 190448

SEQ ID NO: 252915 - RNA, 67 nt, hsa; identical to SEQ ID NO: 190449

SEQ ID NO: 252916 - RNA, 67 nt, hsa; identical to SEQ ID NO: 190450

SEQ ID NO: 252917 - RNA, 67 nt, hsa; identical to SEQ ID NO: 190451

SEQ ID NO: 252918 - RNA, 67 nt, hsa; identical to SEQ ID NO: 190452

SEQ ID NO: 252919 - RNA, 67 nt, hsa; identical to SEQ ID NO: 190453

SEQ ID NO: 252920 - RNA, 67 nt, hsa; identical to SEQ ID NO: 190454

SEQ ID NO: 252921 - RNA, 67 nt, hsa; identical to SEQ ID NO: 190455

SEQ ID NO: 252922 - RNA, 67 nt, hsa; identical to SEQ ID NO: 190456

SEQ ID NO: 252923 - RNA, 67 nt, hsa; identical to SEQ ID NO: 190457

SEQ ID NO: 252924 - RNA, 67 nt, hsa; identical to SEQ ID NO: 190458

SEQ ID NO: 252925 - RNA, 67 nt, hsa; identical to SEQ ID NO: 190459

SEQ ID NO: 252926 - RNA, 67 nt, hsa; identical to SEQ ID NO: 190460

SEQ ID NO: 252927 - RNA, 67 nt, hsa; identical to SEQ ID NO: 190461

SEQ ID NO: 252928 - RNA, 67 nt, hsa; identical to SEQ ID NO: 190462

SEQ ID NO: 252929 - RNA, 67 nt, hsa; identical to SEQ ID NO: 190463

SEQ ID NO: 252930 - RNA, 67 nt, hsa; identical to SEQ ID NO: 190464

SEQ ID NO: 252931 - RNA, 67 nt, hsa; identical to SEQ ID NO: 190465

SEQ ID NO: 252932 - RNA, 67 nt, hsa; identical to SEQ ID NO: 190466

SEQ ID NO: 252933 - RNA, 67 nt, hsa; identical to SEQ ID NO: 190467

SEQ ID NO: 252934 - RNA, 67 nt, hsa; identical to SEQ ID NO: 190468

SEQ ID NO: 252935 - RNA, 67 nt, hsa; identical to SEQ ID NO: 190469

SEQ ID NO: 252936 - RNA, 67 nt, hsa; identical to SEQ ID NO: 190470

SEQ ID NO: 252937 - RNA, 67 nt, hsa; identical to SEQ ID NO: 190471

SEQ ID NO: 252938 - RNA, 67 nt, hsa; identical to SEQ ID NO: 190472

SEQ ID NO: 252939 - RNA, 67 nt, hsa; identical to SEQ ID NO: 190473

SEQ ID NO: 252940 - RNA, 67 nt, hsa; identical to SEQ ID NO: 190474

SEQ ID NO: 252941 - RNA, 67 nt, hsa; identical to SEQ ID NO: 190475

SEQ ID NO: 252942 - RNA, 67 nt, hsa; identical to SEQ ID NO: 190476

SEQ ID NO: 252943 - RNA, 67 nt, hsa; identical to SEQ ID NO: 190477

SEQ ID NO: 252944 - RNA, 67 nt, hsa; identical to SEQ ID NO: 190478

SEQ ID NO: 252945 - RNA, 67 nt, hsa; identical to SEQ ID NO: 190479

SEQ ID NO: 252946 - RNA, 67 nt, hsa; identical to SEQ ID NO: 190480

SEQ ID NO: 252947 - RNA, 67 nt, hsa; identical to SEQ ID NO: 190481

SEQ ID NO: 252948 - RNA, 67 nt, hsa; identical to SEQ ID NO: 190482

SEQ ID NO: 252949 - RNA, 67 nt, hsa; identical to SEQ ID NO: 190483

SEQ ID NO: 252950 - RNA, 67 nt, hsa; identical to SEQ ID NO: 190484

SEQ ID NO: 252951 - RNA, 67 nt, hsa; identical to SEQ ID NO: 190485

SEQ ID NO: 252952 - RNA, 67 nt, hsa; identical to SEQ ID NO: 190486

SEQ ID NO: 252953 - RNA, 67 nt, hsa; identical to SEQ ID NO: 190487

SEQ ID NO: 252954 - RNA, 67 nt, hsa; identical to SEQ ID NO: 190488

SEQ ID NO: 252955 - RNA, 67 nt, hsa; identical to SEQ ID NO: 190489

SEQ ID NO: 252956 - RNA, 67 nt, hsa; identical to SEQ ID NO: 190490

SEQ ID NO: 252957 - RNA, 67 nt, hsa; identical to SEQ ID NO: 190491

SEQ ID NO: 252958 - RNA, 67 nt, hsa; identical to SEQ ID NO: 190492

SEQ ID NO: 252959 - RNA, 67 nt, hsa; identical to SEQ ID NO: 190493

SEQ ID NO: 252960 - RNA, 67 nt, hsa; identical to SEQ ID NO: 190494

SEQ ID NO: 252961 - RNA, 67 nt, hsa; identical to SEQ ID NO: 190495

SEQ ID NO: 252962 - RNA, 67 nt, hsa; identical to SEQ ID NO: 190496

SEQ ID NO: 252963 - RNA, 67 nt, hsa; identical to SEQ ID NO: 190497

SEQ ID NO: 252964 - RNA, 67 nt, hsa; identical to SEQ ID NO: 190498

SEQ ID NO: 252965 - RNA, 67 nt, hsa; identical to SEQ ID NO: 190499

SEQ ID NO: 252966 - RNA, 67 nt, hsa; identical to SEQ ID NO: 190500

SEQ ID NO: 252967 - RNA, 67 nt, hsa; identical to SEQ ID NO: 190501

SEQ ID NO: 252968 - RNA, 67 nt, hsa; identical to SEQ ID NO: 190502

SEQ ID NO: 252969 - RNA, 54 nt, hsa; identical to SEQ ID NO: 190234

SEQ ID NO: 252970 - RNA, 67 nt, hsa; identical to SEQ ID NO: 190504

SEQ ID NO: 252971 - RNA, 67 nt, hsa; identical to SEQ ID NO: 190505

SEQ ID NO: 252972 - RNA, 67 nt, hsa; identical to SEQ ID NO: 190506

SEQ ID NO: 252973 - RNA, 67 nt, hsa; identical to SEQ ID NO: 190507

SEQ ID NO: 252974 - RNA, 67 nt, hsa; identical to SEQ ID NO: 190508

SEQ ID NO: 252975 - RNA, 67 nt, hsa; identical to SEQ ID NO: 190509

SEQ ID NO: 252976 - RNA, 67 nt, hsa; identical to SEQ ID NO: 190510

SEQ ID NO: 252977 - RNA, 67 nt, hsa; identical to SEQ ID NO: 190511

SEQ ID NO: 252978 - RNA, 67 nt, hsa; identical to SEQ ID NO: 190512

SEQ ID NO: 252979 - RNA, 67 nt, hsa; identical to SEQ ID NO: 190513

SEQ ID NO: 252980 - RNA, 67 nt, hsa; identical to SEQ ID NO: 190514

SEQ ID NO: 252981 - RNA, 67 nt, hsa; identical to SEQ ID NO: 190515

SEQ ID NO: 252982 - RNA, 67 nt, hsa; identical to SEQ ID NO: 190516

SEQ ID NO: 252983 - RNA, 67 nt, hsa; identical to SEQ ID NO: 190517

SEQ ID NO: 252984 - RNA, 67 nt, hsa; identical to SEQ ID NO: 190518

SEQ ID NO: 252985 - RNA, 67 nt, hsa; identical to SEQ ID NO: 190519

SEQ ID NO: 252986 - RNA, 67 nt, hsa; identical to SEQ ID NO: 190520

SEQ ID NO: 252987 - RNA, 67 nt, hsa; identical to SEQ ID NO: 190521

SEQ ID NO: 252988 - RNA, 67 nt, hsa; identical to SEQ ID NO: 190522

SEQ ID NO: 252989 - RNA, 67 nt, hsa; identical to SEQ ID NO: 190523

SEQ ID NO: 252990 - RNA, 67 nt, hsa; identical to SEQ ID NO: 190524

SEQ ID NO: 252991 - RNA, 67 nt, hsa; identical to SEQ ID NO: 190525

SEQ ID NO: 252992 - RNA, 67 nt, hsa; identical to SEQ ID NO: 190526

SEQ ID NO: 252993 - RNA, 67 nt, hsa; identical to SEQ ID NO: 190527

SEQ ID NO: 252994 - RNA, 67 nt, hsa; identical to SEQ ID NO: 190528

SEQ ID NO: 252995 - RNA, 67 nt, hsa; identical to SEQ ID NO: 190529

SEQ ID NO: 252996 - RNA, 67 nt, hsa; identical to SEQ ID NO: 190530

SEQ ID NO: 252997 - RNA, 67 nt, hsa; identical to SEQ ID NO: 190531

SEQ ID NO: 252998 - RNA, 67 nt, hsa; identical to SEQ ID NO: 190532

SEQ ID NO: 252999 - RNA, 67 nt, hsa; identical to SEQ ID NO: 190533

SEQ ID NO: 253000 - RNA, 67 nt, hsa; identical to SEQ ID NO: 190534

SEQ ID NO: 253001 - RNA, 67 nt, hsa; identical to SEQ ID NO: 190535

SEQ ID NO: 253002 - RNA, 67 nt, hsa; identical to SEQ ID NO: 190536

SEQ ID NO: 253003 - RNA, 67 nt, hsa; identical to SEQ ID NO: 190537

SEQ ID NO: 253004 - RNA, 67 nt, hsa; identical to SEQ ID NO: 190538

SEQ ID NO: 253005 - RNA, 67 nt, hsa; identical to SEQ ID NO: 190539

SEQ ID NO: 253006 - RNA, 61 nt, hsa; identical to SEQ ID NO: 190271

SEQ ID NO: 253007 - RNA, 67 nt, hsa; identical to SEQ ID NO: 190541

SEQ ID NO: 253008 - RNA, 67 nt, hsa; identical to SEQ ID NO: 190542

SEQ ID NO: 253009 - RNA, 66 nt, hsa; identical to SEQ ID NO: 190543

SEQ ID NO: 253010 - RNA, 67 nt, hsa; identical to SEQ ID NO: 190544

SEQ ID NO: 253011 - RNA, 67 nt, hsa; identical to SEQ ID NO: 190545

SEQ ID NO: 253012 - RNA, 67 nt, hsa; identical to SEQ ID NO: 190546

SEQ ID NO: 253013 - RNA, 67 nt, hsa; identical to SEQ ID NO: 190547

SEQ ID NO: 253014 - RNA, 67 nt, hsa; identical to SEQ ID NO: 190548

SEQ ID NO: 253015 - RNA, 67 nt, hsa; identical to SEQ ID NO: 190549

SEQ ID NO: 253016 - RNA, 67 nt, hsa; identical to SEQ ID NO: 190550

SEQ ID NO: 253017 - RNA, 67 nt, hsa; identical to SEQ ID NO: 190551

SEQ ID NO: 253018 - RNA, 67 nt, hsa; identical to SEQ ID NO: 190552

SEQ ID NO: 253019 - RNA, 67 nt, hsa; identical to SEQ ID NO: 190553

SEQ ID NO: 253020 - RNA, 67 nt, hsa; identical to SEQ ID NO: 190554

SEQ ID NO: 253021 - RNA, 67 nt, hsa; identical to SEQ ID NO: 190555

SEQ ID NO: 253022 - RNA, 67 nt, hsa; identical to SEQ ID NO: 190556

SEQ ID NO: 253023 - RNA, 67 nt, hsa; identical to SEQ ID NO: 190557

SEQ ID NO: 253024 - RNA, 67 nt, hsa; identical to SEQ ID NO: 190558

SEQ ID NO: 253025 - RNA, 67 nt, hsa; identical to SEQ ID NO: 190559

SEQ ID NO: 253026 - RNA, 67 nt, hsa; identical to SEQ ID NO: 190560

SEQ ID NO: 253027 - RNA, 67 nt, hsa; identical to SEQ ID NO: 190561

SEQ ID NO: 253028 - RNA, 67 nt, hsa; identical to SEQ ID NO: 190562

SEQ ID NO: 253029 - RNA, 67 nt, hsa; identical to SEQ ID NO: 190563

SEQ ID NO: 253030 - RNA, 67 nt, hsa; identical to SEQ ID NO: 190564

SEQ ID NO: 253031 - RNA, 67 nt, hsa; identical to SEQ ID NO: 190565

SEQ ID NO: 253032 - RNA, 67 nt, hsa; identical to SEQ ID NO: 190566

SEQ ID NO: 253033 - RNA, 67 nt, hsa; identical to SEQ ID NO: 190567

SEQ ID NO: 253034 - RNA, 67 nt, hsa; identical to SEQ ID NO: 190568

SEQ ID NO: 253035 - RNA, 67 nt, hsa; identical to SEQ ID NO: 190569

SEQ ID NO: 253036 - RNA, 67 nt, hsa; identical to SEQ ID NO: 190570

SEQ ID NO: 253037 - RNA, 67 nt, hsa; identical to SEQ ID NO: 190571

SEQ ID NO: 253038 - RNA, 67 nt, hsa; identical to SEQ ID NO: 190572

SEQ ID NO: 253039 - RNA, 67 nt, hsa; identical to SEQ ID NO: 190573

SEQ ID NO: 253040 - RNA, 67 nt, hsa; identical to SEQ ID NO: 190574

SEQ ID NO: 253041 - RNA, 67 nt, hsa; identical to SEQ ID NO: 190575

SEQ ID NO: 253042 - RNA, 67 nt, hsa; identical to SEQ ID NO: 190576

SEQ ID NO: 253043 - RNA, 67 nt, hsa; identical to SEQ ID NO: 190577

SEQ ID NO: 253044 - RNA, 67 nt, hsa; identical to SEQ ID NO: 190578

SEQ ID NO: 253045 - RNA, 67 nt, hsa; identical to SEQ ID NO: 190579

SEQ ID NO: 253046 - RNA, 67 nt, hsa; identical to SEQ ID NO: 190580

SEQ ID NO: 253047 - RNA, 67 nt, hsa; identical to SEQ ID NO: 190581

SEQ ID NO: 253048 - RNA, 67 nt, hsa; identical to SEQ ID NO: 190582

SEQ ID NO: 253049 - RNA, 67 nt, hsa; identical to SEQ ID NO: 190583

SEQ ID NO: 253050 - RNA, 67 nt, hsa; identical to SEQ ID NO: 190584

SEQ ID NO: 253051 - RNA, 67 nt, hsa; identical to SEQ ID NO: 190585

SEQ ID NO: 253052 - RNA, 67 nt, hsa; identical to SEQ ID NO: 190586

SEQ ID NO: 253053 - RNA, 67 nt, hsa; identical to SEQ ID NO: 190587

SEQ ID NO: 253054 - RNA, 67 nt, hsa; identical to SEQ ID NO: 190588

SEQ ID NO: 253055 - RNA, 67 nt, hsa; identical to SEQ ID NO: 190589

SEQ ID NO: 253056 - RNA, 67 nt, hsa; identical to SEQ ID NO: 190590

SEQ ID NO: 253057 - RNA, 67 nt, hsa; identical to SEQ ID NO: 190591

SEQ ID NO: 253058 - RNA, 67 nt, hsa; identical to SEQ ID NO: 190592

SEQ ID NO: 253059 - RNA, 67 nt, hsa; identical to SEQ ID NO: 190593

SEQ ID NO: 253060 - RNA, 67 nt, hsa; identical to SEQ ID NO: 190594

SEQ ID NO: 253061 - RNA, 67 nt, hsa; identical to SEQ ID NO: 190595

SEQ ID NO: 253062 - RNA, 67 nt, hsa; identical to SEQ ID NO: 190596

SEQ ID NO: 253063 - RNA, 67 nt, hsa; identical to SEQ ID NO: 190597

SEQ ID NO: 253064 - RNA, 67 nt, hsa; identical to SEQ ID NO: 190598

SEQ ID NO: 253065 - RNA, 67 nt, hsa; identical to SEQ ID NO: 190599

SEQ ID NO: 253066 - RNA, 67 nt, hsa; identical to SEQ ID NO: 190600

SEQ ID NO: 253067 - RNA, 67 nt, hsa; identical to SEQ ID NO: 190601

SEQ ID NO: 253068 - RNA, 67 nt, hsa; identical to SEQ ID NO: 190602

SEQ ID NO: 253069 - RNA, 67 nt, hsa; identical to SEQ ID NO: 190603

SEQ ID NO: 253070 - RNA, 67 nt, hsa; identical to SEQ ID NO: 190604

SEQ ID NO: 253071 - RNA, 67 nt, hsa; identical to SEQ ID NO: 190605

SEQ ID NO: 253072 - RNA, 67 nt, hsa; identical to SEQ ID NO: 190606

SEQ ID NO: 253073 - RNA, 67 nt, hsa; identical to SEQ ID NO: 190607

SEQ ID NO: 253074 - RNA, 67 nt, hsa; identical to SEQ ID NO: 190608

SEQ ID NO: 253075 - RNA, 61 nt, hsa; identical to SEQ ID NO: 190340

SEQ ID NO: 253076 - RNA, 67 nt, hsa; identical to SEQ ID NO: 190610

SEQ ID NO: 253077 - RNA, 67 nt, hsa; identical to SEQ ID NO: 190611

SEQ ID NO: 253078 - RNA, 67 nt, hsa; identical to SEQ ID NO: 190612

SEQ ID NO: 253079 - RNA, 67 nt, hsa; identical to SEQ ID NO: 190613

SEQ ID NO: 253080 - RNA, 67 nt, hsa; identical to SEQ ID NO: 190614

SEQ ID NO: 253081 - RNA, 67 nt, hsa; identical to SEQ ID NO: 190615

SEQ ID NO: 253082 - RNA, 67 nt, hsa; identical to SEQ ID NO: 190616

SEQ ID NO: 253083 - RNA, 67 nt, hsa; identical to SEQ ID NO: 190617

SEQ ID NO: 253084 - RNA, 67 nt, hsa; identical to SEQ ID NO: 190618

SEQ ID NO: 253085 - RNA, 67 nt, hsa; identical to SEQ ID NO: 190619

SEQ ID NO: 253086 - RNA, 67 nt, hsa; identical to SEQ ID NO: 190620

SEQ ID NO: 253087 - RNA, 67 nt, hsa; identical to SEQ ID NO: 190621

SEQ ID NO: 253088 - RNA, 67 nt, hsa; identical to SEQ ID NO: 190622

SEQ ID NO: 253089 - RNA, 67 nt, hsa; identical to SEQ ID NO: 190623

SEQ ID NO: 253090 - RNA, 67 nt, hsa; identical to SEQ ID NO: 190624

SEQ ID NO: 253091 - RNA, 67 nt, hsa; identical to SEQ ID NO: 190625

SEQ ID NO: 253092 - RNA, 67 nt, hsa; identical to SEQ ID NO: 190626

SEQ ID NO: 253093 - RNA, 67 nt, hsa; identical to SEQ ID NO: 190627

SEQ ID NO: 253094 - RNA, 67 nt, hsa; identical to SEQ ID NO: 190628

SEQ ID NO: 253095 - RNA, 67 nt, hsa; identical to SEQ ID NO: 190629

SEQ ID NO: 253096 - RNA, 67 nt, hsa; identical to SEQ ID NO: 190630

SEQ ID NO: 253097 - RNA, 67 nt, hsa; identical to SEQ ID NO: 190631

SEQ ID NO: 253098 - RNA, 67 nt, hsa; identical to SEQ ID NO: 190632

SEQ ID NO: 253099 - RNA, 67 nt, hsa; identical to SEQ ID NO: 190633

SEQ ID NO: 253100 - RNA, 67 nt, hsa; identical to SEQ ID NO: 190634

SEQ ID NO: 253101 - RNA, 67 nt, hsa; identical to SEQ ID NO: 190635

SEQ ID NO: 253102 - RNA, 66 nt, hsa; identical to SEQ ID NO: 190636

SEQ ID NO: 253103 - RNA, 67 nt, hsa; identical to SEQ ID NO: 190637

SEQ ID NO: 253104 - RNA, 67 nt, hsa; identical to SEQ ID NO: 190638

SEQ ID NO: 253105 - RNA, 67 nt, hsa; identical to SEQ ID NO: 190639

SEQ ID NO: 253106 - RNA, 67 nt, hsa; identical to SEQ ID NO: 190640

SEQ ID NO: 253107 - RNA, 67 nt, hsa; identical to SEQ ID NO: 190641

SEQ ID NO: 253108 - RNA, 67 nt, hsa; identical to SEQ ID NO: 190642

SEQ ID NO: 253109 - RNA, 67 nt, hsa; identical to SEQ ID NO: 190643

SEQ ID NO: 253110 - RNA, 67 nt, hsa; identical to SEQ ID NO: 190644

SEQ ID NO: 253111 - RNA, 67 nt, hsa; identical to SEQ ID NO: 190645

SEQ ID NO: 253112 - RNA, 58 nt, hsa; identical to SEQ ID NO: 190377

SEQ ID NO: 253113 - RNA, 67 nt, hsa; identical to SEQ ID NO: 190647

SEQ ID NO: 253114 - RNA, 67 nt, hsa; identical to SEQ ID NO: 190648

SEQ ID NO: 253115 - RNA, 67 nt, hsa; identical to SEQ ID NO: 190649

SEQ ID NO: 253116 - RNA, 67 nt, hsa; identical to SEQ ID NO: 190650

SEQ ID NO: 253117 - RNA, 67 nt, hsa; identical to SEQ ID NO: 190651

SEQ ID NO: 253118 - RNA, 67 nt, hsa; identical to SEQ ID NO: 190652

SEQ ID NO: 253119 - RNA, 67 nt, hsa; identical to SEQ ID NO: 190653

SEQ ID NO: 253120 - RNA, 67 nt, hsa; identical to SEQ ID NO: 190654

SEQ ID NO: 253121 - RNA, 67 nt, hsa; identical to SEQ ID NO: 190655

SEQ ID NO: 253122 - RNA, 67 nt, hsa; identical to SEQ ID NO: 190656

SEQ ID NO: 253123 - RNA, 67 nt, hsa; identical to SEQ ID NO: 190657

SEQ ID NO: 253124 - RNA, 67 nt, hsa; identical to SEQ ID NO: 190658

SEQ ID NO: 253125 - RNA, 67 nt, hsa; identical to SEQ ID NO: 190659

SEQ ID NO: 253126 - RNA, 67 nt, hsa; identical to SEQ ID NO: 190660

SEQ ID NO: 253127 - RNA, 67 nt, hsa; identical to SEQ ID NO: 190661

SEQ ID NO: 253128 - RNA, 67 nt, hsa; identical to SEQ ID NO: 190662

SEQ ID NO: 253129 - RNA, 67 nt, hsa; identical to SEQ ID NO: 190663

SEQ ID NO: 253130 - RNA, 67 nt, hsa; identical to SEQ ID NO: 190664

SEQ ID NO: 253131 - RNA, 67 nt, hsa; identical to SEQ ID NO: 190665

SEQ ID NO: 253132 - RNA, 67 nt, hsa; identical to SEQ ID NO: 190666

SEQ ID NO: 253133 - RNA, 67 nt, hsa; identical to SEQ ID NO: 190667

SEQ ID NO: 253134 - RNA, 67 nt, hsa; identical to SEQ ID NO: 190668

SEQ ID NO: 253135 - RNA, 62 nt, hsa
gaccguacucaguaacaggccggaaaauugugcucuagaagaauaaaacugaaaaacucuag

SEQ ID NO: 253136 - RNA, 62 nt, hsa
auaagguaaacauucuauauauucuaugccugcucuagaauugaaagacuucagcaguauua

SEQ ID NO: 253137 - RNA, 62 nt, hsa
uccacaucugccuuaaaaccaaagagggcuuccucuagaagccaagggaaaggggugcuuuu

SEQ ID NO: 253138 - RNA, 62 nt, hsa
ggaacauuauggagagaaaggguacugaggcacucuagaaucugccacauucauuuucaaau

SEQ ID NO: 253139 - RNA, 62 nt, hsa
ggcagcuggaauuggaacucagauuuguugaacucuagaacuaaagaucauaauguugucuu

SEQ ID NO: 253140 - RNA, 62 nt, hsa
ucagaguucaaggaagaagcaaaauaucacaucucuagaaguguugggaaaaauauaauuuc

SEQ ID NO: 253141 - RNA, 62 nt, hsa
cuccuaaguuauuucucauagaacccagccuacucuagaauuucagcagugacauuggagaa

SEQ ID NO: 253142 - RNA, 62 nt, hsa
aauacaccagcucauuuggcugcucagucuaacucuagaauggaugcuuuugaauucauuuc

SEQ ID NO: 253143 - RNA, 62 nt, hsa
agagaggaauuaacuuccuggucugugcccuucucuagaagaauauaagaugcuccuccucc

SEQ ID NO: 253144 - RNA, 62 nt, hsa
cugggaggaaagugcugggcaucuuacaguaacucuagaaguuccuuugacuaggcugcaau

SEQ ID NO: 253145 - RNA, 62 nt, hsa
ugaagccauuggagagcugucuuccuguguaccucuagaaucccagcagcagagaaccauca

SEQ ID NO: 253146 - RNA, 58 nt, hsa; identical to SEQ ID NO: 102991

SEQ ID NO: 253147 - RNA, 62 nt, hsa
gaaguauguggacaucucuucuuuuccugucccucuagaagaacauucucccuugcuugaug

SEQ ID NO: 253148 - RNA, 62 nt, hsa
uaagauccucacagcacgggagcagggagaggcucuagaacaagguuucacaaccgagaugc

SEQ ID NO: 253149 - RNA, 62 nt, hsa
ucauuacccuuuucuggguuugaagcugcugucucuagaagugccaucucaauugugcuuug

SEQ ID NO: 253150 - RNA, 62 nt, hsa
guccagaccauugucuuccaaccccagcuggccucuagaacacccacuggccaguccuagag

SEQ ID NO: 253151 - RNA, 62 nt, hsa
guuaucaaggaauuguacugugcuacaauuaucucuagaaucuccagaaagguggagggcug

SEQ ID NO: 253152 - RNA, 62 nt, hsa
guccugauccuaacccugggcucccuggaggacucuagaagcucagguucccugccacacua

SEQ ID NO: 253153 - RNA, 62 nt, hsa
cuguuuugcccaggggcucccgcuuuuucuugcucuagaagagcaguauucaaccuuuuagc

SEQ ID NO: 253154 - RNA, 62 nt, hsa
agacuauggauguguucucuaggccuucaggacucuagaauguccauauuuauuuuuauguu

SEQ ID NO: 253155 - RNA, 62 nt, hsa
aguaacaaacuccagucuguugcaguaacaaacucuagaauauugacauucucuguggggga

SEQ ID NO: 253156 - RNA, 62 nt, hsa
cccucuuagcuguagucuauauuagggcaguucucuagaacgcccacauuuccaccaacuca

SEQ ID NO: 253157 - RNA, 62 nt, hsa
uaguagguucugcuguuaugcagagccauuuccucuagaauuuggauaauaaagaugcuuau

SEQ ID NO: 253158 - RNA, 62 nt, hsa
ugacaauguagcuugaaagcgaugaagaaugucucuagaagagaaugaaggauugaagaauu

SEQ ID NO: 253159 - RNA, 62 nt, hsa
gaauauauugguugcucauuuuugaagagagucucuagaauauagauuuucacuucuuuuga

SEQ ID NO: 253160 - RNA, 62 nt, hsa
ugauaugauaauccuaccaauuuucaagaagucucuagaaagagauaacacauggaaagacg

SEQ ID NO: 253161 - RNA, 62 nt, hsa
ccagccauauuacucuagucccuaccaaacugcucuagaaggucauuuccauuuuguuugug

SEQ ID NO: 253162 - RNA, 62 nt, hsa
uugaaaguaagaaaacggauuuaggaugaaaacucuagaacuacccuaugcuguuuauacug

SEQ ID NO: 253163 - RNA, 62 nt, hsa
uacagucagauuuauagccagccaucuaucaccucuagaagguuccagagacagugaaacug

SEQ ID NO: 253164 - RNA, 62 nt, hsa
ccucuuuaaaaaaaaaaaaguuuuuguuauaucucuagaacauuucaagucuuuuccuuuuu

SEQ ID NO: 253165 - RNA, 62 nt, hsa
acagaacguauagaguuaaccaaagugcucuucucuagaaucuuuacaccuccugugugguu

SEQ ID NO: 253166 - RNA, 62 nt, hsa
guccccuaaauuucuguucuaguuuuaaauuucucuagaacuugcaauaguuggggguuuua

SEQ ID NO: 253167 - RNA, 62 nt, hsa
ucucggccuccacauuaaccauaggauguugacucuagaaccuggacccacccagcgcgucc

SEQ ID NO: 253168 - RNA, 62 nt, hsa
uuaauuuucuugugagauaauauucuaagaggcucuagaaacaugaaauacucaguagugau

SEQ ID NO: 253169 - RNA, 53 nt, hsa; identical to SEQ ID NO: 103014

SEQ ID NO: 253170 - RNA, 62 nt, hsa
ggacaccauguacuauaaccaguuaaauggaacucuagaauaucaagggagcaagaggaagc

SEQ ID NO: 253171 - RNA, 62 nt, hsa
aucaaaaacaaagaagcccuauaagaccauuucucuagaacagauguucuuaauauuuuucu

SEQ ID NO: 253172 - RNA, 62 nt, hsa
ggagcauguggucuuuuuaaaaaauuguaacccucuagaaaauaucaaagaaaugaaccaga

SEQ ID NO: 253173 - RNA, 62 nt, hsa
guuacugagaauuguugugcuuugacaguuaacucuagaaagaaagaacacuaccacugcaa

SEQ ID NO: 253174 - RNA, 62 nt, hsa
gaaaaaaguacugugaccugagagacacccuccucuagaauuuaguggcgggucugggcugg

SEQ ID NO: 253175 - RNA, 62 nt, hsa
ugaaacacauguguaacaaucaaaauggugggcucuagaaugguuuuggagcucgagaucuu

SEQ ID NO: 253176 - RNA, 62 nt, hsa
gucuccauucaggcaaguguguuucagcaaaucucuagaaauuuacauugauuaaaauguua

SEQ ID NO: 253177 - RNA, 62 nt, hsa
uugauaauuguuauuuuuuuggcagauaauuccucuagaauguguaucuuuuuaugauuuag

SEQ ID NO: 253178 - RNA, 62 nt, hsa
gacccaacauuucuuagcaugagcuaccucaucucuagaagcugggauggacuuacuauucu

SEQ ID NO: 253179 - RNA, 62 nt, hsa
aaacaccuuaaguguauacuguuguguaaugucucuagaaaggaauccugucuuaaaacugg

SEQ ID NO: 253180 - RNA, 62 nt, hsa
ugcuaccuaaaggauauaaagaaauacuauugcucuagaauguauuacuuuguucucccaug

SEQ ID NO: 253181 - RNA, 62 nt, hsa
gccuagaaccaguuuuaagauuaugccuacaucucuagaagacuaguacacuggcaucaucu

SEQ ID NO: 253182 - RNA, 62 nt, hsa
ccugggcccaaggggugaugaggcauccuuuccucuagaagaccugagucuuccugaccgac

SEQ ID NO: 253183 - RNA, 62 nt, hsa
uagacaaaaaccauuguugaugaggcagaugccucuagaagagacguuuaaaagccaucaaa

SEQ ID NO: 253184 - RNA, 62 nt, hsa
uucaauugcuuuaauuguagaucaagaagcuacucuagaagucggagcagaggaugguacag

SEQ ID NO: 253185 - RNA, 62 nt, hsa
guccuguugccaaacaaaagccagucauguaacucuagaagcagugacugguggggcuuucu

SEQ ID NO: 253186 - RNA, 62 nt, hsa
ugaugcuucuggggcacguugaccauaugcaccucuagaaccuaaccagggcuuccuucuac

SEQ ID NO: 253187 - RNA, 62 nt, hsa
agagcguuccuugaguccguacaccguccucccucuagaagcuggcaucacacucaugcugg

SEQ ID NO: 253188 - RNA, 62 nt, hsa
augaaguuccccaaggaaacgaacaaaaugaacucuagaauaucuagcaaauaguuaaagaa

SEQ ID NO: 253189 - RNA, 62 nt, hsa
gcauggaagagaacaccucuuuauggcuuacccucuagaauuucuaauuuauguguucuguu

SEQ ID NO: 253190 - RNA, 62 nt, hsa
gcaccugggucccagcaucuagagcauggagccucuagaagccaugcucacccgcccacauu

SEQ ID NO: 253191 - RNA, 62 nt, hsa
aucaggaaagagagcaccacgugauggaguuucucuagaagcuccagugauaagagauguug

SEQ ID NO: 253192 - RNA, 62 nt, hsa
agugugacucaaucuugccugccuucugggagcucuagaauuguucccaacccaguccaugg

SEQ ID NO: 253193 - RNA, 62 nt, hsa
cccuuccccagagaccuucagugccauccugacucuagaaggccccccacagcagggcguag

SEQ ID NO: 253194 - RNA, 62 nt, hsa
cuugaaagaaccgaagucuuucccauucacuucucuagaaagcugccaagacagaggcagaa

SEQ ID NO: 253195 - RNA, 62 nt, hsa
gcaggcuccaggcaggguccucugggaaguuacucuagaaaacgaagggaggaggagcacaa

SEQ ID NO: 253196 - RNA, 62 nt, hsa
aaacauaaccauauguguuuugcguuuacuuccucuagaaaagaauuugcaggcaaccaugu

SEQ ID NO: 253197 - RNA, 62 nt, hsa
gaagaaacaacuucuuuaaagagcuucuuuggcucuagaaaaauuucaaacaauuaaaauaa

SEQ ID NO: 253198 - RNA, 62 nt, hsa
aaauaauuuuuuucaaauaagaaaauuguguacucuagaaauggagaccgauuuacaauuua

SEQ ID NO: 253199 - RNA, 62 nt, hsa
acuccuccuccagauaccaacugcugauguugcucuagaaaaaccaccaaacaugacuguuc

SEQ ID NO: 253200 - RNA, 62 nt, hsa
auuaggauuugauuucuugaaacccucuaggucucuagaacacugaggacaguuucuuuuga

SEQ ID NO: 253201 - RNA, 62 nt, hsa
gacuuuauuuucacauaagucaauagauguuucucuagaacaaaauauuuaguaaagcuuua

SEQ ID NO: 253202 - RNA, 62 nt, hsa
uaaaaaauguccaugauggaauauuccccuaucucuagaauuuuaagugcuuuguaauggga

SEQ ID NO: 253203 - RNA, 62 nt, hsa
uaauuuuacacaugcuggaaugacuguaauuacucuagaauuccaaguagaauacaauaacu

SEQ ID NO: 253204 - RNA, 62 nt, hsa
auaacucuuaaaaaaccgucgagauuacaaugcucuagaaucagcauauaagaaaauaaaug

SEQ ID NO: 253205 - RNA, 62 nt, hsa
caauauuacauuacagccuguauucauuuguucucuagaaguuuugucagaauuuugacuug

SEQ ID NO: 253206 - RNA, 62 nt, hsa
uuguaacuacacugggcaucagaauaaaaggccucuagaaauugcugaacaaugguuaauua

SEQ ID NO: 253207 - RNA, 62 nt, hsa
cucuccuucauuaauuuaaauauuuuuaucggcucuagaaaaugcauaagguuaguacaaga

SEQ ID NO: 253208 - RNA, 62 nt, hsa
acucucugcacugacuuuuuaauuauuuaaaacucuagaaagaugaacaaagguuaauuuaa

SEQ ID NO: 253209 - RNA, 62 nt, hsa
cuauucuguugugacuaugagaacauuucugucucuagaagucaucugucuguauugaucuu

SEQ ID NO: 253210 - RNA, 62 nt, hsa
uucuccuauuuaccaguccuguccuauauacccucuagaaacagaaagcaauuuuuaggcag

SEQ ID NO: 253211 - RNA, 62 nt, hsa
gugucacauuucucuaagaugaaagauuuuuacucuagaaacugugcgagcacaacacacac

SEQ ID NO: 253212 - RNA, 62 nt, hsa
agcuuugggaaagcugccucguuucccuuuuccucuagaagcagaaccagcucuacgagagu

SEQ ID NO: 253213 - RNA, 62 nt, hsa
augcccugacucuaccagcgcccauaaaugaucucuagaaggacuguuaguaccaaucuguu

SEQ ID NO: 253214 - RNA, 62 nt, hsa
aaauauaccauaggcuaaaacuaaggcuuucacucuagaaugcaaagcuguuuugcagcugu

SEQ ID NO: 253215 - RNA, 62 nt, hsa
ucccaucugcugcucuuuguagaaaagguuuccucuagaacugaauuccucuggaauugagu

SEQ ID NO: 253216 - RNA, 62 nt, hsa
guaaacauugagcucaccuuuuauauauuaaccucuagaauuaaugggccuaugugguuuuu

SEQ ID NO: 253217 - RNA, 62 nt, hsa
aaaauauuuagcccuuccuugguagguagcuucucuagaauuuaauugugcuuuuuuuuuuu

SEQ ID NO: 253218 - RNA, 62 nt, hsa
acuuugccaaagcugucaucuuguaauauaugcucuagaaaugacauaaagguuuaugggga

SEQ ID NO: 253219 - RNA, 62 nt, hsa
aaccugaaauauuguuuucuuccuugaauuuucucuagaaaugcagaaauuaggaaggugau

SEQ ID NO: 253220 - RNA, 62 nt, hsa
ugaaucuuguuuuuuuuaucuuuaaaauauaucucuagaacuuaaagcugaaaucugcaaau

SEQ ID NO: 253221 - RNA, 62 nt, hsa
accucaagggauuuagugcccugucucccugucucuagaagccuuagccugggcaccuggcu

SEQ ID NO: 253222 - RNA, 62 nt, hsa
gaaaugggaaucaguggucuuacuauauacuucucuagaagagauuacuuaagacuguguca

SEQ ID NO: 253223 - RNA, 62 nt, hsa
auggugggaaacagccaccgagaagguucuagcucuagaaagggacuaaacuuauucucuca

SEQ ID NO: 253224 - RNA, 62 nt, hsa
uucuuacccaguuaacaugaagaaaccacugucucuagaagaaagcuuguuuugcaguauua

SEQ ID NO: 253225 - RNA, 62 nt, hsa
accaguugcacauguuuuccccuaaaagcuuacucuagaaaggauauuuuuuggagagggag

SEQ ID NO: 253226 - RNA, 62 nt, hsa
cuuaucucccucagacgcagaguuuuuaguuucucuagaaauuuuguuucauauuaggaaua

SEQ ID NO: 253227 - RNA, 62 nt, hsa
aucauuaagaugaagagaguaauucacauuuacucuagaaccuuuaacaagcacugaaagga

SEQ ID NO: 253228 - RNA, 62 nt, hsa
gucacaggauuaauuaauugccgguuuucauacucuagaaggcugaaacugauguuuaucuu

SEQ ID NO: 253229 - RNA, 62 nt, hsa
aauauauuucacaucuuuauuauugcaguuuucucuagaaagcucugagaagcuuucucugc

SEQ ID NO: 253230 - RNA, 62 nt, hsa
auugaggaacuguugauuggcaggcacugauucucuagaacacugggcaugaggauguugca

SEQ ID NO: 253231 - RNA, 62 nt, hsa
acuuuucagguaauuauggaaaauauuuuaaacucuagaagcuucaauaaugaugugugauu

SEQ ID NO: 253232 - RNA, 62 nt, hsa
cucugugugcuuugugguugcugucauauuugcucuagaagaaaaaaaaaaaaggaggggaa

SEQ ID NO: 253233 - RNA, 62 nt, hsa
acauuuuauacuuuucauaaaccacaaagucucucuagaauuuuuucugccuucacuaaaau

SEQ ID NO: 253234 - RNA, 62 nt, hsa
cuccugggcucaagugauccucuagacucagccucuagaauagcugggacuacaggcacaug

SEQ ID NO: 253235 - RNA, 62 nt, hsa
agccuuuugggaauaauagcacaugauuugggcucuagaauuccaguccccuuucucggggu

SEQ ID NO: 253236 - RNA, 62 nt, hsa
uguucuucaguauuuuguuuuucucaaaaaugcucuagaacuuuccuuggcacauauaaaag

SEQ ID NO: 253237 - RNA, 62 nt, hsa
uccaauaauguuagaguucauguaaucacauucucuagaaccauuuaguuuguguuaacuau

SEQ ID NO: 253238 - RNA, 62 nt, hsa
agaggucuugcagucuucagaugaaacuaaaucucuagaagaggcacaagaauggcuaaagc

SEQ ID NO: 253239 - RNA, 62 nt, hsa
aaggauccacuacuucuuguucuuaugaaugacucuagaaaaaucagaaucaaguugugggu

SEQ ID NO: 253240 - RNA, 62 nt, hsa
uucacuaaugaucacauucuuuccaaaaggaacucuagaagaccaaaugccccgaguuaaga

SEQ ID NO: 253241 - RNA, 62 nt, hsa
cgugaaauauuuaaguauauaguauauuuauacucuagaacaugcacauuuauauauauaug

SEQ ID NO: 253242 - RNA, 62 nt, hsa
aaaccuaaacucuucaggcuaccuuugugugucucuagaagagaaaagcaucuaucuggaga

SEQ ID NO: 253243 - RNA, 62 nt, hsa
gaauaaacaucagaguauuuuaaaaaacaguucucuagaaagaacuguuauaauuaaaauga

SEQ ID NO: 253244 - RNA, 62 nt, hsa
aacuccugugcuuuugagcaaggacuuuugcccucuagaaagcaacugaggccaggugcggu

SEQ ID NO: 253245 - RNA, 62 nt, hsa
cugugucaaaaugauaauuuuguuauguuagccucuagaaaauuuaaguucagaaaaaugca

SEQ ID NO: 253246 - RNA, 62 nt, hsa
gcuuauagaggcaaaccacaguaucauuuuaacucuagaauugggcuuguacagaaggauaa

SEQ ID NO: 253247 - RNA, 62 nt, hsa
uuuugagucauaggucuguaauuuauagagaucucuagaauucuuauuguaauuuuccuacu

SEQ ID NO: 253248 - RNA, 62 nt, hsa
uuucaacucuguugacccucugucuggucuuccucuagaagguaccgcagaaauugaugugu

SEQ ID NO: 253249 - RNA, 62 nt, hsa
acucagggcuucuccucugcuaggcuacccuccucuagaaggcugaguaccaugggcuacag

SEQ ID NO: 253250 - RNA, 62 nt, hsa
aagaccaaaccccacauccuccuuuccccucucucuagaaucaucucgcaccaccaguuaca

SEQ ID NO: 253251 - RNA, 62 nt, hsa
uugcauugcauucagaguaaccugugugcauacucuagaagaguagggaaaauaaugcuugu

SEQ ID NO: 253252 - RNA, 62 nt, hsa
ggauuaaaaauaaggauaaacacuaauaagagcucuagaaaaaagggaacagaaagucugcc

SEQ ID NO: 253253 - RNA, 60 nt, hsa; identical to SEQ ID NO: 103098

SEQ ID NO: 253254 - RNA, 62 nt, hsa
ugagccaccgcaccuggccuucccugcuuccucucuagaauccaauuagggauguuuguuac

SEQ ID NO: 253255 - RNA, 62 nt, hsa
guuuucauugucaagaauguuacuguaguauucucuagaacuucaaugucuuuguggacauu

SEQ ID NO: 253256 - RNA, 62 nt, hsa
uaauuuuuaagcucuuugccaauauuccauuucucuagaauguuuauccuaagcacuuguuu

SEQ ID NO: 253257 - RNA, 62 nt, hsa
cagcuugcuaaauuaggcuauaccuagguaaucucuagaagacaacucugacagacucuuua

SEQ ID NO: 253258 - RNA, 62 nt, hsa
uuuucaucaugcacgaauuaauaaucaucauacucuagaaucuugucugucacucacuacau

SEQ ID NO: 253259 - RNA, 62 nt, hsa
uucuagguuuguaagugcagcaguuuuauuuccucuagaacucauccuguuucaagggaagu

SEQ ID NO: 253260 - RNA, 62 nt, hsa
uaagaauuuuccacuucuucaaaaugaacuuacucuagaaagcuuacccuuggauaaccagu

SEQ ID NO: 253261 - RNA, 62 nt, hsa
gcuggugaguauuaccuuucaucugugccaugcucuagaaccuugaccuugauaguucacca

SEQ ID NO: 253262 - RNA, 62 nt, hsa
cuuaaugaucaaguguuacuuaucuaauaauccucuagaaagaacccuguuagaucuugguu

SEQ ID NO: 253263 - RNA, 62 nt, hsa
ggggaaacucuggugccggggagggcacgaggcucuagaaaugcccuucacuuucuccuggu

SEQ ID NO: 253264 - RNA, 62 nt, hsa
cuccaccugcccaccgggacacucccccugcucucuagaaaggaacucucuuucuucucuug

SEQ ID NO: 253265 - RNA, 62 nt, hsa
uucuaguuuugacauuuuaugauagauuugcucucuagaaggaaacgucuuuauuuaggagg

SEQ ID NO: 253266 - RNA, 62 nt, hsa
ugcagacucaaaccuucccaacaucuuuaugacucuagaauaaucauauugaugaaaucgua

SEQ ID NO: 253267 - RNA, 62 nt, hsa
uuguuuuuugguuuuuuuuuuuacccagacaacucuagaaaugcggaccaaacuacuucauu

SEQ ID NO: 253268 - RNA, 62 nt, hsa
gugcgugaagaccaacaaagucacagucguaucucuagaaagcucuaaagaccauguuggaa

SEQ ID NO: 253269 - RNA, 62 nt, hsa
auuccugcuuguuaauuacauaauaugugaugcucuagaaaauagucacaaguauuaauaau

SEQ ID NO: 253270 - RNA, 62 nt, hsa
aagaccaaaaacuguaauauccuuuagaaaugcucuagaagaucuguauuguguagaaugau

SEQ ID NO: 253271 - RNA, 62 nt, hsa
augauagccaauggugagggaaaaggagguuucucuagaagagucugaugaaaggccgggaa

SEQ ID NO: 253272 - RNA, 62 nt, hsa
agcuuugucagguuaauguagcauguuaaggacucuagaaaaaaauaaacuaaggagacgag

SEQ ID NO: 253273 - RNA, 62 nt, hsa
uauucggggauaugaaggauucaaugaaugaucucuagaaagauuuaaagaagaauauucag

SEQ ID NO: 253274 - RNA, 62 nt, hsa
guuccacccuaacuuggggaaacaaaagccuucucuagaaucugaaggccaggcuuaccucu

SEQ ID NO: 253275 - RNA, 62 nt, hsa
aggaaucaauaguuaguagugacauuggugcucucuagaaaucucagcaugagcugcuauag

SEQ ID NO: 253276 - RNA, 62 nt, hsa
caggccugcuagcucagccgacgcucuggacacucuagaaaucacuccucagugugaccucc

SEQ ID NO: 253277 - RNA, 62 nt, hsa
uaguccugaguauaaauccugugcauagauuccucuagaaaggcaucaaaaggcucaacaga

SEQ ID NO: 253278 - RNA, 62 nt, hsa
aauggguucagggucuuguccuuagcuacuagcucuagaaaagucccaaaagcagcagaagg

SEQ ID NO: 253279 - RNA, 62 nt, hsa
cuggacuguuccugggaaaagggugaagccaccucuagaagggacuuuggccuccccccaag

SEQ ID NO: 253280 - RNA, 62 nt, hsa
uguguguaugguacuagcacaccacugcaugucucuagaaugcuguugccacuuacgggggc

SEQ ID NO: 253281 - RNA, 62 nt, hsa
ugucuucuaagagcuguucaauacaguauucacucuagaaacaauuaucuuuuucucuuaau

SEQ ID NO: 253282 - RNA, 62 nt, hsa
aauaguaaagguaaaaucucucaguuuccuaccucuagaaagaggccaucucacuagaauag

SEQ ID NO: 253283 - RNA, 62 nt, hsa
cccaaacuuucaccaaaagcaauaaagaggaacucuagaacuggagccaggacuaagugaga

SEQ ID NO: 253284 - RNA, 62 nt, hsa
auucaggagcuuugaaggaaguccaaggaaagcucuagaaaacaguauaaacuuucagaggc

SEQ ID NO: 253285 - RNA, 62 nt, hsa
aucuucuagaagaaaaaucuccgaagagcucucucuagaaguccaaaauggcuagccauuau

SEQ ID NO: 253286 - RNA, 62 nt, hsa
agcugaugucagcuucauguggauuuuaagcacucuagaaacaaugaagcuucuuggcauau

SEQ ID NO: 253287 - RNA, 62 nt, hsa
ccugccacuagguuucaccucccaaacccagccucuagaacagccagacccugcagaucccc

SEQ ID NO: 253288 - RNA, 62 nt, hsa
acagugucuaaauauaagacaauauugaucagcucuagaauaacuuuaaagaaagacguguu

SEQ ID NO: 253289 - RNA, 62 nt, hsa
ucuuugcauuuggcucuacuuacuaacaaccccucuagaauacauuggugauuucauuuaaa

SEQ ID NO: 253290 - RNA, 62 nt, hsa
uguaguacauguuuuuacuaauaauucuuguucucuagaaagcuuucuauuucuaaccuaug

SEQ ID NO: 253291 - RNA, 62 nt, hsa
gaaugguaguugaggucuucauacaguucagccucuagaaugguaacaaaucagccaauugg

SEQ ID NO: 253292 - RNA, 62 nt, hsa
ggaauugagcgguuccccaccuccuaccccuacucuagaaacacacuagacagaugucuccu

SEQ ID NO: 253293 - RNA, 62 nt, hsa
caggguucaguuucauguaucuuugucuuuuccucuagaaccugccuuuuucaaauaucccu

SEQ ID NO: 253294 - RNA, 62 nt, hsa
ugccacugucccaacucuuucccucuacgucucucuagaaugacaucuuuaaaccccuuaca

SEQ ID NO: 253295 - RNA, 62 nt, hsa
gagauuuaguuuuacugcuuugacuggugggucucuagaagcaaaacugagugauaacucau

SEQ ID NO: 253296 - RNA, 62 nt, hsa
cauaguuuuguuuugguuuauuuuuaacaacgcucuagaaacaaagucaaauuaaucacaaa

SEQ ID NO: 253297 - RNA, 62 nt, hsa
cucuuuagaacuugauggcugggcacugccaucucuagaauugccacgagucucucucuucc

SEQ ID NO: 253298 - RNA, 62 nt, hsa
gguguacuaguuacacaucuucaacagacccccucuagaaauuuuucagaugcuucugggag

SEQ ID NO: 253299 - RNA, 62 nt, hsa
gcagcuguggucauuaaaccauuaguuuaccccucuagaacuggggucugcaaacucccacc

SEQ ID NO: 253300 - RNA, 62 nt, hsa
uacagcacuaagagaagccccugagaaaaacccucuagaaaaacagcuguuccucugugugg

SEQ ID NO: 253301 - RNA, 62 nt, hsa
ucccucuguggccuccuggcuugcacugcucccucuagaaagauuccuucaggucuggaggc

SEQ ID NO: 253302 - RNA, 62 nt, hsa
caguggacaguaugcacucagcugaccacucucucuagaaauagucaagauaugaacuaaga

SEQ ID NO: 253303 - RNA, 62 nt, hsa
ccuuguuaugcacaagagauucuauuaaaagccucuagaaguaacuccccuuaaaaugucua

SEQ ID NO: 253304 - RNA, 62 nt, hsa
ccuugugcuagugcccucgagaagaguuauugcucuagaaaguugaguucucauuuuuuuaa

SEQ ID NO: 253305 - RNA, 62 nt, hsa
ucccggcggcaaggagaacagaacacugaagacucuagaaaagcaaagccggauuucuggaa

SEQ ID NO: 253306 - RNA, 62 nt, hsa
auacucugcuucucucugucagcguccugcugcucuagaagacuguccguggaugaguuuag

SEQ ID NO: 253307 - RNA, 62 nt, hsa
agcugaagguguacuucaccagcaagagucaacucuagaauucaggauguuccuucuauugu

SEQ ID NO: 253308 - RNA, 62 nt, hsa
uuuccuuuuuuucuugauuaggucuggaacagcucuagaaugaacacauaaaauuuagcaau

SEQ ID NO: 253309 - RNA, 62 nt, hsa
gugauuuugauguauucuaauuuugagaccaucucuagaaaagaauugcuaccucuuguaug

SEQ ID NO: 253310 - RNA, 62 nt, hsa
ucacuucaagacuuuccuucuuuucacuaaaacucuagaagguguuacaagggggagggaag

SEQ ID NO: 253311 - RNA, 62 nt, hsa
ccuaggcccuagggauccaacuggcugucugccucuagaacucuccacccucaucucucugc

SEQ ID NO: 253312 - RNA, 62 nt, hsa
cugguaaaggggugcuggaggccauggaggagcucuagaaacauuagcaugggcugaucuga

SEQ ID NO: 253313 - RNA, 62 nt, hsa
uauggcauaugucuccgauuuagaugguuauucucuagaaaauaguauuuaaagacauuuua

SEQ ID NO: 253314 - RNA, 62 nt, hsa
ucauccccaccccaccucaccccaacaaacuccucuagaagaagccaagaauuucucucuau

SEQ ID NO: 253315 - RNA, 62 nt, hsa
ugaugcuuggaccccuuuuauugaucagagugcucuagaauaauggauggucuuggaugaug

SEQ ID NO: 253316 - RNA, 62 nt, hsa
cauuauuuuaaugaaugugagcucuugacuuacucuagaauucuaauacagauacuuucugc

SEQ ID NO: 253317 - RNA, 62 nt, hsa
uauuguuugaucuaguuauuuuaauaaaggaacucuagaaguuucaaguggccagugaagug

SEQ ID NO: 253318 - RNA, 62 nt, hsa
aauaaguaggacugaguauuuaugugaaaacucucuagaagguaaaaauaaagauaauucuu

SEQ ID NO: 253319 - RNA, 62 nt, hsa
uuuucuguguaauuccagaugagucacuguaacucuagaagauuaaccuuccagccaaccua

SEQ ID NO: 253320 - RNA, 62 nt, hsa
ccucgcccuuucuuaaagugcaguucuuagcccucuagaaacgaguuggugucuuucgucuc

SEQ ID NO: 253321 - RNA, 62 nt, hsa
ccccaaagcauauaaucucuacuccuuacagucucuagaauuaaauguacucauuuagacaa

SEQ ID NO: 253322 - RNA, 62 nt, hsa
cuaccuuacgugauagcauacaaagaagaaagcucuagaaagagaaauuauggagaaugauu

SEQ ID NO: 253323 - RNA, 62 nt, hsa
cuuaccccacagcugguuacugacaacacaagcucuagaauucauguuuguuuguuuguuuu

SEQ ID NO: 253324 - RNA, 62 nt, hsa
gaaaaauguggauaaacagucaaaccuuuauccucuagaauuuuggcaauguugacuaagaa

SEQ ID NO: 253325 - RNA, 62 nt, hsa
auccugaagaaaugguaaggguggagccaaaucucuagaaauaaguagugaggccguuaauu

SEQ ID NO: 253326 - RNA, 62 nt, hsa
acccugacugugggcuugagaacaaagaugaacucuagaacucuagcagccuaacugcugcu

SEQ ID NO: 253327 - RNA, 62 nt, hsa
accauuugaauauuuucauuugguguuuuccccucuagaaaacagaguugcuguuguuuuuu

SEQ ID NO: 253328 - RNA, 62 nt, hsa
cccagaucucuucccccauuccuucuuuugggcucuagaaagucuugccucauugaguguuu

SEQ ID NO: 253329 - RNA, 62 nt, hsa
uuuaucaagaugaagacauuuuacccuaccuacucuagaaauauacaacaauguuauauuuu

SEQ ID NO: 253330 - RNA, 62 nt, hsa
ggcuaaugcugcauuuuucuacaacaucaugccucuagaagguuuaagcuagguaggcuuuc

SEQ ID NO: 253331 - RNA, 62 nt, hsa
ucuauuaucaacugcugcuucaccagacuuuucucuagaagcugucugcguuuacucuuguu

SEQ ID NO: 253332 - RNA, 62 nt, hsa
ggaacacugaacuaguuggaaauuacugcuuucucuagaaauauaaagcaaagcacuauucc

SEQ ID NO: 253333 - RNA, 62 nt, hsa
uuuucagccacuaagaaccccucugcuuuuaacucuagaauuugggcuuggaccagaucuaa

SEQ ID NO: 253334 - RNA, 62 nt, hsa
ggguuuucccuugccuuaugggcugaaguguucucuagaauccagcaggucacacugggggc

SEQ ID NO: 253335 - RNA, 62 nt, hsa
gucugaggauguuaacuuuggaacucgcaguccucuagaacagcuucagauuauggcuuuuu

SEQ ID NO: 253336 - RNA, 62 nt, hsa
cugcucuccaaugcuaacuuucugacacagugcucuagaacccugccugugguccugagcac

SEQ ID NO: 253337 - RNA, 62 nt, hsa
guugaggaaaugguugggaaucgcuguuagaacucuagaaauucuaaucugacuuugccacu

SEQ ID NO: 253338 - RNA, 62 nt, hsa
ccuggacagccaggggcuccucgggcccugugcucuagaaggcccauucuaugucugcuucg

SEQ ID NO: 253339 - RNA, 62 nt, hsa
aaaagaaucugaacauuuaagugcgaaguuuucucuagaaauauauucaagauauguuuauu

SEQ ID NO: 253340 - RNA, 62 nt, hsa
uuauuuugcucgugcuuagcuaaauaugucaucucuagaaaagaugugguuuguuuuggcac

SEQ ID NO: 253341 - RNA, 62 nt, hsa
cguucaaaugagcguagcccccugagucaucacucuagaagaaucuguacaucaucaggacu

SEQ ID NO: 253342 - RNA, 62 nt, hsa
ugguguucacucuacauaucagguuauggugucucuagaaucuguuguuuguuuccuauaag

SEQ ID NO: 253343 - RNA, 62 nt, hsa
augaagaccuacuuucaacuccuuuuuccccccucuagaagaaucaaauugaaucuuuuacu

SEQ ID NO: 253344 - RNA, 62 nt, hsa
aggugauugguuuucuuuacagacuccuuguucucuagaagggcuuuuuacuugaauaaaac

SEQ ID NO: 253345 - RNA, 62 nt, hsa
uugugaaugagaguuggcaugucaaaugcauccucuagaaaaauaauuaguguuauagucuu

SEQ ID NO: 253346 - RNA, 62 nt, hsa
acauagagccucucucuuuuccuguuucuuggcucuagaagaucagcacugcacuguuagcu

SEQ ID NO: 253347 - RNA, 62 nt, hsa
ggagaauuaucacaaccuaaugacauuaauaccucuagaaagggcugcugucauagugaaca

SEQ ID NO: 253348 - RNA, 62 nt, hsa
acuugcagguccagguugguauacauuccacccucuagaaguauuuucuuacaguagauaag

SEQ ID NO: 253349 - RNA, 62 nt, hsa
auuggugauacuucuaaacuauaacuauaaaucucuagaauucugugaauuucaacauuauu

SEQ ID NO: 253350 - RNA, 62 nt, hsa
caaagucaauggaaauugaacucuagaauugucucuagaaaacauagcuucuuacugaacuu

SEQ ID NO: 253351 - RNA, 51 nt, hsa; identical to SEQ ID NO: 103196

SEQ ID NO: 253352 - RNA, 62 nt, hsa
auuuccuguagaaguagcuuuaaugguuuuugcucuagaauaccguaggucuauccuuagag

SEQ ID NO: 253353 - RNA, 62 nt, hsa
cugccuccugggguccagugacugggacccuacucuagaacuguguaccauccaauucgcca

SEQ ID NO: 253354 - RNA, 62 nt, hsa
cccuguaguugacaauucugcauguacuaguccucuagaaauagguuaaacugaagcaacuu

SEQ ID NO: 253355 - RNA, 62 nt, hsa
acgcacaugcgaccccgaggaaacgaaacccacucuagaaaacgcgaccuuggccgcaccua

SEQ ID NO: 253356 - RNA, 62 nt, hsa
gucugcucccacagcaccaucuaagaccccuccucuagaaguggggaaggccagauguguag

SEQ ID NO: 253357 - RNA, 62 nt, hsa
cuauguauauuuaaauuuaguaauuuucuaaucucuagaaaucucugcuguucaaaaggugg

SEQ ID NO: 253358 - RNA, 62 nt, hsa
uuucuaaaucccaucuugauauacuaugaauacucuagaaugauguaaagcagauaggaaug

SEQ ID NO: 253359 - RNA, 62 nt, hsa
aaucauguacuuuaguuuaauguauaaagauccucuagaaaaugauaauauuguguauuaag

SEQ ID NO: 253360 - RNA, 62 nt, hsa
ucugguggucucaagacaagaacaagagcugacucuagaaucuucugccuggcugaccucug

SEQ ID NO: 253361 - RNA, 62 nt, hsa
gucagugauggcaacaggauggccaaggauggcucuagaacacucuguccaugcgucacucc

SEQ ID NO: 253362 - RNA, 62 nt, hsa
uguccuguccaaugcgggggcacugcagaacucucuagaaaugucaugauugagcuucagag

SEQ ID NO: 253363 - RNA, 62 nt, hsa
acugaauaaucuuugccuggagugacacuacacucuagaauuuccacuuuggagaauacuca

SEQ ID NO: 253364 - RNA, 62 nt, hsa
uuuauuuuguuuucaaccaucaauaaaguuuucucuagaauauuguuuugaacauccuugua

SEQ ID NO: 253365 - RNA, 62 nt, hsa
uauggaaaugcacccucccuccugccgcuccucucuagaaccuucuagaaccugggcugugc

SEQ ID NO: 253366 - RNA, 62 nt, hsa
cuaagggugccaagagacugguuagucaaagccucuagaaggggauccucguugaaaggagc

SEQ ID NO: 253367 - RNA, 62 nt, hsa
auaucuauaaaacaaacauaguaucugucaaucucuagaaaccacaagaugauggagagguc

SEQ ID NO: 253368 - RNA, 62 nt, hsa
uguagggacccugccaaguggcaccugauuuacucuagaaaauaaaaguagaaaauacugag

SEQ ID NO: 253369 - RNA, 62 nt, hsa
ucccugaaguauuuaauaagaagcauuuugcacucuagaaaguauguuuguguugguuuuuu

SEQ ID NO: 253370 - RNA, 62 nt, hsa
guagauuacuuaucagaaaacauauaugucaucucuagaacgaagaaaaagcauaguaguuc

SEQ ID NO: 253371 - RNA, 62 nt, hsa
guaggguauaguaucacuccugaguuccacugcucuagaaucuaaccagaaauagaaaccua

SEQ ID NO: 253372 - RNA, 62 nt, hsa
ccugcucaccauuggagaaucagcucacugcucucuagaaacguggcguuggugaacggacc

SEQ ID NO: 253373 - RNA, 62 nt, hsa
caggacgugaugagguacucgugguucuggagcucuagaaacacuucugaugcaugaaaaau

SEQ ID NO: 253374 - RNA, 62 nt, hsa
auguucagucggucguguuuuuaacacagagucucuagaagaggugcagacaucccgucuga

SEQ ID NO: 253375 - RNA, 62 nt, hsa
ggcaaguguccagaugccagaaccuucuuuuccucuagaagggauggugcuugguaaccuua

SEQ ID NO: 253376 - RNA, 62 nt, hsa
uguaugucgauugauaucgcugcuacaucagacucuagaaaaaagggcugagaggaagcaag

SEQ ID NO: 253377 - RNA, 62 nt, hsa
auaauuccucaagcaugagaccuugcuaagcacucuagaauaaguuuuauguucugcucaca

SEQ ID NO: 253378 - RNA, 62 nt, hsa
acaaaagugcaaauuucucauuuccugugggucucuagaaacucucucaauauuuaaagcca

SEQ ID NO: 253379 - RNA, 62 nt, hsa
gggcuugguaagugaauuuaugagauuuacugcucuagaaaguauagauggccaaaggaccg

SEQ ID NO: 253380 - RNA, 62 nt, hsa
caucugagaugggguccuguuguuuauuaucacucuagaaguuauacauugauauuuauucu

SEQ ID NO: 253381 - RNA, 62 nt, hsa
uuuuuguaacuuuacgcaggacacuuagagcucucuagaaucccacugacuuuagugggucu

SEQ ID NO: 253382 - RNA, 62 nt, hsa
augcccauuugauccuaaccuuuuagccugcucucuagaacccuacuuacaguugaccaagc

SEQ ID NO: 253383 - RNA, 62 nt, hsa
guacggcccccucuuugcaggcuuuuccuccucucuagaaccuccuucuguuggaggcccuc

SEQ ID NO: 253384 - RNA, 62 nt, hsa
ucaggcccccagcccuguggcuuccaccucagcucuagaagccugcucccucugcagggggu

SEQ ID NO: 253385 - RNA, 62 nt, hsa
aaaaaaagaaaaagaacaaaaaauauauaucacucuagaaaauaaaucucuccugugucuua

SEQ ID NO: 253386 - RNA, 62 nt, hsa
aaacacuaacugggggauuuuauuuauaagggcucuagaaaaaacgaguuauucacaccagc

SEQ ID NO: 253387 - RNA, 62 nt, hsa
aaaaaaaaguuuguuaaaaggcuacacgagcucucuagaaacugcugcuacuagaaaugucu

SEQ ID NO: 253388 - RNA, 62 nt, hsa
ggggccauuagaaugaggcagacaccaggccacucuagaagccgagccgucacaccucaggc

SEQ ID NO: 253389 - RNA, 62 nt, hsa
uccccuggcaugaaacuuucagauuccccugccucuagaaauuguccugcccuccucaccac

SEQ ID NO: 253390 - RNA, 62 nt, hsa
acccaugguucucagcuggggugacacugcuccucuagaagcagguuugaaauuauggguau

SEQ ID NO: 253391 - RNA, 62 nt, hsa
cuggcuuuuuguugauuauuaagcuguguucacucuagaagguguaaaggcccugucccaau

SEQ ID NO: 253392 - RNA, 62 nt, hsa
acauucuccuugucugguauaacuuccauguucucuagaaaucaagguuuuguuuguuaauu

SEQ ID NO: 253393 - RNA, 62 nt, hsa
uuucuggugugugaacuuuaugguaacuucuacucuagaauacguacguaugcacccacaga

SEQ ID NO: 253394 - RNA, 62 nt, hsa
agaacccagcccagaucggaggacaaguuccucucuagaacccaauccaauuuggagcccca

SEQ ID NO: 253395 - RNA, 62 nt, hsa
gagccccagcccaacuccagaacccaacccuucucuagaauccagcccagaucugaggccaa

SEQ ID NO: 253396 - RNA, 62 nt, hsa
gugguccaaaugcggaucacuggucagauggacucuagaagcacugagcucccugucucugg

SEQ ID NO: 253397 - RNA, 62 nt, hsa
caaaaagccucaugcauagcgggucauguagucucuagaaaauacauaaccugauggaaaug

SEQ ID NO: 253398 - RNA, 62 nt, hsa
uuauuuauauccuauuuuuucucaccccaucucucuagaaacaccuauaaaggcuauuauug

SEQ ID NO: 253399 - RNA, 62 nt, hsa
uguauaagauccuagauccuaagggucgaaagcucuagaaucugcaauucaaaaguuccaag

SEQ ID NO: 253400 - RNA, 62 nt, hsa
cugccgugauggauucuguuugacguauuguucucuagaaggccuggcucugauccagugac

SEQ ID NO: 253401 - RNA, 62 nt, hsa
uccccacccucugccccccagcccucuggcgucucuagaaacugcugcugauggagaccagg

SEQ ID NO: 253402 - RNA, 62 nt, hsa
ugacggaggaauuaacacaaaagcagacaacacucuagaacuggagagagguccagauugcg

SEQ ID NO: 253403 - RNA, 62 nt, hsa
cagccccuccccuacuuuuuggucagcuacgucucuagaauaagaugguaucugaaguccuu

SEQ ID NO: 253404 - RNA, 62 nt, hsa
uuguuucucucccugggccucaguuuccccaucucuagaaugaggauguuggggaaaauccc

SEQ ID NO: 253405 - RNA, 62 nt, hsa
gaaauucaguaauauuugacauuuuuauuuaucucuagaaguuucucuaaaauuguacucag

SEQ ID NO: 253406 - RNA, 62 nt, hsa
aguacagugaugagcaugccuaaauccauguucucuagaauguaagcuuggugaaagaaggg

SEQ ID NO: 253407 - RNA, 62 nt, hsa
agacuguucugggguagcagagucacagaucacucuagaaucuaauacuugguaauuauacu

SEQ ID NO: 253408 - RNA, 62 nt, hsa
ccccaggaauggggaacucucccucuggucuacucuagaagagggguuacuucuccccuggg

SEQ ID NO: 253409 - RNA, 62 nt, hsa
cccaucuccuuucagaaaaauucaagguccuccucuagaaguuucaaaucucucccaacucu

SEQ ID NO: 253410 - RNA, 62 nt, hsa
aggcccuggguucaagagaguuggagaaaccccucuagaaacauauuggcugucaucaaagg

SEQ ID NO: 253411 - RNA, 62 nt, hsa
aaauuccuuaacugagcuauacuugguacuugcucuagaacauuugggaaaugacaaacuca

SEQ ID NO: 253412 - RNA, 62 nt, hsa
ucucuuccagcaccaucaggguuuuaauggcccucuagaauuaccacugagauacacuauuu

SEQ ID NO: 253413 - RNA, 62 nt, hsa
gaagaaucugggccaaccagggguccuugggccucuagaaggccacaguaggccucucuuug

SEQ ID NO: 253414 - RNA, 62 nt, hsa
ucugcuggugccuugaucuuggacuucccagccucuagaacuguaagaaauaaauauuugcu

SEQ ID NO: 253415 - RNA, 62 nt, hsa
aagggcccaaggacagugccuuaguuuggauccucuagaaacuaacccugggaaaagggcau

SEQ ID NO: 253416 - RNA, 62 nt, hsa
guauaacuuauuuucuuauuaucuucuucucccucuagaauauaaauuuaugaaaauacaaa

SEQ ID NO: 253417 - RNA, 62 nt, hsa
gcguggaaggagcaaugcagacacagugaaaucucuagaaucugcuuuguuuuguaagaacu

SEQ ID NO: 253418 - RNA, 62 nt, hsa
guuaaaccaaacuacagucucagccugucauucucuagaacacauccaggugucggagcuaa

SEQ ID NO: 253419 - RNA, 62 nt, hsa
gucagggacccccauaaaggacacccccuucucucuagaaagagcugggcucucagcuauuu

SEQ ID NO: 253420 - RNA, 62 nt, hsa
agacgggggcugcuucuccucuucaguauggacucuagaaagucuggcuacaugaauagauu

SEQ ID NO: 253421 - RNA, 62 nt, hsa
gugcuaacuugggccagcgggguuugggguaucucuagaaaacagcaacugaacagagcucc

SEQ ID NO: 253422 - RNA, 62 nt, hsa
gcgugacccaggccccuguagcccucagccuccucuagaagcuucuguacuccuuguaggau

SEQ ID NO: 253423 - RNA, 62 nt, hsa
gccguggccacccccgcugcccagugucugcccucuagaaguaggcuguguuuccagguguu

SEQ ID NO: 253424 - RNA, 62 nt, hsa
aaacaggaaagucgcauuauuuucccauucuacucuagaaagcauggaaauuaaguguuucg

SEQ ID NO: 253425 - RNA, 62 nt, hsa
caacuauuuuguaaaugcaaguuuuuuaguagcucuagaaacauuuuuaagaaggagggaau

SEQ ID NO: 253426 - RNA, 62 nt, hsa
gaccagcucagaggauggggcuguccccugggcucuagaaagaacauucugugucaccagca

SEQ ID NO: 253427 - RNA, 62 nt, hsa
aagaggcugggggacuagaaagaggcccugcccucuagaaagcucagaucuuggcuucuguu

SEQ ID NO: 253428 - RNA, 62 nt, hsa
cuuccaagaaugccucuguggugcuguuuggucucuagaaacagggucacuuuuuuaaugua

SEQ ID NO: 253429 - RNA, 62 nt, hsa
gacugcugcuguuaaaaaacaugcauuagaaucucuagaacacgaggaaaaacagggucuug

SEQ ID NO: 253430 - RNA, 62 nt, hsa
ugugcaaugauuguuaaauuauacugaaguagcucuagaaagacacauguauacaaggcacu

SEQ ID NO: 253431 - RNA, 62 nt, hsa
ccguaguagauguucuacuuuguucugcuguucucuagaaagaauauuugguuuuccuguau

SEQ ID NO: 253432 - RNA, 62 nt, hsa
acacaucagcauaugagaaucucugagagguccucuagaaaggagagaaaaagcaccucuuu

SEQ ID NO: 253433 - RNA, 62 nt, hsa
gauucauauauuacaucaacuucccuuuuuaacucuagaaauucucaguaugggguuucccu

SEQ ID NO: 253434 - RNA, 62 nt, hsa
ggguuccuauggccuuguuggagggggccaggcucuagaacgucuaacacaguggagaaccg

SEQ ID NO: 253435 - RNA, 62 nt, hsa
ugaucacgaucauauuguagucucucaaagugcucuagaaauugucagugguuuacaugaag

SEQ ID NO: 253436 - RNA, 62 nt, hsa
acuauagugauauaucaguguuugagagugaccucuagaaaaaagaaaaguguuuuuagaaa

SEQ ID NO: 253437 - RNA, 62 nt, hsa
ccacccaguagcccagagugagcuuuagcucucucuagaaugagcaagacugggccccacau

SEQ ID NO: 253438 - RNA, 62 nt, hsa
guugugcaggagguagccuggugguuuucaaccucuagaauuuuaagccuuuguugaacugu

SEQ ID NO: 253439 - RNA, 62 nt, hsa
guuuggaguaagggacuucauauaccugauuccucuagaaggcugucuaacauaccacauga

SEQ ID NO: 253440 - RNA, 62 nt, hsa
gauauauuacuacuuauaauacuguggcuagucucuagaauggauguugaaaucuuugccuc

SEQ ID NO: 253441 - RNA, 62 nt, hsa
gugaacugaggaaggugcuuagauggugagggcucuagaaaccaagccccaugagcagcagu

SEQ ID NO: 253442 - RNA, 62 nt, hsa
acuauagugauauaucaguguuugggagugaccucuagaaaaaagaaaacuguuuuuagaaa

SEQ ID NO: 253443 - RNA, 62 nt, hsa
gccgcauccugccuguagauggccggggaaggcucuagaaaaggggcgcauugcgauccaac

SEQ ID NO: 253444 - RNA, 66 nt, hsa
agaagaccguacucaguaacaggccggaaaauugugcucuagaagaauaaaacugaaaaacucuag

SEQ ID NO: 253445 - RNA, 66 nt, hsa
ggucauaagguaaacauucuauauauucuaugccugcucuagaauugaaagacuucagcaguauua

SEQ ID NO: 253446 - RNA, 66 nt, hsa
aaacuccacaucugccuuaaaaccaaagagggcuuccucuagaagccaagggaaaggggugcuuuu

SEQ ID NO: 253447 - RNA, 66 nt, hsa
agaaggaacauuauggagagaaaggguacugaggcacucuagaaucugccacauucauuuucaaau

SEQ ID NO: 253448 - RNA, 66 nt, hsa
gugaggcagcuggaauuggaacucagauuuguugaacucuagaacuaaagaucauaauguugucuu

SEQ ID NO: 253449 - RNA, 66 nt, hsa
aguuucagaguucaaggaagaagcaaaauaucacaucucuagaaguguugggaaaaauauaauuuc

SEQ ID NO: 253450 - RNA, 66 nt, hsa
uuuacuccuaaguuauuucucauagaacccagccuacucuagaauuucagcagugacauuggagaa

SEQ ID NO: 253451 - RNA, 66 nt, hsa
ucaaaauacaccagcucauuuggcugcucagucuaacucuagaauggaugcuuuugaauucauuuc

SEQ ID NO: 253452 - RNA, 66 nt, hsa
uguuagagaggaauuaacuuccuggucugugcccuucucuagaagaauauaagaugcuccuccucc

SEQ ID NO: 253453 - RNA, 66 nt, hsa
cuggcugggaggaaagugcugggcaucuuacaguaacucuagaaguuccuuugacuaggcugcaau

SEQ ID NO: 253454 - RNA, 66 nt, hsa
acccugaagccauuggagagcugucuuccuguguaccucuagaaucccagcagcagagaaccauca

SEQ ID NO: 253455 - RNA, 58 nt, hsa; identical to SEQ ID NO: 102991

SEQ ID NO: 253456 - RNA, 66 nt, hsa
gagagaaguauguggacaucucuucuuuuccugucccucuagaagaacauucucccuugcuugaug

SEQ ID NO: 253457 - RNA, 66 nt, hsa
gucuuaagauccucacagcacgggagcagggagaggcucuagaacaagguuucacaaccgagaugc

SEQ ID NO: 253458 - RNA, 66 nt, hsa
caucucauuacccuuuucuggguuugaagcugcugucucuagaagugccaucucaauugugcuuug

SEQ ID NO: 253459 - RNA, 66 nt, hsa
aaguguccagaccauugucuuccaaccccagcuggccucuagaacacccacuggccaguccuagag

SEQ ID NO: 253460 - RNA, 66 nt, hsa
cuguguuaucaaggaauuguacugugcuacaauuaucucuagaaucuccagaaagguggagggcug

SEQ ID NO: 253461 - RNA, 66 nt, hsa
gugaguccugauccuaacccugggcucccuggaggacucuagaagcucagguucccugccacacua

SEQ ID NO: 253462 - RNA, 66 nt, hsa
ggcucuguuuugcccaggggcucccgcuuuuucuugcucuagaagagcaguauucaaccuuuuagc

SEQ ID NO: 253463 - RNA, 66 nt, hsa
guccagacuauggauguguucucuaggccuucaggacucuagaauguccauauuuauuuuuauguu

SEQ ID NO: 253464 - RNA, 66 nt, hsa
uugcaguaacaaacuccagucuguugcaguaacaaacucuagaauauugacauucucuguggggga

SEQ ID NO: 253465 - RNA, 66 nt, hsa
ucaucccucuuagcuguagucuauauuagggcaguucucuagaacgcccacauuuccaccaacuca

SEQ ID NO: 253466 - RNA, 66 nt, hsa
cagcuaguagguucugcuguuaugcagagccauuuccucuagaauuuggauaauaaagaugcuuau

SEQ ID NO: 253467 - RNA, 66 nt, hsa
uuaaugacaauguagcuugaaagcgaugaagaaugucucuagaagagaaugaaggauugaagaauu

SEQ ID NO: 253468 - RNA, 66 nt, hsa
aauugaauauauugguugcucauuuuugaagagagucucuagaauauagauuuucacuucuuuuga

SEQ ID NO: 253469 - RNA, 66 nt, hsa
cauaugauaugauaauccuaccaauuuucaagaagucucuagaaagagauaacacauggaaagacg

SEQ ID NO: 253470 - RNA, 66 nt, hsa
aaagccagccauauuacucuagucccuaccaaacugcucuagaaggucauuuccauuuuguuugug

SEQ ID NO: 253471 - RNA, 66 nt, hsa
aagauugaaaguaagaaaacggauuuaggaugaaaacucuagaacuacccuaugcuguuuauacug

SEQ ID NO: 253472 - RNA, 66 nt, hsa
caacuacagucagauuuauagccagccaucuaucaccucuagaagguuccagagacagugaaacug

SEQ ID NO: 253473 - RNA, 66 nt, hsa
ggauccucuuuaaaaaaaaaaaaguuuuuguuauaucucuagaacauuucaagucuuuuccuuuuu

SEQ ID NO: 253474 - RNA, 66 nt, hsa
agccacagaacguauagaguuaaccaaagugcucuucucuagaaucuuuacaccuccugugugguu

SEQ ID NO: 253475 - RNA, 66 nt, hsa
ucuaguccccuaaauuucuguucuaguuuuaaauuucucuagaacuugcaauaguuggggguuuua

SEQ ID NO: 253476 - RNA, 66 nt, hsa
caagucucggccuccacauuaaccauaggauguugacucuagaaccuggacccacccagcgcgucc

SEQ ID NO: 253477 - RNA, 66 nt, hsa
ucuuuuaauuuucuugugagauaauauucuaagaggcucuagaaacaugaaauacucaguagugau

SEQ ID NO: 253478 - RNA, 53 nt, hsa; identical to SEQ ID NO: 103014

SEQ ID NO: 253479 - RNA, 66 nt, hsa
cugaggacaccauguacuauaaccaguuaaauggaacucuagaauaucaagggagcaagaggaagc

SEQ ID NO: 253480 - RNA, 66 nt, hsa
uguaaucaaaaacaaagaagcccuauaagaccauuucucuagaacagauguucuuaauauuuuucu

SEQ ID NO: 253481 - RNA, 66 nt, hsa
guuuggagcauguggucuuuuuaaaaaauuguaacccucuagaaaauaucaaagaaaugaaccaga

SEQ ID NO: 253482 - RNA, 66 nt, hsa
aacaguuacugagaauuguugugcuuugacaguuaacucuagaaagaaagaacacuaccacugcaa

SEQ ID NO: 253483 - RNA, 66 nt, hsa
ugaagaaaaaaguacugugaccugagagacacccuccucuagaauuuaguggcgggucugggcugg

SEQ ID NO: 253484 - RNA, 66 nt, hsa
caucugaaacacauguguaacaaucaaaauggugggcucuagaaugguuuuggagcucgagaucuu

SEQ ID NO: 253485 - RNA, 66 nt, hsa
gauggucuccauucaggcaaguguguuucagcaaaucucuagaaauuuacauugauuaaaauguua

SEQ ID NO: 253486 - RNA, 66 nt, hsa
aucuuugauaauuguuauuuuuuuggcagauaauuccucuagaauguguaucuuuuuaugauuuag

SEQ ID NO: 253487 - RNA, 66 nt, hsa
aaaugacccaacauuucuuagcaugagcuaccucaucucuagaagcugggauggacuuacuauucu

SEQ ID NO: 253488 - RNA, 66 nt, hsa
ccagaaacaccuuaaguguauacuguuguguaaugucucuagaaaggaauccugucuuaaaacugg

SEQ ID NO: 253489 - RNA, 66 nt, hsa
guccugcuaccuaaaggauauaaagaaauacuauugcucuagaauguauuacuuuguucucccaug

SEQ ID NO: 253490 - RNA, 66 nt, hsa
aaaggccuagaaccaguuuuaagauuaugccuacaucucuagaagacuaguacacuggcaucaucu

SEQ ID NO: 253491 - RNA, 66 nt, hsa
gcugccugggcccaaggggugaugaggcauccuuuccucuagaagaccugagucuuccugaccgac

SEQ ID NO: 253492 - RNA, 66 nt, hsa
cuucuagacaaaaaccauuguugaugaggcagaugccucuagaagagacguuuaaaagccaucaaa

SEQ ID NO: 253493 - RNA, 66 nt, hsa
gagaaguuccacaucaucuuaucgaucaagaagcuacucuagaagucggagcagaggaugguacag

SEQ ID NO: 253494 - RNA, 66 nt, hsa
uauuguccuguugccaaacaaaagccagucauguaacucuagaagcagugacugguggggcuuucu

SEQ ID NO: 253495 - RNA, 66 nt, hsa
auugugaugcuucuggggcacguugaccauaugcaccucuagaaccuaaccagggcuuccuucuac

SEQ ID NO: 253496 - RNA, 66 nt, hsa
caugagagcguuccuugaguccguacaccguccucccucuagaagcuggcaucacacucaugcugg

SEQ ID NO: 253497 - RNA, 66 nt, hsa
uaauaugaaguuccccaaggaaacgaacaaaaugaacucuagaauaucuagcaaauaguuaaagaa

SEQ ID NO: 253498 - RNA, 66 nt, hsa
aguugcauggaagagaacaccucuuuauggcuuacccucuagaauuucuaauuuauguguucuguu

SEQ ID NO: 253499 - RNA, 66 nt, hsa
ucuagcaccugggucccagcaucuagagcauggagccucuagaagccaugcucacccgcccacauu

SEQ ID NO: 253500 - RNA, 66 nt, hsa
acacaucaggaaagagagcaccacgugauggaguuucucuagaagcuccagugauaagagauguug

SEQ ID NO: 253501 - RNA, 66 nt, hsa
uggaagugugacucaaucuugccugccuucugggagcucuagaauuguucccaacccaguccaugg

SEQ ID NO: 253502 - RNA, 66 nt, hsa
ucgucccuuccccagagaccuucagugccauccugacucuagaaggccccccacagcagggcguag

SEQ ID NO: 253503 - RNA, 66 nt, hsa
uggccuugaaagaaccgaagucuuucccauucacuucucuagaaagcugccaagacagaggcagaa

SEQ ID NO: 253504 - RNA, 66 nt, hsa
cuuggcaggcuccaggcaggguccucugggaaguuacucuagaaaacgaagggaggaggagcacaa

SEQ ID NO: 253505 - RNA, 66 nt, hsa
agcaaaacauaaccauauguguuuugcguuuacuuccucuagaaaagaauuugcaggcaaccaugu

SEQ ID NO: 253506 - RNA, 66 nt, hsa
uuuggaagaaacaacuucuuuaaagagcuucuuuggcucuagaaaaauuucaaacaauuaaaauaa

SEQ ID NO: 253507 - RNA, 66 nt, hsa
uaagaaauaauuuuuuucaaauaagaaaauuguguacucuagaaauggagaccgauuuacaauuua

SEQ ID NO: 253508 - RNA, 66 nt, hsa
cauuacuccuccuccagauaccaacugcugauguugcucuagaaaaaccaccaaacaugacuguuc

SEQ ID NO: 253509 - RNA, 66 nt, hsa
acugauuaggauuugauuucuugaaacccucuaggucucuagaacacugaggacaguuucuuuuga

SEQ ID NO: 253510 - RNA, 66 nt, hsa
augggacuuuauuuucacauaagucaauagauguuucucuagaacaaaauauuuaguaaagcuuua

SEQ ID NO: 253511 - RNA, 66 nt, hsa
cacuuaaaaaauguccaugauggaauauuccccuaucucuagaauuuuaagugcuuuguaauggga

SEQ ID NO: 253512 - RNA, 66 nt, hsa
aagguaauuuuacacaugcuggaaugacuguaauuacucuagaauuccaaguagaauacaauaacu

SEQ ID NO: 253513 - RNA, 66 nt, hsa
aaagauaacucuuaaaaaaccgucgagauuacaaugcucuagaaucagcauauaagaaaauaaaug

SEQ ID NO: 253514 - RNA, 66 nt, hsa
aauacaauauuacauuacagccuguauucauuuguucucuagaaguuuugucagaauuuugacuug

SEQ ID NO: 253515 - RNA, 66 nt, hsa
ccuauuguaacuacacugggcaucagaauaaaaggccucuagaaauugcugaacaaugguuaauua

SEQ ID NO: 253516 - RNA, 66 nt, hsa
agcucucuccuucauuaauuuaaauauuuuuaucggcucuagaaaaugcauaagguuaguacaaga

SEQ ID NO: 253517 - RNA, 66 nt, hsa
uuucacucucugcacugacuuuuuaauuauuuaaaacucuagaaagaugaacaaagguuaauuuaa

SEQ ID NO: 253518 - RNA, 66 nt, hsa
acaacuauucuguugugacuaugagaacauuucugucucuagaagucaucugucuguauugaucuu

SEQ ID NO: 253519 - RNA, 66 nt, hsa
cccauucuccuauuuaccaguccuguccuauauacccucuagaaacagaaagcaauuuuuaggcag

SEQ ID NO: 253520 - RNA, 66 nt, hsa
cuaagugucacauuucucuaagaugaaagauuuuuacucuagaaacugugcgagcacaacacacac

SEQ ID NO: 253521 - RNA, 66 nt, hsa
cugcagcuuugggaaagcugccucguuucccuuuuccucuagaagcagaaccagcucuacgagagu

SEQ ID NO: 253522 - RNA, 66 nt, hsa
uugaaugcccugacucuaccagcgcccauaaaugaucucuagaaggacuguuaguaccaaucuguu

SEQ ID NO: 253523 - RNA, 66 nt, hsa
aacaaaauauaccauaggcuaaaacuaaggcuuucacucuagaaugcaaagcuguuuugcagcugu

SEQ ID NO: 253524 - RNA, 66 nt, hsa
ugauucccaucugcugcucuuuguagaaaagguuuccucuagaacugaauuccucuggaauugagu

SEQ ID NO: 253525 - RNA, 66 nt, hsa
cuguguaaacauugagcucaccuuuuauauauuaaccucuagaauuaaugggccuaugugguuuuu

SEQ ID NO: 253526 - RNA, 66 nt, hsa
aaauaaaauauuuagcccuuccuugguagguagcuucucuagaauuuaauugugcuuuuuuuuuuu

SEQ ID NO: 253527 - RNA, 66 nt, hsa
uuauacuuugccaaagcugucaucuuguaauauaugcucuagaaaugacauaaagguuuaugggga

SEQ ID NO: 253528 - RNA, 66 nt, hsa
cuagaaccugaaauauuguuuucuuccuugaauuuucucuagaaaugcagaaauuaggaaggugau

SEQ ID NO: 253529 - RNA, 66 nt, hsa
agggugaaucuuguuuuuuuuaucuuuaaaauauaucucuagaacuuaaagcugaaaucugcaaau

SEQ ID NO: 253530 - RNA, 66 nt, hsa
acaaaccucaagggauuuagugcccugucucccugucucuagaagccuuagccugggcaccuggcu

SEQ ID NO: 253531 - RNA, 66 nt, hsa
aaaugaaaugggaaucaguggucuuacuauauacuucucuagaagagauuacuuaagacuguguca

SEQ ID NO: 253532 - RNA, 66 nt, hsa
ucccauggugggaaacagccaccgagaagguucuagcucuagaaagggacuaaacuuauucucuca

SEQ ID NO: 253533 - RNA, 66 nt, hsa
ccaguucuuacccaguuaacaugaagaaaccacugucucuagaagaaagcuuguuuugcaguauua

SEQ ID NO: 253534 - RNA, 66 nt, hsa
ugugaccaguugcacauguuuuccccuaaaagcuuacucuagaaaggauauuuuuuggagagggag

SEQ ID NO: 253535 - RNA, 66 nt, hsa
uuuccuuaucucccucagacgcagaguuuuuaguuucucuagaaauuuuguuucauauuaggaaua

SEQ ID NO: 253536 - RNA, 66 nt, hsa
auggaucauuaagaugaagagaguaauucacauuuacucuagaaccuuuaacaagcacugaaagga

SEQ ID NO: 253537 - RNA, 66 nt, hsa
uucugucacaggauuaauuaauugccgguuuucauacucuagaaggcugaaacugauguuuaucuu

SEQ ID NO: 253538 - RNA, 66 nt, hsa
gaauaauauauuucacaucuuuauuauugcaguuuucucuagaaagcucugagaagcuuucucugc

SEQ ID NO: 253539 - RNA, 66 nt, hsa
auucauugaggaacuguugauuggcaggcacugauucucuagaacacugggcaugaggauguugca

SEQ ID NO: 253540 - RNA, 66 nt, hsa
cuuuacuuuucagguaauuauggaaaauauuuuaaacucuagaagcuucaauaaugaugugugauu

SEQ ID NO: 253541 - RNA, 66 nt, hsa
guuucucugugugcuuugugguugcugucauauuugcucuagaagaaaaaaaaaaaaggaggggaa

SEQ ID NO: 253542 - RNA, 66 nt, hsa
cuacacauuuuauacuuuucauaaaccacaaagucucucuagaauuuuuucugccuucacuaaaau

SEQ ID NO: 253543 - RNA, 66 nt, hsa
ccagcuccugggcucaagugauccucuagacucagccucuagaauagcugggacuacaggcacaug

SEQ ID NO: 253544 - RNA, 66 nt, hsa
acucagccuuuugggaauaauagcacaugauuugggcucuagaauuccaguccccuuucucggggu

SEQ ID NO: 253545 - RNA, 66 nt, hsa
gucuuguucuucaguauuuuguuuuucucaaaaaugcucuagaacuuuccuuggcacauauaaaag

SEQ ID NO: 253546 - RNA, 66 nt, hsa
uucuuccaauaauguuagaguucauguaaucacauucucuagaaccauuuaguuuguguuaacuau

SEQ ID NO: 253547 - RNA, 66 nt, hsa
uugaagaggucuugcagucuucagaugaaacuaaaucucuagaagaggcacaagaauggcuaaagc

SEQ ID NO: 253548 - RNA, 66 nt, hsa
aagaaaggauccacuacuucuuguucuuaugaaugacucuagaaaaaucagaaucaaguugugggu

SEQ ID NO: 253549 - RNA, 66 nt, hsa
aaacuucacuaaugaucacauucuuuccaaaaggaacucuagaagaccaaaugccccgaguuaaga

SEQ ID NO: 253550 - RNA, 66 nt, hsa
gucacgugaaauauuuaaguauauaguauauuuauacucuagaacaugcacauuuauauauauaug

SEQ ID NO: 253551 - RNA, 66 nt, hsa
uaaaaaaccuaaacucuucaggcuaccuuugugugucucuagaagagaaaagcaucuaucuggaga

SEQ ID NO: 253552 - RNA, 66 nt, hsa
cacugaauaaacaucagaguauuuuaaaaaacaguucucuagaaagaacuguuauaauuaaaauga

SEQ ID NO: 253553 - RNA, 66 nt, hsa
agaaaacuccugugcuuuugagcaaggacuuuugcccucuagaaagcaacugaggccaggugcggu

SEQ ID NO: 253554 - RNA, 66 nt, hsa
uauacugugucaaaaugauaauuuuguuauguuagccucuagaaaauuuaaguucagaaaaaugca

SEQ ID NO: 253555 - RNA, 66 nt, hsa
ucuugcuuauagaggcaaaccacaguaucauuuuaacucuagaauugggcuuguacagaaggauaa

SEQ ID NO: 253556 - RNA, 66 nt, hsa
aggauuuugagucauaggucuguaauuuauagagaucucuagaauucuuauuguaauuuuccuacu

SEQ ID NO: 253557 - RNA, 66 nt, hsa
cuccuuucaacucuguugacccucugucuggucuuccucuagaagguaccgcagaaauugaugugu

SEQ ID NO: 253558 - RNA, 66 nt, hsa
uuccacucagggcuucuccucugcuaggcuacccuccucuagaaggcugaguaccaugggcuacag

SEQ ID NO: 253559 - RNA, 66 nt, hsa
ugagaagaccaaaccccacauccuccuuuccccucucucuagaaucaucucgcaccaccaguuaca

SEQ ID NO: 253560 - RNA, 66 nt, hsa
cuuauugcauugcauucagaguaaccugugugcauacucuagaagaguagggaaaauaaugcuugu

SEQ ID NO: 253561 - RNA, 66 nt, hsa
acagggauuaaaaauaaggauaaacacuaauaagagcucuagaaaaaagggaacagaaagucugcc

SEQ ID NO: 253562 - RNA, 60 nt, hsa; identical to SEQ ID NO: 103098

SEQ ID NO: 253563 - RNA, 66 nt, hsa
ggcaugagccaccgcaccuggccuucccugcuuccucucuagaauccaauuagggauguuuguuac

SEQ ID NO: 253564 - RNA, 66 nt, hsa
uuccguuuucauugucaagaauguuacuguaguauucucuagaacuucaaugucuuuguggacauu

SEQ ID NO: 253565 - RNA, 66 nt, hsa
uguuuaauuuuuaagcucuuugccaauauuccauuucucuagaauguuuauccuaagcacuuguuu

SEQ ID NO: 253566 - RNA, 66 nt, hsa
aacccagcuugcuaaauuaggcuauaccuagguaaucucuagaagacaacucugacagacucuuua

SEQ ID NO: 253567 - RNA, 66 nt, hsa
auauuuuucaucaugcacgaauuaauaaucaucauacucuagaaucuugucugucacucacuacau

SEQ ID NO: 253568 - RNA, 66 nt, hsa
auauuucuagguuuguaagugcagcaguuuuauuuccucuagaacucauccuguuucaagggaagu

SEQ ID NO: 253569 - RNA, 66 nt, hsa
ccucuaagaauuuuccacuucuucaaaaugaacuuacucuagaaagcuuacccuuggauaaccagu

SEQ ID NO: 253570 - RNA, 66 nt, hsa
aggugcuggugaguauuaccuuucaucugugccaugcucuagaaccuugaccuugauaguucacca

SEQ ID NO: 253571 - RNA, 66 nt, hsa
cgugcuuaaugaucaaguguuacuuaucuaauaauccucuagaaagaacccuguuagaucuugguu

SEQ ID NO: 253572 - RNA, 66 nt, hsa
ggcaggggaaacucuggugccggggagggcacgaggcucuagaaaugcccuucacuuucuccuggu

SEQ ID NO: 253573 - RNA, 66 nt, hsa
ccuucuccaccugcccaccgggacacucccccugcucucuagaaaggaacucucuuucuucucuug

SEQ ID NO: 253574 - RNA, 66 nt, hsa
ucucuucuaguuuugacauuuuaugauagauuugcucucuagaaggaaacgucuuuauuuaggagg

SEQ ID NO: 253575 - RNA, 66 nt, hsa
caaaugcagacucaaaccuucccaacaucuuuaugacucuagaauaaucauauugaugaaaucgua

SEQ ID NO: 253576 - RNA, 66 nt, hsa
guuuuuguuuuuugguuuuuuuuuuuacccagacaacucuagaaaugcggaccaaacuacuucauu

SEQ ID NO: 253577 - RNA, 66 nt, hsa
cccagugcgugaagaccaacaaagucacagucguaucucuagaaagcucuaaagaccauguuggaa

SEQ ID NO: 253578 - RNA, 66 nt, hsa
cugaauuccugcuuguuaauuacauaauaugugaugcucuagaaaauagucacaaguauuaauaau

SEQ ID NO: 253579 - RNA, 66 nt, hsa
ccuuaagaccaaaaacuguaauauccuuuagaaaugcucuagaagaucuguauuguguagaaugau

SEQ ID NO: 253580 - RNA, 66 nt, hsa
caacaugauagccaauggugagggaaaaggagguuucucuagaagagucugaugaaaggccgggaa

SEQ ID NO: 253581 - RNA, 66 nt, hsa
auuaagcuuugucagguuaauguagcauguuaaggacucuagaaaaaaauaaacuaaggagacgag

SEQ ID NO: 253582 - RNA, 66 nt, hsa
cuuauauucggggauaugaaggauucaaugaaugaucucuagaaagauuuaaagaagaauauucag

SEQ ID NO: 253583 - RNA, 66 nt, hsa
auggguuccacccuaacuuggggaaacaaaagccuucucuagaaucugaaggccaggcuuaccucu

SEQ ID NO: 253584 - RNA, 66 nt, hsa
aaauaggaaucaauaguuaguagugacauuggugcucucuagaaaucucagcaugagcugcuauag

SEQ ID NO: 253585 - RNA, 66 nt, hsa
cuaacaggccugcuagcucagccgacgcucuggacacucuagaaaucacuccucagugugaccucc

SEQ ID NO: 253586 - RNA, 66 nt, hsa
cuccuaguccugaguauaaauccugugcauagauuccucuagaaaggcaucaaaaggcucaacaga

SEQ ID NO: 253587 - RNA, 66 nt, hsa
aaaaaauggguucagggucuuguccuuagcuacuagcucuagaaaagucccaaaagcagcagaagg

SEQ ID NO: 253588 - RNA, 66 nt, hsa
gaaacuggacuguuccugggaaaagggugaagccaccucuagaagggacuuuggccuccccccaag

SEQ ID NO: 253589 - RNA, 66 nt, hsa
guguuguguguaugguacuagcacaccacugcaugucucuagaaugcuguugccacuuacgggggc

SEQ ID NO: 253590 - RNA, 66 nt, hsa
uacgugucuucuaagagcuguucaauacaguauucacucuagaaacaauuaucuuuuucucuuaau

SEQ ID NO: 253591 - RNA, 66 nt, hsa
uauuaauaguaaagguaaaaucucucaguuuccuaccucuagaaagaggccaucucacuagaauag

SEQ ID NO: 253592 - RNA, 66 nt, hsa
caaccccaaacuuucaccaaaagcaauaaagaggaacucuagaacuggagccaggacuaagugaga

SEQ ID NO: 253593 - RNA, 66 nt, hsa
uucaauucaggagcuuugaaggaaguccaaggaaagcucuagaaaacaguauaaacuuucagaggc

SEQ ID NO: 253594 - RNA, 66 nt, hsa
cuuaaucuucuagaagaaaaaucuccgaagagcucucucuagaaguccaaaauggcuagccauuau

SEQ ID NO: 253595 - RNA, 66 nt, hsa
ggguagcugaugucagcuucauguggauuuuaagcacucuagaaacaaugaagcuucuuggcauau

SEQ ID NO: 253596 - RNA, 66 nt, hsa
gacuccugccacuagguuucaccucccaaacccagccucuagaacagccagacccugcagaucccc

SEQ ID NO: 253597 - RNA, 66 nt, hsa
aaagacagugucuaaauauaagacaauauugaucagcucuagaauaacuuuaaagaaagacguguu

SEQ ID NO: 253598 - RNA, 66 nt, hsa
caguucuuugcauuuggcucuacuuacuaacaaccccucuagaauacauuggugauuucauuuaaa

SEQ ID NO: 253599 - RNA, 66 nt, hsa
cuuuuguaguacauguuuuuacuaauaauucuuguucucuagaaagcuuucuauuucuaaccuaug

SEQ ID NO: 253600 - RNA, 66 nt, hsa
uugugaaugguaguugaggucuucauacaguucagccucuagaaugguaacaaaucagccaauugg

SEQ ID NO: 253601 - RNA, 66 nt, hsa
uguaggaauugagcgguuccccaccuccuaccccuacucuagaaacacacuagacagaugucuccu

SEQ ID NO: 253602 - RNA, 66 nt, hsa
acagcaggguucaguuucauguaucuuugucuuuuccucuagaaccugccuuuuucaaauaucccu

SEQ ID NO: 253603 - RNA, 66 nt, hsa
uuccugccacugucccaacucuuucccucuacgucucucuagaaugacaucuuuaaaccccuuaca

SEQ ID NO: 253604 - RNA, 66 nt, hsa
uaaggagauuuaguuuuacugcuuugacuggugggucucuagaagcaaaacugagugauaacucau

SEQ ID NO: 253605 - RNA, 66 nt, hsa
cuuccauaguuuuguuuugguuuauuuuuaacaacgcucuagaaacaaagucaaauuaaucacaaa

SEQ ID NO: 253606 - RNA, 66 nt, hsa
gggucucuuuagaacuugauggcugggcacugccaucucuagaauugccacgagucucucucuucc

SEQ ID NO: 253607 - RNA, 66 nt, hsa
uugggguguacuaguuacacaucuucaacagacccccucuagaaauuuuucagaugcuucugggag

SEQ ID NO: 253608 - RNA, 66 nt, hsa
agcagcagcuguggucauuaaaccauuaguuuaccccucuagaacuggggucugcaaacucccacc

SEQ ID NO: 253609 - RNA, 66 nt, hsa
cagcuacagcacuaagagaagccccugagaaaaacccucuagaaaaacagcuguuccucugugugg

SEQ ID NO: 253610 - RNA, 66 nt, hsa
cuuuucccucuguggccuccuggcuugcacugcucccucuagaaagauuccuucaggucuggaggc

SEQ ID NO: 253611 - RNA, 66 nt, hsa
cucucaguggacaguaugcacucagcugaccacucucucuagaaauagucaagauaugaacuaaga

SEQ ID NO: 253612 - RNA, 66 nt, hsa
cucgccuuguuaugcacaagagauucuauuaaaagccucuagaaguaacuccccuuaaaaugucua

SEQ ID NO: 253613 - RNA, 66 nt, hsa
accgccuugugcuagugcccucgagaagaguuauugcucuagaaaguugaguucucauuuuuuuaa

SEQ ID NO: 253614 - RNA, 66 nt, hsa
gggaucccggcggcaaggagaacagaacacugaagacucuagaaaagcaaagccggauuucuggaa

SEQ ID NO: 253615 - RNA, 66 nt, hsa
guacauacucugcuucucucugucagcguccugcugcucuagaagacuguccguggaugaguuuag

SEQ ID NO: 253616 - RNA, 66 nt, hsa
acuaagcugaagguguacuucaccagcaagagucaacucuagaauucaggauguuccuucuauugu

SEQ ID NO: 253617 - RNA, 66 nt, hsa
uuuuuuuccuuuuuuucuugauuaggucuggaacagcucuagaaugaacacauaaaauuuagcaau

SEQ ID NO: 253618 - RNA, 66 nt, hsa
ccaagugauuuugauguauucuaauuuugagaccaucucuagaaaagaauugcuaccucuuguaug

SEQ ID NO: 253619 - RNA, 66 nt, hsa
gcuuucacuucaagacuuuccuucuuuucacuaaaacucuagaagguguuacaagggggagggaag

SEQ ID NO: 253620 - RNA, 66 nt, hsa
cuguccuaggcccuagggauccaacuggcugucugccucuagaacucuccacccucaucucucugc

SEQ ID NO: 253621 - RNA, 66 nt, hsa
gcagcugguaaaggggugcuggaggccauggaggagcucuagaaacauuagcaugggcugaucuga

SEQ ID NO: 253622 - RNA, 66 nt, hsa
guuuuauggcauaugucuccgauuuagaugguuauucucuagaaaauaguauuuaaagacauuuua

SEQ ID NO: 253623 - RNA, 66 nt, hsa
caccucauccccaccccaccucaccccaacaaacuccucuagaagaagccaagaauuucucucuau

SEQ ID NO: 253624 - RNA, 66 nt, hsa
cuccugaugcuuggaccccuuuuauugaucagagugcucuagaauaauggauggucuuggaugaug

SEQ ID NO: 253625 - RNA, 66 nt, hsa
gugucauuauuuuaaugaaugugagcucuugacuuacucuagaauucuaauacagauacuuucugc

SEQ ID NO: 253626 - RNA, 66 nt, hsa
agucuauuguuugaucuaguuauuuuaauaaaggaacucuagaaguuucaaguggccagugaagug

SEQ ID NO: 253627 - RNA, 66 nt, hsa
augaaauaaguaggacugaguauuuaugugaaaacucucuagaagguaaaaauaaagauaauucuu

SEQ ID NO: 253628 - RNA, 66 nt, hsa
cugguuuucuguguaauuccagaugagucacuguaacucuagaagauuaaccuuccagccaaccua

SEQ ID NO: 253629 - RNA, 66 nt, hsa
accuccucgcccuuucuuaaagugcaguucuuagcccucuagaaacgaguuggugucuuucgucuc

SEQ ID NO: 253630 - RNA, 66 nt, hsa
aaagccccaaagcauauaaucucuacuccuuacagucucuagaauuaaauguacucauuuagacaa

SEQ ID NO: 253631 - RNA, 66 nt, hsa
aguacuaccuuacgugauagcauacaaagaagaaagcucuagaaagagaaauuauggagaaugauu

SEQ ID NO: 253632 - RNA, 66 nt, hsa
uacacuuaccccacagcugguuacugacaacacaagcucuagaauucauguuuguuuguuuguuuu

SEQ ID NO: 253633 - RNA, 66 nt, hsa
auuagaaaaauguggauaaacagucaaaccuuuauccucuagaauuuuggcaauguugacuaagaa

SEQ ID NO: 253634 - RNA, 66 nt, hsa
agacauccugaagaaaugguaaggguggagccaaaucucuagaaauaaguagugaggccguuaauu

SEQ ID NO: 253635 - RNA, 66 nt, hsa
gcuaacccugacugugggcuugagaacaaagaugaacucuagaacucuagcagccuaacugcugcu

SEQ ID NO: 253636 - RNA, 66 nt, hsa
uacuaccauuugaauauuuucauuugguguuuuccccucuagaaaacagaguugcuguuguuuuuu

SEQ ID NO: 253637 - RNA, 66 nt, hsa
acuccccagaucucuucccccauuccuucuuuugggcucuagaaagucuugccucauugaguguuu

SEQ ID NO: 253638 - RNA, 66 nt, hsa
aacuuuuaucaagaugaagacauuuuacccuaccuacucuagaaauauacaacaauguuauauuuu

SEQ ID NO: 253639 - RNA, 66 nt, hsa
uuagggcuaaugcugcauuuuucuacaacaucaugccucuagaagguuuaagcuagguaggcuuuc

SEQ ID NO: 253640 - RNA, 66 nt, hsa
aaaaucuauuaucaacugcugcuucaccagacuuuucucuagaagcugucugcguuuacucuuguu

SEQ ID NO: 253641 - RNA, 66 nt, hsa
augaggaacacugaacuaguuggaaauuacugcuuucucuagaaauauaaagcaaagcacuauucc

SEQ ID NO: 253642 - RNA, 66 nt, hsa
uuuuuuuucagccacuaagaaccccucugcuuuuaacucuagaauuugggcuuggaccagaucuaa

SEQ ID NO: 253643 - RNA, 66 nt, hsa
cguuggguuuucccuugccuuaugggcugaaguguucucuagaauccagcaggucacacugggggc

SEQ ID NO: 253644 - RNA, 66 nt, hsa
cagagucugaggauguuaacuuuggaacucgcaguccucuagaacagcuucagauuauggcuuuuu

SEQ ID NO: 253645 - RNA, 66 nt, hsa
auugcugcucuccaaugcuaacuuucugacacagugcucuagaacccugccugugguccugagcac

SEQ ID NO: 253646 - RNA, 66 nt, hsa
aaaaguugaggaaaugguugggaaucgcuguuagaacucuagaaauucuaaucugacuuugccacu

SEQ ID NO: 253647 - RNA, 66 nt, hsa
caggccuggacagccaggggcuccucgggcccugugcucuagaaggcccauucuaugucugcuucg

SEQ ID NO: 253648 - RNA, 66 nt, hsa
guagaaaagaaucugaacauuuaagugcgaaguuuucucuagaaauauauucaagauauguuuauu

SEQ ID NO: 253649 - RNA, 66 nt, hsa
agauuuauuuugcucgugcuuagcuaaauaugucaucucuagaaaagaugugguuuguuuuggcac

SEQ ID NO: 253650 - RNA, 66 nt, hsa
acaccguucaaaugagcguagcccccugagucaucacucuagaagaaucuguacaucaucaggacu

SEQ ID NO: 253651 - RNA, 66 nt, hsa
aucaugguguucacucuacauaucagguuauggugucucuagaaucuguuguuuguuuccuauaag

SEQ ID NO: 253652 - RNA, 66 nt, hsa
caaaaugaagaccuacuuucaacuccuuuuuccccccucuagaagaaucaaauugaaucuuuuacu

SEQ ID NO: 253653 - RNA, 66 nt, hsa
uugaaggugauugguuuucuuuacagacuccuuguucucuagaagggcuuuuuacuugaauaaaac

SEQ ID NO: 253654 - RNA, 66 nt, hsa
auuuuugugaaugagaguuggcaugucaaaugcauccucuagaaaaauaauuaguguuauagucuu

SEQ ID NO: 253655 - RNA, 66 nt, hsa
ggccacauagagccucucucuuuuccuguuucuuggcucuagaagaucagcacugcacuguuagcu

SEQ ID NO: 253656 - RNA, 66 nt, hsa
uucuggagaauuaucacaaccuaaugacauuaauaccucuagaaagggcugcugucauagugaaca

SEQ ID NO: 253657 - RNA, 66 nt, hsa
cugaacuugcagguccagguugguauacauuccacccucuagaaguauuuucuuacaguagauaag

SEQ ID NO: 253658 - RNA, 66 nt, hsa
acaaauuggugauacuucuaaacuauaacuauaaaucucuagaauucugugaauuucaacauuauu

SEQ ID NO: 253659 - RNA, 63 nt, hsa; identical to SEQ ID NO: 103195

SEQ ID NO: 253660 - RNA, 51 nt, hsa; identical to SEQ ID NO: 103196

SEQ ID NO: 253661 - RNA, 66 nt, hsa
aacgauuuccuguagaaguagcuuuaaugguuuuugcucuagaauaccguaggucuauccuuagag

SEQ ID NO: 253662 - RNA, 66 nt, hsa
ccuccugccuccugggguccagugacugggacccuacucuagaacuguguaccauccaauucgcca

SEQ ID NO: 253663 - RNA, 66 nt, hsa
cauucccuguaguugacaauucugcauguacuaguccucuagaaauagguuaaacugaagcaacuu

SEQ ID NO: 253664 - RNA, 66 nt, hsa
auccacgcacaugcgaccccgaggaaacgaaacccacucuagaaaacgcgaccuuggccgcaccua

SEQ ID NO: 253665 - RNA, 66 nt, hsa
gcuugucugcucccacagcaccaucuaagaccccuccucuagaaguggggaaggccagauguguag

SEQ ID NO: 253666 - RNA, 66 nt, hsa
aaaacuauguauauuuaaauuuaguaauuuucuaaucucuagaaaucucugcuguucaaaaggugg

SEQ ID NO: 253667 - RNA, 66 nt, hsa
cacauuucuaaaucccaucuugauauacuaugaauacucuagaaugauguaaagcagauaggaaug

SEQ ID NO: 253668 - RNA, 66 nt, hsa
aaucaaucauguacuuuaguuuaauguauaaagauccucuagaaaaugauaauauuguguauuaag

SEQ ID NO: 253669 - RNA, 66 nt, hsa
uuucucugguggucucaagacaagaacaagagcugacucuagaaucuucugccuggcugaccucug

SEQ ID NO: 253670 - RNA, 66 nt, hsa
cugggucagugauggcaacaggauggccaaggauggcucuagaacacucuguccaugcgucacucc

SEQ ID NO: 253671 - RNA, 66 nt, hsa
auccuguccuguccaaugcgggggcacugcagaacucucuagaaaugucaugauugagcuucagag

SEQ ID NO: 253672 - RNA, 66 nt, hsa
gagaacugaauaaucuuugccuggagugacacuacacucuagaauuuccacuuuggagaauacuca

SEQ ID NO: 253673 - RNA, 66 nt, hsa
guauuuuauuuuguuuucaaccaucaauaaaguuuucucuagaauauuguuuugaacauccuugua

SEQ ID NO: 253674 - RNA, 66 nt, hsa
gcuguauggaaaugcacccucccuccugccgcuccucucuagaaccuucuagaaccugggcugugc

SEQ ID NO: 253675 - RNA, 66 nt, hsa
cauucuaagggugccaagagacugguuagucaaagccucuagaaggggauccucguugaaaggagc

SEQ ID NO: 253676 - RNA, 66 nt, hsa
uaccauaucuauaaaacaaacauaguaucugucaaucucuagaaaccacaagaugauggagagguc

SEQ ID NO: 253677 - RNA, 66 nt, hsa
cagguguagggacccugccaaguggcaccugauuuacucuagaaaauaaaaguagaaaauacugag

SEQ ID NO: 253678 - RNA, 66 nt, hsa
ugugucccugaaguauuuaauaagaagcauuuugcacucuagaaaguauguuuguguugguuuuuu

SEQ ID NO: 253679 - RNA, 66 nt, hsa
ugugguagauuacuuaucagaaaacauauaugucaucucuagaacgaagaaaaagcauaguaguuc

SEQ ID NO: 253680 - RNA, 66 nt, hsa
cuggguaggguauaguaucacuccugaguuccacugcucuagaaucuaaccagaaauagaaaccua

SEQ ID NO: 253681 - RNA, 66 nt, hsa
guccccugcucaccauuggagaaucagcucacugcucucuagaaacguggcguuggugaacggacc

SEQ ID NO: 253682 - RNA, 66 nt, hsa
cgcucaggacgugaugagguacucgugguucuggagcucuagaaacacuucugaugcaugaaaaau

SEQ ID NO: 253683 - RNA, 66 nt, hsa
cagaauguucagucggucguguuuuuaacacagagucucuagaagaggugcagacaucccgucuga

SEQ ID NO: 253684 - RNA, 66 nt, hsa
uucuggcaaguguccagaugccagaaccuucuuuuccucuagaagggauggugcuugguaaccuua

SEQ ID NO: 253685 - RNA, 66 nt, hsa
cccauguaugucgauugauaucgcugcuacaucagacucuagaaaaaagggcugagaggaagcaag

SEQ ID NO: 253686 - RNA, 66 nt, hsa
uacgauaauuccucaagcaugagaccuugcuaagcacucuagaauaaguuuuauguucugcucaca

SEQ ID NO: 253687 - RNA, 66 nt, hsa
ugcuacaaaagugcaaauuucucauuuccugugggucucuagaaacucucucaauauuuaaagcca

SEQ ID NO: 253688 - RNA, 66 nt, hsa
uccugggcuugguaagugaauuuaugagauuuacugcucuagaaaguauagauggccaaaggaccg

SEQ ID NO: 253689 - RNA, 66 nt, hsa
cauccaucugagaugggguccuguuguuuauuaucacucuagaaguuauacauugauauuuauucu

SEQ ID NO: 253690 - RNA, 66 nt, hsa
gugauuuuuguaacuuuacgcaggacacuuagagcucucuagaaucccacugacuuuagugggucu

SEQ ID NO: 253691 - RNA, 66 nt, hsa
ggauaugcccauuugauccuaaccuuuuagccugcucucuagaacccuacuuacaguugaccaagc

SEQ ID NO: 253692 - RNA, 66 nt, hsa
cccaguacggcccccucuuugcaggcuuuuccuccucucuagaaccuccuucuguuggaggcccuc

SEQ ID NO: 253693 - RNA, 66 nt, hsa
ugccucaggcccccagcccuguggcuuccaccucagcucuagaagccugcucccucugcagggggu

SEQ ID NO: 253694 - RNA, 66 nt, hsa
gaagaaaaaaagaaaaagaacaaaaaauauauaucacucuagaaaauaaaucucuccugugucuua

SEQ ID NO: 253695 - RNA, 66 nt, hsa
augcaaacacuaacugggggauuuuauuuauaagggcucuagaaaaaacgaguuauucacaccagc

SEQ ID NO: 253696 - RNA, 66 nt, hsa
aaaaaaaaaaaaguuuguuaaaaggcuacacgagcucucuagaaacugcugcuacuagaaaugucu

SEQ ID NO: 253697 - RNA, 66 nt, hsa
cguuggggccauuagaaugaggcagacaccaggccacucuagaagccgagccgucacaccucaggc

SEQ ID NO: 253698 - RNA, 66 nt, hsa
ccauuccccuggcaugaaacuuucagauuccccugccucuagaaauuguccugcccuccucaccac

SEQ ID NO: 253699 - RNA, 66 nt, hsa
cuuaacccaugguucucagcuggggugacacugcuccucuagaagcagguuugaaauuauggguau

SEQ ID NO: 253700 - RNA, 66 nt, hsa
aguccuggcuuuuuguugauuauuaagcuguguucacucuagaagguguaaaggcccugucccaau

SEQ ID NO: 253701 - RNA, 66 nt, hsa
cccuacauucuccuugucugguauaacuuccauguucucuagaaaucaagguuuuguuuguuaauu

SEQ ID NO: 253702 - RNA, 66 nt, hsa
uauguuucuggugugugaacuuuaugguaacuucuacucuagaauacguacguaugcacccacaga

SEQ ID NO: 253703 - RNA, 66 nt, hsa
cuccagaacccagcccagaucggaggacaaguuccucucuagaacccaauccaauuuggagcccca

SEQ ID NO: 253704 - RNA, 66 nt, hsa
uuuggagccccagcccaacuccagaacccaacccuucucuagaauccagcccagaucugaggccaa

SEQ ID NO: 253705 - RNA, 66 nt, hsa
uaaugugguccaaaugcggaucacuggucagauggacucuagaagcacugagcucccugucucugg

SEQ ID NO: 253706 - RNA, 66 nt, hsa
acuucaaaaagccucaugcauagcgggucauguagucucuagaaaauacauaaccugauggaaaug

SEQ ID NO: 253707 - RNA, 66 nt, hsa
augguuauuuauauccuauuuuuucucaccccaucucucuagaaacaccuauaaaggcuauuauug

SEQ ID NO: 253708 - RNA, 66 nt, hsa
cucuuguauaagauccuagauccuaagggucgaaagcucuagaaucugcaauucaaaaguuccaag

SEQ ID NO: 253709 - RNA, 66 nt, hsa
ugggcugccgugauggauucuguuugacguauuguucucuagaaggccuggcucugauccagugac

SEQ ID NO: 253710 - RNA, 66 nt, hsa
ccgguccccacccucugccccccagcccucuggcgucucuagaaacugcugcugauggagaccagg

SEQ ID NO: 253711 - RNA, 66 nt, hsa
cugcugacggaggaauuaacacaaaagcagacaacacucuagaacuggagagagguccagauugcg

SEQ ID NO: 253712 - RNA, 66 nt, hsa
gacccagccccuccccuacuuuuuggucagcuacgucucuagaauaagaugguaucugaaguccuu

SEQ ID NO: 253713 - RNA, 66 nt, hsa
aaaguuguuucucucccugggccucaguuuccccaucucuagaaugaggauguuggggaaaauccc

SEQ ID NO: 253714 - RNA, 66 nt, hsa
auuugaaauucaguaauauuugacauuuuuauuuaucucuagaaguuucucuaaaauuguacucag

SEQ ID NO: 253715 - RNA, 66 nt, hsa
uaaaaguacagugaugagcaugccuaaauccauguucucuagaauguaagcuuggugaaagaaggg

SEQ ID NO: 253716 - RNA, 66 nt, hsa
aucuagacuguucugggguagcagagucacagaucacucuagaaucuaauacuugguaauuauacu

SEQ ID NO: 253717 - RNA, 66 nt, hsa
cugcccccaggaauggggaacucucccucuggucuacucuagaagagggguuacuucuccccuggg

SEQ ID NO: 253718 - RNA, 66 nt, hsa
agcucccaucuccuuucagaaaaauucaagguccuccucuagaaguuucaaaucucucccaacucu

SEQ ID NO: 253719 - RNA, 66 nt, hsa
ccuaaggcccuggguucaagagaguuggagaaaccccucuagaaacauauuggcugucaucaaagg

SEQ ID NO: 253720 - RNA, 66 nt, hsa
uuggaaauuccuuaacugagcuauacuugguacuugcucuagaacauuugggaaaugacaaacuca

SEQ ID NO: 253721 - RNA, 66 nt, hsa
gccaucucuuccagcaccaucaggguuuuaauggcccucuagaauuaccacugagauacacuauuu

SEQ ID NO: 253722 - RNA, 66 nt, hsa
gggugaagaaucugggccaaccagggguccuugggccucuagaaggccacaguaggccucucuuug

SEQ ID NO: 253723 - RNA, 66 nt, hsa
ugaaucugcuggugccuugaucuuggacuucccagccucuagaacuguaagaaauaaauauuugcu

SEQ ID NO: 253724 - RNA, 66 nt, hsa
aggcaagggcccaaggacagugccuuaguuuggauccucuagaaacuaacccugggaaaagggcau

SEQ ID NO: 253725 - RNA, 66 nt, hsa
cacuguauaacuuauuuucuuauuaucuucuucucccucuagaauauaaauuuaugaaaauacaaa

SEQ ID NO: 253726 - RNA, 66 nt, hsa
acuugcguggaaggagcaaugcagacacagugaaaucucuagaaucugcuuuguuuuguaagaacu

SEQ ID NO: 253727 - RNA, 66 nt, hsa
aguaguuaaaccaaacuacagucucagccugucauucucuagaacacauccaggugucggagcuaa

SEQ ID NO: 253728 - RNA, 66 nt, hsa
cacagucagggacccccauaaaggacacccccuucucucuagaaagagcugggcucucagcuauuu

SEQ ID NO: 253729 - RNA, 66 nt, hsa
ccuaagacgggggcugcuucuccucuucaguauggacucuagaaagucuggcuacaugaauagauu

SEQ ID NO: 253730 - RNA, 66 nt, hsa
cccagugcuaacuugggccagcgggguuugggguaucucuagaaaacagcaacugaacagagcucc

SEQ ID NO: 253731 - RNA, 66 nt, hsa
agaggcgugacccaggccccuguagcccucagccuccucuagaagcuucuguacuccuuguaggau

SEQ ID NO: 253732 - RNA, 66 nt, hsa
agcugccguggccacccccgcugcccagugucugcccucuagaaguaggcuguguuuccagguguu

SEQ ID NO: 253733 - RNA, 66 nt, hsa
aacuaaacaggaaagucgcauuauuuucccauucuacucuagaaagcauggaaauuaaguguuucg

SEQ ID NO: 253734 - RNA, 66 nt, hsa
uuaucaacuauuuuguaaaugcaaguuuuuuaguagcucuagaaacauuuuuaagaaggagggaau

SEQ ID NO: 253735 - RNA, 66 nt, hsa
uugugaccagcucagaggauggggcuguccccugggcucuagaaagaacauucugugucaccagca

SEQ ID NO: 253736 - RNA, 66 nt, hsa
aaggaagaggcugggggacuagaaagaggcccugcccucuagaaagcucagaucuuggcuucuguu

SEQ ID NO: 253737 - RNA, 66 nt, hsa
uucucuuccaagaaugccucuguggugcuguuuggucucuagaaacagggucacuuuuuuaaugua

SEQ ID NO: 253738 - RNA, 66 nt, hsa
ccucgacugcugcuguuaaaaaacaugcauuagaaucucuagaacacgaggaaaaacagggucuug

SEQ ID NO: 253739 - RNA, 66 nt, hsa
cuauugugcaaugauuguuaaauuauacugaaguagcucuagaaagacacauguauacaaggcacu

SEQ ID NO: 253740 - RNA, 66 nt, hsa
acagccguaguagauguucuacuuuguucugcuguucucuagaaagaauauuugguuuuccuguau

SEQ ID NO: 253741 - RNA, 66 nt, hsa
uaguacacaucagcauaugagaaucucugagagguccucuagaaaggagagaaaaagcaccucuuu

SEQ ID NO: 253742 - RNA, 66 nt, hsa
ucuggauucauauauuacaucaacuucccuuuuuaacucuagaaauucucaguaugggguuucccu

SEQ ID NO: 253743 - RNA, 66 nt, hsa
cucuggguuccuauggccuuguuggagggggccaggcucuagaacgucuaacacaguggagaaccg

SEQ ID NO: 253744 - RNA, 66 nt, hsa
aauuugaucacgaucauauuguagucucucaaagugcucuagaaauugucagugguuuacaugaag

SEQ ID NO: 253745 - RNA, 66 nt, hsa
ucaaacuauagugauauaucaguguuugagagugaccucuagaaaaaagaaaaguguuuuuagaaa

SEQ ID NO: 253746 - RNA, 66 nt, hsa
ggugccacccaguagcccagagugagcuuuagcucucucuagaaugagcaagacugggccccacau

SEQ ID NO: 253747 - RNA, 66 nt, hsa
gacaguugugcaggagguagccuggugguuuucaaccucuagaauuuuaagccuuuguugaacugu

SEQ ID NO: 253748 - RNA, 66 nt, hsa
aauaguuuggaguaagggacuucauauaccugauuccucuagaaggcugucuaacauaccacauga

SEQ ID NO: 253749 - RNA, 66 nt, hsa
uuaugauauauuacuacuuauaauacuguggcuagucucuagaauggauguugaaaucuuugccuc

SEQ ID NO: 253750 - RNA, 66 nt, hsa
cugagugaacugaggaaggugcuuagauggugagggcucuagaaaccaagccccaugagcagcagu

SEQ ID NO: 253751 - RNA, 66 nt, hsa
ucaaacuauagugauauaucaguguuugggagugaccucuagaaaaaagaaaacuguuuuuagaaa

SEQ ID NO: 253752 - RNA, 66 nt, hsa
cccagccgcauccugccuguagauggccggggaaggcucuagaaaaggggcgcauugcgauccaac

SEQ ID NO: 253753 - RNA, 64 nt, hsa; identical to SEQ ID NO: 24356

SEQ ID NO: 253754 - RNA, 64 nt, hsa; identical to SEQ ID NO: 24357

SEQ ID NO: 253755 - RNA, 64 nt, hsa; identical to SEQ ID NO: 24358

SEQ ID NO: 253756 - RNA, 64 nt, hsa; identical to SEQ ID NO: 24359

SEQ ID NO: 253757 - RNA, 64 nt, hsa; identical to SEQ ID NO: 24360

SEQ ID NO: 253758 - RNA, 64 nt, hsa; identical to SEQ ID NO: 24361

SEQ ID NO: 253759 - RNA, 64 nt, hsa; identical to SEQ ID NO: 24362

SEQ ID NO: 253760 - RNA, 64 nt, hsa; identical to SEQ ID NO: 24363

SEQ ID NO: 253761 - RNA, 64 nt, hsa; identical to SEQ ID NO: 24364

SEQ ID NO: 253762 - RNA, 64 nt, hsa; identical to SEQ ID NO: 24365

SEQ ID NO: 253763 - RNA, 64 nt, hsa; identical to SEQ ID NO: 24366

SEQ ID NO: 253764 - RNA, 64 nt, hsa; identical to SEQ ID NO: 24367

SEQ ID NO: 253765 - RNA, 64 nt, hsa; identical to SEQ ID NO: 24368

SEQ ID NO: 253766 - RNA, 64 nt, hsa; identical to SEQ ID NO: 24369

SEQ ID NO: 253767 - RNA, 64 nt, hsa; identical to SEQ ID NO: 24370

SEQ ID NO: 253768 - RNA, 64 nt, hsa; identical to SEQ ID NO: 24371

SEQ ID NO: 253769 - RNA, 64 nt, hsa
uaacucacugacaaaacauauuucaauaguauaugaguaugagauuucuuaucaauuaugagug

SEQ ID NO: 253770 - RNA, 64 nt, hsa
aaggcauuuacaguauuugcuuucaacaguuacugaguaugacauuuuagcaugaaauauauca

SEQ ID NO: 253771 - RNA, 64 nt, hsa
gaaacuuccuguacauaaauucaagaaaggagaugaguaugauguaugugccauuuguuuggau

SEQ ID NO: 253772 - RNA, 64 nt, hsa
agaugaguaugauguaugugccauuuguuuggaugaguaugaagauggagacaaacucagaauc

SEQ ID NO: 253773 - RNA, 64 nt, hsa
acaucagaggguccaucaugaagagaaagccuaugaguaugaugaauauggguuggccuauauu

SEQ ID NO: 253774 - RNA, 64 nt, hsa
aaugcauaggaaagagaaaucguaugaauguaaugaguaugagggcaguuucagucauagcuca

SEQ ID NO: 253775 - RNA, 64 nt, hsa
gauaccaauauuuaaaaguuuguauaauaauaaagaguaugauugugguucaaggauaaaaaca

SEQ ID NO: 253776 - RNA, 64 nt, hsa
uuggucucgaggcagaggucauguucccagccaagaguaugagaacauccagucgagcagagga

SEQ ID NO: 253777 - RNA, 64 nt, hsa
uaguugguaaggccaauguuauuuaaaugaaaguaguuagaaaaaugcucuccuauucuaccaa

SEQ ID NO: 253778 - RNA, 64 nt, hsa
acacagugaucaagaguuucucauagugcuuugaaguuagaaauuauguauaggauauuuuaaa

SEQ ID NO: 253779 - RNA, 64 nt, hsa
uuuuccugugcuuccccagcuucccaaaguagcuaguuagaacuuaagguaaauauuuauucuu

SEQ ID NO: 253780 - RNA, 64 nt, hsa
ggggaugaaggagagcuuaaagguguuucaauuaaguuagaaaacugacacaggcuguugagaa

SEQ ID NO: 253781 - RNA, 64 nt, hsa
cgaacuuuauuacauacugauucuggaacaaaacaguuagaaaaacuuuaaaaaaaaaaaaacc

SEQ ID NO: 253782 - RNA, 64 nt, hsa
ccagaacucagcaggcauuggcuccuagaaaucaaguuagaaaguuuucacccagggaguaagu

SEQ ID NO: 253783 - RNA, 64 nt, hsa
ugaaagagcugugcauuauaaaaucaguuagaauaguuagaacaauucuuauuuaugcccacaa

SEQ ID NO: 253784 - RNA, 64 nt, hsa
guaaucaacugaaagagcugugcauuauaaaaucaguuagaauaguuagaacaauucuuauuua

SEQ ID NO: 253785 - RNA, 64 nt, hsa
cucuucuacccuugaaggugacugguccugggacaguuagaaucuuucagguuuaccucuguuc

SEQ ID NO: 253786 - RNA, 64 nt, hsa
auauuucaauauucaaguuacaaauguauaaggcaguuagaaauaauacagucacaugucacuu

SEQ ID NO: 253787 - RNA, 64 nt, hsa
aaaauaccaauuuaguuuuacuuguggcuuaucuaguuagaacuuagcagacuuuacugggaca

SEQ ID NO: 253788 - RNA, 64 nt, hsa
cagcugccguugaagcuaauauucaguucuguagaguuagaauaccuuuuguuguugaagaugu

SEQ ID NO: 253789 - RNA, 64 nt, hsa
uuuggauuuuguaaaacagaaguuuaagaccacaaguuagaagaaaggucacauauuucaaaca

SEQ ID NO: 253790 - RNA, 64 nt, hsa
uucagucaguguccccaggguccagccuggcuagaguuagaaggcagaccuagccuuuggaagc

SEQ ID NO: 253791 - RNA, 64 nt, hsa
agcuccacacagacccuacccuuuccccuagcccaguuagaaaauaagucugggccggcggcgg

SEQ ID NO: 253792 - RNA, 64 nt, hsa
ugucugcuuuuugcuauuucugcaguuucaaguuaguuagaagcauguugucaacuaaagacaa

SEQ ID NO: 253793 - RNA, 64 nt, hsa
cauggucugcaucaaucuguuugccugcuaaacaaguuagaauaggaaauaguaaaauaaaucc

SEQ ID NO: 253794 - RNA, 64 nt, hsa
ggaacuugaguacaguugaauuauuaaauaugcaaguuagaaauuaagucuacugaaaaauuua

SEQ ID NO: 253795 - RNA, 64 nt, hsa
agugaauaaagaaauaaacuucaacuagaaauccaguuagaagugcaauuuucuuauaggaaau

SEQ ID NO: 253796 - RNA, 64 nt, hsa
gguugcauguucacugccccuaauuccuaaagcaaguuagaaauuuuuagcauuuucuuugaaa

SEQ ID NO: 253797 - RNA, 64 nt, hsa
gguugcguguucacugcccccaauuccuaaagcaaguuagaaguuuuuagcauuuaagguguga

SEQ ID NO: 253798 - RNA, 64 nt, hsa
aaguaaaguaggguaagggaaugccagucugaggaguuagaaguuaccguuuuauguaagguaa

SEQ ID NO: 253799 - RNA, 64 nt, hsa
aaucaagacgugcaagaguggaagaagaaacaccaguuagaaguuuguuugcgauaauccaagc

SEQ ID NO: 253800 - RNA, 64 nt, hsa
uuauuccauuuguaccuaagagaaaaauaggcucaguuagaaaaggacucccuggccaggcgca

SEQ ID NO: 253801 - RNA, 64 nt, hsa
uauuauaaaaauuguaaaacuacuacuuuguuuuaguuagaacaaagcucaaaacuacuuuagu

SEQ ID NO: 253802 - RNA, 64 nt, hsa
uuguagggauaagaaauacauuuguuuuauacuucuaugcuauauuuugcuauucaaaauuuag

SEQ ID NO: 253803 - RNA, 64 nt, hsa
agauuggacuuguucaaauguucauauuuuuguucuaugcuaaaugcaucguuaggggaguagu

SEQ ID NO: 253804 - RNA, 64 nt, hsa
ggcauauguaaaauguccuuuucugguugccucucuaugcuauuguguucagauacuuacacca

SEQ ID NO: 253805 - RNA, 64 nt, hsa
gacuuuuguuuuugggguuuauaauuuaaaccagcuaugcuauuuuuucauaaaggcauuugua

SEQ ID NO: 253806 - RNA, 64 nt, hsa
uuuguguuuuauuauuuucuguccuaugacaguucuaugcuaaauguauuuuaaaauaaaagcc

SEQ ID NO: 253807 - RNA, 64 nt, hsa
uugaauuuuagggaccguuucccauaauuugggccuaugcuauccuguugauuuuuaugucuag

SEQ ID NO: 253808 - RNA, 64 nt, hsa
uguaacaaaccugcacguugugcacauguacccuagaacuuaaaguauauaaaaaaaagaaacc

SEQ ID NO: 253809 - RNA, 64 nt, hsa
caacuccauugaaaaacccugcugggauuuuaauagaacuuacagcucacgccuguaaucucag

SEQ ID NO: 253810 - RNA, 64 nt, hsa
aguuaaucaugccuuuuggagcuagaaggacuuuagaacuuaucuaguuaugcuccuuuauauu

SEQ ID NO: 253811 - RNA, 64 nt, hsa
guuggucaauggcuuuuggaacuggaaggaccuuagaacuuaucuguuaugcuccugauagcca

SEQ ID NO: 253812 - RNA, 64 nt, hsa
ccuccccaacaaauaauuugccaaguguccaaugagaacuuaucauguugguguguuagguaaa

SEQ ID NO: 253813 - RNA, 64 nt, hsa
auaaacuuuuucaauauaagguacaugccuauacagaacuuaacauuuugcacagaauauauca

SEQ ID NO: 253814 - RNA, 64 nt, hsa
uuuauagauguauauuguggaauguaaagcuuuaagaacuuaaacaaagguaauaauuaaaaua

SEQ ID NO: 253815 - RNA, 64 nt, hsa
auguuaaaaccucucaacacagaaggaauacaggagaacuuacucaaguugguaaagaacauac

SEQ ID NO: 253816 - RNA, 64 nt, hsa
cuuugcccugaagucaguucucacaguauagaagagaacuuaaagagggaaaaaacaauaugaa

SEQ ID NO: 253817 - RNA, 64 nt, hsa
guuuugcauuuugcaguacaaaggagaaaugauuagaacuuaggaagugccaguggguugguga

SEQ ID NO: 253818 - RNA, 64 nt, hsa
caauauaccagguaagaaucaaugcacaguauaaagaacuuauuguucuuuucuauucuuucag

SEQ ID NO: 253819 - RNA, 64 nt, hsa
gguuaauuucaccacaaaauugcuuuaaaucugaagaacuuaaguuucacuaaauaauauauau

SEQ ID NO: 253820 - RNA, 64 nt, hsa; identical to SEQ ID NO: 99218

SEQ ID NO: 253821 - RNA, 64 nt, hsa; identical to SEQ ID NO: 99219

SEQ ID NO: 253822 - RNA, 64 nt, hsa; identical to SEQ ID NO: 99220

SEQ ID NO: 253823 - RNA, 64 nt, hsa; identical to SEQ ID NO: 99221

SEQ ID NO: 253824 - RNA, 64 nt, hsa; identical to SEQ ID NO: 99222

SEQ ID NO: 253825 - RNA, 64 nt, hsa; identical to SEQ ID NO: 99223

SEQ ID NO: 253826 - RNA, 64 nt, hsa; identical to SEQ ID NO: 99224

SEQ ID NO: 253827 - RNA, 64 nt, hsa; identical to SEQ ID NO: 99225

SEQ ID NO: 253828 - RNA, 64 nt, hsa; identical to SEQ ID NO: 99226

SEQ ID NO: 253829 - RNA, 64 nt, hsa; identical to SEQ ID NO: 99227

SEQ ID NO: 253830 - RNA, 64 nt, hsa; identical to SEQ ID NO: 99228

SEQ ID NO: 253831 - RNA, 64 nt, hsa; identical to SEQ ID NO: 99229

SEQ ID NO: 253832 - RNA, 64 nt, hsa; identical to SEQ ID NO: 99230

SEQ ID NO: 253833 - RNA, 64 nt, hsa; identical to SEQ ID NO: 99231

SEQ ID NO: 253834 - RNA, 64 nt, hsa; identical to SEQ ID NO: 99232

SEQ ID NO: 253835 - RNA, 64 nt, hsa; identical to SEQ ID NO: 99233

SEQ ID NO: 253836 - RNA, 64 nt, hsa; identical to SEQ ID NO: 99234

SEQ ID NO: 253837 - RNA, 64 nt, hsa; identical to SEQ ID NO: 99235

SEQ ID NO: 253838 - RNA, 64 nt, hsa; identical to SEQ ID NO: 99236

SEQ ID NO: 253839 - RNA, 64 nt, hsa; identical to SEQ ID NO: 99237

SEQ ID NO: 253840 - RNA, 64 nt, hsa; identical to SEQ ID NO: 99238

SEQ ID NO: 253841 - RNA, 64 nt, hsa; identical to SEQ ID NO: 99239

SEQ ID NO: 253842 - RNA, 64 nt, hsa; identical to SEQ ID NO: 99240

SEQ ID NO: 253843 - RNA, 64 nt, hsa; identical to SEQ ID NO: 99241

SEQ ID NO: 253844 - RNA, 64 nt, hsa
gaaaagugagaaaauauuugaaagggauuauauuaauugcuaaauauuuuauucacaaagguca

SEQ ID NO: 253845 - RNA, 64 nt, hsa
uaauagcuaaucuuauucuaucuccugaagauuuaauugcuauuguuacccauucgaaaucagc

SEQ ID NO: 253846 - RNA, 64 nt, hsa
aauuuuauuugguuuguacgcaguucaauuucaaaauugcuaaaauguguuugagcuuuagacu

SEQ ID NO: 253847 - RNA, 64 nt, hsa
uguuugagcuuuagacuauaacauuuguuguaauaauugcuagguugaaguucaacauguaaaa

SEQ ID NO: 253848 - RNA, 64 nt, hsa
cccuuagugagggcaaaguguaguugguagaagaaauugcuaaauaccuaucuaaugugcuaug

SEQ ID NO: 253849 - RNA, 64 nt, hsa
uuucuaacuacuuagcacaguuugagaauacguuaauugcuauuuacuauuuaaaaaguuuuac

SEQ ID NO: 253850 - RNA, 64 nt, hsa
aaaauuuuuacucagauuuuuuuuccucuucccuaauugcuaagauuuaaggacguucuuuauu

SEQ ID NO: 253851 - RNA, 64 nt, hsa
uuugcuuuuucuuuuuguuuuuaaaacuuauuccaauugcuaaauugguaguuuuucagucuuu

SEQ ID NO: 253852 - RNA, 64 nt, hsa
ggcagguauuugcuuuugcuugcacugaaaauuaaauugcuaucaagaauaaaccaugaaacau

SEQ ID NO: 253853 - RNA, 64 nt, hsa
gguauguguuugcuuuugcuugcacugaaaauuaaauugcuaucaagagcaaacuaugaacggu

SEQ ID NO: 253854 - RNA, 64 nt, hsa
acagauguuuuguggauugaaaauuauuuuauggaauugcuacagaggagugcuuuucuucuca

SEQ ID NO: 253855 - RNA, 64 nt, hsa
auaacacuuagaaguguuuacuuaccuggaaaauaauugcuaugccguacauucagagugcccc

SEQ ID NO: 253856 - RNA, 64 nt, hsa
aaauagugugugucuuauuuuacuguugaacagcaauugcuauuuauuuuuuuauugccuagaa

SEQ ID NO: 253857 - RNA, 64 nt, hsa
ggcucaugugucauucuggcacuacauuugcuuaaauugcuauuuuggcaacagcacagaaaac

SEQ ID NO: 253858 - RNA, 64 nt, hsa
gcagaauuaaauuuuuacuugacauuaucauuaaaauugcuagguauggagaacaauuccuauu

SEQ ID NO: 253859 - RNA, 64 nt, hsa
uuuccuaaaacacuuuauauuauaaaugaaaauaaauugcuaguuuauauuuuagauauaaaca

SEQ ID NO: 253860 - RNA, 64 nt, hsa
gccuaucuaaacuggauucacagcucugucacuuaauugcuacaugaucuagagccaguuacuu

SEQ ID NO: 253861 - RNA, 64 nt, hsa
guaucgcuucauguaacuagaauuucuuuaacuuaauugcuauguuuugacauuuuuaguuuaa

SEQ ID NO: 253862 - RNA, 64 nt, hsa
aaguaccuuaauucuuuauugacuuuuugcccuaaauugcuaggugugacccagcaaucuuuua

SEQ ID NO: 253863 - RNA, 64 nt, hsa
ggaaauucuuuaggauaaccauuucaaaaaauaaaauugcuaugcaaucuugaauauuuucucu

SEQ ID NO: 253864 - RNA, 64 nt, hsa
acuuuacaguaaaauuaaguguguauaaaacauuaauugcuaacaauuguuagcaaacuauuuc

SEQ ID NO: 253865 - RNA, 64 nt, hsa
ugccaucacauaguauuaugucaccauaaugaacaauugcuauuuaaauagauaaccaauuuuc

SEQ ID NO: 253866 - RNA, 64 nt, hsa
ugcuagcuaaaaaauaucaagugccugauuaaagaauugcuaaaugguugucaauacucgcugu

SEQ ID NO: 253867 - RNA, 64 nt, hsa
aggaacauguauuagcuguguuuuagugagaaugaauugcuauccaucauaauuuuugcuguug

SEQ ID NO: 253868 - RNA, 51 nt, hsa
acuuuagaggacuuauuuaagaauugcuaagggaaacaggucuuacacaaa

SEQ ID NO: 253869 - RNA, 64 nt, hsa
gcaagagaguuuguaauuaagugccaauuauaccaauugcuagacccaggauguaucuuuaauu

SEQ ID NO: 253870 - RNA, 64 nt, hsa
auuguuuuuagaucagugcuucaacauccaggcugacguuuagccauuuuggcugcuguucuuu

SEQ ID NO: 253871 - RNA, 64 nt, hsa
aaguccaugagaucagugcuucaacauccagguugacguuuaaccauuuuggcugcugcucuuu

SEQ ID NO: 253872 - RNA, 64 nt, hsa
guaacauacugucaauuuuccuuguuugaauauagaauuguaacacuacacgguguacauuucc

SEQ ID NO: 253873 - RNA, 64 nt, hsa
aaaacaaacaaaaacaaaaaaaccugagaaguuugaauuguaguuaaaugaccccaaacuggca

SEQ ID NO: 253874 - RNA, 64 nt, hsa
uucuuuugcaauuguaguuuuauguacuguuaaagaauuguauugaauucuuuuuagaucaaag

SEQ ID NO: 253875 - RNA, 64 nt, hsa
uucuuuugcaauuuuaguuuuauguacuguuaaagaauuguacugaauucuuuuuagaucacag

SEQ ID NO: 253876 - RNA, 64 nt, hsa
uguuaagaaggugaagcccaaaagcucuuaaggagaauuguauuucuccagaagcugcagcaag

SEQ ID NO: 253877 - RNA, 64 nt, hsa
uauucuacaaaauaugucaugcauucuuucuuaugaauuguauauuuagaaaucuuucuaaaua

SEQ ID NO: 253878 - RNA, 64 nt, hsa
ucagagcaacacacaugagaaagagaguaacccggaauuguacuugucaagcaaaaucuauacu

SEQ ID NO: 253879 - RNA, 64 nt, hsa
cacagucuuaaaauacuaggaaagaaguggaugggaauuguaggcauagauuucauaucaaggg

SEQ ID NO: 253880 - RNA, 64 nt, hsa
uuuuaccagacaaaauuugaauacuuuuuuuccugaauuguauaugaccuuggugcugcaugca

SEQ ID NO: 253881 - RNA, 64 nt, hsa
uuucagcgcaagaucucccugauuuugccacguggaauuguacuuguauaugauuaccuuaucu

SEQ ID NO: 253882 - RNA, 64 nt, hsa
ucauauagauuaauuuuaccugcucauaugaagggaauuguacaucaugcauucuuuucuguuu

SEQ ID NO: 253883 - RNA, 64 nt, hsa
ggcaagcuaggagaaugggcuauuauaauguaaagaauuguagucucaguuaaaagggguagcc

SEQ ID NO: 253884 - RNA, 64 nt, hsa
cuacaguuuuuuuuguuugguuugugggcuguuggaauuguaauuuuuaauugccuucuaaaaa

SEQ ID NO: 253885 - RNA, 64 nt, hsa
uucauugucaaaugcauauuuagauuagauuauugaauuguaauguuuaucugcugcuuuuuuu

SEQ ID NO: 253886 - RNA, 64 nt, hsa
ucaucuguugaggucuaaugccuuuacuuggccuauuugccagagaacaucuuaaugcagccug

SEQ ID NO: 253887 - RNA, 64 nt, hsa
cugugcuaccaguacuaagaggggaagacuggcaauuugccaagcacuuggggauuauuauaac

SEQ ID NO: 253888 - RNA, 64 nt, hsa
uucauucaaagaaugggaaaaggauaugacauauauuugccaguacuucaucuucaagauuuac

SEQ ID NO: 253889 - RNA, 64 nt, hsa
aaaauguucuaagcaacuacuuuccuagaguaucauuugccaaccaaaaggcuuucagaggugu

SEQ ID NO: 253890 - RNA, 64 nt, hsa
uagaaaacauuccaaaacuuuaagguguugguguauuugccagcuuuauuugcuguacuuuauu

SEQ ID NO: 253891 - RNA, 64 nt, hsa
uauuugccagcuuuauuugcuguacuuuauuuguauuugccauucagucuagcuuuuaaguaua

SEQ ID NO: 253892 - RNA, 64 nt, hsa
gugcugaguucccuuuucugaguggauuucaagcauuugccaggguaugcuggaggagggacuc

SEQ ID NO: 253893 - RNA, 64 nt, hsa
cuagguaacacuuuaaauacuuuuuuacucaaagauuugccaagaacacagcuuauuagugaaa

SEQ ID NO: 253894 - RNA, 64 nt, hsa
caucagagagcacaaagauuaaaaguuacuuuaaauuugccaauauuuugggagaacaauaaaa

SEQ ID NO: 253895 - RNA, 64 nt, hsa
auaacaaccuaugguugaaggaaugcucaguuucauuugccaauaaauugguuucucauaacuu

SEQ ID NO: 253896 - RNA, 64 nt, hsa
gcucuagcaacaugaucuuaauuguauccagaggauuugccaauguauguucagucucucaaga

SEQ ID NO: 253897 - RNA, 64 nt, hsa
ugagggaacucaaaauaguuaccagaaaaauaauauuugccaauaugacguguauauugcucag

SEQ ID NO: 253898 - RNA, 64 nt, hsa
ucaaacaucugauugacgcuugcaaacugucugaauuugccaugcaagguuuucaaacaauuug

SEQ ID NO: 253899 - RNA, 64 nt, hsa
uaugauccaauaacuuauuuugucacagggcuuaauuugccauuuuuggggauuugucgacuca

SEQ ID NO: 253900 - RNA, 64 nt, hsa
aaaagcccaauacuuagagucccaauuuugucucauuugccaaaaaaaaaaaaaaaaaaaaagc

SEQ ID NO: 253901 - RNA, 64 nt, hsa
cuggcuuuggaaaaaucucaugaugaaaauucauauuugccaacuuuguuagcugcgugcgugc

SEQ ID NO: 253902 - RNA, 64 nt, hsa
uauucagcugcccucguuuacucacaguuugcuuauuugccaccauaagaaaugguacaauaaa

SEQ ID NO: 253903 - RNA, 64 nt, hsa
uaguucuaaucuguauauagucuuggagguuaugauuugccacagauugguuggaucacauaca

SEQ ID NO: 253904 - RNA, 64 nt, hsa
gcuuuugccuuuuuggggaugcuuggugagacagauuugccagucagcccuuuugaguucccgc

SEQ ID NO: 253905 - RNA, 64 nt, hsa
cugggaacagcugucauggucaccccuggauaacauuugccaccaaguauagaugcuggaucuu

SEQ ID NO: 253906 - RNA, 64 nt, hsa
uuaaacugucagaaacuucugugcauguauuuauauuugccagaguauaaacuuuuauacucug

SEQ ID NO: 253907 - RNA, 64 nt, hsa
uuauuagcagaaaccauguuuguaaccaaagcacauuugccaaugcuaacuggcuguuguaaua

SEQ ID NO: 253908 - RNA, 64 nt, hsa
cuaaaacaaacaaacuacagaaauguaaaccuucauuugccaaagguccuugguggccuguccc

SEQ ID NO: 253909 - RNA, 64 nt, hsa
gccagaacccacaggaaaaacuucaaaacuugacauuugccagaauguuuaaaauuuguucaga

SEQ ID NO: 253910 - RNA, 64 nt, hsa
cacacaacauguaagcauguaagaguaaagaauuguaugauauguuccuuuuuucaguucacca

SEQ ID NO: 253911 - RNA, 64 nt, hsa
cucugauccaacccuguacugauaguacuucccaguaugauauugugauguuucauacaaugca

SEQ ID NO: 253912 - RNA, 64 nt, hsa
uugaaaauauuuaaauauugcacuucuauaaauaguaugauaaaugcacagacaauugcaguaa

SEQ ID NO: 253913 - RNA, 64 nt, hsa
aagauguagucaccucagauaaaauugguaucguguaugauaauauuguaucauuuauauuugc

SEQ ID NO: 253914 - RNA, 64 nt, hsa
ugcuuggaguuuaccuggcuuauuuaauaugcuuauaaccuaguuaaagaaaggaaaagaaaac

SEQ ID NO: 253915 - RNA, 64 nt, hsa
aauucuauuuauaauacagaaucuuguuuugaaaauaaccuaauuaauauauuaaaauuccaaa

SEQ ID NO: 253916 - RNA, 64 nt, hsa
cauccauaguguuuagagagaaaaaaauaaaccaauaaccuaccuacugacaaguaaauuuaua

SEQ ID NO: 253917 - RNA, 64 nt, hsa
uguuagauuaggccuuauaaaacuugugugcauuauaaccuaagcugugcaaccugugaagcca

SEQ ID NO: 253918 - RNA, 64 nt, hsa
agaggaaguuuguuuuuuaauuuaagagggaaauauaaccuauaaauuuguuucuuccaagcuu

SEQ ID NO: 253919 - RNA, 63 nt, hsa
caaauuauuguggguguacuuuggcuuccuuuuguaugauagguccccaucaugaccaccucu

SEQ ID NO: 253920 - RNA, 63 nt, hsa
uuuaaaaauuguaaaauucaaguuaaaugacguguaugauauauaagcugaacacauuuucua

SEQ ID NO: 253921 - RNA, 63 nt, hsa
augcaucuacagcaggcauggauuguuuaugucguaugauauccuuuauuaaguaaguucacu

SEQ ID NO: 253922 - RNA, 63 nt, hsa
auaaaacugccacaauuguauuuuaauuuugagguaugauauuuucagauauuucauaauuuc

SEQ ID NO: 253923 - RNA, 63 nt, hsa
aacaaaaaccccugcugcagcauuucaggugcaguaugauauuuccuaaucuuuccuauuucu

SEQ ID NO: 253924 - RNA, 63 nt, hsa
agauuguaaaaguaaaaaacuguaaauguauauguaugauagaauuguuuccucuaaguguag

SEQ ID NO: 253925 - RNA, 63 nt, hsa
guuugugcagauuaccaaauuacugcugauguaguaugauaaagucagcuucuuggauacaga

SEQ ID NO: 253926 - RNA, 63 nt, hsa
ucauuggaauauuugcauuuugcacaaugacugguaugauagcucuugacaaauaaggaaagc

SEQ ID NO: 253927 - RNA, 63 nt, hsa
ggaagagacgaaagaaaggaaaauaaacucuuuguaugauauuuauuaggaggaaagaggacu

SEQ ID NO: 253928 - RNA, 63 nt, hsa
gcauucaggcuggaaaacacugauguggacucaguaugauaacugagaugggggacgccagac

SEQ ID NO: 253929 - RNA, 63 nt, hsa
cuauucugacagaaaagacaaagguuacuaauuguaugauaguguuuuuauauggaagaaugu

SEQ ID NO: 253930 - RNA, 63 nt, hsa
uucaucucaaaaauaauuuuuaaaaagccugagguaugauauagcauaaaagauugagaugaa

SEQ ID NO: 253931 - RNA, 63 nt, hsa
agcccagugcggcuccacagcauggaaucugauguaugauaugauagaauguggcacuaaaug

SEQ ID NO: 253932 - RNA, 63 nt, hsa
uugggauuuuuuuuuuuuuuuuguaacuggcuuguaugauauuuucuuucuguauuucucuau

SEQ ID NO: 253933 - RNA, 63 nt, hsa
ggaggaagauuccugcagccacuaaugcauuguguaugauaacaaaaacucugguaugacaca

SEQ ID NO: 253934 - RNA, 63 nt, hsa
gguuuugcuuuagagugcaaguaucauaauuccguaugauagauggggccuggacacccaucu

SEQ ID NO: 253935 - RNA, 63 nt, hsa
aaaaguuuauaagauuuuuaugaagcagccacuguaugauauuuuaagcaaauauguuauuua

SEQ ID NO: 253936 - RNA, 63 nt, hsa
uaucacuguaauggaauauccaauuuacagauaguaugauauacauuucaucauuuaaguaag

SEQ ID NO: 253937 - RNA, 63 nt, hsa
cuuugcuuuucuuuuucaaaucuccuaaugguaguaugauauagcauaguagaaggagauuug

SEQ ID NO: 253938 - RNA, 63 nt, hsa
cauaauaugcagcuuaggaugcuauuuugagauguaugauauucaguucauucaccugauuac

SEQ ID NO: 253939 - RNA, 63 nt, hsa
caaaauguuuuuuauuacggcuuuucuauugcuguaugauacagaacucuuuuggcauaaaua

SEQ ID NO: 253940 - RNA, 63 nt, hsa
guugguuagaagcauagguaacugauuaaguagguaugauacugcauuugaaauaaguggaca

SEQ ID NO: 253941 - RNA, 63 nt, hsa
acacaacauguaagcauguaagaguaaagaauuguaugauauguuccuuuuuucaguucacca

SEQ ID NO: 253942 - RNA, 63 nt, hsa
ucugauccaacccuguacugauaguacuucccaguaugauauugugauguuucauacaaugca

SEQ ID NO: 253943 - RNA, 63 nt, hsa
guauucugggaaugauguaaugcucugaauuuaguaugauauaaagaaaacuuuuuugugcua

SEQ ID NO: 253944 - RNA, 63 nt, hsa
uuuuaccaagaacauuuaagugccucagcaucuguaugauauaguggagcaggugcugacaua

SEQ ID NO: 253945 - RNA, 63 nt, hsa
uuaaugauggacagcauuauuaggaacccuguaguaugauauuuaacaauauaggcuucaaga

SEQ ID NO: 253946 - RNA, 63 nt, hsa
aacuuaguuuuguuuccuagauccuagaagacaguaugauauuuucucuggccaguugcauaa

SEQ ID NO: 253947 - RNA, 63 nt, hsa
ucuugauuaugcuacuggugcaauuggaucaguguaugauauggaugaugaugaaauggaccc

SEQ ID NO: 253948 - RNA, 63 nt, hsa
ucaugcuaaaaguauguaaagaucccauguacaguaugauaguguacuuuuuuuaaaggacug

SEQ ID NO: 253949 - RNA, 63 nt, hsa
acagucucucuuuauauaaauacacagaguuugguaugauauuuaaauacaucaucuggccag

SEQ ID NO: 253950 - RNA, 63 nt, hsa
uugaauagccuacucccaaguaagagcaaaucuguaugauaacauuuuuuccucuggacauaa

SEQ ID NO: 253951 - RNA, 63 nt, hsa
ugaaggaacugcucaucuaagcaaaagauuugaguaugauaugauaaaggcuuucuacauucu

SEQ ID NO: 253952 - RNA, 63 nt, hsa
uuuuagcuaaaaagagggacuguuaaauacaauguaugauaccaugacaaaaaucuuuccuga

SEQ ID NO: 253953 - RNA, 63 nt, hsa
uugguuauacaugacacugaaaugccuuacuuuguaugauauuccauaguauauuaaaaaugg

SEQ ID NO: 253954 - RNA, 63 nt, hsa
guaucucaaaaguauugaguuuagaaaucaguuguaugauacuaccuuuguaugucugucuuu

SEQ ID NO: 253955 - RNA, 63 nt, hsa
guaauaauuuuuuaagauucacuauaugugauaguaugauaugcauuuauuuaaaaugcauua

SEQ ID NO: 253956 - RNA, 63 nt, hsa
agcaucuaugacuuccuuuauuauucuaaaauaguaugauaagaauuaauagcaauaauaauu

SEQ ID NO: 253957 - RNA, 63 nt, hsa
cagaaauguugcuggugaauuuauaagaaugugguaugauacuaguaaugaaggcaaaaugga

SEQ ID NO: 253958 - RNA, 63 nt, hsa
acaggaggugaugaaccuuuuuaugugcagcugguaugauagaaggaaauugggaaaacuugu

SEQ ID NO: 253959 - RNA, 63 nt, hsa
accacuuuauauccacaaaggcaaauaacuaauguaugauaauagaauaauuugcacuaauua

SEQ ID NO: 253960 - RNA, 63 nt, hsa
acuguuuuccucauguucaguuauguuaaaguaguaugauaaaugcaugccuagaguagugcu

SEQ ID NO: 253961 - RNA, 63 nt, hsa
aggguggguauagaugcauagauaugggauuauguaugauauauauauauauacacacacaca

SEQ ID NO: 253962 - RNA, 63 nt, hsa
uauaaaccauuuuuauuucaugcauuaaaaauaguaugauaaagauuucagaguacaggucug

SEQ ID NO: 253963 - RNA, 63 nt, hsa
gggcuuucacugugauuuacugcauugcaggcuguaugauaaaacacacauaauuuaaagaga

SEQ ID NO: 253964 - RNA, 63 nt, hsa
uuaaaaccaauauuuauaaaaaguguauaugcaguaugauaccacuuuuaaaaaaagauaaau

SEQ ID NO: 253965 - RNA, 63 nt, hsa
uugaccauccuuucuuuuuauaguauauuucuuguaugauauuuuguaaagcucucaccuggu

SEQ ID NO: 253966 - RNA, 63 nt, hsa
acauauuuuugccaggaagaugaaaaucacauaguaugauaaacagguguauuccccucuacu

SEQ ID NO: 253967 - RNA, 63 nt, hsa
uuuaauuucacuaugcuuucagcuuacuuuauuguaugauauguaggucuaaaauauaguuug

SEQ ID NO: 253968 - RNA, 63 nt, hsa
ccaggagcccaugaaguaauagcguaaaguaaaguaugauauggaaaugugaaguuugcaaga

SEQ ID NO: 253969 - RNA, 63 nt, hsa
uuauuuugcauuaaacucuuuuuaucgggaauaguaugauauuuucagugucacuccauucau

SEQ ID NO: 253970 - RNA, 63 nt, hsa
ggauugcaccucuguaaacuauuccuaaaauguguaugauauauuugaaaaggcuuccauuaa

SEQ ID NO: 253971 - RNA, 63 nt, hsa
uucagaacuuguuucuuaucaagaaguuagcagguaugauauguauaucauacguauauaaac

SEQ ID NO: 253972 - RNA, 63 nt, hsa
uuugaugguugacuuaauuggcaccauaacuuuguaugauauuauacauuaaccuuuauuuau

SEQ ID NO: 253973 - RNA, 63 nt, hsa
aguaggcuuggggcagcuggguuuguccuugauguaugauacuguuauuauaauaauuauuau

SEQ ID NO: 253974 - RNA, 63 nt, hsa
ugaaaauauuuaaauauugcacuucuauaaauaguaugauaaaugcacagacaauugcaguaa

SEQ ID NO: 253975 - RNA, 63 nt, hsa
agauguagucaccucagauaaaauugguaucguguaugauaauauuguaucauuuauauuugc

SEQ ID NO: 253976 - RNA, 63 nt, hsa
ugguucagugagcugcacugaccucuacauuuuguaugauauguaaaacagauuuuuuguaga

SEQ ID NO: 253977 - RNA, 63 nt, hsa
uugcccaacagaaaccuuaggcugaauuuacagguaugauaauuuuuguaauuaauuuucuua

SEQ ID NO: 253978 - RNA, 63 nt, hsa
gcugcuuaaaaggagacuuaguaaaguucucuuguaugauaauuugguauuuacucaaaucuu

SEQ ID NO: 253979 - RNA, 63 nt, hsa
ccuuuggggaaaauuaacuuuuucuuuugauaaguaugauauucaauaaaauuuucuaaauag

SEQ ID NO: 253980 - RNA, 63 nt, hsa
agaaauguaguuugaaucauaaucuaaaucaucguaugauagaagagggaaaguuuuggugcc

SEQ ID NO: 253981 - RNA, 63 nt, hsa
caauuagauuucucacacucuaacuguauauuuguaugauauuuuaaaaucuccuaaaugcug

SEQ ID NO: 253982 - RNA, 63 nt, hsa
agugcauggccuucuacggcuucuaugccaagcguaugauacuauagauauaguguaccauac

SEQ ID NO: 253983 - RNA, 63 nt, hsa
gugucuggauauuaacucuuguuuaaacugaauguaugauauuuuguuagaauggaaaaguac

SEQ ID NO: 253984 - RNA, 63 nt, hsa
uucauuucuuuuuauggccgaaauuacuccauuguaugauaugccauguuucuuuauccauuc

SEQ ID NO: 253985 - RNA, 63 nt, hsa
guaagcuuuuauuaauacugaugacauuauaugguaugauaugaaaaaaucaccaauuuuuua

SEQ ID NO: 253986 - RNA, 63 nt, hsa
cguguuuauuuuuguauuuuucucugguugggaguaugauaugaaggaucaagauccucaacu

SEQ ID NO: 253987 - RNA, 63 nt, hsa
uuguuagugaacaggccuguuuuaaauaucuuaguaugauaucaaaagaauaaucaauuuagu

SEQ ID NO: 253988 - RNA, 63 nt, hsa
acgcguuuguccaacagcucauuggcucccuuuguaugauaucguggucuucucacauggugc

SEQ ID NO: 253989 - RNA, 63 nt, hsa
gauaaauuaacuuuuacagaaaucuuguuuacuguaugauauucuaaaacacugucaaauaaa

SEQ ID NO: 253990 - RNA, 63 nt, hsa
uuuacacgaacugaaaugagcaugcauuuucuuguaugauagugacuagcacuagacauguca

SEQ ID NO: 253991 - RNA, 63 nt, hsa
cuuugacugcuguuauuaccuauagcuaaguguguaugauaaugaaacucaucauuuuaguca

SEQ ID NO: 253992 - RNA, 63 nt, hsa
gcuguguugaaggcugugguuaauaaaacacaaguaugauaaacaggaccuagcguuuagccc

SEQ ID NO: 253993 - RNA, 63 nt, hsa
uuuguucuauggaaucaaauuucucacaaugcuguaugauacuauuuaaauuuggaggacaac

SEQ ID NO: 253994 - RNA, 63 nt, hsa
uuggugacucaucaauggauauguguuuuggauguaugauaugcuugguuuaaauucucuuug

SEQ ID NO: 253995 - RNA, 63 nt, hsa
acuguuuccaaaauuauuucuauaugacacaaaguaugauaccuuuaaaaaggugagcuuaua

SEQ ID NO: 253996 - RNA, 63 nt, hsa
gcaucagcugcuuugaaggcugaagauuguuuuguaugauacugcacagcaucaggcauuuua

SEQ ID NO: 253997 - RNA, 63 nt, hsa
uccacucagcuugguuccugcccccgcccugcuguaugauauuaauguggaaggucaucaaua

SEQ ID NO: 253998 - RNA, 63 nt, hsa
ucauaaugggaaaucuuuuucauuugagaaauuguaugauauuuauugguugugucuacugcc

SEQ ID NO: 253999 - RNA, 63 nt, hsa
gagcaagacuccaucucauaaauuaaaaggaaaguaugauaguguuauggauuuuagcucuga

SEQ ID NO: 254000 - RNA, 63 nt, hsa
auauugguauaugacauaacaggaaacaguauuguaugauauauuuauaaaugcuauaaagaa

SEQ ID NO: 254001 - RNA, 63 nt, hsa
ggucaagacuaacuuucuuuuaaagguucauuuguaugauaaauucauauguguauauauaau

SEQ ID NO: 254002 - RNA, 63 nt, hsa
gauuguauuucuguggaagaguaaaaguuguauguaugauauuugaaaaugcuaucccugcac

SEQ ID NO: 254003 - RNA, 63 nt, hsa
auccugugggaggaugagagcuacugggccguuguaugauagguugguaggggcuuguugauc

SEQ ID NO: 254004 - RNA, 63 nt, hsa
ugguuauuuuacagcauacaagcuucugcuccaguaugauaauuuuuaauugccuaagaauca

SEQ ID NO: 254005 - RNA, 63 nt, hsa
aaccucaagacagauuuauuauucuuaaaugcuguaugauaaugaagaaaaauaaaaauuuau

SEQ ID NO: 254006 - RNA, 63 nt, hsa
uuucucuugcuuccucuucucuucucccuuaucguaugauagaaagacauucuuccccaggag

SEQ ID NO: 254007 - RNA, 63 nt, hsa
aauuauagucuauuauuuuaaagggauuuuucaguaugauaugggccauuuuguucaucuauc

SEQ ID NO: 254008 - RNA, 63 nt, hsa
ggcucauuugagcauuuuggaauauuugagaauguaugauacauguaaaauuaaaaaaacuau

SEQ ID NO: 254009 - RNA, 63 nt, hsa
aucauuuuagacacuuuaggagggggugaaguuguaugauaaagcagauauuuuaauuauuug

SEQ ID NO: 254010 - RNA, 63 nt, hsa
acauaccuaguuuuguguauuggcuuugcuggaguaugauagcaaaaugaagacucuuuuacu

SEQ ID NO: 254011 - RNA, 63 nt, hsa
cuuguuucaggaaugguuaauucuucaacguugguaugauaaugauaacuuguuuugacuuga

SEQ ID NO: 254012 - RNA, 63 nt, hsa
aguuuauagaaagaugcugauugguaggugaugguaugauaucaaacuauuuugcaguuguaa

SEQ ID NO: 254013 - RNA, 63 nt, hsa
ugauucgugaauaaaacuagguacauaguaaguguaugauagauguuugauuuguaaauuaca

SEQ ID NO: 254014 - RNA, 63 nt, hsa
aagaaauaggcauuauuuuauugcuguaauauuguaugauacuuuaacuguacaauaauguug

SEQ ID NO: 254015 - RNA, 63 nt, hsa
uucccguggcugccaccagcgaaugaaacuuuuguaugauacauaaagugcuugagucuauuu

SEQ ID NO: 254016 - RNA, 63 nt, hsa
gaggcuuuggguggcucacuacugaacacauguguaugauacuaaagacgguauuaaaaugga

SEQ ID NO: 254017 - RNA, 63 nt, hsa
caaauuuaaggggagcucuucaacauuaaggcaguaugauaucaugcuugguuuucuuuuuuc

SEQ ID NO: 254018 - RNA, 63 nt, hsa
uuuucuccuguguuauauaugcauuaugugcagguaugauauuuucuucacuacuuuuucuau

SEQ ID NO: 254019 - RNA, 63 nt, hsa
gacuauguuagauuauuuuuaaagaugaaacauguaugauaggauggauucuuucuguauucu

SEQ ID NO: 254020 - RNA, 63 nt, hsa
uagaagagucaccagcagguuccaaauugauguguaugauaggaaaaaaaccuuaauuuuaaa

SEQ ID NO: 254021 - RNA, 63 nt, hsa
ggggaauuucaggggacagagaugggauuuguuguaugauaaacuguauguaguuuuuagucu

SEQ ID NO: 254022 - RNA, 63 nt, hsa
ccaaauuauucugaagguuuuuugaugauggagguaugauagguuuaucacacagccuaaggc

SEQ ID NO: 254023 - RNA, 63 nt, hsa
augugaaagcauauuuuguauccuaaaaugaauguaugauauucuaaacaucuguuuuaguau

SEQ ID NO: 254024 - RNA, 63 nt, hsa
ugcuaaguggaaacugcaugaauuaaaagagggguaugauagggacauuguccuuugggcuag

SEQ ID NO: 254025 - RNA, 63 nt, hsa
auuuuaauuuuuuaaugucucuguggaguauuuguaugauaccauaauguauauuuauguaga

SEQ ID NO: 254026 - RNA, 63 nt, hsa
aucagagcccaaugccuacaaguugcaaaaacaguaugauaauaaaacagugguccugaaaac

SEQ ID NO: 254027 - RNA, 63 nt, hsa
aagaagagaggugcacauaauuuaugcaggcaaguaugauacuuauuucauugguuuugugag

SEQ ID NO: 254028 - RNA, 63 nt, hsa
auacgugcaguaucuuuaaugaguaucuucaugguaugauaguguguguuugugagugcgaag

SEQ ID NO: 254029 - RNA, 63 nt, hsa
ucuguuacacuuuuuggaagugaaaacuuuguaguaugauagguuauuuugauguaaagaugu

SEQ ID NO: 254030 - RNA, 63 nt, hsa
uuuauucauuguuaucuugccaauggaaauaaaguaugauauugcauuuaaauauuauauuua

SEQ ID NO: 254031 - RNA, 63 nt, hsa
agggaugcugaccacagaccuuuauagcagcccguaugauauuauucacauuaugauaugugu

SEQ ID NO: 254032 - RNA, 63 nt, hsa
ccauauaauguuagcuggaaggucaauuucaguguaugauauacuuuauuaagauguauaaaa

SEQ ID NO: 254033 - RNA, 63 nt, hsa
caauaaugcacuuuucauacuugaaauuuauuuguaugauauaaaguuauuacuuuaaacaaa

SEQ ID NO: 254034 - RNA, 63 nt, hsa
agugccucuggauuuagagauauauauccuaggguaugauacuacugugacgggucuaacagc

SEQ ID NO: 254035 - RNA, 63 nt, hsa
auaaacuuugaauuaaauacaguugucuugaggguaugauaaguccacaaaaaauuggaaagc

SEQ ID NO: 254036 - RNA, 63 nt, hsa
uuagaagauauuuguuuuuuaaaauauauugauguaugauaaagaugaucuaauuugugaaug

SEQ ID NO: 254037 - RNA, 63 nt, hsa
uaucgggaguuccuuauuuaucacuagcagagaguaugauacaauuuucaaaugugaacaauc

SEQ ID NO: 254038 - RNA, 63 nt, hsa
cuuaaaugugaaggaacaacagcaacaagaccaguaugauauaccaagguaauaaaugcuguu

SEQ ID NO: 254039 - RNA, 63 nt, hsa
caauaauuugagggcaaacuuaguagugaguguguaugauagaaucaagagaauuaugggacg

SEQ ID NO: 254040 - RNA, 63 nt, hsa
gcagaucccagagucaguaaaucugccugugaaguaugauagucugcauuuguaaugagcauu

SEQ ID NO: 254041 - RNA, 63 nt, hsa
uucauauagaacugauaauguagcaagccccaaguaugauaauaggcagacuauucccaacuu

SEQ ID NO: 254042 - RNA, 63 nt, hsa
ggguagugugcauaaaguaccucugugucugaaguaugauaguugucuugaggaaaagcacuu

SEQ ID NO: 254043 - RNA, 63 nt, hsa
uuuaaagauuuaaacuaauaugcuggcuuuuauguaugauaccuaaucagagcauugaccaga

SEQ ID NO: 254044 - RNA, 63 nt, hsa
ggauaacauaccugauggagaaauguuuuguguguaugauauaugggaaagucuuuaguuaua

SEQ ID NO: 254045 - RNA, 63 nt, hsa
agugcuuaaaaaguuaauaaaauaaaaugaucuguaugauaccugcaauugaaaagccgaaaa

SEQ ID NO: 254046 - RNA, 63 nt, hsa
acuaaugaaguuuuaaauuaacaaccacuacuuguaugauaugaauaauauuuagaaauguua

SEQ ID NO: 254047 - RNA, 63 nt, hsa
accaccaauaguguaugugagccuuauuuuuauguaugauaggacuuuuuuuaguccaaaugu

SEQ ID NO: 254048 - RNA, 63 nt, hsa
aagauaauuugugggcagggguggaggaugcauguaugauacuccauaaauucaacauucuuu

SEQ ID NO: 254049 - RNA, 63 nt, hsa
uuuuaccaguauaguaaaaaaguagaaaagcaaguaugauauuuuuguaagauaauuuauuug

SEQ ID NO: 254050 - RNA, 63 nt, hsa
uagacugagaaauucauguuuacuuuucuagguguaugauacuuuguaaaguugauacuuucc

SEQ ID NO: 254051 - RNA, 63 nt, hsa
cucuggucuccugguucaacaacaggcuuauauguaugauacauguaauuuaaaccuucagac

SEQ ID NO: 254052 - RNA, 63 nt, hsa
ucuucuuucauuucuucuacaacucauacacucguaugauacuucgacacuguucuuagcuca

SEQ ID NO: 254053 - RNA, 63 nt, hsa
gaaugcuagguaaucuucguagaaaacuagaaaguaugauaaacaacaguuggaggaauccau

SEQ ID NO: 254054 - RNA, 63 nt, hsa
aauuuugaaaagaauagaggaaacacccucacuguaugauauaaaguuauagucauuuaaaaa

SEQ ID NO: 254055 - RNA, 63 nt, hsa
uuacggacagcauauaauucucccugcaaggauguaugauaauauguacaaaguaauuccaac

SEQ ID NO: 254056 - RNA, 63 nt, hsa
ccuggacauccugaaggagaaguggucugccccguaugauaucaggaccauccugcucucuau

SEQ ID NO: 254057 - RNA, 63 nt, hsa
aaaucaugaaauaucucacacuggagagaugcuguaugauauaaggaaugugggaaagugauc

SEQ ID NO: 254058 - RNA, 63 nt, hsa
auaaaguauacagaaacauuaucugaaagcaaaguaugauaguuuguuuugcuauacaguaca

SEQ ID NO: 254059 - RNA, 63 nt, hsa
uuaugucagugugauuauaaaaaauaaaagaucguaugauaugagauacauacuaugaaauga

SEQ ID NO: 254060 - RNA, 63 nt, hsa
aauggaauuuugcacauaauacauuguaauacuguaugauaaucaugugugaaaauaauuuuu

SEQ ID NO: 254061 - RNA, 63 nt, hsa
aaccuuauauggguugcuuuugcuuucacaccuguaugauagucauggaaacugaagcccaga

SEQ ID NO: 254062 - RNA, 63 nt, hsa
ugccuguaaauguuccccaaauaauuguuguguguaugauacguguauaauaaaaguauucuu

SEQ ID NO: 254063 - RNA, 63 nt, hsa
augagcaaguaaauagaauaauauuuuauuaauguaugauauguaauacuuauugucuaaauc

SEQ ID NO: 254064 - RNA, 63 nt, hsa
uuguuuucuccccugauuaauggugauauucaaguaugauacaaaaagaauuguaccaccaaa

SEQ ID NO: 254065 - RNA, 63 nt, hsa
accccccuuuguauuauagucaugcggucuuauguaugauaaacaguugaauaauuuguccuc

SEQ ID NO: 254066 - RNA, 63 nt, hsa
ucucuccagagcuuucaucugauaucucacaauguaugauauacguacaaaacacacagcaag

SEQ ID NO: 254067 - RNA, 63 nt, hsa
ugucauucucacgacuccgggagaaacugugcuguaugauacagaucuauuuuaauacacuua

SEQ ID NO: 254068 - RNA, 63 nt, hsa
aaacaaaucccuaacacgugguaugggugaaccguaugauaugcuuugccauugugaaacuuu

SEQ ID NO: 254069 - RNA, 63 nt, hsa
uuagauaugccauucauaucaaguaauguucaaguaugauaaaauuauuuugguugcuuuaaa

SEQ ID NO: 254070 - RNA, 63 nt, hsa
uggcuauuuuguuggccaaugggacauuaacaaguaugauacaagcagaggcuugagaagugc

SEQ ID NO: 254071 - RNA, 63 nt, hsa
aggagucaaguuacuggugccacagaucuggagguaugauaggucaggggcuagguguugaac

SEQ ID NO: 254072 - RNA, 63 nt, hsa
accuguaaaaguauugacucuucuaccaaguugguaugauauuccaggcagcucaaugauuau

SEQ ID NO: 254073 - RNA, 63 nt, hsa
uuccuuugaucauuucaugugaauauucuauuuguaugauacacuguauuucaauaaauuccu

SEQ ID NO: 254074 - RNA, 63 nt, hsa
acauaagacauacaucacauuauacacaaaaguguaugauauguacaacugagugguacagau

SEQ ID NO: 254075 - RNA, 63 nt, hsa
gaaauuuuuguuugauguaaucaauaaacuuugguaugauaugauugauauaucagccucuuu

SEQ ID NO: 254076 - RNA, 63 nt, hsa
aaacuuggccuaaaaucaaaccuuggcacagagguaugauacaacuuuaacaggagucaucaa

SEQ ID NO: 254077 - RNA, 63 nt, hsa
ccaaccuuauagauuguuggcuuucacaaucuuauaaccuaggauacagguaguuucgaguau

SEQ ID NO: 254078 - RNA, 63 nt, hsa
uuaugguuuuuggaguuuuucccuuuuuuugggauaaccuaacauugguuuggaaugauugug

SEQ ID NO: 254079 - RNA, 63 nt, hsa
uccagugcaaaauuaaaccauuaguucuugaugauaaccuagcauuaauacuuacaguauuuu

SEQ ID NO: 254080 - RNA, 63 nt, hsa
aaugugaacaugcuucagaguguaccuuuugccauaaccuauuuuaauuuacuuuuucugaag

SEQ ID NO: 254081 - RNA, 63 nt, hsa
gcaaagaaaugaagagauucuggaaaugcaucaauaaccuaagaaaaagcgacauaaaaauau

SEQ ID NO: 254082 - RNA, 63 nt, hsa
aagcaaacaaauuuaaguuuucuuguauugaaaauaaccuaugauuguauguuuugcauuccu

SEQ ID NO: 254083 - RNA, 63 nt, hsa
uuaucuacaauggaaucuucccucuguucucugauaaccuacuugcuuacucaaugccuuuaa

SEQ ID NO: 254084 - RNA, 63 nt, hsa
uccuaaagaauguguucuugcauuuugguugaaauaaccuacacaguguuaaaaaucagauac

SEQ ID NO: 254085 - RNA, 63 nt, hsa
uuguuuuguggguauuaggagugugggaaugugauaaccuaaacaaccuuugcucugaaauuc

SEQ ID NO: 254086 - RNA, 63 nt, hsa
uaauuuguuaaauuaucucuaggauggugauuuauaaccuacccaaaguuaucgauauucuua

SEQ ID NO: 254087 - RNA, 63 nt, hsa
guucuuuuccuuuauauaggcuuccaacaccaaauaaccuaacugcuggaaaacaagggaaau

SEQ ID NO: 254088 - RNA, 62 nt, hsa
aagacagugaccuggagugaaacagaaucuacauaaccuaagcccauauacucugcacugug

SEQ ID NO: 254089 - RNA, 63 nt, hsa
agucccuuauguaaaauggugcaguauuugcauauaaccuacauaccuucucuugugcaaucc

SEQ ID NO: 254090 - RNA, 63 nt, hsa
gcuuggaguuuaccuggcuuauuuaauaugcuuauaaccuaguuaaagaaaggaaaagaaaac

SEQ ID NO: 254091 - RNA, 63 nt, hsa
auucuauuuauaauacagaaucuuguuuugaaaauaaccuaauuaauauauuaaaauuccaaa

SEQ ID NO: 254092 - RNA, 63 nt, hsa
uuuuuauaucaaauuuaagcuggauuugggggcauaaccuaauuugagccaacuccugaguuu

SEQ ID NO: 254093 - RNA, 63 nt, hsa
uaugaauucucuguucugguggcacagcuauucauaaccuauauucuagaguagacaaucugg

SEQ ID NO: 254094 - RNA, 63 nt, hsa
uucaaaauucaaacugucacauuaagaaacaugauaaccuaaaugaccuaaauaagaacacug

SEQ ID NO: 254095 - RNA, 63 nt, hsa
aaaauaauuaauaaaaugguguaguauuugcauauaaccuaugcacauucucccauauaguuu

SEQ ID NO: 254096 - RNA, 63 nt, hsa
aaacaaaccccagcuuguuuaacagaaaugcuaauaaccuacugggaaagauggaggucuaaa

SEQ ID NO: 254097 - RNA, 63 nt, hsa
ccucagguuuuaaauuacaaccacaguugaauaauaaccuaaaaauaaauuuuaguuugcuaa

SEQ ID NO: 254098 - RNA, 63 nt, hsa
caaaaagcuggaacuuaccacucaaaaacauguauaaccuaauaaauucuacacaaggcuuuc

SEQ ID NO: 254099 - RNA, 63 nt, hsa
uuuuagaacaaauuucuaaauuaauuuauucccauaaccuacaauagcacugagaacagaaaa

SEQ ID NO: 254100 - RNA, 63 nt, hsa
agcauuuccagugguguggccugaaaacaaagaauaaccuaggcugcuggaaagcacccuuuu

SEQ ID NO: 254101 - RNA, 63 nt, hsa
cgcaugcaagcuugauucaccuucagggggcugauaaccuaguaaaucaucaaaaugagauca

SEQ ID NO: 254102 - RNA, 63 nt, hsa
acuuuucuauaucucaaauuaauauacauuuucauaaccuaccuuuguauuaagacuugcaau

SEQ ID NO: 254103 - RNA, 63 nt, hsa
gaaguagaauaaaauugaauaagaaaaagaucuauaaccuagguaaagcauaaucugucagag

SEQ ID NO: 254104 - RNA, 63 nt, hsa
uauuuauguauuucuauucugauuucugaaaugauaaccuaguagugucugaugaaguuuuuu

SEQ ID NO: 254105 - RNA, 63 nt, hsa
auccauaguguuuagagagaaaaaaauaaaccaauaaccuaccuacugacaaguaaauuuaua

SEQ ID NO: 254106 - RNA, 63 nt, hsa
guuagauuaggccuuauaaaacuugugugcauuauaaccuaagcugugcaaccugugaagcca

SEQ ID NO: 254107 - RNA, 63 nt, hsa
gaggaaguuuguuuuuuaauuuaagagggaaauauaaccuauaaauuuguuucuuccaagcuu

SEQ ID NO: 254108 - RNA, 63 nt, hsa
cuggagguacaaauaauuuagaaauaaaagaugauaaccuaacacuaucauaguuauuaaugu

SEQ ID NO: 254109 - RNA, 63 nt, hsa
aaauuaaaaaugugaaacuguuguacuauacguauaaccuaaccuuaauuauucuguaagaac

SEQ ID NO: 254110 - RNA, 63 nt, hsa
cuuuucuauuuuuuauaaauaucaugcacaacuauaaccuaugggaaugauguaguaacacag

SEQ ID NO: 254111 - RNA, 63 nt, hsa
acaccacuuuucaaaggacuucuugguuucagcauaaccuaagacagggaauugggagccauc

SEQ ID NO: 254112 - RNA, 63 nt, hsa
uaucauuccuguguuguuguacuuucacuguguauaaccuaaaccaucuacucuuuaguacug

SEQ ID NO: 254113 - RNA, 63 nt, hsa
agguuuccuucagauugcugauugcuuauacaaauaaccuacaugccagauuucuauucaacg

SEQ ID NO: 254114 - RNA, 63 nt, hsa
ccaaacacugcuuugaauuauaggaggagaacaauaaccuaccauccgcaagcaugcuaauuu

SEQ ID NO: 254115 - RNA, 63 nt, hsa
ccugguuacuauguauguugccagcuaguggaaauaaccuaccaauuguuuuuucuaggagau

SEQ ID NO: 254116 - RNA, 63 nt, hsa
aaacugaaacagauggguuuucuggguucucugauaaccuaugggaauguuuggaugccaguu

SEQ ID NO: 254117 - RNA, 63 nt, hsa
cacuaagauuuuauguuggagauacuucuuuaaauaaccuacagcuugggucuauggcuguga

SEQ ID NO: 254118 - RNA, 63 nt, hsa
uuggaaagggucuaauucauacaugcuuaaaguauaaccuacguuagauaguuuguugucaaa

SEQ ID NO: 254119 - RNA, 63 nt, hsa
cauaauuaaaucauagcuaguauaacuuuacagauaaccuaaaaagaauagaaaagaagagag

SEQ ID NO: 254120 - RNA, 63 nt, hsa
aaaauauauaauuuucucacaaacaaccaauacauaaccuauggcaguugguugaauaauuau

SEQ ID NO: 254121 - RNA, 63 nt, hsa
uuuagguguuugcuaauauacacaaucauuacuauaaccuaauuaagggacauuuuauaauuu

SEQ ID NO: 254122 - RNA, 63 nt, hsa
uauuuuuuguaggggucaaagaaaugcugauggauaaccuauaugauuuauaguuuguacaug

SEQ ID NO: 254123 - RNA, 63 nt, hsa
auuaguaaaugugaugcagucagagguuugguaauaaccuaugcaucaggacuuacaucacuu

SEQ ID NO: 254124 - RNA, 63 nt, hsa
aguccucagcuaaaaauagcguaguauuugcauauaaccuaugcacauccuccuguauacuuu

SEQ ID NO: 254125 - RNA, 63 nt, hsa
uuaugauaauaagcuuauauaugugaauaaguuauaaccuaguguauaaaaaauuauuucuaa

SEQ ID NO: 254126 - RNA, 63 nt, hsa
uuauauccagauauacaaccacaauaaagcaaaauaaccuacuaucaaaauagaaauguugcu

SEQ ID NO: 254127 - RNA, 63 nt, hsa
cuaacuggaagaucaaaaucaugucucuugcugauaaccuaagagcauuaagcucugagucca

SEQ ID NO: 254128 - RNA, 63 nt, hsa
auauaaguacuaaaacuguaaaaauccuggaauauaaccuaagaaauaccaauguggacauag

SEQ ID NO: 254129 - RNA, 61 nt, hsa
uuuguaaaugccguacaauaaacaaauuauuuaauaaccuacauguuuccaaaaaucucug

SEQ ID NO: 254130 - RNA, 63 nt, hsa
uccucacuuugacagaaacucaugcuucaguuuauaaccuauuaccuauuuuguaugcgacuc

SEQ ID NO: 254131 - RNA, 63 nt, hsa
guagaaccuuuucuuaucucaguggaaccuucuauaaccuaaauauaccauugaugauucuuc

SEQ ID NO: 254132 - RNA, 63 nt, hsa
gguguucagggcacuucuuguccucucugucccauaaccuaccuccacccucccccuagccag

SEQ ID NO: 254133 - RNA, 63 nt, hsa
agccuugaaagcuuugauaaguuuucaguaauaauaaccuauuuaaucagaugaugauguguu

SEQ ID NO: 254134 - RNA, 63 nt, hsa
uccacagauuaauuaguaacauauuuuucucccauaaccuagugaaccuggaaauacaacuuu

SEQ ID NO: 254135 - RNA, 63 nt, hsa
augcagaagauuuagguuuccagagaagcauacauaaccuagcuucuuuuuacucuugccucu

SEQ ID NO: 254136 - RNA, 63 nt, hsa
cucuuaaaccugguaacacuugauuugccuucuauaaccuauuuauuucaaguguucauauuu

SEQ ID NO: 254137 - RNA, 63 nt, hsa
uaccucuaacuguguaacauuuuagacuucuuaauaaccuaaauauuuaaaauaaugaaugua

SEQ ID NO: 254138 - RNA, 63 nt, hsa
gguauucauucacuuaaagguaccucuguagaaauaaccuaaaacugcagaaggaucugaaag

SEQ ID NO: 254139 - RNA, 63 nt, hsa
aggaucuuucauaaaaauuuaauuuccauaaucauaaccuaaaugaguucuuaaagaauucua

SEQ ID NO: 254140 - RNA, 63 nt, hsa
caauugaguaguacaguggaaacuguuaaaugcauaaccuaauuuuccugggacugccauauu

SEQ ID NO: 254141 - RNA, 63 nt, hsa
uuuuuuuguacuuguggaucuuuuguacuucucauaaccuaaugucagacuaagaaaaauaaa

SEQ ID NO: 254142 - RNA, 63 nt, hsa
acauuacaaagcaaagacuauuuuuaugcuuccauaaccuagaauuaaaaccaaauuaugacc

SEQ ID NO: 254143 - RNA, 63 nt, hsa
augaugacuuuuaagcauuuacaucacguacucauaaccuauuaugaaaauaaaugaaacugg

SEQ ID NO: 254144 - RNA, 63 nt, hsa
ucucaaaaaaaaaaaaaucuuacaaccucacaaauaaccuaguucaaaaaugggcaaagauuu

SEQ ID NO: 254145 - RNA, 63 nt, hsa
auaaaauacccacuuuuuauaaagaugauauuuauaaccuaggaacucaugccugucuuggcu

SEQ ID NO: 254146 - RNA, 63 nt, hsa
aaccuacaggucauuugagucuucacacaaauaauaaccuaucuggccaggagaauuaucuca

SEQ ID NO: 254147 - RNA, 63 nt, hsa
agcauaccugucucagcuguuuggccaaugugcauaaccuacucggauccccaccugacacua

SEQ ID NO: 254148 - RNA, 63 nt, hsa
uucucccaacugguucgaccuuugcagauacccauaaccuauguugagccuugcuuaccagca

SEQ ID NO: 254149 - RNA, 63 nt, hsa
guguacaguagcuuaaaauugcagugauugagcauaaccuacuuguuuguauaaauuauugaa

SEQ ID NO: 254150 - RNA, 63 nt, hsa
uuuugucaugguucauuauuauuaaagcacaaaauaaccuauuguuagaaaauauguguuuuu

SEQ ID NO: 254151 - RNA, 63 nt, hsa
auuccugaaaaugucauauauuuucauuaauaaauaaccuaaauaugauaaaacauaaagcag

SEQ ID NO: 254152 - RNA, 63 nt, hsa
gguggacaaugauuuuuaaaaaacuaacuuuguauaaccuaauauuuguauucucucaucuau

SEQ ID NO: 254153 - RNA, 63 nt, hsa
aaauuuaaaaacuuaaauauuguaauaugacagauaaccuaauaauuguaucuacauuaaaau

SEQ ID NO: 254154 - RNA, 63 nt, hsa
uucaaugaaaugaccuaaaaacaacaaaaaaaaauaaccuauacgguaguugcuuuagggggu

SEQ ID NO: 254155 - RNA, 63 nt, hsa
uagauuuguuaugaaaauugcuuuggggcucuaauaaccuaccuuuuaagaaugagaaacugc

SEQ ID NO: 254156 - RNA, 63 nt, hsa
gugacacuugaacuagucgauuuuuugaaggcuauaaccuaaccucgacuauuuguuguuaug

SEQ ID NO: 254157 - RNA, 63 nt, hsa
aagaaguccaaacccagcacgcaacagcccaacauaaccuagaaugucaagacacucaagaua

SEQ ID NO: 254158 - RNA, 63 nt, hsa
agacauuaugccugccuaaacaaaaagcaggacauaaccuagcucugaauacaugccacaagg

SEQ ID NO: 254159 - RNA, 63 nt, hsa
cccacguagagagaguguggauuauauuacaugauaaccuaccuggggaacaguccagaaagc

SEQ ID NO: 254160 - RNA, 63 nt, hsa
uuaaacuguaaauauauugucauacaauguuaaauaaccuauuuuuuuaaaaaaguucaacuu

SEQ ID NO: 254161 - RNA, 63 nt, hsa
uuuuauugcauaguagggugacuagaguuaacaauaaccuauugcauauauuuugaaauagcu

SEQ ID NO: 254162 - RNA, 63 nt, hsa
uguuuauauuuauuauauaagucuugguaacaaauaaccuauaaaguguuuaugacaaauuua

SEQ ID NO: 254163 - RNA, 63 nt, hsa
aaagaauguaagggcuauaaguagaaacuuucuauaaccuaaaugauguuauagaauuauuuu

SEQ ID NO: 254164 - RNA, 63 nt, hsa
gccucagcccaggccucgggaccaacucuuuguauaaccuaccugaauguauuaaaaacuaau

SEQ ID NO: 254165 - RNA, 63 nt, hsa
cacacacacacacacacacacacacacaaacauauaaccuaugccaauaaaaaugucucagca

SEQ ID NO: 254166 - RNA, 63 nt, hsa
ugcccggcccaaauauuuuuuauucaggaugguauaaccuaacugauaauagguaauaagguu

SEQ ID NO: 254167 - RNA, 63 nt, hsa
cuagauauuuaacaaaacauacggcucaaccucauaaccuauauguguguaugucuacaucug

SEQ ID NO: 254168 - RNA, 63 nt, hsa
uuguagcuuaguaaugagucauagcuacccacaauaaccuaauaaaaacucaaguucauccca

SEQ ID NO: 254169 - RNA, 63 nt, hsa
agcucauaucuuaaagauaaaagguacuauuauauaaccuauacacaagauacaggagaaaau

SEQ ID NO: 254170 - RNA, 63 nt, hsa
acuaugugacuuagugcacaacacauuugugaaauaaccuacuccuauauacugaccugccug

SEQ ID NO: 254171 - RNA, 63 nt, hsa
cuagcccucuguuuuuguuugaugaauucuguuauaaccuauggggucaggauaugaguccug

SEQ ID NO: 254172 - RNA, 63 nt, hsa
guuaaggauaccugauuucaaaauauuuaaagcauaaccuaacugaugguaggaugauuguau

SEQ ID NO: 254173 - RNA, 63 nt, hsa
aaauuugaguuugucuugguuauaccuugcaugauaaccuagcuagauuucuagcauuugcug

SEQ ID NO: 254174 - RNA, 63 nt, hsa
ggaccccagguuugugcucccuacucuccaccgauaaccuaucaaagggcuuugcaagagcuu

SEQ ID NO: 254175 - RNA, 63 nt, hsa
gaaaaauaugucuuacuggaaaaaucccucauaauaaccuaauagggcauugcuauuaaaaau

SEQ ID NO: 254176 - RNA, 63 nt, hsa
uuuuacauaaaagcuugaacauacagaugaauuauaaccuaugugaagaaaucuuagauauaa

SEQ ID NO: 254177 - RNA, 63 nt, hsa
caagcaauaagauuuauguauauuuguuuaauaauaaccuauuucaagucugaguuuugaaaa

SEQ ID NO: 254178 - RNA, 63 nt, hsa
ucagacacauuauuuucuucugaacuuggcaauauaaccuaauaaggcagaauaaguuucugu

SEQ ID NO: 254179 - RNA, 63 nt, hsa
ggauuauaaagagauaucaaagcacgauuuuagauaaccuaaacggcccagccuauacgaagu

SEQ ID NO: 254180 - RNA, 63 nt, hsa
uuucuaaagucaaaauaugaaugcuaagaaggcauaaccuacauccuucucugauuucuucag

SEQ ID NO: 254181 - RNA, 63 nt, hsa
auucauuuauguuucauauacaccuuauauacaauaaccuaaaggugauuuuauaugauauuu

SEQ ID NO: 254182 - RNA, 63 nt, hsa
auuugggaccauuaaaacuuuuuuugauguaauauaaccuaacguugugcugguaccuguuuu

SEQ ID NO: 254183 - RNA, 63 nt, hsa
uggugauauuuuaggccaggaguauaccuugcuauaaccuaagcaugccuucuuuauuccagc

SEQ ID NO: 254184 - RNA, 63 nt, hsa
gacaccaauuaauuuccuggucuuuaguauauaauaaccuaaaauaccauuguaaccucaguc

SEQ ID NO: 254185 - RNA, 63 nt, hsa
uuuugcucaccuuauguaauacuguaacuuccuauaaccuaauauuuucgguaucauuaacca

SEQ ID NO: 254186 - RNA, 63 nt, hsa
uuggguaauuuuuaauuuuuuguuuuuuaaaaaauaaccuagacuaugcaaaacaucaaagug

SEQ ID NO: 254187 - RNA, 63 nt, hsa
guuaaguagaagaaagccaugguaaacugauacauaaccuaaauuauaaaagcagaaaccuaa

SEQ ID NO: 254188 - RNA, 55 nt, hsa
agggagaagaugaugacuaaguggaauaaccuauuuugaaaaauuccuauuguga

SEQ ID NO: 254189 - RNA, 63 nt, hsa
uucacauugauuuacugguugaugauagauuuuauaaccuaacgguucucaugcggugcguaa

SEQ ID NO: 254190 - RNA, 63 nt, hsa
aagaaaggaggggauagagagagaccacuuuucauaaccuagccuuagaagucacacaguauu

SEQ ID NO: 254191 - RNA, 63 nt, hsa
ccuccacuuucuuuaagaaucaggggguacagaauaaccuacaaacaaccucuucaaaguacc

SEQ ID NO: 254192 - RNA, 63 nt, hsa
auguaaaaccccaaacuauaaaaacucuggaagauaaccuaggcaauaccauucuggacauag

SEQ ID NO: 254193 - RNA, 63 nt, hsa
cacucuacuguuaaugacagauguucuguuuuuauaaccuaccaaaaggaaacuagaggcuuc

SEQ ID NO: 254194 - RNA, 63 nt, hsa
uuucaaaugucuacauaaaauaucacuacccacauaaccuauaauuuguguggccagcaauuu

SEQ ID NO: 254195 - RNA, 63 nt, hsa
uacauacuacaucaucuacagaaaucuugaucaauaaccuagaaacuagguuaucuagguuau

SEQ ID NO: 254196 - RNA, 63 nt, hsa
cucagcagaaguaucagaaguagugguauggauauaaccuauuuagauuuaaugugaaauuua

SEQ ID NO: 254197 - RNA, 63 nt, hsa
aaaggcugccuuugcaaaaauccuacuggucaaauaaccuaaggaaauuauucauuucuguuc

SEQ ID NO: 254198 - RNA, 63 nt, hsa
uaggaacuuuuaguuccauuauaugaacacuggauaaccuaauuuuuuuuaaugcuuuaaaaa

SEQ ID NO: 254199 - RNA, 63 nt, hsa
acacaguagcaaauuuugaacgaugugauugauauaaccuaacaaaucugagccaguuauuau

SEQ ID NO: 254200 - RNA, 63 nt, hsa
uaacaccagaaagaaccuugccgaucaccaggcauaaccuaauuuuauccauggaagaaacac

SEQ ID NO: 254201 - RNA, 63 nt, hsa
aauaagccugugugguaggccacauagguccgaauaaccuaguuuuacaguugagggagcuga

SEQ ID NO: 254202 - RNA, 63 nt, hsa
ugcuuuugcauuaugaauuauauuguugaagcaauaaccuagccagcuguugcauuagcuaaa

SEQ ID NO: 254203 - RNA, 63 nt, hsa
accagauuuuaauuuaaauuaauauuuccauuaauaaccuauucauugcagauaccuauuaua

SEQ ID NO: 254204 - RNA, 63 nt, hsa
ccugaauuaugcucuuaugugaaguaaauugauauaaccuauugacuguauucuguguauuau

SEQ ID NO: 254205 - RNA, 63 nt, hsa
agggagaccccgguguguccguucuuuagcaauauaaccuacccagugcgugccgagcaggcu

SEQ ID NO: 254206 - RNA, 63 nt, hsa
uuaaagcacugugugacauagcuccuuagagauauaaccuauugucugcucauugucacgugu

SEQ ID NO: 254207 - RNA, 63 nt, hsa
cugaccacccacacucaaccucccucugaccucauaaccuaauggccuuggacaccagauucu

SEQ ID NO: 254208 - RNA, 63 nt, hsa
cuuccauuacaccacagugaguucacagguaauauaaccuacccaccuguguaaugucaaaaa

SEQ ID NO: 254209 - RNA, 63 nt, hsa
aaacucaaauaaauguaugauuaggaggacaucauaaccuaugaaugauggaaguccaaaaug

SEQ ID NO: 254210 - RNA, 63 nt, hsa
ucuaaguacauauguagauauuguuuucuguaaauaaccuauuuuuuucucuauucucugcaa

SEQ ID NO: 254211 - RNA, 63 nt, hsa
ggucuauggcgagggaaaaggguguucaccaugauaaccuagugccuccauagagggguuugg

SEQ ID NO: 254212 - RNA, 63 nt, hsa
ccuauauuagaaagauauugaucugacugaaauauaaccuaccugccaguaagguccaaaggc

SEQ ID NO: 254213 - RNA, 63 nt, hsa
aucacuuugagaaaugaggccuguacaaggcugauaaccuauaugugauggagaucacccaau

SEQ ID NO: 254214 - RNA, 63 nt, hsa
guguuuggguuuuuuaauugagaugaaauucaaauaaccuaaaaaucaaucacuugaaaguga

SEQ ID NO: 254215 - RNA, 63 nt, hsa
gauaccugccuuguacuuaguaccuuaauaccaauaaccuaaugguacuuaggcgaguaccau

SEQ ID NO: 254216 - RNA, 63 nt, hsa
ugccccuaaccugccuuuucccaucuccccagcauaaccuaauauuuuuuuuuuuuuuuugag

SEQ ID NO: 254217 - RNA, 63 nt, hsa
ccugggaugcccuccucccccucgcccuuuguaauaaccuaaucugagaccgugcuugguggg

SEQ ID NO: 254218 - RNA, 63 nt, hsa
uccgucugugucccacccaugcagacucucugaauaaccuagccaauaucaaacgagaacagg

SEQ ID NO: 254219 - RNA, 63 nt, hsa
uuaaggaacccauuacugccauuuggaauucaaauaaccuaaccaaccuccaccuccuccuuc

SEQ ID NO: 254220 - RNA, 63 nt, hsa
ugcuuaacuuuaucucuuaauuucuaaagguaaauaaccuagguucagcuuuugcuuaaacau

SEQ ID NO: 254221 - RNA, 63 nt, hsa
guuuuagaggucagauuccucccaaccaggcuaauaaccuaacacauguuuaaaaaaaaucug

SEQ ID NO: 254222 - RNA, 63 nt, hsa
ucuucucuucugugaucucaguaggccuaaccuauaaccuagcacagacugcuacagcugcuc

SEQ ID NO: 254223 - RNA, 63 nt, hsa
agucccugauacaaaaugacgucguauuugaauauaaccuaugcacauccucccauacuuuaa

SEQ ID NO: 254224 - RNA, 63 nt, hsa
cauucccugaaaggaggaugaugauaucuaggcauaaccuagccugugaggaaccuaguuagg

SEQ ID NO: 254225 - RNA, 63 nt, hsa
auaccucccaauccaaguagcaucuguagcuacauaaccuauauaccuccagcagcuggacau

SEQ ID NO: 254226 - RNA, 63 nt, hsa
acugcuuuauaaaaauggcaacuuuagguauagauaaccuaauucagguugcaguuuuaauau

SEQ ID NO: 254227 - RNA, 63 nt, hsa
uauuaagggagacauuuuagucaguaagacgauauaaccuacuuacuccguaaggggaaauga

SEQ ID NO: 254228 - RNA, 63 nt, hsa
cucucuaaugagaacaaaguuagaaaucugccgauaaccuaaaauaauuuagaaaugaauuaa

SEQ ID NO: 254229 - RNA, 65 nt, hsa
cuccaaccuuauagauuguuggcuuucacaaucuuauaaccuaggauacagguaguuucgaguau

SEQ ID NO: 254230 - RNA, 65 nt, hsa
gguuaugguuuuuggaguuuuucccuuuuuuugggauaaccuaacauugguuuggaaugauugug

SEQ ID NO: 254231 - RNA, 65 nt, hsa
aauccagugcaaaauuaaaccauuaguucuugaugauaaccuagcauuaauacuuacaguauuuu

SEQ ID NO: 254232 - RNA, 65 nt, hsa
guaaugugaacaugcuucagaguguaccuuuugccauaaccuauuuuaauuuacuuuuucugaag

SEQ ID NO: 254233 - RNA, 65 nt, hsa
uugcaaagaaaugaagagauucuggaaaugcaucaauaaccuaagaaaaagcgacauaaaaauau

SEQ ID NO: 254234 - RNA, 65 nt, hsa
uaaagcaaacaaauuuaaguuuucuuguauugaaaauaaccuaugauuguauguuuugcauuccu

SEQ ID NO: 254235 - RNA, 65 nt, hsa
aauuaucuacaauggaaucuucccucuguucucugauaaccuacuugcuuacucaaugccuuuaa

SEQ ID NO: 254236 - RNA, 65 nt, hsa
ucuccuaaagaauguguucuugcauuuugguugaaauaaccuacacaguguuaaaaaucagauac

SEQ ID NO: 254237 - RNA, 65 nt, hsa
ucuuguuuuguggguauuaggagugugggaaugugauaaccuaaacaaccuuugcucugaaauuc

SEQ ID NO: 254238 - RNA, 65 nt, hsa
uuuaauuuguuaaauuaucucuaggauggugauuuauaaccuacccaaaguuaucgauauucuua

SEQ ID NO: 254239 - RNA, 65 nt, hsa
aaguucuuuuccuuuauauaggcuuccaacaccaaauaaccuaacugcuggaaaacaagggaaau

SEQ ID NO: 254240 - RNA, 62 nt, hsa; identical to SEQ ID NO: 254088

SEQ ID NO: 254241 - RNA, 65 nt, hsa
caagucccuuauguaaaauggugcaguauuugcauauaaccuacauaccuucucuugugcaaucc

SEQ ID NO: 254242 - RNA, 65 nt, hsa
gugcuuggaguuuaccuggcuuauuuaauaugcuuauaaccuaguuaaagaaaggaaaagaaaac

SEQ ID NO: 254243 - RNA, 65 nt, hsa
aaauucuauuuauaauacagaaucuuguuuugaaaauaaccuaauuaauauauuaaaauuccaaa

SEQ ID NO: 254244 - RNA, 65 nt, hsa
uuuuuuuauaucaaauuuaagcuggauuugggggcauaaccuaauuugagccaacuccugaguuu

SEQ ID NO: 254245 - RNA, 65 nt, hsa
ucuaugaauucucuguucugguggcacagcuauucauaaccuauauucuagaguagacaaucugg

SEQ ID NO: 254246 - RNA, 65 nt, hsa
auuucaaaauucaaacugucacauuaagaaacaugauaaccuaaaugaccuaaauaagaacacug

SEQ ID NO: 254247 - RNA, 65 nt, hsa
auaaaauaauuaauaaaaugguguaguauuugcauauaaccuaugcacauucucccauauaguuu

SEQ ID NO: 254248 - RNA, 65 nt, hsa
guaaacaaaccccagcuuguuuaacagaaaugcuaauaaccuacugggaaagauggaggucuaaa

SEQ ID NO: 254249 - RNA, 65 nt, hsa
agccucagguuuuaaauuacaaccacaguugaauaauaaccuaaaaauaaauuuuaguuugcuaa

SEQ ID NO: 254250 - RNA, 65 nt, hsa
accaaaaagcuggaacuuaccacucaaaaacauguauaaccuaauaaauucuacacaaggcuuuc

SEQ ID NO: 254251 - RNA, 65 nt, hsa
uauuuuagaacaaauuucuaaauuaauuuauucccauaaccuacaauagcacugagaacagaaaa

SEQ ID NO: 254252 - RNA, 65 nt, hsa
aaagcauuuccagugguguggccugaaaacaaagaauaaccuaggcugcuggaaagcacccuuuu

SEQ ID NO: 254253 - RNA, 65 nt, hsa
aacgcaugcaagcuugauucaccuucagggggcugauaaccuaguaaaucaucaaaaugagauca

SEQ ID NO: 254254 - RNA, 65 nt, hsa
aaacuuuucuauaucucaaauuaauauacauuuucauaaccuaccuuuguauuaagacuugcaau

SEQ ID NO: 254255 - RNA, 65 nt, hsa
gugaaguagaauaaaauugaauaagaaaaagaucuauaaccuagguaaagcauaaucugucagag

SEQ ID NO: 254256 - RNA, 65 nt, hsa
uauauuuauguauuucuauucugauuucugaaaugauaaccuaguagugucugaugaaguuuuuu

SEQ ID NO: 254257 - RNA, 65 nt, hsa
acauccauaguguuuagagagaaaaaaauaaaccaauaaccuaccuacugacaaguaaauuuaua

SEQ ID NO: 254258 - RNA, 65 nt, hsa
uuguuagauuaggccuuauaaaacuugugugcauuauaaccuaagcugugcaaccugugaagcca

SEQ ID NO: 254259 - RNA, 65 nt, hsa
cagaggaaguuuguuuuuuaauuuaagagggaaauauaaccuauaaauuuguuucuuccaagcuu

SEQ ID NO: 254260 - RNA, 65 nt, hsa
gacuggagguacaaauaauuuagaaauaaaagaugauaaccuaacacuaucauaguuauuaaugu

SEQ ID NO: 254261 - RNA, 65 nt, hsa
uaaaauuaaaaaugugaaacuguuguacuauacguauaaccuaaccuuaauuauucuguaagaac

SEQ ID NO: 254262 - RNA, 65 nt, hsa
uucuuuucuauuuuuuauaaauaucaugcacaacuauaaccuaugggaaugauguaguaacacag

SEQ ID NO: 254263 - RNA, 65 nt, hsa
agacaccacuuuucaaaggacuucuugguuucagcauaaccuaagacagggaauugggagccauc

SEQ ID NO: 254264 - RNA, 65 nt, hsa
uuuaucauuccuguguuguuguacuuucacuguguauaaccuaaaccaucuacucuuuaguacug

SEQ ID NO: 254265 - RNA, 65 nt, hsa
agagguuuccuucagauugcugauugcuuauacaaauaaccuacaugccagauuucuauucaacg

SEQ ID NO: 254266 - RNA, 65 nt, hsa
gaccaaacacugcuuugaauuauaggaggagaacaauaaccuaccauccgcaagcaugcuaauuu

SEQ ID NO: 254267 - RNA, 65 nt, hsa
guccugguuacuauguauguugccagcuaguggaaauaaccuaccaauuguuuuuucuaggagau

SEQ ID NO: 254268 - RNA, 65 nt, hsa
acaaacugaaacagauggguuuucuggguucucugauaaccuaugggaauguuuggaugccaguu

SEQ ID NO: 254269 - RNA, 65 nt, hsa
gacacuaagauuuuauguuggagauacuucuuuaaauaaccuacagcuugggucuauggcuguga

SEQ ID NO: 254270 - RNA, 65 nt, hsa
uuuuggaaagggucuaauucauacaugcuuaaaguauaaccuacguuagauaguuuguugucaaa

SEQ ID NO: 254271 - RNA, 65 nt, hsa
gucauaauuaaaucauagcuaguauaacuuuacagauaaccuaaaaagaauagaaaagaagagag

SEQ ID NO: 254272 - RNA, 65 nt, hsa
aaaaaauauauaauuuucucacaaacaaccaauacauaaccuauggcaguugguugaauaauuau

SEQ ID NO: 254273 - RNA, 65 nt, hsa
cauuuagguguuugcuaauauacacaaucauuacuauaaccuaauuaagggacauuuuauaauuu

SEQ ID NO: 254274 - RNA, 65 nt, hsa
uauauuuuuuguaggggucaaagaaaugcugauggauaaccuauaugauuuauaguuuguacaug

SEQ ID NO: 254275 - RNA, 65 nt, hsa
acauuaguaaaugugaugcagucagagguuugguaauaaccuaugcaucaggacuuacaucacuu

SEQ ID NO: 254276 - RNA, 65 nt, hsa
caaguccucagcuaaaaauagcguaguauuugcauauaaccuaugcacauccuccuguauacuuu

SEQ ID NO: 254277 - RNA, 65 nt, hsa
uauuaugauaauaagcuuauauaugugaauaaguuauaaccuaguguauaaaaaauuauuucuaa

SEQ ID NO: 254278 - RNA, 65 nt, hsa
uuuuauauccagauauacaaccacaauaaagcaaaauaaccuacuaucaaaauagaaauguugcu

SEQ ID NO: 254279 - RNA, 65 nt, hsa
ugcuaacuggaagaucaaaaucaugucucuugcugauaaccuaagagcauuaagcucugagucca

SEQ ID NO: 254280 - RNA, 65 nt, hsa
aaauauaaguacuaaaacuguaaaaauccuggaauauaaccuaagaaauaccaauguggacauag

SEQ ID NO: 254281 - RNA, 63 nt, hsa
ucuuuguaaaugccguacaauaaacaaauuauuuaauaaccuacauguuuccaaaaaucucug

SEQ ID NO: 254282 - RNA, 65 nt, hsa
aauccucacuuugacagaaacucaugcuucaguuuauaaccuauuaccuauuuuguaugcgacuc

SEQ ID NO: 254283 - RNA, 65 nt, hsa
uuguagaaccuuuucuuaucucaguggaaccuucuauaaccuaaauauaccauugaugauucuuc

SEQ ID NO: 254284 - RNA, 65 nt, hsa
aagguguucagggcacuucuuguccucucugucccauaaccuaccuccacccucccccuagccag

SEQ ID NO: 254285 - RNA, 65 nt, hsa
auagccuugaaagcuuugauaaguuuucaguaauaauaaccuauuuaaucagaugaugauguguu

SEQ ID NO: 254286 - RNA, 65 nt, hsa
uguccacagauuaauuaguaacauauuuuucucccauaaccuagugaaccuggaaauacaacuuu

SEQ ID NO: 254287 - RNA, 65 nt, hsa
uaaugcagaagauuuagguuuccagagaagcauacauaaccuagcuucuuuuuacucuugccucu

SEQ ID NO: 254288 - RNA, 65 nt, hsa
uacucuuaaaccugguaacacuugauuugccuucuauaaccuauuuauuucaaguguucauauuu

SEQ ID NO: 254289 - RNA, 65 nt, hsa
ucuaccucuaacuguguaacauuuuagacuucuuaauaaccuaaauauuuaaaauaaugaaugua

SEQ ID NO: 254290 - RNA, 65 nt, hsa
gugguauucauucacuuaaagguaccucuguagaaauaaccuaaaacugcagaaggaucugaaag

SEQ ID NO: 254291 - RNA, 65 nt, hsa
ccaggaucuuucauaaaaauuuaauuuccauaaucauaaccuaaaugaguucuuaaagaauucua

SEQ ID NO: 254292 - RNA, 65 nt, hsa
gucaauugaguaguacaguggaaacuguuaaaugcauaaccuaauuuuccugggacugccauauu

SEQ ID NO: 254293 - RNA, 65 nt, hsa
gauuuuuuuguacuuguggaucuuuuguacuucucauaaccuaaugucagacuaagaaaaauaaa

SEQ ID NO: 254294 - RNA, 65 nt, hsa
gaacauuacaaagcaaagacuauuuuuaugcuuccauaaccuagaauuaaaaccaaauuaugacc

SEQ ID NO: 254295 - RNA, 65 nt, hsa
ugaugaugacuuuuaagcauuuacaucacguacucauaaccuauuaugaaaauaaaugaaacugg

SEQ ID NO: 254296 - RNA, 65 nt, hsa
ugucucaaaaaaaaaaaaaucuuacaaccucacaaauaaccuaguucaaaaaugggcaaagauuu

SEQ ID NO: 254297 - RNA, 65 nt, hsa
cuauaaaauacccacuuuuuauaaagaugauauuuauaaccuaggaacucaugccugucuuggcu

SEQ ID NO: 254298 - RNA, 65 nt, hsa
uuaaccuacaggucauuugagucuucacacaaauaauaaccuaucuggccaggagaauuaucuca

SEQ ID NO: 254299 - RNA, 65 nt, hsa
ugagcauaccugucucagcuguuuggccaaugugcauaaccuacucggauccccaccugacacua

SEQ ID NO: 254300 - RNA, 65 nt, hsa
aauucucccaacugguucgaccuuugcagauacccauaaccuauguugagccuugcuuaccagca

SEQ ID NO: 254301 - RNA, 65 nt, hsa
cuguguacaguagcuuaaaauugcagugauugagcauaaccuacuuguuuguauaaauuauugaa

SEQ ID NO: 254302 - RNA, 65 nt, hsa
uauuuugucaugguucauuauuauuaaagcacaaaauaaccuauuguuagaaaauauguguuuuu

SEQ ID NO: 254303 - RNA, 65 nt, hsa
guauuccugaaaaugucauauauuuucauuaauaaauaaccuaaauaugauaaaacauaaagcag

SEQ ID NO: 254304 - RNA, 65 nt, hsa
uugguggacaaugauuuuuaaaaaacuaacuuuguauaaccuaauauuuguauucucucaucuau

SEQ ID NO: 254305 - RNA, 65 nt, hsa
uaaaauuuaaaaacuuaaauauuguaauaugacagauaaccuaauaauuguaucuacauuaaaau

SEQ ID NO: 254306 - RNA, 65 nt, hsa
uuuucaaugaaaugaccuaaaaacaacaaaaaaaaauaaccuauacgguaguugcuuuagggggu

SEQ ID NO: 254307 - RNA, 65 nt, hsa
gguagauuuguuaugaaaauugcuuuggggcucuaauaaccuaccuuuuaagaaugagaaacugc

SEQ ID NO: 254308 - RNA, 65 nt, hsa
gugugacacuugaacuagucgauuuuuugaaggcuauaaccuaaccucgacuauuuguuguuaug

SEQ ID NO: 254309 - RNA, 65 nt, hsa
ccaagaaguccaaacccagcacgcaacagcccaacauaaccuagaaugucaagacacucaagaua

SEQ ID NO: 254310 - RNA, 65 nt, hsa
aaagacauuaugccugccuaaacaaaaagcaggacauaaccuagcucugaauacaugccacaagg

SEQ ID NO: 254311 - RNA, 65 nt, hsa
uucccacguagagagaguguggauuauauuacaugauaaccuaccuggggaacaguccagaaagc

SEQ ID NO: 254312 - RNA, 65 nt, hsa
auuuaaacuguaaauauauugucauacaauguuaaauaaccuauuuuuuuaaaaaaguucaacuu

SEQ ID NO: 254313 - RNA, 65 nt, hsa
uguuuuauugcauaguagggugacuagaguuaacaauaaccuauugcauauauuuugaaauagcu

SEQ ID NO: 254314 - RNA, 65 nt, hsa
uauguuuauauuuauuauauaagucuugguaacaaauaaccuauaaaguguuuaugacaaauuua

SEQ ID NO: 254315 - RNA, 65 nt, hsa
auaaagaauguaagggcuauaaguagaaacuuucuauaaccuaaaugauguuauagaauuauuuu

SEQ ID NO: 254316 - RNA, 65 nt, hsa
aggccucagcccaggccucgggaccaacucuuuguauaaccuaccugaauguauuaaaaacuaau

SEQ ID NO: 254317 - RNA, 65 nt, hsa
cacacacacacacacacacacacacacacaaacauauaaccuaugccaauaaaaaugucucagca

SEQ ID NO: 254318 - RNA, 65 nt, hsa
caugcccggcccaaauauuuuuuauucaggaugguauaaccuaacugauaauagguaauaagguu

SEQ ID NO: 254319 - RNA, 65 nt, hsa
ugcuagauauuuaacaaaacauacggcucaaccucauaaccuauauguguguaugucuacaucug

SEQ ID NO: 254320 - RNA, 65 nt, hsa
ucuuguagcuuaguaaugagucauagcuacccacaauaaccuaauaaaaacucaaguucauccca

SEQ ID NO: 254321 - RNA, 65 nt, hsa
ucagcucauaucuuaaagauaaaagguacuauuauauaaccuauacacaagauacaggagaaaau

SEQ ID NO: 254322 - RNA, 65 nt, hsa
caacuaugugacuuagugcacaacacauuugugaaauaaccuacuccuauauacugaccugccug

SEQ ID NO: 254323 - RNA, 65 nt, hsa
cucuagcccucuguuuuuguuugaugaauucuguuauaaccuauggggucaggauaugaguccug

SEQ ID NO: 254324 - RNA, 65 nt, hsa
uaguuaaggauaccugauuucaaaauauuuaaagcauaaccuaacugaugguaggaugauuguau

SEQ ID NO: 254325 - RNA, 65 nt, hsa
auaaauuugaguuugucuugguuauaccuugcaugauaaccuagcuagauuucuagcauuugcug

SEQ ID NO: 254326 - RNA, 65 nt, hsa
ugggaccccagguuugugcucccuacucuccaccgauaaccuaucaaagggcuuugcaagagcuu

SEQ ID NO: 254327 - RNA, 65 nt, hsa
augaaaaauaugucuuacuggaaaaaucccucauaauaaccuaauagggcauugcuauuaaaaau

SEQ ID NO: 254328 - RNA, 65 nt, hsa
auuuuuacauaaaagcuugaacauacagaugaauuauaaccuaugugaagaaaucuuagauauaa

SEQ ID NO: 254329 - RNA, 65 nt, hsa
gccaagcaauaagauuuauguauauuuguuuaauaauaaccuauuucaagucugaguuuugaaaa

SEQ ID NO: 254330 - RNA, 65 nt, hsa
aaucagacacauuauuuucuucugaacuuggcaauauaaccuaauaaggcagaauaaguuucugu

SEQ ID NO: 254331 - RNA, 65 nt, hsa
caggauuauaaagagauaucaaagcacgauuuuagauaaccuaaacggcccagccuauacgaagu

SEQ ID NO: 254332 - RNA, 65 nt, hsa
ucuuucuaaagucaaaauaugaaugcuaagaaggcauaaccuacauccuucucugauuucuucag

SEQ ID NO: 254333 - RNA, 65 nt, hsa
aaauucauuuauguuucauauacaccuuauauacaauaaccuaaaggugauuuuauaugauauuu

SEQ ID NO: 254334 - RNA, 65 nt, hsa
auauuugggaccauuaaaacuuuuuuugauguaauauaaccuaacguugugcugguaccuguuuu

SEQ ID NO: 254335 - RNA, 65 nt, hsa
gauggugauauuuuaggccaggaguauaccuugcuauaaccuaagcaugccuucuuuauuccagc

SEQ ID NO: 254336 - RNA, 65 nt, hsa
aggacaccaauuaauuuccuggucuuuaguauauaauaaccuaaaauaccauuguaaccucaguc

SEQ ID NO: 254337 - RNA, 65 nt, hsa
uauuuugcucaccuuauguaauacuguaacuuccuauaaccuaauauuuucgguaucauuaacca

SEQ ID NO: 254338 - RNA, 65 nt, hsa
auuuggguaauuuuuaauuuuuuguuuuuuaaaaaauaaccuagacuaugcaaaacaucaaagug

SEQ ID NO: 254339 - RNA, 65 nt, hsa
cuguuaaguagaagaaagccaugguaaacugauacauaaccuaaauuauaaaagcagaaaccuaa

SEQ ID NO: 254340 - RNA, 55 nt, hsa; identical to SEQ ID NO: 254188

SEQ ID NO: 254341 - RNA, 65 nt, hsa
uuuucacauugauuuacugguugaugauagauuuuauaaccuaacgguucucaugcggugcguaa

SEQ ID NO: 254342 - RNA, 65 nt, hsa
aaaagaaaggaggggauagagagagaccacuuuucauaaccuagccuuagaagucacacaguauu

SEQ ID NO: 254343 - RNA, 65 nt, hsa
cuccuccacuuucuuuaagaaucaggggguacagaauaaccuacaaacaaccucuucaaaguacc

SEQ ID NO: 254344 - RNA, 65 nt, hsa
aaauguaaaaccccaaacuauaaaaacucuggaagauaaccuaggcaauaccauucuggacauag

SEQ ID NO: 254345 - RNA, 65 nt, hsa
aacacucuacuguuaaugacagauguucuguuuuuauaaccuaccaaaaggaaacuagaggcuuc

SEQ ID NO: 254346 - RNA, 65 nt, hsa
uauuucaaaugucuacauaaaauaucacuacccacauaaccuauaauuuguguggccagcaauuu

SEQ ID NO: 254347 - RNA, 65 nt, hsa
uguacauacuacaucaucuacagaaaucuugaucaauaaccuagaaacuagguuaucuagguuau

SEQ ID NO: 254348 - RNA, 65 nt, hsa
uacucagcagaaguaucagaaguagugguauggauauaaccuauuuagauuuaaugugaaauuua

SEQ ID NO: 254349 - RNA, 65 nt, hsa
agaaaggcugccuuugcaaaaauccuacuggucaaauaaccuaaggaaauuauucauuucuguuc

SEQ ID NO: 254350 - RNA, 65 nt, hsa
uguaggaacuuuuaguuccauuauaugaacacuggauaaccuaauuuuuuuuaaugcuuuaaaaa

SEQ ID NO: 254351 - RNA, 65 nt, hsa
acacacaguagcaaauuuugaacgaugugauugauauaaccuaacaaaucugagccaguuauuau

SEQ ID NO: 254352 - RNA, 65 nt, hsa
uuuaacaccagaaagaaccuugccgaucaccaggcauaaccuaauuuuauccauggaagaaacac

SEQ ID NO: 254353 - RNA, 65 nt, hsa
gcaauaagccugugugguaggccacauagguccgaauaaccuaguuuuacaguugagggagcuga

SEQ ID NO: 254354 - RNA, 65 nt, hsa
gcugcuuuugcauuaugaauuauauuguugaagcaauaaccuagccagcuguugcauuagcuaaa

SEQ ID NO: 254355 - RNA, 65 nt, hsa
gaaccagauuuuaauuuaaauuaauauuuccauuaauaaccuauucauugcagauaccuauuaua

SEQ ID NO: 254356 - RNA, 65 nt, hsa
ggccugaauuaugcucuuaugugaaguaaauugauauaaccuauugacuguauucuguguauuau

SEQ ID NO: 254357 - RNA, 65 nt, hsa
ucagggagaccccgguguguccguucuuuagcaauauaaccuacccagugcgugccgagcaggcu

SEQ ID NO: 254358 - RNA, 65 nt, hsa
guuuaaagcacugugugacauagcuccuuagagauauaaccuauugucugcucauugucacgugu

SEQ ID NO: 254359 - RNA, 65 nt, hsa
ugcugaccacccacacucaaccucccucugaccucauaaccuaauggccuuggacaccagauucu

SEQ ID NO: 254360 - RNA, 65 nt, hsa
uccuuccauuacaccacagugaguucacagguaauauaaccuacccaccuguguaaugucaaaaa

SEQ ID NO: 254361 - RNA, 65 nt, hsa
aaaaacucaaauaaauguaugauuaggaggacaucauaaccuaugaaugauggaaguccaaaaug

SEQ ID NO: 254362 - RNA, 65 nt, hsa
ccucuaaguacauauguagauauuguuuucuguaaauaaccuauuuuuuucucuauucucugcaa

SEQ ID NO: 254363 - RNA, 65 nt, hsa
agggucuauggcgagggaaaaggguguucaccaugauaaccuagugccuccauagagggguuugg

SEQ ID NO: 254364 - RNA, 65 nt, hsa
uaccuauauuagaaagauauugaucugacugaaauauaaccuaccugccaguaagguccaaaggc

SEQ ID NO: 254365 - RNA, 65 nt, hsa
uuaucacuuugagaaaugaggccuguacaaggcugauaaccuauaugugauggagaucacccaau

SEQ ID NO: 254366 - RNA, 65 nt, hsa
gcguguuuggguuuuuuaauugagaugaaauucaaauaaccuaaaaaucaaucacuugaaaguga

SEQ ID NO: 254367 - RNA, 65 nt, hsa
cugauaccugccuuguacuuaguaccuuaauaccaauaaccuaaugguacuuaggcgaguaccau

SEQ ID NO: 254368 - RNA, 65 nt, hsa
caugccccuaaccugccuuuucccaucuccccagcauaaccuaauauuuuuuuuuuuuuuuugag

SEQ ID NO: 254369 - RNA, 65 nt, hsa
cuccugggaugcccuccucccccucgcccuuuguaauaaccuaaucugagaccgugcuugguggg

SEQ ID NO: 254370 - RNA, 65 nt, hsa
ucuccgucugugucccacccaugcagacucucugaauaaccuagccaauaucaaacgagaacagg

SEQ ID NO: 254371 - RNA, 65 nt, hsa
cauuaaggaacccauuacugccauuuggaauucaaauaaccuaaccaaccuccaccuccuccuuc

SEQ ID NO: 254372 - RNA, 65 nt, hsa
aaugcuuaacuuuaucucuuaauuucuaaagguaaauaaccuagguucagcuuuugcuuaaacau

SEQ ID NO: 254373 - RNA, 65 nt, hsa
ugguuuuagaggucagauuccucccaaccaggcuaauaaccuaacacauguuuaaaaaaaaucug

SEQ ID NO: 254374 - RNA, 65 nt, hsa
ucucuucucuucugugaucucaguaggccuaaccuauaaccuagcacagacugcuacagcugcuc

SEQ ID NO: 254375 - RNA, 65 nt, hsa
caagucccugauacaaaaugacgucguauuugaauauaaccuaugcacauccucccauacuuuaa

SEQ ID NO: 254376 - RNA, 65 nt, hsa
uucauucccugaaaggaggaugaugauaucuaggcauaaccuagccugugaggaaccuaguuagg

SEQ ID NO: 254377 - RNA, 65 nt, hsa
ccauaccucccaauccaaguagcaucuguagcuacauaaccuauauaccuccagcagcuggacau

SEQ ID NO: 254378 - RNA, 65 nt, hsa
uaacugcuuuauaaaaauggcaacuuuagguauagauaaccuaauucagguugcaguuuuaauau

SEQ ID NO: 254379 - RNA, 65 nt, hsa
uauauuaagggagacauuuuagucaguaagacgauauaaccuacuuacuccguaaggggaaauga

SEQ ID NO: 254380 - RNA, 65 nt, hsa
ugcucucuaaugagaacaaaguuagaaaucugccgauaaccuaaaauaauuuagaaaugaauuaa

SEQ ID NO: 254381 - RNA, 64 nt, hsa; identical to SEQ ID NO: 175479

SEQ ID NO: 254382 - RNA, 64 nt, hsa; identical to SEQ ID NO: 175480

SEQ ID NO: 254383 - RNA, 64 nt, hsa; identical to SEQ ID NO: 175481

SEQ ID NO: 254384 - RNA, 64 nt, hsa; identical to SEQ ID NO: 175482

SEQ ID NO: 254385 - RNA, 64 nt, hsa; identical to SEQ ID NO: 175483

SEQ ID NO: 254386 - RNA, 64 nt, hsa; identical to SEQ ID NO: 175484

SEQ ID NO: 254387 - RNA, 64 nt, hsa; identical to SEQ ID NO: 175485

SEQ ID NO: 254388 - RNA, 64 nt, hsa; identical to SEQ ID NO: 175486

SEQ ID NO: 254389 - RNA, 64 nt, hsa; identical to SEQ ID NO: 175487

SEQ ID NO: 254390 - RNA, 64 nt, hsa; identical to SEQ ID NO: 175488

SEQ ID NO: 254391 - RNA, 64 nt, hsa; identical to SEQ ID NO: 175489

SEQ ID NO: 254392 - RNA, 64 nt, hsa; identical to SEQ ID NO: 175490

SEQ ID NO: 254393 - RNA, 64 nt, hsa; identical to SEQ ID NO: 175491

SEQ ID NO: 254394 - RNA, 64 nt, hsa; identical to SEQ ID NO: 175492

SEQ ID NO: 254395 - RNA, 64 nt, hsa; identical to SEQ ID NO: 175493

SEQ ID NO: 254396 - RNA, 64 nt, hsa; identical to SEQ ID NO: 175494

SEQ ID NO: 254397 - RNA, 64 nt, hsa; identical to SEQ ID NO: 175495

SEQ ID NO: 254398 - RNA, 64 nt, hsa; identical to SEQ ID NO: 175496

SEQ ID NO: 254399 - RNA, 64 nt, hsa; identical to SEQ ID NO: 175497

SEQ ID NO: 254400 - RNA, 64 nt, hsa; identical to SEQ ID NO: 175498

SEQ ID NO: 254401 - RNA, 64 nt, hsa; identical to SEQ ID NO: 175499

SEQ ID NO: 254402 - RNA, 64 nt, hsa; identical to SEQ ID NO: 175500

SEQ ID NO: 254403 - RNA, 64 nt, hsa; identical to SEQ ID NO: 175501

SEQ ID NO: 254404 - RNA, 64 nt, hsa; identical to SEQ ID NO: 175502

SEQ ID NO: 254405 - RNA, 64 nt, hsa; identical to SEQ ID NO: 175503

SEQ ID NO: 254406 - RNA, 64 nt, hsa; identical to SEQ ID NO: 175504

SEQ ID NO: 254407 - RNA, 64 nt, hsa; identical to SEQ ID NO: 175505

SEQ ID NO: 254408 - RNA, 64 nt, hsa; identical to SEQ ID NO: 175506

SEQ ID NO: 254409 - RNA, 64 nt, hsa; identical to SEQ ID NO: 175507

SEQ ID NO: 254410 - RNA, 64 nt, hsa; identical to SEQ ID NO: 175508

SEQ ID NO: 254411 - RNA, 64 nt, hsa; identical to SEQ ID NO: 175509

SEQ ID NO: 254412 - RNA, 64 nt, hsa; identical to SEQ ID NO: 175510

SEQ ID NO: 254413 - RNA, 64 nt, hsa; identical to SEQ ID NO: 175511

SEQ ID NO: 254414 - RNA, 64 nt, hsa; identical to SEQ ID NO: 175512

SEQ ID NO: 254415 - RNA, 64 nt, hsa; identical to SEQ ID NO: 175513

SEQ ID NO: 254416 - RNA, 64 nt, hsa; identical to SEQ ID NO: 175514

SEQ ID NO: 254417 - RNA, 64 nt, hsa; identical to SEQ ID NO: 175515

SEQ ID NO: 254418 - RNA, 64 nt, hsa; identical to SEQ ID NO: 175516

SEQ ID NO: 254419 - RNA, 64 nt, hsa; identical to SEQ ID NO: 175517

SEQ ID NO: 254420 - RNA, 64 nt, hsa; identical to SEQ ID NO: 175518

SEQ ID NO: 254421 - RNA, 64 nt, hsa; identical to SEQ ID NO: 175519

SEQ ID NO: 254422 - RNA, 64 nt, hsa; identical to SEQ ID NO: 175520

SEQ ID NO: 254423 - RNA, 64 nt, hsa; identical to SEQ ID NO: 175521

SEQ ID NO: 254424 - RNA, 64 nt, hsa; identical to SEQ ID NO: 175522

SEQ ID NO: 254425 - RNA, 64 nt, hsa; identical to SEQ ID NO: 175523

SEQ ID NO: 254426 - RNA, 64 nt, hsa; identical to SEQ ID NO: 175524

SEQ ID NO: 254427 - RNA, 64 nt, hsa; identical to SEQ ID NO: 175525

SEQ ID NO: 254428 - RNA, 64 nt, hsa; identical to SEQ ID NO: 175526

SEQ ID NO: 254429 - RNA, 64 nt, hsa; identical to SEQ ID NO: 175527

SEQ ID NO: 254430 - RNA, 64 nt, hsa; identical to SEQ ID NO: 175528

SEQ ID NO: 254431 - RNA, 64 nt, hsa; identical to SEQ ID NO: 175529

SEQ ID NO: 254432 - RNA, 64 nt, hsa; identical to SEQ ID NO: 175530

SEQ ID NO: 254433 - RNA, 64 nt, hsa; identical to SEQ ID NO: 175531

SEQ ID NO: 254434 - RNA, 64 nt, hsa; identical to SEQ ID NO: 175532

SEQ ID NO: 254435 - RNA, 64 nt, hsa; identical to SEQ ID NO: 175533

SEQ ID NO: 254436 - RNA, 64 nt, hsa; identical to SEQ ID NO: 175534

SEQ ID NO: 254437 - RNA, 64 nt, hsa; identical to SEQ ID NO: 175535

SEQ ID NO: 254438 - RNA, 64 nt, hsa; identical to SEQ ID NO: 175536

SEQ ID NO: 254439 - RNA, 64 nt, hsa; identical to SEQ ID NO: 175537

SEQ ID NO: 254440 - RNA, 64 nt, hsa; identical to SEQ ID NO: 175538

SEQ ID NO: 254441 - RNA, 53 nt, hsa; identical to SEQ ID NO: 175539

SEQ ID NO: 254442 - RNA, 64 nt, hsa; identical to SEQ ID NO: 175540

SEQ ID NO: 254443 - RNA, 64 nt, hsa; identical to SEQ ID NO: 175541

SEQ ID NO: 254444 - RNA, 64 nt, hsa; identical to SEQ ID NO: 175542

SEQ ID NO: 254445 - RNA, 64 nt, hsa; identical to SEQ ID NO: 175543

SEQ ID NO: 254446 - RNA, 64 nt, hsa; identical to SEQ ID NO: 175544

SEQ ID NO: 254447 - RNA, 64 nt, hsa; identical to SEQ ID NO: 175545

SEQ ID NO: 254448 - RNA, 64 nt, hsa; identical to SEQ ID NO: 175546

SEQ ID NO: 254449 - RNA, 64 nt, hsa; identical to SEQ ID NO: 175547

SEQ ID NO: 254450 - RNA, 64 nt, hsa; identical to SEQ ID NO: 175548

SEQ ID NO: 254451 - RNA, 64 nt, hsa; identical to SEQ ID NO: 175549

SEQ ID NO: 254452 - RNA, 64 nt, hsa; identical to SEQ ID NO: 175550

SEQ ID NO: 254453 - RNA, 64 nt, hsa; identical to SEQ ID NO: 175551

SEQ ID NO: 254454 - RNA, 64 nt, hsa; identical to SEQ ID NO: 175552

SEQ ID NO: 254455 - RNA, 64 nt, hsa; identical to SEQ ID NO: 175553

SEQ ID NO: 254456 - RNA, 64 nt, hsa; identical to SEQ ID NO: 175554

SEQ ID NO: 254457 - RNA, 64 nt, hsa; identical to SEQ ID NO: 175555

SEQ ID NO: 254458 - RNA, 64 nt, hsa; identical to SEQ ID NO: 175556

SEQ ID NO: 254459 - RNA, 64 nt, hsa; identical to SEQ ID NO: 175557

SEQ ID NO: 254460 - RNA, 64 nt, hsa; identical to SEQ ID NO: 175558

SEQ ID NO: 254461 - RNA, 64 nt, hsa; identical to SEQ ID NO: 175559

SEQ ID NO: 254462 - RNA, 64 nt, hsa; identical to SEQ ID NO: 175560

SEQ ID NO: 254463 - RNA, 64 nt, hsa; identical to SEQ ID NO: 175561

SEQ ID NO: 254464 - RNA, 64 nt, hsa; identical to SEQ ID NO: 175562

SEQ ID NO: 254465 - RNA, 64 nt, hsa; identical to SEQ ID NO: 175563

SEQ ID NO: 254466 - RNA, 64 nt, hsa; identical to SEQ ID NO: 175564

SEQ ID NO: 254467 - RNA, 64 nt, hsa; identical to SEQ ID NO: 175565

SEQ ID NO: 254468 - RNA, 64 nt, hsa; identical to SEQ ID NO: 175566

SEQ ID NO: 254469 - RNA, 64 nt, hsa
agccuuccagcugagugaagcuaggcaaauggagugggggcaggcaucuauuccugcccccauc

SEQ ID NO: 254470 - RNA, 64 nt, hsa
ugaaguggagaggccgagcagcagccggccgggaugggggcauuagaggccugagguucucuag

SEQ ID NO: 254471 - RNA, 64 nt, hsa
auugggccccuuggccccuuccgguucugcuuccugggggcaggguuccugccuuggaccccca

SEQ ID NO: 254472 - RNA, 64 nt, hsa
cagccccggggcuuggcucccccagcucugagcgugggggcauaggcaggaccccccuuguggu

SEQ ID NO: 254473 - RNA, 64 nt, hsa
ucuccuacagcccccugccugauccccugcuggcugggggcagcucccaggauauccugccuuc

SEQ ID NO: 254474 - RNA, 64 nt, hsa
aggggagcagcggcugggagugagcagggcagggugggggcagggugggggcacgaagugggcc

SEQ ID NO: 254475 - RNA, 64 nt, hsa
ggcugggagugagcagggcagggugggggcagggugggggcacgaagugggcccugggugaccc

SEQ ID NO: 254476 - RNA, 64 nt, hsa
acaucuuggugaaguugccccugggaagggcagcugggggcaguggcgccaguucccuuccaug

SEQ ID NO: 254477 - RNA, 64 nt, hsa
cgacggugggaagaugccuuacgucugaucuugaugggggcacuggccuggagccugggcccac

SEQ ID NO: 254478 - RNA, 64 nt, hsa
gaccuuuagccuuuuucuuccuuugcaaaggccuugggggcacuggcugggagucagcaagcga

SEQ ID NO: 254479 - RNA, 64 nt, hsa
aguuucauuccaaaguguauauuggguucagacuugggggcagaaguucagacacaccgugcuc

SEQ ID NO: 254480 - RNA, 64 nt, hsa
acaguacuuaguccaaaggugcuaacgggggaacugggggcauugugacacccaagucugaugu

SEQ ID NO: 254481 - RNA, 64 nt, hsa
gugaugugcuguuuauuuaucagcuugagguccaugggggcagccuugugacuggaagggugga

SEQ ID NO: 254482 - RNA, 64 nt, hsa
auuugcuggccuggcagggggugaaggcaggaguugggggcaggucaggaccaggacccaggga

SEQ ID NO: 254483 - RNA, 64 nt, hsa
uccucgggauuggcggguccacuugccagggcucugggggcagauuuguggggaccucagccug

SEQ ID NO: 254484 - RNA, 64 nt, hsa
gaucuccagagcuaccgaguucaucuguggguguugggggcaagugggggcugaaguccugugc

SEQ ID NO: 254485 - RNA, 64 nt, hsa
ccagcagcagccuggcugccuugucauggccuccugggggcagaaggcgauguggaccacggga

SEQ ID NO: 254486 - RNA, 64 nt, hsa
gaaccagcaccucccaccaaccaaccacacccggugggggcacagcacagaccccagagccagg

SEQ ID NO: 254487 - RNA, 64 nt, hsa
gaaccagcaccucccaccaaccagccacacccggugggggcacagcacagaccccagaggcagg

SEQ ID NO: 254488 - RNA, 64 nt, hsa
gaaccagcaccucccaccaaccagccacacccagugggggcacagcacagaccccagagccagg

SEQ ID NO: 254489 - RNA, 64 nt, hsa
ccagccaggaaccucucagagcugaagcaggcccugggggcagaagugccagaugacagucaga

SEQ ID NO: 254490 - RNA, 51 nt, hsa
ucuuuaagaagaacaaguaguugggggcaaggucccaggccaacucccucc

SEQ ID NO: 254491 - RNA, 64 nt, hsa
uuguagggggggcauuuuugguugcccccaugcgugggggcacuacuaagaaugcuaaacuuag

SEQ ID NO: 254492 - RNA, 64 nt, hsa
gaggccucuggagaagaccuggggugggggcugaugggggcaggcccacagugagagacugccu

SEQ ID NO: 254493 - RNA, 64 nt, hsa
gggagagucaccgagggcccauguggcuggagguugggggcaggaucuggcccgagcucuccuc

SEQ ID NO: 254494 - RNA, 64 nt, hsa
gaacuggcggguggugugugugcagcaaaggcauugggggcacgggugagaugcccacugugug

SEQ ID NO: 254495 - RNA, 64 nt, hsa
cccacugugccuucccggccucccgggcuucugcugggggcagaagaaaugccuccccaggucu

SEQ ID NO: 254496 - RNA, 64 nt, hsa
cccuccacacaggcauccucagggcacagggcccugggggcaccuuccuccuuucguauuuguu

SEQ ID NO: 254497 - RNA, 64 nt, hsa
ccagaacugugaauggccugcuccaggccauggcugggggcagggagugaggggacaauuucug

SEQ ID NO: 254498 - RNA, 64 nt, hsa
auuuuuagauucuucugcucccuagugaccuaccugggggcaaagaaauugcaaggacuuuuuu

SEQ ID NO: 254499 - RNA, 64 nt, hsa
cuaacuucugagcccaccucccaggguaggcaccugggggcaugcaggugcccaccucccaggg

SEQ ID NO: 254500 - RNA, 64 nt, hsa
ggcaugcaggugcccaccucccaggguaggcaccugggggcaugcagguacccaccucuuucuc

SEQ ID NO: 254501 - RNA, 64 nt, hsa
uaucugggagggaagaugggugcugggagaggguugggggcagggggcaaggaaaauugcuacc

SEQ ID NO: 254502 - RNA, 64 nt, hsa
cugcuagcugagcacuuccacaagggcauaccccugggggcaggggcuggggcugagaacugca

SEQ ID NO: 254503 - RNA, 64 nt, hsa
cuggcuggugcuguaacaaagacccaugugaugcugggggcagagacagaggagaagcuguuug

SEQ ID NO: 254504 - RNA, 64 nt, hsa
gccgggccacucugcuagaguccauccgccaagcugggggcaucggcaaggccaagcugcgcag

SEQ ID NO: 254505 - RNA, 64 nt, hsa
uucucacagacccuagguauccacagcugugacaugggggcaagcggcuuuguuucagccuaac

SEQ ID NO: 254506 - RNA, 64 nt, hsa
ccaucuggaccaguagcccaucccgcaguuuucuugggggcagaggaaaacgcuucuuucuccu

SEQ ID NO: 254507 - RNA, 64 nt, hsa
cacccuccccaccucaccaacuuuggucccucucugggggcaugaaugguuaacaaacaccaga

SEQ ID NO: 254508 - RNA, 64 nt, hsa
acaccagagcaguacuccaauauuggagagucgcugggggcacagggcuuugaaucaggguagu

SEQ ID NO: 254509 - RNA, 64 nt, hsa
caggccugaugcuccuguuuggguccagggccccugggggcagaccggugauccuuaccagugg

SEQ ID NO: 254510 - RNA, 64 nt, hsa
ucuccugccggaaagcccugcaacauucuaggguugggggcagggccauccacgguuucugggc

SEQ ID NO: 254511 - RNA, 64 nt, hsa
cguggggccugaggaggucauaaucucuucugagugggggcaggucgauucuugcacaaggugg

SEQ ID NO: 254512 - RNA, 64 nt, hsa
cccccgccgccagguggcccacaugggaccagcaugggggcagguuaucuguuggccugaagag

SEQ ID NO: 254513 - RNA, 64 nt, hsa
ggcaaagcagcucugaccgaauucuaggcaggggugggggcaccugccugggcccuggguccag

SEQ ID NO: 254514 - RNA, 64 nt, hsa
gugccuguggcggaaggaacugcccaguccucccugggggcagguagaccuguggggauggcuc

SEQ ID NO: 254515 - RNA, 64 nt, hsa
cucaaaucuaggggcgucuucuuuggacccacaaugggggcaagccuuaauaauauggaaggga

SEQ ID NO: 254516 - RNA, 64 nt, hsa
uuuuguuauuccuuuugcagauugggauguguuuugggggcagggguuaguucuucaggucggc

SEQ ID NO: 254517 - RNA, 64 nt, hsa
ccucccaggcuccuggcuccaccagccaaggaggugggggcaagggucagggcaaugggggaca

SEQ ID NO: 254518 - RNA, 64 nt, hsa
ggcccaggacauggcugagagguggucagcaggcugggggcauggagcagagagggcuugggua

SEQ ID NO: 254519 - RNA, 64 nt, hsa
uauaucgacgcgaagugcuuaacacagccgggcuugggggcagucaggaggaagcuggccaucc

SEQ ID NO: 254520 - RNA, 64 nt, hsa
cgccgcuuacucucagcggaugcagcugcucacuugggggcacuggccucuuagguuuuaacga

SEQ ID NO: 254521 - RNA, 64 nt, hsa
cgcugccuggggagcugaggcguuaccgcuguguugggggcagcuuggugucaggugcagcagg

SEQ ID NO: 254522 - RNA, 64 nt, hsa
caggaugaacggacgcccacagaggccugcggggugggggcaucgcugccuggggagcugaggc

SEQ ID NO: 254523 - RNA, 64 nt, hsa
ccuucacugacagccgcugcuuccuggcugggaacaacuucaguccaacugucaaccuagguac

SEQ ID NO: 254524 - RNA, 64 nt, hsa
cgcugauucaguacaccagcaaugcugaggaugccaacuucacgcucagagacagcugcaccga

SEQ ID NO: 254525 - RNA, 64 nt, hsa
gccuccuuggcaagaggaaugaccagcugccuuccaacuucaccccuguuuucuacucacaacu

SEQ ID NO: 254526 - RNA, 64 nt, hsa
gccgcaccgcccagacuggcucagcccaggccaccaacuucaucgccuuugcggcucaguaccg

SEQ ID NO: 254527 - RNA, 64 nt, hsa
ugauuaccuaaaauaagcuuggauaaaauugaaccaacuucaagaaugcagcacuucuuaaucu

SEQ ID NO: 254528 - RNA, 64 nt, hsa
gagaagcuagacuuuauucauuauauugcuaugacaacuucacucuuucauaauauauaggaua

SEQ ID NO: 254529 - RNA, 64 nt, hsa
cagcagacaauguguuuggaagaaacaagguguacaacuucacaaagcaaguuuuuucuggucu

SEQ ID NO: 254530 - RNA, 64 nt, hsa
gaacaaugacauggcaacaaaggauggcucuguacaacuucacagauggaaucuuguuuaaggc

SEQ ID NO: 254531 - RNA, 64 nt, hsa
aaaccugggugagaagacuauuccuggacucuagcaacuucaaaacugaggcuggguuucagaa

SEQ ID NO: 254532 - RNA, 64 nt, hsa
caaaugcuuacacaagacaauauccacacuuuuccaacuucacacacggagaguacauggagaa

SEQ ID NO: 254533 - RNA, 64 nt, hsa
auugacgugaacuuugauguauaauaagcagcagcaacuucaugugaaaauauggucagguagu

SEQ ID NO: 254534 - RNA, 64 nt, hsa
uccagaugugacuugcacucagaagaucaguggucaacuucagaagcucuuccacgcuuagauc

SEQ ID NO: 254535 - RNA, 64 nt, hsa
ugaucuuggcccaaaagcuccuagaucugauaaacaacuucagcuaacuuucaggagacaaaau

SEQ ID NO: 254536 - RNA, 64 nt, hsa
gcaaaaagaacaaagcuggaggcaucgcauuacccaacuucaaacuauacuacagggcuacagu

SEQ ID NO: 254537 - RNA, 64 nt, hsa
acccuggccucggcccugcccugucccugccaugcaacuucacaacucagcuggccuagacccc

SEQ ID NO: 254538 - RNA, 64 nt, hsa
ccuaggaugguagucaggggaaggagcgagauuccaacuucaacaucugugaccucaaggggga

SEQ ID NO: 254539 - RNA, 63 nt, hsa
gcgggucagcuggugguucuuagguuuccuucuguuuguuaaaagggacaauguggccacuuc

SEQ ID NO: 254540 - RNA, 63 nt, hsa
gguugauaauagucaguaaccuaauaaaggaacguuuguuaaaauaucaaaccauuuuugaau

SEQ ID NO: 254541 - RNA, 63 nt, hsa
uuccucuccuccuucccaagucauuugaaaaguguuuguuauuuaaauuccaauaaugcccaa

SEQ ID NO: 254542 - RNA, 63 nt, hsa
cguuucugaacagggucugugcuauguguaaagguuuguuaacuguaaaguaauauaaaguua

SEQ ID NO: 254543 - RNA, 58 nt, hsa
aaguguccccacagucuuagggggaaauguuuguuaugauguaaauuuuauuugguuu

SEQ ID NO: 254544 - RNA, 63 nt, hsa
aacugaugggcaccugauacucugucuaaauacguuuguuauauguguuuugcccugugccau

SEQ ID NO: 254545 - RNA, 63 nt, hsa
cccaccacccuuuuuuuucauuuccccuguuuuguuuguuaguuuggcguuagggguggaggu

SEQ ID NO: 254546 - RNA, 63 nt, hsa
uuuucaaaagugcccauuuuaugcugcugugugguuuguuaaaucuaaaugauuuuuaaacuu

SEQ ID NO: 254547 - RNA, 63 nt, hsa
aaauauuucuccuuuuguuuuucuuuuuuuuuuguuuguuacugccacuucuuuuuaggagca

SEQ ID NO: 254548 - RNA, 63 nt, hsa
uagaucucuuucucucuuuuguuuuguuuguuuguuuguuaaaguucauuauuuauuuuaccu

SEQ ID NO: 254549 - RNA, 63 nt, hsa
uauugacucuauuuucugaaggcaaaaaugcauguuuguuagaauggaaacagaaaaacauua

SEQ ID NO: 254550 - RNA, 63 nt, hsa
caugcauggucaugacacccagaauucaugaugguuuguuauaacaaccucugcauauuccag

SEQ ID NO: 254551 - RNA, 63 nt, hsa
uaaaaaaggcauuugaaugaauguuugacucagguuuguuaaauuaaccuucaguaacugcag

SEQ ID NO: 254552 - RNA, 63 nt, hsa
gucauaauuguugacguucuucaguauaaucauguuuguuaaauuguuuguaccuugcaaacu

SEQ ID NO: 254553 - RNA, 63 nt, hsa
uguuacuauugagauucucucaauugcuccuguguuuguuauaaaguaguguuuaaaaggcag

SEQ ID NO: 254554 - RNA, 63 nt, hsa
ugggucauuauuacuuuuauuuugcagcauuugguuuguuauuaguguaagagcaaguauagg

SEQ ID NO: 254555 - RNA, 63 nt, hsa
ccuuuuaggcuugaauaugaugcugaacaguaaguuuguuaaaucuuggaacuuaaaacaauc

SEQ ID NO: 254556 - RNA, 63 nt, hsa
uugcagcaccucuaucucgcagguaauggaguaguuuguuauugguagucuacuccaggccag

SEQ ID NO: 254557 - RNA, 63 nt, hsa
gcagcuuauucuugccaugcuuaggugacagaaguuuguuaaguaccauccuugugcccugcc

SEQ ID NO: 254558 - RNA, 63 nt, hsa
guuuaaauuguuaaaaugcugauuuucuuauuaguuuguuaauugccuguuacuaguacuuga

SEQ ID NO: 254559 - RNA, 63 nt, hsa
aucauggaguacugcucucauaauugaagacguguuuguuauuggcagagaaccuuaaaaaag

SEQ ID NO: 254560 - RNA, 63 nt, hsa
cgccuuccucucuggauacugcaaaggcuugugguuuguuagaggguauuuguggaaacuguc

SEQ ID NO: 254561 - RNA, 63 nt, hsa
uacuaguucagacacuuuggaaguuuguguucuguuuguuaaaacuggcaucugacacaaaaa

SEQ ID NO: 254562 - RNA, 63 nt, hsa
uuauaauuuauaaauacagcauacuucaaaacuguuuguuaucucuuguuaccauguauguau

SEQ ID NO: 254563 - RNA, 63 nt, hsa
cuucauuuugagaaaacuguacauuaguuuaauguuuguuacuguauuucuuuugaguugagg

SEQ ID NO: 254564 - RNA, 63 nt, hsa
gaaaucaguugagcugaauuuaaguuguuuuuuguuuguuagcagguguggaugugggguuau

SEQ ID NO: 254565 - RNA, 63 nt, hsa
agauuguguuaccauuugaauacacugacuaauguuuguuaaacuuuuucuguggcaccuugg

SEQ ID NO: 254566 - RNA, 63 nt, hsa
aaagauuuguaaaugguaaagcacuauauucuuguuuguuaguccuuuuuccuuucuuugggu

SEQ ID NO: 254567 - RNA, 63 nt, hsa
acuuguaucauggccuacccgaggagaagaggaguuuguuaacugggccuauguaguagccuc

SEQ ID NO: 254568 - RNA, 63 nt, hsa
uugguuuauguuaaugauagacaaauacccaguguuuguuacuuuuuccaacuaccacuguaa

SEQ ID NO: 254569 - RNA, 63 nt, hsa
uaaauaaagccugugagucaagcaucaagugguguuuguuagaaauaaacuagagauuuuuaa

SEQ ID NO: 254570 - RNA, 63 nt, hsa
gaaagugcugauggcuggauccaaucugguacaguuuguuaaaagcagcgugggauauaauca

SEQ ID NO: 254571 - RNA, 63 nt, hsa
acuuuuauuuuagauucagggguauaugugcagguuuguuacauagguaaacugcaugucaug

SEQ ID NO: 254572 - RNA, 63 nt, hsa
guaaauguuuuuagaucuucugguaagcauuauguuuguuaauacauauuuauuagagugaug

SEQ ID NO: 254573 - RNA, 63 nt, hsa
cuuaaauaugaaagcaaauugaacacaucggguguuuguuaucagaaaagagaugagaugaga

SEQ ID NO: 254574 - RNA, 63 nt, hsa
uaggaagauucaaaaucuugguuauuacaugaaguuuguuauauuucuugucaacaguauuga

SEQ ID NO: 254575 - RNA, 63 nt, hsa
ucgaaauacaguuauuaaaauguuaaaagauaaguuuguuauauauuaauaugcaugcuucuu

SEQ ID NO: 254576 - RNA, 63 nt, hsa
uggaaaaugaguaaugucucauucuuaccugcaguuuguuacuauguauaaaagucuuuuucu

SEQ ID NO: 254577 - RNA, 63 nt, hsa
ugaaaaaaauguaucuuugggaaaacaauuacaguuuguuaauuugaagaugcuggucuugac

SEQ ID NO: 254578 - RNA, 63 nt, hsa
ucccaaaucuggcuggucgggaauaccugggaaguuuguuaaaauuuuuuaaaaauguuuuaa

SEQ ID NO: 254579 - RNA, 63 nt, hsa
ucagcucugguccacagaggauggauaaaaaugguuuguuauguuuuuuugcucugcagugcu

SEQ ID NO: 254580 - RNA, 63 nt, hsa
auggaugcagaauaaugcagauagugaucccauguuuguuaauugccaucauggaagucagag

SEQ ID NO: 254581 - RNA, 63 nt, hsa
cguaauuuuaggacuccuauaaaauucuuccuuguuuguuaaugcuauuaaaacucagauuca

SEQ ID NO: 254582 - RNA, 63 nt, hsa
acucuguuuuauccuagaacuaagagagcauugguuuguuaaagagcuuucaauguauauuaa

SEQ ID NO: 254583 - RNA, 63 nt, hsa
ugcgugggacgaagacaucuuugaaggucaugaguuuguuaguuuaacaucauauauuuguaa

SEQ ID NO: 254584 - RNA, 63 nt, hsa
cgucucaaaaguaaauaaaaauaaucaccuggaguuuguuaaaccauauggauucucaagcuc

SEQ ID NO: 254585 - RNA, 63 nt, hsa
ucaucccuggagcacucugccgcucaagagcugguuuguuaauuauuguuagacuuugccauu

SEQ ID NO: 254586 - RNA, 63 nt, hsa
aucuugaaguaaauugaucccaccaggucccacguuuguuaucucugccuaaauguuagcuuc

SEQ ID NO: 254587 - RNA, 63 nt, hsa
caccuacccucaaaguagguauacaaaagacuaguuuguuauuaauccacaaauaugcuaaau

SEQ ID NO: 254588 - RNA, 63 nt, hsa
cuuuaaaauuuaacccacaagcauauuaaaucuguuuguuauaagauuggaaacaauuuuuga

SEQ ID NO: 254589 - RNA, 63 nt, hsa
gugaggcaucacuuuguuugcauaaaguauacgguuuguuaaggccuuuguucuugugagaug

SEQ ID NO: 254590 - RNA, 63 nt, hsa
uaauucauguuuguugggacugagguuuaggaaguuuguuacugguuaaaaaccucaaaugaa

SEQ ID NO: 254591 - RNA, 63 nt, hsa
auaagugccuuuuuggagauguaacuuuuagcaguuuguuaaccugacaucucugccagucua

SEQ ID NO: 254592 - RNA, 63 nt, hsa
cccuaaugucuucauaaaguacuugaguguaauguuuguuaccuccaacagaacuaaauguuc

SEQ ID NO: 254593 - RNA, 63 nt, hsa
cagagagugucuucgaggguaucaucauuuccgguuuguuaaucuuauucaccaaauguucua

SEQ ID NO: 254594 - RNA, 63 nt, hsa
caauuuugacuuggccaggggacaccuugguguguuuguuaucuuuaucuguggguaggcuag

SEQ ID NO: 254595 - RNA, 63 nt, hsa
gaggaacaaauagaccauuuccauacuaaaccaguuuguuaacuuuagauuuuuuccaauagu

SEQ ID NO: 254596 - RNA, 63 nt, hsa
ccuuauauucagguauaugugauauuuugccugguuuguuaaaauugccccauuuagauuccu

SEQ ID NO: 254597 - RNA, 63 nt, hsa
ccaccaccacccucaucacucagaaacccuacuguuuguuagacaggugguugaggggacaug

SEQ ID NO: 254598 - RNA, 63 nt, hsa
gcuuuccuauggaaaaaauacauauauaguuuaguuuguuagacgugaguuauccaaguauuu

SEQ ID NO: 254599 - RNA, 63 nt, hsa
uacuguaugcaguacugcaagcuaauaacguugguuuguuauguagugugcuuuuugucccuu

SEQ ID NO: 254600 - RNA, 63 nt, hsa
gaaaacuggguaguucaucugaccaugggauguguuuguuaugaagaaaaucuggaugccugu

SEQ ID NO: 254601 - RNA, 63 nt, hsa
acauggaauauuugguuuccuguuccuauguuaguuuguuaaggauaauggccuccagcccca

SEQ ID NO: 254602 - RNA, 63 nt, hsa
ggguacaugugcagguaaacucgugacaaggggguuuguuauacagauuauuuagugacccag

SEQ ID NO: 254603 - RNA, 63 nt, hsa
ccuguuuuuuuuucauuuauuguuuauguaaauguuuguuaaaaauaaaucccauggaauauu

SEQ ID NO: 254604 - RNA, 63 nt, hsa
uuaaguuuuaggguacaugugcacaaugugcagguuuguuacauauguauacaugugccauau

SEQ ID NO: 254605 - RNA, 63 nt, hsa
aagaaaauucugucucaaaaauuaaagaauuuuguuuguuauuguuguucugaccauauugaa

SEQ ID NO: 254606 - RNA, 63 nt, hsa
uuagcgcugcuucguuuuguauagggcuuuucuguuuguuacaagccaaacacugccugucuu

SEQ ID NO: 254607 - RNA, 63 nt, hsa
ucuguuucuugagaagagaauauuagcuuuacuguuuguuauggcuuaaugacacuagcuaau

SEQ ID NO: 254608 - RNA, 63 nt, hsa
auguauuacuuuguucucccaugaaagaauucaguuuguuaguaccuauauuuuuaaacuggu

SEQ ID NO: 254609 - RNA, 63 nt, hsa
aaauagaagaaaugaacaaaaacuuaaaucacaguuuguuauuaaguaauaucugaaaugaau

SEQ ID NO: 254610 - RNA, 63 nt, hsa
acauucuggaaacauaacacucuacauuacaaaguuuguuaccugcugaaaucaauguaacuc

SEQ ID NO: 254611 - RNA, 63 nt, hsa
guaacaauguuaaauuaauuauaaugggauuggguuuguuaucugugguaguauauauccuag

SEQ ID NO: 254612 - RNA, 63 nt, hsa
acuagaaugugugacucuguggggacugcauagguuuguuaauugaccuauagcuaaaccuua

SEQ ID NO: 254613 - RNA, 63 nt, hsa
cugaagcaucuguccagcugguauccugugaaaguuuguuauuuucugaguagacauucuuau

SEQ ID NO: 254614 - RNA, 63 nt, hsa
uuuuuauauucuuaaauuugcucacaaauugugguuuguuacaauuaaacuggauacuuauuu

SEQ ID NO: 254615 - RNA, 63 nt, hsa
uuaagcucuuuccuauuguguuuauacaguuuuguuuguuauacucuuugcaccuuaaacccc

SEQ ID NO: 254616 - RNA, 63 nt, hsa
guagagcccccuccugugcccucaguggcugucguuuguuaacaucaucaggaagaugggaaa

SEQ ID NO: 254617 - RNA, 63 nt, hsa
gggggaaaucacaagucacugagguguuuguuuguuuguuaggcagugcuagagcuugaagcc

SEQ ID NO: 254618 - RNA, 63 nt, hsa
uaggcaaacuaucaauuuuuuguccauuuuccuguuuguuaaaauaacauaccucuccuacgu

SEQ ID NO: 254619 - RNA, 63 nt, hsa
aacuuacauuuuguuuccaauuuuucauuuuuuguuuguuauuuguuuuuuguagacagcacu

SEQ ID NO: 254620 - RNA, 63 nt, hsa
uucauucuuaagcuugcuuuuuuugagacugguguuuguuagacagccacaguccugucuggg

SEQ ID NO: 254621 - RNA, 63 nt, hsa
caaggaggaggguugagcaaucuagagcauggaguuuguuaagugcucucuggauuugaguug

SEQ ID NO: 254622 - RNA, 63 nt, hsa
caucuaagaugaaacucauaaaaauuauuuaauguuuguuaugaauuuaaaagcuccagaaau

SEQ ID NO: 254623 - RNA, 63 nt, hsa
guuuuuaaauauucaauauuggucuguguuuaaguuuguuauuugaauguaauuuacauagag

SEQ ID NO: 254624 - RNA, 63 nt, hsa
acucugggaagucugaccaaguuggagcagaugguuuguuacuugaaucuccaaacacuuagu

SEQ ID NO: 254625 - RNA, 63 nt, hsa
ccaugaugguuguugcccgagguuaauguaguuguuuguuagaccugugucuuacacauuucu

SEQ ID NO: 254626 - RNA, 63 nt, hsa
augagaacacugcaucugcauucauagccacgaguuuguuauugcuacaggcuacugagcguc

SEQ ID NO: 254627 - RNA, 63 nt, hsa
aucacgggcauuuuaucuucucugaacacugcaguuuguuagacuagagcugagguuggagga

SEQ ID NO: 254628 - RNA, 63 nt, hsa
ccccuuauuuaaaaaaaaaaaagaaaaaaaagaguuuguuacucuauuguauguuacaaaaga

SEQ ID NO: 254629 - RNA, 63 nt, hsa
agcaaaaacccacggccaaaauaaauugguacuguuuguuacaaaguucugucuugucauggg

SEQ ID NO: 254630 - RNA, 63 nt, hsa
ucuggagaaggcccugaaaucacauugauauauguuuguuaguaaaaugugcacaccugacuu

SEQ ID NO: 254631 - RNA, 63 nt, hsa
uguuaauuucaaauaugcaaauuugguacugcaguuuguuaugcaauauuauaucaccaaccc

SEQ ID NO: 254632 - RNA, 63 nt, hsa
cuaaguuguaauuuugauuuuuguggaaccauuguuuguuaauguugggauucucugcacuuu

SEQ ID NO: 254633 - RNA, 63 nt, hsa
uccuucugaaaauauuuacauuuugcuaaccuaguuuguuacuuuaaaaaucaguuuugauga

SEQ ID NO: 254634 - RNA, 63 nt, hsa
ucguguccuugcugucuuuuuauuuuccuuuuuguuuguuagcaaaaaccucuauuuagauuu

SEQ ID NO: 254635 - RNA, 63 nt, hsa
agcuuaaaaguaauguaugcuuugcugaccacuguuuguuaggccuuaaacaacauucacugu

SEQ ID NO: 254636 - RNA, 63 nt, hsa
gaaagauguuuggcaugccaaauuaacuugcauguuuguuaaaaaaacaaacacauguuuuga

SEQ ID NO: 254637 - RNA, 63 nt, hsa
guucauagacgagauuuguucaacacugcaauuguuuguuagauguaaacccugugacuauag

SEQ ID NO: 254638 - RNA, 63 nt, hsa
uuccaaauguucuuccuggggucuuugauauuuguuuguuacauccugcugaaguucgacugu

SEQ ID NO: 254639 - RNA, 63 nt, hsa
gcuuauugaaugucuaaaaaauaaguuuaaaguguuuguuacccuaaguuuuuuacauuuuua

SEQ ID NO: 254640 - RNA, 63 nt, hsa
aauguuuaagaaauuuaccuuaaaucuuguucuguuuguuaguaugaaaaguuaacuuuuuuu

SEQ ID NO: 254641 - RNA, 63 nt, hsa
uuggaacuguucuagagcauaccaugaaaagcaguuuguuauuaugcaggaaaaucaguuuca

SEQ ID NO: 254642 - RNA, 63 nt, hsa
cuuuuuucugccacugcucccuagcccuguuuaguuuguuauugcugcuuuucuuuuuucuuu

SEQ ID NO: 254643 - RNA, 63 nt, hsa
acuuuuucaugaaaauggaguuaucaguuaucuguuuguuacugcaucaucuguuuguaauca

SEQ ID NO: 254644 - RNA, 63 nt, hsa
acucacuuacgacaucacuuccauugugugcauguuuguuauagaggagguuuuaggcuacaa

SEQ ID NO: 254645 - RNA, 63 nt, hsa
gucagaauaguuauucucuaagaggaaacuaguguuuguuaaaaacaaaaauaaaaacaaaac

SEQ ID NO: 254646 - RNA, 63 nt, hsa
gaaaauacauaccacauuuguuauaaagcauuuguuuguuaguaucaaucacauagguagaaa

SEQ ID NO: 254647 - RNA, 63 nt, hsa
uaugcuuugaaaaauaauuauggggaaauacauguuuguuauuaaauuuauuauuaaagauag

SEQ ID NO: 254648 - RNA, 63 nt, hsa
auuucaggcuuguauuuaauauaauaaauagguguuuguuauugugucgaucuguuauuuuua

SEQ ID NO: 254649 - RNA, 63 nt, hsa
uggcuuuuuuugguuugggguagaccuaaggguguuuguuagucucaaaacugugaagugaca

SEQ ID NO: 254650 - RNA, 63 nt, hsa
ucuguaauauauugccaguauauaagcuguuuaguuuguuaauugauuaaacuguaugucuua

SEQ ID NO: 254651 - RNA, 63 nt, hsa
uuacaguguuuguuuagcuaugguuacuaauauguuuguuauauuuauuuucggggagaggau

SEQ ID NO: 254652 - RNA, 63 nt, hsa
caagugacuguccccguaaaaaguagaagauaaguuuguuaaaguauuuuuuauaaacagcuu

SEQ ID NO: 254653 - RNA, 63 nt, hsa
gaaauguuuuuucuuuuccuuguggccaaaccaguuuguuaaucugauuauauucaucugcua

SEQ ID NO: 254654 - RNA, 63 nt, hsa
ucaaaguaguguucuaacuuuaauguauuguauguuuguuauuauauuaaagugugauuauua

SEQ ID NO: 254655 - RNA, 63 nt, hsa
cuaguacgacuucauuccuuccacuaacucauaguuuguuauauccuagacuagacaugcgaa

SEQ ID NO: 254656 - RNA, 63 nt, hsa
cagccuuagaaaagcccucaauguaaaccuuauguuuguuacuaggguggccucucucccauu

SEQ ID NO: 254657 - RNA, 63 nt, hsa
aguuaauaugcuuuucugaugaauuacacaacaguuuguuaauucuucauucuuguaguauuu

SEQ ID NO: 254658 - RNA, 63 nt, hsa
cucagccucaccuuacgaauccaaagaacugggguuuguuagguucuuucucuaauguagagg

SEQ ID NO: 254659 - RNA, 63 nt, hsa
gguuagaacucuuacagccuuauuuauuuuuaaguuuguuacagccaaaggguuggagugugc

SEQ ID NO: 254660 - RNA, 63 nt, hsa
aacauuuuugccaaaagaugacugggguuuuccguuuguuaauauuaagcacaucagaacgug

SEQ ID NO: 254661 - RNA, 63 nt, hsa
agacgaaugccauuggaaccuguuaaaugaguaguuuguuaugugucuggaagaagcagcguu

SEQ ID NO: 254662 - RNA, 63 nt, hsa
gaggggcggggggagggagggauuucuuaucccguuuguuacauuuugaggauaauaaaggug

SEQ ID NO: 254663 - RNA, 63 nt, hsa
cuuaguuacugauuucauuuucaauaaauguagguuuguuacaugaguuucccaauaaaaaaa

SEQ ID NO: 254664 - RNA, 63 nt, hsa
auagauauauaagaaaaaauucuuucacuugauguuuguuagaccagaaaguguguguguucu

SEQ ID NO: 254665 - RNA, 63 nt, hsa
cuuucuguuuuguuuuuuucuccugcaaauuuaguuuguuaaagccuguuccauaggaaggcu

SEQ ID NO: 254666 - RNA, 63 nt, hsa
aaugauuuuuaggguaaauaauacagaugccuuguuuguuaacuaacuuguggaaagcaggaa

SEQ ID NO: 254667 - RNA, 63 nt, hsa
ccauaacauccauaugacugaacacuuguauguguuuguuaaauauucgaaugcauguagauu

SEQ ID NO: 254668 - RNA, 63 nt, hsa
agugacuuuaaacuuucccuuggcuguuaagaaguuuguuauagauuuagcuauuuauuguuc

SEQ ID NO: 254669 - RNA, 63 nt, hsa
gagugcuucaguaaaaagcuacuauauauuguuguuuguuauuguguagguaauauuuucaau

SEQ ID NO: 254670 - RNA, 63 nt, hsa
uuucaaaucaguuuuuuuuccucaaaaacuuguguuuguuauuagaaaugauuuuuuagauau

SEQ ID NO: 254671 - RNA, 63 nt, hsa
gguccuccccaccaccccacccccaagacuuguguuuguuaauagaaauaauuuuuuuaggua

SEQ ID NO: 254672 - RNA, 63 nt, hsa
ggucaacuucaacucaaaacacuguuuucuuauguuuguuacaaacuuaauuuuuugaaagua

SEQ ID NO: 254673 - RNA, 63 nt, hsa
gugucuacuauuaaaagugaaacauuuuggcauguuuguuaauucuaguuucauuuaauaacc

SEQ ID NO: 254674 - RNA, 63 nt, hsa
gccagggggcaggucugggccugggccaaccacguuuguuaucauggcugcugccuucuggac

SEQ ID NO: 254675 - RNA, 63 nt, hsa
uuaguuuuagcuguagaucaagcuauuugggguguuuguuaguaaauagggaaaauaaucuca

SEQ ID NO: 254676 - RNA, 63 nt, hsa
ucccccuuccccugguccccugucccuggggcuguuuguuaaaaaagaguaauaaaaggauuu

SEQ ID NO: 254677 - RNA, 63 nt, hsa
gggcuuguuccccugcaguaucuguucugugaaguuuguuaaauguaaggaaagcuuaaauuc

SEQ ID NO: 254678 - RNA, 63 nt, hsa
ggguugcaguuugguuaggaguggaaauauuuuguuuguuaaugaugucuucaguucugguac

SEQ ID NO: 254679 - RNA, 63 nt, hsa
ccauuuuuucucagacaccuggccguaaaaucaguuuguuacagcauucuucucuaggcugcu

SEQ ID NO: 254680 - RNA, 63 nt, hsa
acacuggguaaaucaccuauacuuagaguaacaguuuguuaucaaaaugccugauaaaauaua

SEQ ID NO: 254681 - RNA, 63 nt, hsa
ucaucaguaucauuagugaaaaagaaacaaauuguuuguuaucaucucuuuagacagauaagc

SEQ ID NO: 254682 - RNA, 63 nt, hsa
aaauuguaauaccuagguaguugguugaucacaguuuguuaauuguauaaaaaaaaauuaccu

SEQ ID NO: 254683 - RNA, 63 nt, hsa
caacuuuauuuuguauuuccuuccauuuggaagguuuguuagaccauuaagguuauauuaaag

SEQ ID NO: 254684 - RNA, 63 nt, hsa
agacauuuguuuguuuuuagaacacgagugacaguuuguuaaaaagcuuuagaggaggaauga

SEQ ID NO: 254685 - RNA, 63 nt, hsa
aaauucauuuuccccuuauggauauuuaugguaguuuguuaagaacugauaaauugugccaag

SEQ ID NO: 254686 - RNA, 63 nt, hsa
ugcuaaucuuauuuuaauuagcuacagcuccuuguuuguuaguuuucauggaaaauuuuaggg

SEQ ID NO: 254687 - RNA, 63 nt, hsa
acuuuuauuuuaaguucaaggguacaugugcagguuuguuacauagguaaacuugugucaugg

SEQ ID NO: 254688 - RNA, 63 nt, hsa
cccaacucaggacagaacaguguuuaauguaaaguuuguuauagucuaugugauucuggaagc

SEQ ID NO: 254689 - RNA, 63 nt, hsa
agaagcccucuuuauuuugguaaaugucacucuguuuguuaggagaugucugcuuuuccauga

SEQ ID NO: 254690 - RNA, 63 nt, hsa
cuagaaaucagaugcccagaugauccaagacuaguuuguuaucucaucuggaaccuacaccaa

SEQ ID NO: 254691 - RNA, 63 nt, hsa
gccauauccuggaaacauauuacgaccucccauguuuguuacaugcauccaguuuaccacacu

SEQ ID NO: 254692 - RNA, 63 nt, hsa
caucuguguauuuucuauagauguuuacuaggcguuuguuauauaaaaauaccccggccaggc

SEQ ID NO: 254693 - RNA, 63 nt, hsa
aacucauagauuauuaucuauuaucucaauuuaguuuguuauuuauccuagugggccauuaaa

SEQ ID NO: 254694 - RNA, 63 nt, hsa
uauaugucacuugugugcuaugugaauagcuauguuuguuauuuaaauauauuuauagaaguu

SEQ ID NO: 254695 - RNA, 63 nt, hsa
gcuugucagguuuggauagaauauaauugauugguuuguuacuuggacuaacaaggcaguaga

SEQ ID NO: 254696 - RNA, 63 nt, hsa
guuuuaaaugcaaaauagccuuauuuucauuuaguuuguuagcacuauagugagcuuuucaaa

SEQ ID NO: 254697 - RNA, 63 nt, hsa
cauuauucauauguguaucuauaucugcauaauguuuguuaaugucuacuaaaauugcuacuu

SEQ ID NO: 254698 - RNA, 63 nt, hsa
cccugcucagggacccuggccguguguccccagguuuguuaccugcagcggcccaucacccug

SEQ ID NO: 254699 - RNA, 63 nt, hsa
uaauauuuuugcugacuacccaguugaagaaaaguuuguuaauuggaugggauuuuuuuuuuu

SEQ ID NO: 254700 - RNA, 63 nt, hsa
aaauuuuuuuuuuagcucuugcuuuaaguguuuguuuguuaucucaguccagaaccaauauua

SEQ ID NO: 254701 - RNA, 63 nt, hsa
cugauggcccggcugaauaaaauggaaauucuaguuuguuagaauuaugcauucuuuuucaag

SEQ ID NO: 254702 - RNA, 63 nt, hsa
auguauuucaaucuuagugagccaaaauuguuuguuuguuacuacagaauagagaugacuguu

SEQ ID NO: 254703 - RNA, 63 nt, hsa
gaaagaguuuaagggcuaauaauuuaauuuguuguuuguuaaaaauuaaaaucuccguucuuu

SEQ ID NO: 254704 - RNA, 63 nt, hsa
aauuuucagacauuuugaaaggaugacaguucuguuuguuagaugaguaaaccucuauauuca

SEQ ID NO: 254705 - RNA, 63 nt, hsa
uuguuuuguauuauucagaaauuaacuguacagguuuguuaucacaauguauaauuguguuuu

SEQ ID NO: 254706 - RNA, 63 nt, hsa
gcuguccaaguuuuauacuaagauaucuuaccuguuuguuauuaaccaaauauuuuuaaaaau

SEQ ID NO: 254707 - RNA, 63 nt, hsa
ucccugcuuccucucuagaauccaauuagggauguuuguuacuacucauauugauuaaaacag

SEQ ID NO: 254708 - RNA, 63 nt, hsa
uuuugacaauguggaguuuuuuuuuaaaaagugguuuguuacuuugacuuauaaauacaauuu

SEQ ID NO: 254709 - RNA, 63 nt, hsa
cugugaagacucaacggauguguguguuuguauguuuguuaacaguuacauauguuuguauga

SEQ ID NO: 254710 - RNA, 63 nt, hsa
gguguccuauuuucuuguuuauacguucauucuguuuguuauugcuacuauguaaaacuuuca

SEQ ID NO: 254711 - RNA, 63 nt, hsa
ggacugcguccauguacuaguauaacagcuuggguuuguuagaauuugggcaacauuuugauu

SEQ ID NO: 254712 - RNA, 63 nt, hsa
guggaucaaaaaugccacuuaacaggaaguuuaguuuguuaugcacuuuaaauggaauaauua

SEQ ID NO: 254713 - RNA, 63 nt, hsa
uuggaugaggaggggacugccauggaaaggagaguuuguuacuuacgguucugagaggagggg

SEQ ID NO: 254714 - RNA, 63 nt, hsa
acuucuaaaugguuccugguuccuuucuuccucguuuguuacuuuagagcaaguuugcccaua

SEQ ID NO: 254715 - RNA, 63 nt, hsa
caugauuaguaccaaaccacuguacaaagaauuguuuguuaacaagaaaaaaaugaauaaugc

SEQ ID NO: 254716 - RNA, 63 nt, hsa
gacaaacguuuaauuugcuaaauauuuuaacaaguuuguuauauauuuuauuuaauuuaaaag

SEQ ID NO: 254717 - RNA, 63 nt, hsa
gaauuaagaguccaguuucggaagauaauaaauguuuguuagauacaccauaauuucagauca

SEQ ID NO: 254718 - RNA, 63 nt, hsa
aauagaaaacaguaaaaaacagggcauagccuaguuuguuauaagaaaaagcauccauuuucu

SEQ ID NO: 254719 - RNA, 63 nt, hsa
ccaaaccacuaugcuuaauguuaacaugauucuguuuguuaauauuuugacagauuaaggugu

SEQ ID NO: 254720 - RNA, 63 nt, hsa
aguuuccaugaagguguguauguuuuauacgauguuuguuauagggccaugcauugguaacuu

SEQ ID NO: 254721 - RNA, 63 nt, hsa
uuaauacugacauacuggauuuuuaaugcacugguuuguuauuugguauucuaucucuuuuuc

SEQ ID NO: 254722 - RNA, 63 nt, hsa
uaccauagaauuauuauccagacuggaauuuuuguuuguuagaacacccuucaguugcaauau

SEQ ID NO: 254723 - RNA, 63 nt, hsa
ggcuuguuuuuacagcuugugaacggacugcacguuuguuacaagggagaagauuauggaggc

SEQ ID NO: 254724 - RNA, 63 nt, hsa
uuggaguaacaggcuuauuccacuuuccaugggguuuguuaauauuuugcauugacucauacu

SEQ ID NO: 254725 - RNA, 63 nt, hsa
uucaauuagaaaccuuuacuauuuccaauguauguuuguuaaaaauaauaauaauaaaaccaa

SEQ ID NO: 254726 - RNA, 63 nt, hsa
auauaugugacagauacaaauucucugugaucaguuuguuauuuuuuuucuccuuaaggcaca

SEQ ID NO: 254727 - RNA, 63 nt, hsa
uggagaccuuaaugcuaaguguagauuauugagguuuguuagugaggaaaagaauaagaguuc

SEQ ID NO: 254728 - RNA, 63 nt, hsa
ccccgguaaguaauuaacagagaauaaaaauguguuuguuaaaugacaaagcagcaguuuuuc

SEQ ID NO: 254729 - RNA, 63 nt, hsa
uguucauuacuaaaacaaacagcaaaacuauugguuuguuauucuguguuuuccucaagucag

SEQ ID NO: 254730 - RNA, 63 nt, hsa
aaaauguaaaaaacaaaaaaaacaacaaaaaaaguuuguuacuuugaauaguccuaaaaagaa

SEQ ID NO: 254731 - RNA, 63 nt, hsa
ugucuuauaauugauauuuuaggauguuuggguguuuguuacaggcagaauuggauagauaca

SEQ ID NO: 254732 - RNA, 63 nt, hsa
gguacaucguauauaaaauguauuaaaacugggguuuguuaccaguugcuguacuuuguauau

SEQ ID NO: 254733 - RNA, 63 nt, hsa
uuucuuuagcaaaccagguuaugugguguaaagguuuguuauacgugccacaauauagcauau

SEQ ID NO: 254734 - RNA, 63 nt, hsa
gcuccacaugggaccugugucacccaaugagauguuuguuacucugguaaaugccacacguua

SEQ ID NO: 254735 - RNA, 63 nt, hsa
uuguaugauugaaacuugcaccgagcuuugacuguuuguuaaagagucauuuuuaaugaaaga

SEQ ID NO: 254736 - RNA, 63 nt, hsa
acguucuagcaacuguauaaaagcguugggcauguuuguuauuucuauacucacucugucaug

SEQ ID NO: 254737 - RNA, 63 nt, hsa
aaguuuuuucuaccauaagugacaccaauaaauguuuguuauuuacacuggucuaauguuugu

SEQ ID NO: 254738 - RNA, 63 nt, hsa
aaaggcccagccggacugccgggcauuggggccguuuguuaagcggcacucauuuugcggagg

SEQ ID NO: 254739 - RNA, 63 nt, hsa
aaaaaaaaaaacaaaacaaaaaaagguuacaaaguuuguuaacuugcuauccuguggucuugu

SEQ ID NO: 254740 - RNA, 63 nt, hsa
uauccuguggucuuguugccugaaauuguuauuguuuguuauuucucucugauguuuuuugua

SEQ ID NO: 254741 - RNA, 63 nt, hsa
guacucugcaguggacauaagcauugggccauaguuuguuaaucucaacuaacgccuacauua

SEQ ID NO: 254742 - RNA, 63 nt, hsa
aagcauuuuugugagugaccaccuuugcaauauguuuguuaauuuacuucauguuggguucuu

SEQ ID NO: 254743 - RNA, 63 nt, hsa
ccgcaugucuuauucuugcccuucccccaaccaguuuguuaaucaaacaauaaaaacauguuu

SEQ ID NO: 254744 - RNA, 63 nt, hsa
cuaugcaauauuuuuuacuuuucuaauaaacauguuuguuaaaacaguugguugagucucuca

SEQ ID NO: 254745 - RNA, 63 nt, hsa
cugccucuuccacauaauguccuuugcuuucauguuuguuaucuucuuuuucuguucacucag

SEQ ID NO: 254746 - RNA, 63 nt, hsa
aucacaaauauauaugcuuccagacaaagaaaaguuuguuaguccugauuuucuaaucguagc

SEQ ID NO: 254747 - RNA, 63 nt, hsa
agagcugaaaguguaacuguuaauucagugaaaguuuguuagguuacaugguuacacagugag

SEQ ID NO: 254748 - RNA, 63 nt, hsa
gcuaaauacuguaauguuucaaaacauccaacuguuuguuauaaaguggcuagaacaucaauu

SEQ ID NO: 254749 - RNA, 63 nt, hsa
uaaugucugauugaaacacaaauuuacaugcauguuuguuacaaaaaaaaugaaaaaaaaagu

SEQ ID NO: 254750 - RNA, 63 nt, hsa
uugcuuccuucuuaaccucuaccacuuaagagaguuuguuauaaucaaauuugacuuccuagc

SEQ ID NO: 254751 - RNA, 63 nt, hsa
cagggccuggcauuugguaggaauacaaugaauguuuguuaaacaaauuaauccacaguuucu

SEQ ID NO: 254752 - RNA, 63 nt, hsa
gaugcaagacaagucauccuuccuacugucaugguuuguuauagagaagcugcuucaaaucac

SEQ ID NO: 254753 - RNA, 63 nt, hsa
ggguauguuuaaucuguuauguacuaguguucuguuuguuauuguuuuguuaauuacaccaua

SEQ ID NO: 254754 - RNA, 63 nt, hsa
uauggagaauguuauggaagaaauaguuuauaaguuuguuaaguacuuauaacaugguuuauc

SEQ ID NO: 254755 - RNA, 63 nt, hsa
aaaaauacaacugagaagggugaagagaaguauguuuguuaaacaguaaaaaugaauaguaua

SEQ ID NO: 254756 - RNA, 63 nt, hsa
cccccuuugccuuuaaaacuuacaaaaauacguguuuguuauuugagaaagcauguuuaaaaa

SEQ ID NO: 254757 - RNA, 63 nt, hsa
aacaauuuaugcgaaccuaugucuaaauucacuguuuguuacuauguauguuuuuuuccaaug

SEQ ID NO: 254758 - RNA, 63 nt, hsa
guuucaaucucugacuaaaaauacuuaaauuugguuuguuaauucuuauuuuagaaauuauaa

SEQ ID NO: 254759 - RNA, 63 nt, hsa
ccuuagauacuccuguaauucuuaaugugaauaguuuguuaauauugcuguaaaguauuauau

SEQ ID NO: 254760 - RNA, 63 nt, hsa
ucuuuguggcuacuuguuuguggaugguauuguguuuguuagugaacuguggacucgcuuucc

SEQ ID NO: 254761 - RNA, 63 nt, hsa
guggacugcagccuucaucuuuauugggaaugaguuuguuauaaaucagaaauggguccauga

SEQ ID NO: 254762 - RNA, 63 nt, hsa
uaggauuccauuugaugauucuggauuuuugcuguuuguuauugcccuuagaggggcucugag

SEQ ID NO: 254763 - RNA, 63 nt, hsa
aaauauuuauuguuucagagacuguacuauuuuguuuguuagaagauuuauaaggcaguaucu

SEQ ID NO: 254764 - RNA, 63 nt, hsa
ugggagaucuggugaucucccaagcuaucuaaaguuuguuagauagcugcauguggcuuuuuu

SEQ ID NO: 254765 - RNA, 63 nt, hsa
aaugagcuuuuuaaggaagaaauauuauauauuguuuguuaaaguuuauugaaauaaagaauc

SEQ ID NO: 254766 - RNA, 63 nt, hsa
cuguguuauuagugaggaaacuuuaaaacucauguuuguuauuacuuacuacccaauuucauu

SEQ ID NO: 254767 - RNA, 63 nt, hsa
uuccccuaaacuugcccuguuuuuguuuuuuuaguuuguuauccccuuacugagcggccucua

SEQ ID NO: 254768 - RNA, 63 nt, hsa
gccaggacccacacagcuucgauggaucucaguguuuguuaacaaaauacaaagaucucaaac

SEQ ID NO: 254769 - RNA, 63 nt, hsa
uugccauucugccguagcuagauguucugugggguuuguuaacauggaacuacucagcuuucu

SEQ ID NO: 254770 - RNA, 63 nt, hsa
ucguccccagcguccguccuguaacgugcuucuguuuguuaugguagaacagcccuguguuaa

SEQ ID NO: 254771 - RNA, 63 nt, hsa
uuuuuaggaaaauucugaagccagcuaucacagguuuguuagcuaauaauaguauuuucuuuu

SEQ ID NO: 254772 - RNA, 63 nt, hsa
auugagcaguagcauuugccuuuuggguuuuuuguuuguuauuauagaagagaugacuucugc

SEQ ID NO: 254773 - RNA, 63 nt, hsa
uaauuuuaaagauucuuuaucugcaucauugcuguuuguuacuauaaauuaaaugaaccucau

SEQ ID NO: 254774 - RNA, 63 nt, hsa
ucaguucuaaugaaauuuuguaaaagauggcaaguuuguuaccucacuugagugggguuuucc

SEQ ID NO: 254775 - RNA, 63 nt, hsa
cauuuuucugucagauuuguaguaauuugugagguuuguuagagauuaauauagguuuucuuu

SEQ ID NO: 254776 - RNA, 63 nt, hsa
gaguuuucucuguauucucagaagauguuaauaguuuguuacuagccagagaguaugacuaug

SEQ ID NO: 254777 - RNA, 63 nt, hsa
cuguuagucggguuagaguuggcucuacgcgagguuuguuaauaaaaguuuguuaaaaguuug

SEQ ID NO: 254778 - RNA, 63 nt, hsa
agaguuggcucuacgcgagguuuguuaauaaaaguuuguuaaaaguuuguuuugugcaagugu

SEQ ID NO: 254779 - RNA, 63 nt, hsa
agcccaugguaaacacaggcuucaccuguucuuguuuguuagccuugacugugaggcaggacu

SEQ ID NO: 254780 - RNA, 63 nt, hsa
aaggaggaggacuggcugccuccauuuugccuuguuuguuaguuugccugggucugucugagg

SEQ ID NO: 254781 - RNA, 63 nt, hsa
cagucacaucacaauauucaguggugaaaucuuguuuguuacugucauucccauuccuuuucg

SEQ ID NO: 254782 - RNA, 63 nt, hsa
uuaaguuucaggauacaugugccgaaugugcagguuuguuacauagguauauauaugccauga

SEQ ID NO: 254783 - RNA, 63 nt, hsa
cccuuuuaucugauucugagacagguaaauucuguuuguuacuacguuuaauuagaaggugga

SEQ ID NO: 254784 - RNA, 63 nt, hsa
acugcauguuuuauaaaauaaaaauaaaauaucguuuguuauuuaucucauuagagaacugcu

SEQ ID NO: 254785 - RNA, 63 nt, hsa
agcauuucagauuuuauugucagauauuuagauguuuguuacauuuuuaaaaauugcucuuaa

SEQ ID NO: 254786 - RNA, 63 nt, hsa
uuaaaaagacauuaagugaauucuagguagcuuguuuguuauuauuuuuaaaggacgcucuag

SEQ ID NO: 254787 - RNA, 63 nt, hsa
uaaggaaucccuaacccuacuaucagaaaagguguuuguuaaagagccuucucuuguguguua

SEQ ID NO: 254788 - RNA, 63 nt, hsa
cuuauucuuagcuguauauacauuuuuuuaaaaguuuguuaaaauaugcuugacuagaguuuc

SEQ ID NO: 254789 - RNA, 63 nt, hsa
cucuguuuuuuaguauaauggugcuauuuuguaguuuguuauaugaaagagucuggccaaaac

SEQ ID NO: 254790 - RNA, 63 nt, hsa
auaaucuaacccaaacuagcauguguuucugcaguuuguuacacaccuaggaucauauugcau

SEQ ID NO: 254791 - RNA, 63 nt, hsa
gcuguuuuuaucuccaauaaaaaaaaaaaaaagguuuguuaauuaauguggccucugucaguu

SEQ ID NO: 254792 - RNA, 63 nt, hsa
ggggagaugugaauaugaccugguuuagagaggguuuguuaagguuuauacuauuuuuggauu

SEQ ID NO: 254793 - RNA, 63 nt, hsa
uauuguuacuguacguguaucuggggcuucuccguuuguuaauacuuuuucuguauuuguugc

SEQ ID NO: 254794 - RNA, 63 nt, hsa
aacaguacgacaguguauuguaaauucccuuuaguuuguuacaguagccaauugaaaauguau

SEQ ID NO: 254795 - RNA, 63 nt, hsa
caggaaacacauuucuguggccuuagccaagcaguuuguuaguuacauauucccucgcaaacc

SEQ ID NO: 254796 - RNA, 63 nt, hsa
accacaggaauguaucacaacuuaaccguucccguuuguuagacuaguuucuuauuaauguug

SEQ ID NO: 254797 - RNA, 63 nt, hsa
ggcaagccucccauugccuuucugcaucaauguguuuguuaccaaauagcagaaauuucgcuu

SEQ ID NO: 254798 - RNA, 63 nt, hsa
cuuauuuguaguuguuaguugcccugcuaccuaguuuguuagugcauuugagcacacauuuua

SEQ ID NO: 254799 - RNA, 63 nt, hsa
gacaauuuucauaacuugauaaauuauaguuuuguuuguuagaaaaguugcucuuaaaagaug

SEQ ID NO: 254800 - RNA, 63 nt, hsa
ucuaaaagagcucgcuggcaagcugccucuugaguuuguuauaaaagcgaacuguucacaaaa

SEQ ID NO: 254801 - RNA, 63 nt, hsa
guuuuuuguaguuguuaccgcucuuuuggguugguuuguuaauuuauacaaagagauuaccac

SEQ ID NO: 254802 - RNA, 63 nt, hsa
cugagccauggugucgagugaagaguaguucuuguuuguuacaaccuuugugagucagccaug

SEQ ID NO: 254803 - RNA, 63 nt, hsa
uugaacugcacuuuauauaaccaaagcuuagcaguuuguuagauaagagucuauguaugucuc

SEQ ID NO: 254804 - RNA, 63 nt, hsa
aaaaguaaaauggacuacuuuuguaacuuaccuguuuguuaggaaauggaauggucucuuuga

SEQ ID NO: 254805 - RNA, 63 nt, hsa
uuuuaguuaauauaccaaagcuuaugaauaauuguuuguuaauugaacauuuucaauuauaug

SEQ ID NO: 254806 - RNA, 63 nt, hsa
acagcuaaaagggacuaaauuuguaaaaaauuaguuuguuauaguugaagauuaacuuuuccu

SEQ ID NO: 254807 - RNA, 63 nt, hsa
aagggauaaaucucuaauuauugcuguuuaacuguuuguuaucauaguuggucaaugccuggc

SEQ ID NO: 254808 - RNA, 63 nt, hsa
agccauugcucugcuccuggcauagagucaccuguuuguuauguggauuaaauaguuuuaaaa

SEQ ID NO: 254809 - RNA, 63 nt, hsa
aaagaacacuucuaagccuaagugugugauacaguuuguuacuuuuaaguacauuuuaauaau

SEQ ID NO: 254810 - RNA, 63 nt, hsa
auggauuaucugggguaauuuucuucaaagggaguuuguuauacacagugaaaauguauuaua

SEQ ID NO: 254811 - RNA, 63 nt, hsa
uacaagauacucuuuggaucucucguagagaugguuuguuaccauccuuuaaucauaacuaaa

SEQ ID NO: 254812 - RNA, 63 nt, hsa
ggugacugaaauugcaucagugaucauaaugagguuuguuaaaacgauagcuauauucaaaau

SEQ ID NO: 254813 - RNA, 63 nt, hsa
auugcuucacugguuuaauaauuuaaaaguuauguuuguuaaacacccugucagaacagucau

SEQ ID NO: 254814 - RNA, 63 nt, hsa
uuuaauggaaucuuuguuuuuguucuccaucuuguuuguuagagucucucggccuuuauuuac

SEQ ID NO: 254815 - RNA, 63 nt, hsa
auucaacuuuuaagauacagaagaaauuuguauguuuguuaaaguugcauuuauugcagcaag

SEQ ID NO: 254816 - RNA, 63 nt, hsa
gcaguaauaaaccauuuguuuuacugcuguuaaguuuguuauuuggguauaaaaccagauguu

SEQ ID NO: 254817 - RNA, 63 nt, hsa
uaacagcugcuggacagacacauuagagcagcuguuuguuauugauaauaaaauauuauaaaa

SEQ ID NO: 254818 - RNA, 63 nt, hsa
ucuuuuucaugggcgggucggggucaguauccuguuuguuauuguuaaauuuguaugaaccuu

SEQ ID NO: 254819 - RNA, 63 nt, hsa
ucgaugugauacaguauaaauaugcuaugguuuguuuguuaugaacagauagccaccaguuac

SEQ ID NO: 254820 - RNA, 63 nt, hsa
agagaaacauuuuugcaugaguucuuacaaacuguuuguuauauuuucuggaaugauaaguga

SEQ ID NO: 254821 - RNA, 63 nt, hsa
agccggcgaugcccaauaaauguguguuuugcuguuuguuaagugauuucagcaacaagugug

SEQ ID NO: 254822 - RNA, 63 nt, hsa
gugugugugaaaaagcuggguucaaauaaguugguuuguuagacauucauaugccuacccauc

SEQ ID NO: 254823 - RNA, 63 nt, hsa
ccacggccauaacaauauuuaacuuuaaaagcuguuuguuauaugcugcuuaauaaaguaagc

SEQ ID NO: 254824 - RNA, 63 nt, hsa
auguuuuccacuugauugcugcagauaucaagaguuuguuauuuucaaauacccauccaacaa

SEQ ID NO: 254825 - RNA, 63 nt, hsa
uguuaacugaacucuuaauuauguuuuuaaaauguuuguuauauuucuuuucuuuuuucuuuu

SEQ ID NO: 254826 - RNA, 63 nt, hsa
caaagggugucugcgucgucaccaaaucguagcguuuguuaccagagguugugcacuguuuac

SEQ ID NO: 254827 - RNA, 63 nt, hsa
uuaauuaauuuuuuucauaauugagacagaacuguuuguuauguaccauaaugcuaaauaaaa

SEQ ID NO: 254828 - RNA, 63 nt, hsa
aaguauuauaccuuuuuuagaguugauacuacaguuuguuaguaugaggcauuuguuugaacu

SEQ ID NO: 254829 - RNA, 63 nt, hsa
agcaucaucauauugugcuguuuuggauaacacguuuguuacaagcauuuaaacuguuucauu

SEQ ID NO: 254830 - RNA, 63 nt, hsa
ugcugccguccaucaagagcccucaacacaagaguuuguuauaaauagaaauaaacgacaaaa

SEQ ID NO: 254831 - RNA, 63 nt, hsa
auugccacuaguuccaucuagaacuccuuucuaguuuguuauuuuuaaaauguuuauacauaa

SEQ ID NO: 254832 - RNA, 63 nt, hsa
ggccugugggaaugggauuuguuacaaaucuagguuuguuacuggcuucagaaagcuaauuaa

SEQ ID NO: 254833 - RNA, 63 nt, hsa
aucaaaguauuauaugcugugugcuuuuuagguguuuguuaguacugugaaggcaaaaaugcu

SEQ ID NO: 254834 - RNA, 63 nt, hsa
uggacugugaagcaucugccauggggaagugcuguuuguuauccuuucucuguggcagugaag

SEQ ID NO: 254835 - RNA, 63 nt, hsa
acguggcgucugauaacagugagggggggugggguuuguuaugucuuuauugaguauuuaagu

SEQ ID NO: 254836 - RNA, 63 nt, hsa
agaaaauaacagaauagccuucuguaaugaggcguuuguuagaguuuugcaugagauucuaau

SEQ ID NO: 254837 - RNA, 63 nt, hsa
acuugugaaaacaagguuguuuuugucuuuaucguuuguuagaguuauagauuuaugauuuca

SEQ ID NO: 254838 - RNA, 63 nt, hsa
cuagggacagaggcaucuggaugcaaacgcgggguuuguuaggggcggaaucccgaggguggu

SEQ ID NO: 254839 - RNA, 63 nt, hsa
auucuuuuccuuucauuuugcuuucugaaagcaguuuguuauacuauucauaacauuguagag

SEQ ID NO: 254840 - RNA, 63 nt, hsa
cauugcuguauacacacagacacacacauguauguuuguuaccaagaacuggucagaccuugc

SEQ ID NO: 254841 - RNA, 63 nt, hsa
acaggcaugagccacuguaccuggcgaaaaacaguuuguuaacacaggcagccaacaucacuc

SEQ ID NO: 254842 - RNA, 63 nt, hsa
cugguuuaaaagggauccaguuuccagcugcagguuuguuagagucuguucuacaugggccug

SEQ ID NO: 254843 - RNA, 63 nt, hsa
cccccuccucaauguaguggccuuggauauccuguuuguuaauaaagacaauucaaccagcuc

SEQ ID NO: 254844 - RNA, 63 nt, hsa
cugugagucuggcucaagaccgacauugccuugguuuguuacaugacuaucgugauggggaaa

SEQ ID NO: 254845 - RNA, 63 nt, hsa
ugggcuuucuguuuaugaggggugagaagugauguuuguuacuauguucuccagcaaguaaac

SEQ ID NO: 254846 - RNA, 63 nt, hsa
ucuaauaacaaaaaauguaaaccuaauuuggcaguuuguuagguuagacaacugacagccuca

SEQ ID NO: 254847 - RNA, 63 nt, hsa
cuuaaauuaguaugugccccuaaaauauucuauguuuguuaugagauucaaauaaaaaaauuu

SEQ ID NO: 254848 - RNA, 63 nt, hsa
cacaucccuguaaggcccauaagagaaagaggaguuuguuacauuuaaucaacacugugaagu

SEQ ID NO: 254849 - RNA, 63 nt, hsa
agcauagugcuuugcacauaguagucacucaguguuuguuaaauaaagcuauuagugucauua

SEQ ID NO: 254850 - RNA, 63 nt, hsa
uucagcagcaaacuugcaacagacuggccuucuguuuguuacuuucaaaaggcccacaugaua

SEQ ID NO: 254851 - RNA, 63 nt, hsa
uguuucucuacuaagaacucuuucuuaaaugugguuuguuacuguagcacuuuuuacacugaa

SEQ ID NO: 254852 - RNA, 63 nt, hsa
gguagcacaaucuacuaauguuguuugaucuguguuuguuauacugguuguaauuaauuuuuu

SEQ ID NO: 254853 - RNA, 63 nt, hsa
acaagguuguagcugugcucaggcuucagcuugguuuguuaaauugagagauaaacaaugaca

SEQ ID NO: 254854 - RNA, 63 nt, hsa
uguugcugcucuguauuugccucucgugauucuguuuguuacccauguucacuucccccagga

SEQ ID NO: 254855 - RNA, 63 nt, hsa
ugccucagcugaucagaguuucuguggaauucuguuuguuaaaucaaauuagcuggucucuga

SEQ ID NO: 254856 - RNA, 63 nt, hsa
aaggcaacacauuccuacacuuuuaauguauauguuuguuauaauguccauguaaacaugccc

SEQ ID NO: 254857 - RNA, 63 nt, hsa
gguagcucaaucuacuaauguuguuugaucuguguuuguuauacugguuguaauuaauuuuuu

SEQ ID NO: 254858 - RNA, 63 nt, hsa
uguguccuccagguuuauaugggaaucgaaacaguuuguuaaucugauugggagaguuccaug

SEQ ID NO: 254859 - RNA, 63 nt, hsa
uguuucuaugugcaaaaaaaaaaaaaaaaaaaaguuuguuaaaaggcuacacgagcucucuag

SEQ ID NO: 254860 - RNA, 63 nt, hsa
guuuccuaaacuauaaaagcagauuuugcuuuuguuuguuaaucauaggcauggccgagcauu

SEQ ID NO: 254861 - RNA, 63 nt, hsa
uuuauuuuaucucaaguauguccaguguguucgguuuguuacauauuccaugaaauaucugag

SEQ ID NO: 254862 - RNA, 63 nt, hsa
agcagauuagcaccauaacuaacuuaaaacuaaguuuguuaccugcuuuuuauacugucacaa

SEQ ID NO: 254863 - RNA, 63 nt, hsa
uuaaaauuaccagacaaaaaaauuuaaaauuacguuuguuauuccuaguggaugacuguugau

SEQ ID NO: 254864 - RNA, 63 nt, hsa
auaggacaaaaaaguugugguuuggggaggucuguuuguuacauaaaaaggaccuuucggugu

SEQ ID NO: 254865 - RNA, 63 nt, hsa
aagauuaugaaaccacaugagaagugauaaaauguuuguuaaagcuagauagagguuaagaau

SEQ ID NO: 254866 - RNA, 63 nt, hsa
uggaaaugcagaauggcguuagauuuauauuugguuuguuaauuuuauaucacuguuuuucac

SEQ ID NO: 254867 - RNA, 63 nt, hsa
cuguaaauggcugucuaaaauaaagacauucauguuuguuaaaaacugguaaauuuugcaacu

SEQ ID NO: 254868 - RNA, 63 nt, hsa
auaacuuccauguucucuagaaaucaagguuuuguuuguuaauucucuuuuauaugcauguau

SEQ ID NO: 254869 - RNA, 63 nt, hsa
uacgaucguuauucccccaauucaucauauuuuguuuguuaucaccagagaugccugaacuca

SEQ ID NO: 254870 - RNA, 63 nt, hsa
uuuuuguuuuuguauuuuuuuucuuuugaaaggguuuguuaauuuuucuaauuuuaccaaagu

SEQ ID NO: 254871 - RNA, 63 nt, hsa
uuuagccguguuugggacuccgugucuucaaugguuuguuaguugccauuacaacuuugucug

SEQ ID NO: 254872 - RNA, 63 nt, hsa
gugcugggauuacaggcccgguccaguuugauaguuuguuaucauguuauacguacacuuaga

SEQ ID NO: 254873 - RNA, 63 nt, hsa
uuagcagagaauuuguaauuuaagaaauuuucuguuuguuacggaacaugugggaaucccuuu

SEQ ID NO: 254874 - RNA, 63 nt, hsa
uucaacucuugcaccuggaguucugcugguuaaguuuguuaaacuuaguugaaacugggaacc

SEQ ID NO: 254875 - RNA, 63 nt, hsa
aaauaaagagcuaucaugcugugguuuauuaugguuuguuacauugauaggauacauacugaa

SEQ ID NO: 254876 - RNA, 63 nt, hsa
agcccgcucguaucuaugguuucgcuuuccacaguuuguuaccugcagucaacugcaguucaa

SEQ ID NO: 254877 - RNA, 63 nt, hsa
cccuuccuccagauccgucugguuuuuuacaccguuuguuaauaaagccugaaaccgcugugu

SEQ ID NO: 254878 - RNA, 63 nt, hsa
uaauguacguacuaccuaaaaggaugucuaaauguuuguuaauaaaaauaagaaauagcuaca

SEQ ID NO: 254879 - RNA, 63 nt, hsa
auuaauauguuaggauuuauccucagucagccaguuuguuaugucuuuucuauucuacuguua

SEQ ID NO: 254880 - RNA, 63 nt, hsa
gcuguuauucuauucugcaaauaaacugaauguguuuguuaguuccaguugcauuuuggcuga

SEQ ID NO: 254881 - RNA, 63 nt, hsa
uaagaaguuuaaucaaaguaaccagaaucccauguuuguuacuaggauuuacauuaacugcug

SEQ ID NO: 254882 - RNA, 63 nt, hsa
auuuacgauuucguuuguuuggauucaagcuuaguuuguuaauauguauaauuuagcaucuau

SEQ ID NO: 254883 - RNA, 63 nt, hsa
cauuuuaagaaaacccgacaacauuucugccagguuuguuaggaggccacaugauacuuauuc

SEQ ID NO: 254884 - RNA, 63 nt, hsa
ggcugacucuuacuaaccaccauuuccccugugguuuguuaucaguacaauucuuuguugcuu

SEQ ID NO: 254885 - RNA, 63 nt, hsa
aauacauuauugacucuaugaauguuuucugaaguuuguuagucauuuguaaaacuaaaucag

SEQ ID NO: 254886 - RNA, 63 nt, hsa
ggcuuugggugaauucuggauggcuugccucauguuuguuagccagcacuucugcucugucgu

SEQ ID NO: 254887 - RNA, 63 nt, hsa
cucaugguaccuuggccaaguuggaaggaagcaguuuguuaaugaggcacaguaauccuggcu

SEQ ID NO: 254888 - RNA, 63 nt, hsa
aauauuuacaauaaagaguauuuacaauaaagaguuuguuauuauuuguaaauugugugcaac

SEQ ID NO: 254889 - RNA, 63 nt, hsa
cagacugggaaccccuccuggccugggggaagaguuuguuaccuaccuuacuauuuaaagagc

SEQ ID NO: 254890 - RNA, 63 nt, hsa
ggaggggaccgggaagcgcuggggcuuguuucuguuuguuacuuacaggacugagacaucuuc

SEQ ID NO: 254891 - RNA, 63 nt, hsa
uaacagcugccugaauugucauuuuccauuuugguuuguuagaggugggagggguggguuuug

SEQ ID NO: 254892 - RNA, 63 nt, hsa
aggacucuucaguggcugagcagcuuuggacuuguuuguuauccuauuuugcauguguuugag

SEQ ID NO: 254893 - RNA, 63 nt, hsa
ccuccuugcccagacuacagggcuuaggacuugguuuguuauuucagggaaaaggaguaggga

SEQ ID NO: 254894 - RNA, 63 nt, hsa
uauugugacuuguaaguuucuuaucccauaaagguuuguuacuucccucacuucaccuccaua

SEQ ID NO: 254895 - RNA, 63 nt, hsa
uuacguuccgggauacaugugcaggaccugcagguuuguuacauagguaagccugugccaugg

SEQ ID NO: 254896 - RNA, 63 nt, hsa
uuauugaaaaauuaaaaaaugucauuguuuccuguuuguuaauauuaggguuguaaggugucg

SEQ ID NO: 254897 - RNA, 63 nt, hsa
uucuccugcauuuuuacauaaacuaaaugugagguuuguuacugguauuuuuuucacgugccu

SEQ ID NO: 254898 - RNA, 63 nt, hsa
cagugccaccuuauggcaaagagcucccgcaguguuuguuagagugcacaucccuacgugccc

SEQ ID NO: 254899 - RNA, 63 nt, hsa
uccagcaguguuagcagggguggcaguccuuguguuuguuauaccaauaaaugcuuuagcugc

SEQ ID NO: 254900 - RNA, 63 nt, hsa
uauaccucaacccaaaaauaaagguuuguuuugguuuguuauggcuuccuuuuuuaaaaaauu

SEQ ID NO: 254901 - RNA, 63 nt, hsa
caauuuuguacaauuagguaucugacuuuacaaguuuguuauccuuucuaauuuuuacugaac

SEQ ID NO: 254902 - RNA, 63 nt, hsa
guuuucagauaaaccagaaaagcuuauacaagaguuuguuacguugacuauguucuucaaauu

SEQ ID NO: 254903 - RNA, 63 nt, hsa
acuaaaugccacugaauuuguauacuucagaauguuuguuauguaaauuuuaccucaacuaaa

SEQ ID NO: 254904 - RNA, 62 nt, hsa
auggaucuccguguacacuaucaauaaaaguggguuuguuacaaagccguguccuugcccau

SEQ ID NO: 254905 - RNA, 63 nt, hsa
gcugggccucccugacuguaaaaucucuguacuguuuguuagguuuuuggugggaggcuguga

SEQ ID NO: 254906 - RNA, 63 nt, hsa
ucuggaagcuggcaguguguaaagcacuggcaaguuuguuacuguuaaaaugucaaauaccaa

SEQ ID NO: 254907 - RNA, 63 nt, hsa
ugauugaaauggcaggauucuaaagagagccugguuuguuaaaagaaaacacugucaugcugu

SEQ ID NO: 254908 - RNA, 63 nt, hsa
cugcauuuauaauuuugugacugaggaucauuuguuuguuaauguacugugccuuuaacuuua

SEQ ID NO: 254909 - RNA, 63 nt, hsa
ugaaguaagauuuugccuguaugguacuguuuuguuuguuaauaaagugcacugccaccccca

SEQ ID NO: 254910 - RNA, 63 nt, hsa
uccuuguuccuguuacaauauuuagcauuauuaguuuguuauguguguauguuuauguuaauu

SEQ ID NO: 254911 - RNA, 63 nt, hsa
gugucuacgauucaaagugaaaacauuuggcauguuuguuaauucuagcuuuuugguuuaaua

SEQ ID NO: 254912 - RNA, 63 nt, hsa
gucucccuuucacuguuuucuuauucuguaauuguuuguuauauuucccaaaaacgucuugau

SEQ ID NO: 254913 - RNA, 63 nt, hsa
guagaguauugagaccuuuuuuauuagggugcuguuuguuauugagagcccaaucucugcaug

SEQ ID NO: 254914 - RNA, 63 nt, hsa
uuauuuguuuccugauagguuauguuuguaauuguuuguuaagcacagccuguuucuuggaag

SEQ ID NO: 254915 - RNA, 63 nt, hsa
uauaaauuaguauaucucuucuauuauuagucuguuuguuaaaugccagaccacguuucuaug

SEQ ID NO: 254916 - RNA, 63 nt, hsa
accuacauuaacauuaugucuuugcagcuuuagguuuguuagauguguucuuaagcauaauuu

SEQ ID NO: 254917 - RNA, 63 nt, hsa
uuuucauuggguuuuuauuguuguuuaguuuugguuuguuacgccagcccagucugucugcgg

SEQ ID NO: 254918 - RNA, 63 nt, hsa
gggagggccucauguuuuaucugguucuuaaauguuuguuacuacagaaaauaaaacugcgcu

SEQ ID NO: 254919 - RNA, 63 nt, hsa
agagagagcuauguuucuaaccaagggccuaauguuuguuacagaaaugaucccagagaccua

SEQ ID NO: 254920 - RNA, 63 nt, hsa
cugcauuuauaauuuugugacugaggaucguuuguuuguuaacguacugugacuuuaacuuua

SEQ ID NO: 254921 - RNA, 63 nt, hsa
guagccuuaaaaaggcuuuuguuuauuucuuugguuuguuaacuagugucaucuauuuagaga

SEQ ID NO: 254922 - RNA, 64 nt, hsa
ggcgggucagcuggugguucuuagguuuccuucuguuuguuaaaagggacaauguggccacuuc

SEQ ID NO: 254923 - RNA, 64 nt, hsa
ugguugauaauagucaguaaccuaauaaaggaacguuuguuaaaauaucaaaccauuuuugaau

SEQ ID NO: 254924 - RNA, 64 nt, hsa
uuuccucuccuccuucccaagucauuugaaaaguguuuguuauuuaaauuccaauaaugcccaa

SEQ ID NO: 254925 - RNA, 64 nt, hsa
acguuucugaacagggucugugcuauguguaaagguuuguuaacuguaaaguaauauaaaguua

SEQ ID NO: 254926 - RNA, 58 nt, hsa; identical to SEQ ID NO: 254543

SEQ ID NO: 254927 - RNA, 64 nt, hsa
aaacugaugggcaccugauacucugucuaaauacguuuguuauauguguuuugcccugugccau

SEQ ID NO: 254928 - RNA, 64 nt, hsa
ccccaccacccuuuuuuuucauuuccccuguuuuguuuguuaguuuggcguuagggguggaggu

SEQ ID NO: 254929 - RNA, 64 nt, hsa
guuuucaaaagugcccauuuuaugcugcugugugguuuguuaaaucuaaaugauuuuuaaacuu

SEQ ID NO: 254930 - RNA, 64 nt, hsa
gaaauauuucuccuuuuguuuuucuuuuuuuuuuguuuguuacugccacuucuuuuuaggagca

SEQ ID NO: 254931 - RNA, 64 nt, hsa
auagaucucuuucucucuuuuguuuuguuuguuuguuuguuaaaguucauuauuuauuuuaccu

SEQ ID NO: 254932 - RNA, 64 nt, hsa
cuauugacucuauuuucugaaggcaaaaaugcauguuuguuagaauggaaacagaaaaacauua

SEQ ID NO: 254933 - RNA, 64 nt, hsa
acaugcauggucaugacacccagaauucaugaugguuuguuauaacaaccucugcauauuccag

SEQ ID NO: 254934 - RNA, 64 nt, hsa
uuaaaaaaggcauuugaaugaauguuugacucagguuuguuaaauuaaccuucaguaacugcag

SEQ ID NO: 254935 - RNA, 64 nt, hsa
ugucauaauuguugacguucuucaguauaaucauguuuguuaaauuguuuguaccuugcaaacu

SEQ ID NO: 254936 - RNA, 64 nt, hsa
guguuacuauugagauucucucaauugcuccuguguuuguuauaaaguaguguuuaaaaggcag

SEQ ID NO: 254937 - RNA, 64 nt, hsa
uugggucauuauuacuuuuauuuugcagcauuugguuuguuauuaguguaagagcaaguauagg

SEQ ID NO: 254938 - RNA, 64 nt, hsa
uccuuuuaggcuugaauaugaugcugaacaguaaguuuguuaaaucuuggaacuuaaaacaauc

SEQ ID NO: 254939 - RNA, 64 nt, hsa
auugcagcaccucuaucucgcagguaauggaguaguuuguuauugguagucuacuccaggccag

SEQ ID NO: 254940 - RNA, 64 nt, hsa
ugcagcuuauucuugccaugcuuaggugacagaaguuuguuaaguaccauccuugugcccugcc

SEQ ID NO: 254941 - RNA, 64 nt, hsa
cguuuaaauuguuaaaaugcugauuuucuuauuaguuuguuaauugccuguuacuaguacuuga

SEQ ID NO: 254942 - RNA, 64 nt, hsa
gaucauggaguacugcucucauaauugaagacguguuuguuauuggcagagaaccuuaaaaaag

SEQ ID NO: 254943 - RNA, 64 nt, hsa
acgccuuccucucuggauacugcaaaggcuugugguuuguuagaggguauuuguggaaacuguc

SEQ ID NO: 254944 - RNA, 64 nt, hsa
guacuaguucagacacuuuggaaguuuguguucuguuuguuaaaacuggcaucugacacaaaaa

SEQ ID NO: 254945 - RNA, 64 nt, hsa
auuauaauuuauaaauacagcauacuucaaaacuguuuguuaucucuuguuaccauguauguau

SEQ ID NO: 254946 - RNA, 64 nt, hsa
ucuucauuuugagaaaacuguacauuaguuuaauguuuguuacuguauuucuuuugaguugagg

SEQ ID NO: 254947 - RNA, 64 nt, hsa
ggaaaucaguugagcugaauuuaaguuguuuuuuguuuguuagcagguguggaugugggguuau

SEQ ID NO: 254948 - RNA, 64 nt, hsa
cagauuguguuaccauuugaauacacugacuaauguuuguuaaacuuuuucuguggcaccuugg

SEQ ID NO: 254949 - RNA, 64 nt, hsa
gaaagauuuguaaaugguaaagcacuauauucuuguuuguuaguccuuuuuccuuucuuugggu

SEQ ID NO: 254950 - RNA, 64 nt, hsa
cacuuguaucauggccuacccgaggagaagaggaguuuguuaacugggccuauguaguagccuc

SEQ ID NO: 254951 - RNA, 64 nt, hsa
guugguuuauguuaaugauagacaaauacccaguguuuguuacuuuuuccaacuaccacuguaa

SEQ ID NO: 254952 - RNA, 64 nt, hsa
guaaauaaagccugugagucaagcaucaagugguguuuguuagaaauaaacuagagauuuuuaa

SEQ ID NO: 254953 - RNA, 64 nt, hsa
ugaaagugcugauggcuggauccaaucugguacaguuuguuaaaagcagcgugggauauaauca

SEQ ID NO: 254954 - RNA, 64 nt, hsa
aacuuuuauuuuagauucagggguauaugugcagguuuguuacauagguaaacugcaugucaug

SEQ ID NO: 254955 - RNA, 64 nt, hsa
gguaaauguuuuuagaucuucugguaagcauuauguuuguuaauacauauuuauuagagugaug

SEQ ID NO: 254956 - RNA, 64 nt, hsa
acuuaaauaugaaagcaaauugaacacaucggguguuuguuaucagaaaagagaugagaugaga

SEQ ID NO: 254957 - RNA, 64 nt, hsa
uuaggaagauucaaaaucuugguuauuacaugaaguuuguuauauuucuugucaacaguauuga

SEQ ID NO: 254958 - RNA, 64 nt, hsa
aucgaaauacaguuauuaaaauguuaaaagauaaguuuguuauauauuaauaugcaugcuucuu

SEQ ID NO: 254959 - RNA, 64 nt, hsa
cuggaaaaugaguaaugucucauucuuaccugcaguuuguuacuauguauaaaagucuuuuucu

SEQ ID NO: 254960 - RNA, 64 nt, hsa
augaaaaaaauguaucuuugggaaaacaauuacaguuuguuaauuugaagaugcuggucuugac

SEQ ID NO: 254961 - RNA, 64 nt, hsa
uucccaaaucuggcuggucgggaauaccugggaaguuuguuaaaauuuuuuaaaaauguuuuaa

SEQ ID NO: 254962 - RNA, 64 nt, hsa
uucagcucugguccacagaggauggauaaaaaugguuuguuauguuuuuuugcucugcagugcu

SEQ ID NO: 254963 - RNA, 64 nt, hsa
aauggaugcagaauaaugcagauagugaucccauguuuguuaauugccaucauggaagucagag

SEQ ID NO: 254964 - RNA, 64 nt, hsa
ccguaauuuuaggacuccuauaaaauucuuccuuguuuguuaaugcuauuaaaacucagauuca

SEQ ID NO: 254965 - RNA, 64 nt, hsa
aacucuguuuuauccuagaacuaagagagcauugguuuguuaaagagcuuucaauguauauuaa

SEQ ID NO: 254966 - RNA, 64 nt, hsa
gugcgugggacgaagacaucuuugaaggucaugaguuuguuaguuuaacaucauauauuuguaa

SEQ ID NO: 254967 - RNA, 64 nt, hsa
ccgucucaaaaguaaauaaaaauaaucaccuggaguuuguuaaaccauauggauucucaagcuc

SEQ ID NO: 254968 - RNA, 64 nt, hsa
cucaucccuggagcacucugccgcucaagagcugguuuguuaauuauuguuagacuuugccauu

SEQ ID NO: 254969 - RNA, 64 nt, hsa
caucuugaaguaaauugaucccaccaggucccacguuuguuaucucugccuaaauguuagcuuc

SEQ ID NO: 254970 - RNA, 64 nt, hsa
ucaccuacccucaaaguagguauacaaaagacuaguuuguuauuaauccacaaauaugcuaaau

SEQ ID NO: 254971 - RNA, 64 nt, hsa
acuuuaaaauuuaacccacaagcauauuaaaucuguuuguuauaagauuggaaacaauuuuuga

SEQ ID NO: 254972 - RNA, 64 nt, hsa
agugaggcaucacuuuguuugcauaaaguauacgguuuguuaaggccuuuguucuugugagaug

SEQ ID NO: 254973 - RNA, 64 nt, hsa
uuaauucauguuuguugggacugagguuuaggaaguuuguuacugguuaaaaaccucaaaugaa

SEQ ID NO: 254974 - RNA, 64 nt, hsa
gauaagugccuuuuuggagauguaacuuuuagcaguuuguuaaccugacaucucugccagucua

SEQ ID NO: 254975 - RNA, 64 nt, hsa
acccuaaugucuucauaaaguacuugaguguaauguuuguuaccuccaacagaacuaaauguuc

SEQ ID NO: 254976 - RNA, 64 nt, hsa
ccagagagugucuucgaggguaucaucauuuccgguuuguuaaucuuauucaccaaauguucua

SEQ ID NO: 254977 - RNA, 64 nt, hsa
ccaauuuugacuuggccaggggacaccuugguguguuuguuaucuuuaucuguggguaggcuag

SEQ ID NO: 254978 - RNA, 64 nt, hsa
ugaggaacaaauagaccauuuccauacuaaaccaguuuguuaacuuuagauuuuuuccaauagu

SEQ ID NO: 254979 - RNA, 64 nt, hsa
accuuauauucagguauaugugauauuuugccugguuuguuaaaauugccccauuuagauuccu

SEQ ID NO: 254980 - RNA, 64 nt, hsa
accaccaccacccucaucacucagaaacccuacuguuuguuagacaggugguugaggggacaug

SEQ ID NO: 254981 - RNA, 64 nt, hsa
ugcuuuccuauggaaaaaauacauauauaguuuaguuuguuagacgugaguuauccaaguauuu

SEQ ID NO: 254982 - RNA, 64 nt, hsa
auacuguaugcaguacugcaagcuaauaacguugguuuguuauguagugugcuuuuugucccuu

SEQ ID NO: 254983 - RNA, 64 nt, hsa
ggaaaacuggguaguucaucugaccaugggauguguuuguuaugaagaaaaucuggaugccugu

SEQ ID NO: 254984 - RNA, 64 nt, hsa
aacauggaauauuugguuuccuguuccuauguuaguuuguuaaggauaauggccuccagcccca

SEQ ID NO: 254985 - RNA, 64 nt, hsa
gggguacaugugcagguaaacucgugacaaggggguuuguuauacagauuauuuagugacccag

SEQ ID NO: 254986 - RNA, 64 nt, hsa
accuguuuuuuuuucauuuauuguuuauguaaauguuuguuaaaaauaaaucccauggaauauu

SEQ ID NO: 254987 - RNA, 64 nt, hsa
uuuaaguuuuaggguacaugugcacaaugugcagguuuguuacauauguauacaugugccauau

SEQ ID NO: 254988 - RNA, 64 nt, hsa
gaagaaaauucugucucaaaaauuaaagaauuuuguuuguuauuguuguucugaccauauugaa

SEQ ID NO: 254989 - RNA, 64 nt, hsa
auuagcgcugcuucguuuuguauagggcuuuucuguuuguuacaagccaaacacugccugucuu

SEQ ID NO: 254990 - RNA, 64 nt, hsa
uucuguuucuugagaagagaauauuagcuuuacuguuuguuauggcuuaaugacacuagcuaau

SEQ ID NO: 254991 - RNA, 64 nt, hsa
aauguauuacuuuguucucccaugaaagaauucaguuuguuaguaccuauauuuuuaaacuggu

SEQ ID NO: 254992 - RNA, 64 nt, hsa
aaaauagaagaaaugaacaaaaacuuaaaucacaguuuguuauuaaguaauaucugaaaugaau

SEQ ID NO: 254993 - RNA, 64 nt, hsa
cacauucuggaaacauaacacucuacauuacaaaguuuguuaccugcugaaaucaauguaacuc

SEQ ID NO: 254994 - RNA, 64 nt, hsa
uguaacaauguuaaauuaauuauaaugggauuggguuuguuaucugugguaguauauauccuag

SEQ ID NO: 254995 - RNA, 64 nt, hsa
aacuagaaugugugacucuguggggacugcauagguuuguuaauugaccuauagcuaaaccuua

SEQ ID NO: 254996 - RNA, 64 nt, hsa
gcugaagcaucuguccagcugguauccugugaaaguuuguuauuuucugaguagacauucuuau

SEQ ID NO: 254997 - RNA, 64 nt, hsa
uuuuuuauauucuuaaauuugcucacaaauugugguuuguuacaauuaaacuggauacuuauuu

SEQ ID NO: 254998 - RNA, 64 nt, hsa
guuaagcucuuuccuauuguguuuauacaguuuuguuuguuauacucuuugcaccuuaaacccc

SEQ ID NO: 254999 - RNA, 64 nt, hsa
uguagagcccccuccugugcccucaguggcugucguuuguuaacaucaucaggaagaugggaaa

SEQ ID NO: 255000 - RNA, 64 nt, hsa
ggggggaaaucacaagucacugagguguuuguuuguuuguuaggcagugcuagagcuugaagcc

SEQ ID NO: 255001 - RNA, 64 nt, hsa
guaggcaaacuaucaauuuuuuguccauuuuccuguuuguuaaaauaacauaccucuccuacgu

SEQ ID NO: 255002 - RNA, 64 nt, hsa
aaacuuacauuuuguuuccaauuuuucauuuuuuguuuguuauuuguuuuuuguagacagcacu

SEQ ID NO: 255003 - RNA, 64 nt, hsa
guucauucuuaagcuugcuuuuuuugagacugguguuuguuagacagccacaguccugucuggg

SEQ ID NO: 255004 - RNA, 64 nt, hsa
gcaaggaggaggguugagcaaucuagagcauggaguuuguuaagugcucucuggauuugaguug

SEQ ID NO: 255005 - RNA, 64 nt, hsa
ucaucuaagaugaaacucauaaaaauuauuuaauguuuguuaugaauuuaaaagcuccagaaau

SEQ ID NO: 255006 - RNA, 64 nt, hsa
gguuuuuaaauauucaauauuggucuguguuuaaguuuguuauuugaauguaauuuacauagag

SEQ ID NO: 255007 - RNA, 64 nt, hsa
gacucugggaagucugaccaaguuggagcagaugguuuguuacuugaaucuccaaacacuuagu

SEQ ID NO: 255008 - RNA, 64 nt, hsa
uccaugaugguuguugcccgagguuaauguaguuguuuguuagaccugugucuuacacauuucu

SEQ ID NO: 255009 - RNA, 64 nt, hsa
uaugagaacacugcaucugcauucauagccacgaguuuguuauugcuacaggcuacugagcguc

SEQ ID NO: 255010 - RNA, 64 nt, hsa
aaucacgggcauuuuaucuucucugaacacugcaguuuguuagacuagagcugagguuggagga

SEQ ID NO: 255011 - RNA, 64 nt, hsa
gccccuuauuuaaaaaaaaaaaagaaaaaaaagaguuuguuacucuauuguauguuacaaaaga

SEQ ID NO: 255012 - RNA, 64 nt, hsa
aagcaaaaacccacggccaaaauaaauugguacuguuuguuacaaaguucugucuugucauggg

SEQ ID NO: 255013 - RNA, 64 nt, hsa
uucuggagaaggcccugaaaucacauugauauauguuuguuaguaaaaugugcacaccugacuu

SEQ ID NO: 255014 - RNA, 64 nt, hsa
guguuaauuucaaauaugcaaauuugguacugcaguuuguuaugcaauauuauaucaccaaccc

SEQ ID NO: 255015 - RNA, 64 nt, hsa
ucuaaguuguaauuuugauuuuuguggaaccauuguuuguuaauguugggauucucugcacuuu

SEQ ID NO: 255016 - RNA, 64 nt, hsa
uuccuucugaaaauauuuacauuuugcuaaccuaguuuguuacuuuaaaaaucaguuuugauga

SEQ ID NO: 255017 - RNA, 64 nt, hsa
aucguguccuugcugucuuuuuauuuuccuuuuuguuuguuagcaaaaaccucuauuuagauuu

SEQ ID NO: 255018 - RNA, 64 nt, hsa
aagcuuaaaaguaauguaugcuuugcugaccacuguuuguuaggccuuaaacaacauucacugu

SEQ ID NO: 255019 - RNA, 64 nt, hsa
agaaagauguuuggcaugccaaauuaacuugcauguuuguuaaaaaaacaaacacauguuuuga

SEQ ID NO: 255020 - RNA, 64 nt, hsa
aguucauagacgagauuuguucaacacugcaauuguuuguuagauguaaacccugugacuauag

SEQ ID NO: 255021 - RNA, 64 nt, hsa
cuuccaaauguucuuccuggggucuuugauauuuguuuguuacauccugcugaaguucgacugu

SEQ ID NO: 255022 - RNA, 64 nt, hsa
ggcuuauugaaugucuaaaaaauaaguuuaaaguguuuguuacccuaaguuuuuuacauuuuua

SEQ ID NO: 255023 - RNA, 64 nt, hsa
uaauguuuaagaaauuuaccuuaaaucuuguucuguuuguuaguaugaaaaguuaacuuuuuuu

SEQ ID NO: 255024 - RNA, 64 nt, hsa
uuuggaacuguucuagagcauaccaugaaaagcaguuuguuauuaugcaggaaaaucaguuuca

SEQ ID NO: 255025 - RNA, 64 nt, hsa
acuuuuuucugccacugcucccuagcccuguuuaguuuguuauugcugcuuuucuuuuuucuuu

SEQ ID NO: 255026 - RNA, 64 nt, hsa
uacuuuuucaugaaaauggaguuaucaguuaucuguuuguuacugcaucaucuguuuguaauca

SEQ ID NO: 255027 - RNA, 64 nt, hsa
cacucacuuacgacaucacuuccauugugugcauguuuguuauagaggagguuuuaggcuacaa

SEQ ID NO: 255028 - RNA, 64 nt, hsa
agucagaauaguuauucucuaagaggaaacuaguguuuguuaaaaacaaaaauaaaaacaaaac

SEQ ID NO: 255029 - RNA, 64 nt, hsa
ugaaaauacauaccacauuuguuauaaagcauuuguuuguuaguaucaaucacauagguagaaa

SEQ ID NO: 255030 - RNA, 64 nt, hsa
uuaugcuuugaaaaauaauuauggggaaauacauguuuguuauuaaauuuauuauuaaagauag

SEQ ID NO: 255031 - RNA, 64 nt, hsa
uauuucaggcuuguauuuaauauaauaaauagguguuuguuauugugucgaucuguuauuuuua

SEQ ID NO: 255032 - RNA, 64 nt, hsa
cuggcuuuuuuugguuugggguagaccuaaggguguuuguuagucucaaaacugugaagugaca

SEQ ID NO: 255033 - RNA, 64 nt, hsa
aucuguaauauauugccaguauauaagcuguuuaguuuguuaauugauuaaacuguaugucuua

SEQ ID NO: 255034 - RNA, 64 nt, hsa
auuacaguguuuguuuagcuaugguuacuaauauguuuguuauauuuauuuucggggagaggau

SEQ ID NO: 255035 - RNA, 64 nt, hsa
ucaagugacuguccccguaaaaaguagaagauaaguuuguuaaaguauuuuuuauaaacagcuu

SEQ ID NO: 255036 - RNA, 64 nt, hsa
agaaauguuuuuucuuuuccuuguggccaaaccaguuuguuaaucugauuauauucaucugcua

SEQ ID NO: 255037 - RNA, 64 nt, hsa
aucaaaguaguguucuaacuuuaauguauuguauguuuguuauuauauuaaagugugauuauua

SEQ ID NO: 255038 - RNA, 64 nt, hsa
ccuaguacgacuucauuccuuccacuaacucauaguuuguuauauccuagacuagacaugcgaa

SEQ ID NO: 255039 - RNA, 64 nt, hsa
ucagccuuagaaaagcccucaauguaaaccuuauguuuguuacuaggguggccucucucccauu

SEQ ID NO: 255040 - RNA, 64 nt, hsa
gaguuaauaugcuuuucugaugaauuacacaacaguuuguuaauucuucauucuuguaguauuu

SEQ ID NO: 255041 - RNA, 64 nt, hsa
ccucagccucaccuuacgaauccaaagaacugggguuuguuagguucuuucucuaauguagagg

SEQ ID NO: 255042 - RNA, 64 nt, hsa
ugguuagaacucuuacagccuuauuuauuuuuaaguuuguuacagccaaaggguuggagugugc

SEQ ID NO: 255043 - RNA, 64 nt, hsa
uaacauuuuugccaaaagaugacugggguuuuccguuuguuaauauuaagcacaucagaacgug

SEQ ID NO: 255044 - RNA, 64 nt, hsa
gagacgaaugccauuggaaccuguuaaaugaguaguuuguuaugugucuggaagaagcagcguu

SEQ ID NO: 255045 - RNA, 64 nt, hsa
ggaggggcggggggagggagggauuucuuaucccguuuguuacauuuugaggauaauaaaggug

SEQ ID NO: 255046 - RNA, 64 nt, hsa
ucuuaguuacugauuucauuuucaauaaauguagguuuguuacaugaguuucccaauaaaaaaa

SEQ ID NO: 255047 - RNA, 64 nt, hsa
aauagauauauaagaaaaaauucuuucacuugauguuuguuagaccagaaaguguguguguucu

SEQ ID NO: 255048 - RNA, 64 nt, hsa
ucuuucuguuuuguuuuuuucuccugcaaauuuaguuuguuaaagccuguuccauaggaaggcu

SEQ ID NO: 255049 - RNA, 64 nt, hsa
gaaugauuuuuaggguaaauaauacagaugccuuguuuguuaacuaacuuguggaaagcaggaa

SEQ ID NO: 255050 - RNA, 64 nt, hsa
uccauaacauccauaugacugaacacuuguauguguuuguuaaauauucgaaugcauguagauu

SEQ ID NO: 255051 - RNA, 64 nt, hsa
aagugacuuuaaacuuucccuuggcuguuaagaaguuuguuauagauuuagcuauuuauuguuc

SEQ ID NO: 255052 - RNA, 64 nt, hsa
agagugcuucaguaaaaagcuacuauauauuguuguuuguuauuguguagguaauauuuucaau

SEQ ID NO: 255053 - RNA, 64 nt, hsa
auuucaaaucaguuuuuuuuccucaaaaacuuguguuuguuauuagaaaugauuuuuuagauau

SEQ ID NO: 255054 - RNA, 64 nt, hsa
ugguccuccccaccaccccacccccaagacuuguguuuguuaauagaaauaauuuuuuuaggua

SEQ ID NO: 255055 - RNA, 64 nt, hsa
uggucaacuucaacucaaaacacuguuuucuuauguuuguuacaaacuuaauuuuuugaaagua

SEQ ID NO: 255056 - RNA, 64 nt, hsa
ugugucuacuauuaaaagugaaacauuuuggcauguuuguuaauucuaguuucauuuaauaacc

SEQ ID NO: 255057 - RNA, 64 nt, hsa
ugccagggggcaggucugggccugggccaaccacguuuguuaucauggcugcugccuucuggac

SEQ ID NO: 255058 - RNA, 64 nt, hsa
auuaguuuuagcuguagaucaagcuauuugggguguuuguuaguaaauagggaaaauaaucuca

SEQ ID NO: 255059 - RNA, 64 nt, hsa
cucccccuuccccugguccccugucccuggggcuguuuguuaaaaaagaguaauaaaaggauuu

SEQ ID NO: 255060 - RNA, 64 nt, hsa
ggggcuuguuccccugcaguaucuguucugugaaguuuguuaaauguaaggaaagcuuaaauuc

SEQ ID NO: 255061 - RNA, 64 nt, hsa
aggguugcaguuugguuaggaguggaaauauuuuguuuguuaaugaugucuucaguucugguac

SEQ ID NO: 255062 - RNA, 64 nt, hsa
gccauuuuuucucagacaccuggccguaaaaucaguuuguuacagcauucuucucuaggcugcu

SEQ ID NO: 255063 - RNA, 64 nt, hsa
uacacuggguaaaucaccuauacuuagaguaacaguuuguuaucaaaaugccugauaaaauaua

SEQ ID NO: 255064 - RNA, 64 nt, hsa
gucaucaguaucauuagugaaaaagaaacaaauuguuuguuaucaucucuuuagacagauaagc

SEQ ID NO: 255065 - RNA, 64 nt, hsa
aaaauuguaauaccuagguaguugguugaucacaguuuguuaauuguauaaaaaaaaauuaccu

SEQ ID NO: 255066 - RNA, 64 nt, hsa
ucaacuuuauuuuguauuuccuuccauuuggaagguuuguuagaccauuaagguuauauuaaag

SEQ ID NO: 255067 - RNA, 64 nt, hsa
aagacauuuguuuguuuuuagaacacgagugacaguuuguuaaaaagcuuuagaggaggaauga

SEQ ID NO: 255068 - RNA, 64 nt, hsa
aaaauucauuuuccccuuauggauauuuaugguaguuuguuaagaacugauaaauugugccaag

SEQ ID NO: 255069 - RNA, 64 nt, hsa
uugcuaaucuuauuuuaauuagcuacagcuccuuguuuguuaguuuucauggaaaauuuuaggg

SEQ ID NO: 255070 - RNA, 64 nt, hsa
aacuuuuauuuuaaguucaaggguacaugugcagguuuguuacauagguaaacuugugucaugg

SEQ ID NO: 255071 - RNA, 64 nt, hsa
ccccaacucaggacagaacaguguuuaauguaaaguuuguuauagucuaugugauucuggaagc

SEQ ID NO: 255072 - RNA, 64 nt, hsa
gagaagcccucuuuauuuugguaaaugucacucuguuuguuaggagaugucugcuuuuccauga

SEQ ID NO: 255073 - RNA, 64 nt, hsa
ucuagaaaucagaugcccagaugauccaagacuaguuuguuaucucaucuggaaccuacaccaa

SEQ ID NO: 255074 - RNA, 64 nt, hsa
ugccauauccuggaaacauauuacgaccucccauguuuguuacaugcauccaguuuaccacacu

SEQ ID NO: 255075 - RNA, 64 nt, hsa
ucaucuguguauuuucuauagauguuuacuaggcguuuguuauauaaaaauaccccggccaggc

SEQ ID NO: 255076 - RNA, 64 nt, hsa
gaacucauagauuauuaucuauuaucucaauuuaguuuguuauuuauccuagugggccauuaaa

SEQ ID NO: 255077 - RNA, 64 nt, hsa
uuauaugucacuugugugcuaugugaauagcuauguuuguuauuuaaauauauuuauagaaguu

SEQ ID NO: 255078 - RNA, 64 nt, hsa
ugcuugucagguuuggauagaauauaauugauugguuuguuacuuggacuaacaaggcaguaga

SEQ ID NO: 255079 - RNA, 64 nt, hsa
aguuuuaaaugcaaaauagccuuauuuucauuuaguuuguuagcacuauagugagcuuuucaaa

SEQ ID NO: 255080 - RNA, 64 nt, hsa
gcauuauucauauguguaucuauaucugcauaauguuuguuaaugucuacuaaaauugcuacuu

SEQ ID NO: 255081 - RNA, 64 nt, hsa
ucccugcucagggacccuggccguguguccccagguuuguuaccugcagcggcccaucacccug

SEQ ID NO: 255082 - RNA, 64 nt, hsa
auaauauuuuugcugacuacccaguugaagaaaaguuuguuaauuggaugggauuuuuuuuuuu

SEQ ID NO: 255083 - RNA, 64 nt, hsa
gaaauuuuuuuuuuagcucuugcuuuaaguguuuguuuguuaucucaguccagaaccaauauua

SEQ ID NO: 255084 - RNA, 64 nt, hsa
ucugauggcccggcugaauaaaauggaaauucuaguuuguuagaauuaugcauucuuuuucaag

SEQ ID NO: 255085 - RNA, 64 nt, hsa
cauguauuucaaucuuagugagccaaaauuguuuguuuguuacuacagaauagagaugacuguu

SEQ ID NO: 255086 - RNA, 64 nt, hsa
ugaaagaguuuaagggcuaauaauuuaauuuguuguuuguuaaaaauuaaaaucuccguucuuu

SEQ ID NO: 255087 - RNA, 64 nt, hsa
caauuuucagacauuuugaaaggaugacaguucuguuuguuagaugaguaaaccucuauauuca

SEQ ID NO: 255088 - RNA, 64 nt, hsa
cuuguuuuguauuauucagaaauuaacuguacagguuuguuaucacaauguauaauuguguuuu

SEQ ID NO: 255089 - RNA, 64 nt, hsa
ugcuguccaaguuuuauacuaagauaucuuaccuguuuguuauuaaccaaauauuuuuaaaaau

SEQ ID NO: 255090 - RNA, 64 nt, hsa
uucccugcuuccucucuagaauccaauuagggauguuuguuacuacucauauugauuaaaacag

SEQ ID NO: 255091 - RNA, 64 nt, hsa
auuuugacaauguggaguuuuuuuuuaaaaagugguuuguuacuuugacuuauaaauacaauuu

SEQ ID NO: 255092 - RNA, 64 nt, hsa
ucugugaagacucaacggauguguguguuuguauguuuguuaacaguuacauauguuuguauga

SEQ ID NO: 255093 - RNA, 64 nt, hsa
ugguguccuauuuucuuguuuauacguucauucuguuuguuauugcuacuauguaaaacuuuca

SEQ ID NO: 255094 - RNA, 64 nt, hsa
gggacugcguccauguacuaguauaacagcuuggguuuguuagaauuugggcaacauuuugauu

SEQ ID NO: 255095 - RNA, 64 nt, hsa
gguggaucaaaaaugccacuuaacaggaaguuuaguuuguuaugcacuuuaaauggaauaauua

SEQ ID NO: 255096 - RNA, 64 nt, hsa
auuggaugaggaggggacugccauggaaaggagaguuuguuacuuacgguucugagaggagggg

SEQ ID NO: 255097 - RNA, 64 nt, hsa
cacuucuaaaugguuccugguuccuuucuuccucguuuguuacuuuagagcaaguuugcccaua

SEQ ID NO: 255098 - RNA, 64 nt, hsa
ucaugauuaguaccaaaccacuguacaaagaauuguuuguuaacaagaaaaaaaugaauaaugc

SEQ ID NO: 255099 - RNA, 64 nt, hsa
agacaaacguuuaauuugcuaaauauuuuaacaaguuuguuauauauuuuauuuaauuuaaaag

SEQ ID NO: 255100 - RNA, 64 nt, hsa
ugaauuaagaguccaguuucggaagauaauaaauguuuguuagauacaccauaauuucagauca

SEQ ID NO: 255101 - RNA, 64 nt, hsa
caauagaaaacaguaaaaaacagggcauagccuaguuuguuauaagaaaaagcauccauuuucu

SEQ ID NO: 255102 - RNA, 64 nt, hsa
uccaaaccacuaugcuuaauguuaacaugauucuguuuguuaauauuuugacagauuaaggugu

SEQ ID NO: 255103 - RNA, 64 nt, hsa
uaguuuccaugaagguguguauguuuuauacgauguuuguuauagggccaugcauugguaacuu

SEQ ID NO: 255104 - RNA, 64 nt, hsa
cuuaauacugacauacuggauuuuuaaugcacugguuuguuauuugguauucuaucucuuuuuc

SEQ ID NO: 255105 - RNA, 64 nt, hsa
cuaccauagaauuauuauccagacuggaauuuuuguuuguuagaacacccuucaguugcaauau

SEQ ID NO: 255106 - RNA, 64 nt, hsa
gggcuuguuuuuacagcuugugaacggacugcacguuuguuacaagggagaagauuauggaggc

SEQ ID NO: 255107 - RNA, 64 nt, hsa
cuuggaguaacaggcuuauuccacuuuccaugggguuuguuaauauuuugcauugacucauacu

SEQ ID NO: 255108 - RNA, 64 nt, hsa
uuucaauuagaaaccuuuacuauuuccaauguauguuuguuaaaaauaauaauaauaaaaccaa

SEQ ID NO: 255109 - RNA, 64 nt, hsa
uauauaugugacagauacaaauucucugugaucaguuuguuauuuuuuuucuccuuaaggcaca

SEQ ID NO: 255110 - RNA, 64 nt, hsa
uuggagaccuuaaugcuaaguguagauuauugagguuuguuagugaggaaaagaauaagaguuc

SEQ ID NO: 255111 - RNA, 64 nt, hsa
accccgguaaguaauuaacagagaauaaaaauguguuuguuaaaugacaaagcagcaguuuuuc

SEQ ID NO: 255112 - RNA, 64 nt, hsa
auguucauuacuaaaacaaacagcaaaacuauugguuuguuauucuguguuuuccucaagucag

SEQ ID NO: 255113 - RNA, 64 nt, hsa
aaaaauguaaaaaacaaaaaaaacaacaaaaaaaguuuguuacuuugaauaguccuaaaaagaa

SEQ ID NO: 255114 - RNA, 64 nt, hsa
cugucuuauaauugauauuuuaggauguuuggguguuuguuacaggcagaauuggauagauaca

SEQ ID NO: 255115 - RNA, 64 nt, hsa
ugguacaucguauauaaaauguauuaaaacugggguuuguuaccaguugcuguacuuuguauau

SEQ ID NO: 255116 - RNA, 64 nt, hsa
uuuucuuuagcaaaccagguuaugugguguaaagguuuguuauacgugccacaauauagcauau

SEQ ID NO: 255117 - RNA, 64 nt, hsa
ugcuccacaugggaccugugucacccaaugagauguuuguuacucugguaaaugccacacguua

SEQ ID NO: 255118 - RNA, 64 nt, hsa
uuuguaugauugaaacuugcaccgagcuuugacuguuuguuaaagagucauuuuuaaugaaaga

SEQ ID NO: 255119 - RNA, 64 nt, hsa
aacguucuagcaacuguauaaaagcguugggcauguuuguuauuucuauacucacucugucaug

SEQ ID NO: 255120 - RNA, 64 nt, hsa
gaaguuuuuucuaccauaagugacaccaauaaauguuuguuauuuacacuggucuaauguuugu

SEQ ID NO: 255121 - RNA, 64 nt, hsa
gaaaggcccagccggacugccgggcauuggggccguuuguuaagcggcacucauuuugcggagg

SEQ ID NO: 255122 - RNA, 64 nt, hsa
uaaaaaaaaaaacaaaacaaaaaaagguuacaaaguuuguuaacuugcuauccuguggucuugu

SEQ ID NO: 255123 - RNA, 64 nt, hsa
cuauccuguggucuuguugccugaaauuguuauuguuuguuauuucucucugauguuuuuugua

SEQ ID NO: 255124 - RNA, 64 nt, hsa
aguacucugcaguggacauaagcauugggccauaguuuguuaaucucaacuaacgccuacauua

SEQ ID NO: 255125 - RNA, 64 nt, hsa
uaagcauuuuugugagugaccaccuuugcaauauguuuguuaauuuacuucauguuggguucuu

SEQ ID NO: 255126 - RNA, 64 nt, hsa
cccgcaugucuuauucuugcccuucccccaaccaguuuguuaaucaaacaauaaaaacauguuu

SEQ ID NO: 255127 - RNA, 64 nt, hsa
ccuaugcaauauuuuuuacuuuucuaauaaacauguuuguuaaaacaguugguugagucucuca

SEQ ID NO: 255128 - RNA, 64 nt, hsa
ucugccucuuccacauaauguccuuugcuuucauguuuguuaucuucuuuuucuguucacucag

SEQ ID NO: 255129 - RNA, 64 nt, hsa
uaucacaaauauauaugcuuccagacaaagaaaaguuuguuaguccugauuuucuaaucguagc

SEQ ID NO: 255130 - RNA, 64 nt, hsa
cagagcugaaaguguaacuguuaauucagugaaaguuuguuagguuacaugguuacacagugag

SEQ ID NO: 255131 - RNA, 64 nt, hsa
ugcuaaauacuguaauguuucaaaacauccaacuguuuguuauaaaguggcuagaacaucaauu

SEQ ID NO: 255132 - RNA, 64 nt, hsa
uuaaugucugauugaaacacaaauuuacaugcauguuuguuacaaaaaaaaugaaaaaaaaagu

SEQ ID NO: 255133 - RNA, 64 nt, hsa
cuugcuuccuucuuaaccucuaccacuuaagagaguuuguuauaaucaaauuugacuuccuagc

SEQ ID NO: 255134 - RNA, 64 nt, hsa
ccagggccuggcauuugguaggaauacaaugaauguuuguuaaacaaauuaauccacaguuucu

SEQ ID NO: 255135 - RNA, 64 nt, hsa
ugaugcaagacaagucauccuuccuacugucaugguuuguuauagagaagcugcuucaaaucac

SEQ ID NO: 255136 - RNA, 64 nt, hsa
uggguauguuuaaucuguuauguacuaguguucuguuuguuauuguuuuguuaauuacaccaua

SEQ ID NO: 255137 - RNA, 64 nt, hsa
auauggagaauguuauggaagaaauaguuuauaaguuuguuaaguacuuauaacaugguuuauc

SEQ ID NO: 255138 - RNA, 64 nt, hsa
aaaaaauacaacugagaagggugaagagaaguauguuuguuaaacaguaaaaaugaauaguaua

SEQ ID NO: 255139 - RNA, 64 nt, hsa
gcccccuuugccuuuaaaacuuacaaaaauacguguuuguuauuugagaaagcauguuuaaaaa

SEQ ID NO: 255140 - RNA, 64 nt, hsa
aaacaauuuaugcgaaccuaugucuaaauucacuguuuguuacuauguauguuuuuuuccaaug

SEQ ID NO: 255141 - RNA, 64 nt, hsa
uguuucaaucucugacuaaaaauacuuaaauuugguuuguuaauucuuauuuuagaaauuauaa

SEQ ID NO: 255142 - RNA, 64 nt, hsa
cccuuagauacuccuguaauucuuaaugugaauaguuuguuaauauugcuguaaaguauuauau

SEQ ID NO: 255143 - RNA, 64 nt, hsa
gucuuuguggcuacuuguuuguggaugguauuguguuuguuagugaacuguggacucgcuuucc

SEQ ID NO: 255144 - RNA, 64 nt, hsa
gguggacugcagccuucaucuuuauugggaaugaguuuguuauaaaucagaaauggguccauga

SEQ ID NO: 255145 - RNA, 64 nt, hsa
guaggauuccauuugaugauucuggauuuuugcuguuuguuauugcccuuagaggggcucugag

SEQ ID NO: 255146 - RNA, 64 nt, hsa
caaauauuuauuguuucagagacuguacuauuuuguuuguuagaagauuuauaaggcaguaucu

SEQ ID NO: 255147 - RNA, 64 nt, hsa
uugggagaucuggugaucucccaagcuaucuaaaguuuguuagauagcugcauguggcuuuuuu

SEQ ID NO: 255148 - RNA, 64 nt, hsa
gaaugagcuuuuuaaggaagaaauauuauauauuguuuguuaaaguuuauugaaauaaagaauc

SEQ ID NO: 255149 - RNA, 64 nt, hsa
ucuguguuauuagugaggaaacuuuaaaacucauguuuguuauuacuuacuacccaauuucauu

SEQ ID NO: 255150 - RNA, 64 nt, hsa
guuccccuaaacuugcccuguuuuuguuuuuuuaguuuguuauccccuuacugagcggccucua

SEQ ID NO: 255151 - RNA, 64 nt, hsa
ugccaggacccacacagcuucgauggaucucaguguuuguuaacaaaauacaaagaucucaaac

SEQ ID NO: 255152 - RNA, 64 nt, hsa
uuugccauucugccguagcuagauguucugugggguuuguuaacauggaacuacucagcuuucu

SEQ ID NO: 255153 - RNA, 64 nt, hsa
uucguccccagcguccguccuguaacgugcuucuguuuguuaugguagaacagcccuguguuaa

SEQ ID NO: 255154 - RNA, 64 nt, hsa
auuuuuaggaaaauucugaagccagcuaucacagguuuguuagcuaauaauaguauuuucuuuu

SEQ ID NO: 255155 - RNA, 64 nt, hsa
gauugagcaguagcauuugccuuuuggguuuuuuguuuguuauuauagaagagaugacuucugc

SEQ ID NO: 255156 - RNA, 64 nt, hsa
auaauuuuaaagauucuuuaucugcaucauugcuguuuguuacuauaaauuaaaugaaccucau

SEQ ID NO: 255157 - RNA, 64 nt, hsa
gucaguucuaaugaaauuuuguaaaagauggcaaguuuguuaccucacuugagugggguuuucc

SEQ ID NO: 255158 - RNA, 64 nt, hsa
gcauuuuucugucagauuuguaguaauuugugagguuuguuagagauuaauauagguuuucuuu

SEQ ID NO: 255159 - RNA, 64 nt, hsa
agaguuuucucuguauucucagaagauguuaauaguuuguuacuagccagagaguaugacuaug

SEQ ID NO: 255160 - RNA, 64 nt, hsa
gcuguuagucggguuagaguuggcucuacgcgagguuuguuaauaaaaguuuguuaaaaguuug

SEQ ID NO: 255161 - RNA, 64 nt, hsa
uagaguuggcucuacgcgagguuuguuaauaaaaguuuguuaaaaguuuguuuugugcaagugu

SEQ ID NO: 255162 - RNA, 64 nt, hsa
cagcccaugguaaacacaggcuucaccuguucuuguuuguuagccuugacugugaggcaggacu

SEQ ID NO: 255163 - RNA, 64 nt, hsa
gaaggaggaggacuggcugccuccauuuugccuuguuuguuaguuugccugggucugucugagg

SEQ ID NO: 255164 - RNA, 64 nt, hsa
gcagucacaucacaauauucaguggugaaaucuuguuuguuacugucauucccauuccuuuucg

SEQ ID NO: 255165 - RNA, 64 nt, hsa
uuuaaguuucaggauacaugugccgaaugugcagguuuguuacauagguauauauaugccauga

SEQ ID NO: 255166 - RNA, 64 nt, hsa
ccccuuuuaucugauucugagacagguaaauucuguuuguuacuacguuuaauuagaaggugga

SEQ ID NO: 255167 - RNA, 64 nt, hsa
aacugcauguuuuauaaaauaaaaauaaaauaucguuuguuauuuaucucauuagagaacugcu

SEQ ID NO: 255168 - RNA, 64 nt, hsa
cagcauuucagauuuuauugucagauauuuagauguuuguuacauuuuuaaaaauugcucuuaa

SEQ ID NO: 255169 - RNA, 64 nt, hsa
uuuaaaaagacauuaagugaauucuagguagcuuguuuguuauuauuuuuaaaggacgcucuag

SEQ ID NO: 255170 - RNA, 64 nt, hsa
uuaaggaaucccuaacccuacuaucagaaaagguguuuguuaaagagccuucucuuguguguua

SEQ ID NO: 255171 - RNA, 64 nt, hsa
ucuuauucuuagcuguauauacauuuuuuuaaaaguuuguuaaaauaugcuugacuagaguuuc

SEQ ID NO: 255172 - RNA, 64 nt, hsa
acucuguuuuuuaguauaauggugcuauuuuguaguuuguuauaugaaagagucuggccaaaac

SEQ ID NO: 255173 - RNA, 64 nt, hsa
uauaaucuaacccaaacuagcauguguuucugcaguuuguuacacaccuaggaucauauugcau

SEQ ID NO: 255174 - RNA, 64 nt, hsa
cgcuguuuuuaucuccaauaaaaaaaaaaaaaagguuuguuaauuaauguggccucugucaguu

SEQ ID NO: 255175 - RNA, 64 nt, hsa
gggggagaugugaauaugaccugguuuagagaggguuuguuaagguuuauacuauuuuuggauu

SEQ ID NO: 255176 - RNA, 64 nt, hsa
guauuguuacuguacguguaucuggggcuucuccguuuguuaauacuuuuucuguauuuguugc

SEQ ID NO: 255177 - RNA, 64 nt, hsa
gaacaguacgacaguguauuguaaauucccuuuaguuuguuacaguagccaauugaaaauguau

SEQ ID NO: 255178 - RNA, 64 nt, hsa
ccaggaaacacauuucuguggccuuagccaagcaguuuguuaguuacauauucccucgcaaacc

SEQ ID NO: 255179 - RNA, 64 nt, hsa
caccacaggaauguaucacaacuuaaccguucccguuuguuagacuaguuucuuauuaauguug

SEQ ID NO: 255180 - RNA, 64 nt, hsa
uggcaagccucccauugccuuucugcaucaauguguuuguuaccaaauagcagaaauuucgcuu

SEQ ID NO: 255181 - RNA, 64 nt, hsa
acuuauuuguaguuguuaguugcccugcuaccuaguuuguuagugcauuugagcacacauuuua

SEQ ID NO: 255182 - RNA, 64 nt, hsa
agacaauuuucauaacuugauaaauuauaguuuuguuuguuagaaaaguugcucuuaaaagaug

SEQ ID NO: 255183 - RNA, 64 nt, hsa
gucuaaaagagcucgcuggcaagcugccucuugaguuuguuauaaaagcgaacuguucacaaaa

SEQ ID NO: 255184 - RNA, 64 nt, hsa
aguuuuuuguaguuguuaccgcucuuuuggguugguuuguuaauuuauacaaagagauuaccac

SEQ ID NO: 255185 - RNA, 64 nt, hsa
ucugagccauggugucgagugaagaguaguucuuguuuguuacaaccuuugugagucagccaug

SEQ ID NO: 255186 - RNA, 64 nt, hsa
auugaacugcacuuuauauaaccaaagcuuagcaguuuguuagauaagagucuauguaugucuc

SEQ ID NO: 255187 - RNA, 64 nt, hsa
gaaaaguaaaauggacuacuuuuguaacuuaccuguuuguuaggaaauggaauggucucuuuga

SEQ ID NO: 255188 - RNA, 64 nt, hsa
uuuuuaguuaauauaccaaagcuuaugaauaauuguuuguuaauugaacauuuucaauuauaug

SEQ ID NO: 255189 - RNA, 64 nt, hsa
uacagcuaaaagggacuaaauuuguaaaaaauuaguuuguuauaguugaagauuaacuuuuccu

SEQ ID NO: 255190 - RNA, 64 nt, hsa
aaagggauaaaucucuaauuauugcuguuuaacuguuuguuaucauaguuggucaaugccuggc

SEQ ID NO: 255191 - RNA, 64 nt, hsa
cagccauugcucugcuccuggcauagagucaccuguuuguuauguggauuaaauaguuuuaaaa

SEQ ID NO: 255192 - RNA, 64 nt, hsa
gaaagaacacuucuaagccuaagugugugauacaguuuguuacuuuuaaguacauuuuaauaau

SEQ ID NO: 255193 - RNA, 64 nt, hsa
gauggauuaucugggguaauuuucuucaaagggaguuuguuauacacagugaaaauguauuaua

SEQ ID NO: 255194 - RNA, 64 nt, hsa
guacaagauacucuuuggaucucucguagagaugguuuguuaccauccuuuaaucauaacuaaa

SEQ ID NO: 255195 - RNA, 64 nt, hsa
aggugacugaaauugcaucagugaucauaaugagguuuguuaaaacgauagcuauauucaaaau

SEQ ID NO: 255196 - RNA, 64 nt, hsa
gauugcuucacugguuuaauaauuuaaaaguuauguuuguuaaacacccugucagaacagucau

SEQ ID NO: 255197 - RNA, 64 nt, hsa
uuuuaauggaaucuuuguuuuuguucuccaucuuguuuguuagagucucucggccuuuauuuac

SEQ ID NO: 255198 - RNA, 64 nt, hsa
aauucaacuuuuaagauacagaagaaauuuguauguuuguuaaaguugcauuuauugcagcaag

SEQ ID NO: 255199 - RNA, 64 nt, hsa
ugcaguaauaaaccauuuguuuuacugcuguuaaguuuguuauuuggguauaaaaccagauguu

SEQ ID NO: 255200 - RNA, 64 nt, hsa
uuaacagcugcuggacagacacauuagagcagcuguuuguuauugauaauaaaauauuauaaaa

SEQ ID NO: 255201 - RNA, 64 nt, hsa
uucuuuuucaugggcgggucggggucaguauccuguuuguuauuguuaaauuuguaugaaccuu

SEQ ID NO: 255202 - RNA, 64 nt, hsa
cucgaugugauacaguauaaauaugcuaugguuuguuuguuaugaacagauagccaccaguuac

SEQ ID NO: 255203 - RNA, 64 nt, hsa
uagagaaacauuuuugcaugaguucuuacaaacuguuuguuauauuuucuggaaugauaaguga

SEQ ID NO: 255204 - RNA, 64 nt, hsa
cagccggcgaugcccaauaaauguguguuuugcuguuuguuaagugauuucagcaacaagugug

SEQ ID NO: 255205 - RNA, 64 nt, hsa
ugugugugugaaaaagcuggguucaaauaaguugguuuguuagacauucauaugccuacccauc

SEQ ID NO: 255206 - RNA, 64 nt, hsa
uccacggccauaacaauauuuaacuuuaaaagcuguuuguuauaugcugcuuaauaaaguaagc

SEQ ID NO: 255207 - RNA, 64 nt, hsa
gauguuuuccacuugauugcugcagauaucaagaguuuguuauuuucaaauacccauccaacaa

SEQ ID NO: 255208 - RNA, 64 nt, hsa
uuguuaacugaacucuuaauuauguuuuuaaaauguuuguuauauuucuuuucuuuuuucuuuu

SEQ ID NO: 255209 - RNA, 64 nt, hsa
gcaaagggugucugcgucgucaccaaaucguagcguuuguuaccagagguugugcacuguuuac

SEQ ID NO: 255210 - RNA, 64 nt, hsa
uuuaauuaauuuuuuucauaauugagacagaacuguuuguuauguaccauaaugcuaaauaaaa

SEQ ID NO: 255211 - RNA, 64 nt, hsa
caaguauuauaccuuuuuuagaguugauacuacaguuuguuaguaugaggcauuuguuugaacu

SEQ ID NO: 255212 - RNA, 64 nt, hsa
uagcaucaucauauugugcuguuuuggauaacacguuuguuacaagcauuuaaacuguuucauu

SEQ ID NO: 255213 - RNA, 64 nt, hsa
uugcugccguccaucaagagcccucaacacaagaguuuguuauaaauagaaauaaacgacaaaa

SEQ ID NO: 255214 - RNA, 64 nt, hsa
cauugccacuaguuccaucuagaacuccuuucuaguuuguuauuuuuaaaauguuuauacauaa

SEQ ID NO: 255215 - RNA, 64 nt, hsa
aggccugugggaaugggauuuguuacaaaucuagguuuguuacuggcuucagaaagcuaauuaa

SEQ ID NO: 255216 - RNA, 64 nt, hsa
gaucaaaguauuauaugcugugugcuuuuuagguguuuguuaguacugugaaggcaaaaaugcu

SEQ ID NO: 255217 - RNA, 64 nt, hsa
uuggacugugaagcaucugccauggggaagugcuguuuguuauccuuucucuguggcagugaag

SEQ ID NO: 255218 - RNA, 64 nt, hsa
aacguggcgucugauaacagugagggggggugggguuuguuaugucuuuauugaguauuuaagu

SEQ ID NO: 255219 - RNA, 64 nt, hsa
cagaaaauaacagaauagccuucuguaaugaggcguuuguuagaguuuugcaugagauucuaau

SEQ ID NO: 255220 - RNA, 64 nt, hsa
aacuugugaaaacaagguuguuuuugucuuuaucguuuguuagaguuauagauuuaugauuuca

SEQ ID NO: 255221 - RNA, 64 nt, hsa
ucuagggacagaggcaucuggaugcaaacgcgggguuuguuaggggcggaaucccgaggguggu

SEQ ID NO: 255222 - RNA, 64 nt, hsa
aauucuuuuccuuucauuuugcuuucugaaagcaguuuguuauacuauucauaacauuguagag

SEQ ID NO: 255223 - RNA, 64 nt, hsa
gcauugcuguauacacacagacacacacauguauguuuguuaccaagaacuggucagaccuugc

SEQ ID NO: 255224 - RNA, 64 nt, hsa
uacaggcaugagccacuguaccuggcgaaaaacaguuuguuaacacaggcagccaacaucacuc

SEQ ID NO: 255225 - RNA, 64 nt, hsa
gcugguuuaaaagggauccaguuuccagcugcagguuuguuagagucuguucuacaugggccug

SEQ ID NO: 255226 - RNA, 64 nt, hsa
ccccccuccucaauguaguggccuuggauauccuguuuguuaauaaagacaauucaaccagcuc

SEQ ID NO: 255227 - RNA, 64 nt, hsa
ucugugagucuggcucaagaccgacauugccuugguuuguuacaugacuaucgugauggggaaa

SEQ ID NO: 255228 - RNA, 64 nt, hsa
augggcuuucuguuuaugaggggugagaagugauguuuguuacuauguucuccagcaaguaaac

SEQ ID NO: 255229 - RNA, 64 nt, hsa
gucuaauaacaaaaaauguaaaccuaauuuggcaguuuguuagguuagacaacugacagccuca

SEQ ID NO: 255230 - RNA, 64 nt, hsa
gcuuaaauuaguaugugccccuaaaauauucuauguuuguuaugagauucaaauaaaaaaauuu

SEQ ID NO: 255231 - RNA, 64 nt, hsa
gcacaucccuguaaggcccauaagagaaagaggaguuuguuacauuuaaucaacacugugaagu

SEQ ID NO: 255232 - RNA, 64 nt, hsa
uagcauagugcuuugcacauaguagucacucaguguuuguuaaauaaagcuauuagugucauua

SEQ ID NO: 255233 - RNA, 64 nt, hsa
guucagcagcaaacuugcaacagacuggccuucuguuuguuacuuucaaaaggcccacaugaua

SEQ ID NO: 255234 - RNA, 64 nt, hsa
uuguuucucuacuaagaacucuuucuuaaaugugguuuguuacuguagcacuuuuuacacugaa

SEQ ID NO: 255235 - RNA, 64 nt, hsa
agguagcacaaucuacuaauguuguuugaucuguguuuguuauacugguuguaauuaauuuuuu

SEQ ID NO: 255236 - RNA, 64 nt, hsa
gacaagguuguagcugugcucaggcuucagcuugguuuguuaaauugagagauaaacaaugaca

SEQ ID NO: 255237 - RNA, 64 nt, hsa
cuguugcugcucuguauuugccucucgugauucuguuuguuacccauguucacuucccccagga

SEQ ID NO: 255238 - RNA, 64 nt, hsa
uugccucagcugaucagaguuucuguggaauucuguuuguuaaaucaaauuagcuggucucuga

SEQ ID NO: 255239 - RNA, 64 nt, hsa
gaaggcaacacauuccuacacuuuuaauguauauguuuguuauaauguccauguaaacaugccc

SEQ ID NO: 255240 - RNA, 64 nt, hsa
agguagcucaaucuacuaauguuguuugaucuguguuuguuauacugguuguaauuaauuuuuu

SEQ ID NO: 255241 - RNA, 64 nt, hsa
cuguguccuccagguuuauaugggaaucgaaacaguuuguuaaucugauugggagaguuccaug

SEQ ID NO: 255242 - RNA, 64 nt, hsa
uuguuucuaugugcaaaaaaaaaaaaaaaaaaaaguuuguuaaaaggcuacacgagcucucuag

SEQ ID NO: 255243 - RNA, 64 nt, hsa
gguuuccuaaacuauaaaagcagauuuugcuuuuguuuguuaaucauaggcauggccgagcauu

SEQ ID NO: 255244 - RNA, 64 nt, hsa
uuuuauuuuaucucaaguauguccaguguguucgguuuguuacauauuccaugaaauaucugag

SEQ ID NO: 255245 - RNA, 64 nt, hsa
uagcagauuagcaccauaacuaacuuaaaacuaaguuuguuaccugcuuuuuauacugucacaa

SEQ ID NO: 255246 - RNA, 64 nt, hsa
cuuaaaauuaccagacaaaaaaauuuaaaauuacguuuguuauuccuaguggaugacuguugau

SEQ ID NO: 255247 - RNA, 64 nt, hsa
aauaggacaaaaaaguugugguuuggggaggucuguuuguuacauaaaaaggaccuuucggugu

SEQ ID NO: 255248 - RNA, 64 nt, hsa
uaagauuaugaaaccacaugagaagugauaaaauguuuguuaaagcuagauagagguuaagaau

SEQ ID NO: 255249 - RNA, 64 nt, hsa
cuggaaaugcagaauggcguuagauuuauauuugguuuguuaauuuuauaucacuguuuuucac

SEQ ID NO: 255250 - RNA, 64 nt, hsa
acuguaaauggcugucuaaaauaaagacauucauguuuguuaaaaacugguaaauuuugcaacu

SEQ ID NO: 255251 - RNA, 64 nt, hsa
uauaacuuccauguucucuagaaaucaagguuuuguuuguuaauucucuuuuauaugcauguau

SEQ ID NO: 255252 - RNA, 64 nt, hsa
uuacgaucguuauucccccaauucaucauauuuuguuuguuaucaccagagaugccugaacuca

SEQ ID NO: 255253 - RNA, 64 nt, hsa
guuuuuguuuuuguauuuuuuuucuuuugaaaggguuuguuaauuuuucuaauuuuaccaaagu

SEQ ID NO: 255254 - RNA, 64 nt, hsa
auuuagccguguuugggacuccgugucuucaaugguuuguuaguugccauuacaacuuugucug

SEQ ID NO: 255255 - RNA, 64 nt, hsa
agugcugggauuacaggcccgguccaguuugauaguuuguuaucauguuauacguacacuuaga

SEQ ID NO: 255256 - RNA, 64 nt, hsa
uuuagcagagaauuuguaauuuaagaaauuuucuguuuguuacggaacaugugggaaucccuuu

SEQ ID NO: 255257 - RNA, 64 nt, hsa
uuucaacucuugcaccuggaguucugcugguuaaguuuguuaaacuuaguugaaacugggaacc

SEQ ID NO: 255258 - RNA, 64 nt, hsa
gaaauaaagagcuaucaugcugugguuuauuaugguuuguuacauugauaggauacauacugaa

SEQ ID NO: 255259 - RNA, 64 nt, hsa
uagcccgcucguaucuaugguuucgcuuuccacaguuuguuaccugcagucaacugcaguucaa

SEQ ID NO: 255260 - RNA, 64 nt, hsa
ucccuuccuccagauccgucugguuuuuuacaccguuuguuaauaaagccugaaaccgcugugu

SEQ ID NO: 255261 - RNA, 64 nt, hsa
auaauguacguacuaccuaaaaggaugucuaaauguuuguuaauaaaaauaagaaauagcuaca

SEQ ID NO: 255262 - RNA, 64 nt, hsa
uauuaauauguuaggauuuauccucagucagccaguuuguuaugucuuuucuauucuacuguua

SEQ ID NO: 255263 - RNA, 64 nt, hsa
ugcuguuauucuauucugcaaauaaacugaauguguuuguuaguuccaguugcauuuuggcuga

SEQ ID NO: 255264 - RNA, 64 nt, hsa
auaagaaguuuaaucaaaguaaccagaaucccauguuuguuacuaggauuuacauuaacugcug

SEQ ID NO: 255265 - RNA, 64 nt, hsa
uauuuacgauuucguuuguuuggauucaagcuuaguuuguuaauauguauaauuuagcaucuau

SEQ ID NO: 255266 - RNA, 64 nt, hsa
ccauuuuaagaaaacccgacaacauuucugccagguuuguuaggaggccacaugauacuuauuc

SEQ ID NO: 255267 - RNA, 64 nt, hsa
aggcugacucuuacuaaccaccauuuccccugugguuuguuaucaguacaauucuuuguugcuu

SEQ ID NO: 255268 - RNA, 64 nt, hsa
uaauacauuauugacucuaugaauguuuucugaaguuuguuagucauuuguaaaacuaaaucag

SEQ ID NO: 255269 - RNA, 64 nt, hsa
aggcuuugggugaauucuggauggcuugccucauguuuguuagccagcacuucugcucugucgu

SEQ ID NO: 255270 - RNA, 64 nt, hsa
acucaugguaccuuggccaaguuggaaggaagcaguuuguuaaugaggcacaguaauccuggcu

SEQ ID NO: 255271 - RNA, 64 nt, hsa
gaauauuuacaauaaagaguauuuacaauaaagaguuuguuauuauuuguaaauugugugcaac

SEQ ID NO: 255272 - RNA, 64 nt, hsa
acagacugggaaccccuccuggccugggggaagaguuuguuaccuaccuuacuauuuaaagagc

SEQ ID NO: 255273 - RNA, 64 nt, hsa
gggaggggaccgggaagcgcuggggcuuguuucuguuuguuacuuacaggacugagacaucuuc

SEQ ID NO: 255274 - RNA, 64 nt, hsa
uuaacagcugccugaauugucauuuuccauuuugguuuguuagaggugggagggguggguuuug

SEQ ID NO: 255275 - RNA, 64 nt, hsa
gaggacucuucaguggcugagcagcuuuggacuuguuuguuauccuauuuugcauguguuugag

SEQ ID NO: 255276 - RNA, 64 nt, hsa
cccuccuugcccagacuacagggcuuaggacuugguuuguuauuucagggaaaaggaguaggga

SEQ ID NO: 255277 - RNA, 64 nt, hsa
uuauugugacuuguaaguuucuuaucccauaaagguuuguuacuucccucacuucaccuccaua

SEQ ID NO: 255278 - RNA, 64 nt, hsa
uuuacguuccgggauacaugugcaggaccugcagguuuguuacauagguaagccugugccaugg

SEQ ID NO: 255279 - RNA, 64 nt, hsa
auuauugaaaaauuaaaaaaugucauuguuuccuguuuguuaauauuaggguuguaaggugucg

SEQ ID NO: 255280 - RNA, 64 nt, hsa
auucuccugcauuuuuacauaaacuaaaugugagguuuguuacugguauuuuuuucacgugccu

SEQ ID NO: 255281 - RNA, 64 nt, hsa
ccagugccaccuuauggcaaagagcucccgcaguguuuguuagagugcacaucccuacgugccc

SEQ ID NO: 255282 - RNA, 64 nt, hsa
guccagcaguguuagcagggguggcaguccuuguguuuguuauaccaauaaaugcuuuagcugc

SEQ ID NO: 255283 - RNA, 64 nt, hsa
guauaccucaacccaaaaauaaagguuuguuuugguuuguuauggcuuccuuuuuuaaaaaauu

SEQ ID NO: 255284 - RNA, 64 nt, hsa
ucaauuuuguacaauuagguaucugacuuuacaaguuuguuauccuuucuaauuuuuacugaac

SEQ ID NO: 255285 - RNA, 64 nt, hsa
aguuuucagauaaaccagaaaagcuuauacaagaguuuguuacguugacuauguucuucaaauu

SEQ ID NO: 255286 - RNA, 64 nt, hsa
uacuaaaugccacugaauuuguauacuucagaauguuuguuauguaaauuuuaccucaacuaaa

SEQ ID NO: 255287 - RNA, 63 nt, hsa
cauggaucuccguguacacuaucaauaaaaguggguuuguuacaaagccguguccuugcccau

SEQ ID NO: 255288 - RNA, 64 nt, hsa
ugcugggccucccugacuguaaaaucucuguacuguuuguuagguuuuuggugggaggcuguga

SEQ ID NO: 255289 - RNA, 64 nt, hsa
cucuggaagcuggcaguguguaaagcacuggcaaguuuguuacuguuaaaaugucaaauaccaa

SEQ ID NO: 255290 - RNA, 64 nt, hsa
uugauugaaauggcaggauucuaaagagagccugguuuguuaaaagaaaacacugucaugcugu

SEQ ID NO: 255291 - RNA, 64 nt, hsa
acugcauuuauaauuuugugacugaggaucauuuguuuguuaauguacugugccuuuaacuuua

SEQ ID NO: 255292 - RNA, 64 nt, hsa
cugaaguaagauuuugccuguaugguacuguuuuguuuguuaauaaagugcacugccaccccca

SEQ ID NO: 255293 - RNA, 64 nt, hsa
auccuuguuccuguuacaauauuuagcauuauuaguuuguuauguguguauguuuauguuaauu

SEQ ID NO: 255294 - RNA, 64 nt, hsa
ugugucuacgauucaaagugaaaacauuuggcauguuuguuaauucuagcuuuuugguuuaaua

SEQ ID NO: 255295 - RNA, 64 nt, hsa
agucucccuuucacuguuuucuuauucuguaauuguuuguuauauuucccaaaaacgucuugau

SEQ ID NO: 255296 - RNA, 64 nt, hsa
gguagaguauugagaccuuuuuuauuagggugcuguuuguuauugagagcccaaucucugcaug

SEQ ID NO: 255297 - RNA, 64 nt, hsa
cuuauuuguuuccugauagguuauguuuguaauuguuuguuaagcacagccuguuucuuggaag

SEQ ID NO: 255298 - RNA, 64 nt, hsa
guauaaauuaguauaucucuucuauuauuagucuguuuguuaaaugccagaccacguuucuaug

SEQ ID NO: 255299 - RNA, 64 nt, hsa
caccuacauuaacauuaugucuuugcagcuuuagguuuguuagauguguucuuaagcauaauuu

SEQ ID NO: 255300 - RNA, 64 nt, hsa
uuuuucauuggguuuuuauuguuguuuaguuuugguuuguuacgccagcccagucugucugcgg

SEQ ID NO: 255301 - RNA, 64 nt, hsa
ugggagggccucauguuuuaucugguucuuaaauguuuguuacuacagaaaauaaaacugcgcu

SEQ ID NO: 255302 - RNA, 64 nt, hsa
gagagagagcuauguuucuaaccaagggccuaauguuuguuacagaaaugaucccagagaccua

SEQ ID NO: 255303 - RNA, 64 nt, hsa
acugcauuuauaauuuugugacugaggaucguuuguuuguuaacguacugugacuuuaacuuua

SEQ ID NO: 255304 - RNA, 64 nt, hsa
aguagccuuaaaaaggcuuuuguuuauuucuuugguuuguuaacuagugucaucuauuuagaga

SEQ ID NO: 255305 - RNA, 65 nt, hsa
uggcgggucagcuggugguucuuagguuuccuucuguuuguuaaaagggacaauguggccacuuc

SEQ ID NO: 255306 - RNA, 65 nt, hsa
augguugauaauagucaguaaccuaauaaaggaacguuuguuaaaauaucaaaccauuuuugaau

SEQ ID NO: 255307 - RNA, 65 nt, hsa
cuuuccucuccuccuucccaagucauuugaaaaguguuuguuauuuaaauuccaauaaugcccaa

SEQ ID NO: 255308 - RNA, 65 nt, hsa
aacguuucugaacagggucugugcuauguguaaagguuuguuaacuguaaaguaauauaaaguua

SEQ ID NO: 255309 - RNA, 58 nt, hsa; identical to SEQ ID NO: 254543

SEQ ID NO: 255310 - RNA, 65 nt, hsa
gaaacugaugggcaccugauacucugucuaaauacguuuguuauauguguuuugcccugugccau

SEQ ID NO: 255311 - RNA, 65 nt, hsa
uccccaccacccuuuuuuuucauuuccccuguuuuguuuguuaguuuggcguuagggguggaggu

SEQ ID NO: 255312 - RNA, 65 nt, hsa
aguuuucaaaagugcccauuuuaugcugcugugugguuuguuaaaucuaaaugauuuuuaaacuu

SEQ ID NO: 255313 - RNA, 65 nt, hsa
agaaauauuucuccuuuuguuuuucuuuuuuuuuuguuuguuacugccacuucuuuuuaggagca

SEQ ID NO: 255314 - RNA, 65 nt, hsa
cauagaucucuuucucucuuuuguuuuguuuguuuguuuguuaaaguucauuauuuauuuuaccu

SEQ ID NO: 255315 - RNA, 64 nt, hsa; identical to SEQ ID NO: 254932

SEQ ID NO: 255316 - RNA, 65 nt, hsa
cacaugcauggucaugacacccagaauucaugaugguuuguuauaacaaccucugcauauuccag

SEQ ID NO: 255317 - RNA, 65 nt, hsa
uuuaaaaaaggcauuugaaugaauguuugacucagguuuguuaaauuaaccuucaguaacugcag

SEQ ID NO: 255318 - RNA, 65 nt, hsa
augucauaauuguugacguucuucaguauaaucauguuuguuaaauuguuuguaccuugcaaacu

SEQ ID NO: 255319 - RNA, 65 nt, hsa
uguguuacuauugagauucucucaauugcuccuguguuuguuauaaaguaguguuuaaaaggcag

SEQ ID NO: 255320 - RNA, 65 nt, hsa
uuugggucauuauuacuuuuauuuugcagcauuugguuuguuauuaguguaagagcaaguauagg

SEQ ID NO: 255321 - RNA, 65 nt, hsa
uuccuuuuaggcuugaauaugaugcugaacaguaaguuuguuaaaucuuggaacuuaaaacaauc

SEQ ID NO: 255322 - RNA, 65 nt, hsa
aauugcagcaccucuaucucgcagguaauggaguaguuuguuauugguagucuacuccaggccag

SEQ ID NO: 255323 - RNA, 65 nt, hsa
cugcagcuuauucuugccaugcuuaggugacagaaguuuguuaaguaccauccuugugcccugcc

SEQ ID NO: 255324 - RNA, 65 nt, hsa
gcguuuaaauuguuaaaaugcugauuuucuuauuaguuuguuaauugccuguuacuaguacuuga

SEQ ID NO: 255325 - RNA, 65 nt, hsa
ggaucauggaguacugcucucauaauugaagacguguuuguuauuggcagagaaccuuaaaaaag

SEQ ID NO: 255326 - RNA, 65 nt, hsa
gacgccuuccucucuggauacugcaaaggcuugugguuuguuagaggguauuuguggaaacuguc

SEQ ID NO: 255327 - RNA, 65 nt, hsa
gguacuaguucagacacuuuggaaguuuguguucuguuuguuaaaacuggcaucugacacaaaaa

SEQ ID NO: 255328 - RNA, 65 nt, hsa
cauuauaauuuauaaauacagcauacuucaaaacuguuuguuaucucuuguuaccauguauguau

SEQ ID NO: 255329 - RNA, 65 nt, hsa
uucuucauuuugagaaaacuguacauuaguuuaauguuuguuacuguauuucuuuugaguugagg

SEQ ID NO: 255330 - RNA, 65 nt, hsa
aggaaaucaguugagcugaauuuaaguuguuuuuuguuuguuagcagguguggaugugggguuau

SEQ ID NO: 255331 - RNA, 65 nt, hsa
ccagauuguguuaccauuugaauacacugacuaauguuuguuaaacuuuuucuguggcaccuugg

SEQ ID NO: 255332 - RNA, 65 nt, hsa
ugaaagauuuguaaaugguaaagcacuauauucuuguuuguuaguccuuuuuccuuucuuugggu

SEQ ID NO: 255333 - RNA, 65 nt, hsa
ccacuuguaucauggccuacccgaggagaagaggaguuuguuaacugggccuauguaguagccuc

SEQ ID NO: 255334 - RNA, 65 nt, hsa
aguugguuuauguuaaugauagacaaauacccaguguuuguuacuuuuuccaacuaccacuguaa

SEQ ID NO: 255335 - RNA, 65 nt, hsa
uguaaauaaagccugugagucaagcaucaagugguguuuguuagaaauaaacuagagauuuuuaa

SEQ ID NO: 255336 - RNA, 65 nt, hsa
cugaaagugcugauggcuggauccaaucugguacaguuuguuaaaagcagcgugggauauaauca

SEQ ID NO: 255337 - RNA, 65 nt, hsa
uaacuuuuauuuuagauucagggguauaugugcagguuuguuacauagguaaacugcaugucaug

SEQ ID NO: 255338 - RNA, 65 nt, hsa
ugguaaauguuuuuagaucuucugguaagcauuauguuuguuaauacauauuuauuagagugaug

SEQ ID NO: 255339 - RNA, 65 nt, hsa
gacuuaaauaugaaagcaaauugaacacaucggguguuuguuaucagaaaagagaugagaugaga

SEQ ID NO: 255340 - RNA, 65 nt, hsa
cuuaggaagauucaaaaucuugguuauuacaugaaguuuguuauauuucuugucaacaguauuga

SEQ ID NO: 255341 - RNA, 65 nt, hsa
uaucgaaauacaguuauuaaaauguuaaaagauaaguuuguuauauauuaauaugcaugcuucuu

SEQ ID NO: 255342 - RNA, 65 nt, hsa
ccuggaaaaugaguaaugucucauucuuaccugcaguuuguuacuauguauaaaagucuuuuucu

SEQ ID NO: 255343 - RNA, 65 nt, hsa
uaugaaaaaaauguaucuuugggaaaacaauuacaguuuguuaauuugaagaugcuggucuugac

SEQ ID NO: 255344 - RNA, 65 nt, hsa
guucccaaaucuggcuggucgggaauaccugggaaguuuguuaaaauuuuuuaaaaauguuuuaa

SEQ ID NO: 255345 - RNA, 65 nt, hsa
guucagcucugguccacagaggauggauaaaaaugguuuguuauguuuuuuugcucugcagugcu

SEQ ID NO: 255346 - RNA, 65 nt, hsa
aaauggaugcagaauaaugcagauagugaucccauguuuguuaauugccaucauggaagucagag

SEQ ID NO: 255347 - RNA, 65 nt, hsa
cccguaauuuuaggacuccuauaaaauucuuccuuguuuguuaaugcuauuaaaacucagauuca

SEQ ID NO: 255348 - RNA, 65 nt, hsa
caacucuguuuuauccuagaacuaagagagcauugguuuguuaaagagcuuucaauguauauuaa

SEQ ID NO: 255349 - RNA, 65 nt, hsa
ugugcgugggacgaagacaucuuugaaggucaugaguuuguuaguuuaacaucauauauuuguaa

SEQ ID NO: 255350 - RNA, 65 nt, hsa
uccgucucaaaaguaaauaaaaauaaucaccuggaguuuguuaaaccauauggauucucaagcuc

SEQ ID NO: 255351 - RNA, 65 nt, hsa
ucucaucccuggagcacucugccgcucaagagcugguuuguuaauuauuguuagacuuugccauu

SEQ ID NO: 255352 - RNA, 65 nt, hsa
acaucuugaaguaaauugaucccaccaggucccacguuuguuaucucugccuaaauguuagcuuc

SEQ ID NO: 255353 - RNA, 65 nt, hsa
cucaccuacccucaaaguagguauacaaaagacuaguuuguuauuaauccacaaauaugcuaaau

SEQ ID NO: 255354 - RNA, 65 nt, hsa
uacuuuaaaauuuaacccacaagcauauuaaaucuguuuguuauaagauuggaaacaauuuuuga

SEQ ID NO: 255355 - RNA, 65 nt, hsa
cagugaggcaucacuuuguuugcauaaaguauacgguuuguuaaggccuuuguucuugugagaug

SEQ ID NO: 255356 - RNA, 65 nt, hsa
uuuaauucauguuuguugggacugagguuuaggaaguuuguuacugguuaaaaaccucaaaugaa

SEQ ID NO: 255357 - RNA, 65 nt, hsa
ugauaagugccuuuuuggagauguaacuuuuagcaguuuguuaaccugacaucucugccagucua

SEQ ID NO: 255358 - RNA, 65 nt, hsa
uacccuaaugucuucauaaaguacuugaguguaauguuuguuaccuccaacagaacuaaauguuc

SEQ ID NO: 255359 - RNA, 65 nt, hsa
uccagagagugucuucgaggguaucaucauuuccgguuuguuaaucuuauucaccaaauguucua

SEQ ID NO: 255360 - RNA, 65 nt, hsa
cccaauuuugacuuggccaggggacaccuugguguguuuguuaucuuuaucuguggguaggcuag

SEQ ID NO: 255361 - RNA, 65 nt, hsa
cugaggaacaaauagaccauuuccauacuaaaccaguuuguuaacuuuagauuuuuuccaauagu

SEQ ID NO: 255362 - RNA, 65 nt, hsa
uaccuuauauucagguauaugugauauuuugccugguuuguuaaaauugccccauuuagauuccu

SEQ ID NO: 255363 - RNA, 65 nt, hsa
uaccaccaccacccucaucacucagaaacccuacuguuuguuagacaggugguugaggggacaug

SEQ ID NO: 255364 - RNA, 65 nt, hsa
gugcuuuccuauggaaaaaauacauauauaguuuaguuuguuagacgugaguuauccaaguauuu

SEQ ID NO: 255365 - RNA, 65 nt, hsa
cauacuguaugcaguacugcaagcuaauaacguugguuuguuauguagugugcuuuuugucccuu

SEQ ID NO: 255366 - RNA, 65 nt, hsa
uggaaaacuggguaguucaucugaccaugggauguguuuguuaugaagaaaaucuggaugccugu

SEQ ID NO: 255367 - RNA, 65 nt, hsa
gaacauggaauauuugguuuccuguuccuauguuaguuuguuaaggauaauggccuccagcccca

SEQ ID NO: 255368 - RNA, 65 nt, hsa
ggggguacaugugcagguaaacucgugacaaggggguuuguuauacagauuauuuagugacccag

SEQ ID NO: 255369 - RNA, 65 nt, hsa
aaccuguuuuuuuuucauuuauuguuuauguaaauguuuguuaaaaauaaaucccauggaauauu

SEQ ID NO: 255370 - RNA, 65 nt, hsa
cuuuaaguuuuaggguacaugugcacaaugugcagguuuguuacauauguauacaugugccauau

SEQ ID NO: 255371 - RNA, 65 nt, hsa
agaagaaaauucugucucaaaaauuaaagaauuuuguuuguuauuguuguucugaccauauugaa

SEQ ID NO: 255372 - RNA, 65 nt, hsa
cauuagcgcugcuucguuuuguauagggcuuuucuguuuguuacaagccaaacacugccugucuu

SEQ ID NO: 255373 - RNA, 65 nt, hsa
auucuguuucuugagaagagaauauuagcuuuacuguuuguuauggcuuaaugacacuagcuaau

SEQ ID NO: 255374 - RNA, 65 nt, hsa
gaauguauuacuuuguucucccaugaaagaauucaguuuguuaguaccuauauuuuuaaacuggu

SEQ ID NO: 255375 - RNA, 65 nt, hsa
aaaaauagaagaaaugaacaaaaacuuaaaucacaguuuguuauuaaguaauaucugaaaugaau

SEQ ID NO: 255376 - RNA, 65 nt, hsa
acacauucuggaaacauaacacucuacauuacaaaguuuguuaccugcugaaaucaauguaacuc

SEQ ID NO: 255377 - RNA, 65 nt, hsa
auguaacaauguuaaauuaauuauaaugggauuggguuuguuaucugugguaguauauauccuag

SEQ ID NO: 255378 - RNA, 65 nt, hsa
gaacuagaaugugugacucuguggggacugcauagguuuguuaauugaccuauagcuaaaccuua

SEQ ID NO: 255379 - RNA, 65 nt, hsa
ugcugaagcaucuguccagcugguauccugugaaaguuuguuauuuucugaguagacauucuuau

SEQ ID NO: 255380 - RNA, 65 nt, hsa
guuuuuuauauucuuaaauuugcucacaaauugugguuuguuacaauuaaacuggauacuuauuu

SEQ ID NO: 255381 - RNA, 65 nt, hsa
aguuaagcucuuuccuauuguguuuauacaguuuuguuuguuauacucuuugcaccuuaaacccc

SEQ ID NO: 255382 - RNA, 65 nt, hsa
guguagagcccccuccugugcccucaguggcugucguuuguuaacaucaucaggaagaugggaaa

SEQ ID NO: 255383 - RNA, 65 nt, hsa
uggggggaaaucacaagucacugagguguuuguuuguuuguuaggcagugcuagagcuugaagcc

SEQ ID NO: 255384 - RNA, 65 nt, hsa
uguaggcaaacuaucaauuuuuuguccauuuuccuguuuguuaaaauaacauaccucuccuacgu

SEQ ID NO: 255385 - RNA, 65 nt, hsa
uaaacuuacauuuuguuuccaauuuuucauuuuuuguuuguuauuuguuuuuuguagacagcacu

SEQ ID NO: 255386 - RNA, 65 nt, hsa
aguucauucuuaagcuugcuuuuuuugagacugguguuuguuagacagccacaguccugucuggg

SEQ ID NO: 255387 - RNA, 65 nt, hsa
agcaaggaggaggguugagcaaucuagagcauggaguuuguuaagugcucucuggauuugaguug

SEQ ID NO: 255388 - RNA, 65 nt, hsa
cucaucuaagaugaaacucauaaaaauuauuuaauguuuguuaugaauuuaaaagcuccagaaau

SEQ ID NO: 255389 - RNA, 65 nt, hsa
ugguuuuuaaauauucaauauuggucuguguuuaaguuuguuauuugaauguaauuuacauagag

SEQ ID NO: 255390 - RNA, 65 nt, hsa
ggacucugggaagucugaccaaguuggagcagaugguuuguuacuugaaucuccaaacacuuagu

SEQ ID NO: 255391 - RNA, 65 nt, hsa
cuccaugaugguuguugcccgagguuaauguaguuguuuguuagaccugugucuuacacauuucu

SEQ ID NO: 255392 - RNA, 65 nt, hsa
cuaugagaacacugcaucugcauucauagccacgaguuuguuauugcuacaggcuacugagcguc

SEQ ID NO: 255393 - RNA, 65 nt, hsa
caaucacgggcauuuuaucuucucugaacacugcaguuuguuagacuagagcugagguuggagga

SEQ ID NO: 255394 - RNA, 65 nt, hsa
ugccccuuauuuaaaaaaaaaaaagaaaaaaaagaguuuguuacucuauuguauguuacaaaaga

SEQ ID NO: 255395 - RNA, 65 nt, hsa
aaagcaaaaacccacggccaaaauaaauugguacuguuuguuacaaaguucugucuugucauggg

SEQ ID NO: 255396 - RNA, 65 nt, hsa
cuucuggagaaggcccugaaaucacauugauauauguuuguuaguaaaaugugcacaccugacuu

SEQ ID NO: 255397 - RNA, 65 nt, hsa
aguguuaauuucaaauaugcaaauuugguacugcaguuuguuaugcaauauuauaucaccaaccc

SEQ ID NO: 255398 - RNA, 65 nt, hsa
gucuaaguuguaauuuugauuuuuguggaaccauuguuuguuaauguugggauucucugcacuuu

SEQ ID NO: 255399 - RNA, 65 nt, hsa
uuuccuucugaaaauauuuacauuuugcuaaccuaguuuguuacuuuaaaaaucaguuuugauga

SEQ ID NO: 255400 - RNA, 65 nt, hsa
aaucguguccuugcugucuuuuuauuuuccuuuuuguuuguuagcaaaaaccucuauuuagauuu

SEQ ID NO: 255401 - RNA, 65 nt, hsa
aaagcuuaaaaguaauguaugcuuugcugaccacuguuuguuaggccuuaaacaacauucacugu

SEQ ID NO: 255402 - RNA, 65 nt, hsa
gagaaagauguuuggcaugccaaauuaacuugcauguuuguuaaaaaaacaaacacauguuuuga

SEQ ID NO: 255403 - RNA, 65 nt, hsa
aaguucauagacgagauuuguucaacacugcaauuguuuguuagauguaaacccugugacuauag

SEQ ID NO: 255404 - RNA, 65 nt, hsa
ucuuccaaauguucuuccuggggucuuugauauuuguuuguuacauccugcugaaguucgacugu

SEQ ID NO: 255405 - RNA, 65 nt, hsa
gggcuuauugaaugucuaaaaaauaaguuuaaaguguuuguuacccuaaguuuuuuacauuuuua

SEQ ID NO: 255406 - RNA, 65 nt, hsa
auaauguuuaagaaauuuaccuuaaaucuuguucuguuuguuaguaugaaaaguuaacuuuuuuu

SEQ ID NO: 255407 - RNA, 65 nt, hsa
uuuuggaacuguucuagagcauaccaugaaaagcaguuuguuauuaugcaggaaaaucaguuuca

SEQ ID NO: 255408 - RNA, 65 nt, hsa
aacuuuuuucugccacugcucccuagcccuguuuaguuuguuauugcugcuuuucuuuuuucuuu

SEQ ID NO: 255409 - RNA, 65 nt, hsa
auacuuuuucaugaaaauggaguuaucaguuaucuguuuguuacugcaucaucuguuuguaauca

SEQ ID NO: 255410 - RNA, 65 nt, hsa
ucacucacuuacgacaucacuuccauugugugcauguuuguuauagaggagguuuuaggcuacaa

SEQ ID NO: 255411 - RNA, 65 nt, hsa
cagucagaauaguuauucucuaagaggaaacuaguguuuguuaaaaacaaaaauaaaaacaaaac

SEQ ID NO: 255412 - RNA, 65 nt, hsa
uugaaaauacauaccacauuuguuauaaagcauuuguuuguuaguaucaaucacauagguagaaa

SEQ ID NO: 255413 - RNA, 65 nt, hsa
auuaugcuuugaaaaauaauuauggggaaauacauguuuguuauuaaauuuauuauuaaagauag

SEQ ID NO: 255414 - RNA, 65 nt, hsa
auauuucaggcuuguauuuaauauaauaaauagguguuuguuauugugucgaucuguuauuuuua

SEQ ID NO: 255415 - RNA, 65 nt, hsa
ccuggcuuuuuuugguuugggguagaccuaaggguguuuguuagucucaaaacugugaagugaca

SEQ ID NO: 255416 - RNA, 65 nt, hsa
caucuguaauauauugccaguauauaagcuguuuaguuuguuaauugauuaaacuguaugucuua

SEQ ID NO: 255417 - RNA, 65 nt, hsa
uauuacaguguuuguuuagcuaugguuacuaauauguuuguuauauuuauuuucggggagaggau

SEQ ID NO: 255418 - RNA, 65 nt, hsa
aucaagugacuguccccguaaaaaguagaagauaaguuuguuaaaguauuuuuuauaaacagcuu

SEQ ID NO: 255419 - RNA, 65 nt, hsa
cagaaauguuuuuucuuuuccuuguggccaaaccaguuuguuaaucugauuauauucaucugcua

SEQ ID NO: 255420 - RNA, 65 nt, hsa
uaucaaaguaguguucuaacuuuaauguauuguauguuuguuauuauauuaaagugugauuauua

SEQ ID NO: 255421 - RNA, 65 nt, hsa
accuaguacgacuucauuccuuccacuaacucauaguuuguuauauccuagacuagacaugcgaa

SEQ ID NO: 255422 - RNA, 65 nt, hsa
uucagccuuagaaaagcccucaauguaaaccuuauguuuguuacuaggguggccucucucccauu

SEQ ID NO: 255423 - RNA, 65 nt, hsa
agaguuaauaugcuuuucugaugaauuacacaacaguuuguuaauucuucauucuuguaguauuu

SEQ ID NO: 255424 - RNA, 65 nt, hsa
uccucagccucaccuuacgaauccaaagaacugggguuuguuagguucuuucucuaauguagagg

SEQ ID NO: 255425 - RNA, 65 nt, hsa
augguuagaacucuuacagccuuauuuauuuuuaaguuuguuacagccaaaggguuggagugugc

SEQ ID NO: 255426 - RNA, 65 nt, hsa
guaacauuuuugccaaaagaugacugggguuuuccguuuguuaauauuaagcacaucagaacgug

SEQ ID NO: 255427 - RNA, 65 nt, hsa
ugagacgaaugccauuggaaccuguuaaaugaguaguuuguuaugugucuggaagaagcagcguu

SEQ ID NO: 255428 - RNA, 65 nt, hsa
gggaggggcggggggagggagggauuucuuaucccguuuguuacauuuugaggauaauaaaggug

SEQ ID NO: 255429 - RNA, 65 nt, hsa
gucuuaguuacugauuucauuuucaauaaauguagguuuguuacaugaguuucccaauaaaaaaa

SEQ ID NO: 255430 - RNA, 65 nt, hsa
aaauagauauauaagaaaaaauucuuucacuugauguuuguuagaccagaaaguguguguguucu

SEQ ID NO: 255431 - RNA, 65 nt, hsa
uucuuucuguuuuguuuuuuucuccugcaaauuuaguuuguuaaagccuguuccauaggaaggcu

SEQ ID NO: 255432 - RNA, 65 nt, hsa
ugaaugauuuuuaggguaaauaauacagaugccuuguuuguuaacuaacuuguggaaagcaggaa

SEQ ID NO: 255433 - RNA, 65 nt, hsa
auccauaacauccauaugacugaacacuuguauguguuuguuaaauauucgaaugcauguagauu

SEQ ID NO: 255434 - RNA, 65 nt, hsa
uaagugacuuuaaacuuucccuuggcuguuaagaaguuuguuauagauuuagcuauuuauuguuc

SEQ ID NO: 255435 - RNA, 65 nt, hsa
cagagugcuucaguaaaaagcuacuauauauuguuguuuguuauuguguagguaauauuuucaau

SEQ ID NO: 255436 - RNA, 65 nt, hsa
uauuucaaaucaguuuuuuuuccucaaaaacuuguguuuguuauuagaaaugauuuuuuagauau

SEQ ID NO: 255437 - RNA, 65 nt, hsa
cugguccuccccaccaccccacccccaagacuuguguuuguuaauagaaauaauuuuuuuaggua

SEQ ID NO: 255438 - RNA, 65 nt, hsa
uuggucaacuucaacucaaaacacuguuuucuuauguuuguuacaaacuuaauuuuuugaaagua

SEQ ID NO: 255439 - RNA, 65 nt, hsa
cugugucuacuauuaaaagugaaacauuuuggcauguuuguuaauucuaguuucauuuaauaacc

SEQ ID NO: 255440 - RNA, 65 nt, hsa
uugccagggggcaggucugggccugggccaaccacguuuguuaucauggcugcugccuucuggac

SEQ ID NO: 255441 - RNA, 65 nt, hsa
aauuaguuuuagcuguagaucaagcuauuugggguguuuguuaguaaauagggaaaauaaucuca

SEQ ID NO: 255442 - RNA, 65 nt, hsa
ccucccccuuccccugguccccugucccuggggcuguuuguuaaaaaagaguaauaaaaggauuu

SEQ ID NO: 255443 - RNA, 65 nt, hsa
uggggcuuguuccccugcaguaucuguucugugaaguuuguuaaauguaaggaaagcuuaaauuc

SEQ ID NO: 255444 - RNA, 65 nt, hsa
aaggguugcaguuugguuaggaguggaaauauuuuguuuguuaaugaugucuucaguucugguac

SEQ ID NO: 255445 - RNA, 65 nt, hsa
ugccauuuuuucucagacaccuggccguaaaaucaguuuguuacagcauucuucucuaggcugcu

SEQ ID NO: 255446 - RNA, 65 nt, hsa
auacacuggguaaaucaccuauacuuagaguaacaguuuguuaucaaaaugccugauaaaauaua

SEQ ID NO: 255447 - RNA, 65 nt, hsa
ggucaucaguaucauuagugaaaaagaaacaaauuguuuguuaucaucucuuuagacagauaagc

SEQ ID NO: 255448 - RNA, 65 nt, hsa
uaaaauuguaauaccuagguaguugguugaucacaguuuguuaauuguauaaaaaaaaauuaccu

SEQ ID NO: 255449 - RNA, 65 nt, hsa
gucaacuuuauuuuguauuuccuuccauuuggaagguuuguuagaccauuaagguuauauuaaag

SEQ ID NO: 255450 - RNA, 65 nt, hsa
aaagacauuuguuuguuuuuagaacacgagugacaguuuguuaaaaagcuuuagaggaggaauga

SEQ ID NO: 255451 - RNA, 65 nt, hsa
uaaaauucauuuuccccuuauggauauuuaugguaguuuguuaagaacugauaaauugugccaag

SEQ ID NO: 255452 - RNA, 65 nt, hsa
uuugcuaaucuuauuuuaauuagcuacagcuccuuguuuguuaguuuucauggaaaauuuuaggg

SEQ ID NO: 255453 - RNA, 65 nt, hsa
uaacuuuuauuuuaaguucaaggguacaugugcagguuuguuacauagguaaacuugugucaugg

SEQ ID NO: 255454 - RNA, 65 nt, hsa
cccccaacucaggacagaacaguguuuaauguaaaguuuguuauagucuaugugauucuggaagc

SEQ ID NO: 255455 - RNA, 65 nt, hsa
ugagaagcccucuuuauuuugguaaaugucacucuguuuguuaggagaugucugcuuuuccauga

SEQ ID NO: 255456 - RNA, 65 nt, hsa
uucuagaaaucagaugcccagaugauccaagacuaguuuguuaucucaucuggaaccuacaccaa

SEQ ID NO: 255457 - RNA, 65 nt, hsa
augccauauccuggaaacauauuacgaccucccauguuuguuacaugcauccaguuuaccacacu

SEQ ID NO: 255458 - RNA, 65 nt, hsa
cucaucuguguauuuucuauagauguuuacuaggcguuuguuauauaaaaauaccccggccaggc

SEQ ID NO: 255459 - RNA, 65 nt, hsa
ugaacucauagauuauuaucuauuaucucaauuuaguuuguuauuuauccuagugggccauuaaa

SEQ ID NO: 255460 - RNA, 65 nt, hsa
uuuauaugucacuugugugcuaugugaauagcuauguuuguuauuuaaauauauuuauagaaguu

SEQ ID NO: 255461 - RNA, 65 nt, hsa
uugcuugucagguuuggauagaauauaauugauugguuuguuacuuggacuaacaaggcaguaga

SEQ ID NO: 255462 - RNA, 65 nt, hsa
caguuuuaaaugcaaaauagccuuauuuucauuuaguuuguuagcacuauagugagcuuuucaaa

SEQ ID NO: 255463 - RNA, 65 nt, hsa
ugcauuauucauauguguaucuauaucugcauaauguuuguuaaugucuacuaaaauugcuacuu

SEQ ID NO: 255464 - RNA, 65 nt, hsa
cucccugcucagggacccuggccguguguccccagguuuguuaccugcagcggcccaucacccug

SEQ ID NO: 255465 - RNA, 65 nt, hsa
uauaauauuuuugcugacuacccaguugaagaaaaguuuguuaauuggaugggauuuuuuuuuuu

SEQ ID NO: 255466 - RNA, 65 nt, hsa
ggaaauuuuuuuuuuagcucuugcuuuaaguguuuguuuguuaucucaguccagaaccaauauua

SEQ ID NO: 255467 - RNA, 65 nt, hsa
uucugauggcccggcugaauaaaauggaaauucuaguuuguuagaauuaugcauucuuuuucaag

SEQ ID NO: 255468 - RNA, 65 nt, hsa
ccauguauuucaaucuuagugagccaaaauuguuuguuuguuacuacagaauagagaugacuguu

SEQ ID NO: 255469 - RNA, 65 nt, hsa
uugaaagaguuuaagggcuaauaauuuaauuuguuguuuguuaaaaauuaaaaucuccguucuuu

SEQ ID NO: 255470 - RNA, 65 nt, hsa
ucaauuuucagacauuuugaaaggaugacaguucuguuuguuagaugaguaaaccucuauauuca

SEQ ID NO: 255471 - RNA, 65 nt, hsa
acuuguuuuguauuauucagaaauuaacuguacagguuuguuaucacaauguauaauuguguuuu

SEQ ID NO: 255472 - RNA, 65 nt, hsa
augcuguccaaguuuuauacuaagauaucuuaccuguuuguuauuaaccaaauauuuuuaaaaau

SEQ ID NO: 255473 - RNA, 65 nt, hsa
cuucccugcuuccucucuagaauccaauuagggauguuuguuacuacucauauugauuaaaacag

SEQ ID NO: 255474 - RNA, 65 nt, hsa
aauuuugacaauguggaguuuuuuuuuaaaaagugguuuguuacuuugacuuauaaauacaauuu

SEQ ID NO: 255475 - RNA, 65 nt, hsa
uucugugaagacucaacggauguguguguuuguauguuuguuaacaguuacauauguuuguauga

SEQ ID NO: 255476 - RNA, 65 nt, hsa
augguguccuauuuucuuguuuauacguucauucuguuuguuauugcuacuauguaaaacuuuca

SEQ ID NO: 255477 - RNA, 65 nt, hsa
agggacugcguccauguacuaguauaacagcuuggguuuguuagaauuugggcaacauuuugauu

SEQ ID NO: 255478 - RNA, 65 nt, hsa
ugguggaucaaaaaugccacuuaacaggaaguuuaguuuguuaugcacuuuaaauggaauaauua

SEQ ID NO: 255479 - RNA, 65 nt, hsa
cauuggaugaggaggggacugccauggaaaggagaguuuguuacuuacgguucugagaggagggg

SEQ ID NO: 255480 - RNA, 65 nt, hsa
ccacuucuaaaugguuccugguuccuuucuuccucguuuguuacuuuagagcaaguuugcccaua

SEQ ID NO: 255481 - RNA, 65 nt, hsa
uucaugauuaguaccaaaccacuguacaaagaauuguuuguuaacaagaaaaaaaugaauaaugc

SEQ ID NO: 255482 - RNA, 65 nt, hsa
aagacaaacguuuaauuugcuaaauauuuuaacaaguuuguuauauauuuuauuuaauuuaaaag

SEQ ID NO: 255483 - RNA, 65 nt, hsa
augaauuaagaguccaguuucggaagauaauaaauguuuguuagauacaccauaauuucagauca

SEQ ID NO: 255484 - RNA, 65 nt, hsa
gcaauagaaaacaguaaaaaacagggcauagccuaguuuguuauaagaaaaagcauccauuuucu

SEQ ID NO: 255485 - RNA, 65 nt, hsa
uuccaaaccacuaugcuuaauguuaacaugauucuguuuguuaauauuuugacagauuaaggugu

SEQ ID NO: 255486 - RNA, 65 nt, hsa
auaguuuccaugaagguguguauguuuuauacgauguuuguuauagggccaugcauugguaacuu

SEQ ID NO: 255487 - RNA, 65 nt, hsa
ucuuaauacugacauacuggauuuuuaaugcacugguuuguuauuugguauucuaucucuuuuuc

SEQ ID NO: 255488 - RNA, 65 nt, hsa
ucuaccauagaauuauuauccagacuggaauuuuuguuuguuagaacacccuucaguugcaauau

SEQ ID NO: 255489 - RNA, 65 nt, hsa
ugggcuuguuuuuacagcuugugaacggacugcacguuuguuacaagggagaagauuauggaggc

SEQ ID NO: 255490 - RNA, 65 nt, hsa
acuuggaguaacaggcuuauuccacuuuccaugggguuuguuaauauuuugcauugacucauacu

SEQ ID NO: 255491 - RNA, 65 nt, hsa
uuuucaauuagaaaccuuuacuauuuccaauguauguuuguuaaaaauaauaauaauaaaaccaa

SEQ ID NO: 255492 - RNA, 65 nt, hsa
uuauauaugugacagauacaaauucucugugaucaguuuguuauuuuuuuucuccuuaaggcaca

SEQ ID NO: 255493 - RNA, 65 nt, hsa
auuggagaccuuaaugcuaaguguagauuauugagguuuguuagugaggaaaagaauaagaguuc

SEQ ID NO: 255494 - RNA, 65 nt, hsa
aaccccgguaaguaauuaacagagaauaaaaauguguuuguuaaaugacaaagcagcaguuuuuc

SEQ ID NO: 255495 - RNA, 65 nt, hsa
cauguucauuacuaaaacaaacagcaaaacuauugguuuguuauucuguguuuuccucaagucag

SEQ ID NO: 255496 - RNA, 65 nt, hsa
caaaaauguaaaaaacaaaaaaaacaacaaaaaaaguuuguuacuuugaauaguccuaaaaagaa

SEQ ID NO: 255497 - RNA, 65 nt, hsa
ucugucuuauaauugauauuuuaggauguuuggguguuuguuacaggcagaauuggauagauaca

SEQ ID NO: 255498 - RNA, 65 nt, hsa
cugguacaucguauauaaaauguauuaaaacugggguuuguuaccaguugcuguacuuuguauau

SEQ ID NO: 255499 - RNA, 65 nt, hsa
uuuuucuuuagcaaaccagguuaugugguguaaagguuuguuauacgugccacaauauagcauau

SEQ ID NO: 255500 - RNA, 65 nt, hsa
augcuccacaugggaccugugucacccaaugagauguuuguuacucugguaaaugccacacguua

SEQ ID NO: 255501 - RNA, 65 nt, hsa
uuuuguaugauugaaacuugcaccgagcuuugacuguuuguuaaagagucauuuuuaaugaaaga

SEQ ID NO: 255502 - RNA, 65 nt, hsa
aaacguucuagcaacuguauaaaagcguugggcauguuuguuauuucuauacucacucugucaug

SEQ ID NO: 255503 - RNA, 65 nt, hsa
ggaaguuuuuucuaccauaagugacaccaauaaauguuuguuauuuacacuggucuaauguuugu

SEQ ID NO: 255504 - RNA, 65 nt, hsa
ugaaaggcccagccggacugccgggcauuggggccguuuguuaagcggcacucauuuugcggagg

SEQ ID NO: 255505 - RNA, 65 nt, hsa
uuaaaaaaaaaaacaaaacaaaaaaagguuacaaaguuuguuaacuugcuauccuguggucuugu

SEQ ID NO: 255506 - RNA, 65 nt, hsa
gcuauccuguggucuuguugccugaaauuguuauuguuuguuauuucucucugauguuuuuugua

SEQ ID NO: 255507 - RNA, 65 nt, hsa
aaguacucugcaguggacauaagcauugggccauaguuuguuaaucucaacuaacgccuacauua

SEQ ID NO: 255508 - RNA, 65 nt, hsa
auaagcauuuuugugagugaccaccuuugcaauauguuuguuaauuuacuucauguuggguucuu

SEQ ID NO: 255509 - RNA, 65 nt, hsa
ccccgcaugucuuauucuugcccuucccccaaccaguuuguuaaucaaacaauaaaaacauguuu

SEQ ID NO: 255510 - RNA, 65 nt, hsa
accuaugcaauauuuuuuacuuuucuaauaaacauguuuguuaaaacaguugguugagucucuca

SEQ ID NO: 255511 - RNA, 65 nt, hsa
gucugccucuuccacauaauguccuuugcuuucauguuuguuaucuucuuuuucuguucacucag

SEQ ID NO: 255512 - RNA, 65 nt, hsa
auaucacaaauauauaugcuuccagacaaagaaaaguuuguuaguccugauuuucuaaucguagc

SEQ ID NO: 255513 - RNA, 65 nt, hsa
ucagagcugaaaguguaacuguuaauucagugaaaguuuguuagguuacaugguuacacagugag

SEQ ID NO: 255514 - RNA, 65 nt, hsa
cugcuaaauacuguaauguuucaaaacauccaacuguuuguuauaaaguggcuagaacaucaauu

SEQ ID NO: 255515 - RNA, 65 nt, hsa
uuuaaugucugauugaaacacaaauuuacaugcauguuuguuacaaaaaaaaugaaaaaaaaagu

SEQ ID NO: 255516 - RNA, 65 nt, hsa
ucuugcuuccuucuuaaccucuaccacuuaagagaguuuguuauaaucaaauuugacuuccuagc

SEQ ID NO: 255517 - RNA, 65 nt, hsa
cccagggccuggcauuugguaggaauacaaugaauguuuguuaaacaaauuaauccacaguuucu

SEQ ID NO: 255518 - RNA, 65 nt, hsa
uugaugcaagacaagucauccuuccuacugucaugguuuguuauagagaagcugcuucaaaucac

SEQ ID NO: 255519 - RNA, 65 nt, hsa
uuggguauguuuaaucuguuauguacuaguguucuguuuguuauuguuuuguuaauuacaccaua

SEQ ID NO: 255520 - RNA, 65 nt, hsa
aauauggagaauguuauggaagaaauaguuuauaaguuuguuaaguacuuauaacaugguuuauc

SEQ ID NO: 255521 - RNA, 65 nt, hsa
aaaaaaauacaacugagaagggugaagagaaguauguuuguuaaacaguaaaaaugaauaguaua

SEQ ID NO: 255522 - RNA, 65 nt, hsa
ugcccccuuugccuuuaaaacuuacaaaaauacguguuuguuauuugagaaagcauguuuaaaaa

SEQ ID NO: 255523 - RNA, 65 nt, hsa
aaaacaauuuaugcgaaccuaugucuaaauucacuguuuguuacuauguauguuuuuuuccaaug

SEQ ID NO: 255524 - RNA, 65 nt, hsa
uuguuucaaucucugacuaaaaauacuuaaauuugguuuguuaauucuuauuuuagaaauuauaa

SEQ ID NO: 255525 - RNA, 65 nt, hsa
ucccuuagauacuccuguaauucuuaaugugaauaguuuguuaauauugcuguaaaguauuauau

SEQ ID NO: 255526 - RNA, 65 nt, hsa
ggucuuuguggcuacuuguuuguggaugguauuguguuuguuagugaacuguggacucgcuuucc

SEQ ID NO: 255527 - RNA, 65 nt, hsa
ugguggacugcagccuucaucuuuauugggaaugaguuuguuauaaaucagaaauggguccauga

SEQ ID NO: 255528 - RNA, 65 nt, hsa
uguaggauuccauuugaugauucuggauuuuugcuguuuguuauugcccuuagaggggcucugag

SEQ ID NO: 255529 - RNA, 65 nt, hsa
acaaauauuuauuguuucagagacuguacuauuuuguuuguuagaagauuuauaaggcaguaucu

SEQ ID NO: 255530 - RNA, 65 nt, hsa
uuugggagaucuggugaucucccaagcuaucuaaaguuuguuagauagcugcauguggcuuuuuu

SEQ ID NO: 255531 - RNA, 65 nt, hsa
ugaaugagcuuuuuaaggaagaaauauuauauauuguuuguuaaaguuuauugaaauaaagaauc

SEQ ID NO: 255532 - RNA, 65 nt, hsa
uucuguguuauuagugaggaaacuuuaaaacucauguuuguuauuacuuacuacccaauuucauu

SEQ ID NO: 255533 - RNA, 65 nt, hsa
gguuccccuaaacuugcccuguuuuuguuuuuuuaguuuguuauccccuuacugagcggccucua

SEQ ID NO: 255534 - RNA, 65 nt, hsa
cugccaggacccacacagcuucgauggaucucaguguuuguuaacaaaauacaaagaucucaaac

SEQ ID NO: 255535 - RNA, 65 nt, hsa
uuuugccauucugccguagcuagauguucugugggguuuguuaacauggaacuacucagcuuucu

SEQ ID NO: 255536 - RNA, 65 nt, hsa
guucguccccagcguccguccuguaacgugcuucuguuuguuaugguagaacagcccuguguuaa

SEQ ID NO: 255537 - RNA, 65 nt, hsa
uauuuuuaggaaaauucugaagccagcuaucacagguuuguuagcuaauaauaguauuuucuuuu

SEQ ID NO: 255538 - RNA, 65 nt, hsa
ugauugagcaguagcauuugccuuuuggguuuuuuguuuguuauuauagaagagaugacuucugc

SEQ ID NO: 255539 - RNA, 65 nt, hsa
aauaauuuuaaagauucuuuaucugcaucauugcuguuuguuacuauaaauuaaaugaaccucau

SEQ ID NO: 255540 - RNA, 65 nt, hsa
ugucaguucuaaugaaauuuuguaaaagauggcaaguuuguuaccucacuugagugggguuuucc

SEQ ID NO: 255541 - RNA, 65 nt, hsa
ggcauuuuucugucagauuuguaguaauuugugagguuuguuagagauuaauauagguuuucuuu

SEQ ID NO: 255542 - RNA, 65 nt, hsa
cagaguuuucucuguauucucagaagauguuaauaguuuguuacuagccagagaguaugacuaug

SEQ ID NO: 255543 - RNA, 65 nt, hsa
ugcuguuagucggguuagaguuggcucuacgcgagguuuguuaauaaaaguuuguuaaaaguuug

SEQ ID NO: 255544 - RNA, 65 nt, hsa
uuagaguuggcucuacgcgagguuuguuaauaaaaguuuguuaaaaguuuguuuugugcaagugu

SEQ ID NO: 255545 - RNA, 65 nt, hsa
ccagcccaugguaaacacaggcuucaccuguucuuguuuguuagccuugacugugaggcaggacu

SEQ ID NO: 255546 - RNA, 65 nt, hsa
ugaaggaggaggacuggcugccuccauuuugccuuguuuguuaguuugccugggucugucugagg

SEQ ID NO: 255547 - RNA, 65 nt, hsa
ugcagucacaucacaauauucaguggugaaaucuuguuuguuacugucauucccauuccuuuucg

SEQ ID NO: 255548 - RNA, 65 nt, hsa
cuuuaaguuucaggauacaugugccgaaugugcagguuuguuacauagguauauauaugccauga

SEQ ID NO: 255549 - RNA, 65 nt, hsa
uccccuuuuaucugauucugagacagguaaauucuguuuguuacuacguuuaauuagaaggugga

SEQ ID NO: 255550 - RNA, 65 nt, hsa
aaacugcauguuuuauaaaauaaaaauaaaauaucguuuguuauuuaucucauuagagaacugcu

SEQ ID NO: 255551 - RNA, 65 nt, hsa
acagcauuucagauuuuauugucagauauuuagauguuuguuacauuuuuaaaaauugcucuuaa

SEQ ID NO: 255552 - RNA, 65 nt, hsa
guuuaaaaagacauuaagugaauucuagguagcuuguuuguuauuauuuuuaaaggacgcucuag

SEQ ID NO: 255553 - RNA, 65 nt, hsa
uuuaaggaaucccuaacccuacuaucagaaaagguguuuguuaaagagccuucucuuguguguua

SEQ ID NO: 255554 - RNA, 65 nt, hsa
cucuuauucuuagcuguauauacauuuuuuuaaaaguuuguuaaaauaugcuugacuagaguuuc

SEQ ID NO: 255555 - RNA, 65 nt, hsa
aacucuguuuuuuaguauaauggugcuauuuuguaguuuguuauaugaaagagucuggccaaaac

SEQ ID NO: 255556 - RNA, 65 nt, hsa
uuauaaucuaacccaaacuagcauguguuucugcaguuuguuacacaccuaggaucauauugcau

SEQ ID NO: 255557 - RNA, 65 nt, hsa
ucgcuguuuuuaucuccaauaaaaaaaaaaaaaagguuuguuaauuaauguggccucugucaguu

SEQ ID NO: 255558 - RNA, 65 nt, hsa
ggggggagaugugaauaugaccugguuuagagaggguuuguuaagguuuauacuauuuuuggauu

SEQ ID NO: 255559 - RNA, 65 nt, hsa
uguauuguuacuguacguguaucuggggcuucuccguuuguuaauacuuuuucuguauuuguugc

SEQ ID NO: 255560 - RNA, 65 nt, hsa
ugaacaguacgacaguguauuguaaauucccuuuaguuuguuacaguagccaauugaaaauguau

SEQ ID NO: 255561 - RNA, 65 nt, hsa
accaggaaacacauuucuguggccuuagccaagcaguuuguuaguuacauauucccucgcaaacc

SEQ ID NO: 255562 - RNA, 65 nt, hsa
ccaccacaggaauguaucacaacuuaaccguucccguuuguuagacuaguuucuuauuaauguug

SEQ ID NO: 255563 - RNA, 65 nt, hsa
uuggcaagccucccauugccuuucugcaucaauguguuuguuaccaaauagcagaaauuucgcuu

SEQ ID NO: 255564 - RNA, 65 nt, hsa
gacuuauuuguaguuguuaguugcccugcuaccuaguuuguuagugcauuugagcacacauuuua

SEQ ID NO: 255565 - RNA, 65 nt, hsa
aagacaauuuucauaacuugauaaauuauaguuuuguuuguuagaaaaguugcucuuaaaagaug

SEQ ID NO: 255566 - RNA, 65 nt, hsa
ugucuaaaagagcucgcuggcaagcugccucuugaguuuguuauaaaagcgaacuguucacaaaa

SEQ ID NO: 255567 - RNA, 65 nt, hsa
aaguuuuuuguaguuguuaccgcucuuuuggguugguuuguuaauuuauacaaagagauuaccac

SEQ ID NO: 255568 - RNA, 65 nt, hsa
cucugagccauggugucgagugaagaguaguucuuguuuguuacaaccuuugugagucagccaug

SEQ ID NO: 255569 - RNA, 65 nt, hsa
cauugaacugcacuuuauauaaccaaagcuuagcaguuuguuagauaagagucuauguaugucuc

SEQ ID NO: 255570 - RNA, 65 nt, hsa
ugaaaaguaaaauggacuacuuuuguaacuuaccuguuuguuaggaaauggaauggucucuuuga

SEQ ID NO: 255571 - RNA, 65 nt, hsa
cuuuuuaguuaauauaccaaagcuuaugaauaauuguuuguuaauugaacauuuucaauuauaug

SEQ ID NO: 255572 - RNA, 65 nt, hsa
auacagcuaaaagggacuaaauuuguaaaaaauuaguuuguuauaguugaagauuaacuuuuccu

SEQ ID NO: 255573 - RNA, 65 nt, hsa
uaaagggauaaaucucuaauuauugcuguuuaacuguuuguuaucauaguuggucaaugccuggc

SEQ ID NO: 255574 - RNA, 65 nt, hsa
ucagccauugcucugcuccuggcauagagucaccuguuuguuauguggauuaaauaguuuuaaaa

SEQ ID NO: 255575 - RNA, 65 nt, hsa
ugaaagaacacuucuaagccuaagugugugauacaguuuguuacuuuuaaguacauuuuaauaau

SEQ ID NO: 255576 - RNA, 65 nt, hsa
agauggauuaucugggguaauuuucuucaaagggaguuuguuauacacagugaaaauguauuaua

SEQ ID NO: 255577 - RNA, 65 nt, hsa
uguacaagauacucuuuggaucucucguagagaugguuuguuaccauccuuuaaucauaacuaaa

SEQ ID NO: 255578 - RNA, 65 nt, hsa
uaggugacugaaauugcaucagugaucauaaugagguuuguuaaaacgauagcuauauucaaaau

SEQ ID NO: 255579 - RNA, 65 nt, hsa
ggauugcuucacugguuuaauaauuuaaaaguuauguuuguuaaacacccugucagaacagucau

SEQ ID NO: 255580 - RNA, 65 nt, hsa
uuuuuaauggaaucuuuguuuuuguucuccaucuuguuuguuagagucucucggccuuuauuuac

SEQ ID NO: 255581 - RNA, 65 nt, hsa
uaauucaacuuuuaagauacagaagaaauuuguauguuuguuaaaguugcauuuauugcagcaag

SEQ ID NO: 255582 - RNA, 65 nt, hsa
augcaguaauaaaccauuuguuuuacugcuguuaaguuuguuauuuggguauaaaaccagauguu

SEQ ID NO: 255583 - RNA, 65 nt, hsa
uuuaacagcugcuggacagacacauuagagcagcuguuuguuauugauaauaaaauauuauaaaa

SEQ ID NO: 255584 - RNA, 65 nt, hsa
guucuuuuucaugggcgggucggggucaguauccuguuuguuauuguuaaauuuguaugaaccuu

SEQ ID NO: 255585 - RNA, 65 nt, hsa
acucgaugugauacaguauaaauaugcuaugguuuguuuguuaugaacagauagccaccaguuac

SEQ ID NO: 255586 - RNA, 65 nt, hsa
uuagagaaacauuuuugcaugaguucuuacaaacuguuuguuauauuuucuggaaugauaaguga

SEQ ID NO: 255587 - RNA, 65 nt, hsa
gcagccggcgaugcccaauaaauguguguuuugcuguuuguuaagugauuucagcaacaagugug

SEQ ID NO: 255588 - RNA, 65 nt, hsa
uugugugugugaaaaagcuggguucaaauaaguugguuuguuagacauucauaugccuacccauc

SEQ ID NO: 255589 - RNA, 65 nt, hsa
cuccacggccauaacaauauuuaacuuuaaaagcuguuuguuauaugcugcuuaauaaaguaagc

SEQ ID NO: 255590 - RNA, 65 nt, hsa
ugauguuuuccacuugauugcugcagauaucaagaguuuguuauuuucaaauacccauccaacaa

SEQ ID NO: 255591 - RNA, 65 nt, hsa
uuuguuaacugaacucuuaauuauguuuuuaaaauguuuguuauauuucuuuucuuuuuucuuuu

SEQ ID NO: 255592 - RNA, 65 nt, hsa
agcaaagggugucugcgucgucaccaaaucguagcguuuguuaccagagguugugcacuguuuac

SEQ ID NO: 255593 - RNA, 65 nt, hsa
uuuuaauuaauuuuuuucauaauugagacagaacuguuuguuauguaccauaaugcuaaauaaaa

SEQ ID NO: 255594 - RNA, 65 nt, hsa
ucaaguauuauaccuuuuuuagaguugauacuacaguuuguuaguaugaggcauuuguuugaacu

SEQ ID NO: 255595 - RNA, 65 nt, hsa
uuagcaucaucauauugugcuguuuuggauaacacguuuguuacaagcauuuaaacuguuucauu

SEQ ID NO: 255596 - RNA, 65 nt, hsa
cuugcugccguccaucaagagcccucaacacaagaguuuguuauaaauagaaauaaacgacaaaa

SEQ ID NO: 255597 - RNA, 65 nt, hsa
ucauugccacuaguuccaucuagaacuccuuucuaguuuguuauuuuuaaaauguuuauacauaa

SEQ ID NO: 255598 - RNA, 65 nt, hsa
caggccugugggaaugggauuuguuacaaaucuagguuuguuacuggcuucagaaagcuaauuaa

SEQ ID NO: 255599 - RNA, 65 nt, hsa
agaucaaaguauuauaugcugugugcuuuuuagguguuuguuaguacugugaaggcaaaaaugcu

SEQ ID NO: 255600 - RNA, 65 nt, hsa
cuuggacugugaagcaucugccauggggaagugcuguuuguuauccuuucucuguggcagugaag

SEQ ID NO: 255601 - RNA, 65 nt, hsa
caacguggcgucugauaacagugagggggggugggguuuguuaugucuuuauugaguauuuaagu

SEQ ID NO: 255602 - RNA, 65 nt, hsa
acagaaaauaacagaauagccuucuguaaugaggcguuuguuagaguuuugcaugagauucuaau

SEQ ID NO: 255603 - RNA, 65 nt, hsa
caacuugugaaaacaagguuguuuuugucuuuaucguuuguuagaguuauagauuuaugauuuca

SEQ ID NO: 255604 - RNA, 65 nt, hsa
aucuagggacagaggcaucuggaugcaaacgcgggguuuguuaggggcggaaucccgaggguggu

SEQ ID NO: 255605 - RNA, 65 nt, hsa
uaauucuuuuccuuucauuuugcuuucugaaagcaguuuguuauacuauucauaacauuguagag

SEQ ID NO: 255606 - RNA, 65 nt, hsa
ugcauugcuguauacacacagacacacacauguauguuuguuaccaagaacuggucagaccuugc

SEQ ID NO: 255607 - RNA, 65 nt, hsa
uuacaggcaugagccacuguaccuggcgaaaaacaguuuguuaacacaggcagccaacaucacuc

SEQ ID NO: 255608 - RNA, 65 nt, hsa
ggcugguuuaaaagggauccaguuuccagcugcagguuuguuagagucuguucuacaugggccug

SEQ ID NO: 255609 - RNA, 65 nt, hsa
uccccccuccucaauguaguggccuuggauauccuguuuguuaauaaagacaauucaaccagcuc

SEQ ID NO: 255610 - RNA, 65 nt, hsa
cucugugagucuggcucaagaccgacauugccuugguuuguuacaugacuaucgugauggggaaa

SEQ ID NO: 255611 - RNA, 65 nt, hsa
aaugggcuuucuguuuaugaggggugagaagugauguuuguuacuauguucuccagcaaguaaac

SEQ ID NO: 255612 - RNA, 65 nt, hsa
agucuaauaacaaaaaauguaaaccuaauuuggcaguuuguuagguuagacaacugacagccuca

SEQ ID NO: 255613 - RNA, 65 nt, hsa
ugcuuaaauuaguaugugccccuaaaauauucuauguuuguuaugagauucaaauaaaaaaauuu

SEQ ID NO: 255614 - RNA, 65 nt, hsa
agcacaucccuguaaggcccauaagagaaagaggaguuuguuacauuuaaucaacacugugaagu

SEQ ID NO: 255615 - RNA, 65 nt, hsa
cuagcauagugcuuugcacauaguagucacucaguguuuguuaaauaaagcuauuagugucauua

SEQ ID NO: 255616 - RNA, 65 nt, hsa
uguucagcagcaaacuugcaacagacuggccuucuguuuguuacuuucaaaaggcccacaugaua

SEQ ID NO: 255617 - RNA, 65 nt, hsa
auuguuucucuacuaagaacucuuucuuaaaugugguuuguuacuguagcacuuuuuacacugaa

SEQ ID NO: 255618 - RNA, 65 nt, hsa
cagguagcacaaucuacuaauguuguuugaucuguguuuguuauacugguuguaauuaauuuuuu

SEQ ID NO: 255619 - RNA, 65 nt, hsa
ggacaagguuguagcugugcucaggcuucagcuugguuuguuaaauugagagauaaacaaugaca

SEQ ID NO: 255620 - RNA, 65 nt, hsa
gcuguugcugcucuguauuugccucucgugauucuguuuguuacccauguucacuucccccagga

SEQ ID NO: 255621 - RNA, 65 nt, hsa
cuugccucagcugaucagaguuucuguggaauucuguuuguuaaaucaaauuagcuggucucuga

SEQ ID NO: 255622 - RNA, 65 nt, hsa
ggaaggcaacacauuccuacacuuuuaauguauauguuuguuauaauguccauguaaacaugccc

SEQ ID NO: 255623 - RNA, 65 nt, hsa
cagguagcucaaucuacuaauguuguuugaucuguguuuguuauacugguuguaauuaauuuuuu

SEQ ID NO: 255624 - RNA, 65 nt, hsa
ccuguguccuccagguuuauaugggaaucgaaacaguuuguuaaucugauugggagaguuccaug

SEQ ID NO: 255625 - RNA, 65 nt, hsa
cuuguuucuaugugcaaaaaaaaaaaaaaaaaaaaguuuguuaaaaggcuacacgagcucucuag

SEQ ID NO: 255626 - RNA, 65 nt, hsa
agguuuccuaaacuauaaaagcagauuuugcuuuuguuuguuaaucauaggcauggccgagcauu

SEQ ID NO: 255627 - RNA, 65 nt, hsa
uuuuuauuuuaucucaaguauguccaguguguucgguuuguuacauauuccaugaaauaucugag

SEQ ID NO: 255628 - RNA, 65 nt, hsa
uuagcagauuagcaccauaacuaacuuaaaacuaaguuuguuaccugcuuuuuauacugucacaa

SEQ ID NO: 255629 - RNA, 65 nt, hsa
ccuuaaaauuaccagacaaaaaaauuuaaaauuacguuuguuauuccuaguggaugacuguugau

SEQ ID NO: 255630 - RNA, 65 nt, hsa
caauaggacaaaaaaguugugguuuggggaggucuguuuguuacauaaaaaggaccuuucggugu

SEQ ID NO: 255631 - RNA, 65 nt, hsa
auaagauuaugaaaccacaugagaagugauaaaauguuuguuaaagcuagauagagguuaagaau

SEQ ID NO: 255632 - RNA, 65 nt, hsa
ucuggaaaugcagaauggcguuagauuuauauuugguuuguuaauuuuauaucacuguuuuucac

SEQ ID NO: 255633 - RNA, 65 nt, hsa
aacuguaaauggcugucuaaaauaaagacauucauguuuguuaaaaacugguaaauuuugcaacu

SEQ ID NO: 255634 - RNA, 65 nt, hsa
guauaacuuccauguucucuagaaaucaagguuuuguuuguuaauucucuuuuauaugcauguau

SEQ ID NO: 255635 - RNA, 65 nt, hsa
cuuacgaucguuauucccccaauucaucauauuuuguuuguuaucaccagagaugccugaacuca

SEQ ID NO: 255636 - RNA, 65 nt, hsa
uguuuuuguuuuuguauuuuuuuucuuuugaaaggguuuguuaauuuuucuaauuuuaccaaagu

SEQ ID NO: 255637 - RNA, 65 nt, hsa
uauuuagccguguuugggacuccgugucuucaaugguuuguuaguugccauuacaacuuugucug

SEQ ID NO: 255638 - RNA, 65 nt, hsa
aagugcugggauuacaggcccgguccaguuugauaguuuguuaucauguuauacguacacuuaga

SEQ ID NO: 255639 - RNA, 65 nt, hsa
cuuuagcagagaauuuguaauuuaagaaauuuucuguuuguuacggaacaugugggaaucccuuu

SEQ ID NO: 255640 - RNA, 65 nt, hsa
uuuucaacucuugcaccuggaguucugcugguuaaguuuguuaaacuuaguugaaacugggaacc

SEQ ID NO: 255641 - RNA, 65 nt, hsa
agaaauaaagagcuaucaugcugugguuuauuaugguuuguuacauugauaggauacauacugaa

SEQ ID NO: 255642 - RNA, 65 nt, hsa
guagcccgcucguaucuaugguuucgcuuuccacaguuuguuaccugcagucaacugcaguucaa

SEQ ID NO: 255643 - RNA, 65 nt, hsa
gucccuuccuccagauccgucugguuuuuuacaccguuuguuaauaaagccugaaaccgcugugu

SEQ ID NO: 255644 - RNA, 65 nt, hsa
aauaauguacguacuaccuaaaaggaugucuaaauguuuguuaauaaaaauaagaaauagcuaca

SEQ ID NO: 255645 - RNA, 65 nt, hsa
uuauuaauauguuaggauuuauccucagucagccaguuuguuaugucuuuucuauucuacuguua

SEQ ID NO: 255646 - RNA, 65 nt, hsa
gugcuguuauucuauucugcaaauaaacugaauguguuuguuaguuccaguugcauuuuggcuga

SEQ ID NO: 255647 - RNA, 65 nt, hsa
cauaagaaguuuaaucaaaguaaccagaaucccauguuuguuacuaggauuuacauuaacugcug

SEQ ID NO: 255648 - RNA, 65 nt, hsa
uuauuuacgauuucguuuguuuggauucaagcuuaguuuguuaauauguauaauuuagcaucuau

SEQ ID NO: 255649 - RNA, 65 nt, hsa
uccauuuuaagaaaacccgacaacauuucugccagguuuguuaggaggccacaugauacuuauuc

SEQ ID NO: 255650 - RNA, 65 nt, hsa
aaggcugacucuuacuaaccaccauuuccccugugguuuguuaucaguacaauucuuuguugcuu

SEQ ID NO: 255651 - RNA, 65 nt, hsa
auaauacauuauugacucuaugaauguuuucugaaguuuguuagucauuuguaaaacuaaaucag

SEQ ID NO: 255652 - RNA, 65 nt, hsa
caggcuuugggugaauucuggauggcuugccucauguuuguuagccagcacuucugcucugucgu

SEQ ID NO: 255653 - RNA, 65 nt, hsa
aacucaugguaccuuggccaaguuggaaggaagcaguuuguuaaugaggcacaguaauccuggcu

SEQ ID NO: 255654 - RNA, 65 nt, hsa
agaauauuuacaauaaagaguauuuacaauaaagaguuuguuauuauuuguaaauugugugcaac

SEQ ID NO: 255655 - RNA, 65 nt, hsa
cacagacugggaaccccuccuggccugggggaagaguuuguuaccuaccuuacuauuuaaagagc

SEQ ID NO: 255656 - RNA, 65 nt, hsa
ggggaggggaccgggaagcgcuggggcuuguuucuguuuguuacuuacaggacugagacaucuuc

SEQ ID NO: 255657 - RNA, 65 nt, hsa
auuaacagcugccugaauugucauuuuccauuuugguuuguuagaggugggagggguggguuuug

SEQ ID NO: 255658 - RNA, 65 nt, hsa
ugaggacucuucaguggcugagcagcuuuggacuuguuuguuauccuauuuugcauguguuugag

SEQ ID NO: 255659 - RNA, 65 nt, hsa
ccccuccuugcccagacuacagggcuuaggacuugguuuguuauuucagggaaaaggaguaggga

SEQ ID NO: 255660 - RNA, 65 nt, hsa
auuauugugacuuguaaguuucuuaucccauaaagguuuguuacuucccucacuucaccuccaua

SEQ ID NO: 255661 - RNA, 65 nt, hsa
uuuuacguuccgggauacaugugcaggaccugcagguuuguuacauagguaagccugugccaugg

SEQ ID NO: 255662 - RNA, 65 nt, hsa
aauuauugaaaaauuaaaaaaugucauuguuuccuguuuguuaauauuaggguuguaaggugucg

SEQ ID NO: 255663 - RNA, 65 nt, hsa
aauucuccugcauuuuuacauaaacuaaaugugagguuuguuacugguauuuuuuucacgugccu

SEQ ID NO: 255664 - RNA, 65 nt, hsa
accagugccaccuuauggcaaagagcucccgcaguguuuguuagagugcacaucccuacgugccc

SEQ ID NO: 255665 - RNA, 65 nt, hsa
gguccagcaguguuagcagggguggcaguccuuguguuuguuauaccaauaaaugcuuuagcugc

SEQ ID NO: 255666 - RNA, 65 nt, hsa
gguauaccucaacccaaaaauaaagguuuguuuugguuuguuauggcuuccuuuuuuaaaaaauu

SEQ ID NO: 255667 - RNA, 65 nt, hsa
gucaauuuuguacaauuagguaucugacuuuacaaguuuguuauccuuucuaauuuuuacugaac

SEQ ID NO: 255668 - RNA, 65 nt, hsa
caguuuucagauaaaccagaaaagcuuauacaagaguuuguuacguugacuauguucuucaaauu

SEQ ID NO: 255669 - RNA, 65 nt, hsa
guacuaaaugccacugaauuuguauacuucagaauguuuguuauguaaauuuuaccucaacuaaa

SEQ ID NO: 255670 - RNA, 64 nt, hsa
ccauggaucuccguguacacuaucaauaaaaguggguuuguuacaaagccguguccuugcccau

SEQ ID NO: 255671 - RNA, 65 nt, hsa
cugcugggccucccugacuguaaaaucucuguacuguuuguuagguuuuuggugggaggcuguga

SEQ ID NO: 255672 - RNA, 65 nt, hsa
gcucuggaagcuggcaguguguaaagcacuggcaaguuuguuacuguuaaaaugucaaauaccaa

SEQ ID NO: 255673 - RNA, 65 nt, hsa
cuugauugaaauggcaggauucuaaagagagccugguuuguuaaaagaaaacacugucaugcugu

SEQ ID NO: 255674 - RNA, 65 nt, hsa
aacugcauuuauaauuuugugacugaggaucauuuguuuguuaauguacugugccuuuaacuuua

SEQ ID NO: 255675 - RNA, 65 nt, hsa
acugaaguaagauuuugccuguaugguacuguuuuguuuguuaauaaagugcacugccaccccca

SEQ ID NO: 255676 - RNA, 65 nt, hsa
uauccuuguuccuguuacaauauuuagcauuauuaguuuguuauguguguauguuuauguuaauu

SEQ ID NO: 255677 - RNA, 65 nt, hsa
cugugucuacgauucaaagugaaaacauuuggcauguuuguuaauucuagcuuuuugguuuaaua

SEQ ID NO: 255678 - RNA, 65 nt, hsa
uagucucccuuucacuguuuucuuauucuguaauuguuuguuauauuucccaaaaacgucuugau

SEQ ID NO: 255679 - RNA, 65 nt, hsa
ggguagaguauugagaccuuuuuuauuagggugcuguuuguuauugagagcccaaucucugcaug

SEQ ID NO: 255680 - RNA, 65 nt, hsa
acuuauuuguuuccugauagguuauguuuguaauuguuuguuaagcacagccuguuucuuggaag

SEQ ID NO: 255681 - RNA, 65 nt, hsa
uguauaaauuaguauaucucuucuauuauuagucuguuuguuaaaugccagaccacguuucuaug

SEQ ID NO: 255682 - RNA, 65 nt, hsa
ucaccuacauuaacauuaugucuuugcagcuuuagguuuguuagauguguucuuaagcauaauuu

SEQ ID NO: 255683 - RNA, 65 nt, hsa
auuuuucauuggguuuuuauuguuguuuaguuuugguuuguuacgccagcccagucugucugcgg

SEQ ID NO: 255684 - RNA, 65 nt, hsa
cugggagggccucauguuuuaucugguucuuaaauguuuguuacuacagaaaauaaaacugcgcu

SEQ ID NO: 255685 - RNA, 65 nt, hsa
ugagagagagcuauguuucuaaccaagggccuaauguuuguuacagaaaugaucccagagaccua

SEQ ID NO: 255686 - RNA, 65 nt, hsa
aacugcauuuauaauuuugugacugaggaucguuuguuuguuaacguacugugacuuuaacuuua

SEQ ID NO: 255687 - RNA, 65 nt, hsa
caguagccuuaaaaaggcuuuuguuuauuucuuugguuuguuaacuagugucaucuauuuagaga

SEQ ID NO: 255688 - RNA, 64 nt, hsa
uauaauuuuauauuuacacacauacgugcuacccagagauuaauuuaguccauaugaacuauug

SEQ ID NO: 255689 - RNA, 64 nt, hsa
auguauugguagcagggauguuuucauaauuuucagagauuaugcauucuucaugaauacuuuu

SEQ ID NO: 255690 - RNA, 64 nt, hsa
ucuaaacaagaaccauuugcaauauggauuucuuagagauuaaaccaauuauaacuuauuagca

SEQ ID NO: 255691 - RNA, 64 nt, hsa
gaucaucauguagaauauggcuaugaaucaggaaagagauuagaacauuuaauaauguauguac

SEQ ID NO: 255692 - RNA, 64 nt, hsa
ccgggacccccgucuccaggggugccccagacccagagauuagccucccacuucggcgcagaaa

SEQ ID NO: 255693 - RNA, 64 nt, hsa
ucuaaauuucuaggccaguacuacugcucucaaaagagauuaacugggauuaagugagaugacg

SEQ ID NO: 255694 - RNA, 64 nt, hsa
cguaggugggccagagaacauuggaagaaucaagagagauuagaauaucugguuucucuaguug

SEQ ID NO: 255695 - RNA, 64 nt, hsa
cucuuuucaaucucuuaaucuaaaugcuuuuuaaagagauuauuuguuuagauguaggcauuuu

SEQ ID NO: 255696 - RNA, 64 nt, hsa
augguggggaaguggauucaggaaucuggggaauggcaaauauauuaagaagaguauugaaagu

SEQ ID NO: 255697 - RNA, 64 nt, hsa
ggcagaucugcuuggggaagcuaguuaugugaaaggcaaauagagucauacaguagcucaaaag

SEQ ID NO: 255698 - RNA, 64 nt, hsa
ugaccaaauacaaacauccuaaaguagagcuuagggcaaauauuugauugagagggcacaauuu

SEQ ID NO: 255699 - RNA, 64 nt, hsa
cagguuguuagaugauaacucaaaauuuucaguaggcaaauagguaauguggaaaucugaagaa

SEQ ID NO: 255700 - RNA, 64 nt, hsa
gcuuuggcucuauugauuuguccauuauguguuaggcaaauauaacuuaaguggagggggaagu

SEQ ID NO: 255701 - RNA, 64 nt, hsa
aaaucuauggccacacugagaagccuuugaaaauggcaaauacuuuucaucaccaauugcccaa

SEQ ID NO: 255702 - RNA, 64 nt, hsa
cauguacccauaaaaauuuaaaaagaaauggaauggcaaauaauggaacauaaacuuuaaacag

SEQ ID NO: 255703 - RNA, 64 nt, hsa
auugaacuauuuuuauaucugcugucuuucagaaggcaaauaggaaacuauauauuugcuuaaa

SEQ ID NO: 255704 - RNA, 64 nt, hsa
uuuuucaaaguaggcaauucuuuguauauuuuaaggcaaauaaucacuucaccucuggugccuu

SEQ ID NO: 255705 - RNA, 64 nt, hsa
aagauucuguuccccucuucgcagaagugaggaaggcaaauacucaggguuugaagggagaccu

SEQ ID NO: 255706 - RNA, 64 nt, hsa
uaguuccuucauuccaacgacugagugaggucuuuauugccaucaucccgugugcgcacucugc

SEQ ID NO: 255707 - RNA, 64 nt, hsa
uuugaagggaaggauaaguguugcuuucaguaguuauugccaauauuguuguuggucaauggcu

SEQ ID NO: 255708 - RNA, 64 nt, hsa
gucaauuuagaacaguuacuaggauaaacuccauuauugccauggcugucaugguacccaagug

SEQ ID NO: 255709 - RNA, 64 nt, hsa
ugagagcagcacaugcauccagguauuuauagauuauugccagugucuuuucuguaugcuauaa

SEQ ID NO: 255710 - RNA, 64 nt, hsa
ucauuaguaugugagggccuugauuguuauguaauauugccaaugaugaauucagguuguuuuu

SEQ ID NO: 255711 - RNA, 64 nt, hsa
gcucccagacuugcccagauuuguguauuguacuuauugccacuggccgccacuuugacuuauu

SEQ ID NO: 255712 - RNA, 64 nt, hsa
guaaaaaaacaaaaaauagaagcaaaacacauuguauugccauuauuuuguauuugguaaaggu

SEQ ID NO: 255713 - RNA, 64 nt, hsa
aagaaaaguuuuaauuauauaaauagcaaagggcuauugccaauacuagggucaaaaaugaauu

SEQ ID NO: 255714 - RNA, 64 nt, hsa
augaaauaaguguaugugcauugcugucugucucuauugccaaaaucaaauaaauggcuucuca

SEQ ID NO: 255715 - RNA, 64 nt, hsa
augcuguaucuuguacacagguuguagguugguuuauugccauuuuguuuuauuucugcuguau

SEQ ID NO: 255716 - RNA, 64 nt, hsa
gcccuuugccuguagagccagccuugguuggaccuauugccaggaauguuucagcugcaguuga

SEQ ID NO: 255717 - RNA, 64 nt, hsa
agagaaccuuuccacucccacugccaggauuuuguauugccaucgggugccaaauaaaugcuca

SEQ ID NO: 255718 - RNA, 64 nt, hsa
ucauuuagaaacauccauauuuuucugcuuuuucuauugccauuuuuuauuugugcaugaauug

SEQ ID NO: 255719 - RNA, 64 nt, hsa
cuguauucagguaauauguuuaaagauauuuauauauugccauacaaaaacuuaacauuuaaaa

SEQ ID NO: 255720 - RNA, 64 nt, hsa
aaaaugauucuucuucagaaauuaaaaacauaacuauugccagauuuagcucuggaauguuuag

SEQ ID NO: 255721 - RNA, 64 nt, hsa
guggcuuauuugagguuguuggugcuguugguauuauugccauaguuguuauuuaauugcuuga

SEQ ID NO: 255722 - RNA, 64 nt, hsa
aguauuuuucugaacccugcuuuaccauuuucuauauugccaaguugaaucaugugggcugaug

SEQ ID NO: 255723 - RNA, 64 nt, hsa
uaacugacauuauauauaaccaauuaauuuaaaguauugccauuuaaauuacacacugagagca

SEQ ID NO: 255724 - RNA, 64 nt, hsa
auuuucccuggagggauccuagaaagcauugucauauugccaucuccauuagcucacuuuuaaa

SEQ ID NO: 255725 - RNA, 64 nt, hsa
aagggagaagacacugcagugaccacuuauucuguauugccauggucuuuccacuuucaucugg

SEQ ID NO: 255726 - RNA, 64 nt, hsa
guucauuuuucaaaaagggaaguaagcaaacaaauauugccaacucuucuauuuauggauauca

SEQ ID NO: 255727 - RNA, 71 nt, hsa
uugauaaaucuggaagcaugaaugcagaagaccgucucuuucgaaugaaucaagcagcagaauuguacuug

SEQ ID NO: 255728 - RNA, 71 nt, hsa
gcuuuucuggucuucggcugcucaggguucaucugaagauucgaaugaaaagaaaugcauguuuccugcuc

SEQ ID NO: 255729 - RNA, 71 nt, hsa
aaguauaggguuuauguccuuauuuuucuuucagcugaauacgaaugaacacagugguggaauuucugaag

SEQ ID NO: 255730 - RNA, 71 nt, hsa
cugcuuguucacaugcacaggugcucucagcucugccaaagcgaaugaaugguguuuccggaggagcaagu

SEQ ID NO: 255731 - RNA, 71 nt, hsa
agaaacucaccauguaaaagagucaucugguagauuuuuaacgaaugaagaugucuaauaguuauucccua

SEQ ID NO: 255732 - RNA, 53 nt, hsa
gcagcuaugcagccgggugaaugcgaaugaacuucacguucuccaaagcacuu

SEQ ID NO: 255733 - RNA, 71 nt, hsa
caaaacaaaacacaaauacucucacagggcauggagguuuucgaaugaacuuggccauaagaauaaauuca

SEQ ID NO: 255734 - RNA, 71 nt, hsa
gcagggccaagcaccuagccucgcucuuggcagguacucagcgaaugaaugcuguauauguugggugcaaa

SEQ ID NO: 255735 - RNA, 71 nt, hsa
uucuaauacccagaaauaacgcuauuuagcuuuauaauuuucgaaugaacaagguaaaccucgguugccau

SEQ ID NO: 255736 - RNA, 71 nt, hsa
ugcuuauaaccuaguuaaagaaaggaaaagaaaacaaaaaacgaaugaaaauaacugaauuuggaggcugg

SEQ ID NO: 255737 - RNA, 71 nt, hsa
uuuuguggaaaagaaacuaguuaaauuuacuauuccuaacccgaaugaaauuagccuuugccuuauucugu

SEQ ID NO: 255738 - RNA, 71 nt, hsa
aaugaaaacaauccagcacucugguuaaauuuuaagguauucgaaugaaauaaagucaaaucaauaaauuu

SEQ ID NO: 255739 - RNA, 71 nt, hsa
cauaaaugaagccucuuuggggugaagccuggacaucccaucgaaugaaaggacacuaguacagcgguucc

SEQ ID NO: 255740 - RNA, 71 nt, hsa
acuguuguuuucauugaguuuggauuuauauuuuaaauguucgaaugaaaguaugauuguaaaagggagug

SEQ ID NO: 255741 - RNA, 71 nt, hsa
cagggacuuuucugggagaacuuaaaggcccauaguaacugcgaaugaagcaauauaccacuaaccugcag

SEQ ID NO: 255742 - RNA, 71 nt, hsa
uuuugaagaagaauagccuuuuucucugcacuauuuagauccgaaugaaccuuaugauguguauauugaga

SEQ ID NO: 255743 - RNA, 71 nt, hsa
ugcacccuuucaccaccucgaggagauuugcuccccauuagcgaaugaaauugaugcaguccuaccuaacu

SEQ ID NO: 255744 - RNA, 71 nt, hsa
guagauugaaauaaauaaccaguauuuaaguaaauguauaacgaaugaauaaauacaugcauaauauuuuc

SEQ ID NO: 255745 - RNA, 71 nt, hsa
gggaauaagguacaagaagcauuuuguaaguugaagcaaaucgaaugaaauuaacuggguaaugaaacaaa

SEQ ID NO: 255746 - RNA, 71 nt, hsa
agaaagagagaaagaaagaaacagaaaaaccuaaaagaaagcgaaugaauuugacaccuguugguuggaug

SEQ ID NO: 255747 - RNA, 71 nt, hsa
ucuuagaauucgcauuuugccagcucagcgcaccuccacaacgaaugaaaugcuccguaugauuugcacaa

SEQ ID NO: 255748 - RNA, 71 nt, hsa
cuccuauguaguucucagaugcguaaagcagaacagccucccgaaugaagcguugccauugaacucaccag

SEQ ID NO: 255749 - RNA, 71 nt, hsa
caucagauaauucacaccagagagaaacccucugaaugugacgaaugaagaaaagguauuaguguuaaacu

SEQ ID NO: 255750 - RNA, 71 nt, hsa
agggaccuaaacuuuggcaaaaagugaacacaauucaaauacgaaugaaggaagagcccucagauggaacg

SEQ ID NO: 255751 - RNA, 71 nt, hsa
agcucaacgagacccaagugaagaucugguuccagaaccgccgaaugaagcaaaagaaacgugagaaggag

SEQ ID NO: 255752 - RNA, 71 nt, hsa
aaggcaaaguguuucugaaggcaauuucuuuuuaauaugcccgaaugaaugaggcuucauccuuuccauau

SEQ ID NO: 255753 - RNA, 71 nt, hsa
uggaagaauauuuuagucaugaguuguuuucaguuuucagacgaaugaauguaauaggaaacuauggaguu

SEQ ID NO: 255754 - RNA, 71 nt, hsa
acaguaagaugugaaauucacaaaaaguaaaccaaacaaaacgaaugaaaaacuggaaauaauucguuucc

SEQ ID NO: 255755 - RNA, 71 nt, hsa
ccugucugggcaaguauuugacucaacuaaauuuuaaugaacgaaugaaugacagagaggaggaaaaaaga

SEQ ID NO: 255756 - RNA, 71 nt, hsa
uggauggcagguagaguucaaccaguucgugacuguuguagcgaaugaaguuaaaaaaaugucuuucugau

SEQ ID NO: 255757 - RNA, 71 nt, hsa
ggucugccuuuaauuuuacccaggaaggacucacauuggggcgaaugaaccaaguuucgccaugcuggaug

SEQ ID NO: 255758 - RNA, 71 nt, hsa
aagcaaguacauaaggacccuccuuuggugaaauccggguucgaaugaauaucucaaggcaggagaugcau

SEQ ID NO: 255759 - RNA, 71 nt, hsa
gcauugaggcccaguaagacacucauguggcuaguguuugccgaaugaaacucaacucaauaaaaaacaaa

SEQ ID NO: 255760 - RNA, 71 nt, hsa
ucccuuuaagccaagagagccucuuguggaccccgccugcccgaaugaaauccgaacaguuggggcuguuc

SEQ ID NO: 255761 - RNA, 71 nt, hsa
agugaaauguaaugauaaagagggauauuuuaacauauuuccgaaugaaugacucauuauuucauucuuuu

SEQ ID NO: 255762 - RNA, 71 nt, hsa
gugaugaggaugugggaguugaaagaaagugguguaucaagcgaaugaacuacagcugugaggguuuagca

SEQ ID NO: 255763 - RNA, 71 nt, hsa
uuccugagcuuuaugguccuaaaagcaaaauaaaaacuauucgaaugaaaagacaagaaaaucagguauua

SEQ ID NO: 255764 - RNA, 71 nt, hsa
auccucgucugucccaacacugagcaggcacucgguaaacacgaaugaauggaugagcgcacggaugaaug

SEQ ID NO: 255765 - RNA, 71 nt, hsa
agaccaguuucagagaaauacuuucaggcacuaagacuaaucgaaugaacaaaguccacaguuuauuuuua

SEQ ID NO: 255766 - RNA, 71 nt, hsa
aucagugcuacggggccagucuuucccguggcugccaccagcgaaugaaacuuuuguaugauacauaaagu

SEQ ID NO: 255767 - RNA, 51 nt, hsa
ugucggugaccacuguaugaccgaaugaauggaaugcaugcgacugauuuu

SEQ ID NO: 255768 - RNA, 71 nt, hsa
gauauaagcuuuuagaagguaauuugaugguauuucuuucucgaaugaaaagcugcugguuuacccucaac

SEQ ID NO: 255769 - RNA, 71 nt, hsa
ggcucuggccaucugcaacccugaacgugcagguuggagaacgaaugaauacaaauuuuauuguaaaauaa

SEQ ID NO: 255770 - RNA, 71 nt, hsa
cuauagcuuugaaaggauaaaaagcccugaagugcucaucacgaaugaaacaccaaaaccagagacuauca

SEQ ID NO: 255771 - RNA, 71 nt, hsa
agguuaaaaagaccauuguauguuuuucuauuucugaauuacgaaugaaauccgaguaccuauuagaaaug

SEQ ID NO: 255772 - RNA, 71 nt, hsa
aauuauguccuccagaaaccagcaagaacacuuggaaugaacgaaugaacuuguagggggcauagaggauu

SEQ ID NO: 255773 - RNA, 71 nt, hsa
acugauucccaggcccugcugcucccauccccaccccagaucgaaugaacuuggcagaaagaagagaacuu

SEQ ID NO: 255774 - RNA, 71 nt, hsa
ucucacuacugcacuugacuagucuuaaaacaaagaaagaacgaaugaaugaaugaaucuguggcuggaug

SEQ ID NO: 255775 - RNA, 71 nt, hsa
uucauaacauuucucugcaaagaauucucuauggagugaagcgaaugaagugaauaauuucuuaccaaaua

SEQ ID NO: 255776 - RNA, 71 nt, hsa
ggagcauucugggaagaaguaauuuauuccuuuucggcagccgaaugaaaaaaaaauuuaaaaaaaugugc

SEQ ID NO: 255777 - RNA, 71 nt, hsa
cccccaccccccuguacauaauuuuuaaaaccuuuuuuuagcgaaugaaauauugaaguauaagauuccuu

SEQ ID NO: 255778 - RNA, 71 nt, hsa
auauuacacaucaagcgaugaaacuggaaaacuacaagccacgaaugaaugaauuaggaaagaaaaaaagu

SEQ ID NO: 255779 - RNA, 52 nt, hsa
ccucuccgcaggcucaaugaaucgaaugaaugugaacuucuucaucugugaa

SEQ ID NO: 255780 - RNA, 71 nt, hsa
ccaaugaggucugcugccaggugugaacaagcaugucucuacgaaugaacgaaacauuggggaucucugcc

SEQ ID NO: 255781 - RNA, 71 nt, hsa
gguuucuuauaacccuacuccacgucuggaugugucuaguccgaaugaagcaggaaggccggagugggaag

SEQ ID NO: 255782 - RNA, 71 nt, hsa
aaauugacccggaaguuccuguaauaaaugucacaauaaaacgaaugaaugaaaaugguuaggacguuaca

SEQ ID NO: 255783 - RNA, 71 nt, hsa
agaaucccugaccccugcccugggccuuaacacacauccgacgaaugaaugaaggguugccucaguaccgg

SEQ ID NO: 255784 - RNA, 71 nt, hsa
uucuucagugauaugaaaaaaucauugagcauucauuauugcgaaugaaguggggaugcauuauuucugac

SEQ ID NO: 255785 - RNA, 71 nt, hsa
uuuaucuuugaaauuuugcaugaaaaggaaaugaauggauucgaaugaaauuguccuuuagagcaugauua

SEQ ID NO: 255786 - RNA, 71 nt, hsa
caguagcgcaaaggcugcgcagcguuaaugcgcauugcgugcgaaugaaccccugugaacgguugacuaga

SEQ ID NO: 255787 - RNA, 71 nt, hsa
gcuuucucuagauugucugugauuggacagacuaugaugagcgaaugaagaaguuggucaguauuguggcu

SEQ ID NO: 255788 - RNA, 71 nt, hsa
cagauacaaacuugccuuauuuucuaguuugugaacaagaacgaaugaaguacuauuauugauaacuuaua

SEQ ID NO: 255789 - RNA, 71 nt, hsa
aacugauacugcagucauuggagagagagcuccucauuucucgaaugaaagaugagauauauucauccuca

SEQ ID NO: 255790 - RNA, 64 nt, hsa
ccccucucagcuguagcugcaccacccccgcucuggcuaccaggcucucccggcugggcacugc

SEQ ID NO: 255791 - RNA, 64 nt, hsa
cccucucccgcuggcagcuccucaggggaacaggggcuaccagaggcugauuucuccccucucc

SEQ ID NO: 255792 - RNA, 59 nt, hsa
guccuaacgagaagagauaauuacaaucaggcuaccagaggaagccuuugguccuaacg

SEQ ID NO: 255793 - RNA, 64 nt, hsa
cuuugguccuaacgagaagagauaauuacaaucaggcuaccaaaggaagcacuaacuuuggugc

SEQ ID NO: 255794 - RNA, 64 nt, hsa
cauauuucaccaguggaaagccaguuaccucaguggcuaccaacccauucaaagaggacauaug

SEQ ID NO: 255795 - RNA, 64 nt, hsa
ccucauccagcucagaucuuauuagcacaggaauggcuaccauaacgauauggaacuaaaguau

SEQ ID NO: 255796 - RNA, 64 nt, hsa
aagguuaucuaacugaaucacuacugaguugaaucauggcuaucauuagccacagguacugcug

SEQ ID NO: 255797 - RNA, 64 nt, hsa
uacaaaauuagcagggccucacagucagcuuccucauggcuaguuuuucccccuuauauuacaa

SEQ ID NO: 255798 - RNA, 64 nt, hsa
ugaaaacagcuauagacaaucauaaaugaaugaucauggcuauguuuuaauaaaacuuuaugga

SEQ ID NO: 255799 - RNA, 64 nt, hsa
ugaaaacagcuauagacaaucauaaaugaaugaucauggcuauguuuuaauaaaacuuuacaga

SEQ ID NO: 255800 - RNA, 64 nt, hsa
gauggcuuauucaaccauagccccuccaacauaucuacuggaaauucugcugguuaacuuuauc

SEQ ID NO: 255801 - RNA, 64 nt, hsa
uacuucacucaacaacaauauucucaagagucuucuacuggaagcuagaaagaaauaggaauuu

SEQ ID NO: 255802 - RNA, 64 nt, hsa
uguacaguuuuauguggggaacaauucaugcaggcuacuggaaaauuaaaucuuauuaccaacu

SEQ ID NO: 255803 - RNA, 64 nt, hsa
aagagauuuauaaucauaauguuuacaaugcagccuacuggauugucucuagaucuguuuuucu

SEQ ID NO: 255804 - RNA, 64 nt, hsa
ggaauuguuggggguccuucauguguucccacuccuacuggaagacccaugucgguuuccggaa

SEQ ID NO: 255805 - RNA, 64 nt, hsa
agaugcaaagucuuuuggaccgaugaugucucuacuacuggaucuaucuguauuaacagcaaug

SEQ ID NO: 255806 - RNA, 64 nt, hsa
aauucauuucuagacucaaaaccuggagaugcagcuacuggaaugguguuuugucagacuucca

SEQ ID NO: 255807 - RNA, 64 nt, hsa
ucguaguccaucaccauuucuuggcauuggaauucuacuggaaaaaaauacaaaaagcaaaaca

SEQ ID NO: 255808 - RNA, 64 nt, hsa
acacacacacacaccauuuuaggaagugguucuccuacuggaaaauaugcuacagaaugaaagu

SEQ ID NO: 255809 - RNA, 64 nt, hsa
auacuguaaugccuaaucuauuuaucaaaacugacuacuggaccggagcccagaaaccaugggu

SEQ ID NO: 255810 - RNA, 64 nt, hsa
caggcucugagugggccugcucucuguagacugaauucagcaccagugaaaggcuuugagaagg

SEQ ID NO: 255811 - RNA, 64 nt, hsa
cagcagccagucucagagaccagcacucagccucauucagcauggguccuugaugccagagggc

SEQ ID NO: 255812 - RNA, 64 nt, hsa
uagaugugaggcuuuuugugaaagagaagccuaaauucagcaucuccccuuccacccucacccc

SEQ ID NO: 255813 - RNA, 64 nt, hsa
ugcaggcaguauuuaggguaguuuaaaugaguaaauucagcacugguaccuuauuauugaguaa

SEQ ID NO: 255814 - RNA, 64 nt, hsa
ggacuuugaaagucauggggguuuuuauuuuguuauucagcaugacauuauuuccauucuaaca

SEQ ID NO: 255815 - RNA, 64 nt, hsa
uugggcuaguuauuuuuuuaaucuucauauaucuauucagcaguaugccauauuuaauuugaag

SEQ ID NO: 255816 - RNA, 64 nt, hsa
uauucagcacaaggaaauaaaauuuuaguugaggauucagcacuaaaauccuugagaucacuuc

SEQ ID NO: 255817 - RNA, 64 nt, hsa
augacuguuuuuaauauggaucuguauguguucuauucagcacaaggaaauaaaauuuuaguug

SEQ ID NO: 255818 - RNA, 64 nt, hsa
ccaagguuacuuaauucaacuuaacuaucaucuuauucagcaccaagcaugucccaggcacugu

SEQ ID NO: 255819 - RNA, 64 nt, hsa
uuccuuuucacugcuguuauauuucaucaugauaauucagcaggcccaaguaaagguuaaaaau

SEQ ID NO: 255820 - RNA, 64 nt, hsa
cuuaaucuccaauaaacaucuauguuaaauccaaauucagcauuugcuguuagcuauucagcau

SEQ ID NO: 255821 - RNA, 64 nt, hsa
auguuaaauccaaauucagcauuugcuguuagcuauucagcaucaggcacucuuauugauucau

SEQ ID NO: 255822 - RNA, 64 nt, hsa
cuaacaacugacaaaucagaguuugccaguucaaauucagcauggcugcagcugauuaagaaau

SEQ ID NO: 255823 - RNA, 64 nt, hsa
cguuugucaaaguuccguaggaucagugauggucauucagcaugacugguucugggagaaggug

SEQ ID NO: 255824 - RNA, 64 nt, hsa
ugauauuuuuagugggugcauucuuccagaaagaauucagcaauguuaucagaauuaauucuuu

SEQ ID NO: 255825 - RNA, 64 nt, hsa
cuuaaacacugaucuuggcagggacggaacuccuauucagcaguuuuuguggaaagcaguaaug

SEQ ID NO: 255826 - RNA, 64 nt, hsa
uggaaagcaguaaugcuugcaaaacgugugugucauucagcauuuuaaguggagacuaugcauu

SEQ ID NO: 255827 - RNA, 64 nt, hsa
gucugauaaauccuguaguccaagcucaggcauaauucagcauaagaaaauucacaccagagcc

SEQ ID NO: 255828 - RNA, 64 nt, hsa
auguggaaaagacuucagauugaauucacaucuuauucagcaucaaagaauucacacaggagag

SEQ ID NO: 255829 - RNA, 64 nt, hsa
auguggaaaagcuuucagucaaaccucaugccuuauucagcaucacaaaaugcauaggaaagag

SEQ ID NO: 255830 - RNA, 64 nt, hsa
gaagaugggaagauauuuaucaaauucaggcuucauucagcaucugagaguucacaccagggag

SEQ ID NO: 255831 - RNA, 64 nt, hsa
uuuuuuaauugggggaaauaagcacuauuaacagauucagcacuacaaguauuuugaauguugu

SEQ ID NO: 255832 - RNA, 64 nt, hsa
ucuguaccuuuacuugugaaagguaugcuauauaauucagcaaguaccaacuuguguagcugca

SEQ ID NO: 255833 - RNA, 64 nt, hsa
caauugcugcuaguucaguuacauuucugcugauauucagcaaauuucuaaguuuauggugaac

SEQ ID NO: 255834 - RNA, 64 nt, hsa
cuuuuaacucaauguguaaauagaucuggagaauauucagcauaaugcuggcucuuguuucacu

SEQ ID NO: 255835 - RNA, 64 nt, hsa
cacaaaaggguaacagggcccaugcaaguccaaaauucagcagggcagucaaauuuuaaaccuc

SEQ ID NO: 255836 - RNA, 64 nt, hsa
ugucaauauugcuaucagcauuuugggcaaagccauucagcaaguaucuaggaaguuccaaacu

SEQ ID NO: 255837 - RNA, 64 nt, hsa
aacucugcuucuaugguagggcaugaggacaacuauucagcaugguuuuagcuucuuggagaug

SEQ ID NO: 255838 - RNA, 64 nt, hsa
gcauuuacgaaugaucuucccaucccuuuuucccauucagcaaauauuaguuuguccuccuuua

SEQ ID NO: 255839 - RNA, 64 nt, hsa
uucucagcugcugcgggagguagguaccauggccauucagcacagccuugauuuccucccaaag

SEQ ID NO: 255840 - RNA, 64 nt, hsa
gaaaagaucccaagauggagaggaagaaacgcuaauucagcauguguucauucugcauugagaa

SEQ ID NO: 255841 - RNA, 64 nt, hsa
uuuucucaucauugggguuagcgggugcagacaaauucagcaauaguaugcagaucagccccuc

SEQ ID NO: 255842 - RNA, 64 nt, hsa
cauuugguauguaucugaauuaauucucacuaaaauucagcaaaggacuugauagccccucccc

SEQ ID NO: 255843 - RNA, 64 nt, hsa
aaguuauuuccuuuuauaauacuuuucuuccccauggaacaaaugggaucaauuugugaguuuu

SEQ ID NO: 255844 - RNA, 64 nt, hsa
gguucacugagggguggcacgggaccacuccagguggaacaaacagaaaugacuguggugugga

SEQ ID NO: 255845 - RNA, 64 nt, hsa
uacuuucuccaguaaaugaggaaccguaacucuuuggaacaaaccaaaauauagcagauguaau

SEQ ID NO: 255846 - RNA, 64 nt, hsa
ugcauuuuauuugauauauuuuauaauccagguuuggaacaaggaaacaaaauuaaaaggacag

SEQ ID NO: 255847 - RNA, 64 nt, hsa
ccccccccaacacaccuauaaaaacccaaauuuuuggaacaaagauaauggaaccuccauuuuc

SEQ ID NO: 255848 - RNA, 64 nt, hsa
uuuaauuuccaggguugcuugaucauuauaucauuggaacaacugauacuucacuacuuuaaua

SEQ ID NO: 255849 - RNA, 64 nt, hsa
gucugugcaaacuggaggacuccuuccaacuuccuggaacaaagcgacaucgccagcagcaggc

SEQ ID NO: 255850 - RNA, 64 nt, hsa
gacagugugcucacucucagagccauggauuaccuggaacaaagugcagauuagugcccacggu

SEQ ID NO: 255851 - RNA, 64 nt, hsa
uuucaugcuagaaacaggaagauuggaaucugccuggaacaaagaacugcaccuaagcagacca

SEQ ID NO: 255852 - RNA, 64 nt, hsa
auagagguuaauuuaaucaaaaugagcuaaaacauggaacaaucacugaauaauuuaaaaagag

SEQ ID NO: 255853 - RNA, 64 nt, hsa
agauuuucccuccuggaauuacacauaaaggacacuaagcaauuuucaagguaaauguugccuu

SEQ ID NO: 255854 - RNA, 64 nt, hsa
cuccccugcuguuaguaacagucaccaaaauguucuaagcaacuacuuuccuagaguaucauuu

SEQ ID NO: 255855 - RNA, 64 nt, hsa
ugugggugacaugaucugagguucuauuugauuacuaagcaaaaucuguuaccccuacaggguu

SEQ ID NO: 255856 - RNA, 64 nt, hsa
uauuccugaaaauaaaaugaggggagaauauucccuaagcaacuggcaauaguauuccugaaau

SEQ ID NO: 255857 - RNA, 64 nt, hsa
caucuaugaauagcacuuuaugauguaggcuaaacuaagcaaauaaugcagcguuauguggauc

SEQ ID NO: 255858 - RNA, 64 nt, hsa
uauuuuuuaaaugccuuauggauaggaauuaguacuaagcaaugugucuugcauuuguuuucaa

SEQ ID NO: 255859 - RNA, 64 nt, hsa; identical to SEQ ID NO: 45886

SEQ ID NO: 255860 - RNA, 64 nt, hsa; identical to SEQ ID NO: 45887

SEQ ID NO: 255861 - RNA, 64 nt, hsa; identical to SEQ ID NO: 45888

SEQ ID NO: 255862 - RNA, 64 nt, hsa; identical to SEQ ID NO: 45889

SEQ ID NO: 255863 - RNA, 64 nt, hsa; identical to SEQ ID NO: 45890

SEQ ID NO: 255864 - RNA, 64 nt, hsa; identical to SEQ ID NO: 45891

SEQ ID NO: 255865 - RNA, 64 nt, hsa; identical to SEQ ID NO: 45892

SEQ ID NO: 255866 - RNA, 64 nt, hsa; identical to SEQ ID NO: 45893

SEQ ID NO: 255867 - RNA, 64 nt, hsa; identical to SEQ ID NO: 45894

SEQ ID NO: 255868 - RNA, 64 nt, hsa; identical to SEQ ID NO: 45895

SEQ ID NO: 255869 - RNA, 64 nt, hsa; identical to SEQ ID NO: 45896

SEQ ID NO: 255870 - RNA, 64 nt, hsa; identical to SEQ ID NO: 45897

SEQ ID NO: 255871 - RNA, 64 nt, hsa; identical to SEQ ID NO: 45898

SEQ ID NO: 255872 - RNA, 64 nt, hsa; identical to SEQ ID NO: 45899

SEQ ID NO: 255873 - RNA, 64 nt, hsa; identical to SEQ ID NO: 45900

SEQ ID NO: 255874 - RNA, 64 nt, hsa; identical to SEQ ID NO: 45901

SEQ ID NO: 255875 - RNA, 64 nt, hsa; identical to SEQ ID NO: 45902

SEQ ID NO: 255876 - RNA, 64 nt, hsa; identical to SEQ ID NO: 45903

SEQ ID NO: 255877 - RNA, 64 nt, hsa; identical to SEQ ID NO: 45904

SEQ ID NO: 255878 - RNA, 64 nt, hsa; identical to SEQ ID NO: 45905

SEQ ID NO: 255879 - RNA, 64 nt, hsa; identical to SEQ ID NO: 45906

SEQ ID NO: 255880 - RNA, 64 nt, hsa; identical to SEQ ID NO: 45907

SEQ ID NO: 255881 - RNA, 64 nt, hsa; identical to SEQ ID NO: 45908

SEQ ID NO: 255882 - RNA, 64 nt, hsa; identical to SEQ ID NO: 45909

SEQ ID NO: 255883 - RNA, 64 nt, hsa; identical to SEQ ID NO: 45910

SEQ ID NO: 255884 - RNA, 64 nt, hsa; identical to SEQ ID NO: 45911

SEQ ID NO: 255885 - RNA, 64 nt, hsa; identical to SEQ ID NO: 45912

SEQ ID NO: 255886 - RNA, 64 nt, hsa; identical to SEQ ID NO: 45913

SEQ ID NO: 255887 - RNA, 64 nt, hsa; identical to SEQ ID NO: 45914

SEQ ID NO: 255888 - RNA, 64 nt, hsa; identical to SEQ ID NO: 45915

SEQ ID NO: 255889 - RNA, 64 nt, hsa; identical to SEQ ID NO: 45916

SEQ ID NO: 255890 - RNA, 64 nt, hsa; identical to SEQ ID NO: 45917

SEQ ID NO: 255891 - RNA, 64 nt, hsa; identical to SEQ ID NO: 45918

SEQ ID NO: 255892 - RNA, 64 nt, hsa; identical to SEQ ID NO: 45919

SEQ ID NO: 255893 - RNA, 64 nt, hsa; identical to SEQ ID NO: 45920

SEQ ID NO: 255894 - RNA, 64 nt, hsa; identical to SEQ ID NO: 45921

SEQ ID NO: 255895 - RNA, 64 nt, hsa; identical to SEQ ID NO: 45922

SEQ ID NO: 255896 - RNA, 64 nt, hsa; identical to SEQ ID NO: 45923

SEQ ID NO: 255897 - RNA, 64 nt, hsa; identical to SEQ ID NO: 45924

SEQ ID NO: 255898 - RNA, 64 nt, hsa; identical to SEQ ID NO: 45925

SEQ ID NO: 255899 - RNA, 64 nt, hsa; identical to SEQ ID NO: 45926

SEQ ID NO: 255900 - RNA, 64 nt, hsa; identical to SEQ ID NO: 45927

SEQ ID NO: 255901 - RNA, 64 nt, hsa; identical to SEQ ID NO: 45928

SEQ ID NO: 255902 - RNA, 64 nt, hsa; identical to SEQ ID NO: 45929

SEQ ID NO: 255903 - RNA, 64 nt, hsa; identical to SEQ ID NO: 45930

SEQ ID NO: 255904 - RNA, 64 nt, hsa; identical to SEQ ID NO: 45931

SEQ ID NO: 255905 - RNA, 64 nt, hsa; identical to SEQ ID NO: 45932

SEQ ID NO: 255906 - RNA, 64 nt, hsa; identical to SEQ ID NO: 45933

SEQ ID NO: 255907 - RNA, 64 nt, hsa; identical to SEQ ID NO: 45934

SEQ ID NO: 255908 - RNA, 64 nt, hsa; identical to SEQ ID NO: 45935

SEQ ID NO: 255909 - RNA, 64 nt, hsa; identical to SEQ ID NO: 45936

SEQ ID NO: 255910 - RNA, 64 nt, hsa; identical to SEQ ID NO: 45937

SEQ ID NO: 255911 - RNA, 64 nt, hsa; identical to SEQ ID NO: 45938

SEQ ID NO: 255912 - RNA, 64 nt, hsa; identical to SEQ ID NO: 45939

SEQ ID NO: 255913 - RNA, 64 nt, hsa; identical to SEQ ID NO: 45940

SEQ ID NO: 255914 - RNA, 64 nt, hsa; identical to SEQ ID NO: 45941

SEQ ID NO: 255915 - RNA, 64 nt, hsa; identical to SEQ ID NO: 45942

SEQ ID NO: 255916 - RNA, 64 nt, hsa; identical to SEQ ID NO: 45943

SEQ ID NO: 255917 - RNA, 64 nt, hsa; identical to SEQ ID NO: 45944

SEQ ID NO: 255918 - RNA, 64 nt, hsa; identical to SEQ ID NO: 45945

SEQ ID NO: 255919 - RNA, 64 nt, hsa; identical to SEQ ID NO: 45946

SEQ ID NO: 255920 - RNA, 64 nt, hsa; identical to SEQ ID NO: 45947

SEQ ID NO: 255921 - RNA, 64 nt, hsa; identical to SEQ ID NO: 45948

SEQ ID NO: 255922 - RNA, 64 nt, hsa; identical to SEQ ID NO: 45949

SEQ ID NO: 255923 - RNA, 64 nt, hsa; identical to SEQ ID NO: 45950

SEQ ID NO: 255924 - RNA, 64 nt, hsa; identical to SEQ ID NO: 45951

SEQ ID NO: 255925 - RNA, 64 nt, hsa; identical to SEQ ID NO: 45952

SEQ ID NO: 255926 - RNA, 64 nt, hsa; identical to SEQ ID NO: 45953

SEQ ID NO: 255927 - RNA, 64 nt, hsa; identical to SEQ ID NO: 45954

SEQ ID NO: 255928 - RNA, 64 nt, hsa; identical to SEQ ID NO: 45955

SEQ ID NO: 255929 - RNA, 64 nt, hsa; identical to SEQ ID NO: 45956

SEQ ID NO: 255930 - RNA, 64 nt, hsa; identical to SEQ ID NO: 45957

SEQ ID NO: 255931 - RNA, 64 nt, hsa; identical to SEQ ID NO: 45958

SEQ ID NO: 255932 - RNA, 64 nt, hsa; identical to SEQ ID NO: 45959

SEQ ID NO: 255933 - RNA, 64 nt, hsa; identical to SEQ ID NO: 45960

SEQ ID NO: 255934 - RNA, 64 nt, hsa; identical to SEQ ID NO: 45961

SEQ ID NO: 255935 - RNA, 64 nt, hsa; identical to SEQ ID NO: 45962

SEQ ID NO: 255936 - RNA, 64 nt, hsa; identical to SEQ ID NO: 45963

SEQ ID NO: 255937 - RNA, 64 nt, hsa; identical to SEQ ID NO: 45964

SEQ ID NO: 255938 - RNA, 64 nt, hsa; identical to SEQ ID NO: 45965

SEQ ID NO: 255939 - RNA, 64 nt, hsa; identical to SEQ ID NO: 45966

SEQ ID NO: 255940 - RNA, 64 nt, hsa; identical to SEQ ID NO: 45967

SEQ ID NO: 255941 - RNA, 64 nt, hsa; identical to SEQ ID NO: 45968

SEQ ID NO: 255942 - RNA, 64 nt, hsa; identical to SEQ ID NO: 45969

SEQ ID NO: 255943 - RNA, 64 nt, hsa; identical to SEQ ID NO: 45970

SEQ ID NO: 255944 - RNA, 64 nt, hsa; identical to SEQ ID NO: 45971

SEQ ID NO: 255945 - RNA, 64 nt, hsa; identical to SEQ ID NO: 45972

SEQ ID NO: 255946 - RNA, 64 nt, hsa; identical to SEQ ID NO: 45973

SEQ ID NO: 255947 - RNA, 64 nt, hsa; identical to SEQ ID NO: 45974

SEQ ID NO: 255948 - RNA, 64 nt, hsa; identical to SEQ ID NO: 45975

SEQ ID NO: 255949 - RNA, 64 nt, hsa; identical to SEQ ID NO: 45976

SEQ ID NO: 255950 - RNA, 64 nt, hsa; identical to SEQ ID NO: 45977

SEQ ID NO: 255951 - RNA, 64 nt, hsa; identical to SEQ ID NO: 45978

SEQ ID NO: 255952 - RNA, 64 nt, hsa; identical to SEQ ID NO: 45979

SEQ ID NO: 255953 - RNA, 64 nt, hsa; identical to SEQ ID NO: 45980

SEQ ID NO: 255954 - RNA, 64 nt, hsa; identical to SEQ ID NO: 45981

SEQ ID NO: 255955 - RNA, 64 nt, hsa; identical to SEQ ID NO: 45982

SEQ ID NO: 255956 - RNA, 64 nt, hsa; identical to SEQ ID NO: 45983

SEQ ID NO: 255957 - RNA, 64 nt, hsa; identical to SEQ ID NO: 45984

SEQ ID NO: 255958 - RNA, 64 nt, hsa; identical to SEQ ID NO: 45985

SEQ ID NO: 255959 - RNA, 64 nt, hsa; identical to SEQ ID NO: 45986

SEQ ID NO: 255960 - RNA, 64 nt, hsa; identical to SEQ ID NO: 45987

SEQ ID NO: 255961 - RNA, 64 nt, hsa; identical to SEQ ID NO: 45988

SEQ ID NO: 255962 - RNA, 64 nt, hsa; identical to SEQ ID NO: 45989

SEQ ID NO: 255963 - RNA, 64 nt, hsa; identical to SEQ ID NO: 45984

SEQ ID NO: 255964 - RNA, 64 nt, hsa; identical to SEQ ID NO: 45983

SEQ ID NO: 255965 - RNA, 64 nt, hsa; identical to SEQ ID NO: 45992

SEQ ID NO: 255966 - RNA, 64 nt, hsa; identical to SEQ ID NO: 45993

SEQ ID NO: 255967 - RNA, 64 nt, hsa; identical to SEQ ID NO: 45994

SEQ ID NO: 255968 - RNA, 64 nt, hsa; identical to SEQ ID NO: 45995

SEQ ID NO: 255969 - RNA, 64 nt, hsa; identical to SEQ ID NO: 45996

SEQ ID NO: 255970 - RNA, 64 nt, hsa; identical to SEQ ID NO: 45997

SEQ ID NO: 255971 - RNA, 64 nt, hsa; identical to SEQ ID NO: 45998

SEQ ID NO: 255972 - RNA, 64 nt, hsa; identical to SEQ ID NO: 45999

SEQ ID NO: 255973 - RNA, 64 nt, hsa; identical to SEQ ID NO: 46000

SEQ ID NO: 255974 - RNA, 64 nt, hsa; identical to SEQ ID NO: 46001

SEQ ID NO: 255975 - RNA, 64 nt, hsa; identical to SEQ ID NO: 46002

SEQ ID NO: 255976 - RNA, 64 nt, hsa; identical to SEQ ID NO: 46003

SEQ ID NO: 255977 - RNA, 64 nt, hsa; identical to SEQ ID NO: 46004

SEQ ID NO: 255978 - RNA, 64 nt, hsa; identical to SEQ ID NO: 46005

SEQ ID NO: 255979 - RNA, 62 nt, hsa; identical to SEQ ID NO: 46006

SEQ ID NO: 255980 - RNA, 64 nt, hsa; identical to SEQ ID NO: 46007

SEQ ID NO: 255981 - RNA, 64 nt, hsa; identical to SEQ ID NO: 46008

SEQ ID NO: 255982 - RNA, 64 nt, hsa; identical to SEQ ID NO: 46009

SEQ ID NO: 255983 - RNA, 64 nt, hsa; identical to SEQ ID NO: 46010

SEQ ID NO: 255984 - RNA, 64 nt, hsa; identical to SEQ ID NO: 46011

SEQ ID NO: 255985 - RNA, 64 nt, hsa; identical to SEQ ID NO: 46012

SEQ ID NO: 255986 - RNA, 64 nt, hsa
caaagcuguaaagaccauugucuuaaauacuacaacaacuuaacacccuuuugugaagaucaca

SEQ ID NO: 255987 - RNA, 64 nt, hsa
acuucucaguugccaaucuuugcucauauuaaaaacaacuuacaaauacuuaguuuuuguaucu

SEQ ID NO: 255988 - RNA, 64 nt, hsa
cauauuuaguaugguuauagucaacacagagaucacaacuuagaagaaauauaaagaaauggcc

SEQ ID NO: 255989 - RNA, 64 nt, hsa
uaucacugaauuacauuuaucugaagaaaauaguacaacuuaauggauuagcuuuuggguuuaa

SEQ ID NO: 255990 - RNA, 64 nt, hsa
aaaaauuaagaagacaacuuacaaaaucaagaugacaacuuauaaaggcaucauugaggaugau

SEQ ID NO: 255991 - RNA, 64 nt, hsa
aaggcuucuauuuggaggaagaaaaauuaagaagacaacuuacaaaaucaagaugacaacuuau

SEQ ID NO: 255992 - RNA, 64 nt, hsa
gacguuuccuugaguugcuacuucguucaucuucacaacuuaacaagugcacggucgaauuauu

SEQ ID NO: 255993 - RNA, 64 nt, hsa
accgggaugaacccaccaccacaaagcaaauuagacaacuuaaugugaaaucauaccauugguu

SEQ ID NO: 255994 - RNA, 64 nt, hsa
auuauaagggagagcugagccaguuguccuauggacaacuuauuuaaaaauauuucagauauca

SEQ ID NO: 255995 - RNA, 64 nt, hsa
uuaaucaacuguagguuauuuaaaauaaauuccuacaacuuaauggaaacuuaagugucugccu

SEQ ID NO: 255996 - RNA, 63 nt, hsa
acaccauccacucacuccaacaaagaacacuuagaaugauaaaaaaaaaaaaaaaaaaccuga

SEQ ID NO: 255997 - RNA, 63 nt, hsa
uuuagagaagucccugauuccuucuuaaacuuggaaugauagaugaaauucacaccccugcag

SEQ ID NO: 255998 - RNA, 60 nt, hsa
gaagaaaauuccauuuauaaaguacugagagaaugauauuggauuuugcugaacaggccu

SEQ ID NO: 255999 - RNA, 63 nt, hsa
cucacugcauuuaauaaauauuuaauaaaugaugaaugauagaaguuuccaucuacaauauau

SEQ ID NO: 256000 - RNA, 63 nt, hsa
ggaaagggacuauaaaaguguacaauguuaauggaaugauacgguaccugaaagccuuguuuu

SEQ ID NO: 256001 - RNA, 63 nt, hsa
ugagccucucccagcuccacuucuaaugcuagagaaugauaacuaagacuucugugcauuuga

SEQ ID NO: 256002 - RNA, 63 nt, hsa
guuuucucauuauuuaugaaacuuaaccauacagaaugauauaacuccugugcaaugaaggug

SEQ ID NO: 256003 - RNA, 63 nt, hsa
agccccaccagcuucaggacuucugccaauuuugaaugauauagcugcaccaacaauaucccg

SEQ ID NO: 256004 - RNA, 63 nt, hsa
guuaaccuagaaauguagcuugcuaauaagauagaaugauacaaaagugaaguaguagccaca

SEQ ID NO: 256005 - RNA, 63 nt, hsa
caagccugguacucaguaaauauuuguugaaaugaaugauaagagcauugguccccaagccag

SEQ ID NO: 256006 - RNA, 63 nt, hsa
aagcaggcuguuugcucacuucuucaaaaggaggaaugauaacccaaaucugcccaagugaca

SEQ ID NO: 256007 - RNA, 63 nt, hsa
gguuugcuuuggaaaaugccugucucucuacuugaaugauaaagaauuaaauuagaucucucu

SEQ ID NO: 256008 - RNA, 63 nt, hsa
gacugaaguuccagcuuuacuuuuuauaaacuugaaugauaaagaauagaccaugggcuacua

SEQ ID NO: 256009 - RNA, 63 nt, hsa
ugccauacuguuuuuaaaguucaugaucaucuggaaugauacuuaguguauauauauuuugua

SEQ ID NO: 256010 - RNA, 63 nt, hsa
ugauucuucuggguuuauacugguuguaaaacagaaugauauuagaaaauguuuuccuuguuu

SEQ ID NO: 256011 - RNA, 63 nt, hsa
uaguugcuucccacugccccccgcccgcccccagaaugauauuaauuuugccuuuuuuuuuuu

SEQ ID NO: 256012 - RNA, 63 nt, hsa
ggcacucaauaaaugcugaaugggugaauaguugaaugauaggugcucaauaaaugaaugaau

SEQ ID NO: 256013 - RNA, 63 nt, hsa
uucucauugggagaguaagguacccccaucccagaaugauaacugcacaguggcagaacaaac

SEQ ID NO: 256014 - RNA, 63 nt, hsa
cggcccaggcccaucuuccaaagcaagaggaaggaaugauaauggugacucaggggaagaaga

SEQ ID NO: 256015 - RNA, 63 nt, hsa
ugcagugaagguucucuacagcuaagccuguuugaaugauacguagguuccccaccaaaagca

SEQ ID NO: 256016 - RNA, 63 nt, hsa
ggagaauucauaacauuugaagaucaaaaaauugaaugauaaauaugaauggcuuuucaauuc

SEQ ID NO: 256017 - RNA, 63 nt, hsa
auaacucaccuggcaucuuacaucugaaauaaggaaugauauaagguuuuuuuuucucacaga

SEQ ID NO: 256018 - RNA, 63 nt, hsa
aacaaauauucuuggaucuuugaucaaagccuggaaugauagcuuuaauaaaagaaggaaaaa

SEQ ID NO: 256019 - RNA, 63 nt, hsa
uuuaagugugcaaacaaguuagagcuggcagcugaaugauagacaaauagugcaaauuugcca

SEQ ID NO: 256020 - RNA, 63 nt, hsa
aagguuaaaauaggggagaaauccuacauguuggaaugauagcuuuuuggaaaauuuaagaaa

SEQ ID NO: 256021 - RNA, 63 nt, hsa
ccgaaaaauguuucuucagcuugagaaauuuuagaaugauaggaaguuucucgaguuagccuu

SEQ ID NO: 256022 - RNA, 63 nt, hsa
aaauauguauaaauauaugaugcugagucuguggaaugauacuucugaaaucaaaauuccuca

SEQ ID NO: 256023 - RNA, 63 nt, hsa
aucuuuugugacuuugagccuuuuaaguaguuugaaugauaagacuuaaaauguuucauaauu

SEQ ID NO: 256024 - RNA, 63 nt, hsa
acgugggaucucaguaugguacuuggacagcaggaaugauacauauaaucugaacuugggaaa

SEQ ID NO: 256025 - RNA, 63 nt, hsa
agaaacuggaggcugcaacaggagggaaaggcagaaugauaucacagcaguacuauuuuuuuu

SEQ ID NO: 256026 - RNA, 63 nt, hsa
uuccugggacucaaauguaugcaguacuauucagaaugauauacacacauauguguauaugua

SEQ ID NO: 256027 - RNA, 63 nt, hsa
auauuuggaggauauugaaagugugaaaaaaaagaaugauaaucuuuuaaaggcucuacaauu

SEQ ID NO: 256028 - RNA, 63 nt, hsa
cauuucaccccacaugacuaggaauccacaucagaaugauacagaguuagcagguuuuucuaa

SEQ ID NO: 256029 - RNA, 63 nt, hsa
ucuguaagcuucauccaugcugguuauugcacugaaugauauauuauuagggcauguuaacag

SEQ ID NO: 256030 - RNA, 63 nt, hsa
uuuuaaaugaguuaaugaaucugccagaucugugaaugauagagauuaugcuaaauuaaugcu

SEQ ID NO: 256031 - RNA, 63 nt, hsa
ggagauaaacagccaaauagcaaauaggucacugaaugauaagauuugcaccuuagaacaaua

SEQ ID NO: 256032 - RNA, 52 nt, hsa
gccauaguccagugggauaaaggaaugauaaacuguauauaacuguaaaaua

SEQ ID NO: 256033 - RNA, 63 nt, hsa
cuaaaacacaaugugaaaauguaucugaguauugaaugauaauucagucuugccuuugaaggg

SEQ ID NO: 256034 - RNA, 63 nt, hsa
gaacuugaagauuaauaaaauaugcucuucagagaaugauauauaaauauugcauguuugcuu

SEQ ID NO: 256035 - RNA, 63 nt, hsa
uuucaaguacaaggucaauacauaagccagagugaaugauacuacaaguugagcaucucuaau

SEQ ID NO: 256036 - RNA, 63 nt, hsa
uaagaccuccucccaagcacuucaaaggaacuggaaugauaauggaaacugucaagagggggc

SEQ ID NO: 256037 - RNA, 63 nt, hsa
uuuuuccuuaaguauaaaaaaaaaguaucagaagaaugauaccauuuuuaaaggcuucauucc

SEQ ID NO: 256038 - RNA, 63 nt, hsa
ucauuugugauauuauaaaacauguuuaacucagaaugauaugugaggccagcagucagaaua

SEQ ID NO: 256039 - RNA, 63 nt, hsa
agauuaggauugacaaguaaagauacugcuauggaaugauacauuguauuuucugcauugugu

SEQ ID NO: 256040 - RNA, 63 nt, hsa
ccugccucagaaaaagcuuuuccauuacacugugaaugauaccuguuuuguuguuucugaauu

SEQ ID NO: 256041 - RNA, 63 nt, hsa
uuuaaaggaagauacagaggugauuguacuucagaaugauaaacccauauaccaccuaaaauc

SEQ ID NO: 256042 - RNA, 63 nt, hsa
ugaaggaacucaugaaaauccugaguuaauuuggaaugauaauuccagagauaaaguguccac

SEQ ID NO: 256043 - RNA, 63 nt, hsa
ugguuugaauuggaugcagugugggccauccuggaaugauacugacugauuaauuauuccuga

SEQ ID NO: 256044 - RNA, 63 nt, hsa
aaacaaauuucaauugcuugaagcaauuguucugaaugauacuuuuucauucacauucaagaa

SEQ ID NO: 256045 - RNA, 63 nt, hsa
aaaauagccaaagauaggagacgucugaauuuugaaugauaaacagugauguuuuaaaaaagc

SEQ ID NO: 256046 - RNA, 63 nt, hsa
uuucugcaaauuauucagccuccaaaugcaaaugaaugauauaaaaauaaguagggaacaugg

SEQ ID NO: 256047 - RNA, 63 nt, hsa
cuuucuaaaguguguguauguuugugugaaugugaaugauacugaucuuauaucuguuaaaag

SEQ ID NO: 256048 - RNA, 63 nt, hsa
aauaaccaggggcacaugggggaacguggaugggaaugauaguguaucucagcgggggguggg

SEQ ID NO: 256049 - RNA, 63 nt, hsa
caggcauccugguguccugagaggcucuugcaggaaugauacguggcagugccugcagcgagg

SEQ ID NO: 256050 - RNA, 55 nt, hsa
uguuauuacuuuuacagugaaauuagaaugauauuuucaucuccugcuugucuga

SEQ ID NO: 256051 - RNA, 63 nt, hsa
cauugcaagcuggcaaauuuauguagcuauguggaaugauaugucauaauguaaaauuagaua

SEQ ID NO: 256052 - RNA, 63 nt, hsa
acaugaacacagcugcugaagaggcaagagacagaaugauauccaguaagcacauguuuauuc

SEQ ID NO: 256053 - RNA, 63 nt, hsa
uaacuguuguauugugacuaaguacaacuuuuggaaugauaccugaagaauuauuaguaauag

SEQ ID NO: 256054 - RNA, 63 nt, hsa
aucucaaucuucaguuuuggccuucugucagcagaaugauaagugcaauaguuguaaaucuac

SEQ ID NO: 256055 - RNA, 63 nt, hsa
aaagcagagccacugucuaacacagcuguuaacgaaugauaaacugacauuauacucuaaaag

SEQ ID NO: 256056 - RNA, 63 nt, hsa
acacuugaaaaagauaaggucaugggggcggaugaaugauaucccucacucauuuagccauuc

SEQ ID NO: 256057 - RNA, 63 nt, hsa
aaaguaauaaaacuuaguuuauauaaacagguugaaugauauauuuaucaaaucucacagaca

SEQ ID NO: 256058 - RNA, 63 nt, hsa
aguauaacuggcuuaguaaguauauccuacucugaaugauaaaaauauagucaagcuaaaaua

SEQ ID NO: 256059 - RNA, 63 nt, hsa
caguugagaaaauuugaauguggauuagauuuugaaugauauuggauaauuauugguaauuuu

SEQ ID NO: 256060 - RNA, 63 nt, hsa; identical to SEQ ID NO: 256059

SEQ ID NO: 256061 - RNA, 63 nt, hsa
ucuaccaaguuuucaccuuguuucaggucagaggaaugauagaauuugucauuuuucuuacaa

SEQ ID NO: 256062 - RNA, 63 nt, hsa
guuuugaaagucuuuaacuaaauuaagauugcagaaugauagugauuauucaauuagauuuua

SEQ ID NO: 256063 - RNA, 63 nt, hsa
cauuuuuuagugucacacugacuuuuaaaauuugaaugauauauagacuuuguuuuuuuaaug

SEQ ID NO: 256064 - RNA, 63 nt, hsa
guugcuaaauucuccauggacauagagagaaaggaaugauauucucaucaucaucuucaucau

SEQ ID NO: 256065 - RNA, 63 nt, hsa
ucuguaaaagauuuguccaauaaacgacuuaaugaaugauacaucagucagauuuuaggaagg

SEQ ID NO: 256066 - RNA, 63 nt, hsa
ccugaccuuuagucuuucacuuccaauuuuguggaaugauauuuuaggaauaacggacuuuua

SEQ ID NO: 256067 - RNA, 63 nt, hsa
uucuucagccacugacugcuuggguugggcugugaaugauaauggaauggcuggagucugcug

SEQ ID NO: 256068 - RNA, 63 nt, hsa
gugaugcugucagccacagcuuccugccguagagaaugauagagcagcugcucacacaggagg

SEQ ID NO: 256069 - RNA, 63 nt, hsa
uuuuuuuuuuuuaacaucuuuguuuuuaaaauagaaugauagaacuuugccagucuuuaagau

SEQ ID NO: 256070 - RNA, 63 nt, hsa
uagcuuuggugaaacugggguuuuguaaccucugaaugauauggacuuagugaauucuaagga

SEQ ID NO: 256071 - RNA, 63 nt, hsa
gaaaugccccgggggcagcaaacugacaugguugaaugauagcauuucacucugcguucuccu

SEQ ID NO: 256072 - RNA, 63 nt, hsa
uugcuuaaucaguaagucuuugugaaugaauacgaaugauacagauuuuuaaaaaaguaauaa

SEQ ID NO: 256073 - RNA, 63 nt, hsa
gacuuauauuuugaauggguucuagugaaaaaggaaugauauauucuugaagacaucgauaua

SEQ ID NO: 256074 - RNA, 63 nt, hsa
uagacagcagggaagauauuagugguaaagagugaaugauaguagugaauauaaauggggcug

SEQ ID NO: 256075 - RNA, 63 nt, hsa
acuaaaaauauauauagacaaaauuaaaagaaggaaugauaagaauaaauuuaauuuaccaaa

SEQ ID NO: 256076 - RNA, 63 nt, hsa
aagcaguuaaacugauuaguauucaggcacugagaaugauaguaauaggauacaauguauaag

SEQ ID NO: 256077 - RNA, 63 nt, hsa
aaagcuacauguaaaguucuuguacaaaaaauggaaugauagguugaucagauucaguaaagu

SEQ ID NO: 256078 - RNA, 63 nt, hsa
acucuagccaagaaaaagcuaauucuggggauagaaugauaaaagacucaagcacuaaaaaua

SEQ ID NO: 256079 - RNA, 63 nt, hsa
gucacauaaaggaagucuuaaguggaguucacagaaugauaauguaucuauuugucauuugug

SEQ ID NO: 256080 - RNA, 63 nt, hsa
gagaauacuuuaaagggaaguggaaguauaagugaaugauauuuuucuuuuacauguaaacaa

SEQ ID NO: 256081 - RNA, 55 nt, hsa
uaagugaauggaaugaaugauguuugaaugauauauaacaaaccaaaggauauua

SEQ ID NO: 256082 - RNA, 63 nt, hsa
uuuccuuuuucugaaauguaaucauugaugcuugaaugauagaauuuuaguacuguaaacagg

SEQ ID NO: 256083 - RNA, 63 nt, hsa
ucccaucucugcaagcagggauaacgguaaugagaaugauaauaaucauuauaugcagaccuu

SEQ ID NO: 256084 - RNA, 63 nt, hsa
gucacuacugaauuuugacaggaggaaggaauagaaugauagcuuguuuuauuuguaaagcuu

SEQ ID NO: 256085 - RNA, 63 nt, hsa
auuuuccuguuuuuauggaaacucugagaagcugaaugauacaugcaggggauauuuuuugag

SEQ ID NO: 256086 - RNA, 63 nt, hsa
ccaugggugcuuguugggccuuuuuccaguaaggaaugauauugcugaagaaucuacuuaacc

SEQ ID NO: 256087 - RNA, 63 nt, hsa
ucauucaguaguuacugaaagaaaacucugcuagaaugauaaaugucaugguggucuauaacu

SEQ ID NO: 256088 - RNA, 63 nt, hsa
guaaaugcuugauaaaucuuuaagauaugucuugaaugauaauuaggacauucaguccagugg

SEQ ID NO: 256089 - RNA, 63 nt, hsa
cauucaaccaacuguaaugcaggauuggaccaugaaugauaugcuagaauagaagaaagagaa

SEQ ID NO: 256090 - RNA, 63 nt, hsa
uuuuucucuuugcaaagacauagcuaggaaagcgaaugauaagggaaaaguucucagggaauu

SEQ ID NO: 256091 - RNA, 63 nt, hsa
uucuuagaauaagaagugcauucaauccuaggagaaugauaauccuggacaugggugaacaug

SEQ ID NO: 256092 - RNA, 63 nt, hsa
uggugacaaccuacuuugcuuggcugagugaaggaaugauauucauauauucauuuauuccau

SEQ ID NO: 256093 - RNA, 63 nt, hsa
uuggaaagcugaucuuuucugauauaaaauguugaaugauauuaucugguuuucugauauuuu

SEQ ID NO: 256094 - RNA, 63 nt, hsa
gcaguauuguuuucuuauaugugcaaugaaguggaaugauaaacaguaugccuuuaauuuaua

SEQ ID NO: 256095 - RNA, 63 nt, hsa
gaaaaaugcuuauguauugacagaacacuucuagaaugauacccaaacuccuggagugggagu

SEQ ID NO: 256096 - RNA, 63 nt, hsa
acauagcuaugcacuaugaaaauuaaauggaaugaaugauauguauauuacucaaaauaaagu

SEQ ID NO: 256097 - RNA, 63 nt, hsa
accagcacauucguuuuguucauauucacuauagaaugauaucuuguaaauaaagacauucag

SEQ ID NO: 256098 - RNA, 63 nt, hsa
ugagccacaggaaguuuggggcguggugaguuggaaugauacguccauuucucuaugaaauau

SEQ ID NO: 256099 - RNA, 63 nt, hsa
uuguagcuacuacauuccagacuggaaauguaugaaugauaaucaacauaaugcugauaaacu

SEQ ID NO: 256100 - RNA, 63 nt, hsa
gucccaaugucagaguucuuggaacagauaacugaaugauagauuuuuuuuuuuuaaagauaa

SEQ ID NO: 256101 - RNA, 63 nt, hsa
gcacucuaacaauguuuacuucuaaacuuuguugaaugauaauagaaagcacccuaauugacu

SEQ ID NO: 256102 - RNA, 63 nt, hsa
aagcaaaaagcguaguuucugauuuauguuauagaaugauacugauuagacuuugagccaagg

SEQ ID NO: 256103 - RNA, 63 nt, hsa
gucaugagauccuacuuaguaugauccuggcuagaaugauaauuaaaaguauuuaauuugaag

SEQ ID NO: 256104 - RNA, 63 nt, hsa
uuuauacaaaaggguuuuuguuuauagcuuaaggaaugauacugugcucugcuuggugcaugg

SEQ ID NO: 256105 - RNA, 63 nt, hsa
auaucuggaguacauuaaaagugugaaagaaaagaaugauaaucuucuaaaggcuauacaauu

SEQ ID NO: 256106 - RNA, 63 nt, hsa
gauggaucuguuggcggguuuuggauguguaaagaaugauauauauauuaaauaggucaauca

SEQ ID NO: 256107 - RNA, 63 nt, hsa
aucuucuccuuuuccugguugaacucccuaaaugaaugauauucauuccaacugcugccccuc

SEQ ID NO: 256108 - RNA, 63 nt, hsa
auacuacuuaauuacuuaagauguuuauuaauagaaugauaaauguacagaguaaccuauaag

SEQ ID NO: 256109 - RNA, 63 nt, hsa
cuucuagcuuugugucuuguuucagaccauguggaaugauaaauacucuuuuugugcuucuga

SEQ ID NO: 256110 - RNA, 63 nt, hsa
cucuacuguccuagaguauaacccuguuguaaagaaugauacacaagacaaacuuacccugau

SEQ ID NO: 256111 - RNA, 63 nt, hsa
aaaaaucagguuuuaaacaggaaaaccuauggggaaugauauuuuuugaaagacuuuuguaua

SEQ ID NO: 256112 - RNA, 63 nt, hsa
aagagggagggugucucacaaccaaccaguucagaaugauacggaacagcauuucccugcagc

SEQ ID NO: 256113 - RNA, 63 nt, hsa
cauugugauuuugguuugcauuucccugauggcgaaugauauugagcaucuuuucaugagcuu

SEQ ID NO: 256114 - RNA, 63 nt, hsa
uacuaugguuuucauuuacucuaaaaacugauugaaugauauauaaauauauuuauagccuga

SEQ ID NO: 256115 - RNA, 63 nt, hsa
uuuucaggacuugcugggucaccuuuuccugaggaaugauacagaagaguguuuuuucauaaa

SEQ ID NO: 256116 - RNA, 63 nt, hsa
ccaaaaaaauuuauaaacuaauuuuguacguaugaaugauaucuuugaccucaauggagguuu

SEQ ID NO: 256117 - RNA, 63 nt, hsa
ugcuguuuaccccaucucucucuuauaucacuugaaugauauauuguaagugagagguaaagg

SEQ ID NO: 256118 - RNA, 63 nt, hsa
uagcagaugauuucuguucaccugguaagaaaagaaugauaggcuugucagagccuauagcca

SEQ ID NO: 256119 - RNA, 63 nt, hsa
uucccauugcaccagcuuguccuccaaaaucaugaaugauacacaugaagauaacuuuuuuua

SEQ ID NO: 256120 - RNA, 63 nt, hsa
cauccaucccccuagcucaccacauagcacauagaaugauauuuuugauuuguaagaggccau

SEQ ID NO: 256121 - RNA, 63 nt, hsa
gugucuuugaaacuugaacauaaugugaaggcugaaugauagagauauuuucuguuguguugg

SEQ ID NO: 256122 - RNA, 63 nt, hsa
cucgggauuauugcucuucugucuauaaauuuugaaugauacugugccuuaauugguuuucau

SEQ ID NO: 256123 - RNA, 63 nt, hsa
auagauccauccaaaugauuucucuguacaaaugaaugauacuauuaaaaaaaaaaaaagcac

SEQ ID NO: 256124 - RNA, 63 nt, hsa
uuucaaugacuuucaauacuuccccugaaggaagaaugauaaggagaaaugucuguuuugagg

SEQ ID NO: 256125 - RNA, 63 nt, hsa
ucuacucauaaguauuuuuuucuauuuagacuugaaugauaaucuguuuuuugaucaguauau

SEQ ID NO: 256126 - RNA, 63 nt, hsa
uccauugcuuugaaaaaguuaaugcuuaagagggaaugauaugcauuugacuuguuaaacagc

SEQ ID NO: 256127 - RNA, 63 nt, hsa
caucauagaacauggcagucguuuuuguuccaagaaugauaugaaaggugaagaagaggccca

SEQ ID NO: 256128 - RNA, 63 nt, hsa
cucuuuaagaguuaguuucuuugggauugcuaugaaugauacccugaauuuggccugcacuaa

SEQ ID NO: 256129 - RNA, 63 nt, hsa
guuaucacuguaaaacacagaaaagugauuaaugaaugauaauuuagauccauuucuuuugug

SEQ ID NO: 256130 - RNA, 63 nt, hsa
ucucauuaaagugauugcugggagcaaaaacuagaaugauacaaagaaaggucagagaaaugc

SEQ ID NO: 256131 - RNA, 63 nt, hsa
auuugaccugcaguauugaaaaaggagaauucagaaugauacaguauuuuaacaaaucuuaau

SEQ ID NO: 256132 - RNA, 63 nt, hsa
gaaauauguauauaaauaucucuauauucuuuggaaugauacuaaagucucuggucuaggacc

SEQ ID NO: 256133 - RNA, 63 nt, hsa
ugucauuggguuccagcugcucuccuccacauugaaugauaucuuguuaauuuauaggcacau

SEQ ID NO: 256134 - RNA, 63 nt, hsa
uggaagccaaaaguucucuucccaaacugccaagaaugauacaggccauaauugaaaugggaa

SEQ ID NO: 256135 - RNA, 63 nt, hsa
cauguguauggggaaaauaguucugaaaggcuagaaugauacaagugagcaaaaguuggucag

SEQ ID NO: 256136 - RNA, 63 nt, hsa
uaauagaaaggaauacuauuauagcaaaucacagaaugauagacucaagcauaaaacuuggca

SEQ ID NO: 256137 - RNA, 63 nt, hsa
uaagaugaaaggagaacacugguuauguugauagaaugauaaaaagggucgggcgcggaggcu

SEQ ID NO: 256138 - RNA, 63 nt, hsa
uguuuaguucacaaguagauguaauuuacuaaagaaugauacacccauaugcuauauacagcu

SEQ ID NO: 256139 - RNA, 63 nt, hsa
accauaugaacauauauuuuuuagaaacuaagagaaugauaggcuuuuguucuuaugaacgaa

SEQ ID NO: 256140 - RNA, 63 nt, hsa
gauaggacuaaugacuaggaagccuaccccaaugaaugauauacuagaugaaauaguguucaa

SEQ ID NO: 256141 - RNA, 63 nt, hsa
ucacaccaauaugaugaugguuuucaugacuuugaaugauauauuuuuguacaucuagcugua

SEQ ID NO: 256142 - RNA, 63 nt, hsa
gacguguauccccgugaaaucugguuagauaaugaaugauaagcaggaaggauggcaagcacg

SEQ ID NO: 256143 - RNA, 63 nt, hsa
cagucagguuuguauuucugagcugucuauaaugaaugauauagaaggugguuucgaaggagg

SEQ ID NO: 256144 - RNA, 63 nt, hsa
uaaaacuauggucaacuucaacuugcauucucagaaugauagugccuuuaaaaauuuuuuuau

SEQ ID NO: 256145 - RNA, 63 nt, hsa
ugccugagucucaguguaggugucuguaaaauggaaugauaauagcuuccaucucacagauuc

SEQ ID NO: 256146 - RNA, 63 nt, hsa
auguucaauauuaucacugcacuuauaaaaaaagaaugauaugugagaagauggccaauccag

SEQ ID NO: 256147 - RNA, 63 nt, hsa
uuccaguucacgagggcaggggguuuaaaacaagaaugauaggccaggaaggcaguggggauc

SEQ ID NO: 256148 - RNA, 63 nt, hsa
guuccuaagggaaagggaagcacaugaucaugggaaugauagcccagaacaaaaagaaaucuu

SEQ ID NO: 256149 - RNA, 63 nt, hsa
uucuuaucaaagaaauaacccagacuuaaucuugaaugauacgauuaugcccaauauuaagua

SEQ ID NO: 256150 - RNA, 63 nt, hsa
uuguaucaaaaguauucaugaugacucuauuuggaaugauauucagggaaaucacaauaauau

SEQ ID NO: 256151 - RNA, 63 nt, hsa
gcauaaauauuagcugcucaaugauugauuguugaaugauagaugaaguauugcugaagccaa

SEQ ID NO: 256152 - RNA, 63 nt, hsa
auauuaacuauauaagagaguugugacaaaacagaaugauaaagcugcgaaccguggcacacg

SEQ ID NO: 256153 - RNA, 63 nt, hsa
ucuuauuuuuaagaaaaugguucugugaaaagugaaugauauguauuuuuccaaaugcuucau

SEQ ID NO: 256154 - RNA, 63 nt, hsa
uaaaaugaaaauugagaaauauaagaugaaaaggaaugauaaaaauaucuuuuagggggcuuu

SEQ ID NO: 256155 - RNA, 63 nt, hsa
aucucucucucaacaaaagguauaugccuucaggaaugauauaaucugucccauuuucgaggc

SEQ ID NO: 256156 - RNA, 63 nt, hsa
auauaguucuaaaaauaaguuucuuccugagaagaaugauacuguuuaugaugaauccauagu

SEQ ID NO: 256157 - RNA, 63 nt, hsa
agggcuaaaacugggcuacagaauuuucaaaaagaaugauacauucugaagguauguuuauaa

SEQ ID NO: 256158 - RNA, 63 nt, hsa
uuauuaagcaucugugggaauauacaguugggggaaugauaaucugguuuauuuuuucuguaa

SEQ ID NO: 256159 - RNA, 63 nt, hsa
uguaguuucuuuucuguaaaaugggaucuggacgaaugauaccaaacguuucuuucuaacauu

SEQ ID NO: 256160 - RNA, 63 nt, hsa
agggugcgauugaaugaguauugagacugaggagaaugauagagagugaagcagaaacaggag

SEQ ID NO: 256161 - RNA, 63 nt, hsa
uaauuugguauuacauguauucuauuuuuuucugaaugauagcaugaaaagugucaaaguggu

SEQ ID NO: 256162 - RNA, 63 nt, hsa
acuuuaccaauuguuacuuucaaugugaggaaugaaugauaaauuaagagaaaaaaauaucag

SEQ ID NO: 256163 - RNA, 63 nt, hsa
uuuugauuauugcauuguauuuuaauuugugcagaaugauaaagaauguuccuuuuagaagug

SEQ ID NO: 256164 - RNA, 63 nt, hsa
gaugcugaaauguccagaaaagaaggacauuuagaaugauaucuuguuuguccuuuucugugg

SEQ ID NO: 256165 - RNA, 63 nt, hsa
gaguucaguguaagcauggaagcuagugauucugaaugauauauauauccauugcauguugaa

SEQ ID NO: 256166 - RNA, 63 nt, hsa
aacauaauucugcacuuuggaaucaguucauuagaaugauaacauuuauauggauaaagaugc

SEQ ID NO: 256167 - RNA, 63 nt, hsa
auauuuggaggaaauugaaaguguggaaaaaaagaaugauaaucuuuuaaagggucuacaacu

SEQ ID NO: 256168 - RNA, 63 nt, hsa
ucuccuccaccuucaccccaagacuaggggcaggaaugauaagaaggcugggugguagcuggg

SEQ ID NO: 256169 - RNA, 63 nt, hsa
aacagcaaugcuaguaacaggaugggaacaugggaaugauaauauauauuuuuucuuuuaaua

SEQ ID NO: 256170 - RNA, 63 nt, hsa
ugaguucuuacaaacuguuuguuauauuuucuggaaugauaagugagaauuauuuagaaaaga

SEQ ID NO: 256171 - RNA, 63 nt, hsa
caaaagcaauuguuuuuaaauuaacaauggagagaaugauaagaugagggaaggaaaaggcau

SEQ ID NO: 256172 - RNA, 63 nt, hsa; identical to SEQ ID NO: 256167

SEQ ID NO: 256173 - RNA, 63 nt, hsa
cuaaauauuuauuuagagaaugauuuuaaaagggaaugauaugcuuguuuaaaugaaagagaa

SEQ ID NO: 256174 - RNA, 63 nt, hsa
uguuuugaauggauuaccuguagugacucauuggaaugauauaauuauacaaguaaugccaaa

SEQ ID NO: 256175 - RNA, 63 nt, hsa
ucaccugguugcucuggaagcucuugcugauaggaaugauagcaacacugaaagagcguggga

SEQ ID NO: 256176 - RNA, 63 nt, hsa
aauguaucaauguauuagauaaacccaguuucagaaugauaaagaaaaaauguuagaccaaau

SEQ ID NO: 256177 - RNA, 63 nt, hsa
ccugaaucugugcauuuugugccuuauucaugagaaugauagaaguacuaaaaucugucaagu

SEQ ID NO: 256178 - RNA, 63 nt, hsa
gauccuagcugcagaucgcaucccacaaugcgagaaugauaaaauaaaauuggauauuugaga

SEQ ID NO: 256179 - RNA, 63 nt, hsa; identical to SEQ ID NO: 256176

SEQ ID NO: 256180 - RNA, 63 nt, hsa
aauuuaucaauguauuacacaaauccaguuucagaaugauaaaaaauguuagaccaaauaaug

SEQ ID NO: 256181 - RNA, 63 nt, hsa
aguugauuccuccaauaugggccagaugcuuuugaaugauagggaaaucuacauaaaauccag

SEQ ID NO: 256182 - RNA, 63 nt, hsa
uguacacaacaaagguacagccaugggaauacagaaugauagaagagacuacagauggauaau

SEQ ID NO: 256183 - RNA, 63 nt, hsa
ggauacuaagaaaauagaagguaaagaugagaagaaugauaauggagcaaguggccaaacauc

SEQ ID NO: 256184 - RNA, 63 nt, hsa
ggacacagccauccagcggcaucuuuccuugucgaaugauacuguaaugaccuuccaaaguga

SEQ ID NO: 256185 - RNA, 63 nt, hsa
cauguuucaucuucauuuuuaauauccugaacugaaugauaguguuuuuuuagaugaagaacu

SEQ ID NO: 256186 - RNA, 63 nt, hsa
guuugcuauauuccuuuuucuaugaaauaaugugaaugauaauaaaacagcuuugacuugauu

SEQ ID NO: 256187 - RNA, 63 nt, hsa
cccauuuacuguauuuuuuuuaaugaaauaugugaaugauaauaaaaguugcugacuuaaugc

SEQ ID NO: 256188 - RNA, 63 nt, hsa
cuccaggaaacuuguccuucuggaaaucauauugaaugauauuucuauaucgaagugagguag

SEQ ID NO: 256189 - RNA, 63 nt, hsa
guaggaaacuguacuuuaucucggcauccucuugaaugauagugcaaguuucuccaguuggga

SEQ ID NO: 256190 - RNA, 63 nt, hsa
gguugucuagguaaugacaguaaacugacuguagaaugauaauugugguauagugaccaauag

SEQ ID NO: 256191 - RNA, 63 nt, hsa
uggugggacuuggucuggagcagggacuacuuggaaugauaaaggcaaaacucaacagccccu

SEQ ID NO: 256192 - RNA, 63 nt, hsa
agccuaccaaauuucaugcuguugguuugccaugaaugauauuacuuccuacauuauauuugu

SEQ ID NO: 256193 - RNA, 63 nt, hsa
ucaagcccugcuuaaaguuaaauaaaauagaaugaaugauaccccggcuccauuucccccacu

SEQ ID NO: 256194 - RNA, 63 nt, hsa
acuucugaaaaguucugcucuaucucaaagacugaaugauacuacacaguccucucccuauua

SEQ ID NO: 256195 - RNA, 63 nt, hsa
cauuccacuuagugucuuuucaaugauaggcaagaaugauaucugaguugaacuucggugcuu

SEQ ID NO: 256196 - RNA, 63 nt, hsa
cagagaacgguguuugagucagcuugucugauugaaugauaaugugcuaaauugauuaccucc

SEQ ID NO: 256197 - RNA, 63 nt, hsa
ugggagcugcgcuaugaagauacaaaggcacaagaaugauacaauggauuuuggggacuuagg

SEQ ID NO: 256198 - RNA, 63 nt, hsa
gaagaaagggccuucacaguguccuuuauguaagaaugauauaaccaaaagguauauaauuug

SEQ ID NO: 256199 - RNA, 63 nt, hsa
agaaaugucuuuucaucuuuuucuggaggagacgaaugauagggccugguuuacauucauuua

SEQ ID NO: 256200 - RNA, 63 nt, hsa
gacccaauggugcuggaaaaaguucaucuauuagaaugauaucugggaucacaaagccaacug

SEQ ID NO: 256201 - RNA, 63 nt, hsa
gcuaccuuacauuucugcguauauaugaaaacugaaugauauuucucaguguauuuccuugca

SEQ ID NO: 256202 - RNA, 63 nt, hsa
agauugagcaauagaaaaaaauuccuuuccuuugaaugauagcugugauucaccccaccccau

SEQ ID NO: 256203 - RNA, 63 nt, hsa
auacacaaugaagaauucuauuuggcuaauuaagaaugauauacuauguacacccaauaagcu

SEQ ID NO: 256204 - RNA, 63 nt, hsa
gcaaauaagccagcagaugggugaagagguccagaaugauaugcaaaaacuacuuuuuagaga

SEQ ID NO: 256205 - RNA, 63 nt, hsa
gugcguguacuguuucuaaaaaccacaaacuaagaaugauaaauuaucaauauaguuuaguau

SEQ ID NO: 256206 - RNA, 63 nt, hsa
aucccagaauuguugaggggggaucaaguugcagaaugauacagauaguacaaugacuuuuuu

SEQ ID NO: 256207 - RNA, 63 nt, hsa
ucaagagaacacacaacagagaaacccuauaaagaaugauacaauauguuucaaucagaaccu

SEQ ID NO: 256208 - RNA, 63 nt, hsa
uauguugugaauuuuccuugguucuuuuuaaaggaaugauaauaaaguuacuugcuuuaggau

SEQ ID NO: 256209 - RNA, 63 nt, hsa
caaagaagaauccagaaauaggggcacauugaggaaugauacugagcccaaagagcauucaau

SEQ ID NO: 256210 - RNA, 63 nt, hsa
agucuuuuuaaauaugcucuguuaguuuguauggaaugauauuucauugcacuuuuaauuuaa

SEQ ID NO: 256211 - RNA, 63 nt, hsa
uuuacuguggauuagguauagugccaacaaauugaaugauaaaacaacauaauacguaguuau

SEQ ID NO: 256212 - RNA, 63 nt, hsa
accaaauucuucauaagaaagaucauauuaugggaaugauaauccuguuuacuguggauuagg

SEQ ID NO: 256213 - RNA, 63 nt, hsa
uugauugggauguuauauuugagaaaauacagagaaugauagauuaacggagugucuaaucua

SEQ ID NO: 256214 - RNA, 63 nt, hsa
auccggucuaugccuucugcaccaagaagaagugaaugauauuuuucaucaauguuaucagau

SEQ ID NO: 256215 - RNA, 63 nt, hsa
uauaaauaaaauauauauauuuuauaaagaucagaaugauauaaaggagauacauguuucuuc

SEQ ID NO: 256216 - RNA, 63 nt, hsa
uuauuuaaagaagaaacgucuauguguacagaugaaugauaaacucucugcuucucccucugc

SEQ ID NO: 256217 - RNA, 63 nt, hsa
auuggugguuuuccuauuacugauguggcuguggaaugauaagguccuagaggggcccuggca

SEQ ID NO: 256218 - RNA, 63 nt, hsa
cacuccaaaacccacucugcacugcagcacagugaaugauaugcacucaccauuagcuucgac

SEQ ID NO: 256219 - RNA, 63 nt, hsa
acccaggauaauagucacaguuuuccagggagggaaugauauaauuuucaugacaaugucaug

SEQ ID NO: 256220 - RNA, 63 nt, hsa
gaagcucuggccugagaguuaaacacccaugcugaaugauacagugugcauucucuccagcug

SEQ ID NO: 256221 - RNA, 63 nt, hsa
ugacuuucaugucgucaugcaucugucaugaaugaaugauacuuugcacugggcuguacgaca

SEQ ID NO: 256222 - RNA, 63 nt, hsa
ucugcccuuuugucugaaacucaaggccaaggagaaugauaggagacuuaggacagagcugac

SEQ ID NO: 256223 - RNA, 63 nt, hsa
ugugugcuuagcgcaaauggcagcucucaucaugaaugauagacucuuucacccugcuggucc

SEQ ID NO: 256224 - RNA, 63 nt, hsa
uucaagaaguugauuccaaaacugaguuaugaagaaugauauaacaguuccuucaaaauuggc

SEQ ID NO: 256225 - RNA, 63 nt, hsa
cuuaauucugagccauuaauccugcuacacuuugaaugauacauuaauucagacuaaucuuug

SEQ ID NO: 256226 - RNA, 63 nt, hsa
ggacuagauucuaaaauuuauuugggaccaugggaaugauaguugggaagaaaacuauuugca

SEQ ID NO: 256227 - RNA, 63 nt, hsa
ucuugaaguauuguucauauuugucaccucuuggaaugauagcagauccuguaaguugaugua

SEQ ID NO: 256228 - RNA, 63 nt, hsa
acaaguuccuuguuuaacuacacagcuaugauggaaugauauauccaaguuccuugccucagu

SEQ ID NO: 256229 - RNA, 63 nt, hsa
aucacagauuuccaaaaguacuagcaauaaguugaaugauaauagcucacagcacauuuguua

SEQ ID NO: 256230 - RNA, 63 nt, hsa
ucaccaguuagacauaauuacuucuaccgaugugaaugauacggaugccggcagagcuuccag

SEQ ID NO: 256231 - RNA, 63 nt, hsa
gugugguuuugaggagggauaugauuuuauggagaaugauauggcaaugugccuaacgauuuu

SEQ ID NO: 256232 - RNA, 63 nt, hsa
uaccucuggccgcaauuccagucugugcaucaugaaugauaagcuguuucugagggaugccag

SEQ ID NO: 256233 - RNA, 63 nt, hsa
uaaaccugaauauuauuaccagccuagagucuugaaugauagccuuaccgaauucuucuugug

SEQ ID NO: 256234 - RNA, 63 nt, hsa
ugaaauucugacuucucuccugugcuucaaugagaaugauaaauuauccuagcaaaggggccu

SEQ ID NO: 256235 - RNA, 63 nt, hsa
aaaacuguuguggaaaaugagugcguuuguacggaaugauaaacuuuuauuuauucacagaag

SEQ ID NO: 256236 - RNA, 63 nt, hsa
guucccgccaguuccacagaucaaagacaaacugaaugauaaccaugagguggaagacgaggu

SEQ ID NO: 256237 - RNA, 63 nt, hsa
auaauuaagaguuucuuauggaaaagagauucagaaugauaaccucuuuuagagaacaaauaa

SEQ ID NO: 256238 - RNA, 64 nt, hsa
aacaccauccacucacuccaacaaagaacacuuagaaugauaaaaaaaaaaaaaaaaaaccuga

SEQ ID NO: 256239 - RNA, 64 nt, hsa
uuuuagagaagucccugauuccuucuuaaacuuggaaugauagaugaaauucacaccccugcag

SEQ ID NO: 256240 - RNA, 60 nt, hsa; identical to SEQ ID NO: 255998

SEQ ID NO: 256241 - RNA, 64 nt, hsa
gcucacugcauuuaauaaauauuuaauaaaugaugaaugauagaaguuuccaucuacaauauau

SEQ ID NO: 256242 - RNA, 64 nt, hsa
aggaaagggacuauaaaaguguacaauguuaauggaaugauacgguaccugaaagccuuguuuu

SEQ ID NO: 256243 - RNA, 64 nt, hsa
cugagccucucccagcuccacuucuaaugcuagagaaugauaacuaagacuucugugcauuuga

SEQ ID NO: 256244 - RNA, 64 nt, hsa
aguuuucucauuauuuaugaaacuuaaccauacagaaugauauaacuccugugcaaugaaggug

SEQ ID NO: 256245 - RNA, 64 nt, hsa
uagccccaccagcuucaggacuucugccaauuuugaaugauauagcugcaccaacaauaucccg

SEQ ID NO: 256246 - RNA, 64 nt, hsa
uguuaaccuagaaauguagcuugcuaauaagauagaaugauacaaaagugaaguaguagccaca

SEQ ID NO: 256247 - RNA, 64 nt, hsa
gcaagccugguacucaguaaauauuuguugaaaugaaugauaagagcauugguccccaagccag

SEQ ID NO: 256248 - RNA, 64 nt, hsa
aaagcaggcuguuugcucacuucuucaaaaggaggaaugauaacccaaaucugcccaagugaca

SEQ ID NO: 256249 - RNA, 64 nt, hsa
ggguuugcuuuggaaaaugccugucucucuacuugaaugauaaagaauuaaauuagaucucucu

SEQ ID NO: 256250 - RNA, 64 nt, hsa
ugacugaaguuccagcuuuacuuuuuauaaacuugaaugauaaagaauagaccaugggcuacua

SEQ ID NO: 256251 - RNA, 64 nt, hsa
gugccauacuguuuuuaaaguucaugaucaucuggaaugauacuuaguguauauauauuuugua

SEQ ID NO: 256252 - RNA, 64 nt, hsa
uugauucuucuggguuuauacugguuguaaaacagaaugauauuagaaaauguuuuccuuguuu

SEQ ID NO: 256253 - RNA, 64 nt, hsa
auaguugcuucccacugccccccgcccgcccccagaaugauauuaauuuugccuuuuuuuuuuu

SEQ ID NO: 256254 - RNA, 64 nt, hsa
aggcacucaauaaaugcugaaugggugaauaguugaaugauaggugcucaauaaaugaaugaau

SEQ ID NO: 256255 - RNA, 64 nt, hsa
uuucucauugggagaguaagguacccccaucccagaaugauaacugcacaguggcagaacaaac

SEQ ID NO: 256256 - RNA, 64 nt, hsa
ccggcccaggcccaucuuccaaagcaagaggaaggaaugauaauggugacucaggggaagaaga

SEQ ID NO: 256257 - RNA, 64 nt, hsa
gugcagugaagguucucuacagcuaagccuguuugaaugauacguagguuccccaccaaaagca

SEQ ID NO: 256258 - RNA, 64 nt, hsa
uggagaauucauaacauuugaagaucaaaaaauugaaugauaaauaugaauggcuuuucaauuc

SEQ ID NO: 256259 - RNA, 64 nt, hsa
aauaacucaccuggcaucuuacaucugaaauaaggaaugauauaagguuuuuuuuucucacaga

SEQ ID NO: 256260 - RNA, 64 nt, hsa
gaacaaauauucuuggaucuuugaucaaagccuggaaugauagcuuuaauaaaagaaggaaaaa

SEQ ID NO: 256261 - RNA, 64 nt, hsa
uuuuaagugugcaaacaaguuagagcuggcagcugaaugauagacaaauagugcaaauuugcca

SEQ ID NO: 256262 - RNA, 64 nt, hsa
uaagguuaaaauaggggagaaauccuacauguuggaaugauagcuuuuuggaaaauuuaagaaa

SEQ ID NO: 256263 - RNA, 64 nt, hsa
uccgaaaaauguuucuucagcuugagaaauuuuagaaugauaggaaguuucucgaguuagccuu

SEQ ID NO: 256264 - RNA, 64 nt, hsa
gaaauauguauaaauauaugaugcugagucuguggaaugauacuucugaaaucaaaauuccuca

SEQ ID NO: 256265 - RNA, 64 nt, hsa
gaucuuuugugacuuugagccuuuuaaguaguuugaaugauaagacuuaaaauguuucauaauu

SEQ ID NO: 256266 - RNA, 64 nt, hsa
gacgugggaucucaguaugguacuuggacagcaggaaugauacauauaaucugaacuugggaaa

SEQ ID NO: 256267 - RNA, 64 nt, hsa
aagaaacuggaggcugcaacaggagggaaaggcagaaugauaucacagcaguacuauuuuuuuu

SEQ ID NO: 256268 - RNA, 64 nt, hsa
auuccugggacucaaauguaugcaguacuauucagaaugauauacacacauauguguauaugua

SEQ ID NO: 256269 - RNA, 64 nt, hsa
aauauuuggaggauauugaaagugugaaaaaaaagaaugauaaucuuuuaaaggcucuacaauu

SEQ ID NO: 256270 - RNA, 64 nt, hsa
gcauuucaccccacaugacuaggaauccacaucagaaugauacagaguuagcagguuuuucuaa

SEQ ID NO: 256271 - RNA, 64 nt, hsa
cucuguaagcuucauccaugcugguuauugcacugaaugauauauuauuagggcauguuaacag

SEQ ID NO: 256272 - RNA, 64 nt, hsa
auuuuaaaugaguuaaugaaucugccagaucugugaaugauagagauuaugcuaaauuaaugcu

SEQ ID NO: 256273 - RNA, 64 nt, hsa
aggagauaaacagccaaauagcaaauaggucacugaaugauaagauuugcaccuuagaacaaua

SEQ ID NO: 256274 - RNA, 52 nt, hsa; identical to SEQ ID NO: 256032

SEQ ID NO: 256275 - RNA, 64 nt, hsa
acuaaaacacaaugugaaaauguaucugaguauugaaugauaauucagucuugccuuugaaggg

SEQ ID NO: 256276 - RNA, 64 nt, hsa
ggaacuugaagauuaauaaaauaugcucuucagagaaugauauauaaauauugcauguuugcuu

SEQ ID NO: 256277 - RNA, 64 nt, hsa
cuuucaaguacaaggucaauacauaagccagagugaaugauacuacaaguugagcaucucuaau

SEQ ID NO: 256278 - RNA, 64 nt, hsa
cuaagaccuccucccaagcacuucaaaggaacuggaaugauaauggaaacugucaagagggggc

SEQ ID NO: 256279 - RNA, 64 nt, hsa
cuuuuuccuuaaguauaaaaaaaaaguaucagaagaaugauaccauuuuuaaaggcuucauucc

SEQ ID NO: 256280 - RNA, 64 nt, hsa
cucauuugugauauuauaaaacauguuuaacucagaaugauaugugaggccagcagucagaaua

SEQ ID NO: 256281 - RNA, 64 nt, hsa
uagauuaggauugacaaguaaagauacugcuauggaaugauacauuguauuuucugcauugugu

SEQ ID NO: 256282 - RNA, 64 nt, hsa
uccugccucagaaaaagcuuuuccauuacacugugaaugauaccuguuuuguuguuucugaauu

SEQ ID NO: 256283 - RNA, 64 nt, hsa
uuuuaaaggaagauacagaggugauuguacuucagaaugauaaacccauauaccaccuaaaauc

SEQ ID NO: 256284 - RNA, 64 nt, hsa
uugaaggaacucaugaaaauccugaguuaauuuggaaugauaauuccagagauaaaguguccac

SEQ ID NO: 256285 - RNA, 64 nt, hsa
gugguuugaauuggaugcagugugggccauccuggaaugauacugacugauuaauuauuccuga

SEQ ID NO: 256286 - RNA, 64 nt, hsa
aaaacaaauuucaauugcuugaagcaauuguucugaaugauacuuuuucauucacauucaagaa

SEQ ID NO: 256287 - RNA, 64 nt, hsa
aaaaauagccaaagauaggagacgucugaauuuugaaugauaaacagugauguuuuaaaaaagc

SEQ ID NO: 256288 - RNA, 64 nt, hsa
cuuucugcaaauuauucagccuccaaaugcaaaugaaugauauaaaaauaaguagggaacaugg

SEQ ID NO: 256289 - RNA, 64 nt, hsa
ucuuucuaaaguguguguauguuugugugaaugugaaugauacugaucuuauaucuguuaaaag

SEQ ID NO: 256290 - RNA, 64 nt, hsa
gaauaaccaggggcacaugggggaacguggaugggaaugauaguguaucucagcgggggguggg

SEQ ID NO: 256291 - RNA, 64 nt, hsa
gcaggcauccugguguccugagaggcucuugcaggaaugauacguggcagugccugcagcgagg

SEQ ID NO: 256292 - RNA, 55 nt, hsa; identical to SEQ ID NO: 256050

SEQ ID NO: 256293 - RNA, 64 nt, hsa
ucauugcaagcuggcaaauuuauguagcuauguggaaugauaugucauaauguaaaauuagaua

SEQ ID NO: 256294 - RNA, 64 nt, hsa
uacaugaacacagcugcugaagaggcaagagacagaaugauauccaguaagcacauguuuauuc

SEQ ID NO: 256295 - RNA, 64 nt, hsa
uuaacuguuguauugugacuaaguacaacuuuuggaaugauaccugaagaauuauuaguaauag

SEQ ID NO: 256296 - RNA, 64 nt, hsa
aaucucaaucuucaguuuuggccuucugucagcagaaugauaagugcaauaguuguaaaucuac

SEQ ID NO: 256297 - RNA, 64 nt, hsa
caaagcagagccacugucuaacacagcuguuaacgaaugauaaacugacauuauacucuaaaag

SEQ ID NO: 256298 - RNA, 64 nt, hsa
cacacuugaaaaagauaaggucaugggggcggaugaaugauaucccucacucauuuagccauuc

SEQ ID NO: 256299 - RNA, 64 nt, hsa
caaaguaauaaaacuuaguuuauauaaacagguugaaugauauauuuaucaaaucucacagaca

SEQ ID NO: 256300 - RNA, 64 nt, hsa
gaguauaacuggcuuaguaaguauauccuacucugaaugauaaaaauauagucaagcuaaaaua

SEQ ID NO: 256301 - RNA, 64 nt, hsa
gcaguugagaaaauuugaauguggauuagauuuugaaugauauuggauaauuauugguaauuuu

SEQ ID NO: 256302 - RNA, 64 nt, hsa; identical to SEQ ID NO: 256301

SEQ ID NO: 256303 - RNA, 64 nt, hsa
uucuaccaaguuuucaccuuguuucaggucagaggaaugauagaauuugucauuuuucuuacaa

SEQ ID NO: 256304 - RNA, 64 nt, hsa
uguuuugaaagucuuuaacuaaauuaagauugcagaaugauagugauuauucaauuagauuuua

SEQ ID NO: 256305 - RNA, 64 nt, hsa
acauuuuuuagugucacacugacuuuuaaaauuugaaugauauauagacuuuguuuuuuuaaug

SEQ ID NO: 256306 - RNA, 64 nt, hsa
aguugcuaaauucuccauggacauagagagaaaggaaugauauucucaucaucaucuucaucau

SEQ ID NO: 256307 - RNA, 64 nt, hsa
uucuguaaaagauuuguccaauaaacgacuuaaugaaugauacaucagucagauuuuaggaagg

SEQ ID NO: 256308 - RNA, 64 nt, hsa
uccugaccuuuagucuuucacuuccaauuuuguggaaugauauuuuaggaauaacggacuuuua

SEQ ID NO: 256309 - RNA, 64 nt, hsa
uuucuucagccacugacugcuuggguugggcugugaaugauaauggaauggcuggagucugcug

SEQ ID NO: 256310 - RNA, 64 nt, hsa
ugugaugcugucagccacagcuuccugccguagagaaugauagagcagcugcucacacaggagg

SEQ ID NO: 256311 - RNA, 64 nt, hsa
cuuuuuuuuuuuuaacaucuuuguuuuuaaaauagaaugauagaacuuugccagucuuuaagau

SEQ ID NO: 256312 - RNA, 64 nt, hsa
guagcuuuggugaaacugggguuuuguaaccucugaaugauauggacuuagugaauucuaagga

SEQ ID NO: 256313 - RNA, 64 nt, hsa
ugaaaugccccgggggcagcaaacugacaugguugaaugauagcauuucacucugcguucuccu

SEQ ID NO: 256314 - RNA, 64 nt, hsa
uuugcuuaaucaguaagucuuugugaaugaauacgaaugauacagauuuuuaaaaaaguaauaa

SEQ ID NO: 256315 - RNA, 64 nt, hsa
ugacuuauauuuugaauggguucuagugaaaaaggaaugauauauucuugaagacaucgauaua

SEQ ID NO: 256316 - RNA, 64 nt, hsa
uuagacagcagggaagauauuagugguaaagagugaaugauaguagugaauauaaauggggcug

SEQ ID NO: 256317 - RNA, 64 nt, hsa
uacuaaaaauauauauagacaaaauuaaaagaaggaaugauaagaauaaauuuaauuuaccaaa

SEQ ID NO: 256318 - RNA, 64 nt, hsa
aaagcaguuaaacugauuaguauucaggcacugagaaugauaguaauaggauacaauguauaag

SEQ ID NO: 256319 - RNA, 64 nt, hsa
uaaagcuacauguaaaguucuuguacaaaaaauggaaugauagguugaucagauucaguaaagu

SEQ ID NO: 256320 - RNA, 64 nt, hsa
gacucuagccaagaaaaagcuaauucuggggauagaaugauaaaagacucaagcacuaaaaaua

SEQ ID NO: 256321 - RNA, 64 nt, hsa
ugucacauaaaggaagucuuaaguggaguucacagaaugauaauguaucuauuugucauuugug

SEQ ID NO: 256322 - RNA, 64 nt, hsa
ugagaauacuuuaaagggaaguggaaguauaagugaaugauauuuuucuuuuacauguaaacaa

SEQ ID NO: 256323 - RNA, 55 nt, hsa; identical to SEQ ID NO: 256081

SEQ ID NO: 256324 - RNA, 64 nt, hsa
auuuccuuuuucugaaauguaaucauugaugcuugaaugauagaauuuuaguacuguaaacagg

SEQ ID NO: 256325 - RNA, 64 nt, hsa
uucccaucucugcaagcagggauaacgguaaugagaaugauaauaaucauuauaugcagaccuu

SEQ ID NO: 256326 - RNA, 64 nt, hsa
ugucacuacugaauuuugacaggaggaaggaauagaaugauagcuuguuuuauuuguaaagcuu

SEQ ID NO: 256327 - RNA, 64 nt, hsa
cauuuuccuguuuuuauggaaacucugagaagcugaaugauacaugcaggggauauuuuuugag

SEQ ID NO: 256328 - RNA, 64 nt, hsa
gccaugggugcuuguugggccuuuuuccaguaaggaaugauauugcugaagaaucuacuuaacc

SEQ ID NO: 256329 - RNA, 64 nt, hsa
cucauucaguaguuacugaaagaaaacucugcuagaaugauaaaugucaugguggucuauaacu

SEQ ID NO: 256330 - RNA, 64 nt, hsa
aguaaaugcuugauaaaucuuuaagauaugucuugaaugauaauuaggacauucaguccagugg

SEQ ID NO: 256331 - RNA, 64 nt, hsa
gcauucaaccaacuguaaugcaggauuggaccaugaaugauaugcuagaauagaagaaagagaa

SEQ ID NO: 256332 - RNA, 64 nt, hsa
guuuuucucuuugcaaagacauagcuaggaaagcgaaugauaagggaaaaguucucagggaauu

SEQ ID NO: 256333 - RNA, 64 nt, hsa
auucuuagaauaagaagugcauucaauccuaggagaaugauaauccuggacaugggugaacaug

SEQ ID NO: 256334 - RNA, 64 nt, hsa
uuggugacaaccuacuuugcuuggcugagugaaggaaugauauucauauauucauuuauuccau

SEQ ID NO: 256335 - RNA, 64 nt, hsa
guuggaaagcugaucuuuucugauauaaaauguugaaugauauuaucugguuuucugauauuuu

SEQ ID NO: 256336 - RNA, 64 nt, hsa
ggcaguauuguuuucuuauaugugcaaugaaguggaaugauaaacaguaugccuuuaauuuaua

SEQ ID NO: 256337 - RNA, 64 nt, hsa
ugaaaaaugcuuauguauugacagaacacuucuagaaugauacccaaacuccuggagugggagu

SEQ ID NO: 256338 - RNA, 64 nt, hsa
cacauagcuaugcacuaugaaaauuaaauggaaugaaugauauguauauuacucaaaauaaagu

SEQ ID NO: 256339 - RNA, 64 nt, hsa
aaccagcacauucguuuuguucauauucacuauagaaugauaucuuguaaauaaagacauucag

SEQ ID NO: 256340 - RNA, 64 nt, hsa
gugagccacaggaaguuuggggcguggugaguuggaaugauacguccauuucucuaugaaauau

SEQ ID NO: 256341 - RNA, 64 nt, hsa
cuuguagcuacuacauuccagacuggaaauguaugaaugauaaucaacauaaugcugauaaacu

SEQ ID NO: 256342 - RNA, 64 nt, hsa
ggucccaaugucagaguucuuggaacagauaacugaaugauagauuuuuuuuuuuuaaagauaa

SEQ ID NO: 256343 - RNA, 64 nt, hsa
agcacucuaacaauguuuacuucuaaacuuuguugaaugauaauagaaagcacccuaauugacu

SEQ ID NO: 256344 - RNA, 64 nt, hsa
aaagcaaaaagcguaguuucugauuuauguuauagaaugauacugauuagacuuugagccaagg

SEQ ID NO: 256345 - RNA, 64 nt, hsa
ugucaugagauccuacuuaguaugauccuggcuagaaugauaauuaaaaguauuuaauuugaag

SEQ ID NO: 256346 - RNA, 64 nt, hsa
auuuauacaaaaggguuuuuguuuauagcuuaaggaaugauacugugcucugcuuggugcaugg

SEQ ID NO: 256347 - RNA, 64 nt, hsa
aauaucuggaguacauuaaaagugugaaagaaaagaaugauaaucuucuaaaggcuauacaauu

SEQ ID NO: 256348 - RNA, 64 nt, hsa
ugauggaucuguuggcggguuuuggauguguaaagaaugauauauauauuaaauaggucaauca

SEQ ID NO: 256349 - RNA, 64 nt, hsa
uaucuucuccuuuuccugguugaacucccuaaaugaaugauauucauuccaacugcugccccuc

SEQ ID NO: 256350 - RNA, 64 nt, hsa
uauacuacuuaauuacuuaagauguuuauuaauagaaugauaaauguacagaguaaccuauaag

SEQ ID NO: 256351 - RNA, 64 nt, hsa
acuucuagcuuugugucuuguuucagaccauguggaaugauaaauacucuuuuugugcuucuga

SEQ ID NO: 256352 - RNA, 64 nt, hsa
acucuacuguccuagaguauaacccuguuguaaagaaugauacacaagacaaacuuacccugau

SEQ ID NO: 256353 - RNA, 64 nt, hsa
aaaaaaucagguuuuaaacaggaaaaccuauggggaaugauauuuuuugaaagacuuuuguaua

SEQ ID NO: 256354 - RNA, 64 nt, hsa
gaagagggagggugucucacaaccaaccaguucagaaugauacggaacagcauuucccugcagc

SEQ ID NO: 256355 - RNA, 64 nt, hsa
ucauugugauuuugguuugcauuucccugauggcgaaugauauugagcaucuuuucaugagcuu

SEQ ID NO: 256356 - RNA, 64 nt, hsa
auacuaugguuuucauuuacucuaaaaacugauugaaugauauauaaauauauuuauagccuga

SEQ ID NO: 256357 - RNA, 64 nt, hsa
cuuuucaggacuugcugggucaccuuuuccugaggaaugauacagaagaguguuuuuucauaaa

SEQ ID NO: 256358 - RNA, 64 nt, hsa
gccaaaaaaauuuauaaacuaauuuuguacguaugaaugauaucuuugaccucaauggagguuu

SEQ ID NO: 256359 - RNA, 64 nt, hsa
augcuguuuaccccaucucucucuuauaucacuugaaugauauauuguaagugagagguaaagg

SEQ ID NO: 256360 - RNA, 64 nt, hsa
uuagcagaugauuucuguucaccugguaagaaaagaaugauaggcuugucagagccuauagcca

SEQ ID NO: 256361 - RNA, 64 nt, hsa
cuucccauugcaccagcuuguccuccaaaaucaugaaugauacacaugaagauaacuuuuuuua

SEQ ID NO: 256362 - RNA, 64 nt, hsa
acauccaucccccuagcucaccacauagcacauagaaugauauuuuugauuuguaagaggccau

SEQ ID NO: 256363 - RNA, 64 nt, hsa
agugucuuugaaacuugaacauaaugugaaggcugaaugauagagauauuuucuguuguguugg

SEQ ID NO: 256364 - RNA, 64 nt, hsa
ucucgggauuauugcucuucugucuauaaauuuugaaugauacugugccuuaauugguuuucau

SEQ ID NO: 256365 - RNA, 64 nt, hsa
aauagauccauccaaaugauuucucuguacaaaugaaugauacuauuaaaaaaaaaaaaagcac

SEQ ID NO: 256366 - RNA, 64 nt, hsa
cuuucaaugacuuucaauacuuccccugaaggaagaaugauaaggagaaaugucuguuuugagg

SEQ ID NO: 256367 - RNA, 64 nt, hsa
cucuacucauaaguauuuuuuucuauuuagacuugaaugauaaucuguuuuuugaucaguauau

SEQ ID NO: 256368 - RNA, 64 nt, hsa
uuccauugcuuugaaaaaguuaaugcuuaagagggaaugauaugcauuugacuuguuaaacagc

SEQ ID NO: 256369 - RNA, 64 nt, hsa
acaucauagaacauggcagucguuuuuguuccaagaaugauaugaaaggugaagaagaggccca

SEQ ID NO: 256370 - RNA, 64 nt, hsa
ccucuuuaagaguuaguuucuuugggauugcuaugaaugauacccugaauuuggccugcacuaa

SEQ ID NO: 256371 - RNA, 64 nt, hsa
uguuaucacuguaaaacacagaaaagugauuaaugaaugauaauuuagauccauuucuuuugug

SEQ ID NO: 256372 - RNA, 64 nt, hsa
gucucauuaaagugauugcugggagcaaaaacuagaaugauacaaagaaaggucagagaaaugc

SEQ ID NO: 256373 - RNA, 64 nt, hsa
uauuugaccugcaguauugaaaaaggagaauucagaaugauacaguauuuuaacaaaucuuaau

SEQ ID NO: 256374 - RNA, 64 nt, hsa
agaaauauguauauaaauaucucuauauucuuuggaaugauacuaaagucucuggucuaggacc

SEQ ID NO: 256375 - RNA, 64 nt, hsa
gugucauuggguuccagcugcucuccuccacauugaaugauaucuuguuaauuuauaggcacau

SEQ ID NO: 256376 - RNA, 64 nt, hsa
auggaagccaaaaguucucuucccaaacugccaagaaugauacaggccauaauugaaaugggaa

SEQ ID NO: 256377 - RNA, 64 nt, hsa
acauguguauggggaaaauaguucugaaaggcuagaaugauacaagugagcaaaaguuggucag

SEQ ID NO: 256378 - RNA, 64 nt, hsa
cuaauagaaaggaauacuauuauagcaaaucacagaaugauagacucaagcauaaaacuuggca

SEQ ID NO: 256379 - RNA, 64 nt, hsa
cuaagaugaaaggagaacacugguuauguugauagaaugauaaaaagggucgggcgcggaggcu

SEQ ID NO: 256380 - RNA, 64 nt, hsa
auguuuaguucacaaguagauguaauuuacuaaagaaugauacacccauaugcuauauacagcu

SEQ ID NO: 256381 - RNA, 64 nt, hsa
aaccauaugaacauauauuuuuuagaaacuaagagaaugauaggcuuuuguucuuaugaacgaa

SEQ ID NO: 256382 - RNA, 64 nt, hsa
agauaggacuaaugacuaggaagccuaccccaaugaaugauauacuagaugaaauaguguucaa

SEQ ID NO: 256383 - RNA, 64 nt, hsa
gucacaccaauaugaugaugguuuucaugacuuugaaugauauauuuuuguacaucuagcugua

SEQ ID NO: 256384 - RNA, 64 nt, hsa
agacguguauccccgugaaaucugguuagauaaugaaugauaagcaggaaggauggcaagcacg

SEQ ID NO: 256385 - RNA, 64 nt, hsa
acagucagguuuguauuucugagcugucuauaaugaaugauauagaaggugguuucgaaggagg

SEQ ID NO: 256386 - RNA, 64 nt, hsa
uuaaaacuauggucaacuucaacuugcauucucagaaugauagugccuuuaaaaauuuuuuuau

SEQ ID NO: 256387 - RNA, 64 nt, hsa
cugccugagucucaguguaggugucuguaaaauggaaugauaauagcuuccaucucacagauuc

SEQ ID NO: 256388 - RNA, 64 nt, hsa
uauguucaauauuaucacugcacuuauaaaaaaagaaugauaugugagaagauggccaauccag

SEQ ID NO: 256389 - RNA, 64 nt, hsa
cuuccaguucacgagggcaggggguuuaaaacaagaaugauaggccaggaaggcaguggggauc

SEQ ID NO: 256390 - RNA, 64 nt, hsa
gguuccuaagggaaagggaagcacaugaucaugggaaugauagcccagaacaaaaagaaaucuu

SEQ ID NO: 256391 - RNA, 64 nt, hsa
guucuuaucaaagaaauaacccagacuuaaucuugaaugauacgauuaugcccaauauuaagua

SEQ ID NO: 256392 - RNA, 64 nt, hsa
uuuguaucaaaaguauucaugaugacucuauuuggaaugauauucagggaaaucacaauaauau

SEQ ID NO: 256393 - RNA, 64 nt, hsa
ggcauaaauauuagcugcucaaugauugauuguugaaugauagaugaaguauugcugaagccaa

SEQ ID NO: 256394 - RNA, 64 nt, hsa
uauauuaacuauauaagagaguugugacaaaacagaaugauaaagcugcgaaccguggcacacg

SEQ ID NO: 256395 - RNA, 64 nt, hsa
cucuuauuuuuaagaaaaugguucugugaaaagugaaugauauguauuuuuccaaaugcuucau

SEQ ID NO: 256396 - RNA, 64 nt, hsa
guaaaaugaaaauugagaaauauaagaugaaaaggaaugauaaaaauaucuuuuagggggcuuu

SEQ ID NO: 256397 - RNA, 64 nt, hsa
aaucucucucucaacaaaagguauaugccuucaggaaugauauaaucugucccauuuucgaggc

SEQ ID NO: 256398 - RNA, 64 nt, hsa
aauauaguucuaaaaauaaguuucuuccugagaagaaugauacuguuuaugaugaauccauagu

SEQ ID NO: 256399 - RNA, 64 nt, hsa
cagggcuaaaacugggcuacagaauuuucaaaaagaaugauacauucugaagguauguuuauaa

SEQ ID NO: 256400 - RNA, 64 nt, hsa
uuuauuaagcaucugugggaauauacaguugggggaaugauaaucugguuuauuuuuucuguaa

SEQ ID NO: 256401 - RNA, 64 nt, hsa
cuguaguuucuuuucuguaaaaugggaucuggacgaaugauaccaaacguuucuuucuaacauu

SEQ ID NO: 256402 - RNA, 64 nt, hsa
gagggugcgauugaaugaguauugagacugaggagaaugauagagagugaagcagaaacaggag

SEQ ID NO: 256403 - RNA, 64 nt, hsa
cuaauuugguauuacauguauucuauuuuuuucugaaugauagcaugaaaagugucaaaguggu

SEQ ID NO: 256404 - RNA, 64 nt, hsa
cacuuuaccaauuguuacuuucaaugugaggaaugaaugauaaauuaagagaaaaaaauaucag

SEQ ID NO: 256405 - RNA, 64 nt, hsa
uuuuugauuauugcauuguauuuuaauuugugcagaaugauaaagaauguuccuuuuagaagug

SEQ ID NO: 256406 - RNA, 64 nt, hsa
agaugcugaaauguccagaaaagaaggacauuuagaaugauaucuuguuuguccuuuucugugg

SEQ ID NO: 256407 - RNA, 64 nt, hsa
ugaguucaguguaagcauggaagcuagugauucugaaugauauauauauccauugcauguugaa

SEQ ID NO: 256408 - RNA, 64 nt, hsa
aaacauaauucugcacuuuggaaucaguucauuagaaugauaacauuuauauggauaaagaugc

SEQ ID NO: 256409 - RNA, 64 nt, hsa
aauauuuggaggaaauugaaaguguggaaaaaaagaaugauaaucuuuuaaagggucuacaacu

SEQ ID NO: 256410 - RNA, 64 nt, hsa
cucuccuccaccuucaccccaagacuaggggcaggaaugauaagaaggcugggugguagcuggg

SEQ ID NO: 256411 - RNA, 64 nt, hsa
gaacagcaaugcuaguaacaggaugggaacaugggaaugauaauauauauuuuuucuuuuaaua

SEQ ID NO: 256412 - RNA, 64 nt, hsa
augaguucuuacaaacuguuuguuauauuuucuggaaugauaagugagaauuauuuagaaaaga

SEQ ID NO: 256413 - RNA, 64 nt, hsa
gcaaaagcaauuguuuuuaaauuaacaauggagagaaugauaagaugagggaaggaaaaggcau

SEQ ID NO: 256414 - RNA, 64 nt, hsa; identical to SEQ ID NO: 256409

SEQ ID NO: 256415 - RNA, 64 nt, hsa
ucuaaauauuuauuuagagaaugauuuuaaaagggaaugauaugcuuguuuaaaugaaagagaa

SEQ ID NO: 256416 - RNA, 64 nt, hsa
auguuuugaauggauuaccuguagugacucauuggaaugauauaauuauacaaguaaugccaaa

SEQ ID NO: 256417 - RNA, 64 nt, hsa
cucaccugguugcucuggaagcucuugcugauaggaaugauagcaacacugaaagagcguggga

SEQ ID NO: 256418 - RNA, 64 nt, hsa
gaauguaucaauguauuagauaaacccaguuucagaaugauaaagaaaaaauguuagaccaaau

SEQ ID NO: 256419 - RNA, 64 nt, hsa
accugaaucugugcauuuugugccuuauucaugagaaugauagaaguacuaaaaucugucaagu

SEQ ID NO: 256420 - RNA, 64 nt, hsa
cgauccuagcugcagaucgcaucccacaaugcgagaaugauaaaauaaaauuggauauuugaga

SEQ ID NO: 256421 - RNA, 64 nt, hsa; identical to SEQ ID NO: 256418

SEQ ID NO: 256422 - RNA, 64 nt, hsa
gaauuuaucaauguauuacacaaauccaguuucagaaugauaaaaaauguuagaccaaauaaug

SEQ ID NO: 256423 - RNA, 64 nt, hsa
gaguugauuccuccaauaugggccagaugcuuuugaaugauagggaaaucuacauaaaauccag

SEQ ID NO: 256424 - RNA, 64 nt, hsa
cuguacacaacaaagguacagccaugggaauacagaaugauagaagagacuacagauggauaau

SEQ ID NO: 256425 - RNA, 64 nt, hsa
aggauacuaagaaaauagaagguaaagaugagaagaaugauaauggagcaaguggccaaacauc

SEQ ID NO: 256426 - RNA, 64 nt, hsa
aggacacagccauccagcggcaucuuuccuugucgaaugauacuguaaugaccuuccaaaguga

SEQ ID NO: 256427 - RNA, 64 nt, hsa
gcauguuucaucuucauuuuuaauauccugaacugaaugauaguguuuuuuuagaugaagaacu

SEQ ID NO: 256428 - RNA, 64 nt, hsa
cguuugcuauauuccuuuuucuaugaaauaaugugaaugauaauaaaacagcuuugacuugauu

SEQ ID NO: 256429 - RNA, 64 nt, hsa
acccauuuacuguauuuuuuuuaaugaaauaugugaaugauaauaaaaguugcugacuuaaugc

SEQ ID NO: 256430 - RNA, 64 nt, hsa
ucuccaggaaacuuguccuucuggaaaucauauugaaugauauuucuauaucgaagugagguag

SEQ ID NO: 256431 - RNA, 64 nt, hsa
aguaggaaacuguacuuuaucucggcauccucuugaaugauagugcaaguuucuccaguuggga

SEQ ID NO: 256432 - RNA, 64 nt, hsa
agguugucuagguaaugacaguaaacugacuguagaaugauaauugugguauagugaccaauag

SEQ ID NO: 256433 - RNA, 64 nt, hsa
auggugggacuuggucuggagcagggacuacuuggaaugauaaaggcaaaacucaacagccccu

SEQ ID NO: 256434 - RNA, 64 nt, hsa
aagccuaccaaauuucaugcuguugguuugccaugaaugauauuacuuccuacauuauauuugu

SEQ ID NO: 256435 - RNA, 64 nt, hsa
aucaagcccugcuuaaaguuaaauaaaauagaaugaaugauaccccggcuccauuucccccacu

SEQ ID NO: 256436 - RNA, 64 nt, hsa
uacuucugaaaaguucugcucuaucucaaagacugaaugauacuacacaguccucucccuauua

SEQ ID NO: 256437 - RNA, 64 nt, hsa
ccauuccacuuagugucuuuucaaugauaggcaagaaugauaucugaguugaacuucggugcuu

SEQ ID NO: 256438 - RNA, 64 nt, hsa
ucagagaacgguguuugagucagcuugucugauugaaugauaaugugcuaaauugauuaccucc

SEQ ID NO: 256439 - RNA, 64 nt, hsa
gugggagcugcgcuaugaagauacaaaggcacaagaaugauacaauggauuuuggggacuuagg

SEQ ID NO: 256440 - RNA, 64 nt, hsa
agaagaaagggccuucacaguguccuuuauguaagaaugauauaaccaaaagguauauaauuug

SEQ ID NO: 256441 - RNA, 64 nt, hsa
cagaaaugucuuuucaucuuuuucuggaggagacgaaugauagggccugguuuacauucauuua

SEQ ID NO: 256442 - RNA, 64 nt, hsa
ggacccaauggugcuggaaaaaguucaucuauuagaaugauaucugggaucacaaagccaacug

SEQ ID NO: 256443 - RNA, 64 nt, hsa
agcuaccuuacauuucugcguauauaugaaaacugaaugauauuucucaguguauuuccuugca

SEQ ID NO: 256444 - RNA, 64 nt, hsa
aagauugagcaauagaaaaaaauuccuuuccuuugaaugauagcugugauucaccccaccccau

SEQ ID NO: 256445 - RNA, 64 nt, hsa
gauacacaaugaagaauucuauuuggcuaauuaagaaugauauacuauguacacccaauaagcu

SEQ ID NO: 256446 - RNA, 64 nt, hsa
agcaaauaagccagcagaugggugaagagguccagaaugauaugcaaaaacuacuuuuuagaga

SEQ ID NO: 256447 - RNA, 64 nt, hsa
ggugcguguacuguuucuaaaaaccacaaacuaagaaugauaaauuaucaauauaguuuaguau

SEQ ID NO: 256448 - RNA, 64 nt, hsa
gaucccagaauuguugaggggggaucaaguugcagaaugauacagauaguacaaugacuuuuuu

SEQ ID NO: 256449 - RNA, 64 nt, hsa
gucaagagaacacacaacagagaaacccuauaaagaaugauacaauauguuucaaucagaaccu

SEQ ID NO: 256450 - RNA, 64 nt, hsa
auauguugugaauuuuccuugguucuuuuuaaaggaaugauaauaaaguuacuugcuuuaggau

SEQ ID NO: 256451 - RNA, 64 nt, hsa
acaaagaagaauccagaaauaggggcacauugaggaaugauacugagcccaaagagcauucaau

SEQ ID NO: 256452 - RNA, 64 nt, hsa
gagucuuuuuaaauaugcucuguuaguuuguauggaaugauauuucauugcacuuuuaauuuaa

SEQ ID NO: 256453 - RNA, 64 nt, hsa
guuuacuguggauuagguauagugccaacaaauugaaugauaaaacaacauaauacguaguuau

SEQ ID NO: 256454 - RNA, 64 nt, hsa
uaccaaauucuucauaagaaagaucauauuaugggaaugauaauccuguuuacuguggauuagg

SEQ ID NO: 256455 - RNA, 64 nt, hsa
uuugauugggauguuauauuugagaaaauacagagaaugauagauuaacggagugucuaaucua

SEQ ID NO: 256456 - RNA, 64 nt, hsa
aauccggucuaugccuucugcaccaagaagaagugaaugauauuuuucaucaauguuaucagau

SEQ ID NO: 256457 - RNA, 64 nt, hsa
auauaaauaaaauauauauauuuuauaaagaucagaaugauauaaaggagauacauguuucuuc

SEQ ID NO: 256458 - RNA, 64 nt, hsa
guuauuuaaagaagaaacgucuauguguacagaugaaugauaaacucucugcuucucccucugc

SEQ ID NO: 256459 - RNA, 64 nt, hsa
cauuggugguuuuccuauuacugauguggcuguggaaugauaagguccuagaggggcccuggca

SEQ ID NO: 256460 - RNA, 64 nt, hsa
gcacuccaaaacccacucugcacugcagcacagugaaugauaugcacucaccauuagcuucgac

SEQ ID NO: 256461 - RNA, 64 nt, hsa
uacccaggauaauagucacaguuuuccagggagggaaugauauaauuuucaugacaaugucaug

SEQ ID NO: 256462 - RNA, 64 nt, hsa
ggaagcucuggccugagaguuaaacacccaugcugaaugauacagugugcauucucuccagcug

SEQ ID NO: 256463 - RNA, 64 nt, hsa
uugacuuucaugucgucaugcaucugucaugaaugaaugauacuuugcacugggcuguacgaca

SEQ ID NO: 256464 - RNA, 64 nt, hsa
cucugcccuuuugucugaaacucaaggccaaggagaaugauaggagacuuaggacagagcugac

SEQ ID NO: 256465 - RNA, 64 nt, hsa
gugugugcuuagcgcaaauggcagcucucaucaugaaugauagacucuuucacccugcuggucc

SEQ ID NO: 256466 - RNA, 64 nt, hsa
cuucaagaaguugauuccaaaacugaguuaugaagaaugauauaacaguuccuucaaaauuggc

SEQ ID NO: 256467 - RNA, 64 nt, hsa
gcuuaauucugagccauuaauccugcuacacuuugaaugauacauuaauucagacuaaucuuug

SEQ ID NO: 256468 - RNA, 64 nt, hsa
gggacuagauucuaaaauuuauuugggaccaugggaaugauaguugggaagaaaacuauuugca

SEQ ID NO: 256469 - RNA, 64 nt, hsa
aucuugaaguauuguucauauuugucaccucuuggaaugauagcagauccuguaaguugaugua

SEQ ID NO: 256470 - RNA, 64 nt, hsa
gacaaguuccuuguuuaacuacacagcuaugauggaaugauauauccaaguuccuugccucagu

SEQ ID NO: 256471 - RNA, 64 nt, hsa
aaucacagauuuccaaaaguacuagcaauaaguugaaugauaauagcucacagcacauuuguua

SEQ ID NO: 256472 - RNA, 64 nt, hsa
uucaccaguuagacauaauuacuucuaccgaugugaaugauacggaugccggcagagcuuccag

SEQ ID NO: 256473 - RNA, 64 nt, hsa
ggugugguuuugaggagggauaugauuuuauggagaaugauauggcaaugugccuaacgauuuu

SEQ ID NO: 256474 - RNA, 64 nt, hsa
cuaccucuggccgcaauuccagucugugcaucaugaaugauaagcuguuucugagggaugccag

SEQ ID NO: 256475 - RNA, 64 nt, hsa
auaaaccugaauauuauuaccagccuagagucuugaaugauagccuuaccgaauucuucuugug

SEQ ID NO: 256476 - RNA, 64 nt, hsa
cugaaauucugacuucucuccugugcuucaaugagaaugauaaauuauccuagcaaaggggccu

SEQ ID NO: 256477 - RNA, 64 nt, hsa
aaaaacuguuguggaaaaugagugcguuuguacggaaugauaaacuuuuauuuauucacagaag

SEQ ID NO: 256478 - RNA, 64 nt, hsa
uguucccgccaguuccacagaucaaagacaaacugaaugauaaccaugagguggaagacgaggu

SEQ ID NO: 256479 - RNA, 64 nt, hsa
uauaauuaagaguuucuuauggaaaagagauucagaaugauaaccucuuuuagagaacaaauaa

SEQ ID NO: 256480 - RNA, 64 nt, hsa; identical to SEQ ID NO: 115576

SEQ ID NO: 256481 - RNA, 64 nt, hsa; identical to SEQ ID NO: 115577

SEQ ID NO: 256482 - RNA, 64 nt, hsa; identical to SEQ ID NO: 115578

SEQ ID NO: 256483 - RNA, 64 nt, hsa; identical to SEQ ID NO: 115579

SEQ ID NO: 256484 - RNA, 64 nt, hsa; identical to SEQ ID NO: 115580

SEQ ID NO: 256485 - RNA, 64 nt, hsa; identical to SEQ ID NO: 115581

SEQ ID NO: 256486 - RNA, 64 nt, hsa; identical to SEQ ID NO: 115582

SEQ ID NO: 256487 - RNA, 64 nt, hsa; identical to SEQ ID NO: 115583

SEQ ID NO: 256488 - RNA, 64 nt, hsa; identical to SEQ ID NO: 115584

SEQ ID NO: 256489 - RNA, 64 nt, hsa; identical to SEQ ID NO: 115585

SEQ ID NO: 256490 - RNA, 64 nt, hsa; identical to SEQ ID NO: 115586

SEQ ID NO: 256491 - RNA, 64 nt, hsa; identical to SEQ ID NO: 115587

SEQ ID NO: 256492 - RNA, 64 nt, hsa; identical to SEQ ID NO: 115588

SEQ ID NO: 256493 - RNA, 64 nt, hsa; identical to SEQ ID NO: 115589

SEQ ID NO: 256494 - RNA, 64 nt, hsa; identical to SEQ ID NO: 115590

SEQ ID NO: 256495 - RNA, 64 nt, hsa; identical to SEQ ID NO: 115591

SEQ ID NO: 256496 - RNA, 63 nt, hsa
gagcaagcgguaguaccaccccuuaguugagggagucagcacaguccuuucugcagcuucuaa

SEQ ID NO: 256497 - RNA, 63 nt, hsa
gaggcagcagcaucccaagaaggaaagagcuggagucagcacuguccagaaagccaaaaagaa

SEQ ID NO: 256498 - RNA, 63 nt, hsa
uuccaagccaaucaaucagccaguuccuagcagagucagcacaugaacaagaucuaagucauu

SEQ ID NO: 256499 - RNA, 63 nt, hsa
gugugugugugcgcgcgcacgcacgccuugagcagucagcauugcaccugcuauggagaaggg

SEQ ID NO: 256500 - RNA, 63 nt, hsa
uccuuugcaaaggccuugggggcacuggcugggagucagcaagcgagcacuuuauaucccuuu

SEQ ID NO: 256501 - RNA, 63 nt, hsa
gccacccugggaggcuugccagaugccgggggcagucagcauuaaugaaacucauguuuaaac

SEQ ID NO: 256502 - RNA, 63 nt, hsa
aggacagcuuccccaucgccuucuggcugcugcagucagcacagagagcggcuuccccaucgc

SEQ ID NO: 256503 - RNA, 63 nt, hsa
aggacggcuuccccaucgccuucuggccgcugcagucagcacagagagcggcuuccccauugc

SEQ ID NO: 256504 - RNA, 63 nt, hsa
augggagaaugaggaguaaaaugcucacggcaaagucagcagcacugguaagccaagacugag

SEQ ID NO: 256505 - RNA, 63 nt, hsa
cugguccaggauucgcccucucccaugccuucaagucagcaucaggcuuagggcaaagaccag

SEQ ID NO: 256506 - RNA, 63 nt, hsa
uuucuugccagcuugggccauucuugcuuagacagucagcauuugucuccuccuuuaacugag

SEQ ID NO: 256507 - RNA, 63 nt, hsa
ggaugggacuggucguguuugugcuuuucuccaagucagcacccaaaggucaaugcacagaga

SEQ ID NO: 256508 - RNA, 63 nt, hsa; identical to SEQ ID NO: 57033

SEQ ID NO: 256509 - RNA, 63 nt, hsa; identical to SEQ ID NO: 57034

SEQ ID NO: 256510 - RNA, 63 nt, hsa; identical to SEQ ID NO: 57035

SEQ ID NO: 256511 - RNA, 63 nt, hsa; identical to SEQ ID NO: 57036

SEQ ID NO: 256512 - RNA, 63 nt, hsa; identical to SEQ ID NO: 57037

SEQ ID NO: 256513 - RNA, 63 nt, hsa; identical to SEQ ID NO: 57038

SEQ ID NO: 256514 - RNA, 63 nt, hsa; identical to SEQ ID NO: 57039

SEQ ID NO: 256515 - RNA, 63 nt, hsa; identical to SEQ ID NO: 57040

SEQ ID NO: 256516 - RNA, 63 nt, hsa; identical to SEQ ID NO: 57041

SEQ ID NO: 256517 - RNA, 63 nt, hsa; identical to SEQ ID NO: 57042

SEQ ID NO: 256518 - RNA, 63 nt, hsa; identical to SEQ ID NO: 57043

SEQ ID NO: 256519 - RNA, 63 nt, hsa; identical to SEQ ID NO: 57044

SEQ ID NO: 256520 - RNA, 63 nt, hsa; identical to SEQ ID NO: 57045

SEQ ID NO: 256521 - RNA, 63 nt, hsa; identical to SEQ ID NO: 57046

SEQ ID NO: 256522 - RNA, 63 nt, hsa; identical to SEQ ID NO: 57047

SEQ ID NO: 256523 - RNA, 63 nt, hsa; identical to SEQ ID NO: 57048

SEQ ID NO: 256524 - RNA, 63 nt, hsa; identical to SEQ ID NO: 57049

SEQ ID NO: 256525 - RNA, 63 nt, hsa; identical to SEQ ID NO: 57050

SEQ ID NO: 256526 - RNA, 63 nt, hsa; identical to SEQ ID NO: 57051

SEQ ID NO: 256527 - RNA, 63 nt, hsa; identical to SEQ ID NO: 57052

SEQ ID NO: 256528 - RNA, 63 nt, hsa; identical to SEQ ID NO: 57053

SEQ ID NO: 256529 - RNA, 63 nt, hsa; identical to SEQ ID NO: 57054

SEQ ID NO: 256530 - RNA, 63 nt, hsa; identical to SEQ ID NO: 57055

SEQ ID NO: 256531 - RNA, 63 nt, hsa; identical to SEQ ID NO: 57056

SEQ ID NO: 256532 - RNA, 63 nt, hsa; identical to SEQ ID NO: 57057

SEQ ID NO: 256533 - RNA, 63 nt, hsa; identical to SEQ ID NO: 57058

SEQ ID NO: 256534 - RNA, 63 nt, hsa; identical to SEQ ID NO: 57059

SEQ ID NO: 256535 - RNA, 63 nt, hsa; identical to SEQ ID NO: 57060

SEQ ID NO: 256536 - RNA, 63 nt, hsa; identical to SEQ ID NO: 57061

SEQ ID NO: 256537 - RNA, 63 nt, hsa; identical to SEQ ID NO: 57062

SEQ ID NO: 256538 - RNA, 63 nt, hsa; identical to SEQ ID NO: 57063

SEQ ID NO: 256539 - RNA, 63 nt, hsa; identical to SEQ ID NO: 57064

SEQ ID NO: 256540 - RNA, 63 nt, hsa; identical to SEQ ID NO: 57065

SEQ ID NO: 256541 - RNA, 63 nt, hsa; identical to SEQ ID NO: 57066

SEQ ID NO: 256542 - RNA, 63 nt, hsa; identical to SEQ ID NO: 57067

SEQ ID NO: 256543 - RNA, 63 nt, hsa; identical to SEQ ID NO: 57068

SEQ ID NO: 256544 - RNA, 63 nt, hsa; identical to SEQ ID NO: 57069

SEQ ID NO: 256545 - RNA, 63 nt, hsa; identical to SEQ ID NO: 57070

SEQ ID NO: 256546 - RNA, 63 nt, hsa; identical to SEQ ID NO: 57071

SEQ ID NO: 256547 - RNA, 63 nt, hsa; identical to SEQ ID NO: 57072

SEQ ID NO: 256548 - RNA, 63 nt, hsa; identical to SEQ ID NO: 57073

SEQ ID NO: 256549 - RNA, 63 nt, hsa; identical to SEQ ID NO: 57074

SEQ ID NO: 256550 - RNA, 63 nt, hsa; identical to SEQ ID NO: 57075

SEQ ID NO: 256551 - RNA, 63 nt, hsa; identical to SEQ ID NO: 57076

SEQ ID NO: 256552 - RNA, 63 nt, hsa; identical to SEQ ID NO: 57077

SEQ ID NO: 256553 - RNA, 63 nt, hsa; identical to SEQ ID NO: 57078

SEQ ID NO: 256554 - RNA, 63 nt, hsa; identical to SEQ ID NO: 57079

SEQ ID NO: 256555 - RNA, 63 nt, hsa; identical to SEQ ID NO: 57080

SEQ ID NO: 256556 - RNA, 63 nt, hsa; identical to SEQ ID NO: 57081

SEQ ID NO: 256557 - RNA, 63 nt, hsa; identical to SEQ ID NO: 57082

SEQ ID NO: 256558 - RNA, 63 nt, hsa; identical to SEQ ID NO: 57083

SEQ ID NO: 256559 - RNA, 63 nt, hsa; identical to SEQ ID NO: 57084

SEQ ID NO: 256560 - RNA, 63 nt, hsa; identical to SEQ ID NO: 57085

SEQ ID NO: 256561 - RNA, 63 nt, hsa; identical to SEQ ID NO: 57086

SEQ ID NO: 256562 - RNA, 63 nt, hsa; identical to SEQ ID NO: 57087

SEQ ID NO: 256563 - RNA, 63 nt, hsa; identical to SEQ ID NO: 57088

SEQ ID NO: 256564 - RNA, 63 nt, hsa; identical to SEQ ID NO: 57089

SEQ ID NO: 256565 - RNA, 64 nt, hsa; identical to SEQ ID NO: 134242

SEQ ID NO: 256566 - RNA, 64 nt, hsa; identical to SEQ ID NO: 134243

SEQ ID NO: 256567 - RNA, 64 nt, hsa; identical to SEQ ID NO: 134244

SEQ ID NO: 256568 - RNA, 64 nt, hsa; identical to SEQ ID NO: 134245

SEQ ID NO: 256569 - RNA, 52 nt, hsa; identical to SEQ ID NO: 134246

SEQ ID NO: 256570 - RNA, 64 nt, hsa; identical to SEQ ID NO: 134247

SEQ ID NO: 256571 - RNA, 64 nt, hsa; identical to SEQ ID NO: 134248

SEQ ID NO: 256572 - RNA, 64 nt, hsa; identical to SEQ ID NO: 134249

SEQ ID NO: 256573 - RNA, 64 nt, hsa; identical to SEQ ID NO: 134250

SEQ ID NO: 256574 - RNA, 64 nt, hsa; identical to SEQ ID NO: 134251

SEQ ID NO: 256575 - RNA, 64 nt, hsa; identical to SEQ ID NO: 134252

SEQ ID NO: 256576 - RNA, 64 nt, hsa; identical to SEQ ID NO: 134253

SEQ ID NO: 256577 - RNA, 64 nt, hsa; identical to SEQ ID NO: 134254

SEQ ID NO: 256578 - RNA, 64 nt, hsa; identical to SEQ ID NO: 134255

SEQ ID NO: 256579 - RNA, 64 nt, hsa; identical to SEQ ID NO: 134256

SEQ ID NO: 256580 - RNA, 64 nt, hsa; identical to SEQ ID NO: 134257

SEQ ID NO: 256581 - RNA, 64 nt, hsa; identical to SEQ ID NO: 134258

SEQ ID NO: 256582 - RNA, 64 nt, hsa; identical to SEQ ID NO: 134259

SEQ ID NO: 256583 - RNA, 64 nt, hsa; identical to SEQ ID NO: 134260

SEQ ID NO: 256584 - RNA, 64 nt, hsa; identical to SEQ ID NO: 134261

SEQ ID NO: 256585 - RNA, 64 nt, hsa; identical to SEQ ID NO: 134262

SEQ ID NO: 256586 - RNA, 64 nt, hsa; identical to SEQ ID NO: 134263

SEQ ID NO: 256587 - RNA, 64 nt, hsa; identical to SEQ ID NO: 134264

SEQ ID NO: 256588 - RNA, 64 nt, hsa; identical to SEQ ID NO: 134265

SEQ ID NO: 256589 - RNA, 64 nt, hsa; identical to SEQ ID NO: 134266

SEQ ID NO: 256590 - RNA, 64 nt, hsa; identical to SEQ ID NO: 134267

SEQ ID NO: 256591 - RNA, 64 nt, hsa; identical to SEQ ID NO: 134268

SEQ ID NO: 256592 - RNA, 64 nt, hsa; identical to SEQ ID NO: 134269

SEQ ID NO: 256593 - RNA, 64 nt, hsa; identical to SEQ ID NO: 97841

SEQ ID NO: 256594 - RNA, 64 nt, hsa; identical to SEQ ID NO: 97842

SEQ ID NO: 256595 - RNA, 64 nt, hsa; identical to SEQ ID NO: 97843

SEQ ID NO: 256596 - RNA, 64 nt, hsa; identical to SEQ ID NO: 97844

SEQ ID NO: 256597 - RNA, 64 nt, hsa; identical to SEQ ID NO: 97845

SEQ ID NO: 256598 - RNA, 64 nt, hsa; identical to SEQ ID NO: 97846

SEQ ID NO: 256599 - RNA, 64 nt, hsa; identical to SEQ ID NO: 97847

SEQ ID NO: 256600 - RNA, 64 nt, hsa; identical to SEQ ID NO: 97848

SEQ ID NO: 256601 - RNA, 64 nt, hsa
ggugguggccuggggcaccggccaggugggccucgguggcgagguggucguucuggcaaaggcg

SEQ ID NO: 256602 - RNA, 64 nt, hsa
accacggcugggcgucugugccaggccucccgaagguggcgauggugagcagcagggguccugg

SEQ ID NO: 256603 - RNA, 64 nt, hsa
cuuagagaaaucuggagaacuauaccugcuucagugaaauaauuacagaauauacuuagaaagg

SEQ ID NO: 256604 - RNA, 64 nt, hsa
uuaaacuccaaaugagccauaggaaggcacuacaugaaauaaugcacugaguaugcaaugcuau

SEQ ID NO: 256605 - RNA, 64 nt, hsa
uucaaguuggagcaauugucuguguuugaaaagaugaaauaaaaauaauaaucaagggcaaagc

SEQ ID NO: 256606 - RNA, 64 nt, hsa
uauccccauuccaagaaauauaagugagugaaguugaaauaaaaucuuuaaaauuuacuauauu

SEQ ID NO: 256607 - RNA, 64 nt, hsa
accuggcuucuauaacaaauaaaugggaaaaaaaugaaauaaaaagaagagagggaggaagaaa

SEQ ID NO: 256608 - RNA, 64 nt, hsa
uaaaaaaagauaaauauuuccuacgucuguucacugaaauaauuaccaaccccuuagcaauaag

SEQ ID NO: 256609 - RNA, 64 nt, hsa
cuauuuugggguaucaguguuugacuagggaucaugaaauaauaaacugaaaaaaacuuuagag

SEQ ID NO: 256610 - RNA, 64 nt, hsa
cauccagaaagucuguuauuccucuuggauuuuuugaaauaaucuucagaggaaggaaggaaaa

SEQ ID NO: 256611 - RNA, 64 nt, hsa
caaugauaacuauuauuugugcaacauuacucuuugaaauaaaaauuggcauguagccaauguu

SEQ ID NO: 256612 - RNA, 64 nt, hsa
uacagccuaauuaauaccuagauaagacuucauuugaaauaagaaauaacucuuuuacuaguga

SEQ ID NO: 256613 - RNA, 64 nt, hsa
aaagaaauaugugaugaugugucuacuuuuuguuugaaauaacuguuggguguucccucuucuu

SEQ ID NO: 256614 - RNA, 64 nt, hsa
uauguugcuuguuugugacacuuagauaaucuucugaaauaauuuguuuuaaaguaaguuauau

SEQ ID NO: 256615 - RNA, 64 nt, hsa
uaaguuuccuacacgcuaacuucguuugugcgauugaaauaaaauugcaguauauauauguugc

SEQ ID NO: 256616 - RNA, 64 nt, hsa
ugaacucugauuaucagaaguuuuacuaaaacuuugaaauaauucacuuucaucugcuuucuag

SEQ ID NO: 256617 - RNA, 64 nt, hsa
ucgauacuguguacauagcagggagugaucggggugaaauaacuugggccagaauauuauuaaa

SEQ ID NO: 256618 - RNA, 64 nt, hsa
uuagguaacaaguucuuacaccaaacuuccuugaugaaauaagccaaaauaauccuaaaauuca

SEQ ID NO: 256619 - RNA, 64 nt, hsa
gcaggaaguacagacguacuuuaaauuuuuguuaugaaauaaaaaaaagauggguuuuguaaaa

SEQ ID NO: 256620 - RNA, 64 nt, hsa
ccaaggaaauggcauauggauuaacuguaagaaaugaaauaaguaauuuauuguaagacaacau

SEQ ID NO: 256621 - RNA, 64 nt, hsa
auuagaaaaugaaaaaugugugaauaacauuguaugaaauaaaccuggucuuguguuuuucucu

SEQ ID NO: 256622 - RNA, 64 nt, hsa
aguuugucuaaguccuggcucuuauugguucauaugaaauaauguuaacuucacuucuuuguau

SEQ ID NO: 256623 - RNA, 64 nt, hsa
cucuuacaagguaauuuacauauuuucuuucuguugaaauaacugaaaauguuaaaucuaccag

SEQ ID NO: 256624 - RNA, 64 nt, hsa
ugggacucaaaugcaaacagacuuucccuagaggugaaauaaccaacguggaguuuuccuuccc

SEQ ID NO: 256625 - RNA, 64 nt, hsa
cuugaucaacaaugaauucaaaauaguuaaccuaugaaauaacauccucucaaauguuugcuga

SEQ ID NO: 256626 - RNA, 64 nt, hsa
cacccaaguaaugaagacuuaagagaaccuugguugaaauaaauuuccaauaguuuggagacuc

SEQ ID NO: 256627 - RNA, 64 nt, hsa
ucauucuguguuaaaucauuucaggguuuaauuuugaaauaaaagauuaauauaaaaugcaaca

SEQ ID NO: 256628 - RNA, 64 nt, hsa
ucccauagggcauuaguucucagauuuuggaaugugaaauaaucaccuaggaaguugguuuaaa

SEQ ID NO: 256629 - RNA, 64 nt, hsa
agguaggaaguaagcuacuuagugguuucaccugugaaauaacuauuuugacugaaauguaaaa

SEQ ID NO: 256630 - RNA, 64 nt, hsa
aaaguauuugggcuaagguuauuauugccugauaugaaauaauauauucuuauucucauuguuu

SEQ ID NO: 256631 - RNA, 64 nt, hsa
cauugauauaacgcuguaauuaaaaauguuuauaugaaauaacuuaauguuuuaaauuuauuua

SEQ ID NO: 256632 - RNA, 64 nt, hsa
uuuuagucaucuuuuauauacuuuuaguuccacaugaaauaaauguuguuaagccuguaggacu

SEQ ID NO: 256633 - RNA, 64 nt, hsa
aaccuuaccuuagaugcuaacagaaggguccugcugaaauaacacugggugcuauauugauggg

SEQ ID NO: 256634 - RNA, 64 nt, hsa
augauggccuguaacaguugaagcaucuaaaaauugaaauaaauauauauuuuuaacauauauu

SEQ ID NO: 256635 - RNA, 64 nt, hsa
uuuugucuuaaaaagaccacauacccagcacccaugaaauaaaagauucaucuguaauugggau

SEQ ID NO: 256636 - RNA, 64 nt, hsa
agcuuaauguuuacaaguguuugaauuugugaucugaaauaacacaaaauuaaaaacaugauuu

SEQ ID NO: 256637 - RNA, 64 nt, hsa
ugaagaauuuaauuuuagaauaaauaauccaaucugaaauaauuauaccuucuuuccuuguuag

SEQ ID NO: 256638 - RNA, 64 nt, hsa
cccugcaucuuggagggaggcaggaaauuucuuuugaaauaaagugcuggagcugaauucugca

SEQ ID NO: 256639 - RNA, 64 nt, hsa
agcuuuauaucuguuccuaaaacaguuaauccugugaaauaaauauugaacauaauccagaaga

SEQ ID NO: 256640 - RNA, 64 nt, hsa
auuuuuuauuauuuuaauauacuguaagccaaacugaaauaacauuugcuguuuuauagguuug

SEQ ID NO: 256641 - RNA, 64 nt, hsa
uucuauuuuguuauauuuaauaauagaauuagauugaaauaaaauauaaugggaaauaaucugc

SEQ ID NO: 256642 - RNA, 64 nt, hsa
agccagacuucuaaggaguagugaaagaaaacccugaaauaaucgaacaggaaaaaguugcccu

SEQ ID NO: 256643 - RNA, 64 nt, hsa
auguaaagaauguuuugagcaaugguagcauuauugaaauaaauguuuaacuauccaaagugau

SEQ ID NO: 256644 - RNA, 64 nt, hsa
uuuaaauggacaauggacuguacaauaaguuacuugaaauaaguuguuucagauaaauuucaau

SEQ ID NO: 256645 - RNA, 64 nt, hsa
uuaaaauaaacauuuuguccaccuuuuaaguuaaugaaauaaaauuugaaacugacuuuugcag

SEQ ID NO: 256646 - RNA, 64 nt, hsa
gccugauaucaucuuaaaaaaaaaucucagaaucugaaauaagcccuaaauuucuccccaaaau

SEQ ID NO: 256647 - RNA, 64 nt, hsa
uuaacuucucaauuaugccaaaguugcacuugcaugaaauaaauauuauuuuguccuuguauag

SEQ ID NO: 256648 - RNA, 64 nt, hsa
gugugcacccacauccaauggugcuacaagugacugaaauaauauuugagucuuucugcucaaa

SEQ ID NO: 256649 - RNA, 64 nt, hsa
uuuauauaaaaacaaugauaaagaugugaaacugugaaauaaauauaccauauuagcuacccac

SEQ ID NO: 256650 - RNA, 64 nt, hsa
uuguaaacucuuuaugaucaacuguucccccuuuugaaauaagugcagauauuuauuuaacccu

SEQ ID NO: 256651 - RNA, 64 nt, hsa
uaugucauagauuucugcuccuccucucuuuuaaugaaauaacgugaccguuaacgcaaguaac

SEQ ID NO: 256652 - RNA, 64 nt, hsa
auacuuaaaaauggguuuauuuugauuucucaucugaaauaaucauguucugguauuauaucua

SEQ ID NO: 256653 - RNA, 64 nt, hsa
uuuguaucagagcaauuuugcuugcagaaagcuaugaaauaaaacacgucccuuaacugcauug

SEQ ID NO: 256654 - RNA, 57 nt, hsa
auuuuaauguacaaaacugaaaccagaugaaauaauguucugucacgugaaauauuu

SEQ ID NO: 256655 - RNA, 64 nt, hsa
gagcauggaaaaauacugccuagaaaaugcaaaaugaaauaagagagaguaguuuuucagcuag

SEQ ID NO: 256656 - RNA, 64 nt, hsa
cugaucaccauguaaggucacauuuaguaaaugcugaaauaaaaugauuaaugcauuuaucaau

SEQ ID NO: 256657 - RNA, 64 nt, hsa
ggccaauauauuuugaaauauugaugcagacaaaugaaauaauaaagagauuuucaugguuuau

SEQ ID NO: 256658 - RNA, 64 nt, hsa
auuuuuaaauauauauauauauauacacacauugugaaauaaugaaauaaagguaauuaacaca

SEQ ID NO: 256659 - RNA, 64 nt, hsa
auauauauauauauauacacacauugugaaauaaugaaauaaagguaauuaacacaucuagcac

SEQ ID NO: 256660 - RNA, 64 nt, hsa
acaaauuuuaugcuuagcagcuucuucacuguuuugaaauaaaauauccuauuaccuacugaua

SEQ ID NO: 256661 - RNA, 64 nt, hsa
auuuuauuuccuaaaaucuaaauucagucuuuaaugaaauaauauuagccaaaugguggaacua

SEQ ID NO: 256662 - RNA, 64 nt, hsa
gccaaaauuuacccguguagccuguuaauuuucuugaaauaaguuuuacauuuuuggcacauaa

SEQ ID NO: 256663 - RNA, 64 nt, hsa
ucucacaugguuugaaacuuaaagugcacaucacugaaauaaugagauuuucuucuacggugug

SEQ ID NO: 256664 - RNA, 64 nt, hsa
gaaauaagauugacuuugaaucugcaacaagaucugaaauaaaugagaagccaagcucuucaag

SEQ ID NO: 256665 - RNA, 64 nt, hsa
auucaacugcaucuccaaacauuacucaugaccuugaaauaaaauaggaaccuaugaaacuauu

SEQ ID NO: 256666 - RNA, 64 nt, hsa
auuuuuaauaugacaaaacaaauuuuaaaagauuugaaauaauuguauuucucugaauucagug

SEQ ID NO: 256667 - RNA, 64 nt, hsa
uuuuuuaaaaagaggaucccaaacuguaaaagauugaaauaaucuuucucaggauuuuuuaaau

SEQ ID NO: 256668 - RNA, 64 nt, hsa
cuuuuuucagguaauagaagugaauaauuuauugugaaauaauucauuuuauaaauguauaauu

SEQ ID NO: 256669 - RNA, 64 nt, hsa
aagagaauggcugaugucucuuucuuggaauaugugaaauaaauuuagcaguuuaacuaaauac

SEQ ID NO: 256670 - RNA, 64 nt, hsa
aaucuuuuuuuauggaaccuguugcgccuauuuaugaaauaauaaauauagguguuuguaagua

SEQ ID NO: 256671 - RNA, 64 nt, hsa
uuaguuguuuucuuauuuuuuuggcuuaguauguugaaauaaacuaugguaucuucaucauuuu

SEQ ID NO: 256672 - RNA, 64 nt, hsa
caagagugugaccuaaaugcuuuugucuugucacugaaauaaaagauggcauuaugugguuaag

SEQ ID NO: 256673 - RNA, 64 nt, hsa
ugggaaauuuguaucuccaaggcggcucugucucugaaauaaauggcaucaagugcaugugugu

SEQ ID NO: 256674 - RNA, 64 nt, hsa
cuccagccaccucagugcucuaagcucacagaagugaaauaaugucuguggguuggcaauggcu

SEQ ID NO: 256675 - RNA, 64 nt, hsa
cuuuguuuuuugaaaucgauugggaucgaaagccugaaauaaauauucauacuuuccauagaac

SEQ ID NO: 256676 - RNA, 64 nt, hsa
gucuuuuucugcccaucugucuacuaauaaaaugugaaauaaaauaccuguauugcuacuuccc

SEQ ID NO: 256677 - RNA, 64 nt, hsa
accaauugcugcuacuuauauaauugccaaaaagugaaauaauguguaguucauguaaauaaua

SEQ ID NO: 256678 - RNA, 64 nt, hsa
aagaaauugaauacuuugaauguguuucacaguuugaaauaagcuauuugauguaauacuucuu

SEQ ID NO: 256679 - RNA, 64 nt, hsa
ucaucuaccuucaggauugcugacagacagaauuugaaauaaaauaugcaaguuagcuaauaca

SEQ ID NO: 256680 - RNA, 64 nt, hsa
uaugcagccuuuccucuguacuuuucuccaugguugaaauaaaacagggugacugggaguuacu

SEQ ID NO: 256681 - RNA, 64 nt, hsa
cuuucagaaauuguaaauaucuuguagcauauucugaaauaauagaguaaguucuucucagaga

SEQ ID NO: 256682 - RNA, 64 nt, hsa
uuuuguuauuaaacucaaaaggcagugauuaggaugaaauaauuguacauaauuuauuuuagua

SEQ ID NO: 256683 - RNA, 64 nt, hsa
guauaucucugaaauaaugaaauauauugaugggugaaauaauauuucugguauuuucuucauu

SEQ ID NO: 256684 - RNA, 64 nt, hsa
aagaauuuacaucuuuuacaaauauguauaucucugaaauaaugaaauauauugaugggugaaa

SEQ ID NO: 256685 - RNA, 64 nt, hsa
guccuguuauauguauaucaggaauacaaggaugugaaauaaaacuguaaauuugcauaacugg

SEQ ID NO: 256686 - RNA, 64 nt, hsa
guaaauuugcauaacuggauguacuuagauaaugugaaauaaacauuaaagacaaggucuauuu

SEQ ID NO: 256687 - RNA, 64 nt, hsa
uguacauuuguaauuagugccuuuauucauauuuugaaauaaguucuuaguuuuauauuauacc

SEQ ID NO: 256688 - RNA, 64 nt, hsa
uagaagucauguuagcagcuaauuauuucagugaugaaauaauuuguguuuuauaucccccuuc

SEQ ID NO: 256689 - RNA, 64 nt, hsa
uguucaaauaaacaaaaaauccaagauugauucaugaaauaaagaagacaugaauuguuuuaag

SEQ ID NO: 256690 - RNA, 64 nt, hsa
aaaucaaauuaagaaaaccugagucuuuagaagcugaaauaaucaacuuguuugugcuguuugc

SEQ ID NO: 256691 - RNA, 64 nt, hsa
uuccaaucauugcuagaaaauuggcauauuccuuugaaauaaacuuaugaaauguuuucucucu

SEQ ID NO: 256692 - RNA, 64 nt, hsa
auuuuaaaagcacuuucuauuuuuaaaaguaacuugaaauaauauaguauaagaauccuauugu

SEQ ID NO: 256693 - RNA, 64 nt, hsa
ugacauggaugaaccuugaguacauuaugcgaagugaaauaagccacccuguggggauggagaa

SEQ ID NO: 256694 - RNA, 64 nt, hsa
agcuaaacuaaucaaaaucuuauaugaauaauuuugaaauaacucugaaagauggucauaugau

SEQ ID NO: 256695 - RNA, 64 nt, hsa
uauuacauuacaucaaauaaaguuuauuuguagcugaaauaaagcaacguaaguaacaauuuuu

SEQ ID NO: 256696 - RNA, 64 nt, hsa
ucaugauucaugauugaaagcagaacaauggagaugaaauaaacaaggcaaaauagagguggaa

SEQ ID NO: 256697 - RNA, 64 nt, hsa
ugcauuuucaaagauaaauuggaauugcuguuggugaaauaacaaccaaaauacugaaucugau

SEQ ID NO: 256698 - RNA, 64 nt, hsa
aucuuguuuaaauguaaauguccccuuaugcuuuugaaauaaauuuccuuuuguaauuuuguuu

SEQ ID NO: 256699 - RNA, 64 nt, hsa
uugugaaaaaagaagacuaaauuaagaccugagcugaaauaaagugaguggaaauggaaauaau

SEQ ID NO: 256700 - RNA, 64 nt, hsa
aaaaaaucagucugagaguauuagucacaauuaaugaaauaauuacauuuuauguauugaggau

SEQ ID NO: 256701 - RNA, 64 nt, hsa
caauggucuauauaagcaaaaggagauagagaucugaaauaauuuuccgaauaauucaggugga

SEQ ID NO: 256702 - RNA, 64 nt, hsa
acagaggaauuuuguuuuaauguagaaaguuauuugaaauaaacuaggugaaaugaaauuaacu

SEQ ID NO: 256703 - RNA, 64 nt, hsa
cucugacuuugaaauaguguuauuuuucuauaucugaaauaaaugcuucuaccauagaaauaaa

SEQ ID NO: 256704 - RNA, 64 nt, hsa
ggaagauguacuccguaucaaauaauaaugauguugaaauaaugauaguagguauguauuaugg

SEQ ID NO: 256705 - RNA, 64 nt, hsa
aagaccucuggcuaagagcaggcuucaaacgaugugaaauaagcugagauggcuacaugauauu

SEQ ID NO: 256706 - RNA, 64 nt, hsa
accggggaagucugacauaugcaggaaacucuuuugaaauaacuuuggugcccaggccaaguag

SEQ ID NO: 256707 - RNA, 64 nt, hsa
uguucaguacaauuauaagcuguuuuuauauaugugaaauaaaaguagaauaaacacaaugguu

SEQ ID NO: 256708 - RNA, 64 nt, hsa
gaugcacuuuauauuauuuugaauccagaaauaaugaaauaacuaggcguggacuuacuauuua

SEQ ID NO: 256709 - RNA, 64 nt, hsa
acaagagcucuguaauaacaguaauaaauagcucugaaauaacaguccuaagaacuccuaaagu

SEQ ID NO: 256710 - RNA, 64 nt, hsa
uucuguugguugugcccaagggcuacaguagcucugaaauaacaagagcucuguaauaacagua

SEQ ID NO: 256711 - RNA, 64 nt, hsa
aaauaguucugaacauuuuucuauucauucauuuugaaauaauuaugcagacacaucagcuguu

SEQ ID NO: 256712 - RNA, 64 nt, hsa
augaaugacaugaccuuucccuagagaauaaggaugaaauaaucacucauucuaugaacaguga

SEQ ID NO: 256713 - RNA, 64 nt, hsa
aggccuuugcaaauggccuaaaugguguucccuuugaaauaacgcuugccacaaguauauaaua

SEQ ID NO: 256714 - RNA, 64 nt, hsa
uguuuuauauuaaaaaaaaccuguuauguacaguugaaauaaauuuugcauuugcuagcccgug

SEQ ID NO: 256715 - RNA, 64 nt, hsa
aauagauauuggauucugucagaaggccuagauuugaaauaauguuuuguacuucgguaagaug

SEQ ID NO: 256716 - RNA, 64 nt, hsa
auuuaucuucuuaagucuucauugauauucugugugaaauaagcaugucuuguacuugcuuucu

SEQ ID NO: 256717 - RNA, 64 nt, hsa
uugaagaccuuugagaaugcuuuaguguuugauuugaaauaaaaggaaauuuuagcaaggauua

SEQ ID NO: 256718 - RNA, 64 nt, hsa
aaagaccaacaaauggauguugacaacaacccaaugaaauaacauuuugcauaucugaaaagaa

SEQ ID NO: 256719 - RNA, 64 nt, hsa
gaauugacuucuuuuccuugaauggaaaacacuuugaaauaauaauaaacauuguuauaaacua

SEQ ID NO: 256720 - RNA, 64 nt, hsa
acuauuaaacaauguaacugcuaucuuaauguucugaaauaaguuaaaacauuuuaaaauauga

SEQ ID NO: 256721 - RNA, 64 nt, hsa; identical to SEQ ID NO: 256720

SEQ ID NO: 256722 - RNA, 64 nt, hsa; identical to SEQ ID NO: 256719

SEQ ID NO: 256723 - RNA, 64 nt, hsa
auuuaaacuguuucauuugguaguaccuuuacauugaaauaaauuguguuugugccuccaaaca

SEQ ID NO: 256724 - RNA, 64 nt, hsa
aacuuuauaaaaaucuugaguuuguucacuaaugugaaauaagcuauguguccaggguauugcu

SEQ ID NO: 256725 - RNA, 64 nt, hsa
ugauagagggucaguguuauaaauaauugucuuuugaaauaaaaucaaauauucaugcauugaa

SEQ ID NO: 256726 - RNA, 64 nt, hsa
caucugagugaguccauaugaagcgagguuaggcugaaauaauugcuuaaagaugucuuucaga

SEQ ID NO: 256727 - RNA, 64 nt, hsa
uccggccacuccugggagacagacccuuuggugaugaaauaaaccagugacuucagagccuaug

SEQ ID NO: 256728 - RNA, 64 nt, hsa
uguucagcaugcaauggaaucaugcuuguccaugugaaauaaauauggcucucucguguccuua

SEQ ID NO: 256729 - RNA, 64 nt, hsa
caaccuggauggaguuggagaucauuauucuaagugaaauaacucaggaauggagaaccaaaua

SEQ ID NO: 256730 - RNA, 64 nt, hsa
uguaaccaaaagccaucugcuccccaaaaacuauugaaauaaaauaaaauauaaaaagaaagag

SEQ ID NO: 256731 - RNA, 64 nt, hsa
guucugagacaccugaugaccuguuagaugauggugaaauaaaggaagauacuaguuuugcuga

SEQ ID NO: 256732 - RNA, 64 nt, hsa
aacaaagucuuccuggaaguaauuguaagcauccugaaauaaaaaagcaagaauaugaagaagu

SEQ ID NO: 256733 - RNA, 64 nt, hsa
cgauuuguuugcugaaaaugugaaauaguaaaaaugaaauaacuggacccuuucuggcucugcg

SEQ ID NO: 256734 - RNA, 64 nt, hsa
uuauuugacaaaaaauccaguuaauauauuaaugugaaauaaacccuguuugcaccucgauuug

SEQ ID NO: 256735 - RNA, 64 nt, hsa
uuuaaauuuucaaacaacauagauuuacucaagaugaaauaaaaaggccauauucagaguugaa

SEQ ID NO: 256736 - RNA, 64 nt, hsa
auuuuaaauagcuucuacucuuauuuuuguucuuugaaauaauuaaaagagggauuaucacuau

SEQ ID NO: 256737 - RNA, 64 nt, hsa
uguauaaugugucagaauauccuuccuuuuuaggugaaauaauauucuaugguauuuauauacc

SEQ ID NO: 256738 - RNA, 64 nt, hsa
guggauacuugggcuacuuccaccuuuugccuauugaaauaaugcugcuaugaagaugagugua

SEQ ID NO: 256739 - RNA, 64 nt, hsa
uuaaguaucucaauuuuucauauugaguacauauugaaauaauauuuuagauauauugguucaa

SEQ ID NO: 256740 - RNA, 64 nt, hsa
aauuauauuagaaaaacuauuguguaacacauaaugaaauaauggaucuaggcaugauucucug

SEQ ID NO: 256741 - RNA, 64 nt, hsa
aaauaaauaaaacagcagcagcaaacaaauaaaaugaaauaaaagaaacaaaugaaauaaauau

SEQ ID NO: 256742 - RNA, 64 nt, hsa
cagcaaacaaauaaaaugaaauaaaagaaacaaaugaaauaaauauuguguugugcagcauuaa

SEQ ID NO: 256743 - RNA, 64 nt, hsa
acagauuuaugaaagcaagugaaucugguuaauaugaaauaaguacuaagucacaugcaaauca

SEQ ID NO: 256744 - RNA, 64 nt, hsa
augauuaugaauguuagaaucaauuugcugaguaugaaauaagaaaaguuagggcacuccacuu

SEQ ID NO: 256745 - RNA, 64 nt, hsa
agaaaauggucuuuuugcuuugcccuuuuaaagcugaaauaaccagcuccauucuuuucaugaa

SEQ ID NO: 256746 - RNA, 64 nt, hsa
aaagcauagccgacaaugguagcuucucaaguuaugaaauaaaacugagagauaauggagaaaa

SEQ ID NO: 256747 - RNA, 64 nt, hsa
gugucccuguugugugguggaaccuaaugacuguugaaauaaaguucuguguuuucccugcccu

SEQ ID NO: 256748 - RNA, 64 nt, hsa
acacgggcggcauuuaaauaggaauuucuauuuuugaaauaagggauggucuaugaggcauaca

SEQ ID NO: 256749 - RNA, 64 nt, hsa
uguuuucuuggcuaguaauaguaguagauacuucugaaauaaauguucucucaagauccuuaaa

SEQ ID NO: 256750 - RNA, 64 nt, hsa
augggauguauauauaucauugcuguuagagaaaugaaauaaaauggggcugggcucaguggcu

SEQ ID NO: 256751 - RNA, 64 nt, hsa
uaauacuuagaaggguuaauuggaaaucagaguuugaaauaaaacuuggaccacuuuguauaca

SEQ ID NO: 256752 - RNA, 64 nt, hsa
guacuuuuaacaauucccaguacuaucaguauugugaaauaauuccucugaaagauaagaauca

SEQ ID NO: 256753 - RNA, 64 nt, hsa
ccuucugccauuuuuuauuuucaguuauaugugcugaaauaauuacugguaaaauuucaggguu

SEQ ID NO: 256754 - RNA, 64 nt, hsa
acuugauaugaaacuccuauuaacagucuuuuuuugaaauaaaaaguagcuugagcuuucuuuu

SEQ ID NO: 256755 - RNA, 64 nt, hsa
cagguugaaugcuuugaauuucuggugacuacuuugaaauaacuuguuuuguuugucaaauucu

SEQ ID NO: 256756 - RNA, 64 nt, hsa; identical to SEQ ID NO: 125921

SEQ ID NO: 256757 - RNA, 64 nt, hsa; identical to SEQ ID NO: 125922

SEQ ID NO: 256758 - RNA, 64 nt, hsa; identical to SEQ ID NO: 125923

SEQ ID NO: 256759 - RNA, 64 nt, hsa; identical to SEQ ID NO: 125924

SEQ ID NO: 256760 - RNA, 64 nt, hsa; identical to SEQ ID NO: 125925

SEQ ID NO: 256761 - RNA, 64 nt, hsa; identical to SEQ ID NO: 125926

SEQ ID NO: 256762 - RNA, 64 nt, hsa; identical to SEQ ID NO: 125927

SEQ ID NO: 256763 - RNA, 64 nt, hsa; identical to SEQ ID NO: 125928

SEQ ID NO: 256764 - RNA, 64 nt, hsa; identical to SEQ ID NO: 125929

SEQ ID NO: 256765 - RNA, 64 nt, hsa; identical to SEQ ID NO: 125930

SEQ ID NO: 256766 - RNA, 64 nt, hsa; identical to SEQ ID NO: 125931

SEQ ID NO: 256767 - RNA, 64 nt, hsa; identical to SEQ ID NO: 125932

SEQ ID NO: 256768 - RNA, 64 nt, hsa
ccacagagaaaucaccucucuuccuuugucuuuuaagaacuauuugguauuaacuaguuucaga

SEQ ID NO: 256769 - RNA, 64 nt, hsa
gauggcuucaugauccagcacagugccucacacaaagaacuauuggguggguggauggauggau

SEQ ID NO: 256770 - RNA, 64 nt, hsa
uaaaucagugaauauguuaaaaaguuugguuuaaaagaacuauaucuauauguauauuuucaua

SEQ ID NO: 256771 - RNA, 64 nt, hsa
uaacuaccauauauaacguguuauugccaucuagaagaacuaugaugagaaagauacauuuaua

SEQ ID NO: 256772 - RNA, 64 nt, hsa
ugguuuuggguuuuuuuuuuuuuuuuuuugguauaagaacuaacaucaaaaggccuguuuaaag

SEQ ID NO: 256773 - RNA, 64 nt, hsa
aggcugccacaguggaauauuaucuuacaagaauaagaacuacauaaaacagauuuguaaaaaa

SEQ ID NO: 256774 - RNA, 64 nt, hsa
uuuaaugaaacauguauaugucaaaucagaagagaagaacuauaaacauauauuguguaaagaa

SEQ ID NO: 256775 - RNA, 64 nt, hsa
auuguuuacaccagugagagggagaucaaaagcuaagaacuacccuguagccaggacuacaacu

SEQ ID NO: 256776 - RNA, 64 nt, hsa
aaccuugcacgcauuuggauaccuugugauuuccaagaacuacgugaagauuaagcuuugcuua

SEQ ID NO: 256777 - RNA, 64 nt, hsa
gagugaggaacagaauguuuuaaaucuggugcaaaagaacuauaucugcuggaugagccuugaa

SEQ ID NO: 256778 - RNA, 64 nt, hsa
uaccauggagccauagaaaggcuauggauuguuuaagaacuauuuuaaaguguuccagacccaa

SEQ ID NO: 256779 - RNA, 64 nt, hsa
cuagguuuucuuuccagaaauagguagcaaggacaagaacuaaacaaucccagccccacccagc

SEQ ID NO: 256780 - RNA, 64 nt, hsa
cauaggaauucaugaaggcgacccaaccuggaaaaagaacuauucacuuuggccaugggggucu

SEQ ID NO: 256781 - RNA, 64 nt, hsa
cuauuuacaaaaggagcacccagugaauuggcacaagaacuaugccaucgccugugagcggaug

SEQ ID NO: 256782 - RNA, 64 nt, hsa
cgugaccaugguguuguucuugaugacauugcuucugcuaaauuuaauaaaaacuucagaaaaa

SEQ ID NO: 256783 - RNA, 64 nt, hsa
gcuaugcacuguaaaugcagccuucuuuucaaaacugcuaaauuuuucuuaaucaagaauauuc

SEQ ID NO: 256784 - RNA, 53 nt, hsa
auaagaagauagaaucauagugucugcuaaauaagacauauaagaacucugaa

SEQ ID NO: 256785 - RNA, 64 nt, hsa
ugaauccucucuggagaggguccaacugggaauccugcuaaaggagcaaagccuuguauuaccu

SEQ ID NO: 256786 - RNA, 64 nt, hsa
guaacugugcuaaucuaucuagagaccucaaacacugcuaaaggccuugcaauugcugcuuuac

SEQ ID NO: 256787 - RNA, 64 nt, hsa
ucaccucccuugccuuuguuucugaaaauuuugucugcuaaaaaguuucugcuacagaguggua

SEQ ID NO: 256788 - RNA, 64 nt, hsa
uaggacuuaaaggugauuuggaugcguuguaacacugcuaaauaugcuaaguacagaauuuuau

SEQ ID NO: 256789 - RNA, 64 nt, hsa
guugaaaucuuugccuccucagucgggaagaguccugcuaaaaaucaggcuaaaaaucaggcca

SEQ ID NO: 256790 - RNA, 64 nt, hsa
gaggggauaggaaguagguuuaaagccuaccaguguaaccuaccaguacaacugugaauccuag

SEQ ID NO: 256791 - RNA, 64 nt, hsa
ucccguucuauuuuaugaugguugauaauagucaguaaccuaauaaaggaacguuuguuaaaau

SEQ ID NO: 256792 - RNA, 64 nt, hsa
cccccacagguuuggcuugugguuuuugucaucaguaaccuacugccugagaucaugaucucuu

SEQ ID NO: 256793 - RNA, 64 nt, hsa
cgucauggcuaagagaacaaaucugauaaauuguguaaccuagucucuucucuacauggugaug

SEQ ID NO: 256794 - RNA, 64 nt, hsa
augaaauaauguaugugaaagcaccuuguaaacuguaaccuaucaauguaaaauguuaaggugu

SEQ ID NO: 256795 - RNA, 53 nt, hsa
uguaucaaaccuugcuuuaaucaguaaccuaaggacuguuuccuuuuucuccu

SEQ ID NO: 256796 - RNA, 64 nt, hsa
aauggaggggacaaucuccugggagcuaugcgcaguaaccuaacuuccuuaugucccauggauc

SEQ ID NO: 256797 - RNA, 64 nt, hsa
ucuuuccagauguuaaagaacuucuaucaauagaguaaccuaucacuagaguucaccucuauca

SEQ ID NO: 256798 - RNA, 64 nt, hsa
cugccuuaacuaacuccucugcgcuuguucacuaguaaccuaaagaggcuauauucauucuuua

SEQ ID NO: 256799 - RNA, 64 nt, hsa
agaacaaauguuuuauuauuacuugagcacaaguguaaccuaaauauuucuauauuaaagcuua

SEQ ID NO: 256800 - RNA, 64 nt, hsa
gcuuugccacuaguaaaugugugaucuucggcaaguaaccuaaccuagggacaucaguuuacuc

SEQ ID NO: 256801 - RNA, 64 nt, hsa
auaauuucacauaguuucucuuuuucauguaacuguaaccuaaauguauuacuucugauaaaac

SEQ ID NO: 256802 - RNA, 64 nt, hsa
cauuauuauaagggauuugugaugucuguaaaguguaaccuaggaaagauaauucaaccaucua

SEQ ID NO: 256803 - RNA, 64 nt, hsa
aacauaauggugaugguuggccauuugagucuuuguaaccuaggaaagacaaaggucugauuca

SEQ ID NO: 256804 - RNA, 64 nt, hsa
uuagggaugggggacagauaacagaacgagcaaaguaaccuauacaggccagcauggaacagca

SEQ ID NO: 256805 - RNA, 64 nt, hsa
acucaguggucaaaauaauuuuuaagaguauuccguaaccuauauuuuacuuuucugauuauau

SEQ ID NO: 256806 - RNA, 64 nt, hsa
cacuggauugacgcaaaguuuugaguuuauuucaguaaccuacauagguguccuggugggaugg

SEQ ID NO: 256807 - RNA, 64 nt, hsa
aguagacuggguauggggaaccuaagucauaguuguaaccuacagcugauugguaagaacuaug

SEQ ID NO: 256808 - RNA, 64 nt, hsa
uauuacagccauggggaagagugaaagauauaaaguaaccuaauuaaauguauggaauugcuau

SEQ ID NO: 256809 - RNA, 64 nt, hsa
uacaugaacagaaacugcccagguggaacagcacguaaccuagugagugacuguacuccuuucu

SEQ ID NO: 256810 - RNA, 64 nt, hsa
guucuuugacagagcauauugcuugguuaauuaaguaaccuaaaguaugcauuaggauugugaa

SEQ ID NO: 256811 - RNA, 64 nt, hsa
ugccucucugauacgaauacacugacacgucaaaguaaccuaauguggacaccauccagaaaac

SEQ ID NO: 256812 - RNA, 64 nt, hsa
uaccuaacuguacagugagugugggggaaauguaguaaccuaguuaguagucuucaauauaacc

SEQ ID NO: 256813 - RNA, 64 nt, hsa
uagguacuaaaggagggauguacuuucagaucauguaaccuauuacgaaggaguggaagaggag

SEQ ID NO: 256814 - RNA, 64 nt, hsa
cuuuuuuuuuucuuaaagaagggcagccaagguaguaaccuaaaaauagugcccaggcauauga

SEQ ID NO: 256815 - RNA, 64 nt, hsa
uucagaaauagguguguguguugauguguuuuugguaaccuagcuuucauacacauaauauaug

SEQ ID NO: 256816 - RNA, 64 nt, hsa
uuucuuacacacucuauccucugcacuguuaauaguaaccuaugacauaauuguaaauauucag

SEQ ID NO: 256817 - RNA, 64 nt, hsa
cuuuaaaauacauagaaauaaaguuaguaauuagguaaccuaugauaacauaauaauguggacg

SEQ ID NO: 256818 - RNA, 64 nt, hsa
gagcacuacaaauuuagaauauauaaaaauaucaguaaccuaugaauucaucaacauaacucac

SEQ ID NO: 256819 - RNA, 64 nt, hsa
uucugggcugcauuuuucuuauugauuuggaauuguaaccuauguaugagaaagggauuuucug

SEQ ID NO: 256820 - RNA, 64 nt, hsa
aguucucuucuaggauuuguuuggcugacuggcaguaaccuagugaauuucugaaagaugagua

SEQ ID NO: 256821 - RNA, 64 nt, hsa
cccgaguaaggugguugggguguugaaguaccaaguaaccuacaagccuccuaguucugaaaag

SEQ ID NO: 256822 - RNA, 64 nt, hsa
guuuugggacaaaauuauaaaaugaaauguguagguaaccuauuuauauacugcuauaaaguau

SEQ ID NO: 256823 - RNA, 64 nt, hsa
uaagcacuguguuccagaccgugucugacuuaguguaaccuaggagauuuuauaguuuuauuuu

SEQ ID NO: 256824 - RNA, 64 nt, hsa
auaucuacccaucaucaaaaaucacaucagauaaguaaccuauuuuacauaguagaggcuaaau

SEQ ID NO: 256825 - RNA, 64 nt, hsa
cugcaaagagucuuuaaaugggggcugauuucaaguaaccuaaaagacuguguuaucagaggaa

SEQ ID NO: 256826 - RNA, 64 nt, hsa
aaaugagcucauuaaugucaucgaaacauuuauuguaaccuaacagaccaucacagauuggaaa

SEQ ID NO: 256827 - RNA, 64 nt, hsa
ugaggagcaggaggacuauucaagauaaacuucuguaaccuaugcauauuuuaugggggcagua

SEQ ID NO: 256828 - RNA, 64 nt, hsa
aguguauccaccaguuuuuuguuuauguuuuuaaguaaccuauuaucucuggauuucaugaagg

SEQ ID NO: 256829 - RNA, 64 nt, hsa
uacaagaauaacaauacuuacaacuuccauuuuuguaaccuacguucacuuaugaucuggauuu

SEQ ID NO: 256830 - RNA, 64 nt, hsa
ggaccugcugucauaaaugugugaacaaccuuuuguaaccuaaccuauugaccugcauguuuuu

SEQ ID NO: 256831 - RNA, 64 nt, hsa
uucucaguuuuauuuuuaccuaacacuaacaugaguaaccuaagggaagugcugaaugguguug

SEQ ID NO: 256832 - RNA, 64 nt, hsa
accuuuguuuccuuauucaggaagauaaaaaucaguaaccuaccccaugaagauauuugguggg

SEQ ID NO: 256833 - RNA, 64 nt, hsa
uggagacuucauagcauccagaagaaguguugaaguaaccuaaacuugaccugcuuaauacauu

SEQ ID NO: 256834 - RNA, 64 nt, hsa
aacugaaacucaacucagagugaaaguguuguguguaaccuaggagcaggaaacuucagcuuaa

SEQ ID NO: 256835 - RNA, 64 nt, hsa
gcuggugcuuuaacuauauugaccaagguguauaguaaccuauuuaucacauuuuacgaagcaa

SEQ ID NO: 256836 - RNA, 64 nt, hsa
auacuuaauuuuggcauuugacucuuaagauuauguaaccuagcuacuuugggauggucuuaga

SEQ ID NO: 256837 - RNA, 64 nt, hsa
cuuagaaaaagcacaggaaacagaccuuaaaauuguaaccuaccaacuaacuuacaugcuuaua

SEQ ID NO: 256838 - RNA, 64 nt, hsa
aagauguuuauuaauagaaugauaaauguacagaguaaccuauaagcaugacauacuuuugcuu

SEQ ID NO: 256839 - RNA, 64 nt, hsa
aaaguuaguauauaggcaucaaacaaccuuggcuguaaccuauagaaucucuauccacguauca

SEQ ID NO: 256840 - RNA, 64 nt, hsa
uuuuguucuagccaugaauuugccugagaaacuuguaaccuaugugccucaauauauuccauag

SEQ ID NO: 256841 - RNA, 64 nt, hsa
uguguuuauugccuauaauggguccccaaaauggguaaccuagacuucagagagaaugagcaga

SEQ ID NO: 256842 - RNA, 64 nt, hsa
ugacaguggcugcucugggaaggggcuuuuagauguaaccuacaauucaguuaggcuagagaca

SEQ ID NO: 256843 - RNA, 64 nt, hsa
cugacuguagccacaucucucccgcucccuaaggguaaccuagccaauggaagcugcccuuugg

SEQ ID NO: 256844 - RNA, 64 nt, hsa
cucauguacaguuacaggaaauuaaaauguuaaaguaaccuaaaaugaauucagaccaauaaaa

SEQ ID NO: 256845 - RNA, 64 nt, hsa
ucaucauuagacaacuggaguuuuugcugguuuuguaaccuaccaaaauggauaggcuguugaa

SEQ ID NO: 256846 - RNA, 64 nt, hsa
uuccccaggagaugauccuguuaaguguucggcaguaaccuacuuuguuccuucgccucagcag

SEQ ID NO: 256847 - RNA, 64 nt, hsa
cugguauuuuucuguaaagaccauuugcaaaauuguaaccuaauacaaaguguagccuucuucc

SEQ ID NO: 256848 - RNA, 64 nt, hsa
cauggggcagugggaaagaguucagguuuugaagguaaccuaguuuagauuugaauuccagcua

SEQ ID NO: 256849 - RNA, 64 nt, hsa
gugaugacuguuuugguuugaaaugaacagauugguaaccuaauuuguggccuccugacuuuua

SEQ ID NO: 256850 - RNA, 64 nt, hsa
cagagguaacaguguccaaauauaauuggccuaaguaaccuaggaaauuguuugacauaacaca

SEQ ID NO: 256851 - RNA, 64 nt, hsa
gcuucccuaugugguaaaagaaaggcauuccuccguaaccuaggcacucugcaaguccaguguu

SEQ ID NO: 256852 - RNA, 64 nt, hsa
uuggauguaaaggaguccuggguaaaauguggcuguaaccuaaaccaacuaguccuugugauuu

SEQ ID NO: 256853 - RNA, 64 nt, hsa
aaauaaaaacaugagucacagcuuuuguucugugguaaccuauaaaaaaaguuugucuuugaga

SEQ ID NO: 256854 - RNA, 64 nt, hsa
caauucuuucaacuccuguuaauacccauaaucaguaaccuaucaagaaaagcccuuauuugga

SEQ ID NO: 256855 - RNA, 64 nt, hsa
ugugcuugaacauucuaaaacgaguccaguucuaguaaccuaaaguaaauuuguuaaccaaaau

SEQ ID NO: 256856 - RNA, 64 nt, hsa
aauacccaaaaggguuuuauggaaacuaacaucaguaaccuaacccccgugacuauccugugcu

SEQ ID NO: 256857 - RNA, 64 nt, hsa
uaugcccaauaauuuguuaucauuuccuuagguaguaaccuauuuuuguucugguuugguucgg

SEQ ID NO: 256858 - RNA, 64 nt, hsa
cugcuggcuacugcagagacccuuggcuauuugaguaaccuaggauuagugagaaggggcagaa

SEQ ID NO: 256859 - RNA, 64 nt, hsa
uucucuacaaaccuaguugcuaaaacuaccuguuguaaccuaaaaccaguuuuaucuaacagcu

SEQ ID NO: 256860 - RNA, 64 nt, hsa
cauuagaauugaauuauugggcuuaauauaaaucguaaccuaugaaguuuauuuucuauuuuag

SEQ ID NO: 256861 - RNA, 64 nt, hsa
acuccgagcagaaaucacaucuugcccacaugcuguaaccuaagaaacugcuaugcaaggcugg

SEQ ID NO: 256862 - RNA, 64 nt, hsa
uauguucccuugguaccaagagguacuaugcaaaguaaccuauuacaccaaguuacuugcuuug

SEQ ID NO: 256863 - RNA, 64 nt, hsa
aguuccaucugcaacuuuaguucccacuggcuguguaaccuaacauagucacaggcucugggga

SEQ ID NO: 256864 - RNA, 64 nt, hsa
aguacguuacuuauuaaagggcgacucuguguaaguaaccuaagaaacgaagaaaaauucuuau

SEQ ID NO: 256865 - RNA, 64 nt, hsa
gucuugguguuaucaggguuaagccuguaauuauguaaccuauuuaucgcaacaugaauuuuua

SEQ ID NO: 256866 - RNA, 64 nt, hsa
auguaugcguauauggaauugaaaugucauuauuguaaccuagaaagugcuuugaaauauugau

SEQ ID NO: 256867 - RNA, 64 nt, hsa
gaauaagauuguucauugcauuucugaguauuauguaaccuauuuuugcagaagguacuguuac

SEQ ID NO: 256868 - RNA, 64 nt, hsa
cucaugcaugucuaaccugauuuaccucuuaccuguaaccuaccuuaucauguggcuuuuaauu

SEQ ID NO: 256869 - RNA, 64 nt, hsa
cagucgcucugcaugcucucugucauacagacagguaaccuaguucuguguucacguggccccc

SEQ ID NO: 256870 - RNA, 64 nt, hsa
aaaaauagcauccaugggacuuuuuaucaucuaaguaaccuaagaauucaaaagcuggauagaa

SEQ ID NO: 256871 - RNA, 64 nt, hsa
ccaccucagugaaaugcuacaacugugaauugacguaaccuagaaugucccccuucuugcuucu

SEQ ID NO: 256872 - RNA, 64 nt, hsa
acgcaucugugguucuuuuguacuugccauagauguaaccuaaaaaguuuuggcauauuuaggu

SEQ ID NO: 256873 - RNA, 64 nt, hsa
ugcugacuuuuuuuguuugaaauuaaacagauugguaaccuaauuuguggccuccugacuuuua

SEQ ID NO: 256874 - RNA, 59 nt, hsa
caggcgaaaagaaaaccuaacgucccuggguaaccuaauggccacuggcuagcagcaca

SEQ ID NO: 256875 - RNA, 64 nt, hsa
cauuccauuugugauuccaugauacaauucaccaguaaccuaucuuacaugagauucggaagua

SEQ ID NO: 256876 - RNA, 64 nt, hsa
uaauauccaacaguuuaagguacuauaccacaugguaaccuacuguuugccagccuguaaaaca

SEQ ID NO: 256877 - RNA, 64 nt, hsa
gaguucaccagauuuuggaaauauuuucuauucuguaaccuaccuuuucauuuacauaacagug

SEQ ID NO: 256878 - RNA, 64 nt, hsa
augcuguguuccuuuuauaaaaggacauuugcauguaaccuauccacauccuccugcaucccau

SEQ ID NO: 256879 - RNA, 64 nt, hsa
uagcuagcgugugccaggcagauccucuggacacguaaccuaugucagacacuacaugaugacu

SEQ ID NO: 256880 - RNA, 64 nt, hsa
uugauaguuuacuugauuguggcugcauaauuugguaaccuaugaaagaugcuagagcaccaau

SEQ ID NO: 256881 - RNA, 64 nt, hsa
aaugaggaugaauaacaaguuuggcaaaaugaugguaaccuaagucuuggauacaugguuuuua

SEQ ID NO: 256882 - RNA, 64 nt, hsa
uuaauagcuuucaguaguuguaucucauaagucuguaaccuacagguuccauuuaccuuuguuu

SEQ ID NO: 256883 - RNA, 64 nt, hsa
aaaaacucauuuuuuccaccaaaaccuuggccagguaaccuaccuuaggcaccugcaaagaaca

SEQ ID NO: 256884 - RNA, 64 nt, hsa
uuaaucaucccugcccuacauauauaaacauaagguaaccuacugaauuuuaugucccuuaguu

SEQ ID NO: 256885 - RNA, 64 nt, hsa
aaagagcauuaaauuuugcuauguauaaauuuuuguaaccuaacagugaaucaauauuuucuau

SEQ ID NO: 256886 - RNA, 64 nt, hsa
aaucacugcaguagggcucugcaaauaaaauaauguaaccuauuaucauggaucuaauguacug

SEQ ID NO: 256887 - RNA, 64 nt, hsa
uuuggggggaacuaggagagcaggaguagaagugagauguuaagaucuuauggcacuaaagacu

SEQ ID NO: 256888 - RNA, 64 nt, hsa
uauucuguuccuacauacucuguuaggaucagauagauguuauagaaaugccuuuuguuucucc

SEQ ID NO: 256889 - RNA, 64 nt, hsa
ccagagaacauugacagacaauuaugaauaauaaagauguuaacaauccaucuguauuuaaaac

SEQ ID NO: 256890 - RNA, 64 nt, hsa
gaaacugaaacaaacagaugcucagaugaaaaacagauguuauccucagcacaaauucaguaaa

SEQ ID NO: 256891 - RNA, 64 nt, hsa
gaaagagccugaagucuugcaggacucacuggauagauguuauucgacuccuucagguuaucuu

SEQ ID NO: 256892 - RNA, 64 nt, hsa
gaaagagccugaagucuugcaggacucacuggauagauguuauucaacuccuucaguuuaucuu

SEQ ID NO: 256893 - RNA, 64 nt, hsa
aaaauaugugaacucaaauauugcacuucuuucaagauguuaucaauugguuauuguacuguau

SEQ ID NO: 256894 - RNA, 64 nt, hsa
ucugcacauuacauugaaguauuauaaaugcaacagauguuauaugcacuggcauuuuauccua

SEQ ID NO: 256895 - RNA, 64 nt, hsa
uuugaauuaacaccaagggugauauuucuuuuagagauguuaguuaaucuguuuugugucuuac

SEQ ID NO: 256896 - RNA, 64 nt, hsa
gguaagcuaaaccaucaacaucucugguguuuuaagauguuauuuuauuggaacaacugacaaa

SEQ ID NO: 256897 - RNA, 64 nt, hsa
gagggcucauagaaguguuagguacggcucucaaagauguuacaguuuuuucuaggguugggag

SEQ ID NO: 256898 - RNA, 64 nt, hsa
aaaaccaacagguuuaucugaaggaccccagguaagauguuaaucucccagcccaccucaaccc

SEQ ID NO: 256899 - RNA, 64 nt, hsa
acuuuauuuaaaugcaugucuuaaaugcucauaaagauguuaaauggaauucguguuaugaauc

SEQ ID NO: 256900 - RNA, 64 nt, hsa
uuuuuguguacuuuaaaaucaacuuauaacugugagauguuauugcuuccauuuuauuagaaga

SEQ ID NO: 256901 - RNA, 64 nt, hsa
aaaaaaaauuuuuuuuuuuuggacagcuucaaggagauguuagcaauuucagauauacuagcca

SEQ ID NO: 256902 - RNA, 64 nt, hsa
uagcauauauaaacaaacaugauaggauuccuuaagauguuaccacccagggggccacaagcca

SEQ ID NO: 256903 - RNA, 64 nt, hsa
agucacuaacaaaugcauuauuuucuacagaauuagauguuaguaguacaguacugcauauuca

SEQ ID NO: 256904 - RNA, 64 nt, hsa
gcagccuagaagcaaugguucuguucaaucauucagauguuaguggaagcauaaaagucaagac

SEQ ID NO: 256905 - RNA, 64 nt, hsa
uaugauguacagguacgacauguauagguuaccuagauguuaugagaaauuuuaguuuauugug

SEQ ID NO: 256906 - RNA, 64 nt, hsa
uuucuuuuuggguacguauuguuucuggauaucaagauguuaaauauauuucuugcuauuguga

SEQ ID NO: 256907 - RNA, 64 nt, hsa
uauucugaaaauaccaguguguggcaguucucgcagauguuaccuaaaacugcugaacuugacc

SEQ ID NO: 256908 - RNA, 64 nt, hsa
auuaagcaggaaggcauuuuaauguggugacaucagauguuauuuuuccuagaugaaaauaaaa

SEQ ID NO: 256909 - RNA, 64 nt, hsa
uggacacuuagagugguuuuuguuuuuucuuuucagauguuaaugugaaagaaaggguguugca

SEQ ID NO: 256910 - RNA, 64 nt, hsa
accaugcggaugcgggucacacugaaugcuggagagauguuauguaauaugcugagguggcgac

SEQ ID NO: 256911 - RNA, 64 nt, hsa
uugccuggauaauagaggauguguuucagcccugagauguuacaguugaagagcuugguuuuca

SEQ ID NO: 256912 - RNA, 64 nt, hsa
uccacaucaggugugugcgaguguguguguguggagauguuaagagccucacaaggaaacuggg

SEQ ID NO: 256913 - RNA, 64 nt, hsa
aagguccuccuauuucccagaaccccguuggggcagauguuacugaaccugugaaucagacgcc

SEQ ID NO: 256914 - RNA, 64 nt, hsa; identical to SEQ ID NO: 256790

SEQ ID NO: 256915 - RNA, 64 nt, hsa; identical to SEQ ID NO: 256791

SEQ ID NO: 256916 - RNA, 64 nt, hsa; identical to SEQ ID NO: 256792

SEQ ID NO: 256917 - RNA, 64 nt, hsa; identical to SEQ ID NO: 256793

SEQ ID NO: 256918 - RNA, 64 nt, hsa; identical to SEQ ID NO: 256794

SEQ ID NO: 256919 - RNA, 53 nt, hsa; identical to SEQ ID NO: 256795

SEQ ID NO: 256920 - RNA, 64 nt, hsa; identical to SEQ ID NO: 256796

SEQ ID NO: 256921 - RNA, 64 nt, hsa; identical to SEQ ID NO: 256797

SEQ ID NO: 256922 - RNA, 64 nt, hsa; identical to SEQ ID NO: 256798

SEQ ID NO: 256923 - RNA, 64 nt, hsa; identical to SEQ ID NO: 256799

SEQ ID NO: 256924 - RNA, 64 nt, hsa; identical to SEQ ID NO: 256800

SEQ ID NO: 256925 - RNA, 64 nt, hsa; identical to SEQ ID NO: 256801

SEQ ID NO: 256926 - RNA, 64 nt, hsa; identical to SEQ ID NO: 256802

SEQ ID NO: 256927 - RNA, 64 nt, hsa; identical to SEQ ID NO: 256803

SEQ ID NO: 256928 - RNA, 64 nt, hsa; identical to SEQ ID NO: 256804

SEQ ID NO: 256929 - RNA, 64 nt, hsa; identical to SEQ ID NO: 256805

SEQ ID NO: 256930 - RNA, 64 nt, hsa; identical to SEQ ID NO: 256806

SEQ ID NO: 256931 - RNA, 64 nt, hsa; identical to SEQ ID NO: 256807

SEQ ID NO: 256932 - RNA, 64 nt, hsa; identical to SEQ ID NO: 256808

SEQ ID NO: 256933 - RNA, 64 nt, hsa; identical to SEQ ID NO: 256809

SEQ ID NO: 256934 - RNA, 64 nt, hsa; identical to SEQ ID NO: 256810

SEQ ID NO: 256935 - RNA, 64 nt, hsa; identical to SEQ ID NO: 256811

SEQ ID NO: 256936 - RNA, 64 nt, hsa; identical to SEQ ID NO: 256812

SEQ ID NO: 256937 - RNA, 64 nt, hsa; identical to SEQ ID NO: 256813

SEQ ID NO: 256938 - RNA, 64 nt, hsa; identical to SEQ ID NO: 256814

SEQ ID NO: 256939 - RNA, 64 nt, hsa; identical to SEQ ID NO: 256815

SEQ ID NO: 256940 - RNA, 64 nt, hsa; identical to SEQ ID NO: 256816

SEQ ID NO: 256941 - RNA, 64 nt, hsa; identical to SEQ ID NO: 256817

SEQ ID NO: 256942 - RNA, 64 nt, hsa; identical to SEQ ID NO: 256818

SEQ ID NO: 256943 - RNA, 64 nt, hsa; identical to SEQ ID NO: 256819

SEQ ID NO: 256944 - RNA, 64 nt, hsa; identical to SEQ ID NO: 256820

SEQ ID NO: 256945 - RNA, 64 nt, hsa; identical to SEQ ID NO: 256821

SEQ ID NO: 256946 - RNA, 64 nt, hsa; identical to SEQ ID NO: 256822

SEQ ID NO: 256947 - RNA, 64 nt, hsa; identical to SEQ ID NO: 256823

SEQ ID NO: 256948 - RNA, 64 nt, hsa; identical to SEQ ID NO: 256824

SEQ ID NO: 256949 - RNA, 64 nt, hsa; identical to SEQ ID NO: 256825

SEQ ID NO: 256950 - RNA, 64 nt, hsa; identical to SEQ ID NO: 256826

SEQ ID NO: 256951 - RNA, 64 nt, hsa; identical to SEQ ID NO: 256827

SEQ ID NO: 256952 - RNA, 64 nt, hsa; identical to SEQ ID NO: 256828

SEQ ID NO: 256953 - RNA, 64 nt, hsa; identical to SEQ ID NO: 256829

SEQ ID NO: 256954 - RNA, 64 nt, hsa; identical to SEQ ID NO: 256830

SEQ ID NO: 256955 - RNA, 64 nt, hsa; identical to SEQ ID NO: 256831

SEQ ID NO: 256956 - RNA, 64 nt, hsa; identical to SEQ ID NO: 256832

SEQ ID NO: 256957 - RNA, 64 nt, hsa; identical to SEQ ID NO: 256833

SEQ ID NO: 256958 - RNA, 64 nt, hsa; identical to SEQ ID NO: 256834

SEQ ID NO: 256959 - RNA, 64 nt, hsa; identical to SEQ ID NO: 256835

SEQ ID NO: 256960 - RNA, 64 nt, hsa; identical to SEQ ID NO: 256836

SEQ ID NO: 256961 - RNA, 64 nt, hsa; identical to SEQ ID NO: 256837

SEQ ID NO: 256962 - RNA, 64 nt, hsa; identical to SEQ ID NO: 256838

SEQ ID NO: 256963 - RNA, 64 nt, hsa; identical to SEQ ID NO: 256839

SEQ ID NO: 256964 - RNA, 64 nt, hsa; identical to SEQ ID NO: 256840

SEQ ID NO: 256965 - RNA, 64 nt, hsa; identical to SEQ ID NO: 256841

SEQ ID NO: 256966 - RNA, 64 nt, hsa; identical to SEQ ID NO: 256842

SEQ ID NO: 256967 - RNA, 64 nt, hsa; identical to SEQ ID NO: 256843

SEQ ID NO: 256968 - RNA, 64 nt, hsa; identical to SEQ ID NO: 256844

SEQ ID NO: 256969 - RNA, 64 nt, hsa; identical to SEQ ID NO: 256845

SEQ ID NO: 256970 - RNA, 64 nt, hsa; identical to SEQ ID NO: 256846

SEQ ID NO: 256971 - RNA, 64 nt, hsa; identical to SEQ ID NO: 256847

SEQ ID NO: 256972 - RNA, 64 nt, hsa; identical to SEQ ID NO: 256848

SEQ ID NO: 256973 - RNA, 64 nt, hsa; identical to SEQ ID NO: 256849

SEQ ID NO: 256974 - RNA, 64 nt, hsa; identical to SEQ ID NO: 256850

SEQ ID NO: 256975 - RNA, 64 nt, hsa; identical to SEQ ID NO: 256851

SEQ ID NO: 256976 - RNA, 64 nt, hsa; identical to SEQ ID NO: 256852

SEQ ID NO: 256977 - RNA, 64 nt, hsa; identical to SEQ ID NO: 256853

SEQ ID NO: 256978 - RNA, 64 nt, hsa; identical to SEQ ID NO: 256854

SEQ ID NO: 256979 - RNA, 64 nt, hsa; identical to SEQ ID NO: 256855

SEQ ID NO: 256980 - RNA, 64 nt, hsa; identical to SEQ ID NO: 256856

SEQ ID NO: 256981 - RNA, 64 nt, hsa; identical to SEQ ID NO: 256857

SEQ ID NO: 256982 - RNA, 64 nt, hsa; identical to SEQ ID NO: 256858

SEQ ID NO: 256983 - RNA, 64 nt, hsa; identical to SEQ ID NO: 256859

SEQ ID NO: 256984 - RNA, 64 nt, hsa; identical to SEQ ID NO: 256860

SEQ ID NO: 256985 - RNA, 64 nt, hsa; identical to SEQ ID NO: 256861

SEQ ID NO: 256986 - RNA, 64 nt, hsa; identical to SEQ ID NO: 256862

SEQ ID NO: 256987 - RNA, 64 nt, hsa; identical to SEQ ID NO: 256863

SEQ ID NO: 256988 - RNA, 64 nt, hsa; identical to SEQ ID NO: 256864

SEQ ID NO: 256989 - RNA, 64 nt, hsa; identical to SEQ ID NO: 256865

SEQ ID NO: 256990 - RNA, 64 nt, hsa; identical to SEQ ID NO: 256866

SEQ ID NO: 256991 - RNA, 64 nt, hsa; identical to SEQ ID NO: 256867

SEQ ID NO: 256992 - RNA, 64 nt, hsa; identical to SEQ ID NO: 256868

SEQ ID NO: 256993 - RNA, 64 nt, hsa; identical to SEQ ID NO: 256869

SEQ ID NO: 256994 - RNA, 64 nt, hsa; identical to SEQ ID NO: 256870

SEQ ID NO: 256995 - RNA, 64 nt, hsa; identical to SEQ ID NO: 256871

SEQ ID NO: 256996 - RNA, 64 nt, hsa; identical to SEQ ID NO: 256872

SEQ ID NO: 256997 - RNA, 64 nt, hsa; identical to SEQ ID NO: 256873

SEQ ID NO: 256998 - RNA, 59 nt, hsa; identical to SEQ ID NO: 256874

SEQ ID NO: 256999 - RNA, 64 nt, hsa; identical to SEQ ID NO: 256875

SEQ ID NO: 257000 - RNA, 64 nt, hsa; identical to SEQ ID NO: 256876

SEQ ID NO: 257001 - RNA, 64 nt, hsa; identical to SEQ ID NO: 256877

SEQ ID NO: 257002 - RNA, 64 nt, hsa; identical to SEQ ID NO: 256878

SEQ ID NO: 257003 - RNA, 64 nt, hsa; identical to SEQ ID NO: 256879

SEQ ID NO: 257004 - RNA, 64 nt, hsa; identical to SEQ ID NO: 256880

SEQ ID NO: 257005 - RNA, 64 nt, hsa; identical to SEQ ID NO: 256881

SEQ ID NO: 257006 - RNA, 64 nt, hsa; identical to SEQ ID NO: 256882

SEQ ID NO: 257007 - RNA, 64 nt, hsa; identical to SEQ ID NO: 256883

SEQ ID NO: 257008 - RNA, 64 nt, hsa; identical to SEQ ID NO: 256884

SEQ ID NO: 257009 - RNA, 64 nt, hsa; identical to SEQ ID NO: 256885

SEQ ID NO: 257010 - RNA, 64 nt, hsa; identical to SEQ ID NO: 256886

SEQ ID NO: 257011 - RNA, 64 nt, hsa; identical to SEQ ID NO: 256887

SEQ ID NO: 257012 - RNA, 64 nt, hsa; identical to SEQ ID NO: 256888

SEQ ID NO: 257013 - RNA, 64 nt, hsa; identical to SEQ ID NO: 256889

SEQ ID NO: 257014 - RNA, 64 nt, hsa; identical to SEQ ID NO: 256890

SEQ ID NO: 257015 - RNA, 64 nt, hsa; identical to SEQ ID NO: 256891

SEQ ID NO: 257016 - RNA, 64 nt, hsa; identical to SEQ ID NO: 256892

SEQ ID NO: 257017 - RNA, 64 nt, hsa; identical to SEQ ID NO: 256893

SEQ ID NO: 257018 - RNA, 64 nt, hsa; identical to SEQ ID NO: 256894

SEQ ID NO: 257019 - RNA, 64 nt, hsa; identical to SEQ ID NO: 256895

SEQ ID NO: 257020 - RNA, 64 nt, hsa; identical to SEQ ID NO: 256896

SEQ ID NO: 257021 - RNA, 64 nt, hsa; identical to SEQ ID NO: 256897

SEQ ID NO: 257022 - RNA, 64 nt, hsa; identical to SEQ ID NO: 256898

SEQ ID NO: 257023 - RNA, 64 nt, hsa; identical to SEQ ID NO: 256899

SEQ ID NO: 257024 - RNA, 64 nt, hsa; identical to SEQ ID NO: 256900

SEQ ID NO: 257025 - RNA, 64 nt, hsa; identical to SEQ ID NO: 256901

SEQ ID NO: 257026 - RNA, 64 nt, hsa; identical to SEQ ID NO: 256902

SEQ ID NO: 257027 - RNA, 64 nt, hsa; identical to SEQ ID NO: 256903

SEQ ID NO: 257028 - RNA, 64 nt, hsa; identical to SEQ ID NO: 256904

SEQ ID NO: 257029 - RNA, 64 nt, hsa; identical to SEQ ID NO: 256905

SEQ ID NO: 257030 - RNA, 64 nt, hsa; identical to SEQ ID NO: 256906

SEQ ID NO: 257031 - RNA, 64 nt, hsa; identical to SEQ ID NO: 256907

SEQ ID NO: 257032 - RNA, 64 nt, hsa; identical to SEQ ID NO: 256908

SEQ ID NO: 257033 - RNA, 64 nt, hsa; identical to SEQ ID NO: 256909

SEQ ID NO: 257034 - RNA, 64 nt, hsa; identical to SEQ ID NO: 256910

SEQ ID NO: 257035 - RNA, 64 nt, hsa; identical to SEQ ID NO: 256911

SEQ ID NO: 257036 - RNA, 64 nt, hsa; identical to SEQ ID NO: 256912

SEQ ID NO: 257037 - RNA, 64 nt, hsa; identical to SEQ ID NO: 256913

SEQ ID NO: 257038 - RNA, 64 nt, hsa; identical to SEQ ID NO: 256790

SEQ ID NO: 257039 - RNA, 64 nt, hsa; identical to SEQ ID NO: 256791

SEQ ID NO: 257040 - RNA, 64 nt, hsa; identical to SEQ ID NO: 256792

SEQ ID NO: 257041 - RNA, 64 nt, hsa; identical to SEQ ID NO: 256793

SEQ ID NO: 257042 - RNA, 64 nt, hsa; identical to SEQ ID NO: 256794

SEQ ID NO: 257043 - RNA, 53 nt, hsa; identical to SEQ ID NO: 256795

SEQ ID NO: 257044 - RNA, 64 nt, hsa; identical to SEQ ID NO: 256796

SEQ ID NO: 257045 - RNA, 64 nt, hsa; identical to SEQ ID NO: 256797

SEQ ID NO: 257046 - RNA, 64 nt, hsa; identical to SEQ ID NO: 256798

SEQ ID NO: 257047 - RNA, 64 nt, hsa; identical to SEQ ID NO: 256799

SEQ ID NO: 257048 - RNA, 64 nt, hsa; identical to SEQ ID NO: 256800

SEQ ID NO: 257049 - RNA, 64 nt, hsa; identical to SEQ ID NO: 256801

SEQ ID NO: 257050 - RNA, 64 nt, hsa; identical to SEQ ID NO: 256802

SEQ ID NO: 257051 - RNA, 64 nt, hsa; identical to SEQ ID NO: 256803

SEQ ID NO: 257052 - RNA, 64 nt, hsa; identical to SEQ ID NO: 256804

SEQ ID NO: 257053 - RNA, 64 nt, hsa; identical to SEQ ID NO: 256805

SEQ ID NO: 257054 - RNA, 64 nt, hsa; identical to SEQ ID NO: 256806

SEQ ID NO: 257055 - RNA, 64 nt, hsa; identical to SEQ ID NO: 256807

SEQ ID NO: 257056 - RNA, 64 nt, hsa; identical to SEQ ID NO: 256808

SEQ ID NO: 257057 - RNA, 64 nt, hsa; identical to SEQ ID NO: 256809

SEQ ID NO: 257058 - RNA, 64 nt, hsa; identical to SEQ ID NO: 256810

SEQ ID NO: 257059 - RNA, 64 nt, hsa; identical to SEQ ID NO: 256811

SEQ ID NO: 257060 - RNA, 64 nt, hsa; identical to SEQ ID NO: 256812

SEQ ID NO: 257061 - RNA, 64 nt, hsa; identical to SEQ ID NO: 256813

SEQ ID NO: 257062 - RNA, 64 nt, hsa; identical to SEQ ID NO: 256814

SEQ ID NO: 257063 - RNA, 64 nt, hsa; identical to SEQ ID NO: 256815

SEQ ID NO: 257064 - RNA, 64 nt, hsa; identical to SEQ ID NO: 256816

SEQ ID NO: 257065 - RNA, 64 nt, hsa; identical to SEQ ID NO: 256817

SEQ ID NO: 257066 - RNA, 64 nt, hsa; identical to SEQ ID NO: 256818

SEQ ID NO: 257067 - RNA, 64 nt, hsa; identical to SEQ ID NO: 256819

SEQ ID NO: 257068 - RNA, 64 nt, hsa; identical to SEQ ID NO: 256820

SEQ ID NO: 257069 - RNA, 64 nt, hsa; identical to SEQ ID NO: 256821

SEQ ID NO: 257070 - RNA, 64 nt, hsa; identical to SEQ ID NO: 256822

SEQ ID NO: 257071 - RNA, 64 nt, hsa; identical to SEQ ID NO: 256823

SEQ ID NO: 257072 - RNA, 64 nt, hsa; identical to SEQ ID NO: 256824

SEQ ID NO: 257073 - RNA, 64 nt, hsa; identical to SEQ ID NO: 256825

SEQ ID NO: 257074 - RNA, 64 nt, hsa; identical to SEQ ID NO: 256826

SEQ ID NO: 257075 - RNA, 64 nt, hsa; identical to SEQ ID NO: 256827

SEQ ID NO: 257076 - RNA, 64 nt, hsa; identical to SEQ ID NO: 256828

SEQ ID NO: 257077 - RNA, 64 nt, hsa; identical to SEQ ID NO: 256829

SEQ ID NO: 257078 - RNA, 64 nt, hsa; identical to SEQ ID NO: 256830

SEQ ID NO: 257079 - RNA, 64 nt, hsa; identical to SEQ ID NO: 256831

SEQ ID NO: 257080 - RNA, 64 nt, hsa; identical to SEQ ID NO: 256832

SEQ ID NO: 257081 - RNA, 64 nt, hsa; identical to SEQ ID NO: 256833

SEQ ID NO: 257082 - RNA, 64 nt, hsa; identical to SEQ ID NO: 256834

SEQ ID NO: 257083 - RNA, 64 nt, hsa; identical to SEQ ID NO: 256835

SEQ ID NO: 257084 - RNA, 64 nt, hsa; identical to SEQ ID NO: 256836

SEQ ID NO: 257085 - RNA, 64 nt, hsa; identical to SEQ ID NO: 256837

SEQ ID NO: 257086 - RNA, 64 nt, hsa; identical to SEQ ID NO: 256838

SEQ ID NO: 257087 - RNA, 64 nt, hsa; identical to SEQ ID NO: 256839

SEQ ID NO: 257088 - RNA, 64 nt, hsa; identical to SEQ ID NO: 256840

SEQ ID NO: 257089 - RNA, 64 nt, hsa; identical to SEQ ID NO: 256841

SEQ ID NO: 257090 - RNA, 64 nt, hsa; identical to SEQ ID NO: 256842

SEQ ID NO: 257091 - RNA, 64 nt, hsa; identical to SEQ ID NO: 256843

SEQ ID NO: 257092 - RNA, 64 nt, hsa; identical to SEQ ID NO: 256844

SEQ ID NO: 257093 - RNA, 64 nt, hsa; identical to SEQ ID NO: 256845

SEQ ID NO: 257094 - RNA, 64 nt, hsa; identical to SEQ ID NO: 256846

SEQ ID NO: 257095 - RNA, 64 nt, hsa; identical to SEQ ID NO: 256847

SEQ ID NO: 257096 - RNA, 64 nt, hsa; identical to SEQ ID NO: 256848

SEQ ID NO: 257097 - RNA, 64 nt, hsa; identical to SEQ ID NO: 256849

SEQ ID NO: 257098 - RNA, 64 nt, hsa; identical to SEQ ID NO: 256850

SEQ ID NO: 257099 - RNA, 64 nt, hsa; identical to SEQ ID NO: 256851

SEQ ID NO: 257100 - RNA, 64 nt, hsa; identical to SEQ ID NO: 256852

SEQ ID NO: 257101 - RNA, 64 nt, hsa; identical to SEQ ID NO: 256853

SEQ ID NO: 257102 - RNA, 64 nt, hsa; identical to SEQ ID NO: 256854

SEQ ID NO: 257103 - RNA, 64 nt, hsa; identical to SEQ ID NO: 256855

SEQ ID NO: 257104 - RNA, 64 nt, hsa; identical to SEQ ID NO: 256856

SEQ ID NO: 257105 - RNA, 64 nt, hsa; identical to SEQ ID NO: 256857

SEQ ID NO: 257106 - RNA, 64 nt, hsa; identical to SEQ ID NO: 256858

SEQ ID NO: 257107 - RNA, 64 nt, hsa; identical to SEQ ID NO: 256859

SEQ ID NO: 257108 - RNA, 64 nt, hsa; identical to SEQ ID NO: 256860

SEQ ID NO: 257109 - RNA, 64 nt, hsa; identical to SEQ ID NO: 256861

SEQ ID NO: 257110 - RNA, 64 nt, hsa; identical to SEQ ID NO: 256862

SEQ ID NO: 257111 - RNA, 64 nt, hsa; identical to SEQ ID NO: 256863

SEQ ID NO: 257112 - RNA, 64 nt, hsa; identical to SEQ ID NO: 256864

SEQ ID NO: 257113 - RNA, 64 nt, hsa; identical to SEQ ID NO: 256865

SEQ ID NO: 257114 - RNA, 64 nt, hsa; identical to SEQ ID NO: 256866

SEQ ID NO: 257115 - RNA, 64 nt, hsa; identical to SEQ ID NO: 256867

SEQ ID NO: 257116 - RNA, 64 nt, hsa; identical to SEQ ID NO: 256868

SEQ ID NO: 257117 - RNA, 64 nt, hsa; identical to SEQ ID NO: 256869

SEQ ID NO: 257118 - RNA, 64 nt, hsa; identical to SEQ ID NO: 256870

SEQ ID NO: 257119 - RNA, 64 nt, hsa; identical to SEQ ID NO: 256871

SEQ ID NO: 257120 - RNA, 64 nt, hsa; identical to SEQ ID NO: 256872

SEQ ID NO: 257121 - RNA, 64 nt, hsa; identical to SEQ ID NO: 256873

SEQ ID NO: 257122 - RNA, 59 nt, hsa; identical to SEQ ID NO: 256874

SEQ ID NO: 257123 - RNA, 64 nt, hsa; identical to SEQ ID NO: 256875

SEQ ID NO: 257124 - RNA, 64 nt, hsa; identical to SEQ ID NO: 256876

SEQ ID NO: 257125 - RNA, 64 nt, hsa; identical to SEQ ID NO: 256877

SEQ ID NO: 257126 - RNA, 64 nt, hsa; identical to SEQ ID NO: 256878

SEQ ID NO: 257127 - RNA, 64 nt, hsa; identical to SEQ ID NO: 256879

SEQ ID NO: 257128 - RNA, 64 nt, hsa; identical to SEQ ID NO: 256880

SEQ ID NO: 257129 - RNA, 64 nt, hsa; identical to SEQ ID NO: 256881

SEQ ID NO: 257130 - RNA, 64 nt, hsa; identical to SEQ ID NO: 256882

SEQ ID NO: 257131 - RNA, 64 nt, hsa; identical to SEQ ID NO: 256883

SEQ ID NO: 257132 - RNA, 64 nt, hsa; identical to SEQ ID NO: 256884

SEQ ID NO: 257133 - RNA, 64 nt, hsa; identical to SEQ ID NO: 256885

SEQ ID NO: 257134 - RNA, 64 nt, hsa; identical to SEQ ID NO: 256886

SEQ ID NO: 257135 - RNA, 64 nt, hsa; identical to SEQ ID NO: 256887

SEQ ID NO: 257136 - RNA, 64 nt, hsa; identical to SEQ ID NO: 256888

SEQ ID NO: 257137 - RNA, 64 nt, hsa; identical to SEQ ID NO: 256889

SEQ ID NO: 257138 - RNA, 64 nt, hsa; identical to SEQ ID NO: 256890

SEQ ID NO: 257139 - RNA, 64 nt, hsa; identical to SEQ ID NO: 256891

SEQ ID NO: 257140 - RNA, 64 nt, hsa; identical to SEQ ID NO: 256892

SEQ ID NO: 257141 - RNA, 64 nt, hsa; identical to SEQ ID NO: 256893

SEQ ID NO: 257142 - RNA, 64 nt, hsa; identical to SEQ ID NO: 256894

SEQ ID NO: 257143 - RNA, 64 nt, hsa; identical to SEQ ID NO: 256895

SEQ ID NO: 257144 - RNA, 64 nt, hsa; identical to SEQ ID NO: 256896

SEQ ID NO: 257145 - RNA, 64 nt, hsa; identical to SEQ ID NO: 256897

SEQ ID NO: 257146 - RNA, 64 nt, hsa; identical to SEQ ID NO: 256898

SEQ ID NO: 257147 - RNA, 64 nt, hsa; identical to SEQ ID NO: 256899

SEQ ID NO: 257148 - RNA, 64 nt, hsa; identical to SEQ ID NO: 256900

SEQ ID NO: 257149 - RNA, 64 nt, hsa; identical to SEQ ID NO: 256901

SEQ ID NO: 257150 - RNA, 64 nt, hsa; identical to SEQ ID NO: 256902

SEQ ID NO: 257151 - RNA, 64 nt, hsa; identical to SEQ ID NO: 256903

SEQ ID NO: 257152 - RNA, 64 nt, hsa; identical to SEQ ID NO: 256904

SEQ ID NO: 257153 - RNA, 64 nt, hsa; identical to SEQ ID NO: 256905

SEQ ID NO: 257154 - RNA, 64 nt, hsa; identical to SEQ ID NO: 256906

SEQ ID NO: 257155 - RNA, 64 nt, hsa; identical to SEQ ID NO: 256907

SEQ ID NO: 257156 - RNA, 64 nt, hsa; identical to SEQ ID NO: 256908

SEQ ID NO: 257157 - RNA, 64 nt, hsa; identical to SEQ ID NO: 256909

SEQ ID NO: 257158 - RNA, 64 nt, hsa; identical to SEQ ID NO: 256910

SEQ ID NO: 257159 - RNA, 64 nt, hsa; identical to SEQ ID NO: 256911

SEQ ID NO: 257160 - RNA, 64 nt, hsa; identical to SEQ ID NO: 256912

SEQ ID NO: 257161 - RNA, 64 nt, hsa; identical to SEQ ID NO: 256913

SEQ ID NO: 257162 - RNA, 64 nt, hsa; identical to SEQ ID NO: 256790

SEQ ID NO: 257163 - RNA, 64 nt, hsa; identical to SEQ ID NO: 256791

SEQ ID NO: 257164 - RNA, 64 nt, hsa; identical to SEQ ID NO: 256792

SEQ ID NO: 257165 - RNA, 64 nt, hsa; identical to SEQ ID NO: 256793

SEQ ID NO: 257166 - RNA, 64 nt, hsa; identical to SEQ ID NO: 256794

SEQ ID NO: 257167 - RNA, 53 nt, hsa; identical to SEQ ID NO: 256795

SEQ ID NO: 257168 - RNA, 64 nt, hsa; identical to SEQ ID NO: 256796

SEQ ID NO: 257169 - RNA, 64 nt, hsa; identical to SEQ ID NO: 256797

SEQ ID NO: 257170 - RNA, 64 nt, hsa; identical to SEQ ID NO: 256798

SEQ ID NO: 257171 - RNA, 64 nt, hsa; identical to SEQ ID NO: 256799

SEQ ID NO: 257172 - RNA, 64 nt, hsa; identical to SEQ ID NO: 256800

SEQ ID NO: 257173 - RNA, 64 nt, hsa; identical to SEQ ID NO: 256801

SEQ ID NO: 257174 - RNA, 64 nt, hsa; identical to SEQ ID NO: 256802

SEQ ID NO: 257175 - RNA, 64 nt, hsa; identical to SEQ ID NO: 256803

SEQ ID NO: 257176 - RNA, 64 nt, hsa; identical to SEQ ID NO: 256804

SEQ ID NO: 257177 - RNA, 64 nt, hsa; identical to SEQ ID NO: 256805

SEQ ID NO: 257178 - RNA, 64 nt, hsa; identical to SEQ ID NO: 256806

SEQ ID NO: 257179 - RNA, 64 nt, hsa; identical to SEQ ID NO: 256807

SEQ ID NO: 257180 - RNA, 64 nt, hsa; identical to SEQ ID NO: 256808

SEQ ID NO: 257181 - RNA, 64 nt, hsa; identical to SEQ ID NO: 256809

SEQ ID NO: 257182 - RNA, 64 nt, hsa; identical to SEQ ID NO: 256810

SEQ ID NO: 257183 - RNA, 64 nt, hsa; identical to SEQ ID NO: 256811

SEQ ID NO: 257184 - RNA, 64 nt, hsa; identical to SEQ ID NO: 256812

SEQ ID NO: 257185 - RNA, 64 nt, hsa; identical to SEQ ID NO: 256813

SEQ ID NO: 257186 - RNA, 64 nt, hsa; identical to SEQ ID NO: 256814

SEQ ID NO: 257187 - RNA, 64 nt, hsa; identical to SEQ ID NO: 256815

SEQ ID NO: 257188 - RNA, 64 nt, hsa; identical to SEQ ID NO: 256816

SEQ ID NO: 257189 - RNA, 64 nt, hsa; identical to SEQ ID NO: 256817

SEQ ID NO: 257190 - RNA, 64 nt, hsa; identical to SEQ ID NO: 256818

SEQ ID NO: 257191 - RNA, 64 nt, hsa; identical to SEQ ID NO: 256819

SEQ ID NO: 257192 - RNA, 64 nt, hsa; identical to SEQ ID NO: 256820

SEQ ID NO: 257193 - RNA, 64 nt, hsa; identical to SEQ ID NO: 256821

SEQ ID NO: 257194 - RNA, 64 nt, hsa; identical to SEQ ID NO: 256822

SEQ ID NO: 257195 - RNA, 64 nt, hsa; identical to SEQ ID NO: 256823

SEQ ID NO: 257196 - RNA, 64 nt, hsa; identical to SEQ ID NO: 256824

SEQ ID NO: 257197 - RNA, 64 nt, hsa; identical to SEQ ID NO: 256825

SEQ ID NO: 257198 - RNA, 64 nt, hsa; identical to SEQ ID NO: 256826

SEQ ID NO: 257199 - RNA, 64 nt, hsa; identical to SEQ ID NO: 256827

SEQ ID NO: 257200 - RNA, 64 nt, hsa; identical to SEQ ID NO: 256828

SEQ ID NO: 257201 - RNA, 64 nt, hsa; identical to SEQ ID NO: 256829

SEQ ID NO: 257202 - RNA, 64 nt, hsa; identical to SEQ ID NO: 256830

SEQ ID NO: 257203 - RNA, 64 nt, hsa; identical to SEQ ID NO: 256831

SEQ ID NO: 257204 - RNA, 64 nt, hsa; identical to SEQ ID NO: 256832

SEQ ID NO: 257205 - RNA, 64 nt, hsa; identical to SEQ ID NO: 256833

SEQ ID NO: 257206 - RNA, 64 nt, hsa; identical to SEQ ID NO: 256834

SEQ ID NO: 257207 - RNA, 64 nt, hsa; identical to SEQ ID NO: 256835

SEQ ID NO: 257208 - RNA, 64 nt, hsa; identical to SEQ ID NO: 256836

SEQ ID NO: 257209 - RNA, 64 nt, hsa; identical to SEQ ID NO: 256837

SEQ ID NO: 257210 - RNA, 64 nt, hsa; identical to SEQ ID NO: 256838

SEQ ID NO: 257211 - RNA, 64 nt, hsa; identical to SEQ ID NO: 256839

SEQ ID NO: 257212 - RNA, 64 nt, hsa; identical to SEQ ID NO: 256840

SEQ ID NO: 257213 - RNA, 64 nt, hsa; identical to SEQ ID NO: 256841

SEQ ID NO: 257214 - RNA, 64 nt, hsa; identical to SEQ ID NO: 256842

SEQ ID NO: 257215 - RNA, 64 nt, hsa; identical to SEQ ID NO: 256843

SEQ ID NO: 257216 - RNA, 64 nt, hsa; identical to SEQ ID NO: 256844

SEQ ID NO: 257217 - RNA, 64 nt, hsa; identical to SEQ ID NO: 256845

SEQ ID NO: 257218 - RNA, 64 nt, hsa; identical to SEQ ID NO: 256846

SEQ ID NO: 257219 - RNA, 64 nt, hsa; identical to SEQ ID NO: 256847

SEQ ID NO: 257220 - RNA, 64 nt, hsa; identical to SEQ ID NO: 256848

SEQ ID NO: 257221 - RNA, 64 nt, hsa; identical to SEQ ID NO: 256849

SEQ ID NO: 257222 - RNA, 64 nt, hsa; identical to SEQ ID NO: 256850

SEQ ID NO: 257223 - RNA, 64 nt, hsa; identical to SEQ ID NO: 256851

SEQ ID NO: 257224 - RNA, 64 nt, hsa; identical to SEQ ID NO: 256852

SEQ ID NO: 257225 - RNA, 64 nt, hsa; identical to SEQ ID NO: 256853

SEQ ID NO: 257226 - RNA, 64 nt, hsa; identical to SEQ ID NO: 256854

SEQ ID NO: 257227 - RNA, 64 nt, hsa; identical to SEQ ID NO: 256855

SEQ ID NO: 257228 - RNA, 64 nt, hsa; identical to SEQ ID NO: 256856

SEQ ID NO: 257229 - RNA, 64 nt, hsa; identical to SEQ ID NO: 256857

SEQ ID NO: 257230 - RNA, 64 nt, hsa; identical to SEQ ID NO: 256858

SEQ ID NO: 257231 - RNA, 64 nt, hsa; identical to SEQ ID NO: 256859

SEQ ID NO: 257232 - RNA, 64 nt, hsa; identical to SEQ ID NO: 256860

SEQ ID NO: 257233 - RNA, 64 nt, hsa; identical to SEQ ID NO: 256861

SEQ ID NO: 257234 - RNA, 64 nt, hsa; identical to SEQ ID NO: 256862

SEQ ID NO: 257235 - RNA, 64 nt, hsa; identical to SEQ ID NO: 256863

SEQ ID NO: 257236 - RNA, 64 nt, hsa; identical to SEQ ID NO: 256864

SEQ ID NO: 257237 - RNA, 64 nt, hsa; identical to SEQ ID NO: 256865

SEQ ID NO: 257238 - RNA, 64 nt, hsa; identical to SEQ ID NO: 256866

SEQ ID NO: 257239 - RNA, 64 nt, hsa; identical to SEQ ID NO: 256867

SEQ ID NO: 257240 - RNA, 64 nt, hsa; identical to SEQ ID NO: 256868

SEQ ID NO: 257241 - RNA, 64 nt, hsa; identical to SEQ ID NO: 256869

SEQ ID NO: 257242 - RNA, 64 nt, hsa; identical to SEQ ID NO: 256870

SEQ ID NO: 257243 - RNA, 64 nt, hsa; identical to SEQ ID NO: 256871

SEQ ID NO: 257244 - RNA, 64 nt, hsa; identical to SEQ ID NO: 256872

SEQ ID NO: 257245 - RNA, 64 nt, hsa; identical to SEQ ID NO: 256873

SEQ ID NO: 257246 - RNA, 59 nt, hsa; identical to SEQ ID NO: 256874

SEQ ID NO: 257247 - RNA, 64 nt, hsa; identical to SEQ ID NO: 256875

SEQ ID NO: 257248 - RNA, 64 nt, hsa; identical to SEQ ID NO: 256876

SEQ ID NO: 257249 - RNA, 64 nt, hsa; identical to SEQ ID NO: 256877

SEQ ID NO: 257250 - RNA, 64 nt, hsa; identical to SEQ ID NO: 256878

SEQ ID NO: 257251 - RNA, 64 nt, hsa; identical to SEQ ID NO: 256879

SEQ ID NO: 257252 - RNA, 64 nt, hsa; identical to SEQ ID NO: 256880

SEQ ID NO: 257253 - RNA, 64 nt, hsa; identical to SEQ ID NO: 256881

SEQ ID NO: 257254 - RNA, 64 nt, hsa; identical to SEQ ID NO: 256882

SEQ ID NO: 257255 - RNA, 64 nt, hsa; identical to SEQ ID NO: 256883

SEQ ID NO: 257256 - RNA, 64 nt, hsa; identical to SEQ ID NO: 256884

SEQ ID NO: 257257 - RNA, 64 nt, hsa; identical to SEQ ID NO: 256885

SEQ ID NO: 257258 - RNA, 64 nt, hsa; identical to SEQ ID NO: 256886

SEQ ID NO: 257259 - RNA, 64 nt, hsa; identical to SEQ ID NO: 256887

SEQ ID NO: 257260 - RNA, 64 nt, hsa; identical to SEQ ID NO: 256888

SEQ ID NO: 257261 - RNA, 64 nt, hsa; identical to SEQ ID NO: 256889

SEQ ID NO: 257262 - RNA, 64 nt, hsa; identical to SEQ ID NO: 256890

SEQ ID NO: 257263 - RNA, 64 nt, hsa; identical to SEQ ID NO: 256891

SEQ ID NO: 257264 - RNA, 64 nt, hsa; identical to SEQ ID NO: 256892

SEQ ID NO: 257265 - RNA, 64 nt, hsa; identical to SEQ ID NO: 256893

SEQ ID NO: 257266 - RNA, 64 nt, hsa; identical to SEQ ID NO: 256894

SEQ ID NO: 257267 - RNA, 64 nt, hsa; identical to SEQ ID NO: 256895

SEQ ID NO: 257268 - RNA, 64 nt, hsa; identical to SEQ ID NO: 256896

SEQ ID NO: 257269 - RNA, 64 nt, hsa; identical to SEQ ID NO: 256897

SEQ ID NO: 257270 - RNA, 64 nt, hsa; identical to SEQ ID NO: 256898

SEQ ID NO: 257271 - RNA, 64 nt, hsa; identical to SEQ ID NO: 256899

SEQ ID NO: 257272 - RNA, 64 nt, hsa; identical to SEQ ID NO: 256900

SEQ ID NO: 257273 - RNA, 64 nt, hsa; identical to SEQ ID NO: 256901

SEQ ID NO: 257274 - RNA, 64 nt, hsa; identical to SEQ ID NO: 256902

SEQ ID NO: 257275 - RNA, 64 nt, hsa; identical to SEQ ID NO: 256903

SEQ ID NO: 257276 - RNA, 64 nt, hsa; identical to SEQ ID NO: 256904

SEQ ID NO: 257277 - RNA, 64 nt, hsa; identical to SEQ ID NO: 256905

SEQ ID NO: 257278 - RNA, 64 nt, hsa; identical to SEQ ID NO: 256906

SEQ ID NO: 257279 - RNA, 64 nt, hsa; identical to SEQ ID NO: 256907

SEQ ID NO: 257280 - RNA, 64 nt, hsa; identical to SEQ ID NO: 256908

SEQ ID NO: 257281 - RNA, 64 nt, hsa; identical to SEQ ID NO: 256909

SEQ ID NO: 257282 - RNA, 64 nt, hsa; identical to SEQ ID NO: 256910

SEQ ID NO: 257283 - RNA, 64 nt, hsa; identical to SEQ ID NO: 256911

SEQ ID NO: 257284 - RNA, 64 nt, hsa; identical to SEQ ID NO: 256912

SEQ ID NO: 257285 - RNA, 64 nt, hsa; identical to SEQ ID NO: 256913

SEQ ID NO: 257286 - RNA, 64 nt, hsa
ggacaaagcagcacguaucaccucauucaucacuuggacacaucgccuuugcauugucuuguca

SEQ ID NO: 257287 - RNA, 64 nt, hsa
agacauccugacaguguugggcaucugcuccccguggacacagccccacucuccacuuucugag

SEQ ID NO: 257288 - RNA, 64 nt, hsa
cagccaacccugaucuggaagacagggccccggcuggacacacguggaaccaagccagggaugg

SEQ ID NO: 257289 - RNA, 64 nt, hsa
accacgagacccucaaccagcccaacaucuuccauggacacaugacauugaagaccaucccaag

SEQ ID NO: 257290 - RNA, 64 nt, hsa
cagcuggucacuccccagagaagcugggccuucauggacacauggaacuaagccucccaaaugg

SEQ ID NO: 257291 - RNA, 64 nt, hsa
cuuggacacuggccaaggagaccccuucgugcuguggacacagcucucuucacucuuugcucau

SEQ ID NO: 257292 - RNA, 64 nt, hsa
caccccaggcagucugugugugaggcauagccccuggacacacacacacagacacacacacugc

SEQ ID NO: 257293 - RNA, 64 nt, hsa
auacacacgcacacccaugcgcagaugugcugccuggacacacacacacacacggauaugcugu

SEQ ID NO: 257294 - RNA, 64 nt, hsa
guauccggacacacacgugcacagauaugcugccuggacacacagauaaugcugccuugacaca

SEQ ID NO: 257295 - RNA, 64 nt, hsa
ugcugccuugacacacacaugcacggauauugccuggacacacacacacacacgugugcacaga

SEQ ID NO: 257296 - RNA, 64 nt, hsa
gucuggacacgcacacacaugcagauaugcugccuggacacacacuuccagacacacgugcaca

SEQ ID NO: 257297 - RNA, 64 nt, hsa
ccagacacacgugcacaggcgcagauaugcugccuggacacacgcagauaugcugucuagucac

SEQ ID NO: 257298 - RNA, 64 nt, hsa
guccggacacacacacgcacgcagauaugcugccuggacacacacacagauaaugcugccucaa

SEQ ID NO: 257299 - RNA, 64 nt, hsa
cugccucaacacucacacacgugcagauauugccuggacacacacaugugcacagauaugcugu

SEQ ID NO: 257300 - RNA, 64 nt, hsa
acacacaugcacacacaggugcagauaugcugccuggacacacgcagacugacgugcuuuuggg

SEQ ID NO: 257301 - RNA, 64 nt, hsa
guaacugcuaacuccuaggaaacagccuuuucccuggacacagaugguccauacgcugagccac

SEQ ID NO: 257302 - RNA, 64 nt, hsa
guauuuuuagaauggcagcuauaaaguuaacuccuggacacaaguauauacugugcacugaaaa

SEQ ID NO: 257303 - RNA, 64 nt, hsa
cuuuccacccagguggacaaacacauucggcggcuggacacagaccuggcccguuuugaggcug

SEQ ID NO: 257304 - RNA, 64 nt, hsa
uuacacaugaaaaggugaacaucaucaaaaacccuggacacaguucccugagaacugccugccg

SEQ ID NO: 257305 - RNA, 64 nt, hsa
auuuauagcauguuucuuuuugaaaaacuagugguggacacauuuggaucacauuuauacaguu

SEQ ID NO: 257306 - RNA, 64 nt, hsa
cucuugcaguuuguucuguaaugccuuuuacauuuggacacauaguuuaugcuuuuuagauuuu

SEQ ID NO: 257307 - RNA, 64 nt, hsa
aggaccugacagagcccaugcagggcuuuagauuuggacacacaagaguugauaacuuccucau

SEQ ID NO: 257308 - RNA, 64 nt, hsa
cucacccuggugcugccucccgcacaaggagaccuggacacaacagacacacaucacaaggcga

SEQ ID NO: 257309 - RNA, 64 nt, hsa
acacaacagacacacaucacaaggcgaacacaaauggacacacauaccuggccacgaacccaca

SEQ ID NO: 257310 - RNA, 54 nt, hsa
augacugggucuaugaauaagagguggacacaacagcagucuccuucagcacgg

SEQ ID NO: 257311 - RNA, 64 nt, hsa
cagcagucuccuucagcacggcguggugugucccuggacacagcucuucauuccauugacuuag

SEQ ID NO: 257312 - RNA, 64 nt, hsa
ugucucaugucuuauuuuugaaccaugcauaugauggacacacaauggauggacacauuauauc

SEQ ID NO: 257313 - RNA, 64 nt, hsa
uuuugaaccaugcauaugauggacacacaauggauggacacauuauaucuccaacaaggugugg

SEQ ID NO: 257314 - RNA, 64 nt, hsa
agccccuuugcuggcuuuaucugcucccuuguucuggacacagagcccugggaaaaagaggggg

SEQ ID NO: 257315 - RNA, 64 nt, hsa
aaagaaagaaagaaaaggaaacccaagagcugccuggacacacggaaacccaacugagaacaaa

SEQ ID NO: 257316 - RNA, 64 nt, hsa
gguuuguuggguuuuucgucuuuccagauugcaguggacacagcccccgaucucgagccccggc

SEQ ID NO: 257317 - RNA, 64 nt, hsa
acagaaagagacagaagcuggggcuacguccauguggacacagaccacagaugugggcacacga

SEQ ID NO: 257318 - RNA, 64 nt, hsa
gcuguuugagauucucaaaggagcgagcaugucguggacacacacagacuauuuuuagauuuuc

SEQ ID NO: 257319 - RNA, 64 nt, hsa
uguccacagcaagaugacgugauucuuauuuucuuggacacagacuauucugaggcacagagcg

SEQ ID NO: 257320 - RNA, 64 nt, hsa
ugacuuuauuaaagcaacauuugccacauguuuaagccgcaaagguauuagcaaugcuugcauc

SEQ ID NO: 257321 - RNA, 64 nt, hsa
uguguuuuucccaucaugacggaagaagagagugagccgcaauuguucugaaaaugucaaacga

SEQ ID NO: 257322 - RNA, 64 nt, hsa
ccaugggcguccuuugggugacucgccauaaaucagccgcaaggauccuucccuguaaauuuga

SEQ ID NO: 257323 - RNA, 64 nt, hsa
cacaaccccugaggagguguagacccagucugagagccgcaagcacugaggcagggccugagac

SEQ ID NO: 257324 - RNA, 64 nt, hsa
uuuuuacagaaagaugccgccuguagccagugacagccgcaacccuacaggccucaguuccuug

SEQ ID NO: 257325 - RNA, 64 nt, hsa
ccaggagacguucaacgccaccggaguccuccugagccgcaacggcucugaggucucggccagc

SEQ ID NO: 257326 - RNA, 64 nt, hsa
agacaaagaccaccccuucacccacuggaccccaagccgcaaaagcuggggagguaggaagggu

SEQ ID NO: 257327 - RNA, 64 nt, hsa
ugaaaccacaggcccuugggguucccccagacagagccgcaaaucaaccccagacucaaacuca

SEQ ID NO: 257328 - RNA, 64 nt, hsa
ggcagccccugggcaggagacguggcugcugaacagccgcaaaccaucuucaccugggggcauu

SEQ ID NO: 257329 - RNA, 64 nt, hsa
cauggagagcacccugaggaccuuuaaaaggcaaagccgcaaggcagaaggaggcugggucccu

SEQ ID NO: 257330 - RNA, 64 nt, hsa
auuuauuuucacacauuuaauuccuauuaaguacagccgcaagaaagaaaaaaugaugaaguug

SEQ ID NO: 257331 - RNA, 64 nt, hsa
guggaaggaccgcgggugucgcaggugucgugucagccgcaauaaacagaagccagaagcccuc

SEQ ID NO: 257332 - RNA, 64 nt, hsa
auauuuauuuuuucaaaauccgaaaucauuugcgagccgcaaucgucgucugccuguguggggg

SEQ ID NO: 257333 - RNA, 64 nt, hsa
cccuuucucuggggauuccacaccucucuuccccagccgcaacgggggugccaggagccccagg

SEQ ID NO: 257334 - RNA, 64 nt, hsa
aggccccgccccaccgcuccgggagcugcucaucagccgcaacuuccugccgacccugaugcgg

SEQ ID NO: 257335 - RNA, 64 nt, hsa
gugagggcagaugucuccagccaggacugcccugagccgcaaaaugucaaagcuggagcuauag

SEQ ID NO: 257336 - RNA, 64 nt, hsa
uccugggagugggagucaagugugccugcuauccagccgcaaauccauacccccugccccagag

SEQ ID NO: 257337 - RNA, 64 nt, hsa
cuuugagagggcugaagggagggccuugauuuccagccgcaaucuggcuccuccuggaaaauuu

SEQ ID NO: 257338 - RNA, 64 nt, hsa
aucccccgaccccuugacacuccuccgaggccugagccgcaaugccugcccguguugagugaga

SEQ ID NO: 257339 - RNA, 64 nt, hsa
uguccgcccaccuucccuccacuacagaaccugcagccgcaaauccucugggcugcuucgucuu

SEQ ID NO: 257340 - RNA, 64 nt, hsa
agugcugggauuacaggcaugagccaccgugcucagccgcaaaauucuuuaugaauuuuacacu

SEQ ID NO: 257341 - RNA, 64 nt, hsa
uggccugaccccugaggagcgguccuuccacaccagccgcaacccaagcagaugacaggcacag

SEQ ID NO: 257342 - RNA, 64 nt, hsa
guggggagaacccggacagcucaguccugccagcagccgcaaagagccgaggcugccaggccca

SEQ ID NO: 257343 - RNA, 64 nt, hsa
cuuuccuggcccaguccucaccacaguccacagaagccgcaaacaggcucauagccaagcugug

SEQ ID NO: 257344 - RNA, 64 nt, hsa
acagccggcagggaaucggaacccucagacccacagccgcaaggcacuggauucuggcagcacc

SEQ ID NO: 257345 - RNA, 64 nt, hsa
cacaggacugcuucaggccguggccacagguagcagccgcaaggggaaaugaagaaaacugagc

SEQ ID NO: 257346 - RNA, 64 nt, hsa
gccggacacggcuucacugaccagcggcugcucaagccgcaagcucucagcaagugcccagugg

SEQ ID NO: 257347 - RNA, 64 nt, hsa
gauugccaagugccagcagcugcagcaagaauacagccgcaaggaggaggagugccaggcaggg

SEQ ID NO: 257348 - RNA, 64 nt, hsa
cgugucauuccagaguggaucugcggugaagccaagccgcaagguuacaaggcauccucaccag

SEQ ID NO: 257349 - RNA, 64 nt, hsa
gcacuuugcuggccccgagaaaggucgaugacacagccgcaaaucuaauccacguaguucccau

SEQ ID NO: 257350 - RNA, 64 nt, hsa
gauugucucagaugcagggcgcugugcgggacgaagccgcaaggacucucguaucgggcccuug

SEQ ID NO: 257351 - RNA, 64 nt, hsa
aaugcugggauuacagauaugagccaucaugcccagccgcaacccuaauuuuucauucagucau

SEQ ID NO: 257352 - RNA, 64 nt, hsa
cccagaauggaggguguucugacaccccacccugagccgcaagagcaguccuggggcccuggac

SEQ ID NO: 257353 - RNA, 64 nt, hsa
ccuagaggagcccuccugugaccauaaggguaaaagccgcaagcuaagaagaggguggccggaa

SEQ ID NO: 257354 - RNA, 64 nt, hsa
uugaucaugugcaauauuucuuacugugccgagaagccgcaaugagcgagauuaaagcuguuua

SEQ ID NO: 257355 - RNA, 64 nt, hsa
caucacaugucgguagguuccgugaugccccacaagccgcaaaaaccagcaaguuuuuauuagg

SEQ ID NO: 257356 - RNA, 64 nt, hsa
cucugaccauuccucuacuggagcccccaaugaaagccgcaaaccuauacccuugacgcccaua

SEQ ID NO: 257357 - RNA, 64 nt, hsa; identical to SEQ ID NO: 237127

SEQ ID NO: 257358 - RNA, 64 nt, hsa; identical to SEQ ID NO: 237128

SEQ ID NO: 257359 - RNA, 64 nt, hsa; identical to SEQ ID NO: 237129

SEQ ID NO: 257360 - RNA, 64 nt, hsa; identical to SEQ ID NO: 237130

SEQ ID NO: 257361 - RNA, 64 nt, hsa; identical to SEQ ID NO: 237131

SEQ ID NO: 257362 - RNA, 64 nt, hsa; identical to SEQ ID NO: 237132

SEQ ID NO: 257363 - RNA, 64 nt, hsa; identical to SEQ ID NO: 237133

SEQ ID NO: 257364 - RNA, 64 nt, hsa; identical to SEQ ID NO: 237134

SEQ ID NO: 257365 - RNA, 64 nt, hsa
uguuuguuuguuuguuuguuuuaaucucuacagcacauuuaaugcaacuuuugaaaucugcagg

SEQ ID NO: 257366 - RNA, 64 nt, hsa
gaguaacauuacuuaaaaaaaaaaggauauguuuacauuuaauuuuggcuaccaggaguuuagu

SEQ ID NO: 257367 - RNA, 64 nt, hsa
gcuaagaagaauaaguccuucuguuuucucuuuaacauuuaaaauaucucaaugcacaugauau

SEQ ID NO: 257368 - RNA, 64 nt, hsa
cacuguuuuuauguaguucauauauauuaccaugacauuuaacaucaauaucguauauguugaa

SEQ ID NO: 257369 - RNA, 64 nt, hsa
uuaaaacacuggacuagaagagauaaugauugaaacauuuaaaaaaaaaaagugcuccauucgc

SEQ ID NO: 257370 - RNA, 64 nt, hsa
auacacuccugcugaaaaauguuaauccaaauacacauuuaaacuuagggucgguccuuauucu

SEQ ID NO: 257371 - RNA, 64 nt, hsa
aagcucagaauaucacauugaaauuacuauaaauacauuuaaaauuaucuauuuuagaucuaag

SEQ ID NO: 257372 - RNA, 64 nt, hsa
uaacguuuuccugaagcuguuucuggagagccacacauuuaaauacagacagcuuuccugauca

SEQ ID NO: 257373 - RNA, 64 nt, hsa
auuagacucccuacaguccuucaauggaaaaguaacauuuaaaaauccuuuggguaauucgaau

SEQ ID NO: 257374 - RNA, 64 nt, hsa
auacauuuaguaaaguccccaagacauuagucuuacauuuaaacuuuuuucuuuaaaacauggu

SEQ ID NO: 257375 - RNA, 64 nt, hsa
gauauugaauucauggagccuuuacagaagcaucacauuuaaaccaaugugaauucaaaaaaga

SEQ ID NO: 257376 - RNA, 64 nt, hsa
uuacaaaacauccaacacuagaaagcaaugacuaacauuuaauuuguuuacaaaaauguuuauu

SEQ ID NO: 257377 - RNA, 64 nt, hsa
caccagagagugcguauccugcucagaaccauucacauuuaauucaauucuuggaaaaaauuaa

SEQ ID NO: 257378 - RNA, 64 nt, hsa
guagauaaauaauaauagcccugagauguuucuaacauuuaaauaagaaaaaaaucaaaucgaa

SEQ ID NO: 257379 - RNA, 64 nt, hsa
gaaauacuucagaucacaugaaaaugcugauuuaacauuuaaguaucacagcauuaaaagaaaa

SEQ ID NO: 257380 - RNA, 64 nt, hsa
cguggguuuuguuuuuaagcaaaacaaugugaaaacauuuaaguuugaaauguugcauuugaag

SEQ ID NO: 257381 - RNA, 64 nt, hsa
cuucuguuauuuacaaaauaauaauuuuuaaaaaacauuuaaaaaaaauccaaagcugcucucg

SEQ ID NO: 257382 - RNA, 64 nt, hsa
ucuagaacaaaauagucuauaugguacuugaucuacauuuaaguggaaaaauuagcaguauuug

SEQ ID NO: 257383 - RNA, 64 nt, hsa
cuaguccucaaagcagaaauaauuagaaauguuaacauuuaagugcuuaucauaugccagauac

SEQ ID NO: 257384 - RNA, 64 nt, hsa
guauuauuuuaggucauaaagguuauaacaaaauacauuuaacauugcuuucuuuuuagcaaga

SEQ ID NO: 257385 - RNA, 64 nt, hsa
ugauggcaccuugaaagugaacuucuagaaaucuacauuuaaaaggcaaagcuuuaaaagcaga

SEQ ID NO: 257386 - RNA, 64 nt, hsa
acuaaaggaaacccaggaauauuuaccugguguuacauuuaauauuuaauguaacuggucuagc

SEQ ID NO: 257387 - RNA, 64 nt, hsa
agugagcucagaggcccuucucacugagacagcaacauuuaaaccaaaccagaggaaguauuug

SEQ ID NO: 257388 - RNA, 64 nt, hsa
cagcuggguuuuuaauuagcgcauucucuauccaacauuuaauuguuugaaagccuccauauag

SEQ ID NO: 257389 - RNA, 64 nt, hsa
acuauaaaaugcaguaacauucuacuugcuuauuacauuuaaauccuuguguaacugaauguuu

SEQ ID NO: 257390 - RNA, 64 nt, hsa
uguuuauggugagguuuaaaggauaugaaacucuacauuuaaacaaguauuuuauauuugggua

SEQ ID NO: 257391 - RNA, 64 nt, hsa
augauauuuucuucuauaauaaaauccaaaguaaacauuuaaauuguagaacugauauuuuuca

SEQ ID NO: 257392 - RNA, 64 nt, hsa
uucucuuuauguuauucuuucacuuuuguagauuacauuuaauagcuuguuaccugugauuuua

SEQ ID NO: 257393 - RNA, 64 nt, hsa
acccaucuuucaauucaauuaaauuuaaauagccacauuuaacuccagccuuggguuugaccug

SEQ ID NO: 257394 - RNA, 64 nt, hsa
gguucauuugcauauacuuuuuuccaaauaaugcacauuuaauauguuuuaaaaugucuuauuu

SEQ ID NO: 257395 - RNA, 64 nt, hsa
cagauuuguaauggcucccaaauuccaucacaucacauuuaaauugcagacaguguuuugcaca

SEQ ID NO: 257396 - RNA, 64 nt, hsa
gagagcaaagguuaauuuugugcuuuuaguaaaaacauuuaaauacaaaguucuuuauugggug

SEQ ID NO: 257397 - RNA, 64 nt, hsa
agaaaugucugaaacuuuagacaaaaacaguaaaacauuuaauauucauuugugaaacuguaua

SEQ ID NO: 257398 - RNA, 64 nt, hsa
aagauuguuauuguaauuuuguuauuccuuaaaaacauuuaaaagcagauuuuuucaaaaucga

SEQ ID NO: 257399 - RNA, 64 nt, hsa
cgcuggcuuaaggagcuggagggguuccuaauacacauuuaauucaguuucucuucccuaagag

SEQ ID NO: 257400 - RNA, 64 nt, hsa
gucuggcaggugggggaaugagaugagaaaguggacauuuaagguccaaguagaagcuugcauc

SEQ ID NO: 257401 - RNA, 64 nt, hsa
aguuuggggcacucaucccauucauaauuauuuuacauuuaaauuacuguuccuacuuaagugg

SEQ ID NO: 257402 - RNA, 64 nt, hsa
acauguuuuauuuuuacuuuuguuaaaauaaauaacauuuaauuugacggaaaauucuaaaaau

SEQ ID NO: 257403 - RNA, 64 nt, hsa
uaucuggcauuuuuaaacauuuaaaaauuauuaaacauuuaaaaauuaguuuauuaucagauau

SEQ ID NO: 257404 - RNA, 64 nt, hsa
ucuguuagaaauuaguuuuaucuggcauuuuuaaacauuuaaaaauuauuaaacauuuaaaaau

SEQ ID NO: 257405 - RNA, 64 nt, hsa
agugaacuauuaauauuuaaaaacgagaaauacaacauuuaaaaaauuaagaguauuuugcauu

SEQ ID NO: 257406 - RNA, 64 nt, hsa
uucaugagauacaauucacauaccauauaaucacacauuuaaaauacacaauucagugguuuua

SEQ ID NO: 257407 - RNA, 64 nt, hsa
aaaaauauugaacucaaugauagcaccuaaacuuacauuuaaaagacagacauuccuucuacau

SEQ ID NO: 257408 - RNA, 64 nt, hsa
agguaagaggaagcuuacauuacauguccaguccacauuuaaagagcacuuacuguggaacaag

SEQ ID NO: 257409 - RNA, 64 nt, hsa
acugcagaagacuaucuuaaaauacaggauuuuaacauuuaagucaugcacauuuaacaauuac

SEQ ID NO: 257410 - RNA, 64 nt, hsa
cuuaaaauacaggauuuuaacauuuaagucaugcacauuuaacaauuacagguuauaaauuagu

SEQ ID NO: 257411 - RNA, 64 nt, hsa
acuagaguuaccauucauauuugagaagaaaagaacauuuaauaaauguauguguggggcugag

SEQ ID NO: 257412 - RNA, 64 nt, hsa
guuuucaugaggaagcuggcuuggcuuuagucuuacauuuaaauucuuugaaaguggcucccag

SEQ ID NO: 257413 - RNA, 64 nt, hsa
uuacaggcaugagccacugcaccuggcuauauuuacauuuaauagaaacauaucuagcauaugu

SEQ ID NO: 257414 - RNA, 64 nt, hsa
uuagauuauguauuccuuuugaaacauaagaaaaacauuuaaaccuaugcugaaaauacgauaa

SEQ ID NO: 257415 - RNA, 64 nt, hsa
auauuguuaacuguuaauaaauacuucugacacuacauuuaaauguuugcagauucugcaaacu

SEQ ID NO: 257416 - RNA, 64 nt, hsa
cuguaacuaagacaauauugauaaauguuggaugacauuuaauuuaauggagcauguacuuauu

SEQ ID NO: 257417 - RNA, 64 nt, hsa
uauaugcuaaaucacauucagcauguguauuuugacauuuaaaauacuucccucaauucuguaa

SEQ ID NO: 257418 - RNA, 64 nt, hsa
uuuacaaaaguucuuauuacugggcggacugauaacauuuaaaaaauaauuguguuugacccca

SEQ ID NO: 257419 - RNA, 64 nt, hsa
augauuuaaaaucaaaucaaaaagaaaaaacuaaacauuuaaacaaaaaugggauaagaauagu

SEQ ID NO: 257420 - RNA, 64 nt, hsa
acuguaaaauguggcucuaaauaacuaaugacacacauuuaaaucaguuaugguguagcugcug

SEQ ID NO: 257421 - RNA, 64 nt, hsa
uuuggagggaguguugcaauauauauaaaugaaaacauuuaauuguguucaucauauuuaaaaa

SEQ ID NO: 257422 - RNA, 64 nt, hsa
aguucugaaaagaauuuuuguuuuguuacacugcacauuuaagggagagucccuccccuaucuu

SEQ ID NO: 257423 - RNA, 64 nt, hsa
uuugcauauuuaaaaauuaaucauuuugcauuuuacauuuaaauaugcuaacaucacugucaua

SEQ ID NO: 257424 - RNA, 64 nt, hsa
uaaagauauuuauauauugccauacaaaaacuuaacauuuaaaacugauaauaucuguaaugac

SEQ ID NO: 257425 - RNA, 64 nt, hsa
uaacaaugauucauucauuaauguuaaggcuaauacauuuaagaucuuguuuaaacaauguuuc

SEQ ID NO: 257426 - RNA, 64 nt, hsa
gcaccugggagcgcugcuuggcucuaucucuacaacauuuaaugaauuucuuguaaaccacuuu

SEQ ID NO: 257427 - RNA, 64 nt, hsa
uccaaaaggguaaggcaguuuuaaaaaugugaaaacauuuaaaaaugauaauagcagggaauuc

SEQ ID NO: 257428 - RNA, 64 nt, hsa
ggagggguacaucgucaacauagccgauccuguuacauuuaagaguagccucguagguugaauu

SEQ ID NO: 257429 - RNA, 64 nt, hsa
ugcuuacuuucugccauuggguugguuugauaccacauuuaacauugacauuuaaguggaaaac

SEQ ID NO: 257430 - RNA, 64 nt, hsa
ccauuggguugguuugauaccacauuuaacauugacauuuaaguggaaaaccaaguuaucauug

SEQ ID NO: 257431 - RNA, 64 nt, hsa
gauuuugugagcagugaaguuuaacagagcagugacauuuaacaaagcagugaaguuuaacaga

SEQ ID NO: 257432 - RNA, 64 nt, hsa
gauuucggaaggcgacagaaaauuuaguucuuagacauuuaaauagaaaguugugugccccuau

SEQ ID NO: 257433 - RNA, 64 nt, hsa
cacauaaaagccacugcuuuuaacaucccauuguacauuuaacacauaaaugguguuaacaucc

SEQ ID NO: 257434 - RNA, 64 nt, hsa
auuuaacacauaaaugguguuaacaucccauuguacauuuaacacauaaauggccauugucuuu

SEQ ID NO: 257435 - RNA, 64 nt, hsa
gacuguauaacuuucccagguucuguuuauggccacauuuaauaucuucagcucuuuuugugga

SEQ ID NO: 257436 - RNA, 64 nt, hsa
ugcuuuauugcuuuuuuguauugguuaaaacuguacauuuaaaauugcuauguuacuauuuucu

SEQ ID NO: 257437 - RNA, 64 nt, hsa
cugguuuaaaacuaaaaauaauacagcuuuuuggacauuuaaccaagauacuaagaagguuuuu

SEQ ID NO: 257438 - RNA, 64 nt, hsa
ucucugucuuuaguauuuuuugcuggugcuucuuacauuuaauauggaaaggugggaagaauau

SEQ ID NO: 257439 - RNA, 64 nt, hsa
uaaaauacuauuuuucaaaaucauacagauuaguacauuuaacagcuaccuguaaagcuuauua

SEQ ID NO: 257440 - RNA, 64 nt, hsa
gcaguuuaguuguugcauuuuucggacacuggaaacauuuaaaugaucaggagggaguaacaga

SEQ ID NO: 257441 - RNA, 64 nt, hsa
gaguguauucucgugucaacauacagggauuuagacauuuaacucucugugccuugauaagaau

SEQ ID NO: 257442 - RNA, 64 nt, hsa
cuucacuuuggucauguuuauuaaaccaccagugacauuuaaaaauauauuuuuagcagucgua

SEQ ID NO: 257443 - RNA, 64 nt, hsa
ccguuaggcuuugaggcuuuucagugaauucuugacauuuaaaucuucuuauagaauucuuuau

SEQ ID NO: 257444 - RNA, 64 nt, hsa
uugauuuuauaucaguauguuaaacuuuauugccacauuuaaaggacuguauuuucauacuuuu

SEQ ID NO: 257445 - RNA, 64 nt, hsa
cucuaagucacuauaugaauaugacaauaugugcacauuuaaaauucagagcucggcauuguga

SEQ ID NO: 257446 - RNA, 64 nt, hsa
cugggaaccucgauauucugacauuuggaaaaacacauuuaauuuaucuccuguguuucauugc

SEQ ID NO: 257447 - RNA, 64 nt, hsa
aggagagauugucuuaggauaaaccuccaagcucacauuuaauauaacagacugaaguaaacau

SEQ ID NO: 257448 - RNA, 64 nt, hsa
ccuuuauuuuauguuuaggcuuauuuuuaaauuaacauuuaacagaaacauuugaaauagaauu

SEQ ID NO: 257449 - RNA, 64 nt, hsa
auagguauguaggaauagucacucacuggcugauacauuuaaagcagcagugugaauagcaagg

SEQ ID NO: 257450 - RNA, 64 nt, hsa
gaagaauacugagaacggcauaaagugaagaucgacauuuaaaaaaugaggugaaagaaagcua

SEQ ID NO: 257451 - RNA, 64 nt, hsa
uuuuguuuuuucuucuucuucuucuuccuuaaagacauuuaagcuaaaggcaacucguacccaa

SEQ ID NO: 257452 - RNA, 64 nt, hsa
cuuacaaaaagaaaaaaaaaauccuguuguauuaacauuuaaaaacagaauuguguuaugugau

SEQ ID NO: 257453 - RNA, 64 nt, hsa
uaacaaucucaaucauacauacugauucuuucagacauuuaauaaccacuacauuuuuuugcau

SEQ ID NO: 257454 - RNA, 64 nt, hsa
ucuuuugaagguuuggccaguuucuaaaaaaugcacauuuaaagagaagcaucuaccacggcuu

SEQ ID NO: 257455 - RNA, 64 nt, hsa
guaguaacuuaauauguaaaguuguaacauacauacauuuaaaauggaaaugcagaaagcugug

SEQ ID NO: 257456 - RNA, 64 nt, hsa
agggaaugaaacauuuauggccucaagauacuauacauuuaaagcaccccaaugucucucuuuu

SEQ ID NO: 257457 - RNA, 64 nt, hsa
aaggucugauaaacugaugaaauggcacagcauaacauuuaauuauaaugacauucugauuaua

SEQ ID NO: 257458 - RNA, 64 nt, hsa
gaauguuuccuuuuacuucaguuaacaaaagaaaacauuuaauaaacauucaauaaugauuaca

SEQ ID NO: 257459 - RNA, 64 nt, hsa
uuauugugucucucucugauguacuguggauuguacauuuaacuuuggaauggcuuuguaauaa

SEQ ID NO: 257460 - RNA, 64 nt, hsa
acaagcucugguugcuuauuuuuagaaaaugaggacauuuaauaauaauaaaaaaaaagggauu

SEQ ID NO: 257461 - RNA, 64 nt, hsa
acauaguugcuuccugguaucugauuuagaaauaacauuuaaaugccaaguaucugggggauug

SEQ ID NO: 257462 - RNA, 64 nt, hsa
ucaaauuauuaaagagucuauuuauugaauuuagacauuuaaucaugaucuuuacagaaaagaa

SEQ ID NO: 257463 - RNA, 64 nt, hsa
guuuagaguaauauucuuuugcauuauaguaagaacauuuaaguuuuguuaaaauuaaaaaauu

SEQ ID NO: 257464 - RNA, 64 nt, hsa
agauauauuuuugcagaugcaguauauauuuaaaacauuuaauccaaaauaagucuauguaaau

SEQ ID NO: 257465 - RNA, 64 nt, hsa
uuucguuucccuuuccccaaaaguagcguaaccaacauuuaagcuugcuuaaaaacgaaaacca

SEQ ID NO: 257466 - RNA, 64 nt, hsa
guuuccugacgguguacagaaucaacaaaauaaaacauuuaaagucugauuuuuuacauuuuuu

SEQ ID NO: 257467 - RNA, 64 nt, hsa
auacaguccuaguguuugccuucuugguaaaauuacauuuaaggaugucauuucaugagucaaa

SEQ ID NO: 257468 - RNA, 64 nt, hsa
uuauaauauaaauuaccauuguuuguggaggauuacauuuaaaaaagcaaaaagugaaaaaaaa

SEQ ID NO: 257469 - RNA, 64 nt, hsa; identical to SEQ ID NO: 215446

SEQ ID NO: 257470 - RNA, 64 nt, hsa; identical to SEQ ID NO: 215447

SEQ ID NO: 257471 - RNA, 64 nt, hsa; identical to SEQ ID NO: 215448

SEQ ID NO: 257472 - RNA, 64 nt, hsa; identical to SEQ ID NO: 215449

SEQ ID NO: 257473 - RNA, 64 nt, hsa; identical to SEQ ID NO: 215450

SEQ ID NO: 257474 - RNA, 64 nt, hsa; identical to SEQ ID NO: 215451

SEQ ID NO: 257475 - RNA, 64 nt, hsa; identical to SEQ ID NO: 215452

SEQ ID NO: 257476 - RNA, 64 nt, hsa; identical to SEQ ID NO: 215453

SEQ ID NO: 257477 - RNA, 64 nt, hsa; identical to SEQ ID NO: 215454

SEQ ID NO: 257478 - RNA, 64 nt, hsa; identical to SEQ ID NO: 215455

SEQ ID NO: 257479 - RNA, 64 nt, hsa; identical to SEQ ID NO: 215456

SEQ ID NO: 257480 - RNA, 64 nt, hsa; identical to SEQ ID NO: 215457

SEQ ID NO: 257481 - RNA, 59 nt, hsa
ccuaauacccaguuuaagacaccaaauauaacaaguauaauuacauccuccaauguacc

SEQ ID NO: 257482 - RNA, 59 nt, hsa
gguuuaaaggauaugaaacucuacauuuaaacaaguauuuuauauuuggguacagagga

SEQ ID NO: 257483 - RNA, 59 nt, hsa
uuaugucauaagcucuauuauguuauucuaacaaguagcaauuucacaaaauuuguaug

SEQ ID NO: 257484 - RNA, 59 nt, hsa
acaaaaugugcuagccacuggggacgcaaaacaaguaagaucccuguugcaagaaauuc

SEQ ID NO: 257485 - RNA, 59 nt, hsa
uuaucaaucucuuuugauacaacauuuaaaacaaguagcuucaagaaaccacugguguu

SEQ ID NO: 257486 - RNA, 59 nt, hsa
cauuguaaguuccuaaaaacauuuuauuaaacaaguagacauuuuguuauuaaaaaaau

SEQ ID NO: 257487 - RNA, 59 nt, hsa
uugcucaaaaguucugaauucauacagaaaacaaguacuaugugaugaaaacauuucau

SEQ ID NO: 257488 - RNA, 59 nt, hsa
uccucacauuccucuucuacuuuguaugcaacaaguagaauggggcauguugugucaug

SEQ ID NO: 257489 - RNA, 64 nt, hsa
uucaaaaccagaggaaggagguucuuagccguuacucagauaccagugcuggggagggaggccu

SEQ ID NO: 257490 - RNA, 64 nt, hsa
gaaaaaagacgacuaauuuccaaacccguuuguucucagauaaaaagcaguuuuauaaacccgc

SEQ ID NO: 257491 - RNA, 64 nt, hsa
agugagaggauagauuuagaaaacaucagugaugcucagauaaacuuuuaggaccucauauuaa

SEQ ID NO: 257492 - RNA, 64 nt, hsa
caaauaaauuucuguuuauuauaaauaacccagucucagauauucuguuacagaaacacaaaau

SEQ ID NO: 257493 - RNA, 64 nt, hsa
gaagugaaagauaagaauuaccuacagcuuuguacucagauaauuuauauccaaaauuuguguu

SEQ ID NO: 257494 - RNA, 64 nt, hsa
gcaaacuaagcugccucucaacaaugagggagaacucagauaaaaauauuuucauacguucuau

SEQ ID NO: 257495 - RNA, 64 nt, hsa
uguucucuuaaaagguaucaauguaccuuuuuugguaguggaaaaaaaaaagacaggcugccac

SEQ ID NO: 257496 - RNA, 64 nt, hsa
ugguguuacaagacuuguuauccauuuaaaaaugguaguggaaauucuaugccuuggauacaca

SEQ ID NO: 257497 - RNA, 64 nt, hsa
ggaugaguuauacaugauauuugacuuuucauaaguaguggaagguuucacuaaguaaaacucu

SEQ ID NO: 257498 - RNA, 64 nt, hsa
agaugaguuauaaaugguauuugacuuuucauaaguaguggaagguuucacuaaguaaagaucu

SEQ ID NO: 257499 - RNA, 64 nt, hsa
aaaagauuuucuguccagaagccuccccgaccccccaagcuauuugcucacauuaacaaauuaa

SEQ ID NO: 257500 - RNA, 64 nt, hsa
cgccacagacuccuguacuauuaacaaucuguaaccaagcuaacugucucauccauguguugau

SEQ ID NO: 257501 - RNA, 64 nt, hsa
gaauuuggcuucaagaugcccaagaugaccaugcccaagcuagggagggcagaguccccaucac

SEQ ID NO: 257502 - RNA, 64 nt, hsa
gugggccagccuugcccucugucuugucacuaacccaagcuaauuccacccucugccccuuccu

SEQ ID NO: 257503 - RNA, 64 nt, hsa; identical to SEQ ID NO: 84132

SEQ ID NO: 257504 - RNA, 64 nt, hsa; identical to SEQ ID NO: 84133

SEQ ID NO: 257505 - RNA, 64 nt, hsa; identical to SEQ ID NO: 84134

SEQ ID NO: 257506 - RNA, 64 nt, hsa; identical to SEQ ID NO: 84135

SEQ ID NO: 257507 - RNA, 64 nt, hsa; identical to SEQ ID NO: 84136

SEQ ID NO: 257508 - RNA, 64 nt, hsa; identical to SEQ ID NO: 84137

SEQ ID NO: 257509 - RNA, 64 nt, hsa; identical to SEQ ID NO: 84138

SEQ ID NO: 257510 - RNA, 64 nt, hsa; identical to SEQ ID NO: 84139

SEQ ID NO: 257511 - RNA, 64 nt, hsa; identical to SEQ ID NO: 84140

SEQ ID NO: 257512 - RNA, 64 nt, hsa; identical to SEQ ID NO: 84141

SEQ ID NO: 257513 - RNA, 64 nt, hsa; identical to SEQ ID NO: 84142

SEQ ID NO: 257514 - RNA, 64 nt, hsa; identical to SEQ ID NO: 84143

SEQ ID NO: 257515 - RNA, 64 nt, hsa; identical to SEQ ID NO: 84144

SEQ ID NO: 257516 - RNA, 64 nt, hsa; identical to SEQ ID NO: 84145

SEQ ID NO: 257517 - RNA, 64 nt, hsa; identical to SEQ ID NO: 84146

SEQ ID NO: 257518 - RNA, 64 nt, hsa; identical to SEQ ID NO: 84147

SEQ ID NO: 257519 - RNA, 64 nt, hsa; identical to SEQ ID NO: 84148

SEQ ID NO: 257520 - RNA, 64 nt, hsa; identical to SEQ ID NO: 84149

SEQ ID NO: 257521 - RNA, 64 nt, hsa
uuuuuaaagaaaugguagaaaauuugauaaucugaaucaccagcauucaaacaaauauuucggc

SEQ ID NO: 257522 - RNA, 64 nt, hsa
guuuuuagaaaaauauuuauauuguuggugcucaaaucaccaauuucuagcuagaucauuuugc

SEQ ID NO: 257523 - RNA, 64 nt, hsa
gacagagacagagaaauaagcauuagagaccugcaaucaccaagcugagacuucucuuugauuu

SEQ ID NO: 257524 - RNA, 64 nt, hsa
ucuggggcccaacaaugccacagccuguucuaucaaucaccagcuguuuuccuuugagcagucu

SEQ ID NO: 257525 - RNA, 64 nt, hsa
auauacuugcauccaccuacaaauauaaccuuuucaagauaaaucgcuuaugauuucaauaguc

SEQ ID NO: 257526 - RNA, 64 nt, hsa
gaguuacauuugcauuuaauuaaucuuaaaguugcaagauaaacagcuguaauucggacaaaca

SEQ ID NO: 257527 - RNA, 64 nt, hsa
uuuggaaaccuuuuaaaaaugcauuuuugcaaaacaagauaacauauauugauaaaaagugacu

SEQ ID NO: 257528 - RNA, 64 nt, hsa
gagauagugguguuuacugcugcagcauguaucacaagauaagaaaugaaaaaucaaucuuucu

SEQ ID NO: 257529 - RNA, 64 nt, hsa
uauucaauagcucagagguugaacucugguuaaacaagauaauauguuauuaauaaaaauagaa

SEQ ID NO: 257530 - RNA, 64 nt, hsa
agaagcaaauuuauaccuauuuguguauuaagcacaagauaaagaacagcuguuaauauuuuuu

SEQ ID NO: 257531 - RNA, 64 nt, hsa
auuuggugucuguaaguaucaaccauuucuugaucaagauaaggaagcaacacugauacugaga

SEQ ID NO: 257532 - RNA, 64 nt, hsa
cagaaaguacuguguagcccaggaguuuauuuagcaagauaaauagugguaauuucuuaaucau

SEQ ID NO: 257533 - RNA, 64 nt, hsa
uuuuuuaaaaucguucauagacuucuguaaaaugcaagauaaauuaaaguuauuauaacaguga

SEQ ID NO: 257534 - RNA, 64 nt, hsa
ugccaucagaguggauauaccguuguauuaaaaacaagauaaaaaagcugccaagauuuuuggc

SEQ ID NO: 257535 - RNA, 64 nt, hsa
aaagacacuugauacuuguuuucaaaccaguauacaagauaagcuuccaggcugcauagaagga

SEQ ID NO: 257536 - RNA, 64 nt, hsa
ggaggagagggaaaauguuuuguaagaaaccaaucaagauaaaggacagugaaguaauccguac

SEQ ID NO: 257537 - RNA, 64 nt, hsa
agcauucccgccgccuccagccucuccccucuggcaggcgcacccaggagauggaauccccugc

SEQ ID NO: 257538 - RNA, 64 nt, hsa
ucucuugccucagccucccaaguagcugggaugacaggcgcacaccaccacgcccagcaaauuu

SEQ ID NO: 257539 - RNA, 64 nt, hsa
ucuugugccucggccucccuaguagcugggauuacaggcgcacaccaccacacacagcuaauuu

SEQ ID NO: 257540 - RNA, 64 nt, hsa
cccucggcucaccuaagugcccugugcugguugccaggcgcagaggggaggccagcccugcccu

SEQ ID NO: 257541 - RNA, 64 nt, hsa
cugauaucaaaacauuccaauaacuuuuuuuuuucaggcgcagucucacucugucgcccgggcu

SEQ ID NO: 257542 - RNA, 64 nt, hsa
aaaugacucagaauggauuaacaugaaaguuauccaggcgcagaguugaagaagcauaagcaag

SEQ ID NO: 257543 - RNA, 64 nt, hsa
ggacugaggacaggugugggcgccagugugggugcaggcgcaggugcaggcacagggccacugu

SEQ ID NO: 257544 - RNA, 64 nt, hsa
guucucuguucaaaaguaauuggcagugauuggccaggcgcaguggcucacgccuguaauccca

SEQ ID NO: 257545 - RNA, 64 nt, hsa
uuugaugggcuccuuuauuuuuuucuacucuuuucaggcgcacucuugauaaaugguuaauuca

SEQ ID NO: 257546 - RNA, 64 nt, hsa
gaaaagaaggguaguaaaaacuagagauuggggccaggcgcaguggcucacgccuguaauccca

SEQ ID NO: 257547 - RNA, 64 nt, hsa
cuucccaagaauuuagcuugcugugcaguggcugcaggcgcagaacagagcguuacuugauaac

SEQ ID NO: 257548 - RNA, 64 nt, hsa
auuggaagcugucauaaaaagacaacucagaggccaggcgcaggggcucacaccuguaauccua

SEQ ID NO: 257549 - RNA, 64 nt, hsa
cuugcacaaaaagcacaagcauuccuuagcagcucaggcgcagcccuagugggagcccagcaca

SEQ ID NO: 257550 - RNA, 64 nt, hsa
ggccccagcagcagguccuggugcuggcggagcccaggcgcaagccaucuaccuucuggcacag

SEQ ID NO: 257551 - RNA, 64 nt, hsa
aaugcagcgaguccucugggugguuaugagccuccaggcgcaugcuguccaguggacagaacau

SEQ ID NO: 257552 - RNA, 64 nt, hsa
ugggacagggagggccggcggcucugagcaggggcaggcgcagaggucccagccccaggccugg

SEQ ID NO: 257553 - RNA, 64 nt, hsa
gccuggggacacuggccccaugaggggaggaaggcaggcgcacgagguccagggaggcccuuuu

SEQ ID NO: 257554 - RNA, 64 nt, hsa
gcugcuuugugggcuccaggccuguacucaucggcaggcgcaugaguaucugugggaguccucu

SEQ ID NO: 257555 - RNA, 64 nt, hsa
uuaaaaaaggacauagaaaauguuuugaauaggccaggcgcaguggcucacaccuguaauccca

SEQ ID NO: 257556 - RNA, 64 nt, hsa
agugugagaggcggccacuuucauggcagcucaucaggcgcagggccccagacagcuucccagc

SEQ ID NO: 257557 - RNA, 64 nt, hsa
gagccucgaacccgcgucccugggggcugggccccaggcgcacggggcuggaggcaggccuucg

SEQ ID NO: 257558 - RNA, 64 nt, hsa
acagauaggcagugaaagaguuuuauuuuccagccaggcgcaguggcucaaaucccagcacuuc

SEQ ID NO: 257559 - RNA, 64 nt, hsa
cggcucucagagcauaauccuuggcagggcucagcaggcgcacguugguuucuuggucguccuu

SEQ ID NO: 257560 - RNA, 64 nt, hsa
gcugccuggacacacacuuccagacacacgugcacaggcgcagauaugcugccuggacacacgc

SEQ ID NO: 257561 - RNA, 64 nt, hsa
gggugguccaguucuagagugggagaaagggagucaggcgcauugggaaucgugguuccagucu

SEQ ID NO: 257562 - RNA, 64 nt, hsa
ccuccugccucagccuccugagcagcugggacuacaggcgcaugccaccaugcccagcuaauuu

SEQ ID NO: 257563 - RNA, 64 nt, hsa
uacucugcaacucuuaaaaauaaauguaaugugccaggcgcaaugggauaugccugcaggccca

SEQ ID NO: 257564 - RNA, 64 nt, hsa
cgugggcaucacguaagcagcacacuaggaggcccaggcgcaggcaaagagaagauggugcugu

SEQ ID NO: 257565 - RNA, 64 nt, hsa
gccucccccuaacaauccuagacugagacgcagucaggcgcacgcccgcaagaggcggcgaggu

SEQ ID NO: 257566 - RNA, 64 nt, hsa
cccacaagcuugucagaucgcccaggugacgggccaggcgcagccaucgggaaggucauucagc

SEQ ID NO: 257567 - RNA, 64 nt, hsa
gaauaaguaaccaucaaaguuacuaaaacauggccaggcgcaguggcucaugccuguaauccca

SEQ ID NO: 257568 - RNA, 64 nt, hsa
gauucuccugcagccucccgaguagcugggauuacaggcgcacgccaccacgcacggcugauuu

SEQ ID NO: 257569 - RNA, 64 nt, hsa
agggagacaacggguggcugcauccagccagagacaggcgcagguggguguccucagcgugcga

SEQ ID NO: 257570 - RNA, 64 nt, hsa
uaagauuaaguauuaaaaaaaaaccaggcucugccaggcgcaguggcucaugccuauaaucccg

SEQ ID NO: 257571 - RNA, 64 nt, hsa
ucccaggcucaagccucccgaauagcugggacuacaggcgcacaccaccauccccggcuaauuu

SEQ ID NO: 257572 - RNA, 64 nt, hsa
gauucuccugccucagccucuuuagcugggacuacaggcgcacgccaccacgcccggcuaauuu

SEQ ID NO: 257573 - RNA, 64 nt, hsa
ccgaauaagauccgaauaagaauauguaauggaccaggcgcagugccucacgccugucauccca

SEQ ID NO: 257574 - RNA, 64 nt, hsa
ucaugcccuuguauccgcacacgcccaguguguacaggcgcaccccguggacuggcccaggagg

SEQ ID NO: 257575 - RNA, 64 nt, hsa
accuuaaucagcaguaaauucuucucuacucggccaggcgcaguggcucaugccuguaauccca

SEQ ID NO: 257576 - RNA, 64 nt, hsa
agcucugcuaggacuuaccccagccacugaguggcaggcgcaugagauuuguggcuguuccuga

SEQ ID NO: 257577 - RNA, 64 nt, hsa
uccccugccucagccucgcgaguagcuaggacuacaggcgcaugucaccaagcccggcuaauuu

SEQ ID NO: 257578 - RNA, 64 nt, hsa
uugcuugaggucgggaguuugaaaccagucucaccaggcgcaguggcucacgccuguaauucca

SEQ ID NO: 257579 - RNA, 64 nt, hsa
caacauacucuaaagaauaacuccaagucuuggccaggcgcaguggcucacaccuguaauccca

SEQ ID NO: 257580 - RNA, 64 nt, hsa
gcuugcuuggcccgguccccuccgugccaguucccaggcgcacucuacuccagcccuucucccu

SEQ ID NO: 257581 - RNA, 64 nt, hsa
cuccaccccgcaagcaccauccccuccggcuaagcaggcgcaagggaggcccagcgcggacauc

SEQ ID NO: 257582 - RNA, 64 nt, hsa
acccaggagccucgggucugaucaagggagaggccaggcgcagcucacugcggcggcucccuaa

SEQ ID NO: 257583 - RNA, 64 nt, hsa
aggaaggcagagugugacagagcagagccagggccaggcgcaccaggagaggcguuucuggggc

SEQ ID NO: 257584 - RNA, 64 nt, hsa
ggugcccugagcaggaagaugugccacuuccuagcaggcgcaaggccugugcggaagaaacgcc

SEQ ID NO: 257585 - RNA, 64 nt, hsa
ggcccggcaagcacagccacugugacggggaguccaggcgcaggagggacccggggccacaagg

SEQ ID NO: 257586 - RNA, 64 nt, hsa
aauucugacucagccucccaaguagcugggauuacaggcgcaggccaccaugcccggcuaauuu

SEQ ID NO: 257587 - RNA, 64 nt, hsa
ugcauugauucccaguuccagggaugaucaugagcaggcgcaaaaucagaauuaaaggucgcac

SEQ ID NO: 257588 - RNA, 64 nt, hsa
cugacagccuccugcugcccuacccuggcaggcacaggcgcagcuggcuggggggcccacucca

SEQ ID NO: 257589 - RNA, 64 nt, hsa
gucucugaucagagccgacaccagacgugauuagcaggcgcagcaaauucaauuuguuaaauga

SEQ ID NO: 257590 - RNA, 64 nt, hsa
cagccccuucagucugcguucccaguucauuuugcaggcgcauucgcccuuccuaguuugcagc

SEQ ID NO: 257591 - RNA, 64 nt, hsa
ucucaaaucauggauuaggaguaaagaaagaggccaggcgcaauggcucaugccuguaauccca

SEQ ID NO: 257592 - RNA, 64 nt, hsa
cugucugcucaguagaaccuugcaggugcuguagcaggcgcaagaccguagaucucaggccucu

SEQ ID NO: 257593 - RNA, 64 nt, hsa
ccuacccaugcagggacugggauucgaggacuuccaggcgcauaggguagaaccaaaugauagg

SEQ ID NO: 257594 - RNA, 64 nt, hsa
auccauggucucuagaugguuuacuuaaauaggccaggcgcaguggcucacaccuguaauccua

SEQ ID NO: 257595 - RNA, 64 nt, hsa
ggaucuccaaguguccuggugccaggugugggcccaggcgcagccugccaccuccccauccacu

SEQ ID NO: 257596 - RNA, 64 nt, hsa
cccaccuuagaccgaaggggaaaacccgcucucucaggcgcaugugccaguuggggccccgcgg

SEQ ID NO: 257597 - RNA, 64 nt, hsa
uuuggugaguucucuugggaaucaucugccucuucaggcgcauuuugcaauaaagucugucuag

SEQ ID NO: 257598 - RNA, 64 nt, hsa
ugugaggcccucccggggcgccuccccucacccccaggcgcacgucuggccccgccucuggcug

SEQ ID NO: 257599 - RNA, 64 nt, hsa
cccaccagaagccaucucccccgcuguguguccccaggcgcaucauugcuccacucuccccugc

SEQ ID NO: 257600 - RNA, 64 nt, hsa
auauucuuccccgaaucacacagacaguuucugacaggcgcaacuccuccauuuuccucccgca

SEQ ID NO: 257601 - RNA, 64 nt, hsa
ggacguucuucugugugcauugcuucuguaaaugcaggcgcaguuugucguguuuccaaaccag

SEQ ID NO: 257602 - RNA, 64 nt, hsa
ugccugcaccugcugccuuaacaguggaguuggccaggcgcaguggcucacaccuguaauccca

SEQ ID NO: 257603 - RNA, 64 nt, hsa
acacuguuuccuggccccagagcucauuuggguucaggcgcacuucaaaacccucccuggggga

SEQ ID NO: 257604 - RNA, 64 nt, hsa
aucaccaugggaaucuuuggacucaggacagggccaggcgcagggcucucccuccucuccccuu

SEQ ID NO: 257605 - RNA, 64 nt, hsa
caccaggaaaucccgcgggguggcccaugcagaccaggcgcacguggcucauggggcagaauug

SEQ ID NO: 257606 - RNA, 64 nt, hsa
aagccaaaaaggauggcuaaaugcuccugggagucaggcgcagccucacaccagcugccuccuc

SEQ ID NO: 257607 - RNA, 64 nt, hsa
gugugauugagguuaugcuggcaccacucgcacacaggcgcacaaugguguuagcugggcagaa

SEQ ID NO: 257608 - RNA, 64 nt, hsa
cccacccucucccucucccuucagcucugggaggcaggcgcagugccccccucccaugggcugg

SEQ ID NO: 257609 - RNA, 64 nt, hsa
cagcagccaagccuagagcccuccggaucccauccaggcgcaaagaggaauaggagggacaugg

SEQ ID NO: 257610 - RNA, 64 nt, hsa
uaaugaagaauggaaguuuggaucugcuccucgucaggcgcagcaucucugaagcuuggaaagc

SEQ ID NO: 257611 - RNA, 64 nt, hsa
ccaccugcuucggccucccaaagugcugggauuacaggcgcaagccacccagcccagcuucuuu

SEQ ID NO: 257612 - RNA, 64 nt, hsa
cugggaggugguuccaagggugucugcuuuuggccaggcgcaguggcucacgcuuguaauccca

SEQ ID NO: 257613 - RNA, 64 nt, hsa
ggugccaucaugacucacugcagccuugaccucccaggcgcacaaaauccuccucucagccuga

SEQ ID NO: 257614 - RNA, 64 nt, hsa
aggcauggcgauggugcgccuguuccacacccagcaggcgcaaccagagucucgugugugccga

SEQ ID NO: 257615 - RNA, 64 nt, hsa
uucugggaggcugggcccuggaggcaacgugcugcaggcgcacucugucagagugaacagcacc

SEQ ID NO: 257616 - RNA, 64 nt, hsa
ucuccugccucagccucuugaguagcugggacuacaggcgcacaccaccacgccaggcuaauuu

SEQ ID NO: 257617 - RNA, 64 nt, hsa
uucuccagcuuuguagcagcagccuugacaaacccaggcgcacuguaccaaggcaauguaacuu

SEQ ID NO: 257618 - RNA, 64 nt, hsa
uuuuaacugcuucagacaccuagaucccagaacucaggcgcauaugcauauuuucccugcaaga

SEQ ID NO: 257619 - RNA, 64 nt, hsa
aaaccccauagcuuuaagaaguaccugcaagggucaggcgcaguggcucacaccuguaauccca

SEQ ID NO: 257620 - RNA, 64 nt, hsa
uccaucugucacgugguucaccaucaucaggcaccaggcgcaaacugcuucccgcuguuggcca

SEQ ID NO: 257621 - RNA, 64 nt, hsa
ucuacuaaaaauacaaaaaccaaaaaaaauuagccaggcgcauuggcucaugucuguaauccca

SEQ ID NO: 257622 - RNA, 64 nt, hsa
ccucccgccucagccuccugagcagcugggauuacaggcgcacaucaccaugcccaaccuccaa

SEQ ID NO: 257623 - RNA, 64 nt, hsa
ucuugugccucagccuccuaagcagcugggacuacaggcgcaugcaaccauacccagcuaauuu

SEQ ID NO: 257624 - RNA, 64 nt, hsa
ucuccugccucagccuccugaguagcugggauuacaggcgcacgccaccacgccuggcuaauuu

SEQ ID NO: 257625 - RNA, 64 nt, hsa
acgugggcggcuuccucaagcccggaggagcucccaggcgcacaggggccgccgguaacagggg

SEQ ID NO: 257626 - RNA, 64 nt, hsa
uuuuuuugugagacggaguuuugcucuuauugcccaggcgcaaucucggcucacugcaaccucu

SEQ ID NO: 257627 - RNA, 64 nt, hsa
gcuucugccucagcuucccaaguagcugagauuacaggcgcacaccaccacgcccaacugauuu

SEQ ID NO: 257628 - RNA, 64 nt, hsa
ccccgcgcgccgguccggcgccccgcacccccgccaggcgcaugucugcaccuccgcuugccag

SEQ ID NO: 257629 - RNA, 64 nt, hsa
gggcagccccuagguuagaguggagacggaggcccaggcgcaggggucacaccucaucugguuu

SEQ ID NO: 257630 - RNA, 64 nt, hsa
acucgggggccuccauccgauggcaggugguggacaggcgcaucccacucuaugcgaaccacaa

SEQ ID NO: 257631 - RNA, 64 nt, hsa
acagcccagcagggcuggagacgcccauguccagcaggcgcaggccuggcaacacgguccccag

SEQ ID NO: 257632 - RNA, 64 nt, hsa
gagugaugggcagguucggcagccuaacauuguucaggcgcauggccccugcgguguguacacg

SEQ ID NO: 257633 - RNA, 64 nt, hsa
aucuucuccccaccaccgccccggugugcguacccaggcgcacgugcugcagcccccggaggcc

SEQ ID NO: 257634 - RNA, 64 nt, hsa
guacacacuuucacucuauuguaaccacacagggcaggcgcauccagcaugucaguguccugcc

SEQ ID NO: 257635 - RNA, 64 nt, hsa
ccugcccaccgcucugucuccuggccgucugcuccaggcgcagcuggggcugaggaugucucaa

SEQ ID NO: 257636 - RNA, 64 nt, hsa
cuccgccucagccuuuggagaguagcuaggacuacaggcgcagccaccacacccagcuaguuuu

SEQ ID NO: 257637 - RNA, 64 nt, hsa
cagcucuuccugucagggaucagggcagcacuaacaggcgcaaaaguagagcugucaagauggg

SEQ ID NO: 257638 - RNA, 64 nt, hsa
gaacauggugguuugcacuuggguucugguggcgcaggcgcaggagcagccagcuguggcagcg

SEQ ID NO: 257639 - RNA, 64 nt, hsa
aaaaauaggcucaguuagaaaaggacucccuggccaggcgcagugacuuacgccuguaaucuca

SEQ ID NO: 257640 - RNA, 64 nt, hsa
uucaaacaugccauaaggaaaacgagugccugaacugcaugauuuauuaguuucucuccacucu

SEQ ID NO: 257641 - RNA, 64 nt, hsa
ucaagugugguaauauggcaagccuuguuccuuucugcaugagaaucuaggagagaauucauaa

SEQ ID NO: 257642 - RNA, 64 nt, hsa
ccacagaccgucucagacacgcacagugggccugcugcaugauucacacccagucccugccaca

SEQ ID NO: 257643 - RNA, 64 nt, hsa; identical to SEQ ID NO: 257642

SEQ ID NO: 257644 - RNA, 64 nt, hsa
gaguuucauucuuguuacccaggcuggagugcagcugcaugauuucagcucaccgcaaccucug

SEQ ID NO: 257645 - RNA, 64 nt, hsa
cuucgucuaugaaaaguugccaagugugacuccccugcaugauguuagccauggguccuuucug

SEQ ID NO: 257646 - RNA, 64 nt, hsa
uucauagacuuugauuuuauuuauaagccacuugcugcaugacccuccaaguagaccuguggcu

SEQ ID NO: 257647 - RNA, 64 nt, hsa
auacucaaacacuuuuggaccaggauuugagucucugcaugacauauacuugauuaaaagguua

SEQ ID NO: 257648 - RNA, 64 nt, hsa; identical to SEQ ID NO: 97683

SEQ ID NO: 257649 - RNA, 64 nt, hsa; identical to SEQ ID NO: 97684

SEQ ID NO: 257650 - RNA, 64 nt, hsa; identical to SEQ ID NO: 97685

SEQ ID NO: 257651 - RNA, 64 nt, hsa; identical to SEQ ID NO: 97686

SEQ ID NO: 257652 - RNA, 64 nt, hsa; identical to SEQ ID NO: 97687

SEQ ID NO: 257653 - RNA, 64 nt, hsa; identical to SEQ ID NO: 97688

SEQ ID NO: 257654 - RNA, 64 nt, hsa; identical to SEQ ID NO: 97689

SEQ ID NO: 257655 - RNA, 64 nt, hsa; identical to SEQ ID NO: 97690

SEQ ID NO: 257656 - RNA, 64 nt, hsa; identical to SEQ ID NO: 97691

SEQ ID NO: 257657 - RNA, 64 nt, hsa; identical to SEQ ID NO: 97692

SEQ ID NO: 257658 - RNA, 56 nt, hsa; identical to SEQ ID NO: 97693

SEQ ID NO: 257659 - RNA, 64 nt, hsa; identical to SEQ ID NO: 97694

SEQ ID NO: 257660 - RNA, 64 nt, hsa; identical to SEQ ID NO: 97695

SEQ ID NO: 257661 - RNA, 64 nt, hsa; identical to SEQ ID NO: 97696

SEQ ID NO: 257662 - RNA, 64 nt, hsa; identical to SEQ ID NO: 97697

SEQ ID NO: 257663 - RNA, 64 nt, hsa; identical to SEQ ID NO: 97698

SEQ ID NO: 257664 - RNA, 64 nt, hsa; identical to SEQ ID NO: 97699

SEQ ID NO: 257665 - RNA, 64 nt, hsa; identical to SEQ ID NO: 97700

SEQ ID NO: 257666 - RNA, 64 nt, hsa; identical to SEQ ID NO: 97701

SEQ ID NO: 257667 - RNA, 64 nt, hsa; identical to SEQ ID NO: 97702

SEQ ID NO: 257668 - RNA, 64 nt, hsa; identical to SEQ ID NO: 97703

SEQ ID NO: 257669 - RNA, 64 nt, hsa; identical to SEQ ID NO: 97704

SEQ ID NO: 257670 - RNA, 64 nt, hsa; identical to SEQ ID NO: 97705

SEQ ID NO: 257671 - RNA, 64 nt, hsa; identical to SEQ ID NO: 97706

SEQ ID NO: 257672 - RNA, 64 nt, hsa; identical to SEQ ID NO: 97707

SEQ ID NO: 257673 - RNA, 64 nt, hsa; identical to SEQ ID NO: 97708

SEQ ID NO: 257674 - RNA, 64 nt, hsa; identical to SEQ ID NO: 97709

SEQ ID NO: 257675 - RNA, 64 nt, hsa; identical to SEQ ID NO: 97710

SEQ ID NO: 257676 - RNA, 64 nt, hsa; identical to SEQ ID NO: 97711

SEQ ID NO: 257677 - RNA, 64 nt, hsa; identical to SEQ ID NO: 97712

SEQ ID NO: 257678 - RNA, 64 nt, hsa; identical to SEQ ID NO: 97713

SEQ ID NO: 257679 - RNA, 64 nt, hsa; identical to SEQ ID NO: 97714

SEQ ID NO: 257680 - RNA, 64 nt, hsa; identical to SEQ ID NO: 97715

SEQ ID NO: 257681 - RNA, 64 nt, hsa; identical to SEQ ID NO: 97716

SEQ ID NO: 257682 - RNA, 64 nt, hsa; identical to SEQ ID NO: 97717

SEQ ID NO: 257683 - RNA, 64 nt, hsa; identical to SEQ ID NO: 97718

SEQ ID NO: 257684 - RNA, 64 nt, hsa; identical to SEQ ID NO: 97719

SEQ ID NO: 257685 - RNA, 64 nt, hsa; identical to SEQ ID NO: 97720

SEQ ID NO: 257686 - RNA, 64 nt, hsa; identical to SEQ ID NO: 97721

SEQ ID NO: 257687 - RNA, 64 nt, hsa; identical to SEQ ID NO: 97722

SEQ ID NO: 257688 - RNA, 64 nt, hsa; identical to SEQ ID NO: 97723

SEQ ID NO: 257689 - RNA, 64 nt, hsa; identical to SEQ ID NO: 97724

SEQ ID NO: 257690 - RNA, 64 nt, hsa; identical to SEQ ID NO: 97725

SEQ ID NO: 257691 - RNA, 64 nt, hsa; identical to SEQ ID NO: 97726

SEQ ID NO: 257692 - RNA, 64 nt, hsa; identical to SEQ ID NO: 97727

SEQ ID NO: 257693 - RNA, 64 nt, hsa; identical to SEQ ID NO: 97728

SEQ ID NO: 257694 - RNA, 64 nt, hsa; identical to SEQ ID NO: 97729

SEQ ID NO: 257695 - RNA, 64 nt, hsa; identical to SEQ ID NO: 97730

SEQ ID NO: 257696 - RNA, 64 nt, hsa; identical to SEQ ID NO: 97731

SEQ ID NO: 257697 - RNA, 64 nt, hsa; identical to SEQ ID NO: 97732

SEQ ID NO: 257698 - RNA, 64 nt, hsa; identical to SEQ ID NO: 97733

SEQ ID NO: 257699 - RNA, 64 nt, hsa; identical to SEQ ID NO: 97734

SEQ ID NO: 257700 - RNA, 64 nt, hsa
auauaaaaccacaaagaauguacugaaccuacuaacccuuuaacauacaguuuaggguccuagc

SEQ ID NO: 257701 - RNA, 64 nt, hsa
agacacagugguuauggaagcauuucuuuacaguacccuuuacauguuugguuucugaacuuaa

SEQ ID NO: 257702 - RNA, 64 nt, hsa
uauguuucauaauuucuuacaacaugagccaguaacccuuuaggaacucucuauggagaacagg

SEQ ID NO: 257703 - RNA, 64 nt, hsa
uuuaucgaggagagaaauaauaacuaaaaaauauacccuuuaaaaaaaccuauauuucucuguc

SEQ ID NO: 257704 - RNA, 64 nt, hsa
aaagaauuaaagaacuugcuguucaaauuaaguagaaagugagacucaauaauaacugaacuac

SEQ ID NO: 257705 - RNA, 64 nt, hsa
guacuaaaaacagguuuccuauuuaauauaaaaagaaagugaaucuucuuuuggauagaaucau

SEQ ID NO: 257706 - RNA, 64 nt, hsa
gcaugcaguccgaaagcaugugggaguggggagggaaagugagaugaauuaagacaaagaacag

SEQ ID NO: 257707 - RNA, 64 nt, hsa
cauuaagguugaacagcauggcucagagucuagagaaagugaucaccaagcugucucaucacca

SEQ ID NO: 257708 - RNA, 64 nt, hsa
gguugaacaacauggcucagagucuuguucaagagaaagugaucaccgagcugucacaucagca

SEQ ID NO: 257709 - RNA, 64 nt, hsa
gacuccaagugcugcgguugauuccagugagggagaaagugaucugcagggagguggacaccga

SEQ ID NO: 257710 - RNA, 64 nt, hsa
ccgaggcgcugucuucugucccccacacguaccagaaagugaaaaaugcagcgaguccucuggg

SEQ ID NO: 257711 - RNA, 64 nt, hsa
ccaugcuaaaugucaguuaccaguuuggauugaugaaagugauuuuucugcuuuaccuuuuucc

SEQ ID NO: 257712 - RNA, 64 nt, hsa
ucccuucugacauuuccuaggaagcuaggaaaaggaaagugaaggaauggucuaaagaaaugac

SEQ ID NO: 257713 - RNA, 64 nt, hsa
uuccaauuccuccucuucuucagaaucaucuucagaaagugaacuugaacaugagagaagcaga

SEQ ID NO: 257714 - RNA, 64 nt, hsa
cucaucauccuaccauaaaagagaaaaaaauucggaaagugaucagagcacuuauucaaaauac

SEQ ID NO: 257715 - RNA, 64 nt, hsa
auuucugaacuaauggugcuaauucagagaaauggaaagugaaagugagauucucuguugucau

SEQ ID NO: 257716 - RNA, 64 nt, hsa
gaacuaauggugcuaauucagagaaauggaaagugaaagugagauucucuguugucaucggcau

SEQ ID NO: 257717 - RNA, 64 nt, hsa
ucugacugagagaaagauggucgucuccagcagagaaagugaacagcauuuguuggaaggugau

SEQ ID NO: 257718 - RNA, 64 nt, hsa
ucccuggggggaaauaucauucuuacuaugguuagaaagugaauuagaaauuucagcucaguuu

SEQ ID NO: 257719 - RNA, 64 nt, hsa
aaguaaacaccagcagcucauagauuacaaccaagaaagugacuguaucagaugauagacuuca

SEQ ID NO: 257720 - RNA, 64 nt, hsa
accacaucccucucaaguguuccacaacaucuaggaaagugagcucuuaaagacagacuaaaaa

SEQ ID NO: 257721 - RNA, 64 nt, hsa
acucauaccacacuuacaauuaaggucaagcccagaaagugauaagugcagggaggaaaagugc

SEQ ID NO: 257722 - RNA, 64 nt, hsa
acagccacuaaaacacaaaaagggggauugggcggaaagugagagccagcagcaaaaacuacau

SEQ ID NO: 257723 - RNA, 64 nt, hsa
ucucaguuuacauuuuguauauuuguauuuaaaugaaagugagacuuugaggguguauauuuuc

SEQ ID NO: 257724 - RNA, 64 nt, hsa
agccucaaaugagaaaaugucuuuauuaaauguagaaagugauccauacuucaccuuugaagga

SEQ ID NO: 257725 - RNA, 64 nt, hsa
gguaaaacuggagacugggugaaagugacuaccagaaagugaggaagccuaaauaaaaaguaua

SEQ ID NO: 257726 - RNA, 64 nt, hsa
ggacucuaagucaggguaaaacuggagacugggugaaagugacuaccagaaagugaggaagccu

SEQ ID NO: 257727 - RNA, 64 nt, hsa
cuuucugugugcuuaaggucccguucaaaggugagaaagugaagcuggugcggcugcggaaucc

SEQ ID NO: 257728 - RNA, 64 nt, hsa
gccuccacagccacagccuggcagcucugaucaggaaagugaggaacagcaacaauuccggaac

SEQ ID NO: 257729 - RNA, 64 nt, hsa
agaggaaaauguauuuaaaagaaauacgagaaaagaaagugaaaguuuuacaaguuagagggau

SEQ ID NO: 257730 - RNA, 64 nt, hsa
ugaagaguuugacuuagaauaaugaagguaacuagaaagugaguuaaucuuguaugagguugca

SEQ ID NO: 257731 - RNA, 64 nt, hsa
aaauaaauucuaaaacauauaauucagguauuaggaaagugaucccagauuagauuuuugagau

SEQ ID NO: 257732 - RNA, 64 nt, hsa
gaaagccuacucaaugaaaacacauuuuaagacugaaagugaaauauagauauuuuaaggaaaa

SEQ ID NO: 257733 - RNA, 64 nt, hsa
uccaucucaaaaaaaaaaaaaaaaaaaaaaaaaagaaagugaugcacagaguggcaggcagacc

SEQ ID NO: 257734 - RNA, 64 nt, hsa
gaaaacuuauuuuaaguugggacaagaugauguugaaagugaugcacaggacaggugugguggc

SEQ ID NO: 257735 - RNA, 64 nt, hsa
cuugaauauauuccuauaacuguagaacaguguggaaagugaugguaacuuugaaguuguucau

SEQ ID NO: 257736 - RNA, 64 nt, hsa
uuuuuaaagugcugagccuuacaaaccccugaaggaaagugacccuuuaagagaggaucaucuu

SEQ ID NO: 257737 - RNA, 64 nt, hsa
cugagaacauccagaggugagacucagacacauugaaagugacugcauuuagggagguuuaacg

SEQ ID NO: 257738 - RNA, 64 nt, hsa
aucucuaauaaagauggccaccacuuaauguguggaaagugauggccuucucgugggccacgcg

SEQ ID NO: 257739 - RNA, 64 nt, hsa
gcuuuucauuaagccucaaaaucuccucuguucuacuuggcaccacaagcuauguccuauauau

SEQ ID NO: 257740 - RNA, 64 nt, hsa
gcaccacaagcuauguccuauauauguauuucugacuuggcaggauaguucaggggucuggcag

SEQ ID NO: 257741 - RNA, 64 nt, hsa
cgugcucagccgcaaaauucuuuaugaauuuuacacuuggcaaauguuaaugacggaagccaua

SEQ ID NO: 257742 - RNA, 64 nt, hsa
auuccuaccaaauaguuucuaaugugggagaaaaacuuggcacaaaauuucuucaguuuauuau

SEQ ID NO: 257743 - RNA, 64 nt, hsa
uuuuuacgucaguuuauauuuuaauucuuacuguacuuggcaugcgcaauaaagcagcacaugu

SEQ ID NO: 257744 - RNA, 64 nt, hsa
uuggccuuucuuggggagaaggcgggguauucccacucaccagcccuagcugucccauggggaa

SEQ ID NO: 257745 - RNA, 64 nt, hsa
cugcagcugauccauaggacuaccgcaggcccggacucaccaacuugccacauguucuagguuu

SEQ ID NO: 257746 - RNA, 64 nt, hsa
ucagauugguaaugccagaaaaaauuuuaagaggacucaccaaaaguacuagaucuauguaagu

SEQ ID NO: 257747 - RNA, 64 nt, hsa
gaaauaagagaugccagaacuacuuccauaacuaacucaccaaaucaaaucaucaguccucaua

SEQ ID NO: 257748 - RNA, 64 nt, hsa
augggaaaaacggcaguaucacagauguaaauuaacucaccagauuuacugggccugaacucau

SEQ ID NO: 257749 - RNA, 64 nt, hsa
gagguagagaaaccguggagaucgcuuuucucagacucaccaacuuuuaaugggauuucauggg

SEQ ID NO: 257750 - RNA, 64 nt, hsa
cugucaggccucugggaaucucccaaaucccagaacucaccacucaccaugggccuuuaaaugc

SEQ ID NO: 257751 - RNA, 64 nt, hsa
gccucugggaaucucccaaaucccagaacucaccacucaccaugggccuuuaaaugcaguaaac

SEQ ID NO: 257752 - RNA, 64 nt, hsa
cgugauguggagggcacauuccuugccugcacaaacucaccaucugugcacgcaguggccuucc

SEQ ID NO: 257753 - RNA, 64 nt, hsa
aggcaucacagcuaacaauugugaagucgucuuaacucaccauaaaaaggaauccacucccagg

SEQ ID NO: 257754 - RNA, 51 nt, hsa
ucuuacagagugcaguaugaaacucaccagcgagaacaaacaccuccccag

SEQ ID NO: 257755 - RNA, 64 nt, hsa
uuccauccagggugccaucaguaaucaugccacuacucaccaguguuguucaccaacacccacc

SEQ ID NO: 257756 - RNA, 59 nt, hsa
acauuaaaugucaauuauaggaaaacauaguuggaaauguaaucauccaaagaucauuu

SEQ ID NO: 257757 - RNA, 59 nt, hsa
auggauucaacuucugccucggaugagagguuggaaauguagcugcuuuucuuuagaaa

SEQ ID NO: 257758 - RNA, 59 nt, hsa
auagaacugaggaucauuuguauuuuugaguuggaaauuaugaaacuucaccauauuau

SEQ ID NO: 257759 - RNA, 59 nt, hsa
cuuauaaguuuauaaguuugauuucagauguuggaaaugugugcuuuauaguguuuacu

SEQ ID NO: 257760 - RNA, 59 nt, hsa
uccuugaaagcccuuuagaagggugccauguuggaaaccuguacauccacaacaaguag

SEQ ID NO: 257761 - RNA, 59 nt, hsa
cauccacaacaaguagcuuuuccuccuauguuggaaaaaaagacuguuucuuuguuuga

SEQ ID NO: 257762 - RNA, 59 nt, hsa
uuuauuuuaucucacagguuuguguaauuguuggaaaauuuuuaaacuucuaagugaaa

SEQ ID NO: 257763 - RNA, 59 nt, hsa
cucauuguaaagcuucaugucuuuuguuuguuggaaaauuuuuacuuauagaaacuuaa

SEQ ID NO: 257764 - RNA, 59 nt, hsa
acaggagaagaaguucauacaggugauucguuggaaaaauucauugucucuagagauug

SEQ ID NO: 257765 - RNA, 59 nt, hsa
cagguugucagguucugccuucaaggguuguuggaaaauaguccccaucuaauauguau

SEQ ID NO: 257766 - RNA, 59 nt, hsa
auaaaaggaucauuuguuuuuuaaaagggguuggaaaaacugguuuuccaguuggaaac

SEQ ID NO: 257767 - RNA, 59 nt, hsa
uaaaagggguuggaaaaacugguuuuccaguuggaaacaguaaagguuguaagcuuugu

SEQ ID NO: 257768 - RNA, 59 nt, hsa
cuggucucucccaccugguuggaaaugucguuggaaacuugcaaagacucuccagaccu

SEQ ID NO: 257769 - RNA, 59 nt, hsa
acucgucaacugcuggucucucccaccugguuggaaaugucguuggaaacuugcaaaga

SEQ ID NO: 257770 - RNA, 64 nt, hsa
gaaaggaagaauaagagugcaccagaauaagagcgcaccagaauaagagcgcaccagcuaacaa

SEQ ID NO: 257771 - RNA, 64 nt, hsa
uuuaaaaucuucucuugaaaggaagaauaagagugcaccagaauaagagcgcaccagaauaaga

SEQ ID NO: 257772 - RNA, 61 nt, hsa
agcugcgggacgaguucugauucuggccggagcaccagacccucugauccuggagggacca

SEQ ID NO: 257773 - RNA, 64 nt, hsa
agcaguaauaaucacuuguguucugaaagaaagggcaccagaaguucuagcaaaauucaguugu

SEQ ID NO: 257774 - RNA, 64 nt, hsa
cgugccuguaaucccagcuauucaggaggcugaggcaccagaauugcuugaacccaggaggugg

SEQ ID NO: 257775 - RNA, 64 nt, hsa
cugaggaguggaguucucuguucuagagugacaggcaccagaugggaugggcuuucucaguguc

SEQ ID NO: 257776 - RNA, 64 nt, hsa
cugggcauacagugucuggacgcugccacaucugggcauacagugucuggacacugccacaugg

SEQ ID NO: 257777 - RNA, 64 nt, hsa
cagccacacagcuggacggaugcugccacaucugggcauacagugucuggacgcugccacaucu

SEQ ID NO: 257778 - RNA, 64 nt, hsa; identical to SEQ ID NO: 80419

SEQ ID NO: 257779 - RNA, 64 nt, hsa; identical to SEQ ID NO: 80420

SEQ ID NO: 257780 - RNA, 64 nt, hsa; identical to SEQ ID NO: 80421

SEQ ID NO: 257781 - RNA, 64 nt, hsa; identical to SEQ ID NO: 80422

SEQ ID NO: 257782 - RNA, 64 nt, hsa; identical to SEQ ID NO: 80423

SEQ ID NO: 257783 - RNA, 64 nt, hsa; identical to SEQ ID NO: 80424

SEQ ID NO: 257784 - RNA, 64 nt, hsa; identical to SEQ ID NO: 80425

SEQ ID NO: 257785 - RNA, 64 nt, hsa; identical to SEQ ID NO: 80426

SEQ ID NO: 257786 - RNA, 64 nt, hsa; identical to SEQ ID NO: 80427

SEQ ID NO: 257787 - RNA, 64 nt, hsa; identical to SEQ ID NO: 80428

SEQ ID NO: 257788 - RNA, 64 nt, hsa; identical to SEQ ID NO: 80429

SEQ ID NO: 257789 - RNA, 64 nt, hsa; identical to SEQ ID NO: 80430

SEQ ID NO: 257790 - RNA, 64 nt, hsa; identical to SEQ ID NO: 80431

SEQ ID NO: 257791 - RNA, 64 nt, hsa; identical to SEQ ID NO: 80432

SEQ ID NO: 257792 - RNA, 64 nt, hsa
ggauaacuaccagaaagguauaccuguugagacugauucagaggagcaacccuauuuagaaaug

SEQ ID NO: 257793 - RNA, 64 nt, hsa
guacaaaauccagcuaugaauauagagggcuuaugauucagauuguuaucuaucaacuauaagc

SEQ ID NO: 257794 - RNA, 64 nt, hsa
cacaguucccuggccggguuuggacugaacaguggauucagaacugcagcguucaaagccccug

SEQ ID NO: 257795 - RNA, 64 nt, hsa
cacacacuccguucaugcauggacaccagaagacgauucagaacacaagaggagaaugagcugg

SEQ ID NO: 257796 - RNA, 64 nt, hsa
acuauauuaaauuuuuaucauuuacuuuuuuuaagauucagaccucaguuauauaaauuucagu

SEQ ID NO: 257797 - RNA, 64 nt, hsa
caaaucuugaaagacgaaaucaaagcccauuaaugauucagaaucagugcuugaccuccuguau

SEQ ID NO: 257798 - RNA, 64 nt, hsa
uugguuuguaaguuuuaguuccuuguauuauugagauucagagcuucauuuuauguuggucauu

SEQ ID NO: 257799 - RNA, 64 nt, hsa
cauauuuucaagucacaugucucucagaccccuggauucagaacccaaggccacaaaucauagg

SEQ ID NO: 257800 - RNA, 64 nt, hsa
gggccacugcuggggguucaugggaucccgaaggagcaagcagucggcagcacccaggccacag

SEQ ID NO: 257801 - RNA, 64 nt, hsa
cuuccacuuccaucagggcuauuccgcagcuugcagcaagcacagagugugaccucccaggauu

SEQ ID NO: 257802 - RNA, 64 nt, hsa
caaaaguuaaacguucuaaaaagaggcgaaaggaagcaagcaguucagaagagccaaggaauaa

SEQ ID NO: 257803 - RNA, 64 nt, hsa
aaaaaagacaaaaagcauaaggcuccaaaacgaaagcaagcauuucacuggcagccuccacuag

SEQ ID NO: 257804 - RNA, 64 nt, hsa
auuucaaaguuuaauuaauauaauuaaaagcaacagcaagcagcagccugugaagauuuugcuc

SEQ ID NO: 257805 - RNA, 64 nt, hsa
acaaaauguagacaagaugccucaagguauugguagcaagcaagauuuugcccuuuaguuuucg

SEQ ID NO: 257806 - RNA, 64 nt, hsa
guuuuauuugccaaauguuaccaaucagugagcaagcaagcacagccaaaaucggaccucagcu

SEQ ID NO: 257807 - RNA, 64 nt, hsa
uuguguuuuauuugccaaauguuaccaaucagugagcaagcaagcacagccaaaaucggaccuc

SEQ ID NO: 257808 - RNA, 64 nt, hsa
uucccugcucagguauaugcgaucucuaccgagaagcaagcacaaaaguagacaaaaguauuaa

SEQ ID NO: 257809 - RNA, 64 nt, hsa
caguguacaaaucuggcugcccguuuacuuucugagcaagcacuggaguccacuccgaccuuuu

SEQ ID NO: 257810 - RNA, 64 nt, hsa
cacuugaaugaagagaaugguggcagaaugagugagcaagcagauugccccagaggggccggua

SEQ ID NO: 257811 - RNA, 64 nt, hsa
aauuuuuuauuuugauuuuauuaaaugggaagaaagcaagcagaaauaguaaaauucaguaggu

SEQ ID NO: 257812 - RNA, 64 nt, hsa
guauucacuagcuaaauaaacauaguucuuguuuagcaagcauauguuguuccucagcucuuuu

SEQ ID NO: 257813 - RNA, 64 nt, hsa
uagguuuuuauguaagagugucauggaagcacucagcaagcaggcugauugcaauagacucaga

SEQ ID NO: 257814 - RNA, 64 nt, hsa
auuaaaauuuuaaucaauaaaguaugucuguugaagcaagcaagcaaacaaauccauaacaacc

SEQ ID NO: 257815 - RNA, 64 nt, hsa
aaauuuuaaucaauaaaguaugucuguugaagcaagcaagcaaacaaauccauaacaaccacaa

SEQ ID NO: 257816 - RNA, 64 nt, hsa
aagccucaacuuacccaggaggagcuagaagcaaagcaagcaaagcaaaagcuggaagaucgcc

SEQ ID NO: 257817 - RNA, 64 nt, hsa
caaguccaaggccaggucucagucggugucacccagcaagcaggcagcgccccggcccgcggcc

SEQ ID NO: 257818 - RNA, 64 nt, hsa
aacucucuuggagcuuuugcauuuaaaacaaacaagcaagcagacacacacagugaacacauuu

SEQ ID NO: 257819 - RNA, 64 nt, hsa
caagucucuauacaaugucuuuaucccugugggcagcaagcaaugaugauaaugacaaacagga

SEQ ID NO: 257820 - RNA, 64 nt, hsa
gaaccuggauuguggagucacauccucccugcaaagcaagcagggcaagggagaucuggcauuu

SEQ ID NO: 257821 - RNA, 64 nt, hsa
gucagauuuuccuauuuuaauugcuuuagggaagagcaagcagagucaugaccagggacacagc

SEQ ID NO: 257822 - RNA, 64 nt, hsa
uaauuggagaugcauuaggucacuugaauguauaagcaagcaccuaugguaggcgcuacagaca

SEQ ID NO: 257823 - RNA, 64 nt, hsa
uccuauuagccauggaaaugcaaaguuuagcagaagcaagcaauuaggcagagaacaaaaaugu

SEQ ID NO: 257824 - RNA, 64 nt, hsa
cugggauuacaggcaugagccaccaugccuagccagcaagcaucauuucuauuauaccuuggug

SEQ ID NO: 257825 - RNA, 64 nt, hsa
cuuuauagcagugugagaaugggcuaauacacggagcaagcauuguuucuuuucauuuguuuau

SEQ ID NO: 257826 - RNA, 64 nt, hsa
ccgcuacccucggccugcccaccaccaagcaagcagcaagcaagaugggguucucaucaguucu

SEQ ID NO: 257827 - RNA, 64 nt, hsa
gagccugccgcuacccucggccugcccaccaccaagcaagcagcaagcaagaugggguucucau

SEQ ID NO: 257828 - RNA, 64 nt, hsa
cccucuugccggcagaguggaauacauggaaaagagcaagcaucugcaggagcagcucaaugaa

SEQ ID NO: 257829 - RNA, 64 nt, hsa
ucugcacaaugagaacuccgacagggguggcagcagcaagcacaauaccauuaaaaagguaccc

SEQ ID NO: 257830 - RNA, 64 nt, hsa
ugaaaggccaaccauuucaggaucagucaaaggcagcaagcagauagacucaaggugugugaaa

SEQ ID NO: 257831 - RNA, 64 nt, hsa
gaugcuuguguugaccagauguuccugagucuggagcaagcacccaggccagaauaacagagcu

SEQ ID NO: 257832 - RNA, 62 nt, hsa
aauuuuaacuuuuaauuuuuauuuuggcaaaacugucaaaugagaaaaaugauuuuaaaaac

SEQ ID NO: 257833 - RNA, 62 nt, hsa
uuaaccuggauagccacauuaaugaauuggugcugucaaaauauaguaauuuuuaaauuugu

SEQ ID NO: 257834 - RNA, 62 nt, hsa
uucagucuaauaaccuugaagugguuuuugaacugucaaacuuugaccuguagaugcuguag

SEQ ID NO: 257835 - RNA, 62 nt, hsa
auugcuacauacacuucucugaggaucaccugcugucaaauugccaucuacaguauuacagc

SEQ ID NO: 257836 - RNA, 62 nt, hsa
uuucuuuuggucacagagaaaggguacuuucucugucaaaucucaacuuagacuugacuucc

SEQ ID NO: 257837 - RNA, 62 nt, hsa
ucucuuccaucucuuuccccaaggcuccgugacugucaaacugggaguaggagaggggacaa

SEQ ID NO: 257838 - RNA, 62 nt, hsa
gccuuuacuuccgccucccucagagcagcagccugucaaaacaccagauuacaacaaauuua

SEQ ID NO: 257839 - RNA, 62 nt, hsa
uagaagagguuaguuuuauagacaggaaggggcugucaaaggcagaaagaaaugaagaacaa

SEQ ID NO: 257840 - RNA, 62 nt, hsa
cccauguaccuuuauugagcuuaauuauaauacugucaaauugccacgaucucacuaaagga

SEQ ID NO: 257841 - RNA, 62 nt, hsa
auuuggguaccauuuuaucacuguucaaagcacugucaaauuccuuucauccuuuaauaguu

SEQ ID NO: 257842 - RNA, 62 nt, hsa
aaauauguuaccugcaguguaaguacagcacacugucaaauucuuuuccuuaaggugcacag

SEQ ID NO: 257843 - RNA, 62 nt, hsa
guggaaggcaguuuuaacuuucugaagaauaucugucaaaauuuaagaaaacaaauguauaa

SEQ ID NO: 257844 - RNA, 62 nt, hsa
cgaucagcuguucauccauuucguguuuuuuccugucaaacauuaauccagcaaauauauga

SEQ ID NO: 257845 - RNA, 62 nt, hsa
uaaaauauuuucacggaauuaaaaguagcuugcugucaaagaaacaccugagaugaauuggu

SEQ ID NO: 257846 - RNA, 62 nt, hsa
ucuuauacccagaaaagaacauauuucagaaucugucaaacuuuuguguaucccacagauuc

SEQ ID NO: 257847 - RNA, 62 nt, hsa
agcuauuugagggacuaagggauggagauauucugucaaaugaaucucuucaguauaccagu

SEQ ID NO: 257848 - RNA, 62 nt, hsa
aguaauugcagaagcaguuggggugaagaaaacugucaaauaugaagcugcuggggaagcug

SEQ ID NO: 257849 - RNA, 62 nt, hsa
aauucuucaaaaaacacagcccacuuauccaucugucaaaaguucacaaugccauacaggcu

SEQ ID NO: 257850 - RNA, 64 nt, hsa
aauaaacauccuugaauuagaaguaugaagguuuguagguuaaaauuacuuuuauuugcaguaa

SEQ ID NO: 257851 - RNA, 64 nt, hsa
uuuuauuuuugaggcauguaauuuuaaaacugcaguagguuaaaauucuauuaaacaaauauag

SEQ ID NO: 257852 - RNA, 64 nt, hsa
uuugaucgauugcuaauuuucaaaggcuucuuagguagguuacuacaguaaacuguaacucagu

SEQ ID NO: 257853 - RNA, 64 nt, hsa
gacuaccauaacaaugcuuaugcuguuuccaaggguagguuauuuuucauuaaaagaagaauga

SEQ ID NO: 257854 - RNA, 64 nt, hsa
aacccaucuuucaauucaauuaaauuuaaauagccacauuuaacuccagccuuggguuugaccu

SEQ ID NO: 257855 - RNA, 64 nt, hsa
agguucauuugcauauacuuuuuuccaaauaaugcacauuuaauauguuuuaaaaugucuuauu

SEQ ID NO: 257856 - RNA, 64 nt, hsa
ggaguagacugguaugagaaaacuaugauuaguucacauuuacuggugcauccuugauccucuc

SEQ ID NO: 257857 - RNA, 64 nt, hsa
uguuuaaaaaaaagacuaaauauauuuaaaaggccacauuuauauuuuuuucacaagaaccaca

SEQ ID NO: 257858 - RNA, 64 nt, hsa
aaagugggggaagaaaguuuauagacuuuccaagcacauuuaugguuuuuuauuacuauuauua

SEQ ID NO: 257859 - RNA, 64 nt, hsa
aacaacuaauuacuaauuuuuaaagaacaaaucacacauuuaaaaaaucuguagaauuuauuuu

SEQ ID NO: 257860 - RNA, 64 nt, hsa
uuacaaguauuuguuuacuaugaaauuuuaaauacacauuuaugccuagaaggaacggacuuuu

SEQ ID NO: 257861 - RNA, 64 nt, hsa
ugaaaagaggaauauauaacucaauuuucacaaccacauuuaccaaaaaaagagaucaaauaua

SEQ ID NO: 257862 - RNA, 64 nt, hsa
auauccaugagcugcacugaucaccauguaaggucacauuuaguaaaugcugaaauaaaaugau

SEQ ID NO: 257863 - RNA, 64 nt, hsa
aaaaucaaaucauguacauuugaaaauauuugcacacauuuaaaaauaaauguaaaguugucuu

SEQ ID NO: 257864 - RNA, 64 nt, hsa
gauguggagucauguuuuguggggucuuccauggcacauuuaccuguugcuccguccagauguu

SEQ ID NO: 257865 - RNA, 64 nt, hsa
ucagaaaguaguuuguaauugauauuaaaaguggcacauuuaaaaauuuaaaaauugaagugca

SEQ ID NO: 257866 - RNA, 64 nt, hsa
gaaagaucuaacuggauauuuggguuaaaagaaucacauuuauucccaaaucggaaugcuuugu

SEQ ID NO: 257867 - RNA, 64 nt, hsa
gaccaagggcuugaaacauauuggauuacaugcucacauuuaacaaagagaggaaauguguuuc

SEQ ID NO: 257868 - RNA, 64 nt, hsa
guauacauauacacaaaugcacauauagaguuaacacauuuagugaacacuuguuuagugucac

SEQ ID NO: 257869 - RNA, 64 nt, hsa
aaggauugccccagguguccccuuucacgguugucacauuuacagugacuucuguugaacaccc

SEQ ID NO: 257870 - RNA, 64 nt, hsa
acucuaagucacuauaugaauaugacaauaugugcacauuuaaaauucagagcucggcauugug

SEQ ID NO: 257871 - RNA, 64 nt, hsa
ccugggaaccucgauauucugacauuuggaaaaacacauuuaauuuaucuccuguguuucauug

SEQ ID NO: 257872 - RNA, 64 nt, hsa
auuaauguuuccaguuaucaagauugugauuagacacauuuaccuuucuucauugaacaaaugg

SEQ ID NO: 257873 - RNA, 64 nt, hsa
guacaggaaaaacaucaucauuauuuccucuguucacauuuacuggucuuaauuaacagguaau

SEQ ID NO: 257874 - RNA, 64 nt, hsa
uagaauugggauguggauauuuacuguaugacaacacauuuacaguucuguaaugcaaggaugc

SEQ ID NO: 257875 - RNA, 64 nt, hsa
cucauuauuuggauggaaucucuuuggucaaaugcacauuuacagagagacacuauaaacaagu

SEQ ID NO: 257876 - RNA, 64 nt, hsa
cacacacacacacacacacacgugcacacacacacacauuuaaaugauauaaaaagaagagguu

SEQ ID NO: 257877 - RNA, 64 nt, hsa
augguauuacugaagguguguauacucccuaauacacauuuaugaaaaucuacuuguuuaggcu

SEQ ID NO: 257878 - RNA, 64 nt, hsa
acgagauacagaauuuuaugcggcauuuucuucucacauuuauauuuuugugauuuugugauug

SEQ ID NO: 257879 - RNA, 64 nt, hsa
ugaaaaaaagcuuuuuuugaaucaucaagucuuucacauuuaaauaaaguguuugaaagcuuua

SEQ ID NO: 257880 - RNA, 64 nt, hsa
gguagugauauuuucuuccacuuaccugcugaagcacauuuaugcauuucuuuauggcaaaacc

SEQ ID NO: 257881 - RNA, 64 nt, hsa
ucccuuaagaucacguuugucaaguguguauucacacauuuacuuaaaucaagggacucaaugc

SEQ ID NO: 257882 - RNA, 64 nt, hsa
cauacacacacacacacacacacgugcacacacacacauuuaaaggauauaaaaagaagagguu

SEQ ID NO: 257883 - RNA, 64 nt, hsa
augguauuacugaagguguguauacucccuaauacacauuuaugaaaaucuacuuguuuagacu

SEQ ID NO: 257884 - RNA, 64 nt, hsa
cuacuucauucccccuccauaaaguuucagccauuaugggcacugguuuuaaaaaauuuauuag

SEQ ID NO: 257885 - RNA, 64 nt, hsa
guggugggcggggguguuggccacuaggcaaugguaugggcagggcuucaccugacauuaugga

SEQ ID NO: 257886 - RNA, 64 nt, hsa
gacaauuuauucaacaccaacgagggacucaucauaugggcacaacucugguguccuucuaugg

SEQ ID NO: 257887 - RNA, 64 nt, hsa
aucucgaagaaaaaagaaaaaagagugguauuauuaugggcaaauaaucauauucccacuuaaa

SEQ ID NO: 257888 - RNA, 64 nt, hsa
cugcagcaacccauggagggcccagggugccugguaugggcaucaguuggugggggugcggggg

SEQ ID NO: 257889 - RNA, 64 nt, hsa
gaagaggcaagaugcauucaauuugaaagauauuuaugggcaacaaaguaaggucaggauuaga

SEQ ID NO: 257890 - RNA, 64 nt, hsa
uuuuuguucaaccucuuccugaggcccaagagcauaugggcaauucggauuuccugcuggacca

SEQ ID NO: 257891 - RNA, 64 nt, hsa
cacugugggucaggggaaugggaccagcaggacauaugggcaagcucugcaggacagacagaca

SEQ ID NO: 257892 - RNA, 64 nt, hsa
gaagccacucuuaagaguccaguuuguuuaauguuaugggcagcuaccaauuuguggugucucu

SEQ ID NO: 257893 - RNA, 64 nt, hsa
ggacuugucucuuacugcugaccagucugugcuuuaugggcagagaugagacccaggcccgugu

SEQ ID NO: 257894 - RNA, 64 nt, hsa
cacuguugaauaucuuugaacuugcuguuuucaauaugggcagcacaaaggugagagauacaua

SEQ ID NO: 257895 - RNA, 64 nt, hsa
aaucacauuaugaaacugggaaagucugaaggaauaugggcaaaauauuucucaguaaagcuuc

SEQ ID NO: 257896 - RNA, 64 nt, hsa
ucuggcaguugaaaauugugggaaagagaauuuguaugggcacuguaucuaugaaauaccucau

SEQ ID NO: 257897 - RNA, 64 nt, hsa
cuuagccucuguuugccacucuggguaucucuccuaugggcaaagccauuagaaaugcauaaaa

SEQ ID NO: 257898 - RNA, 64 nt, hsa
ugguaguaucuauauugcuuuagugaacacagaguaugggcacggcuaugcuaacuugacaaaa

SEQ ID NO: 257899 - RNA, 64 nt, hsa
uugcaaagaacuaaggugaguauagccuacuagauaugggcaauauccagccuagaugauugga

SEQ ID NO: 257900 - RNA, 64 nt, hsa
cuuuuucaucaaaaccuacccuguccuagagaucuaugggcauuugguggaugauaaugagcag

SEQ ID NO: 257901 - RNA, 64 nt, hsa
ccgcuucagaugacagauguuguaagagaagguuuaugggcauccucucuggucuuuuggauua

SEQ ID NO: 257902 - RNA, 64 nt, hsa
uuuagaaggagaaacuuaaguguggaaugcauuauaugggcaaagaagcuaugaagauacauga

SEQ ID NO: 257903 - RNA, 64 nt, hsa
acacuaauucuuuauauuauagaaccaacggaaauaugggcacuauuuugaauucuagagaugg

SEQ ID NO: 257904 - RNA, 64 nt, hsa
aaagcuguuguaaacaucuuugugcagguuuuucuaugggcauguuuuuaauucauuugaauaa

SEQ ID NO: 257905 - RNA, 64 nt, hsa
acccuccucccugcuucuucccuugugccucauguaugggcaggaggaaaggugggagggggag

SEQ ID NO: 257906 - RNA, 64 nt, hsa
cauuucucauuuucccaacuuuuauaugauugucuaugggcaguuugaauuucugguuuucaau

SEQ ID NO: 257907 - RNA, 64 nt, hsa
uucuucuuuuuguagacuuugggcccacguguuuuaugggcauugauacauauauaaauauaua

SEQ ID NO: 257908 - RNA, 64 nt, hsa
guagauauuaauuuuuuccucggcuguaaaaugcuaugggcaacacaaucaugcaauuauaauu

SEQ ID NO: 257909 - RNA, 64 nt, hsa
gagggagcacagaagucguggccugaggcuguucuaugggcacuuggggcuaaaucgccuccug

SEQ ID NO: 257910 - RNA, 64 nt, hsa
cgaagccacagagucucucccuggagcagcagacuaugggcagcccagugcugccaccugcuga

SEQ ID NO: 257911 - RNA, 64 nt, hsa
ggcccacuuuauucugaggaauacagugagcagauaugggcagcagccagguagggcaaagggg

SEQ ID NO: 257912 - RNA, 64 nt, hsa
aaaguaaauuuagauaaaauacagcuuuuuuccuuaugggcauuuguuuuguuucaagucauca

SEQ ID NO: 257913 - RNA, 64 nt, hsa
cugguucaaaguacaauucaagaaacugaguauuuaugggcauugaagaaaaaauguugagaua

SEQ ID NO: 257914 - RNA, 64 nt, hsa
uaacaggauuggcguccguuacaucuagaacuucuaugggcaucauuauuguuggaggaguggu

SEQ ID NO: 257915 - RNA, 64 nt, hsa
cugccguugccgccacugcugccauugcugugguuaugggcauuuagaaaacuugaaagucagc

SEQ ID NO: 257916 - RNA, 64 nt, hsa
uccacucgcuugccugcccuggccaccugaacuguaugggcacucucagcccugguuuuucaau

SEQ ID NO: 257917 - RNA, 64 nt, hsa
gaucacccuccucagccucccaaaaugcugggacuaugggcaugagccccugcgccugaccuuc

SEQ ID NO: 257918 - RNA, 64 nt, hsa
augcccaagcucaagaacgacugcaacacuacuuuaugggcagggcccuagaagagcgagccca

SEQ ID NO: 257919 - RNA, 64 nt, hsa
cagcccccgagaggggacuuggcugggccuuuccuaugggcaaggcccagugcucuuccugccc

SEQ ID NO: 257920 - RNA, 64 nt, hsa
aucagauuauaguuuagaauauuugcguauuaauuaugggcaagcacacaccuucugaauagaa

SEQ ID NO: 257921 - RNA, 64 nt, hsa
agacaaacauuuguccuaauagcuuucucauaaauaugggcaccacuuuacauugugguaagac

SEQ ID NO: 257922 - RNA, 64 nt, hsa
gaguugccgcaagucugaauggcgccaucaaacuuaugggcagggauaacagugugccugguua

SEQ ID NO: 257923 - RNA, 64 nt, hsa
cuucuaaugacaaaacugugagagcuagauguccuaugggcaauuagguaguauaauaaaggua

SEQ ID NO: 257924 - RNA, 64 nt, hsa
accagaugguguauuuccaaaugggccucucugguaugggcaauaggcaagcuccuggggucug

SEQ ID NO: 257925 - RNA, 64 nt, hsa
ggcugauugagacugcaacaacuacaucuauauuuaugggcaauauuuuguuuuacuuaugugg

SEQ ID NO: 257926 - RNA, 64 nt, hsa
aacuagguuuuaauaauuuuuuaauugauguuguuaugggcaggauggcaaccagaccauuguc

SEQ ID NO: 257927 - RNA, 64 nt, hsa
cagauauaaauccaguaagcuauuuuuuucuaccuaugggcaaguucauaagucauugcuggau

SEQ ID NO: 257928 - RNA, 64 nt, hsa
aaauuuggauagaaaggagauguaguuuauuucauaugggcaaaguaguccucuuccaaagucc

SEQ ID NO: 257929 - RNA, 64 nt, hsa
gaaauauauaauaauagcauuuuauguaauaaaauaugggcaacgauuaucuuggaaauuaaag

SEQ ID NO: 257930 - RNA, 64 nt, hsa
guguccguaugcaggcaugccuguguauacuguguaugggcacacugggacuagcugggacaau

SEQ ID NO: 257931 - RNA, 64 nt, hsa
ggacugacccacauggacugggaugugugucgguuaugggcaugacugcacguucacucucagu

SEQ ID NO: 257932 - RNA, 64 nt, hsa
aaaacaaagcauuaaaaaaaaagccuaucaguauuaugggcaauauguaaauaaauaaauguaa

SEQ ID NO: 257933 - RNA, 64 nt, hsa
agaaauguguguagugcuuuuguuaaagccccuauaugggcagcauggaggaucauaagauagc

SEQ ID NO: 257934 - RNA, 64 nt, hsa
acccuuaaagauacaguguucaguauuauugaaauaugggcaucugcaacacauacccccuauu

SEQ ID NO: 257935 - RNA, 64 nt, hsa
uugugaauagucuuuuacauuuuuguaugcugaauaugggcaccaaagaaccuguaaaaguuau

SEQ ID NO: 257936 - RNA, 64 nt, hsa
auauuuucccaguaauugaaauuggaaaggaacuuaugggcauauuacuggagcaucugcagug

SEQ ID NO: 257937 - RNA, 64 nt, hsa
uuuagugcgcugugcuuuguauaaguggucuuucuaugggcaguuucaccuuccaugaaggcuu

SEQ ID NO: 257938 - RNA, 64 nt, hsa
ugacucuggagcacuggguugucuccauugucauuaugggcagaugugugccauccccagccga

SEQ ID NO: 257939 - RNA, 64 nt, hsa
ucucauuguuauaauuggggaggggguggauaacuaugggcaguuugcccuuuucugcaucaaa

SEQ ID NO: 257940 - RNA, 64 nt, hsa
uaaaauaguaaauuucaauguuaagugucugcuuuaugggcauauauaaaaguagacacauuuc

SEQ ID NO: 257941 - RNA, 64 nt, hsa
aagaaccuaaaaugauugacucauucauaguaaauaugggcauguaaacuaauaaauaugcacu

SEQ ID NO: 257942 - RNA, 64 nt, hsa
cuugguaggaauucaguugggcaaugauaacuuuuaugggcaaaaacauucuauuauagugaac

SEQ ID NO: 257943 - RNA, 64 nt, hsa
auugacggggagauagcgccugaaauaaacaaaauaugggcaugcaugcuaaagggaaaaugug

SEQ ID NO: 257944 - RNA, 64 nt, hsa
gaaggggggcuccuucccucuccucgaaugacguuaugggcacaugccuuuuaaaaguucuuua

SEQ ID NO: 257945 - RNA, 64 nt, hsa
augcuggagcccagcacucacacuuaauuauauuuaugggcaaaguaaaaagaaucaugccuua

SEQ ID NO: 257946 - RNA, 64 nt, hsa
agccuugugguuucacacuaaagaguuuccuuguuaugggcaacaugcaugaccuaaugucuug

SEQ ID NO: 257947 - RNA, 64 nt, hsa
ucaaaauguaauuuuccccuaauaaaauuauggauaugggcagucaucaauggcugccaaaacc

SEQ ID NO: 257948 - RNA, 64 nt, hsa
aguagaacguggcucaacuagauaucuuuauauguaugggcauuacucuuagugauauuuguuu

SEQ ID NO: 257949 - RNA, 64 nt, hsa
auaccucagccagucuuaugaauaggaggcuauguaugggcagggaauagauuagauuagaaca

SEQ ID NO: 257950 - RNA, 64 nt, hsa
uuuggcagggaguggggaugagauuugacaccaauaugggcaaaauuagauaaccuuuugguua

SEQ ID NO: 257951 - RNA, 64 nt, hsa
auaagcauauuuccauuuuuauuacugaaagaaauaugggcauuuucauucuuuaaagaaauaa

SEQ ID NO: 257952 - RNA, 64 nt, hsa
gauguaauuuuuuuuaaaaaaguccaaaagcagcuaugggcaguugacaaaagaaaauguaaug

SEQ ID NO: 257953 - RNA, 64 nt, hsa
gcagacugauucauuaaaauugugcauacgauuuuaugggcagcugaugaucuaggugaaaaau

SEQ ID NO: 257954 - RNA, 64 nt, hsa
aguuacacuccaaggucauuggagagaacuucuguaugggcaagccugagagggagaggaaaca

SEQ ID NO: 257955 - RNA, 64 nt, hsa
uuucaggaguguuaagcaacauccuguucagcuguaugggcacuagucccuuacagaugaccau

SEQ ID NO: 257956 - RNA, 64 nt, hsa
ucuuaauaggugucuaagaaugucagggcaaaaguaugggcauuuuucuugcuauguucagaaa

SEQ ID NO: 257957 - RNA, 64 nt, hsa
uuuuggggagugauauuuuaaaaaauaaguugucuaugggcacaaaguuuucuucauuugugua

SEQ ID NO: 257958 - RNA, 64 nt, hsa
uaaguuggugucguaacuccaggccacagugaguuaugggcaaagcuuuuuuccuuaagcauca

SEQ ID NO: 257959 - RNA, 64 nt, hsa
agcugugguucuugaaaacacauccuacauugcauaugggcauagcaguuuuugacccaggcag

SEQ ID NO: 257960 - RNA, 64 nt, hsa
ucacccgaacagaggacaacccugagguguggcauaugggcaccuggcacugggagucggggga

SEQ ID NO: 257961 - RNA, 64 nt, hsa
ugcaaggaagacccggcuuugcccucacaagucuuaugggcaccacagggaacauccuggacuu

SEQ ID NO: 257962 - RNA, 64 nt, hsa
ggcgauuugugucuaaggauacgauuuugaaccauaugggcaguguacaaaauaugaaacaacu

SEQ ID NO: 257963 - RNA, 64 nt, hsa
ggguaucacacauuucucaccaggccuccuuuccuaugggcauuggugccucccagagguuucu

SEQ ID NO: 257964 - RNA, 64 nt, hsa
cugcgggugacccccagcauauuucuagguuacuuaugggcagauuuguaagugacaaaacucc

SEQ ID NO: 257965 - RNA, 64 nt, hsa
gagguaguuuugaauggcauuucauuaaggcaucuaugggcauuaugagcuaaaagcuguggua

SEQ ID NO: 257966 - RNA, 64 nt, hsa
guaugaagcauggagaagcagccauuguccccacuaugggcagaggggggacccggcuggcccc

SEQ ID NO: 257967 - RNA, 64 nt, hsa
aguguuugcuuucaaaugccauggguuacacuuuuaugggcaugacuauaaccauuuuuguaaa

SEQ ID NO: 257968 - RNA, 64 nt, hsa
ggcacggggugucaggagggagagacagccuggguaugggcaagaaaugacuguaaauauuuca

SEQ ID NO: 257969 - RNA, 64 nt, hsa
cacccagcaaaucccucucuaccucccaaggugauaugggcagcugcccaccacuccagaggua

SEQ ID NO: 257970 - RNA, 64 nt, hsa
ggcugagagaagaaggaagaaucagcccagcagguaugggcaucugggaaaccuccagccucaa

SEQ ID NO: 257971 - RNA, 64 nt, hsa
ucccccagaaucgacauaguccagaccacccagguaugggcagcucccaggccagcagcagcag

SEQ ID NO: 257972 - RNA, 64 nt, hsa
guugauguggauggcacuccugcucuccaucuuuuaugggcagagagauuucaaaaccugagca

SEQ ID NO: 257973 - RNA, 64 nt, hsa
uuucaagacacaagauuuugaaaacucacugaauuaugggcaaaaccaugacuuucauugggca

SEQ ID NO: 257974 - RNA, 64 nt, hsa
aucagaauuucaauccacauuagaaaaguuuuuauaugggcaacuuuaugcgaaauccaaauca

SEQ ID NO: 257975 - RNA, 64 nt, hsa
cuuaauuguugaaagagauauguagaaggcacaauaugggcacuuuaaaugaagcuaauaauuc

SEQ ID NO: 257976 - RNA, 64 nt, hsa
gagaaacacuggcauggauuugcacuaggauguauaugggcaaagcuaucuuccccaaguggaa

SEQ ID NO: 257977 - RNA, 64 nt, hsa
auuccaugccccucuccuaguggucaugguuucauaugggcauacaacugcuacugaaguuaua

SEQ ID NO: 257978 - RNA, 64 nt, hsa
cacauuggauggcagcauggguuucuucccauuuuaugggcaugaaauaugugguuuagaauaa

SEQ ID NO: 257979 - RNA, 64 nt, hsa
caaagaagacauguuuuagacaaauacucauguguaugggcaaaaaacucgaggacuguauuug

SEQ ID NO: 257980 - RNA, 64 nt, hsa
agagauucucaaaugagaaaaagggcuccggcuauaugggcaacaaagagggaagauacagguu

SEQ ID NO: 257981 - RNA, 61 nt, hsa
aggccugugggugcaguuagucuaugugugguaugggcagcccaagguugcaugggaaaac

SEQ ID NO: 257982 - RNA, 64 nt, hsa
cauagaccauucuugaccaagcaagcaugcacauuaugggcaguuacauucucaaguuuuuaaa

SEQ ID NO: 257983 - RNA, 64 nt, hsa
agguuucaaagauguagcuagcauuuugaaaccauaugggcaaaacccggcaaccagaagggga

SEQ ID NO: 257984 - RNA, 64 nt, hsa
aucuuucaucacuaaaaauuuguuccuuuuucacuaugggcaguucacacaaggcaaaaacuau

SEQ ID NO: 257985 - RNA, 64 nt, hsa
uuuugugaagcaacuauuuauuugaagaccaggguaugggcacuuuugccuucucuccucucug

SEQ ID NO: 257986 - RNA, 64 nt, hsa
guaguaguacuugaaaucuaggauuauuaacuaauaugggcauuguaguuaaugaugguugaug

SEQ ID NO: 257987 - RNA, 64 nt, hsa
cauugucucuugacaucagaaguuacaauaggcauaugggcaaaaugguguagcaggcucacug

SEQ ID NO: 257988 - RNA, 64 nt, hsa
ucaggauugacuuuuuucuccaaaaccauacauuuaugggcaaauuguguucuuuaucacuucc

SEQ ID NO: 257989 - RNA, 64 nt, hsa
agcucuugaggcuggaucuuucuacuugugccacuaugggcacuaggucuguaggucccuggug

SEQ ID NO: 257990 - RNA, 64 nt, hsa; identical to SEQ ID NO: 257979

SEQ ID NO: 257991 - RNA, 64 nt, hsa
gugugcguuuuuacagcccuuuuuaggaacccaauaugggcauaaauguaacaccuguagcggg

SEQ ID NO: 257992 - RNA, 64 nt, hsa
uuucaaaaugaaauuccauauaugugcaaacagauaugggcaccacgaaauacauaugcagugc

SEQ ID NO: 257993 - RNA, 64 nt, hsa
aaaccacucccaguccccagcccuucacauuuuuuaugggcauugacaaaucuguguauauuau

SEQ ID NO: 257994 - RNA, 64 nt, hsa
uacaaaaggugaacagcaaaaucaagcacugcuuuaugggcaggaacacaagagaaagcaaacu

SEQ ID NO: 257995 - RNA, 64 nt, hsa
gauacgaagcaaaccugggauugcuucuuccagguaugggcaccagagagggaagccacugcaa

SEQ ID NO: 257996 - RNA, 64 nt, hsa
uucuauucaaaucauauuugguuucaggccccuuuaugggcauacgguaacagaaaccuccauc

SEQ ID NO: 257997 - RNA, 64 nt, hsa
ugaguaacuguuguuuugcaaggauuuguaggguuaugggcaguuguuguuugaagcauugcua

SEQ ID NO: 257998 - RNA, 64 nt, hsa
guuucuuccugugaguuccauuauuucuaucucuuaugggcaaagcauuguggguaauuggugc

SEQ ID NO: 257999 - RNA, 64 nt, hsa
ccuuucuaggaccuaugaguggaaugggcaugaauaugggcauggaugggcaauggcacuacau

SEQ ID NO: 258000 - RNA, 64 nt, hsa
gguguuagguuuugucaagugauuuuucugugucuaugggcaugaucaugugguuuugucgugu

SEQ ID NO: 258001 - RNA, 64 nt, hsa
cuugagguuugguuuucauuauuaauuuuuaggguaugggcacugugcaaagacuccauagcug

SEQ ID NO: 258002 - RNA, 64 nt, hsa
auuucacacuuuaaugauaauauuccacauagucuaugggcaaauauuuucaacauuuccaauu

SEQ ID NO: 258003 - RNA, 64 nt, hsa
uaaaaguaccaaacauaacccagaguauguggaauaugggcaacauauauauagccuucuguau

SEQ ID NO: 258004 - RNA, 64 nt, hsa
uauagaaaacaggggcugcuuuuuaaacucucacuaugggcacuuuaccaaaauacuuccauau

SEQ ID NO: 258005 - RNA, 64 nt, hsa
aaccacuguaccugccucagucaggccugcccacuaugggcagaccucucgcucagccugcaga

SEQ ID NO: 258006 - RNA, 64 nt, hsa
cugcuuucucugucuagaacagacgggugacaaguaugggcaggaggcauggggcaggguggcc

SEQ ID NO: 258007 - RNA, 64 nt, hsa
ccagcugccugcaggaagaucuggcucagucuacuaugggcagggccccccaccaagcugagcc

SEQ ID NO: 258008 - RNA, 64 nt, hsa
ugacuacucuuaugauagcugaugccacagagccuaugggcaaaugccagacccaggguuagac

SEQ ID NO: 258009 - RNA, 64 nt, hsa
uccagagaauugcuuuuguaaaugcuccacaacguaugggcaaaaguuuaaggacuacugccug

SEQ ID NO: 258010 - RNA, 64 nt, hsa
cagcacccugcgggcccggggucuggcagagugguaugggcaccccaccccugggcuggggcca

SEQ ID NO: 258011 - RNA, 64 nt, hsa
acugaaugauacuacacaguccucucccuauuaauaugggcacauucuugccaauuucacacuu

SEQ ID NO: 258012 - RNA, 64 nt, hsa
gguuuggcuuggcaugaaaauacuucauucagaguaugggcaaaugcuucuggaaaacccuucc

SEQ ID NO: 258013 - RNA, 64 nt, hsa
ugccauccccaaauagcuaggaucacacuccaaguaugggcagugauggcgcucugggggccac

SEQ ID NO: 258014 - RNA, 51 nt, hsa
ugguaaauaauuccacagaaauaugggcaaaagcuuaucauuaucaacaaa

SEQ ID NO: 258015 - RNA, 64 nt, hsa
ccauuguuugugggagaauuauacuugacugaauuaugggcaggagaaagagcagauuccuuuu

SEQ ID NO: 258016 - RNA, 64 nt, hsa
uuaccagggcuuaaauguugugucuagaauuaaguaugggcauaaacuggcuucugaaucccuu

SEQ ID NO: 258017 - RNA, 64 nt, hsa
cccaggagcccagccccggcugugccaucuuguguaugggcagauaugaccugacagcccccuc

SEQ ID NO: 258018 - RNA, 64 nt, hsa
cacgagcaugucacagugccgcagagauuuuguuuaugggcaguuucucauggccuguuuaugu

SEQ ID NO: 258019 - RNA, 64 nt, hsa
uacucccugggcaccucggccuggucccagcagguaugggcaguugcuugaggcuccagacaua

SEQ ID NO: 258020 - RNA, 64 nt, hsa
gcucaucauaaauuauccaagagaagcacaaaguuaugggcacaaagguuuuccauauaauauu

SEQ ID NO: 258021 - RNA, 64 nt, hsa
gccaguacugucugcccauuggcuccaggggcuguaugggcagauucagucuccagaggguauu

SEQ ID NO: 258022 - RNA, 64 nt, hsa
uuuaucugucuuuuguucacuuuuuaaugcuauauaugggcaggggugagagacauuacugagc

SEQ ID NO: 258023 - RNA, 64 nt, hsa
auccacccaccuuggccuuccaaaguggugggauuaugggcaggagccuccgugcccaggcugc

SEQ ID NO: 258024 - RNA, 64 nt, hsa
ggcccucaggaaggaggucuuuguuuguaggauguaugggcaaagcuuuugugaucacacacca

SEQ ID NO: 258025 - RNA, 64 nt, hsa
caugcuucagugacauugucaacaggaguccaauuaugggcagaaucugcucucugugaccaaa

SEQ ID NO: 258026 - RNA, 64 nt, hsa
ccuggcccucgggacacauugucugccccggggcuaugggcaaaugccccuccuucuuacuucc

SEQ ID NO: 258027 - RNA, 64 nt, hsa
gggacccugaucugggccuuccugucccagggccuaugggcaacugcguugaaaggacguucgc

SEQ ID NO: 258028 - RNA, 64 nt, hsa
cuguauggagaccuuggaccagcaggggaagaucuaugggcaugggaggugggcguuggaaagg

SEQ ID NO: 258029 - RNA, 64 nt, hsa
ggugaggucaggugccucccagcccugcccagaguaugggcacucaggugugggccgaaccuga

SEQ ID NO: 258030 - RNA, 64 nt, hsa
cucccuguccacaacugcagccgggcccucugccuaugggcacccaauccaagcagcugcucca

SEQ ID NO: 258031 - RNA, 64 nt, hsa
cuuguaggaguauaggccggucuaaagugagcucuaugggcagaucuaccccuuacuuauuauu

SEQ ID NO: 258032 - RNA, 64 nt, hsa
uuccauguggaacaaacauuuaucagaugccuauuaugggcauaugucucugcuaagcaccaua

SEQ ID NO: 258033 - RNA, 64 nt, hsa
gaauacaccuggcacccuggcuaccagaauuucauaugggcagaauaauauugugucaaacucu

SEQ ID NO: 258034 - RNA, 62 nt, hsa
cagaggugccuuugaugguggucucaccugcggagccgcacucuuuagccccggagcuccag

SEQ ID NO: 258035 - RNA, 62 nt, hsa
uccggacgcugaagcugccguugccgcguguggagccgcagccuuucccccuggacuggccu

SEQ ID NO: 258036 - RNA, 62 nt, hsa
cugcgcugcagugagaccugggugaaaaucaggagccgcacacagccacaucuuccuagacc

SEQ ID NO: 258037 - RNA, 62 nt, hsa
gucucuuugugucccccacuguagaggacggugagccgcagcugcaucaaccuccuuuuacc

SEQ ID NO: 258038 - RNA, 64 nt, hsa
cccuaccacacucccaguaauugcaacugcucacaugagucaaaauacagcucauuacccuagc

SEQ ID NO: 258039 - RNA, 64 nt, hsa
cagcucauuacccuagcccagugauuguuuaugcaugagucagucaaggguuucuuccuguucu

SEQ ID NO: 258040 - RNA, 64 nt, hsa
acaaaauuauccaguugucugauuuuggaauucuaugagucaaucuuuuuggcagaauucagaa

SEQ ID NO: 258041 - RNA, 64 nt, hsa
ggagauucuuuuucccuuuuagacuuccaucugaaugagucagucaccaggguauucugcauag

SEQ ID NO: 258042 - RNA, 64 nt, hsa; identical to SEQ ID NO: 184076

SEQ ID NO: 258043 - RNA, 64 nt, hsa; identical to SEQ ID NO: 184077

SEQ ID NO: 258044 - RNA, 64 nt, hsa; identical to SEQ ID NO: 184078

SEQ ID NO: 258045 - RNA, 64 nt, hsa; identical to SEQ ID NO: 184079

SEQ ID NO: 258046 - RNA, 64 nt, hsa; identical to SEQ ID NO: 184080

SEQ ID NO: 258047 - RNA, 64 nt, hsa; identical to SEQ ID NO: 184081

SEQ ID NO: 258048 - RNA, 64 nt, hsa; identical to SEQ ID NO: 184082

SEQ ID NO: 258049 - RNA, 64 nt, hsa; identical to SEQ ID NO: 184083

SEQ ID NO: 258050 - RNA, 64 nt, hsa; identical to SEQ ID NO: 184084

SEQ ID NO: 258051 - RNA, 64 nt, hsa; identical to SEQ ID NO: 184085

SEQ ID NO: 258052 - RNA, 64 nt, hsa; identical to SEQ ID NO: 184086

SEQ ID NO: 258053 - RNA, 64 nt, hsa; identical to SEQ ID NO: 184087

SEQ ID NO: 258054 - RNA, 64 nt, hsa; identical to SEQ ID NO: 184088

SEQ ID NO: 258055 - RNA, 64 nt, hsa; identical to SEQ ID NO: 184089

SEQ ID NO: 258056 - RNA, 64 nt, hsa; identical to SEQ ID NO: 184090

SEQ ID NO: 258057 - RNA, 64 nt, hsa; identical to SEQ ID NO: 184091

SEQ ID NO: 258058 - RNA, 63 nt, hsa; identical to SEQ ID NO: 57603

SEQ ID NO: 258059 - RNA, 64 nt, hsa; identical to SEQ ID NO: 57604

SEQ ID NO: 258060 - RNA, 64 nt, hsa; identical to SEQ ID NO: 57605

SEQ ID NO: 258061 - RNA, 64 nt, hsa; identical to SEQ ID NO: 57606

SEQ ID NO: 258062 - RNA, 64 nt, hsa; identical to SEQ ID NO: 57607

SEQ ID NO: 258063 - RNA, 64 nt, hsa; identical to SEQ ID NO: 57608

SEQ ID NO: 258064 - RNA, 64 nt, hsa; identical to SEQ ID NO: 57609

SEQ ID NO: 258065 - RNA, 64 nt, hsa; identical to SEQ ID NO: 57610

SEQ ID NO: 258066 - RNA, 64 nt, hsa; identical to SEQ ID NO: 57611

SEQ ID NO: 258067 - RNA, 64 nt, hsa; identical to SEQ ID NO: 57612

SEQ ID NO: 258068 - RNA, 64 nt, hsa; identical to SEQ ID NO: 57613

SEQ ID NO: 258069 - RNA, 64 nt, hsa; identical to SEQ ID NO: 57614

SEQ ID NO: 258070 - RNA, 64 nt, hsa
aagucaggguuggcuugugaaaaguuguuaaacaacaugcuaaaugugaaauguuaacccucua

SEQ ID NO: 258071 - RNA, 64 nt, hsa
accuaauuuucaguaagaagugauuaaaauaaugacaugcuaaaaggcaaauuucaagggaaga

SEQ ID NO: 258072 - RNA, 64 nt, hsa
aagagaaccuucuuuuucucuugacuuugacagcacaugcuaaaaaucucuuccaagaaguaug

SEQ ID NO: 258073 - RNA, 64 nt, hsa
guuuuagaauuucagauaguacuugcucagaaguacaugcuacucaagauauuaagagauaaca

SEQ ID NO: 258074 - RNA, 64 nt, hsa
uuuuaggacauguacaugaaacagugaaaaugagauccaccaacaucuuuuauuaaguucaguu

SEQ ID NO: 258075 - RNA, 64 nt, hsa
gacaguagaugagucugguuaagcgaggucagacauccaccagaaucaacucagccucaggcau

SEQ ID NO: 258076 - RNA, 64 nt, hsa
agagauaagaggacagaagaauggagaugggaaaauccaccaaauuccaacccaaacccaacuu

SEQ ID NO: 258077 - RNA, 64 nt, hsa
ggagaagaggcagggucaggccucagcaucucacauccaccaccuccaggaggggagaccacug

SEQ ID NO: 258078 - RNA, 64 nt, hsa
caccaagauaccagacauuugagugaaauuuuggauccaccagaccagccaccagcuaaaugcc

SEQ ID NO: 258079 - RNA, 64 nt, hsa
gggagaggcaccugcugaacccugucuucuugacauccaccaagauaccagacauuugagugaa

SEQ ID NO: 258080 - RNA, 62 nt, hsa
auaaagcaaauuuggaggaaacaacugaaguugugcaauauuuucugauaauugcuuuuuuu

SEQ ID NO: 258081 - RNA, 62 nt, hsa
uagaccccucuuccucucucccccaccauagugugcaauaaagugucuguucuuaccaaacc

SEQ ID NO: 258082 - RNA, 62 nt, hsa
ugccguguaugaggagugcuagaaaaugcaaagugcaauauuuucccuaaccuucaaaugug

SEQ ID NO: 258083 - RNA, 62 nt, hsa
gaccaagcaucuaucugauagaagcacauggagugcaauaggacauugugagaaggaauuuu

SEQ ID NO: 258084 - RNA, 62 nt, hsa
cguauuuucuaggacaagaguucucagucacugugcaauaugcccccugggucccaggaggg

SEQ ID NO: 258085 - RNA, 62 nt, hsa
gucucaguacaauccaaauuugucguagacuugugcaauauauacuguuguggguuggagaa

SEQ ID NO: 258086 - RNA, 62 nt, hsa
uugugaugccuucccuccccuagaaagauuuugugcaauauauuaaauggggacagaauucu

SEQ ID NO: 258087 - RNA, 62 nt, hsa
cucaguaagacagugcagugcucaguaaggcagugcaauacucaguaacaguguaguacuca

SEQ ID NO: 258088 - RNA, 62 nt, hsa
aguacucaggaaugcagcacaguacucaggcagugcaauacucagugcgguacucaguaaca

SEQ ID NO: 258089 - RNA, 62 nt, hsa
gaaauaauagggcauuuaacaaagaucgcuaugugcaauacuguauuuaguguuucuauuuc

SEQ ID NO: 258090 - RNA, 62 nt, hsa
ccuuuugcuggggcugccaucuugaaaucugagugcaauaggauuugcuuguaacaguuauu

SEQ ID NO: 258091 - RNA, 62 nt, hsa
uccccuugucccuggggcacucccccaggauugugcaauagucagagugucccuuuuugcag

SEQ ID NO: 258092 - RNA, 62 nt, hsa
aagaauagaccaugggcuacuacugggcauuagugcaauauaacagcgauaauaaaauucuc

SEQ ID NO: 258093 - RNA, 62 nt, hsa
aaauugaauuuucuucagacaaaacugcucuugugcaauauuuuaugcucagugagcaaauu

SEQ ID NO: 258094 - RNA, 62 nt, hsa
aaauagguuaaaucuuauauaaauauuacuuugugcaauauuguuguguaguuaaaugcaua

SEQ ID NO: 258095 - RNA, 62 nt, hsa
uucuaagaccagauucucuaauguuucugggugugcaauagagugaucacaucuuuguuucu

SEQ ID NO: 258096 - RNA, 61 nt, hsa
uggcauaucuaauaagauagccuuacuguaagugcaauaguugacuuuuaaccaaccacca

SEQ ID NO: 258097 - RNA, 62 nt, hsa
ucaguugagauuaaaaguaaggaacagagaaugugcaauaccgucuggcugggggcuguccc

SEQ ID NO: 258098 - RNA, 62 nt, hsa
cggggugggggugagggccccugcaauucacggugcaauauucaccaguuuugcccucugcc

SEQ ID NO: 258099 - RNA, 62 nt, hsa
cucccuuccccaguuuuucucuaagauauacagugcaauagcuccccaccccucaguugacg

SEQ ID NO: 258100 - RNA, 62 nt, hsa
aacugaccauuauaugccuucacuggcuucuugugcaauaauaugauguuuuaagugugcaa

SEQ ID NO: 258101 - RNA, 62 nt, hsa
gaaaauaugcagaauaacuggucuuguuaagagugcaauauuauauuuuuauguaaaaauaa

SEQ ID NO: 258102 - RNA, 62 nt, hsa
aaaggcacauaguuuaaaaaguuucucauuuugugcaauauaaucuaaauaaaguacagacc

SEQ ID NO: 258103 - RNA, 62 nt, hsa
aaucaguuaagauaaagcugcauuguauauaagugcaauauauuuuugaaggucuguaaaug

SEQ ID NO: 258104 - RNA, 62 nt, hsa
ugcuggggcugacuuguccagaaggggacaaagugcaauacagagccuucccuacccugacg

SEQ ID NO: 258105 - RNA, 62 nt, hsa
gucuaugaaagaauaauuauaauaauguccaggugcaauacucuguaagucuauugguucaa

SEQ ID NO: 258106 - RNA, 62 nt, hsa
guuucuugaauauauauuuuugaaguuuuuuugugcaauauauuacuaaaucaguuauuauu

SEQ ID NO: 258107 - RNA, 62 nt, hsa
gaagagaaucccaaaaguuaguucaucuuaaagugcaauauuguuuaaucuuaaaacugggc

SEQ ID NO: 258108 - RNA, 62 nt, hsa
ugcuauguugauguguaagugaaaucaguugugugcaauagacaggggcguauucaugggag

SEQ ID NO: 258109 - RNA, 62 nt, hsa
gggacaucaucucuuccaucuuuggguccuuagugcaauaccuggcagcuagccagugcuca

SEQ ID NO: 258110 - RNA, 62 nt, hsa
ccugguuacaacuugcugguggguuuuauguugugcaauacuaggaggaggaggcaggugau

SEQ ID NO: 258111 - RNA, 62 nt, hsa
gucuugaugugcauagcuucugauaacccugugugcaauaauaugauuugcagggcauuucu

SEQ ID NO: 258112 - RNA, 62 nt, hsa
acucaacagauguagugugacaaguauaauaugugcaauaaucauuguuucucuuaugauuu

SEQ ID NO: 258113 - RNA, 62 nt, hsa
cucaacccaaauccaccuucauacuguaaguagugcaauacuuguuucauuucuguguuuaa

SEQ ID NO: 258114 - RNA, 62 nt, hsa
guuucaacggaaagugcugucuuaaacuaaaugugcaauagaaggugauguugccauccuac

SEQ ID NO: 258115 - RNA, 62 nt, hsa
cuuaaaacacugaccucuaugagguauuuacugugcaauaacugauucauuuuuuucagagc

SEQ ID NO: 258116 - RNA, 62 nt, hsa
gaaucuuugauguuuuuugucauuguucucaagugcaauauaacaauguaaccaaaucuaga

SEQ ID NO: 258117 - RNA, 62 nt, hsa
cauucagauagcaguaaaacauucuguaugaugugcaauaaaacauccaagaucuuuuuuga

SEQ ID NO: 258118 - RNA, 62 nt, hsa
uggacaucuuuucucuuguguuuuguuugaaugugcaauaguuuauaggccacaaauaagcu

SEQ ID NO: 258119 - RNA, 62 nt, hsa
aacuccuguccccuuagucaugagaacagaaagugcaauauuuccuuucaccuggcagggga

SEQ ID NO: 258120 - RNA, 62 nt, hsa
auggugucuaacgagcagugcaauauuaggcggugcaauagaggcccuguuggcaagaugag

SEQ ID NO: 258121 - RNA, 62 nt, hsa
acauggauaagugagauggugucuaacgagcagugcaauauuaggcggugcaauagaggccc

SEQ ID NO: 258122 - RNA, 62 nt, hsa
ggaauccaagugccuuucuguagccuccagaugugcaauaacgguaacuugacucuuccauc

SEQ ID NO: 258123 - RNA, 62 nt, hsa
ugcauuuuacgcaaacuuugagccuuucucuugugcaauaauuuacauguuguguauguuuu

SEQ ID NO: 258124 - RNA, 62 nt, hsa
aauccccaaccucugacugcaaugaccuuucugugcaauaaaagcuuauuguccauuaacau

SEQ ID NO: 258125 - RNA, 62 nt, hsa
cccaaagaauuuucaaaggaaaggguguuauagugcaauagcaauuaaaauauaucaaaucg

SEQ ID NO: 258126 - RNA, 62 nt, hsa
uuuuucuugcuuugaacccugucauaaugacugugcaauacaugugcagaagaugagguauu

SEQ ID NO: 258127 - RNA, 62 nt, hsa
uuauacuacucuaaauagcauauuucauccaagugcaauaauguaagcugaaucuuuuuugg

SEQ ID NO: 258128 - RNA, 62 nt, hsa
acaaugaaaaccaacaccaacucaacaacaaagugcaauacaggcugaaccuggcccaacag

SEQ ID NO: 258129 - RNA, 62 nt, hsa
agugacaugcauucacauaucugcuuaucagugugcaauacuguguaccucauggaugcuuu

SEQ ID NO: 258130 - RNA, 62 nt, hsa
uguuugugugcaaaccaaacuuucuuuacccagugcaauagauuuguuugacugcuuguguc

SEQ ID NO: 258131 - RNA, 62 nt, hsa
aaaagcucaauguacugcccaagaggcaccuugugcaauauucccaucccugaauuuagcau

SEQ ID NO: 258132 - RNA, 62 nt, hsa
gaauagccaguauuuauguuuuuuauaaaacugugcaauacgaauuaugcaaucacaauaca

SEQ ID NO: 258133 - RNA, 62 nt, hsa
cuuacggaaauacacaaaugcuucucuguaaugugcaauaugcuuugcaacuguagaugaua

SEQ ID NO: 258134 - RNA, 62 nt, hsa
cuaugagauuuuuaaaaaauggggccgcugaugugcaauaucaaagugaacuugugaguauu

SEQ ID NO: 258135 - RNA, 62 nt, hsa
accucucuuuugugacucuuguacagcuuaaugugcaauaaaggaaaaguuauaucugucuu

SEQ ID NO: 258136 - RNA, 62 nt, hsa
ugagggaccaucagauaacuguauuuugucaggugcaauaaaaacaaaauuaaaacccaaau

SEQ ID NO: 258137 - RNA, 62 nt, hsa
aauuuaaaaauuaauauuuucuuauagauauugugcaauaaagcugaaguagaauguguggu

SEQ ID NO: 258138 - RNA, 62 nt, hsa
cuugaaugcuuugucaaauuaagaaaguuaaagugcaauaauguuugaagacaauaaguggu

SEQ ID NO: 258139 - RNA, 62 nt, hsa
uuuauuuuuagggugauuuuuuaaaaagacuugugcaauacauuuugaggugaaacuuagug

SEQ ID NO: 258140 - RNA, 62 nt, hsa
acaaguuugcaaauauuuuaacaauauuaaaugugcaauagaacuuuuauaaaauaauuaga

SEQ ID NO: 258141 - RNA, 62 nt, hsa
gcacaucguccuguuuuauugcuuucuacccugugcaauauuagcaugcaagcuuggcuuac

SEQ ID NO: 258142 - RNA, 62 nt, hsa
uggcauauuuuggaauucugcacauucauggagugcaauaauacuguauagcuuuccccacc

SEQ ID NO: 258143 - RNA, 62 nt, hsa
ugauggugcauuuuauucuugaagugaaaucugugcaauaaaauaacagacugucugcaaaa

SEQ ID NO: 258144 - RNA, 62 nt, hsa
ucaauucauagcaguaacuuuaagagggcauugugcaauaguuaguuguuuucuuguucagc

SEQ ID NO: 258145 - RNA, 62 nt, hsa
ccuuuuuuuuuuuuuuauuucgguuguuugaugugcaauauguuuuuguaugcagguaguaa

SEQ ID NO: 258146 - RNA, 62 nt, hsa
cuaauuccaaccuucuaaauuuggcuaguaaagugcaauaaaggcauugauaaguucuguua

SEQ ID NO: 258147 - RNA, 62 nt, hsa
caggaggaggauugugcugauguagugaccaagugcaauaugggcgggcagucgcugcaggg

SEQ ID NO: 258148 - RNA, 62 nt, hsa
uugugugaagaugucaaaaaaagauuuuagaagugcaauauuuauaguguuauuuguuucac

SEQ ID NO: 258149 - RNA, 62 nt, hsa
uuaaaaaaaauaaauaaaaauuaaaaaaaucugugcaauaauuuuaaaaugugcucccagga

SEQ ID NO: 258150 - RNA, 62 nt, hsa
uuauguggaugaagagcauuuuuuaugcuuuugugcaauagguuccaauaugcauuuauuag

SEQ ID NO: 258151 - RNA, 62 nt, hsa
agggcacuccccuguuuccuaagaacgaaaaagugcaauaaaggccauucguuaccuacuuu

SEQ ID NO: 258152 - RNA, 62 nt, hsa
ccauggaguugugcaaagcuauggcuuccuuggugcaauauucuuaaaaccugcuuugcaua

SEQ ID NO: 258153 - RNA, 62 nt, hsa
aaggcugacuaaccucgauucuguguugugaugugcaauacuguuucuaauguuuguauaaa

SEQ ID NO: 258154 - RNA, 62 nt, hsa
uaaaagcaacaaaagggauaccauguagaauugugcaauagucuagccagcuagccuuaaca

SEQ ID NO: 258155 - RNA, 62 nt, hsa
uccuuaauaagaaaaguaauuuuuacucugaugugcaauacauuuguuauuaaauuuauuau

SEQ ID NO: 258156 - RNA, 62 nt, hsa
cacaguguauucagacagauacagugaaccaagugcaauauguaaggaugaaagaagaagag

SEQ ID NO: 258157 - RNA, 62 nt, hsa
gauggaguuucgcuguuguugcccaggcuggagugcaauagcacgaucuuggcucaccgcaa

SEQ ID NO: 258158 - RNA, 62 nt, hsa
ggccucuuucccagcuuucuugcuugccuucugugcaauauuucuuggagaauuuggaugcc

SEQ ID NO: 258159 - RNA, 62 nt, hsa
uuaguuaauauaugugaaaguauggaggagaugugcaauaaauauuuguguuauuaacuaca

SEQ ID NO: 258160 - RNA, 62 nt, hsa
ugugaacugcaaacuugcuuaugauugacuuggugcaauaaaguuccuuucuaaccauuucu

SEQ ID NO: 258161 - RNA, 62 nt, hsa
ucaguuuuggccuucugucagcagaaugauaagugcaauaguuguaaaucuacuugacacug

SEQ ID NO: 258162 - RNA, 62 nt, hsa
ucacuuagaaauuuuauuuucuuauaacuuaagugcaauaaaauguguuuuuucauguuagu

SEQ ID NO: 258163 - RNA, 62 nt, hsa
aucaguauaacugcauuucuaguuucuauauagugcaauagagcauagauucuauaaauucu

SEQ ID NO: 258164 - RNA, 62 nt, hsa
cguuuauucucuucagcuuuaacuauacuugagugcaauaaaaaacuuaauaaaauuuuaug

SEQ ID NO: 258165 - RNA, 62 nt, hsa
uugcugggauguuucugcccacgguuuuguuugugcaauaacguuaucacauuucuaaugag

SEQ ID NO: 258166 - RNA, 62 nt, hsa
uuuucuauguaaauauugaaaacuuaugauuugugcaauaacucagauauuuuuuauuuaau

SEQ ID NO: 258167 - RNA, 62 nt, hsa
uaaaguaaaaugccuuauauauuaaagaguaagugcaauaauaugaaauagccuguacauuu

SEQ ID NO: 258168 - RNA, 62 nt, hsa
acaguacuguuucuggacccuuauaaaauccugugcaauagacacauacaugucacauuuag

SEQ ID NO: 258169 - RNA, 62 nt, hsa
auuugccuuauuuuugcaucucacaaacauaagugcaauagaucuuuucauugaacagcaaa

SEQ ID NO: 258170 - RNA, 62 nt, hsa
uuuaaguuugcagauuuauuuagugaaggcaagugcaauaauccuuccucagaugauguuug

SEQ ID NO: 258171 - RNA, 62 nt, hsa
accugaaacugguaagacaagcacaaagcaacgugcaauacaaaaaucguaucucaagggaa

SEQ ID NO: 258172 - RNA, 62 nt, hsa
gcaagaauuucuuuuaaauaaaaaguuugggggugcaauauaagaaguuuauauaauaugca

SEQ ID NO: 258173 - RNA, 62 nt, hsa
aucauuggcuuuuauaccuuucuugguuugacgugcaauaaagaagcacauuauuuuagcuu

SEQ ID NO: 258174 - RNA, 62 nt, hsa
uauaugcacauaauaaccuguaccuauaaaucgugcaauaaccauaugcgacuauuuugcca

SEQ ID NO: 258175 - RNA, 62 nt, hsa
ugaugaauuguggcaaguuaacuucaaguuaugugcaauacuuauuucaaacuuuugaaaga

SEQ ID NO: 258176 - RNA, 62 nt, hsa
agucucacaguuggugauuucuccgcucuguggugcaauaucccuauuuguaggugaguugu

SEQ ID NO: 258177 - RNA, 62 nt, hsa
cuguaagagucuggcuuagaacagaccucucugugcaauaacuuguggccacuggaaauccc

SEQ ID NO: 258178 - RNA, 62 nt, hsa
auauuauacauacacaaguuugugugaaagaugugcaauaacaaagguguauguauguuuug

SEQ ID NO: 258179 - RNA, 62 nt, hsa
aaaaguaaaauccaaaauguuagcaaaacaaagugcaauauuaaauguuugcuuuauagauu

SEQ ID NO: 258180 - RNA, 62 nt, hsa
uuauaauaaccucccaguucuaggggauauuugugcaauaaauacacaugucaacuugaugg

SEQ ID NO: 258181 - RNA, 62 nt, hsa
auaugucuuaauuuugaguuugaaaauguuaagugcaauaaaaacauacuaguacagauuuu

SEQ ID NO: 258182 - RNA, 62 nt, hsa
aaggggcguuuguuuuauucuugguguuuucagugcaauaaauagcuacaaacuucugugca

SEQ ID NO: 258183 - RNA, 62 nt, hsa
acuaugaucugauggccucuagguguuguuuugugcaauauacagccccagguagggagggg

SEQ ID NO: 258184 - RNA, 62 nt, hsa
gauaccuaagcacuagaauauccagcuaaauggugcaauaggcuaggaauugagccaggaga

SEQ ID NO: 258185 - RNA, 62 nt, hsa
acauggggaucagagcagacuucuccacuacugugcaauagagauacagcucucuucagagu

SEQ ID NO: 258186 - RNA, 62 nt, hsa
auugccugagcccaggaguucaagaccagcuugugcaauauagggagacuccggcucuacaa

SEQ ID NO: 258187 - RNA, 62 nt, hsa
gggaugucgggagaccuagaugaccuuaucgggugcaauacuagcuaagguaaagcuagaaa

SEQ ID NO: 258188 - RNA, 62 nt, hsa
uuguuuuuaaacuuuuuuuugccauccauccugugcaauaugccguguagaauauuugucuu

SEQ ID NO: 258189 - RNA, 62 nt, hsa
acauugauuuuuuuuuuuucguuuucuuucuugugcaauaccuacaauggugcuguguuuua

SEQ ID NO: 258190 - RNA, 62 nt, hsa
gaaaaaaacugcaucccaucacccaaaguucugugcaauagaaauuucuacagauacaggua

SEQ ID NO: 258191 - RNA, 62 nt, hsa
agcuugauaugguguuucagugcuuauugguugugcaauaaugguuauagccuguuagauaa

SEQ ID NO: 258192 - RNA, 62 nt, hsa
ugucccauuucauucucuugcuuuuuuagcaugugcaauacuuucugugccaauagagucug

SEQ ID NO: 258193 - RNA, 62 nt, hsa
cagacugcauuaguauuuuggcauugaaacuugugcaauaucuguguaauguagaauguggg

SEQ ID NO: 258194 - RNA, 62 nt, hsa
auuaacuagguaugaaguauaaacccauuuuggugcaauauucuugacuccuuggugcuaaa

SEQ ID NO: 258195 - RNA, 62 nt, hsa
ucugcccaaaagcagcagacauguaagcagaugugcaauaaaaaaugaucuugauccauuuc

SEQ ID NO: 258196 - RNA, 62 nt, hsa
cauggaagauacuagcccagccuagcagaaaagugcaauauguauagcauacuuugacauuu

SEQ ID NO: 258197 - RNA, 62 nt, hsa
cagcauagcugaaaguugccaaacuggacauugugcaauaaaguagaauucuauauugauaa

SEQ ID NO: 258198 - RNA, 62 nt, hsa
agcauaacuuauaucuguauuuaaggacuuuugugcaauauggucuuaagaaauaauugcca

SEQ ID NO: 258199 - RNA, 62 nt, hsa
gcgcaucagauagucucuguguaccuggauuugugcaauauguaaaaauguaucaaauguau

SEQ ID NO: 258200 - RNA, 62 nt, hsa
uuugggaugucagcaguggccugaagugaguugugcaauaaauguuaaguugaaaccuccuu

SEQ ID NO: 258201 - RNA, 62 nt, hsa
aaaagagaaaaagaaggauugaucagagcauugugcaauacaguuucauuaacuccuucccc

SEQ ID NO: 258202 - RNA, 62 nt, hsa
accagccaguaauuucugugcaaccuuacuaugugcaauauuuuuaaauccugagaaaugug

SEQ ID NO: 258203 - RNA, 62 nt, hsa
ggagggauauccccuuggauuucacuugcauugugcaauaagcaaagaaggguugauaaaag

SEQ ID NO: 258204 - RNA, 62 nt, hsa
uuuuuguugccuuuuuugcuuuuuuuuaaucugugcaauaccucauuuaaucuguaaagguu

SEQ ID NO: 258205 - RNA, 62 nt, hsa
uggaauguuaccuguccguguuacauaaucaagugcaauauacucaguucucaugcagguga

SEQ ID NO: 258206 - RNA, 62 nt, hsa
aauaaauuaaaaacaguauuugggggagaaacgugcaauagcguaaugguggugucccugcc

SEQ ID NO: 258207 - RNA, 62 nt, hsa
uaaauuuauuuuaacguagacacuaaaaguaugugcaauauacaauuaaaguaggaauuugu

SEQ ID NO: 258208 - RNA, 62 nt, hsa
cuguuggucucucuguguucuuuguuacuugggugcaauagcaacuucccuaccccgugcau

SEQ ID NO: 258209 - RNA, 62 nt, hsa
ccaugggggcuccagacauuguauuuuacuuugugcaauaugaggggacugcaugcaagcuc

SEQ ID NO: 258210 - RNA, 62 nt, hsa
aucugcuaccugauuuuauccuggagaauacagugcaauauuucucuuugauuauuuauucc

SEQ ID NO: 258211 - RNA, 62 nt, hsa
cauucauuccuguuaagcugccaaaaauuaaagugcaauauuguauauuuuuaagaacaaau

SEQ ID NO: 258212 - RNA, 62 nt, hsa
accuguagguggagcaaguaauaagccaugcugugcaauauauacauaaagcuucugcuucu

SEQ ID NO: 258213 - RNA, 62 nt, hsa
agaauguuauccaacuauuaagauaucucaaugugcaauaacuuguguauuagauaucaaug

SEQ ID NO: 258214 - RNA, 62 nt, hsa
aaauaauguaaaugucuucuauuaaauguugagugcaauaaaauacagaagaauucucuaua

SEQ ID NO: 258215 - RNA, 62 nt, hsa
gcuuuuggaaaagcuccagguccucauguauugugcaauaacaaugacuuccuuggcgguuu

SEQ ID NO: 258216 - RNA, 62 nt, hsa
uacuugccuggauugcuuuaaaauuaaccuuugugcaauaccaagaaaauagcucuuuaaaa

SEQ ID NO: 258217 - RNA, 62 nt, hsa
agaagaugauuuuaacaguucagaacagaugugugcaauauuggugcauguaauaauguuga

SEQ ID NO: 258218 - RNA, 62 nt, hsa
acccuugccucaucaguuuuccugauuuacaagugcaauauuuuagccaaugccuugggaga

SEQ ID NO: 258219 - RNA, 62 nt, hsa
uaaaucuccaacuugcuguuuccaaaaagaaggugcaauaucauauaucaucaguuagcaau

SEQ ID NO: 258220 - RNA, 62 nt, hsa
cagacagucuguuaugcacugugguuucagaugugcaauaauuuguacaaugguuuauuccc

SEQ ID NO: 258221 - RNA, 62 nt, hsa
cucauucaugauguugauuuuuuuucaauguggugcaauauauacaauaaaauuugucauaa

SEQ ID NO: 258222 - RNA, 62 nt, hsa
caaucacaaacuaaagacugcggcuuguugaggugcaauacccugacucccaaaguuaguua

SEQ ID NO: 258223 - RNA, 62 nt, hsa
gauggaguuucacucuuguugcccaggcuggagugcaauagcaugaucucggcucacugcaa

SEQ ID NO: 258224 - RNA, 62 nt, hsa
ucuugaaaacugcuguagcaaauucaucuguggugcaauacacuuuuugauuaaagcucuuc

SEQ ID NO: 258225 - RNA, 62 nt, hsa
uucccccccaaaugguugcguccuuugaaccugugcaauaugaggccaaauuuaaucuuuga

SEQ ID NO: 258226 - RNA, 62 nt, hsa
gcugccacacacuacaggagucaauaaacaaggugcaauauuuucaaaucguuggccggcua

SEQ ID NO: 258227 - RNA, 62 nt, hsa
uuguuuuuaagacucauggacauuucauaccugugcaauacugaagaccucauucugucaug

SEQ ID NO: 258228 - RNA, 62 nt, hsa
ucugaaccgaauguuuuggacuuaacuguugcgugcaauaugaccgucggcacacugcuguu

SEQ ID NO: 258229 - RNA, 62 nt, hsa
agagauaccagaaugcugguauucuacuacuugugcaauauauauguuuuaaaaaacaaauu

SEQ ID NO: 258230 - RNA, 62 nt, hsa
aucaacuaguucuuccauguaaaauaauuuuagugcaauaugaagacguagaaauguaaaau

SEQ ID NO: 258231 - RNA, 62 nt, hsa
uuccagccugaagccugcuuaaacugugugaugugcaauaacugagcuuagaguuaggaauu

SEQ ID NO: 258232 - RNA, 62 nt, hsa
cuugguagaugucccuagacgggcugagccaugugcaauaagaacauagauccuaaaggauc

SEQ ID NO: 258233 - RNA, 62 nt, hsa
gcuauaaccuaaccucgacuauuuguuguuaugugcaauacuguuuguacuguuuguauaaa

SEQ ID NO: 258234 - RNA, 62 nt, hsa
uuguuagcaucuuuguaugcacaucacuguuugugcaauauaugaauauuuuguugcauugu

SEQ ID NO: 258235 - RNA, 62 nt, hsa
gcacugucuuugaugcagugauguacuuaauggugcaauaaagcugcuucgauuugguuucc

SEQ ID NO: 258236 - RNA, 62 nt, hsa
cugaaagcuuugaugaaauuuguuuuuguauggugcaauaugacagccugucauugaaucua

SEQ ID NO: 258237 - RNA, 62 nt, hsa
guugagugagcugcuaugacuuugguagagaggugcaauauguuuuuugaaccagcuauaaa

SEQ ID NO: 258238 - RNA, 62 nt, hsa
aaaauugucugaaauguuuauuuugcaaaacagugcaauagaaucuaguuaugccuucauca

SEQ ID NO: 258239 - RNA, 62 nt, hsa
accuccuuauguauucucaauuaccuguauuugugcaauaaauuggaauaauguaacuugau

SEQ ID NO: 258240 - RNA, 62 nt, hsa
ggucuggaccccacggggcuggggagggccaugugcaauauuuggaggguuuucuggagggc

SEQ ID NO: 258241 - RNA, 62 nt, hsa
accuuuggugggggcagggccugguggcaccugugcaauaaugucuguguuucucucccacc

SEQ ID NO: 258242 - RNA, 62 nt, hsa
agauauauuauuugcagcaagaaguucauucugugcaauauggacauguuugcaaaccauac

SEQ ID NO: 258243 - RNA, 62 nt, hsa
ucuguguuauucuuaguacccacugauaaauugugcaauaaauaaucuuucgcaagugauuu

SEQ ID NO: 258244 - RNA, 62 nt, hsa
agauuuagaucuggaccaggcuguggguagaugugcaauagaaauagcuaauuuauuucccc

SEQ ID NO: 258245 - RNA, 62 nt, hsa
uacuuuugucagaaucaaggcuucggccaccugugcaauauuuucccauggaaugcagcagu

SEQ ID NO: 258246 - RNA, 62 nt, hsa
augcuuuaucuguguuuucuguaaauaaaagagugcaauaaucucugugugugauugcagga

SEQ ID NO: 258247 - RNA, 62 nt, hsa
acucagaaacgagaucgggaagcagaaauauagugcaauagugcaacaucucugaauccuuu

SEQ ID NO: 258248 - RNA, 62 nt, hsa
aauugcacugaacagaauuaagaaauacucaugugcaauaggugagagaauguauuuucaua

SEQ ID NO: 258249 - RNA, 62 nt, hsa
aaaauugauacaacuaugcagauuuuauaaaugugcaauaaaaguauuuguuuuaccuuugg

SEQ ID NO: 258250 - RNA, 62 nt, hsa
accuuuuucuaugaaaaaagacccagcgccgugugcaauaaagguuauguuucuauguggug

SEQ ID NO: 258251 - RNA, 62 nt, hsa
uccuguagcuugauauuacagaugugcuauuagugcaauaaggugaaggcugucugcccaga

SEQ ID NO: 258252 - RNA, 62 nt, hsa
ggagguauaacccugcuccucucucccagucugugcaauaaaggucgugaagaucucucagc

SEQ ID NO: 258253 - RNA, 62 nt, hsa
agauauauguauauaaaguguaugcuguauuggugcaauaaugguaauuaaaaauaugaaaa

SEQ ID NO: 258254 - RNA, 62 nt, hsa
ugaguuuuuuauuuuuaaguguuuguuuuucagugcaauaauuuuugugugugugugauucu

SEQ ID NO: 258255 - RNA, 62 nt, hsa
gggcugccagcaguacgugggaaagguggaaugugcaauaggaacagaucugugcauuuugu

SEQ ID NO: 258256 - RNA, 62 nt, hsa
gcgaacaucacaccguuccccgaccaagccgugugcaauacaacagagggaggcagguggga

SEQ ID NO: 258257 - RNA, 62 nt, hsa
augggguggaacacagcauuuugucaagcacugugcaauauuccauauuuuuccccacuaug

SEQ ID NO: 258258 - RNA, 62 nt, hsa
uaaucuuuuacgggugggaggugagauugauagugcaauaaucagugaucuauagacccuca

SEQ ID NO: 258259 - RNA, 62 nt, hsa
caucaaaccucacauuugugaacucaaacgaugugcaauacauuuuuuucucuuuccuugaa

SEQ ID NO: 258260 - RNA, 62 nt, hsa
agaguagaagauuugaugcuggagagguuaaggugcaauaagaauuuagggagaaauguugu

SEQ ID NO: 258261 - RNA, 62 nt, hsa
auacuucaauacuucauuuaaaauauuuuuaugugcaauaaaauguauuuguuuguauuuug

SEQ ID NO: 258262 - RNA, 62 nt, hsa
gguuugugacuuuccuaaaucaauucuauuacgugcaauacuucaauacuucauuuaaaaua

SEQ ID NO: 258263 - RNA, 62 nt, hsa
uauuugcaagacauagaauaguguuggaaaaugugcaauaugugauguggcaaaucucuauu

SEQ ID NO: 258264 - RNA, 62 nt, hsa
gacauaaaaccuuuuuuuaauaauaaaauauugugcaauauauucaaagaaaagaaaacaca

SEQ ID NO: 258265 - RNA, 62 nt, hsa
uggguggagaguggagugcgcugggacguugugugcaauagagaggucuccacaccagaugu

SEQ ID NO: 258266 - RNA, 62 nt, hsa
ccauccccauagccauguuuacaugauuugaugugcaauagggugggguaggggcagggaaa

SEQ ID NO: 258267 - RNA, 62 nt, hsa
ucacagaaagugcauuuuaaccaguacucugggugcaauaaauaauauguagaaauuuaagu

SEQ ID NO: 258268 - RNA, 62 nt, hsa
gacacccaggacuuauuuaaacucuguugcaagugcaauaaaucugacccagugcccccacu

SEQ ID NO: 258269 - RNA, 62 nt, hsa
auugcuugguggaacauaugcuuucacuguuugugcaauaugcauuuauuucuuauaugaau

SEQ ID NO: 258270 - RNA, 62 nt, hsa
ggagacaucaggucccccuggauucaaauuaagugcaauauuuugcaaacagcucuucuuag

SEQ ID NO: 258271 - RNA, 62 nt, hsa
aaaucagcgucauuuguucccugccaagcaucgugcaauaagugaauuuccuggccuacuuc

SEQ ID NO: 258272 - RNA, 62 nt, hsa
auguaagugugcuugggaauuccuuaaauuuugugcaauaaacuauuuuuugguaaagauuu

SEQ ID NO: 258273 - RNA, 62 nt, hsa
uucuuuuuuuuuuuuuuuguguagaaaaauaggugcaauaaugaucaaaguuuugaugucuu

SEQ ID NO: 258274 - RNA, 62 nt, hsa
gacaugcagugaaaugguucuuuguuaaaaaugugcaauaaaaauagauuacaauaaguagu

SEQ ID NO: 258275 - RNA, 62 nt, hsa
uuguugagaggaaaagugaauugguuaaaagagugcaauaaggauccaaauacagugacuuu

SEQ ID NO: 258276 - RNA, 62 nt, hsa
gguuguuuucuguuaagcaaagccgagauccagugcaauaccuggacugucaccguccugug

SEQ ID NO: 258277 - RNA, 61 nt, hsa
uaaaaacugaagaacauugaugagaaaucucugugcaauaauguaaaaaaaaaaaaagaua

SEQ ID NO: 258278 - RNA, 62 nt, hsa
uagguuaaguuugagccugaaauuuuaaugaagugcaauacugagugugccucauuaucuug

SEQ ID NO: 258279 - RNA, 62 nt, hsa
cacuuuaauguuuuauucuuguacauaaaaaugugcaauauggagauguauacagucuuuac

SEQ ID NO: 258280 - RNA, 62 nt, hsa
uuguauauuuauucuauuuuguauauuguuaagugcaauaaaguuuuugccuugcuuuauuu

SEQ ID NO: 258281 - RNA, 62 nt, hsa
cugauguacacacauuucauuauuugccaauggugcaauaaccacugcugaccaacccacua

SEQ ID NO: 258282 - RNA, 62 nt, hsa
cugguuuuaauuuuuaguugugcuuugagucagugcaauaaacuagacuuuuuccaaaccug

SEQ ID NO: 258283 - RNA, 62 nt, hsa
uauuuggagaaacaggaguguucacuuaucuagugcaauauguucacaguuuauuaaugcuu

SEQ ID NO: 258284 - RNA, 62 nt, hsa
guuggcuacaucauuuuguguugaauaauaaagugcaauacuuuauucuccauaauuaaacu

SEQ ID NO: 258285 - RNA, 62 nt, hsa
gaaaauuguauaaccauccugcuguuccuuuagugcaauacaauaaaacucugaaauuaaga

SEQ ID NO: 258286 - RNA, 62 nt, hsa
uauuuuguuuauuauuuucauguuugaguucugugcaauauuuucuauuauguccguugaua

SEQ ID NO: 258287 - RNA, 62 nt, hsa
aauaaauaccagguaugaaauuacugauuuuagugcaauaucuguaugauuauccagaacua

SEQ ID NO: 258288 - RNA, 62 nt, hsa
guuuucuaaauguuucuuuuucuuuuuugagugugcaauauguaacaugucuaaaguuaggg

SEQ ID NO: 258289 - RNA, 62 nt, hsa
uaaggcaguacaaauuguggagccuuuuaacugugcaauaauuucuguauuuauuggguuuu

SEQ ID NO: 258290 - RNA, 62 nt, hsa
cuguaggaagaaucaaaucaccgauuuaaagagugcaauauauaauaaucauuuuuaaagua

SEQ ID NO: 258291 - RNA, 62 nt, hsa
ccuuuuccuguggaaaccugucauagaauuuugugcaauauguaugugucuaugaagcuguc

SEQ ID NO: 258292 - RNA, 62 nt, hsa
agucagagucucgcucucuuguccaggcuggagugcaauagcgcgaucugggcucacugcaa

SEQ ID NO: 258293 - RNA, 62 nt, hsa
cauacucuuuguauauauuuauuauaugaaaggugcaauauuuuauuuuguacaguauguaa

SEQ ID NO: 258294 - RNA, 62 nt, hsa
cuguuuaaacugugauuuucuuuauuguguuggugcaauauuuuauuaucauuuaaccucag

SEQ ID NO: 258295 - RNA, 62 nt, hsa
caguguauucuguuuuuaaaacugugccugcagugcaauacuccuucugguguauuuuaucc

SEQ ID NO: 258296 - RNA, 62 nt, hsa
guaccucucauuuucagucagggacauacuuugugcaauauuucugugauugugccuaugca

SEQ ID NO: 258297 - RNA, 62 nt, hsa
gaggaucaccagugcauccuucaucacagcaugugcaauaugccaagauuacccucggucau

SEQ ID NO: 258298 - RNA, 62 nt, hsa
gcuacuguauuugucucaaagcuaccaaguuugugcaauaaguggaagggaugucauccuuc

SEQ ID NO: 258299 - RNA, 62 nt, hsa
gaauaugugcuuuuacuguacauagugcuauugugcaauaggucuuaugcuguuuucacuca

SEQ ID NO: 258300 - RNA, 62 nt, hsa
cccgccccuugccucgauauugccaguuucuugugcaauaaacaaucagcagcugugggugg

SEQ ID NO: 258301 - RNA, 62 nt, hsa
cgcccgcggguccuccccaccugcugcuccccgugcaauaccugcugggccuccugcccgcg

SEQ ID NO: 258302 - RNA, 62 nt, hsa
ugugcguggcuaucaggaguucuaggaacucagugcaauacgggagugacccagcuacugaa

SEQ ID NO: 258303 - RNA, 62 nt, hsa
cacaguguuuuuauugcucgcccagacaccaugugcaauaagauugguguucguuuccauca

SEQ ID NO: 258304 - RNA, 62 nt, hsa
gagacaaaggaggaauuuacuuucuucaccaagugcaauagauuacugaugugauauucugu

SEQ ID NO: 258305 - RNA, 62 nt, hsa
cuucucagugguuuacaugccucugaaacuaugugcaauauuuuugguugacacuuguaucc

SEQ ID NO: 258306 - RNA, 62 nt, hsa
agaaacaaacauugaauuacuaaacaaagauggugcaauaucuuuguuuuuuuuuuaugagg

SEQ ID NO: 258307 - RNA, 62 nt, hsa
uaccuucaacaugugcucgcucugcaugauuagugcaauaaaacucccuuccuuaugcauac

SEQ ID NO: 258308 - RNA, 62 nt, hsa
gggugguugggagagaaacuagaacagaagaugugcaauagggcucagagcagccccaggaa

SEQ ID NO: 258309 - RNA, 62 nt, hsa
guugcguugaggccgcaucuuucuucagcagcgugcaauagcuggcuccucuauaggagaug

SEQ ID NO: 258310 - RNA, 62 nt, hsa
cugugacucucuuggaaaugccuugacugaaugugcaauauuugugucucuugguuucuaac

SEQ ID NO: 258311 - RNA, 62 nt, hsa
uuugucaguuuguuugccuuacucauuucuaagugcaauaagggagugucucacaggauugc

SEQ ID NO: 258312 - RNA, 62 nt, hsa
uggacccagggccugagaccuuugugggauuugugcaauaaaguguuuuuauuuaaaaccaa

SEQ ID NO: 258313 - RNA, 62 nt, hsa
ugugucagaacauucagaagaagucugaagaagugcaauauguuagauacucagcagaagua

SEQ ID NO: 258314 - RNA, 62 nt, hsa
ugcagcuguaggucgucaucaccuaaccacacgugcaauaaaguccucgugccugcugcuca

SEQ ID NO: 258315 - RNA, 62 nt, hsa
uuggacccugacuguauacagaaugaaaggcagugcaauauuuagcugcuaacaagacuggc

SEQ ID NO: 258316 - RNA, 62 nt, hsa
guaaucguaaauauuaauuuuguaccuauauugugcaauacuugaaaaaaacgguauaaaag

SEQ ID NO: 258317 - RNA, 62 nt, hsa
uucuaaauuacuaugucagguuguaaaagucagugcaauaacaaaccuuccuuuuuaagaag

SEQ ID NO: 258318 - RNA, 62 nt, hsa
acguguccuggucacuggucuuuauaauuguugugcaauaacuaaaggcuaaggacuagaug

SEQ ID NO: 258319 - RNA, 62 nt, hsa
ccccuucccuuuuuuuguuauuuuuucagacugugcaauacuuagagaaccuauagcaucuu

SEQ ID NO: 258320 - RNA, 62 nt, hsa
gaugauuucuuuucccugcacacaucuuuccggugcaauaucuaucaauugugaaucuggcu

SEQ ID NO: 258321 - RNA, 62 nt, hsa
cugcuugcagcaacuugauuuccccaaguccugugcaauagccccaggauuggauuccuuca

SEQ ID NO: 258322 - RNA, 62 nt, hsa
aaaccaauuuuuuuaguuauuguucaaggagggugcaauauuaaguguuuuggaauuugaag

SEQ ID NO: 258323 - RNA, 62 nt, hsa
cauuuggguauaaugacaacagccaauuuauagugcaauaaaauguaauuaauucaaguccu

SEQ ID NO: 258324 - RNA, 62 nt, hsa
guggcccccguccgaggaggaucguuuucuaagugcaauacuuggcccgccggcuucccgcu

SEQ ID NO: 258325 - RNA, 62 nt, hsa
auccuccuugacgaguuuuguuuuucaaaauggugcaauaauuuaaguggcaucuucucucc

SEQ ID NO: 258326 - RNA, 62 nt, hsa
cccccuuccccagaacaaaacauguugaucaugugcaauauuucuuacugugccgagaagcc

SEQ ID NO: 258327 - RNA, 60 nt, hsa
auguuggagaaaaaccuuagugaugugauggugcaauaaagucuucacucagucuucaug

SEQ ID NO: 258328 - RNA, 62 nt, hsa
cugguccuuagccccaugccucuuccaaaacagugcaauaaaucuccgguaacccguccacc

SEQ ID NO: 258329 - RNA, 62 nt, hsa
gacacguccccguucccccgaaaccuggcucagugcaauacucccauugccaugggguccuu

SEQ ID NO: 258330 - RNA, 62 nt, hsa
uuuuaaggauugacaagaguuuauuuucuauugugcaauaucuuaaaggaagcaaccaccuu

SEQ ID NO: 258331 - RNA, 62 nt, hsa
agccuccugauuucauaaccaggccggaccacgugcaauaggguggaaaccaaacugcucca

SEQ ID NO: 258332 - RNA, 62 nt, hsa
gcacucgccucccuaccaaugacucaccugaagugcaauacgaaauaaaaggccagcgggcg

SEQ ID NO: 258333 - RNA, 62 nt, hsa
cuucuaagacccacgagcggggugagagaagugugcaauagucuggaauaaauauaaaugaa

SEQ ID NO: 258334 - RNA, 62 nt, hsa
cucagccaggugggccuguauauaggguccaugugcaauagggagggacgucuucuauuuuu

SEQ ID NO: 258335 - RNA, 62 nt, hsa
cugucuaauauaggaaaaacacaugagaacaggugcaauauauugacuuaaacuuguuuagc

SEQ ID NO: 258336 - RNA, 62 nt, hsa
ggugcccacagaggcucagcuccuucuuuucugugcaauacgagacccggccgcaccccgag

SEQ ID NO: 258337 - RNA, 62 nt, hsa
cacaacaaaaacccaaguuuucugugcuacaugugcaauauuuguuaugaauguuaucacaa

SEQ ID NO: 258338 - RNA, 62 nt, hsa
uuucauguccauucaagugacuuuuauucugagugcaauauuucaauagccuuguagugaua

SEQ ID NO: 258339 - RNA, 62 nt, hsa
gguuggguuugggguucaggaugcugcagucugugcaauaauaaacccgcaucugcucacgg

SEQ ID NO: 258340 - RNA, 62 nt, hsa
uauuaaauucaaauaucccauaucuaaauuuagugcaauaucuugucuuuuguauaggucau

SEQ ID NO: 258341 - RNA, 62 nt, hsa
acucugcccugaccccgaucaguuaaggagcugugcaauaaccuuccuaguaccugagugag

SEQ ID NO: 258342 - RNA, 62 nt, hsa
ucaaucacaacagguaauagcaauagacguuagugcaauacaaagucacccucaauaaauac

SEQ ID NO: 258343 - RNA, 62 nt, hsa
uugcugucagccacauauugagaugacacuaggugcaauagcagggauagauuuuguuggug

SEQ ID NO: 258344 - RNA, 62 nt, hsa
cuacaaauagugcuaauaaaguuaaauugcacgugcaauacggaacacugucaauggacugc

SEQ ID NO: 258345 - RNA, 62 nt, hsa
gcuaagagaauugggcauuaguauuucauuaugugcaauaagucauuguaagugcacugaua

SEQ ID NO: 258346 - RNA, 62 nt, hsa
guccaacaagaacaccugacuugggugaaguugugcaauauuggaggcugacuguagggcug

SEQ ID NO: 258347 - RNA, 62 nt, hsa
cuuuccacuggaguucacuuucaauugcuucugugcaauaaaaccaagugcuuauaaaauga

SEQ ID NO: 258348 - RNA, 62 nt, hsa
uagcccagauacacauacucuuuuuugucuuugugcaauaaucaguguuccuggcagagccu

SEQ ID NO: 258349 - RNA, 62 nt, hsa
acuccagagcuccuuuaacaucugcuaauuaagugcaauaaauuuuucuagaaaauggcaaa

SEQ ID NO: 258350 - RNA, 62 nt, hsa
aauacaaucaaggguuuuguauucagaauguugugcaauauuuuggaaugggacauuggugu

SEQ ID NO: 258351 - RNA, 62 nt, hsa
cucucuguugugagaucuucagcuaccucauggugcaauaacacacacacgcuuaaccaugu

SEQ ID NO: 258352 - RNA, 62 nt, hsa
guggcauaggaagacggcaaaaauuuccuaaagugcaauagauuuucaaguguauugugccu

SEQ ID NO: 258353 - RNA, 62 nt, hsa
uguacaguauuuuuuguuguuuuuaucaucaugugcaauauuacugauuuguuuccaugcug

SEQ ID NO: 258354 - RNA, 62 nt, hsa
cucuacucuuuaguagaguucgagacacagaagugcaauaacugcccuaauuaagcaacuau

SEQ ID NO: 258355 - RNA, 62 nt, hsa
acgcuugguuuuucucagaacccccaaaagaugugcaauagcuguuguuacaaaccaccaaa

SEQ ID NO: 258356 - RNA, 62 nt, hsa
uuggauuuuauguugacauuuguuugguuauagugcaauauauuuuguaugcaagcaguuuc

SEQ ID NO: 258357 - RNA, 62 nt, hsa
gauggaguuucacucuuguugcccaggcuggagugcaauagcucgaucucggcucacugcaa

SEQ ID NO: 258358 - RNA, 62 nt, hsa
auaguuguuuacuagugugcuagaugaaaagcgugcaauaugcuuuaaagcuaucaacaaaa

SEQ ID NO: 258359 - RNA, 62 nt, hsa
gaaacugaggguuaucuuugacacagaauugugugcaauauucuuaaauacuacugcucuaa

SEQ ID NO: 258360 - RNA, 62 nt, hsa
uuguaauaggcauuuuuuuuuuuuuuuacaaugugcaauaacucagcaguuaaauaguggaa

SEQ ID NO: 258361 - RNA, 62 nt, hsa
gcaacuuucuauaaugccaaaaugacacaucugugcaauagaaugaugucugcucuagggaa

SEQ ID NO: 258362 - RNA, 62 nt, hsa
augcagcauuaacuuuacugacauggagugaagugcaauauuauaaauauuauagauuaaaa

SEQ ID NO: 258363 - RNA, 62 nt, hsa; identical to SEQ ID NO: 258353

SEQ ID NO: 258364 - RNA, 62 nt, hsa; identical to SEQ ID NO: 258354

SEQ ID NO: 258365 - RNA, 62 nt, hsa
auggcauaagaaguugacaaaaauuucuuaaagugcaauagauuuucaaguguauugugccu

SEQ ID NO: 258366 - RNA, 62 nt, hsa
aagggacuuaauuacaaacuuaagacguaagugugcaauaaaguaagcuaagaagaaaauau

SEQ ID NO: 258367 - RNA, 63 nt, hsa
cauaaagcaaauuuggaggaaacaacugaaguugugcaauauuuucugauaauugcuuuuuuu

SEQ ID NO: 258368 - RNA, 63 nt, hsa
cuagaccccucuuccucucucccccaccauagugugcaauaaagugucuguucuuaccaaacc

SEQ ID NO: 258369 - RNA, 63 nt, hsa
uugccguguaugaggagugcuagaaaaugcaaagugcaauauuuucccuaaccuucaaaugug

SEQ ID NO: 258370 - RNA, 63 nt, hsa
agaccaagcaucuaucugauagaagcacauggagugcaauaggacauugugagaaggaauuuu

SEQ ID NO: 258371 - RNA, 63 nt, hsa; identical to SEQ ID NO: 87681

SEQ ID NO: 258372 - RNA, 63 nt, hsa; identical to SEQ ID NO: 87682

SEQ ID NO: 258373 - RNA, 63 nt, hsa
uuugugaugccuucccuccccuagaaagauuuugugcaauauauuaaauggggacagaauucu

SEQ ID NO: 258374 - RNA, 63 nt, hsa; identical to SEQ ID NO: 87683

SEQ ID NO: 258375 - RNA, 63 nt, hsa; identical to SEQ ID NO: 87684

SEQ ID NO: 258376 - RNA, 63 nt, hsa
ugaaauaauagggcauuuaacaaagaucgcuaugugcaauacuguauuuaguguuucuauuuc

SEQ ID NO: 258377 - RNA, 63 nt, hsa
cccuuuugcuggggcugccaucuugaaaucugagugcaauaggauuugcuuguaacaguuauu

SEQ ID NO: 258378 - RNA, 63 nt, hsa
uuccccuugucccuggggcacucccccaggauugugcaauagucagagugucccuuuuugcag

SEQ ID NO: 258379 - RNA, 63 nt, hsa
aaagaauagaccaugggcuacuacugggcauuagugcaauauaacagcgauaauaaaauucuc

SEQ ID NO: 258380 - RNA, 63 nt, hsa
aaaauugaauuuucuucagacaaaacugcucuugugcaauauuuuaugcucagugagcaaauu

SEQ ID NO: 258381 - RNA, 63 nt, hsa
gaaauagguuaaaucuuauauaaauauuacuuugugcaauauuguuguguaguuaaaugcaua

SEQ ID NO: 258382 - RNA, 63 nt, hsa
auucuaagaccagauucucuaauguuucugggugugcaauagagugaucacaucuuuguuucu

SEQ ID NO: 258383 - RNA, 61 nt, hsa; identical to SEQ ID NO: 258096

SEQ ID NO: 258384 - RNA, 63 nt, hsa
gucaguugagauuaaaaguaaggaacagagaaugugcaauaccgucuggcugggggcuguccc

SEQ ID NO: 258385 - RNA, 63 nt, hsa; identical to SEQ ID NO: 87685

SEQ ID NO: 258386 - RNA, 63 nt, hsa; identical to SEQ ID NO: 87686

SEQ ID NO: 258387 - RNA, 63 nt, hsa
gaacugaccauuauaugccuucacuggcuucuugugcaauaauaugauguuuuaagugugcaa

SEQ ID NO: 258388 - RNA, 63 nt, hsa
agaaaauaugcagaauaacuggucuuguuaagagugcaauauuauauuuuuauguaaaaauaa

SEQ ID NO: 258389 - RNA, 63 nt, hsa
aaaaggcacauaguuuaaaaaguuucucauuuugugcaauauaaucuaaauaaaguacagacc

SEQ ID NO: 258390 - RNA, 63 nt, hsa
aaaucaguuaagauaaagcugcauuguauauaagugcaauauauuuuugaaggucuguaaaug

SEQ ID NO: 258391 - RNA, 63 nt, hsa
cugcuggggcugacuuguccagaaggggacaaagugcaauacagagccuucccuacccugacg

SEQ ID NO: 258392 - RNA, 63 nt, hsa
agucuaugaaagaauaauuauaauaauguccaggugcaauacucuguaagucuauugguucaa

SEQ ID NO: 258393 - RNA, 63 nt, hsa
uguuucuugaauauauauuuuugaaguuuuuuugugcaauauauuacuaaaucaguuauuauu

SEQ ID NO: 258394 - RNA, 63 nt, hsa
ugaagagaaucccaaaaguuaguucaucuuaaagugcaauauuguuuaaucuuaaaacugggc

SEQ ID NO: 258395 - RNA, 63 nt, hsa
uugcuauguugauguguaagugaaaucaguugugugcaauagacaggggcguauucaugggag

SEQ ID NO: 258396 - RNA, 63 nt, hsa
agggacaucaucucuuccaucuuuggguccuuagugcaauaccuggcagcuagccagugcuca

SEQ ID NO: 258397 - RNA, 63 nt, hsa
accugguuacaacuugcugguggguuuuauguugugcaauacuaggaggaggaggcaggugau

SEQ ID NO: 258398 - RNA, 63 nt, hsa
ggucuugaugugcauagcuucugauaacccugugugcaauaauaugauuugcagggcauuucu

SEQ ID NO: 258399 - RNA, 63 nt, hsa
cacucaacagauguagugugacaaguauaauaugugcaauaaucauuguuucucuuaugauuu

SEQ ID NO: 258400 - RNA, 63 nt, hsa
ccucaacccaaauccaccuucauacuguaaguagugcaauacuuguuucauuucuguguuuaa

SEQ ID NO: 258401 - RNA, 63 nt, hsa
uguuucaacggaaagugcugucuuaaacuaaaugugcaauagaaggugauguugccauccuac

SEQ ID NO: 258402 - RNA, 63 nt, hsa
ucuuaaaacacugaccucuaugagguauuuacugugcaauaacugauucauuuuuuucagagc

SEQ ID NO: 258403 - RNA, 63 nt, hsa
ugaaucuuugauguuuuuugucauuguucucaagugcaauauaacaauguaaccaaaucuaga

SEQ ID NO: 258404 - RNA, 63 nt, hsa
ccauucagauagcaguaaaacauucuguaugaugugcaauaaaacauccaagaucuuuuuuga

SEQ ID NO: 258405 - RNA, 63 nt, hsa
uuggacaucuuuucucuuguguuuuguuugaaugugcaauaguuuauaggccacaaauaagcu

SEQ ID NO: 258406 - RNA, 63 nt, hsa
gaacuccuguccccuuagucaugagaacagaaagugcaauauuuccuuucaccuggcagggga

SEQ ID NO: 258407 - RNA, 63 nt, hsa; identical to SEQ ID NO: 87687

SEQ ID NO: 258408 - RNA, 63 nt, hsa; identical to SEQ ID NO: 87688

SEQ ID NO: 258409 - RNA, 63 nt, hsa
aggaauccaagugccuuucuguagccuccagaugugcaauaacgguaacuugacucuuccauc

SEQ ID NO: 258410 - RNA, 63 nt, hsa
uugcauuuuacgcaaacuuugagccuuucucuugugcaauaauuuacauguuguguauguuuu

SEQ ID NO: 258411 - RNA, 63 nt, hsa
caauccccaaccucugacugcaaugaccuuucugugcaauaaaagcuuauuguccauuaacau

SEQ ID NO: 258412 - RNA, 63 nt, hsa
acccaaagaauuuucaaaggaaaggguguuauagugcaauagcaauuaaaauauaucaaaucg

SEQ ID NO: 258413 - RNA, 63 nt, hsa
auuuuucuugcuuugaacccugucauaaugacugugcaauacaugugcagaagaugagguauu

SEQ ID NO: 258414 - RNA, 63 nt, hsa
auuauacuacucuaaauagcauauuucauccaagugcaauaauguaagcugaaucuuuuuugg

SEQ ID NO: 258415 - RNA, 63 nt, hsa
aacaaugaaaaccaacaccaacucaacaacaaagugcaauacaggcugaaccuggcccaacag

SEQ ID NO: 258416 - RNA, 63 nt, hsa
aagugacaugcauucacauaucugcuuaucagugugcaauacuguguaccucauggaugcuuu

SEQ ID NO: 258417 - RNA, 63 nt, hsa
uuguuugugugcaaaccaaacuuucuuuacccagugcaauagauuuguuugacugcuuguguc

SEQ ID NO: 258418 - RNA, 63 nt, hsa
caaaagcucaauguacugcccaagaggcaccuugugcaauauucccaucccugaauuuagcau

SEQ ID NO: 258419 - RNA, 63 nt, hsa
agaauagccaguauuuauguuuuuuauaaaacugugcaauacgaauuaugcaaucacaauaca

SEQ ID NO: 258420 - RNA, 63 nt, hsa
acuuacggaaauacacaaaugcuucucuguaaugugcaauaugcuuugcaacuguagaugaua

SEQ ID NO: 258421 - RNA, 63 nt, hsa; identical to SEQ ID NO: 87689

SEQ ID NO: 258422 - RNA, 63 nt, hsa; identical to SEQ ID NO: 87690

SEQ ID NO: 258423 - RNA, 63 nt, hsa
uugagggaccaucagauaacuguauuuugucaggugcaauaaaaacaaaauuaaaacccaaau

SEQ ID NO: 258424 - RNA, 63 nt, hsa
uaauuuaaaaauuaauauuuucuuauagauauugugcaauaaagcugaaguagaauguguggu

SEQ ID NO: 258425 - RNA, 63 nt, hsa
ucuugaaugcuuugucaaauuaagaaaguuaaagugcaauaauguuugaagacaauaaguggu

SEQ ID NO: 258426 - RNA, 63 nt, hsa
auuuauuuuuagggugauuuuuuaaaaagacuugugcaauacauuuugaggugaaacuuagug

SEQ ID NO: 258427 - RNA, 63 nt, hsa
uacaaguuugcaaauauuuuaacaauauuaaaugugcaauagaacuuuuauaaaauaauuaga

SEQ ID NO: 258428 - RNA, 63 nt, hsa
agcacaucguccuguuuuauugcuuucuacccugugcaauauuagcaugcaagcuuggcuuac

SEQ ID NO: 258429 - RNA, 63 nt, hsa
cuggcauauuuuggaauucugcacauucauggagugcaauaauacuguauagcuuuccccacc

SEQ ID NO: 258430 - RNA, 63 nt, hsa
cugauggugcauuuuauucuugaagugaaaucugugcaauaaaauaacagacugucugcaaaa

SEQ ID NO: 258431 - RNA, 63 nt, hsa
aucaauucauagcaguaacuuuaagagggcauugugcaauaguuaguuguuuucuuguucagc

SEQ ID NO: 258432 - RNA, 63 nt, hsa
uccuuuuuuuuuuuuuuauuucgguuguuugaugugcaauauguuuuuguaugcagguaguaa

SEQ ID NO: 258433 - RNA, 63 nt, hsa
acuaauuccaaccuucuaaauuuggcuaguaaagugcaauaaaggcauugauaaguucuguua

SEQ ID NO: 258434 - RNA, 63 nt, hsa
ccaggaggaggauugugcugauguagugaccaagugcaauaugggcgggcagucgcugcaggg

SEQ ID NO: 258435 - RNA, 63 nt, hsa
guugugugaagaugucaaaaaaagauuuuagaagugcaauauuuauaguguuauuuguuucac

SEQ ID NO: 258436 - RNA, 63 nt, hsa
uuuaaaaaaaauaaauaaaaauuaaaaaaaucugugcaauaauuuuaaaaugugcucccagga

SEQ ID NO: 258437 - RNA, 63 nt, hsa
uuuauguggaugaagagcauuuuuuaugcuuuugugcaauagguuccaauaugcauuuauuag

SEQ ID NO: 258438 - RNA, 63 nt, hsa
cagggcacuccccuguuuccuaagaacgaaaaagugcaauaaaggccauucguuaccuacuuu

SEQ ID NO: 258439 - RNA, 63 nt, hsa
uccauggaguugugcaaagcuauggcuuccuuggugcaauauucuuaaaaccugcuuugcaua

SEQ ID NO: 258440 - RNA, 63 nt, hsa
gaaggcugacuaaccucgauucuguguugugaugugcaauacuguuucuaauguuuguauaaa

SEQ ID NO: 258441 - RNA, 63 nt, hsa
uuaaaagcaacaaaagggauaccauguagaauugugcaauagucuagccagcuagccuuaaca

SEQ ID NO: 258442 - RNA, 63 nt, hsa
uuccuuaauaagaaaaguaauuuuuacucugaugugcaauacauuuguuauuaaauuuauuau

SEQ ID NO: 258443 - RNA, 63 nt, hsa
gcacaguguauucagacagauacagugaaccaagugcaauauguaaggaugaaagaagaagag

SEQ ID NO: 258444 - RNA, 63 nt, hsa
ggauggaguuucgcuguuguugcccaggcuggagugcaauagcacgaucuuggcucaccgcaa

SEQ ID NO: 258445 - RNA, 63 nt, hsa
gggccucuuucccagcuuucuugcuugccuucugugcaauauuucuuggagaauuuggaugcc

SEQ ID NO: 258446 - RNA, 63 nt, hsa
auuaguuaauauaugugaaaguauggaggagaugugcaauaaauauuuguguuauuaacuaca

SEQ ID NO: 258447 - RNA, 63 nt, hsa
cugugaacugcaaacuugcuuaugauugacuuggugcaauaaaguuccuuucuaaccauuucu

SEQ ID NO: 258448 - RNA, 63 nt, hsa
uucaguuuuggccuucugucagcagaaugauaagugcaauaguuguaaaucuacuugacacug

SEQ ID NO: 258449 - RNA, 63 nt, hsa
uucacuuagaaauuuuauuuucuuauaacuuaagugcaauaaaauguguuuuuucauguuagu

SEQ ID NO: 258450 - RNA, 63 nt, hsa
caucaguauaacugcauuucuaguuucuauauagugcaauagagcauagauucuauaaauucu

SEQ ID NO: 258451 - RNA, 63 nt, hsa
acguuuauucucuucagcuuuaacuauacuugagugcaauaaaaaacuuaauaaaauuuuaug

SEQ ID NO: 258452 - RNA, 63 nt, hsa
auugcugggauguuucugcccacgguuuuguuugugcaauaacguuaucacauuucuaaugag

SEQ ID NO: 258453 - RNA, 63 nt, hsa
uuuuucuauguaaauauugaaaacuuaugauuugugcaauaacucagauauuuuuuauuuaau

SEQ ID NO: 258454 - RNA, 63 nt, hsa
guaaaguaaaaugccuuauauauuaaagaguaagugcaauaauaugaaauagccuguacauuu

SEQ ID NO: 258455 - RNA, 63 nt, hsa
uacaguacuguuucuggacccuuauaaaauccugugcaauagacacauacaugucacauuuag

SEQ ID NO: 258456 - RNA, 63 nt, hsa
cauuugccuuauuuuugcaucucacaaacauaagugcaauagaucuuuucauugaacagcaaa

SEQ ID NO: 258457 - RNA, 63 nt, hsa
uuuuaaguuugcagauuuauuuagugaaggcaagugcaauaauccuuccucagaugauguuug

SEQ ID NO: 258458 - RNA, 63 nt, hsa
aaccugaaacugguaagacaagcacaaagcaacgugcaauacaaaaaucguaucucaagggaa

SEQ ID NO: 258459 - RNA, 63 nt, hsa
ugcaagaauuucuuuuaaauaaaaaguuugggggugcaauauaagaaguuuauauaauaugca

SEQ ID NO: 258460 - RNA, 63 nt, hsa
aaucauuggcuuuuauaccuuucuugguuugacgugcaauaaagaagcacauuauuuuagcuu

SEQ ID NO: 258461 - RNA, 63 nt, hsa
uuauaugcacauaauaaccuguaccuauaaaucgugcaauaaccauaugcgacuauuuugcca

SEQ ID NO: 258462 - RNA, 63 nt, hsa
gugaugaauuguggcaaguuaacuucaaguuaugugcaauacuuauuucaaacuuuugaaaga

SEQ ID NO: 258463 - RNA, 63 nt, hsa
aagucucacaguuggugauuucuccgcucuguggugcaauaucccuauuuguaggugaguugu

SEQ ID NO: 258464 - RNA, 63 nt, hsa; identical to SEQ ID NO: 87691

SEQ ID NO: 258465 - RNA, 63 nt, hsa; identical to SEQ ID NO: 87692

SEQ ID NO: 258466 - RNA, 63 nt, hsa
gaaaaguaaaauccaaaauguuagcaaaacaaagugcaauauuaaauguuugcuuuauagauu

SEQ ID NO: 258467 - RNA, 63 nt, hsa; identical to SEQ ID NO: 87693

SEQ ID NO: 258468 - RNA, 63 nt, hsa; identical to SEQ ID NO: 87694

SEQ ID NO: 258469 - RNA, 63 nt, hsa
gaaggggcguuuguuuuauucuugguguuuucagugcaauaaauagcuacaaacuucugugca

SEQ ID NO: 258470 - RNA, 63 nt, hsa
gacuaugaucugauggccucuagguguuguuuugugcaauauacagccccagguagggagggg

SEQ ID NO: 258471 - RNA, 63 nt, hsa
agauaccuaagcacuagaauauccagcuaaauggugcaauaggcuaggaauugagccaggaga

SEQ ID NO: 258472 - RNA, 63 nt, hsa
cacauggggaucagagcagacuucuccacuacugugcaauagagauacagcucucuucagagu

SEQ ID NO: 258473 - RNA, 63 nt, hsa
aauugccugagcccaggaguucaagaccagcuugugcaauauagggagacuccggcucuacaa

SEQ ID NO: 258474 - RNA, 63 nt, hsa
ugggaugucgggagaccuagaugaccuuaucgggugcaauacuagcuaagguaaagcuagaaa

SEQ ID NO: 258475 - RNA, 63 nt, hsa
uuuguuuuuaaacuuuuuuuugccauccauccugugcaauaugccguguagaauauuugucuu

SEQ ID NO: 258476 - RNA, 63 nt, hsa
gacauugauuuuuuuuuuuucguuuucuuucuugugcaauaccuacaauggugcuguguuuua

SEQ ID NO: 258477 - RNA, 63 nt, hsa
ugaaaaaaacugcaucccaucacccaaaguucugugcaauagaaauuucuacagauacaggua

SEQ ID NO: 258478 - RNA, 63 nt, hsa
uagcuugauaugguguuucagugcuuauugguugugcaauaaugguuauagccuguuagauaa

SEQ ID NO: 258479 - RNA, 63 nt, hsa
uugucccauuucauucucuugcuuuuuuagcaugugcaauacuuucugugccaauagagucug

SEQ ID NO: 258480 - RNA, 63 nt, hsa
ccagacugcauuaguauuuuggcauugaaacuugugcaauaucuguguaauguagaauguggg

SEQ ID NO: 258481 - RNA, 63 nt, hsa
uauuaacuagguaugaaguauaaacccauuuuggugcaauauucuugacuccuuggugcuaaa

SEQ ID NO: 258482 - RNA, 63 nt, hsa
cucugcccaaaagcagcagacauguaagcagaugugcaauaaaaaaugaucuugauccauuuc

SEQ ID NO: 258483 - RNA, 63 nt, hsa
ccauggaagauacuagcccagccuagcagaaaagugcaauauguauagcauacuuugacauuu

SEQ ID NO: 258484 - RNA, 63 nt, hsa
acagcauagcugaaaguugccaaacuggacauugugcaauaaaguagaauucuauauugauaa

SEQ ID NO: 258485 - RNA, 63 nt, hsa
uagcauaacuuauaucuguauuuaaggacuuuugugcaauauggucuuaagaaauaauugcca

SEQ ID NO: 258486 - RNA, 63 nt, hsa
ggcgcaucagauagucucuguguaccuggauuugugcaauauguaaaaauguaucaaauguau

SEQ ID NO: 258487 - RNA, 63 nt, hsa
uuuugggaugucagcaguggccugaagugaguugugcaauaaauguuaaguugaaaccuccuu

SEQ ID NO: 258488 - RNA, 63 nt, hsa
caaaagagaaaaagaaggauugaucagagcauugugcaauacaguuucauuaacuccuucccc

SEQ ID NO: 258489 - RNA, 63 nt, hsa
aaccagccaguaauuucugugcaaccuuacuaugugcaauauuuuuaaauccugagaaaugug

SEQ ID NO: 258490 - RNA, 63 nt, hsa
uggagggauauccccuuggauuucacuugcauugugcaauaagcaaagaaggguugauaaaag

SEQ ID NO: 258491 - RNA, 63 nt, hsa
auuuuuguugccuuuuuugcuuuuuuuuaaucugugcaauaccucauuuaaucuguaaagguu

SEQ ID NO: 258492 - RNA, 63 nt, hsa
auggaauguuaccuguccguguuacauaaucaagugcaauauacucaguucucaugcagguga

SEQ ID NO: 258493 - RNA, 63 nt, hsa
gaauaaauuaaaaacaguauuugggggagaaacgugcaauagcguaaugguggugucccugcc

SEQ ID NO: 258494 - RNA, 63 nt, hsa
uuaaauuuauuuuaacguagacacuaaaaguaugugcaauauacaauuaaaguaggaauuugu

SEQ ID NO: 258495 - RNA, 63 nt, hsa
ccuguuggucucucuguguucuuuguuacuugggugcaauagcaacuucccuaccccgugcau

SEQ ID NO: 258496 - RNA, 63 nt, hsa
cccaugggggcuccagacauuguauuuuacuuugugcaauaugaggggacugcaugcaagcuc

SEQ ID NO: 258497 - RNA, 63 nt, hsa
caucugcuaccugauuuuauccuggagaauacagugcaauauuucucuuugauuauuuauucc

SEQ ID NO: 258498 - RNA, 63 nt, hsa
ucauucauuccuguuaagcugccaaaaauuaaagugcaauauuguauauuuuuaagaacaaau

SEQ ID NO: 258499 - RNA, 63 nt, hsa
uaccuguagguggagcaaguaauaagccaugcugugcaauauauacauaaagcuucugcuucu

SEQ ID NO: 258500 - RNA, 63 nt, hsa
aagaauguuauccaacuauuaagauaucucaaugugcaauaacuuguguauuagauaucaaug

SEQ ID NO: 258501 - RNA, 63 nt, hsa
aaaauaauguaaaugucuucuauuaaauguugagugcaauaaaauacagaagaauucucuaua

SEQ ID NO: 258502 - RNA, 63 nt, hsa
agcuuuuggaaaagcuccagguccucauguauugugcaauaacaaugacuuccuuggcgguuu

SEQ ID NO: 258503 - RNA, 63 nt, hsa
uuacuugccuggauugcuuuaaaauuaaccuuugugcaauaccaagaaaauagcucuuuaaaa

SEQ ID NO: 258504 - RNA, 63 nt, hsa
cagaagaugauuuuaacaguucagaacagaugugugcaauauuggugcauguaauaauguuga

SEQ ID NO: 258505 - RNA, 63 nt, hsa
aacccuugccucaucaguuuuccugauuuacaagugcaauauuuuagccaaugccuugggaga

SEQ ID NO: 258506 - RNA, 63 nt, hsa
uuaaaucuccaacuugcuguuuccaaaaagaaggugcaauaucauauaucaucaguuagcaau

SEQ ID NO: 258507 - RNA, 63 nt, hsa
gcagacagucuguuaugcacugugguuucagaugugcaauaauuuguacaaugguuuauuccc

SEQ ID NO: 258508 - RNA, 63 nt, hsa
ucucauucaugauguugauuuuuuuucaauguggugcaauauauacaauaaaauuugucauaa

SEQ ID NO: 258509 - RNA, 63 nt, hsa
gcaaucacaaacuaaagacugcggcuuguugaggugcaauacccugacucccaaaguuaguua

SEQ ID NO: 258510 - RNA, 63 nt, hsa
agauggaguuucacucuuguugcccaggcuggagugcaauagcaugaucucggcucacugcaa

SEQ ID NO: 258511 - RNA, 63 nt, hsa
uucuugaaaacugcuguagcaaauucaucuguggugcaauacacuuuuugauuaaagcucuuc

SEQ ID NO: 258512 - RNA, 63 nt, hsa
uuucccccccaaaugguugcguccuuugaaccugugcaauaugaggccaaauuuaaucuuuga

SEQ ID NO: 258513 - RNA, 63 nt, hsa
cgcugccacacacuacaggagucaauaaacaaggugcaauauuuucaaaucguuggccggcua

SEQ ID NO: 258514 - RNA, 63 nt, hsa
uuuguuuuuaagacucauggacauuucauaccugugcaauacugaagaccucauucugucaug

SEQ ID NO: 258515 - RNA, 63 nt, hsa
cucugaaccgaauguuuuggacuuaacuguugcgugcaauaugaccgucggcacacugcuguu

SEQ ID NO: 258516 - RNA, 63 nt, hsa
uagagauaccagaaugcugguauucuacuacuugugcaauauauauguuuuaaaaaacaaauu

SEQ ID NO: 258517 - RNA, 63 nt, hsa
caucaacuaguucuuccauguaaaauaauuuuagugcaauaugaagacguagaaauguaaaau

SEQ ID NO: 258518 - RNA, 63 nt, hsa
uuuccagccugaagccugcuuaaacugugugaugugcaauaacugagcuuagaguuaggaauu

SEQ ID NO: 258519 - RNA, 63 nt, hsa
ucuugguagaugucccuagacgggcugagccaugugcaauaagaacauagauccuaaaggauc

SEQ ID NO: 258520 - RNA, 63 nt, hsa
ggcuauaaccuaaccucgacuauuuguuguuaugugcaauacuguuuguacuguuuguauaaa

SEQ ID NO: 258521 - RNA, 63 nt, hsa
guuguuagcaucuuuguaugcacaucacuguuugugcaauauaugaauauuuuguugcauugu

SEQ ID NO: 258522 - RNA, 63 nt, hsa
ggcacugucuuugaugcagugauguacuuaauggugcaauaaagcugcuucgauuugguuucc

SEQ ID NO: 258523 - RNA, 63 nt, hsa
acugaaagcuuugaugaaauuuguuuuuguauggugcaauaugacagccugucauugaaucua

SEQ ID NO: 258524 - RNA, 63 nt, hsa
uguugagugagcugcuaugacuuugguagagaggugcaauauguuuuuugaaccagcuauaaa

SEQ ID NO: 258525 - RNA, 63 nt, hsa
aaaaauugucugaaauguuuauuuugcaaaacagugcaauagaaucuaguuaugccuucauca

SEQ ID NO: 258526 - RNA, 63 nt, hsa
gaccuccuuauguauucucaauuaccuguauuugugcaauaaauuggaauaauguaacuugau

SEQ ID NO: 258527 - RNA, 63 nt, hsa
gggucuggaccccacggggcuggggagggccaugugcaauauuuggaggguuuucuggagggc

SEQ ID NO: 258528 - RNA, 63 nt, hsa
caccuuuggugggggcagggccugguggcaccugugcaauaaugucuguguuucucucccacc

SEQ ID NO: 258529 - RNA, 63 nt, hsa
uagauauauuauuugcagcaagaaguucauucugugcaauauggacauguuugcaaaccauac

SEQ ID NO: 258530 - RNA, 63 nt, hsa
aucuguguuauucuuaguacccacugauaaauugugcaauaaauaaucuuucgcaagugauuu

SEQ ID NO: 258531 - RNA, 63 nt, hsa
gagauuuagaucuggaccaggcuguggguagaugugcaauagaaauagcuaauuuauuucccc

SEQ ID NO: 258532 - RNA, 63 nt, hsa
uuacuuuugucagaaucaaggcuucggccaccugugcaauauuuucccauggaaugcagcagu

SEQ ID NO: 258533 - RNA, 63 nt, hsa
aaugcuuuaucuguguuuucuguaaauaaaagagugcaauaaucucugugugugauugcagga

SEQ ID NO: 258534 - RNA, 63 nt, hsa
gacucagaaacgagaucgggaagcagaaauauagugcaauagugcaacaucucugaauccuuu

SEQ ID NO: 258535 - RNA, 63 nt, hsa
gaauugcacugaacagaauuaagaaauacucaugugcaauaggugagagaauguauuuucaua

SEQ ID NO: 258536 - RNA, 63 nt, hsa
aaaaauugauacaacuaugcagauuuuauaaaugugcaauaaaaguauuuguuuuaccuuugg

SEQ ID NO: 258537 - RNA, 63 nt, hsa
uaccuuuuucuaugaaaaaagacccagcgccgugugcaauaaagguuauguuucuauguggug

SEQ ID NO: 258538 - RNA, 63 nt, hsa
guccuguagcuugauauuacagaugugcuauuagugcaauaaggugaaggcugucugcccaga

SEQ ID NO: 258539 - RNA, 63 nt, hsa
gggagguauaacccugcuccucucucccagucugugcaauaaaggucgugaagaucucucagc

SEQ ID NO: 258540 - RNA, 63 nt, hsa
aagauauauguauauaaaguguaugcuguauuggugcaauaaugguaauuaaaaauaugaaaa

SEQ ID NO: 258541 - RNA, 63 nt, hsa
cugaguuuuuuauuuuuaaguguuuguuuuucagugcaauaauuuuugugugugugugauucu

SEQ ID NO: 258542 - RNA, 63 nt, hsa
ugggcugccagcaguacgugggaaagguggaaugugcaauaggaacagaucugugcauuuugu

SEQ ID NO: 258543 - RNA, 63 nt, hsa
cgcgaacaucacaccguuccccgaccaagccgugugcaauacaacagagggaggcagguggga

SEQ ID NO: 258544 - RNA, 63 nt, hsa
aaugggguggaacacagcauuuugucaagcacugugcaauauuccauauuuuuccccacuaug

SEQ ID NO: 258545 - RNA, 63 nt, hsa
guaaucuuuuacgggugggaggugagauugauagugcaauaaucagugaucuauagacccuca

SEQ ID NO: 258546 - RNA, 63 nt, hsa
ccaucaaaccucacauuugugaacucaaacgaugugcaauacauuuuuuucucuuuccuugaa

SEQ ID NO: 258547 - RNA, 63 nt, hsa
uagaguagaagauuugaugcuggagagguuaaggugcaauaagaauuuagggagaaauguugu

SEQ ID NO: 258548 - RNA, 63 nt, hsa; identical to SEQ ID NO: 87695

SEQ ID NO: 258549 - RNA, 63 nt, hsa; identical to SEQ ID NO: 87696

SEQ ID NO: 258550 - RNA, 63 nt, hsa; identical to SEQ ID NO: 87697

SEQ ID NO: 258551 - RNA, 63 nt, hsa
agacauaaaaccuuuuuuuaauaauaaaauauugugcaauauauucaaagaaaagaaaacaca

SEQ ID NO: 258552 - RNA, 63 nt, hsa
guggguggagaguggagugcgcugggacguugugugcaauagagaggucuccacaccagaugu

SEQ ID NO: 258553 - RNA, 63 nt, hsa
gccauccccauagccauguuuacaugauuugaugugcaauagggugggguaggggcagggaaa

SEQ ID NO: 258554 - RNA, 63 nt, hsa
uucacagaaagugcauuuuaaccaguacucugggugcaauaaauaauauguagaaauuuaagu

SEQ ID NO: 258555 - RNA, 63 nt, hsa
agacacccaggacuuauuuaaacucuguugcaagugcaauaaaucugacccagugcccccacu

SEQ ID NO: 258556 - RNA, 63 nt, hsa
aauugcuugguggaacauaugcuuucacuguuugugcaauaugcauuuauuucuuauaugaau

SEQ ID NO: 258557 - RNA, 63 nt, hsa
aggagacaucaggucccccuggauucaaauuaagugcaauauuuugcaaacagcucuucuuag

SEQ ID NO: 258558 - RNA, 63 nt, hsa
aaaaucagcgucauuuguucccugccaagcaucgugcaauaagugaauuuccuggccuacuuc

SEQ ID NO: 258559 - RNA, 63 nt, hsa
aauguaagugugcuugggaauuccuuaaauuuugugcaauaaacuauuuuuugguaaagauuu

SEQ ID NO: 258560 - RNA, 63 nt, hsa
uuucuuuuuuuuuuuuuuuguguagaaaaauaggugcaauaaugaucaaaguuuugaugucuu

SEQ ID NO: 258561 - RNA, 63 nt, hsa
agacaugcagugaaaugguucuuuguuaaaaaugugcaauaaaaauagauuacaauaaguagu

SEQ ID NO: 258562 - RNA, 63 nt, hsa
uuuguugagaggaaaagugaauugguuaaaagagugcaauaaggauccaaauacagugacuuu

SEQ ID NO: 258563 - RNA, 63 nt, hsa
ggguuguuuucuguuaagcaaagccgagauccagugcaauaccuggacugucaccguccugug

SEQ ID NO: 258564 - RNA, 62 nt, hsa
auaaaaacugaagaacauugaugagaaaucucugugcaauaauguaaaaaaaaaaaaagaua

SEQ ID NO: 258565 - RNA, 63 nt, hsa
cuagguuaaguuugagccugaaauuuuaaugaagugcaauacugagugugccucauuaucuug

SEQ ID NO: 258566 - RNA, 63 nt, hsa
acacuuuaauguuuuauucuuguacauaaaaaugugcaauauggagauguauacagucuuuac

SEQ ID NO: 258567 - RNA, 63 nt, hsa
uuuguauauuuauucuauuuuguauauuguuaagugcaauaaaguuuuugccuugcuuuauuu

SEQ ID NO: 258568 - RNA, 63 nt, hsa
gcugauguacacacauuucauuauuugccaauggugcaauaaccacugcugaccaacccacua

SEQ ID NO: 258569 - RNA, 63 nt, hsa
ucugguuuuaauuuuuaguugugcuuugagucagugcaauaaacuagacuuuuuccaaaccug

SEQ ID NO: 258570 - RNA, 63 nt, hsa
guauuuggagaaacaggaguguucacuuaucuagugcaauauguucacaguuuauuaaugcuu

SEQ ID NO: 258571 - RNA, 63 nt, hsa
uguuggcuacaucauuuuguguugaauaauaaagugcaauacuuuauucuccauaauuaaacu

SEQ ID NO: 258572 - RNA, 63 nt, hsa
agaaaauuguauaaccauccugcuguuccuuuagugcaauacaauaaaacucugaaauuaaga

SEQ ID NO: 258573 - RNA, 63 nt, hsa
uuauuuuguuuauuauuuucauguuugaguucugugcaauauuuucuauuauguccguugaua

SEQ ID NO: 258574 - RNA, 63 nt, hsa
aaauaaauaccagguaugaaauuacugauuuuagugcaauaucuguaugauuauccagaacua

SEQ ID NO: 258575 - RNA, 63 nt, hsa
aguuuucuaaauguuucuuuuucuuuuuugagugugcaauauguaacaugucuaaaguuaggg

SEQ ID NO: 258576 - RNA, 63 nt, hsa
uuaaggcaguacaaauuguggagccuuuuaacugugcaauaauuucuguauuuauuggguuuu

SEQ ID NO: 258577 - RNA, 63 nt, hsa
ucuguaggaagaaucaaaucaccgauuuaaagagugcaauauauaauaaucauuuuuaaagua

SEQ ID NO: 258578 - RNA, 63 nt, hsa
accuuuuccuguggaaaccugucauagaauuuugugcaauauguaugugucuaugaagcuguc

SEQ ID NO: 258579 - RNA, 63 nt, hsa
gagucagagucucgcucucuuguccaggcuggagugcaauagcgcgaucugggcucacugcaa

SEQ ID NO: 258580 - RNA, 63 nt, hsa
acauacucuuuguauauauuuauuauaugaaaggugcaauauuuuauuuuguacaguauguaa

SEQ ID NO: 258581 - RNA, 63 nt, hsa
ucuguuuaaacugugauuuucuuuauuguguuggugcaauauuuuauuaucauuuaaccucag

SEQ ID NO: 258582 - RNA, 63 nt, hsa
ccaguguauucuguuuuuaaaacugugccugcagugcaauacuccuucugguguauuuuaucc

SEQ ID NO: 258583 - RNA, 63 nt, hsa
uguaccucucauuuucagucagggacauacuuugugcaauauuucugugauugugccuaugca

SEQ ID NO: 258584 - RNA, 63 nt, hsa
agaggaucaccagugcauccuucaucacagcaugugcaauaugccaagauuacccucggucau

SEQ ID NO: 258585 - RNA, 63 nt, hsa
ugcuacuguauuugucucaaagcuaccaaguuugugcaauaaguggaagggaugucauccuuc

SEQ ID NO: 258586 - RNA, 63 nt, hsa
ugaauaugugcuuuuacuguacauagugcuauugugcaauaggucuuaugcuguuuucacuca

SEQ ID NO: 258587 - RNA, 63 nt, hsa
gcccgccccuugccucgauauugccaguuucuugugcaauaaacaaucagcagcugugggugg

SEQ ID NO: 258588 - RNA, 63 nt, hsa
gcgcccgcggguccuccccaccugcugcuccccgugcaauaccugcugggccuccugcccgcg

SEQ ID NO: 258589 - RNA, 63 nt, hsa
gugugcguggcuaucaggaguucuaggaacucagugcaauacgggagugacccagcuacugaa

SEQ ID NO: 258590 - RNA, 63 nt, hsa; identical to SEQ ID NO: 87698

SEQ ID NO: 258591 - RNA, 63 nt, hsa; identical to SEQ ID NO: 87699

SEQ ID NO: 258592 - RNA, 63 nt, hsa
ccuucucagugguuuacaugccucugaaacuaugugcaauauuuuugguugacacuuguaucc

SEQ ID NO: 258593 - RNA, 63 nt, hsa
aagaaacaaacauugaauuacuaaacaaagauggugcaauaucuuuguuuuuuuuuuaugagg

SEQ ID NO: 258594 - RNA, 63 nt, hsa
cuaccuucaacaugugcucgcucugcaugauuagugcaauaaaacucccuuccuuaugcauac

SEQ ID NO: 258595 - RNA, 63 nt, hsa
ugggugguugggagagaaacuagaacagaagaugugcaauagggcucagagcagccccaggaa

SEQ ID NO: 258596 - RNA, 63 nt, hsa
aguugcguugaggccgcaucuuucuucagcagcgugcaauagcuggcuccucuauaggagaug

SEQ ID NO: 258597 - RNA, 63 nt, hsa
ucugugacucucuuggaaaugccuugacugaaugugcaauauuugugucucuugguuucuaac

SEQ ID NO: 258598 - RNA, 63 nt, hsa
uuuugucaguuuguuugccuuacucauuucuaagugcaauaagggagugucucacaggauugc

SEQ ID NO: 258599 - RNA, 63 nt, hsa
uuggacccagggccugagaccuuugugggauuugugcaauaaaguguuuuuauuuaaaaccaa

SEQ ID NO: 258600 - RNA, 63 nt, hsa
augugucagaacauucagaagaagucugaagaagugcaauauguuagauacucagcagaagua

SEQ ID NO: 258601 - RNA, 63 nt, hsa
gugcagcuguaggucgucaucaccuaaccacacgugcaauaaaguccucgugccugcugcuca

SEQ ID NO: 258602 - RNA, 63 nt, hsa
auuggacccugacuguauacagaaugaaaggcagugcaauauuuagcugcuaacaagacuggc

SEQ ID NO: 258603 - RNA, 63 nt, hsa
uguaaucguaaauauuaauuuuguaccuauauugugcaauacuugaaaaaaacgguauaaaag

SEQ ID NO: 258604 - RNA, 63 nt, hsa
uuucuaaauuacuaugucagguuguaaaagucagugcaauaacaaaccuuccuuuuuaagaag

SEQ ID NO: 258605 - RNA, 63 nt, hsa
cacguguccuggucacuggucuuuauaauuguugugcaauaacuaaaggcuaaggacuagaug

SEQ ID NO: 258606 - RNA, 63 nt, hsa
uccccuucccuuuuuuuguuauuuuuucagacugugcaauacuuagagaaccuauagcaucuu

SEQ ID NO: 258607 - RNA, 63 nt, hsa
ugaugauuucuuuucccugcacacaucuuuccggugcaauaucuaucaauugugaaucuggcu

SEQ ID NO: 258608 - RNA, 63 nt, hsa
gcugcuugcagcaacuugauuuccccaaguccugugcaauagccccaggauuggauuccuuca

SEQ ID NO: 258609 - RNA, 63 nt, hsa
gaaaccaauuuuuuuaguuauuguucaaggagggugcaauauuaaguguuuuggaauuugaag

SEQ ID NO: 258610 - RNA, 63 nt, hsa
acauuuggguauaaugacaacagccaauuuauagugcaauaaaauguaauuaauucaaguccu

SEQ ID NO: 258611 - RNA, 63 nt, hsa
gguggcccccguccgaggaggaucguuuucuaagugcaauacuuggcccgccggcuucccgcu

SEQ ID NO: 258612 - RNA, 63 nt, hsa
gauccuccuugacgaguuuuguuuuucaaaauggugcaauaauuuaaguggcaucuucucucc

SEQ ID NO: 258613 - RNA, 63 nt, hsa
gcccccuuccccagaacaaaacauguugaucaugugcaauauuucuuacugugccgagaagcc

SEQ ID NO: 258614 - RNA, 60 nt, hsa; identical to SEQ ID NO: 258327

SEQ ID NO: 258615 - RNA, 63 nt, hsa
gcugguccuuagccccaugccucuuccaaaacagugcaauaaaucuccgguaacccguccacc

SEQ ID NO: 258616 - RNA, 63 nt, hsa
cgacacguccccguucccccgaaaccuggcucagugcaauacucccauugccaugggguccuu

SEQ ID NO: 258617 - RNA, 63 nt, hsa
auuuuaaggauugacaagaguuuauuuucuauugugcaauaucuuaaaggaagcaaccaccuu

SEQ ID NO: 258618 - RNA, 63 nt, hsa
cagccuccugauuucauaaccaggccggaccacgugcaauaggguggaaaccaaacugcucca

SEQ ID NO: 258619 - RNA, 63 nt, hsa
agcacucgccucccuaccaaugacucaccugaagugcaauacgaaauaaaaggccagcgggcg

SEQ ID NO: 258620 - RNA, 63 nt, hsa
ccuucuaagacccacgagcggggugagagaagugugcaauagucuggaauaaauauaaaugaa

SEQ ID NO: 258621 - RNA, 63 nt, hsa
ccucagccaggugggccuguauauaggguccaugugcaauagggagggacgucuucuauuuuu

SEQ ID NO: 258622 - RNA, 63 nt, hsa
acugucuaauauaggaaaaacacaugagaacaggugcaauauauugacuuaaacuuguuuagc

SEQ ID NO: 258623 - RNA, 63 nt, hsa
gggugcccacagaggcucagcuccuucuuuucugugcaauacgagacccggccgcaccccgag

SEQ ID NO: 258624 - RNA, 63 nt, hsa; identical to SEQ ID NO: 87700

SEQ ID NO: 258625 - RNA, 63 nt, hsa; identical to SEQ ID NO: 87701

SEQ ID NO: 258626 - RNA, 63 nt, hsa
ggguuggguuugggguucaggaugcugcagucugugcaauaauaaacccgcaucugcucacgg

SEQ ID NO: 258627 - RNA, 63 nt, hsa
auauuaaauucaaauaucccauaucuaaauuuagugcaauaucuugucuuuuguauaggucau

SEQ ID NO: 258628 - RNA, 63 nt, hsa
cacucugcccugaccccgaucaguuaaggagcugugcaauaaccuuccuaguaccugagugag

SEQ ID NO: 258629 - RNA, 63 nt, hsa
aucaaucacaacagguaauagcaauagacguuagugcaauacaaagucacccucaauaaauac

SEQ ID NO: 258630 - RNA, 63 nt, hsa
uuugcugucagccacauauugagaugacacuaggugcaauagcagggauagauuuuguuggug

SEQ ID NO: 258631 - RNA, 63 nt, hsa
gcuacaaauagugcuaauaaaguuaaauugcacgugcaauacggaacacugucaauggacugc

SEQ ID NO: 258632 - RNA, 63 nt, hsa
agcuaagagaauugggcauuaguauuucauuaugugcaauaagucauuguaagugcacugaua

SEQ ID NO: 258633 - RNA, 63 nt, hsa
gguccaacaagaacaccugacuugggugaaguugugcaauauuggaggcugacuguagggcug

SEQ ID NO: 258634 - RNA, 63 nt, hsa
acuuuccacuggaguucacuuucaauugcuucugugcaauaaaaccaagugcuuauaaaauga

SEQ ID NO: 258635 - RNA, 63 nt, hsa
uuagcccagauacacauacucuuuuuugucuuugugcaauaaucaguguuccuggcagagccu

SEQ ID NO: 258636 - RNA, 63 nt, hsa
uacuccagagcuccuuuaacaucugcuaauuaagugcaauaaauuuuucuagaaaauggcaaa

SEQ ID NO: 258637 - RNA, 63 nt, hsa
gaauacaaucaaggguuuuguauucagaauguugugcaauauuuuggaaugggacauuggugu

SEQ ID NO: 258638 - RNA, 63 nt, hsa
gcucucuguugugagaucuucagcuaccucauggugcaauaacacacacacgcuuaaccaugu

SEQ ID NO: 258639 - RNA, 63 nt, hsa
aguggcauaggaagacggcaaaaauuuccuaaagugcaauagauuuucaaguguauugugccu

SEQ ID NO: 258640 - RNA, 63 nt, hsa; identical to SEQ ID NO: 87702

SEQ ID NO: 258641 - RNA, 63 nt, hsa; identical to SEQ ID NO: 87703

SEQ ID NO: 258642 - RNA, 63 nt, hsa
gacgcuugguuuuucucagaacccccaaaagaugugcaauagcuguuguuacaaaccaccaaa

SEQ ID NO: 258643 - RNA, 63 nt, hsa
auuggauuuuauguugacauuuguuugguuauagugcaauauauuuuguaugcaagcaguuuc

SEQ ID NO: 258644 - RNA, 63 nt, hsa
agauggaguuucacucuuguugcccaggcuggagugcaauagcucgaucucggcucacugcaa

SEQ ID NO: 258645 - RNA, 63 nt, hsa
aauaguuguuuacuagugugcuagaugaaaagcgugcaauaugcuuuaaagcuaucaacaaaa

SEQ ID NO: 258646 - RNA, 63 nt, hsa
agaaacugaggguuaucuuugacacagaauugugugcaauauucuuaaauacuacugcucuaa

SEQ ID NO: 258647 - RNA, 63 nt, hsa
auuguaauaggcauuuuuuuuuuuuuuuacaaugugcaauaacucagcaguuaaauaguggaa

SEQ ID NO: 258648 - RNA, 63 nt, hsa
ugcaacuuucuauaaugccaaaaugacacaucugugcaauagaaugaugucugcucuagggaa

SEQ ID NO: 258649 - RNA, 63 nt, hsa
uaugcagcauuaacuuuacugacauggagugaagugcaauauuauaaauauuauagauuaaaa

SEQ ID NO: 258650 - RNA, 63 nt, hsa; identical to SEQ ID NO: 87702

SEQ ID NO: 258651 - RNA, 63 nt, hsa; identical to SEQ ID NO: 87703

SEQ ID NO: 258652 - RNA, 63 nt, hsa
aauggcauaagaaguugacaaaaauuucuuaaagugcaauagauuuucaaguguauugugccu

SEQ ID NO: 258653 - RNA, 63 nt, hsa
gaagggacuuaauuacaaacuuaagacguaagugugcaauaaaguaagcuaagaagaaaauau

SEQ ID NO: 258654 - RNA, 64 nt, hsa
acauaaagcaaauuuggaggaaacaacugaaguugugcaauauuuucugauaauugcuuuuuuu

SEQ ID NO: 258655 - RNA, 64 nt, hsa
ccuagaccccucuuccucucucccccaccauagugugcaauaaagugucuguucuuaccaaacc

SEQ ID NO: 258656 - RNA, 64 nt, hsa
uuugccguguaugaggagugcuagaaaaugcaaagugcaauauuuucccuaaccuucaaaugug

SEQ ID NO: 258657 - RNA, 64 nt, hsa
gagaccaagcaucuaucugauagaagcacauggagugcaauaggacauugugagaaggaauuuu

SEQ ID NO: 258658 - RNA, 64 nt, hsa; identical to SEQ ID NO: 169421

SEQ ID NO: 258659 - RNA, 64 nt, hsa; identical to SEQ ID NO: 169422

SEQ ID NO: 258660 - RNA, 64 nt, hsa
auuugugaugccuucccuccccuagaaagauuuugugcaauauauuaaauggggacagaauucu

SEQ ID NO: 258661 - RNA, 64 nt, hsa; identical to SEQ ID NO: 169423

SEQ ID NO: 258662 - RNA, 64 nt, hsa; identical to SEQ ID NO: 169424

SEQ ID NO: 258663 - RNA, 64 nt, hsa
augaaauaauagggcauuuaacaaagaucgcuaugugcaauacuguauuuaguguuucuauuuc

SEQ ID NO: 258664 - RNA, 64 nt, hsa
gcccuuuugcuggggcugccaucuugaaaucugagugcaauaggauuugcuuguaacaguuauu

SEQ ID NO: 258665 - RNA, 64 nt, hsa
cuuccccuugucccuggggcacucccccaggauugugcaauagucagagugucccuuuuugcag

SEQ ID NO: 258666 - RNA, 64 nt, hsa
uaaagaauagaccaugggcuacuacugggcauuagugcaauauaacagcgauaauaaaauucuc

SEQ ID NO: 258667 - RNA, 64 nt, hsa
gaaaauugaauuuucuucagacaaaacugcucuugugcaauauuuuaugcucagugagcaaauu

SEQ ID NO: 258668 - RNA, 64 nt, hsa
ugaaauagguuaaaucuuauauaaauauuacuuugugcaauauuguuguguaguuaaaugcaua

SEQ ID NO: 258669 - RNA, 64 nt, hsa
cauucuaagaccagauucucuaauguuucugggugugcaauagagugaucacaucuuuguuucu

SEQ ID NO: 258670 - RNA, 61 nt, hsa; identical to SEQ ID NO: 258096

SEQ ID NO: 258671 - RNA, 64 nt, hsa
ugucaguugagauuaaaaguaaggaacagagaaugugcaauaccgucuggcugggggcuguccc

SEQ ID NO: 258672 - RNA, 64 nt, hsa; identical to SEQ ID NO: 169425

SEQ ID NO: 258673 - RNA, 64 nt, hsa; identical to SEQ ID NO: 169426

SEQ ID NO: 258674 - RNA, 64 nt, hsa
ggaacugaccauuauaugccuucacuggcuucuugugcaauaauaugauguuuuaagugugcaa

SEQ ID NO: 258675 - RNA, 64 nt, hsa
gagaaaauaugcagaauaacuggucuuguuaagagugcaauauuauauuuuuauguaaaaauaa

SEQ ID NO: 258676 - RNA, 64 nt, hsa
aaaaaggcacauaguuuaaaaaguuucucauuuugugcaauauaaucuaaauaaaguacagacc

SEQ ID NO: 258677 - RNA, 64 nt, hsa
gaaaucaguuaagauaaagcugcauuguauauaagugcaauauauuuuugaaggucuguaaaug

SEQ ID NO: 258678 - RNA, 64 nt, hsa
ucugcuggggcugacuuguccagaaggggacaaagugcaauacagagccuucccuacccugacg

SEQ ID NO: 258679 - RNA, 64 nt, hsa
uagucuaugaaagaauaauuauaauaauguccaggugcaauacucuguaagucuauugguucaa

SEQ ID NO: 258680 - RNA, 64 nt, hsa
cuguuucuugaauauauauuuuugaaguuuuuuugugcaauauauuacuaaaucaguuauuauu

SEQ ID NO: 258681 - RNA, 64 nt, hsa
uugaagagaaucccaaaaguuaguucaucuuaaagugcaauauuguuuaaucuuaaaacugggc

SEQ ID NO: 258682 - RNA, 64 nt, hsa
guugcuauguugauguguaagugaaaucaguugugugcaauagacaggggcguauucaugggag

SEQ ID NO: 258683 - RNA, 64 nt, hsa
cagggacaucaucucuuccaucuuuggguccuuagugcaauaccuggcagcuagccagugcuca

SEQ ID NO: 258684 - RNA, 64 nt, hsa
caccugguuacaacuugcugguggguuuuauguugugcaauacuaggaggaggaggcaggugau

SEQ ID NO: 258685 - RNA, 64 nt, hsa
aggucuugaugugcauagcuucugauaacccugugugcaauaauaugauuugcagggcauuucu

SEQ ID NO: 258686 - RNA, 64 nt, hsa
ccacucaacagauguagugugacaaguauaauaugugcaauaaucauuguuucucuuaugauuu

SEQ ID NO: 258687 - RNA, 64 nt, hsa
cccucaacccaaauccaccuucauacuguaaguagugcaauacuuguuucauuucuguguuuaa

SEQ ID NO: 258688 - RNA, 64 nt, hsa
guguuucaacggaaagugcugucuuaaacuaaaugugcaauagaaggugauguugccauccuac

SEQ ID NO: 258689 - RNA, 64 nt, hsa
aucuuaaaacacugaccucuaugagguauuuacugugcaauaacugauucauuuuuuucagagc

SEQ ID NO: 258690 - RNA, 64 nt, hsa
cugaaucuuugauguuuuuugucauuguucucaagugcaauauaacaauguaaccaaaucuaga

SEQ ID NO: 258691 - RNA, 64 nt, hsa
gccauucagauagcaguaaaacauucuguaugaugugcaauaaaacauccaagaucuuuuuuga

SEQ ID NO: 258692 - RNA, 64 nt, hsa
guuggacaucuuuucucuuguguuuuguuugaaugugcaauaguuuauaggccacaaauaagcu

SEQ ID NO: 258693 - RNA, 64 nt, hsa
ggaacuccuguccccuuagucaugagaacagaaagugcaauauuuccuuucaccuggcagggga

SEQ ID NO: 258694 - RNA, 64 nt, hsa; identical to SEQ ID NO: 169427

SEQ ID NO: 258695 - RNA, 64 nt, hsa; identical to SEQ ID NO: 169428

SEQ ID NO: 258696 - RNA, 64 nt, hsa
aaggaauccaagugccuuucuguagccuccagaugugcaauaacgguaacuugacucuuccauc

SEQ ID NO: 258697 - RNA, 64 nt, hsa
auugcauuuuacgcaaacuuugagccuuucucuugugcaauaauuuacauguuguguauguuuu

SEQ ID NO: 258698 - RNA, 64 nt, hsa
gcaauccccaaccucugacugcaaugaccuuucugugcaauaaaagcuuauuguccauuaacau

SEQ ID NO: 258699 - RNA, 64 nt, hsa
cacccaaagaauuuucaaaggaaaggguguuauagugcaauagcaauuaaaauauaucaaaucg

SEQ ID NO: 258700 - RNA, 64 nt, hsa
aauuuuucuugcuuugaacccugucauaaugacugugcaauacaugugcagaagaugagguauu

SEQ ID NO: 258701 - RNA, 64 nt, hsa
uauuauacuacucuaaauagcauauuucauccaagugcaauaauguaagcugaaucuuuuuugg

SEQ ID NO: 258702 - RNA, 64 nt, hsa
caacaaugaaaaccaacaccaacucaacaacaaagugcaauacaggcugaaccuggcccaacag

SEQ ID NO: 258703 - RNA, 64 nt, hsa
aaagugacaugcauucacauaucugcuuaucagugugcaauacuguguaccucauggaugcuuu

SEQ ID NO: 258704 - RNA, 64 nt, hsa
uuuguuugugugcaaaccaaacuuucuuuacccagugcaauagauuuguuugacugcuuguguc

SEQ ID NO: 258705 - RNA, 64 nt, hsa
ucaaaagcucaauguacugcccaagaggcaccuugugcaauauucccaucccugaauuuagcau

SEQ ID NO: 258706 - RNA, 64 nt, hsa
uagaauagccaguauuuauguuuuuuauaaaacugugcaauacgaauuaugcaaucacaauaca

SEQ ID NO: 258707 - RNA, 64 nt, hsa
aacuuacggaaauacacaaaugcuucucuguaaugugcaauaugcuuugcaacuguagaugaua

SEQ ID NO: 258708 - RNA, 64 nt, hsa; identical to SEQ ID NO: 169429

SEQ ID NO: 258709 - RNA, 64 nt, hsa; identical to SEQ ID NO: 169430

SEQ ID NO: 258710 - RNA, 64 nt, hsa
auugagggaccaucagauaacuguauuuugucaggugcaauaaaaacaaaauuaaaacccaaau

SEQ ID NO: 258711 - RNA, 64 nt, hsa
cuaauuuaaaaauuaauauuuucuuauagauauugugcaauaaagcugaaguagaauguguggu

SEQ ID NO: 258712 - RNA, 64 nt, hsa
uucuugaaugcuuugucaaauuaagaaaguuaaagugcaauaauguuugaagacaauaaguggu

SEQ ID NO: 258713 - RNA, 64 nt, hsa
uauuuauuuuuagggugauuuuuuaaaaagacuugugcaauacauuuugaggugaaacuuagug

SEQ ID NO: 258714 - RNA, 64 nt, hsa
cuacaaguuugcaaauauuuuaacaauauuaaaugugcaauagaacuuuuauaaaauaauuaga

SEQ ID NO: 258715 - RNA, 64 nt, hsa
aagcacaucguccuguuuuauugcuuucuacccugugcaauauuagcaugcaagcuuggcuuac

SEQ ID NO: 258716 - RNA, 64 nt, hsa
gcuggcauauuuuggaauucugcacauucauggagugcaauaauacuguauagcuuuccccacc

SEQ ID NO: 258717 - RNA, 64 nt, hsa
acugauggugcauuuuauucuugaagugaaaucugugcaauaaaauaacagacugucugcaaaa

SEQ ID NO: 258718 - RNA, 64 nt, hsa
caucaauucauagcaguaacuuuaagagggcauugugcaauaguuaguuguuuucuuguucagc

SEQ ID NO: 258719 - RNA, 64 nt, hsa
uuccuuuuuuuuuuuuuuauuucgguuguuugaugugcaauauguuuuuguaugcagguaguaa

SEQ ID NO: 258720 - RNA, 64 nt, hsa
gacuaauuccaaccuucuaaauuuggcuaguaaagugcaauaaaggcauugauaaguucuguua

SEQ ID NO: 258721 - RNA, 64 nt, hsa
cccaggaggaggauugugcugauguagugaccaagugcaauaugggcgggcagucgcugcaggg

SEQ ID NO: 258722 - RNA, 64 nt, hsa
aguugugugaagaugucaaaaaaagauuuuagaagugcaauauuuauaguguuauuuguuucac

SEQ ID NO: 258723 - RNA, 64 nt, hsa
guuuaaaaaaaauaaauaaaaauuaaaaaaaucugugcaauaauuuuaaaaugugcucccagga

SEQ ID NO: 258724 - RNA, 64 nt, hsa
uuuuauguggaugaagagcauuuuuuaugcuuuugugcaauagguuccaauaugcauuuauuag

SEQ ID NO: 258725 - RNA, 64 nt, hsa
gcagggcacuccccuguuuccuaagaacgaaaaagugcaauaaaggccauucguuaccuacuuu

SEQ ID NO: 258726 - RNA, 64 nt, hsa
uuccauggaguugugcaaagcuauggcuuccuuggugcaauauucuuaaaaccugcuuugcaua

SEQ ID NO: 258727 - RNA, 64 nt, hsa
ggaaggcugacuaaccucgauucuguguugugaugugcaauacuguuucuaauguuuguauaaa

SEQ ID NO: 258728 - RNA, 64 nt, hsa
uuuaaaagcaacaaaagggauaccauguagaauugugcaauagucuagccagcuagccuuaaca

SEQ ID NO: 258729 - RNA, 64 nt, hsa
uuuccuuaauaagaaaaguaauuuuuacucugaugugcaauacauuuguuauuaaauuuauuau

SEQ ID NO: 258730 - RNA, 64 nt, hsa
agcacaguguauucagacagauacagugaaccaagugcaauauguaaggaugaaagaagaagag

SEQ ID NO: 258731 - RNA, 64 nt, hsa
gggauggaguuucgcuguuguugcccaggcuggagugcaauagcacgaucuuggcucaccgcaa

SEQ ID NO: 258732 - RNA, 64 nt, hsa
agggccucuuucccagcuuucuugcuugccuucugugcaauauuucuuggagaauuuggaugcc

SEQ ID NO: 258733 - RNA, 64 nt, hsa
cauuaguuaauauaugugaaaguauggaggagaugugcaauaaauauuuguguuauuaacuaca

SEQ ID NO: 258734 - RNA, 64 nt, hsa
ccugugaacugcaaacuugcuuaugauugacuuggugcaauaaaguuccuuucuaaccauuucu

SEQ ID NO: 258735 - RNA, 64 nt, hsa
cuucaguuuuggccuucugucagcagaaugauaagugcaauaguuguaaaucuacuugacacug

SEQ ID NO: 258736 - RNA, 64 nt, hsa
auucacuuagaaauuuuauuuucuuauaacuuaagugcaauaaaauguguuuuuucauguuagu

SEQ ID NO: 258737 - RNA, 64 nt, hsa
acaucaguauaacugcauuucuaguuucuauauagugcaauagagcauagauucuauaaauucu

SEQ ID NO: 258738 - RNA, 64 nt, hsa
uacguuuauucucuucagcuuuaacuauacuugagugcaauaaaaaacuuaauaaaauuuuaug

SEQ ID NO: 258739 - RNA, 64 nt, hsa
cauugcugggauguuucugcccacgguuuuguuugugcaauaacguuaucacauuucuaaugag

SEQ ID NO: 258740 - RNA, 64 nt, hsa
guuuuucuauguaaauauugaaaacuuaugauuugugcaauaacucagauauuuuuuauuuaau

SEQ ID NO: 258741 - RNA, 64 nt, hsa
uguaaaguaaaaugccuuauauauuaaagaguaagugcaauaauaugaaauagccuguacauuu

SEQ ID NO: 258742 - RNA, 64 nt, hsa
auacaguacuguuucuggacccuuauaaaauccugugcaauagacacauacaugucacauuuag

SEQ ID NO: 258743 - RNA, 64 nt, hsa
gcauuugccuuauuuuugcaucucacaaacauaagugcaauagaucuuuucauugaacagcaaa

SEQ ID NO: 258744 - RNA, 64 nt, hsa
auuuuaaguuugcagauuuauuuagugaaggcaagugcaauaauccuuccucagaugauguuug

SEQ ID NO: 258745 - RNA, 64 nt, hsa
aaaccugaaacugguaagacaagcacaaagcaacgugcaauacaaaaaucguaucucaagggaa

SEQ ID NO: 258746 - RNA, 64 nt, hsa
cugcaagaauuucuuuuaaauaaaaaguuugggggugcaauauaagaaguuuauauaauaugca

SEQ ID NO: 258747 - RNA, 64 nt, hsa
gaaucauuggcuuuuauaccuuucuugguuugacgugcaauaaagaagcacauuauuuuagcuu

SEQ ID NO: 258748 - RNA, 64 nt, hsa
uuuauaugcacauaauaaccuguaccuauaaaucgugcaauaaccauaugcgacuauuuugcca

SEQ ID NO: 258749 - RNA, 64 nt, hsa
ugugaugaauuguggcaaguuaacuucaaguuaugugcaauacuuauuucaaacuuuugaaaga

SEQ ID NO: 258750 - RNA, 64 nt, hsa
gaagucucacaguuggugauuucuccgcucuguggugcaauaucccuauuuguaggugaguugu

SEQ ID NO: 258751 - RNA, 64 nt, hsa; identical to SEQ ID NO: 169431

SEQ ID NO: 258752 - RNA, 64 nt, hsa; identical to SEQ ID NO: 169432

SEQ ID NO: 258753 - RNA, 64 nt, hsa
ggaaaaguaaaauccaaaauguuagcaaaacaaagugcaauauuaaauguuugcuuuauagauu

SEQ ID NO: 258754 - RNA, 64 nt, hsa; identical to SEQ ID NO: 169433

SEQ ID NO: 258755 - RNA, 64 nt, hsa; identical to SEQ ID NO: 169434

SEQ ID NO: 258756 - RNA, 64 nt, hsa
agaaggggcguuuguuuuauucuugguguuuucagugcaauaaauagcuacaaacuucugugca

SEQ ID NO: 258757 - RNA, 64 nt, hsa
ggacuaugaucugauggccucuagguguuguuuugugcaauauacagccccagguagggagggg

SEQ ID NO: 258758 - RNA, 64 nt, hsa
aagauaccuaagcacuagaauauccagcuaaauggugcaauaggcuaggaauugagccaggaga

SEQ ID NO: 258759 - RNA, 64 nt, hsa
acacauggggaucagagcagacuucuccacuacugugcaauagagauacagcucucuucagagu

SEQ ID NO: 258760 - RNA, 64 nt, hsa
gaauugccugagcccaggaguucaagaccagcuugugcaauauagggagacuccggcucuacaa

SEQ ID NO: 258761 - RNA, 64 nt, hsa
cugggaugucgggagaccuagaugaccuuaucgggugcaauacuagcuaagguaaagcuagaaa

SEQ ID NO: 258762 - RNA, 64 nt, hsa
uuuuguuuuuaaacuuuuuuuugccauccauccugugcaauaugccguguagaauauuugucuu

SEQ ID NO: 258763 - RNA, 64 nt, hsa
ugacauugauuuuuuuuuuuucguuuucuuucuugugcaauaccuacaauggugcuguguuuua

SEQ ID NO: 258764 - RNA, 64 nt, hsa
augaaaaaaacugcaucccaucacccaaaguucugugcaauagaaauuucuacagauacaggua

SEQ ID NO: 258765 - RNA, 64 nt, hsa
guagcuugauaugguguuucagugcuuauugguugugcaauaaugguuauagccuguuagauaa

SEQ ID NO: 258766 - RNA, 64 nt, hsa
cuugucccauuucauucucuugcuuuuuuagcaugugcaauacuuucugugccaauagagucug

SEQ ID NO: 258767 - RNA, 64 nt, hsa
gccagacugcauuaguauuuuggcauugaaacuugugcaauaucuguguaauguagaauguggg

SEQ ID NO: 258768 - RNA, 64 nt, hsa
uuauuaacuagguaugaaguauaaacccauuuuggugcaauauucuugacuccuuggugcuaaa

SEQ ID NO: 258769 - RNA, 64 nt, hsa
acucugcccaaaagcagcagacauguaagcagaugugcaauaaaaaaugaucuugauccauuuc

SEQ ID NO: 258770 - RNA, 64 nt, hsa
gccauggaagauacuagcccagccuagcagaaaagugcaauauguauagcauacuuugacauuu

SEQ ID NO: 258771 - RNA, 64 nt, hsa
cacagcauagcugaaaguugccaaacuggacauugugcaauaaaguagaauucuauauugauaa

SEQ ID NO: 258772 - RNA, 64 nt, hsa
guagcauaacuuauaucuguauuuaaggacuuuugugcaauauggucuuaagaaauaauugcca

SEQ ID NO: 258773 - RNA, 64 nt, hsa
uggcgcaucagauagucucuguguaccuggauuugugcaauauguaaaaauguaucaaauguau

SEQ ID NO: 258774 - RNA, 64 nt, hsa
guuuugggaugucagcaguggccugaagugaguugugcaauaaauguuaaguugaaaccuccuu

SEQ ID NO: 258775 - RNA, 64 nt, hsa
gcaaaagagaaaaagaaggauugaucagagcauugugcaauacaguuucauuaacuccuucccc

SEQ ID NO: 258776 - RNA, 64 nt, hsa
aaaccagccaguaauuucugugcaaccuuacuaugugcaauauuuuuaaauccugagaaaugug

SEQ ID NO: 258777 - RNA, 64 nt, hsa
auggagggauauccccuuggauuucacuugcauugugcaauaagcaaagaaggguugauaaaag

SEQ ID NO: 258778 - RNA, 64 nt, hsa
uauuuuuguugccuuuuuugcuuuuuuuuaaucugugcaauaccucauuuaaucuguaaagguu

SEQ ID NO: 258779 - RNA, 64 nt, hsa
gauggaauguuaccuguccguguuacauaaucaagugcaauauacucaguucucaugcagguga

SEQ ID NO: 258780 - RNA, 64 nt, hsa
ggaauaaauuaaaaacaguauuugggggagaaacgugcaauagcguaaugguggugucccugcc

SEQ ID NO: 258781 - RNA, 64 nt, hsa
guuaaauuuauuuuaacguagacacuaaaaguaugugcaauauacaauuaaaguaggaauuugu

SEQ ID NO: 258782 - RNA, 64 nt, hsa
uccuguuggucucucuguguucuuuguuacuugggugcaauagcaacuucccuaccccgugcau

SEQ ID NO: 258783 - RNA, 64 nt, hsa
ucccaugggggcuccagacauuguauuuuacuuugugcaauaugaggggacugcaugcaagcuc

SEQ ID NO: 258784 - RNA, 64 nt, hsa
gcaucugcuaccugauuuuauccuggagaauacagugcaauauuucucuuugauuauuuauucc

SEQ ID NO: 258785 - RNA, 64 nt, hsa
cucauucauuccuguuaagcugccaaaaauuaaagugcaauauuguauauuuuuaagaacaaau

SEQ ID NO: 258786 - RNA, 64 nt, hsa
uuaccuguagguggagcaaguaauaagccaugcugugcaauauauacauaaagcuucugcuucu

SEQ ID NO: 258787 - RNA, 64 nt, hsa
uaagaauguuauccaacuauuaagauaucucaaugugcaauaacuuguguauuagauaucaaug

SEQ ID NO: 258788 - RNA, 64 nt, hsa
aaaaauaauguaaaugucuucuauuaaauguugagugcaauaaaauacagaagaauucucuaua

SEQ ID NO: 258789 - RNA, 64 nt, hsa
aagcuuuuggaaaagcuccagguccucauguauugugcaauaacaaugacuuccuuggcgguuu

SEQ ID NO: 258790 - RNA, 64 nt, hsa
cuuacuugccuggauugcuuuaaaauuaaccuuugugcaauaccaagaaaauagcucuuuaaaa

SEQ ID NO: 258791 - RNA, 64 nt, hsa
ucagaagaugauuuuaacaguucagaacagaugugugcaauauuggugcauguaauaauguuga

SEQ ID NO: 258792 - RNA, 64 nt, hsa
aaacccuugccucaucaguuuuccugauuuacaagugcaauauuuuagccaaugccuugggaga

SEQ ID NO: 258793 - RNA, 64 nt, hsa
uuuaaaucuccaacuugcuguuuccaaaaagaaggugcaauaucauauaucaucaguuagcaau

SEQ ID NO: 258794 - RNA, 64 nt, hsa
ugcagacagucuguuaugcacugugguuucagaugugcaauaauuuguacaaugguuuauuccc

SEQ ID NO: 258795 - RNA, 64 nt, hsa
aucucauucaugauguugauuuuuuuucaauguggugcaauauauacaauaaaauuugucauaa

SEQ ID NO: 258796 - RNA, 64 nt, hsa
agcaaucacaaacuaaagacugcggcuuguugaggugcaauacccugacucccaaaguuaguua

SEQ ID NO: 258797 - RNA, 64 nt, hsa
gagauggaguuucacucuuguugcccaggcuggagugcaauagcaugaucucggcucacugcaa

SEQ ID NO: 258798 - RNA, 64 nt, hsa
auucuugaaaacugcuguagcaaauucaucuguggugcaauacacuuuuugauuaaagcucuuc

SEQ ID NO: 258799 - RNA, 64 nt, hsa
cuuucccccccaaaugguugcguccuuugaaccugugcaauaugaggccaaauuuaaucuuuga

SEQ ID NO: 258800 - RNA, 64 nt, hsa
ccgcugccacacacuacaggagucaauaaacaaggugcaauauuuucaaaucguuggccggcua

SEQ ID NO: 258801 - RNA, 64 nt, hsa
uuuuguuuuuaagacucauggacauuucauaccugugcaauacugaagaccucauucugucaug

SEQ ID NO: 258802 - RNA, 64 nt, hsa
acucugaaccgaauguuuuggacuuaacuguugcgugcaauaugaccgucggcacacugcuguu

SEQ ID NO: 258803 - RNA, 64 nt, hsa
uuagagauaccagaaugcugguauucuacuacuugugcaauauauauguuuuaaaaaacaaauu

SEQ ID NO: 258804 - RNA, 64 nt, hsa
gcaucaacuaguucuuccauguaaaauaauuuuagugcaauaugaagacguagaaauguaaaau

SEQ ID NO: 258805 - RNA, 64 nt, hsa
cuuuccagccugaagccugcuuaaacugugugaugugcaauaacugagcuuagaguuaggaauu

SEQ ID NO: 258806 - RNA, 64 nt, hsa
gucuugguagaugucccuagacgggcugagccaugugcaauaagaacauagauccuaaaggauc

SEQ ID NO: 258807 - RNA, 64 nt, hsa
aggcuauaaccuaaccucgacuauuuguuguuaugugcaauacuguuuguacuguuuguauaaa

SEQ ID NO: 258808 - RNA, 64 nt, hsa
uguuguuagcaucuuuguaugcacaucacuguuugugcaauauaugaauauuuuguugcauugu

SEQ ID NO: 258809 - RNA, 64 nt, hsa
uggcacugucuuugaugcagugauguacuuaauggugcaauaaagcugcuucgauuugguuucc

SEQ ID NO: 258810 - RNA, 64 nt, hsa
gacugaaagcuuugaugaaauuuguuuuuguauggugcaauaugacagccugucauugaaucua

SEQ ID NO: 258811 - RNA, 64 nt, hsa
cuguugagugagcugcuaugacuuugguagagaggugcaauauguuuuuugaaccagcuauaaa

SEQ ID NO: 258812 - RNA, 64 nt, hsa
aaaaaauugucugaaauguuuauuuugcaaaacagugcaauagaaucuaguuaugccuucauca

SEQ ID NO: 258813 - RNA, 64 nt, hsa
ugaccuccuuauguauucucaauuaccuguauuugugcaauaaauuggaauaauguaacuugau

SEQ ID NO: 258814 - RNA, 64 nt, hsa
ugggucuggaccccacggggcuggggagggccaugugcaauauuuggaggguuuucuggagggc

SEQ ID NO: 258815 - RNA, 64 nt, hsa
ucaccuuuggugggggcagggccugguggcaccugugcaauaaugucuguguuucucucccacc

SEQ ID NO: 258816 - RNA, 64 nt, hsa
uuagauauauuauuugcagcaagaaguucauucugugcaauauggacauguuugcaaaccauac

SEQ ID NO: 258817 - RNA, 64 nt, hsa
gaucuguguuauucuuaguacccacugauaaauugugcaauaaauaaucuuucgcaagugauuu

SEQ ID NO: 258818 - RNA, 64 nt, hsa
agagauuuagaucuggaccaggcuguggguagaugugcaauagaaauagcuaauuuauuucccc

SEQ ID NO: 258819 - RNA, 64 nt, hsa
uuuacuuuugucagaaucaaggcuucggccaccugugcaauauuuucccauggaaugcagcagu

SEQ ID NO: 258820 - RNA, 64 nt, hsa
aaaugcuuuaucuguguuuucuguaaauaaaagagugcaauaaucucugugugugauugcagga

SEQ ID NO: 258821 - RNA, 64 nt, hsa
ggacucagaaacgagaucgggaagcagaaauauagugcaauagugcaacaucucugaauccuuu

SEQ ID NO: 258822 - RNA, 64 nt, hsa
ugaauugcacugaacagaauuaagaaauacucaugugcaauaggugagagaauguauuuucaua

SEQ ID NO: 258823 - RNA, 64 nt, hsa
aaaaaauugauacaacuaugcagauuuuauaaaugugcaauaaaaguauuuguuuuaccuuugg

SEQ ID NO: 258824 - RNA, 64 nt, hsa
auaccuuuuucuaugaaaaaagacccagcgccgugugcaauaaagguuauguuucuauguggug

SEQ ID NO: 258825 - RNA, 64 nt, hsa
uguccuguagcuugauauuacagaugugcuauuagugcaauaaggugaaggcugucugcccaga

SEQ ID NO: 258826 - RNA, 64 nt, hsa
ugggagguauaacccugcuccucucucccagucugugcaauaaaggucgugaagaucucucagc

SEQ ID NO: 258827 - RNA, 64 nt, hsa
uaagauauauguauauaaaguguaugcuguauuggugcaauaaugguaauuaaaaauaugaaaa

SEQ ID NO: 258828 - RNA, 64 nt, hsa
gcugaguuuuuuauuuuuaaguguuuguuuuucagugcaauaauuuuugugugugugugauucu

SEQ ID NO: 258829 - RNA, 64 nt, hsa
cugggcugccagcaguacgugggaaagguggaaugugcaauaggaacagaucugugcauuuugu

SEQ ID NO: 258830 - RNA, 64 nt, hsa
ccgcgaacaucacaccguuccccgaccaagccgugugcaauacaacagagggaggcagguggga

SEQ ID NO: 258831 - RNA, 64 nt, hsa
gaaugggguggaacacagcauuuugucaagcacugugcaauauuccauauuuuuccccacuaug

SEQ ID NO: 258832 - RNA, 64 nt, hsa
gguaaucuuuuacgggugggaggugagauugauagugcaauaaucagugaucuauagacccuca

SEQ ID NO: 258833 - RNA, 64 nt, hsa
uccaucaaaccucacauuugugaacucaaacgaugugcaauacauuuuuuucucuuuccuugaa

SEQ ID NO: 258834 - RNA, 64 nt, hsa
auagaguagaagauuugaugcuggagagguuaaggugcaauaagaauuuagggagaaauguugu

SEQ ID NO: 258835 - RNA, 64 nt, hsa; identical to SEQ ID NO: 169435

SEQ ID NO: 258836 - RNA, 64 nt, hsa; identical to SEQ ID NO: 169436

SEQ ID NO: 258837 - RNA, 64 nt, hsa; identical to SEQ ID NO: 169437

SEQ ID NO: 258838 - RNA, 64 nt, hsa
gagacauaaaaccuuuuuuuaauaauaaaauauugugcaauauauucaaagaaaagaaaacaca

SEQ ID NO: 258839 - RNA, 64 nt, hsa
aguggguggagaguggagugcgcugggacguugugugcaauagagaggucuccacaccagaugu

SEQ ID NO: 258840 - RNA, 64 nt, hsa
ggccauccccauagccauguuuacaugauuugaugugcaauagggugggguaggggcagggaaa

SEQ ID NO: 258841 - RNA, 64 nt, hsa
cuucacagaaagugcauuuuaaccaguacucugggugcaauaaauaauauguagaaauuuaagu

SEQ ID NO: 258842 - RNA, 64 nt, hsa
cagacacccaggacuuauuuaaacucuguugcaagugcaauaaaucugacccagugcccccacu

SEQ ID NO: 258843 - RNA, 64 nt, hsa
gaauugcuugguggaacauaugcuuucacuguuugugcaauaugcauuuauuucuuauaugaau

SEQ ID NO: 258844 - RNA, 64 nt, hsa
caggagacaucaggucccccuggauucaaauuaagugcaauauuuugcaaacagcucuucuuag

SEQ ID NO: 258845 - RNA, 64 nt, hsa
aaaaaucagcgucauuuguucccugccaagcaucgugcaauaagugaauuuccuggccuacuuc

SEQ ID NO: 258846 - RNA, 64 nt, hsa
aaauguaagugugcuugggaauuccuuaaauuuugugcaauaaacuauuuuuugguaaagauuu

SEQ ID NO: 258847 - RNA, 64 nt, hsa
cuuucuuuuuuuuuuuuuuuguguagaaaaauaggugcaauaaugaucaaaguuuugaugucuu

SEQ ID NO: 258848 - RNA, 64 nt, hsa
cagacaugcagugaaaugguucuuuguuaaaaaugugcaauaaaaauagauuacaauaaguagu

SEQ ID NO: 258849 - RNA, 64 nt, hsa
uuuuguugagaggaaaagugaauugguuaaaagagugcaauaaggauccaaauacagugacuuu

SEQ ID NO: 258850 - RNA, 64 nt, hsa
aggguuguuuucuguuaagcaaagccgagauccagugcaauaccuggacugucaccguccugug

SEQ ID NO: 258851 - RNA, 63 nt, hsa
cauaaaaacugaagaacauugaugagaaaucucugugcaauaauguaaaaaaaaaaaaagaua

SEQ ID NO: 258852 - RNA, 64 nt, hsa
ucuagguuaaguuugagccugaaauuuuaaugaagugcaauacugagugugccucauuaucuug

SEQ ID NO: 258853 - RNA, 64 nt, hsa
uacacuuuaauguuuuauucuuguacauaaaaaugugcaauauggagauguauacagucuuuac

SEQ ID NO: 258854 - RNA, 64 nt, hsa
uuuuguauauuuauucuauuuuguauauuguuaagugcaauaaaguuuuugccuugcuuuauuu

SEQ ID NO: 258855 - RNA, 64 nt, hsa
cgcugauguacacacauuucauuauuugccaauggugcaauaaccacugcugaccaacccacua

SEQ ID NO: 258856 - RNA, 64 nt, hsa
uucugguuuuaauuuuuaguugugcuuugagucagugcaauaaacuagacuuuuuccaaaccug

SEQ ID NO: 258857 - RNA, 64 nt, hsa
uguauuuggagaaacaggaguguucacuuaucuagugcaauauguucacaguuuauuaaugcuu

SEQ ID NO: 258858 - RNA, 64 nt, hsa
cuguuggcuacaucauuuuguguugaauaauaaagugcaauacuuuauucuccauaauuaaacu

SEQ ID NO: 258859 - RNA, 64 nt, hsa
gagaaaauuguauaaccauccugcuguuccuuuagugcaauacaauaaaacucugaaauuaaga

SEQ ID NO: 258860 - RNA, 64 nt, hsa
guuauuuuguuuauuauuuucauguuugaguucugugcaauauuuucuauuauguccguugaua

SEQ ID NO: 258861 - RNA, 64 nt, hsa
uaaauaaauaccagguaugaaauuacugauuuuagugcaauaucuguaugauuauccagaacua

SEQ ID NO: 258862 - RNA, 64 nt, hsa
uaguuuucuaaauguuucuuuuucuuuuuugagugugcaauauguaacaugucuaaaguuaggg

SEQ ID NO: 258863 - RNA, 64 nt, hsa
auuaaggcaguacaaauuguggagccuuuuaacugugcaauaauuucuguauuuauuggguuuu

SEQ ID NO: 258864 - RNA, 64 nt, hsa
uucuguaggaagaaucaaaucaccgauuuaaagagugcaauauauaauaaucauuuuuaaagua

SEQ ID NO: 258865 - RNA, 64 nt, hsa
aaccuuuuccuguggaaaccugucauagaauuuugugcaauauguaugugucuaugaagcuguc

SEQ ID NO: 258866 - RNA, 64 nt, hsa
ggagucagagucucgcucucuuguccaggcuggagugcaauagcgcgaucugggcucacugcaa

SEQ ID NO: 258867 - RNA, 64 nt, hsa
aacauacucuuuguauauauuuauuauaugaaaggugcaauauuuuauuuuguacaguauguaa

SEQ ID NO: 258868 - RNA, 64 nt, hsa
uucuguuuaaacugugauuuucuuuauuguguuggugcaauauuuuauuaucauuuaaccucag

SEQ ID NO: 258869 - RNA, 64 nt, hsa
gccaguguauucuguuuuuaaaacugugccugcagugcaauacuccuucugguguauuuuaucc

SEQ ID NO: 258870 - RNA, 64 nt, hsa
uuguaccucucauuuucagucagggacauacuuugugcaauauuucugugauugugccuaugca

SEQ ID NO: 258871 - RNA, 64 nt, hsa
cagaggaucaccagugcauccuucaucacagcaugugcaauaugccaagauuacccucggucau

SEQ ID NO: 258872 - RNA, 64 nt, hsa
gugcuacuguauuugucucaaagcuaccaaguuugugcaauaaguggaagggaugucauccuuc

SEQ ID NO: 258873 - RNA, 64 nt, hsa
gugaauaugugcuuuuacuguacauagugcuauugugcaauaggucuuaugcuguuuucacuca

SEQ ID NO: 258874 - RNA, 64 nt, hsa
ugcccgccccuugccucgauauugccaguuucuugugcaauaaacaaucagcagcugugggugg

SEQ ID NO: 258875 - RNA, 64 nt, hsa
ugcgcccgcggguccuccccaccugcugcuccccgugcaauaccugcugggccuccugcccgcg

SEQ ID NO: 258876 - RNA, 64 nt, hsa
ugugugcguggcuaucaggaguucuaggaacucagugcaauacgggagugacccagcuacugaa

SEQ ID NO: 258877 - RNA, 64 nt, hsa; identical to SEQ ID NO: 169438

SEQ ID NO: 258878 - RNA, 64 nt, hsa; identical to SEQ ID NO: 169439

SEQ ID NO: 258879 - RNA, 64 nt, hsa
accuucucagugguuuacaugccucugaaacuaugugcaauauuuuugguugacacuuguaucc

SEQ ID NO: 258880 - RNA, 64 nt, hsa
aaagaaacaaacauugaauuacuaaacaaagauggugcaauaucuuuguuuuuuuuuuaugagg

SEQ ID NO: 258881 - RNA, 64 nt, hsa
ucuaccuucaacaugugcucgcucugcaugauuagugcaauaaaacucccuuccuuaugcauac

SEQ ID NO: 258882 - RNA, 64 nt, hsa
augggugguugggagagaaacuagaacagaagaugugcaauagggcucagagcagccccaggaa

SEQ ID NO: 258883 - RNA, 64 nt, hsa
aaguugcguugaggccgcaucuuucuucagcagcgugcaauagcuggcuccucuauaggagaug

SEQ ID NO: 258884 - RNA, 64 nt, hsa
uucugugacucucuuggaaaugccuugacugaaugugcaauauuugugucucuugguuucuaac

SEQ ID NO: 258885 - RNA, 64 nt, hsa
uuuuugucaguuuguuugccuuacucauuucuaagugcaauaagggagugucucacaggauugc

SEQ ID NO: 258886 - RNA, 64 nt, hsa
cuuggacccagggccugagaccuuugugggauuugugcaauaaaguguuuuuauuuaaaaccaa

SEQ ID NO: 258887 - RNA, 64 nt, hsa
uaugugucagaacauucagaagaagucugaagaagugcaauauguuagauacucagcagaagua

SEQ ID NO: 258888 - RNA, 64 nt, hsa
agugcagcuguaggucgucaucaccuaaccacacgugcaauaaaguccucgugccugcugcuca

SEQ ID NO: 258889 - RNA, 64 nt, hsa
cauuggacccugacuguauacagaaugaaaggcagugcaauauuuagcugcuaacaagacuggc

SEQ ID NO: 258890 - RNA, 64 nt, hsa
auguaaucguaaauauuaauuuuguaccuauauugugcaauacuugaaaaaaacgguauaaaag

SEQ ID NO: 258891 - RNA, 64 nt, hsa
uuuucuaaauuacuaugucagguuguaaaagucagugcaauaacaaaccuuccuuuuuaagaag

SEQ ID NO: 258892 - RNA, 64 nt, hsa
ccacguguccuggucacuggucuuuauaauuguugugcaauaacuaaaggcuaaggacuagaug

SEQ ID NO: 258893 - RNA, 64 nt, hsa
cuccccuucccuuuuuuuguuauuuuuucagacugugcaauacuuagagaaccuauagcaucuu

SEQ ID NO: 258894 - RNA, 64 nt, hsa
augaugauuucuuuucccugcacacaucuuuccggugcaauaucuaucaauugugaaucuggcu

SEQ ID NO: 258895 - RNA, 64 nt, hsa
agcugcuugcagcaacuugauuuccccaaguccugugcaauagccccaggauuggauuccuuca

SEQ ID NO: 258896 - RNA, 64 nt, hsa
ggaaaccaauuuuuuuaguuauuguucaaggagggugcaauauuaaguguuuuggaauuugaag

SEQ ID NO: 258897 - RNA, 64 nt, hsa
uacauuuggguauaaugacaacagccaauuuauagugcaauaaaauguaauuaauucaaguccu

SEQ ID NO: 258898 - RNA, 64 nt, hsa
agguggcccccguccgaggaggaucguuuucuaagugcaauacuuggcccgccggcuucccgcu

SEQ ID NO: 258899 - RNA, 64 nt, hsa
cgauccuccuugacgaguuuuguuuuucaaaauggugcaauaauuuaaguggcaucuucucucc

SEQ ID NO: 258900 - RNA, 64 nt, hsa
ugcccccuuccccagaacaaaacauguugaucaugugcaauauuucuuacugugccgagaagcc

SEQ ID NO: 258901 - RNA, 60 nt, hsa; identical to SEQ ID NO: 258327

SEQ ID NO: 258902 - RNA, 64 nt, hsa
cgcugguccuuagccccaugccucuuccaaaacagugcaauaaaucuccgguaacccguccacc

SEQ ID NO: 258903 - RNA, 64 nt, hsa
ccgacacguccccguucccccgaaaccuggcucagugcaauacucccauugccaugggguccuu

SEQ ID NO: 258904 - RNA, 64 nt, hsa
aauuuuaaggauugacaagaguuuauuuucuauugugcaauaucuuaaaggaagcaaccaccuu

SEQ ID NO: 258905 - RNA, 64 nt, hsa
gcagccuccugauuucauaaccaggccggaccacgugcaauaggguggaaaccaaacugcucca

SEQ ID NO: 258906 - RNA, 64 nt, hsa
cagcacucgccucccuaccaaugacucaccugaagugcaauacgaaauaaaaggccagcgggcg

SEQ ID NO: 258907 - RNA, 64 nt, hsa
cccuucuaagacccacgagcggggugagagaagugugcaauagucuggaauaaauauaaaugaa

SEQ ID NO: 258908 - RNA, 64 nt, hsa
gccucagccaggugggccuguauauaggguccaugugcaauagggagggacgucuucuauuuuu

SEQ ID NO: 258909 - RNA, 64 nt, hsa
uacugucuaauauaggaaaaacacaugagaacaggugcaauauauugacuuaaacuuguuuagc

SEQ ID NO: 258910 - RNA, 64 nt, hsa
cgggugcccacagaggcucagcuccuucuuuucugugcaauacgagacccggccgcaccccgag

SEQ ID NO: 258911 - RNA, 64 nt, hsa; identical to SEQ ID NO: 169440

SEQ ID NO: 258912 - RNA, 64 nt, hsa; identical to SEQ ID NO: 169441

SEQ ID NO: 258913 - RNA, 64 nt, hsa
gggguuggguuugggguucaggaugcugcagucugugcaauaauaaacccgcaucugcucacgg

SEQ ID NO: 258914 - RNA, 64 nt, hsa
aauauuaaauucaaauaucccauaucuaaauuuagugcaauaucuugucuuuuguauaggucau

SEQ ID NO: 258915 - RNA, 64 nt, hsa
ccacucugcccugaccccgaucaguuaaggagcugugcaauaaccuuccuaguaccugagugag

SEQ ID NO: 258916 - RNA, 64 nt, hsa
uaucaaucacaacagguaauagcaauagacguuagugcaauacaaagucacccucaauaaauac

SEQ ID NO: 258917 - RNA, 64 nt, hsa
auuugcugucagccacauauugagaugacacuaggugcaauagcagggauagauuuuguuggug

SEQ ID NO: 258918 - RNA, 64 nt, hsa
ugcuacaaauagugcuaauaaaguuaaauugcacgugcaauacggaacacugucaauggacugc

SEQ ID NO: 258919 - RNA, 64 nt, hsa
gagcuaagagaauugggcauuaguauuucauuaugugcaauaagucauuguaagugcacugaua

SEQ ID NO: 258920 - RNA, 64 nt, hsa
ggguccaacaagaacaccugacuugggugaaguugugcaauauuggaggcugacuguagggcug

SEQ ID NO: 258921 - RNA, 64 nt, hsa
cacuuuccacuggaguucacuuucaauugcuucugugcaauaaaaccaagugcuuauaaaauga

SEQ ID NO: 258922 - RNA, 64 nt, hsa
uuuagcccagauacacauacucuuuuuugucuuugugcaauaaucaguguuccuggcagagccu

SEQ ID NO: 258923 - RNA, 64 nt, hsa
cuacuccagagcuccuuuaacaucugcuaauuaagugcaauaaauuuuucuagaaaauggcaaa

SEQ ID NO: 258924 - RNA, 64 nt, hsa
ggaauacaaucaaggguuuuguauucagaauguugugcaauauuuuggaaugggacauuggugu

SEQ ID NO: 258925 - RNA, 64 nt, hsa
ggcucucuguugugagaucuucagcuaccucauggugcaauaacacacacacgcuuaaccaugu

SEQ ID NO: 258926 - RNA, 64 nt, hsa
caguggcauaggaagacggcaaaaauuuccuaaagugcaauagauuuucaaguguauugugccu

SEQ ID NO: 258927 - RNA, 64 nt, hsa; identical to SEQ ID NO: 169442

SEQ ID NO: 258928 - RNA, 64 nt, hsa; identical to SEQ ID NO: 169443

SEQ ID NO: 258929 - RNA, 64 nt, hsa
agacgcuugguuuuucucagaacccccaaaagaugugcaauagcuguuguuacaaaccaccaaa

SEQ ID NO: 258930 - RNA, 64 nt, hsa
gauuggauuuuauguugacauuuguuugguuauagugcaauauauuuuguaugcaagcaguuuc

SEQ ID NO: 258931 - RNA, 64 nt, hsa
gagauggaguuucacucuuguugcccaggcuggagugcaauagcucgaucucggcucacugcaa

SEQ ID NO: 258932 - RNA, 64 nt, hsa
uaauaguuguuuacuagugugcuagaugaaaagcgugcaauaugcuuuaaagcuaucaacaaaa

SEQ ID NO: 258933 - RNA, 64 nt, hsa
uagaaacugaggguuaucuuugacacagaauugugugcaauauucuuaaauacuacugcucuaa

SEQ ID NO: 258934 - RNA, 64 nt, hsa
uauuguaauaggcauuuuuuuuuuuuuuuacaaugugcaauaacucagcaguuaaauaguggaa

SEQ ID NO: 258935 - RNA, 64 nt, hsa
cugcaacuuucuauaaugccaaaaugacacaucugugcaauagaaugaugucugcucuagggaa

SEQ ID NO: 258936 - RNA, 64 nt, hsa
auaugcagcauuaacuuuacugacauggagugaagugcaauauuauaaauauuauagauuaaaa

SEQ ID NO: 258937 - RNA, 64 nt, hsa; identical to SEQ ID NO: 169442

SEQ ID NO: 258938 - RNA, 64 nt, hsa; identical to SEQ ID NO: 169443

SEQ ID NO: 258939 - RNA, 64 nt, hsa
caauggcauaagaaguugacaaaaauuucuuaaagugcaauagauuuucaaguguauugugccu

SEQ ID NO: 258940 - RNA, 64 nt, hsa
agaagggacuuaauuacaaacuuaagacguaagugugcaauaaaguaagcuaagaagaaaauau

SEQ ID NO: 258941 - RNA, 64 nt, hsa; identical to SEQ ID NO: 132477

SEQ ID NO: 258942 - RNA, 64 nt, hsa; identical to SEQ ID NO: 132478

SEQ ID NO: 258943 - RNA, 64 nt, hsa; identical to SEQ ID NO: 132479

SEQ ID NO: 258944 - RNA, 64 nt, hsa; identical to SEQ ID NO: 132480

SEQ ID NO: 258945 - RNA, 64 nt, hsa; identical to SEQ ID NO: 132481

SEQ ID NO: 258946 - RNA, 64 nt, hsa; identical to SEQ ID NO: 132482

SEQ ID NO: 258947 - RNA, 64 nt, hsa; identical to SEQ ID NO: 132483

SEQ ID NO: 258948 - RNA, 64 nt, hsa; identical to SEQ ID NO: 132484

SEQ ID NO: 258949 - RNA, 64 nt, hsa; identical to SEQ ID NO: 132485

SEQ ID NO: 258950 - RNA, 64 nt, hsa; identical to SEQ ID NO: 132486

SEQ ID NO: 258951 - RNA, 64 nt, hsa; identical to SEQ ID NO: 132487

SEQ ID NO: 258952 - RNA, 64 nt, hsa; identical to SEQ ID NO: 132488

SEQ ID NO: 258953 - RNA, 64 nt, hsa; identical to SEQ ID NO: 132489

SEQ ID NO: 258954 - RNA, 64 nt, hsa; identical to SEQ ID NO: 132490

SEQ ID NO: 258955 - RNA, 64 nt, hsa; identical to SEQ ID NO: 132491

SEQ ID NO: 258956 - RNA, 64 nt, hsa; identical to SEQ ID NO: 132492

SEQ ID NO: 258957 - RNA, 64 nt, hsa; identical to SEQ ID NO: 132493

SEQ ID NO: 258958 - RNA, 64 nt, hsa; identical to SEQ ID NO: 132494

SEQ ID NO: 258959 - RNA, 64 nt, hsa; identical to SEQ ID NO: 132495

SEQ ID NO: 258960 - RNA, 64 nt, hsa; identical to SEQ ID NO: 132496

SEQ ID NO: 258961 - RNA, 64 nt, hsa; identical to SEQ ID NO: 132497

SEQ ID NO: 258962 - RNA, 64 nt, hsa; identical to SEQ ID NO: 132498

SEQ ID NO: 258963 - RNA, 64 nt, hsa; identical to SEQ ID NO: 132499

SEQ ID NO: 258964 - RNA, 64 nt, hsa; identical to SEQ ID NO: 132500

SEQ ID NO: 258965 - RNA, 64 nt, hsa; identical to SEQ ID NO: 132501

SEQ ID NO: 258966 - RNA, 64 nt, hsa; identical to SEQ ID NO: 132502

SEQ ID NO: 258967 - RNA, 64 nt, hsa; identical to SEQ ID NO: 132503

SEQ ID NO: 258968 - RNA, 64 nt, hsa; identical to SEQ ID NO: 132504

SEQ ID NO: 258969 - RNA, 64 nt, hsa; identical to SEQ ID NO: 132505

SEQ ID NO: 258970 - RNA, 64 nt, hsa; identical to SEQ ID NO: 132506

SEQ ID NO: 258971 - RNA, 64 nt, hsa; identical to SEQ ID NO: 132507

SEQ ID NO: 258972 - RNA, 64 nt, hsa; identical to SEQ ID NO: 132508

SEQ ID NO: 258973 - RNA, 64 nt, hsa; identical to SEQ ID NO: 132509

SEQ ID NO: 258974 - RNA, 64 nt, hsa; identical to SEQ ID NO: 132510

SEQ ID NO: 258975 - RNA, 64 nt, hsa; identical to SEQ ID NO: 132511

SEQ ID NO: 258976 - RNA, 64 nt, hsa; identical to SEQ ID NO: 132512

SEQ ID NO: 258977 - RNA, 64 nt, hsa; identical to SEQ ID NO: 132513

SEQ ID NO: 258978 - RNA, 64 nt, hsa; identical to SEQ ID NO: 132514

SEQ ID NO: 258979 - RNA, 64 nt, hsa; identical to SEQ ID NO: 132515

SEQ ID NO: 258980 - RNA, 64 nt, hsa; identical to SEQ ID NO: 132516

SEQ ID NO: 258981 - RNA, 64 nt, hsa; identical to SEQ ID NO: 132517

SEQ ID NO: 258982 - RNA, 64 nt, hsa; identical to SEQ ID NO: 132518

SEQ ID NO: 258983 - RNA, 64 nt, hsa; identical to SEQ ID NO: 132519

SEQ ID NO: 258984 - RNA, 64 nt, hsa; identical to SEQ ID NO: 132520

SEQ ID NO: 258985 - RNA, 64 nt, hsa; identical to SEQ ID NO: 132521

SEQ ID NO: 258986 - RNA, 64 nt, hsa; identical to SEQ ID NO: 132522

SEQ ID NO: 258987 - RNA, 64 nt, hsa; identical to SEQ ID NO: 132523

SEQ ID NO: 258988 - RNA, 64 nt, hsa; identical to SEQ ID NO: 132524

SEQ ID NO: 258989 - RNA, 64 nt, hsa; identical to SEQ ID NO: 132525

SEQ ID NO: 258990 - RNA, 64 nt, hsa; identical to SEQ ID NO: 132526

SEQ ID NO: 258991 - RNA, 64 nt, hsa; identical to SEQ ID NO: 132527

SEQ ID NO: 258992 - RNA, 63 nt, hsa; identical to SEQ ID NO: 132528

SEQ ID NO: 258993 - RNA, 54 nt, hsa; identical to SEQ ID NO: 132529

SEQ ID NO: 258994 - RNA, 64 nt, hsa; identical to SEQ ID NO: 132530

SEQ ID NO: 258995 - RNA, 64 nt, hsa; identical to SEQ ID NO: 132531

SEQ ID NO: 258996 - RNA, 64 nt, hsa; identical to SEQ ID NO: 132532

SEQ ID NO: 258997 - RNA, 64 nt, hsa; identical to SEQ ID NO: 132533

SEQ ID NO: 258998 - RNA, 64 nt, hsa; identical to SEQ ID NO: 132534

SEQ ID NO: 258999 - RNA, 64 nt, hsa; identical to SEQ ID NO: 132535

SEQ ID NO: 259000 - RNA, 64 nt, hsa; identical to SEQ ID NO: 132536

SEQ ID NO: 259001 - RNA, 64 nt, hsa; identical to SEQ ID NO: 132537

SEQ ID NO: 259002 - RNA, 64 nt, hsa; identical to SEQ ID NO: 132538

SEQ ID NO: 259003 - RNA, 64 nt, hsa; identical to SEQ ID NO: 132539

SEQ ID NO: 259004 - RNA, 64 nt, hsa; identical to SEQ ID NO: 132540

SEQ ID NO: 259005 - RNA, 64 nt, hsa; identical to SEQ ID NO: 132541

SEQ ID NO: 259006 - RNA, 64 nt, hsa; identical to SEQ ID NO: 132542

SEQ ID NO: 259007 - RNA, 64 nt, hsa; identical to SEQ ID NO: 132543

SEQ ID NO: 259008 - RNA, 64 nt, hsa; identical to SEQ ID NO: 132544

SEQ ID NO: 259009 - RNA, 64 nt, hsa; identical to SEQ ID NO: 132545

SEQ ID NO: 259010 - RNA, 64 nt, hsa; identical to SEQ ID NO: 132546

SEQ ID NO: 259011 - RNA, 64 nt, hsa; identical to SEQ ID NO: 132547

SEQ ID NO: 259012 - RNA, 64 nt, hsa; identical to SEQ ID NO: 132548

SEQ ID NO: 259013 - RNA, 64 nt, hsa; identical to SEQ ID NO: 132549

SEQ ID NO: 259014 - RNA, 64 nt, hsa; identical to SEQ ID NO: 132550

SEQ ID NO: 259015 - RNA, 64 nt, hsa; identical to SEQ ID NO: 132551

SEQ ID NO: 259016 - RNA, 64 nt, hsa; identical to SEQ ID NO: 132552

SEQ ID NO: 259017 - RNA, 64 nt, hsa; identical to SEQ ID NO: 132553

SEQ ID NO: 259018 - RNA, 64 nt, hsa; identical to SEQ ID NO: 132554

SEQ ID NO: 259019 - RNA, 64 nt, hsa; identical to SEQ ID NO: 132555

SEQ ID NO: 259020 - RNA, 64 nt, hsa; identical to SEQ ID NO: 132556

SEQ ID NO: 259021 - RNA, 64 nt, hsa; identical to SEQ ID NO: 132557

SEQ ID NO: 259022 - RNA, 64 nt, hsa; identical to SEQ ID NO: 132558

SEQ ID NO: 259023 - RNA, 64 nt, hsa; identical to SEQ ID NO: 132559

SEQ ID NO: 259024 - RNA, 64 nt, hsa; identical to SEQ ID NO: 132560

SEQ ID NO: 259025 - RNA, 64 nt, hsa; identical to SEQ ID NO: 132561

SEQ ID NO: 259026 - RNA, 64 nt, hsa; identical to SEQ ID NO: 132562

SEQ ID NO: 259027 - RNA, 64 nt, hsa; identical to SEQ ID NO: 132563

SEQ ID NO: 259028 - RNA, 64 nt, hsa; identical to SEQ ID NO: 132564

SEQ ID NO: 259029 - RNA, 64 nt, hsa; identical to SEQ ID NO: 132565

SEQ ID NO: 259030 - RNA, 64 nt, hsa; identical to SEQ ID NO: 132566

SEQ ID NO: 259031 - RNA, 64 nt, hsa; identical to SEQ ID NO: 132567

SEQ ID NO: 259032 - RNA, 64 nt, hsa; identical to SEQ ID NO: 132568

SEQ ID NO: 259033 - RNA, 64 nt, hsa; identical to SEQ ID NO: 132569

SEQ ID NO: 259034 - RNA, 64 nt, hsa; identical to SEQ ID NO: 132570

SEQ ID NO: 259035 - RNA, 64 nt, hsa; identical to SEQ ID NO: 132571

SEQ ID NO: 259036 - RNA, 64 nt, hsa; identical to SEQ ID NO: 132572

SEQ ID NO: 259037 - RNA, 64 nt, hsa; identical to SEQ ID NO: 132573

SEQ ID NO: 259038 - RNA, 64 nt, hsa; identical to SEQ ID NO: 132574

SEQ ID NO: 259039 - RNA, 64 nt, hsa; identical to SEQ ID NO: 132575

SEQ ID NO: 259040 - RNA, 64 nt, hsa; identical to SEQ ID NO: 132576

SEQ ID NO: 259041 - RNA, 64 nt, hsa; identical to SEQ ID NO: 132577

SEQ ID NO: 259042 - RNA, 64 nt, hsa; identical to SEQ ID NO: 132578

SEQ ID NO: 259043 - RNA, 64 nt, hsa; identical to SEQ ID NO: 132579

SEQ ID NO: 259044 - RNA, 64 nt, hsa; identical to SEQ ID NO: 132580

SEQ ID NO: 259045 - RNA, 64 nt, hsa; identical to SEQ ID NO: 132581

SEQ ID NO: 259046 - RNA, 64 nt, hsa; identical to SEQ ID NO: 132582

SEQ ID NO: 259047 - RNA, 64 nt, hsa; identical to SEQ ID NO: 132583

SEQ ID NO: 259048 - RNA, 64 nt, hsa; identical to SEQ ID NO: 132584

SEQ ID NO: 259049 - RNA, 64 nt, hsa; identical to SEQ ID NO: 132585

SEQ ID NO: 259050 - RNA, 64 nt, hsa; identical to SEQ ID NO: 132586

SEQ ID NO: 259051 - RNA, 64 nt, hsa; identical to SEQ ID NO: 132587

SEQ ID NO: 259052 - RNA, 64 nt, hsa; identical to SEQ ID NO: 132588

SEQ ID NO: 259053 - RNA, 64 nt, hsa; identical to SEQ ID NO: 132589

SEQ ID NO: 259054 - RNA, 64 nt, hsa; identical to SEQ ID NO: 132590

SEQ ID NO: 259055 - RNA, 64 nt, hsa; identical to SEQ ID NO: 132591

SEQ ID NO: 259056 - RNA, 64 nt, hsa; identical to SEQ ID NO: 132592

SEQ ID NO: 259057 - RNA, 64 nt, hsa; identical to SEQ ID NO: 132593

SEQ ID NO: 259058 - RNA, 64 nt, hsa; identical to SEQ ID NO: 132594

SEQ ID NO: 259059 - RNA, 64 nt, hsa; identical to SEQ ID NO: 132595

SEQ ID NO: 259060 - RNA, 64 nt, hsa; identical to SEQ ID NO: 132596

SEQ ID NO: 259061 - RNA, 64 nt, hsa; identical to SEQ ID NO: 132597

SEQ ID NO: 259062 - RNA, 64 nt, hsa; identical to SEQ ID NO: 132598

SEQ ID NO: 259063 - RNA, 64 nt, hsa; identical to SEQ ID NO: 132599

SEQ ID NO: 259064 - RNA, 64 nt, hsa; identical to SEQ ID NO: 132600

SEQ ID NO: 259065 - RNA, 64 nt, hsa; identical to SEQ ID NO: 132601

SEQ ID NO: 259066 - RNA, 64 nt, hsa; identical to SEQ ID NO: 132602

SEQ ID NO: 259067 - RNA, 64 nt, hsa; identical to SEQ ID NO: 132603

SEQ ID NO: 259068 - RNA, 64 nt, hsa; identical to SEQ ID NO: 132604

SEQ ID NO: 259069 - RNA, 64 nt, hsa; identical to SEQ ID NO: 132605

SEQ ID NO: 259070 - RNA, 64 nt, hsa; identical to SEQ ID NO: 132606

SEQ ID NO: 259071 - RNA, 64 nt, hsa; identical to SEQ ID NO: 132607

SEQ ID NO: 259072 - RNA, 64 nt, hsa; identical to SEQ ID NO: 132608

SEQ ID NO: 259073 - RNA, 64 nt, hsa; identical to SEQ ID NO: 132609

SEQ ID NO: 259074 - RNA, 64 nt, hsa; identical to SEQ ID NO: 132610

SEQ ID NO: 259075 - RNA, 64 nt, hsa; identical to SEQ ID NO: 132611

SEQ ID NO: 259076 - RNA, 64 nt, hsa; identical to SEQ ID NO: 132612

SEQ ID NO: 259077 - RNA, 64 nt, hsa; identical to SEQ ID NO: 132613

SEQ ID NO: 259078 - RNA, 64 nt, hsa; identical to SEQ ID NO: 132614

SEQ ID NO: 259079 - RNA, 64 nt, hsa; identical to SEQ ID NO: 132615

SEQ ID NO: 259080 - RNA, 64 nt, hsa; identical to SEQ ID NO: 132616

SEQ ID NO: 259081 - RNA, 58 nt, hsa
aacccuuggugugggucugaggucuugacucaacgagagcacuugaaaaugaaaugac

SEQ ID NO: 259082 - RNA, 64 nt, hsa
ucaccucgccaucccugccgucccaaggcucucucucaacgaugguagggaaagccccgccucc

SEQ ID NO: 259083 - RNA, 64 nt, hsa
gguaaauuccaugugccucuggguacaaaagugccucaacgacaugcucuggaaaucccaaaug

SEQ ID NO: 259084 - RNA, 64 nt, hsa
aggggcuugugauggcuacaauggcuccuagacacucaacgacuucaucuguggcagggagaga

SEQ ID NO: 259085 - RNA, 64 nt, hsa
gaagaucugguugaaaauuguauuucuauguaaacucaacgauauguuugguuuuccugaaaau

SEQ ID NO: 259086 - RNA, 64 nt, hsa
cucugccaaacaacacccaguccuauuccaaacucucaacgauucuaucuuguuccuguuuuuc

SEQ ID NO: 259087 - RNA, 64 nt, hsa
cugacucugucuuguccgacucucuugagaauuucucaacgauugcucaugccugucaguauca

SEQ ID NO: 259088 - RNA, 64 nt, hsa
aaacaaaaaagaggcacuagucuaucugcaauuacucaacgaggcauuuucauaggaaacagac

SEQ ID NO: 259089 - RNA, 64 nt, hsa
aggggucaaaaagcuuauuucuuuuaaucucuuacucaacgaacacaucuucugaugauuuccc

SEQ ID NO: 259090 - RNA, 64 nt, hsa
uauucaguucccuuuuucccuuuuaaaaugcuuccucaacgaaggggaacaaauaccuggauaa

SEQ ID NO: 259091 - RNA, 64 nt, hsa
cgcccgcaggguggagaucgcugcaucccugcagcucaacgagacccaagugaagaucugguuc

SEQ ID NO: 259092 - RNA, 64 nt, hsa
auauauagugugugauguguaaaucaggucaaaccucaacgacaauugaaaguuguuauugucc

SEQ ID NO: 259093 - RNA, 64 nt, hsa
acucuccccucaaagaaaagacauucagguguuucucaacgacaucuucuguccagcaagcucg

SEQ ID NO: 259094 - RNA, 64 nt, hsa
agggcugggcacucccugagacccaaagacccaccucaacgacgaguggcguugagccacuucc

SEQ ID NO: 259095 - RNA, 64 nt, hsa
cccgcuccagcggcaccacguccggcacugcgugcucaacgagcuggcccagcugggccuggag

SEQ ID NO: 259096 - RNA, 64 nt, hsa
ggugaccgaguucggcaauaaguacuggcucaugcucaacgagaaggaggcccagcaaguguau

SEQ ID NO: 259097 - RNA, 64 nt, hsa
uuucauucugaaacuucuuaucaauuaccuaaaucucaacgaaaaacaauuuacugaagccgac

SEQ ID NO: 259098 - RNA, 64 nt, hsa
uacauuuuuuuccuuugcaaauucuguaauuucacucaacgauuaagucuaccaaagaacacac

SEQ ID NO: 259099 - RNA, 64 nt, hsa
gaaaauuuccagauaagacaugucaccauuaauucucaacgacugcucuauuuuguuguacggu

SEQ ID NO: 259100 - RNA, 64 nt, hsa
ggagaaagagaucuccgugcccuacagaccuuuucucaacgaaugugggaaggaccuggcuuua

SEQ ID NO: 259101 - RNA, 64 nt, hsa
uuucuauaggcaaaguagaaaauucgaaaagguccucaacgaguuuguacagcugcucccacuc

SEQ ID NO: 259102 - RNA, 64 nt, hsa
cagggaacaagaguuguaguguuagugcaacugucucaacgaugcuguguggcuucagacccaa

SEQ ID NO: 259103 - RNA, 64 nt, hsa
gcugccuacccuuuucucuccucugguucucaaccucaacgaguucaaaucaguuguccuuuuu

SEQ ID NO: 259104 - RNA, 64 nt, hsa
guaaagcagggccgagacagaaagaaaauagauucucaacgagauuucacuguggcuucuccag

SEQ ID NO: 259105 - RNA, 64 nt, hsa
gcuugggggaggacucaguucacaaaaugcaaaacucaacgaucagauucacggacccagagcu

SEQ ID NO: 259106 - RNA, 64 nt, hsa
ggccgacgagauggccaaggcgcuggaggcggagcucaacgaccucaugugagcgcgggcagcg

SEQ ID NO: 259107 - RNA, 64 nt, hsa
gccacagucaccacuccaugacaucccugucuuccucaacgacuucuuccucgacaucuuccuc

SEQ ID NO: 259108 - RNA, 64 nt, hsa
cagaacuucagggacugggagcagaggccccucacucaacgacguuugugcgacauaguauugu

SEQ ID NO: 259109 - RNA, 64 nt, hsa
uggggucuccgaagagggucccuccuuuuugggggaaggucagcccagccccuccaaaggucug

SEQ ID NO: 259110 - RNA, 64 nt, hsa
cacaggugggaucggcacucagggggucuggaaagaaggucauaagggagcaugauaggauuug

SEQ ID NO: 259111 - RNA, 64 nt, hsa
caaucaaaauauguugucacagaaagaauagguggaaggucauagccuggaacccaaguuugaa

SEQ ID NO: 259112 - RNA, 64 nt, hsa
gaauuagcccaaaauuaucaaagaacauuaacuggaaggucagguuuuucaaggaacauagcuu

SEQ ID NO: 259113 - RNA, 64 nt, hsa
cuuaggagugggguuuuaugguggaugaggcuucuuccuggauggggcagagcuucuccugacc

SEQ ID NO: 259114 - RNA, 64 nt, hsa
gccccucauggcgggacuggagaaaugguccgcuuuccuggagccaauggcccggccccuccug

SEQ ID NO: 259115 - RNA, 64 nt, hsa
cuccagggcucugcucgucgggggcugggagauguuccuggaggaggacacucccaucagaacu

SEQ ID NO: 259116 - RNA, 64 nt, hsa
cuucugggcucugcccgcugggggccugaagacauuccuggaggacacucccaucagaaccugg

SEQ ID NO: 259117 - RNA, 64 nt, hsa
ggggcucaccccccuuccagcggcuggucccgcuuuccuggaauuuggccugggcguaugcaga

SEQ ID NO: 259118 - RNA, 64 nt, hsa
ggcagucugauuccucucauucuccauagucuguuuccuggaaagucgauguaauuaacugaug

SEQ ID NO: 259119 - RNA, 64 nt, hsa
uguucguucuaacacugcauuuuccuacaccccuuuccuggacugcucucuccagaaacagcac

SEQ ID NO: 259120 - RNA, 64 nt, hsa
ugugugugugugucucuuugagcaucucucuucauuccuggaaugagccauggacaguaaaguu

SEQ ID NO: 259121 - RNA, 64 nt, hsa
ugugugugugugugucuuugagcauuucucuucauuccuggaaugugugugugugugugucucu

SEQ ID NO: 259122 - RNA, 64 nt, hsa
gggaauuacaacccaucacucccaaugccucccuuuccuggaggagccugcugcauucuccugc

SEQ ID NO: 259123 - RNA, 64 nt, hsa
cccagagagggcaggugcccaccccacaggcccuuuccuggaccauggagccaggugaaaccug

SEQ ID NO: 259124 - RNA, 64 nt, hsa
ccaucccagugccagcuacuccuuccuggaagccuuccuggauuucacgcaucccauccucugg

SEQ ID NO: 259125 - RNA, 64 nt, hsa
ugcuguuccugcccaucccagugccagcuacuccuuccuggaagccuuccuggauuucacgcau

SEQ ID NO: 259126 - RNA, 64 nt, hsa
uccuggacaaguugcuggcuccugagaccaguauuuccuggagcugugccucagugaaggggcc

SEQ ID NO: 259127 - RNA, 64 nt, hsa
aagaggaauuauacagaaggaacagcaggagguuuuccuggacaccgccaacuucacauugcuc

SEQ ID NO: 259128 - RNA, 64 nt, hsa
acuggcacuccagggagcucugguagccuggccuuuccuggacagacugaagagcugagcaggg

SEQ ID NO: 259129 - RNA, 64 nt, hsa
cuugagccucuuuccugauacccaacugcucgaguuccuggaugugcagaaguaagccuucccu

SEQ ID NO: 259130 - RNA, 64 nt, hsa
caacaugucauuuugaaacuggauugauuugcauuuccuggaacucugccaccucauuucacaa

SEQ ID NO: 259131 - RNA, 64 nt, hsa
aaaggaacacaugccauccaagugaugauggcuuuuccuggagggaaaggauaggcuguugcuc

SEQ ID NO: 259132 - RNA, 64 nt, hsa
gcccgcaaccccuccucucugugucccccgcccguuccuggaaacugagcuugacguuuguaaa

SEQ ID NO: 259133 - RNA, 64 nt, hsa
uugguugggggcuccuguuucucauccuagcuuuuuccuggaaagcccgcuagaagguuuggga

SEQ ID NO: 259134 - RNA, 64 nt, hsa
gaugcauggccucuaagagugcccgugucgguucuuccuggaaguugacuuuccuuagacccgc

SEQ ID NO: 259135 - RNA, 64 nt, hsa
gaaguggaucuaaauggaagcaucugcuguuuaauuccuggaaaacuggcugggcagagccugu

SEQ ID NO: 259136 - RNA, 64 nt, hsa
ugaguaaaagcagagagaaguacuuuugauuauuuuccuggagugaagaaaacuugaacaagaa

SEQ ID NO: 259137 - RNA, 64 nt, hsa
gggcccacccagggagcugaugccccuucuccccuuccuggacacacucucauguccccuuccu

SEQ ID NO: 259138 - RNA, 64 nt, hsa
auuggagcaccugggccccacuggacaacacugauuccuggagagguggcugcgcccccagcuu

SEQ ID NO: 259139 - RNA, 64 nt, hsa
cgggaauacagaaagauacagcacuccucaugccuuccuggagguagaaggccaguggcagcga

SEQ ID NO: 259140 - RNA, 64 nt, hsa
auuccacacaucuucuuggucuugcauaaggcaguuccuggagacccagcacucugguucucuc

SEQ ID NO: 259141 - RNA, 64 nt, hsa
ugaagaaucuuaaugcuuguaauuuaaacauuuguuccuggaguuuugauuugguggaugugau

SEQ ID NO: 259142 - RNA, 64 nt, hsa
uuaguugaaaggccucaagaacaaacacugcaguuuccuggaaaagaagaaacuuugccucaag

SEQ ID NO: 259143 - RNA, 64 nt, hsa
gguuugccgagggcugcccagcucugcuucugguuuccuggacaauuucucugucagauacggc

SEQ ID NO: 259144 - RNA, 64 nt, hsa
ggguguuugagacaggucacaagcgcguggauguuuccuggaaguguauuccccuggggcucag

SEQ ID NO: 259145 - RNA, 64 nt, hsa
cuucucuaguggaguuacugcagcuuagggaugguuccuggaaguggacacauuuuacaaaaac

SEQ ID NO: 259146 - RNA, 64 nt, hsa
uuucauuucuuaggcauuuucucucuuauaaaguuuccuggauuuauaaauuuucauugauuuu

SEQ ID NO: 259147 - RNA, 64 nt, hsa
ucucuucuaaacgauggcauucuauguaaugccuuuccuggacuuuuuuggccacugcccugga

SEQ ID NO: 259148 - RNA, 64 nt, hsa
guggucuuuguuauuagggcuuaugguacauggcuuccuggaaucaaaaugugaauucaugugg

SEQ ID NO: 259149 - RNA, 64 nt, hsa
auaaggagagcugagauuggagggaauuguguuguuccuggaggaagcccaggcaucauuaaac

SEQ ID NO: 259150 - RNA, 64 nt, hsa
gcaucgaguaaugucacuggacucggccuaagauuuccuggaacuuccagauucagagaaucug

SEQ ID NO: 259151 - RNA, 64 nt, hsa
augacaggcaauaauauauuggccccauuagcccuuccuggagcagucauaaugaauuacaguc

SEQ ID NO: 259152 - RNA, 64 nt, hsa
uuagaauauagcuagguccaauguuaaauacauuuuccuggaguacauuugucacauucagcuu

SEQ ID NO: 259153 - RNA, 64 nt, hsa
gaguuuggcaggcaggugccaggaacuccccuucuuccuggagugccuucauugaggaaggaaa

SEQ ID NO: 259154 - RNA, 64 nt, hsa
ugaugauaaaaggagaauaagaaaaggcaucacuuuccuggauccaggauaauuuuuaaaccaa

SEQ ID NO: 259155 - RNA, 64 nt, hsa
gcgugucugugcaaacuggaggacuccuuccaacuuccuggaacaaagcgacaucgccagcagc

SEQ ID NO: 259156 - RNA, 64 nt, hsa
acauucuccuugcagcuaccuccaugugagugaauuccuggauaaagcaagauuuccuuucaau

SEQ ID NO: 259157 - RNA, 64 nt, hsa
ccagagcuggacgggccagaacugcgcugcacacuuccuggacugaggcggggacuuugggucc

SEQ ID NO: 259158 - RNA, 64 nt, hsa
ucccuccccuagaccacggggcgggcagcucggguuccuggagggcuguuucccccacgcuguc

SEQ ID NO: 259159 - RNA, 64 nt, hsa
aauguucaaguaucucauccacucaguuuugugauuccuggauauuuguguguuguaaaguguu

SEQ ID NO: 259160 - RNA, 64 nt, hsa
uugguauuaucacuguuaacacuuuuuuuuccuuuuccuggaagguuugucauuucucuaaagu

SEQ ID NO: 259161 - RNA, 64 nt, hsa
gagaggacuuggggcauggccucuggggccacccuuccuggaacucagagaggaagguccgggc

SEQ ID NO: 259162 - RNA, 64 nt, hsa
gggccagcauuuuggagggagcuuccuuccuuccuuccuggacaggucgucaugauggaugcac

SEQ ID NO: 259163 - RNA, 64 nt, hsa
aggaugagggggcucagcggggggagcuggcaccuuccuggagccuccagccaguccuguccuc

SEQ ID NO: 259164 - RNA, 64 nt, hsa
uccagaggugaugccugccucagccagggagggcuuccuggaggagaaggagccagcuagacau

SEQ ID NO: 259165 - RNA, 64 nt, hsa
uuccugauccagcaguccaggccccagccccuucuuccuggacccaggaguugaagccuccauc

SEQ ID NO: 259166 - RNA, 64 nt, hsa
cucagacccaggacuccaggcccccagccccuccuuccuggacccaggacuccaggcccccagc

SEQ ID NO: 259167 - RNA, 64 nt, hsa
uucauuguuaagaguuaacuugugguuuggcuguuuccuggauuuuauaacauacaugugcaga

SEQ ID NO: 259168 - RNA, 64 nt, hsa
ugguauuucauuuuuuucuuaucuaaaucuuaguuuccuggaauaauaaaguuugauguucagc

SEQ ID NO: 259169 - RNA, 64 nt, hsa
uuggaagacauggauuuccuggaagacguggauuuuccuggaagaucuggauuugguggaagac

SEQ ID NO: 259170 - RNA, 64 nt, hsa
auggaagaccuugaaauuauuggaagacauggauuuccuggaagacguggauuuuccuggaaga

SEQ ID NO: 259171 - RNA, 64 nt, hsa
agccagaucgggagcaaaccaaagaccaucugaggaaugagaagucugcggaggcggccaggga

SEQ ID NO: 259172 - RNA, 64 nt, hsa
caacggaugaauguagcccuuccaacaccugacagaaugagaccaaacgcagccagccagaucg

SEQ ID NO: 259173 - RNA, 64 nt, hsa
uucuaccuagauuugaaugaguguuuuuuuaagggaaugagaaugucauggugcuaaaccugac

SEQ ID NO: 259174 - RNA, 64 nt, hsa
cuaccuaacacugagcgcuguuuuuaaaugaaaagaaugagauuuauaaccacuugaguguuau

SEQ ID NO: 259175 - RNA, 64 nt, hsa
acagaaaauuuacgaaaaucuuagauuuuguuuagaaugagaaaauauacaauuagaauuauuu

SEQ ID NO: 259176 - RNA, 64 nt, hsa
aucaauuuggguaaagaaaggaauacuuuuguuagaaugagaauuaaagagaaaacaaaagaau

SEQ ID NO: 259177 - RNA, 64 nt, hsa
gcaguuuuuauauuugucaauuuaugaauauaaugaaugagaguucugguaccuccugucuuua

SEQ ID NO: 259178 - RNA, 64 nt, hsa
gucaagagucacuacaacugauuaguuguuuagagaaugagaaauggaacagugaggaauggag

SEQ ID NO: 259179 - RNA, 64 nt, hsa
agauucuuaaauuugggccucuuagaauaauuuugaaugagaucuaccgacucacuugugagaa

SEQ ID NO: 259180 - RNA, 64 nt, hsa
gauauuuuacugccuuuccuuuuaauuuuuguuugaaugagaaaaguuuaauacaacagguguc

SEQ ID NO: 259181 - RNA, 64 nt, hsa
uugaauacuccauccccuucccucccagugaauggaaugagaaaagccuucuuccuuugcuuca

SEQ ID NO: 259182 - RNA, 64 nt, hsa
ccuuuugacuggaaccagauggcacugagaaaaagaaugagaaccaccuuauucuucugaaaaa

SEQ ID NO: 259183 - RNA, 64 nt, hsa
accucauuuacuguuuggguaaaaauucuaagcugaaugagaguuucuguauaacauaacuggu

SEQ ID NO: 259184 - RNA, 64 nt, hsa
uaagaauuugcagguacuacagauuuucaaaacugaaugagagaaaauuguauaaccauccugc

SEQ ID NO: 259185 - RNA, 64 nt, hsa
cccuucgcuugaauauuaucccuguauauugcaugaaugagagauuucccauauuuccaucaga

SEQ ID NO: 259186 - RNA, 64 nt, hsa
aagaguagcaagaugcugcagcacauugacuauagaaugagauguauccugcaagauggccgaa

SEQ ID NO: 259187 - RNA, 64 nt, hsa
gcucgagggacgccaauaggcaugccgccuccgggaaugagacccccuccaccaggcauuagag

SEQ ID NO: 259188 - RNA, 64 nt, hsa; identical to SEQ ID NO: 206424

SEQ ID NO: 259189 - RNA, 64 nt, hsa; identical to SEQ ID NO: 206425

SEQ ID NO: 259190 - RNA, 64 nt, hsa; identical to SEQ ID NO: 206426

SEQ ID NO: 259191 - RNA, 64 nt, hsa; identical to SEQ ID NO: 206427

SEQ ID NO: 259192 - RNA, 64 nt, hsa; identical to SEQ ID NO: 206428

SEQ ID NO: 259193 - RNA, 64 nt, hsa; identical to SEQ ID NO: 206429

SEQ ID NO: 259194 - RNA, 64 nt, hsa
auggauucuuguaccuaacauuuuauccucuuagaucuaagagccgaagcuauagaacuuuguu

SEQ ID NO: 259195 - RNA, 64 nt, hsa
aacuuuuauuucagagauauuugauuaguuuacaaucuaagaguuauucuuaagaguuucagug

SEQ ID NO: 259196 - RNA, 64 nt, hsa
auccacaucuaagaaaauuuacuguaacuucuuaaucuaagaaaauuauguauuuuugucauau

SEQ ID NO: 259197 - RNA, 64 nt, hsa
aacuugucuuacauaaucacaauaauauauccacaucuaagaaaauuuacuguaacuucuuaau

SEQ ID NO: 259198 - RNA, 64 nt, hsa
gagaaucacuuuucuagacaucuaccuauacuuaaucuaagaaacaaaguaaucuacuguaaag

SEQ ID NO: 259199 - RNA, 64 nt, hsa
acacuuauaguaaauggggacauucacuauaaugaucuaagaagcuacagauugucauaguugu

SEQ ID NO: 259200 - RNA, 63 nt, hsa
uaaguuaauaagcaaaauccugacuauuauguuguuagagaaaaaugcuuugcuuugucugga

SEQ ID NO: 259201 - RNA, 63 nt, hsa
auuacuuuuuuccaauuuuagaaaaucaagcagguuagagaaaauagagaugaauuaggggac

SEQ ID NO: 259202 - RNA, 63 nt, hsa
aaagccugaucucauggagaccugcauggcccuguuagagauggcguagaagugaaagucuua

SEQ ID NO: 259203 - RNA, 63 nt, hsa
ccucucacaacuacauguauguguggcauuuuuguuagagaugagaaaaggauugagaaggau

SEQ ID NO: 259204 - RNA, 63 nt, hsa
uccuuaaguuauaucaucagaaaauuagcucugguuagagagguuaguuucagagugcuccaa

SEQ ID NO: 259205 - RNA, 63 nt, hsa
ggaagauacuauugguguauuaauuuuaucuuuguuagagaugaaaguagcccacuuuauguu

SEQ ID NO: 259206 - RNA, 63 nt, hsa
agaguuuugauauuuucugaaagaggaacauguguuagagaugaagaaucuuccaaggcucau

SEQ ID NO: 259207 - RNA, 63 nt, hsa
cacuggauuccacccaacugccaaguuaguauuguuagagauuucauuuuacaacacaaaaau

SEQ ID NO: 259208 - RNA, 63 nt, hsa
gagguaccaaguaagccggcagaagaguuaaggguuagagaaaucccuuauuucaugucuuga

SEQ ID NO: 259209 - RNA, 63 nt, hsa
aauuuauuguggcgagacuuguccauugugaaaguuagagaacauuauguuuguaucauuucu

SEQ ID NO: 259210 - RNA, 63 nt, hsa
ugcugccuugcugcauaaaauucuagagggcagguuagagacaguauguaugccuucgggaaa

SEQ ID NO: 259211 - RNA, 63 nt, hsa
gcuuacuuccauugcaaaauagaagaagaggaaguuagagauaauucugaucaaucauuuugg

SEQ ID NO: 259212 - RNA, 64 nt, hsa
cuuccucuguaaauauccaaguauaaagcccaggaacuucuagaauaacccagaugcgcuuuaa

SEQ ID NO: 259213 - RNA, 64 nt, hsa
cgcuuuaauuuuuuuuaauauguuuugaucacagaacuucuagaauaacccagaugcucuuuca

SEQ ID NO: 259214 - RNA, 64 nt, hsa
gaauaaaaagaaauuguucuuuuaaaauauguguaacuucuaaaaauaaaacuuaaaauuuaua

SEQ ID NO: 259215 - RNA, 64 nt, hsa
auaagacacuuguacggaacacugaagcuuugccaacuucuacacaugccuuuuuugcaguccu

SEQ ID NO: 259216 - RNA, 64 nt, hsa
ugcuugagauauuucaacauguuauguauauuggaacuucuacagcuugaugccuccugcuuuu

SEQ ID NO: 259217 - RNA, 64 nt, hsa
uuguauuuacuucuuuuuuuaaauguaaggaccaaacuucuaaacuaauuguucuuuuguugcu

SEQ ID NO: 259218 - RNA, 64 nt, hsa
gcagcucugcaaaggaacaguuuuuaaaaaugggaacuucuacauugaaaaguccccauuuuug

SEQ ID NO: 259219 - RNA, 64 nt, hsa
gguauauguguauuagugaaacauuguaaaggugaacuucuaccucuguaucuaaauguauacc

SEQ ID NO: 259220 - RNA, 64 nt, hsa
auccauugagaaauagcaauauucuagcuauuguaacuucuaaaaaugguauggccauuagauc

SEQ ID NO: 259221 - RNA, 64 nt, hsa
caaagcaggccauuucucccaccugaaaguacauaacuucuaucacuugccacauaauuaaaag

SEQ ID NO: 259222 - RNA, 64 nt, hsa
ccuucucuuuuaauugcagugaaguucucuuuauaacuucuaaaauucggaauucuagauccuu

SEQ ID NO: 259223 - RNA, 64 nt, hsa
uauuuuuauguuucuggugugugaacuuuaugguaacuucuacucuagaauacguacguaugca

SEQ ID NO: 259224 - RNA, 64 nt, hsa
ugucaccuuccuguauuuccacagagcaugcaagaacuucuacaaaacuucuauaccacacaga

SEQ ID NO: 259225 - RNA, 64 nt, hsa
uguauuuccacagagcaugcaagaacuucuacaaaacuucuauaccacacagaagcugaaagag

SEQ ID NO: 259226 - RNA, 64 nt, hsa
cucaugguagguuauauugaaggcugacauggagaauguuuacuuuucuauuuggcauagcuaa

SEQ ID NO: 259227 - RNA, 64 nt, hsa
ucaguguuuuuaggauuugggaaaauaaacuguaaauguuuauuugauagguaaauauaguuuu

SEQ ID NO: 259228 - RNA, 64 nt, hsa
uauucacacuugaauugcauuugugaucaaaauaaauguuuaaaucgcuaaaggaaaauacagu

SEQ ID NO: 259229 - RNA, 64 nt, hsa
agugagaugcuuuauggauugaaggauaugguaaaauguuuauaguuuacuuugaaaguaaaau

SEQ ID NO: 259230 - RNA, 64 nt, hsa
ucacugcuauauaagggaaacuaccuuaggaaagaauguuuacugaauguuuauuuuauuuuau

SEQ ID NO: 259231 - RNA, 64 nt, hsa
uaagggaaacuaccuuaggaaagaauguuuacugaauguuuauuuuauuuuauuuuuuuuuuac

SEQ ID NO: 259232 - RNA, 64 nt, hsa
cucuuccuuuuuauucacucuucccacgaauuuaaauguuuaaguuauauucaucacuagcaag

SEQ ID NO: 259233 - RNA, 64 nt, hsa
uacuuaguuuuuguaucuaaucucugauuauuaaaauguuuauaaaguuuauuuuuaccaaaga

SEQ ID NO: 259234 - RNA, 64 nt, hsa
ugauuuaguuuauauguuuuuggaagaaaccauuaauguuuaauuuaaucuuaauaccaaaacg

SEQ ID NO: 259235 - RNA, 64 nt, hsa
ugaaguuucuccguuaaagauugggagucgucgaaauguuuagauucuuuuaggaaaggaauua

SEQ ID NO: 259236 - RNA, 64 nt, hsa
uacucuuuucucaugcacauguuacguuggagaaaauguuuacaaaaaugguuuuguuacacua

SEQ ID NO: 259237 - RNA, 64 nt, hsa
aacuuguaaaacaaauuguguuugcuuuaagaaaaauguuuauugcacucaugucauaggguua

SEQ ID NO: 259238 - RNA, 64 nt, hsa
gaaagcaaugacuaacauuuaauuuguuuacaaaaauguuuauugucuucaguacaaaaaguua

SEQ ID NO: 259239 - RNA, 64 nt, hsa
agaaaaagaaaucagcuuaaaugagguauuaaguaauguuuagagucguagguauuaacuagaa

SEQ ID NO: 259240 - RNA, 64 nt, hsa
uuauuucuacacugacaggauuuacuaguuaagcaauguuuaauauaaauuuuaaaaaacuucu

SEQ ID NO: 259241 - RNA, 64 nt, hsa
uaaauugaagugacaaagaguauuauuaaaauacaauguuuauacgucuauuuguguauuguag

SEQ ID NO: 259242 - RNA, 64 nt, hsa
guuuuguagaauauugcaaauuaaccacacaaaaaauguuuaauuuaugcaacaagcauguuug

SEQ ID NO: 259243 - RNA, 64 nt, hsa
uucuuguggcuagaaguagccugaguuugcuguuaauguuuaacacauuuucuugaguaacagu

SEQ ID NO: 259244 - RNA, 64 nt, hsa
uauauauuguuacugaauugugaauaucugcagaaauguuuacuagagaaccugugacuguuga

SEQ ID NO: 259245 - RNA, 64 nt, hsa
uaaaguauauaugaugucauuaauacuuuuucuaaauguuuaguuuucuaaauuguauaauaau

SEQ ID NO: 259246 - RNA, 64 nt, hsa
ucuguguuauacuguauagguacuuguagcucuaaauguuuaaaguaacuaccaccuaacccaa

SEQ ID NO: 259247 - RNA, 64 nt, hsa
uauuauuuaauuccuuaauuuggaaagcaguuuuaauguuuacaguuuaagauacucauuuuca

SEQ ID NO: 259248 - RNA, 64 nt, hsa
augugaugcugcacugaaaaaacuggucacacaaaauguuuauauguuugacugcauaaguauu

SEQ ID NO: 259249 - RNA, 64 nt, hsa
uuacuuguuuaugauggcauaaccauugcuuuaaaauguuuagacaguagaauauugaauuuau

SEQ ID NO: 259250 - RNA, 64 nt, hsa
uuaaagaauuuuuauucuuucugaagaacuaauuaauguuuaaagcaacuguuuaauaugaugg

SEQ ID NO: 259251 - RNA, 64 nt, hsa
cugaguucuuugauuuacucaugcugcaugacaaaauguuuacuaauaacaauucauuauaaag

SEQ ID NO: 259252 - RNA, 64 nt, hsa
uaagaaacaugaucuuugcucauuaaagagcuaaaauguuuauugcuguuuugucuuucuuuuu

SEQ ID NO: 259253 - RNA, 64 nt, hsa
uauuagaacuuggguuaaaaauguuuaagaagcuaauguuuaagaagcauuugggaaagaaaaa

SEQ ID NO: 259254 - RNA, 64 nt, hsa
cuggcgcaguggaccuauuagaacuuggguuaaaaauguuuaagaagcuaauguuuaagaagca

SEQ ID NO: 259255 - RNA, 64 nt, hsa
uuuuuuuucuuccccaugggggagauugucuuccaauguuuaacuacguuuaaauaaauaaaaa

SEQ ID NO: 259256 - RNA, 64 nt, hsa
cuguguaagccauugauauaacgcuguaauuaaaaauguuuauaugaaauaacuuaauguuuua

SEQ ID NO: 259257 - RNA, 64 nt, hsa
ugaaaaauaaaaagcauuuauuguuuuugcaauaaauguuuaaaauauuucaauaaagauagca

SEQ ID NO: 259258 - RNA, 64 nt, hsa
uuguuuuuaugugugaaacguugagaacaaucuaaauguuuaucaguuggaaguaaguuauggu

SEQ ID NO: 259259 - RNA, 64 nt, hsa
aucuuuuuaaaaaguaaaauucugucagacuacaaauguuuagcuguuacucauuucuagggaa

SEQ ID NO: 259260 - RNA, 64 nt, hsa
agcaguauuaugaaaaaaaauucccccucauuagaauguuuaagaaaucuuuuuaaaaaguaaa

SEQ ID NO: 259261 - RNA, 64 nt, hsa
cugcuguuuuauugugguugugguucaaguuuuuaauguuuaaaguugaugcuguuuucagaag

SEQ ID NO: 259262 - RNA, 64 nt, hsa
agauuuuuaaacuuuauuuucauaauuucugcuuaauguuuaaaauugaagagccuuuucaugu

SEQ ID NO: 259263 - RNA, 64 nt, hsa
gaggacuuuguucuacaucagauuuuacuauuugaauguuuaagaucacuuuauugaauuugaa

SEQ ID NO: 259264 - RNA, 64 nt, hsa
gaggacuuuguucugcaucagaucuuacuauuugaauguuuacuguuggauuuugggcaucuua

SEQ ID NO: 259265 - RNA, 64 nt, hsa
ccuuaccuaguuaucuacaaauguucauuccagaaauguuuaguuacugaauugaaugaagaca

SEQ ID NO: 259266 - RNA, 64 nt, hsa
ugaugacuuuuuuuuaaaugagguucaguaccauaauguuuauuuacuggaagauaaugcauuu

SEQ ID NO: 259267 - RNA, 64 nt, hsa
uaccucagauaauauguuuaguuuuacauuuuaaaauguuuaaauucucuuucacagcaccaaa

SEQ ID NO: 259268 - RNA, 64 nt, hsa
uuaucugauuaagcauucuuuccacugaaugcauaauguuuaaauagcauaaaaugaaaugcua

SEQ ID NO: 259269 - RNA, 64 nt, hsa
aaugacaguaauauuggcauagaaaaaaguagcaaauguuuacuguaucaauuucuaauguuua

SEQ ID NO: 259270 - RNA, 64 nt, hsa
aaaaaaguagcaaauguuuacuguaucaauuucuaauguuuacuauauagaauuuccuguaaua

SEQ ID NO: 259271 - RNA, 64 nt, hsa
auuuaaaauuuuuauuuaagaggauuaaagcccuaauguuuauuuuccuacuuucugaaaacaa

SEQ ID NO: 259272 - RNA, 64 nt, hsa
aauaggacugcacgcuugguguacuuuaaauguuaauguuuaauuuaaaauuuuuauuuaagag

SEQ ID NO: 259273 - RNA, 64 nt, hsa
uagccucacucuuauuccucaagaauuaauauccaauguuuaugagucuugcaaucaauuuugu

SEQ ID NO: 259274 - RNA, 64 nt, hsa
aaauaguaauaguaugaaaauacuagauaaaauuaauguuuaaaauguuuuuguaacaauaauu

SEQ ID NO: 259275 - RNA, 64 nt, hsa
aaaacuaaauaaaaugcacuguauucuuacaguuaauguuuauaacuauaguaaaaaauuaaua

SEQ ID NO: 259276 - RNA, 64 nt, hsa
uuugacacaaauuauguuauugaaaagcauuauuaauguuuaauuuauuuaaaauuuuggaauu

SEQ ID NO: 259277 - RNA, 64 nt, hsa
aaaauggaagccaacacaucacucauuuuaggcaaauguuuaaacauuuuuaucuaucagaaug

SEQ ID NO: 259278 - RNA, 64 nt, hsa
uuuaggcaaauguuuaaacauuuuuaucuaucagaauguuuauuguugcugguuauaagcagca

SEQ ID NO: 259279 - RNA, 64 nt, hsa
ggauuccaaacagguaccacauugucucugagcuaauguuuauauuuuuccauucaggcaccga

SEQ ID NO: 259280 - RNA, 64 nt, hsa
augguuguguuuucagaauucaacauuaaagauuaauguuuauuuaaacgaacacauuccugca

SEQ ID NO: 259281 - RNA, 64 nt, hsa
cagaagaaccuggaggacggaggaaaccaggggcaauguuuacaagacugguggacaaguguaa

SEQ ID NO: 259282 - RNA, 64 nt, hsa
gcauugcugacauucuggaauauuugcaucuaaaaauguuuacucguugccaugcugcaguccg

SEQ ID NO: 259283 - RNA, 64 nt, hsa
ugaaaggcacugaguuuuguaaaucaggacccuaaauguuuaauuguaaauaaguuucagauaa

SEQ ID NO: 259284 - RNA, 64 nt, hsa
ugguaauuguacaauacuugcauuccagaguuaaaauguuuacuguaaauuuuuguucuuuuaa

SEQ ID NO: 259285 - RNA, 64 nt, hsa
gcaagcuuuugccaaugaucuuuaauggaguuaaaauguuuaugguaauuguaaccuuucaaau

SEQ ID NO: 259286 - RNA, 64 nt, hsa
cggauguuauuucuguuauacaucugaauuuuaaaauguuuacugauagauaauggauuuaaag

SEQ ID NO: 259287 - RNA, 64 nt, hsa
ucaaguaauuuaauaguauagcuuaauucuagacaauguuuaaguuggucuaccuuuauuaaaa

SEQ ID NO: 259288 - RNA, 64 nt, hsa
guuaaauauuccugcacuagugauggucacuuagaauguuuauagaaauguggauaauaacuac

SEQ ID NO: 259289 - RNA, 64 nt, hsa
uuuucccuuuagcauugcaugugaauaagaaaauaauguuuaaagaaaaaaaaaaaaaagcaaa

SEQ ID NO: 259290 - RNA, 64 nt, hsa
agcugaaugguuuaaucugacuggcuuccuaagaaauguuuaagacucagcuuuaaaaagaagu

SEQ ID NO: 259291 - RNA, 64 nt, hsa
cuccccuccacaaaaaggagaaagagugcauuaaaauguuuaguuggguuuuuuaauuuuuaau

SEQ ID NO: 259292 - RNA, 64 nt, hsa
ccuccaaaacuggaagcccaucauaaggcaugagaauguuuaacuauaaagccuuuuauuaguu

SEQ ID NO: 259293 - RNA, 64 nt, hsa
cugcuucuuccugaggucuagaacaaggucuggaaauguuuagacaggauauuuucuugaugaa

SEQ ID NO: 259294 - RNA, 64 nt, hsa
aaagcacuuuguaguucucuauugccaacaauuuaauguuuauguguugccaauucuugcaacc

SEQ ID NO: 259295 - RNA, 64 nt, hsa
aagacuuuagguaauggaaauauaaauaagaaagaauguuuaacauaauaugcuaaaaauauuu

SEQ ID NO: 259296 - RNA, 64 nt, hsa
gaaaaagacuaagggaauauauggaaauauuaacaauguuuauuuuggaugaauggaauucuag

SEQ ID NO: 259297 - RNA, 64 nt, hsa
cuugcuaaaacucuauguaaauuuaaguaugcaaaauguuuaagucacauuauuuauuuuucau

SEQ ID NO: 259298 - RNA, 64 nt, hsa
uaugcuuauagguguuacauacaaauaaacaugcaauguuuauguuguacuguauaagagguaa

SEQ ID NO: 259299 - RNA, 64 nt, hsa
uuuuaagcucuuugccaauauuccauuucucuagaauguuuauccuaagcacuuguuugucagc

SEQ ID NO: 259300 - RNA, 64 nt, hsa
augaucuuuuucuuuccuucccaagaaacugaggaauguuuaauaugaaaacauacaucggaua

SEQ ID NO: 259301 - RNA, 64 nt, hsa
ugaaccaugucuccgcacauuucccuaaaaguacaauguuuagacugcuaugguaauacauauu

SEQ ID NO: 259302 - RNA, 64 nt, hsa
augccauuuguuuccuucugaucucucacugaauaauguuuacuguacagucuucccaagguga

SEQ ID NO: 259303 - RNA, 64 nt, hsa
gaauucaacaauuaauaguugaaauugugagguuaauguuuaaaaagcuuuacaccuguuuaca

SEQ ID NO: 259304 - RNA, 64 nt, hsa
ugaauaucauuuaaucuuuaaaaaaucaaguaaaaauguuuaucugauaauguuuaaauaauuu

SEQ ID NO: 259305 - RNA, 64 nt, hsa
ucuuuaaaaaaucaaguaaaaauguuuaucugauaauguuuaaauaauuuacaauauaaacugu

SEQ ID NO: 259306 - RNA, 64 nt, hsa
uauuuuaaugauuuucuagcaaauaauagagaauaauguuuaugcuuaugcaguuagucuuuau

SEQ ID NO: 259307 - RNA, 64 nt, hsa
uaaucucaguguuuccuugaguagagauguuuuaaauguuuauguuggaagcaauuguaguuaa

SEQ ID NO: 259308 - RNA, 64 nt, hsa
ugagcauaauucacuuuaaagucauuuuuccagcaauguuuaaauuacuuucucauucuuuuag

SEQ ID NO: 259309 - RNA, 64 nt, hsa
aaguuucuuacagaaaguaccugugauuuuuuuuaauguuuagauuuguagucuagucuauucu

SEQ ID NO: 259310 - RNA, 64 nt, hsa
aguuuuguaggguggugggaaaugggggaucuucaauguuuauuuuaaaauaaaauaaaauaag

SEQ ID NO: 259311 - RNA, 64 nt, hsa
uugaauccuacaaaaauacugcaaaagacuagugaauguuuaaaauuacacuagauuaaauaau

SEQ ID NO: 259312 - RNA, 64 nt, hsa
ugccugggucugugucaccuggggcaguguggauaauguuuaguucugugacacuguuuuuugg

SEQ ID NO: 259313 - RNA, 64 nt, hsa
aauucccuuuuuauuuugcugguugguaucuguaaauguuuaauaaauaucugagcauguaucu

SEQ ID NO: 259314 - RNA, 64 nt, hsa
uuugauacuugaaauagagggagcuagaacacuuaauguuuaaucuguuaaaccugcugcaaga

SEQ ID NO: 259315 - RNA, 64 nt, hsa
auuuuugaguuaaagcuagaaaaggguucaacauaauguuuaauuuugucacacuguuuucaua

SEQ ID NO: 259316 - RNA, 64 nt, hsa
uuuguaguuucuucuguaaauauguauuuuucauaauguuuaauauuaagcuuuauauaauacu

SEQ ID NO: 259317 - RNA, 64 nt, hsa
cuguugauacuauguauaauuuauuaaucuggagaauguuuaaaauuuuauauaauuuaaaggu

SEQ ID NO: 259318 - RNA, 64 nt, hsa
uaauccaugcuaaaauggauauuugugauccugaaauguuuacuaagcauuguaaauuuauuua

SEQ ID NO: 259319 - RNA, 64 nt, hsa
aggguaacaauuuuucucaaagggaucuggaaaaaauguuuaaaacucaguagugucagccacu

SEQ ID NO: 259320 - RNA, 64 nt, hsa
uagugcuguuuuugucuacguuauacugaaauuaaauguuuauaauuuauauuuuggguuuaug

SEQ ID NO: 259321 - RNA, 64 nt, hsa
gccuauaugaaaugaaaaauauauuggcaaaauaaauguuuaaaccuuuuacguuaaaauuacu

SEQ ID NO: 259322 - RNA, 64 nt, hsa
aggauuuuugagcacaaaauuaugcaaauauuuuaauguuuauuaauguuuacaguggaauugu

SEQ ID NO: 259323 - RNA, 64 nt, hsa
agcacaaaauuaugcaaauauuuuaauguuuauuaauguuuacaguggaauugugaauaaguuu

SEQ ID NO: 259324 - RNA, 64 nt, hsa
ggguauuuagaaauguagguggcauuuagaacacaauguuuaaucaaugggcugaacaaagaug

SEQ ID NO: 259325 - RNA, 64 nt, hsa
acuacagaauuuucuaggguuuuaaauuauguaaaauguuuacuuauucugagcuuagagagaa

SEQ ID NO: 259326 - RNA, 64 nt, hsa
caucggcaguauggggggcagcugucccagugucaauguuuacucaaggguguucuuaggaggc

SEQ ID NO: 259327 - RNA, 64 nt, hsa
uacagauuuuuuuguuuguuuuuugagaaaaaaaaauguuuacucuuccaucauuuaaaaaaaa

SEQ ID NO: 259328 - RNA, 64 nt, hsa
guugucacaaacugugguuaauccaaucaauuuaaauguuuacuauagaccaaaaggagagauu

SEQ ID NO: 259329 - RNA, 64 nt, hsa
cuauagaccaaaaggagagauuauuaaaucguuuaauguuuauacagaguaauuauaggaaguu

SEQ ID NO: 259330 - RNA, 64 nt, hsa
ucccccgucccccagucugacauauuucauacagaauguuuaaaagaaaaacucugcuagucuu

SEQ ID NO: 259331 - RNA, 64 nt, hsa
uauaugcuuucuaugugaauauaagcuugugcacaauguuuaaaagaaaaacaaugaauuagaa

SEQ ID NO: 259332 - RNA, 64 nt, hsa
ucaaaugcauauuuagauuagauuauugaauuguaauguuuaucugcugcuuuuuuuaaauaaa

SEQ ID NO: 259333 - RNA, 64 nt, hsa
aucugcugcuuuuuuuaaauaaaauuugacugaaaauguuuaauuggcauuuuuuaaugacuua

SEQ ID NO: 259334 - RNA, 64 nt, hsa
cugcugcccaacuccugugagagaaaaaccaaucaauguuuacaaaauggaaaaggacacagca

SEQ ID NO: 259335 - RNA, 64 nt, hsa
auccucagcucagaguguauuuugaauaugagcaaauguuuauguacguaugagauuucaaguu

SEQ ID NO: 259336 - RNA, 64 nt, hsa
caucugguuaugucuuauuuuuuuccuaaaagauaauguuuauuuuuaaaaaggaaggaaggag

SEQ ID NO: 259337 - RNA, 64 nt, hsa
ccuggccucagggcaugcccugccuaccuucugaaauguuuaccccauugaccaaacuuggcuc

SEQ ID NO: 259338 - RNA, 64 nt, hsa
uaucaauaucagagauuuggguaaaagaauggguaauguuuaaacauguggaggcauguggagc

SEQ ID NO: 259339 - RNA, 64 nt, hsa
gaacguuuuagaaaccaagagaugugcagaaagaaauguuuaguguuuuuucguuuuaaauuuu

SEQ ID NO: 259340 - RNA, 64 nt, hsa
uuuauuauuuuuaaaaauacagacuaacugauguaauguuuauguauaaguugcaccaaaaauc

SEQ ID NO: 259341 - RNA, 64 nt, hsa
auauuuagaggaagaaagugaaggggaaauuuaaaauguuuacggcgcuuaauugccuggaaau

SEQ ID NO: 259342 - RNA, 64 nt, hsa
aaaugcccagggauuuaaugcacagguguacuuuaauguuuagggucaguuuguaguauucuug

SEQ ID NO: 259343 - RNA, 64 nt, hsa
cuuuaaggaaaauuaauaaaucauuaauaguuaaaauguuuacauugagcacuagaacauguuu

SEQ ID NO: 259344 - RNA, 64 nt, hsa
aaggcacuauuauaaauuuauccuauaagaugacaauguuuacucaaagucuaacauauucaau

SEQ ID NO: 259345 - RNA, 64 nt, hsa
gcuuucuaucgugacucaauucaacaauguggggaauguuuacuacauuuccaacuugauguca

SEQ ID NO: 259346 - RNA, 64 nt, hsa
acauuuuugcugugaaccacagucgggaagguuuaauguuuagacucuuuccucagaggcuuuu

SEQ ID NO: 259347 - RNA, 64 nt, hsa
ccccccaaaagaagugccuauuacauuuuaccuuaauguuuauuuaucauccaaguguucuuga

SEQ ID NO: 259348 - RNA, 64 nt, hsa
aaaguacugauauaaggucagucuauauucuggaaauguuuauauuaaaguguuuuaauuucua

SEQ ID NO: 259349 - RNA, 64 nt, hsa
aaaugcuuugggaugagucuauucuuggauuuugaauguuuaguuuuguuuacccaagguugaa

SEQ ID NO: 259350 - RNA, 64 nt, hsa
gguccauguaaauacuuuccauguuuuuucuucaaauguuuaaaccacuaguugauguauggua

SEQ ID NO: 259351 - RNA, 64 nt, hsa
gauguaccaauugucaaauuaccguguaccaccuaauguuuauaggagaaagcaaaauacauca

SEQ ID NO: 259352 - RNA, 64 nt, hsa
ggcacauuugauucuuccacauauauuuuguguuaauguuuagguaugauuuuuuucuaaauuc

SEQ ID NO: 259353 - RNA, 64 nt, hsa
uuuuuugucuuucuggcaugccuguacuauuauuaauguuuauauuguaccuugauuuggaaaa

SEQ ID NO: 259354 - RNA, 64 nt, hsa; identical to SEQ ID NO: 101831

SEQ ID NO: 259355 - RNA, 64 nt, hsa; identical to SEQ ID NO: 101832

SEQ ID NO: 259356 - RNA, 64 nt, hsa; identical to SEQ ID NO: 101833

SEQ ID NO: 259357 - RNA, 64 nt, hsa; identical to SEQ ID NO: 101834

SEQ ID NO: 259358 - RNA, 61 nt, hsa; identical to SEQ ID NO: 101835

SEQ ID NO: 259359 - RNA, 64 nt, hsa; identical to SEQ ID NO: 101836

SEQ ID NO: 259360 - RNA, 64 nt, hsa; identical to SEQ ID NO: 101837

SEQ ID NO: 259361 - RNA, 64 nt, hsa; identical to SEQ ID NO: 101838

SEQ ID NO: 259362 - RNA, 64 nt, hsa; identical to SEQ ID NO: 101839

SEQ ID NO: 259363 - RNA, 64 nt, hsa; identical to SEQ ID NO: 101840

SEQ ID NO: 259364 - RNA, 64 nt, hsa; identical to SEQ ID NO: 101841

SEQ ID NO: 259365 - RNA, 64 nt, hsa; identical to SEQ ID NO: 101842

SEQ ID NO: 259366 - RNA, 64 nt, hsa; identical to SEQ ID NO: 101843

SEQ ID NO: 259367 - RNA, 64 nt, hsa; identical to SEQ ID NO: 101844

SEQ ID NO: 259368 - RNA, 64 nt, hsa; identical to SEQ ID NO: 101845

SEQ ID NO: 259369 - RNA, 64 nt, hsa; identical to SEQ ID NO: 101846

SEQ ID NO: 259370 - RNA, 64 nt, hsa; identical to SEQ ID NO: 101847

SEQ ID NO: 259371 - RNA, 64 nt, hsa; identical to SEQ ID NO: 101848

SEQ ID NO: 259372 - RNA, 64 nt, hsa; identical to SEQ ID NO: 101849

SEQ ID NO: 259373 - RNA, 64 nt, hsa; identical to SEQ ID NO: 101850

SEQ ID NO: 259374 - RNA, 64 nt, hsa; identical to SEQ ID NO: 101851

SEQ ID NO: 259375 - RNA, 64 nt, hsa; identical to SEQ ID NO: 101852

SEQ ID NO: 259376 - RNA, 64 nt, hsa; identical to SEQ ID NO: 101853

SEQ ID NO: 259377 - RNA, 64 nt, hsa; identical to SEQ ID NO: 101854

SEQ ID NO: 259378 - RNA, 64 nt, hsa
ugucacuuuuucucauguucuaauuauaaaugaccaaaaucaagauugcucaaaaggguaaaug

SEQ ID NO: 259379 - RNA, 64 nt, hsa
uuacauuuuucuguguuacacucaaggauaaaggcaaaaucaauuuuguaauuuguuuagaagc

SEQ ID NO: 259380 - RNA, 64 nt, hsa
gaugugcgaguuauugacuguggaguacuugccacaaaaucaauaaaagaugguaagaacuuuu

SEQ ID NO: 259381 - RNA, 64 nt, hsa
ucuaguuccaagucugggcaccgaaagagagcaucaaaaucaccaagaaaaacagcuucucagu

SEQ ID NO: 259382 - RNA, 64 nt, hsa
guuuaggauaaauagguaagcacaaagagcucuucaaaaucagaaaaaacaauaggaguccuuc

SEQ ID NO: 259383 - RNA, 64 nt, hsa
aucuuaaaaaaaaaaaaaguaaacugcaaaaguacaaaaucauuuuucaaucuguucccaguuu

SEQ ID NO: 259384 - RNA, 64 nt, hsa
uuucuuaaugcauugauuaaaguuuaauaguuaucaaaaucaccuaauuuuuaaaaauagcuuu

SEQ ID NO: 259385 - RNA, 64 nt, hsa
uagcuuucguuuugaguucuggaaagaaaacugucaaaaucaguauauacuauuaguuauauuu

SEQ ID NO: 259386 - RNA, 64 nt, hsa
aacucuacaauaaugaggaaauucuuaagaauaacaaaaucacuguaccuuccucucaauuuug

SEQ ID NO: 259387 - RNA, 64 nt, hsa
uguagcauuccucuaauuauaaacagugaaaaaucaaaaucaguccagaguucuuuuguugacu

SEQ ID NO: 259388 - RNA, 64 nt, hsa
gguugauagcagcuuggagugcuaacuggaagaucaaaaucaugucucuugcugauaaccuaag

SEQ ID NO: 259389 - RNA, 64 nt, hsa
auguuauuuucagaauggcuuuuuuuuuucuauucaaaaucaaaucgagauuuaauguuuggua

SEQ ID NO: 259390 - RNA, 64 nt, hsa
guucagagcaguguccuccugggguucccacgugcaaaaucaacaucaggaacccagcuucagg

SEQ ID NO: 259391 - RNA, 64 nt, hsa
uuuuuccucaaugaaugggaugucuaauguauuucaaaaucacccaaaacuuuuggcaaauaaa

SEQ ID NO: 259392 - RNA, 64 nt, hsa
ggauuuuuaccuuuguuccuuuugcucugauagacaaaaucaguuuaggacuauuaaagaaugu

SEQ ID NO: 259393 - RNA, 64 nt, hsa
agcguaaaugggucaugacaagaugggacagcaacaaaaucauggcuuaggaucgacaagaagu

SEQ ID NO: 259394 - RNA, 64 nt, hsa
agcucagauuagaauggcuaccccauucucuagacaaaaucaaauuguccuauugugacucuuc

SEQ ID NO: 259395 - RNA, 64 nt, hsa
uauuuugugaaaguuguacacuaauguucuaugucaaaaucaaaaguauuuaaugaaauacuag

SEQ ID NO: 259396 - RNA, 64 nt, hsa
aacaccaugucauggaguguaggaaagagcagaccaaaaucagcccuagagccaaccagucagu

SEQ ID NO: 259397 - RNA, 64 nt, hsa
guggcguugagccacuucccuuugaaaagacacucaaaaucacugccaugguucaauguuccca

SEQ ID NO: 259398 - RNA, 64 nt, hsa
aagguuccagggagguuguggggcagcuagaggacaaaaucaugaaaacagagucccugucuuc

SEQ ID NO: 259399 - RNA, 64 nt, hsa
uuuauagaauaauuucuccucauuuaauauuuuucaaaaucaaaguuaugguuuccucauuuua

SEQ ID NO: 259400 - RNA, 64 nt, hsa
auucaucaaguaaucauggccagcgauuauugaucaaaaucaaaagguaaugcacauccucauu

SEQ ID NO: 259401 - RNA, 64 nt, hsa
uacauacacagacacacacagaaagacacagacacaaaaucacacacacacccuccccgccaca

SEQ ID NO: 259402 - RNA, 64 nt, hsa
uacacagacacacacagaaagacacacacagacacaaaaucacacacacacccuccccgccaca

SEQ ID NO: 259403 - RNA, 64 nt, hsa
aggacccacuggggcauauaaaaaagucaaaaaucaaaaucaaacaacaaguucugaguuacuu

SEQ ID NO: 259404 - RNA, 64 nt, hsa
gggguauaacacauuuucauuuacuuuucucccccaaaaucaucuuauccaauuuuauugguua

SEQ ID NO: 259405 - RNA, 64 nt, hsa
aaugauugcuauacauacucauuuuuaaauaauucaaaaucaguagcaaugcaaaaauauucug

SEQ ID NO: 259406 - RNA, 64 nt, hsa
uauuuggaggaagaaaaauuaagaagacaacuuacaaaaucaagaugacaacuuauaaaggcau

SEQ ID NO: 259407 - RNA, 64 nt, hsa
uugucaguguaauaaaaacagaaucuuuguauaucaaaaucauguaguuuguauaaaauguggg

SEQ ID NO: 259408 - RNA, 64 nt, hsa
aacuacuguguguguaaccguuucccccgucaaccaaaaucaguguuuauagagugaacccuau

SEQ ID NO: 259409 - RNA, 64 nt, hsa
uuuuuaaaaucagaauuuaguuaucuaucagacucaaaaucauuuaaagacuaacaaaacacaa

SEQ ID NO: 259410 - RNA, 64 nt, hsa
aggccauuucuaugccaagcuuauucuacaugcacaaaaucauacauguuaauaaauauaaaca

SEQ ID NO: 259411 - RNA, 64 nt, hsa
cuggaaaguuuagacuacauuuagaaucucuauucaaaaucaaaaugcugcucaaaugaauuua

SEQ ID NO: 259412 - RNA, 64 nt, hsa
gggccaagcccaucuauuuacaaaaggugaacagcaaaaucaagcacugcuuuaugggcaggaa

SEQ ID NO: 259413 - RNA, 64 nt, hsa
auagcuauaauaaagauuucccugagacgggagucaaaaucagcaucccucagauaacugcuuu

SEQ ID NO: 259414 - RNA, 64 nt, hsa
cggaugacuuuggagaguuucaaagugaaaagcccaaaaucagcaaauuugacuucuuaguagc

SEQ ID NO: 259415 - RNA, 64 nt, hsa
aaugaacccaugacagcaccugcugcuucaaaaucaaaaucaauuuagggauacagcaggggcu

SEQ ID NO: 259416 - RNA, 64 nt, hsa
gacaagaaugaacccaugacagcaccugcugcuucaaaaucaaaaucaauuuagggauacagca

SEQ ID NO: 259417 - RNA, 64 nt, hsa
guagauucuugaccuuaaauuuaacaacaacaaccaaaaucagauuuuuuuugugagucuuacu

SEQ ID NO: 259418 - RNA, 64 nt, hsa
ucauguauucaauggacuguaauuuaugauuuuucaaaaucauguuacaagauagacauauucu

SEQ ID NO: 259419 - RNA, 64 nt, hsa
ggucaaaucucuacaaauuuuucuguggugauagcaaaaucaagagauggcuuacaaaaagaaa

SEQ ID NO: 259420 - RNA, 64 nt, hsa
caauccauauaagcccuugauuggaagggcuuuucaaaaucauuuagucuaacaacugcccagu

SEQ ID NO: 259421 - RNA, 64 nt, hsa
gagaugcaaaaguucacuguugcaguguuuucaaaugaccaaucaaguacuacuucuugguuaa

SEQ ID NO: 259422 - RNA, 64 nt, hsa
agccacgcccaaaagagagcucccuuagggaaaaaugaccaaaacacacacacacauuuacaau

SEQ ID NO: 259423 - RNA, 64 nt, hsa
uaccaaacauuacaaaaaaauuuuauggcccaaaaugaccaacgaaauuguuacaauagaauuu

SEQ ID NO: 259424 - RNA, 64 nt, hsa
uacaaaucagaacuuuggaggcaaaucuuucugcaugaccaaagugauaaauuccuguugaccu

SEQ ID NO: 259425 - RNA, 64 nt, hsa
ucuuguuaaauaaauuaaaucuuacuuucuuuuaaugaccaaccuuagguaaaacaaaaauauu

SEQ ID NO: 259426 - RNA, 64 nt, hsa
uaauguaaaggccuuguuuugcuguagcaauaaaaugaccaagugcaaugacuugauuuaauaa

SEQ ID NO: 259427 - RNA, 64 nt, hsa; identical to SEQ ID NO: 233051

SEQ ID NO: 259428 - RNA, 64 nt, hsa; identical to SEQ ID NO: 233052

SEQ ID NO: 259429 - RNA, 64 nt, hsa; identical to SEQ ID NO: 233053

SEQ ID NO: 259430 - RNA, 64 nt, hsa; identical to SEQ ID NO: 233054

SEQ ID NO: 259431 - RNA, 64 nt, hsa; identical to SEQ ID NO: 233055

SEQ ID NO: 259432 - RNA, 64 nt, hsa; identical to SEQ ID NO: 233055

SEQ ID NO: 259433 - RNA, 64 nt, hsa; identical to SEQ ID NO: 233057

SEQ ID NO: 259434 - RNA, 64 nt, hsa
ccucagggacguagaacaauggaaugucagucagucucuguaguuaaaacuuuuucuuuaaaau

SEQ ID NO: 259435 - RNA, 64 nt, hsa; identical to SEQ ID NO: 259434

SEQ ID NO: 259436 - RNA, 64 nt, hsa
ucaucaaaaagcuuuaagugccuaacccugcuugucucuguacauagaagccugcacagaucca

SEQ ID NO: 259437 - RNA, 64 nt, hsa
uuucauuuucagaaaacucuuaagcucucuucagucucuguaauguuucugauugcauguuucu

SEQ ID NO: 259438 - RNA, 64 nt, hsa
gaagggcguguggccaucgugucagcagagagagucucuguacacagccccgugaacccugagg

SEQ ID NO: 259439 - RNA, 64 nt, hsa
gaaggccauauggccaucgugucagcagagagagucucuguacacagccccgugaacccugagg

SEQ ID NO: 259440 - RNA, 64 nt, hsa
uguguacuuuacugggcucucccugcacgcauuuucucuguaguuacauuuaggauaaucuuua

SEQ ID NO: 259441 - RNA, 64 nt, hsa
caccuaaaccagacuggauggaaacuuccugcccucucuguaccuuccuacuggagcuugaugu

SEQ ID NO: 259442 - RNA, 64 nt, hsa
caaauugcugggauuacuccccgugcccggccacucucuguacuuuaaacauuucgcuauacuc

SEQ ID NO: 259443 - RNA, 64 nt, hsa
uguaguuuauaauucuaguugaugaauuuuuuucucucuguacuuuauuuaauuuauuauuauu

SEQ ID NO: 259444 - RNA, 64 nt, hsa
ucaucguguuuguaagagaagauggucauuuuauucucuguauaaaacuuagcucuaaagcaga

SEQ ID NO: 259445 - RNA, 64 nt, hsa
guguuugaaaguacugaagcacaaacauauaucaucucuguaccauucuguacuaaagcacuug

SEQ ID NO: 259446 - RNA, 64 nt, hsa
ugaaucugauaucuccaccaaagccuugauguuuucucuguacagcuaaguuuucugauggaau

SEQ ID NO: 259447 - RNA, 64 nt, hsa
aaaauguuuaacucaggugugauuuuugaaaaugucucuguaauauuuuaucuucuuuaaaaaa

SEQ ID NO: 259448 - RNA, 64 nt, hsa
ucauuugcccuggguguccuugguccugccuggcucucuguaguggaggcuccccuuggccuca

SEQ ID NO: 259449 - RNA, 64 nt, hsa
auuaacucucugacuugaugcaaguuacuuaaccucucuguauagaauuuucacaucuuuaaaa

SEQ ID NO: 259450 - RNA, 64 nt, hsa
aaauaggcagaaacaaaaugacuguagaacuuauucucuguaggccaaauuucauuucagccac

SEQ ID NO: 259451 - RNA, 64 nt, hsa
cggcucucuggacacuugcgacaccucaagguguucucuguagcucaaucugcaaacaugccag

SEQ ID NO: 259452 - RNA, 64 nt, hsa
gcucucugugugaccuugggcagcuccgugccucucucuguacucccucaguuuccuucucugu

SEQ ID NO: 259453 - RNA, 64 nt, hsa
cuccgugccucucucuguacucccucaguuuccuucucuguacaauguggcuggggagggagag

SEQ ID NO: 259454 - RNA, 64 nt, hsa
aucuucaggacucuucagagcuaauccucuaaguucucuguacucaguugguucucaguuagcu

SEQ ID NO: 259455 - RNA, 64 nt, hsa
gcaguuccucccccugccuuaaaacaccccacuaucucuguaaagucucucucucucuuuuuuu

SEQ ID NO: 259456 - RNA, 64 nt, hsa
gccagaagagacaucuuggguuccuuggccucacucucuguaagcauauaaaccacaggcgaaa

SEQ ID NO: 259457 - RNA, 64 nt, hsa
uaggaggcccagguagcggcaaaacucagguaugucucuguauggcagcaaauguggcccaugg

SEQ ID NO: 259458 - RNA, 64 nt, hsa
acaaagauucugggcagcugccaccucagucucuucucuguauuaucauagucugguuuaaaua

SEQ ID NO: 259459 - RNA, 64 nt, hsa
ugcagaaagcugugaaaugucuugugucuuauguucucuguauuuaugcagcugauuugucugu

SEQ ID NO: 259460 - RNA, 64 nt, hsa
uuucucugcauucacaauucugauuucauguauuucucuguacauguuugaucauuaucaggcc

SEQ ID NO: 259461 - RNA, 64 nt, hsa
gcuaggaaaagcuuuugcauguguccugaaugugucucuguaaacauagcuguuauuuauuauu

SEQ ID NO: 259462 - RNA, 64 nt, hsa
cccucagaaucgcuccaccuugcagcucuccccuucucuguauuccuagaaacugacacaugcu

SEQ ID NO: 259463 - RNA, 64 nt, hsa
gugugugugcguccugucggagcccugucuccucucucuguaauaaacucauuucuagcagaca

SEQ ID NO: 259464 - RNA, 64 nt, hsa
agaauaugcauaucaaugaguuggaggugauuauucucuguaacucccuaaugauuguuuucua

SEQ ID NO: 259465 - RNA, 64 nt, hsa
ccccgagccccuggcaaccacuaaucuauuucucucucuguagauuugcuuauucuggucauuu

SEQ ID NO: 259466 - RNA, 64 nt, hsa
ucuguccaggccacuguggccagagcuggaaggcagggcagagggaauguucccugcacccugg

SEQ ID NO: 259467 - RNA, 64 nt, hsa
gccaagagcaucgugacccuucagggccagaaggagggcagagccaugggccugggccugcuuu

SEQ ID NO: 259468 - RNA, 64 nt, hsa
agugugacagcacuggggaggagagacaggauaaagggcagaugucagcaauacuaagggcuuc

SEQ ID NO: 259469 - RNA, 64 nt, hsa
uuuggaaaacaaaaaucagaaggcugcauucuagagggcagagaaauucccccgaagacugagc

SEQ ID NO: 259470 - RNA, 64 nt, hsa
cccccaugcucuguggccuucuuacacuucucagagggcagaguggcagccgggcacccuacag

SEQ ID NO: 259471 - RNA, 64 nt, hsa
cagaguggcagccgggcacccuacagaaacucagagggcagaguggcagccaggcccacauguc

SEQ ID NO: 259472 - RNA, 64 nt, hsa
cugaaaauggaccugccuuucacugaauuuucugagggcagagucuuagcuguuuucuuuaagc

SEQ ID NO: 259473 - RNA, 64 nt, hsa
gcuuccacgugcuucccagugacccuggccuuggagggcagagguccgucugggaggguguguc

SEQ ID NO: 259474 - RNA, 64 nt, hsa
gaggaacaauuaggacguggcaaugagaccuggcagggcagaguacaagcccagcacccagugu

SEQ ID NO: 259475 - RNA, 64 nt, hsa
guggagguccucaggaguggagagaaugaguaggagggcagaagcuuccauuuuuguccuuccu

SEQ ID NO: 259476 - RNA, 64 nt, hsa
aggugguugcugucuccauaggggccagcuccccagggcagacucacgugccccucugaggcuc

SEQ ID NO: 259477 - RNA, 64 nt, hsa
cccggcucauggucugggggaugcaggcaggggaagggcagagauggcuucucagauauggcuu

SEQ ID NO: 259478 - RNA, 64 nt, hsa
ccuguuagcccguggcuacggucaggcucuggccagggcagagggcugcccagggccaggcuca

SEQ ID NO: 259479 - RNA, 64 nt, hsa
ggacaccacggggccuuccugcuuuccugggcagagggcagagugaggccaccuggcgggggug

SEQ ID NO: 259480 - RNA, 64 nt, hsa
ucagaugccagcacugacucaggaacagcaagucagggcagagaggaggagggaggcugucagg

SEQ ID NO: 259481 - RNA, 64 nt, hsa
ucccagaccucuccucuuccaguguccccggggaagggcagaugacacucccuucccccuaagc

SEQ ID NO: 259482 - RNA, 64 nt, hsa
cggacucacaauuucuauuuccgggacuacaggaagggcagagaauacugacgguuaccaguau

SEQ ID NO: 259483 - RNA, 64 nt, hsa
ugugagugggguuuauggggaaagggagggacugagggcagagucucuggguuucaggacagca

SEQ ID NO: 259484 - RNA, 64 nt, hsa
uaguguacgauguuugcugugcuucccgccguggagggcagagccaccccacaucaggaucgga

SEQ ID NO: 259485 - RNA, 64 nt, hsa
gcuggugucugggaccaaaaagggggaauaugggagggcagaguggggaggggaguccaugggc

SEQ ID NO: 259486 - RNA, 64 nt, hsa
guaggcugaccccauggacccacuggagacuuugagggcagagcucgggcaccuuucaucuucc

SEQ ID NO: 259487 - RNA, 64 nt, hsa
ugugccggugggggcugggcucccgugagguccuagggcagaaggaggugcuugcagggccucu

SEQ ID NO: 259488 - RNA, 64 nt, hsa
uacgugaauggggagguggcagccacagaagccuagggcagaccaagaagaaagguacagcccc

SEQ ID NO: 259489 - RNA, 64 nt, hsa
gugcaugagagucuagagaaguagugaccagaacagggcagaguagguccccuccauggcccug

SEQ ID NO: 259490 - RNA, 64 nt, hsa
guggucugugaacugagucccugggaugccuuuuagggcagagauuccugagcugcguuuuagg

SEQ ID NO: 259491 - RNA, 64 nt, hsa
gaacguuagugaaucuugagccucauuugggcucagggcagagcagguguuuaucugccccggc

SEQ ID NO: 259492 - RNA, 64 nt, hsa
cucucaagaccagagacccaacagcagugaucucagggcagacagcccuccacuccagcucuga

SEQ ID NO: 259493 - RNA, 64 nt, hsa
uuuggaaagagcacccucgagaaggguggaugacagggcagagcaggaaggacaggaagcuggc

SEQ ID NO: 259494 - RNA, 64 nt, hsa
caccggcucccuccgcucccuccugucaccuaccagggcagaccccacuaagccguugagucuc

SEQ ID NO: 259495 - RNA, 64 nt, hsa
gcaagggugacuccuggcaggugggggcagcaggagggcagagggcagagcucuggccacuucu

SEQ ID NO: 259496 - RNA, 64 nt, hsa
ugacuccuggcaggugggggcagcaggagggcagagggcagagcucuggccacuucugcccacu

SEQ ID NO: 259497 - RNA, 64 nt, hsa
gccuggccugccagccauuggagguguuuaaggaagggcagauaaugugacucuuugcggggug

SEQ ID NO: 259498 - RNA, 64 nt, hsa
ggucaugacgcgugccauuuagagcucucagagcagggcagauugcugggcucugguggccagu

SEQ ID NO: 259499 - RNA, 64 nt, hsa
auggccaucagacagagacuucaaaugcugauggagggcagaggaaguacuuagggagguuggu

SEQ ID NO: 259500 - RNA, 64 nt, hsa
ugggacagugggucaggcaggacaaggagaaagcagggcagaaugaugccuagaggaccacauc

SEQ ID NO: 259501 - RNA, 64 nt, hsa
ccuccccauaugccacccuucccccaaagcugauagggcagaggugcacuuuaugaaacuggca

SEQ ID NO: 259502 - RNA, 64 nt, hsa
guggaugagugaagggagccagguacacggcagcagggcagaggagacuauggggagcccaccg

SEQ ID NO: 259503 - RNA, 64 nt, hsa
aggccaggggaucugggugugugagugggaggagagggcagagguccccugaggucaugcauug

SEQ ID NO: 259504 - RNA, 64 nt, hsa
guauuuaaagaaacugauuuuaaaugcaaauuaaagggcagauauucucaaacaggguuccugu

SEQ ID NO: 259505 - RNA, 64 nt, hsa
auccagucuccaucgugcugcagcagcuggacugagggcagagccuguaggugcagaggcccug

SEQ ID NO: 259506 - RNA, 64 nt, hsa
cugugucaaguagcuaacugcagcagcuggacugagggcagagucugugggugcagagacccug

SEQ ID NO: 259507 - RNA, 64 nt, hsa
gggccuggccuucucucccagcagccuggggggcagggcagagccuccagucggaccccuuccu

SEQ ID NO: 259508 - RNA, 64 nt, hsa
ucggaccccuuccucacacuggccccuaugcagaagggcagacaguucuucugggguuggcagc

SEQ ID NO: 259509 - RNA, 64 nt, hsa
caggaguuuccacacugcuguggacgggauagccagggcagaccugcaucccagagcaagccua

SEQ ID NO: 259510 - RNA, 64 nt, hsa
caaccagccaaggaauaaaagcugaucuguauguagggcagaaguguggcaaaugcaucaggaa

SEQ ID NO: 259511 - RNA, 64 nt, hsa
cgagcugagcaccagugggugaccggggagaaacagggcagacuggguaagggagcagggcuua

SEQ ID NO: 259512 - RNA, 64 nt, hsa
ugcccacugcugcuccauguguaccaagagcagcagggcagaagggcccucccuccagccuagg

SEQ ID NO: 259513 - RNA, 64 nt, hsa
ugggcgagauggacaggugaggucgaggacgcagagggcagaggcccaguggagccucagacgg

SEQ ID NO: 259514 - RNA, 64 nt, hsa
guccagcaugggcuccagagccuuccucucucacagggcagagcucuugucggcagggcagccu

SEQ ID NO: 259515 - RNA, 64 nt, hsa
ggagcuggucacgcugggcgcccaggaggaagggagggcagagggggcuguggccgucagugga

SEQ ID NO: 259516 - RNA, 64 nt, hsa
caagaugcccaagaugaccaugcccaagcuagggagggcagaguccccaucacguggcaagcca

SEQ ID NO: 259517 - RNA, 64 nt, hsa
cgcugugguuguucagggguagcuuuucaaaaacagggcagagccuggcugucccaaccagggg

SEQ ID NO: 259518 - RNA, 64 nt, hsa
auuuuagucuuuuuaaaaaaaacauccuauacuaagggcagaacccacugccccggccucaauu

SEQ ID NO: 259519 - RNA, 64 nt, hsa
ggcuguuucaaagacugggcgaaaggcuguccggagggcagaccaggugccuugccgcagagaa

SEQ ID NO: 259520 - RNA, 64 nt, hsa
acucugcggaggaacggcaggaagaaccucagagagggcagaggugacuucaaagugcugggga

SEQ ID NO: 259521 - RNA, 64 nt, hsa
ccccucccccugggggcaaaucaggacacaacagagggcagaggccccauuagcuuuaaaaugu

SEQ ID NO: 259522 - RNA, 64 nt, hsa
accccccuccucuccacccuaccuuccaucaaccagggcagauccaccgugcccugguucccca

SEQ ID NO: 259523 - RNA, 64 nt, hsa
cugcccugcuuccuggcuccuuaucagugccaugagggcagaggugcuaccuggccuuccugcc

SEQ ID NO: 259524 - RNA, 64 nt, hsa
cagagaagcccuuacuccugguucagugccacgcagggcagaggagagcagcugucaagaagca

SEQ ID NO: 259525 - RNA, 63 nt, hsa
aguuuauuacagauauuaaguaugcaauuacuuguauuauaggaugcaaggucaucauaugua

SEQ ID NO: 259526 - RNA, 63 nt, hsa
caguuuuguaaaauuaguauugaguucuauugaguauuauaagauagcuuacauuuucaaaau

SEQ ID NO: 259527 - RNA, 63 nt, hsa
uacucugcacuguguaaaggaaaagggagaaauguauuauacuugagacauugcaccuacccc

SEQ ID NO: 259528 - RNA, 63 nt, hsa
augaaaaagucuucgauacaauauuguuaagcuguauuauaaguauuguuacacaggguuaug

SEQ ID NO: 259529 - RNA, 63 nt, hsa
caaauggacugaaagaaacuuuucaaggacaguguauuauaacaaucccuuucccagaauuag

SEQ ID NO: 259530 - RNA, 63 nt, hsa
ucaacaacauuuuaaauguauuuuguuauguuuguauuauauaggauaaagcaaaugucaagu

SEQ ID NO: 259531 - RNA, 63 nt, hsa
accuuaacuucauugucugcacauuacauugaaguauuauaaaugcaacagauguuauaugca

SEQ ID NO: 259532 - RNA, 63 nt, hsa
cauaaaguugcguaagaaacuuuaccaagaggaguauuauagccaaguuuucuuugaaaguau

SEQ ID NO: 259533 - RNA, 63 nt, hsa
uuacuauaagguuaauauuuauuuucauuuucuguauuauauaugaaaaguaaauuaauguga

SEQ ID NO: 259534 - RNA, 63 nt, hsa
augcaagcacaacuugaagcugaauucauuucuguauuauauucucaacucguuaucuaaagc

SEQ ID NO: 259535 - RNA, 63 nt, hsa
ccuuuuuuaauguuucaugaccacccauugauuguauuauaaccacuuacaguugcuuauauu

SEQ ID NO: 259536 - RNA, 63 nt, hsa
uuuuguuuuuuaacauuuagaauauuacauuuuguauuauacaguaccuuucucagacauuuu

SEQ ID NO: 259537 - RNA, 63 nt, hsa
uaauuucuaaaccauguauauguacguuuauauguauuauaauugcauacacaugccuccaug

SEQ ID NO: 259538 - RNA, 63 nt, hsa
uugugcccaaguaauaauaaaacuauuucagauguauuauaugauugagcaaaugagaaaaca

SEQ ID NO: 259539 - RNA, 63 nt, hsa
uaccccuuuuugccuuacaagugauauuugcagguauuauaccauuuuucuauucuugguggc

SEQ ID NO: 259540 - RNA, 63 nt, hsa
gaaacaagccugccauaauccuuuggaaaagauguauuauaccagugaaaagguguuauaucu

SEQ ID NO: 259541 - RNA, 63 nt, hsa
augaacuuagauuuuacaugaaguauuuuuucaguauuauauguacccucugaaauacauagg

SEQ ID NO: 259542 - RNA, 63 nt, hsa
uauauguacccucugaaauacauagggauaugcguauuauaccaaaauguugcugaaaaaugg

SEQ ID NO: 259543 - RNA, 63 nt, hsa
gcauacuuaacagugaaaagaaucuuuaauuauguauuauaucuguaauauauuuauuuuguu

SEQ ID NO: 259544 - RNA, 63 nt, hsa
uuuguaauauguuuuuaguucccuuuuuuuguuguauuauaggcagaugaacaaauuaaauuu

SEQ ID NO: 259545 - RNA, 63 nt, hsa
cgggcugcaugcugaggacgaccagcugaggguguauuauaugcagaauuacauaaacgaagc

SEQ ID NO: 259546 - RNA, 63 nt, hsa
cuguaaagagaaguaauuuugcuccuugauaaaguauuauauuaauaauaaaucugccugcaa

SEQ ID NO: 259547 - RNA, 63 nt, hsa
aacacuuagaagacugauagaugucacacagugguauuauagaaggauaauacagagccaaga

SEQ ID NO: 259548 - RNA, 63 nt, hsa
gcaugaugaauagcaccuuaauuucaagcaaauguauuauaauuaaaguuuuauuugcuguag

SEQ ID NO: 259549 - RNA, 63 nt, hsa
ucaaaugagcuuguauauuuauaauacaauauaguauuauaguaacaguuaucauacacugag

SEQ ID NO: 259550 - RNA, 63 nt, hsa
agucacuaguauagacuaucuaucuagugaguuguauuauaagcgaugaaauacuuuaaaagc

SEQ ID NO: 259551 - RNA, 63 nt, hsa
uaucagacuucaccaaauauaugccuuacuauuguauuauaguacugcuuuacuguguaucuc

SEQ ID NO: 259552 - RNA, 63 nt, hsa
agaaauaaaucuauauuuuugugaaggguagugguauuauacuguagauuucaguaguuucua

SEQ ID NO: 259553 - RNA, 64 nt, hsa
ggguaaggagcaccaaagcugaggcuggcucagagaucuccagagaagcugcagccugcccugg

SEQ ID NO: 259554 - RNA, 64 nt, hsa
cagcacugccucccuccucccacugcgacucugggaucuccaggugcugcccaaggaguugccu

SEQ ID NO: 259555 - RNA, 64 nt, hsa
uagccaggauggucucgaucuccaggauggucucgaucuccaggauggucucgaucuccugacg

SEQ ID NO: 259556 - RNA, 64 nt, hsa
gacgggguuucacuguguuagccaggauggucucgaucuccaggauggucucgaucuccaggau

SEQ ID NO: 259557 - RNA, 64 nt, hsa
cugccugguucuccgggaucaccuggauccccaggaucuccaggcucuccuggauccguaccua

SEQ ID NO: 259558 - RNA, 64 nt, hsa
auagcaaauuggcaauuuaacgagccacuuccaugaucuccaaagaaaccaaaauacaaacaca

SEQ ID NO: 259559 - RNA, 64 nt, hsa
uucucuagauaauuuuauauuuuugaguauaccccacuuccaaguguuuuuuguuuuguuuugc

SEQ ID NO: 259560 - RNA, 64 nt, hsa
uugggauuacaggcgugagugaccaugccuagcucacuuccagguuuaacagacaaaauaaacu

SEQ ID NO: 259561 - RNA, 64 nt, hsa
caccauauccuuuguguucucuaaauacauugcccacuuccaaaaauguucagcaugaaaaaaa

SEQ ID NO: 259562 - RNA, 64 nt, hsa
uaaauauuuugacuuuaaggguccuaguaagugccacuuccacuaagaauacaguuugaaugua

SEQ ID NO: 259563 - RNA, 64 nt, hsa
ugaccuuucuggucuuugcacuuccauccucucccacuuccaucuggcaucccacgcguugucc

SEQ ID NO: 259564 - RNA, 64 nt, hsa
uuuuaggaguggggggugaccuuucuggucuuugcacuuccauccucucccacuuccaucuggc

SEQ ID NO: 259565 - RNA, 64 nt, hsa
uggccuuuccggucuucgcacuuccauccucucccacuuccaucuggcgucccacaccuugucc

SEQ ID NO: 259566 - RNA, 64 nt, hsa
gaguuuuaggaggggauggccuuuccggucuucgcacuuccauccucucccacuuccaucuggc

SEQ ID NO: 259567 - RNA, 64 nt, hsa
ccacugagaagagagacgccaacugcacccuugccacuuccaaagcaauagaggcagagugguc

SEQ ID NO: 259568 - RNA, 64 nt, hsa
uacaaacagcagucugcucccaugacccucugcccacuuccauuggucuccaggccccaauaau

SEQ ID NO: 259569 - RNA, 64 nt, hsa
uguuuacagacagaagagaaggaagccauagugucacuuccacacaauuauuuauuucaugucu

SEQ ID NO: 259570 - RNA, 64 nt, hsa
caaaguccuucucuuuagggcucuuacaaucuaucacuuccaaaaaguaaauggugacugauaa

SEQ ID NO: 259571 - RNA, 64 nt, hsa
cugggggcugggcagggcagggcagggccggguccacuuccauuguuagcaguuguuugcagaa

SEQ ID NO: 259572 - RNA, 64 nt, hsa
cuccagccagaccccugaaaggaaggugcucccccacuuccaggccuuaguugggguggggggg

SEQ ID NO: 259573 - RNA, 64 nt, hsa
ccuggcggcgcaucccuccucucccaccuccuggcacuuccagcugggugucccacauguugga

SEQ ID NO: 259574 - RNA, 64 nt, hsa
ugggugucccacauguuggauuccguccccaccacacuuccagagaccggagaacugugcaggg

SEQ ID NO: 259575 - RNA, 64 nt, hsa
auagggauuuuuuuuuugguugaccacucccccacacuuccaaaauuaaacaguguuuucuuag

SEQ ID NO: 259576 - RNA, 64 nt, hsa
aauucauuaggucaguuaagggaaauauuuguaccacuuccaaacuuuucagcguuggauaaaa

SEQ ID NO: 259577 - RNA, 64 nt, hsa
uuggcccucucucugaccucagggccuggccacacacuuccaugugucuuuuugccugcuggag

SEQ ID NO: 259578 - RNA, 64 nt, hsa
ucccgccucagccccaccuguggggccacaucgccacuuccacgcccauggcccagucccaggg

SEQ ID NO: 259579 - RNA, 64 nt, hsa
aacuguguguuuccaacaucaugguagcagcacacacuuccaaagcucagccagggacacuuaa

SEQ ID NO: 259580 - RNA, 64 nt, hsa
aaaaaagaaaacuguuuuuagaaauacauaaaaucacuuccaaauccuguugcuuauguugggu

SEQ ID NO: 259581 - RNA, 64 nt, hsa
ucggacaaacaugacaaacacagugaagccaacuaucccauaaaaugaacacugacauacuugu

SEQ ID NO: 259582 - RNA, 64 nt, hsa
aaauauguggccuguuguauaaccgcacucauguaucccauauguggugccacauugaauuucc

SEQ ID NO: 259583 - RNA, 64 nt, hsa
ugggccaaucuucucauuucuuagugccucagacaucccauauguaaaaugagaguaauaaaac

SEQ ID NO: 259584 - RNA, 64 nt, hsa
uuucagaaccacuucuugauucugccaccacuugaucccauaacaggcuaccccuuggccucau

SEQ ID NO: 259585 - RNA, 64 nt, hsa
ucuguuuauuguuuuccauauuuaaggaaacaacaucccauaauagaaaugagcaugcagggcu

SEQ ID NO: 259586 - RNA, 64 nt, hsa
uuucugcaggacuuuaaagcuuugaaaggccaauaucccauaggcuaacuuuaaacauguauuu

SEQ ID NO: 259587 - RNA, 64 nt, hsa
gcacugucaggcagcuuucggcuggggcucacccaucccauaggaggccuauguggagcauuaa

SEQ ID NO: 259588 - RNA, 64 nt, hsa
caggauuuacaaaaauguaaccugccuuccuucaaucccauauuugguaaauaaguuaauauuu

SEQ ID NO: 259589 - RNA, 64 nt, hsa
ucagucucaguagccaucagccuggcagcugcccaucccauaaccaaagagcucaaugggcugg

SEQ ID NO: 259590 - RNA, 64 nt, hsa
aaaguucaccucugagaguaaccaaaucgguuucaucccauaucaaaaagccuuuggagugugg

SEQ ID NO: 259591 - RNA, 64 nt, hsa; identical to SEQ ID NO: 83734

SEQ ID NO: 259592 - RNA, 64 nt, hsa; identical to SEQ ID NO: 83735

SEQ ID NO: 259593 - RNA, 64 nt, hsa; identical to SEQ ID NO: 83736

SEQ ID NO: 259594 - RNA, 64 nt, hsa; identical to SEQ ID NO: 83737

SEQ ID NO: 259595 - RNA, 64 nt, hsa; identical to SEQ ID NO: 83738

SEQ ID NO: 259596 - RNA, 64 nt, hsa; identical to SEQ ID NO: 83739

SEQ ID NO: 259597 - RNA, 64 nt, hsa; identical to SEQ ID NO: 83740

SEQ ID NO: 259598 - RNA, 64 nt, hsa; identical to SEQ ID NO: 83741

SEQ ID NO: 259599 - RNA, 64 nt, hsa; identical to SEQ ID NO: 83742

SEQ ID NO: 259600 - RNA, 64 nt, hsa; identical to SEQ ID NO: 83743

SEQ ID NO: 259601 - RNA, 64 nt, hsa; identical to SEQ ID NO: 83744

SEQ ID NO: 259602 - RNA, 64 nt, hsa; identical to SEQ ID NO: 83745

SEQ ID NO: 259603 - RNA, 64 nt, hsa; identical to SEQ ID NO: 83746

SEQ ID NO: 259604 - RNA, 64 nt, hsa; identical to SEQ ID NO: 83747

SEQ ID NO: 259605 - RNA, 64 nt, hsa; identical to SEQ ID NO: 83741

SEQ ID NO: 259606 - RNA, 64 nt, hsa; identical to SEQ ID NO: 83749

SEQ ID NO: 259607 - RNA, 64 nt, hsa; identical to SEQ ID NO: 83750

SEQ ID NO: 259608 - RNA, 64 nt, hsa; identical to SEQ ID NO: 83751

SEQ ID NO: 259609 - RNA, 64 nt, hsa; identical to SEQ ID NO: 83752

SEQ ID NO: 259610 - RNA, 64 nt, hsa; identical to SEQ ID NO: 83753

SEQ ID NO: 259611 - RNA, 64 nt, hsa; identical to SEQ ID NO: 83754

SEQ ID NO: 259612 - RNA, 64 nt, hsa; identical to SEQ ID NO: 83755

SEQ ID NO: 259613 - RNA, 64 nt, hsa; identical to SEQ ID NO: 83756

SEQ ID NO: 259614 - RNA, 64 nt, hsa; identical to SEQ ID NO: 83757

SEQ ID NO: 259615 - RNA, 64 nt, hsa; identical to SEQ ID NO: 83742

SEQ ID NO: 259616 - RNA, 64 nt, hsa; identical to SEQ ID NO: 83743

SEQ ID NO: 259617 - RNA, 64 nt, hsa; identical to SEQ ID NO: 83760

SEQ ID NO: 259618 - RNA, 64 nt, hsa; identical to SEQ ID NO: 83761

SEQ ID NO: 259619 - RNA, 64 nt, hsa; identical to SEQ ID NO: 83762

SEQ ID NO: 259620 - RNA, 64 nt, hsa; identical to SEQ ID NO: 83763

SEQ ID NO: 259621 - RNA, 64 nt, hsa; identical to SEQ ID NO: 83764

SEQ ID NO: 259622 - RNA, 64 nt, hsa; identical to SEQ ID NO: 83765

SEQ ID NO: 259623 - RNA, 64 nt, hsa; identical to SEQ ID NO: 83766

SEQ ID NO: 259624 - RNA, 64 nt, hsa; identical to SEQ ID NO: 83767

SEQ ID NO: 259625 - RNA, 64 nt, hsa; identical to SEQ ID NO: 83768

SEQ ID NO: 259626 - RNA, 64 nt, hsa; identical to SEQ ID NO: 83769

SEQ ID NO: 259627 - RNA, 64 nt, hsa; identical to SEQ ID NO: 83770

SEQ ID NO: 259628 - RNA, 64 nt, hsa; identical to SEQ ID NO: 83771

SEQ ID NO: 259629 - RNA, 64 nt, hsa; identical to SEQ ID NO: 83772

SEQ ID NO: 259630 - RNA, 64 nt, hsa; identical to SEQ ID NO: 83773

SEQ ID NO: 259631 - RNA, 64 nt, hsa; identical to SEQ ID NO: 83774

SEQ ID NO: 259632 - RNA, 64 nt, hsa; identical to SEQ ID NO: 83775

SEQ ID NO: 259633 - RNA, 64 nt, hsa; identical to SEQ ID NO: 83776

SEQ ID NO: 259634 - RNA, 64 nt, hsa; identical to SEQ ID NO: 83777

SEQ ID NO: 259635 - RNA, 64 nt, hsa; identical to SEQ ID NO: 83778

SEQ ID NO: 259636 - RNA, 64 nt, hsa; identical to SEQ ID NO: 83779

SEQ ID NO: 259637 - RNA, 64 nt, hsa; identical to SEQ ID NO: 83780

SEQ ID NO: 259638 - RNA, 64 nt, hsa; identical to SEQ ID NO: 83781

SEQ ID NO: 259639 - RNA, 61 nt, hsa
cagggacguagaacaauggaaugucagucagucucuguaguuaaaacuuuuucuuuaaaau

SEQ ID NO: 259640 - RNA, 61 nt, hsa; identical to SEQ ID NO: 259639

SEQ ID NO: 259641 - RNA, 61 nt, hsa
ucaaaaagcuuuaagugccuaacccugcuugucucuguacauagaagccugcacagaucca

SEQ ID NO: 259642 - RNA, 61 nt, hsa
cauuuucagaaaacucuuaagcucucuucagucucuguaauguuucugauugcauguuucu

SEQ ID NO: 259643 - RNA, 61 nt, hsa
gggcguguggccaucgugucagcagagagagucucuguacacagccccgugaacccugagg

SEQ ID NO: 259644 - RNA, 61 nt, hsa
ggccauauggccaucgugucagcagagagagucucuguacacagccccgugaacccugagg

SEQ ID NO: 259645 - RNA, 61 nt, hsa
guacuuuacugggcucucccugcacgcauuuucucuguaguuacauuuaggauaaucuuua

SEQ ID NO: 259646 - RNA, 61 nt, hsa
cuaaaccagacuggauggaaacuuccugcccucucuguaccuuccuacuggagcuugaugu

SEQ ID NO: 259647 - RNA, 61 nt, hsa
auugcugggauuacuccccgugcccggccacucucuguacuuuaaacauuucgcuauacuc

SEQ ID NO: 259648 - RNA, 61 nt, hsa
aguuuauaauucuaguugaugaauuuuuuucucucuguacuuuauuuaauuuauuauuauu

SEQ ID NO: 259649 - RNA, 61 nt, hsa
ucguguuuguaagagaagauggucauuuuauucucuguauaaaacuuagcucuaaagcaga

SEQ ID NO: 259650 - RNA, 61 nt, hsa
uuugaaaguacugaagcacaaacauauaucaucucuguaccauucuguacuaaagcacuug

SEQ ID NO: 259651 - RNA, 61 nt, hsa
aucugauaucuccaccaaagccuugauguuuucucuguacagcuaaguuuucugauggaau

SEQ ID NO: 259652 - RNA, 61 nt, hsa
auguuuaacucaggugugauuuuugaaaaugucucuguaauauuuuaucuucuuuaaaaaa

SEQ ID NO: 259653 - RNA, 61 nt, hsa
uuugcccuggguguccuugguccugccuggcucucuguaguggaggcuccccuuggccuca

SEQ ID NO: 259654 - RNA, 61 nt, hsa
aacucucugacuugaugcaaguuacuuaaccucucuguauagaauuuucacaucuuuaaaa

SEQ ID NO: 259655 - RNA, 61 nt, hsa
uaggcagaaacaaaaugacuguagaacuuauucucuguaggccaaauuucauuucagccac

SEQ ID NO: 259656 - RNA, 61 nt, hsa
cucucuggacacuugcgacaccucaagguguucucuguagcucaaucugcaaacaugccag

SEQ ID NO: 259657 - RNA, 61 nt, hsa
cucugugugaccuugggcagcuccgugccucucucuguacucccucaguuuccuucucugu

SEQ ID NO: 259658 - RNA, 61 nt, hsa
cgugccucucucuguacucccucaguuuccuucucuguacaauguggcuggggagggagag

SEQ ID NO: 259659 - RNA, 61 nt, hsa
uucaggacucuucagagcuaauccucuaaguucucuguacucaguugguucucaguuagcu

SEQ ID NO: 259660 - RNA, 61 nt, hsa
guuccucccccugccuuaaaacaccccacuaucucuguaaagucucucucucucuuuuuuu

SEQ ID NO: 259661 - RNA, 61 nt, hsa
agaagagacaucuuggguuccuuggccucacucucuguaagcauauaaaccacaggcgaaa

SEQ ID NO: 259662 - RNA, 61 nt, hsa
gaggcccagguagcggcaaaacucagguaugucucuguauggcagcaaauguggcccaugg

SEQ ID NO: 259663 - RNA, 61 nt, hsa
aagauucugggcagcugccaccucagucucuucucuguauuaucauagucugguuuaaaua

SEQ ID NO: 259664 - RNA, 61 nt, hsa
agaaagcugugaaaugucuugugucuuauguucucuguauuuaugcagcugauuugucugu

SEQ ID NO: 259665 - RNA, 61 nt, hsa
cucugcauucacaauucugauuucauguauuucucuguacauguuugaucauuaucaggcc

SEQ ID NO: 259666 - RNA, 61 nt, hsa
aggaaaagcuuuugcauguguccugaaugugucucuguaaacauagcuguuauuuauuauu

SEQ ID NO: 259667 - RNA, 61 nt, hsa
ucagaaucgcuccaccuugcagcucuccccuucucuguauuccuagaaacugacacaugcu

SEQ ID NO: 259668 - RNA, 61 nt, hsa
ugugugcguccugucggagcccugucuccucucucuguaauaaacucauuucuagcagaca

SEQ ID NO: 259669 - RNA, 61 nt, hsa
auaugcauaucaaugaguuggaggugauuauucucuguaacucccuaaugauuguuuucua

SEQ ID NO: 259670 - RNA, 61 nt, hsa
cgagccccuggcaaccacuaaucuauuucucucucuguagauuugcuuauucuggucauuu

SEQ ID NO: 259671 - RNA, 64 nt, hsa; identical to SEQ ID NO: 91879

SEQ ID NO: 259672 - RNA, 64 nt, hsa; identical to SEQ ID NO: 91880

SEQ ID NO: 259673 - RNA, 64 nt, hsa; identical to SEQ ID NO: 91881

SEQ ID NO: 259674 - RNA, 64 nt, hsa; identical to SEQ ID NO: 91882

SEQ ID NO: 259675 - RNA, 64 nt, hsa; identical to SEQ ID NO: 91883

SEQ ID NO: 259676 - RNA, 64 nt, hsa; identical to SEQ ID NO: 91884

SEQ ID NO: 259677 - RNA, 64 nt, hsa; identical to SEQ ID NO: 91885

SEQ ID NO: 259678 - RNA, 64 nt, hsa; identical to SEQ ID NO: 91886

SEQ ID NO: 259679 - RNA, 64 nt, hsa; identical to SEQ ID NO: 91887

SEQ ID NO: 259680 - RNA, 64 nt, hsa; identical to SEQ ID NO: 91888

SEQ ID NO: 259681 - RNA, 64 nt, hsa; identical to SEQ ID NO: 91889

SEQ ID NO: 259682 - RNA, 64 nt, hsa; identical to SEQ ID NO: 91890

SEQ ID NO: 259683 - RNA, 64 nt, hsa; identical to SEQ ID NO: 91891

SEQ ID NO: 259684 - RNA, 64 nt, hsa; identical to SEQ ID NO: 91892

SEQ ID NO: 259685 - RNA, 64 nt, hsa; identical to SEQ ID NO: 91893

SEQ ID NO: 259686 - RNA, 64 nt, hsa; identical to SEQ ID NO: 91894

SEQ ID NO: 259687 - RNA, 64 nt, hsa; identical to SEQ ID NO: 91895

SEQ ID NO: 259688 - RNA, 64 nt, hsa; identical to SEQ ID NO: 91896

SEQ ID NO: 259689 - RNA, 64 nt, hsa
agggcugguauuaauaaaaguuagcuuuuaucugcagggcuagguuaaggcuggcauucuuacu

SEQ ID NO: 259690 - RNA, 64 nt, hsa
uuuuucuucauucagcuuagccuuucuguuuggccagggcuacuuacaggggcuguugggguug

SEQ ID NO: 259691 - RNA, 64 nt, hsa
gcaagaagggacccuuccaggaugacacuaggaacagggcuagggcacucgcucagucccuagg

SEQ ID NO: 259692 - RNA, 64 nt, hsa
agccagcgggucagcccagaggcagccucagcuccagggcuaaggacucucggcucccauuuuc

SEQ ID NO: 259693 - RNA, 64 nt, hsa
agagcuugucuuucaaggcagguuccuggggcuucagggcuaggagggaggagccugcccuuuu

SEQ ID NO: 259694 - RNA, 64 nt, hsa
augcggcucaagucacucagaggcuguugcauuucagggcuauguugguccuuuguuuaccucc

SEQ ID NO: 259695 - RNA, 64 nt, hsa
auucuuuacaccuccccccccaagagaaaguacacagggcuauucuguaauauuguucagggaa

SEQ ID NO: 259696 - RNA, 64 nt, hsa
acuacugccuuuguaacuuccacuuagccuacuacagggcuaugcacaucuuaguuuccaaaag

SEQ ID NO: 259697 - RNA, 64 nt, hsa
cuucaaggcuccugcuuaaaguccacacguuauuauggccgaaagcaaccuggugcuucggccu

SEQ ID NO: 259698 - RNA, 64 nt, hsa
uuucaagggagcugauaaagaacuucuucccaaaauggccgaagcuggacuguacugcugccau

SEQ ID NO: 259699 - RNA, 64 nt, hsa
ccccagagccugccauucacguuugccaaggaagauggccgacacucucugaguguguucacug

SEQ ID NO: 259700 - RNA, 64 nt, hsa
ggccgucgucaugguuacuggccccuaggcgccgauggccgaggccgcgccugcccaccgggcg

SEQ ID NO: 259701 - RNA, 64 nt, hsa
guggucugcaggguaggcccgcaggaaaugaggaauggccgagcuggagagaagagcugauuuu

SEQ ID NO: 259702 - RNA, 64 nt, hsa
gaccaaacugccaucaccucccacuuggaaguguauggccgacagcaugaaauagcugagccca

SEQ ID NO: 259703 - RNA, 64 nt, hsa
gugggcagcguacuucuaacucauuguuucccucauggccgaccagggcggggauagcaugccc

SEQ ID NO: 259704 - RNA, 64 nt, hsa
uauagcauguaucaguacuacuucauuucuuuuuauggccgaaauuacuccauuguaugauaug

SEQ ID NO: 259705 - RNA, 64 nt, hsa
guguguaugauugucuuaaaauuuuuuaauagauauggccgagcgugauggcucaccccuguaa

SEQ ID NO: 259706 - RNA, 64 nt, hsa
cggcuagggcuugggggugaugcaggcacagcagauggccgaggcaggacacugcagaggaaga

SEQ ID NO: 259707 - RNA, 64 nt, hsa
cuugagaguggaggagcaggccauucuggaugccauggccgaggagacaaggcagaagcaacuu

SEQ ID NO: 259708 - RNA, 64 nt, hsa
caccauuaggcuaauagagaaacagaucagccaaauggccgaugacacaguggcagaacuggac

SEQ ID NO: 259709 - RNA, 64 nt, hsa
ggcugaaauauuucucguaauagcagaauauuucauggccgaacucuugauagugacaaaucag

SEQ ID NO: 259710 - RNA, 64 nt, hsa
cugagccaggcuuuucucaggagcuucaaugaguauggccgacagacauggacaaggagcugug

SEQ ID NO: 259711 - RNA, 64 nt, hsa
gaaagacacacugagcugugaugaagaaaaauacauggccgacuccaggguggugacauuuaga

SEQ ID NO: 259712 - RNA, 64 nt, hsa
gaaaaugaaauauaacaagugggugaaugugguuauggccgaaaaggauaugcaguaugcuuaa

SEQ ID NO: 259713 - RNA, 64 nt, hsa
uauaaucaaugccaauguaaugccagcgggugagauggccgauggagguuucaaagauguagcu

SEQ ID NO: 259714 - RNA, 64 nt, hsa
ucaccuuguggggcauguuuguauuuauugcuucauggccgacuggaauccugaguccugggaa

SEQ ID NO: 259715 - RNA, 64 nt, hsa
ccaaaccagcccucggcugcuaugaguuggcaagauggccgagucuacuucuucaagggcaaag

SEQ ID NO: 259716 - RNA, 64 nt, hsa
cacauugacuauagaaugagauguauccugcaagauggccgaaucuucauuggcaccuuuaagg

SEQ ID NO: 259717 - RNA, 64 nt, hsa
ucgaccuugaggaggccucccacgaagggcgaagauggccgagaugauccuaaaaauaaccgaa

SEQ ID NO: 259718 - RNA, 64 nt, hsa
uccacaaaggguagccuggcuuuucuggcuggggauggccgauggggcccacauuaggggguuu

SEQ ID NO: 259719 - RNA, 64 nt, hsa
aagcagauuuugcuuuuguuuguuaaucauaggcauggccgagcauuguggauuagccugaggc

SEQ ID NO: 259720 - RNA, 64 nt, hsa
aauuucaagcagugaggauuuuguggugccugagauggccgagggcacagggagugagcuguau

SEQ ID NO: 259721 - RNA, 64 nt, hsa
ggcccgcccccgugacugacugacagaugcagggauggccgaggcagcccucgcuccagcugaa

SEQ ID NO: 259722 - RNA, 64 nt, hsa
auguagaaaaaccuucagccaggaggcuggcaagauggccgaauaggaacagcucugaucugca

SEQ ID NO: 259723 - RNA, 64 nt, hsa
caucugaugcuuccccugggaaucuaaacugggaauggccgaggaggaaggggcuccgugcacu

SEQ ID NO: 259724 - RNA, 64 nt, hsa
gagauggauccuuccaucuuguggggccaggaccauggccgaagccccuuggagagagaggcug

SEQ ID NO: 259725 - RNA, 64 nt, hsa
gcccccgacccaucacugccacauucuccgggucauggccgagcuugaccucugcauccauggu

SEQ ID NO: 259726 - RNA, 64 nt, hsa
ggagaggagaaauguggacagagggcuugaagacauggccgaauaggcuacugccacccggcuu

SEQ ID NO: 259727 - RNA, 64 nt, hsa
auuuuugccugucauaagaaaacucuuagcugaaauggccgaaaacugugagacaugcuaugga

SEQ ID NO: 259728 - RNA, 64 nt, hsa
uuuaaugccugcuauaaaaauuugaaauauuagaauggccgaccauggcagugaccaggccuca

SEQ ID NO: 259729 - RNA, 64 nt, hsa
cccuuagccaagcaguuucuuucaaagaagccagcaggcgaaaagcagggacugccacugcauu

SEQ ID NO: 259730 - RNA, 64 nt, hsa
ccagcucuacacagaggucucuccuggcagaaagcaggcgaagggcaggaggagcugcuuggca

SEQ ID NO: 259731 - RNA, 64 nt, hsa
uuuaaauggaaacuuuaauaucugauuacuuuugcaggcgaagugccccuuuauauauccaaaa

SEQ ID NO: 259732 - RNA, 64 nt, hsa
uggggguacccguugcagagccagggacaugaugcaggcgaagcuugggaucuggccaaguugg

SEQ ID NO: 259733 - RNA, 64 nt, hsa
acuucacacgagggaagucaguaaaaacuacgagcaggcgaacgccacccucaguaaguggccc

SEQ ID NO: 259734 - RNA, 64 nt, hsa
acgccuguaaucccagcacuuugggaggccgaaacaggcgaaucacuugagcccaggaguucaa

SEQ ID NO: 259735 - RNA, 64 nt, hsa
aaaagugauggaaagguguuugaaaggaugcuaucaggcgaagugacaucuuucuaaccagaua

SEQ ID NO: 259736 - RNA, 64 nt, hsa
aagaugauuuuuacuuaaagauauuaggucuggccaggcgaagugacucacaccugcaauccca

SEQ ID NO: 259737 - RNA, 64 nt, hsa
ccggcucuacaaaaaagaguuuuucaaaauuagccaggcgaaguggcacacaucugugguccca

SEQ ID NO: 259738 - RNA, 64 nt, hsa
uuuugggggaacgccgggacugagagacuccacgcaggcgaauucccguuuggggcuuuuuuuu

SEQ ID NO: 259739 - RNA, 64 nt, hsa
augccuguaaucccagcacuuugggaggccgaggcaggcgaaucacgaggucaggaguucgaga

SEQ ID NO: 259740 - RNA, 64 nt, hsa
gagcggccaccauaugcaggcugagagcugggcacaggcgaagccauuggaagcacuucaggaa

SEQ ID NO: 259741 - RNA, 64 nt, hsa
uucugguugggauguggaguuguugcuggacucucaggcgaagcugaagucauugaagugugug

SEQ ID NO: 259742 - RNA, 64 nt, hsa
agcuggcgcucagcagcccuagcggcugcuccuucaggcgaagggugguuugcagaugugggga

SEQ ID NO: 259743 - RNA, 64 nt, hsa
aacauugaccauuggaggagugguuuaagagugccaggcgaagggcaaacuguagaucgaucuu

SEQ ID NO: 259744 - RNA, 64 nt, hsa
uaccaaaaggcccuugggacaucagaggagccggcaggcgaagguagaggauguguuccagaaa

SEQ ID NO: 259745 - RNA, 64 nt, hsa
gugcagaccagcccugucccgccucccugucagucaggcgaauucaaccggaaaagggacgugg

SEQ ID NO: 259746 - RNA, 64 nt, hsa
uccagucccaacaccugcucuugccugguaggaacaggcgaagugucagcccucaauguugggu

SEQ ID NO: 259747 - RNA, 64 nt, hsa
auuauaggcgugagccaccgcccccagcugauuccaggcgaauucuucucugaugggcgggcga

SEQ ID NO: 259748 - RNA, 64 nt, hsa
auccagucccagcguggcccuuggcgcgcagcagcaggcgaacucccagaaggugguggugggc

SEQ ID NO: 259749 - RNA, 64 nt, hsa
cacagauccagugggguccggacacugggccccgcaggcgaaagcacguuccagccaccaggag

SEQ ID NO: 259750 - RNA, 64 nt, hsa
acuccagacugaucugccuaaagcacgcgagaugcaggcgaaaagcagccacaccccucugcca

SEQ ID NO: 259751 - RNA, 64 nt, hsa
ugggaccgcagagcaugcugcguagcucgcgcgucaggcgaaccagcguccggcagcgucccgc

SEQ ID NO: 259752 - RNA, 54 nt, hsa
agcuguggaggagugugugaggaccaggcgaaggaagguaucagcugugcugga

SEQ ID NO: 259753 - RNA, 64 nt, hsa
auugguggccugagccgauggggccccccaggcccaggcgaaagggcagcagcauguggcccau

SEQ ID NO: 259754 - RNA, 64 nt, hsa
ucugaagcuaggacagcuggcugagaaguggguucaggcgaagggugaagccauguguagcagu

SEQ ID NO: 259755 - RNA, 64 nt, hsa
gaggggcuagggcuggaagccaguucuaggcuuccaggcgaaagcugagggaaggaagaaacuc

SEQ ID NO: 259756 - RNA, 64 nt, hsa
augccuguaguuccagcuacuugggaggcugagacaggcgaauugcuugaaccugggaggcaga

SEQ ID NO: 259757 - RNA, 64 nt, hsa
gacccagagguccuuuacguguggauggaguucacaggcgaauagaggagaggaccaggggacg

SEQ ID NO: 259758 - RNA, 64 nt, hsa
uccaccacuuccacccuggcgaguggagcaggggcaggcgaaccucuuucuuugcagaccgaac

SEQ ID NO: 259759 - RNA, 64 nt, hsa
ggccguccuuuccacacaggccagaagaggucuucaggcgaaccgaccuucccccuucuggcau

SEQ ID NO: 259760 - RNA, 64 nt, hsa
cucagcuacaucaugguguauagaugcuguuauucaggcgaacuugcucauggguggacuaaca

SEQ ID NO: 259761 - RNA, 64 nt, hsa
acaagaagcuguggugauuggcccuguggucuaucaggcgaaaaccacagauucuccuucuagu

SEQ ID NO: 259762 - RNA, 64 nt, hsa
uccuuggccucacucucuguaagcauauaaaccacaggcgaaagaggaugcugcauugcgagga

SEQ ID NO: 259763 - RNA, 64 nt, hsa
caauacugugcuggagagugagaaugggggugagcaggcgaacagagcucucucuggaucagcu

SEQ ID NO: 259764 - RNA, 64 nt, hsa
aggggaggaggucagcgaccuggggccguagcggcaggcgaacggugccugcuacccagcugga

SEQ ID NO: 259765 - RNA, 64 nt, hsa
gugccuguagucccagcuccucaggcugcugaggcaggcgaauugcuugaaccugggaggcaga

SEQ ID NO: 259766 - RNA, 64 nt, hsa
acugggaggccugagagugggccagcucgcugcucaggcgaauuucucauuucaagccacuggg

SEQ ID NO: 259767 - RNA, 64 nt, hsa
aggaauggggauagaugggagguucuugaagccccaggcgaagcugguaccucuggcuacagcu

SEQ ID NO: 259768 - RNA, 64 nt, hsa
uuugaagcucaggugucucacgucugggcugcaccaggcgaagagagaaauuaaagauuugagg

SEQ ID NO: 259769 - RNA, 64 nt, hsa
augggccuugcgaaccuggguuagaaacccuggccaggcgaacguggggugauucacagcacaa

SEQ ID NO: 259770 - RNA, 64 nt, hsa
uauuuuuuaaugcuaaucuugugaaaauaauugacaggcgaaagaaaacucuauuuagaugcau

SEQ ID NO: 259771 - RNA, 64 nt, hsa; identical to SEQ ID NO: 106637

SEQ ID NO: 259772 - RNA, 64 nt, hsa; identical to SEQ ID NO: 106638

SEQ ID NO: 259773 - RNA, 64 nt, hsa; identical to SEQ ID NO: 106639

SEQ ID NO: 259774 - RNA, 64 nt, hsa; identical to SEQ ID NO: 106640

SEQ ID NO: 259775 - RNA, 64 nt, hsa; identical to SEQ ID NO: 106641

SEQ ID NO: 259776 - RNA, 64 nt, hsa; identical to SEQ ID NO: 106642

SEQ ID NO: 259777 - RNA, 64 nt, hsa; identical to SEQ ID NO: 106643

SEQ ID NO: 259778 - RNA, 64 nt, hsa; identical to SEQ ID NO: 106644

SEQ ID NO: 259779 - RNA, 64 nt, hsa; identical to SEQ ID NO: 106645

SEQ ID NO: 259780 - RNA, 64 nt, hsa; identical to SEQ ID NO: 106646

SEQ ID NO: 259781 - RNA, 64 nt, hsa; identical to SEQ ID NO: 106647

SEQ ID NO: 259782 - RNA, 64 nt, hsa; identical to SEQ ID NO: 106648

SEQ ID NO: 259783 - RNA, 64 nt, hsa; identical to SEQ ID NO: 106649

SEQ ID NO: 259784 - RNA, 64 nt, hsa; identical to SEQ ID NO: 106650

SEQ ID NO: 259785 - RNA, 61 nt, hsa; identical to SEQ ID NO: 106651

SEQ ID NO: 259786 - RNA, 64 nt, hsa; identical to SEQ ID NO: 106652

SEQ ID NO: 259787 - RNA, 64 nt, hsa; identical to SEQ ID NO: 106653

SEQ ID NO: 259788 - RNA, 64 nt, hsa; identical to SEQ ID NO: 106654

SEQ ID NO: 259789 - RNA, 64 nt, hsa; identical to SEQ ID NO: 106655

SEQ ID NO: 259790 - RNA, 64 nt, hsa; identical to SEQ ID NO: 106656

SEQ ID NO: 259791 - RNA, 64 nt, hsa; identical to SEQ ID NO: 106657

SEQ ID NO: 259792 - RNA, 64 nt, hsa; identical to SEQ ID NO: 106658

SEQ ID NO: 259793 - RNA, 64 nt, hsa; identical to SEQ ID NO: 106659

SEQ ID NO: 259794 - RNA, 64 nt, hsa; identical to SEQ ID NO: 106660

SEQ ID NO: 259795 - RNA, 64 nt, hsa; identical to SEQ ID NO: 106661

SEQ ID NO: 259796 - RNA, 64 nt, hsa; identical to SEQ ID NO: 106662

SEQ ID NO: 259797 - RNA, 64 nt, hsa; identical to SEQ ID NO: 106663

SEQ ID NO: 259798 - RNA, 64 nt, hsa; identical to SEQ ID NO: 106664

SEQ ID NO: 259799 - RNA, 64 nt, hsa; identical to SEQ ID NO: 106665

SEQ ID NO: 259800 - RNA, 64 nt, hsa; identical to SEQ ID NO: 106666

SEQ ID NO: 259801 - RNA, 64 nt, hsa; identical to SEQ ID NO: 106667

SEQ ID NO: 259802 - RNA, 64 nt, hsa; identical to SEQ ID NO: 106668

SEQ ID NO: 259803 - RNA, 64 nt, hsa; identical to SEQ ID NO: 106669

SEQ ID NO: 259804 - RNA, 64 nt, hsa; identical to SEQ ID NO: 106670

SEQ ID NO: 259805 - RNA, 64 nt, hsa; identical to SEQ ID NO: 106671

SEQ ID NO: 259806 - RNA, 64 nt, hsa; identical to SEQ ID NO: 106672

SEQ ID NO: 259807 - RNA, 64 nt, hsa; identical to SEQ ID NO: 106673

SEQ ID NO: 259808 - RNA, 64 nt, hsa; identical to SEQ ID NO: 106674

SEQ ID NO: 259809 - RNA, 64 nt, hsa; identical to SEQ ID NO: 106675

SEQ ID NO: 259810 - RNA, 64 nt, hsa; identical to SEQ ID NO: 106676

SEQ ID NO: 259811 - RNA, 64 nt, hsa; identical to SEQ ID NO: 106677

SEQ ID NO: 259812 - RNA, 64 nt, hsa; identical to SEQ ID NO: 106678

SEQ ID NO: 259813 - RNA, 64 nt, hsa; identical to SEQ ID NO: 106679

SEQ ID NO: 259814 - RNA, 64 nt, hsa; identical to SEQ ID NO: 106680

SEQ ID NO: 259815 - RNA, 64 nt, hsa; identical to SEQ ID NO: 106681

SEQ ID NO: 259816 - RNA, 64 nt, hsa; identical to SEQ ID NO: 106682

SEQ ID NO: 259817 - RNA, 64 nt, hsa; identical to SEQ ID NO: 106683

SEQ ID NO: 259818 - RNA, 64 nt, hsa; identical to SEQ ID NO: 106684

SEQ ID NO: 259819 - RNA, 64 nt, hsa; identical to SEQ ID NO: 106685

SEQ ID NO: 259820 - RNA, 64 nt, hsa; identical to SEQ ID NO: 106686

SEQ ID NO: 259821 - RNA, 64 nt, hsa; identical to SEQ ID NO: 106687

SEQ ID NO: 259822 - RNA, 64 nt, hsa; identical to SEQ ID NO: 106688

SEQ ID NO: 259823 - RNA, 64 nt, hsa; identical to SEQ ID NO: 106689

SEQ ID NO: 259824 - RNA, 64 nt, hsa; identical to SEQ ID NO: 106690

SEQ ID NO: 259825 - RNA, 64 nt, hsa; identical to SEQ ID NO: 106691

SEQ ID NO: 259826 - RNA, 64 nt, hsa; identical to SEQ ID NO: 106692

SEQ ID NO: 259827 - RNA, 64 nt, hsa; identical to SEQ ID NO: 106693

SEQ ID NO: 259828 - RNA, 64 nt, hsa; identical to SEQ ID NO: 106694

SEQ ID NO: 259829 - RNA, 64 nt, hsa; identical to SEQ ID NO: 106695

SEQ ID NO: 259830 - RNA, 64 nt, hsa; identical to SEQ ID NO: 106696

SEQ ID NO: 259831 - RNA, 64 nt, hsa; identical to SEQ ID NO: 106697

SEQ ID NO: 259832 - RNA, 64 nt, hsa; identical to SEQ ID NO: 106698

SEQ ID NO: 259833 - RNA, 64 nt, hsa; identical to SEQ ID NO: 106699

SEQ ID NO: 259834 - RNA, 64 nt, hsa; identical to SEQ ID NO: 106700

SEQ ID NO: 259835 - RNA, 64 nt, hsa; identical to SEQ ID NO: 106701

SEQ ID NO: 259836 - RNA, 64 nt, hsa; identical to SEQ ID NO: 106702

SEQ ID NO: 259837 - RNA, 64 nt, hsa; identical to SEQ ID NO: 106703

SEQ ID NO: 259838 - RNA, 64 nt, hsa; identical to SEQ ID NO: 106704

SEQ ID NO: 259839 - RNA, 64 nt, hsa; identical to SEQ ID NO: 106705

SEQ ID NO: 259840 - RNA, 64 nt, hsa; identical to SEQ ID NO: 106706

SEQ ID NO: 259841 - RNA, 64 nt, hsa; identical to SEQ ID NO: 106707

SEQ ID NO: 259842 - RNA, 64 nt, hsa; identical to SEQ ID NO: 106708

SEQ ID NO: 259843 - RNA, 64 nt, hsa; identical to SEQ ID NO: 106709

SEQ ID NO: 259844 - RNA, 64 nt, hsa; identical to SEQ ID NO: 106710

SEQ ID NO: 259845 - RNA, 64 nt, hsa; identical to SEQ ID NO: 106711

SEQ ID NO: 259846 - RNA, 64 nt, hsa; identical to SEQ ID NO: 106712

SEQ ID NO: 259847 - RNA, 64 nt, hsa; identical to SEQ ID NO: 106713

SEQ ID NO: 259848 - RNA, 64 nt, hsa; identical to SEQ ID NO: 106714

SEQ ID NO: 259849 - RNA, 64 nt, hsa; identical to SEQ ID NO: 106715

SEQ ID NO: 259850 - RNA, 64 nt, hsa; identical to SEQ ID NO: 106716

SEQ ID NO: 259851 - RNA, 64 nt, hsa; identical to SEQ ID NO: 106717

SEQ ID NO: 259852 - RNA, 64 nt, hsa; identical to SEQ ID NO: 106718

SEQ ID NO: 259853 - RNA, 64 nt, hsa; identical to SEQ ID NO: 106719

SEQ ID NO: 259854 - RNA, 64 nt, hsa; identical to SEQ ID NO: 106720

SEQ ID NO: 259855 - RNA, 64 nt, hsa; identical to SEQ ID NO: 106721

SEQ ID NO: 259856 - RNA, 64 nt, hsa; identical to SEQ ID NO: 106722

SEQ ID NO: 259857 - RNA, 64 nt, hsa; identical to SEQ ID NO: 106723

SEQ ID NO: 259858 - RNA, 64 nt, hsa; identical to SEQ ID NO: 106724

SEQ ID NO: 259859 - RNA, 64 nt, hsa; identical to SEQ ID NO: 106725

SEQ ID NO: 259860 - RNA, 64 nt, hsa; identical to SEQ ID NO: 106726

SEQ ID NO: 259861 - RNA, 64 nt, hsa; identical to SEQ ID NO: 106727

SEQ ID NO: 259862 - RNA, 64 nt, hsa; identical to SEQ ID NO: 106728

SEQ ID NO: 259863 - RNA, 64 nt, hsa
uuauuuucaaaugaaugaggccaagcugaagcugaagcugaagauucuucccaucuggccagcc

SEQ ID NO: 259864 - RNA, 64 nt, hsa
aacauuuuauuuucaaaugaaugaggccaagcugaagcugaagcugaagauucuucccaucugg

SEQ ID NO: 259865 - RNA, 64 nt, hsa
cauguaaacauuuuauuuucaaaugaaugaggccaagcugaagcugaagcugaagauucuuccc

SEQ ID NO: 259866 - RNA, 64 nt, hsa
cuauuuggacauagacuucauuuccuuucaguauaagcugaauaaauuuagagcuuucaaacug

SEQ ID NO: 259867 - RNA, 64 nt, hsa
uugccaguucuuaauuauaggacauauuuucucaaagcugaaggugacaccuagaaccaggggc

SEQ ID NO: 259868 - RNA, 64 nt, hsa
gaaacuggcuuuucaaaaugggcuaugggagcacaagcugaagcuuuagugccuucuacaaugu

SEQ ID NO: 259869 - RNA, 64 nt, hsa
accucaugggaagaguuacuuuuuuagaucuaaaaagcugaauagcauguuaguuacuugguuu

SEQ ID NO: 259870 - RNA, 64 nt, hsa
caauucggugggcaauuuuuggacaugaaccagaaagcugaaagcugaggcugacacggacugu

SEQ ID NO: 259871 - RNA, 64 nt, hsa
uuuucuaucucuaggcaacaugucuuuauuauucaagcugaauguuuaagagagauuuuggucu

SEQ ID NO: 259872 - RNA, 64 nt, hsa
ugugucaccgaggugcgggaggggaggagcauuaaagcugaaagaucgcucugcucggggagcc

SEQ ID NO: 259873 - RNA, 64 nt, hsa
uauuuggggagcaggggaggggaggguguugagaaagcugaacuggagucaaucacccuuccca

SEQ ID NO: 259874 - RNA, 64 nt, hsa
ggccagaaugaggaagcccugaagagcuuaaaagaagcugaaaacuuaaugcaggaagaacaug

SEQ ID NO: 259875 - RNA, 64 nt, hsa
cuccuugcccugaagcuucaggaugaaggacaggaagcugaaggagaaaaguacauugaagaag

SEQ ID NO: 259876 - RNA, 64 nt, hsa
gcaagaauguauauagaagcaggcaaucacagaaaagcugaagagaauuuucaaaaauuguuau

SEQ ID NO: 259877 - RNA, 64 nt, hsa
cucucucgugcucaggcugcuccaggcaugugggaagcugaagcggcagcucugcgccaucuac

SEQ ID NO: 259878 - RNA, 64 nt, hsa
ccagcugauggauggcuucuccaugcuggagaagaagcugaaggaagggccggagcccggggcc

SEQ ID NO: 259879 - RNA, 64 nt, hsa
cagguccagagaaccuggcaugcaauggacauggaagcugaaaauuacuuggguauucucugau

SEQ ID NO: 259880 - RNA, 64 nt, hsa
aggccuuacugccccuacucguguacugugccugaagcugaaguuggaggcauccaaaauaagg

SEQ ID NO: 259881 - RNA, 64 nt, hsa
gauaacucaauauaacuauguggcugaaaaugcaaagcugaagaccauggauuucauggugauu

SEQ ID NO: 259882 - RNA, 64 nt, hsa
agaguuaaauaugcaucuggcccaggaauuagagaagcugaaaggaugauccuggggaaggugg

SEQ ID NO: 259883 - RNA, 64 nt, hsa
aaucaucacuucagcuccugauuggucccaggccaagcugaauagcccuuaggaauaaucacuu

SEQ ID NO: 259884 - RNA, 64 nt, hsa
aauaaucacuucaacuccugauuggucccgggccaagcugaauagcccuuaugaaucaucacuu

SEQ ID NO: 259885 - RNA, 64 nt, hsa
guuccugauuggucccgggccaaggucccagaccaagcugaaucacgcuuucuccaagacagcc

SEQ ID NO: 259886 - RNA, 64 nt, hsa
gggcuggggcugggaugggagggugaagaugcccaagcugaagaugccuuccuuugggcuggcu

SEQ ID NO: 259887 - RNA, 64 nt, hsa
uaaggcagaggcugagggggcugggcgagcuaccaagcugaagguauccaaauuugccaucuca

SEQ ID NO: 259888 - RNA, 64 nt, hsa
gccccggcccgcugcuccugaaguuguagagagcaagcugaagcugcccaccaucaagaugccc

SEQ ID NO: 259889 - RNA, 64 nt, hsa
gaaugccacugaagagcugugauagcauguuucaaagcugaacucuacagagcgagugcugaga

SEQ ID NO: 259890 - RNA, 64 nt, hsa
cucaugggaacacuguuaaugacccacacaggauaagcugaaugcaaaguuauuugcagguuga

SEQ ID NO: 259891 - RNA, 64 nt, hsa
aaaaggauuuuguuugauuugaaauuaaaacuucaagcugaaugacuuauaugagaauaauacg

SEQ ID NO: 259892 - RNA, 64 nt, hsa
ggcucaauuggccgggaaaacaugggagcaagagaagcugaaauauauuucugcaagaaccuuu

SEQ ID NO: 259893 - RNA, 64 nt, hsa
cagugaccuggagugaaacagaaucuacauaaccuaagcccauauacucugcacuguguaaagg

SEQ ID NO: 259894 - RNA, 64 nt, hsa
uuauaagcuuacguuaguauuguaauauguaaaguaagcccaacaaaaauuuuuaaaaauuuga

SEQ ID NO: 259895 - RNA, 64 nt, hsa
gcggaaggagcuggagaaucugacaggacagcuuuaagcccaugugcaagaaaaugagggcuug

SEQ ID NO: 259896 - RNA, 64 nt, hsa
gcggaaggagcuggagaaucuggcaggacagcuuuaagcccaaguggaagaaaaugagggcuug

SEQ ID NO: 259897 - RNA, 64 nt, hsa
ucucugugucugugugcccuccugggagucagucagcgcucaggccaggacugugcagggccag

SEQ ID NO: 259898 - RNA, 64 nt, hsa
gaccaggguaccccaggaggcaugaugugccgacagcgcucagugggcagaauggcaguuagau

SEQ ID NO: 259899 - RNA, 64 nt, hsa
gugaagguuuauacguuauacacaaggccagguaagcgcucauaauucacacauaauaaaacau

SEQ ID NO: 259900 - RNA, 64 nt, hsa
auaucuagccguccucgagacuucccuguguugcagcgcucauuuccagcugaggugagggcug

SEQ ID NO: 259901 - RNA, 64 nt, hsa
uuuuugcuugacuucaguuauugguggaaucuuuagcgcucaauaggaccaggauccagccuca

SEQ ID NO: 259902 - RNA, 64 nt, hsa
aaaguccuaucaccuaauauuacaagaguugguaagcgcucaucauuaauuuuauuuuguggca

SEQ ID NO: 259903 - RNA, 64 nt, hsa
accucuccugcuggucccuggaccucuggcugggagcgcucauucuugugacuggcaggcugcc

SEQ ID NO: 259904 - RNA, 64 nt, hsa
ccaaaggagacugacccggcgcggugcuggcgggagcgcucaagggcagcggauuuguuguugu

SEQ ID NO: 259905 - RNA, 64 nt, hsa
ccacaagccuuacucaccucucucuaaguuuagaagcgcucaucuggcuuuucgcuugcuucug

SEQ ID NO: 259906 - RNA, 64 nt, hsa
uuuggucauuggacacggauugcaggcuuugagaagcgcucagaggcccagggcggcgggcuca

SEQ ID NO: 259907 - RNA, 64 nt, hsa
aauaccccucacagcuagucauccauaucauugaagcgcucaugauuugauagauuaaccuuuc

SEQ ID NO: 259908 - RNA, 64 nt, hsa
ggaagugccaaguuuguuuuuggguuccuggaacagcgcucaccuuuguuuagaacacugguuu

SEQ ID NO: 259909 - RNA, 64 nt, hsa
uuguugaacaaaacugaccuugacuacucaguccagcgcucaggaauaucguaaccaguuuuuu

SEQ ID NO: 259910 - RNA, 64 nt, hsa
uuuucucuucuccugcuuuccuggggagagauuaagcgcucauuaagcagaggagcccacuuug

SEQ ID NO: 259911 - RNA, 64 nt, hsa
ggcucagggcuugcggccugcaggcacuccagccagcgcucaccuggccuuuccucaaggcaug

SEQ ID NO: 259912 - RNA, 64 nt, hsa
cuggcaccugugucuacuugcucccgagaagaggagcgcucaugucuuuuuugcaccccaaguu

SEQ ID NO: 259913 - RNA, 64 nt, hsa
ccccuucuccacuaaaaacaauaaucccaaagugagcgcucagccuauggguuuaagcagaggg

SEQ ID NO: 259914 - RNA, 64 nt, hsa
caguacuugauagaagaaaacagucugggaggauagcgcucauuuuucaguuacccuuuaagga

SEQ ID NO: 259915 - RNA, 64 nt, hsa
cuccuauuauaucugacacuaauuucuuuucaacagcgcucaugucucuuggcccagucaggug

SEQ ID NO: 259916 - RNA, 64 nt, hsa
gcaaucugaauuaaaaauacaucaaaaaaguaauagcgcucauuugcuaaaugcaaaaaauaau

SEQ ID NO: 259917 - RNA, 64 nt, hsa
ccaccuggagggaugugggggcugugcagggugcagcgcucagguggauccugggaagcagccu

SEQ ID NO: 259918 - RNA, 64 nt, hsa
cugaaaaccacggggccuguccccagcuggggugagcgcucagagggccuggggcccucacucc

SEQ ID NO: 259919 - RNA, 64 nt, hsa
agguuucuagacagcagaagaaaaccccucucucagcgcucaucucacgcagaggaugccaggc

SEQ ID NO: 259920 - RNA, 64 nt, hsa
acucugguacccacaggagccugggugggcaaagagcgcucaauccagcuccuugaaccccucc

SEQ ID NO: 259921 - RNA, 64 nt, hsa
cucccucccucucucaugaggcacagccaagccaagcgcucauguugagccagugggccagcca

SEQ ID NO: 259922 - RNA, 64 nt, hsa
acccacagcauccgccgccaccccuucgggugugagcgcucaauaaaaacaacacacuauaaag

SEQ ID NO: 259923 - RNA, 64 nt, hsa
ucgcuaacugacauuagcccauucaggucuucacagcgcucauacuguaaaaacuguuaaauau

SEQ ID NO: 259924 - RNA, 64 nt, hsa
acugauaggucgggccauuguugggccaucacugagcgcucaguaucucaagagacucuguuca

SEQ ID NO: 259925 - RNA, 64 nt, hsa
ggguaggugggggcggugagggcuccacguugucagcgcucaggaaugugcuccggcagagugc

SEQ ID NO: 259926 - RNA, 64 nt, hsa
gucccuguugcuggccagagacugccuggucgccagcgcucaccaugggugccaggaugcuucg

SEQ ID NO: 259927 - RNA, 64 nt, hsa
caugccugagagacauggcuuucagaaaacgggaagcgcucagaacaguaucuuugcacuccaa

SEQ ID NO: 259928 - RNA, 64 nt, hsa
ccaaaccuguggagaacuuuguugucaggcccugagcgcucacagcuucauuuggcccagguug

SEQ ID NO: 259929 - RNA, 64 nt, hsa
gguauuuucauaccagacuauuugcaucuugggaagcgcucaaaucuacucagguuuucuccuu

SEQ ID NO: 259930 - RNA, 64 nt, hsa
accugaagcugucaccucuugauuaucuaaacuaagcgcucauucuauuuuauaaaacaaauaa

SEQ ID NO: 259931 - RNA, 64 nt, hsa
uucuuagauugcgcuaaaauuucuuagauuguucagcgcucagaacaaaaguuugaaaaaugca

SEQ ID NO: 259932 - RNA, 64 nt, hsa
aaauuuguguaaaacaguuucaucugaucuaucuagcgcucaaugcuugaauggcagaacugaa

SEQ ID NO: 259933 - RNA, 64 nt, hsa
caccgcagagcuguccaggcacagcuccguccccagcgcucaugguguugaaacugucugucau

SEQ ID NO: 259934 - RNA, 64 nt, hsa
cgcuuggugcuguucucuuuggccuuuaagacaaagcgcucaucuugcccucuaccuccugaua

SEQ ID NO: 259935 - RNA, 64 nt, hsa
cucgccugcccugcuuggcucugaggaccugcccagcgcucaaagggaacggaagccuuccccu

SEQ ID NO: 259936 - RNA, 64 nt, hsa
aaggccuggugcaggcggcuugcugggggaugugagcgcucaggacgugaugagguacucgugg

SEQ ID NO: 259937 - RNA, 64 nt, hsa
cuguccuuccccucauccacccaaggccccagccagcgcucauacccuguccuuucucccugac

SEQ ID NO: 259938 - RNA, 64 nt, hsa
acaaccggccaccagaugucgcccuacucaccugagcgcucagcuucaagaaauuacuggaagg

SEQ ID NO: 259939 - RNA, 64 nt, hsa
ggccaaaccagucacucggggaggaaugcggaggagcgcucauuccauucuauuuaauugcagu

SEQ ID NO: 259940 - RNA, 64 nt, hsa
uuuaaaaaagcaaaacaaaaaacacgacuuuuccagcgcucagcguuuuuuccuuucguccgaa

SEQ ID NO: 259941 - RNA, 64 nt, hsa
gggcuuuugguaagugauaggucaggagaguaacagcgcucaugaaugggauuagugcccuuau

SEQ ID NO: 259942 - RNA, 64 nt, hsa
cagauaucagagcagacggaaauuucucccugcaagcgcucagucucaucccagcaagucaaag

SEQ ID NO: 259943 - RNA, 64 nt, hsa
cagaacugagggcugggauauuccucaugguggcagcgcucauagcgaaagccuacuguaauau

SEQ ID NO: 259944 - RNA, 64 nt, hsa
gggaucugguucggcugcugucggaugaggacguagcgcucauggugcggcaggcucguggccu

SEQ ID NO: 259945 - RNA, 64 nt, hsa
ggaccuaccugccugaguccuggagacagaaugaagcgcucagcaucccgggaauacuucucuu

SEQ ID NO: 259946 - RNA, 64 nt, hsa
cauggaagcagggugggaacucugcugugucgccagcgcucacucuacucgaguggcuuuuuga

SEQ ID NO: 259947 - RNA, 64 nt, hsa
aaagauuuucacuuuaaauuaauuaguaauauugagcgcucacccugugcguggccuugugcua

SEQ ID NO: 259948 - RNA, 64 nt, hsa
auugaauuuaaaauguguuuauuaaccgauucuccauaaauaaaaauaagauguguauguaaaa

SEQ ID NO: 259949 - RNA, 64 nt, hsa
cuggaguuuaaaauguuuaagguugcuucccgcucauaaauacauaauauauugaauuuaaaau

SEQ ID NO: 259950 - RNA, 64 nt, hsa
aucuucauacuuugaauggcaaacgcuauuuaugcauaaauauuuucauuuuaaguaauauaug

SEQ ID NO: 259951 - RNA, 64 nt, hsa
caugccccuguucuuccuaacuuguaaaauuucacauaaauauauuuucaauuguguacaaauu

SEQ ID NO: 259952 - RNA, 64 nt, hsa
agccccagauauaaauucucuugaaagcaauguucauaaauauuuaagcaaauuaaagacaaug

SEQ ID NO: 259953 - RNA, 64 nt, hsa
uucccaagacaaacauuuguccuaauagcuuucucauaaauaugggcaccacuuuacauugugg

SEQ ID NO: 259954 - RNA, 64 nt, hsa
guagcugauaucucauggaaaaaugacauuuuaucauaaauaaauauagagacaaaauaauagu

SEQ ID NO: 259955 - RNA, 64 nt, hsa
agccuuuugagacauccuuuauucuuaaaaagcucauaaauaauuggcuuauuacauauaaacu

SEQ ID NO: 259956 - RNA, 64 nt, hsa
auguauaugucauuuaaaauauuuugaaagcccucauaaauauuuauauuuacuaaacuaauag

SEQ ID NO: 259957 - RNA, 64 nt, hsa
uuauacaaaugaauaaguguaucuuuguauaaugcauaaauacauagauaaaaacauguuugcu

SEQ ID NO: 259958 - RNA, 64 nt, hsa
gaaaugagaguuagaccauaugggcugacaacaccauaaauaacaagaaaagggagugcugaaa

SEQ ID NO: 259959 - RNA, 64 nt, hsa
ccuuaauaauggugguguuuagcaaauuguauuacauaaauaaauauuuauuucauggauugag

SEQ ID NO: 259960 - RNA, 64 nt, hsa
uaucugaauuuuaaaauuaaaaaggcagauaagacauaaauaguuaucauuuuaauugcaauaa

SEQ ID NO: 259961 - RNA, 64 nt, hsa
aucacuugcaauuucauuguaaaaugaacaaauacauaaauauuuuaagaaaaauuuaaguuua

SEQ ID NO: 259962 - RNA, 64 nt, hsa
caagaugucaguuuuguauuggggauauguuuuacauaaauagaacucauuuaaaaguaugguu

SEQ ID NO: 259963 - RNA, 64 nt, hsa
ccaggaaugaagaauuaggcuugguuucagguuacauaaauaauagagcagaugguugccuuug

SEQ ID NO: 259964 - RNA, 64 nt, hsa
uugacuaguuauuauguacauuucagaauguacacauaaauacugugaugaaaaucaugugauu

SEQ ID NO: 259965 - RNA, 64 nt, hsa
cauaccuucaugguggacuacuagucacugcuuccauaaauauuguuuacagggugagauuugg

SEQ ID NO: 259966 - RNA, 64 nt, hsa
cuccaugggcuaaauccagauguccaccuguuuucauaaauaacguuuuauuggagcauagcug

SEQ ID NO: 259967 - RNA, 64 nt, hsa
aucgcauaccuguaucaaaauaucucauguaucccauaaauauauacaccuaccauguacccau

SEQ ID NO: 259968 - RNA, 64 nt, hsa
uuaccaucauuugcaaaaagguaccaaaaaaauccauaaauaaauauggaauacauucauaagu

SEQ ID NO: 259969 - RNA, 64 nt, hsa
acaacaauuucacaaccuauguuuacagauucuucauaaauacaugcauacugacacuauaauc

SEQ ID NO: 259970 - RNA, 64 nt, hsa
aaaccuuaacuaugacuaagaaauuaaagaagaaaaccagcaaacuaaaacuucugggcagcaa

SEQ ID NO: 259971 - RNA, 64 nt, hsa
uuugauauucagggagguaggaaagguaacagaaaaccagcauauuuaaucaaagcaagaagua

SEQ ID NO: 259972 - RNA, 64 nt, hsa
uguucauugguuccucuccuggaaaguggcuucuaaccagcacuggauggugaucauugguaag

SEQ ID NO: 259973 - RNA, 64 nt, hsa
cugccccuagauuucuccucaaggccucuggagcaaccagcacuugcccccuuggaaugcagag

SEQ ID NO: 259974 - RNA, 64 nt, hsa
aaaggaauuuguuuaaauaacauuaugggauugcaaccagcaaaacauaaacugagaaaaaguu

SEQ ID NO: 259975 - RNA, 64 nt, hsa
ucaugauacaccuacugguuaaauaauugacaaaaaccagcagccaaauauuagaggucuccug

SEQ ID NO: 259976 - RNA, 64 nt, hsa
gggacguggccaagggugagguggccaaaaccagaaccagcagucuccugccuuguucccuccc

SEQ ID NO: 259977 - RNA, 64 nt, hsa
ccugcaugccccaugugggaggugcugagcuccaaaccagcaucacaccaacucugacacaugg

SEQ ID NO: 259978 - RNA, 64 nt, hsa
uaucuaauuuauacaaaauaauuuaacuaauuuaaaccagcagaaaagugcuuagaaaguuauu

SEQ ID NO: 259979 - RNA, 64 nt, hsa
ggccaauuaaaauauauauaaauauauauuuuucaaccagcauuuuacuacuuguuaccuuucc

SEQ ID NO: 259980 - RNA, 64 nt, hsa
agggaaauugagccauauuuuggcuaucggcuggaaccagcaguucagagaucugccuuauaaa

SEQ ID NO: 259981 - RNA, 64 nt, hsa
auguguaaccgacguucagucuauucuaggaaugaaccagcaaguuguucauuuaaaacugacc

SEQ ID NO: 259982 - RNA, 64 nt, hsa
ucaaacuucuccaauacaguaagagauaguguugaaccagcaucaagucuccagaaacauggca

SEQ ID NO: 259983 - RNA, 64 nt, hsa
auuugaguaaauacaauuuuuuagguuacucaagaaccagcauuaguaauuucuaguaaaauug

SEQ ID NO: 259984 - RNA, 64 nt, hsa
gaaaacucugaaguuauauuugcaauaauaaugaaaccagcauuuaguaccagcauaugguuca

SEQ ID NO: 259985 - RNA, 64 nt, hsa
gcuaggcuauuuucuugcuaugcuuccugcacccaaccagcagaauucuuccaggguggaggaa

SEQ ID NO: 259986 - RNA, 64 nt, hsa
caggaaccucucagccgaugccccccgguaugggaaccagcaccucccaccaaccaaccacacc

SEQ ID NO: 259987 - RNA, 64 nt, hsa
caggaaccucucagccgaugccccccaguaugggaaccagcaccucccaccaaccagccacacc

SEQ ID NO: 259988 - RNA, 64 nt, hsa
caggaaccucucagccgaugccccccggugugggaaccagcaccucccaccaaccagccacacc

SEQ ID NO: 259989 - RNA, 64 nt, hsa
auaugguagauacuuguaguguuugaauaaaugaaaccagcauuagagcuuuauauacuuucuc

SEQ ID NO: 259990 - RNA, 64 nt, hsa
gucaguacacuuuucuagauaaaucuugagugaaaaccagcaauuucuuuuuccuuguggucug

SEQ ID NO: 259991 - RNA, 64 nt, hsa
cugguuucucgcagccauugccugccugacccugaaccagcaccuucuuuuccgagucauaccc

SEQ ID NO: 259992 - RNA, 64 nt, hsa
accuucacgcugucccaccaugggccaggaaccaaaccagcacuggguucuacugcuguggggu

SEQ ID NO: 259993 - RNA, 64 nt, hsa
ccccacuccacaucaacauuccagggaugagccaaaccagcagggaguuagcacugaacugcuu

SEQ ID NO: 259994 - RNA, 64 nt, hsa
guccuuucucagaggggccagcuaacccgugcagaaccagcacuaagguggacagcagacaaga

SEQ ID NO: 259995 - RNA, 64 nt, hsa
ucgguagguuccgugaugccccacaagccgcaaaaaccagcaaguuuuuauuagggauuuucaa

SEQ ID NO: 259996 - RNA, 64 nt, hsa
ggugggccagguguugcuugcccucauucugguaaaccagcagccuccagcaugggcgucauag

SEQ ID NO: 259997 - RNA, 64 nt, hsa
gccugggcaguagagucagucuccaucucaaagaaaccagcaaacaaaaaauauuaaaaaaaaa

SEQ ID NO: 259998 - RNA, 64 nt, hsa
aaggcacauaggucacuugaggucagaaguuugaaaccagcauggccaacagaugucagccacu

SEQ ID NO: 259999 - RNA, 64 nt, hsa
acuccaggcucuguuuuguguauuuaucugccauuugcaucaugguuuuuaaaauuuauuauua

SEQ ID NO: 260000 - RNA, 64 nt, hsa
uuuuauuguccaugauaaugaaauguuguguucuuugcaucauucacucucaaacguaguucau

SEQ ID NO: 260001 - RNA, 64 nt, hsa
gcagcaccuccagacuggaaaaauauguuaaucuuugcaucauauuggacucuugaaggcaauc

SEQ ID NO: 260002 - RNA, 64 nt, hsa
gcauguccuaaauuuugaauuuagauauuccaauuugcaucagucuuucuguggcucaaauaau

SEQ ID NO: 260003 - RNA, 64 nt, hsa
agucaguguccuuucauccugauucagcucugccuugcaucacccucagccuaagggaguggga

SEQ ID NO: 260004 - RNA, 64 nt, hsa
ugguuuucugucuagccagguccagguagcccacuugcaucagggcugcuggguuggaggggcu

SEQ ID NO: 260005 - RNA, 64 nt, hsa
uggaaauucaggugaaaauguucaucaauucccauugcaucaccucuguaauuuuucagcucuc

SEQ ID NO: 260006 - RNA, 64 nt, hsa
uauauauauaaauauuuggucucuauuucauuuuuugcaucaguauuaauacuaaaauaugucu

SEQ ID NO: 260007 - RNA, 64 nt, hsa; identical to SEQ ID NO: 237576

SEQ ID NO: 260008 - RNA, 64 nt, hsa; identical to SEQ ID NO: 237577

SEQ ID NO: 260009 - RNA, 64 nt, hsa; identical to SEQ ID NO: 237578

SEQ ID NO: 260010 - RNA, 64 nt, hsa; identical to SEQ ID NO: 237579

SEQ ID NO: 260011 - RNA, 64 nt, hsa; identical to SEQ ID NO: 237580

SEQ ID NO: 260012 - RNA, 64 nt, hsa; identical to SEQ ID NO: 237581

SEQ ID NO: 260013 - RNA, 64 nt, hsa; identical to SEQ ID NO: 237582

SEQ ID NO: 260014 - RNA, 64 nt, hsa; identical to SEQ ID NO: 237583

SEQ ID NO: 260015 - RNA, 64 nt, hsa; identical to SEQ ID NO: 237584

SEQ ID NO: 260016 - RNA, 64 nt, hsa; identical to SEQ ID NO: 237585

SEQ ID NO: 260017 - RNA, 64 nt, hsa; identical to SEQ ID NO: 237586

SEQ ID NO: 260018 - RNA, 64 nt, hsa; identical to SEQ ID NO: 237587

SEQ ID NO: 260019 - RNA, 64 nt, hsa; identical to SEQ ID NO: 237588

SEQ ID NO: 260020 - RNA, 64 nt, hsa; identical to SEQ ID NO: 237589

SEQ ID NO: 260021 - RNA, 64 nt, hsa; identical to SEQ ID NO: 237590

SEQ ID NO: 260022 - RNA, 64 nt, hsa; identical to SEQ ID NO: 237591

SEQ ID NO: 260023 - RNA, 64 nt, hsa; identical to SEQ ID NO: 237592

SEQ ID NO: 260024 - RNA, 64 nt, hsa; identical to SEQ ID NO: 237593

SEQ ID NO: 260025 - RNA, 64 nt, hsa; identical to SEQ ID NO: 237594

SEQ ID NO: 260026 - RNA, 64 nt, hsa; identical to SEQ ID NO: 237595

SEQ ID NO: 260027 - RNA, 64 nt, hsa; identical to SEQ ID NO: 237596

SEQ ID NO: 260028 - RNA, 64 nt, hsa; identical to SEQ ID NO: 237597

SEQ ID NO: 260029 - RNA, 64 nt, hsa; identical to SEQ ID NO: 237598

SEQ ID NO: 260030 - RNA, 64 nt, hsa; identical to SEQ ID NO: 237599

SEQ ID NO: 260031 - RNA, 64 nt, hsa; identical to SEQ ID NO: 237600

SEQ ID NO: 260032 - RNA, 64 nt, hsa; identical to SEQ ID NO: 237601

SEQ ID NO: 260033 - RNA, 64 nt, hsa; identical to SEQ ID NO: 237602

SEQ ID NO: 260034 - RNA, 64 nt, hsa; identical to SEQ ID NO: 237603

SEQ ID NO: 260035 - RNA, 64 nt, hsa; identical to SEQ ID NO: 237604

SEQ ID NO: 260036 - RNA, 64 nt, hsa; identical to SEQ ID NO: 237605

SEQ ID NO: 260037 - RNA, 64 nt, hsa; identical to SEQ ID NO: 237606

SEQ ID NO: 260038 - RNA, 64 nt, hsa; identical to SEQ ID NO: 237607

SEQ ID NO: 260039 - RNA, 64 nt, hsa; identical to SEQ ID NO: 237608

SEQ ID NO: 260040 - RNA, 64 nt, hsa; identical to SEQ ID NO: 237609

SEQ ID NO: 260041 - RNA, 64 nt, hsa; identical to SEQ ID NO: 237610

SEQ ID NO: 260042 - RNA, 64 nt, hsa; identical to SEQ ID NO: 237611

SEQ ID NO: 260043 - RNA, 64 nt, hsa; identical to SEQ ID NO: 237612

SEQ ID NO: 260044 - RNA, 64 nt, hsa; identical to SEQ ID NO: 237613

SEQ ID NO: 260045 - RNA, 64 nt, hsa; identical to SEQ ID NO: 237614

SEQ ID NO: 260046 - RNA, 64 nt, hsa; identical to SEQ ID NO: 237615

SEQ ID NO: 260047 - RNA, 64 nt, hsa; identical to SEQ ID NO: 237616

SEQ ID NO: 260048 - RNA, 64 nt, hsa; identical to SEQ ID NO: 237617

SEQ ID NO: 260049 - RNA, 64 nt, hsa; identical to SEQ ID NO: 237618

SEQ ID NO: 260050 - RNA, 64 nt, hsa; identical to SEQ ID NO: 237619

SEQ ID NO: 260051 - RNA, 64 nt, hsa; identical to SEQ ID NO: 237620

SEQ ID NO: 260052 - RNA, 64 nt, hsa; identical to SEQ ID NO: 237621

SEQ ID NO: 260053 - RNA, 64 nt, hsa; identical to SEQ ID NO: 237622

SEQ ID NO: 260054 - RNA, 64 nt, hsa; identical to SEQ ID NO: 237623

SEQ ID NO: 260055 - RNA, 64 nt, hsa; identical to SEQ ID NO: 237624

SEQ ID NO: 260056 - RNA, 64 nt, hsa; identical to SEQ ID NO: 237625

SEQ ID NO: 260057 - RNA, 64 nt, hsa; identical to SEQ ID NO: 237626

SEQ ID NO: 260058 - RNA, 64 nt, hsa; identical to SEQ ID NO: 237627

SEQ ID NO: 260059 - RNA, 64 nt, hsa; identical to SEQ ID NO: 237628

SEQ ID NO: 260060 - RNA, 64 nt, hsa; identical to SEQ ID NO: 237629

SEQ ID NO: 260061 - RNA, 64 nt, hsa; identical to SEQ ID NO: 237630

SEQ ID NO: 260062 - RNA, 64 nt, hsa; identical to SEQ ID NO: 237631

SEQ ID NO: 260063 - RNA, 64 nt, hsa; identical to SEQ ID NO: 237632

SEQ ID NO: 260064 - RNA, 64 nt, hsa; identical to SEQ ID NO: 237633

SEQ ID NO: 260065 - RNA, 64 nt, hsa; identical to SEQ ID NO: 237634

SEQ ID NO: 260066 - RNA, 64 nt, hsa; identical to SEQ ID NO: 237635

SEQ ID NO: 260067 - RNA, 64 nt, hsa; identical to SEQ ID NO: 237636

SEQ ID NO: 260068 - RNA, 64 nt, hsa; identical to SEQ ID NO: 237637

SEQ ID NO: 260069 - RNA, 64 nt, hsa; identical to SEQ ID NO: 237638

SEQ ID NO: 260070 - RNA, 64 nt, hsa; identical to SEQ ID NO: 237639

SEQ ID NO: 260071 - RNA, 64 nt, hsa; identical to SEQ ID NO: 237640

SEQ ID NO: 260072 - RNA, 64 nt, hsa; identical to SEQ ID NO: 237641

SEQ ID NO: 260073 - RNA, 64 nt, hsa; identical to SEQ ID NO: 237642

SEQ ID NO: 260074 - RNA, 64 nt, hsa; identical to SEQ ID NO: 237643

SEQ ID NO: 260075 - RNA, 64 nt, hsa; identical to SEQ ID NO: 237644

SEQ ID NO: 260076 - RNA, 64 nt, hsa; identical to SEQ ID NO: 237645

SEQ ID NO: 260077 - RNA, 64 nt, hsa; identical to SEQ ID NO: 237646

SEQ ID NO: 260078 - RNA, 64 nt, hsa; identical to SEQ ID NO: 237647

SEQ ID NO: 260079 - RNA, 64 nt, hsa; identical to SEQ ID NO: 237648

SEQ ID NO: 260080 - RNA, 64 nt, hsa; identical to SEQ ID NO: 237649

SEQ ID NO: 260081 - RNA, 64 nt, hsa; identical to SEQ ID NO: 237650

SEQ ID NO: 260082 - RNA, 64 nt, hsa; identical to SEQ ID NO: 237651

SEQ ID NO: 260083 - RNA, 64 nt, hsa; identical to SEQ ID NO: 237652

SEQ ID NO: 260084 - RNA, 64 nt, hsa; identical to SEQ ID NO: 237653

SEQ ID NO: 260085 - RNA, 64 nt, hsa; identical to SEQ ID NO: 237654

SEQ ID NO: 260086 - RNA, 64 nt, hsa; identical to SEQ ID NO: 237655

SEQ ID NO: 260087 - RNA, 64 nt, hsa; identical to SEQ ID NO: 237656

SEQ ID NO: 260088 - RNA, 64 nt, hsa; identical to SEQ ID NO: 237657

SEQ ID NO: 260089 - RNA, 64 nt, hsa; identical to SEQ ID NO: 237658

SEQ ID NO: 260090 - RNA, 64 nt, hsa; identical to SEQ ID NO: 237659

SEQ ID NO: 260091 - RNA, 64 nt, hsa; identical to SEQ ID NO: 237660

SEQ ID NO: 260092 - RNA, 64 nt, hsa; identical to SEQ ID NO: 237661

SEQ ID NO: 260093 - RNA, 64 nt, hsa; identical to SEQ ID NO: 237662

SEQ ID NO: 260094 - RNA, 64 nt, hsa; identical to SEQ ID NO: 237663

SEQ ID NO: 260095 - RNA, 64 nt, hsa; identical to SEQ ID NO: 237664

SEQ ID NO: 260096 - RNA, 64 nt, hsa; identical to SEQ ID NO: 237665

SEQ ID NO: 260097 - RNA, 64 nt, hsa; identical to SEQ ID NO: 237666

SEQ ID NO: 260098 - RNA, 64 nt, hsa; identical to SEQ ID NO: 237667

SEQ ID NO: 260099 - RNA, 64 nt, hsa; identical to SEQ ID NO: 237668

SEQ ID NO: 260100 - RNA, 64 nt, hsa; identical to SEQ ID NO: 237669

SEQ ID NO: 260101 - RNA, 64 nt, hsa; identical to SEQ ID NO: 237670

SEQ ID NO: 260102 - RNA, 64 nt, hsa; identical to SEQ ID NO: 237671

SEQ ID NO: 260103 - RNA, 64 nt, hsa; identical to SEQ ID NO: 237672

SEQ ID NO: 260104 - RNA, 64 nt, hsa; identical to SEQ ID NO: 237673

SEQ ID NO: 260105 - RNA, 64 nt, hsa; identical to SEQ ID NO: 237674

SEQ ID NO: 260106 - RNA, 64 nt, hsa; identical to SEQ ID NO: 237675

SEQ ID NO: 260107 - RNA, 64 nt, hsa; identical to SEQ ID NO: 237676

SEQ ID NO: 260108 - RNA, 64 nt, hsa; identical to SEQ ID NO: 237677

SEQ ID NO: 260109 - RNA, 64 nt, hsa; identical to SEQ ID NO: 237678

SEQ ID NO: 260110 - RNA, 64 nt, hsa; identical to SEQ ID NO: 237679

SEQ ID NO: 260111 - RNA, 64 nt, hsa; identical to SEQ ID NO: 237680

SEQ ID NO: 260112 - RNA, 64 nt, hsa; identical to SEQ ID NO: 237681

SEQ ID NO: 260113 - RNA, 64 nt, hsa; identical to SEQ ID NO: 237682

SEQ ID NO: 260114 - RNA, 64 nt, hsa; identical to SEQ ID NO: 237683

SEQ ID NO: 260115 - RNA, 64 nt, hsa; identical to SEQ ID NO: 237684

SEQ ID NO: 260116 - RNA, 64 nt, hsa; identical to SEQ ID NO: 237685

SEQ ID NO: 260117 - RNA, 64 nt, hsa; identical to SEQ ID NO: 237686

SEQ ID NO: 260118 - RNA, 64 nt, hsa; identical to SEQ ID NO: 237687

SEQ ID NO: 260119 - RNA, 64 nt, hsa; identical to SEQ ID NO: 237688

SEQ ID NO: 260120 - RNA, 64 nt, hsa; identical to SEQ ID NO: 237689

SEQ ID NO: 260121 - RNA, 64 nt, hsa; identical to SEQ ID NO: 237690

SEQ ID NO: 260122 - RNA, 64 nt, hsa; identical to SEQ ID NO: 237691

SEQ ID NO: 260123 - RNA, 64 nt, hsa; identical to SEQ ID NO: 237692

SEQ ID NO: 260124 - RNA, 64 nt, hsa; identical to SEQ ID NO: 237693

SEQ ID NO: 260125 - RNA, 64 nt, hsa; identical to SEQ ID NO: 237694

SEQ ID NO: 260126 - RNA, 64 nt, hsa; identical to SEQ ID NO: 237695

SEQ ID NO: 260127 - RNA, 64 nt, hsa; identical to SEQ ID NO: 237696

SEQ ID NO: 260128 - RNA, 64 nt, hsa; identical to SEQ ID NO: 237697

SEQ ID NO: 260129 - RNA, 64 nt, hsa; identical to SEQ ID NO: 237698

SEQ ID NO: 260130 - RNA, 64 nt, hsa; identical to SEQ ID NO: 237699

SEQ ID NO: 260131 - RNA, 64 nt, hsa; identical to SEQ ID NO: 237700

SEQ ID NO: 260132 - RNA, 64 nt, hsa; identical to SEQ ID NO: 237701

SEQ ID NO: 260133 - RNA, 64 nt, hsa; identical to SEQ ID NO: 237702

SEQ ID NO: 260134 - RNA, 64 nt, hsa; identical to SEQ ID NO: 237703

SEQ ID NO: 260135 - RNA, 64 nt, hsa; identical to SEQ ID NO: 237704

SEQ ID NO: 260136 - RNA, 64 nt, hsa; identical to SEQ ID NO: 237705

SEQ ID NO: 260137 - RNA, 64 nt, hsa; identical to SEQ ID NO: 237706

SEQ ID NO: 260138 - RNA, 64 nt, hsa; identical to SEQ ID NO: 237707

SEQ ID NO: 260139 - RNA, 64 nt, hsa; identical to SEQ ID NO: 237708

SEQ ID NO: 260140 - RNA, 64 nt, hsa; identical to SEQ ID NO: 237709

SEQ ID NO: 260141 - RNA, 64 nt, hsa; identical to SEQ ID NO: 237710

SEQ ID NO: 260142 - RNA, 64 nt, hsa; identical to SEQ ID NO: 237711

SEQ ID NO: 260143 - RNA, 64 nt, hsa; identical to SEQ ID NO: 237712

SEQ ID NO: 260144 - RNA, 64 nt, hsa; identical to SEQ ID NO: 237713

SEQ ID NO: 260145 - RNA, 64 nt, hsa; identical to SEQ ID NO: 237714

SEQ ID NO: 260146 - RNA, 64 nt, hsa; identical to SEQ ID NO: 237715

SEQ ID NO: 260147 - RNA, 64 nt, hsa; identical to SEQ ID NO: 237716

SEQ ID NO: 260148 - RNA, 64 nt, hsa; identical to SEQ ID NO: 237717

SEQ ID NO: 260149 - RNA, 64 nt, hsa; identical to SEQ ID NO: 237718

SEQ ID NO: 260150 - RNA, 64 nt, hsa; identical to SEQ ID NO: 237719

SEQ ID NO: 260151 - RNA, 64 nt, hsa; identical to SEQ ID NO: 237720

SEQ ID NO: 260152 - RNA, 64 nt, hsa; identical to SEQ ID NO: 237721

SEQ ID NO: 260153 - RNA, 64 nt, hsa; identical to SEQ ID NO: 237722

SEQ ID NO: 260154 - RNA, 64 nt, hsa; identical to SEQ ID NO: 237723

SEQ ID NO: 260155 - RNA, 64 nt, hsa; identical to SEQ ID NO: 237724

SEQ ID NO: 260156 - RNA, 64 nt, hsa; identical to SEQ ID NO: 237725

SEQ ID NO: 260157 - RNA, 64 nt, hsa; identical to SEQ ID NO: 237726

SEQ ID NO: 260158 - RNA, 64 nt, hsa; identical to SEQ ID NO: 237727

SEQ ID NO: 260159 - RNA, 64 nt, hsa; identical to SEQ ID NO: 237728

SEQ ID NO: 260160 - RNA, 64 nt, hsa; identical to SEQ ID NO: 237729

SEQ ID NO: 260161 - RNA, 64 nt, hsa; identical to SEQ ID NO: 237730

SEQ ID NO: 260162 - RNA, 64 nt, hsa; identical to SEQ ID NO: 237731

SEQ ID NO: 260163 - RNA, 64 nt, hsa; identical to SEQ ID NO: 237732

SEQ ID NO: 260164 - RNA, 64 nt, hsa; identical to SEQ ID NO: 237733

SEQ ID NO: 260165 - RNA, 64 nt, hsa; identical to SEQ ID NO: 117824

SEQ ID NO: 260166 - RNA, 64 nt, hsa; identical to SEQ ID NO: 117825

SEQ ID NO: 260167 - RNA, 64 nt, hsa; identical to SEQ ID NO: 117826

SEQ ID NO: 260168 - RNA, 64 nt, hsa; identical to SEQ ID NO: 117827

SEQ ID NO: 260169 - RNA, 64 nt, hsa; identical to SEQ ID NO: 117828

SEQ ID NO: 260170 - RNA, 64 nt, hsa; identical to SEQ ID NO: 117829

SEQ ID NO: 260171 - RNA, 64 nt, hsa; identical to SEQ ID NO: 117830

SEQ ID NO: 260172 - RNA, 64 nt, hsa; identical to SEQ ID NO: 117831

SEQ ID NO: 260173 - RNA, 64 nt, hsa; identical to SEQ ID NO: 117832

SEQ ID NO: 260174 - RNA, 64 nt, hsa; identical to SEQ ID NO: 117833

SEQ ID NO: 260175 - RNA, 64 nt, hsa; identical to SEQ ID NO: 117834

SEQ ID NO: 260176 - RNA, 64 nt, hsa; identical to SEQ ID NO: 117835

SEQ ID NO: 260177 - RNA, 64 nt, hsa; identical to SEQ ID NO: 117836

SEQ ID NO: 260178 - RNA, 64 nt, hsa; identical to SEQ ID NO: 117837

SEQ ID NO: 260179 - RNA, 64 nt, hsa; identical to SEQ ID NO: 117838

SEQ ID NO: 260180 - RNA, 64 nt, hsa; identical to SEQ ID NO: 117839

SEQ ID NO: 260181 - RNA, 64 nt, hsa; identical to SEQ ID NO: 117840

SEQ ID NO: 260182 - RNA, 64 nt, hsa; identical to SEQ ID NO: 117841

SEQ ID NO: 260183 - RNA, 64 nt, hsa; identical to SEQ ID NO: 117842

SEQ ID NO: 260184 - RNA, 64 nt, hsa; identical to SEQ ID NO: 117843

SEQ ID NO: 260185 - RNA, 64 nt, hsa; identical to SEQ ID NO: 117844

SEQ ID NO: 260186 - RNA, 64 nt, hsa; identical to SEQ ID NO: 117845

SEQ ID NO: 260187 - RNA, 64 nt, hsa; identical to SEQ ID NO: 117846

SEQ ID NO: 260188 - RNA, 64 nt, hsa; identical to SEQ ID NO: 117847

SEQ ID NO: 260189 - RNA, 64 nt, hsa; identical to SEQ ID NO: 117848

SEQ ID NO: 260190 - RNA, 64 nt, hsa; identical to SEQ ID NO: 117849

SEQ ID NO: 260191 - RNA, 64 nt, hsa; identical to SEQ ID NO: 117850

SEQ ID NO: 260192 - RNA, 64 nt, hsa; identical to SEQ ID NO: 117851

SEQ ID NO: 260193 - RNA, 64 nt, hsa; identical to SEQ ID NO: 117852

SEQ ID NO: 260194 - RNA, 64 nt, hsa; identical to SEQ ID NO: 117853

SEQ ID NO: 260195 - RNA, 64 nt, hsa; identical to SEQ ID NO: 117854

SEQ ID NO: 260196 - RNA, 64 nt, hsa; identical to SEQ ID NO: 117855

SEQ ID NO: 260197 - RNA, 64 nt, hsa
cuaguuucacagcuauuugaauuuuuuucuggauuuacuauauaacucuuauuuuuuaaaagau

SEQ ID NO: 260198 - RNA, 64 nt, hsa
acuguaauccuuuguauucauguuuacagugcuauuacuauaauucaaaauuauguaugugacu

SEQ ID NO: 260199 - RNA, 64 nt, hsa
uaagagguaacugugagguuaccauuaugugauguuacuauaaggacuuuuaacauugguuuaa

SEQ ID NO: 260200 - RNA, 64 nt, hsa
uuuuuaaugaaaaacaagucaagcuagcauccaguuacuauauagcuuggcuaaauuauacaag

SEQ ID NO: 260201 - RNA, 64 nt, hsa
gcaaaccggacaugcaggugaauauuuuaauagguuacuauaagguucucaauuaaauucuuua

SEQ ID NO: 260202 - RNA, 64 nt, hsa
gcugaacaggcaagauauaauauuacaugaaugauuacuauauuuuguucacacuaauaaagcu

SEQ ID NO: 260203 - RNA, 64 nt, hsa
aaaacaaaaugcuacuuguuaccucuauuuuuuguuacuauacaauuaugaaauguaauguaag

SEQ ID NO: 260204 - RNA, 64 nt, hsa
agcaucagaacauguguuuucagagaugaguccuuuacuauaagguuaauauuuauuuucauuu

SEQ ID NO: 260205 - RNA, 64 nt, hsa
uugaacaaaagcaugcuaaagaaugugguuuaauuuacuauauauuuguaaacuuguuagcuuu

SEQ ID NO: 260206 - RNA, 64 nt, hsa
uguucucuuacuaauguucugucuuguuuuauucuuacuauagaaaaugggauauuaaaauagu

SEQ ID NO: 260207 - RNA, 64 nt, hsa
aaagccaucucagagccauugauacaagucaaucuuacuauauguaacuucagacaaaguggaa

SEQ ID NO: 260208 - RNA, 64 nt, hsa
cauaaagccguuuauucuuccuuguaagaauccuuuacuauaaauauggguuaaaguauaaugu

SEQ ID NO: 260209 - RNA, 64 nt, hsa
gucuugagcaaugaagcuauauugucccuacauauuacuauauauugaacugaaaguucuuaca

SEQ ID NO: 260210 - RNA, 64 nt, hsa
aagaauuuuaucuuauaucuaaaaaauauauaacuuacuauauguuucaguugcucucugaaca

SEQ ID NO: 260211 - RNA, 64 nt, hsa
gaauaggaaacauuuuaucuucuuaccaaguaccuuacuauaaguaaaccuaagauaagaaaac

SEQ ID NO: 260212 - RNA, 64 nt, hsa
auucugaauggcugaaguuagucuuaaacucaaauuacuauaugaugauuuaaaacaaaauaaa

SEQ ID NO: 260213 - RNA, 64 nt, hsa
uaauauuuuauucuuaaaucuucagugauuccuuuuacuauagauucaugacagcuaauuagua

SEQ ID NO: 260214 - RNA, 64 nt, hsa
aaaggaaaacaagcaaaucuucucuaaucuacucuuacuauaauuuccuaaguguacaccaaac

SEQ ID NO: 260215 - RNA, 61 nt, hsa
caagacagcuggugccuuaagaauuggcccagccucagauccugucuuuagcaaccagcua

SEQ ID NO: 260216 - RNA, 64 nt, hsa
uagaguauuucaaaauggaaucaggaucuggugggccucagaaauugucucuuuucugaguuuc

SEQ ID NO: 260217 - RNA, 57 nt, hsa
acacucucccuuuucaguaagcgcaaagccucagaagaccuggaacaagauucugcc

SEQ ID NO: 260218 - RNA, 64 nt, hsa
cucuccuuccucuuccucaugaaugggccuuagugccucagagaguugaggaccgcagcauccc

SEQ ID NO: 260219 - RNA, 64 nt, hsa
ugggaauuuggguuguguaugcgaauguuucagugccucagacaaauguguauuuaacuuaugu

SEQ ID NO: 260220 - RNA, 64 nt, hsa
uaucuguaaccaagauggaugcaaagaggcuagugccucagagagaacuguacgggguuuguga

SEQ ID NO: 260221 - RNA, 64 nt, hsa
agccuucccauuuugcaguugaggaggcugaguagccucagaaggguuuaggcgaccuucugaa

SEQ ID NO: 260222 - RNA, 64 nt, hsa
aagucacgugauggagagaggauucaaagccagggccucagacccucacacacuugucugugcu

SEQ ID NO: 260223 - RNA, 64 nt, hsa
uuaauuggacuuaaaguuccacauggcuggggaggccucagaaucauggugggaggcaaaagac

SEQ ID NO: 260224 - RNA, 64 nt, hsa
uuacuuggacuuacaguuccacauggcuggggaggccucagaaucauggcgggaggugaaaggc

SEQ ID NO: 260225 - RNA, 64 nt, hsa
ccgccuuguggagaaauccugcccagagggcgaugccucagaaugcccacaagcuacaaaugcu

SEQ ID NO: 260226 - RNA, 64 nt, hsa
ggugaccggagagaaagaggagcccucccgcucagccucagaagcagacucugaagccggagag

SEQ ID NO: 260227 - RNA, 64 nt, hsa
caggcugcagagcaaggaugaagccucaggaggggccucagacccagccccugcuccacacugu

SEQ ID NO: 260228 - RNA, 64 nt, hsa
cuuucccugcucaacccuccauccuaggcucugagccucagaggacccagcccaugagagaacg

SEQ ID NO: 260229 - RNA, 64 nt, hsa
cacccacccaggcuuugaagagcauggagggggagccucagagcugacaguccugcuuagagcc

SEQ ID NO: 260230 - RNA, 64 nt, hsa
ucagcccugcccauggcugugcagcucccuccgugccucagaucugcuguagccagugcagacc

SEQ ID NO: 260231 - RNA, 64 nt, hsa
cacccccgggggccucagaacuaccccuuccagggccucagaacuaccccuacaguuucuccug

SEQ ID NO: 260232 - RNA, 64 nt, hsa
uccucccuggaccugcagcuccgcacccccgggggccucagaacuaccccuuccagggccucag

SEQ ID NO: 260233 - RNA, 64 nt, hsa
ucauguuuugaacugacuagggaggguagcaccugccucagauaguaccaacaauucuguuuca

SEQ ID NO: 260234 - RNA, 64 nt, hsa
uaaaagcaaaaacaaaaaacaaaacaauucauuagccucagauucuucaucuguauacaucaca

SEQ ID NO: 260235 - RNA, 64 nt, hsa
cugccaagucugucaucacugugggguguagccugccucagagggaccugcaaucaccucucug

SEQ ID NO: 260236 - RNA, 64 nt, hsa
gcuguguccccugccugagggcucugugccuccugccucagaugcggccugugccagagaggcu

SEQ ID NO: 260237 - RNA, 64 nt, hsa
uuaauuggacuuacaguuccacaugacuggggaggccucagaaucauggugggaggcaaaaagc

SEQ ID NO: 260238 - RNA, 64 nt, hsa
uuaauuggacuuacaguuccacauggccggggaggccucagaaucauggcgggaggugaaaagc

SEQ ID NO: 260239 - RNA, 64 nt, hsa
cugucauuguuccuuccccagaagcuaagagccagccucagagccuacccaggagcugugaagg

SEQ ID NO: 260240 - RNA, 64 nt, hsa
cuuuuccuuucuaccuccccugugaccuuuccuagccucagaucuguuaauucuuuuggcccca

SEQ ID NO: 260241 - RNA, 64 nt, hsa
ucagagcgcgcugugugugugugugugugugucagccucagagcgcgcgcugugugugugugug

SEQ ID NO: 260242 - RNA, 64 nt, hsa
gugugugugugugugugugugugugugugugucggccucagagcgcgcugugugugugugugug

SEQ ID NO: 260243 - RNA, 64 nt, hsa
acccuaagauggaggccagguagcaauggggccggccucagagagagcgcugugugugugugug

SEQ ID NO: 260244 - RNA, 64 nt, hsa
aagcgcaggugcagcgggggccagacuccugccggccucagaggacaccuggcccagcacaggc

SEQ ID NO: 260245 - RNA, 64 nt, hsa
ugggccccacacccagcccugccuuggucccugagccucagagcguggaauugcugcccugugg

SEQ ID NO: 260246 - RNA, 64 nt, hsa
uuauugagcuccugcaugaacucuggaccugccugccucagacuucugugaaagaauaaaauuu

SEQ ID NO: 260247 - RNA, 64 nt, hsa
ugaccugggaugccuaacugucuacucccugcaagccucagagcagccaagucauugguguuca

SEQ ID NO: 260248 - RNA, 64 nt, hsa
cucagauuucaggacccuccuccucgcccacggcgccucagaccucaggacccugccgucucac

SEQ ID NO: 260249 - RNA, 64 nt, hsa
uggcgugugcuuggcccuccuccucgcccacggcgccucagauuucaggacccuccuccucgcc

SEQ ID NO: 260250 - RNA, 64 nt, hsa
uagcguuuuagucguuuuauguuucuuugcaacggccucagaaguuuggccggagagggggcag

SEQ ID NO: 260251 - RNA, 64 nt, hsa
gccggagagggggcagccagagcggcagcccccggccucagaggcuaucacaggcucagggcaa

SEQ ID NO: 260252 - RNA, 64 nt, hsa
accagccucauucuauuuaacuuugcucucagaugccucagaugcuauaggucagugaaagggc

SEQ ID NO: 260253 - RNA, 64 nt, hsa
ccaccucucucuucucccccagaucaagcgacgugccucagaggcuuugcccgaauugcuucgu

SEQ ID NO: 260254 - RNA, 64 nt, hsa
cccuccugggcccugggcuggcacagccccuggagccucagaaaucuguuugauuggauauucu

SEQ ID NO: 260255 - RNA, 64 nt, hsa
gugagcaccaccagggcuccaggagccucauccagccucagagaucucccuucucaucucccca

SEQ ID NO: 260256 - RNA, 64 nt, hsa
acagaggaaaugugucucccuccaaggccccaaagccucagagaaaggguguuucugguuuugc

SEQ ID NO: 260257 - RNA, 64 nt, hsa
aauucaaggacaaccugucuuugagccagggcaggccucagacacccugccuguggccccgccu

SEQ ID NO: 260258 - RNA, 64 nt, hsa
aggagacuagauugccuuuguuuugauguuuguggccucagaauugaucauuuuccccccacuc

SEQ ID NO: 260259 - RNA, 64 nt, hsa
acuucugugagacccccacaccucaguucccuuggccucagaauucacaaaauuuccacaaaau

SEQ ID NO: 260260 - RNA, 64 nt, hsa
ccuauguccugagcccugacacucccacaccugagccucagauuccaauagcucacucccuaga

SEQ ID NO: 260261 - RNA, 64 nt, hsa
ccuagagccugacgccggggccccugaccccugagccucagauuccaauaccucacuccccaga

SEQ ID NO: 260262 - RNA, 64 nt, hsa
gaggcccuguuacuauuccuuugggaucucugaggccucagagugcuuggcugcuguaucuuua

SEQ ID NO: 260263 - RNA, 64 nt, hsa
ggugggaggcaggcagcugccugcucugcgccgagccucagaaggacccuguugaggguccuca

SEQ ID NO: 260264 - RNA, 64 nt, hsa; identical to SEQ ID NO: 126810

SEQ ID NO: 260265 - RNA, 64 nt, hsa; identical to SEQ ID NO: 126811

SEQ ID NO: 260266 - RNA, 64 nt, hsa; identical to SEQ ID NO: 126812

SEQ ID NO: 260267 - RNA, 64 nt, hsa; identical to SEQ ID NO: 126813

SEQ ID NO: 260268 - RNA, 64 nt, hsa; identical to SEQ ID NO: 126814

SEQ ID NO: 260269 - RNA, 64 nt, hsa; identical to SEQ ID NO: 126815

SEQ ID NO: 260270 - RNA, 64 nt, hsa; identical to SEQ ID NO: 126816

SEQ ID NO: 260271 - RNA, 64 nt, hsa; identical to SEQ ID NO: 126817

SEQ ID NO: 260272 - RNA, 64 nt, hsa; identical to SEQ ID NO: 126818

SEQ ID NO: 260273 - RNA, 64 nt, hsa; identical to SEQ ID NO: 126819

SEQ ID NO: 260274 - RNA, 64 nt, hsa; identical to SEQ ID NO: 126820

SEQ ID NO: 260275 - RNA, 64 nt, hsa; identical to SEQ ID NO: 126821

SEQ ID NO: 260276 - RNA, 64 nt, hsa; identical to SEQ ID NO: 126822

SEQ ID NO: 260277 - RNA, 64 nt, hsa; identical to SEQ ID NO: 126823

SEQ ID NO: 260278 - RNA, 64 nt, hsa; identical to SEQ ID NO: 126824

SEQ ID NO: 260279 - RNA, 64 nt, hsa; identical to SEQ ID NO: 126825

SEQ ID NO: 260280 - RNA, 64 nt, hsa; identical to SEQ ID NO: 126826

SEQ ID NO: 260281 - RNA, 64 nt, hsa; identical to SEQ ID NO: 126827

SEQ ID NO: 260282 - RNA, 64 nt, hsa; identical to SEQ ID NO: 126828

SEQ ID NO: 260283 - RNA, 64 nt, hsa
cccagccgcagcaccaagggcuugcugccuuguuuccugccaggagcgcccugacaucccaaaa

SEQ ID NO: 260284 - RNA, 64 nt, hsa
cuauggugagacccuggcugacauuuccccuccuuccugccaaggcuggaggccgccagguguu

SEQ ID NO: 260285 - RNA, 64 nt, hsa
aacuggucccugccugacagcaccugcugggccuuccugccaguggcccccaguuuuucuuccc

SEQ ID NO: 260286 - RNA, 64 nt, hsa
gcccaggcagcggguguguggagauggcgcccuguccugccaaggggcgccaggagcagagcca

SEQ ID NO: 260287 - RNA, 64 nt, hsa
ccgagucgucauccccggagucccuauacagagguccugccauggaaccuuccccuccccgugc

SEQ ID NO: 260288 - RNA, 64 nt, hsa
ucgggaucuucaggacgccuggagaagggugguuuccugccacccugcuggccaaggaggcucc

SEQ ID NO: 260289 - RNA, 64 nt, hsa
uggagcugucacccccggagucgccacacagacguccugccauggaaccuuccccucccggugc

SEQ ID NO: 260290 - RNA, 64 nt, hsa
ugggugcaucaggacgccuuggagaagcguggcuuccugccacccugcaacccacccucccagc

SEQ ID NO: 260291 - RNA, 64 nt, hsa
uugaccuuaaaaagacaaaaccccacaaaacucuuccugccacgggcuugcagauugaagcacu

SEQ ID NO: 260292 - RNA, 64 nt, hsa
gccagucgggaugacugggugaaagaggaguagcuccugccacuggcguuuugaguguuggcaa

SEQ ID NO: 260293 - RNA, 64 nt, hsa
aguccuugagugucaguuggugaggaccauggaguccugccagcucaaccugucauuuacagac

SEQ ID NO: 260294 - RNA, 64 nt, hsa
auuuggcuucacagauggcuucucacagaugcccuccugccagccaaaccggacuuguucuucc

SEQ ID NO: 260295 - RNA, 64 nt, hsa
cuacacaugaaggcccucucacacagacgugacguccugccagaaagagaaugaaugacagaaa

SEQ ID NO: 260296 - RNA, 64 nt, hsa
ugauucacuuuuagcagcagacuuugaacugcaguccugccaacguuggacacugaggacgccc

SEQ ID NO: 260297 - RNA, 64 nt, hsa
gccuuaaccccucgcacagccauccccccccccguccugccauccccccccgccguccugccuu

SEQ ID NO: 260298 - RNA, 64 nt, hsa
gagucugagaccuuugguuguucuuuaaggcaccuccugccacuuucucccucagaggcacaaa

SEQ ID NO: 260299 - RNA, 64 nt, hsa
auguagguaaaucuuuuuaaaagugaaauuaaccuccugccaauuuuacaacccaagaauuuuu

SEQ ID NO: 260300 - RNA, 64 nt, hsa
cacuccucugaggcuuuccuggggccuccucccauccugccaugagcaauuguuugcucuugaa

SEQ ID NO: 260301 - RNA, 64 nt, hsa
ugagaaaaaggaaaaaaaaacagccaccguuucuuccugccagcaggggugugauguaccaguu

SEQ ID NO: 260302 - RNA, 64 nt, hsa
gcugcugguguucuuauucuggcggcagcgccuuuccugccauguuuagugaaugacuuuucuc

SEQ ID NO: 260303 - RNA, 64 nt, hsa
gucacgggguucccuccuagcucucccagugaacuccugccaggcacacacagccccuauagca

SEQ ID NO: 260304 - RNA, 64 nt, hsa
cuaccuuccugucccugagguuaaacggugcccauccugccauccucaaacgacagaggagcuu

SEQ ID NO: 260305 - RNA, 64 nt, hsa
gcuuuugccccuugacagguaugggccagcaguuuccugccagauauugcccagcgugaggagc

SEQ ID NO: 260306 - RNA, 64 nt, hsa
uggugaaacuacaucuccaaugugcuuucuaaucuccugccagcucuucucaagcaggggaucc

SEQ ID NO: 260307 - RNA, 64 nt, hsa
ucuucuuccuucuuccugccacacucugcuuucuuccugccauggaccccuggaggagaccuau

SEQ ID NO: 260308 - RNA, 64 nt, hsa
uggagaccaagcggccuuugcucuucuuccuucuuccugccacacucugcuuucuuccugccau

SEQ ID NO: 260309 - RNA, 64 nt, hsa
acuccacaaaaacauuuaauuuauggauccugccuccugccacgugcuggguggaccuaagguu

SEQ ID NO: 260310 - RNA, 59 nt, hsa
cguccuggaggacugaguagcuuccgucguccugccagucgccaugccguugcgaggcc

SEQ ID NO: 260311 - RNA, 64 nt, hsa
cucuccgucuguucuguuuuucuccuagucccucuccugccaccucuccaagacuuccguggga

SEQ ID NO: 260312 - RNA, 64 nt, hsa
uaccuacauguacuauuuagcuucaguguacuaguccugccaccuguguauuuuuagggugcua

SEQ ID NO: 260313 - RNA, 64 nt, hsa
acccuauaagagggcucaagauugugaauucugcuccugccaugaggagcucagaaggccagga

SEQ ID NO: 260314 - RNA, 64 nt, hsa
cauugaagcugcaggaagcccugcccagggaugguccugccaugaggaggcugcaacccuauaa

SEQ ID NO: 260315 - RNA, 64 nt, hsa
cuguuagcaggagcuauguccccuuccuaugcuuuccugccacuuggaacugcccuccagacag

SEQ ID NO: 260316 - RNA, 64 nt, hsa
uucuuuacacacauuauggcuguaaauaccuggcuccugccagcagcugagcuggguagccucu

SEQ ID NO: 260317 - RNA, 64 nt, hsa
ccauauggaauaagggcucguccuaccuaaagcuuccugccaauaaugcaagaagccagcugca

SEQ ID NO: 260318 - RNA, 64 nt, hsa
cauccaccucauggaccaagauggcugccacagcuccugccaucacauuuacauuuaagauagu

SEQ ID NO: 260319 - RNA, 64 nt, hsa
ggugggcaccccaugggacucaguggcucacauuuccugccagcuacaccacaggcagauggga

SEQ ID NO: 260320 - RNA, 64 nt, hsa
agcccucacugcugacaggcaccccucugucaccuccugccaccugucagauacccagccugcc

SEQ ID NO: 260321 - RNA, 64 nt, hsa
acaagggaccaagggaaucagggacaaaggcccuuccugccagcccaugaucccgggauuggcu

SEQ ID NO: 260322 - RNA, 64 nt, hsa
acugugcuccuuuuuucccggccuacgaggcagcuccugccacuaucuuuagagccaauaaaga

SEQ ID NO: 260323 - RNA, 64 nt, hsa
uguguguuugugugucuauuuggcaauucacaaguccugccaagugguuucuaugagcaucucu

SEQ ID NO: 260324 - RNA, 64 nt, hsa
agaaaaaaauggugccuucuucugcguuugucccuccugccauguguaaguuguaaggauugcc

SEQ ID NO: 260325 - RNA, 64 nt, hsa
uccccaagacuugguguccuuucccuccacuccuuccugccaccugcugcugcugcugcugcua

SEQ ID NO: 260326 - RNA, 64 nt, hsa
acugacccugaucagucuaagauggguggggacguccugccaccuggggcagucaccugcccag

SEQ ID NO: 260327 - RNA, 64 nt, hsa
ucacacucauauuagcucauguuggaauuucccauccugccauguccuuucccauuucuuuuug

SEQ ID NO: 260328 - RNA, 64 nt, hsa
ucagagcaccucuggguggcaaagggaagcauguuccugccaagguuugcuguggauucagaag

SEQ ID NO: 260329 - RNA, 64 nt, hsa
ggagaauuugacauacccuggacuccugugugccuccugccaucccugcacacagccuggggag

SEQ ID NO: 260330 - RNA, 64 nt, hsa
gcagaaggaaaguacuggacuacccguggguaaguccugccauucaagacuggagacaccuggg

SEQ ID NO: 260331 - RNA, 64 nt, hsa
ggucccaggcagcuuuccucugaaaagcaaccucuccugccacccagaucccaucucaagagcu

SEQ ID NO: 260332 - RNA, 64 nt, hsa
ccugggaggugucccacugaagccccgcgccuccuccugccagcacccccagcaccugcuagca

SEQ ID NO: 260333 - RNA, 64 nt, hsa
cagcugcucaugggcagagcagcccuugggcaacuccugccaccacccccuccccagggagccc

SEQ ID NO: 260334 - RNA, 64 nt, hsa
gugcccccggcugggagaucagacccgguguugguccugccacccacgugcugugugagaggag

SEQ ID NO: 260335 - RNA, 64 nt, hsa
gauccgcuccugccugcgcccgcagcugaccuucuccugccacuagcccggcccugcccuuaac

SEQ ID NO: 260336 - RNA, 64 nt, hsa
cuacgucugagggcgcugggcacggccgggccccuccugccagccacgccugcgaggcguugga

SEQ ID NO: 260337 - RNA, 64 nt, hsa
cgacuguaacagaccaggaggguggcggaggaacuccugccacgccacugugucaugaaggaaa

SEQ ID NO: 260338 - RNA, 64 nt, hsa
uuuagaagcaguucuggucucaaaaccaucaggauccugccaccaggguucuuuugaaauagua

SEQ ID NO: 260339 - RNA, 64 nt, hsa
gugugugccaagcacugugcagaggguacacaguuccugccagguuaacacccucccuucaggc

SEQ ID NO: 260340 - RNA, 64 nt, hsa
gagcccuaugcacauuggcuugugggcuuguucuuccugccaaaugaucagagaggaacauucc

SEQ ID NO: 260341 - RNA, 64 nt, hsa
uuggggugccaggcagcgaggccccccaccccuauccugccauguacuucaagcucacuucuuc

SEQ ID NO: 260342 - RNA, 64 nt, hsa
gggcauacaauccaacccgcgcccucuccucucuuccugccaagguuuauagaaaccugagaau

SEQ ID NO: 260343 - RNA, 64 nt, hsa
gugguagaucaaggcuuuguuucauuugaaaaaaaagaaagaaagaaagaaagaaagaaauccu

SEQ ID NO: 260344 - RNA, 64 nt, hsa
uagaucaaggcuuuguuucauuugaaaaaaaagaaagaaagaaagaaagaaagaaauccuacua

SEQ ID NO: 260345 - RNA, 64 nt, hsa
ucaaggcuuuguuucauuugaaaaaaaagaaagaaagaaagaaagaaagaaauccuacuacgag

SEQ ID NO: 260346 - RNA, 64 nt, hsa
ggcuuuguuucauuugaaaaaaaagaaagaaagaaagaaagaaagaaauccuacuacgagcgau

SEQ ID NO: 260347 - RNA, 64 nt, hsa
uuguuucauuugaaaaaaaagaaagaaagaaagaaagaaagaaauccuacuacgagcgaucaca

SEQ ID NO: 260348 - RNA, 64 nt, hsa
gccuggguaacagagcaagacuccaucucaaaaaaagaaagaaagaaaaaagaaaguacaaguu

SEQ ID NO: 260349 - RNA, 64 nt, hsa
ggguaacagagcaagacuccaucucaaaaaaagaaagaaagaaaaaagaaaguacaaguuuaua

SEQ ID NO: 260350 - RNA, 64 nt, hsa
ucagauguguugggacaaaaugaaagugacuuucaagaaagaucagaggaauuugacucagaga

SEQ ID NO: 260351 - RNA, 57 nt, hsa
gcgcuguuccucagguguaauauuguuaagaaagaaaggggcaaggaaaguaagaag

SEQ ID NO: 260352 - RNA, 64 nt, hsa
acuuaauugcuuuccugccuccuugaaagaaagaaagaaagaagacuguguuuuugccacugau

SEQ ID NO: 260353 - RNA, 64 nt, hsa
gaccacuuaauugcuuuccugccuccuugaaagaaagaaagaaagaagacuguguuuuugccac

SEQ ID NO: 260354 - RNA, 64 nt, hsa
aggugaccacuuaauugcuuuccugccuccuugaaagaaagaaagaaagaagacuguguuuuug

SEQ ID NO: 260355 - RNA, 64 nt, hsa
ccacacaucggaagggcuggaugaccccaaucaaaagaaagaacaaggacucugguuacccuug

SEQ ID NO: 260356 - RNA, 64 nt, hsa
acuuaaagacaggagcuggcauuuaugacagacaaagaaagaagcccagguguccugguguucu

SEQ ID NO: 260357 - RNA, 64 nt, hsa
uagaaaguuuaacugaaauuaauaagccaauggaaagaaagaaauauuaauaacugcuggugga

SEQ ID NO: 260358 - RNA, 64 nt, hsa
uaaagaaaguuauauaacuacauagagauaaauuaagaaagaugccuaaauagaagcaaguuua

SEQ ID NO: 260359 - RNA, 64 nt, hsa
aaaguagcuggcgagguuaccuuaacuaucacugaagaaagaaauuuucugacacacugauggc

SEQ ID NO: 260360 - RNA, 64 nt, hsa
uacauagauaguacuagguauuaauagauauguaaagaaagaaaucacaccauuaauaauggua

SEQ ID NO: 260361 - RNA, 64 nt, hsa
auuccagcaucuuaccuucauaugcaguaaaagaaagaaagaaaaaaaaaggaaaaaaaaaaaa

SEQ ID NO: 260362 - RNA, 64 nt, hsa
cuacauuccagcaucuuaccuucauaugcaguaaaagaaagaaagaaaaaaaaaggaaaaaaaa

SEQ ID NO: 260363 - RNA, 64 nt, hsa
agagaaacuugagaaggcuugugcccaaagcuugaagaaagauuguaauagcauuuaguugugu

SEQ ID NO: 260364 - RNA, 64 nt, hsa
uagauuaguggauuguuagggauuucagcaguauaagaaagaaucaaauaucuugcuuuugggu

SEQ ID NO: 260365 - RNA, 64 nt, hsa
aagcacuucuuaacauuguagcagaaaauuccaaaagaaagacuagaacaaauugguaauuugg

SEQ ID NO: 260366 - RNA, 64 nt, hsa
aaagugacacaaagagaaugaagcagaaguagagaagaaagacuguaugugacaauuaccuggg

SEQ ID NO: 260367 - RNA, 64 nt, hsa
guaacaauaaagaaaaaaaaauacaaaggaagaaaagaaagaaaaacaaguguucagggcauaa

SEQ ID NO: 260368 - RNA, 64 nt, hsa
aauuccuguuguguaaggguaggcuuuguugaaaaagaaagaaagauugaacuacaggugcaua

SEQ ID NO: 260369 - RNA, 64 nt, hsa
ccuguuguguaaggguaggcuuuguugaaaaagaaagaaagauugaacuacaggugcauagcaa

SEQ ID NO: 260370 - RNA, 64 nt, hsa
gaaagaauguaaagcaaccaaaaagaaaaaaaaaaagaaagaaagaggaaaagaaauccauacu

SEQ ID NO: 260371 - RNA, 64 nt, hsa
gaauguaaagcaaccaaaaagaaaaaaaaaaagaaagaaagaggaaaagaaauccauacuaacc

SEQ ID NO: 260372 - RNA, 64 nt, hsa
gguuuauuucagcaaacuuguugaauuuauuuuuaagaaagaaauacuguauugggaaguuacu

SEQ ID NO: 260373 - RNA, 64 nt, hsa
aaagaccgagacuccgccucaaaaaaaaaaaaaaaagaaagaaagaaagaaagaaagaaaucua

SEQ ID NO: 260374 - RNA, 64 nt, hsa
accgagacuccgccucaaaaaaaaaaaaaaaagaaagaaagaaagaaagaaagaaaucuaccug

SEQ ID NO: 260375 - RNA, 64 nt, hsa
agacuccgccucaaaaaaaaaaaaaaaagaaagaaagaaagaaagaaagaaaucuaccugucaa

SEQ ID NO: 260376 - RNA, 64 nt, hsa
uccgccucaaaaaaaaaaaaaaaagaaagaaagaaagaaagaaagaaaucuaccugucaaggaa

SEQ ID NO: 260377 - RNA, 64 nt, hsa
ccucaaaaaaaaaaaaaaaagaaagaaagaaagaaagaaagaaaucuaccugucaaggaacuaa

SEQ ID NO: 260378 - RNA, 64 nt, hsa
uaucuauuacucuugagagcuggcuguccuuugaaagaaagaaguaauguucuuugaaagaaag

SEQ ID NO: 260379 - RNA, 64 nt, hsa
cuguccuuugaaagaaagaaguaauguucuuugaaagaaagaaaaaucucuugcugugucaaac

SEQ ID NO: 260380 - RNA, 64 nt, hsa
uaaauccaguucuacuauggcugaguucuggucaaagaaagaaaguuuagaagcugagacacaa

SEQ ID NO: 260381 - RNA, 64 nt, hsa
ucucaaacuaaaagacauuuguuauuuuggaaagaagaaagacucuauucucaaaguuuccuaa

SEQ ID NO: 260382 - RNA, 64 nt, hsa
augugcagccaaaucugagaggccccauuuaaaaaagaaagaacaugggugguacauugaggag

SEQ ID NO: 260383 - RNA, 64 nt, hsa
auaucuaugauaucgcauuaguccauguggggaaaagaaagaucagauuguuacugugucugug

SEQ ID NO: 260384 - RNA, 64 nt, hsa
uuccacccuuuaaaucuuaggaugacaaguuauaaagaaagaagaucuuugucugggaccccca

SEQ ID NO: 260385 - RNA, 64 nt, hsa
acugcaacuguagguaaacugaaaaaaaauaagaaagaaagaguuggaugaaaaugugaaagcc

SEQ ID NO: 260386 - RNA, 64 nt, hsa
ugguacugcaacuguagguaaacugaaaaaaaauaagaaagaaagaguuggaugaaaaugugaa

SEQ ID NO: 260387 - RNA, 64 nt, hsa
uuuaaacaugauucuaguuaaauguagaagagagaagaaagaggaaguguucacuuuuuuaaua

SEQ ID NO: 260388 - RNA, 64 nt, hsa
acuugaaucaauacucauugauuaaaauggaauaaagaaagagcagcugccacuuuuaaacaac

SEQ ID NO: 260389 - RNA, 64 nt, hsa
cucacggugggcggugggcaagaagccagcauggaagaaagaagggagaaaacuuuggugacug

SEQ ID NO: 260390 - RNA, 64 nt, hsa
gacuaaguggaaaaauauaaaacauaugaauauaaagaaagaaagagacaagucaaauguagua

SEQ ID NO: 260391 - RNA, 64 nt, hsa
aaguggaaaaauauaaaacauaugaauauaaagaaagaaagagacaagucaaauguaguaaaau

SEQ ID NO: 260392 - RNA, 64 nt, hsa
uuuuaagucuuaaaaauagcguguauacuugaauaagaaagacacuggguacuguuacugugau

SEQ ID NO: 260393 - RNA, 64 nt, hsa
ugaauggugguuaggagaaagacuuuggugguggaagaaagaaaagcauaaaacaaagacuacu

SEQ ID NO: 260394 - RNA, 64 nt, hsa
uaaaauguucuaagauaaaaaaacucgagcuacaaagaaagaaugaacuaauucuuuacaaaug

SEQ ID NO: 260395 - RNA, 64 nt, hsa
cauguaguccaaauuugucauuaaaaaaaaaucaaagaaagaaggccacguauguugggguaau

SEQ ID NO: 260396 - RNA, 64 nt, hsa
aagccgcuaugaccggcguugccucucacuuugaaagaaagacuccguaaucuuaaacagaugc

SEQ ID NO: 260397 - RNA, 64 nt, hsa
cuuauuguuuaguaaaauggcccuugguugugggaagaaagagaauuauuuuuaacugaacguu

SEQ ID NO: 260398 - RNA, 64 nt, hsa
uagaauggaugauuccaaaaaaaaaaaaaaaaagaagaaagagagaaagaaagaaacagaaaaa

SEQ ID NO: 260399 - RNA, 64 nt, hsa
uuccaaaaaaaaaaaaaaaaagaagaaagagagaaagaaagaaacagaaaaaccuaaaagaaag

SEQ ID NO: 260400 - RNA, 64 nt, hsa
auauuuuuuauugcucuuuaguaaagaaaggcacaagaaagaaaauauccagcucucuuguguu

SEQ ID NO: 260401 - RNA, 64 nt, hsa
cuuagcaauauauucaguggcacucuuauaucagaagaaagaaguuucuacuggcauucugauu

SEQ ID NO: 260402 - RNA, 64 nt, hsa
uaguaagaagucaccgacgguagcgucauaugagaagaaagaaauccccaccaccucaaccucu

SEQ ID NO: 260403 - RNA, 64 nt, hsa
ccuuuacuuagaauuguccaccuagucagagcccaagaaagaauuuucaguggaaaaaucaaua

SEQ ID NO: 260404 - RNA, 64 nt, hsa
cugcccucugcugccauaaucacacaaauuuaaaaagaaagaaaacagucuuccauagauuuuu

SEQ ID NO: 260405 - RNA, 64 nt, hsa
ucccuguugugauugaacaauacaaauaacaaacaagaaagacaaugcauuccauuagucugcu

SEQ ID NO: 260406 - RNA, 64 nt, hsa
acaaagauuauugacuauacaaccuaccagcugaaagaaagaucuucaucaacaucuguaucuu

SEQ ID NO: 260407 - RNA, 64 nt, hsa
gugacuagcaaaacuccaucucaaaaaaaaaaaaaagaaagaaagaaacugaaaagugaggugu

SEQ ID NO: 260408 - RNA, 64 nt, hsa
cuagcaaaacuccaucucaaaaaaaaaaaaaagaaagaaagaaacugaaaagugagguguggaa

SEQ ID NO: 260409 - RNA, 64 nt, hsa
ucgagcccuggcugugaaaagaaucucaacauagaagaaagaagaaacaauaaauauucugcag

SEQ ID NO: 260410 - RNA, 64 nt, hsa
agaaacaauaaauauucugcagauuaaugcagcaaagaaagaagguugguagugaaacacaaag

SEQ ID NO: 260411 - RNA, 64 nt, hsa
aauagaacuccaagccuuuucuccacuacuauacaagaaagaauucagcaagcugcuucuccaa

SEQ ID NO: 260412 - RNA, 64 nt, hsa
ucucuguagggacacuguguuaucaaccauuaagaagaaagaaccacaagccucccaaguauuu

SEQ ID NO: 260413 - RNA, 64 nt, hsa
cuuaauagcccauuucuguuaaccucuuaucacuaagaaagaaaggaaagaaggagaugaauag

SEQ ID NO: 260414 - RNA, 64 nt, hsa
cacuaagaaagaaaggaaagaaggagaugaauagaagaaagaaaauggaaagaaggaaaaaagg

SEQ ID NO: 260415 - RNA, 64 nt, hsa
aaagaaggaaaaaaggaggauagaaaaaggauggaagaaagaagcauugaaaacaaagacauuc

SEQ ID NO: 260416 - RNA, 64 nt, hsa
guuaaauuggccugcuccagagacuggcucaaaaaagaaagaagcaacgaaaacaaaaugcaca

SEQ ID NO: 260417 - RNA, 64 nt, hsa
cuggaccauccugucuuauggugaaaaaguaaagaagaaagauaacauuaguguauuucuccug

SEQ ID NO: 260418 - RNA, 64 nt, hsa
aaaacagacuauguacauaaucuguauaugggaaaagaaagagcgaaauuaccuuacuuaagga

SEQ ID NO: 260419 - RNA, 64 nt, hsa
ugccuauuaaggauguaagacauuacagccuuagaagaaagauugugaaaagcuggggagaaaa

SEQ ID NO: 260420 - RNA, 64 nt, hsa
acaagacaucagcuauauacucugcuuggugcauaagaaagagaaaagagaugccuuuuguguu

SEQ ID NO: 260421 - RNA, 64 nt, hsa
cagggaguucauuuggccacacuggaagaaaggcaagaaagaggaagacaagucuuggaguacc

SEQ ID NO: 260422 - RNA, 64 nt, hsa
uucuuuguugauuuuuuaagauagaaagauuaaaaagaaagaaagaugggaagaaaaugaaugu

SEQ ID NO: 260423 - RNA, 64 nt, hsa
uuguugauuuuuuaagauagaaagauuaaaaagaaagaaagaugggaagaaaaugaaugucagu

SEQ ID NO: 260424 - RNA, 64 nt, hsa
gaaaggccacuuaaggaucugcucuaugaaggagaagaaagaggaaaaagaaguaaaggaguua

SEQ ID NO: 260425 - RNA, 64 nt, hsa
augccuguacacagaauucuaucgugaugcagagaagaaagaacggagugaagccauuuaugcc

SEQ ID NO: 260426 - RNA, 64 nt, hsa
gcuguaguaucaguuuuugaaccacaguaaugggaagaaagacaaauggauucccuuagaagua

SEQ ID NO: 260427 - RNA, 64 nt, hsa
ucguaaaaaaauagaaaaaaagaaaaaaaaaagaaagaaagagggaaaaagagcuggugguuug

SEQ ID NO: 260428 - RNA, 64 nt, hsa
aggaucguaaaaaaauagaaaaaaagaaaaaaaaaagaaagaaagagggaaaaagagcuggugg

SEQ ID NO: 260429 - RNA, 64 nt, hsa
gggcaacgggcgagacucugucucaaaaaaaagaaagaaagaaaagguacauguauauauuugu

SEQ ID NO: 260430 - RNA, 64 nt, hsa
gccugggcaacgggcgagacucugucucaaaaaaaagaaagaaagaaaagguacauguauauau

SEQ ID NO: 260431 - RNA, 64 nt, hsa
cucuguuguacugauguguugugacuaaauaaaaaagaaagaacaaaguauucugugguguaug

SEQ ID NO: 260432 - RNA, 64 nt, hsa
aaagcguugacaaaucagaugaucagcuuuauccaagaaagaagacuaguaaauugucugccuc

SEQ ID NO: 260433 - RNA, 64 nt, hsa
ugucaauuuguuguuauaggucuuaccugugugaaagaaagaaaaagaaagaaagaaagaaaga

SEQ ID NO: 260434 - RNA, 64 nt, hsa
uuguuauaggucuuaccugugugaaagaaagaaaaagaaagaaagaaagaaagagaaaggaaau

SEQ ID NO: 260435 - RNA, 64 nt, hsa
uauaggucuuaccugugugaaagaaagaaaaagaaagaaagaaagaaagagaaaggaaauuaua

SEQ ID NO: 260436 - RNA, 64 nt, hsa
ggucuuaccugugugaaagaaagaaaaagaaagaaagaaagaaagagaaaggaaauuauaaggu

SEQ ID NO: 260437 - RNA, 64 nt, hsa
uuaccugugugaaagaaagaaaaagaaagaaagaaagaaagagaaaggaaauuauaaggucaag

SEQ ID NO: 260438 - RNA, 64 nt, hsa
acucaaauauuuugccucauuauucuuguuuuaaaagaaagaaaacaggccgggcacaguggcu

SEQ ID NO: 260439 - RNA, 64 nt, hsa
ccagccugggugacagagggagacucugucucgaaagaaagaaagaaaaaaaggaaggaaggag

SEQ ID NO: 260440 - RNA, 64 nt, hsa
ccugggugacagagggagacucugucucgaaagaaagaaagaaaaaaaggaaggaaggagaagg

SEQ ID NO: 260441 - RNA, 64 nt, hsa
guaacucuaaaagauccuuuuuaaauucaguccuaagaaagaggagugcuuguccccuaagagu

SEQ ID NO: 260442 - RNA, 64 nt, hsa
gaaucuaugccaaagaucacuuguuguuuuacuaaagaaagauuacuuagaggaaauaagaaaa

SEQ ID NO: 260443 - RNA, 64 nt, hsa
agccaugacaaaccaaagagugcccaggucagccaagaaagauacauaaucucaugggacuuca

SEQ ID NO: 260444 - RNA, 64 nt, hsa
gagcgagacucugucuccccccgcaaaaaaaaaaaagaaagaaagaaagagaaaagaaaagaaa

SEQ ID NO: 260445 - RNA, 64 nt, hsa
gagacucugucuccccccgcaaaaaaaaaaaagaaagaaagaaagagaaaagaaaagaaaagca

SEQ ID NO: 260446 - RNA, 64 nt, hsa
cucugucuccccccgcaaaaaaaaaaaagaaagaaagaaagagaaaagaaaagaaaagcaacca

SEQ ID NO: 260447 - RNA, 64 nt, hsa
augaugauauucagacgaagcauugauguuauggaagaaagaaagaaacaaacaaaauauauau

SEQ ID NO: 260448 - RNA, 64 nt, hsa
ugauauucagacgaagcauugauguuauggaagaaagaaagaaacaaacaaaauauauauauau

SEQ ID NO: 260449 - RNA, 64 nt, hsa
uucacccaggcaggccauuuucuuuugugauuauaagaaagaguaguuguugauuaaauuuuca

SEQ ID NO: 260450 - RNA, 64 nt, hsa
gauuuuuuaguacaggcccaagagccuguucucuaagaaagaaauuguugccauguuuugauuu

SEQ ID NO: 260451 - RNA, 64 nt, hsa
acaagauaaagaaauaaaagugauccagaucauaaagaaagaaguaaaacuauaucugcacaug

SEQ ID NO: 260452 - RNA, 64 nt, hsa
guugucucaaauccuguccacaaggcaacuccagaagaaagaagcccuuuacauuuccauaaaa

SEQ ID NO: 260453 - RNA, 64 nt, hsa
agcccugauuuggaccagaaucucagaugcucagaagaaagauccuguuuagugaugacccagc

SEQ ID NO: 260454 - RNA, 64 nt, hsa
gcaaaacuuugccucaaaacaaauuuuaaaaagaaagaaagaaggaaagaggguauguuuuuca

SEQ ID NO: 260455 - RNA, 64 nt, hsa
cggagcaaaacuuugccucaaaacaaauuuuaaaaagaaagaaagaaggaaagaggguauguuu

SEQ ID NO: 260456 - RNA, 64 nt, hsa
ucucagucuuaggggacauggcagagaugaaagaaagaaagaguggguuucagaagugucaggg

SEQ ID NO: 260457 - RNA, 64 nt, hsa
ugccucucagucuuaggggacauggcagagaugaaagaaagaaagaguggguuucagaaguguc

SEQ ID NO: 260458 - RNA, 64 nt, hsa
agagcaagacuccaucucaaaaauaaaauaaaaaaagaaagaaagaaaagaagaagaaaagaga

SEQ ID NO: 260459 - RNA, 64 nt, hsa
caagacuccaucucaaaaauaaaauaaaaaaagaaagaaagaaaagaagaagaaaagagaagaa

SEQ ID NO: 260460 - RNA, 64 nt, hsa
ggcagcagagagcuuuuugcacuuuaaaaaaaaaaagaaagaaagaaaggucggaauuucuuuu

SEQ ID NO: 260461 - RNA, 64 nt, hsa
gcagagagcuuuuugcacuuuaaaaaaaaaaagaaagaaagaaaggucggaauuucuuuugggu

SEQ ID NO: 260462 - RNA, 64 nt, hsa
ugaaauaauuuuccgaauaauucagguggaaaacaagaaagauuguauuucucugcuuucauuu

SEQ ID NO: 260463 - RNA, 64 nt, hsa
uauuuguaaaucauguggcaucuauguauaauaaaagaaagagacaacuauauuacucaauuuc

SEQ ID NO: 260464 - RNA, 64 nt, hsa
auguuucucaagcaaccugcaucuuuuaugagagaagaaagagugagagaagaauugccucugg

SEQ ID NO: 260465 - RNA, 64 nt, hsa
ggcauuucagucugacguggauaaagaagaagauaagaaagagcgucaaaagcaguaccugaga

SEQ ID NO: 260466 - RNA, 64 nt, hsa
caacacuuguguugcuuucugacugauccugaacaagaaagaguaacacugaggcgcucgcucc

SEQ ID NO: 260467 - RNA, 64 nt, hsa
uccagggacuguaccuguaggaaacagaaaagagaagaaagaagcacucugcuggcgggaauac

SEQ ID NO: 260468 - RNA, 64 nt, hsa
caucuuuuuucuucccucauuuucugggauucucaagaaagaaaaaguaacccauuaucacucu

SEQ ID NO: 260469 - RNA, 64 nt, hsa
acuaaagagcacuuuauuucuuugaagccuuucuaagaaagaaaugggggugcgaguggcuuga

SEQ ID NO: 260470 - RNA, 56 nt, hsa
aggaagaaaacaaggacuaagcaaaaaagaaagacccccccccccuuagcaacucc

SEQ ID NO: 260471 - RNA, 64 nt, hsa
aaaagagaaaaaaauaaaaaucaaaaaaaaaaaaaagaaagaaagaaaccuccagcguauuuua

SEQ ID NO: 260472 - RNA, 64 nt, hsa
gagaaaaaaauaaaaaucaaaaaaaaaaaaaagaaagaaagaaaccuccagcguauuuuaucac

SEQ ID NO: 260473 - RNA, 64 nt, hsa
acauagcaagacccugucuuaaaagaaaaaugggaagaaagacaagguaacaugaagaaagaag

SEQ ID NO: 260474 - RNA, 64 nt, hsa
aaaagaaaaaugggaagaaagacaagguaacaugaagaaagaagagauaccuaguaugauggag

SEQ ID NO: 260475 - RNA, 64 nt, hsa
aaccucugucucaaaaaaaaaaaaagaaaaaagaaagaaagaaaaaaggcagaagcccuggauu

SEQ ID NO: 260476 - RNA, 64 nt, hsa
agcgaaccucugucucaaaaaaaaaaaaagaaaaaagaaagaaagaaaaaaggcagaagcccug

SEQ ID NO: 260477 - RNA, 64 nt, hsa
ggguucuuacccaaagagucaaaaacuauuucuuaagaaagagcagaguuauucaugacuguuc

SEQ ID NO: 260478 - RNA, 64 nt, hsa
uuugcaaagcacucagcucaauuaucuucuuagaaagaaagaaaaaguaugaauggucaaaaug

SEQ ID NO: 260479 - RNA, 64 nt, hsa
uuauggaggagguugugauggugguaagccuucaaagaaagaaaggccuuucaagaaucaaacu

SEQ ID NO: 260480 - RNA, 64 nt, hsa
ccucaggaaaagacuaguauuugggcaauauuugaagaaagaauuuaacaggcacugaugggga

SEQ ID NO: 260481 - RNA, 64 nt, hsa
uagccucagaugauuuccccccuccgccuccaggaagaaagaauguuacugccuuaauaaaaaa

SEQ ID NO: 260482 - RNA, 64 nt, hsa
uugauuuauuugcuucuucgaaaaucuagaggaaaagaaagaaguuauuuuccagguacccuuc

SEQ ID NO: 260483 - RNA, 64 nt, hsa
uucuuuucuuuuguugauuuucuuguucccguagaagaaagaagaaagguguuuggagaauucg

SEQ ID NO: 260484 - RNA, 64 nt, hsa
uacuuuucgagagaagggaauagggaagacagcaaagaaagauucagauuucuaacccugcaac

SEQ ID NO: 260485 - RNA, 64 nt, hsa
caauaucuaauaccacagugggaaaaggaaagggaagaaagacuuuauucucucucuuauugua

SEQ ID NO: 260486 - RNA, 64 nt, hsa
ugggggggugggggaggguguuguuggggcugagaagaaagagauuuauaugcuguauauaaau

SEQ ID NO: 260487 - RNA, 64 nt, hsa
guauaugcaguauugagcacuguaggcaagagggaagaaagagaaggagccaucuccaucuuga

SEQ ID NO: 260488 - RNA, 64 nt, hsa
uacauucuaaaauauaaucaaccaguagaaauuuaagaaagaagauguaaaaaaaaaaaauauu

SEQ ID NO: 260489 - RNA, 64 nt, hsa
ucagguaaaaggugaucccucuaagaaagaaaugaagaaagaaaaugaugaaaagaguaguuca

SEQ ID NO: 260490 - RNA, 64 nt, hsa
gguucgaaccuuucagguaaaaggugaucccucuaagaaagaaaugaagaaagaaaaugaugaa

SEQ ID NO: 260491 - RNA, 64 nt, hsa
uugggaagcagauuaaguagcagaaaguccaggaaagaaagaccagaaggaguaaugagacaag

SEQ ID NO: 260492 - RNA, 64 nt, hsa
aucugggcuucuuguggaggggaagguagagugaaagaaagagggcccacuuucuaacagggug

SEQ ID NO: 260493 - RNA, 64 nt, hsa
gccacaagggacugaggcaagcacaaugguuucaaagaaagacuguaagcuccaugauuagcau

SEQ ID NO: 260494 - RNA, 64 nt, hsa
cuugggaaacugagguguuauuuucaaugaaacaaagaaagagauguuaagcaagugguuguuu

SEQ ID NO: 260495 - RNA, 64 nt, hsa
gagaaauuugaaaggggguggguauggggggggcaagaaagagggagggaaaucuuucaacuua

SEQ ID NO: 260496 - RNA, 64 nt, hsa
gcgaagauggccgagaugauccuaaaaauaaccgaagaaagagaggaccaaccagaauucccuu

SEQ ID NO: 260497 - RNA, 64 nt, hsa
uuuccuccugccuuugcuuguucacugcagucuuaagaaagagguaaaaggcaagcaaaggaga

SEQ ID NO: 260498 - RNA, 64 nt, hsa
cagagcgagacuccgucucaaaaaaaaaaaaagaaagaaagaaaaggaaacccaagagcugccu

SEQ ID NO: 260499 - RNA, 64 nt, hsa
gcaacagagcgagacuccgucucaaaaaaaaaaaaagaaagaaagaaaaggaaacccaagagcu

SEQ ID NO: 260500 - RNA, 64 nt, hsa
gaaagaaagaaagaaagagagagagagagaaagaaagaaagaaaggcugccuuugcaaaaaucc

SEQ ID NO: 260501 - RNA, 64 nt, hsa
uuuggaaagaaagaaagaaagagagagagagagaaagaaagaaagaaaggcugccuuugcaaaa

SEQ ID NO: 260502 - RNA, 64 nt, hsa
ccauaaugaggaaaaaguuauuuggaaagaaagaaagaaagagagagagagagaaagaaagaaa

SEQ ID NO: 260503 - RNA, 64 nt, hsa
agcaccauaaugaggaaaaaguuauuuggaaagaaagaaagaaagagagagagagagaaagaaa

SEQ ID NO: 260504 - RNA, 64 nt, hsa
cuaaagcaccauaaugaggaaaaaguuauuuggaaagaaagaaagaaagagagagagagagaaa

SEQ ID NO: 260505 - RNA, 64 nt, hsa
aaugggagauuguuuucaggaauucagggaugaaaagaaagaauaauuuccauuaaguagaauu

SEQ ID NO: 260506 - RNA, 64 nt, hsa
cccuugguuucugaugauuuauaaguaacuacaaaagaaagagaccuguucuugaacagauacu

SEQ ID NO: 260507 - RNA, 64 nt, hsa
uucucucucucaaaaaaaaaaaaaaaaaaaaggaaagaaagaaagaaaagaaaagaaaauccuu

SEQ ID NO: 260508 - RNA, 64 nt, hsa
cucucucaaaaaaaaaaaaaaaaaaaaggaaagaaagaaagaaaagaaaagaaaauccuuuuug

SEQ ID NO: 260509 - RNA, 64 nt, hsa
uccagccugcgggacagagugagacccugucugaaagaaagagagaaagaaagaaagaaagaga

SEQ ID NO: 260510 - RNA, 64 nt, hsa
gacagagugagacccugucugaaagaaagagagaaagaaagaaagaaagagagagaaagaaaga

SEQ ID NO: 260511 - RNA, 64 nt, hsa
gagugagacccugucugaaagaaagagagaaagaaagaaagaaagagagagaaagaaagaaaga

SEQ ID NO: 260512 - RNA, 64 nt, hsa
gagacccugucugaaagaaagagagaaagaaagaaagaaagagagagaaagaaagaaagaaaga

SEQ ID NO: 260513 - RNA, 64 nt, hsa
aagaaagagagaaagaaagaaagaaagagagagaaagaaagaaagaaagaaagggaaagaugga

SEQ ID NO: 260514 - RNA, 64 nt, hsa
aagagagaaagaaagaaagaaagagagagaaagaaagaaagaaagaaagggaaagauggaagga

SEQ ID NO: 260515 - RNA, 64 nt, hsa
gagaaagaaagaaagaaagagagagaaagaaagaaagaaagaaagggaaagauggaaggaagga

SEQ ID NO: 260516 - RNA, 64 nt, hsa
gaaagaaagggaaagauggaaggaaggaaggaaaaagaaagagaaagagagagagagagaaaga

SEQ ID NO: 260517 - RNA, 64 nt, hsa
aaaagaaagagaaagagagagagagagaaagaaaaagaaagaaaaguaagaaagaaaaaagaaa

SEQ ID NO: 260518 - RNA, 64 nt, hsa
agagagagagagagaaagaaaaagaaagaaaaguaagaaagaaaaaagaaaaagaaagaaaagu

SEQ ID NO: 260519 - RNA, 64 nt, hsa
gaaaaagaaagaaaaguaagaaagaaaaaagaaaaagaaagaaaaguaagaaagaaaaaaagaa

SEQ ID NO: 260520 - RNA, 64 nt, hsa
caucauaaaugcaacuuuuuuugaagagauggauaagaaagaucaaguguaucugaacucucag

SEQ ID NO: 260521 - RNA, 64 nt, hsa
aaacucaagcgauuacagacaauugcucugaagaaagaaagacauucaacuugaacguccaaau

SEQ ID NO: 260522 - RNA, 64 nt, hsa
auugaaacucaagcgauuacagacaauugcucugaagaaagaaagacauucaacuugaacgucc

SEQ ID NO: 260523 - RNA, 64 nt, hsa
uggucauauccaacccucauucaguauuucuaucaagaaagagaugcuacaaaaaaaaaaagaa

SEQ ID NO: 260524 - RNA, 64 nt, hsa
aacuacaauagaauacuguuaccaaauucuuccuaagaaagaucguauuaaguuaacgauaauc

SEQ ID NO: 260525 - RNA, 64 nt, hsa
uuuuccgagaaaaaaagaaaauuccccacuuggaaagaaagaggaggaacacuggauucuuacu

SEQ ID NO: 260526 - RNA, 64 nt, hsa
guggggggcccuaauggagagguguggguuuggcaagaaagaagcaacacagaugucgucccca

SEQ ID NO: 260527 - RNA, 64 nt, hsa
auggagccgccacacccagccaaugugccgaagaaagaaagaaaaacaugcucauccuuugagu

SEQ ID NO: 260528 - RNA, 64 nt, hsa
aggcauggagccgccacacccagccaaugugccgaagaaagaaagaaaaacaugcucauccuuu

SEQ ID NO: 260529 - RNA, 64 nt, hsa
agcagcagagcgggaccucgucucuaagaauagaaagaaagaaagagaaacgguguccuccgca

SEQ ID NO: 260530 - RNA, 64 nt, hsa
gcagagcgggaccucgucucuaagaauagaaagaaagaaagagaaacgguguccuccgcacagc

SEQ ID NO: 260531 - RNA, 64 nt, hsa
aauuuugcuucucuuucuaaaaaaaaaaaaaaaaaagaaagagaagaaagaagugauuccuacc

SEQ ID NO: 260532 - RNA, 64 nt, hsa
ucucuuucuaaaaaaaaaaaaaaaaaagaaagagaagaaagaagugauuccuacccccuaccuc

SEQ ID NO: 260533 - RNA, 64 nt, hsa
uaaaauuguauguuaaugcuggaaagaaaaaaagaagaaagaaagaaaccaucccuguccuuca

SEQ ID NO: 260534 - RNA, 64 nt, hsa
auuguauguuaaugcuggaaagaaaaaaagaagaaagaaagaaaccaucccuguccuucaguuu

SEQ ID NO: 260535 - RNA, 64 nt, hsa
ugaguucucaacugagugagcaucauggagggagaagaaagaaagaaguucagccugggugugu

SEQ ID NO: 260536 - RNA, 64 nt, hsa
uucucaacugagugagcaucauggagggagaagaaagaaagaaguucagccugggugugugaag

SEQ ID NO: 260537 - RNA, 64 nt, hsa
cugcgaguaguuccacacagguuuguaaguaaguaagaaagaaggcaaauugauucaaauguua

SEQ ID NO: 260538 - RNA, 64 nt, hsa
auuuuggguuguuuaaaaauuuauaacaguuauaaagaaagauuguaaacuaaagugugcuuua

SEQ ID NO: 260539 - RNA, 64 nt, hsa
gaaacugaauccauguaagaaaaaauaauuguugaagaaagaaguugauagaauucaaaaaggc

SEQ ID NO: 260540 - RNA, 64 nt, hsa
cccaggguuuuuaucuagaaaguuauucaagugaaagaaagagaagggaauugcuuaguaggag

SEQ ID NO: 260541 - RNA, 64 nt, hsa
ugguugcauguaaaauuccuuccagccagaaagaaagaaagacaaggaguaagggggauuuaga

SEQ ID NO: 260542 - RNA, 64 nt, hsa
uaacugguugcauguaaaauuccuuccagccagaaagaaagaaagacaaggaguaagggggauu

SEQ ID NO: 260543 - RNA, 64 nt, hsa; identical to SEQ ID NO: 142269

SEQ ID NO: 260544 - RNA, 64 nt, hsa; identical to SEQ ID NO: 142270

SEQ ID NO: 260545 - RNA, 64 nt, hsa; identical to SEQ ID NO: 142271

SEQ ID NO: 260546 - RNA, 64 nt, hsa; identical to SEQ ID NO: 142272

SEQ ID NO: 260547 - RNA, 64 nt, hsa; identical to SEQ ID NO: 142273

SEQ ID NO: 260548 - RNA, 64 nt, hsa; identical to SEQ ID NO: 142274

SEQ ID NO: 260549 - RNA, 64 nt, hsa; identical to SEQ ID NO: 142275

SEQ ID NO: 260550 - RNA, 64 nt, hsa; identical to SEQ ID NO: 142276

SEQ ID NO: 260551 - RNA, 64 nt, hsa; identical to SEQ ID NO: 142277

SEQ ID NO: 260552 - RNA, 64 nt, hsa; identical to SEQ ID NO: 142278

SEQ ID NO: 260553 - RNA, 64 nt, hsa; identical to SEQ ID NO: 142279

SEQ ID NO: 260554 - RNA, 64 nt, hsa; identical to SEQ ID NO: 142280

SEQ ID NO: 260555 - RNA, 64 nt, hsa; identical to SEQ ID NO: 142281

SEQ ID NO: 260556 - RNA, 64 nt, hsa; identical to SEQ ID NO: 142282

SEQ ID NO: 260557 - RNA, 64 nt, hsa; identical to SEQ ID NO: 142283

SEQ ID NO: 260558 - RNA, 64 nt, hsa; identical to SEQ ID NO: 142284

SEQ ID NO: 260559 - RNA, 64 nt, hsa; identical to SEQ ID NO: 142285

SEQ ID NO: 260560 - RNA, 64 nt, hsa; identical to SEQ ID NO: 142286

SEQ ID NO: 260561 - RNA, 64 nt, hsa; identical to SEQ ID NO: 142287

SEQ ID NO: 260562 - RNA, 64 nt, hsa; identical to SEQ ID NO: 142288

SEQ ID NO: 260563 - RNA, 64 nt, hsa; identical to SEQ ID NO: 142289

SEQ ID NO: 260564 - RNA, 64 nt, hsa; identical to SEQ ID NO: 142290

SEQ ID NO: 260565 - RNA, 64 nt, hsa; identical to SEQ ID NO: 142291

SEQ ID NO: 260566 - RNA, 64 nt, hsa; identical to SEQ ID NO: 142292

SEQ ID NO: 260567 - RNA, 64 nt, hsa; identical to SEQ ID NO: 142293

SEQ ID NO: 260568 - RNA, 64 nt, hsa; identical to SEQ ID NO: 142294

SEQ ID NO: 260569 - RNA, 64 nt, hsa; identical to SEQ ID NO: 142295

SEQ ID NO: 260570 - RNA, 64 nt, hsa; identical to SEQ ID NO: 142296

SEQ ID NO: 260571 - RNA, 64 nt, hsa; identical to SEQ ID NO: 142297

SEQ ID NO: 260572 - RNA, 64 nt, hsa; identical to SEQ ID NO: 142298

SEQ ID NO: 260573 - RNA, 64 nt, hsa; identical to SEQ ID NO: 142299

SEQ ID NO: 260574 - RNA, 64 nt, hsa; identical to SEQ ID NO: 142300

SEQ ID NO: 260575 - RNA, 64 nt, hsa; identical to SEQ ID NO: 142301

SEQ ID NO: 260576 - RNA, 64 nt, hsa; identical to SEQ ID NO: 142302

SEQ ID NO: 260577 - RNA, 64 nt, hsa; identical to SEQ ID NO: 142303

SEQ ID NO: 260578 - RNA, 64 nt, hsa; identical to SEQ ID NO: 142304

SEQ ID NO: 260579 - RNA, 64 nt, hsa; identical to SEQ ID NO: 142305

SEQ ID NO: 260580 - RNA, 64 nt, hsa; identical to SEQ ID NO: 142306

SEQ ID NO: 260581 - RNA, 64 nt, hsa; identical to SEQ ID NO: 142307

SEQ ID NO: 260582 - RNA, 64 nt, hsa; identical to SEQ ID NO: 142308

SEQ ID NO: 260583 - RNA, 64 nt, hsa; identical to SEQ ID NO: 142309

SEQ ID NO: 260584 - RNA, 64 nt, hsa; identical to SEQ ID NO: 142310

SEQ ID NO: 260585 - RNA, 64 nt, hsa; identical to SEQ ID NO: 142311

SEQ ID NO: 260586 - RNA, 64 nt, hsa; identical to SEQ ID NO: 142312

SEQ ID NO: 260587 - RNA, 64 nt, hsa; identical to SEQ ID NO: 142313

SEQ ID NO: 260588 - RNA, 64 nt, hsa; identical to SEQ ID NO: 142314

SEQ ID NO: 260589 - RNA, 64 nt, hsa; identical to SEQ ID NO: 142315

SEQ ID NO: 260590 - RNA, 64 nt, hsa; identical to SEQ ID NO: 142316

SEQ ID NO: 260591 - RNA, 64 nt, hsa; identical to SEQ ID NO: 142317

SEQ ID NO: 260592 - RNA, 64 nt, hsa; identical to SEQ ID NO: 142318

SEQ ID NO: 260593 - RNA, 64 nt, hsa; identical to SEQ ID NO: 142319

SEQ ID NO: 260594 - RNA, 64 nt, hsa; identical to SEQ ID NO: 142320

SEQ ID NO: 260595 - RNA, 64 nt, hsa; identical to SEQ ID NO: 142321

SEQ ID NO: 260596 - RNA, 64 nt, hsa; identical to SEQ ID NO: 142322

SEQ ID NO: 260597 - RNA, 64 nt, hsa; identical to SEQ ID NO: 142323

SEQ ID NO: 260598 - RNA, 64 nt, hsa; identical to SEQ ID NO: 142324

SEQ ID NO: 260599 - RNA, 64 nt, hsa; identical to SEQ ID NO: 142325

SEQ ID NO: 260600 - RNA, 64 nt, hsa; identical to SEQ ID NO: 142326

SEQ ID NO: 260601 - RNA, 64 nt, hsa; identical to SEQ ID NO: 142327

SEQ ID NO: 260602 - RNA, 64 nt, hsa; identical to SEQ ID NO: 142328

SEQ ID NO: 260603 - RNA, 64 nt, hsa; identical to SEQ ID NO: 142329

SEQ ID NO: 260604 - RNA, 64 nt, hsa; identical to SEQ ID NO: 142330

SEQ ID NO: 260605 - RNA, 64 nt, hsa; identical to SEQ ID NO: 142331

SEQ ID NO: 260606 - RNA, 64 nt, hsa; identical to SEQ ID NO: 142332

SEQ ID NO: 260607 - RNA, 64 nt, hsa; identical to SEQ ID NO: 142333

SEQ ID NO: 260608 - RNA, 64 nt, hsa; identical to SEQ ID NO: 142334

SEQ ID NO: 260609 - RNA, 64 nt, hsa; identical to SEQ ID NO: 142335

SEQ ID NO: 260610 - RNA, 64 nt, hsa; identical to SEQ ID NO: 142336

SEQ ID NO: 260611 - RNA, 64 nt, hsa; identical to SEQ ID NO: 142337

SEQ ID NO: 260612 - RNA, 64 nt, hsa; identical to SEQ ID NO: 142338

SEQ ID NO: 260613 - RNA, 64 nt, hsa; identical to SEQ ID NO: 142339

SEQ ID NO: 260614 - RNA, 64 nt, hsa; identical to SEQ ID NO: 142340

SEQ ID NO: 260615 - RNA, 64 nt, hsa; identical to SEQ ID NO: 142341

SEQ ID NO: 260616 - RNA, 64 nt, hsa; identical to SEQ ID NO: 142342

SEQ ID NO: 260617 - RNA, 64 nt, hsa; identical to SEQ ID NO: 142343

SEQ ID NO: 260618 - RNA, 64 nt, hsa; identical to SEQ ID NO: 142344

SEQ ID NO: 260619 - RNA, 64 nt, hsa; identical to SEQ ID NO: 142345

SEQ ID NO: 260620 - RNA, 64 nt, hsa; identical to SEQ ID NO: 142346

SEQ ID NO: 260621 - RNA, 64 nt, hsa; identical to SEQ ID NO: 142347

SEQ ID NO: 260622 - RNA, 64 nt, hsa; identical to SEQ ID NO: 142348

SEQ ID NO: 260623 - RNA, 64 nt, hsa; identical to SEQ ID NO: 142349

SEQ ID NO: 260624 - RNA, 64 nt, hsa; identical to SEQ ID NO: 142350

SEQ ID NO: 260625 - RNA, 64 nt, hsa; identical to SEQ ID NO: 142351

SEQ ID NO: 260626 - RNA, 64 nt, hsa; identical to SEQ ID NO: 142352

SEQ ID NO: 260627 - RNA, 64 nt, hsa; identical to SEQ ID NO: 142353

SEQ ID NO: 260628 - RNA, 64 nt, hsa; identical to SEQ ID NO: 142354

SEQ ID NO: 260629 - RNA, 64 nt, hsa; identical to SEQ ID NO: 142355

SEQ ID NO: 260630 - RNA, 64 nt, hsa; identical to SEQ ID NO: 142356

SEQ ID NO: 260631 - RNA, 64 nt, hsa; identical to SEQ ID NO: 142357

SEQ ID NO: 260632 - RNA, 64 nt, hsa; identical to SEQ ID NO: 142358

SEQ ID NO: 260633 - RNA, 64 nt, hsa; identical to SEQ ID NO: 142359

SEQ ID NO: 260634 - RNA, 64 nt, hsa; identical to SEQ ID NO: 142360

SEQ ID NO: 260635 - RNA, 64 nt, hsa; identical to SEQ ID NO: 142361

SEQ ID NO: 260636 - RNA, 64 nt, hsa; identical to SEQ ID NO: 142362

SEQ ID NO: 260637 - RNA, 64 nt, hsa; identical to SEQ ID NO: 142363

SEQ ID NO: 260638 - RNA, 64 nt, hsa; identical to SEQ ID NO: 142364

SEQ ID NO: 260639 - RNA, 64 nt, hsa; identical to SEQ ID NO: 142365

SEQ ID NO: 260640 - RNA, 64 nt, hsa; identical to SEQ ID NO: 142366

SEQ ID NO: 260641 - RNA, 64 nt, hsa; identical to SEQ ID NO: 142367

SEQ ID NO: 260642 - RNA, 64 nt, hsa; identical to SEQ ID NO: 142368

SEQ ID NO: 260643 - RNA, 64 nt, hsa; identical to SEQ ID NO: 142369

SEQ ID NO: 260644 - RNA, 64 nt, hsa; identical to SEQ ID NO: 142370

SEQ ID NO: 260645 - RNA, 64 nt, hsa; identical to SEQ ID NO: 142371

SEQ ID NO: 260646 - RNA, 64 nt, hsa; identical to SEQ ID NO: 142372

SEQ ID NO: 260647 - RNA, 64 nt, hsa; identical to SEQ ID NO: 142373

SEQ ID NO: 260648 - RNA, 64 nt, hsa; identical to SEQ ID NO: 142374

SEQ ID NO: 260649 - RNA, 64 nt, hsa; identical to SEQ ID NO: 142375

SEQ ID NO: 260650 - RNA, 64 nt, hsa; identical to SEQ ID NO: 142376

SEQ ID NO: 260651 - RNA, 64 nt, hsa; identical to SEQ ID NO: 142377

SEQ ID NO: 260652 - RNA, 64 nt, hsa; identical to SEQ ID NO: 142378

SEQ ID NO: 260653 - RNA, 64 nt, hsa; identical to SEQ ID NO: 142379

SEQ ID NO: 260654 - RNA, 64 nt, hsa; identical to SEQ ID NO: 142380

SEQ ID NO: 260655 - RNA, 64 nt, hsa; identical to SEQ ID NO: 142381

SEQ ID NO: 260656 - RNA, 64 nt, hsa; identical to SEQ ID NO: 142382

SEQ ID NO: 260657 - RNA, 64 nt, hsa; identical to SEQ ID NO: 142383

SEQ ID NO: 260658 - RNA, 64 nt, hsa; identical to SEQ ID NO: 142384

SEQ ID NO: 260659 - RNA, 64 nt, hsa; identical to SEQ ID NO: 142385

SEQ ID NO: 260660 - RNA, 64 nt, hsa; identical to SEQ ID NO: 142386

SEQ ID NO: 260661 - RNA, 64 nt, hsa; identical to SEQ ID NO: 142387

SEQ ID NO: 260662 - RNA, 64 nt, hsa; identical to SEQ ID NO: 142388

SEQ ID NO: 260663 - RNA, 64 nt, hsa; identical to SEQ ID NO: 142389

SEQ ID NO: 260664 - RNA, 64 nt, hsa; identical to SEQ ID NO: 142390

SEQ ID NO: 260665 - RNA, 64 nt, hsa; identical to SEQ ID NO: 142391

SEQ ID NO: 260666 - RNA, 64 nt, hsa; identical to SEQ ID NO: 142392

SEQ ID NO: 260667 - RNA, 64 nt, hsa; identical to SEQ ID NO: 142393

SEQ ID NO: 260668 - RNA, 64 nt, hsa; identical to SEQ ID NO: 142394

SEQ ID NO: 260669 - RNA, 61 nt, hsa; identical to SEQ ID NO: 142395

SEQ ID NO: 260670 - RNA, 64 nt, hsa; identical to SEQ ID NO: 142396

SEQ ID NO: 260671 - RNA, 64 nt, hsa; identical to SEQ ID NO: 142397

SEQ ID NO: 260672 - RNA, 64 nt, hsa; identical to SEQ ID NO: 142398

SEQ ID NO: 260673 - RNA, 64 nt, hsa; identical to SEQ ID NO: 142399

SEQ ID NO: 260674 - RNA, 64 nt, hsa; identical to SEQ ID NO: 142400

SEQ ID NO: 260675 - RNA, 64 nt, hsa; identical to SEQ ID NO: 142401

SEQ ID NO: 260676 - RNA, 64 nt, hsa; identical to SEQ ID NO: 142402

SEQ ID NO: 260677 - RNA, 64 nt, hsa; identical to SEQ ID NO: 142403

SEQ ID NO: 260678 - RNA, 64 nt, hsa; identical to SEQ ID NO: 142404

SEQ ID NO: 260679 - RNA, 64 nt, hsa; identical to SEQ ID NO: 142405

SEQ ID NO: 260680 - RNA, 64 nt, hsa; identical to SEQ ID NO: 142406

SEQ ID NO: 260681 - RNA, 64 nt, hsa; identical to SEQ ID NO: 142407

SEQ ID NO: 260682 - RNA, 64 nt, hsa; identical to SEQ ID NO: 142408

SEQ ID NO: 260683 - RNA, 64 nt, hsa; identical to SEQ ID NO: 142409

SEQ ID NO: 260684 - RNA, 64 nt, hsa; identical to SEQ ID NO: 142410

SEQ ID NO: 260685 - RNA, 64 nt, hsa; identical to SEQ ID NO: 142411

SEQ ID NO: 260686 - RNA, 64 nt, hsa; identical to SEQ ID NO: 142412

SEQ ID NO: 260687 - RNA, 64 nt, hsa; identical to SEQ ID NO: 142413

SEQ ID NO: 260688 - RNA, 64 nt, hsa; identical to SEQ ID NO: 142414

SEQ ID NO: 260689 - RNA, 64 nt, hsa; identical to SEQ ID NO: 142415

SEQ ID NO: 260690 - RNA, 64 nt, hsa; identical to SEQ ID NO: 142416

SEQ ID NO: 260691 - RNA, 64 nt, hsa; identical to SEQ ID NO: 142417

SEQ ID NO: 260692 - RNA, 64 nt, hsa; identical to SEQ ID NO: 142418

SEQ ID NO: 260693 - RNA, 64 nt, hsa; identical to SEQ ID NO: 142419

SEQ ID NO: 260694 - RNA, 64 nt, hsa; identical to SEQ ID NO: 142420

SEQ ID NO: 260695 - RNA, 64 nt, hsa; identical to SEQ ID NO: 142421

SEQ ID NO: 260696 - RNA, 64 nt, hsa; identical to SEQ ID NO: 142422

SEQ ID NO: 260697 - RNA, 64 nt, hsa; identical to SEQ ID NO: 142423

SEQ ID NO: 260698 - RNA, 64 nt, hsa; identical to SEQ ID NO: 142424

SEQ ID NO: 260699 - RNA, 64 nt, hsa; identical to SEQ ID NO: 142425

SEQ ID NO: 260700 - RNA, 64 nt, hsa; identical to SEQ ID NO: 142426

SEQ ID NO: 260701 - RNA, 64 nt, hsa; identical to SEQ ID NO: 142427

SEQ ID NO: 260702 - RNA, 64 nt, hsa; identical to SEQ ID NO: 142428

SEQ ID NO: 260703 - RNA, 64 nt, hsa; identical to SEQ ID NO: 142429

SEQ ID NO: 260704 - RNA, 64 nt, hsa; identical to SEQ ID NO: 142430

SEQ ID NO: 260705 - RNA, 64 nt, hsa; identical to SEQ ID NO: 142431

SEQ ID NO: 260706 - RNA, 64 nt, hsa; identical to SEQ ID NO: 142432

SEQ ID NO: 260707 - RNA, 64 nt, hsa; identical to SEQ ID NO: 142433

SEQ ID NO: 260708 - RNA, 64 nt, hsa; identical to SEQ ID NO: 142434

SEQ ID NO: 260709 - RNA, 64 nt, hsa; identical to SEQ ID NO: 142435

SEQ ID NO: 260710 - RNA, 64 nt, hsa; identical to SEQ ID NO: 142436

SEQ ID NO: 260711 - RNA, 64 nt, hsa; identical to SEQ ID NO: 142437

SEQ ID NO: 260712 - RNA, 64 nt, hsa; identical to SEQ ID NO: 142438

SEQ ID NO: 260713 - RNA, 64 nt, hsa; identical to SEQ ID NO: 142439

SEQ ID NO: 260714 - RNA, 64 nt, hsa; identical to SEQ ID NO: 142440

SEQ ID NO: 260715 - RNA, 64 nt, hsa; identical to SEQ ID NO: 142441

SEQ ID NO: 260716 - RNA, 64 nt, hsa; identical to SEQ ID NO: 142442

SEQ ID NO: 260717 - RNA, 64 nt, hsa; identical to SEQ ID NO: 142443

SEQ ID NO: 260718 - RNA, 64 nt, hsa; identical to SEQ ID NO: 142444

SEQ ID NO: 260719 - RNA, 64 nt, hsa; identical to SEQ ID NO: 142445

SEQ ID NO: 260720 - RNA, 64 nt, hsa; identical to SEQ ID NO: 142446

SEQ ID NO: 260721 - RNA, 56 nt, hsa; identical to SEQ ID NO: 142447

SEQ ID NO: 260722 - RNA, 64 nt, hsa; identical to SEQ ID NO: 142448

SEQ ID NO: 260723 - RNA, 64 nt, hsa; identical to SEQ ID NO: 142449

SEQ ID NO: 260724 - RNA, 64 nt, hsa; identical to SEQ ID NO: 142450

SEQ ID NO: 260725 - RNA, 64 nt, hsa; identical to SEQ ID NO: 142451

SEQ ID NO: 260726 - RNA, 64 nt, hsa; identical to SEQ ID NO: 142452

SEQ ID NO: 260727 - RNA, 64 nt, hsa; identical to SEQ ID NO: 142453

SEQ ID NO: 260728 - RNA, 64 nt, hsa; identical to SEQ ID NO: 142454

SEQ ID NO: 260729 - RNA, 64 nt, hsa; identical to SEQ ID NO: 142455

SEQ ID NO: 260730 - RNA, 64 nt, hsa; identical to SEQ ID NO: 142456

SEQ ID NO: 260731 - RNA, 64 nt, hsa; identical to SEQ ID NO: 142457

SEQ ID NO: 260732 - RNA, 64 nt, hsa; identical to SEQ ID NO: 142458

SEQ ID NO: 260733 - RNA, 64 nt, hsa; identical to SEQ ID NO: 142459

SEQ ID NO: 260734 - RNA, 64 nt, hsa; identical to SEQ ID NO: 142460

SEQ ID NO: 260735 - RNA, 64 nt, hsa; identical to SEQ ID NO: 142461

SEQ ID NO: 260736 - RNA, 64 nt, hsa; identical to SEQ ID NO: 142462

SEQ ID NO: 260737 - RNA, 64 nt, hsa; identical to SEQ ID NO: 142463

SEQ ID NO: 260738 - RNA, 64 nt, hsa; identical to SEQ ID NO: 142464

SEQ ID NO: 260739 - RNA, 64 nt, hsa; identical to SEQ ID NO: 142465

SEQ ID NO: 260740 - RNA, 64 nt, hsa; identical to SEQ ID NO: 142466

SEQ ID NO: 260741 - RNA, 64 nt, hsa; identical to SEQ ID NO: 142467

SEQ ID NO: 260742 - RNA, 64 nt, hsa; identical to SEQ ID NO: 142468

SEQ ID NO: 260743 - RNA, 64 nt, hsa; identical to SEQ ID NO: 142469

SEQ ID NO: 260744 - RNA, 64 nt, hsa; identical to SEQ ID NO: 142470

SEQ ID NO: 260745 - RNA, 64 nt, hsa; identical to SEQ ID NO: 142471

SEQ ID NO: 260746 - RNA, 64 nt, hsa; identical to SEQ ID NO: 142472

SEQ ID NO: 260747 - RNA, 64 nt, hsa; identical to SEQ ID NO: 142473

SEQ ID NO: 260748 - RNA, 64 nt, hsa; identical to SEQ ID NO: 142474

SEQ ID NO: 260749 - RNA, 64 nt, hsa; identical to SEQ ID NO: 142475

SEQ ID NO: 260750 - RNA, 64 nt, hsa; identical to SEQ ID NO: 142476

SEQ ID NO: 260751 - RNA, 64 nt, hsa; identical to SEQ ID NO: 142477

SEQ ID NO: 260752 - RNA, 64 nt, hsa; identical to SEQ ID NO: 142478

SEQ ID NO: 260753 - RNA, 64 nt, hsa; identical to SEQ ID NO: 142479

SEQ ID NO: 260754 - RNA, 64 nt, hsa; identical to SEQ ID NO: 142480

SEQ ID NO: 260755 - RNA, 64 nt, hsa; identical to SEQ ID NO: 142481

SEQ ID NO: 260756 - RNA, 64 nt, hsa; identical to SEQ ID NO: 142482

SEQ ID NO: 260757 - RNA, 64 nt, hsa; identical to SEQ ID NO: 142483

SEQ ID NO: 260758 - RNA, 64 nt, hsa; identical to SEQ ID NO: 142484

SEQ ID NO: 260759 - RNA, 64 nt, hsa; identical to SEQ ID NO: 142485

SEQ ID NO: 260760 - RNA, 64 nt, hsa; identical to SEQ ID NO: 142486

SEQ ID NO: 260761 - RNA, 64 nt, hsa; identical to SEQ ID NO: 142487

SEQ ID NO: 260762 - RNA, 64 nt, hsa; identical to SEQ ID NO: 142488

SEQ ID NO: 260763 - RNA, 64 nt, hsa; identical to SEQ ID NO: 142489

SEQ ID NO: 260764 - RNA, 64 nt, hsa; identical to SEQ ID NO: 142490

SEQ ID NO: 260765 - RNA, 64 nt, hsa; identical to SEQ ID NO: 142491

SEQ ID NO: 260766 - RNA, 64 nt, hsa; identical to SEQ ID NO: 142492

SEQ ID NO: 260767 - RNA, 64 nt, hsa; identical to SEQ ID NO: 142493

SEQ ID NO: 260768 - RNA, 64 nt, hsa; identical to SEQ ID NO: 142494

SEQ ID NO: 260769 - RNA, 64 nt, hsa; identical to SEQ ID NO: 142495

SEQ ID NO: 260770 - RNA, 64 nt, hsa; identical to SEQ ID NO: 142496

SEQ ID NO: 260771 - RNA, 64 nt, hsa; identical to SEQ ID NO: 142497

SEQ ID NO: 260772 - RNA, 64 nt, hsa; identical to SEQ ID NO: 142498

SEQ ID NO: 260773 - RNA, 64 nt, hsa; identical to SEQ ID NO: 142499

SEQ ID NO: 260774 - RNA, 64 nt, hsa; identical to SEQ ID NO: 142500

SEQ ID NO: 260775 - RNA, 64 nt, hsa; identical to SEQ ID NO: 142501

SEQ ID NO: 260776 - RNA, 64 nt, hsa; identical to SEQ ID NO: 142502

SEQ ID NO: 260777 - RNA, 64 nt, hsa; identical to SEQ ID NO: 142503

SEQ ID NO: 260778 - RNA, 64 nt, hsa; identical to SEQ ID NO: 142504

SEQ ID NO: 260779 - RNA, 64 nt, hsa; identical to SEQ ID NO: 142505

SEQ ID NO: 260780 - RNA, 64 nt, hsa; identical to SEQ ID NO: 142506

SEQ ID NO: 260781 - RNA, 64 nt, hsa; identical to SEQ ID NO: 142507

SEQ ID NO: 260782 - RNA, 64 nt, hsa; identical to SEQ ID NO: 142508

SEQ ID NO: 260783 - RNA, 64 nt, hsa; identical to SEQ ID NO: 142509

SEQ ID NO: 260784 - RNA, 64 nt, hsa; identical to SEQ ID NO: 142510

SEQ ID NO: 260785 - RNA, 64 nt, hsa; identical to SEQ ID NO: 142511

SEQ ID NO: 260786 - RNA, 64 nt, hsa; identical to SEQ ID NO: 142512

SEQ ID NO: 260787 - RNA, 64 nt, hsa; identical to SEQ ID NO: 142513

SEQ ID NO: 260788 - RNA, 64 nt, hsa; identical to SEQ ID NO: 142514

SEQ ID NO: 260789 - RNA, 64 nt, hsa; identical to SEQ ID NO: 142515

SEQ ID NO: 260790 - RNA, 64 nt, hsa; identical to SEQ ID NO: 142516

SEQ ID NO: 260791 - RNA, 64 nt, hsa; identical to SEQ ID NO: 142517

SEQ ID NO: 260792 - RNA, 64 nt, hsa; identical to SEQ ID NO: 142518

SEQ ID NO: 260793 - RNA, 64 nt, hsa; identical to SEQ ID NO: 142519

SEQ ID NO: 260794 - RNA, 64 nt, hsa; identical to SEQ ID NO: 142520

SEQ ID NO: 260795 - RNA, 64 nt, hsa; identical to SEQ ID NO: 142521

SEQ ID NO: 260796 - RNA, 64 nt, hsa; identical to SEQ ID NO: 142522

SEQ ID NO: 260797 - RNA, 64 nt, hsa; identical to SEQ ID NO: 142523

SEQ ID NO: 260798 - RNA, 64 nt, hsa; identical to SEQ ID NO: 142524

SEQ ID NO: 260799 - RNA, 64 nt, hsa; identical to SEQ ID NO: 142525

SEQ ID NO: 260800 - RNA, 64 nt, hsa; identical to SEQ ID NO: 142526

SEQ ID NO: 260801 - RNA, 64 nt, hsa; identical to SEQ ID NO: 142527

SEQ ID NO: 260802 - RNA, 64 nt, hsa; identical to SEQ ID NO: 142528

SEQ ID NO: 260803 - RNA, 64 nt, hsa; identical to SEQ ID NO: 142529

SEQ ID NO: 260804 - RNA, 64 nt, hsa; identical to SEQ ID NO: 142530

SEQ ID NO: 260805 - RNA, 64 nt, hsa; identical to SEQ ID NO: 142531

SEQ ID NO: 260806 - RNA, 64 nt, hsa; identical to SEQ ID NO: 142532

SEQ ID NO: 260807 - RNA, 64 nt, hsa; identical to SEQ ID NO: 142533

SEQ ID NO: 260808 - RNA, 64 nt, hsa; identical to SEQ ID NO: 142534

SEQ ID NO: 260809 - RNA, 64 nt, hsa; identical to SEQ ID NO: 142535

SEQ ID NO: 260810 - RNA, 64 nt, hsa; identical to SEQ ID NO: 142536

SEQ ID NO: 260811 - RNA, 64 nt, hsa; identical to SEQ ID NO: 142537

SEQ ID NO: 260812 - RNA, 64 nt, hsa; identical to SEQ ID NO: 142538

SEQ ID NO: 260813 - RNA, 64 nt, hsa; identical to SEQ ID NO: 142539

SEQ ID NO: 260814 - RNA, 64 nt, hsa; identical to SEQ ID NO: 142540

SEQ ID NO: 260815 - RNA, 64 nt, hsa; identical to SEQ ID NO: 142541

SEQ ID NO: 260816 - RNA, 59 nt, hsa; identical to SEQ ID NO: 142542

SEQ ID NO: 260817 - RNA, 64 nt, hsa; identical to SEQ ID NO: 142543

SEQ ID NO: 260818 - RNA, 64 nt, hsa; identical to SEQ ID NO: 142544

SEQ ID NO: 260819 - RNA, 64 nt, hsa; identical to SEQ ID NO: 142545

SEQ ID NO: 260820 - RNA, 64 nt, hsa; identical to SEQ ID NO: 142546

SEQ ID NO: 260821 - RNA, 64 nt, hsa; identical to SEQ ID NO: 142547

SEQ ID NO: 260822 - RNA, 64 nt, hsa; identical to SEQ ID NO: 142548

SEQ ID NO: 260823 - RNA, 64 nt, hsa; identical to SEQ ID NO: 142549

SEQ ID NO: 260824 - RNA, 64 nt, hsa; identical to SEQ ID NO: 142550

SEQ ID NO: 260825 - RNA, 64 nt, hsa; identical to SEQ ID NO: 142551

SEQ ID NO: 260826 - RNA, 64 nt, hsa; identical to SEQ ID NO: 142552

SEQ ID NO: 260827 - RNA, 64 nt, hsa; identical to SEQ ID NO: 142553

SEQ ID NO: 260828 - RNA, 64 nt, hsa; identical to SEQ ID NO: 142554

SEQ ID NO: 260829 - RNA, 64 nt, hsa; identical to SEQ ID NO: 142555

SEQ ID NO: 260830 - RNA, 64 nt, hsa; identical to SEQ ID NO: 142556

SEQ ID NO: 260831 - RNA, 64 nt, hsa; identical to SEQ ID NO: 142557

SEQ ID NO: 260832 - RNA, 64 nt, hsa; identical to SEQ ID NO: 142558

SEQ ID NO: 260833 - RNA, 64 nt, hsa; identical to SEQ ID NO: 142559

SEQ ID NO: 260834 - RNA, 64 nt, hsa; identical to SEQ ID NO: 142560

SEQ ID NO: 260835 - RNA, 64 nt, hsa; identical to SEQ ID NO: 142561

SEQ ID NO: 260836 - RNA, 64 nt, hsa; identical to SEQ ID NO: 142562

SEQ ID NO: 260837 - RNA, 64 nt, hsa; identical to SEQ ID NO: 142563

SEQ ID NO: 260838 - RNA, 64 nt, hsa; identical to SEQ ID NO: 142564

SEQ ID NO: 260839 - RNA, 64 nt, hsa; identical to SEQ ID NO: 142565

SEQ ID NO: 260840 - RNA, 64 nt, hsa; identical to SEQ ID NO: 142566

SEQ ID NO: 260841 - RNA, 64 nt, hsa; identical to SEQ ID NO: 142567

SEQ ID NO: 260842 - RNA, 64 nt, hsa; identical to SEQ ID NO: 142568

SEQ ID NO: 260843 - RNA, 64 nt, hsa; identical to SEQ ID NO: 142569

SEQ ID NO: 260844 - RNA, 64 nt, hsa; identical to SEQ ID NO: 142570

SEQ ID NO: 260845 - RNA, 64 nt, hsa; identical to SEQ ID NO: 142571

SEQ ID NO: 260846 - RNA, 64 nt, hsa; identical to SEQ ID NO: 142572

SEQ ID NO: 260847 - RNA, 64 nt, hsa; identical to SEQ ID NO: 142573

SEQ ID NO: 260848 - RNA, 64 nt, hsa; identical to SEQ ID NO: 142574

SEQ ID NO: 260849 - RNA, 64 nt, hsa; identical to SEQ ID NO: 142575

SEQ ID NO: 260850 - RNA, 64 nt, hsa; identical to SEQ ID NO: 142576

SEQ ID NO: 260851 - RNA, 64 nt, hsa; identical to SEQ ID NO: 142577

SEQ ID NO: 260852 - RNA, 64 nt, hsa; identical to SEQ ID NO: 142578

SEQ ID NO: 260853 - RNA, 64 nt, hsa; identical to SEQ ID NO: 142579

SEQ ID NO: 260854 - RNA, 64 nt, hsa; identical to SEQ ID NO: 142580

SEQ ID NO: 260855 - RNA, 64 nt, hsa; identical to SEQ ID NO: 142581

SEQ ID NO: 260856 - RNA, 64 nt, hsa; identical to SEQ ID NO: 142582

SEQ ID NO: 260857 - RNA, 64 nt, hsa; identical to SEQ ID NO: 142583

SEQ ID NO: 260858 - RNA, 55 nt, hsa; identical to SEQ ID NO: 142584

SEQ ID NO: 260859 - RNA, 64 nt, hsa; identical to SEQ ID NO: 142585

SEQ ID NO: 260860 - RNA, 64 nt, hsa; identical to SEQ ID NO: 142586

SEQ ID NO: 260861 - RNA, 64 nt, hsa; identical to SEQ ID NO: 142587

SEQ ID NO: 260862 - RNA, 64 nt, hsa; identical to SEQ ID NO: 142588

SEQ ID NO: 260863 - RNA, 64 nt, hsa; identical to SEQ ID NO: 142589

SEQ ID NO: 260864 - RNA, 64 nt, hsa; identical to SEQ ID NO: 142590

SEQ ID NO: 260865 - RNA, 64 nt, hsa; identical to SEQ ID NO: 142591

SEQ ID NO: 260866 - RNA, 64 nt, hsa; identical to SEQ ID NO: 142592

SEQ ID NO: 260867 - RNA, 64 nt, hsa; identical to SEQ ID NO: 142593

SEQ ID NO: 260868 - RNA, 64 nt, hsa; identical to SEQ ID NO: 142594

SEQ ID NO: 260869 - RNA, 64 nt, hsa; identical to SEQ ID NO: 142595

SEQ ID NO: 260870 - RNA, 64 nt, hsa; identical to SEQ ID NO: 142596

SEQ ID NO: 260871 - RNA, 64 nt, hsa; identical to SEQ ID NO: 142597

SEQ ID NO: 260872 - RNA, 64 nt, hsa; identical to SEQ ID NO: 142598

SEQ ID NO: 260873 - RNA, 64 nt, hsa; identical to SEQ ID NO: 142599

SEQ ID NO: 260874 - RNA, 64 nt, hsa; identical to SEQ ID NO: 142600

SEQ ID NO: 260875 - RNA, 64 nt, hsa; identical to SEQ ID NO: 142601

SEQ ID NO: 260876 - RNA, 64 nt, hsa; identical to SEQ ID NO: 142602

SEQ ID NO: 260877 - RNA, 64 nt, hsa; identical to SEQ ID NO: 142603

SEQ ID NO: 260878 - RNA, 64 nt, hsa; identical to SEQ ID NO: 142604

SEQ ID NO: 260879 - RNA, 64 nt, hsa; identical to SEQ ID NO: 142605

SEQ ID NO: 260880 - RNA, 64 nt, hsa; identical to SEQ ID NO: 142606

SEQ ID NO: 260881 - RNA, 64 nt, hsa; identical to SEQ ID NO: 142607

SEQ ID NO: 260882 - RNA, 64 nt, hsa; identical to SEQ ID NO: 142608

SEQ ID NO: 260883 - RNA, 64 nt, hsa; identical to SEQ ID NO: 142609

SEQ ID NO: 260884 - RNA, 64 nt, hsa; identical to SEQ ID NO: 142610

SEQ ID NO: 260885 - RNA, 64 nt, hsa; identical to SEQ ID NO: 142611

SEQ ID NO: 260886 - RNA, 64 nt, hsa; identical to SEQ ID NO: 142612

SEQ ID NO: 260887 - RNA, 64 nt, hsa; identical to SEQ ID NO: 142613

SEQ ID NO: 260888 - RNA, 64 nt, hsa; identical to SEQ ID NO: 142614

SEQ ID NO: 260889 - RNA, 64 nt, hsa; identical to SEQ ID NO: 142615

SEQ ID NO: 260890 - RNA, 64 nt, hsa; identical to SEQ ID NO: 142616

SEQ ID NO: 260891 - RNA, 64 nt, hsa; identical to SEQ ID NO: 142617

SEQ ID NO: 260892 - RNA, 64 nt, hsa; identical to SEQ ID NO: 142618

SEQ ID NO: 260893 - RNA, 64 nt, hsa; identical to SEQ ID NO: 142619

SEQ ID NO: 260894 - RNA, 64 nt, hsa; identical to SEQ ID NO: 142620

SEQ ID NO: 260895 - RNA, 64 nt, hsa; identical to SEQ ID NO: 142621

SEQ ID NO: 260896 - RNA, 64 nt, hsa; identical to SEQ ID NO: 142622

SEQ ID NO: 260897 - RNA, 64 nt, hsa; identical to SEQ ID NO: 142623

SEQ ID NO: 260898 - RNA, 64 nt, hsa; identical to SEQ ID NO: 142624

SEQ ID NO: 260899 - RNA, 64 nt, hsa; identical to SEQ ID NO: 142625

SEQ ID NO: 260900 - RNA, 64 nt, hsa; identical to SEQ ID NO: 142626

SEQ ID NO: 260901 - RNA, 64 nt, hsa; identical to SEQ ID NO: 142627

SEQ ID NO: 260902 - RNA, 64 nt, hsa; identical to SEQ ID NO: 142628

SEQ ID NO: 260903 - RNA, 64 nt, hsa; identical to SEQ ID NO: 142629

SEQ ID NO: 260904 - RNA, 64 nt, hsa; identical to SEQ ID NO: 142630

SEQ ID NO: 260905 - RNA, 64 nt, hsa; identical to SEQ ID NO: 142631

SEQ ID NO: 260906 - RNA, 64 nt, hsa; identical to SEQ ID NO: 142632

SEQ ID NO: 260907 - RNA, 64 nt, hsa; identical to SEQ ID NO: 142633

SEQ ID NO: 260908 - RNA, 64 nt, hsa; identical to SEQ ID NO: 142634

SEQ ID NO: 260909 - RNA, 64 nt, hsa; identical to SEQ ID NO: 142635

SEQ ID NO: 260910 - RNA, 64 nt, hsa; identical to SEQ ID NO: 142636

SEQ ID NO: 260911 - RNA, 64 nt, hsa; identical to SEQ ID NO: 142637

SEQ ID NO: 260912 - RNA, 64 nt, hsa; identical to SEQ ID NO: 142638

SEQ ID NO: 260913 - RNA, 64 nt, hsa; identical to SEQ ID NO: 142639

SEQ ID NO: 260914 - RNA, 64 nt, hsa; identical to SEQ ID NO: 142640

SEQ ID NO: 260915 - RNA, 64 nt, hsa; identical to SEQ ID NO: 142641

SEQ ID NO: 260916 - RNA, 64 nt, hsa; identical to SEQ ID NO: 142642

SEQ ID NO: 260917 - RNA, 64 nt, hsa; identical to SEQ ID NO: 142643

SEQ ID NO: 260918 - RNA, 64 nt, hsa; identical to SEQ ID NO: 142644

SEQ ID NO: 260919 - RNA, 64 nt, hsa; identical to SEQ ID NO: 142645

SEQ ID NO: 260920 - RNA, 64 nt, hsa; identical to SEQ ID NO: 142646

SEQ ID NO: 260921 - RNA, 64 nt, hsa; identical to SEQ ID NO: 142647

SEQ ID NO: 260922 - RNA, 64 nt, hsa; identical to SEQ ID NO: 142648

SEQ ID NO: 260923 - RNA, 64 nt, hsa; identical to SEQ ID NO: 142649

SEQ ID NO: 260924 - RNA, 64 nt, hsa; identical to SEQ ID NO: 142650

SEQ ID NO: 260925 - RNA, 64 nt, hsa; identical to SEQ ID NO: 142651

SEQ ID NO: 260926 - RNA, 64 nt, hsa; identical to SEQ ID NO: 142652

SEQ ID NO: 260927 - RNA, 64 nt, hsa; identical to SEQ ID NO: 142653

SEQ ID NO: 260928 - RNA, 64 nt, hsa; identical to SEQ ID NO: 142654

SEQ ID NO: 260929 - RNA, 64 nt, hsa; identical to SEQ ID NO: 142655

SEQ ID NO: 260930 - RNA, 64 nt, hsa; identical to SEQ ID NO: 142656

SEQ ID NO: 260931 - RNA, 64 nt, hsa; identical to SEQ ID NO: 142657

SEQ ID NO: 260932 - RNA, 64 nt, hsa; identical to SEQ ID NO: 142658

SEQ ID NO: 260933 - RNA, 64 nt, hsa; identical to SEQ ID NO: 142659

SEQ ID NO: 260934 - RNA, 64 nt, hsa; identical to SEQ ID NO: 142660

SEQ ID NO: 260935 - RNA, 64 nt, hsa; identical to SEQ ID NO: 142661

SEQ ID NO: 260936 - RNA, 64 nt, hsa; identical to SEQ ID NO: 142662

SEQ ID NO: 260937 - RNA, 64 nt, hsa; identical to SEQ ID NO: 142663

SEQ ID NO: 260938 - RNA, 64 nt, hsa; identical to SEQ ID NO: 142664

SEQ ID NO: 260939 - RNA, 64 nt, hsa; identical to SEQ ID NO: 142665

SEQ ID NO: 260940 - RNA, 64 nt, hsa; identical to SEQ ID NO: 142666

SEQ ID NO: 260941 - RNA, 64 nt, hsa; identical to SEQ ID NO: 142667

SEQ ID NO: 260942 - RNA, 64 nt, hsa; identical to SEQ ID NO: 142668

SEQ ID NO: 260943 - RNA, 64 nt, hsa; identical to SEQ ID NO: 142669

SEQ ID NO: 260944 - RNA, 64 nt, hsa; identical to SEQ ID NO: 142670

SEQ ID NO: 260945 - RNA, 64 nt, hsa; identical to SEQ ID NO: 142671

SEQ ID NO: 260946 - RNA, 64 nt, hsa; identical to SEQ ID NO: 142672

SEQ ID NO: 260947 - RNA, 64 nt, hsa; identical to SEQ ID NO: 142673

SEQ ID NO: 260948 - RNA, 64 nt, hsa; identical to SEQ ID NO: 142674

SEQ ID NO: 260949 - RNA, 64 nt, hsa; identical to SEQ ID NO: 142675

SEQ ID NO: 260950 - RNA, 64 nt, hsa; identical to SEQ ID NO: 142676

SEQ ID NO: 260951 - RNA, 64 nt, hsa; identical to SEQ ID NO: 142677

SEQ ID NO: 260952 - RNA, 64 nt, hsa; identical to SEQ ID NO: 142678

SEQ ID NO: 260953 - RNA, 64 nt, hsa; identical to SEQ ID NO: 142679

SEQ ID NO: 260954 - RNA, 64 nt, hsa; identical to SEQ ID NO: 142680

SEQ ID NO: 260955 - RNA, 64 nt, hsa; identical to SEQ ID NO: 142681

SEQ ID NO: 260956 - RNA, 64 nt, hsa; identical to SEQ ID NO: 142682

SEQ ID NO: 260957 - RNA, 64 nt, hsa; identical to SEQ ID NO: 142683

SEQ ID NO: 260958 - RNA, 64 nt, hsa; identical to SEQ ID NO: 142684

SEQ ID NO: 260959 - RNA, 64 nt, hsa; identical to SEQ ID NO: 142685

SEQ ID NO: 260960 - RNA, 64 nt, hsa; identical to SEQ ID NO: 142686

SEQ ID NO: 260961 - RNA, 64 nt, hsa; identical to SEQ ID NO: 142687

SEQ ID NO: 260962 - RNA, 64 nt, hsa; identical to SEQ ID NO: 142688

SEQ ID NO: 260963 - RNA, 64 nt, hsa; identical to SEQ ID NO: 142689

SEQ ID NO: 260964 - RNA, 64 nt, hsa; identical to SEQ ID NO: 142690

SEQ ID NO: 260965 - RNA, 64 nt, hsa; identical to SEQ ID NO: 142691

SEQ ID NO: 260966 - RNA, 64 nt, hsa; identical to SEQ ID NO: 142692

SEQ ID NO: 260967 - RNA, 64 nt, hsa; identical to SEQ ID NO: 142693

SEQ ID NO: 260968 - RNA, 64 nt, hsa; identical to SEQ ID NO: 142694

SEQ ID NO: 260969 - RNA, 64 nt, hsa; identical to SEQ ID NO: 142695

SEQ ID NO: 260970 - RNA, 64 nt, hsa; identical to SEQ ID NO: 142696

SEQ ID NO: 260971 - RNA, 64 nt, hsa; identical to SEQ ID NO: 142697

SEQ ID NO: 260972 - RNA, 64 nt, hsa; identical to SEQ ID NO: 142698

SEQ ID NO: 260973 - RNA, 64 nt, hsa; identical to SEQ ID NO: 142699

SEQ ID NO: 260974 - RNA, 64 nt, hsa; identical to SEQ ID NO: 142700

SEQ ID NO: 260975 - RNA, 64 nt, hsa; identical to SEQ ID NO: 142701

SEQ ID NO: 260976 - RNA, 64 nt, hsa; identical to SEQ ID NO: 142702

SEQ ID NO: 260977 - RNA, 64 nt, hsa; identical to SEQ ID NO: 142703

SEQ ID NO: 260978 - RNA, 64 nt, hsa; identical to SEQ ID NO: 142704

SEQ ID NO: 260979 - RNA, 64 nt, hsa; identical to SEQ ID NO: 142705

SEQ ID NO: 260980 - RNA, 64 nt, hsa; identical to SEQ ID NO: 142706

SEQ ID NO: 260981 - RNA, 64 nt, hsa; identical to SEQ ID NO: 142707

SEQ ID NO: 260982 - RNA, 64 nt, hsa; identical to SEQ ID NO: 142708

SEQ ID NO: 260983 - RNA, 64 nt, hsa; identical to SEQ ID NO: 142709

SEQ ID NO: 260984 - RNA, 64 nt, hsa; identical to SEQ ID NO: 142710

SEQ ID NO: 260985 - RNA, 64 nt, hsa; identical to SEQ ID NO: 142711

SEQ ID NO: 260986 - RNA, 64 nt, hsa; identical to SEQ ID NO: 142712

SEQ ID NO: 260987 - RNA, 64 nt, hsa; identical to SEQ ID NO: 142713

SEQ ID NO: 260988 - RNA, 64 nt, hsa; identical to SEQ ID NO: 142714

SEQ ID NO: 260989 - RNA, 64 nt, hsa; identical to SEQ ID NO: 142715

SEQ ID NO: 260990 - RNA, 64 nt, hsa; identical to SEQ ID NO: 142716

SEQ ID NO: 260991 - RNA, 64 nt, hsa; identical to SEQ ID NO: 142717

SEQ ID NO: 260992 - RNA, 64 nt, hsa; identical to SEQ ID NO: 142718

SEQ ID NO: 260993 - RNA, 64 nt, hsa; identical to SEQ ID NO: 142719

SEQ ID NO: 260994 - RNA, 64 nt, hsa; identical to SEQ ID NO: 142720

SEQ ID NO: 260995 - RNA, 64 nt, hsa; identical to SEQ ID NO: 142721

SEQ ID NO: 260996 - RNA, 64 nt, hsa; identical to SEQ ID NO: 142722

SEQ ID NO: 260997 - RNA, 64 nt, hsa; identical to SEQ ID NO: 142723

SEQ ID NO: 260998 - RNA, 64 nt, hsa; identical to SEQ ID NO: 142724

SEQ ID NO: 260999 - RNA, 64 nt, hsa; identical to SEQ ID NO: 142725

SEQ ID NO: 261000 - RNA, 64 nt, hsa; identical to SEQ ID NO: 142726

SEQ ID NO: 261001 - RNA, 64 nt, hsa; identical to SEQ ID NO: 142727

SEQ ID NO: 261002 - RNA, 64 nt, hsa; identical to SEQ ID NO: 142728

SEQ ID NO: 261003 - RNA, 64 nt, hsa; identical to SEQ ID NO: 142729

SEQ ID NO: 261004 - RNA, 64 nt, hsa; identical to SEQ ID NO: 142730

SEQ ID NO: 261005 - RNA, 64 nt, hsa; identical to SEQ ID NO: 142731

SEQ ID NO: 261006 - RNA, 64 nt, hsa; identical to SEQ ID NO: 142732

SEQ ID NO: 261007 - RNA, 64 nt, hsa; identical to SEQ ID NO: 142733

SEQ ID NO: 261008 - RNA, 64 nt, hsa; identical to SEQ ID NO: 142734

SEQ ID NO: 261009 - RNA, 64 nt, hsa; identical to SEQ ID NO: 142735

SEQ ID NO: 261010 - RNA, 64 nt, hsa; identical to SEQ ID NO: 142736

SEQ ID NO: 261011 - RNA, 64 nt, hsa; identical to SEQ ID NO: 142737

SEQ ID NO: 261012 - RNA, 64 nt, hsa; identical to SEQ ID NO: 142738

SEQ ID NO: 261013 - RNA, 64 nt, hsa; identical to SEQ ID NO: 142739

SEQ ID NO: 261014 - RNA, 64 nt, hsa; identical to SEQ ID NO: 142740

SEQ ID NO: 261015 - RNA, 64 nt, hsa; identical to SEQ ID NO: 142741

SEQ ID NO: 261016 - RNA, 64 nt, hsa; identical to SEQ ID NO: 142742

SEQ ID NO: 261017 - RNA, 64 nt, hsa; identical to SEQ ID NO: 142743

SEQ ID NO: 261018 - RNA, 64 nt, hsa; identical to SEQ ID NO: 142744

SEQ ID NO: 261019 - RNA, 64 nt, hsa; identical to SEQ ID NO: 142745

SEQ ID NO: 261020 - RNA, 64 nt, hsa; identical to SEQ ID NO: 142746

SEQ ID NO: 261021 - RNA, 64 nt, hsa; identical to SEQ ID NO: 142747

SEQ ID NO: 261022 - RNA, 64 nt, hsa; identical to SEQ ID NO: 142748

SEQ ID NO: 261023 - RNA, 64 nt, hsa; identical to SEQ ID NO: 142749

SEQ ID NO: 261024 - RNA, 64 nt, hsa; identical to SEQ ID NO: 142750

SEQ ID NO: 261025 - RNA, 64 nt, hsa; identical to SEQ ID NO: 142751

SEQ ID NO: 261026 - RNA, 64 nt, hsa; identical to SEQ ID NO: 142752

SEQ ID NO: 261027 - RNA, 64 nt, hsa; identical to SEQ ID NO: 142753

SEQ ID NO: 261028 - RNA, 64 nt, hsa; identical to SEQ ID NO: 142754

SEQ ID NO: 261029 - RNA, 64 nt, hsa; identical to SEQ ID NO: 142755

SEQ ID NO: 261030 - RNA, 64 nt, hsa; identical to SEQ ID NO: 142756

SEQ ID NO: 261031 - RNA, 64 nt, hsa; identical to SEQ ID NO: 142757

SEQ ID NO: 261032 - RNA, 64 nt, hsa; identical to SEQ ID NO: 142758

SEQ ID NO: 261033 - RNA, 64 nt, hsa; identical to SEQ ID NO: 142759

SEQ ID NO: 261034 - RNA, 64 nt, hsa; identical to SEQ ID NO: 142760

SEQ ID NO: 261035 - RNA, 64 nt, hsa; identical to SEQ ID NO: 142761

SEQ ID NO: 261036 - RNA, 64 nt, hsa; identical to SEQ ID NO: 142762

SEQ ID NO: 261037 - RNA, 64 nt, hsa; identical to SEQ ID NO: 142763

SEQ ID NO: 261038 - RNA, 64 nt, hsa; identical to SEQ ID NO: 142764

SEQ ID NO: 261039 - RNA, 64 nt, hsa; identical to SEQ ID NO: 142765

SEQ ID NO: 261040 - RNA, 64 nt, hsa; identical to SEQ ID NO: 142766

SEQ ID NO: 261041 - RNA, 64 nt, hsa; identical to SEQ ID NO: 142767

SEQ ID NO: 261042 - RNA, 64 nt, hsa; identical to SEQ ID NO: 142768

SEQ ID NO: 261043 - RNA, 64 nt, hsa; identical to SEQ ID NO: 142769

SEQ ID NO: 261044 - RNA, 64 nt, hsa; identical to SEQ ID NO: 142770

SEQ ID NO: 261045 - RNA, 64 nt, hsa; identical to SEQ ID NO: 142771

SEQ ID NO: 261046 - RNA, 64 nt, hsa; identical to SEQ ID NO: 142772

SEQ ID NO: 261047 - RNA, 64 nt, hsa; identical to SEQ ID NO: 142773

SEQ ID NO: 261048 - RNA, 64 nt, hsa; identical to SEQ ID NO: 142774

SEQ ID NO: 261049 - RNA, 64 nt, hsa; identical to SEQ ID NO: 142775

SEQ ID NO: 261050 - RNA, 64 nt, hsa; identical to SEQ ID NO: 142776

SEQ ID NO: 261051 - RNA, 64 nt, hsa; identical to SEQ ID NO: 142777

SEQ ID NO: 261052 - RNA, 64 nt, hsa; identical to SEQ ID NO: 142778

SEQ ID NO: 261053 - RNA, 64 nt, hsa; identical to SEQ ID NO: 142779

SEQ ID NO: 261054 - RNA, 64 nt, hsa; identical to SEQ ID NO: 142780

SEQ ID NO: 261055 - RNA, 64 nt, hsa; identical to SEQ ID NO: 142781

SEQ ID NO: 261056 - RNA, 64 nt, hsa; identical to SEQ ID NO: 142782

SEQ ID NO: 261057 - RNA, 64 nt, hsa; identical to SEQ ID NO: 142783

SEQ ID NO: 261058 - RNA, 64 nt, hsa; identical to SEQ ID NO: 142784

SEQ ID NO: 261059 - RNA, 64 nt, hsa; identical to SEQ ID NO: 142785

SEQ ID NO: 261060 - RNA, 64 nt, hsa; identical to SEQ ID NO: 142786

SEQ ID NO: 261061 - RNA, 64 nt, hsa; identical to SEQ ID NO: 142787

SEQ ID NO: 261062 - RNA, 64 nt, hsa; identical to SEQ ID NO: 142788

SEQ ID NO: 261063 - RNA, 64 nt, hsa; identical to SEQ ID NO: 142789

SEQ ID NO: 261064 - RNA, 64 nt, hsa; identical to SEQ ID NO: 142790

SEQ ID NO: 261065 - RNA, 64 nt, hsa; identical to SEQ ID NO: 142791

SEQ ID NO: 261066 - RNA, 64 nt, hsa; identical to SEQ ID NO: 142792

SEQ ID NO: 261067 - RNA, 64 nt, hsa; identical to SEQ ID NO: 142793

SEQ ID NO: 261068 - RNA, 64 nt, hsa; identical to SEQ ID NO: 142794

SEQ ID NO: 261069 - RNA, 64 nt, hsa; identical to SEQ ID NO: 142795

SEQ ID NO: 261070 - RNA, 64 nt, hsa; identical to SEQ ID NO: 142796

SEQ ID NO: 261071 - RNA, 64 nt, hsa; identical to SEQ ID NO: 142797

SEQ ID NO: 261072 - RNA, 64 nt, hsa; identical to SEQ ID NO: 142798

SEQ ID NO: 261073 - RNA, 64 nt, hsa; identical to SEQ ID NO: 142799

SEQ ID NO: 261074 - RNA, 64 nt, hsa; identical to SEQ ID NO: 142800

SEQ ID NO: 261075 - RNA, 64 nt, hsa; identical to SEQ ID NO: 142801

SEQ ID NO: 261076 - RNA, 64 nt, hsa; identical to SEQ ID NO: 142802

SEQ ID NO: 261077 - RNA, 64 nt, hsa; identical to SEQ ID NO: 142803

SEQ ID NO: 261078 - RNA, 64 nt, hsa; identical to SEQ ID NO: 142804

SEQ ID NO: 261079 - RNA, 64 nt, hsa; identical to SEQ ID NO: 142805

SEQ ID NO: 261080 - RNA, 64 nt, hsa; identical to SEQ ID NO: 142806

SEQ ID NO: 261081 - RNA, 64 nt, hsa; identical to SEQ ID NO: 142807

SEQ ID NO: 261082 - RNA, 64 nt, hsa; identical to SEQ ID NO: 142808

SEQ ID NO: 261083 - RNA, 64 nt, hsa; identical to SEQ ID NO: 142809

SEQ ID NO: 261084 - RNA, 64 nt, hsa; identical to SEQ ID NO: 142810

SEQ ID NO: 261085 - RNA, 64 nt, hsa; identical to SEQ ID NO: 142811

SEQ ID NO: 261086 - RNA, 64 nt, hsa; identical to SEQ ID NO: 142812

SEQ ID NO: 261087 - RNA, 64 nt, hsa; identical to SEQ ID NO: 142813

SEQ ID NO: 261088 - RNA, 64 nt, hsa; identical to SEQ ID NO: 142814

SEQ ID NO: 261089 - RNA, 64 nt, hsa; identical to SEQ ID NO: 142815

SEQ ID NO: 261090 - RNA, 64 nt, hsa; identical to SEQ ID NO: 142816

SEQ ID NO: 261091 - RNA, 64 nt, hsa; identical to SEQ ID NO: 142817

SEQ ID NO: 261092 - RNA, 64 nt, hsa; identical to SEQ ID NO: 142818

SEQ ID NO: 261093 - RNA, 64 nt, hsa; identical to SEQ ID NO: 142819

SEQ ID NO: 261094 - RNA, 64 nt, hsa; identical to SEQ ID NO: 142820

SEQ ID NO: 261095 - RNA, 64 nt, hsa; identical to SEQ ID NO: 142821

SEQ ID NO: 261096 - RNA, 64 nt, hsa; identical to SEQ ID NO: 142822

SEQ ID NO: 261097 - RNA, 64 nt, hsa; identical to SEQ ID NO: 142823

SEQ ID NO: 261098 - RNA, 64 nt, hsa; identical to SEQ ID NO: 142824

SEQ ID NO: 261099 - RNA, 64 nt, hsa; identical to SEQ ID NO: 142825

SEQ ID NO: 261100 - RNA, 64 nt, hsa; identical to SEQ ID NO: 142826

SEQ ID NO: 261101 - RNA, 64 nt, hsa; identical to SEQ ID NO: 142827

SEQ ID NO: 261102 - RNA, 64 nt, hsa; identical to SEQ ID NO: 142828

SEQ ID NO: 261103 - RNA, 64 nt, hsa; identical to SEQ ID NO: 142829

SEQ ID NO: 261104 - RNA, 64 nt, hsa; identical to SEQ ID NO: 142830

SEQ ID NO: 261105 - RNA, 64 nt, hsa; identical to SEQ ID NO: 142831

SEQ ID NO: 261106 - RNA, 64 nt, hsa; identical to SEQ ID NO: 142832

SEQ ID NO: 261107 - RNA, 64 nt, hsa; identical to SEQ ID NO: 142833

SEQ ID NO: 261108 - RNA, 64 nt, hsa; identical to SEQ ID NO: 142834

SEQ ID NO: 261109 - RNA, 64 nt, hsa; identical to SEQ ID NO: 142835

SEQ ID NO: 261110 - RNA, 64 nt, hsa; identical to SEQ ID NO: 142836

SEQ ID NO: 261111 - RNA, 64 nt, hsa; identical to SEQ ID NO: 142837

SEQ ID NO: 261112 - RNA, 64 nt, hsa; identical to SEQ ID NO: 142838

SEQ ID NO: 261113 - RNA, 64 nt, hsa; identical to SEQ ID NO: 142839

SEQ ID NO: 261114 - RNA, 64 nt, hsa; identical to SEQ ID NO: 142840

SEQ ID NO: 261115 - RNA, 64 nt, hsa; identical to SEQ ID NO: 142841

SEQ ID NO: 261116 - RNA, 64 nt, hsa; identical to SEQ ID NO: 142842

SEQ ID NO: 261117 - RNA, 64 nt, hsa; identical to SEQ ID NO: 142843

SEQ ID NO: 261118 - RNA, 64 nt, hsa; identical to SEQ ID NO: 142844

SEQ ID NO: 261119 - RNA, 64 nt, hsa; identical to SEQ ID NO: 142845

SEQ ID NO: 261120 - RNA, 64 nt, hsa; identical to SEQ ID NO: 142846

SEQ ID NO: 261121 - RNA, 64 nt, hsa; identical to SEQ ID NO: 142847

SEQ ID NO: 261122 - RNA, 64 nt, hsa; identical to SEQ ID NO: 142848

SEQ ID NO: 261123 - RNA, 64 nt, hsa; identical to SEQ ID NO: 142849

SEQ ID NO: 261124 - RNA, 64 nt, hsa; identical to SEQ ID NO: 142850

SEQ ID NO: 261125 - RNA, 64 nt, hsa; identical to SEQ ID NO: 142851

SEQ ID NO: 261126 - RNA, 64 nt, hsa; identical to SEQ ID NO: 142852

SEQ ID NO: 261127 - RNA, 64 nt, hsa; identical to SEQ ID NO: 142853

SEQ ID NO: 261128 - RNA, 64 nt, hsa; identical to SEQ ID NO: 142854

SEQ ID NO: 261129 - RNA, 64 nt, hsa; identical to SEQ ID NO: 142855

SEQ ID NO: 261130 - RNA, 64 nt, hsa; identical to SEQ ID NO: 142856

SEQ ID NO: 261131 - RNA, 64 nt, hsa; identical to SEQ ID NO: 142857

SEQ ID NO: 261132 - RNA, 64 nt, hsa; identical to SEQ ID NO: 142858

SEQ ID NO: 261133 - RNA, 64 nt, hsa; identical to SEQ ID NO: 142859

SEQ ID NO: 261134 - RNA, 64 nt, hsa; identical to SEQ ID NO: 142860

SEQ ID NO: 261135 - RNA, 64 nt, hsa; identical to SEQ ID NO: 142861

SEQ ID NO: 261136 - RNA, 64 nt, hsa; identical to SEQ ID NO: 142862

SEQ ID NO: 261137 - RNA, 64 nt, hsa; identical to SEQ ID NO: 142863

SEQ ID NO: 261138 - RNA, 64 nt, hsa; identical to SEQ ID NO: 142864

SEQ ID NO: 261139 - RNA, 64 nt, hsa; identical to SEQ ID NO: 142865

SEQ ID NO: 261140 - RNA, 64 nt, hsa; identical to SEQ ID NO: 142866

SEQ ID NO: 261141 - RNA, 64 nt, hsa; identical to SEQ ID NO: 142867

SEQ ID NO: 261142 - RNA, 64 nt, hsa; identical to SEQ ID NO: 142868

SEQ ID NO: 261143 - RNA, 64 nt, hsa; identical to SEQ ID NO: 142869

SEQ ID NO: 261144 - RNA, 64 nt, hsa; identical to SEQ ID NO: 142870

SEQ ID NO: 261145 - RNA, 64 nt, hsa; identical to SEQ ID NO: 142871

SEQ ID NO: 261146 - RNA, 64 nt, hsa; identical to SEQ ID NO: 142872

SEQ ID NO: 261147 - RNA, 64 nt, hsa; identical to SEQ ID NO: 142873

SEQ ID NO: 261148 - RNA, 64 nt, hsa; identical to SEQ ID NO: 142874

SEQ ID NO: 261149 - RNA, 64 nt, hsa; identical to SEQ ID NO: 142875

SEQ ID NO: 261150 - RNA, 64 nt, hsa; identical to SEQ ID NO: 142876

SEQ ID NO: 261151 - RNA, 64 nt, hsa; identical to SEQ ID NO: 142877

SEQ ID NO: 261152 - RNA, 64 nt, hsa; identical to SEQ ID NO: 142878

SEQ ID NO: 261153 - RNA, 64 nt, hsa; identical to SEQ ID NO: 142879

SEQ ID NO: 261154 - RNA, 64 nt, hsa; identical to SEQ ID NO: 142880

SEQ ID NO: 261155 - RNA, 64 nt, hsa; identical to SEQ ID NO: 142881

SEQ ID NO: 261156 - RNA, 64 nt, hsa; identical to SEQ ID NO: 142882

SEQ ID NO: 261157 - RNA, 64 nt, hsa; identical to SEQ ID NO: 142883

SEQ ID NO: 261158 - RNA, 64 nt, hsa; identical to SEQ ID NO: 142884

SEQ ID NO: 261159 - RNA, 64 nt, hsa; identical to SEQ ID NO: 142885

SEQ ID NO: 261160 - RNA, 64 nt, hsa; identical to SEQ ID NO: 142886

SEQ ID NO: 261161 - RNA, 64 nt, hsa; identical to SEQ ID NO: 142887

SEQ ID NO: 261162 - RNA, 64 nt, hsa; identical to SEQ ID NO: 142888

SEQ ID NO: 261163 - RNA, 64 nt, hsa; identical to SEQ ID NO: 142889

SEQ ID NO: 261164 - RNA, 64 nt, hsa; identical to SEQ ID NO: 142890

SEQ ID NO: 261165 - RNA, 64 nt, hsa; identical to SEQ ID NO: 142891

SEQ ID NO: 261166 - RNA, 64 nt, hsa; identical to SEQ ID NO: 142892

SEQ ID NO: 261167 - RNA, 64 nt, hsa; identical to SEQ ID NO: 142893

SEQ ID NO: 261168 - RNA, 64 nt, hsa; identical to SEQ ID NO: 142894

SEQ ID NO: 261169 - RNA, 64 nt, hsa; identical to SEQ ID NO: 142895

SEQ ID NO: 261170 - RNA, 64 nt, hsa; identical to SEQ ID NO: 142896

SEQ ID NO: 261171 - RNA, 64 nt, hsa; identical to SEQ ID NO: 142897

SEQ ID NO: 261172 - RNA, 64 nt, hsa; identical to SEQ ID NO: 142898

SEQ ID NO: 261173 - RNA, 64 nt, hsa; identical to SEQ ID NO: 142899

SEQ ID NO: 261174 - RNA, 64 nt, hsa; identical to SEQ ID NO: 142900

SEQ ID NO: 261175 - RNA, 64 nt, hsa; identical to SEQ ID NO: 142901

SEQ ID NO: 261176 - RNA, 64 nt, hsa; identical to SEQ ID NO: 142902

SEQ ID NO: 261177 - RNA, 64 nt, hsa; identical to SEQ ID NO: 142903

SEQ ID NO: 261178 - RNA, 64 nt, hsa; identical to SEQ ID NO: 142904

SEQ ID NO: 261179 - RNA, 64 nt, hsa; identical to SEQ ID NO: 142905

SEQ ID NO: 261180 - RNA, 64 nt, hsa; identical to SEQ ID NO: 142906

SEQ ID NO: 261181 - RNA, 64 nt, hsa; identical to SEQ ID NO: 142907

SEQ ID NO: 261182 - RNA, 64 nt, hsa; identical to SEQ ID NO: 142908

SEQ ID NO: 261183 - RNA, 64 nt, hsa; identical to SEQ ID NO: 142909

SEQ ID NO: 261184 - RNA, 64 nt, hsa; identical to SEQ ID NO: 142910

SEQ ID NO: 261185 - RNA, 64 nt, hsa; identical to SEQ ID NO: 142911

SEQ ID NO: 261186 - RNA, 64 nt, hsa; identical to SEQ ID NO: 142912

SEQ ID NO: 261187 - RNA, 64 nt, hsa; identical to SEQ ID NO: 142913

SEQ ID NO: 261188 - RNA, 64 nt, hsa; identical to SEQ ID NO: 142914

SEQ ID NO: 261189 - RNA, 64 nt, hsa; identical to SEQ ID NO: 142915

SEQ ID NO: 261190 - RNA, 64 nt, hsa; identical to SEQ ID NO: 142916

SEQ ID NO: 261191 - RNA, 64 nt, hsa; identical to SEQ ID NO: 142917

SEQ ID NO: 261192 - RNA, 64 nt, hsa; identical to SEQ ID NO: 142918

SEQ ID NO: 261193 - RNA, 64 nt, hsa; identical to SEQ ID NO: 142919

SEQ ID NO: 261194 - RNA, 64 nt, hsa; identical to SEQ ID NO: 142920

SEQ ID NO: 261195 - RNA, 64 nt, hsa; identical to SEQ ID NO: 142921

SEQ ID NO: 261196 - RNA, 64 nt, hsa; identical to SEQ ID NO: 142922

SEQ ID NO: 261197 - RNA, 64 nt, hsa; identical to SEQ ID NO: 142923

SEQ ID NO: 261198 - RNA, 64 nt, hsa; identical to SEQ ID NO: 142924

SEQ ID NO: 261199 - RNA, 64 nt, hsa; identical to SEQ ID NO: 142925

SEQ ID NO: 261200 - RNA, 64 nt, hsa; identical to SEQ ID NO: 142926

SEQ ID NO: 261201 - RNA, 64 nt, hsa; identical to SEQ ID NO: 142927

SEQ ID NO: 261202 - RNA, 64 nt, hsa; identical to SEQ ID NO: 142928

SEQ ID NO: 261203 - RNA, 64 nt, hsa; identical to SEQ ID NO: 142929

SEQ ID NO: 261204 - RNA, 64 nt, hsa; identical to SEQ ID NO: 142930

SEQ ID NO: 261205 - RNA, 64 nt, hsa; identical to SEQ ID NO: 142931

SEQ ID NO: 261206 - RNA, 64 nt, hsa; identical to SEQ ID NO: 142932

SEQ ID NO: 261207 - RNA, 64 nt, hsa; identical to SEQ ID NO: 142933

SEQ ID NO: 261208 - RNA, 64 nt, hsa; identical to SEQ ID NO: 142934

SEQ ID NO: 261209 - RNA, 64 nt, hsa; identical to SEQ ID NO: 142935

SEQ ID NO: 261210 - RNA, 64 nt, hsa; identical to SEQ ID NO: 142936

SEQ ID NO: 261211 - RNA, 64 nt, hsa; identical to SEQ ID NO: 142937

SEQ ID NO: 261212 - RNA, 64 nt, hsa; identical to SEQ ID NO: 142938

SEQ ID NO: 261213 - RNA, 64 nt, hsa; identical to SEQ ID NO: 142939

SEQ ID NO: 261214 - RNA, 64 nt, hsa; identical to SEQ ID NO: 142940

SEQ ID NO: 261215 - RNA, 64 nt, hsa; identical to SEQ ID NO: 142941

SEQ ID NO: 261216 - RNA, 64 nt, hsa; identical to SEQ ID NO: 142942

SEQ ID NO: 261217 - RNA, 64 nt, hsa; identical to SEQ ID NO: 142943

SEQ ID NO: 261218 - RNA, 64 nt, hsa; identical to SEQ ID NO: 142944

SEQ ID NO: 261219 - RNA, 64 nt, hsa; identical to SEQ ID NO: 142945

SEQ ID NO: 261220 - RNA, 64 nt, hsa; identical to SEQ ID NO: 142946

SEQ ID NO: 261221 - RNA, 64 nt, hsa; identical to SEQ ID NO: 142947

SEQ ID NO: 261222 - RNA, 64 nt, hsa; identical to SEQ ID NO: 142948

SEQ ID NO: 261223 - RNA, 64 nt, hsa; identical to SEQ ID NO: 142949

SEQ ID NO: 261224 - RNA, 64 nt, hsa; identical to SEQ ID NO: 142950

SEQ ID NO: 261225 - RNA, 64 nt, hsa; identical to SEQ ID NO: 142951

SEQ ID NO: 261226 - RNA, 64 nt, hsa; identical to SEQ ID NO: 142952

SEQ ID NO: 261227 - RNA, 64 nt, hsa; identical to SEQ ID NO: 142953

SEQ ID NO: 261228 - RNA, 64 nt, hsa; identical to SEQ ID NO: 142954

SEQ ID NO: 261229 - RNA, 64 nt, hsa; identical to SEQ ID NO: 142955

SEQ ID NO: 261230 - RNA, 64 nt, hsa; identical to SEQ ID NO: 142956

SEQ ID NO: 261231 - RNA, 64 nt, hsa; identical to SEQ ID NO: 142957

SEQ ID NO: 261232 - RNA, 64 nt, hsa; identical to SEQ ID NO: 142958

SEQ ID NO: 261233 - RNA, 64 nt, hsa; identical to SEQ ID NO: 142959

SEQ ID NO: 261234 - RNA, 64 nt, hsa; identical to SEQ ID NO: 142960

SEQ ID NO: 261235 - RNA, 64 nt, hsa; identical to SEQ ID NO: 142961

SEQ ID NO: 261236 - RNA, 64 nt, hsa; identical to SEQ ID NO: 142962

SEQ ID NO: 261237 - RNA, 64 nt, hsa; identical to SEQ ID NO: 142963

SEQ ID NO: 261238 - RNA, 64 nt, hsa; identical to SEQ ID NO: 142964

SEQ ID NO: 261239 - RNA, 64 nt, hsa; identical to SEQ ID NO: 142965

SEQ ID NO: 261240 - RNA, 64 nt, hsa; identical to SEQ ID NO: 142966

SEQ ID NO: 261241 - RNA, 64 nt, hsa; identical to SEQ ID NO: 142967

SEQ ID NO: 261242 - RNA, 64 nt, hsa; identical to SEQ ID NO: 142968

SEQ ID NO: 261243 - RNA, 64 nt, hsa; identical to SEQ ID NO: 142969

SEQ ID NO: 261244 - RNA, 64 nt, hsa; identical to SEQ ID NO: 142970

SEQ ID NO: 261245 - RNA, 64 nt, hsa; identical to SEQ ID NO: 142971

SEQ ID NO: 261246 - RNA, 64 nt, hsa; identical to SEQ ID NO: 142972

SEQ ID NO: 261247 - RNA, 64 nt, hsa; identical to SEQ ID NO: 142973

SEQ ID NO: 261248 - RNA, 64 nt, hsa; identical to SEQ ID NO: 142974

SEQ ID NO: 261249 - RNA, 64 nt, hsa; identical to SEQ ID NO: 142975

SEQ ID NO: 261250 - RNA, 64 nt, hsa; identical to SEQ ID NO: 142976

SEQ ID NO: 261251 - RNA, 64 nt, hsa; identical to SEQ ID NO: 142977

SEQ ID NO: 261252 - RNA, 64 nt, hsa; identical to SEQ ID NO: 142978

SEQ ID NO: 261253 - RNA, 64 nt, hsa; identical to SEQ ID NO: 142979

SEQ ID NO: 261254 - RNA, 64 nt, hsa; identical to SEQ ID NO: 142980

SEQ ID NO: 261255 - RNA, 64 nt, hsa; identical to SEQ ID NO: 142981

SEQ ID NO: 261256 - RNA, 64 nt, hsa; identical to SEQ ID NO: 142982

SEQ ID NO: 261257 - RNA, 64 nt, hsa; identical to SEQ ID NO: 142983

SEQ ID NO: 261258 - RNA, 64 nt, hsa; identical to SEQ ID NO: 142984

SEQ ID NO: 261259 - RNA, 64 nt, hsa; identical to SEQ ID NO: 142985

SEQ ID NO: 261260 - RNA, 64 nt, hsa; identical to SEQ ID NO: 142986

SEQ ID NO: 261261 - RNA, 64 nt, hsa; identical to SEQ ID NO: 142987

SEQ ID NO: 261262 - RNA, 64 nt, hsa; identical to SEQ ID NO: 142988

SEQ ID NO: 261263 - RNA, 64 nt, hsa; identical to SEQ ID NO: 142989

SEQ ID NO: 261264 - RNA, 64 nt, hsa; identical to SEQ ID NO: 142990

SEQ ID NO: 261265 - RNA, 64 nt, hsa; identical to SEQ ID NO: 142991

SEQ ID NO: 261266 - RNA, 64 nt, hsa; identical to SEQ ID NO: 142992

SEQ ID NO: 261267 - RNA, 64 nt, hsa; identical to SEQ ID NO: 142993

SEQ ID NO: 261268 - RNA, 64 nt, hsa; identical to SEQ ID NO: 142994

SEQ ID NO: 261269 - RNA, 64 nt, hsa; identical to SEQ ID NO: 142995

SEQ ID NO: 261270 - RNA, 64 nt, hsa; identical to SEQ ID NO: 142996

SEQ ID NO: 261271 - RNA, 64 nt, hsa; identical to SEQ ID NO: 142997

SEQ ID NO: 261272 - RNA, 64 nt, hsa; identical to SEQ ID NO: 142998

SEQ ID NO: 261273 - RNA, 64 nt, hsa; identical to SEQ ID NO: 142999

SEQ ID NO: 261274 - RNA, 64 nt, hsa; identical to SEQ ID NO: 143000

SEQ ID NO: 261275 - RNA, 64 nt, hsa; identical to SEQ ID NO: 143001

SEQ ID NO: 261276 - RNA, 64 nt, hsa; identical to SEQ ID NO: 143002

SEQ ID NO: 261277 - RNA, 64 nt, hsa; identical to SEQ ID NO: 143003

SEQ ID NO: 261278 - RNA, 64 nt, hsa; identical to SEQ ID NO: 143004

SEQ ID NO: 261279 - RNA, 64 nt, hsa; identical to SEQ ID NO: 143005

SEQ ID NO: 261280 - RNA, 64 nt, hsa; identical to SEQ ID NO: 143006

SEQ ID NO: 261281 - RNA, 64 nt, hsa; identical to SEQ ID NO: 143007

SEQ ID NO: 261282 - RNA, 64 nt, hsa; identical to SEQ ID NO: 143008

SEQ ID NO: 261283 - RNA, 64 nt, hsa; identical to SEQ ID NO: 143009

SEQ ID NO: 261284 - RNA, 64 nt, hsa; identical to SEQ ID NO: 143010

SEQ ID NO: 261285 - RNA, 64 nt, hsa; identical to SEQ ID NO: 143011

SEQ ID NO: 261286 - RNA, 64 nt, hsa; identical to SEQ ID NO: 143012

SEQ ID NO: 261287 - RNA, 64 nt, hsa; identical to SEQ ID NO: 143013

SEQ ID NO: 261288 - RNA, 64 nt, hsa; identical to SEQ ID NO: 143014

SEQ ID NO: 261289 - RNA, 64 nt, hsa; identical to SEQ ID NO: 143015

SEQ ID NO: 261290 - RNA, 64 nt, hsa; identical to SEQ ID NO: 143016

SEQ ID NO: 261291 - RNA, 64 nt, hsa; identical to SEQ ID NO: 143017

SEQ ID NO: 261292 - RNA, 64 nt, hsa; identical to SEQ ID NO: 143018

SEQ ID NO: 261293 - RNA, 64 nt, hsa; identical to SEQ ID NO: 143019

SEQ ID NO: 261294 - RNA, 64 nt, hsa; identical to SEQ ID NO: 143020

SEQ ID NO: 261295 - RNA, 64 nt, hsa; identical to SEQ ID NO: 143021

SEQ ID NO: 261296 - RNA, 64 nt, hsa; identical to SEQ ID NO: 143022

SEQ ID NO: 261297 - RNA, 64 nt, hsa; identical to SEQ ID NO: 143023

SEQ ID NO: 261298 - RNA, 64 nt, hsa; identical to SEQ ID NO: 143024

SEQ ID NO: 261299 - RNA, 64 nt, hsa; identical to SEQ ID NO: 143025

SEQ ID NO: 261300 - RNA, 64 nt, hsa; identical to SEQ ID NO: 143026

SEQ ID NO: 261301 - RNA, 64 nt, hsa; identical to SEQ ID NO: 143027

SEQ ID NO: 261302 - RNA, 64 nt, hsa; identical to SEQ ID NO: 143028

SEQ ID NO: 261303 - RNA, 64 nt, hsa; identical to SEQ ID NO: 143029

SEQ ID NO: 261304 - RNA, 64 nt, hsa; identical to SEQ ID NO: 143030

SEQ ID NO: 261305 - RNA, 64 nt, hsa; identical to SEQ ID NO: 143031

SEQ ID NO: 261306 - RNA, 64 nt, hsa; identical to SEQ ID NO: 143032

SEQ ID NO: 261307 - RNA, 64 nt, hsa; identical to SEQ ID NO: 143033

SEQ ID NO: 261308 - RNA, 64 nt, hsa; identical to SEQ ID NO: 143034

SEQ ID NO: 261309 - RNA, 64 nt, hsa; identical to SEQ ID NO: 143035

SEQ ID NO: 261310 - RNA, 64 nt, hsa; identical to SEQ ID NO: 143036

SEQ ID NO: 261311 - RNA, 64 nt, hsa; identical to SEQ ID NO: 143037

SEQ ID NO: 261312 - RNA, 64 nt, hsa; identical to SEQ ID NO: 143038

SEQ ID NO: 261313 - RNA, 64 nt, hsa; identical to SEQ ID NO: 143039

SEQ ID NO: 261314 - RNA, 64 nt, hsa; identical to SEQ ID NO: 143040

SEQ ID NO: 261315 - RNA, 64 nt, hsa; identical to SEQ ID NO: 143041

SEQ ID NO: 261316 - RNA, 64 nt, hsa; identical to SEQ ID NO: 143042

SEQ ID NO: 261317 - RNA, 64 nt, hsa; identical to SEQ ID NO: 143043

SEQ ID NO: 261318 - RNA, 64 nt, hsa; identical to SEQ ID NO: 143044

SEQ ID NO: 261319 - RNA, 64 nt, hsa; identical to SEQ ID NO: 143045

SEQ ID NO: 261320 - RNA, 64 nt, hsa; identical to SEQ ID NO: 143046

SEQ ID NO: 261321 - RNA, 64 nt, hsa; identical to SEQ ID NO: 143047

SEQ ID NO: 261322 - RNA, 64 nt, hsa; identical to SEQ ID NO: 143048

SEQ ID NO: 261323 - RNA, 64 nt, hsa; identical to SEQ ID NO: 143049

SEQ ID NO: 261324 - RNA, 64 nt, hsa; identical to SEQ ID NO: 143050

SEQ ID NO: 261325 - RNA, 64 nt, hsa; identical to SEQ ID NO: 143051

SEQ ID NO: 261326 - RNA, 64 nt, hsa; identical to SEQ ID NO: 143052

SEQ ID NO: 261327 - RNA, 64 nt, hsa; identical to SEQ ID NO: 143053

SEQ ID NO: 261328 - RNA, 64 nt, hsa; identical to SEQ ID NO: 143054

SEQ ID NO: 261329 - RNA, 64 nt, hsa; identical to SEQ ID NO: 143055

SEQ ID NO: 261330 - RNA, 64 nt, hsa; identical to SEQ ID NO: 143056

SEQ ID NO: 261331 - RNA, 64 nt, hsa; identical to SEQ ID NO: 143057

SEQ ID NO: 261332 - RNA, 64 nt, hsa; identical to SEQ ID NO: 143058

SEQ ID NO: 261333 - RNA, 64 nt, hsa; identical to SEQ ID NO: 143059

SEQ ID NO: 261334 - RNA, 64 nt, hsa; identical to SEQ ID NO: 143060

SEQ ID NO: 261335 - RNA, 64 nt, hsa; identical to SEQ ID NO: 143061

SEQ ID NO: 261336 - RNA, 64 nt, hsa; identical to SEQ ID NO: 143062

SEQ ID NO: 261337 - RNA, 64 nt, hsa; identical to SEQ ID NO: 143063

SEQ ID NO: 261338 - RNA, 64 nt, hsa; identical to SEQ ID NO: 143064

SEQ ID NO: 261339 - RNA, 64 nt, hsa; identical to SEQ ID NO: 143065

SEQ ID NO: 261340 - RNA, 64 nt, hsa; identical to SEQ ID NO: 143066

SEQ ID NO: 261341 - RNA, 64 nt, hsa; identical to SEQ ID NO: 143067

SEQ ID NO: 261342 - RNA, 64 nt, hsa; identical to SEQ ID NO: 143068

SEQ ID NO: 261343 - RNA, 64 nt, hsa; identical to SEQ ID NO: 143069

SEQ ID NO: 261344 - RNA, 64 nt, hsa; identical to SEQ ID NO: 143070

SEQ ID NO: 261345 - RNA, 64 nt, hsa; identical to SEQ ID NO: 143071

SEQ ID NO: 261346 - RNA, 64 nt, hsa; identical to SEQ ID NO: 143072

SEQ ID NO: 261347 - RNA, 64 nt, hsa; identical to SEQ ID NO: 143073

SEQ ID NO: 261348 - RNA, 64 nt, hsa; identical to SEQ ID NO: 143074

SEQ ID NO: 261349 - RNA, 64 nt, hsa; identical to SEQ ID NO: 143075

SEQ ID NO: 261350 - RNA, 64 nt, hsa; identical to SEQ ID NO: 143076

SEQ ID NO: 261351 - RNA, 64 nt, hsa; identical to SEQ ID NO: 143077

SEQ ID NO: 261352 - RNA, 64 nt, hsa; identical to SEQ ID NO: 143078

SEQ ID NO: 261353 - RNA, 64 nt, hsa; identical to SEQ ID NO: 143079

SEQ ID NO: 261354 - RNA, 64 nt, hsa; identical to SEQ ID NO: 143080

SEQ ID NO: 261355 - RNA, 64 nt, hsa; identical to SEQ ID NO: 143081

SEQ ID NO: 261356 - RNA, 64 nt, hsa; identical to SEQ ID NO: 143082

SEQ ID NO: 261357 - RNA, 64 nt, hsa; identical to SEQ ID NO: 143083

SEQ ID NO: 261358 - RNA, 64 nt, hsa; identical to SEQ ID NO: 143084

SEQ ID NO: 261359 - RNA, 64 nt, hsa; identical to SEQ ID NO: 143085

SEQ ID NO: 261360 - RNA, 64 nt, hsa; identical to SEQ ID NO: 143086

SEQ ID NO: 261361 - RNA, 64 nt, hsa; identical to SEQ ID NO: 143087

SEQ ID NO: 261362 - RNA, 64 nt, hsa; identical to SEQ ID NO: 143088

SEQ ID NO: 261363 - RNA, 64 nt, hsa; identical to SEQ ID NO: 143089

SEQ ID NO: 261364 - RNA, 64 nt, hsa; identical to SEQ ID NO: 143090

SEQ ID NO: 261365 - RNA, 64 nt, hsa; identical to SEQ ID NO: 143091

SEQ ID NO: 261366 - RNA, 64 nt, hsa; identical to SEQ ID NO: 143092

SEQ ID NO: 261367 - RNA, 64 nt, hsa; identical to SEQ ID NO: 143093

SEQ ID NO: 261368 - RNA, 64 nt, hsa; identical to SEQ ID NO: 143094

SEQ ID NO: 261369 - RNA, 64 nt, hsa; identical to SEQ ID NO: 143095

SEQ ID NO: 261370 - RNA, 64 nt, hsa; identical to SEQ ID NO: 143096

SEQ ID NO: 261371 - RNA, 64 nt, hsa; identical to SEQ ID NO: 143097

SEQ ID NO: 261372 - RNA, 64 nt, hsa; identical to SEQ ID NO: 143098

SEQ ID NO: 261373 - RNA, 64 nt, hsa; identical to SEQ ID NO: 143099

SEQ ID NO: 261374 - RNA, 64 nt, hsa; identical to SEQ ID NO: 143100

SEQ ID NO: 261375 - RNA, 64 nt, hsa; identical to SEQ ID NO: 143101

SEQ ID NO: 261376 - RNA, 64 nt, hsa; identical to SEQ ID NO: 143102

SEQ ID NO: 261377 - RNA, 64 nt, hsa; identical to SEQ ID NO: 143103

SEQ ID NO: 261378 - RNA, 64 nt, hsa; identical to SEQ ID NO: 143104

SEQ ID NO: 261379 - RNA, 64 nt, hsa; identical to SEQ ID NO: 143105

SEQ ID NO: 261380 - RNA, 64 nt, hsa; identical to SEQ ID NO: 143106

SEQ ID NO: 261381 - RNA, 64 nt, hsa; identical to SEQ ID NO: 143107

SEQ ID NO: 261382 - RNA, 64 nt, hsa; identical to SEQ ID NO: 143108

SEQ ID NO: 261383 - RNA, 64 nt, hsa; identical to SEQ ID NO: 143109

SEQ ID NO: 261384 - RNA, 64 nt, hsa; identical to SEQ ID NO: 143110

SEQ ID NO: 261385 - RNA, 64 nt, hsa; identical to SEQ ID NO: 143111

SEQ ID NO: 261386 - RNA, 64 nt, hsa; identical to SEQ ID NO: 143112

SEQ ID NO: 261387 - RNA, 64 nt, hsa; identical to SEQ ID NO: 143113

SEQ ID NO: 261388 - RNA, 64 nt, hsa; identical to SEQ ID NO: 143114

SEQ ID NO: 261389 - RNA, 64 nt, hsa; identical to SEQ ID NO: 143115

SEQ ID NO: 261390 - RNA, 64 nt, hsa; identical to SEQ ID NO: 143116

SEQ ID NO: 261391 - RNA, 64 nt, hsa; identical to SEQ ID NO: 143117

SEQ ID NO: 261392 - RNA, 64 nt, hsa; identical to SEQ ID NO: 143118

SEQ ID NO: 261393 - RNA, 64 nt, hsa; identical to SEQ ID NO: 143119

SEQ ID NO: 261394 - RNA, 64 nt, hsa; identical to SEQ ID NO: 143120

SEQ ID NO: 261395 - RNA, 64 nt, hsa; identical to SEQ ID NO: 143121

SEQ ID NO: 261396 - RNA, 64 nt, hsa; identical to SEQ ID NO: 143122

SEQ ID NO: 261397 - RNA, 64 nt, hsa; identical to SEQ ID NO: 143123

SEQ ID NO: 261398 - RNA, 64 nt, hsa; identical to SEQ ID NO: 143124

SEQ ID NO: 261399 - RNA, 64 nt, hsa; identical to SEQ ID NO: 143125

SEQ ID NO: 261400 - RNA, 64 nt, hsa; identical to SEQ ID NO: 143126

SEQ ID NO: 261401 - RNA, 64 nt, hsa; identical to SEQ ID NO: 143127

SEQ ID NO: 261402 - RNA, 64 nt, hsa; identical to SEQ ID NO: 143128

SEQ ID NO: 261403 - RNA, 64 nt, hsa; identical to SEQ ID NO: 143129

SEQ ID NO: 261404 - RNA, 64 nt, hsa; identical to SEQ ID NO: 143130

SEQ ID NO: 261405 - RNA, 64 nt, hsa; identical to SEQ ID NO: 143131

SEQ ID NO: 261406 - RNA, 64 nt, hsa; identical to SEQ ID NO: 143132

SEQ ID NO: 261407 - RNA, 64 nt, hsa; identical to SEQ ID NO: 143133

SEQ ID NO: 261408 - RNA, 64 nt, hsa; identical to SEQ ID NO: 143134

SEQ ID NO: 261409 - RNA, 64 nt, hsa; identical to SEQ ID NO: 143135

SEQ ID NO: 261410 - RNA, 64 nt, hsa; identical to SEQ ID NO: 143136

SEQ ID NO: 261411 - RNA, 64 nt, hsa; identical to SEQ ID NO: 143137

SEQ ID NO: 261412 - RNA, 64 nt, hsa; identical to SEQ ID NO: 143138

SEQ ID NO: 261413 - RNA, 64 nt, hsa; identical to SEQ ID NO: 143139

SEQ ID NO: 261414 - RNA, 64 nt, hsa; identical to SEQ ID NO: 143140

SEQ ID NO: 261415 - RNA, 64 nt, hsa; identical to SEQ ID NO: 143141

SEQ ID NO: 261416 - RNA, 64 nt, hsa; identical to SEQ ID NO: 143142

SEQ ID NO: 261417 - RNA, 64 nt, hsa; identical to SEQ ID NO: 143143

SEQ ID NO: 261418 - RNA, 64 nt, hsa; identical to SEQ ID NO: 143144

SEQ ID NO: 261419 - RNA, 64 nt, hsa; identical to SEQ ID NO: 143145

SEQ ID NO: 261420 - RNA, 64 nt, hsa; identical to SEQ ID NO: 143146

SEQ ID NO: 261421 - RNA, 64 nt, hsa; identical to SEQ ID NO: 143147

SEQ ID NO: 261422 - RNA, 64 nt, hsa; identical to SEQ ID NO: 143148

SEQ ID NO: 261423 - RNA, 64 nt, hsa; identical to SEQ ID NO: 143149

SEQ ID NO: 261424 - RNA, 64 nt, hsa; identical to SEQ ID NO: 143150

SEQ ID NO: 261425 - RNA, 64 nt, hsa; identical to SEQ ID NO: 143151

SEQ ID NO: 261426 - RNA, 64 nt, hsa; identical to SEQ ID NO: 143152

SEQ ID NO: 261427 - RNA, 64 nt, hsa; identical to SEQ ID NO: 143153

SEQ ID NO: 261428 - RNA, 64 nt, hsa; identical to SEQ ID NO: 143154

SEQ ID NO: 261429 - RNA, 64 nt, hsa; identical to SEQ ID NO: 143155

SEQ ID NO: 261430 - RNA, 64 nt, hsa; identical to SEQ ID NO: 143156

SEQ ID NO: 261431 - RNA, 64 nt, hsa; identical to SEQ ID NO: 143157

SEQ ID NO: 261432 - RNA, 64 nt, hsa; identical to SEQ ID NO: 143158

SEQ ID NO: 261433 - RNA, 64 nt, hsa; identical to SEQ ID NO: 143159

SEQ ID NO: 261434 - RNA, 64 nt, hsa; identical to SEQ ID NO: 143160

SEQ ID NO: 261435 - RNA, 64 nt, hsa; identical to SEQ ID NO: 143161

SEQ ID NO: 261436 - RNA, 64 nt, hsa; identical to SEQ ID NO: 143162

SEQ ID NO: 261437 - RNA, 64 nt, hsa; identical to SEQ ID NO: 143163

SEQ ID NO: 261438 - RNA, 64 nt, hsa; identical to SEQ ID NO: 143164

SEQ ID NO: 261439 - RNA, 64 nt, hsa; identical to SEQ ID NO: 143165

SEQ ID NO: 261440 - RNA, 64 nt, hsa; identical to SEQ ID NO: 143166

SEQ ID NO: 261441 - RNA, 64 nt, hsa; identical to SEQ ID NO: 143167

SEQ ID NO: 261442 - RNA, 64 nt, hsa; identical to SEQ ID NO: 143168

SEQ ID NO: 261443 - RNA, 64 nt, hsa; identical to SEQ ID NO: 143169

SEQ ID NO: 261444 - RNA, 64 nt, hsa; identical to SEQ ID NO: 143170

SEQ ID NO: 261445 - RNA, 64 nt, hsa; identical to SEQ ID NO: 143171

SEQ ID NO: 261446 - RNA, 64 nt, hsa; identical to SEQ ID NO: 143172

SEQ ID NO: 261447 - RNA, 64 nt, hsa; identical to SEQ ID NO: 143173

SEQ ID NO: 261448 - RNA, 64 nt, hsa; identical to SEQ ID NO: 143174

SEQ ID NO: 261449 - RNA, 64 nt, hsa; identical to SEQ ID NO: 143175

SEQ ID NO: 261450 - RNA, 64 nt, hsa; identical to SEQ ID NO: 143176

SEQ ID NO: 261451 - RNA, 64 nt, hsa; identical to SEQ ID NO: 143177

SEQ ID NO: 261452 - RNA, 64 nt, hsa; identical to SEQ ID NO: 143178

SEQ ID NO: 261453 - RNA, 64 nt, hsa; identical to SEQ ID NO: 143179

SEQ ID NO: 261454 - RNA, 64 nt, hsa; identical to SEQ ID NO: 143180

SEQ ID NO: 261455 - RNA, 64 nt, hsa; identical to SEQ ID NO: 143181

SEQ ID NO: 261456 - RNA, 64 nt, hsa; identical to SEQ ID NO: 143182

SEQ ID NO: 261457 - RNA, 64 nt, hsa; identical to SEQ ID NO: 143183

SEQ ID NO: 261458 - RNA, 64 nt, hsa; identical to SEQ ID NO: 143184

SEQ ID NO: 261459 - RNA, 64 nt, hsa; identical to SEQ ID NO: 143185

SEQ ID NO: 261460 - RNA, 64 nt, hsa; identical to SEQ ID NO: 143186

SEQ ID NO: 261461 - RNA, 64 nt, hsa; identical to SEQ ID NO: 143187

SEQ ID NO: 261462 - RNA, 64 nt, hsa; identical to SEQ ID NO: 143188

SEQ ID NO: 261463 - RNA, 64 nt, hsa; identical to SEQ ID NO: 143189

SEQ ID NO: 261464 - RNA, 64 nt, hsa; identical to SEQ ID NO: 143190

SEQ ID NO: 261465 - RNA, 64 nt, hsa; identical to SEQ ID NO: 143191

SEQ ID NO: 261466 - RNA, 64 nt, hsa; identical to SEQ ID NO: 143192

SEQ ID NO: 261467 - RNA, 64 nt, hsa; identical to SEQ ID NO: 143193

SEQ ID NO: 261468 - RNA, 64 nt, hsa; identical to SEQ ID NO: 143194

SEQ ID NO: 261469 - RNA, 64 nt, hsa; identical to SEQ ID NO: 143195

SEQ ID NO: 261470 - RNA, 64 nt, hsa; identical to SEQ ID NO: 143196

SEQ ID NO: 261471 - RNA, 64 nt, hsa; identical to SEQ ID NO: 143197

SEQ ID NO: 261472 - RNA, 64 nt, hsa; identical to SEQ ID NO: 143198

SEQ ID NO: 261473 - RNA, 64 nt, hsa; identical to SEQ ID NO: 143199

SEQ ID NO: 261474 - RNA, 64 nt, hsa; identical to SEQ ID NO: 143200

SEQ ID NO: 261475 - RNA, 64 nt, hsa; identical to SEQ ID NO: 143201

SEQ ID NO: 261476 - RNA, 64 nt, hsa; identical to SEQ ID NO: 143202

SEQ ID NO: 261477 - RNA, 64 nt, hsa; identical to SEQ ID NO: 143203

SEQ ID NO: 261478 - RNA, 64 nt, hsa; identical to SEQ ID NO: 143204

SEQ ID NO: 261479 - RNA, 64 nt, hsa; identical to SEQ ID NO: 143205

SEQ ID NO: 261480 - RNA, 64 nt, hsa; identical to SEQ ID NO: 143206

SEQ ID NO: 261481 - RNA, 64 nt, hsa; identical to SEQ ID NO: 143207

SEQ ID NO: 261482 - RNA, 64 nt, hsa; identical to SEQ ID NO: 143208

SEQ ID NO: 261483 - RNA, 64 nt, hsa
ugaaaucauccauuuggggacaaauccacauuggggucuagaaacauccacguaucucaucagc

SEQ ID NO: 261484 - RNA, 64 nt, hsa
uucaggaaaugaaaggugaauuaugccccuuauuggucuagaagcauugguuuuuuuuugaucc

SEQ ID NO: 261485 - RNA, 64 nt, hsa
aaaacaacauuggccuuuuguaucucacaauucuggucuagauucaguuaugaauguaggcauu

SEQ ID NO: 261486 - RNA, 62 nt, hsa
aagagaaguuggagcaaugaauguagaauaagggucuagaaaguccucccuggcagcuucuu

SEQ ID NO: 261487 - RNA, 64 nt, hsa
uauugccucuuauaucucugcucuuugaccucaaggucuagaggucugcaguaagccaagaaac

SEQ ID NO: 261488 - RNA, 64 nt, hsa
gcuuccugagggccaaggcauugcuguaagaaaaggucuagaaauaggugaaagugagaggugg

SEQ ID NO: 261489 - RNA, 64 nt, hsa
gaguuggcauuguacagaaauuaacagccauauuggucuagaaacguuaaacuuaauuuuuuuc

SEQ ID NO: 261490 - RNA, 64 nt, hsa
uucaugaucccaccauggucauaucuugaaguauggucuagaaaagucccuuauuauuuuauuu

SEQ ID NO: 261491 - RNA, 64 nt, hsa
gugugucuuacccagcuacacagggugacauuuuggucuagaaccuagucucaugagcccuuug

SEQ ID NO: 261492 - RNA, 64 nt, hsa
ccgauccuggccgaggugaggaacagacagggggggucuagauucugaggggguugguggauau

SEQ ID NO: 261493 - RNA, 64 nt, hsa
ccaaauggaguguuggaaaauguucuuucugcagggucuagagacugcugggacacuuuucuug

SEQ ID NO: 261494 - RNA, 64 nt, hsa
auuuagguagggaggcauguugaaugagccaggaggucuagaacuggagcuuaguccagcuggu

SEQ ID NO: 261495 - RNA, 64 nt, hsa
gucuccuuuagcccgguuuguuucucccugcucaggucuagaaucccaagcaguguucuuuucu

SEQ ID NO: 261496 - RNA, 64 nt, hsa
uaagcagaagacucuccacugaccugguuguccaggucuagaaggccaggccucuacuaggucu

SEQ ID NO: 261497 - RNA, 64 nt, hsa
aaaguuuuaacugaaauauuuauuuagauuucagggucuagauggaugggaaaguagaaaaaca

SEQ ID NO: 261498 - RNA, 64 nt, hsa
uuccaucuguuuggcuuuuucccucagggaacuuggucuagaaggcacugggaagcucaucaga

SEQ ID NO: 261499 - RNA, 64 nt, hsa
uuaguuguacacuuuuaguagucauagugaagcaggucuagaaaauaagccuuuggcagggaaa

SEQ ID NO: 261500 - RNA, 64 nt, hsa
caaagagggucgaccugcaaacuugcaaggucacggucuagaucacauucucgauccagaggaa

SEQ ID NO: 261501 - RNA, 64 nt, hsa
aguauccguccugaacggggccuagucaggaagcggucuagaaguguacggucacggucgccuc

SEQ ID NO: 261502 - RNA, 64 nt, hsa
uagcacagugauaucaccaugacuucacagacauggucuagaaucuguacccuuacccacauau

SEQ ID NO: 261503 - RNA, 64 nt, hsa
gaagcccauuccucugccaggcucuaaagccaaaggucuagaaaagcauccugucuggcauuuu

SEQ ID NO: 261504 - RNA, 64 nt, hsa
aacauuugccauguugaagaguguguauaggaaaggucuagaaauaaauaggcuugugcauacc

SEQ ID NO: 261505 - RNA, 64 nt, hsa
uguguggcagguggcugcccuauuggauagcacaggucuagagaaaugauaccuuuuuuuuuuu

SEQ ID NO: 261506 - RNA, 64 nt, hsa
uuuguguuauuucaguaaaaguuauggaguuaugggucuagacguguuaauaaguuagacagaa

SEQ ID NO: 261507 - RNA, 64 nt, hsa
gaggggcacagauugaacugcugaacuaguuggaggucuagaugaggugcuuuacgcaucagcu

SEQ ID NO: 261508 - RNA, 64 nt, hsa
aguaugaacaauuagucuaacucugcauagacagggucuagauuuuguuaacccaaauguauaa

SEQ ID NO: 261509 - RNA, 64 nt, hsa
gcauacauuuauaugaauauauuuugauaacguaggucuagagcuucuuuuauauucaagcuaa

SEQ ID NO: 261510 - RNA, 64 nt, hsa
ucucacaaaaacuuguaagguaaaggccuaacuuggucuagaauaugacacuuauuguggugga

SEQ ID NO: 261511 - RNA, 64 nt, hsa
agaagugcaauuuagcuuaaauggguguaugaauggucuagaaacauuucuauuuuuuuuuuaa

SEQ ID NO: 261512 - RNA, 64 nt, hsa
ccacuuuuuacucucccuccugaccaguccagcuggucuagagaaagccuuguuuuuucccaga

SEQ ID NO: 261513 - RNA, 64 nt, hsa
acuuuuaaggaguaauuugaauauuaauaacucuggucuagauuuucauauaauguauuaaaga

SEQ ID NO: 261514 - RNA, 64 nt, hsa
cgaucucugagaaguuauguugcaccacugugaaggucuagaugcaagcuuggcucccucagaa

SEQ ID NO: 261515 - RNA, 64 nt, hsa
caauagcauaaauguccuuuuuccccccaaauauggucuagaugaguuauuauaaacauuguuu

SEQ ID NO: 261516 - RNA, 64 nt, hsa
caccccuuucucauccccauuugcaggggcuaaaggucuagaugagacuuggaaggcaaggagc

SEQ ID NO: 261517 - RNA, 64 nt, hsa
aauucaugagagaugaaugacagaugcucucaugggucuagauauugaggaguuuuucugaggg

SEQ ID NO: 261518 - RNA, 64 nt, hsa
cucuaucuuguuuuuuguuuuuucuucuggggggggucuagaacagugccuggcacauaguagg

SEQ ID NO: 261519 - RNA, 64 nt, hsa
uaaugagucucuuggcccacuggucccacuugggggucuagaccaggauuauagaggacacagc

SEQ ID NO: 261520 - RNA, 64 nt, hsa
uacuaaaagcacuuuccauuauauacuuuuuaaaggucuagauaauuuugaaccaauuuauuau

SEQ ID NO: 261521 - RNA, 64 nt, hsa
aguagagacagcguuucaccauguuagcuaggauggucuagaucuccugaccuugugaucugcc

SEQ ID NO: 261522 - RNA, 64 nt, hsa
uuuuuuguuuuguuuuuuuucuccagagcacuuuggucuagacuaggcuuugggugguuccaau

SEQ ID NO: 261523 - RNA, 64 nt, hsa
guaaggacaguuucgguaguuaaguggaauuaaaggucuagagugauuuguauuggaugguaac

SEQ ID NO: 261524 - RNA, 64 nt, hsa
uuccagcaugagguaucuaaggauuuagaccagaggucuagauuaauacucuauuuuuacauuu

SEQ ID NO: 261525 - RNA, 64 nt, hsa
cuaagugcaaacacagcauggguccagaagacguggucuagaccagggcugcucuuuccacuug

SEQ ID NO: 261526 - RNA, 64 nt, hsa
cuucccaccuccccuucaguucagagccaaaaugggucuagaaucuggcacuuuacucauuucc

SEQ ID NO: 261527 - RNA, 64 nt, hsa
uucagaugagucuuuucaacauggucuucaacauggucuagagcuuaccagugaucuucugauc

SEQ ID NO: 261528 - RNA, 64 nt, hsa
uuccuauacucuuguuuccucugcuucuuccugaggucuagaacaaggucuggaaauguuuaga

SEQ ID NO: 261529 - RNA, 64 nt, hsa
uucuagcaaguuuccaggugaugcuguuguugcuggucuagagacuauuuugagaaccacuguc

SEQ ID NO: 261530 - RNA, 64 nt, hsa
agagggagaauggagcaggaggaaaagcagaguuggucuagagaggaggagggcggggcuggag

SEQ ID NO: 261531 - RNA, 64 nt, hsa
ucagucugcaggaauuguuaccucacucccacagggucuagacuagaaauccaucaucucuauc

SEQ ID NO: 261532 - RNA, 64 nt, hsa
uuagaacgcgcucuacauccgcuuuaaagacagaggucuagacgugagauccgcgucgggacag

SEQ ID NO: 261533 - RNA, 64 nt, hsa
uugucgcauguugaccuacguuaaaagaugaauaggucuagagccgugauuucaagcuauuuuc

SEQ ID NO: 261534 - RNA, 64 nt, hsa
ugaaaccuggagcugggaauugcggagaagggaaggucuagacuaguuacaucacauagggauu

SEQ ID NO: 261535 - RNA, 64 nt, hsa
gaagccgcuucccagacugucagggccaggccugggucuagaauucuugcugcugcuuugcaga

SEQ ID NO: 261536 - RNA, 64 nt, hsa
acccuucuccagagauuaugggguuggggguggaggucuagaggugagcucagaaaccuacugu

SEQ ID NO: 261537 - RNA, 64 nt, hsa
uuuuugauucugaaguucagcaucuaaagcagcaggucuagaagaacaacgguuuauucauacu

SEQ ID NO: 261538 - RNA, 64 nt, hsa
augaauuaagacguuuuaauuucuuugcagacaaggucuagaugcggagucagagaugggacug

SEQ ID NO: 261539 - RNA, 64 nt, hsa
aaaauucaaacuucagaaaugaaauccaaagcuuggucuagagugaaaaacaacaaauucaguu

SEQ ID NO: 261540 - RNA, 64 nt, hsa
gauguuucauuuuaugaauggaggcacuuuacuaggucuagaauauuuuuuuaaaagccucuga

SEQ ID NO: 261541 - RNA, 64 nt, hsa
uugaaugagagcaguggacacaucucagcaggucggucuagagaguugcgaaucuaaaccuggg

SEQ ID NO: 261542 - RNA, 64 nt, hsa
ccugacccguauagugugccacaggaccugggucggucuagaacucucucaggaugccuuuucu

SEQ ID NO: 261543 - RNA, 64 nt, hsa
cuugaguagaaugaaggccugcuagcacuagcguggucuagaaugaaggccugcuagcacuagc

SEQ ID NO: 261544 - RNA, 64 nt, hsa
gauauaccucuguuuucacgauagaaauaagggaggucuagagcuucuauuccuuggccauugu

SEQ ID NO: 261545 - RNA, 64 nt, hsa
ccagaugaggaaauggcaguucugagaagucacuggucuagaucccgcagguggcacgugacag

SEQ ID NO: 261546 - RNA, 64 nt, hsa
ucacuguuucuacggcuagacaaauaugacugguggucuagacuacccauaguucauccuccuc

SEQ ID NO: 261547 - RNA, 64 nt, hsa
uggacuauucaggugaacuauuugagggguauggggucuagaaguuaaaagauacgcaugucuu

SEQ ID NO: 261548 - RNA, 64 nt, hsa
gccccagggaacuaaagggugugggucagggaggggucuagaggcuauuccuaggccucaggcc

SEQ ID NO: 261549 - RNA, 64 nt, hsa
cuagacuaaacaaaguauaaguuugaaaugaaauggucuagagggaaaugauucaaauuuuuuc

SEQ ID NO: 261550 - RNA, 64 nt, hsa
uuaauuucacaaacaucaggcaauuuccaggguuggucuagagucuugccacuaaauauugauc

SEQ ID NO: 261551 - RNA, 64 nt, hsa
aucaacauuuuuugugcuuuaaacuguaguaguuggucuagaaacaaaauacuccaagaaaaag

SEQ ID NO: 261552 - RNA, 64 nt, hsa
ccacaguguaaugauuacaaauauccuaguguccggucuagaaagacuuucuaggagaagacua

SEQ ID NO: 261553 - RNA, 64 nt, hsa
acugcaguauugauguuuuacugcaaaucuuaugggucuagauaaucaguaaaagccaucuucc

SEQ ID NO: 261554 - RNA, 64 nt, hsa
cguucucccaaguaccauucgucauccaaguccaggucuagaucacacucaaaagcaaagcauu

SEQ ID NO: 261555 - RNA, 64 nt, hsa
cuggggaugaaaucccacauccucccaagugacuggucuagaaauaaucuugaccuugacuuug

SEQ ID NO: 261556 - RNA, 64 nt, hsa
cuuuaaauucucaguuaucaacgccaagguuuaaggucuagauaggguuugcuauaggguuugc

SEQ ID NO: 261557 - RNA, 64 nt, hsa
cugaaagaauguagccucugcauuaaugguaaauggucuagaaguuuucguuuccacugaggcu

SEQ ID NO: 261558 - RNA, 64 nt, hsa
gacaguuaucccagggagcgugagaaaaucccugggucuagaaugggaacuggagaggacccug

SEQ ID NO: 261559 - RNA, 64 nt, hsa
uucccuuccuuuuugcaggcccauggucagcucuggucuagauguaucuaggcuuagggagccc

SEQ ID NO: 261560 - RNA, 64 nt, hsa
gugaggguggauuauuggauugucauuagaggaaggucuagauuuccugcucuuaauaaaauua

SEQ ID NO: 261561 - RNA, 64 nt, hsa
agcuuauaaagcacaaagcauacauuuccugacuggucuagagaacugauguuucaauuuaccc

SEQ ID NO: 261562 - RNA, 64 nt, hsa
auuuuggcuugugagcccugcuuauuuggagccgggucuagagggaacccucuaucagccucag

SEQ ID NO: 261563 - RNA, 64 nt, hsa
ucuuguugcuuuuguauuaggaguuccccgugugggucuagaacuccccuuugguaaugcuucu

SEQ ID NO: 261564 - RNA, 64 nt, hsa
ugcugauugguacauaaaucuuuuacauggccuuggucuagaggaggcaggcuuuuagaaucau

SEQ ID NO: 261565 - RNA, 64 nt, hsa
auugaaaaacuauuuuuugauuuuugcauuaaguggucuagaauucuuuugcaaugcauuugca

SEQ ID NO: 261566 - RNA, 64 nt, hsa
ugaucaguuggccaccucuagaucuguguuugccggucuagacguuaucggugcacuuccuuga

SEQ ID NO: 261567 - RNA, 64 nt, hsa
cugggauauguuuacuauaaggaaaagacacugaggucuagaaauagcuccguggagcagaauc

SEQ ID NO: 261568 - RNA, 64 nt, hsa
aaauucauuguauugaucagcauuuuuccuaagaggucuagaaaugcuuaaacuauugaaaaua

SEQ ID NO: 261569 - RNA, 64 nt, hsa
acauaaguaaccauugaacauuaauuugauaauaggucuagagacucuaaaaacuaaccaaacu

SEQ ID NO: 261570 - RNA, 64 nt, hsa
ccagaaauggugcucaccaugcuuccagcuaacaggucuagaaaaccagcuugcgaauaacagu

SEQ ID NO: 261571 - RNA, 64 nt, hsa
uauucaucuaguccccugggggaggggaagggugggucuagacauacuauauucagagaacuau

SEQ ID NO: 261572 - RNA, 64 nt, hsa
auuucugcccugagcccuccacgucagugccaucggucuagaaccacuaaccccgcauugcugu

SEQ ID NO: 261573 - RNA, 64 nt, hsa
ucgcugcuagagaagggggauuggagggaagacaggucuagacuuucucagugggacaaaccag

SEQ ID NO: 261574 - RNA, 64 nt, hsa
caugcccagcuggcauuuguuaaucuucauuugaggucuagaucuaggcacuguggacacugaa

SEQ ID NO: 261575 - RNA, 64 nt, hsa
uuuuuuuagggcuugugcccuguuucacuuauagggucuagaaugcuuguguugaguaaaaagg

SEQ ID NO: 261576 - RNA, 64 nt, hsa
aaaaaggaaagguucuuccaggcgagaaaccuguggucuagaaccacagcaagaagaggaggca

SEQ ID NO: 261577 - RNA, 64 nt, hsa
acaucuggccuugaaaccaccuuuuauuacauggggucuagaacuugacccccuugagggugcu

SEQ ID NO: 261578 - RNA, 64 nt, hsa
cagccaaccauaaucagcaugucugggauagacuggucuagaauaaaaaugaaguuuccauugc

SEQ ID NO: 261579 - RNA, 64 nt, hsa
ugguauuucggaaacuaaaguccuuaugggauggggucuagaauugauucuccuuuccugaguu

SEQ ID NO: 261580 - RNA, 64 nt, hsa
cccaccccacccuugucccuggccauugccugguggucuagaaacacuuaaaacuugaaguagu

SEQ ID NO: 261581 - RNA, 64 nt, hsa
gaagacgggcucccuccucccccaccuggccccuggucuagaaggacccacugcaccacccucc

SEQ ID NO: 261582 - RNA, 64 nt, hsa
auguucuaaguuucuaagauucuaaagguccacaggucuagacuauuaggugcaauuucaaggu

SEQ ID NO: 261583 - RNA, 64 nt, hsa
ccuuuuauuuucccccuuuucacagagaaauaaaggucuagaaguaguugguccucuggccuua

SEQ ID NO: 261584 - RNA, 64 nt, hsa
agagggugugggaugaggcuucccagagacccugggucuagaaagcggcuccugaaggucccuu

SEQ ID NO: 261585 - RNA, 64 nt, hsa
aagcaggguuuucauuuuuacucuccuugguuuaggucuagaaagaagaauacugaccugagag

SEQ ID NO: 261586 - RNA, 64 nt, hsa
gggaguaggcggacagccagggcgcuugaccacuggucuagagcccugugguccccuggagccu

SEQ ID NO: 261587 - RNA, 64 nt, hsa
aaguuaaagugaggccacugaagaggaggaggagggucuagaggccugaaauccugguuccuag

SEQ ID NO: 261588 - RNA, 64 nt, hsa
agggacucuccaaacgggauacaggagagaagcuggucuagacuguuugcugauccccaaccug

SEQ ID NO: 261589 - RNA, 64 nt, hsa
agcuuuuuuucuugcuaguauucgcuguguucauggucuagaaaugcggucuggucucgccucg

SEQ ID NO: 261590 - RNA, 64 nt, hsa
uuguaagcacugacugggaccaggcaccaggcagggucuagaaggcuguggugagggaagacgc

SEQ ID NO: 261591 - RNA, 64 nt, hsa
gaaggaagugauccacagcauucaggccacuuggggucuagaccaugguggugccagccugggg

SEQ ID NO: 261592 - RNA, 64 nt, hsa
ggcuggcccagcugacugaggguacacaggauugggucuagaccuugaugccuggguggagggc

SEQ ID NO: 261593 - RNA, 64 nt, hsa
cauucucugccagggacccaugagcaggcugcauggucuagagguugugggcagcauggacagu

SEQ ID NO: 261594 - RNA, 64 nt, hsa
uggacggggcucuuuugcuucccccucaaucuggggucuagaguugugcaaggaauucagcucc

SEQ ID NO: 261595 - RNA, 64 nt, hsa
agggccgucuccauuuuaugguugaggaaacugaggucuagagaggucaagauuacuugcccag

SEQ ID NO: 261596 - RNA, 64 nt, hsa
guauucagguccaagguucugcccuuccuugaguggucuagaaggcacugcguggccccucaga

SEQ ID NO: 261597 - RNA, 64 nt, hsa
uuuucuguaacuacagcuuggaaacuaugcaaauggucuagauuccucagagcucacaugauag

SEQ ID NO: 261598 - RNA, 64 nt, hsa
acugacagcagcuccuucuggacccagucuggaaggucuagagggggauagaauuuuuauuuca

SEQ ID NO: 261599 - RNA, 64 nt, hsa
guuccauuacaccacagcauuguguggaauuugaggucuagagagaaccaauaaaagugguaau

SEQ ID NO: 261600 - RNA, 62 nt, hsa
uaugauucuauggagcuauuuuaaaccaauugcaggucuagauaccuccuucucagcacuau

SEQ ID NO: 261601 - RNA, 64 nt, hsa
cauguaaaaucuggugauacugaauaaagucuguggucuagauagcaguauaauauuauuguca

SEQ ID NO: 261602 - RNA, 64 nt, hsa
uuacuucuagucagucauccaggcuuaccugcuuggucuagaauggauuuuucccggagccgga

SEQ ID NO: 261603 - RNA, 64 nt, hsa
ccugacuguugugaaggccaaggggcagccagacuugccagaggggucucuccccauagccaca

SEQ ID NO: 261604 - RNA, 64 nt, hsa
acacgcucggcugcccaaacccaaggcgaagaccuugccagaguucaucaaggauggcuccagu

SEQ ID NO: 261605 - RNA, 64 nt, hsa
uuaagaugauaagaaagugcuccugagaaggcucuugccagaagccugaugugaguguguggca

SEQ ID NO: 261606 - RNA, 64 nt, hsa
uaucuuugagaugauaaagcuaaauuauagucuuuugccagagaaacugagguaacugucauua

SEQ ID NO: 261607 - RNA, 64 nt, hsa
gcagacuggucaaugggggaugacgguggggagguugccagaugugagacuugaguagcauuug

SEQ ID NO: 261608 - RNA, 64 nt, hsa
cagccuuucuacuugaucuccagcccccaggucuuugccagaugaugggaaggcaaggaagaag

SEQ ID NO: 261609 - RNA, 64 nt, hsa
ggggguggggggauugggguggacucaggguaucuugccagagauaccuguuuugaugaguacc

SEQ ID NO: 261610 - RNA, 64 nt, hsa
cccacccgguguguccagaagaccagccucuuucuugccagaagcaggugcuaagauggacugc

SEQ ID NO: 261611 - RNA, 64 nt, hsa
ugcucugcucguggccccaaagaaccaucucuacuugccagaguauguuccaccacccaagcag

SEQ ID NO: 261612 - RNA, 64 nt, hsa
agagcccucagccauuuuuucaguuaaaguuagguugccagaacuuucuuuuccuugcccccug

SEQ ID NO: 261613 - RNA, 64 nt, hsa
agcugccuggaacagagccugcgggaaacggggcuugccagagacacucacaguuuccuucaug

SEQ ID NO: 261614 - RNA, 64 nt, hsa
uuguugcaggagggggugggaaucuuaggauuuguugccagauuugaaagucacuggaacuugc

SEQ ID NO: 261615 - RNA, 64 nt, hsa
accagagcugugaucucucgguggggggcccaucucugcugaccuggguguggcggagggagag

SEQ ID NO: 261616 - RNA, 64 nt, hsa
gcucagucacguccacgggggacgagccguggguucugcugaguagguggagcucauugcuuuc

SEQ ID NO: 261617 - RNA, 64 nt, hsa
ucaaacugcucaaagugacggguucuugguugucucugcugagcacgcugugucaauggagaug

SEQ ID NO: 261618 - RNA, 64 nt, hsa
cucugcugagcacgcugugucaauggagauggccucugcugacucagaugaagacccaaggcau

SEQ ID NO: 261619 - RNA, 64 nt, hsa
ggaggagguggugccaggagccugcccgcuuaccucugcugaagcauaaguggacuuugcuuuu

SEQ ID NO: 261620 - RNA, 64 nt, hsa
uaggaagucagaaaagacuuguguuugucuuuguucugcugauguggagucauguuuugugggg

SEQ ID NO: 261621 - RNA, 64 nt, hsa
gcacacaugaaaagccaaauuauggcuuggauguucugcugaaacuggucuaugucauacuguc

SEQ ID NO: 261622 - RNA, 64 nt, hsa
accucgggauugguaucaaaggcuuccacugccuucugcugaaggcaugauguaugcggcucca

SEQ ID NO: 261623 - RNA, 64 nt, hsa
cgucuaucugcuucugugcugaacgccuuucccaucugcugacguaggcccagggcugcccugc

SEQ ID NO: 261624 - RNA, 64 nt, hsa
ccucgggccugagggccaggccggagcccaggucucugcugacaauggggguucaaggaagacg

SEQ ID NO: 261625 - RNA, 64 nt, hsa
cacuuuccccuggcugcuguuguaaucuacuuguucugcugacgcccgaacugacuucuuuccc

SEQ ID NO: 261626 - RNA, 64 nt, hsa
cugcuucuucuauauuaugagccuuccucaagugucugcugauucuugguuauccaaucauagu

SEQ ID NO: 261627 - RNA, 64 nt, hsa
agaagggaaaagcaaaaauuauccuugugaaauaucugcugauugugcccuacucuuugcaccu

SEQ ID NO: 261628 - RNA, 64 nt, hsa
agggagugagacauuuuugggagcagaggaaaacucugcugauguucgguccuggcaaacauug

SEQ ID NO: 261629 - RNA, 64 nt, hsa
ggcccugugggauccuccguguuccucggcggacucugcugaccuccugcagacccaaaccaca

SEQ ID NO: 261630 - RNA, 64 nt, hsa
cgggguaguacugggaagcaggaggcagaauggcucugcugagccuccuacccaugacaacacc

SEQ ID NO: 261631 - RNA, 64 nt, hsa
ggguaaagcaagaaccugaacauuuuggagccuuucugcugagcuagaccaucuuuauaacacu

SEQ ID NO: 261632 - RNA, 64 nt, hsa
aaaggcacuaguuuuaagugcacagcucauaaauucugcugacauuuuggauuaaccuuaugua

SEQ ID NO: 261633 - RNA, 64 nt, hsa
gcccaaucccugaucccugaucccuuccaccugcucugcugaugacccccccagcuucacuucu

SEQ ID NO: 261634 - RNA, 64 nt, hsa
ccacccuguuuugagcccugaggaggccuugggcucugcugaguccgaccuggccugucuguga

SEQ ID NO: 261635 - RNA, 64 nt, hsa
ccagugggaacaauacacugcauuacuguucuauacauaugaaaaccuaauaauauaagucuua

SEQ ID NO: 261636 - RNA, 64 nt, hsa
guuucuuguguauccuuucagaauauuuuaauguacauaugacauguguauaugccuaugguau

SEQ ID NO: 261637 - RNA, 64 nt, hsa
aaucauucuguccaauccagccaagguucccuccacauaugaagauggaccauggcaggauaca

SEQ ID NO: 261638 - RNA, 64 nt, hsa
guggcaccauguauuagcagugggaauauguaucacauaugaugcagccuuucauauuucagca

SEQ ID NO: 261639 - RNA, 64 nt, hsa
uccuaauaccaucacauugaggauuaggauuuuaacauaugaauuuugggggggaugcaaucau

SEQ ID NO: 261640 - RNA, 64 nt, hsa
gauacccuacaccaaccagauuuucaacugcuggacauaugaaugaagcuauccuaggcaugca

SEQ ID NO: 261641 - RNA, 64 nt, hsa
gcugccuagcauacaucaguauguaauguaaaagacauaugagcaagaaaaaagugauuuaacu

SEQ ID NO: 261642 - RNA, 64 nt, hsa
gauauagucacugaaucaaugagaaaaauaaugaacauaugaauaccaccuaaaaauacacuga

SEQ ID NO: 261643 - RNA, 64 nt, hsa
guuaccucaguggcuaccaacccauucaaagaggacauaugauucuuuccaagaugaacuugaa

SEQ ID NO: 261644 - RNA, 64 nt, hsa
agcaauggaaaagcaguuaccucauucaaagaagacauaugacucuuuccaagaugaacuugaa

SEQ ID NO: 261645 - RNA, 64 nt, hsa
ggcccugagcccacggaaaaggccagguagaccuccaaacuagaaaugcuggcugauuugcccu

SEQ ID NO: 261646 - RNA, 64 nt, hsa
ggucagauuuauuucagucagugcaagucacacuccaaacuaaaggcugggcagugcguuuagu

SEQ ID NO: 261647 - RNA, 64 nt, hsa
ugaguaacaaaauaaaguaguauuggguuauaacccaaacuauauaauaaauauuuacaagccc

SEQ ID NO: 261648 - RNA, 64 nt, hsa
uauaacccaaacuauauaauaaauauuuacaagcccaaacuaauauaaaugauugaaugggaac

SEQ ID NO: 261649 - RNA, 64 nt, hsa
ucuuuggggaaaaauucuugguuauucugccauaacagauuauguauuaacuuguagauucagu

SEQ ID NO: 261650 - RNA, 64 nt, hsa
uauuuuccaccuuuuguuuuuccaguuccaggacacagauuaucaacuggggggaccaaauagc

SEQ ID NO: 261651 - RNA, 64 nt, hsa
aggugcaauuaucacauuguuuauuaauuguauaacagauuauuacuagaaagguuuuuguugc

SEQ ID NO: 261652 - RNA, 64 nt, hsa
gaaaaauaaggucaggagaaaaagaauaaugccuacagauuauccuucagaugcuggcuagaau

SEQ ID NO: 261653 - RNA, 64 nt, hsa
acgaggggaacuguauaaagacauacuaaagggaacagauuaaaauaaguauuauuaauaaaau

SEQ ID NO: 261654 - RNA, 64 nt, hsa
aaaugucuauaucuuguuacuuacaaaauaaaaaacagauuaauuaguggcuuuuaaauuguag

SEQ ID NO: 261655 - RNA, 64 nt, hsa
ccacagcaucagcaugguuuaggggaagcaauucacagauuaauguacccugcguuuugucuuc

SEQ ID NO: 261656 - RNA, 64 nt, hsa
uaguaaauguauguuuacaggguuuaucauguuuacagauuaagcuaauuucuguagucgcauu

SEQ ID NO: 261657 - RNA, 64 nt, hsa
guaggaauggaagaugguaucuuuuauaugcuaaacagauuagaaaauuaacauaggauacuuu

SEQ ID NO: 261658 - RNA, 64 nt, hsa
uauaaucauucccuuaaaaaguuggaaaaucauuacagauuaaaauuucuuuauaaaguucacc

SEQ ID NO: 261659 - RNA, 61 nt, hsa
ggcucuccagaaccuucuaucccacagucaggccccagagagggcaggacaagccuugucc

SEQ ID NO: 261660 - RNA, 61 nt, hsa
cugggauuacaggugugagcuacugcgcccagccccagaaaucucagugcuguuuggagcu

SEQ ID NO: 261661 - RNA, 61 nt, hsa
ccugcagucagcucggccuccccgaccugcagccccagacucugcucucccagcacugacu

SEQ ID NO: 261662 - RNA, 61 nt, hsa
caguucuggguuaucuccucucauacaucaagccccagaggaggcggcaagaggaacagcc

SEQ ID NO: 261663 - RNA, 61 nt, hsa
cugggauuacaggcgugagccaccaugccccgccccagauggauuuuacauuugcucuuuu

SEQ ID NO: 261664 - RNA, 61 nt, hsa
caggaagccuugcgagaagggacguaccuaugccccagaaggcaagagaggaagacuauuu

SEQ ID NO: 261665 - RNA, 61 nt, hsa
ccccgacgaggagggguaugcaggcuggcaggccccagagcugguggagggcaucucacuc

SEQ ID NO: 261666 - RNA, 61 nt, hsa
uugacaacugcucguguacaggcaccccacagccccagagcauggggcacagcaggcaugc

SEQ ID NO: 261667 - RNA, 61 nt, hsa
gccccaccgcagcccaguagggaugcagcacgccccagagggcucaugugggccccagaug

SEQ ID NO: 261668 - RNA, 61 nt, hsa
ggaugcagcacgccccagagggcucaugugggccccagauggcaaugccaccauuguugau

SEQ ID NO: 261669 - RNA, 61 nt, hsa
auggccucccugaugaucaccaccaaggguagccccagaggggagcuccgagggcagguag

SEQ ID NO: 261670 - RNA, 61 nt, hsa
cuguucccgcugcacggcccaccggcggccagccccagagaccagaacugauccagagcug

SEQ ID NO: 261671 - RNA, 61 nt, hsa
cuuccaaguaugugacguaguccugaaccacgccccagacuuccgccgggucuaccugccu

SEQ ID NO: 261672 - RNA, 61 nt, hsa
cugaagaacaagcugcucauggcaagggcuggccccagaacccugcaagagaggccuucug

SEQ ID NO: 261673 - RNA, 61 nt, hsa
agaagccuccaagcacagagccuggccccaggccccagacagggugggcuuccugcccuuc

SEQ ID NO: 261674 - RNA, 61 nt, hsa
agaugucuucccugggcugccaccagcccccgccccagaguggcccaccguggcacuagaa

SEQ ID NO: 261675 - RNA, 61 nt, hsa
ggcggaugcuggauccggagccccagguuccgccccagagcgguccuggacaaggccagac

SEQ ID NO: 261676 - RNA, 61 nt, hsa
agcauccaucugguggccaaagagaaucguagccccagagcugcccaaguucacugggcuc

SEQ ID NO: 261677 - RNA, 61 nt, hsa
ccaggacccgccagccccgcucccaccuagugccccagacugagcucuccaggccaggugg

SEQ ID NO: 261678 - RNA, 61 nt, hsa
ggcuaguggggugaacagcuggugccaaauagccccagacugggcccaggcaggucugcaa

SEQ ID NO: 261679 - RNA, 61 nt, hsa
aaguuucugggagaugcccgcagcugugcgugccccagacacaaaggcuggccugugugua

SEQ ID NO: 261680 - RNA, 61 nt, hsa
ccugcccucccugccggagccggcucugccagccccagauugggaagucuccccgcuggag

SEQ ID NO: 261681 - RNA, 61 nt, hsa
augggggggaggggggcguguuucugggccugccccagacacugcccuuggcugccagccu

SEQ ID NO: 261682 - RNA, 61 nt, hsa
uaggaguucuugcuucuugcguugauacuuugccccagaaaggccugggauucauucuggu

SEQ ID NO: 261683 - RNA, 61 nt, hsa
acaaaugaagagaaaagccaugcccaccccagccccagagaaaccaauaagaauccucuau

SEQ ID NO: 261684 - RNA, 61 nt, hsa
aauucagaacgugccucuuuccagaucgcuggccccagaacccugucccccacacccaggg

SEQ ID NO: 261685 - RNA, 61 nt, hsa
aucuuuguuugcaucuccagagacaccugaggccccagagcuugaggcaaagccaggccgu

SEQ ID NO: 261686 - RNA, 61 nt, hsa
ucuccucaucuguggagcaagccaacucagugccccagaccccaccugaucugcaucuuug

SEQ ID NO: 261687 - RNA, 61 nt, hsa
agaccacccuccaugucagguacugagcaaggccccagauccuucucucuggaggaagagg

SEQ ID NO: 261688 - RNA, 61 nt, hsa
acacugguuccccacugcccugugccuuccggccccagaaggaucuuccuggaugccaacg

SEQ ID NO: 261689 - RNA, 61 nt, hsa
aagccaaaccugcugccacagcccucccccggccccagauagcagccccagggaggaugcu

SEQ ID NO: 261690 - RNA, 61 nt, hsa
aaccaaggagcuggggcccaaggccaguccugccccagagacacuccaaguccgccagggg

SEQ ID NO: 261691 - RNA, 61 nt, hsa
ggccucugggcuugggcaccagcucaugccagccccagagggucaggguuggaggccugug

SEQ ID NO: 261692 - RNA, 61 nt, hsa
auggugucaugccaagacaguaucagacacagccccagaagggggcauuaugggcccugcc

SEQ ID NO: 261693 - RNA, 61 nt, hsa
uugggauucuugucagcgggaggcgucacuggccccagagugacuccgacucuccgcuggg

SEQ ID NO: 261694 - RNA, 61 nt, hsa
agcccccucccucaccuucccuccaccgccagccccagaguuagauuuuaugcuugggccu

SEQ ID NO: 261695 - RNA, 61 nt, hsa
gguugaaacccugcacauccucccagggccagccccagaaugggccuuucucugccugccc

SEQ ID NO: 261696 - RNA, 61 nt, hsa
auuuucaagacaaacuggaguaagaauuaaagccccagaggauuuaauuauccugguuugc

SEQ ID NO: 261697 - RNA, 61 nt, hsa
augccucagggucucugaaaucucccgggaagccccagagcuuuccugaggcugccuggcc

SEQ ID NO: 261698 - RNA, 61 nt, hsa
uuccucuccauccgccaccuccccucccgcugccccagaaguuucuaucauuccauggaga

SEQ ID NO: 261699 - RNA, 61 nt, hsa
acacaguguuucauugcuccgcgucuucccagccccagaaaccggcuaaaggacccugcac

SEQ ID NO: 261700 - RNA, 61 nt, hsa
aggcaggggcugggccagggcuccaaggcuugccccagaggccacauggccaccagcccca

SEQ ID NO: 261701 - RNA, 61 nt, hsa
ggcccaggcaggaggucccaccccagacccugccccagacgcucccucacccucucggccc

SEQ ID NO: 261702 - RNA, 61 nt, hsa
cacggacagacgcagacggacacagcgacaugccccagacacguuaagggacugguuggcc

SEQ ID NO: 261703 - RNA, 61 nt, hsa
cccgagagaaaguguuaacauugagacucuggccccagauugguaucuucuaugaagaugg

SEQ ID NO: 261704 - RNA, 61 nt, hsa
cuuuccaaaugugguuaaauguaauugguuagccccagacuugggcuagagcagaaggcau

SEQ ID NO: 261705 - RNA, 64 nt, hsa; identical to SEQ ID NO: 261649

SEQ ID NO: 261706 - RNA, 64 nt, hsa; identical to SEQ ID NO: 261650

SEQ ID NO: 261707 - RNA, 64 nt, hsa; identical to SEQ ID NO: 261651

SEQ ID NO: 261708 - RNA, 64 nt, hsa; identical to SEQ ID NO: 261652

SEQ ID NO: 261709 - RNA, 64 nt, hsa; identical to SEQ ID NO: 261653

SEQ ID NO: 261710 - RNA, 64 nt, hsa; identical to SEQ ID NO: 261654

SEQ ID NO: 261711 - RNA, 64 nt, hsa; identical to SEQ ID NO: 261655

SEQ ID NO: 261712 - RNA, 64 nt, hsa; identical to SEQ ID NO: 261656

SEQ ID NO: 261713 - RNA, 64 nt, hsa; identical to SEQ ID NO: 261657

SEQ ID NO: 261714 - RNA, 64 nt, hsa; identical to SEQ ID NO: 261658

SEQ ID NO: 261715 - RNA, 61 nt, hsa; identical to SEQ ID NO: 261659

SEQ ID NO: 261716 - RNA, 61 nt, hsa; identical to SEQ ID NO: 261660

SEQ ID NO: 261717 - RNA, 61 nt, hsa; identical to SEQ ID NO: 261661

SEQ ID NO: 261718 - RNA, 61 nt, hsa; identical to SEQ ID NO: 261662

SEQ ID NO: 261719 - RNA, 61 nt, hsa; identical to SEQ ID NO: 261663

SEQ ID NO: 261720 - RNA, 61 nt, hsa; identical to SEQ ID NO: 261664

SEQ ID NO: 261721 - RNA, 61 nt, hsa; identical to SEQ ID NO: 261665

SEQ ID NO: 261722 - RNA, 61 nt, hsa; identical to SEQ ID NO: 261666

SEQ ID NO: 261723 - RNA, 61 nt, hsa; identical to SEQ ID NO: 261667

SEQ ID NO: 261724 - RNA, 61 nt, hsa; identical to SEQ ID NO: 261668

SEQ ID NO: 261725 - RNA, 61 nt, hsa; identical to SEQ ID NO: 261669

SEQ ID NO: 261726 - RNA, 61 nt, hsa; identical to SEQ ID NO: 261670

SEQ ID NO: 261727 - RNA, 61 nt, hsa; identical to SEQ ID NO: 261671

SEQ ID NO: 261728 - RNA, 61 nt, hsa; identical to SEQ ID NO: 261672

SEQ ID NO: 261729 - RNA, 61 nt, hsa; identical to SEQ ID NO: 261673

SEQ ID NO: 261730 - RNA, 61 nt, hsa; identical to SEQ ID NO: 261674

SEQ ID NO: 261731 - RNA, 61 nt, hsa; identical to SEQ ID NO: 261675

SEQ ID NO: 261732 - RNA, 61 nt, hsa; identical to SEQ ID NO: 261676

SEQ ID NO: 261733 - RNA, 61 nt, hsa; identical to SEQ ID NO: 261677

SEQ ID NO: 261734 - RNA, 61 nt, hsa; identical to SEQ ID NO: 261678

SEQ ID NO: 261735 - RNA, 61 nt, hsa; identical to SEQ ID NO: 261679

SEQ ID NO: 261736 - RNA, 61 nt, hsa; identical to SEQ ID NO: 261680

SEQ ID NO: 261737 - RNA, 61 nt, hsa; identical to SEQ ID NO: 261681

SEQ ID NO: 261738 - RNA, 61 nt, hsa; identical to SEQ ID NO: 261682

SEQ ID NO: 261739 - RNA, 61 nt, hsa; identical to SEQ ID NO: 261683

SEQ ID NO: 261740 - RNA, 61 nt, hsa; identical to SEQ ID NO: 261684

SEQ ID NO: 261741 - RNA, 61 nt, hsa; identical to SEQ ID NO: 261685

SEQ ID NO: 261742 - RNA, 61 nt, hsa; identical to SEQ ID NO: 261686

SEQ ID NO: 261743 - RNA, 61 nt, hsa; identical to SEQ ID NO: 261687

SEQ ID NO: 261744 - RNA, 61 nt, hsa; identical to SEQ ID NO: 261688

SEQ ID NO: 261745 - RNA, 61 nt, hsa; identical to SEQ ID NO: 261689

SEQ ID NO: 261746 - RNA, 61 nt, hsa; identical to SEQ ID NO: 261690

SEQ ID NO: 261747 - RNA, 61 nt, hsa; identical to SEQ ID NO: 261691

SEQ ID NO: 261748 - RNA, 61 nt, hsa; identical to SEQ ID NO: 261692

SEQ ID NO: 261749 - RNA, 61 nt, hsa; identical to SEQ ID NO: 261693

SEQ ID NO: 261750 - RNA, 61 nt, hsa; identical to SEQ ID NO: 261694

SEQ ID NO: 261751 - RNA, 61 nt, hsa; identical to SEQ ID NO: 261695

SEQ ID NO: 261752 - RNA, 61 nt, hsa; identical to SEQ ID NO: 261696

SEQ ID NO: 261753 - RNA, 61 nt, hsa; identical to SEQ ID NO: 261697

SEQ ID NO: 261754 - RNA, 61 nt, hsa; identical to SEQ ID NO: 261698

SEQ ID NO: 261755 - RNA, 61 nt, hsa; identical to SEQ ID NO: 261699

SEQ ID NO: 261756 - RNA, 61 nt, hsa; identical to SEQ ID NO: 261700

SEQ ID NO: 261757 - RNA, 61 nt, hsa; identical to SEQ ID NO: 261701

SEQ ID NO: 261758 - RNA, 61 nt, hsa; identical to SEQ ID NO: 261702

SEQ ID NO: 261759 - RNA, 61 nt, hsa; identical to SEQ ID NO: 261703

SEQ ID NO: 261760 - RNA, 61 nt, hsa; identical to SEQ ID NO: 261704

SEQ ID NO: 261761 - RNA, 64 nt, hsa; identical to SEQ ID NO: 261649

SEQ ID NO: 261762 - RNA, 64 nt, hsa; identical to SEQ ID NO: 261650

SEQ ID NO: 261763 - RNA, 64 nt, hsa; identical to SEQ ID NO: 261651

SEQ ID NO: 261764 - RNA, 64 nt, hsa; identical to SEQ ID NO: 261652

SEQ ID NO: 261765 - RNA, 64 nt, hsa; identical to SEQ ID NO: 261653

SEQ ID NO: 261766 - RNA, 64 nt, hsa; identical to SEQ ID NO: 261654

SEQ ID NO: 261767 - RNA, 64 nt, hsa; identical to SEQ ID NO: 261655

SEQ ID NO: 261768 - RNA, 64 nt, hsa; identical to SEQ ID NO: 261656

SEQ ID NO: 261769 - RNA, 64 nt, hsa; identical to SEQ ID NO: 261657

SEQ ID NO: 261770 - RNA, 64 nt, hsa; identical to SEQ ID NO: 261658

SEQ ID NO: 261771 - RNA, 61 nt, hsa; identical to SEQ ID NO: 261659

SEQ ID NO: 261772 - RNA, 61 nt, hsa; identical to SEQ ID NO: 261660

SEQ ID NO: 261773 - RNA, 61 nt, hsa; identical to SEQ ID NO: 261661

SEQ ID NO: 261774 - RNA, 61 nt, hsa; identical to SEQ ID NO: 261662

SEQ ID NO: 261775 - RNA, 61 nt, hsa; identical to SEQ ID NO: 261663

SEQ ID NO: 261776 - RNA, 61 nt, hsa; identical to SEQ ID NO: 261664

SEQ ID NO: 261777 - RNA, 61 nt, hsa; identical to SEQ ID NO: 261665

SEQ ID NO: 261778 - RNA, 61 nt, hsa; identical to SEQ ID NO: 261666

SEQ ID NO: 261779 - RNA, 61 nt, hsa; identical to SEQ ID NO: 261667

SEQ ID NO: 261780 - RNA, 61 nt, hsa; identical to SEQ ID NO: 261668

SEQ ID NO: 261781 - RNA, 61 nt, hsa; identical to SEQ ID NO: 261669

SEQ ID NO: 261782 - RNA, 61 nt, hsa; identical to SEQ ID NO: 261670

SEQ ID NO: 261783 - RNA, 61 nt, hsa; identical to SEQ ID NO: 261671

SEQ ID NO: 261784 - RNA, 61 nt, hsa; identical to SEQ ID NO: 261672

SEQ ID NO: 261785 - RNA, 61 nt, hsa; identical to SEQ ID NO: 261673

SEQ ID NO: 261786 - RNA, 61 nt, hsa; identical to SEQ ID NO: 261674

SEQ ID NO: 261787 - RNA, 61 nt, hsa; identical to SEQ ID NO: 261675

SEQ ID NO: 261788 - RNA, 61 nt, hsa; identical to SEQ ID NO: 261676

SEQ ID NO: 261789 - RNA, 61 nt, hsa; identical to SEQ ID NO: 261677

SEQ ID NO: 261790 - RNA, 61 nt, hsa; identical to SEQ ID NO: 261678

SEQ ID NO: 261791 - RNA, 61 nt, hsa; identical to SEQ ID NO: 261679

SEQ ID NO: 261792 - RNA, 61 nt, hsa; identical to SEQ ID NO: 261680

SEQ ID NO: 261793 - RNA, 61 nt, hsa; identical to SEQ ID NO: 261681

SEQ ID NO: 261794 - RNA, 61 nt, hsa; identical to SEQ ID NO: 261682

SEQ ID NO: 261795 - RNA, 61 nt, hsa; identical to SEQ ID NO: 261683

SEQ ID NO: 261796 - RNA, 61 nt, hsa; identical to SEQ ID NO: 261684

SEQ ID NO: 261797 - RNA, 61 nt, hsa; identical to SEQ ID NO: 261685

SEQ ID NO: 261798 - RNA, 61 nt, hsa; identical to SEQ ID NO: 261686

SEQ ID NO: 261799 - RNA, 61 nt, hsa; identical to SEQ ID NO: 261687

SEQ ID NO: 261800 - RNA, 61 nt, hsa; identical to SEQ ID NO: 261688

SEQ ID NO: 261801 - RNA, 61 nt, hsa; identical to SEQ ID NO: 261689

SEQ ID NO: 261802 - RNA, 61 nt, hsa; identical to SEQ ID NO: 261690

SEQ ID NO: 261803 - RNA, 61 nt, hsa; identical to SEQ ID NO: 261691

SEQ ID NO: 261804 - RNA, 61 nt, hsa; identical to SEQ ID NO: 261692

SEQ ID NO: 261805 - RNA, 61 nt, hsa; identical to SEQ ID NO: 261693

SEQ ID NO: 261806 - RNA, 61 nt, hsa; identical to SEQ ID NO: 261694

SEQ ID NO: 261807 - RNA, 61 nt, hsa; identical to SEQ ID NO: 261695

SEQ ID NO: 261808 - RNA, 61 nt, hsa; identical to SEQ ID NO: 261696

SEQ ID NO: 261809 - RNA, 61 nt, hsa; identical to SEQ ID NO: 261697

SEQ ID NO: 261810 - RNA, 61 nt, hsa; identical to SEQ ID NO: 261698

SEQ ID NO: 261811 - RNA, 61 nt, hsa; identical to SEQ ID NO: 261699

SEQ ID NO: 261812 - RNA, 61 nt, hsa; identical to SEQ ID NO: 261700

SEQ ID NO: 261813 - RNA, 61 nt, hsa; identical to SEQ ID NO: 261701

SEQ ID NO: 261814 - RNA, 61 nt, hsa; identical to SEQ ID NO: 261702

SEQ ID NO: 261815 - RNA, 61 nt, hsa; identical to SEQ ID NO: 261703

SEQ ID NO: 261816 - RNA, 61 nt, hsa; identical to SEQ ID NO: 261704

SEQ ID NO: 261817 - RNA, 64 nt, hsa; identical to SEQ ID NO: 261649

SEQ ID NO: 261818 - RNA, 64 nt, hsa; identical to SEQ ID NO: 261650

SEQ ID NO: 261819 - RNA, 64 nt, hsa; identical to SEQ ID NO: 261651

SEQ ID NO: 261820 - RNA, 64 nt, hsa; identical to SEQ ID NO: 261652

SEQ ID NO: 261821 - RNA, 64 nt, hsa; identical to SEQ ID NO: 261653

SEQ ID NO: 261822 - RNA, 64 nt, hsa; identical to SEQ ID NO: 261654

SEQ ID NO: 261823 - RNA, 64 nt, hsa; identical to SEQ ID NO: 261655

SEQ ID NO: 261824 - RNA, 64 nt, hsa; identical to SEQ ID NO: 261656

SEQ ID NO: 261825 - RNA, 64 nt, hsa; identical to SEQ ID NO: 261657

SEQ ID NO: 261826 - RNA, 64 nt, hsa; identical to SEQ ID NO: 261658

SEQ ID NO: 261827 - RNA, 61 nt, hsa; identical to SEQ ID NO: 261659

SEQ ID NO: 261828 - RNA, 61 nt, hsa; identical to SEQ ID NO: 261660

SEQ ID NO: 261829 - RNA, 61 nt, hsa; identical to SEQ ID NO: 261661

SEQ ID NO: 261830 - RNA, 61 nt, hsa; identical to SEQ ID NO: 261662

SEQ ID NO: 261831 - RNA, 61 nt, hsa; identical to SEQ ID NO: 261663

SEQ ID NO: 261832 - RNA, 61 nt, hsa; identical to SEQ ID NO: 261664

SEQ ID NO: 261833 - RNA, 61 nt, hsa; identical to SEQ ID NO: 261665

SEQ ID NO: 261834 - RNA, 61 nt, hsa; identical to SEQ ID NO: 261666

SEQ ID NO: 261835 - RNA, 61 nt, hsa; identical to SEQ ID NO: 261667

SEQ ID NO: 261836 - RNA, 61 nt, hsa; identical to SEQ ID NO: 261668

SEQ ID NO: 261837 - RNA, 61 nt, hsa; identical to SEQ ID NO: 261669

SEQ ID NO: 261838 - RNA, 61 nt, hsa; identical to SEQ ID NO: 261670

SEQ ID NO: 261839 - RNA, 61 nt, hsa; identical to SEQ ID NO: 261671

SEQ ID NO: 261840 - RNA, 61 nt, hsa; identical to SEQ ID NO: 261672

SEQ ID NO: 261841 - RNA, 61 nt, hsa; identical to SEQ ID NO: 261673

SEQ ID NO: 261842 - RNA, 61 nt, hsa; identical to SEQ ID NO: 261674

SEQ ID NO: 261843 - RNA, 61 nt, hsa; identical to SEQ ID NO: 261675

SEQ ID NO: 261844 - RNA, 61 nt, hsa; identical to SEQ ID NO: 261676

SEQ ID NO: 261845 - RNA, 61 nt, hsa; identical to SEQ ID NO: 261677

SEQ ID NO: 261846 - RNA, 61 nt, hsa; identical to SEQ ID NO: 261678

SEQ ID NO: 261847 - RNA, 61 nt, hsa; identical to SEQ ID NO: 261679

SEQ ID NO: 261848 - RNA, 61 nt, hsa; identical to SEQ ID NO: 261680

SEQ ID NO: 261849 - RNA, 61 nt, hsa; identical to SEQ ID NO: 261681

SEQ ID NO: 261850 - RNA, 61 nt, hsa; identical to SEQ ID NO: 261682

SEQ ID NO: 261851 - RNA, 61 nt, hsa; identical to SEQ ID NO: 261683

SEQ ID NO: 261852 - RNA, 61 nt, hsa; identical to SEQ ID NO: 261684

SEQ ID NO: 261853 - RNA, 61 nt, hsa; identical to SEQ ID NO: 261685

SEQ ID NO: 261854 - RNA, 61 nt, hsa; identical to SEQ ID NO: 261686

SEQ ID NO: 261855 - RNA, 61 nt, hsa; identical to SEQ ID NO: 261687

SEQ ID NO: 261856 - RNA, 61 nt, hsa; identical to SEQ ID NO: 261688

SEQ ID NO: 261857 - RNA, 61 nt, hsa; identical to SEQ ID NO: 261689

SEQ ID NO: 261858 - RNA, 61 nt, hsa; identical to SEQ ID NO: 261690

SEQ ID NO: 261859 - RNA, 61 nt, hsa; identical to SEQ ID NO: 261691

SEQ ID NO: 261860 - RNA, 61 nt, hsa; identical to SEQ ID NO: 261692

SEQ ID NO: 261861 - RNA, 61 nt, hsa; identical to SEQ ID NO: 261693

SEQ ID NO: 261862 - RNA, 61 nt, hsa; identical to SEQ ID NO: 261694

SEQ ID NO: 261863 - RNA, 61 nt, hsa; identical to SEQ ID NO: 261695

SEQ ID NO: 261864 - RNA, 61 nt, hsa; identical to SEQ ID NO: 261696

SEQ ID NO: 261865 - RNA, 61 nt, hsa; identical to SEQ ID NO: 261697

SEQ ID NO: 261866 - RNA, 61 nt, hsa; identical to SEQ ID NO: 261698

SEQ ID NO: 261867 - RNA, 61 nt, hsa; identical to SEQ ID NO: 261699

SEQ ID NO: 261868 - RNA, 61 nt, hsa; identical to SEQ ID NO: 261700

SEQ ID NO: 261869 - RNA, 61 nt, hsa; identical to SEQ ID NO: 261701

SEQ ID NO: 261870 - RNA, 61 nt, hsa; identical to SEQ ID NO: 261702

SEQ ID NO: 261871 - RNA, 61 nt, hsa; identical to SEQ ID NO: 261703

SEQ ID NO: 261872 - RNA, 61 nt, hsa; identical to SEQ ID NO: 261704

SEQ ID NO: 261873 - RNA, 64 nt, hsa; identical to SEQ ID NO: 261649

SEQ ID NO: 261874 - RNA, 64 nt, hsa; identical to SEQ ID NO: 261650

SEQ ID NO: 261875 - RNA, 64 nt, hsa; identical to SEQ ID NO: 261651

SEQ ID NO: 261876 - RNA, 64 nt, hsa; identical to SEQ ID NO: 261652

SEQ ID NO: 261877 - RNA, 64 nt, hsa; identical to SEQ ID NO: 261653

SEQ ID NO: 261878 - RNA, 64 nt, hsa; identical to SEQ ID NO: 261654

SEQ ID NO: 261879 - RNA, 64 nt, hsa; identical to SEQ ID NO: 261655

SEQ ID NO: 261880 - RNA, 64 nt, hsa; identical to SEQ ID NO: 261656

SEQ ID NO: 261881 - RNA, 64 nt, hsa; identical to SEQ ID NO: 261657

SEQ ID NO: 261882 - RNA, 64 nt, hsa; identical to SEQ ID NO: 261658

SEQ ID NO: 261883 - RNA, 61 nt, hsa; identical to SEQ ID NO: 261659

SEQ ID NO: 261884 - RNA, 61 nt, hsa; identical to SEQ ID NO: 261660

SEQ ID NO: 261885 - RNA, 61 nt, hsa; identical to SEQ ID NO: 261661

SEQ ID NO: 261886 - RNA, 61 nt, hsa; identical to SEQ ID NO: 261662

SEQ ID NO: 261887 - RNA, 61 nt, hsa; identical to SEQ ID NO: 261663

SEQ ID NO: 261888 - RNA, 61 nt, hsa; identical to SEQ ID NO: 261664

SEQ ID NO: 261889 - RNA, 61 nt, hsa; identical to SEQ ID NO: 261665

SEQ ID NO: 261890 - RNA, 61 nt, hsa; identical to SEQ ID NO: 261666

SEQ ID NO: 261891 - RNA, 61 nt, hsa; identical to SEQ ID NO: 261667

SEQ ID NO: 261892 - RNA, 61 nt, hsa; identical to SEQ ID NO: 261668

SEQ ID NO: 261893 - RNA, 61 nt, hsa; identical to SEQ ID NO: 261669

SEQ ID NO: 261894 - RNA, 61 nt, hsa; identical to SEQ ID NO: 261670

SEQ ID NO: 261895 - RNA, 61 nt, hsa; identical to SEQ ID NO: 261671

SEQ ID NO: 261896 - RNA, 61 nt, hsa; identical to SEQ ID NO: 261672

SEQ ID NO: 261897 - RNA, 61 nt, hsa; identical to SEQ ID NO: 261673

SEQ ID NO: 261898 - RNA, 61 nt, hsa; identical to SEQ ID NO: 261674

SEQ ID NO: 261899 - RNA, 61 nt, hsa; identical to SEQ ID NO: 261675

SEQ ID NO: 261900 - RNA, 61 nt, hsa; identical to SEQ ID NO: 261676

SEQ ID NO: 261901 - RNA, 61 nt, hsa; identical to SEQ ID NO: 261677

SEQ ID NO: 261902 - RNA, 61 nt, hsa; identical to SEQ ID NO: 261678

SEQ ID NO: 261903 - RNA, 61 nt, hsa; identical to SEQ ID NO: 261679

SEQ ID NO: 261904 - RNA, 61 nt, hsa; identical to SEQ ID NO: 261680

SEQ ID NO: 261905 - RNA, 61 nt, hsa; identical to SEQ ID NO: 261681

SEQ ID NO: 261906 - RNA, 61 nt, hsa; identical to SEQ ID NO: 261682

SEQ ID NO: 261907 - RNA, 61 nt, hsa; identical to SEQ ID NO: 261683

SEQ ID NO: 261908 - RNA, 61 nt, hsa; identical to SEQ ID NO: 261684

SEQ ID NO: 261909 - RNA, 61 nt, hsa; identical to SEQ ID NO: 261685

SEQ ID NO: 261910 - RNA, 61 nt, hsa; identical to SEQ ID NO: 261686

SEQ ID NO: 261911 - RNA, 61 nt, hsa; identical to SEQ ID NO: 261687

SEQ ID NO: 261912 - RNA, 61 nt, hsa; identical to SEQ ID NO: 261688

SEQ ID NO: 261913 - RNA, 61 nt, hsa; identical to SEQ ID NO: 261689

SEQ ID NO: 261914 - RNA, 61 nt, hsa; identical to SEQ ID NO: 261690

SEQ ID NO: 261915 - RNA, 61 nt, hsa; identical to SEQ ID NO: 261691

SEQ ID NO: 261916 - RNA, 61 nt, hsa; identical to SEQ ID NO: 261692

SEQ ID NO: 261917 - RNA, 61 nt, hsa; identical to SEQ ID NO: 261693

SEQ ID NO: 261918 - RNA, 61 nt, hsa; identical to SEQ ID NO: 261694

SEQ ID NO: 261919 - RNA, 61 nt, hsa; identical to SEQ ID NO: 261695

SEQ ID NO: 261920 - RNA, 61 nt, hsa; identical to SEQ ID NO: 261696

SEQ ID NO: 261921 - RNA, 61 nt, hsa; identical to SEQ ID NO: 261697

SEQ ID NO: 261922 - RNA, 61 nt, hsa; identical to SEQ ID NO: 261698

SEQ ID NO: 261923 - RNA, 61 nt, hsa; identical to SEQ ID NO: 261699

SEQ ID NO: 261924 - RNA, 61 nt, hsa; identical to SEQ ID NO: 261700

SEQ ID NO: 261925 - RNA, 61 nt, hsa; identical to SEQ ID NO: 261701

SEQ ID NO: 261926 - RNA, 61 nt, hsa; identical to SEQ ID NO: 261702

SEQ ID NO: 261927 - RNA, 61 nt, hsa; identical to SEQ ID NO: 261703

SEQ ID NO: 261928 - RNA, 61 nt, hsa; identical to SEQ ID NO: 261704

SEQ ID NO: 261929 - RNA, 64 nt, hsa; identical to SEQ ID NO: 261649

SEQ ID NO: 261930 - RNA, 64 nt, hsa; identical to SEQ ID NO: 261650

SEQ ID NO: 261931 - RNA, 64 nt, hsa; identical to SEQ ID NO: 261651

SEQ ID NO: 261932 - RNA, 64 nt, hsa; identical to SEQ ID NO: 261652

SEQ ID NO: 261933 - RNA, 64 nt, hsa; identical to SEQ ID NO: 261653

SEQ ID NO: 261934 - RNA, 64 nt, hsa; identical to SEQ ID NO: 261654

SEQ ID NO: 261935 - RNA, 64 nt, hsa; identical to SEQ ID NO: 261655

SEQ ID NO: 261936 - RNA, 64 nt, hsa; identical to SEQ ID NO: 261656

SEQ ID NO: 261937 - RNA, 64 nt, hsa; identical to SEQ ID NO: 261657

SEQ ID NO: 261938 - RNA, 64 nt, hsa; identical to SEQ ID NO: 261658

SEQ ID NO: 261939 - RNA, 61 nt, hsa; identical to SEQ ID NO: 261659

SEQ ID NO: 261940 - RNA, 61 nt, hsa; identical to SEQ ID NO: 261660

SEQ ID NO: 261941 - RNA, 61 nt, hsa; identical to SEQ ID NO: 261661

SEQ ID NO: 261942 - RNA, 61 nt, hsa; identical to SEQ ID NO: 261662

SEQ ID NO: 261943 - RNA, 61 nt, hsa; identical to SEQ ID NO: 261663

SEQ ID NO: 261944 - RNA, 61 nt, hsa; identical to SEQ ID NO: 261664

SEQ ID NO: 261945 - RNA, 61 nt, hsa; identical to SEQ ID NO: 261665

SEQ ID NO: 261946 - RNA, 61 nt, hsa; identical to SEQ ID NO: 261666

SEQ ID NO: 261947 - RNA, 61 nt, hsa; identical to SEQ ID NO: 261667

SEQ ID NO: 261948 - RNA, 61 nt, hsa; identical to SEQ ID NO: 261668

SEQ ID NO: 261949 - RNA, 61 nt, hsa; identical to SEQ ID NO: 261669

SEQ ID NO: 261950 - RNA, 61 nt, hsa; identical to SEQ ID NO: 261670

SEQ ID NO: 261951 - RNA, 61 nt, hsa; identical to SEQ ID NO: 261671

SEQ ID NO: 261952 - RNA, 61 nt, hsa; identical to SEQ ID NO: 261672

SEQ ID NO: 261953 - RNA, 61 nt, hsa; identical to SEQ ID NO: 261673

SEQ ID NO: 261954 - RNA, 61 nt, hsa; identical to SEQ ID NO: 261674

SEQ ID NO: 261955 - RNA, 61 nt, hsa; identical to SEQ ID NO: 261675

SEQ ID NO: 261956 - RNA, 61 nt, hsa; identical to SEQ ID NO: 261676

SEQ ID NO: 261957 - RNA, 61 nt, hsa; identical to SEQ ID NO: 261677

SEQ ID NO: 261958 - RNA, 61 nt, hsa; identical to SEQ ID NO: 261678

SEQ ID NO: 261959 - RNA, 61 nt, hsa; identical to SEQ ID NO: 261679

SEQ ID NO: 261960 - RNA, 61 nt, hsa; identical to SEQ ID NO: 261680

SEQ ID NO: 261961 - RNA, 61 nt, hsa; identical to SEQ ID NO: 261681

SEQ ID NO: 261962 - RNA, 61 nt, hsa; identical to SEQ ID NO: 261682

SEQ ID NO: 261963 - RNA, 61 nt, hsa; identical to SEQ ID NO: 261683

SEQ ID NO: 261964 - RNA, 61 nt, hsa; identical to SEQ ID NO: 261684

SEQ ID NO: 261965 - RNA, 61 nt, hsa; identical to SEQ ID NO: 261685

SEQ ID NO: 261966 - RNA, 61 nt, hsa; identical to SEQ ID NO: 261686

SEQ ID NO: 261967 - RNA, 61 nt, hsa; identical to SEQ ID NO: 261687

SEQ ID NO: 261968 - RNA, 61 nt, hsa; identical to SEQ ID NO: 261688

SEQ ID NO: 261969 - RNA, 61 nt, hsa; identical to SEQ ID NO: 261689

SEQ ID NO: 261970 - RNA, 61 nt, hsa; identical to SEQ ID NO: 261690

SEQ ID NO: 261971 - RNA, 61 nt, hsa; identical to SEQ ID NO: 261691

SEQ ID NO: 261972 - RNA, 61 nt, hsa; identical to SEQ ID NO: 261692

SEQ ID NO: 261973 - RNA, 61 nt, hsa; identical to SEQ ID NO: 261693

SEQ ID NO: 261974 - RNA, 61 nt, hsa; identical to SEQ ID NO: 261694

SEQ ID NO: 261975 - RNA, 61 nt, hsa; identical to SEQ ID NO: 261695

SEQ ID NO: 261976 - RNA, 61 nt, hsa; identical to SEQ ID NO: 261696

SEQ ID NO: 261977 - RNA, 61 nt, hsa; identical to SEQ ID NO: 261697

SEQ ID NO: 261978 - RNA, 61 nt, hsa; identical to SEQ ID NO: 261698

SEQ ID NO: 261979 - RNA, 61 nt, hsa; identical to SEQ ID NO: 261699

SEQ ID NO: 261980 - RNA, 61 nt, hsa; identical to SEQ ID NO: 261700

SEQ ID NO: 261981 - RNA, 61 nt, hsa; identical to SEQ ID NO: 261701

SEQ ID NO: 261982 - RNA, 61 nt, hsa; identical to SEQ ID NO: 261702

SEQ ID NO: 261983 - RNA, 61 nt, hsa; identical to SEQ ID NO: 261703

SEQ ID NO: 261984 - RNA, 61 nt, hsa; identical to SEQ ID NO: 261704

SEQ ID NO: 261985 - RNA, 64 nt, hsa; identical to SEQ ID NO: 261649

SEQ ID NO: 261986 - RNA, 64 nt, hsa; identical to SEQ ID NO: 261650

SEQ ID NO: 261987 - RNA, 64 nt, hsa; identical to SEQ ID NO: 261651

SEQ ID NO: 261988 - RNA, 64 nt, hsa; identical to SEQ ID NO: 261652

SEQ ID NO: 261989 - RNA, 64 nt, hsa; identical to SEQ ID NO: 261653

SEQ ID NO: 261990 - RNA, 64 nt, hsa; identical to SEQ ID NO: 261654

SEQ ID NO: 261991 - RNA, 64 nt, hsa; identical to SEQ ID NO: 261655

SEQ ID NO: 261992 - RNA, 64 nt, hsa; identical to SEQ ID NO: 261656

SEQ ID NO: 261993 - RNA, 64 nt, hsa; identical to SEQ ID NO: 261657

SEQ ID NO: 261994 - RNA, 64 nt, hsa; identical to SEQ ID NO: 261658

SEQ ID NO: 261995 - RNA, 61 nt, hsa; identical to SEQ ID NO: 261659

SEQ ID NO: 261996 - RNA, 61 nt, hsa; identical to SEQ ID NO: 261660

SEQ ID NO: 261997 - RNA, 61 nt, hsa; identical to SEQ ID NO: 261661

SEQ ID NO: 261998 - RNA, 61 nt, hsa; identical to SEQ ID NO: 261662

SEQ ID NO: 261999 - RNA, 61 nt, hsa; identical to SEQ ID NO: 261663

SEQ ID NO: 262000 - RNA, 61 nt, hsa; identical to SEQ ID NO: 261664

SEQ ID NO: 262001 - RNA, 61 nt, hsa; identical to SEQ ID NO: 261665

SEQ ID NO: 262002 - RNA, 61 nt, hsa; identical to SEQ ID NO: 261666

SEQ ID NO: 262003 - RNA, 61 nt, hsa; identical to SEQ ID NO: 261667

SEQ ID NO: 262004 - RNA, 61 nt, hsa; identical to SEQ ID NO: 261668

SEQ ID NO: 262005 - RNA, 61 nt, hsa; identical to SEQ ID NO: 261669

SEQ ID NO: 262006 - RNA, 61 nt, hsa; identical to SEQ ID NO: 261670

SEQ ID NO: 262007 - RNA, 61 nt, hsa; identical to SEQ ID NO: 261671

SEQ ID NO: 262008 - RNA, 61 nt, hsa; identical to SEQ ID NO: 261672

SEQ ID NO: 262009 - RNA, 61 nt, hsa; identical to SEQ ID NO: 261673

SEQ ID NO: 262010 - RNA, 61 nt, hsa; identical to SEQ ID NO: 261674

SEQ ID NO: 262011 - RNA, 61 nt, hsa; identical to SEQ ID NO: 261675

SEQ ID NO: 262012 - RNA, 61 nt, hsa; identical to SEQ ID NO: 261676

SEQ ID NO: 262013 - RNA, 61 nt, hsa; identical to SEQ ID NO: 261677

SEQ ID NO: 262014 - RNA, 61 nt, hsa; identical to SEQ ID NO: 261678

SEQ ID NO: 262015 - RNA, 61 nt, hsa; identical to SEQ ID NO: 261679

SEQ ID NO: 262016 - RNA, 61 nt, hsa; identical to SEQ ID NO: 261680

SEQ ID NO: 262017 - RNA, 61 nt, hsa; identical to SEQ ID NO: 261681

SEQ ID NO: 262018 - RNA, 61 nt, hsa; identical to SEQ ID NO: 261682

SEQ ID NO: 262019 - RNA, 61 nt, hsa; identical to SEQ ID NO: 261683

SEQ ID NO: 262020 - RNA, 61 nt, hsa; identical to SEQ ID NO: 261684

SEQ ID NO: 262021 - RNA, 61 nt, hsa; identical to SEQ ID NO: 261685

SEQ ID NO: 262022 - RNA, 61 nt, hsa; identical to SEQ ID NO: 261686

SEQ ID NO: 262023 - RNA, 61 nt, hsa; identical to SEQ ID NO: 261687

SEQ ID NO: 262024 - RNA, 61 nt, hsa; identical to SEQ ID NO: 261688

SEQ ID NO: 262025 - RNA, 61 nt, hsa; identical to SEQ ID NO: 261689

SEQ ID NO: 262026 - RNA, 61 nt, hsa; identical to SEQ ID NO: 261690

SEQ ID NO: 262027 - RNA, 61 nt, hsa; identical to SEQ ID NO: 261691

SEQ ID NO: 262028 - RNA, 61 nt, hsa; identical to SEQ ID NO: 261692

SEQ ID NO: 262029 - RNA, 61 nt, hsa; identical to SEQ ID NO: 261693

SEQ ID NO: 262030 - RNA, 61 nt, hsa; identical to SEQ ID NO: 261694

SEQ ID NO: 262031 - RNA, 61 nt, hsa; identical to SEQ ID NO: 261695

SEQ ID NO: 262032 - RNA, 61 nt, hsa; identical to SEQ ID NO: 261696

SEQ ID NO: 262033 - RNA, 61 nt, hsa; identical to SEQ ID NO: 261697

SEQ ID NO: 262034 - RNA, 61 nt, hsa; identical to SEQ ID NO: 261698

SEQ ID NO: 262035 - RNA, 61 nt, hsa; identical to SEQ ID NO: 261699

SEQ ID NO: 262036 - RNA, 61 nt, hsa; identical to SEQ ID NO: 261700

SEQ ID NO: 262037 - RNA, 61 nt, hsa; identical to SEQ ID NO: 261701

SEQ ID NO: 262038 - RNA, 61 nt, hsa; identical to SEQ ID NO: 261702

SEQ ID NO: 262039 - RNA, 61 nt, hsa; identical to SEQ ID NO: 261703

SEQ ID NO: 262040 - RNA, 61 nt, hsa; identical to SEQ ID NO: 261704

SEQ ID NO: 262041 - RNA, 64 nt, hsa; identical to SEQ ID NO: 261649

SEQ ID NO: 262042 - RNA, 64 nt, hsa; identical to SEQ ID NO: 261650

SEQ ID NO: 262043 - RNA, 64 nt, hsa; identical to SEQ ID NO: 261651

SEQ ID NO: 262044 - RNA, 64 nt, hsa; identical to SEQ ID NO: 261652

SEQ ID NO: 262045 - RNA, 64 nt, hsa; identical to SEQ ID NO: 261653

SEQ ID NO: 262046 - RNA, 64 nt, hsa; identical to SEQ ID NO: 261654

SEQ ID NO: 262047 - RNA, 64 nt, hsa; identical to SEQ ID NO: 261655

SEQ ID NO: 262048 - RNA, 64 nt, hsa; identical to SEQ ID NO: 261656

SEQ ID NO: 262049 - RNA, 64 nt, hsa; identical to SEQ ID NO: 261657

SEQ ID NO: 262050 - RNA, 64 nt, hsa; identical to SEQ ID NO: 261658

SEQ ID NO: 262051 - RNA, 61 nt, hsa; identical to SEQ ID NO: 261659

SEQ ID NO: 262052 - RNA, 61 nt, hsa; identical to SEQ ID NO: 261660

SEQ ID NO: 262053 - RNA, 61 nt, hsa; identical to SEQ ID NO: 261661

SEQ ID NO: 262054 - RNA, 61 nt, hsa; identical to SEQ ID NO: 261662

SEQ ID NO: 262055 - RNA, 61 nt, hsa; identical to SEQ ID NO: 261663

SEQ ID NO: 262056 - RNA, 61 nt, hsa; identical to SEQ ID NO: 261664

SEQ ID NO: 262057 - RNA, 61 nt, hsa; identical to SEQ ID NO: 261665

SEQ ID NO: 262058 - RNA, 61 nt, hsa; identical to SEQ ID NO: 261666

SEQ ID NO: 262059 - RNA, 61 nt, hsa; identical to SEQ ID NO: 261667

SEQ ID NO: 262060 - RNA, 61 nt, hsa; identical to SEQ ID NO: 261668

SEQ ID NO: 262061 - RNA, 61 nt, hsa; identical to SEQ ID NO: 261669

SEQ ID NO: 262062 - RNA, 61 nt, hsa; identical to SEQ ID NO: 261670

SEQ ID NO: 262063 - RNA, 61 nt, hsa; identical to SEQ ID NO: 261671

SEQ ID NO: 262064 - RNA, 61 nt, hsa; identical to SEQ ID NO: 261672

SEQ ID NO: 262065 - RNA, 61 nt, hsa; identical to SEQ ID NO: 261673

SEQ ID NO: 262066 - RNA, 61 nt, hsa; identical to SEQ ID NO: 261674

SEQ ID NO: 262067 - RNA, 61 nt, hsa; identical to SEQ ID NO: 261675

SEQ ID NO: 262068 - RNA, 61 nt, hsa; identical to SEQ ID NO: 261676

SEQ ID NO: 262069 - RNA, 61 nt, hsa; identical to SEQ ID NO: 261677

SEQ ID NO: 262070 - RNA, 61 nt, hsa; identical to SEQ ID NO: 261678

SEQ ID NO: 262071 - RNA, 61 nt, hsa; identical to SEQ ID NO: 261679

SEQ ID NO: 262072 - RNA, 61 nt, hsa; identical to SEQ ID NO: 261680

SEQ ID NO: 262073 - RNA, 61 nt, hsa; identical to SEQ ID NO: 261681

SEQ ID NO: 262074 - RNA, 61 nt, hsa; identical to SEQ ID NO: 261682

SEQ ID NO: 262075 - RNA, 61 nt, hsa; identical to SEQ ID NO: 261683

SEQ ID NO: 262076 - RNA, 61 nt, hsa; identical to SEQ ID NO: 261684

SEQ ID NO: 262077 - RNA, 61 nt, hsa; identical to SEQ ID NO: 261685

SEQ ID NO: 262078 - RNA, 61 nt, hsa; identical to SEQ ID NO: 261686

SEQ ID NO: 262079 - RNA, 61 nt, hsa; identical to SEQ ID NO: 261687

SEQ ID NO: 262080 - RNA, 61 nt, hsa; identical to SEQ ID NO: 261688

SEQ ID NO: 262081 - RNA, 61 nt, hsa; identical to SEQ ID NO: 261689

SEQ ID NO: 262082 - RNA, 61 nt, hsa; identical to SEQ ID NO: 261690

SEQ ID NO: 262083 - RNA, 61 nt, hsa; identical to SEQ ID NO: 261691

SEQ ID NO: 262084 - RNA, 61 nt, hsa; identical to SEQ ID NO: 261692

SEQ ID NO: 262085 - RNA, 61 nt, hsa; identical to SEQ ID NO: 261693

SEQ ID NO: 262086 - RNA, 61 nt, hsa; identical to SEQ ID NO: 261694

SEQ ID NO: 262087 - RNA, 61 nt, hsa; identical to SEQ ID NO: 261695

SEQ ID NO: 262088 - RNA, 61 nt, hsa; identical to SEQ ID NO: 261696

SEQ ID NO: 262089 - RNA, 61 nt, hsa; identical to SEQ ID NO: 261697

SEQ ID NO: 262090 - RNA, 61 nt, hsa; identical to SEQ ID NO: 261698

SEQ ID NO: 262091 - RNA, 61 nt, hsa; identical to SEQ ID NO: 261699

SEQ ID NO: 262092 - RNA, 61 nt, hsa; identical to SEQ ID NO: 261700

SEQ ID NO: 262093 - RNA, 61 nt, hsa; identical to SEQ ID NO: 261701

SEQ ID NO: 262094 - RNA, 61 nt, hsa; identical to SEQ ID NO: 261702

SEQ ID NO: 262095 - RNA, 61 nt, hsa; identical to SEQ ID NO: 261703

SEQ ID NO: 262096 - RNA, 61 nt, hsa; identical to SEQ ID NO: 261704

SEQ ID NO: 262097 - RNA, 64 nt, hsa; identical to SEQ ID NO: 261649

SEQ ID NO: 262098 - RNA, 64 nt, hsa; identical to SEQ ID NO: 261650

SEQ ID NO: 262099 - RNA, 64 nt, hsa; identical to SEQ ID NO: 261651

SEQ ID NO: 262100 - RNA, 64 nt, hsa; identical to SEQ ID NO: 261652

SEQ ID NO: 262101 - RNA, 64 nt, hsa; identical to SEQ ID NO: 261653

SEQ ID NO: 262102 - RNA, 64 nt, hsa; identical to SEQ ID NO: 261654

SEQ ID NO: 262103 - RNA, 64 nt, hsa; identical to SEQ ID NO: 261655

SEQ ID NO: 262104 - RNA, 64 nt, hsa; identical to SEQ ID NO: 261656

SEQ ID NO: 262105 - RNA, 64 nt, hsa; identical to SEQ ID NO: 261657

SEQ ID NO: 262106 - RNA, 64 nt, hsa; identical to SEQ ID NO: 261658

SEQ ID NO: 262107 - RNA, 61 nt, hsa; identical to SEQ ID NO: 261659

SEQ ID NO: 262108 - RNA, 61 nt, hsa; identical to SEQ ID NO: 261660

SEQ ID NO: 262109 - RNA, 61 nt, hsa; identical to SEQ ID NO: 261661

SEQ ID NO: 262110 - RNA, 61 nt, hsa; identical to SEQ ID NO: 261662

SEQ ID NO: 262111 - RNA, 61 nt, hsa; identical to SEQ ID NO: 261663

SEQ ID NO: 262112 - RNA, 61 nt, hsa; identical to SEQ ID NO: 261664

SEQ ID NO: 262113 - RNA, 61 nt, hsa; identical to SEQ ID NO: 261665

SEQ ID NO: 262114 - RNA, 61 nt, hsa; identical to SEQ ID NO: 261666

SEQ ID NO: 262115 - RNA, 61 nt, hsa; identical to SEQ ID NO: 261667

SEQ ID NO: 262116 - RNA, 61 nt, hsa; identical to SEQ ID NO: 261668

SEQ ID NO: 262117 - RNA, 61 nt, hsa; identical to SEQ ID NO: 261669

SEQ ID NO: 262118 - RNA, 61 nt, hsa; identical to SEQ ID NO: 261670

SEQ ID NO: 262119 - RNA, 61 nt, hsa; identical to SEQ ID NO: 261671

SEQ ID NO: 262120 - RNA, 61 nt, hsa; identical to SEQ ID NO: 261672

SEQ ID NO: 262121 - RNA, 61 nt, hsa; identical to SEQ ID NO: 261673

SEQ ID NO: 262122 - RNA, 61 nt, hsa; identical to SEQ ID NO: 261674

SEQ ID NO: 262123 - RNA, 61 nt, hsa; identical to SEQ ID NO: 261675

SEQ ID NO: 262124 - RNA, 61 nt, hsa; identical to SEQ ID NO: 261676

SEQ ID NO: 262125 - RNA, 61 nt, hsa; identical to SEQ ID NO: 261677

SEQ ID NO: 262126 - RNA, 61 nt, hsa; identical to SEQ ID NO: 261678

SEQ ID NO: 262127 - RNA, 61 nt, hsa; identical to SEQ ID NO: 261679

SEQ ID NO: 262128 - RNA, 61 nt, hsa; identical to SEQ ID NO: 261680

SEQ ID NO: 262129 - RNA, 61 nt, hsa; identical to SEQ ID NO: 261681

SEQ ID NO: 262130 - RNA, 61 nt, hsa; identical to SEQ ID NO: 261682

SEQ ID NO: 262131 - RNA, 61 nt, hsa; identical to SEQ ID NO: 261683

SEQ ID NO: 262132 - RNA, 61 nt, hsa; identical to SEQ ID NO: 261684

SEQ ID NO: 262133 - RNA, 61 nt, hsa; identical to SEQ ID NO: 261685

SEQ ID NO: 262134 - RNA, 61 nt, hsa; identical to SEQ ID NO: 261686

SEQ ID NO: 262135 - RNA, 61 nt, hsa; identical to SEQ ID NO: 261687

SEQ ID NO: 262136 - RNA, 61 nt, hsa; identical to SEQ ID NO: 261688

SEQ ID NO: 262137 - RNA, 61 nt, hsa; identical to SEQ ID NO: 261689

SEQ ID NO: 262138 - RNA, 61 nt, hsa; identical to SEQ ID NO: 261690

SEQ ID NO: 262139 - RNA, 61 nt, hsa; identical to SEQ ID NO: 261691

SEQ ID NO: 262140 - RNA, 61 nt, hsa; identical to SEQ ID NO: 261692

SEQ ID NO: 262141 - RNA, 61 nt, hsa; identical to SEQ ID NO: 261693

SEQ ID NO: 262142 - RNA, 61 nt, hsa; identical to SEQ ID NO: 261694

SEQ ID NO: 262143 - RNA, 61 nt, hsa; identical to SEQ ID NO: 261695

SEQ ID NO: 262144 - RNA, 61 nt, hsa; identical to SEQ ID NO: 261696

SEQ ID NO: 262145 - RNA, 61 nt, hsa; identical to SEQ ID NO: 261697

SEQ ID NO: 262146 - RNA, 61 nt, hsa; identical to SEQ ID NO: 261698

SEQ ID NO: 262147 - RNA, 61 nt, hsa; identical to SEQ ID NO: 261699

SEQ ID NO: 262148 - RNA, 61 nt, hsa; identical to SEQ ID NO: 261700

SEQ ID NO: 262149 - RNA, 61 nt, hsa; identical to SEQ ID NO: 261701

SEQ ID NO: 262150 - RNA, 61 nt, hsa; identical to SEQ ID NO: 261702

SEQ ID NO: 262151 - RNA, 61 nt, hsa; identical to SEQ ID NO: 261703

SEQ ID NO: 262152 - RNA, 61 nt, hsa; identical to SEQ ID NO: 261704

SEQ ID NO: 262153 - RNA, 64 nt, hsa; identical to SEQ ID NO: 198753

SEQ ID NO: 262154 - RNA, 64 nt, hsa; identical to SEQ ID NO: 198754

SEQ ID NO: 262155 - RNA, 64 nt, hsa; identical to SEQ ID NO: 198755

SEQ ID NO: 262156 - RNA, 64 nt, hsa; identical to SEQ ID NO: 198756

SEQ ID NO: 262157 - RNA, 64 nt, hsa; identical to SEQ ID NO: 198757

SEQ ID NO: 262158 - RNA, 64 nt, hsa; identical to SEQ ID NO: 198758

SEQ ID NO: 262159 - RNA, 64 nt, hsa; identical to SEQ ID NO: 198759

SEQ ID NO: 262160 - RNA, 64 nt, hsa; identical to SEQ ID NO: 198760

SEQ ID NO: 262161 - RNA, 64 nt, hsa; identical to SEQ ID NO: 198761

SEQ ID NO: 262162 - RNA, 64 nt, hsa; identical to SEQ ID NO: 198762

SEQ ID NO: 262163 - RNA, 64 nt, hsa; identical to SEQ ID NO: 198763

SEQ ID NO: 262164 - RNA, 64 nt, hsa; identical to SEQ ID NO: 198764

SEQ ID NO: 262165 - RNA, 64 nt, hsa; identical to SEQ ID NO: 198765

SEQ ID NO: 262166 - RNA, 64 nt, hsa; identical to SEQ ID NO: 198766

SEQ ID NO: 262167 - RNA, 64 nt, hsa; identical to SEQ ID NO: 198767

SEQ ID NO: 262168 - RNA, 64 nt, hsa; identical to SEQ ID NO: 198768

SEQ ID NO: 262169 - RNA, 64 nt, hsa; identical to SEQ ID NO: 198769

SEQ ID NO: 262170 - RNA, 64 nt, hsa; identical to SEQ ID NO: 198770

SEQ ID NO: 262171 - RNA, 64 nt, hsa; identical to SEQ ID NO: 198771

SEQ ID NO: 262172 - RNA, 64 nt, hsa; identical to SEQ ID NO: 198772

SEQ ID NO: 262173 - RNA, 64 nt, hsa; identical to SEQ ID NO: 198773

SEQ ID NO: 262174 - RNA, 64 nt, hsa; identical to SEQ ID NO: 198774

SEQ ID NO: 262175 - RNA, 64 nt, hsa; identical to SEQ ID NO: 198775

SEQ ID NO: 262176 - RNA, 64 nt, hsa; identical to SEQ ID NO: 198776

SEQ ID NO: 262177 - RNA, 64 nt, hsa; identical to SEQ ID NO: 198777

SEQ ID NO: 262178 - RNA, 64 nt, hsa; identical to SEQ ID NO: 198778

SEQ ID NO: 262179 - RNA, 64 nt, hsa; identical to SEQ ID NO: 198779

SEQ ID NO: 262180 - RNA, 64 nt, hsa; identical to SEQ ID NO: 198780

SEQ ID NO: 262181 - RNA, 64 nt, hsa; identical to SEQ ID NO: 198781

SEQ ID NO: 262182 - RNA, 64 nt, hsa; identical to SEQ ID NO: 198782

SEQ ID NO: 262183 - RNA, 64 nt, hsa; identical to SEQ ID NO: 198783

SEQ ID NO: 262184 - RNA, 64 nt, hsa; identical to SEQ ID NO: 198784

SEQ ID NO: 262185 - RNA, 64 nt, hsa; identical to SEQ ID NO: 198785

SEQ ID NO: 262186 - RNA, 64 nt, hsa; identical to SEQ ID NO: 198786

SEQ ID NO: 262187 - RNA, 64 nt, hsa; identical to SEQ ID NO: 198787

SEQ ID NO: 262188 - RNA, 64 nt, hsa; identical to SEQ ID NO: 198788

SEQ ID NO: 262189 - RNA, 64 nt, hsa; identical to SEQ ID NO: 198789

SEQ ID NO: 262190 - RNA, 64 nt, hsa; identical to SEQ ID NO: 198790

SEQ ID NO: 262191 - RNA, 64 nt, hsa; identical to SEQ ID NO: 198791

SEQ ID NO: 262192 - RNA, 64 nt, hsa; identical to SEQ ID NO: 198792

SEQ ID NO: 262193 - RNA, 64 nt, hsa; identical to SEQ ID NO: 198793

SEQ ID NO: 262194 - RNA, 64 nt, hsa; identical to SEQ ID NO: 198794

SEQ ID NO: 262195 - RNA, 64 nt, hsa; identical to SEQ ID NO: 198795

SEQ ID NO: 262196 - RNA, 64 nt, hsa; identical to SEQ ID NO: 198796

SEQ ID NO: 262197 - RNA, 64 nt, hsa; identical to SEQ ID NO: 198797

SEQ ID NO: 262198 - RNA, 64 nt, hsa; identical to SEQ ID NO: 198798

SEQ ID NO: 262199 - RNA, 64 nt, hsa; identical to SEQ ID NO: 198799

SEQ ID NO: 262200 - RNA, 64 nt, hsa
gaaguacuccugguauugcaagucauuugcucuaauucucaauuguaggcaaacugauuuguaa

SEQ ID NO: 262201 - RNA, 64 nt, hsa
uuggggacaugaguaguugucugggauacgucauauucucaacaguuucuuuguaguaguagga

SEQ ID NO: 262202 - RNA, 64 nt, hsa
acauaccauucucaaucccacugaaauugcuggcauucucaaaggcagggcagagggggaucug

SEQ ID NO: 262203 - RNA, 64 nt, hsa
ugaggaucacuccaagaaaagagauccacauaccauucucaaucccacugaaauugcuggcauu

SEQ ID NO: 262204 - RNA, 64 nt, hsa
gcuuagacucuaucaugggcccccaugaagcuccauucucaauacugaauaauuauuacuuccc

SEQ ID NO: 262205 - RNA, 64 nt, hsa
gacccuucauuuaaugaccaccuuagggcugaugauucucaaaucuguauuccccgaucuugca

SEQ ID NO: 262206 - RNA, 64 nt, hsa
uuguuaucaauuaacuguuuuucuccauuucauaauucucaagauuuuucuaaauacagccuuu

SEQ ID NO: 262207 - RNA, 64 nt, hsa
ugacacggauuauuuguugcuuuuauguuucuaaauucucaauuaaaaagaaguguauccuuaa

SEQ ID NO: 262208 - RNA, 64 nt, hsa
ccccucugggagcuggggccuggccuuucugcccauucucaacaaacacucuugucuggagaca

SEQ ID NO: 262209 - RNA, 64 nt, hsa
guguacuauuuacuuucuucacccuugccccuuuauucucaaggucuuuugauugugaagcaag

SEQ ID NO: 262210 - RNA, 64 nt, hsa
auuaagggaaaaucuauaaaaacaagguuagcauauucucaacacagauaccaccacuuucuuu

SEQ ID NO: 262211 - RNA, 64 nt, hsa
gauaaagcagauucugucuucauugcaaaaaguuauucucaauggaagaauggcaucugaucuc

SEQ ID NO: 262212 - RNA, 64 nt, hsa
aaauuuaauuuugauuugcuucagcagggaaaauauucucaauaauguaaaauaauuaaggucu

SEQ ID NO: 262213 - RNA, 64 nt, hsa
gugacacaccuagauguguguuacuucaauuaaaauucucaaauuuaauuuugauuugcuucag

SEQ ID NO: 262214 - RNA, 64 nt, hsa
uguagcacaggcuggauugcagugcaauccugcaauucucaaucuugcacugcagccucgaccu

SEQ ID NO: 262215 - RNA, 64 nt, hsa
uuugguuuaaaguagcagguuuagguuuugcuacauucucaaaagacagcaggaguauuugaca

SEQ ID NO: 262216 - RNA, 64 nt, hsa
caguguguaagcuaaacaaaaacuaaaacuaagaauucucaaaaaaacuuguucaaaacaggga

SEQ ID NO: 262217 - RNA, 64 nt, hsa
auucuugcaucuggccuuagaaaugugaaguuauauucucaaguuuauuuuuuuccaaguguag

SEQ ID NO: 262218 - RNA, 64 nt, hsa
caauuuauguaugaaagaaauucuugaauucgucauucucaaccuuugaauuaaagcuuagacu

SEQ ID NO: 262219 - RNA, 64 nt, hsa
uaaauuuuuaucuauugccuuaaacauuuacaugauucucaauauguuuuagcuguacaguuuu

SEQ ID NO: 262220 - RNA, 64 nt, hsa
ugaguuacagguucccagggaugaaccaauucacauucucaauguggcuaucaagacugacugu

SEQ ID NO: 262221 - RNA, 64 nt, hsa
cuaguaaagcagggccgagacagaaagaaaauagauucucaacgagauuucacuguggcuucuc

SEQ ID NO: 262222 - RNA, 64 nt, hsa
agagauuuuauauauauuuuguuuguaaugagccauucucaauaaacauuauucucacugcaaa

SEQ ID NO: 262223 - RNA, 64 nt, hsa
ucaccuuccugaaagaugaaugagaaagcugcccauucucaagacucaucugccuagggagggu

SEQ ID NO: 262224 - RNA, 64 nt, hsa
ucauuaauucagauaauuuuuaaguuuccuagugauucucaaucucuuugaauuuuacuuacau

SEQ ID NO: 262225 - RNA, 64 nt, hsa
ucacuaauucagauaauguauaaguuucccagugauucucaaccucuuugaauuuuacuuauaa

SEQ ID NO: 262226 - RNA, 64 nt, hsa
gacagccgugcccagacugugcguuugcuuagcucggggacagcacuuggcccggggucuccug

SEQ ID NO: 262227 - RNA, 64 nt, hsa
agagcauggacagguggauaguaaaucaccaccacggggacagccgugcccagacugugcguuu

SEQ ID NO: 262228 - RNA, 64 nt, hsa
accuaugcaugccaaaacuguucuaggucgacugcggggacagaacaaaaaucaaaacaaagaa

SEQ ID NO: 262229 - RNA, 64 nt, hsa
gauuuuacuaaaaaaaaaaaaaaaaaagagagggcggggacaaauaucaaauuaagcaaguaaa

SEQ ID NO: 262230 - RNA, 64 nt, hsa
acaaaaagggcgcaucuuuaagaguuuuaaugccagugcuuaauucgaaugaggggauuuuaag

SEQ ID NO: 262231 - RNA, 64 nt, hsa
gauugucaguguaagaaugugauuuaauguuuguagugcuuacaauuuuguguaccaacuggau

SEQ ID NO: 262232 - RNA, 64 nt, hsa
ccuuugcauaggagaauguuuuuaugaucuguuuagugcuuauuauuuuuuuuaugaucuguuu

SEQ ID NO: 262233 - RNA, 64 nt, hsa
guuuagugcuuauuauuuuuuuuaugaucuguuuagugcuuauuauuuuccaguaaauaugcuu

SEQ ID NO: 262234 - RNA, 64 nt, hsa
gucucuuguuuuauguccuuguuccuaauguaaaagugcuuaacugcuucuugguuguauuggg

SEQ ID NO: 262235 - RNA, 64 nt, hsa
aacucaaacauugcaaaaguggguggcaauauucagugcuuaacacuuuucuagcguugguaca

SEQ ID NO: 262236 - RNA, 64 nt, hsa
aacugaagauugugaccagucagaauaaugucaaagugcuuacagugcagguagugauaugugc

SEQ ID NO: 262237 - RNA, 64 nt, hsa
ggucuaucugaugugacagcuucuguagcacuaaagugcuuauagugcagguaguguuuaguua

SEQ ID NO: 262238 - RNA, 64 nt, hsa
uccucauuaagccaaccugccuucuguaagucacagugcuuaaaucucaggauuuuucauuagg

SEQ ID NO: 262239 - RNA, 64 nt, hsa
uauuugcccauucugguguaacuuaugugacucuagugcuuaacagcugccguugaagcuaaua

SEQ ID NO: 262240 - RNA, 64 nt, hsa
gcccagugccacgcacaggugcugaccuauaguaagugcuuaacauuuguugaauaggggaaag

SEQ ID NO: 262241 - RNA, 64 nt, hsa
ccugucucuaaaaaaauaaaaauagaaauaaaguagugcuuauuguuugcauguugggucuugu

SEQ ID NO: 262242 - RNA, 64 nt, hsa
auaacuuacgggauaacaauaguagguaacaccgagugcuuacaauucagugggcacggucaaa

SEQ ID NO: 262243 - RNA, 64 nt, hsa
cuuucuuuaaaacauuccaaguguauauagauucagugcuuauuucucagcuuuuucuuucuua

SEQ ID NO: 262244 - RNA, 64 nt, hsa
uuaaaacucuaguuaaaauacuugauguacauaaagugcuuagcaaaaugaccaacucauacua

SEQ ID NO: 262245 - RNA, 64 nt, hsa
auaaagugcuuagcaaaaugaccaacucauacuaagugcuuaguaaauguuagauaaguauucu

SEQ ID NO: 262246 - RNA, 64 nt, hsa
uggucgggggauuccucuucuucaagcugcucagcuaacccagaagaggggagagaguacuccg

SEQ ID NO: 262247 - RNA, 64 nt, hsa
ugaucaaagguagggccaauuaaggauucuaacccuaacccagcaccacaaagccccccuggag

SEQ ID NO: 262248 - RNA, 64 nt, hsa
gcacuaaagucacuuuaaagcuuuuggagaagcaggagggcauuggcuuaaccaagccgaaggc

SEQ ID NO: 262249 - RNA, 64 nt, hsa
ggccccagcugucgccuuucugaccagcaggccuggagggcaggggcacagagcagagaggagg

SEQ ID NO: 262250 - RNA, 64 nt, hsa
agcaggccuggagggcaggggcacagagcagagaggagggcacugguggucuccugcuuagccu

SEQ ID NO: 262251 - RNA, 64 nt, hsa
ucaccaugcuuccccuagaaggguucugaucaccggagggcagccccaaaggccacaguccccu

SEQ ID NO: 262252 - RNA, 64 nt, hsa
uuaagggacaggcacagcagaggugagagugggaggagggcacguaccgggugccagcccugga

SEQ ID NO: 262253 - RNA, 64 nt, hsa
gcucuuagcccccuggcuuugugccaggccuggaggagggcagucccccauggggugccgagcc

SEQ ID NO: 262254 - RNA, 64 nt, hsa
gcgcuggagcugaaggaauggacgagcccugggaggagggcagaaggcuacgcagggcugagga

SEQ ID NO: 262255 - RNA, 64 nt, hsa
uuuaguguacgauguuugcugugcuucccgccguggagggcagagccaccccacaucaggaucg

SEQ ID NO: 262256 - RNA, 64 nt, hsa
gugcuggugucugggaccaaaaagggggaauaugggagggcagaguggggaggggaguccaugg

SEQ ID NO: 262257 - RNA, 64 nt, hsa
auuccuuucccaguuguuacccuagcaaggcuagggagggcaugaacacaaacauaagaacugg

SEQ ID NO: 262258 - RNA, 64 nt, hsa
ggggugaaacuccagcagguggcugggcuggaaaggagggcagggcuacauccuggcucggugg

SEQ ID NO: 262259 - RNA, 64 nt, hsa
uauccauagacacaugcuaggauaggccccgcugggagggcaguuacaggagagaguagguggu

SEQ ID NO: 262260 - RNA, 64 nt, hsa
agcuagccaaguuuucugcgagccuucagagcuaggagggcacccuaggcucugggaucccgug

SEQ ID NO: 262261 - RNA, 64 nt, hsa
agcccagcaguguggagacccugccacagccagaggagggcagagggagaauccaaggguugag

SEQ ID NO: 262262 - RNA, 64 nt, hsa
cacucccugggacacagacccaggacccccgaggggagggcaggauggccuuuccuucccucuc

SEQ ID NO: 262263 - RNA, 64 nt, hsa
guuccuggguacccaggccugaccagagggagcgggagggcagaggugaggagggggaagaugu

SEQ ID NO: 262264 - RNA, 64 nt, hsa
accauaauuguaaccagugccuuuccuccccacuggagggcaagcccccccacccacccaggau

SEQ ID NO: 262265 - RNA, 64 nt, hsa
acucggccaggugcugaucggugagguggccuggggagggcagaggcaagguuaccagggcacc

SEQ ID NO: 262266 - RNA, 64 nt, hsa
cagggcuuggauugauguuuauacccucugaauuggagggcagugccagggcauuugcagaagc

SEQ ID NO: 262267 - RNA, 64 nt, hsa
cgucuccagcuucagccuuuccagaaacccuuguggagggcaguguuggcugcagguuucauca

SEQ ID NO: 262268 - RNA, 64 nt, hsa
aaguaaaugggggccguugggacggcgggugccuggagggcagcucugggcucagcgggcagug

SEQ ID NO: 262269 - RNA, 64 nt, hsa
gggagggccaugugcaauauuuggaggguuuucuggagggcagcaggaaggcuggggaauuccc

SEQ ID NO: 262270 - RNA, 64 nt, hsa
cugugucucaugcacuggcacauauggucaccuuggagggcagaccuaggagccccucugacca

SEQ ID NO: 262271 - RNA, 64 nt, hsa
cacccccuucaagaggcgccauagacccuagcggggagggcaggggagggacggaaggcuggca

SEQ ID NO: 262272 - RNA, 64 nt, hsa
aagcaccuggcuaagggcugggccuggccagcagggagggcaguugaugagagaggguguuccc

SEQ ID NO: 262273 - RNA, 64 nt, hsa
ggagagcagagaaugggggaacuugaggguggggggagggcaccggagccuugccaccauccca

SEQ ID NO: 262274 - RNA, 64 nt, hsa
uuggcgggcuggggagcggcccccagccgggacgggagggcagcgaccccgaggccucguggac

SEQ ID NO: 262275 - RNA, 64 nt, hsa
ccuuucccaggguaucuguggguugccaggcuggggagggcaaccauagccacaccacaggauu

SEQ ID NO: 262276 - RNA, 64 nt, hsa
ccagugcccacccagccccucagguggcacaucuggagggcagggguugaggggccaccaccac

SEQ ID NO: 262277 - RNA, 64 nt, hsa
cuuagaaggggaugagucagauuuuuacagaggaggagggcagggcuuggguccaguggaggaa

SEQ ID NO: 262278 - RNA, 64 nt, hsa
ugauggccaucagacagagacuucaaaugcugauggagggcagaggaaguacuuagggagguug

SEQ ID NO: 262279 - RNA, 64 nt, hsa
aucaggcaggagggcagggaugguggcagccauaggagggcaggguaggguagggccucugagg

SEQ ID NO: 262280 - RNA, 64 nt, hsa
gagcugagcagagaggccuaaccaggaucaggcaggagggcagggaugguggcagccauaggag

SEQ ID NO: 262281 - RNA, 64 nt, hsa
gcaacaaggagcuggguguggaccaggagucagaggagggcaaaggcaaaacaagcccugauaa

SEQ ID NO: 262282 - RNA, 64 nt, hsa
acuuugacaguuucaucugcugcuucguuaggcuggagggcauguucaguaagugggagagggg

SEQ ID NO: 262283 - RNA, 64 nt, hsa
uccugacuggcuccuagggaaggggaaggcuccuggagggcagcccuaccucucccaugcccuu

SEQ ID NO: 262284 - RNA, 64 nt, hsa
augaaaucuuggauuuggggcugaggggugggagggagggcagagcucugcacacucaaaggcu

SEQ ID NO: 262285 - RNA, 64 nt, hsa
guggcagcacagccacacccguucccacgucagaggagggcaaggcuggguacucagcagccac

SEQ ID NO: 262286 - RNA, 64 nt, hsa
gcagccuggagccagcccggggacuguccuggguggagggcaggugaacacaagcugcugccgg

SEQ ID NO: 262287 - RNA, 64 nt, hsa
ugaggccagggacagucuugccagacgacucugaggagggcaagggacaguuccauggcccuuc

SEQ ID NO: 262288 - RNA, 64 nt, hsa
uggcagaaggaaaauggggaggcacugggguuguggagggcauggguauggcugaggagggugc

SEQ ID NO: 262289 - RNA, 64 nt, hsa
guggagcuggucacgcugggcgcccaggaggaagggagggcagagggggcuguggccgucagug

SEQ ID NO: 262290 - RNA, 64 nt, hsa
aggcagcagaacuagugccagggguggcugaguuggagggcaagggcuggggcugggaugggag

SEQ ID NO: 262291 - RNA, 64 nt, hsa
uucaagaugcccaagaugaccaugcccaagcuagggagggcagaguccccaucacguggcaagc

SEQ ID NO: 262292 - RNA, 64 nt, hsa
uccccuuaaagcagagagggagggcaggcgggagggagggcauuggcaugcggcgcugugcaug

SEQ ID NO: 262293 - RNA, 64 nt, hsa
gcccaaaagccccagauccccuuaaagcagagagggagggcaggcgggagggagggcauuggca

SEQ ID NO: 262294 - RNA, 64 nt, hsa
acaccucccuagagggagggagggagggcaggguggagggcaaggcuggggggaggggauuggg

SEQ ID NO: 262295 - RNA, 64 nt, hsa
cugcaggaccucacaccucccuagagggagggagggagggcaggguggagggcaaggcuggggg

SEQ ID NO: 262296 - RNA, 64 nt, hsa
gcuggaggagagacggggcugggcgcaagguggcggagggcaguguggguucugugucugucug

SEQ ID NO: 262297 - RNA, 64 nt, hsa
caugcccugaagaggcaggguacacauggggcugggagggcaaagauggggcggggccuccccc

SEQ ID NO: 262298 - RNA, 64 nt, hsa
ggcuacgccacagcuggacacacaugcagccccuggagggcagccucuuccugugccucgaugg

SEQ ID NO: 262299 - RNA, 64 nt, hsa
ggcagccucuuccugugccucgauggggugggugggagggcaucuucugugcguugggucaguu

SEQ ID NO: 262300 - RNA, 64 nt, hsa
uaccuuguuuugccagugauaagagcaguggguuggagggcacuuggccaguuuucuguucagc

SEQ ID NO: 262301 - RNA, 64 nt, hsa
uuccaacagagggaggaaugugugccuuguucaaggagggcacgacccuuaggccuuuuucaac

SEQ ID NO: 262302 - RNA, 64 nt, hsa; identical to SEQ ID NO: 89720

SEQ ID NO: 262303 - RNA, 64 nt, hsa; identical to SEQ ID NO: 89721

SEQ ID NO: 262304 - RNA, 64 nt, hsa; identical to SEQ ID NO: 89722

SEQ ID NO: 262305 - RNA, 64 nt, hsa; identical to SEQ ID NO: 89723

SEQ ID NO: 262306 - RNA, 64 nt, hsa; identical to SEQ ID NO: 89724

SEQ ID NO: 262307 - RNA, 64 nt, hsa; identical to SEQ ID NO: 89725

SEQ ID NO: 262308 - RNA, 64 nt, hsa; identical to SEQ ID NO: 89726

SEQ ID NO: 262309 - RNA, 64 nt, hsa; identical to SEQ ID NO: 89727

SEQ ID NO: 262310 - RNA, 64 nt, hsa; identical to SEQ ID NO: 89728

SEQ ID NO: 262311 - RNA, 64 nt, hsa; identical to SEQ ID NO: 89729

SEQ ID NO: 262312 - RNA, 64 nt, hsa; identical to SEQ ID NO: 89730

SEQ ID NO: 262313 - RNA, 64 nt, hsa; identical to SEQ ID NO: 89731

SEQ ID NO: 262314 - RNA, 64 nt, hsa
cauuauccagucaucuggauauguauauaaguauauacaccacauuuucuuuauccagucaucu

SEQ ID NO: 262315 - RNA, 64 nt, hsa
augcauauauguguauguguauguauauaaguauauacaccacauuauccagucaucuggauau

SEQ ID NO: 262316 - RNA, 64 nt, hsa
gggugaggguaaagcuuuucuauaaucaagcucaauacaccaaggaaacuggauccagaauucc

SEQ ID NO: 262317 - RNA, 64 nt, hsa
gaaacuguauauguuacugccuuguacuuuucucauacaccaaaaacacaccaaaaaaaucaau

SEQ ID NO: 262318 - RNA, 64 nt, hsa
acaaaaucaauauacaaaauaugguagcauuuuuauacaccaacgacauccaagcugagagcca

SEQ ID NO: 262319 - RNA, 64 nt, hsa
gccuuaaaaaaaaaaaaaagaaaauguggcacauauacaccauggaauacuaugcagccauaaa

SEQ ID NO: 262320 - RNA, 64 nt, hsa
acaaaaucuguguacaaaaauuaguugcauuucuauacaccaguaauguccaagcuaugaacca

SEQ ID NO: 262321 - RNA, 64 nt, hsa
cagcaguagaccagauaaagaaaauuugguacauauacaccauggaauacuaugcagccauaaa

SEQ ID NO: 262322 - RNA, 64 nt, hsa; identical to SEQ ID NO: 47675

SEQ ID NO: 262323 - RNA, 64 nt, hsa; identical to SEQ ID NO: 47676

SEQ ID NO: 262324 - RNA, 64 nt, hsa; identical to SEQ ID NO: 47677

SEQ ID NO: 262325 - RNA, 64 nt, hsa; identical to SEQ ID NO: 47678

SEQ ID NO: 262326 - RNA, 64 nt, hsa; identical to SEQ ID NO: 47679

SEQ ID NO: 262327 - RNA, 64 nt, hsa; identical to SEQ ID NO: 47680

SEQ ID NO: 262328 - RNA, 64 nt, hsa; identical to SEQ ID NO: 47681

SEQ ID NO: 262329 - RNA, 64 nt, hsa; identical to SEQ ID NO: 47682

SEQ ID NO: 262330 - RNA, 64 nt, hsa; identical to SEQ ID NO: 47683

SEQ ID NO: 262331 - RNA, 64 nt, hsa; identical to SEQ ID NO: 47684

SEQ ID NO: 262332 - RNA, 64 nt, hsa; identical to SEQ ID NO: 47685

SEQ ID NO: 262333 - RNA, 64 nt, hsa; identical to SEQ ID NO: 47686

SEQ ID NO: 262334 - RNA, 64 nt, hsa; identical to SEQ ID NO: 47687

SEQ ID NO: 262335 - RNA, 64 nt, hsa; identical to SEQ ID NO: 47688

SEQ ID NO: 262336 - RNA, 63 nt, hsa
acugacgguucccugaggauggggcuguuucuccccuccgacuggggcucccugaggaugggg

SEQ ID NO: 262337 - RNA, 63 nt, hsa
gacuggggcucccugaggauggggcuguuucuccccuccgacuggggcucccugaggacaggg

SEQ ID NO: 262338 - RNA, 63 nt, hsa
gcugaaccccuacucccggagcccccagcagggcccuccgagguggagcagcagcuacaagca

SEQ ID NO: 262339 - RNA, 63 nt, hsa
cagcugaaccccuacccggagcccccagcagggcccuccgagguggaacagcagcuacaagca

SEQ ID NO: 262340 - RNA, 63 nt, hsa
aacacaguggccagguguccccaggcuccuggccccuccgacgaccucaacucugcccagccc

SEQ ID NO: 262341 - RNA, 63 nt, hsa
ggcacccuccugagccggcgugugccgguccagcccuccgagaugccacaauuccuuggaugg

SEQ ID NO: 262342 - RNA, 64 nt, hsa
gugugaaguuccagagcaaggagccauguuccucuaagggaauucaggaauucagacgugcuag

SEQ ID NO: 262343 - RNA, 64 nt, hsa
gcucuucuaccucccuaguuaguggaaauuuggauaagggaacuguagggcccagauucuggag

SEQ ID NO: 262344 - RNA, 64 nt, hsa
cuucuaauuauuccaauaugaccuuaaggaaaaguaagggaauaaauuuuugucuuuguuggag

SEQ ID NO: 262345 - RNA, 64 nt, hsa
ccuggaacgguagcaaugggauauaauaccuuucuaagggaaaaaguuguaucaguaccauuug

SEQ ID NO: 262346 - RNA, 64 nt, hsa
gaaagacgguguuugguuucccaucuaaucaacuuaagggaagccggcauguacccuucaaggc

SEQ ID NO: 262347 - RNA, 64 nt, hsa
aauaaaaucucaacaccugugggagaguaagaacuaagggaaugaguuugggcggccccucaua

SEQ ID NO: 262348 - RNA, 64 nt, hsa
uuuaggagagauaucauuaucgcuguuuuauaaauaagggaaacuuuagcuugaggguuuaagg

SEQ ID NO: 262349 - RNA, 64 nt, hsa
aacugauguuuucagcauauuuucaaaauauugauaagggaaguuauuacuuuuauauaguauu

SEQ ID NO: 262350 - RNA, 64 nt, hsa
cucuccuucuaaaaacuucucaacuguuuucauuuaagggaaagaaaaugaguauuuuguccuu

SEQ ID NO: 262351 - RNA, 64 nt, hsa
aucaggggagaaaaauuggcaaaacuauuauauguaagggaaauauauacaaaaagaaaauuaa

SEQ ID NO: 262352 - RNA, 64 nt, hsa
agccuggggaagacaaucaagcuacaggcacugauaagggaacuagcacaggggauugugccug

SEQ ID NO: 262353 - RNA, 64 nt, hsa
guaaaaacucgcacaaaccuccggcucacucaguuaagggaacaagaccagacacagaaaugcc

SEQ ID NO: 262354 - RNA, 62 nt, hsa
aagcccaguuucuccugagcauucagacccccaggccccagcacuuggcguuuucaggaggc

SEQ ID NO: 262355 - RNA, 62 nt, hsa
caaaacacggccccgacacuuaguguggccccaggccccagcgagccucgcccucccaguuu

SEQ ID NO: 262356 - RNA, 62 nt, hsa
ccuccccuaaacugacuggacggcugccaaggaggccccaaacccaggccccaugcaaaggc

SEQ ID NO: 262357 - RNA, 62 nt, hsa
gacuggacggcugccaaggaggccccaaacccaggccccaugcaaaggcacgugguuuccuu

SEQ ID NO: 262358 - RNA, 62 nt, hsa
cauacccgaaaggugaaaccagcuuucauuauaggccccagugggccacuuggguuuugaga

SEQ ID NO: 262359 - RNA, 62 nt, hsa
aggugaggccagaaaguuguuaggccugccgcaggccccacccucaagcauuccucaggaag

SEQ ID NO: 262360 - RNA, 62 nt, hsa
uuccucccagagcucagcccaugucacccuccaggccccagaauccagaguggccucauuuc

SEQ ID NO: 262361 - RNA, 62 nt, hsa
cuugcucugggaauuaggugaccuuccuggggaggccccaggagagugaaucagggacucuu

SEQ ID NO: 262362 - RNA, 62 nt, hsa
agggucucaccucacauugucccuacaaggacaggccccaacugauaaccguugcuuuuuuu

SEQ ID NO: 262363 - RNA, 62 nt, hsa
guggguaacacccucaagucucuuugccagugaggccccaccacaucggugugaguuagguu

SEQ ID NO: 262364 - RNA, 62 nt, hsa
acucaaaaucacugccaugguucaauguucccaggccccaggccauccacuugccggccccc

SEQ ID NO: 262365 - RNA, 62 nt, hsa
aggguauccuugggcccaaugaauuaggggugaggccccagaacccguuaucuaugaguugu

SEQ ID NO: 262366 - RNA, 62 nt, hsa
cccagugaucuguauuugaugaggaggagccgaggccccagcuucauccagcuucaaccaau

SEQ ID NO: 262367 - RNA, 62 nt, hsa
ugcacacuccagcccaaagggucuguggccggaggccccacgagcaggccccagcagucacc

SEQ ID NO: 262368 - RNA, 62 nt, hsa
ccaaagggucuguggccggaggccccacgagcaggccccagcagucaccggcucuggucuug

SEQ ID NO: 262369 - RNA, 62 nt, hsa
cguacucaggcuugugccacgggugagcacugaggccccagguguccucccucccccacugu

SEQ ID NO: 262370 - RNA, 62 nt, hsa
ugagaacagguucugagagggggcuucuaggaaggccccagcccuaguccuaggcgacuuga

SEQ ID NO: 262371 - RNA, 62 nt, hsa
uguaagaaacacacugaggcagggaaguccccaggccccaggaagccgugcccugcccccgu

SEQ ID NO: 262372 - RNA, 62 nt, hsa
cccacucaagccaagcagccaagcuccuugggaggccccacuggggaaauaacagcuguggc

SEQ ID NO: 262373 - RNA, 62 nt, hsa
ggacuaugacuggcuacggggaggccaccaccaggccccagcucuccacccugaacucccca

SEQ ID NO: 262374 - RNA, 62 nt, hsa
ccgaccugggaugcgcacaguguccccaacgcaggccccacucugagccugcccugggcagc

SEQ ID NO: 262375 - RNA, 62 nt, hsa
cacauaagccaacgccagagccccuccaccucaggccccagccccugccucuccauuauuua

SEQ ID NO: 262376 - RNA, 62 nt, hsa
ccagaggcgagggaccaguggaggugccagggaggccccaggacccugugguccccuggcuc

SEQ ID NO: 262377 - RNA, 62 nt, hsa
agaguaccuuugccuaaacucuuuuagaauugaggccccaacuuugauggcacauuuaauac

SEQ ID NO: 262378 - RNA, 62 nt, hsa
cccagcauccuaggcucagcuuaccgggugauaggccccauaagacacacacaugagcaggg

SEQ ID NO: 262379 - RNA, 62 nt, hsa
gcccgagagccuccccaggccucuucgugggaaggccccaguaccacucguaggaggucuca

SEQ ID NO: 262380 - RNA, 62 nt, hsa
gcaucagacgggcuuccaggaccgcagcaggcaggccccagcgccgagacuccuggugacag

SEQ ID NO: 262381 - RNA, 62 nt, hsa
gggcaaaggagcacaaggaaaccaagcagcagaggccccaucagcacagagggccucguucc

SEQ ID NO: 262382 - RNA, 62 nt, hsa
uucucuauucugacauuacagaccaccggauaaggccccauucuuccuuuacacccuccccu

SEQ ID NO: 262383 - RNA, 62 nt, hsa
ccuuuucccauuguuccugcgcugcaaauugcaggccccagcaaucgugacugacguuugcu

SEQ ID NO: 262384 - RNA, 62 nt, hsa
cgguugacccaggucauggaauggaaacggugaggccccaguggcuguucuggaagaaacag

SEQ ID NO: 262385 - RNA, 62 nt, hsa
ggcuguucuggaagaaacagaucuccuggcaaaggccccagcaucucccucacugaaaccag

SEQ ID NO: 262386 - RNA, 62 nt, hsa
acugagcuccucugggcaggaccucagaguccaggccccaaaaccacagcccugucagugca

SEQ ID NO: 262387 - RNA, 62 nt, hsa
aacaccagggaugguacuagggggaagugacaaggccccagagacucagagggaggaaucga

SEQ ID NO: 262388 - RNA, 62 nt, hsa
cugacagaaagcuccucccacccaaaugggccaggccccagcaugauccugaaaucugcauc

SEQ ID NO: 262389 - RNA, 57 nt, hsa
gggagaccgacguccuuuagcccucccaggccccacggcagcacuuaugguagcggc

SEQ ID NO: 262390 - RNA, 62 nt, hsa
guccugggucuucccaaccauaccccgagaucaggccccaccugccagcucuacugggcuug

SEQ ID NO: 262391 - RNA, 62 nt, hsa
gacaccgucucacacguuggcuuuggacaaccaggccccaacuuggucccugcccuagggac

SEQ ID NO: 262392 - RNA, 62 nt, hsa
caggggaggcuguggggguccuggcagccaggaggccccaggugguuuugaggcucgcucuu

SEQ ID NO: 262393 - RNA, 62 nt, hsa
ggugccugagaagagggugaaggagcuggggcaggccccauccugggcauuggagaugauga

SEQ ID NO: 262394 - RNA, 62 nt, hsa
aaauccuaaagccuccaucucuaauaaauggaaggccccaaggcccugaggggaucucaaau

SEQ ID NO: 262395 - RNA, 62 nt, hsa
gacuucccccuuugggggaccccaaaauuuggaggccccauucuaggacucuggggauccca

SEQ ID NO: 262396 - RNA, 62 nt, hsa
agagaccccuguuagccagcccucgaucauugaggccccauuauuaacagauacucccauaa

SEQ ID NO: 262397 - RNA, 62 nt, hsa
gcgcugcaggggugucggcgcgccaccucuccaggccccagaagcccuucuugcccaaaggc

SEQ ID NO: 262398 - RNA, 62 nt, hsa
cacaaaccucugugguauaggugaggggugugaggccccagccuggagccaggcacugggug

SEQ ID NO: 262399 - RNA, 62 nt, hsa
gguaucugagcugcccacacccccaccugccaaggccccacagagcccaaaacagaaggggg

SEQ ID NO: 262400 - RNA, 62 nt, hsa
agggccugcaggugcuccccgcccugagacccaggccccaaaucagcaauaaugaacaaacc

SEQ ID NO: 262401 - RNA, 62 nt, hsa
cccaagguugucagcuuuggauugcuggggccaggccccauggaggguauacugaggggucu

SEQ ID NO: 262402 - RNA, 62 nt, hsa
aacucuccuggccuucuaggaauggaggagccaggccccaccccuucccuauaggaacagcc

SEQ ID NO: 262403 - RNA, 62 nt, hsa
ccagguauccugggggaagaggagaugugaucaggccccaccccuguaaucaggcaaggagg

SEQ ID NO: 262404 - RNA, 64 nt, hsa
aauacaaauauuccagccccaaaugagaaaucaaacauauuaaaauuguucaagaaaauuucuu

SEQ ID NO: 262405 - RNA, 64 nt, hsa
cuauauaaucuuacauuuaaaauuguauuccuacacauauuagaaacucuucuaauaaaugaag

SEQ ID NO: 262406 - RNA, 64 nt, hsa
aacacuuugacuccuaaaugugauacuggugggcacauauuaauuuguaucgcuuuugcuucuc

SEQ ID NO: 262407 - RNA, 64 nt, hsa
gauccgcacuuacauuagaguuaugggaauauacacauauuaauguggcucccuuuuucuugug

SEQ ID NO: 262408 - RNA, 64 nt, hsa
uagacuuguuuuaguaauggaaacucuuaccuccacauauuauccuacagauguuuccagaaau

SEQ ID NO: 262409 - RNA, 64 nt, hsa
cucaguuagauauauuuugugaacccuugauuagacauauuaaaauauaccaauguuguaguaa

SEQ ID NO: 262410 - RNA, 64 nt, hsa
uuaaaaaauagagcuuggucaaccucuauacuacacauauuacaagauauagcacuuucaaaau

SEQ ID NO: 262411 - RNA, 64 nt, hsa
auauuuucaggaucguucaucuagugagcaauacacauauuauaggccaauauuuuuuuaaaaa

SEQ ID NO: 262412 - RNA, 64 nt, hsa
aaaauuuauuauaacacuaaacacuccuuuuuugacauauuaaagccuuuauuccaucucucaa

SEQ ID NO: 262413 - RNA, 64 nt, hsa
agagaccaaaacugucuagaauuugaaaggguuuacauauuauuauacuaaagcaguacuggac

SEQ ID NO: 262414 - RNA, 64 nt, hsa
aauuuggggccuuguguuugugccagagggauacacauauuaaacugcaggccaccuuccuggu

SEQ ID NO: 262415 - RNA, 64 nt, hsa
uucucuagagcaguuuuaugucauuuguaaaaacacauauuagcaaauucguuugcguagguuu

SEQ ID NO: 262416 - RNA, 64 nt, hsa
gaacaguaaaaugauguguugacuauacugauacacauauuaaacuauaccuuauaguaaacca

SEQ ID NO: 262417 - RNA, 64 nt, hsa
uuaauauaauuagugcuuuacauguguuaguuauacauauuagaagcauauuugccuaguaagg

SEQ ID NO: 262418 - RNA, 64 nt, hsa
cucaaaaguauaaaaaacuuuaauacaaguacauacauauuauauauacacauacauauauaua

SEQ ID NO: 262419 - RNA, 64 nt, hsa
guguaauuguuucaaacauccauuuucuuugugaacauauuagugauugaaguauuuugacuuu

SEQ ID NO: 262420 - RNA, 64 nt, hsa
ucuccucuaguagaccugugacuuacuguguuggacauauuauuuagacuuagucauacaaaga

SEQ ID NO: 262421 - RNA, 64 nt, hsa
cagcuaaugggagagaauguaaaugugcaaagguacauauuaagcuuagggauuuuugaauuuu

SEQ ID NO: 262422 - RNA, 64 nt, hsa
uugcugaacaccuuucccuguuuuccauuuauacacauauuaaagucauauugggaaagauggc

SEQ ID NO: 262423 - RNA, 64 nt, hsa
accacugaagaacaaguguuccuuuuuaccacauacauauuauguuuugaucacugcugcuuga

SEQ ID NO: 262424 - RNA, 59 nt, hsa
guggguugucucuucaugaagaaccagcggaacucaaaacugcuguucaagaaaccucu

SEQ ID NO: 262425 - RNA, 59 nt, hsa
gacaguuaaauucagaaacgugccaaauggaacucaaggugccccuucagaauuaaaau

SEQ ID NO: 262426 - RNA, 59 nt, hsa
cuagguggaaccacuucuucugccucauugaacucaacauccuucagacuuuuaaggca

SEQ ID NO: 262427 - RNA, 59 nt, hsa
cagcccuucagcaccacugcaggauaaccgaacucaaggcuuaauuaacggggcacuaa

SEQ ID NO: 262428 - RNA, 59 nt, hsa
auauuuugacuauuuuuauauauaaagaagaacucaaaaaauuauguucaaauuuguac

SEQ ID NO: 262429 - RNA, 59 nt, hsa
gggcuguuucuacagguaacauuaaaugugaacucaacacuuccagagucuuuaaaggg

SEQ ID NO: 262430 - RNA, 59 nt, hsa
guaaguaggcagcacuuuuaaaaauaugugaacucaaauauugcacuucuuucaagaug

SEQ ID NO: 262431 - RNA, 59 nt, hsa
uacagaccacacugcaggaagucaaacacgaacucaaagaggacauccagcugcucagc

SEQ ID NO: 262432 - RNA, 59 nt, hsa
cccuuaagcagaacaaccgugaugccauggaacucaagcccaacggcggugcugaccaa

SEQ ID NO: 262433 - RNA, 59 nt, hsa
cagaaggcaagaaauaacuaaaaucagcagaacucaaggaaauagagacacaaaaaaac

SEQ ID NO: 262434 - RNA, 59 nt, hsa
acaaagggcuaauauccagaaucuacaaugaacucaaacaaauuuacaggaacaaacaa

SEQ ID NO: 262435 - RNA, 59 nt, hsa
cuucuaugauuccaagcaucuggugcacagaacucaagaccucaaaauugaguuacugu

SEQ ID NO: 262436 - RNA, 59 nt, hsa
ugccauuaucaucauuacauacuguuagagaacucaaauggugggaauauuuuaugauu

SEQ ID NO: 262437 - RNA, 64 nt, hsa; identical to SEQ ID NO: 42317

SEQ ID NO: 262438 - RNA, 64 nt, hsa; identical to SEQ ID NO: 42318

SEQ ID NO: 262439 - RNA, 64 nt, hsa; identical to SEQ ID NO: 42319

SEQ ID NO: 262440 - RNA, 64 nt, hsa; identical to SEQ ID NO: 42320

SEQ ID NO: 262441 - RNA, 64 nt, hsa; identical to SEQ ID NO: 42321

SEQ ID NO: 262442 - RNA, 64 nt, hsa; identical to SEQ ID NO: 42322

SEQ ID NO: 262443 - RNA, 64 nt, hsa; identical to SEQ ID NO: 42323

SEQ ID NO: 262444 - RNA, 64 nt, hsa; identical to SEQ ID NO: 42324

SEQ ID NO: 262445 - RNA, 64 nt, hsa; identical to SEQ ID NO: 42325

SEQ ID NO: 262446 - RNA, 64 nt, hsa; identical to SEQ ID NO: 42326

SEQ ID NO: 262447 - RNA, 64 nt, hsa; identical to SEQ ID NO: 42327

SEQ ID NO: 262448 - RNA, 64 nt, hsa; identical to SEQ ID NO: 42328

SEQ ID NO: 262449 - RNA, 64 nt, hsa; identical to SEQ ID NO: 42329

SEQ ID NO: 262450 - RNA, 64 nt, hsa; identical to SEQ ID NO: 42330

SEQ ID NO: 262451 - RNA, 64 nt, hsa; identical to SEQ ID NO: 42331

SEQ ID NO: 262452 - RNA, 64 nt, hsa; identical to SEQ ID NO: 42332

SEQ ID NO: 262453 - RNA, 64 nt, hsa
gucauucauucaauaguguguguaguauuggugcuguguccaaauuagaagcuagcugagguag

SEQ ID NO: 262454 - RNA, 64 nt, hsa
acucauagugguuguuucucuggucuugagugacuguguccacaguucauuuuuuuccgguagg

SEQ ID NO: 262455 - RNA, 64 nt, hsa
ugggcuaaagccauaggaagaaaaaugugauguauguguccaguauguacuauuuuguuuuugu

SEQ ID NO: 262456 - RNA, 64 nt, hsa
gaugucauugauguuucuccuguuggaaagcugauguguccagcucaaccuuugugcugacauc

SEQ ID NO: 262457 - RNA, 64 nt, hsa
gccaaacaacugcagggaguuuggcuaacaguccuguguccagggugccgguggggauguuaua

SEQ ID NO: 262458 - RNA, 64 nt, hsa
uucguuucuaugaauguccguguacgucagcguguguguccaccuuccugagugauguguucgc

SEQ ID NO: 262459 - RNA, 64 nt, hsa
acaucaagcacgagcgaugaugacaccaaauccauguguccacccugggacccaggagggcaca

SEQ ID NO: 262460 - RNA, 64 nt, hsa
cuuccaggagcucuaaggguacuugggaaucaauuguguccauucugaggucucuccaguggga

SEQ ID NO: 262461 - RNA, 64 nt, hsa
acugacccaggaccauccuggagggcuuucuggguguguccagggggugggcugucacugcuug

SEQ ID NO: 262462 - RNA, 64 nt, hsa
ccucuucgugguuguguuucucgugcugcaucccuguguccacugagacuuuccccucucgcgc

SEQ ID NO: 262463 - RNA, 64 nt, hsa
guccugagcgaacuugccugaugcagggcugugcuguguccagauguugcuggggccucacuuu

SEQ ID NO: 262464 - RNA, 64 nt, hsa
uuggaagugggaacaguuuuguccuguaugcugauguguccagaauuucauuuaaugauagacg

SEQ ID NO: 262465 - RNA, 64 nt, hsa
gcaacagaagugacuucuggagaaagcucauggcuguguccacugcaauuggugguaacagugg

SEQ ID NO: 262466 - RNA, 64 nt, hsa
ggcuaugaggauaaugggaagagguuugguuuccuguguccaguagugggaucauccagaggag

SEQ ID NO: 262467 - RNA, 64 nt, hsa
guggaggggcuucuucagcacagagaccccccacuguguccagggacccccucugccaggugga

SEQ ID NO: 262468 - RNA, 64 nt, hsa
acuguguccagggacccccucugccagguggagguguguccaggggcuggggaagccgagacgg

SEQ ID NO: 262469 - RNA, 64 nt, hsa
cagcaggcggcauuggagucuaggagcucagcuguguguccaucaacacacaaauucguaaaaa

SEQ ID NO: 262470 - RNA, 64 nt, hsa
gacgccuccccaauuccccagggaaggaaacuguuguguccaauccccauuaaagacaaauuga

SEQ ID NO: 262471 - RNA, 64 nt, hsa
aagaaacgugucccuggcccauauuaaucccucguguguccauaauuaggguccacgcccaugu

SEQ ID NO: 262472 - RNA, 64 nt, hsa
cacgcccaugugugagugugugcaaguaugugaguguguccaagugugugugcguguguccaug

SEQ ID NO: 262473 - RNA, 64 nt, hsa
ugcaaguaugugaguguguccaagugugugugcguguguccaugugugugcaagugugugcaug

SEQ ID NO: 262474 - RNA, 64 nt, hsa
cuacaugucuguggguaucacacugagugugaguuguguccacacgugcucaagcagaaggacu

SEQ ID NO: 262475 - RNA, 64 nt, hsa
guuguguccacacgugcucaagcagaaggacuuuuguguccaugcuugugucuagaaaacagac

SEQ ID NO: 262476 - RNA, 64 nt, hsa
uuacccccaaccuggugcucucugaaacaugugcuguguccacucaggguuaaauggauuaagg

SEQ ID NO: 262477 - RNA, 64 nt, hsa
gcagaaagaaaccuccagcaagggaagagagguguguguccacaggaaggggcuccguggggau

SEQ ID NO: 262478 - RNA, 64 nt, hsa
ugguagaagggaaagcccauaugcuaccaccagcuguguccaaaaccgccagcucuguucuucc

SEQ ID NO: 262479 - RNA, 64 nt, hsa
ugugucgcaugcgccaguugggccuggacccuccuguguccaucccuguucccccaggggcucu

SEQ ID NO: 262480 - RNA, 64 nt, hsa
aggcuggcccagcugcagacugcuuagggacuucuguguccauccugggggguaagcccacgug

SEQ ID NO: 262481 - RNA, 64 nt, hsa
acauccuucccuccuuuagugaagcccccgagguuguguccagggugaugaguguggacggggg

SEQ ID NO: 262482 - RNA, 64 nt, hsa
agcuuugagaagcgguacaagaguucugugccuguguguccagcccuggagccagccagugcau

SEQ ID NO: 262483 - RNA, 64 nt, hsa
cccccacauuuaauugucugauauagaauaguguuguguccacugccccgcuagacggcuuucu

SEQ ID NO: 262484 - RNA, 64 nt, hsa
uuucuucccuucuugacuucuaauaggugucauugaaauguaaaaucuaaguaugaaauuauga

SEQ ID NO: 262485 - RNA, 64 nt, hsa
aagaaaaaagaaaaugagcaagcaaauauuugaagaaauguauaaaaccauagauuucuuucag

SEQ ID NO: 262486 - RNA, 64 nt, hsa
uuuccauccacaguguacuuuaagauugucuuaagaaauguaucugcaugaacuccgugggaac

SEQ ID NO: 262487 - RNA, 64 nt, hsa
ggaacacucacuaugguuaaauaaggucuuaaaagaaauguaaauauucuguuaauaaaguuaa

SEQ ID NO: 262488 - RNA, 64 nt, hsa
agagagguauagauaaaugcaucacaucacuuuugaaauguaauucuggucuauaccauggaag

SEQ ID NO: 262489 - RNA, 64 nt, hsa
ucccauuccucuuggguuucaucuugucguuuaagaaauguacugaaauaaucauuggaauauu

SEQ ID NO: 262490 - RNA, 64 nt, hsa
caauaaagaccuccaaggguacuucuuuggaaaugaaauguagcacaaucuuagccuacguuac

SEQ ID NO: 262491 - RNA, 64 nt, hsa
ucuugacucucccggcucugccacuguuuucugagaaauguagcauccgcugcagcuggccaca

SEQ ID NO: 262492 - RNA, 64 nt, hsa
guacagacagguaaaaguuccauuucugagugaugaaauguaacacuucuucaucuuuaacuug

SEQ ID NO: 262493 - RNA, 64 nt, hsa
aauuggaaaugggcaguucugaauuuucacguuugaaauguaaaauauaaacuucagucaauau

SEQ ID NO: 262494 - RNA, 64 nt, hsa
uggcagcuguccuuugacauuuuuuuuuuuagaggaaauguaacuuggaucuaguuuaauuuuu

SEQ ID NO: 262495 - RNA, 64 nt, hsa
accagcuccuucucucaaacuuguauuucuccuggaaauguaucucagaaaugaccuccucucc

SEQ ID NO: 262496 - RNA, 64 nt, hsa
gcccugaggauggugguuaaggaaacaggagcaggaaauguacacacagauuccugucccuuug

SEQ ID NO: 262497 - RNA, 64 nt, hsa
agagaauaaguauagcuagagaaauugcuucucugaaauguacaugagcccuuaagguaagaga

SEQ ID NO: 262498 - RNA, 64 nt, hsa
auuuguagaaauguaaugcgguucugaguggcuugaaauguacagaauguuuugaaaguguuuu

SEQ ID NO: 262499 - RNA, 64 nt, hsa
ucuuggcaccucaucccaacaaaucacauuuguagaaauguaaugcgguucugaguggcuugaa

SEQ ID NO: 262500 - RNA, 64 nt, hsa
aacauuaaaugucaauuauaggaaaacauaguuggaaauguaaucauccaaagaucauuuuuaa

SEQ ID NO: 262501 - RNA, 64 nt, hsa
caaagucuguaguaaauccugaugcugaccaucugaaauguacuuuuuuucugaaugcuguuuc

SEQ ID NO: 262502 - RNA, 64 nt, hsa
gauggauucaacuucugccucggaugagagguuggaaauguagcugcuuuucuuuagaaaauau

SEQ ID NO: 262503 - RNA, 64 nt, hsa
cauuuaaagacaaagacauuauuucucauagcaggaaauguagagguagaugguuccaguauca

SEQ ID NO: 262504 - RNA, 64 nt, hsa
aaaccuuaugaacuacaguggagcuacacucauugaaauguaauuucaguucuaaaaagaugua

SEQ ID NO: 262505 - RNA, 64 nt, hsa
gagaaaagaguacagcauuuacucuuaucaucuagaaauguaauaugcuucccccccgcuuuuu

SEQ ID NO: 262506 - RNA, 64 nt, hsa
uaaguuugugaagguguggugggugaaacuaagagaaauguagcauuagcucucacaaaagagg

SEQ ID NO: 262507 - RNA, 64 nt, hsa
gcacugguguaaauaucauggugccuacucgaaagaaauguagaugcuaugcauuuugaaaaua

SEQ ID NO: 262508 - RNA, 64 nt, hsa
acuauagauuccaaacauaacguugcaccaaauagaaauguauauuuuauuaugcaaugccuua

SEQ ID NO: 262509 - RNA, 64 nt, hsa
guugguuuuuuucccucuuucccaacauguuuaagaaauguaacauucuaaguauuggaucucu

SEQ ID NO: 262510 - RNA, 64 nt, hsa
gaggagaaacagggugagucaagguaaaggagcagaaauguaguuacaagccaggucgucuuca

SEQ ID NO: 262511 - RNA, 64 nt, hsa
aucuauccucagguuugccucaaauaugugacaagaaauguauaauucaugacauagucaugua

SEQ ID NO: 262512 - RNA, 64 nt, hsa
agguguguugcaucaauauuuaaauaaaaucccagaaauguauuuuaaagaauuucagguuuga

SEQ ID NO: 262513 - RNA, 64 nt, hsa
uaagauguaaauugaagaagccucacacguaaaagaaauguauuaauguauguaggagcugcag

SEQ ID NO: 262514 - RNA, 64 nt, hsa
uauugauuuucacagcuuugaggaacaugcauaagaaauguagcugaaguagaggggacgugag

SEQ ID NO: 262515 - RNA, 64 nt, hsa
aauaguacaugaaaucaagaugcuuaugagcauggaaauguauuuaaaguuuuugcuugugucc

SEQ ID NO: 262516 - RNA, 64 nt, hsa
uguugauaaacauuuuaugcuugcauuuaaacuugaaauguaugagcagaaugagacaaucagu

SEQ ID NO: 262517 - RNA, 64 nt, hsa
gcacaaauuuuuaugggacaaagccuagaaaagagaaauguaguuugaaucauaaucuaaauca

SEQ ID NO: 262518 - RNA, 64 nt, hsa
uucuccuuucacugguguuggacuuaaaucaguugaaauguauuucuguaccacaauuuacgcu

SEQ ID NO: 262519 - RNA, 64 nt, hsa
cccucccacuucugaaguucaaauuagugccucggaaauguagaauuuauuauuugucauuuuu

SEQ ID NO: 262520 - RNA, 64 nt, hsa
gcaugauacaguaagguguaauuacagaauuuacgaaauguaaauggccucuacagaguuuuau

SEQ ID NO: 262521 - RNA, 64 nt, hsa
aguacucagugauaaauggauuaaaaaauauucagaaauguauugggggguggaggagaauaag

SEQ ID NO: 262522 - RNA, 64 nt, hsa
aacuauauuugaacgacauuccccccgaaaaauugaaauguaaagaugaggcagagaauaaagu

SEQ ID NO: 262523 - RNA, 64 nt, hsa
cuugaauacauuuugagaauaacuaauguggauugaaauguagagauacacuggagugcuuuau

SEQ ID NO: 262524 - RNA, 64 nt, hsa
ugaugacuguguuaagugcaucuguauuguaagugaaauguaauuauuucuguguaccauaugg

SEQ ID NO: 262525 - RNA, 64 nt, hsa
cugguuauaaccugacgcuaaaacuaaaaacaaggaaauguaccucuuucuucagaauuaaaac

SEQ ID NO: 262526 - RNA, 64 nt, hsa
cacagauuuaauaccuauuaauaauauaagagcugaaauguaagucauuucuucaguccuucuc

SEQ ID NO: 262527 - RNA, 64 nt, hsa
gugguaaguauaucucaguuuaaaugguaaagaagaaauguaguuuacauuuguauuuuuccag

SEQ ID NO: 262528 - RNA, 64 nt, hsa
gaaaagcaaagucaguguacacucugagugaaaggaaauguaauguggauaaaggcccgccacc

SEQ ID NO: 262529 - RNA, 64 nt, hsa
accauuccugagguuuaaaauucacggcaccauggaaauguagcugaacgucuccaguuuccuu

SEQ ID NO: 262530 - RNA, 64 nt, hsa
ucuaaaaacccaaaauguaguucucuauuaaccugaaauguacacuagcccagaacaguuuaau

SEQ ID NO: 262531 - RNA, 64 nt, hsa
auuuaaaauauuugggaguaguauaauuuguggagaaauguaaauuguaauaauguaaaugggg

SEQ ID NO: 262532 - RNA, 64 nt, hsa
uuucaguaggauucugggacauggauucauuacagaaauguauguguagcugugcccuagauga

SEQ ID NO: 262533 - RNA, 64 nt, hsa
auucuuauuuucaagagaauuuauggacguuguagaaauguacaaaugcauuuccaaacugccu

SEQ ID NO: 262534 - RNA, 64 nt, hsa
uuaaacucacauccauauuacaccuuuccccccugaaauguauagaauccauuugucaucagga

SEQ ID NO: 262535 - RNA, 64 nt, hsa
aucuguugccacccaggugauguuaguguuuuaagaaauguaguugauguauccaacaagccag

SEQ ID NO: 262536 - RNA, 64 nt, hsa
aaauacaggcaauuuuacugugaguguuucacuggaaauguacaaucuuuguguguuagaguau

SEQ ID NO: 262537 - RNA, 64 nt, hsa
gaaaaacauuggguuucucucuggguuuggacaugaaauguaagaaaagauuuuucacuggagc

SEQ ID NO: 262538 - RNA, 64 nt, hsa
acuuggcuucgauuuuuauauuuuccuauuauaugaaauguaucuuuugguuguuugauuuuuc

SEQ ID NO: 262539 - RNA, 64 nt, hsa
cuuaccuuuauguauauaauuaaacaaaaucagagaaauguaucaguugcucaaguuaucaagc

SEQ ID NO: 262540 - RNA, 64 nt, hsa
caaucaagaauaauuuuaauuuucuuuuguauuugaaauguaaauaguuuucuuuucgauuaaa

SEQ ID NO: 262541 - RNA, 64 nt, hsa
ccaaaauggcauacaucuuuuguacaaagaacuugaaauguaaauacuguguuugugcuguaag

SEQ ID NO: 262542 - RNA, 64 nt, hsa
guuaguacuacuuaccagauguaauuauguuuuggaaauguacauauucaaacagaagugccuc

SEQ ID NO: 262543 - RNA, 64 nt, hsa
cauuccuaucuuauuguucguuuaaucaguuucugaaauguaagcauuacaugacuauugguga

SEQ ID NO: 262544 - RNA, 64 nt, hsa
aaaccagaucaaauuaauacaaucagaagguuucgaaauguaaauauuccuuauuuaagacaug

SEQ ID NO: 262545 - RNA, 64 nt, hsa
aauuuuggaauacagccuaucucaugaccauauugaaauguacggaauuugauccaugcgauac

SEQ ID NO: 262546 - RNA, 64 nt, hsa
uuuacucaggguuuaaaaugucccauuuaaauaugaaauguaaacaaauuuguuuuuuaagguu

SEQ ID NO: 262547 - RNA, 64 nt, hsa
ugggaaaaauaagaugguuaaauuuugauuuauugaaauguaauuguauuauuuucauaaaaua

SEQ ID NO: 262548 - RNA, 64 nt, hsa
cucaaaaaaaaaaaaaaauuguguugccucauacgaaauguauuugguuuuguuggagaguguc

SEQ ID NO: 262549 - RNA, 64 nt, hsa
ggggaagauaugcaaauacuuugaucuaagaauugaaauguaucaagaauuuauauuuugccug

SEQ ID NO: 262550 - RNA, 64 nt, hsa
uuuuuucccuauugacugucagaaaauccacugggaaauguaaaaaucuucacucaccauuaug

SEQ ID NO: 262551 - RNA, 64 nt, hsa
aaauuuaaaggagcaaaaauuugcaagucaaauagaaauguacaaaucgagauaacauuuacau

SEQ ID NO: 262552 - RNA, 64 nt, hsa
accuacaugcugucauugaacagagauguggggagaaauguaaacaaucagcucacaggcauca

SEQ ID NO: 262553 - RNA, 64 nt, hsa
acuccgccucaaaaaaaaaaaaaaaagaaaaaaagaaauguaccuguuggcaggagaaggccag

SEQ ID NO: 262554 - RNA, 64 nt, hsa
guucccuuuauuuuaacauuguacagacaauacagaaauguaccuguuggcggccgggugcagu

SEQ ID NO: 262555 - RNA, 64 nt, hsa
uuuuaaguguaauuaaguugaagaucaaaaaauggaaauguauaauuaaaucauacuuagcaaa

SEQ ID NO: 262556 - RNA, 64 nt, hsa
uauaauuaaaucauacuuagcaaaucuaacacaugaaauguaacaucugcauauggagaaucgu

SEQ ID NO: 262557 - RNA, 64 nt, hsa
aaggacucacuggagagauacucuauaaaugugugaaauguagggaaguauucuuuaauguuau

SEQ ID NO: 262558 - RNA, 64 nt, hsa
ggauucacucuggagagaagucauaugaauguaagaaauguagaaaagcauugaguucucucag

SEQ ID NO: 262559 - RNA, 64 nt, hsa
auguaaaaaaaaaaaaaaguauaguuuuauauuugaaauguaugcaaauuauggccauauggcu

SEQ ID NO: 262560 - RNA, 64 nt, hsa
uccauguggugcuuccgacccuggcugucagagugaaauguaaagucagggcucuguacaguuu

SEQ ID NO: 262561 - RNA, 64 nt, hsa
ccucuucuuaaaaaugaguaaauggaggcccagagaaauguaauuugccugagaucaaauuaag

SEQ ID NO: 262562 - RNA, 64 nt, hsa
uuucuuucauguagaaaucuacauguauauacaagaaauguauuuuuaucugcaggauaauauu

SEQ ID NO: 262563 - RNA, 64 nt, hsa
ucguaaaaaauguacauuugcccuuucucuuccuucuaaacaugugucucucccacaggucauu

SEQ ID NO: 262564 - RNA, 64 nt, hsa
cugaauacgcauucagggacagaucuaggcaguuucuaaacaacacuuagacuggggucuaacg

SEQ ID NO: 262565 - RNA, 64 nt, hsa
ggauaaaaagguguggaagugaauauaaaaugcaucuaaacaugacauuuaauuuguuuauaaa

SEQ ID NO: 262566 - RNA, 64 nt, hsa
cuuuuaauauuuaaaauaacuuguuuauucaaugucuaaacacaugucaguuuuccacuggauu

SEQ ID NO: 262567 - RNA, 64 nt, hsa
gacuuuucaauacuauuggagugauuuuuuucuuucuaaacagggaaaauaauguuacaaaagc

SEQ ID NO: 262568 - RNA, 64 nt, hsa
aagcuuuucuuacuccugguucccuaccaguauuucuaaacaugucgcacuuucuccacaggca

SEQ ID NO: 262569 - RNA, 64 nt, hsa
aacacagugcuaaguauuuguguaucuaaacauaucuaaacauagaaaagguacaguaaaaaua

SEQ ID NO: 262570 - RNA, 64 nt, hsa
aggcgguuguaacacagugcuaaguauuuguguaucuaaacauaucuaaacauagaaaagguac

SEQ ID NO: 262571 - RNA, 64 nt, hsa
auuuuucacuuguuuuugccaaugggagguagacacaauaaaauaaugccaugggagucacacu

SEQ ID NO: 262572 - RNA, 64 nt, hsa
uuauuuuuucucugaaaauuuugugugugauugcacaauaaauaauuuuuagagaaacaaaggc

SEQ ID NO: 262573 - RNA, 64 nt, hsa
uuugcuuaugaauauuuauaacagcauucuugucacaauaaauguauucaaauaccaauaacag

SEQ ID NO: 262574 - RNA, 64 nt, hsa
uucugaaaauuccagaaaggauauuuaagaaaauacaauaaacuauuggaaaguacuccccuaa

SEQ ID NO: 262575 - RNA, 64 nt, hsa
ccaggagauuucauuuuauucacccuggucagauacaauaaaggcuaugaguauaaauacauaa

SEQ ID NO: 262576 - RNA, 64 nt, hsa
uccucucuugaaaucuugcuggaccucuuaggcuacaauaaacuguaccaaacuaaacugacag

SEQ ID NO: 262577 - RNA, 64 nt, hsa
uuuuuccuugagugugcuuuguauaaaggucuguacaauaaaucacacuuuuuuaaagcuuaga

SEQ ID NO: 262578 - RNA, 64 nt, hsa
ucaaauuggaugaaauauauaauuacuugauagcacaauaaacauagaaagaauuuauaugaau

SEQ ID NO: 262579 - RNA, 64 nt, hsa
cuuuucucaugagagcucacuauuuuaacaauaaacaauaaacguuguuucuaauuuuugcauu

SEQ ID NO: 262580 - RNA, 64 nt, hsa
acauacucuuuucucaugagagcucacuauuuuaacaauaaacaauaaacguuguuucuaauuu

SEQ ID NO: 262581 - RNA, 64 nt, hsa
ugguuaaaagguuuuauguuauguauauuuuaccacaauaaaugcaaaaaauaaaaagucugug

SEQ ID NO: 262582 - RNA, 64 nt, hsa
uguaucccaaaguuauuaccacauaaucuuuuaaacaauaaaacaaauaccccuuagaaagucu

SEQ ID NO: 262583 - RNA, 64 nt, hsa
aaaguugauuugaagugaggauuagaagugaaugacaauaaagucugucagccaagcacgaacc

SEQ ID NO: 262584 - RNA, 64 nt, hsa
cucugaaaauaaaaacccugacuuuaguuguaaaacaauaaaaguuagcuacuugguauacgga

SEQ ID NO: 262585 - RNA, 64 nt, hsa
auucaguuuaguacaggagugacauuaacuaaugacaauaaauuaaacaaagccuacauuaguu

SEQ ID NO: 262586 - RNA, 64 nt, hsa
uaguugacuuuguauauauauaaagaaaucuauuacaauaaaaauauaacauaaucuauucauc

SEQ ID NO: 262587 - RNA, 64 nt, hsa
aaagggaugaaugugaauuaugaacuaguaugugacaauaaaugaccaccaaguacuaccugac

SEQ ID NO: 262588 - RNA, 64 nt, hsa
auuuaaaagaacauuuuucucuccaacauauuuuacaauaaaagcaacuuuuaauuguauagau

SEQ ID NO: 262589 - RNA, 64 nt, hsa
aauuuguugauuuuguaccaaaguguuucugaagacaauaaauugugagucaacuuuagaacaa

SEQ ID NO: 262590 - RNA, 64 nt, hsa
cuaguuaaucauaauauuugauggaaagaaaaagacaauaaaauuguaauauaauaaauuuggc

SEQ ID NO: 262591 - RNA, 64 nt, hsa
uauuaaaaauauuauuaguaaaauaaaauuucacacaauaaaaaacaacauagaguacacauau

SEQ ID NO: 262592 - RNA, 64 nt, hsa
ucuguuguaauuguaguauuguuuuuguaauuuaacaauaaauaagccugcuacauguaaaaag

SEQ ID NO: 262593 - RNA, 64 nt, hsa
guauauaaaugaacaaaaaagcaagcaaagcaaaacaauaaacuagcagaagaacuaguaaaaa

SEQ ID NO: 262594 - RNA, 64 nt, hsa
gaauuuguaccuauaaagcauaaggcauuaaaugacaauaaaaauuccaaauggacuauuuguu

SEQ ID NO: 262595 - RNA, 64 nt, hsa
acuuuaaaauggaaaauuuauauguauuuuuaccacaauaaacaaaaaacccuaaaaaaacuuu

SEQ ID NO: 262596 - RNA, 64 nt, hsa
uuaacuuacaaugugaaaauacaaugugaaauguacaauaaaucauauuuauggacagaugcgu

SEQ ID NO: 262597 - RNA, 64 nt, hsa
acuauucuguuacuuuuauuucugaaacuuaaaaacaauaaauucuuuuucuguguuucuaggu

SEQ ID NO: 262598 - RNA, 64 nt, hsa
uagaauuuguuuuuguuguuuuaccuuaagaaacacaauaaaucacuguuuaaaaaagaucuca

SEQ ID NO: 262599 - RNA, 64 nt, hsa
gccagcccuggauagguuuuuaugggaauucuuuacaauaaacauagcuuguaacuugagaucu

SEQ ID NO: 262600 - RNA, 64 nt, hsa
ccuuuuucaacuuggaaaaagaaagaaacacucaacaauaaagacugagacccguucgccccca

SEQ ID NO: 262601 - RNA, 64 nt, hsa
aauaaaaccaaacaugcuuauaacauuaagaaaaacaauaaagauacaugauugaaaccaaguu

SEQ ID NO: 262602 - RNA, 64 nt, hsa
acauacuaaugaaguauuacaugauuuaaagacuacaauaaaaccaaacaugcuuauaacauua

SEQ ID NO: 262603 - RNA, 64 nt, hsa
ugcaaaauaaagaaaaaugccaaccuuagaaaagacaauaaaugcacaaaagauauaaacagga

SEQ ID NO: 262604 - RNA, 64 nt, hsa
uuuuuaaagugguuacaucuauucuugcugaagaacaauaaacagaauuuuuugacuaagcaua

SEQ ID NO: 262605 - RNA, 64 nt, hsa
gaagucuucgauucucagagagcauuugucuaauacaauaaaaacuggcauuaauacaaaccuc

SEQ ID NO: 262606 - RNA, 64 nt, hsa
gagauucugucucaaaauaaauacauacauacauacaauaaaaccgaaugagcugguucuuucc

SEQ ID NO: 262607 - RNA, 64 nt, hsa
gaaaaucugccguggaauuaacuaauaaguaguaacaauaaacuucauauuuagaaugcaaagu

SEQ ID NO: 262608 - RNA, 64 nt, hsa
uaauauuugaaggagauugccuaccaaggacaaaacaauaaauuuaaaaaucaaacgauuucuc

SEQ ID NO: 262609 - RNA, 64 nt, hsa
agugggggggaaagaugacaugguauuuaauaauacaauaaaaauauucuuaucacuuccuauc

SEQ ID NO: 262610 - RNA, 64 nt, hsa
uaauacacagaauguguacagauuauuuguuaugacaauaaaacacucaaaauaaauggucuuu

SEQ ID NO: 262611 - RNA, 64 nt, hsa
acugggccaaugcuuaauauuuuaauguaucucaacaauaaaaccaagaagaaacaaagccuuu

SEQ ID NO: 262612 - RNA, 64 nt, hsa
augcuauucuguauuuuuacuguauauugcuuuuacaauaaauauaaaaugaaauguuuauguu

SEQ ID NO: 262613 - RNA, 64 nt, hsa
uuguaucauucuugagcaaucgcucgguccguggacaauaaacaguauuaucaaagagaacgug

SEQ ID NO: 262614 - RNA, 64 nt, hsa
ggcagcugacagaggaagccgcucaaauaccuucacaauaaauaguggcaauauauauauaguu

SEQ ID NO: 262615 - RNA, 64 nt, hsa
guaaacucugcauccagagauucauuuucuagauacaauaaauugcuaauguugcuggaucagg

SEQ ID NO: 262616 - RNA, 64 nt, hsa
ugagauucaauauugaauuuuuccuaugcuauugacaauaaaauauuauugaacuacaugucuu

SEQ ID NO: 262617 - RNA, 64 nt, hsa
uaaacaauuauuuaucacuuuuaugacccaaaucacaauaaaauugucauuuaggauaaacugg

SEQ ID NO: 262618 - RNA, 64 nt, hsa
gguuuguuguuucaugucauauuacucagucuaaacaauaaauauuucauaauuuacaaaggag

SEQ ID NO: 262619 - RNA, 64 nt, hsa
cacaguuugcuuauuugccaccauaagaaaugguacaauaaaaauucauguaaucaccccuuag

SEQ ID NO: 262620 - RNA, 64 nt, hsa
ucuuuuugagaauuuguuuacuugauuucuuuccacaauaaacugacagagaacgcuacuaaug

SEQ ID NO: 262621 - RNA, 64 nt, hsa
uaggaccuugaugugaggaaaagauaaaauuuaaacaauaaauuugccacuuagauuuucuagc

SEQ ID NO: 262622 - RNA, 64 nt, hsa
uauauuuuguagaacccaaaagauuggagccuuaacaauaaacaucagcacuaagugaccuguu

SEQ ID NO: 262623 - RNA, 64 nt, hsa
auugucuauauggaauuuaggauaaagaauauuuacaauaaagaauauuuacaauaaagaguuu

SEQ ID NO: 262624 - RNA, 64 nt, hsa
uuaggauaaagaauauuuacaauaaagaauauuuacaauaaagaguuuauuauuauuuguaagu

SEQ ID NO: 262625 - RNA, 64 nt, hsa
uaauuggcuauauggaauuuaggauagaauauuuacaauaaagaguauuuacaauaaagaguuu

SEQ ID NO: 262626 - RNA, 64 nt, hsa
auuuaggauagaauauuuacaauaaagaguauuuacaauaaagaguuuguuauuauuuguaaau

SEQ ID NO: 262627 - RNA, 64 nt, hsa
uuacugcugaauucucaauuuucuuaacauugagacaauaaauguguguuuugucuuguauaug

SEQ ID NO: 262628 - RNA, 64 nt, hsa
uauauaggcuugucaguucccauuuuucuugacaacaauaaauaccacuuuuaaaaaugacaca

SEQ ID NO: 262629 - RNA, 64 nt, hsa
uguguuacuguuuaccauggcaguaauggggcaaacaauaaaaugcaaugugaaaugauuugau

SEQ ID NO: 262630 - RNA, 64 nt, hsa
aaaaaucauucuggagguggcauguccuugacucacaauaaaaauuuuagaaaacuauugaaag

SEQ ID NO: 262631 - RNA, 64 nt, hsa
ucaucuuugugugaagccaguuauagaauguuugacaauaaauugugcuguacacguaaauguc

SEQ ID NO: 262632 - RNA, 64 nt, hsa
caaucugcaacaauauguaaaguugauauugacuacaauaaaaauccagucuuaauuccagauu

SEQ ID NO: 262633 - RNA, 64 nt, hsa; identical to SEQ ID NO: 90763

SEQ ID NO: 262634 - RNA, 64 nt, hsa; identical to SEQ ID NO: 90764

SEQ ID NO: 262635 - RNA, 64 nt, hsa; identical to SEQ ID NO: 90765

SEQ ID NO: 262636 - RNA, 64 nt, hsa; identical to SEQ ID NO: 90766

SEQ ID NO: 262637 - RNA, 64 nt, hsa; identical to SEQ ID NO: 90767

SEQ ID NO: 262638 - RNA, 64 nt, hsa; identical to SEQ ID NO: 90768

SEQ ID NO: 262639 - RNA, 64 nt, hsa; identical to SEQ ID NO: 90769

SEQ ID NO: 262640 - RNA, 64 nt, hsa; identical to SEQ ID NO: 90770

SEQ ID NO: 262641 - RNA, 64 nt, hsa; identical to SEQ ID NO: 90771

SEQ ID NO: 262642 - RNA, 64 nt, hsa; identical to SEQ ID NO: 90772

SEQ ID NO: 262643 - RNA, 64 nt, hsa; identical to SEQ ID NO: 90773

SEQ ID NO: 262644 - RNA, 64 nt, hsa; identical to SEQ ID NO: 90774

SEQ ID NO: 262645 - RNA, 64 nt, hsa; identical to SEQ ID NO: 90775

SEQ ID NO: 262646 - RNA, 64 nt, hsa; identical to SEQ ID NO: 90776

SEQ ID NO: 262647 - RNA, 64 nt, hsa; identical to SEQ ID NO: 90777

SEQ ID NO: 262648 - RNA, 64 nt, hsa; identical to SEQ ID NO: 90778

SEQ ID NO: 262649 - RNA, 64 nt, hsa; identical to SEQ ID NO: 90779

SEQ ID NO: 262650 - RNA, 64 nt, hsa; identical to SEQ ID NO: 90780

SEQ ID NO: 262651 - RNA, 64 nt, hsa; identical to SEQ ID NO: 90781

SEQ ID NO: 262652 - RNA, 64 nt, hsa; identical to SEQ ID NO: 90782

SEQ ID NO: 262653 - RNA, 64 nt, hsa; identical to SEQ ID NO: 90783

SEQ ID NO: 262654 - RNA, 64 nt, hsa; identical to SEQ ID NO: 90784

SEQ ID NO: 262655 - RNA, 64 nt, hsa; identical to SEQ ID NO: 90785

SEQ ID NO: 262656 - RNA, 64 nt, hsa; identical to SEQ ID NO: 90786

SEQ ID NO: 262657 - RNA, 64 nt, hsa; identical to SEQ ID NO: 90787

SEQ ID NO: 262658 - RNA, 64 nt, hsa; identical to SEQ ID NO: 90788

SEQ ID NO: 262659 - RNA, 64 nt, hsa; identical to SEQ ID NO: 90789

SEQ ID NO: 262660 - RNA, 64 nt, hsa; identical to SEQ ID NO: 90790

SEQ ID NO: 262661 - RNA, 64 nt, hsa; identical to SEQ ID NO: 90791

SEQ ID NO: 262662 - RNA, 64 nt, hsa; identical to SEQ ID NO: 90792

SEQ ID NO: 262663 - RNA, 64 nt, hsa; identical to SEQ ID NO: 90793

SEQ ID NO: 262664 - RNA, 64 nt, hsa; identical to SEQ ID NO: 90794

SEQ ID NO: 262665 - RNA, 64 nt, hsa; identical to SEQ ID NO: 90795

SEQ ID NO: 262666 - RNA, 64 nt, hsa; identical to SEQ ID NO: 90796

SEQ ID NO: 262667 - RNA, 64 nt, hsa; identical to SEQ ID NO: 90797

SEQ ID NO: 262668 - RNA, 64 nt, hsa; identical to SEQ ID NO: 90798

SEQ ID NO: 262669 - RNA, 64 nt, hsa; identical to SEQ ID NO: 90799

SEQ ID NO: 262670 - RNA, 64 nt, hsa; identical to SEQ ID NO: 90800

SEQ ID NO: 262671 - RNA, 64 nt, hsa; identical to SEQ ID NO: 90801

SEQ ID NO: 262672 - RNA, 64 nt, hsa; identical to SEQ ID NO: 90802

SEQ ID NO: 262673 - RNA, 64 nt, hsa; identical to SEQ ID NO: 90803

SEQ ID NO: 262674 - RNA, 64 nt, hsa; identical to SEQ ID NO: 90804

SEQ ID NO: 262675 - RNA, 64 nt, hsa; identical to SEQ ID NO: 90805

SEQ ID NO: 262676 - RNA, 64 nt, hsa; identical to SEQ ID NO: 90806

SEQ ID NO: 262677 - RNA, 64 nt, hsa; identical to SEQ ID NO: 90807

SEQ ID NO: 262678 - RNA, 64 nt, hsa; identical to SEQ ID NO: 90808

SEQ ID NO: 262679 - RNA, 64 nt, hsa; identical to SEQ ID NO: 90809

SEQ ID NO: 262680 - RNA, 64 nt, hsa; identical to SEQ ID NO: 90810

SEQ ID NO: 262681 - RNA, 64 nt, hsa; identical to SEQ ID NO: 90811

SEQ ID NO: 262682 - RNA, 64 nt, hsa; identical to SEQ ID NO: 90812

SEQ ID NO: 262683 - RNA, 64 nt, hsa; identical to SEQ ID NO: 90813

SEQ ID NO: 262684 - RNA, 64 nt, hsa; identical to SEQ ID NO: 90814

SEQ ID NO: 262685 - RNA, 64 nt, hsa; identical to SEQ ID NO: 90815

SEQ ID NO: 262686 - RNA, 64 nt, hsa; identical to SEQ ID NO: 90816

SEQ ID NO: 262687 - RNA, 64 nt, hsa; identical to SEQ ID NO: 90817

SEQ ID NO: 262688 - RNA, 64 nt, hsa; identical to SEQ ID NO: 90818

SEQ ID NO: 262689 - RNA, 64 nt, hsa; identical to SEQ ID NO: 90819

SEQ ID NO: 262690 - RNA, 64 nt, hsa; identical to SEQ ID NO: 90820

SEQ ID NO: 262691 - RNA, 64 nt, hsa; identical to SEQ ID NO: 90821

SEQ ID NO: 262692 - RNA, 64 nt, hsa; identical to SEQ ID NO: 90822

SEQ ID NO: 262693 - RNA, 64 nt, hsa; identical to SEQ ID NO: 90823

SEQ ID NO: 262694 - RNA, 64 nt, hsa; identical to SEQ ID NO: 90824

SEQ ID NO: 262695 - RNA, 64 nt, hsa; identical to SEQ ID NO: 90825

SEQ ID NO: 262696 - RNA, 64 nt, hsa; identical to SEQ ID NO: 90826

SEQ ID NO: 262697 - RNA, 64 nt, hsa; identical to SEQ ID NO: 90827

SEQ ID NO: 262698 - RNA, 64 nt, hsa; identical to SEQ ID NO: 90828

SEQ ID NO: 262699 - RNA, 64 nt, hsa; identical to SEQ ID NO: 90829

SEQ ID NO: 262700 - RNA, 64 nt, hsa; identical to SEQ ID NO: 90830

SEQ ID NO: 262701 - RNA, 64 nt, hsa; identical to SEQ ID NO: 90831

SEQ ID NO: 262702 - RNA, 64 nt, hsa; identical to SEQ ID NO: 90832

SEQ ID NO: 262703 - RNA, 64 nt, hsa; identical to SEQ ID NO: 90833

SEQ ID NO: 262704 - RNA, 64 nt, hsa; identical to SEQ ID NO: 90834

SEQ ID NO: 262705 - RNA, 64 nt, hsa; identical to SEQ ID NO: 90835

SEQ ID NO: 262706 - RNA, 64 nt, hsa; identical to SEQ ID NO: 90836

SEQ ID NO: 262707 - RNA, 64 nt, hsa; identical to SEQ ID NO: 90837

SEQ ID NO: 262708 - RNA, 64 nt, hsa; identical to SEQ ID NO: 90838

SEQ ID NO: 262709 - RNA, 64 nt, hsa; identical to SEQ ID NO: 90839

SEQ ID NO: 262710 - RNA, 64 nt, hsa; identical to SEQ ID NO: 90840

SEQ ID NO: 262711 - RNA, 64 nt, hsa; identical to SEQ ID NO: 90841

SEQ ID NO: 262712 - RNA, 64 nt, hsa; identical to SEQ ID NO: 90842

SEQ ID NO: 262713 - RNA, 64 nt, hsa; identical to SEQ ID NO: 90843

SEQ ID NO: 262714 - RNA, 64 nt, hsa; identical to SEQ ID NO: 90844

SEQ ID NO: 262715 - RNA, 64 nt, hsa; identical to SEQ ID NO: 90845

SEQ ID NO: 262716 - RNA, 64 nt, hsa; identical to SEQ ID NO: 90846

SEQ ID NO: 262717 - RNA, 64 nt, hsa; identical to SEQ ID NO: 90847

SEQ ID NO: 262718 - RNA, 64 nt, hsa; identical to SEQ ID NO: 90848

SEQ ID NO: 262719 - RNA, 64 nt, hsa; identical to SEQ ID NO: 90849

SEQ ID NO: 262720 - RNA, 64 nt, hsa; identical to SEQ ID NO: 90850

SEQ ID NO: 262721 - RNA, 64 nt, hsa; identical to SEQ ID NO: 90851

SEQ ID NO: 262722 - RNA, 64 nt, hsa; identical to SEQ ID NO: 90852

SEQ ID NO: 262723 - RNA, 64 nt, hsa; identical to SEQ ID NO: 90853

SEQ ID NO: 262724 - RNA, 64 nt, hsa; identical to SEQ ID NO: 90854

SEQ ID NO: 262725 - RNA, 64 nt, hsa; identical to SEQ ID NO: 90855

SEQ ID NO: 262726 - RNA, 64 nt, hsa; identical to SEQ ID NO: 90856

SEQ ID NO: 262727 - RNA, 64 nt, hsa; identical to SEQ ID NO: 90857

SEQ ID NO: 262728 - RNA, 64 nt, hsa; identical to SEQ ID NO: 90858

SEQ ID NO: 262729 - RNA, 64 nt, hsa; identical to SEQ ID NO: 90859

SEQ ID NO: 262730 - RNA, 64 nt, hsa; identical to SEQ ID NO: 90860

SEQ ID NO: 262731 - RNA, 64 nt, hsa; identical to SEQ ID NO: 90861

SEQ ID NO: 262732 - RNA, 64 nt, hsa; identical to SEQ ID NO: 90862

SEQ ID NO: 262733 - RNA, 64 nt, hsa; identical to SEQ ID NO: 90863

SEQ ID NO: 262734 - RNA, 64 nt, hsa; identical to SEQ ID NO: 90864

SEQ ID NO: 262735 - RNA, 64 nt, hsa; identical to SEQ ID NO: 90865

SEQ ID NO: 262736 - RNA, 64 nt, hsa; identical to SEQ ID NO: 90866

SEQ ID NO: 262737 - RNA, 64 nt, hsa; identical to SEQ ID NO: 90867

SEQ ID NO: 262738 - RNA, 64 nt, hsa; identical to SEQ ID NO: 90868

SEQ ID NO: 262739 - RNA, 64 nt, hsa; identical to SEQ ID NO: 90869

SEQ ID NO: 262740 - RNA, 64 nt, hsa; identical to SEQ ID NO: 90870

SEQ ID NO: 262741 - RNA, 64 nt, hsa; identical to SEQ ID NO: 90871

SEQ ID NO: 262742 - RNA, 64 nt, hsa; identical to SEQ ID NO: 90872

SEQ ID NO: 262743 - RNA, 64 nt, hsa; identical to SEQ ID NO: 90873

SEQ ID NO: 262744 - RNA, 64 nt, hsa; identical to SEQ ID NO: 90874

SEQ ID NO: 262745 - RNA, 64 nt, hsa; identical to SEQ ID NO: 90875

SEQ ID NO: 262746 - RNA, 64 nt, hsa; identical to SEQ ID NO: 90876

SEQ ID NO: 262747 - RNA, 64 nt, hsa; identical to SEQ ID NO: 90877

SEQ ID NO: 262748 - RNA, 64 nt, hsa; identical to SEQ ID NO: 90878

SEQ ID NO: 262749 - RNA, 64 nt, hsa; identical to SEQ ID NO: 90879

SEQ ID NO: 262750 - RNA, 64 nt, hsa; identical to SEQ ID NO: 90880

SEQ ID NO: 262751 - RNA, 64 nt, hsa; identical to SEQ ID NO: 90881

SEQ ID NO: 262752 - RNA, 64 nt, hsa; identical to SEQ ID NO: 90882

SEQ ID NO: 262753 - RNA, 64 nt, hsa; identical to SEQ ID NO: 90883

SEQ ID NO: 262754 - RNA, 64 nt, hsa; identical to SEQ ID NO: 90884

SEQ ID NO: 262755 - RNA, 64 nt, hsa; identical to SEQ ID NO: 90885

SEQ ID NO: 262756 - RNA, 64 nt, hsa; identical to SEQ ID NO: 90886

SEQ ID NO: 262757 - RNA, 64 nt, hsa; identical to SEQ ID NO: 90887

SEQ ID NO: 262758 - RNA, 64 nt, hsa; identical to SEQ ID NO: 90888

SEQ ID NO: 262759 - RNA, 64 nt, hsa; identical to SEQ ID NO: 90889

SEQ ID NO: 262760 - RNA, 64 nt, hsa; identical to SEQ ID NO: 90890

SEQ ID NO: 262761 - RNA, 64 nt, hsa; identical to SEQ ID NO: 90891

SEQ ID NO: 262762 - RNA, 64 nt, hsa; identical to SEQ ID NO: 90892

SEQ ID NO: 262763 - RNA, 64 nt, hsa; identical to SEQ ID NO: 90893

SEQ ID NO: 262764 - RNA, 64 nt, hsa; identical to SEQ ID NO: 90894

SEQ ID NO: 262765 - RNA, 64 nt, hsa; identical to SEQ ID NO: 90895

SEQ ID NO: 262766 - RNA, 64 nt, hsa; identical to SEQ ID NO: 90896

SEQ ID NO: 262767 - RNA, 64 nt, hsa; identical to SEQ ID NO: 90897

SEQ ID NO: 262768 - RNA, 64 nt, hsa; identical to SEQ ID NO: 90898

SEQ ID NO: 262769 - RNA, 64 nt, hsa; identical to SEQ ID NO: 90899

SEQ ID NO: 262770 - RNA, 54 nt, hsa; identical to SEQ ID NO: 90900

SEQ ID NO: 262771 - RNA, 64 nt, hsa; identical to SEQ ID NO: 90901

SEQ ID NO: 262772 - RNA, 64 nt, hsa; identical to SEQ ID NO: 90902

SEQ ID NO: 262773 - RNA, 64 nt, hsa; identical to SEQ ID NO: 90903

SEQ ID NO: 262774 - RNA, 64 nt, hsa; identical to SEQ ID NO: 90904

SEQ ID NO: 262775 - RNA, 64 nt, hsa; identical to SEQ ID NO: 90905

SEQ ID NO: 262776 - RNA, 64 nt, hsa; identical to SEQ ID NO: 90906

SEQ ID NO: 262777 - RNA, 64 nt, hsa; identical to SEQ ID NO: 90907

SEQ ID NO: 262778 - RNA, 64 nt, hsa; identical to SEQ ID NO: 90908

SEQ ID NO: 262779 - RNA, 64 nt, hsa; identical to SEQ ID NO: 90909

SEQ ID NO: 262780 - RNA, 64 nt, hsa; identical to SEQ ID NO: 90910

SEQ ID NO: 262781 - RNA, 64 nt, hsa; identical to SEQ ID NO: 90911

SEQ ID NO: 262782 - RNA, 64 nt, hsa; identical to SEQ ID NO: 90912

SEQ ID NO: 262783 - RNA, 64 nt, hsa; identical to SEQ ID NO: 90913

SEQ ID NO: 262784 - RNA, 64 nt, hsa; identical to SEQ ID NO: 90914

SEQ ID NO: 262785 - RNA, 64 nt, hsa; identical to SEQ ID NO: 90915

SEQ ID NO: 262786 - RNA, 64 nt, hsa; identical to SEQ ID NO: 90916

SEQ ID NO: 262787 - RNA, 64 nt, hsa; identical to SEQ ID NO: 90917

SEQ ID NO: 262788 - RNA, 64 nt, hsa; identical to SEQ ID NO: 90918

SEQ ID NO: 262789 - RNA, 64 nt, hsa; identical to SEQ ID NO: 90919

SEQ ID NO: 262790 - RNA, 64 nt, hsa; identical to SEQ ID NO: 90920

SEQ ID NO: 262791 - RNA, 64 nt, hsa; identical to SEQ ID NO: 90921

SEQ ID NO: 262792 - RNA, 64 nt, hsa; identical to SEQ ID NO: 90922

SEQ ID NO: 262793 - RNA, 64 nt, hsa; identical to SEQ ID NO: 90923

SEQ ID NO: 262794 - RNA, 64 nt, hsa; identical to SEQ ID NO: 90924

SEQ ID NO: 262795 - RNA, 64 nt, hsa; identical to SEQ ID NO: 90925

SEQ ID NO: 262796 - RNA, 64 nt, hsa; identical to SEQ ID NO: 90926

SEQ ID NO: 262797 - RNA, 64 nt, hsa; identical to SEQ ID NO: 90927

SEQ ID NO: 262798 - RNA, 64 nt, hsa; identical to SEQ ID NO: 90928

SEQ ID NO: 262799 - RNA, 64 nt, hsa; identical to SEQ ID NO: 90929

SEQ ID NO: 262800 - RNA, 64 nt, hsa; identical to SEQ ID NO: 90811

SEQ ID NO: 262801 - RNA, 64 nt, hsa; identical to SEQ ID NO: 90931

SEQ ID NO: 262802 - RNA, 64 nt, hsa; identical to SEQ ID NO: 90932

SEQ ID NO: 262803 - RNA, 64 nt, hsa; identical to SEQ ID NO: 90933

SEQ ID NO: 262804 - RNA, 64 nt, hsa; identical to SEQ ID NO: 90934

SEQ ID NO: 262805 - RNA, 64 nt, hsa; identical to SEQ ID NO: 90935

SEQ ID NO: 262806 - RNA, 64 nt, hsa; identical to SEQ ID NO: 90936

SEQ ID NO: 262807 - RNA, 64 nt, hsa; identical to SEQ ID NO: 90937

SEQ ID NO: 262808 - RNA, 64 nt, hsa; identical to SEQ ID NO: 90938

SEQ ID NO: 262809 - RNA, 64 nt, hsa; identical to SEQ ID NO: 90939

SEQ ID NO: 262810 - RNA, 64 nt, hsa; identical to SEQ ID NO: 90940

SEQ ID NO: 262811 - RNA, 64 nt, hsa; identical to SEQ ID NO: 90941

SEQ ID NO: 262812 - RNA, 64 nt, hsa; identical to SEQ ID NO: 90942

SEQ ID NO: 262813 - RNA, 64 nt, hsa; identical to SEQ ID NO: 90943

SEQ ID NO: 262814 - RNA, 64 nt, hsa; identical to SEQ ID NO: 90944

SEQ ID NO: 262815 - RNA, 64 nt, hsa; identical to SEQ ID NO: 90945

SEQ ID NO: 262816 - RNA, 64 nt, hsa; identical to SEQ ID NO: 90946

SEQ ID NO: 262817 - RNA, 64 nt, hsa; identical to SEQ ID NO: 90947

SEQ ID NO: 262818 - RNA, 64 nt, hsa; identical to SEQ ID NO: 90948

SEQ ID NO: 262819 - RNA, 64 nt, hsa; identical to SEQ ID NO: 90949

SEQ ID NO: 262820 - RNA, 64 nt, hsa; identical to SEQ ID NO: 90950

SEQ ID NO: 262821 - RNA, 64 nt, hsa; identical to SEQ ID NO: 90951

SEQ ID NO: 262822 - RNA, 64 nt, hsa; identical to SEQ ID NO: 90952

SEQ ID NO: 262823 - RNA, 64 nt, hsa; identical to SEQ ID NO: 90953

SEQ ID NO: 262824 - RNA, 64 nt, hsa; identical to SEQ ID NO: 90954

SEQ ID NO: 262825 - RNA, 64 nt, hsa; identical to SEQ ID NO: 90955

SEQ ID NO: 262826 - RNA, 64 nt, hsa; identical to SEQ ID NO: 90956

SEQ ID NO: 262827 - RNA, 64 nt, hsa; identical to SEQ ID NO: 90957

SEQ ID NO: 262828 - RNA, 64 nt, hsa; identical to SEQ ID NO: 90958

SEQ ID NO: 262829 - RNA, 64 nt, hsa; identical to SEQ ID NO: 90959

SEQ ID NO: 262830 - RNA, 64 nt, hsa; identical to SEQ ID NO: 90960

SEQ ID NO: 262831 - RNA, 64 nt, hsa; identical to SEQ ID NO: 90961

SEQ ID NO: 262832 - RNA, 64 nt, hsa; identical to SEQ ID NO: 90962

SEQ ID NO: 262833 - RNA, 64 nt, hsa; identical to SEQ ID NO: 90963

SEQ ID NO: 262834 - RNA, 64 nt, hsa; identical to SEQ ID NO: 90964

SEQ ID NO: 262835 - RNA, 64 nt, hsa; identical to SEQ ID NO: 90965

SEQ ID NO: 262836 - RNA, 64 nt, hsa; identical to SEQ ID NO: 90966

SEQ ID NO: 262837 - RNA, 64 nt, hsa; identical to SEQ ID NO: 90967

SEQ ID NO: 262838 - RNA, 64 nt, hsa; identical to SEQ ID NO: 90968

SEQ ID NO: 262839 - RNA, 64 nt, hsa; identical to SEQ ID NO: 90969

SEQ ID NO: 262840 - RNA, 64 nt, hsa; identical to SEQ ID NO: 90970

SEQ ID NO: 262841 - RNA, 64 nt, hsa; identical to SEQ ID NO: 90971

SEQ ID NO: 262842 - RNA, 64 nt, hsa; identical to SEQ ID NO: 90972

SEQ ID NO: 262843 - RNA, 64 nt, hsa; identical to SEQ ID NO: 90973

SEQ ID NO: 262844 - RNA, 64 nt, hsa; identical to SEQ ID NO: 90974

SEQ ID NO: 262845 - RNA, 64 nt, hsa; identical to SEQ ID NO: 90975

SEQ ID NO: 262846 - RNA, 64 nt, hsa; identical to SEQ ID NO: 90976

SEQ ID NO: 262847 - RNA, 64 nt, hsa; identical to SEQ ID NO: 90977

SEQ ID NO: 262848 - RNA, 64 nt, hsa; identical to SEQ ID NO: 90978

SEQ ID NO: 262849 - RNA, 64 nt, hsa; identical to SEQ ID NO: 90979

SEQ ID NO: 262850 - RNA, 64 nt, hsa; identical to SEQ ID NO: 90980

SEQ ID NO: 262851 - RNA, 64 nt, hsa; identical to SEQ ID NO: 90981

SEQ ID NO: 262852 - RNA, 64 nt, hsa; identical to SEQ ID NO: 90982

SEQ ID NO: 262853 - RNA, 64 nt, hsa; identical to SEQ ID NO: 90983

SEQ ID NO: 262854 - RNA, 64 nt, hsa; identical to SEQ ID NO: 90984

SEQ ID NO: 262855 - RNA, 64 nt, hsa; identical to SEQ ID NO: 90985

SEQ ID NO: 262856 - RNA, 64 nt, hsa; identical to SEQ ID NO: 90986

SEQ ID NO: 262857 - RNA, 64 nt, hsa; identical to SEQ ID NO: 90987

SEQ ID NO: 262858 - RNA, 64 nt, hsa; identical to SEQ ID NO: 90988

SEQ ID NO: 262859 - RNA, 64 nt, hsa; identical to SEQ ID NO: 90989

SEQ ID NO: 262860 - RNA, 64 nt, hsa; identical to SEQ ID NO: 90990

SEQ ID NO: 262861 - RNA, 64 nt, hsa; identical to SEQ ID NO: 90991

SEQ ID NO: 262862 - RNA, 64 nt, hsa; identical to SEQ ID NO: 90992

SEQ ID NO: 262863 - RNA, 64 nt, hsa; identical to SEQ ID NO: 90993

SEQ ID NO: 262864 - RNA, 64 nt, hsa; identical to SEQ ID NO: 90994

SEQ ID NO: 262865 - RNA, 64 nt, hsa; identical to SEQ ID NO: 90995

SEQ ID NO: 262866 - RNA, 64 nt, hsa; identical to SEQ ID NO: 90996

SEQ ID NO: 262867 - RNA, 64 nt, hsa; identical to SEQ ID NO: 90997

SEQ ID NO: 262868 - RNA, 64 nt, hsa; identical to SEQ ID NO: 90998

SEQ ID NO: 262869 - RNA, 64 nt, hsa; identical to SEQ ID NO: 90999

SEQ ID NO: 262870 - RNA, 64 nt, hsa; identical to SEQ ID NO: 91000

SEQ ID NO: 262871 - RNA, 64 nt, hsa; identical to SEQ ID NO: 91001

SEQ ID NO: 262872 - RNA, 64 nt, hsa; identical to SEQ ID NO: 91002

SEQ ID NO: 262873 - RNA, 64 nt, hsa; identical to SEQ ID NO: 91003

SEQ ID NO: 262874 - RNA, 64 nt, hsa; identical to SEQ ID NO: 91004

SEQ ID NO: 262875 - RNA, 64 nt, hsa; identical to SEQ ID NO: 91005

SEQ ID NO: 262876 - RNA, 64 nt, hsa; identical to SEQ ID NO: 91006

SEQ ID NO: 262877 - RNA, 64 nt, hsa; identical to SEQ ID NO: 91007

SEQ ID NO: 262878 - RNA, 64 nt, hsa; identical to SEQ ID NO: 91008

SEQ ID NO: 262879 - RNA, 64 nt, hsa; identical to SEQ ID NO: 91009

SEQ ID NO: 262880 - RNA, 64 nt, hsa; identical to SEQ ID NO: 91010

SEQ ID NO: 262881 - RNA, 64 nt, hsa; identical to SEQ ID NO: 91011

SEQ ID NO: 262882 - RNA, 64 nt, hsa; identical to SEQ ID NO: 91012

SEQ ID NO: 262883 - RNA, 64 nt, hsa; identical to SEQ ID NO: 91013

SEQ ID NO: 262884 - RNA, 64 nt, hsa; identical to SEQ ID NO: 91014

SEQ ID NO: 262885 - RNA, 64 nt, hsa; identical to SEQ ID NO: 91015

SEQ ID NO: 262886 - RNA, 64 nt, hsa; identical to SEQ ID NO: 91016

SEQ ID NO: 262887 - RNA, 64 nt, hsa; identical to SEQ ID NO: 91017

SEQ ID NO: 262888 - RNA, 64 nt, hsa; identical to SEQ ID NO: 91018

SEQ ID NO: 262889 - RNA, 64 nt, hsa; identical to SEQ ID NO: 91019

SEQ ID NO: 262890 - RNA, 64 nt, hsa; identical to SEQ ID NO: 91020

SEQ ID NO: 262891 - RNA, 64 nt, hsa; identical to SEQ ID NO: 91021

SEQ ID NO: 262892 - RNA, 64 nt, hsa; identical to SEQ ID NO: 91022

SEQ ID NO: 262893 - RNA, 64 nt, hsa; identical to SEQ ID NO: 91023

SEQ ID NO: 262894 - RNA, 64 nt, hsa; identical to SEQ ID NO: 91024

SEQ ID NO: 262895 - RNA, 64 nt, hsa; identical to SEQ ID NO: 91025

SEQ ID NO: 262896 - RNA, 64 nt, hsa; identical to SEQ ID NO: 91026

SEQ ID NO: 262897 - RNA, 64 nt, hsa; identical to SEQ ID NO: 91027

SEQ ID NO: 262898 - RNA, 64 nt, hsa; identical to SEQ ID NO: 91028

SEQ ID NO: 262899 - RNA, 64 nt, hsa; identical to SEQ ID NO: 91029

SEQ ID NO: 262900 - RNA, 64 nt, hsa
cucggaaaugggagcauaguacugggaaaugggagcacaguacugggaaaugggagcauaguac

SEQ ID NO: 262901 - RNA, 64 nt, hsa
gagaaaugggagcacacaguacugggaaaugggagcacaguacugggaaaugggagcccacagu

SEQ ID NO: 262902 - RNA, 64 nt, hsa
cugagaaaugggaguacacuacugagaaaugggagcacaguacugggaaaugggcauacaguac

SEQ ID NO: 262903 - RNA, 64 nt, hsa
cugggaagugggagcacaguacugagaagugggagcacaguacugagaaaugggaguacacuac

SEQ ID NO: 262904 - RNA, 64 nt, hsa
uugggaaaugggagcacaguacugggaagugggagcacaguacugagaagugggagcacaguac

SEQ ID NO: 262905 - RNA, 64 nt, hsa
cugcaaaaugggagcacaguauugggaaaugggagcacaguacugggaagugggagcacaguac

SEQ ID NO: 262906 - RNA, 64 nt, hsa
gggaaaugggggcucacagcacugcaaaaugggagcacaguauugggaaaugggagcacaguac

SEQ ID NO: 262907 - RNA, 64 nt, hsa
cuaggaaaugggagcacaguacugggaaaugggagcacaguacugggaaaugggggcucacagc

SEQ ID NO: 262908 - RNA, 64 nt, hsa
cugggaaaugggagcacaguacuaggaaaugggagcacaguacugggaaaugggagcacaguac

SEQ ID NO: 262909 - RNA, 64 nt, hsa
cucacaccugugagcacaguacugggaaaugggagcacaguacuaggaaaugggagcacaguac

SEQ ID NO: 262910 - RNA, 64 nt, hsa
cugaugggccgggcauguuggcucacaccugugagcacaguacugggaaaugggagcacaguac

SEQ ID NO: 262911 - RNA, 64 nt, hsa
acguacauaugauaaaguucaguuuauaaguuaggcacaguaagagacuaacaacagcucacag

SEQ ID NO: 262912 - RNA, 64 nt, hsa
aagguuuuccuagauacaaaauggaauuucaggagcacaguaaauuucagggucugucuaucuu

SEQ ID NO: 262913 - RNA, 64 nt, hsa
uauggauucacuuuuuacuuauguuaaaauuauaccauuuaacuggcucuuuugucauugugcu

SEQ ID NO: 262914 - RNA, 64 nt, hsa
auuuuuguucugcaggcuugcagaguucuucucaccauuuaaacugaaggacccuauauuauau

SEQ ID NO: 262915 - RNA, 64 nt, hsa
uccauugucuuggugguguuacaagacuuguuauccauuuaaaaaugguaguggaaauucuaug

SEQ ID NO: 262916 - RNA, 64 nt, hsa
aauaugauuuauuagcacaacgugguacuauuugccauuuaaaacuagaacagguauauaagcu

SEQ ID NO: 262917 - RNA, 64 nt, hsa
uguuuccaauggcucaggagacaaugaaaagcccccauuuaaaaaaauaacaaacauuuuuuaa

SEQ ID NO: 262918 - RNA, 64 nt, hsa
aaaucaaaugacugauaagcauuggaucccucugccauuuaauggcaaugguagucuuugguua

SEQ ID NO: 262919 - RNA, 64 nt, hsa
cugucauuuuaucuucaugauuagaacugaucuuccauuuaacuauuacagaaagcaguaacua

SEQ ID NO: 262920 - RNA, 64 nt, hsa
ucucuauuauaaaaguacauccaucaauaccauuccauuuaaaaugggcuauuguaauuuaccc

SEQ ID NO: 262921 - RNA, 64 nt, hsa
aggugauccgaugugcagccaaaucugagaggccccauuuaaaaaagaaagaacauggguggua

SEQ ID NO: 262922 - RNA, 64 nt, hsa
acaccaaaauauuagaggacaaauauuuuuagauccauuuaaggaguuuugaagugccuaagau

SEQ ID NO: 262923 - RNA, 64 nt, hsa
aauuuuaagaccaagguaagauaacuaaucaaggccauuuaauccgucacauucaucucauaau

SEQ ID NO: 262924 - RNA, 64 nt, hsa
uagaaaaaaauaccauuuacaguauuauugugaaccauuuaacccuuuugauccaaggccccgg

SEQ ID NO: 262925 - RNA, 64 nt, hsa
aaccaaagccauuuggcaagcccuguagccugggccauuuaagacaggggcggucucagccaaa

SEQ ID NO: 262926 - RNA, 64 nt, hsa
auuuaagacaggggcggucucagccaaauugcacccauuuaacuaucccaaagagccacagugc

SEQ ID NO: 262927 - RNA, 64 nt, hsa
ugugaaaaacauaagagucuuaaaagaaauuaagccauuuaacauuuuuuaaauagguaagaua

SEQ ID NO: 262928 - RNA, 64 nt, hsa
auggaaagggaugaaaauaaugggaguauaauacccauuuaaugugaaaaacauaagagucuua

SEQ ID NO: 262929 - RNA, 64 nt, hsa
uuuuuuguuuguuuaguuauaacagaguaacauaccauuuaauuacaauuuuuagccagaaaag

SEQ ID NO: 262930 - RNA, 64 nt, hsa
uuuaguauaguuaauauuuucuuagaauuugagcccauuuaaguggauuaauauucuacaugug

SEQ ID NO: 262931 - RNA, 64 nt, hsa
aauucuccagaagauagacuucagacccuuaaugccauuuaaauguaguuuuugugguuuaauc

SEQ ID NO: 262932 - RNA, 64 nt, hsa
gacucauauucagucuuuggaacuaguuuuuuuuccauuuaauuuaaaugacaaaauugcauag

SEQ ID NO: 262933 - RNA, 64 nt, hsa
cagugacaaaggaaaaguggugccguuaugcaauccauuuaacucauaaacauauuacucugag

SEQ ID NO: 262934 - RNA, 64 nt, hsa
augguagaacggagaucuggguuucagagcuuucccauuuaagaaaaauagaucuugagauucu

SEQ ID NO: 262935 - RNA, 64 nt, hsa
uuagcucacacagguguuugcugacauucauuggccauuuaauacaguguugagugguucucug

SEQ ID NO: 262936 - RNA, 64 nt, hsa
aucaaacaaaaaugcccugguggcaaagcuaucaccauuuaaugucuucucucagucuugcacc

SEQ ID NO: 262937 - RNA, 64 nt, hsa
cucaaaaagcccuguuaagccaggacuguuaucuccauuuaacagaugagaaaauggagguuua

SEQ ID NO: 262938 - RNA, 64 nt, hsa
acauuacucauuugauuucccccacccccgccaaccauuuaaaaaaguuugccggcuaggugcg

SEQ ID NO: 262939 - RNA, 64 nt, hsa
auuaagugguucucaucucuaauuaacugugaaaccauuuaauccaaacauguaagcacacacu

SEQ ID NO: 262940 - RNA, 64 nt, hsa
agucuauuggacucaaagguuacauuuuguuuuuccauuuaauuuaauaaucaacaaaacgaca

SEQ ID NO: 262941 - RNA, 64 nt, hsa
auugcaagaaacucuuuuauuaaacuuggaacaaccauuuaaaugaaggauuuugugagauaga

SEQ ID NO: 262942 - RNA, 64 nt, hsa
gauuguuuuuagucuugcuugaggaaugcacacuccauuuaaaaaauugugcgcucuguagauu

SEQ ID NO: 262943 - RNA, 64 nt, hsa
uugaguaauuuuuacauuucuaagacauuaaaucccauuuaaauucugugugaacauuaaagac

SEQ ID NO: 262944 - RNA, 64 nt, hsa
aaaacuguacaaagaagacgacuguuuuccauuuccauuuaaacauuuuuagccacuucauuuc

SEQ ID NO: 262945 - RNA, 64 nt, hsa; identical to SEQ ID NO: 210966

SEQ ID NO: 262946 - RNA, 64 nt, hsa; identical to SEQ ID NO: 210967

SEQ ID NO: 262947 - RNA, 64 nt, hsa; identical to SEQ ID NO: 210968

SEQ ID NO: 262948 - RNA, 64 nt, hsa; identical to SEQ ID NO: 210969

SEQ ID NO: 262949 - RNA, 64 nt, hsa; identical to SEQ ID NO: 210970

SEQ ID NO: 262950 - RNA, 64 nt, hsa; identical to SEQ ID NO: 210971

SEQ ID NO: 262951 - RNA, 64 nt, hsa; identical to SEQ ID NO: 210972

SEQ ID NO: 262952 - RNA, 64 nt, hsa; identical to SEQ ID NO: 210973

SEQ ID NO: 262953 - RNA, 64 nt, hsa
cccucagacuuuaagacaagaagccaccaucaaaacaaaggaugggauacguauagaauggacu

SEQ ID NO: 262954 - RNA, 64 nt, hsa
uuucuccagaagcugcagcaagagguacagcucaacaaaggaaaaccacaggacuggauaugca

SEQ ID NO: 262955 - RNA, 64 nt, hsa
aguaggauuuuuguuuuguuuugcauuuugcaguacaaaggagaaaugauuagaacuuaggaag

SEQ ID NO: 262956 - RNA, 64 nt, hsa
aaacaaauucauacaucuauggugaccacuuuugacaaaggaaugaagaacauacacuggggaa

SEQ ID NO: 262957 - RNA, 64 nt, hsa
uugaacuuguaccuuuuuuuauacuagcaacacuacaaaggagaaguuacucauuucaaaaugg

SEQ ID NO: 262958 - RNA, 64 nt, hsa
acuugaagauucuaggcacauuaugaggagggaaacaaaggaggcuucugcaggacugcaucuc

SEQ ID NO: 262959 - RNA, 64 nt, hsa
ucuguggacaccucaugcucuguucaaggccaucacaaaggaaccgccagggagaagcagccgg

SEQ ID NO: 262960 - RNA, 64 nt, hsa
gcuggcgacccgauggaagguuuucaggcuccucacaaaggagagagggaagaaaagaucuuuu

SEQ ID NO: 262961 - RNA, 64 nt, hsa
cugaguuuucucuacuucaggguuucuagcuuugacaaaggaccaggcuugccuuuucuguggc

SEQ ID NO: 262962 - RNA, 64 nt, hsa
caccaacuuuaacuugaaauuuuuauaguuuaugacaaaggaagugaagaacagacuucacugu

SEQ ID NO: 262963 - RNA, 64 nt, hsa
uauuauaaaagcaagguuuauuauaaaagauacuacaaaggauacagaugaagaggcacauagg

SEQ ID NO: 262964 - RNA, 64 nt, hsa
cuguuuccugaggcuuaauacacccaacauuauaacaaaggacuguagcaagggcuaugggagu

SEQ ID NO: 262965 - RNA, 64 nt, hsa
ucuccaaaaaaaaaaaaaaaaaaaaaguaaccuuacaaaggagugcggccaguuuuucagccac

SEQ ID NO: 262966 - RNA, 57 nt, hsa
gaagaauucauaguggauagaaaccuuacaaaggacgccgggcgugguggcucacgc

SEQ ID NO: 262967 - RNA, 64 nt, hsa
guguacugaaccacuagccuaauagaccagcacggucaacuagaaugacaaacauuagcuacug

SEQ ID NO: 262968 - RNA, 64 nt, hsa
ugcuguggcugcacuggccccaguccauagaggggucaacuaugcuggcuggacuggcugccuu

SEQ ID NO: 262969 - RNA, 64 nt, hsa
gcauuauguggacgccucauguauuuuuuauagagucaacuauuuccucuuuauuuucccucau

SEQ ID NO: 262970 - RNA, 64 nt, hsa
cucuaauaaaguucccauccuuaaugacucacuugucaacuaguggacuaauuaacccuccacc

SEQ ID NO: 262971 - RNA, 64 nt, hsa
uacaacuguccuuagacugaugagcaaaggaggagucaacuaaugaagaaaugaauaauaaauu

SEQ ID NO: 262972 - RNA, 64 nt, hsa
cuugagaguucaaagaaaaucaaccucugugguggucaacuaaagguauuaggaaacuaagucu

SEQ ID NO: 262973 - RNA, 64 nt, hsa
agcauuuuuuuauuuuacuaaagccauuuuuauagucaacuaucuuuucuuauuugugugauua

SEQ ID NO: 262974 - RNA, 64 nt, hsa
uaucccuccuuuccccacagcagcuuucuuuccugucaacuagaaaggagcaggauguaauaaa

SEQ ID NO: 262975 - RNA, 64 nt, hsa
agugugguagggacuuaaaaaacuuguaaaugcugucaacuaugauaugguaaaaguuacuuau

SEQ ID NO: 262976 - RNA, 64 nt, hsa
gccccaaguuccagagucaaaucccaguuuugcagucaacuauuaaccuggggcccuggcagau

SEQ ID NO: 262977 - RNA, 64 nt, hsa
uaauuagacauauuuuaaaguauuuauuauaguugucaacuaguaacucaaugaaaaaguugau

SEQ ID NO: 262978 - RNA, 64 nt, hsa
guauuuaaaugaaugcuggucagugggacauuuugucaacuauggguauugggugcuuaacugu

SEQ ID NO: 262979 - RNA, 64 nt, hsa
ucacuguguccuuuucugaaucccauuguagccugucaacuaaauuugaguguuaacggucuuu

SEQ ID NO: 262980 - RNA, 64 nt, hsa
aaugaccauggauauuuuucuaccuacaguuugagucaacuagaauaugccuggggaccuugaa

SEQ ID NO: 262981 - RNA, 64 nt, hsa
uuaauuuguaauuucauuuauuuguauuuauguugucaacuagccccuaauuagugauggccac

SEQ ID NO: 262982 - RNA, 64 nt, hsa
aaaaaaucaugccaguauuuuuaaaggcauuagagucaacuacacaaagcaggcuugcccagua

SEQ ID NO: 262983 - RNA, 64 nt, hsa
caugacuuuuacuaacucacuucggucucugucugucaacuaaacuuuucuaaagguuaccagu

SEQ ID NO: 262984 - RNA, 64 nt, hsa
auuaguguuauauaccauauagaacuuacugucagucaacuauaaacaggcccaauuaaaaacu

SEQ ID NO: 262985 - RNA, 64 nt, hsa
uauuuuguuaaugaaauaaaaacauggacugagugucaacuacaugagcuuuggcauggggaua

SEQ ID NO: 262986 - RNA, 64 nt, hsa
acugccucaguuuggguaaaggaugagcagacaagucaacuaaagaaaaaagaaaagcaaggag

SEQ ID NO: 262987 - RNA, 64 nt, hsa
aaagaauaaaacaggaccauauuuauuuacuucugucaacuauagaaagaaagaccuucagcug

SEQ ID NO: 262988 - RNA, 64 nt, hsa
uuagucuguuaguuaaacccauuaggaauuuucugucaacuaccaugcccaugagauguuuauc

SEQ ID NO: 262989 - RNA, 64 nt, hsa
aaacauguauaaaauaguuuuaguaguccaaaaugucaacuaucuguagcugcuuuugugugug

SEQ ID NO: 262990 - RNA, 64 nt, hsa
aucagaaauaacuuuuuaucuugcucaaguucuggucaacuaguagccugacggcuuagaacuu

SEQ ID NO: 262991 - RNA, 64 nt, hsa
caagguagguuggcucuuaggugaauuuagccaugucaacuaauagcuuuuauaugguauguaa

SEQ ID NO: 262992 - RNA, 64 nt, hsa
ccucagcugugggggggaagcgcgugugcaucgugucaacuacuguacauguuggucaugugaa

SEQ ID NO: 262993 - RNA, 64 nt, hsa
ucagcaaaagcuaauuaaauuguaauguuucuaugucaacuacugggaaguauguuacagucuu

SEQ ID NO: 262994 - RNA, 64 nt, hsa
uuuuuugucacacuacuuuauauaacaauacuaagucaacuaagcuacuuuuagauuuggaaau

SEQ ID NO: 262995 - RNA, 64 nt, hsa
uacugaaggaacaauaaugaugagauuuguaacugucaacuauuaaauacauugauuuuugaga

SEQ ID NO: 262996 - RNA, 64 nt, hsa
uuaaaacuguuuaaaauguagcuguuaugacuuggucaacuauggaagugaagaagguucagaa

SEQ ID NO: 262997 - RNA, 64 nt, hsa
cuuuccuuuaaaaacaguguuugaaaugaagacugucaacuaucccauaauuuauuuauucuuc

SEQ ID NO: 262998 - RNA, 64 nt, hsa
acuucucuagaagagauuacuuaagacugugucagucaacuaaacauucuaauauuuuuguaaa

SEQ ID NO: 262999 - RNA, 64 nt, hsa
gcaaggagagaaaugcaaccauacaugggcuccagucaacuaugggacugaagguccuaauugc

SEQ ID NO: 263000 - RNA, 64 nt, hsa
aguuuugcaacugcauaauagcuaugcccaaggagucaacuauuguauauauugcagauuugcc

SEQ ID NO: 263001 - RNA, 64 nt, hsa
cauacagcaaguauggaaaaaagaugaucuagaagucaacuaucucaaccuccauuguuaccca

SEQ ID NO: 263002 - RNA, 64 nt, hsa
caacagucacaacagguuuccucaagccccauuugucaacuaaaagagacggaucugcaccucc

SEQ ID NO: 263003 - RNA, 64 nt, hsa
ugaugcugugcaguuuguuuuuauauggaaagaugucaacuauagccauaaccaauaaaauaaa

SEQ ID NO: 263004 - RNA, 64 nt, hsa
cagugucccagucaaauuccuauucuaacaugcugucaacuaugugauucuuuccaagccaaua

SEQ ID NO: 263005 - RNA, 64 nt, hsa
ucccgccacaaaguuguaggaaaugggaagaggagucaacuagaggcaagggaguugagagagc

SEQ ID NO: 263006 - RNA, 64 nt, hsa
gugugaaacuuaccauucaacugaacaacuaguugucaacuaaugaaaauaaaacauuuucucu

SEQ ID NO: 263007 - RNA, 64 nt, hsa
agggaagacuguaacacagcugaacuauuucagugucaacuauucagaauugaaaauguaaauu

SEQ ID NO: 263008 - RNA, 64 nt, hsa
uaaggagcccccugccauagcaaaggcagugagugucaacuaucugcaucuggcugagagagac

SEQ ID NO: 263009 - RNA, 64 nt, hsa
ucuuuucuccagggguguggggaaaauggcaaaggucaacuagcugcuuccccagggaauaggg

SEQ ID NO: 263010 - RNA, 50 nt, hsa
ucaccauugcagaugcuuaagucaacuauuuuaauaaauugaugaccagu

SEQ ID NO: 263011 - RNA, 64 nt, hsa
uuuuuuucccuagaaaaagauuguuuguuucuaugucaacuagauaugauuaaaaauaaguauu

SEQ ID NO: 263012 - RNA, 64 nt, hsa
uuuugaaauguuagacuuggaaggggccuggucugucaacuaguccaaccccuuaaaauucaua

SEQ ID NO: 263013 - RNA, 64 nt, hsa
ucuccuugacugucaccuguaggacaguuuaucagucaacuaccuuuccuccagacuuuacuuc

SEQ ID NO: 263014 - RNA, 64 nt, hsa
cuagccuggggaguuugauaaacugagugauugggucaacuaucacuguacuuccauaaugaau

SEQ ID NO: 263015 - RNA, 64 nt, hsa
ccucuacuuaaauccguccuguuuagcgacuucagucaacuacagcugaguccauaggccagaa

SEQ ID NO: 263016 - RNA, 64 nt, hsa
gacuccaggggagaugaccugggggaggaagugugucaacuauuucuuuaggccuguuuggcuc

SEQ ID NO: 263017 - RNA, 64 nt, hsa
uguguaagggagguccauagaauuuagguggucugucaacuauucuacuuaugagagaauuggu

SEQ ID NO: 263018 - RNA, 64 nt, hsa
uacaaacuaacagucaccagcaccaaagaauuaagucaacuaaccugccuugaauuuuagacca

SEQ ID NO: 263019 - RNA, 64 nt, hsa
uuccuuagaguauuaucacugcuggaggaauuuugucaacuacccaccuggggaugaagcucac

SEQ ID NO: 263020 - RNA, 64 nt, hsa
gaaauauaauuguaccaaccucauagaguuuggugucaacuaaaugagauuauauguggacuaa

SEQ ID NO: 263021 - RNA, 64 nt, hsa
auauuucuagauacaacauaaaccuugguuauaugucaacuauucugcauuuuacucugugaau

SEQ ID NO: 263022 - RNA, 64 nt, hsa
agacucaaauaugacugugcucugaaaugcuaaugucaacuacaaaucaaaagugcugaguuaa

SEQ ID NO: 263023 - RNA, 64 nt, hsa
auaugcuggaauuggauauuuaauuuauguuugugucaacuauaauccuuuccccaccccuuuc

SEQ ID NO: 263024 - RNA, 64 nt, hsa
cuacacuuaaugcuauuaaguugaacuuuugaaugucaacuaauuugcaaucaauuaaagauac

SEQ ID NO: 263025 - RNA, 64 nt, hsa
ucgcaaguccagaaauugaggacucuggauuuuugucaacuaacucugugaacauagccaucag

SEQ ID NO: 263026 - RNA, 64 nt, hsa
gauccaaggagaauuguauagcaagaaaaaaacagucaacuacagaaacucuuaaaaggaauaa

SEQ ID NO: 263027 - RNA, 64 nt, hsa
ccccaagcugcuuauguggcccaaccccacugcugucaacuaggcuugaaccccacagcggcug

SEQ ID NO: 263028 - RNA, 64 nt, hsa
cagcaucacucaaguuugaaguuucgccgcuuuugucaacuauccucugggcaaagguauucag

SEQ ID NO: 263029 - RNA, 64 nt, hsa
auuuucuguagcugaaaauguuugugaaguggcugucaacuacacaucgcaugaguagaggggc

SEQ ID NO: 263030 - RNA, 64 nt, hsa
uucccuuuuuuagaaauugaaguggucuucauaugucaacuacagaaaaggaaaaaaauagaaa

SEQ ID NO: 263031 - RNA, 64 nt, hsa
cucaguggaacucucuagccuccugguucggaaugucaacuaugagauccccucacugaagaag

SEQ ID NO: 263032 - RNA, 64 nt, hsa
auuucugcaguuucaaguuaguuagaagcauguugucaacuaaagacaacaaacuaucagauuc

SEQ ID NO: 263033 - RNA, 64 nt, hsa
caagaccagccuggccaaccuggugaaaugcagugucaacuaaaaauaggaaaaucagccaggc

SEQ ID NO: 263034 - RNA, 64 nt, hsa
ucucucuuuuauuugaaaggauuucagaaagcaggucaacuaugagguggaucggagauuucau

SEQ ID NO: 263035 - RNA, 64 nt, hsa
aaaugaacauaaguuguaauuugcucugaaaucugucaacuaucuuaauugaaauauuugcucu

SEQ ID NO: 263036 - RNA, 64 nt, hsa
cucuaaaugaagucuuuaugaaacuggaaggacagucaacuaucgaacaagguaaagccauuug

SEQ ID NO: 263037 - RNA, 64 nt, hsa
gcaccucuuccucacugcacggaaccugacaguggucaacuacucaagcaucaauagacucaug

SEQ ID NO: 263038 - RNA, 64 nt, hsa
uuuaacaaaaguaugauugacagaaaaaauggaugucaacuaaaauguaaccucuauguaagga

SEQ ID NO: 263039 - RNA, 64 nt, hsa
ccagaggacauuuuuuuuagcaauaaaauugagugucaacuauuuaaucagguguucuugagaa

SEQ ID NO: 263040 - RNA, 64 nt, hsa
cugaaguuccugcaucagggucuacauugccacagucaacuauuuguacuucuagaauuccacu

SEQ ID NO: 263041 - RNA, 64 nt, hsa
cucauucuccgaacuuacuccuuuuuauggguaagucaacuagguuuacagucccuuauuuuua

SEQ ID NO: 263042 - RNA, 64 nt, hsa
uuuauuaagacguccacuagaaauagcuuguccugucaacuaugaaauauggugacuagauuuu

SEQ ID NO: 263043 - RNA, 64 nt, hsa
cuaauaaaaugcccaaugaaagaagaguuccauggucaacuaaguucagggaacccuguuacac

SEQ ID NO: 263044 - RNA, 64 nt, hsa
aaaugcuaacuuaacagcacuggcuuucuggcuggucaacuauaugaaaccuuguucauuccuc

SEQ ID NO: 263045 - RNA, 64 nt, hsa
aagacuuuucacuagggaaacugauaaagcuugagucaacuaaaucugccuucauacuuuauca

SEQ ID NO: 263046 - RNA, 64 nt, hsa
uuccuuuccucuggguuuaagugauuuuauuuaagucaacuaaggggauuuaacaguggacuag

SEQ ID NO: 263047 - RNA, 64 nt, hsa
cgugccuuaaaaaggaaaacuaguguugcuauugugcauuuacuagaaaaaaggaauugguugu

SEQ ID NO: 263048 - RNA, 64 nt, hsa
uucguagauguuuuugaaguugacaugacuuacgugcauuuaaauauauauugccauccuuagu

SEQ ID NO: 263049 - RNA, 64 nt, hsa
gaugaaaucugggcagagacuuauuaauuaauuuugcauuuacuaccucagagcucagaagaaa

SEQ ID NO: 263050 - RNA, 64 nt, hsa
cccuauugcccagggaugucauuguaaauauaugugcauuuauaaauaauuuuuguauucauug

SEQ ID NO: 263051 - RNA, 64 nt, hsa
ucucuuauuucuuacuuuaauguacuucuaucacugcauuuauuuugccugugcauaggagcaa

SEQ ID NO: 263052 - RNA, 64 nt, hsa
uggaaaauuaguuggcuggacauugauaaaauaaugcauuuauaacaauuacauguguuucugg

SEQ ID NO: 263053 - RNA, 64 nt, hsa
cuuuuauuuuauaauuugauaaugaauauauuucugcauuuauuuacuucuguuuuguaaauug

SEQ ID NO: 263054 - RNA, 64 nt, hsa
acucuaucaauauuguauaaaaagacugaaacaaugcauuuauauaauauguauacaauauugu

SEQ ID NO: 263055 - RNA, 64 nt, hsa
aacccgcgcuuuuauuaugggaagcuucuugaacugcauuuacuauugugaaguuucaaguccc

SEQ ID NO: 263056 - RNA, 64 nt, hsa
ucuaauaucaagauuaacaaauauaaauuuauggugcauuuagauugcguuguauuaauuuaua

SEQ ID NO: 263057 - RNA, 64 nt, hsa
uauuuuuuauuuuaguccuauuuguauuauuuuaugcauuuaaaaacacaguccugagagggau

SEQ ID NO: 263058 - RNA, 64 nt, hsa
auguuuuuauuucagcccuauuuguauuauuuugugcauuuaaaaaacacaaucuuaaggggau

SEQ ID NO: 263059 - RNA, 64 nt, hsa
acucagucuauggguuggggcucagauaacucugugcauuuaagcuacuuguagagacccaggc

SEQ ID NO: 263060 - RNA, 64 nt, hsa
aaaugguaguugaaaggagcaggggcccugguguugcauuuagcccuggggcauggagcugaac

SEQ ID NO: 263061 - RNA, 64 nt, hsa
acauuaugaugcguuucuuuuucuccuuuggccuugcauuuauccgagguugguuucuuauguu

SEQ ID NO: 263062 - RNA, 64 nt, hsa
cuuaagauugauuggagauuuuaaaacuggaggaugcauuuagagggagaaagcuacuuccagc

SEQ ID NO: 263063 - RNA, 64 nt, hsa
cgccccauggaauauuuaaucuauuuaaucuucuugcauuuauuucucaagaauuacuggcuuu

SEQ ID NO: 263064 - RNA, 64 nt, hsa
aaaauauuaauauguuugucagaaggaaaaauaaugcauuuaucuucccccccaccccccgccc

SEQ ID NO: 263065 - RNA, 64 nt, hsa
uuuuacacuuuaugguaaguagcagggggggaaaugcauuuauagaucauuucuaggcaaaauu

SEQ ID NO: 263066 - RNA, 64 nt, hsa
ucauggccucuugaagagaaaaaagucaccauucugcauuuagcuguauucauauauugcauuu

SEQ ID NO: 263067 - RNA, 64 nt, hsa
ucacauuuaguaaaugcugaaauaaaaugauuaaugcauuuaucaauaaaagccuuugaaaaua

SEQ ID NO: 263068 - RNA, 64 nt, hsa
cuugguauacuccagggauugguuucaggaccccugcauuuaccaaaauuugugcacacucaag

SEQ ID NO: 263069 - RNA, 64 nt, hsa
cccuucuggggcacggucuuuggggagaggggagugcauuuagacuuauguggaacuguacaaa

SEQ ID NO: 263070 - RNA, 64 nt, hsa
ugaugguaggugugacauguuaguuuuucuuacuugcauuuauuuaagacacuguuacagagau

SEQ ID NO: 263071 - RNA, 64 nt, hsa
caguguuaagcuauagccauguuaaaagucacugugcauuuauucucagcaucaaauaccuugu

SEQ ID NO: 263072 - RNA, 64 nt, hsa
uucaggccugaagcugcacgaccugaaguucgccugcauuuaucagcccucuuugugcugcucc

SEQ ID NO: 263073 - RNA, 64 nt, hsa
acuugcauaugucaucccauauaacuaagacauaugcauuuaugggaagacaaaacaagaauga

SEQ ID NO: 263074 - RNA, 64 nt, hsa
aauauuuucuaagagaaugaauuaucccccaaaaugcauuuagaaaacagucuuuggugauauu

SEQ ID NO: 263075 - RNA, 64 nt, hsa
ugaaaagcaacucaaaacaacuucaacguggaggugcauuuauaauucagucugcauuuauucu

SEQ ID NO: 263076 - RNA, 64 nt, hsa
aacuucaacguggaggugcauuuauaauucagucugcauuuauucuguaaaaagguggcuguuu

SEQ ID NO: 263077 - RNA, 64 nt, hsa
uaggaauauaaaaacuugcaguucuaugauagauugcauuuauuaaaaauguuucauuguauca

SEQ ID NO: 263078 - RNA, 64 nt, hsa
ucaaaaggaaauccaaaaccuauucuaaacaauuugcauuuauauaauuuuccuguuuaacaac

SEQ ID NO: 263079 - RNA, 64 nt, hsa
uacacaauaauuuaaagagaauguauuucuuuuuugcauuuaauggccucagacauuucuuuca

SEQ ID NO: 263080 - RNA, 64 nt, hsa
guacuuggggugugugugugugugugugugugugugcauuuauguaugcucuguggcuacauau

SEQ ID NO: 263081 - RNA, 64 nt, hsa
gaucuaucuguauuggaaauauguuccuggaaaaugcauuuaaauaauaguaaauucucuugca

SEQ ID NO: 263082 - RNA, 64 nt, hsa
aggguagcauguauaaugcccacguguuaaacauugcauuuaaucgagaugcguccuauugucc

SEQ ID NO: 263083 - RNA, 64 nt, hsa
ccacauucugugguuucucauuauacuuacuuccugcauuuagagggaguuuauuuaaaagaaa

SEQ ID NO: 263084 - RNA, 64 nt, hsa
ugcacgaacuuagauaaugaggugcaggguuauuugcauuuaaauugcaauccagcacacgugu

SEQ ID NO: 263085 - RNA, 64 nt, hsa
uaagaacuuccacaaaauauuucauggagaggucugcauuuagacggaaacagaaauugcuuuu

SEQ ID NO: 263086 - RNA, 64 nt, hsa
aucaaucaucugauuuccugaaaguaauuaauugugcauuuaauaccaguuagaguuccgacuc

SEQ ID NO: 263087 - RNA, 64 nt, hsa
guugaaauuuuaaaaauuaauguuaauauggaaaugcauuuagagaagcccaguaguuuuuauu

SEQ ID NO: 263088 - RNA, 64 nt, hsa
augcauccauacucaggguguagggagaauacuuugcauuuaaaaacccuguccaccugucacc

SEQ ID NO: 263089 - RNA, 64 nt, hsa
gaacagcgaaagcagagcauguuauuuauauaacugcauuuaagcaguaccaagacugaaaaaa

SEQ ID NO: 263090 - RNA, 64 nt, hsa
ugcaauuaacauauaugaaauuuauuacucugcuugcauuuaugaaacuaaccaguuuuuuaaa

SEQ ID NO: 263091 - RNA, 64 nt, hsa
auucucugacuugguaacuauguucugaaaacacugcauuuaagaauuuuuaaaaauugguuuu

SEQ ID NO: 263092 - RNA, 64 nt, hsa
aguacacguuucuguauuuuaaaaaauacuuugaugcauuuauuuuuagguguuuuuuuuuucc

SEQ ID NO: 263093 - RNA, 64 nt, hsa
uuguuaucuugccaauggaaauaaaguaugauauugcauuuaaauauuauauuuauaccucaug

SEQ ID NO: 263094 - RNA, 64 nt, hsa
gcaaaugaguguuuucagguuuuuuugcauuauaugcauuuauguaauguuucuguuaucagca

SEQ ID NO: 263095 - RNA, 64 nt, hsa
caccugaccccaguuuuaagugguacgaauguugugcauuuaauguuaaaggacagucugcaau

SEQ ID NO: 263096 - RNA, 64 nt, hsa
agguuagaacauugcuuaauccuuuuaaaaaaaaugcauuuacguaaacacgaauacugaaauu

SEQ ID NO: 263097 - RNA, 64 nt, hsa
aaggcugauacuugagcugugugcccagagaucaugcauuuagauuuauauuuuugccagaaaa

SEQ ID NO: 263098 - RNA, 64 nt, hsa
auauuuuucuaauaaaugcggcugcaaccuccugugcauuuaauuaaauaggccaaauuuuugc

SEQ ID NO: 263099 - RNA, 64 nt, hsa
uuccaauggggaggaggaaagaugcaauaugucucuuacacauuucuucaagcugaaaagugcu

SEQ ID NO: 263100 - RNA, 64 nt, hsa
uucuucaagcugaaaagugcuuguggugaaccugcuuacacaaauuauguugguggcuuucaug

SEQ ID NO: 263101 - RNA, 64 nt, hsa
cuccuggcugggccauccuuccgccaaucuggcccuuacacacucaggccugugcccacucccu

SEQ ID NO: 263102 - RNA, 64 nt, hsa
uauggggugggguggguguaggggcuuacaaagccuuacacagggcgagggguuggugggaggg

SEQ ID NO: 263103 - RNA, 64 nt, hsa
uuaucuguuuugaccaaaauauguagcuauuucccuuacacagauuggaccgcacuuaucuccc

SEQ ID NO: 263104 - RNA, 64 nt, hsa
cccuuucuggcugaaaacuugccuuauuugguaucuuacacauuaauguuacuagcaucaggag

SEQ ID NO: 263105 - RNA, 64 nt, hsa
ugguacauguacuggaaguggauaaccaguaucacuuacacaaacaaaaauaacuuugucaaau

SEQ ID NO: 263106 - RNA, 64 nt, hsa
guguaugccgaauaccuuaaaguaacuaauuauccuuacacacaaaaggcucagugcauuaaau

SEQ ID NO: 263107 - RNA, 64 nt, hsa
ggauuuagcugugucauuuuuaugaugucuguaacaacccaacaagguaacugaagcuccagag

SEQ ID NO: 263108 - RNA, 64 nt, hsa
uacccuuauaagaguaaagaauuaagaugauagucaacccaauauuucuacuacauucuuuaaa

SEQ ID NO: 263109 - RNA, 64 nt, hsa
cgcucacacaaccagaaggagcugaguuuggcaacaacccaagugagccugaagcagauucgcc

SEQ ID NO: 263110 - RNA, 64 nt, hsa
uguauccugcaggaggacgccccuacagacccagcaacccaaguugccagcccguguuucucag

SEQ ID NO: 263111 - RNA, 64 nt, hsa
ucaucugucugggguaaagacaacaaaguaaauacaacccaaggcaacugggguacucacuggg

SEQ ID NO: 263112 - RNA, 64 nt, hsa
ccaugcuccuuuggccaagaucaucagaaccucucaacccaacaaggcuggcuucagggccacu

SEQ ID NO: 263113 - RNA, 64 nt, hsa
gcugggucccagccugguuugcaaagaccaccuccaacccaacccaaucccucuccacucuucu

SEQ ID NO: 263114 - RNA, 64 nt, hsa
gucccagccugguuugcaaagaccaccuccaacccaacccaaucccucuccacucuucucuccu

SEQ ID NO: 263115 - RNA, 64 nt, hsa
acuacagcuucagugauugggggaggaaaagucccaacccaaugggcucaaacuucuaaggggu

SEQ ID NO: 263116 - RNA, 64 nt, hsa
guaugucugguuccccaguagagcucuacugccucaacccaaggggauuuuuaugucuggggca

SEQ ID NO: 263117 - RNA, 64 nt, hsa
cagaagaauggagaugggaaaauccaccaaauuccaacccaaacccaacuuucuuucucccuau

SEQ ID NO: 263118 - RNA, 64 nt, hsa
ugccgccgcggguccaccgaggacgccaaucaaucaacccaacaccacaagcuugguugggugc

SEQ ID NO: 263119 - RNA, 64 nt, hsa
ggauaggacagagggauuuuguucaaguuugcugcaacccaaguggacguuaggccaggccuua

SEQ ID NO: 263120 - RNA, 64 nt, hsa
ggccuccguugucugguugcuaaugacagccuugcaacccaaggugaggugaacuccaggcaug

SEQ ID NO: 263121 - RNA, 64 nt, hsa; identical to SEQ ID NO: 71859

SEQ ID NO: 263122 - RNA, 64 nt, hsa; identical to SEQ ID NO: 71860

SEQ ID NO: 263123 - RNA, 64 nt, hsa; identical to SEQ ID NO: 71861

SEQ ID NO: 263124 - RNA, 64 nt, hsa; identical to SEQ ID NO: 71862

SEQ ID NO: 263125 - RNA, 64 nt, hsa; identical to SEQ ID NO: 71863

SEQ ID NO: 263126 - RNA, 64 nt, hsa; identical to SEQ ID NO: 71864

SEQ ID NO: 263127 - RNA, 64 nt, hsa; identical to SEQ ID NO: 71865

SEQ ID NO: 263128 - RNA, 64 nt, hsa; identical to SEQ ID NO: 71866

SEQ ID NO: 263129 - RNA, 64 nt, hsa; identical to SEQ ID NO: 71867

SEQ ID NO: 263130 - RNA, 64 nt, hsa; identical to SEQ ID NO: 71868

SEQ ID NO: 263131 - RNA, 64 nt, hsa; identical to SEQ ID NO: 71869

SEQ ID NO: 263132 - RNA, 64 nt, hsa; identical to SEQ ID NO: 71870

SEQ ID NO: 263133 - RNA, 64 nt, hsa; identical to SEQ ID NO: 71871

SEQ ID NO: 263134 - RNA, 64 nt, hsa; identical to SEQ ID NO: 71872

SEQ ID NO: 263135 - RNA, 64 nt, hsa; identical to SEQ ID NO: 71873

SEQ ID NO: 263136 - RNA, 64 nt, hsa; identical to SEQ ID NO: 71874

SEQ ID NO: 263137 - RNA, 64 nt, hsa; identical to SEQ ID NO: 71875

SEQ ID NO: 263138 - RNA, 64 nt, hsa; identical to SEQ ID NO: 71876

SEQ ID NO: 263139 - RNA, 64 nt, hsa; identical to SEQ ID NO: 71877

SEQ ID NO: 263140 - RNA, 64 nt, hsa; identical to SEQ ID NO: 71878

SEQ ID NO: 263141 - RNA, 64 nt, hsa; identical to SEQ ID NO: 71879

SEQ ID NO: 263142 - RNA, 64 nt, hsa
augguuucuucauguuuucccaacucuuucauccaguguccaaaauauauaaguaaauagcugu

SEQ ID NO: 263143 - RNA, 64 nt, hsa
cuccccuccugcugcuguagaguuuucccaaagcaguguccaggagagaauuugagagagugaa

SEQ ID NO: 263144 - RNA, 64 nt, hsa
gcugaggccugagcgaguguccagccaagggcugaguguccagcacaccugccgucuucacuuc

SEQ ID NO: 263145 - RNA, 64 nt, hsa
gcugaaggcugaguguccggcugaggccugagcgaguguccagccaagggcugaguguccagca

SEQ ID NO: 263146 - RNA, 64 nt, hsa
agggcucagagcugaccaugcaugaauguauggcaguguccacuuuucuguauaaaauguauaa

SEQ ID NO: 263147 - RNA, 64 nt, hsa
ucugcagggggaggccugagcauuucccagccccaguguccacaccucucagaaaagagaaaaa

SEQ ID NO: 263148 - RNA, 64 nt, hsa
aggugacacgugucugacagagacgggagcucugaguguccacgggugaagaagugagugucca

SEQ ID NO: 263149 - RNA, 64 nt, hsa
acgggagcucugaguguccacgggugaagaagugaguguccacgggugaagaagugaguauguu

SEQ ID NO: 263150 - RNA, 64 nt, hsa
ggggaaauuucuaaaccuagugcacuguuuggccaguguccacagccucuuuucuggcuguguu

SEQ ID NO: 263151 - RNA, 64 nt, hsa
ccaaaggaaaaagcccugcugcauuuaaaaacaaaguguccaagcugucagugguguguuuaca

SEQ ID NO: 263152 - RNA, 64 nt, hsa
ccguggucugccuccuaguugaaucucagcccugaguguccagaucuggccaaggugucuaggg

SEQ ID NO: 263153 - RNA, 64 nt, hsa
ggcugcugcuaacauuaaugagaagguggccuucaguguccaccuguggaacccaggacacagc

SEQ ID NO: 263154 - RNA, 64 nt, hsa; identical to SEQ ID NO: 238026

SEQ ID NO: 263155 - RNA, 64 nt, hsa; identical to SEQ ID NO: 238027

SEQ ID NO: 263156 - RNA, 64 nt, hsa; identical to SEQ ID NO: 238028

SEQ ID NO: 263157 - RNA, 64 nt, hsa; identical to SEQ ID NO: 238029

SEQ ID NO: 263158 - RNA, 64 nt, hsa; identical to SEQ ID NO: 238030

SEQ ID NO: 263159 - RNA, 64 nt, hsa; identical to SEQ ID NO: 238031

SEQ ID NO: 263160 - RNA, 64 nt, hsa; identical to SEQ ID NO: 238032

SEQ ID NO: 263161 - RNA, 64 nt, hsa; identical to SEQ ID NO: 238033

SEQ ID NO: 263162 - RNA, 64 nt, hsa; identical to SEQ ID NO: 238034

SEQ ID NO: 263163 - RNA, 64 nt, hsa; identical to SEQ ID NO: 238035

SEQ ID NO: 263164 - RNA, 64 nt, hsa; identical to SEQ ID NO: 238036

SEQ ID NO: 263165 - RNA, 64 nt, hsa; identical to SEQ ID NO: 238037

SEQ ID NO: 263166 - RNA, 64 nt, hsa; identical to SEQ ID NO: 238038

SEQ ID NO: 263167 - RNA, 64 nt, hsa; identical to SEQ ID NO: 238039

SEQ ID NO: 263168 - RNA, 64 nt, hsa; identical to SEQ ID NO: 238040

SEQ ID NO: 263169 - RNA, 64 nt, hsa; identical to SEQ ID NO: 238041

SEQ ID NO: 263170 - RNA, 64 nt, hsa; identical to SEQ ID NO: 238042

SEQ ID NO: 263171 - RNA, 64 nt, hsa; identical to SEQ ID NO: 238043

SEQ ID NO: 263172 - RNA, 64 nt, hsa; identical to SEQ ID NO: 238044

SEQ ID NO: 263173 - RNA, 64 nt, hsa; identical to SEQ ID NO: 238045

SEQ ID NO: 263174 - RNA, 64 nt, hsa; identical to SEQ ID NO: 238046

SEQ ID NO: 263175 - RNA, 64 nt, hsa; identical to SEQ ID NO: 238047

SEQ ID NO: 263176 - RNA, 64 nt, hsa; identical to SEQ ID NO: 238048

SEQ ID NO: 263177 - RNA, 64 nt, hsa; identical to SEQ ID NO: 238049

SEQ ID NO: 263178 - RNA, 64 nt, hsa; identical to SEQ ID NO: 238050

SEQ ID NO: 263179 - RNA, 64 nt, hsa; identical to SEQ ID NO: 238051

SEQ ID NO: 263180 - RNA, 64 nt, hsa; identical to SEQ ID NO: 238052

SEQ ID NO: 263181 - RNA, 64 nt, hsa; identical to SEQ ID NO: 238053

SEQ ID NO: 263182 - RNA, 64 nt, hsa; identical to SEQ ID NO: 238054

SEQ ID NO: 263183 - RNA, 64 nt, hsa; identical to SEQ ID NO: 238055

SEQ ID NO: 263184 - RNA, 64 nt, hsa; identical to SEQ ID NO: 238056

SEQ ID NO: 263185 - RNA, 64 nt, hsa; identical to SEQ ID NO: 238057

SEQ ID NO: 263186 - RNA, 64 nt, hsa; identical to SEQ ID NO: 238058

SEQ ID NO: 263187 - RNA, 64 nt, hsa; identical to SEQ ID NO: 238059

SEQ ID NO: 263188 - RNA, 64 nt, hsa; identical to SEQ ID NO: 238060

SEQ ID NO: 263189 - RNA, 64 nt, hsa; identical to SEQ ID NO: 238061

SEQ ID NO: 263190 - RNA, 64 nt, hsa; identical to SEQ ID NO: 238062

SEQ ID NO: 263191 - RNA, 64 nt, hsa; identical to SEQ ID NO: 238063

SEQ ID NO: 263192 - RNA, 64 nt, hsa; identical to SEQ ID NO: 238064

SEQ ID NO: 263193 - RNA, 64 nt, hsa; identical to SEQ ID NO: 238065

SEQ ID NO: 263194 - RNA, 64 nt, hsa; identical to SEQ ID NO: 238066

SEQ ID NO: 263195 - RNA, 64 nt, hsa; identical to SEQ ID NO: 238067

SEQ ID NO: 263196 - RNA, 64 nt, hsa; identical to SEQ ID NO: 238068

SEQ ID NO: 263197 - RNA, 64 nt, hsa; identical to SEQ ID NO: 238069

SEQ ID NO: 263198 - RNA, 64 nt, hsa; identical to SEQ ID NO: 238070

SEQ ID NO: 263199 - RNA, 64 nt, hsa; identical to SEQ ID NO: 238071

SEQ ID NO: 263200 - RNA, 64 nt, hsa; identical to SEQ ID NO: 238072

SEQ ID NO: 263201 - RNA, 64 nt, hsa; identical to SEQ ID NO: 238073

SEQ ID NO: 263202 - RNA, 64 nt, hsa; identical to SEQ ID NO: 238074

SEQ ID NO: 263203 - RNA, 64 nt, hsa; identical to SEQ ID NO: 238075

SEQ ID NO: 263204 - RNA, 64 nt, hsa; identical to SEQ ID NO: 238076

SEQ ID NO: 263205 - RNA, 64 nt, hsa
cgcccucagccgcggagccucugcggaggcugagccccgcgaccggagcgccgcucuccgcuuc

SEQ ID NO: 263206 - RNA, 64 nt, hsa
ggaggggcagaguuaaacauuagccacaauggccccccgcgaagugagucauacuccccacaag

SEQ ID NO: 263207 - RNA, 64 nt, hsa
cccugccggcacggcucccccuccuggaccagucccccgcgagcccggagaaggggagacccgu

SEQ ID NO: 263208 - RNA, 64 nt, hsa
caguggaggcgggacgcccuccaucuccucggagccccgcgagguccggcccagcaacuucccg

SEQ ID NO: 263209 - RNA, 64 nt, hsa
cccauuggaugaaguggugcccucuccucuggucccccgcgaaaagguaaauacacccaaaggg

SEQ ID NO: 263210 - RNA, 64 nt, hsa
ccuuccuacggggaaucuguguaugggcccaguuccccgcgaguuccugugguaaggcuuucug

SEQ ID NO: 263211 - RNA, 64 nt, hsa
agucacuucuuggcugugcagcaggucccccccuccccgcgauaugcuggaggguaggauucug

SEQ ID NO: 263212 - RNA, 64 nt, hsa
agcagcgcccgaggccagggccgccgaagggcagccccgcgaccaccccugugcgcgcguucgc

SEQ ID NO: 263213 - RNA, 64 nt, hsa
cagccucaaauuccagaaguggaggcuccagccuccccgcgaggguccagccccacagucuucu

SEQ ID NO: 263214 - RNA, 54 nt, hsa
agggcgaggacgaggcguagaugcccccgcgagacggguuagggaaagcggagg

SEQ ID NO: 263215 - RNA, 64 nt, hsa
caugaugagcccuguuccugcucaucaugaagauccccgcgauacuucaacgccuucugacuuc

SEQ ID NO: 263216 - RNA, 64 nt, hsa
gcggcagcagagcuggcacaccgauucugggaagccccgcgaaugauggcuuuugaauuaauga

SEQ ID NO: 263217 - RNA, 64 nt, hsa
caggauccuucugcuccgcucaggacccccggagccccgcgaaaacaucugccucccaggaggg

SEQ ID NO: 263218 - RNA, 64 nt, hsa
ugaacaccgcgaacagccucugucugggugggacccccgcgagugcauccagcagcaguagcag

SEQ ID NO: 263219 - RNA, 64 nt, hsa
cugcauuuccucgcagccucucagugcccuccagccccgcgaccauguggccacaauccacgcu

SEQ ID NO: 263220 - RNA, 64 nt, hsa
ccagguuuaaccguugcgucaccgggacccgagcccccgcgaugcccugggggccgugcucacu

SEQ ID NO: 263221 - RNA, 64 nt, hsa
cauggaauccacgcgcuccagggacucugcccgcccccgcgacuggagacggcaucucguucac

SEQ ID NO: 263222 - RNA, 64 nt, hsa
cguuucuuuuuaccuuuuuuggcacucccucugaccccgcgaugaguguuuugguggcagaggu

SEQ ID NO: 263223 - RNA, 64 nt, hsa
guguggccacagcggacaugguaugcccggaugcccccgcgagccccagcgcccuggcagucag

SEQ ID NO: 263224 - RNA, 64 nt, hsa
gaaaugauccccucuuugccuuggacuucuucucccccgcgaguuuuccccacuuacuuacccu

SEQ ID NO: 263225 - RNA, 64 nt, hsa
agggccgaggucugagcucucguccugccguggcccccgcgauggccuggggugcaagcuuggg

SEQ ID NO: 263226 - RNA, 64 nt, hsa
accagaccuuccauguccucgggcagcugcaacuccccgcgagaccccgcagcugggugggaug

SEQ ID NO: 263227 - RNA, 64 nt, hsa
ccgacaggggcgagggcugcuuccucgcggcagcccccgcgaagaaaucucgagagaacuggca

SEQ ID NO: 263228 - RNA, 50 nt, hsa
ucccgcacgcacaaucgugaccccgcgaccucuccaucuucagcuucuuc

SEQ ID NO: 263229 - RNA, 64 nt, hsa
ccucaccccgacccccacccucacuccuaccccaccccgcgaucgucaggggugccacgguggg

SEQ ID NO: 263230 - RNA, 64 nt, hsa
ccacuccccccgccucgacggcaccacuggccggccccgcgaaagacugcgcgugcguagagca

SEQ ID NO: 263231 - RNA, 50 nt, hsa
cggggccugaagccacguagccccgcgaugccagaggaggggcacugggu

SEQ ID NO: 263232 - RNA, 64 nt, hsa
ccccgcgccggaguccaggggccccuucuggacgccccgcgacucuggcgaaauaaagcgagug

SEQ ID NO: 263233 - RNA, 64 nt, hsa
uauaauauuuagcgaacucggucucccucagaucccccgcgagggaggcugcuggacccacccc

SEQ ID NO: 263234 - RNA, 64 nt, hsa
gcccggggcaacuccgagugggugcucaagucccccccgcgacccacccgcggaguggggggcc

SEQ ID NO: 263235 - RNA, 64 nt, hsa
gaguccgcaguugcccuuguucggaauccacguuccccgcgaucccgggagcuggaggcgcaug

SEQ ID NO: 263236 - RNA, 64 nt, hsa
cggcgccccggacgccgcgauuuugccuuugguuccccgcgaaguccgaggccuggcucuggag

SEQ ID NO: 263237 - RNA, 64 nt, hsa
ccgcccgggucccugcagcgcuuccucccgcagcccccgcgaccgauccgaccgcgucgcugcc

SEQ ID NO: 263238 - RNA, 64 nt, hsa
acacgcagggggcucggaggacucaggccgcagcccccgcgacggagggcagggcccacccugc

SEQ ID NO: 263239 - RNA, 64 nt, hsa
aggucaucagccagguugauugugcggguuagauagagaucaucagccggguugauucuacagg

SEQ ID NO: 263240 - RNA, 64 nt, hsa
aggucaucagccagguugauuguguggguuagauagagaucaucagccugguagauuguguggg

SEQ ID NO: 263241 - RNA, 64 nt, hsa
gucaagcuaaaauaggugacuauacuauuaagauagagaucauacaaaagauuccaaagaaagu

SEQ ID NO: 263242 - RNA, 64 nt, hsa
ccaaagaaagucaaaaaguguaaaauggaaaauaagagaucaaaaugaauauagcauaggaaua

SEQ ID NO: 263243 - RNA, 64 nt, hsa
ucaucaccaucucagcacaauuuggccauucugaagagaucauguuauuucacucuucauguau

SEQ ID NO: 263244 - RNA, 64 nt, hsa
cuauucuaacaaauuuuucguccaccaucuuaacagagaucaaguguauacaugaagguaucag

SEQ ID NO: 263245 - RNA, 64 nt, hsa
aguacacaggcugcagaagacagagacagaagaaagagaucaagggcagauaacuguugauagg

SEQ ID NO: 263246 - RNA, 64 nt, hsa
agucugaccauucacuuucugugugccagagaagagagaucauggguauagaccagccccugga

SEQ ID NO: 263247 - RNA, 64 nt, hsa
gauauugauggccacuaaguguguauccagaagaagagaucagaaugaugaguccagaaccccu

SEQ ID NO: 263248 - RNA, 64 nt, hsa
cuccugggacugugacugcuuuugagagcucuucagagaucauaagaacuugggcuuuucuacg

SEQ ID NO: 263249 - RNA, 64 nt, hsa
gucucaauuuuuuauuuaucuauaugguaaacucagagaucacuccuuaggggugaguccuauu

SEQ ID NO: 263250 - RNA, 64 nt, hsa
auaucacaugguacacuugauuaguaauaaaaccagagaucaauuuaaauugcugauagguccu

SEQ ID NO: 263251 - RNA, 64 nt, hsa
caaggauacaguugguauauuaguuggauggcauagagaucauacucagaaaccuucgcucacg

SEQ ID NO: 263252 - RNA, 64 nt, hsa
agaguccacgcugacauacagaaugacgaaaaggagagaucaaugucuuauugugaugagucuc

SEQ ID NO: 263253 - RNA, 64 nt, hsa
caauggccuagaagcugccuguacuuuggggaaacagauggagcucuugggcccagccagcugg

SEQ ID NO: 263254 - RNA, 64 nt, hsa
gccacugagcccaggucuggacuuuuuuggccaucagauggacgaucugaacauaggguggcug

SEQ ID NO: 263255 - RNA, 64 nt, hsa
ugggauuacaggcgugagccaccaugccccgccccagauggauuuuacauuugcucuuuugugu

SEQ ID NO: 263256 - RNA, 64 nt, hsa
acucccuuaucucuucauauucuuuauucccuaccagauggauuuuuuuuuuuuuuuuuggaga

SEQ ID NO: 263257 - RNA, 64 nt, hsa
auguaucucauacgcugugauguggauggggccccagauggaagguuugaaacuggauucucga

SEQ ID NO: 263258 - RNA, 64 nt, hsa
accccugggaugcgaagccagcaagcuuuugcugcagauggacagguuucuuuucuguggcuuu

SEQ ID NO: 263259 - RNA, 64 nt, hsa
gaccgauaaaaagaccuccagauaggcagacagacagauggaccaccaaccuggacagacagcc

SEQ ID NO: 263260 - RNA, 64 nt, hsa
acagaccuucuggccagacagacuccuaaccaaccagauggacugccagacaggcagacaucag

SEQ ID NO: 263261 - RNA, 64 nt, hsa
cccccaaaugaguacacaucuccagcuauucagacagauggacccccagcaaaucaggaccuau

SEQ ID NO: 263262 - RNA, 64 nt, hsa
aagaucuuuugaauuuuagaaaaaacauaugaaucagauggaacaaucugaaugugauaugcuc

SEQ ID NO: 263263 - RNA, 64 nt, hsa
acugauuuuggaccuuugagacuuuuaccacauacagauggaugaaacuacuuacugauuuaag

SEQ ID NO: 263264 - RNA, 64 nt, hsa
ucuuugucuacugugguccugugcacguuggccucagauggacuacaggagauuacaacguaca

SEQ ID NO: 263265 - RNA, 64 nt, hsa
ucagauggacuacaggagauuacaacguacaaggcagauggagcauugacguuuucaaaaccau

SEQ ID NO: 263266 - RNA, 64 nt, hsa
ccaucggccucuaguucuccaaggaccuagaagacagauggaguucuccccugaacuccuugcu

SEQ ID NO: 263267 - RNA, 64 nt, hsa
agcagggccgggccuuccugccauccccaggucucagauggaauuacacuagaggcccuccgcu

SEQ ID NO: 263268 - RNA, 64 nt, hsa
aaaaaaagaaauguaccuguuggcaggagaaggccagauggaguauguggaguaauagggaaag

SEQ ID NO: 263269 - RNA, 64 nt, hsa
ccuaucagaacuauaggauuucuucugggaaauacagauggaaauacagaaugaauauguuuuu

SEQ ID NO: 263270 - RNA, 64 nt, hsa
gccggcugcacccagagggagcagugaggcaggacagauggacagguuccuccugcgcuguaau

SEQ ID NO: 263271 - RNA, 64 nt, hsa
gaacccugggcagggcucuggugggagagggagacagauggaggcaguggcuggugggccacuc

SEQ ID NO: 263272 - RNA, 64 nt, hsa
cagggagcuggcaaugcccuaccugccuguucuccagauggagaaacaggcucugagauuucac

SEQ ID NO: 263273 - RNA, 59 nt, hsa
gcuaccgcauccgcccaugacacagggagcagauggauccacgugcucgccucugccca

SEQ ID NO: 263274 - RNA, 64 nt, hsa; identical to SEQ ID NO: 94944

SEQ ID NO: 263275 - RNA, 64 nt, hsa; identical to SEQ ID NO: 94945

SEQ ID NO: 263276 - RNA, 64 nt, hsa; identical to SEQ ID NO: 94946

SEQ ID NO: 263277 - RNA, 64 nt, hsa; identical to SEQ ID NO: 94947

SEQ ID NO: 263278 - RNA, 64 nt, hsa; identical to SEQ ID NO: 94948

SEQ ID NO: 263279 - RNA, 64 nt, hsa; identical to SEQ ID NO: 94949

SEQ ID NO: 263280 - RNA, 64 nt, hsa; identical to SEQ ID NO: 94950

SEQ ID NO: 263281 - RNA, 59 nt, hsa; identical to SEQ ID NO: 94951

SEQ ID NO: 263282 - RNA, 64 nt, hsa; identical to SEQ ID NO: 94952

SEQ ID NO: 263283 - RNA, 64 nt, hsa; identical to SEQ ID NO: 94953

SEQ ID NO: 263284 - RNA, 62 nt, hsa; identical to SEQ ID NO: 94954

SEQ ID NO: 263285 - RNA, 64 nt, hsa; identical to SEQ ID NO: 94955

SEQ ID NO: 263286 - RNA, 64 nt, hsa
guggucaccauacucaaauggugucauggcugaaguuggccaccuugcuugagggacaaguugu

SEQ ID NO: 263287 - RNA, 64 nt, hsa
uuuuguauguuuaguagaaacgggguuucaccauguuggccaggcuguucucgaacuccugacc

SEQ ID NO: 263288 - RNA, 64 nt, hsa
uuuugcauuuuuaguagagaugggguuucaccauguuggccaggauggucuugaucucuugacc

SEQ ID NO: 263289 - RNA, 64 nt, hsa
uuuuguguuuuuagcagagacaggguuucaccacguuggccaggguggucuuggacuccugacc

SEQ ID NO: 263290 - RNA, 64 nt, hsa
uuuuguauuuuuaguagagacaggguuucaccauguuggccaggcugcucuugaacuccugacc

SEQ ID NO: 263291 - RNA, 64 nt, hsa
uuuuguauuuuuaguagagacgggguuucaccauguuggccaggcuggucucgaacuccugacc

SEQ ID NO: 263292 - RNA, 64 nt, hsa
acgggaccccugggcggguggacaugagaccacuguuggccagggacgccgugcggaggccuac

SEQ ID NO: 263293 - RNA, 64 nt, hsa
gcugccugagcagcagcugaccgcccgucucacuguuggccagggcuuuguggcguggguguuu

SEQ ID NO: 263294 - RNA, 64 nt, hsa
uuuuauaauuuuaguagagaugggguuucacugcguuggccaggaugaucucgaucucuugacc

SEQ ID NO: 263295 - RNA, 64 nt, hsa
uuuuguguuuuuauuagaaacagaguuucaccauguuggccaggcuggagaauugcuguaauag

SEQ ID NO: 263296 - RNA, 64 nt, hsa
auuagugauguugagcauuuuuuuguguguguuuguuggccacuuguaugucuucuuugaaaac

SEQ ID NO: 263297 - RNA, 64 nt, hsa
acuaaucccuuugaaaaucaaguaguagagccaaguuggccaaaaaacuuggauauuuaaaaag

SEQ ID NO: 263298 - RNA, 64 nt, hsa
uuuuguauuuuuaguagagacgggauuuuaucauguuggccaggcuggucucgaacuccugacc

SEQ ID NO: 263299 - RNA, 64 nt, hsa
uuuuguauuuuuaguggaaccgggguuucaccauguuggccaggcuggucuugaacuccugacc

SEQ ID NO: 263300 - RNA, 64 nt, hsa
uuuuguauuuuuaguagaaacagggugucaccauguuggccagacuggucucaaacuccugacc

SEQ ID NO: 263301 - RNA, 64 nt, hsa
uuuuguauuuuuaguagagaugggguuucaccauguuggccaggauggucuugaucucuugacc

SEQ ID NO: 263302 - RNA, 64 nt, hsa
uuuuguauuuuucguagagauaggguuucaccauguuggccaggcuggucucaaacuccugacc

SEQ ID NO: 263303 - RNA, 64 nt, hsa
caaaugaagggagcagacagugauuaaugguucuguuggccaaggcuucucccugucggugaag

SEQ ID NO: 263304 - RNA, 64 nt, hsa
uuuuguauuaguagagacgacaggguuucaccauguuggccagggcuggucucgaacuccugac

SEQ ID NO: 263305 - RNA, 64 nt, hsa
uuuuguauuuuuaguagagaugggguuucacuguguuggccaggcuggucuugaacugaccuca

SEQ ID NO: 263306 - RNA, 64 nt, hsa
uuuuguaauuuuaguagagacagaguuucaccauguuggccaggauggucucgaucucuugacc

SEQ ID NO: 263307 - RNA, 64 nt, hsa
ucuuguauuuuuaguagagacggaguuucuccauguuggccagacuggucucgaacuccugacc

SEQ ID NO: 263308 - RNA, 64 nt, hsa
uuaccccaagcccucuagcuguguggcuggcaguguuggccacguaggggcucccaucccccca

SEQ ID NO: 263309 - RNA, 64 nt, hsa
uuuguauuuuuaguagagacagggguuucaccacguuggccaggcuggucucgaacuccugacc

SEQ ID NO: 263310 - RNA, 64 nt, hsa
aauuguauuuuuaguagagacaggauuucaccauguuggccaggccagucucaaacuccugacc

SEQ ID NO: 263311 - RNA, 64 nt, hsa
gucuuuuggauaauuggaaaccuucaucacugagguuggccagccccugccaaguguuguguag

SEQ ID NO: 263312 - RNA, 64 nt, hsa
uuuuguacuuuuaguagagaugggguuucaccauguuggccaggcuggucuucaacuccagauc

SEQ ID NO: 263313 - RNA, 64 nt, hsa
uuuuguaauuuuaguagagacgggguuucaccauguuggccaggcugauuaacuccugaccuca

SEQ ID NO: 263314 - RNA, 64 nt, hsa
uuuuguauuuuuaguagagacagaguuucaccauguuggccaggcuggucuugaacuccugacc

SEQ ID NO: 263315 - RNA, 64 nt, hsa
uuuuguauuuuuaguagagaugggguuucaccauguuggccaggcuggucuugaacuccugacc

SEQ ID NO: 263316 - RNA, 64 nt, hsa
uuggguugagcuuuuuuagaaagucgaagugaauguuggccaggaaaauggaaaagccauugua

SEQ ID NO: 263317 - RNA, 64 nt, hsa
uuuuguauuuuuaguggagacaggguuucaccauguuggccaggcuggucucgaacuccugacc

SEQ ID NO: 263318 - RNA, 64 nt, hsa
uuuugcauuuuuaguggagagggaguuucaccauguuggccagguuggucuugaacuccugacc

SEQ ID NO: 263319 - RNA, 64 nt, hsa
uuuuguaguuuuaguggagaugggguuucaccauguuggccaggcuugucucgaacuccugacc

SEQ ID NO: 263320 - RNA, 64 nt, hsa
uuuuguauuuuuaguagagacgagguuucacuguguuggccaggauggucuccaucucuugacc

SEQ ID NO: 263321 - RNA, 64 nt, hsa
gaucccucucuuuggaaaguuuagccuggaagcaguuggccacacuguguggagggcaccucuc

SEQ ID NO: 263322 - RNA, 64 nt, hsa
uuuuguauuuucgguagagacgggauuucaccauguuggccaggcuagucucgaacucaugacc

SEQ ID NO: 263323 - RNA, 64 nt, hsa
uuuuucauuuuuaguagagacaggguuuugccauguuggccaggcuggucucaaacucuugacc

SEQ ID NO: 263324 - RNA, 64 nt, hsa
ugcuuuugucuaugggacucaaugcacugacauuguuggccaaagccaaagcuaggccuggcca

SEQ ID NO: 263325 - RNA, 64 nt, hsa
aaccaccacacccagcccacuucugccauauucuguuggccagugugacaaggauugcuacugu

SEQ ID NO: 263326 - RNA, 64 nt, hsa
uuuuguauuuuuaguagagaugggguuucaccauguuggccaggauugucuccaucucuugacc

SEQ ID NO: 263327 - RNA, 64 nt, hsa
agccaccacacccagcgagacgggguuucauuauguuggccaggcuggucuccaacuccugacc

SEQ ID NO: 263328 - RNA, 64 nt, hsa
uuuuguauuuuuagaagagaugggguuucuccauguuggccaggcuggucuugaacuccugguc

SEQ ID NO: 263329 - RNA, 64 nt, hsa
ccugaccgguccuugugcccucaccagacacccuguuggccaugacucaacaaaccaguguugg

SEQ ID NO: 263330 - RNA, 64 nt, hsa
uuuuguauuuuuaauagagacgggguuucaccauguuggccaggcuggucucgaacucuugacc

SEQ ID NO: 263331 - RNA, 64 nt, hsa
uuguauuuuuuuaauagauaugggguuucgccauguuggccaggcuggucucgaacuccugacc

SEQ ID NO: 263332 - RNA, 64 nt, hsa
aauaugccaagguagggaaugugccuuuuucagaguuggccaggagcuccuggcugggacacgg

SEQ ID NO: 263333 - RNA, 64 nt, hsa
gucucgguugcuauuccaagaacagaaggaggaaguuggccaauuacagcgugugugcauggau

SEQ ID NO: 263334 - RNA, 64 nt, hsa
cccaaugcuguggccccaccaggcccagagccugguuggccauucucaugcccaccagcuucug

SEQ ID NO: 263335 - RNA, 64 nt, hsa
uuuuguauuuuugaucaagacggaguuucaccauguuggccaggcuggucuccaacuccugccc

SEQ ID NO: 263336 - RNA, 64 nt, hsa
ucuuuuuugguguacuuggcacaguaggugccaaguuggccaccauucuguguaacaccuuuuu

SEQ ID NO: 263337 - RNA, 64 nt, hsa
ccaccaugugccaugauggcugcugcagccccguguuggccaugucgucaccauucucucuggc

SEQ ID NO: 263338 - RNA, 64 nt, hsa
uuuuuguauuuuuaguagagacaguguuuaccauguuggccaggcaggucuccaacuccugacc

SEQ ID NO: 263339 - RNA, 64 nt, hsa
uuuuguauuuuuaguagagaugggguuucaccacguuggccacacuggucucaaacuccugacc

SEQ ID NO: 263340 - RNA, 64 nt, hsa
uggaaaaauugagauggaaaacaaaccaucucuaguuggccagcgucuugcucuguucacaguc

SEQ ID NO: 263341 - RNA, 64 nt, hsa
uuuuguauuuuuaguagagacaggguuucaccauguuggccaggauggucucgaucuccugacc

SEQ ID NO: 263342 - RNA, 64 nt, hsa
uuuuguauuuuuaguagagacaggguuucaccauguuggccaggcuggucuugaacuccugacc

SEQ ID NO: 263343 - RNA, 64 nt, hsa
uuuuguauuuuuaguagagacaguguuuugccauguuggccaggcuggucucgaacuccugaca

SEQ ID NO: 263344 - RNA, 64 nt, hsa
uuuuguauuuuuaguacagacgggguuucaccauguuggccaggauggucucgaucucuugacc

SEQ ID NO: 263345 - RNA, 64 nt, hsa
cagcucuguuacaggaggauagagauuugauccuguuggccagaggauguuugacacccagccg

SEQ ID NO: 263346 - RNA, 64 nt, hsa
aguggcgcgaucucggcucagccucccgaguagcugggauuacaggcaugugccaccacgcccg

SEQ ID NO: 263347 - RNA, 64 nt, hsa
caagugguucuccuuccucagccucccaaguagcugggauuacaggcaccuaccaccagggcca

SEQ ID NO: 263348 - RNA, 64 nt, hsa
caggugaucugcccgccucggucucccaaagugcugggauuacaggcaugagccacugcaccug

SEQ ID NO: 263349 - RNA, 64 nt, hsa
caagugauucuucugccucagccuccugaguagcugggauuacaggugugcaccaccguaccca

SEQ ID NO: 263350 - RNA, 64 nt, hsa
caggugauccacccgccugagccucccaaagugcugggauuacaggcaugagccaccgcgcccg

SEQ ID NO: 263351 - RNA, 64 nt, hsa
caagcaaaucuccugccucagccuccaaaguagcugggauuacaggcacccaccacaucuggcu

SEQ ID NO: 263352 - RNA, 64 nt, hsa
cucaugaucagccugccucggccucccaaagugcugggauuacaggugugagccaccgugccca

SEQ ID NO: 263353 - RNA, 64 nt, hsa
caagcaauucucuugccucagccucccgaguagcugggauuacaggugcaugccaccauggcug

SEQ ID NO: 263354 - RNA, 64 nt, hsa
caggugauccaccugccucagccucccaaagugcugggauuacaggcgugagcaaucgugccca

SEQ ID NO: 263355 - RNA, 64 nt, hsa
caagcaauucucccaccucagccuccugaguagcugggauuacaggcacaugccaccaugcuca

SEQ ID NO: 263356 - RNA, 64 nt, hsa
cucgugauccacccaccuuggccucccaaagugcugggauuacaggcaugagccaccacgccug

SEQ ID NO: 263357 - RNA, 64 nt, hsa
caagcgauucuugugccucggccucccuaguagcugggauuacaggcgcacaccaccacacaca

SEQ ID NO: 263358 - RNA, 64 nt, hsa
cucgugauccgccugccucugccucccaaagugcugggauuacaggugugacccacugcgcaca

SEQ ID NO: 263359 - RNA, 64 nt, hsa
cucgugauccguccaccucagccucccaaagugcugggauuacaggugugagccaccacgcccg

SEQ ID NO: 263360 - RNA, 64 nt, hsa
ugccucuccaguguaauauuugccuuucuguaaaugggauuaaauaugauuuguaaauaaagga

SEQ ID NO: 263361 - RNA, 64 nt, hsa
caggugauccucuugucucagccucccaaagugcugggauuacaggcaugagccacuguguccu

SEQ ID NO: 263362 - RNA, 64 nt, hsa
caagcgauucuccugccucagccucccaaguagcugggauuacaggcauacaccaccacgcccc

SEQ ID NO: 263363 - RNA, 64 nt, hsa
caagugauucuccucccucagccucccaaguagcugggauuacaggcacccacgagcaugcccg

SEQ ID NO: 263364 - RNA, 64 nt, hsa
caggugauccacccgccucggccucccaaagugcugggauuacaggugcgagccaccgugcccg

SEQ ID NO: 263365 - RNA, 64 nt, hsa
ggcaauagagguugagagagauucagcaucuuucugggauuagaauucaagucucuuuacuccu

SEQ ID NO: 263366 - RNA, 64 nt, hsa
uugucacuggaaccucccugggccugucucagauugggauuaacauaaaagaguggaacuaucc

SEQ ID NO: 263367 - RNA, 64 nt, hsa
cauuuccucuuccuucucuacucaugccagauuuugggauuacaaauagaagcuucuugcuccu

SEQ ID NO: 263368 - RNA, 64 nt, hsa
caagcgauucuccugccucagccuccugaguagcugggauuacaggugugcaccaacacacccg

SEQ ID NO: 263369 - RNA, 64 nt, hsa
caagugaucugccugccuuggccucccaaagugcugggauuacaggugugagcugccacgccca

SEQ ID NO: 263370 - RNA, 64 nt, hsa
cucgugauccaccugccauggccucccaaagugcugggauuacaggcgugagccaccaugcucg

SEQ ID NO: 263371 - RNA, 64 nt, hsa
caagcgauucuucugccucagccuucugaguagcugggauuacacgcgugugccaccacgcucg

SEQ ID NO: 263372 - RNA, 64 nt, hsa
aggugauccgcccgccucagccuccuuaaagugcugggauuacaggcaugagccaccgcaccca

SEQ ID NO: 263373 - RNA, 64 nt, hsa
caaucgauucuccugccucagccuccugaguaccugggauuacaggugccugccaccacgccug

SEQ ID NO: 263374 - RNA, 64 nt, hsa
caggugauccgcccgccucggccucccaaagugcugggauuacaggcgugagccaccgcgccca

SEQ ID NO: 263375 - RNA, 64 nt, hsa
caagugauucuccugccucagccucccaaguagcugggauuacaggcacccgccaccacaccug

SEQ ID NO: 263376 - RNA, 64 nt, hsa
caagugauccaccuaccuaggccuuccagagugcugggauuauaggcgugagccaccgugccug

SEQ ID NO: 263377 - RNA, 64 nt, hsa
caagcaauucuccugccucagccuccugaguagcugggauuauaggcgugcaccaccaugccca

SEQ ID NO: 263378 - RNA, 64 nt, hsa
caggugauccaccugccuuggccucccaaagugcugggauuacaggcaugaaccaccacgccug

SEQ ID NO: 263379 - RNA, 64 nt, hsa
caagcaauucuccugccucagccucucgaguagcugggauuauaggcguccgccaccaugccug

SEQ ID NO: 263380 - RNA, 64 nt, hsa
caggugauccgcccgccucggccuccuaaagugcugggauuacaggcgugagccacugcgccca

SEQ ID NO: 263381 - RNA, 64 nt, hsa
caagcgauuuuccugcuucaucuucccagguagcugggauuacaggcaugugccacaacgccug

SEQ ID NO: 263382 - RNA, 64 nt, hsa
cucaugauccacccaccucagccucccaaagugcugggauuacaggugugagccaccgcacccg

SEQ ID NO: 263383 - RNA, 64 nt, hsa
caagcgauucuccugugucagucuccugaguagcugggauuacaggcacccaccacuaugccca

SEQ ID NO: 263384 - RNA, 64 nt, hsa
caggugauccacccaccucggccucccaaagugcugggauuacaggugugagccacagcgccug

SEQ ID NO: 263385 - RNA, 64 nt, hsa
caagcgauucuccugccucagccucucgaguagcugggauuacaggcaccugccaccaugcccg

SEQ ID NO: 263386 - RNA, 64 nt, hsa
caggugauccacccacuuugaccucccaaagugcugggauuacuagacguaagccaccacaccu

SEQ ID NO: 263387 - RNA, 64 nt, hsa
caagugauccacccgccucagccucccaaagugcugggauuacaggugugagccacugcaccca

SEQ ID NO: 263388 - RNA, 64 nt, hsa
cucuugauccgccugccuuggccucccaaagugaugggauuacagaugugagccaccgugccua

SEQ ID NO: 263389 - RNA, 64 nt, hsa
caagccauucuccugccucagucuccugaguagcugggauuacgggugcgugccaccaugccug

SEQ ID NO: 263390 - RNA, 64 nt, hsa
cagguaaucgaccugccucggccucccaaagugcugggauuacaggugugagccaccacgcccg

SEQ ID NO: 263391 - RNA, 64 nt, hsa
uaggugauccacucgccuucaucucccaaagugcugggauuacaggcgugagccaccgugccug

SEQ ID NO: 263392 - RNA, 64 nt, hsa
caagugauucucaugccucagccuccugaguagcugggauuacaggcuccugccaccacgcccg

SEQ ID NO: 263393 - RNA, 64 nt, hsa
cucguaaucugcccaccucggccucccaaaguucugggauuacaggugugagcgaccacauccg

SEQ ID NO: 263394 - RNA, 64 nt, hsa
caagcgauucuccugcuucaaccuccugaguagcugggauuacaggugcgugccaccacacccc

SEQ ID NO: 263395 - RNA, 64 nt, hsa
ucuucccuccagccugcaugcccuccucuggaacugggauuaaacagauacccaagaggcagga

SEQ ID NO: 263396 - RNA, 64 nt, hsa
cucgugaucugccugccuuggccucccaaagugcugggauuacaggcgugagccaccaugcccc

SEQ ID NO: 263397 - RNA, 64 nt, hsa
caagcgauucuccuaccucagccucccgaguagcugggauuacaggcaugugccaccacgccaa

SEQ ID NO: 263398 - RNA, 64 nt, hsa
caggugauccacccaccucggccucccaaagugcugggauuacaggcgugagccaccgcgcccc

SEQ ID NO: 263399 - RNA, 64 nt, hsa
caagcgauucuccugccucagccucccuaguagcugggauuacaggcgcccgccaccaugcccg

SEQ ID NO: 263400 - RNA, 64 nt, hsa
ucaagugaucugccgccucagcuucucaaaguacugggauuauauaggcaugagccacugagcc

SEQ ID NO: 263401 - RNA, 64 nt, hsa
cucgugauccgccugccucugccucccaaagugcugggauuacaggcgugagccaccgcguccg

SEQ ID NO: 263402 - RNA, 64 nt, hsa
caagcaauucuccuuccucagccucccaaguagcugggauuacaggcaugcaccaccaugccca

SEQ ID NO: 263403 - RNA, 64 nt, hsa
ucaggugauccgcccaccucagcucucaaagugcugggauuacaggcgggagccacugcacaug

SEQ ID NO: 263404 - RNA, 64 nt, hsa
caagcgauucuccugccucagccucucgaguagcugggauuacaggcaugcgucaccacuccca

SEQ ID NO: 263405 - RNA, 64 nt, hsa
cucgugauccgcccgccucggccucccaaagugcugggauuacaggcgugagccaccgugccug

SEQ ID NO: 263406 - RNA, 64 nt, hsa
caagugauucuccagccucagccucccgaguagcugggauuaugggcgcccaccaccaugccca

SEQ ID NO: 263407 - RNA, 64 nt, hsa
caggugaucugcccaccucauccuccaaaagugcugggauuacaggcaugagccacugcgccug

SEQ ID NO: 263408 - RNA, 64 nt, hsa
caagcaauucuccugccucagccucccgaguagcugggauuacaggcaugcgccacuaccccag

SEQ ID NO: 263409 - RNA, 64 nt, hsa
caggugauccgccugccucggccucccaaagugcugggauuacaggcauaagccacugcgccca

SEQ ID NO: 263410 - RNA, 64 nt, hsa
caaaugauucuccugccucagccucccgaguagcugggauuacaggcaccugccaccacgccca

SEQ ID NO: 263411 - RNA, 64 nt, hsa
cucaugauccacccaccuuagccucccaaagugcugggauuaggugugagccaccgcaccuggc

SEQ ID NO: 263412 - RNA, 64 nt, hsa
ucaagggauucuccugccucagccuccaacuagcugggauuacaggcacaagccaccaugccug

SEQ ID NO: 263413 - RNA, 64 nt, hsa
caggugauccaccagccucggccucccaaaguucugggauuaaaugcgugagccaccaugcccg

SEQ ID NO: 263414 - RNA, 64 nt, hsa
caagcgauucuccugccccagccucccauauagcugggauuauaggugccugccaccaugccca

SEQ ID NO: 263415 - RNA, 64 nt, hsa
caggugauccacccaccuuggccucucuaaauacugggauuacaggcgugagccacugcauccg

SEQ ID NO: 263416 - RNA, 64 nt, hsa
caagcgauucuccuguaucagccucccaaguagcugggauuauaggcaugugccaccaugccca

SEQ ID NO: 263417 - RNA, 64 nt, hsa
caagugauccacacgccuuggucucccaaagugcugggauuacgguguuagccacuacaccugg

SEQ ID NO: 263418 - RNA, 64 nt, hsa
caagcgauucuccugccucagccuccugaguagcugggauuacaggcacgcaccaccauaccug

SEQ ID NO: 263419 - RNA, 64 nt, hsa
caagcgauccaccugccuuggccuuccagagugcugggauuacaggugugagccaccacgccca

SEQ ID NO: 263420 - RNA, 64 nt, hsa
caagcgauucucguggcucagccucccuaguagcugggauuacaggcacacaccaccauaccug

SEQ ID NO: 263421 - RNA, 64 nt, hsa
caggugauccacccgccuuggccucccaaagugcugggauuacaggugugagccacuauacccg

SEQ ID NO: 263422 - RNA, 64 nt, hsa
cucacgauuugcccgccucggcuucccagagugcugggauuacaggcgugagccaccgcgccug

SEQ ID NO: 263423 - RNA, 64 nt, hsa
caaaugauccgccugcgucggcuucccagagugcugggauuacaggugucagccacugcgcuca

SEQ ID NO: 263424 - RNA, 64 nt, hsa
caagugauucucuugccuuagccucccgagcagcugggauuauaggcguccaccaccacgccca

SEQ ID NO: 263425 - RNA, 64 nt, hsa
caagugaucugcccgccucgggcucccaaagugcugggauuacaggcgugagccacugcaccug

SEQ ID NO: 263426 - RNA, 64 nt, hsa
caagcgauucuccugccucagccaccugaguagcugggauuacacgcacaugccaccacaccca

SEQ ID NO: 263427 - RNA, 64 nt, hsa
caggugauccucccgccucggccucccaaagugcugggauuacaggcaugagccaccgcgccug

SEQ ID NO: 263428 - RNA, 64 nt, hsa
caagcgauucuccugccucagccuccugaguagcugggauuacaggcaacugccaccaugcccg

SEQ ID NO: 263429 - RNA, 64 nt, hsa
caagugauccgcccgccucagccucccaaagugcugggauuacaggugugagccaccaggccca

SEQ ID NO: 263430 - RNA, 64 nt, hsa
caagugauucuugugccucagccucccaaguagcugggauuaaaggcacgugccaccaugacug

SEQ ID NO: 263431 - RNA, 64 nt, hsa
ugccuccuggguucacguaauccuccugaguagcugggauuacaggcgccugccaccacgcugg

SEQ ID NO: 263432 - RNA, 64 nt, hsa
caggugauccgcccaccucagccucccaaaauggugggauuacaggugugugggccaccgugcc

SEQ ID NO: 263433 - RNA, 64 nt, hsa
caagcaauucugcugcaucagccucccgaguaccugggauuacaggcaugugccaccacgcccg

SEQ ID NO: 263434 - RNA, 64 nt, hsa
cagaugauccaucugccuuggccucccacagugcugggauuacaggcgugagccaccaugcccg

SEQ ID NO: 263435 - RNA, 64 nt, hsa
caagcgauucuccuccuucagacucucgaauagcugggauuacaggcacgccucaccacgccca

SEQ ID NO: 263436 - RNA, 64 nt, hsa
caagugauccgccugccuuggccccccaaagugcugggauuacaggagugagccacugugccca

SEQ ID NO: 263437 - RNA, 64 nt, hsa
caagugauccacccaccucggucucccaaaguguugggauuacaggcgugagccacugcaccug

SEQ ID NO: 263438 - RNA, 64 nt, hsa
cuugggauccacccgccuuggccucccaaagugcugggauuacaggugugagccaccaugccug

SEQ ID NO: 263439 - RNA, 64 nt, hsa
caagcaauuugccugccucagccucccaaagugcugggauuacaggcgugagccacugcacagg

SEQ ID NO: 263440 - RNA, 64 nt, hsa
uaagcgauucuccugccucagcuucccgaguagcugggauuacaggcgugcgccaacaugucug

SEQ ID NO: 263441 - RNA, 64 nt, hsa
caggugauccacccaccucggccucccaaaguguugggauuacaggcgugagccaccgcacccg

SEQ ID NO: 263442 - RNA, 64 nt, hsa
caagugauucuccugccucagccucccgaguagcugggauuacaggcaugcuccaccaugccca

SEQ ID NO: 263443 - RNA, 64 nt, hsa
caggugauccgcccaccucggccucccaaacugcugggauuacaggcgugagccaccgcgccug

SEQ ID NO: 263444 - RNA, 64 nt, hsa
caagugauucuccugugucagccuccugaguagcugggauuacaggcgugugccaccaugccug

SEQ ID NO: 263445 - RNA, 64 nt, hsa
ccagugauccgccugccuugaccucccaaagugcugggauuacagacaugagccaccgagccug

SEQ ID NO: 263446 - RNA, 64 nt, hsa
cucgugauccgcccgccucagccuuccaaaguguugggauuauaggcgugagccaccgcgccca

SEQ ID NO: 263447 - RNA, 64 nt, hsa
caagcgauucuccugccucagccuccugaguagcugggauuacaggugugugccuccacacccg

SEQ ID NO: 263448 - RNA, 64 nt, hsa
caagccaucccccaaccuuggccucucgaguagaugggauuauaggcaugugccacggugccug

SEQ ID NO: 263449 - RNA, 64 nt, hsa
caagggauccuccugucuugggcucccaaaguguugggauuacaggcgugagugaccaugccua

SEQ ID NO: 263450 - RNA, 64 nt, hsa
caagugauucuccugccucagccucccgaguagcugggauuacaggcaugcgcuaacacaccca

SEQ ID NO: 263451 - RNA, 64 nt, hsa
ggucucgaacucccaccucagccucccaaacugcugggauuacaggugugagccaccgugacca

SEQ ID NO: 263452 - RNA, 64 nt, hsa
caagugauucuccugccucagccucccgaguagcugggauuacaggugugugccaccacacccg

SEQ ID NO: 263453 - RNA, 64 nt, hsa
caggugauucgcccaccucagccucccaaagugcugggauuacaggugugggccacugcaccug

SEQ ID NO: 263454 - RNA, 64 nt, hsa
uaggugauccacccgccucgaccucccaaagugcugggauuacaggcaugagccaccaugccca

SEQ ID NO: 263455 - RNA, 64 nt, hsa
uuugugauccacccgccucggccucccaaagugcugggauuacaggcaugagccaucacaccug

SEQ ID NO: 263456 - RNA, 64 nt, hsa
cauuuuggccggccuccucggccucccaaaguucugggauuacaggcaugagccacugugccca

SEQ ID NO: 263457 - RNA, 64 nt, hsa
caaguaauucuccugccucaggcuucugaguagcugggauuauaggugcgcaccaccacacccg

SEQ ID NO: 263458 - RNA, 64 nt, hsa
uaagcaauucuccugccucagccuccccaguagcugggauuacaggcaccuaccaccuugccca

SEQ ID NO: 263459 - RNA, 64 nt, hsa
aaauuauuuuauccugaaguaagcuguuuauauuugggauuauacugaaccuauuuguccaaua

SEQ ID NO: 263460 - RNA, 64 nt, hsa
gucgugauccacccgccucggccucccaaaaugcugggauuacaggugugagccacugugcccg

SEQ ID NO: 263461 - RNA, 64 nt, hsa
caagcaauccacccaccucugccucccaaagugcugggauuacaggcgugagccacugugccug

SEQ ID NO: 263462 - RNA, 64 nt, hsa
caagcaauccuccugccucggccucccaaagugcugggauuacagaugugagccaccgcaucca

SEQ ID NO: 263463 - RNA, 64 nt, hsa
gcagguugcauuuauuguaaugaaaaagaaagacugggauuaaucucuaaucaggugaguagac

SEQ ID NO: 263464 - RNA, 64 nt, hsa
caagugauccacccgccuuggccacccaaagugcugggauuacaggugugagacacugugccug

SEQ ID NO: 263465 - RNA, 64 nt, hsa
caagugguucuccugccucagccucccaaguagcugggauuauaggugugcgccaccacaccag

SEQ ID NO: 263466 - RNA, 64 nt, hsa
ucaagaaauccucccaccuugccucccaaagugcugggauuacaggugugagccaccacgcaug

SEQ ID NO: 263467 - RNA, 64 nt, hsa
caagugauucuugugccuuagccucccaaguagcugggauuacaggcgugcaccaccacgccca

SEQ ID NO: 263468 - RNA, 64 nt, hsa
cucgugauccacccgucucagccucccaaaguacugggauuacaggcgugagccaccaugccug

SEQ ID NO: 263469 - RNA, 64 nt, hsa
caagcaauucuccugccucagccuccugaguagcugggauuauaggcaugcaccaccacaccca

SEQ ID NO: 263470 - RNA, 64 nt, hsa
caggugauccacccaccucagccucccaaagugcugggauuacaggcaugagccauugcgcccg

SEQ ID NO: 263471 - RNA, 64 nt, hsa
caagugauucuccugcuucagcuucccgaguagcugggauuacaggcacacacuaccacgccug

SEQ ID NO: 263472 - RNA, 64 nt, hsa
caagugaucugcccgccuuggccucccaaagugcugggauuacaggcguaagccacuacaccug

SEQ ID NO: 263473 - RNA, 64 nt, hsa
caagugauucucaugccucagcguucugaguagcugggauuagaggcgugugccacuacacccg

SEQ ID NO: 263474 - RNA, 64 nt, hsa
caggugaucugcccaccuuggccucccaaagugcugggauuacaggcaugagccacugugccug

SEQ ID NO: 263475 - RNA, 64 nt, hsa
cauaaguguucuaguccacauauaaggguaggguugggauuaccauuuacugaccacaucugug

SEQ ID NO: 263476 - RNA, 64 nt, hsa
caaucgauucuccugccucacccucccauguagcugggauuacagcugccugccaaauuuuugu

SEQ ID NO: 263477 - RNA, 64 nt, hsa
ucaacugauccgcccaccuuggccucccaagugcugggauuacaggcgcgagccacggcgccca

SEQ ID NO: 263478 - RNA, 64 nt, hsa
caagcauuucuccugccucagccucccaaguagcugggauuacaggcagcaccacaccuggcua

SEQ ID NO: 263479 - RNA, 64 nt, hsa
caagugauccgcccuccccagccucccaaagugcugggauuacaggugugagccaccacagcca

SEQ ID NO: 263480 - RNA, 64 nt, hsa
uaagggauucuccugccucagccucccaaguagcugggauuacagacucaugccaccacgccag

SEQ ID NO: 263481 - RNA, 64 nt, hsa
ucaugaucugcccaccucggccuccccaaagugcugggauuacagguacaaugauguauaauua

SEQ ID NO: 263482 - RNA, 64 nt, hsa
caagcaauucuccugccucagccuccugaguagcugggauuacaggcaugaaccaccacaccug

SEQ ID NO: 263483 - RNA, 64 nt, hsa
cucgugaucugcccgccucagccucccaaagugcugggauuacaggcgugagccaccacaccug

SEQ ID NO: 263484 - RNA, 64 nt, hsa
caagugauucuccugccucagccucccgaguagcugggauuacaggcgugcacuaccacaccca

SEQ ID NO: 263485 - RNA, 64 nt, hsa
cucaugauccacccgccucagcuucccaaagugcugggauuacaggugugagucacugcaccca

SEQ ID NO: 263486 - RNA, 64 nt, hsa
caagcaauucuucugccucagccucccaaguagcugggauuacaggcacccgccaccacgccca

SEQ ID NO: 263487 - RNA, 64 nt, hsa
caagugaucugcccaccuuggccucccaaagugcugggauuacagguguaagccacugcgcccg

SEQ ID NO: 263488 - RNA, 64 nt, hsa
caagcaauucuucugccucagccucccaaguagcugggauuacaggugccugccaccaugccug

SEQ ID NO: 263489 - RNA, 64 nt, hsa
caagugauccaccugccucagccucccaaagugcugggauuauagucgugagccaccacgccug

SEQ ID NO: 263490 - RNA, 64 nt, hsa
caggugauccacccuccucagccucccaaagugcugggauuacaggcaugagccaccgcaccca

SEQ ID NO: 263491 - RNA, 64 nt, hsa
caggcgauucuccugccucagccuccugaguagcugggauuacaggcaugcaccaccacaccag

SEQ ID NO: 263492 - RNA, 64 nt, hsa
uugugauccaccccgccuuggccucccaaagugcugggauuacaggugugagccaccgugcccg

SEQ ID NO: 263493 - RNA, 64 nt, hsa
caagcaauucuccugccucagcuucccaaguagcugggauuacaggcacgugccaccacgccca

SEQ ID NO: 263494 - RNA, 64 nt, hsa
ucaagcaauuucuugccucagccucaugaauagcugggauuacaggugcccaccaccaugccug

SEQ ID NO: 263495 - RNA, 64 nt, hsa
cucgugauccaccugccucggcuucccaaagugcugggauuacaggcgugcaccacugagucca

SEQ ID NO: 263496 - RNA, 64 nt, hsa
aaagugauucuccugccucagccucucgaguagcugggauuacaggcaugcaccaccacaccca

SEQ ID NO: 263497 - RNA, 64 nt, hsa
caggugauccgcccaccuaggccucucaaaguguugggauuacguguguaagccacagugccca

SEQ ID NO: 263498 - RNA, 64 nt, hsa
caagcgauucuugugccucagcuucccaagcagcugggauuacaggugcccgccaccacgccca

SEQ ID NO: 263499 - RNA, 64 nt, hsa
cagguaauccgccugccuuggccucccaaagugcugggauuacagacaugaaccaccacgccug

SEQ ID NO: 263500 - RNA, 64 nt, hsa
cucaugauccacccgccucagccucccaaaguguugggauuacaggcgugagucaccgcgccca

SEQ ID NO: 263501 - RNA, 64 nt, hsa
caagcgauucuccugccucugccucccaaguagcugggauuacaggcacccaccaccaugccca

SEQ ID NO: 263502 - RNA, 64 nt, hsa
caagcaguucucuugccucagccuccuggguagcugggauuacaggcacgcgcugccacaccca

SEQ ID NO: 263503 - RNA, 64 nt, hsa
caagcgauucuccagccucagcuuccugaguagaugggauuacaggcgccugccaccacgccca

SEQ ID NO: 263504 - RNA, 64 nt, hsa
cucgugauucacccgccucggccucccaaagugcugggauuacaggcgugagucacagcccccg

SEQ ID NO: 263505 - RNA, 64 nt, hsa
ucaagcaauucccugccucagccucaugaauagcugggauuacaggugcccaccaccaugccug

SEQ ID NO: 263506 - RNA, 64 nt, hsa
ccugugauccaccugccuuggcuucccaaagugcugggauuacaggcgugcaccacugagucca

SEQ ID NO: 263507 - RNA, 64 nt, hsa
caagggauucuccugccucagccucccaaguagcugggauuacaggcaugcaccaccacgccca

SEQ ID NO: 263508 - RNA, 64 nt, hsa
caggugaucugcccaccucggccucccaaagugcugggauuacaggcgugagccacugcaccug

SEQ ID NO: 263509 - RNA, 64 nt, hsa
caggugauucuccugccucagccuccugaguagcugggauuacaagcacgugucaccacgccug

SEQ ID NO: 263510 - RNA, 64 nt, hsa
cucgugauccgccugccucagccucccaaagugcugggauuacaggcaugagccaccaugccug

SEQ ID NO: 263511 - RNA, 64 nt, hsa
caaaugauccaccugccucugcuucccaaagugcugggauuacaggcacgagccaccacaccug

SEQ ID NO: 263512 - RNA, 64 nt, hsa
caagugauccuccugccuuggccucccaaaaugcugggauuacaggcaugagccacugugccug

SEQ ID NO: 263513 - RNA, 64 nt, hsa
caagcaauucuccugccucagccucccaaguagcugggauuacaggugucugccaccaugccag

SEQ ID NO: 263514 - RNA, 64 nt, hsa
caggugauccacccgccucagccucccaaagugcugggauuacaggcaaaagccaacacacccg

SEQ ID NO: 263515 - RNA, 64 nt, hsa
caagcaauucuccugccucagccuccugaguagcugggauuauaggcacaugccaccgcgccca

SEQ ID NO: 263516 - RNA, 64 nt, hsa
cuugugaugcucccaccucggccucccaaagugcugggauuaaagcugugagccacugugccaa

SEQ ID NO: 263517 - RNA, 64 nt, hsa
cucaugauccucccgccucagccucccaaaaugcugggauuacaggcgugagccaccgcgccug

SEQ ID NO: 263518 - RNA, 64 nt, hsa
caagugauccaucugccuuggccucccaaagugcugggauuacaggcaugagccacugcaccug

SEQ ID NO: 263519 - RNA, 64 nt, hsa
caagggauucucgugccucagccuuccaaguagcugggauuacaggugugcgccaguacgccug

SEQ ID NO: 263520 - RNA, 64 nt, hsa
caagugauccacccacuucagcuucccaaagcacugggauuacaggugugagccacugugcccg

SEQ ID NO: 263521 - RNA, 64 nt, hsa
ccagcaauuaucccagcuugggcuccaaaagugcugggauuacaggcaugagucaccaugccug

SEQ ID NO: 263522 - RNA, 64 nt, hsa
caagcgauucuccugccucagccucccaauuuacugggauuacaggcaccugccaccacgccca

SEQ ID NO: 263523 - RNA, 64 nt, hsa
caagugauucaccugccucggccucccaaagugcugggauuacaggcgugagccacugcgcccg

SEQ ID NO: 263524 - RNA, 64 nt, hsa
caagcaagucuccugucucagccucccaaguagcugggauuacaggcaugugccaccaugccca

SEQ ID NO: 263525 - RNA, 64 nt, hsa
cagguuauccacccaccucagccucccaaagugcugggauuacaggugugagccaccgcagccg

SEQ ID NO: 263526 - RNA, 64 nt, hsa
cucgugauccacccgccuuggccucccaaagugcugggauuacaggcgugagccaccgugccug

SEQ ID NO: 263527 - RNA, 64 nt, hsa
caagugauccaccugccucgaccucccaaaguacugggauuacaggcgugagccacugugccca

SEQ ID NO: 263528 - RNA, 64 nt, hsa
ucaagugauucuccugccucagcccccaaguagcugggauuacaagugugcgccaccacaccca

SEQ ID NO: 263529 - RNA, 64 nt, hsa
cucaugauuugccugccucggccucccaaagcacugggauuacaggcgugagccaccacaucca

SEQ ID NO: 263530 - RNA, 64 nt, hsa
caagcgauucuccugccucagccuccugaguggcugggauuacaggcaugcaccaccaugccca

SEQ ID NO: 263531 - RNA, 64 nt, hsa
aggggacuuuggcacccaaggaguucugacuuucugggauuauaauaguaauucccagccauac

SEQ ID NO: 263532 - RNA, 64 nt, hsa
gaaaauuuucucuggauuguuuuaguaauauuuuugggauuauacuuccuuucuguaccaauuu

SEQ ID NO: 263533 - RNA, 64 nt, hsa
caagcacuucucguaccucagacucccgaauagcugggauuacagacaggcaccaccacaccca

SEQ ID NO: 263534 - RNA, 64 nt, hsa
caggugaucugccugccuuggcaucccaaagugcugggauuacaagaaugagccaccgugccug

SEQ ID NO: 263535 - RNA, 64 nt, hsa
ucagccaucugcgcccaggccacgugucccgaucugggauuagaaaauauggguccauuccuuu

SEQ ID NO: 263536 - RNA, 64 nt, hsa
ccagugauccucccgccucagccucccaaguagcugggauuauaggugugugccacugugccaa

SEQ ID NO: 263537 - RNA, 64 nt, hsa
caagcgaugcucccaccuccaccucccaaagugcugggauuacaggcgugagccaccauaccug

SEQ ID NO: 263538 - RNA, 64 nt, hsa
caagugauucuccugccucagccucccaaguagcugggauuacaggcgugcaccaccacgccgg

SEQ ID NO: 263539 - RNA, 64 nt, hsa
caggugauccgccagccucagccucccaaagugcugggauuacaggcgugagccacugcacccg

SEQ ID NO: 263540 - RNA, 64 nt, hsa
caagcgauucuccugccucagccugcugaguaguugggauuacaggcgcccaccaccaugccca

SEQ ID NO: 263541 - RNA, 64 nt, hsa
caagugauccaccugccuuagccucccaaagugcugggauuacaggcaugagccacugcaccug

SEQ ID NO: 263542 - RNA, 64 nt, hsa
caagugauucuccugccuuagccucccgaguagcugggauuauaggcacccaccaccacgccca

SEQ ID NO: 263543 - RNA, 64 nt, hsa
caggugguccacccgccucagccucccaaagugcugggauuacaggugugagccaccgcaccug

SEQ ID NO: 263544 - RNA, 64 nt, hsa
caggugauuauuuugccucagccucccaagcagcugggauuauagacacccgccaacacgccag

SEQ ID NO: 263545 - RNA, 64 nt, hsa
caggugauccgcccgccucggccucccaaagugcugggauuacagacgugagccaccacucccg

SEQ ID NO: 263546 - RNA, 64 nt, hsa
caggugaucuacccaccucggccucccaaagugcugggauuacaggcgugagccacugcaccug

SEQ ID NO: 263547 - RNA, 64 nt, hsa
caggugauucuccugccucagccuccugaguagcugggauuacaggugugcgccaccacgccca

SEQ ID NO: 263548 - RNA, 64 nt, hsa
cuugugaucugcccgccucggccucccaaagugcugggauuacaggcgugagccaccgcgcccg

SEQ ID NO: 263549 - RNA, 64 nt, hsa
cuggugauccgcccgccucggccucccaaaguauugggauuacccgcgugagccaccgcgcccg

SEQ ID NO: 263550 - RNA, 64 nt, hsa
caggugaucugcccaccucagccucccaaagugcugggauuacaggcgugagccaccacaccag

SEQ ID NO: 263551 - RNA, 64 nt, hsa
caagcaauucuguggcuucagccuccggaguagcugggauuacaggcacaugccaccacaccca

SEQ ID NO: 263552 - RNA, 64 nt, hsa
caagugaucugcccaccucaccaucccaaagugcugggauuacaggcgugagccauugugcccg

SEQ ID NO: 263553 - RNA, 64 nt, hsa
ugagugauucuccugcgucagccucccgaguagcugggauuacaggcaccugccacugcgccug

SEQ ID NO: 263554 - RNA, 64 nt, hsa
cagguaaucagcccgccucggccucccaaagugcugggauuacaggcgugagccacuuaguauu

SEQ ID NO: 263555 - RNA, 64 nt, hsa
cucaugauccaccugccucagccucccaaaaugcugggauuacaggcuugagccacugcucccg

SEQ ID NO: 263556 - RNA, 64 nt, hsa
caagcaauucuccugccucagccucccgaguagcugggauuacaggugcucaccaccacaccca

SEQ ID NO: 263557 - RNA, 64 nt, hsa
caggugguccuucugccuuggccucccaaagugcugggauuacaggcgugagccacugcgcccg

SEQ ID NO: 263558 - RNA, 64 nt, hsa
cucgugaucugcccgccucagccucccaaagugcugggauuacaggagugagccaccgcucccg

SEQ ID NO: 263559 - RNA, 64 nt, hsa
caagugauucuacugccucagccucccgaguagcugggauuauaggcgagugccaucaugcccg

SEQ ID NO: 263560 - RNA, 64 nt, hsa
cgugugauccgcccuccucagccucccaaagugcugggauuacaggcaugagccacagugcccg

SEQ ID NO: 263561 - RNA, 64 nt, hsa
caagcaauucuccugccucagccucccuaguagcugggauuacaggcaugugccacaccuggcu

SEQ ID NO: 263562 - RNA, 64 nt, hsa
caggugauaugcccgccucggccucccaaaauguugggauuacaggcaugagccacugcacccg

SEQ ID NO: 263563 - RNA, 64 nt, hsa
caagcaauucuccugccuccgccucccaaguagcugggauuacaggcaugcaccaccacaccug

SEQ ID NO: 263564 - RNA, 64 nt, hsa
caggugauccaccugccugggcuucccaaaguacugggauuauaggcuugagccaccacgcccg

SEQ ID NO: 263565 - RNA, 64 nt, hsa
ugagcaauucuccugccucagccucccaaauagcugggauuacaggugcaugccaccacaccca

SEQ ID NO: 263566 - RNA, 64 nt, hsa
cagaugauccgccugccuuggccucccaaagugcugggauuacaggugugggagccaccaugcc

SEQ ID NO: 263567 - RNA, 64 nt, hsa
caggugaucuaccugccucggccucccaaagugcugggauuacaggcgugagccaccacgccug

SEQ ID NO: 263568 - RNA, 64 nt, hsa
caagcgauucuccugacucagccucucaaguagcugggauuacaagcaugcgccaccaugccca

SEQ ID NO: 263569 - RNA, 64 nt, hsa
caagugauucuccugccucagccuccugaguagcugggauuacaggcacccgccaccacgccug

SEQ ID NO: 263570 - RNA, 64 nt, hsa
caauccguccacuugccuuggcuccccaaagugcugggauuacaggcgugagccaccaggcccu

SEQ ID NO: 263571 - RNA, 64 nt, hsa
cucgugauccacccgccuuggccucccaaagugcugggauuacaggcaugagccaccgcaccug

SEQ ID NO: 263572 - RNA, 64 nt, hsa
ucaagcaauucucugccucagccucccaaguaguugggauuacaggcaccugccaccaugccug

SEQ ID NO: 263573 - RNA, 64 nt, hsa
ccagggauucuccugccucacccuuucaaguagcugggauuacagguaccucuaccaugccugg

SEQ ID NO: 263574 - RNA, 64 nt, hsa
aaagugaucugcccaccucggccucccaaaguucugggauuacgggcgugagccacuucacccg

SEQ ID NO: 263575 - RNA, 64 nt, hsa
gggauccacagucccccuuggccucccaaaguguugggauuacaugcaugagccacugugcugg

SEQ ID NO: 263576 - RNA, 64 nt, hsa
ucaagcaacucucugccucagccucccgaguagcugggauuacaagcacccaccacuacacuca

SEQ ID NO: 263577 - RNA, 64 nt, hsa
cucaugauccacccgccucagccucccaaagugcugggauuacaggccccuuguucagccacug

SEQ ID NO: 263578 - RNA, 64 nt, hsa
caagugauccacucaccucggccucccaaagugcugggauuacaggugugagccaccaugccug

SEQ ID NO: 263579 - RNA, 64 nt, hsa
ucaagcgauuucgugccucagccucccgaguagcugggauuacaggcacccaccaccacgccca

SEQ ID NO: 263580 - RNA, 64 nt, hsa
caaaugaugugcccaacucggccucccaaagugcugggauuacaggcaugaaccgccaugccug

SEQ ID NO: 263581 - RNA, 64 nt, hsa
caagcgauucuccugucucagccuccugaguagcugggauuauagguacaugccaucacaccug

SEQ ID NO: 263582 - RNA, 64 nt, hsa
caggugauccacccgccucagccucccaaagugcugggauuacaggugggagccacaacacccg

SEQ ID NO: 263583 - RNA, 64 nt, hsa
uaggugauccgcccgccucagccucccaaaguguugggauuacaggcaugagccacugcgccug

SEQ ID NO: 263584 - RNA, 64 nt, hsa
caagugauucuccugccuuagccuccugaaaagcugggauuacagggcccugccaccaagccca

SEQ ID NO: 263585 - RNA, 64 nt, hsa
caggugauccaccugccucagccucccagacuguugggauuacaggcaugagccaccacgccug

SEQ ID NO: 263586 - RNA, 64 nt, hsa
aaggcucaggugacacuauggcuagauuaacaucugggauuaggacuggaaacacaugucauuu

SEQ ID NO: 263587 - RNA, 64 nt, hsa
uuaaacaugagcugagcauccauaagcauugaauugggauuaaauaaagauguugggcaggaac

SEQ ID NO: 263588 - RNA, 64 nt, hsa
caggugauccgcccgccucugccucccaaagugcugggauuacagguguaagccaucacaccug

SEQ ID NO: 263589 - RNA, 64 nt, hsa
caagugauucuccugccucagccucuugaguagcugggauuacaggcacaugcaccacgcccgg

SEQ ID NO: 263590 - RNA, 64 nt, hsa
caagugaucugccugccuuggccucccaaagugcugggauuacaggugucagccaccgcaccca

SEQ ID NO: 263591 - RNA, 64 nt, hsa
caagcgacucuccugccucagccuccugaguagcugggauuauaggcgucugccaccacgcccg

SEQ ID NO: 263592 - RNA, 64 nt, hsa
caggugauccacccaccucugccucccaaagugcugggauuacaggcaugagcuaccacaccug

SEQ ID NO: 263593 - RNA, 64 nt, hsa
caagagauucuccugccucagccuccccaguagcugggauuacaggcucaugccaccaugccca

SEQ ID NO: 263594 - RNA, 64 nt, hsa
gucucaaaaaaaaaaaaaauuaugaaaaaaguuaugggauuaaagaaagucaggauaaaaauuu

SEQ ID NO: 263595 - RNA, 64 nt, hsa
gcuggccacuaaauuaaaaaaaaauuaaaaguuaugggauuaaaaaaaguuaugggauaaaaaa

SEQ ID NO: 263596 - RNA, 64 nt, hsa
cucgugaucugcccgccucggccucccaaagugcugggauuacaggcgugagccaccgcgccca

SEQ ID NO: 263597 - RNA, 64 nt, hsa
caggugauucgccugccucggccuuucaaagugcugggauuacagacaugagccacugugcccg

SEQ ID NO: 263598 - RNA, 64 nt, hsa
caagcgauucuucugccucagccucccgaguagcugggauuaccggcacccaccaccacgccug

SEQ ID NO: 263599 - RNA, 64 nt, hsa
auacccgcccccccgccucagccucccaaagugcugggauuacaggcgugagccaccgugccug

SEQ ID NO: 263600 - RNA, 64 nt, hsa
caagcaauucuccugccucagccucccaaguagcugggauuacaggcacccgccaccacaccca

SEQ ID NO: 263601 - RNA, 64 nt, hsa
caggugauccaccugccucagccucccaaauugcugggauuacaggcgugagccaccuugccca

SEQ ID NO: 263602 - RNA, 64 nt, hsa
caagagauccccccaaccuuggccuccaaagugcugggauuacaggcaugagccaccgcgccug

SEQ ID NO: 263603 - RNA, 64 nt, hsa
caagccauccucccgcuuuggccuccuaaagugcugggauuacaugagccaccacaugcagcca

SEQ ID NO: 263604 - RNA, 64 nt, hsa
cucauauuccacccgccucggccucccaaagugcugggauuacaggcguuagccacugcgcccg

SEQ ID NO: 263605 - RNA, 64 nt, hsa
caagcaauuauccugccucagccucccgaguaggugggauuauaggagcgugccaccaugcccg

SEQ ID NO: 263606 - RNA, 64 nt, hsa
uaggugaucagcccgccucggccucccagagugcugggauuacaggcgugagccacuguggcca

SEQ ID NO: 263607 - RNA, 64 nt, hsa
caagcgauucuccugccucagccucucaaguagcugggauuacagggcaccugccaccacgccu

SEQ ID NO: 263608 - RNA, 64 nt, hsa
caggugauccgcccgccucagccucugaaauugcugggauuacaggcaugagccaccacaccca

SEQ ID NO: 263609 - RNA, 64 nt, hsa
caagcgauucuccagccucagccucccgaguagcugggauuacagacacccgccaccacgcccg

SEQ ID NO: 263610 - RNA, 64 nt, hsa
ccugugauccgcccgccucggccucccaaagugcugggauuacaggcaugagccacugcacccg

SEQ ID NO: 263611 - RNA, 64 nt, hsa
caggugauccgccugucucggccucccaaagugcugggauuaaaggugugauccaccaugcccg

SEQ ID NO: 263612 - RNA, 64 nt, hsa
caaacgauucugcugccucagccuccugaguagcugggauuacgggcgcgugccaccauguccg

SEQ ID NO: 263613 - RNA, 64 nt, hsa
cucaugaucuacccgccucggccucccaaagugcugggauuacaggcgugagccaccacgcccg

SEQ ID NO: 263614 - RNA, 64 nt, hsa
caggugauccaccugccucagccucccaaagugcugggauuacaggcaugagucaccgcaccca

SEQ ID NO: 263615 - RNA, 64 nt, hsa
caagcgauucuccugccucagccucccaaguagcugggauuacuggcgcccgccaccaugccug

SEQ ID NO: 263616 - RNA, 64 nt, hsa
caggugaucugccugccucagccucccaaaguucugggauuacaggcaugagccaccaugccca

SEQ ID NO: 263617 - RNA, 64 nt, hsa
caagugguucuccugccucagccucccuaguagcugggauuacaggugcacaccaccacaccug

SEQ ID NO: 263618 - RNA, 64 nt, hsa
caagcgaaccuccugccucagcaucccaaguagcugggauuacaggcacccaccaccaugccca

SEQ ID NO: 263619 - RNA, 64 nt, hsa
caagugauccacccgccucggucucccaaagugcugggauuacagaugugagccgccgcgccca

SEQ ID NO: 263620 - RNA, 64 nt, hsa
aggauucacaacuaaucacuauagcacaugaccuugggauuacauuuuuauggggcagggguaa

SEQ ID NO: 263621 - RNA, 64 nt, hsa
auugaugauuggucagugaggucaaaaggagccuugggauuaauaaacaugcacugagaagcaa

SEQ ID NO: 263622 - RNA, 64 nt, hsa
caagcgauucuuaugccucagucuccugagcagcugggauuacaggcaaacgccaccacaccca

SEQ ID NO: 263623 - RNA, 64 nt, hsa
cucgugauccaccugccucggccuuccaaagugcugggauuacaaguuugagccacugcaccug

SEQ ID NO: 263624 - RNA, 64 nt, hsa
caggugauccaccugccucagccucccaaagugcugggauuacaggcgugagccacugugccca

SEQ ID NO: 263625 - RNA, 64 nt, hsa
caagcaauucuccugccucagccucccgaguagcugggauuacaggcgaccgccaccacgccug

SEQ ID NO: 263626 - RNA, 64 nt, hsa
caagggauucuccugccucagccucuugaguagcugggauuacaggcgcccaccaccacagccu

SEQ ID NO: 263627 - RNA, 64 nt, hsa
gaagugauccgcccaccuuggccucccaaagcguugggauuauaggcaugagccaugugccugg

SEQ ID NO: 263628 - RNA, 64 nt, hsa
caagcgauucuccugccucagccuccugaguagcugggauuacaggugcaugccaccaggcccc

SEQ ID NO: 263629 - RNA, 64 nt, hsa
cucaugaucugcccgccucaaccucccaaagugcugggauuauaggcgugagccaccgccccca

SEQ ID NO: 263630 - RNA, 64 nt, hsa
gagagugugacagaggaucugccugugaaccaccugggauuagucaagucccaaggugcccaga

SEQ ID NO: 263631 - RNA, 64 nt, hsa
uuuagucauaagccaaguacaaucuaacucagaaugggauuaaaaauuuuagaagcagaagcua

SEQ ID NO: 263632 - RNA, 64 nt, hsa
caggugauccacccgccucggccucccaaagugcugggauuacaggcgugagccacggcgccca

SEQ ID NO: 263633 - RNA, 64 nt, hsa
caagcaauucuccugccucagccucccaaguagcugggauuacaggugcccaccaccaccccug

SEQ ID NO: 263634 - RNA, 64 nt, hsa
cuugugauccguccgccuuggccucccaaagugcugggauuacaggcgugagccaccgcgccug

SEQ ID NO: 263635 - RNA, 64 nt, hsa
gaucaagcaauucugacucagccucccaaguagcugggauuacaggcgcaggccaccaugcccg

SEQ ID NO: 263636 - RNA, 64 nt, hsa
caggugaucuacccuccucggccucccaaaguacugggauuacaggccugagccaccgcgcccg

SEQ ID NO: 263637 - RNA, 64 nt, hsa
caagcgauucuccucucucagccuccuggguagcugggauuacaggugcccaccaacaugccug

SEQ ID NO: 263638 - RNA, 64 nt, hsa
cagguacuccacccgccuuggucucucaaagugcugggauuacaggcauaagccacugugccca

SEQ ID NO: 263639 - RNA, 64 nt, hsa
caagcgauucuccugccucagcauccuaauuaguugggauuacaggcgcccaccaccaugcccg

SEQ ID NO: 263640 - RNA, 64 nt, hsa
caggugaucugcccaccuuggccuuaaaaagugcugggauuaaaggcgugagccaccaugccca

SEQ ID NO: 263641 - RNA, 64 nt, hsa
caagcgauucucuuaacucagccucuugaguagcugggauuacaggaacgcgccaccacgccca

SEQ ID NO: 263642 - RNA, 64 nt, hsa
cucgugauccacccgccucagccucccaaagugcugggauuacaggcuugagccaccgugccug

SEQ ID NO: 263643 - RNA, 64 nt, hsa
cucgugauccgcccaucuccaccucccgcagugcugggauuacaggcaugagccaccgcgccca

SEQ ID NO: 263644 - RNA, 64 nt, hsa
caagugaucugccugccccgaccucccaaagugcugggauuacaggcuugagccaccgugccag

SEQ ID NO: 263645 - RNA, 64 nt, hsa
uaaccucugccuccuggauucaaguguuaguagcugggauuacaaaagcauguggccccacgcc

SEQ ID NO: 263646 - RNA, 64 nt, hsa
caagcaaucugccagccucagccucucaaagugcugggauuacaggccugagcaacugugccug

SEQ ID NO: 263647 - RNA, 64 nt, hsa
caagcaauucucaugccucggccucuccaguagcugggauuacaggugugcaccaccacgccug

SEQ ID NO: 263648 - RNA, 64 nt, hsa
cuugugaucugcccgccucagccucccaaaguacugggauuauaggcaugagccaccacgccca

SEQ ID NO: 263649 - RNA, 64 nt, hsa
cucgugaaucgccccccucggucucccaaagugcugggauuacaggcgugagccaccaugcccg

SEQ ID NO: 263650 - RNA, 64 nt, hsa
caagggauucuccugccucagccucccaaguagcugggauuacaggcgccugccaccacgccca

SEQ ID NO: 263651 - RNA, 64 nt, hsa
gaggcgaucugcccaccucggccucccaaagugcugggauuacaggcgugagccaccgugcccg

SEQ ID NO: 263652 - RNA, 64 nt, hsa
caagcgauccuccugccucagucucccaaguagcugggauuacaggugugcaccaccacgccug

SEQ ID NO: 263653 - RNA, 64 nt, hsa
caggugauccacccgcguuggccucccaacgugcugggauuauaggcgugagccaccacgcccc

SEQ ID NO: 263654 - RNA, 64 nt, hsa
cacgccauucuccugccucagccucccgaguagcugggauuacgggcgcccgccaccacgcccg

SEQ ID NO: 263655 - RNA, 64 nt, hsa
cuugugauccacccaccucggccucccaaagugcugggauuacaggcgugagccacugcgcccg

SEQ ID NO: 263656 - RNA, 64 nt, hsa
caagcgauucuccugccucagccucccgaguaguugggauuacaggcgccugccuccaugccug

SEQ ID NO: 263657 - RNA, 64 nt, hsa
cucgugauccgccugccucgaccucccaaagugcugggauuacaggcaugagccaccaugccca

SEQ ID NO: 263658 - RNA, 64 nt, hsa
aaccuccaucuccugucucagccuccuagauaacugggauuacaggugcccaccaccaugcccg

SEQ ID NO: 263659 - RNA, 64 nt, hsa
cagguaauccacccaccuuggccucccaaagugcugggauuacaggcaugagccaccaucuuca

SEQ ID NO: 263660 - RNA, 64 nt, hsa
guucaagcgauucugccucgaccucucaaguagcugggauuacaagcaccagccaccaugccug

SEQ ID NO: 263661 - RNA, 64 nt, hsa
caggugauccacccgccuuggccucccaaagugcugggauuacaggcgcgagccaccgcgccca

SEQ ID NO: 263662 - RNA, 64 nt, hsa
caagcaauucuccugccucagccuccugaguagcugggauuacaggcguccgcuaccacaacug

SEQ ID NO: 263663 - RNA, 64 nt, hsa
ucaaaugauugccugccucagccucccaaagugcugggauuacagguguaagucacuguaccca

SEQ ID NO: 263664 - RNA, 64 nt, hsa
caggugauucuccugucucagccucccgaguaacugggauuacaggcaugcgccaccgugacca

SEQ ID NO: 263665 - RNA, 64 nt, hsa
caagugauccaccugccucggccucccuaagugcugggauuacaggcgugagccaccaugccug

SEQ ID NO: 263666 - RNA, 64 nt, hsa
ucaagugaucugccugccucggccucccaagugcugggauuacaggcgugagccacugcaccca

SEQ ID NO: 263667 - RNA, 64 nt, hsa
caagcaauucuccugccucagccucccaaguagcugggauuacagucaggcaccaccacacccg

SEQ ID NO: 263668 - RNA, 64 nt, hsa
uaagugaucugcccgccuuggccucccaaagugcugggauuacagaugugagccaccacaccug

SEQ ID NO: 263669 - RNA, 64 nt, hsa
cuagugauccacccuccucggccucccaaagugcugggauuacaggcaugagccaccacagcug

SEQ ID NO: 263670 - RNA, 64 nt, hsa
caagcgauucuccugccucagccuccuaaguaucugggauuacaggcaugugccaccacaccug

SEQ ID NO: 263671 - RNA, 64 nt, hsa
caagugaucuguccaccucggccucccagagugcugggauuacaggcgugagccacuguuccca

SEQ ID NO: 263672 - RNA, 64 nt, hsa
caagugacucuccugccucagccuccccaguagcugggauuacagaucugcaccaccaugccca

SEQ ID NO: 263673 - RNA, 64 nt, hsa
caagugauccucacgccuuggccucccaaagugcugggauuauaggcaugagccacugugcuug

SEQ ID NO: 263674 - RNA, 64 nt, hsa
caggugauccaccuuucucggccucccaaagugcugggauuacgggugugagccaccgugcccg

SEQ ID NO: 263675 - RNA, 64 nt, hsa
cuugugauccacccaccucggccucccagagugcugggauuacaggcaugagccaccacgcuug

SEQ ID NO: 263676 - RNA, 64 nt, hsa
caagcgauucuccugccuccgccuccugaguagcugggauuauaggcacgcaccaccacgccca

SEQ ID NO: 263677 - RNA, 64 nt, hsa
cuugugauccacccaccucagccucccaaagugcugggauuacaggcgugagucaccgggcagg

SEQ ID NO: 263678 - RNA, 64 nt, hsa
caagcaauucuccugccucagccucccgaguagcugggauuacaggcaugggccaccacaccca

SEQ ID NO: 263679 - RNA, 64 nt, hsa
caagcaauucuccuaccucagcuucccgaguagcugggauuauaggcacccaccaccacaccug

SEQ ID NO: 263680 - RNA, 64 nt, hsa
caagugaucugcccaucucagccucccaaagugcugggauuacagguaugagccacaacgccca

SEQ ID NO: 263681 - RNA, 64 nt, hsa
caagugauuauccugccuuagccuccugaguagcugggauuacaggcgcgugccaccacgccca

SEQ ID NO: 263682 - RNA, 64 nt, hsa
cucgugauccgccugccucggccucccaaagugcugggauuacaggugugagccaccgugccca

SEQ ID NO: 263683 - RNA, 64 nt, hsa
caagcaaucugccugucucagccucccaaagugcugggauuacaggcgugagccaccgccccca

SEQ ID NO: 263684 - RNA, 64 nt, hsa
caggcaacacuccugccucagccucccacguggcugggauuacaggugccugcccccauggcua

SEQ ID NO: 263685 - RNA, 64 nt, hsa
cagaugauccgcccacauuggccucccaaagugcugggauuacaggugugauccaccgcaccug

SEQ ID NO: 263686 - RNA, 64 nt, hsa
caagccauucuccugccucggccuccugaguagcugggauuacaguugccgccacacccggcuu

SEQ ID NO: 263687 - RNA, 64 nt, hsa
caagcaauucuccugucucagccucccaaguagcugggauuacaggugcgcaccaccaugccug

SEQ ID NO: 263688 - RNA, 64 nt, hsa
ucaaaugauccgcugucuuguccucccaaagugcugggauuauaggcgugagccaucgcgcccu

SEQ ID NO: 263689 - RNA, 64 nt, hsa
caagcgauuuuccugccucagccucccaaguagcugggauuacaggugcccaccaccaugccug

SEQ ID NO: 263690 - RNA, 64 nt, hsa
cuggugaucugcccaccucggccugccaaagugcugggauuacaggcuugagcuaccgcgcccg

SEQ ID NO: 263691 - RNA, 64 nt, hsa
caaguaauucuccugccucagccucccgaguggcugggauuagcggcaugcaccaccacgccca

SEQ ID NO: 263692 - RNA, 64 nt, hsa
caagcaauucuccugccucagccuucggaguggcugggauuacaggugugcgccaccaugcccg

SEQ ID NO: 263693 - RNA, 64 nt, hsa
caggugaucugcccacuuuggccucccaaagugcugggauuacaggcaugagccaucgcccagc

SEQ ID NO: 263694 - RNA, 64 nt, hsa
cagaugaucugcccgccucagccucccaaagugcugggauuacaggcaugagccaccacgccca

SEQ ID NO: 263695 - RNA, 64 nt, hsa
caagcgcuucuccagccucagccuccugaguagcugggauuacagguaugugccaccaugccug

SEQ ID NO: 263696 - RNA, 64 nt, hsa
cagguaauccgcccgccucggccucccaaaaugcugggauuagaggugugagccacugugccca

SEQ ID NO: 263697 - RNA, 64 nt, hsa
caagcgauccacccaccuaggccucccaaagugcugggauuacaggcaugaaucaccacaacua

SEQ ID NO: 263698 - RNA, 64 nt, hsa
caagcgauucuccugccucagcaucucgaguagcugggauuacaggcaugcaccaccacgccca

SEQ ID NO: 263699 - RNA, 64 nt, hsa
caggugauccgcccgccugggccucccaaagugcugggauuacaggcgugagccacugcuccug

SEQ ID NO: 263700 - RNA, 64 nt, hsa
uaagugauucuccugccucagccucccaaguagcugggauuacaggugugcaccaccaugcccg

SEQ ID NO: 263701 - RNA, 64 nt, hsa
cucgugauccgccugccucagccucccaaagugcugggauuacaggugugagccaccacgccug

SEQ ID NO: 263702 - RNA, 64 nt, hsa
caagcaauucucccaccucagccucccaaguagcugggauuacagacgugugccaccauaccug

SEQ ID NO: 263703 - RNA, 64 nt, hsa
caggugauccuccugccucggccucccaaagugcugggauuacaggcaugagccaccgugcuca

SEQ ID NO: 263704 - RNA, 64 nt, hsa
ucaagcaauucuccugccuugccuccugaguagcugggauuacaggcgugugucaccacgcucg

SEQ ID NO: 263705 - RNA, 64 nt, hsa
gucgugauccacccgccuuggccucccaaaguacugggauuacaggcgugagccacugugccug

SEQ ID NO: 263706 - RNA, 64 nt, hsa
caagcaauucuccugccucagccucucgaguagcugggauuacaggcauccgccaccaugcccg

SEQ ID NO: 263707 - RNA, 64 nt, hsa
caggugauccacccgccucggcuucccaaagugcugggauuacgggcgugagccaccgugcucg

SEQ ID NO: 263708 - RNA, 64 nt, hsa
caagcaauccucccacuucagccucccaagcaccugggauuacaagcaugagucacuacgccug

SEQ ID NO: 263709 - RNA, 64 nt, hsa
caaguuauccaccugccuuggcuucccaaaguccugggauuacaggugugagccaccacaucca

SEQ ID NO: 263710 - RNA, 64 nt, hsa
cucgugauccacccgccucagccucccaaagugcugggauuaacagguaugaaccaccgcgccc

SEQ ID NO: 263711 - RNA, 64 nt, hsa
cuugugacucacccgcaucggccucccaaagugcugggauuacaggcaugagccaccgcacccg

SEQ ID NO: 263712 - RNA, 64 nt, hsa
ccagcgauucuccugccucagccuccugaguagcugggauuacaggugccugccaucacgccug

SEQ ID NO: 263713 - RNA, 64 nt, hsa
cucgugauccacccgccucggccucccaaaauccugggauuacaggcgcgagccaccacacccg

SEQ ID NO: 263714 - RNA, 64 nt, hsa
caaacaauucuccugccucagccuccugaguagcugggauuacaggcacaugccaccacgcccg

SEQ ID NO: 263715 - RNA, 64 nt, hsa
caggugauccacucgccucggccucccaaagugcugggauuauaggcaugugccaccaugcccg

SEQ ID NO: 263716 - RNA, 64 nt, hsa
caagcaguucuccugccucagccucccaaguagcugggauuacaggcguccgccaccaugccca

SEQ ID NO: 263717 - RNA, 64 nt, hsa
cuugugauccgcaugccucagccucccaaagugcugggauuacaggcaugagccaccacggccc

SEQ ID NO: 263718 - RNA, 64 nt, hsa
caagcuguucuacugccucagccuccugaguagcugggauuacaggugugugccaccacgccug

SEQ ID NO: 263719 - RNA, 64 nt, hsa
ucccggauacuccugccucagccuccuggguagcugggauuacaagcacccaaccacgcccagc

SEQ ID NO: 263720 - RNA, 64 nt, hsa
caagugauccgcccacuucggucucccaaagugcugggauuacaggcaugagccacggcgccug

SEQ ID NO: 263721 - RNA, 64 nt, hsa
caggugauccacccaccucagccucccaaagugcugggauuacaagcgugagccacugcaccgg

SEQ ID NO: 263722 - RNA, 64 nt, hsa
caagugauucuccugccucagccucccaaagugcugggauuacaggugugaaccaccacaccca

SEQ ID NO: 263723 - RNA, 64 nt, hsa
caagcaauucuccugccucaggcuccugaguagcugggauuacaggcacgugacaccaggccca

SEQ ID NO: 263724 - RNA, 64 nt, hsa
cgcauaauccacccaccucggccucccaaagugcugggauuacaggcgugagccaccacaaccg

SEQ ID NO: 263725 - RNA, 64 nt, hsa
caaacgauccuacugccucauccuucggaguagcugggauuacaggcaggugccaccaugccug

SEQ ID NO: 263726 - RNA, 64 nt, hsa
ucuuuucaaguacugcuggaucauacucaccccuugggauuauggcuuagaagaagggggcugg

SEQ ID NO: 263727 - RNA, 64 nt, hsa
caagugagucucgugccucagccucccaaguagcugggauuacaggcacccgccaccgugcccg

SEQ ID NO: 263728 - RNA, 64 nt, hsa
caggugcuccaccugccuuggccucccaaagugcugggauuacaggcgugagccacugugccca

SEQ ID NO: 263729 - RNA, 64 nt, hsa
caagcaauccucccaccucagccuccuaaagcacugggauuacaggugugaaccaccguaccca

SEQ ID NO: 263730 - RNA, 64 nt, hsa
cgagcacuuuucaugccucagccuccugaguagcugggauuacaggcgugcaccacaacgccug

SEQ ID NO: 263731 - RNA, 64 nt, hsa
caggugauccaccugccucggccucccagagugcugggauuacaggcaugagccacugcaccug

SEQ ID NO: 263732 - RNA, 64 nt, hsa
caagugauucuccugccucagccucccaaguagcugggauuacuggugcacaccaccacacuca

SEQ ID NO: 263733 - RNA, 64 nt, hsa
uaagugagccucccgccucagucucccaaagcgcugggauuacaggcaggagccacugagccca

SEQ ID NO: 263734 - RNA, 64 nt, hsa
caagugauucucuugccucagccuccugaguagcugggauuacagguuccugcuaccacgccca

SEQ ID NO: 263735 - RNA, 64 nt, hsa
cagguaauccgcccaccucagccucccaaagugcugggauuacaggcgugagccacagugccug

SEQ ID NO: 263736 - RNA, 64 nt, hsa
caagcgauucucccaccccagccucccaaguagcugggauuacaggugugugccacuacggcug

SEQ ID NO: 263737 - RNA, 64 nt, hsa
caagcgauccuccuggcucagccucccaaagugcugggauuacaggcgugagucacugcgccug

SEQ ID NO: 263738 - RNA, 64 nt, hsa
caagagauucuccugccucagccuccgaaguagcugggauuacaggcgcccgccaccaugcccg

SEQ ID NO: 263739 - RNA, 64 nt, hsa
caggugauccacccgccucagccucccaaagugcugggauuacaggcaugagccacugugcccg

SEQ ID NO: 263740 - RNA, 64 nt, hsa
caagcgauucuccugccucagccuccugagcagcugggauuacaggugcgugccaccacaccag

SEQ ID NO: 263741 - RNA, 64 nt, hsa
gaagugauucucuugccucagccucccgaguagcugggauuacaggugcccaccaccgcgccca

SEQ ID NO: 263742 - RNA, 64 nt, hsa
caagugaucugcccaccuuggccucccuaagugcugggauuauaggcgugagccaccaugcuca

SEQ ID NO: 263743 - RNA, 64 nt, hsa
cuugugauccacccaccucagccucccaaagugcugggauuacaggcaugagccaccacaccca

SEQ ID NO: 263744 - RNA, 64 nt, hsa
aaagugaucugcccgccuuggccucccaaagugcugggauuacagacaugagccaccacgcuug

SEQ ID NO: 263745 - RNA, 64 nt, hsa
caagcgauucucaugccuuagccucccaaguagcugggauuacaggugugugccgcaaugccca

SEQ ID NO: 263746 - RNA, 64 nt, hsa
cacgugaucuguccacuucagccguccaaagugcugggauuacaagcgugagccacugugcugg

SEQ ID NO: 263747 - RNA, 64 nt, hsa
caagugaucugcccgccucggccucccaaagugcugggauuacaggugugagccaccgcaccca

SEQ ID NO: 263748 - RNA, 64 nt, hsa
caagcgauucucucaccucagccuccugaguaggugggauuacagaugcccgccaccacaccca

SEQ ID NO: 263749 - RNA, 64 nt, hsa
caggugauccacccgccucggccucccaaagugcugggauuacaggcgugagccgccgugcccg

SEQ ID NO: 263750 - RNA, 64 nt, hsa
caagugauucuccugccucagccucccgaguagcugggauuacaggcacccgccaccguaccug

SEQ ID NO: 263751 - RNA, 64 nt, hsa
caggugaucugcccgccuuggccucccaaagugcugggauuacaggugugagccgcugcgcucg

SEQ ID NO: 263752 - RNA, 64 nt, hsa
caggugauccgcccaccucggccucccaaagugcugggauuacaggugugagccuccacaccug

SEQ ID NO: 263753 - RNA, 64 nt, hsa
ccagcaauucuccugccucggcuucccaaguagcugggauuacaggcacgugccaccaugucug

SEQ ID NO: 263754 - RNA, 64 nt, hsa
cucgugaugcacccaccucggccucccaaagugcugggauuacaugcgugagccacugcgcccu

SEQ ID NO: 263755 - RNA, 64 nt, hsa
caagcaauucuccugccucagccucccgaguagcugggauuacaggugccugccaccacaccca

SEQ ID NO: 263756 - RNA, 64 nt, hsa
cagguaauccaccugcuucggccucccaaagugcugggauuacaggcgcaagccacccagccca

SEQ ID NO: 263757 - RNA, 64 nt, hsa
caagcaauuauccugccucaggcucccaaguagcugggauuacaggcaugugcaacucacccag

SEQ ID NO: 263758 - RNA, 64 nt, hsa
caagugauucuccugccucagccucccuaguagcugggauuacaggcaugcaccaccauaccca

SEQ ID NO: 263759 - RNA, 64 nt, hsa
caggugauccgcccaccuuggccucccaaagugcugggauuacacgcgugagccaccaugcccg

SEQ ID NO: 263760 - RNA, 64 nt, hsa
caagugauucucauggcucagccgccugaguagcugggauuacaggugugagccaacaagcccg

SEQ ID NO: 263761 - RNA, 64 nt, hsa
uccugaauccgccugccucggccucccaaagugcugggauuacaggugugagcugccgcaccca

SEQ ID NO: 263762 - RNA, 64 nt, hsa
caagcgauucuugugccuaagccaccugagcagcugggauuacaggugcaugccaccaugccug

SEQ ID NO: 263763 - RNA, 64 nt, hsa
gaaacaauccucccgccuuggccucccaaagugcugggauuauaggcacaagacaccacaauaa

SEQ ID NO: 263764 - RNA, 64 nt, hsa
cuuccuaaaaggaagacuucauuuucucaagaaaugggauuaguuggggguauuauaauaccaa

SEQ ID NO: 263765 - RNA, 64 nt, hsa
aacauaauuaaucccuuuaacaaaaagccgucuaugggauuaaaagacacgugaaaugauacuu

SEQ ID NO: 263766 - RNA, 64 nt, hsa
caggugauccaccugccucggccucccaaagugcugggauuacaggcgugagccacugcgcccg

SEQ ID NO: 263767 - RNA, 64 nt, hsa
caagugauucuccugccucagccuccugaguagcugggauuacaggcacccaccaccacaccug

SEQ ID NO: 263768 - RNA, 64 nt, hsa
cuggugaucugcccaccugggccucccaaaaugcugggauuacaggcaugagccaccacaccug

SEQ ID NO: 263769 - RNA, 64 nt, hsa
caagugauucuccuacgucagccuccugaauagcugggauuacaggugcacgccaccaugcuug

SEQ ID NO: 263770 - RNA, 64 nt, hsa
caagugauuguccugucucagccucccaaguagcugggauuacaggcacccaccaccacaucca

SEQ ID NO: 263771 - RNA, 64 nt, hsa
caggugauccacccgccucggccucccaaagugcugggauuacaggcccgguccaguuugauag

SEQ ID NO: 263772 - RNA, 64 nt, hsa
caagugauccucccaccucagccuccugaguagcugggauuacaggcacccgccaccacgucca

SEQ ID NO: 263773 - RNA, 64 nt, hsa
caggugauccgcuggccucggccucccagagugcugggauuauaggcgugagccucuggcccgg

SEQ ID NO: 263774 - RNA, 64 nt, hsa
caagcaacucuccugccucagccucccuaguagcugggauuacaggcaugcacuaccacgcuug

SEQ ID NO: 263775 - RNA, 64 nt, hsa
caagugauucacccaccuuagccucccaaagugcugggauuacaggcgugagucaccgugccca

SEQ ID NO: 263776 - RNA, 64 nt, hsa
ucaagagauucuccagucucagcucccaaguagcugggauuacaggcauguacuaccaugccug

SEQ ID NO: 263777 - RNA, 64 nt, hsa
aaagugauucucucagcucagucucccagguagcugggauuacaggcaugugccaccacacccc

SEQ ID NO: 263778 - RNA, 64 nt, hsa
gaucuguccgccccggccucccagagugcuggguugggauuacaggcgugagccaccgcguccg

SEQ ID NO: 263779 - RNA, 64 nt, hsa
gugacccgauaggaggcaaaagaaaugagacuucugggauuaguuuagccucagauucugcagc

SEQ ID NO: 263780 - RNA, 64 nt, hsa
cucaugauccgccuuccucggccucccaaagugcugggauuacagguguuagccacugcgcccg

SEQ ID NO: 263781 - RNA, 64 nt, hsa
caagugauauguucaccucagccucccaaagugcugggauuacaggcaugaaccauggugccca

SEQ ID NO: 263782 - RNA, 64 nt, hsa
caagcaauucuccugccucagccucccaaguagcugggauuacaggcguguaccaccauaccca

SEQ ID NO: 263783 - RNA, 64 nt, hsa
auuaaaguguuuauguuaagaagauugggccaggugggauuacaggcgcgagccaccgcgcccg

SEQ ID NO: 263784 - RNA, 64 nt, hsa
caagcgauucuccugccucagcuucccgaguagcugggauuacagguaugaaccacuaugcccg

SEQ ID NO: 263785 - RNA, 64 nt, hsa
cuugugauccaccagccucagccucccaaagugcugggauuacaggcgugagccacugugcccg

SEQ ID NO: 263786 - RNA, 64 nt, hsa
caggugauccgccuaccuuggccuccaaaagugcugggauuacaggcaugagcuacugcacccg

SEQ ID NO: 263787 - RNA, 64 nt, hsa
caagugauucuccugcuucagccucccaaguagcugggauuacaggugugcgccaccacgccca

SEQ ID NO: 263788 - RNA, 64 nt, hsa
cucgugauucgcccgccgcguccucccaaagugcugggauuacaggccugagccaccgcgccca

SEQ ID NO: 263789 - RNA, 64 nt, hsa
agaugaucugcccgccucggccucccaaaauugcugggauuacaggugugagccaccgcgccug

SEQ ID NO: 263790 - RNA, 64 nt, hsa
uuggugauccaccugccuuggccucccaaagugcugggauuacaggccugagccaccguaucug

SEQ ID NO: 263791 - RNA, 64 nt, hsa
guuccagugauucuccugccucacccucaguagcugggauuauuggcaugcaccacaaaccuua

SEQ ID NO: 263792 - RNA, 64 nt, hsa
uuugugaucugcccgccuuggccucccaaagugcugggauuacaggugugagucaccgcgccug

SEQ ID NO: 263793 - RNA, 64 nt, hsa
caagcgauucuccugccucagccuccaaaguagcugggauuacaggcaugcgccaccacaccca

SEQ ID NO: 263794 - RNA, 64 nt, hsa
uugugauccacccaccucggucuccccaaagugcugggauuacaggcgugagccacucugccug

SEQ ID NO: 263795 - RNA, 64 nt, hsa
cucgugauccgcccuccucggccucccaaagugcugggauuauaggcgugagccaccgcgcccg

SEQ ID NO: 263796 - RNA, 64 nt, hsa
cagguaauccaccugccuuggccucccaaagugcugggauuacaggcgugagccaccacacccg

SEQ ID NO: 263797 - RNA, 64 nt, hsa
caagcaauucuucugccucagccuuccaaguagcugggauuacaagugcccaccaccaugccca

SEQ ID NO: 263798 - RNA, 64 nt, hsa
caggugaucugccugccucggccucccaaagugcugggauuacaggugugagccacagcaccca

SEQ ID NO: 263799 - RNA, 64 nt, hsa
caagcaauucuccugccgcagccucccaagaagcugggauuacaggcaugcgccaccacgccug

SEQ ID NO: 263800 - RNA, 64 nt, hsa
caggugauccacccaccucagccucucaaagugcugggauuacaggugugagccacuguggccg

SEQ ID NO: 263801 - RNA, 64 nt, hsa
caagugauccaccugccuuggccucccaaaguguugggauuauaggcgugagccaccaugccca

SEQ ID NO: 263802 - RNA, 64 nt, hsa
caagcgaucugcccgccucggccuccugaagugcugggauuacaggcguggccacugcgcccag

SEQ ID NO: 263803 - RNA, 64 nt, hsa
caagugauucuccugccucagccuccugaguagcugggauuacagcacccgccaccaugccgag

SEQ ID NO: 263804 - RNA, 64 nt, hsa
caagcaauuauccugccucagccucccaaguagcugggauuacaggcaccugccaccacaucug

SEQ ID NO: 263805 - RNA, 64 nt, hsa
uaaaugauuugccugccucggcuucccaaaguucugggauuacaggcaugagccaccgugccca

SEQ ID NO: 263806 - RNA, 64 nt, hsa
cacgcaauucuccugccucagccuccuaaguagcugggauuacaggcacccaccaccaugccca

SEQ ID NO: 263807 - RNA, 64 nt, hsa
caggugauccgcccaccuuggccucccgaagugcugggauuacaggcgugagccaccgugcccg

SEQ ID NO: 263808 - RNA, 64 nt, hsa
caagugguucuccugccucagccucuugaguagcugggauuacaggcaugcgccaccaugcccg

SEQ ID NO: 263809 - RNA, 64 nt, hsa
cuugugaucccccugccucggccucccaaagugcugggauuacaggcaugagccaccacgccug

SEQ ID NO: 263810 - RNA, 64 nt, hsa
caagcgauuccccugccucagccugccaaguagcugggauuacaggcaugcgccaccaugccca

SEQ ID NO: 263811 - RNA, 64 nt, hsa
caggugauccacccgccucagccucccaaagugcugggauuacaggcaugagccaccgcaccca

SEQ ID NO: 263812 - RNA, 64 nt, hsa
ucaggcuauucuccugcucagccuccugauuagcugggauuacaggcaugcgccaccaugaccg

SEQ ID NO: 263813 - RNA, 64 nt, hsa
caggugauccaccugccuuggccucccaaggugcugggauuacaggcgugagccaccaugcccg

SEQ ID NO: 263814 - RNA, 64 nt, hsa
caagccauucuccucccucagacuuccgaguggcugggauuacaggcgcccgccaccacaccag

SEQ ID NO: 263815 - RNA, 64 nt, hsa
cucaugauccacccgccucggccuuccaaagugcugggauuacaggcaugagccaccgugccug

SEQ ID NO: 263816 - RNA, 64 nt, hsa
caagugauccacccaccucagccucccaaagugcugggauuacaggccacuacaccuggcacau

SEQ ID NO: 263817 - RNA, 64 nt, hsa
caagcgauuauugugccucagccuccagaguagcugggauuacaggcaugcaccaccacagccc

SEQ ID NO: 263818 - RNA, 64 nt, hsa
cucgugaucugcccaccucggccucccacagugcugggauuaccggcgugagccaccaugccug

SEQ ID NO: 263819 - RNA, 64 nt, hsa
cuugucauccaccugucuuggccucccaaagugcugggauuacuggcaugagccacugugccca

SEQ ID NO: 263820 - RNA, 64 nt, hsa
caggcaaucugcccaccucagccucccaaagugcugggauuacaggcgugagccacugcacccg

SEQ ID NO: 263821 - RNA, 64 nt, hsa
caagugauucuccugccucagccucccgaguagcugggauuacaggcaugcaccaccacgccca

SEQ ID NO: 263822 - RNA, 64 nt, hsa
caagugauccacccgccucagccucccaaagugcugggauuacaggggugagccaccacgccca

SEQ ID NO: 263823 - RNA, 64 nt, hsa
caagugauccucccgccucagccucccaaaguguugggauuacaggugugagccacagcaccug

SEQ ID NO: 263824 - RNA, 64 nt, hsa
caagcacuuuuccugucucagccuuccgaguagcugggauuacaggugugugccaucaugccug

SEQ ID NO: 263825 - RNA, 64 nt, hsa
uaagcgauucucaugccucauccucccaaguaggugggauuacaggugcccaccaccaagcccu

SEQ ID NO: 263826 - RNA, 64 nt, hsa
caggugauccaccugccucggccucccaaagugcugggauuacaggugugagccaccacgcccu

SEQ ID NO: 263827 - RNA, 64 nt, hsa
accuccgccucccggguucaagcgauucuucugcugggauuacagcauaugccaccaugcccag

SEQ ID NO: 263828 - RNA, 64 nt, hsa
caggugauccacccgccucagccucccacacugcugggauuacaggcaugagccaccgcuccug

SEQ ID NO: 263829 - RNA, 64 nt, hsa
cuugugauccacccgccucggccucccaaagugcugggauuacaggcgugagccaccuugccug

SEQ ID NO: 263830 - RNA, 64 nt, hsa
caagcgauucuccugccucagccuccugaguagcugggauuacaggcgcacgccaccacgccug

SEQ ID NO: 263831 - RNA, 64 nt, hsa
cucgugauccgccugccucgacuucccagagugcugggauuacaggcgugagccaccacacccu

SEQ ID NO: 263832 - RNA, 64 nt, hsa
aguacaucagaacucaugccaacagucuuuaugaugggauuaagguggacaagaucuccuaaga

SEQ ID NO: 263833 - RNA, 64 nt, hsa
auuaagguggacaagaucuccuaagaucugugaaugggauuaagguggacaagaucuccuaaga

SEQ ID NO: 263834 - RNA, 64 nt, hsa
caagcgauucuccugccucagccucccaaguagcugggauuacaggcacgcgccaccacaccug

SEQ ID NO: 263835 - RNA, 64 nt, hsa
caaguagucugccugccucaaccucccaaagugcugggauuacaggcgugagccacugcgccug

SEQ ID NO: 263836 - RNA, 64 nt, hsa
caggugauccaccugucuuggccucccaaagugcugggauuacaggcaugagccaccaugccua

SEQ ID NO: 263837 - RNA, 64 nt, hsa
caagugauucuccugccucagccuccugaguagcugggauuacaggcauguaccaccacaccca

SEQ ID NO: 263838 - RNA, 64 nt, hsa
caggugauccacccaccuuggccucccaaagugcugggauuacaggugugagccacggcaccca

SEQ ID NO: 263839 - RNA, 64 nt, hsa
caaacaauucuccugccucagccuccagaauagcugggauuacaggcguacaccaccaugccug

SEQ ID NO: 263840 - RNA, 64 nt, hsa
ugauucuccugccucagccucccucgcaaguagcugggauuacaggcgccugccaccaugccua

SEQ ID NO: 263841 - RNA, 64 nt, hsa
caagugaucugcccuccucagccucguaaagugcugggauuacaggggugagccgcugugccug

SEQ ID NO: 263842 - RNA, 64 nt, hsa
caagugauucuccugucucagccucccaaguagcugggauuacaggcaugagcuaccacgccug

SEQ ID NO: 263843 - RNA, 64 nt, hsa
caggugauccacccgccuuggccucccaaagugcugggauuacaggcgugagccacugagcccg

SEQ ID NO: 263844 - RNA, 64 nt, hsa
caagugauucucccaccucagccucccaaguaggugggauuacagguacucaccaccaggucca

SEQ ID NO: 263845 - RNA, 64 nt, hsa
cagauggucugcccaccuccgccucccaaagugcugggauuacaggcgugagccacugcgcccg

SEQ ID NO: 263846 - RNA, 64 nt, hsa
caagcaauucuccuuccuuagccuccugaguagcugggauuacaggcaugcgccaccacacccg

SEQ ID NO: 263847 - RNA, 64 nt, hsa
caggugaucugccugccucagccucccaaagugcugggauuacaggugugagccaccgcgcccg

SEQ ID NO: 263848 - RNA, 64 nt, hsa
cucgugacccacccgccuuggccucccaaagugcugggauuacaggugugagccaccacaccca

SEQ ID NO: 263849 - RNA, 64 nt, hsa
caagcgacucuccugccucagccucccgaguaguugggauuacaggugacugccaccgugcccg

SEQ ID NO: 263850 - RNA, 64 nt, hsa
caggugauccacccaccuuggccucccagcgugcugggauuauaggcaugagccaccaggccgg

SEQ ID NO: 263851 - RNA, 64 nt, hsa; identical to SEQ ID NO: 263834

SEQ ID NO: 263852 - RNA, 64 nt, hsa
gaagcgauucuccugccucagccucccaaguagcugggauuacaggcaugcaccaccaugccug

SEQ ID NO: 263853 - RNA, 64 nt, hsa
caggugaccugcccaccucggccucccgaagugcugggauuacaagggugagccaccaugcccg

SEQ ID NO: 263854 - RNA, 64 nt, hsa
cucgugaucugcccgccucggccucccaaagugcugggauuacaggccugagccaccgcguccg

SEQ ID NO: 263855 - RNA, 64 nt, hsa
cucgugguccacccgccucggccucccaaagcacugggauuacaggcgugagccacccggccug

SEQ ID NO: 263856 - RNA, 64 nt, hsa
aagcggauucucgugccucagccuccugaguagcugggauuacaggcaugcaccaccaugcccg

SEQ ID NO: 263857 - RNA, 64 nt, hsa
caagugauccuccugccgcagucucccgaagugcugggauuacugacaugagccaccacacuca

SEQ ID NO: 263858 - RNA, 64 nt, hsa
caggugacccacccgccucggccucucaaaaugcugggauuacaggugugagccaccgugccug

SEQ ID NO: 263859 - RNA, 64 nt, hsa
caagcgauucuucugccucagccucccuaguggcugggauuacaggcgccugcuaccaugccug

SEQ ID NO: 263860 - RNA, 64 nt, hsa
caagugauccacucgcuucggccucccaaagugcugggauuauaggcgugagccacugugccca

SEQ ID NO: 263861 - RNA, 64 nt, hsa
caagcgguucuccugccucagccucccgaguagcugggauuaugggcgcccgccaccacgccca

SEQ ID NO: 263862 - RNA, 64 nt, hsa
caaaagauccacccaccucggccucccaaagugcugggauuauaggcaugaaccaccguguccg

SEQ ID NO: 263863 - RNA, 64 nt, hsa
caagugauucuccagccucagccuccugaguagcugggauuacaggcacacaccaccaugccca

SEQ ID NO: 263864 - RNA, 64 nt, hsa
caagugauccgccugccucagccucccacagugcugggauuacaggcgugagccaccgcacccg

SEQ ID NO: 263865 - RNA, 64 nt, hsa
caagcaauucuccugccucagccucccaaagugcugggauuacaggugugagccaccgugcccg

SEQ ID NO: 263866 - RNA, 64 nt, hsa
caagcaauucuccuucuucagccucccgaguagcugggauuacaggcaugcaccaccacaccug

SEQ ID NO: 263867 - RNA, 64 nt, hsa
ccugaccucgugauccacccaccucaggaagugcugggauuacaggcgugugagccaccacgcc

SEQ ID NO: 263868 - RNA, 64 nt, hsa
cucgugaucugcccgccuuggccucccaaaguacugggauuacaggcgugagccaccgugccca

SEQ ID NO: 263869 - RNA, 64 nt, hsa
caggugauccaccugccucggccucccaaagugcugggauuacaggcuugagcccccgcgccca

SEQ ID NO: 263870 - RNA, 64 nt, hsa
caagcgauucuccugccucagccucccaaguagcugggauuacaggcaccugccaccaugcccg

SEQ ID NO: 263871 - RNA, 64 nt, hsa
auaucuauuauguagauaaauauauauaguggccuuucaggacugucacaguaacacuuuauuu

SEQ ID NO: 263872 - RNA, 64 nt, hsa
cacuuuauuuacagagcuaauguuuguccuaaauuuucaggacccuagaggagagcuuuauaca

SEQ ID NO: 263873 - RNA, 64 nt, hsa
acccugaagcuuuuguuuugaauuaagaaaugaguuucaggaauugacaaaccauuuguuaacc

SEQ ID NO: 263874 - RNA, 64 nt, hsa
ccaaguaauuuaaaaguaauauguuaccuaugucuuucaggaaaaauaauuauagcagcugauc

SEQ ID NO: 263875 - RNA, 64 nt, hsa
accauguauguuucauuucugguuuaaccaggcuuuucaggaugggacuucagaccaaggacac

SEQ ID NO: 263876 - RNA, 64 nt, hsa
acacuuugucagaacccuuaaaggugggugacguuuucaggaggaaccugggauguccugaugc

SEQ ID NO: 263877 - RNA, 64 nt, hsa
uaacacaguugggguugggucaauaguuucccaauuucaggauauuucgaugucagaaauaacg

SEQ ID NO: 263878 - RNA, 64 nt, hsa
aaaaaaaaaccaaaaaaacuguccagcuguggacuuucaggauucaggacugcuggggaucaag

SEQ ID NO: 263879 - RNA, 64 nt, hsa
ccgaaguagagcaauguguuuccucucauuguaguuucaggacuuugucaguacaagcucugcc

SEQ ID NO: 263880 - RNA, 64 nt, hsa
uucuucaaugcugcugcugugugaagccauacuuuuucaggauucuuccccuaauuggcucuuu

SEQ ID NO: 263881 - RNA, 64 nt, hsa
uagauaauucugaaauaauuuggauucuuucauuuuucaggauuugagcucaucaauuauguua

SEQ ID NO: 263882 - RNA, 64 nt, hsa
auggaagacaauuuuuccguggaugggggaaugguuucaggaugaacuguuccaccucagauca

SEQ ID NO: 263883 - RNA, 64 nt, hsa
acuuaucccaagagaaugaaauugcugaaagaucuuucaggacucuaccucauaucaguuugcu

SEQ ID NO: 263884 - RNA, 64 nt, hsa
agaaaaagcaauaaccucaaagugacuauucaguuuucaggaugauacacuaugaagauguuuc

SEQ ID NO: 263885 - RNA, 64 nt, hsa
cuuccaggagaacugauucuguggauggaugugauuucaggagauugugcagugccagcaucag

SEQ ID NO: 263886 - RNA, 64 nt, hsa
uccucagcucugugacuugugacccuauuugaaguuucaggauuugggugucacaaaggauugu

SEQ ID NO: 263887 - RNA, 64 nt, hsa
aaagcaugucucaauaguaaaagauaacaagaucuuucaggaaagacggauugcauuagaaaua

SEQ ID NO: 263888 - RNA, 64 nt, hsa
uucccauuuuggaaguuuucaggacuuggucugauuucaggauacucugucagaugggaagaca

SEQ ID NO: 263889 - RNA, 64 nt, hsa
gugcauuuucccagauacuucccauuuuggaaguuuucaggacuuggucugauuucaggauacu

SEQ ID NO: 263890 - RNA, 64 nt, hsa
ggaaaaggaauaggaaggagaaauuaauugagauuuucaggacacagacauaugaugugaaugc

SEQ ID NO: 263891 - RNA, 64 nt, hsa
ucuucucuugcuugguguaacuaaucacuguuaauuucaggaaacagaacucauuaaaacuccu

SEQ ID NO: 263892 - RNA, 64 nt, hsa
agaauagagguaucaucaaacguggcaaauuuucuuucaggaauaauaaagagcaugauuccac

SEQ ID NO: 263893 - RNA, 64 nt, hsa
ggcagaaugacaauaagguuuucccccauuuugguuucaggaggacaugaauaguguguuuauu

SEQ ID NO: 263894 - RNA, 64 nt, hsa
aagugaggacaaacugcuaggcuguaucccauaauuucaggaugagaaacauuaacaauaaaaa

SEQ ID NO: 263895 - RNA, 64 nt, hsa
aggauucaggaucuacccagcaccaaagauguauuuucaggagaacagaccuagaaaugggccu

SEQ ID NO: 263896 - RNA, 64 nt, hsa
aguagucaagaaaagggaucugagaaaaguacucuuucaggagggacuagaaagagaagggggu

SEQ ID NO: 263897 - RNA, 64 nt, hsa
gaggaaugaagguuuuccuagauacaaaauggaauuucaggagcacaguaaauuucagggucug

SEQ ID NO: 263898 - RNA, 64 nt, hsa
auuugcugcaaucuguugcuauucagaguuuaaguuucaggagaaaacaggaacaauagaacac

SEQ ID NO: 263899 - RNA, 64 nt, hsa
uuuccacaguucuugaaaaguacuauguuucaaauuucaggaacaccagcguuagcuguaaaag

SEQ ID NO: 263900 - RNA, 64 nt, hsa
cagcaggaguaauaaauuuacucacagcacuuguuuucaggacaacacuucauuuucaggaaau

SEQ ID NO: 263901 - RNA, 64 nt, hsa
acucacagcacuuguuuucaggacaacacuucauuuucaggaaaucuacuuccuacagagccaa

SEQ ID NO: 263902 - RNA, 64 nt, hsa
uuuaauuacauaauuuuuuuuuuuuaacuuuaaguuucaggauacaugugccgaaugugcaggu

SEQ ID NO: 263903 - RNA, 64 nt, hsa
ucugcuuaggagagaccgagugaaccuaccuucauuucaggagggauuggccgcuuggcacaug

SEQ ID NO: 263904 - RNA, 64 nt, hsa
aaauaaaauaccaauaucaggaagccauuuuuuauuucaggaaauguaagaaaccauuauuuca

SEQ ID NO: 263905 - RNA, 64 nt, hsa
aagugaccugcuguugagaccgguacaaauuggauuucaggaaggagacuccaucacagccagg

SEQ ID NO: 263906 - RNA, 64 nt, hsa
gucauuuaaaauaaugacuugaauuucucagaaauuucaggagcauauaaacuauuuaaaucaa

SEQ ID NO: 263907 - RNA, 64 nt, hsa
ugcuuucuuuuuacagaaauuacuacccaacagauuucaggaaguacuaguaguuaucccaaaa

SEQ ID NO: 263908 - RNA, 64 nt, hsa
gcucugauauagcagcccugguguaguuucuucauuucaggaagacugguagguauaauggccu

SEQ ID NO: 263909 - RNA, 64 nt, hsa
uuuugcugauucuuuaaaugucuuguuucccagauuucaggaaacuuuuuuucuuuuaagcuau

SEQ ID NO: 263910 - RNA, 64 nt, hsa
uuaugucccagggguauauuuagacccuguuuccuuucaggaggguccccagcugguccagggc

SEQ ID NO: 263911 - RNA, 64 nt, hsa
gcuuugccaagcuugugagagcugguugcuacauuuucaggauuuuuacaaguugguaaacaca

SEQ ID NO: 263912 - RNA, 64 nt, hsa
agucugcuccucuuguuccugaaauguguuuccuuuucaggagauggggaauaauuuccuucag

SEQ ID NO: 263913 - RNA, 64 nt, hsa
caaagaagaaagcugauuuuugucuuuuaauccauuucaggacucucuccaggagggcucgggg

SEQ ID NO: 263914 - RNA, 64 nt, hsa
ggugucuucugcuauuuuaucuacuuuugaacacuuucaggacuuuuuagccaguuugccuuuc

SEQ ID NO: 263915 - RNA, 64 nt, hsa
aggcacugagacuaccgcucaaccccagggugguuuucaggaguccgagguagccuucaaucac

SEQ ID NO: 263916 - RNA, 64 nt, hsa
gggcacauugggggcauggaagugccagggugguuuucaggagcucuggugaaguggguggagc

SEQ ID NO: 263917 - RNA, 64 nt, hsa
cccuuugaauauauuugggaagaguugcuuccuauuucaggacccugccaaaaaagaagaaagc

SEQ ID NO: 263918 - RNA, 64 nt, hsa
cucuccaacagcuugugguuuucuuauuacucauuuucaggaaaguuuguaguauuacaaggca

SEQ ID NO: 263919 - RNA, 64 nt, hsa; identical to SEQ ID NO: 95106

SEQ ID NO: 263920 - RNA, 64 nt, hsa; identical to SEQ ID NO: 95107

SEQ ID NO: 263921 - RNA, 64 nt, hsa; identical to SEQ ID NO: 95108

SEQ ID NO: 263922 - RNA, 64 nt, hsa; identical to SEQ ID NO: 95109

SEQ ID NO: 263923 - RNA, 64 nt, hsa; identical to SEQ ID NO: 95110

SEQ ID NO: 263924 - RNA, 64 nt, hsa; identical to SEQ ID NO: 95111

SEQ ID NO: 263925 - RNA, 64 nt, hsa; identical to SEQ ID NO: 95112

SEQ ID NO: 263926 - RNA, 64 nt, hsa; identical to SEQ ID NO: 95113

SEQ ID NO: 263927 - RNA, 64 nt, hsa; identical to SEQ ID NO: 95114

SEQ ID NO: 263928 - RNA, 64 nt, hsa; identical to SEQ ID NO: 95115

SEQ ID NO: 263929 - RNA, 64 nt, hsa; identical to SEQ ID NO: 95116

SEQ ID NO: 263930 - RNA, 64 nt, hsa; identical to SEQ ID NO: 95117

SEQ ID NO: 263931 - RNA, 64 nt, hsa; identical to SEQ ID NO: 95118

SEQ ID NO: 263932 - RNA, 64 nt, hsa; identical to SEQ ID NO: 95119

SEQ ID NO: 263933 - RNA, 64 nt, hsa; identical to SEQ ID NO: 95120

SEQ ID NO: 263934 - RNA, 64 nt, hsa; identical to SEQ ID NO: 95121

SEQ ID NO: 263935 - RNA, 64 nt, hsa; identical to SEQ ID NO: 95122

SEQ ID NO: 263936 - RNA, 64 nt, hsa; identical to SEQ ID NO: 95123

SEQ ID NO: 263937 - RNA, 64 nt, hsa; identical to SEQ ID NO: 95124

SEQ ID NO: 263938 - RNA, 64 nt, hsa; identical to SEQ ID NO: 95125

SEQ ID NO: 263939 - RNA, 64 nt, hsa; identical to SEQ ID NO: 95126

SEQ ID NO: 263940 - RNA, 64 nt, hsa; identical to SEQ ID NO: 95127

SEQ ID NO: 263941 - RNA, 64 nt, hsa; identical to SEQ ID NO: 95128

SEQ ID NO: 263942 - RNA, 64 nt, hsa; identical to SEQ ID NO: 95129

SEQ ID NO: 263943 - RNA, 64 nt, hsa; identical to SEQ ID NO: 95130

SEQ ID NO: 263944 - RNA, 64 nt, hsa; identical to SEQ ID NO: 95131

SEQ ID NO: 263945 - RNA, 60 nt, hsa; identical to SEQ ID NO: 95132

SEQ ID NO: 263946 - RNA, 64 nt, hsa; identical to SEQ ID NO: 95133

SEQ ID NO: 263947 - RNA, 64 nt, hsa; identical to SEQ ID NO: 95134

SEQ ID NO: 263948 - RNA, 64 nt, hsa; identical to SEQ ID NO: 95135

SEQ ID NO: 263949 - RNA, 64 nt, hsa; identical to SEQ ID NO: 95136

SEQ ID NO: 263950 - RNA, 64 nt, hsa; identical to SEQ ID NO: 95137

SEQ ID NO: 263951 - RNA, 64 nt, hsa; identical to SEQ ID NO: 95138

SEQ ID NO: 263952 - RNA, 64 nt, hsa; identical to SEQ ID NO: 95139

SEQ ID NO: 263953 - RNA, 62 nt, hsa; identical to SEQ ID NO: 95140

SEQ ID NO: 263954 - RNA, 64 nt, hsa; identical to SEQ ID NO: 95141

SEQ ID NO: 263955 - RNA, 53 nt, hsa; identical to SEQ ID NO: 95142

SEQ ID NO: 263956 - RNA, 52 nt, hsa; identical to SEQ ID NO: 95143

SEQ ID NO: 263957 - RNA, 64 nt, hsa; identical to SEQ ID NO: 95144

SEQ ID NO: 263958 - RNA, 64 nt, hsa; identical to SEQ ID NO: 95145

SEQ ID NO: 263959 - RNA, 64 nt, hsa; identical to SEQ ID NO: 95146

SEQ ID NO: 263960 - RNA, 50 nt, hsa; identical to SEQ ID NO: 95147

SEQ ID NO: 263961 - RNA, 64 nt, hsa; identical to SEQ ID NO: 95148

SEQ ID NO: 263962 - RNA, 64 nt, hsa
uacugaagggcuaguggcacugccaggggaagggagugcguaggcuuccagugaugguugggga

SEQ ID NO: 263963 - RNA, 64 nt, hsa
uggaauucuucaggguaucuuauauuuuugacugagugcguaguacccauuagacagcuggaga

SEQ ID NO: 263964 - RNA, 64 nt, hsa
cagaaaugcuaacaagcgugcagaaacaccagagagugcguauccugcucagaaccauucacau

SEQ ID NO: 263965 - RNA, 64 nt, hsa
auguguauuucugccauguaccuaaugauuauucagugcguauauaucugaaaagucauguugc

SEQ ID NO: 263966 - RNA, 64 nt, hsa
uucugaggcccacugucuaccuugccagauccucagugcguaucgccaaugcaggaugcuccuu

SEQ ID NO: 263967 - RNA, 64 nt, hsa
aaauuucuggaaguuuauaucuaaaaauguuaauagugcguaccucuaggaagugggccuggaa

SEQ ID NO: 263968 - RNA, 64 nt, hsa
aggccuaagaguacacauggaggguaaauauuaaagugcguauuauguacaucuagaauccaug

SEQ ID NO: 263969 - RNA, 54 nt, hsa
augcaguuuggacggauugauggcagugcguacauucuagacuuccaguauccg

SEQ ID NO: 263970 - RNA, 64 nt, hsa
aaaugucaggacauuccuuuuccaauugugugucagugcguauuguaauaaaacuacugauuua

SEQ ID NO: 263971 - RNA, 64 nt, hsa
ccguuggguuuuuucauaucuguacauaaugccgagugcguaaggaaaccguggcgucgcgcac

SEQ ID NO: 263972 - RNA, 64 nt, hsa
uugcaaauggcagugugcugucaccugcaacagaagugcguaccagaaguaugacucaugcaaa

SEQ ID NO: 263973 - RNA, 64 nt, hsa
aucaggaauacauuuuuuuacugccuuaaccuguagugcguagaauaugcaucaauuucuugaa

SEQ ID NO: 263974 - RNA, 64 nt, hsa
aggccuucaaacugucccagguccugcgcagcucagugcguaucuucuugcuuccaugugucuu

SEQ ID NO: 263975 - RNA, 64 nt, hsa
cuagccaaagaugauaaagggggaaaugguuuuuagugcguauauuauacugccucuuaggugu

SEQ ID NO: 263976 - RNA, 64 nt, hsa
agagaccugggggugugucuggggguggggugugagugcguaugaaagugugugucugcugggg

SEQ ID NO: 263977 - RNA, 64 nt, hsa
cucugccacaucacuuccuucuugaaagccuaagagugcguaugcgugugugugugugugugug

SEQ ID NO: 263978 - RNA, 64 nt, hsa
aaugagaaucucaaugccaguaguacuggauaauagugcguauugcuucugguggcauuacccu

SEQ ID NO: 263979 - RNA, 64 nt, hsa
cuagaaagucuugccucauugaguguuuuucccuagugcguaguuggagucugucccugucuug

SEQ ID NO: 263980 - RNA, 64 nt, hsa
uaugggaaugaacaugaauuagggaacuucaaauagugcguagacuuuucccuacuuaccauug

SEQ ID NO: 263981 - RNA, 64 nt, hsa
caguaugggagacacaccaacuacucuucaaaucagugcguaccugcucuacgcgugaagguac

SEQ ID NO: 263982 - RNA, 64 nt, hsa
ucuguaaauguggauagaaagcucagugugaggcagugcguagaccuaacgucuaccuuuacau

SEQ ID NO: 263983 - RNA, 64 nt, hsa
ucucacuucaauuaaugcugcgcuucgcuuggugagugcguacuuuuucuaccuguacacauuc

SEQ ID NO: 263984 - RNA, 64 nt, hsa
gcggaagggagugggcggagauauguaaauagaaagugcguacaguuagaacguccggcacgua

SEQ ID NO: 263985 - RNA, 64 nt, hsa
auagacauauucuacuuagacguuaaacuguacaagugcguacaaugugaccuucucuaaaugc

SEQ ID NO: 263986 - RNA, 64 nt, hsa
ccacgcccacccagcgucgacccuugacccacgaagugcguagcaugcaguauuuaaagcagug

SEQ ID NO: 263987 - RNA, 64 nt, hsa
cugaauagggacaaacaaaucuugaggaagcccaagugcguaccuuuauuuuugcccccaccac

SEQ ID NO: 263988 - RNA, 64 nt, hsa; identical to SEQ ID NO: 124017

SEQ ID NO: 263989 - RNA, 64 nt, hsa; identical to SEQ ID NO: 124018

SEQ ID NO: 263990 - RNA, 64 nt, hsa; identical to SEQ ID NO: 124019

SEQ ID NO: 263991 - RNA, 64 nt, hsa; identical to SEQ ID NO: 124020

SEQ ID NO: 263992 - RNA, 64 nt, hsa; identical to SEQ ID NO: 124021

SEQ ID NO: 263993 - RNA, 64 nt, hsa; identical to SEQ ID NO: 124022

SEQ ID NO: 263994 - RNA, 64 nt, hsa; identical to SEQ ID NO: 124023

SEQ ID NO: 263995 - RNA, 64 nt, hsa; identical to SEQ ID NO: 124024

SEQ ID NO: 263996 - RNA, 64 nt, hsa; identical to SEQ ID NO: 124025

SEQ ID NO: 263997 - RNA, 64 nt, hsa; identical to SEQ ID NO: 124026

SEQ ID NO: 263998 - RNA, 64 nt, hsa; identical to SEQ ID NO: 124027

SEQ ID NO: 263999 - RNA, 64 nt, hsa; identical to SEQ ID NO: 124028

SEQ ID NO: 264000 - RNA, 64 nt, hsa; identical to SEQ ID NO: 144070

SEQ ID NO: 264001 - RNA, 64 nt, hsa; identical to SEQ ID NO: 144071

SEQ ID NO: 264002 - RNA, 64 nt, hsa; identical to SEQ ID NO: 144072

SEQ ID NO: 264003 - RNA, 64 nt, hsa; identical to SEQ ID NO: 144073

SEQ ID NO: 264004 - RNA, 64 nt, hsa; identical to SEQ ID NO: 144074

SEQ ID NO: 264005 - RNA, 64 nt, hsa; identical to SEQ ID NO: 144075

SEQ ID NO: 264006 - RNA, 64 nt, hsa; identical to SEQ ID NO: 144076

SEQ ID NO: 264007 - RNA, 64 nt, hsa; identical to SEQ ID NO: 144077

SEQ ID NO: 264008 - RNA, 64 nt, hsa; identical to SEQ ID NO: 144078

SEQ ID NO: 264009 - RNA, 64 nt, hsa; identical to SEQ ID NO: 144079

SEQ ID NO: 264010 - RNA, 64 nt, hsa; identical to SEQ ID NO: 144080

SEQ ID NO: 264011 - RNA, 64 nt, hsa; identical to SEQ ID NO: 144081

SEQ ID NO: 264012 - RNA, 64 nt, hsa; identical to SEQ ID NO: 144082

SEQ ID NO: 264013 - RNA, 64 nt, hsa; identical to SEQ ID NO: 144083

SEQ ID NO: 264014 - RNA, 64 nt, hsa; identical to SEQ ID NO: 144084

SEQ ID NO: 264015 - RNA, 64 nt, hsa; identical to SEQ ID NO: 144085

SEQ ID NO: 264016 - RNA, 64 nt, hsa; identical to SEQ ID NO: 144086

SEQ ID NO: 264017 - RNA, 64 nt, hsa; identical to SEQ ID NO: 144087

SEQ ID NO: 264018 - RNA, 64 nt, hsa; identical to SEQ ID NO: 144088

SEQ ID NO: 264019 - RNA, 64 nt, hsa; identical to SEQ ID NO: 144089

SEQ ID NO: 264020 - RNA, 64 nt, hsa; identical to SEQ ID NO: 144090

SEQ ID NO: 264021 - RNA, 64 nt, hsa; identical to SEQ ID NO: 144091

SEQ ID NO: 264022 - RNA, 64 nt, hsa; identical to SEQ ID NO: 144092

SEQ ID NO: 264023 - RNA, 64 nt, hsa; identical to SEQ ID NO: 144093

SEQ ID NO: 264024 - RNA, 64 nt, hsa; identical to SEQ ID NO: 144094

SEQ ID NO: 264025 - RNA, 64 nt, hsa; identical to SEQ ID NO: 144095

SEQ ID NO: 264026 - RNA, 64 nt, hsa; identical to SEQ ID NO: 144096

SEQ ID NO: 264027 - RNA, 64 nt, hsa; identical to SEQ ID NO: 144097

SEQ ID NO: 264028 - RNA, 64 nt, hsa; identical to SEQ ID NO: 144098

SEQ ID NO: 264029 - RNA, 64 nt, hsa; identical to SEQ ID NO: 144099

SEQ ID NO: 264030 - RNA, 64 nt, hsa; identical to SEQ ID NO: 144100

SEQ ID NO: 264031 - RNA, 64 nt, hsa; identical to SEQ ID NO: 144101

SEQ ID NO: 264032 - RNA, 64 nt, hsa; identical to SEQ ID NO: 144102

SEQ ID NO: 264033 - RNA, 64 nt, hsa; identical to SEQ ID NO: 144103

SEQ ID NO: 264034 - RNA, 64 nt, hsa; identical to SEQ ID NO: 144104

SEQ ID NO: 264035 - RNA, 64 nt, hsa; identical to SEQ ID NO: 144105

SEQ ID NO: 264036 - RNA, 64 nt, hsa; identical to SEQ ID NO: 144106

SEQ ID NO: 264037 - RNA, 64 nt, hsa; identical to SEQ ID NO: 144107

SEQ ID NO: 264038 - RNA, 64 nt, hsa; identical to SEQ ID NO: 144108

SEQ ID NO: 264039 - RNA, 64 nt, hsa; identical to SEQ ID NO: 144109

SEQ ID NO: 264040 - RNA, 64 nt, hsa; identical to SEQ ID NO: 144110

SEQ ID NO: 264041 - RNA, 64 nt, hsa; identical to SEQ ID NO: 144111

SEQ ID NO: 264042 - RNA, 64 nt, hsa; identical to SEQ ID NO: 144112

SEQ ID NO: 264043 - RNA, 64 nt, hsa; identical to SEQ ID NO: 144113

SEQ ID NO: 264044 - RNA, 64 nt, hsa; identical to SEQ ID NO: 144114

SEQ ID NO: 264045 - RNA, 64 nt, hsa; identical to SEQ ID NO: 144115

SEQ ID NO: 264046 - RNA, 64 nt, hsa; identical to SEQ ID NO: 144116

SEQ ID NO: 264047 - RNA, 64 nt, hsa; identical to SEQ ID NO: 144117

SEQ ID NO: 264048 - RNA, 64 nt, hsa; identical to SEQ ID NO: 144118

SEQ ID NO: 264049 - RNA, 64 nt, hsa; identical to SEQ ID NO: 144119

SEQ ID NO: 264050 - RNA, 64 nt, hsa; identical to SEQ ID NO: 144120

SEQ ID NO: 264051 - RNA, 64 nt, hsa; identical to SEQ ID NO: 144121

SEQ ID NO: 264052 - RNA, 64 nt, hsa; identical to SEQ ID NO: 144122

SEQ ID NO: 264053 - RNA, 64 nt, hsa; identical to SEQ ID NO: 144123

SEQ ID NO: 264054 - RNA, 64 nt, hsa; identical to SEQ ID NO: 144124

SEQ ID NO: 264055 - RNA, 64 nt, hsa; identical to SEQ ID NO: 144125

SEQ ID NO: 264056 - RNA, 64 nt, hsa; identical to SEQ ID NO: 144126

SEQ ID NO: 264057 - RNA, 64 nt, hsa; identical to SEQ ID NO: 144127

SEQ ID NO: 264058 - RNA, 64 nt, hsa; identical to SEQ ID NO: 144128

SEQ ID NO: 264059 - RNA, 64 nt, hsa; identical to SEQ ID NO: 144129

SEQ ID NO: 264060 - RNA, 64 nt, hsa; identical to SEQ ID NO: 144130

SEQ ID NO: 264061 - RNA, 64 nt, hsa; identical to SEQ ID NO: 144131

SEQ ID NO: 264062 - RNA, 64 nt, hsa; identical to SEQ ID NO: 144132

SEQ ID NO: 264063 - RNA, 64 nt, hsa; identical to SEQ ID NO: 144133

SEQ ID NO: 264064 - RNA, 64 nt, hsa; identical to SEQ ID NO: 144134

SEQ ID NO: 264065 - RNA, 64 nt, hsa; identical to SEQ ID NO: 144135

SEQ ID NO: 264066 - RNA, 64 nt, hsa; identical to SEQ ID NO: 144136

SEQ ID NO: 264067 - RNA, 64 nt, hsa; identical to SEQ ID NO: 144137

SEQ ID NO: 264068 - RNA, 64 nt, hsa; identical to SEQ ID NO: 144138

SEQ ID NO: 264069 - RNA, 64 nt, hsa; identical to SEQ ID NO: 144139

SEQ ID NO: 264070 - RNA, 64 nt, hsa; identical to SEQ ID NO: 144140

SEQ ID NO: 264071 - RNA, 64 nt, hsa; identical to SEQ ID NO: 144141

SEQ ID NO: 264072 - RNA, 64 nt, hsa; identical to SEQ ID NO: 144142

SEQ ID NO: 264073 - RNA, 64 nt, hsa; identical to SEQ ID NO: 144143

SEQ ID NO: 264074 - RNA, 64 nt, hsa; identical to SEQ ID NO: 144144

SEQ ID NO: 264075 - RNA, 64 nt, hsa; identical to SEQ ID NO: 144145

SEQ ID NO: 264076 - RNA, 64 nt, hsa; identical to SEQ ID NO: 144146

SEQ ID NO: 264077 - RNA, 64 nt, hsa; identical to SEQ ID NO: 144147

SEQ ID NO: 264078 - RNA, 64 nt, hsa; identical to SEQ ID NO: 144148

SEQ ID NO: 264079 - RNA, 64 nt, hsa; identical to SEQ ID NO: 144149

SEQ ID NO: 264080 - RNA, 64 nt, hsa; identical to SEQ ID NO: 144150

SEQ ID NO: 264081 - RNA, 64 nt, hsa; identical to SEQ ID NO: 144151

SEQ ID NO: 264082 - RNA, 64 nt, hsa; identical to SEQ ID NO: 144152

SEQ ID NO: 264083 - RNA, 64 nt, hsa; identical to SEQ ID NO: 144153

SEQ ID NO: 264084 - RNA, 64 nt, hsa; identical to SEQ ID NO: 144154

SEQ ID NO: 264085 - RNA, 64 nt, hsa; identical to SEQ ID NO: 144155

SEQ ID NO: 264086 - RNA, 64 nt, hsa
auauccaaguauaaagcccaggaacuucuagaauaacccagaugcgcuuuaauuuuuuuuaaua

SEQ ID NO: 264087 - RNA, 64 nt, hsa
uuuuaauauguuuugaucacagaacuucuagaauaacccagaugcucuuucauauucuuuuaau

SEQ ID NO: 264088 - RNA, 64 nt, hsa
ggugcacccaccuguuuucugaaacacacgagcaaacccagagguggauguuaugaacagcugu

SEQ ID NO: 264089 - RNA, 64 nt, hsa
uugugugagucuucucgaaggaggguugacucagaacccagagacaauacaaaaccccucacuu

SEQ ID NO: 264090 - RNA, 64 nt, hsa
gaguauauauuugaaaaggaaaaaacaaaaaacaaacccagaccccaccugaauugggcuuuuu

SEQ ID NO: 264091 - RNA, 64 nt, hsa
guucugugacugaagugauacacuaaucacggggaacccagaaugauucaacauuuucccccca

SEQ ID NO: 264092 - RNA, 64 nt, hsa
aguucuguguccacaacccagaccccuccacacaaacccagauggggcugugccgcuguuuucc

SEQ ID NO: 264093 - RNA, 64 nt, hsa
ggcaccaucucucugaugacaguucuguguccacaacccagaccccuccacacaaacccagaug

SEQ ID NO: 264094 - RNA, 64 nt, hsa
gaacagacacauacgucaauggaacagaugagagaacccagaaauaaacccauauaaauaugcu

SEQ ID NO: 264095 - RNA, 64 nt, hsa
ggagcuuuauuuguaauagccccaaacuggaaacaacccagauguccuacaacagguacauggu

SEQ ID NO: 264096 - RNA, 64 nt, hsa
uugaggggaaauuacugucaccacuaguuuuaauauaguacaaugaaaaaauaauauauauaua

SEQ ID NO: 264097 - RNA, 64 nt, hsa
aauauaguacaaugaaaaaauaauauauauauauauaguacaaugguccagacauaauaagagg

SEQ ID NO: 264098 - RNA, 64 nt, hsa
uauauauauguauauauauaguacauguauauauauaguacauguguauauauauauuacacac

SEQ ID NO: 264099 - RNA, 64 nt, hsa
uguguguguguguguaauauauauauguauauauauaguacauguauauauauaguacaugugu

SEQ ID NO: 264100 - RNA, 64 nt, hsa
auuucuauccauugagcaugcauggauauacccaauaguacacacaaaauaaauguuuacuuaa

SEQ ID NO: 264101 - RNA, 64 nt, hsa
aauucacaaguauauauugauaucugauguguguauaguacaucuguugguuauguacauuuua

SEQ ID NO: 264102 - RNA, 64 nt, hsa
gcaaagauguuuuguauuuuagccaaaucuuuuuauaguacaaacuuagaauuauuuuacacac

SEQ ID NO: 264103 - RNA, 64 nt, hsa
gucaaguacuuagucaucccuauuaugauaugagauaguacagcuuuucaggaagcuuagaucu

SEQ ID NO: 264104 - RNA, 64 nt, hsa; identical to SEQ ID NO: 172267

SEQ ID NO: 264105 - RNA, 64 nt, hsa; identical to SEQ ID NO: 172268

SEQ ID NO: 264106 - RNA, 64 nt, hsa; identical to SEQ ID NO: 172269

SEQ ID NO: 264107 - RNA, 64 nt, hsa; identical to SEQ ID NO: 172270

SEQ ID NO: 264108 - RNA, 64 nt, hsa; identical to SEQ ID NO: 172271

SEQ ID NO: 264109 - RNA, 64 nt, hsa; identical to SEQ ID NO: 172272

SEQ ID NO: 264110 - RNA, 64 nt, hsa; identical to SEQ ID NO: 172273

SEQ ID NO: 264111 - RNA, 64 nt, hsa; identical to SEQ ID NO: 172274

SEQ ID NO: 264112 - RNA, 64 nt, hsa; identical to SEQ ID NO: 172275

SEQ ID NO: 264113 - RNA, 64 nt, hsa; identical to SEQ ID NO: 172276

SEQ ID NO: 264114 - RNA, 64 nt, hsa; identical to SEQ ID NO: 172277

SEQ ID NO: 264115 - RNA, 64 nt, hsa; identical to SEQ ID NO: 172278

SEQ ID NO: 264116 - RNA, 64 nt, hsa; identical to SEQ ID NO: 172279

SEQ ID NO: 264117 - RNA, 64 nt, hsa; identical to SEQ ID NO: 172280

SEQ ID NO: 264118 - RNA, 64 nt, hsa; identical to SEQ ID NO: 172281

SEQ ID NO: 264119 - RNA, 64 nt, hsa; identical to SEQ ID NO: 172282

SEQ ID NO: 264120 - RNA, 64 nt, hsa; identical to SEQ ID NO: 172283

SEQ ID NO: 264121 - RNA, 64 nt, hsa; identical to SEQ ID NO: 172284

SEQ ID NO: 264122 - RNA, 64 nt, hsa; identical to SEQ ID NO: 172285

SEQ ID NO: 264123 - RNA, 64 nt, hsa; identical to SEQ ID NO: 172286

SEQ ID NO: 264124 - RNA, 64 nt, hsa; identical to SEQ ID NO: 172287

SEQ ID NO: 264125 - RNA, 64 nt, hsa; identical to SEQ ID NO: 172288

SEQ ID NO: 264126 - RNA, 64 nt, hsa; identical to SEQ ID NO: 172289

SEQ ID NO: 264127 - RNA, 64 nt, hsa; identical to SEQ ID NO: 172290

SEQ ID NO: 264128 - RNA, 64 nt, hsa; identical to SEQ ID NO: 172291

SEQ ID NO: 264129 - RNA, 64 nt, hsa; identical to SEQ ID NO: 172292

SEQ ID NO: 264130 - RNA, 64 nt, hsa; identical to SEQ ID NO: 172293

SEQ ID NO: 264131 - RNA, 64 nt, hsa; identical to SEQ ID NO: 172294

SEQ ID NO: 264132 - RNA, 64 nt, hsa; identical to SEQ ID NO: 172295

SEQ ID NO: 264133 - RNA, 64 nt, hsa; identical to SEQ ID NO: 172296

SEQ ID NO: 264134 - RNA, 64 nt, hsa; identical to SEQ ID NO: 172297

SEQ ID NO: 264135 - RNA, 64 nt, hsa; identical to SEQ ID NO: 172298

SEQ ID NO: 264136 - RNA, 64 nt, hsa; identical to SEQ ID NO: 172299

SEQ ID NO: 264137 - RNA, 64 nt, hsa; identical to SEQ ID NO: 172300

SEQ ID NO: 264138 - RNA, 64 nt, hsa; identical to SEQ ID NO: 172301

SEQ ID NO: 264139 - RNA, 64 nt, hsa; identical to SEQ ID NO: 172302

SEQ ID NO: 264140 - RNA, 64 nt, hsa; identical to SEQ ID NO: 172303

SEQ ID NO: 264141 - RNA, 64 nt, hsa; identical to SEQ ID NO: 172304

SEQ ID NO: 264142 - RNA, 64 nt, hsa; identical to SEQ ID NO: 172305

SEQ ID NO: 264143 - RNA, 64 nt, hsa; identical to SEQ ID NO: 172306

SEQ ID NO: 264144 - RNA, 64 nt, hsa; identical to SEQ ID NO: 172307

SEQ ID NO: 264145 - RNA, 64 nt, hsa; identical to SEQ ID NO: 172308

SEQ ID NO: 264146 - RNA, 64 nt, hsa; identical to SEQ ID NO: 172309

SEQ ID NO: 264147 - RNA, 64 nt, hsa; identical to SEQ ID NO: 172310

SEQ ID NO: 264148 - RNA, 64 nt, hsa
acucaaguacuaguaauuuaacuucaucaugaaugaacuauaauuuuuaaguuaugcccauuua

SEQ ID NO: 264149 - RNA, 64 nt, hsa
gaaaaccuaauccaaaauaaaauucacuuaaguagaacuauaaauaaauaucuagaaucugacu

SEQ ID NO: 264150 - RNA, 64 nt, hsa
uuuuagaugauucagcuuuuguuccauuacuguugaacuauaugaacuauuccauuacugcaga

SEQ ID NO: 264151 - RNA, 64 nt, hsa
acauuaacuaguaagacauaaagauuugaaacuggaacuauauuauacuuuuuaaccaaucucu

SEQ ID NO: 264152 - RNA, 64 nt, hsa
uagacaguuuugagaacguaaagaacuuuuucuuuucccucaaucucaauccugcagugggguu

SEQ ID NO: 264153 - RNA, 64 nt, hsa
gguacuuuuugugaagacggcacggucuucccucuucccucagucccaaauccuucccaaguaa

SEQ ID NO: 264154 - RNA, 64 nt, hsa
augaaauuauaccuucugaucaaauaaccauggcuucccucagccauuccugagacuugguaua

SEQ ID NO: 264155 - RNA, 64 nt, hsa
uaguuucucaagugaacacucucaggauacccaguucccucauagccucuguucucagagaauu

SEQ ID NO: 264156 - RNA, 64 nt, hsa
ggguuuagaaagaucucaggaaaaugaguuucucuucccucaggguggcugugauacagguucc

SEQ ID NO: 264157 - RNA, 64 nt, hsa
agucagaguccucucucacagucggccacuggauuucccucacuggcucucaggagugugacca

SEQ ID NO: 264158 - RNA, 64 nt, hsa
agaacaagauaaccacugcugcugauggauacuuuucccucacugccauggcacaccagucaug

SEQ ID NO: 264159 - RNA, 64 nt, hsa
guuucauucuuagaaccuucuuuaauagagggucuucccucaacagccugugccucuggucuac

SEQ ID NO: 264160 - RNA, 64 nt, hsa
auggcaacagcccccucaccuaugggaagcugacuucccucagucgggcacuucucaugggggc

SEQ ID NO: 264161 - RNA, 64 nt, hsa
gcacccaaacaagaaaguccauaauggaaugaucuucccucagcuuccuaucgauuuaguuacc

SEQ ID NO: 264162 - RNA, 64 nt, hsa
gucuggggacagauagaaccuguugggggaaauauucccucaccccaggguucuuucugcagag

SEQ ID NO: 264163 - RNA, 64 nt, hsa
ucucuccuccugaguaggaacguuucuguucaguuucccucacagcagccuguguuagcaugca

SEQ ID NO: 264164 - RNA, 64 nt, hsa
uacaugaucccaugcucccaagcuccauucuuccuucccucaacucucugcccuccacagagcu

SEQ ID NO: 264165 - RNA, 64 nt, hsa
uuucagucuccuuuucuuucucaccauuuaucacuucccucacugcccuacccaggcuuucucu

SEQ ID NO: 264166 - RNA, 64 nt, hsa
uuuuauguuggucauuaggugaauauuacucauuuucccucaagagaagcucauaagugugugu

SEQ ID NO: 264167 - RNA, 64 nt, hsa
acccuucuuucugaacccagggcccuuuucagccuucccucauauuuucuugagaucaaacuuu

SEQ ID NO: 264168 - RNA, 64 nt, hsa
uuuuccccugccucuguuagugguuaacacucuuuucccucagggagccuaaugagguuuuuaa

SEQ ID NO: 264169 - RNA, 64 nt, hsa
uaugaagcuuguacuuaugcauuucucgggccucuucccucauuuucaucagucugucuaagaa

SEQ ID NO: 264170 - RNA, 64 nt, hsa
cucaggggccagcccagucugggccacccuuuguuucccucauccucggcucccacacagguga

SEQ ID NO: 264171 - RNA, 64 nt, hsa
cauggcccuggccauugauguguaugggcuuucuuucccucaugcagccccuucuuccccaggc

SEQ ID NO: 264172 - RNA, 64 nt, hsa
gcuggaggucacguuucuaaaacucaccuacgaaagauagcauuaaaggaacaggggcucucug

SEQ ID NO: 264173 - RNA, 64 nt, hsa
guuccuggugaagcaguuucacaucagucucuccagauagcacuacgauguauuccgcuucuga

SEQ ID NO: 264174 - RNA, 64 nt, hsa
gauaguucuuuaaggagacaaaacgguaaugaacagauagcacuggggcagaauaugcaugcau

SEQ ID NO: 264175 - RNA, 64 nt, hsa
aaaaaaacgaaagcaucuucacaaugaagcuuccagauagcaccguuuugcuaaaagauacauu

SEQ ID NO: 264176 - RNA, 64 nt, hsa; identical to SEQ ID NO: 133830

SEQ ID NO: 264177 - RNA, 64 nt, hsa; identical to SEQ ID NO: 133831

SEQ ID NO: 264178 - RNA, 64 nt, hsa; identical to SEQ ID NO: 133832

SEQ ID NO: 264179 - RNA, 64 nt, hsa; identical to SEQ ID NO: 133833

SEQ ID NO: 264180 - RNA, 64 nt, hsa; identical to SEQ ID NO: 133834

SEQ ID NO: 264181 - RNA, 64 nt, hsa; identical to SEQ ID NO: 133835

SEQ ID NO: 264182 - RNA, 64 nt, hsa; identical to SEQ ID NO: 133836

SEQ ID NO: 264183 - RNA, 64 nt, hsa; identical to SEQ ID NO: 133837

SEQ ID NO: 264184 - RNA, 64 nt, hsa; identical to SEQ ID NO: 133838

SEQ ID NO: 264185 - RNA, 64 nt, hsa; identical to SEQ ID NO: 133839

SEQ ID NO: 264186 - RNA, 64 nt, hsa; identical to SEQ ID NO: 133840

SEQ ID NO: 264187 - RNA, 64 nt, hsa; identical to SEQ ID NO: 133841

SEQ ID NO: 264188 - RNA, 64 nt, hsa; identical to SEQ ID NO: 133842

SEQ ID NO: 264189 - RNA, 64 nt, hsa; identical to SEQ ID NO: 133843

SEQ ID NO: 264190 - RNA, 64 nt, hsa; identical to SEQ ID NO: 133844

SEQ ID NO: 264191 - RNA, 64 nt, hsa; identical to SEQ ID NO: 133845

SEQ ID NO: 264192 - RNA, 64 nt, hsa; identical to SEQ ID NO: 133846

SEQ ID NO: 264193 - RNA, 64 nt, hsa; identical to SEQ ID NO: 133847

SEQ ID NO: 264194 - RNA, 64 nt, hsa; identical to SEQ ID NO: 133848

SEQ ID NO: 264195 - RNA, 64 nt, hsa; identical to SEQ ID NO: 133849

SEQ ID NO: 264196 - RNA, 64 nt, hsa; identical to SEQ ID NO: 133850

SEQ ID NO: 264197 - RNA, 64 nt, hsa; identical to SEQ ID NO: 133851

SEQ ID NO: 264198 - RNA, 64 nt, hsa; identical to SEQ ID NO: 133852

SEQ ID NO: 264199 - RNA, 64 nt, hsa; identical to SEQ ID NO: 133853

SEQ ID NO: 264200 - RNA, 64 nt, hsa; identical to SEQ ID NO: 133854

SEQ ID NO: 264201 - RNA, 64 nt, hsa; identical to SEQ ID NO: 133855

SEQ ID NO: 264202 - RNA, 64 nt, hsa; identical to SEQ ID NO: 133856

SEQ ID NO: 264203 - RNA, 64 nt, hsa; identical to SEQ ID NO: 133857

SEQ ID NO: 264204 - RNA, 64 nt, hsa; identical to SEQ ID NO: 133858

SEQ ID NO: 264205 - RNA, 64 nt, hsa; identical to SEQ ID NO: 133859

SEQ ID NO: 264206 - RNA, 64 nt, hsa; identical to SEQ ID NO: 133860

SEQ ID NO: 264207 - RNA, 64 nt, hsa; identical to SEQ ID NO: 133861

SEQ ID NO: 264208 - RNA, 64 nt, hsa; identical to SEQ ID NO: 133862

SEQ ID NO: 264209 - RNA, 64 nt, hsa; identical to SEQ ID NO: 133863

SEQ ID NO: 264210 - RNA, 64 nt, hsa; identical to SEQ ID NO: 133864

SEQ ID NO: 264211 - RNA, 64 nt, hsa; identical to SEQ ID NO: 133865

SEQ ID NO: 264212 - RNA, 64 nt, hsa; identical to SEQ ID NO: 133866

SEQ ID NO: 264213 - RNA, 64 nt, hsa; identical to SEQ ID NO: 133867

SEQ ID NO: 264214 - RNA, 64 nt, hsa; identical to SEQ ID NO: 133868

SEQ ID NO: 264215 - RNA, 64 nt, hsa; identical to SEQ ID NO: 133869

SEQ ID NO: 264216 - RNA, 64 nt, hsa; identical to SEQ ID NO: 133870

SEQ ID NO: 264217 - RNA, 64 nt, hsa; identical to SEQ ID NO: 133871

SEQ ID NO: 264218 - RNA, 64 nt, hsa; identical to SEQ ID NO: 133872

SEQ ID NO: 264219 - RNA, 64 nt, hsa; identical to SEQ ID NO: 133873

SEQ ID NO: 264220 - RNA, 64 nt, hsa; identical to SEQ ID NO: 133874

SEQ ID NO: 264221 - RNA, 64 nt, hsa; identical to SEQ ID NO: 133875

SEQ ID NO: 264222 - RNA, 64 nt, hsa; identical to SEQ ID NO: 133876

SEQ ID NO: 264223 - RNA, 64 nt, hsa; identical to SEQ ID NO: 133877

SEQ ID NO: 264224 - RNA, 64 nt, hsa; identical to SEQ ID NO: 133878

SEQ ID NO: 264225 - RNA, 64 nt, hsa; identical to SEQ ID NO: 133879

SEQ ID NO: 264226 - RNA, 64 nt, hsa; identical to SEQ ID NO: 133880

SEQ ID NO: 264227 - RNA, 64 nt, hsa; identical to SEQ ID NO: 133881

SEQ ID NO: 264228 - RNA, 64 nt, hsa; identical to SEQ ID NO: 133882

SEQ ID NO: 264229 - RNA, 64 nt, hsa; identical to SEQ ID NO: 133883

SEQ ID NO: 264230 - RNA, 64 nt, hsa; identical to SEQ ID NO: 133884

SEQ ID NO: 264231 - RNA, 64 nt, hsa; identical to SEQ ID NO: 133885

SEQ ID NO: 264232 - RNA, 64 nt, hsa; identical to SEQ ID NO: 133886

SEQ ID NO: 264233 - RNA, 64 nt, hsa; identical to SEQ ID NO: 133887

SEQ ID NO: 264234 - RNA, 64 nt, hsa; identical to SEQ ID NO: 133888

SEQ ID NO: 264235 - RNA, 64 nt, hsa; identical to SEQ ID NO: 133889

SEQ ID NO: 264236 - RNA, 64 nt, hsa; identical to SEQ ID NO: 133890

SEQ ID NO: 264237 - RNA, 64 nt, hsa; identical to SEQ ID NO: 133891

SEQ ID NO: 264238 - RNA, 64 nt, hsa; identical to SEQ ID NO: 133892

SEQ ID NO: 264239 - RNA, 64 nt, hsa; identical to SEQ ID NO: 133893

SEQ ID NO: 264240 - RNA, 64 nt, hsa
uugaaagggauuauauuaauugcuaaauauuuuauucacaaaggucaauaacauggcaagauaa

SEQ ID NO: 264241 - RNA, 64 nt, hsa
uaaaacucaaggcuuguugugaagccuaaaaauauucacaaauaagcuuuuaaacuggugucuu

SEQ ID NO: 264242 - RNA, 64 nt, hsa
gggaggcacguuucaucugucagcucacuccagcuucacaaaugugcugagagcauuacugugu

SEQ ID NO: 264243 - RNA, 64 nt, hsa
auauaaauuugcuguugauuuuuguaugaauuuuuucacaaaaagauccugaauaagcauuguu

SEQ ID NO: 264244 - RNA, 64 nt, hsa
accucucaaugaaaaauguaaaaguaccuagaaauucacaaaaaaauuaauaccucuguggaga

SEQ ID NO: 264245 - RNA, 64 nt, hsa
ggaacgaaauuagaaaucaauaaaauuugggaaauucacaaauauguggauauuaaacaacaca

SEQ ID NO: 264246 - RNA, 64 nt, hsa
gguguacuuuaaaaaauauauguuucauuuaaucuucacaaaagaucuguagaguaagcaaaga

SEQ ID NO: 264247 - RNA, 64 nt, hsa
agauaugaacuuacauuucugugcaaguuguuuuuucacaaaauaucuuccuaagaggcagcau

SEQ ID NO: 264248 - RNA, 64 nt, hsa
cagaucaguuucugccaauuucagugguuuauuguucacaaaaaaaucuucaaaacaaguauug

SEQ ID NO: 264249 - RNA, 64 nt, hsa
guucacaaaaaaaucuucaaaacaaguauugacuuucacaaaauuuaaaucauaaacaggcaaa

SEQ ID NO: 264250 - RNA, 64 nt, hsa
uaacaaccucugagccuugguguacagaccaccuuucacaaaacgaaaugcuaugacuguaucu

SEQ ID NO: 264251 - RNA, 64 nt, hsa
uuauuuacuucuguauguguauuuuugugaaguauucacaaagguuaaguuaaaauaaaaccaa

SEQ ID NO: 264252 - RNA, 64 nt, hsa
auuuacaagagaagaaagugaaagcaaaugggguuucacaaauaguuguaaauauagugaagca

SEQ ID NO: 264253 - RNA, 64 nt, hsa
uuuacugaacuaugaaaauaaauacacauaauuuuucacaaaauuuugggcccaauuccccuaa

SEQ ID NO: 264254 - RNA, 64 nt, hsa
uuuuauuaaucauggucauucauucauucauucauucacaaaauauuuaugauguauuuacucu

SEQ ID NO: 264255 - RNA, 64 nt, hsa
uaaucauacaaacucucaccaugaugugaagaguuucacaaauccuucaaaauaaaaaguaaug

SEQ ID NO: 264256 - RNA, 50 nt, hsa
caguugccaaccauuuguaguucacaaauuaaaacuggguuuccaggccu

SEQ ID NO: 264257 - RNA, 64 nt, hsa
uauagguagcuacacguacauaauuaucucuuuauucacaaaggguauaguaaaauugauugua

SEQ ID NO: 264258 - RNA, 64 nt, hsa
aagacgccaaaaacaauugcaacagaagcaaaaauucacaaaugggaucuaauuaaacuaaaga

SEQ ID NO: 264259 - RNA, 64 nt, hsa
auuaaacuuuguauuaauuuaccaccaauauuucuucacaaaggaacuuuuaaaagauuaucuc

SEQ ID NO: 264260 - RNA, 64 nt, hsa
ucuuuguuuuauguuuuuaaauacagaaauugcuuucacaaauuuguaccacaugguaauucua

SEQ ID NO: 264261 - RNA, 64 nt, hsa
cauggaauguaauauuuuugcaaagauggacuacuucacaaaugguuauaaagucauauccacu

SEQ ID NO: 264262 - RNA, 64 nt, hsa
uguuacuagacaugaucuugaaagaggccaugauuucacaaaacucauuuuuauuuuauucuca

SEQ ID NO: 264263 - RNA, 64 nt, hsa
ccuaagggaccuuucccugguaguaguggucucauucacaaaaaagaauaauagauguaacugg

SEQ ID NO: 264264 - RNA, 64 nt, hsa
uaagcucuauuauguuauucuaacaaguagcaauuucacaaaauuuguauguagauguuaacgc

SEQ ID NO: 264265 - RNA, 64 nt, hsa
uuagacuaguguugacuuuggggggggacauuuauucacaaaugagaaguaggcacaaaguaaa

SEQ ID NO: 264266 - RNA, 64 nt, hsa
gccauccagguacuaaggacccaaggcauacagauucacaaaauuaacuaaucuuuuugccuca

SEQ ID NO: 264267 - RNA, 64 nt, hsa
auagcaagaaacuauauagguauacacuuacgacuucacaaaaccuauacuuaauauaguaaau

SEQ ID NO: 264268 - RNA, 64 nt, hsa
uaaauccaagagaaaugauccuauccaaagcugauucacaaacccacgcucaccugacagccga

SEQ ID NO: 264269 - RNA, 64 nt, hsa
acuugugacuucuauagacaauuuuuuuuucuuguucacaaaaaaauucccuguaaaucugaaa

SEQ ID NO: 264270 - RNA, 64 nt, hsa
ugugggaaccuguguuugucauauuuuucuucauuucacaaaggcuuuuuuugaagcaguggca

SEQ ID NO: 264271 - RNA, 64 nt, hsa
cagagacucugccuggccacugagaacagccaaauucacaaacccucaguggggcuuuguuuuu

SEQ ID NO: 264272 - RNA, 64 nt, hsa
ccaaaaucagcaaauuugacuucuuaguagccacuucacaaagcaaaaugaaauccagugaaga

SEQ ID NO: 264273 - RNA, 64 nt, hsa
gcaaaaggaauaugaaaacagagacuauaaagauuucacaaaacaggaccugccuacggcugaa

SEQ ID NO: 264274 - RNA, 64 nt, hsa
guaaaagugucacaccaccucccucagcacuuccccaucacaacaaccuaugucacugacucag

SEQ ID NO: 264275 - RNA, 64 nt, hsa
ucaaugauuagaucgggucucggaagggaaguagccaucacaccauuaaaaagccuguggaccu

SEQ ID NO: 264276 - RNA, 64 nt, hsa
ugaggacugcaccagaguucugaagggaucuuaaccaucacaaguuuuuacccucuuccuucau

SEQ ID NO: 264277 - RNA, 64 nt, hsa
gccugccuuuucccuuccuauuucacuuugccucccaucacacaacugcguguaaaugguguca

SEQ ID NO: 264278 - RNA, 64 nt, hsa
uaagggcccuugguaucaagugagguaaauucacccaucacagggucucgcccuaccauccugg

SEQ ID NO: 264279 - RNA, 64 nt, hsa
gcaaccgcuaugcagucuggugagagggagacagccaucacauagaaagugaccguacggguuu

SEQ ID NO: 264280 - RNA, 64 nt, hsa
gggaacaagguuggaugccuacuuaugagcuugaccaucacagcuaucgguaaucagaaauaug

SEQ ID NO: 264281 - RNA, 64 nt, hsa
cugcauuugaauaucacuuccccucugcauuuucccaucacauagaagacuuugaccugugaag

SEQ ID NO: 264282 - RNA, 64 nt, hsa
uccuuuaauucugaaguuggaguuggugccccugccaucacaaacaacacgagagccaauugug

SEQ ID NO: 264283 - RNA, 64 nt, hsa
aguguucagcuuauucaccccacccccccaccccccaucacacgugcuccugugaacuuuccau

SEQ ID NO: 264284 - RNA, 64 nt, hsa
ccugccacuucagcacaccuugccccaccugggaccaucacacgugaagcaccaggcugggaga

SEQ ID NO: 264285 - RNA, 64 nt, hsa
aaucuuccaccaccucuccggcugccccugcccuccaucacagacagcagagccgggcagcuuu

SEQ ID NO: 264286 - RNA, 64 nt, hsa
ccuuccugcccagaaguggaugaugugggaguugacaggccagggagagggugaagcagguauc

SEQ ID NO: 264287 - RNA, 64 nt, hsa
gggcaaauauuucaccauugccagagaagaugugacaggccaaucagacagggcccagagcauc

SEQ ID NO: 264288 - RNA, 64 nt, hsa
gacuaugucuuucaagauguacagaagacugacaacaggccagugcagacuuugcuuccuccuu

SEQ ID NO: 264289 - RNA, 64 nt, hsa
cccucacugcuagucagcuucuuuuggaaacuggacaggccauugccaccugcacuuugaagaa

SEQ ID NO: 264290 - RNA, 64 nt, hsa
auuucaucaaggacagggaauaucccucccacacacaggccagcugcucacccugccaccucca

SEQ ID NO: 264291 - RNA, 64 nt, hsa
uuccucauccagcaccaaaucuuugcuuauguccacaggccagggccugugcugcagucgggga

SEQ ID NO: 264292 - RNA, 64 nt, hsa
ggcugggcucagcaaaggacucgccuugcaaccgacaggccauucccacccccacacacaaccu

SEQ ID NO: 264293 - RNA, 64 nt, hsa
accauggcaucccagagcaaggacacaggagcccacaggccaguugagguugggcaaggagacu

SEQ ID NO: 264294 - RNA, 64 nt, hsa
ucugacagagcaucagaaccagaggcuuggucccacaggccacggaccaauggccugcagccgu

SEQ ID NO: 264295 - RNA, 64 nt, hsa
uaguaaugcucaggacaggagcggcagccccagaacaggccacucauuuagaauucuaguguuu

SEQ ID NO: 264296 - RNA, 64 nt, hsa
aggccuuuccuuccuggagccacagugcuuagagacaggccacuggggucagcauuugagcuca

SEQ ID NO: 264297 - RNA, 64 nt, hsa
ccagcacaggcagcgcauggcuccggaagcagacacaggccaggccugggccaggagucugcca

SEQ ID NO: 264298 - RNA, 64 nt, hsa
uggaaggaagagccaucguggucuuugucuggccacaggccaggcugcugggcauccuccuccu

SEQ ID NO: 264299 - RNA, 64 nt, hsa
aaggaccaaaaauuauuuuuagcuauggcaaggcacaggccacauggccccugauggcgucccu

SEQ ID NO: 264300 - RNA, 64 nt, hsa
cuuagcacucuugguggugggugggaggguggguacaggccagggauauucccuugcucuuuug

SEQ ID NO: 264301 - RNA, 64 nt, hsa
ccuggcuucagcuuggaacccaauaccuaggcuuacaggccauccugagccaggggccucugga

SEQ ID NO: 264302 - RNA, 64 nt, hsa
aaaagcacaucuuccugaucacaguuauaaaagaaacccugaggccgggcgcgguggcucaagc

SEQ ID NO: 264303 - RNA, 64 nt, hsa
aaaaaaaaaaaaaaaaaaaaaaaaaagaagaagaaacccugagccauuaaugugucucguaacu

SEQ ID NO: 264304 - RNA, 64 nt, hsa
gucagcagagagagucucuguacacagccccgugaacccugaggaguggagucauacgcgaagg

SEQ ID NO: 264305 - RNA, 64 nt, hsa
gucagcagagagagucucuguacacagccccgugaacccugaggaguggagucauacacgaagg

SEQ ID NO: 264306 - RNA, 64 nt, hsa
ugguaucaugucagcagagucuccaagccccacgaacccugaggaguggagucauacgcgaagg

SEQ ID NO: 264307 - RNA, 64 nt, hsa
uucuucccaaacauauugcuagauucuggacauuaacccugacguuuccuaaauacuggccugg

SEQ ID NO: 264308 - RNA, 64 nt, hsa
uucauaagacacaaagacgugcacaggaguuugaaacccugagcuguuucucuguuccacuuuc

SEQ ID NO: 264309 - RNA, 64 nt, hsa
ugcccacuugauugagaaagauguuccagugaggaacccugaucucucagccccaaacacccac

SEQ ID NO: 264310 - RNA, 64 nt, hsa
ggcacuguuaccuugguggugggacuuggaacccaacccugagcucccgauaaagcuaaagucc

SEQ ID NO: 264311 - RNA, 64 nt, hsa
ccugggacguuuuuaagaucgcugugugucuguaaacccugaaucucaucuggggugggggccc

SEQ ID NO: 264312 - RNA, 64 nt, hsa
ccugaaucucaucuggggugggggcccugcuggcaacccugagcccuguccaagguucccucuu

SEQ ID NO: 264313 - RNA, 64 nt, hsa
cagcugcucagagcaguguucuggcuucuucucaaacccugagcgggcugccggccuccaaguu

SEQ ID NO: 264314 - RNA, 64 nt, hsa
gggaacagcagaacuuagggucagggucucagggaacccugagcuccaagcgugcugugcgucu

SEQ ID NO: 264315 - RNA, 64 nt, hsa
uggcuuucuuauacagaugguguccauuugcuccaccagacaggaguuaaaaaccuuuaaagag

SEQ ID NO: 264316 - RNA, 64 nt, hsa
ugacguuuguauacagaugguguccauuugcucaaccagacaggaguuaacuuguauuagaauu

SEQ ID NO: 264317 - RNA, 64 nt, hsa
cguuuggggucuuuagaaguuugaugauguugugaccagacauuugccuuaggaacuuaacucu

SEQ ID NO: 264318 - RNA, 64 nt, hsa
gagagacguccauagccuuagguauaucauuuauaccagacauuaugaaguuauuaaagucucc

SEQ ID NO: 264319 - RNA, 64 nt, hsa
cucuucgucaugaccaacgugauccucaccaugaaccagacacagggccugugccccgagguag

SEQ ID NO: 264320 - RNA, 64 nt, hsa
uccucagagaagcgcugugcuaaggugaucgaggaccagacauuaaagcgugauuuucuuaauc

SEQ ID NO: 264321 - RNA, 64 nt, hsa
auugcugugacagugauggcgaaagaggguaauaaccagacacaaacugccaaguuggguggag

SEQ ID NO: 264322 - RNA, 64 nt, hsa
gcuccuucaacaaggcuugcugcagauacuacugaccagacaagcuguugaccaggcaccuccc

SEQ ID NO: 264323 - RNA, 64 nt, hsa
cagcugcagaccgccccucaccaacccagagaaccugcuuuacuuugcccagggacuuccuccc

SEQ ID NO: 264324 - RNA, 64 nt, hsa
gaugucgagaggcaccacggccucacccaggcaucugcuuuacucuggaccauaggaaacaaga

SEQ ID NO: 264325 - RNA, 64 nt, hsa
ugcauacaaacuaugucucugacaugcacauacacugcuuuauaaugaaaaugaggacacuuuc

SEQ ID NO: 264326 - RNA, 64 nt, hsa
cuuacuuacccuauuauggcucccaagaaaguuccugcuuuaguguuuuguucccucugcccca

SEQ ID NO: 264327 - RNA, 64 nt, hsa
cuugcaaacuuucacauuaagaaugugccugaggcugcuuuacucuggaauagucucagaucua

SEQ ID NO: 264328 - RNA, 64 nt, hsa
aaauaauuuuuuaaaacuuacaacacuccgaguucugcuuuauucucuagcaauccacaguaca

SEQ ID NO: 264329 - RNA, 64 nt, hsa
guuggucucgaacuccugaccucaggugaucagccugcuuuagccucccagagugcugggauua

SEQ ID NO: 264330 - RNA, 64 nt, hsa
uaauguauacagcuaaaaaaucacaauuuuuuuacugcuuuaauucuacuuaauuuugguagau

SEQ ID NO: 264331 - RNA, 64 nt, hsa
uguuuuguugggcagugccugauaagcuucaaagcugcuuuauucaauaaaaaaaagaaaugaa

SEQ ID NO: 264332 - RNA, 64 nt, hsa
caacugacgauuucccugguuuuagucugcgucucugcuuuaaaguuauugugauauccuucua

SEQ ID NO: 264333 - RNA, 64 nt, hsa
aauuuuacuagauauuugucauucaaguuuucaucugcuuuauaauugauacaccuugaggguc

SEQ ID NO: 264334 - RNA, 64 nt, hsa
cuaacuucauuaccuuaaaggcuagaacauuauucugcuuuauuuauauggcuuucucacuuuu

SEQ ID NO: 264335 - RNA, 64 nt, hsa
ucucucuugccaaagugugcuucagaaauauauacugcuuuaaaaaagaauaaaagaauauccu

SEQ ID NO: 264336 - RNA, 64 nt, hsa
caguuauaguaagaaaaagguuuuuccccuugugcugcuuuauaauuuagcgugugucugaacc

SEQ ID NO: 264337 - RNA, 64 nt, hsa
gaucuuuaacccaccuaaaauuuuauagugaaaccugcuuuauauuguuguucugaagcuuaca

SEQ ID NO: 264338 - RNA, 64 nt, hsa
uuaagaguuuuauaccuugagcagauacaaugaucugcuuuagugagaggacaauuucugauug

SEQ ID NO: 264339 - RNA, 64 nt, hsa
uuuuagaaacccauuuucuuggucauuuauaaagcugcuuuauagauaucuuugauccuggcau

SEQ ID NO: 264340 - RNA, 64 nt, hsa
aauaccagcacuuuuucauggcuuuuagguuauucugcuuuagugcauccagacugguggaguc

SEQ ID NO: 264341 - RNA, 64 nt, hsa
uugaauuucuguaguuugaaaauacgacuuuaagcugcuuuaguaaaacacuuccauuuugugu

SEQ ID NO: 264342 - RNA, 64 nt, hsa
uccagauuucuaaaugaaauguuucacuauaacgcugcuuuagaaugaaggucuuccagaagcc

SEQ ID NO: 264343 - RNA, 64 nt, hsa
gacaggacaaauaaucauuacuuucaauucaugacugcuuuauauucauuugaugaaaucauuu

SEQ ID NO: 264344 - RNA, 64 nt, hsa
uguaaaacuguuuauaagcaguguuugagagggucugcuuuaccauuacccccucaauaucaug

SEQ ID NO: 264345 - RNA, 64 nt, hsa
uguaaauacagugaccauguuaaccuacccugcacugcuuuaagugaacauacuuugaaaaagc

SEQ ID NO: 264346 - RNA, 64 nt, hsa
aacccggagaggcucugggcugauucagagguuacugcuuuauauucguccaaacuguguuagu

SEQ ID NO: 264347 - RNA, 64 nt, hsa
gugagcaagcgugauuaugaugaggaagcccccucugcuuuaauccacacaaggaacguaaccu

SEQ ID NO: 264348 - RNA, 64 nt, hsa
ugucuacuaugcuguuuccuuguuccugcuagugcugcuuuacaaaugcagaccauucuaucau

SEQ ID NO: 264349 - RNA, 64 nt, hsa
uguuaagaaggguauucaugugucuuugcucuuucugcuuuaugccucaguuugguuuaaaaac

SEQ ID NO: 264350 - RNA, 64 nt, hsa
uauuuuugauaacggcucuuaaacuuuaaaauaccugcuuuauuucauuuugacucuuggaauu

SEQ ID NO: 264351 - RNA, 64 nt, hsa
aaaaaugccucagcagaaucuguuuuuauguugacugcuuuauguugaauauuuucuuccacaa

SEQ ID NO: 264352 - RNA, 64 nt, hsa
ugauuugcaguguucaucaguauuuuucugaacccugcuuuaccauuuucuauauugccaaguu

SEQ ID NO: 264353 - RNA, 64 nt, hsa
gccuaugagggccucguuuauuaagaucuuuaaacugcuuuauacacugucacguggcuucauc

SEQ ID NO: 264354 - RNA, 64 nt, hsa
guugcacuaaaaaguggauuacaaaucuccucgacugcuuuaguggggaaaggaaucaauuauu

SEQ ID NO: 264355 - RNA, 64 nt, hsa
gccuggucucugaaggcauuugaguuugccucuucugcuuuaaucucauccugacaggaggggu

SEQ ID NO: 264356 - RNA, 64 nt, hsa
gagacgggagucaaaaucagcaucccucagauaacugcuuuaugggcuaaaaacaagcacagca

SEQ ID NO: 264357 - RNA, 64 nt, hsa
aggcacacuuguaggaaaauuaggaucaugaguccugcuuuaaguauuugcaguguaguaagag

SEQ ID NO: 264358 - RNA, 64 nt, hsa
aaaccaggugccuucucaugauggaagacagauucugcuuuaaauuaaaaaaaaaaaaaaaucu

SEQ ID NO: 264359 - RNA, 64 nt, hsa
uugcaguaugcuccacgugguaagauccuccaagcugcuuuagaaguaacaaugaagaacgugg

SEQ ID NO: 264360 - RNA, 64 nt, hsa
ucaauguuuaaugcugugguugauauuucgaaagcugcuuuaaaaaaauacaugcaucucagcg

SEQ ID NO: 264361 - RNA, 64 nt, hsa
gugaccauguaccuuccuuuuuaagaaaaauaaacugcuuuauggaaguugguagcuguggagu

SEQ ID NO: 264362 - RNA, 64 nt, hsa
guuacgcuaacuccaaaaggcugucuaggaugagcugcuuuaucagggagcuccuuguacccau

SEQ ID NO: 264363 - RNA, 64 nt, hsa
acuaaaauaaguuuggcugacaguuuuuguauaccugcuuuaauguuuauaaaauuuuuauuga

SEQ ID NO: 264364 - RNA, 64 nt, hsa
uauaguaaaaugcacagagguuaaguauucuuaccugcuuuaauuuugaaacagauuuuuauug

SEQ ID NO: 264365 - RNA, 64 nt, hsa
cuggaauaaggcagcaucacggaaauucuguaaggacugacacagagagcucaugcugacugug

SEQ ID NO: 264366 - RNA, 64 nt, hsa
gugacgucacuccugucucucuuugcuuucuucugacugacauuuauucagccuucucuacagg

SEQ ID NO: 264367 - RNA, 64 nt, hsa
agcagugaagacugacaaaucagauauucccaaugacugacagcuucucaucuugccucuaccu

SEQ ID NO: 264368 - RNA, 64 nt, hsa
gaaauagguucugccagucuacaauagcagugaagacugacaaaucagauauucccaaugacug

SEQ ID NO: 264369 - RNA, 64 nt, hsa
aaaaaaacaacuaccuucuguccuagaagacacagacugacagauggggugaaggccuggggac

SEQ ID NO: 264370 - RNA, 64 nt, hsa
gccugaggcucgauuugccucucugguccaaugggacugacacuguuguacaaccugaccugug

SEQ ID NO: 264371 - RNA, 64 nt, hsa
uccuuuugucuaccuaacauugacuuaugucuuagacugacacuguuuuaggcuuuucacuagg

SEQ ID NO: 264372 - RNA, 64 nt, hsa
auugaguaggggcuucaugcucacaacucgaacugacugacaauguggcaauagucuuagucuu

SEQ ID NO: 264373 - RNA, 64 nt, hsa
uuucaugugcuuggaaacuugcaguagaaucagggacugacaucgcaguuccucuccucucuuc

SEQ ID NO: 264374 - RNA, 64 nt, hsa
cugaaagcauaaacucuagaggugacucagucaggacugacaguaaugugauaauugccuucau

SEQ ID NO: 264375 - RNA, 64 nt, hsa
cucucccccucagccuguggguggcacgagcaaggacugacauccgcacagggaggauugucug

SEQ ID NO: 264376 - RNA, 64 nt, hsa
agggugccacaucaguccccuccccaaccucagugacugacagaggauccggaucucagagccu

SEQ ID NO: 264377 - RNA, 64 nt, hsa; identical to SEQ ID NO: 73410

SEQ ID NO: 264378 - RNA, 64 nt, hsa; identical to SEQ ID NO: 73411

SEQ ID NO: 264379 - RNA, 64 nt, hsa; identical to SEQ ID NO: 73412

SEQ ID NO: 264380 - RNA, 64 nt, hsa; identical to SEQ ID NO: 73413

SEQ ID NO: 264381 - RNA, 64 nt, hsa; identical to SEQ ID NO: 73414

SEQ ID NO: 264382 - RNA, 64 nt, hsa; identical to SEQ ID NO: 73415

SEQ ID NO: 264383 - RNA, 64 nt, hsa; identical to SEQ ID NO: 73416

SEQ ID NO: 264384 - RNA, 64 nt, hsa; identical to SEQ ID NO: 73417

SEQ ID NO: 264385 - RNA, 64 nt, hsa; identical to SEQ ID NO: 73418

SEQ ID NO: 264386 - RNA, 64 nt, hsa; identical to SEQ ID NO: 73419

SEQ ID NO: 264387 - RNA, 64 nt, hsa; identical to SEQ ID NO: 74296

SEQ ID NO: 264388 - RNA, 64 nt, hsa; identical to SEQ ID NO: 74297

SEQ ID NO: 264389 - RNA, 64 nt, hsa; identical to SEQ ID NO: 74298

SEQ ID NO: 264390 - RNA, 64 nt, hsa; identical to SEQ ID NO: 74299

SEQ ID NO: 264391 - RNA, 64 nt, hsa; identical to SEQ ID NO: 74300

SEQ ID NO: 264392 - RNA, 64 nt, hsa; identical to SEQ ID NO: 74301

SEQ ID NO: 264393 - RNA, 64 nt, hsa; identical to SEQ ID NO: 74302

SEQ ID NO: 264394 - RNA, 64 nt, hsa; identical to SEQ ID NO: 74303

SEQ ID NO: 264395 - RNA, 64 nt, hsa; identical to SEQ ID NO: 74304

SEQ ID NO: 264396 - RNA, 64 nt, hsa; identical to SEQ ID NO: 74305

SEQ ID NO: 264397 - RNA, 64 nt, hsa; identical to SEQ ID NO: 74306

SEQ ID NO: 264398 - RNA, 64 nt, hsa; identical to SEQ ID NO: 74307

SEQ ID NO: 264399 - RNA, 64 nt, hsa; identical to SEQ ID NO: 74308

SEQ ID NO: 264400 - RNA, 64 nt, hsa; identical to SEQ ID NO: 74309

SEQ ID NO: 264401 - RNA, 64 nt, hsa; identical to SEQ ID NO: 74310

SEQ ID NO: 264402 - RNA, 64 nt, hsa; identical to SEQ ID NO: 74311

SEQ ID NO: 264403 - RNA, 64 nt, hsa; identical to SEQ ID NO: 74312

SEQ ID NO: 264404 - RNA, 64 nt, hsa; identical to SEQ ID NO: 74313

SEQ ID NO: 264405 - RNA, 64 nt, hsa; identical to SEQ ID NO: 87364

SEQ ID NO: 264406 - RNA, 64 nt, hsa; identical to SEQ ID NO: 87365

SEQ ID NO: 264407 - RNA, 64 nt, hsa; identical to SEQ ID NO: 87366

SEQ ID NO: 264408 - RNA, 64 nt, hsa; identical to SEQ ID NO: 87367

SEQ ID NO: 264409 - RNA, 64 nt, hsa; identical to SEQ ID NO: 87368

SEQ ID NO: 264410 - RNA, 64 nt, hsa; identical to SEQ ID NO: 87369

SEQ ID NO: 264411 - RNA, 64 nt, hsa; identical to SEQ ID NO: 87370

SEQ ID NO: 264412 - RNA, 64 nt, hsa; identical to SEQ ID NO: 87371

SEQ ID NO: 264413 - RNA, 64 nt, hsa; identical to SEQ ID NO: 87372

SEQ ID NO: 264414 - RNA, 64 nt, hsa; identical to SEQ ID NO: 87373

SEQ ID NO: 264415 - RNA, 64 nt, hsa; identical to SEQ ID NO: 87374

SEQ ID NO: 264416 - RNA, 64 nt, hsa; identical to SEQ ID NO: 87375

SEQ ID NO: 264417 - RNA, 64 nt, hsa; identical to SEQ ID NO: 87376

SEQ ID NO: 264418 - RNA, 64 nt, hsa; identical to SEQ ID NO: 87377

SEQ ID NO: 264419 - RNA, 64 nt, hsa; identical to SEQ ID NO: 87378

SEQ ID NO: 264420 - RNA, 64 nt, hsa; identical to SEQ ID NO: 87379

SEQ ID NO: 264421 - RNA, 64 nt, hsa; identical to SEQ ID NO: 87380

SEQ ID NO: 264422 - RNA, 64 nt, hsa; identical to SEQ ID NO: 87381

SEQ ID NO: 264423 - RNA, 64 nt, hsa; identical to SEQ ID NO: 87382

SEQ ID NO: 264424 - RNA, 64 nt, hsa; identical to SEQ ID NO: 87383

SEQ ID NO: 264425 - RNA, 64 nt, hsa; identical to SEQ ID NO: 87384

SEQ ID NO: 264426 - RNA, 64 nt, hsa; identical to SEQ ID NO: 87385

SEQ ID NO: 264427 - RNA, 64 nt, hsa; identical to SEQ ID NO: 87386

SEQ ID NO: 264428 - RNA, 64 nt, hsa; identical to SEQ ID NO: 87387

SEQ ID NO: 264429 - RNA, 64 nt, hsa; identical to SEQ ID NO: 87388

SEQ ID NO: 264430 - RNA, 64 nt, hsa; identical to SEQ ID NO: 87389

SEQ ID NO: 264431 - RNA, 64 nt, hsa; identical to SEQ ID NO: 87390

SEQ ID NO: 264432 - RNA, 64 nt, hsa; identical to SEQ ID NO: 87391

SEQ ID NO: 264433 - RNA, 64 nt, hsa; identical to SEQ ID NO: 87392

SEQ ID NO: 264434 - RNA, 64 nt, hsa; identical to SEQ ID NO: 87393

SEQ ID NO: 264435 - RNA, 64 nt, hsa; identical to SEQ ID NO: 87394

SEQ ID NO: 264436 - RNA, 64 nt, hsa; identical to SEQ ID NO: 87395

SEQ ID NO: 264437 - RNA, 64 nt, hsa; identical to SEQ ID NO: 87396

SEQ ID NO: 264438 - RNA, 64 nt, hsa; identical to SEQ ID NO: 87397

SEQ ID NO: 264439 - RNA, 64 nt, hsa; identical to SEQ ID NO: 87398

SEQ ID NO: 264440 - RNA, 64 nt, hsa; identical to SEQ ID NO: 87399

SEQ ID NO: 264441 - RNA, 64 nt, hsa; identical to SEQ ID NO: 87400

SEQ ID NO: 264442 - RNA, 64 nt, hsa; identical to SEQ ID NO: 87401

SEQ ID NO: 264443 - RNA, 64 nt, hsa; identical to SEQ ID NO: 87402

SEQ ID NO: 264444 - RNA, 64 nt, hsa; identical to SEQ ID NO: 87403

SEQ ID NO: 264445 - RNA, 64 nt, hsa; identical to SEQ ID NO: 87404

SEQ ID NO: 264446 - RNA, 64 nt, hsa; identical to SEQ ID NO: 87405

SEQ ID NO: 264447 - RNA, 64 nt, hsa; identical to SEQ ID NO: 87406

SEQ ID NO: 264448 - RNA, 64 nt, hsa
augccaccccaagcguaauuuuagccagcaguuucaguuauacucaaccaugcccuucugagcu

SEQ ID NO: 264449 - RNA, 64 nt, hsa
aggcacuugccauuaauccuaauucagugcuauccaguuauaaauggaaucuugagacaaaacc

SEQ ID NO: 264450 - RNA, 64 nt, hsa
aaauaggcuuuuuaaucaugaauaugaugacaaucaguuauacaguuauaaaauuaaaaguuug

SEQ ID NO: 264451 - RNA, 64 nt, hsa
uuuuuaaucaugaauaugaugacaaucaguuauacaguuauaaaauuaaaaguuugaaaagcaa

SEQ ID NO: 264452 - RNA, 64 nt, hsa
uuuuuauguuuccuuuaugccaaacauaacaaaacaguuauauagacugcuuuagcaaaguaca

SEQ ID NO: 264453 - RNA, 64 nt, hsa
uaauacaauauuuuauuuuaauauaaacaucugucaguuauagacaaagauaauaauucacaaa

SEQ ID NO: 264454 - RNA, 64 nt, hsa
uaaagaagcuuucaugauuagauuugagcuauaucaguuauaccgauuauaccuuauaauacac

SEQ ID NO: 264455 - RNA, 64 nt, hsa
auugggacucaacucuuugaaaacaccuauugagcaguuauaccuguugagcaguuuacuuccu

SEQ ID NO: 264456 - RNA, 64 nt, hsa
uggaagcgguggucagaagguuguuuuauacgagaacaggcagaaagugcccauuguucaggau

SEQ ID NO: 264457 - RNA, 64 nt, hsa
auguguuuuauuuugaagugagaaaaugaacauuaacaggcauguuuguacagcuagaauauau

SEQ ID NO: 264458 - RNA, 64 nt, hsa
accuguguccgugccguccggcucccugggugggaacaggcaagggaucagaugccccugacac

SEQ ID NO: 264459 - RNA, 64 nt, hsa
uauguuacucucuuuaaaaucuguucccauauugaacaggcagauuggaaaagcuaugguucga

SEQ ID NO: 264460 - RNA, 64 nt, hsa
augacucagcagggaugacucagcaccgccccucaacaggcaugacucugcagagaugacucag

SEQ ID NO: 264461 - RNA, 64 nt, hsa
augacucagcagggaugacucagcaccgccccucaacaggcaugacucugcagagaugacuuag

SEQ ID NO: 264462 - RNA, 64 nt, hsa; identical to SEQ ID NO: 264460

SEQ ID NO: 264463 - RNA, 62 nt, hsa
gaaauuaaccaggaagauguuuccaccaagccugcugugagucaauugagggaguguuuggg

SEQ ID NO: 264464 - RNA, 62 nt, hsa
gcuggggugggcagggaagggaagccgggggcugcugugagggaucuuggagcuucccugua

SEQ ID NO: 264465 - RNA, 62 nt, hsa
auacgacaguguuccaaaucccaucaacaaaaugcugugaacaacaacaacaaaaaauaaau

SEQ ID NO: 264466 - RNA, 62 nt, hsa
aacacugcucgcuacaagcuggccguggcagaugcugugauugagaaguuugccccaauuaa

SEQ ID NO: 264467 - RNA, 62 nt, hsa
aagucagucuauguacauacugcuuauugaugugcugugauaugagggaaucugaaauguuu

SEQ ID NO: 264468 - RNA, 62 nt, hsa
agcguuccuuauucuuugagggaaacugugcuugcugugauccauuuugucucuagcuucua

SEQ ID NO: 264469 - RNA, 62 nt, hsa
ccacagaucaaucucugcagaugacagggaggugcugugagaagugcaccaggcagcuuucu

SEQ ID NO: 264470 - RNA, 62 nt, hsa
gaaccugggcuguggcucucugucguuuguggugcugugauggugucuacuguuagaauagc

SEQ ID NO: 264471 - RNA, 62 nt, hsa
ugugcauguucuuagccaccgccucccuccuuugcugugacaucaccacucuuuccugaugc

SEQ ID NO: 264472 - RNA, 62 nt, hsa
aauauuugguauuucuuuuaaaguauuuuuugugcugugaacauuuucugccaaagaccaug

SEQ ID NO: 264473 - RNA, 62 nt, hsa
caaacucccgaucucaagccacccucccaaaaugcugugauuauaggccagagccauuguuc

SEQ ID NO: 264474 - RNA, 62 nt, hsa
cgcaguguugggcuuggugacuggagcaaagcugcugugagagaguguccuuucccaucugu

SEQ ID NO: 264475 - RNA, 62 nt, hsa
acuacuccacguguuuuuccauccaaucacacugcugugauucagggaucuuucuucuaaga

SEQ ID NO: 264476 - RNA, 62 nt, hsa
uuuucagugagcguggugacugcagagguuagugcugugaaaagcugggcuaaauauucuuu

SEQ ID NO: 264477 - RNA, 62 nt, hsa
ucugaaaaggccugggagcagaauggcuggccugcugugagcaggagaggagauucuaagaa

SEQ ID NO: 264478 - RNA, 62 nt, hsa
uuaccuuugcuccucuccugugauucccaccaugcugugacccucagcugucucccuuugcu

SEQ ID NO: 264479 - RNA, 62 nt, hsa
uuagccuccugagcaucugggacuacagccauugcugugaauuacgugagggaaagauauug

SEQ ID NO: 264480 - RNA, 62 nt, hsa
ugcauucugcgagucugugcucauuaacaaugugcugugaccaugugacucagcaauccugc

SEQ ID NO: 264481 - RNA, 62 nt, hsa
ugucccacuuuuuuaaccacuccgcacaucagugcugugaaggcaaccucaccauguauuuu

SEQ ID NO: 264482 - RNA, 62 nt, hsa
aaugucauacaaaaaauguauuuguuuuuuugugcugugagaauugauguuuguagauuaau

SEQ ID NO: 264483 - RNA, 62 nt, hsa
ucugccaggccucgagcauccaagcaugauuuugcugugacaaaucuaaaaucaaccaggcu

SEQ ID NO: 264484 - RNA, 62 nt, hsa
gccaggccccaagcaucugagcaugaugauuuugcugugacaauucuaagaucaaccagguu

SEQ ID NO: 264485 - RNA, 62 nt, hsa
ucuguuguacuuuaauuauuguuuugccuuguugcugugaccucccuaagacacugaagaua

SEQ ID NO: 264486 - RNA, 62 nt, hsa
aaaagucaucuguucauuaggagaacucaaguugcugugacuuuucucauccaaaagacuca

SEQ ID NO: 264487 - RNA, 62 nt, hsa
aggauccucaccacccaaaggguggugggcacugcugugaccaccccagcugcagagucagu

SEQ ID NO: 264488 - RNA, 62 nt, hsa
cuuuaggcaccaucuguucccaucgcgccugcugcugugacccguuuuggaaaacuggugug

SEQ ID NO: 264489 - RNA, 62 nt, hsa
gagggucuugucugcugugauucgacucuggaugcugugagcuugaugcuggccagggaagc

SEQ ID NO: 264490 - RNA, 62 nt, hsa
uccccggguugguggccauggagggucuugucugcugugauucgacucuggaugcugugagc

SEQ ID NO: 264491 - RNA, 62 nt, hsa
gccccaccuugcagcuaaaugugauccugccuugcugugaaauuucuguaccuucaaccugg

SEQ ID NO: 264492 - RNA, 62 nt, hsa
cacuccccacccugcucccuucccagagggauugcugugaaauuuuuuugguggcaaauaaa

SEQ ID NO: 264493 - RNA, 62 nt, hsa
acauuuuguguagacaauuuuaaugucagugcugcugugaacuaaaguaugucauuuaugcu

SEQ ID NO: 264494 - RNA, 62 nt, hsa
auagauggagaguuugagggcuuucgcagaaaugcugugauucuguuuuaaguccauaccuu

SEQ ID NO: 264495 - RNA, 62 nt, hsa
aaugaccauuguuuauaaacaguuaugaaaaaugcugugacuugaaaucuuucccacaucuc

SEQ ID NO: 264496 - RNA, 62 nt, hsa
gaguuguuuucaguuuuuugcccuaauaaagcugcugugaacauucauguacagguuuuuau

SEQ ID NO: 264497 - RNA, 62 nt, hsa
ucuuagcauucaaacugcagauacuaaacagaugcugugauuuauuaaagaguuagccauau

SEQ ID NO: 264498 - RNA, 62 nt, hsa
ggccuugcagagcucaagaagggggcuuccaaugcugugagaauuccgagcuguucccuggg

SEQ ID NO: 264499 - RNA, 62 nt, hsa
uugugcaaccagggcccacggcgccccuccugugcugugacgugugugucguggcuggcccc

SEQ ID NO: 264500 - RNA, 62 nt, hsa
gccuaccgcccuggccgugucugucuggugugugcugugaaccccugcacccaaccccacau

SEQ ID NO: 264501 - RNA, 62 nt, hsa
cugcagacgucugguggcagcgucuacuccauugcugugacaaaucaccacauugucugugg

SEQ ID NO: 264502 - RNA, 62 nt, hsa
uggccuugagguuggugugcacaggcacuggcugcugugagugggggggcauggggcaguuu

SEQ ID NO: 264503 - RNA, 62 nt, hsa
cagggugccugaccugugugccggcugcucacugcugugaccagcagccgagcccuuggccc

SEQ ID NO: 264504 - RNA, 62 nt, hsa
cggugccucggucacucugggggcaguuuagaugcugugaaauuaaaccuguucuaagugua

SEQ ID NO: 264505 - RNA, 62 nt, hsa
aacuuagaugugaaaaucuacacacugggagaugcugugagccccaagguuuugauggaguu

SEQ ID NO: 264506 - RNA, 62 nt, hsa
ucauuugcaaaacacacauaauaccgucagagugcugugaaaaaccuuaaggguguguggau

SEQ ID NO: 264507 - RNA, 62 nt, hsa
aaagaaguacagauuuuuuaaaaagcuaauauugcugugauucaacucucuaguuacuugau

SEQ ID NO: 264508 - RNA, 62 nt, hsa
ccucaugcucugcccagcuuggcuucccaaagugcugugauuacaggcuuaagccacagcgc

SEQ ID NO: 264509 - RNA, 62 nt, hsa
uacacuuucccacguugaggugguguguucugugcugugacuauagaaaucuuggucagggc

SEQ ID NO: 264510 - RNA, 62 nt, hsa
cuguguauuguuuaagcucgccaagucuguguugcugugaaaugaaugaaggagaggcuccu

SEQ ID NO: 264511 - RNA, 62 nt, hsa
aaguagccaucuccuuguuccagcugaaaaccugcugugagaguuuugacagagcacuuuau

SEQ ID NO: 264512 - RNA, 62 nt, hsa
aggacauuccuucuaugagcgcuucagaauuuugcugugaacaguccucuuggacacagguu

SEQ ID NO: 264513 - RNA, 64 nt, hsa
agcccuccuacgcagaugcugucacuggcagagcacagcccacggggaucacagcguuucagga

SEQ ID NO: 264514 - RNA, 64 nt, hsa
ccuggucgucuaucccaguguguguuuaacauucacagcccagaaccacagaugugucugggag

SEQ ID NO: 264515 - RNA, 64 nt, hsa
acgcgcuugcugaaacgacuccaacagcuaguucacagcccagcuuuguacguugguuaccaua

SEQ ID NO: 264516 - RNA, 64 nt, hsa
guggagcaggaucuucauucaucucaccagagcaacagcccaguccugaggaugggagggacgu

SEQ ID NO: 264517 - RNA, 64 nt, hsa
uuccccagaaacgaucaagaagggcaauggguugacagcccagauauggcaggaccagacugca

SEQ ID NO: 264518 - RNA, 64 nt, hsa
auauggcaggaccagacugcaaugggaaucucauacagcccauucagacuaaagggugauggaa

SEQ ID NO: 264519 - RNA, 64 nt, hsa
ugguccagagagggucugggauucccaaggucacacagcccagaagagauggggcuggguuaag

SEQ ID NO: 264520 - RNA, 64 nt, hsa
agccauuaagggggcucaucuaggaauucugguuacagcccagugcucaucccagcguaugcug

SEQ ID NO: 264521 - RNA, 64 nt, hsa
ccugcccccagccuggcuggacagcaaggaauccacagcccacacgugagcucccuccucaccc

SEQ ID NO: 264522 - RNA, 64 nt, hsa
cccgggccacaauagggacagggcagggacagggacagcccaggucacacguggggucagcaga

SEQ ID NO: 264523 - RNA, 64 nt, hsa
gccaccgucuacagauggcuuaguuaagucauccacagcccaagggcggggcuaugccuugucu

SEQ ID NO: 264524 - RNA, 64 nt, hsa
ccuaguggcuuccuccgucugcaaugucccuugcacagcccacacaugaaccauccuucccaug

SEQ ID NO: 264525 - RNA, 64 nt, hsa
aucacagacgaguggccaccggaaucacccgauaacagcccaucacaacuccaaagcccuugug

SEQ ID NO: 264526 - RNA, 64 nt, hsa
cugcacccuguuugcucgcagaccucccauugccacagcccaagcaccuucuucaacucuccca

SEQ ID NO: 264527 - RNA, 64 nt, hsa
ucagccacagcagagccaaucacagacccaccacacagcccagcagcccuucgugaauccugca

SEQ ID NO: 264528 - RNA, 64 nt, hsa
ccauugaaaauaucucugugucuguccaccagccacagcccaaacacaucaaacuugcuaagcg

SEQ ID NO: 264529 - RNA, 64 nt, hsa
gcacagcccacccacuuuccucugcuucccuggcacagcccaggcauagacgagcuggcguugg

SEQ ID NO: 264530 - RNA, 64 nt, hsa
cagugccuuuuaagggggaccucaccuccugugcacagcccacccacuuuccucugcuucccug

SEQ ID NO: 264531 - RNA, 64 nt, hsa
gaugcugggaacaaaggccucuugaagcccagccacagcccagcugagcaugaggcccagccca

SEQ ID NO: 264532 - RNA, 64 nt, hsa
acaccugcuguuccuggagucgaaggacaagcccacagcccagauuccgguucucccaacucag

SEQ ID NO: 264533 - RNA, 64 nt, hsa
cuaggaaugcgccauggcugcuaugacaauuugcacagcccaguggcuuaaacaccauuuauac

SEQ ID NO: 264534 - RNA, 64 nt, hsa
ccuggcuguccggaugaaguaccagagugacgccacagcccaucccggugacaugcucaccccc

SEQ ID NO: 264535 - RNA, 64 nt, hsa
uggcuuugccauaauucagugucaccaauaaggcacagcccaguuagcagcuuagccccccuag

SEQ ID NO: 264536 - RNA, 64 nt, hsa
agcuagugaggcauaauuugcucaaaguauagaaacagcccaccugugcccacuuugaccauug

SEQ ID NO: 264537 - RNA, 64 nt, hsa
gggcaccccgacguagcugccccccuggggggccacagcccagagaaccagccuaggaacacuc

SEQ ID NO: 264538 - RNA, 64 nt, hsa
accuuccgcaccagagggacacuccacagaagccacagcccaguaagucaggcgcuucugcggc

SEQ ID NO: 264539 - RNA, 64 nt, hsa
cccccauacccugcugucuccacggagggaggucacagcccaucacgcaggacacugugauugu

SEQ ID NO: 264540 - RNA, 64 nt, hsa
ugcuugagucacugaaaucaaaguacucaggcacacagcccacugacaagagacaccucaucca

SEQ ID NO: 264541 - RNA, 64 nt, hsa
uggggaaaucgauuucacaauccaaaaauggcccacagcccaggaagcuacccugaacaugcca

SEQ ID NO: 264542 - RNA, 64 nt, hsa
ccuucaggcaugcaauaugccagaacuacagacaacagcccacaggaugcaaaagugcuuugcc

SEQ ID NO: 264543 - RNA, 64 nt, hsa; identical to SEQ ID NO: 49894

SEQ ID NO: 264544 - RNA, 64 nt, hsa; identical to SEQ ID NO: 49895

SEQ ID NO: 264545 - RNA, 64 nt, hsa; identical to SEQ ID NO: 49896

SEQ ID NO: 264546 - RNA, 64 nt, hsa; identical to SEQ ID NO: 49897

SEQ ID NO: 264547 - RNA, 64 nt, hsa; identical to SEQ ID NO: 49898

SEQ ID NO: 264548 - RNA, 64 nt, hsa; identical to SEQ ID NO: 49899

SEQ ID NO: 264549 - RNA, 64 nt, hsa; identical to SEQ ID NO: 49900

SEQ ID NO: 264550 - RNA, 64 nt, hsa; identical to SEQ ID NO: 49901

SEQ ID NO: 264551 - RNA, 64 nt, hsa; identical to SEQ ID NO: 49902

SEQ ID NO: 264552 - RNA, 64 nt, hsa; identical to SEQ ID NO: 49903

SEQ ID NO: 264553 - RNA, 64 nt, hsa; identical to SEQ ID NO: 49904

SEQ ID NO: 264554 - RNA, 64 nt, hsa; identical to SEQ ID NO: 49905

SEQ ID NO: 264555 - RNA, 64 nt, hsa; identical to SEQ ID NO: 49906

SEQ ID NO: 264556 - RNA, 64 nt, hsa; identical to SEQ ID NO: 49907

SEQ ID NO: 264557 - RNA, 64 nt, hsa; identical to SEQ ID NO: 49908

SEQ ID NO: 264558 - RNA, 64 nt, hsa; identical to SEQ ID NO: 49909

SEQ ID NO: 264559 - RNA, 64 nt, hsa; identical to SEQ ID NO: 49910

SEQ ID NO: 264560 - RNA, 64 nt, hsa; identical to SEQ ID NO: 49911

SEQ ID NO: 264561 - RNA, 64 nt, hsa; identical to SEQ ID NO: 49912

SEQ ID NO: 264562 - RNA, 64 nt, hsa; identical to SEQ ID NO: 49913

SEQ ID NO: 264563 - RNA, 64 nt, hsa; identical to SEQ ID NO: 49914

SEQ ID NO: 264564 - RNA, 64 nt, hsa; identical to SEQ ID NO: 49915

SEQ ID NO: 264565 - RNA, 64 nt, hsa; identical to SEQ ID NO: 49916

SEQ ID NO: 264566 - RNA, 64 nt, hsa; identical to SEQ ID NO: 49917

SEQ ID NO: 264567 - RNA, 64 nt, hsa; identical to SEQ ID NO: 49918

SEQ ID NO: 264568 - RNA, 64 nt, hsa; identical to SEQ ID NO: 49919

SEQ ID NO: 264569 - RNA, 64 nt, hsa; identical to SEQ ID NO: 49920

SEQ ID NO: 264570 - RNA, 64 nt, hsa; identical to SEQ ID NO: 49921

SEQ ID NO: 264571 - RNA, 52 nt, hsa; identical to SEQ ID NO: 49922

SEQ ID NO: 264572 - RNA, 64 nt, hsa; identical to SEQ ID NO: 49923

SEQ ID NO: 264573 - RNA, 64 nt, hsa; identical to SEQ ID NO: 49924

SEQ ID NO: 264574 - RNA, 64 nt, hsa; identical to SEQ ID NO: 49925

SEQ ID NO: 264575 - RNA, 64 nt, hsa; identical to SEQ ID NO: 49926

SEQ ID NO: 264576 - RNA, 64 nt, hsa; identical to SEQ ID NO: 49927

SEQ ID NO: 264577 - RNA, 64 nt, hsa; identical to SEQ ID NO: 49928

SEQ ID NO: 264578 - RNA, 64 nt, hsa; identical to SEQ ID NO: 49929

SEQ ID NO: 264579 - RNA, 64 nt, hsa; identical to SEQ ID NO: 49930

SEQ ID NO: 264580 - RNA, 64 nt, hsa; identical to SEQ ID NO: 49931

SEQ ID NO: 264581 - RNA, 64 nt, hsa; identical to SEQ ID NO: 49932

SEQ ID NO: 264582 - RNA, 64 nt, hsa; identical to SEQ ID NO: 49933

SEQ ID NO: 264583 - RNA, 64 nt, hsa; identical to SEQ ID NO: 49934

SEQ ID NO: 264584 - RNA, 64 nt, hsa; identical to SEQ ID NO: 264513

SEQ ID NO: 264585 - RNA, 64 nt, hsa; identical to SEQ ID NO: 264514

SEQ ID NO: 264586 - RNA, 64 nt, hsa; identical to SEQ ID NO: 264515

SEQ ID NO: 264587 - RNA, 64 nt, hsa; identical to SEQ ID NO: 264516

SEQ ID NO: 264588 - RNA, 64 nt, hsa; identical to SEQ ID NO: 264517

SEQ ID NO: 264589 - RNA, 64 nt, hsa; identical to SEQ ID NO: 264518

SEQ ID NO: 264590 - RNA, 64 nt, hsa; identical to SEQ ID NO: 264519

SEQ ID NO: 264591 - RNA, 64 nt, hsa; identical to SEQ ID NO: 264520

SEQ ID NO: 264592 - RNA, 64 nt, hsa; identical to SEQ ID NO: 264521

SEQ ID NO: 264593 - RNA, 64 nt, hsa; identical to SEQ ID NO: 264522

SEQ ID NO: 264594 - RNA, 64 nt, hsa; identical to SEQ ID NO: 264523

SEQ ID NO: 264595 - RNA, 64 nt, hsa; identical to SEQ ID NO: 264524

SEQ ID NO: 264596 - RNA, 64 nt, hsa; identical to SEQ ID NO: 264525

SEQ ID NO: 264597 - RNA, 64 nt, hsa; identical to SEQ ID NO: 264526

SEQ ID NO: 264598 - RNA, 64 nt, hsa; identical to SEQ ID NO: 264527

SEQ ID NO: 264599 - RNA, 64 nt, hsa; identical to SEQ ID NO: 264528

SEQ ID NO: 264600 - RNA, 64 nt, hsa; identical to SEQ ID NO: 264529

SEQ ID NO: 264601 - RNA, 64 nt, hsa; identical to SEQ ID NO: 264530

SEQ ID NO: 264602 - RNA, 64 nt, hsa; identical to SEQ ID NO: 264531

SEQ ID NO: 264603 - RNA, 64 nt, hsa; identical to SEQ ID NO: 264532

SEQ ID NO: 264604 - RNA, 64 nt, hsa; identical to SEQ ID NO: 264533

SEQ ID NO: 264605 - RNA, 64 nt, hsa; identical to SEQ ID NO: 264534

SEQ ID NO: 264606 - RNA, 64 nt, hsa; identical to SEQ ID NO: 264535

SEQ ID NO: 264607 - RNA, 64 nt, hsa; identical to SEQ ID NO: 264536

SEQ ID NO: 264608 - RNA, 64 nt, hsa; identical to SEQ ID NO: 264537

SEQ ID NO: 264609 - RNA, 64 nt, hsa; identical to SEQ ID NO: 264538

SEQ ID NO: 264610 - RNA, 64 nt, hsa; identical to SEQ ID NO: 264539

SEQ ID NO: 264611 - RNA, 64 nt, hsa; identical to SEQ ID NO: 264540

SEQ ID NO: 264612 - RNA, 64 nt, hsa; identical to SEQ ID NO: 264541

SEQ ID NO: 264613 - RNA, 64 nt, hsa; identical to SEQ ID NO: 264542

SEQ ID NO: 264614 - RNA, 64 nt, hsa; identical to SEQ ID NO: 49894

SEQ ID NO: 264615 - RNA, 64 nt, hsa; identical to SEQ ID NO: 49895

SEQ ID NO: 264616 - RNA, 64 nt, hsa; identical to SEQ ID NO: 49896

SEQ ID NO: 264617 - RNA, 64 nt, hsa; identical to SEQ ID NO: 49897

SEQ ID NO: 264618 - RNA, 64 nt, hsa; identical to SEQ ID NO: 49898

SEQ ID NO: 264619 - RNA, 64 nt, hsa; identical to SEQ ID NO: 49899

SEQ ID NO: 264620 - RNA, 64 nt, hsa; identical to SEQ ID NO: 49900

SEQ ID NO: 264621 - RNA, 64 nt, hsa; identical to SEQ ID NO: 49901

SEQ ID NO: 264622 - RNA, 64 nt, hsa; identical to SEQ ID NO: 49902

SEQ ID NO: 264623 - RNA, 64 nt, hsa; identical to SEQ ID NO: 49903

SEQ ID NO: 264624 - RNA, 64 nt, hsa; identical to SEQ ID NO: 49904

SEQ ID NO: 264625 - RNA, 64 nt, hsa; identical to SEQ ID NO: 49905

SEQ ID NO: 264626 - RNA, 64 nt, hsa; identical to SEQ ID NO: 49906

SEQ ID NO: 264627 - RNA, 64 nt, hsa; identical to SEQ ID NO: 49907

SEQ ID NO: 264628 - RNA, 64 nt, hsa; identical to SEQ ID NO: 49908

SEQ ID NO: 264629 - RNA, 64 nt, hsa; identical to SEQ ID NO: 49909

SEQ ID NO: 264630 - RNA, 64 nt, hsa; identical to SEQ ID NO: 49910

SEQ ID NO: 264631 - RNA, 64 nt, hsa; identical to SEQ ID NO: 49911

SEQ ID NO: 264632 - RNA, 64 nt, hsa; identical to SEQ ID NO: 49912

SEQ ID NO: 264633 - RNA, 64 nt, hsa; identical to SEQ ID NO: 49913

SEQ ID NO: 264634 - RNA, 64 nt, hsa; identical to SEQ ID NO: 49914

SEQ ID NO: 264635 - RNA, 64 nt, hsa; identical to SEQ ID NO: 49915

SEQ ID NO: 264636 - RNA, 64 nt, hsa; identical to SEQ ID NO: 49916

SEQ ID NO: 264637 - RNA, 64 nt, hsa; identical to SEQ ID NO: 49917

SEQ ID NO: 264638 - RNA, 64 nt, hsa; identical to SEQ ID NO: 49918

SEQ ID NO: 264639 - RNA, 64 nt, hsa; identical to SEQ ID NO: 49919

SEQ ID NO: 264640 - RNA, 64 nt, hsa; identical to SEQ ID NO: 49920

SEQ ID NO: 264641 - RNA, 64 nt, hsa; identical to SEQ ID NO: 49921

SEQ ID NO: 264642 - RNA, 52 nt, hsa; identical to SEQ ID NO: 49922

SEQ ID NO: 264643 - RNA, 64 nt, hsa; identical to SEQ ID NO: 49923

SEQ ID NO: 264644 - RNA, 64 nt, hsa; identical to SEQ ID NO: 49924

SEQ ID NO: 264645 - RNA, 64 nt, hsa; identical to SEQ ID NO: 49925

SEQ ID NO: 264646 - RNA, 64 nt, hsa; identical to SEQ ID NO: 49926

SEQ ID NO: 264647 - RNA, 64 nt, hsa; identical to SEQ ID NO: 49927

SEQ ID NO: 264648 - RNA, 64 nt, hsa; identical to SEQ ID NO: 49928

SEQ ID NO: 264649 - RNA, 64 nt, hsa; identical to SEQ ID NO: 49929

SEQ ID NO: 264650 - RNA, 64 nt, hsa; identical to SEQ ID NO: 49930

SEQ ID NO: 264651 - RNA, 64 nt, hsa; identical to SEQ ID NO: 49931

SEQ ID NO: 264652 - RNA, 64 nt, hsa; identical to SEQ ID NO: 49932

SEQ ID NO: 264653 - RNA, 64 nt, hsa; identical to SEQ ID NO: 49933

SEQ ID NO: 264654 - RNA, 64 nt, hsa; identical to SEQ ID NO: 49934

SEQ ID NO: 264655 - RNA, 64 nt, hsa; identical to SEQ ID NO: 108766

SEQ ID NO: 264656 - RNA, 64 nt, hsa; identical to SEQ ID NO: 108767

SEQ ID NO: 264657 - RNA, 64 nt, hsa; identical to SEQ ID NO: 108768

SEQ ID NO: 264658 - RNA, 64 nt, hsa; identical to SEQ ID NO: 108769

SEQ ID NO: 264659 - RNA, 64 nt, hsa; identical to SEQ ID NO: 108770

SEQ ID NO: 264660 - RNA, 64 nt, hsa; identical to SEQ ID NO: 108771

SEQ ID NO: 264661 - RNA, 64 nt, hsa; identical to SEQ ID NO: 108772

SEQ ID NO: 264662 - RNA, 64 nt, hsa; identical to SEQ ID NO: 108773

SEQ ID NO: 264663 - RNA, 64 nt, hsa; identical to SEQ ID NO: 108774

SEQ ID NO: 264664 - RNA, 64 nt, hsa; identical to SEQ ID NO: 108775

SEQ ID NO: 264665 - RNA, 64 nt, hsa; identical to SEQ ID NO: 108776

SEQ ID NO: 264666 - RNA, 64 nt, hsa; identical to SEQ ID NO: 108777

SEQ ID NO: 264667 - RNA, 64 nt, hsa; identical to SEQ ID NO: 108778

SEQ ID NO: 264668 - RNA, 64 nt, hsa; identical to SEQ ID NO: 108779

SEQ ID NO: 264669 - RNA, 64 nt, hsa; identical to SEQ ID NO: 108780

SEQ ID NO: 264670 - RNA, 64 nt, hsa; identical to SEQ ID NO: 108781

SEQ ID NO: 264671 - RNA, 64 nt, hsa; identical to SEQ ID NO: 108782

SEQ ID NO: 264672 - RNA, 64 nt, hsa; identical to SEQ ID NO: 108783

SEQ ID NO: 264673 - RNA, 64 nt, hsa; identical to SEQ ID NO: 108784

SEQ ID NO: 264674 - RNA, 64 nt, hsa; identical to SEQ ID NO: 108785

SEQ ID NO: 264675 - RNA, 64 nt, hsa; identical to SEQ ID NO: 108786

SEQ ID NO: 264676 - RNA, 64 nt, hsa; identical to SEQ ID NO: 108787

SEQ ID NO: 264677 - RNA, 64 nt, hsa; identical to SEQ ID NO: 108788

SEQ ID NO: 264678 - RNA, 64 nt, hsa; identical to SEQ ID NO: 108789

SEQ ID NO: 264679 - RNA, 64 nt, hsa; identical to SEQ ID NO: 108790

SEQ ID NO: 264680 - RNA, 64 nt, hsa; identical to SEQ ID NO: 108791

SEQ ID NO: 264681 - RNA, 64 nt, hsa; identical to SEQ ID NO: 108792

SEQ ID NO: 264682 - RNA, 64 nt, hsa; identical to SEQ ID NO: 108793

SEQ ID NO: 264683 - RNA, 64 nt, hsa; identical to SEQ ID NO: 108794

SEQ ID NO: 264684 - RNA, 64 nt, hsa; identical to SEQ ID NO: 108795

SEQ ID NO: 264685 - RNA, 64 nt, hsa; identical to SEQ ID NO: 108796

SEQ ID NO: 264686 - RNA, 64 nt, hsa; identical to SEQ ID NO: 108797

SEQ ID NO: 264687 - RNA, 64 nt, hsa; identical to SEQ ID NO: 108798

SEQ ID NO: 264688 - RNA, 64 nt, hsa; identical to SEQ ID NO: 108799

SEQ ID NO: 264689 - RNA, 64 nt, hsa; identical to SEQ ID NO: 108800

SEQ ID NO: 264690 - RNA, 64 nt, hsa; identical to SEQ ID NO: 108801

SEQ ID NO: 264691 - RNA, 64 nt, hsa; identical to SEQ ID NO: 108802

SEQ ID NO: 264692 - RNA, 64 nt, hsa; identical to SEQ ID NO: 108803

SEQ ID NO: 264693 - RNA, 64 nt, hsa; identical to SEQ ID NO: 108804

SEQ ID NO: 264694 - RNA, 64 nt, hsa; identical to SEQ ID NO: 108805

SEQ ID NO: 264695 - RNA, 64 nt, hsa; identical to SEQ ID NO: 108806

SEQ ID NO: 264696 - RNA, 64 nt, hsa; identical to SEQ ID NO: 108807

SEQ ID NO: 264697 - RNA, 64 nt, hsa; identical to SEQ ID NO: 108808

SEQ ID NO: 264698 - RNA, 64 nt, hsa; identical to SEQ ID NO: 108809

SEQ ID NO: 264699 - RNA, 64 nt, hsa; identical to SEQ ID NO: 108810

SEQ ID NO: 264700 - RNA, 64 nt, hsa; identical to SEQ ID NO: 108811

SEQ ID NO: 264701 - RNA, 64 nt, hsa; identical to SEQ ID NO: 108812

SEQ ID NO: 264702 - RNA, 64 nt, hsa; identical to SEQ ID NO: 108813

SEQ ID NO: 264703 - RNA, 64 nt, hsa; identical to SEQ ID NO: 108814

SEQ ID NO: 264704 - RNA, 64 nt, hsa; identical to SEQ ID NO: 108815

SEQ ID NO: 264705 - RNA, 64 nt, hsa; identical to SEQ ID NO: 108816

SEQ ID NO: 264706 - RNA, 64 nt, hsa; identical to SEQ ID NO: 108817

SEQ ID NO: 264707 - RNA, 64 nt, hsa; identical to SEQ ID NO: 108818

SEQ ID NO: 264708 - RNA, 64 nt, hsa; identical to SEQ ID NO: 108819

SEQ ID NO: 264709 - RNA, 64 nt, hsa; identical to SEQ ID NO: 108820

SEQ ID NO: 264710 - RNA, 64 nt, hsa; identical to SEQ ID NO: 108821

SEQ ID NO: 264711 - RNA, 64 nt, hsa; identical to SEQ ID NO: 108822

SEQ ID NO: 264712 - RNA, 64 nt, hsa; identical to SEQ ID NO: 108823

SEQ ID NO: 264713 - RNA, 64 nt, hsa; identical to SEQ ID NO: 108824

SEQ ID NO: 264714 - RNA, 64 nt, hsa; identical to SEQ ID NO: 108825

SEQ ID NO: 264715 - RNA, 63 nt, hsa
acccuauagagagggggcucuccaaaggggcugcuggggcaugugugccuguggcagaaaaga

SEQ ID NO: 264716 - RNA, 63 nt, hsa
auguccucuuuacucccuuccuggccucacuggcuggggcagaggggcagccgcuaggagaga

SEQ ID NO: 264717 - RNA, 63 nt, hsa
ggauuucuaagggucaggaggccuucaccgcugcuggggcacacacacacacaugcauacaca

SEQ ID NO: 264718 - RNA, 63 nt, hsa
gcucccagaagauaaccucuccuccugggccaccuggggcaccuuaccaccggagccgaaucu

SEQ ID NO: 264719 - RNA, 63 nt, hsa
agcuuccagcccuacauugaaccaccuucuuuccuggggcaagagcaccaggcuccagggcac

SEQ ID NO: 264720 - RNA, 63 nt, hsa
cuccuggccagcguuugaagccuggccucccaccuggggcauuuacugacacccugucgccag

SEQ ID NO: 264721 - RNA, 63 nt, hsa
aaacccccgggacuuuaccccagcaggcugccacuggggcaccgaacuaagccagcucagccu

SEQ ID NO: 264722 - RNA, 63 nt, hsa
ccgaaucuggggcaauggaaucacugcuuccagcuggggcaggugagaucuuuacgccuuuua

SEQ ID NO: 264723 - RNA, 63 nt, hsa
aagagaggccuaguuuaaaucacaauuccgaaucuggggcaauggaaucacugcuuccagcug

SEQ ID NO: 264724 - RNA, 63 nt, hsa
aucagggaggagucagaggaauuugcccaauggcuggggcaucucccuugacuuacccauaau

SEQ ID NO: 264725 - RNA, 63 nt, hsa
gguggguuuguguuuaguucagaagcggagagccuggggcacuccuccuacucuguggaugau

SEQ ID NO: 264726 - RNA, 63 nt, hsa
aacgucucagcccuucaguuuggucugcuccgccuggggcagaaagccacaaacuccauccag

SEQ ID NO: 264727 - RNA, 63 nt, hsa
uaucaauggcacgcuccugccuacccaguuccacuggggcaaggugagugagcccacagcauc

SEQ ID NO: 264728 - RNA, 63 nt, hsa
uuucuaaagcugaaugucaaacagugccaaaugcuggggcagggggugaagaacccucugucc

SEQ ID NO: 264729 - RNA, 63 nt, hsa
ccucccagcuuaaauccuagcaggagagaggcucuggggcagcccccaugggcuccugccccu

SEQ ID NO: 264730 - RNA, 63 nt, hsa
cccuugccgcccagcuguugugcugggcacagucuggggcacaggccuccaugaugaagacgc

SEQ ID NO: 264731 - RNA, 63 nt, hsa
ccgguggcuuucuauaaucaaaucaauauuguucuggggcaucacaaagaggaaggggguccc

SEQ ID NO: 264732 - RNA, 63 nt, hsa
gacccucuggcuggggcagcgcagacccucuagcuggggcagaacaaggcuggugcuuccuuc

SEQ ID NO: 264733 - RNA, 63 nt, hsa
uaggccucagcagggacagcacagacccucuggcuggggcagcgcagacccucuagcuggggc

SEQ ID NO: 264734 - RNA, 63 nt, hsa
cccaacaaaacguuuucaaaccccuuacaguuccuggggcaggcggaaacaggcucacagauu

SEQ ID NO: 264735 - RNA, 63 nt, hsa
ucaggcuggagggcgucccagccuaaucccgagcuggggcacacguauccugaggggcuuggg

SEQ ID NO: 264736 - RNA, 63 nt, hsa
cggggagcuggaagaaaagucucuuggggaccucuggggcaaggagcugagaaguccugcagc

SEQ ID NO: 264737 - RNA, 63 nt, hsa
acagaggguccugacacucuggcagggccugagcuggggcaggccucccucagggccaggggc

SEQ ID NO: 264738 - RNA, 63 nt, hsa
aaaggagcaggggcccugguguugcauuuagcccuggggcauggagcugaacaguacuugugc

SEQ ID NO: 264739 - RNA, 63 nt, hsa
agacagcuguguuccuacaauuggcccagcacccuggggcacgggagaaggguggggaccguu

SEQ ID NO: 264740 - RNA, 63 nt, hsa
ccuuccccauagagaccgugcuccaacucgggccuggggcacugcucgcugcucccaggaagg

SEQ ID NO: 264741 - RNA, 63 nt, hsa
ccuuugugugucaccucacacaccacaagggggcuggggcaucuggucccuggggccugggcc

SEQ ID NO: 264742 - RNA, 63 nt, hsa
cucuccagggagccggggcugugagaggaucaucuggggcaggcccuccacuuccaagcaagc

SEQ ID NO: 264743 - RNA, 63 nt, hsa
cuuagcaggcagcugggcauggaggugcuggggcuggggcagaugccuaauuucgcacaaugc

SEQ ID NO: 264744 - RNA, 63 nt, hsa
uuuaucaguggccagcuaccugccaggcccgggcuggggcacggucugcggccaugaggccag

SEQ ID NO: 264745 - RNA, 63 nt, hsa
agcaaaccugucccccaccugugaccagucacucuggggcaagcaucacugggaagggcauag

SEQ ID NO: 264746 - RNA, 63 nt, hsa
gaccaccucaccgggcaaauggggucggggggacuggggcaccagaccaggcaccaccuggac

SEQ ID NO: 264747 - RNA, 63 nt, hsa
caucccccacccagcucccggccguccuccuaccuggggcagcuggggcugccaucccauuuc

SEQ ID NO: 264748 - RNA, 63 nt, hsa
agagcccaagcacuggcuucgccccucagugcccuggggcauguucagggcaggguugagggg

SEQ ID NO: 264749 - RNA, 63 nt, hsa
gugccaccugcaucgugccauaacccugaccgccuggggcaggaaguauucagguuggcugug

SEQ ID NO: 264750 - RNA, 63 nt, hsa
gcuucccaguugagcucccaagaccaggacccacuggggcauauaaaaaagucaaaaaucaaa

SEQ ID NO: 264751 - RNA, 63 nt, hsa
gcuucccaguugagcucccaagaccaggacccacuggggcauauaaaaucucugcuguauccu

SEQ ID NO: 264752 - RNA, 63 nt, hsa
ggcgccuccagggggcgggaggagcacuaggggcuggggcaggaggcuccuggagcgcuggau

SEQ ID NO: 264753 - RNA, 63 nt, hsa
cagcugggggacagugggcuguuguggcugggucuggggcaggugcauuugagccagggcugg

SEQ ID NO: 264754 - RNA, 63 nt, hsa
uuuuuggaaaagggugugggggugggggcgccgcuggggcagggccagguuuuguguuuuagu

SEQ ID NO: 264755 - RNA, 63 nt, hsa
agcgggcggcagcgccagcgccccucugucaggcuggggcaaucuugguuuuguguccaaagg

SEQ ID NO: 264756 - RNA, 63 nt, hsa
ccugcuccucugccuggaccaggaggagggccccuggggcagaaguuaggcacgaggcagucu

SEQ ID NO: 264757 - RNA, 63 nt, hsa
cccagccaggcccugcagggcuggucagggugucuggggcaggaggaggccaacucacugaac

SEQ ID NO: 264758 - RNA, 63 nt, hsa
uggucacauggggaaccuccccucaucgggccucuggggcaggaagcuugucacuggaagauc

SEQ ID NO: 264759 - RNA, 63 nt, hsa
cucccucucuccaacaaauggaguagcaucccccuggggcacuugcugaggccaagccacuca

SEQ ID NO: 264760 - RNA, 63 nt, hsa
ucggggugaagggugguaucuuggcaguugaagcuggggcaagaacucugggcuuggguaaug

SEQ ID NO: 264761 - RNA, 63 nt, hsa
cuggguaccucagggugagcagagggcacugggcuggggcacagccccugcuucccugcaccc

SEQ ID NO: 264762 - RNA, 63 nt, hsa
cgaugcaauuucugggccugaaugucaugcucccuggggcaggaccuugagccugcagcacac

SEQ ID NO: 264763 - RNA, 63 nt, hsa
ggagggccugguggaugcccuccucccucagagcuggggcagcugccucccaggggugggacu

SEQ ID NO: 264764 - RNA, 63 nt, hsa
ccagacuuugacaaacccaccucaacaucaagccuggggcagguggaagguggucugacugca

SEQ ID NO: 264765 - RNA, 63 nt, hsa
ucagugagagagaaaaugauuuagaucuuggugcuggggcaaggccaucagcuucagagaccu

SEQ ID NO: 264766 - RNA, 63 nt, hsa
aggaccucugaggccaggccugaaccuucuuggcuggggcaaaccacucuucaagugguggca

SEQ ID NO: 264767 - RNA, 63 nt, hsa
ucuuuugaaaugucacaaggccgccucccaccucuggggcauuguacaaguucuucccucucc

SEQ ID NO: 264768 - RNA, 63 nt, hsa
ggccacgcagccagccagaugccuggcccugugcuggggcagacaacgcugcagagcccaggg

SEQ ID NO: 264769 - RNA, 63 nt, hsa
cagagagcagccuggcccucaccagugcgcaagcuggggcagcaaggcugacaguugcugcau

SEQ ID NO: 264770 - RNA, 63 nt, hsa
cccucggcaaccguggggaggccauuugcugcccuggggcaucaugggcaacucgugacagcc

SEQ ID NO: 264771 - RNA, 63 nt, hsa
gagcaagagccaggggugucccagucccagccucuggggcagagcuuguagcccuggauggcc

SEQ ID NO: 264772 - RNA, 63 nt, hsa
cucuggggcagagcuuguagcccuggauggccucuggggcaggaccacuagcuaagcaagcca

SEQ ID NO: 264773 - RNA, 63 nt, hsa
gcucuucaccaccacaaaggaugugugugcauccuggggcaugccugccucaugugggggugu

SEQ ID NO: 264774 - RNA, 63 nt, hsa
cucuggcaucucugccgaggcugcuggaaucgacuggggcaucuucccggaaucagauucaaa

SEQ ID NO: 264775 - RNA, 63 nt, hsa
cgggaggccggacucaggggucagaagcagggacuggggcaggcgagcccggacagggaagag

SEQ ID NO: 264776 - RNA, 63 nt, hsa
auagucuccaagggaccuggccuugccaagggccuggggcaaggugucggcgggacggugagg

SEQ ID NO: 264777 - RNA, 63 nt, hsa
cagagggcggcgaguucggggucgacucuaccccuggggcaucguggaagguaaagcacugag

SEQ ID NO: 264778 - RNA, 52 nt, hsa
gucuggcacugcuuuuuuaaggcuggggcaaaggccugaaagggagagaaga

SEQ ID NO: 264779 - RNA, 63 nt, hsa
ggcuuugcggggcacgggggccacucagcagcgcuggggcaggugccucugcugucagcucca

SEQ ID NO: 264780 - RNA, 63 nt, hsa
ucuugcgcggugccugagaagagggugaaggagcuggggcaggccccauccugggcauuggag

SEQ ID NO: 264781 - RNA, 63 nt, hsa
gugagaggcaaagggcacagccaugcaaaggcccuggggcaggacggcaccugguaugcggga

SEQ ID NO: 264782 - RNA, 63 nt, hsa
cugcauuuucgaucaugggcuacaugccgagugcuggggcacagagaugaacaagaucgguuc

SEQ ID NO: 264783 - RNA, 63 nt, hsa
uguguuugggggcuuuuaggggacccagcugcacuggggcacugcccguggccuggguaggac

SEQ ID NO: 264784 - RNA, 63 nt, hsa
uagucucguagcugagggguggggucccucugucuggggcacuggcacccacagcaggacucc

SEQ ID NO: 264785 - RNA, 63 nt, hsa
cagagagccacuucaccugagaccacgcccuuccuggggcagccuguaucuggugucugagug

SEQ ID NO: 264786 - RNA, 63 nt, hsa
gaugggugagccugaagauggucccuuugguuucuggggcaaauagagcaccagcuuugugca

SEQ ID NO: 264787 - RNA, 63 nt, hsa
uccuccuugucuuuguaaaaagggaccaccucccuggggcagggcuugggcugaccuguagga

SEQ ID NO: 264788 - RNA, 63 nt, hsa
aagaccaggcugaggccccuccaggccaggguccuggggcaggcaucucagggagcagccagc

SEQ ID NO: 264789 - RNA, 63 nt, hsa
agauccaugaggugugucccuagggcuucaguccuggggcagaggcauaaacagaaccaguca

SEQ ID NO: 264790 - RNA, 63 nt, hsa
gacguucuuggcuccguuagacaggugaggaaacuggggcacagagaggugaugucaucugcc

SEQ ID NO: 264791 - RNA, 63 nt, hsa
ggcagagccacauuaccuacccugugcaugguccuggggcagcaaggaagaagcucagagggu

SEQ ID NO: 264792 - RNA, 63 nt, hsa
ccuaggaggucccccuggggugggcgggcgggccuggggcacuccgucgccuuugcagaacca

SEQ ID NO: 264793 - RNA, 63 nt, hsa
gggguaccuaggagccaggugggguacgacaggcuggggcacacagucuccccccggccaccu

SEQ ID NO: 264794 - RNA, 63 nt, hsa
cuuuugaagcaauuuuuugagaaauaguaaaaucuggggcagagugucuugcaguuaauugca

SEQ ID NO: 264795 - RNA, 63 nt, hsa
agacuggggaaaaauugaggaucucuguuuuuccuggggcaaacagaaagaaaucugcaugag

SEQ ID NO: 264796 - RNA, 64 nt, hsa
cccaagccccuggccacucuaagcugggcagacggagcacgagcaccuauucaaggcacugcag

SEQ ID NO: 264797 - RNA, 64 nt, hsa
gccgacuugcuaaaggucacacacgcgcccgguggagcacgagagaccucguggcagcauguga

SEQ ID NO: 264798 - RNA, 64 nt, hsa
gguguccugcuacaaaaagacaucggucaguaacgagcacgauguggaaaaaugagagaaggga

SEQ ID NO: 264799 - RNA, 64 nt, hsa
uuggaagaugggcccaauuucuuaagugaugagagagcacgaaauuccauaaccaguacaggcc

SEQ ID NO: 264800 - RNA, 64 nt, hsa
ugagagacggcagacugagcagaauuccuuuuuugagcacgagagcauuacuagaaccauuguc

SEQ ID NO: 264801 - RNA, 64 nt, hsa
agcuugggcuguggcccugcugugaucauaccuugagcacgacgaagcaaccuuguuucugagg

SEQ ID NO: 264802 - RNA, 64 nt, hsa
cuguuuccccucagaacacccuguaccauccauggagcacgaggccuucagaaaagacacuuca

SEQ ID NO: 264803 - RNA, 64 nt, hsa
caagcgcaucgggagcacaccagaaaccggcccugagcacgagaagagccuccgcccggcccgg

SEQ ID NO: 264804 - RNA, 64 nt, hsa
agagagagagcauguauacccguauguuaucauagagcacgauucuccaguggauggauaccug

SEQ ID NO: 264805 - RNA, 64 nt, hsa
cuggggugggguagcuuucgggaaagggaauaaggagcacgaugcaagggcgcuguggcccccg

SEQ ID NO: 264806 - RNA, 64 nt, hsa
caggccccagagcagcccaggccaugacccugccgagcacgaguccccccgugcagccaagaac

SEQ ID NO: 264807 - RNA, 64 nt, hsa
gcccugaagccuggggccagcugggacuugaagggagcacgaguccaggauggacucagugcag

SEQ ID NO: 264808 - RNA, 64 nt, hsa
gaagggaaaguucacaaccugugaacagggacuugagcacgagacacuuuucaucuggagcagg

SEQ ID NO: 264809 - RNA, 64 nt, hsa
cccaaagugaagcggucacuccucucaguggaaagagcacgaggauguucucagcucuggccaa

SEQ ID NO: 264810 - RNA, 64 nt, hsa
ccagucuaggcagagacagaagaauguugaauaagagcacgauuagaguccugucugguuaucu

SEQ ID NO: 264811 - RNA, 62 nt, hsa
auuuggcagaacaaguuugauuuuaagaacuagagcacgagucaucuccggugauccuuaaa

SEQ ID NO: 264812 - RNA, 64 nt, hsa
uugaagcaggcacuugcguggauguuucucacuugagcacgauauuuaggcucucuuccaacuc

SEQ ID NO: 264813 - RNA, 64 nt, hsa
aaguugccucuuuuaggaaucucuuuggaauugggagcacgaugacucugaguuugagcuauua

SEQ ID NO: 264814 - RNA, 64 nt, hsa
gggccuggaggaggagcugcggaggcuucagagcgagcacgacaggugccgccccugccacagc

SEQ ID NO: 264815 - RNA, 64 nt, hsa
aaggggccuccuggauucaguccccacuggcccugagcacgacagcccuucuuacccucccagg

SEQ ID NO: 264816 - RNA, 64 nt, hsa
uuggaccucuccuggcugagcucugauucccugugagcacgaugcugaugcaauaguccugugu

SEQ ID NO: 264817 - RNA, 64 nt, hsa
cgcaauaacuguuugguauuugaugcagaugagagagcacgagcuaaaguaaaauaucuaacag

SEQ ID NO: 264818 - RNA, 64 nt, hsa
ggcccuggaggccccugaccccaccccacccacagagcacgagggccccgucagcucagucugu

SEQ ID NO: 264819 - RNA, 64 nt, hsa
ccauugccgccacuaucuguguaauaaaauccgugagcacgaggugggacgugcugguguguga

SEQ ID NO: 264820 - RNA, 64 nt, hsa
ucccagucccagcaggcagaaugcccaaaaccaggagcacgaaggccugucauccauggggcca

SEQ ID NO: 264821 - RNA, 64 nt, hsa
gaccccuuucguuugaguccugcuguuggugucggagcacgaggggaggcacggugcggagagc

SEQ ID NO: 264822 - RNA, 64 nt, hsa
ccgugagcagacacaaaacgguggcagguuuggcgagcacgaacuagaccaagcgaagggcagc

SEQ ID NO: 264823 - RNA, 64 nt, hsa
guccuucccuccacagaccccuaugccuuguuccgagcacgaagaaacagcagcagggaugucu

SEQ ID NO: 264824 - RNA, 64 nt, hsa
cuauauaaaaguguuuuauaaaaacccagaauaggagcacgacgcaugauugguguuugaggcg

SEQ ID NO: 264825 - RNA, 64 nt, hsa
aagugugggagaccgaggacacaguggagcccacgagcacgagcuggaacccacgaggauggcc

SEQ ID NO: 264826 - RNA, 64 nt, hsa
ccaccagcgggcgccuccucccagaggcuuccaggagcacgagggccuugcggcacaggacugu

SEQ ID NO: 264827 - RNA, 64 nt, hsa
ccggagcccccgccgcuccacagucccuggggccgagcacgagugaguggacacugccccgccg

SEQ ID NO: 264828 - RNA, 64 nt, hsa
uugaucgugccacugcacuccagccugggggacagagcacgacccugucuccaaaaauaaaaua

SEQ ID NO: 264829 - RNA, 64 nt, hsa
uguucuaaagcccuuaauuguuccaguuucuuuugagcacgaaagaauucccacuggugagaaa

SEQ ID NO: 264830 - RNA, 64 nt, hsa
ggcagacccuggacccagccucagauccaggcaggagcacgaggucuggccaagguggacgggg

SEQ ID NO: 264831 - RNA, 64 nt, hsa
gcgggcagugaugagcccuguucuggaguggaaagagcacgauagagcaccaggcuaagaggca

SEQ ID NO: 264832 - RNA, 64 nt, hsa
cucaagagaagcucauaagugugugugggugugagagcacgauggugccuguguucugugaaug

SEQ ID NO: 264833 - RNA, 64 nt, hsa
acaacauaaugaugguuaaauuaaaaaaaaaaaagagcacgacaaaccuuggaaaucaagaaag

SEQ ID NO: 264834 - RNA, 64 nt, hsa
gugccccuuaucucauggaaagugccaauuuacugagcacgagauaaacagguaacugacuguu

SEQ ID NO: 264835 - RNA, 64 nt, hsa
uaaccuuggcccaagaccccuuugauucucuaaggagcacgaaagggggaaugccccucccagg

SEQ ID NO: 264836 - RNA, 64 nt, hsa
aagauugugccacuguauuccaacuugggugacagagcacgacucugucucaaaaaaagaaaag

SEQ ID NO: 264837 - RNA, 54 nt, hsa
ugagagagggggaagagugagucugagcacgaguugcagccagggccaguggga

SEQ ID NO: 264838 - RNA, 64 nt, hsa
gcuaaggcuggguaagaauaguugugcagggagggagcacgagaugggcagagcugguuccuac

SEQ ID NO: 264839 - RNA, 54 nt, hsa
uuagagagggggaagagugagucugagcacgaguugcagccagggccaguggga

SEQ ID NO: 264840 - RNA, 54 nt, hsa; identical to SEQ ID NO: 264837

SEQ ID NO: 264841 - RNA, 64 nt, hsa
uggcacagccuuggcuuccacgccugagcguggagagcacgaguuaguuguaguccggcuugcg

SEQ ID NO: 264842 - RNA, 64 nt, hsa; identical to SEQ ID NO: 83098

SEQ ID NO: 264843 - RNA, 64 nt, hsa; identical to SEQ ID NO: 83099

SEQ ID NO: 264844 - RNA, 64 nt, hsa; identical to SEQ ID NO: 83100

SEQ ID NO: 264845 - RNA, 64 nt, hsa; identical to SEQ ID NO: 83101

SEQ ID NO: 264846 - RNA, 64 nt, hsa; identical to SEQ ID NO: 83102

SEQ ID NO: 264847 - RNA, 64 nt, hsa; identical to SEQ ID NO: 83103

SEQ ID NO: 264848 - RNA, 64 nt, hsa; identical to SEQ ID NO: 83104

SEQ ID NO: 264849 - RNA, 64 nt, hsa; identical to SEQ ID NO: 83105

SEQ ID NO: 264850 - RNA, 64 nt, hsa; identical to SEQ ID NO: 83106

SEQ ID NO: 264851 - RNA, 64 nt, hsa; identical to SEQ ID NO: 83107

SEQ ID NO: 264852 - RNA, 64 nt, hsa; identical to SEQ ID NO: 83108

SEQ ID NO: 264853 - RNA, 64 nt, hsa; identical to SEQ ID NO: 83109

SEQ ID NO: 264854 - RNA, 64 nt, hsa; identical to SEQ ID NO: 83110

SEQ ID NO: 264855 - RNA, 64 nt, hsa; identical to SEQ ID NO: 83111

SEQ ID NO: 264856 - RNA, 64 nt, hsa; identical to SEQ ID NO: 83112

SEQ ID NO: 264857 - RNA, 64 nt, hsa; identical to SEQ ID NO: 83113

SEQ ID NO: 264858 - RNA, 64 nt, hsa; identical to SEQ ID NO: 83114

SEQ ID NO: 264859 - RNA, 64 nt, hsa; identical to SEQ ID NO: 83115

SEQ ID NO: 264860 - RNA, 64 nt, hsa; identical to SEQ ID NO: 83116

SEQ ID NO: 264861 - RNA, 64 nt, hsa; identical to SEQ ID NO: 83117

SEQ ID NO: 264862 - RNA, 64 nt, hsa; identical to SEQ ID NO: 83118

SEQ ID NO: 264863 - RNA, 64 nt, hsa; identical to SEQ ID NO: 83119

SEQ ID NO: 264864 - RNA, 64 nt, hsa; identical to SEQ ID NO: 83120

SEQ ID NO: 264865 - RNA, 64 nt, hsa; identical to SEQ ID NO: 83121

SEQ ID NO: 264866 - RNA, 64 nt, hsa; identical to SEQ ID NO: 52330

SEQ ID NO: 264867 - RNA, 64 nt, hsa; identical to SEQ ID NO: 52331

SEQ ID NO: 264868 - RNA, 64 nt, hsa; identical to SEQ ID NO: 52332

SEQ ID NO: 264869 - RNA, 64 nt, hsa; identical to SEQ ID NO: 52333

SEQ ID NO: 264870 - RNA, 64 nt, hsa; identical to SEQ ID NO: 52334

SEQ ID NO: 264871 - RNA, 64 nt, hsa; identical to SEQ ID NO: 52335

SEQ ID NO: 264872 - RNA, 64 nt, hsa; identical to SEQ ID NO: 52336

SEQ ID NO: 264873 - RNA, 63 nt, hsa; identical to SEQ ID NO: 52337

SEQ ID NO: 264874 - RNA, 64 nt, hsa; identical to SEQ ID NO: 52338

SEQ ID NO: 264875 - RNA, 64 nt, hsa; identical to SEQ ID NO: 52339

SEQ ID NO: 264876 - RNA, 64 nt, hsa; identical to SEQ ID NO: 52340

SEQ ID NO: 264877 - RNA, 64 nt, hsa; identical to SEQ ID NO: 52341

SEQ ID NO: 264878 - RNA, 64 nt, hsa; identical to SEQ ID NO: 52342

SEQ ID NO: 264879 - RNA, 64 nt, hsa; identical to SEQ ID NO: 52343

SEQ ID NO: 264880 - RNA, 64 nt, hsa; identical to SEQ ID NO: 52344

SEQ ID NO: 264881 - RNA, 64 nt, hsa; identical to SEQ ID NO: 52345

SEQ ID NO: 264882 - RNA, 64 nt, hsa; identical to SEQ ID NO: 52346

SEQ ID NO: 264883 - RNA, 64 nt, hsa; identical to SEQ ID NO: 52347

SEQ ID NO: 264884 - RNA, 64 nt, hsa; identical to SEQ ID NO: 52348

SEQ ID NO: 264885 - RNA, 64 nt, hsa; identical to SEQ ID NO: 52349

SEQ ID NO: 264886 - RNA, 64 nt, hsa; identical to SEQ ID NO: 52350

SEQ ID NO: 264887 - RNA, 64 nt, hsa; identical to SEQ ID NO: 52351

SEQ ID NO: 264888 - RNA, 64 nt, hsa; identical to SEQ ID NO: 52352

SEQ ID NO: 264889 - RNA, 64 nt, hsa; identical to SEQ ID NO: 52353

SEQ ID NO: 264890 - RNA, 64 nt, hsa; identical to SEQ ID NO: 52354

SEQ ID NO: 264891 - RNA, 64 nt, hsa; identical to SEQ ID NO: 52355

SEQ ID NO: 264892 - RNA, 64 nt, hsa; identical to SEQ ID NO: 52356

SEQ ID NO: 264893 - RNA, 64 nt, hsa; identical to SEQ ID NO: 52357

SEQ ID NO: 264894 - RNA, 64 nt, hsa; identical to SEQ ID NO: 52358

SEQ ID NO: 264895 - RNA, 64 nt, hsa; identical to SEQ ID NO: 52359

SEQ ID NO: 264896 - RNA, 64 nt, hsa; identical to SEQ ID NO: 52360

SEQ ID NO: 264897 - RNA, 59 nt, hsa; identical to SEQ ID NO: 52361

SEQ ID NO: 264898 - RNA, 64 nt, hsa; identical to SEQ ID NO: 52362

SEQ ID NO: 264899 - RNA, 64 nt, hsa; identical to SEQ ID NO: 52363

SEQ ID NO: 264900 - RNA, 64 nt, hsa; identical to SEQ ID NO: 52364

SEQ ID NO: 264901 - RNA, 64 nt, hsa; identical to SEQ ID NO: 52365

SEQ ID NO: 264902 - RNA, 64 nt, hsa; identical to SEQ ID NO: 52366

SEQ ID NO: 264903 - RNA, 64 nt, hsa; identical to SEQ ID NO: 52367

SEQ ID NO: 264904 - RNA, 64 nt, hsa; identical to SEQ ID NO: 52368

SEQ ID NO: 264905 - RNA, 64 nt, hsa; identical to SEQ ID NO: 52369

SEQ ID NO: 264906 - RNA, 64 nt, hsa; identical to SEQ ID NO: 52370

SEQ ID NO: 264907 - RNA, 64 nt, hsa; identical to SEQ ID NO: 52371

SEQ ID NO: 264908 - RNA, 64 nt, hsa; identical to SEQ ID NO: 52372

SEQ ID NO: 264909 - RNA, 64 nt, hsa; identical to SEQ ID NO: 52373

SEQ ID NO: 264910 - RNA, 64 nt, hsa; identical to SEQ ID NO: 52374

SEQ ID NO: 264911 - RNA, 64 nt, hsa; identical to SEQ ID NO: 52375

SEQ ID NO: 264912 - RNA, 64 nt, hsa
auccgcuacucuuuauuucauggagucguaucaacgcuaugaacgcaaggcugugauauggaac

SEQ ID NO: 264913 - RNA, 64 nt, hsa
aauugcagaacuucuucagcuaagguuaauuugacgcuaugauaaaacugagagaugucaaaaa

SEQ ID NO: 264914 - RNA, 64 nt, hsa
aaggcaaauugaaaaucacuggcaacaugggucucgcuaugaaguuacaaaaucuucagcuuca

SEQ ID NO: 264915 - RNA, 64 nt, hsa
ucaaggaaaucaauaccuaccaauuuaaccuaaacgcuaugauauauaacagcucuagcuagug

SEQ ID NO: 264916 - RNA, 64 nt, hsa
gucagaggcucucacuacacuggguccguguucccgcuaugacaaugaccuggcaccaaugggc

SEQ ID NO: 264917 - RNA, 64 nt, hsa
cucaucauucaaauaacgcacaaaaaacaaaagccgcuaugaccggcguugccucucacuuuga

SEQ ID NO: 264918 - RNA, 64 nt, hsa
ugguguucauaauguuccagggauucagaagcaacgcuaugaacuucagcugacuuguuacuua

SEQ ID NO: 264919 - RNA, 64 nt, hsa
acugaaagaccacuaucuggaguuugagaaaacccgcuaugaaauguaugucagcauucucaag

SEQ ID NO: 264920 - RNA, 64 nt, hsa
gcuccccugugcuccugaccuaugcuccuggauacgcuaugaacucucaccggcuccccagccc

SEQ ID NO: 264921 - RNA, 64 nt, hsa
cccccaaaugccccaaaauccaaaccuuccugaacgcuaugacaccaugaguggaaaauuccac

SEQ ID NO: 264922 - RNA, 64 nt, hsa
cuccgaguucuauaaaaaccucaccuccaucaagcgcuaugauggggacaucacugaccugggc

SEQ ID NO: 264923 - RNA, 64 nt, hsa
acagagcauuuuagugacauccacuacuuauugccgcuaugaguuagagucuaucaguguucuu

SEQ ID NO: 264924 - RNA, 64 nt, hsa
cgaaaugaaucuacauuaaauguuguuuuaacugcgcuaugauuaaaaccauucauauagaguu

SEQ ID NO: 264925 - RNA, 64 nt, hsa
uugaaacuugcaggauuuacuuaauaaaaauacacgcuaugagucauaauugugccaaguuguu

SEQ ID NO: 264926 - RNA, 64 nt, hsa
aauuuuauuuuuaauguauauguuucucuucaggcgcuaugaacugaaaaauauguuuucuuac

SEQ ID NO: 264927 - RNA, 64 nt, hsa
ugccacacauucucucucaauuucagcuucggaacgcuaugaaaauaauacaugauuaaaguuu

SEQ ID NO: 264928 - RNA, 64 nt, hsa
cuuccacguuuucugcuucgagugcgugcggggccgcuaugaggcccgccagaggaagugcccc

SEQ ID NO: 264929 - RNA, 64 nt, hsa
uuccuagccugaugauggggaacccagagccacccgcuaugagcacaggccggggguggaaggc

SEQ ID NO: 264930 - RNA, 64 nt, hsa
aauauuguacauccucacuuauaagugggagcugcgcuaugaagauacaaaggcacaagaauga

SEQ ID NO: 264931 - RNA, 64 nt, hsa
accauuccaggaaaacugggacauaggaucgucccgcuaugauggaaguguucagacaguuuau

SEQ ID NO: 264932 - RNA, 64 nt, hsa
ucgagcacaugaaaggaaucacacuguacagaaacgcuaugaauguaaacaauguggaaaaacc

SEQ ID NO: 264933 - RNA, 64 nt, hsa
ucaguucguuuuuuugacaguaauuuuaugguaacgcuaugaauugaauugucuguucuaggac

SEQ ID NO: 264934 - RNA, 64 nt, hsa
caauuccuuuucaugcccuccugcauugcugcugcguggguauuugucuccuuagccaucaggu

SEQ ID NO: 264935 - RNA, 64 nt, hsa
ucugcugcucccaucugcacuaauugacccaaaacguggguauuuccugcuacacaaaagccaa

SEQ ID NO: 264936 - RNA, 64 nt, hsa
uaucaagaugccucugugcagaaaguaugccucccguggguauacguuuuuaccuuuuuuaaaa

SEQ ID NO: 264937 - RNA, 64 nt, hsa
cacuuccuuuagggcaaauaacacagcagaaccacguggguauuuuaguacuuuuuuuuauauu

SEQ ID NO: 264938 - RNA, 64 nt, hsa
acauggcuggacuccagccaggaggacacacggccguggguaucugcccugggcugggugcccg

SEQ ID NO: 264939 - RNA, 64 nt, hsa
ggugugagauauuuuagcuuuuuugucuuaucugcguggguauugcugcuuuauuuuaaaaaau

SEQ ID NO: 264940 - RNA, 64 nt, hsa
gcccaugcuuugggcaugagaugcucagauggugcguggguagaucuaguugaggaaguguggg

SEQ ID NO: 264941 - RNA, 64 nt, hsa
uugugugcauggaugugugcguggggagaaagaacguggguaagaugucccuucccagcccuga

SEQ ID NO: 264942 - RNA, 64 nt, hsa
cagagugacgcacugacucaccuagaggcuggaacguggguagggauuuagcaugcuggaaaua

SEQ ID NO: 264943 - RNA, 64 nt, hsa
uauguguuugugcccgucugugucuagguaccaccguggguacauuguugggcaggagugugug

SEQ ID NO: 264944 - RNA, 64 nt, hsa
cagagugaagcaucaaccuacuuagaagcugaaacguggguaaggauuuagcaugcuggaaaua

SEQ ID NO: 264945 - RNA, 64 nt, hsa
ggcaaguuuucuacguuuuuaagagcccuuagaacguggguauuuuuuuucuugagaaaagcua

SEQ ID NO: 264946 - RNA, 64 nt, hsa
caugaggggagggggagagaggucaggccaggcccguggguaggucccuggcucccagcuggag

SEQ ID NO: 264947 - RNA, 64 nt, hsa
aucugcuuugggucauccacaucugugggugggccguggguagagggacccacaggcguggaca

SEQ ID NO: 264948 - RNA, 64 nt, hsa
acaguucgaugcaaaaucaaugauccagaaugaucguggguaaaaauaacucaaaguguuucuu

SEQ ID NO: 264949 - RNA, 64 nt, hsa
acaaauucguaaaaaacacacauggccucgccaucguggguaaaaucggccccacagcacgucu

SEQ ID NO: 264950 - RNA, 64 nt, hsa
ugcccuuugugcuguaugacuggaggccucuccgcguggguacuuggggguggggccacaaauc

SEQ ID NO: 264951 - RNA, 64 nt, hsa
cuuucucuccuaacuauaaauccuauuugugugucguggguauggaaggacagauauauuucuu

SEQ ID NO: 264952 - RNA, 64 nt, hsa
uauccuguucuuccccuccccgcuccuaaugguacguggguacccaggcugguucuugggcuag

SEQ ID NO: 264953 - RNA, 64 nt, hsa
augccuaggguagggacauccuuuccagcucaaacguggguagggaugugggagaauaagaaug

SEQ ID NO: 264954 - RNA, 64 nt, hsa
cagugacuguagggagcugggucauagugcacgucguggguauuaggaaagccuguauucuuuc

SEQ ID NO: 264955 - RNA, 64 nt, hsa
ucccuacagcugugcacuucagugcagaaugguucguggguacagugaacaccaacacauccua

SEQ ID NO: 264956 - RNA, 64 nt, hsa
ccgcggggcagccucacggaagggcccggugggacguggguagugugugaagccccucagccug

SEQ ID NO: 264957 - RNA, 64 nt, hsa
uuugcuagugucuuugucaugcgucucuggcccucguggguaaaugacaaacgggaccaauggg

SEQ ID NO: 264958 - RNA, 64 nt, hsa
aacccugguguugagagaacguccuucuguccaucguggguaacagccuuggggagggugcaga

SEQ ID NO: 264959 - RNA, 64 nt, hsa
aucaguucauaaaauucuaugguacuggccccuucguggguauugugugaaaugagaugguggc

SEQ ID NO: 264960 - RNA, 64 nt, hsa
cuagcaaguugacuaaacagcaaaaguucuuucucguggguaaauauacccacagguucuauga

SEQ ID NO: 264961 - RNA, 64 nt, hsa
ugcuggugcuucccggcauguucaauaaugcaggcguggguaaggggccccccugggaugggga

SEQ ID NO: 264962 - RNA, 64 nt, hsa
ggggcccagaggagcaauagcccugggccacaagcguggguaggccuuucacguauuccgucug

SEQ ID NO: 264963 - RNA, 64 nt, hsa
ccugagcauguagagguggguccugcaguggucucguggguauuacugcuugugucugauuguc

SEQ ID NO: 264964 - RNA, 64 nt, hsa
caguacacacuggagaaagacugaaugccgugaacguggguaauuauguagguacagcucucca

SEQ ID NO: 264965 - RNA, 64 nt, hsa
uguccauggcauccggagcgaggcgacuguccugcguggguagcccucggccggggagugaggc

SEQ ID NO: 264966 - RNA, 64 nt, hsa
aagacugucagcagaaggaaaguacuggacuacccguggguaaguccugccauucaagacugga

SEQ ID NO: 264967 - RNA, 64 nt, hsa
gaagauagaacaaugcuauaauauauaaugaacacguggguauuuaauaagaaacaugauguga

SEQ ID NO: 264968 - RNA, 64 nt, hsa
ggccucgggaggcugcugggccagugugggugagcguggguacgaugccacacgcccugcccug

SEQ ID NO: 264969 - RNA, 64 nt, hsa
uuccuaacugcagugugcugcuuacaccuccccgcguggguaaccaaauuuuuaaguagucaga

SEQ ID NO: 264970 - RNA, 64 nt, hsa
gggucaagaucacaacccugcauccauguguguccguggguaccguaagggcuacugggggaag

SEQ ID NO: 264971 - RNA, 64 nt, hsa
gcuuagcgaguauaugcugauauucuucgacacacguggguaaguugaugccauuuauaaaugu

SEQ ID NO: 264972 - RNA, 64 nt, hsa; identical to SEQ ID NO: 159069

SEQ ID NO: 264973 - RNA, 64 nt, hsa; identical to SEQ ID NO: 159070

SEQ ID NO: 264974 - RNA, 64 nt, hsa; identical to SEQ ID NO: 159071

SEQ ID NO: 264975 - RNA, 64 nt, hsa; identical to SEQ ID NO: 159072

SEQ ID NO: 264976 - RNA, 64 nt, hsa; identical to SEQ ID NO: 159073

SEQ ID NO: 264977 - RNA, 56 nt, hsa; identical to SEQ ID NO: 159074

SEQ ID NO: 264978 - RNA, 64 nt, hsa; identical to SEQ ID NO: 159075

SEQ ID NO: 264979 - RNA, 64 nt, hsa; identical to SEQ ID NO: 159076

SEQ ID NO: 264980 - RNA, 64 nt, hsa
ggaaggggagaaaaaccgauucaaaucaacuuguacauggaaacagcaagcauuauggucaaac

SEQ ID NO: 264981 - RNA, 64 nt, hsa
uuuuucaacaauuucaacaaugacacaaaaauucacauggaaauggggaagauggucuguuuug

SEQ ID NO: 264982 - RNA, 64 nt, hsa
auuuauccaauguugggucaagaacauugcuucgacauggaaauuaacauggaacauugcuuuu

SEQ ID NO: 264983 - RNA, 64 nt, hsa
uugggucaagaacauugcuucgacauggaaauuaacauggaacauugcuuuucgugauacuguu

SEQ ID NO: 264984 - RNA, 64 nt, hsa
gaauguacauggaaugaccaggcucuaugaauguacauggaaaaccccuaaaaauccccaaaac

SEQ ID NO: 264985 - RNA, 64 nt, hsa
ggacuccucgcugcugaccaggcucuaugaauguacauggaaugaccaggcucuaugaauguac

SEQ ID NO: 264986 - RNA, 64 nt, hsa
ucaacagccguuuuucuaguuccaaguuuuaaauacauggaaggaaguccgggagaaccauaug

SEQ ID NO: 264987 - RNA, 64 nt, hsa
uuagaagaugaacagguauuuugaaucugaucugacauggaacaguuuaccucauuguagguag

SEQ ID NO: 264988 - RNA, 64 nt, hsa
cguaugacccuggccucucgugaagagcagcacaacauggaaagagccaaaaugucacaguucc

SEQ ID NO: 264989 - RNA, 64 nt, hsa
aaugcuuuuauuagccaauaggaauuuuaaaauaacauggaacuuacacaaaaggcuuuucaug

SEQ ID NO: 264990 - RNA, 64 nt, hsa
gugauaccaaaucuucagcugucuacuuggaagaacauggaauaagcauacuuaacagugaaaa

SEQ ID NO: 264991 - RNA, 64 nt, hsa
gaugacuguauagagaugugaaauguauaauuacacauggaagcaauauguugcuguguuguua

SEQ ID NO: 264992 - RNA, 64 nt, hsa
aaagacauggaagguuagguuugucaacacaaagacauggaagauuagagguuugucaacacaa

SEQ ID NO: 264993 - RNA, 64 nt, hsa
agacauggaagguuagagguuugucaacaaaaagacauggaagguuagguuugucaacacaaag

SEQ ID NO: 264994 - RNA, 64 nt, hsa
ugcaccacccauggagagguuugucaacacaaagacauggaagguuagagguuugucaacaaaa

SEQ ID NO: 264995 - RNA, 64 nt, hsa
ugaucagaauucaguaccauccacauuggaauauacauggaauauuguaaaaccuacaugagca

SEQ ID NO: 264996 - RNA, 64 nt, hsa
acagaauuuuuuguauuuguaaauugguuuaaauacauggaauuuuauacagguuuucuccugu

SEQ ID NO: 264997 - RNA, 64 nt, hsa
ucugccguagcuagauguucugugggguuuguuaacauggaacuacucagcuuucuuucaguca

SEQ ID NO: 264998 - RNA, 64 nt, hsa
ugauaggccaggaaggcaguggggauccaccaucacauggaacuguaaggccauauaacuacac

SEQ ID NO: 264999 - RNA, 64 nt, hsa
cuaaaugaauaaaaacucggaauuaggccaggagacauggaauaccauucaugggaugguuauc

SEQ ID NO: 265000 - RNA, 64 nt, hsa
cuguuuuaacacagaaauucaaaauagugacuuaacauggaagcuauuucucucuuacuuaaag

SEQ ID NO: 265001 - RNA, 64 nt, hsa
ucccaauuauccacucuaauggagcagaacacuuacauggaaaauccuaaacauggaagaugau

SEQ ID NO: 265002 - RNA, 64 nt, hsa
uaauggagcagaacacuuacauggaaaauccuaaacauggaagaugauuuaaaaaugauucacc

SEQ ID NO: 265003 - RNA, 64 nt, hsa
acaaauggaccgaugcagauuuuagagagugacgacauggaaaaugaauuuaaccacuuucuua

SEQ ID NO: 265004 - RNA, 64 nt, hsa
uaauuaauauauuauucuauuuagcuuguaaaacacauggaaucuguuuaagauagcccuugua

SEQ ID NO: 265005 - RNA, 64 nt, hsa
ccgccuugguguggguuugugucacguguggacaucuccucaggcuuugugucacgcguggaca

SEQ ID NO: 265006 - RNA, 64 nt, hsa
gacaucuccucaggcuuugugucacgcguggacaucuccucaggcuguccccagcggugacggg

SEQ ID NO: 265007 - RNA, 64 nt, hsa
aagaggauaggaccucccaggaugcuucccagccucuccucaguuucccaucugcugugccucu

SEQ ID NO: 265008 - RNA, 64 nt, hsa
gccccaggccaucaucuccccaccucuccuccccucuccucaguuuugccgacugcuuuucauc

SEQ ID NO: 265009 - RNA, 64 nt, hsa
aaggaaaagucugcacuguuugcucuaaagagcuucuccucauuccaauguguuuugcuucaug

SEQ ID NO: 265010 - RNA, 64 nt, hsa
ggcaaauggcauaauuauuugaaagugacaggaaucuccucagaaugaagaauaaagccuacua

SEQ ID NO: 265011 - RNA, 64 nt, hsa
uuauuuuuugaauaccccgaguggggagcaggguucuccucaaagccucacaaccauaggauca

SEQ ID NO: 265012 - RNA, 64 nt, hsa
cucugucugugugguuaauguucugguuucucagucuccucacuauauccacuucacuccucau

SEQ ID NO: 265013 - RNA, 64 nt, hsa
ggcacauugccugcuuccccccagcgccggcuucucuccucagagcgccugucacuccaucccc

SEQ ID NO: 265014 - RNA, 64 nt, hsa
ucgguggccuccccaggccccuggacacgacaguucuccucaggcaggugggcuuugugguccu

SEQ ID NO: 265015 - RNA, 64 nt, hsa
ucugggagaugcugcucugagcugcucucaguacucuccucaucauggcaguuaacacauuacc

SEQ ID NO: 265016 - RNA, 64 nt, hsa
aaccugcuuugauuguucaggcacuuggccaccuucuccucacuccucccacagccuucugucu

SEQ ID NO: 265017 - RNA, 64 nt, hsa
uuucagagcuucucacagcaaaccucuccucaugucuccucaugucuuauuguucagaaauggg

SEQ ID NO: 265018 - RNA, 64 nt, hsa
aauaacucuuuuucagagcuucucacagcaaaccucuccucaugucuccucaugucuuauuguu

SEQ ID NO: 265019 - RNA, 64 nt, hsa
ccaggaucagagaccuguugaauuugagugggugucuccucaagccuuaccuuucucagguguu

SEQ ID NO: 265020 - RNA, 64 nt, hsa
uggggugugauuaugauaacuucaggcuuuuagcucuccucaaaguuugagguuaaaaaaaugu

SEQ ID NO: 265021 - RNA, 64 nt, hsa
accuccuugccaccuuccuuccuccaagauaccaucuccucauccuaacccaggucuucggcac

SEQ ID NO: 265022 - RNA, 64 nt, hsa
uugccugauggaaaaaaaacaaaggaauuaaaacucuccucaggcauucggaagucuuuuugcu

SEQ ID NO: 265023 - RNA, 64 nt, hsa
uccugagcucuuggaggugcccaggaacccugcuucuccucacagggccuggccauauagccag

SEQ ID NO: 265024 - RNA, 64 nt, hsa
ugcacagugccucacccacucccuucuccuggucucuccucaaaagaauuuuacaugauuuuaa

SEQ ID NO: 265025 - RNA, 64 nt, hsa
aucgugauguaccuaaaagucagaaaccacauuuucuccucagaaguagggaccgcuuucuuac

SEQ ID NO: 265026 - RNA, 64 nt, hsa
uaaaaaauucauuagcaugaaaggcaagcauauuucuccucauaugaaugagccuaucagcagg

SEQ ID NO: 265027 - RNA, 64 nt, hsa
ucaggguguguccuauacaaaacuucccaucaguucuccucaauauuccccauuuguaaaugau

SEQ ID NO: 265028 - RNA, 64 nt, hsa
uuauuugguauagauccacccaucccaaccuuucucuccucagucccugcuccucauguuucug

SEQ ID NO: 265029 - RNA, 64 nt, hsa
uggcuggagguugggggcaggaucuggcccgagcucuccucagaccuccccagaccugucuucu

SEQ ID NO: 265030 - RNA, 64 nt, hsa
cuccaccuccucuccuccgggccccucaguuuccucuccucaucucuggccucaguuccagagg

SEQ ID NO: 265031 - RNA, 64 nt, hsa
uguggcaggugagggggcucccgccugugccccuucuccucaccaugucucccccacccugccu

SEQ ID NO: 265032 - RNA, 64 nt, hsa
ugaagcuguccccaucucagugucagaccagccuucuccucagcugaccacccuccucugaccc

SEQ ID NO: 265033 - RNA, 64 nt, hsa
cuugcccgcagcccaggcuccugggccagugcucucuccucaaauggaggcagccauggccuga

SEQ ID NO: 265034 - RNA, 64 nt, hsa
gccuccugugccgcgcacucacggagcugcguagucuccucagacauagucaaagcuuugccga

SEQ ID NO: 265035 - RNA, 64 nt, hsa; identical to SEQ ID NO: 38453

SEQ ID NO: 265036 - RNA, 64 nt, hsa; identical to SEQ ID NO: 38454

SEQ ID NO: 265037 - RNA, 64 nt, hsa; identical to SEQ ID NO: 38455

SEQ ID NO: 265038 - RNA, 64 nt, hsa; identical to SEQ ID NO: 38456

SEQ ID NO: 265039 - RNA, 64 nt, hsa; identical to SEQ ID NO: 38457

SEQ ID NO: 265040 - RNA, 64 nt, hsa; identical to SEQ ID NO: 38458

SEQ ID NO: 265041 - RNA, 64 nt, hsa; identical to SEQ ID NO: 38459

SEQ ID NO: 265042 - RNA, 64 nt, hsa; identical to SEQ ID NO: 38460

SEQ ID NO: 265043 - RNA, 64 nt, hsa; identical to SEQ ID NO: 38461

SEQ ID NO: 265044 - RNA, 64 nt, hsa; identical to SEQ ID NO: 38462

SEQ ID NO: 265045 - RNA, 64 nt, hsa; identical to SEQ ID NO: 38463

SEQ ID NO: 265046 - RNA, 64 nt, hsa; identical to SEQ ID NO: 38464

SEQ ID NO: 265047 - RNA, 64 nt, hsa; identical to SEQ ID NO: 38465

SEQ ID NO: 265048 - RNA, 64 nt, hsa; identical to SEQ ID NO: 38466

SEQ ID NO: 265049 - RNA, 64 nt, hsa; identical to SEQ ID NO: 38467

SEQ ID NO: 265050 - RNA, 64 nt, hsa; identical to SEQ ID NO: 38468

SEQ ID NO: 265051 - RNA, 64 nt, hsa; identical to SEQ ID NO: 38469

SEQ ID NO: 265052 - RNA, 64 nt, hsa; identical to SEQ ID NO: 38470

SEQ ID NO: 265053 - RNA, 64 nt, hsa; identical to SEQ ID NO: 38471

SEQ ID NO: 265054 - RNA, 64 nt, hsa; identical to SEQ ID NO: 38472

SEQ ID NO: 265055 - RNA, 64 nt, hsa; identical to SEQ ID NO: 38473

SEQ ID NO: 265056 - RNA, 64 nt, hsa; identical to SEQ ID NO: 38474

SEQ ID NO: 265057 - RNA, 64 nt, hsa; identical to SEQ ID NO: 38475

SEQ ID NO: 265058 - RNA, 64 nt, hsa; identical to SEQ ID NO: 38476

SEQ ID NO: 265059 - RNA, 64 nt, hsa; identical to SEQ ID NO: 38477

SEQ ID NO: 265060 - RNA, 64 nt, hsa; identical to SEQ ID NO: 38478

SEQ ID NO: 265061 - RNA, 64 nt, hsa; identical to SEQ ID NO: 38479

SEQ ID NO: 265062 - RNA, 64 nt, hsa; identical to SEQ ID NO: 38480

SEQ ID NO: 265063 - RNA, 64 nt, hsa; identical to SEQ ID NO: 38481

SEQ ID NO: 265064 - RNA, 64 nt, hsa; identical to SEQ ID NO: 38482

SEQ ID NO: 265065 - RNA, 64 nt, hsa; identical to SEQ ID NO: 38483

SEQ ID NO: 265066 - RNA, 64 nt, hsa; identical to SEQ ID NO: 38484

SEQ ID NO: 265067 - RNA, 64 nt, hsa; identical to SEQ ID NO: 38485

SEQ ID NO: 265068 - RNA, 64 nt, hsa; identical to SEQ ID NO: 38486

SEQ ID NO: 265069 - RNA, 64 nt, hsa
uuagaacacugguuuaaagggauaaucaucucugucacauuagacuauccaucaugaccagcaa

SEQ ID NO: 265070 - RNA, 64 nt, hsa
ugugauugggcguagaagugggagcauugggaccucacauuacacacacgagagaucauaacca

SEQ ID NO: 265071 - RNA, 64 nt, hsa
gggaauauucccaauaaaggucuuaagagaaaagucacauuacaaguaauguaauggcucuacc

SEQ ID NO: 265072 - RNA, 64 nt, hsa
aauugcuugucaaaauggcccaaaagaucugaauucacauuaaguuccccuugcacacuuaccu

SEQ ID NO: 265073 - RNA, 64 nt, hsa
auaaggaaaaacuuuuaucgcaaugauagucaguucacauuaguuuagcacuauagauaguauu

SEQ ID NO: 265074 - RNA, 64 nt, hsa
auuuucuagaggcucugggagcaaauuacauucaucacauuaccucugcucucucaagauuaaa

SEQ ID NO: 265075 - RNA, 64 nt, hsa
gguuacuuucccuagucaaugcucugaaaaugugucacauuauaaacaauacagaaggagagau

SEQ ID NO: 265076 - RNA, 64 nt, hsa
uuaugauuucccuagucagugcucugaagaugugucacauuauauuauaaacaauacggaaggg

SEQ ID NO: 265077 - RNA, 64 nt, hsa; identical to SEQ ID NO: 183750

SEQ ID NO: 265078 - RNA, 64 nt, hsa; identical to SEQ ID NO: 183751

SEQ ID NO: 265079 - RNA, 64 nt, hsa; identical to SEQ ID NO: 183752

SEQ ID NO: 265080 - RNA, 64 nt, hsa; identical to SEQ ID NO: 183753

SEQ ID NO: 265081 - RNA, 64 nt, hsa; identical to SEQ ID NO: 183754

SEQ ID NO: 265082 - RNA, 64 nt, hsa; identical to SEQ ID NO: 183755

SEQ ID NO: 265083 - RNA, 64 nt, hsa; identical to SEQ ID NO: 183756

SEQ ID NO: 265084 - RNA, 64 nt, hsa; identical to SEQ ID NO: 183757

SEQ ID NO: 265085 - RNA, 64 nt, hsa; identical to SEQ ID NO: 183758

SEQ ID NO: 265086 - RNA, 64 nt, hsa; identical to SEQ ID NO: 183759

SEQ ID NO: 265087 - RNA, 64 nt, hsa
ccucuccuggggggccugcugggcaggcgaccugcugacccacggucacugcuguguucagccc

SEQ ID NO: 265088 - RNA, 64 nt, hsa
caucucagccugagacgcacagagaggucucuuccugacccagacgcacucacgagccaggucc

SEQ ID NO: 265089 - RNA, 64 nt, hsa
acccaaacccaaccacacaaugguuugucucaaucugacccagcggcuggacccuccguaaauu

SEQ ID NO: 265090 - RNA, 64 nt, hsa
aaugaucaaaaagaacagaacccucuccagccugcugacccaaacccaaccacacaaugguuug

SEQ ID NO: 265091 - RNA, 64 nt, hsa
aagacuuaacugugaaaaaguacugagaacccaccugacccaggcuugccccaagcagaggcua

SEQ ID NO: 265092 - RNA, 64 nt, hsa
ccggcuacaaugcucuuccucuucuggaauguugcugacccaggccguggacuuggcugagcac

SEQ ID NO: 265093 - RNA, 64 nt, hsa
uuuaggguaaaauuaacaaauccauucuauuccucugacccaugcuuaguacauaugaccuuua

SEQ ID NO: 265094 - RNA, 61 nt, hsa
gguuggaccaaaccucgugagccagccaccccugacccaaaugaggagagcucugauucuc

SEQ ID NO: 265095 - RNA, 64 nt, hsa
cuuagagcuguggauuucugcauccccccugagucugacccauggacaccuguuucauucacuu

SEQ ID NO: 265096 - RNA, 64 nt, hsa
ucucccagucucccagcagggacugauuucauuucugacccacuagguuuucuuuccagaaaua

SEQ ID NO: 265097 - RNA, 64 nt, hsa
ucuggcggcugcugucguuguguucuaccccguacugacccaacaccacaagggcuuucucugg

SEQ ID NO: 265098 - RNA, 64 nt, hsa
cccucugugugcucugaauauguccuuguccuuccugacccaucucugaccagcugggaaccug

SEQ ID NO: 265099 - RNA, 64 nt, hsa
auuucccuauuuccagugcuuuccagccggguuucugacccagaggguggaaccggccuggacu

SEQ ID NO: 265100 - RNA, 64 nt, hsa
ucgccaucuuaauaacaaaauaaacuacaaauuccugacccaaggacacuguguuauaagaggc

SEQ ID NO: 265101 - RNA, 64 nt, hsa
accuccuuguccucacccaguuccugcagugucucugacccacgccucccgccuccuggccgac

SEQ ID NO: 265102 - RNA, 64 nt, hsa
gccuucuggcucaugguucaguccagcagccuggcugacccacuauuucuccucugcuucagag

SEQ ID NO: 265103 - RNA, 64 nt, hsa
gaaaguugcaggaaaaccuuagucuuccauccuucugacccaugguggaaauucacaccaugga

SEQ ID NO: 265104 - RNA, 64 nt, hsa
aguuucaugcugcacauaaugggguugcacuggucugacccaggacuuuggagccacccacacu

SEQ ID NO: 265105 - RNA, 64 nt, hsa
ugcccugguggagcuuguggucugaugggugaggcugacccaagcccaccccauugccaacagg

SEQ ID NO: 265106 - RNA, 64 nt, hsa
cagcucugaucacuuccccacuguggaaacaggacugacccagccuucagugugggcugcugaa

SEQ ID NO: 265107 - RNA, 64 nt, hsa
cuaaguguugguuuaguggauguucguggaauugcugacccauccaagggcguccuuuggagcc

SEQ ID NO: 265108 - RNA, 64 nt, hsa
cugcgguuguuacagaagcauggcggccuccagacugacccauugguugcccuuuagauuuugu

SEQ ID NO: 265109 - RNA, 64 nt, hsa
uuauaaugucauuuguguugugaaaauucuuccacugacccaaaauggaaccguacaaagccua

SEQ ID NO: 265110 - RNA, 64 nt, hsa
cagcagcuugcgcccucccucugcuccugagaugcugacccagcauggagcccaagagcagcuc

SEQ ID NO: 265111 - RNA, 64 nt, hsa
ggacaccaacgccgcauaggacugcccacaugggaccgcccacauaggaccgcccacauaggac

SEQ ID NO: 265112 - RNA, 64 nt, hsa
cauaggacugcccacaugggaccgcccacauaggaccgcccacauaggaccgcccacaugggac

SEQ ID NO: 265113 - RNA, 64 nt, hsa
caugggaccgcccacauaggaccgcccacauaggaccgcccacaugggaccgcccacaugggac

SEQ ID NO: 265114 - RNA, 64 nt, hsa
cauaggaccgcccacauaggaccgcccacaugggaccgcccacaugggaccgcccacaugggac

SEQ ID NO: 265115 - RNA, 64 nt, hsa
cauaggaccgcccacaugggaccgcccacaugggaccgcccacaugggaccgcccacauagaac

SEQ ID NO: 265116 - RNA, 64 nt, hsa
caugggaccgcccacaugggaccgcccacaugggaccgcccacauagaaccguccuccaguggu

SEQ ID NO: 265117 - RNA, 64 nt, hsa
ccagccucggccaggccugcucugcucagcgcccaccgcccaccaccccuccugcuuccccgag

SEQ ID NO: 265118 - RNA, 64 nt, hsa
cagccugagcuccacccuccccucuucuugcggcaccgcccacccacaccccgucugccccuug

SEQ ID NO: 265119 - RNA, 64 nt, hsa
gcucugccccuccguccccagggugcaggcgcgcaccgcccaacccccaccucccgguguaugc

SEQ ID NO: 265120 - RNA, 64 nt, hsa
uacccgggccuccccucgucccucuucuagugguaccgcccaggccuuaaucacccccauuccg

SEQ ID NO: 265121 - RNA, 64 nt, hsa
gccccgcccaggcacggccgaccccgccccgggcaccgcccaccgagccauccugccucgccuc

SEQ ID NO: 265122 - RNA, 64 nt, hsa
ucccugagggcccaccagccugugcugcauacccaccgcccagcuucucccugagggcccacca

SEQ ID NO: 265123 - RNA, 64 nt, hsa
ccucugagggcccaccagccugugcugcauacccaccgcccagcuucucccugagggcccacca

SEQ ID NO: 265124 - RNA, 61 nt, hsa
aggucaagccggugggcugaggcccgugggccgcgcggauccgggaucugcgcuggggggu

SEQ ID NO: 265125 - RNA, 61 nt, hsa
gaucugcgcugggggguccccgcgugcggggcgcgcggagccuucccuucgcccuggugag

SEQ ID NO: 265126 - RNA, 64 nt, hsa
gcuauaacagaauaccacagacuggguaacgugaugaacaaaaauuuauuuggcucacaguucu

SEQ ID NO: 265127 - RNA, 64 nt, hsa
aauguuucuaaguugcacacaguuuauuaacaacugaacaaaacauuuuuaucauuuaaaaauc

SEQ ID NO: 265128 - RNA, 64 nt, hsa
uucaaaaagaugcacuuaguauuaaguugaaacuugaacaaauagauggucacauugcugaaca

SEQ ID NO: 265129 - RNA, 64 nt, hsa
uuaaaaauguguccauuguugcauuuuauauauaugaacaaacaaaaaaugcacaguucauaau

SEQ ID NO: 265130 - RNA, 64 nt, hsa
gcauguguuuuuuuuuuuuuuuuuaaagcgugugugaacaaauggaaauaaagcagggacugug

SEQ ID NO: 265131 - RNA, 64 nt, hsa
aaacucccauuaaaaacaaaacaucuuuguguuuugaacaaaggaauuuucaauauuugauugg

SEQ ID NO: 265132 - RNA, 64 nt, hsa
uauuguuuaacgaguacauaguuucuguuugggaugaacaaauucuggaaauggauagcgauga

SEQ ID NO: 265133 - RNA, 64 nt, hsa
uuuugcccauuacuucaucccuaaaucuucagcaugaacaaauauuaaugucgauaauaaaaca

SEQ ID NO: 265134 - RNA, 64 nt, hsa
cagugccuuccucucucuaccagucuauuuccacugaacaaaaccuacgcacauaccuucaugu

SEQ ID NO: 265135 - RNA, 64 nt, hsa
cacugccuuccucucucuaccagucuauuuccacugaacaaaaccuacacacauaccuucaugu

SEQ ID NO: 265136 - RNA, 64 nt, hsa
uuugcucagcuggcugagacacugaagaagucacugaacaaaaccuacacacguaccuucaugu

SEQ ID NO: 265137 - RNA, 64 nt, hsa
uuauaucuuccuaauaagguguggucuguuugucugaacaaagugcuagacuuucuggagugau

SEQ ID NO: 265138 - RNA, 64 nt, hsa
agacauaggccaugaaaaaaaugauccccaagugugaacaaaagaugcucuucuguggaccacu

SEQ ID NO: 265139 - RNA, 64 nt, hsa
uuuuaaggaaacaauauaaccacaaagcacaguuugaacaaaaucuccucuuuuagcugaugaa

SEQ ID NO: 265140 - RNA, 64 nt, hsa
uggggagggcggggccaaucagucaaugauaaucugaacaaauuuuaagagcagauuuuagauu

SEQ ID NO: 265141 - RNA, 64 nt, hsa
uuugggcaggacauuccaugcacuggaaauagcaugaacaaaugcaugaaaauugccuacaaca

SEQ ID NO: 265142 - RNA, 64 nt, hsa
aucuauuuguauucuuauaccuuuucaauauauuugaacaaauauaguuucuggcacuauuuuu

SEQ ID NO: 265143 - RNA, 64 nt, hsa
ccacaugucauuucuaauguugaguuuccaugacugaacaaagagaauauauuuauucagcuuc

SEQ ID NO: 265144 - RNA, 64 nt, hsa
ugugccauggauuucugauaagaauuaacauucuugaacaaagguaucagaaaggguaacucga

SEQ ID NO: 265145 - RNA, 64 nt, hsa
aacuagauaauucccauaagaugaagaucuuccaugaacaaacuaccaucaaucauccaucaga

SEQ ID NO: 265146 - RNA, 64 nt, hsa
cucuggaacgugaagagcuguuugguuugaaccgugaacaaaacuguguuuugaguuuagcuga

SEQ ID NO: 265147 - RNA, 64 nt, hsa
acaaggggacagacaagcugggacgucagggaaaugaacaaaagggacgcagguuauuuggggu

SEQ ID NO: 265148 - RNA, 64 nt, hsa
aauuaaaaucauaauauaaacgcuugguuuuacaugaacaaaaaguggugugcucgaaaaagac

SEQ ID NO: 265149 - RNA, 64 nt, hsa
ugugugugcaugcacucaggugcccuuuguuucaugaacaaauacauuucauuguacauguuuu

SEQ ID NO: 265150 - RNA, 63 nt, hsa
ugcauguacgcccucugagaugcaauaaacaccuugaacaaagaaaugcaaacauaacguuuc

SEQ ID NO: 265151 - RNA, 64 nt, hsa
guguuuuugaagguuucaauguacauauaacuuuugaacaaaccccaaacucuucccauaaauu

SEQ ID NO: 265152 - RNA, 64 nt, hsa
cuguagaacaguuuuauuuuuauuaaaacuugacugaacaaaaggggaccaucaacauuguaga

SEQ ID NO: 265153 - RNA, 64 nt, hsa
guuuaaccugcucuuggucauuggaaauuuacacugaacaaagugcaauuaacuguagaacagu

SEQ ID NO: 265154 - RNA, 64 nt, hsa
acacagaucacaggggccuuacaaaguuuaugucugaacaaauaagucaauuaaguacacuuua

SEQ ID NO: 265155 - RNA, 64 nt, hsa
agugcucauaaucacuugcaauuucauuguaaaaugaacaaauacauaaauauuuuaagaaaaa

SEQ ID NO: 265156 - RNA, 64 nt, hsa
aauguacuggcagauuaacauacaaccuauguuuugaacaaaaacaaccagcgauacguaauca

SEQ ID NO: 265157 - RNA, 64 nt, hsa
aaaaacauacagacacucaaauuccacaagcuaaugaacaaaagggacucuugugagaagacua

SEQ ID NO: 265158 - RNA, 64 nt, hsa
cuccugcaggccaggaaguauaauagcaaaaaguugaacaaagaugaacuaauguauuacauua

SEQ ID NO: 265159 - RNA, 64 nt, hsa
gccuauuuugauuuagaaaucacuuuaagauaaaugaacaaaauuauuguaagucuucuaaacu

SEQ ID NO: 265160 - RNA, 64 nt, hsa
ugaaaaauaagaagaugagaguacacgguuguuaugaacaaaugacuuaaugcuuuuuaagcac

SEQ ID NO: 265161 - RNA, 64 nt, hsa
cuaggaguuucuuagacccuauguagauuauuaaugaacaaaagauuaaacuccaaauauuaaa

SEQ ID NO: 265162 - RNA, 64 nt, hsa
gccgaaaucaaagccaucugaagccugucucuggugaacaaacuuccucucuggccucucagga

SEQ ID NO: 265163 - RNA, 64 nt, hsa
gccaaucucucauuuagaccuggcuucuuucuucugaacaaaguaggguucaaaaugcagacug

SEQ ID NO: 265164 - RNA, 64 nt, hsa
aaucuuucagugccuuugucauaaaacaguuauuugaacaaacaaaaguacuguacucacacac

SEQ ID NO: 265165 - RNA, 64 nt, hsa
uucuacuaaaaguuuuaugcagugaaucucaguuugaacaaacuagcaacaauuaagugacccc

SEQ ID NO: 265166 - RNA, 64 nt, hsa
cuuuaaauuguuuuugguugaacaaaugcaagauugaacaaaauuaaaaauucauugaagcuga

SEQ ID NO: 265167 - RNA, 64 nt, hsa
ugauugucguguuccucuuuaaauuguuuuugguugaacaaaugcaagauugaacaaaauuaaa

SEQ ID NO: 265168 - RNA, 64 nt, hsa
gaaauuauccuuucuuacuaaugccuugaaagaaugaacaaauaaaaauucccagaccacagaa

SEQ ID NO: 265169 - RNA, 64 nt, hsa
uucauuuucauuuguugggcagaggcccaauaaaugaacaaauguacauacacucaggaaggua

SEQ ID NO: 265170 - RNA, 64 nt, hsa
uccuuuguuccucaaaccccaucugucagaccacugaacaaauacacauacuaggccucaagug

SEQ ID NO: 265171 - RNA, 64 nt, hsa
auaaagagcugauaacaguacucagaagaaucugugaacaaauacuugaaaauggguucaaugu

SEQ ID NO: 265172 - RNA, 64 nt, hsa
aauugguccaacccagccugagugcaccacccuuugaacaaauguaucagugaugaaaauuugc

SEQ ID NO: 265173 - RNA, 64 nt, hsa
aggcuggguccaggggagggaaaagcuaagagggugaacaaagaaaagacauugaaagcucuau

SEQ ID NO: 265174 - RNA, 64 nt, hsa
agcagacgaaacgaaguaagcuauauuucuggacugaacaaagcucugcuguuuagagcauuua

SEQ ID NO: 265175 - RNA, 64 nt, hsa
uguagaucugcuauugaaucagaaucuguguacuugaacaaaugugugaaucucaaauaucuca

SEQ ID NO: 265176 - RNA, 64 nt, hsa
gaaagaauauaaauauccuguacacggcagauugugaacaaacuauauuccuuuaaguuuuccu

SEQ ID NO: 265177 - RNA, 64 nt, hsa
ugauguucagauuuuccagugaaaaauacccuucugaacaaaacauguacuuacucuccgaaag

SEQ ID NO: 265178 - RNA, 64 nt, hsa
caagugccaaaggcagacgugcuuuauagcuaaaugaacaaagcaaaggauacagagguauguu

SEQ ID NO: 265179 - RNA, 64 nt, hsa
uuauuggccagggaaaacuaauucaauuuuuuuuugaacaaaguauaacugagacuauuuuugg

SEQ ID NO: 265180 - RNA, 64 nt, hsa; identical to SEQ ID NO: 168843

SEQ ID NO: 265181 - RNA, 64 nt, hsa; identical to SEQ ID NO: 168844

SEQ ID NO: 265182 - RNA, 56 nt, hsa; identical to SEQ ID NO: 168845

SEQ ID NO: 265183 - RNA, 64 nt, hsa; identical to SEQ ID NO: 168846

SEQ ID NO: 265184 - RNA, 64 nt, hsa; identical to SEQ ID NO: 168847

SEQ ID NO: 265185 - RNA, 64 nt, hsa; identical to SEQ ID NO: 168848

SEQ ID NO: 265186 - RNA, 64 nt, hsa; identical to SEQ ID NO: 168849

SEQ ID NO: 265187 - RNA, 64 nt, hsa; identical to SEQ ID NO: 168850

SEQ ID NO: 265188 - RNA, 64 nt, hsa; identical to SEQ ID NO: 168851

SEQ ID NO: 265189 - RNA, 64 nt, hsa; identical to SEQ ID NO: 168852

SEQ ID NO: 265190 - RNA, 64 nt, hsa; identical to SEQ ID NO: 168853

SEQ ID NO: 265191 - RNA, 64 nt, hsa; identical to SEQ ID NO: 168854

SEQ ID NO: 265192 - RNA, 64 nt, hsa; identical to SEQ ID NO: 168855

SEQ ID NO: 265193 - RNA, 64 nt, hsa; identical to SEQ ID NO: 168856

SEQ ID NO: 265194 - RNA, 64 nt, hsa; identical to SEQ ID NO: 168857

SEQ ID NO: 265195 - RNA, 64 nt, hsa; identical to SEQ ID NO: 168858

SEQ ID NO: 265196 - RNA, 64 nt, hsa; identical to SEQ ID NO: 168859

SEQ ID NO: 265197 - RNA, 64 nt, hsa; identical to SEQ ID NO: 168860

SEQ ID NO: 265198 - RNA, 64 nt, hsa
accuaaaucucccauccaguucaggaggugacaacauccuuauuuuaaacuuccuaaaauuagg

SEQ ID NO: 265199 - RNA, 64 nt, hsa
gucacuuggaggcagccaacacuucuggacauugcauccuuauucacacauguggcagcugaac

SEQ ID NO: 265200 - RNA, 64 nt, hsa
uguacuuuuccuuugcuaguuguuugggcuuuaacauccuuauucagccuuauccagguugguu

SEQ ID NO: 265201 - RNA, 64 nt, hsa
ccagacugacagacuuagaaccugaggucucauucauccuuaugguuuaggccuugccaguuuu

SEQ ID NO: 265202 - RNA, 64 nt, hsa
cacagucccucagguucuacugggaucucaucaucauccuuagucaagcagcagggcccuggcc

SEQ ID NO: 265203 - RNA, 64 nt, hsa
gcuggaucaugcuugcccuccacagggaauacagcauccuuacagcuugcaugcaaucaaccuc

SEQ ID NO: 265204 - RNA, 64 nt, hsa
cuuuucucugauguuuuaccuuuaaaagauccaacauccuuaccguugguauuuuuaguaaggu

SEQ ID NO: 265205 - RNA, 64 nt, hsa
agagauagccauuauuauuaauauuugguauguacauccuuauauuauuuuuuucuuaugcaug

SEQ ID NO: 265206 - RNA, 62 nt, hsa
ugggggaggcacuggcgggaggccucgggcuccccuggaagggcgcugggcuggcgggucag

SEQ ID NO: 265207 - RNA, 62 nt, hsa
gcuguggaagaacucugcucgagggcagggugcccuggaacacugguaguucuggggcuggg

SEQ ID NO: 265208 - RNA, 62 nt, hsa
auuuguuuucugugagagcacugaaauggcagcccuggaaucuacaauuuggcucuccacug

SEQ ID NO: 265209 - RNA, 62 nt, hsa
cacagccgguucugcacuuaucaccgagucgccccuggaagcagauucccauugaguuuucc

SEQ ID NO: 265210 - RNA, 62 nt, hsa
gggcaugugugccuguggcagaaaagaggagacccuggaauucagcacccugggugccauuc

SEQ ID NO: 265211 - RNA, 62 nt, hsa
uggaaggcagggcagagggaauguucccugcacccuggaaaggggaguugagucacaagagg

SEQ ID NO: 265212 - RNA, 62 nt, hsa
uaauuugaccacagcaucugaacucccucucucccuggaauaaguauuuuucccacauuuuu

SEQ ID NO: 265213 - RNA, 62 nt, hsa
uaaaagcaguauuuuaagguuggugucuuacucccuggaagccugaaauggguggaauagcg

SEQ ID NO: 265214 - RNA, 57 nt, hsa
cccagcucagcaucagcuaaaccacaacccuggaagaggcggccuaaggagauucca

SEQ ID NO: 265215 - RNA, 62 nt, hsa
cuuaaaaagauacacaaagaugggcugugggucccuggaaagggggagaguugcccuuuaca

SEQ ID NO: 265216 - RNA, 62 nt, hsa
augaacaugagaaaauuuauacuguagagaaacccuggaaaugugaagaacguggcaaaguu

SEQ ID NO: 265217 - RNA, 62 nt, hsa
acuguauauauauaauuccuacugaagaaauccccuggaaaugcaaaaaauguggcaggauu

SEQ ID NO: 265218 - RNA, 62 nt, hsa
aguccuuuaaaaugaguagaagcaaccuguuacccuggaaagagcacuggacauagaccuag

SEQ ID NO: 265219 - RNA, 62 nt, hsa
ucuggaacagcggcaaccaagaggccuugcagcccuggaagugggucagggcccuugguggu

SEQ ID NO: 265220 - RNA, 62 nt, hsa
gaagagccucauccugucugccccucacucugcccuggaaucaacaucuuccgaguccuucu

SEQ ID NO: 265221 - RNA, 62 nt, hsa
gguguugagauggggcagcucugaauccuagacccuggaauagccugucccuuuucucuggg

SEQ ID NO: 265222 - RNA, 62 nt, hsa
ugaagcccuuggugaugaggacauagcaucugcccuggaaaucguuauuccaacauaauauu

SEQ ID NO: 265223 - RNA, 62 nt, hsa
guuauuccaacauaauauuauuuucuagaaugcccuggaaggacagaauauuuaaaaauaua

SEQ ID NO: 265224 - RNA, 62 nt, hsa
ccccaagagaauaccaagacaagcaggcuguucccuggaaaaaaucuaaugcaaggagggcu

SEQ ID NO: 265225 - RNA, 62 nt, hsa
ccacacagggggcgugggagcaucccaguuaucccuggaaagcuagaaggggacagaggugu

SEQ ID NO: 265226 - RNA, 62 nt, hsa
gguuucaagaagucuuagggcuuccagggguccccuggaagcuuuagaauauuuauggguuu

SEQ ID NO: 265227 - RNA, 62 nt, hsa
ggacaggaagccuggcacccacuucugucuuccccuggaacugggcacuggcguacacuggu

SEQ ID NO: 265228 - RNA, 62 nt, hsa
ccauggauggucuuccuaguugccuggggaaacccuggaaugggcaucaggagaaagcaaca

SEQ ID NO: 265229 - RNA, 62 nt, hsa
ccaccccacugggcccaaccaugggcucaggacccuggaauuccguuuucugauuugcuuug

SEQ ID NO: 265230 - RNA, 62 nt, hsa
gagggcagggcugcggggaggccaggccgagccccuggaaccaucccguccuguaucauaug

SEQ ID NO: 265231 - RNA, 62 nt, hsa
auguaaaggucuguuguugaauuguacucugccccuggaagcagauacagauggcugccugc

SEQ ID NO: 265232 - RNA, 62 nt, hsa
gcccucugaggccccguacaccagaagggaggcccuggaaaauuuugugcuuccaacguggc

SEQ ID NO: 265233 - RNA, 62 nt, hsa
ugaacuaacaaaccugugaacuguaaauaggccccuggaagcacgugcuuaagcccuuuugc

SEQ ID NO: 265234 - RNA, 62 nt, hsa
uaggaucugcauuuucagguuccgagccugaccccuggaacugaccagcgcucgauugucag

SEQ ID NO: 265235 - RNA, 62 nt, hsa
cugggaaauugaggggacggcaggcccggcugcccuggaacugggagacagggagaaucccc

SEQ ID NO: 265236 - RNA, 62 nt, hsa
acugggagacagggagaauccccugccggggucccuggaaacagugcccaccccacaucacu

SEQ ID NO: 265237 - RNA, 62 nt, hsa
agcgaggggcagauucuagucgggagcccaugcccuggaaauccaucuuucuucaucuuucc

SEQ ID NO: 265238 - RNA, 62 nt, hsa
ugcaccuccuuucccucucuccaucuuccaaucccuggaaaagucuggucugagugugacuu

SEQ ID NO: 265239 - RNA, 62 nt, hsa
aguuuuguaggggucacugucacaugcuugugcccuggaagccccaaggcucuuccuccagc

SEQ ID NO: 265240 - RNA, 64 nt, hsa
gcaggugugccagggcucagggcucagacuugggagggccuaggcagaagccccaaguucuguu

SEQ ID NO: 265241 - RNA, 64 nt, hsa
gccuuuugcugugucuucgcuguguguuagacguagggccuagagcucggggugugugugugcg

SEQ ID NO: 265242 - RNA, 64 nt, hsa
ggugccuaaugcuacuggaaguggaacuugagauagggccuaauuuguuauacauauuagccaa

SEQ ID NO: 265243 - RNA, 64 nt, hsa
guuuauuccuucaaucauuucaaacauugaaaguagggccuacaugguuauuugccugcucacu

SEQ ID NO: 265244 - RNA, 60 nt, hsa
ggaauuuauagaggcuacaaccacauuuguucacaggaguuuuuggugcggggugggaag

SEQ ID NO: 265245 - RNA, 60 nt, hsa
guuguaacucccauguggaguaucagucgcucacaggacuuggaucugaagcacaguaaa

SEQ ID NO: 265246 - RNA, 60 nt, hsa
agaguuaucaaggcacauucuccaccacugucacaggaaggacaugucaaucuuggucau

SEQ ID NO: 265247 - RNA, 60 nt, hsa
agaguuaucgaggcacauacuucaccacugucacaggaagaaccugccaagcuuggucau

SEQ ID NO: 265248 - RNA, 60 nt, hsa
agaguuaucgaggcacauacuucaccaccgucacaggaagcacuugccaagcuuggucau

SEQ ID NO: 265249 - RNA, 60 nt, hsa
gcucccgcaccugucgguggcugccuuugaucacaggagcaaucacaggaaaauguaucc

SEQ ID NO: 265250 - RNA, 60 nt, hsa
gucgguggcugccuuugaucacaggagcaaucacaggaaaauguauccagaggaauugau

SEQ ID NO: 265251 - RNA, 60 nt, hsa
uaguggaauucuuaaauuaugggaauguauucacaggaagacggugauucuugcccuuaa

SEQ ID NO: 265252 - RNA, 60 nt, hsa
ucuuuuuaagcuugaaacugcagaagaaauucacaggaaaaaucaacaagauagugaucu

SEQ ID NO: 265253 - RNA, 60 nt, hsa
ucagaaaugcagacaccccagacgagagccucacaggagggagggggccccacaggcucc

SEQ ID NO: 265254 - RNA, 60 nt, hsa
ugcauggagaaaugggcuggccccacagccucacaggagcaguuugugggcugguuuccc

SEQ ID NO: 265255 - RNA, 60 nt, hsa
aaagaaaaccauuuucagggagcucagacgucacaggagggagcgggagcaggauguggc

SEQ ID NO: 265256 - RNA, 60 nt, hsa
aaucuuuacuccuguaagcaagagccaaccucacaggauuaggagcugggguagaacugg

SEQ ID NO: 265257 - RNA, 60 nt, hsa
uuaaagauauggcugcuucaaaggccagagucacaggaaggacuucuuccagggagauua

SEQ ID NO: 265258 - RNA, 60 nt, hsa
gaugaagaccuagacuuaccugaaggaucuucacaggaggauaaagacguagaauuaccu

SEQ ID NO: 265259 - RNA, 60 nt, hsa
gauaaagacguagaauuaccugaaggaucuucacaggaggaugaagaccuagagaaaaag

SEQ ID NO: 265260 - RNA, 60 nt, hsa
gaugaagaccuacaauuaccugaaggaucuucacaggaggaugaagaccuaggguuaucu

SEQ ID NO: 265261 - RNA, 60 nt, hsa
ccaguccaagaggaggaggacgaaggauccucacaggaggaugaagaccuagacucaucu

SEQ ID NO: 265262 - RNA, 64 nt, hsa
cucccuggcuucucugacccucaaaggagaugccacgcaggacagacuggagagagaagccugg

SEQ ID NO: 265263 - RNA, 64 nt, hsa
gccacccugggccuggcagcucagcuuccccaacacgcaggagcacacccagcccccacauccu

SEQ ID NO: 265264 - RNA, 64 nt, hsa
uggggagacuccccucuugcuguguguacuggacacgcaggaagcaugcugucuugcugccucu

SEQ ID NO: 265265 - RNA, 64 nt, hsa
guggcgaggggugcgcuguggaacugccgcagccacgcaggaggucccugggggaugcuuuggg

SEQ ID NO: 265266 - RNA, 64 nt, hsa
ugaaaaccucggaaguuuuaauuugagguuaucugcuacgaaacaguauuucuaaaaggcuaaa

SEQ ID NO: 265267 - RNA, 64 nt, hsa
ccaaaggcccaaaggugauggucaucgagauggagcuacgaaaggaugagcagagcccggagcu

SEQ ID NO: 265268 - RNA, 64 nt, hsa
cuccaccucagcauugcaucguaucaucauuuucgcuacgaauuuauuuuucaacaauaagcuu

SEQ ID NO: 265269 - RNA, 64 nt, hsa
cacagcggagaccgccuccaacaacgaauuuggggcuacgaagaggaauagcgaaaaagcaaau

SEQ ID NO: 265270 - RNA, 64 nt, hsa
uacaaaagaaaccaugcaaagcaacgacuacuuugcuacgaagaaagacuccuuuccugcaucu

SEQ ID NO: 265271 - RNA, 64 nt, hsa
cagacccgggaagggaaguccgcagccgacgcccgcuacgaagcagccugcaacaggcuggcca

SEQ ID NO: 265272 - RNA, 64 nt, hsa
ggaauggaccuuguauagaucuggaggaaagaaagcuacgaaaaacuuuuuaaaaguucuagug

SEQ ID NO: 265273 - RNA, 64 nt, hsa
aguuaacuguuuuuuuuuuagucaaaaugaucaugcuacgaaaagaugcuucugagagaaugua

SEQ ID NO: 265274 - RNA, 64 nt, hsa
ucagaagaacugagcaaacuaacagaaauacaaggcuacgaacaguuuaguggacaacuaaauc

SEQ ID NO: 265275 - RNA, 64 nt, hsa
cagcaggcgugaggcacugugcgucugcagaggggcuacgaaccaggugcagggucccagcugg

SEQ ID NO: 265276 - RNA, 64 nt, hsa
ggcccgggauagaagaggggagguaagucugggggcuacgaagccgggcccccacacccuggcu

SEQ ID NO: 265277 - RNA, 64 nt, hsa
agcugacagccuuggaguucagugcuuccccagggcuacgaaggaagcugaacacgcguccagu

SEQ ID NO: 265278 - RNA, 64 nt, hsa
cugcgcucugccacuguccggaaauucaugguuggcuacgaaaugcuugcucaggcucagaggg

SEQ ID NO: 265279 - RNA, 64 nt, hsa
aaagugcauaugaaauccuugacuggaccugguggcuacgaaucuuccgauggaugaaucuccc

SEQ ID NO: 265280 - RNA, 64 nt, hsa
auguauguguuauaauacaacuuaguacauuaaagcuacgaaaacucauccuggcuguaggaua

SEQ ID NO: 265281 - RNA, 64 nt, hsa
agugggcuggcugagauuucaucccaggcugccugcuacgaagcuccucaucugccucccucga

SEQ ID NO: 265282 - RNA, 64 nt, hsa
acaacguauguaauuguaacauugcaguaauggugcuacgaagccauuucucuugauuuuuagu

SEQ ID NO: 265283 - RNA, 64 nt, hsa
gccaacauccgucucuugagcaugguuuuuagaggcuacgaauaaggcuaugaauaaggguuau

SEQ ID NO: 265284 - RNA, 64 nt, hsa
gagaaaauggagguuuauggucuguucucacacugcuacgaagaaauaccccaaacuggguaau

SEQ ID NO: 265285 - RNA, 64 nt, hsa
ggucuccuuugugugugaagcuggggcagaguaugcuacgaagggaccaggccaggccacaggg

SEQ ID NO: 265286 - RNA, 64 nt, hsa
aauguuaaguacaacauucugaaaauacaauuuggcuacgaagaguauucaucuucuuugaagc

SEQ ID NO: 265287 - RNA, 64 nt, hsa
aaucuugucccucuguugagcccagaucucaugugcuacgaaggaaaccccaagacccagagag

SEQ ID NO: 265288 - RNA, 64 nt, hsa
ccucgggggacuggacacacauccugccagaggcgcuacgaagcuuugcccagaugaagccagg

SEQ ID NO: 265289 - RNA, 64 nt, hsa
ccuagggauaagcaauguucuuuauguagccaaugcuacgaaacaaaagaggugaaagagaccc

SEQ ID NO: 265290 - RNA, 64 nt, hsa
ugcagauaugugaauggacuccauggacagaaaagcuacgaauguauggaguguaggaaagccu

SEQ ID NO: 265291 - RNA, 64 nt, hsa
accaaagguuuacauuugcaccuuagccucaauagcuacgaacccuagagaagcagcuagcugg

SEQ ID NO: 265292 - RNA, 64 nt, hsa
aaggcucugugggaggaugaaggagugcgugccugcuacgaacgcuccaacgaguaccagcuga

SEQ ID NO: 265293 - RNA, 64 nt, hsa
uacauugagggaauaucaaaaaauagcguucauggcuacgaauauguagaauguuaaaagcaca

SEQ ID NO: 265294 - RNA, 64 nt, hsa
auaauccugaaaugaagagaauucccuuccagaagcuacgaaaaagggagcuguuuaaauuuaa

SEQ ID NO: 265295 - RNA, 64 nt, hsa
uuguguggagugugcgugugcaggcagugugggugcauggcagcguaacuguggaguggauggg

SEQ ID NO: 265296 - RNA, 64 nt, hsa
cccauugcugccaaugcuggcagccccuccccuggcauggcaggaccaucgccacucugggcac

SEQ ID NO: 265297 - RNA, 64 nt, hsa
ugcagaauguauguaauaaaauaagcuuggccuagcauggcaaaucagauuuauacaggagucu

SEQ ID NO: 265298 - RNA, 64 nt, hsa
acuguggcccaucaacagacguugauaugcaacugcauggcaugugcuguuuugguugaaauca

SEQ ID NO: 265299 - RNA, 64 nt, hsa; identical to SEQ ID NO: 112230

SEQ ID NO: 265300 - RNA, 64 nt, hsa; identical to SEQ ID NO: 112231

SEQ ID NO: 265301 - RNA, 64 nt, hsa; identical to SEQ ID NO: 112232

SEQ ID NO: 265302 - RNA, 64 nt, hsa; identical to SEQ ID NO: 112233

SEQ ID NO: 265303 - RNA, 64 nt, hsa; identical to SEQ ID NO: 112234

SEQ ID NO: 265304 - RNA, 64 nt, hsa; identical to SEQ ID NO: 112235

SEQ ID NO: 265305 - RNA, 64 nt, hsa; identical to SEQ ID NO: 112236

SEQ ID NO: 265306 - RNA, 64 nt, hsa; identical to SEQ ID NO: 112237

SEQ ID NO: 265307 - RNA, 64 nt, hsa; identical to SEQ ID NO: 112238

SEQ ID NO: 265308 - RNA, 64 nt, hsa; identical to SEQ ID NO: 112239

SEQ ID NO: 265309 - RNA, 64 nt, hsa; identical to SEQ ID NO: 112240

SEQ ID NO: 265310 - RNA, 64 nt, hsa; identical to SEQ ID NO: 112241

SEQ ID NO: 265311 - RNA, 64 nt, hsa; identical to SEQ ID NO: 112242

SEQ ID NO: 265312 - RNA, 64 nt, hsa; identical to SEQ ID NO: 112243

SEQ ID NO: 265313 - RNA, 64 nt, hsa; identical to SEQ ID NO: 112244

SEQ ID NO: 265314 - RNA, 64 nt, hsa; identical to SEQ ID NO: 112245

SEQ ID NO: 265315 - RNA, 64 nt, hsa; identical to SEQ ID NO: 112246

SEQ ID NO: 265316 - RNA, 64 nt, hsa; identical to SEQ ID NO: 112247

SEQ ID NO: 265317 - RNA, 64 nt, hsa; identical to SEQ ID NO: 112248

SEQ ID NO: 265318 - RNA, 64 nt, hsa; identical to SEQ ID NO: 112249

SEQ ID NO: 265319 - RNA, 64 nt, hsa; identical to SEQ ID NO: 112250

SEQ ID NO: 265320 - RNA, 64 nt, hsa; identical to SEQ ID NO: 112251

SEQ ID NO: 265321 - RNA, 64 nt, hsa; identical to SEQ ID NO: 112252

SEQ ID NO: 265322 - RNA, 64 nt, hsa; identical to SEQ ID NO: 112253

SEQ ID NO: 265323 - RNA, 64 nt, hsa; identical to SEQ ID NO: 112254

SEQ ID NO: 265324 - RNA, 64 nt, hsa; identical to SEQ ID NO: 112255

SEQ ID NO: 265325 - RNA, 64 nt, hsa; identical to SEQ ID NO: 112256

SEQ ID NO: 265326 - RNA, 64 nt, hsa; identical to SEQ ID NO: 112257

SEQ ID NO: 265327 - RNA, 64 nt, hsa; identical to SEQ ID NO: 112258

SEQ ID NO: 265328 - RNA, 64 nt, hsa
cuagcuguauuccuaaacaaauuguuuccuaaacaaaugugaaaaugugaacagugcugaaagg

SEQ ID NO: 265329 - RNA, 64 nt, hsa
auuccuaaacaaauuguuuccuaaacaaaugugaaaaugugaacagugcugaaagguuuuguga

SEQ ID NO: 265330 - RNA, 64 nt, hsa
auuagaaacauagacucccaaguuuuaaacaccuaaaugugaauaacccauauauacaacaaag

SEQ ID NO: 265331 - RNA, 64 nt, hsa
cuaacccuuaacuaaaguguaggauuuuaaaauuaaaugugagguaaaauaaguuuauuuuuaa

SEQ ID NO: 265332 - RNA, 64 nt, hsa
cauaucuggaucuguguauuugauuuuguacuuuaaaugugacaaauaaaccuuuugggagaaa

SEQ ID NO: 265333 - RNA, 64 nt, hsa
gaaguguauaguguauauauaaccuuuccuauggaaaugugacauugaguacauuuuguguugc

SEQ ID NO: 265334 - RNA, 64 nt, hsa
cuguuguacauugcauagauguacacacgaauuuaaaugugaugucuuuguauauaucuguaua

SEQ ID NO: 265335 - RNA, 64 nt, hsa
uguuccugaaguaaccgccaguggucuuuaaacuaaaugugacauuguggagguucugaguaag

SEQ ID NO: 265336 - RNA, 64 nt, hsa
ucugcgcacaaaagccaaacgcauccgacucucuaaaugugauuuauuucuugcuuugagauug

SEQ ID NO: 265337 - RNA, 64 nt, hsa
acuagcuuuuaaaaauacaguacaaagacuuuguaaaugugauucagggcccccagcaccccug

SEQ ID NO: 265338 - RNA, 64 nt, hsa
agaaauugcuuuagcuucuggucagcacugauuaaaaugugaauagugaaguggcuauccuaaa

SEQ ID NO: 265339 - RNA, 64 nt, hsa
aaauaagccugccgccaaaauaaaucacuuaucaaaaugugaacuguuuuccucauguucaguu

SEQ ID NO: 265340 - RNA, 64 nt, hsa
aauaccucaguuuugagguuaugcacacuaaauuaaaugugacauaaauuaauuuguacaaaaa

SEQ ID NO: 265341 - RNA, 64 nt, hsa
caugggaucugcugcugcauuaaaucgggaaagaaaaugugaagauuucauuuggaaucacaga

SEQ ID NO: 265342 - RNA, 64 nt, hsa
acaugagaaaauuuauacuguagagaaacccuggaaaugugaagaacguggcaaaguucuuuac

SEQ ID NO: 265343 - RNA, 64 nt, hsa
acauaagagaauucauaccggagagaaacuguacaaaugugaagaauauggcaaagccugugaa

SEQ ID NO: 265344 - RNA, 64 nt, hsa
acaagauaauucauucuggggaaaaaaaugcuacaaaugugaaaaacguggcagagccuucaga

SEQ ID NO: 265345 - RNA, 64 nt, hsa
cauaaugagaacucauacuggaggaaagucuuacaaaugugaagaauguggcagucuuuaaauc

SEQ ID NO: 265346 - RNA, 64 nt, hsa
gcaagcacccaucguauuauccaaauuuuguugcaaaugugauuaauuugguugucaaguuuug

SEQ ID NO: 265347 - RNA, 64 nt, hsa
cauuucugccagcgcauguguccuuucaaggggaaaaugugaagcugaacccccuccagacacc

SEQ ID NO: 265348 - RNA, 64 nt, hsa
uagcuuauaagucucaaauuuuugccuuuuacuaaaaugugauuguuucuauucauuguguaug

SEQ ID NO: 265349 - RNA, 64 nt, hsa
gugguuuucucucaauaauaagugaaccaauuucaaaugugaucacaaaguuuggaaagcuuuu

SEQ ID NO: 265350 - RNA, 64 nt, hsa
auagagcaucaaucaauauaagcauuauugagaaaaaugugacccguaacacuguguucuggau

SEQ ID NO: 265351 - RNA, 64 nt, hsa
aaaaaugugacccguaacacuguguucuggauaaaaaugugauuaggaaucacgcaaagugcuu

SEQ ID NO: 265352 - RNA, 64 nt, hsa
uacaguucucucacaccaagggccccauaguuauaaaugugaaauuauauuccaggucaaaauu

SEQ ID NO: 265353 - RNA, 64 nt, hsa
uaugugacaaggaucuagaaauucugagaggggaaaaugugauuuuggauuuacaaugacaggg

SEQ ID NO: 265354 - RNA, 64 nt, hsa
guuuaaauuuaaaaugcagagagaccaaugguuaaaaugugaauaguauuguaacuauuuuaag

SEQ ID NO: 265355 - RNA, 64 nt, hsa
ucuuuccagaagaggagacaaaagcaagauagccaaaugugacaucaagcuccauuguuucgga

SEQ ID NO: 265356 - RNA, 64 nt, hsa
cacucuuauuuuucuguaaaauauuucacaucccaaaugugaagaagugaaaaagacuucgcag

SEQ ID NO: 265357 - RNA, 64 nt, hsa
gacaaagucauuacaaaugugacuaagucauuacaaaugugacugagucauuacaguggacccu

SEQ ID NO: 265358 - RNA, 64 nt, hsa
ggaaaagguaucuugguuaugacaaagucauuacaaaugugacuaagucauuacaaaugugacu

SEQ ID NO: 265359 - RNA, 64 nt, hsa
agacauuuaaaaucaaauaucaaguagaauugaaaaaugugaguuacauaaguuaaaaacuuac

SEQ ID NO: 265360 - RNA, 64 nt, hsa
uuaaguauauggauaaaaaguuaugaacuauuaaaaaugugauguggaccaaaggcuagguugu

SEQ ID NO: 265361 - RNA, 64 nt, hsa
uuacaucuugugguuauucuggguuguggaaggaaaaugugaaugaaaguagugcuggaugcaa

SEQ ID NO: 265362 - RNA, 64 nt, hsa
cuaaagagagacagcagaaauaaagaucagaagcaaaugugagcaaaucuguuuuacuguuaac

SEQ ID NO: 265363 - RNA, 64 nt, hsa
gaccuuuucuuuagucccaaccacuaguuuuaacaaaugugaauuauugaaaugugaagggaca

SEQ ID NO: 265364 - RNA, 64 nt, hsa
cccaaccacuaguuuuaacaaaugugaauuauugaaaugugaagggacaaaaagaaucauacau

SEQ ID NO: 265365 - RNA, 64 nt, hsa
aguucaaugaucguuuucacuuacugcuuuuaguaaaugugacucgcuguaauucaccauaacu

SEQ ID NO: 265366 - RNA, 64 nt, hsa
uggaggccuaggccuuguugaaggcuucaucaggaaaugugacgcagagauugugcugcugugc

SEQ ID NO: 265367 - RNA, 64 nt, hsa
cugaccuggagugacuggaauagcaccuggggauaaaugugacaacugugcauugaacccuggg

SEQ ID NO: 265368 - RNA, 64 nt, hsa
cagagcaaagggcaucagggagaaagucccgaggaaaugugaccagugguuucugcucggagcu

SEQ ID NO: 265369 - RNA, 64 nt, hsa
acacauaggaaaauucauacuggagagaaacuacaaaugugaagaauguguuaaagccuuuaac

SEQ ID NO: 265370 - RNA, 64 nt, hsa
aaguugagaaaauucguacuggagagaauccuacaaaugugaaaaauguggcaaauccuuuaac

SEQ ID NO: 265371 - RNA, 64 nt, hsa
agauaagaaaauucauacuggaaagaaacccuacaaaugugaagucuguggcaaagcuuuuaac

SEQ ID NO: 265372 - RNA, 64 nt, hsa
uauaagacaguuuauacuuugagagaaacccugcaaaugugaauaauguggcaauacuuuaaac

SEQ ID NO: 265373 - RNA, 64 nt, hsa
uucuaacauaaaucauacuggugaaaaauccuagaaaugugaaaaauaucacaaagccuuuaaa

SEQ ID NO: 265374 - RNA, 64 nt, hsa
acauaagaaaauuuacacuagagagaaagccuacaaaugugaagaauguggcaaagccuuuaac

SEQ ID NO: 265375 - RNA, 64 nt, hsa
acauaagauaauucauagcggagagaaaccccacaaaugugaagaauguggcagagcuuuuaac

SEQ ID NO: 265376 - RNA, 64 nt, hsa
acauaagauaauucacaguggagaaaaacccuacaaaugugaagaauguggcaaagcuuuuaac

SEQ ID NO: 265377 - RNA, 64 nt, hsa
acauaagaaaauucauaguaaagagaaacccuacaaaugugaacaguguggcaaggucuuuaag

SEQ ID NO: 265378 - RNA, 64 nt, hsa
acauaagaucauucauacuggagagaaaccuuacaaaugugaggaauguggcaaagguuuuagc

SEQ ID NO: 265379 - RNA, 64 nt, hsa
acacaagaagauucauacuagagagaaacccuacaaaugugaagaauguggcauaucuuuuaac

SEQ ID NO: 265380 - RNA, 64 nt, hsa
acauaagaugauucacacuugaaugaaacccuacaaaugugaacgauguggcaguuguuuuaac

SEQ ID NO: 265381 - RNA, 64 nt, hsa
gcauaagaaaauucaaacuggagagaaacucuacaaaugugaagaauguggcaaagcuuuuaac

SEQ ID NO: 265382 - RNA, 64 nt, hsa
uacaccuaaaauucaugcaggagagaaacaccacaaaugugaaaaauuugguaaauucuuuaac

SEQ ID NO: 265383 - RNA, 64 nt, hsa
augggagagcaucccuaacacugagaaauccuauaaaugugauguaugugggaaaauuuuccau

SEQ ID NO: 265384 - RNA, 64 nt, hsa
acauaaaagaauacacacuagagaaaaaccuuacaaaugugaagcaucugauaaauccugugaa

SEQ ID NO: 265385 - RNA, 64 nt, hsa
acaagagcuaaaauugacauaacuuaauauuuuaaaaugugauuuaaaaaaaauguugaaaugu

SEQ ID NO: 265386 - RNA, 64 nt, hsa
uaauauuuuaaaaugugauuuaaaaaaaauguugaaaugugauucccucagauaauuucuugua

SEQ ID NO: 265387 - RNA, 64 nt, hsa
acauaagauaauucauacugaagagaaacaguacaaaugugaugaauguggcaaagcuucuacc

SEQ ID NO: 265388 - RNA, 64 nt, hsa
acauaagagaauucauacuggagagaaacccuacaaaugugaagaauguggcaaagcuuuuaac

SEQ ID NO: 265389 - RNA, 64 nt, hsa
cuagaaaacacugacuuuguuuuuauaaguuauuaaaugugaaauugaucugcaucagcuuauu

SEQ ID NO: 265390 - RNA, 64 nt, hsa
augaaaacauuuguaaggcugcaacauaauauuaaaaugugaauaaauaaauguucugauaaaa

SEQ ID NO: 265391 - RNA, 64 nt, hsa
gugaaaauguguuuacuucagaacggcacuacauaaaugugaaaaguuguugaucuugaaauau

SEQ ID NO: 265392 - RNA, 64 nt, hsa
aguugacuuuaaugaaucuuugguguggaaugaaaaaugugaacuucuuacucauagugugguu

SEQ ID NO: 265393 - RNA, 64 nt, hsa
uaaaguaacacuuuguacauaacaaauacucagcaaaugugaaacuuuauuugcucuuacuuca

SEQ ID NO: 265394 - RNA, 64 nt, hsa
agcuuauaaugaaaaccuugccugccuuuauaaaaaaugugauuaucuucuucuguuaauguca

SEQ ID NO: 265395 - RNA, 64 nt, hsa
accaauaaaggguggauguucaacaugugccuucaaaugugacccacugagaaggaaacaacau

SEQ ID NO: 265396 - RNA, 64 nt, hsa
ucucuuuugcaauagaacgucauggaccaguguuaaaugugaguggaaggaguucuggaauugg

SEQ ID NO: 265397 - RNA, 64 nt, hsa
ggauaauuuauagacagauaauuuauagacagguaaaugugaguuaaauauaacucacauccca

SEQ ID NO: 265398 - RNA, 64 nt, hsa
ugugaaagcauauuuagauuuuauauacuaucugaaaugugauuuguuaagauucuuaaauuug

SEQ ID NO: 265399 - RNA, 64 nt, hsa
uuuucuguccuuaauuuuuugagcaaaaucuggaaaaugugaaagcauauuuagauuuuauaua

SEQ ID NO: 265400 - RNA, 64 nt, hsa
acuuaccuacugaacugcuacuguugccugagaaaaaugugauuuuuauucugcuuguauuuaa

SEQ ID NO: 265401 - RNA, 64 nt, hsa
acuagagcugcuugcaugcguuacuaauacaaacaaaugugaucaagccacuuaccuacugaac

SEQ ID NO: 265402 - RNA, 64 nt, hsa
acugguugaaaauguugacccuauccuguuauuuaaaugugaacauuuauuguacauucaguga

SEQ ID NO: 265403 - RNA, 64 nt, hsa
aagacggucaacuucacacuuagggaaaaaauuaaaaugugauggccacuucuaauaauucagg

SEQ ID NO: 265404 - RNA, 64 nt, hsa
caucauuaacaguuuguccuuaggaugcaaaugaaaaugugaauacauaccuuguuguacuguu

SEQ ID NO: 265405 - RNA, 64 nt, hsa
uuuuaaucauaagccuuaauaagauuuuucuaagaaaugugaaauagaacaauuuucaucuaau

SEQ ID NO: 265406 - RNA, 64 nt, hsa
aggagcuaguuuacaggcuuacugugauuuaagcaaaugugaaaagugaaaccuuaauuuuauc

SEQ ID NO: 265407 - RNA, 64 nt, hsa
caggguuuccugaaacuggguuaauucuuuauagaaaugugaacacugaauuuauuuuaaaaaa

SEQ ID NO: 265408 - RNA, 64 nt, hsa
gaccuggugucuccugcccacccuggucccagguaaaugugaauggagacagguaugagaggcu

SEQ ID NO: 265409 - RNA, 64 nt, hsa
gucagcaaauuggaagaggauccgaugggaguguaaaugugagacacaaugucuugauuauacc

SEQ ID NO: 265410 - RNA, 64 nt, hsa
caguaaucaaaaugugaucuaguguaaugaaauaaaaugugaucuaguguaauggaagaccuuu

SEQ ID NO: 265411 - RNA, 64 nt, hsa
aaauaaggaauacauuuucaaaaugcaguaaucaaaaugugaucuaguguaaugaaauaaaaug

SEQ ID NO: 265412 - RNA, 64 nt, hsa
uugguaguuguuuaugaaauuaccagauauucauaaaugugacaaaugaacagcaggauuauga

SEQ ID NO: 265413 - RNA, 64 nt, hsa
uuuuauuaaacaaguagacauuuuguuauuaaaaaaaugugaucuguaauuucuuugugcagaa

SEQ ID NO: 265414 - RNA, 64 nt, hsa
uuggugauaacugccucguuuaaauggucacaagaaaugugaagagagagcuagggcagacaug

SEQ ID NO: 265415 - RNA, 64 nt, hsa
uuauauuauuuggcuagaaauugcuguuuuuaauaaaugugaauuuuuuaaaaauaaagauuuu

SEQ ID NO: 265416 - RNA, 64 nt, hsa
acaaucacuguucuauaggcuuaugaucugagcaaaaugugaacuucaguauguuuacuauugc

SEQ ID NO: 265417 - RNA, 64 nt, hsa
uuaaacaacccuuguuuccagauaaguguauuuuaaaugugaccuuucguaaauuugggcugga

SEQ ID NO: 265418 - RNA, 64 nt, hsa
gguuuuuuuggguaacaaucccgcagcugacaaaaaaugugaaauuuccacaaaauauccaacu

SEQ ID NO: 265419 - RNA, 64 nt, hsa
uuuagccagaaagcaaaaaaacaauaguaaugauaaaugugaacauuuuugcuuauucauugaa

SEQ ID NO: 265420 - RNA, 63 nt, hsa
aagguucacuuguaaaacaauaaaguacuaaagaaaaugugauaauacuuucgugauuuugug

SEQ ID NO: 265421 - RNA, 64 nt, hsa
auuaauguaaucaaaaugaaauauagauuaguuuaaaugugaauucagugacucuagggccaaa

SEQ ID NO: 265422 - RNA, 64 nt, hsa
auaucauugaacacacauaccagagauguuuuagaaaugugagaaaaacauccuuuuggaccau

SEQ ID NO: 265423 - RNA, 64 nt, hsa
auuuaucacuagcagagaguaugauacaauuuucaaaugugaacaaucuuaaauuuagcuuguc

SEQ ID NO: 265424 - RNA, 64 nt, hsa
uagaauaagagcuuuuuuguuucuuggguuuuuaaaaugugaaucugcaaugaucauaaaaauu

SEQ ID NO: 265425 - RNA, 64 nt, hsa
uuaaaaugugaaucugcaaugaucauaaaaauuaaaaugugaaugucaacaauaaaaagcaaga

SEQ ID NO: 265426 - RNA, 64 nt, hsa
gaaguuaguauugccaaucuuucacugcaugugaaaaugugaccaauuuagcacaaauucucuc

SEQ ID NO: 265427 - RNA, 64 nt, hsa
ugauccauccagacauuugcaaacgucaggagaaaaaugugaauuauuuauccagaugcauguc

SEQ ID NO: 265428 - RNA, 64 nt, hsa
cacuggaguccagucucuucugcuggcagaaagcaaaugugaccugugucacuacgugacugug

SEQ ID NO: 265429 - RNA, 64 nt, hsa
ugccaagcacagugccugcauguauuuauccaauaaaugugaaauucuguccaguuuuguggug

SEQ ID NO: 265430 - RNA, 64 nt, hsa
gauaauccauacuagagaaacacuauagauguaaaaaugugaaaaguuuuauucaaaauaucaa

SEQ ID NO: 265431 - RNA, 64 nt, hsa
ggguucauagaaaaaggaaguuugcagaugcaauaaaugugaggaaguauuuaauaaaaaauga

SEQ ID NO: 265432 - RNA, 64 nt, hsa
cuaaugaaagaaaaugugaccaaagaaaugcacgaaaugugaaguucuuugucacuguccugua

SEQ ID NO: 265433 - RNA, 64 nt, hsa
ucauaagugaagaguaauucauucuaaugaaagaaaaugugaccaaagaaaugcacgaaaugug

SEQ ID NO: 265434 - RNA, 64 nt, hsa
agacucuguuucuguuauuuuuaauugcuguaugaaaugugaucagauuauuuuacuaccaaca

SEQ ID NO: 265435 - RNA, 64 nt, hsa
aagggaaauuaaaccauucaugaauaaacuuuaaaaaugugaaguguccuuuuccuuuucacaa

SEQ ID NO: 265436 - RNA, 64 nt, hsa
acauaagauaauuaaugcuggagagaaacccuacaaaugugaagaauguggcaaagauuucuau

SEQ ID NO: 265437 - RNA, 64 nt, hsa
acauaaaauaauucauaaaggagauaaauuauacaaaugugaagaauguggcaaagcuuuuaac

SEQ ID NO: 265438 - RNA, 64 nt, hsa
acauaagauaauucauacuggagagaaaaccuacaaaugugaggaauguggcaaagccuuuagc

SEQ ID NO: 265439 - RNA, 64 nt, hsa
acauaagauaauuuauacuggagagaagcccuacaaaugugaaaaauguggcaaaccuuuuaac

SEQ ID NO: 265440 - RNA, 64 nt, hsa
acauuagauaauucaugcuggagagaaacccuacaaaugugaaaaauguggcaaagcuuuuaac

SEQ ID NO: 265441 - RNA, 64 nt, hsa
acauaagauaacucauacuggagaaaaaucuuacaaaugugaagaauguggcaaagccuuuauc

SEQ ID NO: 265442 - RNA, 64 nt, hsa
gaacaaaauaauucauacaggagagaaacccuacaaaugugaagaaugugacaaagccuuuaac

SEQ ID NO: 265443 - RNA, 64 nt, hsa
acuaaacauaauucauaauggagaaaaacccuacaaaugugaagaaugugucaaagcuuuuaac

SEQ ID NO: 265444 - RNA, 64 nt, hsa
aaacauaagggaauucauaauagagaaacccuacaaaugugaagaacguggccuggcuuuuaac

SEQ ID NO: 265445 - RNA, 64 nt, hsa
gcauaaaauaauucaugcuggagagaaacucuugaaaugugaugaauguggcauagccucuucc

SEQ ID NO: 265446 - RNA, 64 nt, hsa
aaaucauacuggugaggaacuuuaaaaaugcgaaaaaugugacaaaaucuuuaaaugauuguca

SEQ ID NO: 265447 - RNA, 64 nt, hsa
acacaagauaauucauacuggagagaaauccuacaaaugugauaaauguggcaaagccuuuaac

SEQ ID NO: 265448 - RNA, 64 nt, hsa
auauaaaagaaaucauaugaaugagaaauccuagaaaugugaagaaugugacaaagccuuuaaa

SEQ ID NO: 265449 - RNA, 64 nt, hsa
acauaagggaauuuauacaggagggaaacccuacaaaugugaagaauguggcaagccuuuuagc

SEQ ID NO: 265450 - RNA, 64 nt, hsa
cauaaaagaauucauacuggaggaaaagcccuacaaaugugaaaaacguggcaaagcuuuucau

SEQ ID NO: 265451 - RNA, 50 nt, hsa
auacuggagagaaucccuaaaaaugugaagaaugugguaaauccuucagc

SEQ ID NO: 265452 - RNA, 64 nt, hsa
cuuguauucucaguaguuccgauauguacccucgaaaugugaauguuaucuuaugagacucugu

SEQ ID NO: 265453 - RNA, 64 nt, hsa
gaauccagcguucucauuggaaauggauaaacagaaaugugaucauugauuucaguguucaaga

SEQ ID NO: 265454 - RNA, 64 nt, hsa
gagaauccauaaugagagaucuuacaaguguaauaaaugugacagauuuuucagauaucguuca

SEQ ID NO: 265455 - RNA, 64 nt, hsa
ucaucauagucuucauacugcagagaaaucuuacaaaugugaagacugugacaaaguugucagu

SEQ ID NO: 265456 - RNA, 64 nt, hsa
acauauuagaauucaaacuggagagaaaccuuacaaaugugaugaguguggcaacaccuuuggu

SEQ ID NO: 265457 - RNA, 64 nt, hsa
ugaaauugucauguuaaaaaaaaaaacaggaaccaaaugugaccuugugcauauauugguagcu

SEQ ID NO: 265458 - RNA, 64 nt, hsa
ugugucucaugaaggaucacagaguucagggggaaaaugugacagcacacgcacaaacgccuuc

SEQ ID NO: 265459 - RNA, 64 nt, hsa
uaucugcugcaacuuggagaaccucccugcccugaaaugugaaccaagcacacuuugguuccuu

SEQ ID NO: 265460 - RNA, 64 nt, hsa
ugagugcuggccuuaacccuaggcguggaagagaaaaugugagguuguuuagauacucaucagg

SEQ ID NO: 265461 - RNA, 64 nt, hsa
ugaaguuauucuugaucagauagaauuuaaccuaaaaugugaacucuuacuuacuuuuuguaca

SEQ ID NO: 265462 - RNA, 64 nt, hsa
cuuaaauuaguuauggagacaaagugaaaacauaaaaugugaccauuuaacuuauggcuaagaa

SEQ ID NO: 265463 - RNA, 64 nt, hsa
ucuaacaauccuucgcuuuuccucacucacguggaaaugugaacugucccggcucugucuucau

SEQ ID NO: 265464 - RNA, 64 nt, hsa
aaaagagagaccuuuuuuuuuaauguucgguuaaaaaugugacagaugaguacaaaaaugcaga

SEQ ID NO: 265465 - RNA, 62 nt, hsa
aucccacucaagguugaagaagaaaugaagaagcaugaaaguaauaaugugggauuacuaga

SEQ ID NO: 265466 - RNA, 62 nt, hsa
ucucuuaguuguaagaaagaaaaagacgucuugcaugaaaauaguacguugcgggaagaaau

SEQ ID NO: 265467 - RNA, 62 nt, hsa
cuuccauacugguagaugcgaaauuuaucugugcaugaaagggucacuucuguaauagugca

SEQ ID NO: 265468 - RNA, 62 nt, hsa
uauuuccucugcaggauacaguucaauaugaugcaugaaaaaugcuccacauuuaaaggaca

SEQ ID NO: 265469 - RNA, 62 nt, hsa
auggagaaacagguacuggacuuuucccuccugcaugaaacaagcaaacaauggacaaaaua

SEQ ID NO: 265470 - RNA, 62 nt, hsa
aaaauguacaaugucuagcauccaguagagaggcaugaaaagcaggaaaauacauugcauaa

SEQ ID NO: 265471 - RNA, 62 nt, hsa
ucauauauuugugacaauuuuugaguaauauugcaugaaaaugucccuauguuacauccauu

SEQ ID NO: 265472 - RNA, 62 nt, hsa
ucgcuuucuccuguuuuuuuuuuaaaaaaaaagcaugaaaaaggaagagaaaaaguuugaua

SEQ ID NO: 265473 - RNA, 64 nt, hsa
acaugcaacucaaacgacggaaaaaaaaagggaaugggaaaaaagaaaacagauccugggaggg

SEQ ID NO: 265474 - RNA, 64 nt, hsa
acagauggacagacagccacccugagaaccccucugggaaaaucuauuccugccaccacugggc

SEQ ID NO: 265475 - RNA, 64 nt, hsa
aggaagaagcaaaauaucacaucucuagaaguguugggaaaaauauaauuucuuucuuuacuua

SEQ ID NO: 265476 - RNA, 64 nt, hsa
uagcauaauuuaaaaaaucaguguuuuuaggauuugggaaaauaaacuguaaauguuuauuuga

SEQ ID NO: 265477 - RNA, 64 nt, hsa
cagaggcuagacaacugaaaggggcuaccaaggcugggaaaaaaaugcaauuguugcugugagu

SEQ ID NO: 265478 - RNA, 64 nt, hsa
aaaagaaaacgcgacaucuuucuaagauucucugugggaaaaugacugucaauaaaaugcgggu

SEQ ID NO: 265479 - RNA, 64 nt, hsa
aaaacguuggacuauuugggaaaaggaaaagaguugggaaaauugguuuuaagguaaguuuuag

SEQ ID NO: 265480 - RNA, 64 nt, hsa
ccucauauauuucuccucaaaacguuggacuauuugggaaaaggaaaagaguugggaaaauugg

SEQ ID NO: 265481 - RNA, 64 nt, hsa
uaaccaucgaugauguugucuauguuaucgauucugggaaaaugaaagaaaagagguauuccgu

SEQ ID NO: 265482 - RNA, 60 nt, hsa
uuaggacuuauuuguuuuaauguacagaugugggaaaaccacacaaauuccgcaguuuau

SEQ ID NO: 265483 - RNA, 64 nt, hsa
cugggcaaacaggugggacuguuagugacccauuugggaaaauagagcaucucagagaaggagg

SEQ ID NO: 265484 - RNA, 64 nt, hsa
cuuuuuacaaaaaaaaguauagaguuggaaacucugggaaaacuuacggaaauacacaaaugcu

SEQ ID NO: 265485 - RNA, 64 nt, hsa
uaauaacuacuuccaucccugcuuauuuuuaauuugggaaaauaaauacauucgaaggaaccug

SEQ ID NO: 265486 - RNA, 64 nt, hsa
guugaucucaguauugucaggggaacagagaaguugggaaaagauuacugaaauauaccuuuug

SEQ ID NO: 265487 - RNA, 64 nt, hsa
uuuaauaccagauaccuuaucuuacaauauugauugggaaaacauuugcugccauuacagaggu

SEQ ID NO: 265488 - RNA, 64 nt, hsa
uaaaccacuuaaacgaagaguucccuugaaacuuugggaaaacauguuaaugacaauauuccag

SEQ ID NO: 265489 - RNA, 64 nt, hsa
ccccuguucaauaguaugggaaaaauaagaugacugggaaaaagacacacccacaccguagaac

SEQ ID NO: 265490 - RNA, 64 nt, hsa
auacguuaucagcaacuuccccuguucaauaguaugggaaaaauaagaugacugggaaaaagac

SEQ ID NO: 265491 - RNA, 64 nt, hsa
aaauugguauuaucaaagcauugcugagagacggugggaaaauaaguugacuuucaaaucacgu

SEQ ID NO: 265492 - RNA, 64 nt, hsa
uuuauguagaggcuuuauguugcaauuaaaaaguugggaaaaugagagaaauuguguggaauuu

SEQ ID NO: 265493 - RNA, 64 nt, hsa
uggaucuguacugcacuggaguaagcaagaaaauugggaaaacuuuuucguuuguucagguuuu

SEQ ID NO: 265494 - RNA, 64 nt, hsa
gauggcaaaaaaauuuaaagauguccaauauaugugggaaaagagcuaacagagagaucauuau

SEQ ID NO: 265495 - RNA, 64 nt, hsa
ccuuguguugaugagagaauaaucuugggcagucugggaaaauaaggaaggcaucuccuucuua

SEQ ID NO: 265496 - RNA, 64 nt, hsa
uucagggaaaauaacaaccacccuuacugauaguugggaaaagaagauuggguuauuuugccau

SEQ ID NO: 265497 - RNA, 64 nt, hsa
auaugaugaccucaauauugacuuucagccauacugggaaaacuuacuuuucauggagugccac

SEQ ID NO: 265498 - RNA, 64 nt, hsa
cugagucucugaagggaauagggcugguagugggugggaaaaggggaaaaacuguuucuucagu

SEQ ID NO: 265499 - RNA, 64 nt, hsa
ucuacuauuauuugggaaaauuguuuagguuauaugggaaaaguagcucuuuaaaaaucauauu

SEQ ID NO: 265500 - RNA, 64 nt, hsa
uuaauguguauagagaccccagucuacuauuauuugggaaaauuguuuagguuauaugggaaaa

SEQ ID NO: 265501 - RNA, 64 nt, hsa
cuuuuugaugaagagguuuuacuaucucucacugugggaaaauuugaugaaauauuugaacugu

SEQ ID NO: 265502 - RNA, 64 nt, hsa
ugucccccaccucuuuuccuaguuuuauguuucuugggaaaauaucacuuuguauucucugucc

SEQ ID NO: 265503 - RNA, 64 nt, hsa
cccugcuuggggccuggcguggggggagcucuggugggaaaaugucccccaccucuuuuccuag

SEQ ID NO: 265504 - RNA, 64 nt, hsa
ugcucucauagaaauaacuuuuuaauuuaguagaugggaaaauugacuucguauuuccccaagu

SEQ ID NO: 265505 - RNA, 64 nt, hsa
aacuugcucugauaugugaaguaauggacaagagugggaaaaaagagauccuuuucaaaaagau

SEQ ID NO: 265506 - RNA, 64 nt, hsa
uggccucaagccacuuuucugguccaaagaauauugggaaaacuggauuacuuucaguauauuu

SEQ ID NO: 265507 - RNA, 64 nt, hsa
ugcacugugucugaggaaugcucaggaaaucuugugggaaaaaaauggggcaugcauucauaau

SEQ ID NO: 265508 - RNA, 64 nt, hsa
cuaacacugagaaauccuauaaaugugauguaugugggaaaauuuuccaucagagcucagcccu

SEQ ID NO: 265509 - RNA, 64 nt, hsa
ccucaccagacagaaagccuuugauugugauguaugggaaaagaacuccagucagagagcacau

SEQ ID NO: 265510 - RNA, 64 nt, hsa
ugcaaaacgccugaagaauacaaaggauggucugugggaaaauauauuagaaguuacuaugaag

SEQ ID NO: 265511 - RNA, 64 nt, hsa
ugagucauuugaccaagacacagaagaugaugaaugggaaaaaaaacauagagaucacaccgca

SEQ ID NO: 265512 - RNA, 64 nt, hsa
gcacaaauuuagucuggucauuuuguuuacacauugggaaaaaaauuaguuuauuaaacauuac

SEQ ID NO: 265513 - RNA, 64 nt, hsa
gacaucuggacuggauuuaugcuugaugcauuguugggaaaauaugcaauacaaacugguauca

SEQ ID NO: 265514 - RNA, 64 nt, hsa
cugaccucgacccacucucaaauccugaugcuguugggaaaaccgauaaagaacacgaauugcu

SEQ ID NO: 265515 - RNA, 64 nt, hsa
ucuucaucagucuugucucaagaagaaaacgaacugggaaaauuucuucgaucccaagguuucc

SEQ ID NO: 265516 - RNA, 64 nt, hsa
agauaaaccaagcuuuacacgagcaggauggggaugggaaaacuaaaggggcccccugugaccg

SEQ ID NO: 265517 - RNA, 64 nt, hsa
gauagcugggggacaagggcagacggccccugccugggaaaaaccacacucacaccccaccccg

SEQ ID NO: 265518 - RNA, 64 nt, hsa
aaagacaaaacagacuauguacauaaucuguauaugggaaaagaaagagcgaaauuaccuuacu

SEQ ID NO: 265519 - RNA, 64 nt, hsa
uuugaacuuagaagguaggagaucagaucauaugugggaaaauguaaaagcagggauaucagug

SEQ ID NO: 265520 - RNA, 64 nt, hsa
uguuucucuuacuacguacucacagguuugcaaaugggaaaaaaguuuacauuucaguuuaggg

SEQ ID NO: 265521 - RNA, 64 nt, hsa
gaacacagguaguuccuuuucacuguguuuaauuugggaaaauccagauccacaucauuguaga

SEQ ID NO: 265522 - RNA, 64 nt, hsa
cuagaagacagauauuuacauuuaaauagauuagugggaaaacuuuaagaguuuccacauauua

SEQ ID NO: 265523 - RNA, 64 nt, hsa
ggcacucaagugacuucauauuucucucugcccaugggaaaagagauaggcuuuauauuuccac

SEQ ID NO: 265524 - RNA, 64 nt, hsa
auggcuuugugggaucauaugucuuggccaaagaugggaaaaccuauguugaagaggcagcccu

SEQ ID NO: 265525 - RNA, 64 nt, hsa
augcuuugugaguucuuuuccacuccuuuaaaguugggaaaacuugauucguggggcaggagau

SEQ ID NO: 265526 - RNA, 64 nt, hsa
uuauuuggggggaaauaccuugagcagaauacaaugggaaaagagucucuaccccuuucuguuc

SEQ ID NO: 265527 - RNA, 64 nt, hsa
aaaaacuguauggaaucaacaccaccgagcucugugggaaaaaagaaaaaccugcucccuucgc

SEQ ID NO: 265528 - RNA, 64 nt, hsa
gagacaggauuugauaagucuaggaaaagaaagaugggaaaacgggauuccuuuucagaaguac

SEQ ID NO: 265529 - RNA, 64 nt, hsa
gguuaguugaagccaauuucuggcuugacuuuuaugggaaaaguuauuuuaugucuccuaagca

SEQ ID NO: 265530 - RNA, 64 nt, hsa
cacacuuggagaaaccuuuuggguguaaugaaugugggaaaaccuuucaucagaagucagcucu

SEQ ID NO: 265531 - RNA, 64 nt, hsa
cuggggaaaagauaaugucuuuaauaaauggugcugggaaaacuggauauccauaugcagaaga

SEQ ID NO: 265532 - RNA, 64 nt, hsa
uuuucucccaaaaaaucuuuaaguaaagaugaucugggaaaaugugccauguuuauccuguggc

SEQ ID NO: 265533 - RNA, 64 nt, hsa
aguguggcgcgcuuuuuuaauaaucauuuaaucuugggaaaauucagguguuuggugucugccu

SEQ ID NO: 265534 - RNA, 64 nt, hsa
auaaguaauucagaaccaucaaugaauucagauaugggaaaagucaguaaaaaugauacugaag

SEQ ID NO: 265535 - RNA, 64 nt, hsa
cauuucuugccagaauuugcuaccuuaaggugauugggaaaauucuguugcaagaacauuaaca

SEQ ID NO: 265536 - RNA, 64 nt, hsa
uccucauuguuggggaugaugagaagaaaugauuugggaaaauuaaguaacaacgaccuagaaa

SEQ ID NO: 265537 - RNA, 64 nt, hsa
auuauaguucggcuguugacugagaaguuuguggugggaaaacguuugccauauuuucuuugca

SEQ ID NO: 265538 - RNA, 64 nt, hsa
accuaauugugauucuuuuauuaauaaaagcuaaugggaaaaggaucccugauuaagcugauga

SEQ ID NO: 265539 - RNA, 64 nt, hsa
caccgaagaaaaauaucuaaacaucgagaaacuaugggaaaaaaaauugcaaaaucuaaaauaa

SEQ ID NO: 265540 - RNA, 64 nt, hsa
aaaauacaaaaaccaguuaauguuuuguagacccugggaaaagaauuuucagcaaaguacaaaa

SEQ ID NO: 265541 - RNA, 64 nt, hsa
uauaaaguauuccagcaaaagaggauguagccucugggaaaaaacaaacauguuacaguguuuu

SEQ ID NO: 265542 - RNA, 64 nt, hsa
ccaugaaauugaucaccgggauugcaaaucuaauugggaaaagaguugagcaaacagcuuggac

SEQ ID NO: 265543 - RNA, 64 nt, hsa
acaccacuuuguaaaaggacucuuccaucagagaugggaaaaccauuggggaggacuaggaccc

SEQ ID NO: 265544 - RNA, 64 nt, hsa
uggaaauaccaggaccaguuuauguuugugguuuugggaaaaauuauuuguguugggggaaaug

SEQ ID NO: 265545 - RNA, 64 nt, hsa
gauuuucuuugccuuuguguuugaugccgucgugugggaaaagucaacuccgaugccaccauug

SEQ ID NO: 265546 - RNA, 64 nt, hsa
gccccaugcaugcccgccucucugcauggucucuugggaaaagagagaugugucgccuccgcca

SEQ ID NO: 265547 - RNA, 64 nt, hsa
cccucacccauuccuagugcucuugguauacacuugggaaaauaauguccuccaggagaaagug

SEQ ID NO: 265548 - RNA, 64 nt, hsa
ucuauacaguauaaacuaccucacuugccuuucuugggaaaaaaaaaaugaauggacuuuaaca

SEQ ID NO: 265549 - RNA, 64 nt, hsa
augcuuaucaucuaaagauguagcucuggcccagugggaaaaauuaggaagugauuauaaaucg

SEQ ID NO: 265550 - RNA, 64 nt, hsa
uacccacugagauuuccacgccgaaggacagcgaugggaaaaaugcccuuaaaucauaggaaag

SEQ ID NO: 265551 - RNA, 64 nt, hsa
cugguacuauuccuucugaaacuauuccaaucaaugggaaaagagggaauccucccuaacucau

SEQ ID NO: 265552 - RNA, 64 nt, hsa
auggggaaaggauucccuauuuaauaaauggugcugggaaaacugucuagccauaaguagaaag

SEQ ID NO: 265553 - RNA, 64 nt, hsa
acacugcaaagaaacaguaugaauguaaaaaaugugggaaaacauacauuacucuugcagguuu

SEQ ID NO: 265554 - RNA, 64 nt, hsa
acacugcacagaaacacuaugaauguaaacugugugggaaaacuuacuugucuccuuuagguuu

SEQ ID NO: 265555 - RNA, 64 nt, hsa
uuaggaaagugucuaugauauauagugaaaagugugggaaaagaauauagaaauaauauucacu

SEQ ID NO: 265556 - RNA, 64 nt, hsa
guaguuggaagaacuacuauaaaaacaauauaugugggaaaacuuccagcccucuguuaauugu

SEQ ID NO: 265557 - RNA, 64 nt, hsa
gcuggcgguggagcagccaucccugccuuucuguugggaaaaacuguugugccaaacucuugug

SEQ ID NO: 265558 - RNA, 64 nt, hsa
guuaggugccugcccucaguauagacguauccaaugggaaaacagcggaccugcccagagcagg

SEQ ID NO: 265559 - RNA, 64 nt, hsa
uuuaagcugaaguccuauucuggacacucugcuuugggaaaaaauguuaucauuuaauuuccuu

SEQ ID NO: 265560 - RNA, 64 nt, hsa
auugucaaggggaguuuuuacauggaaaugacaaugggaaaauucagauauuuucuuaguagug

SEQ ID NO: 265561 - RNA, 64 nt, hsa
auuugucaaaacuaggugagaaaauagagcauugugggaaaaacugaguccaacuagauuagca

SEQ ID NO: 265562 - RNA, 64 nt, hsa
uucuaguccaaauauaagaaacugucauguuuugugggaaaauaauuuuauaauccauuuaaag

SEQ ID NO: 265563 - RNA, 64 nt, hsa
gaggugcccccaagugaagggguacaguggcaccugggaaaaggcaccuggaagguuuccaugu

SEQ ID NO: 265564 - RNA, 64 nt, hsa
cuugggccuggcuucuuaagaguuuugaugaugcugggaaaagugacugcgauucugaagaacc

SEQ ID NO: 265565 - RNA, 64 nt, hsa
uauaccuugacuuggauuuugacaggagggagccugggaaaauaauuuuuuccuccaagauucu

SEQ ID NO: 265566 - RNA, 64 nt, hsa
ggggcaaccaauugaucagauuacuaaaaggacuugggaaaaagcaaaaaggucccauuguacu

SEQ ID NO: 265567 - RNA, 64 nt, hsa
uucuuagugccucccagaacauuuuguaguuaauugggaaaaagugauacuuggauuagggggu

SEQ ID NO: 265568 - RNA, 64 nt, hsa
gcuguuuacauauacagcacuuaaaauguuugugugggaaaaaaaaaacucauuggcagaucca

SEQ ID NO: 265569 - RNA, 64 nt, hsa
cccaaacuaauauuuaucacacauggucauuaaaugggaaaaaaauagacuaaacaaaucacaa

SEQ ID NO: 265570 - RNA, 64 nt, hsa
acuauuuugaauguuuccaacuggcucaauuggcugggaaaacaugggaacaagagaagcugaa

SEQ ID NO: 265571 - RNA, 64 nt, hsa
cuauuaaucuaguucaaugcccuuauuuuacagaugggaaaacugaggccuggagguaggaagg

SEQ ID NO: 265572 - RNA, 64 nt, hsa
aguacagagagccugugcugugaacccccuucaaugggaaaaagcugcaguggugauggcaggc

SEQ ID NO: 265573 - RNA, 64 nt, hsa
ugcuagcauuuuagcugugcaaagggagguagugugggaaaaguguuuccauucugggaaaagc

SEQ ID NO: 265574 - RNA, 64 nt, hsa
aaagggagguagugugggaaaaguguuuccauucugggaaaagcccaaaccgaauacggucagc

SEQ ID NO: 265575 - RNA, 64 nt, hsa; identical to SEQ ID NO: 126055

SEQ ID NO: 265576 - RNA, 64 nt, hsa; identical to SEQ ID NO: 126056

SEQ ID NO: 265577 - RNA, 64 nt, hsa; identical to SEQ ID NO: 126057

SEQ ID NO: 265578 - RNA, 64 nt, hsa; identical to SEQ ID NO: 126058

SEQ ID NO: 265579 - RNA, 64 nt, hsa; identical to SEQ ID NO: 126059

SEQ ID NO: 265580 - RNA, 64 nt, hsa; identical to SEQ ID NO: 126060

SEQ ID NO: 265581 - RNA, 64 nt, hsa; identical to SEQ ID NO: 126061

SEQ ID NO: 265582 - RNA, 64 nt, hsa; identical to SEQ ID NO: 126062

SEQ ID NO: 265583 - RNA, 64 nt, hsa; identical to SEQ ID NO: 126063

SEQ ID NO: 265584 - RNA, 64 nt, hsa; identical to SEQ ID NO: 126064

SEQ ID NO: 265585 - RNA, 64 nt, hsa; identical to SEQ ID NO: 126065

SEQ ID NO: 265586 - RNA, 64 nt, hsa; identical to SEQ ID NO: 126066

SEQ ID NO: 265587 - RNA, 64 nt, hsa; identical to SEQ ID NO: 126067

SEQ ID NO: 265588 - RNA, 64 nt, hsa; identical to SEQ ID NO: 126068

SEQ ID NO: 265589 - RNA, 64 nt, hsa; identical to SEQ ID NO: 126069

SEQ ID NO: 265590 - RNA, 64 nt, hsa; identical to SEQ ID NO: 126070

SEQ ID NO: 265591 - RNA, 64 nt, hsa; identical to SEQ ID NO: 126071

SEQ ID NO: 265592 - RNA, 64 nt, hsa; identical to SEQ ID NO: 126072

SEQ ID NO: 265593 - RNA, 64 nt, hsa; identical to SEQ ID NO: 126073

SEQ ID NO: 265594 - RNA, 64 nt, hsa; identical to SEQ ID NO: 126074

SEQ ID NO: 265595 - RNA, 64 nt, hsa; identical to SEQ ID NO: 126075

SEQ ID NO: 265596 - RNA, 64 nt, hsa; identical to SEQ ID NO: 126076

SEQ ID NO: 265597 - RNA, 64 nt, hsa; identical to SEQ ID NO: 126077

SEQ ID NO: 265598 - RNA, 64 nt, hsa; identical to SEQ ID NO: 126078

SEQ ID NO: 265599 - RNA, 64 nt, hsa; identical to SEQ ID NO: 126079

SEQ ID NO: 265600 - RNA, 64 nt, hsa; identical to SEQ ID NO: 126080

SEQ ID NO: 265601 - RNA, 64 nt, hsa; identical to SEQ ID NO: 126081

SEQ ID NO: 265602 - RNA, 64 nt, hsa; identical to SEQ ID NO: 126082

SEQ ID NO: 265603 - RNA, 64 nt, hsa; identical to SEQ ID NO: 126083

SEQ ID NO: 265604 - RNA, 64 nt, hsa; identical to SEQ ID NO: 126084

SEQ ID NO: 265605 - RNA, 64 nt, hsa; identical to SEQ ID NO: 126085

SEQ ID NO: 265606 - RNA, 64 nt, hsa; identical to SEQ ID NO: 126086

SEQ ID NO: 265607 - RNA, 64 nt, hsa; identical to SEQ ID NO: 126087

SEQ ID NO: 265608 - RNA, 64 nt, hsa; identical to SEQ ID NO: 126088

SEQ ID NO: 265609 - RNA, 64 nt, hsa; identical to SEQ ID NO: 126089

SEQ ID NO: 265610 - RNA, 64 nt, hsa; identical to SEQ ID NO: 126090

SEQ ID NO: 265611 - RNA, 64 nt, hsa; identical to SEQ ID NO: 126091

SEQ ID NO: 265612 - RNA, 64 nt, hsa; identical to SEQ ID NO: 126092

SEQ ID NO: 265613 - RNA, 64 nt, hsa; identical to SEQ ID NO: 126093

SEQ ID NO: 265614 - RNA, 64 nt, hsa; identical to SEQ ID NO: 126094

SEQ ID NO: 265615 - RNA, 64 nt, hsa; identical to SEQ ID NO: 126095

SEQ ID NO: 265616 - RNA, 64 nt, hsa; identical to SEQ ID NO: 126096

SEQ ID NO: 265617 - RNA, 64 nt, hsa; identical to SEQ ID NO: 126097

SEQ ID NO: 265618 - RNA, 64 nt, hsa; identical to SEQ ID NO: 126098

SEQ ID NO: 265619 - RNA, 64 nt, hsa; identical to SEQ ID NO: 126099

SEQ ID NO: 265620 - RNA, 64 nt, hsa; identical to SEQ ID NO: 126100

SEQ ID NO: 265621 - RNA, 64 nt, hsa; identical to SEQ ID NO: 126101

SEQ ID NO: 265622 - RNA, 64 nt, hsa; identical to SEQ ID NO: 126102

SEQ ID NO: 265623 - RNA, 64 nt, hsa; identical to SEQ ID NO: 126103

SEQ ID NO: 265624 - RNA, 64 nt, hsa; identical to SEQ ID NO: 126104

SEQ ID NO: 265625 - RNA, 64 nt, hsa; identical to SEQ ID NO: 126105

SEQ ID NO: 265626 - RNA, 64 nt, hsa; identical to SEQ ID NO: 126106

SEQ ID NO: 265627 - RNA, 64 nt, hsa; identical to SEQ ID NO: 126107

SEQ ID NO: 265628 - RNA, 64 nt, hsa; identical to SEQ ID NO: 126108

SEQ ID NO: 265629 - RNA, 64 nt, hsa; identical to SEQ ID NO: 126109

SEQ ID NO: 265630 - RNA, 64 nt, hsa; identical to SEQ ID NO: 126110

SEQ ID NO: 265631 - RNA, 64 nt, hsa; identical to SEQ ID NO: 126111

SEQ ID NO: 265632 - RNA, 64 nt, hsa; identical to SEQ ID NO: 126112

SEQ ID NO: 265633 - RNA, 64 nt, hsa; identical to SEQ ID NO: 126113

SEQ ID NO: 265634 - RNA, 64 nt, hsa; identical to SEQ ID NO: 126114

SEQ ID NO: 265635 - RNA, 64 nt, hsa; identical to SEQ ID NO: 126115

SEQ ID NO: 265636 - RNA, 64 nt, hsa; identical to SEQ ID NO: 126116

SEQ ID NO: 265637 - RNA, 64 nt, hsa; identical to SEQ ID NO: 126117

SEQ ID NO: 265638 - RNA, 64 nt, hsa; identical to SEQ ID NO: 126117

SEQ ID NO: 265639 - RNA, 64 nt, hsa; identical to SEQ ID NO: 126119

SEQ ID NO: 265640 - RNA, 64 nt, hsa; identical to SEQ ID NO: 126120

SEQ ID NO: 265641 - RNA, 64 nt, hsa; identical to SEQ ID NO: 126121

SEQ ID NO: 265642 - RNA, 64 nt, hsa; identical to SEQ ID NO: 126122

SEQ ID NO: 265643 - RNA, 64 nt, hsa; identical to SEQ ID NO: 126123

SEQ ID NO: 265644 - RNA, 64 nt, hsa; identical to SEQ ID NO: 126124

SEQ ID NO: 265645 - RNA, 64 nt, hsa; identical to SEQ ID NO: 126125

SEQ ID NO: 265646 - RNA, 64 nt, hsa; identical to SEQ ID NO: 126126

SEQ ID NO: 265647 - RNA, 64 nt, hsa; identical to SEQ ID NO: 126127

SEQ ID NO: 265648 - RNA, 64 nt, hsa; identical to SEQ ID NO: 126128

SEQ ID NO: 265649 - RNA, 64 nt, hsa; identical to SEQ ID NO: 126129

SEQ ID NO: 265650 - RNA, 64 nt, hsa; identical to SEQ ID NO: 126130

SEQ ID NO: 265651 - RNA, 64 nt, hsa; identical to SEQ ID NO: 126131

SEQ ID NO: 265652 - RNA, 64 nt, hsa; identical to SEQ ID NO: 217042

SEQ ID NO: 265653 - RNA, 64 nt, hsa; identical to SEQ ID NO: 217043

SEQ ID NO: 265654 - RNA, 64 nt, hsa; identical to SEQ ID NO: 217044

SEQ ID NO: 265655 - RNA, 64 nt, hsa; identical to SEQ ID NO: 217045

SEQ ID NO: 265656 - RNA, 64 nt, hsa; identical to SEQ ID NO: 217046

SEQ ID NO: 265657 - RNA, 64 nt, hsa; identical to SEQ ID NO: 217047

SEQ ID NO: 265658 - RNA, 64 nt, hsa; identical to SEQ ID NO: 217048

SEQ ID NO: 265659 - RNA, 64 nt, hsa; identical to SEQ ID NO: 217049

SEQ ID NO: 265660 - RNA, 64 nt, hsa; identical to SEQ ID NO: 217050

SEQ ID NO: 265661 - RNA, 64 nt, hsa; identical to SEQ ID NO: 217051

SEQ ID NO: 265662 - RNA, 64 nt, hsa; identical to SEQ ID NO: 217052

SEQ ID NO: 265663 - RNA, 64 nt, hsa; identical to SEQ ID NO: 217053

SEQ ID NO: 265664 - RNA, 64 nt, hsa; identical to SEQ ID NO: 217054

SEQ ID NO: 265665 - RNA, 64 nt, hsa; identical to SEQ ID NO: 217055

SEQ ID NO: 265666 - RNA, 64 nt, hsa; identical to SEQ ID NO: 217056

SEQ ID NO: 265667 - RNA, 64 nt, hsa; identical to SEQ ID NO: 217057

SEQ ID NO: 265668 - RNA, 64 nt, hsa; identical to SEQ ID NO: 217058

SEQ ID NO: 265669 - RNA, 63 nt, hsa
uuuuauagaauccuaaaaaauaacgccugauguauagauuaguuagcaaauucucagaaaucc

SEQ ID NO: 265670 - RNA, 63 nt, hsa
uuucuauuuuaaaaaauuguguucucuuguuaaauagauuaacauuuccacuucuguuuauca

SEQ ID NO: 265671 - RNA, 63 nt, hsa
gcaaaacaaagugcaauauuaaauguuugcuuuauagauuauauucuauggcuguuuguaauu

SEQ ID NO: 265672 - RNA, 63 nt, hsa
cuaaacaugagaaaucacucacuuugauuauguauagauuacauaggaagaacaaucacauca

SEQ ID NO: 265673 - RNA, 63 nt, hsa
aucugaggaauucuguauagauuagaauucuguauagauuagagaguguugaaacggaugauu

SEQ ID NO: 265674 - RNA, 63 nt, hsa
guugaaauuguaauuauaucugaggaauucuguauagauuagaauucuguauagauuagagag

SEQ ID NO: 265675 - RNA, 63 nt, hsa
caaaggaggaauuuacuuucuucaccaagugcaauagauuacugaugugauauucuguugcuu

SEQ ID NO: 265676 - RNA, 63 nt, hsa
accacauaagaaggcaauuuuaguguauuaaucauagauuauuauaaacuauaaacuuaaggg

SEQ ID NO: 265677 - RNA, 63 nt, hsa
gcuuucccucccugcacaugggcacuguaucagauagauuacuuuuuaaauguagauaaaauu

SEQ ID NO: 265678 - RNA, 63 nt, hsa
uaaaauuucaaaaaugaauggcuaguuuacgugauagauuaggcucuuacuacauaugugugu

SEQ ID NO: 265679 - RNA, 63 nt, hsa
gagcaagacucugucucuuaaauaaauaaauaaauagauuaccagaaaaaugaaaagaaaaaa

SEQ ID NO: 265680 - RNA, 63 nt, hsa
uggaauaauuaacuggagauaauauccaguaaaauagauuaaacuuccauuuauaaagucaga

SEQ ID NO: 265681 - RNA, 63 nt, hsa
guaagccugugauaaacauuauuucuauagauuauagauuagcuaaaaguauuccuuacaaga

SEQ ID NO: 265682 - RNA, 63 nt, hsa
auugacaguaagccugugauaaacauuauuucuauagauuauagauuagcuaaaaguauuccu

SEQ ID NO: 265683 - RNA, 63 nt, hsa
augcugcaggauuaaauaacuugaagagccuuuauagauuauaugaaugccuauuugugucua

SEQ ID NO: 265684 - RNA, 63 nt, hsa
uucuagcauuacuagauauuaaaaguuaagcaaauagauuaaugacguauacauaggcaucau

SEQ ID NO: 265685 - RNA, 63 nt, hsa
agagaugagcacuucuaaguugaguauauuauaauagauuaguacuggauuauucaggcuuua

SEQ ID NO: 265686 - RNA, 63 nt, hsa
aucuauaacuacauauugaauagggcuaggaauauagauuaaaucauacuccuaugcuuuagc

SEQ ID NO: 265687 - RNA, 64 nt, hsa
accuuccuccagccugugcgcaccugcccuccuugcagcccagcacaccugcagguguaaggga

SEQ ID NO: 265688 - RNA, 64 nt, hsa
gcuuccuagaaauaagcaacaccucucccaaaaagcagcccacaaggcaggggcccagcagccc

SEQ ID NO: 265689 - RNA, 64 nt, hsa
ucucccaaaaagcagcccacaaggcaggggcccagcagcccagccaucacucaucuuugaggaa

SEQ ID NO: 265690 - RNA, 64 nt, hsa
ugauacuuggaugcagcucuugggaccguguucugcagcccagccuuccuguugggguggggcc

SEQ ID NO: 265691 - RNA, 64 nt, hsa
aaagcucacgaaccccaaaccuggcaagucaccugcagcccauggugagcucugggaagugugg

SEQ ID NO: 265692 - RNA, 64 nt, hsa
gagccugguguugggucaugcugggaagggagcggcagcccagccaggccuggcccauaaaagg

SEQ ID NO: 265693 - RNA, 64 nt, hsa
gccaggccuggcccauaaaaggcucccaugcugagcagcccauugcugaagccaggauguucug

SEQ ID NO: 265694 - RNA, 64 nt, hsa
ucuggcuccagaggaccugagacucacacucucugcagcccagccuagucagggcacagcugcc

SEQ ID NO: 265695 - RNA, 64 nt, hsa
ccucucuucguccugaucccuccacccccauguggcagcccauggguaugacauaggccaaggc

SEQ ID NO: 265696 - RNA, 64 nt, hsa
aacugucaucuccugguuccaaguucgggcucuggcagcccagccgcuaucuuagcugucuuuc

SEQ ID NO: 265697 - RNA, 64 nt, hsa
gcaagcagcucgcagccagcccagaaucucuuaugcagcccaaagggcuucuugagguagagag

SEQ ID NO: 265698 - RNA, 64 nt, hsa
aggacaagcacugauccugaggggauacuguggagcagcccaguccacaccagagccccacgcg

SEQ ID NO: 265699 - RNA, 64 nt, hsa
uacagguagguggcgcucacguuccugcccaaaugcagcccaucggggagucacagucaguccc

SEQ ID NO: 265700 - RNA, 64 nt, hsa
ggggccuccccacaggccaccgucgcccagccuggcagcccagcguuuugggcugaaaccacca

SEQ ID NO: 265701 - RNA, 64 nt, hsa
uucucgaucacgagccugagaacugcacgggggagcagcccagacuggcuggaaaccauguuuu

SEQ ID NO: 265702 - RNA, 64 nt, hsa
cucuacaggcugcucggccucccugcagcucagcgcagcccagggcuccaagugaggcccagaa

SEQ ID NO: 265703 - RNA, 64 nt, hsa
uuccccgagagcugucggaaccagaugcaacccggcagcccagagaacucuccugggaggcugu

SEQ ID NO: 265704 - RNA, 64 nt, hsa
cacuguguuccgugcccuggggacccccggaaaagcagcccagucagaugugggaacgugccag

SEQ ID NO: 265705 - RNA, 64 nt, hsa
gagcacccagcaggagaggcuccugguguagugggcagcccagcacuucccgcugcugccugcc

SEQ ID NO: 265706 - RNA, 64 nt, hsa
gggcccuugggucgggcccuggagacgacacacggcagcccacaggccacgacagacgcuggau

SEQ ID NO: 265707 - RNA, 64 nt, hsa
acaccugugcagggucccagacccaggccccagagcagcccaggccaugacccugccgagcacg

SEQ ID NO: 265708 - RNA, 64 nt, hsa
ccuucagcaguugaggcuggggcuaguggucccagcagcccagcccccacccuccuggcagcag

SEQ ID NO: 265709 - RNA, 64 nt, hsa
ugcccacugucuugcccgggcugaggucagcacugcagcccaaacagugccaacagcccugucc

SEQ ID NO: 265710 - RNA, 64 nt, hsa
ccccggcaagccacaggaaggaggggagagacaggcagcccagcaguguggagacccugccaca

SEQ ID NO: 265711 - RNA, 64 nt, hsa
uucccucucugaugucccagugcucaccagcccugcagcccaccagacgucaggcccugacucc

SEQ ID NO: 265712 - RNA, 64 nt, hsa
aguuacaguguaggcaccccggcccagcagcccagcagcccacauguguucaggacccucccug

SEQ ID NO: 265713 - RNA, 64 nt, hsa
augcugcuaguuacaguguaggcaccccggcccagcagcccagcagcccacauguguucaggac

SEQ ID NO: 265714 - RNA, 64 nt, hsa
cccucugucccugugcuccaagcugcccccggcugcagcccaggccauggacaugugcaccagu

SEQ ID NO: 265715 - RNA, 64 nt, hsa
cggcuuuccagugcggagagucgagaugcucccugcagcccaggccccgggcaccuccugcaac

SEQ ID NO: 265716 - RNA, 64 nt, hsa
uucccugcagaagacaaaaaggaagcuggaagaggcagcccagcgucuggaguaucuauaugag

SEQ ID NO: 265717 - RNA, 64 nt, hsa
aaccuacagggucacucaguaugccaaccuccuggcagcccagggcagccuggccacugccaug

SEQ ID NO: 265718 - RNA, 63 nt, hsa
cccuaccccacggaggaugagaagaggcagaucgcagcccagaccaaccucacccuccugcaa

SEQ ID NO: 265719 - RNA, 64 nt, hsa
ugggcagguucaucaaugcccggaggcgcauccugcagcccaugcuugaugccagcaacccaga

SEQ ID NO: 265720 - RNA, 64 nt, hsa
ggcuuggaacacagugacucccuggaguagucgggcagcccagauggcacugaucacugagcag

SEQ ID NO: 265721 - RNA, 64 nt, hsa
cugucccuauuacgggagccgccuugccaucccugcagcccagcugguggugcugcccuaucag

SEQ ID NO: 265722 - RNA, 64 nt, hsa
cugaacgguacggagcaguguucucaucccgggagcagcccaaacuggcuggguuucagcaauu

SEQ ID NO: 265723 - RNA, 64 nt, hsa
aacuggcuggguuucagcaauuccugcagagccugcagcccaggacgacugaaggugaggcagg

SEQ ID NO: 265724 - RNA, 64 nt, hsa
agaacagucugaggugaugcuggcuacagcccuggcagcccauggcaacucaaagugccuucca

SEQ ID NO: 265725 - RNA, 64 nt, hsa
cucauuagcucccugcuccugggaugcuucccaagcagcccaggccucuagccuccauggcuga

SEQ ID NO: 265726 - RNA, 64 nt, hsa
gaggucacucugggccuggggacccaaacccccugcagcccaggccagucagacgccaggcacc

SEQ ID NO: 265727 - RNA, 64 nt, hsa
ccuggacagcuugacuuguggggcaggauucucugcagcccauucccaagggagacugaccauc

SEQ ID NO: 265728 - RNA, 64 nt, hsa
uggggcagucggaagaugugggcccugggugggagcagcccacuucagcagcacugccacugcc

SEQ ID NO: 265729 - RNA, 64 nt, hsa
cagccuccccucagagacaggccucaguucgagggcagcccauuaucugucgcagacaucugcc

SEQ ID NO: 265730 - RNA, 64 nt, hsa
aaaagcccauccucacucagcgcuaacaucagcagcagcccaaaaggugaggccugggggccuu

SEQ ID NO: 265731 - RNA, 64 nt, hsa
agcugucccuccagcaaaaacagcagcccuaauagcagcccacggacuuuggggaggagcaaag

SEQ ID NO: 265732 - RNA, 64 nt, hsa
gggccgcucuuggccccaagguugccccgggccagcagcccagccagcagcacagucucuaugg

SEQ ID NO: 265733 - RNA, 64 nt, hsa
cagccaugggaaagcaaacuucauccuaaggugugcagcccaggcccugccccuuuacagucua

SEQ ID NO: 265734 - RNA, 64 nt, hsa
uuuuaagcugccuggcauguggcacuuugucagggcagcccaggaaucugaaacaggaucaaac

SEQ ID NO: 265735 - RNA, 64 nt, hsa
gccagcaucucuggcucggcuuucugggcuggaugcagcccacgacgcacuggugucugagaug

SEQ ID NO: 265736 - RNA, 64 nt, hsa
gcccugggccgucccugugugaacgcaggcaaaagcagcccagucccccucacugcuugagcua

SEQ ID NO: 265737 - RNA, 64 nt, hsa
caggccggccuucagcguccggucagggaagcgugcagcccaaaugggcacuugcaugggagcc

SEQ ID NO: 265738 - RNA, 64 nt, hsa
caugagcaggcgaggagcuggccugucccgggaagcagcccagccuguggcugcccccgacacc

SEQ ID NO: 265739 - RNA, 64 nt, hsa
cccaggggagugaggagggagaacuuggaagggugcagcccacuuccagacucuccccucuccc

SEQ ID NO: 265740 - RNA, 64 nt, hsa
aggcagccuuggggaaccccgagcugggggguuggcagcccacugcaccgccucaggguuuugg

SEQ ID NO: 265741 - RNA, 64 nt, hsa
ggaccauagucgggaugucagcagacacacaugggcagcccaaagcugcaggugccagggccca

SEQ ID NO: 265742 - RNA, 64 nt, hsa
agaccacagaugacucaagccaugccagaaccaagcagcccaugccuggcuguggcgauucaga

SEQ ID NO: 265743 - RNA, 64 nt, hsa
ggagagcacauaugcaaugccugauggguuccuugcagcccaaaaugaugccaaugagcugcuc

SEQ ID NO: 265744 - RNA, 64 nt, hsa
gcucccuguucugccccgaggccggggacgcagggcagcccacgccuccgugggcuccauucug

SEQ ID NO: 265745 - RNA, 64 nt, hsa
gaggaagcguguugucuuacaagucauccccgcagcagcccauuggaugcuuugcuguaaauac

SEQ ID NO: 265746 - RNA, 64 nt, hsa; identical to SEQ ID NO: 53544

SEQ ID NO: 265747 - RNA, 64 nt, hsa; identical to SEQ ID NO: 53545

SEQ ID NO: 265748 - RNA, 64 nt, hsa; identical to SEQ ID NO: 53546

SEQ ID NO: 265749 - RNA, 64 nt, hsa; identical to SEQ ID NO: 53547

SEQ ID NO: 265750 - RNA, 64 nt, hsa; identical to SEQ ID NO: 53548

SEQ ID NO: 265751 - RNA, 64 nt, hsa; identical to SEQ ID NO: 53549

SEQ ID NO: 265752 - RNA, 64 nt, hsa; identical to SEQ ID NO: 53550

SEQ ID NO: 265753 - RNA, 64 nt, hsa; identical to SEQ ID NO: 53551

SEQ ID NO: 265754 - RNA, 64 nt, hsa; identical to SEQ ID NO: 53552

SEQ ID NO: 265755 - RNA, 64 nt, hsa; identical to SEQ ID NO: 53553

SEQ ID NO: 265756 - RNA, 64 nt, hsa; identical to SEQ ID NO: 53554

SEQ ID NO: 265757 - RNA, 64 nt, hsa; identical to SEQ ID NO: 53555

SEQ ID NO: 265758 - RNA, 64 nt, hsa; identical to SEQ ID NO: 53556

SEQ ID NO: 265759 - RNA, 64 nt, hsa; identical to SEQ ID NO: 53557

SEQ ID NO: 265760 - RNA, 64 nt, hsa; identical to SEQ ID NO: 53558

SEQ ID NO: 265761 - RNA, 64 nt, hsa; identical to SEQ ID NO: 53559

SEQ ID NO: 265762 - RNA, 64 nt, hsa; identical to SEQ ID NO: 53560

SEQ ID NO: 265763 - RNA, 64 nt, hsa; identical to SEQ ID NO: 53561

SEQ ID NO: 265764 - RNA, 64 nt, hsa; identical to SEQ ID NO: 53562

SEQ ID NO: 265765 - RNA, 64 nt, hsa; identical to SEQ ID NO: 53563

SEQ ID NO: 265766 - RNA, 64 nt, hsa; identical to SEQ ID NO: 53564

SEQ ID NO: 265767 - RNA, 64 nt, hsa; identical to SEQ ID NO: 53565

SEQ ID NO: 265768 - RNA, 64 nt, hsa; identical to SEQ ID NO: 53566

SEQ ID NO: 265769 - RNA, 64 nt, hsa; identical to SEQ ID NO: 53567

SEQ ID NO: 265770 - RNA, 64 nt, hsa; identical to SEQ ID NO: 53568

SEQ ID NO: 265771 - RNA, 64 nt, hsa; identical to SEQ ID NO: 53569

SEQ ID NO: 265772 - RNA, 64 nt, hsa; identical to SEQ ID NO: 53570

SEQ ID NO: 265773 - RNA, 64 nt, hsa; identical to SEQ ID NO: 53571

SEQ ID NO: 265774 - RNA, 64 nt, hsa; identical to SEQ ID NO: 53572

SEQ ID NO: 265775 - RNA, 64 nt, hsa; identical to SEQ ID NO: 53573

SEQ ID NO: 265776 - RNA, 64 nt, hsa; identical to SEQ ID NO: 53574

SEQ ID NO: 265777 - RNA, 64 nt, hsa; identical to SEQ ID NO: 53575

SEQ ID NO: 265778 - RNA, 64 nt, hsa; identical to SEQ ID NO: 53576

SEQ ID NO: 265779 - RNA, 64 nt, hsa; identical to SEQ ID NO: 53577

SEQ ID NO: 265780 - RNA, 64 nt, hsa; identical to SEQ ID NO: 53578

SEQ ID NO: 265781 - RNA, 64 nt, hsa; identical to SEQ ID NO: 53579

SEQ ID NO: 265782 - RNA, 64 nt, hsa; identical to SEQ ID NO: 53580

SEQ ID NO: 265783 - RNA, 64 nt, hsa; identical to SEQ ID NO: 53580

SEQ ID NO: 265784 - RNA, 64 nt, hsa; identical to SEQ ID NO: 53582

SEQ ID NO: 265785 - RNA, 64 nt, hsa; identical to SEQ ID NO: 53583

SEQ ID NO: 265786 - RNA, 64 nt, hsa; identical to SEQ ID NO: 53584

SEQ ID NO: 265787 - RNA, 64 nt, hsa; identical to SEQ ID NO: 53585

SEQ ID NO: 265788 - RNA, 64 nt, hsa; identical to SEQ ID NO: 53586

SEQ ID NO: 265789 - RNA, 64 nt, hsa
cugauaaagacauaccugagaccaggaagaaaaagagguuuaauuggacuuacaguuccacaug

SEQ ID NO: 265790 - RNA, 64 nt, hsa
ugauaaagacauuccucaagauugugaagaaaaagagguuuaauuggacuuacaguuccacaug

SEQ ID NO: 265791 - RNA, 64 nt, hsa
aauaccccaaacuggguaauuauuauaaaggaaagagguuuaauggacucaguuccgcauugcu

SEQ ID NO: 265792 - RNA, 64 nt, hsa
ggacuguuaucuccauuuaacagaugagaaaauggagguuuauggucuguucucacacugcuac

SEQ ID NO: 265793 - RNA, 64 nt, hsa; identical to SEQ ID NO: 132617

SEQ ID NO: 265794 - RNA, 64 nt, hsa; identical to SEQ ID NO: 132618

SEQ ID NO: 265795 - RNA, 64 nt, hsa; identical to SEQ ID NO: 132619

SEQ ID NO: 265796 - RNA, 64 nt, hsa; identical to SEQ ID NO: 132620

SEQ ID NO: 265797 - RNA, 64 nt, hsa; identical to SEQ ID NO: 132621

SEQ ID NO: 265798 - RNA, 64 nt, hsa; identical to SEQ ID NO: 132622

SEQ ID NO: 265799 - RNA, 64 nt, hsa; identical to SEQ ID NO: 132623

SEQ ID NO: 265800 - RNA, 64 nt, hsa; identical to SEQ ID NO: 132624

SEQ ID NO: 265801 - RNA, 64 nt, hsa; identical to SEQ ID NO: 132625

SEQ ID NO: 265802 - RNA, 64 nt, hsa; identical to SEQ ID NO: 132626

SEQ ID NO: 265803 - RNA, 64 nt, hsa; identical to SEQ ID NO: 132627

SEQ ID NO: 265804 - RNA, 64 nt, hsa; identical to SEQ ID NO: 132628

SEQ ID NO: 265805 - RNA, 64 nt, hsa; identical to SEQ ID NO: 132629

SEQ ID NO: 265806 - RNA, 64 nt, hsa; identical to SEQ ID NO: 132630

SEQ ID NO: 265807 - RNA, 64 nt, hsa; identical to SEQ ID NO: 132631

SEQ ID NO: 265808 - RNA, 64 nt, hsa; identical to SEQ ID NO: 132632

SEQ ID NO: 265809 - RNA, 64 nt, hsa; identical to SEQ ID NO: 132633

SEQ ID NO: 265810 - RNA, 64 nt, hsa; identical to SEQ ID NO: 132634

SEQ ID NO: 265811 - RNA, 64 nt, hsa; identical to SEQ ID NO: 132635

SEQ ID NO: 265812 - RNA, 64 nt, hsa; identical to SEQ ID NO: 132636

SEQ ID NO: 265813 - RNA, 64 nt, hsa; identical to SEQ ID NO: 132637

SEQ ID NO: 265814 - RNA, 64 nt, hsa; identical to SEQ ID NO: 132638

SEQ ID NO: 265815 - RNA, 64 nt, hsa; identical to SEQ ID NO: 132639

SEQ ID NO: 265816 - RNA, 64 nt, hsa; identical to SEQ ID NO: 132640

SEQ ID NO: 265817 - RNA, 64 nt, hsa; identical to SEQ ID NO: 132641

SEQ ID NO: 265818 - RNA, 64 nt, hsa; identical to SEQ ID NO: 132642

SEQ ID NO: 265819 - RNA, 64 nt, hsa; identical to SEQ ID NO: 132643

SEQ ID NO: 265820 - RNA, 64 nt, hsa; identical to SEQ ID NO: 132644

SEQ ID NO: 265821 - RNA, 64 nt, hsa; identical to SEQ ID NO: 132645

SEQ ID NO: 265822 - RNA, 64 nt, hsa; identical to SEQ ID NO: 132646

SEQ ID NO: 265823 - RNA, 64 nt, hsa; identical to SEQ ID NO: 132647

SEQ ID NO: 265824 - RNA, 64 nt, hsa; identical to SEQ ID NO: 132648

SEQ ID NO: 265825 - RNA, 64 nt, hsa; identical to SEQ ID NO: 132649

SEQ ID NO: 265826 - RNA, 64 nt, hsa; identical to SEQ ID NO: 132650

SEQ ID NO: 265827 - RNA, 64 nt, hsa; identical to SEQ ID NO: 132651

SEQ ID NO: 265828 - RNA, 64 nt, hsa; identical to SEQ ID NO: 132652

SEQ ID NO: 265829 - RNA, 64 nt, hsa; identical to SEQ ID NO: 132653

SEQ ID NO: 265830 - RNA, 64 nt, hsa; identical to SEQ ID NO: 132654

SEQ ID NO: 265831 - RNA, 64 nt, hsa; identical to SEQ ID NO: 132655

SEQ ID NO: 265832 - RNA, 64 nt, hsa; identical to SEQ ID NO: 132656

SEQ ID NO: 265833 - RNA, 64 nt, hsa; identical to SEQ ID NO: 132657

SEQ ID NO: 265834 - RNA, 64 nt, hsa; identical to SEQ ID NO: 132658

SEQ ID NO: 265835 - RNA, 64 nt, hsa; identical to SEQ ID NO: 132659

SEQ ID NO: 265836 - RNA, 64 nt, hsa; identical to SEQ ID NO: 132660

SEQ ID NO: 265837 - RNA, 64 nt, hsa; identical to SEQ ID NO: 132661

SEQ ID NO: 265838 - RNA, 64 nt, hsa; identical to SEQ ID NO: 132662

SEQ ID NO: 265839 - RNA, 64 nt, hsa; identical to SEQ ID NO: 132663

SEQ ID NO: 265840 - RNA, 64 nt, hsa; identical to SEQ ID NO: 132664

SEQ ID NO: 265841 - RNA, 64 nt, hsa; identical to SEQ ID NO: 132665

SEQ ID NO: 265842 - RNA, 64 nt, hsa; identical to SEQ ID NO: 132666

SEQ ID NO: 265843 - RNA, 64 nt, hsa; identical to SEQ ID NO: 132667

SEQ ID NO: 265844 - RNA, 64 nt, hsa; identical to SEQ ID NO: 132668

SEQ ID NO: 265845 - RNA, 64 nt, hsa; identical to SEQ ID NO: 132669

SEQ ID NO: 265846 - RNA, 64 nt, hsa; identical to SEQ ID NO: 132670

SEQ ID NO: 265847 - RNA, 64 nt, hsa; identical to SEQ ID NO: 132671

SEQ ID NO: 265848 - RNA, 64 nt, hsa; identical to SEQ ID NO: 132672

SEQ ID NO: 265849 - RNA, 64 nt, hsa; identical to SEQ ID NO: 132673

SEQ ID NO: 265850 - RNA, 64 nt, hsa; identical to SEQ ID NO: 132674

SEQ ID NO: 265851 - RNA, 64 nt, hsa; identical to SEQ ID NO: 132675

SEQ ID NO: 265852 - RNA, 64 nt, hsa; identical to SEQ ID NO: 132676

SEQ ID NO: 265853 - RNA, 64 nt, hsa; identical to SEQ ID NO: 132677

SEQ ID NO: 265854 - RNA, 57 nt, hsa; identical to SEQ ID NO: 132678

SEQ ID NO: 265855 - RNA, 64 nt, hsa; identical to SEQ ID NO: 132679

SEQ ID NO: 265856 - RNA, 64 nt, hsa; identical to SEQ ID NO: 132680

SEQ ID NO: 265857 - RNA, 64 nt, hsa; identical to SEQ ID NO: 132681

SEQ ID NO: 265858 - RNA, 64 nt, hsa; identical to SEQ ID NO: 132682

SEQ ID NO: 265859 - RNA, 64 nt, hsa; identical to SEQ ID NO: 132683

SEQ ID NO: 265860 - RNA, 64 nt, hsa; identical to SEQ ID NO: 132684

SEQ ID NO: 265861 - RNA, 64 nt, hsa; identical to SEQ ID NO: 132685

SEQ ID NO: 265862 - RNA, 64 nt, hsa; identical to SEQ ID NO: 132686

SEQ ID NO: 265863 - RNA, 64 nt, hsa; identical to SEQ ID NO: 132687

SEQ ID NO: 265864 - RNA, 64 nt, hsa; identical to SEQ ID NO: 132688

SEQ ID NO: 265865 - RNA, 64 nt, hsa; identical to SEQ ID NO: 132689

SEQ ID NO: 265866 - RNA, 64 nt, hsa; identical to SEQ ID NO: 132690

SEQ ID NO: 265867 - RNA, 55 nt, hsa; identical to SEQ ID NO: 132691

SEQ ID NO: 265868 - RNA, 64 nt, hsa; identical to SEQ ID NO: 132692

SEQ ID NO: 265869 - RNA, 64 nt, hsa; identical to SEQ ID NO: 132693

SEQ ID NO: 265870 - RNA, 64 nt, hsa; identical to SEQ ID NO: 132694

SEQ ID NO: 265871 - RNA, 64 nt, hsa; identical to SEQ ID NO: 132695

SEQ ID NO: 265872 - RNA, 64 nt, hsa; identical to SEQ ID NO: 132696

SEQ ID NO: 265873 - RNA, 64 nt, hsa; identical to SEQ ID NO: 132697

SEQ ID NO: 265874 - RNA, 64 nt, hsa; identical to SEQ ID NO: 132698

SEQ ID NO: 265875 - RNA, 64 nt, hsa; identical to SEQ ID NO: 132699

SEQ ID NO: 265876 - RNA, 64 nt, hsa; identical to SEQ ID NO: 132700

SEQ ID NO: 265877 - RNA, 64 nt, hsa; identical to SEQ ID NO: 132701

SEQ ID NO: 265878 - RNA, 64 nt, hsa; identical to SEQ ID NO: 132702

SEQ ID NO: 265879 - RNA, 64 nt, hsa; identical to SEQ ID NO: 132703

SEQ ID NO: 265880 - RNA, 64 nt, hsa; identical to SEQ ID NO: 132704

SEQ ID NO: 265881 - RNA, 64 nt, hsa; identical to SEQ ID NO: 132705

SEQ ID NO: 265882 - RNA, 64 nt, hsa; identical to SEQ ID NO: 132706

SEQ ID NO: 265883 - RNA, 64 nt, hsa; identical to SEQ ID NO: 132707

SEQ ID NO: 265884 - RNA, 64 nt, hsa; identical to SEQ ID NO: 132708

SEQ ID NO: 265885 - RNA, 64 nt, hsa; identical to SEQ ID NO: 132709

SEQ ID NO: 265886 - RNA, 64 nt, hsa; identical to SEQ ID NO: 132710

SEQ ID NO: 265887 - RNA, 64 nt, hsa; identical to SEQ ID NO: 132711

SEQ ID NO: 265888 - RNA, 64 nt, hsa; identical to SEQ ID NO: 132712

SEQ ID NO: 265889 - RNA, 64 nt, hsa
augccugucuuaaacucaguugcaucccuggugcccaaagcaacaccagaaccaagaaggagcu

SEQ ID NO: 265890 - RNA, 64 nt, hsa
ccaagcaagggagcccucagaggugguguuuggaccaaagcaucggggugggggaggggucugc

SEQ ID NO: 265891 - RNA, 64 nt, hsa
ucuaaaaauagacuaaggaugccuuugcagaacaccaaagcaucccaaggaacugguagggaag

SEQ ID NO: 265892 - RNA, 64 nt, hsa
ggcagaaaccuaagaaguuaucuuuucuuucuacccaaagcauacauagucacugagcaccugc

SEQ ID NO: 265893 - RNA, 64 nt, hsa
ucguaauaaaagcaaaguuuuugaaccucugaguccaaagcaggcugguuggcauaauauguaa

SEQ ID NO: 265894 - RNA, 64 nt, hsa
ucucauaaaauauauacuuuauuaaaucauccaaccaaagcauaggaaacauugacccagaacc

SEQ ID NO: 265895 - RNA, 64 nt, hsa
cuggaccagugaccaaaccucauaugugaaauggccaaagcacaugcaggcuccugguuguucc

SEQ ID NO: 265896 - RNA, 64 nt, hsa
aaugucauuagauccuuuauaacguagaucgaagccaaagcagcucauuugugacaacauuuca

SEQ ID NO: 265897 - RNA, 64 nt, hsa
ucccaccuuuaccccaccuuccugggaaaggccuccaaagcaaaggaucuggaccaguuucccu

SEQ ID NO: 265898 - RNA, 64 nt, hsa
gagcccgacuuagccagcccuggcuguuguauuaccaaagcaggguccauguuugcugccuuaa

SEQ ID NO: 265899 - RNA, 64 nt, hsa
aaugccauguuuuaaaaccacugcgaaaauuuccccaaagcauagguggcuuugugugugugcg

SEQ ID NO: 265900 - RNA, 64 nt, hsa
uguuugauaaacacaguccuuaacugaagguaaaccaaagcaucacguugacauuagaccaaau

SEQ ID NO: 265901 - RNA, 64 nt, hsa
ugauugacagugucuccuuacuuugaaguuuucaccaaagcaaaaagguccauauccaauagua

SEQ ID NO: 265902 - RNA, 64 nt, hsa
cagaagaaauuaaucuuuuaguuaguugaacauaccaaagcagaggacuggaaucuguuuguuc

SEQ ID NO: 265903 - RNA, 64 nt, hsa
ggaagaaucaauauuguuaaaauggccauacuacccaaagcaauuuauagauucaaugcuauuc

SEQ ID NO: 265904 - RNA, 64 nt, hsa
aaauuuauuugaaaccaaaaaagagcccaaaaagccaaagcaauccuaagcaaaaagaacaaag

SEQ ID NO: 265905 - RNA, 64 nt, hsa
uggauaggaagaaucaguauuguuaaaauacugcccaaagcaauuuacagagccaaugcuauuu

SEQ ID NO: 265906 - RNA, 64 nt, hsa
cauaagugcuggaaaagacuuaaugaugaacaccccaaagcaauugcaacaaaaacaaaaauug

SEQ ID NO: 265907 - RNA, 64 nt, hsa
ugcucccacauggucaggucucacccugcuugaagcgcagaaggcacagccuuacugaccagca

SEQ ID NO: 265908 - RNA, 64 nt, hsa
caguagacacagugcacaggggagaagagggguggcgcagaaggguugggggccuguaugccuu

SEQ ID NO: 265909 - RNA, 64 nt, hsa
ucccuggcugaagggaauuaacagauaguaucaagcgcagaaggaaugugccaguauggcuccc

SEQ ID NO: 265910 - RNA, 64 nt, hsa
cccaagaauuuagcuugcugugcaguggcugcaggcgcagaacagagcguuacuugauaacagc

SEQ ID NO: 265911 - RNA, 64 nt, hsa
aacaaugccccgagugguggcagccaggagagcagcgcagaacagcccagaaaaggcggugcuc

SEQ ID NO: 265912 - RNA, 64 nt, hsa
ggacugcugaugccccggugcugcugagcgccgugcgcagaauggaaacagugggccuggauca

SEQ ID NO: 265913 - RNA, 64 nt, hsa
cucagcagaaaguggcaagaagagggcgauuagggcgcagaacuuuggaagcugcuacuuacuu

SEQ ID NO: 265914 - RNA, 64 nt, hsa
uucugugguuguaaaaaugcuguugcuaaagguggcgcagaaacaaauaucaguguuagucauu

SEQ ID NO: 265915 - RNA, 64 nt, hsa
ugguaaggugcuguucacuugaacaggugcuguugcgcagaaaggaaacucugugacuaauuua

SEQ ID NO: 265916 - RNA, 64 nt, hsa
gugcucuggugacccgaggaggucgugcagcacagcgcagaagccccugcccacgggauccggc

SEQ ID NO: 265917 - RNA, 64 nt, hsa
uugcguuacacccuuucuugacaaaaccuaacuugcgcagaaaacaagaugagauuggcauggc

SEQ ID NO: 265918 - RNA, 64 nt, hsa
ggcgccagagcugggcucuucaacacggcauuuagcgcagaaagucgugguucaggcaguaugg

SEQ ID NO: 265919 - RNA, 64 nt, hsa
acgcuggaagcccacccaagccggcggggcccuagcgcagaaauucagaacccccuguccugaa

SEQ ID NO: 265920 - RNA, 64 nt, hsa
aagagguauuggauuuucacagaggaagaacacagcgcagaaugaagggccaggcuuacugagc

SEQ ID NO: 265921 - RNA, 64 nt, hsa
gauuagugagauguuaccacuuaccccuucugcugcgcagaauaauauuaagaauugcuaugcu

SEQ ID NO: 265922 - RNA, 64 nt, hsa
ugacaaccugugaugucucacaguagagcacuuagcgcagaaucagguccccacggcuguugcu

SEQ ID NO: 265923 - RNA, 64 nt, hsa
gugccccagacccagagauuagccucccacuucggcgcagaaaacaaaagcccuuugugggacc

SEQ ID NO: 265924 - RNA, 64 nt, hsa
aggacuuccccggagggcugcggcguacaggcuggcgcagaacgaaccuuggccugggccguau

SEQ ID NO: 265925 - RNA, 64 nt, hsa
gucaguuuuguugagaacuguguccugcauccuggcgcagaaccuaccugaugcgguuccucuc

SEQ ID NO: 265926 - RNA, 64 nt, hsa
ugguuggugagaguucuucucagucuguucauaggcgcagaaauugugggugaguguguggugc

SEQ ID NO: 265927 - RNA, 64 nt, hsa
agccgagugcccgccgccgcgccagccucagcccgcgcagaaugugcucgcugccccgcggcuu

SEQ ID NO: 265928 - RNA, 64 nt, hsa
accagcagccgagcccuuggcccuagcccuugcugcgcagaacagcuugcuggcagcuggcauc

SEQ ID NO: 265929 - RNA, 64 nt, hsa
caccggacugagcucacaggaggagccugcacccgcgcagaaggggagccggggccgagccucc

SEQ ID NO: 265930 - RNA, 64 nt, hsa
uaugcacuuuacagaugaggggaggggccgcagugcgcagaacccaccccaccccccagugcag

SEQ ID NO: 265931 - RNA, 64 nt, hsa
cccguaaaaucacaaagaaaauccaacaccaaaggcgcagaagccggcuggccguggugggggc

SEQ ID NO: 265932 - RNA, 64 nt, hsa
uaaguugacaaaaggaauggggaacuggcaggccgcgcagaagguucuugguuuuaauggauag

SEQ ID NO: 265933 - RNA, 64 nt, hsa
ugcuguggccguguccgugccccggggguagggggcgcagaauggcgcuuccccuucuccucug

SEQ ID NO: 265934 - RNA, 64 nt, hsa
cacuuuaggagccccagacaggaggaucacuuaagcgcagaagaucaagaccagccugggaaau

SEQ ID NO: 265935 - RNA, 64 nt, hsa
aacaccauggugugugcaggcgcggagggcagaggcgcagaauccugugaggucagagccuaga

SEQ ID NO: 265936 - RNA, 64 nt, hsa
ucagcuauucggcgcgguuccccaacagcgccgggcgcagaaagcuuucgauuuuuuaaauaag

SEQ ID NO: 265937 - RNA, 64 nt, hsa
aguacuuucuuccugaugccaguucuucugggaagcgcagaauuucagauauauuuuaguaaca

SEQ ID NO: 265938 - RNA, 64 nt, hsa
aaagcaguugagcaaacaccaacccgagcuucgggcgcagaauucuucaccuucucuuccccuu

SEQ ID NO: 265939 - RNA, 64 nt, hsa
agcacaacgggucauuuuccuuuguauguuccuagcgcagaacuguuucuaaaacaacuugaag

SEQ ID NO: 265940 - RNA, 64 nt, hsa
ggauauuggaacucagagagguggcuauugcauugcgcagaacgcuacagagcccaugcucuuc

SEQ ID NO: 265941 - RNA, 64 nt, hsa
cucccccacucccuccuaucguugguuugucuagaacacucagcugcuucuuuggucauccuug

SEQ ID NO: 265942 - RNA, 64 nt, hsa
augguccguucuauaccuuuuucuggucauaaugaacacucauuuuguuagcgagggugguaaa

SEQ ID NO: 265943 - RNA, 64 nt, hsa
cucaacccaaggggauuuuuaugucuggggcagaaacacucaaguugauuagaaagaccaggcc

SEQ ID NO: 265944 - RNA, 64 nt, hsa
auccauccuugccaauagugucauccucacagugaacacucaguggcccauggcauuuuauagg

SEQ ID NO: 265945 - RNA, 64 nt, hsa
uucguuauucuaaguuuaguuacaaucccuucuuuaccucuacuuaauguuccauauauuuuua

SEQ ID NO: 265946 - RNA, 64 nt, hsa
uuuuuccucuuuuuuggcccguuguuauuaguaauaccucuaguaguugauacuucaggaaguc

SEQ ID NO: 265947 - RNA, 64 nt, hsa
cucuauaaaaugaauaaaauguuuaagaaaagagaaagagaaaaggaauuaauucagugaagga

SEQ ID NO: 265948 - RNA, 64 nt, hsa
aaaucucucuauaaaaugaauaaaauguuuaagaaaagagaaagagaaaaggaauuaauucagu

SEQ ID NO: 265949 - RNA, 64 nt, hsa
acuguggaagcuaaaacacuucuacuagggccaaaaagagaaaagaaaagaaaauuucuacuaa

SEQ ID NO: 265950 - RNA, 64 nt, hsa
uaauaucaagagucuagaugugaggcuuuuugugaaagagaagccuaaauucagcaucuccccu

SEQ ID NO: 265951 - RNA, 64 nt, hsa
aaggaaauuucaguggcucucugguuucuuaacaaaagagaaagcacagcacuuucugauccaa

SEQ ID NO: 265952 - RNA, 64 nt, hsa
aguuuuauuggagaaaucuugccuauaauucuauaaagagaaaugacauuccacaaaugucaag

SEQ ID NO: 265953 - RNA, 64 nt, hsa
uaaagcaagagaucuggcaguugaaaauugugggaaagagaauuuguaugggcacuguaucuau

SEQ ID NO: 265954 - RNA, 64 nt, hsa
ccuagaauuuaaaaauaaaaaagucuuccucuggaaagagaagucacacagacaaucaugugcc

SEQ ID NO: 265955 - RNA, 64 nt, hsa
aaaucuucacugaauaucauauguaucuaaaugaaaagagaauuacuuauauucaucuauuuuc

SEQ ID NO: 265956 - RNA, 64 nt, hsa
augggaguccacgauucucagguauugauugaaaaaagagaaaggggcaagaaauucauuaaag

SEQ ID NO: 265957 - RNA, 64 nt, hsa
aacuuuuuuuuuuuuuuacaauuauuacaacacuaaagagaaguuuagaauauagagaguuuuu

SEQ ID NO: 265958 - RNA, 64 nt, hsa
gagaggcaugugugccggcauccuugauggguucaaagagaaagguuggagaugauagugggug

SEQ ID NO: 265959 - RNA, 64 nt, hsa
ccagcugcuccuaaggacacagggcuggguugguaaagagaaggcuaugguugacuucuugcuu

SEQ ID NO: 265960 - RNA, 64 nt, hsa
aaagugccacagauaggaaacagcuguuaauuacaaagagaaagaauugucauagcaucuuauu

SEQ ID NO: 265961 - RNA, 64 nt, hsa
cacugucauuuaaggcugugcuugugcuuuauacaaagagaaagagguggucuuaaggggaugc

SEQ ID NO: 265962 - RNA, 64 nt, hsa
augaaauuaaaaguggauagcuuucaggaaagauaaagagaacaugcuuagaauguaagcuaaa

SEQ ID NO: 265963 - RNA, 64 nt, hsa
ucugaugcauuaauaaaagcagccaaauagggccaaagagaaaaauaacaggacucuguacugg

SEQ ID NO: 265964 - RNA, 64 nt, hsa
cuggcugccuggccguggcuucucuuuggcucccaaagagaaggacaguguugggaguaucugc

SEQ ID NO: 265965 - RNA, 64 nt, hsa
ugggaguaucugccguggcuucucuuuggcucccaaagagaaggacaguguugggaguaucugc

SEQ ID NO: 265966 - RNA, 64 nt, hsa
uuuagggaugagacuauucucugcuucaucaaggaaagagaaauguucaggguuguagggaugg

SEQ ID NO: 265967 - RNA, 64 nt, hsa
uuaggauagagagugggcucauuggccuaaauaaaaagagaagaccagaagucuuugaggucuc

SEQ ID NO: 265968 - RNA, 64 nt, hsa
ccauuaguagaguucaagcuucaguauucaucucaaagagaaaccuugggaacaugaugaaugu

SEQ ID NO: 265969 - RNA, 64 nt, hsa
accacaucuuguuccacaucaggcaauaauuacuaaagagaaucccugucaaugucaagagggg

SEQ ID NO: 265970 - RNA, 64 nt, hsa
cugggcaacagagugagacccugucuccaaagagaaagagaaacuugagaaggcuugugcccaa

SEQ ID NO: 265971 - RNA, 64 nt, hsa
uccagccugggcaacagagugagacccugucuccaaagagaaagagaaacuugagaaggcuugu

SEQ ID NO: 265972 - RNA, 64 nt, hsa
auuaaagagacugguagcucaucauccuaccauaaaagagaaaaaaauucggaaagugaucaga

SEQ ID NO: 265973 - RNA, 64 nt, hsa
gucaaguguucaggccacacagucagcccaggaaaaagagaagcagggccaaauggaaagaaca

SEQ ID NO: 265974 - RNA, 64 nt, hsa
acgggaaugcccucauucaaaaaaaagaacuuugaaagagaaucuuucugaucaccuuagaaau

SEQ ID NO: 265975 - RNA, 64 nt, hsa
caaaagcacaaacaugggucaaaggaaaaucuuaaaagagaacacaccaaaaaagugaaagaga

SEQ ID NO: 265976 - RNA, 64 nt, hsa
ggaaaaucuuaaaagagaacacaccaaaaaagugaaagagaaauugaaagggaaaaaagacaaa

SEQ ID NO: 265977 - RNA, 64 nt, hsa
ggagauugaugacaagcaaguuacucaggaaucaaaagagaaaaaaguuucugaaaacaaugaa

SEQ ID NO: 265978 - RNA, 64 nt, hsa
uuuauagaaugcaugucuuuuguguuaagaaaccaaagagaaauaaagagaacacuccuaauag

SEQ ID NO: 265979 - RNA, 64 nt, hsa
gcaugucuuuuguguuaagaaaccaaagagaaauaaagagaacacuccuaauagcucuuguccu

SEQ ID NO: 265980 - RNA, 64 nt, hsa
gcaaaugacaagcgauaggcuauugcaaccugagaaagagaacugcuccuucaucguaaauuua

SEQ ID NO: 265981 - RNA, 64 nt, hsa
aaggcccucucacacagacgugacguccugccagaaagagaaugaaugacagaaaaaaaaaaga

SEQ ID NO: 265982 - RNA, 64 nt, hsa
auaucaaaacaucucuaagauacaguauuuaguaaaagagaaaguuucaggaaauaaaacuaca

SEQ ID NO: 265983 - RNA, 64 nt, hsa
ggauuuuuuuuuuuuaaguaagaagggaacuguaaaagagaaaaaaagaaauucaugcauagcu

SEQ ID NO: 265984 - RNA, 64 nt, hsa
ugcagagguugagaggaggacuugguugauguuuaaagagaaguucccagccaagggccucggg

SEQ ID NO: 265985 - RNA, 64 nt, hsa
cagacaucagccuccuucuuucaccccuuaccccaaagagaaagaguuugaaacucgagaccau

SEQ ID NO: 265986 - RNA, 64 nt, hsa
uuagucaaaagaaaaaaugcuuuauagcaaaaugaaagagaacaugaaaugcuucuuucucagu

SEQ ID NO: 265987 - RNA, 64 nt, hsa
uguagaagcaaacaaaauacuuuuacccacuuaaaaagagaauauaacauuuuaugucacuaua

SEQ ID NO: 265988 - RNA, 64 nt, hsa
cagugaauagugcucauaaauugguagcguauauaaagagaaguuccugucacauuauauuccc

SEQ ID NO: 265989 - RNA, 64 nt, hsa
caaacagauccauguuaggacauuucugaauaauaaagagaaaagguguuucguuggguauugc

SEQ ID NO: 265990 - RNA, 64 nt, hsa
cacuaaauaacccaguuuuaauauauccuuauccaaagagaaacucauuuuuuuaaagugaaau

SEQ ID NO: 265991 - RNA, 64 nt, hsa
aaauacuccucuaaaguagauaaacuccuugaguaaagagaaguuuaccauagcaacuuucagu

SEQ ID NO: 265992 - RNA, 64 nt, hsa
auguccauucugcagcguuucucuuucccuuggaaaagagaauuuaucauuacuguuacauuug

SEQ ID NO: 265993 - RNA, 64 nt, hsa
gguggucccugcccuuaccagagcugaaaaugaaaaagagaacagcagcuuucuagggacagcu

SEQ ID NO: 265994 - RNA, 64 nt, hsa
uucgcuguuuguuguuucauagauuuauuuaaaaaaagagaaagucuauagcuauaaaucuuua

SEQ ID NO: 265995 - RNA, 64 nt, hsa
uaaaaaaagagaaagucuauagcuauaaaucuuuaaagagaaauaugaauacaauuccccuaaa

SEQ ID NO: 265996 - RNA, 64 nt, hsa
gaaauaugaauacaauuccccuaaacucuccucaaaagagaauucagucuacagccauuuaaau

SEQ ID NO: 265997 - RNA, 64 nt, hsa
aaugcaauaaggaaucaauucuuuucugccugagaaagagaaccagacgcaggaagaugaaagg

SEQ ID NO: 265998 - RNA, 64 nt, hsa
caauguccuuugauuuuuuuuaauacauuaagagaaagagaaauauauauauauccacccccag

SEQ ID NO: 265999 - RNA, 64 nt, hsa
auuccucaccuuucuugccuuuaccagacacuggaaagagaauacuauauugcucauuuagcua

SEQ ID NO: 266000 - RNA, 64 nt, hsa
aagaaauaaauacaucucaucuaacacacacgacaaagagaagcugugcgugccccgggguggg

SEQ ID NO: 266001 - RNA, 64 nt, hsa
cauuuguaaaauaaaauagagcagaaaaacacaaaaagagaacacugguucagacauucagugg

SEQ ID NO: 266002 - RNA, 64 nt, hsa
guuucuguugauuucuuuuuuguaugcugugauaaaagagaaaugaaaagugccagucacugug

SEQ ID NO: 266003 - RNA, 64 nt, hsa
agaguugauuaagaaaaaugaagaaaaaacgcaaaaagagaacacauguagaaggugguggaug

SEQ ID NO: 266004 - RNA, 64 nt, hsa
aaacugcacaaauuuuuaugggacaaagccuagaaaagagaaauguaguuugaaucauaaucua

SEQ ID NO: 266005 - RNA, 64 nt, hsa
cacugaaaaggggugggaguuggaaaucagaaagaaagagaaauauuucauuauguuaaugaag

SEQ ID NO: 266006 - RNA, 64 nt, hsa
aagaaagagaaauauuucauuauguuaaugaagaaaagagaaaauugaagcauaaauguauuuu

SEQ ID NO: 266007 - RNA, 64 nt, hsa
uuagugccugacacagaaacaacugggaauccugaaagagaagcagacaccgucacaggccccu

SEQ ID NO: 266008 - RNA, 64 nt, hsa
gcauuucccagccccaguguccacaccucucagaaaagagaaaaaagaaugucaguuuaggaga

SEQ ID NO: 266009 - RNA, 64 nt, hsa
cucaugccuuauucagcaucacaaaaugcauaggaaagagaaaucguaugaauguaaugaguau

SEQ ID NO: 266010 - RNA, 64 nt, hsa
agcacaucuaguucaacaucagagcauucauaccaaagagaacucaugaauguaaugaagaugg

SEQ ID NO: 266011 - RNA, 64 nt, hsa
agacaucagcuauauacucugcuuggugcauaagaaagagaaaagagaugccuuuuguguuuug

SEQ ID NO: 266012 - RNA, 64 nt, hsa
gaucuagaacugguccagccgacgaagaguaggaaaagagaagggcugcucagggaaacauugg

SEQ ID NO: 266013 - RNA, 64 nt, hsa
uguaaaucaucuggcaucacugauagaauuucugaaagagaaagagaaguagauggucaaccag

SEQ ID NO: 266014 - RNA, 64 nt, hsa
ucaucuggcaucacugauagaauuucugaaagagaaagagaaguagauggucaaccagucacua

SEQ ID NO: 266015 - RNA, 64 nt, hsa
gucaggauugcacaguauguuacaauacaauuucaaagagaacccacauuugugagauuuacag

SEQ ID NO: 266016 - RNA, 64 nt, hsa
uaagagaugaaaaagaauugacacaguucucuuuaaagagaagaacuuuuuuauuauuauuuuu

SEQ ID NO: 266017 - RNA, 64 nt, hsa
agaggcucuguuuuccacugaagcuuuguuggagaaagagaauaugaaaauuacacauuuuaua

SEQ ID NO: 266018 - RNA, 64 nt, hsa
cauuaaaucguagguagggcaauguaguaaaaugaaagagaauuaagaaagguuuugaauucuu

SEQ ID NO: 266019 - RNA, 64 nt, hsa
uaguauuuauagaaauaauguaaaaauaaaaaguaaagagaaugagaacagugugguaaaaggg

SEQ ID NO: 266020 - RNA, 64 nt, hsa
gcuugaaaaauuaaaggagguuguucacuuccagaaagagaaagacgacguaucagaaagaggu

SEQ ID NO: 266021 - RNA, 64 nt, hsa
aagucacucaauuguuuuuguuguggucugagccaaagagaaugccauucucuuggguggguaa

SEQ ID NO: 266022 - RNA, 64 nt, hsa
aguuuccguuuccagguguuuauagugguguuuuaaagagaauguagaccugugagaaaacguu

SEQ ID NO: 266023 - RNA, 64 nt, hsa
uugcauuuuuuuguuugcauauuaaaaaaagagaaaagagaaagcaagagacagaaaucaggac

SEQ ID NO: 266024 - RNA, 64 nt, hsa
uucauuuuugcauuuuuuuguuugcauauuaaaaaaagagaaaagagaaagcaagagacagaaa

SEQ ID NO: 266025 - RNA, 64 nt, hsa
uuccgugagagucaucucaaacacugcuuaaggaaaagagaaacacuaauggccaaguguacau

SEQ ID NO: 266026 - RNA, 64 nt, hsa
aaguaauaacuguuagaauuagguaauggauaugaaagagaaaaugcuuucucaugcauagaca

SEQ ID NO: 266027 - RNA, 64 nt, hsa
uaccaucucccccgccaauaaaaaagagaagaaaaaagagaaacccguggcacuauguaaauaa

SEQ ID NO: 266028 - RNA, 64 nt, hsa
aacaaguuauaguaccaucucccccgccaauaaaaaagagaagaaaaaagagaaacccguggca

SEQ ID NO: 266029 - RNA, 64 nt, hsa
ucauuuuucuuuucuucuugcauuuugugaacuuaaagagaaggaauauuuguguaggugaauc

SEQ ID NO: 266030 - RNA, 64 nt, hsa
gaaccaacccaaccccuagcucaccuccuacuguaaagagaaugcacugguccugacaauuuuu

SEQ ID NO: 266031 - RNA, 64 nt, hsa
gaccagaagaggcacuagccauuuuaaggagaggaaagagaaaacucuggggucagggagagac

SEQ ID NO: 266032 - RNA, 64 nt, hsa
uuuccaucugucugguuaugucaaguuaauucagaaagagaagagacagugaccaacccugaga

SEQ ID NO: 266033 - RNA, 64 nt, hsa
uuuaauuaauugguaagauauaaugcaaaaaaaaaaagagaaauguuugccuuauguauauucc

SEQ ID NO: 266034 - RNA, 64 nt, hsa
ugaccuaauacaauuaauuuucuggauaacucuuaaagagaagucauuuuaacuguuuuugcua

SEQ ID NO: 266035 - RNA, 64 nt, hsa
gucaauaauuagaaauagaagauuuauauagcaaaaagagaaugauguuuggcaauauagaacu

SEQ ID NO: 266036 - RNA, 64 nt, hsa
augcaaaaagguaacaaauucauaacuggaaagcaaagagaagaacaaguaugauuuggaugau

SEQ ID NO: 266037 - RNA, 64 nt, hsa
ucuccccugcgagcccuuuuuauuugagaaggaaaaagagaaaagagaaucguuuaagggaacc

SEQ ID NO: 266038 - RNA, 64 nt, hsa
ugcgagcccuuuuuauuugagaaggaaaaagagaaaagagaaucguuuaagggaacccggcgcc

SEQ ID NO: 266039 - RNA, 64 nt, hsa
guaauuuuacauuucaugaaaugaugucaguuucaaagagaaaguggagaggaccuaacauaug

SEQ ID NO: 266040 - RNA, 64 nt, hsa
uuuauuuaggccuucugugugacguauccacagaaaagagaagcucugauucagcuggggcuag

SEQ ID NO: 266041 - RNA, 64 nt, hsa
agcuauuaguauauuuaaaaacuguucaaaagcaaaagagaaggaacaggaaugaaaggaaacc

SEQ ID NO: 266042 - RNA, 64 nt, hsa
gaauuugcaaacuaccgucgcucagcaacaccaaaaagagaaagucugguuaaaacaccaugag

SEQ ID NO: 266043 - RNA, 64 nt, hsa
guugaaaugaaaagagagacagagagaaaaaaaaaaagagaacccacaugaagcucugaaacca

SEQ ID NO: 266044 - RNA, 64 nt, hsa
ugguaaauuuuugaguuguuuguuucuguuuuguaaagagaauccuuauuggacaccagugaag

SEQ ID NO: 266045 - RNA, 64 nt, hsa
gcugcauuuugaugaauuuuuucuagccauuuuuaaagagaaaacuaggaauugaguauuuugu

SEQ ID NO: 266046 - RNA, 64 nt, hsa
gaggaggcauaagcuauggagguuggaaaggaagaaagagaagagcugaaguaaauguauggua

SEQ ID NO: 266047 - RNA, 64 nt, hsa
aaaccauauugaucaacuagaaagaaaaauaugaaaagagaaaaauauuuuaauuuaaaaauug

SEQ ID NO: 266048 - RNA, 64 nt, hsa
uuguguuuaucuaaauacguaaacucaagcuaccaaagagaaagauguuguaaucauaucugca

SEQ ID NO: 266049 - RNA, 64 nt, hsa
agacucugucucaaaaaaaaaaaaaaaaaggaagaaagagaagauagagacacaggggagaaug

SEQ ID NO: 266050 - RNA, 64 nt, hsa
accuaccuuuucaggauuuagaaccuaaaauuagaaagagaaucccagcugucauuguuccuuc

SEQ ID NO: 266051 - RNA, 64 nt, hsa
gggcuucccuguucccucagccccagucgagaggaaagagaaucgggccacugccagaaagaga

SEQ ID NO: 266052 - RNA, 64 nt, hsa
agagcagguagcccaaaauagagaaagauuagauaaagagaaaauaaguauccaucagagacag

SEQ ID NO: 266053 - RNA, 64 nt, hsa
uaaaugaauaaaacauuugcaaagaccuuuagagaaagagaaugggagcauaugugagaaauaa

SEQ ID NO: 266054 - RNA, 64 nt, hsa
ugauuccgcagcucagacccuuucuucagcucugaaagagaaacacguaucccaccugacaugu

SEQ ID NO: 266055 - RNA, 64 nt, hsa
agcucaggacugccauuggacuauggagugcaccaaagagaaugcccuucuccuuauuguaacc

SEQ ID NO: 266056 - RNA, 64 nt, hsa
guugauauuauuguuauuaucauuauuaauaaauaaagagaaaaggaauuuuuguuuaaaugag

SEQ ID NO: 266057 - RNA, 64 nt, hsa
ggcuucuggcacuuagaaaacaaaaagaacaaaaaaagagaaacccccaagccuggaacgcaga

SEQ ID NO: 266058 - RNA, 64 nt, hsa
aaguuaacucuuaguuuuuacuuguuuaauucuaaaagagaagggagcugaggccauucccugu

SEQ ID NO: 266059 - RNA, 64 nt, hsa
guggguuccagggacuguaccuguaggaaacagaaaagagaagaaagaagcacucugcuggcgg

SEQ ID NO: 266060 - RNA, 64 nt, hsa
uuuucugcaucaauucagucaauuugccuucaacaaagagaagucagcaaguucuauuuaugcu

SEQ ID NO: 266061 - RNA, 64 nt, hsa
gggaggcauuuugaagauagaaccucuauuuuaaaaagagaaguucaacucauaaacgugauug

SEQ ID NO: 266062 - RNA, 64 nt, hsa
gggaagccugagguagucaacccaggagccaagaaaagagaacuacgaggaacaggugcccgga

SEQ ID NO: 266063 - RNA, 64 nt, hsa
aaaagggcaaaaaacaaucucaaaaagauuagaaaaagagaaggggggaagggaagagaaaauc

SEQ ID NO: 266064 - RNA, 64 nt, hsa
aacauagcgugacccugucucuacaaaaaauuaaaaagagaacauacaaaguugacauaugaga

SEQ ID NO: 266065 - RNA, 64 nt, hsa
accaauuuuguuuuuacagaaaagauaaaacucaaaagagaacaguguauuccuucugaggggc

SEQ ID NO: 266066 - RNA, 64 nt, hsa
uucauuagcugaaugaggauauuuuaagaaguugaaagagaauuuauuuucaaguugugaguaa

SEQ ID NO: 266067 - RNA, 64 nt, hsa
ccuaaagggaaccugcaauaaucuugaaaaagaaaaagagaaaaauuuuaaaauccugcuauag

SEQ ID NO: 266068 - RNA, 64 nt, hsa
gagaaaaauuuuaaaauccugcuauaggagaaaaaaagagaaaaaaauaaaaaucaaaaaaaaa

SEQ ID NO: 266069 - RNA, 64 nt, hsa
ucagguuuuuaaagacccagcccuucccaaucucaaagagaaaaaggaaacugaguuaucuuga

SEQ ID NO: 266070 - RNA, 64 nt, hsa
gcauuuaagaugacagugagaaaaugauaagcauaaagagaaguaucagguuauuugcuuuuuc

SEQ ID NO: 266071 - RNA, 64 nt, hsa
uucuucuucuucuuuuuuuuuuuuuauaaaagcaaaagagaaauacauaaaaaaguguuuaccc

SEQ ID NO: 266072 - RNA, 64 nt, hsa
ugcaauacauuuuuuucucuuuccuugaaaauaaaaagagaaacaaguauuuugcuauauauaa

SEQ ID NO: 266073 - RNA, 64 nt, hsa
aaaaauaaacugauuuaauuugcucuauaguccuaaagagaauuauauccucucauagaccaau

SEQ ID NO: 266074 - RNA, 64 nt, hsa
uaucuuuaaagucaucugggaggugcagguaaguaaagagaaacaauuuuugucacaaaguagu

SEQ ID NO: 266075 - RNA, 64 nt, hsa
gauuuuaaaagggaaugauaugcuuguuuaaaugaaagagaaaagcuguaguaaacuguguuaa

SEQ ID NO: 266076 - RNA, 64 nt, hsa
ccucuggaucaucuggcugagcaacugaauuacaaaagagaauuacuuccaucucaacuucaac

SEQ ID NO: 266077 - RNA, 64 nt, hsa
uauauacucaauaugguuuuacugugccuuacacaaagagaaacucuauacagaauguauauca

SEQ ID NO: 266078 - RNA, 64 nt, hsa
uuaguuaaaucuaguaaaggacagucuauuguuuaaagagaaggugcauuuguuccucaaucaa

SEQ ID NO: 266079 - RNA, 64 nt, hsa
cugcaaagaagggagagaagguacccaaagggaaaaagagaaaagcugaugcuggcaaggagcg

SEQ ID NO: 266080 - RNA, 64 nt, hsa
gaugacaauauccuuacacauuugucauacuaucaaagagaaagaaacaagauuuccauuccca

SEQ ID NO: 266081 - RNA, 64 nt, hsa
cauguuaaaagccuuaaucucauuuggguacucaaaagagaaaucagaguuuauucugguuaac

SEQ ID NO: 266082 - RNA, 64 nt, hsa
gccaaaaggagauaccauccugauaagcucugugaaagagaagaugugccugguguguguaaug

SEQ ID NO: 266083 - RNA, 64 nt, hsa
uuucuuuaauggcgggggcggggggcggggguacaaagagaaaucucuaaaagaauaugaucuu

SEQ ID NO: 266084 - RNA, 64 nt, hsa
acaaugcauggauuccuuugaagaaaaaaaagaaaaagagaaaaaaaucacaaaaacaaacuuu

SEQ ID NO: 266085 - RNA, 64 nt, hsa
gucggcugugcaucgcauucgaggcuccuuuuuuaaagagaaaagcauaggccucuguucucau

SEQ ID NO: 266086 - RNA, 64 nt, hsa
gguccugaaguuugcugguucaggaaagaacaggaaagagaaaagccuucugugcccaggcuaa

SEQ ID NO: 266087 - RNA, 64 nt, hsa
cuuuuuguuuuaacuauugucaggagauugggcuaaagagaagacgacgagaguaaggaaauaa

SEQ ID NO: 266088 - RNA, 64 nt, hsa
cagucuugcacauaagugcagauuuggcucaaguaaagagaauuuccucaacacuaacuucacu

SEQ ID NO: 266089 - RNA, 64 nt, hsa
ugugcugaugaaguccucuauaagcacaagccaaaaagagaaagagaaaaaaagguaauuauug

SEQ ID NO: 266090 - RNA, 64 nt, hsa
cuaauucuuaaaucccagcacaagccaaaaagagaaagagaaaaaaagguaauuauuguagaac

SEQ ID NO: 266091 - RNA, 64 nt, hsa
uuugcaugugacuuagcaagggcucugaaaugacaaagagaacgagcaccacaaaugagaacag

SEQ ID NO: 266092 - RNA, 64 nt, hsa
gcagaggguuucugcugucuccagacugucuaccaaagagaaggcgacagaugccuccuggguu

SEQ ID NO: 266093 - RNA, 64 nt, hsa
gggggguggauuaggagauugaaggguugagaagaaagagaaauuguccaaagaguccucagaa

SEQ ID NO: 266094 - RNA, 64 nt, hsa
gccgucaaguaguaagaagaacuuggaugccagcaaagagaauggggcugggcagaucugugag

SEQ ID NO: 266095 - RNA, 64 nt, hsa
ggaaaccacagugaagaagacagcacugaugaccaaagagaagacacucauauuaagccuauuu

SEQ ID NO: 266096 - RNA, 64 nt, hsa
auuuagugcagcuguuauggcucaccucagaacaaaagagaauugaaccaaauuugggaguuug

SEQ ID NO: 266097 - RNA, 64 nt, hsa
cuaauuucaaaagaaucccaauauugcuguauagaaagagaacuagcuugcacauuuuaggucu

SEQ ID NO: 266098 - RNA, 64 nt, hsa
augcugguagugaugcuggcuguucggauaugccaaagagaaaccguaaggugcuuccuuuaag

SEQ ID NO: 266099 - RNA, 64 nt, hsa
cagacuccugccagauggggcagguaguuuauucaaagagaacucuguaucccauaggcccagg

SEQ ID NO: 266100 - RNA, 64 nt, hsa
ccagaaagucugguggcuuuggucccaagugggaaaagagaacugccccaugcccagcuuguga

SEQ ID NO: 266101 - RNA, 64 nt, hsa
gguagugagcugaucauccacuuucuucuaaaauaaagagaagaaaauggccaguauucauccu

SEQ ID NO: 266102 - RNA, 64 nt, hsa
cuguguucuaaauagaaauauuaaguugcaguaaaaagagaaaaaaaggcuauuuagcauuaca

SEQ ID NO: 266103 - RNA, 64 nt, hsa
gguguaaaaaagauguuucacuaauguaacggugaaagagaaucccuguuguacuuuaucuuuu

SEQ ID NO: 266104 - RNA, 64 nt, hsa
aagauauuuucuuuuuguuauuagaaggaaauacaaagagaaaaauuucuuucuuucaugggca

SEQ ID NO: 266105 - RNA, 64 nt, hsa
ugcuuucuuuaaaauaacuagaagaacauaaaagaaagagaaucucagaaguaguuugcugcua

SEQ ID NO: 266106 - RNA, 64 nt, hsa
uugacagacucacucggccucacuucauccuugcaaagagaauccuguacuucauccuugcaaa

SEQ ID NO: 266107 - RNA, 64 nt, hsa
uccuugcaaagagaauccuguacuucauccuugcaaagagaauccuguacuucacucagaauga

SEQ ID NO: 266108 - RNA, 64 nt, hsa
ccaugugcuuuucgcagccuuccuguguuggaugaaagagaauaagaauucagcugacaggagg

SEQ ID NO: 266109 - RNA, 64 nt, hsa
guggcuuuuaaaccaggagcccggaggaagggugaaagagaaagccugugaaauaggcagggcc

SEQ ID NO: 266110 - RNA, 64 nt, hsa
uuggaugguccaggcucuaugugaccuccagagcaaagagaaagacuucggacagucuaggucc

SEQ ID NO: 266111 - RNA, 64 nt, hsa
ugcagagaaggugggaccagggccaggguuccaaaaagagaauaagccuccuggggggucugac

SEQ ID NO: 266112 - RNA, 64 nt, hsa
uuuccuaaagcuccucugcacauagaggggagaaaaagagaauuuaggcaacuccacucccccu

SEQ ID NO: 266113 - RNA, 64 nt, hsa
ccuucacccccaacccuguauucuacucucccgaaaagagaagagaaucgcaugaguagcaaga

SEQ ID NO: 266114 - RNA, 64 nt, hsa
uagcuuauauaugacgguauauuuacaaaaagagaaagagaaaaucugguauuugcaaugaucu

SEQ ID NO: 266115 - RNA, 64 nt, hsa
aaauuuuagcuuauauaugacgguauauuuacaaaaagagaaagagaaaaucugguauuugcaa

SEQ ID NO: 266116 - RNA, 64 nt, hsa; identical to SEQ ID NO: 51753

SEQ ID NO: 266117 - RNA, 64 nt, hsa; identical to SEQ ID NO: 51754

SEQ ID NO: 266118 - RNA, 64 nt, hsa; identical to SEQ ID NO: 51755

SEQ ID NO: 266119 - RNA, 64 nt, hsa; identical to SEQ ID NO: 51756

SEQ ID NO: 266120 - RNA, 64 nt, hsa; identical to SEQ ID NO: 51757

SEQ ID NO: 266121 - RNA, 64 nt, hsa; identical to SEQ ID NO: 51758

SEQ ID NO: 266122 - RNA, 64 nt, hsa; identical to SEQ ID NO: 51759

SEQ ID NO: 266123 - RNA, 64 nt, hsa; identical to SEQ ID NO: 51760

SEQ ID NO: 266124 - RNA, 64 nt, hsa; identical to SEQ ID NO: 51761

SEQ ID NO: 266125 - RNA, 64 nt, hsa; identical to SEQ ID NO: 51762

SEQ ID NO: 266126 - RNA, 64 nt, hsa; identical to SEQ ID NO: 51763

SEQ ID NO: 266127 - RNA, 64 nt, hsa; identical to SEQ ID NO: 51764

SEQ ID NO: 266128 - RNA, 64 nt, hsa
ggaucucaggaaggcaucaguguugauuaacacucauaacuagggagugagugguaguuacuua

SEQ ID NO: 266129 - RNA, 64 nt, hsa
aaagaaacaaaaaaaagaguggaaacuauucuaucauaacuacccaaggacuacuaaaaggaaa

SEQ ID NO: 266130 - RNA, 64 nt, hsa
auuaugacuagcuuuacuauuuuaauucaccuugcauaacuacugaauuuugucauucuugaaa

SEQ ID NO: 266131 - RNA, 64 nt, hsa
gcugggauuacagaugugagccaccgugcuuggccauaacuauugaaugcuuucuauguggaga

SEQ ID NO: 266132 - RNA, 64 nt, hsa
aaugauuauccuuuuaucaggagcccacuucugacauaacuaacccacaccugagauaacggca

SEQ ID NO: 266133 - RNA, 64 nt, hsa
cccucuacugaugagacuuccugcugccuuuggacauaacuaagccaggaaacuuuaaaagccu

SEQ ID NO: 266134 - RNA, 64 nt, hsa
ugcagcccaguuuaauucagcacuuucccauuuucauaacuaugugaaaacaucugggaauuug

SEQ ID NO: 266135 - RNA, 64 nt, hsa; identical to SEQ ID NO: 212887

SEQ ID NO: 266136 - RNA, 64 nt, hsa; identical to SEQ ID NO: 212888

SEQ ID NO: 266137 - RNA, 64 nt, hsa; identical to SEQ ID NO: 212889

SEQ ID NO: 266138 - RNA, 64 nt, hsa; identical to SEQ ID NO: 212890

SEQ ID NO: 266139 - RNA, 64 nt, hsa; identical to SEQ ID NO: 212891

SEQ ID NO: 266140 - RNA, 64 nt, hsa; identical to SEQ ID NO: 212892

SEQ ID NO: 266141 - RNA, 64 nt, hsa; identical to SEQ ID NO: 212893

SEQ ID NO: 266142 - RNA, 64 nt, hsa; identical to SEQ ID NO: 212894

SEQ ID NO: 266143 - RNA, 64 nt, hsa; identical to SEQ ID NO: 212895

SEQ ID NO: 266144 - RNA, 64 nt, hsa; identical to SEQ ID NO: 212896

SEQ ID NO: 266145 - RNA, 64 nt, hsa; identical to SEQ ID NO: 212897

SEQ ID NO: 266146 - RNA, 64 nt, hsa; identical to SEQ ID NO: 212898

SEQ ID NO: 266147 - RNA, 64 nt, hsa; identical to SEQ ID NO: 212899

SEQ ID NO: 266148 - RNA, 64 nt, hsa; identical to SEQ ID NO: 212900

SEQ ID NO: 266149 - RNA, 64 nt, hsa; identical to SEQ ID NO: 212901

SEQ ID NO: 266150 - RNA, 64 nt, hsa; identical to SEQ ID NO: 212902

SEQ ID NO: 266151 - RNA, 64 nt, hsa; identical to SEQ ID NO: 212903

SEQ ID NO: 266152 - RNA, 64 nt, hsa; identical to SEQ ID NO: 212904

SEQ ID NO: 266153 - RNA, 64 nt, hsa; identical to SEQ ID NO: 212905

SEQ ID NO: 266154 - RNA, 64 nt, hsa; identical to SEQ ID NO: 212906

SEQ ID NO: 266155 - RNA, 64 nt, hsa; identical to SEQ ID NO: 212907

SEQ ID NO: 266156 - RNA, 64 nt, hsa; identical to SEQ ID NO: 212908

SEQ ID NO: 266157 - RNA, 64 nt, hsa; identical to SEQ ID NO: 212909

SEQ ID NO: 266158 - RNA, 64 nt, hsa; identical to SEQ ID NO: 212910

SEQ ID NO: 266159 - RNA, 64 nt, hsa; identical to SEQ ID NO: 212911

SEQ ID NO: 266160 - RNA, 64 nt, hsa; identical to SEQ ID NO: 164705

SEQ ID NO: 266161 - RNA, 64 nt, hsa; identical to SEQ ID NO: 164706

SEQ ID NO: 266162 - RNA, 64 nt, hsa; identical to SEQ ID NO: 172749

SEQ ID NO: 266163 - RNA, 64 nt, hsa; identical to SEQ ID NO: 172750

SEQ ID NO: 266164 - RNA, 64 nt, hsa; identical to SEQ ID NO: 172751

SEQ ID NO: 266165 - RNA, 64 nt, hsa; identical to SEQ ID NO: 172752

SEQ ID NO: 266166 - RNA, 64 nt, hsa; identical to SEQ ID NO: 172753

SEQ ID NO: 266167 - RNA, 64 nt, hsa; identical to SEQ ID NO: 172754

SEQ ID NO: 266168 - RNA, 64 nt, hsa; identical to SEQ ID NO: 172755

SEQ ID NO: 266169 - RNA, 64 nt, hsa; identical to SEQ ID NO: 172756

SEQ ID NO: 266170 - RNA, 64 nt, hsa; identical to SEQ ID NO: 172757

SEQ ID NO: 266171 - RNA, 64 nt, hsa
guuagguggccuuaaguucucaguaaugacacuuaucaaauaggaacuuaguguuacucaccuu

SEQ ID NO: 266172 - RNA, 64 nt, hsa
aauugccuuugcuauaucccuaugagaugagcagaucaaauauuccccgugaguuaaugaaaac

SEQ ID NO: 266173 - RNA, 51 nt, hsa
cugaaagagauugcuaauaaaaucaaauaaaacuguaugaacucuaaugga

SEQ ID NO: 266174 - RNA, 64 nt, hsa
uacuuuuuauguaagcuuuuucacuuaguauuuuaucaaauauguuuuuauuauauucauagcc

SEQ ID NO: 266175 - RNA, 64 nt, hsa
uggauuguuagggauuucagcaguauaagaaagaaucaaauaucuugcuuuugggucuucucca

SEQ ID NO: 266176 - RNA, 64 nt, hsa
aauuuagaagcucuccagugaguauuuuuuuaguaucaaauagugaucuucuuuugcuaacaua

SEQ ID NO: 266177 - RNA, 64 nt, hsa
guuuuuacaaaacauuauucaagccacuagaauuaucaaauaugacgcuauagcagaguaaaua

SEQ ID NO: 266178 - RNA, 64 nt, hsa
uuuuuaauaaggacaccucuuuccaaacagugccaucaaauauguucuuaucucagacuuacgu

SEQ ID NO: 266179 - RNA, 64 nt, hsa
cagagacucacucaggaagugacaggcccaucauaucaaauaacuuauucacuuuucauguggc

SEQ ID NO: 266180 - RNA, 64 nt, hsa
guaacuggggugcaaaccucuucaagaagguaacaucaaauaaauaagucaagcagaggacuuc

SEQ ID NO: 266181 - RNA, 64 nt, hsa
aaagcugugauuauaucaaaaauccagauaaaucaucaaauauaucagauuaagaccaggguuu

SEQ ID NO: 266182 - RNA, 64 nt, hsa
gccaguuuaagugcuuuguguugaugccaugcuuaucaaauacaugcacaagcuaaacauaauu

SEQ ID NO: 266183 - RNA, 64 nt, hsa
caguuuguagugaugggaaguguauuuuacucugaucaaauaaauaaugcuggaauacucaaga

SEQ ID NO: 266184 - RNA, 64 nt, hsa
augucaaaaucugaauauaucuggauauguacuaaucaaauaauaaucaaucaaucagcauaua

SEQ ID NO: 266185 - RNA, 64 nt, hsa
uuucuguuuuauuacagcugguaaugccgcugucaucaaauaugaggagaaaccuccaaaacca

SEQ ID NO: 266186 - RNA, 64 nt, hsa
auacuucaucacuaaagaauucuuguuauuuaauaucaaauaaugaaacagcagucacuucuag

SEQ ID NO: 266187 - RNA, 64 nt, hsa
uuugauauuuagcuugagaauggguauggaaugaaucaaauacuucaucacuaaagaauucuug

SEQ ID NO: 266188 - RNA, 64 nt, hsa
agauuuuuaaaauuucuugaugugguuuguaauaaucaaauauugacaagaaccuuaggucucg

SEQ ID NO: 266189 - RNA, 64 nt, hsa
uguuacuucauacuggaacuuuuaaaaagauuucaucaaauaaaguuuuguuuucuacuuuuaa

SEQ ID NO: 266190 - RNA, 64 nt, hsa
ggagguugugguaacuaaauaggaguccuauaaaaucaaauacauugucaaccuuuucugcaca

SEQ ID NO: 266191 - RNA, 64 nt, hsa
uucuucuggucaccagaugauuucuuccuuuaccaucaaauacuucuucauaauggucacaguc

SEQ ID NO: 266192 - RNA, 64 nt, hsa
ucccaggaauucaagguugguucaacaucuaaaaaucaaauaagcuaauauacagucaguucuc

SEQ ID NO: 266193 - RNA, 64 nt, hsa
gguuaggaauucaagguuuguucaacaucuaaaaaucaaauaagcuaauaaagaaaagagguuu

SEQ ID NO: 266194 - RNA, 64 nt, hsa
aggccucccaggugggggaacugcuugggccuugcugagccaggguccucagggugaagcagga

SEQ ID NO: 266195 - RNA, 64 nt, hsa
cccugccccauccccuuugagugucagaagcacucugagccaaggggacagggggcacgugcac

SEQ ID NO: 266196 - RNA, 64 nt, hsa
cgccccugguggucacaggcugugccuugguuuccugagccaccuuuacucugcucuaugccag

SEQ ID NO: 266197 - RNA, 64 nt, hsa
agggggcgugccugccaagcucacacagcaggaacugagccagaaacgcagauugggcuggcuc

SEQ ID NO: 266198 - RNA, 64 nt, hsa
uucucagaggauuauguaaccccugcaguggaaacugagccagcuaacuuaaaaagcugccuua

SEQ ID NO: 266199 - RNA, 64 nt, hsa
auuuauuagauucguaggucauauuacuuaucaacugagccaaaugucugugugcaauuguguu

SEQ ID NO: 266200 - RNA, 64 nt, hsa
ccauggggguuuggggcuaagaaguucaccagcccugagccauggcggccccucagccugccug

SEQ ID NO: 266201 - RNA, 64 nt, hsa
caggcccugcccagccagccaucggaagagagggcugagccauggggguuuggggcuaagaagu

SEQ ID NO: 266202 - RNA, 64 nt, hsa
ucccuggaacauccugucaguuuggucauaaacccugagccagaugaaaugagccaccgugaac

SEQ ID NO: 266203 - RNA, 64 nt, hsa
gauacugaucugaaggagguggugcuucaggacucugagccauucucuccccuccucugcccug

SEQ ID NO: 266204 - RNA, 64 nt, hsa
ugcgaccuccaccaccccugcagugggcugccagcugagccaccugucuuccacuguaucuacu

SEQ ID NO: 266205 - RNA, 64 nt, hsa
uggucaaggcagcaguccccuuggauacuaaagucugagccaggccccucaggcccggcauggg

SEQ ID NO: 266206 - RNA, 64 nt, hsa
uggggccauuaggcagccuaauuaaugcuggaggcugagccaaguacaggacacccccagccug

SEQ ID NO: 266207 - RNA, 64 nt, hsa
accagcccucugccuccagggaggccaacugacucugagccaggguucccccagggaacucagu

SEQ ID NO: 266208 - RNA, 64 nt, hsa
ccagaguaugcgacggacagaggaacuaaucuaccugagccagaagauugaguuugagugcaaa

SEQ ID NO: 266209 - RNA, 64 nt, hsa
cuuucaucauuaaaaaaagggggaccauuggggccugagccaaggaacuuuccuucuacugccu

SEQ ID NO: 266210 - RNA, 64 nt, hsa
uugagccacgcugucuggugggugauucucugcccugagccaccacccuggacuggcccagucu

SEQ ID NO: 266211 - RNA, 64 nt, hsa
cuggucacugccucaggacccccaagccuaugcccugagccauggcugcugacugacuccagcc

SEQ ID NO: 266212 - RNA, 64 nt, hsa
accuaguucagauacagggugcuccuugucaauacugagccauuuauaccuuugaaauauuaaa

SEQ ID NO: 266213 - RNA, 64 nt, hsa
gcuugaaugugaagcaaacacagcaucgugaucacugagccaucauuuccugggagaaagacca

SEQ ID NO: 266214 - RNA, 64 nt, hsa
gggagggguuaucugggagaagcuuuagccuguucugagccauuaggagacauuagugaauugg

SEQ ID NO: 266215 - RNA, 64 nt, hsa
augcccaccagagauguggucauaagaucugauccugagccagagauucagauggcacaggaag

SEQ ID NO: 266216 - RNA, 64 nt, hsa
cucccaggauacgcccgagcggaagaagcgggcucugagccacgcccuuucacccuccucuacc

SEQ ID NO: 266217 - RNA, 64 nt, hsa
ccacugguuuccccaacaggcugcguaagggacccugagccacagugaguuggucaaaugcucc

SEQ ID NO: 266218 - RNA, 64 nt, hsa
aucacuucugaggagcagaguugagggagccgagcugagccacgcugggaggccagagccuuuc

SEQ ID NO: 266219 - RNA, 64 nt, hsa
gcaggauccucagccauguucaagugaaguaagccugagccagugcguggacuggugccacggg

SEQ ID NO: 266220 - RNA, 64 nt, hsa
ccucucuucugcacagcuccuccccugcuaccugcugagccagauuccccaggaaucuugaaug

SEQ ID NO: 266221 - RNA, 64 nt, hsa
uuuaccucuucuucuccaaaggaucuuuguuccucugagccaagacugagguaaauaaagccac

SEQ ID NO: 266222 - RNA, 64 nt, hsa
gaccaucuggucuugguagaugucccuagacgggcugagccaugugcaauaagaacauagaucc

SEQ ID NO: 266223 - RNA, 64 nt, hsa
uaugaaaucccuggagaauuuuuggugacaugcacugagccaaggugauggacuguauauuuga

SEQ ID NO: 266224 - RNA, 64 nt, hsa
agaauggauggacagacaggccauggaggcagcacugagccagcaccacacguccauccuggga

SEQ ID NO: 266225 - RNA, 64 nt, hsa
cgacacacagggagacgggggccuggagccagcccugagccagaggcagaauggauggacagac

SEQ ID NO: 266226 - RNA, 64 nt, hsa
accucaccuuguugguaccucccucccuggaucucugagccagcagccaggaggaccugaccca

SEQ ID NO: 266227 - RNA, 64 nt, hsa
ccccggucagcacagugccuuuuccucuccugcucugagccaggguggggcauucccucuagau

SEQ ID NO: 266228 - RNA, 64 nt, hsa
ggcgggcacuuucaccaagauguucuagaaacuucugagccaggagugaauggcccuuccuuag

SEQ ID NO: 266229 - RNA, 64 nt, hsa
ccccauucccagggcacuccuuaccccugcugcccugagccaacgccuucacggaccucccuag

SEQ ID NO: 266230 - RNA, 64 nt, hsa
cacauugacuuucuguugagguaccuuggagaagcugagccauucugaggacaucuggcugugu

SEQ ID NO: 266231 - RNA, 64 nt, hsa
acugccuugggucaguccagcccccuccacaucacugagccaucaaugagcugagagaucaaug

SEQ ID NO: 266232 - RNA, 64 nt, hsa
cgcaggggcucugagcccgggccacgcaggggcccugagccaaaagagggggagaaugagaagg

SEQ ID NO: 266233 - RNA, 64 nt, hsa
cagccccuccagucguuauuucuguuuguuuaagcugagccacggauaccgccacggguuuccc

SEQ ID NO: 266234 - RNA, 64 nt, hsa
gcuuggaacccaauaccuaggcuuacaggccauccugagccaggggccucuggaaauucucuuc

SEQ ID NO: 266235 - RNA, 64 nt, hsa
gagcuggauguuccccagcuggcaguugagcugccugagccaaugugucugucuuugguaacug

SEQ ID NO: 266236 - RNA, 64 nt, hsa
acuggauguccagagcuggccaggccacugggcccugagccagagacaaggucaccugggcugu

SEQ ID NO: 266237 - RNA, 64 nt, hsa
gaaucccgacucugauaccuucuggcugugcuaccugagccaagucgccuccccucucugggcu

SEQ ID NO: 266238 - RNA, 64 nt, hsa
ccacucauucacccaaccucaggguucuccccaucugagccagccugcuggugugacuuacuca

SEQ ID NO: 266239 - RNA, 64 nt, hsa
acucauccuccauuccucugcacuugcagacuuucugagccaggguuuucuuuuaguggaaaca

SEQ ID NO: 266240 - RNA, 64 nt, hsa
gcgaugugcaccuguagucccagcuacucgggggcugagccaggcggauagcuugagcucaggg

SEQ ID NO: 266241 - RNA, 64 nt, hsa
caccccguaccacuguugaugugaagcaccucuucugagccaggccgagccccuggccgacuug

SEQ ID NO: 266242 - RNA, 64 nt, hsa
cuucuggcugggacugacuuggccauguucucagcugagccacgcggcugguagugcagccuuc

SEQ ID NO: 266243 - RNA, 64 nt, hsa
cccaagggauuucuggcucaggcuguaaaaguagcugagccauccugcccauuccuggaggucc

SEQ ID NO: 266244 - RNA, 64 nt, hsa
ccuggugauuucaaugauggcauccaggaauuagcugagccaacagaccauguggacagcuuug

SEQ ID NO: 266245 - RNA, 64 nt, hsa
acugcugaccugccuagcgagcaggacaucccuucugagccaucugcugcucucucauuucauc

SEQ ID NO: 266246 - RNA, 64 nt, hsa
ugaagcagggugguccugcguccacuucccaagccugagccaagcucaucuucauugaaugucu

SEQ ID NO: 266247 - RNA, 64 nt, hsa
gcaccuccuguuggagggguggagggauguuccccugagccaggcugagacuagaaccccaucu

SEQ ID NO: 266248 - RNA, 64 nt, hsa
ccugagccaggcugagacuagaaccccaucuucccugagccaggcugagacuagaaccccaucu

SEQ ID NO: 266249 - RNA, 64 nt, hsa
cggugggcugaggcaggggccgcugucgucaggccugagccagggugagcuggugccugccuug

SEQ ID NO: 266250 - RNA, 64 nt, hsa
gccacacaaucaguggggcagccagagcucagaccugagccauuuugucaguauccaggacccc

SEQ ID NO: 266251 - RNA, 64 nt, hsa
gugggaaacccguuguuccucccgucuucagaugcugagccaacugcuuggacagcagccagcg

SEQ ID NO: 266252 - RNA, 64 nt, hsa
cacagaugucuuaaaagacuagaauccacacuuccugagccagaggggccguguugacgguaau

SEQ ID NO: 266253 - RNA, 64 nt, hsa
auguauaauguauuuauaauauucaucgauaccauuauucaaauauugcucaauacagcaaauu

SEQ ID NO: 266254 - RNA, 64 nt, hsa
uacaucauugaagacaagggauagcaguuuguuuuuauucaaagacauugcuguguucucuuuc

SEQ ID NO: 266255 - RNA, 64 nt, hsa
guagagccugaagucuugcaggacucacuggauguuauucaacuccuuccaguugucuugaaca

SEQ ID NO: 266256 - RNA, 64 nt, hsa
agccugaagucuugcaggacucacuggauagauguuauucaacuccuucaguuuaucuuggacu

SEQ ID NO: 266257 - RNA, 64 nt, hsa
aauuuaaaggauggaaauuuaucauguuuaaaaauuauucaagcacucuuaaaaccacuuaaac

SEQ ID NO: 266258 - RNA, 64 nt, hsa
guucacgagaaacauaggcuuuucaaaaaaauuuuuauucaaggcaaagcaaggaacaucuuga

SEQ ID NO: 266259 - RNA, 64 nt, hsa
agaucuuugcgaauuacaaugcauauaugucuauuuauucaauaucugucauauaauaucuauu

SEQ ID NO: 266260 - RNA, 64 nt, hsa
aaaaugacucaauaaaaugacuugcuacguuccguuauucaauuugucauuacuguagugaaca

SEQ ID NO: 266261 - RNA, 64 nt, hsa
uugucuuaagauggaaauacaguuauuucaucuuuuauucaaggaaguuuuaacuuuaauacag

SEQ ID NO: 266262 - RNA, 64 nt, hsa
guuuuuaaaaagaguaauuucauuuaaauaucuguuauucaaauuugaugauguuaaauguaau

SEQ ID NO: 266263 - RNA, 64 nt, hsa
cuuuaacuaaauuaagauugcagaaugauagugauuauucaauuagauuuuaaguaaggauugu

SEQ ID NO: 266264 - RNA, 64 nt, hsa
guuaaaaaugggugucucuguacuaguauuguauuuauucaauugaacuuguauucugauuucu

SEQ ID NO: 266265 - RNA, 64 nt, hsa
caaggaacauauuguuaacuccugauucuuaacuuuauucaacuggacucagaauuguagggau

SEQ ID NO: 266266 - RNA, 64 nt, hsa
aaugaauuuucuaucucuaggcaacaugucuuuauuauucaagcugaauguuuaagagagauuu

SEQ ID NO: 266267 - RNA, 64 nt, hsa
aauaccaucagcauucugcuuuaaagcucauguuuuauucaaagcacaaggacgguuauaacuc

SEQ ID NO: 266268 - RNA, 64 nt, hsa
uuuugauguacuuucugauuccaggauuggauauuuauucaaggacuauuuuaaaaauagaaag

SEQ ID NO: 266269 - RNA, 64 nt, hsa
agaggaggaauuuuauucaaagcauucaaacauuuuauucaaguguuucaaaauucaaagcauu

SEQ ID NO: 266270 - RNA, 64 nt, hsa
cuaaaauaagguuuacucugaaagaggaggaauuuuauucaaagcauucaaacauuuuauucaa

SEQ ID NO: 266271 - RNA, 64 nt, hsa
auguaaaacuuuacuaagcuaaacugcucucugauuauucaagagcaaaguauuaaaaauuucu

SEQ ID NO: 266272 - RNA, 64 nt, hsa
aaaauacauauuuccaccucucucugggagauuuuuauucaaauuggucugugcugacacuaag

SEQ ID NO: 266273 - RNA, 64 nt, hsa
ucuugaauaaaucuguuauuuuaagaauaucacauuauucaaugcauauaaaacuaucagaagu

SEQ ID NO: 266274 - RNA, 64 nt, hsa
aagaggaaagacaagugucguauuucgauccuguuuauucaaaugugugauuuugcugaaauga

SEQ ID NO: 266275 - RNA, 64 nt, hsa
aagucauuaauuacuguccuccuuucacugagcuuuauucaaauuuugacaaucagagcacugg

SEQ ID NO: 266276 - RNA, 64 nt, hsa
cuuuggcuuuauugcagugacuuuccaaguuuaauuauucaaaacuuuuugaacugacugaauu

SEQ ID NO: 266277 - RNA, 64 nt, hsa
uagucuguaagcuccuuaagaguaggguugugccuuauucaacugcauacauagcuccuagcac

SEQ ID NO: 266278 - RNA, 64 nt, hsa
uaucuuuaaagauaucauauuuuauguauguagcuuauucaaagaaguguuuccuauuucuaua

SEQ ID NO: 266279 - RNA, 64 nt, hsa
gauuguaaaaaagcuuuucuuuguuauucaacauuuauucaacacuauagaacucauacuaaug

SEQ ID NO: 266280 - RNA, 64 nt, hsa
augaauguaaagauuguaaaaaagcuuuucuuuguuauucaacauuuauucaacacuauagaac

SEQ ID NO: 266281 - RNA, 64 nt, hsa
acagguccugcuucccacuauccuuuuccuguuauuauucaaauuuuacacaaggacuaauccu

SEQ ID NO: 266282 - RNA, 64 nt, hsa
ucucccauacaagaugacccucugagcuuuucauuuauucaagcucugugguacagccuuuuuu

SEQ ID NO: 266283 - RNA, 64 nt, hsa
guggugagcacaucugggaggcuggucucccuccagcuggaauugcugcucucugagggagagg

SEQ ID NO: 266284 - RNA, 64 nt, hsa
ggugaugaugaccaagaauuacaaguagaauggcagcuggaauuuaaggagggacaagaaucaa

SEQ ID NO: 266285 - RNA, 64 nt, hsa
aucugcuucauuuuagaaccuuuauaaaagcaauagcuggaauauacucccaguuuuaaaauaa

SEQ ID NO: 266286 - RNA, 64 nt, hsa
uuuuguuuuaacugaaucauuuuuuaacuuaaaaagcuggaaaauaucaaaugcuguuuuuuuu

SEQ ID NO: 266287 - RNA, 64 nt, hsa
aucccaucuagauuucuucuugcuuuugacucacagcuggaaguuagaaaagccucgauuucau

SEQ ID NO: 266288 - RNA, 64 nt, hsa
acucaagcaauucuucuacccuggccucccaaguagcuggaauuacaggugugcgccaucacaa

SEQ ID NO: 266289 - RNA, 64 nt, hsa
aggaagaaacuuuuuuuccuucuuuuccaggaguagcuggaaauuaagaucggguuccuuuucu

SEQ ID NO: 266290 - RNA, 64 nt, hsa
gucauaagagcauagauuuuuuguuuuucacaacagcuggaauaaguuccugcauuauaaguau

SEQ ID NO: 266291 - RNA, 64 nt, hsa
uguuugagcuuucaugaguuucccagagagacauagcuggaaaauuccuauugauuuucucuaa

SEQ ID NO: 266292 - RNA, 64 nt, hsa
ccaugagcaauucuccugccucagccucccaaguagcuggaacuacaggcucaugccacugcgc

SEQ ID NO: 266293 - RNA, 64 nt, hsa
ugugugcaugcucuagacaccaccucgcuggagaagcuggaagggcuguugucuucccaggucu

SEQ ID NO: 266294 - RNA, 64 nt, hsa
uugugugugagggcaggucuugacucuaggucucagcuggaaccccacccuuucuccuccuccu

SEQ ID NO: 266295 - RNA, 64 nt, hsa
uuuuaguaagucagaccccaugugugagaaggaaagcuggaaucaugggugguaauccccacuu

SEQ ID NO: 266296 - RNA, 64 nt, hsa
gcuggggaggauuugguagcaauguguagagcagagcuggaaaauaaggguucuugaaacagca

SEQ ID NO: 266297 - RNA, 64 nt, hsa
ccaaggguggaaacuugccccuucccauuucuagagcuggaacccacuccuuuuuuucccauug

SEQ ID NO: 266298 - RNA, 64 nt, hsa
cacaccaucaaugauccagagcaacacagccaaaagcuggaaucgcccuuauuuccacccucac

SEQ ID NO: 266299 - RNA, 64 nt, hsa
ggucccggugagauggagugggucacaccuggcaagcuggaagaaaguucccuggggaugggag

SEQ ID NO: 266300 - RNA, 64 nt, hsa
ugcugugaccuccgagcccuccuggugggaagacagcuggaaaggcugggaggagaagggaggg

SEQ ID NO: 266301 - RNA, 64 nt, hsa
gucaaggauaaaacaagcacgcgcacaaucaaggagcuggaacacacucuccaggccgucaaau

SEQ ID NO: 266302 - RNA, 64 nt, hsa
augauuugacaguguccaaacugagacauucuggagcuggaaagccugucacacuagagugugu

SEQ ID NO: 266303 - RNA, 64 nt, hsa
cuuacuuuuagugacuuuauguacuuauauuaacagcuggaaauagguuguuggguuuugagca

SEQ ID NO: 266304 - RNA, 64 nt, hsa
cugcuuccacuuacaggagagcugauaauuuguuagcuggaaccuauucacuuccgagauucag

SEQ ID NO: 266305 - RNA, 64 nt, hsa
ucaggagagucacagggcuugacaccugacucugagcuggaacaguaggggcagggagaagaca

SEQ ID NO: 266306 - RNA, 64 nt, hsa
ucuacuugaucuggagggcauugacaccuggcucagcuggaacaguggggacaggaggaggcag

SEQ ID NO: 266307 - RNA, 64 nt, hsa
uagacgucugucaaaaauccgacaaauaaaauuuagcuggaacgaaggcagccuggaauguguu

SEQ ID NO: 266308 - RNA, 64 nt, hsa
cacuccugcccccugaccagaagacagaauuugaagcuggaaagggaagaccccuuuuccccuc

SEQ ID NO: 266309 - RNA, 64 nt, hsa
accaggccaugggacuuugggggcagugagagagagcuggaaaggggcaacccugagcagcagg

SEQ ID NO: 266310 - RNA, 64 nt, hsa
accucaaagaugcccccuguccaagccaucccacagcuggaagguaggggaugggggugcccac

SEQ ID NO: 266311 - RNA, 64 nt, hsa
auucccuucguccugcccaagggcgggacugaagagcuggaagaaagcagucaguacccuccca

SEQ ID NO: 266312 - RNA, 64 nt, hsa
uguuuccauccuagaagcagucccaugugcuucuagcuggaaggagcuuucucuucuuuacauu

SEQ ID NO: 266313 - RNA, 64 nt, hsa
agagcaagccuguguguggggaugucaggucaggagcuggaaguucaccugcaggugccaaaga

SEQ ID NO: 266314 - RNA, 64 nt, hsa
caggcugugcuuggaucaugcucgucugcccucaagcuggaaaacaaggggcuaccuaccgaga

SEQ ID NO: 266315 - RNA, 64 nt, hsa
gaagaccagcaggggcuuccuaaaaagcagcagcagcuggaauuccaaggccaaguccugcagg

SEQ ID NO: 266316 - RNA, 64 nt, hsa
cuguugcuaugacaacagggagaaccccaucuccagcuggaacgugaagguaauggcuccucuc

SEQ ID NO: 266317 - RNA, 64 nt, hsa
aaacuugcucaacuaauccuuaaaaauaaacuugagcuggaauuugaggcuugccuggacuaca

SEQ ID NO: 266318 - RNA, 64 nt, hsa
uucaagccaucccuccugccucagccuccccaguagcuggaacuacaggugugugccaucacac

SEQ ID NO: 266319 - RNA, 64 nt, hsa
uagcaauuccccuacaucaaaugcucaagcccccagcuggaaguuaagagaaagucaccugccc

SEQ ID NO: 266320 - RNA, 64 nt, hsa
agaaggcacuaagcuuccugggccccucacccccagcuggaaauuaagaaaaagucgcccgaaa

SEQ ID NO: 266321 - RNA, 64 nt, hsa
gcacggaguguggaagggggucuaggagagggagagcuggaaaaggagcugauggggucuuauc

SEQ ID NO: 266322 - RNA, 64 nt, hsa
acuuucuuucucccuauguggaagacaccagauuagcuggaauucugccaccuuccuuugugcc

SEQ ID NO: 266323 - RNA, 64 nt, hsa
gaggggaggaagaaaguuguuuucagcauaguaaagcuggaaggccaggugcagugucucaccc

SEQ ID NO: 266324 - RNA, 64 nt, hsa
aagcacuucaucggagacuuccugccuccagacgagcuggaaaaguuuauggagaccuucaagg

SEQ ID NO: 266325 - RNA, 64 nt, hsa
guccugaguaaauguguucuguauaaacaaaugcagcuggaaucgcucaagaaucuuauuuuuc

SEQ ID NO: 266326 - RNA, 64 nt, hsa
gaauggaaauucuuaaagggaaugaugugauucaagcuggaaagaggguugggagaaacagcuu

SEQ ID NO: 266327 - RNA, 64 nt, hsa
acgacugagccuuccugccuccagccuggcuucuagcuggaagccagcccagcguuucucuacc

SEQ ID NO: 266328 - RNA, 64 nt, hsa
ucugugaaccaccuuuuccagccagaguucccaaagcuggaacgcuagcugccugcucuuccuu

SEQ ID NO: 266329 - RNA, 64 nt, hsa
caaaguauuuaaauuuccuagguuuucaugaaaaagcuggaaagcgaucagcaucaagggcuuu

SEQ ID NO: 266330 - RNA, 64 nt, hsa
cuggacugggcuaaauuuaguuuucccacuguuaagcuggaaugaggacugucccaacaacagu

SEQ ID NO: 266331 - RNA, 64 nt, hsa
ugugaggagccccaucugucuaaagauagagucauugcuguaggaucuaaggcuguuugcuuca

SEQ ID NO: 266332 - RNA, 64 nt, hsa
cugugcauucuccuggaugcuuagagggauuucuuugcuguaagaugucuguuugcugaugguc

SEQ ID NO: 266333 - RNA, 64 nt, hsa
cacaggucagcuccugauccuugccgacuugauguugcuguaccagggcuuccuccccagaggu

SEQ ID NO: 266334 - RNA, 64 nt, hsa
ggaauacgagcuucuggguauguuucguuucccauugcuguagcauuucuuauccccugagagc

SEQ ID NO: 266335 - RNA, 64 nt, hsa
agcugggugucacuuggcucugaacauacuggcuuugcuguaaugcuugaaaaggcguugguau

SEQ ID NO: 266336 - RNA, 64 nt, hsa
acugaagaauguacacuuuuuuagagggcacauuuugcuguaaaucuggaaauuugauagacuu

SEQ ID NO: 266337 - RNA, 64 nt, hsa
cguggaacguuuuuccuguucuuaagacgugauuuugcuguagaagauggcacuuauaaccaaa

SEQ ID NO: 266338 - RNA, 64 nt, hsa
ugugucuaggcaggaccuguggccaaguucuuaguugcuguaugucucgugguaggacuguaga

SEQ ID NO: 266339 - RNA, 64 nt, hsa
aguauguucuaaauauuugucugcuguagucuauuugcuguauaugcugaaauuuuuguaugcc

SEQ ID NO: 266340 - RNA, 64 nt, hsa
uuagaugacucuuauuccuguaguaauauucaauuugcuguaccugcuuggugguuagaaggag

SEQ ID NO: 266341 - RNA, 64 nt, hsa
cuguagcuauaguuguuaugugauuguuuuuuaauugcuguaggauccuguucuuucagcaggu

SEQ ID NO: 266342 - RNA, 64 nt, hsa
uaugcuuauuuuauuauuacugcaguaguugacuuugcuguauggaaaaauaaagugaaauugc

SEQ ID NO: 266343 - RNA, 64 nt, hsa
augcuguuuguaaccaugcaucuguuuucauucuuugcuguaccuuuugcugcccauccuguua

SEQ ID NO: 266344 - RNA, 64 nt, hsa
ccucuugucuugaaacaguuugaguaagaaagucuugcuguaaaugcugcccucugccgccuuu

SEQ ID NO: 266345 - RNA, 64 nt, hsa
uuggaguaggcacugcauagcagauaccauugaauugcuguaaaaauaggauggcgaguuugug

SEQ ID NO: 266346 - RNA, 64 nt, hsa
caugugauaugaaaagaagcaugaauaauuuuuuuugcuguaaguuacaucaugcgcaguggaa

SEQ ID NO: 266347 - RNA, 64 nt, hsa
uucuuuguauucuucuucgucuauauuugucaguuugcuguacauguacuccaagcugcaggau

SEQ ID NO: 266348 - RNA, 64 nt, hsa
aaaucauuuguaauagcauagugcuuuuuacucauugcuguaucuuuuucugaaaacacuguug

SEQ ID NO: 266349 - RNA, 64 nt, hsa
agacagagaagguucuucuuauuuugugggcugguugcuguagaaacacauaacaaagggcagc

SEQ ID NO: 266350 - RNA, 64 nt, hsa
gcaacucgaacugcuuucguccauguuucucacauugcuguauuuuagaaaauagggguuaaga

SEQ ID NO: 266351 - RNA, 64 nt, hsa
cccucaaagggagagaaaagcuggaccuuuucccuugcuguaccauauucagcauuugauuucc

SEQ ID NO: 266352 - RNA, 64 nt, hsa
uacagcacauauaaaauauguaaacaccagccuguugcuguacuuuucugcuuauuuuacagcc

SEQ ID NO: 266353 - RNA, 64 nt, hsa
gaaaugagaaguauuauaauguaaaggccuuguuuugcuguagcaauaaaaugaccaagugcaa

SEQ ID NO: 266354 - RNA, 64 nt, hsa
uauagauguacaguuuugcuuuaaccacugaagauugcuguaaauuauaaagggugugauagaa

SEQ ID NO: 266355 - RNA, 64 nt, hsa
gagucuuauuuuuauuuauagaaauguggaaagcuugcuguaauucauauuugaaguccuaguc

SEQ ID NO: 266356 - RNA, 64 nt, hsa
cugagaucagugccuauggguuguuaauacuauauugcuguaugguauaugcaugcugauuuac

SEQ ID NO: 266357 - RNA, 64 nt, hsa
cugagaucagugccucuggguuguuaauacuguauugcuguaugguauauguaugcugauuuac

SEQ ID NO: 266358 - RNA, 64 nt, hsa
gaaaaucgaugacaacaguccucuuacagauagcuugcuguauucuguauagcuuacucuaccu

SEQ ID NO: 266359 - RNA, 64 nt, hsa
aaagaaugacaaaggaggcacucguucucuuuucuugcuguaugccuagaaagugguugaagga

SEQ ID NO: 266360 - RNA, 64 nt, hsa
uuacuagcaugcuaugcugcaugcuuuacugccauugcuguaugcuuuacugucuuuguaaaaa

SEQ ID NO: 266361 - RNA, 64 nt, hsa
uguauaggugagacucuguuucuguuauuuuuaauugcuguaugaaaugugaucagauuauuuu

SEQ ID NO: 266362 - RNA, 64 nt, hsa
cauuguauguaccuuuauugcuucuuaaggguccuugcuguauagacaguccugcuucagaagu

SEQ ID NO: 266363 - RNA, 64 nt, hsa
cuguuuacagaagacucacucaccaggauaaacauugcuguauguuacaguaaagcuaucugga

SEQ ID NO: 266364 - RNA, 64 nt, hsa
guucgguuuuauuuacaguugcuuuuacaaauauuugcuguaacauuugacuucuaagguuuag

SEQ ID NO: 266365 - RNA, 64 nt, hsa
auucgaagcuuuuggucuauauuguuaauugccauugcuguaaaucuuaaaaugaaugaauaaa

SEQ ID NO: 266366 - RNA, 64 nt, hsa
aguuugacucccuuauacuguggacgcaguagccuugcuguagggaguugaagaguacuccaca

SEQ ID NO: 266367 - RNA, 64 nt, hsa
uguuacuuaauguagcucaauccaucuucuguaauugcuguauagauugucaucauaugauuac

SEQ ID NO: 266368 - RNA, 64 nt, hsa; identical to SEQ ID NO: 53273

SEQ ID NO: 266369 - RNA, 64 nt, hsa; identical to SEQ ID NO: 53274

SEQ ID NO: 266370 - RNA, 64 nt, hsa; identical to SEQ ID NO: 53275

SEQ ID NO: 266371 - RNA, 64 nt, hsa; identical to SEQ ID NO: 53276

SEQ ID NO: 266372 - RNA, 64 nt, hsa; identical to SEQ ID NO: 53277

SEQ ID NO: 266373 - RNA, 64 nt, hsa; identical to SEQ ID NO: 53278

SEQ ID NO: 266374 - RNA, 64 nt, hsa; identical to SEQ ID NO: 53279

SEQ ID NO: 266375 - RNA, 64 nt, hsa; identical to SEQ ID NO: 53280

SEQ ID NO: 266376 - RNA, 64 nt, hsa; identical to SEQ ID NO: 53281

SEQ ID NO: 266377 - RNA, 64 nt, hsa; identical to SEQ ID NO: 53282

SEQ ID NO: 266378 - RNA, 64 nt, hsa; identical to SEQ ID NO: 53283

SEQ ID NO: 266379 - RNA, 64 nt, hsa; identical to SEQ ID NO: 53284

SEQ ID NO: 266380 - RNA, 64 nt, hsa; identical to SEQ ID NO: 53285

SEQ ID NO: 266381 - RNA, 64 nt, hsa; identical to SEQ ID NO: 53286

SEQ ID NO: 266382 - RNA, 64 nt, hsa; identical to SEQ ID NO: 53287

SEQ ID NO: 266383 - RNA, 64 nt, hsa; identical to SEQ ID NO: 53288

SEQ ID NO: 266384 - RNA, 64 nt, hsa; identical to SEQ ID NO: 53289

SEQ ID NO: 266385 - RNA, 64 nt, hsa; identical to SEQ ID NO: 53290

SEQ ID NO: 266386 - RNA, 64 nt, hsa
gagaacagaagggcgucgggggaaccugccgcaaggagcagagacagcacagccccccgggccc

SEQ ID NO: 266387 - RNA, 64 nt, hsa
ggacggauggagcccucagcgugucuuuucagcaggagcagaaccgaugagagccgcccuuacc

SEQ ID NO: 266388 - RNA, 64 nt, hsa
cagauacagccccaaaccagggugcauggcuuggggagcagaguauaggauggauugcaguccc

SEQ ID NO: 266389 - RNA, 64 nt, hsa
aagagaagcugagaagaagcugaggauccucacaggagcagacagagaaaugugaagggugggg

SEQ ID NO: 266390 - RNA, 64 nt, hsa
ccacaguccuuccuggggcauuccaggcagagaaggagcagaggcucucccggcaggagcuggg

SEQ ID NO: 266391 - RNA, 64 nt, hsa
ccccucagaacuggcuugaucaagggccuuauguggagcagagguugucucugaaccaggagag

SEQ ID NO: 266392 - RNA, 64 nt, hsa
agugauagaaguucagaaagcucaccaaggucaaggagcagaucuucuaggaguagaucuuauu

SEQ ID NO: 266393 - RNA, 64 nt, hsa
uuuaauuguagaucaagaagcuacucuagaagucggagcagaggaugguacagcagaggccgaa

SEQ ID NO: 266394 - RNA, 64 nt, hsa
uaccggaguuacaaaagucacaggacguccagcaggagcagauccaggagcagcucauaugauc

SEQ ID NO: 266395 - RNA, 64 nt, hsa
aauggugcuggguggagaauggagagagcaugauggagcagagucccagucacugaccaacuaa

SEQ ID NO: 266396 - RNA, 64 nt, hsa
gucugagugcacgaaaauuucucucuugccuugaggagcagaaaagcuucugauggacaugggc

SEQ ID NO: 266397 - RNA, 64 nt, hsa
uguauuaaauagccaugagcuucacugcuuagagggagcagaaaggucaacaucuaaaagcacc

SEQ ID NO: 266398 - RNA, 64 nt, hsa
aaagaggaggagaaacagggugagucaagguaaaggagcagaaauguaguuacaagccaggucg

SEQ ID NO: 266399 - RNA, 64 nt, hsa
cauuccccacaucccacugagcaugggaccauugggagcagagcugauauuaaagcauguuuag

SEQ ID NO: 266400 - RNA, 64 nt, hsa
auccccaaaagucuuggccuaaaccaucccuaggggagcagauuaaccuaccacuacauugcac

SEQ ID NO: 266401 - RNA, 64 nt, hsa
agaaacgcacacaagguuugcccaugagaauuggggagcagauggccaagcagauagguuaugu

SEQ ID NO: 266402 - RNA, 64 nt, hsa
acuucuuggguaaucugaccugaagcauaguccaggagcagaguuagccagaaaugccuccugc

SEQ ID NO: 266403 - RNA, 64 nt, hsa
auggucuguuaaacagggcuggcaucagguagagggagcagaguggugaccugauagcuccugu

SEQ ID NO: 266404 - RNA, 64 nt, hsa
cugcaccauugcugaaaugaaagaugacucugggggagcagagcuuggccuugugcccagcugg

SEQ ID NO: 266405 - RNA, 64 nt, hsa
auugagaugaauuuugguguugaaaguucuuccuggagcagauguccuagaagguuuuaggaau

SEQ ID NO: 266406 - RNA, 64 nt, hsa
cuuggcuagagaacucacagcucugggaaaaagaggagcagacaggguucccugggcccagucu

SEQ ID NO: 266407 - RNA, 64 nt, hsa
auaauuuucagauuuuuuuccccuagauuuugagggagcagagaaacuggaaaaaacuuuaguc

SEQ ID NO: 266408 - RNA, 64 nt, hsa
gcucaacugaauaagaggcuuaagaggauaaacuggagcagaaauaagccuuaggugcugccca

SEQ ID NO: 266409 - RNA, 64 nt, hsa
ccucacacugacacuuuguccccacaugggguggggagcagagugcccgccccguggagauacc

SEQ ID NO: 266410 - RNA, 64 nt, hsa
ccgccuccgcaggaacccccaaagugcagauuccggagcagacacauccgggcggagagacuca

SEQ ID NO: 266411 - RNA, 64 nt, hsa
aggaaaagacacugaggucuagaaauagcuccguggagcagaaucaguauugggagccgguggc

SEQ ID NO: 266412 - RNA, 64 nt, hsa
gcaccagagcacgugauggucugagacucucuuaggagcagagcucugccgcaauggccaugug

SEQ ID NO: 266413 - RNA, 64 nt, hsa
cgucuggcuggcuggccagccugugggucuguugggagcagaugugcucacugacguuugugcc

SEQ ID NO: 266414 - RNA, 64 nt, hsa
gccccaucaccggccuucuccuggcaggagaggaggagcagagagcuggguccugggcugggau

SEQ ID NO: 266415 - RNA, 64 nt, hsa
uuauaggaagacauaauuccagugccuuuaugguggagcagaauucgacaacacauguccauuc

SEQ ID NO: 266416 - RNA, 64 nt, hsa
ucccuccuccccacguaccauugcgcgugcagcuggagcagaauacccucauuuuuaggaaucu

SEQ ID NO: 266417 - RNA, 64 nt, hsa
uaggggaacaguucuagggagugagacauuuuugggagcagaggaaaacucugcugauguucgg

SEQ ID NO: 266418 - RNA, 64 nt, hsa
caucuugagaaauccuccuugguaucaugaaacuggagcagaggaauugcaauuuagcaggagg

SEQ ID NO: 266419 - RNA, 64 nt, hsa
gagccugcggcccgggccagcccgggcuuucuccggagcagagcagcgcugcuggccuggcagc

SEQ ID NO: 266420 - RNA, 64 nt, hsa
ggcaguucccaguccugugggcucggcuaucuggggagcagauuuugggucuggaucucccugg

SEQ ID NO: 266421 - RNA, 64 nt, hsa
gccggcauguuuuggggguaaugaucgugggcagggagcagagguccgcugaggcagucugucc

SEQ ID NO: 266422 - RNA, 64 nt, hsa
aagagagggcuuauaaaucccucugccgacgcagggagcagagacuugccggcauguuuugggg

SEQ ID NO: 266423 - RNA, 64 nt, hsa
ggauagagaaggaucugcuccgccuuuggccacaggagcagaggcagaccugggaugccccagu

SEQ ID NO: 266424 - RNA, 64 nt, hsa
guaggguccuaacagugcuccuuguccaucccuuggagcagauuuugucuguggauggagacag

SEQ ID NO: 266425 - RNA, 64 nt, hsa
agacguaggaaacucaauauucuucucuaaccauauacgauagggcucuucgcuuuuaaugaua

SEQ ID NO: 266426 - RNA, 64 nt, hsa
ccacuugauggaguagaucugucacauuacuaagauacgauauuucuuuuuuuuuccgagacgg

SEQ ID NO: 266427 - RNA, 64 nt, hsa
cuccagcuaacacagauguaaaagacuuuuuuuuauacgauaaauaacuuuuuuuuaaguuaca

SEQ ID NO: 266428 - RNA, 64 nt, hsa
cacaguacauuaacaauccaugccaacggugcuaauacgauaggcugaaugucugaggcuacca

SEQ ID NO: 266429 - RNA, 64 nt, hsa
uuccaauuauuuaaccaguuacuuccaccuggacauacgauaggaaauucaaacucaaaauaug

SEQ ID NO: 266430 - RNA, 64 nt, hsa
uugagaauguacuacgguacuucccucccacaccauacgauaaagcaagacauuuuauaacgau

SEQ ID NO: 266431 - RNA, 64 nt, hsa
caugucagguccggaggggagguauuaagaauagauacgauauuacaccauuuccuauaggagu

SEQ ID NO: 266432 - RNA, 64 nt, hsa
aaacauaagaaaaacauuuaaaccuaugcugaaaauacgauaaaagaaaaacaacuccaauaug

SEQ ID NO: 266433 - RNA, 64 nt, hsa
cugccuggaaggggccgcgcguguguucaugccuauacgauaaacaugauacauaaugaaaaug

SEQ ID NO: 266434 - RNA, 64 nt, hsa
cgacauugggacaugcugcucaagguaguuauauauacgauaaguuguauauaugaucacuggu

SEQ ID NO: 266435 - RNA, 64 nt, hsa
cugaacaucacuccaauuauuaaugaaccaaaucauacgauaaguuacuguuugcauugaaaua

SEQ ID NO: 266436 - RNA, 64 nt, hsa
cucauccugccuuagugugcaaucucauuugacuauacgauaaaguuugcacagucuuacuucu

SEQ ID NO: 266437 - RNA, 64 nt, hsa
aaccuuguagcaugugaagaaugucuguaccuugauacgauaguuacauaaucaguauauuugg

SEQ ID NO: 266438 - RNA, 64 nt, hsa
cgcugccagggcuggagccggggcaauguugcaaauacgauaaccuuaacaaaguucuuccccu

SEQ ID NO: 266439 - RNA, 64 nt, hsa
uuaaaaauucuuacuaaggaauaaaaacuuuaauauacgauaugauauugucuaauaauuaaaa

SEQ ID NO: 266440 - RNA, 64 nt, hsa
ucuaaccuauuugaauacgcuuuuccuuaaagugauacgauaauauuacucuugauugcugcug

SEQ ID NO: 266441 - RNA, 64 nt, hsa
acuaauauccaugacauucaguggccuugugcaaauacgauauguugcuuaggcauaucuuuug

SEQ ID NO: 266442 - RNA, 64 nt, hsa
auagaacaagcugcacaaccuggauuuuuuuucaauacgauacugagccauuugcugcauuucu

SEQ ID NO: 266443 - RNA, 64 nt, hsa
uuggguuugcugcucccugaagcuggauucuuucauacgauacucuuucucaagaagggggcuc

SEQ ID NO: 266444 - RNA, 64 nt, hsa
uuacaccuuauccacauagccugaggguaauuuuauacgauauuuuaaauaguuguguacauga

SEQ ID NO: 266445 - RNA, 64 nt, hsa
aaaggcuuuaacuaguccucaguucuuaacacacauacgauaauucuuacugcagagaaacucu

SEQ ID NO: 266446 - RNA, 64 nt, hsa
ugucugguagugaagacaagcaaguggagaaguuauacgauauaguuuaaugagaguuaaaaaa

SEQ ID NO: 266447 - RNA, 64 nt, hsa; identical to SEQ ID NO: 80183

SEQ ID NO: 266448 - RNA, 64 nt, hsa; identical to SEQ ID NO: 80184

SEQ ID NO: 266449 - RNA, 64 nt, hsa; identical to SEQ ID NO: 80185

SEQ ID NO: 266450 - RNA, 64 nt, hsa; identical to SEQ ID NO: 80186

SEQ ID NO: 266451 - RNA, 64 nt, hsa; identical to SEQ ID NO: 80187

SEQ ID NO: 266452 - RNA, 64 nt, hsa; identical to SEQ ID NO: 80188

SEQ ID NO: 266453 - RNA, 64 nt, hsa; identical to SEQ ID NO: 80189

SEQ ID NO: 266454 - RNA, 64 nt, hsa; identical to SEQ ID NO: 80190

SEQ ID NO: 266455 - RNA, 64 nt, hsa; identical to SEQ ID NO: 80191

SEQ ID NO: 266456 - RNA, 64 nt, hsa; identical to SEQ ID NO: 80192

SEQ ID NO: 266457 - RNA, 64 nt, hsa; identical to SEQ ID NO: 80193

SEQ ID NO: 266458 - RNA, 64 nt, hsa; identical to SEQ ID NO: 80194

SEQ ID NO: 266459 - RNA, 64 nt, hsa; identical to SEQ ID NO: 80195

SEQ ID NO: 266460 - RNA, 64 nt, hsa; identical to SEQ ID NO: 80196

SEQ ID NO: 266461 - RNA, 64 nt, hsa; identical to SEQ ID NO: 80197

SEQ ID NO: 266462 - RNA, 64 nt, hsa; identical to SEQ ID NO: 80198

SEQ ID NO: 266463 - RNA, 64 nt, hsa
gugagcaucuuagcuuagcaccaaccaacacagucucaccuagaaaacagauggaagcuucguu

SEQ ID NO: 266464 - RNA, 64 nt, hsa
gguggcuggcaagaaggaagcaguucuccacguucucaccuaagcccagagcaaggaacaggua

SEQ ID NO: 266465 - RNA, 64 nt, hsa
cugcacugacagccugaagggucuacacccucggcucaccuaagugcccugugcugguugccag

SEQ ID NO: 266466 - RNA, 64 nt, hsa
gaccacaggguucaaaaugucuguagcuccucaacucaccuaauguuuaugagccagacaaaug

SEQ ID NO: 266467 - RNA, 64 nt, hsa
ugguaggaauauuauucccaagaaauacccgcuccucaccuacucccucauccuaccaaggugc

SEQ ID NO: 266468 - RNA, 64 nt, hsa
guucugcugaagaguugucaucaacaauccaaugcucaccuauucaguugcucuguggucagug

SEQ ID NO: 266469 - RNA, 64 nt, hsa
agaguugggcagugaaauuaccuuuugcucaaggcucaccuagauggguacaauaaaaagaaca

SEQ ID NO: 266470 - RNA, 64 nt, hsa
gcggagaguggcagacuuucuucuccuuuucccucucaccuaaaugucaacuugucauugaaug

SEQ ID NO: 266471 - RNA, 64 nt, hsa
cucccaaagugcugggauuacagacacgagccaccucaccuagccugaugagauuuuuaaaaaa

SEQ ID NO: 266472 - RNA, 64 nt, hsa
ugaaaauauucuguuugugaauucagacuaugagcucaccuacaaccuagagaagguaagaugg

SEQ ID NO: 266473 - RNA, 64 nt, hsa
aaaauucccagauaauuaacuagcuauuacagaucucaccuagaggguugauguuaugaagacu

SEQ ID NO: 266474 - RNA, 64 nt, hsa
gugcuggguugagaggucagggcacuuucaaucccucaccuaguccugcugcacagggcaggag

SEQ ID NO: 266475 - RNA, 64 nt, hsa
agaaaucagcaccugcguuuuagagaucauaauucucaccuacuucugagcuuauuuuuccauu

SEQ ID NO: 266476 - RNA, 64 nt, hsa
gugagcccugaauuugcuuccucugacaaguuaccucaccuaauuuuugcuucucaggaaugag

SEQ ID NO: 266477 - RNA, 64 nt, hsa
ccuggccccagggaggagcacauuuuucuugacccucaccuaccuggugcuaguuggucaaccc

SEQ ID NO: 266478 - RNA, 64 nt, hsa
cagccccagcagccauggguacauggguccccagcucaccuauggauucccgccagucugccca

SEQ ID NO: 266479 - RNA, 64 nt, hsa
uauuuacagaacaugcauccuuaaacugugacuucucaccuagugcagaacuuuuaccaggcug

SEQ ID NO: 266480 - RNA, 64 nt, hsa
uaaauaauauuauauuguauuuaacccauuauuccucaccuacccucaaaguagguauacaaaa

SEQ ID NO: 266481 - RNA, 64 nt, hsa
cuuagcuaaucugaccaaauguugggaaaaaugucucaccuaacccacuauuccuuaauuaugg

SEQ ID NO: 266482 - RNA, 64 nt, hsa
uuauagaaauaaagaaaugggugacaggcuuaaccucaccuaugaauguacaguauguggauuu

SEQ ID NO: 266483 - RNA, 64 nt, hsa
aucuaacuccauacugaacaaggggcuuuauguccucaccuaugaccuggaauaguuuaaauau

SEQ ID NO: 266484 - RNA, 64 nt, hsa
aauuaaugguacuccuauaauuuuugauugugagcucaccuauuuggguuaagcaugccaauuu

SEQ ID NO: 266485 - RNA, 64 nt, hsa
uaggugaagcagaagcaaacccugcucuuaggggcucaccuaggugagugcacagccugugacg

SEQ ID NO: 266486 - RNA, 64 nt, hsa
gguauuugcaauauuccuuugggccucugcuucucucaccuaaaaaaagagaauuagauuauau

SEQ ID NO: 266487 - RNA, 64 nt, hsa
ucucuuaaaaguauggaugcuucauccaaaucgccucaccuacagcagggaaguugacucaucc

SEQ ID NO: 266488 - RNA, 64 nt, hsa
gaucagaagaucuggccaugcuggggcucacauucucaccuagcaacaacuggcuggagcuggg

SEQ ID NO: 266489 - RNA, 64 nt, hsa
aaugcauuauuuccugaggcaagaacuuaagguccucaccuaauuccuccaucacaaccauuaa

SEQ ID NO: 266490 - RNA, 64 nt, hsa
agauccacaugaacgcacgccugagauuuggccacucaccuauguuuuggguggauugccuagg

SEQ ID NO: 266491 - RNA, 64 nt, hsa
ucgcagcagcuggggaggagccaaagccucggcgcucaccuaagccgcagggagauacacccaa

SEQ ID NO: 266492 - RNA, 64 nt, hsa
cugaugccuccccauuauguaacacccaaccgcucucaccuacacccugaggucuauucacugc

SEQ ID NO: 266493 - RNA, 64 nt, hsa
augaacggaauaccugcuagguuccaggaaugagcucaccuaacagauagcaaaugugucuggu

SEQ ID NO: 266494 - RNA, 64 nt, hsa
aguuuuuccagagcuggaggucacguuucuaaaacucaccuacgaaagauagcauuaaaggaac

SEQ ID NO: 266495 - RNA, 64 nt, hsa
uuuuucugaaagcuacccauaaaaucacuuucaucucaccuaccugaugcaaagcaggugaaac

SEQ ID NO: 266496 - RNA, 64 nt, hsa
ugucagaucccuucuuugucuuacuaguuaaauccucaccuaaucucuuggguaugaauauaaa

SEQ ID NO: 266497 - RNA, 64 nt, hsa
uggugugugcuuggaugggaaagaaaaggcuccacucaccuauaggagauuauuuuuaagugga

SEQ ID NO: 266498 - RNA, 64 nt, hsa
cccagucaccaagggccccagcuggcccguucuacucaccuaagugccgccugacccuuguaca

SEQ ID NO: 266499 - RNA, 64 nt, hsa
uaaagaacccuccuggccuccagcucagccuucucucaccuacuaugucuguccaacaggucug

SEQ ID NO: 266500 - RNA, 64 nt, hsa
uguacguuaccuccaucuauuuuaggauauuuuccucaccuauauauuauagggagaauaauuu

SEQ ID NO: 266501 - RNA, 64 nt, hsa
agagcaagaguugauagagcuuuuacaaucaauacucaccuaauucugauaaaaggaauacugc

SEQ ID NO: 266502 - RNA, 64 nt, hsa
guucuggccagaaugcugcaggacuugagaagaccucaccuagaaauugacacaaguggaccuu

SEQ ID NO: 266503 - RNA, 64 nt, hsa
cacacaccggcacuuucauacccugaccucugaccucaccuacagcugggauguaccuggagag

SEQ ID NO: 266504 - RNA, 64 nt, hsa
acagugcugcagcucccuggcuucuguggggccccucaccuacuuacccaggugggucccggcu

SEQ ID NO: 266505 - RNA, 64 nt, hsa
ggauauuuugauucuaaauaugauaaaauaauuucucaccuauuuugugugugugacuugaaau

SEQ ID NO: 266506 - RNA, 64 nt, hsa
uacuauaaauuucauccaacuacuugugaucucucucaccuacaucaauuauguauguuaauuu

SEQ ID NO: 266507 - RNA, 64 nt, hsa
gguuuagaggcuaaaauuguguugaugcuguuuacucaccuaauuacauaguuuuaaucauuug

SEQ ID NO: 266508 - RNA, 64 nt, hsa
ccugggcgcuuguuagaaucaaagacucucaggccucaccuagacauccagaaucaaaaucugc

SEQ ID NO: 266509 - RNA, 64 nt, hsa
ccuauacauuuuucccacguuuccaacagcacuucucaccuauucaauaacugaaaaagacauu

SEQ ID NO: 266510 - RNA, 64 nt, hsa
aauuaauuggacgggagacagagugacgcacugacucaccuagaggcuggaacguggguaggga

SEQ ID NO: 266511 - RNA, 64 nt, hsa
cccucacugggacuuuguaaacuuccaagucauucucaccuaaacccucugugaaauuuguaau

SEQ ID NO: 266512 - RNA, 64 nt, hsa
uuuuuuaugaaauauuucuuuuaaaagccccagucucaccuacgaaauaugaagagcaaaagcu

SEQ ID NO: 266513 - RNA, 64 nt, hsa
gccaaacugcuauaagaucgaaguuuguuuuuuucucaccuaauaauagagagguaaucagaug

SEQ ID NO: 266514 - RNA, 64 nt, hsa
uuugcaagucuuaacuuaccugugcuucaguuuccucaccuauaaaauugugauaauaauaaug

SEQ ID NO: 266515 - RNA, 64 nt, hsa
ugucuugauauugaaaaguguaauaaacuucaugcucaccuauuggagauuugggaagguugaa

SEQ ID NO: 266516 - RNA, 64 nt, hsa
gcaccugcucagcccugugucggcuuccugugugcucaccuaaagcugugguuuugcuguguuc

SEQ ID NO: 266517 - RNA, 64 nt, hsa
cuucacucuuuuuuuuucuuuuuugagacagagucucaccuauugcccagacugaagugcagug

SEQ ID NO: 266518 - RNA, 64 nt, hsa
aggccgugcaccuccaccuccagccuccagucaccucaccuagcucacugcucucucuccugca

SEQ ID NO: 266519 - RNA, 64 nt, hsa
gaagcgaaucaugcaugcaauuagcucccuccuccucaccuacuccacucccaucuuuaugaca

SEQ ID NO: 266520 - RNA, 64 nt, hsa
uaaaagaaauacucaggaauugucucauaaaguccucaccuacuggcaaaaacaagauguucua

SEQ ID NO: 266521 - RNA, 64 nt, hsa
uuuuuuaguucuguauguauuuuagcaaucucaucucaccuaacugagauguguuucaauuaua

SEQ ID NO: 266522 - RNA, 64 nt, hsa
ccuggcacauuuuggaguguccuggcuaccagcucucaccuacacccacgcacccccccacaca

SEQ ID NO: 266523 - RNA, 64 nt, hsa
gaggggcgcagagcagauccaggccccagaaagccucaccuacagacagcugugguccucugau

SEQ ID NO: 266524 - RNA, 64 nt, hsa
aauauuuaaugcuaaaugcuuugcuacauuguaacucaccuaaaaccuuuuagugacaaaaucc

SEQ ID NO: 266525 - RNA, 64 nt, hsa
uaugugugucccaaggaaaucccuguaaauuuaacucaccuacaaaaggcuuuuuccccgccuu

SEQ ID NO: 266526 - RNA, 64 nt, hsa
agguaauggcacacauauucaugcacaagaagcacucaccuagagcugucugugccucucuggg

SEQ ID NO: 266527 - RNA, 64 nt, hsa
aaauguucuugguguuugacuguaauguaacuaucucaccuaaugguuguacauauccuuuggu

SEQ ID NO: 266528 - RNA, 64 nt, hsa
uaguggugcguuaguggcauuaucuauaaauacacucaccuaaauugaaagcuaagaaggaaau

SEQ ID NO: 266529 - RNA, 64 nt, hsa
aaccucaaccguuaaagcagaugcaaaaauucaccucaccuaaauugaacuucuugcauauuuc

SEQ ID NO: 266530 - RNA, 64 nt, hsa
aaagaccucaauuacgagaggcauagugaccugccucaccuaauccucacccuugcugcuccug

SEQ ID NO: 266531 - RNA, 64 nt, hsa
uacaauaaauaugaauaaauguuauauaaggaaacucaccuauuugaaaucauggcuauauugu

SEQ ID NO: 266532 - RNA, 64 nt, hsa
cuggccuagccuggagcccaggaccuaaguccaccucaccuagagccuggaauuaggaucccag

SEQ ID NO: 266533 - RNA, 64 nt, hsa
gcugaaaaaauugauuauuuuuauuagauaauuucucaccuauagacuuaaacugucaauuugc

SEQ ID NO: 266534 - RNA, 64 nt, hsa
ugucagcugguuuugauacugaaugugaacaaggcucaccuaaggaaacugacccagaaaacag

SEQ ID NO: 266535 - RNA, 64 nt, hsa
caaggcuugucuagucugcccaaaauuacuuauccucaccuagcuccuaccacucuucuuagag

SEQ ID NO: 266536 - RNA, 64 nt, hsa
uauaaccuuguuuacuuggauuuauaaaagcagacucaccuaauaaaaucaacauucauuguau

SEQ ID NO: 266537 - RNA, 64 nt, hsa
caauaaggaagcuauaucuagagugcuuaugugacucaccuaaggccacucaacaaguuugugg

SEQ ID NO: 266538 - RNA, 64 nt, hsa
accucugcggcagccgacugcaugaaccaaaguucucaccuaaugguaucaucacgcagugcac

SEQ ID NO: 266539 - RNA, 64 nt, hsa
gaacagagcauuuccagcauuuguuguuguuuuacucaccuaacccuuagaaaaugaauguuag

SEQ ID NO: 266540 - RNA, 64 nt, hsa
ucaggccacagacuuguaguaaucauuugaaggccucaccuaguguccccuuggugacguaugc

SEQ ID NO: 266541 - RNA, 64 nt, hsa
guaucaaacaucuaugccccacuucuucucuugccucaccuauuccuuagauucuuggucacuu

SEQ ID NO: 266542 - RNA, 64 nt, hsa
cuggcugugccccuagguggagacagcccucuuucucaccuacccccugccgcacagcccagca

SEQ ID NO: 266543 - RNA, 64 nt, hsa
acccuaacuccaucuccuuucuuuaaagucaaaucucaccuaccuguuugggucagagagaugu

SEQ ID NO: 266544 - RNA, 64 nt, hsa
gagugagcugagacagauaagagaauaccuuggucucaccuauccugcccucacaucuuccacc

SEQ ID NO: 266545 - RNA, 64 nt, hsa
acaugugaaguuauacuguggcuaugcaacagcucucaccuacgcgagucuuacuuugaguuag

SEQ ID NO: 266546 - RNA, 64 nt, hsa
auuuagauucugagcccauaauggcaacagcccccucaccuaugggaagcugacuucccucagu

SEQ ID NO: 266547 - RNA, 64 nt, hsa
ugcauuuuuauuuaaaugaaggaauuccaaauaacucaccuacagauuuuuagcacaaaaauag

SEQ ID NO: 266548 - RNA, 64 nt, hsa
cugguccuggugcuccaggcggggccguggaccccucaccuacauuccauagugggcccguggg

SEQ ID NO: 266549 - RNA, 64 nt, hsa
accaugugagguuaucugaagcacaaggcccacccucaccuaucugucgaccccauuuccuacc

SEQ ID NO: 266550 - RNA, 64 nt, hsa
cucaggaccauccgaucaagcugcagcugccacccucaccuagaaacaugccuuugugcccacc

SEQ ID NO: 266551 - RNA, 64 nt, hsa
aaauaagccagggauuguggcaugcaccuguagucucaccuacuccagaggcugaggugggagg

SEQ ID NO: 266552 - RNA, 64 nt, hsa
agccccuagaaacccaagcuccuccucggaaccgcucaccuagagccagaccaacguuacucag

SEQ ID NO: 266553 - RNA, 64 nt, hsa
cuagguccccaugugaggagaucugcuuucagcccucaccuaagggaggugaggaagaggaaaa

SEQ ID NO: 266554 - RNA, 64 nt, hsa
auccaaucaguuuauacccuaguuaguguuuugccucaccuaauaggcugggagacugaagacu

SEQ ID NO: 266555 - RNA, 64 nt, hsa
ggccaccugaccucacaccugacccugaccccuccucaccuauucucuuccucuauccugaccg

SEQ ID NO: 266556 - RNA, 64 nt, hsa
aaugaaaagguacaacagaauaaugcaugaugaacucaccuaauuaugaggugggaggagcgaa

SEQ ID NO: 266557 - RNA, 64 nt, hsa
gaaugguacacaaugugauuuuauggugaugucacucaccuagacaaccagaggcuggcauuga

SEQ ID NO: 266558 - RNA, 64 nt, hsa
gaaaaagacccaaacaaaucuaacuucuugcuuucucaccuauuugaauuuucuccuaccuaau

SEQ ID NO: 266559 - RNA, 64 nt, hsa
uuauuguguccagagaguacacuuuuucaaaaugcucaccuacuggaagugugaauuacuugac

SEQ ID NO: 266560 - RNA, 64 nt, hsa
ucauggagaggugacaucauacauucacaugcuucucaccuaaguccccaggguccaagggaga

SEQ ID NO: 266561 - RNA, 55 nt, hsa
cugccugcaguccugugugaagccccucaccuaugccaucuccauaagcacccua

SEQ ID NO: 266562 - RNA, 64 nt, hsa
caauuaaugcagcaguugcgauaaauaaaaacaucucaccuaagucuccuuuucuucauaacau

SEQ ID NO: 266563 - RNA, 64 nt, hsa
uguuuauccauuggccaaccugaaggaaaugaaacucaccuaucuuucuaucacagaugaaugu

SEQ ID NO: 266564 - RNA, 64 nt, hsa
ucccauuuuugcccuuaguuaacauuuacuggugcucaccuaggauuggcuauucugagggauu

SEQ ID NO: 266565 - RNA, 64 nt, hsa
cagucagucaaguuccucggagaucugccucugccucaccuaccccagggaacuuccaaggaag

SEQ ID NO: 266566 - RNA, 64 nt, hsa
aaguuggaagaugaacacuugaggacuucagcuucucaccuacuuaguacaguugggaaccaua

SEQ ID NO: 266567 - RNA, 64 nt, hsa
uguuucagagcuucuucccuaagccauaaacugucucaccuaaacaagauagaccucaauaaaa

SEQ ID NO: 266568 - RNA, 64 nt, hsa
aaaagagucucccccuuaaauuuccugguacccccucaccuaugccugaaagcauuucacccuc

SEQ ID NO: 266569 - RNA, 64 nt, hsa
ccgggaacacagacagggugucuacccaagaagccucaccuauccccaacuuagaauuugcuac

SEQ ID NO: 266570 - RNA, 64 nt, hsa
ugacagccugaaaagcaugcagggguuugguccacucaccuacuugaaagccugugggcaacgu

SEQ ID NO: 266571 - RNA, 64 nt, hsa
gcgccggcaugcccaaccucaucagcaccgacuucucaccuaagcugcacuucaaguucgacac

SEQ ID NO: 266572 - RNA, 64 nt, hsa
cucauucugggcccuugcugccaaggagcccagccucaccuagcaggaaaggagaugaaggccc

SEQ ID NO: 266573 - RNA, 64 nt, hsa
uucuucuugauuggcugacacugaaucauaguuucucaccuacauauauccuuagcaccucgua

SEQ ID NO: 266574 - RNA, 64 nt, hsa
ucacgugcgcugcaggaaaagcaaucagucacaacucaccuagcgaccugacuuacucuggaau

SEQ ID NO: 266575 - RNA, 64 nt, hsa
guuucagcugugggcuucuaccaccacuaagccgcucaccuagaguuguuacuuuuuugauggg

SEQ ID NO: 266576 - RNA, 60 nt, hsa
uggccagugugcucaucugagaggcugccgcucaccuaccugcacaucugccacagcugg

SEQ ID NO: 266577 - RNA, 64 nt, hsa
caagaaaugggggcaagggccugccccccacucccucaccuaccuccuuagcauuccuucaggc

SEQ ID NO: 266578 - RNA, 64 nt, hsa
gacaccuuucuuuugggagcucaaagcaagugagcucaccuaccugccaccgcccaggaccagu

SEQ ID NO: 266579 - RNA, 64 nt, hsa
ggugucccagucuggccacagcccugccuccgcccucaccuacaugcccucccagccccuccca

SEQ ID NO: 266580 - RNA, 64 nt, hsa
ccuccccugggcccaucucaaggcugcccccuuccucaccuacuucggacucuuccagguucac

SEQ ID NO: 266581 - RNA, 64 nt, hsa
uuucccuguuaagggggagggccccaggacaccccucaccuacuuucagcuucaaccccaggcc

SEQ ID NO: 266582 - RNA, 64 nt, hsa
ccgcccaccccagcgucuguugguacuuaccugucucaccuacccuccaguccccucccagcuc

SEQ ID NO: 266583 - RNA, 64 nt, hsa
ucauccagguccuuuccuucucgucuuccucucucucaccuacuuccuccuccuccuccuguuc

SEQ ID NO: 266584 - RNA, 64 nt, hsa
ccacuguuugcuucaacaguauauccuaauaagccucaccuauuuaauccaaugaguuuuaaau

SEQ ID NO: 266585 - RNA, 64 nt, hsa
cacggcaacugaagcggcuggaaucagucagccgcucaccuaucuacucccacuuuucggagac

SEQ ID NO: 266586 - RNA, 64 nt, hsa
cuuggcccuuaaccuuuaucuuucuuccuguccucucaccuagauuguaagcucccugggccag

SEQ ID NO: 266587 - RNA, 64 nt, hsa
agaauggggccacagggcagccgggacucccugucucaccuacauuaacccaugcauacuguau

SEQ ID NO: 266588 - RNA, 64 nt, hsa
uuugccuucuuacggauuuagacgagguucgaggcucaccuaucagggcagcucucaggauugu

SEQ ID NO: 266589 - RNA, 64 nt, hsa
ucucugccucuauucuucuauacugcagauuuuucucaccuauuguacaaagaaauugcgaugu

SEQ ID NO: 266590 - RNA, 64 nt, hsa
ccccugauucguaaaccuaggggaaaccaucucucucaccuaaugacccgccuuguucugaagc

SEQ ID NO: 266591 - RNA, 54 nt, hsa
cuaguggcucuugcugcugaugcccucaccuauacucaccugccuuuauuaacc

SEQ ID NO: 266592 - RNA, 64 nt, hsa
caauuuucucaccucuguaaauuuuagucucaaucucaccuaaaugaaucaggucugcccuuua

SEQ ID NO: 266593 - RNA, 64 nt, hsa
gagaacagugcagccccauuuccgguccugcuaccucaccuagauguugugaggauucauauuc

SEQ ID NO: 266594 - RNA, 64 nt, hsa
uggcaaugcagaguuguauuuacuuguuucuguacucaccuacucccaccccaagggaaaauuu

SEQ ID NO: 266595 - RNA, 64 nt, hsa
cucaucagaaacucaaaagaaggccacuguuugucucaccuacccaugaccugaagccccuccc

SEQ ID NO: 266596 - RNA, 64 nt, hsa
cgucccguuugagucaaagucuuacuucccugcucucaccuacucacagacgggaugcuaagca

SEQ ID NO: 266597 - RNA, 64 nt, hsa
uaauagcacuaaugcuuuaagauuuggucacacucucaccuaggugagcgcauugagccagugg

SEQ ID NO: 266598 - RNA, 64 nt, hsa
aaucaucuuccccacacacaaucauucauaucuacucaccuaacagcaacacuggggagagccu

SEQ ID NO: 266599 - RNA, 64 nt, hsa
uuuauccuccaagccuaucucucaccauccagcccucaccuagccauuucccaacccuaguccu

SEQ ID NO: 266600 - RNA, 64 nt, hsa
ccccacaaaggggggcuacgcagucacugacuuccucaccuacaacugccucacgguaagcaug

SEQ ID NO: 266601 - RNA, 64 nt, hsa
ggccugggcugccgggaccucacuuucccagggccucaccuaccuagggucucacuagucgggg

SEQ ID NO: 266602 - RNA, 64 nt, hsa
caccucaauccccucccaucuuccccagaccuaccucaccuacuaggaccugaggcagcuccuu

SEQ ID NO: 266603 - RNA, 64 nt, hsa
cgcaugcccuuucacacacacuuucuacccaauucucaccuagugucacguucccccgacccug

SEQ ID NO: 266604 - RNA, 64 nt, hsa
uucccucacgaugaugaacaauuaucucccguuacucaccuagcaguaucuaacugucccuaac

SEQ ID NO: 266605 - RNA, 64 nt, hsa
cgaccacuuggagacgggggagcuggcucagcaccucaccuaccuggaguuccgguccuuccag

SEQ ID NO: 266606 - RNA, 64 nt, hsa
ccuacugugagcuucuccaccuggaaauuucccucucaccuacuucucuggcccuggguacccc

SEQ ID NO: 266607 - RNA, 64 nt, hsa
accuaccaccccacuggcugguuccagaacgucucucaccuagaccuugccuccccuccucucc

SEQ ID NO: 266608 - RNA, 64 nt, hsa
gcaggcaucugucacugccgugaggucagcgcuucucaccuaacugccuccuggauugucaucu

SEQ ID NO: 266609 - RNA, 64 nt, hsa
ucccuccuccuuuuuuaaguuauuugauggaagacucaccuaauuugugaccugagacuguuga

SEQ ID NO: 266610 - RNA, 64 nt, hsa
cuuucccaccaggcguguguaacaucccaugugccucaccuaauaaaauggcucuucuucugca

SEQ ID NO: 266611 - RNA, 64 nt, hsa
uguuggugucagauaccuucccauccugagcucucucaccuaccugcucucucuccuagagcag

SEQ ID NO: 266612 - RNA, 64 nt, hsa
ccucuguccccauagcugguuuuucccaccaauccucaccuaacaguuacuuuacaauuaaacu

SEQ ID NO: 266613 - RNA, 64 nt, hsa
ggcaggaccgagagugacauccaguugcaccuuucucaccuacuuugggaccuuugggggugag

SEQ ID NO: 266614 - RNA, 64 nt, hsa
caggccugaugcagguguccacucacagguggcgcucaccuaggcugucacaggacccaccucc

SEQ ID NO: 266615 - RNA, 64 nt, hsa
ggguagaggauacuauuuccagaauaguguuuagcucaccuagggggauauguuuguauacaca

SEQ ID NO: 266616 - RNA, 64 nt, hsa
aaucagaaacucaaaagaaugcaacuguuugugucucaccuaucugugaccuggaagcucccuc

SEQ ID NO: 266617 - RNA, 64 nt, hsa
gcccaggauugaccuguguguaagucccaauaaacucaccuacucaucaagcuggacuuguucg

SEQ ID NO: 266618 - RNA, 64 nt, hsa
gucccagggccccaccuaggugcagagccggccccucaccuaacagcugguuccuaccagaccg

SEQ ID NO: 266619 - RNA, 64 nt, hsa
ccacgucagagacauguacugccccucacauuuucucaccuaaaccagcagcaccuccaucuua

SEQ ID NO: 266620 - RNA, 64 nt, hsa
aauaaauagcaaaaugaauccccuagccuuuguccucaccuacccuaaggcagguguguaugcu

SEQ ID NO: 266621 - RNA, 64 nt, hsa
ccugcugagugcccuguguguaaguccuaauaaacucaccuacucaccaagcuggacuuauucg

SEQ ID NO: 266622 - RNA, 64 nt, hsa
gcccaggauugaccuguguguaagucccaauaaacucaccuacucaccaagcuggacuuguucg

SEQ ID NO: 266623 - RNA, 64 nt, hsa
aaauguguguagauuucaugcucgacacuuaccacucaccuaucaacagaucauccugcuugac

SEQ ID NO: 266624 - RNA, 64 nt, hsa
cccuuuuuccuuguccccacacuccuacaccuaacucaccuaacucauacugugcuggagccac

SEQ ID NO: 266625 - RNA, 64 nt, hsa
acaaggauacuuuaauauccagugccgguucagacucaccuauguggcaccuuaaacuuaaaua

SEQ ID NO: 266626 - RNA, 64 nt, hsa
uuaugcuuuuggggggcauauauuggguuccauucucaccuauccacacaacauauccguauau

SEQ ID NO: 266627 - RNA, 64 nt, hsa
guccuuugcacuuccucaaagcuuguguacagugcucaccuaaauccaucugacuacuuguucc

SEQ ID NO: 266628 - RNA, 64 nt, hsa
aacccaaaaaucugagaaccccuccccuuuucuccucaccuaaacccaucuccuacuuugggcg

SEQ ID NO: 266629 - RNA, 64 nt, hsa
cccccaauaguagucucugugaggccuuacugaccucaccuaggaagugauuuuugagcccuug

SEQ ID NO: 266630 - RNA, 64 nt, hsa
guuuguagagauuuuaggcgucuucggauaucuucucaccuauguucccuggcuaagaagucag

SEQ ID NO: 266631 - RNA, 64 nt, hsa
ugugcuuuucauuugcagaaguuaguaacugcagcucaccuacugcaccaaaguucucgauuuu

SEQ ID NO: 266632 - RNA, 64 nt, hsa
aucugagagaaggacugccaaauuuucucaugaucucaccuauacuuuggggaugauaauccaa

SEQ ID NO: 266633 - RNA, 64 nt, hsa
gcuucucugaccacaugugcccaacuucaauaagagaaccaagggacccucauuuucugaggug

SEQ ID NO: 266634 - RNA, 64 nt, hsa
cggaagacauuuauuucuccuuuggauuuuggggagaaccaagcccugguagggaagagguaag

SEQ ID NO: 266635 - RNA, 64 nt, hsa
uugggagauuuauacuauaaauucagugauggcaagaaccaacacuguuuuuuugugagaauug

SEQ ID NO: 266636 - RNA, 64 nt, hsa
aacagaucuugacuacacuaauucuuuauauuauagaaccaacggaaauaugggcacuauuuug

SEQ ID NO: 266637 - RNA, 64 nt, hsa
gaauuaaagcagagagaagccauucgugaugcuuagaaccaaggauggucauguacacaaagac

SEQ ID NO: 266638 - RNA, 64 nt, hsa
uggggccuucuuaacaaaagucuuugauaacuuaagaaccaaaguaacagaguaaacagaggca

SEQ ID NO: 266639 - RNA, 64 nt, hsa
ucuuccuugguacagugguuuuuaaauacugagaagaaccaagucagguuuuuuaaagcagacu

SEQ ID NO: 266640 - RNA, 64 nt, hsa
gcaaggacccaucucugcccugggucagcuccucagaaccaacccccagcaucucuaaagcaaa

SEQ ID NO: 266641 - RNA, 64 nt, hsa
aucuuucagccacagaaucuaacuggugagcuucagaaccaauaauugccacauuuauuguccu

SEQ ID NO: 266642 - RNA, 64 nt, hsa
auuugauguuuuguuugaaacaauacagcauuaaagaaccaauguuauucacuaauaucauuca

SEQ ID NO: 266643 - RNA, 64 nt, hsa
cucuguggaguagaaccaagucuacuuggagaaaagaaccaaguccuuggauaucuaggggaaa

SEQ ID NO: 266644 - RNA, 64 nt, hsa
auuagaaaugagggcuguaucuacucuguggaguagaaccaagucuacuuggagaaaagaacca

SEQ ID NO: 266645 - RNA, 64 nt, hsa
ugcggucacccugcaaaagacuugcacuuuccucagaaccaacaugacgcagcucaauaagggu

SEQ ID NO: 266646 - RNA, 64 nt, hsa
cuuucccacagacuucccuccuggguccagguucagaaccaagacuucuguaccuagugcugcc

SEQ ID NO: 266647 - RNA, 63 nt, hsa
augaaugauuuuuucaguaaaaaauacauauucaagaaccaaaccuugguggucauuucucuu

SEQ ID NO: 266648 - RNA, 64 nt, hsa
aaagauucuuugucaacauuaguaacugauacauagaaccaaggagcacucaaauagggagcca

SEQ ID NO: 266649 - RNA, 64 nt, hsa
cuccggaucugucgauuuggagaccuuccgagagagaaccaagggugcagucagcuuaaagugu

SEQ ID NO: 266650 - RNA, 64 nt, hsa
gccucuauagaccacagaugacucaagccaugccagaaccaagcagcccaugccuggcuguggc

SEQ ID NO: 266651 - RNA, 63 nt, hsa
aagcagugucgccgucccucugccuugcacaaaaagcacaagcauuccuuagcagcucaggcg

SEQ ID NO: 266652 - RNA, 63 nt, hsa
ccccaaagcccagcccggcugaccaacauucaaaagcacaaacccuggggacucugcuuggcu

SEQ ID NO: 266653 - RNA, 63 nt, hsa
auauauauauauaauucaaagcacaauaauugaaagcacaauaauugacagaaaaauacaggu

SEQ ID NO: 266654 - RNA, 63 nt, hsa
cacacacacacauauauauauauauauaauucaaagcacaauaauugaaagcacaauaauuga

SEQ ID NO: 266655 - RNA, 63 nt, hsa
cuuuccuacaacauuuuagcuuuugcccaucuaaagcacaauuaaaauuaggcuacauucuuu

SEQ ID NO: 266656 - RNA, 63 nt, hsa
gauacuuuaagagaaauacaaaggaaauuucuaaagcacaagaaauagugagguaguaguuag

SEQ ID NO: 266657 - RNA, 63 nt, hsa
uuugcaagcaguaauuaacacuaguaacagugaaagcacaagauuuccaaaucagucguuuuc

SEQ ID NO: 266658 - RNA, 63 nt, hsa
ugaacagcuuauguguuagccauagcugaaaauaagcacaaauagcuuauauucagauccuau

SEQ ID NO: 266659 - RNA, 63 nt, hsa
auguaugcgaacauaugugauuuugggguacuaaagcacaaaaaaaucccccauaaaauaaac

SEQ ID NO: 266660 - RNA, 63 nt, hsa
ccauuuucuguuuuuaaaucuagaagaucuucuaagcacaaauacagcuacaaugaaauauuu

SEQ ID NO: 266661 - RNA, 63 nt, hsa
auuuccuuaaaauuucauagcaauuuaaagcacaagcacaauguucaggcauaaucccuaaua

SEQ ID NO: 266662 - RNA, 63 nt, hsa
caauaaauuuccuuaaaauuucauagcaauuuaaagcacaagcacaauguucaggcauaaucc

SEQ ID NO: 266663 - RNA, 63 nt, hsa
cacagccuagaguuaaguaaagucaauucacagaagcacaauuuugcccuuugcgagacauug

SEQ ID NO: 266664 - RNA, 60 nt, hsa
ugcaucgggauucagaaugaccaaccuaagaagcacaaauuuaguuuggguguuccucau

SEQ ID NO: 266665 - RNA, 63 nt, hsa
guguagauauaacuuaaauauggagcuuucaaaaagcacaaauaggcuggacaugguggcuca

SEQ ID NO: 266666 - RNA, 63 nt, hsa
agggcaaaauucuagagagugguaaaucucagaaagcacaagcauaaaaugcagcucuggggg

SEQ ID NO: 266667 - RNA, 63 nt, hsa
ccuaaauaaucauugaugaaguaugucaguuacaagcacaaaagaauauaacugcuuuuauaa

SEQ ID NO: 266668 - RNA, 63 nt, hsa
aaaaucagcuuuuuaauguagguuaccacuuauaagcacaaaagaaacauguauaagaaacca

SEQ ID NO: 266669 - RNA, 63 nt, hsa
ccacuucugcugaaaugcauugggagccugugaaagcacaaagcuggaggcugggcgccugcg

SEQ ID NO: 266670 - RNA, 63 nt, hsa
uccacuuuugugcauuuaucuuuguuaggaucaaagcacaagcucaccaucaaugagccugga

SEQ ID NO: 266671 - RNA, 63 nt, hsa
agacggagaccccgguggcaguggaaaaaucagaagcacaaaggaaaacucuuggccucugcu

SEQ ID NO: 266672 - RNA, 63 nt, hsa
gcugggauagccauuuccauggcucuguuaugcaagcacaaauuucaucuccuagauggacuu

SEQ ID NO: 266673 - RNA, 63 nt, hsa
gaauggcuugucccaucagcagaugaauguguuaagcacaaagcaucuuccuuaaagcacaaa

SEQ ID NO: 266674 - RNA, 63 nt, hsa
gaugaauguguuaagcacaaagcaucuuccuuaaagcacaaagagagggacuaacugaugcug

SEQ ID NO: 266675 - RNA, 63 nt, hsa
cugcaaguuuaaauaguuguacagauaguuuauaagcacaauauuuuaagaaaaaaaaguggc

SEQ ID NO: 266676 - RNA, 63 nt, hsa
gguggccaagcagaugucacauggaguuagucaaagcacaaagucacgauuccacaauggagg

SEQ ID NO: 266677 - RNA, 63 nt, hsa
cucuaccuuacgagagagcuaugcuccuccucaaagcacaaucauccugugacagaaguugcu

SEQ ID NO: 266678 - RNA, 63 nt, hsa
gcugcauauugcauuguuagccacucuuggaaaaagcacaaccuaacaaacauguuuacuaua

SEQ ID NO: 266679 - RNA, 63 nt, hsa
auuaaauuauagcauuugcaaauauuaauauaaaagcacaacaaaauguaguggaaaaugaca

SEQ ID NO: 266680 - RNA, 63 nt, hsa
agaaaaaaaaaagagcuauagaaauccuugucaaagcacaaagucauggcugguuuuguuuca

SEQ ID NO: 266681 - RNA, 63 nt, hsa
acaaucaguguucaggcuucaguuauauaauguaagcacaacuaaaaugaaacuuguugacug

SEQ ID NO: 266682 - RNA, 63 nt, hsa
uccagcgcacagaagcaagugcaaaaaugacacaagcacaacucuccagacguggcuccuucu

SEQ ID NO: 266683 - RNA, 63 nt, hsa
guccuuuguaaagcuguacagacuuugcaguuuaagcacaaugugcacauguuaguuuuauau

SEQ ID NO: 266684 - RNA, 63 nt, hsa
gcuauauauacuggaaguugaagguuaaaggaaaagcacaagaaacuuuggaagcacuuuuuc

SEQ ID NO: 266685 - RNA, 63 nt, hsa
ggucuuugccauaacuuuaugaagugcuacagaaagcacaaagaauugauucauguucaucaa

SEQ ID NO: 266686 - RNA, 63 nt, hsa
ggccugagugggggauauugacacccccagcuaaagcacaagcaccuuagucaccccuccucu

SEQ ID NO: 266687 - RNA, 63 nt, hsa
cuggccugccaccccaccccagcguuuaccccaaagcacaaugcccuggucacuuggcaagcg

SEQ ID NO: 266688 - RNA, 63 nt, hsa
aagggaauuucugcugaagaaccagaaaaaagaaagcacaacaccuuucccaugccuccucug

SEQ ID NO: 266689 - RNA, 63 nt, hsa
ggcugaacucugggagugugucccagcugagggaagcacaaguagcaaagcucauuggucugg

SEQ ID NO: 266690 - RNA, 63 nt, hsa
aggggguggggauuaucuuggggagaggcugaaaagcacaaaagauagucuucccuguacgua

SEQ ID NO: 266691 - RNA, 63 nt, hsa
aaccugagccuaucuggcugggaugguggaauuaagcacaaggucacauucucugugaucaca

SEQ ID NO: 266692 - RNA, 63 nt, hsa
uaacugaucuuuugucuaaggauuuuuaccugaaagcacaauguauugagucucuugaaaauc

SEQ ID NO: 266693 - RNA, 63 nt, hsa
auuauuaagacaacuuugccaaaaaaguccccuaagcacaacuauuuacauuucuuuauagcc

SEQ ID NO: 266694 - RNA, 64 nt, hsa; identical to SEQ ID NO: 91802

SEQ ID NO: 266695 - RNA, 64 nt, hsa; identical to SEQ ID NO: 91803

SEQ ID NO: 266696 - RNA, 64 nt, hsa; identical to SEQ ID NO: 91804

SEQ ID NO: 266697 - RNA, 64 nt, hsa; identical to SEQ ID NO: 91805

SEQ ID NO: 266698 - RNA, 64 nt, hsa; identical to SEQ ID NO: 91806

SEQ ID NO: 266699 - RNA, 64 nt, hsa; identical to SEQ ID NO: 91807

SEQ ID NO: 266700 - RNA, 64 nt, hsa; identical to SEQ ID NO: 91808

SEQ ID NO: 266701 - RNA, 64 nt, hsa; identical to SEQ ID NO: 91809

SEQ ID NO: 266702 - RNA, 64 nt, hsa; identical to SEQ ID NO: 91810

SEQ ID NO: 266703 - RNA, 64 nt, hsa; identical to SEQ ID NO: 91811

SEQ ID NO: 266704 - RNA, 64 nt, hsa; identical to SEQ ID NO: 91812

SEQ ID NO: 266705 - RNA, 64 nt, hsa; identical to SEQ ID NO: 91813

SEQ ID NO: 266706 - RNA, 64 nt, hsa; identical to SEQ ID NO: 91814

SEQ ID NO: 266707 - RNA, 64 nt, hsa; identical to SEQ ID NO: 91815

SEQ ID NO: 266708 - RNA, 64 nt, hsa; identical to SEQ ID NO: 91816

SEQ ID NO: 266709 - RNA, 64 nt, hsa; identical to SEQ ID NO: 91817

SEQ ID NO: 266710 - RNA, 64 nt, hsa; identical to SEQ ID NO: 91818

SEQ ID NO: 266711 - RNA, 64 nt, hsa; identical to SEQ ID NO: 91819

SEQ ID NO: 266712 - RNA, 64 nt, hsa; identical to SEQ ID NO: 91820

SEQ ID NO: 266713 - RNA, 64 nt, hsa; identical to SEQ ID NO: 91821

SEQ ID NO: 266714 - RNA, 64 nt, hsa; identical to SEQ ID NO: 91822

SEQ ID NO: 266715 - RNA, 64 nt, hsa; identical to SEQ ID NO: 91823

SEQ ID NO: 266716 - RNA, 64 nt, hsa; identical to SEQ ID NO: 91824

SEQ ID NO: 266717 - RNA, 64 nt, hsa; identical to SEQ ID NO: 91825

SEQ ID NO: 266718 - RNA, 64 nt, hsa; identical to SEQ ID NO: 91826

SEQ ID NO: 266719 - RNA, 64 nt, hsa; identical to SEQ ID NO: 91827

SEQ ID NO: 266720 - RNA, 64 nt, hsa; identical to SEQ ID NO: 91828

SEQ ID NO: 266721 - RNA, 64 nt, hsa; identical to SEQ ID NO: 91829

SEQ ID NO: 266722 - RNA, 64 nt, hsa; identical to SEQ ID NO: 91830

SEQ ID NO: 266723 - RNA, 64 nt, hsa; identical to SEQ ID NO: 91831

SEQ ID NO: 266724 - RNA, 64 nt, hsa; identical to SEQ ID NO: 91832

SEQ ID NO: 266725 - RNA, 64 nt, hsa; identical to SEQ ID NO: 91833

SEQ ID NO: 266726 - RNA, 64 nt, hsa; identical to SEQ ID NO: 91834

SEQ ID NO: 266727 - RNA, 64 nt, hsa; identical to SEQ ID NO: 91835

SEQ ID NO: 266728 - RNA, 64 nt, hsa; identical to SEQ ID NO: 91836

SEQ ID NO: 266729 - RNA, 64 nt, hsa; identical to SEQ ID NO: 91837

SEQ ID NO: 266730 - RNA, 64 nt, hsa; identical to SEQ ID NO: 91838

SEQ ID NO: 266731 - RNA, 64 nt, hsa; identical to SEQ ID NO: 91839

SEQ ID NO: 266732 - RNA, 64 nt, hsa; identical to SEQ ID NO: 91840

SEQ ID NO: 266733 - RNA, 64 nt, hsa; identical to SEQ ID NO: 91841

SEQ ID NO: 266734 - RNA, 64 nt, hsa; identical to SEQ ID NO: 91842

SEQ ID NO: 266735 - RNA, 64 nt, hsa; identical to SEQ ID NO: 91843

SEQ ID NO: 266736 - RNA, 64 nt, hsa; identical to SEQ ID NO: 91844

SEQ ID NO: 266737 - RNA, 64 nt, hsa; identical to SEQ ID NO: 91845

SEQ ID NO: 266738 - RNA, 64 nt, hsa; identical to SEQ ID NO: 91846

SEQ ID NO: 266739 - RNA, 64 nt, hsa; identical to SEQ ID NO: 91847

SEQ ID NO: 266740 - RNA, 64 nt, hsa; identical to SEQ ID NO: 91848

SEQ ID NO: 266741 - RNA, 64 nt, hsa; identical to SEQ ID NO: 91849

SEQ ID NO: 266742 - RNA, 64 nt, hsa; identical to SEQ ID NO: 91850

SEQ ID NO: 266743 - RNA, 64 nt, hsa; identical to SEQ ID NO: 91851

SEQ ID NO: 266744 - RNA, 64 nt, hsa; identical to SEQ ID NO: 91852

SEQ ID NO: 266745 - RNA, 64 nt, hsa; identical to SEQ ID NO: 91853

SEQ ID NO: 266746 - RNA, 64 nt, hsa; identical to SEQ ID NO: 91854

SEQ ID NO: 266747 - RNA, 64 nt, hsa; identical to SEQ ID NO: 91855

SEQ ID NO: 266748 - RNA, 64 nt, hsa; identical to SEQ ID NO: 91856

SEQ ID NO: 266749 - RNA, 64 nt, hsa; identical to SEQ ID NO: 91857

SEQ ID NO: 266750 - RNA, 64 nt, hsa; identical to SEQ ID NO: 91858

SEQ ID NO: 266751 - RNA, 64 nt, hsa; identical to SEQ ID NO: 91859

SEQ ID NO: 266752 - RNA, 64 nt, hsa; identical to SEQ ID NO: 91860

SEQ ID NO: 266753 - RNA, 64 nt, hsa; identical to SEQ ID NO: 91861

SEQ ID NO: 266754 - RNA, 64 nt, hsa; identical to SEQ ID NO: 91862

SEQ ID NO: 266755 - RNA, 60 nt, hsa
acaauguauauagcugaaaugcucagaugaacaacauauuaaaauuaaaaccacugccua

SEQ ID NO: 266756 - RNA, 60 nt, hsa
guuauuugcagugcagaugaugucuguguaacaacauaaugguuauucaccuuuuuuuga

SEQ ID NO: 266757 - RNA, 60 nt, hsa
uuuuaauuacacauaauauguaauuaaaguacaacauaauauguuguuucucuguagccc

SEQ ID NO: 266758 - RNA, 60 nt, hsa
acauaccuuugacaaauaacuaauguuuuuacaacauaaaacugucuuauuuuugugaaa

SEQ ID NO: 266759 - RNA, 60 nt, hsa
aaguaagcccaagagaacaacauaaagcaaacaacauaaagcacaauaaaaaugcaaaua

SEQ ID NO: 266760 - RNA, 60 nt, hsa
caucuccaacucggaaguaagcccaagagaacaacauaaagcaaacaacauaaagcacaa

SEQ ID NO: 266761 - RNA, 60 nt, hsa
gggaccccagaccccuugguuuccuuggaaacaacauaccucuucccccuuauccccagu

SEQ ID NO: 266762 - RNA, 60 nt, hsa
auuuuuuuuaauuucucucugaguguacauacaacauacucaagcgggaccuucuuucuc

SEQ ID NO: 266763 - RNA, 64 nt, hsa
uaauuucucauauggugcuggaaaugguugggcuuuguaacauuugaaguguuuccaugguagc

SEQ ID NO: 266764 - RNA, 64 nt, hsa
uagcggaggacuacccuugcucacugacuuccuguuguaacacacuuuccuuacggagccuggc

SEQ ID NO: 266765 - RNA, 64 nt, hsa
cauuagccuuugcuuuuucucuuuccggauaaccuuguaacauauugaaaccuuuuaaggaugc

SEQ ID NO: 266766 - RNA, 64 nt, hsa
gcauguaacuuaauuguuuuagagcguguugcuguuguaacaucccagagaagaaugaaaaggc

SEQ ID NO: 266767 - RNA, 64 nt, hsa
ccgaagauuuaagauacaccaaauuucaguuuguuuguaacauuguucaucuuuagugcacuuu

SEQ ID NO: 266768 - RNA, 64 nt, hsa
ugacuucugacauguuggcaaucaaagcaugcacuuguaacaaugaaaaagaaaaagcauuuua

SEQ ID NO: 266769 - RNA, 64 nt, hsa
uuugcguucaucuugucuauuuuuucucuucauguuguaacaaaaaggaaaaaagaaaaaaaaa

SEQ ID NO: 266770 - RNA, 64 nt, hsa
ucaucgguuggauuggaugcuuacaggguuuuucuuguaacauuuauaagugcugcuuacauca

SEQ ID NO: 266771 - RNA, 64 nt, hsa
cuacaauaauuccaaaagguuugcacauuagaguuuguaacaaaauauuuuauuauauaaaacc

SEQ ID NO: 266772 - RNA, 64 nt, hsa
caguggauagcacucaauuuauuccguagugauauuguaacaauacugccauucccuucuacug

SEQ ID NO: 266773 - RNA, 64 nt, hsa
auguaccauaggacuuaaaggugauuuggaugcguuguaacacugcuaaauaugcuaaguacag

SEQ ID NO: 266774 - RNA, 64 nt, hsa
ucucuuugggguaugucuucguuucuuaauauguuuguaacauuauugagauauaauucacaua

SEQ ID NO: 266775 - RNA, 64 nt, hsa
aagcacaugggauguaaucaugagcucugaagauuuucagcauuuaucucccaugacagaaaua

SEQ ID NO: 266776 - RNA, 64 nt, hsa
augcccauaaaaacauaaauggccuuauugaugcuuucagcagaauuucaucuagaaguggcag

SEQ ID NO: 266777 - RNA, 64 nt, hsa
gaauggcuaacucuugccugcuuugguuuuagcuuuucagcaugccaaagucauguaaguuugu

SEQ ID NO: 266778 - RNA, 64 nt, hsa
aggcagccagucagucugucccagaaagggcccuuuucagcacccaaagcugggcuggcuggga

SEQ ID NO: 266779 - RNA, 62 nt, hsa
ggcuaaggagaaacacauagcuuguggcuaucuuucagcacuccucuugcauauuauaaugu

SEQ ID NO: 266780 - RNA, 64 nt, hsa
agagaauuuuuucuucaaauguagaaauguaaauuuucagcaauaaaauaucugcaugccuaca

SEQ ID NO: 266781 - RNA, 64 nt, hsa
ggguacuuuuaccuguguguucaaaggcauuucuuuucagcagugaucauuauaacuucacaaa

SEQ ID NO: 266782 - RNA, 64 nt, hsa
uaguugaucuuugacugucuuauuuauuauaaccuuucagcacauuccaagguuuuaguuacuc

SEQ ID NO: 266783 - RNA, 64 nt, hsa
uacucucuucaaagagcaugagaugcagccauucuuucagcaaagcuucauugacaccugcacc

SEQ ID NO: 266784 - RNA, 64 nt, hsa
cccguaacaccugauuaacugaggcauccacuucuuucagcagacugaucaggaccuccaagcc

SEQ ID NO: 266785 - RNA, 64 nt, hsa
ugccuucccaacagucccccaaagucuuaacucauuucagcauuaacccaaaaguccgcagucc

SEQ ID NO: 266786 - RNA, 64 nt, hsa
aguuccaaacuugcuuucauauuuuuggcuaucuuuucagcaaugccccacucuacuguuagca

SEQ ID NO: 266787 - RNA, 64 nt, hsa
uuuucucagguauaacacauagaaacaccaagauuuucagcaucugaaucaaacuaaaauuacu

SEQ ID NO: 266788 - RNA, 64 nt, hsa
augcagauuccagcauccccuccucagagaucaauuucagcagggccaggcaggaccuggguuu

SEQ ID NO: 266789 - RNA, 64 nt, hsa
uuuucuuaacacgugcaacaucuuaauuuuuguuuuucagcaguugcuguuuuguacuuuggua

SEQ ID NO: 266790 - RNA, 64 nt, hsa
ccuggcuggaaccuucgcuguuugguauuugguauuucagcagcagugugcaauuuuugcuugg

SEQ ID NO: 266791 - RNA, 64 nt, hsa
guaaaauagcccuugacaugaugaacaucacuuauuucagcacuuggauugucuggcaaugauu

SEQ ID NO: 266792 - RNA, 64 nt, hsa
uaagcaaguaauaccuauuagucauaccuaaauuuuucagcacuucauucaauuaaaauacaug

SEQ ID NO: 266793 - RNA, 64 nt, hsa
aaauuauacuaaagugagaugcauuuuuucucauuuucagcaagacuccucuaagcauuuacuc

SEQ ID NO: 266794 - RNA, 64 nt, hsa
caaaauacgaacuuugagaugcacuaaaguuuuguuucagcaguggcucaaaaaauuucagaaa

SEQ ID NO: 266795 - RNA, 64 nt, hsa
cagagagcuaguacuucauuuucacuggauacauuuucagcaucaugaguugucacagccucug

SEQ ID NO: 266796 - RNA, 64 nt, hsa
caauugaggaacuugggaugcuauuaauuuuguauuucagcaacugccccuucuccuaucccaa

SEQ ID NO: 266797 - RNA, 64 nt, hsa
ccuucgccaaguaggcgcacucuuugugauauuguuucagcagacuucuuucagcagcucgugu

SEQ ID NO: 266798 - RNA, 64 nt, hsa
gcgcacucuuugugauauuguuucagcagacuucuuucagcagcucguguuuuucuaaagugaa

SEQ ID NO: 266799 - RNA, 64 nt, hsa
uuucauuuaaaguuuuauccaauauucuaggaauuuucagcaauacugauauucacuuuauuuu

SEQ ID NO: 266800 - RNA, 64 nt, hsa
uguuauuuaaaguuuuauccaguauucuaggaauuuucagcaauacuaauauucucauuuuuaa

SEQ ID NO: 266801 - RNA, 64 nt, hsa
gauucacagaaccguggucacauuuccccaucaaaauccccaaggcgggucccaaguucucucc

SEQ ID NO: 266802 - RNA, 64 nt, hsa
aacaaaaaauaaaucaagaaggcauagcugucugaauccccaauuauugaggcacacuccuugg

SEQ ID NO: 266803 - RNA, 64 nt, hsa
ucacccaaauuucaucucgaauuguaauccccauaauccccaugugucuagggagagaccuggu

SEQ ID NO: 266804 - RNA, 64 nt, hsa
ucuguguccucacccaaauuucaucucgaauuguaauccccauaauccccaugugucuagggag

SEQ ID NO: 266805 - RNA, 64 nt, hsa
ugaugcaaaaaacaaaaacaaaaaaaaaccaccaaauccccaaauucauuccagaucuauuuuu

SEQ ID NO: 266806 - RNA, 64 nt, hsa
cacaagauucaagauuauccacaccccagcccuuaauccccaucccccaaaucacuggauccug

SEQ ID NO: 266807 - RNA, 62 nt, hsa
uuucaccaacugaaaugucucccuuugaaaguagcaaacaugauuuguauguuaacuuaacu

SEQ ID NO: 266808 - RNA, 62 nt, hsa
aaauagugucucagcuaaauggaaaacuguuaagcaaacauccauaguaaaacaaauaaucu

SEQ ID NO: 266809 - RNA, 62 nt, hsa
aaauuacagaauggaaaauaauauuuugggcaagcaaacaaauucacugagaauuccaaaag

SEQ ID NO: 266810 - RNA, 62 nt, hsa
guuuuaaaaagauacacucuaucacauauuuaagcaaacaucacauuuggagaagaggaaau

SEQ ID NO: 266811 - RNA, 62 nt, hsa
uacugggcgugugcaucugaauccugcuggagagcaaacacgaacuucuguucccugcaaaa

SEQ ID NO: 266812 - RNA, 62 nt, hsa
auuuuguucuggcauuagaagaaaaacaagcaagcaaacaaaaacacagccuccgaugccaa

SEQ ID NO: 266813 - RNA, 62 nt, hsa
aguggccguaugggaauuuaguucauucauccagcaaacauugaguaccaauuauuugcuag

SEQ ID NO: 266814 - RNA, 62 nt, hsa
auuguuucuuuccuuuucuccuuugugagcaaagcaaacaaguacuguccaaggacagccuu

SEQ ID NO: 266815 - RNA, 62 nt, hsa
gucuagacuaaaaauauccuugaaagaauaguagcaaacaguaugcaguacuccuguguucu

SEQ ID NO: 266816 - RNA, 62 nt, hsa
ugcagggucaguuaaugcuacaguuacuguauagcaaacaguauccuuuuuucuccuucccc

SEQ ID NO: 266817 - RNA, 62 nt, hsa
cuuuuaaagggauccuuucaaaaggaucacuuagcaaacacauguugacuuuuaacugaugu

SEQ ID NO: 266818 - RNA, 62 nt, hsa
gagaagucaggugauagaugauauuaaaaauuagcaaacaaaagugacuugcucagggucau

SEQ ID NO: 266819 - RNA, 62 nt, hsa
acuuccaguauaguggggacaaucaguuaauaagcaaacaaacacauuucuauuuauaaaug

SEQ ID NO: 266820 - RNA, 62 nt, hsa
ugcauuugcuaugcuuuaccugucuggcaucuagcaaacauucuucacauguuugcuguuau

SEQ ID NO: 266821 - RNA, 62 nt, hsa
aacagaggccaaagaaacgaagcaagacaaacagcaaacaggcauuuuggucaggucauuug

SEQ ID NO: 266822 - RNA, 62 nt, hsa
uacuuuucaggccuuuuuaaaaaauucauuacagcaaacagcuggggaaggacaugcagucc

SEQ ID NO: 266823 - RNA, 62 nt, hsa
uaaucaauaaaguaugucuguugaagcaagcaagcaaacaaauccauaacaaccacaacaag

SEQ ID NO: 266824 - RNA, 62 nt, hsa
acuuagacauaauccauuccacucauuauuccagcaaacacuuacugacaaaucggguccug

SEQ ID NO: 266825 - RNA, 62 nt, hsa
uacugggcgugugcaucugaaucccgcuggagagcaaacacgaacuucuguucgcugcaaaa

SEQ ID NO: 266826 - RNA, 62 nt, hsa
auuuuguucuggcauuaaaagaaaaacaagcaagcaaacaaaaacacagccuccgaugccaa

SEQ ID NO: 266827 - RNA, 62 nt, hsa
aaauaagagaccaaaaguaggcuaucacccaaagcaaacauccuuaacugacccuaacgugu

SEQ ID NO: 266828 - RNA, 62 nt, hsa
cacgaccaagucagcgagagcuagcccugguaagcaaacauagcccauuacagguucagaac

SEQ ID NO: 266829 - RNA, 62 nt, hsa
uagcuacuuaaugguucuguucuuuuauaugcagcaaacacaccguccauuucugaagaggc

SEQ ID NO: 266830 - RNA, 62 nt, hsa
ccacccgagcuaaucauggaaugucuguucccagcaaacacgauaaagaaagauugugcacu

SEQ ID NO: 266831 - RNA, 62 nt, hsa
gaaagucagcaaaagaaagaaugcauuucgaaagcaaacagaagaaaaaaguauauucucac

SEQ ID NO: 266832 - RNA, 62 nt, hsa
uuaaaccaguuuuuacuugucaguuuucucucagcaaacagucuuacuauuauguggaauuu

SEQ ID NO: 266833 - RNA, 62 nt, hsa
caaguagcuuugggcauaggcugcccaaucugagcaaacaccagugaggcucuauugagcca

SEQ ID NO: 266834 - RNA, 62 nt, hsa
aaagauaaacaguuuagcccaucucuccagagagcaaacauaggaauaugacucaggagccu

SEQ ID NO: 266835 - RNA, 62 nt, hsa
ugaagagguaaaaaauaaauaaauacauaaaaagcaaacaagcggggacaccugcagucuua

SEQ ID NO: 266836 - RNA, 62 nt, hsa
acauuuucauggaaugguacugugggagacugagcaaacacucuuuuggcaacuuaguagaa

SEQ ID NO: 266837 - RNA, 62 nt, hsa
cucugauaagaaaaguguucaauuuguauuuaagcaaacagugaacgacguuugcaaucaac

SEQ ID NO: 266838 - RNA, 62 nt, hsa
ucuguggaguuuguucagugguacgguguccaagcaaacagcagaaugcaacuuucuaaaca

SEQ ID NO: 266839 - RNA, 62 nt, hsa
aacagcagaaugcaacuuucuaaacagccccaagcaaacagcagaauucaacuuuuuaaaca

SEQ ID NO: 266840 - RNA, 62 nt, hsa
aaucuggaauauucuacauggcuugauuacauagcaaacaagaccaagauuuagggcugucu

SEQ ID NO: 266841 - RNA, 62 nt, hsa
uuuuggcuaaguagaggacauggacuaguuguagcaaacagaacaugcuguuugcucuugcc

SEQ ID NO: 266842 - RNA, 64 nt, hsa; identical to SEQ ID NO: 168029

SEQ ID NO: 266843 - RNA, 64 nt, hsa; identical to SEQ ID NO: 168030

SEQ ID NO: 266844 - RNA, 64 nt, hsa; identical to SEQ ID NO: 168031

SEQ ID NO: 266845 - RNA, 64 nt, hsa; identical to SEQ ID NO: 168032

SEQ ID NO: 266846 - RNA, 64 nt, hsa; identical to SEQ ID NO: 168033

SEQ ID NO: 266847 - RNA, 64 nt, hsa; identical to SEQ ID NO: 168034

SEQ ID NO: 266848 - RNA, 64 nt, hsa; identical to SEQ ID NO: 168035

SEQ ID NO: 266849 - RNA, 64 nt, hsa; identical to SEQ ID NO: 168036

SEQ ID NO: 266850 - RNA, 64 nt, hsa; identical to SEQ ID NO: 168037

SEQ ID NO: 266851 - RNA, 64 nt, hsa; identical to SEQ ID NO: 168038

SEQ ID NO: 266852 - RNA, 64 nt, hsa; identical to SEQ ID NO: 168039

SEQ ID NO: 266853 - RNA, 64 nt, hsa; identical to SEQ ID NO: 168040

SEQ ID NO: 266854 - RNA, 64 nt, hsa; identical to SEQ ID NO: 168041

SEQ ID NO: 266855 - RNA, 64 nt, hsa; identical to SEQ ID NO: 168042

SEQ ID NO: 266856 - RNA, 64 nt, hsa; identical to SEQ ID NO: 168043

SEQ ID NO: 266857 - RNA, 64 nt, hsa; identical to SEQ ID NO: 168044

SEQ ID NO: 266858 - RNA, 64 nt, hsa; identical to SEQ ID NO: 168045

SEQ ID NO: 266859 - RNA, 64 nt, hsa; identical to SEQ ID NO: 168046

SEQ ID NO: 266860 - RNA, 64 nt, hsa; identical to SEQ ID NO: 168047

SEQ ID NO: 266861 - RNA, 64 nt, hsa; identical to SEQ ID NO: 168048

SEQ ID NO: 266862 - RNA, 64 nt, hsa; identical to SEQ ID NO: 168049

SEQ ID NO: 266863 - RNA, 64 nt, hsa; identical to SEQ ID NO: 168050

SEQ ID NO: 266864 - RNA, 64 nt, hsa; identical to SEQ ID NO: 168051

SEQ ID NO: 266865 - RNA, 64 nt, hsa; identical to SEQ ID NO: 168052

SEQ ID NO: 266866 - RNA, 64 nt, hsa; identical to SEQ ID NO: 168053

SEQ ID NO: 266867 - RNA, 64 nt, hsa; identical to SEQ ID NO: 168054

SEQ ID NO: 266868 - RNA, 64 nt, hsa; identical to SEQ ID NO: 168055

SEQ ID NO: 266869 - RNA, 64 nt, hsa; identical to SEQ ID NO: 168056

SEQ ID NO: 266870 - RNA, 64 nt, hsa; identical to SEQ ID NO: 168057

SEQ ID NO: 266871 - RNA, 64 nt, hsa; identical to SEQ ID NO: 168058

SEQ ID NO: 266872 - RNA, 64 nt, hsa; identical to SEQ ID NO: 168059

SEQ ID NO: 266873 - RNA, 64 nt, hsa; identical to SEQ ID NO: 168060

SEQ ID NO: 266874 - RNA, 64 nt, hsa; identical to SEQ ID NO: 168061

SEQ ID NO: 266875 - RNA, 64 nt, hsa; identical to SEQ ID NO: 168062

SEQ ID NO: 266876 - RNA, 64 nt, hsa; identical to SEQ ID NO: 168063

SEQ ID NO: 266877 - RNA, 64 nt, hsa; identical to SEQ ID NO: 168064

SEQ ID NO: 266878 - RNA, 64 nt, hsa; identical to SEQ ID NO: 168065

SEQ ID NO: 266879 - RNA, 64 nt, hsa; identical to SEQ ID NO: 168066

SEQ ID NO: 266880 - RNA, 64 nt, hsa; identical to SEQ ID NO: 195795

SEQ ID NO: 266881 - RNA, 64 nt, hsa; identical to SEQ ID NO: 195796

SEQ ID NO: 266882 - RNA, 64 nt, hsa; identical to SEQ ID NO: 195797

SEQ ID NO: 266883 - RNA, 64 nt, hsa; identical to SEQ ID NO: 195798

SEQ ID NO: 266884 - RNA, 64 nt, hsa; identical to SEQ ID NO: 195799

SEQ ID NO: 266885 - RNA, 64 nt, hsa; identical to SEQ ID NO: 195800

SEQ ID NO: 266886 - RNA, 64 nt, hsa; identical to SEQ ID NO: 195801

SEQ ID NO: 266887 - RNA, 64 nt, hsa; identical to SEQ ID NO: 195802

SEQ ID NO: 266888 - RNA, 64 nt, hsa; identical to SEQ ID NO: 195803

SEQ ID NO: 266889 - RNA, 64 nt, hsa; identical to SEQ ID NO: 195804

SEQ ID NO: 266890 - RNA, 64 nt, hsa; identical to SEQ ID NO: 195805

SEQ ID NO: 266891 - RNA, 64 nt, hsa; identical to SEQ ID NO: 195806

SEQ ID NO: 266892 - RNA, 64 nt, hsa; identical to SEQ ID NO: 195807

SEQ ID NO: 266893 - RNA, 64 nt, hsa; identical to SEQ ID NO: 195808

SEQ ID NO: 266894 - RNA, 64 nt, hsa; identical to SEQ ID NO: 195809

SEQ ID NO: 266895 - RNA, 64 nt, hsa; identical to SEQ ID NO: 195810

SEQ ID NO: 266896 - RNA, 64 nt, hsa; identical to SEQ ID NO: 195811

SEQ ID NO: 266897 - RNA, 64 nt, hsa; identical to SEQ ID NO: 195812

SEQ ID NO: 266898 - RNA, 64 nt, hsa; identical to SEQ ID NO: 195813

SEQ ID NO: 266899 - RNA, 64 nt, hsa; identical to SEQ ID NO: 195814

SEQ ID NO: 266900 - RNA, 64 nt, hsa; identical to SEQ ID NO: 195815

SEQ ID NO: 266901 - RNA, 64 nt, hsa; identical to SEQ ID NO: 195816

SEQ ID NO: 266902 - RNA, 64 nt, hsa; identical to SEQ ID NO: 195817

SEQ ID NO: 266903 - RNA, 64 nt, hsa; identical to SEQ ID NO: 195818

SEQ ID NO: 266904 - RNA, 64 nt, hsa; identical to SEQ ID NO: 195819

SEQ ID NO: 266905 - RNA, 64 nt, hsa; identical to SEQ ID NO: 195820

SEQ ID NO: 266906 - RNA, 64 nt, hsa; identical to SEQ ID NO: 195821

SEQ ID NO: 266907 - RNA, 64 nt, hsa; identical to SEQ ID NO: 195822

SEQ ID NO: 266908 - RNA, 64 nt, hsa; identical to SEQ ID NO: 195823

SEQ ID NO: 266909 - RNA, 64 nt, hsa; identical to SEQ ID NO: 195824

SEQ ID NO: 266910 - RNA, 64 nt, hsa; identical to SEQ ID NO: 195825

SEQ ID NO: 266911 - RNA, 64 nt, hsa; identical to SEQ ID NO: 195826

SEQ ID NO: 266912 - RNA, 64 nt, hsa; identical to SEQ ID NO: 195827

SEQ ID NO: 266913 - RNA, 64 nt, hsa; identical to SEQ ID NO: 195828

SEQ ID NO: 266914 - RNA, 64 nt, hsa; identical to SEQ ID NO: 195829

SEQ ID NO: 266915 - RNA, 64 nt, hsa; identical to SEQ ID NO: 195830

SEQ ID NO: 266916 - RNA, 64 nt, hsa; identical to SEQ ID NO: 195831

SEQ ID NO: 266917 - RNA, 64 nt, hsa; identical to SEQ ID NO: 195832

SEQ ID NO: 266918 - RNA, 64 nt, hsa; identical to SEQ ID NO: 195833

SEQ ID NO: 266919 - RNA, 64 nt, hsa; identical to SEQ ID NO: 195834

SEQ ID NO: 266920 - RNA, 64 nt, hsa; identical to SEQ ID NO: 195835

SEQ ID NO: 266921 - RNA, 64 nt, hsa; identical to SEQ ID NO: 195836

SEQ ID NO: 266922 - RNA, 64 nt, hsa
uggguuccaacuagaauucuagaaauauuucuagaacacacagagagggaauaagucccucuau

SEQ ID NO: 266923 - RNA, 64 nt, hsa
uauuuucaaagugaagcugagagagaaucuuggaaacacacauaccuguugaucaugggcccug

SEQ ID NO: 266924 - RNA, 64 nt, hsa
uaugcuucuaaauaucuaaacucauuaacauggaaacacacacacaggagcuacaguacauauu

SEQ ID NO: 266925 - RNA, 64 nt, hsa
uaguaauucaggcucuaauuagcugagggaaugaaacacacaaaaaucacugaauuccuaagag

SEQ ID NO: 266926 - RNA, 64 nt, hsa
gcuugcaggaggccaaacugucccucccuugcugaacacacacacacacacacacacacaggug

SEQ ID NO: 266927 - RNA, 64 nt, hsa
ucacauucgacauaccccacugggcacacgcacaaacacacacacuaugggguggggugggugu

SEQ ID NO: 266928 - RNA, 64 nt, hsa
gggcguuaaauucacagauuuuuuuaacgagaaaaacacacagaagaagcuaccucagguguuu

SEQ ID NO: 266929 - RNA, 64 nt, hsa
ugaguaucacaucacacaaaaggaacaaaagcgaaacacacaaaccagccucaacuuacacuug

SEQ ID NO: 266930 - RNA, 64 nt, hsa
aagcacugggagaacuaacagaggagaaaggugaaacacacacacauucuuaaggcaauaaaac

SEQ ID NO: 266931 - RNA, 64 nt, hsa
agcucgccaaccgcaucugcucaucugauauucaaacacacaguauucgugaauaaguugauuc

SEQ ID NO: 266932 - RNA, 64 nt, hsa
acaauauuagagaaaggacaggcuuuuuaugaguaacacacaccauauauaaaacagccuuucu

SEQ ID NO: 266933 - RNA, 64 nt, hsa
gauauuuguaccaggcugcguguuuuucauuuuaaacacacaagauuuaauugaaaggacauca

SEQ ID NO: 266934 - RNA, 64 nt, hsa
agcaaccaaagaaauagggcaagagaggcaggugaacacacaugauaccucaauugacaaucuu

SEQ ID NO: 266935 - RNA, 64 nt, hsa
cacacacacgagcacacacacacacacacacacgaacacacacacacacacacacacgcacaca

SEQ ID NO: 266936 - RNA, 64 nt, hsa
uuuuacaccuggaaaauuuaccucgauuuuuaagaacacacauugccauggcaggauuaucuau

SEQ ID NO: 266937 - RNA, 64 nt, hsa
gagagccacugagggacccagcacucagagacacaacacacauguguagcugcuucuggcugag

SEQ ID NO: 266938 - RNA, 64 nt, hsa
guucuugaacauuucagaaggagugguagaaaaaaacacacauucagccaaccacuuauaugaa

SEQ ID NO: 266939 - RNA, 64 nt, hsa
ccauuuaacuagcacuuuauaagccaaugaagcaaacacacagacucugugagauucuaaaugu

SEQ ID NO: 266940 - RNA, 64 nt, hsa
ucugaggugucaggagagcccucugcugcuuuccaacacacaauuaacuccguuuccaaauaca

SEQ ID NO: 266941 - RNA, 64 nt, hsa
gacuggauccacuaaaccaacacuaagaugggaaaacacacaugguuuggagcaauaggaacau

SEQ ID NO: 266942 - RNA, 64 nt, hsa
auaucacuauuuacaacucauguggacucagaaaaacacacaccaccuuuuggcuuacuucgag

SEQ ID NO: 266943 - RNA, 64 nt, hsa
cccaccauuuucucaguuucucccucucucucccaacacacacacacacacaccccucacauac

SEQ ID NO: 266944 - RNA, 64 nt, hsa
auuaaguacacuuuauugaaaauugccuuccauuaacacacaagaaagaaagcaggauuuucuc

SEQ ID NO: 266945 - RNA, 64 nt, hsa
aaagguucaucucacaacaggaaaaacaaaucucaacacacauuagagauaauugauucagggg

SEQ ID NO: 266946 - RNA, 64 nt, hsa
uauuuuuguuucauugguuguuucacagaauuagaacacacacgacuuuuuauuccuccauugc

SEQ ID NO: 266947 - RNA, 64 nt, hsa
cauuggagucuaggagcucagcuguguguccaucaacacacaaauucguaaaaaacacacaugg

SEQ ID NO: 266948 - RNA, 64 nt, hsa
agcuguguguccaucaacacacaaauucguaaaaaacacacauggccucgccaucguggguaaa

SEQ ID NO: 266949 - RNA, 64 nt, hsa
acuucauuuggagauguaugguguaaaacacacaaacacacacaaaaaagcacaagcccgcugc

SEQ ID NO: 266950 - RNA, 64 nt, hsa
uaauaaauacuucauuuggagauguaugguguaaaacacacaaacacacacaaaaaagcacaag

SEQ ID NO: 266951 - RNA, 64 nt, hsa
acaccacagacacacacacgcacgcacacacacaaacacacaugcacacacacacaucucauuu

SEQ ID NO: 266952 - RNA, 64 nt, hsa
agagaagauuguauaguuggggcuggucuuggugaacacacauuauuaccccacacauccccuu

SEQ ID NO: 266953 - RNA, 64 nt, hsa
acacacagacacacauacacccaugaugugagcaaacacacacacgugcgccuucauagcccag

SEQ ID NO: 266954 - RNA, 64 nt, hsa
acagacacacaacacacacacauacacaccccugaacacacacacagacacacauacacccaug

SEQ ID NO: 266955 - RNA, 64 nt, hsa
cacaugcacacccugaaaacacacacagacacacaacacacacacauacacaccccugaacaca

SEQ ID NO: 266956 - RNA, 64 nt, hsa
cucaaucuggcccucuccacaugcacacccugaaaacacacacagacacacaacacacacacau

SEQ ID NO: 266957 - RNA, 64 nt, hsa
cauaaugcagcaguuucuccaaaaacaaaaacaaaacacacaccacacacacgcgcuuuuccag

SEQ ID NO: 266958 - RNA, 64 nt, hsa
ccaaaagaggucaccagaugcacaugggccgcaaaacacacagucaggcuuccagcacauucuc

SEQ ID NO: 266959 - RNA, 63 nt, hsa
cauuaccuaaaaccaguccaaaaugaaacagaccaacacacacacaaaagcaaauugucaauc

SEQ ID NO: 266960 - RNA, 64 nt, hsa
ucaaggcacaugagugugaccucugccauggggaaacacacacagagauaucuauacauauaua

SEQ ID NO: 266961 - RNA, 64 nt, hsa
uuugccccuuuuggaaugaucucugaauauauaaaacacacacacaaagagcaauaguuugccc

SEQ ID NO: 266962 - RNA, 64 nt, hsa
uuugccccuuuuggaacgaccccugaauauauaaaacacacacacaccccgcgcacucucacuc

SEQ ID NO: 266963 - RNA, 64 nt, hsa
cauucuucauaucaauuuuguauaaauauauagaaacacacacacagccucagacuuacaaacu

SEQ ID NO: 266964 - RNA, 64 nt, hsa
gugugcauucugaggucuaacccggggugccaggaacacacacauccuccaucccagcauagag

SEQ ID NO: 266965 - RNA, 64 nt, hsa
guggguuugguuagaggaaggcugaacucuucagaacacacagacuuucugugacgcagacaga

SEQ ID NO: 266966 - RNA, 64 nt, hsa
gaaccaccacugccugacugcccgcuccucgggaaacacacaagcaacaaaccucacugagagg

SEQ ID NO: 266967 - RNA, 64 nt, hsa
auuugauuccagccuugguaauggagaguuugcaaacacacagcggcccacagcuucacguggu

SEQ ID NO: 266968 - RNA, 64 nt, hsa
augauaauccuaauuauauaaaaauauauauauaaacacacauauauauagugauuucuaaaga

SEQ ID NO: 266969 - RNA, 64 nt, hsa
cuccuaggcaggacaugcugaagccaaagccaauaacacacagcuaacacacagcucccauaac

SEQ ID NO: 266970 - RNA, 64 nt, hsa
gacaugcugaagccaaagccaauaacacacagcuaacacacagcucccauaaccgcugauucuc

SEQ ID NO: 266971 - RNA, 64 nt, hsa
gcuaugcuguucuuuccauuccuuuucccucugaaacacacaaaauaccaaaggaacuuacgca

SEQ ID NO: 266972 - RNA, 64 nt, hsa
agucuccaaaaaaauugaagucacccacaauuccaacacacagcaaucacugcuguuaauagug

SEQ ID NO: 266973 - RNA, 64 nt, hsa
aauaaacucuguuuaaaaaauaaggucugugugaaacacacaugugggggugaggcuggauuaa

SEQ ID NO: 266974 - RNA, 64 nt, hsa
gacuaaauggacauauuucuuaugcaaaaaggaaaacacacacaaccaauaacucaaacaaaaa

SEQ ID NO: 266975 - RNA, 64 nt, hsa
ccagccucccgcggggccacacacuuccccucccaacacacacacacaccugccaucuugguca

SEQ ID NO: 266976 - RNA, 64 nt, hsa
gggcagguggcgugagguccguguugccuucuuuaacacacacucgugcagugggggaguucug

SEQ ID NO: 266977 - RNA, 64 nt, hsa
ucagcccaaguuccgucuuuggucuugguggauaaacacacaguguggagaucccacguacugc

SEQ ID NO: 266978 - RNA, 64 nt, hsa
cauauuguagagagaugcucaguguuaaaacugaaacacacaaacacacacacacacacauuuu

SEQ ID NO: 266979 - RNA, 64 nt, hsa
agagagaugcucaguguuaaaacugaaacacacaaacacacacacacacacauuuuucucuugu

SEQ ID NO: 266980 - RNA, 64 nt, hsa
uucucaugguauuaucuaguaggucugcacacauaacacacaucaguccacccccauugugaau

SEQ ID NO: 266981 - RNA, 64 nt, hsa
aaaacuuuccaugacaguagcauacugaugagacaacacacacacacacaaaacaacagcaaca

SEQ ID NO: 266982 - RNA, 64 nt, hsa
cacacacauacacacacauauacauagacacacaaacacacacacacacauuaauaucuaucuu

SEQ ID NO: 266983 - RNA, 64 nt, hsa
ccccuuuuagcuccuccacacugucucccuccucaacacacacacacacacauacacacacaua

SEQ ID NO: 266984 - RNA, 64 nt, hsa
ucccaucugcaccaguacacaggcaggcauuaucauucuucaccuacuuuuuaaauaguggcaa

SEQ ID NO: 266985 - RNA, 64 nt, hsa
gcgagguggagggcuaacaagaggaaagaacuacauucuucagaauacagugaugaaaauucau

SEQ ID NO: 266986 - RNA, 64 nt, hsa
acgaguguaagauacacuuuaagccagacaccuaauucuucaguucacugcccaugugauacug

SEQ ID NO: 266987 - RNA, 64 nt, hsa
aaacuguuaagauaaacuguaauccagacaccuaauucuucaguucacuacucaugugauacug

SEQ ID NO: 266988 - RNA, 64 nt, hsa
aaacauauacauauauacauacacacauacacauauucuucaggucucuaagccccuggaagca

SEQ ID NO: 266989 - RNA, 64 nt, hsa
gccagaucacgggaacuugagagcuuuuacugugauucuucaauguaaaaaauaaacaacaaug

SEQ ID NO: 266990 - RNA, 64 nt, hsa
gaaacacacuggauacugccuacugacaaaaccuauucuucauauuuugcuaaaaauaugucua

SEQ ID NO: 266991 - RNA, 64 nt, hsa
aauauugccuaugcugcucuauuuuacucaauccauucuucacaagucuugguuaaagaauguc

SEQ ID NO: 266992 - RNA, 64 nt, hsa
caccacugcugcaugggucacucucggccucucaauucuucaggcucagucuggacucuacuua

SEQ ID NO: 266993 - RNA, 64 nt, hsa
cacaguuuugucaccauggaacaccccaaaugccauucuucagcgugucugguaccuuggaugu

SEQ ID NO: 266994 - RNA, 64 nt, hsa
gcucugagagcucugagggagaagcuguuugcucauucuucagaucuucucagugaauuuaaga

SEQ ID NO: 266995 - RNA, 64 nt, hsa
uccacuggccacucugauagaugagaaaguucuaauucuucaugguggggugucagacauaacu

SEQ ID NO: 266996 - RNA, 64 nt, hsa
uauauaccuaauuaugugcacuggagaguaauuuauucuucauuaucauuuguaaacauuguuu

SEQ ID NO: 266997 - RNA, 64 nt, hsa
gagaucguaggugaaaaaagaugggccauuaaggauucuucaaggaaaacauuccucaaaauga

SEQ ID NO: 266998 - RNA, 64 nt, hsa
gcuuggaaagaugguuaguugauaccguccgaugauucuucaguaaagauagauucccacaaag

SEQ ID NO: 266999 - RNA, 64 nt, hsa
uuggccuugggaaaaaccacguucuuccuuuccgauucuucauccggucuacgcuaugcaauuc

SEQ ID NO: 267000 - RNA, 64 nt, hsa
cguggcaucugucagcuuuucaccuuucauucuuauucuucacuuuugcugcugagccuagcug

SEQ ID NO: 267001 - RNA, 64 nt, hsa
aauuuucaucaauaggaaaaaagaaauacgucucauucuucaauacuuuaaaauggcuuuuucc

SEQ ID NO: 267002 - RNA, 64 nt, hsa
ggaagguuuuuuucuuuuuuuuccccuguguaacauucuucauuguucaucaacauuuaagaaa

SEQ ID NO: 267003 - RNA, 64 nt, hsa
aaaagccuguugccacuguugugucaugauuuccauucuucaucauggaaagccacaagccuca

SEQ ID NO: 267004 - RNA, 64 nt, hsa
ccauuuuccuucuucuuuuuuaagcauuuuucauauucuucacugucuucuauuuggucuugau

SEQ ID NO: 267005 - RNA, 64 nt, hsa
aaaaacaaaaaacaaaacaauucauuagccucagauucuucaucuguauacaucacaaggcuca

SEQ ID NO: 267006 - RNA, 64 nt, hsa
accuccuucagaggaugcuaugggguccauuuuaauucuucauuuguucuacggggaggaaaga

SEQ ID NO: 267007 - RNA, 64 nt, hsa
caaaauuauguggugugaaacagccaaggcauuuauucuucagaggcaggauaauauuucagga

SEQ ID NO: 267008 - RNA, 64 nt, hsa
uaugguuuccucauuuuacuaaaaucguauucuaauucuucauuauaguaaaucuaugagcaac

SEQ ID NO: 267009 - RNA, 64 nt, hsa
aagaaaguauaagggucacaagucuaaacaaugaauucuucaacagggaaaacagcuagcuuga

SEQ ID NO: 267010 - RNA, 64 nt, hsa
gacaugggaaaccuaaguuacaccuuggguuaaaauucuucaccauauuaguuuuguugcuuca

SEQ ID NO: 267011 - RNA, 64 nt, hsa
gcaagagugccacauuauaacuaggcaauuauccauucuucaagacuuaguuauugucacacua

SEQ ID NO: 267012 - RNA, 64 nt, hsa
gugugcuuucgccuuggcuaacuccuuugaccucauucuucauauaguagucuaggaaaaaguu

SEQ ID NO: 267013 - RNA, 64 nt, hsa
gagcuuuuaggcauuauguauauuuaaaaaauauauucuucaaaaaugcauuuuggcauggugg

SEQ ID NO: 267014 - RNA, 64 nt, hsa
gaaaugucuaaaugcugaaaaaacaccuagcuuuauucuucagauacaaacugcagccuguagu

SEQ ID NO: 267015 - RNA, 64 nt, hsa
gauuaucuuggugugcauuuaauuauuuuucugaauucuucauggauaaugacauaguaauugu

SEQ ID NO: 267016 - RNA, 64 nt, hsa
gaaaggugggaagaauauuacugcauuagauguaauucuucauucuagacuuccaaguuuguuu

SEQ ID NO: 267017 - RNA, 64 nt, hsa
gcuauuacagcucauauauacuuuuuccaucuggauucuucacaaaagaauauguugugagcau

SEQ ID NO: 267018 - RNA, 64 nt, hsa
gcuugagguaucauuaucaguuacaaauugaguuauucuucaucaaaugacuuuuggaguagag

SEQ ID NO: 267019 - RNA, 64 nt, hsa
auaugaccugagaccacaauuuguucacuuuuguauucuucaguccuaugucugucucuaccuu

SEQ ID NO: 267020 - RNA, 64 nt, hsa
ugcagggcucuaagcuucagagguaguaacugucauucuucaaucagauaguggaaauagaacu

SEQ ID NO: 267021 - RNA, 64 nt, hsa
aacaagggaugcaugcagucaaauugauaguuuaauucuucaagugauaauauaggaaguuuca

SEQ ID NO: 267022 - RNA, 64 nt, hsa
guuucacugccaaacagauucacuacucuuacugauucuucacugagcuuugcuaguauaagca

SEQ ID NO: 267023 - RNA, 64 nt, hsa
aagaaagauauaaaggaucuuguaguuuaugagaauucuucaaaucccgugugcacgcugaacg

SEQ ID NO: 267024 - RNA, 64 nt, hsa
aaguaaacaugcagcugccgacgaggcuuugaaaauucuucaaaaaacacagcccacuuaucca

SEQ ID NO: 267025 - RNA, 64 nt, hsa
cuguuucaaguacucaagacugacuuacagaccaaccaaccaccuugcuggaacccuugcuagc

SEQ ID NO: 267026 - RNA, 64 nt, hsa
agaacuguuucaaguacucaagacugacuuacagaccaaccaaccaccuugcuggaacccuugc

SEQ ID NO: 267027 - RNA, 64 nt, hsa
ucacauguacagcuuucuacuucuuuguaagaacaccaaccaaccaagguuuaagugauuaaua

SEQ ID NO: 267028 - RNA, 64 nt, hsa
auguacagcuuucuacuucuuuguaagaacaccaaccaaccaagguuuaagugauuaauaggcu

SEQ ID NO: 267029 - RNA, 64 nt, hsa
aaggaaagaaaacuaacaaccaaccaaccaaccaaccaaccacaaaccacccuaaaaugacagc

SEQ ID NO: 267030 - RNA, 64 nt, hsa
uaaaaaggaaagaaaacuaacaaccaaccaaccaaccaaccaaccacaaaccacccuaaaauga

SEQ ID NO: 267031 - RNA, 64 nt, hsa
aaauuaaaaaggaaagaaaacuaacaaccaaccaaccaaccaaccaaccacaaaccacccuaaa

SEQ ID NO: 267032 - RNA, 64 nt, hsa
auauaaauuaaaaaggaaagaaaacuaacaaccaaccaaccaaccaaccaaccacaaaccaccc

SEQ ID NO: 267033 - RNA, 64 nt, hsa
auauauauaaauuaaaaaggaaagaaaacuaacaaccaaccaaccaaccaaccaaccacaaacc

SEQ ID NO: 267034 - RNA, 64 nt, hsa
gccauuuuuacacacuugacuuuuuaaaaauacaaccaaccaaccaccacaacuucuuauacau

SEQ ID NO: 267035 - RNA, 64 nt, hsa
uuuuuacacacuugacuuuuuaaaaauacaaccaaccaaccaccacaacuucuuauacauuugg

SEQ ID NO: 267036 - RNA, 64 nt, hsa
cccaagcaccaugucagugucguacaaucuaccaaccaaccagugcugaagagauuuuagaacc

SEQ ID NO: 267037 - RNA, 64 nt, hsa
cccucccaagcaccaugucagugucguacaaucuaccaaccaaccagugcugaagagauuuuag

SEQ ID NO: 267038 - RNA, 64 nt, hsa
auauccaacuaaaaauuacgcuaucuagaauuguaccaaccaaaaucucguauuggcagaucuu

SEQ ID NO: 267039 - RNA, 64 nt, hsa
uuugcacuuuguguggauugagguguucagaaauaccaaccauaaaaauguaaucuaguuggca

SEQ ID NO: 267040 - RNA, 64 nt, hsa
ugccccccgguaugggaaccagcaccucccaccaaccaaccacacccggugggggcacagcaca

SEQ ID NO: 267041 - RNA, 64 nt, hsa
ccgaugccccccgguaugggaaccagcaccucccaccaaccaaccacacccggugggggcacag

SEQ ID NO: 267042 - RNA, 64 nt, hsa
ccgaugccccccaguaugggaaccagcaccucccaccaaccagccacacccggugggggcacag

SEQ ID NO: 267043 - RNA, 64 nt, hsa
ccgaugccccccggugugggaaccagcaccucccaccaaccagccacacccagugggggcacag

SEQ ID NO: 267044 - RNA, 64 nt, hsa
ggggggcccccgggugcagaaaacagcaccucccaccaaccagccacucccgguggggacacag

SEQ ID NO: 267045 - RNA, 64 nt, hsa
ccaggaccucaacucggccaucacauaucgaauuaccaaccacucacacuuccggauggaggga

SEQ ID NO: 267046 - RNA, 64 nt, hsa
gagaaaugcacuuuugcacuaccaaccacuuuaaaccaaccacgagaacaaagaggagcgguug

SEQ ID NO: 267047 - RNA, 64 nt, hsa
cccugacaccaguagagaaaugcacuuuugcacuaccaaccacuuuaaaccaaccacgagaaca

SEQ ID NO: 267048 - RNA, 64 nt, hsa
aaccagugugccaucuccaauauuucuauaguauaccaaccaccccaggaaugcacuuuaacaa

SEQ ID NO: 267049 - RNA, 64 nt, hsa
cauauguauguauucacugaccaaaaauucacugaccaaccaaccaaacuccacacuucaucug

SEQ ID NO: 267050 - RNA, 64 nt, hsa
uguauguauucacugaccaaaaauucacugaccaaccaaccaaacuccacacuucaucugaucc

SEQ ID NO: 267051 - RNA, 64 nt, hsa
ccuuugaggcucuaaaggaaaaucagcugccucuaccaaccacccucuaucagcaguggcccag

SEQ ID NO: 267052 - RNA, 64 nt, hsa
gggcauucaaacggagggcaaaccgaugaucuaaaccaaccacuuggaaaaacccaauggggac

SEQ ID NO: 267053 - RNA, 64 nt, hsa
uauccaguguuguguaaagagacuggccaacaggaccaaccaagcaccuuaccucucccauaca

SEQ ID NO: 267054 - RNA, 64 nt, hsa
aauaaauuaaucuauauugguugacaaacaagccaccaaccacugacugcaaaacugccugaug

SEQ ID NO: 267055 - RNA, 64 nt, hsa
cuccaagaucaagauccuguucugagucagaugaugaugacagcagugaaacuccuccucacug

SEQ ID NO: 267056 - RNA, 64 nt, hsa
cacuagaauuuggugaagaggaggaggaggagauugaugacaagcaaguuacucaggaaucaaa

SEQ ID NO: 267057 - RNA, 64 nt, hsa
ugcuuccccuggaaaaaaaucguguuaagcuagaugaugacagugaugaugaugaagaaagcaa

SEQ ID NO: 267058 - RNA, 64 nt, hsa
cauggacccuugguggcuuuuguaaauuaauuuuugaugacauuuugaguuuuaagauuucuga

SEQ ID NO: 267059 - RNA, 64 nt, hsa
gccugauuuucaucuuuauaggaaauaguuuaagugaugacaaguuccaauagcuuauaugccc

SEQ ID NO: 267060 - RNA, 64 nt, hsa
aaagcuucucagcugaggacacucaaggcauacaugaugacagucuuuuuuuuuuuuguauguu

SEQ ID NO: 267061 - RNA, 64 nt, hsa
agcuucuccagggccgacagcugagggcugcucccugcaucauccaagcaaugaccucagacuu

SEQ ID NO: 267062 - RNA, 64 nt, hsa
cagagcgggugggcggggggugaauaugguuggccugcaucagguggccuucccauuuaagugc

SEQ ID NO: 267063 - RNA, 64 nt, hsa
cuucugcuccagcugcaucacagugauggccaagcugcaucagccgcacucuccuggacgccau

SEQ ID NO: 267064 - RNA, 64 nt, hsa
cuggcugaagugaacgggccgccuucugcuccagcugcaucacagugauggccaagcugcauca

SEQ ID NO: 267065 - RNA, 64 nt, hsa
ugcaaccuccgccucuuggguucaagcaauucugcugcaucagccucccgaguaccugggauua

SEQ ID NO: 267066 - RNA, 64 nt, hsa
gacaccacguccucacucaccugcacaagaaucccugcaucagguucuccuuugaggguaccca

SEQ ID NO: 267067 - RNA, 64 nt, hsa
uaacuuauaggaguuaacauuugaggacuuuguucugcaucagaucuuacuauuugaauguuua

SEQ ID NO: 267068 - RNA, 64 nt, hsa
ggcaucuuauuacuguuacucaaaaacauugacucugcaucaagaaagaaacaagaaagcaaua

SEQ ID NO: 267069 - RNA, 64 nt, hsa
ugacuuacuuaaccagguuugggauggagauggucugcaucagcuuuuuguauuaacaaaguua

SEQ ID NO: 267070 - RNA, 64 nt, hsa
agcugccucugagcccucgcucguccacggucuucugcaucacugguauacacacucguuagcg

SEQ ID NO: 267071 - RNA, 64 nt, hsa
gcaguggccgucuccaccucagcuccugcucccucugcaucagagcccuuccuuucuuggggga

SEQ ID NO: 267072 - RNA, 64 nt, hsa
gcuuuauuuggauggccuggcaacaucacauuuucugcaucacccugagccccauuugcuuccc

SEQ ID NO: 267073 - RNA, 64 nt, hsa
gguucaagaugcagauuucucaauuuggacacaccugcaucacguuggucaaauuuugcugccu

SEQ ID NO: 267074 - RNA, 64 nt, hsa
auuguguccaggacuggaauaaagguccuuuuugcugcaucacccaggcaacacucccagccuu

SEQ ID NO: 267075 - RNA, 64 nt, hsa
aguacgagccccacagagcaggaagccgaugugacugcaucauauauuuaacaaugacaagaug

SEQ ID NO: 267076 - RNA, 64 nt, hsa
cugcagcaccucaccugagaccuccacuccacaucugcaucacucauggaacacucaugucugg

SEQ ID NO: 267077 - RNA, 64 nt, hsa
aaccaauaacuucugcaucaaaacauguuacagccugcaucaagggcuuuaccccaaccugcag

SEQ ID NO: 267078 - RNA, 64 nt, hsa
uuaccuugcccuuucuacucagaaccaauaacuucugcaucaaaacauguuacagccugcauca

SEQ ID NO: 267079 - RNA, 64 nt, hsa
ucagcccuuaauucucaggugaacaaacagcuaacugcaucagcaaauuggaauggcuggcuug

SEQ ID NO: 267080 - RNA, 64 nt, hsa
agggucaaggacucgugacuccuagcucuuuucacugcaucauacugcugucagaugaauaaau

SEQ ID NO: 267081 - RNA, 61 nt, hsa
gugugugaacaaauggaaauaaagcagggacugugaacauuuguuuuuggucuguugaaga

SEQ ID NO: 267082 - RNA, 61 nt, hsa
cauguguuuuuuuuuuuuuuuuuaaagcgugugugaacaaauggaaauaaagcagggacug

SEQ ID NO: 267083 - RNA, 61 nt, hsa
gagcuauaauaaacuuguaaaauuaaguugaugugaacauaauuuugauuaauuaauaagg

SEQ ID NO: 267084 - RNA, 61 nt, hsa
aaucuaaaauuuguuauucaaauuaaauggcugugaacaauguuaaauagcaucaguuugu

SEQ ID NO: 267085 - RNA, 61 nt, hsa
uguaguucucuacauuucucuggauggagacugugaacaucugauuguucagcaaccuuca

SEQ ID NO: 267086 - RNA, 61 nt, hsa
gcucucaucauaugcaaauucucagaagggcugugaacaccuuaguaauaaauuuaucuuu

SEQ ID NO: 267087 - RNA, 61 nt, hsa
uuugagaaugaugcuacucugaucuaaugaaugugaacauguagauguuuuguguguauuu

SEQ ID NO: 267088 - RNA, 61 nt, hsa
aaaauuuuguuaggccacaaaaacacugcacugugaacauuuuagaaaagguaugucagac

SEQ ID NO: 267089 - RNA, 61 nt, hsa
auauguguguuuacacauaugucugcaugcaugugaacacacacacacacacacacacacc

SEQ ID NO: 267090 - RNA, 61 nt, hsa
uguuucuauuuacaacugugcuuaucaaaauugugaacacccccacccccgcauuuuugug

SEQ ID NO: 267091 - RNA, 61 nt, hsa
cuuugugcuauguggagcucacagccucacaugugaacacccgugucuggguugccugggg

SEQ ID NO: 267092 - RNA, 61 nt, hsa
uuacacacucacacacauaacucaaaaguuuugugaacaaguacuuuccuuuuuuacaugu

SEQ ID NO: 267093 - RNA, 61 nt, hsa
gcugcugugaacauucauguacagguuuuuaugugaacauacauuuucauuuucugggaua

SEQ ID NO: 267094 - RNA, 61 nt, hsa
uguuuucaguuuuuugcccuaauaaagcugcugugaacauucauguacagguuuuuaugug

SEQ ID NO: 267095 - RNA, 61 nt, hsa
uaaagagcugauaacaguacucagaagaaucugugaacaaauacuugaaaauggguucaau

SEQ ID NO: 267096 - RNA, 61 nt, hsa
gacugccauuauguguggucuucccauuaaaugugaacauuuuaauauguaugcauucacc

SEQ ID NO: 267097 - RNA, 64 nt, hsa; identical to SEQ ID NO: 199615

SEQ ID NO: 267098 - RNA, 64 nt, hsa; identical to SEQ ID NO: 199616

SEQ ID NO: 267099 - RNA, 64 nt, hsa; identical to SEQ ID NO: 199617

SEQ ID NO: 267100 - RNA, 64 nt, hsa; identical to SEQ ID NO: 199618

SEQ ID NO: 267101 - RNA, 64 nt, hsa; identical to SEQ ID NO: 199619

SEQ ID NO: 267102 - RNA, 64 nt, hsa; identical to SEQ ID NO: 199620

SEQ ID NO: 267103 - RNA, 64 nt, hsa; identical to SEQ ID NO: 199621

SEQ ID NO: 267104 - RNA, 64 nt, hsa; identical to SEQ ID NO: 199622

SEQ ID NO: 267105 - RNA, 64 nt, hsa; identical to SEQ ID NO: 199623

SEQ ID NO: 267106 - RNA, 64 nt, hsa; identical to SEQ ID NO: 199624

SEQ ID NO: 267107 - RNA, 64 nt, hsa; identical to SEQ ID NO: 199625

SEQ ID NO: 267108 - RNA, 64 nt, hsa; identical to SEQ ID NO: 199626

SEQ ID NO: 267109 - RNA, 64 nt, hsa; identical to SEQ ID NO: 199627

SEQ ID NO: 267110 - RNA, 64 nt, hsa; identical to SEQ ID NO: 199628

SEQ ID NO: 267111 - RNA, 64 nt, hsa; identical to SEQ ID NO: 161976

SEQ ID NO: 267112 - RNA, 64 nt, hsa; identical to SEQ ID NO: 161977

SEQ ID NO: 267113 - RNA, 64 nt, hsa; identical to SEQ ID NO: 161978

SEQ ID NO: 267114 - RNA, 64 nt, hsa; identical to SEQ ID NO: 161979

SEQ ID NO: 267115 - RNA, 64 nt, hsa; identical to SEQ ID NO: 161980

SEQ ID NO: 267116 - RNA, 64 nt, hsa; identical to SEQ ID NO: 161981

SEQ ID NO: 267117 - RNA, 64 nt, hsa; identical to SEQ ID NO: 161982

SEQ ID NO: 267118 - RNA, 64 nt, hsa; identical to SEQ ID NO: 161983

SEQ ID NO: 267119 - RNA, 64 nt, hsa; identical to SEQ ID NO: 161984

SEQ ID NO: 267120 - RNA, 64 nt, hsa; identical to SEQ ID NO: 161985

SEQ ID NO: 267121 - RNA, 64 nt, hsa; identical to SEQ ID NO: 161986

SEQ ID NO: 267122 - RNA, 64 nt, hsa; identical to SEQ ID NO: 161987

SEQ ID NO: 267123 - RNA, 64 nt, hsa; identical to SEQ ID NO: 161988

SEQ ID NO: 267124 - RNA, 64 nt, hsa; identical to SEQ ID NO: 161989

SEQ ID NO: 267125 - RNA, 64 nt, hsa; identical to SEQ ID NO: 161990

SEQ ID NO: 267126 - RNA, 64 nt, hsa; identical to SEQ ID NO: 161991

SEQ ID NO: 267127 - RNA, 64 nt, hsa; identical to SEQ ID NO: 161992

SEQ ID NO: 267128 - RNA, 64 nt, hsa; identical to SEQ ID NO: 161993

SEQ ID NO: 267129 - RNA, 64 nt, hsa; identical to SEQ ID NO: 161994

SEQ ID NO: 267130 - RNA, 64 nt, hsa; identical to SEQ ID NO: 161995

SEQ ID NO: 267131 - RNA, 64 nt, hsa; identical to SEQ ID NO: 161996

SEQ ID NO: 267132 - RNA, 64 nt, hsa; identical to SEQ ID NO: 161997

SEQ ID NO: 267133 - RNA, 64 nt, hsa; identical to SEQ ID NO: 161998

SEQ ID NO: 267134 - RNA, 64 nt, hsa; identical to SEQ ID NO: 161999

SEQ ID NO: 267135 - RNA, 64 nt, hsa; identical to SEQ ID NO: 162000

SEQ ID NO: 267136 - RNA, 64 nt, hsa; identical to SEQ ID NO: 162001

SEQ ID NO: 267137 - RNA, 64 nt, hsa; identical to SEQ ID NO: 162002

SEQ ID NO: 267138 - RNA, 64 nt, hsa; identical to SEQ ID NO: 162003

SEQ ID NO: 267139 - RNA, 64 nt, hsa; identical to SEQ ID NO: 162004

SEQ ID NO: 267140 - RNA, 64 nt, hsa; identical to SEQ ID NO: 162005

SEQ ID NO: 267141 - RNA, 64 nt, hsa; identical to SEQ ID NO: 162006

SEQ ID NO: 267142 - RNA, 64 nt, hsa; identical to SEQ ID NO: 162007

SEQ ID NO: 267143 - RNA, 64 nt, hsa; identical to SEQ ID NO: 162008

SEQ ID NO: 267144 - RNA, 64 nt, hsa
cauucaugcaaugacuauuucuaaagcaccugcuacacagcaggcuguacacagcagaucagua

SEQ ID NO: 267145 - RNA, 64 nt, hsa
cuauuucuaaagcaccugcuacacagcaggcuguacacagcagaucaguacuguucaacagaac

SEQ ID NO: 267146 - RNA, 64 nt, hsa
auauaggggaguuguauggaaaaauaguagaauuacacagcaugaaaagcagcccaugguuuaa

SEQ ID NO: 267147 - RNA, 64 nt, hsa
uuuucccuucugccuucaccuuugccguggguggacacagcaagaaggcccucaucagaugcug

SEQ ID NO: 267148 - RNA, 64 nt, hsa
auacuacgcauauacgguaagagauuaaauauaaacacagcaaguuccaccccaguccuauuug

SEQ ID NO: 267149 - RNA, 64 nt, hsa
gugagcuaugaucagcugcaauccacccuggguaacacagcaagacucuaucucaaaaaaaaga

SEQ ID NO: 267150 - RNA, 64 nt, hsa
ucuaauauagaaacucacauaacuagcccagguaacacagcaagaccccaucucuacaaaaaua

SEQ ID NO: 267151 - RNA, 64 nt, hsa
augggggauuuucccucugcucccacccaccuaaacacagcagccauuuguaccuguuugcuuc

SEQ ID NO: 267152 - RNA, 64 nt, hsa
cugguaagacaaguacauccacucaugaaugcagacacagcagcuggugguuuuguguauaccu

SEQ ID NO: 267153 - RNA, 64 nt, hsa
agacccagagaggcugaaugacaugcucacagucacacagcaggcaguggcaggcaguagugaa

SEQ ID NO: 267154 - RNA, 64 nt, hsa
aggcucagagagguuaugugguuuucucaaagccacacagcaagauuuggcaggugagccuuac

SEQ ID NO: 267155 - RNA, 64 nt, hsa
gcuaacuaacuuacauuuguggggaagccaacagacacagcaggaggagagggagguggcgcug

SEQ ID NO: 267156 - RNA, 64 nt, hsa
gcagaaacguugguaaaagggcaguuugguuucaacacagcagaccugauaugggaucccuuag

SEQ ID NO: 267157 - RNA, 64 nt, hsa
agagaugacucagcacugucccuuagcagggaugacacagcaaggaugacucagcacugccccu

SEQ ID NO: 267158 - RNA, 64 nt, hsa; identical to SEQ ID NO: 267157

SEQ ID NO: 267159 - RNA, 64 nt, hsa
agggaugacucagcacugucccuuagcagugaugacacagcaaggaugacucagcacugccccu

SEQ ID NO: 267160 - RNA, 64 nt, hsa
agggaugacucagcagugucccuuagcagcgaugacacagcaaggaugacucagcacugccccu

SEQ ID NO: 267161 - RNA, 64 nt, hsa
caucuuuaggggucuggauuuuguagguccgacuacacagcaguguuaacucauuucucaugcc

SEQ ID NO: 267162 - RNA, 64 nt, hsa
aauuagaaaacaugaaauagggaacuccagacugacacagcaguuguuuuugaaaaggaaauaa

SEQ ID NO: 267163 - RNA, 64 nt, hsa
ggccacacagcacaugcacacaggugcacagaccacacagcacacacaagugcacagagcacac

SEQ ID NO: 267164 - RNA, 64 nt, hsa
gcacuaacacaugcacacacaaagugcauaggccacacagcacaugcacacaggugcacagacc

SEQ ID NO: 267165 - RNA, 64 nt, hsa
acacaguauacacauacacaagugcacagaccacacacagcacuaacacaugcacacacaaagu

SEQ ID NO: 267166 - RNA, 64 nt, hsa
aaacuuuuagauuggauuguuugcuauugcucugugugaggauacauaaucuuucaguaaacug

SEQ ID NO: 267167 - RNA, 64 nt, hsa
cuuggauacaguuugcuuguaauauuuuuaauaaugugaggaguacaguguuuucuaauucauu

SEQ ID NO: 267168 - RNA, 64 nt, hsa
aauggggucaauaccaccuaccucacagggguguugugaggacugagaagaacaaugucaaaug

SEQ ID NO: 267169 - RNA, 64 nt, hsa
ccagagcaccacucugcugccccaccacgcggccugugaggagccacuaaaccuuuccgugccu

SEQ ID NO: 267170 - RNA, 64 nt, hsa
aaaaaaacccauguggugaugauguguauauauaugugaggauguaucgggaagauuucuaaau

SEQ ID NO: 267171 - RNA, 64 nt, hsa
uaggguugguuccuuuccaacguuuggaagauccugugaggagccccaucugucuaaagauaga

SEQ ID NO: 267172 - RNA, 64 nt, hsa
uccauauucuuaugauuacuuggguuaaagcuucugugaggaccuuuuggcucuuaagauaucc

SEQ ID NO: 267173 - RNA, 64 nt, hsa
cccuguuaagucccuuccguaauuuuuauguucuugugaggaaaaaaguaaaacauguuuaauu

SEQ ID NO: 267174 - RNA, 64 nt, hsa
ucuugggaagagguuucuguaaccccugcccuggugugaggaggaaauggcucuggccuggcug

SEQ ID NO: 267175 - RNA, 64 nt, hsa
uaaaaaccauuuuucuaauucuaacaaguuagaaugugaggaaggaaugaacaugaguguuuag

SEQ ID NO: 267176 - RNA, 64 nt, hsa
ggucaagacgagggaaauaugagaaggcaaaugaugugaggauuaguaucuugagauucaccug

SEQ ID NO: 267177 - RNA, 64 nt, hsa
gagaagaaucauacuuugaccuaccuuguagagaugugaggauuuagauguuugcuaacuucaa

SEQ ID NO: 267178 - RNA, 64 nt, hsa
gggggaaggcaguguggucccuacccugugugaaugugaggauguagacauccaucagugcaac

SEQ ID NO: 267179 - RNA, 64 nt, hsa
ugauuuaucugggagaaaacuguggugcacagcuugugaggagggcaagguugugacguucgag

SEQ ID NO: 267180 - RNA, 64 nt, hsa
uuauuuccagaauuuuagacauuauuacaggguuugugaggaccuuugacucagugacaaucau

SEQ ID NO: 267181 - RNA, 64 nt, hsa
ggcaaagaggguugauuaaaucuauaaguuuuuaugugaggacuuuguaagucagcauaaaaau

SEQ ID NO: 267182 - RNA, 64 nt, hsa
uguccucagcgacauuucugaugugcugcucuuaugugaggaccagugcuuucucucuuugcac

SEQ ID NO: 267183 - RNA, 64 nt, hsa
gauggcacgggcuccucagagcgugguagccgacugugaggaaaagcagagggaaugugaaaga

SEQ ID NO: 267184 - RNA, 64 nt, hsa
cucuuccugucuaacuuggggaaggggccugggcugugaggacagggcccccacaggggauggu

SEQ ID NO: 267185 - RNA, 64 nt, hsa
agauguaggaaccgaucugcuauuuuuaauuuccugugaggauagagacuugcaguuagacuca

SEQ ID NO: 267186 - RNA, 64 nt, hsa
uugauaucccaaguuggaagggaccccagauaccugugaggacugguugucucucuucgguggc

SEQ ID NO: 267187 - RNA, 64 nt, hsa
ugggcgagcugggcgagcugggcuggggagagccugugaggaccgagaggagaaaugagaagaa

SEQ ID NO: 267188 - RNA, 64 nt, hsa
gcagggccuacaacgaggggccuuugcgaugggcugugaggauggggguggugggaagaauugg

SEQ ID NO: 267189 - RNA, 64 nt, hsa
acuuaaugcaggaagaacaugacaaccaagcaaaugugaggagucuggugaccuggggcaacuu

SEQ ID NO: 267190 - RNA, 64 nt, hsa
cuuccgcuauagaauggaguguccagaaauagacugugaggaaggaugggccuugcugaagugu

SEQ ID NO: 267191 - RNA, 64 nt, hsa
ugcuuccccauuguuuccaucugaucagcuguggugugaggacuucucagacaaaggcaaggcc

SEQ ID NO: 267192 - RNA, 64 nt, hsa
ucgaccguggccgcuggcuggcuggacaggcgggugugaggaguugcagacccaaacccacgug

SEQ ID NO: 267193 - RNA, 64 nt, hsa
uagaacuccaagauguuccauaaguguuuuuacuugugaggaaugagaagccauccauggaaau

SEQ ID NO: 267194 - RNA, 64 nt, hsa
gucuuccuucuguagccauuaacugcugaauccaugugaggaagacaggcuucccuuccuuccc

SEQ ID NO: 267195 - RNA, 64 nt, hsa
aaggggggcaaugauaccuaccucacagggguguugugaggauuaaaugugaggaggauagugg

SEQ ID NO: 267196 - RNA, 64 nt, hsa
auaccuaccucacagggguguugugaggauuaaaugugaggaggauaguggcagaugagugaug

SEQ ID NO: 267197 - RNA, 64 nt, hsa
guuguacaucaugaugacugauggucuucaagguugugaggaaagccgucucccugcuugacuc

SEQ ID NO: 267198 - RNA, 64 nt, hsa
ggggggacggcgacagcgcggcucugugaguggcugugaggaugcugcacguccucagcagagu

SEQ ID NO: 267199 - RNA, 64 nt, hsa
acaaccagccaaaugcacuuuugugaaaauggggugugaggagugguucugcagcuugaguccu

SEQ ID NO: 267200 - RNA, 64 nt, hsa
aauuuagaauagccagggucuguaggcaucacauugugaggaagggagcuuucuggaaguacuu

SEQ ID NO: 267201 - RNA, 64 nt, hsa
ccuggcccuccuggugcccacucccgccagccccugccucgaggacugauacugcagugacugc

SEQ ID NO: 267202 - RNA, 64 nt, hsa
caugguccucauaucucccaugggaauccuguccugccucgaaggagcagccugggcagccauc

SEQ ID NO: 267203 - RNA, 64 nt, hsa
caggucuccaaguggaacccgguccagacagggcugccucgacuucaccuuucccccuaacuuc

SEQ ID NO: 267204 - RNA, 64 nt, hsa
gccucagcccuagacucccuccuccugccacuggugccucgaguagccauggcaacgggcccag

SEQ ID NO: 267205 - RNA, 64 nt, hsa
uggccugcugggaaccccgcagcccgugaagcagugccucgaggcaccggcgcugcagguacuu

SEQ ID NO: 267206 - RNA, 64 nt, hsa
uggagggaaggacauuacugaaccugucuugcugugccucgaaacucuggagguuggagcauca

SEQ ID NO: 267207 - RNA, 64 nt, hsa
gcaaaccaaggggguuuauagucaucugucgcauugccucgaguugcaguaauugaaaaaaugc

SEQ ID NO: 267208 - RNA, 64 nt, hsa
caugguggcccaccuggccugguuguccaagcugugccucgacacauccucauccccagcaugg

SEQ ID NO: 267209 - RNA, 64 nt, hsa
ugccucgcuggggcggucuuggaggccuggucucugccucgacgggagauccccgaucacuggc

SEQ ID NO: 267210 - RNA, 64 nt, hsa
uucuccuaauacaacccguaauagcauuuuugccugccucgaggcagaguuucccgugagcaau

SEQ ID NO: 267211 - RNA, 64 nt, hsa
ccggaaugagccuucgacccugaaauccuuggggugccucgaggacgacuggccgaaaagccgc

SEQ ID NO: 267212 - RNA, 64 nt, hsa
aaaccgaaacgugaccacgcacaaaggcagucacugccucgaggggugcagaccgcagaauuuu

SEQ ID NO: 267213 - RNA, 64 nt, hsa
uccuccuaggcgcucagaggccgcucugggggguugccucgaguccccccaccccuccccaccc

SEQ ID NO: 267214 - RNA, 64 nt, hsa
gaccuuaaaaaagcaagaaggccaugaccaucccugccucgaaacuugcaagucacuugucuga

SEQ ID NO: 267215 - RNA, 64 nt, hsa
ccauccuguucuauggaauaaagcgucgccucucugccucgaaccagucaaauggaguauugcg

SEQ ID NO: 267216 - RNA, 64 nt, hsa
ucuuugggccaggcauggccuaguaaguacaccaugccucgaaaauaaguccagaagcacugga

SEQ ID NO: 267217 - RNA, 64 nt, hsa
cgaggugcccgcucagcucagcaagguucucaacugccucgaguacccaccagaccaagaaggc

SEQ ID NO: 267218 - RNA, 64 nt, hsa
cuggucuugaacuccugaacucaagugauccaccugccucgaccucccaaaguacugggauuac

SEQ ID NO: 267219 - RNA, 64 nt, hsa
acgggacugcuugcugccucuccuuucuuccucuugccucgagguggaagcuguauagagcccg

SEQ ID NO: 267220 - RNA, 64 nt, hsa
agacgcuggccucagacacagacagcagucuugaugccucgacgggaccccuugaaggcugucg

SEQ ID NO: 267221 - RNA, 64 nt, hsa
guuuuggaaggauuccuuuuucuguagaauacuuugccucgauauauaagcauacagaugcacu

SEQ ID NO: 267222 - RNA, 64 nt, hsa
aaagcaauaacucaccaaagcucaacgcugccccugccucgaccuccaugggucucuucguguu

SEQ ID NO: 267223 - RNA, 64 nt, hsa
ugauggcaacacugaaggaacaguuacccugcuuugccucgaaagugucaucaauuuguaauuu

SEQ ID NO: 267224 - RNA, 56 nt, hsa
gcuuugccacugccgccuagacuugcugccucgacacgugggcuccccucuuccuc

SEQ ID NO: 267225 - RNA, 64 nt, hsa
cuggucuccaacuccugaccucaggugauccaccugccucgaccucacaaagugcugggauuac

SEQ ID NO: 267226 - RNA, 64 nt, hsa
ucagaacuaacccaggacucaguccugcuucuuuugccucgagugauuuuccucuguuuuucac

SEQ ID NO: 267227 - RNA, 64 nt, hsa
caucggggugcccgcgauggcccucaugaagccaugccucgacggcauucaggaagcccugcaa

SEQ ID NO: 267228 - RNA, 64 nt, hsa; identical to SEQ ID NO: 267225

SEQ ID NO: 267229 - RNA, 64 nt, hsa
gauugcucccuccuguguggacguugccuggcccugccucgaugccucucuggcgcaucaccug

SEQ ID NO: 267230 - RNA, 64 nt, hsa
ucagggcuacagcaguagggaggucagugcuucgugccucgauugaaggugaccucugccccag

SEQ ID NO: 267231 - RNA, 64 nt, hsa
ccugcugagccugcccccuggauuggcuguaauuugccucgaaguucagcaguucaucuucaug

SEQ ID NO: 267232 - RNA, 64 nt, hsa
guuccaguccaugugcauccugagcugugugaucugccucgaggcuaugaucugagcaagcagg

SEQ ID NO: 267233 - RNA, 64 nt, hsa
uaaugaguggacggcagacagcuauauuuaguggugccucgacacucacgaaccgccagcgugg

SEQ ID NO: 267234 - RNA, 64 nt, hsa
ugcugauaaugcugcagcccugcugguuugggcuugccucgaagauuuuauuaaggcacgaaga

SEQ ID NO: 267235 - RNA, 64 nt, hsa
agccuggcauccccagucuuugccuucuuccagcugccucgacacagcacuguggccugucccu

SEQ ID NO: 267236 - RNA, 56 nt, hsa
agaugggggaggagccauagagccucugccucgaugccguuuugcccccgcucuuu

SEQ ID NO: 267237 - RNA, 64 nt, hsa
uagaucccuguguuccagcguggagggacaaucgugccucgauggaugcgagugcggcggucuu

SEQ ID NO: 267238 - RNA, 64 nt, hsa
uggcaaacaaaacccgagcugagcaucaggaccuugccucgaauugucuuccaguauuacggug

SEQ ID NO: 267239 - RNA, 64 nt, hsa
ggcuggucucaaacuccuaaccucgugauccgccugccucgaccucccaaagugcugggauuac

SEQ ID NO: 267240 - RNA, 64 nt, hsa
acugcaaccuccaccuuccugguucaagcgauucugccucgaccucucaaguagcugggauuac

SEQ ID NO: 267241 - RNA, 64 nt, hsa
gcugguccagcugugcccagaucugucacugaugugccucgaaagauccgguguuuguggcucc

SEQ ID NO: 267242 - RNA, 64 nt, hsa
gguaguccucugcgucagggagcacuuuuuuguuugccucgagacuacucauuagcgcacuggc

SEQ ID NO: 267243 - RNA, 64 nt, hsa
gggcugcacugacauugaugccugggggaccuuuugccucgaggcugagcuggaaaaucuugaa

SEQ ID NO: 267244 - RNA, 64 nt, hsa
ggauggggugggggcgggcuccccuagggacaggugccucgagugcccgugccuggggucccgc

SEQ ID NO: 267245 - RNA, 64 nt, hsa
ggucccaaggucccugggaggacugggccccucaugccucgagcuuggcaaccgaaaacccgag

SEQ ID NO: 267246 - RNA, 64 nt, hsa
ggucugcauaaugaucccauuucagccugugcucugccucgauuguuguguuggacauuccggu

SEQ ID NO: 267247 - RNA, 64 nt, hsa
gguugaugaucuuugcagacaggcaagcaccuccugccucgaacuggcugcaaaggguaucagg

SEQ ID NO: 267248 - RNA, 64 nt, hsa
cuggucaccagauuguuuuguaaugcccgccccuugccucgauauugccaguuucuugugcaau

SEQ ID NO: 267249 - RNA, 64 nt, hsa
uggaagaggacccaagagagugccgugcugaggcugccucgaggucacugccuuccggagcugc

SEQ ID NO: 267250 - RNA, 64 nt, hsa
cauccaggcaccugccuauaccccacaucccuucugccucgaggccaagaugccuaaaaaagcu

SEQ ID NO: 267251 - RNA, 64 nt, hsa
aagucuuuuugaaguguuauuucauccagggaaaugccucgagccauagagccugaaaucaucu

SEQ ID NO: 267252 - RNA, 63 nt, hsa
aggagccaccucuccuuuaauuuauuucuucaaugccucgaccugccgcagggguccgggauu

SEQ ID NO: 267253 - RNA, 64 nt, hsa
gacagugaaagagaucugaccuaacuaucuaucuugccucgaaacugcccuuggucguuccuga

SEQ ID NO: 267254 - RNA, 64 nt, hsa
ugcccggucagcgcagccccagcccgcccaccccugccucgaguuaguuuuacaauuaaaacau

SEQ ID NO: 267255 - RNA, 64 nt, hsa
ccccagagcaauaaagucagcuggcuuucucaccugccucgacugggccucccuuuuugaaacg

SEQ ID NO: 267256 - RNA, 64 nt, hsa
cgcuggauccuagauccccaaccccagauccccaugccucgagcccuggaucuccaagcucagc

SEQ ID NO: 267257 - RNA, 64 nt, hsa
ugaggcaacuccuuuccccgcuucagcccucaacugccucgaguccugugaugguccagggaau

SEQ ID NO: 267258 - RNA, 64 nt, hsa
gguggcgggaccguucccaggagguaccagcaccugccucgaucuccucugagccucuucugcc

SEQ ID NO: 267259 - RNA, 64 nt, hsa
ggcuggucucgaacuccugaccucgugauccgccugccucgacuucccagagugcugggauuac

SEQ ID NO: 267260 - RNA, 64 nt, hsa
acacaugcagccccuggagggcagccucuuccugugccucgauggggugggugggagggcaucu

SEQ ID NO: 267261 - RNA, 64 nt, hsa
gaaggccggguggagcccauccaugcugugguguugccucgagggaagucgcuggaccagugug

SEQ ID NO: 267262 - RNA, 64 nt, hsa
uugcaggcggcccucagugcauccccacgaccccugccucgagggccgccugccuuagcaaugg

SEQ ID NO: 267263 - RNA, 64 nt, hsa
cgccuggguuucuuggccccagcugcccagcaggugccucgauucccugcccuugugaccuccc

SEQ ID NO: 267264 - RNA, 64 nt, hsa
ccugugucucccuaauauguaucaaagcaagcugugccucgaccaccuugggcacauauccuca

SEQ ID NO: 267265 - RNA, 64 nt, hsa
aguaguguaaacugcgucucggaugucugucuuuugccucgaagccacgauggaucgcugguuu

SEQ ID NO: 267266 - RNA, 64 nt, hsa
gguguggcucugcccuggaaagggggugaccucuugccucgaggggcccagggaagccugggug

SEQ ID NO: 267267 - RNA, 64 nt, hsa
uucuacaucagaucaaaacacuaaguugguguacugccucgaccuuuuuucagcucauccugga

SEQ ID NO: 267268 - RNA, 64 nt, hsa
agugggcuugauucugcaguaaaucuuuuacaacugccucgaaacacagaaaccuuuuuaaaaa

SEQ ID NO: 267269 - RNA, 64 nt, hsa; identical to SEQ ID NO: 53427

SEQ ID NO: 267270 - RNA, 64 nt, hsa; identical to SEQ ID NO: 53428

SEQ ID NO: 267271 - RNA, 64 nt, hsa; identical to SEQ ID NO: 53429

SEQ ID NO: 267272 - RNA, 64 nt, hsa; identical to SEQ ID NO: 53430

SEQ ID NO: 267273 - RNA, 64 nt, hsa; identical to SEQ ID NO: 53431

SEQ ID NO: 267274 - RNA, 64 nt, hsa; identical to SEQ ID NO: 53432

SEQ ID NO: 267275 - RNA, 64 nt, hsa; identical to SEQ ID NO: 53433

SEQ ID NO: 267276 - RNA, 64 nt, hsa; identical to SEQ ID NO: 53434

SEQ ID NO: 267277 - RNA, 64 nt, hsa
ggcaaaaucuuugguucaggguacuaguuguuuaaaaguugauucauauucuuaccuugugcug

SEQ ID NO: 267278 - RNA, 64 nt, hsa
ucagcaucuguuuaugguaguaggagaaauagccaaaguugaggauuuuauguauguuuuccug

SEQ ID NO: 267279 - RNA, 64 nt, hsa
ucauauuuauaugggggggagggcgcuggaugcaaaaguugaagaucgugaugcuaugauguua

SEQ ID NO: 267280 - RNA, 64 nt, hsa
aacuuauuaauauuuuugaaaaaugcacugggaaaaaguugaugucaauaacaguauaaaacag

SEQ ID NO: 267281 - RNA, 64 nt, hsa
ucuagaagcuccagugauaagagauguugacucuaaaguugauuuaaggccaggcauggugguu

SEQ ID NO: 267282 - RNA, 64 nt, hsa
aaauaaauaaauaaauaaauaaauaaauaaaaacaaaguugauuaagaaaggaaguauaggcca

SEQ ID NO: 267283 - RNA, 64 nt, hsa
uagaaucccaauuaacaaaauauacuuuaucuucaaaguugaugucauuuaaaauuuuuccguc

SEQ ID NO: 267284 - RNA, 64 nt, hsa
uauguuuaaucuguauuucuugcuuauuauauguaaaguugagcuucuuucuagauauuaggcc

SEQ ID NO: 267285 - RNA, 64 nt, hsa
uuacuuaccuuguaaauaacuuuaauaauauucaaaaguugacucuccuguggcucaugccaca

SEQ ID NO: 267286 - RNA, 64 nt, hsa
gggugacagagugagacuccaucucaaaaaaaaaaaaguugacucuacccccuaauuugguagg

SEQ ID NO: 267287 - RNA, 64 nt, hsa
uuuuaauuuugggaaauuuuaaaguaaaaguuucaaaguugaaagauuauagugaguacccuua

SEQ ID NO: 267288 - RNA, 64 nt, hsa
ugcaucauggaacgccacaggauuuuuacauuaaaaaguugaauauguuccugcauuucagcag

SEQ ID NO: 267289 - RNA, 64 nt, hsa
ggcaacagaacgagaucccaucucuuagaaaaacaaaguugauaguuaaagaacauaaguggau

SEQ ID NO: 267290 - RNA, 64 nt, hsa
ucuuaaauauccuuuuuguuccuaaaggagaggaaaaguugauuaacuucugguuugguuuaga

SEQ ID NO: 267291 - RNA, 64 nt, hsa
acuuccuuuagaaggaacuguuauaauuuauuuaaaaguugaaaaaccacccaagaugacuacc

SEQ ID NO: 267292 - RNA, 64 nt, hsa
guacuacgaucacagacacagacauacuuuuccuaaaguugaagcauuuguucccaggauuuau

SEQ ID NO: 267293 - RNA, 64 nt, hsa
gcgguguagguguugugagcuuuugcuguaagaaaaaguugagacuuuuguuuugcuuuguuug

SEQ ID NO: 267294 - RNA, 64 nt, hsa
caaguaaaaggaauaaaugugucaugcuuuuuaaaaaguugaugugcggaaaauguuuucuugg

SEQ ID NO: 267295 - RNA, 64 nt, hsa
agauauucuggacucagcagaagaauucucggcaaaaguugauaucgaaguugacagcccaaac

SEQ ID NO: 267296 - RNA, 64 nt, hsa
uuuggucaaaccaaugacaaaaccgccuuccacaaaaguugaaauaagaaacaagaguauuacu

SEQ ID NO: 267297 - RNA, 64 nt, hsa
uaaaagcacauuucauguguauucaacccuaaguaaaguugaaugaaacuuaacagaauggaaa

SEQ ID NO: 267298 - RNA, 64 nt, hsa
auuucuaagguugugcuaauucuuuugguugugaaaaguugaauuuuucuguugccuucguuuu

SEQ ID NO: 267299 - RNA, 64 nt, hsa
uuuuuuuuuuuucaaaaaggaaaguuuuuaauggaaaguugagccagaacuaaaccagggagcu

SEQ ID NO: 267300 - RNA, 64 nt, hsa
ggccacuccuggguuggagcccgauuuuauuuguaaaguugacagucgagcaaauguuccuauu

SEQ ID NO: 267301 - RNA, 64 nt, hsa
ugcacuucgcaacugacuucuuguccugggguuaaaaguugaagauauuuucugaugauauuaa

SEQ ID NO: 267302 - RNA, 64 nt, hsa
gguuaaaaguugaagauauuuucugaugauauuaaaaguugaagauauuucugcacuugggccc

SEQ ID NO: 267303 - RNA, 64 nt, hsa
gugcugucaugcugccugcuuucuggagcuguagaaaguugaaacaccuggcgcagauugcagc

SEQ ID NO: 267304 - RNA, 64 nt, hsa
uuccacccuugacugccaaaaaugugugaaauggaaaguugauggcagcagggccgacgauguc

SEQ ID NO: 267305 - RNA, 64 nt, hsa
gaauuaguguaugcuuccugaauaaaaaggagccaaaguugaucagaaugguggcgugcucauu

SEQ ID NO: 267306 - RNA, 64 nt, hsa
aaagggcauagcacagcaaucugcaacaauauguaaaguugauauugacuacaauaaaaaucca

SEQ ID NO: 267307 - RNA, 64 nt, hsa
uauuuaagcaugugguuuuaaaaauagacaguauuuuuuaaaaaucaaaaaaugacuugcaaau

SEQ ID NO: 267308 - RNA, 64 nt, hsa
uuuuuuaaaaaucaaaaaaugacuugcaaauuguuuuuuaaaaguaauuuugcauugcuuugaa

SEQ ID NO: 267309 - RNA, 64 nt, hsa
gagugaaggaggcaggugggaaaugguauuucuauuuuuaaauccagugaaauuaucuugaguc

SEQ ID NO: 267310 - RNA, 64 nt, hsa
aaauccagugaaauuaucuugagucuacacauuauuuuuaaaacacaaaaauuguucggcugga

SEQ ID NO: 267311 - RNA, 64 nt, hsa
gaggcagggaguuauuuuagauuaugggaaauaauuuuuaaagguauugguuaaauaacguuua

SEQ ID NO: 267312 - RNA, 64 nt, hsa
ggccucacuuuagaaugaaugagucaccuugugauuuuuaaauuuuuauuuuaauaaagcuaau

SEQ ID NO: 267313 - RNA, 64 nt, hsa
ugagugaaauauuuuaagccaaaaaaaaauucccuuuuuaaaaaaggggguuuaaauacuguug

SEQ ID NO: 267314 - RNA, 64 nt, hsa
uguuuuuguuuugauuuuuuuuuuguuuugauuuuuuuuaaacuaaagcuauauaaagcuugug

SEQ ID NO: 267315 - RNA, 64 nt, hsa
ugcugaaaauaaaacuuugcuauguauuuacucuuuuuuaaaagacaaaagcaaaaccagacuu

SEQ ID NO: 267316 - RNA, 64 nt, hsa
aguacacaggcaggcauuaucauucuucaccuacuuuuuaaauaguggcaacuugggauucauu

SEQ ID NO: 267317 - RNA, 64 nt, hsa
uguuucaaauguguauuaccaauguggguguaaauuuuuaaaaaaugauuauugauagaaguuu

SEQ ID NO: 267318 - RNA, 64 nt, hsa
gaaaaugauuguaauuuauuguucaugacuuuuuuuuuuaaauaaagugaguuucaacaaaaaa

SEQ ID NO: 267319 - RNA, 64 nt, hsa
uauaaggguugcugggcauuugaaggcaggaagauuuuuaaagauagauugagguugguuuaaa

SEQ ID NO: 267320 - RNA, 64 nt, hsa
ugcacuguugcacuuacuuaauacaaauaaauguuuuuuaaagcuuuuguaguauguuuuuaug

SEQ ID NO: 267321 - RNA, 64 nt, hsa
uuaguggugauuuggggaaggaaaguuaaugagguuuuuaaaauaagguuuucuaguuuugaga

SEQ ID NO: 267322 - RNA, 64 nt, hsa
uuuggugacaaaaaugaaggagcuuuguaaauuuuuuuuaaaauuaugaaucauaucaaguagu

SEQ ID NO: 267323 - RNA, 64 nt, hsa
gcacugucugaugcgucaacaaaauugagccauuuuuuuaaaguaauagauacuaauagauuau

SEQ ID NO: 267324 - RNA, 64 nt, hsa
uuaugcugcugugugguuuguuaaaucuaaaugauuuuuaaacuuuucucauagaaacuuaacu

SEQ ID NO: 267325 - RNA, 64 nt, hsa
gaaaccagucagaaaagacauauauuuccaugccuuuuuaaagaauuauuuuuaccuguuuuau

SEQ ID NO: 267326 - RNA, 64 nt, hsa
uuucuguccuggcagcauguuccagcucuugauguuuuuaaacuuuuuuuuagaagaaaaauua

SEQ ID NO: 267327 - RNA, 64 nt, hsa
ucuuaaaacacugaaugaauuuugaagcuuaauguuuuuaaaggcauaguuuuaucuuugacau

SEQ ID NO: 267328 - RNA, 64 nt, hsa
uacuuugaaaacaaaugucaugaaugauuuccaguuuuuaaagcuauauguuucacugcuucau

SEQ ID NO: 267329 - RNA, 64 nt, hsa
uaaagacgucucuuuuugguaauaacaaacguguuuuuuaaaaaagccugguuuuucucaauac

SEQ ID NO: 267330 - RNA, 64 nt, hsa
aaaagccugguuuuucucaauacgccuuuaaagguuuuuaaauuguuucauaucuggucaaguu

SEQ ID NO: 267331 - RNA, 64 nt, hsa
auggugcucaccaaacgaaggguaucagcuauuuuuuuuaaaauucaaaaagaauaucccuuuu

SEQ ID NO: 267332 - RNA, 64 nt, hsa
uuggcaucauguugaagcaccgaaagauaaaugauuuuuaaaaggcuauagaguccaaaggaau

SEQ ID NO: 267333 - RNA, 64 nt, hsa
guuuuuugaaagaccccaauuuaagccuugcuuauuuuuaaauuauuuccauucagugauguug

SEQ ID NO: 267334 - RNA, 64 nt, hsa
uuuccauuggaaauggaauucauugccuuaggucuuuuuaaauaguguauuauuaucguugggg

SEQ ID NO: 267335 - RNA, 64 nt, hsa
uuuuuucuagauuguuaaaauuggcaaaugaacuuuuuuaaaaaucaucuuccauguugcaguu

SEQ ID NO: 267336 - RNA, 64 nt, hsa
acagcaaaggccauaaccuuuugggauuuuuuuuuuuuuaaaauacuuuagggacuguuguaau

SEQ ID NO: 267337 - RNA, 64 nt, hsa
cgaaaauggcaaacuacuacuacuacuguucaguuuuuuaaaaguuuugaaaugcugcacuuac

SEQ ID NO: 267338 - RNA, 64 nt, hsa
aacacuuggauuuacaccagucuuuuguguuugcuuuuuaaaauaaagugcucguauuuguauu

SEQ ID NO: 267339 - RNA, 64 nt, hsa
aucaaacuuagaggugugaccuuaaauuuaacuuuuuuuaaaaacugggaggucaauaaaauuu

SEQ ID NO: 267340 - RNA, 64 nt, hsa
auaaaggauuauaaaauuuuuuuuuuuuuuuuuuuuuuuaaauuucuacuuaagggcaaguaau

SEQ ID NO: 267341 - RNA, 64 nt, hsa
ucauuuuucagccaucaguucaagagccaaugccuuuuuaaaauaaagcuucuguggucuuguu

SEQ ID NO: 267342 - RNA, 64 nt, hsa
ccuagcucuuugucaaagauggucuguagaaauguuuuuaaagauuagggaugcuguacuuuuu

SEQ ID NO: 267343 - RNA, 64 nt, hsa
gaauuguugcaguguuggagaugccauuuucaccuuuuuaaaaagaugcauuuuauuugcaggu

SEQ ID NO: 267344 - RNA, 64 nt, hsa
ugucugccauucugaauaugcuuauuaaaauauuuuuuuaaacauauuugccuacauaauacug

SEQ ID NO: 267345 - RNA, 64 nt, hsa
agaauauccugaugcaucuguuucaccauuuugauuuuuaaaguaugcuguagcauuucuuaau

SEQ ID NO: 267346 - RNA, 64 nt, hsa
caauugcuugaauuacugauauuuuagaauagacuuuuuaaaaugccauauguaauuuuaugca

SEQ ID NO: 267347 - RNA, 64 nt, hsa
acauguauagauugcauuucuuagguguuuuaauuuuuuaaauauauuuauguuuuaaaaauuu

SEQ ID NO: 267348 - RNA, 64 nt, hsa
cugaagaaacaacccaucguucuuuuuuuucucuuuuuuaaaaaguccuauaagaucuguuuuu

SEQ ID NO: 267349 - RNA, 64 nt, hsa
aaauaaggaucaauuguaauauucauucaaaagguuuuuaaaaguaaguuuuaaggaguauuuc

SEQ ID NO: 267350 - RNA, 64 nt, hsa
uuuuaaauuuucucuaauaguccucaucauaaacuuuuuaaaggaaaauaagcaaacuaaaaag

SEQ ID NO: 267351 - RNA, 64 nt, hsa
auuucugaccaaucaaguacacuaaauuagaauauuuuuaaaguauguaacauucccaguuuca

SEQ ID NO: 267352 - RNA, 64 nt, hsa
uggauuugcccauauuuauguaggugguuuuaauuuuuuaaauggugauuaguguuaaaaauca

SEQ ID NO: 267353 - RNA, 64 nt, hsa
aauauaaaaauauuaaaagaacauaggcaggcuuuuuuuaaauuuggcuuuuuucuuuccuuuu

SEQ ID NO: 267354 - RNA, 64 nt, hsa
uaaauaaauagaaccacugagacaauaauguauuuuuuuaaaguggcaaaugugguuuucuuuu

SEQ ID NO: 267355 - RNA, 64 nt, hsa
ugcugcuaaguaguucucuguauuaaaggagauauuuuuaaaacaggguacaacccccugcugc

SEQ ID NO: 267356 - RNA, 64 nt, hsa
augcuucaucaaaacaucuuguucauguuuuauguuuuuaaaaaaggcauuugaaugaauguuu

SEQ ID NO: 267357 - RNA, 64 nt, hsa
cugguacuguacgauccaaaacauuguacccagcuuuuuaaaagagagaaauuaucacuacaac

SEQ ID NO: 267358 - RNA, 64 nt, hsa
acugcuuucauucccacaaaaccaguauuacuuuuuuuuaaaaaaagaaagaaauuggaaaucu

SEQ ID NO: 267359 - RNA, 64 nt, hsa
uuaucuucacagaaaauaaaagguguuaauuugcuuuuuaaaacaaauuuaauuaucacauuuu

SEQ ID NO: 267360 - RNA, 64 nt, hsa
gugugagccaccgugcucagccacuagcuuugguuuuuuaaacauagauuauauuccucaagau

SEQ ID NO: 267361 - RNA, 64 nt, hsa
uuuucagugcaauuaaaccgagagaugucuuguuuuuuuaaaaagaauaguauuuaauagguuu

SEQ ID NO: 267362 - RNA, 63 nt, hsa
gcuuuaucaacuuuuaaacauuaauaaacugauuuuuuuaaagaucccuuugugaagagcauu

SEQ ID NO: 267363 - RNA, 64 nt, hsa
uaaugugguaacuuugucaauuucccauuuuauuuuuuuaaauaaauauaugaucuaaaagcca

SEQ ID NO: 267364 - RNA, 64 nt, hsa
ucaguggaaagauaaacuaaguuuuaauguuauuuuuuuaaauuuaagcaaaauuuauuucugu

SEQ ID NO: 267365 - RNA, 64 nt, hsa
ggcaaaggaagugccagcuucucuggggaacuuguuuuuaaauccaaagacuugaaccacauuc

SEQ ID NO: 267366 - RNA, 64 nt, hsa
ucugcauuuuuuagaagcauuuuacccauuuauuuuuuuaaacauucaagaacugcugacguac

SEQ ID NO: 267367 - RNA, 64 nt, hsa
cacuucuaugaccaggccuuaagggaaggucaguuuuuuaaaaaaccaaguagugucuuccuac

SEQ ID NO: 267368 - RNA, 64 nt, hsa
cugcauuguuguagucuucccaaaguuugcccuauuuuuaaauucauuauuuuugugacaguaa

SEQ ID NO: 267369 - RNA, 64 nt, hsa
agaauccauaucugcgugaaaacaccaaguauucuuuuuaaaugaagcaccaugaauucuuuuu

SEQ ID NO: 267370 - RNA, 64 nt, hsa
aaguauucuuuuuaaaugaagcaccaugaauucuuuuuuaaauuauuuuuuaaaagucuuucuc

SEQ ID NO: 267371 - RNA, 64 nt, hsa
uaaaugaagcaccaugaauucuuuuuuaaauuauuuuuuaaaagucuuucucucucugauucag

SEQ ID NO: 267372 - RNA, 64 nt, hsa
acagccuaccaggaacauguuguguuuucuuuauuuuuuaaaaucauuauauugaguuguguuu

SEQ ID NO: 267373 - RNA, 64 nt, hsa
aucuuacuaucaguagguuuugcauugauauuucuuuuuaaauaaacuacuaguucuuuauauu

SEQ ID NO: 267374 - RNA, 64 nt, hsa
acuugccagugucauguuuuauuuuuguuauagauuuuuaaauuauuuccuucaagaucaauuc

SEQ ID NO: 267375 - RNA, 64 nt, hsa
ucucucaugacuucauggacccuccucugccaguuuuuuaaaucagaucacccuccauguuguu

SEQ ID NO: 267376 - RNA, 64 nt, hsa
gggccucauaccaacagccucuccuuguacuauauuuuuaaaacuggaacuaugaacuucaucc

SEQ ID NO: 267377 - RNA, 64 nt, hsa
aaauuagcugcacguauauacauauauauauuucuuuuuaaauuucauauugauggcaguaccu

SEQ ID NO: 267378 - RNA, 64 nt, hsa
uccuuuuuauuucauaagacugcuaggaagugauuuuuuaaaauuaggacuccuuaagaauaaa

SEQ ID NO: 267379 - RNA, 64 nt, hsa
gugaauggaaccaaugugcaagauacauacugcauuuuuaaaauagugucucagcuaaauggaa

SEQ ID NO: 267380 - RNA, 64 nt, hsa
auacauguacuuaguaugugugguaucaggauauuuuuuaaacugugauaauacaacagauagc

SEQ ID NO: 267381 - RNA, 64 nt, hsa
augggaaaggcauucagaaauuaugguuucuaccuuuuuaaaaaguagaugggauugugucaau

SEQ ID NO: 267382 - RNA, 64 nt, hsa
auaacuuauugagcacuuuuaguagugauaacuguuuuuaaacuugccuaauaccuuucuuggg

SEQ ID NO: 267383 - RNA, 64 nt, hsa
agcccgguuuugacugguugaaaccggacauugguuuuuaaauuuuuugucaguuuauguggag

SEQ ID NO: 267384 - RNA, 64 nt, hsa
gaaaauuuuuaucaauuaacugacaaauaguuucuuuuuaaaguaguuucuuccaucuuuauuc

SEQ ID NO: 267385 - RNA, 64 nt, hsa
cauagaguugauugucuagugaggaagacaagcauuuuuaaaaaauaaauuuaaacuuacaaac

SEQ ID NO: 267386 - RNA, 64 nt, hsa
ugcuucuguauuuccuuggauuuuccugaaaguguuuuuaaauaaagaacaauuguuagaugcc

SEQ ID NO: 267387 - RNA, 64 nt, hsa
agaauuuuguuuauuuuccugucaaugaaagcaauuuuuaaagauaccagugggacagauuugg

SEQ ID NO: 267388 - RNA, 64 nt, hsa
caauuuuuaaagauaccagugggacagauuugguuuuuuaaaaaucucauguguucaaauuaac

SEQ ID NO: 267389 - RNA, 64 nt, hsa
acuuccugauacaaauguagggauauauacuguauuuuuaaacauuucucaccaacuuucuuau

SEQ ID NO: 267390 - RNA, 64 nt, hsa
uaaacauuucucaccaacuuucuuauguguguucuuuuuaaaaauuuuuuuucuuuuaaaauau

SEQ ID NO: 267391 - RNA, 64 nt, hsa
caaaccuuuucuaacauugguuuuuuuuuuuuaguuuuuaaauucuuccucuucuuuuuauuau

SEQ ID NO: 267392 - RNA, 64 nt, hsa
agguuaauaaagaaccagauaauuaauuaguuacuuuuuaaaucuugcaauuguaugugugauu

SEQ ID NO: 267393 - RNA, 64 nt, hsa
uaugugugauuauggaguuuugaaaacguuacauuuuuuaaaucuuaaaacugaaaacuuguuu

SEQ ID NO: 267394 - RNA, 64 nt, hsa
auauuuauaacucauauaaaaauuauauuuagaauuuuuaaacauguacaaagggcuacauuuu

SEQ ID NO: 267395 - RNA, 64 nt, hsa
uuuuuuauuauggugcagcuuuuuuuuaauuauguuuuuaaaauuauacaguugaaaaauaugc

SEQ ID NO: 267396 - RNA, 64 nt, hsa
augguagaaucuacuccuugguagucacuugucauuuuuaaagaaaugaugacaauccucuugg

SEQ ID NO: 267397 - RNA, 64 nt, hsa
gccugacagguuacccuugagggcuugugucuacuuuuuaaaagucaaugguuuuuuuucuugu

SEQ ID NO: 267398 - RNA, 64 nt, hsa
guaguuuauaguuagagcucuauuuuguuaugguuuuuuaaacuuuuaaguccugcucuauuuu

SEQ ID NO: 267399 - RNA, 64 nt, hsa
gggcagguuuauguugauguuuacccacuacaauuuuuuaaaaauauaagcucacaugccuuuu

SEQ ID NO: 267400 - RNA, 64 nt, hsa
uucaaaggcaacacaagcucgcaacucuaagauuuuuuuaaaccacaaaaacccugguuagcca

SEQ ID NO: 267401 - RNA, 64 nt, hsa
ucaguguguaaguguuuguuuccaggauauuuucuuuuuaaaugucuuucuuauauggguuuua

SEQ ID NO: 267402 - RNA, 64 nt, hsa
uggaauuucugguuuguaagguggucacuguucuuuuuuaaaauauuuguaauauggaaugggc

SEQ ID NO: 267403 - RNA, 64 nt, hsa
acuuuuguauggauucagaauauacuaaauuaacuuuuuaaaacacaacuuuuaaaaaauguau

SEQ ID NO: 267404 - RNA, 64 nt, hsa
agcuagaaaguguauguguggcauuuguuuucacuuuuuaaaacaucccuaacugaucgaauau

SEQ ID NO: 267405 - RNA, 64 nt, hsa
gaagucucacugauagagguucuuuauugcucauuuuuuaaaaaauggacucuugaaaucuguu

SEQ ID NO: 267406 - RNA, 64 nt, hsa
cuuaaguuaaggauguuuggcuuuuuucuuuaauuuuuuaaaaaccauuuuccuauguuaggag

SEQ ID NO: 267407 - RNA, 64 nt, hsa
ugcauaucccuucuuucaaaaaauguugcuuuuuuuuuuaaaggaauuuuaauauauuccuuua

SEQ ID NO: 267408 - RNA, 64 nt, hsa
gggacaguuaaauaucuuaaaauaucuaaaacauuuuuuaaagcacuuagauugucuuacguau

SEQ ID NO: 267409 - RNA, 64 nt, hsa
guuaucauuuuugagaaaucuacaccaaagugguuuuuuaaaauuacauaacuaaaaauaaacc

SEQ ID NO: 267410 - RNA, 64 nt, hsa
aaauguucuucccuguuauuuacauucugguggguuuuuaaaauucuuaccuccaucaugcaau

SEQ ID NO: 267411 - RNA, 64 nt, hsa
agauacaaaauguuuacaguguuggcacuuagaguuuuuaaauucaaguacaugaaauucagua

SEQ ID NO: 267412 - RNA, 64 nt, hsa
uaacgagggcaacagggagcaccugucuggauuguuuuuaaaccuccauacucaagcugucucu

SEQ ID NO: 267413 - RNA, 64 nt, hsa
aaaaaucuaguggguugaccuuuaaaugcaacaguuuuuaaaauauauugcugcauuuuauaga

SEQ ID NO: 267414 - RNA, 64 nt, hsa
uucuucgugaacauagaguuuggggccgaaaauguuuuuaaaguauguguuugaguuaaauaua

SEQ ID NO: 267415 - RNA, 64 nt, hsa
uaaucaucaggacuaucucacccucccacuccuguuuuuaaaacucagaauucuuuccuaagag

SEQ ID NO: 267416 - RNA, 64 nt, hsa
aaaauauaguuugguaauuuuuuuuuccaguugauuuuuaaaaagaacugcuguacagagcuug

SEQ ID NO: 267417 - RNA, 64 nt, hsa
ggagccuugcuauuucaguggguauaauuuaaacuuuuuaaagaaaaucuguacuuuuauaaag

SEQ ID NO: 267418 - RNA, 64 nt, hsa
cacuuuaaaaauauagaauauauggucuaauaguuuuuuaaagcuuuuggacuaaaguauucca

SEQ ID NO: 267419 - RNA, 64 nt, hsa
caaauggaaaauuucugaaaugcuggauuaucuauuuuuaaacaagcaguugacuuaaaacuuu

SEQ ID NO: 267420 - RNA, 64 nt, hsa
gcauuaucuuuaguuacuugaagaguuucuaguuuuuuuaaaauacaguuuauguuaaaauaau

SEQ ID NO: 267421 - RNA, 64 nt, hsa
cuguuuaguuuuguacuauugguguguuggugaauuuuuaaacugugugcuaacugcaauaaau

SEQ ID NO: 267422 - RNA, 64 nt, hsa
ucggguuguccaauucuguaacauucaucuccauuuuuuaaaaagguuucucugacggccccac

SEQ ID NO: 267423 - RNA, 64 nt, hsa
aucgauacagauggauaaacugccaagaaccagauuuuuaaaaggccgcaaaaaaucuuuuccu

SEQ ID NO: 267424 - RNA, 64 nt, hsa
acagaaaccuuuuauuuuuauuucugacucuuauuuuuuaaaaaauuugcgccucgguaucugg

SEQ ID NO: 267425 - RNA, 64 nt, hsa
acuugugauuggcugcaggaagaaacuuuuuuauuuuuuaaaucuugaccaacagaaaccuuuu

SEQ ID NO: 267426 - RNA, 64 nt, hsa
auuuauagaaaauauuuucuguuuuaaucuuuucuuuuuaaacaaggacucauacuuaaaaaaa

SEQ ID NO: 267427 - RNA, 64 nt, hsa
cacaaaaugaaacaaaagaaacaauuuaaguauuuuuuuaaaaaguuucacgucuucgccaauc

SEQ ID NO: 267428 - RNA, 64 nt, hsa
guauuacccuaaacuguuuaaauaaagagcucuauuuuuaaagaaaaaagguacaauugaaugg

SEQ ID NO: 267429 - RNA, 64 nt, hsa
cgugagccaccgcgcccagccaaaccuuacuauuuuuuuaaagaauuuuuuccagaguuuaauu

SEQ ID NO: 267430 - RNA, 64 nt, hsa
cggguuuucauuuacucuggacuggugaaaauauuuuuuaaagccagugcucuaagaccucagc

SEQ ID NO: 267431 - RNA, 64 nt, hsa
gugagaguuuuuaaaguguaagggaaaaauuaauuuuuuaaaaaacaccaugcuuggagggugg

SEQ ID NO: 267432 - RNA, 64 nt, hsa
uaguguggcaguuucuuuuauacauaggugagaguuuuuaaaguguaagggaaaaauuaauuuu

SEQ ID NO: 267433 - RNA, 64 nt, hsa
gaaaggucauuuuguugcauuuccccauuucuuguuuuuaaaagaccaacaaaucucaagcccu

SEQ ID NO: 267434 - RNA, 64 nt, hsa
uuuggcauauaggaagcacgcuggugcuaaguauuuuuuaaaugguuauguaagcaaagcugaa

SEQ ID NO: 267435 - RNA, 64 nt, hsa
ggcaacacagggagacccccucucuacaaaaacauuuuuaaaaaauuagcuggguguggugaug

SEQ ID NO: 267436 - RNA, 64 nt, hsa
uacaggcaugaaccaccacgccuggccuaaaauguuuuuaaauaacuguacuuguacucacuca

SEQ ID NO: 267437 - RNA, 64 nt, hsa
acuaaaaauauuaaagccucaugugugaaauaaauuuuuaaaaagauuuaucuggauuuagaga

SEQ ID NO: 267438 - RNA, 64 nt, hsa
ucuuuuaugauuggugcaaauuggcuaaagugcauuuuuaaauuuccucuacuuaauuuguuuu

SEQ ID NO: 267439 - RNA, 64 nt, hsa
uguaucugcgaaacuauacuuguauuaaaugugcuuuuuaaauaaaagcucguaacacaacuaa

SEQ ID NO: 267440 - RNA, 64 nt, hsa
uacauuagcugcuuaaaaaagcauugaguuaauuuuuuuaaauaucaacuaaaauaucauaguu

SEQ ID NO: 267441 - RNA, 64 nt, hsa
aguagaauguagggaaaaacuuuugcccgacugauuuuuaaaaaggaaaaaaaaaauguuuuac

SEQ ID NO: 267442 - RNA, 64 nt, hsa
auucugccacauuuauugauaaacagugaaggaauuuuuaaaaaauuuuuaagaauuguuuguc

SEQ ID NO: 267443 - RNA, 64 nt, hsa
auuauaacugauuuacauuuucagcuauauuuacuuuuuaaaugcuugaguuucccauuuuaaa

SEQ ID NO: 267444 - RNA, 64 nt, hsa
gcuaguuuuuuuuuuucuucuaaaaaaugucagguuuuuaaaaucauuuaccuuauuaaaauga

SEQ ID NO: 267445 - RNA, 64 nt, hsa
gauuucaugacuccgaaguauuuuacagaaacauuuuuuaaauaagggaaauauuuuauauacc

SEQ ID NO: 267446 - RNA, 64 nt, hsa
uuggguuacuguuuaaggaaaguugaucugggccuuuuuaaaaacauaauuauauacuuuagaa

SEQ ID NO: 267447 - RNA, 64 nt, hsa
caucaagugguguuuguuagaaauaaacuagagauuuuuaaacucugaucuaauguucauuuuu

SEQ ID NO: 267448 - RNA, 64 nt, hsa
ucuuaaaaaaauccaguacagugcaugaagcauauuuuuaaagaaguuggugucuuacuugguc

SEQ ID NO: 267449 - RNA, 64 nt, hsa
uguauaaucugaaguggaaauuguuugcuuagaguuuuuaaaaaccuagucuuugaaaagcagu

SEQ ID NO: 267450 - RNA, 64 nt, hsa
uauaguaaaauauaugcucacgaaucaaugcugauuuuuaaaauauguauaaucugaaguggaa

SEQ ID NO: 267451 - RNA, 64 nt, hsa
ccaugguguacuuugcaagaaauaagcacucuaauuuuuaaaguaaaucucuuauuuuagcaaa

SEQ ID NO: 267452 - RNA, 64 nt, hsa
uagauuuuuauuuuguauauguagaauauuauaauuuuuaaaaggacuauugaugauagaagaa

SEQ ID NO: 267453 - RNA, 64 nt, hsa
uauuuaaugucuuugcaacuuuaugcugggauuguuuuuaaaaaaacuuuaaugaggaaagcua

SEQ ID NO: 267454 - RNA, 64 nt, hsa
auugagaccuauaauucaccaauaacuguuuauauuuuuaaaagcaauauuuaaugucuuugca

SEQ ID NO: 267455 - RNA, 64 nt, hsa
uagaaauggaaauuuugcuaucaacaauaaaauuuuuuuaaaguagugagugcuauuuuggagu

SEQ ID NO: 267456 - RNA, 64 nt, hsa
acagacacgagccaccucaccuagccugaugagauuuuuaaaaaauauuuucucuguacuuuuc

SEQ ID NO: 267457 - RNA, 64 nt, hsa
uuucuuuuuuuccuuuuuaaggucuuucaguacuuuuuuaaauauuuucuauuuuaagacugau

SEQ ID NO: 267458 - RNA, 64 nt, hsa
guuugggguacagauuggggguugugccauacuguuuuuaaaguucaugaucaucuggaaugau

SEQ ID NO: 267459 - RNA, 64 nt, hsa
gcaaaagaauuagauuucuuuguuuuuguuuuauuuuuuaaauuguuguaaaaauuauuauagg

SEQ ID NO: 267460 - RNA, 64 nt, hsa
agaacagacuuccuccuaagaaggagaaaaggcauuuuuaaaggacuaugauugauaaaguauu

SEQ ID NO: 267461 - RNA, 64 nt, hsa
uuuggcucuuggcuuaauguuauuaacgccacauuuuuuaaauagacaaaaauaugagauuaaa

SEQ ID NO: 267462 - RNA, 64 nt, hsa
uagugauuagugaugaugagugauuuuuauaugcuuuuuaaaugcauauaugucuucuuuugaa

SEQ ID NO: 267463 - RNA, 64 nt, hsa
gugcaggugucuuggucaugauaaauugugauucuuuuuaaaaauuuuuuccaaaaacaauuag

SEQ ID NO: 267464 - RNA, 64 nt, hsa
cagaguacuauucuaucuagauguguaaguguuuuuuuuaaaaucacauggaacgguuuuuuuu

SEQ ID NO: 267465 - RNA, 64 nt, hsa
uaagcucuuauuuuucaauuggcaauucaguuaauuuuuaaauguuuacauaauggccagaagg

SEQ ID NO: 267466 - RNA, 64 nt, hsa
uuuaaaguugugaauaagauagguggauucguauuuuuuaaaguucaguugacuuuccccacca

SEQ ID NO: 267467 - RNA, 64 nt, hsa
uugugccucacuggaauuaucuuuaaauucuguauuuuuaaaguugugaauaagauagguggau

SEQ ID NO: 267468 - RNA, 64 nt, hsa
uuggaugggaugcaugacauacagguagcucucuuuuuuaaaauauagguaucucuuugcauau

SEQ ID NO: 267469 - RNA, 64 nt, hsa
gaaaguuuuaagaauuguuccuuggggaaaaauuuuuuuaaaauucaccuagaaucauagggcc

SEQ ID NO: 267470 - RNA, 64 nt, hsa
cagauuaagugcuuuugucauuugagcugacaaguuuuuaaaacuucagugcuuccuaaauguu

SEQ ID NO: 267471 - RNA, 64 nt, hsa
gcaacauagugagaucccaucucaaaaaacauuauuuuuaaaauuagccugguggcucacgccu

SEQ ID NO: 267472 - RNA, 64 nt, hsa
gguacuuuaaauguagcagccacugacauuucuuuuuuuaaaaaaaauuugagaagucuacuuc

SEQ ID NO: 267473 - RNA, 64 nt, hsa
uaacacaauucucugaugcggugcuguacagucauuuuuaaaucucuugcuaacauuuuauugg

SEQ ID NO: 267474 - RNA, 64 nt, hsa
gacuaaugguggcuuaaaugcacgaaugucuuuuuuuuuaaaacugucauuuuuuacugucuuu

SEQ ID NO: 267475 - RNA, 64 nt, hsa
auauaaagaccuauaaaucauuaagacaacugaguuuuuaaaaauggacaaaauccaugaacaa

SEQ ID NO: 267476 - RNA, 64 nt, hsa
cugccuguggaguagccauucuuuauucuuuuacuuuuuaaaauaauaacaaucacaaaggaaa

SEQ ID NO: 267477 - RNA, 64 nt, hsa
guaucuuucuaaucuguuuuaucauugcuacagguuuuuaaaaaagaaccuuucacuagcuagc

SEQ ID NO: 267478 - RNA, 64 nt, hsa
auaaguuuuaauauuuuguggagcagagggaugguuuuuaaaugugcuuauggaaaggacccaa

SEQ ID NO: 267479 - RNA, 64 nt, hsa
ugguaugaaagguaaugugauuauugcagggguguuuuuaaaucuuggguauaaauucuagggu

SEQ ID NO: 267480 - RNA, 64 nt, hsa
gugauauguacauauucaaacacauuuuuuaacuuuuuuaaauuuugaugugaaguuauaguuu

SEQ ID NO: 267481 - RNA, 64 nt, hsa
gcaugauguagagagcuguugauuuguuucuguuuuuuuaaaggaaaacuauuuguaagauguu

SEQ ID NO: 267482 - RNA, 64 nt, hsa
uguuacagggcuucuuauucuuuguaauguacucuuuuuaaaucccuuuaguuuacccuuuuug

SEQ ID NO: 267483 - RNA, 64 nt, hsa
ucauuacauacuaugccagauuacaaaauacuuauuuuuaaaaugaaaucuauauauugacuuu

SEQ ID NO: 267484 - RNA, 64 nt, hsa
uuugcuauggaggcuccauguucaaggcaauggcuuuuuaaaucuuggcuaucuaaaauuuuuu

SEQ ID NO: 267485 - RNA, 64 nt, hsa
uguggaauucccuagcaauuuauuuagacuuaauuuuuuaaauucaagcuuacuguauuaguca

SEQ ID NO: 267486 - RNA, 64 nt, hsa
uguuaaagccuaugaaugccuucuuaaaaucauguuuuuaaaugcauaaaauauauaggauuac

SEQ ID NO: 267487 - RNA, 64 nt, hsa
aaacagaaaagaaaauauaguuugauucuucauuuuuuuaaauuugcaaaucucaggauaaagu

SEQ ID NO: 267488 - RNA, 64 nt, hsa
uuuccaauggaacccuuguuuuuuaauaaucgacuuuuuaaaugugaucaggacuauaauauug

SEQ ID NO: 267489 - RNA, 64 nt, hsa
guaacagucguagauaccagcuuuuuuuuuuuuuuuuuuaaauuggcuuuggccaguagcuaaa

SEQ ID NO: 267490 - RNA, 64 nt, hsa
ggauaaggggugggggagaaaaaaucacuguuuguuuuuaaaaagcaaaucuuucuguaaacag

SEQ ID NO: 267491 - RNA, 64 nt, hsa
uguuucuguuuaccagcuucccagcaacuuuccuuuuuuaaaauauuaaaaauuuaauucaggu

SEQ ID NO: 267492 - RNA, 64 nt, hsa
ccugucuccugaaugauggucugggugccaccuguuuuuaaacucuuaaaccuggaacuccuua

SEQ ID NO: 267493 - RNA, 64 nt, hsa
uuugcuuuucucucuuccacaaaauuggaagcuuuuuuuaaaaauguuuuccccacaagucauc

SEQ ID NO: 267494 - RNA, 64 nt, hsa
guuuccccacuuuuauuuuuuaaaauuaaguaauuuuuuaaagaaggcacuuuuaaaauuaaca

SEQ ID NO: 267495 - RNA, 64 nt, hsa
ugaaagucaccugaggaaguuuccccacuuuuauuuuuuaaaauuaaguaauuuuuuaaagaag

SEQ ID NO: 267496 - RNA, 64 nt, hsa
gcccagaugauaaacacugagcugccaaaacauuuuuuuaaauacacccgaggagcccaagggg

SEQ ID NO: 267497 - RNA, 64 nt, hsa
uucucuggccucuccaguccugcuuacuccucuauuuuuaaagugccaaacaaauccccuuccu

SEQ ID NO: 267498 - RNA, 64 nt, hsa
gauaaauaaaauccaaggcaauuuucaaacaauuuuuuuaaacuuuggaauguguuuaaauuua

SEQ ID NO: 267499 - RNA, 64 nt, hsa
uuugcuuuauuccgauuauagaauaaaguaauucuuuuuaaaaauauuuuuuggggcaaaguua

SEQ ID NO: 267500 - RNA, 64 nt, hsa
uuggauaucacagcaacauugaaaugcuaaaaaguuuuuaaacacucucaauuucuaauucacc

SEQ ID NO: 267501 - RNA, 64 nt, hsa
auccccugcccauccucccuuuuaccuccucucuuuuuuaaacaccuguuuaucccaaccuuuu

SEQ ID NO: 267502 - RNA, 64 nt, hsa
agaugugagccaccgugccuagccaaggaugagauuuuuaaaguauguuucaguucugugucau

SEQ ID NO: 267503 - RNA, 64 nt, hsa
gaguuuguuguuuuuuguuuuguuuuguuuuguuuuuuuaaagacggagucucgcucugucacc

SEQ ID NO: 267504 - RNA, 64 nt, hsa
aaauuaaucgccacccucuuccaaauuauagaauuuuuuaaaaacaagcuguggcccuuuccac

SEQ ID NO: 267505 - RNA, 64 nt, hsa
uccaaccaaucacaccccugccuuuuuuuuuuuuuuuuuaaagaaaaagacaaaagaaagugga

SEQ ID NO: 267506 - RNA, 64 nt, hsa
ccaaaacaugacccauaguauuaaauacauaucauuuuuaaaaauaaaaaaaaacccaaaaaua

SEQ ID NO: 267507 - RNA, 64 nt, hsa
ucuaagauugcucuaacgucuagugaaaaaaauauuuuuaaaauuucagccaaauaaugcauuu

SEQ ID NO: 267508 - RNA, 64 nt, hsa
uauuacuuggcacaauuuauuucuacacagaaaguuuuuaaaaugaauuuuaccguaacuauaa

SEQ ID NO: 267509 - RNA, 64 nt, hsa
uuuuuuucucucccagguuucuuaagaauaauguuuuuuaaaggaggcuuuuugcccaucaaga

SEQ ID NO: 267510 - RNA, 64 nt, hsa
uugucuuuuugggugcauuccucagcacacuuuuuuuuuaaaccuuuuuguuuuguuuuguuug

SEQ ID NO: 267511 - RNA, 64 nt, hsa
cugcugagacacuaaacuuuaaccuucugaugacuuuuuaaaaugccucaaaugugcacaugua

SEQ ID NO: 267512 - RNA, 64 nt, hsa
cuggugaacacugugagccgcagaugugacuuuuuuuuuaaagucaucucuucagcaauccaga

SEQ ID NO: 267513 - RNA, 64 nt, hsa
aggauucugucacaagucuuauugaaaaguagauuuuuuaaaaaaaaaaaaucuuagucccugu

SEQ ID NO: 267514 - RNA, 64 nt, hsa
ucaauaugcuuguauaaaacacuguucacuguuuuuuuuaaaaaaaaaacuugauuuguuauua

SEQ ID NO: 267515 - RNA, 64 nt, hsa
aaauauucugugucaagcacuguggguuuuaauauuuuuaaaucaaacgcugauuacagauaau

SEQ ID NO: 267516 - RNA, 64 nt, hsa
uuaaauuagacauuaccaguaauuucaugucuacuuuuuaaaaucagcaaugaaacaauaauuu

SEQ ID NO: 267517 - RNA, 64 nt, hsa
ggaugaacaauguauacaaugcacuuuuaugaaguuuuuaaaaauaaaggaaaacaaaaaacuu

SEQ ID NO: 267518 - RNA, 64 nt, hsa
guuucaucaaugcaguucucacgaaaguauuuacuuuuuaaaaauaacugagauauuauuuuaa

SEQ ID NO: 267519 - RNA, 64 nt, hsa
caugcuuauaaaagacuuuuaaugaaauguugccuuuuuaaaauaauuauacuugcacaugaaa

SEQ ID NO: 267520 - RNA, 64 nt, hsa
auaaugaagcagaucaacuuaaaggauaauaaaauuuuuaaagaaaagauauucuaauguacuc

SEQ ID NO: 267521 - RNA, 64 nt, hsa
aagaagcacaguugaaguccuagaauaauggauuuuuuuaaaaaaaaaaaguuguuaguuugaa

SEQ ID NO: 267522 - RNA, 64 nt, hsa
cuuaagacuaguggacauacuuacuauguucuccuuuuuaaaguauucuuauuucuuugugugg

SEQ ID NO: 267523 - RNA, 64 nt, hsa
ucuuauccuaagauucaauauuacguuauacaaauuuuuaaaauugaaauuaggaauuugaauu

SEQ ID NO: 267524 - RNA, 64 nt, hsa
ucuggcauaauauuugaagugcacauuuuugugauuuuuaaagauuauuuagugcuaacuuuua

SEQ ID NO: 267525 - RNA, 64 nt, hsa
uccaugccugccacuuuguccgucucuuuuuuuuuuuuuaaaguaauauuuuuuagaaauacau

SEQ ID NO: 267526 - RNA, 64 nt, hsa
gggaggauuccaccgaucuucacuucuagcagguuuuuuaaacgugacccuuggcuguauuucc

SEQ ID NO: 267527 - RNA, 64 nt, hsa
cgauuucucccgcaauuuguuccuucuuuuuaccuuuuuaaaaaucuguuagaagaaaaaaagc

SEQ ID NO: 267528 - RNA, 64 nt, hsa
cuauguacaaacauacuggaagaaaaccagcuuguuuuuaaaacuuaacacaaucagaaauuuu

SEQ ID NO: 267529 - RNA, 64 nt, hsa
gcuggucgggaauaccugggaaguuuguuaaaauuuuuuaaaaauguuuuaagauuuuuggguc

SEQ ID NO: 267530 - RNA, 64 nt, hsa
uccgucucaaaaaaaaaagaaaaaagaauagucauuuuuaaacuaccuaucucaugcaaugaaa

SEQ ID NO: 267531 - RNA, 64 nt, hsa
gggugacaaaugccaauagauaugugaguuaauuuuuuuaaauaucuccgugaguuguaaauag

SEQ ID NO: 267532 - RNA, 64 nt, hsa
gguuuggggacugguuguuauaaaaugcaauuuuuuuuuaaaucuaagcauuucauuauguguu

SEQ ID NO: 267533 - RNA, 64 nt, hsa
aggcuauaaaacaaaaaaagguugcuguuuucuauuuuuaaauaaaccaaaaaaaaacagaaaa

SEQ ID NO: 267534 - RNA, 64 nt, hsa
ggaggccaaaaagucaaugugagcuucucacagguuuuuaaagcuccacuaaaaauaauuaucc

SEQ ID NO: 267535 - RNA, 64 nt, hsa
cuaagucuuuguacuaaagcauuugcuauaauuauuuuuaaaaaaacaaacagaugaaaaccuc

SEQ ID NO: 267536 - RNA, 64 nt, hsa
gauuacaggcgggagccacugcacauggcagcauuuuuuaaaaauucaguuuuaagaucucugg

SEQ ID NO: 267537 - RNA, 64 nt, hsa
uuuauauucuaaauccuaguaaaauugacagugauuuuuaaauauaaugcaucuuccuuugucu

SEQ ID NO: 267538 - RNA, 64 nt, hsa
acuuugaauauuucaagaauauagauaagucuaauuuuuaaaugcuguauauauggcuuucacu

SEQ ID NO: 267539 - RNA, 64 nt, hsa
caauaaugaaggacaaaugaauccugaaggaagauuuuuaaaaauguuuuguuucuucuuacaa

SEQ ID NO: 267540 - RNA, 64 nt, hsa
uuaguaucuucucagauacagaccguuuuaugauuuuuuaaaaaguaaaaguucuaaaaugaag

SEQ ID NO: 267541 - RNA, 64 nt, hsa
gaugaacgaaagcccccucuucaacuccucucacuuuuuaaagcauugauauuaguaucuucuc

SEQ ID NO: 267542 - RNA, 64 nt, hsa
auuauuuaauccuagcucuuuguuauucaccagcuuuuuaaaaaaguguuugaaaauuauacau

SEQ ID NO: 267543 - RNA, 64 nt, hsa
auaugcuuaugaaacagauuuaugagaaaaguuuuuuuuaaauaaauuauuuaauccuagcucu

SEQ ID NO: 267544 - RNA, 64 nt, hsa
uucagagugcuucugaaguacaguuuaaaaacacuuuuuaaaaaguggaguaaaagugaggcac

SEQ ID NO: 267545 - RNA, 64 nt, hsa
gcuuguugccccguaaaaggguuaacagcacaauuuuuuaaaaauaaauuaagaaguauuuaua

SEQ ID NO: 267546 - RNA, 64 nt, hsa
guuguuauuguauguuguuacugaaguacuuagauuuuuaaaauuucaaauccuaaaucacuuc

SEQ ID NO: 267547 - RNA, 64 nt, hsa
uauaucaggugcagcuggcuuugauuaaaggccauuuuuaaaacuuaaaaacucaacaccucac

SEQ ID NO: 267548 - RNA, 64 nt, hsa
gcagaagcuuuauuuuuugaacaggaaaacauguuuuuuaaauucacauguuuguaugaguacu

SEQ ID NO: 267549 - RNA, 64 nt, hsa
uuuucaacauuuuggcacaugaaagccugacaaguuuuuaaaagggcagaagcuuuauuuuuug

SEQ ID NO: 267550 - RNA, 64 nt, hsa
agaucuuuuuauucagaguuuuaauaauuguaacuuuuuaaaugucuauagcacugaaguuauu

SEQ ID NO: 267551 - RNA, 64 nt, hsa
auuuaaaugguugcuucuucauagaauugucugcuuuuuaaaacuggaaguacaggauuuucuu

SEQ ID NO: 267552 - RNA, 64 nt, hsa
auuuuuguuucauuuuuuauuuuuccuugcuuuguuuuuaaacaugaauauaaugcuuacuuca

SEQ ID NO: 267553 - RNA, 64 nt, hsa
uaaaaucuuuagacaauauuuaaaaucuugauuuuuuuuaaaugucagcagauacaauuuggaa

SEQ ID NO: 267554 - RNA, 64 nt, hsa
acacaaaauuugcuauuuucacuuaaaguaagcauuuuuaaaggauuuauuuuagaauacaauc

SEQ ID NO: 267555 - RNA, 64 nt, hsa
gaugccuaaauagaagcaaguuuaaagagcuauauuuuuaaacaugaacaaacucccaugggag

SEQ ID NO: 267556 - RNA, 64 nt, hsa
caaagacuaauucaagaaguugcaggauacacaauuuuuaaaaaucucauuucuacaucuuagc

SEQ ID NO: 267557 - RNA, 64 nt, hsa
acuuauguuauuuuguuaugcauuuacaacuccauuuuuaaauaaaguguuucuggaacuuuau

SEQ ID NO: 267558 - RNA, 64 nt, hsa
aaguaacucuauacacuucaagacuuuacaggauuuuuuaaauccuguauuguuggaucaauua

SEQ ID NO: 267559 - RNA, 64 nt, hsa
gauuaaacuagacagauaguuuagguggaguauauuuuuaaaacucagaacauguauauugguc

SEQ ID NO: 267560 - RNA, 64 nt, hsa
gaaaauuuugguggaguuaaagugaaaugaguaguuuuuaaacauuuuuccuguccuuuuuuug

SEQ ID NO: 267561 - RNA, 64 nt, hsa
ugaaacauuuuugauacauaacagaccucagucuuuuuuaaaaauuaauauauuuucaggcgua

SEQ ID NO: 267562 - RNA, 64 nt, hsa
cuucagaaugggaagagauagucaagauuuuuuuuuuuuaaagccauguggccuaacuugauac

SEQ ID NO: 267563 - RNA, 64 nt, hsa
ugggggcuagggaagagccugccagauuuucacauuuuuaaaauguucuagucauuuugagaaa

SEQ ID NO: 267564 - RNA, 64 nt, hsa
cuuuuaucucaguuauuugcccaucacaagcacauuuuuaaaauguugcuuuguguguguuuga

SEQ ID NO: 267565 - RNA, 64 nt, hsa
gccugaaagguccauuaggacaucacucaugggauuuuuaaaaagccucuuuccaggaauggaa

SEQ ID NO: 267566 - RNA, 64 nt, hsa
uuguaguuucagaaguuuuuuuguuuugguuuuuuuuuuaaagaaaugguagaaaauuugauaa

SEQ ID NO: 267567 - RNA, 64 nt, hsa
gacagucacugccacuuugcacauuuugauuuuuuuuuuaaacaaacauuguguugacauuaag

SEQ ID NO: 267568 - RNA, 64 nt, hsa
uccaaguuuccaaacaacagaaagucauuccuucuuuuuaaaauggugcuuaaguuccagcaga

SEQ ID NO: 267569 - RNA, 64 nt, hsa
cacuuguacgcuguaaccucaucuacuucugauguuuuuaaaaaaugacuuuuaacaaggagag

SEQ ID NO: 267570 - RNA, 64 nt, hsa
gguacuucuacuaaauuguugucuuguuuuuuauuuuuuaaauaaacugacaaaugacaaaaug

SEQ ID NO: 267571 - RNA, 64 nt, hsa
aaaaauguauagaaaaaucaugucugugaguucauuuuuaaauguacuugcucagcucaacugc

SEQ ID NO: 267572 - RNA, 64 nt, hsa
ccucuagcagcuugguagccuaguacagguuguuuuuuuaaaaaaggaaaagcaggaaggagga

SEQ ID NO: 267573 - RNA, 64 nt, hsa
uuauccauuaaaguuacaucuucauguaucacaauuuuuaaaguugaaaagcaucccaguuaaa

SEQ ID NO: 267574 - RNA, 64 nt, hsa
aauggcaaauacuucuaauuuuuuucccuaaacauuuuuaaaagugaaauaugggaagagcuuu

SEQ ID NO: 267575 - RNA, 64 nt, hsa
uaaguauguugguuaauaggaauccuuuuuuuuuuuuuuaaagacuaaaugugaaaaaauaauc

SEQ ID NO: 267576 - RNA, 64 nt, hsa
ucuaagauggaaccuuucuuucuuucuuucuuuuuuuuuaaauuuuguauuuuccauccaacag

SEQ ID NO: 267577 - RNA, 64 nt, hsa
ugucaauugugaaaggaaaauguuaggaguaugguuuuuaaacuugggcuucauuuuaaacuuu

SEQ ID NO: 267578 - RNA, 64 nt, hsa
gguuuuuaaacuugggcuucauuuuaaacuuuuuuuuuuaaacccaguuauuucacuugauuug

SEQ ID NO: 267579 - RNA, 64 nt, hsa
ucuguuaaaaaugguauacaugaagucacauacuuuuuuaaaggaacacucagaacauucuguc

SEQ ID NO: 267580 - RNA, 64 nt, hsa
uguuuuuucuuuuucuuuucuuuuuuuuuuuuuuuuuuuaaaaaagcaccuuuuuuuguuguuu

SEQ ID NO: 267581 - RNA, 64 nt, hsa
aguuccuuggcuacuguuuuucuuuuacuucaguuuuuuaaaaaucucaaaugaaaaagucuuc

SEQ ID NO: 267582 - RNA, 64 nt, hsa
aguauuguaauauguaaaguaagcccaacaaaaauuuuuaaaaauuugaugauccccaauauau

SEQ ID NO: 267583 - RNA, 64 nt, hsa
agcuacuaggugaaaugcaaaacaaccaucaauuuuuuuaaacucaauaauuuugugaaaaaaa

SEQ ID NO: 267584 - RNA, 64 nt, hsa
auuaacauuucauuuaagcuuuuaaaauaucaauuuuuuaaauagcucccauuuacccaaaaua

SEQ ID NO: 267585 - RNA, 64 nt, hsa
agauaacugaccaaguguuuucuuagaaccaaaguuuuuaaaguugcuaagauauauuugccug

SEQ ID NO: 267586 - RNA, 64 nt, hsa
guuuuuguugaagcucuagcuuaagaagaaacuuuuuuuaaaaagacuguuuggggauucuuuu

SEQ ID NO: 267587 - RNA, 64 nt, hsa
aguagccucucugggcccaauaaaacaacacacauuuuuaaaaaauauggguauugauguccgg

SEQ ID NO: 267588 - RNA, 64 nt, hsa
cuauucacaggaaacugauaagauauauguuauuuuuuuaaaugagcuagggcaauauguuuug

SEQ ID NO: 267589 - RNA, 64 nt, hsa
aggcaugagccaccgugcccagccucaaaaauauuuuuuaaaagaaaagagaaaauaauucuuc

SEQ ID NO: 267590 - RNA, 64 nt, hsa
uauuuuacuuuauugauaaugacaaaaagaauauuuuuuaaaccccaucaaaauagauuucaau

SEQ ID NO: 267591 - RNA, 64 nt, hsa
acuuauacaaaaugguaguacuacuguguugugguuuuuaaacauuaaacauguaaaguuauau

SEQ ID NO: 267592 - RNA, 64 nt, hsa
cuaaugaugacauucaguucucuuuuguuuuuauuuuuuaaaaacucagguguaauuauuaucu

SEQ ID NO: 267593 - RNA, 64 nt, hsa
uuaaaaaaaaaaaagaaggcuaaaaaauuaccucuuuuuaaauuaugugcaaaauaauucuggc

SEQ ID NO: 267594 - RNA, 64 nt, hsa
gccuuuuucugagaugcucacuuuauuaucccuauuuuuaaaguacacaauuguuuuaccuguu

SEQ ID NO: 267595 - RNA, 64 nt, hsa
guggcgucucccucgcagagcccuucucguuucuuuuuuaaacuaaucaccauauuguaaauuu

SEQ ID NO: 267596 - RNA, 64 nt, hsa
gauuuuuuauuauuauucaaaaacauaacugaguuuuuuaaaagaggagaaaauuuauaucugg

SEQ ID NO: 267597 - RNA, 64 nt, hsa
uaguagaauuuuauugaaaggccuagguauuaauuuuuuaaaugagugcuuuaacuuaaaacag

SEQ ID NO: 267598 - RNA, 64 nt, hsa
caacaauuucucuuguaaauggaaugguuugggguuuuuaaauaagcauuaacuaacaaccuuu

SEQ ID NO: 267599 - RNA, 64 nt, hsa
guagccugucaacuaaauuugaguguuaacggucuuuuuaaagugcauuuaaauacaaaccagg

SEQ ID NO: 267600 - RNA, 64 nt, hsa
uacuuauuucuuucaaaacauuuuugguuuuugguuuuuaaaauuuuuauuaaacaauugcugu

SEQ ID NO: 267601 - RNA, 64 nt, hsa
acauuaaugaauuggugcugucaaaauauaguaauuuuuaaauuuguuaauaaugaaaacccuu

SEQ ID NO: 267602 - RNA, 64 nt, hsa
gcaucuaacugccagugccauugucaaaacuuauuuuuuaaaucguuguacauuucuuauuaaa

SEQ ID NO: 267603 - RNA, 64 nt, hsa
uguauaauugccaauugauuguaacuauuauuuauuuuuaaaugaaaguguaagaaugcuuucu

SEQ ID NO: 267604 - RNA, 64 nt, hsa
uuguagguuuccuuaugcuguuuuuacugugcacuuuuuaaaauuagguuuuaauuucaguaug

SEQ ID NO: 267605 - RNA, 64 nt, hsa
cuucuuauuauaguugaaggcauucuccagauucuuuuuaaaagauuuguucauauuucucucu

SEQ ID NO: 267606 - RNA, 64 nt, hsa
gcaaucauuuaguggcauagaugcagccacuuguuuuuuaaauagaaguggcugucauacguga

SEQ ID NO: 267607 - RNA, 64 nt, hsa
guuuaaaaccuuuauugucucuccuuagucuaauuuuuuaaauauggauuaugcuugaauuacu

SEQ ID NO: 267608 - RNA, 64 nt, hsa
auuccauuacuauguggcuuagggauuuauuuguuuuuuaaaaucaaccauguuagcugggauu

SEQ ID NO: 267609 - RNA, 64 nt, hsa
gcuacuuaaauuuccaauaauuaaaaauuuaaaauuuuuaaauuagaauugccaauacuucuac

SEQ ID NO: 267610 - RNA, 64 nt, hsa
agauuuuaaaguagaaauaaauauguauuccauguuuuuaaaagauuacuuucuacuuuguguu

SEQ ID NO: 267611 - RNA, 64 nt, hsa
uaaauuauuccauauuuucuuuucagugaaaaauuuuuuaaauggaagacuguucuaaaaucac

SEQ ID NO: 267612 - RNA, 64 nt, hsa
ugauauaaagaaaacuuuuuugugcuaaaaauacuuuuuaaaaucaauuuuguugauuguagua

SEQ ID NO: 267613 - RNA, 64 nt, hsa
ucugacaagauaaaggaagucaccaaaauuucuuuuuuuaaauuguaucuaauccucaacaaca

SEQ ID NO: 267614 - RNA, 64 nt, hsa
agguacuaucugugaaguuacacuuuuuuuuuuuuuuuuaaagguagagaugugugugugugua

SEQ ID NO: 267615 - RNA, 64 nt, hsa
aauccagucuuaugaaguauuguuauuaaaugucuuuuuaaaaagagaaauauaaacauauauu

SEQ ID NO: 267616 - RNA, 64 nt, hsa
auaaacauauauuuuuacuauuaaaauauucaguuuuuuaaaugaaguagaacuugaguucaug

SEQ ID NO: 267617 - RNA, 64 nt, hsa
caugccgaacuuucuugugacaaauugucuggauuuuuuaaaaaaggaaaaagcaagaaugaau

SEQ ID NO: 267618 - RNA, 64 nt, hsa
ggagauucuguuaaauauuuuggaacucuuuuuuuuuuuaaauuauaguauuuccucuaaaaaa

SEQ ID NO: 267619 - RNA, 64 nt, hsa
uggagagagagaauaaagagauuauuuuucauuauuuuuaaaugguuguuuuuguuuuaauuug

SEQ ID NO: 267620 - RNA, 64 nt, hsa
uacacagaggaaauaacuuaggcacuuucuguuuuuuuuaaaaaaauaauaaggucucauggcu

SEQ ID NO: 267621 - RNA, 64 nt, hsa
uauucuaauuuuauauauagagaaagugaccuauuuuuuaaaaaaaucacacucuaaguucuau

SEQ ID NO: 267622 - RNA, 64 nt, hsa
uaauuagauuuucuugcaguuuuuuuauggcauuuuuuuaaagaugcccuaaguguugaagaag

SEQ ID NO: 267623 - RNA, 64 nt, hsa
ccuuucuuauuugcaauaaaagguauugagccauuuuuuaaaugacauuuuugauaaauuaugu

SEQ ID NO: 267624 - RNA, 64 nt, hsa
cucugugaugauuaacaguaugucaccacuucauuuuuuaaaaaggaucacgucuaaugcccau

SEQ ID NO: 267625 - RNA, 64 nt, hsa
cugaaugcuuuuuguuggauuucguaggguauuuuuuuuaaaauagggucuugcuauguugccc

SEQ ID NO: 267626 - RNA, 64 nt, hsa
uuuuauguguauuguaaguagcaguuaaauuauuuuuuuaaaagcaauuucaguuuuaaucacu

SEQ ID NO: 267627 - RNA, 64 nt, hsa
caaucuuggagucuagguugccuugucucuccuauuuuuaaauaagugaaauuugggagauugu

SEQ ID NO: 267628 - RNA, 64 nt, hsa
aagcugccuuaguuuauuuuuagagauuacagaauuuuuaaacagggagacgugugauauacuc

SEQ ID NO: 267629 - RNA, 64 nt, hsa
acucccucccuucccuacuauugccucucugaccuuuuuaaauuauuuuuaauaccaaaagagu

SEQ ID NO: 267630 - RNA, 64 nt, hsa
cuuuccccaagaaucuccuugggacuuugacuuauuuuuaaagcuguguuggagcucaucuugu

SEQ ID NO: 267631 - RNA, 64 nt, hsa
aaaguaugccucccguggguauacguuuuuaccuuuuuuaaaaaacauuuuuguagaaaaaaua

SEQ ID NO: 267632 - RNA, 64 nt, hsa
gguagagaaacagaugacaaaucucugaaagagguuuuuaaaacuuuugauccaacugcuucac

SEQ ID NO: 267633 - RNA, 64 nt, hsa
guuuuguaacugguuuaccucuauaguuuauuuauuuuuaaauuauaaacacuuuucagcugcu

SEQ ID NO: 267634 - RNA, 64 nt, hsa
uauuuguguaaaugaagcauuugaaugucauaucuuuuuaaaguauuuuauuguauacuguauc

SEQ ID NO: 267635 - RNA, 64 nt, hsa
guguucaucaugacuuuggcgauuuuuaacaaaauuuuuaaagacccagugagagucuguagug

SEQ ID NO: 267636 - RNA, 64 nt, hsa
uugaaugaaagcagugcccuugagaagggauuuuuuuuuaaauauacaguaaaauauuucgugg

SEQ ID NO: 267637 - RNA, 64 nt, hsa
ugccuaguucccuuuuuuuuucuuuuuuuacuuuuuuuuaaacguuuguaaaaaccucuuugag

SEQ ID NO: 267638 - RNA, 64 nt, hsa
uggcuuccaauaaguaucuuaggaacuuauuuccuuuuuaaaaaauauuuuuuaaauuuuuaaa

SEQ ID NO: 267639 - RNA, 64 nt, hsa
uaucuuaggaacuuauuuccuuuuuaaaaaauauuuuuuaaauuuuuaaaauuugauuuuaaau

SEQ ID NO: 267640 - RNA, 64 nt, hsa
gaacuuauuuccuuuuuaaaaaauauuuuuuaaauuuuuaaaauuugauuuuaaauuucaaaua

SEQ ID NO: 267641 - RNA, 64 nt, hsa
uacuacauuaaaaaguguugauuaauagaugaaauuuuuaaauuaauuuuuuaaaacaugccau

SEQ ID NO: 267642 - RNA, 64 nt, hsa
aguguugauuaauagaugaaauuuuuaaauuaauuuuuuaaaacaugccauacauuguaucaca

SEQ ID NO: 267643 - RNA, 64 nt, hsa
acuuucuauuuuuuaccugugaaauaacagugacuuuuuaaaauggugacaguguuggcaagga

SEQ ID NO: 267644 - RNA, 64 nt, hsa
guuugucaucuuuaaaaauacagcaauaugugacuuuuuaaaaaagcugucaaauaggugugac

SEQ ID NO: 267645 - RNA, 64 nt, hsa
uuuuggaguaggagguucccuccucaauuuuguauuuuuaaaaguacaugguaaaaaaaaaaau

SEQ ID NO: 267646 - RNA, 64 nt, hsa
uguaugcguauauaagcaaauauguaaucuuuauuuuuuaaauaaaugggaucauauuauauau

SEQ ID NO: 267647 - RNA, 64 nt, hsa
uucuauuuaguauuuucagagaaaauugaagguuuuuuuaaacaucacuggauuucuugauuga

SEQ ID NO: 267648 - RNA, 64 nt, hsa
ugaaaauuuauucuuaugagacguauaguauucauuuuuaaaugcaugauuguacauuauguau

SEQ ID NO: 267649 - RNA, 64 nt, hsa
auuugcaguacuguguucuucagcuagaggcagcuuuuuaaauaaugcaaguguauuuauuagc

SEQ ID NO: 267650 - RNA, 64 nt, hsa
ggucccuuuuccuuggauguguaguuauaugaucuuuuuaaauguacagauauuuugcuauaaa

SEQ ID NO: 267651 - RNA, 64 nt, hsa
uaaaccaaugugaauucaaaaaagagaaggaaacuuuuuaaauucaauuuagaguacauaaaaa

SEQ ID NO: 267652 - RNA, 64 nt, hsa
acuaaaacuacaugaguuucauguuagaaaagaauuuuuaaacaaucuucagauggcuugaaca

SEQ ID NO: 267653 - RNA, 64 nt, hsa
uugaauuccaaauucaccuagcaauaaaaucuaauuuuuaaaaaguauauaaauauaaaaugua

SEQ ID NO: 267654 - RNA, 64 nt, hsa
aaaaaaauuauugcaaucucaaguuaauggaauauuuuuaaaucccacauucagaguuuaaaac

SEQ ID NO: 267655 - RNA, 64 nt, hsa
gaauuuuuuucuggauuuacuauauaacucuuauuuuuuaaaagaucauucuguucuuucaagg

SEQ ID NO: 267656 - RNA, 64 nt, hsa
aaaacaacugguagaauuauuuaaacacuuuagauuuuuaaauaauauacauggcuuuaauuuu

SEQ ID NO: 267657 - RNA, 64 nt, hsa
uuuacacuuauauuuucacaguuaauugaacauauuuuuaaacaacuguaguuuugggcaacuu

SEQ ID NO: 267658 - RNA, 64 nt, hsa
caugcauugucuuagcucugagguuaauuuaccauuuuuaaauuuuauuguaaagaaguguaau

SEQ ID NO: 267659 - RNA, 64 nt, hsa
cggaaucccuagggcuagagccuagaaaucucacuuuuuaaaaugcuuccaagguaagucugau

SEQ ID NO: 267660 - RNA, 64 nt, hsa
uuuguauuugacuuuauuuccuuuauucaaaucauuuuuaaaaacuuacauuuugaacaaacac

SEQ ID NO: 267661 - RNA, 64 nt, hsa
gaaggaggacaaggcccauggguggguguugagguuuuuaaaguguggucaggaaaggccccac

SEQ ID NO: 267662 - RNA, 64 nt, hsa
uucucuuuguuauuauaaugugugauuaaaugcuuuuuuaaauugcuaagggaaaauaacaaag

SEQ ID NO: 267663 - RNA, 64 nt, hsa
acuuaacuuacuauuucaaagggaaguauauuucuuuuuaaagaaucuuuuuaagauuaaaaau

SEQ ID NO: 267664 - RNA, 64 nt, hsa
ugacuuagaagauaucauugccauguagguuuuauuuuuaaaagucuugagcucuucuuaaaua

SEQ ID NO: 267665 - RNA, 64 nt, hsa
ugccucuuuguuuuucaauagauuauucugccauuuuuuaaaggaaagggaaaaugaaaacagc

SEQ ID NO: 267666 - RNA, 64 nt, hsa
uuuuaaaggaaagggaaaaugaaaacagcaugucuuuuuaaacauugaaaagaaauauggaggc

SEQ ID NO: 267667 - RNA, 64 nt, hsa
auucuauuuauuugagguuaauugaaguuaauaauuuuuaaauuuuuuucuaauuuuaugccuu

SEQ ID NO: 267668 - RNA, 64 nt, hsa
aaugauuucccaaaagccauaccuuaaagauaacuuuuuaaauucugaagagacaugccaaugu

SEQ ID NO: 267669 - RNA, 64 nt, hsa
agagacaugccaaugucaaacuaaacauguucuguuuuuaaaccaacaaacauguuacuauuca

SEQ ID NO: 267670 - RNA, 64 nt, hsa
auaagcuguauauucaccaguguggcacucaugguuuuuaaauaagauuaguauuaucuguuua

SEQ ID NO: 267671 - RNA, 64 nt, hsa
uauuaauggcacuauaaaccaaugguaaugguaauuuuuaaacuugcuaaauauugagaaacua

SEQ ID NO: 267672 - RNA, 64 nt, hsa
aagagaaaaguaaaauauuucuuaugccuauuuuuuuuuaaaucaaaagggagagaacaaaagc

SEQ ID NO: 267673 - RNA, 64 nt, hsa
ggacuacaggggcccgccaccacaccuggcuaauuuuuuaaaaauauuuuuaguagagacaggg

SEQ ID NO: 267674 - RNA, 64 nt, hsa
caaucuugcaacacuauccuguuucucagaacaguuuuuaaaugccaaucauagaggguacugu

SEQ ID NO: 267675 - RNA, 64 nt, hsa
uucuucaaccuucaaaacuaucucaucugucagauuuuuaaaacuccaacacagguuuuggcau

SEQ ID NO: 267676 - RNA, 64 nt, hsa
ccacuuuaucacauguacagaucacaaauaaauuuuuuuaaauacaaaaugaacauuuauuuag

SEQ ID NO: 267677 - RNA, 64 nt, hsa
agcuaugcagaaaaauuuagcuuaugcuuccauauuuuuaaauuuuguuuuuuaaguuuugcac

SEQ ID NO: 267678 - RNA, 64 nt, hsa
ccuuuuaguaauaaaaugacuugaaaucauauuauuuuuaaaagcccuuugcuucuuucauuac

SEQ ID NO: 267679 - RNA, 64 nt, hsa
uuauaaucuccucuaaaacaaccucugcauguuuuuuuuaaauaaagcacuuucugucaaauaa

SEQ ID NO: 267680 - RNA, 64 nt, hsa
caagauggugaaaccccgucucuauuaaaaauauuuuuuaaaaauuaacugagcgugguggugg

SEQ ID NO: 267681 - RNA, 64 nt, hsa
guaaauugaugggagaaaugaggaaaagaaaaucuuuuuaaaaaugauuucaagguuugugcug

SEQ ID NO: 267682 - RNA, 64 nt, hsa
ucaguaaaccaaucccuugaguuauauaacaagauuuuuaaauaaauguuauuguccucaccuu

SEQ ID NO: 267683 - RNA, 64 nt, hsa
auauuaacaauuuaacagagaaucucuagugaauuuuuuaaaugaaagaaguuguaaggauaua

SEQ ID NO: 267684 - RNA, 64 nt, hsa
uuuccagcuugccuguuuuugaguauguuugauguuuuuaaaauuuugucuucucuguggaaga

SEQ ID NO: 267685 - RNA, 64 nt, hsa
acagcaauuaacuuuaagccuccuuuuagagauauuuuuaaaacuuguuuaaaauuuuugugca

SEQ ID NO: 267686 - RNA, 64 nt, hsa
cauauuggggaagcagugauuuuaaaaccucaaguuuuuaaacaugauuuauauguucuguaua

SEQ ID NO: 267687 - RNA, 64 nt, hsa
auuuauauguucuguauaauguucaguuuguaacuuuuuaaaaguuuggauguauagagggaua

SEQ ID NO: 267688 - RNA, 64 nt, hsa
ggaaauacuguaugguuuuguuuuguuuuguugguuuuuaaagauuuuuguuuguuuauugaau

SEQ ID NO: 267689 - RNA, 64 nt, hsa
guacggcuggcuacaacugcuccauccgugccucuuuuuaaaguucaaacucacaggugacucu

SEQ ID NO: 267690 - RNA, 64 nt, hsa
cagacugcaaaaggccuauuuuaacuauugauuuuuuuuaaaaaaaauugucuuugaauguauu

SEQ ID NO: 267691 - RNA, 64 nt, hsa
aaaccgaacacaacucagaaacuuggaaucguuuuuuuuaaaaaugccucugagcaacccauau

SEQ ID NO: 267692 - RNA, 64 nt, hsa
uauuuuaaaaguuuuaucuuaaauugauuaaaacuuuuuaaaaagcuuugguauuaaaagaggu

SEQ ID NO: 267693 - RNA, 64 nt, hsa
aaaaaaacuucaacguaagacuguguaagauuuguuuuuaaaccguacacuguguuuuuuugua

SEQ ID NO: 267694 - RNA, 64 nt, hsa
uguugacauucugaaugcuucuaaguaaauacaauuuuuaaaaaaccguaugagggaacugugu

SEQ ID NO: 267695 - RNA, 64 nt, hsa
cacauuuuaacaguaccugugccugagaauuuaauuuuuaaaagacuuugauguguuuuuguau

SEQ ID NO: 267696 - RNA, 64 nt, hsa
uuuaaagaagucucuuaauucugaugcuagguuguuuuuaaaaccacuaugcaaagaacucacc

SEQ ID NO: 267697 - RNA, 64 nt, hsa
aaguggccucaaaggcacuuaauuugauuuuuauuuuuuaaaugcugucaaaguuacaguuuac

SEQ ID NO: 267698 - RNA, 64 nt, hsa
uauaucaaugucagccuauuuugauuaacaaauguuuuuaaaguauuauugguuauagaaacaa

SEQ ID NO: 267699 - RNA, 64 nt, hsa
auauauauauaguacucuaauacugcaagaagguuuuuuaaacuucccacuuuauuuuuuauac

SEQ ID NO: 267700 - RNA, 64 nt, hsa
agucacugcagcaacgccuuguguuuguuucauuuuuuuaaaacccacacaaagccgcugucuc

SEQ ID NO: 267701 - RNA, 64 nt, hsa
uaauguaaauuuauuucuccaaaucgagagugauuuuuuaaaaauuuuuuaucuuuauaugguu

SEQ ID NO: 267702 - RNA, 64 nt, hsa
uguaaauuuuuaccuuguaaagucacaaaaauaguuuuuaaaggaaaaaguacaguauucuuuu

SEQ ID NO: 267703 - RNA, 64 nt, hsa
ucaaaacacaacucaacuaugaaucuucaauuuuuuuuuaaagcaaaacuauuuauugacuuua

SEQ ID NO: 267704 - RNA, 64 nt, hsa
guaaguaagcagccacugcaagcucugaaucaguuuuuuaaaaaaaagaaaaaaaaaaaaaagg

SEQ ID NO: 267705 - RNA, 64 nt, hsa
ugucuucaacaucugagucaccaagaaguaacacuuuuuaaacuuguuagaaaucccuggaggc

SEQ ID NO: 267706 - RNA, 64 nt, hsa
aucgcacuuuucaucuugguaauaucaaaacaacuuuuuaaaugaacugauugauauauguuau

SEQ ID NO: 267707 - RNA, 64 nt, hsa
uccugcuugggcuccaaauuucugaagaguaauauuuuuaaacuauagcuuacaaaauacauuc

SEQ ID NO: 267708 - RNA, 64 nt, hsa
uguaccagaaacauuuucuuuuauuguuacuugcuuuuuaaacuuuguuuagccacuuaaaauc

SEQ ID NO: 267709 - RNA, 64 nt, hsa
guuggucaaaugagggaacaucuggguuaugccuuuuuuaaaguaguuuucuuuaggaacuguc

SEQ ID NO: 267710 - RNA, 64 nt, hsa
ugccaccauuauaaauugccacaauuacuuuuauuuuuuaaagaaauuacaguguaguguuuau

SEQ ID NO: 267711 - RNA, 64 nt, hsa
aagaagacagggaaugcaaucaggaaggaaagacuuuuuaaaaaauaaaaacaaguaucucaug

SEQ ID NO: 267712 - RNA, 64 nt, hsa
cauccaacucaugacaagagauaccacuguuuguuuuuuaaaaaacauuuuucauuuuguuucu

SEQ ID NO: 267713 - RNA, 64 nt, hsa
cagaucuguccauguggaaaugcuuucauccaaauuuuuaaauuggugguuaccaaagaguuca

SEQ ID NO: 267714 - RNA, 64 nt, hsa
aaucuucaaggucugaaaugagaaacauacugacuuuuuaaaauuuuaacaguguacuucuuag

SEQ ID NO: 267715 - RNA, 64 nt, hsa
aucaaggagcacuacuggauucaacugccaaaauuuuuuaaagguuuuaggacuuacuauaccu

SEQ ID NO: 267716 - RNA, 64 nt, hsa
gaaguaacaagacaccuagcaacuauaggaaucauuuuuaaaaaucuuuaaggagacuuuuaac

SEQ ID NO: 267717 - RNA, 64 nt, hsa
aaacuuuuuuaaauauaaauguuaagaaaaauuuuuuuuaaaaaacacuucauuauguuuaggg

SEQ ID NO: 267718 - RNA, 64 nt, hsa
cuucuacagugcaaggauuuuuuuguacaaaacuuuuuuaaauauaaauguuaagaaaaauuuu

SEQ ID NO: 267719 - RNA, 64 nt, hsa
aaaaaaaauugaacacaaucucauugaggagcauuuuuuaaaaacuaaaaaaaaaaaaacuuug

SEQ ID NO: 267720 - RNA, 64 nt, hsa
uucauuuuaugaagauauuugcuuuaauaaugucuuuuuaaaaauacuggcaccaaaagaaaua

SEQ ID NO: 267721 - RNA, 64 nt, hsa
aaagaaaugggcuguuuugcccaaaguuuuauuuuuuuuaaacaaugauuaaauugaaugugua

SEQ ID NO: 267722 - RNA, 64 nt, hsa
ucuugugcaauaauuuacauguuguguauguuuuuuuuuaaacuuagacagcauguaugguaug

SEQ ID NO: 267723 - RNA, 64 nt, hsa
uccuauuacaaaacuguucugaauuuucuuuugguuuuuaaaaaacaaaacuuguugcuuagaa

SEQ ID NO: 267724 - RNA, 64 nt, hsa
uucugcucuggucauuugcauuaagaugaagaauuuuuuaaaacauuuauaauaaauaguagca

SEQ ID NO: 267725 - RNA, 64 nt, hsa
gcuccaaagagccaaaguaucaacuuacagaucguuuuuaaagcuuaaauuuaugaaccaccuu

SEQ ID NO: 267726 - RNA, 64 nt, hsa
caaauuuuuaagaaaagcaucaaaggguugauauuuuuuaaaguuuuuuuaguagcacuuucuc

SEQ ID NO: 267727 - RNA, 64 nt, hsa
uucuuuaggaauaacuuuuauauuuauuuaaaaauuuuuaaauuaugggauguuuuguuguugu

SEQ ID NO: 267728 - RNA, 64 nt, hsa
ccccuggcuauuuuauauuaauggggagaggggauuuuuaaaugucauaaauuugaagaguggu

SEQ ID NO: 267729 - RNA, 64 nt, hsa
uaugagccuccccauuaccccuaaaguagaacauuuuuuaaauuguguugccaccacuucuaaa

SEQ ID NO: 267730 - RNA, 64 nt, hsa
ugguuuuuauuuccuuguaucuguagucuuuuauuuuuuaaaugacugcugaaugacauauuuu

SEQ ID NO: 267731 - RNA, 64 nt, hsa
gaugugauuuauuuugaaauuuguuucuguuuuguuuuuaaaucaaacuguaaaacuuaaaacu

SEQ ID NO: 267732 - RNA, 64 nt, hsa
agaacacauugcagaaguaagacaaacauguauauuuuuaaauguucuaacauaagaccuguuc

SEQ ID NO: 267733 - RNA, 64 nt, hsa
augaaaagcccccauuuaaaaaaauaacaaacauuuuuuaaaaggccuccaauacucuuaugga

SEQ ID NO: 267734 - RNA, 64 nt, hsa
gacccccuagcaacguaguugacacagcuccagguuuuuaaauuacuaaaauaaguucaaguuu

SEQ ID NO: 267735 - RNA, 64 nt, hsa
uuccauuuuguugcuugguugguuuguugcuuuauuuuuaaaaggagaaguuuaacuuugcuau

SEQ ID NO: 267736 - RNA, 64 nt, hsa
ccaucuuuuucuuauggacuuuaagaccuuuauauuuuuaaagauauugauuuuuugcccaugc

SEQ ID NO: 267737 - RNA, 64 nt, hsa
gccaaugaaucccuaccagcaguaguuauuauccuuuuuaaaaaugcauugaaaauuugaaagg

SEQ ID NO: 267738 - RNA, 64 nt, hsa
uuuuaaagaaauguuuauacaauaauuuaaauauuuuuuaaaaccauaaaauaaauuuuuauaa

SEQ ID NO: 267739 - RNA, 64 nt, hsa
cuuagguuuuacucuuuucuuucuacagaccauauuuuuaaagaaauguuuauacaauaauuua

SEQ ID NO: 267740 - RNA, 64 nt, hsa
ccuguaaauguguuuuguccaguccuuagaguguuuuuuaaaaaauuguaaagucaagguuuuc

SEQ ID NO: 267741 - RNA, 64 nt, hsa
uucuggagaguuuguaaaacaaggacacuauguauuuuuaaagaguugguaaaucuuaccugua

SEQ ID NO: 267742 - RNA, 64 nt, hsa
ucucucuuccuccucagcgaaccacuaggcccccuuuuuaaaaacaccuuuagagccuaauuac

SEQ ID NO: 267743 - RNA, 64 nt, hsa
gcugagauggcgaaacccuguguguggggugcaguuuuuaaaaaucagagcgcucuagccacua

SEQ ID NO: 267744 - RNA, 64 nt, hsa
uugaccagagcacagauuacuuaugcuucuuaauuuuuuaaaaucuuaaauccucuguccaacu

SEQ ID NO: 267745 - RNA, 64 nt, hsa
uacucugcaaaguagccuuuaaaaaaauguaaauuuuuuaaaaaguccacagaggagaauuugc

SEQ ID NO: 267746 - RNA, 64 nt, hsa
ggggccacaggugugcaccacaacucucagcuaauuuuuaaaauuuuuuauagaggugggguuu

SEQ ID NO: 267747 - RNA, 64 nt, hsa
aaccgcuguuaguuugaaaugcuuuuuuuuuuuuuuuuuaaauggagauagggucuuaacucuu

SEQ ID NO: 267748 - RNA, 64 nt, hsa
uuauaacuguuauaaagcagaacuuuuguugcauuuuuuaaacuguugaagucacuguguaugu

SEQ ID NO: 267749 - RNA, 64 nt, hsa
uauaaucuauucauggaucuccacuuugauuuaauuuuuaaauguuuuaaucuccuuuacaaaa

SEQ ID NO: 267750 - RNA, 64 nt, hsa
ggaaacaaaucuucuguuauuuacaaaauaauaauuuuuaaaaaacauuuaaaaaaaauccaaa

SEQ ID NO: 267751 - RNA, 64 nt, hsa
aaaguuacguggaagcaagauuucuauauuuguuuuuuuaaaggaagcagucauucuuucuacu

SEQ ID NO: 267752 - RNA, 64 nt, hsa
acauauucagauugggaaaaacaauggacauuaguuuuuaaaaaguuacguggaagcaagauuu

SEQ ID NO: 267753 - RNA, 64 nt, hsa
uggaugauaaguguguuuuuagugguguguuguuuuuuuaaagaggugauucaaguaccguugc

SEQ ID NO: 267754 - RNA, 64 nt, hsa
augugaacacugcaaaaauguguuuaaauuaucuuuuuuaaaaccuauucaggauuauuagccu

SEQ ID NO: 267755 - RNA, 64 nt, hsa
auccaucaccaguggaguuuuuuuauuuguuauuuuuuuaaaaguuuaggugccuuugcggaug

SEQ ID NO: 267756 - RNA, 64 nt, hsa
cagcagagaaauaagaauaaaacuaaugaaggguuuuuuaaaagaacuaaauaaaacaaauaaa

SEQ ID NO: 267757 - RNA, 64 nt, hsa
caaauguagcacuagaggcaagaaaaggggugauuuuuuaaagauuuggcuauacuuaagauau

SEQ ID NO: 267758 - RNA, 64 nt, hsa
ucagauaaacauacaacuuccaaaaggcaucugauuuuuaaaaaauuaaaauuucugaaaacca

SEQ ID NO: 267759 - RNA, 64 nt, hsa
uaauaagguauaacaagcuuggcaaaguguuggcuuuuuaaaaaaaaauuuuuuuaaucucuag

SEQ ID NO: 267760 - RNA, 64 nt, hsa
uuacaugguuuuguuuaaaauuaccauuacuuguuuuuuaaaaacacaugaccacauauguaua

SEQ ID NO: 267761 - RNA, 64 nt, hsa
cacuugcuaucuauucugugugcugcagccugaguuuuuaaaaaacagaaaaugaggggccagg

SEQ ID NO: 267762 - RNA, 64 nt, hsa
gaaauaggaaacugaaacucuguggaauauaaacuuuuuaaaaauaauuucaucagguuuuuug

SEQ ID NO: 267763 - RNA, 64 nt, hsa
uaaauauuacaaaaaugauuguauuuaaagaaauuuuuuaaaauccagaaagucauuuaaaaua

SEQ ID NO: 267764 - RNA, 64 nt, hsa
aagaaugacuagccuuuuuauaacgauacaaaguuuuuuaaaaauacauaaaugucauaaaguu

SEQ ID NO: 267765 - RNA, 64 nt, hsa
guauguuaauaucugauacuguaucugggcugauuuuuuaaauaaaauagagucuggaaugcua

SEQ ID NO: 267766 - RNA, 64 nt, hsa
auagucucaaaucaaauacauacaaccuauguaauuuuuaaagcaaauauauaaugcaacaaug

SEQ ID NO: 267767 - RNA, 64 nt, hsa
uacaguagccaaggaauacaaacauaauugcauguuuuuaaaaauuccuuggaggcuggaaggg

SEQ ID NO: 267768 - RNA, 64 nt, hsa
aauuauuuuguauuuaugauuaauaaaaguucauuuuuuaaauuuguauuuuuauacaaccucc

SEQ ID NO: 267769 - RNA, 64 nt, hsa
gccacaauaccuuuuuaauacucaguguucuguuuuuuuaaaaacuugauauuccuguauggug

SEQ ID NO: 267770 - RNA, 64 nt, hsa
agauggcuucacugaagaaaaggcauuuuaagauuuuuuaaaaaucuugucagaagaucccaga

SEQ ID NO: 267771 - RNA, 64 nt, hsa
aucaagccucaguccccuucauauuacccucuccuuuuuaaaaauuacgugugcacagagaggu

SEQ ID NO: 267772 - RNA, 64 nt, hsa
uuuauuuuuuuucuuuucccucaauccuuuuuuauuuuuaaaaauaguucuuuuguaauguggu

SEQ ID NO: 267773 - RNA, 64 nt, hsa
cauuuuaauuuuguacaauaaccugcuagacacauuuuuaaaaugcaacauguguacuuaauuu

SEQ ID NO: 267774 - RNA, 64 nt, hsa
uccucuugacuccuugugauguggcaauaaauuuuuuuuaaaaaacugaaaauacuuaggaagg

SEQ ID NO: 267775 - RNA, 64 nt, hsa
aggguaccacccuauuaagcauuaauuucuucauuuuuuaaauggggacaaaaauaucugcuuu

SEQ ID NO: 267776 - RNA, 64 nt, hsa
acaaacuuuugcuuguaguuuuacuguacauuuauuuuuaaagaaaaagaaaacaaaagccaga

SEQ ID NO: 267777 - RNA, 64 nt, hsa
auaaacauacacacacacacacaccccuauguaguuuuuaaaacacuggcaaugacccacuccc

SEQ ID NO: 267778 - RNA, 64 nt, hsa
ggaagcaaccagcaaauuaacuaauuuaaguacauuuuuaaaaaaagagcuaagauaaagacug

SEQ ID NO: 267779 - RNA, 64 nt, hsa
uuuguuucuuucuuccucuucuuuuuuuuuuuuuuuuuuaaagcagaugguugaaacacccaug

SEQ ID NO: 267780 - RNA, 64 nt, hsa
cugucaaguacuuuuuuaaacuaguuuuuaggguuuuuuaaaacucucuguuguuuguaauauu

SEQ ID NO: 267781 - RNA, 64 nt, hsa
auccauggguauuaaaaggacacugucaaguacuuuuuuaaacuaguuuuuaggguuuuuuaaa

SEQ ID NO: 267782 - RNA, 64 nt, hsa
ucccaugaaagaauucaguuuguuaguaccuauauuuuuaaacuggugaaacugacccaaauau

SEQ ID NO: 267783 - RNA, 64 nt, hsa
uagggauauggaaguaaguggagaagggccuaccuuuuuaaaggacaaauauaaaaauagcaac

SEQ ID NO: 267784 - RNA, 64 nt, hsa
gaauggacaguagccacuuacaaacaaaucaacauuuuuaaaaagaaaauguaaagguguguuu

SEQ ID NO: 267785 - RNA, 64 nt, hsa
gaauauuuccuaguucauuugacccauuugauauuuuuuaaaccaugcucuggcauguugaaua

SEQ ID NO: 267786 - RNA, 64 nt, hsa
auaaugguaaaaccaugacgcaaagagagauuuuuuuuuaaagaagaaaaaaaaaaauucacac

SEQ ID NO: 267787 - RNA, 64 nt, hsa
cuuugugcuaucaaauggaauagaauacacuuauuuuuuaaacaaucccagaauacugugugua

SEQ ID NO: 267788 - RNA, 64 nt, hsa
uuaaggacuucuggauaacuauacuuuuacucuauuuuuaaagaucacaaaguaauuuuaaaug

SEQ ID NO: 267789 - RNA, 64 nt, hsa
gcuuccugcuugaaacccaauucuuauaugaaauuuuuuaaaagcagaaaccuagcagcccauc

SEQ ID NO: 267790 - RNA, 64 nt, hsa
gcgaacaaagagcgaaccaaagcgaugcuucgaauuuuuaaaacggaaucucugcacccaaaug

SEQ ID NO: 267791 - RNA, 64 nt, hsa
uauuuuuuauuauauauuuaguguuuuauagaauuuuuuaaaguuaacauauaauguagauauu

SEQ ID NO: 267792 - RNA, 64 nt, hsa
augauauuuaccagugaucuagcauauguaaucuuuuuuaaagguauuguuaauaaauauucug

SEQ ID NO: 267793 - RNA, 64 nt, hsa
gccaguuucaaagguuacuuguuuuuuuuuuuuuuuuuuaaagucagaauguuaacagcuguga

SEQ ID NO: 267794 - RNA, 64 nt, hsa
aaaccagcuucuguauucaaaucuuuccuucauuuuuuuaaauuuuuuuuuuggcagcgcuugu

SEQ ID NO: 267795 - RNA, 64 nt, hsa
cucuuccuucuuucugcaaggcagaggaauaauauuuuuaaagguuauuuuguuuuaguuuuaa

SEQ ID NO: 267796 - RNA, 64 nt, hsa
uuuuccacuuuuguucuacuccuucccuaauagcuuuuuaaaaaaaucuccccaguagagaaac

SEQ ID NO: 267797 - RNA, 64 nt, hsa
ugggcucauagugagaacccaucuauacaaaaaauuuuuaaaaauuagcauggcggcacacauc

SEQ ID NO: 267798 - RNA, 64 nt, hsa
agugugacuuuaucuucugggugguuugauaguguuuuuaaaaguaauauauaaugugggguga

SEQ ID NO: 267799 - RNA, 64 nt, hsa
ccuuuauuuuauuauuaacuaauuaacuaugagauuuuuaaaaaauggggccgcugaugugcaa

SEQ ID NO: 267800 - RNA, 64 nt, hsa
aagaacuuaaagaaauucacuacugcaguuuuuauuuuuaaaaaacaguaauugagauauugaa

SEQ ID NO: 267801 - RNA, 64 nt, hsa
auugaagacauuacaauuuaguuuguguggucuuuuuuuaaauugcuguaucguucagucucuu

SEQ ID NO: 267802 - RNA, 64 nt, hsa
uuuagguggacaaauuuaacaaguuuucuguuacuuuuuaaaaagaaaaaauccagaacauaag

SEQ ID NO: 267803 - RNA, 64 nt, hsa
guuugaagucucuuuauagacuuuuuauauauauuuuuuaaaacacucaucuagaugaggugcu

SEQ ID NO: 267804 - RNA, 64 nt, hsa
auauucagaaugcucacacugaaaaugccucaacuuuuuaaaguguaagaaaccaccaugagug

SEQ ID NO: 267805 - RNA, 64 nt, hsa
ugaagaaucuugcuacagccaaauggcaucucacuuuuuaaagacguuugcaauuauuaguuga

SEQ ID NO: 267806 - RNA, 64 nt, hsa
auuuacuuggaagagcaaagaaggaaaaauuauauuuuuaaagaaagagaauauucaggcuuua

SEQ ID NO: 267807 - RNA, 64 nt, hsa
uauucaggcuuuauuucugguaugaaguuuauauuuuuuaaaaaaauccuauauuaucacacca

SEQ ID NO: 267808 - RNA, 64 nt, hsa
uuaugggcuuacauaauauuccuuucauccauucuuuuuaaagaacggcuuaccuuuccuauuu

SEQ ID NO: 267809 - RNA, 64 nt, hsa
acggcuuaccuuuccuauuuauuuuuagggugauuuuuuaaaaagacuugugcaauacauuuug

SEQ ID NO: 267810 - RNA, 64 nt, hsa
aaacccuuggauauaaaagaaaucuguuuauugauuuuuaaaucuuuccuuuccaaaagcugga

SEQ ID NO: 267811 - RNA, 64 nt, hsa
agucuguaaccuggcaacauuuuacaacccuguauuuuuaaagauggcuuucuaauaaaaaauc

SEQ ID NO: 267812 - RNA, 64 nt, hsa
auagcaauuaauagcaaaaccuuuacauucuugguuuuuaaacuuuaccaugugucugaauuac

SEQ ID NO: 267813 - RNA, 64 nt, hsa
cacugcaccuggccuguaacaugauuugcugaaauuuuuaaaaaucuuaaauaauguacuguuu

SEQ ID NO: 267814 - RNA, 64 nt, hsa
gugaugauuaaagcauucucauugcacaguucuguuuuuaaauacagagucugaugccuccuau

SEQ ID NO: 267815 - RNA, 64 nt, hsa
uuucuuuucagcuuacacauguguucaaaguggauuuuuaaaaaguguuuuagcaauacuccuu

SEQ ID NO: 267816 - RNA, 64 nt, hsa
ucuuaguuaugcaucucauaaucagacuccaugcuuuuuaaagacagagauaauaucuucucua

SEQ ID NO: 267817 - RNA, 64 nt, hsa
aguauuuuguacauaccaguuguuaaauaaauaauuuuuaaaaucucagcucucacauugaauu

SEQ ID NO: 267818 - RNA, 64 nt, hsa
uauccauaugaugguucugcagccauugcaaacauuuuuaaagacaauuuaaugccauggggaa

SEQ ID NO: 267819 - RNA, 64 nt, hsa
acuaauuuuauaugcaagaaaaaaagcacaguauuuuuuaaaugcaaugaagacgugcuuauuu

SEQ ID NO: 267820 - RNA, 64 nt, hsa
uauuuggggaaaggucuuuuuugcuuaauuuuguuuuuuaaaacucugaugauugcuugagcaa

SEQ ID NO: 267821 - RNA, 64 nt, hsa
cgaauguuuauaagcuuuccauuuccuagguaauuuuuuaaaagccagucaaaacaaaaacuuu

SEQ ID NO: 267822 - RNA, 64 nt, hsa
auuccuucucuuuacuuuuuuuuucuuuuuucuuuuuuuaaagaaaugguagcauaauauacac

SEQ ID NO: 267823 - RNA, 64 nt, hsa
aagaaaugguagcauaauauacacaguuguccauuuuuuaaagacuaaaccaucucacagauug

SEQ ID NO: 267824 - RNA, 64 nt, hsa
caaaacuaaguucuuagauuuugggggauuuuuuuuuuuaaacgaugagaagggaauccgguua

SEQ ID NO: 267825 - RNA, 64 nt, hsa
aaaguugucaguaaaaccuuugacagaggauggauuuuuaaaccuguucagaguccugguuuaa

SEQ ID NO: 267826 - RNA, 64 nt, hsa
aaacaaagacagacuuguaguuuauuuuguauuuuuuuuaaauaaauacacuuuacauuaaaga

SEQ ID NO: 267827 - RNA, 64 nt, hsa
guaagcaauaauuugcuugcaauuuuucauguaauuuuuaaauuaguauguuaagauucugaau

SEQ ID NO: 267828 - RNA, 64 nt, hsa
uauuguucugaaaugcuuaacuucagaauuacauuuuuuaaaguaaauaauuguuuuaaaucua

SEQ ID NO: 267829 - RNA, 64 nt, hsa
cugggcauauuucuaauuggcuuuacuauuuuuauuuuuaaauuauguuuuacuguucauuuga

SEQ ID NO: 267830 - RNA, 64 nt, hsa
aacuucuuucaucaggaaaccuuauucaggaggguuuuuaaaaaguguuuaaaugucaaaugug

SEQ ID NO: 267831 - RNA, 64 nt, hsa
uaugauguuaguuuuccuuagcugauuuugaggguuuuuaaaaauaaagcaagguugacuaacc

SEQ ID NO: 267832 - RNA, 64 nt, hsa
gucauacauaggaugacaaaauucuuucugguuguuuuuaaacaauaaagcaauaagaacaaau

SEQ ID NO: 267833 - RNA, 64 nt, hsa
agguguuuugcaagagcuguauuuauauuacaguuuuuuaaaaacauuuucugaauuaucguaa

SEQ ID NO: 267834 - RNA, 64 nt, hsa
auuuaaaaggagaaaaaaaugcauguuuauaaacuuuuuaaauaaaaccagaccuuguaagugg

SEQ ID NO: 267835 - RNA, 64 nt, hsa
ggaugggugggugggguauuuuuuuguaauugcuuuuuuaaauauuaguuaauggauuaaauuu

SEQ ID NO: 267836 - RNA, 64 nt, hsa
agaugaaguuuguaguuguuuuaaguacuacacauuuuuaaauuguuagcuuccuuaaguauau

SEQ ID NO: 267837 - RNA, 64 nt, hsa
cuuucagauuuuuugaaccauccacuuacauauauuuuuaaaaaaugaaauccuuuuccuguuc

SEQ ID NO: 267838 - RNA, 64 nt, hsa
uagaauucuguauuggauauauaagagcaugaaauuuuuaaaaauacacuugugauuauaaaau

SEQ ID NO: 267839 - RNA, 64 nt, hsa
uuauaccugcuaucagcagcuagaaaacauuuuuuuuuuaaaucaaguauuuuguguuuggaau

SEQ ID NO: 267840 - RNA, 64 nt, hsa
uuuauaaccaaaauuuuaaaacuauuuuuauauuuuuuuaaaucuuuaaaaauuuuaauuacug

SEQ ID NO: 267841 - RNA, 64 nt, hsa
aaugagacuggaaauaccuuuuguaccuaaauguuuuuuaaauuaaucaaaauacauucuguga

SEQ ID NO: 267842 - RNA, 64 nt, hsa
uuuuuaauauuuaucucguuugggaguauacguguuuuuaaaauuuguguuuucuaucuguuua

SEQ ID NO: 267843 - RNA, 64 nt, hsa
gggguggguguaaaguuaaaaggaacaguuuccuuuuuuaaagaaugguauaagacuaucuuug

SEQ ID NO: 267844 - RNA, 64 nt, hsa
uaucuuuggagccgcuuuuuuuuucuuuuucauuuuuuuaaaagauugagugguacacuaauaa

SEQ ID NO: 267845 - RNA, 64 nt, hsa
uguacauauugcuuaaguauuuggcuguuuuuauuuuuuaaaagguauaaacaccaaaaaaaaa

SEQ ID NO: 267846 - RNA, 64 nt, hsa
guuuguuuuguauuuuuguauuguauaugaacuuuuuuuaaaugugacaguuaaacacaucuuu

SEQ ID NO: 267847 - RNA, 64 nt, hsa
uugaaauuugccagucucccugguguaaaauguuuuuuuaaagccuuuuuuccuccuuucggag

SEQ ID NO: 267848 - RNA, 64 nt, hsa
ggaucacaugguacguggcauuuguuguuauuguuuuuuaaagagauggaggcuggcucuguug

SEQ ID NO: 267849 - RNA, 64 nt, hsa
uuuguaauaaauuugacucauuaaaaaccuuuuuuuuuuaaaaaaaaaaaaaaagaaaaucuca

SEQ ID NO: 267850 - RNA, 64 nt, hsa
gugaacuuaucuuugcagcugaguacuuaaauucuuuuuaaaaagauacccuuuggauugauca

SEQ ID NO: 267851 - RNA, 64 nt, hsa
acuggcauugacauuauugguaaucaacuggcuuuuuuuaaaaaagguagcauuuuguugacag

SEQ ID NO: 267852 - RNA, 64 nt, hsa
cagugaaggacaaaaaucaugauuguggaagauauuuuuaaaaucugauuuugcagcgaucacu

SEQ ID NO: 267853 - RNA, 64 nt, hsa
cgugagccaccgcgccuggccagggacuauacucuuuuuaaaauagacauuuguggggcucaca

SEQ ID NO: 267854 - RNA, 64 nt, hsa
aaggacuauuacauacuucauuacuaggaaguucuuuuuaaaaugacacuuaaaacaaucacug

SEQ ID NO: 267855 - RNA, 64 nt, hsa
gguuucgccuuguugcccaggcugaauuuggguuuuuuuaaaaugagacuuucaguccuaauuu

SEQ ID NO: 267856 - RNA, 64 nt, hsa
ggaaauuuauagcuucaaauacuuauauacauauuuuuuaaaaguagcuuuacauaggaaggaa

SEQ ID NO: 267857 - RNA, 64 nt, hsa
guuuugucuguuacuaaggguagaagauuauugcuuuuuaaaggcuaaauauuguuugugggaa

SEQ ID NO: 267858 - RNA, 64 nt, hsa
ucauucccuuugacaagcuguagaacuggauucauuuuuaaaccauuuucaucaguuucaaaug

SEQ ID NO: 267859 - RNA, 64 nt, hsa
uuuucaucaguuucaaaugguaaauucugauugauuuuuaaaugcguuuuuggaagaacuuugc

SEQ ID NO: 267860 - RNA, 64 nt, hsa
uauauguuauguaaaguguguauauagaauuaguuuuuuaaaccuucuguuaguggcuuuuugc

SEQ ID NO: 267861 - RNA, 64 nt, hsa
aucauucuugcugcuuaagaugaaaagcauugguuuuuuaaaauuagagaauaaaauauguauu

SEQ ID NO: 267862 - RNA, 64 nt, hsa
ugauuaccagagaacuacuaaaaaaaccaacugcuuuuuaaauccuauuguguaguuaaagugu

SEQ ID NO: 267863 - RNA, 64 nt, hsa
aauuuuauuguauaugaugaacaaaacuuaaaauuuuuuaaauuuaauuuuuaaauacuguuuc

SEQ ID NO: 267864 - RNA, 64 nt, hsa
augaugaacaaaacuuaaaauuuuuuaaauuuaauuuuuaaauacuguuucagaguucuaaaaa

SEQ ID NO: 267865 - RNA, 64 nt, hsa
uuuaaauacuguuucagaguucuaaaaaggcaguuuuuuaaaaaacuuaaguugauaaaaacug

SEQ ID NO: 267866 - RNA, 64 nt, hsa
gauuuuaaacauggugugguauucuaaagccuuuuuuuuaaaaaaagagaucuuuuugagagaa

SEQ ID NO: 267867 - RNA, 64 nt, hsa
aaauuuucagguauuuagcuccccuuucauauuauuuuuaaauuuuuuaauuaccuguuguagg

SEQ ID NO: 267868 - RNA, 64 nt, hsa
ucucuucauuuuaagacuuuuaauacaaaugucauuuuuaaagaaacaaacccaaaacuauugu

SEQ ID NO: 267869 - RNA, 64 nt, hsa
ucucagugacaaguuggaugacacuacucccaacuuuuuaaauuuggagaaaaccaucaagguc

SEQ ID NO: 267870 - RNA, 64 nt, hsa
agcaaaagcugacuuuuaaacuugaccccugcuguuuuuaaacagcuuuuccuuuuggucucug

SEQ ID NO: 267871 - RNA, 64 nt, hsa
cauuggacauuaauagggcacuuuucagacccauuuuuuaaagugcuagaaaaugcuuuuuuua

SEQ ID NO: 267872 - RNA, 64 nt, hsa
ucagacccauuuuuuaaagugcuagaaaaugcuuuuuuuaaaaaaaaaauacaaguuuuaaaau

SEQ ID NO: 267873 - RNA, 64 nt, hsa
aucaugucaaaauuuaguugaacugguuuuucaguuuuuaaaaggccuacagaugaguaaugaa

SEQ ID NO: 267874 - RNA, 64 nt, hsa
ugagguuuuaaccauuauucaggguggucuuuuguuuuuaaaucuuuuuuuaacuaauaagauu

SEQ ID NO: 267875 - RNA, 64 nt, hsa
uccaaaugaaugaaaauguauguuucuuuguacuuuuuuaaaaaaaucagcuuaguaacaauac

SEQ ID NO: 267876 - RNA, 64 nt, hsa
uuauauuucuaaugcaaacuuaacaauuguguacuuuuuaaaagcugcaauauguguuggaaaa

SEQ ID NO: 267877 - RNA, 64 nt, hsa
acaagauacuuuuuuuuuuuuuuuuuuuuuuuuuuuuuuaaauagggccucacucuguugcuca

SEQ ID NO: 267878 - RNA, 64 nt, hsa
aaucguacauuuucauaugcuucaaacuaacacauuuuuaaagcuuucccccacuuuucucucu

SEQ ID NO: 267879 - RNA, 64 nt, hsa
cauuuuaauacacacauuuauucagauacuccccuuuuuaaagcccuuuuguuuuuugauuuau

SEQ ID NO: 267880 - RNA, 64 nt, hsa
ugcaaaacuaggaaaagguuaaacuggauuuuuuuuuuuaaaaaaaagaaaaaaaaagaagaaa

SEQ ID NO: 267881 - RNA, 64 nt, hsa
uguaguauuauuaaucuucugacauuuucuuauguuuuuaaaaagauaagagcaucuagugcau

SEQ ID NO: 267882 - RNA, 64 nt, hsa
cuuuguccucaaagaaauuguugaaaaagaaaacuuuuuaaagagauuuuuugcauauucucug

SEQ ID NO: 267883 - RNA, 64 nt, hsa
ucuuggaugggaagaauugagaaaacucugagcauuuuuaaaaguuuguuuacaauuccacaag

SEQ ID NO: 267884 - RNA, 64 nt, hsa
uuuugacaaguauaaagcuauuauuacauuguauuuuuuaaauguaaauauagaaagaacauuu

SEQ ID NO: 267885 - RNA, 64 nt, hsa
cacaacuuaugaaaucugccuuuaacaaguaacuuuuuuaaauuauaaaauuuuauuggcauug

SEQ ID NO: 267886 - RNA, 64 nt, hsa
caguuuuccuuccuuaaccaugggugcuaguaacuuuuuaaaacucaagacaagauuaguuuuu

SEQ ID NO: 267887 - RNA, 64 nt, hsa
ggaagaaaagauuugguuuucauggcagucuguuuuuuuaaaaaaaaauuuuugagccacuauc

SEQ ID NO: 267888 - RNA, 64 nt, hsa
aggacuacaggcauguggcaccaugcccgcuaaguuuuuaaauuucuuguagagaugagaucuc

SEQ ID NO: 267889 - RNA, 64 nt, hsa
caaauaagcugauuuuaaugacguuuucaacugguuuuuaaauauucaauauuggucuguguuu

SEQ ID NO: 267890 - RNA, 64 nt, hsa
gugauagaaaaguugccaguuugggguuaaagcauuuuuaaagcugcauguuccuuguaaucaa

SEQ ID NO: 267891 - RNA, 64 nt, hsa
aaaaaacuuuuuggugcuccaguguagggcuaucuuuuuaaaaaaugucaacaaagggaaaaua

SEQ ID NO: 267892 - RNA, 64 nt, hsa
accuugccuuagaaacacauaaauuaugagauuuuuuuuaaaaguuguuaccaaauacacauuu

SEQ ID NO: 267893 - RNA, 64 nt, hsa
uuauaacauaaccucagaguaucuuuaccaaagguuuuuaaaguaaaucucuuuuuaagauaga

SEQ ID NO: 267894 - RNA, 64 nt, hsa
cauugucuaucccuguuuuuauaugucuccauucuuuuuaaaaucuuaacauauggagcagccu

SEQ ID NO: 267895 - RNA, 64 nt, hsa
uacaauauuaaaaaccacuggaacucuuguccaguuuuuaaauuauguuuuuacuggaauguuu

SEQ ID NO: 267896 - RNA, 64 nt, hsa
auuuagagaacaagaacaaaccaugucucaaauuuuuuuaaaaaaaauuaaugguuuuaaauau

SEQ ID NO: 267897 - RNA, 64 nt, hsa
agaaauauacuuugguuaauuuugaaaugugucauuuuuaaacaaucuuaaaaguaauacagaa

SEQ ID NO: 267898 - RNA, 64 nt, hsa
uuacaggcgugagccacugcaccuggccucauguuuuuuaaauaauugccuuuuauauuuaccc

SEQ ID NO: 267899 - RNA, 64 nt, hsa
aaauaacucuuauuuuuauuuuugaagguuuuuuuuuuuaaaaaaaaaaacguauaaaauaaug

SEQ ID NO: 267900 - RNA, 64 nt, hsa
uuguaauccuuguucaguucuuaaguuucgguuuuuuuuaaaaacaggaugcaacuuaaacuuu

SEQ ID NO: 267901 - RNA, 64 nt, hsa
cccuggugucuccgacucaucaauucucgggucuuuuuuaaaagccaggcuccccaaagcacuc

SEQ ID NO: 267902 - RNA, 64 nt, hsa
agagagagcaaauacagcaaucuagaguuuagccuuuuuaaaaaugugacuuuaacccgcccac

SEQ ID NO: 267903 - RNA, 64 nt, hsa
agauauaaaauucaguuuaaaaagaacaugcuauuuuuuaaaugccaucacauaaacaaaguga

SEQ ID NO: 267904 - RNA, 64 nt, hsa
ggccacagagcaagacugucucaagaaaaaaaauuuuuuaaauaaguuuaauuauaaagugaag

SEQ ID NO: 267905 - RNA, 64 nt, hsa
uaguaauuaggauaacuaaaauucugggccuaauuuuuuaaagaauccaagacaaacuaaacuu

SEQ ID NO: 267906 - RNA, 64 nt, hsa
augauuucuccagaaauuuaccacaaaagcaaaauuuuuaaaacugcauuuuuaaucaguggaa

SEQ ID NO: 267907 - RNA, 64 nt, hsa
uguuuaaaagcaaauacugauuuucaaaaaaauguuuuuaaaaaccuauuuugaaaggucagaa

SEQ ID NO: 267908 - RNA, 64 nt, hsa
agacugaaagaaacuaagauuuaucugcaaggauuuuuuaaaaauuggcauuuuaaguguuuaa

SEQ ID NO: 267909 - RNA, 64 nt, hsa
aaacauaguuggaaauguaaucauccaaagaucauuuuuaaaaugaaauuuaauuagcacauau

SEQ ID NO: 267910 - RNA, 64 nt, hsa
gacagugacagauauaauuuacuacauauauugauuuuuaaauaaaguugccuuaaauaagugu

SEQ ID NO: 267911 - RNA, 64 nt, hsa
uaauuauuuccaaagaccccaguauuugcugcuauuuuuaaaacuccccugauguaccugaaca

SEQ ID NO: 267912 - RNA, 64 nt, hsa
uuuauuuuguguauuaguuuuugcuuuucugagcuuuuuaaagucuaacaaaucuuuuuaguca

SEQ ID NO: 267913 - RNA, 64 nt, hsa
auaaugauaguuuuuaacuuuuauguuuaaauuuuuuuuaaaucuuaaaaccuucauaucuagg

SEQ ID NO: 267914 - RNA, 64 nt, hsa
uuguaugucaugcuguuuaugugugacuaccggguuuuuaaaaguagugucuggaguuuguaau

SEQ ID NO: 267915 - RNA, 64 nt, hsa
uuuuuuaucucucuugaugucagauuuuauagucuuuuuaaauaaauccauuuaauuaaaacgu

SEQ ID NO: 267916 - RNA, 64 nt, hsa
aauggcaaauucaauaaacucaaauuuaaaauaauuuuuaaauuaacaguuaugauaaauuuua

SEQ ID NO: 267917 - RNA, 64 nt, hsa
cgugauuauauucaucuacuuagaaauuguuuuauuuuuaaauuaauuugcuuagcuguuuguu

SEQ ID NO: 267918 - RNA, 64 nt, hsa
uggagauuuuggugggaggaggagaaaacaauuguuuuuaaaucacacagcucaacgguugaua

SEQ ID NO: 267919 - RNA, 64 nt, hsa
cacaaaguaggccagauaaguuaaaaaaaauuuuuuuuuaaauaauaauugaaacuuaucucaa

SEQ ID NO: 267920 - RNA, 64 nt, hsa
aggcaccucuucccuucaauaucuguucuucguauuuuuaaaaaaauuuguuuuagacugccuu

SEQ ID NO: 267921 - RNA, 64 nt, hsa
uaaguaauucuguaacugcauggcagucuuuuuuuuuuuaaauaaauauaguuguuacuggucc

SEQ ID NO: 267922 - RNA, 64 nt, hsa
uguuuugucuaaccaucaaaauguuugagacuuuuuuuuaaacauuucugaguucgaagguaau

SEQ ID NO: 267923 - RNA, 64 nt, hsa
ggcagcaugggacugaaacaugagaaugccaccuuuuuuaaaacuuaguuuagugacaaaguca

SEQ ID NO: 267924 - RNA, 64 nt, hsa
auguuauuuuacauuuuauguucaauaagaacacuuuuuaaaagacguauauucaacauaaaau

SEQ ID NO: 267925 - RNA, 64 nt, hsa
aaagagaguuauuacaaauaaauaugucucuuuauuuuuaaaaaugaaaucuuaauucauuuac

SEQ ID NO: 267926 - RNA, 64 nt, hsa
cguccuugggaucccagaucacucuuuuuuuuuuuuuuuaaaaggggcagccccuugauggcuc

SEQ ID NO: 267927 - RNA, 64 nt, hsa
acacugcucuuccucaccugucacauaaagcauuuuuuuaaaaagucagcugcuccaaaaucau

SEQ ID NO: 267928 - RNA, 64 nt, hsa
uuuuuuggcccaauguugaagauguagaacuuuguuuuuaaauaauguuuuuauaauuucauuc

SEQ ID NO: 267929 - RNA, 64 nt, hsa
ucgccagggaucuuuucaaaacugguaguaguuauuuuuaaaaaucauguuugacaucuuucua

SEQ ID NO: 267930 - RNA, 64 nt, hsa
uuacuaaaaucuaaauaaugauagauauuuuaaguuuuuaaauugaguaguucugaguaauccu

SEQ ID NO: 267931 - RNA, 64 nt, hsa
uguauuuggaaauaaagucagauggaaaauucauuuuuuaaauucccguuuugucacuuuuucu

SEQ ID NO: 267932 - RNA, 64 nt, hsa
cuaauacugucauccucaaagaaaguguauugguuuuuuaaaaaagaaaguguauuuggaaaua

SEQ ID NO: 267933 - RNA, 64 nt, hsa
auaucagugcuucauugucauuguguuuuuaaacuuuuuaaaauuaaaacaguucauuuugggg

SEQ ID NO: 267934 - RNA, 64 nt, hsa
uccuaaggcauaucagugcuucauugucauuguguuuuuaaacuuuuuaaaauuaaaacaguuc

SEQ ID NO: 267935 - RNA, 64 nt, hsa
gaaauguggacaucucuuguucagcagauggcaguuuuuaaaaaauaaagguugugaggaaaag

SEQ ID NO: 267936 - RNA, 64 nt, hsa
gucaacuuucauuugaaaguggguuucaauuuacuuuuuaaacaguguuuaugacgagaccuca

SEQ ID NO: 267937 - RNA, 64 nt, hsa
gaagucuugcauugaauuuagucauuauuauuacuuuuuaaaauguuggugcaauuaacucugg

SEQ ID NO: 267938 - RNA, 64 nt, hsa
ccacguguaugcaagugggagaugaaaaccugcauuuuuaaaggacaaacagugaauuuaagca

SEQ ID NO: 267939 - RNA, 64 nt, hsa
ucuguaaaugaagggucauuucucuuuuuuuuuuuuuuuaaagaaaaugugucugcaacaugga

SEQ ID NO: 267940 - RNA, 64 nt, hsa
gucaccucugggccagguuggaaaagaaaucaauuuuuuaaaccacuaaugcuugccaagaaau

SEQ ID NO: 267941 - RNA, 64 nt, hsa
gguauuaauaugacauuugucauugucacugauuuuuuuaaaaaagcaaugcacauguugguug

SEQ ID NO: 267942 - RNA, 64 nt, hsa
uagaauuuauuuucuacaaagugguaguaauuuuuuuuuaaauugcaaauguaauuuuugccaa

SEQ ID NO: 267943 - RNA, 64 nt, hsa
uaaauguuuuauuguuacuuuuuuaaaaugaauuuuuuuaaaacaaucuagccaucaucaaggu

SEQ ID NO: 267944 - RNA, 64 nt, hsa
uuuacuuuucaucuguaaauguuuuauuguuacuuuuuuaaaaugaauuuuuuuaaaacaaucu

SEQ ID NO: 267945 - RNA, 64 nt, hsa
aauggaguaacaaauuacagaauagcuaaauaauuuuuuaaaaauauuuuacaguuguaaaaaa

SEQ ID NO: 267946 - RNA, 64 nt, hsa
ugaguagucugauuuagagacuaguuacuucuauuuuuuaaaauaauggaguaacaaauuacag

SEQ ID NO: 267947 - RNA, 64 nt, hsa
guuggauagguggggaaaucugaaguggguacauuuuuuaaauuuugcugugugggucacacaa

SEQ ID NO: 267948 - RNA, 64 nt, hsa
cagucuuugauuauuuugugguccuuuccugggauuuuuaaaagguccuuugucaaggaaaaaa

SEQ ID NO: 267949 - RNA, 64 nt, hsa
uggaugaugggaaguuugagaccgcugcauuuuguuuuuaaauuaugcaccuucugauaacccc

SEQ ID NO: 267950 - RNA, 64 nt, hsa
agcaagaccccauccuuuaaaaaauuuuagaacuuuuuuaaaaucaaagugcagauugcuugua

SEQ ID NO: 267951 - RNA, 64 nt, hsa
gugugaauaauguaaguauuuuacagcauguugauuuuuaaauuaacguaguaaaugcuguaaa

SEQ ID NO: 267952 - RNA, 64 nt, hsa
cugugcaacaaaagauuagaacauguuaaagggauuuuuaaauaaaguugcaaagaguacaaau

SEQ ID NO: 267953 - RNA, 64 nt, hsa
cauuauaaaacagggggaaagcagacugacccucuuuuuaaaaguuuacccccucuucaacuga

SEQ ID NO: 267954 - RNA, 64 nt, hsa
ucugcaaagccagauugcucucauugcuuuuauauuuuuaaauuguagcuuuuagagaccuaug

SEQ ID NO: 267955 - RNA, 64 nt, hsa
uuugaaacaaaaaauuuuaccugugcaaaauaguuuuuuaaaaauuauacauguagcucaacuu

SEQ ID NO: 267956 - RNA, 64 nt, hsa
ugcagcucaagcaugcaguaugaauacuguguauuuuuuaaaaaaauaauuuaguaucaaggcu

SEQ ID NO: 267957 - RNA, 64 nt, hsa
augaaaacuaaguuauauuaauucauauguuugauuuuuaaaucccaccuccucaagcuaucca

SEQ ID NO: 267958 - RNA, 64 nt, hsa
auuacaguuccacuaaauuguugaagauaaauuauuuuuaaagguuaugaaaacuaaguuauau

SEQ ID NO: 267959 - RNA, 64 nt, hsa
uaucuauaugaggaacccauaaaugaauagcuaauuuuuaaaaugccauuaaaaugcaugaaau

SEQ ID NO: 267960 - RNA, 64 nt, hsa
aagcauuucaauaggaugcauagguauauuacguuuuuuaaaugcuuuagaucugugauucuug

SEQ ID NO: 267961 - RNA, 64 nt, hsa
uucaggaauagauuuauacaccauuauuguuuuauuuuuaaauuuucauucacucuucuguuug
